United States Patent 7,655,785 (BIOINFORMATICALLY DETECTABLE GROUP OF NOVEL REGULATORY OLIGONUCLEOTIDES AND USES THEREOF) - sequence listing, part 49

SEQ ID NO: 2030618 - RNA, 20 nt, Homo sapiens
ggcugccgcagggcacugaa

SEQ ID NO: 2030619 - RNA, 17 nt, Homo sapiens
ccugaccucaggugauu

SEQ ID NO: 2030620 - RNA, 15 nt, Homo sapiens
cccugcccuggucca

SEQ ID NO: 2030621 - RNA, 16 nt, Homo sapiens
accucccauuacuuug

SEQ ID NO: 2030622 - RNA, 22 nt, Homo sapiens
agauuauuaucuauuaucucaa

SEQ ID NO: 2030623 - RNA, 18 nt, Homo sapiens
augcaucuuccacuggaa

SEQ ID NO: 2030624 - RNA, 17 nt, Homo sapiens
ucggugcagaaacuacc

SEQ ID NO: 2030625 - RNA, 21 nt, Homo sapiens
ucuuuaaagcaggauuucuca

SEQ ID NO: 2030626 - RNA, 16 nt, Homo sapiens
ggaguccucuagagag

SEQ ID NO: 2030627 - RNA, 14 nt, Homo sapiens
agagacaagacuuc

SEQ ID NO: 2030628 - RNA, 23 nt, Homo sapiens
uucuuuccucuuccccuugcccu

SEQ ID NO: 2030629 - RNA, 17 nt, Homo sapiens
cuuuuuccuuagcuuaa

SEQ ID NO: 2030630 - RNA, 20 nt, Homo sapiens
acucuuaagaagacugcauu

SEQ ID NO: 2030631 - RNA, 15 nt, Homo sapiens
guaccccacugggcc

SEQ ID NO: 2030632 - RNA, 16 nt, Homo sapiens
uuuguuucauauauac

SEQ ID NO: 2030633 - RNA, 20 nt, Homo sapiens
auuuuauuauguaaauccca

SEQ ID NO: 2030634 - RNA, 12 nt, Homo sapiens
uuacacugaguu

SEQ ID NO: 2030635 - RNA, 14 nt, Homo sapiens
agggugagugcaag

SEQ ID NO: 2030636 - RNA, 16 nt, Homo sapiens
ugcuguucuucacuuc

SEQ ID NO: 2030637 - RNA, 20 nt, Homo sapiens
cuaauaaauauacuaugaaa

SEQ ID NO: 2030638 - RNA, 20 nt, Homo sapiens
agagccuucagaaugcuccu

SEQ ID NO: 2030639 - RNA, 15 nt, Homo sapiens
ugcuauuucaucugg

SEQ ID NO: 2030640 - RNA, 14 nt, Homo sapiens
uuuauuaauauaua

SEQ ID NO: 2030641 - RNA, 13 nt, Homo sapiens
cuuuugcauuucc

SEQ ID NO: 2030642 - RNA, 15 nt, Homo sapiens
aaugcucuggucuau

SEQ ID NO: 2030643 - RNA, 20 nt, Homo sapiens
ugcuaaggcagcugauccag

SEQ ID NO: 2030644 - RNA, 17 nt, Homo sapiens
agcccuuccuaccucug

SEQ ID NO: 2030645 - RNA, 20 nt, Homo sapiens
agaugucccccaggggccca

SEQ ID NO: 2030646 - RNA, 19 nt, Homo sapiens
ccucuuaaaugagaaagca

SEQ ID NO: 2030647 - RNA, 11 nt, Homo sapiens
uuugaacacaa

SEQ ID NO: 2030648 - RNA, 21 nt, Homo sapiens
caaaaaaauuaaaauggaugc

SEQ ID NO: 2030649 - RNA, 23 nt, Homo sapiens
aaauacggaaguaaaccugaaca

SEQ ID NO: 2030650 - RNA, 11 nt, Homo sapiens
uauauaaacug

SEQ ID NO: 2030651 - RNA, 17 nt, Homo sapiens
ugucaaaugugucucac

SEQ ID NO: 2030652 - RNA, 20 nt, Homo sapiens
gccacuggaggaagcuguuu

SEQ ID NO: 2030653 - RNA, 13 nt, Homo sapiens
cauuuuguggaau

SEQ ID NO: 2030654 - RNA, 19 nt, Homo sapiens
aucagcaaaaaaguacuua

SEQ ID NO: 2030655 - RNA, 22 nt, Homo sapiens
gucacccaggcuggagugcaga

SEQ ID NO: 2030656 - RNA, 19 nt, Homo sapiens
ccugauuuaauaugcaaag

SEQ ID NO: 2030657 - RNA, 15 nt, Homo sapiens
aauauguauucugua

SEQ ID NO: 2030658 - RNA, 20 nt, Homo sapiens
auauuaacuuuuaaugguga

SEQ ID NO: 2030659 - RNA, 18 nt, Homo sapiens
aagaugggagguggaagc

SEQ ID NO: 2030660 - RNA, 21 nt, Homo sapiens
cauguugggaaaaacuggcuu

SEQ ID NO: 2030661 - RNA, 15 nt, Homo sapiens
ccuugucugcacugu

SEQ ID NO: 2030662 - RNA, 16 nt, Homo sapiens
ccgagagcugggacuc

SEQ ID NO: 2030663 - RNA, 12 nt, Homo sapiens
uaugaaaacuga

SEQ ID NO: 2030664 - RNA, 19 nt, Homo sapiens
ucaugcgaugacacuugua

SEQ ID NO: 2030665 - RNA, 23 nt, Homo sapiens
uuuggccaguagcuaaagugcaa

SEQ ID NO: 2030666 - RNA, 16 nt, Homo sapiens
gaguacaaggucauca

SEQ ID NO: 2030667 - RNA, 17 nt, Homo sapiens
aaucuuucuucucgccu

SEQ ID NO: 2030668 - RNA, 20 nt, Homo sapiens
ucccuggugucguauuuugc

SEQ ID NO: 2030669 - RNA, 17 nt, Homo sapiens
aucaaaugguuauuugu

SEQ ID NO: 2030670 - RNA, 14 nt, Homo sapiens
cauuugcucuucag

SEQ ID NO: 2030671 - RNA, 13 nt, Homo sapiens
caaauaauagcaa

SEQ ID NO: 2030672 - RNA, 12 nt, Homo sapiens
ucuucacugcca

SEQ ID NO: 2030673 - RNA, 14 nt, Homo sapiens
cuugaaccccaaau

SEQ ID NO: 2030674 - RNA, 22 nt, Homo sapiens
agggaagguucuucaugaucca

SEQ ID NO: 2030675 - RNA, 20 nt, Homo sapiens
acugaugugugaagugagaa

SEQ ID NO: 2030676 - RNA, 15 nt, Homo sapiens
augauugcugacuca

SEQ ID NO: 2030677 - RNA, 21 nt, Homo sapiens
uuaaauaauguacuuuuggcu

SEQ ID NO: 2030678 - RNA, 22 nt, Homo sapiens
ucaaagcccccacuucucucca

SEQ ID NO: 2030679 - RNA, 19 nt, Homo sapiens
cagaggaucaccagugcau

SEQ ID NO: 2030680 - RNA, 23 nt, Homo sapiens
gaaauacguuaggaggacaaaag

SEQ ID NO: 2030681 - RNA, 15 nt, Homo sapiens
ugcauguaugacuua

SEQ ID NO: 2030682 - RNA, 14 nt, Homo sapiens
aaccugucaugugc

SEQ ID NO: 2030683 - RNA, 20 nt, Homo sapiens
aacaccaggagagcuucucc

SEQ ID NO: 2030684 - RNA, 15 nt, Homo sapiens
cuccauuacuaaaga

SEQ ID NO: 2030685 - RNA, 15 nt, Homo sapiens
aggcuaccucaagac

SEQ ID NO: 2030686 - RNA, 14 nt, Homo sapiens
cagcuccuuucaug

SEQ ID NO: 2030687 - RNA, 22 nt, Homo sapiens
uacaacugugcauuacaaaguu

SEQ ID NO: 2030688 - RNA, 16 nt, Homo sapiens
cacugcccaaagccau

SEQ ID NO: 2030689 - RNA, 23 nt, Homo sapiens
agaauuacuuguguuacuugcca

SEQ ID NO: 2030690 - RNA, 12 nt, Homo sapiens
acacacagugau

SEQ ID NO: 2030691 - RNA, 12 nt, Homo sapiens
ucacacagagau

SEQ ID NO: 2030692 - RNA, 19 nt, Homo sapiens
aaugacuaaaaaacaaaga

SEQ ID NO: 2030693 - RNA, 22 nt, Homo sapiens
uaaauuauuuauuuauggagga

SEQ ID NO: 2030694 - RNA, 13 nt, Homo sapiens
guacucugugaaa

SEQ ID NO: 2030695 - RNA, 15 nt, Homo sapiens
cuggcuuuuugcacg

SEQ ID NO: 2030696 - RNA, 14 nt, Homo sapiens
uacuugucauauca

SEQ ID NO: 2030697 - RNA, 17 nt, Homo sapiens
aaucccuggcaaaggga

SEQ ID NO: 2030698 - RNA, 21 nt, Homo sapiens
gaguacaauggcgugaucuca

SEQ ID NO: 2030699 - RNA, 20 nt, Homo sapiens
agauacauuuuuagaaauca

SEQ ID NO: 2030700 - RNA, 19 nt, Homo sapiens
ucacugaguggcuugugau

SEQ ID NO: 2030701 - RNA, 18 nt, Homo sapiens
uugccaaagagaaacaaa

SEQ ID NO: 2030702 - RNA, 14 nt, Homo sapiens
cucuuauuacuguu

SEQ ID NO: 2030703 - RNA, 22 nt, Homo sapiens
cauucaugccaaguaucuuucc

SEQ ID NO: 2030704 - RNA, 20 nt, Homo sapiens
agaaccuggaaaaauuccag

SEQ ID NO: 2030705 - RNA, 20 nt, Homo sapiens
gcaauuguuacaaguguucu

SEQ ID NO: 2030706 - RNA, 12 nt, Homo sapiens
uacacgggacca

SEQ ID NO: 2030707 - RNA, 17 nt, Homo sapiens
aagaaaucuugcuucag

SEQ ID NO: 2030708 - RNA, 17 nt, Homo sapiens
ggccucccccgugacag

SEQ ID NO: 2030709 - RNA, 22 nt, Homo sapiens
uacagaugaaccaagugucuaa

SEQ ID NO: 2030710 - RNA, 11 nt, Homo sapiens
auuugcauuac

SEQ ID NO: 2030711 - RNA, 18 nt, Homo sapiens
ccauauacucuucaagga

SEQ ID NO: 2030712 - RNA, 18 nt, Homo sapiens
acuucugcuuuaauggcu

SEQ ID NO: 2030713 - RNA, 13 nt, Homo sapiens
caugaugucuacc

SEQ ID NO: 2030714 - RNA, 24 nt, Homo sapiens
uggcuggauuuguauuacacacag

SEQ ID NO: 2030715 - RNA, 22 nt, Homo sapiens
cuuaauagcuauacauuaaucc

SEQ ID NO: 2030716 - RNA, 20 nt, Homo sapiens
aaucuccauuucugcucaga

SEQ ID NO: 2030717 - RNA, 16 nt, Homo sapiens
auaucugaaccaagau

SEQ ID NO: 2030718 - RNA, 21 nt, Homo sapiens
ugaaauagguguuaccuucuc

SEQ ID NO: 2030719 - RNA, 22 nt, Homo sapiens
aguuacugaaggugauggaggu

SEQ ID NO: 2030720 - RNA, 11 nt, Homo sapiens
uacaaacucau

SEQ ID NO: 2030721 - RNA, 17 nt, Homo sapiens
guucccuugaaagggaa

SEQ ID NO: 2030722 - RNA, 19 nt, Homo sapiens
cagcccagacauccuguga

SEQ ID NO: 2030723 - RNA, 23 nt, Homo sapiens
gaaauauaggauagacacuggac

SEQ ID NO: 2030724 - RNA, 16 nt, Homo sapiens
aaguucaacuuccaaa

SEQ ID NO: 2030725 - RNA, 20 nt, Homo sapiens
uuuggagauagucucauucu

SEQ ID NO: 2030726 - RNA, 20 nt, Homo sapiens
ucuggcaucuuagaccucca

SEQ ID NO: 2030727 - RNA, 13 nt, Homo sapiens
auaaaaaggaaua

SEQ ID NO: 2030728 - RNA, 13 nt, Homo sapiens
guaaaaagaaaua

SEQ ID NO: 2030729 - RNA, 21 nt, Homo sapiens
auuaccucaaauuccuaauaa

SEQ ID NO: 2030730 - RNA, 22 nt, Homo sapiens
agaaguccauggaguuaucuaa

SEQ ID NO: 2030731 - RNA, 19 nt, Homo sapiens
aguguauagaaaaaccaaa

SEQ ID NO: 2030732 - RNA, 16 nt, Homo sapiens
ccuuccacgucuuccu

SEQ ID NO: 2030733 - RNA, 14 nt, Homo sapiens
aucucucuuuacau

SEQ ID NO: 2030734 - RNA, 19 nt, Homo sapiens
accagcgcccgcugggcug

SEQ ID NO: 2030735 - RNA, 15 nt, Homo sapiens
aucaccucucuucag

SEQ ID NO: 2030736 - RNA, 20 nt, Homo sapiens
cccuugaaaacucucaguca

SEQ ID NO: 2030737 - RNA, 16 nt, Homo sapiens
gauagugaaacagcuu

SEQ ID NO: 2030738 - RNA, 16 nt, Homo sapiens
cacaauguauacuuca

SEQ ID NO: 2030739 - RNA, 15 nt, Homo sapiens
aguauuuugaugaag

SEQ ID NO: 2030740 - RNA, 15 nt, Homo sapiens
uaguuuuacuuuuaa

SEQ ID NO: 2030741 - RNA, 13 nt, Homo sapiens
aguaaaaccaaag

SEQ ID NO: 2030742 - RNA, 21 nt, Homo sapiens
uugggaaaaaaacuuggcacu

SEQ ID NO: 2030743 - RNA, 15 nt, Homo sapiens
ugggcugggcaguau

SEQ ID NO: 2030744 - RNA, 14 nt, Homo sapiens
aagagcuggaugca

SEQ ID NO: 2030745 - RNA, 16 nt, Homo sapiens
gcaauagcaguuauaa

SEQ ID NO: 2030746 - RNA, 16 nt, Homo sapiens
ugagaugugagccuug

SEQ ID NO: 2030747 - RNA, 14 nt, Homo sapiens
ucucauuacagauu

SEQ ID NO: 2030748 - RNA, 19 nt, Homo sapiens
uaaauugacccuagccaga

SEQ ID NO: 2030749 - RNA, 22 nt, Homo sapiens
gucagaacccugccauggaacu

SEQ ID NO: 2030750 - RNA, 17 nt, Homo sapiens
cuguuaucaauucacau

SEQ ID NO: 2030751 - RNA, 16 nt, Homo sapiens
accgugggucaugcag

SEQ ID NO: 2030752 - RNA, 15 nt, Homo sapiens
gcgcagaggacauca

SEQ ID NO: 2030753 - RNA, 15 nt, Homo sapiens
ccuguccucuuugug

SEQ ID NO: 2030754 - RNA, 13 nt, Homo sapiens
gcgugugcguuuc

SEQ ID NO: 2030755 - RNA, 17 nt, Homo sapiens
cuguugggaaccagaga

SEQ ID NO: 2030756 - RNA, 13 nt, Homo sapiens
aucuaaugaaugu

SEQ ID NO: 2030757 - RNA, 13 nt, Homo sapiens
cggugagcauugu

SEQ ID NO: 2030758 - RNA, 15 nt, Homo sapiens
caagacuuugcuaaa

SEQ ID NO: 2030759 - RNA, 17 nt, Homo sapiens
uuuccaauuauuugacu

SEQ ID NO: 2030760 - RNA, 19 nt, Homo sapiens
cagcucauuugugacaaca

SEQ ID NO: 2030761 - RNA, 21 nt, Homo sapiens
ugcugagauuggaaaagggca

SEQ ID NO: 2030762 - RNA, 20 nt, Homo sapiens
ugcuuucacauuguacuuaa

SEQ ID NO: 2030763 - RNA, 13 nt, Homo sapiens
uguauaacauuua

SEQ ID NO: 2030764 - RNA, 18 nt, Homo sapiens
cccuccuuuucucugaga

SEQ ID NO: 2030765 - RNA, 18 nt, Homo sapiens
uaacuuauguaugugguu

SEQ ID NO: 2030766 - RNA, 18 nt, Homo sapiens
agcuguugcggacaucau

SEQ ID NO: 2030767 - RNA, 14 nt, Homo sapiens
caaagacuguaaau

SEQ ID NO: 2030768 - RNA, 13 nt, Homo sapiens
ccaccucagggca

SEQ ID NO: 2030769 - RNA, 12 nt, Homo sapiens
cgccaccugccc

SEQ ID NO: 2030770 - RNA, 18 nt, Homo sapiens
accaaaugcuuuuccuca

SEQ ID NO: 2030771 - RNA, 17 nt, Homo sapiens
aacaaguuaguuucuca

SEQ ID NO: 2030772 - RNA, 12 nt, Homo sapiens
ccucaccugguc

SEQ ID NO: 2030773 - RNA, 21 nt, Homo sapiens
aacucucugguuuacuucaaa

SEQ ID NO: 2030774 - RNA, 21 nt, Homo sapiens
uguagaacaagaaaucuuucu

SEQ ID NO: 2030775 - RNA, 13 nt, Homo sapiens
uuaauaucuucac

SEQ ID NO: 2030776 - RNA, 23 nt, Homo sapiens
ugaagguuaaaggaaaagcacaa

SEQ ID NO: 2030777 - RNA, 18 nt, Homo sapiens
agagccaccagggcacug

SEQ ID NO: 2030778 - RNA, 17 nt, Homo sapiens
caucgcauccucuucca

SEQ ID NO: 2030779 - RNA, 20 nt, Homo sapiens
gcccaggagccucacugggg

SEQ ID NO: 2030780 - RNA, 16 nt, Homo sapiens
agaauccaaagaucac

SEQ ID NO: 2030781 - RNA, 15 nt, Homo sapiens
gguuuccuuccuugg

SEQ ID NO: 2030782 - RNA, 15 nt, Homo sapiens
gugcuggggcacggc

SEQ ID NO: 2030783 - RNA, 22 nt, Homo sapiens
acauuaaguaaaugcuguagaa

SEQ ID NO: 2030784 - RNA, 23 nt, Homo sapiens
aacuguacaguuucuuccccaag

SEQ ID NO: 2030785 - RNA, 13 nt, Homo sapiens
ucugaacuuccaa

SEQ ID NO: 2030786 - RNA, 14 nt, Homo sapiens
aaaucgaccacagu

SEQ ID NO: 2030787 - RNA, 22 nt, Homo sapiens
ugaauacugcauuuacagugua

SEQ ID NO: 2030788 - RNA, 15 nt, Homo sapiens
aaugcuaagccaguu

SEQ ID NO: 2030789 - RNA, 13 nt, Homo sapiens
ugcaguggcacaa

SEQ ID NO: 2030790 - RNA, 12 nt, Homo sapiens
ugcauauccaaa

SEQ ID NO: 2030791 - RNA, 12 nt, Homo sapiens
cacuuaucugau

SEQ ID NO: 2030792 - RNA, 17 nt, Homo sapiens
uucacuugggucucugg

SEQ ID NO: 2030793 - RNA, 22 nt, Homo sapiens
uaccuugguauaucauacuggu

SEQ ID NO: 2030794 - RNA, 18 nt, Homo sapiens
agguguguccuugaacug

SEQ ID NO: 2030795 - RNA, 14 nt, Homo sapiens
cagugcaccucuca

SEQ ID NO: 2030796 - RNA, 21 nt, Homo sapiens
ugagccucacagcagugagac

SEQ ID NO: 2030797 - RNA, 12 nt, Homo sapiens
ugugauugccau

SEQ ID NO: 2030798 - RNA, 14 nt, Homo sapiens
ugacucuggaacca

SEQ ID NO: 2030799 - RNA, 17 nt, Homo sapiens
acuguggcaaacaaaac

SEQ ID NO: 2030800 - RNA, 12 nt, Homo sapiens
ucugaaacuggg

SEQ ID NO: 2030801 - RNA, 11 nt, Homo sapiens
caaugaucuag

SEQ ID NO: 2030802 - RNA, 21 nt, Homo sapiens
ccuugcugcaaacccaugaag

SEQ ID NO: 2030803 - RNA, 21 nt, Homo sapiens
uggacuacacaauacaguauu

SEQ ID NO: 2030804 - RNA, 20 nt, Homo sapiens
ccugacccugucuuucucuc

SEQ ID NO: 2030805 - RNA, 20 nt, Homo sapiens
ugugaccccuccuuucuucc

SEQ ID NO: 2030806 - RNA, 20 nt, Homo sapiens
cugggugauggaaacugcca

SEQ ID NO: 2030807 - RNA, 15 nt, Homo sapiens
uaaaugagcuaugua

SEQ ID NO: 2030808 - RNA, 13 nt, Homo sapiens
aucaaguaauaca

SEQ ID NO: 2030809 - RNA, 19 nt, Homo sapiens
gaucacuuuugcacauucc

SEQ ID NO: 2030810 - RNA, 18 nt, Homo sapiens
uguguuuaggaacuacug

SEQ ID NO: 2030811 - RNA, 16 nt, Homo sapiens
gaacagauggcuguga

SEQ ID NO: 2030812 - RNA, 12 nt, Homo sapiens
aguacaguauau

SEQ ID NO: 2030813 - RNA, 18 nt, Homo sapiens
ucaggaguuuugggaaug

SEQ ID NO: 2030814 - RNA, 17 nt, Homo sapiens
aaugcuccagcacucaa

SEQ ID NO: 2030815 - RNA, 15 nt, Homo sapiens
gcuccugaguagcug

SEQ ID NO: 2030816 - RNA, 14 nt, Homo sapiens
ggggaacaagucaa

SEQ ID NO: 2030817 - RNA, 15 nt, Homo sapiens
gcugugggcaauugu

SEQ ID NO: 2030818 - RNA, 23 nt, Homo sapiens
aauuuccagaacugcacaaugac

SEQ ID NO: 2030819 - RNA, 19 nt, Homo sapiens
agcgaggaggcuccagagg

SEQ ID NO: 2030820 - RNA, 14 nt, Homo sapiens
cacuugcaguggaa

SEQ ID NO: 2030821 - RNA, 11 nt, Homo sapiens
ggaacagggau

SEQ ID NO: 2030822 - RNA, 17 nt, Homo sapiens
cagauaagaaggugcga

SEQ ID NO: 2030823 - RNA, 20 nt, Homo sapiens
ucacuuuuguucccagguac

SEQ ID NO: 2030824 - RNA, 20 nt, Homo sapiens
cuaagcucaaggcgugagga

SEQ ID NO: 2030825 - RNA, 17 nt, Homo sapiens
guuuacagcacuacucu

SEQ ID NO: 2030826 - RNA, 20 nt, Homo sapiens
gauuuaauccuagagauuug

SEQ ID NO: 2030827 - RNA, 22 nt, Homo sapiens
agcugaaagauugauuaaugaa

SEQ ID NO: 2030828 - RNA, 22 nt, Homo sapiens
acugcccccugcugccaugugg

SEQ ID NO: 2030829 - RNA, 16 nt, Homo sapiens
cacaguuaucaaaaag

SEQ ID NO: 2030830 - RNA, 13 nt, Homo sapiens
aaucugccauaaa

SEQ ID NO: 2030831 - RNA, 18 nt, Homo sapiens
ucaagcccuuuacuugac

SEQ ID NO: 2030832 - RNA, 21 nt, Homo sapiens
cauuagaaaugagguagcuga

SEQ ID NO: 2030833 - RNA, 16 nt, Homo sapiens
ggaagaaauuccugua

SEQ ID NO: 2030834 - RNA, 16 nt, Homo sapiens
auauuuguauacacau

SEQ ID NO: 2030835 - RNA, 23 nt, Homo sapiens
cucccccaucccuacccuugucc

SEQ ID NO: 2030836 - RNA, 15 nt, Homo sapiens
uauagauguugcuaa

SEQ ID NO: 2030837 - RNA, 21 nt, Homo sapiens
agcacaucucaacaggccuca

SEQ ID NO: 2030838 - RNA, 15 nt, Homo sapiens
aucuuauuucuguca

SEQ ID NO: 2030839 - RNA, 23 nt, Homo sapiens
ccaaucugucacauaaaagucug

SEQ ID NO: 2030840 - RNA, 19 nt, Homo sapiens
uggucuuucugaauugcac

SEQ ID NO: 2030841 - RNA, 19 nt, Homo sapiens
ccaggcuggagugcagugg

SEQ ID NO: 2030842 - RNA, 19 nt, Homo sapiens
ccaggcuagagugcaaugg

SEQ ID NO: 2030843 - RNA, 16 nt, Homo sapiens
uauuguuguugccaaa

SEQ ID NO: 2030844 - RNA, 20 nt, Homo sapiens
guuccagaacgucucucacc

SEQ ID NO: 2030845 - RNA, 17 nt, Homo sapiens
agucacucccaagcccc

SEQ ID NO: 2030846 - RNA, 15 nt, Homo sapiens
acaugauccugaguu

SEQ ID NO: 2030847 - RNA, 17 nt, Homo sapiens
agucacuuguuucuacu

SEQ ID NO: 2030848 - RNA, 14 nt, Homo sapiens
augcaucaugcuca

SEQ ID NO: 2030849 - RNA, 20 nt, Homo sapiens
ccaugcugaaggcucccauu

SEQ ID NO: 2030850 - RNA, 21 nt, Homo sapiens
uagucaguguacucugagucc

SEQ ID NO: 2030851 - RNA, 12 nt, Homo sapiens
ugcuucacauaa

SEQ ID NO: 2030852 - RNA, 22 nt, Homo sapiens
ccuaaagaaugcaaccuaguca

SEQ ID NO: 2030853 - RNA, 10 nt, Homo sapiens
ccugcaaaac

SEQ ID NO: 2030854 - RNA, 16 nt, Homo sapiens
aagaguguuucuucca

SEQ ID NO: 2030855 - RNA, 16 nt, Homo sapiens
aucaggagcugcucag

SEQ ID NO: 2030856 - RNA, 23 nt, Homo sapiens
gaguaaugauguaacagugcaag

SEQ ID NO: 2030857 - RNA, 19 nt, Homo sapiens
ggcagcgggggccagggaa

SEQ ID NO: 2030858 - RNA, 20 nt, Homo sapiens
auuaaaccuuuccauuuuac

SEQ ID NO: 2030859 - RNA, 15 nt, Homo sapiens
aacgugguucagaga

SEQ ID NO: 2030860 - RNA, 21 nt, Homo sapiens
ccaugaggccucaguggacuu

SEQ ID NO: 2030861 - RNA, 17 nt, Homo sapiens
gaccaguuguugauaac

SEQ ID NO: 2030862 - RNA, 15 nt, Homo sapiens
ucaggcagugugagu

SEQ ID NO: 2030863 - RNA, 13 nt, Homo sapiens
gacuguuuuccca

SEQ ID NO: 2030864 - RNA, 17 nt, Homo sapiens
acacccuguaccaucca

SEQ ID NO: 2030865 - RNA, 16 nt, Homo sapiens
aauauauucuauucca

SEQ ID NO: 2030866 - RNA, 18 nt, Homo sapiens
auuuuuauaaacuaccaa

SEQ ID NO: 2030867 - RNA, 16 nt, Homo sapiens
caggccagcaagcucu

SEQ ID NO: 2030868 - RNA, 13 nt, Homo sapiens
acauuuacaauaa

SEQ ID NO: 2030869 - RNA, 15 nt, Homo sapiens
accuggugcuuuuaa

SEQ ID NO: 2030870 - RNA, 14 nt, Homo sapiens
ccuggcuggcacag

SEQ ID NO: 2030871 - RNA, 23 nt, Homo sapiens
auuacauuccuaacuagaauuag

SEQ ID NO: 2030872 - RNA, 13 nt, Homo sapiens
ucuuggaaaucau

SEQ ID NO: 2030873 - RNA, 12 nt, Homo sapiens
uauaacucugca

SEQ ID NO: 2030874 - RNA, 16 nt, Homo sapiens
cugcuuugucaaaagg

SEQ ID NO: 2030875 - RNA, 12 nt, Homo sapiens
ugcgcacugugu

SEQ ID NO: 2030876 - RNA, 10 nt, Homo sapiens
cgcaaagggc

SEQ ID NO: 2030877 - RNA, 19 nt, Homo sapiens
uaaugacaaugaagugaca

SEQ ID NO: 2030878 - RNA, 13 nt, Homo sapiens
acacgugcacaga

SEQ ID NO: 2030879 - RNA, 23 nt, Homo sapiens
agguccagcuuuacuguggcugu

SEQ ID NO: 2030880 - RNA, 12 nt, Homo sapiens
ucuuacuugcca

SEQ ID NO: 2030881 - RNA, 14 nt, Homo sapiens
gagaacagcauuua

SEQ ID NO: 2030882 - RNA, 20 nt, Homo sapiens
aacacugcugaggcuucaua

SEQ ID NO: 2030883 - RNA, 15 nt, Homo sapiens
cccgagugagcaugg

SEQ ID NO: 2030884 - RNA, 15 nt, Homo sapiens
ugggacucaggauau

SEQ ID NO: 2030885 - RNA, 21 nt, Homo sapiens
caccuaauguuuaugagccag

SEQ ID NO: 2030886 - RNA, 14 nt, Homo sapiens
aauuuucuguaaga

SEQ ID NO: 2030887 - RNA, 15 nt, Homo sapiens
agggcugccuuugga

SEQ ID NO: 2030888 - RNA, 17 nt, Homo sapiens
acuuuuguggaccaaua

SEQ ID NO: 2030889 - RNA, 16 nt, Homo sapiens
ugcaaaacuccaggca

SEQ ID NO: 2030890 - RNA, 14 nt, Homo sapiens
cuuuuaaucaguga

SEQ ID NO: 2030891 - RNA, 15 nt, Homo sapiens
caguugcugaucccu

SEQ ID NO: 2030892 - RNA, 21 nt, Homo sapiens
ccagaaacguaacugugugca

SEQ ID NO: 2030893 - RNA, 14 nt, Homo sapiens
gccuccagguugcc

SEQ ID NO: 2030894 - RNA, 14 nt, Homo sapiens
gccuuuugcugcgc

SEQ ID NO: 2030895 - RNA, 16 nt, Homo sapiens
ucuccccaggccucca

SEQ ID NO: 2030896 - RNA, 20 nt, Homo sapiens
guuaccugucauuuugcacu

SEQ ID NO: 2030897 - RNA, 21 nt, Homo sapiens
uguguuuccuucagugcaucu

SEQ ID NO: 2030898 - RNA, 14 nt, Homo sapiens
aguguagugcucag

SEQ ID NO: 2030899 - RNA, 23 nt, Homo sapiens
cucccuaccugacugccacagaa

SEQ ID NO: 2030900 - RNA, 22 nt, Homo sapiens
ugcuccaugacuggcugucugc

SEQ ID NO: 2030901 - RNA, 20 nt, Homo sapiens
ccaggaaugaucccacucac

SEQ ID NO: 2030902 - RNA, 19 nt, Homo sapiens
caccaccaggcaccucaca

SEQ ID NO: 2030903 - RNA, 21 nt, Homo sapiens
ccuaacuguuuuguauaugcu

SEQ ID NO: 2030904 - RNA, 12 nt, Homo sapiens
gcuguugcuuga

SEQ ID NO: 2030905 - RNA, 17 nt, Homo sapiens
cccggggcccaggacuc

SEQ ID NO: 2030906 - RNA, 22 nt, Homo sapiens
aguuggggaauaaauggauaug

SEQ ID NO: 2030907 - RNA, 10 nt, Homo sapiens
aguaccccau

SEQ ID NO: 2030908 - RNA, 15 nt, Homo sapiens
gcccauccaucugcu

SEQ ID NO: 2030909 - RNA, 17 nt, Homo sapiens
guuguucacaccacagg

SEQ ID NO: 2030910 - RNA, 19 nt, Homo sapiens
ugaggugcccacuccgcca

SEQ ID NO: 2030911 - RNA, 14 nt, Homo sapiens
uaaagaauacuuga

SEQ ID NO: 2030912 - RNA, 17 nt, Homo sapiens
accacaggcuuguuacc

SEQ ID NO: 2030913 - RNA, 17 nt, Homo sapiens
cuggccuuuccuagcua

SEQ ID NO: 2030914 - RNA, 17 nt, Homo sapiens
uuaugaaugaguuuuac

SEQ ID NO: 2030915 - RNA, 22 nt, Homo sapiens
cccagcuuuuagaaaaugcagu

SEQ ID NO: 2030916 - RNA, 15 nt, Homo sapiens
accccagacacuggu

SEQ ID NO: 2030917 - RNA, 14 nt, Homo sapiens
uauaaaauacauaa

SEQ ID NO: 2030918 - RNA, 19 nt, Homo sapiens
cuuggaugucauaucuucu

SEQ ID NO: 2030919 - RNA, 14 nt, Homo sapiens
uauaacuuacuuau

SEQ ID NO: 2030920 - RNA, 20 nt, Homo sapiens
caaacauuuugaaagucugu

SEQ ID NO: 2030921 - RNA, 17 nt, Homo sapiens
guuuggugauacuguca

SEQ ID NO: 2030922 - RNA, 13 nt, Homo sapiens
agggcacauuucu

SEQ ID NO: 2030923 - RNA, 16 nt, Homo sapiens
ucaguuugcaaauaga

SEQ ID NO: 2030924 - RNA, 16 nt, Homo sapiens
caauuugcugccaaac

SEQ ID NO: 2030925 - RNA, 17 nt, Homo sapiens
caggccuugcugacucu

SEQ ID NO: 2030926 - RNA, 20 nt, Homo sapiens
aauacaaagcuguuuuauga

SEQ ID NO: 2030927 - RNA, 14 nt, Homo sapiens
uacagauacuguga

SEQ ID NO: 2030928 - RNA, 14 nt, Homo sapiens
ucuugcucacuccc

SEQ ID NO: 2030929 - RNA, 23 nt, Homo sapiens
uaucuaaacuggauucacagcuc

SEQ ID NO: 2030930 - RNA, 18 nt, Homo sapiens
cagucuggccacugucaa

SEQ ID NO: 2030931 - RNA, 23 nt, Homo sapiens
aacccacagaccucacaccuggg

SEQ ID NO: 2030932 - RNA, 23 nt, Homo sapiens
cuggaagaggaauccagugaaug

SEQ ID NO: 2030933 - RNA, 20 nt, Homo sapiens
aauauauccccacuacucaa

SEQ ID NO: 2030934 - RNA, 19 nt, Homo sapiens
aacacaguguuuccugagu

SEQ ID NO: 2030935 - RNA, 17 nt, Homo sapiens
uuaauuaaguacaacca

SEQ ID NO: 2030936 - RNA, 16 nt, Homo sapiens
uccccauccuccagcu

SEQ ID NO: 2030937 - RNA, 15 nt, Homo sapiens
cacguggggcccacu

SEQ ID NO: 2030938 - RNA, 16 nt, Homo sapiens
ugcacugacagccuug

SEQ ID NO: 2030939 - RNA, 17 nt, Homo sapiens
ugagucugcaugugcac

SEQ ID NO: 2030940 - RNA, 20 nt, Homo sapiens
caguaagggauauuagauaa

SEQ ID NO: 2030941 - RNA, 17 nt, Homo sapiens
gccccacgcauggugca

SEQ ID NO: 2030942 - RNA, 12 nt, Homo sapiens
guuguucuuggc

SEQ ID NO: 2030943 - RNA, 16 nt, Homo sapiens
ugcugucacaaccaag

SEQ ID NO: 2030944 - RNA, 14 nt, Homo sapiens
gaaaaaugcuguuu

SEQ ID NO: 2030945 - RNA, 15 nt, Homo sapiens
uguccacaucugccu

SEQ ID NO: 2030946 - RNA, 19 nt, Homo sapiens
aaacgaaacuccaucucaa

SEQ ID NO: 2030947 - RNA, 14 nt, Homo sapiens
guugcacugauauu

SEQ ID NO: 2030948 - RNA, 18 nt, Homo sapiens
ucuucagauacaaacugc

SEQ ID NO: 2030949 - RNA, 13 nt, Homo sapiens
uaauaacauauua

SEQ ID NO: 2030950 - RNA, 12 nt, Homo sapiens
acccagcaauag

SEQ ID NO: 2030951 - RNA, 17 nt, Homo sapiens
ggcucugaagccaagcc

SEQ ID NO: 2030952 - RNA, 13 nt, Homo sapiens
acuauacaacaau

SEQ ID NO: 2030953 - RNA, 23 nt, Homo sapiens
accgcuucugccuuuucacugug

SEQ ID NO: 2030954 - RNA, 18 nt, Homo sapiens
caggucaggaugcacauu

SEQ ID NO: 2030955 - RNA, 17 nt, Homo sapiens
uuuauuuaaacuauuca

SEQ ID NO: 2030956 - RNA, 19 nt, Homo sapiens
agugaaugccagugugcug

SEQ ID NO: 2030957 - RNA, 14 nt, Homo sapiens
ucucccacuccagc

SEQ ID NO: 2030958 - RNA, 17 nt, Homo sapiens
auucagaaagcuucaaa

SEQ ID NO: 2030959 - RNA, 22 nt, Homo sapiens
gcuggagugcaguggugcaauc

SEQ ID NO: 2030960 - RNA, 16 nt, Homo sapiens
ugcggaucuucauggc

SEQ ID NO: 2030961 - RNA, 12 nt, Homo sapiens
ccaguucaucuu

SEQ ID NO: 2030962 - RNA, 21 nt, Homo sapiens
ccauaaaaugugcuucucuuc

SEQ ID NO: 2030963 - RNA, 21 nt, Homo sapiens
ggacguccagguggagguggc

SEQ ID NO: 2030964 - RNA, 16 nt, Homo sapiens
caaauaggcaucauca

SEQ ID NO: 2030965 - RNA, 15 nt, Homo sapiens
uagcaaacuuuucac

SEQ ID NO: 2030966 - RNA, 18 nt, Homo sapiens
gagauacugaagugcagc

SEQ ID NO: 2030967 - RNA, 16 nt, Homo sapiens
uaaagcuacuguagaa

SEQ ID NO: 2030968 - RNA, 22 nt, Homo sapiens
gcugugugagaccaggggacca

SEQ ID NO: 2030969 - RNA, 20 nt, Homo sapiens
uaaauugucugccauuacac

SEQ ID NO: 2030970 - RNA, 17 nt, Homo sapiens
cucucagcaggcaaaga

SEQ ID NO: 2030971 - RNA, 14 nt, Homo sapiens
ugcaccacugcacu

SEQ ID NO: 2030972 - RNA, 14 nt, Homo sapiens
cugcccaccugccu

SEQ ID NO: 2030973 - RNA, 21 nt, Homo sapiens
ggaaaagagcgcaucaggccu

SEQ ID NO: 2030974 - RNA, 15 nt, Homo sapiens
augcuacgugugauu

SEQ ID NO: 2030975 - RNA, 22 nt, Homo sapiens
gaaaagaggggaagagacuugg

SEQ ID NO: 2030976 - RNA, 18 nt, Homo sapiens
ugagauuggaaaagggca

SEQ ID NO: 2030977 - RNA, 21 nt, Homo sapiens
gcuucucuacagacuccaaaa

SEQ ID NO: 2030978 - RNA, 22 nt, Homo sapiens
caaagugggagcccgauaaaua

SEQ ID NO: 2030979 - RNA, 12 nt, Homo sapiens
agaaagauuaaa

SEQ ID NO: 2030980 - RNA, 15 nt, Homo sapiens
uacacgaacugaaau

SEQ ID NO: 2030981 - RNA, 13 nt, Homo sapiens
cagguuuuugccc

SEQ ID NO: 2030982 - RNA, 18 nt, Homo sapiens
acgucagcugggacaccc

SEQ ID NO: 2030983 - RNA, 19 nt, Homo sapiens
caauacucuugaaauguag

SEQ ID NO: 2030984 - RNA, 22 nt, Homo sapiens
cucccucagacucagaggucca

SEQ ID NO: 2030985 - RNA, 21 nt, Homo sapiens
uuuucaagaaagcauugccag

SEQ ID NO: 2030986 - RNA, 22 nt, Homo sapiens
cuccucucugcuggguuuccac

SEQ ID NO: 2030987 - RNA, 14 nt, Homo sapiens
agagcccagucucc

SEQ ID NO: 2030988 - RNA, 14 nt, Homo sapiens
cauuucugucucca

SEQ ID NO: 2030989 - RNA, 12 nt, Homo sapiens
aauuuaacaaga

SEQ ID NO: 2030990 - RNA, 14 nt, Homo sapiens
aagccuaauuccag

SEQ ID NO: 2030991 - RNA, 13 nt, Homo sapiens
aacacacacuguu

SEQ ID NO: 2030992 - RNA, 21 nt, Homo sapiens
uucucuacagacuccaaaagg

SEQ ID NO: 2030993 - RNA, 23 nt, Homo sapiens
gccuugccuaaauuuaaugcugc

SEQ ID NO: 2030994 - RNA, 12 nt, Homo sapiens
uccuuaaguaua

SEQ ID NO: 2030995 - RNA, 16 nt, Homo sapiens
ucauguugaugacucg

SEQ ID NO: 2030996 - RNA, 15 nt, Homo sapiens
gcuugugugcacaua

SEQ ID NO: 2030997 - RNA, 16 nt, Homo sapiens
gcaaagggcaaggaau

SEQ ID NO: 2030998 - RNA, 22 nt, Homo sapiens
cccaagcugccucugggccaug

SEQ ID NO: 2030999 - RNA, 15 nt, Homo sapiens
ucauagcaacauuau

SEQ ID NO: 2031000 - RNA, 21 nt, Homo sapiens
agugaaugaguaaauaaacuc

SEQ ID NO: 2031001 - RNA, 14 nt, Homo sapiens
aaaugauccuuccu

SEQ ID NO: 2031002 - RNA, 24 nt, Homo sapiens
ucccugccucucaucaacugaaug

SEQ ID NO: 2031003 - RNA, 21 nt, Homo sapiens
agauguaauuguuugucuuua

SEQ ID NO: 2031004 - RNA, 13 nt, Homo sapiens
aaauacaauucaa

SEQ ID NO: 2031005 - RNA, 17 nt, Homo sapiens
gugagcuggugaccacc

SEQ ID NO: 2031006 - RNA, 17 nt, Homo sapiens
acuaccugcccucagcu

SEQ ID NO: 2031007 - RNA, 12 nt, Homo sapiens
uuuuccuuccag

SEQ ID NO: 2031008 - RNA, 15 nt, Homo sapiens
gaaaggacagggauu

SEQ ID NO: 2031009 - RNA, 19 nt, Homo sapiens
cucugugcccggugccauc

SEQ ID NO: 2031010 - RNA, 15 nt, Homo sapiens
gccuuaaccaugagg

SEQ ID NO: 2031011 - RNA, 13 nt, Homo sapiens
acgccuccaucca

SEQ ID NO: 2031012 - RNA, 22 nt, Homo sapiens
cugaaauaaaaugauaaacaag

SEQ ID NO: 2031013 - RNA, 23 nt, Homo sapiens
ggcuuguccucaucucuacccau

SEQ ID NO: 2031014 - RNA, 20 nt, Homo sapiens
uggauugugggaauuaagga

SEQ ID NO: 2031015 - RNA, 17 nt, Homo sapiens
auguuaccuucacaugu

SEQ ID NO: 2031016 - RNA, 22 nt, Homo sapiens
acugcucugagaauuguugaga

SEQ ID NO: 2031017 - RNA, 19 nt, Homo sapiens
auucgcugaaauacuuaau

SEQ ID NO: 2031018 - RNA, 17 nt, Homo sapiens
uagaacauugaucuguu

SEQ ID NO: 2031019 - RNA, 11 nt, Homo sapiens
auagcucucau

SEQ ID NO: 2031020 - RNA, 18 nt, Homo sapiens
aacaggaauccacauugc

SEQ ID NO: 2031021 - RNA, 17 nt, Homo sapiens
ugacaauuuauggaagc

SEQ ID NO: 2031022 - RNA, 16 nt, Homo sapiens
auuuaauauaaaccuc

SEQ ID NO: 2031023 - RNA, 17 nt, Homo sapiens
aguucucugccaaagcu

SEQ ID NO: 2031024 - RNA, 15 nt, Homo sapiens
ucauuugaaugcuua

SEQ ID NO: 2031025 - RNA, 14 nt, Homo sapiens
auaucaucccuguc

SEQ ID NO: 2031026 - RNA, 14 nt, Homo sapiens
gucagauauuugag

SEQ ID NO: 2031027 - RNA, 18 nt, Homo sapiens
acugaaaaugaacuguaa

SEQ ID NO: 2031028 - RNA, 16 nt, Homo sapiens
acccagggacucucca

SEQ ID NO: 2031029 - RNA, 18 nt, Homo sapiens
uggccagggcuuccucaa

SEQ ID NO: 2031030 - RNA, 22 nt, Homo sapiens
uguuugggauccuauugaacca

SEQ ID NO: 2031031 - RNA, 23 nt, Homo sapiens
acuuguggagcgccagcucugcc

SEQ ID NO: 2031032 - RNA, 12 nt, Homo sapiens
aacaacuuugaa

SEQ ID NO: 2031033 - RNA, 15 nt, Homo sapiens
cucuacccuauacaa

SEQ ID NO: 2031034 - RNA, 13 nt, Homo sapiens
caucacuuuguga

SEQ ID NO: 2031035 - RNA, 21 nt, Homo sapiens
uuuauguuuggugaacuauau

SEQ ID NO: 2031036 - RNA, 13 nt, Homo sapiens
ucaagaaugcaau

SEQ ID NO: 2031037 - RNA, 13 nt, Homo sapiens
ugcagaauggcau

SEQ ID NO: 2031038 - RNA, 13 nt, Homo sapiens
gcccaucucaaca

SEQ ID NO: 2031039 - RNA, 13 nt, Homo sapiens
gaaucucucccuc

SEQ ID NO: 2031040 - RNA, 14 nt, Homo sapiens
aggugcucuucuca

SEQ ID NO: 2031041 - RNA, 23 nt, Homo sapiens
acugaucaggaccuccaagccac

SEQ ID NO: 2031042 - RNA, 19 nt, Homo sapiens
acaaagggaaaaaagaguu

SEQ ID NO: 2031043 - RNA, 19 nt, Homo sapiens
ugcugugucuccucucaga

SEQ ID NO: 2031044 - RNA, 20 nt, Homo sapiens
aauggcuuguucaucaucca

SEQ ID NO: 2031045 - RNA, 13 nt, Homo sapiens
aaauauucucucc

SEQ ID NO: 2031046 - RNA, 15 nt, Homo sapiens
agcucuaaagaccau

SEQ ID NO: 2031047 - RNA, 23 nt, Homo sapiens
cauagaaguuaaagguuacuguu

SEQ ID NO: 2031048 - RNA, 22 nt, Homo sapiens
acaggcaaauccgaaaucagca

SEQ ID NO: 2031049 - RNA, 12 nt, Homo sapiens
auuaucuacuac

SEQ ID NO: 2031050 - RNA, 16 nt, Homo sapiens
ccugacaccaggcaag

SEQ ID NO: 2031051 - RNA, 20 nt, Homo sapiens
cauuguccauuacuugccag

SEQ ID NO: 2031052 - RNA, 21 nt, Homo sapiens
aauaacugaaccaaauugcac

SEQ ID NO: 2031053 - RNA, 21 nt, Homo sapiens
ucauccaggacugagaugcaa

SEQ ID NO: 2031054 - RNA, 18 nt, Homo sapiens
aaucucaaaguguacaaa

SEQ ID NO: 2031055 - RNA, 18 nt, Homo sapiens
cauaaaagcauugucucu

SEQ ID NO: 2031056 - RNA, 14 nt, Homo sapiens
gguucucacuguug

SEQ ID NO: 2031057 - RNA, 15 nt, Homo sapiens
uggggcaugugccau

SEQ ID NO: 2031058 - RNA, 19 nt, Homo sapiens
accauuccaggaaaacugg

SEQ ID NO: 2031059 - RNA, 18 nt, Homo sapiens
cccugacagcuguguacu

SEQ ID NO: 2031060 - RNA, 13 nt, Homo sapiens
acuuuugcacauu

SEQ ID NO: 2031061 - RNA, 20 nt, Homo sapiens
cucauccuuccucauuugca

SEQ ID NO: 2031062 - RNA, 21 nt, Homo sapiens
aauguaguuuugugaugcauu

SEQ ID NO: 2031063 - RNA, 21 nt, Homo sapiens
caacgcacaggaaaagguagc

SEQ ID NO: 2031064 - RNA, 21 nt, Homo sapiens
aacugugccaauacagacaaa

SEQ ID NO: 2031065 - RNA, 17 nt, Homo sapiens
ugcuuucaugaccaucc

SEQ ID NO: 2031066 - RNA, 21 nt, Homo sapiens
caugcccagcuuggagugcca

SEQ ID NO: 2031067 - RNA, 18 nt, Homo sapiens
gccccagggaucacuggc

SEQ ID NO: 2031068 - RNA, 18 nt, Homo sapiens
gcuuuuccaaacauucuc

SEQ ID NO: 2031069 - RNA, 22 nt, Homo sapiens
cucuauauuguucagcaugcaa

SEQ ID NO: 2031070 - RNA, 13 nt, Homo sapiens
cuccuaauucugc

SEQ ID NO: 2031071 - RNA, 19 nt, Homo sapiens
auugaaucugauuggacau

SEQ ID NO: 2031072 - RNA, 15 nt, Homo sapiens
aaugccauucucuug

SEQ ID NO: 2031073 - RNA, 21 nt, Homo sapiens
aaaguggcguuguucauagaa

SEQ ID NO: 2031074 - RNA, 18 nt, Homo sapiens
agaaauuuacuauguaaa

SEQ ID NO: 2031075 - RNA, 21 nt, Homo sapiens
uguguauagaacuggauuuuc

SEQ ID NO: 2031076 - RNA, 20 nt, Homo sapiens
aggccacccccuauccucug

SEQ ID NO: 2031077 - RNA, 19 nt, Homo sapiens
ucccuccucacuugcccug

SEQ ID NO: 2031078 - RNA, 23 nt, Homo sapiens
uagaggguagcuguggcuucuag

SEQ ID NO: 2031079 - RNA, 17 nt, Homo sapiens
aacacccuuuccaaagc

SEQ ID NO: 2031080 - RNA, 17 nt, Homo sapiens
gaacccuuugggagcaa

SEQ ID NO: 2031081 - RNA, 15 nt, Homo sapiens
agauuuggaugcacu

SEQ ID NO: 2031082 - RNA, 14 nt, Homo sapiens
ccacagccacauuu

SEQ ID NO: 2031083 - RNA, 20 nt, Homo sapiens
ucacuuggccaguuucagcu

SEQ ID NO: 2031084 - RNA, 21 nt, Homo sapiens
acacuucaguauagcauuggu

SEQ ID NO: 2031085 - RNA, 16 nt, Homo sapiens
guucuuugaccagcac

SEQ ID NO: 2031086 - RNA, 19 nt, Homo sapiens
ccucucauagaaauugccu

SEQ ID NO: 2031087 - RNA, 17 nt, Homo sapiens
ucucagcacuaugacau

SEQ ID NO: 2031088 - RNA, 17 nt, Homo sapiens
acgccuccugccaaggc

SEQ ID NO: 2031089 - RNA, 14 nt, Homo sapiens
cugggucugaguca

SEQ ID NO: 2031090 - RNA, 13 nt, Homo sapiens
aguguuaaaauac

SEQ ID NO: 2031091 - RNA, 23 nt, Homo sapiens
ccuccaggauaccagcaaaugga

SEQ ID NO: 2031092 - RNA, 23 nt, Homo sapiens
agggccuagcuuucauuugacac

SEQ ID NO: 2031093 - RNA, 18 nt, Homo sapiens
uagcugggacuacaggug

SEQ ID NO: 2031094 - RNA, 21 nt, Homo sapiens
gcucaauuuugucuguacuca

SEQ ID NO: 2031095 - RNA, 16 nt, Homo sapiens
ccugcugugcugcuca

SEQ ID NO: 2031096 - RNA, 22 nt, Homo sapiens
gaucucauaaugcuuuguuaaa

SEQ ID NO: 2031097 - RNA, 14 nt, Homo sapiens
uguaccauaugauc

SEQ ID NO: 2031098 - RNA, 15 nt, Homo sapiens
ccccucccugcuuca

SEQ ID NO: 2031099 - RNA, 20 nt, Homo sapiens
aggugccuggccaugucacc

SEQ ID NO: 2031100 - RNA, 15 nt, Homo sapiens
caguguccucuucaa

SEQ ID NO: 2031101 - RNA, 21 nt, Homo sapiens
aggagaaggacauuuuacugc

SEQ ID NO: 2031102 - RNA, 21 nt, Homo sapiens
uccauggggggagaagugaua

SEQ ID NO: 2031103 - RNA, 18 nt, Homo sapiens
gacugcugacauuuugca

SEQ ID NO: 2031104 - RNA, 15 nt, Homo sapiens
aaggccuccaaagca

SEQ ID NO: 2031105 - RNA, 22 nt, Homo sapiens
aagaauaaaaaagaaauccaua

SEQ ID NO: 2031106 - RNA, 11 nt, Homo sapiens
gucaacuuaaa

SEQ ID NO: 2031107 - RNA, 16 nt, Homo sapiens
cuuacucuaagaucuu

SEQ ID NO: 2031108 - RNA, 15 nt, Homo sapiens
ucucuacugcuggac

SEQ ID NO: 2031109 - RNA, 18 nt, Homo sapiens
ccccuuauucccgcucac

SEQ ID NO: 2031110 - RNA, 21 nt, Homo sapiens
cuucagggcuggaaaagucac

SEQ ID NO: 2031111 - RNA, 14 nt, Homo sapiens
auacugguauuaaa

SEQ ID NO: 2031112 - RNA, 16 nt, Homo sapiens
ggaacacaagugcccc

SEQ ID NO: 2031113 - RNA, 23 nt, Homo sapiens
gggccccucucuccacauuccaa

SEQ ID NO: 2031114 - RNA, 19 nt, Homo sapiens
cucuuuuucuuucuuccac

SEQ ID NO: 2031115 - RNA, 23 nt, Homo sapiens
auaaaguuuuuauuuuccucuga

SEQ ID NO: 2031116 - RNA, 18 nt, Homo sapiens
cacaugugacacauaugc

SEQ ID NO: 2031117 - RNA, 15 nt, Homo sapiens
aauacauuacaugua

SEQ ID NO: 2031118 - RNA, 18 nt, Homo sapiens
gcucuuggggccagccua

SEQ ID NO: 2031119 - RNA, 16 nt, Homo sapiens
gaguccacugcuccau

SEQ ID NO: 2031120 - RNA, 20 nt, Homo sapiens
uuaagauaauuguacuuuga

SEQ ID NO: 2031121 - RNA, 15 nt, Homo sapiens
ucuuaauaaucucau

SEQ ID NO: 2031122 - RNA, 15 nt, Homo sapiens
aagcguaauuuugcc

SEQ ID NO: 2031123 - RNA, 20 nt, Homo sapiens
gagucaggccuuaauuuuca

SEQ ID NO: 2031124 - RNA, 13 nt, Homo sapiens
acuauccaaugaa

SEQ ID NO: 2031125 - RNA, 13 nt, Homo sapiens
ugucuaccucuga

SEQ ID NO: 2031126 - RNA, 14 nt, Homo sapiens
uggcaguggacuca

SEQ ID NO: 2031127 - RNA, 21 nt, Homo sapiens
gcuuuccuggucccucacccc

SEQ ID NO: 2031128 - RNA, 16 nt, Homo sapiens
aauuaugugccagauu

SEQ ID NO: 2031129 - RNA, 17 nt, Homo sapiens
uagcaucuguaacagca

SEQ ID NO: 2031130 - RNA, 21 nt, Homo sapiens
ucgggaaggugucuggacauu

SEQ ID NO: 2031131 - RNA, 18 nt, Homo sapiens
guaaagaaaccauggcau

SEQ ID NO: 2031132 - RNA, 12 nt, Homo sapiens
aauaggucugga

SEQ ID NO: 2031133 - RNA, 17 nt, Homo sapiens
gaaccauuauacuuuau

SEQ ID NO: 2031134 - RNA, 13 nt, Homo sapiens
ggcgaguggcacg

SEQ ID NO: 2031135 - RNA, 14 nt, Homo sapiens
cauucgagguguca

SEQ ID NO: 2031136 - RNA, 21 nt, Homo sapiens
uacaauaccagaucacucaaa

SEQ ID NO: 2031137 - RNA, 18 nt, Homo sapiens
cuuuccccauucagugac

SEQ ID NO: 2031138 - RNA, 21 nt, Homo sapiens
ucuucagucucuauaccaaua

SEQ ID NO: 2031139 - RNA, 18 nt, Homo sapiens
uuccuaggucacuugaag

SEQ ID NO: 2031140 - RNA, 15 nt, Homo sapiens
cgagcagaugaugcc

SEQ ID NO: 2031141 - RNA, 15 nt, Homo sapiens
aaauaaaauguuuac

SEQ ID NO: 2031142 - RNA, 13 nt, Homo sapiens
agaauuuagcuua

SEQ ID NO: 2031143 - RNA, 16 nt, Homo sapiens
gcuucugcaguucuca

SEQ ID NO: 2031144 - RNA, 20 nt, Homo sapiens
aauuguucaucgcugcugga

SEQ ID NO: 2031145 - RNA, 15 nt, Homo sapiens
aaaacagucgaucaa

SEQ ID NO: 2031146 - RNA, 14 nt, Homo sapiens
gaguuuuguauuca

SEQ ID NO: 2031147 - RNA, 19 nt, Homo sapiens
aaagggcgcaaagggcaug

SEQ ID NO: 2031148 - RNA, 18 nt, Homo sapiens
agucaccauacacacugu

SEQ ID NO: 2031149 - RNA, 17 nt, Homo sapiens
ucuuuaaugucacaggc

SEQ ID NO: 2031150 - RNA, 15 nt, Homo sapiens
uuuccuucagguuuu

SEQ ID NO: 2031151 - RNA, 13 nt, Homo sapiens
ccugaagugaccc

SEQ ID NO: 2031152 - RNA, 12 nt, Homo sapiens
guacaguguucu

SEQ ID NO: 2031153 - RNA, 12 nt, Homo sapiens
ucuguacuuugg

SEQ ID NO: 2031154 - RNA, 19 nt, Homo sapiens
ucuaagugguauauacaua

SEQ ID NO: 2031155 - RNA, 17 nt, Homo sapiens
uuuuauuagaaguuuca

SEQ ID NO: 2031156 - RNA, 17 nt, Homo sapiens
gaugaacaaaucugcac

SEQ ID NO: 2031157 - RNA, 16 nt, Homo sapiens
gcuaugauaagauuga

SEQ ID NO: 2031158 - RNA, 14 nt, Homo sapiens
ugcuccguuccuca

SEQ ID NO: 2031159 - RNA, 10 nt, Homo sapiens
ccaauacugc

SEQ ID NO: 2031160 - RNA, 16 nt, Homo sapiens
ucaguuaacuauugca

SEQ ID NO: 2031161 - RNA, 18 nt, Homo sapiens
gcacagcaguuucaccau

SEQ ID NO: 2031162 - RNA, 13 nt, Homo sapiens
uguuaacaugaca

SEQ ID NO: 2031163 - RNA, 18 nt, Homo sapiens
auuuuacuaccaaugcca

SEQ ID NO: 2031164 - RNA, 20 nt, Homo sapiens
uaacucuuuauuuuuugcca

SEQ ID NO: 2031165 - RNA, 20 nt, Homo sapiens
uaccugcagccagcagagcu

SEQ ID NO: 2031166 - RNA, 17 nt, Homo sapiens
uccuugccgcugggaga

SEQ ID NO: 2031167 - RNA, 16 nt, Homo sapiens
acugucuucucccugc

SEQ ID NO: 2031168 - RNA, 20 nt, Homo sapiens
cagacacucugacuaccucc

SEQ ID NO: 2031169 - RNA, 14 nt, Homo sapiens
caccacacccaggu

SEQ ID NO: 2031170 - RNA, 13 nt, Homo sapiens
uccuggucuggca

SEQ ID NO: 2031171 - RNA, 18 nt, Homo sapiens
ggauuauauuaugaagcu

SEQ ID NO: 2031172 - RNA, 20 nt, Homo sapiens
agucccccuucaaucucguu

SEQ ID NO: 2031173 - RNA, 20 nt, Homo sapiens
aaacuuauccuccaugaaua

SEQ ID NO: 2031174 - RNA, 17 nt, Homo sapiens
ugaaacacaauaucauc

SEQ ID NO: 2031175 - RNA, 13 nt, Homo sapiens
gccagggcaccua

SEQ ID NO: 2031176 - RNA, 19 nt, Homo sapiens
ccgucuccauggcaucuuc

SEQ ID NO: 2031177 - RNA, 15 nt, Homo sapiens
ccuccccacagugcc

SEQ ID NO: 2031178 - RNA, 18 nt, Homo sapiens
agaacuuggcacacucuc

SEQ ID NO: 2031179 - RNA, 21 nt, Homo sapiens
auuuuccuuuuuuauacacau

SEQ ID NO: 2031180 - RNA, 17 nt, Homo sapiens
cucuggcgacaguuuuc

SEQ ID NO: 2031181 - RNA, 17 nt, Homo sapiens
cuacaacgaacacaaga

SEQ ID NO: 2031182 - RNA, 12 nt, Homo sapiens
cuccugccuuag

SEQ ID NO: 2031183 - RNA, 13 nt, Homo sapiens
cagagaugugcau

SEQ ID NO: 2031184 - RNA, 16 nt, Homo sapiens
uguugcccauugcacu

SEQ ID NO: 2031185 - RNA, 23 nt, Homo sapiens
ugaaaauuauuuuggaaauugag

SEQ ID NO: 2031186 - RNA, 17 nt, Homo sapiens
uaggcgcaggugcacag

SEQ ID NO: 2031187 - RNA, 20 nt, Homo sapiens
ccugaaauuuauucacauau

SEQ ID NO: 2031188 - RNA, 21 nt, Homo sapiens
ugcuguauuuuuauuuuugca

SEQ ID NO: 2031189 - RNA, 19 nt, Homo sapiens
ggaguuagggacugaccag

SEQ ID NO: 2031190 - RNA, 16 nt, Homo sapiens
aacagaacuacucucc

SEQ ID NO: 2031191 - RNA, 15 nt, Homo sapiens
ccccaucucccugcc

SEQ ID NO: 2031192 - RNA, 19 nt, Homo sapiens
augugacauuauaugcacu

SEQ ID NO: 2031193 - RNA, 19 nt, Homo sapiens
gaauaucgagaacugccau

SEQ ID NO: 2031194 - RNA, 22 nt, Homo sapiens
gaaggguggggauaucagggca

SEQ ID NO: 2031195 - RNA, 14 nt, Homo sapiens
gucaaauaccacau

SEQ ID NO: 2031196 - RNA, 15 nt, Homo sapiens
augcuggcugaagag

SEQ ID NO: 2031197 - RNA, 14 nt, Homo sapiens
agggcugcccugag

SEQ ID NO: 2031198 - RNA, 21 nt, Homo sapiens
uauugcccuuuaacaagacuu

SEQ ID NO: 2031199 - RNA, 19 nt, Homo sapiens
ccucugaucaguuucacaa

SEQ ID NO: 2031200 - RNA, 22 nt, Homo sapiens
cagccucggccucccaaaguac

SEQ ID NO: 2031201 - RNA, 16 nt, Homo sapiens
caccccucacucuggc

SEQ ID NO: 2031202 - RNA, 15 nt, Homo sapiens
auuuaagguuucaca

SEQ ID NO: 2031203 - RNA, 18 nt, Homo sapiens
cuaacaccacacugacca

SEQ ID NO: 2031204 - RNA, 16 nt, Homo sapiens
ugggagcugcuccuaa

SEQ ID NO: 2031205 - RNA, 19 nt, Homo sapiens
gaagggaguggcucuguaa

SEQ ID NO: 2031206 - RNA, 20 nt, Homo sapiens
gaacaaugacgugccuaccu

SEQ ID NO: 2031207 - RNA, 17 nt, Homo sapiens
uagauuuugcugagaug

SEQ ID NO: 2031208 - RNA, 18 nt, Homo sapiens
agacaccaaguuccguca

SEQ ID NO: 2031209 - RNA, 11 nt, Homo sapiens
cccuacuggga

SEQ ID NO: 2031210 - RNA, 21 nt, Homo sapiens
uacuaccccagaacgcaugca

SEQ ID NO: 2031211 - RNA, 20 nt, Homo sapiens
cuaaacuccaggggggacaa

SEQ ID NO: 2031212 - RNA, 21 nt, Homo sapiens
ugcugaaggacagaacauugc

SEQ ID NO: 2031213 - RNA, 23 nt, Homo sapiens
uccucuuuguaauuuaaugaaaa

SEQ ID NO: 2031214 - RNA, 22 nt, Homo sapiens
agccuuggccauccuggcucag

SEQ ID NO: 2031215 - RNA, 20 nt, Homo sapiens
ggcagcagaauugcuugaac

SEQ ID NO: 2031216 - RNA, 21 nt, Homo sapiens
aauaucugagcucuuugcacu

SEQ ID NO: 2031217 - RNA, 15 nt, Homo sapiens
auugugacaccagau

SEQ ID NO: 2031218 - RNA, 15 nt, Homo sapiens
cuacccugcucccug

SEQ ID NO: 2031219 - RNA, 16 nt, Homo sapiens
gcaaccugauuguaaa

SEQ ID NO: 2031220 - RNA, 22 nt, Homo sapiens
aacccaauacagucuaguuucc

SEQ ID NO: 2031221 - RNA, 19 nt, Homo sapiens
uugacaaagaaacccaagu

SEQ ID NO: 2031222 - RNA, 23 nt, Homo sapiens
gguaaauuuccccaacaguguga

SEQ ID NO: 2031223 - RNA, 16 nt, Homo sapiens
cuccauguacuggcaa

SEQ ID NO: 2031224 - RNA, 18 nt, Homo sapiens
ugaguccccaccagcuca

SEQ ID NO: 2031225 - RNA, 18 nt, Homo sapiens
auagucuuugccagucau

SEQ ID NO: 2031226 - RNA, 15 nt, Homo sapiens
cuuucucagccacaa

SEQ ID NO: 2031227 - RNA, 11 nt, Homo sapiens
guuuuuacuaa

SEQ ID NO: 2031228 - RNA, 18 nt, Homo sapiens
agaauaggguaugauccu

SEQ ID NO: 2031229 - RNA, 20 nt, Homo sapiens
auuuggcuucccuaacuuaa

SEQ ID NO: 2031230 - RNA, 12 nt, Homo sapiens
uauuucaucuca

SEQ ID NO: 2031231 - RNA, 23 nt, Homo sapiens
ucuucuuuguuuggauugcagca

SEQ ID NO: 2031232 - RNA, 22 nt, Homo sapiens
ucccuaucuuugccacccucau

SEQ ID NO: 2031233 - RNA, 12 nt, Homo sapiens
agaaaaacucau

SEQ ID NO: 2031234 - RNA, 13 nt, Homo sapiens
gaaaucucuucca

SEQ ID NO: 2031235 - RNA, 16 nt, Homo sapiens
gcaacggggaggccaa

SEQ ID NO: 2031236 - RNA, 20 nt, Homo sapiens
uguaauauuccaggaugcug

SEQ ID NO: 2031237 - RNA, 20 nt, Homo sapiens
agguuacaugagagcaauca

SEQ ID NO: 2031238 - RNA, 18 nt, Homo sapiens
aggcagcuucaagugccu

SEQ ID NO: 2031239 - RNA, 20 nt, Homo sapiens
ucaaguaguguaucacagua

SEQ ID NO: 2031240 - RNA, 19 nt, Homo sapiens
ccugugaugucccaguuuc

SEQ ID NO: 2031241 - RNA, 17 nt, Homo sapiens
aaagcccuaauagcaga

SEQ ID NO: 2031242 - RNA, 16 nt, Homo sapiens
ucucucucucuuuuuc

SEQ ID NO: 2031243 - RNA, 19 nt, Homo sapiens
aaacugcacugucaagaug

SEQ ID NO: 2031244 - RNA, 23 nt, Homo sapiens
cuuggcacugaugggcacuggaa

SEQ ID NO: 2031245 - RNA, 13 nt, Homo sapiens
cauacuguucacu

SEQ ID NO: 2031246 - RNA, 15 nt, Homo sapiens
aaagcauuugaaugc

SEQ ID NO: 2031247 - RNA, 15 nt, Homo sapiens
aaaauguuugagcac

SEQ ID NO: 2031248 - RNA, 15 nt, Homo sapiens
gcacauccauuccca

SEQ ID NO: 2031249 - RNA, 15 nt, Homo sapiens
aaauuaacaugucac

SEQ ID NO: 2031250 - RNA, 23 nt, Homo sapiens
aacauccuggcuuuugagcacuu

SEQ ID NO: 2031251 - RNA, 13 nt, Homo sapiens
ccauccugccauc

SEQ ID NO: 2031252 - RNA, 13 nt, Homo sapiens
uucaucuguucau

SEQ ID NO: 2031253 - RNA, 13 nt, Homo sapiens
uguaccuguguac

SEQ ID NO: 2031254 - RNA, 16 nt, Homo sapiens
cagaacaauucugcag

SEQ ID NO: 2031255 - RNA, 16 nt, Homo sapiens
acguccuccaccggug

SEQ ID NO: 2031256 - RNA, 17 nt, Homo sapiens
ccaaauacugcuuagca

SEQ ID NO: 2031257 - RNA, 15 nt, Homo sapiens
aaauguaacauacuc

SEQ ID NO: 2031258 - RNA, 18 nt, Homo sapiens
ucuccuagcccuccugag

SEQ ID NO: 2031259 - RNA, 21 nt, Homo sapiens
cccauaacuuccaguaucauu

SEQ ID NO: 2031260 - RNA, 23 nt, Homo sapiens
cuccuauuccuucacacaguuca

SEQ ID NO: 2031261 - RNA, 21 nt, Homo sapiens
agaagguugguggggggucca

SEQ ID NO: 2031262 - RNA, 21 nt, Homo sapiens
ugggaagaauaaaaugcagug

SEQ ID NO: 2031263 - RNA, 12 nt, Homo sapiens
aggcaugaacac

SEQ ID NO: 2031264 - RNA, 16 nt, Homo sapiens
uugacaggccauccau

SEQ ID NO: 2031265 - RNA, 24 nt, Homo sapiens
agaaauaugagcaugcucccucau

SEQ ID NO: 2031266 - RNA, 16 nt, Homo sapiens
auuuacuguugaucag

SEQ ID NO: 2031267 - RNA, 11 nt, Homo sapiens
gucgucucuuc

SEQ ID NO: 2031268 - RNA, 12 nt, Homo sapiens
uuguucugagau

SEQ ID NO: 2031269 - RNA, 12 nt, Homo sapiens
augcucugugac

SEQ ID NO: 2031270 - RNA, 17 nt, Homo sapiens
ucucugcaaaccaacag

SEQ ID NO: 2031271 - RNA, 22 nt, Homo sapiens
ccaaggcugagacagugaauuu

SEQ ID NO: 2031272 - RNA, 18 nt, Homo sapiens
auugaccaauuccugaca

SEQ ID NO: 2031273 - RNA, 21 nt, Homo sapiens
agaaguaggggaagacaugca

SEQ ID NO: 2031274 - RNA, 11 nt, Homo sapiens
uuacagccaca

SEQ ID NO: 2031275 - RNA, 17 nt, Homo sapiens
ugaaagucccagaucaa

SEQ ID NO: 2031276 - RNA, 13 nt, Homo sapiens
caaguacugcgca

SEQ ID NO: 2031277 - RNA, 15 nt, Homo sapiens
aaagccaaaggucua

SEQ ID NO: 2031278 - RNA, 15 nt, Homo sapiens
uugaauauuacuccu

SEQ ID NO: 2031279 - RNA, 19 nt, Homo sapiens
acauuucccccgagcucuu

SEQ ID NO: 2031280 - RNA, 20 nt, Homo sapiens
ucugaggagcuguugaggua

SEQ ID NO: 2031281 - RNA, 17 nt, Homo sapiens
uaggccuuccagugcag

SEQ ID NO: 2031282 - RNA, 18 nt, Homo sapiens
ucaaaugugacauuauau

SEQ ID NO: 2031283 - RNA, 23 nt, Homo sapiens
cccacuuuuuguuguucauuauu

SEQ ID NO: 2031284 - RNA, 18 nt, Homo sapiens
ccgugaggcaaugggagc

SEQ ID NO: 2031285 - RNA, 19 nt, Homo sapiens
aucaauccagcgguucuca

SEQ ID NO: 2031286 - RNA, 20 nt, Homo sapiens
cauguagcuggcaagcugca

SEQ ID NO: 2031287 - RNA, 17 nt, Homo sapiens
uaaaggacugauuugau

SEQ ID NO: 2031288 - RNA, 17 nt, Homo sapiens
aaauucuuuaguacuca

SEQ ID NO: 2031289 - RNA, 20 nt, Homo sapiens
aaaagcaaauagaucaugca

SEQ ID NO: 2031290 - RNA, 19 nt, Homo sapiens
auacaggagucugucucug

SEQ ID NO: 2031291 - RNA, 23 nt, Homo sapiens
gagucgguuagucauugauagaa

SEQ ID NO: 2031292 - RNA, 14 nt, Homo sapiens
auacaccagcaauu

SEQ ID NO: 2031293 - RNA, 23 nt, Homo sapiens
agaauuauauuagucuguuugca

SEQ ID NO: 2031294 - RNA, 17 nt, Homo sapiens
gauuuugcaaucugugu

SEQ ID NO: 2031295 - RNA, 21 nt, Homo sapiens
cuguugaucucaguauuguca

SEQ ID NO: 2031296 - RNA, 13 nt, Homo sapiens
aaguuagcauuuc

SEQ ID NO: 2031297 - RNA, 18 nt, Homo sapiens
ggcaggaacaaacagggc

SEQ ID NO: 2031298 - RNA, 17 nt, Homo sapiens
augacuuuuauacuauu

SEQ ID NO: 2031299 - RNA, 16 nt, Homo sapiens
uccuucuuaacucucu

SEQ ID NO: 2031300 - RNA, 21 nt, Homo sapiens
gaacugcuugugcacuggaug

SEQ ID NO: 2031301 - RNA, 17 nt, Homo sapiens
ucacugaaaucccucua

SEQ ID NO: 2031302 - RNA, 15 nt, Homo sapiens
cucaugcaugcaaau

SEQ ID NO: 2031303 - RNA, 15 nt, Homo sapiens
auaccuggcuuuuac

SEQ ID NO: 2031304 - RNA, 15 nt, Homo sapiens
cuucacuuuccucag

SEQ ID NO: 2031305 - RNA, 18 nt, Homo sapiens
agcaggcauugcuuugcc

SEQ ID NO: 2031306 - RNA, 22 nt, Homo sapiens
ccacucagaacucuccagggag

SEQ ID NO: 2031307 - RNA, 15 nt, Homo sapiens
uuuauuaaugaacug

SEQ ID NO: 2031308 - RNA, 18 nt, Homo sapiens
aauauuuugaauacacau

SEQ ID NO: 2031309 - RNA, 23 nt, Homo sapiens
ccccuucuccccugcacuguaaa

SEQ ID NO: 2031310 - RNA, 16 nt, Homo sapiens
uccuaggggugcgcuc

SEQ ID NO: 2031311 - RNA, 14 nt, Homo sapiens
uaaugacaacacuu

SEQ ID NO: 2031312 - RNA, 22 nt, Homo sapiens
uggcucucagcgccgucgccac

SEQ ID NO: 2031313 - RNA, 18 nt, Homo sapiens
ugcagguuuguuacauag

SEQ ID NO: 2031314 - RNA, 17 nt, Homo sapiens
aaaaugaaaugcauuuu

SEQ ID NO: 2031315 - RNA, 16 nt, Homo sapiens
aguguggaaccacuga

SEQ ID NO: 2031316 - RNA, 23 nt, Homo sapiens
uagggaaugaacuagcuaugaaa

SEQ ID NO: 2031317 - RNA, 15 nt, Homo sapiens
aucagagacuaugua

SEQ ID NO: 2031318 - RNA, 21 nt, Homo sapiens
acagcucugcauacucauuag

SEQ ID NO: 2031319 - RNA, 21 nt, Homo sapiens
augcuaccacugguacuuccu

SEQ ID NO: 2031320 - RNA, 20 nt, Homo sapiens
ggcacugugccugagcucug

SEQ ID NO: 2031321 - RNA, 20 nt, Homo sapiens
aagcgaaauauuacaguagu

SEQ ID NO: 2031322 - RNA, 19 nt, Homo sapiens
gcuggccucucuagcacaa

SEQ ID NO: 2031323 - RNA, 15 nt, Homo sapiens
cagagaggcaagguu

SEQ ID NO: 2031324 - RNA, 15 nt, Homo sapiens
guuccuccugcucua

SEQ ID NO: 2031325 - RNA, 17 nt, Homo sapiens
uuguuaaagagcacugg

SEQ ID NO: 2031326 - RNA, 20 nt, Homo sapiens
uagagucuagaacacaauuu

SEQ ID NO: 2031327 - RNA, 16 nt, Homo sapiens
acaagccuuagcuuuu

SEQ ID NO: 2031328 - RNA, 17 nt, Homo sapiens
gagaccuuuucaacuug

SEQ ID NO: 2031329 - RNA, 18 nt, Homo sapiens
ugcacccaucagcacucu

SEQ ID NO: 2031330 - RNA, 22 nt, Homo sapiens
cgugccugaucugcacauuuca

SEQ ID NO: 2031331 - RNA, 12 nt, Homo sapiens
uggagugauagc

SEQ ID NO: 2031332 - RNA, 16 nt, Homo sapiens
cucuuaaugcuguguu

SEQ ID NO: 2031333 - RNA, 19 nt, Homo sapiens
cucaauuguauaguuauau

SEQ ID NO: 2031334 - RNA, 20 nt, Homo sapiens
uuaaacccugccccacuucu

SEQ ID NO: 2031335 - RNA, 12 nt, Homo sapiens
auaugcugcauu

SEQ ID NO: 2031336 - RNA, 16 nt, Homo sapiens
agccuggacugcuacc

SEQ ID NO: 2031337 - RNA, 20 nt, Homo sapiens
agcguccacucuucaugccu

SEQ ID NO: 2031338 - RNA, 15 nt, Homo sapiens
ucucacagaggcagu

SEQ ID NO: 2031339 - RNA, 22 nt, Homo sapiens
acacccccaugacauugcauuu

SEQ ID NO: 2031340 - RNA, 17 nt, Homo sapiens
aguuugagacuauggaa

SEQ ID NO: 2031341 - RNA, 16 nt, Homo sapiens
cauuuauagaugucag

SEQ ID NO: 2031342 - RNA, 21 nt, Homo sapiens
caacacaguuuugaccuaaca

SEQ ID NO: 2031343 - RNA, 18 nt, Homo sapiens
ccucaaaaugacagccau

SEQ ID NO: 2031344 - RNA, 18 nt, Homo sapiens
uuacacugaucaauuuca

SEQ ID NO: 2031345 - RNA, 18 nt, Homo sapiens
cugcccacccacuccuua

SEQ ID NO: 2031346 - RNA, 21 nt, Homo sapiens
gggauuuauuuucaauuaaua

SEQ ID NO: 2031347 - RNA, 22 nt, Homo sapiens
acagccugucuugucaggugga

SEQ ID NO: 2031348 - RNA, 23 nt, Homo sapiens
ggaaucagugaagccaaagggac

SEQ ID NO: 2031349 - RNA, 19 nt, Homo sapiens
uccggccccuccugugacg

SEQ ID NO: 2031350 - RNA, 12 nt, Homo sapiens
caggcuugccug

SEQ ID NO: 2031351 - RNA, 18 nt, Homo sapiens
caaggauuuuguaagaag

SEQ ID NO: 2031352 - RNA, 16 nt, Homo sapiens
uuccauugccuagcuc

SEQ ID NO: 2031353 - RNA, 20 nt, Homo sapiens
aaccauuucagccaaacugu

SEQ ID NO: 2031354 - RNA, 23 nt, Homo sapiens
uguuuuuuuuuuaaaaaagacau

SEQ ID NO: 2031355 - RNA, 16 nt, Homo sapiens
gggucuuugaacccuu

SEQ ID NO: 2031356 - RNA, 13 nt, Homo sapiens
agcucaucucagc

SEQ ID NO: 2031357 - RNA, 19 nt, Homo sapiens
uuauuguccuuugauucca

SEQ ID NO: 2031358 - RNA, 16 nt, Homo sapiens
ugacauagcacuugcc

SEQ ID NO: 2031359 - RNA, 21 nt, Homo sapiens
guuuagacaguaugagucaau

SEQ ID NO: 2031360 - RNA, 13 nt, Homo sapiens
uguguucagugcc

SEQ ID NO: 2031361 - RNA, 19 nt, Homo sapiens
cguggugugucaaugccac

SEQ ID NO: 2031362 - RNA, 13 nt, Homo sapiens
uggccuccaaaau

SEQ ID NO: 2031363 - RNA, 17 nt, Homo sapiens
accugaccccagugaau

SEQ ID NO: 2031364 - RNA, 18 nt, Homo sapiens
cugcagucgcuugccaaa

SEQ ID NO: 2031365 - RNA, 12 nt, Homo sapiens
gggcuggcacag

SEQ ID NO: 2031366 - RNA, 19 nt, Homo sapiens
uagagauguugagucuuau

SEQ ID NO: 2031367 - RNA, 22 nt, Homo sapiens
gaagugaccgcaccucacacuc

SEQ ID NO: 2031368 - RNA, 19 nt, Homo sapiens
uguucuuuagaugguggca

SEQ ID NO: 2031369 - RNA, 20 nt, Homo sapiens
ugcccuguuuccaaugccaa

SEQ ID NO: 2031370 - RNA, 18 nt, Homo sapiens
uguauuacaaauggugaa

SEQ ID NO: 2031371 - RNA, 21 nt, Homo sapiens
caucgauauguauaucauucu

SEQ ID NO: 2031372 - RNA, 18 nt, Homo sapiens
uggagcuccugcuggaug

SEQ ID NO: 2031373 - RNA, 16 nt, Homo sapiens
guagaaacucagcaga

SEQ ID NO: 2031374 - RNA, 22 nt, Homo sapiens
uuugcguacacagagaaggcua

SEQ ID NO: 2031375 - RNA, 19 nt, Homo sapiens
cuuuaguccuucugccauu

SEQ ID NO: 2031376 - RNA, 18 nt, Homo sapiens
agcacugaaaauaguguu

SEQ ID NO: 2031377 - RNA, 18 nt, Homo sapiens
cuuuuuuuucuucaccuc

SEQ ID NO: 2031378 - RNA, 17 nt, Homo sapiens
gcgcagggcuggcacgu

SEQ ID NO: 2031379 - RNA, 18 nt, Homo sapiens
uaaauacuuuaacuucca

SEQ ID NO: 2031380 - RNA, 14 nt, Homo sapiens
auauauacacacac

SEQ ID NO: 2031381 - RNA, 14 nt, Homo sapiens
acacacacauauau

SEQ ID NO: 2031382 - RNA, 20 nt, Homo sapiens
ucaucccguaucacaguguu

SEQ ID NO: 2031383 - RNA, 20 nt, Homo sapiens
acaucaucaaggcacugccu

SEQ ID NO: 2031384 - RNA, 17 nt, Homo sapiens
aucgugaucacugagcc

SEQ ID NO: 2031385 - RNA, 15 nt, Homo sapiens
uggcugaccccaaag

SEQ ID NO: 2031386 - RNA, 16 nt, Homo sapiens
cacuuauucucaagaa

SEQ ID NO: 2031387 - RNA, 19 nt, Homo sapiens
gaaucccuggcaaagggag

SEQ ID NO: 2031388 - RNA, 15 nt, Homo sapiens
gagacuugggggcca

SEQ ID NO: 2031389 - RNA, 19 nt, Homo sapiens
agagaacgggaguggccau

SEQ ID NO: 2031390 - RNA, 19 nt, Homo sapiens
acccagcggcucuagccac

SEQ ID NO: 2031391 - RNA, 15 nt, Homo sapiens
ugaacuucaguaugu

SEQ ID NO: 2031392 - RNA, 18 nt, Homo sapiens
cuucucuggauaagugac

SEQ ID NO: 2031393 - RNA, 13 nt, Homo sapiens
cagaggcuuuaaa

SEQ ID NO: 2031394 - RNA, 14 nt, Homo sapiens
agcaagugcacaug

SEQ ID NO: 2031395 - RNA, 20 nt, Homo sapiens
cccacaggagcauguccuau

SEQ ID NO: 2031396 - RNA, 22 nt, Homo sapiens
ucacaggacgauuucacugaca

SEQ ID NO: 2031397 - RNA, 23 nt, Homo sapiens
agguccuuguuuuguuuuguuca

SEQ ID NO: 2031398 - RNA, 12 nt, Homo sapiens
aaggaaacacuu

SEQ ID NO: 2031399 - RNA, 11 nt, Homo sapiens
cugcuguggaa

SEQ ID NO: 2031400 - RNA, 20 nt, Homo sapiens
aauaagucccgcauauacuu

SEQ ID NO: 2031401 - RNA, 15 nt, Homo sapiens
accagggacagagcu

SEQ ID NO: 2031402 - RNA, 14 nt, Homo sapiens
auacugaguaugug

SEQ ID NO: 2031403 - RNA, 17 nt, Homo sapiens
uguggaaauagaugugc

SEQ ID NO: 2031404 - RNA, 23 nt, Homo sapiens
ucagcccgggacagggucuugca

SEQ ID NO: 2031405 - RNA, 12 nt, Homo sapiens
cugggcugagga

SEQ ID NO: 2031406 - RNA, 19 nt, Homo sapiens
aaagguuaugaaacauauc

SEQ ID NO: 2031407 - RNA, 24 nt, Homo sapiens
gacucacuguguggccucagagaa

SEQ ID NO: 2031408 - RNA, 12 nt, Homo sapiens
gaacuuucuccc

SEQ ID NO: 2031409 - RNA, 19 nt, Homo sapiens
agcuggcagccuccagugg

SEQ ID NO: 2031410 - RNA, 14 nt, Homo sapiens
acuauauuugcuag

SEQ ID NO: 2031411 - RNA, 16 nt, Homo sapiens
cagcuaggcugagaug

SEQ ID NO: 2031412 - RNA, 20 nt, Homo sapiens
cccacgggugccaugaagug

SEQ ID NO: 2031413 - RNA, 23 nt, Homo sapiens
gaaaccuucagauuuguguuaua

SEQ ID NO: 2031414 - RNA, 21 nt, Homo sapiens
gcauguggaaaugacccaaac

SEQ ID NO: 2031415 - RNA, 16 nt, Homo sapiens
uguccuucuccaucua

SEQ ID NO: 2031416 - RNA, 19 nt, Homo sapiens
agcuagcagaucucuuccc

SEQ ID NO: 2031417 - RNA, 16 nt, Homo sapiens
ugggcaugccauuaca

SEQ ID NO: 2031418 - RNA, 23 nt, Homo sapiens
aagaagcugguggagcagagugu

SEQ ID NO: 2031419 - RNA, 16 nt, Homo sapiens
aggagaguacauggca

SEQ ID NO: 2031420 - RNA, 19 nt, Homo sapiens
aaucaaaaucucuccacuu

SEQ ID NO: 2031421 - RNA, 13 nt, Homo sapiens
uuucuuucugcca

SEQ ID NO: 2031422 - RNA, 13 nt, Homo sapiens
cacacacauggau

SEQ ID NO: 2031423 - RNA, 13 nt, Homo sapiens
ugcacacacagau

SEQ ID NO: 2031424 - RNA, 22 nt, Homo sapiens
gaaauuuaaacuauaagcaaga

SEQ ID NO: 2031425 - RNA, 15 nt, Homo sapiens
gaguucagcaaagag

SEQ ID NO: 2031426 - RNA, 16 nt, Homo sapiens
ugcacuugaacacuga

SEQ ID NO: 2031427 - RNA, 16 nt, Homo sapiens
uggguggaaaggugug

SEQ ID NO: 2031428 - RNA, 12 nt, Homo sapiens
uccagcuacaaa

SEQ ID NO: 2031429 - RNA, 12 nt, Homo sapiens
ugauuugaccca

SEQ ID NO: 2031430 - RNA, 23 nt, Homo sapiens
uucauuaaaguauauuuaacuca

SEQ ID NO: 2031431 - RNA, 14 nt, Homo sapiens
cauaaggugcuauc

SEQ ID NO: 2031432 - RNA, 13 nt, Homo sapiens
ugaacagaacaaa

SEQ ID NO: 2031433 - RNA, 20 nt, Homo sapiens
agagccaaagaauauuccau

SEQ ID NO: 2031434 - RNA, 16 nt, Homo sapiens
cucccucuuucuuccc

SEQ ID NO: 2031435 - RNA, 22 nt, Homo sapiens
uuucauacacguaaaugcagaa

SEQ ID NO: 2031436 - RNA, 23 nt, Homo sapiens
accagggaugucuguugaaauaa

SEQ ID NO: 2031437 - RNA, 15 nt, Homo sapiens
aaugggaaaagagau

SEQ ID NO: 2031438 - RNA, 13 nt, Homo sapiens
ugauguuuuagug

SEQ ID NO: 2031439 - RNA, 14 nt, Homo sapiens
ucugugccagagau

SEQ ID NO: 2031440 - RNA, 21 nt, Homo sapiens
guucuuacacaggcuucauca

SEQ ID NO: 2031441 - RNA, 15 nt, Homo sapiens
cuuguucguggguca

SEQ ID NO: 2031442 - RNA, 21 nt, Homo sapiens
auuaaguauuacugaguauua

SEQ ID NO: 2031443 - RNA, 17 nt, Homo sapiens
acaagacccccaggaag

SEQ ID NO: 2031444 - RNA, 19 nt, Homo sapiens
caggaccgccauggugcug

SEQ ID NO: 2031445 - RNA, 17 nt, Homo sapiens
guuuguuuuuuugccac

SEQ ID NO: 2031446 - RNA, 17 nt, Homo sapiens
cuauggaauauacaugu

SEQ ID NO: 2031447 - RNA, 15 nt, Homo sapiens
aucuuugugccucaa

SEQ ID NO: 2031448 - RNA, 22 nt, Homo sapiens
ucaaguagcguuggagacauac

SEQ ID NO: 2031449 - RNA, 22 nt, Homo sapiens
gagacuccacucaggugcacac

SEQ ID NO: 2031450 - RNA, 19 nt, Homo sapiens
acuuuuccauugaccagcu

SEQ ID NO: 2031451 - RNA, 23 nt, Homo sapiens
cuacauacaaacaaugcaaccaa

SEQ ID NO: 2031452 - RNA, 11 nt, Homo sapiens
agacagcugcu

SEQ ID NO: 2031453 - RNA, 23 nt, Homo sapiens
augacccccaucccucauaccau

SEQ ID NO: 2031454 - RNA, 11 nt, Homo sapiens
caaaggcaucu

SEQ ID NO: 2031455 - RNA, 18 nt, Homo sapiens
uaaaaucuugcauggcau

SEQ ID NO: 2031456 - RNA, 19 nt, Homo sapiens
caauauucuuuuguucuaa

SEQ ID NO: 2031457 - RNA, 19 nt, Homo sapiens
agauggaaugggggugugg

SEQ ID NO: 2031458 - RNA, 21 nt, Homo sapiens
gauauauguguauacauacau

SEQ ID NO: 2031459 - RNA, 16 nt, Homo sapiens
gaauucuuuugccaag

SEQ ID NO: 2031460 - RNA, 19 nt, Homo sapiens
cucugaacugcaacacugg

SEQ ID NO: 2031461 - RNA, 15 nt, Homo sapiens
ugcccgcacagcagc

SEQ ID NO: 2031462 - RNA, 15 nt, Homo sapiens
ucaacagcagugagu

SEQ ID NO: 2031463 - RNA, 14 nt, Homo sapiens
gguauggccaaaga

SEQ ID NO: 2031464 - RNA, 16 nt, Homo sapiens
cugagaucagugccua

SEQ ID NO: 2031465 - RNA, 15 nt, Homo sapiens
auugcaacagacugu

SEQ ID NO: 2031466 - RNA, 23 nt, Homo sapiens
caccaugaagcgaaacacagaga

SEQ ID NO: 2031467 - RNA, 15 nt, Homo sapiens
ugaaugcuugccuug

SEQ ID NO: 2031468 - RNA, 21 nt, Homo sapiens
ggaggcugcucggggugcaca

SEQ ID NO: 2031469 - RNA, 17 nt, Homo sapiens
cucugguaugaauucac

SEQ ID NO: 2031470 - RNA, 12 nt, Homo sapiens
ugaagcuuuuau

SEQ ID NO: 2031471 - RNA, 21 nt, Homo sapiens
uccagccacuugacuggcaca

SEQ ID NO: 2031472 - RNA, 17 nt, Homo sapiens
cacagcaagaugaauuu

SEQ ID NO: 2031473 - RNA, 23 nt, Homo sapiens
uguuaugcauagcuuugcacuuc

SEQ ID NO: 2031474 - RNA, 14 nt, Homo sapiens
cugaggcuguagga

SEQ ID NO: 2031475 - RNA, 12 nt, Homo sapiens
uccuagaacuuu

SEQ ID NO: 2031476 - RNA, 12 nt, Homo sapiens
cucagaccugaa

SEQ ID NO: 2031477 - RNA, 15 nt, Homo sapiens
cuguguuugcugagg

SEQ ID NO: 2031478 - RNA, 15 nt, Homo sapiens
uucuccuuuugaacu

SEQ ID NO: 2031479 - RNA, 19 nt, Homo sapiens
auuguuuaaaaaccgaaua

SEQ ID NO: 2031480 - RNA, 16 nt, Homo sapiens
ccugggccguggcaca

SEQ ID NO: 2031481 - RNA, 17 nt, Homo sapiens
uacgagaaaaucugcau

SEQ ID NO: 2031482 - RNA, 13 nt, Homo sapiens
ggaguaugcaaaa

SEQ ID NO: 2031483 - RNA, 19 nt, Homo sapiens
auaauguaaagguuuuuau

SEQ ID NO: 2031484 - RNA, 12 nt, Homo sapiens
cuggaagacacu

SEQ ID NO: 2031485 - RNA, 15 nt, Homo sapiens
aucauguguguccac

SEQ ID NO: 2031486 - RNA, 16 nt, Homo sapiens
agccaggagcucucca

SEQ ID NO: 2031487 - RNA, 15 nt, Homo sapiens
aucuugccugcauga

SEQ ID NO: 2031488 - RNA, 18 nt, Homo sapiens
ugaaguaggcauauauca

SEQ ID NO: 2031489 - RNA, 18 nt, Homo sapiens
ccccuauacaaaacacca

SEQ ID NO: 2031490 - RNA, 23 nt, Homo sapiens
aggccccuggucugcccugggcu

SEQ ID NO: 2031491 - RNA, 18 nt, Homo sapiens
ugugaaaauuuaaucuua

SEQ ID NO: 2031492 - RNA, 16 nt, Homo sapiens
gagcaagugacaugcc

SEQ ID NO: 2031493 - RNA, 11 nt, Homo sapiens
acggaagggau

SEQ ID NO: 2031494 - RNA, 13 nt, Homo sapiens
guuuaacugugca

SEQ ID NO: 2031495 - RNA, 20 nt, Homo sapiens
aguaacuuuguaauuauuug

SEQ ID NO: 2031496 - RNA, 13 nt, Homo sapiens
uuaccuguucucu

SEQ ID NO: 2031497 - RNA, 18 nt, Homo sapiens
cgccccaaaguugcucac

SEQ ID NO: 2031498 - RNA, 23 nt, Homo sapiens
ucucauguucaaagugugacauu

SEQ ID NO: 2031499 - RNA, 22 nt, Homo sapiens
uggacccuuggccuccauuucu

SEQ ID NO: 2031500 - RNA, 20 nt, Homo sapiens
ugccauuuuuugucugugau

SEQ ID NO: 2031501 - RNA, 18 nt, Homo sapiens
aaucagcccagugcaaac

SEQ ID NO: 2031502 - RNA, 17 nt, Homo sapiens
ugacaaaaauauuuucc

SEQ ID NO: 2031503 - RNA, 16 nt, Homo sapiens
gagagucauucaggug

SEQ ID NO: 2031504 - RNA, 23 nt, Homo sapiens
gucuuucugacaucagcagagaa

SEQ ID NO: 2031505 - RNA, 15 nt, Homo sapiens
gaaaucacaagaaca

SEQ ID NO: 2031506 - RNA, 18 nt, Homo sapiens
uaugugcauuauucauaa

SEQ ID NO: 2031507 - RNA, 22 nt, Homo sapiens
ccugauuaacugaggcauccac

SEQ ID NO: 2031508 - RNA, 17 nt, Homo sapiens
accgugguuacuguauu

SEQ ID NO: 2031509 - RNA, 17 nt, Homo sapiens
uagaacugcaauuucca

SEQ ID NO: 2031510 - RNA, 23 nt, Homo sapiens
aacuguuuuguaagugcugcuau

SEQ ID NO: 2031511 - RNA, 13 nt, Homo sapiens
uuacaaaccucuc

SEQ ID NO: 2031512 - RNA, 16 nt, Homo sapiens
uccuuuggcauguuua

SEQ ID NO: 2031513 - RNA, 16 nt, Homo sapiens
ccucuugccaaaucaa

SEQ ID NO: 2031514 - RNA, 19 nt, Homo sapiens
ucucccaacucaagguucu

SEQ ID NO: 2031515 - RNA, 16 nt, Homo sapiens
gcucaagaacacaugu

SEQ ID NO: 2031516 - RNA, 20 nt, Homo sapiens
ggcccagggaaucagggagc

SEQ ID NO: 2031517 - RNA, 20 nt, Homo sapiens
acaauccuuuguucucccaa

SEQ ID NO: 2031518 - RNA, 12 nt, Homo sapiens
caagacuccauc

SEQ ID NO: 2031519 - RNA, 13 nt, Homo sapiens
ucugccaaaguaa

SEQ ID NO: 2031520 - RNA, 14 nt, Homo sapiens
aaugaucuuccaaa

SEQ ID NO: 2031521 - RNA, 13 nt, Homo sapiens
cuauugucaguca

SEQ ID NO: 2031522 - RNA, 19 nt, Homo sapiens
uugccccacuccucuccac

SEQ ID NO: 2031523 - RNA, 18 nt, Homo sapiens
agcaccuacuuacaugca

SEQ ID NO: 2031524 - RNA, 14 nt, Homo sapiens
aggaggcagaaagc

SEQ ID NO: 2031525 - RNA, 20 nt, Homo sapiens
aaccugcccacccacuccuu

SEQ ID NO: 2031526 - RNA, 19 nt, Homo sapiens
augcagcacugcugccuca

SEQ ID NO: 2031527 - RNA, 20 nt, Homo sapiens
gcuuacagaaaugacugccg

SEQ ID NO: 2031528 - RNA, 15 nt, Homo sapiens
gaauuuuaagugcuu

SEQ ID NO: 2031529 - RNA, 19 nt, Homo sapiens
caaaauacuacacauccaa

SEQ ID NO: 2031530 - RNA, 16 nt, Homo sapiens
cauuuacuuugcaagu

SEQ ID NO: 2031531 - RNA, 23 nt, Homo sapiens
agcccuugcacuccuacugaguu

SEQ ID NO: 2031532 - RNA, 15 nt, Homo sapiens
cugcugcuaccagcg

SEQ ID NO: 2031533 - RNA, 21 nt, Homo sapiens
uuaaacugugguccaucucca

SEQ ID NO: 2031534 - RNA, 19 nt, Homo sapiens
ggaucuucccacuuugcca

SEQ ID NO: 2031535 - RNA, 18 nt, Homo sapiens
uuaagauggcuacaccuc

SEQ ID NO: 2031536 - RNA, 17 nt, Homo sapiens
cuggguuucaugagcuu

SEQ ID NO: 2031537 - RNA, 22 nt, Homo sapiens
accgcccuggcuaacaugguga

SEQ ID NO: 2031538 - RNA, 20 nt, Homo sapiens
aaacucuugaccucagguga

SEQ ID NO: 2031539 - RNA, 15 nt, Homo sapiens
aauauugucauuccu

SEQ ID NO: 2031540 - RNA, 18 nt, Homo sapiens
uucgaaaacagaugagaa

SEQ ID NO: 2031541 - RNA, 16 nt, Homo sapiens
gcaguucugaagaaga

SEQ ID NO: 2031542 - RNA, 22 nt, Homo sapiens
uuuuugauuucagguuuguaug

SEQ ID NO: 2031543 - RNA, 10 nt, Homo sapiens
acaugugcuu

SEQ ID NO: 2031544 - RNA, 18 nt, Homo sapiens
uuuaaagccacauuucau

SEQ ID NO: 2031545 - RNA, 15 nt, Homo sapiens
cucccaaaguaccuu

SEQ ID NO: 2031546 - RNA, 16 nt, Homo sapiens
gguaacucccauaucu

SEQ ID NO: 2031547 - RNA, 20 nt, Homo sapiens
gagauucucuggcacucuga

SEQ ID NO: 2031548 - RNA, 15 nt, Homo sapiens
uucgagguggaucac

SEQ ID NO: 2031549 - RNA, 18 nt, Homo sapiens
cuucuugaaaucaaucaa

SEQ ID NO: 2031550 - RNA, 17 nt, Homo sapiens
uauauaguuugugguaa

SEQ ID NO: 2031551 - RNA, 13 nt, Homo sapiens
uauggaaacauuu

SEQ ID NO: 2031552 - RNA, 13 nt, Homo sapiens
ugcagagagggaa

SEQ ID NO: 2031553 - RNA, 22 nt, Homo sapiens
aaccuguucuaccaagcaacaa

SEQ ID NO: 2031554 - RNA, 18 nt, Homo sapiens
guuuaagacuagucccuu

SEQ ID NO: 2031555 - RNA, 22 nt, Homo sapiens
uagggaugccuuucuaguccua

SEQ ID NO: 2031556 - RNA, 20 nt, Homo sapiens
aaccugugcuuucauguuua

SEQ ID NO: 2031557 - RNA, 23 nt, Homo sapiens
uuagacagcaguaguagcucccu

SEQ ID NO: 2031558 - RNA, 12 nt, Homo sapiens
aaagucagucuu

SEQ ID NO: 2031559 - RNA, 19 nt, Homo sapiens
ugcccaggcaaagugcacc

SEQ ID NO: 2031560 - RNA, 17 nt, Homo sapiens
aagggguaauugcauuc

SEQ ID NO: 2031561 - RNA, 21 nt, Homo sapiens
acccccucccugcccccagac

SEQ ID NO: 2031562 - RNA, 21 nt, Homo sapiens
aaggggagucaaguucccugg

SEQ ID NO: 2031563 - RNA, 17 nt, Homo sapiens
caaggaguaacaaaaca

SEQ ID NO: 2031564 - RNA, 15 nt, Homo sapiens
augugcuuauaucau

SEQ ID NO: 2031565 - RNA, 17 nt, Homo sapiens
ggcaugguggcacgugc

SEQ ID NO: 2031566 - RNA, 16 nt, Homo sapiens
ccuccgugcuuccuca

SEQ ID NO: 2031567 - RNA, 16 nt, Homo sapiens
cagacagauagugaaa

SEQ ID NO: 2031568 - RNA, 14 nt, Homo sapiens
ggaucuacacccac

SEQ ID NO: 2031569 - RNA, 15 nt, Homo sapiens
gggugaggaggacaa

SEQ ID NO: 2031570 - RNA, 21 nt, Homo sapiens
aaaucucagcaaugauuacuc

SEQ ID NO: 2031571 - RNA, 20 nt, Homo sapiens
uugguggacgagaaggugcu

SEQ ID NO: 2031572 - RNA, 22 nt, Homo sapiens
guggcuuugcauagcuuucaca

SEQ ID NO: 2031573 - RNA, 13 nt, Homo sapiens
acuuuaaugaacu

SEQ ID NO: 2031574 - RNA, 15 nt, Homo sapiens
cuacuguacuauuua

SEQ ID NO: 2031575 - RNA, 20 nt, Homo sapiens
aacucaaaucgaauagggaa

SEQ ID NO: 2031576 - RNA, 16 nt, Homo sapiens
uugucuuuuacuacaa

SEQ ID NO: 2031577 - RNA, 17 nt, Homo sapiens
ucugagacagcuugucu

SEQ ID NO: 2031578 - RNA, 15 nt, Homo sapiens
ugagggcaguucuga

SEQ ID NO: 2031579 - RNA, 17 nt, Homo sapiens
cuugcauaggcucuuaa

SEQ ID NO: 2031580 - RNA, 17 nt, Homo sapiens
uccuugauacugcucau

SEQ ID NO: 2031581 - RNA, 18 nt, Homo sapiens
uucagaaaucaaacugcu

SEQ ID NO: 2031582 - RNA, 13 nt, Homo sapiens
agguacagagaag

SEQ ID NO: 2031583 - RNA, 18 nt, Homo sapiens
caccuccacccccaagaa

SEQ ID NO: 2031584 - RNA, 21 nt, Homo sapiens
augcacugggguaccacaugg

SEQ ID NO: 2031585 - RNA, 22 nt, Homo sapiens
gaaaaugccaccauccaauaaa

SEQ ID NO: 2031586 - RNA, 16 nt, Homo sapiens
agguggccugcgggga

SEQ ID NO: 2031587 - RNA, 14 nt, Homo sapiens
acugccaagccaug

SEQ ID NO: 2031588 - RNA, 14 nt, Homo sapiens
aaugccaagacaug

SEQ ID NO: 2031589 - RNA, 23 nt, Homo sapiens
agauguuguaagagaagguuuau

SEQ ID NO: 2031590 - RNA, 20 nt, Homo sapiens
gccucagacugcacccagga

SEQ ID NO: 2031591 - RNA, 22 nt, Homo sapiens
cuggacaggcaaagacugcagu

SEQ ID NO: 2031592 - RNA, 18 nt, Homo sapiens
uuccuaugcugcaauaca

SEQ ID NO: 2031593 - RNA, 14 nt, Homo sapiens
gcacuggcaccaag

SEQ ID NO: 2031594 - RNA, 22 nt, Homo sapiens
aguaggugggggaacacugaga

SEQ ID NO: 2031595 - RNA, 14 nt, Homo sapiens
gaacaagcaacaua

SEQ ID NO: 2031596 - RNA, 22 nt, Homo sapiens
acuuucccucugggauuugccc

SEQ ID NO: 2031597 - RNA, 20 nt, Homo sapiens
ucuuuuuuuuaauaaaccau

SEQ ID NO: 2031598 - RNA, 15 nt, Homo sapiens
ccuguagcucaagag

SEQ ID NO: 2031599 - RNA, 15 nt, Homo sapiens
uuuggaaccuaauaa

SEQ ID NO: 2031600 - RNA, 15 nt, Homo sapiens
auauaaaaaaucaug

SEQ ID NO: 2031601 - RNA, 15 nt, Homo sapiens
cuugacauguagcuu

SEQ ID NO: 2031602 - RNA, 15 nt, Homo sapiens
acugaugcuguucuc

SEQ ID NO: 2031603 - RNA, 15 nt, Homo sapiens
aauauucagauauaa

SEQ ID NO: 2031604 - RNA, 21 nt, Homo sapiens
accacagagggcgugugcucg

SEQ ID NO: 2031605 - RNA, 14 nt, Homo sapiens
uagcucuuggggaa

SEQ ID NO: 2031606 - RNA, 14 nt, Homo sapiens
caauaccaaauagc

SEQ ID NO: 2031607 - RNA, 14 nt, Homo sapiens
ucauaauuaaauca

SEQ ID NO: 2031608 - RNA, 15 nt, Homo sapiens
gaagauccagcuuuu

SEQ ID NO: 2031609 - RNA, 21 nt, Homo sapiens
agguuaagacaaacugcauau

SEQ ID NO: 2031610 - RNA, 21 nt, Homo sapiens
aauacaugaagcuucaugcac

SEQ ID NO: 2031611 - RNA, 22 nt, Homo sapiens
ugagcuggguacugacugagau

SEQ ID NO: 2031612 - RNA, 11 nt, Homo sapiens
uuagacacugg

SEQ ID NO: 2031613 - RNA, 18 nt, Homo sapiens
guaguccaccuucauuua

SEQ ID NO: 2031614 - RNA, 21 nt, Homo sapiens
gauuguguugaagaaggguua

SEQ ID NO: 2031615 - RNA, 23 nt, Homo sapiens
auacaacuaagaugaaauauuga

SEQ ID NO: 2031616 - RNA, 18 nt, Homo sapiens
ugaauugaagucaucaua

SEQ ID NO: 2031617 - RNA, 18 nt, Homo sapiens
uugacaguauuaacacua

SEQ ID NO: 2031618 - RNA, 21 nt, Homo sapiens
gcuuguaaaauuucacuuaau

SEQ ID NO: 2031619 - RNA, 12 nt, Homo sapiens
uccuuucuuuuc

SEQ ID NO: 2031620 - RNA, 21 nt, Homo sapiens
cuccccagcccuuugcaggcc

SEQ ID NO: 2031621 - RNA, 16 nt, Homo sapiens
aagugguugcauucua

SEQ ID NO: 2031622 - RNA, 16 nt, Homo sapiens
uauauuuauugugcuu

SEQ ID NO: 2031623 - RNA, 15 nt, Homo sapiens
aauguaaacugccau

SEQ ID NO: 2031624 - RNA, 16 nt, Homo sapiens
uucuguugaaguuuac

SEQ ID NO: 2031625 - RNA, 17 nt, Homo sapiens
gacaaaaauauuuacac

SEQ ID NO: 2031626 - RNA, 22 nt, Homo sapiens
ccuuuucugcuucaauaucuaa

SEQ ID NO: 2031627 - RNA, 14 nt, Homo sapiens
augguagucacuaa

SEQ ID NO: 2031628 - RNA, 14 nt, Homo sapiens
cgguagugccugaa

SEQ ID NO: 2031629 - RNA, 20 nt, Homo sapiens
uccagccugggcaacagagc

SEQ ID NO: 2031630 - RNA, 15 nt, Homo sapiens
uggaggccagugaaa

SEQ ID NO: 2031631 - RNA, 19 nt, Homo sapiens
ugucccaucucuacccccu

SEQ ID NO: 2031632 - RNA, 15 nt, Homo sapiens
uuuaagcagucucac

SEQ ID NO: 2031633 - RNA, 12 nt, Homo sapiens
cucugcugcauc

SEQ ID NO: 2031634 - RNA, 23 nt, Homo sapiens
agagcaggcuggcagcucuccag

SEQ ID NO: 2031635 - RNA, 22 nt, Homo sapiens
gggucucucacuguugcagugg

SEQ ID NO: 2031636 - RNA, 20 nt, Homo sapiens
uggcauuacccucugcagaa

SEQ ID NO: 2031637 - RNA, 20 nt, Homo sapiens
guaccuauuuggugcuagua

SEQ ID NO: 2031638 - RNA, 17 nt, Homo sapiens
gucauaaauuacuguuu

SEQ ID NO: 2031639 - RNA, 15 nt, Homo sapiens
uauuauuugauaucu

SEQ ID NO: 2031640 - RNA, 18 nt, Homo sapiens
uuagaugggcaugguggu

SEQ ID NO: 2031641 - RNA, 19 nt, Homo sapiens
ucugcaauggaaacuuuua

SEQ ID NO: 2031642 - RNA, 11 nt, Homo sapiens
gacaacauguu

SEQ ID NO: 2031643 - RNA, 13 nt, Homo sapiens
acuggacugugug

SEQ ID NO: 2031644 - RNA, 13 nt, Homo sapiens
auguaacugcuga

SEQ ID NO: 2031645 - RNA, 14 nt, Homo sapiens
acccccaucccucg

SEQ ID NO: 2031646 - RNA, 15 nt, Homo sapiens
ggcaggucacuuuac

SEQ ID NO: 2031647 - RNA, 12 nt, Homo sapiens
uaugugcacauc

SEQ ID NO: 2031648 - RNA, 12 nt, Homo sapiens
ucucugcaccug

SEQ ID NO: 2031649 - RNA, 23 nt, Homo sapiens
cccugguggaaugcgggggagca

SEQ ID NO: 2031650 - RNA, 13 nt, Homo sapiens
cuggcugugagca

SEQ ID NO: 2031651 - RNA, 17 nt, Homo sapiens
auguaauagugacagca

SEQ ID NO: 2031652 - RNA, 23 nt, Homo sapiens
aagaauuuguaguaaaccaggcc

SEQ ID NO: 2031653 - RNA, 19 nt, Homo sapiens
gggguucucagacugccaa

SEQ ID NO: 2031654 - RNA, 19 nt, Homo sapiens
auccuggcaaauaauacua

SEQ ID NO: 2031655 - RNA, 16 nt, Homo sapiens
caaaaccaacucucua

SEQ ID NO: 2031656 - RNA, 19 nt, Homo sapiens
uaaaaauacaacacugagc

SEQ ID NO: 2031657 - RNA, 20 nt, Homo sapiens
cauggaaucuacauguguuu

SEQ ID NO: 2031658 - RNA, 19 nt, Homo sapiens
gaccuuaucugugcgugaa

SEQ ID NO: 2031659 - RNA, 13 nt, Homo sapiens
uuuucuugcauug

SEQ ID NO: 2031660 - RNA, 13 nt, Homo sapiens
uaugcuugcuugg

SEQ ID NO: 2031661 - RNA, 19 nt, Homo sapiens
ggaauauaauaugucuuca

SEQ ID NO: 2031662 - RNA, 16 nt, Homo sapiens
ucaucuuugugccaau

SEQ ID NO: 2031663 - RNA, 15 nt, Homo sapiens
ccuucccgggcugca

SEQ ID NO: 2031664 - RNA, 16 nt, Homo sapiens
agacuuuaugcaauaa

SEQ ID NO: 2031665 - RNA, 18 nt, Homo sapiens
accuccaggcuccagcac

SEQ ID NO: 2031666 - RNA, 16 nt, Homo sapiens
aaauuaaacauauuca

SEQ ID NO: 2031667 - RNA, 15 nt, Homo sapiens
agcaccaggacucag

SEQ ID NO: 2031668 - RNA, 19 nt, Homo sapiens
gcuggaagauauuccugag

SEQ ID NO: 2031669 - RNA, 19 nt, Homo sapiens
gcaguccugccucagccuc

SEQ ID NO: 2031670 - RNA, 16 nt, Homo sapiens
cacaauugaguugaag

SEQ ID NO: 2031671 - RNA, 20 nt, Homo sapiens
auuagagcaagaacauucaa

SEQ ID NO: 2031672 - RNA, 18 nt, Homo sapiens
ugagaggguuugagucaa

SEQ ID NO: 2031673 - RNA, 18 nt, Homo sapiens
agcacgauuuugcacaaa

SEQ ID NO: 2031674 - RNA, 22 nt, Homo sapiens
gcgccccccccuccccaugcag

SEQ ID NO: 2031675 - RNA, 14 nt, Homo sapiens
gcugcgacugauga

SEQ ID NO: 2031676 - RNA, 21 nt, Homo sapiens
gauuuggguuuggaaauggag

SEQ ID NO: 2031677 - RNA, 22 nt, Homo sapiens
cucaggggucuuaccuugaacu

SEQ ID NO: 2031678 - RNA, 23 nt, Homo sapiens
cuuccuacacguuagauuugccg

SEQ ID NO: 2031679 - RNA, 20 nt, Homo sapiens
uuaguuuacaauauuaugaa

SEQ ID NO: 2031680 - RNA, 20 nt, Homo sapiens
gccugcuaaggaacaaugcc

SEQ ID NO: 2031681 - RNA, 19 nt, Homo sapiens
auucucucuaacauaacaa

SEQ ID NO: 2031682 - RNA, 16 nt, Homo sapiens
uucuggaaaagcaaaa

SEQ ID NO: 2031683 - RNA, 20 nt, Homo sapiens
cuggcaccuguggccaguac

SEQ ID NO: 2031684 - RNA, 21 nt, Homo sapiens
ugggagagccagcuuugcuau

SEQ ID NO: 2031685 - RNA, 13 nt, Homo sapiens
ucuguuuagugaa

SEQ ID NO: 2031686 - RNA, 19 nt, Homo sapiens
agcaggggugcugggaccu

SEQ ID NO: 2031687 - RNA, 13 nt, Homo sapiens
ccccaucccaguu

SEQ ID NO: 2031688 - RNA, 12 nt, Homo sapiens
caggcaccucac

SEQ ID NO: 2031689 - RNA, 18 nt, Homo sapiens
ugcgugaaugcuggucag

SEQ ID NO: 2031690 - RNA, 15 nt, Homo sapiens
gugaaaaaagcaaau

SEQ ID NO: 2031691 - RNA, 16 nt, Homo sapiens
agguuaaggugcaaua

SEQ ID NO: 2031692 - RNA, 18 nt, Homo sapiens
uaacuucagauguuucca

SEQ ID NO: 2031693 - RNA, 12 nt, Homo sapiens
gucaucaucuca

SEQ ID NO: 2031694 - RNA, 19 nt, Homo sapiens
aacgccccgggcaaagggu

SEQ ID NO: 2031695 - RNA, 16 nt, Homo sapiens
auagaaacaugacacu

SEQ ID NO: 2031696 - RNA, 15 nt, Homo sapiens
guccugacacuauuc

SEQ ID NO: 2031697 - RNA, 12 nt, Homo sapiens
uggcugcaguga

SEQ ID NO: 2031698 - RNA, 16 nt, Homo sapiens
gcggcuuucacugcug

SEQ ID NO: 2031699 - RNA, 21 nt, Homo sapiens
augccaaguacuaaagcaccu

SEQ ID NO: 2031700 - RNA, 18 nt, Homo sapiens
cuuuaaagguaacuucuc

SEQ ID NO: 2031701 - RNA, 14 nt, Homo sapiens
aagaggcuguuaua

SEQ ID NO: 2031702 - RNA, 22 nt, Homo sapiens
auuugcuaaucaaagccagggu

SEQ ID NO: 2031703 - RNA, 13 nt, Homo sapiens
ucacagcauuugc

SEQ ID NO: 2031704 - RNA, 18 nt, Homo sapiens
cuucugucaucuaccuuu

SEQ ID NO: 2031705 - RNA, 16 nt, Homo sapiens
caaaacucaguaucau

SEQ ID NO: 2031706 - RNA, 17 nt, Homo sapiens
gcuggaggaacauuggg

SEQ ID NO: 2031707 - RNA, 13 nt, Homo sapiens
cagugccaccuau

SEQ ID NO: 2031708 - RNA, 18 nt, Homo sapiens
uacauauguuuaucucac

SEQ ID NO: 2031709 - RNA, 16 nt, Homo sapiens
uucuuuugcuuuccuu

SEQ ID NO: 2031710 - RNA, 15 nt, Homo sapiens
uaauguaugcauuca

SEQ ID NO: 2031711 - RNA, 15 nt, Homo sapiens
uacuguaugccuuca

SEQ ID NO: 2031712 - RNA, 17 nt, Homo sapiens
cauguaagccaagucau

SEQ ID NO: 2031713 - RNA, 12 nt, Homo sapiens
ucugacuaggca

SEQ ID NO: 2031714 - RNA, 15 nt, Homo sapiens
acguguuaggcuuua

SEQ ID NO: 2031715 - RNA, 18 nt, Homo sapiens
accaacugugaaaggaac

SEQ ID NO: 2031716 - RNA, 15 nt, Homo sapiens
aauuacuuggcuuuu

SEQ ID NO: 2031717 - RNA, 14 nt, Homo sapiens
ugaguguauucuau

SEQ ID NO: 2031718 - RNA, 21 nt, Homo sapiens
agacgggguuucacuguguua

SEQ ID NO: 2031719 - RNA, 22 nt, Homo sapiens
gggaagggguccugcaggggga

SEQ ID NO: 2031720 - RNA, 17 nt, Homo sapiens
aaccucaagcugcaucu

SEQ ID NO: 2031721 - RNA, 20 nt, Homo sapiens
uagaacaggguuucucagcc

SEQ ID NO: 2031722 - RNA, 22 nt, Homo sapiens
aaggcacacagcaagucagggu

SEQ ID NO: 2031723 - RNA, 13 nt, Homo sapiens
cguguuauauucc

SEQ ID NO: 2031724 - RNA, 22 nt, Homo sapiens
aaaauguaugugucucccaggu

SEQ ID NO: 2031725 - RNA, 18 nt, Homo sapiens
aaagggggcuauucccug

SEQ ID NO: 2031726 - RNA, 16 nt, Homo sapiens
uucaccucuucccaca

SEQ ID NO: 2031727 - RNA, 14 nt, Homo sapiens
aguuuaccuaugua

SEQ ID NO: 2031728 - RNA, 19 nt, Homo sapiens
uucagcgaagucucauggg

SEQ ID NO: 2031729 - RNA, 15 nt, Homo sapiens
aaaaagccugucauu

SEQ ID NO: 2031730 - RNA, 21 nt, Homo sapiens
cacagcuuagaagugcuauaa

SEQ ID NO: 2031731 - RNA, 17 nt, Homo sapiens
auuuuguuggaguauua

SEQ ID NO: 2031732 - RNA, 16 nt, Homo sapiens
aaaagccuguauuuaa

SEQ ID NO: 2031733 - RNA, 11 nt, Homo sapiens
aauccaaaaag

SEQ ID NO: 2031734 - RNA, 21 nt, Homo sapiens
ggagaccccuuguugcacugc

SEQ ID NO: 2031735 - RNA, 13 nt, Homo sapiens
gugugugugcaug

SEQ ID NO: 2031736 - RNA, 21 nt, Homo sapiens
uguugacaauuugccauagca

SEQ ID NO: 2031737 - RNA, 21 nt, Homo sapiens
ggauugcuacuguccuaccca

SEQ ID NO: 2031738 - RNA, 12 nt, Homo sapiens
ccacacauauug

SEQ ID NO: 2031739 - RNA, 22 nt, Homo sapiens
acaucuuuuggaaguuuugcua

SEQ ID NO: 2031740 - RNA, 17 nt, Homo sapiens
uugaugccagcuguacu

SEQ ID NO: 2031741 - RNA, 20 nt, Homo sapiens
gaaucucuucacuacccuga

SEQ ID NO: 2031742 - RNA, 22 nt, Homo sapiens
augcaaggaaggaaagaaagaa

SEQ ID NO: 2031743 - RNA, 21 nt, Homo sapiens
accauuucagaugcaaucacu

SEQ ID NO: 2031744 - RNA, 14 nt, Homo sapiens
aguuaggugggucu

SEQ ID NO: 2031745 - RNA, 21 nt, Homo sapiens
auccugauuccaaauauguau

SEQ ID NO: 2031746 - RNA, 12 nt, Homo sapiens
gugggcaucuca

SEQ ID NO: 2031747 - RNA, 17 nt, Homo sapiens
aggccauucuugcauug

SEQ ID NO: 2031748 - RNA, 22 nt, Homo sapiens
aauuccaucccuaagaauuccc

SEQ ID NO: 2031749 - RNA, 15 nt, Homo sapiens
gcucugagauuucac

SEQ ID NO: 2031750 - RNA, 18 nt, Homo sapiens
uuaaauaauucccuaugc

SEQ ID NO: 2031751 - RNA, 21 nt, Homo sapiens
acuaagaugaaaugcacugua

SEQ ID NO: 2031752 - RNA, 22 nt, Homo sapiens
ugguguaaagccaacacccugu

SEQ ID NO: 2031753 - RNA, 21 nt, Homo sapiens
uaggaagcaugagggcaacua

SEQ ID NO: 2031754 - RNA, 21 nt, Homo sapiens
ccuagcccagcaaaugaucag

SEQ ID NO: 2031755 - RNA, 15 nt, Homo sapiens
aacaaguagcacacu

SEQ ID NO: 2031756 - RNA, 12 nt, Homo sapiens
acuauaaguaau

SEQ ID NO: 2031757 - RNA, 14 nt, Homo sapiens
aaacuucauaugua

SEQ ID NO: 2031758 - RNA, 14 nt, Homo sapiens
gcuucuacugugac

SEQ ID NO: 2031759 - RNA, 17 nt, Homo sapiens
ugggagaaugucaguau

SEQ ID NO: 2031760 - RNA, 23 nt, Homo sapiens
agggaagcgucgccccaguggca

SEQ ID NO: 2031761 - RNA, 22 nt, Homo sapiens
agcagugcuuuucacuacuuug

SEQ ID NO: 2031762 - RNA, 15 nt, Homo sapiens
aaggauuuuggaaac

SEQ ID NO: 2031763 - RNA, 21 nt, Homo sapiens
cugccaggcggcccuggggag

SEQ ID NO: 2031764 - RNA, 20 nt, Homo sapiens
uguagcuuuaaaaccacagc

SEQ ID NO: 2031765 - RNA, 21 nt, Homo sapiens
uggggacacagcaucagcuca

SEQ ID NO: 2031766 - RNA, 20 nt, Homo sapiens
acuuucucuucuacacagca

SEQ ID NO: 2031767 - RNA, 15 nt, Homo sapiens
ugcaaaauacuguac

SEQ ID NO: 2031768 - RNA, 19 nt, Homo sapiens
cuuccuucgcagcuuuuag

SEQ ID NO: 2031769 - RNA, 17 nt, Homo sapiens
aucagcaggcuccaguu

SEQ ID NO: 2031770 - RNA, 12 nt, Homo sapiens
cucaccauagag

SEQ ID NO: 2031771 - RNA, 17 nt, Homo sapiens
guaacuucuuaaucuaa

SEQ ID NO: 2031772 - RNA, 17 nt, Homo sapiens
caacuuaaguauuuaca

SEQ ID NO: 2031773 - RNA, 14 nt, Homo sapiens
uugguacuuuuaug

SEQ ID NO: 2031774 - RNA, 17 nt, Homo sapiens
gauuucugguuguuaug

SEQ ID NO: 2031775 - RNA, 20 nt, Homo sapiens
uuuuguuacaaaaagacaaa

SEQ ID NO: 2031776 - RNA, 15 nt, Homo sapiens
gcuauccaaucucau

SEQ ID NO: 2031777 - RNA, 14 nt, Homo sapiens
auucaacauuugcu

SEQ ID NO: 2031778 - RNA, 22 nt, Homo sapiens
caccuaguggcuguccagugcc

SEQ ID NO: 2031779 - RNA, 22 nt, Homo sapiens
cagguaacaugauuguuugaca

SEQ ID NO: 2031780 - RNA, 22 nt, Homo sapiens
aaccucucugaucuugugcuca

SEQ ID NO: 2031781 - RNA, 16 nt, Homo sapiens
ugcucaccgcccugcu

SEQ ID NO: 2031782 - RNA, 15 nt, Homo sapiens
cauaaacacuucucc

SEQ ID NO: 2031783 - RNA, 14 nt, Homo sapiens
gggcagucauuauc

SEQ ID NO: 2031784 - RNA, 20 nt, Homo sapiens
ugcuucugccguugcugcca

SEQ ID NO: 2031785 - RNA, 21 nt, Homo sapiens
ccucacuaugacacugagcaa

SEQ ID NO: 2031786 - RNA, 20 nt, Homo sapiens
aucucgcuaaagagugaaug

SEQ ID NO: 2031787 - RNA, 19 nt, Homo sapiens
uccgcgggcugacugggcc

SEQ ID NO: 2031788 - RNA, 15 nt, Homo sapiens
cggaacagccaaaga

SEQ ID NO: 2031789 - RNA, 21 nt, Homo sapiens
cucaagaacaaacacugcagu

SEQ ID NO: 2031790 - RNA, 19 nt, Homo sapiens
uaacaaccugggcauuccu

SEQ ID NO: 2031791 - RNA, 18 nt, Homo sapiens
agagcaaugguagcaaaa

SEQ ID NO: 2031792 - RNA, 21 nt, Homo sapiens
accaaaggugugcccuguaca

SEQ ID NO: 2031793 - RNA, 16 nt, Homo sapiens
cuuccuuaugucucca

SEQ ID NO: 2031794 - RNA, 12 nt, Homo sapiens
aauacaaaaauu

SEQ ID NO: 2031795 - RNA, 12 nt, Homo sapiens
uguucaaaugua

SEQ ID NO: 2031796 - RNA, 18 nt, Homo sapiens
guuacccugcauguuggc

SEQ ID NO: 2031797 - RNA, 21 nt, Homo sapiens
cccucacaagcgcucccagcc

SEQ ID NO: 2031798 - RNA, 23 nt, Homo sapiens
uucuggauucaaaugucaguuca

SEQ ID NO: 2031799 - RNA, 17 nt, Homo sapiens
cuuguaaaugugguaaa

SEQ ID NO: 2031800 - RNA, 22 nt, Homo sapiens
aacaucaauguuuauuaguucu

SEQ ID NO: 2031801 - RNA, 16 nt, Homo sapiens
uacauaaagacugugc

SEQ ID NO: 2031802 - RNA, 13 nt, Homo sapiens
cuccucaggguug

SEQ ID NO: 2031803 - RNA, 16 nt, Homo sapiens
gaagacuucaucccuc

SEQ ID NO: 2031804 - RNA, 17 nt, Homo sapiens
cccagcugaaggcagug

SEQ ID NO: 2031805 - RNA, 13 nt, Homo sapiens
uucugugccucag

SEQ ID NO: 2031806 - RNA, 16 nt, Homo sapiens
aggcaggugcagggaa

SEQ ID NO: 2031807 - RNA, 21 nt, Homo sapiens
caggaagcucagccuucuccu

SEQ ID NO: 2031808 - RNA, 23 nt, Homo sapiens
uagcuacauagcagacuuuccca

SEQ ID NO: 2031809 - RNA, 22 nt, Homo sapiens
acucaccuucuagucuuggcca

SEQ ID NO: 2031810 - RNA, 17 nt, Homo sapiens
augccucagucuauucu

SEQ ID NO: 2031811 - RNA, 20 nt, Homo sapiens
uccagcacaaacacaagguc

SEQ ID NO: 2031812 - RNA, 14 nt, Homo sapiens
uagcuccaaagcau

SEQ ID NO: 2031813 - RNA, 16 nt, Homo sapiens
gcuaaagacugaucuc

SEQ ID NO: 2031814 - RNA, 14 nt, Homo sapiens
aggcaaaguacaaa

SEQ ID NO: 2031815 - RNA, 16 nt, Homo sapiens
accgagugaggccaua

SEQ ID NO: 2031816 - RNA, 19 nt, Homo sapiens
gccacucagagcucccuca

SEQ ID NO: 2031817 - RNA, 11 nt, Homo sapiens
uaugcauuuau

SEQ ID NO: 2031818 - RNA, 18 nt, Homo sapiens
cuuguucucacugucugu

SEQ ID NO: 2031819 - RNA, 23 nt, Homo sapiens
ugccuccaaguucaaaacuuauu

SEQ ID NO: 2031820 - RNA, 17 nt, Homo sapiens
ccagaggaauccuggca

SEQ ID NO: 2031821 - RNA, 18 nt, Homo sapiens
ugcugguguuuaugugaa

SEQ ID NO: 2031822 - RNA, 19 nt, Homo sapiens
ucacacagacacacaaaau

SEQ ID NO: 2031823 - RNA, 17 nt, Homo sapiens
gcucuccugggagacaa

SEQ ID NO: 2031824 - RNA, 10 nt, Homo sapiens
acacugagaa

SEQ ID NO: 2031825 - RNA, 18 nt, Homo sapiens
aauuauauggucaauauu

SEQ ID NO: 2031826 - RNA, 14 nt, Homo sapiens
uguugcccagguug

SEQ ID NO: 2031827 - RNA, 16 nt, Homo sapiens
augugaaagaguucug

SEQ ID NO: 2031828 - RNA, 21 nt, Homo sapiens
cccuaaaccaaaaacugaaag

SEQ ID NO: 2031829 - RNA, 15 nt, Homo sapiens
uacguuaccaggcag

SEQ ID NO: 2031830 - RNA, 20 nt, Homo sapiens
acucacauagguagguaucu

SEQ ID NO: 2031831 - RNA, 19 nt, Homo sapiens
aacugaagauccacaaaag

SEQ ID NO: 2031832 - RNA, 13 nt, Homo sapiens
gggccgggaacuu

SEQ ID NO: 2031833 - RNA, 20 nt, Homo sapiens
ugaaaaugcuguauuaguca

SEQ ID NO: 2031834 - RNA, 15 nt, Homo sapiens
cuacuuguaaaggug

SEQ ID NO: 2031835 - RNA, 17 nt, Homo sapiens
aauaaauaugagugcca

SEQ ID NO: 2031836 - RNA, 12 nt, Homo sapiens
cuauaugcauuu

SEQ ID NO: 2031837 - RNA, 22 nt, Homo sapiens
guaaaacaagaaaugcuuugag

SEQ ID NO: 2031838 - RNA, 15 nt, Homo sapiens
caagugcucuuucca

SEQ ID NO: 2031839 - RNA, 16 nt, Homo sapiens
uaacuuuaacuuuuga

SEQ ID NO: 2031840 - RNA, 16 nt, Homo sapiens
aauaaagucauuauua

SEQ ID NO: 2031841 - RNA, 18 nt, Homo sapiens
gcacaccucaugcugagc

SEQ ID NO: 2031842 - RNA, 15 nt, Homo sapiens
ucccucaucuguccc

SEQ ID NO: 2031843 - RNA, 18 nt, Homo sapiens
aagaagucggaaugucau

SEQ ID NO: 2031844 - RNA, 21 nt, Homo sapiens
ucaagggaacuugagcgugaa

SEQ ID NO: 2031845 - RNA, 18 nt, Homo sapiens
auagcuuguacacauaua

SEQ ID NO: 2031846 - RNA, 16 nt, Homo sapiens
aagugcauccaaaggu

SEQ ID NO: 2031847 - RNA, 13 nt, Homo sapiens
cguagccaucucu

SEQ ID NO: 2031848 - RNA, 16 nt, Homo sapiens
aagauaaacacaaaau

SEQ ID NO: 2031849 - RNA, 13 nt, Homo sapiens
agguggugcaaau

SEQ ID NO: 2031850 - RNA, 14 nt, Homo sapiens
auagauguguuauu

SEQ ID NO: 2031851 - RNA, 18 nt, Homo sapiens
cuccccaguccucaggca

SEQ ID NO: 2031852 - RNA, 15 nt, Homo sapiens
aaaacugcucuggaa

SEQ ID NO: 2031853 - RNA, 22 nt, Homo sapiens
acagcaucgugaucacugagcc

SEQ ID NO: 2031854 - RNA, 12 nt, Homo sapiens
ggaaggcaaaug

SEQ ID NO: 2031855 - RNA, 16 nt, Homo sapiens
gauaguuuacugagaa

SEQ ID NO: 2031856 - RNA, 20 nt, Homo sapiens
uuauaauuguucucagaauc

SEQ ID NO: 2031857 - RNA, 19 nt, Homo sapiens
cacagaccugcucuggaca

SEQ ID NO: 2031858 - RNA, 13 nt, Homo sapiens
agcuucaaaaacu

SEQ ID NO: 2031859 - RNA, 15 nt, Homo sapiens
ugcugagugagcgag

SEQ ID NO: 2031860 - RNA, 12 nt, Homo sapiens
uguucacauaua

SEQ ID NO: 2031861 - RNA, 23 nt, Homo sapiens
gggaggaaguuggcugagccauu

SEQ ID NO: 2031862 - RNA, 13 nt, Homo sapiens
ugaugcucaaaau

SEQ ID NO: 2031863 - RNA, 13 nt, Homo sapiens
agcuucucuacag

SEQ ID NO: 2031864 - RNA, 21 nt, Homo sapiens
uuaguuuuucuuacuugcauu

SEQ ID NO: 2031865 - RNA, 21 nt, Homo sapiens
ccugguggagaaagcacugac

SEQ ID NO: 2031866 - RNA, 12 nt, Homo sapiens
uugccaaaacag

SEQ ID NO: 2031867 - RNA, 18 nt, Homo sapiens
uuucacccauuuacacau

SEQ ID NO: 2031868 - RNA, 16 nt, Homo sapiens
auggauuucuuugaaa

SEQ ID NO: 2031869 - RNA, 20 nt, Homo sapiens
ccaaauugaugggugggcua

SEQ ID NO: 2031870 - RNA, 14 nt, Homo sapiens
uguauauuuguaaa

SEQ ID NO: 2031871 - RNA, 14 nt, Homo sapiens
ugcauauuugcaaa

SEQ ID NO: 2031872 - RNA, 16 nt, Homo sapiens
ugcguggacucugcac

SEQ ID NO: 2031873 - RNA, 19 nt, Homo sapiens
acacccccgacggccucca

SEQ ID NO: 2031874 - RNA, 19 nt, Homo sapiens
auaacuuggggaggcaaga

SEQ ID NO: 2031875 - RNA, 22 nt, Homo sapiens
acaugauuccuuccuguucuga

SEQ ID NO: 2031876 - RNA, 12 nt, Homo sapiens
aggguggcagag

SEQ ID NO: 2031877 - RNA, 16 nt, Homo sapiens
ugcccaagcacuucac

SEQ ID NO: 2031878 - RNA, 23 nt, Homo sapiens
cagccucaaguaggaguuuuaua

SEQ ID NO: 2031879 - RNA, 16 nt, Homo sapiens
caguuacugaugcucc

SEQ ID NO: 2031880 - RNA, 17 nt, Homo sapiens
acagaggaccagcacac

SEQ ID NO: 2031881 - RNA, 14 nt, Homo sapiens
gggccuacacccgu

SEQ ID NO: 2031882 - RNA, 15 nt, Homo sapiens
cuauaaaagaauugc

SEQ ID NO: 2031883 - RNA, 15 nt, Homo sapiens
auaaccaacauuuua

SEQ ID NO: 2031884 - RNA, 20 nt, Homo sapiens
ucuuuaaaaguauccagaga

SEQ ID NO: 2031885 - RNA, 14 nt, Homo sapiens
ucuggaaaagcagc

SEQ ID NO: 2031886 - RNA, 16 nt, Homo sapiens
agcagugaucucaggg

SEQ ID NO: 2031887 - RNA, 20 nt, Homo sapiens
ccucaagugccuuauucuca

SEQ ID NO: 2031888 - RNA, 14 nt, Homo sapiens
ucugccuuuguuca

SEQ ID NO: 2031889 - RNA, 17 nt, Homo sapiens
cuaggaaaauuauucua

SEQ ID NO: 2031890 - RNA, 16 nt, Homo sapiens
uauucauuaagcuuuu

SEQ ID NO: 2031891 - RNA, 15 nt, Homo sapiens
ucaugugauccuuuu

SEQ ID NO: 2031892 - RNA, 19 nt, Homo sapiens
uaccuucuuuucuuccuca

SEQ ID NO: 2031893 - RNA, 18 nt, Homo sapiens
cagaugcuacgcuccagc

SEQ ID NO: 2031894 - RNA, 15 nt, Homo sapiens
gucgggagagccagg

SEQ ID NO: 2031895 - RNA, 19 nt, Homo sapiens
ccucaauaaaaaguuuuau

SEQ ID NO: 2031896 - RNA, 23 nt, Homo sapiens
gcuuugcugaccaaaugccuggu

SEQ ID NO: 2031897 - RNA, 21 nt, Homo sapiens
aggugaaaagggguguggcaa

SEQ ID NO: 2031898 - RNA, 17 nt, Homo sapiens
cacuaaugugucaucua

SEQ ID NO: 2031899 - RNA, 13 nt, Homo sapiens
acccaacagugau

SEQ ID NO: 2031900 - RNA, 23 nt, Homo sapiens
auguugcaaagaacuccagaguc

SEQ ID NO: 2031901 - RNA, 13 nt, Homo sapiens
cgacucaccugcg

SEQ ID NO: 2031902 - RNA, 22 nt, Homo sapiens
gucaaaugcccccugagugacu

SEQ ID NO: 2031903 - RNA, 20 nt, Homo sapiens
gauuggauuauucauuuaaa

SEQ ID NO: 2031904 - RNA, 23 nt, Homo sapiens
ggugcugcuuucuuguugcugca

SEQ ID NO: 2031905 - RNA, 14 nt, Homo sapiens
ccugcccuccccca

SEQ ID NO: 2031906 - RNA, 22 nt, Homo sapiens
gcuccaacacuuugagcauuuu

SEQ ID NO: 2031907 - RNA, 18 nt, Homo sapiens
ugguaauaaaccuugaug

SEQ ID NO: 2031908 - RNA, 21 nt, Homo sapiens
ucauucuuguuaauuauacca

SEQ ID NO: 2031909 - RNA, 19 nt, Homo sapiens
caaagauaauguuauacau

SEQ ID NO: 2031910 - RNA, 19 nt, Homo sapiens
ccugucacgccgggcucua

SEQ ID NO: 2031911 - RNA, 14 nt, Homo sapiens
accugaacugaugg

SEQ ID NO: 2031912 - RNA, 14 nt, Homo sapiens
ugcucaccaagaag

SEQ ID NO: 2031913 - RNA, 22 nt, Homo sapiens
accacgccucuugaccaggcug

SEQ ID NO: 2031914 - RNA, 12 nt, Homo sapiens
cacugaguuucu

SEQ ID NO: 2031915 - RNA, 17 nt, Homo sapiens
caaagaguaucaucaac

SEQ ID NO: 2031916 - RNA, 14 nt, Homo sapiens
aaaaaacugaugaa

SEQ ID NO: 2031917 - RNA, 15 nt, Homo sapiens
gcccaauuaccagaa

SEQ ID NO: 2031918 - RNA, 13 nt, Homo sapiens
uggccaucuguau

SEQ ID NO: 2031919 - RNA, 17 nt, Homo sapiens
cccagaacgcaugcagg

SEQ ID NO: 2031920 - RNA, 16 nt, Homo sapiens
auccugagucaugugu

SEQ ID NO: 2031921 - RNA, 19 nt, Homo sapiens
acugguuauggaaggugac

SEQ ID NO: 2031922 - RNA, 18 nt, Homo sapiens
ugcuucccauccuacccu

SEQ ID NO: 2031923 - RNA, 11 nt, Homo sapiens
uuccccugugg

SEQ ID NO: 2031924 - RNA, 16 nt, Homo sapiens
gaaacagaaauagacu

SEQ ID NO: 2031925 - RNA, 13 nt, Homo sapiens
acuuuacuaagua

SEQ ID NO: 2031926 - RNA, 18 nt, Homo sapiens
cuauauaauucucugucu

SEQ ID NO: 2031927 - RNA, 17 nt, Homo sapiens
gacauacauauuaucuc

SEQ ID NO: 2031928 - RNA, 20 nt, Homo sapiens
cuuaacuuaaaauugcuaac

SEQ ID NO: 2031929 - RNA, 18 nt, Homo sapiens
ugguacuuuauucuugcu

SEQ ID NO: 2031930 - RNA, 17 nt, Homo sapiens
gccugaaauuucaccau

SEQ ID NO: 2031931 - RNA, 15 nt, Homo sapiens
caaucucuggugccu

SEQ ID NO: 2031932 - RNA, 17 nt, Homo sapiens
cuaaaacaaaagcucau

SEQ ID NO: 2031933 - RNA, 23 nt, Homo sapiens
caaggcauuugucuuuguaauau

SEQ ID NO: 2031934 - RNA, 22 nt, Homo sapiens
uuaguagagacgagguuucacu

SEQ ID NO: 2031935 - RNA, 15 nt, Homo sapiens
gagauacuucccaaa

SEQ ID NO: 2031936 - RNA, 17 nt, Homo sapiens
cuccaccgccauggcuu

SEQ ID NO: 2031937 - RNA, 17 nt, Homo sapiens
caucaggagcugcucag

SEQ ID NO: 2031938 - RNA, 20 nt, Homo sapiens
ugaucucuuagaagccaugg

SEQ ID NO: 2031939 - RNA, 11 nt, Homo sapiens
guccaucucau

SEQ ID NO: 2031940 - RNA, 13 nt, Homo sapiens
cuuaauucucugc

SEQ ID NO: 2031941 - RNA, 14 nt, Homo sapiens
gcaguucauacuga

SEQ ID NO: 2031942 - RNA, 13 nt, Homo sapiens
cagaaaagcauac

SEQ ID NO: 2031943 - RNA, 18 nt, Homo sapiens
gaucuuaaagcauucccc

SEQ ID NO: 2031944 - RNA, 12 nt, Homo sapiens
uuccaugauuaa

SEQ ID NO: 2031945 - RNA, 12 nt, Homo sapiens
uuacaugauuca

SEQ ID NO: 2031946 - RNA, 15 nt, Homo sapiens
uaaguauugucacca

SEQ ID NO: 2031947 - RNA, 17 nt, Homo sapiens
ugguuaugugcauuauu

SEQ ID NO: 2031948 - RNA, 16 nt, Homo sapiens
ugacaggcuuucccag

SEQ ID NO: 2031949 - RNA, 21 nt, Homo sapiens
agcucugggguuuguaaggca

SEQ ID NO: 2031950 - RNA, 14 nt, Homo sapiens
augugaaggggaga

SEQ ID NO: 2031951 - RNA, 22 nt, Homo sapiens
uccacacaagggaaggacagaa

SEQ ID NO: 2031952 - RNA, 19 nt, Homo sapiens
aaauuuccuccacauucau

SEQ ID NO: 2031953 - RNA, 14 nt, Homo sapiens
cucucuucucucca

SEQ ID NO: 2031954 - RNA, 19 nt, Homo sapiens
caguacaugggaaaggagg

SEQ ID NO: 2031955 - RNA, 21 nt, Homo sapiens
gauaggaagacgcagagcaaa

SEQ ID NO: 2031956 - RNA, 11 nt, Homo sapiens
agggugguggu

SEQ ID NO: 2031957 - RNA, 14 nt, Homo sapiens
uugucccucugcua

SEQ ID NO: 2031958 - RNA, 18 nt, Homo sapiens
caucccugaaacauugca

SEQ ID NO: 2031959 - RNA, 15 nt, Homo sapiens
agugccaucccacau

SEQ ID NO: 2031960 - RNA, 18 nt, Homo sapiens
ugaucaucgaggagcuag

SEQ ID NO: 2031961 - RNA, 17 nt, Homo sapiens
auuuuacaugacagaua

SEQ ID NO: 2031962 - RNA, 20 nt, Homo sapiens
agaacuuugcauagcagcug

SEQ ID NO: 2031963 - RNA, 13 nt, Homo sapiens
cucuaacccagug

SEQ ID NO: 2031964 - RNA, 14 nt, Homo sapiens
cuguaugaacuuua

SEQ ID NO: 2031965 - RNA, 19 nt, Homo sapiens
cuacccuuccagugcccua

SEQ ID NO: 2031966 - RNA, 22 nt, Homo sapiens
agugaucacgacaaucacacaa

SEQ ID NO: 2031967 - RNA, 16 nt, Homo sapiens
uagcccuugcugccac

SEQ ID NO: 2031968 - RNA, 15 nt, Homo sapiens
gauccuguuggacac

SEQ ID NO: 2031969 - RNA, 23 nt, Homo sapiens
agauccuuucuccacacagcaau

SEQ ID NO: 2031970 - RNA, 20 nt, Homo sapiens
acuuucugauuggugauuca

SEQ ID NO: 2031971 - RNA, 20 nt, Homo sapiens
gaccaggcaaagcaagugau

SEQ ID NO: 2031972 - RNA, 16 nt, Homo sapiens
uugccaaaaacaaaaa

SEQ ID NO: 2031973 - RNA, 16 nt, Homo sapiens
gaccuaaacauuauuu

SEQ ID NO: 2031974 - RNA, 23 nt, Homo sapiens
cucacaaugucccuucagcaccu

SEQ ID NO: 2031975 - RNA, 19 nt, Homo sapiens
aacacgugacacaaacaca

SEQ ID NO: 2031976 - RNA, 23 nt, Homo sapiens
ugccguucgcugagucccagcaa

SEQ ID NO: 2031977 - RNA, 21 nt, Homo sapiens
uccaugcaucacuauucagaa

SEQ ID NO: 2031978 - RNA, 23 nt, Homo sapiens
acccacaugugacacauaugcac

SEQ ID NO: 2031979 - RNA, 12 nt, Homo sapiens
uuggcaugccuu

SEQ ID NO: 2031980 - RNA, 21 nt, Homo sapiens
cuugaaaguuuucuaaacuca

SEQ ID NO: 2031981 - RNA, 14 nt, Homo sapiens
uguucaacugugag

SEQ ID NO: 2031982 - RNA, 22 nt, Homo sapiens
acucacuguguggccucagaga

SEQ ID NO: 2031983 - RNA, 20 nt, Homo sapiens
uaugugucacacuuugccaa

SEQ ID NO: 2031984 - RNA, 13 nt, Homo sapiens
cuuuccaucccag

SEQ ID NO: 2031985 - RNA, 22 nt, Homo sapiens
uggcucaugccucuaaucucag

SEQ ID NO: 2031986 - RNA, 15 nt, Homo sapiens
aaccaggaaauggaa

SEQ ID NO: 2031987 - RNA, 19 nt, Homo sapiens
aacauauccuuucaagaca

SEQ ID NO: 2031988 - RNA, 17 nt, Homo sapiens
auuauuuuagucuguca

SEQ ID NO: 2031989 - RNA, 12 nt, Homo sapiens
cuguagauuuaa

SEQ ID NO: 2031990 - RNA, 16 nt, Homo sapiens
ugaccuuuuaaucaga

SEQ ID NO: 2031991 - RNA, 19 nt, Homo sapiens
agccaagaucacgccauug

SEQ ID NO: 2031992 - RNA, 15 nt, Homo sapiens
auagagugcauuuga

SEQ ID NO: 2031993 - RNA, 19 nt, Homo sapiens
uauguauauguauaucuau

SEQ ID NO: 2031994 - RNA, 22 nt, Homo sapiens
acgagccuauuucucuuugcac

SEQ ID NO: 2031995 - RNA, 14 nt, Homo sapiens
gcccagcacugucu

SEQ ID NO: 2031996 - RNA, 19 nt, Homo sapiens
cuggagugcaguggcacga

SEQ ID NO: 2031997 - RNA, 18 nt, Homo sapiens
agcucaauaaaagaaucu

SEQ ID NO: 2031998 - RNA, 13 nt, Homo sapiens
acaagccaagaaa

SEQ ID NO: 2031999 - RNA, 22 nt, Homo sapiens
cacuuaaggggggaugucuuga

SEQ ID NO: 2032000 - RNA, 18 nt, Homo sapiens
gaaaucugccuaugucau

SEQ ID NO: 2032001 - RNA, 14 nt, Homo sapiens
aaugucucccacac

SEQ ID NO: 2032002 - RNA, 20 nt, Homo sapiens
gugcaagaugaaugcagauu

SEQ ID NO: 2032003 - RNA, 18 nt, Homo sapiens
cuaaagauugcagcauuu

SEQ ID NO: 2032004 - RNA, 22 nt, Homo sapiens
auuuuaaagaaagccacacaga

SEQ ID NO: 2032005 - RNA, 11 nt, Homo sapiens
gacugucuaua

SEQ ID NO: 2032006 - RNA, 19 nt, Homo sapiens
auagggagcagaugcaaug

SEQ ID NO: 2032007 - RNA, 18 nt, Homo sapiens
auguauguuucugcauag

SEQ ID NO: 2032008 - RNA, 19 nt, Homo sapiens
cucuuuugaauccaugcuu

SEQ ID NO: 2032009 - RNA, 18 nt, Homo sapiens
cuuuccacuccaaccaga

SEQ ID NO: 2032010 - RNA, 17 nt, Homo sapiens
gaagagaaugugacagg

SEQ ID NO: 2032011 - RNA, 18 nt, Homo sapiens
uccaaacccaaccuuuca

SEQ ID NO: 2032012 - RNA, 14 nt, Homo sapiens
acacugaagccaca

SEQ ID NO: 2032013 - RNA, 14 nt, Homo sapiens
aggcacuguucaau

SEQ ID NO: 2032014 - RNA, 12 nt, Homo sapiens
acuucccaagga

SEQ ID NO: 2032015 - RNA, 17 nt, Homo sapiens
gugacauuugucauuuu

SEQ ID NO: 2032016 - RNA, 18 nt, Homo sapiens
uggaaugagcagcuuuag

SEQ ID NO: 2032017 - RNA, 21 nt, Homo sapiens
gucagaggagagauagccugu

SEQ ID NO: 2032018 - RNA, 11 nt, Homo sapiens
cccagcauuug

SEQ ID NO: 2032019 - RNA, 13 nt, Homo sapiens
ggcccagccuugu

SEQ ID NO: 2032020 - RNA, 23 nt, Homo sapiens
guggucacaacuugauggcugcg

SEQ ID NO: 2032021 - RNA, 23 nt, Homo sapiens
ucuuccuuucuugucuuuccucc

SEQ ID NO: 2032022 - RNA, 16 nt, Homo sapiens
agugagaacagcauuu

SEQ ID NO: 2032023 - RNA, 18 nt, Homo sapiens
cuagcuaaucucuacaaa

SEQ ID NO: 2032024 - RNA, 12 nt, Homo sapiens
cugguagcacau

SEQ ID NO: 2032025 - RNA, 16 nt, Homo sapiens
uauguccauucacuuu

SEQ ID NO: 2032026 - RNA, 15 nt, Homo sapiens
ugucaauaguauuaa

SEQ ID NO: 2032027 - RNA, 13 nt, Homo sapiens
uauauuguucaaa

SEQ ID NO: 2032028 - RNA, 23 nt, Homo sapiens
cgauaaagaacacgaauugcuca

SEQ ID NO: 2032029 - RNA, 15 nt, Homo sapiens
aggaauaaaugccuu

SEQ ID NO: 2032030 - RNA, 14 nt, Homo sapiens
uuuaugaaguuaaa

SEQ ID NO: 2032031 - RNA, 15 nt, Homo sapiens
cauuuaauuugaaau

SEQ ID NO: 2032032 - RNA, 19 nt, Homo sapiens
ugcugaggccacccacuga

SEQ ID NO: 2032033 - RNA, 18 nt, Homo sapiens
ccuccuggcucacagcca

SEQ ID NO: 2032034 - RNA, 17 nt, Homo sapiens
ggagaaaugacuuugaa

SEQ ID NO: 2032035 - RNA, 18 nt, Homo sapiens
augucuucuguauucacu

SEQ ID NO: 2032036 - RNA, 22 nt, Homo sapiens
ucagagcacagccaaucuccag

SEQ ID NO: 2032037 - RNA, 18 nt, Homo sapiens
uaacacguccacuuucaa

SEQ ID NO: 2032038 - RNA, 15 nt, Homo sapiens
agcuuccacaagaca

SEQ ID NO: 2032039 - RNA, 23 nt, Homo sapiens
agguugucugaagucacugcaca

SEQ ID NO: 2032040 - RNA, 19 nt, Homo sapiens
acgugauaaugcagauaaa

SEQ ID NO: 2032041 - RNA, 15 nt, Homo sapiens
augcugccaaccagc

SEQ ID NO: 2032042 - RNA, 21 nt, Homo sapiens
gguuugacacgcaguugcucg

SEQ ID NO: 2032043 - RNA, 15 nt, Homo sapiens
cuuccugcaguguuu

SEQ ID NO: 2032044 - RNA, 17 nt, Homo sapiens
aagccauugagcucucc

SEQ ID NO: 2032045 - RNA, 20 nt, Homo sapiens
ucaacuguugauugcaggaa

SEQ ID NO: 2032046 - RNA, 14 nt, Homo sapiens
agcagcuccaaaac

SEQ ID NO: 2032047 - RNA, 17 nt, Homo sapiens
caaguaucacacuuuaa

SEQ ID NO: 2032048 - RNA, 16 nt, Homo sapiens
aacucagaaacaucag

SEQ ID NO: 2032049 - RNA, 23 nt, Homo sapiens
acauagccuauauuuacagugaa

SEQ ID NO: 2032050 - RNA, 13 nt, Homo sapiens
uucgcacacugug

SEQ ID NO: 2032051 - RNA, 20 nt, Homo sapiens
cugcacuccagccugggcaa

SEQ ID NO: 2032052 - RNA, 14 nt, Homo sapiens
ggcacaugcugagu

SEQ ID NO: 2032053 - RNA, 20 nt, Homo sapiens
ugcuuacaauucccugcugu

SEQ ID NO: 2032054 - RNA, 12 nt, Homo sapiens
caaaacauucca

SEQ ID NO: 2032055 - RNA, 18 nt, Homo sapiens
accuugggucugugucac

SEQ ID NO: 2032056 - RNA, 17 nt, Homo sapiens
agggcagcuuugcaaaa

SEQ ID NO: 2032057 - RNA, 18 nt, Homo sapiens
ucugauucugauugcuau

SEQ ID NO: 2032058 - RNA, 22 nt, Homo sapiens
uauuuuuggguuuggccaggga

SEQ ID NO: 2032059 - RNA, 19 nt, Homo sapiens
gacucuccagaaagcucau

SEQ ID NO: 2032060 - RNA, 20 nt, Homo sapiens
ucuguauucgaaaugagcuc

SEQ ID NO: 2032061 - RNA, 15 nt, Homo sapiens
cauugccuucucugc

SEQ ID NO: 2032062 - RNA, 14 nt, Homo sapiens
aaauugugggucua

SEQ ID NO: 2032063 - RNA, 16 nt, Homo sapiens
aauuuaaaauaauuau

SEQ ID NO: 2032064 - RNA, 17 nt, Homo sapiens
acugcaggagcaguuug

SEQ ID NO: 2032065 - RNA, 14 nt, Homo sapiens
ucagaguagaacca

SEQ ID NO: 2032066 - RNA, 13 nt, Homo sapiens
uacuacauuauua

SEQ ID NO: 2032067 - RNA, 17 nt, Homo sapiens
aauacacuggaauucag

SEQ ID NO: 2032068 - RNA, 15 nt, Homo sapiens
gaagaaauucuguca

SEQ ID NO: 2032069 - RNA, 14 nt, Homo sapiens
gcaagucuugucag

SEQ ID NO: 2032070 - RNA, 20 nt, Homo sapiens
gacgguaaguguucucauga

SEQ ID NO: 2032071 - RNA, 21 nt, Homo sapiens
gccucccccucagaugaucuc

SEQ ID NO: 2032072 - RNA, 20 nt, Homo sapiens
aaagacaauucuuuauacaa

SEQ ID NO: 2032073 - RNA, 16 nt, Homo sapiens
uguuuaaacugaguag

SEQ ID NO: 2032074 - RNA, 15 nt, Homo sapiens
aaggcagcucugucg

SEQ ID NO: 2032075 - RNA, 21 nt, Homo sapiens
ggaccucugacagcagcaucu

SEQ ID NO: 2032076 - RNA, 19 nt, Homo sapiens
ccucugauacccagagcau

SEQ ID NO: 2032077 - RNA, 20 nt, Homo sapiens
gaagugacugauguucccuc

SEQ ID NO: 2032078 - RNA, 23 nt, Homo sapiens
gaaaggggccccaccggggucua

SEQ ID NO: 2032079 - RNA, 14 nt, Homo sapiens
ugccuauaaaggaa

SEQ ID NO: 2032080 - RNA, 19 nt, Homo sapiens
ugacagaaagcaaggacau

SEQ ID NO: 2032081 - RNA, 20 nt, Homo sapiens
ccucugucaacaucaaagag

SEQ ID NO: 2032082 - RNA, 17 nt, Homo sapiens
ggacugugaggccauac

SEQ ID NO: 2032083 - RNA, 15 nt, Homo sapiens
acagucaucugccac

SEQ ID NO: 2032084 - RNA, 20 nt, Homo sapiens
cuccacaaagcaaaggcagu

SEQ ID NO: 2032085 - RNA, 18 nt, Homo sapiens
guccuacucugugucagg

SEQ ID NO: 2032086 - RNA, 18 nt, Homo sapiens
cugcuauuugcuguuauu

SEQ ID NO: 2032087 - RNA, 12 nt, Homo sapiens
aaacuucaccua

SEQ ID NO: 2032088 - RNA, 23 nt, Homo sapiens
cacuguugguguucggagcucuu

SEQ ID NO: 2032089 - RNA, 19 nt, Homo sapiens
uuagacaucuuugcuuaug

SEQ ID NO: 2032090 - RNA, 18 nt, Homo sapiens
uacaacccgguucacucu

SEQ ID NO: 2032091 - RNA, 15 nt, Homo sapiens
aaugaacuaacugcc

SEQ ID NO: 2032092 - RNA, 19 nt, Homo sapiens
ucugcauuucuuaccagug

SEQ ID NO: 2032093 - RNA, 14 nt, Homo sapiens
ucucugacaaagug

SEQ ID NO: 2032094 - RNA, 22 nt, Homo sapiens
gagcugccaagagugaagggaa

SEQ ID NO: 2032095 - RNA, 18 nt, Homo sapiens
caguaaaguucauccuuu

SEQ ID NO: 2032096 - RNA, 20 nt, Homo sapiens
aacagaaguugaagcacaac

SEQ ID NO: 2032097 - RNA, 14 nt, Homo sapiens
ccuuguaguucuca

SEQ ID NO: 2032098 - RNA, 17 nt, Homo sapiens
accaauggcugcaucaa

SEQ ID NO: 2032099 - RNA, 14 nt, Homo sapiens
cguccuccaccggu

SEQ ID NO: 2032100 - RNA, 12 nt, Homo sapiens
uuucaaguugca

SEQ ID NO: 2032101 - RNA, 18 nt, Homo sapiens
uggaaauuaaacccugcc

SEQ ID NO: 2032102 - RNA, 17 nt, Homo sapiens
aaaaagaaaucuguuuc

SEQ ID NO: 2032103 - RNA, 16 nt, Homo sapiens
gcccugggucuugcca

SEQ ID NO: 2032104 - RNA, 14 nt, Homo sapiens
auuuucugauguau

SEQ ID NO: 2032105 - RNA, 12 nt, Homo sapiens
gaaagaacauca

SEQ ID NO: 2032106 - RNA, 18 nt, Homo sapiens
cuguaugguccauagcac

SEQ ID NO: 2032107 - RNA, 21 nt, Homo sapiens
ugaugcugggauuuacacuug

SEQ ID NO: 2032108 - RNA, 22 nt, Homo sapiens
caaaugggguuucacaaauagu

SEQ ID NO: 2032109 - RNA, 14 nt, Homo sapiens
uggauccacugugc

SEQ ID NO: 2032110 - RNA, 16 nt, Homo sapiens
aagcaguugcaaugau

SEQ ID NO: 2032111 - RNA, 22 nt, Homo sapiens
cccuguagccuauacaguuuag

SEQ ID NO: 2032112 - RNA, 18 nt, Homo sapiens
uguguuaguaaacugugc

SEQ ID NO: 2032113 - RNA, 23 nt, Homo sapiens
ccacauuuagauccugguuucau

SEQ ID NO: 2032114 - RNA, 22 nt, Homo sapiens
ucuuaguuacuuuggaacacua

SEQ ID NO: 2032115 - RNA, 15 nt, Homo sapiens
uuuccugugccaacc

SEQ ID NO: 2032116 - RNA, 21 nt, Homo sapiens
cgugggcaucucaagccccaa

SEQ ID NO: 2032117 - RNA, 18 nt, Homo sapiens
acugggcugggccucgug

SEQ ID NO: 2032118 - RNA, 19 nt, Homo sapiens
accuguggccaaguucuua

SEQ ID NO: 2032119 - RNA, 18 nt, Homo sapiens
caaagaaaugcugaugga

SEQ ID NO: 2032120 - RNA, 19 nt, Homo sapiens
agagcuggcacccugucau

SEQ ID NO: 2032121 - RNA, 22 nt, Homo sapiens
agggugacugaagucgugcuuu

SEQ ID NO: 2032122 - RNA, 18 nt, Homo sapiens
uugaaaaacacauuguaa

SEQ ID NO: 2032123 - RNA, 13 nt, Homo sapiens
aacugagcacuuu

SEQ ID NO: 2032124 - RNA, 21 nt, Homo sapiens
auaaauuuuaaaaaggaauuu

SEQ ID NO: 2032125 - RNA, 24 nt, Homo sapiens
uuucaaaaucaaauuccagaauga

SEQ ID NO: 2032126 - RNA, 16 nt, Homo sapiens
aggcuuggaccugcug

SEQ ID NO: 2032127 - RNA, 15 nt, Homo sapiens
cagcuuagcuacaaa

SEQ ID NO: 2032128 - RNA, 13 nt, Homo sapiens
cccagcaguucug

SEQ ID NO: 2032129 - RNA, 22 nt, Homo sapiens
auuugguguagguaggucuguu

SEQ ID NO: 2032130 - RNA, 22 nt, Homo sapiens
gguggaaugccgcugucucuga

SEQ ID NO: 2032131 - RNA, 15 nt, Homo sapiens
augacguccucucaa

SEQ ID NO: 2032132 - RNA, 22 nt, Homo sapiens
uuccacaaaauuaugcugcauu

SEQ ID NO: 2032133 - RNA, 20 nt, Homo sapiens
auaacccacuuuaaaauauc

SEQ ID NO: 2032134 - RNA, 20 nt, Homo sapiens
uucucuacagcaccuuaaaa

SEQ ID NO: 2032135 - RNA, 20 nt, Homo sapiens
ucagauuuugugaacuccag

SEQ ID NO: 2032136 - RNA, 15 nt, Homo sapiens
ugaaaugaccaagac

SEQ ID NO: 2032137 - RNA, 23 nt, Homo sapiens
ggauuuuuuguuauguuugcacu

SEQ ID NO: 2032138 - RNA, 16 nt, Homo sapiens
aagaaggaaauagcca

SEQ ID NO: 2032139 - RNA, 15 nt, Homo sapiens
auuucauguuaugca

SEQ ID NO: 2032140 - RNA, 12 nt, Homo sapiens
caggcugugcuu

SEQ ID NO: 2032141 - RNA, 19 nt, Homo sapiens
gaggaguccagcacaaccu

SEQ ID NO: 2032142 - RNA, 12 nt, Homo sapiens
gacaucuucaau

SEQ ID NO: 2032143 - RNA, 16 nt, Homo sapiens
uucacaggguauuaau

SEQ ID NO: 2032144 - RNA, 13 nt, Homo sapiens
cagucaucuccaa

SEQ ID NO: 2032145 - RNA, 12 nt, Homo sapiens
ugaucucagcuc

SEQ ID NO: 2032146 - RNA, 13 nt, Homo sapiens
gaaccuucuuaac

SEQ ID NO: 2032147 - RNA, 15 nt, Homo sapiens
gucuauuuccacuga

SEQ ID NO: 2032148 - RNA, 20 nt, Homo sapiens
cauguuauauuuaaugcauu

SEQ ID NO: 2032149 - RNA, 15 nt, Homo sapiens
gagauaugcacacac

SEQ ID NO: 2032150 - RNA, 14 nt, Homo sapiens
cacagcuuuuuacc

SEQ ID NO: 2032151 - RNA, 18 nt, Homo sapiens
aacaugagaaaugugaac

SEQ ID NO: 2032152 - RNA, 22 nt, Homo sapiens
gccuccccauuucccaucugca

SEQ ID NO: 2032153 - RNA, 14 nt, Homo sapiens
gauucaaaugcaug

SEQ ID NO: 2032154 - RNA, 20 nt, Homo sapiens
uuaucauggguaucacauug

SEQ ID NO: 2032155 - RNA, 12 nt, Homo sapiens
uuccugaugaca

SEQ ID NO: 2032156 - RNA, 22 nt, Homo sapiens
cuagauggagaaaguaacacaa

SEQ ID NO: 2032157 - RNA, 22 nt, Homo sapiens
aggggaagaccaaaguuugcaa

SEQ ID NO: 2032158 - RNA, 19 nt, Homo sapiens
uaaaauaaacuagauauua

SEQ ID NO: 2032159 - RNA, 15 nt, Homo sapiens
gccugcuacacaggc

SEQ ID NO: 2032160 - RNA, 23 nt, Homo sapiens
aacuuuguuuagcccaaaaccaa

SEQ ID NO: 2032161 - RNA, 14 nt, Homo sapiens
auggugggaacccu

SEQ ID NO: 2032162 - RNA, 18 nt, Homo sapiens
auuuaaaggaaaguucua

SEQ ID NO: 2032163 - RNA, 17 nt, Homo sapiens
gccagcguggcgcagug

SEQ ID NO: 2032164 - RNA, 16 nt, Homo sapiens
uguauucacacuuuaa

SEQ ID NO: 2032165 - RNA, 14 nt, Homo sapiens
gcagaagaaggcau

SEQ ID NO: 2032166 - RNA, 17 nt, Homo sapiens
cucuugccacaucuuga

SEQ ID NO: 2032167 - RNA, 21 nt, Homo sapiens
agaugucccugaagucuugca

SEQ ID NO: 2032168 - RNA, 17 nt, Homo sapiens
uaaaauaaaaauucuga

SEQ ID NO: 2032169 - RNA, 20 nt, Homo sapiens
ucucacuuuuuacccagaac

SEQ ID NO: 2032170 - RNA, 22 nt, Homo sapiens
uaccauauggaaugccaaaauu

SEQ ID NO: 2032171 - RNA, 17 nt, Homo sapiens
gcacacaucuuaccucu

SEQ ID NO: 2032172 - RNA, 19 nt, Homo sapiens
cuacucaagaggcugaggc

SEQ ID NO: 2032173 - RNA, 16 nt, Homo sapiens
cauuucacuauucugu

SEQ ID NO: 2032174 - RNA, 16 nt, Homo sapiens
cuuucauggaccaggu

SEQ ID NO: 2032175 - RNA, 23 nt, Homo sapiens
ugaugcuucuaucaggucccauc

SEQ ID NO: 2032176 - RNA, 23 nt, Homo sapiens
uuuauugagguauaauucaccca

SEQ ID NO: 2032177 - RNA, 15 nt, Homo sapiens
gcgucauuacagggc

SEQ ID NO: 2032178 - RNA, 15 nt, Homo sapiens
uugugcaaagccaaa

SEQ ID NO: 2032179 - RNA, 22 nt, Homo sapiens
auccacccaacccuaucuccug

SEQ ID NO: 2032180 - RNA, 20 nt, Homo sapiens
agacagguccaaguucaagc

SEQ ID NO: 2032181 - RNA, 17 nt, Homo sapiens
gagacauauuacuggaa

SEQ ID NO: 2032182 - RNA, 18 nt, Homo sapiens
gaccacaguuuaccucag

SEQ ID NO: 2032183 - RNA, 16 nt, Homo sapiens
agcagcuuucagcucu

SEQ ID NO: 2032184 - RNA, 16 nt, Homo sapiens
agcuagcagaagacaa

SEQ ID NO: 2032185 - RNA, 12 nt, Homo sapiens
acugcuggugcc

SEQ ID NO: 2032186 - RNA, 12 nt, Homo sapiens
acuacaucccac

SEQ ID NO: 2032187 - RNA, 16 nt, Homo sapiens
ccugcaggacuugcca

SEQ ID NO: 2032188 - RNA, 22 nt, Homo sapiens
cuucugaccugggcuggcacug

SEQ ID NO: 2032189 - RNA, 17 nt, Homo sapiens
uccauaguggacauugu

SEQ ID NO: 2032190 - RNA, 22 nt, Homo sapiens
uuagucgcuaacuuaguaagug

SEQ ID NO: 2032191 - RNA, 18 nt, Homo sapiens
acccagccucuagaacag

SEQ ID NO: 2032192 - RNA, 19 nt, Homo sapiens
ccugcuccuaaggguagaa

SEQ ID NO: 2032193 - RNA, 14 nt, Homo sapiens
gaugacacaauccc

SEQ ID NO: 2032194 - RNA, 18 nt, Homo sapiens
cauuucuuugcauuccag

SEQ ID NO: 2032195 - RNA, 18 nt, Homo sapiens
agggggucugggccagug

SEQ ID NO: 2032196 - RNA, 15 nt, Homo sapiens
ucucucccagucuac

SEQ ID NO: 2032197 - RNA, 15 nt, Homo sapiens
ugagacggagucuca

SEQ ID NO: 2032198 - RNA, 20 nt, Homo sapiens
cauuggauucaucagcauuu

SEQ ID NO: 2032199 - RNA, 14 nt, Homo sapiens
auaagaucacugaa

SEQ ID NO: 2032200 - RNA, 16 nt, Homo sapiens
guaaguuccuacuagg

SEQ ID NO: 2032201 - RNA, 11 nt, Homo sapiens
gaugcugcuau

SEQ ID NO: 2032202 - RNA, 23 nt, Homo sapiens
ucuguugaauuauguuuugacac

SEQ ID NO: 2032203 - RNA, 20 nt, Homo sapiens
auauuuuuauccuguucuca

SEQ ID NO: 2032204 - RNA, 17 nt, Homo sapiens
cacacucaaaagacaaa

SEQ ID NO: 2032205 - RNA, 15 nt, Homo sapiens
uuagauucugaccau

SEQ ID NO: 2032206 - RNA, 21 nt, Homo sapiens
ccacaaacccccaccagcaag

SEQ ID NO: 2032207 - RNA, 23 nt, Homo sapiens
caugagggagaugccaugagccg

SEQ ID NO: 2032208 - RNA, 23 nt, Homo sapiens
uuccaaaacuuuaaugaacuaac

SEQ ID NO: 2032209 - RNA, 19 nt, Homo sapiens
gcuucaguugcauaucuua

SEQ ID NO: 2032210 - RNA, 22 nt, Homo sapiens
cucuucuuacucauuacugcaa

SEQ ID NO: 2032211 - RNA, 24 nt, Homo sapiens
agccucuguccuggcugugcacau

SEQ ID NO: 2032212 - RNA, 19 nt, Homo sapiens
ccuauaaauggaccauccu

SEQ ID NO: 2032213 - RNA, 14 nt, Homo sapiens
uuuccauccuccaa

SEQ ID NO: 2032214 - RNA, 13 nt, Homo sapiens
gggcauaagcaaa

SEQ ID NO: 2032215 - RNA, 21 nt, Homo sapiens
auugaaccuuugugcccuauc

SEQ ID NO: 2032216 - RNA, 22 nt, Homo sapiens
acccugaucucucagccccaaa

SEQ ID NO: 2032217 - RNA, 18 nt, Homo sapiens
uaggcagcuguccuguga

SEQ ID NO: 2032218 - RNA, 19 nt, Homo sapiens
cacuacuguauuucauuau

SEQ ID NO: 2032219 - RNA, 11 nt, Homo sapiens
guuagccuuag

SEQ ID NO: 2032220 - RNA, 11 nt, Homo sapiens
gauagccuuug

SEQ ID NO: 2032221 - RNA, 19 nt, Homo sapiens
acagaaagacugagcucaa

SEQ ID NO: 2032222 - RNA, 17 nt, Homo sapiens
agaauaucuagcaugua

SEQ ID NO: 2032223 - RNA, 22 nt, Homo sapiens
uucccuuuaacccucacacugc

SEQ ID NO: 2032224 - RNA, 14 nt, Homo sapiens
gcccugcuaugaaa

SEQ ID NO: 2032225 - RNA, 18 nt, Homo sapiens
auaaacugaauuuguacu

SEQ ID NO: 2032226 - RNA, 20 nt, Homo sapiens
agagaaaggguaauuuccuu

SEQ ID NO: 2032227 - RNA, 12 nt, Homo sapiens
ugggccgugugg

SEQ ID NO: 2032228 - RNA, 14 nt, Homo sapiens
auaaagcugugagc

SEQ ID NO: 2032229 - RNA, 13 nt, Homo sapiens
acugacucuggaa

SEQ ID NO: 2032230 - RNA, 14 nt, Homo sapiens
auaacucuccagua

SEQ ID NO: 2032231 - RNA, 20 nt, Homo sapiens
uauccuccccuuuuaccacu

SEQ ID NO: 2032232 - RNA, 17 nt, Homo sapiens
ccuugcacaggccacuu

SEQ ID NO: 2032233 - RNA, 12 nt, Homo sapiens
cccccugugcau

SEQ ID NO: 2032234 - RNA, 15 nt, Homo sapiens
uaaaacauuuucaca

SEQ ID NO: 2032235 - RNA, 19 nt, Homo sapiens
augggacucugaacuggag

SEQ ID NO: 2032236 - RNA, 22 nt, Homo sapiens
aggcucuaauguacaauaaagc

SEQ ID NO: 2032237 - RNA, 15 nt, Homo sapiens
cucgaaguucuagga

SEQ ID NO: 2032238 - RNA, 21 nt, Homo sapiens
acucaaguuuuuacaaaauac

SEQ ID NO: 2032239 - RNA, 19 nt, Homo sapiens
ccagcuuguggagccccac

SEQ ID NO: 2032240 - RNA, 19 nt, Homo sapiens
uuuauauagaaacacuuuc

SEQ ID NO: 2032241 - RNA, 21 nt, Homo sapiens
guuuaaugguaucuguuacuc

SEQ ID NO: 2032242 - RNA, 20 nt, Homo sapiens
uuuacaguguauuuaagaaa

SEQ ID NO: 2032243 - RNA, 22 nt, Homo sapiens
gccuguuugcuuagcauuccua

SEQ ID NO: 2032244 - RNA, 12 nt, Homo sapiens
aggggcucucag

SEQ ID NO: 2032245 - RNA, 16 nt, Homo sapiens
ucuucuuuauugcacu

SEQ ID NO: 2032246 - RNA, 15 nt, Homo sapiens
agcuaaauggcaaca

SEQ ID NO: 2032247 - RNA, 15 nt, Homo sapiens
auaaacauguauaaa

SEQ ID NO: 2032248 - RNA, 18 nt, Homo sapiens
ccucucguaagauuuccu

SEQ ID NO: 2032249 - RNA, 22 nt, Homo sapiens
aagcuauucuuaugcuguaaca

SEQ ID NO: 2032250 - RNA, 13 nt, Homo sapiens
cccccaaaccaga

SEQ ID NO: 2032251 - RNA, 20 nt, Homo sapiens
aaaucuccccacuccagaag

SEQ ID NO: 2032252 - RNA, 13 nt, Homo sapiens
ucaaaacagagaa

SEQ ID NO: 2032253 - RNA, 19 nt, Homo sapiens
uucucaacauacuguaauc

SEQ ID NO: 2032254 - RNA, 17 nt, Homo sapiens
ucuuguuaaagauuuca

SEQ ID NO: 2032255 - RNA, 12 nt, Homo sapiens
uggugaugcagu

SEQ ID NO: 2032256 - RNA, 17 nt, Homo sapiens
auaacguucucaguccu

SEQ ID NO: 2032257 - RNA, 16 nt, Homo sapiens
uaguuuuaguugcaga

SEQ ID NO: 2032258 - RNA, 19 nt, Homo sapiens
aacuguaguaauuguuaca

SEQ ID NO: 2032259 - RNA, 22 nt, Homo sapiens
acugaugccauguuuagauucc

SEQ ID NO: 2032260 - RNA, 21 nt, Homo sapiens
ucacaccacuagccucagggg

SEQ ID NO: 2032261 - RNA, 14 nt, Homo sapiens
cuuuccaaagccaa

SEQ ID NO: 2032262 - RNA, 14 nt, Homo sapiens
auucaagaaacuag

SEQ ID NO: 2032263 - RNA, 17 nt, Homo sapiens
agaaggauguacauuuc

SEQ ID NO: 2032264 - RNA, 20 nt, Homo sapiens
uaaauuaguuugacacugcu

SEQ ID NO: 2032265 - RNA, 14 nt, Homo sapiens
uuccaacuugucug

SEQ ID NO: 2032266 - RNA, 16 nt, Homo sapiens
gaaaagugaauuucac

SEQ ID NO: 2032267 - RNA, 14 nt, Homo sapiens
agcuugucaaagau

SEQ ID NO: 2032268 - RNA, 21 nt, Homo sapiens
acccaagcagagaagcucucg

SEQ ID NO: 2032269 - RNA, 19 nt, Homo sapiens
caaaaacgugccguuuaaa

SEQ ID NO: 2032270 - RNA, 18 nt, Homo sapiens
cucaauuggaaguaguuc

SEQ ID NO: 2032271 - RNA, 24 nt, Homo sapiens
gccucuaagcgugcugacaucaga

SEQ ID NO: 2032272 - RNA, 14 nt, Homo sapiens
caagaaaguccagu

SEQ ID NO: 2032273 - RNA, 15 nt, Homo sapiens
ugugaaacuuucauu

SEQ ID NO: 2032274 - RNA, 22 nt, Homo sapiens
aacacaacuuuauugauugaau

SEQ ID NO: 2032275 - RNA, 22 nt, Homo sapiens
ucuaacugugcagaaaggcaga

SEQ ID NO: 2032276 - RNA, 14 nt, Homo sapiens
gcugagcacuuuug

SEQ ID NO: 2032277 - RNA, 17 nt, Homo sapiens
uuggauuauuccucuac

SEQ ID NO: 2032278 - RNA, 22 nt, Homo sapiens
cuugcuccuacccuuggugccu

SEQ ID NO: 2032279 - RNA, 14 nt, Homo sapiens
cagaggguugugau

SEQ ID NO: 2032280 - RNA, 12 nt, Homo sapiens
ccugugacuguc

SEQ ID NO: 2032281 - RNA, 20 nt, Homo sapiens
uucuugccuuaaccagucuc

SEQ ID NO: 2032282 - RNA, 14 nt, Homo sapiens
auccccugguggcu

SEQ ID NO: 2032283 - RNA, 17 nt, Homo sapiens
cugacaagcuggccaaa

SEQ ID NO: 2032284 - RNA, 20 nt, Homo sapiens
aauuauguuuuaauuccaag

SEQ ID NO: 2032285 - RNA, 19 nt, Homo sapiens
aauagcugccuucaaggac

SEQ ID NO: 2032286 - RNA, 20 nt, Homo sapiens
agcacuagaucucccuuaau

SEQ ID NO: 2032287 - RNA, 21 nt, Homo sapiens
ggguucuuauuuugcauucca

SEQ ID NO: 2032288 - RNA, 18 nt, Homo sapiens
cuuugguauuucacugaa

SEQ ID NO: 2032289 - RNA, 15 nt, Homo sapiens
cagcauuagcuuccu

SEQ ID NO: 2032290 - RNA, 20 nt, Homo sapiens
gauggauucaucauccagga

SEQ ID NO: 2032291 - RNA, 19 nt, Homo sapiens
agauccucuucucaaagcu

SEQ ID NO: 2032292 - RNA, 19 nt, Homo sapiens
acccacggcucaacuccuc

SEQ ID NO: 2032293 - RNA, 18 nt, Homo sapiens
gaauaucugggauucuac

SEQ ID NO: 2032294 - RNA, 15 nt, Homo sapiens
cucauuuuaggcaaa

SEQ ID NO: 2032295 - RNA, 18 nt, Homo sapiens
acucccuaaguaauccca

SEQ ID NO: 2032296 - RNA, 16 nt, Homo sapiens
cacacgaugcauuuaa

SEQ ID NO: 2032297 - RNA, 22 nt, Homo sapiens
acacagcaagggugaugggaaa

SEQ ID NO: 2032298 - RNA, 18 nt, Homo sapiens
cauccuuuucaaaaccua

SEQ ID NO: 2032299 - RNA, 19 nt, Homo sapiens
uuccuuugaaagcuguaua

SEQ ID NO: 2032300 - RNA, 12 nt, Homo sapiens
aaauacacuaca

SEQ ID NO: 2032301 - RNA, 12 nt, Homo sapiens
aacaacacuaau

SEQ ID NO: 2032302 - RNA, 15 nt, Homo sapiens
guuauagacugccau

SEQ ID NO: 2032303 - RNA, 14 nt, Homo sapiens
acgggaagcaagau

SEQ ID NO: 2032304 - RNA, 12 nt, Homo sapiens
uuauaacuauua

SEQ ID NO: 2032305 - RNA, 12 nt, Homo sapiens
uaauaacuaaua

SEQ ID NO: 2032306 - RNA, 15 nt, Homo sapiens
ccagacucagacauu

SEQ ID NO: 2032307 - RNA, 17 nt, Homo sapiens
agugaaaauaauuuguu

SEQ ID NO: 2032308 - RNA, 14 nt, Homo sapiens
ccuuuggcuucuga

SEQ ID NO: 2032309 - RNA, 16 nt, Homo sapiens
uaguucuaucaggaaa

SEQ ID NO: 2032310 - RNA, 18 nt, Homo sapiens
cauuuuagcucaaacccu

SEQ ID NO: 2032311 - RNA, 20 nt, Homo sapiens
caugcauguucuccucuauc

SEQ ID NO: 2032312 - RNA, 19 nt, Homo sapiens
aaggaccucagcugcuucu

SEQ ID NO: 2032313 - RNA, 22 nt, Homo sapiens
aauugccuacagagggauuuau

SEQ ID NO: 2032314 - RNA, 19 nt, Homo sapiens
acauaacagacuaggccag

SEQ ID NO: 2032315 - RNA, 14 nt, Homo sapiens
ucccucucuugccg

SEQ ID NO: 2032316 - RNA, 20 nt, Homo sapiens
cugucgcaugagaacauuaa

SEQ ID NO: 2032317 - RNA, 16 nt, Homo sapiens
caaggaugacacugcc

SEQ ID NO: 2032318 - RNA, 21 nt, Homo sapiens
ucuuucuuuucucugucuacu

SEQ ID NO: 2032319 - RNA, 19 nt, Homo sapiens
gugauccuuuugugccaug

SEQ ID NO: 2032320 - RNA, 19 nt, Homo sapiens
caucaccccgugaagcaau

SEQ ID NO: 2032321 - RNA, 17 nt, Homo sapiens
aaagccucagccauuca

SEQ ID NO: 2032322 - RNA, 15 nt, Homo sapiens
cauaugccuacaaag

SEQ ID NO: 2032323 - RNA, 15 nt, Homo sapiens
cuucaccaagugcaa

SEQ ID NO: 2032324 - RNA, 16 nt, Homo sapiens
agcccgggaggggugg

SEQ ID NO: 2032325 - RNA, 18 nt, Homo sapiens
aggcccaccccagccacc

SEQ ID NO: 2032326 - RNA, 15 nt, Homo sapiens
ucucagcucacugca

SEQ ID NO: 2032327 - RNA, 15 nt, Homo sapiens
ggguuccaggacagg

SEQ ID NO: 2032328 - RNA, 13 nt, Homo sapiens
gcccaucaacugu

SEQ ID NO: 2032329 - RNA, 16 nt, Homo sapiens
ucguugacaugcacag

SEQ ID NO: 2032330 - RNA, 16 nt, Homo sapiens
ccaaaugcagcuuuaa

SEQ ID NO: 2032331 - RNA, 12 nt, Homo sapiens
aagaagcauuuc

SEQ ID NO: 2032332 - RNA, 20 nt, Homo sapiens
gaugacaauguuuacucaaa

SEQ ID NO: 2032333 - RNA, 14 nt, Homo sapiens
aagugugaauucac

SEQ ID NO: 2032334 - RNA, 23 nt, Homo sapiens
gcaaaaaaggaugcaacaauucu

SEQ ID NO: 2032335 - RNA, 13 nt, Homo sapiens
auaauacucuguu

SEQ ID NO: 2032336 - RNA, 13 nt, Homo sapiens
aagacacucaauc

SEQ ID NO: 2032337 - RNA, 15 nt, Homo sapiens
ugguucagcuacuuu

SEQ ID NO: 2032338 - RNA, 19 nt, Homo sapiens
accucucuucugcacagcu

SEQ ID NO: 2032339 - RNA, 19 nt, Homo sapiens
augauggccuuacacugaa

SEQ ID NO: 2032340 - RNA, 18 nt, Homo sapiens
gucccauccccacauccc

SEQ ID NO: 2032341 - RNA, 16 nt, Homo sapiens
ucguuuggaucuguga

SEQ ID NO: 2032342 - RNA, 22 nt, Homo sapiens
uauaguguucacaaacugugaa

SEQ ID NO: 2032343 - RNA, 12 nt, Homo sapiens
ucauauauugca

SEQ ID NO: 2032344 - RNA, 18 nt, Homo sapiens
aagcguccucucaguaau

SEQ ID NO: 2032345 - RNA, 20 nt, Homo sapiens
ucuccauguuuacacuucaa

SEQ ID NO: 2032346 - RNA, 15 nt, Homo sapiens
guguuugacgggaaa

SEQ ID NO: 2032347 - RNA, 23 nt, Homo sapiens
gacccucgggccccauccucauc

SEQ ID NO: 2032348 - RNA, 15 nt, Homo sapiens
aaccaguacuaaccu

SEQ ID NO: 2032349 - RNA, 19 nt, Homo sapiens
guccuucaauuuucuucac

SEQ ID NO: 2032350 - RNA, 14 nt, Homo sapiens
guaguggcacaauc

SEQ ID NO: 2032351 - RNA, 19 nt, Homo sapiens
acgcccagccuccucccac

SEQ ID NO: 2032352 - RNA, 20 nt, Homo sapiens
cuggcagggggugaaggcag

SEQ ID NO: 2032353 - RNA, 21 nt, Homo sapiens
gugaaacccugucucuacuaa

SEQ ID NO: 2032354 - RNA, 13 nt, Homo sapiens
ucugaaacagcuu

SEQ ID NO: 2032355 - RNA, 17 nt, Homo sapiens
agcccucaggucagggu

SEQ ID NO: 2032356 - RNA, 21 nt, Homo sapiens
caggaagcccacacuaugcac

SEQ ID NO: 2032357 - RNA, 22 nt, Homo sapiens
caggacccugucaggauugcag

SEQ ID NO: 2032358 - RNA, 13 nt, Homo sapiens
ugcgguucagggc

SEQ ID NO: 2032359 - RNA, 18 nt, Homo sapiens
cugcccuuccucuuugaa

SEQ ID NO: 2032360 - RNA, 17 nt, Homo sapiens
ccugaaaauugcaauac

SEQ ID NO: 2032361 - RNA, 22 nt, Homo sapiens
ugcaguggcgcgaucucagcuc

SEQ ID NO: 2032362 - RNA, 22 nt, Homo sapiens
uguggugagcagaaguggagcu

SEQ ID NO: 2032363 - RNA, 19 nt, Homo sapiens
agacaaagggaaaugcagc

SEQ ID NO: 2032364 - RNA, 18 nt, Homo sapiens
gauuucaguuacuuaccu

SEQ ID NO: 2032365 - RNA, 18 nt, Homo sapiens
agggcugcccugagcgcc

SEQ ID NO: 2032366 - RNA, 14 nt, Homo sapiens
accuaccucaccau

SEQ ID NO: 2032367 - RNA, 12 nt, Homo sapiens
cacugccaaaga

SEQ ID NO: 2032368 - RNA, 22 nt, Homo sapiens
cucuugaagacaacucugaaaa

SEQ ID NO: 2032369 - RNA, 20 nt, Homo sapiens
cacugauuuaguugcaugau

SEQ ID NO: 2032370 - RNA, 14 nt, Homo sapiens
caaaguauguuuca

SEQ ID NO: 2032371 - RNA, 14 nt, Homo sapiens
cauacaauguaugu

SEQ ID NO: 2032372 - RNA, 21 nt, Homo sapiens
cacuagagaaaauaaauucca

SEQ ID NO: 2032373 - RNA, 14 nt, Homo sapiens
ggaaccucacucuu

SEQ ID NO: 2032374 - RNA, 13 nt, Homo sapiens
uacuaccuugaaa

SEQ ID NO: 2032375 - RNA, 11 nt, Homo sapiens
ucacacuguau

SEQ ID NO: 2032376 - RNA, 20 nt, Homo sapiens
auuggagaaaagcacaauca

SEQ ID NO: 2032377 - RNA, 20 nt, Homo sapiens
auuugcgacucacccacaau

SEQ ID NO: 2032378 - RNA, 11 nt, Homo sapiens
cuccacauucc

SEQ ID NO: 2032379 - RNA, 19 nt, Homo sapiens
uguagaauauauuuccuua

SEQ ID NO: 2032380 - RNA, 17 nt, Homo sapiens
gauggcaaaaacaaagg

SEQ ID NO: 2032381 - RNA, 17 nt, Homo sapiens
cagauuguaccauugag

SEQ ID NO: 2032382 - RNA, 18 nt, Homo sapiens
uuaaaauauuugaaugaa

SEQ ID NO: 2032383 - RNA, 21 nt, Homo sapiens
cuaaauauugauuucugccuu

SEQ ID NO: 2032384 - RNA, 13 nt, Homo sapiens
uacaaguuugcua

SEQ ID NO: 2032385 - RNA, 15 nt, Homo sapiens
gccuuucaaagugca

SEQ ID NO: 2032386 - RNA, 22 nt, Homo sapiens
ccuguccggaaugccacccaca

SEQ ID NO: 2032387 - RNA, 21 nt, Homo sapiens
aauauuuccaucagcccaucu

SEQ ID NO: 2032388 - RNA, 20 nt, Homo sapiens
augcacugggaaaaaguuga

SEQ ID NO: 2032389 - RNA, 20 nt, Homo sapiens
uaucaaugaguaacaggaaa

SEQ ID NO: 2032390 - RNA, 18 nt, Homo sapiens
cacucccuccuaaccuag

SEQ ID NO: 2032391 - RNA, 21 nt, Homo sapiens
agcuguaaccgauaugcacuu

SEQ ID NO: 2032392 - RNA, 18 nt, Homo sapiens
acuugaggaucauaugaa

SEQ ID NO: 2032393 - RNA, 23 nt, Homo sapiens
agucuauuaaagaaagaaaaaug

SEQ ID NO: 2032394 - RNA, 19 nt, Homo sapiens
auauacagaccuccagauu

SEQ ID NO: 2032395 - RNA, 23 nt, Homo sapiens
auuauaugaaguuuaaauucuag

SEQ ID NO: 2032396 - RNA, 20 nt, Homo sapiens
uugcuuuagguaucacugga

SEQ ID NO: 2032397 - RNA, 17 nt, Homo sapiens
caaauccucccuacuuc

SEQ ID NO: 2032398 - RNA, 11 nt, Homo sapiens
aaaaaugaaga

SEQ ID NO: 2032399 - RNA, 17 nt, Homo sapiens
ucacaauacaguggaua

SEQ ID NO: 2032400 - RNA, 18 nt, Homo sapiens
cuuuauauggaugauuca

SEQ ID NO: 2032401 - RNA, 22 nt, Homo sapiens
cuggaagccaccucaccaagga

SEQ ID NO: 2032402 - RNA, 19 nt, Homo sapiens
aguggcucagaccccucag

SEQ ID NO: 2032403 - RNA, 16 nt, Homo sapiens
ugcagauucgagucac

SEQ ID NO: 2032404 - RNA, 20 nt, Homo sapiens
uaauaauuaaagaaugcaau

SEQ ID NO: 2032405 - RNA, 16 nt, Homo sapiens
gcaaaacuccaucuca

SEQ ID NO: 2032406 - RNA, 14 nt, Homo sapiens
gcauucacauuuag

SEQ ID NO: 2032407 - RNA, 16 nt, Homo sapiens
ggccuccccugcugaa

SEQ ID NO: 2032408 - RNA, 15 nt, Homo sapiens
ucugacaugcauugu

SEQ ID NO: 2032409 - RNA, 18 nt, Homo sapiens
uguauacauuacaucuga

SEQ ID NO: 2032410 - RNA, 18 nt, Homo sapiens
agucauguaaauacuguu

SEQ ID NO: 2032411 - RNA, 14 nt, Homo sapiens
uguccugauuacaa

SEQ ID NO: 2032412 - RNA, 13 nt, Homo sapiens
ucuauuugagauu

SEQ ID NO: 2032413 - RNA, 19 nt, Homo sapiens
aggagggucggugccuuca

SEQ ID NO: 2032414 - RNA, 15 nt, Homo sapiens
caaauugucugguac

SEQ ID NO: 2032415 - RNA, 14 nt, Homo sapiens
aguaugugauggac

SEQ ID NO: 2032416 - RNA, 14 nt, Homo sapiens
cuccuugguauuuc

SEQ ID NO: 2032417 - RNA, 16 nt, Homo sapiens
caggucuucuccaagg

SEQ ID NO: 2032418 - RNA, 15 nt, Homo sapiens
accuggcacauucau

SEQ ID NO: 2032419 - RNA, 14 nt, Homo sapiens
aacuguguuuacuc

SEQ ID NO: 2032420 - RNA, 15 nt, Homo sapiens
auaaauaaaguuuca

SEQ ID NO: 2032421 - RNA, 19 nt, Homo sapiens
ugaacuguaccaugugcua

SEQ ID NO: 2032422 - RNA, 20 nt, Homo sapiens
gugacuugcccaguuucagg

SEQ ID NO: 2032423 - RNA, 18 nt, Homo sapiens
ccguugcugaaaaugauu

SEQ ID NO: 2032424 - RNA, 23 nt, Homo sapiens
cagaauaaaagaugauuucucaa

SEQ ID NO: 2032425 - RNA, 14 nt, Homo sapiens
ggaggaugaugcca

SEQ ID NO: 2032426 - RNA, 15 nt, Homo sapiens
ggcccggacucacca

SEQ ID NO: 2032427 - RNA, 13 nt, Homo sapiens
uggggucagggaa

SEQ ID NO: 2032428 - RNA, 16 nt, Homo sapiens
caaccuguuaccuacu

SEQ ID NO: 2032429 - RNA, 15 nt, Homo sapiens
uugaaugaacuaguu

SEQ ID NO: 2032430 - RNA, 20 nt, Homo sapiens
acaguucagaccaaugcuca

SEQ ID NO: 2032431 - RNA, 22 nt, Homo sapiens
cuuugugcaaaagggucuggcu

SEQ ID NO: 2032432 - RNA, 19 nt, Homo sapiens
ugccuggcacagaccaggc

SEQ ID NO: 2032433 - RNA, 15 nt, Homo sapiens
uaccuguuauuuauc

SEQ ID NO: 2032434 - RNA, 20 nt, Homo sapiens
acgggcccgugacaucccca

SEQ ID NO: 2032435 - RNA, 23 nt, Homo sapiens
uacagaauaaaagaauuacauau

SEQ ID NO: 2032436 - RNA, 24 nt, Homo sapiens
aguuauuuucugagugugcagaca

SEQ ID NO: 2032437 - RNA, 15 nt, Homo sapiens
cuuugguaccagaua

SEQ ID NO: 2032438 - RNA, 22 nt, Homo sapiens
ccggcucccaccggugccaaac

SEQ ID NO: 2032439 - RNA, 15 nt, Homo sapiens
uccucugcuugucau

SEQ ID NO: 2032440 - RNA, 12 nt, Homo sapiens
uccacacccgcg

SEQ ID NO: 2032441 - RNA, 19 nt, Homo sapiens
ucaccaagcuaggugcuau

SEQ ID NO: 2032442 - RNA, 14 nt, Homo sapiens
guauaauaugcaau

SEQ ID NO: 2032443 - RNA, 18 nt, Homo sapiens
ucagauuugccauucaag

SEQ ID NO: 2032444 - RNA, 13 nt, Homo sapiens
acucuagauucca

SEQ ID NO: 2032445 - RNA, 17 nt, Homo sapiens
augucuauaaucccagc

SEQ ID NO: 2032446 - RNA, 20 nt, Homo sapiens
cauagagaucauccuuucca

SEQ ID NO: 2032447 - RNA, 18 nt, Homo sapiens
uagaguguagacuguggc

SEQ ID NO: 2032448 - RNA, 20 nt, Homo sapiens
auugccaccaggagaaccac

SEQ ID NO: 2032449 - RNA, 14 nt, Homo sapiens
ccucauccaaaguu

SEQ ID NO: 2032450 - RNA, 14 nt, Homo sapiens
caacauccacuguu

SEQ ID NO: 2032451 - RNA, 14 nt, Homo sapiens
cugaaccacauuca

SEQ ID NO: 2032452 - RNA, 21 nt, Homo sapiens
ugacuguaacauauucuguau

SEQ ID NO: 2032453 - RNA, 20 nt, Homo sapiens
aguuuccaucccaacaugau

SEQ ID NO: 2032454 - RNA, 22 nt, Homo sapiens
aguucaaguccugccucuuaaa

SEQ ID NO: 2032455 - RNA, 22 nt, Homo sapiens
cuauuccauggcuaacuggcga

SEQ ID NO: 2032456 - RNA, 13 nt, Homo sapiens
ccuuuccuuucau

SEQ ID NO: 2032457 - RNA, 14 nt, Homo sapiens
ggauaggcuuuauu

SEQ ID NO: 2032458 - RNA, 18 nt, Homo sapiens
aaaccuacccucagugag

SEQ ID NO: 2032459 - RNA, 19 nt, Homo sapiens
uccaguuguuacugaaguu

SEQ ID NO: 2032460 - RNA, 23 nt, Homo sapiens
agaacuuuauuuccaaguuguuc

SEQ ID NO: 2032461 - RNA, 15 nt, Homo sapiens
ugggaaagcagagug

SEQ ID NO: 2032462 - RNA, 16 nt, Homo sapiens
cugauucuccugucag

SEQ ID NO: 2032463 - RNA, 12 nt, Homo sapiens
acucuucacuug

SEQ ID NO: 2032464 - RNA, 21 nt, Homo sapiens
agugcaauggugcgaucucag

SEQ ID NO: 2032465 - RNA, 20 nt, Homo sapiens
agaauguggagaacuaaagg

SEQ ID NO: 2032466 - RNA, 16 nt, Homo sapiens
cuuaacacacuggcca

SEQ ID NO: 2032467 - RNA, 21 nt, Homo sapiens
ugcucuagagguucaaaggca

SEQ ID NO: 2032468 - RNA, 15 nt, Homo sapiens
ugcuccuugccucug

SEQ ID NO: 2032469 - RNA, 14 nt, Homo sapiens
cuugcccaugcaca

SEQ ID NO: 2032470 - RNA, 18 nt, Homo sapiens
ccagcaccgugacaguuu

SEQ ID NO: 2032471 - RNA, 21 nt, Homo sapiens
gcaaugaaugaugcuuuucug

SEQ ID NO: 2032472 - RNA, 22 nt, Homo sapiens
acaaggggcuccacaccuuugc

SEQ ID NO: 2032473 - RNA, 13 nt, Homo sapiens
acaggcagucucu

SEQ ID NO: 2032474 - RNA, 17 nt, Homo sapiens
cagguucuauuuggaau

SEQ ID NO: 2032475 - RNA, 22 nt, Homo sapiens
uucucucucucuuugaucccau

SEQ ID NO: 2032476 - RNA, 14 nt, Homo sapiens
gcccauccagucuc

SEQ ID NO: 2032477 - RNA, 21 nt, Homo sapiens
ucucagggaaagccucuggca

SEQ ID NO: 2032478 - RNA, 15 nt, Homo sapiens
cauuucaaaacccaa

SEQ ID NO: 2032479 - RNA, 15 nt, Homo sapiens
ugauugaagucuucu

SEQ ID NO: 2032480 - RNA, 22 nt, Homo sapiens
cagccuuuaucaagcuuaguga

SEQ ID NO: 2032481 - RNA, 16 nt, Homo sapiens
uuaagauagaacacaa

SEQ ID NO: 2032482 - RNA, 19 nt, Homo sapiens
gcuccuguccccugcuaca

SEQ ID NO: 2032483 - RNA, 22 nt, Homo sapiens
uagugaagcuaauuaaacacau

SEQ ID NO: 2032484 - RNA, 16 nt, Homo sapiens
aaccccaucucuacaa

SEQ ID NO: 2032485 - RNA, 11 nt, Homo sapiens
cuucugugguc

SEQ ID NO: 2032486 - RNA, 16 nt, Homo sapiens
auauccaguuccugcu

SEQ ID NO: 2032487 - RNA, 21 nt, Homo sapiens
acagaaaugagaucaggcucu

SEQ ID NO: 2032488 - RNA, 15 nt, Homo sapiens
ugccuacaaccaucc

SEQ ID NO: 2032489 - RNA, 14 nt, Homo sapiens
uuacagcuuucaca

SEQ ID NO: 2032490 - RNA, 19 nt, Homo sapiens
agcagggggagugcugguc

SEQ ID NO: 2032491 - RNA, 12 nt, Homo sapiens
caccugccuugg

SEQ ID NO: 2032492 - RNA, 22 nt, Homo sapiens
auuuucauauugcuaccaaaaa

SEQ ID NO: 2032493 - RNA, 11 nt, Homo sapiens
uuguacugcuu

SEQ ID NO: 2032494 - RNA, 16 nt, Homo sapiens
aguuucccaaauuccc

SEQ ID NO: 2032495 - RNA, 22 nt, Homo sapiens
aguaaacccagcugugagacaa

SEQ ID NO: 2032496 - RNA, 22 nt, Homo sapiens
uguguccccucacucugucagc

SEQ ID NO: 2032497 - RNA, 14 nt, Homo sapiens
acuucccauuuacu

SEQ ID NO: 2032498 - RNA, 16 nt, Homo sapiens
cggcaacauuccucag

SEQ ID NO: 2032499 - RNA, 13 nt, Homo sapiens
cuuuugccuuuug

SEQ ID NO: 2032500 - RNA, 13 nt, Homo sapiens
ccagggccucagu

SEQ ID NO: 2032501 - RNA, 17 nt, Homo sapiens
uccugccccacacuccc

SEQ ID NO: 2032502 - RNA, 20 nt, Homo sapiens
gagcacgaggccuucagaaa

SEQ ID NO: 2032503 - RNA, 13 nt, Homo sapiens
gcucagggccagg

SEQ ID NO: 2032504 - RNA, 15 nt, Homo sapiens
ucuuguugcugcauc

SEQ ID NO: 2032505 - RNA, 19 nt, Homo sapiens
cguuccuuccgaugacagu

SEQ ID NO: 2032506 - RNA, 17 nt, Homo sapiens
uggggagucugagaaag

SEQ ID NO: 2032507 - RNA, 14 nt, Homo sapiens
uagguagacacaaa

SEQ ID NO: 2032508 - RNA, 14 nt, Homo sapiens
uauccccucaaaau

SEQ ID NO: 2032509 - RNA, 13 nt, Homo sapiens
cagagacauacuu

SEQ ID NO: 2032510 - RNA, 15 nt, Homo sapiens
aacauugugauguau

SEQ ID NO: 2032511 - RNA, 21 nt, Homo sapiens
ccccaucuccauugcauucau

SEQ ID NO: 2032512 - RNA, 16 nt, Homo sapiens
agcaucuguguaaccu

SEQ ID NO: 2032513 - RNA, 16 nt, Homo sapiens
agcccagcccuccagc

SEQ ID NO: 2032514 - RNA, 22 nt, Homo sapiens
cagaacugucggaggaaagaca

SEQ ID NO: 2032515 - RNA, 15 nt, Homo sapiens
ccgugggucaugcag

SEQ ID NO: 2032516 - RNA, 21 nt, Homo sapiens
caauaagccacgaggugcagu

SEQ ID NO: 2032517 - RNA, 21 nt, Homo sapiens
uucuaacccaacugacuugua

SEQ ID NO: 2032518 - RNA, 17 nt, Homo sapiens
gauuagcccuuccuugc

SEQ ID NO: 2032519 - RNA, 15 nt, Homo sapiens
aggcagggaagcucu

SEQ ID NO: 2032520 - RNA, 19 nt, Homo sapiens
acuggcugccuccacuccc

SEQ ID NO: 2032521 - RNA, 17 nt, Homo sapiens
ugacagcugcaagccag

SEQ ID NO: 2032522 - RNA, 22 nt, Homo sapiens
acuggaugugauuauuaauauc

SEQ ID NO: 2032523 - RNA, 17 nt, Homo sapiens
aaucugauuggacauuu

SEQ ID NO: 2032524 - RNA, 18 nt, Homo sapiens
uuccucccugguuugcag

SEQ ID NO: 2032525 - RNA, 15 nt, Homo sapiens
uguaaugcacacuua

SEQ ID NO: 2032526 - RNA, 22 nt, Homo sapiens
gaucuuucucaaucuugaacuc

SEQ ID NO: 2032527 - RNA, 17 nt, Homo sapiens
auuuauucauguguaca

SEQ ID NO: 2032528 - RNA, 16 nt, Homo sapiens
cugccugggugggaca

SEQ ID NO: 2032529 - RNA, 21 nt, Homo sapiens
guuuaccuucagccauagcuu

SEQ ID NO: 2032530 - RNA, 22 nt, Homo sapiens
uaaauuuaaaacacaguauugu

SEQ ID NO: 2032531 - RNA, 16 nt, Homo sapiens
gccuauuguugaauaa

SEQ ID NO: 2032532 - RNA, 14 nt, Homo sapiens
gaaaaugugcaaua

SEQ ID NO: 2032533 - RNA, 14 nt, Homo sapiens
uaauauguucauua

SEQ ID NO: 2032534 - RNA, 14 nt, Homo sapiens
ucuuuuguuauuaa

SEQ ID NO: 2032535 - RNA, 15 nt, Homo sapiens
aacaucuggcccaag

SEQ ID NO: 2032536 - RNA, 21 nt, Homo sapiens
cagacugugucuuauucuccc

SEQ ID NO: 2032537 - RNA, 12 nt, Homo sapiens
cuugaugauuga

SEQ ID NO: 2032538 - RNA, 13 nt, Homo sapiens
gucuuugcugcag

SEQ ID NO: 2032539 - RNA, 22 nt, Homo sapiens
gaaagaugguguggguguccug

SEQ ID NO: 2032540 - RNA, 12 nt, Homo sapiens
ugaaacugaaag

SEQ ID NO: 2032541 - RNA, 17 nt, Homo sapiens
cguuuagaaaaaacaau

SEQ ID NO: 2032542 - RNA, 22 nt, Homo sapiens
uucggugguaaaaguaccacac

SEQ ID NO: 2032543 - RNA, 20 nt, Homo sapiens
ggaauaacaacuuucagugg

SEQ ID NO: 2032544 - RNA, 13 nt, Homo sapiens
uaaagguaugaaa

SEQ ID NO: 2032545 - RNA, 17 nt, Homo sapiens
gaucuucuuggagcgag

SEQ ID NO: 2032546 - RNA, 16 nt, Homo sapiens
uccggagaauugccuc

SEQ ID NO: 2032547 - RNA, 19 nt, Homo sapiens
uugguugugacagagucaa

SEQ ID NO: 2032548 - RNA, 16 nt, Homo sapiens
cuguugccuuuuuaca

SEQ ID NO: 2032549 - RNA, 20 nt, Homo sapiens
ccucagcggacaagcagcug

SEQ ID NO: 2032550 - RNA, 17 nt, Homo sapiens
gagauagcauugugaac

SEQ ID NO: 2032551 - RNA, 24 nt, Homo sapiens
uaaccuggguaaaugcagcgugaa

SEQ ID NO: 2032552 - RNA, 15 nt, Homo sapiens
ggacuugaacccagg

SEQ ID NO: 2032553 - RNA, 15 nt, Homo sapiens
uacauggucaaguau

SEQ ID NO: 2032554 - RNA, 13 nt, Homo sapiens
gcccacaucccac

SEQ ID NO: 2032555 - RNA, 15 nt, Homo sapiens
acggagccaugucau

SEQ ID NO: 2032556 - RNA, 13 nt, Homo sapiens
gugcacaucugac

SEQ ID NO: 2032557 - RNA, 21 nt, Homo sapiens
ugcacugcccuccgcccuucc

SEQ ID NO: 2032558 - RNA, 19 nt, Homo sapiens
uauuccucagauugcugaa

SEQ ID NO: 2032559 - RNA, 17 nt, Homo sapiens
caucccuuaguuuccac

SEQ ID NO: 2032560 - RNA, 16 nt, Homo sapiens
cuugauaauacuugac

SEQ ID NO: 2032561 - RNA, 19 nt, Homo sapiens
auuuuuguuuuauccacaa

SEQ ID NO: 2032562 - RNA, 19 nt, Homo sapiens
uuuccaucagcccaucuca

SEQ ID NO: 2032563 - RNA, 18 nt, Homo sapiens
gcuucuugugaaggccau

SEQ ID NO: 2032564 - RNA, 21 nt, Homo sapiens
agcaguuguaccaagugaaau

SEQ ID NO: 2032565 - RNA, 17 nt, Homo sapiens
cccaaauggcugcuuug

SEQ ID NO: 2032566 - RNA, 17 nt, Homo sapiens
uccauuuuuagugaaau

SEQ ID NO: 2032567 - RNA, 23 nt, Homo sapiens
gugaacacugugaccaggcuuuu

SEQ ID NO: 2032568 - RNA, 18 nt, Homo sapiens
acaaagagaaacuuguaa

SEQ ID NO: 2032569 - RNA, 13 nt, Homo sapiens
aagugaaacugcu

SEQ ID NO: 2032570 - RNA, 16 nt, Homo sapiens
ccuuugcuucauucaa

SEQ ID NO: 2032571 - RNA, 15 nt, Homo sapiens
ccuuggugugcugua

SEQ ID NO: 2032572 - RNA, 20 nt, Homo sapiens
auuucuauguaugugccaau

SEQ ID NO: 2032573 - RNA, 14 nt, Homo sapiens
aacaucucugggaa

SEQ ID NO: 2032574 - RNA, 18 nt, Homo sapiens
ucggaaauacacuacaaa

SEQ ID NO: 2032575 - RNA, 18 nt, Homo sapiens
ucaaaacuaaccaucuga

SEQ ID NO: 2032576 - RNA, 14 nt, Homo sapiens
augaggaucugaaa

SEQ ID NO: 2032577 - RNA, 12 nt, Homo sapiens
agaugaggcaaa

SEQ ID NO: 2032578 - RNA, 19 nt, Homo sapiens
acacaagaaaacucaaaga

SEQ ID NO: 2032579 - RNA, 11 nt, Homo sapiens
gcuccagugua

SEQ ID NO: 2032580 - RNA, 14 nt, Homo sapiens
cuucuuccuuguag

SEQ ID NO: 2032581 - RNA, 12 nt, Homo sapiens
aggcuucuucag

SEQ ID NO: 2032582 - RNA, 13 nt, Homo sapiens
gcccugcaccaug

SEQ ID NO: 2032583 - RNA, 15 nt, Homo sapiens
cagaaccauuucacc

SEQ ID NO: 2032584 - RNA, 17 nt, Homo sapiens
uacaaaaauaaacuaua

SEQ ID NO: 2032585 - RNA, 17 nt, Homo sapiens
gaugcuguacagguaca

SEQ ID NO: 2032586 - RNA, 14 nt, Homo sapiens
caagcuaacugcuu

SEQ ID NO: 2032587 - RNA, 14 nt, Homo sapiens
aaugguuuacugcu

SEQ ID NO: 2032588 - RNA, 16 nt, Homo sapiens
gcuuguuuacagcacu

SEQ ID NO: 2032589 - RNA, 23 nt, Homo sapiens
agcgcuaauuuugaaugcccuca

SEQ ID NO: 2032590 - RNA, 16 nt, Homo sapiens
cuaguagcuaaccauc

SEQ ID NO: 2032591 - RNA, 14 nt, Homo sapiens
aucuucaacaaauu

SEQ ID NO: 2032592 - RNA, 16 nt, Homo sapiens
gaucuuccagaagcug

SEQ ID NO: 2032593 - RNA, 21 nt, Homo sapiens
augauuccuugagcauuuuau

SEQ ID NO: 2032594 - RNA, 18 nt, Homo sapiens
agagcugggaguagcaug

SEQ ID NO: 2032595 - RNA, 22 nt, Homo sapiens
cacauccgccuuuuguauacau

SEQ ID NO: 2032596 - RNA, 11 nt, Homo sapiens
gaagagcauug

SEQ ID NO: 2032597 - RNA, 23 nt, Homo sapiens
aaaucagcuuuauagguuuauua

SEQ ID NO: 2032598 - RNA, 19 nt, Homo sapiens
gauccaagauguuuggaca

SEQ ID NO: 2032599 - RNA, 16 nt, Homo sapiens
accgccccucaccaac

SEQ ID NO: 2032600 - RNA, 18 nt, Homo sapiens
gcccugggacagggcaaa

SEQ ID NO: 2032601 - RNA, 23 nt, Homo sapiens
aacucacuuucccuugugucaag

SEQ ID NO: 2032602 - RNA, 13 nt, Homo sapiens
agaaguuccucaa

SEQ ID NO: 2032603 - RNA, 12 nt, Homo sapiens
uccuuccaucaa

SEQ ID NO: 2032604 - RNA, 13 nt, Homo sapiens
cuagaugcacgug

SEQ ID NO: 2032605 - RNA, 20 nt, Homo sapiens
uugguaaaacucacugugau

SEQ ID NO: 2032606 - RNA, 16 nt, Homo sapiens
cgacuucugcccauuc

SEQ ID NO: 2032607 - RNA, 15 nt, Homo sapiens
ugcccugaacccacu

SEQ ID NO: 2032608 - RNA, 23 nt, Homo sapiens
cagcuacucaggaggcugaagca

SEQ ID NO: 2032609 - RNA, 15 nt, Homo sapiens
aauucugguccuguu

SEQ ID NO: 2032610 - RNA, 14 nt, Homo sapiens
gaagauaguaacug

SEQ ID NO: 2032611 - RNA, 19 nt, Homo sapiens
ugcuccuugggcccuuuga

SEQ ID NO: 2032612 - RNA, 23 nt, Homo sapiens
gagccuguccugccuguggccau

SEQ ID NO: 2032613 - RNA, 12 nt, Homo sapiens
ggaaucuagccc

SEQ ID NO: 2032614 - RNA, 19 nt, Homo sapiens
acacaagcaaccaauggaa

SEQ ID NO: 2032615 - RNA, 15 nt, Homo sapiens
auggcgaaaccucau

SEQ ID NO: 2032616 - RNA, 16 nt, Homo sapiens
ccuuaauauacuacuu

SEQ ID NO: 2032617 - RNA, 19 nt, Homo sapiens
cacauggccgcugcccacg

SEQ ID NO: 2032618 - RNA, 16 nt, Homo sapiens
caccugccacaguuca

SEQ ID NO: 2032619 - RNA, 21 nt, Homo sapiens
ucuaguuauuggaucagugaa

SEQ ID NO: 2032620 - RNA, 19 nt, Homo sapiens
gugcccuagaugcacgugg

SEQ ID NO: 2032621 - RNA, 23 nt, Homo sapiens
uaggacuccacaguuuugccuua

SEQ ID NO: 2032622 - RNA, 22 nt, Homo sapiens
acaaaaauucacaagcugccuc

SEQ ID NO: 2032623 - RNA, 14 nt, Homo sapiens
ccacauauagagcu

SEQ ID NO: 2032624 - RNA, 19 nt, Homo sapiens
cagccaccacccucaggug

SEQ ID NO: 2032625 - RNA, 13 nt, Homo sapiens
cuagaaacagugu

SEQ ID NO: 2032626 - RNA, 22 nt, Homo sapiens
acuuuaauugaagaacugcacu

SEQ ID NO: 2032627 - RNA, 21 nt, Homo sapiens
caaauacaaucagcccagugc

SEQ ID NO: 2032628 - RNA, 15 nt, Homo sapiens
uuuccuccaggcaaa

SEQ ID NO: 2032629 - RNA, 19 nt, Homo sapiens
uacuuauaccucucucaaa

SEQ ID NO: 2032630 - RNA, 17 nt, Homo sapiens
cguguauaguaucugua

SEQ ID NO: 2032631 - RNA, 17 nt, Homo sapiens
uccaaugugcuuucuaa

SEQ ID NO: 2032632 - RNA, 17 nt, Homo sapiens
caggccaggugcagugg

SEQ ID NO: 2032633 - RNA, 20 nt, Homo sapiens
ucaggacagguggugcaaau

SEQ ID NO: 2032634 - RNA, 22 nt, Homo sapiens
gaaagaggccaaacaggcccuc

SEQ ID NO: 2032635 - RNA, 15 nt, Homo sapiens
aguccaguagggcag

SEQ ID NO: 2032636 - RNA, 19 nt, Homo sapiens
ucuucagguucucaugaua

SEQ ID NO: 2032637 - RNA, 15 nt, Homo sapiens
aggccagagugcagu

SEQ ID NO: 2032638 - RNA, 17 nt, Homo sapiens
uuaauacaaaacuguga

SEQ ID NO: 2032639 - RNA, 20 nt, Homo sapiens
uaaaguuuggacuuaucuau

SEQ ID NO: 2032640 - RNA, 18 nt, Homo sapiens
gggaggugagagugcaga

SEQ ID NO: 2032641 - RNA, 20 nt, Homo sapiens
uaacuaucaacuagcagaaa

SEQ ID NO: 2032642 - RNA, 18 nt, Homo sapiens
ccuguucuugaggucucu

SEQ ID NO: 2032643 - RNA, 17 nt, Homo sapiens
caagcauucucuccauu

SEQ ID NO: 2032644 - RNA, 16 nt, Homo sapiens
auacuucauacaacau

SEQ ID NO: 2032645 - RNA, 19 nt, Homo sapiens
ugauuucuagaacccguga

SEQ ID NO: 2032646 - RNA, 20 nt, Homo sapiens
ggacgcacgcucgcugccau

SEQ ID NO: 2032647 - RNA, 21 nt, Homo sapiens
gaaacugggaaucucauagga

SEQ ID NO: 2032648 - RNA, 19 nt, Homo sapiens
uggcuuacaguaaaugaac

SEQ ID NO: 2032649 - RNA, 14 nt, Homo sapiens
aaauaaaguaccau

SEQ ID NO: 2032650 - RNA, 14 nt, Homo sapiens
agcuuaagugacuu

SEQ ID NO: 2032651 - RNA, 20 nt, Homo sapiens
aggagguugaggcugcagug

SEQ ID NO: 2032652 - RNA, 23 nt, Homo sapiens
uacaggugacuacccuaguucaa

SEQ ID NO: 2032653 - RNA, 22 nt, Homo sapiens
gccccucaaccuccuguggaac

SEQ ID NO: 2032654 - RNA, 19 nt, Homo sapiens
gagucauccagcucuugcu

SEQ ID NO: 2032655 - RNA, 20 nt, Homo sapiens
gauaguacuaagcauuucag

SEQ ID NO: 2032656 - RNA, 23 nt, Homo sapiens
gaaaauguuuccuugugccugcu

SEQ ID NO: 2032657 - RNA, 21 nt, Homo sapiens
ucccgagcaacccucugaaga

SEQ ID NO: 2032658 - RNA, 18 nt, Homo sapiens
agccccagagcagggugu

SEQ ID NO: 2032659 - RNA, 18 nt, Homo sapiens
cccugcacgccggcacca

SEQ ID NO: 2032660 - RNA, 19 nt, Homo sapiens
caauaaaaguuuucuccaa

SEQ ID NO: 2032661 - RNA, 17 nt, Homo sapiens
ucaggcgauucuccugc

SEQ ID NO: 2032662 - RNA, 14 nt, Homo sapiens
ggaccaucagagag

SEQ ID NO: 2032663 - RNA, 17 nt, Homo sapiens
acaaguggcaaccugcu

SEQ ID NO: 2032664 - RNA, 17 nt, Homo sapiens
acagacuucuccagacc

SEQ ID NO: 2032665 - RNA, 14 nt, Homo sapiens
aucguguacaagaa

SEQ ID NO: 2032666 - RNA, 15 nt, Homo sapiens
acagaauuguuccag

SEQ ID NO: 2032667 - RNA, 13 nt, Homo sapiens
aggaggccagugg

SEQ ID NO: 2032668 - RNA, 16 nt, Homo sapiens
caaagcaucacacuug

SEQ ID NO: 2032669 - RNA, 14 nt, Homo sapiens
cccaaagagcuccu

SEQ ID NO: 2032670 - RNA, 23 nt, Homo sapiens
agggcagauucuucccucugagu

SEQ ID NO: 2032671 - RNA, 21 nt, Homo sapiens
uauaagaagcuuucaguauua

SEQ ID NO: 2032672 - RNA, 20 nt, Homo sapiens
cuaagaagugguguuccaug

SEQ ID NO: 2032673 - RNA, 12 nt, Homo sapiens
acaucaagcaca

SEQ ID NO: 2032674 - RNA, 17 nt, Homo sapiens
ugcuguaugucauuaaa

SEQ ID NO: 2032675 - RNA, 23 nt, Homo sapiens
ggcucuguggcaaaaagagucag

SEQ ID NO: 2032676 - RNA, 18 nt, Homo sapiens
uuaagauuuugcaccugu

SEQ ID NO: 2032677 - RNA, 20 nt, Homo sapiens
auaaaccaagacaagaccuc

SEQ ID NO: 2032678 - RNA, 11 nt, Homo sapiens
uuccacaaaau

SEQ ID NO: 2032679 - RNA, 20 nt, Homo sapiens
aucuggaagaagaugggcug

SEQ ID NO: 2032680 - RNA, 18 nt, Homo sapiens
uuuccccucuauuuuggu

SEQ ID NO: 2032681 - RNA, 20 nt, Homo sapiens
cccuggauguggauuucaca

SEQ ID NO: 2032682 - RNA, 16 nt, Homo sapiens
agccuaaauuucccaa

SEQ ID NO: 2032683 - RNA, 14 nt, Homo sapiens
ucccucuggcccug

SEQ ID NO: 2032684 - RNA, 18 nt, Homo sapiens
ugggcaaagcugugcacu

SEQ ID NO: 2032685 - RNA, 13 nt, Homo sapiens
agcugaccuggag

SEQ ID NO: 2032686 - RNA, 22 nt, Homo sapiens
uccccaagugaccuauaccugu

SEQ ID NO: 2032687 - RNA, 15 nt, Homo sapiens
acuuuccaggcuagu

SEQ ID NO: 2032688 - RNA, 20 nt, Homo sapiens
aagaaggauaccaaauacca

SEQ ID NO: 2032689 - RNA, 21 nt, Homo sapiens
ucuguaucgcugauguucacc

SEQ ID NO: 2032690 - RNA, 20 nt, Homo sapiens
acagcaaacccugaugugac

SEQ ID NO: 2032691 - RNA, 13 nt, Homo sapiens
caugacacugacc

SEQ ID NO: 2032692 - RNA, 16 nt, Homo sapiens
accaucaguuacuggu

SEQ ID NO: 2032693 - RNA, 22 nt, Homo sapiens
aguguauuuuuguuuaaucaaa

SEQ ID NO: 2032694 - RNA, 21 nt, Homo sapiens
guuuauacaguguacauguac

SEQ ID NO: 2032695 - RNA, 14 nt, Homo sapiens
aaguggcuucccau

SEQ ID NO: 2032696 - RNA, 21 nt, Homo sapiens
acaaaccuucuuuaaggcaua

SEQ ID NO: 2032697 - RNA, 19 nt, Homo sapiens
acuccucccauagauacuc

SEQ ID NO: 2032698 - RNA, 19 nt, Homo sapiens
gguguccccuauccucccc

SEQ ID NO: 2032699 - RNA, 17 nt, Homo sapiens
gauuaagaguugccaaa

SEQ ID NO: 2032700 - RNA, 21 nt, Homo sapiens
ugccccuccagagacaggaaa

SEQ ID NO: 2032701 - RNA, 16 nt, Homo sapiens
ucaaccgcuugccaua

SEQ ID NO: 2032702 - RNA, 17 nt, Homo sapiens
acaagccagucugccuc

SEQ ID NO: 2032703 - RNA, 19 nt, Homo sapiens
acuccuccaaggaaaggga

SEQ ID NO: 2032704 - RNA, 16 nt, Homo sapiens
ucuguuuccuguucuc

SEQ ID NO: 2032705 - RNA, 19 nt, Homo sapiens
acugcacccaccuacuuag

SEQ ID NO: 2032706 - RNA, 14 nt, Homo sapiens
auuaaguaaacuaa

SEQ ID NO: 2032707 - RNA, 15 nt, Homo sapiens
cuuaauaaguauuua

SEQ ID NO: 2032708 - RNA, 21 nt, Homo sapiens
aagaaguuguuugaggcaaau

SEQ ID NO: 2032709 - RNA, 16 nt, Homo sapiens
cagcugcuucucccac

SEQ ID NO: 2032710 - RNA, 23 nt, Homo sapiens
uucauugauuuaguaaguguucu

SEQ ID NO: 2032711 - RNA, 11 nt, Homo sapiens
aagacucugag

SEQ ID NO: 2032712 - RNA, 18 nt, Homo sapiens
augcaucacuauucagaa

SEQ ID NO: 2032713 - RNA, 15 nt, Homo sapiens
uggcuguauggaaau

SEQ ID NO: 2032714 - RNA, 19 nt, Homo sapiens
ccacauauuuuagacacuu

SEQ ID NO: 2032715 - RNA, 18 nt, Homo sapiens
gaacacgaauugcucaau

SEQ ID NO: 2032716 - RNA, 22 nt, Homo sapiens
uccugucuguauauaacuuauu

SEQ ID NO: 2032717 - RNA, 16 nt, Homo sapiens
ugcucugugcacucac

SEQ ID NO: 2032718 - RNA, 19 nt, Homo sapiens
ucaauacccuuggcacuga

SEQ ID NO: 2032719 - RNA, 15 nt, Homo sapiens
ugcacagcuaugaag

SEQ ID NO: 2032720 - RNA, 16 nt, Homo sapiens
caucuuuguugauguu

SEQ ID NO: 2032721 - RNA, 12 nt, Homo sapiens
gcuuccacucag

SEQ ID NO: 2032722 - RNA, 21 nt, Homo sapiens
agccauuuccacuacagugag

SEQ ID NO: 2032723 - RNA, 13 nt, Homo sapiens
uuucaauuacaaa

SEQ ID NO: 2032724 - RNA, 13 nt, Homo sapiens
uuuaaauuacaca

SEQ ID NO: 2032725 - RNA, 23 nt, Homo sapiens
cuucccuaggaucccgucuucca

SEQ ID NO: 2032726 - RNA, 17 nt, Homo sapiens
aaagccuucaaacuccc

SEQ ID NO: 2032727 - RNA, 17 nt, Homo sapiens
cugguaaaagcaccauu

SEQ ID NO: 2032728 - RNA, 23 nt, Homo sapiens
uuaaaaagauaaaaaaacagcuu

SEQ ID NO: 2032729 - RNA, 21 nt, Homo sapiens
aaaccacuucuccaugcugca

SEQ ID NO: 2032730 - RNA, 14 nt, Homo sapiens
auagcaauuucgcc

SEQ ID NO: 2032731 - RNA, 18 nt, Homo sapiens
gauauggcacuucuccaa

SEQ ID NO: 2032732 - RNA, 22 nt, Homo sapiens
ggaguuucuauagcgagacaua

SEQ ID NO: 2032733 - RNA, 22 nt, Homo sapiens
ucgcucagcaauagggugcagu

SEQ ID NO: 2032734 - RNA, 21 nt, Homo sapiens
cuaugugcacugauauggguu

SEQ ID NO: 2032735 - RNA, 18 nt, Homo sapiens
uucuuagguuuacuguga

SEQ ID NO: 2032736 - RNA, 17 nt, Homo sapiens
guuguaauaaaacuuau

SEQ ID NO: 2032737 - RNA, 15 nt, Homo sapiens
auagagggaguagaa

SEQ ID NO: 2032738 - RNA, 18 nt, Homo sapiens
uuuaccucauccaugcac

SEQ ID NO: 2032739 - RNA, 13 nt, Homo sapiens
caaauggacauaa

SEQ ID NO: 2032740 - RNA, 15 nt, Homo sapiens
ugccuccucaucagu

SEQ ID NO: 2032741 - RNA, 21 nt, Homo sapiens
ugcauguuuuaugugcacuca

SEQ ID NO: 2032742 - RNA, 22 nt, Homo sapiens
agaccagccaaggguccucacc

SEQ ID NO: 2032743 - RNA, 23 nt, Homo sapiens
aaagugcuucauucuuugcagga

SEQ ID NO: 2032744 - RNA, 22 nt, Homo sapiens
cgguuuccauauuuuuugcaca

SEQ ID NO: 2032745 - RNA, 12 nt, Homo sapiens
auauauggacau

SEQ ID NO: 2032746 - RNA, 17 nt, Homo sapiens
gcuccgaggacccagga

SEQ ID NO: 2032747 - RNA, 15 nt, Homo sapiens
uaucaauaucuaaua

SEQ ID NO: 2032748 - RNA, 21 nt, Homo sapiens
cuugagcagaccgugauuugg

SEQ ID NO: 2032749 - RNA, 16 nt, Homo sapiens
cuuuccaagucauuuu

SEQ ID NO: 2032750 - RNA, 16 nt, Homo sapiens
cucaauggaaccaaau

SEQ ID NO: 2032751 - RNA, 12 nt, Homo sapiens
cauagccuauaa

SEQ ID NO: 2032752 - RNA, 13 nt, Homo sapiens
gaucguacuugaa

SEQ ID NO: 2032753 - RNA, 23 nt, Homo sapiens
uagggcacaaagacuucggggaa

SEQ ID NO: 2032754 - RNA, 14 nt, Homo sapiens
ggaaacuaagguca

SEQ ID NO: 2032755 - RNA, 13 nt, Homo sapiens
cauacauguuaca

SEQ ID NO: 2032756 - RNA, 21 nt, Homo sapiens
cagggccagcuuuuccucacc

SEQ ID NO: 2032757 - RNA, 20 nt, Homo sapiens
cagguccccuuucagagaua

SEQ ID NO: 2032758 - RNA, 20 nt, Homo sapiens
ugaaaauucgaaccaggaaa

SEQ ID NO: 2032759 - RNA, 18 nt, Homo sapiens
gcauauguguuacuucaa

SEQ ID NO: 2032760 - RNA, 19 nt, Homo sapiens
agagauaccaucuucugua

SEQ ID NO: 2032761 - RNA, 16 nt, Homo sapiens
ucacaucacacaaaag

SEQ ID NO: 2032762 - RNA, 14 nt, Homo sapiens
aucuguguacugaa

SEQ ID NO: 2032763 - RNA, 19 nt, Homo sapiens
ugaacuauuagacaugaaa

SEQ ID NO: 2032764 - RNA, 21 nt, Homo sapiens
ugcagggggugugucugcuca

SEQ ID NO: 2032765 - RNA, 16 nt, Homo sapiens
ggacucucagccucuu

SEQ ID NO: 2032766 - RNA, 15 nt, Homo sapiens
cucuccagacacaga

SEQ ID NO: 2032767 - RNA, 16 nt, Homo sapiens
auaauaaauacacaau

SEQ ID NO: 2032768 - RNA, 14 nt, Homo sapiens
agaaagauacuaau

SEQ ID NO: 2032769 - RNA, 22 nt, Homo sapiens
uuuaaagggaaugacuuugaag

SEQ ID NO: 2032770 - RNA, 19 nt, Homo sapiens
auccgaaguaugagggaaa

SEQ ID NO: 2032771 - RNA, 18 nt, Homo sapiens
uugaggagcugcacugau

SEQ ID NO: 2032772 - RNA, 20 nt, Homo sapiens
guaucagccccaagcaggug

SEQ ID NO: 2032773 - RNA, 12 nt, Homo sapiens
cuuaagcuuuca

SEQ ID NO: 2032774 - RNA, 21 nt, Homo sapiens
cugggacccacuccgacuccc

SEQ ID NO: 2032775 - RNA, 21 nt, Homo sapiens
gcccugcaccuugggcacggg

SEQ ID NO: 2032776 - RNA, 20 nt, Homo sapiens
ucuccuuggaaauacuuuau

SEQ ID NO: 2032777 - RNA, 14 nt, Homo sapiens
aaugggcucuucca

SEQ ID NO: 2032778 - RNA, 20 nt, Homo sapiens
cucaucacugcuccugucac

SEQ ID NO: 2032779 - RNA, 18 nt, Homo sapiens
cccuguucaugugccucu

SEQ ID NO: 2032780 - RNA, 20 nt, Homo sapiens
gaaucaacagaucaaugaca

SEQ ID NO: 2032781 - RNA, 17 nt, Homo sapiens
cauccagagaccaaaua

SEQ ID NO: 2032782 - RNA, 17 nt, Homo sapiens
uagagacuuugugaaaa

SEQ ID NO: 2032783 - RNA, 13 nt, Homo sapiens
agggugucuuccu

SEQ ID NO: 2032784 - RNA, 16 nt, Homo sapiens
ugagaaauuccuuagu

SEQ ID NO: 2032785 - RNA, 18 nt, Homo sapiens
caucuucccuucacucaa

SEQ ID NO: 2032786 - RNA, 20 nt, Homo sapiens
ugggaaacuugucacuugca

SEQ ID NO: 2032787 - RNA, 14 nt, Homo sapiens
ucuaaacccaaaua

SEQ ID NO: 2032788 - RNA, 16 nt, Homo sapiens
ccugugcuuucccuga

SEQ ID NO: 2032789 - RNA, 20 nt, Homo sapiens
accuguacacugacuugaga

SEQ ID NO: 2032790 - RNA, 22 nt, Homo sapiens
acaguuuccuucuggaguucca

SEQ ID NO: 2032791 - RNA, 19 nt, Homo sapiens
acugaauuuuggaggcaaa

SEQ ID NO: 2032792 - RNA, 20 nt, Homo sapiens
guuucagcuucaguccuccu

SEQ ID NO: 2032793 - RNA, 21 nt, Homo sapiens
agccucagcggacaagcagcu

SEQ ID NO: 2032794 - RNA, 17 nt, Homo sapiens
uaguuuuuccugugcaa

SEQ ID NO: 2032795 - RNA, 21 nt, Homo sapiens
ggggcagccacaccacugcca

SEQ ID NO: 2032796 - RNA, 19 nt, Homo sapiens
agauaccuugcaaagcaac

SEQ ID NO: 2032797 - RNA, 16 nt, Homo sapiens
cccaaaugcuuuccau

SEQ ID NO: 2032798 - RNA, 19 nt, Homo sapiens
cagaugcugaaaauguccu

SEQ ID NO: 2032799 - RNA, 22 nt, Homo sapiens
guggaugucccuauucugccau

SEQ ID NO: 2032800 - RNA, 20 nt, Homo sapiens
accauaaaaauccuucucac

SEQ ID NO: 2032801 - RNA, 18 nt, Homo sapiens
ucugaaugggagccagaa

SEQ ID NO: 2032802 - RNA, 20 nt, Homo sapiens
uguugaauucuuuugccaag

SEQ ID NO: 2032803 - RNA, 12 nt, Homo sapiens
agcaccgugcca

SEQ ID NO: 2032804 - RNA, 16 nt, Homo sapiens
auugauaacagcacug

SEQ ID NO: 2032805 - RNA, 23 nt, Homo sapiens
agugcaguggugcgaucuuggcu

SEQ ID NO: 2032806 - RNA, 20 nt, Homo sapiens
agcuaugaagaaaacacaaa

SEQ ID NO: 2032807 - RNA, 18 nt, Homo sapiens
uagaaguuaaagucaaua

SEQ ID NO: 2032808 - RNA, 13 nt, Homo sapiens
agagccucaguga

SEQ ID NO: 2032809 - RNA, 17 nt, Homo sapiens
cuauuuauauaucauag

SEQ ID NO: 2032810 - RNA, 20 nt, Homo sapiens
ccugcugcgcucggcccuca

SEQ ID NO: 2032811 - RNA, 16 nt, Homo sapiens
uaaacauugugaucau

SEQ ID NO: 2032812 - RNA, 16 nt, Homo sapiens
uaaaauguaucugcau

SEQ ID NO: 2032813 - RNA, 17 nt, Homo sapiens
uccacaccugggcauuu

SEQ ID NO: 2032814 - RNA, 14 nt, Homo sapiens
ccggcuguggagca

SEQ ID NO: 2032815 - RNA, 22 nt, Homo sapiens
acuugcaguuagacucaaagaa

SEQ ID NO: 2032816 - RNA, 15 nt, Homo sapiens
ugggggccuccucag

SEQ ID NO: 2032817 - RNA, 15 nt, Homo sapiens
acguuuucuuucaca

SEQ ID NO: 2032818 - RNA, 17 nt, Homo sapiens
aucccguaucacagugu

SEQ ID NO: 2032819 - RNA, 19 nt, Homo sapiens
gggugagccaccgugccca

SEQ ID NO: 2032820 - RNA, 14 nt, Homo sapiens
ggucacccugugac

SEQ ID NO: 2032821 - RNA, 15 nt, Homo sapiens
uguggaguguggcag

SEQ ID NO: 2032822 - RNA, 23 nt, Homo sapiens
aacuuuuaccuggcugcugccau

SEQ ID NO: 2032823 - RNA, 20 nt, Homo sapiens
aauuucacucucugcauuga

SEQ ID NO: 2032824 - RNA, 21 nt, Homo sapiens
ucagaguuuguguguauuugu

SEQ ID NO: 2032825 - RNA, 21 nt, Homo sapiens
cuggcugggaguccuuaccuc

SEQ ID NO: 2032826 - RNA, 20 nt, Homo sapiens
uucuguguagacaugguucu

SEQ ID NO: 2032827 - RNA, 17 nt, Homo sapiens
cccuuacuaugaucuca

SEQ ID NO: 2032828 - RNA, 21 nt, Homo sapiens
cacagaaagcuccuuccagac

SEQ ID NO: 2032829 - RNA, 22 nt, Homo sapiens
auguuaauuuuuugguacaaaa

SEQ ID NO: 2032830 - RNA, 21 nt, Homo sapiens
agcuggcccgucaagugcugc

SEQ ID NO: 2032831 - RNA, 21 nt, Homo sapiens
uuauauguauaucacauuccc

SEQ ID NO: 2032832 - RNA, 13 nt, Homo sapiens
cucuggucuccac

SEQ ID NO: 2032833 - RNA, 16 nt, Homo sapiens
ccauauucuaaauuca

SEQ ID NO: 2032834 - RNA, 15 nt, Homo sapiens
caugcugcuacaaua

SEQ ID NO: 2032835 - RNA, 16 nt, Homo sapiens
cuaauuguaagugaaa

SEQ ID NO: 2032836 - RNA, 18 nt, Homo sapiens
gagaggggacucaaacag

SEQ ID NO: 2032837 - RNA, 15 nt, Homo sapiens
uuuuaaagugcucuu

SEQ ID NO: 2032838 - RNA, 18 nt, Homo sapiens
ucaucauacaugacucag

SEQ ID NO: 2032839 - RNA, 15 nt, Homo sapiens
cagugaacugagacu

SEQ ID NO: 2032840 - RNA, 18 nt, Homo sapiens
aagugaagacgaggccaa

SEQ ID NO: 2032841 - RNA, 19 nt, Homo sapiens
agguucuaaaguucuaaga

SEQ ID NO: 2032842 - RNA, 19 nt, Homo sapiens
ucauguuuacuuguuuuau

SEQ ID NO: 2032843 - RNA, 12 nt, Homo sapiens
auuuauauaugu

SEQ ID NO: 2032844 - RNA, 14 nt, Homo sapiens
cuuuauuaaguaaa

SEQ ID NO: 2032845 - RNA, 16 nt, Homo sapiens
gcuagacugugucuga

SEQ ID NO: 2032846 - RNA, 17 nt, Homo sapiens
ccugugaccagcacugu

SEQ ID NO: 2032847 - RNA, 14 nt, Homo sapiens
aagacacuguuaca

SEQ ID NO: 2032848 - RNA, 19 nt, Homo sapiens
uucagcucacggaagggau

SEQ ID NO: 2032849 - RNA, 18 nt, Homo sapiens
uugugaaagcaccaucau

SEQ ID NO: 2032850 - RNA, 15 nt, Homo sapiens
ggcauuuuguacaau

SEQ ID NO: 2032851 - RNA, 23 nt, Homo sapiens
cagaaggacacuagccugugcac

SEQ ID NO: 2032852 - RNA, 12 nt, Homo sapiens
gugaacagggaa

SEQ ID NO: 2032853 - RNA, 19 nt, Homo sapiens
auauguaagugguuuuuau

SEQ ID NO: 2032854 - RNA, 18 nt, Homo sapiens
acaggcagucucucucuu

SEQ ID NO: 2032855 - RNA, 22 nt, Homo sapiens
caaaggcagggccacuuuugaa

SEQ ID NO: 2032856 - RNA, 13 nt, Homo sapiens
acagggugagcac

SEQ ID NO: 2032857 - RNA, 18 nt, Homo sapiens
ugccucgggaaccucacu

SEQ ID NO: 2032858 - RNA, 19 nt, Homo sapiens
ugcuuggaaauuccuugcc

SEQ ID NO: 2032859 - RNA, 15 nt, Homo sapiens
uuaaaugaccaaaga

SEQ ID NO: 2032860 - RNA, 19 nt, Homo sapiens
ccaggaaagcagcaaagga

SEQ ID NO: 2032861 - RNA, 22 nt, Homo sapiens
ugucuuaggcugaugccacuac

SEQ ID NO: 2032862 - RNA, 21 nt, Homo sapiens
ggcccugcccugcccaaccuc

SEQ ID NO: 2032863 - RNA, 21 nt, Homo sapiens
ccauauuggcaaggcugccac

SEQ ID NO: 2032864 - RNA, 17 nt, Homo sapiens
gugcagcgggugcugcu

SEQ ID NO: 2032865 - RNA, 22 nt, Homo sapiens
aggaaaaccgaguaucuggccu

SEQ ID NO: 2032866 - RNA, 18 nt, Homo sapiens
gggccuguagaucaggga

SEQ ID NO: 2032867 - RNA, 20 nt, Homo sapiens
cccuguucuuggaucugcca

SEQ ID NO: 2032868 - RNA, 17 nt, Homo sapiens
auaaagaggacuugaac

SEQ ID NO: 2032869 - RNA, 12 nt, Homo sapiens
gaaucaagcaau

SEQ ID NO: 2032870 - RNA, 18 nt, Homo sapiens
cacuugggagcaaaagau

SEQ ID NO: 2032871 - RNA, 23 nt, Homo sapiens
caggaggaggcugcccugagggg

SEQ ID NO: 2032872 - RNA, 18 nt, Homo sapiens
ggcuaaagagaugagaca

SEQ ID NO: 2032873 - RNA, 22 nt, Homo sapiens
agagaagggaaguaggcccuua

SEQ ID NO: 2032874 - RNA, 13 nt, Homo sapiens
gaagugcagcuca

SEQ ID NO: 2032875 - RNA, 13 nt, Homo sapiens
auuuaacuugagc

SEQ ID NO: 2032876 - RNA, 23 nt, Homo sapiens
acaagugccuccuggacuguuca

SEQ ID NO: 2032877 - RNA, 14 nt, Homo sapiens
uaaccauuaugcaa

SEQ ID NO: 2032878 - RNA, 13 nt, Homo sapiens
ugcccuaaccuga

SEQ ID NO: 2032879 - RNA, 16 nt, Homo sapiens
ccugucuacaguuuaa

SEQ ID NO: 2032880 - RNA, 20 nt, Homo sapiens
guguaccucauggaugcuuu

SEQ ID NO: 2032881 - RNA, 15 nt, Homo sapiens
cuuagggugaaccac

SEQ ID NO: 2032882 - RNA, 16 nt, Homo sapiens
cuaagucucugugaau

SEQ ID NO: 2032883 - RNA, 14 nt, Homo sapiens
aggccugcccuccc

SEQ ID NO: 2032884 - RNA, 19 nt, Homo sapiens
aucccugaggaaaagucca

SEQ ID NO: 2032885 - RNA, 22 nt, Homo sapiens
uguuacauagguauauauaugc

SEQ ID NO: 2032886 - RNA, 21 nt, Homo sapiens
cagaaccuacuguuccuuuca

SEQ ID NO: 2032887 - RNA, 21 nt, Homo sapiens
uccuugcugauuugcacacau

SEQ ID NO: 2032888 - RNA, 18 nt, Homo sapiens
caagccacaagucuucca

SEQ ID NO: 2032889 - RNA, 18 nt, Homo sapiens
ucccucuuggucuuccca

SEQ ID NO: 2032890 - RNA, 18 nt, Homo sapiens
gcuaaguauugaauuuca

SEQ ID NO: 2032891 - RNA, 13 nt, Homo sapiens
uucagagagcagu

SEQ ID NO: 2032892 - RNA, 19 nt, Homo sapiens
guuucaguaauugucagag

SEQ ID NO: 2032893 - RNA, 17 nt, Homo sapiens
cugucccaccugcacac

SEQ ID NO: 2032894 - RNA, 18 nt, Homo sapiens
gaaaaugucacugugaca

SEQ ID NO: 2032895 - RNA, 18 nt, Homo sapiens
uccaacaagaaugcauuc

SEQ ID NO: 2032896 - RNA, 17 nt, Homo sapiens
aaaucagaaauaugaca

SEQ ID NO: 2032897 - RNA, 15 nt, Homo sapiens
ugaauguggacucaa

SEQ ID NO: 2032898 - RNA, 21 nt, Homo sapiens
augccaauaaaguuugcccau

SEQ ID NO: 2032899 - RNA, 19 nt, Homo sapiens
augccuggucccaagacag

SEQ ID NO: 2032900 - RNA, 15 nt, Homo sapiens
acuuagcaugcacaa

SEQ ID NO: 2032901 - RNA, 18 nt, Homo sapiens
uccgguuugccauguugc

SEQ ID NO: 2032902 - RNA, 13 nt, Homo sapiens
uacauuguauucu

SEQ ID NO: 2032903 - RNA, 20 nt, Homo sapiens
gaguugccaagacaaaucaa

SEQ ID NO: 2032904 - RNA, 12 nt, Homo sapiens
aucagaagcaca

SEQ ID NO: 2032905 - RNA, 14 nt, Homo sapiens
aucaacaacacagc

SEQ ID NO: 2032906 - RNA, 12 nt, Homo sapiens
aguaacacuggc

SEQ ID NO: 2032907 - RNA, 16 nt, Homo sapiens
cuuauuuuuagccaua

SEQ ID NO: 2032908 - RNA, 20 nt, Homo sapiens
ugcaccuuccagcccggggc

SEQ ID NO: 2032909 - RNA, 13 nt, Homo sapiens
uaaguaugccuca

SEQ ID NO: 2032910 - RNA, 22 nt, Homo sapiens
gcaggaaaccccagcggcagau

SEQ ID NO: 2032911 - RNA, 17 nt, Homo sapiens
acuacaaacacaauauu

SEQ ID NO: 2032912 - RNA, 19 nt, Homo sapiens
gcauagcuuugcacuucaa

SEQ ID NO: 2032913 - RNA, 22 nt, Homo sapiens
acucauggaugagacuacuuca

SEQ ID NO: 2032914 - RNA, 21 nt, Homo sapiens
aaugucaguuacaauaugaga

SEQ ID NO: 2032915 - RNA, 13 nt, Homo sapiens
gugauuucucacc

SEQ ID NO: 2032916 - RNA, 15 nt, Homo sapiens
cccucccucagggag

SEQ ID NO: 2032917 - RNA, 17 nt, Homo sapiens
uccuccccaaccugcaa

SEQ ID NO: 2032918 - RNA, 19 nt, Homo sapiens
ugugcuccagucauugcac

SEQ ID NO: 2032919 - RNA, 17 nt, Homo sapiens
ccaagucuccaccccuu

SEQ ID NO: 2032920 - RNA, 19 nt, Homo sapiens
auuugcauuauguauuuau

SEQ ID NO: 2032921 - RNA, 17 nt, Homo sapiens
ucccacccugggcaaug

SEQ ID NO: 2032922 - RNA, 15 nt, Homo sapiens
uagcuuuucauuucu

SEQ ID NO: 2032923 - RNA, 21 nt, Homo sapiens
auauaaaugugauugcagcuu

SEQ ID NO: 2032924 - RNA, 11 nt, Homo sapiens
cucuaacugga

SEQ ID NO: 2032925 - RNA, 18 nt, Homo sapiens
gcuagcaguaaaagauga

SEQ ID NO: 2032926 - RNA, 18 nt, Homo sapiens
ccacaaccgaccagaugc

SEQ ID NO: 2032927 - RNA, 23 nt, Homo sapiens
gagaccagccugggcaacaaagu

SEQ ID NO: 2032928 - RNA, 22 nt, Homo sapiens
auucucguauccaacccaagga

SEQ ID NO: 2032929 - RNA, 15 nt, Homo sapiens
aaccaagggggauga

SEQ ID NO: 2032930 - RNA, 23 nt, Homo sapiens
gaaagcaucuauucccaaagaac

SEQ ID NO: 2032931 - RNA, 19 nt, Homo sapiens
auaauaaacaacauugucu

SEQ ID NO: 2032932 - RNA, 17 nt, Homo sapiens
gagccuucugugcugug

SEQ ID NO: 2032933 - RNA, 14 nt, Homo sapiens
uuucauggacacuu

SEQ ID NO: 2032934 - RNA, 13 nt, Homo sapiens
cagcuaaauguga

SEQ ID NO: 2032935 - RNA, 23 nt, Homo sapiens
uaaaauuauuacuaaugaugcuu

SEQ ID NO: 2032936 - RNA, 13 nt, Homo sapiens
ugccuugaacugu

SEQ ID NO: 2032937 - RNA, 12 nt, Homo sapiens
uaaaagcacuua

SEQ ID NO: 2032938 - RNA, 20 nt, Homo sapiens
ccaggauggcgcaggaacuc

SEQ ID NO: 2032939 - RNA, 17 nt, Homo sapiens
uccuccugacaccccac

SEQ ID NO: 2032940 - RNA, 13 nt, Homo sapiens
uguuuuaaguuua

SEQ ID NO: 2032941 - RNA, 22 nt, Homo sapiens
auuuuuuuuuuaaaacuaucca

SEQ ID NO: 2032942 - RNA, 13 nt, Homo sapiens
aguagguuuacau

SEQ ID NO: 2032943 - RNA, 13 nt, Homo sapiens
aaacauagguaua

SEQ ID NO: 2032944 - RNA, 18 nt, Homo sapiens
aggaucauuugagcucau

SEQ ID NO: 2032945 - RNA, 18 nt, Homo sapiens
cuccuauggucacagacu

SEQ ID NO: 2032946 - RNA, 19 nt, Homo sapiens
gguugccauggagaucuga

SEQ ID NO: 2032947 - RNA, 16 nt, Homo sapiens
uggguggagaagggag

SEQ ID NO: 2032948 - RNA, 17 nt, Homo sapiens
ccucuagucagcacuag

SEQ ID NO: 2032949 - RNA, 21 nt, Homo sapiens
ggguggaggggagugugugca

SEQ ID NO: 2032950 - RNA, 20 nt, Homo sapiens
ucuagaauuuagugauacug

SEQ ID NO: 2032951 - RNA, 16 nt, Homo sapiens
acuccugccgcaguga

SEQ ID NO: 2032952 - RNA, 15 nt, Homo sapiens
ucugauggugucauc

SEQ ID NO: 2032953 - RNA, 14 nt, Homo sapiens
cccaggacacugcc

SEQ ID NO: 2032954 - RNA, 22 nt, Homo sapiens
cugaccaguuuaaccugaugca

SEQ ID NO: 2032955 - RNA, 17 nt, Homo sapiens
gaaaugauaaagauguc

SEQ ID NO: 2032956 - RNA, 14 nt, Homo sapiens
caaggagacacaac

SEQ ID NO: 2032957 - RNA, 17 nt, Homo sapiens
ugugugccaugucacag

SEQ ID NO: 2032958 - RNA, 19 nt, Homo sapiens
gcuuuuaagagcaauguuu

SEQ ID NO: 2032959 - RNA, 14 nt, Homo sapiens
uacagaacucuuuc

SEQ ID NO: 2032960 - RNA, 16 nt, Homo sapiens
aucuuuuaauuacaga

SEQ ID NO: 2032961 - RNA, 16 nt, Homo sapiens
cacacuuucauuuagu

SEQ ID NO: 2032962 - RNA, 17 nt, Homo sapiens
auucuuaaugacauuuc

SEQ ID NO: 2032963 - RNA, 13 nt, Homo sapiens
acugaagauuuca

SEQ ID NO: 2032964 - RNA, 16 nt, Homo sapiens
uugguguaaaucuuuu

SEQ ID NO: 2032965 - RNA, 14 nt, Homo sapiens
aacccucugucacc

SEQ ID NO: 2032966 - RNA, 16 nt, Homo sapiens
aguuauauugaauaua

SEQ ID NO: 2032967 - RNA, 19 nt, Homo sapiens
augagaacugguucuugcc

SEQ ID NO: 2032968 - RNA, 14 nt, Homo sapiens
uuaccagacuucaa

SEQ ID NO: 2032969 - RNA, 14 nt, Homo sapiens
cuuccagauuacaa

SEQ ID NO: 2032970 - RNA, 22 nt, Homo sapiens
cauuccauuuugugaauuguga

SEQ ID NO: 2032971 - RNA, 17 nt, Homo sapiens
agguuagugacauuuaa

SEQ ID NO: 2032972 - RNA, 16 nt, Homo sapiens
uacuuuucacacuguc

SEQ ID NO: 2032973 - RNA, 10 nt, Homo sapiens
auuccaaagu

SEQ ID NO: 2032974 - RNA, 17 nt, Homo sapiens
gcuucugucuccagcuu

SEQ ID NO: 2032975 - RNA, 14 nt, Homo sapiens
cuguguucugcaca

SEQ ID NO: 2032976 - RNA, 14 nt, Homo sapiens
ggagcuugcaguga

SEQ ID NO: 2032977 - RNA, 13 nt, Homo sapiens
uacucacauauaa

SEQ ID NO: 2032978 - RNA, 19 nt, Homo sapiens
gcuguccucuuaagacacu

SEQ ID NO: 2032979 - RNA, 19 nt, Homo sapiens
gcauuagggaaaacuuaau

SEQ ID NO: 2032980 - RNA, 15 nt, Homo sapiens
uauuuaaacucgcuc

SEQ ID NO: 2032981 - RNA, 17 nt, Homo sapiens
gaggacuguuggcugau

SEQ ID NO: 2032982 - RNA, 22 nt, Homo sapiens
ccgagagaugacacuagucaga

SEQ ID NO: 2032983 - RNA, 22 nt, Homo sapiens
ccgcacuuggaaagguuucaag

SEQ ID NO: 2032984 - RNA, 14 nt, Homo sapiens
agacagagucucac

SEQ ID NO: 2032985 - RNA, 20 nt, Homo sapiens
caggacucaaucuacaggcc

SEQ ID NO: 2032986 - RNA, 14 nt, Homo sapiens
agauggagucuugc

SEQ ID NO: 2032987 - RNA, 13 nt, Homo sapiens
cagaaaugcacau

SEQ ID NO: 2032988 - RNA, 16 nt, Homo sapiens
auguuuugaucaaauu

SEQ ID NO: 2032989 - RNA, 20 nt, Homo sapiens
cuuuacuccguaacagauuu

SEQ ID NO: 2032990 - RNA, 16 nt, Homo sapiens
aauuauuucugucaca

SEQ ID NO: 2032991 - RNA, 22 nt, Homo sapiens
aauauauauauauaucaguuug

SEQ ID NO: 2032992 - RNA, 13 nt, Homo sapiens
uccuaaccaguga

SEQ ID NO: 2032993 - RNA, 21 nt, Homo sapiens
uggucccuaaauuugcaugaa

SEQ ID NO: 2032994 - RNA, 16 nt, Homo sapiens
gacuaggaaauuccaa

SEQ ID NO: 2032995 - RNA, 19 nt, Homo sapiens
uauuucaaaccaguuucac

SEQ ID NO: 2032996 - RNA, 18 nt, Homo sapiens
gcccagcgcggacauccc

SEQ ID NO: 2032997 - RNA, 21 nt, Homo sapiens
aaauaaagucuccuggauuua

SEQ ID NO: 2032998 - RNA, 16 nt, Homo sapiens
acauuucuguucucau

SEQ ID NO: 2032999 - RNA, 13 nt, Homo sapiens
caagaacaauuca

SEQ ID NO: 2033000 - RNA, 16 nt, Homo sapiens
gucuucuuuugauaua

SEQ ID NO: 2033001 - RNA, 22 nt, Homo sapiens
uguagucccagcuacucaggag

SEQ ID NO: 2033002 - RNA, 15 nt, Homo sapiens
gaacccaacaguuca

SEQ ID NO: 2033003 - RNA, 17 nt, Homo sapiens
uccuggucugcucagga

SEQ ID NO: 2033004 - RNA, 17 nt, Homo sapiens
auguaaacuuugucaug

SEQ ID NO: 2033005 - RNA, 11 nt, Homo sapiens
accugugacaa

SEQ ID NO: 2033006 - RNA, 16 nt, Homo sapiens
agaaaagaacuggaaa

SEQ ID NO: 2033007 - RNA, 15 nt, Homo sapiens
auaauaaaguagcaa

SEQ ID NO: 2033008 - RNA, 15 nt, Homo sapiens
augaagaccaaagac

SEQ ID NO: 2033009 - RNA, 13 nt, Homo sapiens
accguaucucagg

SEQ ID NO: 2033010 - RNA, 17 nt, Homo sapiens
gcaaacuucagacugaa

SEQ ID NO: 2033011 - RNA, 15 nt, Homo sapiens
aaaugaaaauguuuc

SEQ ID NO: 2033012 - RNA, 22 nt, Homo sapiens
ucaaggggcuggaaucucauga

SEQ ID NO: 2033013 - RNA, 21 nt, Homo sapiens
ucuaaggcugugccaucagcu

SEQ ID NO: 2033014 - RNA, 21 nt, Homo sapiens
cugcccccacagcuccuugca

SEQ ID NO: 2033015 - RNA, 15 nt, Homo sapiens
aauagaugacagugg

SEQ ID NO: 2033016 - RNA, 14 nt, Homo sapiens
uccauguugcugac

SEQ ID NO: 2033017 - RNA, 12 nt, Homo sapiens
cuuaacaaucaa

SEQ ID NO: 2033018 - RNA, 20 nt, Homo sapiens
agcaaugcugaugaaucacu

SEQ ID NO: 2033019 - RNA, 13 nt, Homo sapiens
uaacgugucaggg

SEQ ID NO: 2033020 - RNA, 13 nt, Homo sapiens
ucagcuugguucc

SEQ ID NO: 2033021 - RNA, 22 nt, Homo sapiens
auacaaacugugaccucagcuu

SEQ ID NO: 2033022 - RNA, 16 nt, Homo sapiens
agaacagaaguguuca

SEQ ID NO: 2033023 - RNA, 19 nt, Homo sapiens
auuacggacucuggauauu

SEQ ID NO: 2033024 - RNA, 15 nt, Homo sapiens
cauuucuauaggcaa

SEQ ID NO: 2033025 - RNA, 13 nt, Homo sapiens
aguggugccauca

SEQ ID NO: 2033026 - RNA, 13 nt, Homo sapiens
ugcagccacuuuc

SEQ ID NO: 2033027 - RNA, 23 nt, Homo sapiens
gcccagagugagcuuuagcucuc

SEQ ID NO: 2033028 - RNA, 21 nt, Homo sapiens
accucaugcugagcgcugugu

SEQ ID NO: 2033029 - RNA, 18 nt, Homo sapiens
ugcugguggguuagcuaa

SEQ ID NO: 2033030 - RNA, 19 nt, Homo sapiens
cggccagcaccgcugcuca

SEQ ID NO: 2033031 - RNA, 16 nt, Homo sapiens
acuuucuuacacugaa

SEQ ID NO: 2033032 - RNA, 22 nt, Homo sapiens
uucugcacauaaguuaugguuu

SEQ ID NO: 2033033 - RNA, 13 nt, Homo sapiens
uuuccaguucccu

SEQ ID NO: 2033034 - RNA, 13 nt, Homo sapiens
gucucagugcuuu

SEQ ID NO: 2033035 - RNA, 14 nt, Homo sapiens
uuugugugcgucac

SEQ ID NO: 2033036 - RNA, 13 nt, Homo sapiens
augacuuuuccau

SEQ ID NO: 2033037 - RNA, 21 nt, Homo sapiens
ugagggucgugggaaagggga

SEQ ID NO: 2033038 - RNA, 18 nt, Homo sapiens
uccuuagcuaguuagcuc

SEQ ID NO: 2033039 - RNA, 24 nt, Homo sapiens
cagcuacuccggaggcugaggcag

SEQ ID NO: 2033040 - RNA, 22 nt, Homo sapiens
uuuuaccaaagcaucaauacaa

SEQ ID NO: 2033041 - RNA, 21 nt, Homo sapiens
caaaucauacuuuuucuuuga

SEQ ID NO: 2033042 - RNA, 23 nt, Homo sapiens
ugaaaguuuuucugaaaguguug

SEQ ID NO: 2033043 - RNA, 19 nt, Homo sapiens
aaagacuuuccucuuaguc

SEQ ID NO: 2033044 - RNA, 23 nt, Homo sapiens
gugaaauuuaaauaauagacaua

SEQ ID NO: 2033045 - RNA, 14 nt, Homo sapiens
agugucuaccuucc

SEQ ID NO: 2033046 - RNA, 17 nt, Homo sapiens
aaaaccuuuacaguuag

SEQ ID NO: 2033047 - RNA, 18 nt, Homo sapiens
gucuauuuucucagucau

SEQ ID NO: 2033048 - RNA, 19 nt, Homo sapiens
aacccugccaguuucucca

SEQ ID NO: 2033049 - RNA, 23 nt, Homo sapiens
gaauauuuaagcaauaaaacugc

SEQ ID NO: 2033050 - RNA, 20 nt, Homo sapiens
acuggaggggucauccuugc

SEQ ID NO: 2033051 - RNA, 15 nt, Homo sapiens
aauuuauugcacaaa

SEQ ID NO: 2033052 - RNA, 18 nt, Homo sapiens
ucagauggagacauugga

SEQ ID NO: 2033053 - RNA, 20 nt, Homo sapiens
uuccugauauaucaaacuga

SEQ ID NO: 2033054 - RNA, 12 nt, Homo sapiens
cucucuggucua

SEQ ID NO: 2033055 - RNA, 12 nt, Homo sapiens
gaacacaccucu

SEQ ID NO: 2033056 - RNA, 19 nt, Homo sapiens
agaugcaugucugccaaaa

SEQ ID NO: 2033057 - RNA, 17 nt, Homo sapiens
ccuuuggcaauucuucu

SEQ ID NO: 2033058 - RNA, 15 nt, Homo sapiens
cuggaaacacauguu

SEQ ID NO: 2033059 - RNA, 19 nt, Homo sapiens
uguauauaaaaugugcgag

SEQ ID NO: 2033060 - RNA, 16 nt, Homo sapiens
aggcuggaccaacugc

SEQ ID NO: 2033061 - RNA, 16 nt, Homo sapiens
aggacucaccacugcc

SEQ ID NO: 2033062 - RNA, 22 nt, Homo sapiens
ugaccccuguccccacacugac

SEQ ID NO: 2033063 - RNA, 18 nt, Homo sapiens
ccacacuuccugagccag

SEQ ID NO: 2033064 - RNA, 18 nt, Homo sapiens
uugacaccaagaaaccac

SEQ ID NO: 2033065 - RNA, 19 nt, Homo sapiens
cuaaggaguaaucugugua

SEQ ID NO: 2033066 - RNA, 18 nt, Homo sapiens
gcucuccccuucucugua

SEQ ID NO: 2033067 - RNA, 23 nt, Homo sapiens
ucagaggccugcugccagugcag

SEQ ID NO: 2033068 - RNA, 16 nt, Homo sapiens
auuccagcgucuucua

SEQ ID NO: 2033069 - RNA, 16 nt, Homo sapiens
gccccaggcauugcca

SEQ ID NO: 2033070 - RNA, 17 nt, Homo sapiens
aucucaaagaaggcauu

SEQ ID NO: 2033071 - RNA, 16 nt, Homo sapiens
acaacuccuacaugau

SEQ ID NO: 2033072 - RNA, 18 nt, Homo sapiens
cucuccauucugcuccuu

SEQ ID NO: 2033073 - RNA, 21 nt, Homo sapiens
uaucugaguugccaagacaaa

SEQ ID NO: 2033074 - RNA, 13 nt, Homo sapiens
gaauucuuugcau

SEQ ID NO: 2033075 - RNA, 15 nt, Homo sapiens
ccgaggaggagcucu

SEQ ID NO: 2033076 - RNA, 21 nt, Homo sapiens
gacccaguggucagcaggugu

SEQ ID NO: 2033077 - RNA, 19 nt, Homo sapiens
cugaugucuccacuuucac

SEQ ID NO: 2033078 - RNA, 20 nt, Homo sapiens
gacugauacugcagugacug

SEQ ID NO: 2033079 - RNA, 18 nt, Homo sapiens
ccaggcaccucacagaaa

SEQ ID NO: 2033080 - RNA, 11 nt, Homo sapiens
gcaauggcgcc

SEQ ID NO: 2033081 - RNA, 19 nt, Homo sapiens
agacugaaaggugugaaca

SEQ ID NO: 2033082 - RNA, 23 nt, Homo sapiens
cccgaaacaccaagugaggccau

SEQ ID NO: 2033083 - RNA, 22 nt, Homo sapiens
ugcagucggugguaccugagau

SEQ ID NO: 2033084 - RNA, 14 nt, Homo sapiens
caaaacuacaaauc

SEQ ID NO: 2033085 - RNA, 19 nt, Homo sapiens
caaggaaaggcacauguca

SEQ ID NO: 2033086 - RNA, 14 nt, Homo sapiens
auacauuaauacuu

SEQ ID NO: 2033087 - RNA, 23 nt, Homo sapiens
aucuuagcuucuauuauagccac

SEQ ID NO: 2033088 - RNA, 21 nt, Homo sapiens
uuaugugcaaaaucuguuaua

SEQ ID NO: 2033089 - RNA, 17 nt, Homo sapiens
ugauuaaacagacuuua

SEQ ID NO: 2033090 - RNA, 18 nt, Homo sapiens
gacugguugguuuugcca

SEQ ID NO: 2033091 - RNA, 19 nt, Homo sapiens
cagauaaagguucaugcaa

SEQ ID NO: 2033092 - RNA, 23 nt, Homo sapiens
acauaacccuagaauucuuaguc

SEQ ID NO: 2033093 - RNA, 14 nt, Homo sapiens
uccccuacucccuc

SEQ ID NO: 2033094 - RNA, 23 nt, Homo sapiens
acaugacuucugccccagcuuua

SEQ ID NO: 2033095 - RNA, 13 nt, Homo sapiens
uuggaaucaugca

SEQ ID NO: 2033096 - RNA, 13 nt, Homo sapiens
acucaaucucuga

SEQ ID NO: 2033097 - RNA, 15 nt, Homo sapiens
agcugcucacugcuc

SEQ ID NO: 2033098 - RNA, 13 nt, Homo sapiens
uaaaccaucuccc

SEQ ID NO: 2033099 - RNA, 15 nt, Homo sapiens
uugaaaccuuugaca

SEQ ID NO: 2033100 - RNA, 15 nt, Homo sapiens
cugaccaccuugcac

SEQ ID NO: 2033101 - RNA, 13 nt, Homo sapiens
agcagaaguggaa

SEQ ID NO: 2033102 - RNA, 21 nt, Homo sapiens
cauuauucuucucaacccaag

SEQ ID NO: 2033103 - RNA, 13 nt, Homo sapiens
cagauuuugauaa

SEQ ID NO: 2033104 - RNA, 16 nt, Homo sapiens
ggcaagggcaacccac

SEQ ID NO: 2033105 - RNA, 19 nt, Homo sapiens
caggcccaguggccgguca

SEQ ID NO: 2033106 - RNA, 15 nt, Homo sapiens
cgcuggagugcagug

SEQ ID NO: 2033107 - RNA, 17 nt, Homo sapiens
ggccuaugcacauaugg

SEQ ID NO: 2033108 - RNA, 20 nt, Homo sapiens
aguaucaaauauuagaugug

SEQ ID NO: 2033109 - RNA, 18 nt, Homo sapiens
uauguagacuauauacau

SEQ ID NO: 2033110 - RNA, 17 nt, Homo sapiens
cauagcuugauugcuca

SEQ ID NO: 2033111 - RNA, 17 nt, Homo sapiens
ggaagaguagaugagcc

SEQ ID NO: 2033112 - RNA, 17 nt, Homo sapiens
ccaugugcacaagugug

SEQ ID NO: 2033113 - RNA, 18 nt, Homo sapiens
uacauuuaucuguacaua

SEQ ID NO: 2033114 - RNA, 14 nt, Homo sapiens
caauaugcaaugug

SEQ ID NO: 2033115 - RNA, 15 nt, Homo sapiens
uucuccaaccacuca

SEQ ID NO: 2033116 - RNA, 13 nt, Homo sapiens
accccucucucau

SEQ ID NO: 2033117 - RNA, 14 nt, Homo sapiens
cucagaaccauuua

SEQ ID NO: 2033118 - RNA, 18 nt, Homo sapiens
ucgggauaaaacagcauu

SEQ ID NO: 2033119 - RNA, 16 nt, Homo sapiens
cugcugccauccucac

SEQ ID NO: 2033120 - RNA, 17 nt, Homo sapiens
uauauaauuuacuuugu

SEQ ID NO: 2033121 - RNA, 17 nt, Homo sapiens
ugggcccugagccagag

SEQ ID NO: 2033122 - RNA, 18 nt, Homo sapiens
cugauuuaaacuucuuaa

SEQ ID NO: 2033123 - RNA, 20 nt, Homo sapiens
gugacagaccacaucuuuau

SEQ ID NO: 2033124 - RNA, 20 nt, Homo sapiens
cuuucuugaauuagcauuuu

SEQ ID NO: 2033125 - RNA, 16 nt, Homo sapiens
uaaacacuagacugua

SEQ ID NO: 2033126 - RNA, 16 nt, Homo sapiens
ugggcugggcagccuu

SEQ ID NO: 2033127 - RNA, 19 nt, Homo sapiens
ugcacagcuuccugaguca

SEQ ID NO: 2033128 - RNA, 21 nt, Homo sapiens
agcugcagcucuccaccagcu

SEQ ID NO: 2033129 - RNA, 12 nt, Homo sapiens
gcugcugcugau

SEQ ID NO: 2033130 - RNA, 17 nt, Homo sapiens
uauguuacuacaugcac

SEQ ID NO: 2033131 - RNA, 14 nt, Homo sapiens
aggaaacugaguca

SEQ ID NO: 2033132 - RNA, 14 nt, Homo sapiens
gacaaucuagcucu

SEQ ID NO: 2033133 - RNA, 18 nt, Homo sapiens
ccuuccagcuagugaccc

SEQ ID NO: 2033134 - RNA, 15 nt, Homo sapiens
augacuuacuuuccu

SEQ ID NO: 2033135 - RNA, 20 nt, Homo sapiens
aauacauuuucagagccaaa

SEQ ID NO: 2033136 - RNA, 14 nt, Homo sapiens
gaauacaaagugau

SEQ ID NO: 2033137 - RNA, 18 nt, Homo sapiens
augaaagacuuacaggcc

SEQ ID NO: 2033138 - RNA, 22 nt, Homo sapiens
aacuuggguuugcgcuaaaaag

SEQ ID NO: 2033139 - RNA, 18 nt, Homo sapiens
gggccaggugcacagacg

SEQ ID NO: 2033140 - RNA, 20 nt, Homo sapiens
acaucccuauagaccacugg

SEQ ID NO: 2033141 - RNA, 15 nt, Homo sapiens
ucauagaaaauguga

SEQ ID NO: 2033142 - RNA, 19 nt, Homo sapiens
uuucaccauguuggccagg

SEQ ID NO: 2033143 - RNA, 18 nt, Homo sapiens
aaacaaaaaaacuauaaa

SEQ ID NO: 2033144 - RNA, 14 nt, Homo sapiens
uuucauaauugccu

SEQ ID NO: 2033145 - RNA, 14 nt, Homo sapiens
cuucaaaacugcca

SEQ ID NO: 2033146 - RNA, 14 nt, Homo sapiens
uuccuugggcuuua

SEQ ID NO: 2033147 - RNA, 14 nt, Homo sapiens
caguaugacauuuc

SEQ ID NO: 2033148 - RNA, 15 nt, Homo sapiens
ucaguauugagacac

SEQ ID NO: 2033149 - RNA, 14 nt, Homo sapiens
uuuucuucaccuca

SEQ ID NO: 2033150 - RNA, 19 nt, Homo sapiens
ucuggccuuguaucuugca

SEQ ID NO: 2033151 - RNA, 23 nt, Homo sapiens
uagaauuuuuugagagaaugaga

SEQ ID NO: 2033152 - RNA, 14 nt, Homo sapiens
caaucuccaugugu

SEQ ID NO: 2033153 - RNA, 19 nt, Homo sapiens
uuuguaagacacacagccu

SEQ ID NO: 2033154 - RNA, 20 nt, Homo sapiens
agcccguuagccccagggau

SEQ ID NO: 2033155 - RNA, 14 nt, Homo sapiens
uaauuuguauugaa

SEQ ID NO: 2033156 - RNA, 13 nt, Homo sapiens
gcguccccggcca

SEQ ID NO: 2033157 - RNA, 19 nt, Homo sapiens
cgcguagugucaguacuaa

SEQ ID NO: 2033158 - RNA, 13 nt, Homo sapiens
accuuccagagaa

SEQ ID NO: 2033159 - RNA, 17 nt, Homo sapiens
aagagaucacaauacuc

SEQ ID NO: 2033160 - RNA, 16 nt, Homo sapiens
agaauaaugccuugua

SEQ ID NO: 2033161 - RNA, 19 nt, Homo sapiens
cacacagggcucacagggc

SEQ ID NO: 2033162 - RNA, 13 nt, Homo sapiens
augcuaucucaaa

SEQ ID NO: 2033163 - RNA, 14 nt, Homo sapiens
ggcucugcacccac

SEQ ID NO: 2033164 - RNA, 17 nt, Homo sapiens
augugggugaaggugac

SEQ ID NO: 2033165 - RNA, 21 nt, Homo sapiens
agcucacacagcaggaacuga

SEQ ID NO: 2033166 - RNA, 14 nt, Homo sapiens
cauuggcaucugcu

SEQ ID NO: 2033167 - RNA, 19 nt, Homo sapiens
auaacaagccaaacauucu

SEQ ID NO: 2033168 - RNA, 13 nt, Homo sapiens
gcugauggugaca

SEQ ID NO: 2033169 - RNA, 14 nt, Homo sapiens
ggcuaacauagcac

SEQ ID NO: 2033170 - RNA, 19 nt, Homo sapiens
cagugagucagaggcagaa

SEQ ID NO: 2033171 - RNA, 22 nt, Homo sapiens
ccugugaagaaaggaccugcaa

SEQ ID NO: 2033172 - RNA, 19 nt, Homo sapiens
aggcagagguugcagugaa

SEQ ID NO: 2033173 - RNA, 20 nt, Homo sapiens
auaauuuucauucauucacu

SEQ ID NO: 2033174 - RNA, 12 nt, Homo sapiens
cuuuauuguggg

SEQ ID NO: 2033175 - RNA, 21 nt, Homo sapiens
uaagaucguucucugccucac

SEQ ID NO: 2033176 - RNA, 23 nt, Homo sapiens
uucauucuccguugucauugacu

SEQ ID NO: 2033177 - RNA, 23 nt, Homo sapiens
aucccuguucauuguaagcacuu

SEQ ID NO: 2033178 - RNA, 12 nt, Homo sapiens
ggaaaagcccuc

SEQ ID NO: 2033179 - RNA, 15 nt, Homo sapiens
cuuuaugauucuuac

SEQ ID NO: 2033180 - RNA, 19 nt, Homo sapiens
gauuguucauaauacauaa

SEQ ID NO: 2033181 - RNA, 14 nt, Homo sapiens
guuaauacugagaa

SEQ ID NO: 2033182 - RNA, 13 nt, Homo sapiens
ggggccugugcac

SEQ ID NO: 2033183 - RNA, 19 nt, Homo sapiens
ucacugucagggucuuucu

SEQ ID NO: 2033184 - RNA, 13 nt, Homo sapiens
caguucugaugag

SEQ ID NO: 2033185 - RNA, 13 nt, Homo sapiens
cuugcucuaccug

SEQ ID NO: 2033186 - RNA, 19 nt, Homo sapiens
ucaccugcuggggaccuca

SEQ ID NO: 2033187 - RNA, 19 nt, Homo sapiens
aagauuugugaacuggaag

SEQ ID NO: 2033188 - RNA, 17 nt, Homo sapiens
aucuuuuagacacagcc

SEQ ID NO: 2033189 - RNA, 21 nt, Homo sapiens
cuuugauuuuuugcugcagac

SEQ ID NO: 2033190 - RNA, 14 nt, Homo sapiens
gacaauacuggggu

SEQ ID NO: 2033191 - RNA, 18 nt, Homo sapiens
uauucucugcugcaucuu

SEQ ID NO: 2033192 - RNA, 14 nt, Homo sapiens
gucaccuggccugc

SEQ ID NO: 2033193 - RNA, 21 nt, Homo sapiens
gccugggugacagagugagug

SEQ ID NO: 2033194 - RNA, 19 nt, Homo sapiens
gcacacagcaggcuuucaa

SEQ ID NO: 2033195 - RNA, 20 nt, Homo sapiens
ugcacacauuggccgcuuca

SEQ ID NO: 2033196 - RNA, 18 nt, Homo sapiens
ugcuguccagugccuaca

SEQ ID NO: 2033197 - RNA, 16 nt, Homo sapiens
ggcuuggaagggcgcu

SEQ ID NO: 2033198 - RNA, 21 nt, Homo sapiens
gaggaacggaucagaugucua

SEQ ID NO: 2033199 - RNA, 14 nt, Homo sapiens
cggccuaugauucu

SEQ ID NO: 2033200 - RNA, 23 nt, Homo sapiens
gauuccaggcgaugugcaagugu

SEQ ID NO: 2033201 - RNA, 15 nt, Homo sapiens
ucacuucauagcuca

SEQ ID NO: 2033202 - RNA, 14 nt, Homo sapiens
gaucgauuugcacc

SEQ ID NO: 2033203 - RNA, 18 nt, Homo sapiens
ccugcucccucacccagg

SEQ ID NO: 2033204 - RNA, 16 nt, Homo sapiens
cuuaaugguagcaacu

SEQ ID NO: 2033205 - RNA, 15 nt, Homo sapiens
augcauuuaauaaag

SEQ ID NO: 2033206 - RNA, 20 nt, Homo sapiens
acuuggggguaaaggucugu

SEQ ID NO: 2033207 - RNA, 16 nt, Homo sapiens
uccagagaagccaugg

SEQ ID NO: 2033208 - RNA, 20 nt, Homo sapiens
ucuucaaaaacgcacugcaa

SEQ ID NO: 2033209 - RNA, 18 nt, Homo sapiens
ggagccccugcucuggug

SEQ ID NO: 2033210 - RNA, 18 nt, Homo sapiens
aagaaagcccugugcuuu

SEQ ID NO: 2033211 - RNA, 15 nt, Homo sapiens
agucgacacuaagaa

SEQ ID NO: 2033212 - RNA, 21 nt, Homo sapiens
uuggcugacggugaaccgcau

SEQ ID NO: 2033213 - RNA, 22 nt, Homo sapiens
ucuuugguugucacuaagucag

SEQ ID NO: 2033214 - RNA, 14 nt, Homo sapiens
uuacaauaggauuu

SEQ ID NO: 2033215 - RNA, 14 nt, Homo sapiens
uuuaauacauuaag

SEQ ID NO: 2033216 - RNA, 14 nt, Homo sapiens
ugcaggacagcagu

SEQ ID NO: 2033217 - RNA, 18 nt, Homo sapiens
ccagaugaucccagucac

SEQ ID NO: 2033218 - RNA, 14 nt, Homo sapiens
ugcuugaaccuggg

SEQ ID NO: 2033219 - RNA, 18 nt, Homo sapiens
accuccauuucucuccag

SEQ ID NO: 2033220 - RNA, 19 nt, Homo sapiens
aacaacuuaauguucugaa

SEQ ID NO: 2033221 - RNA, 23 nt, Homo sapiens
aaucauuauaaauaauguucauu

SEQ ID NO: 2033222 - RNA, 18 nt, Homo sapiens
accaucccaccucuggau

SEQ ID NO: 2033223 - RNA, 16 nt, Homo sapiens
aaaaucaggcagaaau

SEQ ID NO: 2033224 - RNA, 14 nt, Homo sapiens
ugccucugucucac

SEQ ID NO: 2033225 - RNA, 23 nt, Homo sapiens
gguuugucgggcaccagccagcg

SEQ ID NO: 2033226 - RNA, 14 nt, Homo sapiens
cuuuugccugcaag

SEQ ID NO: 2033227 - RNA, 19 nt, Homo sapiens
uccugucuaauuugcaccu

SEQ ID NO: 2033228 - RNA, 20 nt, Homo sapiens
aacccaggaggcagcuguug

SEQ ID NO: 2033229 - RNA, 19 nt, Homo sapiens
ccaagagccugagugacag

SEQ ID NO: 2033230 - RNA, 15 nt, Homo sapiens
aaauccuuccaugaa

SEQ ID NO: 2033231 - RNA, 19 nt, Homo sapiens
acaugaacccauccaaugg

SEQ ID NO: 2033232 - RNA, 13 nt, Homo sapiens
uggaaggugacac

SEQ ID NO: 2033233 - RNA, 15 nt, Homo sapiens
cuaccucugugccag

SEQ ID NO: 2033234 - RNA, 21 nt, Homo sapiens
cuuuccucuuaaugucucaaa

SEQ ID NO: 2033235 - RNA, 22 nt, Homo sapiens
aggaccuuucugaggaguaaaa

SEQ ID NO: 2033236 - RNA, 13 nt, Homo sapiens
augccagagccug

SEQ ID NO: 2033237 - RNA, 20 nt, Homo sapiens
cugagcccccaccugccuga

SEQ ID NO: 2033238 - RNA, 19 nt, Homo sapiens
cagaauguuguacuugaaa

SEQ ID NO: 2033239 - RNA, 20 nt, Homo sapiens
uauuaauuuuccaaugcaca

SEQ ID NO: 2033240 - RNA, 22 nt, Homo sapiens
ugguaaagauggcauuucacca

SEQ ID NO: 2033241 - RNA, 23 nt, Homo sapiens
agcaaaggggagucucagcuuuc

SEQ ID NO: 2033242 - RNA, 23 nt, Homo sapiens
aguagggccccugcacacucagu

SEQ ID NO: 2033243 - RNA, 13 nt, Homo sapiens
uggauuauuucau

SEQ ID NO: 2033244 - RNA, 16 nt, Homo sapiens
caugaagggucccuga

SEQ ID NO: 2033245 - RNA, 17 nt, Homo sapiens
cauagccgauucucugc

SEQ ID NO: 2033246 - RNA, 11 nt, Homo sapiens
uuuaaugggaa

SEQ ID NO: 2033247 - RNA, 22 nt, Homo sapiens
ccuguacuggagagcaacacag

SEQ ID NO: 2033248 - RNA, 18 nt, Homo sapiens
acccaagcucuggggaug

SEQ ID NO: 2033249 - RNA, 17 nt, Homo sapiens
ugaaaauagagcaauac

SEQ ID NO: 2033250 - RNA, 16 nt, Homo sapiens
uaaauguuuguguuaa

SEQ ID NO: 2033251 - RNA, 21 nt, Homo sapiens
gucuuuucauugcuaccucua

SEQ ID NO: 2033252 - RNA, 21 nt, Homo sapiens
gcagcaugauuauaagccaaa

SEQ ID NO: 2033253 - RNA, 15 nt, Homo sapiens
cagagccacuaccuu

SEQ ID NO: 2033254 - RNA, 16 nt, Homo sapiens
auuguaucuguuuaga

SEQ ID NO: 2033255 - RNA, 22 nt, Homo sapiens
cugcaucuuauagcacuuugaa

SEQ ID NO: 2033256 - RNA, 12 nt, Homo sapiens
agaaaugaauau

SEQ ID NO: 2033257 - RNA, 14 nt, Homo sapiens
cagcaacacucuac

SEQ ID NO: 2033258 - RNA, 19 nt, Homo sapiens
aaaagcccauucauuccau

SEQ ID NO: 2033259 - RNA, 15 nt, Homo sapiens
uuuuguauaacuuaa

SEQ ID NO: 2033260 - RNA, 14 nt, Homo sapiens
cucccauccaagaa

SEQ ID NO: 2033261 - RNA, 12 nt, Homo sapiens
uucauacaacau

SEQ ID NO: 2033262 - RNA, 18 nt, Homo sapiens
acuguguucacacuuuuc

SEQ ID NO: 2033263 - RNA, 16 nt, Homo sapiens
ggcccaaugcacuuug

SEQ ID NO: 2033264 - RNA, 17 nt, Homo sapiens
uuguuaggaaaugucau

SEQ ID NO: 2033265 - RNA, 14 nt, Homo sapiens
agcacgacagugga

SEQ ID NO: 2033266 - RNA, 17 nt, Homo sapiens
ccauguaauaagcacuu

SEQ ID NO: 2033267 - RNA, 17 nt, Homo sapiens
cuuaaugugcagcaaaa

SEQ ID NO: 2033268 - RNA, 18 nt, Homo sapiens
cuuucuuggagugccaag

SEQ ID NO: 2033269 - RNA, 14 nt, Homo sapiens
uuacuaaguauuaa

SEQ ID NO: 2033270 - RNA, 20 nt, Homo sapiens
auuccuuauuucucuuucau

SEQ ID NO: 2033271 - RNA, 13 nt, Homo sapiens
gcaauaauugaca

SEQ ID NO: 2033272 - RNA, 13 nt, Homo sapiens
ucacaaauggaau

SEQ ID NO: 2033273 - RNA, 15 nt, Homo sapiens
cuuaaugugcagcaa

SEQ ID NO: 2033274 - RNA, 14 nt, Homo sapiens
gacugauguguaua

SEQ ID NO: 2033275 - RNA, 21 nt, Homo sapiens
cuugugcuccucucgcacaau

SEQ ID NO: 2033276 - RNA, 22 nt, Homo sapiens
ugcccgccgccccuccacccau

SEQ ID NO: 2033277 - RNA, 14 nt, Homo sapiens
ugagugaguucuca

SEQ ID NO: 2033278 - RNA, 14 nt, Homo sapiens
aacucaccauagag

SEQ ID NO: 2033279 - RNA, 20 nt, Homo sapiens
gaccccuccccagugccucu

SEQ ID NO: 2033280 - RNA, 15 nt, Homo sapiens
caggacacauuucca

SEQ ID NO: 2033281 - RNA, 23 nt, Homo sapiens
caucagugcacacggaugcacag

SEQ ID NO: 2033282 - RNA, 20 nt, Homo sapiens
ugcccagacacagacuggca

SEQ ID NO: 2033283 - RNA, 19 nt, Homo sapiens
aaggcuugaaguaaccuua

SEQ ID NO: 2033284 - RNA, 21 nt, Homo sapiens
gcugaaagacucgagaaccaa

SEQ ID NO: 2033285 - RNA, 22 nt, Homo sapiens
acaaagaaaggugccaugucuu

SEQ ID NO: 2033286 - RNA, 17 nt, Homo sapiens
ugcacacggaugcacag

SEQ ID NO: 2033287 - RNA, 13 nt, Homo sapiens
acuacaagggcau

SEQ ID NO: 2033288 - RNA, 14 nt, Homo sapiens
uagaccuuugguau

SEQ ID NO: 2033289 - RNA, 23 nt, Homo sapiens
caugcacuuuauguggagacuac

SEQ ID NO: 2033290 - RNA, 22 nt, Homo sapiens
aggugagugccaccacacucag

SEQ ID NO: 2033291 - RNA, 19 nt, Homo sapiens
aacaccagcagcacuggaa

SEQ ID NO: 2033292 - RNA, 19 nt, Homo sapiens
agcuuccuguuacugagau

SEQ ID NO: 2033293 - RNA, 22 nt, Homo sapiens
auaugaaauaaaaagauccugc

SEQ ID NO: 2033294 - RNA, 17 nt, Homo sapiens
ugucccuuuuaauauaa

SEQ ID NO: 2033295 - RNA, 18 nt, Homo sapiens
ccuggcccauaaugugaa

SEQ ID NO: 2033296 - RNA, 16 nt, Homo sapiens
uuagcccauaaucucu

SEQ ID NO: 2033297 - RNA, 15 nt, Homo sapiens
agaaggauagccuca

SEQ ID NO: 2033298 - RNA, 15 nt, Homo sapiens
ggaguucagcugcuu

SEQ ID NO: 2033299 - RNA, 11 nt, Homo sapiens
guucugcagcc

SEQ ID NO: 2033300 - RNA, 22 nt, Homo sapiens
gcuuccccaaaggccaacagca

SEQ ID NO: 2033301 - RNA, 18 nt, Homo sapiens
cauaaguuaacuuccaau

SEQ ID NO: 2033302 - RNA, 20 nt, Homo sapiens
ucccaguaguuauaaagucc

SEQ ID NO: 2033303 - RNA, 21 nt, Homo sapiens
aagaauagccuagauaugaau

SEQ ID NO: 2033304 - RNA, 20 nt, Homo sapiens
cugguggaggcuucuugccc

SEQ ID NO: 2033305 - RNA, 10 nt, Homo sapiens
uggaggacca

SEQ ID NO: 2033306 - RNA, 13 nt, Homo sapiens
aaaugagugcuua

SEQ ID NO: 2033307 - RNA, 22 nt, Homo sapiens
cuggggggcaccggcucaggag

SEQ ID NO: 2033308 - RNA, 17 nt, Homo sapiens
ucuggcacucugagguc

SEQ ID NO: 2033309 - RNA, 11 nt, Homo sapiens
ucuugggucuu

SEQ ID NO: 2033310 - RNA, 21 nt, Homo sapiens
cagacuugguccuaagcaccu

SEQ ID NO: 2033311 - RNA, 13 nt, Homo sapiens
agacgugaugaag

SEQ ID NO: 2033312 - RNA, 18 nt, Homo sapiens
gggcuaccccacccaagu

SEQ ID NO: 2033313 - RNA, 16 nt, Homo sapiens
ugagcacaucugggag

SEQ ID NO: 2033314 - RNA, 15 nt, Homo sapiens
acggcgccaggugau

SEQ ID NO: 2033315 - RNA, 17 nt, Homo sapiens
uauuucucuugcuggaa

SEQ ID NO: 2033316 - RNA, 20 nt, Homo sapiens
uuuaauguagacauuaucuu

SEQ ID NO: 2033317 - RNA, 13 nt, Homo sapiens
uuauuuugauuga

SEQ ID NO: 2033318 - RNA, 12 nt, Homo sapiens
gaccauucugcc

SEQ ID NO: 2033319 - RNA, 20 nt, Homo sapiens
gguggccccuccccaacucc

SEQ ID NO: 2033320 - RNA, 22 nt, Homo sapiens
aguguggggcgggggucuauac

SEQ ID NO: 2033321 - RNA, 14 nt, Homo sapiens
uugcagugagcuga

SEQ ID NO: 2033322 - RNA, 19 nt, Homo sapiens
aaguauuuacugacugcuu

SEQ ID NO: 2033323 - RNA, 17 nt, Homo sapiens
uggugggggcagggaug

SEQ ID NO: 2033324 - RNA, 19 nt, Homo sapiens
ucugaaagugguacuugau

SEQ ID NO: 2033325 - RNA, 13 nt, Homo sapiens
acaucccuuaccu

SEQ ID NO: 2033326 - RNA, 16 nt, Homo sapiens
agcuuucaaaagcaag

SEQ ID NO: 2033327 - RNA, 13 nt, Homo sapiens
aauaaaugaacug

SEQ ID NO: 2033328 - RNA, 19 nt, Homo sapiens
aaauccccucccugugacc

SEQ ID NO: 2033329 - RNA, 17 nt, Homo sapiens
auaauaaaggcauuuca

SEQ ID NO: 2033330 - RNA, 17 nt, Homo sapiens
uauaagcagaagcacau

SEQ ID NO: 2033331 - RNA, 17 nt, Homo sapiens
acauacauaagcagcau

SEQ ID NO: 2033332 - RNA, 13 nt, Homo sapiens
cuggaaugccaau

SEQ ID NO: 2033333 - RNA, 14 nt, Homo sapiens
ugacaaauuauuga

SEQ ID NO: 2033334 - RNA, 12 nt, Homo sapiens
gugugugccauc

SEQ ID NO: 2033335 - RNA, 14 nt, Homo sapiens
cucucccuaccuug

SEQ ID NO: 2033336 - RNA, 17 nt, Homo sapiens
auugcuuuagacaaauu

SEQ ID NO: 2033337 - RNA, 16 nt, Homo sapiens
uguaaucaaacugcaa

SEQ ID NO: 2033338 - RNA, 20 nt, Homo sapiens
accuaucuuugguauaugau

SEQ ID NO: 2033339 - RNA, 21 nt, Homo sapiens
cucaggcgccuggcacauuuc

SEQ ID NO: 2033340 - RNA, 23 nt, Homo sapiens
ucuccuuugaaaccugcucugua

SEQ ID NO: 2033341 - RNA, 21 nt, Homo sapiens
cccaggcacuuugcaucacag

SEQ ID NO: 2033342 - RNA, 19 nt, Homo sapiens
uucccacauaauacauucc

SEQ ID NO: 2033343 - RNA, 12 nt, Homo sapiens
ugauuguacaaa

SEQ ID NO: 2033344 - RNA, 23 nt, Homo sapiens
cccagaaacaaaucucaaagugu

SEQ ID NO: 2033345 - RNA, 13 nt, Homo sapiens
guucuugggauac

SEQ ID NO: 2033346 - RNA, 13 nt, Homo sapiens
auucuuggaauac

SEQ ID NO: 2033347 - RNA, 21 nt, Homo sapiens
gacugccuugccuccucagua

SEQ ID NO: 2033348 - RNA, 14 nt, Homo sapiens
guaacccaaaccuc

SEQ ID NO: 2033349 - RNA, 17 nt, Homo sapiens
cagccuuggauacucca

SEQ ID NO: 2033350 - RNA, 14 nt, Homo sapiens
aaaagcaaggcaca

SEQ ID NO: 2033351 - RNA, 17 nt, Homo sapiens
aaucaaucuugcaugua

SEQ ID NO: 2033352 - RNA, 16 nt, Homo sapiens
auuuucaccuauccag

SEQ ID NO: 2033353 - RNA, 17 nt, Homo sapiens
auacaaaaagcaaaaau

SEQ ID NO: 2033354 - RNA, 22 nt, Homo sapiens
uggacacuuauggggacagcau

SEQ ID NO: 2033355 - RNA, 13 nt, Homo sapiens
gacucuaaaaaga

SEQ ID NO: 2033356 - RNA, 18 nt, Homo sapiens
uguuccagaggagcucuc

SEQ ID NO: 2033357 - RNA, 15 nt, Homo sapiens
agcucaagaacacau

SEQ ID NO: 2033358 - RNA, 13 nt, Homo sapiens
cagauguugcauc

SEQ ID NO: 2033359 - RNA, 20 nt, Homo sapiens
agauccggcagcacaagcug

SEQ ID NO: 2033360 - RNA, 20 nt, Homo sapiens
uuccuuagcuaaaugcaauu

SEQ ID NO: 2033361 - RNA, 14 nt, Homo sapiens
cgaguuaagaacau

SEQ ID NO: 2033362 - RNA, 23 nt, Homo sapiens
agccuggcugguccucccauuuc

SEQ ID NO: 2033363 - RNA, 14 nt, Homo sapiens
ucaguguugagaug

SEQ ID NO: 2033364 - RNA, 20 nt, Homo sapiens
aaaggaaaaugaaacuagaa

SEQ ID NO: 2033365 - RNA, 14 nt, Homo sapiens
ugauaaauugcugc

SEQ ID NO: 2033366 - RNA, 19 nt, Homo sapiens
uugaaagagcccuaaacau

SEQ ID NO: 2033367 - RNA, 15 nt, Homo sapiens
uagacuuuugcuuua

SEQ ID NO: 2033368 - RNA, 19 nt, Homo sapiens
agucuuugguaaauggcaa

SEQ ID NO: 2033369 - RNA, 21 nt, Homo sapiens
cucaaagaggccaguacuuug

SEQ ID NO: 2033370 - RNA, 15 nt, Homo sapiens
gggcaucagccagcu

SEQ ID NO: 2033371 - RNA, 16 nt, Homo sapiens
ugaaaaaaaugaucua

SEQ ID NO: 2033372 - RNA, 16 nt, Homo sapiens
caaugugggaucucag

SEQ ID NO: 2033373 - RNA, 21 nt, Homo sapiens
agcuuccaugaugcacaguau

SEQ ID NO: 2033374 - RNA, 17 nt, Homo sapiens
ccugacccuacuucuuu

SEQ ID NO: 2033375 - RNA, 20 nt, Homo sapiens
gagagaagggacacauucaa

SEQ ID NO: 2033376 - RNA, 16 nt, Homo sapiens
augauaacugcaauuu

SEQ ID NO: 2033377 - RNA, 15 nt, Homo sapiens
gacuucccaaggaaa

SEQ ID NO: 2033378 - RNA, 13 nt, Homo sapiens
gacauuccaccau

SEQ ID NO: 2033379 - RNA, 22 nt, Homo sapiens
agccacagggucugccuccagc

SEQ ID NO: 2033380 - RNA, 17 nt, Homo sapiens
uaaaguggaaguaugua

SEQ ID NO: 2033381 - RNA, 16 nt, Homo sapiens
uaaauuuuaaacaaua

SEQ ID NO: 2033382 - RNA, 22 nt, Homo sapiens
agccagaauucuacccuggaaa

SEQ ID NO: 2033383 - RNA, 19 nt, Homo sapiens
aagagacagaacuguccac

SEQ ID NO: 2033384 - RNA, 12 nt, Homo sapiens
uugcuugcugaa

SEQ ID NO: 2033385 - RNA, 16 nt, Homo sapiens
uacuucauggugauag

SEQ ID NO: 2033386 - RNA, 15 nt, Homo sapiens
uggggcuguccugcu

SEQ ID NO: 2033387 - RNA, 22 nt, Homo sapiens
uucuaaguaagaacacugagau

SEQ ID NO: 2033388 - RNA, 19 nt, Homo sapiens
ccacacgcguguguacaca

SEQ ID NO: 2033389 - RNA, 14 nt, Homo sapiens
uuacaggggagaaa

SEQ ID NO: 2033390 - RNA, 17 nt, Homo sapiens
uaagaaucauagugcca

SEQ ID NO: 2033391 - RNA, 23 nt, Homo sapiens
ucaaucaguaauuaacauaucaa

SEQ ID NO: 2033392 - RNA, 17 nt, Homo sapiens
uuaacuuuaccaugcuc

SEQ ID NO: 2033393 - RNA, 14 nt, Homo sapiens
caaaguucauucaa

SEQ ID NO: 2033394 - RNA, 19 nt, Homo sapiens
uguacuauguuaauaacuu

SEQ ID NO: 2033395 - RNA, 16 nt, Homo sapiens
guaggugugacuugaa

SEQ ID NO: 2033396 - RNA, 13 nt, Homo sapiens
aggaaugacaaua

SEQ ID NO: 2033397 - RNA, 15 nt, Homo sapiens
guguauuagauauca

SEQ ID NO: 2033398 - RNA, 23 nt, Homo sapiens
caggaguguuaagcguucaguga

SEQ ID NO: 2033399 - RNA, 21 nt, Homo sapiens
ccauguguaagaacaaugcca

SEQ ID NO: 2033400 - RNA, 20 nt, Homo sapiens
cacagcaggcugccagugcc

SEQ ID NO: 2033401 - RNA, 23 nt, Homo sapiens
guggcagcaacaaaggauuugaa

SEQ ID NO: 2033402 - RNA, 19 nt, Homo sapiens
guaaggcaaucauggugcu

SEQ ID NO: 2033403 - RNA, 21 nt, Homo sapiens
aauccauucuuaaaguacuug

SEQ ID NO: 2033404 - RNA, 15 nt, Homo sapiens
aaaccugugccuccc

SEQ ID NO: 2033405 - RNA, 11 nt, Homo sapiens
agccaugccug

SEQ ID NO: 2033406 - RNA, 18 nt, Homo sapiens
gggaguuguuaugccaug

SEQ ID NO: 2033407 - RNA, 21 nt, Homo sapiens
ucaaaaagggaaguaagcaaa

SEQ ID NO: 2033408 - RNA, 21 nt, Homo sapiens
auaucauucuuuguaucuuaa

SEQ ID NO: 2033409 - RNA, 18 nt, Homo sapiens
uucagucuugccuuugaa

SEQ ID NO: 2033410 - RNA, 14 nt, Homo sapiens
cagagcuuccacaa

SEQ ID NO: 2033411 - RNA, 19 nt, Homo sapiens
cccagacuggagugcagug

SEQ ID NO: 2033412 - RNA, 19 nt, Homo sapiens
cccaggcuggaguacagug

SEQ ID NO: 2033413 - RNA, 12 nt, Homo sapiens
cuuauuuuacac

SEQ ID NO: 2033414 - RNA, 15 nt, Homo sapiens
uaguaacaguuguga

SEQ ID NO: 2033415 - RNA, 22 nt, Homo sapiens
uuuacagauaucugaauggaag

SEQ ID NO: 2033416 - RNA, 24 nt, Homo sapiens
caagugcugggucugucacagaga

SEQ ID NO: 2033417 - RNA, 17 nt, Homo sapiens
aguccaggccuggguca

SEQ ID NO: 2033418 - RNA, 20 nt, Homo sapiens
uccugcagccccagcccagc

SEQ ID NO: 2033419 - RNA, 21 nt, Homo sapiens
cguggacucugcacaugucuu

SEQ ID NO: 2033420 - RNA, 12 nt, Homo sapiens
cuaaaugcacug

SEQ ID NO: 2033421 - RNA, 12 nt, Homo sapiens
cuuaaugcacag

SEQ ID NO: 2033422 - RNA, 15 nt, Homo sapiens
ucccaguuccuuuag

SEQ ID NO: 2033423 - RNA, 19 nt, Homo sapiens
gagucaggcuucucuugcu

SEQ ID NO: 2033424 - RNA, 20 nt, Homo sapiens
aacauuguaaauauuuacuc

SEQ ID NO: 2033425 - RNA, 12 nt, Homo sapiens
aaaaaaacauug

SEQ ID NO: 2033426 - RNA, 17 nt, Homo sapiens
uguggcugggcuuccca

SEQ ID NO: 2033427 - RNA, 14 nt, Homo sapiens
ggaccuguccaugc

SEQ ID NO: 2033428 - RNA, 13 nt, Homo sapiens
aggcaccaugcug

SEQ ID NO: 2033429 - RNA, 13 nt, Homo sapiens
ccaguccauuucc

SEQ ID NO: 2033430 - RNA, 14 nt, Homo sapiens
aggaaaagaaucuc

SEQ ID NO: 2033431 - RNA, 18 nt, Homo sapiens
gcaaucaugagcaaguga

SEQ ID NO: 2033432 - RNA, 16 nt, Homo sapiens
aaacucaucacauaaa

SEQ ID NO: 2033433 - RNA, 14 nt, Homo sapiens
augcaagugcaaaa

SEQ ID NO: 2033434 - RNA, 17 nt, Homo sapiens
aucauucucugucucau

SEQ ID NO: 2033435 - RNA, 19 nt, Homo sapiens
gagauuccugagccagugu

SEQ ID NO: 2033436 - RNA, 15 nt, Homo sapiens
caguaaaacucucaa

SEQ ID NO: 2033437 - RNA, 21 nt, Homo sapiens
aauguuaucaguauuaagcua

SEQ ID NO: 2033438 - RNA, 12 nt, Homo sapiens
caccccaagaga

SEQ ID NO: 2033439 - RNA, 16 nt, Homo sapiens
aaaaaggaugcacaga

SEQ ID NO: 2033440 - RNA, 15 nt, Homo sapiens
aauauuuuccugcca

SEQ ID NO: 2033441 - RNA, 18 nt, Homo sapiens
cuucuuaacucucuguua

SEQ ID NO: 2033442 - RNA, 21 nt, Homo sapiens
caggaacccaccaaaccaacc

SEQ ID NO: 2033443 - RNA, 14 nt, Homo sapiens
uuucauucuuguug

SEQ ID NO: 2033444 - RNA, 15 nt, Homo sapiens
gcugcaccaucccag

SEQ ID NO: 2033445 - RNA, 14 nt, Homo sapiens
uagagccuugacaa

SEQ ID NO: 2033446 - RNA, 16 nt, Homo sapiens
auuuaauaacauaaca

SEQ ID NO: 2033447 - RNA, 17 nt, Homo sapiens
aguguguguaguuuuac

SEQ ID NO: 2033448 - RNA, 16 nt, Homo sapiens
cccaaacaacucagcu

SEQ ID NO: 2033449 - RNA, 18 nt, Homo sapiens
ugucaaauaaacacugug

SEQ ID NO: 2033450 - RNA, 14 nt, Homo sapiens
gaugcuauuugcaa

SEQ ID NO: 2033451 - RNA, 19 nt, Homo sapiens
aaacagauguuuguuuuca

SEQ ID NO: 2033452 - RNA, 15 nt, Homo sapiens
gcugaacucaugaga

SEQ ID NO: 2033453 - RNA, 17 nt, Homo sapiens
caaguauauaugaauga

SEQ ID NO: 2033454 - RNA, 19 nt, Homo sapiens
uuuccuauuggacaaugga

SEQ ID NO: 2033455 - RNA, 14 nt, Homo sapiens
gcuuaaaugcaaua

SEQ ID NO: 2033456 - RNA, 14 nt, Homo sapiens
ugaauuauuguuau

SEQ ID NO: 2033457 - RNA, 23 nt, Homo sapiens
gaggaacugcuugugcacuggau

SEQ ID NO: 2033458 - RNA, 17 nt, Homo sapiens
uagccauccuuggccug

SEQ ID NO: 2033459 - RNA, 18 nt, Homo sapiens
ugggagacugcugaguca

SEQ ID NO: 2033460 - RNA, 23 nt, Homo sapiens
cagcugccaaaaucguagguguu

SEQ ID NO: 2033461 - RNA, 17 nt, Homo sapiens
ucagcucucugggaccu

SEQ ID NO: 2033462 - RNA, 19 nt, Homo sapiens
aaagacugucaaaugaacu

SEQ ID NO: 2033463 - RNA, 18 nt, Homo sapiens
gguggcagcuugugaaga

SEQ ID NO: 2033464 - RNA, 11 nt, Homo sapiens
ugaggccugug

SEQ ID NO: 2033465 - RNA, 11 nt, Homo sapiens
uggggccugua

SEQ ID NO: 2033466 - RNA, 17 nt, Homo sapiens
uugaguucaaauuuugc

SEQ ID NO: 2033467 - RNA, 23 nt, Homo sapiens
auguccuauucccugucacuaca

SEQ ID NO: 2033468 - RNA, 18 nt, Homo sapiens
acaaugguuucaccaucc

SEQ ID NO: 2033469 - RNA, 17 nt, Homo sapiens
uccagcccugcagcuau

SEQ ID NO: 2033470 - RNA, 22 nt, Homo sapiens
gugccugcucagcagccagucu

SEQ ID NO: 2033471 - RNA, 17 nt, Homo sapiens
ucccacccccaucucuc

SEQ ID NO: 2033472 - RNA, 21 nt, Homo sapiens
accgccggccacacuggucac

SEQ ID NO: 2033473 - RNA, 14 nt, Homo sapiens
guucuuugggccag

SEQ ID NO: 2033474 - RNA, 13 nt, Homo sapiens
aauauaugacuuc

SEQ ID NO: 2033475 - RNA, 13 nt, Homo sapiens
uccucauguacau

SEQ ID NO: 2033476 - RNA, 15 nt, Homo sapiens
uuaugauauucucau

SEQ ID NO: 2033477 - RNA, 21 nt, Homo sapiens
ucuagaaagcucuaaagacca

SEQ ID NO: 2033478 - RNA, 20 nt, Homo sapiens
aaaaaccauaaacauuugca

SEQ ID NO: 2033479 - RNA, 18 nt, Homo sapiens
gcaacaagaccaccacuu

SEQ ID NO: 2033480 - RNA, 23 nt, Homo sapiens
ugcccguaaacacgccugcaaac

SEQ ID NO: 2033481 - RNA, 17 nt, Homo sapiens
cuucagaacaaucugag

SEQ ID NO: 2033482 - RNA, 21 nt, Homo sapiens
ugugcaaauccccuccccaaa

SEQ ID NO: 2033483 - RNA, 19 nt, Homo sapiens
agacauucuuccaaaaaga

SEQ ID NO: 2033484 - RNA, 15 nt, Homo sapiens
gaaaugaccaagaca

SEQ ID NO: 2033485 - RNA, 21 nt, Homo sapiens
gagcauuuaagagugaaguca

SEQ ID NO: 2033486 - RNA, 23 nt, Homo sapiens
caggguuuacccagugggacaga

SEQ ID NO: 2033487 - RNA, 17 nt, Homo sapiens
gaagauuucauggacac

SEQ ID NO: 2033488 - RNA, 21 nt, Homo sapiens
aggcguuucugaagugcucuu

SEQ ID NO: 2033489 - RNA, 14 nt, Homo sapiens
uuuaacuucaccuu

SEQ ID NO: 2033490 - RNA, 20 nt, Homo sapiens
agucaaggacgaauuugcac

SEQ ID NO: 2033491 - RNA, 19 nt, Homo sapiens
cagccacuugccugugcua

SEQ ID NO: 2033492 - RNA, 23 nt, Homo sapiens
caucuucgucuucacucuuaggc

SEQ ID NO: 2033493 - RNA, 20 nt, Homo sapiens
uacacaaucugaaacagcuu

SEQ ID NO: 2033494 - RNA, 19 nt, Homo sapiens
gccaagauggaagucaccu

SEQ ID NO: 2033495 - RNA, 19 nt, Homo sapiens
ucucaucaauccuuugaau

SEQ ID NO: 2033496 - RNA, 22 nt, Homo sapiens
ugcugaguuccggggugcaaug

SEQ ID NO: 2033497 - RNA, 21 nt, Homo sapiens
cucaagccaagcagccaagcu

SEQ ID NO: 2033498 - RNA, 21 nt, Homo sapiens
uuuccugcugccauccucacc

SEQ ID NO: 2033499 - RNA, 21 nt, Homo sapiens
cccagccuccugcucaucccu

SEQ ID NO: 2033500 - RNA, 15 nt, Homo sapiens
auaucaagauguuaa

SEQ ID NO: 2033501 - RNA, 23 nt, Homo sapiens
agggacuucacgaaguguugcau

SEQ ID NO: 2033502 - RNA, 23 nt, Homo sapiens
aaaauauaccuucagagacuguc

SEQ ID NO: 2033503 - RNA, 18 nt, Homo sapiens
agaaaugcaaccaacugc

SEQ ID NO: 2033504 - RNA, 21 nt, Homo sapiens
aaugauaaaguaaugaucuca

SEQ ID NO: 2033505 - RNA, 17 nt, Homo sapiens
ucccuggaaccuucuag

SEQ ID NO: 2033506 - RNA, 14 nt, Homo sapiens
cauggugcuuucag

SEQ ID NO: 2033507 - RNA, 19 nt, Homo sapiens
aacuccugaccuugugauc

SEQ ID NO: 2033508 - RNA, 21 nt, Homo sapiens
ccagacacacagccugugcuu

SEQ ID NO: 2033509 - RNA, 13 nt, Homo sapiens
cuucauuuagcca

SEQ ID NO: 2033510 - RNA, 17 nt, Homo sapiens
augcaucaaaagacuua

SEQ ID NO: 2033511 - RNA, 16 nt, Homo sapiens
augcugcaaaggagaa

SEQ ID NO: 2033512 - RNA, 21 nt, Homo sapiens
accaggcaggcacgugcacau

SEQ ID NO: 2033513 - RNA, 12 nt, Homo sapiens
caagugugcauu

SEQ ID NO: 2033514 - RNA, 12 nt, Homo sapiens
auugugugauau

SEQ ID NO: 2033515 - RNA, 15 nt, Homo sapiens
gcagggcgagcugca

SEQ ID NO: 2033516 - RNA, 15 nt, Homo sapiens
guaucuugauaucuc

SEQ ID NO: 2033517 - RNA, 17 nt, Homo sapiens
gagggcccaguggugcc

SEQ ID NO: 2033518 - RNA, 13 nt, Homo sapiens
aacucaagcaaga

SEQ ID NO: 2033519 - RNA, 14 nt, Homo sapiens
cagagaaugugaac

SEQ ID NO: 2033520 - RNA, 17 nt, Homo sapiens
aaugauucucaagauca

SEQ ID NO: 2033521 - RNA, 15 nt, Homo sapiens
ucuuaguguaugauu

SEQ ID NO: 2033522 - RNA, 21 nt, Homo sapiens
uucaaaaacauuucaugcaau

SEQ ID NO: 2033523 - RNA, 16 nt, Homo sapiens
aaccaaggugcacuga

SEQ ID NO: 2033524 - RNA, 12 nt, Homo sapiens
ugagaaaaccug

SEQ ID NO: 2033525 - RNA, 13 nt, Homo sapiens
ucuucuaaccuca

SEQ ID NO: 2033526 - RNA, 14 nt, Homo sapiens
uauuaaaugcauca

SEQ ID NO: 2033527 - RNA, 14 nt, Homo sapiens
gaagaaauucugca

SEQ ID NO: 2033528 - RNA, 13 nt, Homo sapiens
cucucuaauucca

SEQ ID NO: 2033529 - RNA, 17 nt, Homo sapiens
guuccucgcaggucuca

SEQ ID NO: 2033530 - RNA, 20 nt, Homo sapiens
cauuccuguucccaugagau

SEQ ID NO: 2033531 - RNA, 11 nt, Homo sapiens
auggauuccac

SEQ ID NO: 2033532 - RNA, 16 nt, Homo sapiens
agggugcuccuuguca

SEQ ID NO: 2033533 - RNA, 21 nt, Homo sapiens
caucuuucaagggaccucucc

SEQ ID NO: 2033534 - RNA, 20 nt, Homo sapiens
aggcaagccaggcucacuca

SEQ ID NO: 2033535 - RNA, 17 nt, Homo sapiens
cauuaauuaaaagugug

SEQ ID NO: 2033536 - RNA, 13 nt, Homo sapiens
gcgacccaagacc

SEQ ID NO: 2033537 - RNA, 22 nt, Homo sapiens
acaugcccccucccuucacagg

SEQ ID NO: 2033538 - RNA, 12 nt, Homo sapiens
auugccuucuag

SEQ ID NO: 2033539 - RNA, 14 nt, Homo sapiens
ccuaaaaguucuca

SEQ ID NO: 2033540 - RNA, 12 nt, Homo sapiens
aggcaccaugca

SEQ ID NO: 2033541 - RNA, 22 nt, Homo sapiens
cugucugacuuauaauuugcau

SEQ ID NO: 2033542 - RNA, 21 nt, Homo sapiens
aucauuuaauaauauacuugu

SEQ ID NO: 2033543 - RNA, 17 nt, Homo sapiens
ucuggcuugccccagga

SEQ ID NO: 2033544 - RNA, 21 nt, Homo sapiens
ucuuuauuaaaacaguguauu

SEQ ID NO: 2033545 - RNA, 23 nt, Homo sapiens
uucaacaacaaaacauuugcucu

SEQ ID NO: 2033546 - RNA, 21 nt, Homo sapiens
cucccuggugccucugugcac

SEQ ID NO: 2033547 - RNA, 17 nt, Homo sapiens
agaucaggccaacccca

SEQ ID NO: 2033548 - RNA, 18 nt, Homo sapiens
ugguaucuugagucuugg

SEQ ID NO: 2033549 - RNA, 20 nt, Homo sapiens
ccuuauagagcacaauauua

SEQ ID NO: 2033550 - RNA, 15 nt, Homo sapiens
aaaauuauacucaaa

SEQ ID NO: 2033551 - RNA, 19 nt, Homo sapiens
gccaccucucccucaacaa

SEQ ID NO: 2033552 - RNA, 22 nt, Homo sapiens
cacaaucuugaacauuuuacag

SEQ ID NO: 2033553 - RNA, 19 nt, Homo sapiens
guuucuguucucccuggga

SEQ ID NO: 2033554 - RNA, 15 nt, Homo sapiens
cagacaaagugacau

SEQ ID NO: 2033555 - RNA, 13 nt, Homo sapiens
ugugaccuugacu

SEQ ID NO: 2033556 - RNA, 16 nt, Homo sapiens
guacccagagaccaag

SEQ ID NO: 2033557 - RNA, 15 nt, Homo sapiens
gcucucucucgcugc

SEQ ID NO: 2033558 - RNA, 13 nt, Homo sapiens
caaauagccagug

SEQ ID NO: 2033559 - RNA, 18 nt, Homo sapiens
agauucccacccaauuca

SEQ ID NO: 2033560 - RNA, 20 nt, Homo sapiens
guaguuguuggucuguagca

SEQ ID NO: 2033561 - RNA, 20 nt, Homo sapiens
aagaacuugcaauaccaaug

SEQ ID NO: 2033562 - RNA, 16 nt, Homo sapiens
uuaaagagccaguuua

SEQ ID NO: 2033563 - RNA, 16 nt, Homo sapiens
gacagcuuccuuuccu

SEQ ID NO: 2033564 - RNA, 11 nt, Homo sapiens
gcaacccaaau

SEQ ID NO: 2033565 - RNA, 23 nt, Homo sapiens
ccagaaggaaaagaguaauggua

SEQ ID NO: 2033566 - RNA, 18 nt, Homo sapiens
uuccagauccuucaaaga

SEQ ID NO: 2033567 - RNA, 16 nt, Homo sapiens
cuccuuaaacuaccac

SEQ ID NO: 2033568 - RNA, 18 nt, Homo sapiens
cauguaugcaugcacaaa

SEQ ID NO: 2033569 - RNA, 19 nt, Homo sapiens
accaaguaaaacaaaacca

SEQ ID NO: 2033570 - RNA, 20 nt, Homo sapiens
acacucaagaagcaggcuac

SEQ ID NO: 2033571 - RNA, 16 nt, Homo sapiens
agauuucagggagaca

SEQ ID NO: 2033572 - RNA, 19 nt, Homo sapiens
aagaaaugugauuugucuu

SEQ ID NO: 2033573 - RNA, 18 nt, Homo sapiens
ucccuuggggaagggugg

SEQ ID NO: 2033574 - RNA, 20 nt, Homo sapiens
acaucucgggaguccucuag

SEQ ID NO: 2033575 - RNA, 17 nt, Homo sapiens
gaaucgcuuaaaccugg

SEQ ID NO: 2033576 - RNA, 14 nt, Homo sapiens
auuaauaaagcauu

SEQ ID NO: 2033577 - RNA, 20 nt, Homo sapiens
ucagaugcaccacccaugga

SEQ ID NO: 2033578 - RNA, 20 nt, Homo sapiens
agcgcugcccacaccaccgc

SEQ ID NO: 2033579 - RNA, 14 nt, Homo sapiens
aucugauacuguau

SEQ ID NO: 2033580 - RNA, 20 nt, Homo sapiens
ucagcgaaugacaaaaucau

SEQ ID NO: 2033581 - RNA, 18 nt, Homo sapiens
ugaacgccaaacuaaagu

SEQ ID NO: 2033582 - RNA, 20 nt, Homo sapiens
cauggagacagcaguuucca

SEQ ID NO: 2033583 - RNA, 17 nt, Homo sapiens
cuguagccucagaugau

SEQ ID NO: 2033584 - RNA, 17 nt, Homo sapiens
acaaccuuguugcuuua

SEQ ID NO: 2033585 - RNA, 20 nt, Homo sapiens
caacauaacugaaggcauau

SEQ ID NO: 2033586 - RNA, 14 nt, Homo sapiens
cgagaugcucugcu

SEQ ID NO: 2033587 - RNA, 16 nt, Homo sapiens
uggguccuuggcuccc

SEQ ID NO: 2033588 - RNA, 20 nt, Homo sapiens
guuucauuuagucaugugac

SEQ ID NO: 2033589 - RNA, 22 nt, Homo sapiens
ccacugccuuuucucacucaga

SEQ ID NO: 2033590 - RNA, 23 nt, Homo sapiens
gaguaucuuuaaauauaaucccu

SEQ ID NO: 2033591 - RNA, 14 nt, Homo sapiens
cuuguaaaugugac

SEQ ID NO: 2033592 - RNA, 22 nt, Homo sapiens
cuagaacacccacuggccaguc

SEQ ID NO: 2033593 - RNA, 22 nt, Homo sapiens
ucucagacuuuggaaaaugcau

SEQ ID NO: 2033594 - RNA, 11 nt, Homo sapiens
cuugcagagau

SEQ ID NO: 2033595 - RNA, 18 nt, Homo sapiens
acucagaaacuccaugau

SEQ ID NO: 2033596 - RNA, 11 nt, Homo sapiens
ccucuaucuaa

SEQ ID NO: 2033597 - RNA, 16 nt, Homo sapiens
ucccagcgagccacag

SEQ ID NO: 2033598 - RNA, 17 nt, Homo sapiens
cuugccuguaaucccag

SEQ ID NO: 2033599 - RNA, 15 nt, Homo sapiens
agaaucccuuugcac

SEQ ID NO: 2033600 - RNA, 16 nt, Homo sapiens
gcccugccaugcucuc

SEQ ID NO: 2033601 - RNA, 12 nt, Homo sapiens
caacugacacuc

SEQ ID NO: 2033602 - RNA, 12 nt, Homo sapiens
caugugacacag

SEQ ID NO: 2033603 - RNA, 17 nt, Homo sapiens
caauuugacaaaaccca

SEQ ID NO: 2033604 - RNA, 23 nt, Homo sapiens
uacugaguuugugguaaccagcc

SEQ ID NO: 2033605 - RNA, 16 nt, Homo sapiens
auccaccugcacaaac

SEQ ID NO: 2033606 - RNA, 20 nt, Homo sapiens
cucuaacaauguauuuucuu

SEQ ID NO: 2033607 - RNA, 21 nt, Homo sapiens
ugucccacuaucugggugcau

SEQ ID NO: 2033608 - RNA, 18 nt, Homo sapiens
auuuacacauauccacaa

SEQ ID NO: 2033609 - RNA, 14 nt, Homo sapiens
cagacgaaacacaa

SEQ ID NO: 2033610 - RNA, 14 nt, Homo sapiens
auaccaaagcaguu

SEQ ID NO: 2033611 - RNA, 17 nt, Homo sapiens
cuguccaguucccagaa

SEQ ID NO: 2033612 - RNA, 14 nt, Homo sapiens
uuccugaugaugcu

SEQ ID NO: 2033613 - RNA, 18 nt, Homo sapiens
cuugaccucgugauccgc

SEQ ID NO: 2033614 - RNA, 17 nt, Homo sapiens
uccuguuuuuugaugcu

SEQ ID NO: 2033615 - RNA, 21 nt, Homo sapiens
ucacagacaccagcaaagcaa

SEQ ID NO: 2033616 - RNA, 18 nt, Homo sapiens
cugggauuugcccacgua

SEQ ID NO: 2033617 - RNA, 18 nt, Homo sapiens
aaugucauacugccuuga

SEQ ID NO: 2033618 - RNA, 13 nt, Homo sapiens
auucuauaagcua

SEQ ID NO: 2033619 - RNA, 22 nt, Homo sapiens
uagggccaccccacagcucuuu

SEQ ID NO: 2033620 - RNA, 17 nt, Homo sapiens
guauuucuccuuugcaa

SEQ ID NO: 2033621 - RNA, 17 nt, Homo sapiens
gcucuuuuauacuguac

SEQ ID NO: 2033622 - RNA, 14 nt, Homo sapiens
ucuccugugcugcg

SEQ ID NO: 2033623 - RNA, 21 nt, Homo sapiens
cacuuccaccagccugcacua

SEQ ID NO: 2033624 - RNA, 18 nt, Homo sapiens
cagcccuuucagcugcag

SEQ ID NO: 2033625 - RNA, 11 nt, Homo sapiens
cucagugccac

SEQ ID NO: 2033626 - RNA, 21 nt, Homo sapiens
gccuccaugggccccagggga

SEQ ID NO: 2033627 - RNA, 14 nt, Homo sapiens
cuaacacgcacagc

SEQ ID NO: 2033628 - RNA, 23 nt, Homo sapiens
cugaauuaagcagcucaccaucc

SEQ ID NO: 2033629 - RNA, 13 nt, Homo sapiens
gcauuuguucacu

SEQ ID NO: 2033630 - RNA, 13 nt, Homo sapiens
ucuuuugugcucu

SEQ ID NO: 2033631 - RNA, 13 nt, Homo sapiens
cugagaccaaaga

SEQ ID NO: 2033632 - RNA, 23 nt, Homo sapiens
aagugaauguuuaccaugaagau

SEQ ID NO: 2033633 - RNA, 14 nt, Homo sapiens
uugauacgggauuu

SEQ ID NO: 2033634 - RNA, 19 nt, Homo sapiens
cugagauauauuugcuaga

SEQ ID NO: 2033635 - RNA, 16 nt, Homo sapiens
uauaugggaaaccaug

SEQ ID NO: 2033636 - RNA, 14 nt, Homo sapiens
acaauucauucauu

SEQ ID NO: 2033637 - RNA, 13 nt, Homo sapiens
uccauucuugcuu

SEQ ID NO: 2033638 - RNA, 16 nt, Homo sapiens
cagagaagguagauuu

SEQ ID NO: 2033639 - RNA, 20 nt, Homo sapiens
ugucaugacggggacagagu

SEQ ID NO: 2033640 - RNA, 15 nt, Homo sapiens
aacaguaaucugcau

SEQ ID NO: 2033641 - RNA, 14 nt, Homo sapiens
aaaaugaagcccua

SEQ ID NO: 2033642 - RNA, 13 nt, Homo sapiens
cagaaaaccuguu

SEQ ID NO: 2033643 - RNA, 13 nt, Homo sapiens
uauuuaacuuuaa

SEQ ID NO: 2033644 - RNA, 14 nt, Homo sapiens
aaaccagagucaaa

SEQ ID NO: 2033645 - RNA, 13 nt, Homo sapiens
caccaaguacaag

SEQ ID NO: 2033646 - RNA, 17 nt, Homo sapiens
uccuuuagcgcccaguu

SEQ ID NO: 2033647 - RNA, 13 nt, Homo sapiens
cuguaacacuccu

SEQ ID NO: 2033648 - RNA, 14 nt, Homo sapiens
cagaggacaccauc

SEQ ID NO: 2033649 - RNA, 18 nt, Homo sapiens
aacuccugaaaugccaag

SEQ ID NO: 2033650 - RNA, 19 nt, Homo sapiens
ccaagcaggaagcucagac

SEQ ID NO: 2033651 - RNA, 23 nt, Homo sapiens
aauaaucucuauguagaaaucuc

SEQ ID NO: 2033652 - RNA, 19 nt, Homo sapiens
cacagggcccgcagugcug

SEQ ID NO: 2033653 - RNA, 11 nt, Homo sapiens
auagugccucu

SEQ ID NO: 2033654 - RNA, 18 nt, Homo sapiens
auaguccuccaaaacaca

SEQ ID NO: 2033655 - RNA, 16 nt, Homo sapiens
auggaagggccuucuc

SEQ ID NO: 2033656 - RNA, 16 nt, Homo sapiens
uuuuuccccauuguau

SEQ ID NO: 2033657 - RNA, 20 nt, Homo sapiens
uuggaagacuuaauucugau

SEQ ID NO: 2033658 - RNA, 19 nt, Homo sapiens
acuucacagauuuguccag

SEQ ID NO: 2033659 - RNA, 15 nt, Homo sapiens
cucaugcuuagaaag

SEQ ID NO: 2033660 - RNA, 15 nt, Homo sapiens
gggcucuaugccugc

SEQ ID NO: 2033661 - RNA, 13 nt, Homo sapiens
acuaucaguuccc

SEQ ID NO: 2033662 - RNA, 18 nt, Homo sapiens
uuucuggaagauucuuac

SEQ ID NO: 2033663 - RNA, 14 nt, Homo sapiens
uucaaggaauguua

SEQ ID NO: 2033664 - RNA, 14 nt, Homo sapiens
gccacuaugagcuu

SEQ ID NO: 2033665 - RNA, 16 nt, Homo sapiens
cuggagacagaaguca

SEQ ID NO: 2033666 - RNA, 14 nt, Homo sapiens
aaaugcaccacuuu

SEQ ID NO: 2033667 - RNA, 17 nt, Homo sapiens
ucacuugucgggggccc

SEQ ID NO: 2033668 - RNA, 15 nt, Homo sapiens
gcacuagaauauuua

SEQ ID NO: 2033669 - RNA, 16 nt, Homo sapiens
cgaguuuuaaacuggu

SEQ ID NO: 2033670 - RNA, 15 nt, Homo sapiens
ugagccggguggauc

SEQ ID NO: 2033671 - RNA, 23 nt, Homo sapiens
uucuugaagaaaggcaaaucuga

SEQ ID NO: 2033672 - RNA, 22 nt, Homo sapiens
cuuaaggagaggagagcaucug

SEQ ID NO: 2033673 - RNA, 23 nt, Homo sapiens
cuugaagaauguugauggugcua

SEQ ID NO: 2033674 - RNA, 20 nt, Homo sapiens
ugccacccaggcuggagugc

SEQ ID NO: 2033675 - RNA, 21 nt, Homo sapiens
gcuugaucacagcucccuagg

SEQ ID NO: 2033676 - RNA, 13 nt, Homo sapiens
ucaugaauucaua

SEQ ID NO: 2033677 - RNA, 16 nt, Homo sapiens
aggugccaacaguguu

SEQ ID NO: 2033678 - RNA, 16 nt, Homo sapiens
ggaagcauguacugua

SEQ ID NO: 2033679 - RNA, 12 nt, Homo sapiens
uaaaauucaccc

SEQ ID NO: 2033680 - RNA, 18 nt, Homo sapiens
cccuucucccaucagggu

SEQ ID NO: 2033681 - RNA, 19 nt, Homo sapiens
ucugagagaugacagggaa

SEQ ID NO: 2033682 - RNA, 22 nt, Homo sapiens
gugcacaccagugucgugucug

SEQ ID NO: 2033683 - RNA, 21 nt, Homo sapiens
ccuggauuuccugcugccauc

SEQ ID NO: 2033684 - RNA, 16 nt, Homo sapiens
cugggcugugcugcuu

SEQ ID NO: 2033685 - RNA, 17 nt, Homo sapiens
ucucauuuuguauguau

SEQ ID NO: 2033686 - RNA, 18 nt, Homo sapiens
acaagaagcacugacaau

SEQ ID NO: 2033687 - RNA, 17 nt, Homo sapiens
ugaguugaugggggcca

SEQ ID NO: 2033688 - RNA, 19 nt, Homo sapiens
uacuagaaucagauacaaa

SEQ ID NO: 2033689 - RNA, 13 nt, Homo sapiens
uccaugcuuucac

SEQ ID NO: 2033690 - RNA, 23 nt, Homo sapiens
aaacccauuuccagcuccuagua

SEQ ID NO: 2033691 - RNA, 17 nt, Homo sapiens
ccuucuucuccaucucc

SEQ ID NO: 2033692 - RNA, 23 nt, Homo sapiens
gacaccccugcucuacccaugag

SEQ ID NO: 2033693 - RNA, 12 nt, Homo sapiens
auucucuuucac

SEQ ID NO: 2033694 - RNA, 23 nt, Homo sapiens
ucggcacucccaggcugggagcu

SEQ ID NO: 2033695 - RNA, 11 nt, Homo sapiens
cacuguauuca

SEQ ID NO: 2033696 - RNA, 15 nt, Homo sapiens
gaaaguauaacugag

SEQ ID NO: 2033697 - RNA, 17 nt, Homo sapiens
guaaaaugcuaguauaa

SEQ ID NO: 2033698 - RNA, 22 nt, Homo sapiens
ggcauuugucagggauuuagcc

SEQ ID NO: 2033699 - RNA, 15 nt, Homo sapiens
ucagcugaaccuggg

SEQ ID NO: 2033700 - RNA, 19 nt, Homo sapiens
auuguagauaacacugacu

SEQ ID NO: 2033701 - RNA, 15 nt, Homo sapiens
uaaaaauccccaaaa

SEQ ID NO: 2033702 - RNA, 13 nt, Homo sapiens
uugcccacaaugc

SEQ ID NO: 2033703 - RNA, 17 nt, Homo sapiens
guggcaacccucacugu

SEQ ID NO: 2033704 - RNA, 15 nt, Homo sapiens
cacuugguaauugua

SEQ ID NO: 2033705 - RNA, 16 nt, Homo sapiens
cuuuucauuuggaaug

SEQ ID NO: 2033706 - RNA, 12 nt, Homo sapiens
gucccugcaaaa

SEQ ID NO: 2033707 - RNA, 20 nt, Homo sapiens
ccaaugcgcacacacaccga

SEQ ID NO: 2033708 - RNA, 14 nt, Homo sapiens
ccuugcuaaccuaa

SEQ ID NO: 2033709 - RNA, 16 nt, Homo sapiens
uuacuuuucacacugu

SEQ ID NO: 2033710 - RNA, 16 nt, Homo sapiens
ugcaaggauuacagaa

SEQ ID NO: 2033711 - RNA, 11 nt, Homo sapiens
aagaccaaaaa

SEQ ID NO: 2033712 - RNA, 12 nt, Homo sapiens
cauauguucuca

SEQ ID NO: 2033713 - RNA, 19 nt, Homo sapiens
uugaggcauuuccagacuu

SEQ ID NO: 2033714 - RNA, 19 nt, Homo sapiens
augucuuaaaugcucauaa

SEQ ID NO: 2033715 - RNA, 21 nt, Homo sapiens
ugaucccccauagguggcuga

SEQ ID NO: 2033716 - RNA, 16 nt, Homo sapiens
aacgaugcacuuugga

SEQ ID NO: 2033717 - RNA, 16 nt, Homo sapiens
caucugugucucugga

SEQ ID NO: 2033718 - RNA, 13 nt, Homo sapiens
uucucucucuggu

SEQ ID NO: 2033719 - RNA, 19 nt, Homo sapiens
ccaguaaaaucaaaugugc

SEQ ID NO: 2033720 - RNA, 13 nt, Homo sapiens
aaauccucaggug

SEQ ID NO: 2033721 - RNA, 12 nt, Homo sapiens
ccuuaauuugau

SEQ ID NO: 2033722 - RNA, 16 nt, Homo sapiens
aaggggccugcccuca

SEQ ID NO: 2033723 - RNA, 18 nt, Homo sapiens
aaugcacauccucauuca

SEQ ID NO: 2033724 - RNA, 11 nt, Homo sapiens
gcuauuugccu

SEQ ID NO: 2033725 - RNA, 20 nt, Homo sapiens
cauggauaauugcuucacag

SEQ ID NO: 2033726 - RNA, 20 nt, Homo sapiens
aggccuccugugacuggcag

SEQ ID NO: 2033727 - RNA, 18 nt, Homo sapiens
caauaaagcacugagcaa

SEQ ID NO: 2033728 - RNA, 15 nt, Homo sapiens
uuucuggaauggaaa

SEQ ID NO: 2033729 - RNA, 21 nt, Homo sapiens
uuuaaauagaugacauugacu

SEQ ID NO: 2033730 - RNA, 20 nt, Homo sapiens
cugaagaaguuuuugguguc

SEQ ID NO: 2033731 - RNA, 23 nt, Homo sapiens
cugccuuugggagcaggauuuuu

SEQ ID NO: 2033732 - RNA, 13 nt, Homo sapiens
agagcuccauuuc

SEQ ID NO: 2033733 - RNA, 17 nt, Homo sapiens
ugcacacaccugcacac

SEQ ID NO: 2033734 - RNA, 20 nt, Homo sapiens
gaguugcaugacuuggacac

SEQ ID NO: 2033735 - RNA, 17 nt, Homo sapiens
acaguuagguagcuuua

SEQ ID NO: 2033736 - RNA, 23 nt, Homo sapiens
cggccucucuuggaacugcacca

SEQ ID NO: 2033737 - RNA, 21 nt, Homo sapiens
caagggauggacaucuuguca

SEQ ID NO: 2033738 - RNA, 18 nt, Homo sapiens
ucaagaaagcauugccag

SEQ ID NO: 2033739 - RNA, 17 nt, Homo sapiens
cuuaacucagccagaaa

SEQ ID NO: 2033740 - RNA, 14 nt, Homo sapiens
ugugagcaggguga

SEQ ID NO: 2033741 - RNA, 14 nt, Homo sapiens
guuuagcauuggga

SEQ ID NO: 2033742 - RNA, 13 nt, Homo sapiens
guagcccauccuu

SEQ ID NO: 2033743 - RNA, 16 nt, Homo sapiens
aucucuuccuuuccaa

SEQ ID NO: 2033744 - RNA, 23 nt, Homo sapiens
acucuucuccaagucuagcuuuc

SEQ ID NO: 2033745 - RNA, 16 nt, Homo sapiens
cagcucccgcuguggc

SEQ ID NO: 2033746 - RNA, 18 nt, Homo sapiens
acauguuuaaauagccua

SEQ ID NO: 2033747 - RNA, 13 nt, Homo sapiens
uacuaauugucua

SEQ ID NO: 2033748 - RNA, 19 nt, Homo sapiens
cccacacuccuacaccuaa

SEQ ID NO: 2033749 - RNA, 20 nt, Homo sapiens
gcugagaucaugccacugca

SEQ ID NO: 2033750 - RNA, 17 nt, Homo sapiens
aacaucuggauaucaag

SEQ ID NO: 2033751 - RNA, 16 nt, Homo sapiens
uggagugcaguggcac

SEQ ID NO: 2033752 - RNA, 16 nt, Homo sapiens
uggaguguaguggcau

SEQ ID NO: 2033753 - RNA, 15 nt, Homo sapiens
gaaaagaaaccagag

SEQ ID NO: 2033754 - RNA, 21 nt, Homo sapiens
ucugccacuugcacugugcuu

SEQ ID NO: 2033755 - RNA, 22 nt, Homo sapiens
ugacaaggggcaguggugguuu

SEQ ID NO: 2033756 - RNA, 23 nt, Homo sapiens
acaaaaggcuggaugugcuuuca

SEQ ID NO: 2033757 - RNA, 15 nt, Homo sapiens
ugaucuaugcuauau

SEQ ID NO: 2033758 - RNA, 16 nt, Homo sapiens
cuaauaacaugugaaa

SEQ ID NO: 2033759 - RNA, 17 nt, Homo sapiens
uaaaugucacugccaac

SEQ ID NO: 2033760 - RNA, 20 nt, Homo sapiens
uuaaaaagaagagacugcua

SEQ ID NO: 2033761 - RNA, 16 nt, Homo sapiens
auaugcaucccaagau

SEQ ID NO: 2033762 - RNA, 15 nt, Homo sapiens
caagaaacacuuuca

SEQ ID NO: 2033763 - RNA, 18 nt, Homo sapiens
ccugucauaugcucugau

SEQ ID NO: 2033764 - RNA, 18 nt, Homo sapiens
ugacacuagucagaaaau

SEQ ID NO: 2033765 - RNA, 23 nt, Homo sapiens
cacaguauuacuucugcuacaua

SEQ ID NO: 2033766 - RNA, 20 nt, Homo sapiens
uugauuugcucuuacuacag

SEQ ID NO: 2033767 - RNA, 15 nt, Homo sapiens
ugauuuuagccaugc

SEQ ID NO: 2033768 - RNA, 21 nt, Homo sapiens
ggacgcccccaccagcucaaa

SEQ ID NO: 2033769 - RNA, 22 nt, Homo sapiens
ucuggccuguacccaguagaug

SEQ ID NO: 2033770 - RNA, 15 nt, Homo sapiens
ggucuagaaaagcau

SEQ ID NO: 2033771 - RNA, 17 nt, Homo sapiens
uucugacggcccugcaa

SEQ ID NO: 2033772 - RNA, 19 nt, Homo sapiens
caaugaccacauccugaaa

SEQ ID NO: 2033773 - RNA, 18 nt, Homo sapiens
ugauaggaggacaaccau

SEQ ID NO: 2033774 - RNA, 20 nt, Homo sapiens
aaacuaggcuucuguaauca

SEQ ID NO: 2033775 - RNA, 18 nt, Homo sapiens
agaagccaguggacaguu

SEQ ID NO: 2033776 - RNA, 22 nt, Homo sapiens
ccucaccuuggcucuguugcug

SEQ ID NO: 2033777 - RNA, 12 nt, Homo sapiens
accucuccuucc

SEQ ID NO: 2033778 - RNA, 20 nt, Homo sapiens
cauucaaaagcacaaacccu

SEQ ID NO: 2033779 - RNA, 13 nt, Homo sapiens
ccaauacuacuga

SEQ ID NO: 2033780 - RNA, 23 nt, Homo sapiens
caagacugaauuaaugagaagau

SEQ ID NO: 2033781 - RNA, 11 nt, Homo sapiens
aaaagcacuug

SEQ ID NO: 2033782 - RNA, 11 nt, Homo sapiens
gacaacacuga

SEQ ID NO: 2033783 - RNA, 20 nt, Homo sapiens
uguuaccugaaaacacugug

SEQ ID NO: 2033784 - RNA, 19 nt, Homo sapiens
caggguggucuugaucucc

SEQ ID NO: 2033785 - RNA, 22 nt, Homo sapiens
uuccauggcuucccagagcucc

SEQ ID NO: 2033786 - RNA, 14 nt, Homo sapiens
gcccguaaacacgc

SEQ ID NO: 2033787 - RNA, 21 nt, Homo sapiens
aagaggauuguaaaaugcacc

SEQ ID NO: 2033788 - RNA, 19 nt, Homo sapiens
acagggucugcucuuucuc

SEQ ID NO: 2033789 - RNA, 17 nt, Homo sapiens
auagacacuugcuccca

SEQ ID NO: 2033790 - RNA, 18 nt, Homo sapiens
cgggaggcagagguugua

SEQ ID NO: 2033791 - RNA, 16 nt, Homo sapiens
gagcuggggaucccuc

SEQ ID NO: 2033792 - RNA, 17 nt, Homo sapiens
ggcaggacuccuggcag

SEQ ID NO: 2033793 - RNA, 17 nt, Homo sapiens
uguguuuacuaugcauu

SEQ ID NO: 2033794 - RNA, 23 nt, Homo sapiens
cccaggugguggcugcaaggugg

SEQ ID NO: 2033795 - RNA, 14 nt, Homo sapiens
cuacaucuaacuca

SEQ ID NO: 2033796 - RNA, 22 nt, Homo sapiens
cugaaucucccaaggagggcac

SEQ ID NO: 2033797 - RNA, 18 nt, Homo sapiens
cugagggcuggguaggca

SEQ ID NO: 2033798 - RNA, 19 nt, Homo sapiens
auggcagcugguugcucca

SEQ ID NO: 2033799 - RNA, 17 nt, Homo sapiens
cuugagguggugccuuc

SEQ ID NO: 2033800 - RNA, 23 nt, Homo sapiens
uaccuaugugugugcuuugccac

SEQ ID NO: 2033801 - RNA, 12 nt, Homo sapiens
gccucacuuuua

SEQ ID NO: 2033802 - RNA, 17 nt, Homo sapiens
agaugcauauagacaca

SEQ ID NO: 2033803 - RNA, 18 nt, Homo sapiens
uaauauauuugcagauaa

SEQ ID NO: 2033804 - RNA, 12 nt, Homo sapiens
gccuggugguca

SEQ ID NO: 2033805 - RNA, 13 nt, Homo sapiens
cuggcaacugcug

SEQ ID NO: 2033806 - RNA, 23 nt, Homo sapiens
uugcucuuucucuuccuuugguu

SEQ ID NO: 2033807 - RNA, 22 nt, Homo sapiens
ccucauggaugcuuuggcaaug

SEQ ID NO: 2033808 - RNA, 21 nt, Homo sapiens
cagcauggcguaucaggaaag

SEQ ID NO: 2033809 - RNA, 16 nt, Homo sapiens
guauaucuuugcacug

SEQ ID NO: 2033810 - RNA, 16 nt, Homo sapiens
gggauaaagaggguga

SEQ ID NO: 2033811 - RNA, 14 nt, Homo sapiens
ccuauuguaguaaa

SEQ ID NO: 2033812 - RNA, 17 nt, Homo sapiens
gucaaagcuuugcccuu

SEQ ID NO: 2033813 - RNA, 12 nt, Homo sapiens
cauucaagagag

SEQ ID NO: 2033814 - RNA, 21 nt, Homo sapiens
uacauugggcacauaucuccu

SEQ ID NO: 2033815 - RNA, 20 nt, Homo sapiens
ugggaguuuauaccaagaga

SEQ ID NO: 2033816 - RNA, 13 nt, Homo sapiens
auuugcucauaag

SEQ ID NO: 2033817 - RNA, 17 nt, Homo sapiens
aacaacaugucaaagcu

SEQ ID NO: 2033818 - RNA, 20 nt, Homo sapiens
acaguuuuacaauagacauu

SEQ ID NO: 2033819 - RNA, 14 nt, Homo sapiens
ccuuuuuguacuga

SEQ ID NO: 2033820 - RNA, 13 nt, Homo sapiens
agacucugggaac

SEQ ID NO: 2033821 - RNA, 17 nt, Homo sapiens
ccucacauucucuaugu

SEQ ID NO: 2033822 - RNA, 19 nt, Homo sapiens
ugcuccaggccugcauuac

SEQ ID NO: 2033823 - RNA, 21 nt, Homo sapiens
ggcucuaccuccccugcguca

SEQ ID NO: 2033824 - RNA, 18 nt, Homo sapiens
ccuggcccaaccagacuu

SEQ ID NO: 2033825 - RNA, 18 nt, Homo sapiens
gcacugauaggacuuaaa

SEQ ID NO: 2033826 - RNA, 17 nt, Homo sapiens
auggaagcuuccagucc

SEQ ID NO: 2033827 - RNA, 19 nt, Homo sapiens
uggagagacagacacgugu

SEQ ID NO: 2033828 - RNA, 18 nt, Homo sapiens
cagggccaggugcuuuag

SEQ ID NO: 2033829 - RNA, 18 nt, Homo sapiens
auggccuugcuaccuggg

SEQ ID NO: 2033830 - RNA, 16 nt, Homo sapiens
gcugauucaagaaaca

SEQ ID NO: 2033831 - RNA, 22 nt, Homo sapiens
ccuggauuuauaguaugugacu

SEQ ID NO: 2033832 - RNA, 13 nt, Homo sapiens
uccaaucauacaa

SEQ ID NO: 2033833 - RNA, 14 nt, Homo sapiens
cccuggggacagca

SEQ ID NO: 2033834 - RNA, 18 nt, Homo sapiens
cagagggccucaucucag

SEQ ID NO: 2033835 - RNA, 18 nt, Homo sapiens
cuauuacuaguacuauua

SEQ ID NO: 2033836 - RNA, 19 nt, Homo sapiens
acugguagaaaggcaguuc

SEQ ID NO: 2033837 - RNA, 23 nt, Homo sapiens
cccauuuuuaauugugagagauu

SEQ ID NO: 2033838 - RNA, 16 nt, Homo sapiens
acacaacuccacuguc

SEQ ID NO: 2033839 - RNA, 13 nt, Homo sapiens
accaugccaggcu

SEQ ID NO: 2033840 - RNA, 18 nt, Homo sapiens
cuccuuuuaaaacaauau

SEQ ID NO: 2033841 - RNA, 22 nt, Homo sapiens
uuguuggauccguuugaccaau

SEQ ID NO: 2033842 - RNA, 19 nt, Homo sapiens
ccucagccugcccaccucu

SEQ ID NO: 2033843 - RNA, 13 nt, Homo sapiens
agagaaccaagcu

SEQ ID NO: 2033844 - RNA, 17 nt, Homo sapiens
ccuugagggaacaguca

SEQ ID NO: 2033845 - RNA, 15 nt, Homo sapiens
uuuuaauuugaugaa

SEQ ID NO: 2033846 - RNA, 14 nt, Homo sapiens
uaaauauuuccaua

SEQ ID NO: 2033847 - RNA, 14 nt, Homo sapiens
aagcuaaucugccu

SEQ ID NO: 2033848 - RNA, 18 nt, Homo sapiens
aacuccugguucagccau

SEQ ID NO: 2033849 - RNA, 17 nt, Homo sapiens
ucaguacccaccugagc

SEQ ID NO: 2033850 - RNA, 22 nt, Homo sapiens
aauagacuucucuuacauuuuc

SEQ ID NO: 2033851 - RNA, 18 nt, Homo sapiens
cauguggcccuccagugu

SEQ ID NO: 2033852 - RNA, 14 nt, Homo sapiens
aaacacugggcucu

SEQ ID NO: 2033853 - RNA, 17 nt, Homo sapiens
aaagauugaacacugcg

SEQ ID NO: 2033854 - RNA, 16 nt, Homo sapiens
aacccccgcuccagau

SEQ ID NO: 2033855 - RNA, 15 nt, Homo sapiens
aucugcauugcccag

SEQ ID NO: 2033856 - RNA, 16 nt, Homo sapiens
guccaacaaaccacac

SEQ ID NO: 2033857 - RNA, 18 nt, Homo sapiens
aaaguccccagagaaagc

SEQ ID NO: 2033858 - RNA, 21 nt, Homo sapiens
gggaagccuccgucaggagag

SEQ ID NO: 2033859 - RNA, 21 nt, Homo sapiens
cauaaauuacuguuuugccaa

SEQ ID NO: 2033860 - RNA, 16 nt, Homo sapiens
gagggccaggauuccu

SEQ ID NO: 2033861 - RNA, 22 nt, Homo sapiens
cugaagucuucuccuccaugaa

SEQ ID NO: 2033862 - RNA, 13 nt, Homo sapiens
ccuaaauuucagu

SEQ ID NO: 2033863 - RNA, 12 nt, Homo sapiens
auaauuacuuuc

SEQ ID NO: 2033864 - RNA, 21 nt, Homo sapiens
uuaaacaaaauagaagcugua

SEQ ID NO: 2033865 - RNA, 22 nt, Homo sapiens
aaagcaaauaaaugccuuccac

SEQ ID NO: 2033866 - RNA, 18 nt, Homo sapiens
aaccaaacauaacauuau

SEQ ID NO: 2033867 - RNA, 12 nt, Homo sapiens
cugaauucacuu

SEQ ID NO: 2033868 - RNA, 13 nt, Homo sapiens
ugguuaccacagu

SEQ ID NO: 2033869 - RNA, 18 nt, Homo sapiens
aaauuuucucuaaacugu

SEQ ID NO: 2033870 - RNA, 21 nt, Homo sapiens
ccucuggacaagucaucugca

SEQ ID NO: 2033871 - RNA, 15 nt, Homo sapiens
cugggucagacccau

SEQ ID NO: 2033872 - RNA, 16 nt, Homo sapiens
cgauuucagcacaugc

SEQ ID NO: 2033873 - RNA, 12 nt, Homo sapiens
auugaacuacuu

SEQ ID NO: 2033874 - RNA, 20 nt, Homo sapiens
acagccuuucugaacugacu

SEQ ID NO: 2033875 - RNA, 20 nt, Homo sapiens
gcuuguaaauagcucaggug

SEQ ID NO: 2033876 - RNA, 19 nt, Homo sapiens
gaaugugugggguauagaa

SEQ ID NO: 2033877 - RNA, 14 nt, Homo sapiens
aaggaaagcacagc

SEQ ID NO: 2033878 - RNA, 13 nt, Homo sapiens
ccuacaacagccu

SEQ ID NO: 2033879 - RNA, 13 nt, Homo sapiens
cugcauaaugucc

SEQ ID NO: 2033880 - RNA, 14 nt, Homo sapiens
caauuccuucuuca

SEQ ID NO: 2033881 - RNA, 18 nt, Homo sapiens
cauccccaggauccacuu

SEQ ID NO: 2033882 - RNA, 23 nt, Homo sapiens
aauuacauguuuuuucauuugua

SEQ ID NO: 2033883 - RNA, 16 nt, Homo sapiens
cuaucaacacugcagc

SEQ ID NO: 2033884 - RNA, 11 nt, Homo sapiens
gcaggugcugc

SEQ ID NO: 2033885 - RNA, 21 nt, Homo sapiens
ucacacauccugucaguguca

SEQ ID NO: 2033886 - RNA, 19 nt, Homo sapiens
ccuccucccagacuuucua

SEQ ID NO: 2033887 - RNA, 23 nt, Homo sapiens
gcagguuuguaaugcaaaaggcu

SEQ ID NO: 2033888 - RNA, 20 nt, Homo sapiens
acuaaugauaaaguaaugau

SEQ ID NO: 2033889 - RNA, 21 nt, Homo sapiens
agagcaacucugagaucuaag

SEQ ID NO: 2033890 - RNA, 18 nt, Homo sapiens
agagggucucgcugucac

SEQ ID NO: 2033891 - RNA, 16 nt, Homo sapiens
cugugacuacuauggc

SEQ ID NO: 2033892 - RNA, 18 nt, Homo sapiens
ugaguaauuguauuguca

SEQ ID NO: 2033893 - RNA, 19 nt, Homo sapiens
aaaccuacagcauauucuu

SEQ ID NO: 2033894 - RNA, 19 nt, Homo sapiens
uugccuggggucugagcau

SEQ ID NO: 2033895 - RNA, 19 nt, Homo sapiens
auggaauacagucauucca

SEQ ID NO: 2033896 - RNA, 22 nt, Homo sapiens
aacauaccguuuauaaugccau

SEQ ID NO: 2033897 - RNA, 16 nt, Homo sapiens
cuucuugguucugaaa

SEQ ID NO: 2033898 - RNA, 13 nt, Homo sapiens
uacccugaucuga

SEQ ID NO: 2033899 - RNA, 20 nt, Homo sapiens
cacaggcuguaaauugaacu

SEQ ID NO: 2033900 - RNA, 14 nt, Homo sapiens
aauucuguauagau

SEQ ID NO: 2033901 - RNA, 19 nt, Homo sapiens
aaaguaaaaacacuaccuc

SEQ ID NO: 2033902 - RNA, 16 nt, Homo sapiens
ggauagaggaaaggga

SEQ ID NO: 2033903 - RNA, 14 nt, Homo sapiens
ugaucucaguucuc

SEQ ID NO: 2033904 - RNA, 21 nt, Homo sapiens
cugugauuucuuucuuugcac

SEQ ID NO: 2033905 - RNA, 15 nt, Homo sapiens
gugcuauacacacac

SEQ ID NO: 2033906 - RNA, 14 nt, Homo sapiens
aaucaagagugagu

SEQ ID NO: 2033907 - RNA, 13 nt, Homo sapiens
cuggacaugucaa

SEQ ID NO: 2033908 - RNA, 13 nt, Homo sapiens
agaaaagcacuua

SEQ ID NO: 2033909 - RNA, 15 nt, Homo sapiens
uuaacacacuggcca

SEQ ID NO: 2033910 - RNA, 23 nt, Homo sapiens
uaaucauuuguuuacauuugaug

SEQ ID NO: 2033911 - RNA, 17 nt, Homo sapiens
ucacaccucacugucau

SEQ ID NO: 2033912 - RNA, 19 nt, Homo sapiens
ugaaaccaagggggaugac

SEQ ID NO: 2033913 - RNA, 14 nt, Homo sapiens
accuccguggaaua

SEQ ID NO: 2033914 - RNA, 19 nt, Homo sapiens
ugcuuucuuaucccaguga

SEQ ID NO: 2033915 - RNA, 22 nt, Homo sapiens
auauguugcaaaauauaucacu

SEQ ID NO: 2033916 - RNA, 14 nt, Homo sapiens
gccccucaggggaa

SEQ ID NO: 2033917 - RNA, 14 nt, Homo sapiens
cuguccugucccac

SEQ ID NO: 2033918 - RNA, 17 nt, Homo sapiens
caggguauggccagcuu

SEQ ID NO: 2033919 - RNA, 14 nt, Homo sapiens
aucaucuguggaac

SEQ ID NO: 2033920 - RNA, 21 nt, Homo sapiens
acucuuauucccaaacuacag

SEQ ID NO: 2033921 - RNA, 19 nt, Homo sapiens
agcucaucuguuaugcaua

SEQ ID NO: 2033922 - RNA, 22 nt, Homo sapiens
aauaaauuuguaugcucaauua

SEQ ID NO: 2033923 - RNA, 13 nt, Homo sapiens
ucacuaaaaucag

SEQ ID NO: 2033924 - RNA, 18 nt, Homo sapiens
accccagguauccuucau

SEQ ID NO: 2033925 - RNA, 19 nt, Homo sapiens
auauuaacaacaauaacac

SEQ ID NO: 2033926 - RNA, 12 nt, Homo sapiens
ucaaagccacug

SEQ ID NO: 2033927 - RNA, 18 nt, Homo sapiens
gcucaaccacacacaccu

SEQ ID NO: 2033928 - RNA, 21 nt, Homo sapiens
gcugucuccaugcuggauacu

SEQ ID NO: 2033929 - RNA, 22 nt, Homo sapiens
auacaguacucaggcagugcag

SEQ ID NO: 2033930 - RNA, 14 nt, Homo sapiens
cauugaacuuuaag

SEQ ID NO: 2033931 - RNA, 20 nt, Homo sapiens
cagugagcugugauuaugcc

SEQ ID NO: 2033932 - RNA, 16 nt, Homo sapiens
auucugaauuugcaaa

SEQ ID NO: 2033933 - RNA, 22 nt, Homo sapiens
caugcuggcucccagggccaug

SEQ ID NO: 2033934 - RNA, 17 nt, Homo sapiens
auaaccucucugugcca

SEQ ID NO: 2033935 - RNA, 16 nt, Homo sapiens
agcucagcgccagccu

SEQ ID NO: 2033936 - RNA, 13 nt, Homo sapiens
aggauagccucag

SEQ ID NO: 2033937 - RNA, 16 nt, Homo sapiens
uugaaaccccaucucu

SEQ ID NO: 2033938 - RNA, 19 nt, Homo sapiens
auguggaagaacugugaua

SEQ ID NO: 2033939 - RNA, 18 nt, Homo sapiens
aagguaugugucagccau

SEQ ID NO: 2033940 - RNA, 12 nt, Homo sapiens
gacucacauccu

SEQ ID NO: 2033941 - RNA, 20 nt, Homo sapiens
uggccccuccuugcaaccag

SEQ ID NO: 2033942 - RNA, 20 nt, Homo sapiens
agacauuugguuuucaucau

SEQ ID NO: 2033943 - RNA, 15 nt, Homo sapiens
uacucauaaaggaca

SEQ ID NO: 2033944 - RNA, 23 nt, Homo sapiens
acagcaauuccuggacucggggg

SEQ ID NO: 2033945 - RNA, 12 nt, Homo sapiens
uucuuuaccuca

SEQ ID NO: 2033946 - RNA, 16 nt, Homo sapiens
aacucgaauaaaggau

SEQ ID NO: 2033947 - RNA, 17 nt, Homo sapiens
auaacauuuaaauucca

SEQ ID NO: 2033948 - RNA, 17 nt, Homo sapiens
uuaacacuuaaauuucu

SEQ ID NO: 2033949 - RNA, 22 nt, Homo sapiens
gaauccccuaucccauucugcg

SEQ ID NO: 2033950 - RNA, 11 nt, Homo sapiens
cccaagccaga

SEQ ID NO: 2033951 - RNA, 12 nt, Homo sapiens
ugaucccugugc

SEQ ID NO: 2033952 - RNA, 18 nt, Homo sapiens
gaagugguucuaugucca

SEQ ID NO: 2033953 - RNA, 11 nt, Homo sapiens
ggacuugccuc

SEQ ID NO: 2033954 - RNA, 17 nt, Homo sapiens
ccaaugccuuuccagca

SEQ ID NO: 2033955 - RNA, 23 nt, Homo sapiens
ccuucauaucauccacacaugaa

SEQ ID NO: 2033956 - RNA, 22 nt, Homo sapiens
auguuuauauacuguuauuuca

SEQ ID NO: 2033957 - RNA, 13 nt, Homo sapiens
gcccauggaugug

SEQ ID NO: 2033958 - RNA, 13 nt, Homo sapiens
uaucauugcuaaa

SEQ ID NO: 2033959 - RNA, 13 nt, Homo sapiens
cuguauuuuccac

SEQ ID NO: 2033960 - RNA, 11 nt, Homo sapiens
accaugcugcc

SEQ ID NO: 2033961 - RNA, 17 nt, Homo sapiens
agggcccugaggaauaa

SEQ ID NO: 2033962 - RNA, 15 nt, Homo sapiens
uauacuucagugcuc

SEQ ID NO: 2033963 - RNA, 20 nt, Homo sapiens
gaauuccuaaaauuauggaa

SEQ ID NO: 2033964 - RNA, 19 nt, Homo sapiens
aggagggugacgcccagcu

SEQ ID NO: 2033965 - RNA, 13 nt, Homo sapiens
cuauguauuugca

SEQ ID NO: 2033966 - RNA, 19 nt, Homo sapiens
aauguucaggagaguaaaa

SEQ ID NO: 2033967 - RNA, 15 nt, Homo sapiens
acugcccauggacag

SEQ ID NO: 2033968 - RNA, 13 nt, Homo sapiens
auagaucuuuuca

SEQ ID NO: 2033969 - RNA, 22 nt, Homo sapiens
guagugaauauguuuuauaugu

SEQ ID NO: 2033970 - RNA, 16 nt, Homo sapiens
auugaggacuauggaa

SEQ ID NO: 2033971 - RNA, 21 nt, Homo sapiens
cggccccugcugguucagggu

SEQ ID NO: 2033972 - RNA, 15 nt, Homo sapiens
ccagacaauuccauu

SEQ ID NO: 2033973 - RNA, 19 nt, Homo sapiens
uuucugcuaaaaaguccuu

SEQ ID NO: 2033974 - RNA, 17 nt, Homo sapiens
uuaaaaauuggcauuuu

SEQ ID NO: 2033975 - RNA, 19 nt, Homo sapiens
cuuguuuugaauugucaau

SEQ ID NO: 2033976 - RNA, 14 nt, Homo sapiens
ugccucaccugguc

SEQ ID NO: 2033977 - RNA, 16 nt, Homo sapiens
cuuagcaaggggcuca

SEQ ID NO: 2033978 - RNA, 15 nt, Homo sapiens
ucuuccuuugcucug

SEQ ID NO: 2033979 - RNA, 16 nt, Homo sapiens
uaaaagcuuucugcca

SEQ ID NO: 2033980 - RNA, 12 nt, Homo sapiens
uuuaaguaggca

SEQ ID NO: 2033981 - RNA, 16 nt, Homo sapiens
ucucagcucacugcaa

SEQ ID NO: 2033982 - RNA, 18 nt, Homo sapiens
aaagccugagaagaaaga

SEQ ID NO: 2033983 - RNA, 12 nt, Homo sapiens
ugguccuggaac

SEQ ID NO: 2033984 - RNA, 15 nt, Homo sapiens
aagaaugacgaugcc

SEQ ID NO: 2033985 - RNA, 14 nt, Homo sapiens
aucagcacugccag

SEQ ID NO: 2033986 - RNA, 15 nt, Homo sapiens
gcccuacucugugua

SEQ ID NO: 2033987 - RNA, 20 nt, Homo sapiens
cagagcuuuaaaaguaucuu

SEQ ID NO: 2033988 - RNA, 18 nt, Homo sapiens
agauuuuuaauacguuaa

SEQ ID NO: 2033989 - RNA, 23 nt, Homo sapiens
ugaagcaaaucagaaacuuguga

SEQ ID NO: 2033990 - RNA, 19 nt, Homo sapiens
auuaaacuucuacugagca

SEQ ID NO: 2033991 - RNA, 16 nt, Homo sapiens
gcuuaguuuguguguu

SEQ ID NO: 2033992 - RNA, 13 nt, Homo sapiens
gcacuuuaaacuu

SEQ ID NO: 2033993 - RNA, 14 nt, Homo sapiens
uucuucaaaucuca

SEQ ID NO: 2033994 - RNA, 14 nt, Homo sapiens
ucagccaaacagua

SEQ ID NO: 2033995 - RNA, 11 nt, Homo sapiens
aguuagccaaa

SEQ ID NO: 2033996 - RNA, 20 nt, Homo sapiens
cauuccacacagaaugcaac

SEQ ID NO: 2033997 - RNA, 16 nt, Homo sapiens
caaggacuccauugga

SEQ ID NO: 2033998 - RNA, 14 nt, Homo sapiens
guuacuaguacagg

SEQ ID NO: 2033999 - RNA, 14 nt, Homo sapiens
gauaggaguucacu

SEQ ID NO: 2034000 - RNA, 16 nt, Homo sapiens
ugcagaaaauugccua

SEQ ID NO: 2034001 - RNA, 12 nt, Homo sapiens
caggcacucucc

SEQ ID NO: 2034002 - RNA, 18 nt, Homo sapiens
caaccgcgggggcuguga

SEQ ID NO: 2034003 - RNA, 22 nt, Homo sapiens
aauuuccacaagcauugcuuca

SEQ ID NO: 2034004 - RNA, 17 nt, Homo sapiens
uccuugauaaaguauua

SEQ ID NO: 2034005 - RNA, 16 nt, Homo sapiens
caacccaaggcaauga

SEQ ID NO: 2034006 - RNA, 20 nt, Homo sapiens
ucuuuccugaaccaugugga

SEQ ID NO: 2034007 - RNA, 16 nt, Homo sapiens
cuggugagaaaauaua

SEQ ID NO: 2034008 - RNA, 15 nt, Homo sapiens
ugcagagcagacagg

SEQ ID NO: 2034009 - RNA, 16 nt, Homo sapiens
uucuaagaaccaaaaa

SEQ ID NO: 2034010 - RNA, 14 nt, Homo sapiens
aguguguaugucag

SEQ ID NO: 2034011 - RNA, 19 nt, Homo sapiens
aguccagagggacagucag

SEQ ID NO: 2034012 - RNA, 16 nt, Homo sapiens
gacugguuuucugcca

SEQ ID NO: 2034013 - RNA, 17 nt, Homo sapiens
cuaauauccacuugucc

SEQ ID NO: 2034014 - RNA, 22 nt, Homo sapiens
ucucuagcacaauuugcacuaa

SEQ ID NO: 2034015 - RNA, 13 nt, Homo sapiens
acauuaccauaua

SEQ ID NO: 2034016 - RNA, 17 nt, Homo sapiens
ugccuccugguuuccuu

SEQ ID NO: 2034017 - RNA, 20 nt, Homo sapiens
cagacaagcgccgcugugag

SEQ ID NO: 2034018 - RNA, 17 nt, Homo sapiens
uacauggggcucacuca

SEQ ID NO: 2034019 - RNA, 14 nt, Homo sapiens
uuccagacaguggg

SEQ ID NO: 2034020 - RNA, 14 nt, Homo sapiens
ucccagggagcaag

SEQ ID NO: 2034021 - RNA, 22 nt, Homo sapiens
aguauuaauguaacuagcauaa

SEQ ID NO: 2034022 - RNA, 16 nt, Homo sapiens
uggcuagucacauauc

SEQ ID NO: 2034023 - RNA, 21 nt, Homo sapiens
ugaaacuaaugaaagcacucc

SEQ ID NO: 2034024 - RNA, 24 nt, Homo sapiens
cugagacccacaggucuaagagga

SEQ ID NO: 2034025 - RNA, 17 nt, Homo sapiens
aagcaaaaagugaugau

SEQ ID NO: 2034026 - RNA, 17 nt, Homo sapiens
agcccccuccuggugcc

SEQ ID NO: 2034027 - RNA, 14 nt, Homo sapiens
ugucaguucauccu

SEQ ID NO: 2034028 - RNA, 21 nt, Homo sapiens
caggagcugaggauaaagggc

SEQ ID NO: 2034029 - RNA, 19 nt, Homo sapiens
cacauugccccaugagaca

SEQ ID NO: 2034030 - RNA, 16 nt, Homo sapiens
cucccuccagccaaua

SEQ ID NO: 2034031 - RNA, 13 nt, Homo sapiens
cgccugcugcauc

SEQ ID NO: 2034032 - RNA, 16 nt, Homo sapiens
aacuggacaugaagga

SEQ ID NO: 2034033 - RNA, 12 nt, Homo sapiens
uauauuucacau

SEQ ID NO: 2034034 - RNA, 20 nt, Homo sapiens
ggugucauucugccugcucc

SEQ ID NO: 2034035 - RNA, 15 nt, Homo sapiens
accacccucccugac

SEQ ID NO: 2034036 - RNA, 20 nt, Homo sapiens
gcccaggcuggagugcagua

SEQ ID NO: 2034037 - RNA, 10 nt, Homo sapiens
ccccaagaca

SEQ ID NO: 2034038 - RNA, 17 nt, Homo sapiens
uacuaacaaauguaaaa

SEQ ID NO: 2034039 - RNA, 17 nt, Homo sapiens
ugcccuuguuccagcuu

SEQ ID NO: 2034040 - RNA, 18 nt, Homo sapiens
ugccagauaaccaaguga

SEQ ID NO: 2034041 - RNA, 12 nt, Homo sapiens
gucaauauuuga

SEQ ID NO: 2034042 - RNA, 22 nt, Homo sapiens
cugcaaaggcaccugaaugugu

SEQ ID NO: 2034043 - RNA, 20 nt, Homo sapiens
uggcacauguauacauaugu

SEQ ID NO: 2034044 - RNA, 14 nt, Homo sapiens
caacuucaagggac

SEQ ID NO: 2034045 - RNA, 21 nt, Homo sapiens
cugcagcuuaaaacaagcaaa

SEQ ID NO: 2034046 - RNA, 23 nt, Homo sapiens
ugcucucaggaccagagaaggga

SEQ ID NO: 2034047 - RNA, 21 nt, Homo sapiens
uuuaaaccuugugcuacuuag

SEQ ID NO: 2034048 - RNA, 19 nt, Homo sapiens
aauguaucuuaaaggacau

SEQ ID NO: 2034049 - RNA, 23 nt, Homo sapiens
cugcuuccugucccacuacugua

SEQ ID NO: 2034050 - RNA, 18 nt, Homo sapiens
agaagaagcccauaucac

SEQ ID NO: 2034051 - RNA, 17 nt, Homo sapiens
uaaacguauaauaugua

SEQ ID NO: 2034052 - RNA, 12 nt, Homo sapiens
uggaggugccag

SEQ ID NO: 2034053 - RNA, 16 nt, Homo sapiens
auuugacucaugaacu

SEQ ID NO: 2034054 - RNA, 14 nt, Homo sapiens
acaaaauccaacuc

SEQ ID NO: 2034055 - RNA, 17 nt, Homo sapiens
ccuccaguuuugccuga

SEQ ID NO: 2034056 - RNA, 19 nt, Homo sapiens
cuuuccccggaguaccuau

SEQ ID NO: 2034057 - RNA, 18 nt, Homo sapiens
auuauuacaacaagcaaa

SEQ ID NO: 2034058 - RNA, 17 nt, Homo sapiens
uggccgcugcugugaca

SEQ ID NO: 2034059 - RNA, 18 nt, Homo sapiens
agaauguuuugcacugac

SEQ ID NO: 2034060 - RNA, 22 nt, Homo sapiens
cgcguggaucuacccucuaguu

SEQ ID NO: 2034061 - RNA, 24 nt, Homo sapiens
uaaagguaaaacaugcuggugaac

SEQ ID NO: 2034062 - RNA, 15 nt, Homo sapiens
uguagccugggacca

SEQ ID NO: 2034063 - RNA, 20 nt, Homo sapiens
augaugaaaacuaaggauuu

SEQ ID NO: 2034064 - RNA, 18 nt, Homo sapiens
caaacguuuuuccagucu

SEQ ID NO: 2034065 - RNA, 15 nt, Homo sapiens
cccagccucuuuauu

SEQ ID NO: 2034066 - RNA, 11 nt, Homo sapiens
aaagccaguca

SEQ ID NO: 2034067 - RNA, 21 nt, Homo sapiens
cuuuaugcuaguuugaccuca

SEQ ID NO: 2034068 - RNA, 18 nt, Homo sapiens
aaaggcugaacauaaauc

SEQ ID NO: 2034069 - RNA, 14 nt, Homo sapiens
cucuuagaagccau

SEQ ID NO: 2034070 - RNA, 13 nt, Homo sapiens
uguaaugugaauu

SEQ ID NO: 2034071 - RNA, 14 nt, Homo sapiens
aaucugcuuugugg

SEQ ID NO: 2034072 - RNA, 17 nt, Homo sapiens
ugcaaugccucuggaau

SEQ ID NO: 2034073 - RNA, 17 nt, Homo sapiens
gcacagcuaacauggaa

SEQ ID NO: 2034074 - RNA, 18 nt, Homo sapiens
ugauaucuggccuaaaau

SEQ ID NO: 2034075 - RNA, 13 nt, Homo sapiens
augaacaauguau

SEQ ID NO: 2034076 - RNA, 21 nt, Homo sapiens
uuccuccgaggccaguaccuu

SEQ ID NO: 2034077 - RNA, 13 nt, Homo sapiens
aggugagccagac

SEQ ID NO: 2034078 - RNA, 21 nt, Homo sapiens
uacaaauagaagcuucuugcu

SEQ ID NO: 2034079 - RNA, 17 nt, Homo sapiens
gaaugaaugaaccauga

SEQ ID NO: 2034080 - RNA, 17 nt, Homo sapiens
agauucuucagcuugau

SEQ ID NO: 2034081 - RNA, 20 nt, Homo sapiens
ccacgugggcaaacaggcag

SEQ ID NO: 2034082 - RNA, 17 nt, Homo sapiens
aagcaauguacaccaga

SEQ ID NO: 2034083 - RNA, 19 nt, Homo sapiens
gaaacugacuugcugugac

SEQ ID NO: 2034084 - RNA, 17 nt, Homo sapiens
gaaacaauaaauuggaa

SEQ ID NO: 2034085 - RNA, 17 nt, Homo sapiens
gaagcuggagugcugcu

SEQ ID NO: 2034086 - RNA, 16 nt, Homo sapiens
uuaaaugaccaaagau

SEQ ID NO: 2034087 - RNA, 13 nt, Homo sapiens
uugaaacauaucu

SEQ ID NO: 2034088 - RNA, 20 nt, Homo sapiens
aaucucacccucuccuccag

SEQ ID NO: 2034089 - RNA, 23 nt, Homo sapiens
caaggauagaagcugcaguggua

SEQ ID NO: 2034090 - RNA, 19 nt, Homo sapiens
cuugauguugcuuagucac

SEQ ID NO: 2034091 - RNA, 18 nt, Homo sapiens
accuugaucccaauccuu

SEQ ID NO: 2034092 - RNA, 18 nt, Homo sapiens
aaaauuauuugcauaaca

SEQ ID NO: 2034093 - RNA, 14 nt, Homo sapiens
guauuaccuauuca

SEQ ID NO: 2034094 - RNA, 12 nt, Homo sapiens
ggugauaugcac

SEQ ID NO: 2034095 - RNA, 13 nt, Homo sapiens
aagagacugagcc

SEQ ID NO: 2034096 - RNA, 15 nt, Homo sapiens
accaacauucugugu

SEQ ID NO: 2034097 - RNA, 15 nt, Homo sapiens
gcuuuugguaauauu

SEQ ID NO: 2034098 - RNA, 22 nt, Homo sapiens
ccaggaguucgaggcugcaguc

SEQ ID NO: 2034099 - RNA, 15 nt, Homo sapiens
cuccuccagcccacc

SEQ ID NO: 2034100 - RNA, 16 nt, Homo sapiens
agaaagaccacuggca

SEQ ID NO: 2034101 - RNA, 19 nt, Homo sapiens
cuggccacugaauuaugcc

SEQ ID NO: 2034102 - RNA, 16 nt, Homo sapiens
gucaucagcuauucag

SEQ ID NO: 2034103 - RNA, 16 nt, Homo sapiens
acauuuucauaucauc

SEQ ID NO: 2034104 - RNA, 12 nt, Homo sapiens
aguuggugcugc

SEQ ID NO: 2034105 - RNA, 11 nt, Homo sapiens
aguggugagca

SEQ ID NO: 2034106 - RNA, 15 nt, Homo sapiens
ugucaaaagcacaaa

SEQ ID NO: 2034107 - RNA, 16 nt, Homo sapiens
aaauucaugcugcuua

SEQ ID NO: 2034108 - RNA, 16 nt, Homo sapiens
aaauucaagcugcuuu

SEQ ID NO: 2034109 - RNA, 21 nt, Homo sapiens
auucacacaacaccucacuuu

SEQ ID NO: 2034110 - RNA, 22 nt, Homo sapiens
ccacugaaaauucgaaccagga

SEQ ID NO: 2034111 - RNA, 22 nt, Homo sapiens
uucaguugacaaaauauauaau

SEQ ID NO: 2034112 - RNA, 17 nt, Homo sapiens
cacccuccuggcacaac

SEQ ID NO: 2034113 - RNA, 13 nt, Homo sapiens
uacuucaguauua

SEQ ID NO: 2034114 - RNA, 20 nt, Homo sapiens
gcuucucaggccucugcucu

SEQ ID NO: 2034115 - RNA, 13 nt, Homo sapiens
acuaccaauuucc

SEQ ID NO: 2034116 - RNA, 20 nt, Homo sapiens
ccugagguugcuuuauccua

SEQ ID NO: 2034117 - RNA, 15 nt, Homo sapiens
ccauuucucugggac

SEQ ID NO: 2034118 - RNA, 21 nt, Homo sapiens
acuucuuaacuggcaacaguu

SEQ ID NO: 2034119 - RNA, 20 nt, Homo sapiens
aagugcagcaggagaacucu

SEQ ID NO: 2034120 - RNA, 15 nt, Homo sapiens
uuccaaaagcacaga

SEQ ID NO: 2034121 - RNA, 23 nt, Homo sapiens
agggaagcuguuugugugucugg

SEQ ID NO: 2034122 - RNA, 11 nt, Homo sapiens
uuuccuuccau

SEQ ID NO: 2034123 - RNA, 16 nt, Homo sapiens
auuaaggcaguaugcc

SEQ ID NO: 2034124 - RNA, 23 nt, Homo sapiens
aauaauaaaaucaaaaacuuuug

SEQ ID NO: 2034125 - RNA, 18 nt, Homo sapiens
accucaguuuccucaucu

SEQ ID NO: 2034126 - RNA, 17 nt, Homo sapiens
aacaguguuuacuuuaa

SEQ ID NO: 2034127 - RNA, 11 nt, Homo sapiens
aaccacaucaa

SEQ ID NO: 2034128 - RNA, 17 nt, Homo sapiens
agauuuaugaugcacuu

SEQ ID NO: 2034129 - RNA, 20 nt, Homo sapiens
gaggcuuugggagcaaaaua

SEQ ID NO: 2034130 - RNA, 14 nt, Homo sapiens
cggcucagugcaac

SEQ ID NO: 2034131 - RNA, 22 nt, Homo sapiens
uaaaauacuugagaaauuugug

SEQ ID NO: 2034132 - RNA, 14 nt, Homo sapiens
caaaugcagcuuua

SEQ ID NO: 2034133 - RNA, 13 nt, Homo sapiens
aaguuguuugcau

SEQ ID NO: 2034134 - RNA, 19 nt, Homo sapiens
uucuaaagcucugaacaaa

SEQ ID NO: 2034135 - RNA, 21 nt, Homo sapiens
ccagagcauuuccaacaccac

SEQ ID NO: 2034136 - RNA, 15 nt, Homo sapiens
guaggcauauaucac

SEQ ID NO: 2034137 - RNA, 23 nt, Homo sapiens
uuauagggaugaguccccuguga

SEQ ID NO: 2034138 - RNA, 23 nt, Homo sapiens
aagcccugggugcaggacacugg

SEQ ID NO: 2034139 - RNA, 17 nt, Homo sapiens
gaguggcugaccaggcc

SEQ ID NO: 2034140 - RNA, 12 nt, Homo sapiens
cucuuuggugua

SEQ ID NO: 2034141 - RNA, 12 nt, Homo sapiens
agcagagcacug

SEQ ID NO: 2034142 - RNA, 19 nt, Homo sapiens
uagagaauacacauauaaa

SEQ ID NO: 2034143 - RNA, 20 nt, Homo sapiens
ggccgccuacucccagcugg

SEQ ID NO: 2034144 - RNA, 18 nt, Homo sapiens
auucagucuagccacaaa

SEQ ID NO: 2034145 - RNA, 22 nt, Homo sapiens
uaagacgguuaaauacugugug

SEQ ID NO: 2034146 - RNA, 19 nt, Homo sapiens
ggagcccugucuccucucu

SEQ ID NO: 2034147 - RNA, 13 nt, Homo sapiens
auggccucaagau

SEQ ID NO: 2034148 - RNA, 16 nt, Homo sapiens
gccuaggggucaggga

SEQ ID NO: 2034149 - RNA, 20 nt, Homo sapiens
caggcaugagccacugugcc

SEQ ID NO: 2034150 - RNA, 21 nt, Homo sapiens
caggauuuggcuaugacauga

SEQ ID NO: 2034151 - RNA, 19 nt, Homo sapiens
uugaagacguggacuccuc

SEQ ID NO: 2034152 - RNA, 14 nt, Homo sapiens
ccaaucagcacucu

SEQ ID NO: 2034153 - RNA, 21 nt, Homo sapiens
guaacucacauucucuuccca

SEQ ID NO: 2034154 - RNA, 15 nt, Homo sapiens
uauuugcuauguccu

SEQ ID NO: 2034155 - RNA, 16 nt, Homo sapiens
ccuaugguaucauauc

SEQ ID NO: 2034156 - RNA, 21 nt, Homo sapiens
cuuuugaauuaugcuuuguag

SEQ ID NO: 2034157 - RNA, 21 nt, Homo sapiens
gaauuugauuuauauuuugca

SEQ ID NO: 2034158 - RNA, 23 nt, Homo sapiens
gagugauuuuggccacacuguca

SEQ ID NO: 2034159 - RNA, 19 nt, Homo sapiens
ucaggcccuggugcgaaug

SEQ ID NO: 2034160 - RNA, 12 nt, Homo sapiens
auugcuauuacu

SEQ ID NO: 2034161 - RNA, 16 nt, Homo sapiens
ugugccugcacugaga

SEQ ID NO: 2034162 - RNA, 23 nt, Homo sapiens
uucuuauuaaggaaauacuuugc

SEQ ID NO: 2034163 - RNA, 14 nt, Homo sapiens
agaaaauguucacu

SEQ ID NO: 2034164 - RNA, 16 nt, Homo sapiens
guacgguggcacgugc

SEQ ID NO: 2034165 - RNA, 19 nt, Homo sapiens
cacagcguccuguccacac

SEQ ID NO: 2034166 - RNA, 18 nt, Homo sapiens
gaacacuguuaggguaca

SEQ ID NO: 2034167 - RNA, 15 nt, Homo sapiens
ucuucuuccugaaua

SEQ ID NO: 2034168 - RNA, 23 nt, Homo sapiens
cuguuauuagcugggaagaccaa

SEQ ID NO: 2034169 - RNA, 19 nt, Homo sapiens
gcuggaguucaugucgcaa

SEQ ID NO: 2034170 - RNA, 20 nt, Homo sapiens
aucagugauuauuuuuccag

SEQ ID NO: 2034171 - RNA, 19 nt, Homo sapiens
uucuuuaggggaaguaaaa

SEQ ID NO: 2034172 - RNA, 12 nt, Homo sapiens
aacagacuugaa

SEQ ID NO: 2034173 - RNA, 16 nt, Homo sapiens
aacugcacaaugcauu

SEQ ID NO: 2034174 - RNA, 22 nt, Homo sapiens
gccaucgcaagucacagaaaau

SEQ ID NO: 2034175 - RNA, 22 nt, Homo sapiens
aguuaagagaaagucaccugcc

SEQ ID NO: 2034176 - RNA, 18 nt, Homo sapiens
agauaacagugugcucau

SEQ ID NO: 2034177 - RNA, 18 nt, Homo sapiens
ucuacuuggugguuugcu

SEQ ID NO: 2034178 - RNA, 13 nt, Homo sapiens
auuaaagaugcca

SEQ ID NO: 2034179 - RNA, 12 nt, Homo sapiens
cgcagauguuac

SEQ ID NO: 2034180 - RNA, 16 nt, Homo sapiens
caagauguacuauaac

SEQ ID NO: 2034181 - RNA, 21 nt, Homo sapiens
acuaaguaaucucacagcauu

SEQ ID NO: 2034182 - RNA, 14 nt, Homo sapiens
gcacaucaguacuu

SEQ ID NO: 2034183 - RNA, 22 nt, Homo sapiens
aaaauacucuuaaguugaucua

SEQ ID NO: 2034184 - RNA, 16 nt, Homo sapiens
cacagacccugcccug

SEQ ID NO: 2034185 - RNA, 17 nt, Homo sapiens
uuauuugccagagccaa

SEQ ID NO: 2034186 - RNA, 21 nt, Homo sapiens
ugcauuucucguucuuuacug

SEQ ID NO: 2034187 - RNA, 16 nt, Homo sapiens
guaagaagaaagcaaa

SEQ ID NO: 2034188 - RNA, 12 nt, Homo sapiens
auugaccaaaua

SEQ ID NO: 2034189 - RNA, 18 nt, Homo sapiens
uauggaagauaauuuuau

SEQ ID NO: 2034190 - RNA, 17 nt, Homo sapiens
gccccuuugccauagcc

SEQ ID NO: 2034191 - RNA, 22 nt, Homo sapiens
caguggaacaugcaaggcacug

SEQ ID NO: 2034192 - RNA, 22 nt, Homo sapiens
ucacaucagaacagacaaucac

SEQ ID NO: 2034193 - RNA, 22 nt, Homo sapiens
aguccuagaauguuucauuugc

SEQ ID NO: 2034194 - RNA, 19 nt, Homo sapiens
uguguggcauuuucacuuu

SEQ ID NO: 2034195 - RNA, 18 nt, Homo sapiens
caauauuuccucauguga

SEQ ID NO: 2034196 - RNA, 21 nt, Homo sapiens
accccaccugaccucugcaag

SEQ ID NO: 2034197 - RNA, 20 nt, Homo sapiens
gcugggauuacaggugugca

SEQ ID NO: 2034198 - RNA, 20 nt, Homo sapiens
gcccaggcccggaugcagag

SEQ ID NO: 2034199 - RNA, 17 nt, Homo sapiens
ucauaaauguuugcugc

SEQ ID NO: 2034200 - RNA, 15 nt, Homo sapiens
acuaaauagcaugua

SEQ ID NO: 2034201 - RNA, 17 nt, Homo sapiens
uggcucucugcagccuu

SEQ ID NO: 2034202 - RNA, 13 nt, Homo sapiens
augauaaagacuu

SEQ ID NO: 2034203 - RNA, 22 nt, Homo sapiens
gcaugguggugagcaccuguaa

SEQ ID NO: 2034204 - RNA, 20 nt, Homo sapiens
aaacuuccuaaugauuagca

SEQ ID NO: 2034205 - RNA, 23 nt, Homo sapiens
aacauuuuguaugcugcaugaaa

SEQ ID NO: 2034206 - RNA, 18 nt, Homo sapiens
acccuguccuuugcaauu

SEQ ID NO: 2034207 - RNA, 16 nt, Homo sapiens
cuaugcagccacauca

SEQ ID NO: 2034208 - RNA, 15 nt, Homo sapiens
cuauuaccuugugaa

SEQ ID NO: 2034209 - RNA, 16 nt, Homo sapiens
acguaugguggcucau

SEQ ID NO: 2034210 - RNA, 15 nt, Homo sapiens
gaaagauuugugaac

SEQ ID NO: 2034211 - RNA, 20 nt, Homo sapiens
uguaauuuguacaggggcca

SEQ ID NO: 2034212 - RNA, 13 nt, Homo sapiens
acagucauucaca

SEQ ID NO: 2034213 - RNA, 17 nt, Homo sapiens
gaagucucaucugggga

SEQ ID NO: 2034214 - RNA, 14 nt, Homo sapiens
auaucaacucucac

SEQ ID NO: 2034215 - RNA, 18 nt, Homo sapiens
aagguagaaaugucuaug

SEQ ID NO: 2034216 - RNA, 18 nt, Homo sapiens
aaguggaaacaacccaaa

SEQ ID NO: 2034217 - RNA, 19 nt, Homo sapiens
cccaggccaggacucugca

SEQ ID NO: 2034218 - RNA, 18 nt, Homo sapiens
caugugacucugaagcug

SEQ ID NO: 2034219 - RNA, 19 nt, Homo sapiens
caaccaggauccugaugua

SEQ ID NO: 2034220 - RNA, 14 nt, Homo sapiens
acccacgcauauac

SEQ ID NO: 2034221 - RNA, 14 nt, Homo sapiens
auugaagaacugca

SEQ ID NO: 2034222 - RNA, 22 nt, Homo sapiens
guaaaguauuauuuauuugaau

SEQ ID NO: 2034223 - RNA, 15 nt, Homo sapiens
ugaggcuucucagcc

SEQ ID NO: 2034224 - RNA, 14 nt, Homo sapiens
agcaggcuagacag

SEQ ID NO: 2034225 - RNA, 22 nt, Homo sapiens
guuccugccaggcucucccucu

SEQ ID NO: 2034226 - RNA, 19 nt, Homo sapiens
cucuuagcuuucucagggg

SEQ ID NO: 2034227 - RNA, 19 nt, Homo sapiens
aauuuaaaaauaaauacca

SEQ ID NO: 2034228 - RNA, 18 nt, Homo sapiens
gccaccacgccuagccuc

SEQ ID NO: 2034229 - RNA, 23 nt, Homo sapiens
uuuacguuugaagacauugcacc

SEQ ID NO: 2034230 - RNA, 14 nt, Homo sapiens
caguaaguggcaca

SEQ ID NO: 2034231 - RNA, 23 nt, Homo sapiens
aaguauaacugaguuaaauuaua

SEQ ID NO: 2034232 - RNA, 18 nt, Homo sapiens
agcugggacuacaggcac

SEQ ID NO: 2034233 - RNA, 22 nt, Homo sapiens
uguucaaauuaaaaaagcugcu

SEQ ID NO: 2034234 - RNA, 16 nt, Homo sapiens
uuaaagaaaaccacag

SEQ ID NO: 2034235 - RNA, 19 nt, Homo sapiens
agccaaagcuuaugugaca

SEQ ID NO: 2034236 - RNA, 18 nt, Homo sapiens
auaugucaccuggcacau

SEQ ID NO: 2034237 - RNA, 14 nt, Homo sapiens
guuguucauuauuu

SEQ ID NO: 2034238 - RNA, 14 nt, Homo sapiens
ucagcucagcuucu

SEQ ID NO: 2034239 - RNA, 23 nt, Homo sapiens
uggcggcccuucugacuguuuau

SEQ ID NO: 2034240 - RNA, 15 nt, Homo sapiens
ucccgucccauaucc

SEQ ID NO: 2034241 - RNA, 17 nt, Homo sapiens
aacaacauguaccugua

SEQ ID NO: 2034242 - RNA, 18 nt, Homo sapiens
auuuguaaguaacacagu

SEQ ID NO: 2034243 - RNA, 23 nt, Homo sapiens
aagccaagaaagaaaaauuaucu

SEQ ID NO: 2034244 - RNA, 19 nt, Homo sapiens
caaaauaaaagaaauauga

SEQ ID NO: 2034245 - RNA, 14 nt, Homo sapiens
ccucccacagugac

SEQ ID NO: 2034246 - RNA, 20 nt, Homo sapiens
uccuggaacagaagacagcu

SEQ ID NO: 2034247 - RNA, 12 nt, Homo sapiens
gggacucaggug

SEQ ID NO: 2034248 - RNA, 22 nt, Homo sapiens
gccugagcuggccuccuaugcc

SEQ ID NO: 2034249 - RNA, 13 nt, Homo sapiens
gcuuugcuuauaa

SEQ ID NO: 2034250 - RNA, 18 nt, Homo sapiens
ugaaggccccucuccgca

SEQ ID NO: 2034251 - RNA, 17 nt, Homo sapiens
guuuacucacagccagc

SEQ ID NO: 2034252 - RNA, 21 nt, Homo sapiens
ugaaaugcucuuuugcacaag

SEQ ID NO: 2034253 - RNA, 21 nt, Homo sapiens
accagaugccauuacauuuau

SEQ ID NO: 2034254 - RNA, 19 nt, Homo sapiens
agcuggcaaagguggcucu

SEQ ID NO: 2034255 - RNA, 13 nt, Homo sapiens
accuccacuccca

SEQ ID NO: 2034256 - RNA, 16 nt, Homo sapiens
cgggguuucuccaugu

SEQ ID NO: 2034257 - RNA, 23 nt, Homo sapiens
ucagccagcccauggcccccaau

SEQ ID NO: 2034258 - RNA, 22 nt, Homo sapiens
caaagcaugccaauuucucuua

SEQ ID NO: 2034259 - RNA, 18 nt, Homo sapiens
uggcaaaugccugacuca

SEQ ID NO: 2034260 - RNA, 13 nt, Homo sapiens
gacccaagcugcc

SEQ ID NO: 2034261 - RNA, 15 nt, Homo sapiens
auguucacugugagu

SEQ ID NO: 2034262 - RNA, 23 nt, Homo sapiens
aucgcuacuggcaucuguuaucu

SEQ ID NO: 2034263 - RNA, 17 nt, Homo sapiens
uuuuggcaucugcaaag

SEQ ID NO: 2034264 - RNA, 15 nt, Homo sapiens
cugugcuaugaauuu

SEQ ID NO: 2034265 - RNA, 22 nt, Homo sapiens
ccacagcgcucgauggaccuca

SEQ ID NO: 2034266 - RNA, 20 nt, Homo sapiens
uccauuuccccuccuuccca

SEQ ID NO: 2034267 - RNA, 20 nt, Homo sapiens
aguaaagcagaggaugcaac

SEQ ID NO: 2034268 - RNA, 23 nt, Homo sapiens
gccuccaucucauguaucaucug

SEQ ID NO: 2034269 - RNA, 16 nt, Homo sapiens
caaugguggugcacca

SEQ ID NO: 2034270 - RNA, 15 nt, Homo sapiens
gugaacacaucagcu

SEQ ID NO: 2034271 - RNA, 16 nt, Homo sapiens
uuguaaagcccuugca

SEQ ID NO: 2034272 - RNA, 15 nt, Homo sapiens
aguccuccuauucca

SEQ ID NO: 2034273 - RNA, 16 nt, Homo sapiens
uaaaauuacugaugca

SEQ ID NO: 2034274 - RNA, 18 nt, Homo sapiens
gaaaacaacuuggcauuu

SEQ ID NO: 2034275 - RNA, 24 nt, Homo sapiens
aaaaacuuccaucccuacuuuuca

SEQ ID NO: 2034276 - RNA, 16 nt, Homo sapiens
gaauuuuguaaguaua

SEQ ID NO: 2034277 - RNA, 15 nt, Homo sapiens
gcagugaucucaggg

SEQ ID NO: 2034278 - RNA, 23 nt, Homo sapiens
accagguccaaugagcuuucuga

SEQ ID NO: 2034279 - RNA, 18 nt, Homo sapiens
ugcaauaggugugcguca

SEQ ID NO: 2034280 - RNA, 19 nt, Homo sapiens
agcaccugguugaugugua

SEQ ID NO: 2034281 - RNA, 23 nt, Homo sapiens
gaaagaccaggccaaugucaggg

SEQ ID NO: 2034282 - RNA, 15 nt, Homo sapiens
ccugggauccagugu

SEQ ID NO: 2034283 - RNA, 21 nt, Homo sapiens
ucaaaagacagcacuacagau

SEQ ID NO: 2034284 - RNA, 22 nt, Homo sapiens
auggcauauuuuucacauaucu

SEQ ID NO: 2034285 - RNA, 14 nt, Homo sapiens
uaguauaauaugca

SEQ ID NO: 2034286 - RNA, 17 nt, Homo sapiens
gaggugugaaagcccag

SEQ ID NO: 2034287 - RNA, 12 nt, Homo sapiens
ccagcugcaaag

SEQ ID NO: 2034288 - RNA, 20 nt, Homo sapiens
cagacuucccugaauguauu

SEQ ID NO: 2034289 - RNA, 19 nt, Homo sapiens
ugcacccaucagcacucug

SEQ ID NO: 2034290 - RNA, 23 nt, Homo sapiens
acugcaaccuccaccucccaggu

SEQ ID NO: 2034291 - RNA, 12 nt, Homo sapiens
agggacuugccu

SEQ ID NO: 2034292 - RNA, 22 nt, Homo sapiens
ucuuuucaaaauaauuagcuau

SEQ ID NO: 2034293 - RNA, 15 nt, Homo sapiens
uauguguuacauuau

SEQ ID NO: 2034294 - RNA, 15 nt, Homo sapiens
acauaaauuaugaga

SEQ ID NO: 2034295 - RNA, 14 nt, Homo sapiens
uugauggucucaag

SEQ ID NO: 2034296 - RNA, 15 nt, Homo sapiens
guacuuuucuguuca

SEQ ID NO: 2034297 - RNA, 20 nt, Homo sapiens
aaagauucuucuguguuuau

SEQ ID NO: 2034298 - RNA, 20 nt, Homo sapiens
acaaucuguucuacucuuaa

SEQ ID NO: 2034299 - RNA, 21 nt, Homo sapiens
auggagauguugugugcaaug

SEQ ID NO: 2034300 - RNA, 21 nt, Homo sapiens
caacaaagcagaagacuccuc

SEQ ID NO: 2034301 - RNA, 17 nt, Homo sapiens
ucccacaauauuaccuu

SEQ ID NO: 2034302 - RNA, 13 nt, Homo sapiens
cuacuacaaugau

SEQ ID NO: 2034303 - RNA, 17 nt, Homo sapiens
cuaggaccuauguugua

SEQ ID NO: 2034304 - RNA, 22 nt, Homo sapiens
uaugauaugcauguagcauaua

SEQ ID NO: 2034305 - RNA, 24 nt, Homo sapiens
aggcucagagagguagcacucuca

SEQ ID NO: 2034306 - RNA, 11 nt, Homo sapiens
uuuacuaccug

SEQ ID NO: 2034307 - RNA, 15 nt, Homo sapiens
aagcaagcugauuaa

SEQ ID NO: 2034308 - RNA, 22 nt, Homo sapiens
uauccuuuucuauuaagauaua

SEQ ID NO: 2034309 - RNA, 14 nt, Homo sapiens
uaaagaugauugaa

SEQ ID NO: 2034310 - RNA, 17 nt, Homo sapiens
gguggcccuugcaguuc

SEQ ID NO: 2034311 - RNA, 14 nt, Homo sapiens
cugauagggguuca

SEQ ID NO: 2034312 - RNA, 17 nt, Homo sapiens
aacaucgcgaugggaac

SEQ ID NO: 2034313 - RNA, 19 nt, Homo sapiens
aguugaagcucuucauuca

SEQ ID NO: 2034314 - RNA, 16 nt, Homo sapiens
acaaaaagccauuguu

SEQ ID NO: 2034315 - RNA, 13 nt, Homo sapiens
aaaauacucugac

SEQ ID NO: 2034316 - RNA, 14 nt, Homo sapiens
cccuucccaguggg

SEQ ID NO: 2034317 - RNA, 19 nt, Homo sapiens
ugaagagauuucaacaaga

SEQ ID NO: 2034318 - RNA, 13 nt, Homo sapiens
aucaucagucuua

SEQ ID NO: 2034319 - RNA, 20 nt, Homo sapiens
uggagcagaagcagcaacuu

SEQ ID NO: 2034320 - RNA, 21 nt, Homo sapiens
aacucacugaggguaucugac

SEQ ID NO: 2034321 - RNA, 13 nt, Homo sapiens
ccaugcaauucau

SEQ ID NO: 2034322 - RNA, 17 nt, Homo sapiens
uuuuacauauauuccca

SEQ ID NO: 2034323 - RNA, 17 nt, Homo sapiens
cuaaagcuuuggacaag

SEQ ID NO: 2034324 - RNA, 16 nt, Homo sapiens
gcugggacguggcuca

SEQ ID NO: 2034325 - RNA, 22 nt, Homo sapiens
aaggagaaaugauaagugacaa

SEQ ID NO: 2034326 - RNA, 22 nt, Homo sapiens
guuaggcacaggcugggaugga

SEQ ID NO: 2034327 - RNA, 17 nt, Homo sapiens
caucagaaacucugcca

SEQ ID NO: 2034328 - RNA, 19 nt, Homo sapiens
agcagccugcugcucucag

SEQ ID NO: 2034329 - RNA, 18 nt, Homo sapiens
gcagacaagaacagccgc

SEQ ID NO: 2034330 - RNA, 12 nt, Homo sapiens
aggcauggaaag

SEQ ID NO: 2034331 - RNA, 20 nt, Homo sapiens
gaucaaaguguaaacaccau

SEQ ID NO: 2034332 - RNA, 15 nt, Homo sapiens
uggggcucucuccau

SEQ ID NO: 2034333 - RNA, 13 nt, Homo sapiens
gauagcugaauga

SEQ ID NO: 2034334 - RNA, 22 nt, Homo sapiens
uccccuuggcccaucugugcag

SEQ ID NO: 2034335 - RNA, 15 nt, Homo sapiens
guucuuauucacuga

SEQ ID NO: 2034336 - RNA, 22 nt, Homo sapiens
gaaagggaagaucuuaugccuu

SEQ ID NO: 2034337 - RNA, 15 nt, Homo sapiens
ccuagaccuugccuc

SEQ ID NO: 2034338 - RNA, 21 nt, Homo sapiens
gcauuagcucuuagacccaca

SEQ ID NO: 2034339 - RNA, 13 nt, Homo sapiens
gaaggagugugca

SEQ ID NO: 2034340 - RNA, 21 nt, Homo sapiens
ggucucccaacaagugcucuu

SEQ ID NO: 2034341 - RNA, 17 nt, Homo sapiens
caucacuucccuacaug

SEQ ID NO: 2034342 - RNA, 22 nt, Homo sapiens
caggguggaugaucucaaucuc

SEQ ID NO: 2034343 - RNA, 22 nt, Homo sapiens
acacgaagccagcagaggucag

SEQ ID NO: 2034344 - RNA, 20 nt, Homo sapiens
caggguguguacugcacaag

SEQ ID NO: 2034345 - RNA, 20 nt, Homo sapiens
augccacgauuuagauuuaa

SEQ ID NO: 2034346 - RNA, 22 nt, Homo sapiens
ugguguauuugccagcuuuauu

SEQ ID NO: 2034347 - RNA, 16 nt, Homo sapiens
gagcugaagaccuaaa

SEQ ID NO: 2034348 - RNA, 14 nt, Homo sapiens
gacuagaaccugga

SEQ ID NO: 2034349 - RNA, 17 nt, Homo sapiens
uucacuucaucuucuca

SEQ ID NO: 2034350 - RNA, 18 nt, Homo sapiens
aauauuauuacuguugau

SEQ ID NO: 2034351 - RNA, 21 nt, Homo sapiens
gaugaaaaccuaacagggugg

SEQ ID NO: 2034352 - RNA, 22 nt, Homo sapiens
uguuauuuguugagacuaucaa

SEQ ID NO: 2034353 - RNA, 17 nt, Homo sapiens
agcaggcacccacuucc

SEQ ID NO: 2034354 - RNA, 14 nt, Homo sapiens
agaaacauuucaga

SEQ ID NO: 2034355 - RNA, 14 nt, Homo sapiens
cugaugauuucacu

SEQ ID NO: 2034356 - RNA, 22 nt, Homo sapiens
uguauaguuuuauuuacuucug

SEQ ID NO: 2034357 - RNA, 18 nt, Homo sapiens
uacugaaugaccacuuga

SEQ ID NO: 2034358 - RNA, 16 nt, Homo sapiens
uuuagugugccuucca

SEQ ID NO: 2034359 - RNA, 18 nt, Homo sapiens
agcgucacggccaagugu

SEQ ID NO: 2034360 - RNA, 11 nt, Homo sapiens
acucacacagg

SEQ ID NO: 2034361 - RNA, 18 nt, Homo sapiens
agagagacagacuugaga

SEQ ID NO: 2034362 - RNA, 17 nt, Homo sapiens
aagugggaucugucaca

SEQ ID NO: 2034363 - RNA, 18 nt, Homo sapiens
guagccuggucugugcau

SEQ ID NO: 2034364 - RNA, 13 nt, Homo sapiens
gcaccaucauucc

SEQ ID NO: 2034365 - RNA, 17 nt, Homo sapiens
uagcaagaagauucuaa

SEQ ID NO: 2034366 - RNA, 17 nt, Homo sapiens
cucccccugccagugcc

SEQ ID NO: 2034367 - RNA, 20 nt, Homo sapiens
guaaauugaaucaguauaaa

SEQ ID NO: 2034368 - RNA, 21 nt, Homo sapiens
uaauaccuuggacuuuggaca

SEQ ID NO: 2034369 - RNA, 20 nt, Homo sapiens
gccucaagaacaaacacugc

SEQ ID NO: 2034370 - RNA, 18 nt, Homo sapiens
auaaaguuauuacucuga

SEQ ID NO: 2034371 - RNA, 13 nt, Homo sapiens
ucugaagugcucu

SEQ ID NO: 2034372 - RNA, 18 nt, Homo sapiens
ggcaggaaauacuuugua

SEQ ID NO: 2034373 - RNA, 14 nt, Homo sapiens
cuauaucugagaga

SEQ ID NO: 2034374 - RNA, 14 nt, Homo sapiens
cagaaucuguauga

SEQ ID NO: 2034375 - RNA, 18 nt, Homo sapiens
ugacuacuauggcuguuu

SEQ ID NO: 2034376 - RNA, 14 nt, Homo sapiens
uaaaucguccuccc

SEQ ID NO: 2034377 - RNA, 15 nt, Homo sapiens
cugccugacugccag

SEQ ID NO: 2034378 - RNA, 15 nt, Homo sapiens
cacacacacacacuc

SEQ ID NO: 2034379 - RNA, 20 nt, Homo sapiens
cugcugauaucaacagcuuc

SEQ ID NO: 2034380 - RNA, 19 nt, Homo sapiens
cuugguuagacgccuucca

SEQ ID NO: 2034381 - RNA, 14 nt, Homo sapiens
agcuuucagacucc

SEQ ID NO: 2034382 - RNA, 19 nt, Homo sapiens
caccaugacuugaggcaca

SEQ ID NO: 2034383 - RNA, 20 nt, Homo sapiens
ucuuucagcagaaaugaaau

SEQ ID NO: 2034384 - RNA, 17 nt, Homo sapiens
uggccuugcaaccucuu

SEQ ID NO: 2034385 - RNA, 17 nt, Homo sapiens
aacaaauaaacuagucu

SEQ ID NO: 2034386 - RNA, 19 nt, Homo sapiens
cagagaccccaggauccca

SEQ ID NO: 2034387 - RNA, 13 nt, Homo sapiens
cagacacaacagc

SEQ ID NO: 2034388 - RNA, 14 nt, Homo sapiens
aggucaaguaagaa

SEQ ID NO: 2034389 - RNA, 18 nt, Homo sapiens
gccuucuacugcucuccu

SEQ ID NO: 2034390 - RNA, 18 nt, Homo sapiens
gcccuccaaaagcacuua

SEQ ID NO: 2034391 - RNA, 17 nt, Homo sapiens
cgugcucccgaugcugc

SEQ ID NO: 2034392 - RNA, 20 nt, Homo sapiens
uuaacuuugcuuaaacuaca

SEQ ID NO: 2034393 - RNA, 22 nt, Homo sapiens
acagaaauccacgcucaaucuc

SEQ ID NO: 2034394 - RNA, 21 nt, Homo sapiens
aguauuuaacgaagccuagaa

SEQ ID NO: 2034395 - RNA, 23 nt, Homo sapiens
ucugcccuagcgcucucuuccag

SEQ ID NO: 2034396 - RNA, 16 nt, Homo sapiens
aauucucaaccuacca

SEQ ID NO: 2034397 - RNA, 19 nt, Homo sapiens
acuaauuuauaacuauuau

SEQ ID NO: 2034398 - RNA, 15 nt, Homo sapiens
accuuuagugccaac

SEQ ID NO: 2034399 - RNA, 14 nt, Homo sapiens
cugcucacuuucca

SEQ ID NO: 2034400 - RNA, 12 nt, Homo sapiens
ggucugccaauc

SEQ ID NO: 2034401 - RNA, 22 nt, Homo sapiens
agcuuagccaaugugggagcag

SEQ ID NO: 2034402 - RNA, 20 nt, Homo sapiens
aaaagacugaaucuaccugc

SEQ ID NO: 2034403 - RNA, 14 nt, Homo sapiens
ucucccuugaggga

SEQ ID NO: 2034404 - RNA, 18 nt, Homo sapiens
caggauagagugggacag

SEQ ID NO: 2034405 - RNA, 16 nt, Homo sapiens
gauuuuauguugacau

SEQ ID NO: 2034406 - RNA, 22 nt, Homo sapiens
cagagaaaaggacuccucagaa

SEQ ID NO: 2034407 - RNA, 19 nt, Homo sapiens
aaaacccacaaaaguacaa

SEQ ID NO: 2034408 - RNA, 22 nt, Homo sapiens
ggacaaugucugaacucuccag

SEQ ID NO: 2034409 - RNA, 17 nt, Homo sapiens
uuugaaaccaaaccaga

SEQ ID NO: 2034410 - RNA, 21 nt, Homo sapiens
ggauguacgacauuuugugac

SEQ ID NO: 2034411 - RNA, 22 nt, Homo sapiens
aaagaaaaaaaaaagaaaaagg

SEQ ID NO: 2034412 - RNA, 19 nt, Homo sapiens
aacauguuguacauuucac

SEQ ID NO: 2034413 - RNA, 15 nt, Homo sapiens
augugauauuuucac

SEQ ID NO: 2034414 - RNA, 14 nt, Homo sapiens
uuugucccaucucu

SEQ ID NO: 2034415 - RNA, 16 nt, Homo sapiens
cggaauuccaccugga

SEQ ID NO: 2034416 - RNA, 16 nt, Homo sapiens
gaagucaauaugugga

SEQ ID NO: 2034417 - RNA, 23 nt, Homo sapiens
ucuuuuggcaguucugauaagcu

SEQ ID NO: 2034418 - RNA, 12 nt, Homo sapiens
cagcaucuguag

SEQ ID NO: 2034419 - RNA, 22 nt, Homo sapiens
ucacacuccccuagggggagaa

SEQ ID NO: 2034420 - RNA, 21 nt, Homo sapiens
uugcuuuccugcaucucugug

SEQ ID NO: 2034421 - RNA, 15 nt, Homo sapiens
gaggacuacuuucca

SEQ ID NO: 2034422 - RNA, 20 nt, Homo sapiens
ggcuuuaugcuaguuugacc

SEQ ID NO: 2034423 - RNA, 21 nt, Homo sapiens
cagugaaagcugacaucugua

SEQ ID NO: 2034424 - RNA, 20 nt, Homo sapiens
cacacaguauuacuucugcu

SEQ ID NO: 2034425 - RNA, 11 nt, Homo sapiens
ccccacugaca

SEQ ID NO: 2034426 - RNA, 23 nt, Homo sapiens
caguuagcauggcuucacacugu

SEQ ID NO: 2034427 - RNA, 19 nt, Homo sapiens
cccuguaguugacaauucu

SEQ ID NO: 2034428 - RNA, 17 nt, Homo sapiens
ggcacauggcuggcacu

SEQ ID NO: 2034429 - RNA, 14 nt, Homo sapiens
gaaacuaaucauaa

SEQ ID NO: 2034430 - RNA, 19 nt, Homo sapiens
ugaaaagaaaaugugccau

SEQ ID NO: 2034431 - RNA, 20 nt, Homo sapiens
cucucgagggaagcagugug

SEQ ID NO: 2034432 - RNA, 17 nt, Homo sapiens
accaauauuucuucaca

SEQ ID NO: 2034433 - RNA, 12 nt, Homo sapiens
caaccaagaaug

SEQ ID NO: 2034434 - RNA, 22 nt, Homo sapiens
auuucaaaguuuuguuguacuu

SEQ ID NO: 2034435 - RNA, 14 nt, Homo sapiens
ucugaagugguuug

SEQ ID NO: 2034436 - RNA, 16 nt, Homo sapiens
ucgugaagaagccugu

SEQ ID NO: 2034437 - RNA, 17 nt, Homo sapiens
gaccaggcaggcaaagg

SEQ ID NO: 2034438 - RNA, 17 nt, Homo sapiens
uacugaggugguggaca

SEQ ID NO: 2034439 - RNA, 15 nt, Homo sapiens
uuaugucaucauaca

SEQ ID NO: 2034440 - RNA, 12 nt, Homo sapiens
cacccuuucauu

SEQ ID NO: 2034441 - RNA, 19 nt, Homo sapiens
ccuguugaaugacaaagua

SEQ ID NO: 2034442 - RNA, 15 nt, Homo sapiens
ggauuuaccaaauag

SEQ ID NO: 2034443 - RNA, 22 nt, Homo sapiens
uuguuaauaacuaauaacugga

SEQ ID NO: 2034444 - RNA, 17 nt, Homo sapiens
agagcacgccuguacua

SEQ ID NO: 2034445 - RNA, 16 nt, Homo sapiens
gguccugggucuuuca

SEQ ID NO: 2034446 - RNA, 18 nt, Homo sapiens
ugggaggauccuggagaa

SEQ ID NO: 2034447 - RNA, 22 nt, Homo sapiens
aucacuaccuuuauagcucuca

SEQ ID NO: 2034448 - RNA, 16 nt, Homo sapiens
auuuacugacugcuua

SEQ ID NO: 2034449 - RNA, 16 nt, Homo sapiens
ggcuccgcaugguuca

SEQ ID NO: 2034450 - RNA, 15 nt, Homo sapiens
cuucaccaucuguau

SEQ ID NO: 2034451 - RNA, 20 nt, Homo sapiens
ugacuaaacuaccaccucag

SEQ ID NO: 2034452 - RNA, 16 nt, Homo sapiens
auacaugacucagcau

SEQ ID NO: 2034453 - RNA, 20 nt, Homo sapiens
cuagauuaccaugaagaaca

SEQ ID NO: 2034454 - RNA, 22 nt, Homo sapiens
gaugugggucccucucuugacc

SEQ ID NO: 2034455 - RNA, 14 nt, Homo sapiens
gaggccaugugcau

SEQ ID NO: 2034456 - RNA, 18 nt, Homo sapiens
aaguucgagacuagccug

SEQ ID NO: 2034457 - RNA, 16 nt, Homo sapiens
cugacuggcacagucu

SEQ ID NO: 2034458 - RNA, 19 nt, Homo sapiens
gaagcauugaaaacaaaga

SEQ ID NO: 2034459 - RNA, 20 nt, Homo sapiens
aauaauggcaucaauauaca

SEQ ID NO: 2034460 - RNA, 21 nt, Homo sapiens
cccagaggauaagccacuggg

SEQ ID NO: 2034461 - RNA, 17 nt, Homo sapiens
uuuaagcuucaguugcu

SEQ ID NO: 2034462 - RNA, 19 nt, Homo sapiens
aauuuauuaacuaaucaag

SEQ ID NO: 2034463 - RNA, 12 nt, Homo sapiens
acaugcuguuac

SEQ ID NO: 2034464 - RNA, 23 nt, Homo sapiens
aucacggcucacugcagccucaa

SEQ ID NO: 2034465 - RNA, 19 nt, Homo sapiens
ugacuccucuaagccacuc

SEQ ID NO: 2034466 - RNA, 22 nt, Homo sapiens
aagccacguuaaguccaaggag

SEQ ID NO: 2034467 - RNA, 16 nt, Homo sapiens
gggcccaacacuggcc

SEQ ID NO: 2034468 - RNA, 13 nt, Homo sapiens
uacauacugcugu

SEQ ID NO: 2034469 - RNA, 18 nt, Homo sapiens
ugugggugggaccacaga

SEQ ID NO: 2034470 - RNA, 22 nt, Homo sapiens
caaggucucacacuccuccugc

SEQ ID NO: 2034471 - RNA, 15 nt, Homo sapiens
uauuuguaacauugu

SEQ ID NO: 2034472 - RNA, 13 nt, Homo sapiens
ggaacaauaucaa

SEQ ID NO: 2034473 - RNA, 13 nt, Homo sapiens
aguggacaccgcu

SEQ ID NO: 2034474 - RNA, 19 nt, Homo sapiens
aagagcgagacuccguuuc

SEQ ID NO: 2034475 - RNA, 16 nt, Homo sapiens
ugaugauaacacuuaa

SEQ ID NO: 2034476 - RNA, 15 nt, Homo sapiens
ucuauuaaauguaua

SEQ ID NO: 2034477 - RNA, 14 nt, Homo sapiens
uugaaauaaacagg

SEQ ID NO: 2034478 - RNA, 21 nt, Homo sapiens
aaagcuagaaaguguaugugu

SEQ ID NO: 2034479 - RNA, 21 nt, Homo sapiens
uggcauaacauaaaucuguga

SEQ ID NO: 2034480 - RNA, 18 nt, Homo sapiens
uucaucaccagacuuugg

SEQ ID NO: 2034481 - RNA, 16 nt, Homo sapiens
ggggcccucugccuca

SEQ ID NO: 2034482 - RNA, 17 nt, Homo sapiens
caaggacgaauuugcac

SEQ ID NO: 2034483 - RNA, 21 nt, Homo sapiens
uaaugucugucagaagacacu

SEQ ID NO: 2034484 - RNA, 20 nt, Homo sapiens
aguuaucuccagugcauuaa

SEQ ID NO: 2034485 - RNA, 20 nt, Homo sapiens
acagaucacacacaugcaca

SEQ ID NO: 2034486 - RNA, 21 nt, Homo sapiens
acaacagcccugucucaaaac

SEQ ID NO: 2034487 - RNA, 15 nt, Homo sapiens
gaaggagcaguguga

SEQ ID NO: 2034488 - RNA, 12 nt, Homo sapiens
cuucucaggcau

SEQ ID NO: 2034489 - RNA, 19 nt, Homo sapiens
ccugcagaggaaagacagg

SEQ ID NO: 2034490 - RNA, 14 nt, Homo sapiens
uggaagcauacaaa

SEQ ID NO: 2034491 - RNA, 13 nt, Homo sapiens
ccaguucaguguu

SEQ ID NO: 2034492 - RNA, 16 nt, Homo sapiens
cagaacccagggcucu

SEQ ID NO: 2034493 - RNA, 22 nt, Homo sapiens
uggcauuuuccucgccuaggcc

SEQ ID NO: 2034494 - RNA, 14 nt, Homo sapiens
aagcuaaaaggaaa

SEQ ID NO: 2034495 - RNA, 18 nt, Homo sapiens
uuagggccucauuugcuc

SEQ ID NO: 2034496 - RNA, 12 nt, Homo sapiens
ccgcacaucuca

SEQ ID NO: 2034497 - RNA, 15 nt, Homo sapiens
auuuaugaugcaguu

SEQ ID NO: 2034498 - RNA, 18 nt, Homo sapiens
aguguagauguagcauug

SEQ ID NO: 2034499 - RNA, 18 nt, Homo sapiens
auguuaaagagaaugagu

SEQ ID NO: 2034500 - RNA, 16 nt, Homo sapiens
uacuccuuccaucaaa

SEQ ID NO: 2034501 - RNA, 18 nt, Homo sapiens
gcuucugggccacucagg

SEQ ID NO: 2034502 - RNA, 12 nt, Homo sapiens
cuucuuacugau

SEQ ID NO: 2034503 - RNA, 14 nt, Homo sapiens
cauagugcacacuu

SEQ ID NO: 2034504 - RNA, 15 nt, Homo sapiens
aguuuggaagcacug

SEQ ID NO: 2034505 - RNA, 22 nt, Homo sapiens
agaaauuccuguagcaucuucu

SEQ ID NO: 2034506 - RNA, 22 nt, Homo sapiens
gggcucaaggaaaggggguccc

SEQ ID NO: 2034507 - RNA, 14 nt, Homo sapiens
agccuuaugugagc

SEQ ID NO: 2034508 - RNA, 22 nt, Homo sapiens
auuuucccccacuacugcagca

SEQ ID NO: 2034509 - RNA, 17 nt, Homo sapiens
ccucccuucucuucaca

SEQ ID NO: 2034510 - RNA, 22 nt, Homo sapiens
acuucauacaauguaaggucag

SEQ ID NO: 2034511 - RNA, 17 nt, Homo sapiens
gucuccaaaacauuucu

SEQ ID NO: 2034512 - RNA, 13 nt, Homo sapiens
agcauaacaugga

SEQ ID NO: 2034513 - RNA, 21 nt, Homo sapiens
ggaaguuucguaugcacuccc

SEQ ID NO: 2034514 - RNA, 22 nt, Homo sapiens
cagaauuaugauggaagacagg

SEQ ID NO: 2034515 - RNA, 20 nt, Homo sapiens
cacauccugaccuugcacaa

SEQ ID NO: 2034516 - RNA, 15 nt, Homo sapiens
aucaugugaggaaau

SEQ ID NO: 2034517 - RNA, 17 nt, Homo sapiens
cacuugugucaaucaug

SEQ ID NO: 2034518 - RNA, 14 nt, Homo sapiens
ccuugacuaaauuc

SEQ ID NO: 2034519 - RNA, 14 nt, Homo sapiens
ucagaaagauuuga

SEQ ID NO: 2034520 - RNA, 20 nt, Homo sapiens
gaugaaaauguaacuugaaa

SEQ ID NO: 2034521 - RNA, 13 nt, Homo sapiens
gaagacacacuca

SEQ ID NO: 2034522 - RNA, 22 nt, Homo sapiens
ugccacaaugcaguucugagca

SEQ ID NO: 2034523 - RNA, 13 nt, Homo sapiens
ugauggucauuca

SEQ ID NO: 2034524 - RNA, 14 nt, Homo sapiens
guucucacugucuc

SEQ ID NO: 2034525 - RNA, 22 nt, Homo sapiens
agcuugacucccaaguuuccau

SEQ ID NO: 2034526 - RNA, 21 nt, Homo sapiens
aacaccacgguagugccugaa

SEQ ID NO: 2034527 - RNA, 21 nt, Homo sapiens
gucugcacuguucaaaccucu

SEQ ID NO: 2034528 - RNA, 19 nt, Homo sapiens
ugauaaaauuuuacauuug

SEQ ID NO: 2034529 - RNA, 16 nt, Homo sapiens
aaacauccuugcaaau

SEQ ID NO: 2034530 - RNA, 19 nt, Homo sapiens
gacaaaccuuauggaaaag

SEQ ID NO: 2034531 - RNA, 12 nt, Homo sapiens
auauaagccaua

SEQ ID NO: 2034532 - RNA, 19 nt, Homo sapiens
caagaugcgcacugcauuc

SEQ ID NO: 2034533 - RNA, 17 nt, Homo sapiens
uccuauaauucuauuga

SEQ ID NO: 2034534 - RNA, 17 nt, Homo sapiens
cuagagacucugugauc

SEQ ID NO: 2034535 - RNA, 13 nt, Homo sapiens
cuugagcucuaaa

SEQ ID NO: 2034536 - RNA, 18 nt, Homo sapiens
ucuuaguuuuuaaaaagg

SEQ ID NO: 2034537 - RNA, 16 nt, Homo sapiens
uccccucccccaagau

SEQ ID NO: 2034538 - RNA, 18 nt, Homo sapiens
aggacagagcugacaaaa

SEQ ID NO: 2034539 - RNA, 19 nt, Homo sapiens
ucaaguuguugacugugau

SEQ ID NO: 2034540 - RNA, 15 nt, Homo sapiens
ggauuuggguuggaa

SEQ ID NO: 2034541 - RNA, 13 nt, Homo sapiens
gaagaagagccac

SEQ ID NO: 2034542 - RNA, 20 nt, Homo sapiens
ggucuuuauuccucccucau

SEQ ID NO: 2034543 - RNA, 14 nt, Homo sapiens
cuuagcucccccac

SEQ ID NO: 2034544 - RNA, 12 nt, Homo sapiens
aauagauuucag

SEQ ID NO: 2034545 - RNA, 12 nt, Homo sapiens
acaagauuuaug

SEQ ID NO: 2034546 - RNA, 12 nt, Homo sapiens
aaccuggaccca

SEQ ID NO: 2034547 - RNA, 20 nt, Homo sapiens
accuuaugagaaacugcaug

SEQ ID NO: 2034548 - RNA, 22 nt, Homo sapiens
acuauccaaauaaaaauaacau

SEQ ID NO: 2034549 - RNA, 21 nt, Homo sapiens
auuugagaucguccacuguca

SEQ ID NO: 2034550 - RNA, 22 nt, Homo sapiens
caccuaauccaggcagauccag

SEQ ID NO: 2034551 - RNA, 20 nt, Homo sapiens
agagcaaauuugaauaauuc

SEQ ID NO: 2034552 - RNA, 11 nt, Homo sapiens
ugcucaggaaa

SEQ ID NO: 2034553 - RNA, 14 nt, Homo sapiens
uggcccuacuggga

SEQ ID NO: 2034554 - RNA, 17 nt, Homo sapiens
cucccagagagugaaua

SEQ ID NO: 2034555 - RNA, 14 nt, Homo sapiens
agcaacccugugau

SEQ ID NO: 2034556 - RNA, 20 nt, Homo sapiens
gcuauugaacugagccaaac

SEQ ID NO: 2034557 - RNA, 19 nt, Homo sapiens
aacccaccccgcuuucgua

SEQ ID NO: 2034558 - RNA, 16 nt, Homo sapiens
caguccaauaggugua

SEQ ID NO: 2034559 - RNA, 19 nt, Homo sapiens
aauauauugaauaggcauu

SEQ ID NO: 2034560 - RNA, 19 nt, Homo sapiens
ccaucuccuuucucuggua

SEQ ID NO: 2034561 - RNA, 16 nt, Homo sapiens
gucaaucacagucuca

SEQ ID NO: 2034562 - RNA, 20 nt, Homo sapiens
guaguuuuauuacacauuua

SEQ ID NO: 2034563 - RNA, 23 nt, Homo sapiens
uccaccuguggguguagccaggu

SEQ ID NO: 2034564 - RNA, 12 nt, Homo sapiens
cuagugcuacug

SEQ ID NO: 2034565 - RNA, 21 nt, Homo sapiens
cugcuuaggugccaggcaugu

SEQ ID NO: 2034566 - RNA, 15 nt, Homo sapiens
ccauaauaaaauauc

SEQ ID NO: 2034567 - RNA, 13 nt, Homo sapiens
aaugucuaagaua

SEQ ID NO: 2034568 - RNA, 17 nt, Homo sapiens
caguaagcuaucuucaa

SEQ ID NO: 2034569 - RNA, 13 nt, Homo sapiens
gcuugucaggggg

SEQ ID NO: 2034570 - RNA, 13 nt, Homo sapiens
gcuggucagggug

SEQ ID NO: 2034571 - RNA, 21 nt, Homo sapiens
gagaaccuggccuucagugua

SEQ ID NO: 2034572 - RNA, 14 nt, Homo sapiens
uucaagauuguuga

SEQ ID NO: 2034573 - RNA, 22 nt, Homo sapiens
uugucauguggcuaaaugccua

SEQ ID NO: 2034574 - RNA, 22 nt, Homo sapiens
gcacaauuuuaauucaaaagau

SEQ ID NO: 2034575 - RNA, 15 nt, Homo sapiens
gugaucgcacaagga

SEQ ID NO: 2034576 - RNA, 18 nt, Homo sapiens
ugguauuauauaauucaa

SEQ ID NO: 2034577 - RNA, 22 nt, Homo sapiens
uguacauguguagccugugcau

SEQ ID NO: 2034578 - RNA, 14 nt, Homo sapiens
gauagcauugcuuu

SEQ ID NO: 2034579 - RNA, 16 nt, Homo sapiens
ucuacaaaaauuuauu

SEQ ID NO: 2034580 - RNA, 13 nt, Homo sapiens
aagaggccaaaca

SEQ ID NO: 2034581 - RNA, 20 nt, Homo sapiens
cucaguguaccacuacuuag

SEQ ID NO: 2034582 - RNA, 21 nt, Homo sapiens
auuucgaagccacagagucuc

SEQ ID NO: 2034583 - RNA, 14 nt, Homo sapiens
acuaugacaucuaa

SEQ ID NO: 2034584 - RNA, 19 nt, Homo sapiens
cuggccaaauaugcacuuu

SEQ ID NO: 2034585 - RNA, 21 nt, Homo sapiens
aaaccccgagauagugcugga

SEQ ID NO: 2034586 - RNA, 17 nt, Homo sapiens
uuccuucacuuugcaga

SEQ ID NO: 2034587 - RNA, 15 nt, Homo sapiens
uugucugagacagaa

SEQ ID NO: 2034588 - RNA, 15 nt, Homo sapiens
auaccgcagaguauu

SEQ ID NO: 2034589 - RNA, 15 nt, Homo sapiens
ccuacccuaaccaag

SEQ ID NO: 2034590 - RNA, 17 nt, Homo sapiens
gcaccagacacccagga

SEQ ID NO: 2034591 - RNA, 14 nt, Homo sapiens
ccugccauaacaua

SEQ ID NO: 2034592 - RNA, 19 nt, Homo sapiens
cugaaccccugggguagcc

SEQ ID NO: 2034593 - RNA, 19 nt, Homo sapiens
aaccugacuuccucugcca

SEQ ID NO: 2034594 - RNA, 22 nt, Homo sapiens
auuuucucuccucgguggcauu

SEQ ID NO: 2034595 - RNA, 23 nt, Homo sapiens
gagcaugugagggguagugggau

SEQ ID NO: 2034596 - RNA, 13 nt, Homo sapiens
uucaugagucuug

SEQ ID NO: 2034597 - RNA, 14 nt, Homo sapiens
auuucaagugccua

SEQ ID NO: 2034598 - RNA, 12 nt, Homo sapiens
ccugugaccucc

SEQ ID NO: 2034599 - RNA, 23 nt, Homo sapiens
cuguggaaaagccaucucagguu

SEQ ID NO: 2034600 - RNA, 20 nt, Homo sapiens
cugcagucaagguugucaau

SEQ ID NO: 2034601 - RNA, 22 nt, Homo sapiens
aaacacaauccuuuguucuccc

SEQ ID NO: 2034602 - RNA, 17 nt, Homo sapiens
uuauguuaaaaagaaau

SEQ ID NO: 2034603 - RNA, 18 nt, Homo sapiens
caugacacucuagugacu

SEQ ID NO: 2034604 - RNA, 15 nt, Homo sapiens
auugagcuacuucag

SEQ ID NO: 2034605 - RNA, 19 nt, Homo sapiens
agauaccagagacucugaa

SEQ ID NO: 2034606 - RNA, 19 nt, Homo sapiens
gucucuuggcuuugucacu

SEQ ID NO: 2034607 - RNA, 17 nt, Homo sapiens
ucuagaagcuccaguga

SEQ ID NO: 2034608 - RNA, 22 nt, Homo sapiens
auguugaagcucuuuacuguaa

SEQ ID NO: 2034609 - RNA, 20 nt, Homo sapiens
uguaauaaagugaacuuugu

SEQ ID NO: 2034610 - RNA, 14 nt, Homo sapiens
ccuguggucugugu

SEQ ID NO: 2034611 - RNA, 21 nt, Homo sapiens
caggcagaugagacaguguua

SEQ ID NO: 2034612 - RNA, 18 nt, Homo sapiens
gaggcugccucccaacag

SEQ ID NO: 2034613 - RNA, 14 nt, Homo sapiens
gauccaguggacac

SEQ ID NO: 2034614 - RNA, 13 nt, Homo sapiens
guggacucagugg

SEQ ID NO: 2034615 - RNA, 15 nt, Homo sapiens
gaauagcacagguga

SEQ ID NO: 2034616 - RNA, 20 nt, Homo sapiens
gcuuccuuugggagcucauu

SEQ ID NO: 2034617 - RNA, 17 nt, Homo sapiens
uguguugauacuguugc

SEQ ID NO: 2034618 - RNA, 13 nt, Homo sapiens
aagauggagacac

SEQ ID NO: 2034619 - RNA, 17 nt, Homo sapiens
aguuccagcuaacuggg

SEQ ID NO: 2034620 - RNA, 15 nt, Homo sapiens
aguugccacauuuag

SEQ ID NO: 2034621 - RNA, 18 nt, Homo sapiens
cagaaaguggccaugcca

SEQ ID NO: 2034622 - RNA, 14 nt, Homo sapiens
ggcaguuacagggc

SEQ ID NO: 2034623 - RNA, 12 nt, Homo sapiens
uaauauacuuua

SEQ ID NO: 2034624 - RNA, 19 nt, Homo sapiens
uaagaaauacuagaguaaa

SEQ ID NO: 2034625 - RNA, 22 nt, Homo sapiens
cuacaccaaugaaaacauguac

SEQ ID NO: 2034626 - RNA, 16 nt, Homo sapiens
uagcaguguauuacuc

SEQ ID NO: 2034627 - RNA, 14 nt, Homo sapiens
uuccugcauguucu

SEQ ID NO: 2034628 - RNA, 22 nt, Homo sapiens
gcuugggcaccagcucaugcca

SEQ ID NO: 2034629 - RNA, 21 nt, Homo sapiens
cacccaagagggcugcuuccc

SEQ ID NO: 2034630 - RNA, 15 nt, Homo sapiens
caguguccaaagcag

SEQ ID NO: 2034631 - RNA, 19 nt, Homo sapiens
guucaaaguuuaagcaauu

SEQ ID NO: 2034632 - RNA, 20 nt, Homo sapiens
auauuccccuaagauuugau

SEQ ID NO: 2034633 - RNA, 14 nt, Homo sapiens
agaaggcauaucag

SEQ ID NO: 2034634 - RNA, 16 nt, Homo sapiens
aaccuggagaugauga

SEQ ID NO: 2034635 - RNA, 21 nt, Homo sapiens
cuggucagcauguacuccccu

SEQ ID NO: 2034636 - RNA, 15 nt, Homo sapiens
auugcagacugugua

SEQ ID NO: 2034637 - RNA, 21 nt, Homo sapiens
uccccacagugacagucacuu

SEQ ID NO: 2034638 - RNA, 19 nt, Homo sapiens
cagcuccuuucaugcucca

SEQ ID NO: 2034639 - RNA, 13 nt, Homo sapiens
uuaggauuacuua

SEQ ID NO: 2034640 - RNA, 16 nt, Homo sapiens
aucuuggggacaucuc

SEQ ID NO: 2034641 - RNA, 16 nt, Homo sapiens
gcgucagcaauuuccu

SEQ ID NO: 2034642 - RNA, 21 nt, Homo sapiens
guucaagugauucucaugccu

SEQ ID NO: 2034643 - RNA, 19 nt, Homo sapiens
ucuaguggguugaccuuua

SEQ ID NO: 2034644 - RNA, 22 nt, Homo sapiens
acugcuacagcaauuucuaauu

SEQ ID NO: 2034645 - RNA, 18 nt, Homo sapiens
aaaugaggccuacucuaa

SEQ ID NO: 2034646 - RNA, 14 nt, Homo sapiens
agacagauaccucc

SEQ ID NO: 2034647 - RNA, 18 nt, Homo sapiens
cauucaucacuccaaaaa

SEQ ID NO: 2034648 - RNA, 14 nt, Homo sapiens
aggguccaguggau

SEQ ID NO: 2034649 - RNA, 16 nt, Homo sapiens
cacaucuguccugaca

SEQ ID NO: 2034650 - RNA, 16 nt, Homo sapiens
uggagcacaaaauuca

SEQ ID NO: 2034651 - RNA, 17 nt, Homo sapiens
ucucuggagguacugag

SEQ ID NO: 2034652 - RNA, 13 nt, Homo sapiens
caggauaccagca

SEQ ID NO: 2034653 - RNA, 20 nt, Homo sapiens
aucacaagucagcacuaccu

SEQ ID NO: 2034654 - RNA, 19 nt, Homo sapiens
aauguagacauuaucuuuu

SEQ ID NO: 2034655 - RNA, 23 nt, Homo sapiens
ccacacuugggguuuaaauaucc

SEQ ID NO: 2034656 - RNA, 14 nt, Homo sapiens
uagcucuccugcca

SEQ ID NO: 2034657 - RNA, 22 nt, Homo sapiens
agcccacccugcugcuggugca

SEQ ID NO: 2034658 - RNA, 17 nt, Homo sapiens
cagcccccccacccacc

SEQ ID NO: 2034659 - RNA, 21 nt, Homo sapiens
aagugcccucucugaaccuca

SEQ ID NO: 2034660 - RNA, 17 nt, Homo sapiens
gcguuuaaaguacugag

SEQ ID NO: 2034661 - RNA, 15 nt, Homo sapiens
gccacucuacagguc

SEQ ID NO: 2034662 - RNA, 15 nt, Homo sapiens
agagcaguggcagag

SEQ ID NO: 2034663 - RNA, 14 nt, Homo sapiens
cagcuccuguaaca

SEQ ID NO: 2034664 - RNA, 19 nt, Homo sapiens
aaaacaaaacaaaccuuaa

SEQ ID NO: 2034665 - RNA, 22 nt, Homo sapiens
gucuggagaagguauuagcaaa

SEQ ID NO: 2034666 - RNA, 18 nt, Homo sapiens
cagguugcuuugcccugg

SEQ ID NO: 2034667 - RNA, 14 nt, Homo sapiens
aacaaaaaaccaca

SEQ ID NO: 2034668 - RNA, 14 nt, Homo sapiens
auuagcuucaggau

SEQ ID NO: 2034669 - RNA, 16 nt, Homo sapiens
uuauuuugaaaauaau

SEQ ID NO: 2034670 - RNA, 17 nt, Homo sapiens
uuuccgugcguggcacu

SEQ ID NO: 2034671 - RNA, 20 nt, Homo sapiens
agaaaaucuuuaggcuuuca

SEQ ID NO: 2034672 - RNA, 18 nt, Homo sapiens
ucuggacagcuugacucu

SEQ ID NO: 2034673 - RNA, 22 nt, Homo sapiens
uguucaauggaugaauuucuaa

SEQ ID NO: 2034674 - RNA, 18 nt, Homo sapiens
ugagaccugaaggguuga

SEQ ID NO: 2034675 - RNA, 17 nt, Homo sapiens
aauuuuaguguuaauga

SEQ ID NO: 2034676 - RNA, 23 nt, Homo sapiens
cauuauuugagaagcugcucaac

SEQ ID NO: 2034677 - RNA, 18 nt, Homo sapiens
caacauugcuugugccac

SEQ ID NO: 2034678 - RNA, 14 nt, Homo sapiens
cagcugcaccugcc

SEQ ID NO: 2034679 - RNA, 12 nt, Homo sapiens
auuagaugacug

SEQ ID NO: 2034680 - RNA, 22 nt, Homo sapiens
gaugugggaaaaauaugugaau

SEQ ID NO: 2034681 - RNA, 20 nt, Homo sapiens
cuuaguuacuuuggaacacu

SEQ ID NO: 2034682 - RNA, 17 nt, Homo sapiens
guaggggcugcagggac

SEQ ID NO: 2034683 - RNA, 13 nt, Homo sapiens
guagucacuugcg

SEQ ID NO: 2034684 - RNA, 10 nt, Homo sapiens
caacacugcu

SEQ ID NO: 2034685 - RNA, 16 nt, Homo sapiens
caaguucacaccugca

SEQ ID NO: 2034686 - RNA, 12 nt, Homo sapiens
ccuuugcuaaug

SEQ ID NO: 2034687 - RNA, 15 nt, Homo sapiens
ucccuccacauuucc

SEQ ID NO: 2034688 - RNA, 15 nt, Homo sapiens
cuacgaaagcacagu

SEQ ID NO: 2034689 - RNA, 16 nt, Homo sapiens
aauccuguccucagcu

SEQ ID NO: 2034690 - RNA, 18 nt, Homo sapiens
auauguacuaguggcaug

SEQ ID NO: 2034691 - RNA, 22 nt, Homo sapiens
aauucuuguucauuuugcauuc

SEQ ID NO: 2034692 - RNA, 13 nt, Homo sapiens
cugccauguacua

SEQ ID NO: 2034693 - RNA, 13 nt, Homo sapiens
uauuuagaucuca

SEQ ID NO: 2034694 - RNA, 14 nt, Homo sapiens
guaucgauguuaug

SEQ ID NO: 2034695 - RNA, 13 nt, Homo sapiens
caccccucugcca

SEQ ID NO: 2034696 - RNA, 15 nt, Homo sapiens
uacaggagugagcac

SEQ ID NO: 2034697 - RNA, 13 nt, Homo sapiens
cccugcucaggag

SEQ ID NO: 2034698 - RNA, 20 nt, Homo sapiens
guauuacaaaaacauggccu

SEQ ID NO: 2034699 - RNA, 22 nt, Homo sapiens
ugauucuuaacacagccuuccu

SEQ ID NO: 2034700 - RNA, 13 nt, Homo sapiens
aagaaaagccagu

SEQ ID NO: 2034701 - RNA, 21 nt, Homo sapiens
ggcuccgagggcggccaggga

SEQ ID NO: 2034702 - RNA, 15 nt, Homo sapiens
ccagccccagcaccu

SEQ ID NO: 2034703 - RNA, 23 nt, Homo sapiens
caaccgguaaccaaagucacaaa

SEQ ID NO: 2034704 - RNA, 12 nt, Homo sapiens
aaaguauguaag

SEQ ID NO: 2034705 - RNA, 12 nt, Homo sapiens
uagauaugaaga

SEQ ID NO: 2034706 - RNA, 17 nt, Homo sapiens
auaagaccccacuggag

SEQ ID NO: 2034707 - RNA, 21 nt, Homo sapiens
aagcugugggacgaaagcaca

SEQ ID NO: 2034708 - RNA, 19 nt, Homo sapiens
ugcuggcucugagaaucac

SEQ ID NO: 2034709 - RNA, 18 nt, Homo sapiens
cuugaaccgucuguggag

SEQ ID NO: 2034710 - RNA, 20 nt, Homo sapiens
gaaauccacgcucaaucuca

SEQ ID NO: 2034711 - RNA, 21 nt, Homo sapiens
cuaucuauaccuuacugcaau

SEQ ID NO: 2034712 - RNA, 20 nt, Homo sapiens
uuuugaggccuuuuuugcca

SEQ ID NO: 2034713 - RNA, 12 nt, Homo sapiens
guacauaaucuu

SEQ ID NO: 2034714 - RNA, 15 nt, Homo sapiens
acaaagaaacaaaga

SEQ ID NO: 2034715 - RNA, 15 nt, Homo sapiens
ugcauaaaugcauaa

SEQ ID NO: 2034716 - RNA, 15 nt, Homo sapiens
cauacauacauacau

SEQ ID NO: 2034717 - RNA, 15 nt, Homo sapiens
ugacacaaugacaca

SEQ ID NO: 2034718 - RNA, 12 nt, Homo sapiens
aaggaccugaga

SEQ ID NO: 2034719 - RNA, 19 nt, Homo sapiens
guacagcagggucuugcug

SEQ ID NO: 2034720 - RNA, 15 nt, Homo sapiens
cgcguucccaaagau

SEQ ID NO: 2034721 - RNA, 16 nt, Homo sapiens
agagccccacucucag

SEQ ID NO: 2034722 - RNA, 15 nt, Homo sapiens
cgguguauccuggcc

SEQ ID NO: 2034723 - RNA, 22 nt, Homo sapiens
ccuuuacaugaauacgucuuga

SEQ ID NO: 2034724 - RNA, 19 nt, Homo sapiens
augaagacccaguguaaag

SEQ ID NO: 2034725 - RNA, 19 nt, Homo sapiens
ucagauaauuaauuuccaa

SEQ ID NO: 2034726 - RNA, 18 nt, Homo sapiens
aagcuuugguucugccau

SEQ ID NO: 2034727 - RNA, 16 nt, Homo sapiens
cccugccuucacugug

SEQ ID NO: 2034728 - RNA, 22 nt, Homo sapiens
cagcaguuucugacaauuaaca

SEQ ID NO: 2034729 - RNA, 23 nt, Homo sapiens
uuagacucaugguguguuacaca

SEQ ID NO: 2034730 - RNA, 21 nt, Homo sapiens
aaucccaguucauguugcuca

SEQ ID NO: 2034731 - RNA, 15 nt, Homo sapiens
gacugcacaggugac

SEQ ID NO: 2034732 - RNA, 22 nt, Homo sapiens
accucgccuguuggggaccuca

SEQ ID NO: 2034733 - RNA, 20 nt, Homo sapiens
agacacucagaccagagaag

SEQ ID NO: 2034734 - RNA, 14 nt, Homo sapiens
aagaacuagcauaa

SEQ ID NO: 2034735 - RNA, 17 nt, Homo sapiens
uccauuccugcucuccc

SEQ ID NO: 2034736 - RNA, 15 nt, Homo sapiens
cagauguagauauaa

SEQ ID NO: 2034737 - RNA, 18 nt, Homo sapiens
uugaagauaguaacugua

SEQ ID NO: 2034738 - RNA, 18 nt, Homo sapiens
cacaccugggggacagag

SEQ ID NO: 2034739 - RNA, 12 nt, Homo sapiens
aguacugugaau

SEQ ID NO: 2034740 - RNA, 16 nt, Homo sapiens
ugaaauuuauucacau

SEQ ID NO: 2034741 - RNA, 13 nt, Homo sapiens
acugccucuggaa

SEQ ID NO: 2034742 - RNA, 13 nt, Homo sapiens
gucaucggcacua

SEQ ID NO: 2034743 - RNA, 19 nt, Homo sapiens
cacuuuuuccccugcaaug

SEQ ID NO: 2034744 - RNA, 18 nt, Homo sapiens
uuuauaggccugugugua

SEQ ID NO: 2034745 - RNA, 23 nt, Homo sapiens
gaggaggcaauugggauggcgcu

SEQ ID NO: 2034746 - RNA, 23 nt, Homo sapiens
uccauaucccuuccucucaggcu

SEQ ID NO: 2034747 - RNA, 22 nt, Homo sapiens
ugcacuuauaagaaagaucaaa

SEQ ID NO: 2034748 - RNA, 15 nt, Homo sapiens
uccuucaaucuucau

SEQ ID NO: 2034749 - RNA, 12 nt, Homo sapiens
gugacccugaga

SEQ ID NO: 2034750 - RNA, 14 nt, Homo sapiens
aaacaucagcaaaa

SEQ ID NO: 2034751 - RNA, 12 nt, Homo sapiens
agcggcaaaauu

SEQ ID NO: 2034752 - RNA, 21 nt, Homo sapiens
cacacuggagaaaaggcagua

SEQ ID NO: 2034753 - RNA, 15 nt, Homo sapiens
cuacauucuaaugca

SEQ ID NO: 2034754 - RNA, 22 nt, Homo sapiens
gcuccacuuucagugaaagcau

SEQ ID NO: 2034755 - RNA, 20 nt, Homo sapiens
ugaaauauggaacuguaaua

SEQ ID NO: 2034756 - RNA, 22 nt, Homo sapiens
cauguguguucaugcacacuug

SEQ ID NO: 2034757 - RNA, 15 nt, Homo sapiens
auauuuucuguguaa

SEQ ID NO: 2034758 - RNA, 14 nt, Homo sapiens
ugugcacugcauua

SEQ ID NO: 2034759 - RNA, 11 nt, Homo sapiens
cuguugcccaa

SEQ ID NO: 2034760 - RNA, 17 nt, Homo sapiens
uuaauaaacaaaguaac

SEQ ID NO: 2034761 - RNA, 16 nt, Homo sapiens
acacaaagacuccuug

SEQ ID NO: 2034762 - RNA, 16 nt, Homo sapiens
uuuacagucuauuuga

SEQ ID NO: 2034763 - RNA, 11 nt, Homo sapiens
acuguggcaaa

SEQ ID NO: 2034764 - RNA, 18 nt, Homo sapiens
ucuacuaaggcuuuccua

SEQ ID NO: 2034765 - RNA, 15 nt, Homo sapiens
ucaaaacauuccaag

SEQ ID NO: 2034766 - RNA, 11 nt, Homo sapiens
auuucuuugca

SEQ ID NO: 2034767 - RNA, 12 nt, Homo sapiens
cagauugaacuu

SEQ ID NO: 2034768 - RNA, 17 nt, Homo sapiens
uuguuaacacgugacac

SEQ ID NO: 2034769 - RNA, 19 nt, Homo sapiens
ccagcuguguuucuuaacu

SEQ ID NO: 2034770 - RNA, 15 nt, Homo sapiens
ucuacuaaaaacaca

SEQ ID NO: 2034771 - RNA, 23 nt, Homo sapiens
ugagcagguguucuucauuaccu

SEQ ID NO: 2034772 - RNA, 21 nt, Homo sapiens
acugccggggguucaggguug

SEQ ID NO: 2034773 - RNA, 16 nt, Homo sapiens
gccuauagacacuuau

SEQ ID NO: 2034774 - RNA, 21 nt, Homo sapiens
acacagcccccacggacaaaa

SEQ ID NO: 2034775 - RNA, 13 nt, Homo sapiens
aauacucagggaa

SEQ ID NO: 2034776 - RNA, 16 nt, Homo sapiens
augcagcuacccaggc

SEQ ID NO: 2034777 - RNA, 16 nt, Homo sapiens
acuguaguucagauag

SEQ ID NO: 2034778 - RNA, 18 nt, Homo sapiens
guagcaucauugaucuuu

SEQ ID NO: 2034779 - RNA, 13 nt, Homo sapiens
ucaggaguuucau

SEQ ID NO: 2034780 - RNA, 23 nt, Homo sapiens
acaaugggcacugauuugauacc

SEQ ID NO: 2034781 - RNA, 22 nt, Homo sapiens
uuuucaagacuuuaaacauuua

SEQ ID NO: 2034782 - RNA, 20 nt, Homo sapiens
acauacauuguauaggccau

SEQ ID NO: 2034783 - RNA, 18 nt, Homo sapiens
ggaaaguaaauauuucag

SEQ ID NO: 2034784 - RNA, 18 nt, Homo sapiens
ucagauuagagagucuca

SEQ ID NO: 2034785 - RNA, 13 nt, Homo sapiens
cuuuccuguucca

SEQ ID NO: 2034786 - RNA, 15 nt, Homo sapiens
uauuuguauuugcca

SEQ ID NO: 2034787 - RNA, 17 nt, Homo sapiens
aaagauucuacaaagcu

SEQ ID NO: 2034788 - RNA, 13 nt, Homo sapiens
cagccccuguaga

SEQ ID NO: 2034789 - RNA, 24 nt, Homo sapiens
acugaugaccgucugagcccagcu

SEQ ID NO: 2034790 - RNA, 16 nt, Homo sapiens
ucggcagcuacucaga

SEQ ID NO: 2034791 - RNA, 14 nt, Homo sapiens
uguacauucuucca

SEQ ID NO: 2034792 - RNA, 13 nt, Homo sapiens
ggaaugacuuggg

SEQ ID NO: 2034793 - RNA, 16 nt, Homo sapiens
aaagaaacaaccugcc

SEQ ID NO: 2034794 - RNA, 20 nt, Homo sapiens
gguguaagccaguuccagca

SEQ ID NO: 2034795 - RNA, 21 nt, Homo sapiens
acaaguaccacucuuggucag

SEQ ID NO: 2034796 - RNA, 16 nt, Homo sapiens
guuacaguuugcacaa

SEQ ID NO: 2034797 - RNA, 16 nt, Homo sapiens
guacaauguacauuau

SEQ ID NO: 2034798 - RNA, 16 nt, Homo sapiens
gaagaauugucuugca

SEQ ID NO: 2034799 - RNA, 11 nt, Homo sapiens
aagcuccuagg

SEQ ID NO: 2034800 - RNA, 14 nt, Homo sapiens
ccugagauuuacac

SEQ ID NO: 2034801 - RNA, 19 nt, Homo sapiens
auaccacuuuucauugcaa

SEQ ID NO: 2034802 - RNA, 13 nt, Homo sapiens
uugaaagauuaca

SEQ ID NO: 2034803 - RNA, 16 nt, Homo sapiens
aacuguccucuuucag

SEQ ID NO: 2034804 - RNA, 22 nt, Homo sapiens
ccuggggagcccaguccacuga

SEQ ID NO: 2034805 - RNA, 14 nt, Homo sapiens
auaaaugaucuaga

SEQ ID NO: 2034806 - RNA, 20 nt, Homo sapiens
aaugccaaucuucaguauuu

SEQ ID NO: 2034807 - RNA, 22 nt, Homo sapiens
aaggacucaacauuacauuuga

SEQ ID NO: 2034808 - RNA, 15 nt, Homo sapiens
ucuuggggaagauac

SEQ ID NO: 2034809 - RNA, 23 nt, Homo sapiens
ucuuuaauuuauaucagguguau

SEQ ID NO: 2034810 - RNA, 17 nt, Homo sapiens
ucaggaagaaagggaaa

SEQ ID NO: 2034811 - RNA, 17 nt, Homo sapiens
ugcucccaacccauuca

SEQ ID NO: 2034812 - RNA, 18 nt, Homo sapiens
accagggcucagcuccuu

SEQ ID NO: 2034813 - RNA, 23 nt, Homo sapiens
ucuguaaaauuagaggauugcac

SEQ ID NO: 2034814 - RNA, 20 nt, Homo sapiens
cauaguaacugacaugauua

SEQ ID NO: 2034815 - RNA, 19 nt, Homo sapiens
agauauauuaagugacugu

SEQ ID NO: 2034816 - RNA, 16 nt, Homo sapiens
gcaaagcugugcacuu

SEQ ID NO: 2034817 - RNA, 15 nt, Homo sapiens
gaacugcaugcugcu

SEQ ID NO: 2034818 - RNA, 14 nt, Homo sapiens
ugagaaagcccugu

SEQ ID NO: 2034819 - RNA, 23 nt, Homo sapiens
aaacaacuuucuccuacucuucc

SEQ ID NO: 2034820 - RNA, 19 nt, Homo sapiens
cacugucuccuuucucuua

SEQ ID NO: 2034821 - RNA, 19 nt, Homo sapiens
cauuuugcaaaauuuccag

SEQ ID NO: 2034822 - RNA, 14 nt, Homo sapiens
gauauaagauuugu

SEQ ID NO: 2034823 - RNA, 14 nt, Homo sapiens
caacgacugccgug

SEQ ID NO: 2034824 - RNA, 13 nt, Homo sapiens
acagacaaauacu

SEQ ID NO: 2034825 - RNA, 18 nt, Homo sapiens
ucgaggugaaaggcucag

SEQ ID NO: 2034826 - RNA, 17 nt, Homo sapiens
gcuaauccaauuauuau

SEQ ID NO: 2034827 - RNA, 14 nt, Homo sapiens
cacccaugugccaa

SEQ ID NO: 2034828 - RNA, 23 nt, Homo sapiens
guuuaaaaaccaaauaagcaucu

SEQ ID NO: 2034829 - RNA, 23 nt, Homo sapiens
uggagggagaagcugucagggac

SEQ ID NO: 2034830 - RNA, 22 nt, Homo sapiens
cuauuuccuucuccuccugucu

SEQ ID NO: 2034831 - RNA, 14 nt, Homo sapiens
agcggcuuccccau

SEQ ID NO: 2034832 - RNA, 17 nt, Homo sapiens
aaggcacguuuggcauu

SEQ ID NO: 2034833 - RNA, 22 nt, Homo sapiens
ugaaccagugauccauguccug

SEQ ID NO: 2034834 - RNA, 18 nt, Homo sapiens
auaguucaguagaauuac

SEQ ID NO: 2034835 - RNA, 22 nt, Homo sapiens
uccucacucucgccaucuggca

SEQ ID NO: 2034836 - RNA, 14 nt, Homo sapiens
augcuuuucuaauc

SEQ ID NO: 2034837 - RNA, 19 nt, Homo sapiens
auucucuccuguaccucuu

SEQ ID NO: 2034838 - RNA, 16 nt, Homo sapiens
aaguuucuuaaggaaa

SEQ ID NO: 2034839 - RNA, 14 nt, Homo sapiens
gacgaggaggacag

SEQ ID NO: 2034840 - RNA, 21 nt, Homo sapiens
acugagguuuuuaacauguau

SEQ ID NO: 2034841 - RNA, 21 nt, Homo sapiens
ccuuggaggacccagcacuga

SEQ ID NO: 2034842 - RNA, 16 nt, Homo sapiens
cuagauccagcccaaa

SEQ ID NO: 2034843 - RNA, 15 nt, Homo sapiens
cucagugcugucuug

SEQ ID NO: 2034844 - RNA, 17 nt, Homo sapiens
gguccgaagucuuccau

SEQ ID NO: 2034845 - RNA, 19 nt, Homo sapiens
guugugaaaauuuaaucuu

SEQ ID NO: 2034846 - RNA, 12 nt, Homo sapiens
uauaaacagcuu

SEQ ID NO: 2034847 - RNA, 13 nt, Homo sapiens
caggugugcacca

SEQ ID NO: 2034848 - RNA, 20 nt, Homo sapiens
auuauagaguauacuaaaaa

SEQ ID NO: 2034849 - RNA, 13 nt, Homo sapiens
auaugaugccacu

SEQ ID NO: 2034850 - RNA, 21 nt, Homo sapiens
ggucagaguuccgacugccau

SEQ ID NO: 2034851 - RNA, 14 nt, Homo sapiens
uugguaugugacau

SEQ ID NO: 2034852 - RNA, 14 nt, Homo sapiens
aaaguuuaagcaau

SEQ ID NO: 2034853 - RNA, 23 nt, Homo sapiens
uuuggacccagggccugacuuga

SEQ ID NO: 2034854 - RNA, 19 nt, Homo sapiens
aacuccugacaucagguga

SEQ ID NO: 2034855 - RNA, 19 nt, Homo sapiens
cagcacucacgcaccggag

SEQ ID NO: 2034856 - RNA, 16 nt, Homo sapiens
auuauggaauacaaaa

SEQ ID NO: 2034857 - RNA, 16 nt, Homo sapiens
cuggcaccaacacuuu

SEQ ID NO: 2034858 - RNA, 16 nt, Homo sapiens
ugaucaagcaauaaua

SEQ ID NO: 2034859 - RNA, 16 nt, Homo sapiens
gguuuaggauuacuua

SEQ ID NO: 2034860 - RNA, 15 nt, Homo sapiens
cgagacaacagcaca

SEQ ID NO: 2034861 - RNA, 15 nt, Homo sapiens
aagcauucugugcau

SEQ ID NO: 2034862 - RNA, 22 nt, Homo sapiens
gaaacaggcgcggggucucagg

SEQ ID NO: 2034863 - RNA, 18 nt, Homo sapiens
ugggcaacagagcaagac

SEQ ID NO: 2034864 - RNA, 18 nt, Homo sapiens
ugggcgacagagcgagac

SEQ ID NO: 2034865 - RNA, 18 nt, Homo sapiens
agacaugguggcaugcac

SEQ ID NO: 2034866 - RNA, 17 nt, Homo sapiens
gugggaggggaagaaaa

SEQ ID NO: 2034867 - RNA, 19 nt, Homo sapiens
cagagguuuagcugcagga

SEQ ID NO: 2034868 - RNA, 17 nt, Homo sapiens
ggaaaguuucuuugaaa

SEQ ID NO: 2034869 - RNA, 23 nt, Homo sapiens
aaauacaucuccaguacauuccg

SEQ ID NO: 2034870 - RNA, 13 nt, Homo sapiens
ggguuacacuguu

SEQ ID NO: 2034871 - RNA, 13 nt, Homo sapiens
cuguaacagggua

SEQ ID NO: 2034872 - RNA, 14 nt, Homo sapiens
auuccuagaaacug

SEQ ID NO: 2034873 - RNA, 21 nt, Homo sapiens
uaagguauaguguguguugca

SEQ ID NO: 2034874 - RNA, 20 nt, Homo sapiens
acaucccaagaaaaucacau

SEQ ID NO: 2034875 - RNA, 12 nt, Homo sapiens
aaccaguuauuu

SEQ ID NO: 2034876 - RNA, 13 nt, Homo sapiens
uacugcauuuaca

SEQ ID NO: 2034877 - RNA, 20 nt, Homo sapiens
ucaucaugaagcguggagac

SEQ ID NO: 2034878 - RNA, 16 nt, Homo sapiens
aaaguggagaagcaca

SEQ ID NO: 2034879 - RNA, 13 nt, Homo sapiens
ugucaugugccuu

SEQ ID NO: 2034880 - RNA, 13 nt, Homo sapiens
cucacauucugag

SEQ ID NO: 2034881 - RNA, 18 nt, Homo sapiens
acaaacgggcucgggucu

SEQ ID NO: 2034882 - RNA, 14 nt, Homo sapiens
ucugauguggaaug

SEQ ID NO: 2034883 - RNA, 18 nt, Homo sapiens
gcagcccguguccaggag

SEQ ID NO: 2034884 - RNA, 15 nt, Homo sapiens
uucaaugaaccacaa

SEQ ID NO: 2034885 - RNA, 20 nt, Homo sapiens
uguugaccaggcuggaguga

SEQ ID NO: 2034886 - RNA, 15 nt, Homo sapiens
cuuccaccaaauacu

SEQ ID NO: 2034887 - RNA, 22 nt, Homo sapiens
gauggacucaggauccagugac

SEQ ID NO: 2034888 - RNA, 12 nt, Homo sapiens
ugcacuauagcc

SEQ ID NO: 2034889 - RNA, 16 nt, Homo sapiens
augaaaucagcaagag

SEQ ID NO: 2034890 - RNA, 20 nt, Homo sapiens
uaauaguacauaaucuuuau

SEQ ID NO: 2034891 - RNA, 14 nt, Homo sapiens
cuguagaggcaguu

SEQ ID NO: 2034892 - RNA, 17 nt, Homo sapiens
ccuuggcaccagacacc

SEQ ID NO: 2034893 - RNA, 20 nt, Homo sapiens
acagccacuccccuccacuc

SEQ ID NO: 2034894 - RNA, 21 nt, Homo sapiens
ucuucaggccugcuagucacu

SEQ ID NO: 2034895 - RNA, 11 nt, Homo sapiens
aaaaaugcacu

SEQ ID NO: 2034896 - RNA, 21 nt, Homo sapiens
auuuuaguaagagauuccuga

SEQ ID NO: 2034897 - RNA, 20 nt, Homo sapiens
uccuacuucucuuguaaaac

SEQ ID NO: 2034898 - RNA, 23 nt, Homo sapiens
auuuugacauacaggagagcugc

SEQ ID NO: 2034899 - RNA, 22 nt, Homo sapiens
uugugauugacuuuuuggcuca

SEQ ID NO: 2034900 - RNA, 14 nt, Homo sapiens
uuagacuacauuua

SEQ ID NO: 2034901 - RNA, 13 nt, Homo sapiens
gugagaacuucca

SEQ ID NO: 2034902 - RNA, 16 nt, Homo sapiens
uuuccucaucugcaaa

SEQ ID NO: 2034903 - RNA, 12 nt, Homo sapiens
ccuguacccagc

SEQ ID NO: 2034904 - RNA, 16 nt, Homo sapiens
agcugugcacuugcag

SEQ ID NO: 2034905 - RNA, 23 nt, Homo sapiens
uagaaaaccuaauuaaggaagua

SEQ ID NO: 2034906 - RNA, 15 nt, Homo sapiens
aacaugacacauuug

SEQ ID NO: 2034907 - RNA, 13 nt, Homo sapiens
gagacugaucccu

SEQ ID NO: 2034908 - RNA, 20 nt, Homo sapiens
ucuucacuguguguuuuaaa

SEQ ID NO: 2034909 - RNA, 17 nt, Homo sapiens
ugcacugacaagaugga

SEQ ID NO: 2034910 - RNA, 18 nt, Homo sapiens
aaaugcaguccagaauaa

SEQ ID NO: 2034911 - RNA, 17 nt, Homo sapiens
uguuguuucuagauuag

SEQ ID NO: 2034912 - RNA, 12 nt, Homo sapiens
ugcaacuaggaa

SEQ ID NO: 2034913 - RNA, 22 nt, Homo sapiens
gugaucccuagcugugaccucu

SEQ ID NO: 2034914 - RNA, 15 nt, Homo sapiens
aaagaccuucucccu

SEQ ID NO: 2034915 - RNA, 19 nt, Homo sapiens
caguguguuucugaucuga

SEQ ID NO: 2034916 - RNA, 23 nt, Homo sapiens
ccaggaaguaauuuucuucucau

SEQ ID NO: 2034917 - RNA, 19 nt, Homo sapiens
uuauagacagucguuccca

SEQ ID NO: 2034918 - RNA, 15 nt, Homo sapiens
uuccacuucuaugca

SEQ ID NO: 2034919 - RNA, 22 nt, Homo sapiens
accuggcccccucagcucuguc

SEQ ID NO: 2034920 - RNA, 19 nt, Homo sapiens
aguuagauaugugccaaag

SEQ ID NO: 2034921 - RNA, 16 nt, Homo sapiens
aaaacagaauuugaga

SEQ ID NO: 2034922 - RNA, 16 nt, Homo sapiens
auggcagaaugaaaau

SEQ ID NO: 2034923 - RNA, 21 nt, Homo sapiens
ggcaggggcccgcgaugugga

SEQ ID NO: 2034924 - RNA, 14 nt, Homo sapiens
acagugaacacuca

SEQ ID NO: 2034925 - RNA, 21 nt, Homo sapiens
agaugucagcuucccagccau

SEQ ID NO: 2034926 - RNA, 14 nt, Homo sapiens
cauuugcucuuuca

SEQ ID NO: 2034927 - RNA, 11 nt, Homo sapiens
uguccaaagag

SEQ ID NO: 2034928 - RNA, 11 nt, Homo sapiens
gggccaaauau

SEQ ID NO: 2034929 - RNA, 11 nt, Homo sapiens
uggccaaagau

SEQ ID NO: 2034930 - RNA, 23 nt, Homo sapiens
caaaaaaaguuuguuacuuugaa

SEQ ID NO: 2034931 - RNA, 18 nt, Homo sapiens
uuggggcuguucauggca

SEQ ID NO: 2034932 - RNA, 15 nt, Homo sapiens
gaacugugaauugug

SEQ ID NO: 2034933 - RNA, 15 nt, Homo sapiens
augaaugacaugacc

SEQ ID NO: 2034934 - RNA, 14 nt, Homo sapiens
gaaguagcugggau

SEQ ID NO: 2034935 - RNA, 12 nt, Homo sapiens
acaugagcagag

SEQ ID NO: 2034936 - RNA, 23 nt, Homo sapiens
ucauaaaacaugaaucaagcaau

SEQ ID NO: 2034937 - RNA, 16 nt, Homo sapiens
agauugaagccuuugc

SEQ ID NO: 2034938 - RNA, 22 nt, Homo sapiens
uuaaaauuuucauucugaaucu

SEQ ID NO: 2034939 - RNA, 18 nt, Homo sapiens
aacuuuuagguuguuacc

SEQ ID NO: 2034940 - RNA, 15 nt, Homo sapiens
acaugcuuauuccau

SEQ ID NO: 2034941 - RNA, 14 nt, Homo sapiens
cuaaaugagcuaaa

SEQ ID NO: 2034942 - RNA, 15 nt, Homo sapiens
uaacaguaucucaaa

SEQ ID NO: 2034943 - RNA, 20 nt, Homo sapiens
uagaugugucuuaccagauc

SEQ ID NO: 2034944 - RNA, 16 nt, Homo sapiens
ccugaccaucgcacac

SEQ ID NO: 2034945 - RNA, 13 nt, Homo sapiens
cuguaagcauucu

SEQ ID NO: 2034946 - RNA, 14 nt, Homo sapiens
agucaucauucccu

SEQ ID NO: 2034947 - RNA, 17 nt, Homo sapiens
gaugccuguguacugcc

SEQ ID NO: 2034948 - RNA, 16 nt, Homo sapiens
aacgucccuagcccuu

SEQ ID NO: 2034949 - RNA, 22 nt, Homo sapiens
uagcuaaaaccuuccaugucaa

SEQ ID NO: 2034950 - RNA, 13 nt, Homo sapiens
ucuauuuguauug

SEQ ID NO: 2034951 - RNA, 13 nt, Homo sapiens
cauauuugccuug

SEQ ID NO: 2034952 - RNA, 13 nt, Homo sapiens
acuaucacugguu

SEQ ID NO: 2034953 - RNA, 18 nt, Homo sapiens
aaugaaguauuacaugau

SEQ ID NO: 2034954 - RNA, 11 nt, Homo sapiens
uucugcaaugu

SEQ ID NO: 2034955 - RNA, 12 nt, Homo sapiens
gcaugucauuug

SEQ ID NO: 2034956 - RNA, 19 nt, Homo sapiens
acaugucuccuauccuggu

SEQ ID NO: 2034957 - RNA, 17 nt, Homo sapiens
cuguaugaauagcugug

SEQ ID NO: 2034958 - RNA, 20 nt, Homo sapiens
acagcaguggagaguguucc

SEQ ID NO: 2034959 - RNA, 14 nt, Homo sapiens
aagcuguccuccca

SEQ ID NO: 2034960 - RNA, 15 nt, Homo sapiens
agacauuucugcaca

SEQ ID NO: 2034961 - RNA, 20 nt, Homo sapiens
cuucaagucaacaugcauau

SEQ ID NO: 2034962 - RNA, 19 nt, Homo sapiens
ugggcaaagggaaguaaca

SEQ ID NO: 2034963 - RNA, 23 nt, Homo sapiens
aaacgggcgccaagacucagggg

SEQ ID NO: 2034964 - RNA, 14 nt, Homo sapiens
agauagugccaggu

SEQ ID NO: 2034965 - RNA, 13 nt, Homo sapiens
ucaaaaaccugcc

SEQ ID NO: 2034966 - RNA, 11 nt, Homo sapiens
aacugcagugu

SEQ ID NO: 2034967 - RNA, 23 nt, Homo sapiens
caauaaauuggaacaccuccuca

SEQ ID NO: 2034968 - RNA, 14 nt, Homo sapiens
agaugagcaaugcu

SEQ ID NO: 2034969 - RNA, 17 nt, Homo sapiens
ucagagaaauacuuuca

SEQ ID NO: 2034970 - RNA, 15 nt, Homo sapiens
auauagaaacucuca

SEQ ID NO: 2034971 - RNA, 15 nt, Homo sapiens
ugaagcuuccuuggc

SEQ ID NO: 2034972 - RNA, 20 nt, Homo sapiens
aggcugagauaggaucacuu

SEQ ID NO: 2034973 - RNA, 15 nt, Homo sapiens
auucucagcacuuug

SEQ ID NO: 2034974 - RNA, 20 nt, Homo sapiens
ccaacuugccacauguucua

SEQ ID NO: 2034975 - RNA, 21 nt, Homo sapiens
uuucuauuauggaaaacugug

SEQ ID NO: 2034976 - RNA, 21 nt, Homo sapiens
acccuuggaaagaaauguaga

SEQ ID NO: 2034977 - RNA, 22 nt, Homo sapiens
uuccagguccaaacccuucaac

SEQ ID NO: 2034978 - RNA, 21 nt, Homo sapiens
gugacuggcagcauugacucu

SEQ ID NO: 2034979 - RNA, 17 nt, Homo sapiens
agcaaauaaagaccuga

SEQ ID NO: 2034980 - RNA, 16 nt, Homo sapiens
ccuuccacagucauuu

SEQ ID NO: 2034981 - RNA, 14 nt, Homo sapiens
aaagauuguuggca

SEQ ID NO: 2034982 - RNA, 20 nt, Homo sapiens
acauuuuuuuuuucaauaaa

SEQ ID NO: 2034983 - RNA, 15 nt, Homo sapiens
auuuauuuuguauga

SEQ ID NO: 2034984 - RNA, 18 nt, Homo sapiens
uuuagcagaggagccaug

SEQ ID NO: 2034985 - RNA, 18 nt, Homo sapiens
aaaugcauccauuccuca

SEQ ID NO: 2034986 - RNA, 21 nt, Homo sapiens
ucuguccagaggcugcaagga

SEQ ID NO: 2034987 - RNA, 15 nt, Homo sapiens
aauaaauauuuaguc

SEQ ID NO: 2034988 - RNA, 15 nt, Homo sapiens
aaaaugaguuaccua

SEQ ID NO: 2034989 - RNA, 14 nt, Homo sapiens
ccacuggacuugag

SEQ ID NO: 2034990 - RNA, 23 nt, Homo sapiens
uguuuauguacuguaaacaguuc

SEQ ID NO: 2034991 - RNA, 19 nt, Homo sapiens
uccccgaguuuccccagac

SEQ ID NO: 2034992 - RNA, 16 nt, Homo sapiens
uacacugccuguauac

SEQ ID NO: 2034993 - RNA, 21 nt, Homo sapiens
ugaggggaggaucuuacugaa

SEQ ID NO: 2034994 - RNA, 10 nt, Homo sapiens
acacacaucc

SEQ ID NO: 2034995 - RNA, 17 nt, Homo sapiens
caguagaggguccaguc

SEQ ID NO: 2034996 - RNA, 13 nt, Homo sapiens
cuaaguacuuaaa

SEQ ID NO: 2034997 - RNA, 13 nt, Homo sapiens
ccuuguacucuua

SEQ ID NO: 2034998 - RNA, 23 nt, Homo sapiens
ggcccccaaugacacccaugcca

SEQ ID NO: 2034999 - RNA, 16 nt, Homo sapiens
cuggcacagccugcac

SEQ ID NO: 2035000 - RNA, 13 nt, Homo sapiens
auaaaauuuugca

SEQ ID NO: 2035001 - RNA, 21 nt, Homo sapiens
acauaucuguguauuaucuca

SEQ ID NO: 2035002 - RNA, 19 nt, Homo sapiens
agcauuucuugauguugcu

SEQ ID NO: 2035003 - RNA, 18 nt, Homo sapiens
cagucagaguugugcaca

SEQ ID NO: 2035004 - RNA, 21 nt, Homo sapiens
gcuuuucuuugcuagcacaau

SEQ ID NO: 2035005 - RNA, 23 nt, Homo sapiens
guuuagcacggguuaagaucuga

SEQ ID NO: 2035006 - RNA, 21 nt, Homo sapiens
guguugccccuauuagcucuu

SEQ ID NO: 2035007 - RNA, 22 nt, Homo sapiens
uaacuuccaguaucauuuucca

SEQ ID NO: 2035008 - RNA, 19 nt, Homo sapiens
accugcgccuggcucuguc

SEQ ID NO: 2035009 - RNA, 19 nt, Homo sapiens
ccaccauucacauuugaug

SEQ ID NO: 2035010 - RNA, 23 nt, Homo sapiens
cagaagagguugggcuuccaugc

SEQ ID NO: 2035011 - RNA, 16 nt, Homo sapiens
auucaugcaacuugau

SEQ ID NO: 2035012 - RNA, 21 nt, Homo sapiens
augaaaggcaaugacaaguuu

SEQ ID NO: 2035013 - RNA, 13 nt, Homo sapiens
cccugagcaaugu

SEQ ID NO: 2035014 - RNA, 20 nt, Homo sapiens
cauuuggacaaucugcaaaa

SEQ ID NO: 2035015 - RNA, 17 nt, Homo sapiens
agcucagucccaucaga

SEQ ID NO: 2035016 - RNA, 13 nt, Homo sapiens
agaugccagugaa

SEQ ID NO: 2035017 - RNA, 13 nt, Homo sapiens
ccccacaacuuua

SEQ ID NO: 2035018 - RNA, 13 nt, Homo sapiens
gcuccucacuucc

SEQ ID NO: 2035019 - RNA, 14 nt, Homo sapiens
cuguagccuaaacu

SEQ ID NO: 2035020 - RNA, 18 nt, Homo sapiens
gaagaauuauaacccaga

SEQ ID NO: 2035021 - RNA, 15 nt, Homo sapiens
augugggucuaccaa

SEQ ID NO: 2035022 - RNA, 18 nt, Homo sapiens
gucuaauuuauuaaucua

SEQ ID NO: 2035023 - RNA, 19 nt, Homo sapiens
uucuucucaagcacugaca

SEQ ID NO: 2035024 - RNA, 17 nt, Homo sapiens
gacugacccccaucuga

SEQ ID NO: 2035025 - RNA, 15 nt, Homo sapiens
gcuuugcacuugacc

SEQ ID NO: 2035026 - RNA, 17 nt, Homo sapiens
cuguauggaaaugcacc

SEQ ID NO: 2035027 - RNA, 16 nt, Homo sapiens
ugugagugugugcaca

SEQ ID NO: 2035028 - RNA, 15 nt, Homo sapiens
uaagaaguaagcaac

SEQ ID NO: 2035029 - RNA, 17 nt, Homo sapiens
acaguaaaaggacagag

SEQ ID NO: 2035030 - RNA, 18 nt, Homo sapiens
caggaauauuaaagggau

SEQ ID NO: 2035031 - RNA, 12 nt, Homo sapiens
uaaagagccagu

SEQ ID NO: 2035032 - RNA, 13 nt, Homo sapiens
gaccauucucacc

SEQ ID NO: 2035033 - RNA, 19 nt, Homo sapiens
aagcugcagcuugggagag

SEQ ID NO: 2035034 - RNA, 22 nt, Homo sapiens
gaaaacaauucaagcugagaaa

SEQ ID NO: 2035035 - RNA, 12 nt, Homo sapiens
uagagauugcau

SEQ ID NO: 2035036 - RNA, 15 nt, Homo sapiens
gaucaaauacuuuaa

SEQ ID NO: 2035037 - RNA, 23 nt, Homo sapiens
ucagaguuugaagguaacugaga

SEQ ID NO: 2035038 - RNA, 16 nt, Homo sapiens
aggugauggguauuag

SEQ ID NO: 2035039 - RNA, 22 nt, Homo sapiens
gaagguuuuuuugucgauuagu

SEQ ID NO: 2035040 - RNA, 22 nt, Homo sapiens
cauccaucccuuaggugagcuu

SEQ ID NO: 2035041 - RNA, 19 nt, Homo sapiens
ugggagacccugaacucag

SEQ ID NO: 2035042 - RNA, 16 nt, Homo sapiens
guuggaagaagugugu

SEQ ID NO: 2035043 - RNA, 13 nt, Homo sapiens
ucauguucauuca

SEQ ID NO: 2035044 - RNA, 14 nt, Homo sapiens
aagcaaaaccugag

SEQ ID NO: 2035045 - RNA, 23 nt, Homo sapiens
cuaucucagccauaggugcaguu

SEQ ID NO: 2035046 - RNA, 14 nt, Homo sapiens
accccaucccuauc

SEQ ID NO: 2035047 - RNA, 19 nt, Homo sapiens
ugauauuuucacacuggua

SEQ ID NO: 2035048 - RNA, 13 nt, Homo sapiens
uccagcagcuuuc

SEQ ID NO: 2035049 - RNA, 21 nt, Homo sapiens
aauccuucccugcucuugcag

SEQ ID NO: 2035050 - RNA, 19 nt, Homo sapiens
ucagccacagggagccaca

SEQ ID NO: 2035051 - RNA, 20 nt, Homo sapiens
cugccuucuggauucuuggc

SEQ ID NO: 2035052 - RNA, 16 nt, Homo sapiens
cauucacucuuccugc

SEQ ID NO: 2035053 - RNA, 16 nt, Homo sapiens
caccugcucacugguc

SEQ ID NO: 2035054 - RNA, 17 nt, Homo sapiens
cacaucaauaaauacuu

SEQ ID NO: 2035055 - RNA, 13 nt, Homo sapiens
ggcccagugacaa

SEQ ID NO: 2035056 - RNA, 18 nt, Homo sapiens
ucuuguuuuaagugccuu

SEQ ID NO: 2035057 - RNA, 17 nt, Homo sapiens
aauauauaaaaaagcca

SEQ ID NO: 2035058 - RNA, 23 nt, Homo sapiens
cucaccagcgcuugaagccugaa

SEQ ID NO: 2035059 - RNA, 20 nt, Homo sapiens
auucugugccuccaggacca

SEQ ID NO: 2035060 - RNA, 21 nt, Homo sapiens
uauuacaacacuuuaaguaaa

SEQ ID NO: 2035061 - RNA, 14 nt, Homo sapiens
cuucucucagcucc

SEQ ID NO: 2035062 - RNA, 14 nt, Homo sapiens
ucaggaccaucaga

SEQ ID NO: 2035063 - RNA, 18 nt, Homo sapiens
ccaacagccaagacccaa

SEQ ID NO: 2035064 - RNA, 17 nt, Homo sapiens
cagaacaagaagcuuau

SEQ ID NO: 2035065 - RNA, 16 nt, Homo sapiens
caguaccuagcuguaa

SEQ ID NO: 2035066 - RNA, 23 nt, Homo sapiens
ugcaggcuccauggaacuuuuaa

SEQ ID NO: 2035067 - RNA, 17 nt, Homo sapiens
cacucccgccucagggc

SEQ ID NO: 2035068 - RNA, 20 nt, Homo sapiens
ccaacuuugaagucugauuu

SEQ ID NO: 2035069 - RNA, 19 nt, Homo sapiens
aguauugucaccaggauua

SEQ ID NO: 2035070 - RNA, 13 nt, Homo sapiens
aguuguacaugau

SEQ ID NO: 2035071 - RNA, 12 nt, Homo sapiens
gagaguaucuga

SEQ ID NO: 2035072 - RNA, 18 nt, Homo sapiens
agcuagaauucacuccac

SEQ ID NO: 2035073 - RNA, 19 nt, Homo sapiens
caauagauugggcacugug

SEQ ID NO: 2035074 - RNA, 17 nt, Homo sapiens
uucuuuuucacacugau

SEQ ID NO: 2035075 - RNA, 20 nt, Homo sapiens
uguacagcaagauguuucuu

SEQ ID NO: 2035076 - RNA, 15 nt, Homo sapiens
gccauugauccagcu

SEQ ID NO: 2035077 - RNA, 16 nt, Homo sapiens
agaacccuagcacaaa

SEQ ID NO: 2035078 - RNA, 17 nt, Homo sapiens
cagucuuccauuugcaa

SEQ ID NO: 2035079 - RNA, 14 nt, Homo sapiens
cccacacacaggug

SEQ ID NO: 2035080 - RNA, 18 nt, Homo sapiens
agacuggauucgugacaa

SEQ ID NO: 2035081 - RNA, 19 nt, Homo sapiens
aagcagcuuuuuauucccu

SEQ ID NO: 2035082 - RNA, 18 nt, Homo sapiens
ccgacaggcuggcucuca

SEQ ID NO: 2035083 - RNA, 19 nt, Homo sapiens
ucaauagcaccccuacuca

SEQ ID NO: 2035084 - RNA, 18 nt, Homo sapiens
gucccuguuguaacugcc

SEQ ID NO: 2035085 - RNA, 14 nt, Homo sapiens
aacaaacauuguuu

SEQ ID NO: 2035086 - RNA, 21 nt, Homo sapiens
gucaugcauaaauaugcagug

SEQ ID NO: 2035087 - RNA, 14 nt, Homo sapiens
caguagaugugcuu

SEQ ID NO: 2035088 - RNA, 14 nt, Homo sapiens
gacagaagcagcuc

SEQ ID NO: 2035089 - RNA, 19 nt, Homo sapiens
gagacugcuugacaaagga

SEQ ID NO: 2035090 - RNA, 15 nt, Homo sapiens
aauccugcugccaga

SEQ ID NO: 2035091 - RNA, 20 nt, Homo sapiens
uuucaucuauuauacuuuau

SEQ ID NO: 2035092 - RNA, 15 nt, Homo sapiens
auuaguaaaagugcu

SEQ ID NO: 2035093 - RNA, 16 nt, Homo sapiens
caaaacaaucucucaa

SEQ ID NO: 2035094 - RNA, 17 nt, Homo sapiens
ucgggcagggccccuga

SEQ ID NO: 2035095 - RNA, 15 nt, Homo sapiens
agugacaugcggcug

SEQ ID NO: 2035096 - RNA, 23 nt, Homo sapiens
gaggauguguggcauuuucacuu

SEQ ID NO: 2035097 - RNA, 13 nt, Homo sapiens
cugccaaggugaa

SEQ ID NO: 2035098 - RNA, 22 nt, Homo sapiens
uucuggcaguuuugacaucagc

SEQ ID NO: 2035099 - RNA, 22 nt, Homo sapiens
uucucuuuuuuaaaaacaaaca

SEQ ID NO: 2035100 - RNA, 15 nt, Homo sapiens
auacauagugaaaau

SEQ ID NO: 2035101 - RNA, 15 nt, Homo sapiens
uguauuaacuuguag

SEQ ID NO: 2035102 - RNA, 15 nt, Homo sapiens
cugagaaauggggug

SEQ ID NO: 2035103 - RNA, 21 nt, Homo sapiens
ugaccuacagggaacugggaa

SEQ ID NO: 2035104 - RNA, 21 nt, Homo sapiens
acaguaggucccggccagcuc

SEQ ID NO: 2035105 - RNA, 15 nt, Homo sapiens
uuucucaaaaaccac

SEQ ID NO: 2035106 - RNA, 21 nt, Homo sapiens
agaguugaaguuuacagagau

SEQ ID NO: 2035107 - RNA, 14 nt, Homo sapiens
augccaaauucuua

SEQ ID NO: 2035108 - RNA, 17 nt, Homo sapiens
agacgaaauagugacau

SEQ ID NO: 2035109 - RNA, 15 nt, Homo sapiens
aauguaaagugcaau

SEQ ID NO: 2035110 - RNA, 15 nt, Homo sapiens
uucuuucaaagaagc

SEQ ID NO: 2035111 - RNA, 23 nt, Homo sapiens
agcuccuuccuagccuugcacuu

SEQ ID NO: 2035112 - RNA, 12 nt, Homo sapiens
guaaaaccaaag

SEQ ID NO: 2035113 - RNA, 14 nt, Homo sapiens
caccuuauguauua

SEQ ID NO: 2035114 - RNA, 20 nt, Homo sapiens
ucaucauuggcuccauugcu

SEQ ID NO: 2035115 - RNA, 15 nt, Homo sapiens
caaguagcacccugg

SEQ ID NO: 2035116 - RNA, 22 nt, Homo sapiens
uauuaugugcaacauuaugauu

SEQ ID NO: 2035117 - RNA, 15 nt, Homo sapiens
aacugucugacuuau

SEQ ID NO: 2035118 - RNA, 18 nt, Homo sapiens
cucagcacuuucccaugu

SEQ ID NO: 2035119 - RNA, 15 nt, Homo sapiens
uaucccagaccccuc

SEQ ID NO: 2035120 - RNA, 15 nt, Homo sapiens
uguuaugaacaucca

SEQ ID NO: 2035121 - RNA, 21 nt, Homo sapiens
uuuaagagaagaugugauuua

SEQ ID NO: 2035122 - RNA, 22 nt, Homo sapiens
ugaggacauggagagagacuca

SEQ ID NO: 2035123 - RNA, 14 nt, Homo sapiens
agaacagagugcaa

SEQ ID NO: 2035124 - RNA, 19 nt, Homo sapiens
agauuauuuacugacauau

SEQ ID NO: 2035125 - RNA, 12 nt, Homo sapiens
uguugcacugaa

SEQ ID NO: 2035126 - RNA, 15 nt, Homo sapiens
cccuuugccaacaga

SEQ ID NO: 2035127 - RNA, 22 nt, Homo sapiens
auuuugguuucuuccuuuccuc

SEQ ID NO: 2035128 - RNA, 13 nt, Homo sapiens
ccccuuuuuggca

SEQ ID NO: 2035129 - RNA, 16 nt, Homo sapiens
gauguaugaauacagc

SEQ ID NO: 2035130 - RNA, 19 nt, Homo sapiens
gccagcuuaucucaggggu

SEQ ID NO: 2035131 - RNA, 21 nt, Homo sapiens
ggguuuguuuuucaaagccug

SEQ ID NO: 2035132 - RNA, 20 nt, Homo sapiens
guggcuuucauuucuuauua

SEQ ID NO: 2035133 - RNA, 19 nt, Homo sapiens
gaaagaaauuaaguacuua

SEQ ID NO: 2035134 - RNA, 18 nt, Homo sapiens
caguggccuggaugcaca

SEQ ID NO: 2035135 - RNA, 18 nt, Homo sapiens
uggguuuucuaacuguaa

SEQ ID NO: 2035136 - RNA, 15 nt, Homo sapiens
cuggaaaagcacuuu

SEQ ID NO: 2035137 - RNA, 17 nt, Homo sapiens
gugugagugugugcaag

SEQ ID NO: 2035138 - RNA, 17 nt, Homo sapiens
cggaaggagacuguggu

SEQ ID NO: 2035139 - RNA, 15 nt, Homo sapiens
ucagggcacauguga

SEQ ID NO: 2035140 - RNA, 14 nt, Homo sapiens
guaaucauccccau

SEQ ID NO: 2035141 - RNA, 16 nt, Homo sapiens
caagagcccagaucac

SEQ ID NO: 2035142 - RNA, 21 nt, Homo sapiens
ccuuuucuccuacaaagggaa

SEQ ID NO: 2035143 - RNA, 22 nt, Homo sapiens
uaggcaaaaccuugugacucag

SEQ ID NO: 2035144 - RNA, 18 nt, Homo sapiens
aguggacgugguaugaaa

SEQ ID NO: 2035145 - RNA, 18 nt, Homo sapiens
agguauuuacacauacaa

SEQ ID NO: 2035146 - RNA, 19 nt, Homo sapiens
ccauucaaaugacgccuga

SEQ ID NO: 2035147 - RNA, 22 nt, Homo sapiens
agaaaugugauuugucuucccu

SEQ ID NO: 2035148 - RNA, 19 nt, Homo sapiens
ugcugcaaaggagaagcac

SEQ ID NO: 2035149 - RNA, 23 nt, Homo sapiens
ccacagcagccacuuugcuacca

SEQ ID NO: 2035150 - RNA, 23 nt, Homo sapiens
cugagaaauaaaaagccugucau

SEQ ID NO: 2035151 - RNA, 20 nt, Homo sapiens
ggcagcaggaugcucaguga

SEQ ID NO: 2035152 - RNA, 13 nt, Homo sapiens
aagugauccuccu

SEQ ID NO: 2035153 - RNA, 15 nt, Homo sapiens
aacacacacauauac

SEQ ID NO: 2035154 - RNA, 15 nt, Homo sapiens
cacauuaauuaauua

SEQ ID NO: 2035155 - RNA, 15 nt, Homo sapiens
cacgcagauuagcag

SEQ ID NO: 2035156 - RNA, 19 nt, Homo sapiens
auacugguuauccugugcu

SEQ ID NO: 2035157 - RNA, 16 nt, Homo sapiens
cauuucuguaaauacc

SEQ ID NO: 2035158 - RNA, 22 nt, Homo sapiens
gaagcuguguccuugcaccugc

SEQ ID NO: 2035159 - RNA, 18 nt, Homo sapiens
cauagcgaagaccaguau

SEQ ID NO: 2035160 - RNA, 22 nt, Homo sapiens
uuccauacgugcccauuucaca

SEQ ID NO: 2035161 - RNA, 13 nt, Homo sapiens
uuuugaagucuug

SEQ ID NO: 2035162 - RNA, 20 nt, Homo sapiens
ccugcugaagcugcugcagc

SEQ ID NO: 2035163 - RNA, 17 nt, Homo sapiens
ugagaccagccugggca

SEQ ID NO: 2035164 - RNA, 16 nt, Homo sapiens
ccaggcuggggccagg

SEQ ID NO: 2035165 - RNA, 18 nt, Homo sapiens
gccccaauucaauccugc

SEQ ID NO: 2035166 - RNA, 17 nt, Homo sapiens
auuuuucuuacuggaaa

SEQ ID NO: 2035167 - RNA, 15 nt, Homo sapiens
uucuguuauugcacu

SEQ ID NO: 2035168 - RNA, 20 nt, Homo sapiens
uauguguggaugaugcugcc

SEQ ID NO: 2035169 - RNA, 21 nt, Homo sapiens
ccagauuggcaccccuuucua

SEQ ID NO: 2035170 - RNA, 17 nt, Homo sapiens
agccggacacuucucag

SEQ ID NO: 2035171 - RNA, 18 nt, Homo sapiens
gaguacagaaaaguugua

SEQ ID NO: 2035172 - RNA, 19 nt, Homo sapiens
agcaguauguuuguuucau

SEQ ID NO: 2035173 - RNA, 21 nt, Homo sapiens
acaaauuuuucaaaucauucc

SEQ ID NO: 2035174 - RNA, 20 nt, Homo sapiens
uaccuggauguucuuuuuac

SEQ ID NO: 2035175 - RNA, 10 nt, Homo sapiens
ucuucacuuu

SEQ ID NO: 2035176 - RNA, 22 nt, Homo sapiens
aaagugggcaaaagcuuacaaa

SEQ ID NO: 2035177 - RNA, 18 nt, Homo sapiens
ucuccaaggagcauguca

SEQ ID NO: 2035178 - RNA, 18 nt, Homo sapiens
ccugugcugugagugugu

SEQ ID NO: 2035179 - RNA, 23 nt, Homo sapiens
gucagagagaaacgguccuuugu

SEQ ID NO: 2035180 - RNA, 18 nt, Homo sapiens
accuuauaguuacugugu

SEQ ID NO: 2035181 - RNA, 15 nt, Homo sapiens
caguauuccaucagg

SEQ ID NO: 2035182 - RNA, 22 nt, Homo sapiens
gcuuccggcugagcugugccag

SEQ ID NO: 2035183 - RNA, 18 nt, Homo sapiens
aagucacaguuaucucca

SEQ ID NO: 2035184 - RNA, 18 nt, Homo sapiens
uuaaguuaauaaguugau

SEQ ID NO: 2035185 - RNA, 20 nt, Homo sapiens
gauagcuugauaucuucugu

SEQ ID NO: 2035186 - RNA, 19 nt, Homo sapiens
accugcuuuacuuugccca

SEQ ID NO: 2035187 - RNA, 16 nt, Homo sapiens
uuuacaaaagauguau

SEQ ID NO: 2035188 - RNA, 23 nt, Homo sapiens
cauuucuuuucucuuuaaucucc

SEQ ID NO: 2035189 - RNA, 11 nt, Homo sapiens
ggcccugucac

SEQ ID NO: 2035190 - RNA, 17 nt, Homo sapiens
uauccaaagcauugcag

SEQ ID NO: 2035191 - RNA, 21 nt, Homo sapiens
uggguucauccuauucuuucg

SEQ ID NO: 2035192 - RNA, 20 nt, Homo sapiens
cugcagucccacacugugca

SEQ ID NO: 2035193 - RNA, 22 nt, Homo sapiens
ccuucucagccuugguuccuga

SEQ ID NO: 2035194 - RNA, 17 nt, Homo sapiens
ccugcuagaaaugggaa

SEQ ID NO: 2035195 - RNA, 14 nt, Homo sapiens
uaacacuguacugc

SEQ ID NO: 2035196 - RNA, 19 nt, Homo sapiens
aacuaagagaaacugugua

SEQ ID NO: 2035197 - RNA, 14 nt, Homo sapiens
aaagcccagggucu

SEQ ID NO: 2035198 - RNA, 18 nt, Homo sapiens
cucucaguuauucagauu

SEQ ID NO: 2035199 - RNA, 15 nt, Homo sapiens
acaguaugucccaua

SEQ ID NO: 2035200 - RNA, 21 nt, Homo sapiens
aggugaggauugauuaccuag

SEQ ID NO: 2035201 - RNA, 18 nt, Homo sapiens
agaagagugccacauuua

SEQ ID NO: 2035202 - RNA, 22 nt, Homo sapiens
gagcuguccccguguugcauga

SEQ ID NO: 2035203 - RNA, 21 nt, Homo sapiens
uaaaaaaacuguuaccagaua

SEQ ID NO: 2035204 - RNA, 18 nt, Homo sapiens
uuucaaauuaagugugca

SEQ ID NO: 2035205 - RNA, 21 nt, Homo sapiens
aauaaacuagucuguuggcaa

SEQ ID NO: 2035206 - RNA, 13 nt, Homo sapiens
cuaugcugaagag

SEQ ID NO: 2035207 - RNA, 15 nt, Homo sapiens
ugcuccagcacucaa

SEQ ID NO: 2035208 - RNA, 16 nt, Homo sapiens
acuucuuccucgacau

SEQ ID NO: 2035209 - RNA, 17 nt, Homo sapiens
ugguacuuguaccuccg

SEQ ID NO: 2035210 - RNA, 14 nt, Homo sapiens
gccugucuucagag

SEQ ID NO: 2035211 - RNA, 16 nt, Homo sapiens
ucacugccucauggca

SEQ ID NO: 2035212 - RNA, 22 nt, Homo sapiens
auaccuuguuuuuaaucuccug

SEQ ID NO: 2035213 - RNA, 16 nt, Homo sapiens
aucacgccacuggacu

SEQ ID NO: 2035214 - RNA, 16 nt, Homo sapiens
cugcaugcugaaacaa

SEQ ID NO: 2035215 - RNA, 20 nt, Homo sapiens
uuggaggcucucuugugcau

SEQ ID NO: 2035216 - RNA, 19 nt, Homo sapiens
acccccguguccaccguga

SEQ ID NO: 2035217 - RNA, 15 nt, Homo sapiens
accauacaauuucau

SEQ ID NO: 2035218 - RNA, 22 nt, Homo sapiens
ugugcccugcacguauacaccc

SEQ ID NO: 2035219 - RNA, 14 nt, Homo sapiens
aacugccacagaua

SEQ ID NO: 2035220 - RNA, 16 nt, Homo sapiens
guucucacagugggag

SEQ ID NO: 2035221 - RNA, 18 nt, Homo sapiens
ccaugauaucacuucuuc

SEQ ID NO: 2035222 - RNA, 20 nt, Homo sapiens
gagccuggggauuccagcug

SEQ ID NO: 2035223 - RNA, 16 nt, Homo sapiens
uaacuuuauugcauau

SEQ ID NO: 2035224 - RNA, 22 nt, Homo sapiens
gcuucuccugugugauugacag

SEQ ID NO: 2035225 - RNA, 16 nt, Homo sapiens
ugaguguauguauaca

SEQ ID NO: 2035226 - RNA, 19 nt, Homo sapiens
ugaccugauuuccauuugc

SEQ ID NO: 2035227 - RNA, 16 nt, Homo sapiens
ucacuacucagugcau

SEQ ID NO: 2035228 - RNA, 17 nt, Homo sapiens
acaugcccaucccagug

SEQ ID NO: 2035229 - RNA, 15 nt, Homo sapiens
uacauaaaacaaaag

SEQ ID NO: 2035230 - RNA, 13 nt, Homo sapiens
ugaagugugcugu

SEQ ID NO: 2035231 - RNA, 17 nt, Homo sapiens
cuuaucaccacaccacu

SEQ ID NO: 2035232 - RNA, 16 nt, Homo sapiens
agaagaugugauuuau

SEQ ID NO: 2035233 - RNA, 17 nt, Homo sapiens
cauaaccccuagucauc

SEQ ID NO: 2035234 - RNA, 16 nt, Homo sapiens
cacaaauaacaucuca

SEQ ID NO: 2035235 - RNA, 17 nt, Homo sapiens
cuggagcugaagcguua

SEQ ID NO: 2035236 - RNA, 19 nt, Homo sapiens
cagugagccaugaucaugc

SEQ ID NO: 2035237 - RNA, 19 nt, Homo sapiens
ucuauacuccuucccuuaa

SEQ ID NO: 2035238 - RNA, 13 nt, Homo sapiens
aauaauuguguac

SEQ ID NO: 2035239 - RNA, 12 nt, Homo sapiens
uaucuaugacug

SEQ ID NO: 2035240 - RNA, 12 nt, Homo sapiens
auuuggugcugg

SEQ ID NO: 2035241 - RNA, 14 nt, Homo sapiens
cccucccagcccau

SEQ ID NO: 2035242 - RNA, 14 nt, Homo sapiens
cucucccaguccau

SEQ ID NO: 2035243 - RNA, 16 nt, Homo sapiens
aaaccaccaucuucua

SEQ ID NO: 2035244 - RNA, 18 nt, Homo sapiens
guaauuugauacugaccu

SEQ ID NO: 2035245 - RNA, 16 nt, Homo sapiens
gucaggguucacuugg

SEQ ID NO: 2035246 - RNA, 20 nt, Homo sapiens
cuugacccauguucucaaua

SEQ ID NO: 2035247 - RNA, 21 nt, Homo sapiens
uguaaauaguuacuccagugc

SEQ ID NO: 2035248 - RNA, 21 nt, Homo sapiens
gaccaguaugcuuggacugaa

SEQ ID NO: 2035249 - RNA, 12 nt, Homo sapiens
agagcagcucac

SEQ ID NO: 2035250 - RNA, 18 nt, Homo sapiens
ugcuucaggauaccauau

SEQ ID NO: 2035251 - RNA, 14 nt, Homo sapiens
ggacagaaaaugca

SEQ ID NO: 2035252 - RNA, 21 nt, Homo sapiens
ugguaguuuuacaguguuucu

SEQ ID NO: 2035253 - RNA, 15 nt, Homo sapiens
ugugaaaggaagugu

SEQ ID NO: 2035254 - RNA, 23 nt, Homo sapiens
cagugagcacugguuaguacugg

SEQ ID NO: 2035255 - RNA, 14 nt, Homo sapiens
auggcagcuuaaag

SEQ ID NO: 2035256 - RNA, 16 nt, Homo sapiens
ucccuccccuugccug

SEQ ID NO: 2035257 - RNA, 17 nt, Homo sapiens
cuccaguugcagaccau

SEQ ID NO: 2035258 - RNA, 14 nt, Homo sapiens
aauuuccucuccac

SEQ ID NO: 2035259 - RNA, 17 nt, Homo sapiens
gaaugaguuuccagcua

SEQ ID NO: 2035260 - RNA, 14 nt, Homo sapiens
cucacuacagccuc

SEQ ID NO: 2035261 - RNA, 15 nt, Homo sapiens
cagaaacugaugcca

SEQ ID NO: 2035262 - RNA, 19 nt, Homo sapiens
cccugaggguggucagcca

SEQ ID NO: 2035263 - RNA, 21 nt, Homo sapiens
aacucagugaaggcccaugaa

SEQ ID NO: 2035264 - RNA, 14 nt, Homo sapiens
ucaucagcauuuaa

SEQ ID NO: 2035265 - RNA, 19 nt, Homo sapiens
gcugaaacuugaacucugg

SEQ ID NO: 2035266 - RNA, 15 nt, Homo sapiens
cuaagaagcuugaau

SEQ ID NO: 2035267 - RNA, 15 nt, Homo sapiens
cuaaacaccacguca

SEQ ID NO: 2035268 - RNA, 18 nt, Homo sapiens
cagugaaggucuuuguua

SEQ ID NO: 2035269 - RNA, 18 nt, Homo sapiens
cucuuucugcucugccau

SEQ ID NO: 2035270 - RNA, 14 nt, Homo sapiens
cgccccucccugaa

SEQ ID NO: 2035271 - RNA, 16 nt, Homo sapiens
cugcacugucugagaa

SEQ ID NO: 2035272 - RNA, 19 nt, Homo sapiens
aucuguucuaacauguaau

SEQ ID NO: 2035273 - RNA, 12 nt, Homo sapiens
uaacaugacaca

SEQ ID NO: 2035274 - RNA, 14 nt, Homo sapiens
uauuaguaacauca

SEQ ID NO: 2035275 - RNA, 20 nt, Homo sapiens
ccagagucuagcguagugca

SEQ ID NO: 2035276 - RNA, 22 nt, Homo sapiens
acacuuucagaaaaacaaaugu

SEQ ID NO: 2035277 - RNA, 20 nt, Homo sapiens
gaaauuuuaagccaaaaaca

SEQ ID NO: 2035278 - RNA, 12 nt, Homo sapiens
aaaguaucuaca

SEQ ID NO: 2035279 - RNA, 21 nt, Homo sapiens
uaaaauauuuuagauaauucu

SEQ ID NO: 2035280 - RNA, 22 nt, Homo sapiens
uccacuguuaccuaaguucuca

SEQ ID NO: 2035281 - RNA, 21 nt, Homo sapiens
ggaaauguaacuugaagcagc

SEQ ID NO: 2035282 - RNA, 16 nt, Homo sapiens
uggagcuccagccuga

SEQ ID NO: 2035283 - RNA, 16 nt, Homo sapiens
auuucacaaaucacca

SEQ ID NO: 2035284 - RNA, 17 nt, Homo sapiens
uaacaaauacauucaaa

SEQ ID NO: 2035285 - RNA, 17 nt, Homo sapiens
aacuuauaacccacuuu

SEQ ID NO: 2035286 - RNA, 22 nt, Homo sapiens
ugacaaaaccuuuaaucugcac

SEQ ID NO: 2035287 - RNA, 14 nt, Homo sapiens
guaugacaaccucu

SEQ ID NO: 2035288 - RNA, 16 nt, Homo sapiens
agccuuuccaaugaag

SEQ ID NO: 2035289 - RNA, 16 nt, Homo sapiens
gggcaauaccagugac

SEQ ID NO: 2035290 - RNA, 19 nt, Homo sapiens
aggcagaucuuuaaauaca

SEQ ID NO: 2035291 - RNA, 20 nt, Homo sapiens
acgacccuugagaagcugcc

SEQ ID NO: 2035292 - RNA, 21 nt, Homo sapiens
aaggaaccguggagcaugcaa

SEQ ID NO: 2035293 - RNA, 15 nt, Homo sapiens
uccugcggcaucaga

SEQ ID NO: 2035294 - RNA, 13 nt, Homo sapiens
ccuuccuauucuc

SEQ ID NO: 2035295 - RNA, 23 nt, Homo sapiens
cucaacauguuacugaccagcaa

SEQ ID NO: 2035296 - RNA, 17 nt, Homo sapiens
guccuaauggugaugca

SEQ ID NO: 2035297 - RNA, 16 nt, Homo sapiens
aaaauguugcagcuca

SEQ ID NO: 2035298 - RNA, 16 nt, Homo sapiens
agcauugagaucucca

SEQ ID NO: 2035299 - RNA, 14 nt, Homo sapiens
guuuaaagucacau

SEQ ID NO: 2035300 - RNA, 14 nt, Homo sapiens
uccgccagauccug

SEQ ID NO: 2035301 - RNA, 22 nt, Homo sapiens
acucucuauugaccaccaguua

SEQ ID NO: 2035302 - RNA, 22 nt, Homo sapiens
uggaggacaaauaagaaaugaa

SEQ ID NO: 2035303 - RNA, 16 nt, Homo sapiens
ugggcugagacuggau

SEQ ID NO: 2035304 - RNA, 21 nt, Homo sapiens
guguccugaggccuccaagga

SEQ ID NO: 2035305 - RNA, 20 nt, Homo sapiens
cguguaccucacuuuacaua

SEQ ID NO: 2035306 - RNA, 15 nt, Homo sapiens
uaauaaguccaucug

SEQ ID NO: 2035307 - RNA, 19 nt, Homo sapiens
aagccacccuaccaugaau

SEQ ID NO: 2035308 - RNA, 19 nt, Homo sapiens
guagcugggacuacaggca

SEQ ID NO: 2035309 - RNA, 17 nt, Homo sapiens
uucuacaacugauugca

SEQ ID NO: 2035310 - RNA, 22 nt, Homo sapiens
uggaagucuccaugaagagcuu

SEQ ID NO: 2035311 - RNA, 21 nt, Homo sapiens
caguacuuucaaugaacauaa

SEQ ID NO: 2035312 - RNA, 19 nt, Homo sapiens
ccagugcaccugucauaug

SEQ ID NO: 2035313 - RNA, 19 nt, Homo sapiens
ugacacccaugccagagag

SEQ ID NO: 2035314 - RNA, 19 nt, Homo sapiens
gcauauaaaaugcuuuauu

SEQ ID NO: 2035315 - RNA, 11 nt, Homo sapiens
cuucacuguau

SEQ ID NO: 2035316 - RNA, 18 nt, Homo sapiens
aacuuauuuuuguucaua

SEQ ID NO: 2035317 - RNA, 22 nt, Homo sapiens
cugcucuaggcccacaagugua

SEQ ID NO: 2035318 - RNA, 18 nt, Homo sapiens
cacuccagucugccauau

SEQ ID NO: 2035319 - RNA, 12 nt, Homo sapiens
agcacaccucau

SEQ ID NO: 2035320 - RNA, 16 nt, Homo sapiens
cagaaaaacucuggga

SEQ ID NO: 2035321 - RNA, 17 nt, Homo sapiens
aggguggucuugaucuc

SEQ ID NO: 2035322 - RNA, 22 nt, Homo sapiens
gaacauaaaaaauaaaguacca

SEQ ID NO: 2035323 - RNA, 19 nt, Homo sapiens
aauuguuuccaaagugcau

SEQ ID NO: 2035324 - RNA, 14 nt, Homo sapiens
auuauugugacuuc

SEQ ID NO: 2035325 - RNA, 17 nt, Homo sapiens
gagguuuauacugcaaa

SEQ ID NO: 2035326 - RNA, 16 nt, Homo sapiens
uccgaucgacugccaa

SEQ ID NO: 2035327 - RNA, 18 nt, Homo sapiens
uucucuugacguuuacau

SEQ ID NO: 2035328 - RNA, 19 nt, Homo sapiens
uucaccugcccugugcaug

SEQ ID NO: 2035329 - RNA, 20 nt, Homo sapiens
ucauaaaacccaaaccacau

SEQ ID NO: 2035330 - RNA, 16 nt, Homo sapiens
ggcccugcugaagcug

SEQ ID NO: 2035331 - RNA, 12 nt, Homo sapiens
uccgcagacuug

SEQ ID NO: 2035332 - RNA, 15 nt, Homo sapiens
uacauuccugagauu

SEQ ID NO: 2035333 - RNA, 20 nt, Homo sapiens
gaaaggcucauuuaaaacag

SEQ ID NO: 2035334 - RNA, 15 nt, Homo sapiens
agcuuaagaaccauu

SEQ ID NO: 2035335 - RNA, 15 nt, Homo sapiens
auugugaagauuuca

SEQ ID NO: 2035336 - RNA, 19 nt, Homo sapiens
aaucuucggggugugauga

SEQ ID NO: 2035337 - RNA, 23 nt, Homo sapiens
cauagcuuucuucccguaaaaac

SEQ ID NO: 2035338 - RNA, 16 nt, Homo sapiens
aguaucuccaagggua

SEQ ID NO: 2035339 - RNA, 20 nt, Homo sapiens
cuguacuucugugugcaauu

SEQ ID NO: 2035340 - RNA, 14 nt, Homo sapiens
auuuaucaccuuaa

SEQ ID NO: 2035341 - RNA, 22 nt, Homo sapiens
cuguagcagcauuacagaaaua

SEQ ID NO: 2035342 - RNA, 13 nt, Homo sapiens
aaggcaagccagc

SEQ ID NO: 2035343 - RNA, 16 nt, Homo sapiens
uccauccuaaucugaa

SEQ ID NO: 2035344 - RNA, 17 nt, Homo sapiens
gaaaaccacaacuaaaa

SEQ ID NO: 2035345 - RNA, 21 nt, Homo sapiens
ugcaccuucugacgcagccug

SEQ ID NO: 2035346 - RNA, 18 nt, Homo sapiens
guggguucuccuguucuc

SEQ ID NO: 2035347 - RNA, 16 nt, Homo sapiens
aaauacccaaaugucc

SEQ ID NO: 2035348 - RNA, 18 nt, Homo sapiens
ccagcugcucccaaauaa

SEQ ID NO: 2035349 - RNA, 15 nt, Homo sapiens
uggacucucagggau

SEQ ID NO: 2035350 - RNA, 17 nt, Homo sapiens
ugaugauagucaucauc

SEQ ID NO: 2035351 - RNA, 18 nt, Homo sapiens
ccugcugccugcugagau

SEQ ID NO: 2035352 - RNA, 19 nt, Homo sapiens
cugggguuggaagugugac

SEQ ID NO: 2035353 - RNA, 21 nt, Homo sapiens
ugaagcccacccugcaccuca

SEQ ID NO: 2035354 - RNA, 17 nt, Homo sapiens
aaacacuugacuauaaa

SEQ ID NO: 2035355 - RNA, 15 nt, Homo sapiens
auguauuacaugacu

SEQ ID NO: 2035356 - RNA, 16 nt, Homo sapiens
cagcuagcucugccaa

SEQ ID NO: 2035357 - RNA, 17 nt, Homo sapiens
uguaauuauaucuaaaa

SEQ ID NO: 2035358 - RNA, 16 nt, Homo sapiens
caaaaaaguauagaaa

SEQ ID NO: 2035359 - RNA, 16 nt, Homo sapiens
ccugcuuuagagcuag

SEQ ID NO: 2035360 - RNA, 16 nt, Homo sapiens
uaguauuucucaggaa

SEQ ID NO: 2035361 - RNA, 22 nt, Homo sapiens
gccauaugaaugucaguaguuu

SEQ ID NO: 2035362 - RNA, 18 nt, Homo sapiens
cagcucuguaucugccau

SEQ ID NO: 2035363 - RNA, 16 nt, Homo sapiens
agcaggucccugugag

SEQ ID NO: 2035364 - RNA, 20 nt, Homo sapiens
uggcuucugcuucaaacccu

SEQ ID NO: 2035365 - RNA, 18 nt, Homo sapiens
gauuuguaugcucauuga

SEQ ID NO: 2035366 - RNA, 13 nt, Homo sapiens
ccugcuggcauca

SEQ ID NO: 2035367 - RNA, 14 nt, Homo sapiens
aaauguauguuggu

SEQ ID NO: 2035368 - RNA, 20 nt, Homo sapiens
ucacgcucagcacacaugca

SEQ ID NO: 2035369 - RNA, 14 nt, Homo sapiens
auggagaaugcacc

SEQ ID NO: 2035370 - RNA, 17 nt, Homo sapiens
gagaacacagugcuauu

SEQ ID NO: 2035371 - RNA, 13 nt, Homo sapiens
aaaagaaguugua

SEQ ID NO: 2035372 - RNA, 17 nt, Homo sapiens
uuaacauuccucaugaa

SEQ ID NO: 2035373 - RNA, 15 nt, Homo sapiens
aauaguuguaaauau

SEQ ID NO: 2035374 - RNA, 13 nt, Homo sapiens
ucucccugccaag

SEQ ID NO: 2035375 - RNA, 23 nt, Homo sapiens
ucccccaccagcuaaggacauuu

SEQ ID NO: 2035376 - RNA, 15 nt, Homo sapiens
cagagaaauucugug

SEQ ID NO: 2035377 - RNA, 14 nt, Homo sapiens
gugaugccauuaca

SEQ ID NO: 2035378 - RNA, 16 nt, Homo sapiens
auauuuaagagauuaa

SEQ ID NO: 2035379 - RNA, 23 nt, Homo sapiens
aacaauucucccgggacucugca

SEQ ID NO: 2035380 - RNA, 21 nt, Homo sapiens
gcccugcgccaccucacugca

SEQ ID NO: 2035381 - RNA, 20 nt, Homo sapiens
gugaaacacacaauguggac

SEQ ID NO: 2035382 - RNA, 17 nt, Homo sapiens
aauuguuaaacuugcag

SEQ ID NO: 2035383 - RNA, 21 nt, Homo sapiens
aucaccuccccuccuugccuc

SEQ ID NO: 2035384 - RNA, 12 nt, Homo sapiens
caagguguuucu

SEQ ID NO: 2035385 - RNA, 15 nt, Homo sapiens
gauguauuaugcaaa

SEQ ID NO: 2035386 - RNA, 17 nt, Homo sapiens
cauguaacaaccagaga

SEQ ID NO: 2035387 - RNA, 15 nt, Homo sapiens
agaaaucucuuccau

SEQ ID NO: 2035388 - RNA, 14 nt, Homo sapiens
agaaacgucuucua

SEQ ID NO: 2035389 - RNA, 17 nt, Homo sapiens
ccugcccccgcucugcc

SEQ ID NO: 2035390 - RNA, 16 nt, Homo sapiens
ucuauagcaucacuua

SEQ ID NO: 2035391 - RNA, 20 nt, Homo sapiens
ccuucugggacuggacagcu

SEQ ID NO: 2035392 - RNA, 17 nt, Homo sapiens
acugcugcagacaccug

SEQ ID NO: 2035393 - RNA, 18 nt, Homo sapiens
cacauuggaaugccuugg

SEQ ID NO: 2035394 - RNA, 14 nt, Homo sapiens
agcagcuggugcuc

SEQ ID NO: 2035395 - RNA, 14 nt, Homo sapiens
acagcugugcucca

SEQ ID NO: 2035396 - RNA, 14 nt, Homo sapiens
cugcuccaccagca

SEQ ID NO: 2035397 - RNA, 18 nt, Homo sapiens
aacugcccaggcaaagug

SEQ ID NO: 2035398 - RNA, 16 nt, Homo sapiens
agauauauaugugcuc

SEQ ID NO: 2035399 - RNA, 20 nt, Homo sapiens
accucucucugggauuuacc

SEQ ID NO: 2035400 - RNA, 19 nt, Homo sapiens
auccacgcacacauggaca

SEQ ID NO: 2035401 - RNA, 17 nt, Homo sapiens
auuuaaucaccacucaa

SEQ ID NO: 2035402 - RNA, 12 nt, Homo sapiens
auccagcacugg

SEQ ID NO: 2035403 - RNA, 18 nt, Homo sapiens
gugaauugccagcguugu

SEQ ID NO: 2035404 - RNA, 14 nt, Homo sapiens
uuacaucauccucc

SEQ ID NO: 2035405 - RNA, 22 nt, Homo sapiens
gagaaagcagaaaaucuaccaa

SEQ ID NO: 2035406 - RNA, 17 nt, Homo sapiens
ggggccauguccucucu

SEQ ID NO: 2035407 - RNA, 16 nt, Homo sapiens
ugaacgagcagcccag

SEQ ID NO: 2035408 - RNA, 18 nt, Homo sapiens
uaaacaaaauugcaauuu

SEQ ID NO: 2035409 - RNA, 13 nt, Homo sapiens
gacucauuucaca

SEQ ID NO: 2035410 - RNA, 16 nt, Homo sapiens
accaccucugugggca

SEQ ID NO: 2035411 - RNA, 19 nt, Homo sapiens
accccucaaacugcacauc

SEQ ID NO: 2035412 - RNA, 13 nt, Homo sapiens
gcaccaaccugca

SEQ ID NO: 2035413 - RNA, 21 nt, Homo sapiens
uuaggugcuucuucacuucag

SEQ ID NO: 2035414 - RNA, 22 nt, Homo sapiens
acgguuucuccccggacacucg

SEQ ID NO: 2035415 - RNA, 19 nt, Homo sapiens
aggaaggggccccauggca

SEQ ID NO: 2035416 - RNA, 19 nt, Homo sapiens
auauauauuuuugugcaca

SEQ ID NO: 2035417 - RNA, 17 nt, Homo sapiens
ggcuggggacacaggau

SEQ ID NO: 2035418 - RNA, 14 nt, Homo sapiens
aucuaucugcuuau

SEQ ID NO: 2035419 - RNA, 20 nt, Homo sapiens
auauaauaugcacacagugc

SEQ ID NO: 2035420 - RNA, 18 nt, Homo sapiens
uucugauguuucugugaa

SEQ ID NO: 2035421 - RNA, 21 nt, Homo sapiens
cuccacuuucuagccagagga

SEQ ID NO: 2035422 - RNA, 14 nt, Homo sapiens
gagaacaacccaag

SEQ ID NO: 2035423 - RNA, 12 nt, Homo sapiens
aacuauguguuc

SEQ ID NO: 2035424 - RNA, 14 nt, Homo sapiens
aaguuuugaugaaa

SEQ ID NO: 2035425 - RNA, 11 nt, Homo sapiens
aaaauguucuu

SEQ ID NO: 2035426 - RNA, 11 nt, Homo sapiens
aauauguucua

SEQ ID NO: 2035427 - RNA, 12 nt, Homo sapiens
gccucaccuuca

SEQ ID NO: 2035428 - RNA, 13 nt, Homo sapiens
cauuuagcuucuu

SEQ ID NO: 2035429 - RNA, 13 nt, Homo sapiens
agaaaacuggaaa

SEQ ID NO: 2035430 - RNA, 13 nt, Homo sapiens
accucacugccuc

SEQ ID NO: 2035431 - RNA, 13 nt, Homo sapiens
ggagaacuagaga

SEQ ID NO: 2035432 - RNA, 13 nt, Homo sapiens
agaagacuggaag

SEQ ID NO: 2035433 - RNA, 19 nt, Homo sapiens
caguuggagggaaagccag

SEQ ID NO: 2035434 - RNA, 19 nt, Homo sapiens
cagcugggagccuuugcca

SEQ ID NO: 2035435 - RNA, 22 nt, Homo sapiens
uagaaccucgagguuucucaaa

SEQ ID NO: 2035436 - RNA, 21 nt, Homo sapiens
aaagguccaauaaaaugccuc

SEQ ID NO: 2035437 - RNA, 21 nt, Homo sapiens
aguuucauguacaagaugaag

SEQ ID NO: 2035438 - RNA, 16 nt, Homo sapiens
acucaagugccauuca

SEQ ID NO: 2035439 - RNA, 18 nt, Homo sapiens
aaaaugguuuacuuaaca

SEQ ID NO: 2035440 - RNA, 18 nt, Homo sapiens
acaaauuauaagcauaca

SEQ ID NO: 2035441 - RNA, 10 nt, Homo sapiens
guuggugcaa

SEQ ID NO: 2035442 - RNA, 20 nt, Homo sapiens
guaacuaaaacuuuucaguu

SEQ ID NO: 2035443 - RNA, 16 nt, Homo sapiens
cuuccacugccugaaa

SEQ ID NO: 2035444 - RNA, 21 nt, Homo sapiens
caggaggcaagcguguucuca

SEQ ID NO: 2035445 - RNA, 15 nt, Homo sapiens
aggucguagcauuug

SEQ ID NO: 2035446 - RNA, 13 nt, Homo sapiens
ugaauaauacagu

SEQ ID NO: 2035447 - RNA, 13 nt, Homo sapiens
acaaaaauugaga

SEQ ID NO: 2035448 - RNA, 21 nt, Homo sapiens
agcaugcuuugcugcuaugaa

SEQ ID NO: 2035449 - RNA, 21 nt, Homo sapiens
aacuagacaucugcuguuauc

SEQ ID NO: 2035450 - RNA, 16 nt, Homo sapiens
acucagucucuuccac

SEQ ID NO: 2035451 - RNA, 16 nt, Homo sapiens
agcuuauagucuucca

SEQ ID NO: 2035452 - RNA, 13 nt, Homo sapiens
ucauuauguuucc

SEQ ID NO: 2035453 - RNA, 12 nt, Homo sapiens
ggagugugggcu

SEQ ID NO: 2035454 - RNA, 20 nt, Homo sapiens
gcuuucagguguuacagaaa

SEQ ID NO: 2035455 - RNA, 15 nt, Homo sapiens
caacauaugaauaua

SEQ ID NO: 2035456 - RNA, 15 nt, Homo sapiens
cauaacuugcugaau

SEQ ID NO: 2035457 - RNA, 22 nt, Homo sapiens
ucaaguucuggaccugggcaug

SEQ ID NO: 2035458 - RNA, 12 nt, Homo sapiens
cuaggacauaua

SEQ ID NO: 2035459 - RNA, 14 nt, Homo sapiens
augaaucacaguau

SEQ ID NO: 2035460 - RNA, 22 nt, Homo sapiens
cucaguaauacaguacaguacu

SEQ ID NO: 2035461 - RNA, 18 nt, Homo sapiens
uguuggguugaauauauu

SEQ ID NO: 2035462 - RNA, 19 nt, Homo sapiens
ggcaugaagcugcauauga

SEQ ID NO: 2035463 - RNA, 14 nt, Homo sapiens
agcuguuuuaguca

SEQ ID NO: 2035464 - RNA, 16 nt, Homo sapiens
ggcuaaaaacauuuua

SEQ ID NO: 2035465 - RNA, 14 nt, Homo sapiens
cgaacaaacugaug

SEQ ID NO: 2035466 - RNA, 13 nt, Homo sapiens
aauaugugaaaga

SEQ ID NO: 2035467 - RNA, 13 nt, Homo sapiens
ucagugugucuaa

SEQ ID NO: 2035468 - RNA, 13 nt, Homo sapiens
aaacccacaguuu

SEQ ID NO: 2035469 - RNA, 13 nt, Homo sapiens
gauuaacauauag

SEQ ID NO: 2035470 - RNA, 13 nt, Homo sapiens
augucuaccucag

SEQ ID NO: 2035471 - RNA, 19 nt, Homo sapiens
uggcucacuauggugccaa

SEQ ID NO: 2035472 - RNA, 15 nt, Homo sapiens
agaaaugugacuugg

SEQ ID NO: 2035473 - RNA, 20 nt, Homo sapiens
accuugcacaaacagccccu

SEQ ID NO: 2035474 - RNA, 16 nt, Homo sapiens
uggagaacuaaaggug

SEQ ID NO: 2035475 - RNA, 21 nt, Homo sapiens
ugcaccuacgggggcaucuga

SEQ ID NO: 2035476 - RNA, 18 nt, Homo sapiens
aaaaauuugaacacuggc

SEQ ID NO: 2035477 - RNA, 16 nt, Homo sapiens
ccuucaccuucugcca

SEQ ID NO: 2035478 - RNA, 20 nt, Homo sapiens
uauuaccagguccauuuugc

SEQ ID NO: 2035479 - RNA, 14 nt, Homo sapiens
uguuuggaaaccac

SEQ ID NO: 2035480 - RNA, 14 nt, Homo sapiens
ucugaguuuuacca

SEQ ID NO: 2035481 - RNA, 11 nt, Homo sapiens
cucccuuugaa

SEQ ID NO: 2035482 - RNA, 17 nt, Homo sapiens
agcagacaaaaugaaag

SEQ ID NO: 2035483 - RNA, 22 nt, Homo sapiens
agaaagacuugguugguagggu

SEQ ID NO: 2035484 - RNA, 21 nt, Homo sapiens
uaaccccacccuuuacauuuu

SEQ ID NO: 2035485 - RNA, 18 nt, Homo sapiens
acuauguugcccaggcag

SEQ ID NO: 2035486 - RNA, 10 nt, Homo sapiens
uggcuuuaug

SEQ ID NO: 2035487 - RNA, 23 nt, Homo sapiens
cugugcccaucaucucugccuuu

SEQ ID NO: 2035488 - RNA, 14 nt, Homo sapiens
gcuguguaagcuca

SEQ ID NO: 2035489 - RNA, 14 nt, Homo sapiens
gccacauuuuagcc

SEQ ID NO: 2035490 - RNA, 14 nt, Homo sapiens
aacucccucuggga

SEQ ID NO: 2035491 - RNA, 16 nt, Homo sapiens
gccacccggcacuggc

SEQ ID NO: 2035492 - RNA, 24 nt, Homo sapiens
cuaguacuauuacuaguacuagua

SEQ ID NO: 2035493 - RNA, 17 nt, Homo sapiens
ucucucacugacuauua

SEQ ID NO: 2035494 - RNA, 15 nt, Homo sapiens
aaggucuauggcuca

SEQ ID NO: 2035495 - RNA, 20 nt, Homo sapiens
aucugucucauccaaaaagu

SEQ ID NO: 2035496 - RNA, 16 nt, Homo sapiens
aggcugggccaugucc

SEQ ID NO: 2035497 - RNA, 19 nt, Homo sapiens
aacauggacuuucuugcau

SEQ ID NO: 2035498 - RNA, 15 nt, Homo sapiens
aggaauaaugauacc

SEQ ID NO: 2035499 - RNA, 18 nt, Homo sapiens
auuuguaauggcucccaa

SEQ ID NO: 2035500 - RNA, 16 nt, Homo sapiens
gucuucucacaagcca

SEQ ID NO: 2035501 - RNA, 14 nt, Homo sapiens
cccaugcagugacc

SEQ ID NO: 2035502 - RNA, 17 nt, Homo sapiens
guaggaaagucacccaa

SEQ ID NO: 2035503 - RNA, 14 nt, Homo sapiens
uaauacguacaugu

SEQ ID NO: 2035504 - RNA, 12 nt, Homo sapiens
acagcaugcauu

SEQ ID NO: 2035505 - RNA, 17 nt, Homo sapiens
aaguccguguccuaccu

SEQ ID NO: 2035506 - RNA, 19 nt, Homo sapiens
guucugaugggucccaaaa

SEQ ID NO: 2035507 - RNA, 16 nt, Homo sapiens
guguacuuaauacuca

SEQ ID NO: 2035508 - RNA, 18 nt, Homo sapiens
uaacaucauuguauuaac

SEQ ID NO: 2035509 - RNA, 18 nt, Homo sapiens
uugacugaucagugugau

SEQ ID NO: 2035510 - RNA, 20 nt, Homo sapiens
auauaaaauauauauugcau

SEQ ID NO: 2035511 - RNA, 18 nt, Homo sapiens
aguuucuuggccacugaa

SEQ ID NO: 2035512 - RNA, 21 nt, Homo sapiens
gcuguggagcuccacugccau

SEQ ID NO: 2035513 - RNA, 14 nt, Homo sapiens
ugacacacagcagc

SEQ ID NO: 2035514 - RNA, 14 nt, Homo sapiens
ggcuuuguggcacu

SEQ ID NO: 2035515 - RNA, 21 nt, Homo sapiens
acagccccugcuuuuucccuu

SEQ ID NO: 2035516 - RNA, 16 nt, Homo sapiens
aacuuuccaagcucca

SEQ ID NO: 2035517 - RNA, 14 nt, Homo sapiens
aauuacaugggauc

SEQ ID NO: 2035518 - RNA, 18 nt, Homo sapiens
agccggcgggaggucugc

SEQ ID NO: 2035519 - RNA, 17 nt, Homo sapiens
uuggaugagaagugucu

SEQ ID NO: 2035520 - RNA, 15 nt, Homo sapiens
gguccaugcaggggc

SEQ ID NO: 2035521 - RNA, 18 nt, Homo sapiens
ugcaaaccauagcacagg

SEQ ID NO: 2035522 - RNA, 16 nt, Homo sapiens
guauuaagaauaucua

SEQ ID NO: 2035523 - RNA, 15 nt, Homo sapiens
guacguuuugcacau

SEQ ID NO: 2035524 - RNA, 22 nt, Homo sapiens
auguuucccuacuaacauccca

SEQ ID NO: 2035525 - RNA, 13 nt, Homo sapiens
augcagcagggau

SEQ ID NO: 2035526 - RNA, 13 nt, Homo sapiens
gugcugcaaggaa

SEQ ID NO: 2035527 - RNA, 21 nt, Homo sapiens
guuacaauaaaacuaaaugug

SEQ ID NO: 2035528 - RNA, 22 nt, Homo sapiens
augucuguagcuccucaacuca

SEQ ID NO: 2035529 - RNA, 17 nt, Homo sapiens
ugcauaugucacuagaa

SEQ ID NO: 2035530 - RNA, 14 nt, Homo sapiens
uucauucaaacugc

SEQ ID NO: 2035531 - RNA, 15 nt, Homo sapiens
caaaucccuauguug

SEQ ID NO: 2035532 - RNA, 20 nt, Homo sapiens
cacucucagaccaagcagca

SEQ ID NO: 2035533 - RNA, 15 nt, Homo sapiens
aaagccuuaagcaca

SEQ ID NO: 2035534 - RNA, 15 nt, Homo sapiens
aaagacuuaagccca

SEQ ID NO: 2035535 - RNA, 15 nt, Homo sapiens
caagaaaucagccau

SEQ ID NO: 2035536 - RNA, 12 nt, Homo sapiens
aagaugugcuua

SEQ ID NO: 2035537 - RNA, 18 nt, Homo sapiens
gaccccuguucccaugcu

SEQ ID NO: 2035538 - RNA, 21 nt, Homo sapiens
ugucgccacacgccucugcau

SEQ ID NO: 2035539 - RNA, 23 nt, Homo sapiens
cagaggagccaauaaaccuguaa

SEQ ID NO: 2035540 - RNA, 14 nt, Homo sapiens
cacaaguccuguga

SEQ ID NO: 2035541 - RNA, 22 nt, Homo sapiens
ccuagagggcccccuacuuguu

SEQ ID NO: 2035542 - RNA, 19 nt, Homo sapiens
gugugggcugugaguguaa

SEQ ID NO: 2035543 - RNA, 22 nt, Homo sapiens
acaucauuagaacaaaggacag

SEQ ID NO: 2035544 - RNA, 15 nt, Homo sapiens
aagucaucuguaugc

SEQ ID NO: 2035545 - RNA, 13 nt, Homo sapiens
aggugcucugugg

SEQ ID NO: 2035546 - RNA, 13 nt, Homo sapiens
ggaugaugcaguu

SEQ ID NO: 2035547 - RNA, 17 nt, Homo sapiens
agaaucagaucauuuca

SEQ ID NO: 2035548 - RNA, 23 nt, Homo sapiens
ucuauaucucauuucauucucac

SEQ ID NO: 2035549 - RNA, 22 nt, Homo sapiens
gaaaaugagcacacccuucaca

SEQ ID NO: 2035550 - RNA, 14 nt, Homo sapiens
ugauauacaaagug

SEQ ID NO: 2035551 - RNA, 15 nt, Homo sapiens
uggaauagaugucuc

SEQ ID NO: 2035552 - RNA, 20 nt, Homo sapiens
gaagcuuuuuguugccuuau

SEQ ID NO: 2035553 - RNA, 16 nt, Homo sapiens
cucaacucacugcaag

SEQ ID NO: 2035554 - RNA, 20 nt, Homo sapiens
auuaaugaaaagcagauugc

SEQ ID NO: 2035555 - RNA, 21 nt, Homo sapiens
cuaucuuugauauuggcuuaa

SEQ ID NO: 2035556 - RNA, 17 nt, Homo sapiens
uccuggaaucaguauuu

SEQ ID NO: 2035557 - RNA, 14 nt, Homo sapiens
uugcuccauuguca

SEQ ID NO: 2035558 - RNA, 20 nt, Homo sapiens
cugggaaggggaacacagac

SEQ ID NO: 2035559 - RNA, 16 nt, Homo sapiens
cgucgguccuggugcc

SEQ ID NO: 2035560 - RNA, 20 nt, Homo sapiens
ccacagcagcugaacagcca

SEQ ID NO: 2035561 - RNA, 18 nt, Homo sapiens
auagcuaaguacacaaua

SEQ ID NO: 2035562 - RNA, 15 nt, Homo sapiens
aggcugcacugcagu

SEQ ID NO: 2035563 - RNA, 15 nt, Homo sapiens
gaaaugaacuuuguc

SEQ ID NO: 2035564 - RNA, 19 nt, Homo sapiens
ccuucccuccccacagucc

SEQ ID NO: 2035565 - RNA, 13 nt, Homo sapiens
auaauuugcacug

SEQ ID NO: 2035566 - RNA, 14 nt, Homo sapiens
aaucaaucuguaaa

SEQ ID NO: 2035567 - RNA, 21 nt, Homo sapiens
auuuaugaauaaauauuacaa

SEQ ID NO: 2035568 - RNA, 18 nt, Homo sapiens
ggccgaagcugcugugac

SEQ ID NO: 2035569 - RNA, 20 nt, Homo sapiens
ugugucagaguaacaugcca

SEQ ID NO: 2035570 - RNA, 21 nt, Homo sapiens
auggcugguuaccaccagccu

SEQ ID NO: 2035571 - RNA, 12 nt, Homo sapiens
gcugccucuugg

SEQ ID NO: 2035572 - RNA, 15 nt, Homo sapiens
ccucuuucuucauuc

SEQ ID NO: 2035573 - RNA, 19 nt, Homo sapiens
gugauuauauuucacccau

SEQ ID NO: 2035574 - RNA, 16 nt, Homo sapiens
acagccaguuuucaca

SEQ ID NO: 2035575 - RNA, 14 nt, Homo sapiens
gugugcaaguacga

SEQ ID NO: 2035576 - RNA, 23 nt, Homo sapiens
cuaacuuaauguaguuacuguga

SEQ ID NO: 2035577 - RNA, 11 nt, Homo sapiens
gagagcuguuc

SEQ ID NO: 2035578 - RNA, 12 nt, Homo sapiens
caaaacauugaa

SEQ ID NO: 2035579 - RNA, 20 nt, Homo sapiens
ugugacuugaacuagauugc

SEQ ID NO: 2035580 - RNA, 18 nt, Homo sapiens
ccagcgagggcgugucua

SEQ ID NO: 2035581 - RNA, 21 nt, Homo sapiens
gcagugacuuuagaaacaaau

SEQ ID NO: 2035582 - RNA, 14 nt, Homo sapiens
uuaaacagauuaga

SEQ ID NO: 2035583 - RNA, 19 nt, Homo sapiens
aagcaguuaugugaccuca

SEQ ID NO: 2035584 - RNA, 22 nt, Homo sapiens
uguaaauaagcccagugcugcu

SEQ ID NO: 2035585 - RNA, 18 nt, Homo sapiens
uaccuuaagagacacucc

SEQ ID NO: 2035586 - RNA, 17 nt, Homo sapiens
uguuggaaaaugugcaa

SEQ ID NO: 2035587 - RNA, 20 nt, Homo sapiens
cacauuggucauugugaaua

SEQ ID NO: 2035588 - RNA, 18 nt, Homo sapiens
auuugauuacaauacuga

SEQ ID NO: 2035589 - RNA, 11 nt, Homo sapiens
ggcaagcugca

SEQ ID NO: 2035590 - RNA, 13 nt, Homo sapiens
ugauuucagggaa

SEQ ID NO: 2035591 - RNA, 21 nt, Homo sapiens
gccagcaccgccggcuuucag

SEQ ID NO: 2035592 - RNA, 13 nt, Homo sapiens
ugacgaacuggcu

SEQ ID NO: 2035593 - RNA, 17 nt, Homo sapiens
gcucugagaaaguacaa

SEQ ID NO: 2035594 - RNA, 21 nt, Homo sapiens
aucacugccacacucuccauc

SEQ ID NO: 2035595 - RNA, 16 nt, Homo sapiens
uuucaacugcagugua

SEQ ID NO: 2035596 - RNA, 17 nt, Homo sapiens
uuaacauuugaugucua

SEQ ID NO: 2035597 - RNA, 20 nt, Homo sapiens
cuccccacuuguccgcuggg

SEQ ID NO: 2035598 - RNA, 18 nt, Homo sapiens
agauguguuuuugggaag

SEQ ID NO: 2035599 - RNA, 16 nt, Homo sapiens
aaauugccauauugca

SEQ ID NO: 2035600 - RNA, 17 nt, Homo sapiens
ugaaucuuggugucuac

SEQ ID NO: 2035601 - RNA, 22 nt, Homo sapiens
uuugacacaccccuaaguacaa

SEQ ID NO: 2035602 - RNA, 17 nt, Homo sapiens
auuucugugaaacuauc

SEQ ID NO: 2035603 - RNA, 18 nt, Homo sapiens
auaaauucagaauuaacu

SEQ ID NO: 2035604 - RNA, 21 nt, Homo sapiens
cacauaacaauaaaaaccaaa

SEQ ID NO: 2035605 - RNA, 18 nt, Homo sapiens
uaauguuccaugucugaa

SEQ ID NO: 2035606 - RNA, 13 nt, Homo sapiens
aaugaugaggcuc

SEQ ID NO: 2035607 - RNA, 17 nt, Homo sapiens
guccagcccugccuugc

SEQ ID NO: 2035608 - RNA, 19 nt, Homo sapiens
cugcucugaugcaucagaa

SEQ ID NO: 2035609 - RNA, 14 nt, Homo sapiens
cuagcagaaaucua

SEQ ID NO: 2035610 - RNA, 23 nt, Homo sapiens
ucuggcauuauaaagaacagcug

SEQ ID NO: 2035611 - RNA, 18 nt, Homo sapiens
agcccaggacccaucuuu

SEQ ID NO: 2035612 - RNA, 17 nt, Homo sapiens
ccacaauggagugggag

SEQ ID NO: 2035613 - RNA, 20 nt, Homo sapiens
gggcuggagcagucugagga

SEQ ID NO: 2035614 - RNA, 17 nt, Homo sapiens
cugagguauaaagacaa

SEQ ID NO: 2035615 - RNA, 23 nt, Homo sapiens
ccacccgaacgucuuaucuaauc

SEQ ID NO: 2035616 - RNA, 21 nt, Homo sapiens
acauguuaacaccuaccucac

SEQ ID NO: 2035617 - RNA, 14 nt, Homo sapiens
agacugaagaccag

SEQ ID NO: 2035618 - RNA, 14 nt, Homo sapiens
gaacauaaagccuu

SEQ ID NO: 2035619 - RNA, 14 nt, Homo sapiens
gaacacaaagccuc

SEQ ID NO: 2035620 - RNA, 23 nt, Homo sapiens
cugaauauuaagaaacaauuuaa

SEQ ID NO: 2035621 - RNA, 17 nt, Homo sapiens
gagauaccauggugcca

SEQ ID NO: 2035622 - RNA, 13 nt, Homo sapiens
ggauuugaugcuu

SEQ ID NO: 2035623 - RNA, 16 nt, Homo sapiens
auaucagucacuguuc

SEQ ID NO: 2035624 - RNA, 16 nt, Homo sapiens
aucucaaagaaggcau

SEQ ID NO: 2035625 - RNA, 22 nt, Homo sapiens
aaaaguaaguaccacucaggcc

SEQ ID NO: 2035626 - RNA, 17 nt, Homo sapiens
gagcagcaagaagcagc

SEQ ID NO: 2035627 - RNA, 14 nt, Homo sapiens
agacuggcuugccc

SEQ ID NO: 2035628 - RNA, 20 nt, Homo sapiens
uugaaaugagaaacuuugau

SEQ ID NO: 2035629 - RNA, 18 nt, Homo sapiens
cuaaccccauucaugaga

SEQ ID NO: 2035630 - RNA, 19 nt, Homo sapiens
uucuagcaguaugugugcu

SEQ ID NO: 2035631 - RNA, 11 nt, Homo sapiens
aagaauggagg

SEQ ID NO: 2035632 - RNA, 23 nt, Homo sapiens
cuuaaauaauaaacaguggaaua

SEQ ID NO: 2035633 - RNA, 23 nt, Homo sapiens
uugcaggggauugaagcccucca

SEQ ID NO: 2035634 - RNA, 18 nt, Homo sapiens
acagauugcugaaacugu

SEQ ID NO: 2035635 - RNA, 16 nt, Homo sapiens
cagggaaaacugcaaa

SEQ ID NO: 2035636 - RNA, 23 nt, Homo sapiens
gaagcuguccuugagcuguccua

SEQ ID NO: 2035637 - RNA, 17 nt, Homo sapiens
agggcuuauccaugccu

SEQ ID NO: 2035638 - RNA, 15 nt, Homo sapiens
caccacaugugcaca

SEQ ID NO: 2035639 - RNA, 15 nt, Homo sapiens
acagacauacauuua

SEQ ID NO: 2035640 - RNA, 15 nt, Homo sapiens
cuccugcugagcugc

SEQ ID NO: 2035641 - RNA, 22 nt, Homo sapiens
aucagccucacugagcuaauaa

SEQ ID NO: 2035642 - RNA, 18 nt, Homo sapiens
caagccucuaguguacca

SEQ ID NO: 2035643 - RNA, 22 nt, Homo sapiens
cacacacuguucugaaagugac

SEQ ID NO: 2035644 - RNA, 14 nt, Homo sapiens
aauauuuaggcaag

SEQ ID NO: 2035645 - RNA, 16 nt, Homo sapiens
ggaaauacacuacaaa

SEQ ID NO: 2035646 - RNA, 17 nt, Homo sapiens
auguaaugaucuuggac

SEQ ID NO: 2035647 - RNA, 16 nt, Homo sapiens
cagcaggcauuugcua

SEQ ID NO: 2035648 - RNA, 23 nt, Homo sapiens
gaugcuaagagaaaaaaaagacu

SEQ ID NO: 2035649 - RNA, 17 nt, Homo sapiens
cagccccaauccagaga

SEQ ID NO: 2035650 - RNA, 15 nt, Homo sapiens
ccgagacccaccauc

SEQ ID NO: 2035651 - RNA, 16 nt, Homo sapiens
ugaaugugcuggugaa

SEQ ID NO: 2035652 - RNA, 18 nt, Homo sapiens
aggaauauaugugugccu

SEQ ID NO: 2035653 - RNA, 21 nt, Homo sapiens
uuauuauuugacaacaaucca

SEQ ID NO: 2035654 - RNA, 21 nt, Homo sapiens
cuuacaggcauggacaugcag

SEQ ID NO: 2035655 - RNA, 16 nt, Homo sapiens
agccucugaaaaccaa

SEQ ID NO: 2035656 - RNA, 13 nt, Homo sapiens
uaucccugcacac

SEQ ID NO: 2035657 - RNA, 12 nt, Homo sapiens
caauuauuacca

SEQ ID NO: 2035658 - RNA, 21 nt, Homo sapiens
agccuaaaaauaaagcacaaa

SEQ ID NO: 2035659 - RNA, 24 nt, Homo sapiens
gcaggagggaggguuucucuccca

SEQ ID NO: 2035660 - RNA, 17 nt, Homo sapiens
gcuccacgaagccuuaa

SEQ ID NO: 2035661 - RNA, 18 nt, Homo sapiens
uuaugccggaugugcuuu

SEQ ID NO: 2035662 - RNA, 18 nt, Homo sapiens
aucaagauauauguguau

SEQ ID NO: 2035663 - RNA, 20 nt, Homo sapiens
gcaggauuuggcuaugacau

SEQ ID NO: 2035664 - RNA, 20 nt, Homo sapiens
accacagcaaggcaccugca

SEQ ID NO: 2035665 - RNA, 15 nt, Homo sapiens
gugggaguagugcuu

SEQ ID NO: 2035666 - RNA, 22 nt, Homo sapiens
uggaacuggccacgcacaggcu

SEQ ID NO: 2035667 - RNA, 12 nt, Homo sapiens
uuaacucaggag

SEQ ID NO: 2035668 - RNA, 15 nt, Homo sapiens
uagagagagaacuuu

SEQ ID NO: 2035669 - RNA, 15 nt, Homo sapiens
cucuuauaaaaucaa

SEQ ID NO: 2035670 - RNA, 23 nt, Homo sapiens
uuucuacguggauguucuccuga

SEQ ID NO: 2035671 - RNA, 17 nt, Homo sapiens
acuauauuuauacugua

SEQ ID NO: 2035672 - RNA, 22 nt, Homo sapiens
cagauugugauaagaaaagcca

SEQ ID NO: 2035673 - RNA, 19 nt, Homo sapiens
gauacuaauagaguacuua

SEQ ID NO: 2035674 - RNA, 19 nt, Homo sapiens
gaaaacacuaguaccuuca

SEQ ID NO: 2035675 - RNA, 22 nt, Homo sapiens
cuggaagauuuaugaacagaaa

SEQ ID NO: 2035676 - RNA, 23 nt, Homo sapiens
ugagagggagggcugcugccaca

SEQ ID NO: 2035677 - RNA, 19 nt, Homo sapiens
auauauaguuguacauaua

SEQ ID NO: 2035678 - RNA, 16 nt, Homo sapiens
aaacuacugaacuguu

SEQ ID NO: 2035679 - RNA, 16 nt, Homo sapiens
augcucauugaacuuu

SEQ ID NO: 2035680 - RNA, 15 nt, Homo sapiens
ccucugacucaccac

SEQ ID NO: 2035681 - RNA, 15 nt, Homo sapiens
caagugccuaugcaa

SEQ ID NO: 2035682 - RNA, 21 nt, Homo sapiens
cuaaagaaaaauaucuuggcc

SEQ ID NO: 2035683 - RNA, 12 nt, Homo sapiens
uagaccauuaau

SEQ ID NO: 2035684 - RNA, 13 nt, Homo sapiens
auucagaucaaaa

SEQ ID NO: 2035685 - RNA, 15 nt, Homo sapiens
auauuuuugugcaca

SEQ ID NO: 2035686 - RNA, 20 nt, Homo sapiens
gcugccccuugcaagccaua

SEQ ID NO: 2035687 - RNA, 20 nt, Homo sapiens
aagcgauucucuugccucag

SEQ ID NO: 2035688 - RNA, 22 nt, Homo sapiens
auuugcuagagggagggagcag

SEQ ID NO: 2035689 - RNA, 17 nt, Homo sapiens
gaagcuugguccacuug

SEQ ID NO: 2035690 - RNA, 21 nt, Homo sapiens
accuucggagaguaaugccac

SEQ ID NO: 2035691 - RNA, 23 nt, Homo sapiens
cuguccccucuccccucauggag

SEQ ID NO: 2035692 - RNA, 21 nt, Homo sapiens
agugagcuccugccuuagggc

SEQ ID NO: 2035693 - RNA, 16 nt, Homo sapiens
accaaaugacaaguca

SEQ ID NO: 2035694 - RNA, 20 nt, Homo sapiens
auccuuuagguaagaaguuu

SEQ ID NO: 2035695 - RNA, 11 nt, Homo sapiens
cagcucaaagg

SEQ ID NO: 2035696 - RNA, 15 nt, Homo sapiens
guuuacaguguuccg

SEQ ID NO: 2035697 - RNA, 18 nt, Homo sapiens
uccauaucagaagugcca

SEQ ID NO: 2035698 - RNA, 23 nt, Homo sapiens
uucucuaugauaauuacaauaca

SEQ ID NO: 2035699 - RNA, 20 nt, Homo sapiens
agaugccugggugcaaagaa

SEQ ID NO: 2035700 - RNA, 20 nt, Homo sapiens
auagugauagagugcaguga

SEQ ID NO: 2035701 - RNA, 19 nt, Homo sapiens
cucugaagcuaauuguacu

SEQ ID NO: 2035702 - RNA, 17 nt, Homo sapiens
caggcccaaugcugcuu

SEQ ID NO: 2035703 - RNA, 21 nt, Homo sapiens
aaaccaggccuccaagccagg

SEQ ID NO: 2035704 - RNA, 18 nt, Homo sapiens
uggccucagcuggcugua

SEQ ID NO: 2035705 - RNA, 19 nt, Homo sapiens
cuuacuuucuuuacauacc

SEQ ID NO: 2035706 - RNA, 17 nt, Homo sapiens
gacuccaaccucaggga

SEQ ID NO: 2035707 - RNA, 19 nt, Homo sapiens
aaguacagaauuugaauua

SEQ ID NO: 2035708 - RNA, 22 nt, Homo sapiens
ccacaauuccuccucuggccac

SEQ ID NO: 2035709 - RNA, 11 nt, Homo sapiens
uugguggcaug

SEQ ID NO: 2035710 - RNA, 11 nt, Homo sapiens
uagguggcaag

SEQ ID NO: 2035711 - RNA, 18 nt, Homo sapiens
ucagaagucaucuugcua

SEQ ID NO: 2035712 - RNA, 16 nt, Homo sapiens
acauguaucacucacu

SEQ ID NO: 2035713 - RNA, 17 nt, Homo sapiens
aucccugaaacaucuca

SEQ ID NO: 2035714 - RNA, 23 nt, Homo sapiens
ucagguccgugggccguaucugu

SEQ ID NO: 2035715 - RNA, 15 nt, Homo sapiens
cacaggacacaguca

SEQ ID NO: 2035716 - RNA, 17 nt, Homo sapiens
gcccccugaccuuccaa

SEQ ID NO: 2035717 - RNA, 14 nt, Homo sapiens
ucacaucucaggga

SEQ ID NO: 2035718 - RNA, 17 nt, Homo sapiens
uaguauauuaaaaaugg

SEQ ID NO: 2035719 - RNA, 16 nt, Homo sapiens
gcauagagugaccuuu

SEQ ID NO: 2035720 - RNA, 14 nt, Homo sapiens
aggacugcauuguu

SEQ ID NO: 2035721 - RNA, 15 nt, Homo sapiens
caaauguauagacuu

SEQ ID NO: 2035722 - RNA, 17 nt, Homo sapiens
acacccaccucugccac

SEQ ID NO: 2035723 - RNA, 19 nt, Homo sapiens
ccagucccagcuaacucug

SEQ ID NO: 2035724 - RNA, 13 nt, Homo sapiens
guauaucuucuac

SEQ ID NO: 2035725 - RNA, 17 nt, Homo sapiens
ugaauuauugacacuga

SEQ ID NO: 2035726 - RNA, 20 nt, Homo sapiens
caguaccccugguaaaccaa

SEQ ID NO: 2035727 - RNA, 19 nt, Homo sapiens
uucaccuuuauauauguac

SEQ ID NO: 2035728 - RNA, 23 nt, Homo sapiens
ggaaccccaggaggccugcagcc

SEQ ID NO: 2035729 - RNA, 19 nt, Homo sapiens
agcuuucagagccagugaa

SEQ ID NO: 2035730 - RNA, 19 nt, Homo sapiens
aagguccacaggucuagac

SEQ ID NO: 2035731 - RNA, 23 nt, Homo sapiens
augagcacacacacaccaaugcg

SEQ ID NO: 2035732 - RNA, 12 nt, Homo sapiens
cugaaagccagg

SEQ ID NO: 2035733 - RNA, 14 nt, Homo sapiens
aagaauaaaaugca

SEQ ID NO: 2035734 - RNA, 19 nt, Homo sapiens
uuggcuaguaaaagccauc

SEQ ID NO: 2035735 - RNA, 12 nt, Homo sapiens
acuagcuuuuaa

SEQ ID NO: 2035736 - RNA, 14 nt, Homo sapiens
aguguuagaggugg

SEQ ID NO: 2035737 - RNA, 18 nt, Homo sapiens
aaacagcaauagugaaug

SEQ ID NO: 2035738 - RNA, 21 nt, Homo sapiens
ccucuggucgcuccugcccac

SEQ ID NO: 2035739 - RNA, 14 nt, Homo sapiens
ccaaaauacuacac

SEQ ID NO: 2035740 - RNA, 12 nt, Homo sapiens
cccucuggaucc

SEQ ID NO: 2035741 - RNA, 15 nt, Homo sapiens
gcucuuuggggucag

SEQ ID NO: 2035742 - RNA, 22 nt, Homo sapiens
ccagcaccggccccauuuaccc

SEQ ID NO: 2035743 - RNA, 13 nt, Homo sapiens
gcugucaucucag

SEQ ID NO: 2035744 - RNA, 19 nt, Homo sapiens
cugcugagugcaccacuuc

SEQ ID NO: 2035745 - RNA, 18 nt, Homo sapiens
augccaccuuccuugucc

SEQ ID NO: 2035746 - RNA, 12 nt, Homo sapiens
aauuaugaauga

SEQ ID NO: 2035747 - RNA, 21 nt, Homo sapiens
ugugacuuaaugccacuaaau

SEQ ID NO: 2035748 - RNA, 20 nt, Homo sapiens
gauguagucuuacucuguca

SEQ ID NO: 2035749 - RNA, 15 nt, Homo sapiens
cuagccaaagagcuc

SEQ ID NO: 2035750 - RNA, 20 nt, Homo sapiens
uggcuuuugccccagaaagg

SEQ ID NO: 2035751 - RNA, 20 nt, Homo sapiens
ccucuguccagccagcuccu

SEQ ID NO: 2035752 - RNA, 22 nt, Homo sapiens
uuuauugucggaagacuugcca

SEQ ID NO: 2035753 - RNA, 12 nt, Homo sapiens
gaaaaauuccag

SEQ ID NO: 2035754 - RNA, 22 nt, Homo sapiens
aucccuucuuccauccuuagag

SEQ ID NO: 2035755 - RNA, 20 nt, Homo sapiens
acugcuacuugcucugcucu

SEQ ID NO: 2035756 - RNA, 17 nt, Homo sapiens
aaggaaaaccagugggu

SEQ ID NO: 2035757 - RNA, 18 nt, Homo sapiens
gcacccagcccagauugu

SEQ ID NO: 2035758 - RNA, 21 nt, Homo sapiens
cuaaaguuuugcaacaauaaa

SEQ ID NO: 2035759 - RNA, 23 nt, Homo sapiens
uuaaguugagaacuuauguguuu

SEQ ID NO: 2035760 - RNA, 15 nt, Homo sapiens
aauugauucaaguga

SEQ ID NO: 2035761 - RNA, 12 nt, Homo sapiens
cgagaaacacag

SEQ ID NO: 2035762 - RNA, 13 nt, Homo sapiens
gaaaugugcugca

SEQ ID NO: 2035763 - RNA, 21 nt, Homo sapiens
uccuugucacagaaucuccau

SEQ ID NO: 2035764 - RNA, 18 nt, Homo sapiens
gaaauguaaacugccaua

SEQ ID NO: 2035765 - RNA, 21 nt, Homo sapiens
aaaucaaucaauggugcaaaa

SEQ ID NO: 2035766 - RNA, 22 nt, Homo sapiens
auuaauagaacacagagugugu

SEQ ID NO: 2035767 - RNA, 21 nt, Homo sapiens
uagcagucaucaucuuuuugu

SEQ ID NO: 2035768 - RNA, 16 nt, Homo sapiens
uuaccgagcacuguga

SEQ ID NO: 2035769 - RNA, 21 nt, Homo sapiens
gggaucuggugggcagucgaa

SEQ ID NO: 2035770 - RNA, 23 nt, Homo sapiens
ugugcacuuaguaguuuuuacaa

SEQ ID NO: 2035771 - RNA, 17 nt, Homo sapiens
uacugcaugcucaggac

SEQ ID NO: 2035772 - RNA, 15 nt, Homo sapiens
acccaccaguugaau

SEQ ID NO: 2035773 - RNA, 15 nt, Homo sapiens
uuucuucuuaaccua

SEQ ID NO: 2035774 - RNA, 22 nt, Homo sapiens
uaaauaaaaauaaaaauucaua

SEQ ID NO: 2035775 - RNA, 18 nt, Homo sapiens
uuugauaguuaacauuuc

SEQ ID NO: 2035776 - RNA, 10 nt, Homo sapiens
ugcuuugcau

SEQ ID NO: 2035777 - RNA, 13 nt, Homo sapiens
auaaguauuucca

SEQ ID NO: 2035778 - RNA, 20 nt, Homo sapiens
acaggcugagaacucguuca

SEQ ID NO: 2035779 - RNA, 17 nt, Homo sapiens
acccaguauuacugcug

SEQ ID NO: 2035780 - RNA, 17 nt, Homo sapiens
gcccagcuauacuguau

SEQ ID NO: 2035781 - RNA, 21 nt, Homo sapiens
cuugucuuuugagcuauucac

SEQ ID NO: 2035782 - RNA, 15 nt, Homo sapiens
cuuuaaagauguaau

SEQ ID NO: 2035783 - RNA, 15 nt, Homo sapiens
aagaaaugcauaaaa

SEQ ID NO: 2035784 - RNA, 20 nt, Homo sapiens
cacagucucugggagacuuu

SEQ ID NO: 2035785 - RNA, 20 nt, Homo sapiens
uaggugggggaacacugaga

SEQ ID NO: 2035786 - RNA, 19 nt, Homo sapiens
gccgccguggcuauaccug

SEQ ID NO: 2035787 - RNA, 16 nt, Homo sapiens
acccuaucuccugaca

SEQ ID NO: 2035788 - RNA, 16 nt, Homo sapiens
cuggugugaagguccu

SEQ ID NO: 2035789 - RNA, 21 nt, Homo sapiens
uuagucuguuguucuugaaaa

SEQ ID NO: 2035790 - RNA, 14 nt, Homo sapiens
caucugguaacuca

SEQ ID NO: 2035791 - RNA, 20 nt, Homo sapiens
gaacauggcggggcuuuccu

SEQ ID NO: 2035792 - RNA, 16 nt, Homo sapiens
uuacagacugaaaggu

SEQ ID NO: 2035793 - RNA, 12 nt, Homo sapiens
augaaacaacuc

SEQ ID NO: 2035794 - RNA, 17 nt, Homo sapiens
acaggcuggagugcagu

SEQ ID NO: 2035795 - RNA, 22 nt, Homo sapiens
ucauugggaaaggacagcuuug

SEQ ID NO: 2035796 - RNA, 21 nt, Homo sapiens
auugaugugguauaaaugccc

SEQ ID NO: 2035797 - RNA, 13 nt, Homo sapiens
uccagaacacaga

SEQ ID NO: 2035798 - RNA, 13 nt, Homo sapiens
uacagaacaaaga

SEQ ID NO: 2035799 - RNA, 16 nt, Homo sapiens
aaaaguuauguagaaa

SEQ ID NO: 2035800 - RNA, 21 nt, Homo sapiens
aagucagagacagauaccucc

SEQ ID NO: 2035801 - RNA, 19 nt, Homo sapiens
gugaccuccccuuccagac

SEQ ID NO: 2035802 - RNA, 14 nt, Homo sapiens
agaaaaaacuggaa

SEQ ID NO: 2035803 - RNA, 22 nt, Homo sapiens
aauauaggauagacacuggaca

SEQ ID NO: 2035804 - RNA, 22 nt, Homo sapiens
ccagccugggacucccagugaa

SEQ ID NO: 2035805 - RNA, 12 nt, Homo sapiens
gggccucuccag

SEQ ID NO: 2035806 - RNA, 20 nt, Homo sapiens
uuuccgguguuuaagacauu

SEQ ID NO: 2035807 - RNA, 22 nt, Homo sapiens
cuccagccugggugacagagcg

SEQ ID NO: 2035808 - RNA, 18 nt, Homo sapiens
ucaucacagcaugugcaa

SEQ ID NO: 2035809 - RNA, 17 nt, Homo sapiens
cauaucggcucacaaag

SEQ ID NO: 2035810 - RNA, 13 nt, Homo sapiens
aguugagaacaaa

SEQ ID NO: 2035811 - RNA, 14 nt, Homo sapiens
ccugaagugucgag

SEQ ID NO: 2035812 - RNA, 14 nt, Homo sapiens
cuuguuucacucca

SEQ ID NO: 2035813 - RNA, 14 nt, Homo sapiens
ugauauuuuaguca

SEQ ID NO: 2035814 - RNA, 20 nt, Homo sapiens
cuaaaucauauuaguauuaa

SEQ ID NO: 2035815 - RNA, 18 nt, Homo sapiens
ucuaucugcuuuugccua

SEQ ID NO: 2035816 - RNA, 20 nt, Homo sapiens
ucuccacucaguugcaacuu

SEQ ID NO: 2035817 - RNA, 20 nt, Homo sapiens
acagcuauuaaaauguaacu

SEQ ID NO: 2035818 - RNA, 15 nt, Homo sapiens
caucauugcuugcuu

SEQ ID NO: 2035819 - RNA, 17 nt, Homo sapiens
cuguggucuacccgugu

SEQ ID NO: 2035820 - RNA, 21 nt, Homo sapiens
aaaacuuuggaguccccucac

SEQ ID NO: 2035821 - RNA, 21 nt, Homo sapiens
uggacaguuuucugcuuuaau

SEQ ID NO: 2035822 - RNA, 20 nt, Homo sapiens
auaauucuguacauagccua

SEQ ID NO: 2035823 - RNA, 16 nt, Homo sapiens
auguacccgagcacau

SEQ ID NO: 2035824 - RNA, 15 nt, Homo sapiens
agacccccagcacuu

SEQ ID NO: 2035825 - RNA, 21 nt, Homo sapiens
cagaggccaguuaaaguagau

SEQ ID NO: 2035826 - RNA, 19 nt, Homo sapiens
uuuaaaauuaaaugcaugu

SEQ ID NO: 2035827 - RNA, 19 nt, Homo sapiens
cagaccuagggauccugag

SEQ ID NO: 2035828 - RNA, 19 nt, Homo sapiens
uagaaauugggcagucuua

SEQ ID NO: 2035829 - RNA, 19 nt, Homo sapiens
cuuccaugucaagauucag

SEQ ID NO: 2035830 - RNA, 14 nt, Homo sapiens
uggccuguaauccc

SEQ ID NO: 2035831 - RNA, 20 nt, Homo sapiens
cuuauaacaggaauaagcaa

SEQ ID NO: 2035832 - RNA, 20 nt, Homo sapiens
uaguaugaugcuuuacauuu

SEQ ID NO: 2035833 - RNA, 21 nt, Homo sapiens
uuagagccaggcacacacugu

SEQ ID NO: 2035834 - RNA, 14 nt, Homo sapiens
gcaagucacagaaa

SEQ ID NO: 2035835 - RNA, 10 nt, Homo sapiens
ugucuggccc

SEQ ID NO: 2035836 - RNA, 13 nt, Homo sapiens
aauaaauugaugg

SEQ ID NO: 2035837 - RNA, 20 nt, Homo sapiens
gcguaggagagaacagggau

SEQ ID NO: 2035838 - RNA, 15 nt, Homo sapiens
uaaugagaauagaaa

SEQ ID NO: 2035839 - RNA, 22 nt, Homo sapiens
aaugugauuuuucuucagguaa

SEQ ID NO: 2035840 - RNA, 21 nt, Homo sapiens
agagggcagcccccacuuucc

SEQ ID NO: 2035841 - RNA, 15 nt, Homo sapiens
ucauacuuaacuuua

SEQ ID NO: 2035842 - RNA, 22 nt, Homo sapiens
auuuauaucuaauuauuuccac

SEQ ID NO: 2035843 - RNA, 20 nt, Homo sapiens
uuaaucuuggauagcuaaua

SEQ ID NO: 2035844 - RNA, 16 nt, Homo sapiens
gacccccagugcucac

SEQ ID NO: 2035845 - RNA, 14 nt, Homo sapiens
cuagagcuuuuauu

SEQ ID NO: 2035846 - RNA, 22 nt, Homo sapiens
ugaagauuuaccucguucugcu

SEQ ID NO: 2035847 - RNA, 22 nt, Homo sapiens
agcuugaauauuguuuuugcac

SEQ ID NO: 2035848 - RNA, 22 nt, Homo sapiens
uuuuuauauucucagcagagug

SEQ ID NO: 2035849 - RNA, 14 nt, Homo sapiens
guggcgcgaucuca

SEQ ID NO: 2035850 - RNA, 18 nt, Homo sapiens
uaaagugccuaccccagc

SEQ ID NO: 2035851 - RNA, 19 nt, Homo sapiens
ccuucugauaagacuggaa

SEQ ID NO: 2035852 - RNA, 15 nt, Homo sapiens
ccaggucaacaucua

SEQ ID NO: 2035853 - RNA, 18 nt, Homo sapiens
aaggugacaaaaggcaga

SEQ ID NO: 2035854 - RNA, 18 nt, Homo sapiens
uugcuaggaacauguggu

SEQ ID NO: 2035855 - RNA, 12 nt, Homo sapiens
aaaacucaaaac

SEQ ID NO: 2035856 - RNA, 22 nt, Homo sapiens
uuaagccagggcacaaccagaa

SEQ ID NO: 2035857 - RNA, 21 nt, Homo sapiens
gcugccuggccuuguccucag

SEQ ID NO: 2035858 - RNA, 13 nt, Homo sapiens
acuuaaccuugaa

SEQ ID NO: 2035859 - RNA, 15 nt, Homo sapiens
uccuaaauaucucaa

SEQ ID NO: 2035860 - RNA, 16 nt, Homo sapiens
ucucugagauguguuc

SEQ ID NO: 2035861 - RNA, 15 nt, Homo sapiens
ccaggcgaugugcaa

SEQ ID NO: 2035862 - RNA, 14 nt, Homo sapiens
aacaccaagacuug

SEQ ID NO: 2035863 - RNA, 23 nt, Homo sapiens
uaggggugggaggaagcaaaaga

SEQ ID NO: 2035864 - RNA, 23 nt, Homo sapiens
aauaucccuuggacauuuuaugu

SEQ ID NO: 2035865 - RNA, 14 nt, Homo sapiens
guuaaaacuacuuu

SEQ ID NO: 2035866 - RNA, 21 nt, Homo sapiens
agcuacucaggagacugaguu

SEQ ID NO: 2035867 - RNA, 11 nt, Homo sapiens
augcaguaugc

SEQ ID NO: 2035868 - RNA, 16 nt, Homo sapiens
ccagcacuccaucacu

SEQ ID NO: 2035869 - RNA, 19 nt, Homo sapiens
caauaaaguuguugcauuc

SEQ ID NO: 2035870 - RNA, 14 nt, Homo sapiens
ucacucagcacuuu

SEQ ID NO: 2035871 - RNA, 23 nt, Homo sapiens
auuaacuuauugucuaggccaga

SEQ ID NO: 2035872 - RNA, 15 nt, Homo sapiens
gagacagucaggaag

SEQ ID NO: 2035873 - RNA, 14 nt, Homo sapiens
aucauuccuugaga

SEQ ID NO: 2035874 - RNA, 20 nt, Homo sapiens
acugaugcgaaaacuugaau

SEQ ID NO: 2035875 - RNA, 18 nt, Homo sapiens
cuucuauuccauggcuaa

SEQ ID NO: 2035876 - RNA, 22 nt, Homo sapiens
uucaggcucugcccaggaacuc

SEQ ID NO: 2035877 - RNA, 14 nt, Homo sapiens
uuguacuaaucuga

SEQ ID NO: 2035878 - RNA, 16 nt, Homo sapiens
aauaugaguaauacau

SEQ ID NO: 2035879 - RNA, 19 nt, Homo sapiens
acauuaugaugugugaaaa

SEQ ID NO: 2035880 - RNA, 18 nt, Homo sapiens
gccugaauagcuuggaaa

SEQ ID NO: 2035881 - RNA, 15 nt, Homo sapiens
gagcaugcuuaccuu

SEQ ID NO: 2035882 - RNA, 15 nt, Homo sapiens
acauucgaccuccau

SEQ ID NO: 2035883 - RNA, 15 nt, Homo sapiens
ggagcacuguucaca

SEQ ID NO: 2035884 - RNA, 12 nt, Homo sapiens
agccucugccag

SEQ ID NO: 2035885 - RNA, 15 nt, Homo sapiens
guacaaugugacuuu

SEQ ID NO: 2035886 - RNA, 21 nt, Homo sapiens
acuggcuuaccuccucauggc

SEQ ID NO: 2035887 - RNA, 16 nt, Homo sapiens
acucugauguggaaug

SEQ ID NO: 2035888 - RNA, 21 nt, Homo sapiens
agcuggcagccuccaguggga

SEQ ID NO: 2035889 - RNA, 15 nt, Homo sapiens
cccaucaccuacuca

SEQ ID NO: 2035890 - RNA, 14 nt, Homo sapiens
guaccuuguguacu

SEQ ID NO: 2035891 - RNA, 12 nt, Homo sapiens
agucaagcuccu

SEQ ID NO: 2035892 - RNA, 23 nt, Homo sapiens
cagaaucucauagguugccaaua

SEQ ID NO: 2035893 - RNA, 22 nt, Homo sapiens
uaucauuaaacaaauaaaauac

SEQ ID NO: 2035894 - RNA, 22 nt, Homo sapiens
uuaguggagaugggguuucacc

SEQ ID NO: 2035895 - RNA, 14 nt, Homo sapiens
gacugucaguucuc

SEQ ID NO: 2035896 - RNA, 11 nt, Homo sapiens
gagaagcaaaa

SEQ ID NO: 2035897 - RNA, 23 nt, Homo sapiens
guccccucuuuucccuucagucu

SEQ ID NO: 2035898 - RNA, 22 nt, Homo sapiens
ugguuguagugggaagucccgc

SEQ ID NO: 2035899 - RNA, 20 nt, Homo sapiens
ucaguaaagaacguggucag

SEQ ID NO: 2035900 - RNA, 20 nt, Homo sapiens
caccaaugggccuccagaga

SEQ ID NO: 2035901 - RNA, 18 nt, Homo sapiens
cauaccucugaccaacag

SEQ ID NO: 2035902 - RNA, 21 nt, Homo sapiens
acuggcccggaggacccagcu

SEQ ID NO: 2035903 - RNA, 13 nt, Homo sapiens
cuuucucugaggg

SEQ ID NO: 2035904 - RNA, 18 nt, Homo sapiens
ggagacuuugaguggcag

SEQ ID NO: 2035905 - RNA, 15 nt, Homo sapiens
agggcugagugcccu

SEQ ID NO: 2035906 - RNA, 17 nt, Homo sapiens
acgugauuuccagugag

SEQ ID NO: 2035907 - RNA, 18 nt, Homo sapiens
aaaugaaauuuaauuaca

SEQ ID NO: 2035908 - RNA, 19 nt, Homo sapiens
guugauguaaccgauucau

SEQ ID NO: 2035909 - RNA, 23 nt, Homo sapiens
uguacaauaaaaacauugccuuu

SEQ ID NO: 2035910 - RNA, 22 nt, Homo sapiens
uggauugugggaauuaaggaag

SEQ ID NO: 2035911 - RNA, 14 nt, Homo sapiens
gcuaauguaauaac

SEQ ID NO: 2035912 - RNA, 19 nt, Homo sapiens
ugcaauaaaauuauuugca

SEQ ID NO: 2035913 - RNA, 16 nt, Homo sapiens
gccucccuugucucag

SEQ ID NO: 2035914 - RNA, 22 nt, Homo sapiens
cauugaucuuuugcuaaugcaa

SEQ ID NO: 2035915 - RNA, 18 nt, Homo sapiens
cugacauucacacagaga

SEQ ID NO: 2035916 - RNA, 12 nt, Homo sapiens
ugaauucuggga

SEQ ID NO: 2035917 - RNA, 16 nt, Homo sapiens
ccuuugucuuggguga

SEQ ID NO: 2035918 - RNA, 16 nt, Homo sapiens
gacugggcaacacugc

SEQ ID NO: 2035919 - RNA, 23 nt, Homo sapiens
caaggaggccuggggaggcccua

SEQ ID NO: 2035920 - RNA, 18 nt, Homo sapiens
agcacaaucuguucuacu

SEQ ID NO: 2035921 - RNA, 22 nt, Homo sapiens
ucuccauguuugauguaucuga

SEQ ID NO: 2035922 - RNA, 19 nt, Homo sapiens
ugagguuucccccugucuc

SEQ ID NO: 2035923 - RNA, 23 nt, Homo sapiens
cgcuugaaccugggaaguggagg

SEQ ID NO: 2035924 - RNA, 21 nt, Homo sapiens
cuaucauucucucacaagaac

SEQ ID NO: 2035925 - RNA, 15 nt, Homo sapiens
caucucuuccucaca

SEQ ID NO: 2035926 - RNA, 23 nt, Homo sapiens
auugaucuuuggauguggcuuuu

SEQ ID NO: 2035927 - RNA, 14 nt, Homo sapiens
cauaggcagcacua

SEQ ID NO: 2035928 - RNA, 15 nt, Homo sapiens
aaagagggacaagag

SEQ ID NO: 2035929 - RNA, 12 nt, Homo sapiens
uaaccuggugcu

SEQ ID NO: 2035930 - RNA, 21 nt, Homo sapiens
ugcauguuuguuguauacuuc

SEQ ID NO: 2035931 - RNA, 18 nt, Homo sapiens
ccuaggaugucaugucug

SEQ ID NO: 2035932 - RNA, 18 nt, Homo sapiens
aaaagagaaugucuccau

SEQ ID NO: 2035933 - RNA, 12 nt, Homo sapiens
ccaaacacccuc

SEQ ID NO: 2035934 - RNA, 17 nt, Homo sapiens
aauaucuucacuuguca

SEQ ID NO: 2035935 - RNA, 20 nt, Homo sapiens
uccccuuuucuauguugcua

SEQ ID NO: 2035936 - RNA, 12 nt, Homo sapiens
cugagaagccaa

SEQ ID NO: 2035937 - RNA, 22 nt, Homo sapiens
agacuggagaaaugcuuacuuc

SEQ ID NO: 2035938 - RNA, 22 nt, Homo sapiens
uaaagcaguguuuucaccucau

SEQ ID NO: 2035939 - RNA, 17 nt, Homo sapiens
cacuauguggagcucag

SEQ ID NO: 2035940 - RNA, 21 nt, Homo sapiens
uggacuguuccaggcccucca

SEQ ID NO: 2035941 - RNA, 16 nt, Homo sapiens
gaacauucugucauca

SEQ ID NO: 2035942 - RNA, 16 nt, Homo sapiens
ugggugacaaagugag

SEQ ID NO: 2035943 - RNA, 20 nt, Homo sapiens
uggaaucccacuaaugcaaa

SEQ ID NO: 2035944 - RNA, 23 nt, Homo sapiens
agcugcuugugucccuccuggga

SEQ ID NO: 2035945 - RNA, 14 nt, Homo sapiens
cacagaaggaauaa

SEQ ID NO: 2035946 - RNA, 19 nt, Homo sapiens
aauuuuuuaaaaagcaaaa

SEQ ID NO: 2035947 - RNA, 21 nt, Homo sapiens
cucuguauuccuagaaacuga

SEQ ID NO: 2035948 - RNA, 21 nt, Homo sapiens
auaaacacuuguagagcagau

SEQ ID NO: 2035949 - RNA, 19 nt, Homo sapiens
uguauucuagcuaauguaa

SEQ ID NO: 2035950 - RNA, 16 nt, Homo sapiens
aauugaugaugcaguu

SEQ ID NO: 2035951 - RNA, 12 nt, Homo sapiens
cagaacaggaau

SEQ ID NO: 2035952 - RNA, 14 nt, Homo sapiens
aacagaaugcauug

SEQ ID NO: 2035953 - RNA, 22 nt, Homo sapiens
uguucgggccaaggaccugaga

SEQ ID NO: 2035954 - RNA, 16 nt, Homo sapiens
cagcuugcacauuugg

SEQ ID NO: 2035955 - RNA, 14 nt, Homo sapiens
ucuuccaccugcug

SEQ ID NO: 2035956 - RNA, 21 nt, Homo sapiens
uaaaaaaugaaaaacauuauu

SEQ ID NO: 2035957 - RNA, 20 nt, Homo sapiens
accccugcucuacccaugag

SEQ ID NO: 2035958 - RNA, 14 nt, Homo sapiens
auucaaaaagccaa

SEQ ID NO: 2035959 - RNA, 14 nt, Homo sapiens
cacuggcagccugc

SEQ ID NO: 2035960 - RNA, 16 nt, Homo sapiens
ggucucucuugcccca

SEQ ID NO: 2035961 - RNA, 19 nt, Homo sapiens
uagagaggacaauacuggg

SEQ ID NO: 2035962 - RNA, 18 nt, Homo sapiens
aguaggugugacuugaac

SEQ ID NO: 2035963 - RNA, 15 nt, Homo sapiens
ugaaucuuuuccacu

SEQ ID NO: 2035964 - RNA, 23 nt, Homo sapiens
aacuggaaggcugcuuucuccuu

SEQ ID NO: 2035965 - RNA, 15 nt, Homo sapiens
gaauugagcuagaaa

SEQ ID NO: 2035966 - RNA, 22 nt, Homo sapiens
guggcguuguugcauguuugaa

SEQ ID NO: 2035967 - RNA, 17 nt, Homo sapiens
cuuauaaagcauugcaa

SEQ ID NO: 2035968 - RNA, 20 nt, Homo sapiens
gaccaagagcaauugcagca

SEQ ID NO: 2035969 - RNA, 22 nt, Homo sapiens
gccacacugugggacucuucuu

SEQ ID NO: 2035970 - RNA, 22 nt, Homo sapiens
uuggcucguuugauccaguuga

SEQ ID NO: 2035971 - RNA, 21 nt, Homo sapiens
aaucuggcaggaaucuaucca

SEQ ID NO: 2035972 - RNA, 15 nt, Homo sapiens
agaagaaaacaaagu

SEQ ID NO: 2035973 - RNA, 21 nt, Homo sapiens
gaaaugaauagccaggccuga

SEQ ID NO: 2035974 - RNA, 23 nt, Homo sapiens
ugagcuaugauuacaccacugca

SEQ ID NO: 2035975 - RNA, 20 nt, Homo sapiens
ccgcccuugccgaaccagga

SEQ ID NO: 2035976 - RNA, 13 nt, Homo sapiens
aaauaugucaaga

SEQ ID NO: 2035977 - RNA, 13 nt, Homo sapiens
uugauaguuuaca

SEQ ID NO: 2035978 - RNA, 13 nt, Homo sapiens
auccugugcugcu

SEQ ID NO: 2035979 - RNA, 21 nt, Homo sapiens
uuaccuccauccauccuucca

SEQ ID NO: 2035980 - RNA, 20 nt, Homo sapiens
uggacuuauucauuccucac

SEQ ID NO: 2035981 - RNA, 17 nt, Homo sapiens
uccaggccucaguuucu

SEQ ID NO: 2035982 - RNA, 16 nt, Homo sapiens
guuggucccccuucca

SEQ ID NO: 2035983 - RNA, 14 nt, Homo sapiens
gcagagcucagagg

SEQ ID NO: 2035984 - RNA, 18 nt, Homo sapiens
cgaguugccagcucccau

SEQ ID NO: 2035985 - RNA, 15 nt, Homo sapiens
aaacuccuaauucaa

SEQ ID NO: 2035986 - RNA, 19 nt, Homo sapiens
gcaccaaaauuaugguguu

SEQ ID NO: 2035987 - RNA, 21 nt, Homo sapiens
agaaccacaagagaucagcag

SEQ ID NO: 2035988 - RNA, 18 nt, Homo sapiens
ucuccccuccucuugccu

SEQ ID NO: 2035989 - RNA, 20 nt, Homo sapiens
ggcaaaggcucucacuccag

SEQ ID NO: 2035990 - RNA, 14 nt, Homo sapiens
ucagcuuggggaca

SEQ ID NO: 2035991 - RNA, 14 nt, Homo sapiens
caaagaugugcaaa

SEQ ID NO: 2035992 - RNA, 12 nt, Homo sapiens
ucuugugcucag

SEQ ID NO: 2035993 - RNA, 14 nt, Homo sapiens
gagccgcugugagc

SEQ ID NO: 2035994 - RNA, 14 nt, Homo sapiens
ucccgguugugaga

SEQ ID NO: 2035995 - RNA, 21 nt, Homo sapiens
cuccacaaccaccuccagccu

SEQ ID NO: 2035996 - RNA, 21 nt, Homo sapiens
caaacucgcacaaccaugacg

SEQ ID NO: 2035997 - RNA, 14 nt, Homo sapiens
caaagugcauguca

SEQ ID NO: 2035998 - RNA, 17 nt, Homo sapiens
aaagccucugugcugca

SEQ ID NO: 2035999 - RNA, 19 nt, Homo sapiens
ucacaccacuugugagcug

SEQ ID NO: 2036000 - RNA, 12 nt, Homo sapiens
agccccggccac

SEQ ID NO: 2036001 - RNA, 16 nt, Homo sapiens
uccugccuuaacugau

SEQ ID NO: 2036002 - RNA, 22 nt, Homo sapiens
cuugcccagggugcagugugag

SEQ ID NO: 2036003 - RNA, 19 nt, Homo sapiens
ucuggagguacugagacag

SEQ ID NO: 2036004 - RNA, 15 nt, Homo sapiens
aucuuuucauuuagg

SEQ ID NO: 2036005 - RNA, 15 nt, Homo sapiens
agagugaauguguac

SEQ ID NO: 2036006 - RNA, 17 nt, Homo sapiens
gcuuucuuuccaauccu

SEQ ID NO: 2036007 - RNA, 13 nt, Homo sapiens
ugacacugugacc

SEQ ID NO: 2036008 - RNA, 21 nt, Homo sapiens
acccacguauucauucaguga

SEQ ID NO: 2036009 - RNA, 17 nt, Homo sapiens
ccaaugaaauacugaga

SEQ ID NO: 2036010 - RNA, 18 nt, Homo sapiens
aaucagucggcagucaug

SEQ ID NO: 2036011 - RNA, 19 nt, Homo sapiens
gccacaagggcaguggaag

SEQ ID NO: 2036012 - RNA, 14 nt, Homo sapiens
ggcacucagucucu

SEQ ID NO: 2036013 - RNA, 14 nt, Homo sapiens
auuuuacaaguaua

SEQ ID NO: 2036014 - RNA, 20 nt, Homo sapiens
ugaacagcucaccacugugc

SEQ ID NO: 2036015 - RNA, 19 nt, Homo sapiens
aguggacucagaaagccaa

SEQ ID NO: 2036016 - RNA, 13 nt, Homo sapiens
cugcugcuucugc

SEQ ID NO: 2036017 - RNA, 23 nt, Homo sapiens
acugguauguguggaugaugcug

SEQ ID NO: 2036018 - RNA, 22 nt, Homo sapiens
caacccgaguuaccacuuucca

SEQ ID NO: 2036019 - RNA, 14 nt, Homo sapiens
cucacuguugcagu

SEQ ID NO: 2036020 - RNA, 18 nt, Homo sapiens
uaaaagaagcaucucuga

SEQ ID NO: 2036021 - RNA, 17 nt, Homo sapiens
gagaucauccuuuccag

SEQ ID NO: 2036022 - RNA, 23 nt, Homo sapiens
aaauauuuguaauuuuacacaaa

SEQ ID NO: 2036023 - RNA, 19 nt, Homo sapiens
uugccacugcugugugauu

SEQ ID NO: 2036024 - RNA, 17 nt, Homo sapiens
uugcauacccaaaccag

SEQ ID NO: 2036025 - RNA, 16 nt, Homo sapiens
ucaggauuucaccaga

SEQ ID NO: 2036026 - RNA, 16 nt, Homo sapiens
aucucuaucucuuuau

SEQ ID NO: 2036027 - RNA, 22 nt, Homo sapiens
aaguuuaaaggacugauuugau

SEQ ID NO: 2036028 - RNA, 15 nt, Homo sapiens
auccuuuccucuagc

SEQ ID NO: 2036029 - RNA, 18 nt, Homo sapiens
aaugcuuuggaaaaaugg

SEQ ID NO: 2036030 - RNA, 16 nt, Homo sapiens
ccuccaugugggugcu

SEQ ID NO: 2036031 - RNA, 22 nt, Homo sapiens
uggcuccccuuuuucuuccuca

SEQ ID NO: 2036032 - RNA, 21 nt, Homo sapiens
auacugugaaguuacaugcau

SEQ ID NO: 2036033 - RNA, 18 nt, Homo sapiens
aggaggcgcccuuggcuu

SEQ ID NO: 2036034 - RNA, 23 nt, Homo sapiens
ucuuucaggauuauuuuaauuaa

SEQ ID NO: 2036035 - RNA, 22 nt, Homo sapiens
ccuggacgcagccacacagugg

SEQ ID NO: 2036036 - RNA, 15 nt, Homo sapiens
gaguuguucucaggg

SEQ ID NO: 2036037 - RNA, 14 nt, Homo sapiens
aagaguuuguuacc

SEQ ID NO: 2036038 - RNA, 24 nt, Homo sapiens
gagugcuaugaagacaggaucuag

SEQ ID NO: 2036039 - RNA, 15 nt, Homo sapiens
auacaaagcaguuua

SEQ ID NO: 2036040 - RNA, 13 nt, Homo sapiens
gaccaucccugaa

SEQ ID NO: 2036041 - RNA, 17 nt, Homo sapiens
aagggaagagcauguaa

SEQ ID NO: 2036042 - RNA, 16 nt, Homo sapiens
cugagagaccugaguc

SEQ ID NO: 2036043 - RNA, 17 nt, Homo sapiens
gauauuacugaaaggga

SEQ ID NO: 2036044 - RNA, 15 nt, Homo sapiens
uugauguaacugugu

SEQ ID NO: 2036045 - RNA, 23 nt, Homo sapiens
ggaagcgagcuuugcugggagag

SEQ ID NO: 2036046 - RNA, 21 nt, Homo sapiens
uccaguguacauaguguaaug

SEQ ID NO: 2036047 - RNA, 23 nt, Homo sapiens
cacucuuugaucagaaacagggu

SEQ ID NO: 2036048 - RNA, 20 nt, Homo sapiens
guguucuaagcaaugcaaau

SEQ ID NO: 2036049 - RNA, 20 nt, Homo sapiens
ucucaacuggguccagaaga

SEQ ID NO: 2036050 - RNA, 23 nt, Homo sapiens
aaagaucauuuauaauacuguuu

SEQ ID NO: 2036051 - RNA, 16 nt, Homo sapiens
ucaagugccuuuuugu

SEQ ID NO: 2036052 - RNA, 15 nt, Homo sapiens
aagcgauucucaugc

SEQ ID NO: 2036053 - RNA, 14 nt, Homo sapiens
uaagaauuucacaa

SEQ ID NO: 2036054 - RNA, 15 nt, Homo sapiens
cugagcacuuuugaa

SEQ ID NO: 2036055 - RNA, 14 nt, Homo sapiens
acgugcagccacac

SEQ ID NO: 2036056 - RNA, 16 nt, Homo sapiens
auucaccuucacuuag

SEQ ID NO: 2036057 - RNA, 15 nt, Homo sapiens
auuuugauuccuuga

SEQ ID NO: 2036058 - RNA, 23 nt, Homo sapiens
ucagauuuuaaaaagucuucacu

SEQ ID NO: 2036059 - RNA, 21 nt, Homo sapiens
guggaaagucaggcuagcugu

SEQ ID NO: 2036060 - RNA, 17 nt, Homo sapiens
uaccuucaugugguuca

SEQ ID NO: 2036061 - RNA, 13 nt, Homo sapiens
agacaauuugcac

SEQ ID NO: 2036062 - RNA, 12 nt, Homo sapiens
ccccacucccug

SEQ ID NO: 2036063 - RNA, 22 nt, Homo sapiens
uuagaacccauaaccauacaca

SEQ ID NO: 2036064 - RNA, 16 nt, Homo sapiens
uggaacccccaucucu

SEQ ID NO: 2036065 - RNA, 16 nt, Homo sapiens
gcugugugaccuggga

SEQ ID NO: 2036066 - RNA, 21 nt, Homo sapiens
uccuuuuuuauacacauaauu

SEQ ID NO: 2036067 - RNA, 13 nt, Homo sapiens
ucccuaucaaaac

SEQ ID NO: 2036068 - RNA, 18 nt, Homo sapiens
uguccauaagcuacgggu

SEQ ID NO: 2036069 - RNA, 18 nt, Homo sapiens
uuaauguaauaaagugaa

SEQ ID NO: 2036070 - RNA, 19 nt, Homo sapiens
ccuuuaacugacaagccau

SEQ ID NO: 2036071 - RNA, 17 nt, Homo sapiens
guacauguuaaacuuac

SEQ ID NO: 2036072 - RNA, 20 nt, Homo sapiens
cuguaugugccaaagcuuua

SEQ ID NO: 2036073 - RNA, 22 nt, Homo sapiens
auuuucuacuugccagcagagu

SEQ ID NO: 2036074 - RNA, 19 nt, Homo sapiens
uggagcaucauaauggacu

SEQ ID NO: 2036075 - RNA, 15 nt, Homo sapiens
gaaaauaaugcuguu

SEQ ID NO: 2036076 - RNA, 21 nt, Homo sapiens
ugugccauacuuguucuguau

SEQ ID NO: 2036077 - RNA, 18 nt, Homo sapiens
uguauuacacacaguuuu

SEQ ID NO: 2036078 - RNA, 19 nt, Homo sapiens
ucugauguguucucugauc

SEQ ID NO: 2036079 - RNA, 23 nt, Homo sapiens
gccuggcuuagaaggcacuggga

SEQ ID NO: 2036080 - RNA, 20 nt, Homo sapiens
uuccacagggauaccuuaau

SEQ ID NO: 2036081 - RNA, 16 nt, Homo sapiens
caaugacuuacuguac

SEQ ID NO: 2036082 - RNA, 23 nt, Homo sapiens
acacauuaaaggguagccuacaa

SEQ ID NO: 2036083 - RNA, 18 nt, Homo sapiens
auggcucaggcaagcccc

SEQ ID NO: 2036084 - RNA, 13 nt, Homo sapiens
augucaccucagc

SEQ ID NO: 2036085 - RNA, 16 nt, Homo sapiens
cucugggccaagucaa

SEQ ID NO: 2036086 - RNA, 21 nt, Homo sapiens
guacauuaaagauuucugcuc

SEQ ID NO: 2036087 - RNA, 16 nt, Homo sapiens
ccacaaccucuugggc

SEQ ID NO: 2036088 - RNA, 21 nt, Homo sapiens
cagagcccuucacugccauga

SEQ ID NO: 2036089 - RNA, 22 nt, Homo sapiens
gaauggucuggcaauauucugu

SEQ ID NO: 2036090 - RNA, 23 nt, Homo sapiens
acuaacucaaauacacauuugcu

SEQ ID NO: 2036091 - RNA, 14 nt, Homo sapiens
ggaauuacauaaca

SEQ ID NO: 2036092 - RNA, 17 nt, Homo sapiens
ggacaguccugggagaa

SEQ ID NO: 2036093 - RNA, 22 nt, Homo sapiens
ugguaaaguuagguacagagac

SEQ ID NO: 2036094 - RNA, 13 nt, Homo sapiens
auuuaaucugcug

SEQ ID NO: 2036095 - RNA, 21 nt, Homo sapiens
aacuccaucagaaaaccaaag

SEQ ID NO: 2036096 - RNA, 14 nt, Homo sapiens
ccaggugggagcca

SEQ ID NO: 2036097 - RNA, 17 nt, Homo sapiens
ggauugaagcccuccaa

SEQ ID NO: 2036098 - RNA, 15 nt, Homo sapiens
gauagaucuguguuu

SEQ ID NO: 2036099 - RNA, 17 nt, Homo sapiens
ucuggucacauggcugu

SEQ ID NO: 2036100 - RNA, 12 nt, Homo sapiens
cuggaaaacugg

SEQ ID NO: 2036101 - RNA, 17 nt, Homo sapiens
ggucaccugggcuguga

SEQ ID NO: 2036102 - RNA, 23 nt, Homo sapiens
agcuguguuucagccacacugaa

SEQ ID NO: 2036103 - RNA, 23 nt, Homo sapiens
guguuggggaaaccuucaucuga

SEQ ID NO: 2036104 - RNA, 13 nt, Homo sapiens
aucacuuuuggac

SEQ ID NO: 2036105 - RNA, 21 nt, Homo sapiens
aucuguccccugcuacuagau

SEQ ID NO: 2036106 - RNA, 17 nt, Homo sapiens
cggagguccuuuggaca

SEQ ID NO: 2036107 - RNA, 11 nt, Homo sapiens
agccacaggcc

SEQ ID NO: 2036108 - RNA, 14 nt, Homo sapiens
gacaucaaaaugag

SEQ ID NO: 2036109 - RNA, 20 nt, Homo sapiens
agcucaugguagaaaaccau

SEQ ID NO: 2036110 - RNA, 13 nt, Homo sapiens
agaguugccaaaa

SEQ ID NO: 2036111 - RNA, 13 nt, Homo sapiens
uccucucaucccc

SEQ ID NO: 2036112 - RNA, 14 nt, Homo sapiens
uauuuggguacaug

SEQ ID NO: 2036113 - RNA, 22 nt, Homo sapiens
cuucccagggaccagcaccuuc

SEQ ID NO: 2036114 - RNA, 13 nt, Homo sapiens
aguauugugauau

SEQ ID NO: 2036115 - RNA, 18 nt, Homo sapiens
uaaacauaugaaugcagc

SEQ ID NO: 2036116 - RNA, 16 nt, Homo sapiens
gaauaaugauaccucc

SEQ ID NO: 2036117 - RNA, 14 nt, Homo sapiens
cuuucuucugaaua

SEQ ID NO: 2036118 - RNA, 17 nt, Homo sapiens
aaaacucuuauggccaa

SEQ ID NO: 2036119 - RNA, 16 nt, Homo sapiens
uccaauuaguuuccuu

SEQ ID NO: 2036120 - RNA, 13 nt, Homo sapiens
gcuggucuccccc

SEQ ID NO: 2036121 - RNA, 21 nt, Homo sapiens
cuuucucccaggccaggcucc

SEQ ID NO: 2036122 - RNA, 18 nt, Homo sapiens
uucugcugcccaggccac

SEQ ID NO: 2036123 - RNA, 13 nt, Homo sapiens
caccucuggaucc

SEQ ID NO: 2036124 - RNA, 18 nt, Homo sapiens
caucucuuccccagagag

SEQ ID NO: 2036125 - RNA, 15 nt, Homo sapiens
aagguauugugcauc

SEQ ID NO: 2036126 - RNA, 17 nt, Homo sapiens
cacacacagccuauauc

SEQ ID NO: 2036127 - RNA, 22 nt, Homo sapiens
caucuguuccagaaaaacauuu

SEQ ID NO: 2036128 - RNA, 19 nt, Homo sapiens
aaguuauugauaaguucau

SEQ ID NO: 2036129 - RNA, 14 nt, Homo sapiens
ccuaucauguuaac

SEQ ID NO: 2036130 - RNA, 22 nt, Homo sapiens
aagaaauaauagaaaugucuca

SEQ ID NO: 2036131 - RNA, 17 nt, Homo sapiens
ggcugcggcuugcccag

SEQ ID NO: 2036132 - RNA, 20 nt, Homo sapiens
caugaaaaauauugcugaac

SEQ ID NO: 2036133 - RNA, 20 nt, Homo sapiens
aaaagucaggugcaguccca

SEQ ID NO: 2036134 - RNA, 23 nt, Homo sapiens
uaaguaaucucacagcauuugcc

SEQ ID NO: 2036135 - RNA, 23 nt, Homo sapiens
ucuagggaaauuuuucagacuuu

SEQ ID NO: 2036136 - RNA, 13 nt, Homo sapiens
auugcaggucucu

SEQ ID NO: 2036137 - RNA, 19 nt, Homo sapiens
uguguaggggagccacauu

SEQ ID NO: 2036138 - RNA, 20 nt, Homo sapiens
ucucagaguccagucaaguu

SEQ ID NO: 2036139 - RNA, 20 nt, Homo sapiens
ugccuuccucaguauccaca

SEQ ID NO: 2036140 - RNA, 16 nt, Homo sapiens
guacagaguaaccuau

SEQ ID NO: 2036141 - RNA, 15 nt, Homo sapiens
auucccgccuaauaa

SEQ ID NO: 2036142 - RNA, 14 nt, Homo sapiens
uguugagccuaaua

SEQ ID NO: 2036143 - RNA, 21 nt, Homo sapiens
cucacuuugaagagugugagg

SEQ ID NO: 2036144 - RNA, 20 nt, Homo sapiens
uccacucuugaucucucuug

SEQ ID NO: 2036145 - RNA, 19 nt, Homo sapiens
aaccaccgcauaugcaugc

SEQ ID NO: 2036146 - RNA, 23 nt, Homo sapiens
aagcuggagcaguugcuuuuuga

SEQ ID NO: 2036147 - RNA, 15 nt, Homo sapiens
gccugcacacaccug

SEQ ID NO: 2036148 - RNA, 14 nt, Homo sapiens
agcccgaagcccag

SEQ ID NO: 2036149 - RNA, 19 nt, Homo sapiens
gaagcagagagguggagaa

SEQ ID NO: 2036150 - RNA, 20 nt, Homo sapiens
ucagaagagggaacuaagca

SEQ ID NO: 2036151 - RNA, 15 nt, Homo sapiens
cagaccagcacuuca

SEQ ID NO: 2036152 - RNA, 20 nt, Homo sapiens
ugaagcuuucuuuccuacac

SEQ ID NO: 2036153 - RNA, 21 nt, Homo sapiens
uugggauauucugaaacuuga

SEQ ID NO: 2036154 - RNA, 21 nt, Homo sapiens
uccuguggcauguugauuucu

SEQ ID NO: 2036155 - RNA, 21 nt, Homo sapiens
agagccgcaaaucaaccccag

SEQ ID NO: 2036156 - RNA, 20 nt, Homo sapiens
cggguggaucacaaggucaa

SEQ ID NO: 2036157 - RNA, 17 nt, Homo sapiens
agaggcaucgccugcag

SEQ ID NO: 2036158 - RNA, 22 nt, Homo sapiens
auucaaaauguacuauguguua

SEQ ID NO: 2036159 - RNA, 17 nt, Homo sapiens
auaaauguaucugaaua

SEQ ID NO: 2036160 - RNA, 15 nt, Homo sapiens
gggggagcaccagcg

SEQ ID NO: 2036161 - RNA, 19 nt, Homo sapiens
aaagugguaaauacuguga

SEQ ID NO: 2036162 - RNA, 22 nt, Homo sapiens
cacggagggggacggggcucag

SEQ ID NO: 2036163 - RNA, 20 nt, Homo sapiens
uccucaucgacacuuacucc

SEQ ID NO: 2036164 - RNA, 17 nt, Homo sapiens
guuggcggggggcugca

SEQ ID NO: 2036165 - RNA, 17 nt, Homo sapiens
agucaauaaacuuguag

SEQ ID NO: 2036166 - RNA, 15 nt, Homo sapiens
uuuuaauuuacuugu

SEQ ID NO: 2036167 - RNA, 15 nt, Homo sapiens
agcuguuggauuuca

SEQ ID NO: 2036168 - RNA, 11 nt, Homo sapiens
aaaagugcagu

SEQ ID NO: 2036169 - RNA, 21 nt, Homo sapiens
aaugcagugccuuucuucucu

SEQ ID NO: 2036170 - RNA, 22 nt, Homo sapiens
agucacucuuaugcuguaccca

SEQ ID NO: 2036171 - RNA, 17 nt, Homo sapiens
acaucaaugaugaggcu

SEQ ID NO: 2036172 - RNA, 15 nt, Homo sapiens
ucccagaaccuugau

SEQ ID NO: 2036173 - RNA, 19 nt, Homo sapiens
aguucaggcucugagacac

SEQ ID NO: 2036174 - RNA, 11 nt, Homo sapiens
gaacagccaga

SEQ ID NO: 2036175 - RNA, 20 nt, Homo sapiens
uccaugggaugguuagugug

SEQ ID NO: 2036176 - RNA, 16 nt, Homo sapiens
guguugagggugucac

SEQ ID NO: 2036177 - RNA, 23 nt, Homo sapiens
auuuuuuaaaacaagccaagaaa

SEQ ID NO: 2036178 - RNA, 13 nt, Homo sapiens
cucuguacagcug

SEQ ID NO: 2036179 - RNA, 15 nt, Homo sapiens
accuugcuccugugu

SEQ ID NO: 2036180 - RNA, 22 nt, Homo sapiens
gaaaugccgggcacaggccagg

SEQ ID NO: 2036181 - RNA, 12 nt, Homo sapiens
uaaaacuuuccu

SEQ ID NO: 2036182 - RNA, 15 nt, Homo sapiens
cacugggaguguccu

SEQ ID NO: 2036183 - RNA, 17 nt, Homo sapiens
agaaagcccucuaggaa

SEQ ID NO: 2036184 - RNA, 16 nt, Homo sapiens
auuaucacgcagauca

SEQ ID NO: 2036185 - RNA, 21 nt, Homo sapiens
aguuugcccaccacaacuaac

SEQ ID NO: 2036186 - RNA, 20 nt, Homo sapiens
caaguucuuagggcacauga

SEQ ID NO: 2036187 - RNA, 23 nt, Homo sapiens
gaacaaauucuuuaguacucaau

SEQ ID NO: 2036188 - RNA, 19 nt, Homo sapiens
uaauuccaauuauaugaga

SEQ ID NO: 2036189 - RNA, 20 nt, Homo sapiens
agagacgggguuugccaugc

SEQ ID NO: 2036190 - RNA, 20 nt, Homo sapiens
gcauaaaagacaagcacuuu

SEQ ID NO: 2036191 - RNA, 11 nt, Homo sapiens
auuucuaaucc

SEQ ID NO: 2036192 - RNA, 23 nt, Homo sapiens
gaagggccuucuccacagggaca

SEQ ID NO: 2036193 - RNA, 14 nt, Homo sapiens
ugccggaucugggc

SEQ ID NO: 2036194 - RNA, 13 nt, Homo sapiens
ucagcucuuggcu

SEQ ID NO: 2036195 - RNA, 14 nt, Homo sapiens
agugccuaccccag

SEQ ID NO: 2036196 - RNA, 13 nt, Homo sapiens
uaaaaagaggcau

SEQ ID NO: 2036197 - RNA, 23 nt, Homo sapiens
cagauuuauuuuugaaacaaaca

SEQ ID NO: 2036198 - RNA, 21 nt, Homo sapiens
gacccucauggcccccagggg

SEQ ID NO: 2036199 - RNA, 20 nt, Homo sapiens
caggacuugcuaaagcacuu

SEQ ID NO: 2036200 - RNA, 15 nt, Homo sapiens
gagagaagaaagugu

SEQ ID NO: 2036201 - RNA, 12 nt, Homo sapiens
gaccaaugcauu

SEQ ID NO: 2036202 - RNA, 22 nt, Homo sapiens
aauaacucuuauaacacaacaa

SEQ ID NO: 2036203 - RNA, 18 nt, Homo sapiens
caccgagugaggccauag

SEQ ID NO: 2036204 - RNA, 22 nt, Homo sapiens
ugauaaggggccuugcucugag

SEQ ID NO: 2036205 - RNA, 19 nt, Homo sapiens
aagcgagguccaagcacau

SEQ ID NO: 2036206 - RNA, 22 nt, Homo sapiens
acaaugccuagacuguguaugu

SEQ ID NO: 2036207 - RNA, 16 nt, Homo sapiens
aagguauugagacaua

SEQ ID NO: 2036208 - RNA, 17 nt, Homo sapiens
caacaguggugugguuc

SEQ ID NO: 2036209 - RNA, 21 nt, Homo sapiens
aagaauuuuaauauugccaua

SEQ ID NO: 2036210 - RNA, 21 nt, Homo sapiens
uuccucuuacgcucugcucaa

SEQ ID NO: 2036211 - RNA, 15 nt, Homo sapiens
agccgauucucugcc

SEQ ID NO: 2036212 - RNA, 22 nt, Homo sapiens
aaaagcagcucaagaacacaug

SEQ ID NO: 2036213 - RNA, 12 nt, Homo sapiens
uuccuaaauaua

SEQ ID NO: 2036214 - RNA, 19 nt, Homo sapiens
cuacaaguauuauuuuaca

SEQ ID NO: 2036215 - RNA, 18 nt, Homo sapiens
aucugagcaaaaugugaa

SEQ ID NO: 2036216 - RNA, 11 nt, Homo sapiens
acccuaccugc

SEQ ID NO: 2036217 - RNA, 17 nt, Homo sapiens
aucuuuccuuccucuca

SEQ ID NO: 2036218 - RNA, 20 nt, Homo sapiens
ugaccucgcccuccacaaau

SEQ ID NO: 2036219 - RNA, 11 nt, Homo sapiens
aacugugcucu

SEQ ID NO: 2036220 - RNA, 11 nt, Homo sapiens
uccugugcaau

SEQ ID NO: 2036221 - RNA, 20 nt, Homo sapiens
aucaauaggaaagcauaugc

SEQ ID NO: 2036222 - RNA, 20 nt, Homo sapiens
cuggauggccccuccuugca

SEQ ID NO: 2036223 - RNA, 21 nt, Homo sapiens
accaaguuccuuggccaugca

SEQ ID NO: 2036224 - RNA, 22 nt, Homo sapiens
uaaauauuacacaucaagcgau

SEQ ID NO: 2036225 - RNA, 18 nt, Homo sapiens
agaaucggcuuugcagug

SEQ ID NO: 2036226 - RNA, 17 nt, Homo sapiens
gcucugcccaccucucu

SEQ ID NO: 2036227 - RNA, 15 nt, Homo sapiens
agauucugaccuuaa

SEQ ID NO: 2036228 - RNA, 14 nt, Homo sapiens
ugauauaugcaugu

SEQ ID NO: 2036229 - RNA, 14 nt, Homo sapiens
uuaaguguuuugua

SEQ ID NO: 2036230 - RNA, 20 nt, Homo sapiens
cacugcuaugccauuucuuc

SEQ ID NO: 2036231 - RNA, 15 nt, Homo sapiens
aucuggaaccucagc

SEQ ID NO: 2036232 - RNA, 16 nt, Homo sapiens
gguggcaggugccuug

SEQ ID NO: 2036233 - RNA, 20 nt, Homo sapiens
ugaccuggaaaugaaugaaa

SEQ ID NO: 2036234 - RNA, 17 nt, Homo sapiens
cuccaucucucauccuc

SEQ ID NO: 2036235 - RNA, 18 nt, Homo sapiens
cuuuccauuaaaucaauc

SEQ ID NO: 2036236 - RNA, 13 nt, Homo sapiens
cuuggcugcauuu

SEQ ID NO: 2036237 - RNA, 15 nt, Homo sapiens
aaugucugaaaugga

SEQ ID NO: 2036238 - RNA, 20 nt, Homo sapiens
ucagacccagggguccaggc

SEQ ID NO: 2036239 - RNA, 22 nt, Homo sapiens
cucgaauaaaggaugggaccaa

SEQ ID NO: 2036240 - RNA, 16 nt, Homo sapiens
cucauggcagucccaa

SEQ ID NO: 2036241 - RNA, 16 nt, Homo sapiens
cugccucccaucucaa

SEQ ID NO: 2036242 - RNA, 22 nt, Homo sapiens
gaaugguggaguguagccucca

SEQ ID NO: 2036243 - RNA, 12 nt, Homo sapiens
ggggacagguga

SEQ ID NO: 2036244 - RNA, 22 nt, Homo sapiens
uauggcuucaaguuguaaaaau

SEQ ID NO: 2036245 - RNA, 20 nt, Homo sapiens
gugccucccaagcucagagc

SEQ ID NO: 2036246 - RNA, 16 nt, Homo sapiens
agaaauacaguacugu

SEQ ID NO: 2036247 - RNA, 13 nt, Homo sapiens
uaugcagugcugc

SEQ ID NO: 2036248 - RNA, 19 nt, Homo sapiens
ugaagguagaauguuuuca

SEQ ID NO: 2036249 - RNA, 14 nt, Homo sapiens
caaaaagacugugg

SEQ ID NO: 2036250 - RNA, 16 nt, Homo sapiens
cuguucucagcaucca

SEQ ID NO: 2036251 - RNA, 13 nt, Homo sapiens
auacagcugucca

SEQ ID NO: 2036252 - RNA, 15 nt, Homo sapiens
uuaaaaccaaaagaa

SEQ ID NO: 2036253 - RNA, 15 nt, Homo sapiens
aauuacccuuuugca

SEQ ID NO: 2036254 - RNA, 12 nt, Homo sapiens
aacaugacacuu

SEQ ID NO: 2036255 - RNA, 16 nt, Homo sapiens
uggaauucuacuggaa

SEQ ID NO: 2036256 - RNA, 15 nt, Homo sapiens
gccucagcuucucaa

SEQ ID NO: 2036257 - RNA, 17 nt, Homo sapiens
cacucccucugccuuca

SEQ ID NO: 2036258 - RNA, 13 nt, Homo sapiens
ccggccaccagau

SEQ ID NO: 2036259 - RNA, 18 nt, Homo sapiens
acggggaagccgagcucc

SEQ ID NO: 2036260 - RNA, 24 nt, Homo sapiens
acagaacugcuaaauacuguacau

SEQ ID NO: 2036261 - RNA, 14 nt, Homo sapiens
ugugcauuuuacua

SEQ ID NO: 2036262 - RNA, 16 nt, Homo sapiens
agggcucacucagcca

SEQ ID NO: 2036263 - RNA, 20 nt, Homo sapiens
ugauuuccuaauaugaucua

SEQ ID NO: 2036264 - RNA, 14 nt, Homo sapiens
cuucccucagauuu

SEQ ID NO: 2036265 - RNA, 18 nt, Homo sapiens
ugcaguuggacucucagg

SEQ ID NO: 2036266 - RNA, 22 nt, Homo sapiens
ucuacuuuccccagaggaccac

SEQ ID NO: 2036267 - RNA, 23 nt, Homo sapiens
gugguggcauacgccuguagucc

SEQ ID NO: 2036268 - RNA, 20 nt, Homo sapiens
uaugcagagccacagcugug

SEQ ID NO: 2036269 - RNA, 18 nt, Homo sapiens
auauugcugugagauugc

SEQ ID NO: 2036270 - RNA, 15 nt, Homo sapiens
agagagcaucugcaa

SEQ ID NO: 2036271 - RNA, 11 nt, Homo sapiens
caaugucuucc

SEQ ID NO: 2036272 - RNA, 17 nt, Homo sapiens
cagauccgcaugugucu

SEQ ID NO: 2036273 - RNA, 17 nt, Homo sapiens
ccacacuaccaguuuca

SEQ ID NO: 2036274 - RNA, 23 nt, Homo sapiens
gcaauaaauauuauuugaugaua

SEQ ID NO: 2036275 - RNA, 20 nt, Homo sapiens
aguccaggcccccagccccu

SEQ ID NO: 2036276 - RNA, 18 nt, Homo sapiens
aguagugcaccaucucac

SEQ ID NO: 2036277 - RNA, 14 nt, Homo sapiens
agacuugcauuuaa

SEQ ID NO: 2036278 - RNA, 15 nt, Homo sapiens
uaagauuaauagcau

SEQ ID NO: 2036279 - RNA, 15 nt, Homo sapiens
uuggagccugcagag

SEQ ID NO: 2036280 - RNA, 17 nt, Homo sapiens
uuauuaggcucagugac

SEQ ID NO: 2036281 - RNA, 17 nt, Homo sapiens
ugaagaacucaugugau

SEQ ID NO: 2036282 - RNA, 11 nt, Homo sapiens
ccaaagcacuu

SEQ ID NO: 2036283 - RNA, 11 nt, Homo sapiens
acaaagcaauu

SEQ ID NO: 2036284 - RNA, 18 nt, Homo sapiens
gcuggcauugaugggguu

SEQ ID NO: 2036285 - RNA, 22 nt, Homo sapiens
ccacaccuggcccuugcaaucu

SEQ ID NO: 2036286 - RNA, 22 nt, Homo sapiens
aauucaaugaaucaaauccaau

SEQ ID NO: 2036287 - RNA, 12 nt, Homo sapiens
ucuuuuuacaau

SEQ ID NO: 2036288 - RNA, 24 nt, Homo sapiens
aucuuuuauacauuuuagaaucag

SEQ ID NO: 2036289 - RNA, 14 nt, Homo sapiens
ggccagguagcaag

SEQ ID NO: 2036290 - RNA, 22 nt, Homo sapiens
cucuggucccagcauccagcug

SEQ ID NO: 2036291 - RNA, 20 nt, Homo sapiens
agaagggaacccccaaauuu

SEQ ID NO: 2036292 - RNA, 16 nt, Homo sapiens
gccucccgaguagcug

SEQ ID NO: 2036293 - RNA, 17 nt, Homo sapiens
cucuccccagcaaguga

SEQ ID NO: 2036294 - RNA, 15 nt, Homo sapiens
uuucaucacacuggg

SEQ ID NO: 2036295 - RNA, 21 nt, Homo sapiens
uguauuuaaaugaaagugaga

SEQ ID NO: 2036296 - RNA, 20 nt, Homo sapiens
ucaccccagcgagcucucaa

SEQ ID NO: 2036297 - RNA, 16 nt, Homo sapiens
agguugccugaaaaau

SEQ ID NO: 2036298 - RNA, 20 nt, Homo sapiens
gcaugaaagagaaagacuga

SEQ ID NO: 2036299 - RNA, 22 nt, Homo sapiens
uugagccacuccuuccuucagg

SEQ ID NO: 2036300 - RNA, 11 nt, Homo sapiens
gucaccuuccu

SEQ ID NO: 2036301 - RNA, 20 nt, Homo sapiens
uccuguuuaugcauucacaa

SEQ ID NO: 2036302 - RNA, 17 nt, Homo sapiens
gcugcugaaaaccaucu

SEQ ID NO: 2036303 - RNA, 14 nt, Homo sapiens
acugcccaccaaag

SEQ ID NO: 2036304 - RNA, 22 nt, Homo sapiens
ccaccugccugcaucugugaaa

SEQ ID NO: 2036305 - RNA, 17 nt, Homo sapiens
cauuuuaaugcaccuga

SEQ ID NO: 2036306 - RNA, 21 nt, Homo sapiens
ccagaggguagggcagcagau

SEQ ID NO: 2036307 - RNA, 15 nt, Homo sapiens
ucaccuucugccaug

SEQ ID NO: 2036308 - RNA, 14 nt, Homo sapiens
gcaguccuccgggg

SEQ ID NO: 2036309 - RNA, 23 nt, Homo sapiens
gcuccuaaggguagaaaacucca

SEQ ID NO: 2036310 - RNA, 16 nt, Homo sapiens
acagaguccugcagag

SEQ ID NO: 2036311 - RNA, 18 nt, Homo sapiens
cuauuuuuuguaaugugu

SEQ ID NO: 2036312 - RNA, 19 nt, Homo sapiens
acacagcaggacuccaucu

SEQ ID NO: 2036313 - RNA, 14 nt, Homo sapiens
aaucccaguacuug

SEQ ID NO: 2036314 - RNA, 18 nt, Homo sapiens
ugcauauaaaaugcuuua

SEQ ID NO: 2036315 - RNA, 12 nt, Homo sapiens
cugcugccagua

SEQ ID NO: 2036316 - RNA, 20 nt, Homo sapiens
gacgauuuuggaaaugagaa

SEQ ID NO: 2036317 - RNA, 18 nt, Homo sapiens
ggcuuguguguuucacuu

SEQ ID NO: 2036318 - RNA, 18 nt, Homo sapiens
cccagccacagcauuuau

SEQ ID NO: 2036319 - RNA, 15 nt, Homo sapiens
agggucccucugugu

SEQ ID NO: 2036320 - RNA, 17 nt, Homo sapiens
guucaaaaacaagacag

SEQ ID NO: 2036321 - RNA, 13 nt, Homo sapiens
gcugucaggauug

SEQ ID NO: 2036322 - RNA, 18 nt, Homo sapiens
uaacuauaacaaucacug

SEQ ID NO: 2036323 - RNA, 11 nt, Homo sapiens
ugugcaaaaau

SEQ ID NO: 2036324 - RNA, 22 nt, Homo sapiens
ucccagauguaaauagaacaac

SEQ ID NO: 2036325 - RNA, 18 nt, Homo sapiens
guaagagcuggugucuga

SEQ ID NO: 2036326 - RNA, 16 nt, Homo sapiens
uagggcucuaauuucc

SEQ ID NO: 2036327 - RNA, 15 nt, Homo sapiens
uaugaaaaucuccau

SEQ ID NO: 2036328 - RNA, 12 nt, Homo sapiens
uauguuucuccc

SEQ ID NO: 2036329 - RNA, 16 nt, Homo sapiens
uuuucauuuagugcua

SEQ ID NO: 2036330 - RNA, 21 nt, Homo sapiens
acaccuccuccugcugcucac

SEQ ID NO: 2036331 - RNA, 13 nt, Homo sapiens
ugcagcacgcugg

SEQ ID NO: 2036332 - RNA, 14 nt, Homo sapiens
uaacacuauccaau

SEQ ID NO: 2036333 - RNA, 16 nt, Homo sapiens
ccugauacaugacuga

SEQ ID NO: 2036334 - RNA, 15 nt, Homo sapiens
guguguggacagccc

SEQ ID NO: 2036335 - RNA, 19 nt, Homo sapiens
gagcuagaugugucuuacc

SEQ ID NO: 2036336 - RNA, 16 nt, Homo sapiens
uacauccaaagcagac

SEQ ID NO: 2036337 - RNA, 17 nt, Homo sapiens
gccaccagucacugucc

SEQ ID NO: 2036338 - RNA, 15 nt, Homo sapiens
gacagcucagaaaau

SEQ ID NO: 2036339 - RNA, 18 nt, Homo sapiens
aagcaaacacacucucac

SEQ ID NO: 2036340 - RNA, 16 nt, Homo sapiens
auaggaagauaugcca

SEQ ID NO: 2036341 - RNA, 14 nt, Homo sapiens
auuccacacugcac

SEQ ID NO: 2036342 - RNA, 20 nt, Homo sapiens
acuacuuugaaaacaauuca

SEQ ID NO: 2036343 - RNA, 18 nt, Homo sapiens
accugucuauaagagaau

SEQ ID NO: 2036344 - RNA, 15 nt, Homo sapiens
aauuguuuugcacuu

SEQ ID NO: 2036345 - RNA, 20 nt, Homo sapiens
uauaggugauguuugcucuu

SEQ ID NO: 2036346 - RNA, 18 nt, Homo sapiens
caucagacuccugugcaa

SEQ ID NO: 2036347 - RNA, 17 nt, Homo sapiens
ugcagcaggaagccagc

SEQ ID NO: 2036348 - RNA, 20 nt, Homo sapiens
guaguauuaaaaguugcauu

SEQ ID NO: 2036349 - RNA, 17 nt, Homo sapiens
aauccgaaaucagcagg

SEQ ID NO: 2036350 - RNA, 11 nt, Homo sapiens
uggagugcagu

SEQ ID NO: 2036351 - RNA, 19 nt, Homo sapiens
aaauggagaacaguuucau

SEQ ID NO: 2036352 - RNA, 21 nt, Homo sapiens
acaccucaggagcuuuacuca

SEQ ID NO: 2036353 - RNA, 18 nt, Homo sapiens
agaaaaacacaaacauuc

SEQ ID NO: 2036354 - RNA, 17 nt, Homo sapiens
gccaucaugccugacua

SEQ ID NO: 2036355 - RNA, 22 nt, Homo sapiens
caaauaaauguucaauggaugc

SEQ ID NO: 2036356 - RNA, 14 nt, Homo sapiens
aagagcuacuccca

SEQ ID NO: 2036357 - RNA, 19 nt, Homo sapiens
aaaacuguggcacuuuuca

SEQ ID NO: 2036358 - RNA, 19 nt, Homo sapiens
aaagucugucaugccaaaa

SEQ ID NO: 2036359 - RNA, 14 nt, Homo sapiens
uaugaccuaaguca

SEQ ID NO: 2036360 - RNA, 16 nt, Homo sapiens
guggauguaaagugau

SEQ ID NO: 2036361 - RNA, 15 nt, Homo sapiens
ugcgagagaaaggga

SEQ ID NO: 2036362 - RNA, 15 nt, Homo sapiens
ugauagggaacuggg

SEQ ID NO: 2036363 - RNA, 21 nt, Homo sapiens
uaaggaguaacuugcaaguuu

SEQ ID NO: 2036364 - RNA, 20 nt, Homo sapiens
cauuagcuuugggugccuuu

SEQ ID NO: 2036365 - RNA, 20 nt, Homo sapiens
agucuccauuguuuugccuu

SEQ ID NO: 2036366 - RNA, 14 nt, Homo sapiens
guaaauugcaaaua

SEQ ID NO: 2036367 - RNA, 19 nt, Homo sapiens
gccaggagucugugcucuu

SEQ ID NO: 2036368 - RNA, 19 nt, Homo sapiens
gaaguaagcaaagacuuuc

SEQ ID NO: 2036369 - RNA, 23 nt, Homo sapiens
aggaauuuuuuuaacuuaaggga

SEQ ID NO: 2036370 - RNA, 22 nt, Homo sapiens
ugcauuccuuacuugcacuguu

SEQ ID NO: 2036371 - RNA, 22 nt, Homo sapiens
cugugaucuaagcaguugcaau

SEQ ID NO: 2036372 - RNA, 18 nt, Homo sapiens
uacugguuucaguugaca

SEQ ID NO: 2036373 - RNA, 20 nt, Homo sapiens
auuaaccugaauuauuccaa

SEQ ID NO: 2036374 - RNA, 15 nt, Homo sapiens
uuauacguacauaca

SEQ ID NO: 2036375 - RNA, 21 nt, Homo sapiens
ucauccucacucaguccagcu

SEQ ID NO: 2036376 - RNA, 22 nt, Homo sapiens
ucuguauuuccccaacauguaa

SEQ ID NO: 2036377 - RNA, 18 nt, Homo sapiens
uacuugggaggcugaggc

SEQ ID NO: 2036378 - RNA, 20 nt, Homo sapiens
auacgcaucagacagaugga

SEQ ID NO: 2036379 - RNA, 14 nt, Homo sapiens
auuucauugcucag

SEQ ID NO: 2036380 - RNA, 15 nt, Homo sapiens
auaugaaaaucucca

SEQ ID NO: 2036381 - RNA, 14 nt, Homo sapiens
aagcuccacuguca

SEQ ID NO: 2036382 - RNA, 19 nt, Homo sapiens
caggugaaaauccaucuca

SEQ ID NO: 2036383 - RNA, 20 nt, Homo sapiens
agagaccaggcugugaaauc

SEQ ID NO: 2036384 - RNA, 17 nt, Homo sapiens
augucaucauacaugac

SEQ ID NO: 2036385 - RNA, 15 nt, Homo sapiens
gauauuuccauuucu

SEQ ID NO: 2036386 - RNA, 15 nt, Homo sapiens
gcuacuucccuuccu

SEQ ID NO: 2036387 - RNA, 22 nt, Homo sapiens
cuuucccagaaaaaaaaaaacu

SEQ ID NO: 2036388 - RNA, 23 nt, Homo sapiens
acucucuggugagcgaggacauu

SEQ ID NO: 2036389 - RNA, 20 nt, Homo sapiens
acaaaaaaugugcuguucaa

SEQ ID NO: 2036390 - RNA, 16 nt, Homo sapiens
uuaaagcacaugucuc

SEQ ID NO: 2036391 - RNA, 18 nt, Homo sapiens
uugauguuaacugagcua

SEQ ID NO: 2036392 - RNA, 14 nt, Homo sapiens
ggaauaaagcuucu

SEQ ID NO: 2036393 - RNA, 22 nt, Homo sapiens
ccuaguaagggaacuauggaaa

SEQ ID NO: 2036394 - RNA, 23 nt, Homo sapiens
auucuaaaacagacucaaugucc

SEQ ID NO: 2036395 - RNA, 15 nt, Homo sapiens
ugggcaacagagcaa

SEQ ID NO: 2036396 - RNA, 18 nt, Homo sapiens
auuaugaauuacauuugu

SEQ ID NO: 2036397 - RNA, 22 nt, Homo sapiens
cacuguccugggcgcccuggaa

SEQ ID NO: 2036398 - RNA, 22 nt, Homo sapiens
gggagagugucaaccagacaga

SEQ ID NO: 2036399 - RNA, 17 nt, Homo sapiens
ugccagagguaauguua

SEQ ID NO: 2036400 - RNA, 20 nt, Homo sapiens
caaauaaaguacuaaaucuc

SEQ ID NO: 2036401 - RNA, 17 nt, Homo sapiens
ucacugucuuuccuaga

SEQ ID NO: 2036402 - RNA, 13 nt, Homo sapiens
agagggcuuuauu

SEQ ID NO: 2036403 - RNA, 13 nt, Homo sapiens
auauggcuugagu

SEQ ID NO: 2036404 - RNA, 17 nt, Homo sapiens
uccgaugaguaaaaagu

SEQ ID NO: 2036405 - RNA, 16 nt, Homo sapiens
ugcuaaaagugcauuu

SEQ ID NO: 2036406 - RNA, 20 nt, Homo sapiens
uuccugacccucccuaccug

SEQ ID NO: 2036407 - RNA, 23 nt, Homo sapiens
cuuauuucagccaaaacauacca

SEQ ID NO: 2036408 - RNA, 18 nt, Homo sapiens
gcagugagcugagaucac

SEQ ID NO: 2036409 - RNA, 16 nt, Homo sapiens
ucaacaaauugcccuu

SEQ ID NO: 2036410 - RNA, 16 nt, Homo sapiens
cacugugaaauacacu

SEQ ID NO: 2036411 - RNA, 11 nt, Homo sapiens
cauaaagccau

SEQ ID NO: 2036412 - RNA, 11 nt, Homo sapiens
aauaaagcaau

SEQ ID NO: 2036413 - RNA, 11 nt, Homo sapiens
caaaaagccaa

SEQ ID NO: 2036414 - RNA, 20 nt, Homo sapiens
ucacuuuaauagaagggcaa

SEQ ID NO: 2036415 - RNA, 21 nt, Homo sapiens
agccaggagugcccccgggaa

SEQ ID NO: 2036416 - RNA, 17 nt, Homo sapiens
aaagacuguacaaagua

SEQ ID NO: 2036417 - RNA, 13 nt, Homo sapiens
aaaacacugugca

SEQ ID NO: 2036418 - RNA, 13 nt, Homo sapiens
gaaccacuaugaa

SEQ ID NO: 2036419 - RNA, 17 nt, Homo sapiens
ucugaguugagcacugg

SEQ ID NO: 2036420 - RNA, 20 nt, Homo sapiens
guccugaagaucaagccagu

SEQ ID NO: 2036421 - RNA, 16 nt, Homo sapiens
gaccagacacugccug

SEQ ID NO: 2036422 - RNA, 20 nt, Homo sapiens
aguacaauggcgugaucuca

SEQ ID NO: 2036423 - RNA, 20 nt, Homo sapiens
agugcaauggcgugaucucg

SEQ ID NO: 2036424 - RNA, 18 nt, Homo sapiens
acuaccauuguacccugc

SEQ ID NO: 2036425 - RNA, 18 nt, Homo sapiens
agcuuaaugacuuacuua

SEQ ID NO: 2036426 - RNA, 17 nt, Homo sapiens
aggcucgccaaggccua

SEQ ID NO: 2036427 - RNA, 15 nt, Homo sapiens
cagagggucaggguu

SEQ ID NO: 2036428 - RNA, 15 nt, Homo sapiens
ucgagugcauuugcu

SEQ ID NO: 2036429 - RNA, 21 nt, Homo sapiens
ccccugaccuuccaaaccuca

SEQ ID NO: 2036430 - RNA, 19 nt, Homo sapiens
uaauacauugaucaggcca

SEQ ID NO: 2036431 - RNA, 20 nt, Homo sapiens
ggauauuaggccaguugaag

SEQ ID NO: 2036432 - RNA, 12 nt, Homo sapiens
aauaaagcuuuu

SEQ ID NO: 2036433 - RNA, 14 nt, Homo sapiens
aaggaauacaauau

SEQ ID NO: 2036434 - RNA, 14 nt, Homo sapiens
cuuuccuuguggca

SEQ ID NO: 2036435 - RNA, 13 nt, Homo sapiens
ccaaauauaacca

SEQ ID NO: 2036436 - RNA, 21 nt, Homo sapiens
ucuuccaggucccagagggug

SEQ ID NO: 2036437 - RNA, 21 nt, Homo sapiens
uccaugacaguagcauacuga

SEQ ID NO: 2036438 - RNA, 16 nt, Homo sapiens
aaucuuugugccucaa

SEQ ID NO: 2036439 - RNA, 18 nt, Homo sapiens
ugccugggccuguucacg

SEQ ID NO: 2036440 - RNA, 18 nt, Homo sapiens
ucacuauucaaggaugac

SEQ ID NO: 2036441 - RNA, 18 nt, Homo sapiens
gaccacagaagacccgcu

SEQ ID NO: 2036442 - RNA, 13 nt, Homo sapiens
uccauucagaaag

SEQ ID NO: 2036443 - RNA, 14 nt, Homo sapiens
cucagccccacuga

SEQ ID NO: 2036444 - RNA, 15 nt, Homo sapiens
cuagagccagaccaa

SEQ ID NO: 2036445 - RNA, 15 nt, Homo sapiens
uucuuagguuuacug

SEQ ID NO: 2036446 - RNA, 18 nt, Homo sapiens
gcuguguauuuacaugaa

SEQ ID NO: 2036447 - RNA, 23 nt, Homo sapiens
aucacauucuguuuaucaagcca

SEQ ID NO: 2036448 - RNA, 11 nt, Homo sapiens
uauucuugagu

SEQ ID NO: 2036449 - RNA, 18 nt, Homo sapiens
cucaggaguuugagacca

SEQ ID NO: 2036450 - RNA, 19 nt, Homo sapiens
uuucaagaucaaacuucca

SEQ ID NO: 2036451 - RNA, 15 nt, Homo sapiens
ugcuucagaguuugu

SEQ ID NO: 2036452 - RNA, 12 nt, Homo sapiens
uuauaugugcac

SEQ ID NO: 2036453 - RNA, 22 nt, Homo sapiens
cuuuucuccccgccugcuccca

SEQ ID NO: 2036454 - RNA, 22 nt, Homo sapiens
cauuacuuaugaugaugaaggg

SEQ ID NO: 2036455 - RNA, 17 nt, Homo sapiens
acaaaauguucaguuua

SEQ ID NO: 2036456 - RNA, 20 nt, Homo sapiens
cggagaagagcuguucacag

SEQ ID NO: 2036457 - RNA, 13 nt, Homo sapiens
agccccgacucca

SEQ ID NO: 2036458 - RNA, 20 nt, Homo sapiens
cagaggccgcgcguccagcu

SEQ ID NO: 2036459 - RNA, 21 nt, Homo sapiens
aagacaaauugaucagugcuu

SEQ ID NO: 2036460 - RNA, 21 nt, Homo sapiens
uuauaagugaagugauacuau

SEQ ID NO: 2036461 - RNA, 13 nt, Homo sapiens
gucaauuccuuag

SEQ ID NO: 2036462 - RNA, 23 nt, Homo sapiens
cauggccgcuucuagagccucga

SEQ ID NO: 2036463 - RNA, 13 nt, Homo sapiens
gcacuuauucuca

SEQ ID NO: 2036464 - RNA, 22 nt, Homo sapiens
gaauccgccugcagaggacaga

SEQ ID NO: 2036465 - RNA, 18 nt, Homo sapiens
uuagugaaguugugcaac

SEQ ID NO: 2036466 - RNA, 15 nt, Homo sapiens
gucagagaaccuaau

SEQ ID NO: 2036467 - RNA, 20 nt, Homo sapiens
gcuucauugcacugaucuua

SEQ ID NO: 2036468 - RNA, 16 nt, Homo sapiens
gacagagggcacauga

SEQ ID NO: 2036469 - RNA, 12 nt, Homo sapiens
gaacugcaguga

SEQ ID NO: 2036470 - RNA, 16 nt, Homo sapiens
uccaaauaauuccaca

SEQ ID NO: 2036471 - RNA, 17 nt, Homo sapiens
ccuucccucuucuucuc

SEQ ID NO: 2036472 - RNA, 17 nt, Homo sapiens
caacacaaagacaugga

SEQ ID NO: 2036473 - RNA, 16 nt, Homo sapiens
gcuuugagcaacuaac

SEQ ID NO: 2036474 - RNA, 19 nt, Homo sapiens
caccucugccuuacaaaau

SEQ ID NO: 2036475 - RNA, 19 nt, Homo sapiens
cucccuggggaugugcuuu

SEQ ID NO: 2036476 - RNA, 13 nt, Homo sapiens
gaccuggaaccag

SEQ ID NO: 2036477 - RNA, 22 nt, Homo sapiens
uauuucacagcaaggaaauuca

SEQ ID NO: 2036478 - RNA, 18 nt, Homo sapiens
agagcuggcacccuguca

SEQ ID NO: 2036479 - RNA, 20 nt, Homo sapiens
ucuacuuuccugauguugau

SEQ ID NO: 2036480 - RNA, 12 nt, Homo sapiens
cuggauggggcu

SEQ ID NO: 2036481 - RNA, 17 nt, Homo sapiens
ugccucugaaacuuaau

SEQ ID NO: 2036482 - RNA, 17 nt, Homo sapiens
ccaaaauaaaucaucuu

SEQ ID NO: 2036483 - RNA, 16 nt, Homo sapiens
ccaaucacucuauaca

SEQ ID NO: 2036484 - RNA, 22 nt, Homo sapiens
ugugauggauuggacguuguga

SEQ ID NO: 2036485 - RNA, 13 nt, Homo sapiens
uaagacuacugaa

SEQ ID NO: 2036486 - RNA, 20 nt, Homo sapiens
aguugcugcuugugaucuca

SEQ ID NO: 2036487 - RNA, 15 nt, Homo sapiens
ucucgcuacauuucc

SEQ ID NO: 2036488 - RNA, 20 nt, Homo sapiens
gucuugauccucacugagaa

SEQ ID NO: 2036489 - RNA, 20 nt, Homo sapiens
ugggaggcacagcaaacugu

SEQ ID NO: 2036490 - RNA, 19 nt, Homo sapiens
cauagaaaaaaguagcaaa

SEQ ID NO: 2036491 - RNA, 16 nt, Homo sapiens
gaagagaaugugacag

SEQ ID NO: 2036492 - RNA, 16 nt, Homo sapiens
gauugguaugaugcug

SEQ ID NO: 2036493 - RNA, 18 nt, Homo sapiens
uagcgaguuuucugacca

SEQ ID NO: 2036494 - RNA, 22 nt, Homo sapiens
ccugucauucuagaaacaggaa

SEQ ID NO: 2036495 - RNA, 20 nt, Homo sapiens
acaucaaucuaaagauacag

SEQ ID NO: 2036496 - RNA, 22 nt, Homo sapiens
ccaggaugcccaccguuaggau

SEQ ID NO: 2036497 - RNA, 21 nt, Homo sapiens
aauguuauagcugcauuuguc

SEQ ID NO: 2036498 - RNA, 16 nt, Homo sapiens
ugaaugcugccacaac

SEQ ID NO: 2036499 - RNA, 21 nt, Homo sapiens
cuuagacuaguugaacaucuc

SEQ ID NO: 2036500 - RNA, 23 nt, Homo sapiens
cacaaggucauggccacacugug

SEQ ID NO: 2036501 - RNA, 21 nt, Homo sapiens
cagcauuugaugauagcagac

SEQ ID NO: 2036502 - RNA, 20 nt, Homo sapiens
guuucuuucugugcugguaa

SEQ ID NO: 2036503 - RNA, 23 nt, Homo sapiens
ucaauuggguuuugaucucagca

SEQ ID NO: 2036504 - RNA, 14 nt, Homo sapiens
uuucacugcaaugu

SEQ ID NO: 2036505 - RNA, 20 nt, Homo sapiens
ggcgcagaggacaucaccug

SEQ ID NO: 2036506 - RNA, 21 nt, Homo sapiens
agcucccuccucccaucuccu

SEQ ID NO: 2036507 - RNA, 23 nt, Homo sapiens
accuuggagcauuuauguagaca

SEQ ID NO: 2036508 - RNA, 21 nt, Homo sapiens
uuuaagcaaguuaaguguccu

SEQ ID NO: 2036509 - RNA, 15 nt, Homo sapiens
aaucuccagucucau

SEQ ID NO: 2036510 - RNA, 16 nt, Homo sapiens
ucagacgugugaccuc

SEQ ID NO: 2036511 - RNA, 17 nt, Homo sapiens
agaaugaaccaauauga

SEQ ID NO: 2036512 - RNA, 12 nt, Homo sapiens
ugacuguuuaca

SEQ ID NO: 2036513 - RNA, 20 nt, Homo sapiens
uccuugguuuugccucuuua

SEQ ID NO: 2036514 - RNA, 16 nt, Homo sapiens
ccagcucagugccaaa

SEQ ID NO: 2036515 - RNA, 16 nt, Homo sapiens
guugaggaugcacugg

SEQ ID NO: 2036516 - RNA, 20 nt, Homo sapiens
ugaaaaugauaaaacagaau

SEQ ID NO: 2036517 - RNA, 14 nt, Homo sapiens
cauucaccuuccac

SEQ ID NO: 2036518 - RNA, 21 nt, Homo sapiens
ucaguaacacaauacaguacu

SEQ ID NO: 2036519 - RNA, 16 nt, Homo sapiens
acuuuugcugaugcuu

SEQ ID NO: 2036520 - RNA, 18 nt, Homo sapiens
cuuaaacugcugaauuca

SEQ ID NO: 2036521 - RNA, 17 nt, Homo sapiens
gauuguacgugggagag

SEQ ID NO: 2036522 - RNA, 16 nt, Homo sapiens
cauuccuuugucuuca

SEQ ID NO: 2036523 - RNA, 17 nt, Homo sapiens
gauggcaacuguauuaa

SEQ ID NO: 2036524 - RNA, 23 nt, Homo sapiens
augcaggcagcacagcagacuag

SEQ ID NO: 2036525 - RNA, 14 nt, Homo sapiens
gucccccccagugc

SEQ ID NO: 2036526 - RNA, 19 nt, Homo sapiens
auaaaugacaagugagaca

SEQ ID NO: 2036527 - RNA, 14 nt, Homo sapiens
ucaagcauauugga

SEQ ID NO: 2036528 - RNA, 15 nt, Homo sapiens
auaaaaccaccaaag

SEQ ID NO: 2036529 - RNA, 18 nt, Homo sapiens
ucuucuccauccucacac

SEQ ID NO: 2036530 - RNA, 19 nt, Homo sapiens
auaggcauuugauuuugcc

SEQ ID NO: 2036531 - RNA, 21 nt, Homo sapiens
acaaagagaaugagaagacau

SEQ ID NO: 2036532 - RNA, 15 nt, Homo sapiens
ugugaaacacagcug

SEQ ID NO: 2036533 - RNA, 21 nt, Homo sapiens
aauggaugcucauucauauuc

SEQ ID NO: 2036534 - RNA, 13 nt, Homo sapiens
aggccgccagacu

SEQ ID NO: 2036535 - RNA, 19 nt, Homo sapiens
gacaaaauggauacauaaa

SEQ ID NO: 2036536 - RNA, 22 nt, Homo sapiens
ucauauuucuuuucuaucucau

SEQ ID NO: 2036537 - RNA, 12 nt, Homo sapiens
ugaaaauguacu

SEQ ID NO: 2036538 - RNA, 19 nt, Homo sapiens
acaagauccuuaaugcaga

SEQ ID NO: 2036539 - RNA, 18 nt, Homo sapiens
aagugucuagacauauuu

SEQ ID NO: 2036540 - RNA, 16 nt, Homo sapiens
aggccucccacaguga

SEQ ID NO: 2036541 - RNA, 23 nt, Homo sapiens
aagaaagagcaacaauccaucuc

SEQ ID NO: 2036542 - RNA, 14 nt, Homo sapiens
uagucaguuacuga

SEQ ID NO: 2036543 - RNA, 20 nt, Homo sapiens
aagcugcggcccugaucucc

SEQ ID NO: 2036544 - RNA, 17 nt, Homo sapiens
uacuucggggcugggaa

SEQ ID NO: 2036545 - RNA, 14 nt, Homo sapiens
caauuuugucuauu

SEQ ID NO: 2036546 - RNA, 20 nt, Homo sapiens
aauauccagcgagagaaaga

SEQ ID NO: 2036547 - RNA, 12 nt, Homo sapiens
agcgcuguguua

SEQ ID NO: 2036548 - RNA, 14 nt, Homo sapiens
ucucagccuccuca

SEQ ID NO: 2036549 - RNA, 13 nt, Homo sapiens
aaauggacuugcu

SEQ ID NO: 2036550 - RNA, 12 nt, Homo sapiens
caugcuggugaa

SEQ ID NO: 2036551 - RNA, 13 nt, Homo sapiens
gacauccacagga

SEQ ID NO: 2036552 - RNA, 13 nt, Homo sapiens
gcuuccuaucugu

SEQ ID NO: 2036553 - RNA, 14 nt, Homo sapiens
uaaggcagugcagu

SEQ ID NO: 2036554 - RNA, 11 nt, Homo sapiens
auuacauguaa

SEQ ID NO: 2036555 - RNA, 20 nt, Homo sapiens
aucuguacgguucugugcaa

SEQ ID NO: 2036556 - RNA, 20 nt, Homo sapiens
cuggugccccucgccagcuu

SEQ ID NO: 2036557 - RNA, 17 nt, Homo sapiens
cugagggaaagugcaua

SEQ ID NO: 2036558 - RNA, 19 nt, Homo sapiens
acuuauggagcuaacauuu

SEQ ID NO: 2036559 - RNA, 22 nt, Homo sapiens
uucagcuguacuucgucuucua

SEQ ID NO: 2036560 - RNA, 19 nt, Homo sapiens
uguauucauauauugcauu

SEQ ID NO: 2036561 - RNA, 14 nt, Homo sapiens
gacaaaaagggugg

SEQ ID NO: 2036562 - RNA, 17 nt, Homo sapiens
gaauuucacaagcuauu

SEQ ID NO: 2036563 - RNA, 14 nt, Homo sapiens
aacaucugauuuga

SEQ ID NO: 2036564 - RNA, 22 nt, Homo sapiens
guggccccaccuggcccucucu

SEQ ID NO: 2036565 - RNA, 17 nt, Homo sapiens
cucagugugacuccuca

SEQ ID NO: 2036566 - RNA, 15 nt, Homo sapiens
caaaacaaucucuca

SEQ ID NO: 2036567 - RNA, 19 nt, Homo sapiens
acagcugggguggggaccu

SEQ ID NO: 2036568 - RNA, 14 nt, Homo sapiens
uuuuugcacuauug

SEQ ID NO: 2036569 - RNA, 20 nt, Homo sapiens
aaauaggcggggcuugccuu

SEQ ID NO: 2036570 - RNA, 14 nt, Homo sapiens
aacaggcuguagau

SEQ ID NO: 2036571 - RNA, 13 nt, Homo sapiens
auuccaaagcaaa

SEQ ID NO: 2036572 - RNA, 23 nt, Homo sapiens
accuuaaaugcuacugaaacuua

SEQ ID NO: 2036573 - RNA, 16 nt, Homo sapiens
gaaaaggguuucuuga

SEQ ID NO: 2036574 - RNA, 19 nt, Homo sapiens
cgccguggcuauaccuggg

SEQ ID NO: 2036575 - RNA, 22 nt, Homo sapiens
cuuuugugcaaagccaaaaccu

SEQ ID NO: 2036576 - RNA, 18 nt, Homo sapiens
guaaccaagaguauucca

SEQ ID NO: 2036577 - RNA, 18 nt, Homo sapiens
ccaacuguuggaauucac

SEQ ID NO: 2036578 - RNA, 13 nt, Homo sapiens
ugcuccauuguca

SEQ ID NO: 2036579 - RNA, 21 nt, Homo sapiens
gaugaaggcuugucagcacuu

SEQ ID NO: 2036580 - RNA, 15 nt, Homo sapiens
aaggauagugcgaug

SEQ ID NO: 2036581 - RNA, 22 nt, Homo sapiens
uccuacuccaguaugacagagg

SEQ ID NO: 2036582 - RNA, 13 nt, Homo sapiens
acugccaagccau

SEQ ID NO: 2036583 - RNA, 20 nt, Homo sapiens
gcucgugggauguccuacua

SEQ ID NO: 2036584 - RNA, 11 nt, Homo sapiens
auaucagugaa

SEQ ID NO: 2036585 - RNA, 11 nt, Homo sapiens
gauucaguauu

SEQ ID NO: 2036586 - RNA, 16 nt, Homo sapiens
augcacagugcauuau

SEQ ID NO: 2036587 - RNA, 19 nt, Homo sapiens
cgccccucaccaacccaga

SEQ ID NO: 2036588 - RNA, 15 nt, Homo sapiens
gugcaagucuuguca

SEQ ID NO: 2036589 - RNA, 17 nt, Homo sapiens
agggaccccugcccuug

SEQ ID NO: 2036590 - RNA, 16 nt, Homo sapiens
auaauuuguaguauaa

SEQ ID NO: 2036591 - RNA, 15 nt, Homo sapiens
caccuauuaucccag

SEQ ID NO: 2036592 - RNA, 18 nt, Homo sapiens
aaacuuggaugucacugc

SEQ ID NO: 2036593 - RNA, 12 nt, Homo sapiens
uaugcaguaugc

SEQ ID NO: 2036594 - RNA, 14 nt, Homo sapiens
caugauaggauuug

SEQ ID NO: 2036595 - RNA, 14 nt, Homo sapiens
cuccaccccacaga

SEQ ID NO: 2036596 - RNA, 13 nt, Homo sapiens
aacugucuuucau

SEQ ID NO: 2036597 - RNA, 13 nt, Homo sapiens
aagauucuuugug

SEQ ID NO: 2036598 - RNA, 21 nt, Homo sapiens
uucucugcaauuuuacuguga

SEQ ID NO: 2036599 - RNA, 15 nt, Homo sapiens
cagcacaguuuuuaa

SEQ ID NO: 2036600 - RNA, 14 nt, Homo sapiens
ccuaaaacaauccu

SEQ ID NO: 2036601 - RNA, 13 nt, Homo sapiens
auaagacuggaaa

SEQ ID NO: 2036602 - RNA, 15 nt, Homo sapiens
ucugcacuguucaaa

SEQ ID NO: 2036603 - RNA, 10 nt, Homo sapiens
uacaugacug

SEQ ID NO: 2036604 - RNA, 15 nt, Homo sapiens
uguccaagauaagau

SEQ ID NO: 2036605 - RNA, 18 nt, Homo sapiens
ucaaaaacacuugagaag

SEQ ID NO: 2036606 - RNA, 13 nt, Homo sapiens
ggaggcugcagug

SEQ ID NO: 2036607 - RNA, 17 nt, Homo sapiens
auucuacccuguugcaa

SEQ ID NO: 2036608 - RNA, 14 nt, Homo sapiens
auacuuagaccaaa

SEQ ID NO: 2036609 - RNA, 16 nt, Homo sapiens
gauuccauacagugac

SEQ ID NO: 2036610 - RNA, 17 nt, Homo sapiens
agccgcgggccaggagg

SEQ ID NO: 2036611 - RNA, 20 nt, Homo sapiens
accugggcuuaaguuuuacu

SEQ ID NO: 2036612 - RNA, 19 nt, Homo sapiens
caaaugcuacauauaugca

SEQ ID NO: 2036613 - RNA, 19 nt, Homo sapiens
ucuuaacuuugaaccauaa

SEQ ID NO: 2036614 - RNA, 22 nt, Homo sapiens
acgaugccgagaccucaagccc

SEQ ID NO: 2036615 - RNA, 16 nt, Homo sapiens
guuauggucaauccca

SEQ ID NO: 2036616 - RNA, 22 nt, Homo sapiens
cagugagccgagaucacaccac

SEQ ID NO: 2036617 - RNA, 17 nt, Homo sapiens
aaacugaaaaucuaaua

SEQ ID NO: 2036618 - RNA, 12 nt, Homo sapiens
gaaaaugaaucu

SEQ ID NO: 2036619 - RNA, 12 nt, Homo sapiens
auuuugcucaac

SEQ ID NO: 2036620 - RNA, 13 nt, Homo sapiens
cagcuccagugcc

SEQ ID NO: 2036621 - RNA, 14 nt, Homo sapiens
aagucuaaaaccuu

SEQ ID NO: 2036622 - RNA, 18 nt, Homo sapiens
uggggcgagcacugugag

SEQ ID NO: 2036623 - RNA, 14 nt, Homo sapiens
auuauagugaaaca

SEQ ID NO: 2036624 - RNA, 22 nt, Homo sapiens
uuaugauauaauaaauauauau

SEQ ID NO: 2036625 - RNA, 18 nt, Homo sapiens
gccguuuccccuccuugg

SEQ ID NO: 2036626 - RNA, 18 nt, Homo sapiens
aauguuugaguaccugau

SEQ ID NO: 2036627 - RNA, 14 nt, Homo sapiens
uacauuucauacaa

SEQ ID NO: 2036628 - RNA, 14 nt, Homo sapiens
ugaacgcacaugac

SEQ ID NO: 2036629 - RNA, 16 nt, Homo sapiens
ugaaaauaagauucca

SEQ ID NO: 2036630 - RNA, 11 nt, Homo sapiens
uggcuucuuac

SEQ ID NO: 2036631 - RNA, 17 nt, Homo sapiens
cugaauauaacaaccuu

SEQ ID NO: 2036632 - RNA, 16 nt, Homo sapiens
ggcacaaaugcaccuc

SEQ ID NO: 2036633 - RNA, 22 nt, Homo sapiens
uuccuauggcuggccacugcac

SEQ ID NO: 2036634 - RNA, 21 nt, Homo sapiens
cuaaccuggguuguugcagag

SEQ ID NO: 2036635 - RNA, 22 nt, Homo sapiens
gaaauguggucaucaaagauga

SEQ ID NO: 2036636 - RNA, 23 nt, Homo sapiens
cagaggagugcagccuucuccau

SEQ ID NO: 2036637 - RNA, 16 nt, Homo sapiens
guuuauuagaugaauu

SEQ ID NO: 2036638 - RNA, 13 nt, Homo sapiens
uuaagcacaagca

SEQ ID NO: 2036639 - RNA, 22 nt, Homo sapiens
agcccaaauauaaaaacagacu

SEQ ID NO: 2036640 - RNA, 18 nt, Homo sapiens
gcugacucuggccuuaca

SEQ ID NO: 2036641 - RNA, 16 nt, Homo sapiens
uucucuuuaaucucau

SEQ ID NO: 2036642 - RNA, 15 nt, Homo sapiens
guucuacccaggugc

SEQ ID NO: 2036643 - RNA, 22 nt, Homo sapiens
uccccagguguguuggggccuu

SEQ ID NO: 2036644 - RNA, 22 nt, Homo sapiens
ccuguucgugcuuguaaugcuc

SEQ ID NO: 2036645 - RNA, 12 nt, Homo sapiens
gacaaguaucau

SEQ ID NO: 2036646 - RNA, 11 nt, Homo sapiens
ggugucuguga

SEQ ID NO: 2036647 - RNA, 19 nt, Homo sapiens
ucaaauaguugcauagcag

SEQ ID NO: 2036648 - RNA, 14 nt, Homo sapiens
ggggaaugggaaga

SEQ ID NO: 2036649 - RNA, 14 nt, Homo sapiens
gggagcugggagac

SEQ ID NO: 2036650 - RNA, 22 nt, Homo sapiens
cuauuauaaaaucuuacuuugu

SEQ ID NO: 2036651 - RNA, 16 nt, Homo sapiens
uuaaacagaggugaug

SEQ ID NO: 2036652 - RNA, 16 nt, Homo sapiens
ugaaaaauaugugcuu

SEQ ID NO: 2036653 - RNA, 15 nt, Homo sapiens
caggcauuucaggaa

SEQ ID NO: 2036654 - RNA, 14 nt, Homo sapiens
gcagugacugccgu

SEQ ID NO: 2036655 - RNA, 23 nt, Homo sapiens
uggcuucccauuaaccugagguc

SEQ ID NO: 2036656 - RNA, 23 nt, Homo sapiens
uucugcagggaugauaguggaau

SEQ ID NO: 2036657 - RNA, 17 nt, Homo sapiens
aauuuucacuucugucu

SEQ ID NO: 2036658 - RNA, 18 nt, Homo sapiens
agacuucgcuaagggcuu

SEQ ID NO: 2036659 - RNA, 16 nt, Homo sapiens
uauaugaauuuccacu

SEQ ID NO: 2036660 - RNA, 15 nt, Homo sapiens
auagaauucagucaa

SEQ ID NO: 2036661 - RNA, 19 nt, Homo sapiens
agucaaacuuucaccucag

SEQ ID NO: 2036662 - RNA, 15 nt, Homo sapiens
aaguaaaacagucau

SEQ ID NO: 2036663 - RNA, 23 nt, Homo sapiens
aaaaugucauuguucuugugaac

SEQ ID NO: 2036664 - RNA, 21 nt, Homo sapiens
agauuaaauuacagcuuuuau

SEQ ID NO: 2036665 - RNA, 14 nt, Homo sapiens
ucugccucacauca

SEQ ID NO: 2036666 - RNA, 21 nt, Homo sapiens
ucugggguccauucucugagu

SEQ ID NO: 2036667 - RNA, 19 nt, Homo sapiens
guaaaacgcaccaaucagc

SEQ ID NO: 2036668 - RNA, 13 nt, Homo sapiens
aagaaaugugauu

SEQ ID NO: 2036669 - RNA, 15 nt, Homo sapiens
uaaacauuucauuuc

SEQ ID NO: 2036670 - RNA, 17 nt, Homo sapiens
auaauuaugucccaggg

SEQ ID NO: 2036671 - RNA, 19 nt, Homo sapiens
aaauguacuacauuugcau

SEQ ID NO: 2036672 - RNA, 13 nt, Homo sapiens
gaauguauuuuca

SEQ ID NO: 2036673 - RNA, 23 nt, Homo sapiens
ucaagagaucuuucuuuccaaaa

SEQ ID NO: 2036674 - RNA, 17 nt, Homo sapiens
acuugcaauaccaaugu

SEQ ID NO: 2036675 - RNA, 17 nt, Homo sapiens
gaggugggcagguggug

SEQ ID NO: 2036676 - RNA, 23 nt, Homo sapiens
cuuaacucacuggcgagaauaca

SEQ ID NO: 2036677 - RNA, 15 nt, Homo sapiens
aggccgacugggcug

SEQ ID NO: 2036678 - RNA, 16 nt, Homo sapiens
cacgacgaaaagacaa

SEQ ID NO: 2036679 - RNA, 16 nt, Homo sapiens
caaacagaaacacaaa

SEQ ID NO: 2036680 - RNA, 23 nt, Homo sapiens
agacaaaaaucaaagaacagaug

SEQ ID NO: 2036681 - RNA, 17 nt, Homo sapiens
gguaucagcaucugucc

SEQ ID NO: 2036682 - RNA, 17 nt, Homo sapiens
aggguauccugugcuau

SEQ ID NO: 2036683 - RNA, 20 nt, Homo sapiens
ucuugagggacaaugccaau

SEQ ID NO: 2036684 - RNA, 17 nt, Homo sapiens
ucacuguccauuccaaa

SEQ ID NO: 2036685 - RNA, 18 nt, Homo sapiens
uuuccucuugaaccagaa

SEQ ID NO: 2036686 - RNA, 15 nt, Homo sapiens
ucuccccguggaccc

SEQ ID NO: 2036687 - RNA, 18 nt, Homo sapiens
gcacacugugauuuugcc

SEQ ID NO: 2036688 - RNA, 18 nt, Homo sapiens
cccgcccacccuccugac

SEQ ID NO: 2036689 - RNA, 12 nt, Homo sapiens
uaacccuuuuuc

SEQ ID NO: 2036690 - RNA, 21 nt, Homo sapiens
cuucagagcugacacaggaug

SEQ ID NO: 2036691 - RNA, 16 nt, Homo sapiens
ggacuaugaaaagcua

SEQ ID NO: 2036692 - RNA, 17 nt, Homo sapiens
ucauugacuaaagccau

SEQ ID NO: 2036693 - RNA, 17 nt, Homo sapiens
uauuuccaucuaggacu

SEQ ID NO: 2036694 - RNA, 20 nt, Homo sapiens
guacauuuuuauacagugau

SEQ ID NO: 2036695 - RNA, 21 nt, Homo sapiens
agguuggagugcauucauuca

SEQ ID NO: 2036696 - RNA, 14 nt, Homo sapiens
gaaagccucacuga

SEQ ID NO: 2036697 - RNA, 22 nt, Homo sapiens
agaaacagugggagcccugacc

SEQ ID NO: 2036698 - RNA, 21 nt, Homo sapiens
ucacagagauaauucuagcuu

SEQ ID NO: 2036699 - RNA, 11 nt, Homo sapiens
uuuucuuacca

SEQ ID NO: 2036700 - RNA, 23 nt, Homo sapiens
caauauugggccuaaaacaguau

SEQ ID NO: 2036701 - RNA, 14 nt, Homo sapiens
uauuuguucuuaua

SEQ ID NO: 2036702 - RNA, 14 nt, Homo sapiens
aauuaccaguuuuc

SEQ ID NO: 2036703 - RNA, 18 nt, Homo sapiens
ugcaccugcaaucccagc

SEQ ID NO: 2036704 - RNA, 14 nt, Homo sapiens
aagaaguugcucug

SEQ ID NO: 2036705 - RNA, 16 nt, Homo sapiens
gugcuccaagcacagg

SEQ ID NO: 2036706 - RNA, 18 nt, Homo sapiens
agccugccauauuuguca

SEQ ID NO: 2036707 - RNA, 22 nt, Homo sapiens
caaaacuuuaaugaacuaacug

SEQ ID NO: 2036708 - RNA, 17 nt, Homo sapiens
cauggaacacaaacaca

SEQ ID NO: 2036709 - RNA, 18 nt, Homo sapiens
aggaaggacuaugacaaa

SEQ ID NO: 2036710 - RNA, 16 nt, Homo sapiens
acucaggggucauuca

SEQ ID NO: 2036711 - RNA, 14 nt, Homo sapiens
cuucucagcuccca

SEQ ID NO: 2036712 - RNA, 12 nt, Homo sapiens
aauaaaccaaug

SEQ ID NO: 2036713 - RNA, 18 nt, Homo sapiens
agcuuaagucauggaauu

SEQ ID NO: 2036714 - RNA, 19 nt, Homo sapiens
cucuuaaugugcagcaaaa

SEQ ID NO: 2036715 - RNA, 16 nt, Homo sapiens
agcuuugggugccuuu

SEQ ID NO: 2036716 - RNA, 17 nt, Homo sapiens
uuaccaugugcuaauaa

SEQ ID NO: 2036717 - RNA, 13 nt, Homo sapiens
agcaucagaguug

SEQ ID NO: 2036718 - RNA, 13 nt, Homo sapiens
cacagcagcauuu

SEQ ID NO: 2036719 - RNA, 19 nt, Homo sapiens
acauauauaugaaugcuug

SEQ ID NO: 2036720 - RNA, 15 nt, Homo sapiens
uauacauuaacuuca

SEQ ID NO: 2036721 - RNA, 12 nt, Homo sapiens
auuucugugaug

SEQ ID NO: 2036722 - RNA, 13 nt, Homo sapiens
ccguuccagcuga

SEQ ID NO: 2036723 - RNA, 17 nt, Homo sapiens
ucucggggucagguucu

SEQ ID NO: 2036724 - RNA, 18 nt, Homo sapiens
ccaggcugcuggagugca

SEQ ID NO: 2036725 - RNA, 16 nt, Homo sapiens
aggacggacucacuuc

SEQ ID NO: 2036726 - RNA, 17 nt, Homo sapiens
gaugucuucuugcaaua

SEQ ID NO: 2036727 - RNA, 16 nt, Homo sapiens
uacaguagugucauca

SEQ ID NO: 2036728 - RNA, 18 nt, Homo sapiens
uguaucucuauguggauc

SEQ ID NO: 2036729 - RNA, 23 nt, Homo sapiens
auuucugaccuuguaccucucuu

SEQ ID NO: 2036730 - RNA, 19 nt, Homo sapiens
cacuucucaucauauugua

SEQ ID NO: 2036731 - RNA, 13 nt, Homo sapiens
gguguauuugcca

SEQ ID NO: 2036732 - RNA, 15 nt, Homo sapiens
uuacaaagcaaaaag

SEQ ID NO: 2036733 - RNA, 18 nt, Homo sapiens
auaaaauuccuaucucau

SEQ ID NO: 2036734 - RNA, 14 nt, Homo sapiens
cuccuucacaucag

SEQ ID NO: 2036735 - RNA, 22 nt, Homo sapiens
uaauucucccgcauugguggcu

SEQ ID NO: 2036736 - RNA, 20 nt, Homo sapiens
ucagaauaaauuauugcugu

SEQ ID NO: 2036737 - RNA, 16 nt, Homo sapiens
cgagaaccaggcugcu

SEQ ID NO: 2036738 - RNA, 19 nt, Homo sapiens
cuugggaguguugucacac

SEQ ID NO: 2036739 - RNA, 13 nt, Homo sapiens
cuucccauucucc

SEQ ID NO: 2036740 - RNA, 13 nt, Homo sapiens
gcacaaguguaau

SEQ ID NO: 2036741 - RNA, 13 nt, Homo sapiens
acaauaguauaca

SEQ ID NO: 2036742 - RNA, 20 nt, Homo sapiens
auuccugggccuguccccca

SEQ ID NO: 2036743 - RNA, 16 nt, Homo sapiens
cuggggacggggcucc

SEQ ID NO: 2036744 - RNA, 21 nt, Homo sapiens
cauaugaggaggaugucccug

SEQ ID NO: 2036745 - RNA, 13 nt, Homo sapiens
gccacagcagcuu

SEQ ID NO: 2036746 - RNA, 17 nt, Homo sapiens
gaagagcucaagggaca

SEQ ID NO: 2036747 - RNA, 22 nt, Homo sapiens
acugguauauacgugugguuca

SEQ ID NO: 2036748 - RNA, 14 nt, Homo sapiens
gguggggagucuga

SEQ ID NO: 2036749 - RNA, 15 nt, Homo sapiens
augguaucuguuacu

SEQ ID NO: 2036750 - RNA, 22 nt, Homo sapiens
gacaguguuuuaggugccugga

SEQ ID NO: 2036751 - RNA, 16 nt, Homo sapiens
ccuagcugugaccucu

SEQ ID NO: 2036752 - RNA, 17 nt, Homo sapiens
cucuguuauguacugua

SEQ ID NO: 2036753 - RNA, 14 nt, Homo sapiens
accacaaacaauuc

SEQ ID NO: 2036754 - RNA, 15 nt, Homo sapiens
ugcuagacaguuaaa

SEQ ID NO: 2036755 - RNA, 16 nt, Homo sapiens
agcuugcgcauucuca

SEQ ID NO: 2036756 - RNA, 20 nt, Homo sapiens
auccauuguguucucuuuaa

SEQ ID NO: 2036757 - RNA, 16 nt, Homo sapiens
uuuuaaauaccacaag

SEQ ID NO: 2036758 - RNA, 21 nt, Homo sapiens
acagcucccugccaaacugaa

SEQ ID NO: 2036759 - RNA, 13 nt, Homo sapiens
accagagcugucu

SEQ ID NO: 2036760 - RNA, 15 nt, Homo sapiens
aaaacagaugaccau

SEQ ID NO: 2036761 - RNA, 18 nt, Homo sapiens
augagagaauaagucaug

SEQ ID NO: 2036762 - RNA, 13 nt, Homo sapiens
agaugaaugucag

SEQ ID NO: 2036763 - RNA, 15 nt, Homo sapiens
cgugaugcuaugaug

SEQ ID NO: 2036764 - RNA, 18 nt, Homo sapiens
uggaucucacaagcacuu

SEQ ID NO: 2036765 - RNA, 15 nt, Homo sapiens
aauguaacugugcca

SEQ ID NO: 2036766 - RNA, 16 nt, Homo sapiens
ucuuuccucuuucugc

SEQ ID NO: 2036767 - RNA, 19 nt, Homo sapiens
guaucaguuauaugauauu

SEQ ID NO: 2036768 - RNA, 20 nt, Homo sapiens
cauaagcuuuuucucugaac

SEQ ID NO: 2036769 - RNA, 16 nt, Homo sapiens
uggcucaugccuguaa

SEQ ID NO: 2036770 - RNA, 12 nt, Homo sapiens
cuguaccacaau

SEQ ID NO: 2036771 - RNA, 12 nt, Homo sapiens
aaaaaccaauga

SEQ ID NO: 2036772 - RNA, 13 nt, Homo sapiens
cucucaggggcca

SEQ ID NO: 2036773 - RNA, 13 nt, Homo sapiens
gccgggcgcagug

SEQ ID NO: 2036774 - RNA, 23 nt, Homo sapiens
ugccaacaagaaugcauugauau

SEQ ID NO: 2036775 - RNA, 15 nt, Homo sapiens
aauucaugcaucuca

SEQ ID NO: 2036776 - RNA, 22 nt, Homo sapiens
cuagguggcaggacaaauugcg

SEQ ID NO: 2036777 - RNA, 15 nt, Homo sapiens
cuuguuuuccagucu

SEQ ID NO: 2036778 - RNA, 21 nt, Homo sapiens
gcaagugcuaugccaagccau

SEQ ID NO: 2036779 - RNA, 15 nt, Homo sapiens
uuuaaggauguugcc

SEQ ID NO: 2036780 - RNA, 16 nt, Homo sapiens
cuaggagacaucuucc

SEQ ID NO: 2036781 - RNA, 19 nt, Homo sapiens
uccauuguggagccaaagc

SEQ ID NO: 2036782 - RNA, 19 nt, Homo sapiens
uucugggcacccucccacc

SEQ ID NO: 2036783 - RNA, 15 nt, Homo sapiens
cuaagccaacuuuaa

SEQ ID NO: 2036784 - RNA, 13 nt, Homo sapiens
auuuaaucuccau

SEQ ID NO: 2036785 - RNA, 18 nt, Homo sapiens
cugacagcaaacacaguc

SEQ ID NO: 2036786 - RNA, 21 nt, Homo sapiens
ccuuuucacggagaccuaucu

SEQ ID NO: 2036787 - RNA, 13 nt, Homo sapiens
cauauauauuaca

SEQ ID NO: 2036788 - RNA, 15 nt, Homo sapiens
gccaaucacaagcag

SEQ ID NO: 2036789 - RNA, 16 nt, Homo sapiens
auaugucaucacucua

SEQ ID NO: 2036790 - RNA, 20 nt, Homo sapiens
ugcuccauuuucuugucaau

SEQ ID NO: 2036791 - RNA, 18 nt, Homo sapiens
gccagguaugguggcaua

SEQ ID NO: 2036792 - RNA, 21 nt, Homo sapiens
augcuaaaugggaaugcaaag

SEQ ID NO: 2036793 - RNA, 15 nt, Homo sapiens
agggccacugggaag

SEQ ID NO: 2036794 - RNA, 14 nt, Homo sapiens
ggacaaggccuugc

SEQ ID NO: 2036795 - RNA, 18 nt, Homo sapiens
gagcaguugcccucaggc

SEQ ID NO: 2036796 - RNA, 23 nt, Homo sapiens
ucaggaaagagauuagaacauuu

SEQ ID NO: 2036797 - RNA, 21 nt, Homo sapiens
agaucugaauggggcuuuccu

SEQ ID NO: 2036798 - RNA, 15 nt, Homo sapiens
guagucucauuacuu

SEQ ID NO: 2036799 - RNA, 22 nt, Homo sapiens
uauuuuacaaucaacaaaaugg

SEQ ID NO: 2036800 - RNA, 19 nt, Homo sapiens
uggaccaaggugaagcaaa

SEQ ID NO: 2036801 - RNA, 19 nt, Homo sapiens
ugaaaguagcagugugaag

SEQ ID NO: 2036802 - RNA, 12 nt, Homo sapiens
auuuuagcacau

SEQ ID NO: 2036803 - RNA, 21 nt, Homo sapiens
aauaucguaucauuguaauca

SEQ ID NO: 2036804 - RNA, 21 nt, Homo sapiens
uaaaugucuuuccaaaagugu

SEQ ID NO: 2036805 - RNA, 20 nt, Homo sapiens
aaagcuuuuuccuccuggaa

SEQ ID NO: 2036806 - RNA, 16 nt, Homo sapiens
cgcacgcucgcugcca

SEQ ID NO: 2036807 - RNA, 20 nt, Homo sapiens
cacaaagaaacguugcgaaa

SEQ ID NO: 2036808 - RNA, 14 nt, Homo sapiens
acuucaaaguuaau

SEQ ID NO: 2036809 - RNA, 14 nt, Homo sapiens
gcaaauaaauauca

SEQ ID NO: 2036810 - RNA, 19 nt, Homo sapiens
gaauugcucgaacuuggag

SEQ ID NO: 2036811 - RNA, 14 nt, Homo sapiens
cagggaacuuagua

SEQ ID NO: 2036812 - RNA, 19 nt, Homo sapiens
agccaugggagacacugau

SEQ ID NO: 2036813 - RNA, 17 nt, Homo sapiens
aauuccaggaaccaaaa

SEQ ID NO: 2036814 - RNA, 20 nt, Homo sapiens
gcuuaaacccuuuagugcuu

SEQ ID NO: 2036815 - RNA, 14 nt, Homo sapiens
caauguauacuuca

SEQ ID NO: 2036816 - RNA, 18 nt, Homo sapiens
uuaaaccuuaagauacua

SEQ ID NO: 2036817 - RNA, 11 nt, Homo sapiens
uucauggugau

SEQ ID NO: 2036818 - RNA, 20 nt, Homo sapiens
acacacuggaccccacuggc

SEQ ID NO: 2036819 - RNA, 23 nt, Homo sapiens
gagcaacagcgauggcagugaga

SEQ ID NO: 2036820 - RNA, 22 nt, Homo sapiens
ccagccaucuuuggcaaagguc

SEQ ID NO: 2036821 - RNA, 18 nt, Homo sapiens
ucagccaggcccugagau

SEQ ID NO: 2036822 - RNA, 23 nt, Homo sapiens
augugauuuugagcaaaccacau

SEQ ID NO: 2036823 - RNA, 17 nt, Homo sapiens
auuuaagagaacaagca

SEQ ID NO: 2036824 - RNA, 19 nt, Homo sapiens
cacugaaacuucaagcacc

SEQ ID NO: 2036825 - RNA, 15 nt, Homo sapiens
cugggccacugggga

SEQ ID NO: 2036826 - RNA, 20 nt, Homo sapiens
cucuaguugaacccugggaa

SEQ ID NO: 2036827 - RNA, 21 nt, Homo sapiens
uaaauaucacaguauuaucug

SEQ ID NO: 2036828 - RNA, 15 nt, Homo sapiens
uugccucugugcugu

SEQ ID NO: 2036829 - RNA, 13 nt, Homo sapiens
cccuggacagggc

SEQ ID NO: 2036830 - RNA, 16 nt, Homo sapiens
ccaggaguucugcuca

SEQ ID NO: 2036831 - RNA, 22 nt, Homo sapiens
aggaaacaaggggucugaggau

SEQ ID NO: 2036832 - RNA, 16 nt, Homo sapiens
ccuaccaaccucugaa

SEQ ID NO: 2036833 - RNA, 15 nt, Homo sapiens
agagagcacagugau

SEQ ID NO: 2036834 - RNA, 14 nt, Homo sapiens
ucugcaagcaauac

SEQ ID NO: 2036835 - RNA, 15 nt, Homo sapiens
uacaucuguacauga

SEQ ID NO: 2036836 - RNA, 19 nt, Homo sapiens
cacaggacgauuucacuga

SEQ ID NO: 2036837 - RNA, 14 nt, Homo sapiens
ugcauguacuguau

SEQ ID NO: 2036838 - RNA, 15 nt, Homo sapiens
cagaagccuccaagc

SEQ ID NO: 2036839 - RNA, 11 nt, Homo sapiens
cuucagcauuu

SEQ ID NO: 2036840 - RNA, 22 nt, Homo sapiens
acacaugucaagggauuacuua

SEQ ID NO: 2036841 - RNA, 13 nt, Homo sapiens
cgccuugucauug

SEQ ID NO: 2036842 - RNA, 22 nt, Homo sapiens
uguuuaauacccuguacauauc

SEQ ID NO: 2036843 - RNA, 16 nt, Homo sapiens
caucuguaaaauggag

SEQ ID NO: 2036844 - RNA, 15 nt, Homo sapiens
acgccgcccuaaaag

SEQ ID NO: 2036845 - RNA, 13 nt, Homo sapiens
gagccuccagucc

SEQ ID NO: 2036846 - RNA, 15 nt, Homo sapiens
ucuagagcucaucag

SEQ ID NO: 2036847 - RNA, 13 nt, Homo sapiens
caagucacaaaga

SEQ ID NO: 2036848 - RNA, 21 nt, Homo sapiens
ugcaaagcugaagaccaugga

SEQ ID NO: 2036849 - RNA, 17 nt, Homo sapiens
uccuuccagcaaacgua

SEQ ID NO: 2036850 - RNA, 23 nt, Homo sapiens
aucagcuacccauuauagcacaa

SEQ ID NO: 2036851 - RNA, 21 nt, Homo sapiens
gccuaaaaaguaucauuacau

SEQ ID NO: 2036852 - RNA, 15 nt, Homo sapiens
acuucuucauucucu

SEQ ID NO: 2036853 - RNA, 19 nt, Homo sapiens
aagaguguucaacugugag

SEQ ID NO: 2036854 - RNA, 14 nt, Homo sapiens
aaugguuugaauau

SEQ ID NO: 2036855 - RNA, 19 nt, Homo sapiens
ucagggcuauggauggggc

SEQ ID NO: 2036856 - RNA, 19 nt, Homo sapiens
uucccuuugauacagucaa

SEQ ID NO: 2036857 - RNA, 14 nt, Homo sapiens
gacccuagugaaaa

SEQ ID NO: 2036858 - RNA, 18 nt, Homo sapiens
ggaaaagggaaaugugac

SEQ ID NO: 2036859 - RNA, 14 nt, Homo sapiens
cugucucaucacau

SEQ ID NO: 2036860 - RNA, 17 nt, Homo sapiens
ucugcauaaauuuuaca

SEQ ID NO: 2036861 - RNA, 19 nt, Homo sapiens
uaaguccagcuuggccaag

SEQ ID NO: 2036862 - RNA, 17 nt, Homo sapiens
acaauccugauaaauuu

SEQ ID NO: 2036863 - RNA, 22 nt, Homo sapiens
uucuggaugaaugcccagugag

SEQ ID NO: 2036864 - RNA, 22 nt, Homo sapiens
ucucccuggggaugugcuuugu

SEQ ID NO: 2036865 - RNA, 22 nt, Homo sapiens
ugcuuuaggugagucacacuca

SEQ ID NO: 2036866 - RNA, 13 nt, Homo sapiens
acaucagucacaa

SEQ ID NO: 2036867 - RNA, 16 nt, Homo sapiens
gcccguucuugaaaug

SEQ ID NO: 2036868 - RNA, 15 nt, Homo sapiens
caaaugagugauucc

SEQ ID NO: 2036869 - RNA, 14 nt, Homo sapiens
ccaagccccacuga

SEQ ID NO: 2036870 - RNA, 14 nt, Homo sapiens
aaauauccugcuca

SEQ ID NO: 2036871 - RNA, 15 nt, Homo sapiens
acccaccucugccac

SEQ ID NO: 2036872 - RNA, 16 nt, Homo sapiens
cugggauauuuccaua

SEQ ID NO: 2036873 - RNA, 22 nt, Homo sapiens
caucaaguaugugguacuacug

SEQ ID NO: 2036874 - RNA, 15 nt, Homo sapiens
aaaugauagacaauu

SEQ ID NO: 2036875 - RNA, 20 nt, Homo sapiens
guuuacaguuuguguuuuaa

SEQ ID NO: 2036876 - RNA, 18 nt, Homo sapiens
agaagcaaaccugauaca

SEQ ID NO: 2036877 - RNA, 16 nt, Homo sapiens
augacgguaucacugu

SEQ ID NO: 2036878 - RNA, 20 nt, Homo sapiens
uaaagugucauccaagccau

SEQ ID NO: 2036879 - RNA, 22 nt, Homo sapiens
aguuucugaggaucagcacugc

SEQ ID NO: 2036880 - RNA, 22 nt, Homo sapiens
ucgcuauugauuuuuacuucaa

SEQ ID NO: 2036881 - RNA, 20 nt, Homo sapiens
aguccaagguauugagacau

SEQ ID NO: 2036882 - RNA, 12 nt, Homo sapiens
guugcagucuca

SEQ ID NO: 2036883 - RNA, 16 nt, Homo sapiens
ccucccugaguggucc

SEQ ID NO: 2036884 - RNA, 17 nt, Homo sapiens
ugcucagacccaacagc

SEQ ID NO: 2036885 - RNA, 12 nt, Homo sapiens
agcauuccucag

SEQ ID NO: 2036886 - RNA, 17 nt, Homo sapiens
aaccugugaugagggga

SEQ ID NO: 2036887 - RNA, 21 nt, Homo sapiens
aaagcuacaaaaaacugcagu

SEQ ID NO: 2036888 - RNA, 17 nt, Homo sapiens
gauguuuccccagaccg

SEQ ID NO: 2036889 - RNA, 18 nt, Homo sapiens
aacugaauaaauaccucu

SEQ ID NO: 2036890 - RNA, 22 nt, Homo sapiens
auuugaaugugguuacuuccua

SEQ ID NO: 2036891 - RNA, 17 nt, Homo sapiens
ucacccaucagauaccu

SEQ ID NO: 2036892 - RNA, 15 nt, Homo sapiens
cauguaaaauguuua

SEQ ID NO: 2036893 - RNA, 21 nt, Homo sapiens
auugaucauuuuuauaugaaa

SEQ ID NO: 2036894 - RNA, 18 nt, Homo sapiens
cuguuaucgaacacauuc

SEQ ID NO: 2036895 - RNA, 19 nt, Homo sapiens
guuucaagacugacauuuu

SEQ ID NO: 2036896 - RNA, 17 nt, Homo sapiens
ccagggcccccaaagag

SEQ ID NO: 2036897 - RNA, 15 nt, Homo sapiens
ugagcuuuacagcag

SEQ ID NO: 2036898 - RNA, 16 nt, Homo sapiens
uaacccucccauggca

SEQ ID NO: 2036899 - RNA, 19 nt, Homo sapiens
accaagaccccaaagggcc

SEQ ID NO: 2036900 - RNA, 15 nt, Homo sapiens
aaaauccuggaagac

SEQ ID NO: 2036901 - RNA, 17 nt, Homo sapiens
aaagcagucuguucuga

SEQ ID NO: 2036902 - RNA, 20 nt, Homo sapiens
ugaagaaagauacuaauaga

SEQ ID NO: 2036903 - RNA, 11 nt, Homo sapiens
cuguucauucc

SEQ ID NO: 2036904 - RNA, 13 nt, Homo sapiens
uccacagugauua

SEQ ID NO: 2036905 - RNA, 13 nt, Homo sapiens
uacucagugcuaa

SEQ ID NO: 2036906 - RNA, 20 nt, Homo sapiens
agugguggauagaagacuua

SEQ ID NO: 2036907 - RNA, 15 nt, Homo sapiens
aauguggaugcucuu

SEQ ID NO: 2036908 - RNA, 18 nt, Homo sapiens
gccuauaauacaguuuuc

SEQ ID NO: 2036909 - RNA, 18 nt, Homo sapiens
uauugaggauuaauuuau

SEQ ID NO: 2036910 - RNA, 20 nt, Homo sapiens
aaaaugcauguaaucaacau

SEQ ID NO: 2036911 - RNA, 17 nt, Homo sapiens
gugaccuaagaacaaaa

SEQ ID NO: 2036912 - RNA, 15 nt, Homo sapiens
accccaguaagccac

SEQ ID NO: 2036913 - RNA, 17 nt, Homo sapiens
aacugugaagaucucac

SEQ ID NO: 2036914 - RNA, 21 nt, Homo sapiens
cuguccuaguuguccagagau

SEQ ID NO: 2036915 - RNA, 20 nt, Homo sapiens
uccccugccugcccugguga

SEQ ID NO: 2036916 - RNA, 22 nt, Homo sapiens
aaguucauaccuaaguacugua

SEQ ID NO: 2036917 - RNA, 18 nt, Homo sapiens
auguaacuuccuguggau

SEQ ID NO: 2036918 - RNA, 23 nt, Homo sapiens
cacucuuauucccaaacuacaga

SEQ ID NO: 2036919 - RNA, 16 nt, Homo sapiens
ugccuuuuaccaugaa

SEQ ID NO: 2036920 - RNA, 15 nt, Homo sapiens
ccaagacaguggcag

SEQ ID NO: 2036921 - RNA, 19 nt, Homo sapiens
accauuauggcuuugugcu

SEQ ID NO: 2036922 - RNA, 17 nt, Homo sapiens
gcuccacaguguugcca

SEQ ID NO: 2036923 - RNA, 19 nt, Homo sapiens
gauucggagugucugaaca

SEQ ID NO: 2036924 - RNA, 15 nt, Homo sapiens
cccagcuacucagga

SEQ ID NO: 2036925 - RNA, 13 nt, Homo sapiens
cuacuucaagaaa

SEQ ID NO: 2036926 - RNA, 14 nt, Homo sapiens
cuuaauaggcuuua

SEQ ID NO: 2036927 - RNA, 17 nt, Homo sapiens
aacucaguuucuaggca

SEQ ID NO: 2036928 - RNA, 14 nt, Homo sapiens
aacagcuuugugaa

SEQ ID NO: 2036929 - RNA, 14 nt, Homo sapiens
ugagagcauucugc

SEQ ID NO: 2036930 - RNA, 15 nt, Homo sapiens
gauccucccaccuca

SEQ ID NO: 2036931 - RNA, 13 nt, Homo sapiens
cuugggcucugau

SEQ ID NO: 2036932 - RNA, 14 nt, Homo sapiens
agauucuuccccaa

SEQ ID NO: 2036933 - RNA, 14 nt, Homo sapiens
aagaaacuuuggaa

SEQ ID NO: 2036934 - RNA, 23 nt, Homo sapiens
gacaaccugaaauuuauucacau

SEQ ID NO: 2036935 - RNA, 14 nt, Homo sapiens
uccagcucucaguu

SEQ ID NO: 2036936 - RNA, 15 nt, Homo sapiens
ggccaaccuccccaa

SEQ ID NO: 2036937 - RNA, 18 nt, Homo sapiens
uucauagguuacuaccua

SEQ ID NO: 2036938 - RNA, 15 nt, Homo sapiens
uucuugaugauggug

SEQ ID NO: 2036939 - RNA, 19 nt, Homo sapiens
uggauugcagacucaugaa

SEQ ID NO: 2036940 - RNA, 18 nt, Homo sapiens
ccuaaagcaaaucugcca

SEQ ID NO: 2036941 - RNA, 18 nt, Homo sapiens
agauuuuguauucagggg

SEQ ID NO: 2036942 - RNA, 15 nt, Homo sapiens
gacacccccugggau

SEQ ID NO: 2036943 - RNA, 20 nt, Homo sapiens
cuuacagaaccaauucacuu

SEQ ID NO: 2036944 - RNA, 20 nt, Homo sapiens
gcuuccuuagaacuucuaca

SEQ ID NO: 2036945 - RNA, 21 nt, Homo sapiens
cugugcaguagagagccuuuc

SEQ ID NO: 2036946 - RNA, 21 nt, Homo sapiens
aaauuacuucccccacuacuu

SEQ ID NO: 2036947 - RNA, 18 nt, Homo sapiens
cagacagaagucuccuca

SEQ ID NO: 2036948 - RNA, 16 nt, Homo sapiens
caggcauguuuguaca

SEQ ID NO: 2036949 - RNA, 18 nt, Homo sapiens
ggccagagcucccaggac

SEQ ID NO: 2036950 - RNA, 15 nt, Homo sapiens
cuugauuacuuccac

SEQ ID NO: 2036951 - RNA, 19 nt, Homo sapiens
cugccuaggaggcuggcca

SEQ ID NO: 2036952 - RNA, 15 nt, Homo sapiens
acuaacuaaucacuu

SEQ ID NO: 2036953 - RNA, 13 nt, Homo sapiens
caaacaugguuua

SEQ ID NO: 2036954 - RNA, 18 nt, Homo sapiens
aauuuggagcauaacugg

SEQ ID NO: 2036955 - RNA, 21 nt, Homo sapiens
cagacgggcacacagacugga

SEQ ID NO: 2036956 - RNA, 21 nt, Homo sapiens
ugaaugaaucaacaaaccaca

SEQ ID NO: 2036957 - RNA, 21 nt, Homo sapiens
aggccucucaccucugugccu

SEQ ID NO: 2036958 - RNA, 19 nt, Homo sapiens
ccagaggaaguuaagggag

SEQ ID NO: 2036959 - RNA, 17 nt, Homo sapiens
uaaggaaugauccaaua

SEQ ID NO: 2036960 - RNA, 15 nt, Homo sapiens
ugcaaauucauuuca

SEQ ID NO: 2036961 - RNA, 13 nt, Homo sapiens
ucugaggucauua

SEQ ID NO: 2036962 - RNA, 16 nt, Homo sapiens
uaaaacuaagcacaaa

SEQ ID NO: 2036963 - RNA, 19 nt, Homo sapiens
ucauccagaaguguauuca

SEQ ID NO: 2036964 - RNA, 22 nt, Homo sapiens
auauuugcauuccagaaccaaa

SEQ ID NO: 2036965 - RNA, 17 nt, Homo sapiens
cuugggcugagugcagc

SEQ ID NO: 2036966 - RNA, 11 nt, Homo sapiens
ccaguuuccaa

SEQ ID NO: 2036967 - RNA, 16 nt, Homo sapiens
uguguccuugugcaug

SEQ ID NO: 2036968 - RNA, 17 nt, Homo sapiens
uugguuaagcuuugaca

SEQ ID NO: 2036969 - RNA, 22 nt, Homo sapiens
gccauauauuuuuaagacuuuu

SEQ ID NO: 2036970 - RNA, 16 nt, Homo sapiens
ccucugacuccacuca

SEQ ID NO: 2036971 - RNA, 19 nt, Homo sapiens
auauugaaaaaaguuccac

SEQ ID NO: 2036972 - RNA, 23 nt, Homo sapiens
ugcacuuguggcaacagauaagu

SEQ ID NO: 2036973 - RNA, 22 nt, Homo sapiens
cuuucaaaagcaagaacaccau

SEQ ID NO: 2036974 - RNA, 11 nt, Homo sapiens
gaaagcacugg

SEQ ID NO: 2036975 - RNA, 20 nt, Homo sapiens
uaaauugaaauauaaugcaa

SEQ ID NO: 2036976 - RNA, 21 nt, Homo sapiens
cuccacaugacagaaccaauu

SEQ ID NO: 2036977 - RNA, 19 nt, Homo sapiens
uggaaaucaguagaaagcu

SEQ ID NO: 2036978 - RNA, 21 nt, Homo sapiens
uguagaaagauacacugacuu

SEQ ID NO: 2036979 - RNA, 20 nt, Homo sapiens
ucaggcucugaaucucucaa

SEQ ID NO: 2036980 - RNA, 15 nt, Homo sapiens
uaaguugagaacuua

SEQ ID NO: 2036981 - RNA, 13 nt, Homo sapiens
uuaucagugugca

SEQ ID NO: 2036982 - RNA, 19 nt, Homo sapiens
aacucuaaagccaagcacu

SEQ ID NO: 2036983 - RNA, 23 nt, Homo sapiens
uaagaauguacaguugagcucag

SEQ ID NO: 2036984 - RNA, 11 nt, Homo sapiens
uccccagacac

SEQ ID NO: 2036985 - RNA, 15 nt, Homo sapiens
gcgcuggcucaggaa

SEQ ID NO: 2036986 - RNA, 17 nt, Homo sapiens
caguugaagcugacuca

SEQ ID NO: 2036987 - RNA, 16 nt, Homo sapiens
agacaaucuagcacuu

SEQ ID NO: 2036988 - RNA, 17 nt, Homo sapiens
uaauggcuaguacugua

SEQ ID NO: 2036989 - RNA, 20 nt, Homo sapiens
ggccugcucgcccacuuccu

SEQ ID NO: 2036990 - RNA, 15 nt, Homo sapiens
uagucucaaaucaaa

SEQ ID NO: 2036991 - RNA, 19 nt, Homo sapiens
aauacugaaccacuuguag

SEQ ID NO: 2036992 - RNA, 16 nt, Homo sapiens
uacguauaaauaucag

SEQ ID NO: 2036993 - RNA, 21 nt, Homo sapiens
guccgcuuucaugaacacagc

SEQ ID NO: 2036994 - RNA, 13 nt, Homo sapiens
gccucaaggacuu

SEQ ID NO: 2036995 - RNA, 23 nt, Homo sapiens
uuagccauaauuuugcauacuga

SEQ ID NO: 2036996 - RNA, 18 nt, Homo sapiens
caccccuacacugugaag

SEQ ID NO: 2036997 - RNA, 14 nt, Homo sapiens
acuagaucacaacu

SEQ ID NO: 2036998 - RNA, 20 nt, Homo sapiens
ucccccaacuucaucuggaa

SEQ ID NO: 2036999 - RNA, 16 nt, Homo sapiens
ccaaauccacaagcca

SEQ ID NO: 2037000 - RNA, 14 nt, Homo sapiens
acauauaguguaca

SEQ ID NO: 2037001 - RNA, 13 nt, Homo sapiens
auccuuguguuua

SEQ ID NO: 2037002 - RNA, 22 nt, Homo sapiens
gucccuauacagagguccugcc

SEQ ID NO: 2037003 - RNA, 14 nt, Homo sapiens
auggguaaagcaau

SEQ ID NO: 2037004 - RNA, 22 nt, Homo sapiens
acacagcaguaugaaugauguu

SEQ ID NO: 2037005 - RNA, 21 nt, Homo sapiens
gcugucaccaagcaugaccca

SEQ ID NO: 2037006 - RNA, 14 nt, Homo sapiens
uggccuggccauuu

SEQ ID NO: 2037007 - RNA, 14 nt, Homo sapiens
agacacugugagag

SEQ ID NO: 2037008 - RNA, 16 nt, Homo sapiens
uaaaauuccuaucuca

SEQ ID NO: 2037009 - RNA, 20 nt, Homo sapiens
aagucccccagcagaaccag

SEQ ID NO: 2037010 - RNA, 23 nt, Homo sapiens
gaaagcaggauguaguucugcca

SEQ ID NO: 2037011 - RNA, 23 nt, Homo sapiens
ucucugaagaugaucauuugccc

SEQ ID NO: 2037012 - RNA, 15 nt, Homo sapiens
gggcagggguuccca

SEQ ID NO: 2037013 - RNA, 17 nt, Homo sapiens
uuguguguuuucuggga

SEQ ID NO: 2037014 - RNA, 20 nt, Homo sapiens
agaggggagagagacuggag

SEQ ID NO: 2037015 - RNA, 13 nt, Homo sapiens
auuccuucauuca

SEQ ID NO: 2037016 - RNA, 11 nt, Homo sapiens
cauugcacaug

SEQ ID NO: 2037017 - RNA, 23 nt, Homo sapiens
acagggucucccuauguugccca

SEQ ID NO: 2037018 - RNA, 15 nt, Homo sapiens
ugguagccaucucau

SEQ ID NO: 2037019 - RNA, 21 nt, Homo sapiens
cugucucagacuuuuguacau

SEQ ID NO: 2037020 - RNA, 17 nt, Homo sapiens
cuguuauaaaagcaaua

SEQ ID NO: 2037021 - RNA, 21 nt, Homo sapiens
cucacacucauccacacuuaa

SEQ ID NO: 2037022 - RNA, 16 nt, Homo sapiens
uucguaugccagcuca

SEQ ID NO: 2037023 - RNA, 23 nt, Homo sapiens
uuuagugacuaaaccauugugca

SEQ ID NO: 2037024 - RNA, 22 nt, Homo sapiens
ccuaaccuuggugccugaucca

SEQ ID NO: 2037025 - RNA, 22 nt, Homo sapiens
cccauuugcuuacuuugcauuu

SEQ ID NO: 2037026 - RNA, 12 nt, Homo sapiens
ccaucacacugu

SEQ ID NO: 2037027 - RNA, 18 nt, Homo sapiens
uccccuucguguugccau

SEQ ID NO: 2037028 - RNA, 18 nt, Homo sapiens
uuuaaaauccccaugccu

SEQ ID NO: 2037029 - RNA, 17 nt, Homo sapiens
uaaaauaaaugcaauug

SEQ ID NO: 2037030 - RNA, 16 nt, Homo sapiens
cuucuguucugcagac

SEQ ID NO: 2037031 - RNA, 19 nt, Homo sapiens
gccccugucucggggcuug

SEQ ID NO: 2037032 - RNA, 21 nt, Homo sapiens
cccaaccccgugacaaaggua

SEQ ID NO: 2037033 - RNA, 16 nt, Homo sapiens
cugcaaaaugucuuaa

SEQ ID NO: 2037034 - RNA, 18 nt, Homo sapiens
uccuggccucaagugauc

SEQ ID NO: 2037035 - RNA, 17 nt, Homo sapiens
auacuugagugugcaag

SEQ ID NO: 2037036 - RNA, 21 nt, Homo sapiens
cucugauacuuuuuugaaauc

SEQ ID NO: 2037037 - RNA, 13 nt, Homo sapiens
acuauacugcuga

SEQ ID NO: 2037038 - RNA, 22 nt, Homo sapiens
cccuggcaaaugccugacucag

SEQ ID NO: 2037039 - RNA, 13 nt, Homo sapiens
aaucuguauaaau

SEQ ID NO: 2037040 - RNA, 13 nt, Homo sapiens
auucaguauuaaa

SEQ ID NO: 2037041 - RNA, 21 nt, Homo sapiens
ucaggcaaggggcauuucaca

SEQ ID NO: 2037042 - RNA, 23 nt, Homo sapiens
uugccguuuguccuuaacuuucu

SEQ ID NO: 2037043 - RNA, 20 nt, Homo sapiens
uguagagagcagcauuccca

SEQ ID NO: 2037044 - RNA, 13 nt, Homo sapiens
aacaaaauccaac

SEQ ID NO: 2037045 - RNA, 17 nt, Homo sapiens
uaaauaaccuucaucaa

SEQ ID NO: 2037046 - RNA, 18 nt, Homo sapiens
gccucccugaaacacugc

SEQ ID NO: 2037047 - RNA, 17 nt, Homo sapiens
augcugcuggacaguau

SEQ ID NO: 2037048 - RNA, 22 nt, Homo sapiens
aaggaauauguacacuggaacu

SEQ ID NO: 2037049 - RNA, 15 nt, Homo sapiens
uguguacucagggca

SEQ ID NO: 2037050 - RNA, 16 nt, Homo sapiens
uguuggaaggggguca

SEQ ID NO: 2037051 - RNA, 23 nt, Homo sapiens
auauacauacaugcauacacucu

SEQ ID NO: 2037052 - RNA, 16 nt, Homo sapiens
guaacucaaagggugg

SEQ ID NO: 2037053 - RNA, 20 nt, Homo sapiens
ugucagguuuuucaguguug

SEQ ID NO: 2037054 - RNA, 17 nt, Homo sapiens
caguggcgcaaucuuaa

SEQ ID NO: 2037055 - RNA, 14 nt, Homo sapiens
gaugggaacacugg

SEQ ID NO: 2037056 - RNA, 17 nt, Homo sapiens
ugccauuccucuacugc

SEQ ID NO: 2037057 - RNA, 17 nt, Homo sapiens
cgagauaggguggcaca

SEQ ID NO: 2037058 - RNA, 21 nt, Homo sapiens
aucaaagcuaggaaaggcaga

SEQ ID NO: 2037059 - RNA, 11 nt, Homo sapiens
aaaaccugcuu

SEQ ID NO: 2037060 - RNA, 18 nt, Homo sapiens
aguagucccugcacagug

SEQ ID NO: 2037061 - RNA, 13 nt, Homo sapiens
ucuaugccuuuag

SEQ ID NO: 2037062 - RNA, 21 nt, Homo sapiens
cuccagcaucgucucauguaa

SEQ ID NO: 2037063 - RNA, 15 nt, Homo sapiens
cagaggcgugggcuc

SEQ ID NO: 2037064 - RNA, 19 nt, Homo sapiens
cacauguauugacaacagu

SEQ ID NO: 2037065 - RNA, 20 nt, Homo sapiens
guuuucuugcucaaagggaa

SEQ ID NO: 2037066 - RNA, 20 nt, Homo sapiens
auagcuccuucucucuuaca

SEQ ID NO: 2037067 - RNA, 15 nt, Homo sapiens
aaaauaaaacacauu

SEQ ID NO: 2037068 - RNA, 15 nt, Homo sapiens
aaucauaaacuauau

SEQ ID NO: 2037069 - RNA, 21 nt, Homo sapiens
auguuuuuugccacagcuuuu

SEQ ID NO: 2037070 - RNA, 23 nt, Homo sapiens
gccugaacagcccucucucucac

SEQ ID NO: 2037071 - RNA, 19 nt, Homo sapiens
ugccgccccgugccuguac

SEQ ID NO: 2037072 - RNA, 14 nt, Homo sapiens
uuauuaaaucaaaa

SEQ ID NO: 2037073 - RNA, 17 nt, Homo sapiens
aaguggcuaauucaauu

SEQ ID NO: 2037074 - RNA, 11 nt, Homo sapiens
uuuaagaacga

SEQ ID NO: 2037075 - RNA, 13 nt, Homo sapiens
ucuuuggacagaa

SEQ ID NO: 2037076 - RNA, 13 nt, Homo sapiens
ugaacuaaugaca

SEQ ID NO: 2037077 - RNA, 18 nt, Homo sapiens
cuccccucagagugcaag

SEQ ID NO: 2037078 - RNA, 16 nt, Homo sapiens
acaaacauagacagau

SEQ ID NO: 2037079 - RNA, 12 nt, Homo sapiens
ugaagcauuaug

SEQ ID NO: 2037080 - RNA, 16 nt, Homo sapiens
cagacucuggauucag

SEQ ID NO: 2037081 - RNA, 19 nt, Homo sapiens
gagaugcgaaccacccaaa

SEQ ID NO: 2037082 - RNA, 22 nt, Homo sapiens
gcuaucaucauccuacaacuca

SEQ ID NO: 2037083 - RNA, 16 nt, Homo sapiens
cauuuucugcaucucc

SEQ ID NO: 2037084 - RNA, 21 nt, Homo sapiens
ucaccuugaaagcaguagcau

SEQ ID NO: 2037085 - RNA, 18 nt, Homo sapiens
uugcacauuaaucagauu

SEQ ID NO: 2037086 - RNA, 15 nt, Homo sapiens
acaaucagcagucua

SEQ ID NO: 2037087 - RNA, 20 nt, Homo sapiens
cugaauguauugaacuugga

SEQ ID NO: 2037088 - RNA, 18 nt, Homo sapiens
cagccagguuagccuuug

SEQ ID NO: 2037089 - RNA, 12 nt, Homo sapiens
uauuuacagcug

SEQ ID NO: 2037090 - RNA, 23 nt, Homo sapiens
cacugcugcagacaccugccuua

SEQ ID NO: 2037091 - RNA, 19 nt, Homo sapiens
uccaggcgaugugcaagug

SEQ ID NO: 2037092 - RNA, 22 nt, Homo sapiens
uggagagcacaccuaucuuagu

SEQ ID NO: 2037093 - RNA, 19 nt, Homo sapiens
aaagaacugccccaucucc

SEQ ID NO: 2037094 - RNA, 21 nt, Homo sapiens
augcugcuauggaaggugcua

SEQ ID NO: 2037095 - RNA, 16 nt, Homo sapiens
ucccaccuacugcacu

SEQ ID NO: 2037096 - RNA, 18 nt, Homo sapiens
agggccaagcaccuagcc

SEQ ID NO: 2037097 - RNA, 17 nt, Homo sapiens
cagcuaacuuaucauca

SEQ ID NO: 2037098 - RNA, 17 nt, Homo sapiens
ugguucuuaguucucac

SEQ ID NO: 2037099 - RNA, 23 nt, Homo sapiens
cuucauagaugagaaaacugaga

SEQ ID NO: 2037100 - RNA, 20 nt, Homo sapiens
uccggcagaagcagcugcag

SEQ ID NO: 2037101 - RNA, 21 nt, Homo sapiens
cucauuucacuuuacacgcuc

SEQ ID NO: 2037102 - RNA, 19 nt, Homo sapiens
auucucggggcccugugua

SEQ ID NO: 2037103 - RNA, 17 nt, Homo sapiens
aggcucagacaacagac

SEQ ID NO: 2037104 - RNA, 12 nt, Homo sapiens
uuggagggauaa

SEQ ID NO: 2037105 - RNA, 15 nt, Homo sapiens
ugcugaaugucauuu

SEQ ID NO: 2037106 - RNA, 13 nt, Homo sapiens
cacagcuuuauga

SEQ ID NO: 2037107 - RNA, 22 nt, Homo sapiens
cucagccaggugcugugacacc

SEQ ID NO: 2037108 - RNA, 16 nt, Homo sapiens
gcccacggcaacugcc

SEQ ID NO: 2037109 - RNA, 13 nt, Homo sapiens
cuuccugccccuc

SEQ ID NO: 2037110 - RNA, 17 nt, Homo sapiens
agaucgcgccacugcac

SEQ ID NO: 2037111 - RNA, 16 nt, Homo sapiens
gcugugcuagugccug

SEQ ID NO: 2037112 - RNA, 14 nt, Homo sapiens
uuuuuguacacauc

SEQ ID NO: 2037113 - RNA, 21 nt, Homo sapiens
gcauggcucccgaguacagua

SEQ ID NO: 2037114 - RNA, 14 nt, Homo sapiens
aucuucuauucuag

SEQ ID NO: 2037115 - RNA, 14 nt, Homo sapiens
uaaacccaagugcu

SEQ ID NO: 2037116 - RNA, 20 nt, Homo sapiens
ucaaggacaccugccuucaa

SEQ ID NO: 2037117 - RNA, 15 nt, Homo sapiens
augagaauguauuag

SEQ ID NO: 2037118 - RNA, 15 nt, Homo sapiens
gugcacagcacacgu

SEQ ID NO: 2037119 - RNA, 21 nt, Homo sapiens
ucauaagauuaugaaaccaca

SEQ ID NO: 2037120 - RNA, 19 nt, Homo sapiens
gcccaggcuggagugcagu

SEQ ID NO: 2037121 - RNA, 19 nt, Homo sapiens
gcccaggcuagagugcaau

SEQ ID NO: 2037122 - RNA, 15 nt, Homo sapiens
ucuacgccaauguua

SEQ ID NO: 2037123 - RNA, 16 nt, Homo sapiens
ugugaaagaguugaag

SEQ ID NO: 2037124 - RNA, 22 nt, Homo sapiens
caagguggugugaucuuaauau

SEQ ID NO: 2037125 - RNA, 22 nt, Homo sapiens
gccuuaaaaggggcccaagccc

SEQ ID NO: 2037126 - RNA, 22 nt, Homo sapiens
agccuacccuuccugcauuucu

SEQ ID NO: 2037127 - RNA, 16 nt, Homo sapiens
cugcugucacuuccca

SEQ ID NO: 2037128 - RNA, 18 nt, Homo sapiens
guuucgugguuucgucua

SEQ ID NO: 2037129 - RNA, 17 nt, Homo sapiens
ccuguucauuugaagaa

SEQ ID NO: 2037130 - RNA, 17 nt, Homo sapiens
aggagcaaagcagcaau

SEQ ID NO: 2037131 - RNA, 19 nt, Homo sapiens
uuucucagugcacaugcaa

SEQ ID NO: 2037132 - RNA, 18 nt, Homo sapiens
uuaggaguaccauaauuc

SEQ ID NO: 2037133 - RNA, 13 nt, Homo sapiens
uaccggcaauuuc

SEQ ID NO: 2037134 - RNA, 14 nt, Homo sapiens
agucaugaacacau

SEQ ID NO: 2037135 - RNA, 18 nt, Homo sapiens
acagcgacagaaaaccuc

SEQ ID NO: 2037136 - RNA, 17 nt, Homo sapiens
cugagaacaaauacaau

SEQ ID NO: 2037137 - RNA, 17 nt, Homo sapiens
aaucuuuucacaaauaa

SEQ ID NO: 2037138 - RNA, 15 nt, Homo sapiens
ggguggaucaccuga

SEQ ID NO: 2037139 - RNA, 15 nt, Homo sapiens
aucuuggaaucaugc

SEQ ID NO: 2037140 - RNA, 15 nt, Homo sapiens
agccuuuaaaaccag

SEQ ID NO: 2037141 - RNA, 12 nt, Homo sapiens
auguuuccuuaa

SEQ ID NO: 2037142 - RNA, 19 nt, Homo sapiens
aaaguaaguuaauaaugua

SEQ ID NO: 2037143 - RNA, 14 nt, Homo sapiens
ggucagcgugcuua

SEQ ID NO: 2037144 - RNA, 17 nt, Homo sapiens
agggaaaacauuccauc

SEQ ID NO: 2037145 - RNA, 14 nt, Homo sapiens
gugagaaauuucug

SEQ ID NO: 2037146 - RNA, 16 nt, Homo sapiens
aauuuaaaaaaauaca

SEQ ID NO: 2037147 - RNA, 13 nt, Homo sapiens
aacaugaggacag

SEQ ID NO: 2037148 - RNA, 21 nt, Homo sapiens
uggucuccaguggaagggaaa

SEQ ID NO: 2037149 - RNA, 17 nt, Homo sapiens
accuacaggacugggcc

SEQ ID NO: 2037150 - RNA, 17 nt, Homo sapiens
cuucuggccggugcugg

SEQ ID NO: 2037151 - RNA, 17 nt, Homo sapiens
agaagaccuugggccaa

SEQ ID NO: 2037152 - RNA, 23 nt, Homo sapiens
acagagggaaaggcugaacauaa

SEQ ID NO: 2037153 - RNA, 21 nt, Homo sapiens
aauauuuauuuaacuauucau

SEQ ID NO: 2037154 - RNA, 23 nt, Homo sapiens
cauuuaauuugaaauuugacuca

SEQ ID NO: 2037155 - RNA, 24 nt, Homo sapiens
aaccugggcauuccuugggacuca

SEQ ID NO: 2037156 - RNA, 12 nt, Homo sapiens
acaacagccuga

SEQ ID NO: 2037157 - RNA, 21 nt, Homo sapiens
acuacaaacauggggagccau

SEQ ID NO: 2037158 - RNA, 19 nt, Homo sapiens
cucauuuauuuccauauua

SEQ ID NO: 2037159 - RNA, 21 nt, Homo sapiens
uccagcuuuugaaaacaguga

SEQ ID NO: 2037160 - RNA, 22 nt, Homo sapiens
cuucagguucuuagugucacuu

SEQ ID NO: 2037161 - RNA, 22 nt, Homo sapiens
guuacauuaaaauaaaccaaau

SEQ ID NO: 2037162 - RNA, 15 nt, Homo sapiens
agucaugggucacac

SEQ ID NO: 2037163 - RNA, 19 nt, Homo sapiens
ugggaaaugagaacauucc

SEQ ID NO: 2037164 - RNA, 18 nt, Homo sapiens
aucaaugaaaugauguca

SEQ ID NO: 2037165 - RNA, 18 nt, Homo sapiens
uugcaggaccucagguga

SEQ ID NO: 2037166 - RNA, 17 nt, Homo sapiens
ccaugugauuacccucu

SEQ ID NO: 2037167 - RNA, 16 nt, Homo sapiens
uuacaggaacuucauc

SEQ ID NO: 2037168 - RNA, 16 nt, Homo sapiens
aagcacuuugcacuua

SEQ ID NO: 2037169 - RNA, 21 nt, Homo sapiens
uucaggcagagcuguggcaca

SEQ ID NO: 2037170 - RNA, 15 nt, Homo sapiens
guucucagagacuca

SEQ ID NO: 2037171 - RNA, 14 nt, Homo sapiens
acuaaugaguuuaa

SEQ ID NO: 2037172 - RNA, 21 nt, Homo sapiens
aguaauagggcuucugccuaa

SEQ ID NO: 2037173 - RNA, 14 nt, Homo sapiens
cuugaagcuuguau

SEQ ID NO: 2037174 - RNA, 19 nt, Homo sapiens
cuuucagguccaggccagu

SEQ ID NO: 2037175 - RNA, 19 nt, Homo sapiens
auaccaaguugauacuuga

SEQ ID NO: 2037176 - RNA, 18 nt, Homo sapiens
cuucgcaucaaaagacaa

SEQ ID NO: 2037177 - RNA, 23 nt, Homo sapiens
aggaguggccguugcuacaaguc

SEQ ID NO: 2037178 - RNA, 22 nt, Homo sapiens
uaaaugggaaaucaguguuuua

SEQ ID NO: 2037179 - RNA, 14 nt, Homo sapiens
auuccacagauuau

SEQ ID NO: 2037180 - RNA, 17 nt, Homo sapiens
uuagacagagucucacu

SEQ ID NO: 2037181 - RNA, 18 nt, Homo sapiens
ccuacccugcaacuucua

SEQ ID NO: 2037182 - RNA, 17 nt, Homo sapiens
uuugcugaugcuuuuga

SEQ ID NO: 2037183 - RNA, 16 nt, Homo sapiens
cuuguaaagacuguag

SEQ ID NO: 2037184 - RNA, 13 nt, Homo sapiens
aauuguccacagc

SEQ ID NO: 2037185 - RNA, 22 nt, Homo sapiens
uugcugaguccaacaauguugu

SEQ ID NO: 2037186 - RNA, 21 nt, Homo sapiens
gcagaagagacccaaccacuu

SEQ ID NO: 2037187 - RNA, 22 nt, Homo sapiens
auuagauaaucaagggcacugu

SEQ ID NO: 2037188 - RNA, 20 nt, Homo sapiens
gacucugcagauagugccuc

SEQ ID NO: 2037189 - RNA, 14 nt, Homo sapiens
aguguuaguuauaa

SEQ ID NO: 2037190 - RNA, 14 nt, Homo sapiens
gaaagaugcagugg

SEQ ID NO: 2037191 - RNA, 22 nt, Homo sapiens
caguucuaugcagaacagugag

SEQ ID NO: 2037192 - RNA, 20 nt, Homo sapiens
auccucccuguaacuugauc

SEQ ID NO: 2037193 - RNA, 14 nt, Homo sapiens
cugcacuugcagac

SEQ ID NO: 2037194 - RNA, 14 nt, Homo sapiens
cugcauuugcagau

SEQ ID NO: 2037195 - RNA, 22 nt, Homo sapiens
agaaaguuuccccaccagugaa

SEQ ID NO: 2037196 - RNA, 20 nt, Homo sapiens
aaugaaaaggaaacuugaaa

SEQ ID NO: 2037197 - RNA, 17 nt, Homo sapiens
uccugugugagcccaga

SEQ ID NO: 2037198 - RNA, 17 nt, Homo sapiens
cucaugguccuuggagg

SEQ ID NO: 2037199 - RNA, 17 nt, Homo sapiens
aagauggcacuguccag

SEQ ID NO: 2037200 - RNA, 13 nt, Homo sapiens
cauucuaugacaa

SEQ ID NO: 2037201 - RNA, 22 nt, Homo sapiens
ugcgaucucggcucagugcaac

SEQ ID NO: 2037202 - RNA, 23 nt, Homo sapiens
ccucuccuacucggcucugcagu

SEQ ID NO: 2037203 - RNA, 16 nt, Homo sapiens
gaaugaagguaauauu

SEQ ID NO: 2037204 - RNA, 17 nt, Homo sapiens
auaaacagacaggcucu

SEQ ID NO: 2037205 - RNA, 20 nt, Homo sapiens
aauauuuauaaaugagcaaa

SEQ ID NO: 2037206 - RNA, 22 nt, Homo sapiens
cucggagaaacgggugagcuga

SEQ ID NO: 2037207 - RNA, 18 nt, Homo sapiens
auauauuaugauugcaua

SEQ ID NO: 2037208 - RNA, 21 nt, Homo sapiens
cccucugcuuuuaacucuaga

SEQ ID NO: 2037209 - RNA, 21 nt, Homo sapiens
uagaaggcuucuuagcgcagu

SEQ ID NO: 2037210 - RNA, 15 nt, Homo sapiens
caaagaauuacagua

SEQ ID NO: 2037211 - RNA, 16 nt, Homo sapiens
caauuaucaaaaaaca

SEQ ID NO: 2037212 - RNA, 17 nt, Homo sapiens
ugcuaucugaacuaauu

SEQ ID NO: 2037213 - RNA, 17 nt, Homo sapiens
ugucuuucuuuggugcc

SEQ ID NO: 2037214 - RNA, 22 nt, Homo sapiens
uggaagggaaaagcccaugauc

SEQ ID NO: 2037215 - RNA, 20 nt, Homo sapiens
gcaugucugccuaugcacug

SEQ ID NO: 2037216 - RNA, 12 nt, Homo sapiens
uagaaucagggu

SEQ ID NO: 2037217 - RNA, 17 nt, Homo sapiens
acuuuguacauguuaca

SEQ ID NO: 2037218 - RNA, 19 nt, Homo sapiens
gcuucaaagccauauggac

SEQ ID NO: 2037219 - RNA, 13 nt, Homo sapiens
cuccuccaugcug

SEQ ID NO: 2037220 - RNA, 22 nt, Homo sapiens
cugacaggaagaaaauagaaca

SEQ ID NO: 2037221 - RNA, 19 nt, Homo sapiens
aacagguauauacuuugaa

SEQ ID NO: 2037222 - RNA, 20 nt, Homo sapiens
cuauuaagacuuacuugcau

SEQ ID NO: 2037223 - RNA, 14 nt, Homo sapiens
gaaaaacaccagcu

SEQ ID NO: 2037224 - RNA, 14 nt, Homo sapiens
uggagaaggcccac

SEQ ID NO: 2037225 - RNA, 13 nt, Homo sapiens
uuuuccuucucau

SEQ ID NO: 2037226 - RNA, 20 nt, Homo sapiens
ucaggcaggguuaaacugca

SEQ ID NO: 2037227 - RNA, 16 nt, Homo sapiens
ugauucaaauugcugc

SEQ ID NO: 2037228 - RNA, 20 nt, Homo sapiens
uaaaauuuaacuuuugagca

SEQ ID NO: 2037229 - RNA, 22 nt, Homo sapiens
ccuuaaaaugugagugaccuca

SEQ ID NO: 2037230 - RNA, 18 nt, Homo sapiens
uugggcuauuuggacuca

SEQ ID NO: 2037231 - RNA, 21 nt, Homo sapiens
gguuauguugauaaaccaaaa

SEQ ID NO: 2037232 - RNA, 12 nt, Homo sapiens
auucaaggccuu

SEQ ID NO: 2037233 - RNA, 19 nt, Homo sapiens
cuggcaucugacacugaca

SEQ ID NO: 2037234 - RNA, 16 nt, Homo sapiens
caagucuaugaugcug

SEQ ID NO: 2037235 - RNA, 16 nt, Homo sapiens
uagacagagucucacu

SEQ ID NO: 2037236 - RNA, 19 nt, Homo sapiens
ccaccucggaucccacuga

SEQ ID NO: 2037237 - RNA, 22 nt, Homo sapiens
guuaugacugcguaggcaagaa

SEQ ID NO: 2037238 - RNA, 21 nt, Homo sapiens
ucuucccgcaaaucaacacuu

SEQ ID NO: 2037239 - RNA, 14 nt, Homo sapiens
aagauccucucuug

SEQ ID NO: 2037240 - RNA, 21 nt, Homo sapiens
uagcucuguggaauucaguga

SEQ ID NO: 2037241 - RNA, 21 nt, Homo sapiens
agcucuaauagagucacagcu

SEQ ID NO: 2037242 - RNA, 17 nt, Homo sapiens
ccugggaaauaagcccc

SEQ ID NO: 2037243 - RNA, 21 nt, Homo sapiens
gaaucuauccauugaacuaaa

SEQ ID NO: 2037244 - RNA, 15 nt, Homo sapiens
ccuauaaugugugua

SEQ ID NO: 2037245 - RNA, 16 nt, Homo sapiens
accuucagugcuggug

SEQ ID NO: 2037246 - RNA, 16 nt, Homo sapiens
uuccuggcuacuccau

SEQ ID NO: 2037247 - RNA, 20 nt, Homo sapiens
cugugaaaccuuuaccuuuu

SEQ ID NO: 2037248 - RNA, 12 nt, Homo sapiens
ucuacacagcaa

SEQ ID NO: 2037249 - RNA, 14 nt, Homo sapiens
cguaaggucucauu

SEQ ID NO: 2037250 - RNA, 22 nt, Homo sapiens
uauaccccaaauuguguauaua

SEQ ID NO: 2037251 - RNA, 16 nt, Homo sapiens
acuguugcguccaugc

SEQ ID NO: 2037252 - RNA, 13 nt, Homo sapiens
gaacaguguuucc

SEQ ID NO: 2037253 - RNA, 15 nt, Homo sapiens
caggcacugggcaug

SEQ ID NO: 2037254 - RNA, 13 nt, Homo sapiens
gaucugugauagu

SEQ ID NO: 2037255 - RNA, 19 nt, Homo sapiens
gaugcuggguccauaucac

SEQ ID NO: 2037256 - RNA, 18 nt, Homo sapiens
cugagucaaauccagugg

SEQ ID NO: 2037257 - RNA, 21 nt, Homo sapiens
aacauagaacucagagccaga

SEQ ID NO: 2037258 - RNA, 14 nt, Homo sapiens
aaguaaugaugaaa

SEQ ID NO: 2037259 - RNA, 14 nt, Homo sapiens
guuaacugagcuac

SEQ ID NO: 2037260 - RNA, 20 nt, Homo sapiens
acaaaaacagguauauacuu

SEQ ID NO: 2037261 - RNA, 21 nt, Homo sapiens
aauguaaauacucaugaauga

SEQ ID NO: 2037262 - RNA, 21 nt, Homo sapiens
cugaaagcugaauccuuccau

SEQ ID NO: 2037263 - RNA, 11 nt, Homo sapiens
gaaacuugaac

SEQ ID NO: 2037264 - RNA, 21 nt, Homo sapiens
ugaacccuauguguccauuuc

SEQ ID NO: 2037265 - RNA, 22 nt, Homo sapiens
uuggaugcagugcucgcuguug

SEQ ID NO: 2037266 - RNA, 14 nt, Homo sapiens
ccacaggggccaug

SEQ ID NO: 2037267 - RNA, 18 nt, Homo sapiens
uuccuuaagagcuauuug

SEQ ID NO: 2037268 - RNA, 23 nt, Homo sapiens
uuuguguaaaaaaaccaccaaaa

SEQ ID NO: 2037269 - RNA, 21 nt, Homo sapiens
caucuguugacaaaugacaga

SEQ ID NO: 2037270 - RNA, 18 nt, Homo sapiens
agaggacauauucacagu

SEQ ID NO: 2037271 - RNA, 19 nt, Homo sapiens
gacuagccugaaaauccaa

SEQ ID NO: 2037272 - RNA, 14 nt, Homo sapiens
cuggagaaagacuu

SEQ ID NO: 2037273 - RNA, 22 nt, Homo sapiens
agucauccacagcccaagggcg

SEQ ID NO: 2037274 - RNA, 19 nt, Homo sapiens
aaacauuugguugcuacug

SEQ ID NO: 2037275 - RNA, 23 nt, Homo sapiens
uucugauccucagccccuccagu

SEQ ID NO: 2037276 - RNA, 17 nt, Homo sapiens
uacugucucuccaguga

SEQ ID NO: 2037277 - RNA, 23 nt, Homo sapiens
guaaccuccacaguagcauuucu

SEQ ID NO: 2037278 - RNA, 21 nt, Homo sapiens
gcuguguuaccucaauuucag

SEQ ID NO: 2037279 - RNA, 11 nt, Homo sapiens
ucauggcauau

SEQ ID NO: 2037280 - RNA, 19 nt, Homo sapiens
augucuuuucuuccacugc

SEQ ID NO: 2037281 - RNA, 14 nt, Homo sapiens
auauguaccaugua

SEQ ID NO: 2037282 - RNA, 16 nt, Homo sapiens
uucacagauaccucuc

SEQ ID NO: 2037283 - RNA, 21 nt, Homo sapiens
ugcuggcuccacgcccugggg

SEQ ID NO: 2037284 - RNA, 20 nt, Homo sapiens
cuggcaauaaacuccuacua

SEQ ID NO: 2037285 - RNA, 21 nt, Homo sapiens
uagaaccugaggucucauuca

SEQ ID NO: 2037286 - RNA, 15 nt, Homo sapiens
uugcucuugccaaaa

SEQ ID NO: 2037287 - RNA, 23 nt, Homo sapiens
acccagacuuuuggccccagcgc

SEQ ID NO: 2037288 - RNA, 11 nt, Homo sapiens
acaagcacaau

SEQ ID NO: 2037289 - RNA, 17 nt, Homo sapiens
agauuuuaaaacuucau

SEQ ID NO: 2037290 - RNA, 18 nt, Homo sapiens
ugcaugguggcaccagcg

SEQ ID NO: 2037291 - RNA, 15 nt, Homo sapiens
agccacuaccuucug

SEQ ID NO: 2037292 - RNA, 13 nt, Homo sapiens
agcaccuccaugu

SEQ ID NO: 2037293 - RNA, 17 nt, Homo sapiens
agcaagucuuaguacau

SEQ ID NO: 2037294 - RNA, 16 nt, Homo sapiens
uaaaacucccuuccuu

SEQ ID NO: 2037295 - RNA, 21 nt, Homo sapiens
gaaauuuuguaagaaggcaau

SEQ ID NO: 2037296 - RNA, 15 nt, Homo sapiens
gccaucucuuccuca

SEQ ID NO: 2037297 - RNA, 14 nt, Homo sapiens
ugcugguuccugac

SEQ ID NO: 2037298 - RNA, 14 nt, Homo sapiens
ucuguaaacucaaa

SEQ ID NO: 2037299 - RNA, 20 nt, Homo sapiens
ggccauguucccagaaccuu

SEQ ID NO: 2037300 - RNA, 20 nt, Homo sapiens
ccaugcguuucuuccacuga

SEQ ID NO: 2037301 - RNA, 21 nt, Homo sapiens
gccaaggucaugccacugcac

SEQ ID NO: 2037302 - RNA, 22 nt, Homo sapiens
cagggccuggcaggccaguguc

SEQ ID NO: 2037303 - RNA, 15 nt, Homo sapiens
aaacuauugagccuu

SEQ ID NO: 2037304 - RNA, 22 nt, Homo sapiens
cauguugccaugaggccuuucc

SEQ ID NO: 2037305 - RNA, 22 nt, Homo sapiens
agugcucaagguuacugggagu

SEQ ID NO: 2037306 - RNA, 23 nt, Homo sapiens
ggcccccgucagggagaggucac

SEQ ID NO: 2037307 - RNA, 21 nt, Homo sapiens
aucagacuugcggccacagca

SEQ ID NO: 2037308 - RNA, 12 nt, Homo sapiens
uagacugccugg

SEQ ID NO: 2037309 - RNA, 14 nt, Homo sapiens
augguaaucagaaa

SEQ ID NO: 2037310 - RNA, 17 nt, Homo sapiens
uagagcaaccuauauaa

SEQ ID NO: 2037311 - RNA, 23 nt, Homo sapiens
uuucaauaacaaagcacauaacu

SEQ ID NO: 2037312 - RNA, 16 nt, Homo sapiens
auuucuaaguguuuca

SEQ ID NO: 2037313 - RNA, 14 nt, Homo sapiens
auauuucaaccaca

SEQ ID NO: 2037314 - RNA, 16 nt, Homo sapiens
uuuucuguaauucuuc

SEQ ID NO: 2037315 - RNA, 21 nt, Homo sapiens
gagcaucugucccacugggac

SEQ ID NO: 2037316 - RNA, 13 nt, Homo sapiens
uauauuugucaug

SEQ ID NO: 2037317 - RNA, 13 nt, Homo sapiens
cuguagaguugcu

SEQ ID NO: 2037318 - RNA, 15 nt, Homo sapiens
uccugaaauaaacac

SEQ ID NO: 2037319 - RNA, 13 nt, Homo sapiens
cacaccuguaauc

SEQ ID NO: 2037320 - RNA, 13 nt, Homo sapiens
cacugcuguaaag

SEQ ID NO: 2037321 - RNA, 14 nt, Homo sapiens
aggacacaguggga

SEQ ID NO: 2037322 - RNA, 16 nt, Homo sapiens
uccuguccguguuugu

SEQ ID NO: 2037323 - RNA, 23 nt, Homo sapiens
ccuaggaaagccaguuacauaaa

SEQ ID NO: 2037324 - RNA, 13 nt, Homo sapiens
uaaaguacaagag

SEQ ID NO: 2037325 - RNA, 18 nt, Homo sapiens
uauuucuuaauuuggaua

SEQ ID NO: 2037326 - RNA, 15 nt, Homo sapiens
auucugucacucacc

SEQ ID NO: 2037327 - RNA, 23 nt, Homo sapiens
aggcagagguugcagugagcuga

SEQ ID NO: 2037328 - RNA, 19 nt, Homo sapiens
ugcaguggcgcgaucucag

SEQ ID NO: 2037329 - RNA, 11 nt, Homo sapiens
agccauugcac

SEQ ID NO: 2037330 - RNA, 20 nt, Homo sapiens
aauuagccggucaugguggu

SEQ ID NO: 2037331 - RNA, 16 nt, Homo sapiens
aauguaacauacucau

SEQ ID NO: 2037332 - RNA, 17 nt, Homo sapiens
cccagcagcucaagaag

SEQ ID NO: 2037333 - RNA, 13 nt, Homo sapiens
uugucauaccuuu

SEQ ID NO: 2037334 - RNA, 17 nt, Homo sapiens
gaacaagagaaguacua

SEQ ID NO: 2037335 - RNA, 22 nt, Homo sapiens
uagaaacugaggccauuauuuc

SEQ ID NO: 2037336 - RNA, 13 nt, Homo sapiens
augguuagacagc

SEQ ID NO: 2037337 - RNA, 18 nt, Homo sapiens
ucuugcaaagauuucuca

SEQ ID NO: 2037338 - RNA, 22 nt, Homo sapiens
ugccuacgaauagccacugcau

SEQ ID NO: 2037339 - RNA, 12 nt, Homo sapiens
aaccuaccugug

SEQ ID NO: 2037340 - RNA, 16 nt, Homo sapiens
guucaaaccugugaag

SEQ ID NO: 2037341 - RNA, 21 nt, Homo sapiens
uguaguuaaggaaaacugagg

SEQ ID NO: 2037342 - RNA, 18 nt, Homo sapiens
caaagucugugugaugaa

SEQ ID NO: 2037343 - RNA, 15 nt, Homo sapiens
auauacacuuuacau

SEQ ID NO: 2037344 - RNA, 14 nt, Homo sapiens
cuguaagugucuug

SEQ ID NO: 2037345 - RNA, 13 nt, Homo sapiens
guccccuucuuuu

SEQ ID NO: 2037346 - RNA, 17 nt, Homo sapiens
agagaaguguggggaag

SEQ ID NO: 2037347 - RNA, 20 nt, Homo sapiens
uggauccagggaaaagcagu

SEQ ID NO: 2037348 - RNA, 17 nt, Homo sapiens
gugaaaugugaaggaaa

SEQ ID NO: 2037349 - RNA, 14 nt, Homo sapiens
cauaaagacugugc

SEQ ID NO: 2037350 - RNA, 16 nt, Homo sapiens
gguuaagacagggugg

SEQ ID NO: 2037351 - RNA, 20 nt, Homo sapiens
aguguagcuaccuacaugcu

SEQ ID NO: 2037352 - RNA, 15 nt, Homo sapiens
gccccugcccggcug

SEQ ID NO: 2037353 - RNA, 18 nt, Homo sapiens
aaaauuguuuaccauaga

SEQ ID NO: 2037354 - RNA, 14 nt, Homo sapiens
auuauuaaucucau

SEQ ID NO: 2037355 - RNA, 18 nt, Homo sapiens
aucuccuuaccucuggaa

SEQ ID NO: 2037356 - RNA, 14 nt, Homo sapiens
uuuauuaaacucau

SEQ ID NO: 2037357 - RNA, 21 nt, Homo sapiens
auguuugauacucuaguaugu

SEQ ID NO: 2037358 - RNA, 17 nt, Homo sapiens
acuuaaaaaaagcacau

SEQ ID NO: 2037359 - RNA, 17 nt, Homo sapiens
uuaaaaauaaauucaaa

SEQ ID NO: 2037360 - RNA, 16 nt, Homo sapiens
acuuguggacacagcu

SEQ ID NO: 2037361 - RNA, 23 nt, Homo sapiens
ucccucuaaaacuagaaaaggaa

SEQ ID NO: 2037362 - RNA, 15 nt, Homo sapiens
uuggauguggagcuc

SEQ ID NO: 2037363 - RNA, 18 nt, Homo sapiens
gugucaccuugguuugca

SEQ ID NO: 2037364 - RNA, 14 nt, Homo sapiens
cagaccuuuggacu

SEQ ID NO: 2037365 - RNA, 23 nt, Homo sapiens
uaagaaauuccauacuucucuca

SEQ ID NO: 2037366 - RNA, 17 nt, Homo sapiens
aguuauuuuuugaauaa

SEQ ID NO: 2037367 - RNA, 17 nt, Homo sapiens
uuagauuucugaaucuc

SEQ ID NO: 2037368 - RNA, 20 nt, Homo sapiens
gauucuccagccaaccucau

SEQ ID NO: 2037369 - RNA, 13 nt, Homo sapiens
acguggaugaagc

SEQ ID NO: 2037370 - RNA, 19 nt, Homo sapiens
agucauuggcaaagugaca

SEQ ID NO: 2037371 - RNA, 14 nt, Homo sapiens
uggaugguagaaua

SEQ ID NO: 2037372 - RNA, 20 nt, Homo sapiens
aagcagaaagggccuugaau

SEQ ID NO: 2037373 - RNA, 22 nt, Homo sapiens
uuuaagcauuuucuacacagcg

SEQ ID NO: 2037374 - RNA, 21 nt, Homo sapiens
gagaucgugccacugcacucc

SEQ ID NO: 2037375 - RNA, 21 nt, Homo sapiens
gagaucaugccacuacacucc

SEQ ID NO: 2037376 - RNA, 23 nt, Homo sapiens
agcucucggaacugcaugcugcu

SEQ ID NO: 2037377 - RNA, 21 nt, Homo sapiens
aaggucacuuugcguguguca

SEQ ID NO: 2037378 - RNA, 13 nt, Homo sapiens
auuuguuuuuacc

SEQ ID NO: 2037379 - RNA, 13 nt, Homo sapiens
cucaguucuuccu

SEQ ID NO: 2037380 - RNA, 23 nt, Homo sapiens
ccacuggaacguuucacugcaaa

SEQ ID NO: 2037381 - RNA, 15 nt, Homo sapiens
guuuauugauauuca

SEQ ID NO: 2037382 - RNA, 21 nt, Homo sapiens
ggcugugggucugcaccucug

SEQ ID NO: 2037383 - RNA, 23 nt, Homo sapiens
ccuucucacagcacaugcuggcc

SEQ ID NO: 2037384 - RNA, 19 nt, Homo sapiens
acugaagccugcuccuucu

SEQ ID NO: 2037385 - RNA, 22 nt, Homo sapiens
gguucuuugaccagcacauuaa

SEQ ID NO: 2037386 - RNA, 23 nt, Homo sapiens
caauuaaacauuacuguuuucca

SEQ ID NO: 2037387 - RNA, 18 nt, Homo sapiens
gaaccacacagcuaaggg

SEQ ID NO: 2037388 - RNA, 13 nt, Homo sapiens
caaccccaugaga

SEQ ID NO: 2037389 - RNA, 23 nt, Homo sapiens
uugguccagagcggaggcugugu

SEQ ID NO: 2037390 - RNA, 22 nt, Homo sapiens
uggaccaaaggaaggaagcaag

SEQ ID NO: 2037391 - RNA, 21 nt, Homo sapiens
uguaaauagagaucaguuugu

SEQ ID NO: 2037392 - RNA, 16 nt, Homo sapiens
agcccugaguggucac

SEQ ID NO: 2037393 - RNA, 22 nt, Homo sapiens
gucaaaauaaaggauaacucug

SEQ ID NO: 2037394 - RNA, 15 nt, Homo sapiens
gacagccaaguuaua

SEQ ID NO: 2037395 - RNA, 19 nt, Homo sapiens
aaaugacagcaccugagaa

SEQ ID NO: 2037396 - RNA, 12 nt, Homo sapiens
cucuuaagccua

SEQ ID NO: 2037397 - RNA, 15 nt, Homo sapiens
uaaaucuuucucuca

SEQ ID NO: 2037398 - RNA, 16 nt, Homo sapiens
acuauucucaaaugcu

SEQ ID NO: 2037399 - RNA, 15 nt, Homo sapiens
uaaaaauacaaaaau

SEQ ID NO: 2037400 - RNA, 17 nt, Homo sapiens
uuauaucagacugcuuu

SEQ ID NO: 2037401 - RNA, 15 nt, Homo sapiens
uaauauaacaauaua

SEQ ID NO: 2037402 - RNA, 16 nt, Homo sapiens
guugaauuucccacau

SEQ ID NO: 2037403 - RNA, 22 nt, Homo sapiens
acuucauggucccaaaauguca

SEQ ID NO: 2037404 - RNA, 14 nt, Homo sapiens
gucuucuaauuccu

SEQ ID NO: 2037405 - RNA, 21 nt, Homo sapiens
aauuguuguaauugcauuaua

SEQ ID NO: 2037406 - RNA, 16 nt, Homo sapiens
caagagagacauggaa

SEQ ID NO: 2037407 - RNA, 17 nt, Homo sapiens
ugggaggcagaaaccua

SEQ ID NO: 2037408 - RNA, 18 nt, Homo sapiens
gaucugggagauccugca

SEQ ID NO: 2037409 - RNA, 18 nt, Homo sapiens
uaacagcuuucuuauuca

SEQ ID NO: 2037410 - RNA, 18 nt, Homo sapiens
auucauuggcagcucaaa

SEQ ID NO: 2037411 - RNA, 13 nt, Homo sapiens
cuaaugcucugaa

SEQ ID NO: 2037412 - RNA, 13 nt, Homo sapiens
aggagacugaguu

SEQ ID NO: 2037413 - RNA, 18 nt, Homo sapiens
uaguucacugacacagua

SEQ ID NO: 2037414 - RNA, 14 nt, Homo sapiens
guaggaauugagga

SEQ ID NO: 2037415 - RNA, 14 nt, Homo sapiens
gaguagaauugcau

SEQ ID NO: 2037416 - RNA, 17 nt, Homo sapiens
aauauuguauacuacca

SEQ ID NO: 2037417 - RNA, 13 nt, Homo sapiens
agucuacacugcc

SEQ ID NO: 2037418 - RNA, 21 nt, Homo sapiens
agugagccaucaucauggcau

SEQ ID NO: 2037419 - RNA, 23 nt, Homo sapiens
ugacccuugugucucauauaccc

SEQ ID NO: 2037420 - RNA, 13 nt, Homo sapiens
cuuguucauucug

SEQ ID NO: 2037421 - RNA, 23 nt, Homo sapiens
auccaaucucaauaucuggguca

SEQ ID NO: 2037422 - RNA, 14 nt, Homo sapiens
cuuucagauuaugg

SEQ ID NO: 2037423 - RNA, 23 nt, Homo sapiens
gauucugugaucuuuuaaagugu

SEQ ID NO: 2037424 - RNA, 14 nt, Homo sapiens
uaacucuguccuua

SEQ ID NO: 2037425 - RNA, 15 nt, Homo sapiens
augaaguucuggaga

SEQ ID NO: 2037426 - RNA, 16 nt, Homo sapiens
cacucucaaauccuga

SEQ ID NO: 2037427 - RNA, 17 nt, Homo sapiens
cgcccuccucccuguca

SEQ ID NO: 2037428 - RNA, 14 nt, Homo sapiens
cuguguaucugaua

SEQ ID NO: 2037429 - RNA, 17 nt, Homo sapiens
aaauuugcaacauauaa

SEQ ID NO: 2037430 - RNA, 22 nt, Homo sapiens
acaguugcauugacugucacau

SEQ ID NO: 2037431 - RNA, 17 nt, Homo sapiens
ggcaccuguaguccuag

SEQ ID NO: 2037432 - RNA, 14 nt, Homo sapiens
cucugcugcaucuu

SEQ ID NO: 2037433 - RNA, 18 nt, Homo sapiens
ccuggggacuguuccaaa

SEQ ID NO: 2037434 - RNA, 22 nt, Homo sapiens
aauuaauucucagauuccugcc

SEQ ID NO: 2037435 - RNA, 21 nt, Homo sapiens
gcagccccucccagccuaccc

SEQ ID NO: 2037436 - RNA, 18 nt, Homo sapiens
uuacugcuuucugaaugu

SEQ ID NO: 2037437 - RNA, 16 nt, Homo sapiens
gugauugucaccauga

SEQ ID NO: 2037438 - RNA, 18 nt, Homo sapiens
ugaaaaugcuguuuucaa

SEQ ID NO: 2037439 - RNA, 16 nt, Homo sapiens
uguugcuuaucauuug

SEQ ID NO: 2037440 - RNA, 23 nt, Homo sapiens
aagagcauuugguacacacuuga

SEQ ID NO: 2037441 - RNA, 22 nt, Homo sapiens
agcuuucccugccucucaucaa

SEQ ID NO: 2037442 - RNA, 17 nt, Homo sapiens
cccugagcuugcagggu

SEQ ID NO: 2037443 - RNA, 14 nt, Homo sapiens
caccccucugccaa

SEQ ID NO: 2037444 - RNA, 15 nt, Homo sapiens
uugaaaugcuguuag

SEQ ID NO: 2037445 - RNA, 12 nt, Homo sapiens
ucaucaccaccc

SEQ ID NO: 2037446 - RNA, 14 nt, Homo sapiens
cacuucucucagga

SEQ ID NO: 2037447 - RNA, 14 nt, Homo sapiens
ugaaaggaugaucc

SEQ ID NO: 2037448 - RNA, 16 nt, Homo sapiens
caauaugugccaauca

SEQ ID NO: 2037449 - RNA, 22 nt, Homo sapiens
aaauuauuugaaaacauauaaa

SEQ ID NO: 2037450 - RNA, 12 nt, Homo sapiens
aauggugcuguu

SEQ ID NO: 2037451 - RNA, 19 nt, Homo sapiens
cuauuguauauauaaucua

SEQ ID NO: 2037452 - RNA, 21 nt, Homo sapiens
uguuuuuuagcauaagccaga

SEQ ID NO: 2037453 - RNA, 14 nt, Homo sapiens
auaccuccaacccu

SEQ ID NO: 2037454 - RNA, 12 nt, Homo sapiens
cgaucucagcuc

SEQ ID NO: 2037455 - RNA, 13 nt, Homo sapiens
cucucccuaggcu

SEQ ID NO: 2037456 - RNA, 14 nt, Homo sapiens
auucggaccaagca

SEQ ID NO: 2037457 - RNA, 21 nt, Homo sapiens
aacuuccgccuccuguguuca

SEQ ID NO: 2037458 - RNA, 15 nt, Homo sapiens
ccaugccucaagaac

SEQ ID NO: 2037459 - RNA, 16 nt, Homo sapiens
aagaucuucuguacuu

SEQ ID NO: 2037460 - RNA, 10 nt, Homo sapiens
accacccacc

SEQ ID NO: 2037461 - RNA, 21 nt, Homo sapiens
gucugacauguuugugcucug

SEQ ID NO: 2037462 - RNA, 14 nt, Homo sapiens
guccucacaggugu

SEQ ID NO: 2037463 - RNA, 21 nt, Homo sapiens
ugccaggcauucaauccucag

SEQ ID NO: 2037464 - RNA, 18 nt, Homo sapiens
caauaguuagaucuaccc

SEQ ID NO: 2037465 - RNA, 19 nt, Homo sapiens
ugaugugugagcuaugcaa

SEQ ID NO: 2037466 - RNA, 18 nt, Homo sapiens
guucccugcaggagagag

SEQ ID NO: 2037467 - RNA, 17 nt, Homo sapiens
ugaacaaagcagccacg

SEQ ID NO: 2037468 - RNA, 18 nt, Homo sapiens
auauaggcauuucacaaa

SEQ ID NO: 2037469 - RNA, 16 nt, Homo sapiens
caggcuguaaggcaug

SEQ ID NO: 2037470 - RNA, 16 nt, Homo sapiens
ccuucagacacccuca

SEQ ID NO: 2037471 - RNA, 23 nt, Homo sapiens
uaauguacaauaaagcaaugugg

SEQ ID NO: 2037472 - RNA, 13 nt, Homo sapiens
ucugcaauauuau

SEQ ID NO: 2037473 - RNA, 17 nt, Homo sapiens
cugucucuaaccauuca

SEQ ID NO: 2037474 - RNA, 19 nt, Homo sapiens
acccuccagaauccugaug

SEQ ID NO: 2037475 - RNA, 18 nt, Homo sapiens
guugugaugaaucaauga

SEQ ID NO: 2037476 - RNA, 21 nt, Homo sapiens
uccccacccccgcugggggug

SEQ ID NO: 2037477 - RNA, 19 nt, Homo sapiens
cacguaauuuuuuucacag

SEQ ID NO: 2037478 - RNA, 22 nt, Homo sapiens
cugggagcagcucugugacucc

SEQ ID NO: 2037479 - RNA, 14 nt, Homo sapiens
ugcaagccaucucu

SEQ ID NO: 2037480 - RNA, 23 nt, Homo sapiens
cccagcccucaggccagugccag

SEQ ID NO: 2037481 - RNA, 13 nt, Homo sapiens
uacuguagccuca

SEQ ID NO: 2037482 - RNA, 16 nt, Homo sapiens
auuuagucuugccagg

SEQ ID NO: 2037483 - RNA, 16 nt, Homo sapiens
cugcucuuugaacucc

SEQ ID NO: 2037484 - RNA, 17 nt, Homo sapiens
acauaauuuugugcaug

SEQ ID NO: 2037485 - RNA, 20 nt, Homo sapiens
gcccccaauaaaggcagcug

SEQ ID NO: 2037486 - RNA, 18 nt, Homo sapiens
auccuccaagaauuugac

SEQ ID NO: 2037487 - RNA, 19 nt, Homo sapiens
gggccacaucccacugcca

SEQ ID NO: 2037488 - RNA, 20 nt, Homo sapiens
acuggcaauaaacuccuacu

SEQ ID NO: 2037489 - RNA, 17 nt, Homo sapiens
aacuuuaaaacugcuca

SEQ ID NO: 2037490 - RNA, 17 nt, Homo sapiens
ugagugugugugcaugg

SEQ ID NO: 2037491 - RNA, 14 nt, Homo sapiens
accaaugaacuuua

SEQ ID NO: 2037492 - RNA, 14 nt, Homo sapiens
agggucucagggug

SEQ ID NO: 2037493 - RNA, 15 nt, Homo sapiens
ggugagaccaaagga

SEQ ID NO: 2037494 - RNA, 17 nt, Homo sapiens
aaaauagaaaagcacuu

SEQ ID NO: 2037495 - RNA, 14 nt, Homo sapiens
gacuacagcuguua

SEQ ID NO: 2037496 - RNA, 17 nt, Homo sapiens
ugggaacagugugcaag

SEQ ID NO: 2037497 - RNA, 19 nt, Homo sapiens
cacugacucuggaaaaggc

SEQ ID NO: 2037498 - RNA, 18 nt, Homo sapiens
gcuguguuuccaucucaa

SEQ ID NO: 2037499 - RNA, 15 nt, Homo sapiens
agggcuaaacaugug

SEQ ID NO: 2037500 - RNA, 14 nt, Homo sapiens
agaugcuacaguau

SEQ ID NO: 2037501 - RNA, 15 nt, Homo sapiens
acauacauccaacau

SEQ ID NO: 2037502 - RNA, 22 nt, Homo sapiens
uccaccgggccugaaccacagc

SEQ ID NO: 2037503 - RNA, 16 nt, Homo sapiens
ugucagugagucagag

SEQ ID NO: 2037504 - RNA, 17 nt, Homo sapiens
cugagcagugccagcuu

SEQ ID NO: 2037505 - RNA, 23 nt, Homo sapiens
aaauauuuugacuuguugagggu

SEQ ID NO: 2037506 - RNA, 12 nt, Homo sapiens
caguuacugaaa

SEQ ID NO: 2037507 - RNA, 12 nt, Homo sapiens
cugauacuguau

SEQ ID NO: 2037508 - RNA, 12 nt, Homo sapiens
uugaaaaccaca

SEQ ID NO: 2037509 - RNA, 12 nt, Homo sapiens
cugaaaacuaca

SEQ ID NO: 2037510 - RNA, 20 nt, Homo sapiens
gcuacucuguuccuucacau

SEQ ID NO: 2037511 - RNA, 21 nt, Homo sapiens
ugauucagccaaaugcaggga

SEQ ID NO: 2037512 - RNA, 17 nt, Homo sapiens
agcaaaggaaaccaaag

SEQ ID NO: 2037513 - RNA, 17 nt, Homo sapiens
gagacaaacuuguucaa

SEQ ID NO: 2037514 - RNA, 17 nt, Homo sapiens
uaccagaaggagaugcu

SEQ ID NO: 2037515 - RNA, 16 nt, Homo sapiens
guauuauuagucuguu

SEQ ID NO: 2037516 - RNA, 18 nt, Homo sapiens
aacccaagagcaagggcu

SEQ ID NO: 2037517 - RNA, 18 nt, Homo sapiens
ggaacagacaacagaagu

SEQ ID NO: 2037518 - RNA, 21 nt, Homo sapiens
aacagagaagggaaagcaguc

SEQ ID NO: 2037519 - RNA, 14 nt, Homo sapiens
uucuagucacuucc

SEQ ID NO: 2037520 - RNA, 22 nt, Homo sapiens
uauccuuccaaaaaauuaaaac

SEQ ID NO: 2037521 - RNA, 17 nt, Homo sapiens
uuuuuguggaagcacuu

SEQ ID NO: 2037522 - RNA, 12 nt, Homo sapiens
ccugggagacag

SEQ ID NO: 2037523 - RNA, 18 nt, Homo sapiens
ccugaggacugauuucag

SEQ ID NO: 2037524 - RNA, 16 nt, Homo sapiens
uucuggaaaugaagga

SEQ ID NO: 2037525 - RNA, 22 nt, Homo sapiens
ccagcauauauacuugcaagau

SEQ ID NO: 2037526 - RNA, 18 nt, Homo sapiens
ugacuuagcgucaagaca

SEQ ID NO: 2037527 - RNA, 11 nt, Homo sapiens
uuuucaucaca

SEQ ID NO: 2037528 - RNA, 15 nt, Homo sapiens
gcacugacugggcau

SEQ ID NO: 2037529 - RNA, 22 nt, Homo sapiens
cgguggaggaaggcucugucac

SEQ ID NO: 2037530 - RNA, 12 nt, Homo sapiens
uggcuggcacag

SEQ ID NO: 2037531 - RNA, 16 nt, Homo sapiens
cuuucuggccuguuau

SEQ ID NO: 2037532 - RNA, 17 nt, Homo sapiens
guguugugcagcauuaa

SEQ ID NO: 2037533 - RNA, 22 nt, Homo sapiens
uaacugugaaauaccacaagcc

SEQ ID NO: 2037534 - RNA, 18 nt, Homo sapiens
ucauuuccaaacuugaaa

SEQ ID NO: 2037535 - RNA, 22 nt, Homo sapiens
guguuguguuccuggcugauga

SEQ ID NO: 2037536 - RNA, 21 nt, Homo sapiens
guaacauagcugagguaaaaa

SEQ ID NO: 2037537 - RNA, 23 nt, Homo sapiens
uccuuuuauuuauaacaauguua

SEQ ID NO: 2037538 - RNA, 14 nt, Homo sapiens
aaucaaaugugcau

SEQ ID NO: 2037539 - RNA, 18 nt, Homo sapiens
ccuaaaauauauuccuga

SEQ ID NO: 2037540 - RNA, 14 nt, Homo sapiens
uccuccuacuguau

SEQ ID NO: 2037541 - RNA, 16 nt, Homo sapiens
acuggcaacaguugga

SEQ ID NO: 2037542 - RNA, 13 nt, Homo sapiens
caccugugguuuu

SEQ ID NO: 2037543 - RNA, 19 nt, Homo sapiens
gaaaugcugcccaugccac

SEQ ID NO: 2037544 - RNA, 17 nt, Homo sapiens
uccuggaauaaaccaca

SEQ ID NO: 2037545 - RNA, 16 nt, Homo sapiens
aucugagaaaaggcaa

SEQ ID NO: 2037546 - RNA, 19 nt, Homo sapiens
auugggucgugguggagaa

SEQ ID NO: 2037547 - RNA, 15 nt, Homo sapiens
agguauuacacucug

SEQ ID NO: 2037548 - RNA, 14 nt, Homo sapiens
agcguccaggugau

SEQ ID NO: 2037549 - RNA, 15 nt, Homo sapiens
uaaucucagcacuuu

SEQ ID NO: 2037550 - RNA, 23 nt, Homo sapiens
cucuccuggcccugaaggugcca

SEQ ID NO: 2037551 - RNA, 16 nt, Homo sapiens
cucuuucccuuccagu

SEQ ID NO: 2037552 - RNA, 14 nt, Homo sapiens
ccaaacacacugua

SEQ ID NO: 2037553 - RNA, 20 nt, Homo sapiens
aacaaugcugauuuggugac

SEQ ID NO: 2037554 - RNA, 12 nt, Homo sapiens
gaagccuugcca

SEQ ID NO: 2037555 - RNA, 13 nt, Homo sapiens
ugagaacuccuga

SEQ ID NO: 2037556 - RNA, 15 nt, Homo sapiens
aaacucaccauuuca

SEQ ID NO: 2037557 - RNA, 21 nt, Homo sapiens
aauauuuuuuucuagcuauaa

SEQ ID NO: 2037558 - RNA, 22 nt, Homo sapiens
aacguuuacuuaucuuaugcca

SEQ ID NO: 2037559 - RNA, 13 nt, Homo sapiens
uauagcagucauc

SEQ ID NO: 2037560 - RNA, 17 nt, Homo sapiens
gccuuuauuuccacugu

SEQ ID NO: 2037561 - RNA, 16 nt, Homo sapiens
aagcugugacccucaa

SEQ ID NO: 2037562 - RNA, 12 nt, Homo sapiens
cuuugucugucg

SEQ ID NO: 2037563 - RNA, 23 nt, Homo sapiens
ucacucuuucuucucucuuuguc

SEQ ID NO: 2037564 - RNA, 17 nt, Homo sapiens
agcucuccugggccagg

SEQ ID NO: 2037565 - RNA, 21 nt, Homo sapiens
uggaugugaagcucacacuga

SEQ ID NO: 2037566 - RNA, 21 nt, Homo sapiens
cucccugggccaccuccuacc

SEQ ID NO: 2037567 - RNA, 11 nt, Homo sapiens
gaccaccaaca

SEQ ID NO: 2037568 - RNA, 18 nt, Homo sapiens
ugucuuuguucugugauu

SEQ ID NO: 2037569 - RNA, 22 nt, Homo sapiens
ugcuacgcuccagcugauccag

SEQ ID NO: 2037570 - RNA, 13 nt, Homo sapiens
uaaaucagugcag

SEQ ID NO: 2037571 - RNA, 21 nt, Homo sapiens
gcuuccuccugguguggaaga

SEQ ID NO: 2037572 - RNA, 16 nt, Homo sapiens
aaaacaagguccagua

SEQ ID NO: 2037573 - RNA, 16 nt, Homo sapiens
auauuucaauacugcu

SEQ ID NO: 2037574 - RNA, 12 nt, Homo sapiens
cgauuagcuuua

SEQ ID NO: 2037575 - RNA, 16 nt, Homo sapiens
caggaagaaagggaaa

SEQ ID NO: 2037576 - RNA, 16 nt, Homo sapiens
cucagaaaaucaaaga

SEQ ID NO: 2037577 - RNA, 13 nt, Homo sapiens
uucuucacugucu

SEQ ID NO: 2037578 - RNA, 16 nt, Homo sapiens
agugacuuugagcuga

SEQ ID NO: 2037579 - RNA, 22 nt, Homo sapiens
auauucucuuugugaggacaaa

SEQ ID NO: 2037580 - RNA, 22 nt, Homo sapiens
uuuugcauaacgucugccuucu

SEQ ID NO: 2037581 - RNA, 15 nt, Homo sapiens
gugagaaauagcuga

SEQ ID NO: 2037582 - RNA, 20 nt, Homo sapiens
ugacaaaugcccugcaccua

SEQ ID NO: 2037583 - RNA, 17 nt, Homo sapiens
caagagcguuacuguag

SEQ ID NO: 2037584 - RNA, 14 nt, Homo sapiens
caaaugacugucag

SEQ ID NO: 2037585 - RNA, 14 nt, Homo sapiens
cucugucucaaaaa

SEQ ID NO: 2037586 - RNA, 20 nt, Homo sapiens
agagcaagacuccaucucaa

SEQ ID NO: 2037587 - RNA, 20 nt, Homo sapiens
agagcgagacuccgucucaa

SEQ ID NO: 2037588 - RNA, 20 nt, Homo sapiens
agagugagacucugucucaa

SEQ ID NO: 2037589 - RNA, 22 nt, Homo sapiens
agguaaauuuuuaggcaaagau

SEQ ID NO: 2037590 - RNA, 19 nt, Homo sapiens
cugcuuacccaucuucaaa

SEQ ID NO: 2037591 - RNA, 19 nt, Homo sapiens
augccagugacacuuccag

SEQ ID NO: 2037592 - RNA, 22 nt, Homo sapiens
cuucuucaggcugccuaagaca

SEQ ID NO: 2037593 - RNA, 16 nt, Homo sapiens
ccacccaauuggccca

SEQ ID NO: 2037594 - RNA, 14 nt, Homo sapiens
agaauggaggaauc

SEQ ID NO: 2037595 - RNA, 18 nt, Homo sapiens
gugcagcccuuccucccu

SEQ ID NO: 2037596 - RNA, 17 nt, Homo sapiens
accagcuucauguggcu

SEQ ID NO: 2037597 - RNA, 14 nt, Homo sapiens
auuuggcauugauc

SEQ ID NO: 2037598 - RNA, 22 nt, Homo sapiens
guccacagaguuuguaguaaau

SEQ ID NO: 2037599 - RNA, 11 nt, Homo sapiens
ccacagggaac

SEQ ID NO: 2037600 - RNA, 13 nt, Homo sapiens
ucugagggucuga

SEQ ID NO: 2037601 - RNA, 22 nt, Homo sapiens
gaugggauggcaaaugcuguga

SEQ ID NO: 2037602 - RNA, 15 nt, Homo sapiens
cuuacugaagccagg

SEQ ID NO: 2037603 - RNA, 16 nt, Homo sapiens
auuauaaacaaaaagc

SEQ ID NO: 2037604 - RNA, 14 nt, Homo sapiens
guuguagcauuuaa

SEQ ID NO: 2037605 - RNA, 11 nt, Homo sapiens
aaucucacaaa

SEQ ID NO: 2037606 - RNA, 18 nt, Homo sapiens
aauguuagucauuguuau

SEQ ID NO: 2037607 - RNA, 22 nt, Homo sapiens
cugucaguaggggcaugguaua

SEQ ID NO: 2037608 - RNA, 17 nt, Homo sapiens
ucugauguggcaaaagg

SEQ ID NO: 2037609 - RNA, 21 nt, Homo sapiens
ucauccuugaccucauuuaca

SEQ ID NO: 2037610 - RNA, 22 nt, Homo sapiens
aauguguuuuucccccaugaaa

SEQ ID NO: 2037611 - RNA, 21 nt, Homo sapiens
aagcugccugcuuuucacugc

SEQ ID NO: 2037612 - RNA, 20 nt, Homo sapiens
gagcccccuguccuucccac

SEQ ID NO: 2037613 - RNA, 18 nt, Homo sapiens
ugugaauugaagucauca

SEQ ID NO: 2037614 - RNA, 16 nt, Homo sapiens
augaaaguggacaagg

SEQ ID NO: 2037615 - RNA, 17 nt, Homo sapiens
guacauuguuaccucua

SEQ ID NO: 2037616 - RNA, 18 nt, Homo sapiens
aggaaugaggcucuguaa

SEQ ID NO: 2037617 - RNA, 17 nt, Homo sapiens
gcacuauccccacuuuu

SEQ ID NO: 2037618 - RNA, 13 nt, Homo sapiens
cagcuggacaggu

SEQ ID NO: 2037619 - RNA, 13 nt, Homo sapiens
agccaacugcugc

SEQ ID NO: 2037620 - RNA, 21 nt, Homo sapiens
caaguccugugaauuucuuca

SEQ ID NO: 2037621 - RNA, 16 nt, Homo sapiens
cuguuaauauucaugu

SEQ ID NO: 2037622 - RNA, 18 nt, Homo sapiens
cauaagcuacugccaucc

SEQ ID NO: 2037623 - RNA, 15 nt, Homo sapiens
uugaugccauaugcc

SEQ ID NO: 2037624 - RNA, 16 nt, Homo sapiens
acacauaaaagcacaa

SEQ ID NO: 2037625 - RNA, 13 nt, Homo sapiens
auuugcaccaguu

SEQ ID NO: 2037626 - RNA, 18 nt, Homo sapiens
ugacucuuagccccagac

SEQ ID NO: 2037627 - RNA, 11 nt, Homo sapiens
gcauuagcaca

SEQ ID NO: 2037628 - RNA, 22 nt, Homo sapiens
ggaugcauagccuggacacaga

SEQ ID NO: 2037629 - RNA, 14 nt, Homo sapiens
accucgugcuuuaa

SEQ ID NO: 2037630 - RNA, 15 nt, Homo sapiens
cgggccccaccugca

SEQ ID NO: 2037631 - RNA, 21 nt, Homo sapiens
ccacagaagguguucaaacac

SEQ ID NO: 2037632 - RNA, 16 nt, Homo sapiens
ucauaauaaauaucua

SEQ ID NO: 2037633 - RNA, 12 nt, Homo sapiens
cccagcacugac

SEQ ID NO: 2037634 - RNA, 19 nt, Homo sapiens
ucagcgccuggccuaccca

SEQ ID NO: 2037635 - RNA, 16 nt, Homo sapiens
aaacauccagauacac

SEQ ID NO: 2037636 - RNA, 16 nt, Homo sapiens
ucccuaggaaacucac

SEQ ID NO: 2037637 - RNA, 20 nt, Homo sapiens
gauucucaccagcugugucc

SEQ ID NO: 2037638 - RNA, 11 nt, Homo sapiens
guucacuccca

SEQ ID NO: 2037639 - RNA, 12 nt, Homo sapiens
gacuucugcuag

SEQ ID NO: 2037640 - RNA, 18 nt, Homo sapiens
cuuuaucuaauaccucug

SEQ ID NO: 2037641 - RNA, 22 nt, Homo sapiens
auucucaguucucuucacucaa

SEQ ID NO: 2037642 - RNA, 23 nt, Homo sapiens
cugaggaaggccguaaaaugggg

SEQ ID NO: 2037643 - RNA, 18 nt, Homo sapiens
auauuuagucugcauugc

SEQ ID NO: 2037644 - RNA, 17 nt, Homo sapiens
cucaaaugcugggggua

SEQ ID NO: 2037645 - RNA, 22 nt, Homo sapiens
uuuuugggaaaagaaaagucaa

SEQ ID NO: 2037646 - RNA, 15 nt, Homo sapiens
cauaaugcgugcaua

SEQ ID NO: 2037647 - RNA, 15 nt, Homo sapiens
ccuucuaggucacuu

SEQ ID NO: 2037648 - RNA, 24 nt, Homo sapiens
auuuacaggucuucucuccaacuc

SEQ ID NO: 2037649 - RNA, 21 nt, Homo sapiens
uuuaacauugcugauguagua

SEQ ID NO: 2037650 - RNA, 19 nt, Homo sapiens
agacaggguuucacugugu

SEQ ID NO: 2037651 - RNA, 15 nt, Homo sapiens
uggugucugucagac

SEQ ID NO: 2037652 - RNA, 17 nt, Homo sapiens
gggggucauuguucucc

SEQ ID NO: 2037653 - RNA, 13 nt, Homo sapiens
aaccuccacugcu

SEQ ID NO: 2037654 - RNA, 16 nt, Homo sapiens
ucucggcucacugcaa

SEQ ID NO: 2037655 - RNA, 17 nt, Homo sapiens
uaagcuguaacuuguca

SEQ ID NO: 2037656 - RNA, 21 nt, Homo sapiens
gcccccaguggacaccaauga

SEQ ID NO: 2037657 - RNA, 17 nt, Homo sapiens
ccaaacugacucuuaag

SEQ ID NO: 2037658 - RNA, 22 nt, Homo sapiens
caguguaauaauaaaucguccu

SEQ ID NO: 2037659 - RNA, 18 nt, Homo sapiens
agucaucaugaacuggcu

SEQ ID NO: 2037660 - RNA, 23 nt, Homo sapiens
auucuaacccaagacaugacauu

SEQ ID NO: 2037661 - RNA, 15 nt, Homo sapiens
uaaaacaaugaagga

SEQ ID NO: 2037662 - RNA, 22 nt, Homo sapiens
uacuguacccucgcaugacugu

SEQ ID NO: 2037663 - RNA, 18 nt, Homo sapiens
aaugugcucuacaucucg

SEQ ID NO: 2037664 - RNA, 14 nt, Homo sapiens
uaccaaagcugcug

SEQ ID NO: 2037665 - RNA, 21 nt, Homo sapiens
uccucacacacccugagguca

SEQ ID NO: 2037666 - RNA, 14 nt, Homo sapiens
aggagcuacacucc

SEQ ID NO: 2037667 - RNA, 20 nt, Homo sapiens
auguaacauuaauucuacua

SEQ ID NO: 2037668 - RNA, 23 nt, Homo sapiens
aauuucugaacaccauagguaga

SEQ ID NO: 2037669 - RNA, 14 nt, Homo sapiens
acauaaaagaacaa

SEQ ID NO: 2037670 - RNA, 16 nt, Homo sapiens
ucgagaccaaccugac

SEQ ID NO: 2037671 - RNA, 15 nt, Homo sapiens
acuugaagugagaag

SEQ ID NO: 2037672 - RNA, 14 nt, Homo sapiens
aguguucauugcac

SEQ ID NO: 2037673 - RNA, 16 nt, Homo sapiens
caugguggcaugugcc

SEQ ID NO: 2037674 - RNA, 21 nt, Homo sapiens
agcaaauggagaaguucagga

SEQ ID NO: 2037675 - RNA, 13 nt, Homo sapiens
acuaaaugaacua

SEQ ID NO: 2037676 - RNA, 13 nt, Homo sapiens
ccuauaugcacuu

SEQ ID NO: 2037677 - RNA, 13 nt, Homo sapiens
ccuugaugcacag

SEQ ID NO: 2037678 - RNA, 19 nt, Homo sapiens
gcuucaucccacaaucuua

SEQ ID NO: 2037679 - RNA, 19 nt, Homo sapiens
uccaguaauagcaagucuu

SEQ ID NO: 2037680 - RNA, 20 nt, Homo sapiens
uugacguuucuucuuucuag

SEQ ID NO: 2037681 - RNA, 23 nt, Homo sapiens
aggaugcggaaggauugcaaugc

SEQ ID NO: 2037682 - RNA, 18 nt, Homo sapiens
caacuguuggauucagaa

SEQ ID NO: 2037683 - RNA, 18 nt, Homo sapiens
uccugaccucaggugauc

SEQ ID NO: 2037684 - RNA, 16 nt, Homo sapiens
uugccuuugaauguua

SEQ ID NO: 2037685 - RNA, 19 nt, Homo sapiens
aaacaauuggcaaacuuug

SEQ ID NO: 2037686 - RNA, 19 nt, Homo sapiens
cauaaugaaaaacuauguc

SEQ ID NO: 2037687 - RNA, 15 nt, Homo sapiens
aaucuauucugcuaa

SEQ ID NO: 2037688 - RNA, 11 nt, Homo sapiens
cacaacaaucc

SEQ ID NO: 2037689 - RNA, 13 nt, Homo sapiens
augcugacuguac

SEQ ID NO: 2037690 - RNA, 22 nt, Homo sapiens
uucuaaaggggacagaucuuga

SEQ ID NO: 2037691 - RNA, 23 nt, Homo sapiens
ugccggcucuggcucuccccaau

SEQ ID NO: 2037692 - RNA, 11 nt, Homo sapiens
guugguucuga

SEQ ID NO: 2037693 - RNA, 23 nt, Homo sapiens
augagguacaaccuguucugcuu

SEQ ID NO: 2037694 - RNA, 21 nt, Homo sapiens
guagucucuccccuggccaca

SEQ ID NO: 2037695 - RNA, 21 nt, Homo sapiens
uggccucucagucaaacaagu

SEQ ID NO: 2037696 - RNA, 12 nt, Homo sapiens
aaggugccacuu

SEQ ID NO: 2037697 - RNA, 13 nt, Homo sapiens
uauuaggauauca

SEQ ID NO: 2037698 - RNA, 13 nt, Homo sapiens
aaaacaccaaaga

SEQ ID NO: 2037699 - RNA, 13 nt, Homo sapiens
cagagaagcugga

SEQ ID NO: 2037700 - RNA, 13 nt, Homo sapiens
guauuuucauuua

SEQ ID NO: 2037701 - RNA, 20 nt, Homo sapiens
cuggaaggcuuuauucuucc

SEQ ID NO: 2037702 - RNA, 23 nt, Homo sapiens
uaaacgaagagacagaacugucc

SEQ ID NO: 2037703 - RNA, 23 nt, Homo sapiens
agugguggguaauuguacaauaa

SEQ ID NO: 2037704 - RNA, 18 nt, Homo sapiens
accaauuguacauucccu

SEQ ID NO: 2037705 - RNA, 13 nt, Homo sapiens
aguauauaaccuc

SEQ ID NO: 2037706 - RNA, 18 nt, Homo sapiens
cuuaaaagaacauaggaa

SEQ ID NO: 2037707 - RNA, 19 nt, Homo sapiens
agccccacugcuugcacug

SEQ ID NO: 2037708 - RNA, 21 nt, Homo sapiens
aacuuuaagaaagguaaagac

SEQ ID NO: 2037709 - RNA, 19 nt, Homo sapiens
caaucaguagccagcaucu

SEQ ID NO: 2037710 - RNA, 20 nt, Homo sapiens
gggacaacuguagaggcagu

SEQ ID NO: 2037711 - RNA, 24 nt, Homo sapiens
gucuccucuucaaauaaacauguc

SEQ ID NO: 2037712 - RNA, 14 nt, Homo sapiens
accuuggcauccuu

SEQ ID NO: 2037713 - RNA, 20 nt, Homo sapiens
gagcuuugaaagcagucacu

SEQ ID NO: 2037714 - RNA, 22 nt, Homo sapiens
ccucaggcaaggucuggccuca

SEQ ID NO: 2037715 - RNA, 13 nt, Homo sapiens
cccuacaccaagu

SEQ ID NO: 2037716 - RNA, 23 nt, Homo sapiens
uauuuuuggcugggggaguguga

SEQ ID NO: 2037717 - RNA, 21 nt, Homo sapiens
aauuuuguaguaguugaugac

SEQ ID NO: 2037718 - RNA, 22 nt, Homo sapiens
gaaucuuauuuuuccuguccug

SEQ ID NO: 2037719 - RNA, 15 nt, Homo sapiens
cuuggagucaaaagg

SEQ ID NO: 2037720 - RNA, 20 nt, Homo sapiens
gaagcugcugugacuguguc

SEQ ID NO: 2037721 - RNA, 20 nt, Homo sapiens
aaccuucauccuagcacuaa

SEQ ID NO: 2037722 - RNA, 17 nt, Homo sapiens
accucccucugccaguc

SEQ ID NO: 2037723 - RNA, 17 nt, Homo sapiens
accuccccuugccagcu

SEQ ID NO: 2037724 - RNA, 17 nt, Homo sapiens
uaaucaucaaguaauac

SEQ ID NO: 2037725 - RNA, 16 nt, Homo sapiens
gccuccccguccaggc

SEQ ID NO: 2037726 - RNA, 16 nt, Homo sapiens
caaagauaacaugcuu

SEQ ID NO: 2037727 - RNA, 16 nt, Homo sapiens
caggcuggagugcagu

SEQ ID NO: 2037728 - RNA, 16 nt, Homo sapiens
caggcuagagugcaau

SEQ ID NO: 2037729 - RNA, 14 nt, Homo sapiens
gggugaaaccacau

SEQ ID NO: 2037730 - RNA, 17 nt, Homo sapiens
aggaacugagguuuaca

SEQ ID NO: 2037731 - RNA, 20 nt, Homo sapiens
caggguagguuugugucuua

SEQ ID NO: 2037732 - RNA, 21 nt, Homo sapiens
uaaaaguuuuuuauuaugcau

SEQ ID NO: 2037733 - RNA, 20 nt, Homo sapiens
ggauaguccaaagacuuaac

SEQ ID NO: 2037734 - RNA, 15 nt, Homo sapiens
cagcacuaauucaac

SEQ ID NO: 2037735 - RNA, 20 nt, Homo sapiens
caggagucucugccacccac

SEQ ID NO: 2037736 - RNA, 17 nt, Homo sapiens
ugaaauaaggaaugaua

SEQ ID NO: 2037737 - RNA, 13 nt, Homo sapiens
aggagcaacagcu

SEQ ID NO: 2037738 - RNA, 22 nt, Homo sapiens
gcuguguccgccgcaccagcca

SEQ ID NO: 2037739 - RNA, 14 nt, Homo sapiens
agcuuggacagucu

SEQ ID NO: 2037740 - RNA, 16 nt, Homo sapiens
aucccuuccucuccca

SEQ ID NO: 2037741 - RNA, 21 nt, Homo sapiens
aacuccugacaucaggugauc

SEQ ID NO: 2037742 - RNA, 16 nt, Homo sapiens
acccaacaggugcuga

SEQ ID NO: 2037743 - RNA, 15 nt, Homo sapiens
cuuuagcgcccaguu

SEQ ID NO: 2037744 - RNA, 18 nt, Homo sapiens
ccagccauuguaauuuga

SEQ ID NO: 2037745 - RNA, 22 nt, Homo sapiens
cagaugggagugcccccaacag

SEQ ID NO: 2037746 - RNA, 13 nt, Homo sapiens
gaacugcuugugc

SEQ ID NO: 2037747 - RNA, 22 nt, Homo sapiens
uuuuucaagagcuccuugaccc

SEQ ID NO: 2037748 - RNA, 21 nt, Homo sapiens
uuaucguccagugacuuucag

SEQ ID NO: 2037749 - RNA, 20 nt, Homo sapiens
gcuugggaaacucaacuucu

SEQ ID NO: 2037750 - RNA, 20 nt, Homo sapiens
gucaccggccuugugacauu

SEQ ID NO: 2037751 - RNA, 20 nt, Homo sapiens
ggagacagagguugcaguga

SEQ ID NO: 2037752 - RNA, 16 nt, Homo sapiens
cacaggcugugccaac

SEQ ID NO: 2037753 - RNA, 19 nt, Homo sapiens
guuucaaaauaaaaaccaa

SEQ ID NO: 2037754 - RNA, 20 nt, Homo sapiens
aaaaucaguuuuccucucaa

SEQ ID NO: 2037755 - RNA, 20 nt, Homo sapiens
accucaguucccucuugcuc

SEQ ID NO: 2037756 - RNA, 22 nt, Homo sapiens
aacaaugucugguuaguuaaaa

SEQ ID NO: 2037757 - RNA, 17 nt, Homo sapiens
cgaggcaaugacuguga

SEQ ID NO: 2037758 - RNA, 19 nt, Homo sapiens
auuugggcaggaacacaga

SEQ ID NO: 2037759 - RNA, 22 nt, Homo sapiens
cuggcaacagagcgagauucca

SEQ ID NO: 2037760 - RNA, 22 nt, Homo sapiens
caccaaaagaagaaaccuucau

SEQ ID NO: 2037761 - RNA, 19 nt, Homo sapiens
ccaggaggcggcagugcaa

SEQ ID NO: 2037762 - RNA, 14 nt, Homo sapiens
caaguuugcuaaaa

SEQ ID NO: 2037763 - RNA, 13 nt, Homo sapiens
auucacagcaagu

SEQ ID NO: 2037764 - RNA, 12 nt, Homo sapiens
cuugaaaucuga

SEQ ID NO: 2037765 - RNA, 15 nt, Homo sapiens
aucuuguacagccuu

SEQ ID NO: 2037766 - RNA, 15 nt, Homo sapiens
ucauccuccacugaa

SEQ ID NO: 2037767 - RNA, 16 nt, Homo sapiens
accuucuauguauuag

SEQ ID NO: 2037768 - RNA, 14 nt, Homo sapiens
uuuaaauagccuaa

SEQ ID NO: 2037769 - RNA, 15 nt, Homo sapiens
cagccaagccugacu

SEQ ID NO: 2037770 - RNA, 18 nt, Homo sapiens
ugcaauagacacauacau

SEQ ID NO: 2037771 - RNA, 16 nt, Homo sapiens
aauuaaaauuuaucuu

SEQ ID NO: 2037772 - RNA, 24 nt, Homo sapiens
gaacugcguuaugaagagcuaauu

SEQ ID NO: 2037773 - RNA, 23 nt, Homo sapiens
aauuugaggacaagauaccaagg

SEQ ID NO: 2037774 - RNA, 18 nt, Homo sapiens
cuguaucaucuuugccaa

SEQ ID NO: 2037775 - RNA, 15 nt, Homo sapiens
caacucugaagcuaa

SEQ ID NO: 2037776 - RNA, 14 nt, Homo sapiens
cagaggcauuugag

SEQ ID NO: 2037777 - RNA, 19 nt, Homo sapiens
uaacuguuccccuugguau

SEQ ID NO: 2037778 - RNA, 22 nt, Homo sapiens
gauacuauuaccaccaccugcu

SEQ ID NO: 2037779 - RNA, 19 nt, Homo sapiens
guauaagccccgaggccua

SEQ ID NO: 2037780 - RNA, 13 nt, Homo sapiens
gaggacucaccac

SEQ ID NO: 2037781 - RNA, 22 nt, Homo sapiens
cuggacaggcucugcuucucca

SEQ ID NO: 2037782 - RNA, 21 nt, Homo sapiens
guagcguuuccuuucuucccu

SEQ ID NO: 2037783 - RNA, 18 nt, Homo sapiens
uccaaaaacagugauuaa

SEQ ID NO: 2037784 - RNA, 12 nt, Homo sapiens
cuacuugccaca

SEQ ID NO: 2037785 - RNA, 13 nt, Homo sapiens
ugcugcugugcag

SEQ ID NO: 2037786 - RNA, 16 nt, Homo sapiens
ugaugcccccacagca

SEQ ID NO: 2037787 - RNA, 13 nt, Homo sapiens
ggaaagaugaaug

SEQ ID NO: 2037788 - RNA, 23 nt, Homo sapiens
caacccugugcaugacugauguu

SEQ ID NO: 2037789 - RNA, 14 nt, Homo sapiens
acuaacagccucag

SEQ ID NO: 2037790 - RNA, 14 nt, Homo sapiens
cuuuuucagggaaa

SEQ ID NO: 2037791 - RNA, 16 nt, Homo sapiens
agacuauucuaaugaa

SEQ ID NO: 2037792 - RNA, 16 nt, Homo sapiens
agggcagcaggccaga

SEQ ID NO: 2037793 - RNA, 18 nt, Homo sapiens
acacuggaacauggcuag

SEQ ID NO: 2037794 - RNA, 19 nt, Homo sapiens
uuuugcuggucacugccau

SEQ ID NO: 2037795 - RNA, 14 nt, Homo sapiens
gcuuucaguauuag

SEQ ID NO: 2037796 - RNA, 14 nt, Homo sapiens
aaucuuacuuugua

SEQ ID NO: 2037797 - RNA, 15 nt, Homo sapiens
caaugcaaaguacau

SEQ ID NO: 2037798 - RNA, 21 nt, Homo sapiens
agguguccuuuccccucucug

SEQ ID NO: 2037799 - RNA, 15 nt, Homo sapiens
ucucagcugcuggau

SEQ ID NO: 2037800 - RNA, 12 nt, Homo sapiens
cgccuuccucuc

SEQ ID NO: 2037801 - RNA, 23 nt, Homo sapiens
aaauuccagaagaagagaagcug

SEQ ID NO: 2037802 - RNA, 14 nt, Homo sapiens
uugaauagucucau

SEQ ID NO: 2037803 - RNA, 19 nt, Homo sapiens
cagcaugagugcugagaua

SEQ ID NO: 2037804 - RNA, 22 nt, Homo sapiens
ugaaguuauggcuucacauuca

SEQ ID NO: 2037805 - RNA, 16 nt, Homo sapiens
aaauggaugacaaaga

SEQ ID NO: 2037806 - RNA, 15 nt, Homo sapiens
gcuaaaacagcuucc

SEQ ID NO: 2037807 - RNA, 15 nt, Homo sapiens
ugaguaucacuuuaa

SEQ ID NO: 2037808 - RNA, 17 nt, Homo sapiens
gcuccuagaguauauuc

SEQ ID NO: 2037809 - RNA, 21 nt, Homo sapiens
ccaauacuucauuaauuucaa

SEQ ID NO: 2037810 - RNA, 17 nt, Homo sapiens
uaaugugcugagcauuu

SEQ ID NO: 2037811 - RNA, 19 nt, Homo sapiens
cacuggcgagcaggugccc

SEQ ID NO: 2037812 - RNA, 15 nt, Homo sapiens
agccuguguccugaa

SEQ ID NO: 2037813 - RNA, 21 nt, Homo sapiens
cugacauuagauugaugugca

SEQ ID NO: 2037814 - RNA, 17 nt, Homo sapiens
caagauccugucuugcu

SEQ ID NO: 2037815 - RNA, 13 nt, Homo sapiens
cuaguucugccag

SEQ ID NO: 2037816 - RNA, 19 nt, Homo sapiens
gagaacaagaaagggccag

SEQ ID NO: 2037817 - RNA, 22 nt, Homo sapiens
uccuuuuuuggggaguaccugu

SEQ ID NO: 2037818 - RNA, 16 nt, Homo sapiens
aggcuuaaaaacugaa

SEQ ID NO: 2037819 - RNA, 20 nt, Homo sapiens
uaaaucuuccagcaugcauc

SEQ ID NO: 2037820 - RNA, 17 nt, Homo sapiens
ugagaaaagcuuugaac

SEQ ID NO: 2037821 - RNA, 19 nt, Homo sapiens
cagucucacucuguugccc

SEQ ID NO: 2037822 - RNA, 15 nt, Homo sapiens
gcuccugacacugcu

SEQ ID NO: 2037823 - RNA, 21 nt, Homo sapiens
uugccccuuacgacucucacc

SEQ ID NO: 2037824 - RNA, 17 nt, Homo sapiens
cgggucugucaggguug

SEQ ID NO: 2037825 - RNA, 17 nt, Homo sapiens
guguaucuaauucagcu

SEQ ID NO: 2037826 - RNA, 18 nt, Homo sapiens
uacccaugcacaguacaa

SEQ ID NO: 2037827 - RNA, 16 nt, Homo sapiens
uccaugaagcacugag

SEQ ID NO: 2037828 - RNA, 17 nt, Homo sapiens
accccuguuaagcaauu

SEQ ID NO: 2037829 - RNA, 21 nt, Homo sapiens
uccuuucagcaauccaugaga

SEQ ID NO: 2037830 - RNA, 21 nt, Homo sapiens
gauuucagaucauauuucaca

SEQ ID NO: 2037831 - RNA, 16 nt, Homo sapiens
cagcuccgacugccgc

SEQ ID NO: 2037832 - RNA, 23 nt, Homo sapiens
cccacgugggccuuuugcucagu

SEQ ID NO: 2037833 - RNA, 13 nt, Homo sapiens
cccgcccucggga

SEQ ID NO: 2037834 - RNA, 16 nt, Homo sapiens
agagacccaagcugcc

SEQ ID NO: 2037835 - RNA, 14 nt, Homo sapiens
gagggaaagccagc

SEQ ID NO: 2037836 - RNA, 17 nt, Homo sapiens
ucaucgcucuacaccug

SEQ ID NO: 2037837 - RNA, 20 nt, Homo sapiens
cuaaauaagcuuccacgcca

SEQ ID NO: 2037838 - RNA, 19 nt, Homo sapiens
caauggcugcugaagcugc

SEQ ID NO: 2037839 - RNA, 13 nt, Homo sapiens
cugagauguagcc

SEQ ID NO: 2037840 - RNA, 13 nt, Homo sapiens
cauagauguuucc

SEQ ID NO: 2037841 - RNA, 18 nt, Homo sapiens
uuggauuauuccucuaca

SEQ ID NO: 2037842 - RNA, 22 nt, Homo sapiens
uggcucuaacauuacugccuuc

SEQ ID NO: 2037843 - RNA, 16 nt, Homo sapiens
acuucuggaugcccau

SEQ ID NO: 2037844 - RNA, 20 nt, Homo sapiens
ucagcuuuucauaauaucua

SEQ ID NO: 2037845 - RNA, 22 nt, Homo sapiens
aggcagggagggggcugggaaa

SEQ ID NO: 2037846 - RNA, 14 nt, Homo sapiens
aauaaaacauuccu

SEQ ID NO: 2037847 - RNA, 12 nt, Homo sapiens
cagccuuggcac

SEQ ID NO: 2037848 - RNA, 15 nt, Homo sapiens
gaugagcccacagag

SEQ ID NO: 2037849 - RNA, 17 nt, Homo sapiens
caugagguacagcagaa

SEQ ID NO: 2037850 - RNA, 16 nt, Homo sapiens
ucaugauuuggcaugg

SEQ ID NO: 2037851 - RNA, 15 nt, Homo sapiens
cacguccacuuucaa

SEQ ID NO: 2037852 - RNA, 15 nt, Homo sapiens
augaaagagccagac

SEQ ID NO: 2037853 - RNA, 14 nt, Homo sapiens
ucuguuccauaguu

SEQ ID NO: 2037854 - RNA, 18 nt, Homo sapiens
acugauuugauaccaugg

SEQ ID NO: 2037855 - RNA, 16 nt, Homo sapiens
ggugagaaaucacaau

SEQ ID NO: 2037856 - RNA, 21 nt, Homo sapiens
aagugguuaaaacauagcuuu

SEQ ID NO: 2037857 - RNA, 14 nt, Homo sapiens
gaaaucagugcgau

SEQ ID NO: 2037858 - RNA, 21 nt, Homo sapiens
gccaggccgggaaaaagccca

SEQ ID NO: 2037859 - RNA, 19 nt, Homo sapiens
uugagggaaucaugggcag

SEQ ID NO: 2037860 - RNA, 17 nt, Homo sapiens
auggugagcucugggaa

SEQ ID NO: 2037861 - RNA, 12 nt, Homo sapiens
gugaaguguuac

SEQ ID NO: 2037862 - RNA, 12 nt, Homo sapiens
accaaacccagc

SEQ ID NO: 2037863 - RNA, 20 nt, Homo sapiens
uugauuuuccucucucacaa

SEQ ID NO: 2037864 - RNA, 15 nt, Homo sapiens
cacuaaggguggaga

SEQ ID NO: 2037865 - RNA, 22 nt, Homo sapiens
accucauggggguauuguauaa

SEQ ID NO: 2037866 - RNA, 22 nt, Homo sapiens
auauaccuuuuguuaccacaga

SEQ ID NO: 2037867 - RNA, 13 nt, Homo sapiens
gacaccauucuga

SEQ ID NO: 2037868 - RNA, 19 nt, Homo sapiens
cacauaagcccaguucauc

SEQ ID NO: 2037869 - RNA, 14 nt, Homo sapiens
aacuccaugccuau

SEQ ID NO: 2037870 - RNA, 17 nt, Homo sapiens
aagucugucaugccaaa

SEQ ID NO: 2037871 - RNA, 18 nt, Homo sapiens
ccauaauucagauuucua

SEQ ID NO: 2037872 - RNA, 15 nt, Homo sapiens
uauauuucagugaca

SEQ ID NO: 2037873 - RNA, 12 nt, Homo sapiens
uaugaguauaau

SEQ ID NO: 2037874 - RNA, 12 nt, Homo sapiens
auuuaguaauag

SEQ ID NO: 2037875 - RNA, 18 nt, Homo sapiens
aacaauuuuaaauuugaa

SEQ ID NO: 2037876 - RNA, 12 nt, Homo sapiens
auggcauauaau

SEQ ID NO: 2037877 - RNA, 13 nt, Homo sapiens
uuaaugauuuagc

SEQ ID NO: 2037878 - RNA, 16 nt, Homo sapiens
gcccagagcacuuuag

SEQ ID NO: 2037879 - RNA, 18 nt, Homo sapiens
uuccuguugaaugacaaa

SEQ ID NO: 2037880 - RNA, 16 nt, Homo sapiens
aacaaaaaaagcauug

SEQ ID NO: 2037881 - RNA, 13 nt, Homo sapiens
caucaccauggaa

SEQ ID NO: 2037882 - RNA, 22 nt, Homo sapiens
agcaggguagagaggacaaaga

SEQ ID NO: 2037883 - RNA, 18 nt, Homo sapiens
acaugcaccuugcuccca

SEQ ID NO: 2037884 - RNA, 16 nt, Homo sapiens
uuuguaaauaugcaaa

SEQ ID NO: 2037885 - RNA, 17 nt, Homo sapiens
cucuucaucugcuacaa

SEQ ID NO: 2037886 - RNA, 23 nt, Homo sapiens
augcuuuugguccagguacugag

SEQ ID NO: 2037887 - RNA, 16 nt, Homo sapiens
uccagcaucccaagau

SEQ ID NO: 2037888 - RNA, 18 nt, Homo sapiens
ugacacaaguggaccuua

SEQ ID NO: 2037889 - RNA, 21 nt, Homo sapiens
agagcaaaguguaacggccaa

SEQ ID NO: 2037890 - RNA, 13 nt, Homo sapiens
gucaagauugcaa

SEQ ID NO: 2037891 - RNA, 18 nt, Homo sapiens
ugcucguuuucgcugggg

SEQ ID NO: 2037892 - RNA, 11 nt, Homo sapiens
agccaucucaa

SEQ ID NO: 2037893 - RNA, 15 nt, Homo sapiens
uaaacucuggaugau

SEQ ID NO: 2037894 - RNA, 15 nt, Homo sapiens
cuuuaauccaaaagg

SEQ ID NO: 2037895 - RNA, 13 nt, Homo sapiens
ccacugcacucua

SEQ ID NO: 2037896 - RNA, 13 nt, Homo sapiens
ccauugcacucca

SEQ ID NO: 2037897 - RNA, 20 nt, Homo sapiens
auagauuucuacacugaggu

SEQ ID NO: 2037898 - RNA, 20 nt, Homo sapiens
ucucccaagacugcucccuu

SEQ ID NO: 2037899 - RNA, 16 nt, Homo sapiens
auugaaguauuuugcu

SEQ ID NO: 2037900 - RNA, 21 nt, Homo sapiens
acaguucauguuugcuucaua

SEQ ID NO: 2037901 - RNA, 18 nt, Homo sapiens
aaagcaaaauaauaagaa

SEQ ID NO: 2037902 - RNA, 17 nt, Homo sapiens
aucacaauguacuauau

SEQ ID NO: 2037903 - RNA, 15 nt, Homo sapiens
accucaaaucacugc

SEQ ID NO: 2037904 - RNA, 15 nt, Homo sapiens
cuaaguucaagaaga

SEQ ID NO: 2037905 - RNA, 23 nt, Homo sapiens
uacggguguaaacacugauggua

SEQ ID NO: 2037906 - RNA, 21 nt, Homo sapiens
gacuggaggcaggacuccugg

SEQ ID NO: 2037907 - RNA, 14 nt, Homo sapiens
cucagcaauggcag

SEQ ID NO: 2037908 - RNA, 16 nt, Homo sapiens
uauuuagauuggcagu

SEQ ID NO: 2037909 - RNA, 18 nt, Homo sapiens
cugagagucugcacuuaa

SEQ ID NO: 2037910 - RNA, 19 nt, Homo sapiens
aguuguaccaagugaaauu

SEQ ID NO: 2037911 - RNA, 13 nt, Homo sapiens
aagugacucucac

SEQ ID NO: 2037912 - RNA, 19 nt, Homo sapiens
acauagucuuuguuuacau

SEQ ID NO: 2037913 - RNA, 20 nt, Homo sapiens
agcuguguccugcaguuccc

SEQ ID NO: 2037914 - RNA, 13 nt, Homo sapiens
augccgauuucau

SEQ ID NO: 2037915 - RNA, 18 nt, Homo sapiens
gacuucauacaucccuca

SEQ ID NO: 2037916 - RNA, 14 nt, Homo sapiens
agcacucauuccuu

SEQ ID NO: 2037917 - RNA, 21 nt, Homo sapiens
aacagauauuuuuaacuuaau

SEQ ID NO: 2037918 - RNA, 15 nt, Homo sapiens
uauaaguaacuuguc

SEQ ID NO: 2037919 - RNA, 23 nt, Homo sapiens
auagccuggacuuuccuguuguc

SEQ ID NO: 2037920 - RNA, 12 nt, Homo sapiens
ugacaaauugaa

SEQ ID NO: 2037921 - RNA, 22 nt, Homo sapiens
caccccagaauccccuggggag

SEQ ID NO: 2037922 - RNA, 22 nt, Homo sapiens
ucaagaauggggaucacagaga

SEQ ID NO: 2037923 - RNA, 20 nt, Homo sapiens
ccagcugacgcgacuaucau

SEQ ID NO: 2037924 - RNA, 21 nt, Homo sapiens
cucgugcccaucaagugcagu

SEQ ID NO: 2037925 - RNA, 15 nt, Homo sapiens
cugccggcccaguga

SEQ ID NO: 2037926 - RNA, 22 nt, Homo sapiens
uaaauucgagaagcaaucugcc

SEQ ID NO: 2037927 - RNA, 22 nt, Homo sapiens
ugcuggaaguagaauuugucca

SEQ ID NO: 2037928 - RNA, 16 nt, Homo sapiens
aaugcuuuuugaucug

SEQ ID NO: 2037929 - RNA, 16 nt, Homo sapiens
caggauggcgcaggaa

SEQ ID NO: 2037930 - RNA, 15 nt, Homo sapiens
ugucugccuucacaa

SEQ ID NO: 2037931 - RNA, 18 nt, Homo sapiens
ugcagaaagaaauugagc

SEQ ID NO: 2037932 - RNA, 20 nt, Homo sapiens
uccagcuguacuagugccau

SEQ ID NO: 2037933 - RNA, 16 nt, Homo sapiens
aagcaguucucacaau

SEQ ID NO: 2037934 - RNA, 21 nt, Homo sapiens
uaacucccuccucacacucca

SEQ ID NO: 2037935 - RNA, 21 nt, Homo sapiens
aucugacuuuagccuaccuaa

SEQ ID NO: 2037936 - RNA, 23 nt, Homo sapiens
acaaaugaggggagaaugcuaaa

SEQ ID NO: 2037937 - RNA, 18 nt, Homo sapiens
ccacuucucacucaccac

SEQ ID NO: 2037938 - RNA, 14 nt, Homo sapiens
ccagagaauucuua

SEQ ID NO: 2037939 - RNA, 17 nt, Homo sapiens
gaguagguacuccauaa

SEQ ID NO: 2037940 - RNA, 15 nt, Homo sapiens
auaugcaagcagcuu

SEQ ID NO: 2037941 - RNA, 15 nt, Homo sapiens
cacggaccaugcgac

SEQ ID NO: 2037942 - RNA, 17 nt, Homo sapiens
aagugaagacaaugacu

SEQ ID NO: 2037943 - RNA, 14 nt, Homo sapiens
gcuguggagcaaaa

SEQ ID NO: 2037944 - RNA, 23 nt, Homo sapiens
cuaguugugaccuuaguguuucu

SEQ ID NO: 2037945 - RNA, 13 nt, Homo sapiens
acacucgccagcu

SEQ ID NO: 2037946 - RNA, 22 nt, Homo sapiens
gaagaugauccacaacuugaga

SEQ ID NO: 2037947 - RNA, 14 nt, Homo sapiens
cuggaauuuaccuc

SEQ ID NO: 2037948 - RNA, 15 nt, Homo sapiens
ucuguggcaaaaaga

SEQ ID NO: 2037949 - RNA, 23 nt, Homo sapiens
auauuuauucauuauuugucaaa

SEQ ID NO: 2037950 - RNA, 13 nt, Homo sapiens
aauauucugucau

SEQ ID NO: 2037951 - RNA, 16 nt, Homo sapiens
agccaucucaagcaag

SEQ ID NO: 2037952 - RNA, 19 nt, Homo sapiens
gaaaggccugcacacaagc

SEQ ID NO: 2037953 - RNA, 21 nt, Homo sapiens
ccaacuugagggcccagagca

SEQ ID NO: 2037954 - RNA, 19 nt, Homo sapiens
guugagcgugcgucugugu

SEQ ID NO: 2037955 - RNA, 23 nt, Homo sapiens
ggagcugggcccgacauggcucc

SEQ ID NO: 2037956 - RNA, 14 nt, Homo sapiens
acugaagccuuucu

SEQ ID NO: 2037957 - RNA, 21 nt, Homo sapiens
ccacuuccuuuuaacugccaa

SEQ ID NO: 2037958 - RNA, 21 nt, Homo sapiens
auucaguugguaagcuuccag

SEQ ID NO: 2037959 - RNA, 22 nt, Homo sapiens
acguugccuaauaaacauccuu

SEQ ID NO: 2037960 - RNA, 18 nt, Homo sapiens
acccuugagaagcugcca

SEQ ID NO: 2037961 - RNA, 21 nt, Homo sapiens
gccagugggacccucucagaa

SEQ ID NO: 2037962 - RNA, 19 nt, Homo sapiens
agacaaauccuuucugccc

SEQ ID NO: 2037963 - RNA, 14 nt, Homo sapiens
ugcaggacacagau

SEQ ID NO: 2037964 - RNA, 22 nt, Homo sapiens
aacaucaguugggaucccuccu

SEQ ID NO: 2037965 - RNA, 13 nt, Homo sapiens
gaugggacaccca

SEQ ID NO: 2037966 - RNA, 18 nt, Homo sapiens
guuaucuuuuaaaauuca

SEQ ID NO: 2037967 - RNA, 14 nt, Homo sapiens
auuuuggggaggag

SEQ ID NO: 2037968 - RNA, 22 nt, Homo sapiens
uguuggucacauggagcucuuc

SEQ ID NO: 2037969 - RNA, 15 nt, Homo sapiens
uuauucugauuccac

SEQ ID NO: 2037970 - RNA, 14 nt, Homo sapiens
aagacauucuucca

SEQ ID NO: 2037971 - RNA, 21 nt, Homo sapiens
ugugcuggaaagcguugaugg

SEQ ID NO: 2037972 - RNA, 18 nt, Homo sapiens
caccaagcugcucuccuu

SEQ ID NO: 2037973 - RNA, 19 nt, Homo sapiens
acucuuguuuucaguuuca

SEQ ID NO: 2037974 - RNA, 18 nt, Homo sapiens
cuucauuguuacauguaa

SEQ ID NO: 2037975 - RNA, 15 nt, Homo sapiens
auuccaaaacuuuaa

SEQ ID NO: 2037976 - RNA, 16 nt, Homo sapiens
cacacgcacauauaca

SEQ ID NO: 2037977 - RNA, 13 nt, Homo sapiens
aaguacauguauu

SEQ ID NO: 2037978 - RNA, 21 nt, Homo sapiens
gaacagguuuaaaaaucccca

SEQ ID NO: 2037979 - RNA, 20 nt, Homo sapiens
caaugauaugcaagugcaaa

SEQ ID NO: 2037980 - RNA, 17 nt, Homo sapiens
uaccccuuggcuuugug

SEQ ID NO: 2037981 - RNA, 11 nt, Homo sapiens
ggcacauagaa

SEQ ID NO: 2037982 - RNA, 14 nt, Homo sapiens
auggggugggccca

SEQ ID NO: 2037983 - RNA, 16 nt, Homo sapiens
aauuaaauagugugau

SEQ ID NO: 2037984 - RNA, 15 nt, Homo sapiens
uuacaguaacuguaa

SEQ ID NO: 2037985 - RNA, 19 nt, Homo sapiens
uguauuuuaauaacauauc

SEQ ID NO: 2037986 - RNA, 16 nt, Homo sapiens
cugcucugcaagcaga

SEQ ID NO: 2037987 - RNA, 18 nt, Homo sapiens
auaaucccauacucucaa

SEQ ID NO: 2037988 - RNA, 18 nt, Homo sapiens
uuccuucuuucauuuuaa

SEQ ID NO: 2037989 - RNA, 12 nt, Homo sapiens
uugcucucugug

SEQ ID NO: 2037990 - RNA, 20 nt, Homo sapiens
ugcuaacuguguguacauau

SEQ ID NO: 2037991 - RNA, 17 nt, Homo sapiens
uaaucucucugcagcug

SEQ ID NO: 2037992 - RNA, 10 nt, Homo sapiens
uaaagauaug

SEQ ID NO: 2037993 - RNA, 18 nt, Homo sapiens
uggagcuggcacugugga

SEQ ID NO: 2037994 - RNA, 19 nt, Homo sapiens
gagaugagucagugccaug

SEQ ID NO: 2037995 - RNA, 23 nt, Homo sapiens
cccaggagaagaaagaggugacc

SEQ ID NO: 2037996 - RNA, 23 nt, Homo sapiens
aucuucacuucuaaaugcauauc

SEQ ID NO: 2037997 - RNA, 19 nt, Homo sapiens
ggcugcccacacaccccaa

SEQ ID NO: 2037998 - RNA, 23 nt, Homo sapiens
acuccuuccagcuagugacccac

SEQ ID NO: 2037999 - RNA, 17 nt, Homo sapiens
gcacaaaccuuacuaug

SEQ ID NO: 2038000 - RNA, 19 nt, Homo sapiens
caguguagacacaggucac

SEQ ID NO: 2038001 - RNA, 16 nt, Homo sapiens
aaaaauguuaggauaa

SEQ ID NO: 2038002 - RNA, 23 nt, Homo sapiens
gugaguauaacucuaacugaugu

SEQ ID NO: 2038003 - RNA, 21 nt, Homo sapiens
agcuggccuuuguaagugcag

SEQ ID NO: 2038004 - RNA, 15 nt, Homo sapiens
ggcugcugcugccac

SEQ ID NO: 2038005 - RNA, 13 nt, Homo sapiens
aaaaaaaaaucac

SEQ ID NO: 2038006 - RNA, 18 nt, Homo sapiens
gcuuuuuuaucaugugaa

SEQ ID NO: 2038007 - RNA, 13 nt, Homo sapiens
acaauggacugua

SEQ ID NO: 2038008 - RNA, 17 nt, Homo sapiens
ugggagauguucuuccu

SEQ ID NO: 2038009 - RNA, 13 nt, Homo sapiens
auguuaugugcaa

SEQ ID NO: 2038010 - RNA, 21 nt, Homo sapiens
uuugcaaauucaagagccucc

SEQ ID NO: 2038011 - RNA, 21 nt, Homo sapiens
uauacaucuagcacagcugug

SEQ ID NO: 2038012 - RNA, 19 nt, Homo sapiens
agcucaguauacuaaugcc

SEQ ID NO: 2038013 - RNA, 15 nt, Homo sapiens
gcaccaaaucaaaau

SEQ ID NO: 2038014 - RNA, 19 nt, Homo sapiens
uccuccuuuaucauuacca

SEQ ID NO: 2038015 - RNA, 21 nt, Homo sapiens
aacuguugcccuucuguccaa

SEQ ID NO: 2038016 - RNA, 14 nt, Homo sapiens
uucacugagcaugu

SEQ ID NO: 2038017 - RNA, 11 nt, Homo sapiens
gacugcugaca

SEQ ID NO: 2038018 - RNA, 15 nt, Homo sapiens
auuccauacagugac

SEQ ID NO: 2038019 - RNA, 20 nt, Homo sapiens
uggugcuacgaccaggguga

SEQ ID NO: 2038020 - RNA, 19 nt, Homo sapiens
uuacacaugggcauauucu

SEQ ID NO: 2038021 - RNA, 15 nt, Homo sapiens
aaugugcaacauucu

SEQ ID NO: 2038022 - RNA, 16 nt, Homo sapiens
caaguugccacauugc

SEQ ID NO: 2038023 - RNA, 16 nt, Homo sapiens
uccaggacucagggac

SEQ ID NO: 2038024 - RNA, 14 nt, Homo sapiens
agcagacucuggag

SEQ ID NO: 2038025 - RNA, 22 nt, Homo sapiens
aaggaauuuugucucacuuuua

SEQ ID NO: 2038026 - RNA, 21 nt, Homo sapiens
uagaugcuggcaucucugcag

SEQ ID NO: 2038027 - RNA, 15 nt, Homo sapiens
aagucaucaucucca

SEQ ID NO: 2038028 - RNA, 21 nt, Homo sapiens
ugggaaccauuucaagacaga

SEQ ID NO: 2038029 - RNA, 15 nt, Homo sapiens
aagaugcuaguucau

SEQ ID NO: 2038030 - RNA, 18 nt, Homo sapiens
caccuucaagcacccugu

SEQ ID NO: 2038031 - RNA, 22 nt, Homo sapiens
aagcaguagcauuugcuuccuc

SEQ ID NO: 2038032 - RNA, 14 nt, Homo sapiens
cucacucuugccaa

SEQ ID NO: 2038033 - RNA, 14 nt, Homo sapiens
caugguggugugca

SEQ ID NO: 2038034 - RNA, 14 nt, Homo sapiens
ccucacaucuuuca

SEQ ID NO: 2038035 - RNA, 23 nt, Homo sapiens
gccccugguuaagggagaucugg

SEQ ID NO: 2038036 - RNA, 19 nt, Homo sapiens
gcagaauccuggcccucug

SEQ ID NO: 2038037 - RNA, 15 nt, Homo sapiens
cuugaaaucaagggc

SEQ ID NO: 2038038 - RNA, 17 nt, Homo sapiens
ggauaauaggaauucaa

SEQ ID NO: 2038039 - RNA, 19 nt, Homo sapiens
gcacuguuuucuaguguau

SEQ ID NO: 2038040 - RNA, 23 nt, Homo sapiens
ccagugugcuugcccaccacagc

SEQ ID NO: 2038041 - RNA, 14 nt, Homo sapiens
cagugcacagggaa

SEQ ID NO: 2038042 - RNA, 19 nt, Homo sapiens
ugaaaaaucuaguauuugu

SEQ ID NO: 2038043 - RNA, 19 nt, Homo sapiens
gcugucguuguuguggaag

SEQ ID NO: 2038044 - RNA, 24 nt, Homo sapiens
ucugagcaccuacuuacaugcauu

SEQ ID NO: 2038045 - RNA, 17 nt, Homo sapiens
ucaauaaacaacagcug

SEQ ID NO: 2038046 - RNA, 20 nt, Homo sapiens
caguggcccaugugacugug

SEQ ID NO: 2038047 - RNA, 16 nt, Homo sapiens
augcaauccuuccaaa

SEQ ID NO: 2038048 - RNA, 19 nt, Homo sapiens
uccuuuuaaagaagcuuua

SEQ ID NO: 2038049 - RNA, 18 nt, Homo sapiens
aguucuuugggccagaca

SEQ ID NO: 2038050 - RNA, 20 nt, Homo sapiens
aaucugaagauacaugucuu

SEQ ID NO: 2038051 - RNA, 16 nt, Homo sapiens
cuguuuagccuaguca

SEQ ID NO: 2038052 - RNA, 14 nt, Homo sapiens
gcgggcuggccuuc

SEQ ID NO: 2038053 - RNA, 18 nt, Homo sapiens
ucuacugagacaugacua

SEQ ID NO: 2038054 - RNA, 20 nt, Homo sapiens
ccucauuagcauuuugcuaa

SEQ ID NO: 2038055 - RNA, 13 nt, Homo sapiens
auugcuacaaauc

SEQ ID NO: 2038056 - RNA, 22 nt, Homo sapiens
cauuggagagaaaaaacuuaag

SEQ ID NO: 2038057 - RNA, 12 nt, Homo sapiens
cauaucauucag

SEQ ID NO: 2038058 - RNA, 12 nt, Homo sapiens
cucaaccagagu

SEQ ID NO: 2038059 - RNA, 13 nt, Homo sapiens
uaaaugugagcaa

SEQ ID NO: 2038060 - RNA, 18 nt, Homo sapiens
cagagaaggcuuccucca

SEQ ID NO: 2038061 - RNA, 21 nt, Homo sapiens
cugcuuuguuuggaugccuca

SEQ ID NO: 2038062 - RNA, 15 nt, Homo sapiens
aaugccacucugggc

SEQ ID NO: 2038063 - RNA, 17 nt, Homo sapiens
uccggcccacagguuuc

SEQ ID NO: 2038064 - RNA, 14 nt, Homo sapiens
ucauuucauuucag

SEQ ID NO: 2038065 - RNA, 22 nt, Homo sapiens
ucugccugauaggacccauauu

SEQ ID NO: 2038066 - RNA, 11 nt, Homo sapiens
gagugcagugc

SEQ ID NO: 2038067 - RNA, 13 nt, Homo sapiens
acugggacuugca

SEQ ID NO: 2038068 - RNA, 18 nt, Homo sapiens
uccaaaagugauagugug

SEQ ID NO: 2038069 - RNA, 18 nt, Homo sapiens
aucaguuucucaaacuga

SEQ ID NO: 2038070 - RNA, 12 nt, Homo sapiens
ugagagaccuga

SEQ ID NO: 2038071 - RNA, 19 nt, Homo sapiens
agcaugcccugagcucucu

SEQ ID NO: 2038072 - RNA, 17 nt, Homo sapiens
cuggcuccacaccucca

SEQ ID NO: 2038073 - RNA, 14 nt, Homo sapiens
aggcugacauucac

SEQ ID NO: 2038074 - RNA, 21 nt, Homo sapiens
uucccuaggcugagcuggcau

SEQ ID NO: 2038075 - RNA, 21 nt, Homo sapiens
ugaagucucaagaacugccau

SEQ ID NO: 2038076 - RNA, 13 nt, Homo sapiens
caaggaaccauuu

SEQ ID NO: 2038077 - RNA, 20 nt, Homo sapiens
uuccuuuuuaauaugcuuaa

SEQ ID NO: 2038078 - RNA, 21 nt, Homo sapiens
uaccuuuguuacagcuacuau

SEQ ID NO: 2038079 - RNA, 12 nt, Homo sapiens
uguuuuuacuaa

SEQ ID NO: 2038080 - RNA, 19 nt, Homo sapiens
gaugguggggcccccagca

SEQ ID NO: 2038081 - RNA, 16 nt, Homo sapiens
cuccagagaccccagg

SEQ ID NO: 2038082 - RNA, 16 nt, Homo sapiens
gaucauaguugcaaaa

SEQ ID NO: 2038083 - RNA, 17 nt, Homo sapiens
uccugggacaaccagac

SEQ ID NO: 2038084 - RNA, 17 nt, Homo sapiens
caauuaauauuacucag

SEQ ID NO: 2038085 - RNA, 16 nt, Homo sapiens
uguacaaaacaguuug

SEQ ID NO: 2038086 - RNA, 17 nt, Homo sapiens
uggaauucaaagcucua

SEQ ID NO: 2038087 - RNA, 22 nt, Homo sapiens
gagaagauucuucccauucucc

SEQ ID NO: 2038088 - RNA, 19 nt, Homo sapiens
uguaucuauucuucugacc

SEQ ID NO: 2038089 - RNA, 15 nt, Homo sapiens
cauauacuauuuagu

SEQ ID NO: 2038090 - RNA, 13 nt, Homo sapiens
auacaaaacuguu

SEQ ID NO: 2038091 - RNA, 14 nt, Homo sapiens
uuuuauauuuucac

SEQ ID NO: 2038092 - RNA, 14 nt, Homo sapiens
auauauauauacac

SEQ ID NO: 2038093 - RNA, 14 nt, Homo sapiens
acauacauacacau

SEQ ID NO: 2038094 - RNA, 18 nt, Homo sapiens
cuaagugccacccuccuc

SEQ ID NO: 2038095 - RNA, 18 nt, Homo sapiens
acauugauucaugucuca

SEQ ID NO: 2038096 - RNA, 15 nt, Homo sapiens
guccuuucccaccca

SEQ ID NO: 2038097 - RNA, 13 nt, Homo sapiens
aacccuccccaaa

SEQ ID NO: 2038098 - RNA, 13 nt, Homo sapiens
cacccuccacaaa

SEQ ID NO: 2038099 - RNA, 17 nt, Homo sapiens
ugggaagcaggagccca

SEQ ID NO: 2038100 - RNA, 14 nt, Homo sapiens
uucccucucuugcc

SEQ ID NO: 2038101 - RNA, 22 nt, Homo sapiens
guuuuuaugauuuuuauuugaa

SEQ ID NO: 2038102 - RNA, 14 nt, Homo sapiens
cagguuugggaccc

SEQ ID NO: 2038103 - RNA, 15 nt, Homo sapiens
ccgaaguaaacugau

SEQ ID NO: 2038104 - RNA, 15 nt, Homo sapiens
ugguaugaaacaaac

SEQ ID NO: 2038105 - RNA, 20 nt, Homo sapiens
agguucuagguuucaaagau

SEQ ID NO: 2038106 - RNA, 20 nt, Homo sapiens
ucugccuuaaaaccaaagag

SEQ ID NO: 2038107 - RNA, 16 nt, Homo sapiens
auuuguaaaucugcca

SEQ ID NO: 2038108 - RNA, 16 nt, Homo sapiens
agcccucccacuuugc

SEQ ID NO: 2038109 - RNA, 20 nt, Homo sapiens
agcuuauaagagggcauaua

SEQ ID NO: 2038110 - RNA, 15 nt, Homo sapiens
gauauauuuauauca

SEQ ID NO: 2038111 - RNA, 16 nt, Homo sapiens
cacuguccacauguga

SEQ ID NO: 2038112 - RNA, 18 nt, Homo sapiens
caucacuccucugucaua

SEQ ID NO: 2038113 - RNA, 16 nt, Homo sapiens
uuaauaucaacucuga

SEQ ID NO: 2038114 - RNA, 13 nt, Homo sapiens
uguagguccucag

SEQ ID NO: 2038115 - RNA, 18 nt, Homo sapiens
aaguuucugauaccacug

SEQ ID NO: 2038116 - RNA, 19 nt, Homo sapiens
guccccgcccucucucaua

SEQ ID NO: 2038117 - RNA, 18 nt, Homo sapiens
cuuccacucgaugaugcu

SEQ ID NO: 2038118 - RNA, 22 nt, Homo sapiens
aaggcucucuggucuaccugag

SEQ ID NO: 2038119 - RNA, 13 nt, Homo sapiens
ugucaagaguauu

SEQ ID NO: 2038120 - RNA, 20 nt, Homo sapiens
ucccaaacuggaaacccaag

SEQ ID NO: 2038121 - RNA, 15 nt, Homo sapiens
acuugcacaaaauca

SEQ ID NO: 2038122 - RNA, 18 nt, Homo sapiens
auuugggcagauauagca

SEQ ID NO: 2038123 - RNA, 17 nt, Homo sapiens
cuggggaagagguuuua

SEQ ID NO: 2038124 - RNA, 14 nt, Homo sapiens
uacuacauaccuca

SEQ ID NO: 2038125 - RNA, 16 nt, Homo sapiens
uugagugaggcaguga

SEQ ID NO: 2038126 - RNA, 18 nt, Homo sapiens
aaaacccaacuccucucc

SEQ ID NO: 2038127 - RNA, 13 nt, Homo sapiens
gcuuuccaagcuu

SEQ ID NO: 2038128 - RNA, 21 nt, Homo sapiens
uauguguguguguguaugugu

SEQ ID NO: 2038129 - RNA, 21 nt, Homo sapiens
gaaaacaaguauuuacuucug

SEQ ID NO: 2038130 - RNA, 19 nt, Homo sapiens
uauaguaugaaugcagugg

SEQ ID NO: 2038131 - RNA, 21 nt, Homo sapiens
ccuguuuuuagagcuuccaaa

SEQ ID NO: 2038132 - RNA, 21 nt, Homo sapiens
aaacuucaucacacacugaga

SEQ ID NO: 2038133 - RNA, 14 nt, Homo sapiens
acccucauucccuc

SEQ ID NO: 2038134 - RNA, 19 nt, Homo sapiens
uguaaaaacuuucacugaa

SEQ ID NO: 2038135 - RNA, 15 nt, Homo sapiens
cggcuuuaagugugc

SEQ ID NO: 2038136 - RNA, 20 nt, Homo sapiens
gagcuuuggacgcacacagc

SEQ ID NO: 2038137 - RNA, 20 nt, Homo sapiens
auuuguuuguuuucuugucu

SEQ ID NO: 2038138 - RNA, 16 nt, Homo sapiens
gaaaugaaaacagugu

SEQ ID NO: 2038139 - RNA, 14 nt, Homo sapiens
cauucauauuugca

SEQ ID NO: 2038140 - RNA, 14 nt, Homo sapiens
uaagacuacuauac

SEQ ID NO: 2038141 - RNA, 22 nt, Homo sapiens
uauaccauaugucugcuucugu

SEQ ID NO: 2038142 - RNA, 16 nt, Homo sapiens
gagcagaccacauaua

SEQ ID NO: 2038143 - RNA, 19 nt, Homo sapiens
ccagacaccgccacauggc

SEQ ID NO: 2038144 - RNA, 16 nt, Homo sapiens
uaaugucuagauuuug

SEQ ID NO: 2038145 - RNA, 15 nt, Homo sapiens
ugaccucccaccuau

SEQ ID NO: 2038146 - RNA, 16 nt, Homo sapiens
gucugguugcuaauga

SEQ ID NO: 2038147 - RNA, 19 nt, Homo sapiens
uuuauagcacaaacuuuaa

SEQ ID NO: 2038148 - RNA, 21 nt, Homo sapiens
ggaugaaggcaaaaacuguac

SEQ ID NO: 2038149 - RNA, 14 nt, Homo sapiens
acuccucccauaga

SEQ ID NO: 2038150 - RNA, 16 nt, Homo sapiens
gauauggaaacagaag

SEQ ID NO: 2038151 - RNA, 18 nt, Homo sapiens
uacccgagguuugcaaau

SEQ ID NO: 2038152 - RNA, 16 nt, Homo sapiens
agaaaccagagucaaa

SEQ ID NO: 2038153 - RNA, 19 nt, Homo sapiens
ccaaaaauggcagugacuc

SEQ ID NO: 2038154 - RNA, 16 nt, Homo sapiens
uccauuaaguacaugu

SEQ ID NO: 2038155 - RNA, 18 nt, Homo sapiens
gcuuuugccucugcccaa

SEQ ID NO: 2038156 - RNA, 20 nt, Homo sapiens
caggagacuguggagacugc

SEQ ID NO: 2038157 - RNA, 17 nt, Homo sapiens
cuuccaugacccuuugc

SEQ ID NO: 2038158 - RNA, 12 nt, Homo sapiens
cauuuccaugca

SEQ ID NO: 2038159 - RNA, 22 nt, Homo sapiens
uacucaguuaggcagugcagua

SEQ ID NO: 2038160 - RNA, 17 nt, Homo sapiens
ccagcccauggcuuuag

SEQ ID NO: 2038161 - RNA, 20 nt, Homo sapiens
aggauccccucucuuccuac

SEQ ID NO: 2038162 - RNA, 21 nt, Homo sapiens
uuagauaaauuguagggcuuu

SEQ ID NO: 2038163 - RNA, 14 nt, Homo sapiens
cguguuaugacucc

SEQ ID NO: 2038164 - RNA, 13 nt, Homo sapiens
guccuccaaaaca

SEQ ID NO: 2038165 - RNA, 19 nt, Homo sapiens
agaccugccccucccucua

SEQ ID NO: 2038166 - RNA, 16 nt, Homo sapiens
ucuccucuucccgccg

SEQ ID NO: 2038167 - RNA, 15 nt, Homo sapiens
cuuugucagcaauaa

SEQ ID NO: 2038168 - RNA, 22 nt, Homo sapiens
aguggaaaaaucagaagcacaa

SEQ ID NO: 2038169 - RNA, 21 nt, Homo sapiens
ugcccugggggauaccagcug

SEQ ID NO: 2038170 - RNA, 14 nt, Homo sapiens
ugaaaugggcuuua

SEQ ID NO: 2038171 - RNA, 18 nt, Homo sapiens
gacauuuauuaaccaaau

SEQ ID NO: 2038172 - RNA, 14 nt, Homo sapiens
cugcugucuuguug

SEQ ID NO: 2038173 - RNA, 13 nt, Homo sapiens
aggggcaggugaa

SEQ ID NO: 2038174 - RNA, 14 nt, Homo sapiens
ccuugggccucauc

SEQ ID NO: 2038175 - RNA, 17 nt, Homo sapiens
uguucccagggucugcu

SEQ ID NO: 2038176 - RNA, 21 nt, Homo sapiens
ucuccagcucuggcuuccugc

SEQ ID NO: 2038177 - RNA, 18 nt, Homo sapiens
augccacccucuccaugc

SEQ ID NO: 2038178 - RNA, 20 nt, Homo sapiens
guuuauguaagagcaccuuc

SEQ ID NO: 2038179 - RNA, 20 nt, Homo sapiens
ugguggcaacauucauugcc

SEQ ID NO: 2038180 - RNA, 12 nt, Homo sapiens
aucauugguucg

SEQ ID NO: 2038181 - RNA, 23 nt, Homo sapiens
auuucuguggauggcaucaaaca

SEQ ID NO: 2038182 - RNA, 14 nt, Homo sapiens
aagcacauuccaaa

SEQ ID NO: 2038183 - RNA, 14 nt, Homo sapiens
ggcucacacugaga

SEQ ID NO: 2038184 - RNA, 14 nt, Homo sapiens
acuggacuugucca

SEQ ID NO: 2038185 - RNA, 20 nt, Homo sapiens
acacuacugcuaaauccuca

SEQ ID NO: 2038186 - RNA, 23 nt, Homo sapiens
uuucuugaaguccaguguuucca

SEQ ID NO: 2038187 - RNA, 17 nt, Homo sapiens
aauuugacugugcauga

SEQ ID NO: 2038188 - RNA, 16 nt, Homo sapiens
uagauaaauguccauu

SEQ ID NO: 2038189 - RNA, 16 nt, Homo sapiens
cguguucucacacugg

SEQ ID NO: 2038190 - RNA, 16 nt, Homo sapiens
uauuuaagcaacaucu

SEQ ID NO: 2038191 - RNA, 19 nt, Homo sapiens
uguaaagcuaaaauaaaga

SEQ ID NO: 2038192 - RNA, 18 nt, Homo sapiens
ugaaccgcacagcucagg

SEQ ID NO: 2038193 - RNA, 18 nt, Homo sapiens
uccaugcuccucacugcc

SEQ ID NO: 2038194 - RNA, 20 nt, Homo sapiens
agcacagauucaagugcaau

SEQ ID NO: 2038195 - RNA, 14 nt, Homo sapiens
uaggcugaugccac

SEQ ID NO: 2038196 - RNA, 19 nt, Homo sapiens
agaaugcaccccugagggu

SEQ ID NO: 2038197 - RNA, 15 nt, Homo sapiens
gagaugcagugccag

SEQ ID NO: 2038198 - RNA, 23 nt, Homo sapiens
aguauuuuaucuggaacaacuug

SEQ ID NO: 2038199 - RNA, 18 nt, Homo sapiens
agcaaucugagagauuug

SEQ ID NO: 2038200 - RNA, 16 nt, Homo sapiens
aaucuaaccacuuaag

SEQ ID NO: 2038201 - RNA, 14 nt, Homo sapiens
acccacagaugucu

SEQ ID NO: 2038202 - RNA, 19 nt, Homo sapiens
gggcagacaggugggagau

SEQ ID NO: 2038203 - RNA, 16 nt, Homo sapiens
cucaugccugcugaga

SEQ ID NO: 2038204 - RNA, 12 nt, Homo sapiens
gagaaaugccag

SEQ ID NO: 2038205 - RNA, 20 nt, Homo sapiens
ccauaugcaggacagcagua

SEQ ID NO: 2038206 - RNA, 16 nt, Homo sapiens
uagagaauuuccuuac

SEQ ID NO: 2038207 - RNA, 12 nt, Homo sapiens
acacgugacaga

SEQ ID NO: 2038208 - RNA, 14 nt, Homo sapiens
auauauaccacuuu

SEQ ID NO: 2038209 - RNA, 18 nt, Homo sapiens
uaacucaccucucaaggu

SEQ ID NO: 2038210 - RNA, 14 nt, Homo sapiens
acuccaugcauuca

SEQ ID NO: 2038211 - RNA, 17 nt, Homo sapiens
ucauuuuuaaagccugg

SEQ ID NO: 2038212 - RNA, 19 nt, Homo sapiens
ugcucauguguacacacgc

SEQ ID NO: 2038213 - RNA, 18 nt, Homo sapiens
cuccacucaguugcaacu

SEQ ID NO: 2038214 - RNA, 14 nt, Homo sapiens
uggccugucuuugg

SEQ ID NO: 2038215 - RNA, 19 nt, Homo sapiens
aacccuacgaaagcacagu

SEQ ID NO: 2038216 - RNA, 20 nt, Homo sapiens
aaacaugguggguccauggg

SEQ ID NO: 2038217 - RNA, 18 nt, Homo sapiens
gaaauaaaaggaagccaa

SEQ ID NO: 2038218 - RNA, 15 nt, Homo sapiens
augaagaucauauac

SEQ ID NO: 2038219 - RNA, 17 nt, Homo sapiens
aaaacaccuagcuuuau

SEQ ID NO: 2038220 - RNA, 17 nt, Homo sapiens
uccacacccaauuccac

SEQ ID NO: 2038221 - RNA, 22 nt, Homo sapiens
gggcacuggccuagagccucac

SEQ ID NO: 2038222 - RNA, 19 nt, Homo sapiens
guaggcaccaccucuguca

SEQ ID NO: 2038223 - RNA, 21 nt, Homo sapiens
cuugccugaauccaucaggac

SEQ ID NO: 2038224 - RNA, 15 nt, Homo sapiens
ccucuggaguuucau

SEQ ID NO: 2038225 - RNA, 14 nt, Homo sapiens
cugaggaccagaaa

SEQ ID NO: 2038226 - RNA, 16 nt, Homo sapiens
cggagacaaaagcagu

SEQ ID NO: 2038227 - RNA, 17 nt, Homo sapiens
guuguugugcaaguuga

SEQ ID NO: 2038228 - RNA, 15 nt, Homo sapiens
aauucuuuuauaaau

SEQ ID NO: 2038229 - RNA, 20 nt, Homo sapiens
guacauaaauuccagaggac

SEQ ID NO: 2038230 - RNA, 13 nt, Homo sapiens
acuuauugccaaa

SEQ ID NO: 2038231 - RNA, 20 nt, Homo sapiens
aacuggaagauacauaaaag

SEQ ID NO: 2038232 - RNA, 17 nt, Homo sapiens
acguggccucuugagca

SEQ ID NO: 2038233 - RNA, 21 nt, Homo sapiens
cucacuggcugggaguccuua

SEQ ID NO: 2038234 - RNA, 16 nt, Homo sapiens
augugguacuacugua

SEQ ID NO: 2038235 - RNA, 12 nt, Homo sapiens
ucauacuguaga

SEQ ID NO: 2038236 - RNA, 12 nt, Homo sapiens
cagaacugccau

SEQ ID NO: 2038237 - RNA, 16 nt, Homo sapiens
guuuucuaacuguaaa

SEQ ID NO: 2038238 - RNA, 15 nt, Homo sapiens
ccgcucucucugagg

SEQ ID NO: 2038239 - RNA, 14 nt, Homo sapiens
gaagaaaacuuuug

SEQ ID NO: 2038240 - RNA, 14 nt, Homo sapiens
ucauguuaugcauu

SEQ ID NO: 2038241 - RNA, 13 nt, Homo sapiens
uaauaauuacuua

SEQ ID NO: 2038242 - RNA, 19 nt, Homo sapiens
aagggauggaaaaggaaga

SEQ ID NO: 2038243 - RNA, 19 nt, Homo sapiens
auuuucuuucuccucugau

SEQ ID NO: 2038244 - RNA, 21 nt, Homo sapiens
uucacucuuuagaaauaaugg

SEQ ID NO: 2038245 - RNA, 22 nt, Homo sapiens
cuugaccauucucacccuguga

SEQ ID NO: 2038246 - RNA, 20 nt, Homo sapiens
ugggagacugaagacucagc

SEQ ID NO: 2038247 - RNA, 19 nt, Homo sapiens
accagggacugcagcugca

SEQ ID NO: 2038248 - RNA, 18 nt, Homo sapiens
guuuggcaaugcacugaa

SEQ ID NO: 2038249 - RNA, 14 nt, Homo sapiens
uggggagagacaga

SEQ ID NO: 2038250 - RNA, 16 nt, Homo sapiens
agggaaacucuggaga

SEQ ID NO: 2038251 - RNA, 21 nt, Homo sapiens
ugccccaguggggauccugcc

SEQ ID NO: 2038252 - RNA, 22 nt, Homo sapiens
ccacagcccugcucauuccuca

SEQ ID NO: 2038253 - RNA, 18 nt, Homo sapiens
uccccuuccccugcugac

SEQ ID NO: 2038254 - RNA, 15 nt, Homo sapiens
aguaacuugucuuaa

SEQ ID NO: 2038255 - RNA, 23 nt, Homo sapiens
auagacuugcaccuuaugucaug

SEQ ID NO: 2038256 - RNA, 13 nt, Homo sapiens
aggaacacugcac

SEQ ID NO: 2038257 - RNA, 13 nt, Homo sapiens
ccuucuugcugcc

SEQ ID NO: 2038258 - RNA, 19 nt, Homo sapiens
cugaagcuucaaaaagcca

SEQ ID NO: 2038259 - RNA, 19 nt, Homo sapiens
ccacuuccccacaggugaa

SEQ ID NO: 2038260 - RNA, 22 nt, Homo sapiens
ugcaagugcuaugccaagccau

SEQ ID NO: 2038261 - RNA, 21 nt, Homo sapiens
ugcuguuucacaauaccucau

SEQ ID NO: 2038262 - RNA, 13 nt, Homo sapiens
ugcuaagcacucu

SEQ ID NO: 2038263 - RNA, 13 nt, Homo sapiens
aacaguugugaac

SEQ ID NO: 2038264 - RNA, 15 nt, Homo sapiens
ucacuaugacacuga

SEQ ID NO: 2038265 - RNA, 17 nt, Homo sapiens
agagaauucuguucuaa

SEQ ID NO: 2038266 - RNA, 16 nt, Homo sapiens
uuauggcagacauugu

SEQ ID NO: 2038267 - RNA, 16 nt, Homo sapiens
agugguuuccagucau

SEQ ID NO: 2038268 - RNA, 17 nt, Homo sapiens
gauccucaaaaaucauc

SEQ ID NO: 2038269 - RNA, 13 nt, Homo sapiens
gcuguguuugcag

SEQ ID NO: 2038270 - RNA, 20 nt, Homo sapiens
caggcuggaguacaguggca

SEQ ID NO: 2038271 - RNA, 22 nt, Homo sapiens
uacugaaagggagggguggaga

SEQ ID NO: 2038272 - RNA, 20 nt, Homo sapiens
aguugcgcugggagacgcug

SEQ ID NO: 2038273 - RNA, 16 nt, Homo sapiens
ccugcaggaccucgug

SEQ ID NO: 2038274 - RNA, 17 nt, Homo sapiens
uuaauguuuacagugga

SEQ ID NO: 2038275 - RNA, 14 nt, Homo sapiens
ucuuagcugccaag

SEQ ID NO: 2038276 - RNA, 11 nt, Homo sapiens
caaaccauggc

SEQ ID NO: 2038277 - RNA, 20 nt, Homo sapiens
ugccaugggggcaacagcca

SEQ ID NO: 2038278 - RNA, 19 nt, Homo sapiens
gaaaauuauguuccuagaa

SEQ ID NO: 2038279 - RNA, 19 nt, Homo sapiens
aggcgggcgcacugccucu

SEQ ID NO: 2038280 - RNA, 19 nt, Homo sapiens
guugcccaagguugcacag

SEQ ID NO: 2038281 - RNA, 18 nt, Homo sapiens
augccuuuccagcaccuu

SEQ ID NO: 2038282 - RNA, 18 nt, Homo sapiens
auucuauuacgugcaaua

SEQ ID NO: 2038283 - RNA, 12 nt, Homo sapiens
aaugacugugag

SEQ ID NO: 2038284 - RNA, 18 nt, Homo sapiens
gcagaguugcucuucacc

SEQ ID NO: 2038285 - RNA, 14 nt, Homo sapiens
auacuucacucacu

SEQ ID NO: 2038286 - RNA, 13 nt, Homo sapiens
gcccugaugcucu

SEQ ID NO: 2038287 - RNA, 13 nt, Homo sapiens
auuaggauaucag

SEQ ID NO: 2038288 - RNA, 13 nt, Homo sapiens
gagaguuugccug

SEQ ID NO: 2038289 - RNA, 14 nt, Homo sapiens
cuccuccuucaugg

SEQ ID NO: 2038290 - RNA, 22 nt, Homo sapiens
cugggcuaaguaaauaggaauu

SEQ ID NO: 2038291 - RNA, 13 nt, Homo sapiens
uuuuggcuugacu

SEQ ID NO: 2038292 - RNA, 23 nt, Homo sapiens
uguacgguggucuuugaauuaua

SEQ ID NO: 2038293 - RNA, 15 nt, Homo sapiens
gaguuugacaccguc

SEQ ID NO: 2038294 - RNA, 14 nt, Homo sapiens
agagauccaaagac

SEQ ID NO: 2038295 - RNA, 20 nt, Homo sapiens
agccuacugccucuccagca

SEQ ID NO: 2038296 - RNA, 19 nt, Homo sapiens
uuguguaagaaauacagac

SEQ ID NO: 2038297 - RNA, 20 nt, Homo sapiens
ccccuccugcugugcuggaa

SEQ ID NO: 2038298 - RNA, 23 nt, Homo sapiens
ugaggacgagacccccauccagc

SEQ ID NO: 2038299 - RNA, 20 nt, Homo sapiens
cgcuucugccuuuucacugu

SEQ ID NO: 2038300 - RNA, 16 nt, Homo sapiens
aucucuucagucucua

SEQ ID NO: 2038301 - RNA, 15 nt, Homo sapiens
cacccccuguucccu

SEQ ID NO: 2038302 - RNA, 22 nt, Homo sapiens
ugauacauccaaagcagacagc

SEQ ID NO: 2038303 - RNA, 14 nt, Homo sapiens
aaguuacacuuuua

SEQ ID NO: 2038304 - RNA, 14 nt, Homo sapiens
auuccucacagccu

SEQ ID NO: 2038305 - RNA, 23 nt, Homo sapiens
ccaugggagauuuggagcugucu

SEQ ID NO: 2038306 - RNA, 14 nt, Homo sapiens
uuccaggguugcuu

SEQ ID NO: 2038307 - RNA, 19 nt, Homo sapiens
uaaaaugccaugaugccuc

SEQ ID NO: 2038308 - RNA, 15 nt, Homo sapiens
aagaaguuugaccau

SEQ ID NO: 2038309 - RNA, 20 nt, Homo sapiens
cagcagggugaagaguccaa

SEQ ID NO: 2038310 - RNA, 21 nt, Homo sapiens
cugcugggacuugaacaaaga

SEQ ID NO: 2038311 - RNA, 15 nt, Homo sapiens
uuuaaucaguuugcu

SEQ ID NO: 2038312 - RNA, 23 nt, Homo sapiens
uccccagcccuccccaccugcuc

SEQ ID NO: 2038313 - RNA, 19 nt, Homo sapiens
ucaccauuuggcaaugcca

SEQ ID NO: 2038314 - RNA, 22 nt, Homo sapiens
ugauccugacacauucugagua

SEQ ID NO: 2038315 - RNA, 16 nt, Homo sapiens
aaucuuccagcaugca

SEQ ID NO: 2038316 - RNA, 15 nt, Homo sapiens
cugccuguugcguga

SEQ ID NO: 2038317 - RNA, 16 nt, Homo sapiens
uagauucuaacauauu

SEQ ID NO: 2038318 - RNA, 18 nt, Homo sapiens
ccacaucacuacaguaca

SEQ ID NO: 2038319 - RNA, 13 nt, Homo sapiens
guuacuuccuuau

SEQ ID NO: 2038320 - RNA, 20 nt, Homo sapiens
aagugacauaauuuacaugc

SEQ ID NO: 2038321 - RNA, 22 nt, Homo sapiens
uccauauccuucuggcuguaga

SEQ ID NO: 2038322 - RNA, 21 nt, Homo sapiens
guaaaugauaccuacauucua

SEQ ID NO: 2038323 - RNA, 16 nt, Homo sapiens
cuucuaaaaguacugc

SEQ ID NO: 2038324 - RNA, 14 nt, Homo sapiens
caucuggacacugg

SEQ ID NO: 2038325 - RNA, 19 nt, Homo sapiens
uuugaagguauaaccuuca

SEQ ID NO: 2038326 - RNA, 13 nt, Homo sapiens
ggcaggaugcuga

SEQ ID NO: 2038327 - RNA, 19 nt, Homo sapiens
gcccuguuuccaaugccaa

SEQ ID NO: 2038328 - RNA, 19 nt, Homo sapiens
cgucugucuguaaugugaa

SEQ ID NO: 2038329 - RNA, 20 nt, Homo sapiens
cuaaaaagaauagaaaagaa

SEQ ID NO: 2038330 - RNA, 22 nt, Homo sapiens
gcaaguuuucccugaaguuaug

SEQ ID NO: 2038331 - RNA, 19 nt, Homo sapiens
aguuccccgagaacuuucu

SEQ ID NO: 2038332 - RNA, 15 nt, Homo sapiens
uuccaacaccacaga

SEQ ID NO: 2038333 - RNA, 21 nt, Homo sapiens
ucagaugggaauugcacagua

SEQ ID NO: 2038334 - RNA, 18 nt, Homo sapiens
uaaaauaaaccagacuca

SEQ ID NO: 2038335 - RNA, 15 nt, Homo sapiens
caacuuccuguugau

SEQ ID NO: 2038336 - RNA, 16 nt, Homo sapiens
aguugggggcugucca

SEQ ID NO: 2038337 - RNA, 22 nt, Homo sapiens
uucauuaaauuuucuaugcuua

SEQ ID NO: 2038338 - RNA, 21 nt, Homo sapiens
gaaguccuugcccacuuccca

SEQ ID NO: 2038339 - RNA, 23 nt, Homo sapiens
cacaguuguuaaagucuguucca

SEQ ID NO: 2038340 - RNA, 20 nt, Homo sapiens
guuccucuuggagucuagaa

SEQ ID NO: 2038341 - RNA, 17 nt, Homo sapiens
augggacccuguugaug

SEQ ID NO: 2038342 - RNA, 20 nt, Homo sapiens
uccaggaacugcaggucaag

SEQ ID NO: 2038343 - RNA, 22 nt, Homo sapiens
aggccuuuuuugccagacucua

SEQ ID NO: 2038344 - RNA, 17 nt, Homo sapiens
gcugcugcccauucaaa

SEQ ID NO: 2038345 - RNA, 22 nt, Homo sapiens
aucaggauccagucuggaaaac

SEQ ID NO: 2038346 - RNA, 14 nt, Homo sapiens
cacuguuuagauuu

SEQ ID NO: 2038347 - RNA, 22 nt, Homo sapiens
cagugauauauuucuaugugua

SEQ ID NO: 2038348 - RNA, 14 nt, Homo sapiens
gugcugccauuuga

SEQ ID NO: 2038349 - RNA, 14 nt, Homo sapiens
ucuccauacuuuga

SEQ ID NO: 2038350 - RNA, 15 nt, Homo sapiens
cuggcugguccuccc

SEQ ID NO: 2038351 - RNA, 17 nt, Homo sapiens
agcagaggcugcaggaa

SEQ ID NO: 2038352 - RNA, 17 nt, Homo sapiens
aacauaagguacuagca

SEQ ID NO: 2038353 - RNA, 15 nt, Homo sapiens
aucaacauuucucaa

SEQ ID NO: 2038354 - RNA, 18 nt, Homo sapiens
cugugaaauucacaguaa

SEQ ID NO: 2038355 - RNA, 22 nt, Homo sapiens
aauaauuuuaagaaaucaaaga

SEQ ID NO: 2038356 - RNA, 17 nt, Homo sapiens
acaaaaccaagccuugg

SEQ ID NO: 2038357 - RNA, 12 nt, Homo sapiens
cacugguucugc

SEQ ID NO: 2038358 - RNA, 14 nt, Homo sapiens
cggacagugcccau

SEQ ID NO: 2038359 - RNA, 14 nt, Homo sapiens
ggcuguauauucaa

SEQ ID NO: 2038360 - RNA, 19 nt, Homo sapiens
gccuccugguaacagcuau

SEQ ID NO: 2038361 - RNA, 13 nt, Homo sapiens
uuuguuccaugag

SEQ ID NO: 2038362 - RNA, 12 nt, Homo sapiens
aaaaaauccauu

SEQ ID NO: 2038363 - RNA, 21 nt, Homo sapiens
cccucaggcuccccagugcuc

SEQ ID NO: 2038364 - RNA, 21 nt, Homo sapiens
ccagaaccucuaagugcugcu

SEQ ID NO: 2038365 - RNA, 19 nt, Homo sapiens
aaggccucuugcuggugca

SEQ ID NO: 2038366 - RNA, 14 nt, Homo sapiens
auuccgaaacauac

SEQ ID NO: 2038367 - RNA, 22 nt, Homo sapiens
gauuuuuugcauuccugacaaa

SEQ ID NO: 2038368 - RNA, 21 nt, Homo sapiens
cauacugacauaagauucuau

SEQ ID NO: 2038369 - RNA, 14 nt, Homo sapiens
uucaguccuaagaa

SEQ ID NO: 2038370 - RNA, 14 nt, Homo sapiens
gagcugcugaguga

SEQ ID NO: 2038371 - RNA, 13 nt, Homo sapiens
cuuuaugauuuca

SEQ ID NO: 2038372 - RNA, 13 nt, Homo sapiens
ccuucugaucucc

SEQ ID NO: 2038373 - RNA, 19 nt, Homo sapiens
ugaagacccaaaacagcuu

SEQ ID NO: 2038374 - RNA, 17 nt, Homo sapiens
uccaaaggaagugcuaa

SEQ ID NO: 2038375 - RNA, 14 nt, Homo sapiens
uuagaacagugccu

SEQ ID NO: 2038376 - RNA, 16 nt, Homo sapiens
ggauccagagagcagc

SEQ ID NO: 2038377 - RNA, 14 nt, Homo sapiens
augaagacagauac

SEQ ID NO: 2038378 - RNA, 15 nt, Homo sapiens
aaagacagucauaua

SEQ ID NO: 2038379 - RNA, 11 nt, Homo sapiens
caaagaugacc

SEQ ID NO: 2038380 - RNA, 14 nt, Homo sapiens
caaaaucauggcuu

SEQ ID NO: 2038381 - RNA, 20 nt, Homo sapiens
uaccugaaauaaaauucauu

SEQ ID NO: 2038382 - RNA, 23 nt, Homo sapiens
uuuaaagagcaggauagcucuuc

SEQ ID NO: 2038383 - RNA, 13 nt, Homo sapiens
uaagaaauaucug

SEQ ID NO: 2038384 - RNA, 15 nt, Homo sapiens
cccacgugcacagcu

SEQ ID NO: 2038385 - RNA, 17 nt, Homo sapiens
uaaauaucuagugcuaa

SEQ ID NO: 2038386 - RNA, 14 nt, Homo sapiens
cagagcaagacucu

SEQ ID NO: 2038387 - RNA, 16 nt, Homo sapiens
uuuacuuuuaccacua

SEQ ID NO: 2038388 - RNA, 16 nt, Homo sapiens
uagguggcaagcugug

SEQ ID NO: 2038389 - RNA, 23 nt, Homo sapiens
gauugaagcuaaaauaaaccaga

SEQ ID NO: 2038390 - RNA, 22 nt, Homo sapiens
caccuucccucaugcuguuuca

SEQ ID NO: 2038391 - RNA, 22 nt, Homo sapiens
aguggugggcaccuauaauacc

SEQ ID NO: 2038392 - RNA, 19 nt, Homo sapiens
guccccagcaccuuccuga

SEQ ID NO: 2038393 - RNA, 18 nt, Homo sapiens
uuuccuuccuuccuucca

SEQ ID NO: 2038394 - RNA, 18 nt, Homo sapiens
cauacauacauacauaua

SEQ ID NO: 2038395 - RNA, 18 nt, Homo sapiens
uauagugcaauagugcaa

SEQ ID NO: 2038396 - RNA, 13 nt, Homo sapiens
agacuggcaauaa

SEQ ID NO: 2038397 - RNA, 16 nt, Homo sapiens
aaaagaucuacauaca

SEQ ID NO: 2038398 - RNA, 23 nt, Homo sapiens
ggcaguguaugcucauacuugga

SEQ ID NO: 2038399 - RNA, 17 nt, Homo sapiens
ggacuacauuuugcucu

SEQ ID NO: 2038400 - RNA, 15 nt, Homo sapiens
uguucuugaagcagu

SEQ ID NO: 2038401 - RNA, 19 nt, Homo sapiens
gagugcauugugaggguua

SEQ ID NO: 2038402 - RNA, 20 nt, Homo sapiens
accacggugaaagugcugcu

SEQ ID NO: 2038403 - RNA, 15 nt, Homo sapiens
agugggcauugccau

SEQ ID NO: 2038404 - RNA, 23 nt, Homo sapiens
cugcucuuugauucaaagcacug

SEQ ID NO: 2038405 - RNA, 21 nt, Homo sapiens
gccaucgcuuuugacccaaau

SEQ ID NO: 2038406 - RNA, 13 nt, Homo sapiens
cuaaaaaucauga

SEQ ID NO: 2038407 - RNA, 22 nt, Homo sapiens
gaguauuccaugagcugcucau

SEQ ID NO: 2038408 - RNA, 20 nt, Homo sapiens
accucugucauuuguuguga

SEQ ID NO: 2038409 - RNA, 16 nt, Homo sapiens
ugccuuggagaucaaa

SEQ ID NO: 2038410 - RNA, 22 nt, Homo sapiens
ccugcuucauucaagcuucaua

SEQ ID NO: 2038411 - RNA, 14 nt, Homo sapiens
ucaaucaaccaaag

SEQ ID NO: 2038412 - RNA, 15 nt, Homo sapiens
auguuuugcacugac

SEQ ID NO: 2038413 - RNA, 19 nt, Homo sapiens
auaguuauauaauucacuc

SEQ ID NO: 2038414 - RNA, 18 nt, Homo sapiens
uaagcgaagaugauuuca

SEQ ID NO: 2038415 - RNA, 21 nt, Homo sapiens
uugauagauuucuacacugag

SEQ ID NO: 2038416 - RNA, 19 nt, Homo sapiens
aaauuuauuugugauguac

SEQ ID NO: 2038417 - RNA, 19 nt, Homo sapiens
uauuauaaacuguaugcuc

SEQ ID NO: 2038418 - RNA, 18 nt, Homo sapiens
cuacaggaggaacagugg

SEQ ID NO: 2038419 - RNA, 23 nt, Homo sapiens
aaacucuuucauucuucucacau

SEQ ID NO: 2038420 - RNA, 19 nt, Homo sapiens
ucuggcucugucacccagg

SEQ ID NO: 2038421 - RNA, 14 nt, Homo sapiens
cauuaaacugaauc

SEQ ID NO: 2038422 - RNA, 21 nt, Homo sapiens
gcucuuuugcacaaggaaaua

SEQ ID NO: 2038423 - RNA, 15 nt, Homo sapiens
aggcuggaugggaaa

SEQ ID NO: 2038424 - RNA, 23 nt, Homo sapiens
uaagaaccacucauaauucuuca

SEQ ID NO: 2038425 - RNA, 16 nt, Homo sapiens
uccauugucugagucu

SEQ ID NO: 2038426 - RNA, 15 nt, Homo sapiens
ggagguauaugauga

SEQ ID NO: 2038427 - RNA, 17 nt, Homo sapiens
ucuuugcccacaaugcu

SEQ ID NO: 2038428 - RNA, 21 nt, Homo sapiens
ccuaaugaaagugaugacaua

SEQ ID NO: 2038429 - RNA, 14 nt, Homo sapiens
uugcucuugccaaa

SEQ ID NO: 2038430 - RNA, 16 nt, Homo sapiens
guugagugcacugacu

SEQ ID NO: 2038431 - RNA, 15 nt, Homo sapiens
uauuuacacuccucu

SEQ ID NO: 2038432 - RNA, 16 nt, Homo sapiens
aucaaggaaagccagg

SEQ ID NO: 2038433 - RNA, 15 nt, Homo sapiens
acacugaagccacag

SEQ ID NO: 2038434 - RNA, 22 nt, Homo sapiens
ugguagauuauucauaauguga

SEQ ID NO: 2038435 - RNA, 19 nt, Homo sapiens
accuggguggggucaggga

SEQ ID NO: 2038436 - RNA, 20 nt, Homo sapiens
auuuuauggugaugucacuc

SEQ ID NO: 2038437 - RNA, 14 nt, Homo sapiens
cuugcggauuucca

SEQ ID NO: 2038438 - RNA, 16 nt, Homo sapiens
caaccuguucaagucu

SEQ ID NO: 2038439 - RNA, 17 nt, Homo sapiens
acuauuuauaacuaaua

SEQ ID NO: 2038440 - RNA, 17 nt, Homo sapiens
aauauagacagugcccu

SEQ ID NO: 2038441 - RNA, 19 nt, Homo sapiens
uccucccacagaccugcag

SEQ ID NO: 2038442 - RNA, 13 nt, Homo sapiens
agcagccucgccc

SEQ ID NO: 2038443 - RNA, 23 nt, Homo sapiens
gaggccacaugauacuuauucaa

SEQ ID NO: 2038444 - RNA, 18 nt, Homo sapiens
guugcagccagggccagu

SEQ ID NO: 2038445 - RNA, 17 nt, Homo sapiens
ugcagccccacagacaa

SEQ ID NO: 2038446 - RNA, 14 nt, Homo sapiens
ccucaaaaugacag

SEQ ID NO: 2038447 - RNA, 14 nt, Homo sapiens
ccaucuauggugug

SEQ ID NO: 2038448 - RNA, 13 nt, Homo sapiens
ggucugugcugac

SEQ ID NO: 2038449 - RNA, 16 nt, Homo sapiens
uccccacucugaguga

SEQ ID NO: 2038450 - RNA, 21 nt, Homo sapiens
uuaacguauauuaaaccuguu

SEQ ID NO: 2038451 - RNA, 18 nt, Homo sapiens
uccuuuaaagugaguacu

SEQ ID NO: 2038452 - RNA, 22 nt, Homo sapiens
ugagcuauuuccauuccagaau

SEQ ID NO: 2038453 - RNA, 15 nt, Homo sapiens
cuaacuggacauucu

SEQ ID NO: 2038454 - RNA, 16 nt, Homo sapiens
cuuucaaaagcaagaa

SEQ ID NO: 2038455 - RNA, 12 nt, Homo sapiens
guaucauucaac

SEQ ID NO: 2038456 - RNA, 18 nt, Homo sapiens
gcacucaauaaaugcuca

SEQ ID NO: 2038457 - RNA, 18 nt, Homo sapiens
uucauucuguuaucucag

SEQ ID NO: 2038458 - RNA, 18 nt, Homo sapiens
ggcuccugugcuacuuug

SEQ ID NO: 2038459 - RNA, 16 nt, Homo sapiens
aggcgucuucaucucc

SEQ ID NO: 2038460 - RNA, 19 nt, Homo sapiens
ucagacacccucuccuuaa

SEQ ID NO: 2038461 - RNA, 14 nt, Homo sapiens
ccccacuagcauuu

SEQ ID NO: 2038462 - RNA, 22 nt, Homo sapiens
ucuauguuugcacuugugcuuu

SEQ ID NO: 2038463 - RNA, 12 nt, Homo sapiens
ccacccacccuu

SEQ ID NO: 2038464 - RNA, 19 nt, Homo sapiens
ggaagacacagcccagaca

SEQ ID NO: 2038465 - RNA, 13 nt, Homo sapiens
ccuuuaaaaccag

SEQ ID NO: 2038466 - RNA, 12 nt, Homo sapiens
gcuugaaccugg

SEQ ID NO: 2038467 - RNA, 14 nt, Homo sapiens
auucuacacugagg

SEQ ID NO: 2038468 - RNA, 18 nt, Homo sapiens
cacaggcccuuuccucag

SEQ ID NO: 2038469 - RNA, 23 nt, Homo sapiens
ugacacagacauccucuaugcca

SEQ ID NO: 2038470 - RNA, 22 nt, Homo sapiens
gagccuuaguuuuuucaucugu

SEQ ID NO: 2038471 - RNA, 18 nt, Homo sapiens
agccucagcaacagccag

SEQ ID NO: 2038472 - RNA, 20 nt, Homo sapiens
cucaaagcagcaggacugug

SEQ ID NO: 2038473 - RNA, 20 nt, Homo sapiens
cuggaucucacaagcacuuu

SEQ ID NO: 2038474 - RNA, 20 nt, Homo sapiens
acccuggaccauuccaggaa

SEQ ID NO: 2038475 - RNA, 19 nt, Homo sapiens
ccuugaagaaaaugacuuu

SEQ ID NO: 2038476 - RNA, 23 nt, Homo sapiens
auaacagaaagaacgugaucucc

SEQ ID NO: 2038477 - RNA, 14 nt, Homo sapiens
uucugauuucugcc

SEQ ID NO: 2038478 - RNA, 12 nt, Homo sapiens
ucucauaggaga

SEQ ID NO: 2038479 - RNA, 12 nt, Homo sapiens
cuguauuugcca

SEQ ID NO: 2038480 - RNA, 17 nt, Homo sapiens
uccuguauaaauacuga

SEQ ID NO: 2038481 - RNA, 23 nt, Homo sapiens
gcauuauaaauaaauaccaaaaa

SEQ ID NO: 2038482 - RNA, 16 nt, Homo sapiens
agcguguacuacccca

SEQ ID NO: 2038483 - RNA, 15 nt, Homo sapiens
uccuaguucuuauga

SEQ ID NO: 2038484 - RNA, 14 nt, Homo sapiens
ggaaagccaugacc

SEQ ID NO: 2038485 - RNA, 15 nt, Homo sapiens
cugcaaauacuguau

SEQ ID NO: 2038486 - RNA, 23 nt, Homo sapiens
uauuuaaaaauuguuucuugaca

SEQ ID NO: 2038487 - RNA, 22 nt, Homo sapiens
gggcucugccccaccuggagaa

SEQ ID NO: 2038488 - RNA, 13 nt, Homo sapiens
aacaugguacaaa

SEQ ID NO: 2038489 - RNA, 20 nt, Homo sapiens
cuguucucugacuaacgcca

SEQ ID NO: 2038490 - RNA, 14 nt, Homo sapiens
accuugacaaaauc

SEQ ID NO: 2038491 - RNA, 13 nt, Homo sapiens
guguuuccuucag

SEQ ID NO: 2038492 - RNA, 12 nt, Homo sapiens
cuaggccccaga

SEQ ID NO: 2038493 - RNA, 15 nt, Homo sapiens
ugggauggggguacu

SEQ ID NO: 2038494 - RNA, 15 nt, Homo sapiens
guaaaugaauuauua

SEQ ID NO: 2038495 - RNA, 12 nt, Homo sapiens
uuucucaaaaau

SEQ ID NO: 2038496 - RNA, 14 nt, Homo sapiens
aggcuaaaugagau

SEQ ID NO: 2038497 - RNA, 19 nt, Homo sapiens
uaaaaauauacaagcuaca

SEQ ID NO: 2038498 - RNA, 12 nt, Homo sapiens
auaggugcuuau

SEQ ID NO: 2038499 - RNA, 21 nt, Homo sapiens
gcugaggcaggaggaucgccu

SEQ ID NO: 2038500 - RNA, 19 nt, Homo sapiens
caagugcccagccugugga

SEQ ID NO: 2038501 - RNA, 20 nt, Homo sapiens
ucuccucgagcccuccccca

SEQ ID NO: 2038502 - RNA, 19 nt, Homo sapiens
aaaauaggauugcuucaau

SEQ ID NO: 2038503 - RNA, 20 nt, Homo sapiens
cugggucuaccacucagaga

SEQ ID NO: 2038504 - RNA, 20 nt, Homo sapiens
cccauucuaugugucaucaa

SEQ ID NO: 2038505 - RNA, 12 nt, Homo sapiens
gguccauaacag

SEQ ID NO: 2038506 - RNA, 20 nt, Homo sapiens
gcuccaagauguucuccuga

SEQ ID NO: 2038507 - RNA, 20 nt, Homo sapiens
caggugauucgcccaccuca

SEQ ID NO: 2038508 - RNA, 22 nt, Homo sapiens
ccacagcaucgggagcacccag

SEQ ID NO: 2038509 - RNA, 19 nt, Homo sapiens
caaauauaucugcuauucu

SEQ ID NO: 2038510 - RNA, 21 nt, Homo sapiens
cuggauggggcuuccagcuca

SEQ ID NO: 2038511 - RNA, 17 nt, Homo sapiens
aaggaaaaccagggaua

SEQ ID NO: 2038512 - RNA, 19 nt, Homo sapiens
aauaccuuuucucacaaaa

SEQ ID NO: 2038513 - RNA, 16 nt, Homo sapiens
aucccacuaaugcaaa

SEQ ID NO: 2038514 - RNA, 14 nt, Homo sapiens
aggacuacaaccaa

SEQ ID NO: 2038515 - RNA, 17 nt, Homo sapiens
agaucacacacaugcac

SEQ ID NO: 2038516 - RNA, 22 nt, Homo sapiens
gaaaaaaggaaguggaaugggu

SEQ ID NO: 2038517 - RNA, 14 nt, Homo sapiens
cuauguuguaauau

SEQ ID NO: 2038518 - RNA, 22 nt, Homo sapiens
agggaaaaggaguagggaguuc

SEQ ID NO: 2038519 - RNA, 17 nt, Homo sapiens
cuaaaucaauucuauua

SEQ ID NO: 2038520 - RNA, 14 nt, Homo sapiens
acuuuaaguauaca

SEQ ID NO: 2038521 - RNA, 15 nt, Homo sapiens
uggaaggcccacugu

SEQ ID NO: 2038522 - RNA, 14 nt, Homo sapiens
cuauuauauucauu

SEQ ID NO: 2038523 - RNA, 14 nt, Homo sapiens
ccacuguguuccuu

SEQ ID NO: 2038524 - RNA, 18 nt, Homo sapiens
gaaaugagaaacuuugau

SEQ ID NO: 2038525 - RNA, 18 nt, Homo sapiens
aaauaugguagcucgcca

SEQ ID NO: 2038526 - RNA, 12 nt, Homo sapiens
uugugugcugug

SEQ ID NO: 2038527 - RNA, 13 nt, Homo sapiens
uguaagauuucau

SEQ ID NO: 2038528 - RNA, 18 nt, Homo sapiens
cuccugggcucaagugau

SEQ ID NO: 2038529 - RNA, 20 nt, Homo sapiens
ugcugaaucggaaucucugg

SEQ ID NO: 2038530 - RNA, 18 nt, Homo sapiens
uugcccacacacacuccu

SEQ ID NO: 2038531 - RNA, 12 nt, Homo sapiens
cagcacuuccau

SEQ ID NO: 2038532 - RNA, 21 nt, Homo sapiens
caaaccucacacuacuguauu

SEQ ID NO: 2038533 - RNA, 15 nt, Homo sapiens
accaaaauccgacug

SEQ ID NO: 2038534 - RNA, 15 nt, Homo sapiens
gaaaagagucuucca

SEQ ID NO: 2038535 - RNA, 14 nt, Homo sapiens
agugggcagucaca

SEQ ID NO: 2038536 - RNA, 12 nt, Homo sapiens
gaauacacaugc

SEQ ID NO: 2038537 - RNA, 13 nt, Homo sapiens
caggcagccucaa

SEQ ID NO: 2038538 - RNA, 21 nt, Homo sapiens
acaacgaaagaaggcauggac

SEQ ID NO: 2038539 - RNA, 14 nt, Homo sapiens
ccugcucuggauuu

SEQ ID NO: 2038540 - RNA, 12 nt, Homo sapiens
aggccacagugg

SEQ ID NO: 2038541 - RNA, 13 nt, Homo sapiens
gguacuugguaag

SEQ ID NO: 2038542 - RNA, 17 nt, Homo sapiens
cagguuuaacauuugcc

SEQ ID NO: 2038543 - RNA, 16 nt, Homo sapiens
gggaccccuucccaca

SEQ ID NO: 2038544 - RNA, 16 nt, Homo sapiens
ccugcugaaaauaaca

SEQ ID NO: 2038545 - RNA, 18 nt, Homo sapiens
caucacugagacaaucau

SEQ ID NO: 2038546 - RNA, 14 nt, Homo sapiens
gacauuacagauga

SEQ ID NO: 2038547 - RNA, 12 nt, Homo sapiens
auuccucagggu

SEQ ID NO: 2038548 - RNA, 18 nt, Homo sapiens
cuggcuuuggugaacugu

SEQ ID NO: 2038549 - RNA, 15 nt, Homo sapiens
aaucaccccauuuca

SEQ ID NO: 2038550 - RNA, 12 nt, Homo sapiens
gcauaacuuauu

SEQ ID NO: 2038551 - RNA, 16 nt, Homo sapiens
ucuucuaugacccagc

SEQ ID NO: 2038552 - RNA, 21 nt, Homo sapiens
ucuugggcuuugcuagccugu

SEQ ID NO: 2038553 - RNA, 15 nt, Homo sapiens
auuuuaggcacccau

SEQ ID NO: 2038554 - RNA, 14 nt, Homo sapiens
acacacaugcacac

SEQ ID NO: 2038555 - RNA, 14 nt, Homo sapiens
acagucaugcaguc

SEQ ID NO: 2038556 - RNA, 14 nt, Homo sapiens
accaaaaugccaaa

SEQ ID NO: 2038557 - RNA, 17 nt, Homo sapiens
auccaaucaaucuugca

SEQ ID NO: 2038558 - RNA, 23 nt, Homo sapiens
aaugggaagauuaaaaagcacag

SEQ ID NO: 2038559 - RNA, 17 nt, Homo sapiens
gaugccgccucaagggu

SEQ ID NO: 2038560 - RNA, 21 nt, Homo sapiens
aaguucacaucagaacagaca

SEQ ID NO: 2038561 - RNA, 22 nt, Homo sapiens
uggguugacuccugagcauauu

SEQ ID NO: 2038562 - RNA, 22 nt, Homo sapiens
agauaauuggcaacugggugaa

SEQ ID NO: 2038563 - RNA, 16 nt, Homo sapiens
uggagagacagcuaca

SEQ ID NO: 2038564 - RNA, 13 nt, Homo sapiens
cgguucaccagcc

SEQ ID NO: 2038565 - RNA, 12 nt, Homo sapiens
ucaaguggcaug

SEQ ID NO: 2038566 - RNA, 23 nt, Homo sapiens
cacauucuuuucuucugcuuccc

SEQ ID NO: 2038567 - RNA, 15 nt, Homo sapiens
acaaagugacauucc

SEQ ID NO: 2038568 - RNA, 20 nt, Homo sapiens
acuuuagcauugggugcaaa

SEQ ID NO: 2038569 - RNA, 18 nt, Homo sapiens
ugaguaucuuaaguacug

SEQ ID NO: 2038570 - RNA, 19 nt, Homo sapiens
caugaagcacaucaauuac

SEQ ID NO: 2038571 - RNA, 13 nt, Homo sapiens
acaauccaaaaau

SEQ ID NO: 2038572 - RNA, 13 nt, Homo sapiens
ucccuccauaccu

SEQ ID NO: 2038573 - RNA, 20 nt, Homo sapiens
agcaaccaacuuuaccucuu

SEQ ID NO: 2038574 - RNA, 13 nt, Homo sapiens
uuggaaaccacag

SEQ ID NO: 2038575 - RNA, 22 nt, Homo sapiens
aauuuccccuaaucuuuucuga

SEQ ID NO: 2038576 - RNA, 18 nt, Homo sapiens
caagugcgcacuaccaca

SEQ ID NO: 2038577 - RNA, 16 nt, Homo sapiens
gacuugaagcacagag

SEQ ID NO: 2038578 - RNA, 21 nt, Homo sapiens
gcaacguguaacuugugcuuu

SEQ ID NO: 2038579 - RNA, 20 nt, Homo sapiens
aacaccaccaucaucugaga

SEQ ID NO: 2038580 - RNA, 14 nt, Homo sapiens
cuuuuacaccaguu

SEQ ID NO: 2038581 - RNA, 14 nt, Homo sapiens
ccauaacacuugau

SEQ ID NO: 2038582 - RNA, 21 nt, Homo sapiens
caaaugucaguucauaauaua

SEQ ID NO: 2038583 - RNA, 15 nt, Homo sapiens
uaacaaaugaucuag

SEQ ID NO: 2038584 - RNA, 20 nt, Homo sapiens
gcacauagagauaugcacac

SEQ ID NO: 2038585 - RNA, 21 nt, Homo sapiens
guauaaguuauuuuuguacau

SEQ ID NO: 2038586 - RNA, 23 nt, Homo sapiens
guucccaccauucccugccuugc

SEQ ID NO: 2038587 - RNA, 15 nt, Homo sapiens
ggguguggcaaagga

SEQ ID NO: 2038588 - RNA, 14 nt, Homo sapiens
agcaaauacauauu

SEQ ID NO: 2038589 - RNA, 20 nt, Homo sapiens
caggcucugggcacagugcu

SEQ ID NO: 2038590 - RNA, 23 nt, Homo sapiens
ccaggcuggagugcaguggugca

SEQ ID NO: 2038591 - RNA, 17 nt, Homo sapiens
agagaguuaagugaaug

SEQ ID NO: 2038592 - RNA, 14 nt, Homo sapiens
ucaaaguuaauuca

SEQ ID NO: 2038593 - RNA, 23 nt, Homo sapiens
aauguaacuuugguuaaaaucuc

SEQ ID NO: 2038594 - RNA, 21 nt, Homo sapiens
auauguauuauaggaggagcu

SEQ ID NO: 2038595 - RNA, 20 nt, Homo sapiens
ggaauaaagcuucucucuga

SEQ ID NO: 2038596 - RNA, 14 nt, Homo sapiens
ggaugcugcaaugu

SEQ ID NO: 2038597 - RNA, 16 nt, Homo sapiens
aucugguauggugcua

SEQ ID NO: 2038598 - RNA, 16 nt, Homo sapiens
caauucugaugugaaa

SEQ ID NO: 2038599 - RNA, 18 nt, Homo sapiens
cuauuacuuaugauuuau

SEQ ID NO: 2038600 - RNA, 21 nt, Homo sapiens
uccgccagggcccacaccccc

SEQ ID NO: 2038601 - RNA, 18 nt, Homo sapiens
gcuccagauucugaugca

SEQ ID NO: 2038602 - RNA, 19 nt, Homo sapiens
acaucaaaaaaggcaguua

SEQ ID NO: 2038603 - RNA, 19 nt, Homo sapiens
uaagccuucauuugcaauu

SEQ ID NO: 2038604 - RNA, 21 nt, Homo sapiens
caacauggugaaaaccccauc

SEQ ID NO: 2038605 - RNA, 17 nt, Homo sapiens
augcugaaacaaugccu

SEQ ID NO: 2038606 - RNA, 22 nt, Homo sapiens
gcuuaaaauccaaagugucaua

SEQ ID NO: 2038607 - RNA, 16 nt, Homo sapiens
uuauugacucauacac

SEQ ID NO: 2038608 - RNA, 20 nt, Homo sapiens
cggugcacaguaauaugaaa

SEQ ID NO: 2038609 - RNA, 22 nt, Homo sapiens
cauagcuccuucucucuuacau

SEQ ID NO: 2038610 - RNA, 16 nt, Homo sapiens
acuggggaaagugcau

SEQ ID NO: 2038611 - RNA, 15 nt, Homo sapiens
ugauuuugaaaucau

SEQ ID NO: 2038612 - RNA, 22 nt, Homo sapiens
accagccaagagggcugcaaaa

SEQ ID NO: 2038613 - RNA, 13 nt, Homo sapiens
caagaugccugau

SEQ ID NO: 2038614 - RNA, 16 nt, Homo sapiens
guggccgucgaguuga

SEQ ID NO: 2038615 - RNA, 23 nt, Homo sapiens
uaaaggaguaagaaccuugccug

SEQ ID NO: 2038616 - RNA, 20 nt, Homo sapiens
uaauuguagaccuguuucau

SEQ ID NO: 2038617 - RNA, 16 nt, Homo sapiens
aagcaaaugccugcca

SEQ ID NO: 2038618 - RNA, 16 nt, Homo sapiens
cuagaaaucuauuuau

SEQ ID NO: 2038619 - RNA, 16 nt, Homo sapiens
uguuuaauugugauau

SEQ ID NO: 2038620 - RNA, 15 nt, Homo sapiens
aaggucuauauucug

SEQ ID NO: 2038621 - RNA, 13 nt, Homo sapiens
cuaccagcauaaa

SEQ ID NO: 2038622 - RNA, 14 nt, Homo sapiens
uuuaaaacauucac

SEQ ID NO: 2038623 - RNA, 18 nt, Homo sapiens
acuaaagcauucaauuua

SEQ ID NO: 2038624 - RNA, 16 nt, Homo sapiens
aauguacaacugcacc

SEQ ID NO: 2038625 - RNA, 23 nt, Homo sapiens
uucugugauuaggugaagggaug

SEQ ID NO: 2038626 - RNA, 16 nt, Homo sapiens
aauagugggaucaaag

SEQ ID NO: 2038627 - RNA, 14 nt, Homo sapiens
aaggcagaggcugg

SEQ ID NO: 2038628 - RNA, 23 nt, Homo sapiens
ucagcucuuggcuccacugggau

SEQ ID NO: 2038629 - RNA, 17 nt, Homo sapiens
caugaugcuuuuacuga

SEQ ID NO: 2038630 - RNA, 19 nt, Homo sapiens
uccauaucagcucugcaua

SEQ ID NO: 2038631 - RNA, 22 nt, Homo sapiens
accagggaugucuguugaaaua

SEQ ID NO: 2038632 - RNA, 16 nt, Homo sapiens
cuaacuccugccauuc

SEQ ID NO: 2038633 - RNA, 16 nt, Homo sapiens
cugagcuuuugccacu

SEQ ID NO: 2038634 - RNA, 23 nt, Homo sapiens
ggauagcccauagcuauuuuccu

SEQ ID NO: 2038635 - RNA, 22 nt, Homo sapiens
aguaguauuugccuauuucccc

SEQ ID NO: 2038636 - RNA, 21 nt, Homo sapiens
gaguggugguuccuuugcacc

SEQ ID NO: 2038637 - RNA, 19 nt, Homo sapiens
gaaaguuccaaauguuuau

SEQ ID NO: 2038638 - RNA, 21 nt, Homo sapiens
ucagacagacuuauacacccc

SEQ ID NO: 2038639 - RNA, 12 nt, Homo sapiens
auugaaguaaug

SEQ ID NO: 2038640 - RNA, 12 nt, Homo sapiens
ccugauguuaaa

SEQ ID NO: 2038641 - RNA, 17 nt, Homo sapiens
cccagguaacauguuua

SEQ ID NO: 2038642 - RNA, 13 nt, Homo sapiens
aaagaaauuugau

SEQ ID NO: 2038643 - RNA, 15 nt, Homo sapiens
agacuuucuucucua

SEQ ID NO: 2038644 - RNA, 17 nt, Homo sapiens
acuuuaacccucucuuc

SEQ ID NO: 2038645 - RNA, 23 nt, Homo sapiens
acauguaaggccaaguacacuga

SEQ ID NO: 2038646 - RNA, 15 nt, Homo sapiens
caagcugugcaggca

SEQ ID NO: 2038647 - RNA, 13 nt, Homo sapiens
aagccccagggac

SEQ ID NO: 2038648 - RNA, 17 nt, Homo sapiens
cacauaggcaauaucuu

SEQ ID NO: 2038649 - RNA, 14 nt, Homo sapiens
gaggcccucagggc

SEQ ID NO: 2038650 - RNA, 17 nt, Homo sapiens
acagagaagaagugcuu

SEQ ID NO: 2038651 - RNA, 15 nt, Homo sapiens
gaagaugugaucaau

SEQ ID NO: 2038652 - RNA, 11 nt, Homo sapiens
accaaccaaac

SEQ ID NO: 2038653 - RNA, 15 nt, Homo sapiens
acaguguuuacuuua

SEQ ID NO: 2038654 - RNA, 13 nt, Homo sapiens
cuacaaaauggag

SEQ ID NO: 2038655 - RNA, 24 nt, Homo sapiens
cucaaguuggaguugacugcucau

SEQ ID NO: 2038656 - RNA, 21 nt, Homo sapiens
aguuacacagaaaugcugcug

SEQ ID NO: 2038657 - RNA, 18 nt, Homo sapiens
ucaucauggcaucauugc

SEQ ID NO: 2038658 - RNA, 22 nt, Homo sapiens
aauaagcaguauguuuguuuca

SEQ ID NO: 2038659 - RNA, 20 nt, Homo sapiens
auaugcaucuacuuggcaag

SEQ ID NO: 2038660 - RNA, 16 nt, Homo sapiens
gcuuaaaaugccagau

SEQ ID NO: 2038661 - RNA, 22 nt, Homo sapiens
accuccauggaaacgaagcacc

SEQ ID NO: 2038662 - RNA, 19 nt, Homo sapiens
agucuugcaacagugccau

SEQ ID NO: 2038663 - RNA, 12 nt, Homo sapiens
caaccaauucca

SEQ ID NO: 2038664 - RNA, 21 nt, Homo sapiens
cacccagcaaggcacaggcuc

SEQ ID NO: 2038665 - RNA, 15 nt, Homo sapiens
ugccggcccagugac

SEQ ID NO: 2038666 - RNA, 22 nt, Homo sapiens
gacagccauuuguaaugaauuu

SEQ ID NO: 2038667 - RNA, 20 nt, Homo sapiens
auauuucacccaucucucag

SEQ ID NO: 2038668 - RNA, 13 nt, Homo sapiens
ugagcaugaaggg

SEQ ID NO: 2038669 - RNA, 18 nt, Homo sapiens
gaugaugacguccucuca

SEQ ID NO: 2038670 - RNA, 15 nt, Homo sapiens
ugcgugugaaacagc

SEQ ID NO: 2038671 - RNA, 16 nt, Homo sapiens
agccuuucaguauuug

SEQ ID NO: 2038672 - RNA, 17 nt, Homo sapiens
cauggcgaggcugaggu

SEQ ID NO: 2038673 - RNA, 18 nt, Homo sapiens
auaguguccuaugcaaua

SEQ ID NO: 2038674 - RNA, 17 nt, Homo sapiens
cugugagaagucacuca

SEQ ID NO: 2038675 - RNA, 18 nt, Homo sapiens
cucauuuucacagcacua

SEQ ID NO: 2038676 - RNA, 22 nt, Homo sapiens
cauuuguggucacagccaugaa

SEQ ID NO: 2038677 - RNA, 19 nt, Homo sapiens
ggacugaauuacucuccaa

SEQ ID NO: 2038678 - RNA, 15 nt, Homo sapiens
gucucaguccaugaa

SEQ ID NO: 2038679 - RNA, 20 nt, Homo sapiens
aauuaaauccaacuuucaca

SEQ ID NO: 2038680 - RNA, 18 nt, Homo sapiens
gugauuucuguggauccc

SEQ ID NO: 2038681 - RNA, 22 nt, Homo sapiens
caccaugcucucucaccugcuc

SEQ ID NO: 2038682 - RNA, 19 nt, Homo sapiens
gaauauggaacauaugcac

SEQ ID NO: 2038683 - RNA, 21 nt, Homo sapiens
caucauucacuucacugugcu

SEQ ID NO: 2038684 - RNA, 15 nt, Homo sapiens
auaaacuugcuuuca

SEQ ID NO: 2038685 - RNA, 16 nt, Homo sapiens
aaucaccccauuucag

SEQ ID NO: 2038686 - RNA, 19 nt, Homo sapiens
agcuuggaaaggaccagua

SEQ ID NO: 2038687 - RNA, 14 nt, Homo sapiens
ucacuggugguuuu

SEQ ID NO: 2038688 - RNA, 12 nt, Homo sapiens
cauacuuuguua

SEQ ID NO: 2038689 - RNA, 23 nt, Homo sapiens
ccgcauccgggguucaagccauu

SEQ ID NO: 2038690 - RNA, 20 nt, Homo sapiens
cccucucuccacauuccaaa

SEQ ID NO: 2038691 - RNA, 20 nt, Homo sapiens
aaauguuaagcugcuggaaa

SEQ ID NO: 2038692 - RNA, 22 nt, Homo sapiens
ccagcccauccaaacacugagg

SEQ ID NO: 2038693 - RNA, 13 nt, Homo sapiens
acugcuugugcac

SEQ ID NO: 2038694 - RNA, 12 nt, Homo sapiens
uucauacaaggc

SEQ ID NO: 2038695 - RNA, 19 nt, Homo sapiens
cuucugguucuaacugcug

SEQ ID NO: 2038696 - RNA, 17 nt, Homo sapiens
aucuucauuaauacugu

SEQ ID NO: 2038697 - RNA, 21 nt, Homo sapiens
gccgagaucacgucacugcac

SEQ ID NO: 2038698 - RNA, 18 nt, Homo sapiens
uaaauucccuggggaaaa

SEQ ID NO: 2038699 - RNA, 23 nt, Homo sapiens
gcaccugggggccuggccuugca

SEQ ID NO: 2038700 - RNA, 22 nt, Homo sapiens
cgugcaugcucugcagcauuga

SEQ ID NO: 2038701 - RNA, 20 nt, Homo sapiens
ccgaaaaggauaugcaguau

SEQ ID NO: 2038702 - RNA, 13 nt, Homo sapiens
agaaccaccauuc

SEQ ID NO: 2038703 - RNA, 12 nt, Homo sapiens
ggagcugcucaa

SEQ ID NO: 2038704 - RNA, 14 nt, Homo sapiens
ugcauacguacauu

SEQ ID NO: 2038705 - RNA, 17 nt, Homo sapiens
guugcuuuuaagucuuc

SEQ ID NO: 2038706 - RNA, 16 nt, Homo sapiens
ugggcuuagagcucuc

SEQ ID NO: 2038707 - RNA, 16 nt, Homo sapiens
aacuggaugaggucau

SEQ ID NO: 2038708 - RNA, 14 nt, Homo sapiens
cgccccaagguucc

SEQ ID NO: 2038709 - RNA, 14 nt, Homo sapiens
cccccuaagcuucu

SEQ ID NO: 2038710 - RNA, 20 nt, Homo sapiens
agaaaacccaacuccucucc

SEQ ID NO: 2038711 - RNA, 17 nt, Homo sapiens
auuggcaaauacuaucu

SEQ ID NO: 2038712 - RNA, 15 nt, Homo sapiens
cgugugaacugcaac

SEQ ID NO: 2038713 - RNA, 22 nt, Homo sapiens
aagauaauauugucugucucua

SEQ ID NO: 2038714 - RNA, 12 nt, Homo sapiens
guaaguacagaa

SEQ ID NO: 2038715 - RNA, 23 nt, Homo sapiens
gccguuuucuugcucaaagggaa

SEQ ID NO: 2038716 - RNA, 14 nt, Homo sapiens
cagucccucagcca

SEQ ID NO: 2038717 - RNA, 13 nt, Homo sapiens
accaaaugcaaug

SEQ ID NO: 2038718 - RNA, 17 nt, Homo sapiens
gucuugucuuagcucug

SEQ ID NO: 2038719 - RNA, 12 nt, Homo sapiens
ugucauaugcag

SEQ ID NO: 2038720 - RNA, 16 nt, Homo sapiens
uauauaagacuauucc

SEQ ID NO: 2038721 - RNA, 22 nt, Homo sapiens
ccacaacuacuagugugacucc

SEQ ID NO: 2038722 - RNA, 22 nt, Homo sapiens
caggaggcagacaaugacccca

SEQ ID NO: 2038723 - RNA, 15 nt, Homo sapiens
agguaaacuagcaaa

SEQ ID NO: 2038724 - RNA, 15 nt, Homo sapiens
uacuauacagccaua

SEQ ID NO: 2038725 - RNA, 15 nt, Homo sapiens
cuguucuucacuucu

SEQ ID NO: 2038726 - RNA, 18 nt, Homo sapiens
ugugugagcuaugcaaac

SEQ ID NO: 2038727 - RNA, 15 nt, Homo sapiens
ucaaccaaugccaaa

SEQ ID NO: 2038728 - RNA, 14 nt, Homo sapiens
acuguuucucucac

SEQ ID NO: 2038729 - RNA, 17 nt, Homo sapiens
aagaaaaaguugcaguc

SEQ ID NO: 2038730 - RNA, 21 nt, Homo sapiens
aauucauauacugccuugugu

SEQ ID NO: 2038731 - RNA, 23 nt, Homo sapiens
gaacucuuucuuugguauuccau

SEQ ID NO: 2038732 - RNA, 16 nt, Homo sapiens
cacuuuaacucaggag

SEQ ID NO: 2038733 - RNA, 15 nt, Homo sapiens
acggcucucaccagu

SEQ ID NO: 2038734 - RNA, 18 nt, Homo sapiens
ucacaaccccugcuccag

SEQ ID NO: 2038735 - RNA, 17 nt, Homo sapiens
uuccuugaucuguauau

SEQ ID NO: 2038736 - RNA, 17 nt, Homo sapiens
accugcagccaagcaaa

SEQ ID NO: 2038737 - RNA, 19 nt, Homo sapiens
cuucccacucaccccggca

SEQ ID NO: 2038738 - RNA, 16 nt, Homo sapiens
acaguaaaauuaacuc

SEQ ID NO: 2038739 - RNA, 20 nt, Homo sapiens
gugacaucucuuugauguca

SEQ ID NO: 2038740 - RNA, 18 nt, Homo sapiens
ccaaauuuagaaagcuua

SEQ ID NO: 2038741 - RNA, 19 nt, Homo sapiens
ccacuaugagcugcuggca

SEQ ID NO: 2038742 - RNA, 22 nt, Homo sapiens
ugucccacucaagccaagcagc

SEQ ID NO: 2038743 - RNA, 22 nt, Homo sapiens
ccccagccccagagaaacugcc

SEQ ID NO: 2038744 - RNA, 15 nt, Homo sapiens
caaaccagacaccug

SEQ ID NO: 2038745 - RNA, 13 nt, Homo sapiens
cuuaucauggucu

SEQ ID NO: 2038746 - RNA, 16 nt, Homo sapiens
aauaggaacagcugaa

SEQ ID NO: 2038747 - RNA, 12 nt, Homo sapiens
ucaacucugagu

SEQ ID NO: 2038748 - RNA, 20 nt, Homo sapiens
uaaccucuacaggcauuuaa

SEQ ID NO: 2038749 - RNA, 21 nt, Homo sapiens
ccugcacuguccugaccaucg

SEQ ID NO: 2038750 - RNA, 19 nt, Homo sapiens
aagagacuggagcaucuga

SEQ ID NO: 2038751 - RNA, 15 nt, Homo sapiens
cacacagaugcacac

SEQ ID NO: 2038752 - RNA, 21 nt, Homo sapiens
gcacagaucugcuugaucaau

SEQ ID NO: 2038753 - RNA, 23 nt, Homo sapiens
ugauggagacaguaacacuggcg

SEQ ID NO: 2038754 - RNA, 19 nt, Homo sapiens
cauccccuagaaauccugg

SEQ ID NO: 2038755 - RNA, 17 nt, Homo sapiens
ugcuggagaaaucuuga

SEQ ID NO: 2038756 - RNA, 14 nt, Homo sapiens
augauuagagggau

SEQ ID NO: 2038757 - RNA, 18 nt, Homo sapiens
ugguaaagccucauuuga

SEQ ID NO: 2038758 - RNA, 13 nt, Homo sapiens
aauuaaauuggaa

SEQ ID NO: 2038759 - RNA, 13 nt, Homo sapiens
caaacuccugacc

SEQ ID NO: 2038760 - RNA, 21 nt, Homo sapiens
aauauaaaacuguacuucacu

SEQ ID NO: 2038761 - RNA, 23 nt, Homo sapiens
aggucaucaaacauuugccaagu

SEQ ID NO: 2038762 - RNA, 21 nt, Homo sapiens
uuaguggauaaccacagggcu

SEQ ID NO: 2038763 - RNA, 16 nt, Homo sapiens
caucuccaucaggaaa

SEQ ID NO: 2038764 - RNA, 19 nt, Homo sapiens
aucucugaccagaagacaa

SEQ ID NO: 2038765 - RNA, 20 nt, Homo sapiens
uguaacuuucauaccacuug

SEQ ID NO: 2038766 - RNA, 21 nt, Homo sapiens
guucgccgcguggaaugugag

SEQ ID NO: 2038767 - RNA, 19 nt, Homo sapiens
uccuucaguccaccacagc

SEQ ID NO: 2038768 - RNA, 12 nt, Homo sapiens
ucauaugcagaa

SEQ ID NO: 2038769 - RNA, 12 nt, Homo sapiens
ugauaugcacaa

SEQ ID NO: 2038770 - RNA, 13 nt, Homo sapiens
acccacucagcuc

SEQ ID NO: 2038771 - RNA, 19 nt, Homo sapiens
ggagcugggagccaggcuc

SEQ ID NO: 2038772 - RNA, 19 nt, Homo sapiens
cccauucuacacagagcag

SEQ ID NO: 2038773 - RNA, 12 nt, Homo sapiens
acugaacuguga

SEQ ID NO: 2038774 - RNA, 21 nt, Homo sapiens
uuggcugaauagcacagguga

SEQ ID NO: 2038775 - RNA, 19 nt, Homo sapiens
uaguucuuaugagcuagca

SEQ ID NO: 2038776 - RNA, 15 nt, Homo sapiens
uuauaaguugaagaa

SEQ ID NO: 2038777 - RNA, 17 nt, Homo sapiens
auuucuuuaugaucuua

SEQ ID NO: 2038778 - RNA, 15 nt, Homo sapiens
agaaauugcaauaac

SEQ ID NO: 2038779 - RNA, 15 nt, Homo sapiens
cuacaaacguguguc

SEQ ID NO: 2038780 - RNA, 18 nt, Homo sapiens
caacaaucucaauuccau

SEQ ID NO: 2038781 - RNA, 15 nt, Homo sapiens
uugagcagacaggcu

SEQ ID NO: 2038782 - RNA, 17 nt, Homo sapiens
cuuaacggcuccaggau

SEQ ID NO: 2038783 - RNA, 20 nt, Homo sapiens
cuguuauuaacaaacaucac

SEQ ID NO: 2038784 - RNA, 13 nt, Homo sapiens
agauuaguauuag

SEQ ID NO: 2038785 - RNA, 14 nt, Homo sapiens
agaggccugugcua

SEQ ID NO: 2038786 - RNA, 15 nt, Homo sapiens
uuuucccucuucacu

SEQ ID NO: 2038787 - RNA, 21 nt, Homo sapiens
ugggacuacaggcacaggcca

SEQ ID NO: 2038788 - RNA, 13 nt, Homo sapiens
gaaagacauuuca

SEQ ID NO: 2038789 - RNA, 15 nt, Homo sapiens
uuaaaauauuuuaga

SEQ ID NO: 2038790 - RNA, 14 nt, Homo sapiens
gcugggacuccugg

SEQ ID NO: 2038791 - RNA, 21 nt, Homo sapiens
caacaugguaaaaccccaucu

SEQ ID NO: 2038792 - RNA, 18 nt, Homo sapiens
gcagcugcuacuagcucu

SEQ ID NO: 2038793 - RNA, 19 nt, Homo sapiens
auccuucuaucuugaaucu

SEQ ID NO: 2038794 - RNA, 15 nt, Homo sapiens
guuuuaaggucuauc

SEQ ID NO: 2038795 - RNA, 17 nt, Homo sapiens
uguacccccagguggaa

SEQ ID NO: 2038796 - RNA, 22 nt, Homo sapiens
ugagcagguaucaacuagggga

SEQ ID NO: 2038797 - RNA, 20 nt, Homo sapiens
aaguaaauauagcucaggua

SEQ ID NO: 2038798 - RNA, 17 nt, Homo sapiens
acccugcaaaggacugu

SEQ ID NO: 2038799 - RNA, 21 nt, Homo sapiens
accucaccugggcagggauga

SEQ ID NO: 2038800 - RNA, 12 nt, Homo sapiens
cauccauucucc

SEQ ID NO: 2038801 - RNA, 22 nt, Homo sapiens
accaggacuaaugcauguggua

SEQ ID NO: 2038802 - RNA, 18 nt, Homo sapiens
uggaaguguuccugucuc

SEQ ID NO: 2038803 - RNA, 21 nt, Homo sapiens
caauaaaguuguugcauuccc

SEQ ID NO: 2038804 - RNA, 13 nt, Homo sapiens
ugaaauaauucaa

SEQ ID NO: 2038805 - RNA, 22 nt, Homo sapiens
acagggcgguaccuugugccca

SEQ ID NO: 2038806 - RNA, 16 nt, Homo sapiens
caacagggcaaccaau

SEQ ID NO: 2038807 - RNA, 15 nt, Homo sapiens
ugucccucugccuuu

SEQ ID NO: 2038808 - RNA, 22 nt, Homo sapiens
guuuccgaggcacuguuuuauc

SEQ ID NO: 2038809 - RNA, 12 nt, Homo sapiens
ugugucagcaua

SEQ ID NO: 2038810 - RNA, 13 nt, Homo sapiens
agcuaguggcucu

SEQ ID NO: 2038811 - RNA, 22 nt, Homo sapiens
accaggauuacuagucaaacaa

SEQ ID NO: 2038812 - RNA, 17 nt, Homo sapiens
acacagugcuuuccagc

SEQ ID NO: 2038813 - RNA, 17 nt, Homo sapiens
aaugugacgaaagugga

SEQ ID NO: 2038814 - RNA, 17 nt, Homo sapiens
aaacuguuuugacaaau

SEQ ID NO: 2038815 - RNA, 18 nt, Homo sapiens
augugcacugcaaugcca

SEQ ID NO: 2038816 - RNA, 12 nt, Homo sapiens
ccuaaacuguau

SEQ ID NO: 2038817 - RNA, 18 nt, Homo sapiens
gucucaguguuaauacug

SEQ ID NO: 2038818 - RNA, 22 nt, Homo sapiens
aucccacgggaaaggagcugcu

SEQ ID NO: 2038819 - RNA, 18 nt, Homo sapiens
auguaacgcaaguuccca

SEQ ID NO: 2038820 - RNA, 15 nt, Homo sapiens
cggagcgccccggcc

SEQ ID NO: 2038821 - RNA, 16 nt, Homo sapiens
cauaaagaauuuguca

SEQ ID NO: 2038822 - RNA, 12 nt, Homo sapiens
agccugcacagu

SEQ ID NO: 2038823 - RNA, 17 nt, Homo sapiens
uucauguccaccacuga

SEQ ID NO: 2038824 - RNA, 18 nt, Homo sapiens
cacauuuggaaugcacac

SEQ ID NO: 2038825 - RNA, 15 nt, Homo sapiens
augauauauucuuga

SEQ ID NO: 2038826 - RNA, 13 nt, Homo sapiens
ggauuggggacca

SEQ ID NO: 2038827 - RNA, 22 nt, Homo sapiens
ugagcccagaucaccaccugaa

SEQ ID NO: 2038828 - RNA, 18 nt, Homo sapiens
gaaugcccucagcucuua

SEQ ID NO: 2038829 - RNA, 22 nt, Homo sapiens
aucauuagcaacaacaugcuaa

SEQ ID NO: 2038830 - RNA, 15 nt, Homo sapiens
aggaaaacgugcuuu

SEQ ID NO: 2038831 - RNA, 18 nt, Homo sapiens
uaccuucaccaucuguau

SEQ ID NO: 2038832 - RNA, 18 nt, Homo sapiens
aagaaagaagacaaacuu

SEQ ID NO: 2038833 - RNA, 21 nt, Homo sapiens
ccuggauuugcauacauucuu

SEQ ID NO: 2038834 - RNA, 20 nt, Homo sapiens
gauucugagcagugccucuu

SEQ ID NO: 2038835 - RNA, 18 nt, Homo sapiens
caaaggagaagcacagcu

SEQ ID NO: 2038836 - RNA, 13 nt, Homo sapiens
ccuugcagggugg

SEQ ID NO: 2038837 - RNA, 16 nt, Homo sapiens
aaggggauauuuacug

SEQ ID NO: 2038838 - RNA, 22 nt, Homo sapiens
caaauaaaacuagugacagcuu

SEQ ID NO: 2038839 - RNA, 20 nt, Homo sapiens
ccugccuguagcagugagaa

SEQ ID NO: 2038840 - RNA, 12 nt, Homo sapiens
gaagacuugccc

SEQ ID NO: 2038841 - RNA, 19 nt, Homo sapiens
uaaaaucauuucugcauca

SEQ ID NO: 2038842 - RNA, 18 nt, Homo sapiens
cugcucacaaaaucacuu

SEQ ID NO: 2038843 - RNA, 21 nt, Homo sapiens
guuucgaagaauaaaauauga

SEQ ID NO: 2038844 - RNA, 16 nt, Homo sapiens
cccaggagacaaacag

SEQ ID NO: 2038845 - RNA, 20 nt, Homo sapiens
gagccuggagggaugccacc

SEQ ID NO: 2038846 - RNA, 15 nt, Homo sapiens
ugaagaaucuaauga

SEQ ID NO: 2038847 - RNA, 22 nt, Homo sapiens
uuuuaaauuaaugaacauaugu

SEQ ID NO: 2038848 - RNA, 18 nt, Homo sapiens
auccgcaugugucuguau

SEQ ID NO: 2038849 - RNA, 17 nt, Homo sapiens
aauuucgggagccuugu

SEQ ID NO: 2038850 - RNA, 19 nt, Homo sapiens
cuuuugaagucuucccuca

SEQ ID NO: 2038851 - RNA, 19 nt, Homo sapiens
aggcuggggaggccagugu

SEQ ID NO: 2038852 - RNA, 17 nt, Homo sapiens
agugucuuagcauauuu

SEQ ID NO: 2038853 - RNA, 17 nt, Homo sapiens
aauguaaauacaucaaa

SEQ ID NO: 2038854 - RNA, 21 nt, Homo sapiens
cucaggagagugugcaacugg

SEQ ID NO: 2038855 - RNA, 22 nt, Homo sapiens
ggaucagcugguucaguacugu

SEQ ID NO: 2038856 - RNA, 23 nt, Homo sapiens
aguaaaacaaaaauucacaagcu

SEQ ID NO: 2038857 - RNA, 14 nt, Homo sapiens
agagagaaacagcu

SEQ ID NO: 2038858 - RNA, 15 nt, Homo sapiens
cuaugagaugaaaua

SEQ ID NO: 2038859 - RNA, 17 nt, Homo sapiens
accuuacuucuucucau

SEQ ID NO: 2038860 - RNA, 23 nt, Homo sapiens
cuuuaacauuuuacugugcuguu

SEQ ID NO: 2038861 - RNA, 19 nt, Homo sapiens
aauacauaaaaaagggaca

SEQ ID NO: 2038862 - RNA, 21 nt, Homo sapiens
ccacaaaauuaugcugcauuu

SEQ ID NO: 2038863 - RNA, 15 nt, Homo sapiens
cacugacagauuucc

SEQ ID NO: 2038864 - RNA, 23 nt, Homo sapiens
cauucgugaaaacacauuugcuu

SEQ ID NO: 2038865 - RNA, 14 nt, Homo sapiens
ggggauguggagug

SEQ ID NO: 2038866 - RNA, 20 nt, Homo sapiens
ugucucugggccacuuggag

SEQ ID NO: 2038867 - RNA, 15 nt, Homo sapiens
agugacuucugagau

SEQ ID NO: 2038868 - RNA, 15 nt, Homo sapiens
agggagaagaaagaa

SEQ ID NO: 2038869 - RNA, 14 nt, Homo sapiens
cccugggguggcca

SEQ ID NO: 2038870 - RNA, 14 nt, Homo sapiens
aacacucaucacac

SEQ ID NO: 2038871 - RNA, 20 nt, Homo sapiens
uaaacucauuuaacuaaagu

SEQ ID NO: 2038872 - RNA, 14 nt, Homo sapiens
cauuuaaaagagua

SEQ ID NO: 2038873 - RNA, 18 nt, Homo sapiens
ccagaaguuacagaugag

SEQ ID NO: 2038874 - RNA, 13 nt, Homo sapiens
auuucaagcucau

SEQ ID NO: 2038875 - RNA, 18 nt, Homo sapiens
cucugccugggacacugc

SEQ ID NO: 2038876 - RNA, 17 nt, Homo sapiens
cuuggccaagcugcugc

SEQ ID NO: 2038877 - RNA, 16 nt, Homo sapiens
ucccagugagccucug

SEQ ID NO: 2038878 - RNA, 17 nt, Homo sapiens
acugugaccuaagaaca

SEQ ID NO: 2038879 - RNA, 22 nt, Homo sapiens
aacaggagauccuaauaugaaa

SEQ ID NO: 2038880 - RNA, 16 nt, Homo sapiens
gcauaacuguucucau

SEQ ID NO: 2038881 - RNA, 15 nt, Homo sapiens
gcuccgccucugucc

SEQ ID NO: 2038882 - RNA, 16 nt, Homo sapiens
gucccaaaugucauca

SEQ ID NO: 2038883 - RNA, 18 nt, Homo sapiens
cuuaccugaccucuugcu

SEQ ID NO: 2038884 - RNA, 18 nt, Homo sapiens
ccuuccucaccacuuccc

SEQ ID NO: 2038885 - RNA, 21 nt, Homo sapiens
cuuuggccccuggacuauggu

SEQ ID NO: 2038886 - RNA, 16 nt, Homo sapiens
caggccuuacaucugg

SEQ ID NO: 2038887 - RNA, 16 nt, Homo sapiens
caggcucacagagauu

SEQ ID NO: 2038888 - RNA, 24 nt, Homo sapiens
uauauauuuauguuuucacaguca

SEQ ID NO: 2038889 - RNA, 18 nt, Homo sapiens
cuggauugcagacuguuc

SEQ ID NO: 2038890 - RNA, 13 nt, Homo sapiens
ccucuacugggaa

SEQ ID NO: 2038891 - RNA, 14 nt, Homo sapiens
accaacacacagga

SEQ ID NO: 2038892 - RNA, 19 nt, Homo sapiens
ccaggcccgucuguccauc

SEQ ID NO: 2038893 - RNA, 15 nt, Homo sapiens
auguuauuugcucua

SEQ ID NO: 2038894 - RNA, 22 nt, Homo sapiens
cagccucuucuagagccgugau

SEQ ID NO: 2038895 - RNA, 21 nt, Homo sapiens
gaguccauggugucaugccaa

SEQ ID NO: 2038896 - RNA, 17 nt, Homo sapiens
guagugaaauuauacag

SEQ ID NO: 2038897 - RNA, 17 nt, Homo sapiens
acuacuuuuggugcuua

SEQ ID NO: 2038898 - RNA, 13 nt, Homo sapiens
guuuuauuuugaa

SEQ ID NO: 2038899 - RNA, 23 nt, Homo sapiens
cugaacauaggaaaauagaaacu

SEQ ID NO: 2038900 - RNA, 19 nt, Homo sapiens
gaaacaagaagaguaaaca

SEQ ID NO: 2038901 - RNA, 16 nt, Homo sapiens
auccacccaacccuau

SEQ ID NO: 2038902 - RNA, 20 nt, Homo sapiens
ucucauuccucuguccccga

SEQ ID NO: 2038903 - RNA, 21 nt, Homo sapiens
ccauaauagacaccaaaacaa

SEQ ID NO: 2038904 - RNA, 14 nt, Homo sapiens
auucucagauuccu

SEQ ID NO: 2038905 - RNA, 21 nt, Homo sapiens
cuguaaucccagcuacucggg

SEQ ID NO: 2038906 - RNA, 12 nt, Homo sapiens
uucucuuaccac

SEQ ID NO: 2038907 - RNA, 17 nt, Homo sapiens
ugaaguggugagcuuaa

SEQ ID NO: 2038908 - RNA, 19 nt, Homo sapiens
agaaaccaaauuacaagua

SEQ ID NO: 2038909 - RNA, 21 nt, Homo sapiens
uaccaguguuaauaaauggau

SEQ ID NO: 2038910 - RNA, 20 nt, Homo sapiens
acauccguuuucauuguuca

SEQ ID NO: 2038911 - RNA, 22 nt, Homo sapiens
agauuuuaaauagacaauccaa

SEQ ID NO: 2038912 - RNA, 19 nt, Homo sapiens
cgaugauacuguuucuugc

SEQ ID NO: 2038913 - RNA, 14 nt, Homo sapiens
ccucaagcaccacg

SEQ ID NO: 2038914 - RNA, 22 nt, Homo sapiens
aaccuccuguggaacccagcag

SEQ ID NO: 2038915 - RNA, 13 nt, Homo sapiens
cuagggcagagua

SEQ ID NO: 2038916 - RNA, 18 nt, Homo sapiens
uccagaccaaccuuccau

SEQ ID NO: 2038917 - RNA, 12 nt, Homo sapiens
aagaaaugugau

SEQ ID NO: 2038918 - RNA, 22 nt, Homo sapiens
aaacucaucuguaaacuuuuau

SEQ ID NO: 2038919 - RNA, 16 nt, Homo sapiens
ugaugugccuacuccc

SEQ ID NO: 2038920 - RNA, 12 nt, Homo sapiens
ucauuaauucaa

SEQ ID NO: 2038921 - RNA, 13 nt, Homo sapiens
uagaccuuuuccc

SEQ ID NO: 2038922 - RNA, 22 nt, Homo sapiens
gaagacauuugccuuuuguuaa

SEQ ID NO: 2038923 - RNA, 17 nt, Homo sapiens
uggcagugauccugcaa

SEQ ID NO: 2038924 - RNA, 13 nt, Homo sapiens
agaucucccuuaa

SEQ ID NO: 2038925 - RNA, 12 nt, Homo sapiens
ugaagaaucugc

SEQ ID NO: 2038926 - RNA, 19 nt, Homo sapiens
ggagaaggucuccaaggga

SEQ ID NO: 2038927 - RNA, 19 nt, Homo sapiens
gacuaccuauaaauggacu

SEQ ID NO: 2038928 - RNA, 13 nt, Homo sapiens
ugguagagauuca

SEQ ID NO: 2038929 - RNA, 22 nt, Homo sapiens
cuacaugugccaccaacauaaa

SEQ ID NO: 2038930 - RNA, 15 nt, Homo sapiens
auaagcacugugcua

SEQ ID NO: 2038931 - RNA, 23 nt, Homo sapiens
ugucugugugugugugugcauau

SEQ ID NO: 2038932 - RNA, 15 nt, Homo sapiens
uuaaauaaaccucaa

SEQ ID NO: 2038933 - RNA, 17 nt, Homo sapiens
aggucaguaaugcugca

SEQ ID NO: 2038934 - RNA, 15 nt, Homo sapiens
uagagucuagacaga

SEQ ID NO: 2038935 - RNA, 15 nt, Homo sapiens
cucuccccuccagcc

SEQ ID NO: 2038936 - RNA, 16 nt, Homo sapiens
aucucuaguguagcug

SEQ ID NO: 2038937 - RNA, 22 nt, Homo sapiens
cuccuuuuugccauuucacuua

SEQ ID NO: 2038938 - RNA, 17 nt, Homo sapiens
accucccuauacugcuu

SEQ ID NO: 2038939 - RNA, 14 nt, Homo sapiens
auugcugcaaagau

SEQ ID NO: 2038940 - RNA, 17 nt, Homo sapiens
uuguguacaaaauaucc

SEQ ID NO: 2038941 - RNA, 17 nt, Homo sapiens
uuaacuuaacucaugaa

SEQ ID NO: 2038942 - RNA, 16 nt, Homo sapiens
uagacacugggagaag

SEQ ID NO: 2038943 - RNA, 17 nt, Homo sapiens
cagcccccacuccaguc

SEQ ID NO: 2038944 - RNA, 14 nt, Homo sapiens
agcagcgagugcau

SEQ ID NO: 2038945 - RNA, 21 nt, Homo sapiens
ugacuucucaacgccaaguca

SEQ ID NO: 2038946 - RNA, 17 nt, Homo sapiens
agcugggauuacaggcg

SEQ ID NO: 2038947 - RNA, 14 nt, Homo sapiens
ccuuguuucaaaau

SEQ ID NO: 2038948 - RNA, 16 nt, Homo sapiens
cugauggugcaaugac

SEQ ID NO: 2038949 - RNA, 18 nt, Homo sapiens
ggagaacucagugccaca

SEQ ID NO: 2038950 - RNA, 11 nt, Homo sapiens
ugcuguaugaa

SEQ ID NO: 2038951 - RNA, 15 nt, Homo sapiens
gcccugcccacagaa

SEQ ID NO: 2038952 - RNA, 16 nt, Homo sapiens
uaaaugcuguauguca

SEQ ID NO: 2038953 - RNA, 16 nt, Homo sapiens
auucuaaaggcuugau

SEQ ID NO: 2038954 - RNA, 14 nt, Homo sapiens
cccggcacuuccga

SEQ ID NO: 2038955 - RNA, 17 nt, Homo sapiens
aaguucaauacucuuga

SEQ ID NO: 2038956 - RNA, 17 nt, Homo sapiens
agagccacccuguguug

SEQ ID NO: 2038957 - RNA, 23 nt, Homo sapiens
acagacucugauucuacagugau

SEQ ID NO: 2038958 - RNA, 16 nt, Homo sapiens
ugaauguuaaugguca

SEQ ID NO: 2038959 - RNA, 22 nt, Homo sapiens
uguaaaaaugaaagugacuuua

SEQ ID NO: 2038960 - RNA, 14 nt, Homo sapiens
uccauuucuuaaca

SEQ ID NO: 2038961 - RNA, 15 nt, Homo sapiens
cuugaugacauuuca

SEQ ID NO: 2038962 - RNA, 16 nt, Homo sapiens
aguacuuauguugcac

SEQ ID NO: 2038963 - RNA, 18 nt, Homo sapiens
uuugguguuacacagccc

SEQ ID NO: 2038964 - RNA, 20 nt, Homo sapiens
cagcaggcacguuaacucga

SEQ ID NO: 2038965 - RNA, 18 nt, Homo sapiens
uaggauauuggcauuugu

SEQ ID NO: 2038966 - RNA, 17 nt, Homo sapiens
gaccgagccucugucac

SEQ ID NO: 2038967 - RNA, 12 nt, Homo sapiens
aagcccacagca

SEQ ID NO: 2038968 - RNA, 22 nt, Homo sapiens
cugccugugcaugaccugauca

SEQ ID NO: 2038969 - RNA, 17 nt, Homo sapiens
cugccaucaugccugac

SEQ ID NO: 2038970 - RNA, 18 nt, Homo sapiens
guggacaggaugaggaca

SEQ ID NO: 2038971 - RNA, 19 nt, Homo sapiens
ucaacaagauacaaucuca

SEQ ID NO: 2038972 - RNA, 21 nt, Homo sapiens
cacacgcauacacacauauaa

SEQ ID NO: 2038973 - RNA, 20 nt, Homo sapiens
aguccucccagacuaccugc

SEQ ID NO: 2038974 - RNA, 18 nt, Homo sapiens
gauuguauaagcaugcuu

SEQ ID NO: 2038975 - RNA, 20 nt, Homo sapiens
caauguuuuaaacauucuuc

SEQ ID NO: 2038976 - RNA, 15 nt, Homo sapiens
ucagagcuaauaagu

SEQ ID NO: 2038977 - RNA, 22 nt, Homo sapiens
aggaauggaggcucuaauugaa

SEQ ID NO: 2038978 - RNA, 16 nt, Homo sapiens
ggacuucugcagcuau

SEQ ID NO: 2038979 - RNA, 20 nt, Homo sapiens
caauuccuuaguauaauauu

SEQ ID NO: 2038980 - RNA, 23 nt, Homo sapiens
ugcagugcuccauccaaacucag

SEQ ID NO: 2038981 - RNA, 22 nt, Homo sapiens
cagcugauugggcaccugacca

SEQ ID NO: 2038982 - RNA, 19 nt, Homo sapiens
uuuagccgacaacagagac

SEQ ID NO: 2038983 - RNA, 17 nt, Homo sapiens
ccucuggguaggaauca

SEQ ID NO: 2038984 - RNA, 19 nt, Homo sapiens
gcugccauauuguagcuca

SEQ ID NO: 2038985 - RNA, 13 nt, Homo sapiens
acuuacacuguau

SEQ ID NO: 2038986 - RNA, 17 nt, Homo sapiens
cuguguacccuccaugu

SEQ ID NO: 2038987 - RNA, 16 nt, Homo sapiens
cccuccccagauauca

SEQ ID NO: 2038988 - RNA, 19 nt, Homo sapiens
ugucccugugaucuuggca

SEQ ID NO: 2038989 - RNA, 21 nt, Homo sapiens
ggcugaaaaugcaaagcugaa

SEQ ID NO: 2038990 - RNA, 20 nt, Homo sapiens
aagccuuggggauucuucca

SEQ ID NO: 2038991 - RNA, 18 nt, Homo sapiens
cuguacugagacauuaca

SEQ ID NO: 2038992 - RNA, 20 nt, Homo sapiens
cuugugacaaacuggcaggu

SEQ ID NO: 2038993 - RNA, 13 nt, Homo sapiens
ggcuuaugcccuc

SEQ ID NO: 2038994 - RNA, 20 nt, Homo sapiens
cuucuaaaggcuuuugcccu

SEQ ID NO: 2038995 - RNA, 19 nt, Homo sapiens
ccccaucuugaucuuugag

SEQ ID NO: 2038996 - RNA, 18 nt, Homo sapiens
uaaaaagaauuugguuaa

SEQ ID NO: 2038997 - RNA, 16 nt, Homo sapiens
ugcaauaauacuucuc

SEQ ID NO: 2038998 - RNA, 17 nt, Homo sapiens
aggccguccucccgggc

SEQ ID NO: 2038999 - RNA, 13 nt, Homo sapiens
ggauuaaugucaa

SEQ ID NO: 2039000 - RNA, 22 nt, Homo sapiens
ccacaccaguaauaaaaagcca

SEQ ID NO: 2039001 - RNA, 19 nt, Homo sapiens
uacauucacgacaguacuu

SEQ ID NO: 2039002 - RNA, 20 nt, Homo sapiens
acugcgccugggaucucgcc

SEQ ID NO: 2039003 - RNA, 21 nt, Homo sapiens
ugcugggacuugaacaaagac

SEQ ID NO: 2039004 - RNA, 19 nt, Homo sapiens
aacaacucgaaucacucau

SEQ ID NO: 2039005 - RNA, 16 nt, Homo sapiens
augugguuaucuguga

SEQ ID NO: 2039006 - RNA, 17 nt, Homo sapiens
aaauguuuacuguauca

SEQ ID NO: 2039007 - RNA, 20 nt, Homo sapiens
agcccagugggcugcacgcu

SEQ ID NO: 2039008 - RNA, 18 nt, Homo sapiens
ccaaacagcaugugcuca

SEQ ID NO: 2039009 - RNA, 19 nt, Homo sapiens
gcuccuucaguucugcuug

SEQ ID NO: 2039010 - RNA, 23 nt, Homo sapiens
ugggggaaggccuugcugucaug

SEQ ID NO: 2039011 - RNA, 18 nt, Homo sapiens
ccaugaagaggaugcugu

SEQ ID NO: 2039012 - RNA, 19 nt, Homo sapiens
aucgugccacugcacucca

SEQ ID NO: 2039013 - RNA, 19 nt, Homo sapiens
guuggggaaaccuucaucu

SEQ ID NO: 2039014 - RNA, 17 nt, Homo sapiens
augccgccucaaggguc

SEQ ID NO: 2039015 - RNA, 17 nt, Homo sapiens
ugccaggggcagugaag

SEQ ID NO: 2039016 - RNA, 21 nt, Homo sapiens
cugccauccaugugcuaguca

SEQ ID NO: 2039017 - RNA, 15 nt, Homo sapiens
uaagcuaaagcagug

SEQ ID NO: 2039018 - RNA, 19 nt, Homo sapiens
cugcccaaggccuacccca

SEQ ID NO: 2039019 - RNA, 16 nt, Homo sapiens
uucauuaugaggucag

SEQ ID NO: 2039020 - RNA, 16 nt, Homo sapiens
aagacacacagccuuu

SEQ ID NO: 2039021 - RNA, 12 nt, Homo sapiens
caggugccugua

SEQ ID NO: 2039022 - RNA, 21 nt, Homo sapiens
ucggccacccgccucccucuc

SEQ ID NO: 2039023 - RNA, 12 nt, Homo sapiens
aggagaccaagg

SEQ ID NO: 2039024 - RNA, 17 nt, Homo sapiens
agucuuuucaacaaaug

SEQ ID NO: 2039025 - RNA, 21 nt, Homo sapiens
acaaauccaacgcuuuuccca

SEQ ID NO: 2039026 - RNA, 14 nt, Homo sapiens
ugacaauuacucag

SEQ ID NO: 2039027 - RNA, 18 nt, Homo sapiens
uugcacaccagccuuaca

SEQ ID NO: 2039028 - RNA, 18 nt, Homo sapiens
ugcuugucgauuauauuc

SEQ ID NO: 2039029 - RNA, 14 nt, Homo sapiens
ugaagaaacuuccc

SEQ ID NO: 2039030 - RNA, 18 nt, Homo sapiens
guauugauacugguccca

SEQ ID NO: 2039031 - RNA, 14 nt, Homo sapiens
uaugccuucacuuu

SEQ ID NO: 2039032 - RNA, 13 nt, Homo sapiens
uccugacacuuga

SEQ ID NO: 2039033 - RNA, 23 nt, Homo sapiens
ugcauuugucaaagcauugagau

SEQ ID NO: 2039034 - RNA, 14 nt, Homo sapiens
cgagagccaaacag

SEQ ID NO: 2039035 - RNA, 15 nt, Homo sapiens
cagcaucuuugcccu

SEQ ID NO: 2039036 - RNA, 21 nt, Homo sapiens
gcccucugcucuaauugcugc

SEQ ID NO: 2039037 - RNA, 16 nt, Homo sapiens
uacugcaauguaaaua

SEQ ID NO: 2039038 - RNA, 16 nt, Homo sapiens
agucuguauuuuccac

SEQ ID NO: 2039039 - RNA, 13 nt, Homo sapiens
aauaauagcagau

SEQ ID NO: 2039040 - RNA, 15 nt, Homo sapiens
ugccuuccugccucu

SEQ ID NO: 2039041 - RNA, 23 nt, Homo sapiens
uuaggccccugauucacugccua

SEQ ID NO: 2039042 - RNA, 18 nt, Homo sapiens
cugucacuagucucacca

SEQ ID NO: 2039043 - RNA, 19 nt, Homo sapiens
cuguuuaaucauaguuacu

SEQ ID NO: 2039044 - RNA, 19 nt, Homo sapiens
aacuaguagagagagacuu

SEQ ID NO: 2039045 - RNA, 14 nt, Homo sapiens
uugcgaaaauugcg

SEQ ID NO: 2039046 - RNA, 16 nt, Homo sapiens
uagaucucccuuaaua

SEQ ID NO: 2039047 - RNA, 20 nt, Homo sapiens
gaccagcucugggguuugua

SEQ ID NO: 2039048 - RNA, 23 nt, Homo sapiens
acuuccucagucuggugcuccag

SEQ ID NO: 2039049 - RNA, 14 nt, Homo sapiens
ccauugcaugaauu

SEQ ID NO: 2039050 - RNA, 15 nt, Homo sapiens
ccuuuuccacuuuaa

SEQ ID NO: 2039051 - RNA, 17 nt, Homo sapiens
cauaauuuaaaagcaca

SEQ ID NO: 2039052 - RNA, 22 nt, Homo sapiens
acagugucgcuaagugcauuuc

SEQ ID NO: 2039053 - RNA, 19 nt, Homo sapiens
ugcuccaucaugcuugauu

SEQ ID NO: 2039054 - RNA, 12 nt, Homo sapiens
auucuucuugcu

SEQ ID NO: 2039055 - RNA, 22 nt, Homo sapiens
uauucaguugguaagcuuccag

SEQ ID NO: 2039056 - RNA, 14 nt, Homo sapiens
uuugcacacugcac

SEQ ID NO: 2039057 - RNA, 21 nt, Homo sapiens
auaauuguaaaggugaugaau

SEQ ID NO: 2039058 - RNA, 14 nt, Homo sapiens
ucuggaccccaaag

SEQ ID NO: 2039059 - RNA, 23 nt, Homo sapiens
aucuuagggcaucgcuccuccuc

SEQ ID NO: 2039060 - RNA, 23 nt, Homo sapiens
ggcaaaucugacuuuuucugugc

SEQ ID NO: 2039061 - RNA, 19 nt, Homo sapiens
cuucccuucuuugcugcug

SEQ ID NO: 2039062 - RNA, 19 nt, Homo sapiens
gaauaaagaugguccaaaa

SEQ ID NO: 2039063 - RNA, 23 nt, Homo sapiens
cccuaaagugccaggugaucucc

SEQ ID NO: 2039064 - RNA, 14 nt, Homo sapiens
aaggcuaagcuuca

SEQ ID NO: 2039065 - RNA, 20 nt, Homo sapiens
cacucucaaagcaaauaauu

SEQ ID NO: 2039066 - RNA, 21 nt, Homo sapiens
aguauccacuguuuauucaac

SEQ ID NO: 2039067 - RNA, 15 nt, Homo sapiens
uuggacugcauuuaa

SEQ ID NO: 2039068 - RNA, 18 nt, Homo sapiens
aggccuaugccaccugca

SEQ ID NO: 2039069 - RNA, 16 nt, Homo sapiens
gaauguauaguauuug

SEQ ID NO: 2039070 - RNA, 20 nt, Homo sapiens
caggguccucuucugggccu

SEQ ID NO: 2039071 - RNA, 23 nt, Homo sapiens
auuagcagucccuccacauuucc

SEQ ID NO: 2039072 - RNA, 13 nt, Homo sapiens
gagagauggaaua

SEQ ID NO: 2039073 - RNA, 17 nt, Homo sapiens
agcucaucugccaaaau

SEQ ID NO: 2039074 - RNA, 17 nt, Homo sapiens
ugugagggacaugcuca

SEQ ID NO: 2039075 - RNA, 17 nt, Homo sapiens
aaguuacauuaugugua

SEQ ID NO: 2039076 - RNA, 13 nt, Homo sapiens
ucagaaguuucua

SEQ ID NO: 2039077 - RNA, 13 nt, Homo sapiens
cuggugcacauga

SEQ ID NO: 2039078 - RNA, 12 nt, Homo sapiens
acuuaaguauau

SEQ ID NO: 2039079 - RNA, 19 nt, Homo sapiens
cagacacuaaaugcagaca

SEQ ID NO: 2039080 - RNA, 13 nt, Homo sapiens
aacacauaacaau

SEQ ID NO: 2039081 - RNA, 15 nt, Homo sapiens
cuucagugcagugaa

SEQ ID NO: 2039082 - RNA, 19 nt, Homo sapiens
gaaaaagacuaagccagac

SEQ ID NO: 2039083 - RNA, 19 nt, Homo sapiens
guucaguuuccccauuugu

SEQ ID NO: 2039084 - RNA, 18 nt, Homo sapiens
ugaugaggcagauggaga

SEQ ID NO: 2039085 - RNA, 19 nt, Homo sapiens
ucguuugaaucacaguaua

SEQ ID NO: 2039086 - RNA, 22 nt, Homo sapiens
ugugaagagacuuuauugccua

SEQ ID NO: 2039087 - RNA, 13 nt, Homo sapiens
ggccacccaggga

SEQ ID NO: 2039088 - RNA, 20 nt, Homo sapiens
uguuuucuuaaccagaucau

SEQ ID NO: 2039089 - RNA, 17 nt, Homo sapiens
cuauguagucauaauaa

SEQ ID NO: 2039090 - RNA, 22 nt, Homo sapiens
gagcuuguaauugcaccacugc

SEQ ID NO: 2039091 - RNA, 15 nt, Homo sapiens
cucuggccacuauua

SEQ ID NO: 2039092 - RNA, 14 nt, Homo sapiens
ugugucuccaugca

SEQ ID NO: 2039093 - RNA, 14 nt, Homo sapiens
ugcacaagaaugga

SEQ ID NO: 2039094 - RNA, 15 nt, Homo sapiens
ggaauucagugacaa

SEQ ID NO: 2039095 - RNA, 15 nt, Homo sapiens
cuucugacgcagccu

SEQ ID NO: 2039096 - RNA, 15 nt, Homo sapiens
uuugcuuaguucuca

SEQ ID NO: 2039097 - RNA, 19 nt, Homo sapiens
gggucauugaccucucagg

SEQ ID NO: 2039098 - RNA, 13 nt, Homo sapiens
ugaacugugcaua

SEQ ID NO: 2039099 - RNA, 13 nt, Homo sapiens
aagguugugauga

SEQ ID NO: 2039100 - RNA, 12 nt, Homo sapiens
auuacccuccua

SEQ ID NO: 2039101 - RNA, 15 nt, Homo sapiens
uaagaagaaacugcu

SEQ ID NO: 2039102 - RNA, 23 nt, Homo sapiens
agaagguugagggcaauggacaa

SEQ ID NO: 2039103 - RNA, 19 nt, Homo sapiens
uuggaagggaaacuuucaa

SEQ ID NO: 2039104 - RNA, 15 nt, Homo sapiens
agcagugcaggcaca

SEQ ID NO: 2039105 - RNA, 16 nt, Homo sapiens
cguggagggugcccag

SEQ ID NO: 2039106 - RNA, 15 nt, Homo sapiens
uuccaugcuugagca

SEQ ID NO: 2039107 - RNA, 15 nt, Homo sapiens
ggcuuaaaagcaagu

SEQ ID NO: 2039108 - RNA, 16 nt, Homo sapiens
aagagagaugauacug

SEQ ID NO: 2039109 - RNA, 15 nt, Homo sapiens
agaaaaugcauuauu

SEQ ID NO: 2039110 - RNA, 22 nt, Homo sapiens
augccaucuaccggcguccugc

SEQ ID NO: 2039111 - RNA, 16 nt, Homo sapiens
ggugucauccugugaa

SEQ ID NO: 2039112 - RNA, 16 nt, Homo sapiens
agcucauaaacugcca

SEQ ID NO: 2039113 - RNA, 23 nt, Homo sapiens
ggugauguaaaacagaauauucu

SEQ ID NO: 2039114 - RNA, 22 nt, Homo sapiens
auguuuugaaauguaccaucaa

SEQ ID NO: 2039115 - RNA, 22 nt, Homo sapiens
cagccuccuuauauuuggccca

SEQ ID NO: 2039116 - RNA, 16 nt, Homo sapiens
agugucccaccuugac

SEQ ID NO: 2039117 - RNA, 20 nt, Homo sapiens
ccaggcagggauaauuaaaa

SEQ ID NO: 2039118 - RNA, 17 nt, Homo sapiens
augauuuugaugcacaa

SEQ ID NO: 2039119 - RNA, 19 nt, Homo sapiens
gcucugucuucuuugccca

SEQ ID NO: 2039120 - RNA, 18 nt, Homo sapiens
aaguugacuuuaacaagg

SEQ ID NO: 2039121 - RNA, 21 nt, Homo sapiens
uugcaguucccacauuaaaga

SEQ ID NO: 2039122 - RNA, 19 nt, Homo sapiens
ccagggggagcugggccug

SEQ ID NO: 2039123 - RNA, 17 nt, Homo sapiens
ggccacuggccaucucc

SEQ ID NO: 2039124 - RNA, 15 nt, Homo sapiens
aaaucuccaucucaa

SEQ ID NO: 2039125 - RNA, 17 nt, Homo sapiens
guuuucugacacaguca

SEQ ID NO: 2039126 - RNA, 22 nt, Homo sapiens
ugagacuuugaaacuaucucau

SEQ ID NO: 2039127 - RNA, 21 nt, Homo sapiens
ucuauacguaauuuaaacaaa

SEQ ID NO: 2039128 - RNA, 19 nt, Homo sapiens
ggagacacuggccccucaa

SEQ ID NO: 2039129 - RNA, 14 nt, Homo sapiens
cccuccaguaccau

SEQ ID NO: 2039130 - RNA, 15 nt, Homo sapiens
cccugaucuucacug

SEQ ID NO: 2039131 - RNA, 22 nt, Homo sapiens
gaggggccaggccauggccaag

SEQ ID NO: 2039132 - RNA, 14 nt, Homo sapiens
acauuaucaucuga

SEQ ID NO: 2039133 - RNA, 20 nt, Homo sapiens
ccgaugcaggggauggugug

SEQ ID NO: 2039134 - RNA, 18 nt, Homo sapiens
aaacuuugaagcaacugu

SEQ ID NO: 2039135 - RNA, 13 nt, Homo sapiens
uauuuauaacuca

SEQ ID NO: 2039136 - RNA, 19 nt, Homo sapiens
ugcuggguaauaaaaucau

SEQ ID NO: 2039137 - RNA, 16 nt, Homo sapiens
uuucucuaaaacugcc

SEQ ID NO: 2039138 - RNA, 18 nt, Homo sapiens
gucccauuugccuugcaa

SEQ ID NO: 2039139 - RNA, 18 nt, Homo sapiens
caacccuuccugcugcug

SEQ ID NO: 2039140 - RNA, 14 nt, Homo sapiens
aggaacagcccagc

SEQ ID NO: 2039141 - RNA, 19 nt, Homo sapiens
cuacaugucuacaugccau

SEQ ID NO: 2039142 - RNA, 14 nt, Homo sapiens
aacuucaccuuaaa

SEQ ID NO: 2039143 - RNA, 20 nt, Homo sapiens
aagagugagacuccaccuca

SEQ ID NO: 2039144 - RNA, 19 nt, Homo sapiens
cuacagcuacauugagaua

SEQ ID NO: 2039145 - RNA, 15 nt, Homo sapiens
aguauccucuugcca

SEQ ID NO: 2039146 - RNA, 16 nt, Homo sapiens
ccuguugaaaugugaa

SEQ ID NO: 2039147 - RNA, 14 nt, Homo sapiens
accaaaaacaauac

SEQ ID NO: 2039148 - RNA, 13 nt, Homo sapiens
guccuccugcucu

SEQ ID NO: 2039149 - RNA, 12 nt, Homo sapiens
aaugaaacaauc

SEQ ID NO: 2039150 - RNA, 15 nt, Homo sapiens
auagcaauguaacau

SEQ ID NO: 2039151 - RNA, 15 nt, Homo sapiens
cacccgcuuccuccc

SEQ ID NO: 2039152 - RNA, 15 nt, Homo sapiens
ucccuccucacuugc

SEQ ID NO: 2039153 - RNA, 12 nt, Homo sapiens
agaugaauuuau

SEQ ID NO: 2039154 - RNA, 16 nt, Homo sapiens
cuggggcaacugagag

SEQ ID NO: 2039155 - RNA, 19 nt, Homo sapiens
caaaaauguaaugaucaua

SEQ ID NO: 2039156 - RNA, 14 nt, Homo sapiens
caggagugacucug

SEQ ID NO: 2039157 - RNA, 17 nt, Homo sapiens
cuccauacucuguaaca

SEQ ID NO: 2039158 - RNA, 15 nt, Homo sapiens
cuuacaauucccugc

SEQ ID NO: 2039159 - RNA, 14 nt, Homo sapiens
aguaagaagaggag

SEQ ID NO: 2039160 - RNA, 19 nt, Homo sapiens
aguccuguaugucugucau

SEQ ID NO: 2039161 - RNA, 20 nt, Homo sapiens
cgaagagacaagaucuugaa

SEQ ID NO: 2039162 - RNA, 14 nt, Homo sapiens
agaugcagcacaua

SEQ ID NO: 2039163 - RNA, 15 nt, Homo sapiens
aaggcaaaguggaau

SEQ ID NO: 2039164 - RNA, 22 nt, Homo sapiens
ccaucaugcggugggugcugcc

SEQ ID NO: 2039165 - RNA, 16 nt, Homo sapiens
ccaucacacauguuca

SEQ ID NO: 2039166 - RNA, 11 nt, Homo sapiens
cccuuucacaa

SEQ ID NO: 2039167 - RNA, 23 nt, Homo sapiens
aaccuuuuuuaagauuuuucuca

SEQ ID NO: 2039168 - RNA, 19 nt, Homo sapiens
ugcugcaucccugugucca

SEQ ID NO: 2039169 - RNA, 20 nt, Homo sapiens
aacuaaaaauuuacaagaga

SEQ ID NO: 2039170 - RNA, 16 nt, Homo sapiens
aagauaacuuacugua

SEQ ID NO: 2039171 - RNA, 20 nt, Homo sapiens
uuggaaggcucccuaacaca

SEQ ID NO: 2039172 - RNA, 16 nt, Homo sapiens
uccaacccaaccucau

SEQ ID NO: 2039173 - RNA, 18 nt, Homo sapiens
cagguugauaaaucauuu

SEQ ID NO: 2039174 - RNA, 20 nt, Homo sapiens
cucugcauccauuugaacac

SEQ ID NO: 2039175 - RNA, 14 nt, Homo sapiens
acugagucucaugg

SEQ ID NO: 2039176 - RNA, 22 nt, Homo sapiens
uucugauuccccuccaccaaac

SEQ ID NO: 2039177 - RNA, 21 nt, Homo sapiens
gcuucugcaccaacucaccug

SEQ ID NO: 2039178 - RNA, 13 nt, Homo sapiens
uggccaugcagaa

SEQ ID NO: 2039179 - RNA, 16 nt, Homo sapiens
gacugaguuaggagaa

SEQ ID NO: 2039180 - RNA, 17 nt, Homo sapiens
cucagccuccaaagugg

SEQ ID NO: 2039181 - RNA, 15 nt, Homo sapiens
uuucagaaauauuca

SEQ ID NO: 2039182 - RNA, 13 nt, Homo sapiens
uucuucuaccaga

SEQ ID NO: 2039183 - RNA, 19 nt, Homo sapiens
cagcuaacuccagucuccu

SEQ ID NO: 2039184 - RNA, 19 nt, Homo sapiens
aaguuuucuuccaugauuu

SEQ ID NO: 2039185 - RNA, 12 nt, Homo sapiens
cccucuugccag

SEQ ID NO: 2039186 - RNA, 14 nt, Homo sapiens
cuagccgaccucag

SEQ ID NO: 2039187 - RNA, 19 nt, Homo sapiens
caauucuuucaacuggguu

SEQ ID NO: 2039188 - RNA, 14 nt, Homo sapiens
uuggaaaguacucc

SEQ ID NO: 2039189 - RNA, 16 nt, Homo sapiens
uaucucuccaaccaga

SEQ ID NO: 2039190 - RNA, 23 nt, Homo sapiens
uaacuuaaaaaacugcaucccac

SEQ ID NO: 2039191 - RNA, 14 nt, Homo sapiens
gaagagauccaaag

SEQ ID NO: 2039192 - RNA, 15 nt, Homo sapiens
ggaacagcauaugca

SEQ ID NO: 2039193 - RNA, 14 nt, Homo sapiens
uacaagguaauugu

SEQ ID NO: 2039194 - RNA, 22 nt, Homo sapiens
auuggcaccccuuucuaguuca

SEQ ID NO: 2039195 - RNA, 18 nt, Homo sapiens
uugccucuuuuaccugcu

SEQ ID NO: 2039196 - RNA, 13 nt, Homo sapiens
aguuacuacugau

SEQ ID NO: 2039197 - RNA, 19 nt, Homo sapiens
gaagaaguuaucaacaugc

SEQ ID NO: 2039198 - RNA, 14 nt, Homo sapiens
acaaacccuuuaaa

SEQ ID NO: 2039199 - RNA, 20 nt, Homo sapiens
gcaaucacggcucacuguag

SEQ ID NO: 2039200 - RNA, 15 nt, Homo sapiens
cuucagagacuaucu

SEQ ID NO: 2039201 - RNA, 16 nt, Homo sapiens
gacuaugcacacuuuu

SEQ ID NO: 2039202 - RNA, 21 nt, Homo sapiens
gugccccagggaguccagggu

SEQ ID NO: 2039203 - RNA, 21 nt, Homo sapiens
gaugaaguuguacaacaccag

SEQ ID NO: 2039204 - RNA, 19 nt, Homo sapiens
cacuaaugaggaaacugca

SEQ ID NO: 2039205 - RNA, 17 nt, Homo sapiens
ugcaccugugcauucuc

SEQ ID NO: 2039206 - RNA, 21 nt, Homo sapiens
auugcacgggagaauauacaa

SEQ ID NO: 2039207 - RNA, 23 nt, Homo sapiens
ccuccacagagaggaggggacca

SEQ ID NO: 2039208 - RNA, 23 nt, Homo sapiens
accugcuguuggaugcagcaaua

SEQ ID NO: 2039209 - RNA, 16 nt, Homo sapiens
ucuccuaaagcuuuua

SEQ ID NO: 2039210 - RNA, 22 nt, Homo sapiens
caauguugcaacacauucauuu

SEQ ID NO: 2039211 - RNA, 20 nt, Homo sapiens
guacagacaaguuggaaaaa

SEQ ID NO: 2039212 - RNA, 22 nt, Homo sapiens
ccagguagagagaccacaagca

SEQ ID NO: 2039213 - RNA, 21 nt, Homo sapiens
augaacaauuaugaacaucca

SEQ ID NO: 2039214 - RNA, 19 nt, Homo sapiens
gaaaaucccggugcuugca

SEQ ID NO: 2039215 - RNA, 19 nt, Homo sapiens
aagaugauggaaacgcacu

SEQ ID NO: 2039216 - RNA, 13 nt, Homo sapiens
uguccuaaugcuu

SEQ ID NO: 2039217 - RNA, 13 nt, Homo sapiens
cccaggaacaaua

SEQ ID NO: 2039218 - RNA, 14 nt, Homo sapiens
uuuuaaggagcugg

SEQ ID NO: 2039219 - RNA, 24 nt, Homo sapiens
aaaaauugacuucuugcuuguaca

SEQ ID NO: 2039220 - RNA, 19 nt, Homo sapiens
aaggcaggauuuagcccuu

SEQ ID NO: 2039221 - RNA, 15 nt, Homo sapiens
uggacccaugacucu

SEQ ID NO: 2039222 - RNA, 20 nt, Homo sapiens
acugguuaaaucaauucuga

SEQ ID NO: 2039223 - RNA, 14 nt, Homo sapiens
agaucagccaguga

SEQ ID NO: 2039224 - RNA, 14 nt, Homo sapiens
uuaaacaugcugua

SEQ ID NO: 2039225 - RNA, 22 nt, Homo sapiens
cuauuucggaaauacacuacaa

SEQ ID NO: 2039226 - RNA, 17 nt, Homo sapiens
aagcuggagucugucaa

SEQ ID NO: 2039227 - RNA, 14 nt, Homo sapiens
gugugugcaugugc

SEQ ID NO: 2039228 - RNA, 14 nt, Homo sapiens
gcugcugcacugcc

SEQ ID NO: 2039229 - RNA, 19 nt, Homo sapiens
ggccacuguuugucucacc

SEQ ID NO: 2039230 - RNA, 18 nt, Homo sapiens
cagggccugacuugagcc

SEQ ID NO: 2039231 - RNA, 18 nt, Homo sapiens
acgucgcccgcugagcug

SEQ ID NO: 2039232 - RNA, 16 nt, Homo sapiens
cucaggaaaacagcua

SEQ ID NO: 2039233 - RNA, 18 nt, Homo sapiens
caguucugccuuaucuaa

SEQ ID NO: 2039234 - RNA, 16 nt, Homo sapiens
ccuggcuuugccucuu

SEQ ID NO: 2039235 - RNA, 19 nt, Homo sapiens
uauuuggacucuaagcucu

SEQ ID NO: 2039236 - RNA, 22 nt, Homo sapiens
cacucagguucuucagggccag

SEQ ID NO: 2039237 - RNA, 20 nt, Homo sapiens
caggggagacaucacaaccu

SEQ ID NO: 2039238 - RNA, 14 nt, Homo sapiens
cuuaaugguuuccu

SEQ ID NO: 2039239 - RNA, 13 nt, Homo sapiens
cuguguacugggu

SEQ ID NO: 2039240 - RNA, 19 nt, Homo sapiens
ucauugccuucucccucau

SEQ ID NO: 2039241 - RNA, 12 nt, Homo sapiens
ccauugaacuca

SEQ ID NO: 2039242 - RNA, 14 nt, Homo sapiens
uauaguacuggcau

SEQ ID NO: 2039243 - RNA, 14 nt, Homo sapiens
caagaggaaagcuu

SEQ ID NO: 2039244 - RNA, 17 nt, Homo sapiens
agaacucaacuguauaa

SEQ ID NO: 2039245 - RNA, 18 nt, Homo sapiens
auuuccaaguaagaguac

SEQ ID NO: 2039246 - RNA, 22 nt, Homo sapiens
agcaaugcccugccuugcugcc

SEQ ID NO: 2039247 - RNA, 15 nt, Homo sapiens
gaaauacucuuccaa

SEQ ID NO: 2039248 - RNA, 12 nt, Homo sapiens
agcuuguugaaa

SEQ ID NO: 2039249 - RNA, 18 nt, Homo sapiens
aaaugcacauuugucacu

SEQ ID NO: 2039250 - RNA, 21 nt, Homo sapiens
aauugucuuuguucugugauu

SEQ ID NO: 2039251 - RNA, 19 nt, Homo sapiens
acagaaggguaaugcgugc

SEQ ID NO: 2039252 - RNA, 20 nt, Homo sapiens
uccaggguggaugaucucaa

SEQ ID NO: 2039253 - RNA, 24 nt, Homo sapiens
ucagugcaagagacuuugucacuu

SEQ ID NO: 2039254 - RNA, 23 nt, Homo sapiens
agcucauggacuucugccagcau

SEQ ID NO: 2039255 - RNA, 15 nt, Homo sapiens
uacugugcauuggga

SEQ ID NO: 2039256 - RNA, 21 nt, Homo sapiens
cuuugggauugcuaugaauga

SEQ ID NO: 2039257 - RNA, 16 nt, Homo sapiens
gcuccaggcuccaggc

SEQ ID NO: 2039258 - RNA, 15 nt, Homo sapiens
cagacaaauguaaca

SEQ ID NO: 2039259 - RNA, 20 nt, Homo sapiens
ugucaucccucccaaugcca

SEQ ID NO: 2039260 - RNA, 14 nt, Homo sapiens
ggcgggaaugagcu

SEQ ID NO: 2039261 - RNA, 16 nt, Homo sapiens
ugugaagugauugaca

SEQ ID NO: 2039262 - RNA, 15 nt, Homo sapiens
ucuucacucuucacu

SEQ ID NO: 2039263 - RNA, 16 nt, Homo sapiens
uauuagaugcucugag

SEQ ID NO: 2039264 - RNA, 19 nt, Homo sapiens
uggagaugaggugcucaau

SEQ ID NO: 2039265 - RNA, 13 nt, Homo sapiens
guuucuauacugu

SEQ ID NO: 2039266 - RNA, 20 nt, Homo sapiens
acagggcgagacucugucuc

SEQ ID NO: 2039267 - RNA, 19 nt, Homo sapiens
uaugugaauugagcacaua

SEQ ID NO: 2039268 - RNA, 15 nt, Homo sapiens
auuaugaacauccaa

SEQ ID NO: 2039269 - RNA, 19 nt, Homo sapiens
uccccuguccugauggcac

SEQ ID NO: 2039270 - RNA, 19 nt, Homo sapiens
aaguaggugugacuugaac

SEQ ID NO: 2039271 - RNA, 18 nt, Homo sapiens
cuugaaaguuuuccagua

SEQ ID NO: 2039272 - RNA, 15 nt, Homo sapiens
cugaaaagggaauca

SEQ ID NO: 2039273 - RNA, 15 nt, Homo sapiens
cccugauguggcaua

SEQ ID NO: 2039274 - RNA, 14 nt, Homo sapiens
uuucugauucugau

SEQ ID NO: 2039275 - RNA, 21 nt, Homo sapiens
cauauauauuaauacugguau

SEQ ID NO: 2039276 - RNA, 15 nt, Homo sapiens
accacugacccaaau

SEQ ID NO: 2039277 - RNA, 16 nt, Homo sapiens
ggccacagccugggug

SEQ ID NO: 2039278 - RNA, 13 nt, Homo sapiens
gggcugcagauuu

SEQ ID NO: 2039279 - RNA, 13 nt, Homo sapiens
augguggccucaa

SEQ ID NO: 2039280 - RNA, 13 nt, Homo sapiens
cucccacucccau

SEQ ID NO: 2039281 - RNA, 16 nt, Homo sapiens
agcccauuucuuuauu

SEQ ID NO: 2039282 - RNA, 16 nt, Homo sapiens
ugucucaaaccuccaa

SEQ ID NO: 2039283 - RNA, 19 nt, Homo sapiens
aagcaauucuccugccuua

SEQ ID NO: 2039284 - RNA, 16 nt, Homo sapiens
uuuguuggcucagaaa

SEQ ID NO: 2039285 - RNA, 21 nt, Homo sapiens
ucuugcucuaaugaucaaaac

SEQ ID NO: 2039286 - RNA, 19 nt, Homo sapiens
acugaugaaggcaugccua

SEQ ID NO: 2039287 - RNA, 15 nt, Homo sapiens
gaccccuuucacuua

SEQ ID NO: 2039288 - RNA, 13 nt, Homo sapiens
gagcauucugcuc

SEQ ID NO: 2039289 - RNA, 23 nt, Homo sapiens
uuacacgucauugaaacuacacu

SEQ ID NO: 2039290 - RNA, 17 nt, Homo sapiens
gaaauaaacagguaaua

SEQ ID NO: 2039291 - RNA, 14 nt, Homo sapiens
acauucccaugaau

SEQ ID NO: 2039292 - RNA, 12 nt, Homo sapiens
caugaugacucu

SEQ ID NO: 2039293 - RNA, 14 nt, Homo sapiens
aguagugcuaucuc

SEQ ID NO: 2039294 - RNA, 17 nt, Homo sapiens
cacagaucuguaauuca

SEQ ID NO: 2039295 - RNA, 17 nt, Homo sapiens
cauuugcuugcaaucua

SEQ ID NO: 2039296 - RNA, 23 nt, Homo sapiens
ggaacugcguuaugaagagcuaa

SEQ ID NO: 2039297 - RNA, 22 nt, Homo sapiens
acauuucaucuggguggucuga

SEQ ID NO: 2039298 - RNA, 22 nt, Homo sapiens
accucuggggaccccaaccuca

SEQ ID NO: 2039299 - RNA, 13 nt, Homo sapiens
gccagggaaacca

SEQ ID NO: 2039300 - RNA, 23 nt, Homo sapiens
guauuccuagaaacugacacaug

SEQ ID NO: 2039301 - RNA, 22 nt, Homo sapiens
uaccauuuaauggggaggacaa

SEQ ID NO: 2039302 - RNA, 15 nt, Homo sapiens
gauuuugaacauacu

SEQ ID NO: 2039303 - RNA, 17 nt, Homo sapiens
augaccuuguugcauga

SEQ ID NO: 2039304 - RNA, 14 nt, Homo sapiens
agaugaaugcaaua

SEQ ID NO: 2039305 - RNA, 22 nt, Homo sapiens
uuaugaggcaaccugauuguaa

SEQ ID NO: 2039306 - RNA, 16 nt, Homo sapiens
uaaagccaagcacuuu

SEQ ID NO: 2039307 - RNA, 13 nt, Homo sapiens
ugacuaacgccau

SEQ ID NO: 2039308 - RNA, 10 nt, Homo sapiens
cccacuuccc

SEQ ID NO: 2039309 - RNA, 17 nt, Homo sapiens
ggaaauccccuuaugac

SEQ ID NO: 2039310 - RNA, 14 nt, Homo sapiens
uagcaagugcuauu

SEQ ID NO: 2039311 - RNA, 18 nt, Homo sapiens
ucuggagguacgaaaaga

SEQ ID NO: 2039312 - RNA, 21 nt, Homo sapiens
ggcaucuccugugcaugggug

SEQ ID NO: 2039313 - RNA, 22 nt, Homo sapiens
uagugcugaugccuguguacug

SEQ ID NO: 2039314 - RNA, 15 nt, Homo sapiens
gcaucuggaagauca

SEQ ID NO: 2039315 - RNA, 13 nt, Homo sapiens
uuagucauugcag

SEQ ID NO: 2039316 - RNA, 16 nt, Homo sapiens
cacgugugugugugau

SEQ ID NO: 2039317 - RNA, 21 nt, Homo sapiens
aaaaccugggcaccuaagcaa

SEQ ID NO: 2039318 - RNA, 16 nt, Homo sapiens
gacuuugccacaucca

SEQ ID NO: 2039319 - RNA, 17 nt, Homo sapiens
guagauacaaucagcug

SEQ ID NO: 2039320 - RNA, 19 nt, Homo sapiens
ccugucuggcucaggguca

SEQ ID NO: 2039321 - RNA, 18 nt, Homo sapiens
ccaugaccuuacauuucc

SEQ ID NO: 2039322 - RNA, 13 nt, Homo sapiens
ccucugcucugag

SEQ ID NO: 2039323 - RNA, 14 nt, Homo sapiens
uuacucugagcuca

SEQ ID NO: 2039324 - RNA, 14 nt, Homo sapiens
ccaucccauuggca

SEQ ID NO: 2039325 - RNA, 12 nt, Homo sapiens
ucagagcuaaac

SEQ ID NO: 2039326 - RNA, 21 nt, Homo sapiens
aaaaccucaagggcuuuccca

SEQ ID NO: 2039327 - RNA, 22 nt, Homo sapiens
uauaaagaagaacuugcaugga

SEQ ID NO: 2039328 - RNA, 18 nt, Homo sapiens
agcccugauugcgcaaaa

SEQ ID NO: 2039329 - RNA, 14 nt, Homo sapiens
uucagcucugcaag

SEQ ID NO: 2039330 - RNA, 22 nt, Homo sapiens
ugcucaaccccccucccagaca

SEQ ID NO: 2039331 - RNA, 17 nt, Homo sapiens
acuugcuaaagcacuuu

SEQ ID NO: 2039332 - RNA, 15 nt, Homo sapiens
aggccaccagcugcu

SEQ ID NO: 2039333 - RNA, 17 nt, Homo sapiens
acuauaaugugaugauu

SEQ ID NO: 2039334 - RNA, 13 nt, Homo sapiens
ugggggccugaga

SEQ ID NO: 2039335 - RNA, 20 nt, Homo sapiens
ucuuuaauacuucacacaga

SEQ ID NO: 2039336 - RNA, 14 nt, Homo sapiens
ggccuguccuccaa

SEQ ID NO: 2039337 - RNA, 18 nt, Homo sapiens
caggguucaucugaagau

SEQ ID NO: 2039338 - RNA, 15 nt, Homo sapiens
ccauggcagcagcca

SEQ ID NO: 2039339 - RNA, 14 nt, Homo sapiens
cugcccaccuguca

SEQ ID NO: 2039340 - RNA, 14 nt, Homo sapiens
auacacacauauaa

SEQ ID NO: 2039341 - RNA, 21 nt, Homo sapiens
uguguccauuucugcacacac

SEQ ID NO: 2039342 - RNA, 15 nt, Homo sapiens
cucuuagaagccaug

SEQ ID NO: 2039343 - RNA, 17 nt, Homo sapiens
ccuuuggcccugaacca

SEQ ID NO: 2039344 - RNA, 14 nt, Homo sapiens
uaaaaaaacacaua

SEQ ID NO: 2039345 - RNA, 19 nt, Homo sapiens
ccugucauccuuggucuuu

SEQ ID NO: 2039346 - RNA, 16 nt, Homo sapiens
accaauccaacaucca

SEQ ID NO: 2039347 - RNA, 23 nt, Homo sapiens
cucaucuacugaaugaccucucu

SEQ ID NO: 2039348 - RNA, 19 nt, Homo sapiens
cuggcccgcaauacuguag

SEQ ID NO: 2039349 - RNA, 13 nt, Homo sapiens
uagaaaguagcca

SEQ ID NO: 2039350 - RNA, 19 nt, Homo sapiens
ugugcacaagucuuuccag

SEQ ID NO: 2039351 - RNA, 21 nt, Homo sapiens
gaugccacuucucacucacca

SEQ ID NO: 2039352 - RNA, 13 nt, Homo sapiens
gucuguaccucaa

SEQ ID NO: 2039353 - RNA, 20 nt, Homo sapiens
cuugucccuuucccuaccuu

SEQ ID NO: 2039354 - RNA, 21 nt, Homo sapiens
agugaauugacccauguuccc

SEQ ID NO: 2039355 - RNA, 23 nt, Homo sapiens
gaaaaccaacaccaucacagcuu

SEQ ID NO: 2039356 - RNA, 21 nt, Homo sapiens
aacuccuauuccuugcuuaga

SEQ ID NO: 2039357 - RNA, 13 nt, Homo sapiens
acuuaacauugca

SEQ ID NO: 2039358 - RNA, 21 nt, Homo sapiens
uagacgucucacucaaagaca

SEQ ID NO: 2039359 - RNA, 22 nt, Homo sapiens
cugguggcacaggaguguccuc

SEQ ID NO: 2039360 - RNA, 21 nt, Homo sapiens
gaaauuucaaaguauguuuca

SEQ ID NO: 2039361 - RNA, 21 nt, Homo sapiens
aaagccucauuuguguggaaa

SEQ ID NO: 2039362 - RNA, 23 nt, Homo sapiens
cuuuuuaauggaaaccaagccaa

SEQ ID NO: 2039363 - RNA, 17 nt, Homo sapiens
uggcacuguuugccauu

SEQ ID NO: 2039364 - RNA, 21 nt, Homo sapiens
agaaauaaucccuguaauauu

SEQ ID NO: 2039365 - RNA, 22 nt, Homo sapiens
uuagucauugauagaacuacuu

SEQ ID NO: 2039366 - RNA, 14 nt, Homo sapiens
auggccaacuuucu

SEQ ID NO: 2039367 - RNA, 23 nt, Homo sapiens
cauuuauugccucuaugugcaac

SEQ ID NO: 2039368 - RNA, 14 nt, Homo sapiens
gagacagggagaaa

SEQ ID NO: 2039369 - RNA, 14 nt, Homo sapiens
cuucaaggcuucca

SEQ ID NO: 2039370 - RNA, 19 nt, Homo sapiens
uguaaggaauuaucaauua

SEQ ID NO: 2039371 - RNA, 14 nt, Homo sapiens
ggccauggggcccu

SEQ ID NO: 2039372 - RNA, 19 nt, Homo sapiens
uggacgcucugcaccaacc

SEQ ID NO: 2039373 - RNA, 20 nt, Homo sapiens
ucacuagaagaaaagcccau

SEQ ID NO: 2039374 - RNA, 15 nt, Homo sapiens
ugcgcuguguacaau

SEQ ID NO: 2039375 - RNA, 22 nt, Homo sapiens
auuuuucagcacuuaacuacuu

SEQ ID NO: 2039376 - RNA, 17 nt, Homo sapiens
aucccacccacauguga

SEQ ID NO: 2039377 - RNA, 18 nt, Homo sapiens
uucauacauuaucucacu

SEQ ID NO: 2039378 - RNA, 14 nt, Homo sapiens
ggaaaugaaccaca

SEQ ID NO: 2039379 - RNA, 16 nt, Homo sapiens
auauguaaaauuacac

SEQ ID NO: 2039380 - RNA, 16 nt, Homo sapiens
uggauccugggucaaa

SEQ ID NO: 2039381 - RNA, 20 nt, Homo sapiens
uuguuucuuuugcuuaggaa

SEQ ID NO: 2039382 - RNA, 20 nt, Homo sapiens
gccuuuccaagucacuagaa

SEQ ID NO: 2039383 - RNA, 22 nt, Homo sapiens
gacucaucuugggaagggccau

SEQ ID NO: 2039384 - RNA, 22 nt, Homo sapiens
uuugcuugaagcaaacaguuga

SEQ ID NO: 2039385 - RNA, 18 nt, Homo sapiens
uccaccagagcaggggcu

SEQ ID NO: 2039386 - RNA, 16 nt, Homo sapiens
uuccuucccagcacau

SEQ ID NO: 2039387 - RNA, 23 nt, Homo sapiens
gccgcacuggggcagaugucucc

SEQ ID NO: 2039388 - RNA, 22 nt, Homo sapiens
cccugucccuucgaguccagga

SEQ ID NO: 2039389 - RNA, 16 nt, Homo sapiens
aaccagaucauuguga

SEQ ID NO: 2039390 - RNA, 12 nt, Homo sapiens
ggaauaaagcuu

SEQ ID NO: 2039391 - RNA, 17 nt, Homo sapiens
auaguuaaucuauaacu

SEQ ID NO: 2039392 - RNA, 22 nt, Homo sapiens
ccccacuggggaaauaacagcu

SEQ ID NO: 2039393 - RNA, 20 nt, Homo sapiens
aauguacaauaaagcaaugu

SEQ ID NO: 2039394 - RNA, 19 nt, Homo sapiens
cuccaccagccugcugaca

SEQ ID NO: 2039395 - RNA, 16 nt, Homo sapiens
acagacgugaaagcca

SEQ ID NO: 2039396 - RNA, 18 nt, Homo sapiens
aacgaaacuccaucucaa

SEQ ID NO: 2039397 - RNA, 18 nt, Homo sapiens
ucucuaaagaaaaucucu

SEQ ID NO: 2039398 - RNA, 14 nt, Homo sapiens
gacuagugagcaag

SEQ ID NO: 2039399 - RNA, 20 nt, Homo sapiens
ccuuugcucugaggucccuu

SEQ ID NO: 2039400 - RNA, 21 nt, Homo sapiens
uuacaguauauguugcaaaau

SEQ ID NO: 2039401 - RNA, 15 nt, Homo sapiens
ccaccaaaacugcuc

SEQ ID NO: 2039402 - RNA, 18 nt, Homo sapiens
gcccccaucugacaagaa

SEQ ID NO: 2039403 - RNA, 15 nt, Homo sapiens
cuugacagagucugu

SEQ ID NO: 2039404 - RNA, 14 nt, Homo sapiens
cauuguacuugaag

SEQ ID NO: 2039405 - RNA, 15 nt, Homo sapiens
cuggucaguuuucac

SEQ ID NO: 2039406 - RNA, 14 nt, Homo sapiens
ccgugccaaaagac

SEQ ID NO: 2039407 - RNA, 12 nt, Homo sapiens
aaggauagggaa

SEQ ID NO: 2039408 - RNA, 14 nt, Homo sapiens
uauuaaauguugcu

SEQ ID NO: 2039409 - RNA, 19 nt, Homo sapiens
caagaauguuucuuuauag

SEQ ID NO: 2039410 - RNA, 20 nt, Homo sapiens
ugaauauggugucuauuaua

SEQ ID NO: 2039411 - RNA, 16 nt, Homo sapiens
cagcuucauguuccca

SEQ ID NO: 2039412 - RNA, 17 nt, Homo sapiens
uccagaacucaaaugag

SEQ ID NO: 2039413 - RNA, 20 nt, Homo sapiens
gaaauuuacugugagacugu

SEQ ID NO: 2039414 - RNA, 13 nt, Homo sapiens
cugcagcugugag

SEQ ID NO: 2039415 - RNA, 13 nt, Homo sapiens
cagaggcugagca

SEQ ID NO: 2039416 - RNA, 19 nt, Homo sapiens
uggugacucacaccuguaa

SEQ ID NO: 2039417 - RNA, 18 nt, Homo sapiens
aguucuaacaaaacaagu

SEQ ID NO: 2039418 - RNA, 14 nt, Homo sapiens
aacauuaguacuuu

SEQ ID NO: 2039419 - RNA, 17 nt, Homo sapiens
aacuacuucuuacuucu

SEQ ID NO: 2039420 - RNA, 18 nt, Homo sapiens
ccugggucucugggcaca

SEQ ID NO: 2039421 - RNA, 19 nt, Homo sapiens
agcuggcggaucuagugac

SEQ ID NO: 2039422 - RNA, 22 nt, Homo sapiens
cauacuuccguccauccauuca

SEQ ID NO: 2039423 - RNA, 17 nt, Homo sapiens
gcgccuggcacauuuca

SEQ ID NO: 2039424 - RNA, 22 nt, Homo sapiens
agcagagaguccaauuuauuga

SEQ ID NO: 2039425 - RNA, 22 nt, Homo sapiens
aggugugcaaaguccguguccu

SEQ ID NO: 2039426 - RNA, 15 nt, Homo sapiens
uuuuagccacucaaa

SEQ ID NO: 2039427 - RNA, 16 nt, Homo sapiens
aguauuaucacugcug

SEQ ID NO: 2039428 - RNA, 21 nt, Homo sapiens
aacauucuccaguaagcaggu

SEQ ID NO: 2039429 - RNA, 15 nt, Homo sapiens
uuagucacuaagacu

SEQ ID NO: 2039430 - RNA, 15 nt, Homo sapiens
uuccucacuaccacu

SEQ ID NO: 2039431 - RNA, 15 nt, Homo sapiens
cacagucuuggguuu

SEQ ID NO: 2039432 - RNA, 21 nt, Homo sapiens
acuuuuaaaaugaagcuuugg

SEQ ID NO: 2039433 - RNA, 15 nt, Homo sapiens
uuaauauguuauuau

SEQ ID NO: 2039434 - RNA, 18 nt, Homo sapiens
acucucaagugucuuagg

SEQ ID NO: 2039435 - RNA, 21 nt, Homo sapiens
cagcauuuccucagucucccu

SEQ ID NO: 2039436 - RNA, 20 nt, Homo sapiens
aauuguuagauggcaauagu

SEQ ID NO: 2039437 - RNA, 20 nt, Homo sapiens
gcccauuuuucuagacuguc

SEQ ID NO: 2039438 - RNA, 18 nt, Homo sapiens
gcucacagauugagguaa

SEQ ID NO: 2039439 - RNA, 12 nt, Homo sapiens
agaaaaccagcg

SEQ ID NO: 2039440 - RNA, 13 nt, Homo sapiens
agaauagucucac

SEQ ID NO: 2039441 - RNA, 14 nt, Homo sapiens
cucuguugaaggcu

SEQ ID NO: 2039442 - RNA, 23 nt, Homo sapiens
guuccauuuuuccucuguucaca

SEQ ID NO: 2039443 - RNA, 19 nt, Homo sapiens
uauucccucuuguccuuua

SEQ ID NO: 2039444 - RNA, 22 nt, Homo sapiens
cauugugcuugguagauuuagu

SEQ ID NO: 2039445 - RNA, 20 nt, Homo sapiens
auacccagugucuaccuuca

SEQ ID NO: 2039446 - RNA, 14 nt, Homo sapiens
cuuuaaugaacuaa

SEQ ID NO: 2039447 - RNA, 14 nt, Homo sapiens
auuuaaugcacuaa

SEQ ID NO: 2039448 - RNA, 20 nt, Homo sapiens
cacuuugcuuaagaugcuaa

SEQ ID NO: 2039449 - RNA, 16 nt, Homo sapiens
guauuaacaugcaaua

SEQ ID NO: 2039450 - RNA, 18 nt, Homo sapiens
cacuaaauccuuuccaau

SEQ ID NO: 2039451 - RNA, 15 nt, Homo sapiens
uagaagaagcccaua

SEQ ID NO: 2039452 - RNA, 23 nt, Homo sapiens
aagacaaauuagccauuucacuc

SEQ ID NO: 2039453 - RNA, 22 nt, Homo sapiens
accuaaaagacagcagggacaa

SEQ ID NO: 2039454 - RNA, 15 nt, Homo sapiens
aacuuaggggacuga

SEQ ID NO: 2039455 - RNA, 17 nt, Homo sapiens
uaggaaaauauaugaag

SEQ ID NO: 2039456 - RNA, 17 nt, Homo sapiens
cagcgaaaggauguaaa

SEQ ID NO: 2039457 - RNA, 16 nt, Homo sapiens
cuaaaauuuaaugcau

SEQ ID NO: 2039458 - RNA, 14 nt, Homo sapiens
cucuagauugagag

SEQ ID NO: 2039459 - RNA, 18 nt, Homo sapiens
acuggacugugugcaacg

SEQ ID NO: 2039460 - RNA, 23 nt, Homo sapiens
uugcccaggcuggucuugaacuc

SEQ ID NO: 2039461 - RNA, 12 nt, Homo sapiens
gacuuauguaau

SEQ ID NO: 2039462 - RNA, 21 nt, Homo sapiens
auuacaguccaaaauacuguu

SEQ ID NO: 2039463 - RNA, 22 nt, Homo sapiens
uguguaucagauguuucacuga

SEQ ID NO: 2039464 - RNA, 16 nt, Homo sapiens
caagaugaaugcagau

SEQ ID NO: 2039465 - RNA, 21 nt, Homo sapiens
ggcagugagaaggcaaccaaa

SEQ ID NO: 2039466 - RNA, 18 nt, Homo sapiens
ugcaauuuuucaagagcu

SEQ ID NO: 2039467 - RNA, 21 nt, Homo sapiens
cauguaaaagccuaggucuau

SEQ ID NO: 2039468 - RNA, 19 nt, Homo sapiens
ucaaugaaauggauuggua

SEQ ID NO: 2039469 - RNA, 20 nt, Homo sapiens
aguuggagaagccguggccu

SEQ ID NO: 2039470 - RNA, 20 nt, Homo sapiens
agaaauaauaugcauuguca

SEQ ID NO: 2039471 - RNA, 20 nt, Homo sapiens
cuuuucccguaugcuuucuu

SEQ ID NO: 2039472 - RNA, 23 nt, Homo sapiens
cuggaggcccaguucacccugau

SEQ ID NO: 2039473 - RNA, 16 nt, Homo sapiens
ccagcccacguucucu

SEQ ID NO: 2039474 - RNA, 23 nt, Homo sapiens
cgcuaguuaggaaguuaccugga

SEQ ID NO: 2039475 - RNA, 16 nt, Homo sapiens
ugcauuuccuguguuu

SEQ ID NO: 2039476 - RNA, 18 nt, Homo sapiens
agacuugcggccacagca

SEQ ID NO: 2039477 - RNA, 14 nt, Homo sapiens
aacauguacuacag

SEQ ID NO: 2039478 - RNA, 20 nt, Homo sapiens
ugugcaccccuccccauuca

SEQ ID NO: 2039479 - RNA, 17 nt, Homo sapiens
uaacugauuucuauggc

SEQ ID NO: 2039480 - RNA, 19 nt, Homo sapiens
ucccuucuuccauccuuag

SEQ ID NO: 2039481 - RNA, 19 nt, Homo sapiens
gugcauuuuuaaacuugaa

SEQ ID NO: 2039482 - RNA, 23 nt, Homo sapiens
ccuguaccacaaacacauuacau

SEQ ID NO: 2039483 - RNA, 22 nt, Homo sapiens
acucauccuuuuuaaaugagac

SEQ ID NO: 2039484 - RNA, 19 nt, Homo sapiens
uuucucaagggccaugugg

SEQ ID NO: 2039485 - RNA, 19 nt, Homo sapiens
ucuacacaguaaaaacuug

SEQ ID NO: 2039486 - RNA, 12 nt, Homo sapiens
acgaaggugagg

SEQ ID NO: 2039487 - RNA, 23 nt, Homo sapiens
agagucuucuccaauguccaaaa

SEQ ID NO: 2039488 - RNA, 13 nt, Homo sapiens
cuugggacaaauc

SEQ ID NO: 2039489 - RNA, 23 nt, Homo sapiens
gcugaggcgccacccuucuucag

SEQ ID NO: 2039490 - RNA, 14 nt, Homo sapiens
gagcagugauucuc

SEQ ID NO: 2039491 - RNA, 15 nt, Homo sapiens
uaaaagaguuaacau

SEQ ID NO: 2039492 - RNA, 15 nt, Homo sapiens
gcuccccgggggcca

SEQ ID NO: 2039493 - RNA, 17 nt, Homo sapiens
auagguauauauaugcc

SEQ ID NO: 2039494 - RNA, 19 nt, Homo sapiens
caugugcaaaugugcuggu

SEQ ID NO: 2039495 - RNA, 13 nt, Homo sapiens
caaauguaaaaua

SEQ ID NO: 2039496 - RNA, 19 nt, Homo sapiens
agauuccaccuagagcuag

SEQ ID NO: 2039497 - RNA, 14 nt, Homo sapiens
aacacauggcacuu

SEQ ID NO: 2039498 - RNA, 22 nt, Homo sapiens
caaggaauuucccuguguggau

SEQ ID NO: 2039499 - RNA, 23 nt, Homo sapiens
aaagucaggaguccaagaccaga

SEQ ID NO: 2039500 - RNA, 12 nt, Homo sapiens
gggacuugcaaa

SEQ ID NO: 2039501 - RNA, 22 nt, Homo sapiens
augaauagaaaaaaaacaaacc

SEQ ID NO: 2039502 - RNA, 21 nt, Homo sapiens
accuggagagcuagaaccuag

SEQ ID NO: 2039503 - RNA, 19 nt, Homo sapiens
aacacacgggaagucuggu

SEQ ID NO: 2039504 - RNA, 19 nt, Homo sapiens
auuuucacacguaagcaca

SEQ ID NO: 2039505 - RNA, 16 nt, Homo sapiens
cugccaggcaccaucu

SEQ ID NO: 2039506 - RNA, 21 nt, Homo sapiens
gcauauuuauugcauugcugg

SEQ ID NO: 2039507 - RNA, 23 nt, Homo sapiens
cucacaacuuggguucuucucag

SEQ ID NO: 2039508 - RNA, 17 nt, Homo sapiens
ccaauaaaaugccucaa

SEQ ID NO: 2039509 - RNA, 12 nt, Homo sapiens
ggccuccaggac

SEQ ID NO: 2039510 - RNA, 16 nt, Homo sapiens
uaauauugagaaucag

SEQ ID NO: 2039511 - RNA, 16 nt, Homo sapiens
gugcucuucuguucuc

SEQ ID NO: 2039512 - RNA, 14 nt, Homo sapiens
uuucugcagggaug

SEQ ID NO: 2039513 - RNA, 15 nt, Homo sapiens
aguggcagcucagcc

SEQ ID NO: 2039514 - RNA, 18 nt, Homo sapiens
uucugcgcuguguacaau

SEQ ID NO: 2039515 - RNA, 18 nt, Homo sapiens
cuccucagggacucaggu

SEQ ID NO: 2039516 - RNA, 13 nt, Homo sapiens
uuacauagcucug

SEQ ID NO: 2039517 - RNA, 13 nt, Homo sapiens
gacugguuagaca

SEQ ID NO: 2039518 - RNA, 15 nt, Homo sapiens
guuucuuugcugcaa

SEQ ID NO: 2039519 - RNA, 19 nt, Homo sapiens
gccugcuguucgugacuca

SEQ ID NO: 2039520 - RNA, 18 nt, Homo sapiens
guuuaauauuuugaauau

SEQ ID NO: 2039521 - RNA, 17 nt, Homo sapiens
cauguuguaagcacuga

SEQ ID NO: 2039522 - RNA, 16 nt, Homo sapiens
cuuugauugaguucau

SEQ ID NO: 2039523 - RNA, 16 nt, Homo sapiens
gcagacccagucccac

SEQ ID NO: 2039524 - RNA, 20 nt, Homo sapiens
acacuuggaguuugcauucu

SEQ ID NO: 2039525 - RNA, 15 nt, Homo sapiens
ccugggugcugucau

SEQ ID NO: 2039526 - RNA, 21 nt, Homo sapiens
aauaugaguaauacaucaaag

SEQ ID NO: 2039527 - RNA, 16 nt, Homo sapiens
uuacaaggagggguua

SEQ ID NO: 2039528 - RNA, 14 nt, Homo sapiens
ucagauuccaccua

SEQ ID NO: 2039529 - RNA, 18 nt, Homo sapiens
gauccaaaauaaauggac

SEQ ID NO: 2039530 - RNA, 16 nt, Homo sapiens
cuacccccucaucccc

SEQ ID NO: 2039531 - RNA, 14 nt, Homo sapiens
acaaugacgugccu

SEQ ID NO: 2039532 - RNA, 14 nt, Homo sapiens
cuccgaggccagua

SEQ ID NO: 2039533 - RNA, 20 nt, Homo sapiens
gaccccagcacgugggucua

SEQ ID NO: 2039534 - RNA, 24 nt, Homo sapiens
gcacacuaagaaaugggacucuga

SEQ ID NO: 2039535 - RNA, 15 nt, Homo sapiens
accacugagccugag

SEQ ID NO: 2039536 - RNA, 13 nt, Homo sapiens
cugugccaguucu

SEQ ID NO: 2039537 - RNA, 20 nt, Homo sapiens
acuucagauugaaccauuca

SEQ ID NO: 2039538 - RNA, 21 nt, Homo sapiens
guuccuacacaggacaggggu

SEQ ID NO: 2039539 - RNA, 16 nt, Homo sapiens
gcuuaacaaugcaacu

SEQ ID NO: 2039540 - RNA, 14 nt, Homo sapiens
caagguaaaaaggu

SEQ ID NO: 2039541 - RNA, 14 nt, Homo sapiens
aauauaaacauaua

SEQ ID NO: 2039542 - RNA, 14 nt, Homo sapiens
aauuuuaacauuuu

SEQ ID NO: 2039543 - RNA, 14 nt, Homo sapiens
auauaaaacuauaa

SEQ ID NO: 2039544 - RNA, 19 nt, Homo sapiens
uuucuuggcguuccugcca

SEQ ID NO: 2039545 - RNA, 18 nt, Homo sapiens
aggaucacuugagcccag

SEQ ID NO: 2039546 - RNA, 20 nt, Homo sapiens
aaaauggaagcaaagacaaa

SEQ ID NO: 2039547 - RNA, 19 nt, Homo sapiens
ugcaagcagaaccuuggaa

SEQ ID NO: 2039548 - RNA, 16 nt, Homo sapiens
uaagagauaugcucau

SEQ ID NO: 2039549 - RNA, 16 nt, Homo sapiens
ccuaaaaugcuucacu

SEQ ID NO: 2039550 - RNA, 17 nt, Homo sapiens
uguguauuuaacugccu

SEQ ID NO: 2039551 - RNA, 15 nt, Homo sapiens
caaguguauuguaau

SEQ ID NO: 2039552 - RNA, 13 nt, Homo sapiens
agugcuuguguaa

SEQ ID NO: 2039553 - RNA, 19 nt, Homo sapiens
gguucauuuucagauucag

SEQ ID NO: 2039554 - RNA, 23 nt, Homo sapiens
ugccacccaccuuugccacaaag

SEQ ID NO: 2039555 - RNA, 13 nt, Homo sapiens
ggagcaggaccua

SEQ ID NO: 2039556 - RNA, 23 nt, Homo sapiens
cccucauuauuuauguccaggug

SEQ ID NO: 2039557 - RNA, 13 nt, Homo sapiens
aaauauuuugcua

SEQ ID NO: 2039558 - RNA, 16 nt, Homo sapiens
gcucuuuuauacugua

SEQ ID NO: 2039559 - RNA, 13 nt, Homo sapiens
uuacccacugcca

SEQ ID NO: 2039560 - RNA, 19 nt, Homo sapiens
uuuaucaaguguauuugaa

SEQ ID NO: 2039561 - RNA, 19 nt, Homo sapiens
uagauuuauuuuacauuua

SEQ ID NO: 2039562 - RNA, 21 nt, Homo sapiens
aguuggcauuuguuauccucu

SEQ ID NO: 2039563 - RNA, 21 nt, Homo sapiens
gugauacucacguuugcuuaa

SEQ ID NO: 2039564 - RNA, 21 nt, Homo sapiens
uagucucugaacuaggugauc

SEQ ID NO: 2039565 - RNA, 13 nt, Homo sapiens
ugauuuacaugcu

SEQ ID NO: 2039566 - RNA, 13 nt, Homo sapiens
agacauacuugua

SEQ ID NO: 2039567 - RNA, 19 nt, Homo sapiens
uuuuccugcuuucaggaaa

SEQ ID NO: 2039568 - RNA, 15 nt, Homo sapiens
cguauggaaugcuuc

SEQ ID NO: 2039569 - RNA, 23 nt, Homo sapiens
uguugcuauagagccuaccugua

SEQ ID NO: 2039570 - RNA, 20 nt, Homo sapiens
gcaugaccuuuuggccuuug

SEQ ID NO: 2039571 - RNA, 19 nt, Homo sapiens
ggccuuuggcuuggcgaga

SEQ ID NO: 2039572 - RNA, 16 nt, Homo sapiens
uauaucugcuguccag

SEQ ID NO: 2039573 - RNA, 18 nt, Homo sapiens
cauguuaguaauaccucu

SEQ ID NO: 2039574 - RNA, 13 nt, Homo sapiens
cucuaacaucucc

SEQ ID NO: 2039575 - RNA, 15 nt, Homo sapiens
aguaguaccuuucag

SEQ ID NO: 2039576 - RNA, 17 nt, Homo sapiens
caagucucgcuacauuu

SEQ ID NO: 2039577 - RNA, 17 nt, Homo sapiens
caaaucacucugcaaug

SEQ ID NO: 2039578 - RNA, 15 nt, Homo sapiens
uuaaugcuucauuca

SEQ ID NO: 2039579 - RNA, 21 nt, Homo sapiens
ccauccucccaaucucaauac

SEQ ID NO: 2039580 - RNA, 17 nt, Homo sapiens
uuugauuaaagacucca

SEQ ID NO: 2039581 - RNA, 21 nt, Homo sapiens
aaauugcugcaccaaugcacu

SEQ ID NO: 2039582 - RNA, 20 nt, Homo sapiens
ucaagugauacaacugaguc

SEQ ID NO: 2039583 - RNA, 17 nt, Homo sapiens
gucauucucauccaaaa

SEQ ID NO: 2039584 - RNA, 15 nt, Homo sapiens
cuacuagggaaaaau

SEQ ID NO: 2039585 - RNA, 13 nt, Homo sapiens
ucugcacugaaaa

SEQ ID NO: 2039586 - RNA, 14 nt, Homo sapiens
aauuuggugcuuau

SEQ ID NO: 2039587 - RNA, 15 nt, Homo sapiens
agccacgaacuugcu

SEQ ID NO: 2039588 - RNA, 23 nt, Homo sapiens
augacauaagucagcaaacugcg

SEQ ID NO: 2039589 - RNA, 21 nt, Homo sapiens
cuaaacaauuccuuacauuua

SEQ ID NO: 2039590 - RNA, 22 nt, Homo sapiens
aauuuauauagcaagugcuauu

SEQ ID NO: 2039591 - RNA, 21 nt, Homo sapiens
uacuccagcagguaggggcac

SEQ ID NO: 2039592 - RNA, 15 nt, Homo sapiens
ucacagugacacugg

SEQ ID NO: 2039593 - RNA, 12 nt, Homo sapiens
cuuguugugaca

SEQ ID NO: 2039594 - RNA, 14 nt, Homo sapiens
acaaaccauuaccu

SEQ ID NO: 2039595 - RNA, 12 nt, Homo sapiens
augcacugccug

SEQ ID NO: 2039596 - RNA, 13 nt, Homo sapiens
agguccugcuacc

SEQ ID NO: 2039597 - RNA, 19 nt, Homo sapiens
ucuuccaauuuccuuuaaa

SEQ ID NO: 2039598 - RNA, 12 nt, Homo sapiens
agggggugacug

SEQ ID NO: 2039599 - RNA, 17 nt, Homo sapiens
ugcuuuacuuugcccag

SEQ ID NO: 2039600 - RNA, 19 nt, Homo sapiens
aggaagucacagauucuuu

SEQ ID NO: 2039601 - RNA, 14 nt, Homo sapiens
cuuuucaagcugcu

SEQ ID NO: 2039602 - RNA, 16 nt, Homo sapiens
uugucuucccuucuuu

SEQ ID NO: 2039603 - RNA, 16 nt, Homo sapiens
aagacauccugagcag

SEQ ID NO: 2039604 - RNA, 17 nt, Homo sapiens
aaagugaauuguugaca

SEQ ID NO: 2039605 - RNA, 18 nt, Homo sapiens
gguaagaagaaagcaaaa

SEQ ID NO: 2039606 - RNA, 13 nt, Homo sapiens
aagcaugaagucu

SEQ ID NO: 2039607 - RNA, 19 nt, Homo sapiens
gcaauaggaugagguuucu

SEQ ID NO: 2039608 - RNA, 23 nt, Homo sapiens
acuaccuaugccacccugcaaua

SEQ ID NO: 2039609 - RNA, 18 nt, Homo sapiens
agguggguuaaacuguaa

SEQ ID NO: 2039610 - RNA, 15 nt, Homo sapiens
caccaaccuccagac

SEQ ID NO: 2039611 - RNA, 18 nt, Homo sapiens
gggcaacaaggugcacag

SEQ ID NO: 2039612 - RNA, 18 nt, Homo sapiens
cauuuuaacgcugccuaa

SEQ ID NO: 2039613 - RNA, 17 nt, Homo sapiens
gugcucaauacacagaa

SEQ ID NO: 2039614 - RNA, 23 nt, Homo sapiens
agcaaaugcuacauauaugcaau

SEQ ID NO: 2039615 - RNA, 14 nt, Homo sapiens
ucaacaacauguca

SEQ ID NO: 2039616 - RNA, 17 nt, Homo sapiens
uuaucaagcuaccagcu

SEQ ID NO: 2039617 - RNA, 10 nt, Homo sapiens
aaguggaaug

SEQ ID NO: 2039618 - RNA, 19 nt, Homo sapiens
ugguuauucuaagcccuuu

SEQ ID NO: 2039619 - RNA, 20 nt, Homo sapiens
cuguuaauguggacuggaac

SEQ ID NO: 2039620 - RNA, 20 nt, Homo sapiens
accugcgaacuuguguuuau

SEQ ID NO: 2039621 - RNA, 14 nt, Homo sapiens
accuaaaauuucaa

SEQ ID NO: 2039622 - RNA, 17 nt, Homo sapiens
auuguucaaagcacaga

SEQ ID NO: 2039623 - RNA, 23 nt, Homo sapiens
cgggguauucccacucaccagcc

SEQ ID NO: 2039624 - RNA, 21 nt, Homo sapiens
gcagcaaggaaagcucacgaa

SEQ ID NO: 2039625 - RNA, 20 nt, Homo sapiens
uugcaugaugucuaccucag

SEQ ID NO: 2039626 - RNA, 22 nt, Homo sapiens
accuggaggggcuagaaccuag

SEQ ID NO: 2039627 - RNA, 20 nt, Homo sapiens
gaggugggaggauugcuuga

SEQ ID NO: 2039628 - RNA, 21 nt, Homo sapiens
guggcaggccuaggaccucag

SEQ ID NO: 2039629 - RNA, 13 nt, Homo sapiens
gugucucuguaua

SEQ ID NO: 2039630 - RNA, 22 nt, Homo sapiens
augcauuauugacgaacuggcu

SEQ ID NO: 2039631 - RNA, 19 nt, Homo sapiens
uagcugagacuacagguga

SEQ ID NO: 2039632 - RNA, 15 nt, Homo sapiens
uguuacugucuucag

SEQ ID NO: 2039633 - RNA, 17 nt, Homo sapiens
agaaauuaaaucugaau

SEQ ID NO: 2039634 - RNA, 17 nt, Homo sapiens
gccaauauaacuaucuc

SEQ ID NO: 2039635 - RNA, 23 nt, Homo sapiens
uuucaagacauuaaaucuaugaa

SEQ ID NO: 2039636 - RNA, 18 nt, Homo sapiens
acuggucaccuugcacuc

SEQ ID NO: 2039637 - RNA, 23 nt, Homo sapiens
uggacuaaaugaucucugaaagu

SEQ ID NO: 2039638 - RNA, 14 nt, Homo sapiens
ugaguucuacauaa

SEQ ID NO: 2039639 - RNA, 20 nt, Homo sapiens
gaaaauuucuucgaucccaa

SEQ ID NO: 2039640 - RNA, 14 nt, Homo sapiens
cugugauaccuuag

SEQ ID NO: 2039641 - RNA, 14 nt, Homo sapiens
aggcaucaaucugg

SEQ ID NO: 2039642 - RNA, 15 nt, Homo sapiens
auagaaaaguauguu

SEQ ID NO: 2039643 - RNA, 19 nt, Homo sapiens
gccacauuuucuuaaucca

SEQ ID NO: 2039644 - RNA, 23 nt, Homo sapiens
uaagccaaagaaacaagcugugc

SEQ ID NO: 2039645 - RNA, 17 nt, Homo sapiens
uggccacggccacggcc

SEQ ID NO: 2039646 - RNA, 22 nt, Homo sapiens
ugcauauauguauauagacaug

SEQ ID NO: 2039647 - RNA, 16 nt, Homo sapiens
aucugaacacauacua

SEQ ID NO: 2039648 - RNA, 20 nt, Homo sapiens
cagaagguguguccuugaac

SEQ ID NO: 2039649 - RNA, 20 nt, Homo sapiens
uccaaccucccggggggacg

SEQ ID NO: 2039650 - RNA, 17 nt, Homo sapiens
ugauucaaaauguacua

SEQ ID NO: 2039651 - RNA, 14 nt, Homo sapiens
caaugugcacugaa

SEQ ID NO: 2039652 - RNA, 14 nt, Homo sapiens
uggcagaaagggaa

SEQ ID NO: 2039653 - RNA, 23 nt, Homo sapiens
ggcuucaggugacgauuuagcug

SEQ ID NO: 2039654 - RNA, 18 nt, Homo sapiens
acccuggauaagucacuu

SEQ ID NO: 2039655 - RNA, 22 nt, Homo sapiens
uguugucuacauuaaaucacuu

SEQ ID NO: 2039656 - RNA, 17 nt, Homo sapiens
aaaaauuuuuuuccuga

SEQ ID NO: 2039657 - RNA, 21 nt, Homo sapiens
ugaagggagguggggaugaga

SEQ ID NO: 2039658 - RNA, 21 nt, Homo sapiens
aauucuugaaagaauuuuccu

SEQ ID NO: 2039659 - RNA, 23 nt, Homo sapiens
uccaaaucccuuucaugucuuuc

SEQ ID NO: 2039660 - RNA, 22 nt, Homo sapiens
ucugggagggauguucuagccc

SEQ ID NO: 2039661 - RNA, 12 nt, Homo sapiens
gaaaaacuauua

SEQ ID NO: 2039662 - RNA, 22 nt, Homo sapiens
acacugaaaaaauacuaccuau

SEQ ID NO: 2039663 - RNA, 19 nt, Homo sapiens
ugugaauguaaaacagagc

SEQ ID NO: 2039664 - RNA, 12 nt, Homo sapiens
ucauauugagaa

SEQ ID NO: 2039665 - RNA, 21 nt, Homo sapiens
acucacacggacacucaaaag

SEQ ID NO: 2039666 - RNA, 17 nt, Homo sapiens
agcuucccacaccugcc

SEQ ID NO: 2039667 - RNA, 22 nt, Homo sapiens
ucucagcucacugcaagcucca

SEQ ID NO: 2039668 - RNA, 14 nt, Homo sapiens
uggggcaagaugag

SEQ ID NO: 2039669 - RNA, 14 nt, Homo sapiens
agcccagugcacug

SEQ ID NO: 2039670 - RNA, 22 nt, Homo sapiens
aagcucuggugacaccagccuu

SEQ ID NO: 2039671 - RNA, 16 nt, Homo sapiens
aauuaaauacuauuaa

SEQ ID NO: 2039672 - RNA, 23 nt, Homo sapiens
uagccaggguggucuugaucucc

SEQ ID NO: 2039673 - RNA, 17 nt, Homo sapiens
ccucuugcugccagcua

SEQ ID NO: 2039674 - RNA, 19 nt, Homo sapiens
agaugugaaaacaucucaa

SEQ ID NO: 2039675 - RNA, 14 nt, Homo sapiens
augaacgugccuga

SEQ ID NO: 2039676 - RNA, 14 nt, Homo sapiens
augaaagugccugc

SEQ ID NO: 2039677 - RNA, 12 nt, Homo sapiens
aggagguucugg

SEQ ID NO: 2039678 - RNA, 13 nt, Homo sapiens
cuucauaggcaga

SEQ ID NO: 2039679 - RNA, 15 nt, Homo sapiens
cuuuccagcuuagaa

SEQ ID NO: 2039680 - RNA, 18 nt, Homo sapiens
cugagcuuaaauaacaaa

SEQ ID NO: 2039681 - RNA, 15 nt, Homo sapiens
cacauagcucaauca

SEQ ID NO: 2039682 - RNA, 24 nt, Homo sapiens
gccacguaugguggcucaugucua

SEQ ID NO: 2039683 - RNA, 19 nt, Homo sapiens
gccucaagcuaugugagcu

SEQ ID NO: 2039684 - RNA, 17 nt, Homo sapiens
auaauauuuuauaccaa

SEQ ID NO: 2039685 - RNA, 19 nt, Homo sapiens
uaacacacccugcuucauu

SEQ ID NO: 2039686 - RNA, 18 nt, Homo sapiens
auaaaccagguuugcacc

SEQ ID NO: 2039687 - RNA, 16 nt, Homo sapiens
gugcauuuaugagcuc

SEQ ID NO: 2039688 - RNA, 22 nt, Homo sapiens
aaucuucacaauauccaaugaa

SEQ ID NO: 2039689 - RNA, 16 nt, Homo sapiens
aaccucuaacccaggu

SEQ ID NO: 2039690 - RNA, 20 nt, Homo sapiens
ugaaccugaggaugcaucuu

SEQ ID NO: 2039691 - RNA, 13 nt, Homo sapiens
gaagcaagccaga

SEQ ID NO: 2039692 - RNA, 15 nt, Homo sapiens
cugaguuugcuuuca

SEQ ID NO: 2039693 - RNA, 19 nt, Homo sapiens
uaauggaggugacggcacu

SEQ ID NO: 2039694 - RNA, 13 nt, Homo sapiens
caauaaagcugaa

SEQ ID NO: 2039695 - RNA, 16 nt, Homo sapiens
ugcagagggacagaug

SEQ ID NO: 2039696 - RNA, 12 nt, Homo sapiens
gugucuaccugg

SEQ ID NO: 2039697 - RNA, 14 nt, Homo sapiens
cugugaagcccuuu

SEQ ID NO: 2039698 - RNA, 14 nt, Homo sapiens
gcagaacagcauca

SEQ ID NO: 2039699 - RNA, 17 nt, Homo sapiens
gcuguuugcaauccaaa

SEQ ID NO: 2039700 - RNA, 16 nt, Homo sapiens
cugaaacuuaccugag

SEQ ID NO: 2039701 - RNA, 14 nt, Homo sapiens
accccaagcugccu

SEQ ID NO: 2039702 - RNA, 19 nt, Homo sapiens
gugucagagcugaaauuca

SEQ ID NO: 2039703 - RNA, 15 nt, Homo sapiens
uggcaguggcuguga

SEQ ID NO: 2039704 - RNA, 15 nt, Homo sapiens
cucagaaggcuucau

SEQ ID NO: 2039705 - RNA, 12 nt, Homo sapiens
ucacaccuguaa

SEQ ID NO: 2039706 - RNA, 18 nt, Homo sapiens
agccucagaggagcucua

SEQ ID NO: 2039707 - RNA, 20 nt, Homo sapiens
cuuuaaaaccauaucagaga

SEQ ID NO: 2039708 - RNA, 18 nt, Homo sapiens
gcagggggaaggcuugga

SEQ ID NO: 2039709 - RNA, 18 nt, Homo sapiens
caaauagccagugcuagu

SEQ ID NO: 2039710 - RNA, 13 nt, Homo sapiens
ucugcucccucug

SEQ ID NO: 2039711 - RNA, 20 nt, Homo sapiens
ucacagccaccccugagauc

SEQ ID NO: 2039712 - RNA, 19 nt, Homo sapiens
cuccugggcucaagugauc

SEQ ID NO: 2039713 - RNA, 21 nt, Homo sapiens
cuuguaguuccauguacugua

SEQ ID NO: 2039714 - RNA, 18 nt, Homo sapiens
aagucaguggcuuugcau

SEQ ID NO: 2039715 - RNA, 15 nt, Homo sapiens
uuuguuagcaaagau

SEQ ID NO: 2039716 - RNA, 17 nt, Homo sapiens
aaaguucuucauaucau

SEQ ID NO: 2039717 - RNA, 17 nt, Homo sapiens
uaauagcuacagugcau

SEQ ID NO: 2039718 - RNA, 16 nt, Homo sapiens
cuucagcacaggaauu

SEQ ID NO: 2039719 - RNA, 20 nt, Homo sapiens
cuggcugucaguaugacauu

SEQ ID NO: 2039720 - RNA, 16 nt, Homo sapiens
aauguuaaaugacgag

SEQ ID NO: 2039721 - RNA, 22 nt, Homo sapiens
uucucagucauuuuuaaccucu

SEQ ID NO: 2039722 - RNA, 14 nt, Homo sapiens
cuuuuccaaccuac

SEQ ID NO: 2039723 - RNA, 20 nt, Homo sapiens
cucugcuuaguacauuugau

SEQ ID NO: 2039724 - RNA, 16 nt, Homo sapiens
ccuugguuaucaaaua

SEQ ID NO: 2039725 - RNA, 13 nt, Homo sapiens
caaucguaaaauu

SEQ ID NO: 2039726 - RNA, 23 nt, Homo sapiens
aguuaggucauuacuaaccauag

SEQ ID NO: 2039727 - RNA, 17 nt, Homo sapiens
gauuacaggcauguguc

SEQ ID NO: 2039728 - RNA, 19 nt, Homo sapiens
ucuuaaggacaaagugcca

SEQ ID NO: 2039729 - RNA, 21 nt, Homo sapiens
caugcuggcuuuugugcccaa

SEQ ID NO: 2039730 - RNA, 17 nt, Homo sapiens
uguuuugggaucaggag

SEQ ID NO: 2039731 - RNA, 13 nt, Homo sapiens
aacggaagccagg

SEQ ID NO: 2039732 - RNA, 13 nt, Homo sapiens
acaaaaagcacaa

SEQ ID NO: 2039733 - RNA, 16 nt, Homo sapiens
acauuaaacucccuuu

SEQ ID NO: 2039734 - RNA, 21 nt, Homo sapiens
acaaagaagguuaccaagaag

SEQ ID NO: 2039735 - RNA, 21 nt, Homo sapiens
ugcaguucaccugcacuuaag

SEQ ID NO: 2039736 - RNA, 20 nt, Homo sapiens
aaaucugucauaagcauuac

SEQ ID NO: 2039737 - RNA, 23 nt, Homo sapiens
guguuacccaguaacucaucugu

SEQ ID NO: 2039738 - RNA, 13 nt, Homo sapiens
agaaaaauuaauu

SEQ ID NO: 2039739 - RNA, 23 nt, Homo sapiens
caccuggacacaacaccaaaaag

SEQ ID NO: 2039740 - RNA, 23 nt, Homo sapiens
caaguggguccaaguggcuguga

SEQ ID NO: 2039741 - RNA, 17 nt, Homo sapiens
acucucgcaucuuccca

SEQ ID NO: 2039742 - RNA, 19 nt, Homo sapiens
auucauaaagauucaccua

SEQ ID NO: 2039743 - RNA, 20 nt, Homo sapiens
aucucauggagaagcagaaa

SEQ ID NO: 2039744 - RNA, 18 nt, Homo sapiens
acccuccuuccacaugua

SEQ ID NO: 2039745 - RNA, 14 nt, Homo sapiens
agagcuuccacaag

SEQ ID NO: 2039746 - RNA, 23 nt, Homo sapiens
cagaugggcuguuucguguagug

SEQ ID NO: 2039747 - RNA, 21 nt, Homo sapiens
caaagcaaguuucaucaguca

SEQ ID NO: 2039748 - RNA, 15 nt, Homo sapiens
gucccagaguggcug

SEQ ID NO: 2039749 - RNA, 20 nt, Homo sapiens
uauaaauuuuuugaaacaca

SEQ ID NO: 2039750 - RNA, 20 nt, Homo sapiens
caccaauuccaccaagacag

SEQ ID NO: 2039751 - RNA, 20 nt, Homo sapiens
uguaguuugucccauuuauu

SEQ ID NO: 2039752 - RNA, 19 nt, Homo sapiens
uuucaaguaauaaaacaau

SEQ ID NO: 2039753 - RNA, 14 nt, Homo sapiens
aauuacacauguag

SEQ ID NO: 2039754 - RNA, 17 nt, Homo sapiens
auaauguccaacuaaaa

SEQ ID NO: 2039755 - RNA, 16 nt, Homo sapiens
aucucucaaaucuguu

SEQ ID NO: 2039756 - RNA, 15 nt, Homo sapiens
auaaaugaaugugcu

SEQ ID NO: 2039757 - RNA, 21 nt, Homo sapiens
acuauguaaacaaaaagggaa

SEQ ID NO: 2039758 - RNA, 17 nt, Homo sapiens
ccagacugucucaaaua

SEQ ID NO: 2039759 - RNA, 16 nt, Homo sapiens
accgggguucaagcca

SEQ ID NO: 2039760 - RNA, 20 nt, Homo sapiens
auguuagaugcuuaguguga

SEQ ID NO: 2039761 - RNA, 20 nt, Homo sapiens
aagauaaucauugcuuaugu

SEQ ID NO: 2039762 - RNA, 17 nt, Homo sapiens
ccaaauguccuuucuca

SEQ ID NO: 2039763 - RNA, 19 nt, Homo sapiens
ucaccaguuaaaagcauuu

SEQ ID NO: 2039764 - RNA, 13 nt, Homo sapiens
cuagugaaugugc

SEQ ID NO: 2039765 - RNA, 23 nt, Homo sapiens
cuucccaccccuacacacacacu

SEQ ID NO: 2039766 - RNA, 15 nt, Homo sapiens
aggagugaugggcaa

SEQ ID NO: 2039767 - RNA, 15 nt, Homo sapiens
cuccaguuugcauuu

SEQ ID NO: 2039768 - RNA, 22 nt, Homo sapiens
agcaacuugaacuucaccugca

SEQ ID NO: 2039769 - RNA, 23 nt, Homo sapiens
ccugauuagaugacucucagucc

SEQ ID NO: 2039770 - RNA, 14 nt, Homo sapiens
agaagagcuguuca

SEQ ID NO: 2039771 - RNA, 13 nt, Homo sapiens
uguucugauuaga

SEQ ID NO: 2039772 - RNA, 13 nt, Homo sapiens
cuagaaacaacac

SEQ ID NO: 2039773 - RNA, 14 nt, Homo sapiens
auuccaacuucaau

SEQ ID NO: 2039774 - RNA, 13 nt, Homo sapiens
aauggaaacagcc

SEQ ID NO: 2039775 - RNA, 19 nt, Homo sapiens
cuuuguacuuugugcaaaa

SEQ ID NO: 2039776 - RNA, 15 nt, Homo sapiens
uuccuguuacugaga

SEQ ID NO: 2039777 - RNA, 21 nt, Homo sapiens
cagaaucaagcuuuugcuuga

SEQ ID NO: 2039778 - RNA, 13 nt, Homo sapiens
auauggcugccca

SEQ ID NO: 2039779 - RNA, 18 nt, Homo sapiens
cucugcagcccacagagg

SEQ ID NO: 2039780 - RNA, 14 nt, Homo sapiens
caaaugcagcuuca

SEQ ID NO: 2039781 - RNA, 19 nt, Homo sapiens
cauaauauuucuuaaaaag

SEQ ID NO: 2039782 - RNA, 20 nt, Homo sapiens
cauuuuugccagucuguuaa

SEQ ID NO: 2039783 - RNA, 21 nt, Homo sapiens
ccagcagaggugauucuuaca

SEQ ID NO: 2039784 - RNA, 13 nt, Homo sapiens
ccuaauucaucuu

SEQ ID NO: 2039785 - RNA, 14 nt, Homo sapiens
agugaagacuggaa

SEQ ID NO: 2039786 - RNA, 18 nt, Homo sapiens
aacauugcauugugacua

SEQ ID NO: 2039787 - RNA, 14 nt, Homo sapiens
cuuuuuaaugcugu

SEQ ID NO: 2039788 - RNA, 13 nt, Homo sapiens
uuaaagaauucuc

SEQ ID NO: 2039789 - RNA, 14 nt, Homo sapiens
auuuguaacuuuag

SEQ ID NO: 2039790 - RNA, 20 nt, Homo sapiens
gacugguuagugaugcaguu

SEQ ID NO: 2039791 - RNA, 12 nt, Homo sapiens
ggaaaaugugac

SEQ ID NO: 2039792 - RNA, 16 nt, Homo sapiens
acguuuggccagugac

SEQ ID NO: 2039793 - RNA, 13 nt, Homo sapiens
agcucacguguau

SEQ ID NO: 2039794 - RNA, 13 nt, Homo sapiens
guuuucauaauac

SEQ ID NO: 2039795 - RNA, 22 nt, Homo sapiens
guccagccacuugacuggcaca

SEQ ID NO: 2039796 - RNA, 16 nt, Homo sapiens
ucuauuacgugcaaua

SEQ ID NO: 2039797 - RNA, 16 nt, Homo sapiens
cugugcuguccuuuaa

SEQ ID NO: 2039798 - RNA, 17 nt, Homo sapiens
uagcauuugccacuuag

SEQ ID NO: 2039799 - RNA, 17 nt, Homo sapiens
cuacccuuuucugggga

SEQ ID NO: 2039800 - RNA, 14 nt, Homo sapiens
ccaagugauaauuu

SEQ ID NO: 2039801 - RNA, 17 nt, Homo sapiens
gccuggaguugacugac

SEQ ID NO: 2039802 - RNA, 22 nt, Homo sapiens
aacuuucccuccaccagugugc

SEQ ID NO: 2039803 - RNA, 16 nt, Homo sapiens
ccuaugcccagggaau

SEQ ID NO: 2039804 - RNA, 15 nt, Homo sapiens
accaggagcugcuca

SEQ ID NO: 2039805 - RNA, 22 nt, Homo sapiens
uauagaaagucggcuguugaua

SEQ ID NO: 2039806 - RNA, 15 nt, Homo sapiens
ugauaaggaugauaa

SEQ ID NO: 2039807 - RNA, 23 nt, Homo sapiens
aaauucauacauaguacauacaa

SEQ ID NO: 2039808 - RNA, 17 nt, Homo sapiens
auaucauuugugaagaa

SEQ ID NO: 2039809 - RNA, 12 nt, Homo sapiens
caauagcuugaa

SEQ ID NO: 2039810 - RNA, 18 nt, Homo sapiens
gaaacacuaaauuaguuu

SEQ ID NO: 2039811 - RNA, 20 nt, Homo sapiens
acagauggauagucugucca

SEQ ID NO: 2039812 - RNA, 19 nt, Homo sapiens
agacuggcaagaaaagagu

SEQ ID NO: 2039813 - RNA, 18 nt, Homo sapiens
aacuauuuauaucacaca

SEQ ID NO: 2039814 - RNA, 16 nt, Homo sapiens
caagaaucagugcaaa

SEQ ID NO: 2039815 - RNA, 16 nt, Homo sapiens
uguuguagcagugauu

SEQ ID NO: 2039816 - RNA, 20 nt, Homo sapiens
ccuuauggacuuuaguauua

SEQ ID NO: 2039817 - RNA, 16 nt, Homo sapiens
caugguacuaguguuu

SEQ ID NO: 2039818 - RNA, 12 nt, Homo sapiens
uaacagcacaau

SEQ ID NO: 2039819 - RNA, 15 nt, Homo sapiens
uuauagaugcugcug

SEQ ID NO: 2039820 - RNA, 21 nt, Homo sapiens
cauaucuaugggaaaaaucua

SEQ ID NO: 2039821 - RNA, 16 nt, Homo sapiens
cuuugagggcugacaa

SEQ ID NO: 2039822 - RNA, 23 nt, Homo sapiens
caagguggucaacaacauuccuc

SEQ ID NO: 2039823 - RNA, 16 nt, Homo sapiens
aagcacgugcaaggac

SEQ ID NO: 2039824 - RNA, 12 nt, Homo sapiens
cucccagaucca

SEQ ID NO: 2039825 - RNA, 17 nt, Homo sapiens
gcucuuugucucaccag

SEQ ID NO: 2039826 - RNA, 23 nt, Homo sapiens
ucuguucagcuuuucagugaaug

SEQ ID NO: 2039827 - RNA, 18 nt, Homo sapiens
gauaggaauucacugaua

SEQ ID NO: 2039828 - RNA, 23 nt, Homo sapiens
aaaaauggauacuggugcaguca

SEQ ID NO: 2039829 - RNA, 21 nt, Homo sapiens
uucccacacugaaauucuaaa

SEQ ID NO: 2039830 - RNA, 14 nt, Homo sapiens
cccauccagugucu

SEQ ID NO: 2039831 - RNA, 18 nt, Homo sapiens
uguucucugcuugacaga

SEQ ID NO: 2039832 - RNA, 16 nt, Homo sapiens
aauacuuugcuucaua

SEQ ID NO: 2039833 - RNA, 17 nt, Homo sapiens
accaggacuugugcaga

SEQ ID NO: 2039834 - RNA, 12 nt, Homo sapiens
uguaaaauggag

SEQ ID NO: 2039835 - RNA, 22 nt, Homo sapiens
caugcagaaagggagcagagaa

SEQ ID NO: 2039836 - RNA, 23 nt, Homo sapiens
cagaccuuucuuugggacugugu

SEQ ID NO: 2039837 - RNA, 15 nt, Homo sapiens
gugugugugcaagug

SEQ ID NO: 2039838 - RNA, 19 nt, Homo sapiens
gaagaaauuccaggaaaau

SEQ ID NO: 2039839 - RNA, 15 nt, Homo sapiens
ccucuggauucccuu

SEQ ID NO: 2039840 - RNA, 20 nt, Homo sapiens
agacccuccuauucuauaaa

SEQ ID NO: 2039841 - RNA, 19 nt, Homo sapiens
ccacguucucacacccacc

SEQ ID NO: 2039842 - RNA, 20 nt, Homo sapiens
gcaaggcccgagcagcugag

SEQ ID NO: 2039843 - RNA, 15 nt, Homo sapiens
gguaaugugaauaaa

SEQ ID NO: 2039844 - RNA, 16 nt, Homo sapiens
aaauugugugugcaag

SEQ ID NO: 2039845 - RNA, 21 nt, Homo sapiens
uggugcuggaaccagcucucu

SEQ ID NO: 2039846 - RNA, 17 nt, Homo sapiens
ccccuccucacuggcca

SEQ ID NO: 2039847 - RNA, 19 nt, Homo sapiens
aaagcuuuuauugucacag

SEQ ID NO: 2039848 - RNA, 14 nt, Homo sapiens
uccgccagaccuca

SEQ ID NO: 2039849 - RNA, 16 nt, Homo sapiens
cggcacauuggcagug

SEQ ID NO: 2039850 - RNA, 14 nt, Homo sapiens
uuccauauauccuu

SEQ ID NO: 2039851 - RNA, 14 nt, Homo sapiens
auguucauuuguac

SEQ ID NO: 2039852 - RNA, 23 nt, Homo sapiens
caauaaaccagugaacaguguga

SEQ ID NO: 2039853 - RNA, 22 nt, Homo sapiens
ugaaacaaaaauugucuuuaug

SEQ ID NO: 2039854 - RNA, 20 nt, Homo sapiens
gaggugugcacaccaaagcu

SEQ ID NO: 2039855 - RNA, 17 nt, Homo sapiens
gccacaguagaacuguc

SEQ ID NO: 2039856 - RNA, 19 nt, Homo sapiens
auccccuugaggucucagc

SEQ ID NO: 2039857 - RNA, 21 nt, Homo sapiens
caaacaccacuuuacuugugu

SEQ ID NO: 2039858 - RNA, 14 nt, Homo sapiens
ccguggcugcaggg

SEQ ID NO: 2039859 - RNA, 14 nt, Homo sapiens
ugucccuguccuuc

SEQ ID NO: 2039860 - RNA, 14 nt, Homo sapiens
ucucuuugugcucu

SEQ ID NO: 2039861 - RNA, 20 nt, Homo sapiens
acuacuuugguuguguaugu

SEQ ID NO: 2039862 - RNA, 19 nt, Homo sapiens
gaugaaaaccuacauauuc

SEQ ID NO: 2039863 - RNA, 20 nt, Homo sapiens
aaauuuauggccguaucaaa

SEQ ID NO: 2039864 - RNA, 14 nt, Homo sapiens
aguuccauguuaaa

SEQ ID NO: 2039865 - RNA, 18 nt, Homo sapiens
agaagguugagggcaaug

SEQ ID NO: 2039866 - RNA, 19 nt, Homo sapiens
cucccggguucaagugauu

SEQ ID NO: 2039867 - RNA, 17 nt, Homo sapiens
uagagccugugugaaag

SEQ ID NO: 2039868 - RNA, 14 nt, Homo sapiens
uaaugauggauuua

SEQ ID NO: 2039869 - RNA, 14 nt, Homo sapiens
gcuuuuugucaugu

SEQ ID NO: 2039870 - RNA, 16 nt, Homo sapiens
uauuguuacuuccaau

SEQ ID NO: 2039871 - RNA, 21 nt, Homo sapiens
gcauugccugaaaaaacuggu

SEQ ID NO: 2039872 - RNA, 22 nt, Homo sapiens
uucuucccuucucucucucuca

SEQ ID NO: 2039873 - RNA, 14 nt, Homo sapiens
ggcacaagugcccg

SEQ ID NO: 2039874 - RNA, 15 nt, Homo sapiens
aaggaauaagcauuc

SEQ ID NO: 2039875 - RNA, 15 nt, Homo sapiens
aggggcuuggcugcc

SEQ ID NO: 2039876 - RNA, 13 nt, Homo sapiens
uuauacugcugua

SEQ ID NO: 2039877 - RNA, 14 nt, Homo sapiens
gaucuguccaccuc

SEQ ID NO: 2039878 - RNA, 14 nt, Homo sapiens
uuaucagugccaug

SEQ ID NO: 2039879 - RNA, 16 nt, Homo sapiens
ccagucccugaggcag

SEQ ID NO: 2039880 - RNA, 17 nt, Homo sapiens
gauuauuugcucagggg

SEQ ID NO: 2039881 - RNA, 15 nt, Homo sapiens
uguauuuuccaagua

SEQ ID NO: 2039882 - RNA, 15 nt, Homo sapiens
uacagggacugggca

SEQ ID NO: 2039883 - RNA, 21 nt, Homo sapiens
gcuccgagggcggccagggac

SEQ ID NO: 2039884 - RNA, 13 nt, Homo sapiens
uacugaaucuuca

SEQ ID NO: 2039885 - RNA, 23 nt, Homo sapiens
ugccauaaccacauuuaauggga

SEQ ID NO: 2039886 - RNA, 16 nt, Homo sapiens
cucacugccguccuca

SEQ ID NO: 2039887 - RNA, 21 nt, Homo sapiens
agugacucacuaauucauuaa

SEQ ID NO: 2039888 - RNA, 19 nt, Homo sapiens
uccaacaguuaaacuugca

SEQ ID NO: 2039889 - RNA, 15 nt, Homo sapiens
caaauuaaaaaagcu

SEQ ID NO: 2039890 - RNA, 13 nt, Homo sapiens
gaguaugucugau

SEQ ID NO: 2039891 - RNA, 13 nt, Homo sapiens
caaauuguguaua

SEQ ID NO: 2039892 - RNA, 19 nt, Homo sapiens
cugaucuaacaaaauaagg

SEQ ID NO: 2039893 - RNA, 16 nt, Homo sapiens
accccuaccucuagua

SEQ ID NO: 2039894 - RNA, 21 nt, Homo sapiens
ggugagauaauguucugggaa

SEQ ID NO: 2039895 - RNA, 16 nt, Homo sapiens
acugcaguucaucuca

SEQ ID NO: 2039896 - RNA, 14 nt, Homo sapiens
aacuauaacagugu

SEQ ID NO: 2039897 - RNA, 22 nt, Homo sapiens
acccuucccaaucagcacugaa

SEQ ID NO: 2039898 - RNA, 18 nt, Homo sapiens
ggaggguuucucucccaa

SEQ ID NO: 2039899 - RNA, 22 nt, Homo sapiens
auauuucagauaucagaaucau

SEQ ID NO: 2039900 - RNA, 15 nt, Homo sapiens
gaauucuauguuggc

SEQ ID NO: 2039901 - RNA, 23 nt, Homo sapiens
cauuucuuauaccuucugacagc

SEQ ID NO: 2039902 - RNA, 16 nt, Homo sapiens
uacaggagaagaaaca

SEQ ID NO: 2039903 - RNA, 20 nt, Homo sapiens
caaaguagaggaauccaugu

SEQ ID NO: 2039904 - RNA, 18 nt, Homo sapiens
ucccuauaucagggccug

SEQ ID NO: 2039905 - RNA, 15 nt, Homo sapiens
ugcacaucacaacau

SEQ ID NO: 2039906 - RNA, 17 nt, Homo sapiens
uaacaaagcacauaacu

SEQ ID NO: 2039907 - RNA, 15 nt, Homo sapiens
ugcaauaaugugcaa

SEQ ID NO: 2039908 - RNA, 19 nt, Homo sapiens
ugccuccugaugggacaua

SEQ ID NO: 2039909 - RNA, 20 nt, Homo sapiens
aagucacuggccaguggcug

SEQ ID NO: 2039910 - RNA, 13 nt, Homo sapiens
aacuguguugcca

SEQ ID NO: 2039911 - RNA, 15 nt, Homo sapiens
cuuaaauuuuaguuc

SEQ ID NO: 2039912 - RNA, 19 nt, Homo sapiens
guauaaccugucuauacua

SEQ ID NO: 2039913 - RNA, 19 nt, Homo sapiens
aaggaacaucccugagaaa

SEQ ID NO: 2039914 - RNA, 15 nt, Homo sapiens
uuaugauaaccaaga

SEQ ID NO: 2039915 - RNA, 13 nt, Homo sapiens
uuguuauuuacac

SEQ ID NO: 2039916 - RNA, 13 nt, Homo sapiens
cugacauucacuu

SEQ ID NO: 2039917 - RNA, 15 nt, Homo sapiens
aucagaaacaauuuc

SEQ ID NO: 2039918 - RNA, 13 nt, Homo sapiens
gguaaauguuucu

SEQ ID NO: 2039919 - RNA, 20 nt, Homo sapiens
auaauuuagaccccauacaa

SEQ ID NO: 2039920 - RNA, 18 nt, Homo sapiens
auggcaauuuagcucucu

SEQ ID NO: 2039921 - RNA, 16 nt, Homo sapiens
aagugagagaggggga

SEQ ID NO: 2039922 - RNA, 13 nt, Homo sapiens
ccacugcuguauu

SEQ ID NO: 2039923 - RNA, 23 nt, Homo sapiens
ccagggagcagagcuuccacaag

SEQ ID NO: 2039924 - RNA, 16 nt, Homo sapiens
aggugcucaugcugcu

SEQ ID NO: 2039925 - RNA, 17 nt, Homo sapiens
uacacaauggugcuauu

SEQ ID NO: 2039926 - RNA, 23 nt, Homo sapiens
gcacguaguagggucaggccacg

SEQ ID NO: 2039927 - RNA, 22 nt, Homo sapiens
cugugacucgagucacacucaa

SEQ ID NO: 2039928 - RNA, 19 nt, Homo sapiens
caguaucuuugcacuccaa

SEQ ID NO: 2039929 - RNA, 21 nt, Homo sapiens
aagucauggcccaaauccagu

SEQ ID NO: 2039930 - RNA, 20 nt, Homo sapiens
aaaugaaccuugcuaucaag

SEQ ID NO: 2039931 - RNA, 16 nt, Homo sapiens
cacaggcauauucccu

SEQ ID NO: 2039932 - RNA, 21 nt, Homo sapiens
uaucugagugaauuacagaca

SEQ ID NO: 2039933 - RNA, 22 nt, Homo sapiens
uggcuugggccucugacaugac

SEQ ID NO: 2039934 - RNA, 20 nt, Homo sapiens
ucauguagaacucagcaguu

SEQ ID NO: 2039935 - RNA, 21 nt, Homo sapiens
ugaaauuguagugcaaaaugg

SEQ ID NO: 2039936 - RNA, 15 nt, Homo sapiens
agcaauguuccagga

SEQ ID NO: 2039937 - RNA, 21 nt, Homo sapiens
cccaugcugagcucaucuggc

SEQ ID NO: 2039938 - RNA, 19 nt, Homo sapiens
gaacaaaucuaccagguga

SEQ ID NO: 2039939 - RNA, 15 nt, Homo sapiens
gucacuggggcccaa

SEQ ID NO: 2039940 - RNA, 15 nt, Homo sapiens
aggcugucacagucc

SEQ ID NO: 2039941 - RNA, 15 nt, Homo sapiens
acugcucaauucugu

SEQ ID NO: 2039942 - RNA, 14 nt, Homo sapiens
cagacccagggugg

SEQ ID NO: 2039943 - RNA, 15 nt, Homo sapiens
aaaaagcaccaaagg

SEQ ID NO: 2039944 - RNA, 17 nt, Homo sapiens
uaagaauugucucuggg

SEQ ID NO: 2039945 - RNA, 22 nt, Homo sapiens
uuugaaacauuugccaaacuaa

SEQ ID NO: 2039946 - RNA, 12 nt, Homo sapiens
uuuauccacuuu

SEQ ID NO: 2039947 - RNA, 19 nt, Homo sapiens
uucucgugguagaagccag

SEQ ID NO: 2039948 - RNA, 14 nt, Homo sapiens
uucuaauaaagcca

SEQ ID NO: 2039949 - RNA, 12 nt, Homo sapiens
ucaaaacauaca

SEQ ID NO: 2039950 - RNA, 12 nt, Homo sapiens
acaaaacaaaca

SEQ ID NO: 2039951 - RNA, 14 nt, Homo sapiens
caccuggaaacugc

SEQ ID NO: 2039952 - RNA, 17 nt, Homo sapiens
uucuuggcaugcaucuu

SEQ ID NO: 2039953 - RNA, 18 nt, Homo sapiens
uauggaaggguaaauacu

SEQ ID NO: 2039954 - RNA, 13 nt, Homo sapiens
gcagccuuuccag

SEQ ID NO: 2039955 - RNA, 18 nt, Homo sapiens
agguagagcccuugucca

SEQ ID NO: 2039956 - RNA, 17 nt, Homo sapiens
cauguuuaaaccugaca

SEQ ID NO: 2039957 - RNA, 14 nt, Homo sapiens
uuugcuuagcucaa

SEQ ID NO: 2039958 - RNA, 11 nt, Homo sapiens
uuaaagcacuu

SEQ ID NO: 2039959 - RNA, 22 nt, Homo sapiens
uuaaaucauuuuaacuucuaua

SEQ ID NO: 2039960 - RNA, 17 nt, Homo sapiens
gcaggcugguuugcaag

SEQ ID NO: 2039961 - RNA, 20 nt, Homo sapiens
gugcugccagucagccugga

SEQ ID NO: 2039962 - RNA, 15 nt, Homo sapiens
ugaaaccgccucugg

SEQ ID NO: 2039963 - RNA, 21 nt, Homo sapiens
caagauacauaugaggacaag

SEQ ID NO: 2039964 - RNA, 18 nt, Homo sapiens
uuguagauggaguuucac

SEQ ID NO: 2039965 - RNA, 20 nt, Homo sapiens
guuucaaagaaaagguguca

SEQ ID NO: 2039966 - RNA, 18 nt, Homo sapiens
gagcccagcauucagggg

SEQ ID NO: 2039967 - RNA, 15 nt, Homo sapiens
ugggggugucccugg

SEQ ID NO: 2039968 - RNA, 14 nt, Homo sapiens
aggggguacagucc

SEQ ID NO: 2039969 - RNA, 19 nt, Homo sapiens
uccuuuuuguugauuccaa

SEQ ID NO: 2039970 - RNA, 24 nt, Homo sapiens
gcuccuaugucaccuugaugacuu

SEQ ID NO: 2039971 - RNA, 23 nt, Homo sapiens
cuacauuguacaaggaaugaaag

SEQ ID NO: 2039972 - RNA, 21 nt, Homo sapiens
augucucugugagacucgaga

SEQ ID NO: 2039973 - RNA, 16 nt, Homo sapiens
guaaacauuaguucua

SEQ ID NO: 2039974 - RNA, 21 nt, Homo sapiens
cacgcugaaggcuuacuucag

SEQ ID NO: 2039975 - RNA, 15 nt, Homo sapiens
ccaaaccucaaguaa

SEQ ID NO: 2039976 - RNA, 20 nt, Homo sapiens
auauaauuauccaaauugau

SEQ ID NO: 2039977 - RNA, 18 nt, Homo sapiens
uucauaugcuguauaucc

SEQ ID NO: 2039978 - RNA, 16 nt, Homo sapiens
ccugcccuagcuccac

SEQ ID NO: 2039979 - RNA, 16 nt, Homo sapiens
ucggacuuugcaggag

SEQ ID NO: 2039980 - RNA, 20 nt, Homo sapiens
auuucaauaguuauccccag

SEQ ID NO: 2039981 - RNA, 22 nt, Homo sapiens
uuuggcugccuuuggaagucca

SEQ ID NO: 2039982 - RNA, 15 nt, Homo sapiens
aagcagccuggagac

SEQ ID NO: 2039983 - RNA, 20 nt, Homo sapiens
agauuuuauuuucaagcaaa

SEQ ID NO: 2039984 - RNA, 15 nt, Homo sapiens
gauccuucaaagagu

SEQ ID NO: 2039985 - RNA, 13 nt, Homo sapiens
caggugacaguga

SEQ ID NO: 2039986 - RNA, 20 nt, Homo sapiens
aggucugcaggccaccagcu

SEQ ID NO: 2039987 - RNA, 17 nt, Homo sapiens
gcuuucaaagcauuuac

SEQ ID NO: 2039988 - RNA, 21 nt, Homo sapiens
ucaccucuacccaaacccuag

SEQ ID NO: 2039989 - RNA, 15 nt, Homo sapiens
ucagaaaauuucuca

SEQ ID NO: 2039990 - RNA, 23 nt, Homo sapiens
guauccuacugagcauuugcacc

SEQ ID NO: 2039991 - RNA, 17 nt, Homo sapiens
uguuuuuguacaguuuu

SEQ ID NO: 2039992 - RNA, 19 nt, Homo sapiens
ccacaucuugaucugcuca

SEQ ID NO: 2039993 - RNA, 16 nt, Homo sapiens
ggcagcuagugccuuu

SEQ ID NO: 2039994 - RNA, 21 nt, Homo sapiens
aguugccaaagaaucuaggaa

SEQ ID NO: 2039995 - RNA, 12 nt, Homo sapiens
aguacauggcau

SEQ ID NO: 2039996 - RNA, 21 nt, Homo sapiens
auuuagccaggaccugccaau

SEQ ID NO: 2039997 - RNA, 17 nt, Homo sapiens
uccuacgccuugucauu

SEQ ID NO: 2039998 - RNA, 17 nt, Homo sapiens
gugaacgcugugaugcu

SEQ ID NO: 2039999 - RNA, 19 nt, Homo sapiens
agucugugugggacuguac

SEQ ID NO: 2040000 - RNA, 15 nt, Homo sapiens
cauacauacacauau

SEQ ID NO: 2040001 - RNA, 21 nt, Homo sapiens
ucccauggcuuugugcugcug

SEQ ID NO: 2040002 - RNA, 16 nt, Homo sapiens
uucugauaccacugca

SEQ ID NO: 2040003 - RNA, 14 nt, Homo sapiens
uguccauuuacacg

SEQ ID NO: 2040004 - RNA, 20 nt, Homo sapiens
gcaacucuuuuaagugccuu

SEQ ID NO: 2040005 - RNA, 19 nt, Homo sapiens
agcugacaauuuccaaagc

SEQ ID NO: 2040006 - RNA, 22 nt, Homo sapiens
aucacgucacugcacuccagcu

SEQ ID NO: 2040007 - RNA, 16 nt, Homo sapiens
acuggcaugagccacu

SEQ ID NO: 2040008 - RNA, 14 nt, Homo sapiens
gcaucuacuuagau

SEQ ID NO: 2040009 - RNA, 17 nt, Homo sapiens
ggaucuggaagggccaa

SEQ ID NO: 2040010 - RNA, 23 nt, Homo sapiens
ccuccuccagccgccaugcuccu

SEQ ID NO: 2040011 - RNA, 19 nt, Homo sapiens
agagaccucaaauuacuuu

SEQ ID NO: 2040012 - RNA, 17 nt, Homo sapiens
uuaaguuuuacugauaa

SEQ ID NO: 2040013 - RNA, 20 nt, Homo sapiens
cugaggagggcccugaggaa

SEQ ID NO: 2040014 - RNA, 21 nt, Homo sapiens
caaaaaagaaugugcuaugaa

SEQ ID NO: 2040015 - RNA, 14 nt, Homo sapiens
accaaucucuguga

SEQ ID NO: 2040016 - RNA, 22 nt, Homo sapiens
gccuccagccgccggcugugca

SEQ ID NO: 2040017 - RNA, 13 nt, Homo sapiens
agaaucaaaugca

SEQ ID NO: 2040018 - RNA, 13 nt, Homo sapiens
uagcuuugcacau

SEQ ID NO: 2040019 - RNA, 17 nt, Homo sapiens
aauaaaugucaccaggu

SEQ ID NO: 2040020 - RNA, 14 nt, Homo sapiens
acagaagggcagug

SEQ ID NO: 2040021 - RNA, 13 nt, Homo sapiens
cccugccaguguu

SEQ ID NO: 2040022 - RNA, 13 nt, Homo sapiens
ucaauuucuacaa

SEQ ID NO: 2040023 - RNA, 20 nt, Homo sapiens
acugagagcagaugguccuc

SEQ ID NO: 2040024 - RNA, 12 nt, Homo sapiens
aaugucacuuaa

SEQ ID NO: 2040025 - RNA, 12 nt, Homo sapiens
agccuuugccag

SEQ ID NO: 2040026 - RNA, 22 nt, Homo sapiens
ucagaauaggaagauaugccac

SEQ ID NO: 2040027 - RNA, 13 nt, Homo sapiens
ucuccugcaugca

SEQ ID NO: 2040028 - RNA, 21 nt, Homo sapiens
aggcaucauacuaaacuucac

SEQ ID NO: 2040029 - RNA, 21 nt, Homo sapiens
uucuccaucccucuaaugaga

SEQ ID NO: 2040030 - RNA, 20 nt, Homo sapiens
gguuucuuguuuaccaaaga

SEQ ID NO: 2040031 - RNA, 18 nt, Homo sapiens
gucacagagagacacggg

SEQ ID NO: 2040032 - RNA, 20 nt, Homo sapiens
ccaaaugccauccagaugug

SEQ ID NO: 2040033 - RNA, 21 nt, Homo sapiens
ugcuaauuggcagcacccacu

SEQ ID NO: 2040034 - RNA, 18 nt, Homo sapiens
ugaccuggaaucagugaa

SEQ ID NO: 2040035 - RNA, 22 nt, Homo sapiens
uaaggagggucacuggggccca

SEQ ID NO: 2040036 - RNA, 20 nt, Homo sapiens
cucccuaguagcugggauua

SEQ ID NO: 2040037 - RNA, 18 nt, Homo sapiens
ugggagggaagcuucugg

SEQ ID NO: 2040038 - RNA, 17 nt, Homo sapiens
gcagggacaaccaccag

SEQ ID NO: 2040039 - RNA, 22 nt, Homo sapiens
cauuguaaaacuaucugaacca

SEQ ID NO: 2040040 - RNA, 13 nt, Homo sapiens
gacuggcuuuguc

SEQ ID NO: 2040041 - RNA, 14 nt, Homo sapiens
caggaugggcacug

SEQ ID NO: 2040042 - RNA, 16 nt, Homo sapiens
guagcaacccaggugu

SEQ ID NO: 2040043 - RNA, 20 nt, Homo sapiens
agagcaagaccccaucucaa

SEQ ID NO: 2040044 - RNA, 20 nt, Homo sapiens
agagugagacccugucucaa

SEQ ID NO: 2040045 - RNA, 23 nt, Homo sapiens
gcacaagucauaccuacauucaa

SEQ ID NO: 2040046 - RNA, 22 nt, Homo sapiens
ugcucagcccuggaggugccag

SEQ ID NO: 2040047 - RNA, 22 nt, Homo sapiens
agagcuuagggucucagggugu

SEQ ID NO: 2040048 - RNA, 20 nt, Homo sapiens
aguuuguaaauucuagcuua

SEQ ID NO: 2040049 - RNA, 23 nt, Homo sapiens
gcacuaaaaugaggauccagggc

SEQ ID NO: 2040050 - RNA, 12 nt, Homo sapiens
aacaauggauau

SEQ ID NO: 2040051 - RNA, 19 nt, Homo sapiens
gaguauccuuucaguguua

SEQ ID NO: 2040052 - RNA, 17 nt, Homo sapiens
agagagaugaucgugcc

SEQ ID NO: 2040053 - RNA, 17 nt, Homo sapiens
ugucgauuucaccaaga

SEQ ID NO: 2040054 - RNA, 14 nt, Homo sapiens
accuccucugccag

SEQ ID NO: 2040055 - RNA, 18 nt, Homo sapiens
guccugggccuccugaca

SEQ ID NO: 2040056 - RNA, 15 nt, Homo sapiens
cugggcucugccacc

SEQ ID NO: 2040057 - RNA, 13 nt, Homo sapiens
auacaauuuacuu

SEQ ID NO: 2040058 - RNA, 13 nt, Homo sapiens
cauucacauaucu

SEQ ID NO: 2040059 - RNA, 21 nt, Homo sapiens
cucaggaggcugagacaggag

SEQ ID NO: 2040060 - RNA, 17 nt, Homo sapiens
uguagauucacauacag

SEQ ID NO: 2040061 - RNA, 17 nt, Homo sapiens
ugugaaauaauuccucu

SEQ ID NO: 2040062 - RNA, 23 nt, Homo sapiens
uaaaugucuucuguauucacuua

SEQ ID NO: 2040063 - RNA, 19 nt, Homo sapiens
ugcuugaauugcaaggcua

SEQ ID NO: 2040064 - RNA, 20 nt, Homo sapiens
cucacuucuuuccucaaaga

SEQ ID NO: 2040065 - RNA, 18 nt, Homo sapiens
cugcugucacaaccaaga

SEQ ID NO: 2040066 - RNA, 15 nt, Homo sapiens
uaaauaaauggaaua

SEQ ID NO: 2040067 - RNA, 14 nt, Homo sapiens
gaaagcacuggaau

SEQ ID NO: 2040068 - RNA, 18 nt, Homo sapiens
cagaugccuccucugucc

SEQ ID NO: 2040069 - RNA, 16 nt, Homo sapiens
ccaugucuaugcuccc

SEQ ID NO: 2040070 - RNA, 14 nt, Homo sapiens
gaaaauaaagcaga

SEQ ID NO: 2040071 - RNA, 17 nt, Homo sapiens
uauuucuuccuaccaag

SEQ ID NO: 2040072 - RNA, 13 nt, Homo sapiens
cuguaaccuaccu

SEQ ID NO: 2040073 - RNA, 22 nt, Homo sapiens
ccccgaaucacacagacaguuu

SEQ ID NO: 2040074 - RNA, 18 nt, Homo sapiens
acuccaucgugugugccu

SEQ ID NO: 2040075 - RNA, 23 nt, Homo sapiens
cagugaugcugugcuaugaauuu

SEQ ID NO: 2040076 - RNA, 12 nt, Homo sapiens
aucuuacugaaa

SEQ ID NO: 2040077 - RNA, 19 nt, Homo sapiens
gacuuccauuugcuuuguc

SEQ ID NO: 2040078 - RNA, 14 nt, Homo sapiens
auuacuaaauugac

SEQ ID NO: 2040079 - RNA, 13 nt, Homo sapiens
aagagcacuggag

SEQ ID NO: 2040080 - RNA, 13 nt, Homo sapiens
uaaaacacagaaa

SEQ ID NO: 2040081 - RNA, 20 nt, Homo sapiens
cuuugucuaaguagggccag

SEQ ID NO: 2040082 - RNA, 21 nt, Homo sapiens
aacuuucucacugcugucagc

SEQ ID NO: 2040083 - RNA, 22 nt, Homo sapiens
acagaggcauagaauacacauu

SEQ ID NO: 2040084 - RNA, 10 nt, Homo sapiens
aaugccacag

SEQ ID NO: 2040085 - RNA, 20 nt, Homo sapiens
gacuuugagcugagugcuga

SEQ ID NO: 2040086 - RNA, 18 nt, Homo sapiens
ucagcuccugaccaguug

SEQ ID NO: 2040087 - RNA, 20 nt, Homo sapiens
gucauguuguaaacauuucu

SEQ ID NO: 2040088 - RNA, 12 nt, Homo sapiens
uccguguguuua

SEQ ID NO: 2040089 - RNA, 17 nt, Homo sapiens
aagcgauucucaugccu

SEQ ID NO: 2040090 - RNA, 22 nt, Homo sapiens
agugguagcuuucaguauugua

SEQ ID NO: 2040091 - RNA, 19 nt, Homo sapiens
acacuguaccccagcucuc

SEQ ID NO: 2040092 - RNA, 18 nt, Homo sapiens
agugaccagcacacugga

SEQ ID NO: 2040093 - RNA, 23 nt, Homo sapiens
ucucuauuugagaaguucucaga

SEQ ID NO: 2040094 - RNA, 13 nt, Homo sapiens
acacggcacauuu

SEQ ID NO: 2040095 - RNA, 12 nt, Homo sapiens
uucaacaugaca

SEQ ID NO: 2040096 - RNA, 20 nt, Homo sapiens
cauuauaugcacuagcaaua

SEQ ID NO: 2040097 - RNA, 22 nt, Homo sapiens
ucaacaaaauaaugcacuuccu

SEQ ID NO: 2040098 - RNA, 18 nt, Homo sapiens
agaaggcaaaguuuccau

SEQ ID NO: 2040099 - RNA, 18 nt, Homo sapiens
gaagagcuggguaccagg

SEQ ID NO: 2040100 - RNA, 14 nt, Homo sapiens
cucguggugaggcu

SEQ ID NO: 2040101 - RNA, 21 nt, Homo sapiens
aaaacaaagccaugccaauaa

SEQ ID NO: 2040102 - RNA, 14 nt, Homo sapiens
aaggccucccucag

SEQ ID NO: 2040103 - RNA, 22 nt, Homo sapiens
uugucaaaaagcaacugaucau

SEQ ID NO: 2040104 - RNA, 14 nt, Homo sapiens
agagaagcauucuc

SEQ ID NO: 2040105 - RNA, 13 nt, Homo sapiens
augaggaaacuuu

SEQ ID NO: 2040106 - RNA, 20 nt, Homo sapiens
ccuacggaaggggacgcuuu

SEQ ID NO: 2040107 - RNA, 23 nt, Homo sapiens
uauaaauuuauuuacugcuaguc

SEQ ID NO: 2040108 - RNA, 20 nt, Homo sapiens
uaaccaguuuuuucaccucc

SEQ ID NO: 2040109 - RNA, 15 nt, Homo sapiens
aaagaugccauagca

SEQ ID NO: 2040110 - RNA, 14 nt, Homo sapiens
gaacuaaugaggau

SEQ ID NO: 2040111 - RNA, 13 nt, Homo sapiens
aauauauuuccau

SEQ ID NO: 2040112 - RNA, 18 nt, Homo sapiens
ccuuuaguuauaaaggaa

SEQ ID NO: 2040113 - RNA, 20 nt, Homo sapiens
aagccacuuucaaucuucaa

SEQ ID NO: 2040114 - RNA, 17 nt, Homo sapiens
aauacauuucaauuaua

SEQ ID NO: 2040115 - RNA, 16 nt, Homo sapiens
cugguaaccuguggug

SEQ ID NO: 2040116 - RNA, 19 nt, Homo sapiens
aggauuauuuuaaauacaa

SEQ ID NO: 2040117 - RNA, 17 nt, Homo sapiens
gcccuccaccuaccugc

SEQ ID NO: 2040118 - RNA, 15 nt, Homo sapiens
cagcucugaucacau

SEQ ID NO: 2040119 - RNA, 18 nt, Homo sapiens
aagaaauaauacccugcc

SEQ ID NO: 2040120 - RNA, 19 nt, Homo sapiens
agacagagaugaaaagaca

SEQ ID NO: 2040121 - RNA, 15 nt, Homo sapiens
cgaccaacugcccua

SEQ ID NO: 2040122 - RNA, 15 nt, Homo sapiens
caaauugcuacauag

SEQ ID NO: 2040123 - RNA, 12 nt, Homo sapiens
cacccugagguu

SEQ ID NO: 2040124 - RNA, 21 nt, Homo sapiens
cauccugccacccacacagca

SEQ ID NO: 2040125 - RNA, 13 nt, Homo sapiens
cuauuugaagcau

SEQ ID NO: 2040126 - RNA, 12 nt, Homo sapiens
cgcuaaggugaa

SEQ ID NO: 2040127 - RNA, 15 nt, Homo sapiens
aguuaauccaaacau

SEQ ID NO: 2040128 - RNA, 19 nt, Homo sapiens
ccgauauacucuagaugaa

SEQ ID NO: 2040129 - RNA, 15 nt, Homo sapiens
agcaacccauuaauc

SEQ ID NO: 2040130 - RNA, 17 nt, Homo sapiens
augagaaaggacagagc

SEQ ID NO: 2040131 - RNA, 13 nt, Homo sapiens
agugguuucccau

SEQ ID NO: 2040132 - RNA, 16 nt, Homo sapiens
uucauucuuguauuau

SEQ ID NO: 2040133 - RNA, 16 nt, Homo sapiens
aguaggaaaucaggca

SEQ ID NO: 2040134 - RNA, 14 nt, Homo sapiens
caaaaagaccagcc

SEQ ID NO: 2040135 - RNA, 15 nt, Homo sapiens
aauguuauagcugca

SEQ ID NO: 2040136 - RNA, 22 nt, Homo sapiens
caugauuguuugacacaccauu

SEQ ID NO: 2040137 - RNA, 23 nt, Homo sapiens
aggugauuuguaugcucauugaa

SEQ ID NO: 2040138 - RNA, 14 nt, Homo sapiens
ucaaauuugccaug

SEQ ID NO: 2040139 - RNA, 19 nt, Homo sapiens
uugccaucggaacugccuu

SEQ ID NO: 2040140 - RNA, 14 nt, Homo sapiens
uccuacaacagccu

SEQ ID NO: 2040141 - RNA, 18 nt, Homo sapiens
uaccacaucacaccacuu

SEQ ID NO: 2040142 - RNA, 15 nt, Homo sapiens
uagguguuaccuucu

SEQ ID NO: 2040143 - RNA, 12 nt, Homo sapiens
ugucucauuaua

SEQ ID NO: 2040144 - RNA, 19 nt, Homo sapiens
aagaaaauauauucuuuca

SEQ ID NO: 2040145 - RNA, 24 nt, Homo sapiens
auacuuugguuggcagcauuccau

SEQ ID NO: 2040146 - RNA, 24 nt, Homo sapiens
uuaaagacgcauguuauggugcua

SEQ ID NO: 2040147 - RNA, 22 nt, Homo sapiens
gcugauccggcugcuccuccag

SEQ ID NO: 2040148 - RNA, 14 nt, Homo sapiens
acacggucuucaca

SEQ ID NO: 2040149 - RNA, 15 nt, Homo sapiens
auugugagaugauuu

SEQ ID NO: 2040150 - RNA, 22 nt, Homo sapiens
guguggcuucuaugagcccaga

SEQ ID NO: 2040151 - RNA, 15 nt, Homo sapiens
aauccugcagugggg

SEQ ID NO: 2040152 - RNA, 17 nt, Homo sapiens
agucugugggagcucag

SEQ ID NO: 2040153 - RNA, 19 nt, Homo sapiens
ccugggaauguauuauucu

SEQ ID NO: 2040154 - RNA, 21 nt, Homo sapiens
uagagcagccucguggagcuc

SEQ ID NO: 2040155 - RNA, 17 nt, Homo sapiens
caaucccuucuccacuu

SEQ ID NO: 2040156 - RNA, 13 nt, Homo sapiens
ccuguugggagag

SEQ ID NO: 2040157 - RNA, 17 nt, Homo sapiens
guuaaacuacuuguaaa

SEQ ID NO: 2040158 - RNA, 17 nt, Homo sapiens
uagucagaaacugccau

SEQ ID NO: 2040159 - RNA, 17 nt, Homo sapiens
aggacccaagcagagaa

SEQ ID NO: 2040160 - RNA, 23 nt, Homo sapiens
ucuguauuaaaauuagaaucuga

SEQ ID NO: 2040161 - RNA, 15 nt, Homo sapiens
uuauucagauuggga

SEQ ID NO: 2040162 - RNA, 15 nt, Homo sapiens
auggaguacacagcu

SEQ ID NO: 2040163 - RNA, 20 nt, Homo sapiens
augagaaugaugcacacuga

SEQ ID NO: 2040164 - RNA, 18 nt, Homo sapiens
uggcccccuuucccgggc

SEQ ID NO: 2040165 - RNA, 12 nt, Homo sapiens
aauuauaaugca

SEQ ID NO: 2040166 - RNA, 16 nt, Homo sapiens
agggauggcaguggcu

SEQ ID NO: 2040167 - RNA, 11 nt, Homo sapiens
cauuuacugug

SEQ ID NO: 2040168 - RNA, 13 nt, Homo sapiens
aagaaacauuuau

SEQ ID NO: 2040169 - RNA, 16 nt, Homo sapiens
guacaugugcacuccc

SEQ ID NO: 2040170 - RNA, 23 nt, Homo sapiens
gaccaaggcgggcggaucacuua

SEQ ID NO: 2040171 - RNA, 14 nt, Homo sapiens
acauuuacugugga

SEQ ID NO: 2040172 - RNA, 21 nt, Homo sapiens
gugggagcuugauucucagca

SEQ ID NO: 2040173 - RNA, 15 nt, Homo sapiens
ggagggugggaccaa

SEQ ID NO: 2040174 - RNA, 14 nt, Homo sapiens
aggaaaagcaagaa

SEQ ID NO: 2040175 - RNA, 21 nt, Homo sapiens
aguuucugagcuaacgugcug

SEQ ID NO: 2040176 - RNA, 20 nt, Homo sapiens
cuaucaacaccacuaggaau

SEQ ID NO: 2040177 - RNA, 18 nt, Homo sapiens
ccagaaggaaccagccau

SEQ ID NO: 2040178 - RNA, 20 nt, Homo sapiens
uugcagugaagauguguaaa

SEQ ID NO: 2040179 - RNA, 15 nt, Homo sapiens
gccugggaguguuug

SEQ ID NO: 2040180 - RNA, 23 nt, Homo sapiens
auacuguauugcuguaugguaua

SEQ ID NO: 2040181 - RNA, 21 nt, Homo sapiens
gacaaaacauuuugaaggaaa

SEQ ID NO: 2040182 - RNA, 18 nt, Homo sapiens
aaggacucuuccaccucc

SEQ ID NO: 2040183 - RNA, 16 nt, Homo sapiens
auuucuccaaccacuc

SEQ ID NO: 2040184 - RNA, 23 nt, Homo sapiens
agucaucuugcuaccaguauuua

SEQ ID NO: 2040185 - RNA, 13 nt, Homo sapiens
agaggaaacugaa

SEQ ID NO: 2040186 - RNA, 18 nt, Homo sapiens
ugcaucuggguagcugua

SEQ ID NO: 2040187 - RNA, 16 nt, Homo sapiens
acuguugcaaacucag

SEQ ID NO: 2040188 - RNA, 14 nt, Homo sapiens
agcucacugcugcu

SEQ ID NO: 2040189 - RNA, 20 nt, Homo sapiens
caagauuaucuuauuccccu

SEQ ID NO: 2040190 - RNA, 15 nt, Homo sapiens
guguucuagaccucu

SEQ ID NO: 2040191 - RNA, 15 nt, Homo sapiens
cugccccacacuccc

SEQ ID NO: 2040192 - RNA, 20 nt, Homo sapiens
ccuuugugggcccagcuaca

SEQ ID NO: 2040193 - RNA, 13 nt, Homo sapiens
aaucaguguuacc

SEQ ID NO: 2040194 - RNA, 17 nt, Homo sapiens
uugcugagagccauuuu

SEQ ID NO: 2040195 - RNA, 21 nt, Homo sapiens
cucugcaauuuuacugugaaa

SEQ ID NO: 2040196 - RNA, 21 nt, Homo sapiens
gggguauuuuaggcagggauu

SEQ ID NO: 2040197 - RNA, 15 nt, Homo sapiens
uagaaaugggaaaug

SEQ ID NO: 2040198 - RNA, 16 nt, Homo sapiens
uaagauuccaaaaagc

SEQ ID NO: 2040199 - RNA, 23 nt, Homo sapiens
cucaaggguuauagacugccaug

SEQ ID NO: 2040200 - RNA, 17 nt, Homo sapiens
ucagacucuaagaaaga

SEQ ID NO: 2040201 - RNA, 19 nt, Homo sapiens
uauuuaauaugcaucuuug

SEQ ID NO: 2040202 - RNA, 13 nt, Homo sapiens
uacguugugcauu

SEQ ID NO: 2040203 - RNA, 16 nt, Homo sapiens
uagagaugcugggacu

SEQ ID NO: 2040204 - RNA, 19 nt, Homo sapiens
accguauccauaaagaccc

SEQ ID NO: 2040205 - RNA, 18 nt, Homo sapiens
auuucuagaggaacuuuu

SEQ ID NO: 2040206 - RNA, 15 nt, Homo sapiens
ucauggacacuuuga

SEQ ID NO: 2040207 - RNA, 15 nt, Homo sapiens
ugaaauuauaucugu

SEQ ID NO: 2040208 - RNA, 16 nt, Homo sapiens
agcugcucugcaagag

SEQ ID NO: 2040209 - RNA, 17 nt, Homo sapiens
caucccaacagcccagc

SEQ ID NO: 2040210 - RNA, 14 nt, Homo sapiens
caaucugugucaug

SEQ ID NO: 2040211 - RNA, 15 nt, Homo sapiens
acagggaacugggaa

SEQ ID NO: 2040212 - RNA, 22 nt, Homo sapiens
aaacgggcgccaagacucaggg

SEQ ID NO: 2040213 - RNA, 12 nt, Homo sapiens
uggaaagccagg

SEQ ID NO: 2040214 - RNA, 15 nt, Homo sapiens
caccuccuuggcacc

SEQ ID NO: 2040215 - RNA, 21 nt, Homo sapiens
ugaaaauauuuuacccaaaua

SEQ ID NO: 2040216 - RNA, 15 nt, Homo sapiens
ucuaacagcaaauaa

SEQ ID NO: 2040217 - RNA, 18 nt, Homo sapiens
aguugccaagacaaauca

SEQ ID NO: 2040218 - RNA, 17 nt, Homo sapiens
cugagaguggugcccug

SEQ ID NO: 2040219 - RNA, 16 nt, Homo sapiens
gaccuguggugcaaaa

SEQ ID NO: 2040220 - RNA, 14 nt, Homo sapiens
ucauuugcacacaa

SEQ ID NO: 2040221 - RNA, 18 nt, Homo sapiens
gaaacuauaaguaauucu

SEQ ID NO: 2040222 - RNA, 15 nt, Homo sapiens
cccgaaauucuagcu

SEQ ID NO: 2040223 - RNA, 17 nt, Homo sapiens
uguuggcuuuuugaaaa

SEQ ID NO: 2040224 - RNA, 15 nt, Homo sapiens
ccaagcacacaugca

SEQ ID NO: 2040225 - RNA, 15 nt, Homo sapiens
cauucauauuuucca

SEQ ID NO: 2040226 - RNA, 19 nt, Homo sapiens
uuaguucaauacagugaag

SEQ ID NO: 2040227 - RNA, 16 nt, Homo sapiens
uuucagcuacagcaaa

SEQ ID NO: 2040228 - RNA, 15 nt, Homo sapiens
cacagugucuagauc

SEQ ID NO: 2040229 - RNA, 15 nt, Homo sapiens
ccucuggucccacaa

SEQ ID NO: 2040230 - RNA, 15 nt, Homo sapiens
acugguuuuuuccag

SEQ ID NO: 2040231 - RNA, 19 nt, Homo sapiens
aucccaccugacauguccu

SEQ ID NO: 2040232 - RNA, 16 nt, Homo sapiens
ccauuccugaucccau

SEQ ID NO: 2040233 - RNA, 21 nt, Homo sapiens
cagacaccuccuucuuccuag

SEQ ID NO: 2040234 - RNA, 15 nt, Homo sapiens
auuuaaagccuccuc

SEQ ID NO: 2040235 - RNA, 19 nt, Homo sapiens
agcugagaucgugccacug

SEQ ID NO: 2040236 - RNA, 17 nt, Homo sapiens
ggguagacacacaugaa

SEQ ID NO: 2040237 - RNA, 22 nt, Homo sapiens
acuggaaaugagcccaagcaca

SEQ ID NO: 2040238 - RNA, 18 nt, Homo sapiens
gaaaaaauaacacuguac

SEQ ID NO: 2040239 - RNA, 17 nt, Homo sapiens
cagauucugauucccuu

SEQ ID NO: 2040240 - RNA, 19 nt, Homo sapiens
caguaaacuuucucugcaa

SEQ ID NO: 2040241 - RNA, 13 nt, Homo sapiens
aaaaaaccaucca

SEQ ID NO: 2040242 - RNA, 16 nt, Homo sapiens
uaggugugacuugaac

SEQ ID NO: 2040243 - RNA, 14 nt, Homo sapiens
uguguauauauaca

SEQ ID NO: 2040244 - RNA, 13 nt, Homo sapiens
uggggacuugaug

SEQ ID NO: 2040245 - RNA, 22 nt, Homo sapiens
uccuuuacuaauccaacccaug

SEQ ID NO: 2040246 - RNA, 17 nt, Homo sapiens
uuacaaauuguuuuuac

SEQ ID NO: 2040247 - RNA, 21 nt, Homo sapiens
ucccucccagaaaaacuggcu

SEQ ID NO: 2040248 - RNA, 22 nt, Homo sapiens
gggaugcacggcggcagggugg

SEQ ID NO: 2040249 - RNA, 16 nt, Homo sapiens
acaaguggucugggac

SEQ ID NO: 2040250 - RNA, 16 nt, Homo sapiens
aauguugaacauucau

SEQ ID NO: 2040251 - RNA, 11 nt, Homo sapiens
ugaggcucacc

SEQ ID NO: 2040252 - RNA, 15 nt, Homo sapiens
ugcacugucugagaa

SEQ ID NO: 2040253 - RNA, 17 nt, Homo sapiens
agagaauggauccucau

SEQ ID NO: 2040254 - RNA, 14 nt, Homo sapiens
cuaaauaucuguca

SEQ ID NO: 2040255 - RNA, 19 nt, Homo sapiens
ggaugcugggcucuguucu

SEQ ID NO: 2040256 - RNA, 13 nt, Homo sapiens
ccagccuccugcu

SEQ ID NO: 2040257 - RNA, 19 nt, Homo sapiens
ucuauuucuccuccauggg

SEQ ID NO: 2040258 - RNA, 11 nt, Homo sapiens
ggaauauuugc

SEQ ID NO: 2040259 - RNA, 21 nt, Homo sapiens
ggugcagggagacaucugcac

SEQ ID NO: 2040260 - RNA, 16 nt, Homo sapiens
cagguugaucaccuga

SEQ ID NO: 2040261 - RNA, 23 nt, Homo sapiens
accuacccccaaaaaacaauuau

SEQ ID NO: 2040262 - RNA, 18 nt, Homo sapiens
cuuaugacugcaccaaca

SEQ ID NO: 2040263 - RNA, 12 nt, Homo sapiens
ucguuuugacua

SEQ ID NO: 2040264 - RNA, 16 nt, Homo sapiens
uuauuuuuuucuuaaa

SEQ ID NO: 2040265 - RNA, 19 nt, Homo sapiens
gaauaccuuggucucaccu

SEQ ID NO: 2040266 - RNA, 12 nt, Homo sapiens
guauaccucacu

SEQ ID NO: 2040267 - RNA, 13 nt, Homo sapiens
acauauacacaca

SEQ ID NO: 2040268 - RNA, 13 nt, Homo sapiens
cucuuuaccuccu

SEQ ID NO: 2040269 - RNA, 13 nt, Homo sapiens
auacauacauaua

SEQ ID NO: 2040270 - RNA, 15 nt, Homo sapiens
auggaaccacuaaaa

SEQ ID NO: 2040271 - RNA, 19 nt, Homo sapiens
aacaguaaagaaagcagaa

SEQ ID NO: 2040272 - RNA, 19 nt, Homo sapiens
aaugcugcuucuccuccca

SEQ ID NO: 2040273 - RNA, 13 nt, Homo sapiens
cgaucucagcuca

SEQ ID NO: 2040274 - RNA, 18 nt, Homo sapiens
guacuccucacuuuucaa

SEQ ID NO: 2040275 - RNA, 22 nt, Homo sapiens
cucuuguaucccuagugcucca

SEQ ID NO: 2040276 - RNA, 15 nt, Homo sapiens
aagaaaaccaccccu

SEQ ID NO: 2040277 - RNA, 21 nt, Homo sapiens
uaaacaccauuuagucacuga

SEQ ID NO: 2040278 - RNA, 21 nt, Homo sapiens
uguuguuccaggauguggaau

SEQ ID NO: 2040279 - RNA, 17 nt, Homo sapiens
gagggcaggcacuccca

SEQ ID NO: 2040280 - RNA, 16 nt, Homo sapiens
guacaaagauuaguuu

SEQ ID NO: 2040281 - RNA, 18 nt, Homo sapiens
gaggguaaugagaagcuu

SEQ ID NO: 2040282 - RNA, 16 nt, Homo sapiens
ugcagaauaauccugu

SEQ ID NO: 2040283 - RNA, 13 nt, Homo sapiens
cuaccugucugua

SEQ ID NO: 2040284 - RNA, 11 nt, Homo sapiens
auccaaaaaga

SEQ ID NO: 2040285 - RNA, 22 nt, Homo sapiens
cuuucaauugcuucugugcaau

SEQ ID NO: 2040286 - RNA, 21 nt, Homo sapiens
ucccaaaggaugagaauguga

SEQ ID NO: 2040287 - RNA, 11 nt, Homo sapiens
gggugugcuau

SEQ ID NO: 2040288 - RNA, 22 nt, Homo sapiens
agcaccugccccggcagugggg

SEQ ID NO: 2040289 - RNA, 16 nt, Homo sapiens
aacugcacauugguca

SEQ ID NO: 2040290 - RNA, 18 nt, Homo sapiens
aagauuucuuaaugcuau

SEQ ID NO: 2040291 - RNA, 15 nt, Homo sapiens
acuucuagcauauag

SEQ ID NO: 2040292 - RNA, 22 nt, Homo sapiens
auuuauggucuucaaccaaggc

SEQ ID NO: 2040293 - RNA, 13 nt, Homo sapiens
cgugugaccucca

SEQ ID NO: 2040294 - RNA, 14 nt, Homo sapiens
gccgguaaacacgc

SEQ ID NO: 2040295 - RNA, 16 nt, Homo sapiens
ucccuguguggcugcu

SEQ ID NO: 2040296 - RNA, 18 nt, Homo sapiens
uguaggguccaaccagac

SEQ ID NO: 2040297 - RNA, 21 nt, Homo sapiens
acacugaucuuauguguuaca

SEQ ID NO: 2040298 - RNA, 12 nt, Homo sapiens
cacccuguguug

SEQ ID NO: 2040299 - RNA, 12 nt, Homo sapiens
acacugaugaua

SEQ ID NO: 2040300 - RNA, 16 nt, Homo sapiens
uugacugcuuggaacu

SEQ ID NO: 2040301 - RNA, 16 nt, Homo sapiens
acauucaaaaaccccu

SEQ ID NO: 2040302 - RNA, 16 nt, Homo sapiens
accugcgggagcugca

SEQ ID NO: 2040303 - RNA, 23 nt, Homo sapiens
augcugcuggggaagacaguggc

SEQ ID NO: 2040304 - RNA, 15 nt, Homo sapiens
ucaauacaaccagcc

SEQ ID NO: 2040305 - RNA, 21 nt, Homo sapiens
uucucuggaauaguuacuuua

SEQ ID NO: 2040306 - RNA, 19 nt, Homo sapiens
gacuucugccccagcuuua

SEQ ID NO: 2040307 - RNA, 14 nt, Homo sapiens
aacuugauaaucuu

SEQ ID NO: 2040308 - RNA, 21 nt, Homo sapiens
agcauuggguagcuauacuca

SEQ ID NO: 2040309 - RNA, 15 nt, Homo sapiens
cugcuggagugcagu

SEQ ID NO: 2040310 - RNA, 19 nt, Homo sapiens
uaaaaccagaaaggugauu

SEQ ID NO: 2040311 - RNA, 19 nt, Homo sapiens
accuggagccaucuuccua

SEQ ID NO: 2040312 - RNA, 16 nt, Homo sapiens
uccugcagucaauguu

SEQ ID NO: 2040313 - RNA, 21 nt, Homo sapiens
cuuggaaaaaauaauuauuca

SEQ ID NO: 2040314 - RNA, 16 nt, Homo sapiens
guacuaugacacuguu

SEQ ID NO: 2040315 - RNA, 23 nt, Homo sapiens
uucucaccuuaacucagccagaa

SEQ ID NO: 2040316 - RNA, 14 nt, Homo sapiens
acuacugcucucaa

SEQ ID NO: 2040317 - RNA, 22 nt, Homo sapiens
cccaauaugccugcgccaucuu

SEQ ID NO: 2040318 - RNA, 18 nt, Homo sapiens
uucugguauucacagaaa

SEQ ID NO: 2040319 - RNA, 20 nt, Homo sapiens
agcugucuuccuguguaccu

SEQ ID NO: 2040320 - RNA, 13 nt, Homo sapiens
ggugugggccaga

SEQ ID NO: 2040321 - RNA, 12 nt, Homo sapiens
aagacagugcag

SEQ ID NO: 2040322 - RNA, 12 nt, Homo sapiens
aaggcagugcaa

SEQ ID NO: 2040323 - RNA, 20 nt, Homo sapiens
cguggaugcgcagugccuug

SEQ ID NO: 2040324 - RNA, 15 nt, Homo sapiens
aucauacaccagaag

SEQ ID NO: 2040325 - RNA, 17 nt, Homo sapiens
gccuggagccccacugc

SEQ ID NO: 2040326 - RNA, 13 nt, Homo sapiens
aagugacccuguu

SEQ ID NO: 2040327 - RNA, 21 nt, Homo sapiens
gcuuuuccaauaaaagacaca

SEQ ID NO: 2040328 - RNA, 18 nt, Homo sapiens
ucacaguauuuacaagcu

SEQ ID NO: 2040329 - RNA, 16 nt, Homo sapiens
uggcuagauguuuaca

SEQ ID NO: 2040330 - RNA, 13 nt, Homo sapiens
caccucaccagaa

SEQ ID NO: 2040331 - RNA, 13 nt, Homo sapiens
uggcucacugcaa

SEQ ID NO: 2040332 - RNA, 21 nt, Homo sapiens
gauucacgcccucuuguuucc

SEQ ID NO: 2040333 - RNA, 22 nt, Homo sapiens
agaggagaguaccccccugaga

SEQ ID NO: 2040334 - RNA, 16 nt, Homo sapiens
ugagggaagacgccuu

SEQ ID NO: 2040335 - RNA, 14 nt, Homo sapiens
agucaguauggucu

SEQ ID NO: 2040336 - RNA, 17 nt, Homo sapiens
ccccaagauagagucaa

SEQ ID NO: 2040337 - RNA, 19 nt, Homo sapiens
aucucuguuauguacugua

SEQ ID NO: 2040338 - RNA, 14 nt, Homo sapiens
ccuguagugagaaa

SEQ ID NO: 2040339 - RNA, 18 nt, Homo sapiens
aaauaaauauacuaauaa

SEQ ID NO: 2040340 - RNA, 22 nt, Homo sapiens
ccuccacaugcugccuggcaca

SEQ ID NO: 2040341 - RNA, 22 nt, Homo sapiens
uaguaugggaaaaaaacugaag

SEQ ID NO: 2040342 - RNA, 12 nt, Homo sapiens
acaauuucugca

SEQ ID NO: 2040343 - RNA, 16 nt, Homo sapiens
cuucuagaauauguaa

SEQ ID NO: 2040344 - RNA, 22 nt, Homo sapiens
uacaugucacauuuagcugugc

SEQ ID NO: 2040345 - RNA, 23 nt, Homo sapiens
aagcgauucuugugccucagcuu

SEQ ID NO: 2040346 - RNA, 23 nt, Homo sapiens
aagaaaaagaccuaugagcacau

SEQ ID NO: 2040347 - RNA, 21 nt, Homo sapiens
uuucuggggaaagacacugcc

SEQ ID NO: 2040348 - RNA, 20 nt, Homo sapiens
gaaucugcauuuagcacaaa

SEQ ID NO: 2040349 - RNA, 18 nt, Homo sapiens
cuguccucaagauggagg

SEQ ID NO: 2040350 - RNA, 22 nt, Homo sapiens
cucaagaggcgagaugagccca

SEQ ID NO: 2040351 - RNA, 14 nt, Homo sapiens
caccauguugccaa

SEQ ID NO: 2040352 - RNA, 20 nt, Homo sapiens
uaacaaaauuugaauagccc

SEQ ID NO: 2040353 - RNA, 14 nt, Homo sapiens
guaggguugccaga

SEQ ID NO: 2040354 - RNA, 21 nt, Homo sapiens
ggcacugacaaugggcacaca

SEQ ID NO: 2040355 - RNA, 12 nt, Homo sapiens
ugaaaaacugcu

SEQ ID NO: 2040356 - RNA, 19 nt, Homo sapiens
ugugguuaaugccauggac

SEQ ID NO: 2040357 - RNA, 14 nt, Homo sapiens
ugcuuugcugcuau

SEQ ID NO: 2040358 - RNA, 14 nt, Homo sapiens
acuguugcacugau

SEQ ID NO: 2040359 - RNA, 13 nt, Homo sapiens
caaauaaagccug

SEQ ID NO: 2040360 - RNA, 14 nt, Homo sapiens
caguaacagugcag

SEQ ID NO: 2040361 - RNA, 18 nt, Homo sapiens
uaaucccccuugccaaau

SEQ ID NO: 2040362 - RNA, 19 nt, Homo sapiens
aauggacuauuuguuccac

SEQ ID NO: 2040363 - RNA, 22 nt, Homo sapiens
aaggaacgcugucucuuugcaa

SEQ ID NO: 2040364 - RNA, 21 nt, Homo sapiens
uaggugggggaacacugagaa

SEQ ID NO: 2040365 - RNA, 16 nt, Homo sapiens
auuucuaauggcccau

SEQ ID NO: 2040366 - RNA, 17 nt, Homo sapiens
cacgggcaaucaugagc

SEQ ID NO: 2040367 - RNA, 15 nt, Homo sapiens
gugaaacuccaucuc

SEQ ID NO: 2040368 - RNA, 22 nt, Homo sapiens
ccuagcaucucaugagugccaa

SEQ ID NO: 2040369 - RNA, 16 nt, Homo sapiens
ucaugauaugucaggg

SEQ ID NO: 2040370 - RNA, 19 nt, Homo sapiens
agccgcauuggugacucac

SEQ ID NO: 2040371 - RNA, 16 nt, Homo sapiens
gagggaucacugccaa

SEQ ID NO: 2040372 - RNA, 14 nt, Homo sapiens
uggacuaugcugau

SEQ ID NO: 2040373 - RNA, 20 nt, Homo sapiens
gauacauggcaacgugugaa

SEQ ID NO: 2040374 - RNA, 17 nt, Homo sapiens
ccacaggcagcauuuag

SEQ ID NO: 2040375 - RNA, 13 nt, Homo sapiens
cugguagaccacu

SEQ ID NO: 2040376 - RNA, 14 nt, Homo sapiens
ggucuccaagggag

SEQ ID NO: 2040377 - RNA, 22 nt, Homo sapiens
accuggauuuuuuauguacaac

SEQ ID NO: 2040378 - RNA, 13 nt, Homo sapiens
auuccauccugug

SEQ ID NO: 2040379 - RNA, 18 nt, Homo sapiens
agacuccaccucuaccaa

SEQ ID NO: 2040380 - RNA, 18 nt, Homo sapiens
aaaauccuuuuugcauau

SEQ ID NO: 2040381 - RNA, 14 nt, Homo sapiens
uuacauuucaccua

SEQ ID NO: 2040382 - RNA, 23 nt, Homo sapiens
uucuucuacugcccugagccuga

SEQ ID NO: 2040383 - RNA, 16 nt, Homo sapiens
auuuuugcugaauuca

SEQ ID NO: 2040384 - RNA, 12 nt, Homo sapiens
cccuuuccagcc

SEQ ID NO: 2040385 - RNA, 12 nt, Homo sapiens
agacuuccccau

SEQ ID NO: 2040386 - RNA, 16 nt, Homo sapiens
caagagcugagaaaca

SEQ ID NO: 2040387 - RNA, 13 nt, Homo sapiens
cacaccugcccua

SEQ ID NO: 2040388 - RNA, 15 nt, Homo sapiens
ugccggaugugcuuu

SEQ ID NO: 2040389 - RNA, 14 nt, Homo sapiens
cagcacaagcugcg

SEQ ID NO: 2040390 - RNA, 21 nt, Homo sapiens
ucucuguuuuguaagcuuuaa

SEQ ID NO: 2040391 - RNA, 14 nt, Homo sapiens
aauauuuguagaag

SEQ ID NO: 2040392 - RNA, 23 nt, Homo sapiens
uaccugcuggaagaauucuagca

SEQ ID NO: 2040393 - RNA, 17 nt, Homo sapiens
uaagaaaggauaaaguu

SEQ ID NO: 2040394 - RNA, 22 nt, Homo sapiens
acacaauucuaggaugaacaau

SEQ ID NO: 2040395 - RNA, 19 nt, Homo sapiens
cacagugacuucugagauc

SEQ ID NO: 2040396 - RNA, 20 nt, Homo sapiens
guccaacaagaaugcauucc

SEQ ID NO: 2040397 - RNA, 13 nt, Homo sapiens
uggcaagucacag

SEQ ID NO: 2040398 - RNA, 23 nt, Homo sapiens
cccagggucgucuuuguguaugg

SEQ ID NO: 2040399 - RNA, 18 nt, Homo sapiens
ggccagggcagcaaggga

SEQ ID NO: 2040400 - RNA, 17 nt, Homo sapiens
caggcagggccuggcuc

SEQ ID NO: 2040401 - RNA, 13 nt, Homo sapiens
uacaaauggacau

SEQ ID NO: 2040402 - RNA, 16 nt, Homo sapiens
agguaugaccuuuuaa

SEQ ID NO: 2040403 - RNA, 21 nt, Homo sapiens
cacagccucuuagaugcaguu

SEQ ID NO: 2040404 - RNA, 21 nt, Homo sapiens
augccaugaccuuccuccucc

SEQ ID NO: 2040405 - RNA, 12 nt, Homo sapiens
ugacaugcucca

SEQ ID NO: 2040406 - RNA, 23 nt, Homo sapiens
uucaacuuggaucauuaggcuua

SEQ ID NO: 2040407 - RNA, 13 nt, Homo sapiens
uaagguaaugguu

SEQ ID NO: 2040408 - RNA, 15 nt, Homo sapiens
ucagccaacugaaaa

SEQ ID NO: 2040409 - RNA, 16 nt, Homo sapiens
uggucccuaugggcuu

SEQ ID NO: 2040410 - RNA, 20 nt, Homo sapiens
auuuguccugcagugcucau

SEQ ID NO: 2040411 - RNA, 11 nt, Homo sapiens
cugacauugcc

SEQ ID NO: 2040412 - RNA, 20 nt, Homo sapiens
aaccugugaucaagcaauaa

SEQ ID NO: 2040413 - RNA, 20 nt, Homo sapiens
augaauguucgggcuuuuca

SEQ ID NO: 2040414 - RNA, 16 nt, Homo sapiens
ccguuugagugucugc

SEQ ID NO: 2040415 - RNA, 16 nt, Homo sapiens
cuacaagcaaauggag

SEQ ID NO: 2040416 - RNA, 20 nt, Homo sapiens
agaaccuuaaugacaacacu

SEQ ID NO: 2040417 - RNA, 21 nt, Homo sapiens
ggcugcaggcucuaugggguu

SEQ ID NO: 2040418 - RNA, 15 nt, Homo sapiens
uugacuguuaucucg

SEQ ID NO: 2040419 - RNA, 19 nt, Homo sapiens
uaauuuuguacaauaaccu

SEQ ID NO: 2040420 - RNA, 22 nt, Homo sapiens
uacaggcaugaaauacugugcc

SEQ ID NO: 2040421 - RNA, 14 nt, Homo sapiens
gaaagaggccaaac

SEQ ID NO: 2040422 - RNA, 17 nt, Homo sapiens
gcaggagaauugcuuga

SEQ ID NO: 2040423 - RNA, 17 nt, Homo sapiens
gcaagagaauuacuuga

SEQ ID NO: 2040424 - RNA, 17 nt, Homo sapiens
acuugaaacagauucag

SEQ ID NO: 2040425 - RNA, 23 nt, Homo sapiens
cagacuuuggaaaaugcauugua

SEQ ID NO: 2040426 - RNA, 14 nt, Homo sapiens
cagaccuguucuga

SEQ ID NO: 2040427 - RNA, 13 nt, Homo sapiens
gaugcugugaaga

SEQ ID NO: 2040428 - RNA, 15 nt, Homo sapiens
ugggaaccacuccca

SEQ ID NO: 2040429 - RNA, 19 nt, Homo sapiens
cgugaccugcuaggccaga

SEQ ID NO: 2040430 - RNA, 15 nt, Homo sapiens
cucuuucuuucaaua

SEQ ID NO: 2040431 - RNA, 21 nt, Homo sapiens
acagagcgagacuccaucuca

SEQ ID NO: 2040432 - RNA, 11 nt, Homo sapiens
aaacaaccuac

SEQ ID NO: 2040433 - RNA, 22 nt, Homo sapiens
ugcugugaagggagaaagggag

SEQ ID NO: 2040434 - RNA, 24 nt, Homo sapiens
auccaucuuugaacuucugacuac

SEQ ID NO: 2040435 - RNA, 12 nt, Homo sapiens
cagggagcauga

SEQ ID NO: 2040436 - RNA, 21 nt, Homo sapiens
gaugcagugugaaacuuacca

SEQ ID NO: 2040437 - RNA, 18 nt, Homo sapiens
gugacauuuauauauuga

SEQ ID NO: 2040438 - RNA, 19 nt, Homo sapiens
ggagucagaaacuguuucu

SEQ ID NO: 2040439 - RNA, 23 nt, Homo sapiens
cugggcagaccccucuaccuccu

SEQ ID NO: 2040440 - RNA, 19 nt, Homo sapiens
guccacuccuccuacugua

SEQ ID NO: 2040441 - RNA, 17 nt, Homo sapiens
uguguccccugaccugu

SEQ ID NO: 2040442 - RNA, 13 nt, Homo sapiens
ccccaccuccagu

SEQ ID NO: 2040443 - RNA, 15 nt, Homo sapiens
ucaaggagcccagaa

SEQ ID NO: 2040444 - RNA, 19 nt, Homo sapiens
gucccagccccuccucccu

SEQ ID NO: 2040445 - RNA, 13 nt, Homo sapiens
aacaugcuuuaga

SEQ ID NO: 2040446 - RNA, 14 nt, Homo sapiens
ccaucccaucccau

SEQ ID NO: 2040447 - RNA, 14 nt, Homo sapiens
uccccagagcugug

SEQ ID NO: 2040448 - RNA, 17 nt, Homo sapiens
ccagcucuaagucucaa

SEQ ID NO: 2040449 - RNA, 16 nt, Homo sapiens
cccucagaaccauuua

SEQ ID NO: 2040450 - RNA, 23 nt, Homo sapiens
aggaacacccggaaagacugaaa

SEQ ID NO: 2040451 - RNA, 13 nt, Homo sapiens
ucuggugugaacu

SEQ ID NO: 2040452 - RNA, 20 nt, Homo sapiens
uuucagcuccuucaaugcaa

SEQ ID NO: 2040453 - RNA, 22 nt, Homo sapiens
cgaccuaauugucuuuguucug

SEQ ID NO: 2040454 - RNA, 16 nt, Homo sapiens
cuggagucuggcuuua

SEQ ID NO: 2040455 - RNA, 15 nt, Homo sapiens
aaaagaagaguuugu

SEQ ID NO: 2040456 - RNA, 13 nt, Homo sapiens
gugacuuccucug

SEQ ID NO: 2040457 - RNA, 19 nt, Homo sapiens
guuuuguuaauauacccca

SEQ ID NO: 2040458 - RNA, 14 nt, Homo sapiens
ggcucagcucucaa

SEQ ID NO: 2040459 - RNA, 14 nt, Homo sapiens
auuuuauaucuguu

SEQ ID NO: 2040460 - RNA, 21 nt, Homo sapiens
cauaggcugacaccaagaaga

SEQ ID NO: 2040461 - RNA, 14 nt, Homo sapiens
ucuggaaaagcaaa

SEQ ID NO: 2040462 - RNA, 23 nt, Homo sapiens
auguaagguuuuuuuuguacgca

SEQ ID NO: 2040463 - RNA, 13 nt, Homo sapiens
uugguauauuucc

SEQ ID NO: 2040464 - RNA, 19 nt, Homo sapiens
ccauuauguaauagugaca

SEQ ID NO: 2040465 - RNA, 23 nt, Homo sapiens
gcuuaagccacugccucucccuc

SEQ ID NO: 2040466 - RNA, 18 nt, Homo sapiens
auacuuuggggacuugua

SEQ ID NO: 2040467 - RNA, 20 nt, Homo sapiens
cucauuacucuuaaggaaua

SEQ ID NO: 2040468 - RNA, 19 nt, Homo sapiens
uuccaccuggaaacugcuc

SEQ ID NO: 2040469 - RNA, 19 nt, Homo sapiens
ccgacaccacuccugccag

SEQ ID NO: 2040470 - RNA, 19 nt, Homo sapiens
uauacuguagcugaugaaa

SEQ ID NO: 2040471 - RNA, 14 nt, Homo sapiens
gcuagagugacuca

SEQ ID NO: 2040472 - RNA, 14 nt, Homo sapiens
gaagccccgucucu

SEQ ID NO: 2040473 - RNA, 14 nt, Homo sapiens
acuuaaacuugcau

SEQ ID NO: 2040474 - RNA, 22 nt, Homo sapiens
aggcacacagcaagucaggguu

SEQ ID NO: 2040475 - RNA, 16 nt, Homo sapiens
ggagcaugagugccgu

SEQ ID NO: 2040476 - RNA, 16 nt, Homo sapiens
aauaacuggaaaaagu

SEQ ID NO: 2040477 - RNA, 20 nt, Homo sapiens
uuugagccaugucacacaaa

SEQ ID NO: 2040478 - RNA, 22 nt, Homo sapiens
aagcauuucuagcagugaugaa

SEQ ID NO: 2040479 - RNA, 17 nt, Homo sapiens
auagaaauauugacuca

SEQ ID NO: 2040480 - RNA, 15 nt, Homo sapiens
ucagaaguucugggu

SEQ ID NO: 2040481 - RNA, 22 nt, Homo sapiens
aaauauuacacaucaagcgaug

SEQ ID NO: 2040482 - RNA, 17 nt, Homo sapiens
aucccuuauguaugacu

SEQ ID NO: 2040483 - RNA, 19 nt, Homo sapiens
caaacugugaagcauuuac

SEQ ID NO: 2040484 - RNA, 20 nt, Homo sapiens
agaacccacugcuuuuccca

SEQ ID NO: 2040485 - RNA, 18 nt, Homo sapiens
acagcucacggcagccuc

SEQ ID NO: 2040486 - RNA, 19 nt, Homo sapiens
caugggccucugauggaag

SEQ ID NO: 2040487 - RNA, 21 nt, Homo sapiens
uaagccuaguugcugaaauuu

SEQ ID NO: 2040488 - RNA, 19 nt, Homo sapiens
gagcuuaaacagaagcagc

SEQ ID NO: 2040489 - RNA, 17 nt, Homo sapiens
uccugucuuaccaaaca

SEQ ID NO: 2040490 - RNA, 20 nt, Homo sapiens
uaacguuagaccacaaauag

SEQ ID NO: 2040491 - RNA, 12 nt, Homo sapiens
agaccagggaug

SEQ ID NO: 2040492 - RNA, 20 nt, Homo sapiens
agcauagcagaggggccagg

SEQ ID NO: 2040493 - RNA, 19 nt, Homo sapiens
acagagaaguuuguagcca

SEQ ID NO: 2040494 - RNA, 20 nt, Homo sapiens
caugauggagcgcaccugcc

SEQ ID NO: 2040495 - RNA, 21 nt, Homo sapiens
auccacccaacccuaucuccu

SEQ ID NO: 2040496 - RNA, 12 nt, Homo sapiens
gugagcacugaa

SEQ ID NO: 2040497 - RNA, 22 nt, Homo sapiens
cugccuuaacacacacaccucu

SEQ ID NO: 2040498 - RNA, 17 nt, Homo sapiens
aagcauuuuugaucaaa

SEQ ID NO: 2040499 - RNA, 18 nt, Homo sapiens
cccaccaacucucucugc

SEQ ID NO: 2040500 - RNA, 19 nt, Homo sapiens
cauuccagucaagcagaaa

SEQ ID NO: 2040501 - RNA, 15 nt, Homo sapiens
cccaaauccaagcuu

SEQ ID NO: 2040502 - RNA, 21 nt, Homo sapiens
agaggccggucccuuccuugg

SEQ ID NO: 2040503 - RNA, 19 nt, Homo sapiens
aaacauuuuuuuguucucu

SEQ ID NO: 2040504 - RNA, 16 nt, Homo sapiens
uaucugacaucuuauu

SEQ ID NO: 2040505 - RNA, 14 nt, Homo sapiens
acuuaagcccagga

SEQ ID NO: 2040506 - RNA, 17 nt, Homo sapiens
uccaacuccugaccuca

SEQ ID NO: 2040507 - RNA, 14 nt, Homo sapiens
gaauaaauaauucu

SEQ ID NO: 2040508 - RNA, 14 nt, Homo sapiens
aaaaaaaugauacu

SEQ ID NO: 2040509 - RNA, 16 nt, Homo sapiens
ucgagaccaucuuggc

SEQ ID NO: 2040510 - RNA, 15 nt, Homo sapiens
ugaaggcaaugccau

SEQ ID NO: 2040511 - RNA, 22 nt, Homo sapiens
uuauauuuggguuaugauguca

SEQ ID NO: 2040512 - RNA, 22 nt, Homo sapiens
cuauuuuuguacaaaagagaag

SEQ ID NO: 2040513 - RNA, 16 nt, Homo sapiens
ugugcacaaugggcaa

SEQ ID NO: 2040514 - RNA, 22 nt, Homo sapiens
uagauacucauuagugacuuca

SEQ ID NO: 2040515 - RNA, 22 nt, Homo sapiens
cugaccuuggguccugaaguga

SEQ ID NO: 2040516 - RNA, 17 nt, Homo sapiens
caggccucuuguuccuu

SEQ ID NO: 2040517 - RNA, 22 nt, Homo sapiens
cuucuaguugcccccauuccca

SEQ ID NO: 2040518 - RNA, 22 nt, Homo sapiens
auuuuauguaaagucucucaau

SEQ ID NO: 2040519 - RNA, 17 nt, Homo sapiens
acugcgaggacaucaaa

SEQ ID NO: 2040520 - RNA, 22 nt, Homo sapiens
gacuuuccagaaugaccuugag

SEQ ID NO: 2040521 - RNA, 20 nt, Homo sapiens
acuuuuaaaaugaagcuuug

SEQ ID NO: 2040522 - RNA, 21 nt, Homo sapiens
auagagccacuaagaugaggg

SEQ ID NO: 2040523 - RNA, 19 nt, Homo sapiens
agucuggcucugucaccca

SEQ ID NO: 2040524 - RNA, 17 nt, Homo sapiens
ggcccccaucacacucg

SEQ ID NO: 2040525 - RNA, 20 nt, Homo sapiens
uacccuugauggauuuucaa

SEQ ID NO: 2040526 - RNA, 23 nt, Homo sapiens
ugaguuucuguucucccugggaa

SEQ ID NO: 2040527 - RNA, 15 nt, Homo sapiens
aauuucagggugcag

SEQ ID NO: 2040528 - RNA, 13 nt, Homo sapiens
ugaaauuaacuca

SEQ ID NO: 2040529 - RNA, 19 nt, Homo sapiens
ucuaguaaauuuaagucca

SEQ ID NO: 2040530 - RNA, 22 nt, Homo sapiens
uguggugacaggcccaguggaa

SEQ ID NO: 2040531 - RNA, 23 nt, Homo sapiens
gccacuggaaggaacauggagcu

SEQ ID NO: 2040532 - RNA, 17 nt, Homo sapiens
gagggccccucugccca

SEQ ID NO: 2040533 - RNA, 13 nt, Homo sapiens
agccaauauuccu

SEQ ID NO: 2040534 - RNA, 14 nt, Homo sapiens
cauggagugaccau

SEQ ID NO: 2040535 - RNA, 14 nt, Homo sapiens
gagaucgagaccau

SEQ ID NO: 2040536 - RNA, 14 nt, Homo sapiens
cggcacacacugug

SEQ ID NO: 2040537 - RNA, 13 nt, Homo sapiens
ccaaauugcuacc

SEQ ID NO: 2040538 - RNA, 21 nt, Homo sapiens
uugguacccacugggacauuu

SEQ ID NO: 2040539 - RNA, 14 nt, Homo sapiens
uccuuuaccccaca

SEQ ID NO: 2040540 - RNA, 19 nt, Homo sapiens
ucugagugggcccagcaca

SEQ ID NO: 2040541 - RNA, 16 nt, Homo sapiens
aaaccaggauuuccuu

SEQ ID NO: 2040542 - RNA, 23 nt, Homo sapiens
ugucaccacccacccuaccugca

SEQ ID NO: 2040543 - RNA, 18 nt, Homo sapiens
ccaaaugacuucauuucu

SEQ ID NO: 2040544 - RNA, 18 nt, Homo sapiens
gaguuaagauaucccuaa

SEQ ID NO: 2040545 - RNA, 15 nt, Homo sapiens
guuguacaagcucag

SEQ ID NO: 2040546 - RNA, 19 nt, Homo sapiens
cuguuggucaaaaucugca

SEQ ID NO: 2040547 - RNA, 22 nt, Homo sapiens
uacugacuuucugauuacuguc

SEQ ID NO: 2040548 - RNA, 16 nt, Homo sapiens
cagcaauuugauaaaa

SEQ ID NO: 2040549 - RNA, 12 nt, Homo sapiens
aucaucaauaaa

SEQ ID NO: 2040550 - RNA, 13 nt, Homo sapiens
cuucugcuucuca

SEQ ID NO: 2040551 - RNA, 23 nt, Homo sapiens
acagcagccacucaguucuuccu

SEQ ID NO: 2040552 - RNA, 16 nt, Homo sapiens
uauauuuuaaagacca

SEQ ID NO: 2040553 - RNA, 16 nt, Homo sapiens
gucuccaugcuggaua

SEQ ID NO: 2040554 - RNA, 18 nt, Homo sapiens
ucacucacauugagagua

SEQ ID NO: 2040555 - RNA, 14 nt, Homo sapiens
auauuguaagcauu

SEQ ID NO: 2040556 - RNA, 15 nt, Homo sapiens
gaggauaacuuccuu

SEQ ID NO: 2040557 - RNA, 13 nt, Homo sapiens
auaaaaugugauu

SEQ ID NO: 2040558 - RNA, 23 nt, Homo sapiens
gcucauuugucauuuacccuggu

SEQ ID NO: 2040559 - RNA, 15 nt, Homo sapiens
auaauugacaaacuu

SEQ ID NO: 2040560 - RNA, 13 nt, Homo sapiens
ccaguaacugcug

SEQ ID NO: 2040561 - RNA, 14 nt, Homo sapiens
agaacauugaucug

SEQ ID NO: 2040562 - RNA, 14 nt, Homo sapiens
ccauucauugcagc

SEQ ID NO: 2040563 - RNA, 13 nt, Homo sapiens
accauggcuuuaa

SEQ ID NO: 2040564 - RNA, 23 nt, Homo sapiens
uaugguguuccuagaaugcagcu

SEQ ID NO: 2040565 - RNA, 12 nt, Homo sapiens
cacaucuuccac

SEQ ID NO: 2040566 - RNA, 12 nt, Homo sapiens
uacaucuuucac

SEQ ID NO: 2040567 - RNA, 15 nt, Homo sapiens
uucuaugcauuaaga

SEQ ID NO: 2040568 - RNA, 22 nt, Homo sapiens
ucugaggcgccccaacccgugg

SEQ ID NO: 2040569 - RNA, 13 nt, Homo sapiens
caucagggcccag

SEQ ID NO: 2040570 - RNA, 13 nt, Homo sapiens
gacauuacuguau

SEQ ID NO: 2040571 - RNA, 16 nt, Homo sapiens
guuuacagcacuacuc

SEQ ID NO: 2040572 - RNA, 18 nt, Homo sapiens
ggcaaguggagccaccuc

SEQ ID NO: 2040573 - RNA, 18 nt, Homo sapiens
ccauggcccccaauaaag

SEQ ID NO: 2040574 - RNA, 18 nt, Homo sapiens
acuguggagcucagugug

SEQ ID NO: 2040575 - RNA, 23 nt, Homo sapiens
auuuuccacgcugauguuuaugu

SEQ ID NO: 2040576 - RNA, 16 nt, Homo sapiens
cauuaccuccauccau

SEQ ID NO: 2040577 - RNA, 21 nt, Homo sapiens
guccacggucuguucuugaag

SEQ ID NO: 2040578 - RNA, 17 nt, Homo sapiens
gacaugugaagcuauuu

SEQ ID NO: 2040579 - RNA, 13 nt, Homo sapiens
uaacaguuccuuu

SEQ ID NO: 2040580 - RNA, 18 nt, Homo sapiens
aaaaccuacccucaguga

SEQ ID NO: 2040581 - RNA, 21 nt, Homo sapiens
uguuucgcauuaagcacacac

SEQ ID NO: 2040582 - RNA, 11 nt, Homo sapiens
aggucaguggg

SEQ ID NO: 2040583 - RNA, 15 nt, Homo sapiens
uaauuaaaaugauag

SEQ ID NO: 2040584 - RNA, 20 nt, Homo sapiens
ccuccguguagugucuguaa

SEQ ID NO: 2040585 - RNA, 19 nt, Homo sapiens
auagacagauguggacaug

SEQ ID NO: 2040586 - RNA, 17 nt, Homo sapiens
gagacuuagaagcauca

SEQ ID NO: 2040587 - RNA, 17 nt, Homo sapiens
augguggugagcacauc

SEQ ID NO: 2040588 - RNA, 13 nt, Homo sapiens
gccuaaccuggga

SEQ ID NO: 2040589 - RNA, 14 nt, Homo sapiens
augcaaagaugaag

SEQ ID NO: 2040590 - RNA, 23 nt, Homo sapiens
gccuaauacauuaaagcagucac

SEQ ID NO: 2040591 - RNA, 12 nt, Homo sapiens
uucaaaaugcau

SEQ ID NO: 2040592 - RNA, 21 nt, Homo sapiens
cacucaaaagacaaacaugca

SEQ ID NO: 2040593 - RNA, 16 nt, Homo sapiens
ucagugaauuugucca

SEQ ID NO: 2040594 - RNA, 15 nt, Homo sapiens
cccuacaccucuggg

SEQ ID NO: 2040595 - RNA, 18 nt, Homo sapiens
aacuggcaguugucauca

SEQ ID NO: 2040596 - RNA, 20 nt, Homo sapiens
caggacgcacccccacugcu

SEQ ID NO: 2040597 - RNA, 17 nt, Homo sapiens
acacuuuugaggacaag

SEQ ID NO: 2040598 - RNA, 17 nt, Homo sapiens
uuaaacaccugacacau

SEQ ID NO: 2040599 - RNA, 21 nt, Homo sapiens
ccuuguaauaccugauugauc

SEQ ID NO: 2040600 - RNA, 15 nt, Homo sapiens
ccuuguuuguacugu

SEQ ID NO: 2040601 - RNA, 15 nt, Homo sapiens
ccccaggaccagaag

SEQ ID NO: 2040602 - RNA, 14 nt, Homo sapiens
ccaugggcccgcug

SEQ ID NO: 2040603 - RNA, 20 nt, Homo sapiens
uuaaaagagacaaacuguaa

SEQ ID NO: 2040604 - RNA, 17 nt, Homo sapiens
uaucuuguuuuuccacu

SEQ ID NO: 2040605 - RNA, 11 nt, Homo sapiens
agcaguggcau

SEQ ID NO: 2040606 - RNA, 21 nt, Homo sapiens
gacuugaacuagauugcaugc

SEQ ID NO: 2040607 - RNA, 12 nt, Homo sapiens
agugcacugagc

SEQ ID NO: 2040608 - RNA, 17 nt, Homo sapiens
uuuagcagcauggcugc

SEQ ID NO: 2040609 - RNA, 19 nt, Homo sapiens
ucuaauagaaaagucucca

SEQ ID NO: 2040610 - RNA, 14 nt, Homo sapiens
cucacaggccucuc

SEQ ID NO: 2040611 - RNA, 18 nt, Homo sapiens
cucaugugaaaggggaau

SEQ ID NO: 2040612 - RNA, 23 nt, Homo sapiens
ggaagaccaaaauuacuaauaaa

SEQ ID NO: 2040613 - RNA, 21 nt, Homo sapiens
accacaggaaccacaagacug

SEQ ID NO: 2040614 - RNA, 23 nt, Homo sapiens
guuuuuuuuuuuuuaaucugcau

SEQ ID NO: 2040615 - RNA, 19 nt, Homo sapiens
gaaauuccagcguacuaua

SEQ ID NO: 2040616 - RNA, 19 nt, Homo sapiens
acuggugagguugaggaau

SEQ ID NO: 2040617 - RNA, 22 nt, Homo sapiens
uaggauuuguguuuuacaguau

SEQ ID NO: 2040618 - RNA, 22 nt, Homo sapiens
uuuucuacuuuaaauuguggau

SEQ ID NO: 2040619 - RNA, 20 nt, Homo sapiens
accuaacucccuaggccuga

SEQ ID NO: 2040620 - RNA, 14 nt, Homo sapiens
ugcaagauucugaa

SEQ ID NO: 2040621 - RNA, 17 nt, Homo sapiens
auuucucaaaugcacau

SEQ ID NO: 2040622 - RNA, 23 nt, Homo sapiens
uucccaguuaaagauuauuguga

SEQ ID NO: 2040623 - RNA, 13 nt, Homo sapiens
augcacacagaua

SEQ ID NO: 2040624 - RNA, 13 nt, Homo sapiens
gagcaaauaacua

SEQ ID NO: 2040625 - RNA, 16 nt, Homo sapiens
caacgagauaccaucu

SEQ ID NO: 2040626 - RNA, 15 nt, Homo sapiens
uuuuucccaguauuu

SEQ ID NO: 2040627 - RNA, 15 nt, Homo sapiens
auuaacucuccaguu

SEQ ID NO: 2040628 - RNA, 18 nt, Homo sapiens
aaccugagaucuguguuu

SEQ ID NO: 2040629 - RNA, 13 nt, Homo sapiens
uaaaacauuucuc

SEQ ID NO: 2040630 - RNA, 17 nt, Homo sapiens
uccugccagcucaggau

SEQ ID NO: 2040631 - RNA, 20 nt, Homo sapiens
ggggcccugcaccugugcag

SEQ ID NO: 2040632 - RNA, 21 nt, Homo sapiens
uuuauuuacaucuauguaucu

SEQ ID NO: 2040633 - RNA, 14 nt, Homo sapiens
agugagaggauauu

SEQ ID NO: 2040634 - RNA, 18 nt, Homo sapiens
cccaggcuccagccacag

SEQ ID NO: 2040635 - RNA, 18 nt, Homo sapiens
gaagaugaucauuugccc

SEQ ID NO: 2040636 - RNA, 17 nt, Homo sapiens
ucacucaggaacccugg

SEQ ID NO: 2040637 - RNA, 14 nt, Homo sapiens
uagauguugccaug

SEQ ID NO: 2040638 - RNA, 18 nt, Homo sapiens
gaagaugggcuucaucca

SEQ ID NO: 2040639 - RNA, 17 nt, Homo sapiens
ugaagaaugcauucaaa

SEQ ID NO: 2040640 - RNA, 20 nt, Homo sapiens
gcuguaacguggcacuggua

SEQ ID NO: 2040641 - RNA, 15 nt, Homo sapiens
aaauaggauuugcac

SEQ ID NO: 2040642 - RNA, 16 nt, Homo sapiens
uuugaagugcagcuca

SEQ ID NO: 2040643 - RNA, 22 nt, Homo sapiens
ccauaguuacuguaaaaugcaa

SEQ ID NO: 2040644 - RNA, 11 nt, Homo sapiens
ugauucccaac

SEQ ID NO: 2040645 - RNA, 21 nt, Homo sapiens
cagaucaguuuagcaaaucua

SEQ ID NO: 2040646 - RNA, 17 nt, Homo sapiens
aaugcucaaccuaacca

SEQ ID NO: 2040647 - RNA, 19 nt, Homo sapiens
gcguaacccucgcccuguc

SEQ ID NO: 2040648 - RNA, 20 nt, Homo sapiens
aagauggcuaggccaucacc

SEQ ID NO: 2040649 - RNA, 19 nt, Homo sapiens
uucuuuuggcuuccaugau

SEQ ID NO: 2040650 - RNA, 23 nt, Homo sapiens
gagcuuggcguuuggacccaguu

SEQ ID NO: 2040651 - RNA, 21 nt, Homo sapiens
agaccacacugcacacaguga

SEQ ID NO: 2040652 - RNA, 18 nt, Homo sapiens
ugugcaaauauaucugcu

SEQ ID NO: 2040653 - RNA, 15 nt, Homo sapiens
gggcgggauucucuc

SEQ ID NO: 2040654 - RNA, 19 nt, Homo sapiens
aauacaugcugcuaauuca

SEQ ID NO: 2040655 - RNA, 14 nt, Homo sapiens
auuugggcacugua

SEQ ID NO: 2040656 - RNA, 22 nt, Homo sapiens
auaguuaacacagaucaaguga

SEQ ID NO: 2040657 - RNA, 16 nt, Homo sapiens
uaggaaucuaguacaa

SEQ ID NO: 2040658 - RNA, 13 nt, Homo sapiens
uuccagacugcuu

SEQ ID NO: 2040659 - RNA, 19 nt, Homo sapiens
augccuauauccccaaaau

SEQ ID NO: 2040660 - RNA, 23 nt, Homo sapiens
aaaucacacaugcuuuucuuccu

SEQ ID NO: 2040661 - RNA, 22 nt, Homo sapiens
augcagaacuucccuccaucca

SEQ ID NO: 2040662 - RNA, 23 nt, Homo sapiens
uuuuaaauuccugcuuaauguca

SEQ ID NO: 2040663 - RNA, 16 nt, Homo sapiens
aauaaaauccuaagac

SEQ ID NO: 2040664 - RNA, 20 nt, Homo sapiens
cagaugcguccgaagggaaa

SEQ ID NO: 2040665 - RNA, 19 nt, Homo sapiens
uucugaggccugagugauc

SEQ ID NO: 2040666 - RNA, 12 nt, Homo sapiens
uuucugaacaau

SEQ ID NO: 2040667 - RNA, 18 nt, Homo sapiens
aaugugcaaagucaucaa

SEQ ID NO: 2040668 - RNA, 23 nt, Homo sapiens
gaacuaauaaauacauacgguca

SEQ ID NO: 2040669 - RNA, 17 nt, Homo sapiens
caacuugggaacuagac

SEQ ID NO: 2040670 - RNA, 18 nt, Homo sapiens
aucauauugaauguuucc

SEQ ID NO: 2040671 - RNA, 13 nt, Homo sapiens
gaugaggggccac

SEQ ID NO: 2040672 - RNA, 15 nt, Homo sapiens
ucugugaaacuggga

SEQ ID NO: 2040673 - RNA, 14 nt, Homo sapiens
aaccccugaaguau

SEQ ID NO: 2040674 - RNA, 17 nt, Homo sapiens
aguuacuguugauccug

SEQ ID NO: 2040675 - RNA, 15 nt, Homo sapiens
gcugcacuccaugag

SEQ ID NO: 2040676 - RNA, 20 nt, Homo sapiens
gaaaaacaaaaacuacuuug

SEQ ID NO: 2040677 - RNA, 18 nt, Homo sapiens
acagguucuccaggugau

SEQ ID NO: 2040678 - RNA, 19 nt, Homo sapiens
cuagacucaagguucccag

SEQ ID NO: 2040679 - RNA, 22 nt, Homo sapiens
aauauuucugauacugcugagu

SEQ ID NO: 2040680 - RNA, 16 nt, Homo sapiens
uuaaacuaacaauuca

SEQ ID NO: 2040681 - RNA, 19 nt, Homo sapiens
cugugugacaucacagggc

SEQ ID NO: 2040682 - RNA, 15 nt, Homo sapiens
uaaauagcauucucu

SEQ ID NO: 2040683 - RNA, 18 nt, Homo sapiens
cugaacuuacuugccuca

SEQ ID NO: 2040684 - RNA, 16 nt, Homo sapiens
ugccgucaccaccacc

SEQ ID NO: 2040685 - RNA, 17 nt, Homo sapiens
cuguuucugcagccacu

SEQ ID NO: 2040686 - RNA, 20 nt, Homo sapiens
ugcagaacagugaaagguau

SEQ ID NO: 2040687 - RNA, 12 nt, Homo sapiens
cacucaugcuga

SEQ ID NO: 2040688 - RNA, 16 nt, Homo sapiens
acaaaaucagguaacu

SEQ ID NO: 2040689 - RNA, 16 nt, Homo sapiens
gggaucuugcauuccc

SEQ ID NO: 2040690 - RNA, 12 nt, Homo sapiens
gcuuuacuuuag

SEQ ID NO: 2040691 - RNA, 13 nt, Homo sapiens
accaucuuugcag

SEQ ID NO: 2040692 - RNA, 13 nt, Homo sapiens
acuggcuuugugu

SEQ ID NO: 2040693 - RNA, 17 nt, Homo sapiens
gagcaaucguguauaag

SEQ ID NO: 2040694 - RNA, 18 nt, Homo sapiens
ugggauguauauugcuau

SEQ ID NO: 2040695 - RNA, 14 nt, Homo sapiens
ugaaacugacuugc

SEQ ID NO: 2040696 - RNA, 15 nt, Homo sapiens
gacacauaguguuug

SEQ ID NO: 2040697 - RNA, 15 nt, Homo sapiens
auggauguguugccc

SEQ ID NO: 2040698 - RNA, 17 nt, Homo sapiens
cuggagagacugugcug

SEQ ID NO: 2040699 - RNA, 11 nt, Homo sapiens
ccgucuucucc

SEQ ID NO: 2040700 - RNA, 23 nt, Homo sapiens
aaguucuggcaagauugaagucu

SEQ ID NO: 2040701 - RNA, 16 nt, Homo sapiens
gcucgccccaccucca

SEQ ID NO: 2040702 - RNA, 20 nt, Homo sapiens
aaggcccagacaggcucagg

SEQ ID NO: 2040703 - RNA, 21 nt, Homo sapiens
ucauaugcagaacguauuuag

SEQ ID NO: 2040704 - RNA, 14 nt, Homo sapiens
ugagagugcaaauu

SEQ ID NO: 2040705 - RNA, 20 nt, Homo sapiens
gaauuacaguacacaucccc

SEQ ID NO: 2040706 - RNA, 19 nt, Homo sapiens
gucucuuuuugguaauaac

SEQ ID NO: 2040707 - RNA, 14 nt, Homo sapiens
ucaugagacaaguc

SEQ ID NO: 2040708 - RNA, 12 nt, Homo sapiens
cuugaugaauaa

SEQ ID NO: 2040709 - RNA, 22 nt, Homo sapiens
gguauccagaauggaauuuugc

SEQ ID NO: 2040710 - RNA, 22 nt, Homo sapiens
uuaugucaucauacaugacuca

SEQ ID NO: 2040711 - RNA, 20 nt, Homo sapiens
aagccaguuccgucuucccu

SEQ ID NO: 2040712 - RNA, 19 nt, Homo sapiens
ucuacccugcugaccuccc

SEQ ID NO: 2040713 - RNA, 19 nt, Homo sapiens
gaugggaugcacucucaga

SEQ ID NO: 2040714 - RNA, 17 nt, Homo sapiens
ugaucagccuugcaaau

SEQ ID NO: 2040715 - RNA, 14 nt, Homo sapiens
agucugaugacaca

SEQ ID NO: 2040716 - RNA, 22 nt, Homo sapiens
aacuucagauugaaccauucau

SEQ ID NO: 2040717 - RNA, 12 nt, Homo sapiens
uguaacugccua

SEQ ID NO: 2040718 - RNA, 16 nt, Homo sapiens
caagucauuccaugaa

SEQ ID NO: 2040719 - RNA, 22 nt, Homo sapiens
cccugcugagcgugaugaucua

SEQ ID NO: 2040720 - RNA, 14 nt, Homo sapiens
cuacuaaacugggg

SEQ ID NO: 2040721 - RNA, 17 nt, Homo sapiens
agcaaaggaaacuuugc

SEQ ID NO: 2040722 - RNA, 12 nt, Homo sapiens
uuuugcguagaa

SEQ ID NO: 2040723 - RNA, 21 nt, Homo sapiens
gcacaggcgcaucccaggccu

SEQ ID NO: 2040724 - RNA, 18 nt, Homo sapiens
augaaauaaagaauuuaa

SEQ ID NO: 2040725 - RNA, 22 nt, Homo sapiens
aaaaccaaaagaacaagaauuu

SEQ ID NO: 2040726 - RNA, 13 nt, Homo sapiens
ggcuucccaucug

SEQ ID NO: 2040727 - RNA, 16 nt, Homo sapiens
gacccacaaacugccu

SEQ ID NO: 2040728 - RNA, 14 nt, Homo sapiens
uuuccccaauucau

SEQ ID NO: 2040729 - RNA, 12 nt, Homo sapiens
cccauucuugca

SEQ ID NO: 2040730 - RNA, 16 nt, Homo sapiens
gcucuauuaagauuuc

SEQ ID NO: 2040731 - RNA, 19 nt, Homo sapiens
ugacaggccugaagauauu

SEQ ID NO: 2040732 - RNA, 14 nt, Homo sapiens
agaaaagugcauau

SEQ ID NO: 2040733 - RNA, 23 nt, Homo sapiens
aggaagcccuaagacgucccuuu

SEQ ID NO: 2040734 - RNA, 20 nt, Homo sapiens
cacucccucugccuucaggc

SEQ ID NO: 2040735 - RNA, 23 nt, Homo sapiens
uaagauugaagcuaaaacacuuc

SEQ ID NO: 2040736 - RNA, 15 nt, Homo sapiens
aucucacagcacacu

SEQ ID NO: 2040737 - RNA, 22 nt, Homo sapiens
uacaguuuaauaaauagcaucu

SEQ ID NO: 2040738 - RNA, 21 nt, Homo sapiens
gcuaauuuugaaaaacugcuc

SEQ ID NO: 2040739 - RNA, 18 nt, Homo sapiens
guuuugaagaaaugccaa

SEQ ID NO: 2040740 - RNA, 14 nt, Homo sapiens
uauauaauauguca

SEQ ID NO: 2040741 - RNA, 16 nt, Homo sapiens
uugcacccaugccaua

SEQ ID NO: 2040742 - RNA, 13 nt, Homo sapiens
ggaauacuggcca

SEQ ID NO: 2040743 - RNA, 13 nt, Homo sapiens
gaccuacugaaaa

SEQ ID NO: 2040744 - RNA, 14 nt, Homo sapiens
aaaacugucccuuu

SEQ ID NO: 2040745 - RNA, 20 nt, Homo sapiens
gaaaguaaaaaguugcuucu

SEQ ID NO: 2040746 - RNA, 16 nt, Homo sapiens
ucugggcuauggacac

SEQ ID NO: 2040747 - RNA, 19 nt, Homo sapiens
ugcuuugccauaaccacau

SEQ ID NO: 2040748 - RNA, 20 nt, Homo sapiens
cagccauacggcacugaaca

SEQ ID NO: 2040749 - RNA, 21 nt, Homo sapiens
uuauauuacuugccuaucuga

SEQ ID NO: 2040750 - RNA, 13 nt, Homo sapiens
ucaugaaaacugg

SEQ ID NO: 2040751 - RNA, 20 nt, Homo sapiens
ucucuugccccuuguccuga

SEQ ID NO: 2040752 - RNA, 19 nt, Homo sapiens
ucgaccacuuuucaguuca

SEQ ID NO: 2040753 - RNA, 12 nt, Homo sapiens
uuggagugcagu

SEQ ID NO: 2040754 - RNA, 14 nt, Homo sapiens
auaaagccacugaa

SEQ ID NO: 2040755 - RNA, 20 nt, Homo sapiens
cugucaaagaaaacuuccaa

SEQ ID NO: 2040756 - RNA, 16 nt, Homo sapiens
gguccaugcagggggc

SEQ ID NO: 2040757 - RNA, 22 nt, Homo sapiens
auucuaaauaaauuucccaguu

SEQ ID NO: 2040758 - RNA, 13 nt, Homo sapiens
gauccucuugcca

SEQ ID NO: 2040759 - RNA, 16 nt, Homo sapiens
accaagcagcaggaau

SEQ ID NO: 2040760 - RNA, 15 nt, Homo sapiens
aaacaaauaauagca

SEQ ID NO: 2040761 - RNA, 20 nt, Homo sapiens
cgagcuagcuucugcaaugu

SEQ ID NO: 2040762 - RNA, 19 nt, Homo sapiens
gggaaggcgacugagccau

SEQ ID NO: 2040763 - RNA, 14 nt, Homo sapiens
uccauggacucaga

SEQ ID NO: 2040764 - RNA, 15 nt, Homo sapiens
gcuucaaaugcaaau

SEQ ID NO: 2040765 - RNA, 14 nt, Homo sapiens
ccccaagugaccua

SEQ ID NO: 2040766 - RNA, 18 nt, Homo sapiens
cuugccugaauccaucag

SEQ ID NO: 2040767 - RNA, 16 nt, Homo sapiens
cauauaauguaaaaag

SEQ ID NO: 2040768 - RNA, 14 nt, Homo sapiens
cuggaaaccagaau

SEQ ID NO: 2040769 - RNA, 20 nt, Homo sapiens
cagauccuuuuccaucccac

SEQ ID NO: 2040770 - RNA, 13 nt, Homo sapiens
aucucuuccuguc

SEQ ID NO: 2040771 - RNA, 16 nt, Homo sapiens
agguggccccaguuca

SEQ ID NO: 2040772 - RNA, 23 nt, Homo sapiens
caagaaaacaacuucaauaucca

SEQ ID NO: 2040773 - RNA, 15 nt, Homo sapiens
uacuccaucauggcu

SEQ ID NO: 2040774 - RNA, 18 nt, Homo sapiens
accagcgugugacuacuc

SEQ ID NO: 2040775 - RNA, 21 nt, Homo sapiens
ucacacacggaggccagacac

SEQ ID NO: 2040776 - RNA, 21 nt, Homo sapiens
ugagcaaaaccaaauauucca

SEQ ID NO: 2040777 - RNA, 15 nt, Homo sapiens
gacuggaaccaggga

SEQ ID NO: 2040778 - RNA, 22 nt, Homo sapiens
gggagaacgcggggaccccaga

SEQ ID NO: 2040779 - RNA, 13 nt, Homo sapiens
agggguauguucc

SEQ ID NO: 2040780 - RNA, 15 nt, Homo sapiens
auugaaguguauaau

SEQ ID NO: 2040781 - RNA, 23 nt, Homo sapiens
uaccugccaugcauacaugcugc

SEQ ID NO: 2040782 - RNA, 18 nt, Homo sapiens
cuggcuuacuuccuaguc

SEQ ID NO: 2040783 - RNA, 17 nt, Homo sapiens
aaaauguauaucucucc

SEQ ID NO: 2040784 - RNA, 19 nt, Homo sapiens
aucuuuuuuuuaggcaaaa

SEQ ID NO: 2040785 - RNA, 17 nt, Homo sapiens
ugcaagcagaugacaaa

SEQ ID NO: 2040786 - RNA, 19 nt, Homo sapiens
uccuugccugaacuccaga

SEQ ID NO: 2040787 - RNA, 16 nt, Homo sapiens
ggcaaugaaaccaaag

SEQ ID NO: 2040788 - RNA, 13 nt, Homo sapiens
gagacucuagggu

SEQ ID NO: 2040789 - RNA, 19 nt, Homo sapiens
cagcuuugcuaccaaagca

SEQ ID NO: 2040790 - RNA, 16 nt, Homo sapiens
guaugugacuuuucug

SEQ ID NO: 2040791 - RNA, 12 nt, Homo sapiens
uuccccacugac

SEQ ID NO: 2040792 - RNA, 20 nt, Homo sapiens
ugaaaaauguguuccauugc

SEQ ID NO: 2040793 - RNA, 19 nt, Homo sapiens
caagaacuccugaaaucau

SEQ ID NO: 2040794 - RNA, 20 nt, Homo sapiens
ucucaggggucuuaccuuga

SEQ ID NO: 2040795 - RNA, 20 nt, Homo sapiens
gagccagucuaguuccugau

SEQ ID NO: 2040796 - RNA, 14 nt, Homo sapiens
uggcuuuugugcau

SEQ ID NO: 2040797 - RNA, 16 nt, Homo sapiens
cuccaaaguccacaca

SEQ ID NO: 2040798 - RNA, 17 nt, Homo sapiens
cuuaguauuucucagga

SEQ ID NO: 2040799 - RNA, 22 nt, Homo sapiens
ugugauuuuucugcacuaauau

SEQ ID NO: 2040800 - RNA, 21 nt, Homo sapiens
ccauugccaucagugaucuca

SEQ ID NO: 2040801 - RNA, 14 nt, Homo sapiens
cacugcacuuggug

SEQ ID NO: 2040802 - RNA, 17 nt, Homo sapiens
gaaacuagcuuuugcca

SEQ ID NO: 2040803 - RNA, 23 nt, Homo sapiens
ggaaaggccuguggggagccgag

SEQ ID NO: 2040804 - RNA, 13 nt, Homo sapiens
ccucuccccucau

SEQ ID NO: 2040805 - RNA, 12 nt, Homo sapiens
cuuaauuugauu

SEQ ID NO: 2040806 - RNA, 14 nt, Homo sapiens
aauaugacacagcu

SEQ ID NO: 2040807 - RNA, 20 nt, Homo sapiens
agaucuccaacagccagugu

SEQ ID NO: 2040808 - RNA, 18 nt, Homo sapiens
uuucauuguaaucaaaaa

SEQ ID NO: 2040809 - RNA, 20 nt, Homo sapiens
uaaagaaacgguaugacuua

SEQ ID NO: 2040810 - RNA, 16 nt, Homo sapiens
caugugacacacuggc

SEQ ID NO: 2040811 - RNA, 20 nt, Homo sapiens
aggagacugagaccauccug

SEQ ID NO: 2040812 - RNA, 17 nt, Homo sapiens
cagcucuguccugggag

SEQ ID NO: 2040813 - RNA, 19 nt, Homo sapiens
ggcaagcgcuucugcugaa

SEQ ID NO: 2040814 - RNA, 21 nt, Homo sapiens
agacacagauuuuuacacuaa

SEQ ID NO: 2040815 - RNA, 18 nt, Homo sapiens
auaugcuuguaacuaaaa

SEQ ID NO: 2040816 - RNA, 13 nt, Homo sapiens
ucuucuacacagc

SEQ ID NO: 2040817 - RNA, 15 nt, Homo sapiens
ugugcgaacacagug

SEQ ID NO: 2040818 - RNA, 20 nt, Homo sapiens
aaauucauuugcuugcaauc

SEQ ID NO: 2040819 - RNA, 14 nt, Homo sapiens
gauuuuuaccuuug

SEQ ID NO: 2040820 - RNA, 13 nt, Homo sapiens
uugguuggcagaa

SEQ ID NO: 2040821 - RNA, 21 nt, Homo sapiens
gaaaaccacagucaguggaga

SEQ ID NO: 2040822 - RNA, 13 nt, Homo sapiens
cugaagccauagc

SEQ ID NO: 2040823 - RNA, 13 nt, Homo sapiens
cugccaccugccc

SEQ ID NO: 2040824 - RNA, 15 nt, Homo sapiens
cuccuugcaccggcc

SEQ ID NO: 2040825 - RNA, 14 nt, Homo sapiens
uaggaaauuccuuc

SEQ ID NO: 2040826 - RNA, 18 nt, Homo sapiens
aaccuagcacgugccagu

SEQ ID NO: 2040827 - RNA, 20 nt, Homo sapiens
cugagcucauuuggggacca

SEQ ID NO: 2040828 - RNA, 19 nt, Homo sapiens
gaucggcuuccucaggggc

SEQ ID NO: 2040829 - RNA, 21 nt, Homo sapiens
aauuugggcagauauagcauu

SEQ ID NO: 2040830 - RNA, 18 nt, Homo sapiens
auuauacacuaugaaacc

SEQ ID NO: 2040831 - RNA, 14 nt, Homo sapiens
uuccagagccagaa

SEQ ID NO: 2040832 - RNA, 19 nt, Homo sapiens
ucagcaccaagagcagcug

SEQ ID NO: 2040833 - RNA, 16 nt, Homo sapiens
aguucagagucuucag

SEQ ID NO: 2040834 - RNA, 15 nt, Homo sapiens
cacagcaugcauuua

SEQ ID NO: 2040835 - RNA, 16 nt, Homo sapiens
auuuagauaugcaaaa

SEQ ID NO: 2040836 - RNA, 22 nt, Homo sapiens
gugcauucaaccuuaccaaaaa

SEQ ID NO: 2040837 - RNA, 14 nt, Homo sapiens
augaaacuggaaaa

SEQ ID NO: 2040838 - RNA, 13 nt, Homo sapiens
uuuugaaagaagc

SEQ ID NO: 2040839 - RNA, 17 nt, Homo sapiens
uacauaucugacuucua

SEQ ID NO: 2040840 - RNA, 16 nt, Homo sapiens
ccacuuagagaacaaa

SEQ ID NO: 2040841 - RNA, 17 nt, Homo sapiens
acaggcaaauuccugac

SEQ ID NO: 2040842 - RNA, 19 nt, Homo sapiens
uaaguguauuuuaaaugug

SEQ ID NO: 2040843 - RNA, 18 nt, Homo sapiens
ugaggccccugugcagua

SEQ ID NO: 2040844 - RNA, 21 nt, Homo sapiens
auaugaguaauacaucaaaga

SEQ ID NO: 2040845 - RNA, 17 nt, Homo sapiens
auucuucagaaugucag

SEQ ID NO: 2040846 - RNA, 21 nt, Homo sapiens
ucugaaaggguuuuuaaucuc

SEQ ID NO: 2040847 - RNA, 14 nt, Homo sapiens
cuccaaaaugugcc

SEQ ID NO: 2040848 - RNA, 23 nt, Homo sapiens
uguugaccaucacugccaucaca

SEQ ID NO: 2040849 - RNA, 21 nt, Homo sapiens
caagaagugggauucaggaau

SEQ ID NO: 2040850 - RNA, 18 nt, Homo sapiens
augauucaaauugcugcu

SEQ ID NO: 2040851 - RNA, 18 nt, Homo sapiens
acaucuccccucuacccc

SEQ ID NO: 2040852 - RNA, 15 nt, Homo sapiens
caagguagaacaaag

SEQ ID NO: 2040853 - RNA, 16 nt, Homo sapiens
gagagauaccuugaaa

SEQ ID NO: 2040854 - RNA, 15 nt, Homo sapiens
uacuugaaaaccuca

SEQ ID NO: 2040855 - RNA, 21 nt, Homo sapiens
acgcuuugucacacaaaaagu

SEQ ID NO: 2040856 - RNA, 17 nt, Homo sapiens
agacauuaaaccuggau

SEQ ID NO: 2040857 - RNA, 19 nt, Homo sapiens
uccagcccucucacugugu

SEQ ID NO: 2040858 - RNA, 23 nt, Homo sapiens
guaucauuucaugcuuugauuua

SEQ ID NO: 2040859 - RNA, 18 nt, Homo sapiens
ccucugaggcacucaucu

SEQ ID NO: 2040860 - RNA, 17 nt, Homo sapiens
aaagucugaaucuccca

SEQ ID NO: 2040861 - RNA, 14 nt, Homo sapiens
gaauuuaaugucua

SEQ ID NO: 2040862 - RNA, 13 nt, Homo sapiens
cagauaaugugaa

SEQ ID NO: 2040863 - RNA, 13 nt, Homo sapiens
agguccucuacuu

SEQ ID NO: 2040864 - RNA, 14 nt, Homo sapiens
caaccuuccagcuc

SEQ ID NO: 2040865 - RNA, 22 nt, Homo sapiens
aguuucagagaaauacuuucag

SEQ ID NO: 2040866 - RNA, 14 nt, Homo sapiens
gucuuuugcagcuu

SEQ ID NO: 2040867 - RNA, 13 nt, Homo sapiens
agcccagcacaac

SEQ ID NO: 2040868 - RNA, 14 nt, Homo sapiens
ucaccgccaugcaa

SEQ ID NO: 2040869 - RNA, 21 nt, Homo sapiens
ucacucaaccauaacacuuga

SEQ ID NO: 2040870 - RNA, 16 nt, Homo sapiens
acuguauaaguaacac

SEQ ID NO: 2040871 - RNA, 15 nt, Homo sapiens
cucaugggugggaca

SEQ ID NO: 2040872 - RNA, 19 nt, Homo sapiens
accccaaaggaacacugac

SEQ ID NO: 2040873 - RNA, 20 nt, Homo sapiens
gggaguaggacauaccagcu

SEQ ID NO: 2040874 - RNA, 17 nt, Homo sapiens
cacacaaaaaaggcagu

SEQ ID NO: 2040875 - RNA, 22 nt, Homo sapiens
agcacuuuuuggcugacuucau

SEQ ID NO: 2040876 - RNA, 20 nt, Homo sapiens
ggcucagugcaaccucugcu

SEQ ID NO: 2040877 - RNA, 22 nt, Homo sapiens
ugaaacugcuugagcaucagga

SEQ ID NO: 2040878 - RNA, 20 nt, Homo sapiens
aaaguaucuugcacugauaa

SEQ ID NO: 2040879 - RNA, 19 nt, Homo sapiens
cugggcuucgucuacuccu

SEQ ID NO: 2040880 - RNA, 12 nt, Homo sapiens
uagaaaccugcc

SEQ ID NO: 2040881 - RNA, 16 nt, Homo sapiens
gccugaacacugcuuc

SEQ ID NO: 2040882 - RNA, 20 nt, Homo sapiens
uggaagaguguuucuuccac

SEQ ID NO: 2040883 - RNA, 16 nt, Homo sapiens
aaauaguaaacauuaa

SEQ ID NO: 2040884 - RNA, 20 nt, Homo sapiens
augaucaaaaccugugccag

SEQ ID NO: 2040885 - RNA, 16 nt, Homo sapiens
caaauuauugauuaau

SEQ ID NO: 2040886 - RNA, 15 nt, Homo sapiens
cagaucacuacugca

SEQ ID NO: 2040887 - RNA, 12 nt, Homo sapiens
guggugccacau

SEQ ID NO: 2040888 - RNA, 19 nt, Homo sapiens
agccgggguguaacuuccu

SEQ ID NO: 2040889 - RNA, 14 nt, Homo sapiens
uauuuaguugauag

SEQ ID NO: 2040890 - RNA, 23 nt, Homo sapiens
aauguugcauuuaugaugcaguu

SEQ ID NO: 2040891 - RNA, 16 nt, Homo sapiens
uaggagaccauuugau

SEQ ID NO: 2040892 - RNA, 21 nt, Homo sapiens
uccauuccugaguuacuuccc

SEQ ID NO: 2040893 - RNA, 15 nt, Homo sapiens
ggcuguccuccuucc

SEQ ID NO: 2040894 - RNA, 21 nt, Homo sapiens
gguuuuuaucaaauuugccau

SEQ ID NO: 2040895 - RNA, 13 nt, Homo sapiens
gagcgggggcuaa

SEQ ID NO: 2040896 - RNA, 14 nt, Homo sapiens
auugcuaccaaaaa

SEQ ID NO: 2040897 - RNA, 23 nt, Homo sapiens
gaaacaaauagcuguugacguuu

SEQ ID NO: 2040898 - RNA, 15 nt, Homo sapiens
ccuacagacuaagaa

SEQ ID NO: 2040899 - RNA, 18 nt, Homo sapiens
ccauccagccaccaccua

SEQ ID NO: 2040900 - RNA, 21 nt, Homo sapiens
ggagaacuugcucaagugcag

SEQ ID NO: 2040901 - RNA, 22 nt, Homo sapiens
gugaaugcugcugagugaauga

SEQ ID NO: 2040902 - RNA, 12 nt, Homo sapiens
cuuuacucuuga

SEQ ID NO: 2040903 - RNA, 14 nt, Homo sapiens
cuuauccaacucuc

SEQ ID NO: 2040904 - RNA, 15 nt, Homo sapiens
gagagagcuuggaau

SEQ ID NO: 2040905 - RNA, 23 nt, Homo sapiens
agguaaguguaugaucuuaggga

SEQ ID NO: 2040906 - RNA, 21 nt, Homo sapiens
aauauaggguuuguuugcugc

SEQ ID NO: 2040907 - RNA, 18 nt, Homo sapiens
agccucuccccugauuac

SEQ ID NO: 2040908 - RNA, 21 nt, Homo sapiens
ggcagaaagauggagaggcau

SEQ ID NO: 2040909 - RNA, 23 nt, Homo sapiens
ucccagaguccucugguuccuua

SEQ ID NO: 2040910 - RNA, 17 nt, Homo sapiens
aaaaauauauuuccuca

SEQ ID NO: 2040911 - RNA, 16 nt, Homo sapiens
gauuaccgacacuguc

SEQ ID NO: 2040912 - RNA, 19 nt, Homo sapiens
cucuccugcccaagcacuu

SEQ ID NO: 2040913 - RNA, 23 nt, Homo sapiens
acuuagaaauugcauuuccugac

SEQ ID NO: 2040914 - RNA, 15 nt, Homo sapiens
ucaguuccaaaguca

SEQ ID NO: 2040915 - RNA, 17 nt, Homo sapiens
aauacagggcaugcauu

SEQ ID NO: 2040916 - RNA, 20 nt, Homo sapiens
gcccuugggguaagccagag

SEQ ID NO: 2040917 - RNA, 15 nt, Homo sapiens
cggcugcaucuucca

SEQ ID NO: 2040918 - RNA, 19 nt, Homo sapiens
cuacugggagccuacccac

SEQ ID NO: 2040919 - RNA, 16 nt, Homo sapiens
augugagguguugcua

SEQ ID NO: 2040920 - RNA, 17 nt, Homo sapiens
ccucugugccuugccac

SEQ ID NO: 2040921 - RNA, 18 nt, Homo sapiens
augacugcacccagcucc

SEQ ID NO: 2040922 - RNA, 18 nt, Homo sapiens
auggaagcaauugcucau

SEQ ID NO: 2040923 - RNA, 18 nt, Homo sapiens
uccuaguggaugacuguu

SEQ ID NO: 2040924 - RNA, 16 nt, Homo sapiens
gaaaauggaagacagc

SEQ ID NO: 2040925 - RNA, 14 nt, Homo sapiens
aucaagucagcaac

SEQ ID NO: 2040926 - RNA, 23 nt, Homo sapiens
uaaagaaugcuggguguugcauu

SEQ ID NO: 2040927 - RNA, 17 nt, Homo sapiens
ccagagggacacuagga

SEQ ID NO: 2040928 - RNA, 12 nt, Homo sapiens
gaugcaccgugg

SEQ ID NO: 2040929 - RNA, 15 nt, Homo sapiens
cugcccagcucugag

SEQ ID NO: 2040930 - RNA, 17 nt, Homo sapiens
cugugcgugccauccag

SEQ ID NO: 2040931 - RNA, 19 nt, Homo sapiens
caagugcuuccuacaaaga

SEQ ID NO: 2040932 - RNA, 16 nt, Homo sapiens
cacccagagcuuuccu

SEQ ID NO: 2040933 - RNA, 13 nt, Homo sapiens
uuuaauugugaua

SEQ ID NO: 2040934 - RNA, 16 nt, Homo sapiens
acuuucuguaaucaca

SEQ ID NO: 2040935 - RNA, 13 nt, Homo sapiens
uaguggucuuugu

SEQ ID NO: 2040936 - RNA, 17 nt, Homo sapiens
gcacaggccacuugcuc

SEQ ID NO: 2040937 - RNA, 21 nt, Homo sapiens
caggcaugaggaaucugggag

SEQ ID NO: 2040938 - RNA, 19 nt, Homo sapiens
agagacugcccuucucacg

SEQ ID NO: 2040939 - RNA, 16 nt, Homo sapiens
uaauuacauauuugac

SEQ ID NO: 2040940 - RNA, 19 nt, Homo sapiens
augguuaguuucacuuuuu

SEQ ID NO: 2040941 - RNA, 23 nt, Homo sapiens
uccucgacaucuuccuccucuac

SEQ ID NO: 2040942 - RNA, 18 nt, Homo sapiens
accccucuuccagcuucu

SEQ ID NO: 2040943 - RNA, 23 nt, Homo sapiens
aaaguauaauuugcuggaacaca

SEQ ID NO: 2040944 - RNA, 19 nt, Homo sapiens
uagguggcacacugggugc

SEQ ID NO: 2040945 - RNA, 16 nt, Homo sapiens
aagauuuucaaacaaa

SEQ ID NO: 2040946 - RNA, 23 nt, Homo sapiens
gaucucagcucacugcaaccucc

SEQ ID NO: 2040947 - RNA, 16 nt, Homo sapiens
acuccugaaagcccug

SEQ ID NO: 2040948 - RNA, 14 nt, Homo sapiens
cccugccuuugaaa

SEQ ID NO: 2040949 - RNA, 21 nt, Homo sapiens
acuccagauuuuuuacagcug

SEQ ID NO: 2040950 - RNA, 13 nt, Homo sapiens
aaaauaaauucca

SEQ ID NO: 2040951 - RNA, 13 nt, Homo sapiens
ugaaccaagcuau

SEQ ID NO: 2040952 - RNA, 20 nt, Homo sapiens
ccugacauauucaagugaua

SEQ ID NO: 2040953 - RNA, 17 nt, Homo sapiens
ugauuuguaaugagcac

SEQ ID NO: 2040954 - RNA, 14 nt, Homo sapiens
aaguaaagcccaga

SEQ ID NO: 2040955 - RNA, 17 nt, Homo sapiens
guacaaugugacuuuga

SEQ ID NO: 2040956 - RNA, 18 nt, Homo sapiens
agcuccugguagcugaug

SEQ ID NO: 2040957 - RNA, 18 nt, Homo sapiens
ucuagggaaucuggauua

SEQ ID NO: 2040958 - RNA, 22 nt, Homo sapiens
ugauuaucucuuugaucuacuu

SEQ ID NO: 2040959 - RNA, 18 nt, Homo sapiens
guguucuucaagccagcu

SEQ ID NO: 2040960 - RNA, 18 nt, Homo sapiens
ugcacacaaacaccuccu

SEQ ID NO: 2040961 - RNA, 20 nt, Homo sapiens
gaaaacucccaauacaaaga

SEQ ID NO: 2040962 - RNA, 13 nt, Homo sapiens
agauucccagugu

SEQ ID NO: 2040963 - RNA, 21 nt, Homo sapiens
caaaacuguucuuuugcauuu

SEQ ID NO: 2040964 - RNA, 17 nt, Homo sapiens
uuguaugucuguguaug

SEQ ID NO: 2040965 - RNA, 20 nt, Homo sapiens
gaucgugcuacugcacucca

SEQ ID NO: 2040966 - RNA, 20 nt, Homo sapiens
gccuggcucccucacucuca

SEQ ID NO: 2040967 - RNA, 12 nt, Homo sapiens
cuaaucaaguca

SEQ ID NO: 2040968 - RNA, 21 nt, Homo sapiens
auuuuccaguaggaaaagcaa

SEQ ID NO: 2040969 - RNA, 22 nt, Homo sapiens
gcagaguugugcaugccccuga

SEQ ID NO: 2040970 - RNA, 13 nt, Homo sapiens
uccacauguucaa

SEQ ID NO: 2040971 - RNA, 18 nt, Homo sapiens
ccagggcuguaacugcca

SEQ ID NO: 2040972 - RNA, 14 nt, Homo sapiens
uuugauagaaccau

SEQ ID NO: 2040973 - RNA, 17 nt, Homo sapiens
cauuguagaaacacagu

SEQ ID NO: 2040974 - RNA, 15 nt, Homo sapiens
uccuuacucugagga

SEQ ID NO: 2040975 - RNA, 18 nt, Homo sapiens
caauaaaaccaagugcuu

SEQ ID NO: 2040976 - RNA, 19 nt, Homo sapiens
gauugaggagcugcacuga

SEQ ID NO: 2040977 - RNA, 19 nt, Homo sapiens
cagagcacaggagcugcca

SEQ ID NO: 2040978 - RNA, 19 nt, Homo sapiens
auugggcuugugauuucca

SEQ ID NO: 2040979 - RNA, 15 nt, Homo sapiens
cccuucugcucagcu

SEQ ID NO: 2040980 - RNA, 14 nt, Homo sapiens
uaucuauuaucuca

SEQ ID NO: 2040981 - RNA, 14 nt, Homo sapiens
uuucuucauuaaga

SEQ ID NO: 2040982 - RNA, 15 nt, Homo sapiens
ccugacaaaagggac

SEQ ID NO: 2040983 - RNA, 13 nt, Homo sapiens
ucuggacugcaca

SEQ ID NO: 2040984 - RNA, 13 nt, Homo sapiens
gccagagugcagu

SEQ ID NO: 2040985 - RNA, 22 nt, Homo sapiens
auaaaguguuugaaagcuuuau

SEQ ID NO: 2040986 - RNA, 16 nt, Homo sapiens
ggaagcacugccauua

SEQ ID NO: 2040987 - RNA, 14 nt, Homo sapiens
uaaaaccacuguac

SEQ ID NO: 2040988 - RNA, 19 nt, Homo sapiens
gaaauugaaaaugaccaaa

SEQ ID NO: 2040989 - RNA, 14 nt, Homo sapiens
ggcuucucuuucuc

SEQ ID NO: 2040990 - RNA, 12 nt, Homo sapiens
cagcggaugcug

SEQ ID NO: 2040991 - RNA, 18 nt, Homo sapiens
agaagccuauguccguuc

SEQ ID NO: 2040992 - RNA, 22 nt, Homo sapiens
ccuccagggcgagcacuuucca

SEQ ID NO: 2040993 - RNA, 15 nt, Homo sapiens
uuuauuaacuauuua

SEQ ID NO: 2040994 - RNA, 16 nt, Homo sapiens
ccacacagggugcaug

SEQ ID NO: 2040995 - RNA, 19 nt, Homo sapiens
ggcuucacugcugugacuu

SEQ ID NO: 2040996 - RNA, 14 nt, Homo sapiens
guccagcagucacu

SEQ ID NO: 2040997 - RNA, 14 nt, Homo sapiens
gcuuuucugccaca

SEQ ID NO: 2040998 - RNA, 21 nt, Homo sapiens
aauccaggcuacaaucuucau

SEQ ID NO: 2040999 - RNA, 12 nt, Homo sapiens
gcacacacugug

SEQ ID NO: 2041000 - RNA, 14 nt, Homo sapiens
agaauuguaucauu

SEQ ID NO: 2041001 - RNA, 17 nt, Homo sapiens
ccugcagcccaugguga

SEQ ID NO: 2041002 - RNA, 20 nt, Homo sapiens
acuguuccaaagccagugaa

SEQ ID NO: 2041003 - RNA, 16 nt, Homo sapiens
gccucugaucugugca

SEQ ID NO: 2041004 - RNA, 13 nt, Homo sapiens
auacacacaggag

SEQ ID NO: 2041005 - RNA, 14 nt, Homo sapiens
aacagaccagugac

SEQ ID NO: 2041006 - RNA, 18 nt, Homo sapiens
gcccaucaauuauagaaa

SEQ ID NO: 2041007 - RNA, 23 nt, Homo sapiens
auggaaagguccugcuguggaaa

SEQ ID NO: 2041008 - RNA, 20 nt, Homo sapiens
cccuuggccuccauuucugu

SEQ ID NO: 2041009 - RNA, 19 nt, Homo sapiens
gagcaaaucaauucuaguc

SEQ ID NO: 2041010 - RNA, 17 nt, Homo sapiens
caagugauaucaccucu

SEQ ID NO: 2041011 - RNA, 21 nt, Homo sapiens
accucauuccggccacaucau

SEQ ID NO: 2041012 - RNA, 17 nt, Homo sapiens
aaaacagacccucccac

SEQ ID NO: 2041013 - RNA, 16 nt, Homo sapiens
gcaauuucacugaugu

SEQ ID NO: 2041014 - RNA, 19 nt, Homo sapiens
acucuuagccccagacucu

SEQ ID NO: 2041015 - RNA, 15 nt, Homo sapiens
caaggcugugccagg

SEQ ID NO: 2041016 - RNA, 14 nt, Homo sapiens
uuuggggacagagu

SEQ ID NO: 2041017 - RNA, 9 nt, Homo sapiens
aaauucugu

SEQ ID NO: 2041018 - RNA, 17 nt, Homo sapiens
acugcauagcagaccac

SEQ ID NO: 2041019 - RNA, 16 nt, Homo sapiens
aucucaagagcccugu

SEQ ID NO: 2041020 - RNA, 18 nt, Homo sapiens
gaccaaauaaaguaccau

SEQ ID NO: 2041021 - RNA, 15 nt, Homo sapiens
aggccauucuugcau

SEQ ID NO: 2041022 - RNA, 15 nt, Homo sapiens
uaauaaaauaaucau

SEQ ID NO: 2041023 - RNA, 15 nt, Homo sapiens
cagcccaacagcacu

SEQ ID NO: 2041024 - RNA, 23 nt, Homo sapiens
uccaucacccucuuccugugauc

SEQ ID NO: 2041025 - RNA, 12 nt, Homo sapiens
ugggcucaggga

SEQ ID NO: 2041026 - RNA, 20 nt, Homo sapiens
acagaguugccaggcacuuu

SEQ ID NO: 2041027 - RNA, 19 nt, Homo sapiens
cucugccugagacuuucag

SEQ ID NO: 2041028 - RNA, 19 nt, Homo sapiens
ggcuuuuccaaaucaagga

SEQ ID NO: 2041029 - RNA, 17 nt, Homo sapiens
uuucugagcaaagcauc

SEQ ID NO: 2041030 - RNA, 18 nt, Homo sapiens
ucugagugaauacuuuga

SEQ ID NO: 2041031 - RNA, 23 nt, Homo sapiens
accaaaaugagaguuuugcuaaa

SEQ ID NO: 2041032 - RNA, 15 nt, Homo sapiens
aacacacagcaacau

SEQ ID NO: 2041033 - RNA, 21 nt, Homo sapiens
auguuuuuuauccccaaacac

SEQ ID NO: 2041034 - RNA, 20 nt, Homo sapiens
ugcacucuagccugggugac

SEQ ID NO: 2041035 - RNA, 11 nt, Homo sapiens
agaaaugccag

SEQ ID NO: 2041036 - RNA, 19 nt, Homo sapiens
cacccggcucccccugcuu

SEQ ID NO: 2041037 - RNA, 16 nt, Homo sapiens
ucacugaaucuucacg

SEQ ID NO: 2041038 - RNA, 19 nt, Homo sapiens
caggagauccuaauaugaa

SEQ ID NO: 2041039 - RNA, 12 nt, Homo sapiens
caaucauugcaa

SEQ ID NO: 2041040 - RNA, 17 nt, Homo sapiens
uaaauguaacagucuga

SEQ ID NO: 2041041 - RNA, 22 nt, Homo sapiens
gaacuacaagugugagccaccg

SEQ ID NO: 2041042 - RNA, 17 nt, Homo sapiens
acuuagcuggccaagga

SEQ ID NO: 2041043 - RNA, 15 nt, Homo sapiens
gaggaguucaaugau

SEQ ID NO: 2041044 - RNA, 15 nt, Homo sapiens
acuugagauaaucua

SEQ ID NO: 2041045 - RNA, 13 nt, Homo sapiens
gaacacagugccu

SEQ ID NO: 2041046 - RNA, 23 nt, Homo sapiens
caucuugcucugcugacagacac

SEQ ID NO: 2041047 - RNA, 19 nt, Homo sapiens
augugugaguguaauucca

SEQ ID NO: 2041048 - RNA, 17 nt, Homo sapiens
cugguauggugcuaaua

SEQ ID NO: 2041049 - RNA, 22 nt, Homo sapiens
uguaauugcaugacaaaccuua

SEQ ID NO: 2041050 - RNA, 20 nt, Homo sapiens
acagcugcuggagacuccua

SEQ ID NO: 2041051 - RNA, 23 nt, Homo sapiens
ggaauuacaaaacucagagaaau

SEQ ID NO: 2041052 - RNA, 19 nt, Homo sapiens
cugauaugggacugagccu

SEQ ID NO: 2041053 - RNA, 16 nt, Homo sapiens
aaacuccugaguucaa

SEQ ID NO: 2041054 - RNA, 16 nt, Homo sapiens
guauuaauaugcuaca

SEQ ID NO: 2041055 - RNA, 17 nt, Homo sapiens
acacucccugcuugcag

SEQ ID NO: 2041056 - RNA, 17 nt, Homo sapiens
uucagauuccacacaaa

SEQ ID NO: 2041057 - RNA, 14 nt, Homo sapiens
uaacugaaccaaau

SEQ ID NO: 2041058 - RNA, 22 nt, Homo sapiens
ucacauugugugaauacuggaa

SEQ ID NO: 2041059 - RNA, 13 nt, Homo sapiens
agugaaucuguau

SEQ ID NO: 2041060 - RNA, 16 nt, Homo sapiens
uagaaaugauucacca

SEQ ID NO: 2041061 - RNA, 15 nt, Homo sapiens
aguugagaaagucac

SEQ ID NO: 2041062 - RNA, 19 nt, Homo sapiens
acagcccaggcaucuccuu

SEQ ID NO: 2041063 - RNA, 17 nt, Homo sapiens
uggcaguggccaggcag

SEQ ID NO: 2041064 - RNA, 13 nt, Homo sapiens
aggcuaaggauag

SEQ ID NO: 2041065 - RNA, 23 nt, Homo sapiens
gucuccuggaccuugacagagca

SEQ ID NO: 2041066 - RNA, 20 nt, Homo sapiens
ucaaguuuuucagaaagcau

SEQ ID NO: 2041067 - RNA, 11 nt, Homo sapiens
ccagaccucaa

SEQ ID NO: 2041068 - RNA, 14 nt, Homo sapiens
cuggcugauuauca

SEQ ID NO: 2041069 - RNA, 20 nt, Homo sapiens
aauaaaagaugauuucucaa

SEQ ID NO: 2041070 - RNA, 13 nt, Homo sapiens
gacucugcucucc

SEQ ID NO: 2041071 - RNA, 23 nt, Homo sapiens
aauguauauuugcugcaaagaga

SEQ ID NO: 2041072 - RNA, 17 nt, Homo sapiens
gagcucuagcaagggag

SEQ ID NO: 2041073 - RNA, 22 nt, Homo sapiens
auauuggcugguaaauugccau

SEQ ID NO: 2041074 - RNA, 22 nt, Homo sapiens
ucgaccacgggaagcaucuucc

SEQ ID NO: 2041075 - RNA, 14 nt, Homo sapiens
aggauuucagccau

SEQ ID NO: 2041076 - RNA, 19 nt, Homo sapiens
uucaggguuuuaaacacua

SEQ ID NO: 2041077 - RNA, 18 nt, Homo sapiens
ucaauguuucacuacucu

SEQ ID NO: 2041078 - RNA, 16 nt, Homo sapiens
gcaacccucacugugu

SEQ ID NO: 2041079 - RNA, 16 nt, Homo sapiens
aaggcaucauuuucac

SEQ ID NO: 2041080 - RNA, 16 nt, Homo sapiens
ccuuuacguucaucac

SEQ ID NO: 2041081 - RNA, 19 nt, Homo sapiens
ucaguugugaauacauucu

SEQ ID NO: 2041082 - RNA, 17 nt, Homo sapiens
aaacuuuguaaaauauc

SEQ ID NO: 2041083 - RNA, 18 nt, Homo sapiens
acugucccugccaaugcu

SEQ ID NO: 2041084 - RNA, 22 nt, Homo sapiens
cuaauguaugcauucauccaac

SEQ ID NO: 2041085 - RNA, 12 nt, Homo sapiens
uagagccagcuu

SEQ ID NO: 2041086 - RNA, 16 nt, Homo sapiens
ucacccaacucaagga

SEQ ID NO: 2041087 - RNA, 22 nt, Homo sapiens
aaacugagaugugaacacauca

SEQ ID NO: 2041088 - RNA, 15 nt, Homo sapiens
ccaugagugugccac

SEQ ID NO: 2041089 - RNA, 14 nt, Homo sapiens
cuuaccacaguguu

SEQ ID NO: 2041090 - RNA, 19 nt, Homo sapiens
uaaaacaacacgauuuaca

SEQ ID NO: 2041091 - RNA, 14 nt, Homo sapiens
ggcacuucacagag

SEQ ID NO: 2041092 - RNA, 17 nt, Homo sapiens
guccccuaaaccaaaaa

SEQ ID NO: 2041093 - RNA, 13 nt, Homo sapiens
cauguucaugggu

SEQ ID NO: 2041094 - RNA, 17 nt, Homo sapiens
ggggacccuccaaagga

SEQ ID NO: 2041095 - RNA, 12 nt, Homo sapiens
agccugugauua

SEQ ID NO: 2041096 - RNA, 21 nt, Homo sapiens
gacagucacugccacuuugca

SEQ ID NO: 2041097 - RNA, 16 nt, Homo sapiens
ccugugagcagggauu

SEQ ID NO: 2041098 - RNA, 20 nt, Homo sapiens
aagacaaaugcaacauuuua

SEQ ID NO: 2041099 - RNA, 17 nt, Homo sapiens
uuuugcacaaggaaaua

SEQ ID NO: 2041100 - RNA, 13 nt, Homo sapiens
gagggcauuccau

SEQ ID NO: 2041101 - RNA, 22 nt, Homo sapiens
aauaaugugacgaaaguggaaa

SEQ ID NO: 2041102 - RNA, 21 nt, Homo sapiens
gaaucugcauuuagcacaaaa

SEQ ID NO: 2041103 - RNA, 22 nt, Homo sapiens
accuagagaagcagaauccuua

SEQ ID NO: 2041104 - RNA, 22 nt, Homo sapiens
ucauauugcuaccaaaaacuag

SEQ ID NO: 2041105 - RNA, 23 nt, Homo sapiens
aauacaucagaaaauaaaauauu

SEQ ID NO: 2041106 - RNA, 22 nt, Homo sapiens
cagcaugaggacagaccacaga

SEQ ID NO: 2041107 - RNA, 11 nt, Homo sapiens
uuucccugugu

SEQ ID NO: 2041108 - RNA, 14 nt, Homo sapiens
uguuuuccaauauu

SEQ ID NO: 2041109 - RNA, 13 nt, Homo sapiens
cuucuuacuugau

SEQ ID NO: 2041110 - RNA, 13 nt, Homo sapiens
cuuacuacuugcc

SEQ ID NO: 2041111 - RNA, 13 nt, Homo sapiens
gcacugcugcugc

SEQ ID NO: 2041112 - RNA, 21 nt, Homo sapiens
gcuccagcucauaugcugaca

SEQ ID NO: 2041113 - RNA, 14 nt, Homo sapiens
uaaagacuaggaua

SEQ ID NO: 2041114 - RNA, 23 nt, Homo sapiens
acaagauagccaccgagauccuu

SEQ ID NO: 2041115 - RNA, 20 nt, Homo sapiens
uugucgcuuucucagugugu

SEQ ID NO: 2041116 - RNA, 21 nt, Homo sapiens
ccaugugugagugugugcaag

SEQ ID NO: 2041117 - RNA, 18 nt, Homo sapiens
auauacgaacaaaacaca

SEQ ID NO: 2041118 - RNA, 12 nt, Homo sapiens
ugcuucaugagc

SEQ ID NO: 2041119 - RNA, 22 nt, Homo sapiens
auguauaucuauaucucuaaac

SEQ ID NO: 2041120 - RNA, 14 nt, Homo sapiens
gaggcaagaaccag

SEQ ID NO: 2041121 - RNA, 17 nt, Homo sapiens
gauggucucgaucuccu

SEQ ID NO: 2041122 - RNA, 14 nt, Homo sapiens
acuaaauaugugac

SEQ ID NO: 2041123 - RNA, 18 nt, Homo sapiens
caugaauuaaaggugcca

SEQ ID NO: 2041124 - RNA, 16 nt, Homo sapiens
ggcugucugugccaug

SEQ ID NO: 2041125 - RNA, 12 nt, Homo sapiens
uaccuguucaaa

SEQ ID NO: 2041126 - RNA, 11 nt, Homo sapiens
ggaucagccag

SEQ ID NO: 2041127 - RNA, 20 nt, Homo sapiens
aaacuguagcgaccccagac

SEQ ID NO: 2041128 - RNA, 22 nt, Homo sapiens
cugcauacucauuaggauggcu

SEQ ID NO: 2041129 - RNA, 22 nt, Homo sapiens
agcaauuugauaaaauauacuu

SEQ ID NO: 2041130 - RNA, 15 nt, Homo sapiens
gaaacaaagcauuug

SEQ ID NO: 2041131 - RNA, 22 nt, Homo sapiens
aaauagaauauauaaacgauau

SEQ ID NO: 2041132 - RNA, 22 nt, Homo sapiens
uugggaaaaccuucugccucau

SEQ ID NO: 2041133 - RNA, 20 nt, Homo sapiens
uuagagcauugccauucccu

SEQ ID NO: 2041134 - RNA, 23 nt, Homo sapiens
uuauauucaaggaucucaaagaa

SEQ ID NO: 2041135 - RNA, 17 nt, Homo sapiens
gcguaggcuacagagaa

SEQ ID NO: 2041136 - RNA, 15 nt, Homo sapiens
agggggcugcugcug

SEQ ID NO: 2041137 - RNA, 22 nt, Homo sapiens
uucauccugaaguuugcauuaa

SEQ ID NO: 2041138 - RNA, 15 nt, Homo sapiens
uuaaagugaaucuca

SEQ ID NO: 2041139 - RNA, 21 nt, Homo sapiens
aacugauuuuuagcuuuacaa

SEQ ID NO: 2041140 - RNA, 14 nt, Homo sapiens
guaacagucugcau

SEQ ID NO: 2041141 - RNA, 23 nt, Homo sapiens
ucaaaacacucaucuccucugua

SEQ ID NO: 2041142 - RNA, 21 nt, Homo sapiens
gacgggaccgggccgcuagau

SEQ ID NO: 2041143 - RNA, 16 nt, Homo sapiens
gcacuguuugccauuc

SEQ ID NO: 2041144 - RNA, 18 nt, Homo sapiens
acuguuauuuauaaucac

SEQ ID NO: 2041145 - RNA, 14 nt, Homo sapiens
ugcccgcccgggga

SEQ ID NO: 2041146 - RNA, 14 nt, Homo sapiens
gcuuaaugggagcu

SEQ ID NO: 2041147 - RNA, 21 nt, Homo sapiens
uaacuaccaugucuuaaaauc

SEQ ID NO: 2041148 - RNA, 17 nt, Homo sapiens
ucccauggucaaugcag

SEQ ID NO: 2041149 - RNA, 23 nt, Homo sapiens
ccaccgcuguggccggcacucca

SEQ ID NO: 2041150 - RNA, 15 nt, Homo sapiens
ugaaauuaagcauuu

SEQ ID NO: 2041151 - RNA, 17 nt, Homo sapiens
gaggagcuggaggggug

SEQ ID NO: 2041152 - RNA, 19 nt, Homo sapiens
cccaggggcacuguguucu

SEQ ID NO: 2041153 - RNA, 13 nt, Homo sapiens
uuuaaaacaaaga

SEQ ID NO: 2041154 - RNA, 20 nt, Homo sapiens
aucauuguuauaaagacaca

SEQ ID NO: 2041155 - RNA, 12 nt, Homo sapiens
cauaaucuguac

SEQ ID NO: 2041156 - RNA, 17 nt, Homo sapiens
ucccacccccacuucau

SEQ ID NO: 2041157 - RNA, 23 nt, Homo sapiens
uggaggaaacuuccaacuuuuac

SEQ ID NO: 2041158 - RNA, 12 nt, Homo sapiens
auauaaaccugg

SEQ ID NO: 2041159 - RNA, 13 nt, Homo sapiens
uaaaaaucuuuca

SEQ ID NO: 2041160 - RNA, 20 nt, Homo sapiens
accugaggcuccugugcuac

SEQ ID NO: 2041161 - RNA, 20 nt, Homo sapiens
aggagacccaacaaugagug

SEQ ID NO: 2041162 - RNA, 13 nt, Homo sapiens
ucacaacacugaa

SEQ ID NO: 2041163 - RNA, 14 nt, Homo sapiens
auuucuaagcagau

SEQ ID NO: 2041164 - RNA, 23 nt, Homo sapiens
accuguaggucaggaccaucaga

SEQ ID NO: 2041165 - RNA, 14 nt, Homo sapiens
ggacccggauguga

SEQ ID NO: 2041166 - RNA, 11 nt, Homo sapiens
uucugugcuca

SEQ ID NO: 2041167 - RNA, 18 nt, Homo sapiens
ccucccucugaggcugua

SEQ ID NO: 2041168 - RNA, 13 nt, Homo sapiens
uguagaucaggga

SEQ ID NO: 2041169 - RNA, 16 nt, Homo sapiens
cagcugucuguggcuu

SEQ ID NO: 2041170 - RNA, 13 nt, Homo sapiens
cgaucgcugugaa

SEQ ID NO: 2041171 - RNA, 14 nt, Homo sapiens
uggaccaagcacaa

SEQ ID NO: 2041172 - RNA, 12 nt, Homo sapiens
uguggaugcuag

SEQ ID NO: 2041173 - RNA, 20 nt, Homo sapiens
aucccuuuuucaaugaauuu

SEQ ID NO: 2041174 - RNA, 23 nt, Homo sapiens
uucaccaacaugcccacagauca

SEQ ID NO: 2041175 - RNA, 21 nt, Homo sapiens
aauuccucugugcucuccuag

SEQ ID NO: 2041176 - RNA, 19 nt, Homo sapiens
ucaggcuggagugcaguga

SEQ ID NO: 2041177 - RNA, 17 nt, Homo sapiens
acccaugggcucugaca

SEQ ID NO: 2041178 - RNA, 17 nt, Homo sapiens
ccuuagcuuaaugacuu

SEQ ID NO: 2041179 - RNA, 23 nt, Homo sapiens
caacaagccucaaagucccuuga

SEQ ID NO: 2041180 - RNA, 19 nt, Homo sapiens
uguuauuuacacuggucua

SEQ ID NO: 2041181 - RNA, 17 nt, Homo sapiens
uggagcauugcagcucc

SEQ ID NO: 2041182 - RNA, 16 nt, Homo sapiens
gccauuacuacuguac

SEQ ID NO: 2041183 - RNA, 17 nt, Homo sapiens
cugacagcuucaugaaa

SEQ ID NO: 2041184 - RNA, 12 nt, Homo sapiens
ugaccaaauggc

SEQ ID NO: 2041185 - RNA, 18 nt, Homo sapiens
uuuacaauaaaauuuugc

SEQ ID NO: 2041186 - RNA, 19 nt, Homo sapiens
uauuucagucaucaucuca

SEQ ID NO: 2041187 - RNA, 16 nt, Homo sapiens
uaauugacaacacagc

SEQ ID NO: 2041188 - RNA, 16 nt, Homo sapiens
uccucagaacaaugaa

SEQ ID NO: 2041189 - RNA, 20 nt, Homo sapiens
ucaucuguggagcugccaca

SEQ ID NO: 2041190 - RNA, 23 nt, Homo sapiens
aggacuagggcuuauccaugccu

SEQ ID NO: 2041191 - RNA, 19 nt, Homo sapiens
ggccagggcugcccugaga

SEQ ID NO: 2041192 - RNA, 19 nt, Homo sapiens
agaaauacccacuaacaaa

SEQ ID NO: 2041193 - RNA, 16 nt, Homo sapiens
guuucuugcacugaau

SEQ ID NO: 2041194 - RNA, 12 nt, Homo sapiens
caaaacauaucu

SEQ ID NO: 2041195 - RNA, 23 nt, Homo sapiens
uaaagaguucuccuuguacuuga

SEQ ID NO: 2041196 - RNA, 17 nt, Homo sapiens
aaagccugaaguggaau

SEQ ID NO: 2041197 - RNA, 14 nt, Homo sapiens
ucccuagcccuucc

SEQ ID NO: 2041198 - RNA, 23 nt, Homo sapiens
acaauugguaaaacucacuguga

SEQ ID NO: 2041199 - RNA, 20 nt, Homo sapiens
uauccagaagaagagaucag

SEQ ID NO: 2041200 - RNA, 15 nt, Homo sapiens
caaaucgugccuugu

SEQ ID NO: 2041201 - RNA, 17 nt, Homo sapiens
aaccugccugugcauga

SEQ ID NO: 2041202 - RNA, 18 nt, Homo sapiens
cuggucuugaacuccuga

SEQ ID NO: 2041203 - RNA, 14 nt, Homo sapiens
acuauguguucaau

SEQ ID NO: 2041204 - RNA, 12 nt, Homo sapiens
uuggaauucugg

SEQ ID NO: 2041205 - RNA, 12 nt, Homo sapiens
ucaaaauuccaa

SEQ ID NO: 2041206 - RNA, 15 nt, Homo sapiens
ugaaaagaccaaaau

SEQ ID NO: 2041207 - RNA, 21 nt, Homo sapiens
aacccuuucugggaugcaaua

SEQ ID NO: 2041208 - RNA, 14 nt, Homo sapiens
cuacuucugagcaa

SEQ ID NO: 2041209 - RNA, 23 nt, Homo sapiens
agacauuaacucauuagacugga

SEQ ID NO: 2041210 - RNA, 17 nt, Homo sapiens
uuuugccauaaugacuc

SEQ ID NO: 2041211 - RNA, 21 nt, Homo sapiens
aguuuccuaugggaacaauug

SEQ ID NO: 2041212 - RNA, 12 nt, Homo sapiens
cacaucuugacu

SEQ ID NO: 2041213 - RNA, 12 nt, Homo sapiens
cccuucuugcca

SEQ ID NO: 2041214 - RNA, 15 nt, Homo sapiens
uuggagcauuuucaa

SEQ ID NO: 2041215 - RNA, 17 nt, Homo sapiens
gauuggcucacccaagc

SEQ ID NO: 2041216 - RNA, 13 nt, Homo sapiens
gcuucucucugag

SEQ ID NO: 2041217 - RNA, 23 nt, Homo sapiens
caugguaaacuuuugguuuucag

SEQ ID NO: 2041218 - RNA, 15 nt, Homo sapiens
uuguuccucagaaac

SEQ ID NO: 2041219 - RNA, 15 nt, Homo sapiens
uggaugagcacacac

SEQ ID NO: 2041220 - RNA, 17 nt, Homo sapiens
uccccaagcccaccagg

SEQ ID NO: 2041221 - RNA, 21 nt, Homo sapiens
cauuuaaagggugauguacac

SEQ ID NO: 2041222 - RNA, 17 nt, Homo sapiens
uggccucuggcucucau

SEQ ID NO: 2041223 - RNA, 13 nt, Homo sapiens
aagagcuaauaaa

SEQ ID NO: 2041224 - RNA, 17 nt, Homo sapiens
caguguuuacacuuugg

SEQ ID NO: 2041225 - RNA, 12 nt, Homo sapiens
caacuucugucc

SEQ ID NO: 2041226 - RNA, 22 nt, Homo sapiens
acagagauaccauucaacccag

SEQ ID NO: 2041227 - RNA, 18 nt, Homo sapiens
agaaaaaaaagaaacuua

SEQ ID NO: 2041228 - RNA, 22 nt, Homo sapiens
cugaggcaggggaguaguggag

SEQ ID NO: 2041229 - RNA, 18 nt, Homo sapiens
augcaaugagcaaugugg

SEQ ID NO: 2041230 - RNA, 13 nt, Homo sapiens
gugaucuaccugc

SEQ ID NO: 2041231 - RNA, 20 nt, Homo sapiens
uccaucuguacccuuuucca

SEQ ID NO: 2041232 - RNA, 22 nt, Homo sapiens
cauccacacccucuccuuguca

SEQ ID NO: 2041233 - RNA, 13 nt, Homo sapiens
aaauggaagcaau

SEQ ID NO: 2041234 - RNA, 18 nt, Homo sapiens
acagcgguuugcagagaa

SEQ ID NO: 2041235 - RNA, 23 nt, Homo sapiens
agauauugggacacacaucaaaa

SEQ ID NO: 2041236 - RNA, 20 nt, Homo sapiens
ccaccaagggaucugccauu

SEQ ID NO: 2041237 - RNA, 19 nt, Homo sapiens
aggcaaagugcugcuggaa

SEQ ID NO: 2041238 - RNA, 14 nt, Homo sapiens
cagugcauuugccu

SEQ ID NO: 2041239 - RNA, 21 nt, Homo sapiens
ugagaguaauucaucugugaa

SEQ ID NO: 2041240 - RNA, 22 nt, Homo sapiens
aaaccccagucauggcuuccuu

SEQ ID NO: 2041241 - RNA, 11 nt, Homo sapiens
aggccuuccag

SEQ ID NO: 2041242 - RNA, 18 nt, Homo sapiens
agcagauaaagacagcug

SEQ ID NO: 2041243 - RNA, 14 nt, Homo sapiens
aggaauauaagguu

SEQ ID NO: 2041244 - RNA, 18 nt, Homo sapiens
caucuguggacaagacau

SEQ ID NO: 2041245 - RNA, 19 nt, Homo sapiens
aaagggcagcccuccuuac

SEQ ID NO: 2041246 - RNA, 14 nt, Homo sapiens
cugacaaugggcac

SEQ ID NO: 2041247 - RNA, 14 nt, Homo sapiens
aagaaggguguuua

SEQ ID NO: 2041248 - RNA, 23 nt, Homo sapiens
uuaaauccuuugcuucauuccaa

SEQ ID NO: 2041249 - RNA, 24 nt, Homo sapiens
auccaucugcuuacaauucccugc

SEQ ID NO: 2041250 - RNA, 15 nt, Homo sapiens
gucccucagugauac

SEQ ID NO: 2041251 - RNA, 21 nt, Homo sapiens
uauuuauccagaaaacuguga

SEQ ID NO: 2041252 - RNA, 15 nt, Homo sapiens
aaaauuuagcccuuu

SEQ ID NO: 2041253 - RNA, 21 nt, Homo sapiens
acauuuguggucugacuccuu

SEQ ID NO: 2041254 - RNA, 18 nt, Homo sapiens
cagugauauucuuuguua

SEQ ID NO: 2041255 - RNA, 16 nt, Homo sapiens
cagagaaugcaccucu

SEQ ID NO: 2041256 - RNA, 15 nt, Homo sapiens
cuucacaaucuguca

SEQ ID NO: 2041257 - RNA, 22 nt, Homo sapiens
gaaucauuguggugguugagau

SEQ ID NO: 2041258 - RNA, 21 nt, Homo sapiens
caggggcuucuuucuuuucga

SEQ ID NO: 2041259 - RNA, 14 nt, Homo sapiens
gcagaggagccaug

SEQ ID NO: 2041260 - RNA, 18 nt, Homo sapiens
acacaugcucaucccaaa

SEQ ID NO: 2041261 - RNA, 12 nt, Homo sapiens
ccccauauuugu

SEQ ID NO: 2041262 - RNA, 18 nt, Homo sapiens
ggcauuuuuauacucaga

SEQ ID NO: 2041263 - RNA, 21 nt, Homo sapiens
cuuaagcgauucucaugccuc

SEQ ID NO: 2041264 - RNA, 18 nt, Homo sapiens
uuucaacucagaaugcac

SEQ ID NO: 2041265 - RNA, 22 nt, Homo sapiens
acauggucuccucugauuauca

SEQ ID NO: 2041266 - RNA, 14 nt, Homo sapiens
ucugauggauucaa

SEQ ID NO: 2041267 - RNA, 18 nt, Homo sapiens
cuccccugccacacugau

SEQ ID NO: 2041268 - RNA, 16 nt, Homo sapiens
gacaugggugugccag

SEQ ID NO: 2041269 - RNA, 16 nt, Homo sapiens
gaaggcaaaugacuuu

SEQ ID NO: 2041270 - RNA, 15 nt, Homo sapiens
agugcacuccaagaa

SEQ ID NO: 2041271 - RNA, 20 nt, Homo sapiens
ggaagugugacuucuuacac

SEQ ID NO: 2041272 - RNA, 12 nt, Homo sapiens
ccaaugcugcuu

SEQ ID NO: 2041273 - RNA, 13 nt, Homo sapiens
uacaccaguuuga

SEQ ID NO: 2041274 - RNA, 13 nt, Homo sapiens
uccucaaaccuac

SEQ ID NO: 2041275 - RNA, 15 nt, Homo sapiens
gcaucaaggugcuga

SEQ ID NO: 2041276 - RNA, 12 nt, Homo sapiens
cccccacaagaa

SEQ ID NO: 2041277 - RNA, 22 nt, Homo sapiens
cgccccaaucccucaggauucc

SEQ ID NO: 2041278 - RNA, 20 nt, Homo sapiens
guucuuucaucucccuccuc

SEQ ID NO: 2041279 - RNA, 17 nt, Homo sapiens
cuacacagaucacagcu

SEQ ID NO: 2041280 - RNA, 16 nt, Homo sapiens
ccacaggcucugacca

SEQ ID NO: 2041281 - RNA, 17 nt, Homo sapiens
cguagggcuaagggagg

SEQ ID NO: 2041282 - RNA, 18 nt, Homo sapiens
gguuuaguuuauuuacuc

SEQ ID NO: 2041283 - RNA, 22 nt, Homo sapiens
cagcaucuggaggagcucugca

SEQ ID NO: 2041284 - RNA, 16 nt, Homo sapiens
cuguagaguccuuggc

SEQ ID NO: 2041285 - RNA, 15 nt, Homo sapiens
auccguugugacucu

SEQ ID NO: 2041286 - RNA, 19 nt, Homo sapiens
cucuaucccugaaauccag

SEQ ID NO: 2041287 - RNA, 23 nt, Homo sapiens
ugccucgaggacugauacugcag

SEQ ID NO: 2041288 - RNA, 18 nt, Homo sapiens
cagaacuucaggugugac

SEQ ID NO: 2041289 - RNA, 14 nt, Homo sapiens
acaaauaauuuuag

SEQ ID NO: 2041290 - RNA, 21 nt, Homo sapiens
agaaaugaggaggaugcuaaa

SEQ ID NO: 2041291 - RNA, 22 nt, Homo sapiens
auggcaacaaacacauugugaa

SEQ ID NO: 2041292 - RNA, 14 nt, Homo sapiens
aucaacuguugaua

SEQ ID NO: 2041293 - RNA, 21 nt, Homo sapiens
ccagauccaagauguuuggac

SEQ ID NO: 2041294 - RNA, 23 nt, Homo sapiens
gagccugcaauaagggaaaaaug

SEQ ID NO: 2041295 - RNA, 20 nt, Homo sapiens
uccacccaggcugcacugca

SEQ ID NO: 2041296 - RNA, 17 nt, Homo sapiens
guauuccuccugagaua

SEQ ID NO: 2041297 - RNA, 16 nt, Homo sapiens
acagcaaauaaaacag

SEQ ID NO: 2041298 - RNA, 14 nt, Homo sapiens
auugagacuauuua

SEQ ID NO: 2041299 - RNA, 18 nt, Homo sapiens
caagaacaugaugggccu

SEQ ID NO: 2041300 - RNA, 17 nt, Homo sapiens
ccaucuugaaaaacacu

SEQ ID NO: 2041301 - RNA, 19 nt, Homo sapiens
ugaauaugaugacaaucag

SEQ ID NO: 2041302 - RNA, 19 nt, Homo sapiens
aacaguugccagugauaau

SEQ ID NO: 2041303 - RNA, 17 nt, Homo sapiens
ucaguaaugcugcagga

SEQ ID NO: 2041304 - RNA, 14 nt, Homo sapiens
uugucucagucaaa

SEQ ID NO: 2041305 - RNA, 16 nt, Homo sapiens
guagcagcauuuacag

SEQ ID NO: 2041306 - RNA, 15 nt, Homo sapiens
ccacuuggccucacu

SEQ ID NO: 2041307 - RNA, 15 nt, Homo sapiens
uguugauuccacuga

SEQ ID NO: 2041308 - RNA, 19 nt, Homo sapiens
guaagaaaagcaguuugca

SEQ ID NO: 2041309 - RNA, 13 nt, Homo sapiens
ucaggccagucac

SEQ ID NO: 2041310 - RNA, 17 nt, Homo sapiens
ucaugguguccagacag

SEQ ID NO: 2041311 - RNA, 20 nt, Homo sapiens
uugaucagugugcuaaccuc

SEQ ID NO: 2041312 - RNA, 18 nt, Homo sapiens
uuccuuuuucuucacuua

SEQ ID NO: 2041313 - RNA, 21 nt, Homo sapiens
ucugugugcgcucuguggaug

SEQ ID NO: 2041314 - RNA, 15 nt, Homo sapiens
agggcccacuuguau

SEQ ID NO: 2041315 - RNA, 20 nt, Homo sapiens
uacuaagggaacaauccaug

SEQ ID NO: 2041316 - RNA, 19 nt, Homo sapiens
aacaucaguuacucugaag

SEQ ID NO: 2041317 - RNA, 12 nt, Homo sapiens
ucuucaacagcu

SEQ ID NO: 2041318 - RNA, 17 nt, Homo sapiens
uccuucaccucacugaa

SEQ ID NO: 2041319 - RNA, 15 nt, Homo sapiens
gaccucuacauugaa

SEQ ID NO: 2041320 - RNA, 23 nt, Homo sapiens
aucaauggcgcagugccucuggu

SEQ ID NO: 2041321 - RNA, 15 nt, Homo sapiens
cuugagcuaagcaga

SEQ ID NO: 2041322 - RNA, 12 nt, Homo sapiens
guaacugugcuu

SEQ ID NO: 2041323 - RNA, 17 nt, Homo sapiens
aaguacucagauuugau

SEQ ID NO: 2041324 - RNA, 16 nt, Homo sapiens
gaggugccacccagua

SEQ ID NO: 2041325 - RNA, 14 nt, Homo sapiens
uacaggcgugagcc

SEQ ID NO: 2041326 - RNA, 20 nt, Homo sapiens
uucaguagugagcagcaucu

SEQ ID NO: 2041327 - RNA, 18 nt, Homo sapiens
gauguacaugauugccaa

SEQ ID NO: 2041328 - RNA, 18 nt, Homo sapiens
gaagguugacacaggaaa

SEQ ID NO: 2041329 - RNA, 15 nt, Homo sapiens
agcacugaggaagaa

SEQ ID NO: 2041330 - RNA, 18 nt, Homo sapiens
uacccugcgauuuugccu

SEQ ID NO: 2041331 - RNA, 17 nt, Homo sapiens
gagaauaaagcauuuca

SEQ ID NO: 2041332 - RNA, 14 nt, Homo sapiens
ugacccugcucuca

SEQ ID NO: 2041333 - RNA, 22 nt, Homo sapiens
ucaaaucuguaaucagcaauaa

SEQ ID NO: 2041334 - RNA, 19 nt, Homo sapiens
ucugcagucacccagggcg

SEQ ID NO: 2041335 - RNA, 16 nt, Homo sapiens
auacuaccggcuacau

SEQ ID NO: 2041336 - RNA, 17 nt, Homo sapiens
ugccagccgugaugcuc

SEQ ID NO: 2041337 - RNA, 17 nt, Homo sapiens
cucauacacaugugcac

SEQ ID NO: 2041338 - RNA, 19 nt, Homo sapiens
uauccaaucucaucucuug

SEQ ID NO: 2041339 - RNA, 13 nt, Homo sapiens
uggugcacugagc

SEQ ID NO: 2041340 - RNA, 19 nt, Homo sapiens
gacuggacuauacaacuuu

SEQ ID NO: 2041341 - RNA, 15 nt, Homo sapiens
gcccccaucuugggg

SEQ ID NO: 2041342 - RNA, 16 nt, Homo sapiens
ugcauguauguauaca

SEQ ID NO: 2041343 - RNA, 19 nt, Homo sapiens
aggcaugagccacugcacu

SEQ ID NO: 2041344 - RNA, 21 nt, Homo sapiens
gccauuggcuacugacuguau

SEQ ID NO: 2041345 - RNA, 16 nt, Homo sapiens
uccaaagccaauguga

SEQ ID NO: 2041346 - RNA, 19 nt, Homo sapiens
aacauagacagauguggac

SEQ ID NO: 2041347 - RNA, 23 nt, Homo sapiens
gaggccaguguugugggcuuccu

SEQ ID NO: 2041348 - RNA, 21 nt, Homo sapiens
auguuggcuagacuagucuca

SEQ ID NO: 2041349 - RNA, 18 nt, Homo sapiens
gaaugcagucuguccagg

SEQ ID NO: 2041350 - RNA, 18 nt, Homo sapiens
aggaaagaccaugugguu

SEQ ID NO: 2041351 - RNA, 21 nt, Homo sapiens
ucucuccacgguagcacuuga

SEQ ID NO: 2041352 - RNA, 19 nt, Homo sapiens
cuucugcucacauucccuc

SEQ ID NO: 2041353 - RNA, 21 nt, Homo sapiens
ugaaggccucuuguugagugc

SEQ ID NO: 2041354 - RNA, 14 nt, Homo sapiens
accaggauggagca

SEQ ID NO: 2041355 - RNA, 23 nt, Homo sapiens
uaaaagaugcauuaucuaugaua

SEQ ID NO: 2041356 - RNA, 15 nt, Homo sapiens
aucugcaccuagaac

SEQ ID NO: 2041357 - RNA, 13 nt, Homo sapiens
uuuucacuuugaa

SEQ ID NO: 2041358 - RNA, 20 nt, Homo sapiens
aggaguggauuccuccccac

SEQ ID NO: 2041359 - RNA, 23 nt, Homo sapiens
uggacuuuugaaguccacuuguu

SEQ ID NO: 2041360 - RNA, 19 nt, Homo sapiens
uggcaucagauaaugccac

SEQ ID NO: 2041361 - RNA, 21 nt, Homo sapiens
uaagacucuuaccuacaaaau

SEQ ID NO: 2041362 - RNA, 20 nt, Homo sapiens
auuaagaucagcaaagggag

SEQ ID NO: 2041363 - RNA, 12 nt, Homo sapiens
ucucaagauauu

SEQ ID NO: 2041364 - RNA, 19 nt, Homo sapiens
gagcuguguggccuggcaa

SEQ ID NO: 2041365 - RNA, 13 nt, Homo sapiens
ggacaaagugcca

SEQ ID NO: 2041366 - RNA, 13 nt, Homo sapiens
ucaaaaaggccaa

SEQ ID NO: 2041367 - RNA, 22 nt, Homo sapiens
aaaauguucugacagcauuuca

SEQ ID NO: 2041368 - RNA, 22 nt, Homo sapiens
aaauguugacucuuugggagag

SEQ ID NO: 2041369 - RNA, 23 nt, Homo sapiens
ggaccacuguuucuugcuuguac

SEQ ID NO: 2041370 - RNA, 20 nt, Homo sapiens
cugcuuuucuucccagcaaa

SEQ ID NO: 2041371 - RNA, 20 nt, Homo sapiens
uuuaguuuaaaaaucagaaa

SEQ ID NO: 2041372 - RNA, 14 nt, Homo sapiens
cuuacuguaacgga

SEQ ID NO: 2041373 - RNA, 18 nt, Homo sapiens
accucuucucuuccugua

SEQ ID NO: 2041374 - RNA, 13 nt, Homo sapiens
ugagaucuacugg

SEQ ID NO: 2041375 - RNA, 15 nt, Homo sapiens
uuugggggcacuuag

SEQ ID NO: 2041376 - RNA, 17 nt, Homo sapiens
aaucuuguuaaugucau

SEQ ID NO: 2041377 - RNA, 20 nt, Homo sapiens
gaagucucccugcacagccu

SEQ ID NO: 2041378 - RNA, 14 nt, Homo sapiens
ucccaauaucaugu

SEQ ID NO: 2041379 - RNA, 23 nt, Homo sapiens
uaauagccuggguuaaguauuau

SEQ ID NO: 2041380 - RNA, 21 nt, Homo sapiens
agaacacccaauucaaauuga

SEQ ID NO: 2041381 - RNA, 20 nt, Homo sapiens
uggaaaugucaucuaaccau

SEQ ID NO: 2041382 - RNA, 23 nt, Homo sapiens
gccuuauuuuuguaugccuuuug

SEQ ID NO: 2041383 - RNA, 19 nt, Homo sapiens
guuuccuaugacuaauuca

SEQ ID NO: 2041384 - RNA, 19 nt, Homo sapiens
aaccuacccugguccaguc

SEQ ID NO: 2041385 - RNA, 14 nt, Homo sapiens
cacuuaugauuuca

SEQ ID NO: 2041386 - RNA, 18 nt, Homo sapiens
gaauacugcuacagcaau

SEQ ID NO: 2041387 - RNA, 22 nt, Homo sapiens
aauccuucccugcucuugcagu

SEQ ID NO: 2041388 - RNA, 19 nt, Homo sapiens
acugaacuuacacuguaua

SEQ ID NO: 2041389 - RNA, 14 nt, Homo sapiens
gcccucugcucuaa

SEQ ID NO: 2041390 - RNA, 12 nt, Homo sapiens
uugcuacuguca

SEQ ID NO: 2041391 - RNA, 23 nt, Homo sapiens
ccuucucuguagggaacucuggg

SEQ ID NO: 2041392 - RNA, 21 nt, Homo sapiens
cugcccuccuuugccuuccac

SEQ ID NO: 2041393 - RNA, 20 nt, Homo sapiens
aaguugcuaggaacaugugg

SEQ ID NO: 2041394 - RNA, 20 nt, Homo sapiens
aucuuccucucgcagcuuga

SEQ ID NO: 2041395 - RNA, 16 nt, Homo sapiens
auuugcuguucaccca

SEQ ID NO: 2041396 - RNA, 12 nt, Homo sapiens
accgugugcucc

SEQ ID NO: 2041397 - RNA, 12 nt, Homo sapiens
acgcugugcugg

SEQ ID NO: 2041398 - RNA, 17 nt, Homo sapiens
uacccagccuaccagag

SEQ ID NO: 2041399 - RNA, 19 nt, Homo sapiens
ggugagacacugcacagaa

SEQ ID NO: 2041400 - RNA, 13 nt, Homo sapiens
gaguagcauauua

SEQ ID NO: 2041401 - RNA, 18 nt, Homo sapiens
acgcuuaggccaugaugu

SEQ ID NO: 2041402 - RNA, 18 nt, Homo sapiens
acccagugcugaauuucc

SEQ ID NO: 2041403 - RNA, 20 nt, Homo sapiens
uacaacauuguggaugugua

SEQ ID NO: 2041404 - RNA, 15 nt, Homo sapiens
cuucagaccugacac

SEQ ID NO: 2041405 - RNA, 15 nt, Homo sapiens
cagaguugcuuuaaa

SEQ ID NO: 2041406 - RNA, 14 nt, Homo sapiens
caaagccuuuccag

SEQ ID NO: 2041407 - RNA, 22 nt, Homo sapiens
aagcaacuacaacuucuccuua

SEQ ID NO: 2041408 - RNA, 12 nt, Homo sapiens
acaggugccagg

SEQ ID NO: 2041409 - RNA, 23 nt, Homo sapiens
gauccugguauuguaauauuaaa

SEQ ID NO: 2041410 - RNA, 15 nt, Homo sapiens
caucaucacucaucu

SEQ ID NO: 2041411 - RNA, 13 nt, Homo sapiens
cagccaaacugua

SEQ ID NO: 2041412 - RNA, 13 nt, Homo sapiens
aaauagauuucag

SEQ ID NO: 2041413 - RNA, 17 nt, Homo sapiens
gagucucuucuccacug

SEQ ID NO: 2041414 - RNA, 17 nt, Homo sapiens
ccuucuuauguuucuaa

SEQ ID NO: 2041415 - RNA, 20 nt, Homo sapiens
acuauuucaauacuuacaua

SEQ ID NO: 2041416 - RNA, 18 nt, Homo sapiens
uacuaacauuuucauuga

SEQ ID NO: 2041417 - RNA, 21 nt, Homo sapiens
uuggaagggaguuggugugcu

SEQ ID NO: 2041418 - RNA, 23 nt, Homo sapiens
auagcucuggggugggcaguuuu

SEQ ID NO: 2041419 - RNA, 23 nt, Homo sapiens
cuucaagccuagcccuucucuca

SEQ ID NO: 2041420 - RNA, 19 nt, Homo sapiens
agugccccaccacucccca

SEQ ID NO: 2041421 - RNA, 17 nt, Homo sapiens
uucccugugucauuuca

SEQ ID NO: 2041422 - RNA, 17 nt, Homo sapiens
auauccaauugcugcuu

SEQ ID NO: 2041423 - RNA, 22 nt, Homo sapiens
uuuggaaucuucucuuugacaa

SEQ ID NO: 2041424 - RNA, 20 nt, Homo sapiens
agugcagaagcaugaucaca

SEQ ID NO: 2041425 - RNA, 21 nt, Homo sapiens
aucauggagaagugaaggcau

SEQ ID NO: 2041426 - RNA, 21 nt, Homo sapiens
agauccuggaaacagcagugu

SEQ ID NO: 2041427 - RNA, 11 nt, Homo sapiens
uuaaacuuaau

SEQ ID NO: 2041428 - RNA, 23 nt, Homo sapiens
cuagaagaaaagcccauuuucaa

SEQ ID NO: 2041429 - RNA, 16 nt, Homo sapiens
caggcaagcaccuccu

SEQ ID NO: 2041430 - RNA, 20 nt, Homo sapiens
gggauaccgucuccuugaag

SEQ ID NO: 2041431 - RNA, 17 nt, Homo sapiens
acagaaaacaaaccuua

SEQ ID NO: 2041432 - RNA, 20 nt, Homo sapiens
auauuggguuccauucucac

SEQ ID NO: 2041433 - RNA, 13 nt, Homo sapiens
gcauauacaguga

SEQ ID NO: 2041434 - RNA, 17 nt, Homo sapiens
uuuaaccucuagaguca

SEQ ID NO: 2041435 - RNA, 23 nt, Homo sapiens
gcugauuuuuuuuuuaacuugaa

SEQ ID NO: 2041436 - RNA, 14 nt, Homo sapiens
acaugcugcucugg

SEQ ID NO: 2041437 - RNA, 21 nt, Homo sapiens
guaauauacaagcaagcaaaa

SEQ ID NO: 2041438 - RNA, 20 nt, Homo sapiens
cacauauauuuuuuacaaac

SEQ ID NO: 2041439 - RNA, 19 nt, Homo sapiens
ugccuuaaccagucucuca

SEQ ID NO: 2041440 - RNA, 17 nt, Homo sapiens
guuacaaauaugcagac

SEQ ID NO: 2041441 - RNA, 21 nt, Homo sapiens
gguugcacaaaaccacuuuuu

SEQ ID NO: 2041442 - RNA, 15 nt, Homo sapiens
acuauccuugcuaag

SEQ ID NO: 2041443 - RNA, 22 nt, Homo sapiens
cuuagauaacuucuugaaaaag

SEQ ID NO: 2041444 - RNA, 21 nt, Homo sapiens
cuguauaguuuuuagucugug

SEQ ID NO: 2041445 - RNA, 15 nt, Homo sapiens
uuugcuccagaacac

SEQ ID NO: 2041446 - RNA, 16 nt, Homo sapiens
cauguuucucacauug

SEQ ID NO: 2041447 - RNA, 13 nt, Homo sapiens
cugcaccgucuca

SEQ ID NO: 2041448 - RNA, 11 nt, Homo sapiens
cacaucaccuc

SEQ ID NO: 2041449 - RNA, 22 nt, Homo sapiens
uaagauguguagaccuugaugg

SEQ ID NO: 2041450 - RNA, 15 nt, Homo sapiens
auauuaaacauccac

SEQ ID NO: 2041451 - RNA, 15 nt, Homo sapiens
guuugacauuugucu

SEQ ID NO: 2041452 - RNA, 15 nt, Homo sapiens
guauuuuugucauag

SEQ ID NO: 2041453 - RNA, 22 nt, Homo sapiens
ccugcgggaagcugaccuuuaa

SEQ ID NO: 2041454 - RNA, 20 nt, Homo sapiens
cagagcgcaagcugggagca

SEQ ID NO: 2041455 - RNA, 18 nt, Homo sapiens
acccuggccuagaccagc

SEQ ID NO: 2041456 - RNA, 23 nt, Homo sapiens
aucguuuucuuugcugugccaaa

SEQ ID NO: 2041457 - RNA, 19 nt, Homo sapiens
ggaccaucgcugccugcca

SEQ ID NO: 2041458 - RNA, 13 nt, Homo sapiens
cgaucauugugcc

SEQ ID NO: 2041459 - RNA, 18 nt, Homo sapiens
ucucuccuuguucugaua

SEQ ID NO: 2041460 - RNA, 21 nt, Homo sapiens
uuuccacugccaaaacaaugc

SEQ ID NO: 2041461 - RNA, 13 nt, Homo sapiens
ccuucaccuggau

SEQ ID NO: 2041462 - RNA, 13 nt, Homo sapiens
ugcaguuuggccc

SEQ ID NO: 2041463 - RNA, 23 nt, Homo sapiens
acccauagugcacacuuguauau

SEQ ID NO: 2041464 - RNA, 23 nt, Homo sapiens
auaaaggacaggccacaccacag

SEQ ID NO: 2041465 - RNA, 18 nt, Homo sapiens
uuuuucuauuucacugga

SEQ ID NO: 2041466 - RNA, 19 nt, Homo sapiens
gaaagagagcaccacguga

SEQ ID NO: 2041467 - RNA, 13 nt, Homo sapiens
aaauguuucuaca

SEQ ID NO: 2041468 - RNA, 12 nt, Homo sapiens
cuucacauccac

SEQ ID NO: 2041469 - RNA, 24 nt, Homo sapiens
ggccuguccacccugccaagacuc

SEQ ID NO: 2041470 - RNA, 14 nt, Homo sapiens
agaaugaaccacug

SEQ ID NO: 2041471 - RNA, 14 nt, Homo sapiens
agacaaaaccaaaa

SEQ ID NO: 2041472 - RNA, 15 nt, Homo sapiens
uccgaucaacauuua

SEQ ID NO: 2041473 - RNA, 15 nt, Homo sapiens
auauaaagcacagau

SEQ ID NO: 2041474 - RNA, 13 nt, Homo sapiens
ucaugauccuugc

SEQ ID NO: 2041475 - RNA, 16 nt, Homo sapiens
gcgauuaagagacaga

SEQ ID NO: 2041476 - RNA, 18 nt, Homo sapiens
caugaagccuugcugaac

SEQ ID NO: 2041477 - RNA, 20 nt, Homo sapiens
cugggcuaauauacuuguaa

SEQ ID NO: 2041478 - RNA, 14 nt, Homo sapiens
aaaaaugggaacau

SEQ ID NO: 2041479 - RNA, 23 nt, Homo sapiens
auuccuccugucuccucugucag

SEQ ID NO: 2041480 - RNA, 22 nt, Homo sapiens
gaucguuuuuucccagggcaag

SEQ ID NO: 2041481 - RNA, 17 nt, Homo sapiens
cuugguuuucccuuugc

SEQ ID NO: 2041482 - RNA, 14 nt, Homo sapiens
agggaagcuuccau

SEQ ID NO: 2041483 - RNA, 15 nt, Homo sapiens
ggagagggaaguuuc

SEQ ID NO: 2041484 - RNA, 15 nt, Homo sapiens
agaggaguucaauga

SEQ ID NO: 2041485 - RNA, 20 nt, Homo sapiens
agcuugucaaugauuucaaa

SEQ ID NO: 2041486 - RNA, 20 nt, Homo sapiens
uauuuaugaacagacuuuuu

SEQ ID NO: 2041487 - RNA, 14 nt, Homo sapiens
uaauuuuaauacca

SEQ ID NO: 2041488 - RNA, 19 nt, Homo sapiens
cagccucccaaguagcuga

SEQ ID NO: 2041489 - RNA, 15 nt, Homo sapiens
caccaugaaacuuua

SEQ ID NO: 2041490 - RNA, 20 nt, Homo sapiens
cugaauuccagcaaaagagc

SEQ ID NO: 2041491 - RNA, 15 nt, Homo sapiens
aacugaauaaauacc

SEQ ID NO: 2041492 - RNA, 23 nt, Homo sapiens
uucucucaucuuuuagcauguga

SEQ ID NO: 2041493 - RNA, 16 nt, Homo sapiens
accugaccccauuccu

SEQ ID NO: 2041494 - RNA, 21 nt, Homo sapiens
cauccacgcucaagacccgcc

SEQ ID NO: 2041495 - RNA, 17 nt, Homo sapiens
uucugccugcugaccau

SEQ ID NO: 2041496 - RNA, 14 nt, Homo sapiens
guccucucauccca

SEQ ID NO: 2041497 - RNA, 19 nt, Homo sapiens
aaagccagggucucucccu

SEQ ID NO: 2041498 - RNA, 15 nt, Homo sapiens
ucaacagaaguauca

SEQ ID NO: 2041499 - RNA, 23 nt, Homo sapiens
agacggcggccaggcacagggcc

SEQ ID NO: 2041500 - RNA, 18 nt, Homo sapiens
agaugauggcucauuuac

SEQ ID NO: 2041501 - RNA, 22 nt, Homo sapiens
aauuugaaaacauaaucugcaa

SEQ ID NO: 2041502 - RNA, 22 nt, Homo sapiens
gguaggggcaaggaaacucgaa

SEQ ID NO: 2041503 - RNA, 16 nt, Homo sapiens
uuguaccugacuucca

SEQ ID NO: 2041504 - RNA, 21 nt, Homo sapiens
aagaaguugcuaagugugcuu

SEQ ID NO: 2041505 - RNA, 18 nt, Homo sapiens
ucaaaacuggagucccaa

SEQ ID NO: 2041506 - RNA, 21 nt, Homo sapiens
uuagagccagccacacuugaa

SEQ ID NO: 2041507 - RNA, 21 nt, Homo sapiens
ggcacuuuaagucagugacag

SEQ ID NO: 2041508 - RNA, 11 nt, Homo sapiens
uuuaauuuugg

SEQ ID NO: 2041509 - RNA, 23 nt, Homo sapiens
auugggaguaggaguugcuccua

SEQ ID NO: 2041510 - RNA, 18 nt, Homo sapiens
auuggcccucauuccaag

SEQ ID NO: 2041511 - RNA, 11 nt, Homo sapiens
gguggggcuua

SEQ ID NO: 2041512 - RNA, 24 nt, Homo sapiens
cauugccuagagcgcugcacauug

SEQ ID NO: 2041513 - RNA, 19 nt, Homo sapiens
ccagacacaccaggcaaca

SEQ ID NO: 2041514 - RNA, 14 nt, Homo sapiens
auuuaguugauaua

SEQ ID NO: 2041515 - RNA, 17 nt, Homo sapiens
gagggaacauagacuca

SEQ ID NO: 2041516 - RNA, 13 nt, Homo sapiens
acuuaacuauuaa

SEQ ID NO: 2041517 - RNA, 15 nt, Homo sapiens
gacacuuacccaagg

SEQ ID NO: 2041518 - RNA, 21 nt, Homo sapiens
aucagugauuuucaaaccuca

SEQ ID NO: 2041519 - RNA, 22 nt, Homo sapiens
auaccucucaacuuacauaugu

SEQ ID NO: 2041520 - RNA, 14 nt, Homo sapiens
uuaccugucucucu

SEQ ID NO: 2041521 - RNA, 18 nt, Homo sapiens
uacuauauaauauaucau

SEQ ID NO: 2041522 - RNA, 14 nt, Homo sapiens
cccgagaagcacuu

SEQ ID NO: 2041523 - RNA, 22 nt, Homo sapiens
ggcacugcaggggccgagccau

SEQ ID NO: 2041524 - RNA, 19 nt, Homo sapiens
caucagcagagaacuggaa

SEQ ID NO: 2041525 - RNA, 16 nt, Homo sapiens
ugaagcaaacacauua

SEQ ID NO: 2041526 - RNA, 23 nt, Homo sapiens
cugaccucgugauccaccugccu

SEQ ID NO: 2041527 - RNA, 16 nt, Homo sapiens
aauacuuuucuucccc

SEQ ID NO: 2041528 - RNA, 16 nt, Homo sapiens
uuuugggaagucucag

SEQ ID NO: 2041529 - RNA, 17 nt, Homo sapiens
uucucagguguugccaa

SEQ ID NO: 2041530 - RNA, 15 nt, Homo sapiens
agaacugaaggcaua

SEQ ID NO: 2041531 - RNA, 19 nt, Homo sapiens
aaucgauucccaagcuccc

SEQ ID NO: 2041532 - RNA, 20 nt, Homo sapiens
acucuccuccccucccucag

SEQ ID NO: 2041533 - RNA, 23 nt, Homo sapiens
guaucuaccaucuaaucuaugca

SEQ ID NO: 2041534 - RNA, 14 nt, Homo sapiens
uggaggccacuguu

SEQ ID NO: 2041535 - RNA, 18 nt, Homo sapiens
gccuuccugccaggagcu

SEQ ID NO: 2041536 - RNA, 17 nt, Homo sapiens
cuguaccuggugcccug

SEQ ID NO: 2041537 - RNA, 12 nt, Homo sapiens
aggaaauggugg

SEQ ID NO: 2041538 - RNA, 14 nt, Homo sapiens
uuacagcuacuaua

SEQ ID NO: 2041539 - RNA, 21 nt, Homo sapiens
acuuguuuacauagcauuugu

SEQ ID NO: 2041540 - RNA, 16 nt, Homo sapiens
uucugaauugacugua

SEQ ID NO: 2041541 - RNA, 19 nt, Homo sapiens
cuacugaccaucugcacug

SEQ ID NO: 2041542 - RNA, 17 nt, Homo sapiens
auaaugcaugaagcaac

SEQ ID NO: 2041543 - RNA, 13 nt, Homo sapiens
agaacuacuucuu

SEQ ID NO: 2041544 - RNA, 15 nt, Homo sapiens
ugaagauuucucuga

SEQ ID NO: 2041545 - RNA, 14 nt, Homo sapiens
gacuccaucucuca

SEQ ID NO: 2041546 - RNA, 22 nt, Homo sapiens
uugcaacuucuaaacacaaaua

SEQ ID NO: 2041547 - RNA, 19 nt, Homo sapiens
guaucugcuuaggugccag

SEQ ID NO: 2041548 - RNA, 12 nt, Homo sapiens
cuaauauauaaa

SEQ ID NO: 2041549 - RNA, 15 nt, Homo sapiens
ccuccuccugggcua

SEQ ID NO: 2041550 - RNA, 13 nt, Homo sapiens
acaaugugaaaag

SEQ ID NO: 2041551 - RNA, 19 nt, Homo sapiens
uacuaauuuuccauaagcu

SEQ ID NO: 2041552 - RNA, 14 nt, Homo sapiens
uaagagaugggacu

SEQ ID NO: 2041553 - RNA, 20 nt, Homo sapiens
gaacagucauuaauuuucaa

SEQ ID NO: 2041554 - RNA, 20 nt, Homo sapiens
auuuuugucagucugaguca

SEQ ID NO: 2041555 - RNA, 20 nt, Homo sapiens
auauuagauaaccauauuca

SEQ ID NO: 2041556 - RNA, 15 nt, Homo sapiens
uaaacccaaucagau

SEQ ID NO: 2041557 - RNA, 16 nt, Homo sapiens
cucuucccgcaaauca

SEQ ID NO: 2041558 - RNA, 16 nt, Homo sapiens
cuuaggcacugaggga

SEQ ID NO: 2041559 - RNA, 16 nt, Homo sapiens
cgacaaagcuacuuga

SEQ ID NO: 2041560 - RNA, 15 nt, Homo sapiens
aaauguaauugaaua

SEQ ID NO: 2041561 - RNA, 14 nt, Homo sapiens
cuuaauaguaguua

SEQ ID NO: 2041562 - RNA, 12 nt, Homo sapiens
cacacugggacu

SEQ ID NO: 2041563 - RNA, 20 nt, Homo sapiens
gguauaaugguugacugggu

SEQ ID NO: 2041564 - RNA, 16 nt, Homo sapiens
ugcucacaaaggauac

SEQ ID NO: 2041565 - RNA, 20 nt, Homo sapiens
ggcuggacuggaggugggca

SEQ ID NO: 2041566 - RNA, 20 nt, Homo sapiens
aggauuuguguuuuacagua

SEQ ID NO: 2041567 - RNA, 18 nt, Homo sapiens
auauguaugccugcaaua

SEQ ID NO: 2041568 - RNA, 19 nt, Homo sapiens
cauccaacauuaaaagcca

SEQ ID NO: 2041569 - RNA, 14 nt, Homo sapiens
gucuguugcuugua

SEQ ID NO: 2041570 - RNA, 12 nt, Homo sapiens
gugaagcauuua

SEQ ID NO: 2041571 - RNA, 15 nt, Homo sapiens
accacgguagugccu

SEQ ID NO: 2041572 - RNA, 14 nt, Homo sapiens
acugucuugccaga

SEQ ID NO: 2041573 - RNA, 19 nt, Homo sapiens
ccuuagccuaggccuaguc

SEQ ID NO: 2041574 - RNA, 15 nt, Homo sapiens
gcuggcaucuccccc

SEQ ID NO: 2041575 - RNA, 22 nt, Homo sapiens
cgggaacuggagucugucucuu

SEQ ID NO: 2041576 - RNA, 14 nt, Homo sapiens
ucucaggacucuga

SEQ ID NO: 2041577 - RNA, 22 nt, Homo sapiens
ccaaaaaaaaaagaaguuacuu

SEQ ID NO: 2041578 - RNA, 16 nt, Homo sapiens
ucccguggccuguaga

SEQ ID NO: 2041579 - RNA, 14 nt, Homo sapiens
ucuggacacugcca

SEQ ID NO: 2041580 - RNA, 22 nt, Homo sapiens
aggggugagccccgccgugucu

SEQ ID NO: 2041581 - RNA, 19 nt, Homo sapiens
aggugguccuuccuaccuc

SEQ ID NO: 2041582 - RNA, 19 nt, Homo sapiens
acuggcacacugcucuuaa

SEQ ID NO: 2041583 - RNA, 17 nt, Homo sapiens
aucccuggccaccugcc

SEQ ID NO: 2041584 - RNA, 16 nt, Homo sapiens
uauuuucaucacccca

SEQ ID NO: 2041585 - RNA, 22 nt, Homo sapiens
guggcagaauggggugcaugaa

SEQ ID NO: 2041586 - RNA, 18 nt, Homo sapiens
uaaacaaauguaugauua

SEQ ID NO: 2041587 - RNA, 16 nt, Homo sapiens
ccugccccugccccau

SEQ ID NO: 2041588 - RNA, 15 nt, Homo sapiens
aguuagucaauccug

SEQ ID NO: 2041589 - RNA, 13 nt, Homo sapiens
uguggcuccagga

SEQ ID NO: 2041590 - RNA, 18 nt, Homo sapiens
uaccccuuccagaagcaa

SEQ ID NO: 2041591 - RNA, 21 nt, Homo sapiens
ccccagugguauccugugaca

SEQ ID NO: 2041592 - RNA, 22 nt, Homo sapiens
ccucccaagcacuucaaaggaa

SEQ ID NO: 2041593 - RNA, 19 nt, Homo sapiens
agagcaagacuccaucuca

SEQ ID NO: 2041594 - RNA, 19 nt, Homo sapiens
agagcgagacuccgucuca

SEQ ID NO: 2041595 - RNA, 14 nt, Homo sapiens
cugcugagcacaga

SEQ ID NO: 2041596 - RNA, 14 nt, Homo sapiens
cugguucuuagccc

SEQ ID NO: 2041597 - RNA, 16 nt, Homo sapiens
ccucaaauuaacuuuc

SEQ ID NO: 2041598 - RNA, 17 nt, Homo sapiens
gaaaagugaaucuugcu

SEQ ID NO: 2041599 - RNA, 19 nt, Homo sapiens
agugcuuuucagugauacu

SEQ ID NO: 2041600 - RNA, 13 nt, Homo sapiens
uacaguaccuugu

SEQ ID NO: 2041601 - RNA, 17 nt, Homo sapiens
aaagcuguuaggcucac

SEQ ID NO: 2041602 - RNA, 13 nt, Homo sapiens
aagaaaaugaagc

SEQ ID NO: 2041603 - RNA, 13 nt, Homo sapiens
uugcaaaauggaa

SEQ ID NO: 2041604 - RNA, 17 nt, Homo sapiens
cugcccagaugcccuuu

SEQ ID NO: 2041605 - RNA, 17 nt, Homo sapiens
ugucccauagucccugc

SEQ ID NO: 2041606 - RNA, 17 nt, Homo sapiens
caaguguguaugugcgu

SEQ ID NO: 2041607 - RNA, 16 nt, Homo sapiens
ucuaaggaaugcacaa

SEQ ID NO: 2041608 - RNA, 22 nt, Homo sapiens
uauuugggguugcaucagaaau

SEQ ID NO: 2041609 - RNA, 17 nt, Homo sapiens
auggucaacuuacuuaa

SEQ ID NO: 2041610 - RNA, 15 nt, Homo sapiens
auacugcuacuguaa

SEQ ID NO: 2041611 - RNA, 19 nt, Homo sapiens
gagaagauucuuguauuua

SEQ ID NO: 2041612 - RNA, 15 nt, Homo sapiens
augcugaaugaaucc

SEQ ID NO: 2041613 - RNA, 17 nt, Homo sapiens
uuaacauaucauucaga

SEQ ID NO: 2041614 - RNA, 15 nt, Homo sapiens
cuuugcaauugugga

SEQ ID NO: 2041615 - RNA, 12 nt, Homo sapiens
acuaaaguauau

SEQ ID NO: 2041616 - RNA, 16 nt, Homo sapiens
uaacuuaagauuugcu

SEQ ID NO: 2041617 - RNA, 22 nt, Homo sapiens
cagggcaaggauccugugcugc

SEQ ID NO: 2041618 - RNA, 20 nt, Homo sapiens
cucagccucccaaguagcug

SEQ ID NO: 2041619 - RNA, 14 nt, Homo sapiens
caggaccugccuag

SEQ ID NO: 2041620 - RNA, 19 nt, Homo sapiens
ucaggggccugcccagugc

SEQ ID NO: 2041621 - RNA, 16 nt, Homo sapiens
ucaguuuuacucugcu

SEQ ID NO: 2041622 - RNA, 17 nt, Homo sapiens
uccaucugacaaauuca

SEQ ID NO: 2041623 - RNA, 22 nt, Homo sapiens
uuauagcacuuugaaauaccuc

SEQ ID NO: 2041624 - RNA, 22 nt, Homo sapiens
ccccagcuauuuucugaccaaa

SEQ ID NO: 2041625 - RNA, 19 nt, Homo sapiens
ccuggugagacuguccaua

SEQ ID NO: 2041626 - RNA, 21 nt, Homo sapiens
aaugcuuaaaaauguauccca

SEQ ID NO: 2041627 - RNA, 20 nt, Homo sapiens
ugaacaccuccuagccacau

SEQ ID NO: 2041628 - RNA, 19 nt, Homo sapiens
cuucuuaggguuaugauua

SEQ ID NO: 2041629 - RNA, 20 nt, Homo sapiens
cuccacauucauguacaaug

SEQ ID NO: 2041630 - RNA, 13 nt, Homo sapiens
uucaagcuucaua

SEQ ID NO: 2041631 - RNA, 24 nt, Homo sapiens
cuccaaccacugugccacugacuu

SEQ ID NO: 2041632 - RNA, 15 nt, Homo sapiens
caaaaaugaauucac

SEQ ID NO: 2041633 - RNA, 20 nt, Homo sapiens
uuucuggccaaaagcaguaa

SEQ ID NO: 2041634 - RNA, 17 nt, Homo sapiens
ccucaaagcauuugcaa

SEQ ID NO: 2041635 - RNA, 16 nt, Homo sapiens
guguugucucuuuccu

SEQ ID NO: 2041636 - RNA, 21 nt, Homo sapiens
cccugguggguggcacucuca

SEQ ID NO: 2041637 - RNA, 21 nt, Homo sapiens
cuugcaauuguuaaucaaaga

SEQ ID NO: 2041638 - RNA, 17 nt, Homo sapiens
aauccucccuuccuccc

SEQ ID NO: 2041639 - RNA, 17 nt, Homo sapiens
auuuccuuuauuccuuu

SEQ ID NO: 2041640 - RNA, 20 nt, Homo sapiens
cuugaaauuaagaaggcaaa

SEQ ID NO: 2041641 - RNA, 16 nt, Homo sapiens
uauuacaaaacaaaca

SEQ ID NO: 2041642 - RNA, 14 nt, Homo sapiens
guguggugaugaau

SEQ ID NO: 2041643 - RNA, 19 nt, Homo sapiens
aacuuccacaagagugaau

SEQ ID NO: 2041644 - RNA, 14 nt, Homo sapiens
gagcugcaggggug

SEQ ID NO: 2041645 - RNA, 18 nt, Homo sapiens
aggcucauuuaaaacagg

SEQ ID NO: 2041646 - RNA, 15 nt, Homo sapiens
cuggcucuaccuucc

SEQ ID NO: 2041647 - RNA, 13 nt, Homo sapiens
ugugucuccugug

SEQ ID NO: 2041648 - RNA, 22 nt, Homo sapiens
caucaaggcacugccugaugga

SEQ ID NO: 2041649 - RNA, 17 nt, Homo sapiens
uccagugguaccagcuc

SEQ ID NO: 2041650 - RNA, 22 nt, Homo sapiens
auggaacacuggaacauuccag

SEQ ID NO: 2041651 - RNA, 18 nt, Homo sapiens
auucuucugagcacuguu

SEQ ID NO: 2041652 - RNA, 18 nt, Homo sapiens
uucauaauuuccaugaua

SEQ ID NO: 2041653 - RNA, 18 nt, Homo sapiens
uauaauuuccucacugcc

SEQ ID NO: 2041654 - RNA, 16 nt, Homo sapiens
aucccauuuuauccca

SEQ ID NO: 2041655 - RNA, 14 nt, Homo sapiens
ugaagggaagccca

SEQ ID NO: 2041656 - RNA, 20 nt, Homo sapiens
cuagaucaaggagcccagaa

SEQ ID NO: 2041657 - RNA, 21 nt, Homo sapiens
ugagaguaagcacguugccca

SEQ ID NO: 2041658 - RNA, 16 nt, Homo sapiens
cuaaagacugaucuca

SEQ ID NO: 2041659 - RNA, 15 nt, Homo sapiens
cuuccagcaugcauc

SEQ ID NO: 2041660 - RNA, 17 nt, Homo sapiens
caggucuuguucaagca

SEQ ID NO: 2041661 - RNA, 22 nt, Homo sapiens
cuaacccaagacaugacauucu

SEQ ID NO: 2041662 - RNA, 13 nt, Homo sapiens
accuguacacaca

SEQ ID NO: 2041663 - RNA, 22 nt, Homo sapiens
uguauguuuacauaucaccuca

SEQ ID NO: 2041664 - RNA, 16 nt, Homo sapiens
caagagguuaggugaa

SEQ ID NO: 2041665 - RNA, 23 nt, Homo sapiens
cuauugggauauccuuucacucu

SEQ ID NO: 2041666 - RNA, 22 nt, Homo sapiens
gauaacuaaaauucugggccua

SEQ ID NO: 2041667 - RNA, 17 nt, Homo sapiens
cauggaguauagugcaa

SEQ ID NO: 2041668 - RNA, 16 nt, Homo sapiens
ucuccauuucugcuca

SEQ ID NO: 2041669 - RNA, 18 nt, Homo sapiens
gcagggauuagguguuca

SEQ ID NO: 2041670 - RNA, 22 nt, Homo sapiens
uaacggaugaccauaugcacaa

SEQ ID NO: 2041671 - RNA, 21 nt, Homo sapiens
ucucguucuuuacugggucua

SEQ ID NO: 2041672 - RNA, 18 nt, Homo sapiens
ugguucagacaagacaga

SEQ ID NO: 2041673 - RNA, 12 nt, Homo sapiens
guuuuagaacca

SEQ ID NO: 2041674 - RNA, 19 nt, Homo sapiens
uacccacacauuccagggc

SEQ ID NO: 2041675 - RNA, 17 nt, Homo sapiens
acugugaguacuacuua

SEQ ID NO: 2041676 - RNA, 22 nt, Homo sapiens
caguuauaauuauuccacucaa

SEQ ID NO: 2041677 - RNA, 19 nt, Homo sapiens
agaauaaaaacuuccuuca

SEQ ID NO: 2041678 - RNA, 16 nt, Homo sapiens
agugcucacaaaggau

SEQ ID NO: 2041679 - RNA, 18 nt, Homo sapiens
uuaagccuuauaaaccaa

SEQ ID NO: 2041680 - RNA, 12 nt, Homo sapiens
ggcucagggauu

SEQ ID NO: 2041681 - RNA, 19 nt, Homo sapiens
uggacccugaggcccagag

SEQ ID NO: 2041682 - RNA, 11 nt, Homo sapiens
ggggucuugca

SEQ ID NO: 2041683 - RNA, 14 nt, Homo sapiens
ucagaauacagaca

SEQ ID NO: 2041684 - RNA, 13 nt, Homo sapiens
ccagaaacaaaaa

SEQ ID NO: 2041685 - RNA, 17 nt, Homo sapiens
aaagccuucauugccuu

SEQ ID NO: 2041686 - RNA, 20 nt, Homo sapiens
cugucccugcagacaugaga

SEQ ID NO: 2041687 - RNA, 22 nt, Homo sapiens
uuccuguaacacaagccacaga

SEQ ID NO: 2041688 - RNA, 16 nt, Homo sapiens
aucagcccagugcaaa

SEQ ID NO: 2041689 - RNA, 16 nt, Homo sapiens
acucugcagacugcua

SEQ ID NO: 2041690 - RNA, 16 nt, Homo sapiens
auguguugaaaaccaa

SEQ ID NO: 2041691 - RNA, 14 nt, Homo sapiens
gccaguuaaggaaa

SEQ ID NO: 2041692 - RNA, 18 nt, Homo sapiens
ugaaaaaucggcuuacca

SEQ ID NO: 2041693 - RNA, 15 nt, Homo sapiens
ccccuccccaaagcc

SEQ ID NO: 2041694 - RNA, 16 nt, Homo sapiens
accagggugagaauaa

SEQ ID NO: 2041695 - RNA, 15 nt, Homo sapiens
acagaaagagacaca

SEQ ID NO: 2041696 - RNA, 15 nt, Homo sapiens
acccaugacucugua

SEQ ID NO: 2041697 - RNA, 15 nt, Homo sapiens
gcccaaauccagugu

SEQ ID NO: 2041698 - RNA, 17 nt, Homo sapiens
gauccagguggucccau

SEQ ID NO: 2041699 - RNA, 18 nt, Homo sapiens
ggccuugcggaagccaua

SEQ ID NO: 2041700 - RNA, 16 nt, Homo sapiens
gaguuccucugcaguu

SEQ ID NO: 2041701 - RNA, 18 nt, Homo sapiens
ugaaaauauagacauucu

SEQ ID NO: 2041702 - RNA, 17 nt, Homo sapiens
augugguccaucucuga

SEQ ID NO: 2041703 - RNA, 23 nt, Homo sapiens
guccugaaaaaugcucaaucuca

SEQ ID NO: 2041704 - RNA, 16 nt, Homo sapiens
gcagcaacaacuguca

SEQ ID NO: 2041705 - RNA, 22 nt, Homo sapiens
ggcggaaaccuugcagcauuuu

SEQ ID NO: 2041706 - RNA, 17 nt, Homo sapiens
ggugccgcugucucuga

SEQ ID NO: 2041707 - RNA, 16 nt, Homo sapiens
agaugccaugugcagg

SEQ ID NO: 2041708 - RNA, 16 nt, Homo sapiens
uaccacaaacacauua

SEQ ID NO: 2041709 - RNA, 22 nt, Homo sapiens
gcuacuccccagaccucaggga

SEQ ID NO: 2041710 - RNA, 11 nt, Homo sapiens
augacauauuu

SEQ ID NO: 2041711 - RNA, 22 nt, Homo sapiens
uaugagugcugauucaaaccaa

SEQ ID NO: 2041712 - RNA, 23 nt, Homo sapiens
guuucugaaaaauaaaaguauaa

SEQ ID NO: 2041713 - RNA, 21 nt, Homo sapiens
aauguaucugugugugauuug

SEQ ID NO: 2041714 - RNA, 19 nt, Homo sapiens
ugaauuauguuuugacaca

SEQ ID NO: 2041715 - RNA, 19 nt, Homo sapiens
cuucugggucaugcacuga

SEQ ID NO: 2041716 - RNA, 20 nt, Homo sapiens
gcuuuuaaaugcucucucau

SEQ ID NO: 2041717 - RNA, 15 nt, Homo sapiens
agggccauugaacuc

SEQ ID NO: 2041718 - RNA, 17 nt, Homo sapiens
uuaaaaggcaagucaaa

SEQ ID NO: 2041719 - RNA, 23 nt, Homo sapiens
gacacuacaugaugacucaaggc

SEQ ID NO: 2041720 - RNA, 17 nt, Homo sapiens
ggcaaaagucauugcug

SEQ ID NO: 2041721 - RNA, 16 nt, Homo sapiens
cuguaugauuccuuga

SEQ ID NO: 2041722 - RNA, 21 nt, Homo sapiens
aagcucccagcugaccagaca

SEQ ID NO: 2041723 - RNA, 18 nt, Homo sapiens
uuuaucugcuaugcuauu

SEQ ID NO: 2041724 - RNA, 14 nt, Homo sapiens
gauggagcuuugua

SEQ ID NO: 2041725 - RNA, 18 nt, Homo sapiens
ugauuuuauacauaguca

SEQ ID NO: 2041726 - RNA, 20 nt, Homo sapiens
aaucaagaaaaacaucuuug

SEQ ID NO: 2041727 - RNA, 17 nt, Homo sapiens
cucacgcucccaacaca

SEQ ID NO: 2041728 - RNA, 16 nt, Homo sapiens
uccccguagccacucu

SEQ ID NO: 2041729 - RNA, 20 nt, Homo sapiens
accacagcagacaccauuca

SEQ ID NO: 2041730 - RNA, 16 nt, Homo sapiens
acgucuuaucuaauca

SEQ ID NO: 2041731 - RNA, 22 nt, Homo sapiens
caccuauauagaugcagcauuu

SEQ ID NO: 2041732 - RNA, 21 nt, Homo sapiens
uaauguugacuuuaauacucu

SEQ ID NO: 2041733 - RNA, 23 nt, Homo sapiens
aggcucacucauugcagauccca

SEQ ID NO: 2041734 - RNA, 14 nt, Homo sapiens
gaagccccacuuga

SEQ ID NO: 2041735 - RNA, 12 nt, Homo sapiens
caaaacacuuuc

SEQ ID NO: 2041736 - RNA, 21 nt, Homo sapiens
gaacaaugaauuauccagcau

SEQ ID NO: 2041737 - RNA, 12 nt, Homo sapiens
cagaugaugcuu

SEQ ID NO: 2041738 - RNA, 15 nt, Homo sapiens
uuuccaauuccaaaa

SEQ ID NO: 2041739 - RNA, 16 nt, Homo sapiens
cuuauucagaaugaga

SEQ ID NO: 2041740 - RNA, 18 nt, Homo sapiens
cuucucuacagacuucuc

SEQ ID NO: 2041741 - RNA, 15 nt, Homo sapiens
guaccaagugaaauu

SEQ ID NO: 2041742 - RNA, 21 nt, Homo sapiens
cggggaucaucucugugaccg

SEQ ID NO: 2041743 - RNA, 15 nt, Homo sapiens
auacccacuaacaaa

SEQ ID NO: 2041744 - RNA, 15 nt, Homo sapiens
gcacuuuggcuuaua

SEQ ID NO: 2041745 - RNA, 20 nt, Homo sapiens
cagaggggcugcuccagugg

SEQ ID NO: 2041746 - RNA, 17 nt, Homo sapiens
auuuauuggucagggug

SEQ ID NO: 2041747 - RNA, 19 nt, Homo sapiens
gaacuccugaccucaggua

SEQ ID NO: 2041748 - RNA, 23 nt, Homo sapiens
cccuguuuuaguuucugaacucu

SEQ ID NO: 2041749 - RNA, 16 nt, Homo sapiens
ccucaagcuuuccugc

SEQ ID NO: 2041750 - RNA, 16 nt, Homo sapiens
ccacaauauuaccuua

SEQ ID NO: 2041751 - RNA, 15 nt, Homo sapiens
gccaagagaccagcc

SEQ ID NO: 2041752 - RNA, 14 nt, Homo sapiens
augugcaguacuua

SEQ ID NO: 2041753 - RNA, 22 nt, Homo sapiens
cucucaggggugauaacucagg

SEQ ID NO: 2041754 - RNA, 12 nt, Homo sapiens
cauucagugaca

SEQ ID NO: 2041755 - RNA, 12 nt, Homo sapiens
cucacaguguuu

SEQ ID NO: 2041756 - RNA, 17 nt, Homo sapiens
ucuauccuguacauuuc

SEQ ID NO: 2041757 - RNA, 15 nt, Homo sapiens
cagccucagauccag

SEQ ID NO: 2041758 - RNA, 11 nt, Homo sapiens
acccucaggcc

SEQ ID NO: 2041759 - RNA, 11 nt, Homo sapiens
ggacucagaga

SEQ ID NO: 2041760 - RNA, 11 nt, Homo sapiens
ggccucagagc

SEQ ID NO: 2041761 - RNA, 14 nt, Homo sapiens
aauuuuacugugaa

SEQ ID NO: 2041762 - RNA, 14 nt, Homo sapiens
aucuucaaagccuu

SEQ ID NO: 2041763 - RNA, 15 nt, Homo sapiens
auuucagcugaucag

SEQ ID NO: 2041764 - RNA, 23 nt, Homo sapiens
uguauccccccccuguauaguua

SEQ ID NO: 2041765 - RNA, 23 nt, Homo sapiens
aacagacagaugaggacagagcu

SEQ ID NO: 2041766 - RNA, 18 nt, Homo sapiens
cacaggaaacuacuucac

SEQ ID NO: 2041767 - RNA, 21 nt, Homo sapiens
auugaaagggaguauuacaaa

SEQ ID NO: 2041768 - RNA, 21 nt, Homo sapiens
guggacuugggaacaggcugu

SEQ ID NO: 2041769 - RNA, 15 nt, Homo sapiens
agcaaggucauuucu

SEQ ID NO: 2041770 - RNA, 20 nt, Homo sapiens
augacauccaauacagaguu

SEQ ID NO: 2041771 - RNA, 18 nt, Homo sapiens
aucgccaaugcacagcuu

SEQ ID NO: 2041772 - RNA, 22 nt, Homo sapiens
caguuaaggggagcaacagagg

SEQ ID NO: 2041773 - RNA, 22 nt, Homo sapiens
auacaggcaugaaccacugcac

SEQ ID NO: 2041774 - RNA, 17 nt, Homo sapiens
cagcaaugccauuucag

SEQ ID NO: 2041775 - RNA, 14 nt, Homo sapiens
uugaugauuuccua

SEQ ID NO: 2041776 - RNA, 16 nt, Homo sapiens
aaggaaauucuuauaa

SEQ ID NO: 2041777 - RNA, 14 nt, Homo sapiens
uccaugccugggaa

SEQ ID NO: 2041778 - RNA, 11 nt, Homo sapiens
caaaacagccu

SEQ ID NO: 2041779 - RNA, 12 nt, Homo sapiens
ggcccucauaca

SEQ ID NO: 2041780 - RNA, 21 nt, Homo sapiens
guguuugcauugucuaaugac

SEQ ID NO: 2041781 - RNA, 17 nt, Homo sapiens
agcucuuugugaaugug

SEQ ID NO: 2041782 - RNA, 17 nt, Homo sapiens
acuaaagagcacuaguu

SEQ ID NO: 2041783 - RNA, 17 nt, Homo sapiens
uacaauucagagaauag

SEQ ID NO: 2041784 - RNA, 21 nt, Homo sapiens
ugccaguaggcucaacuaggg

SEQ ID NO: 2041785 - RNA, 15 nt, Homo sapiens
gaaaaagucauccaa

SEQ ID NO: 2041786 - RNA, 21 nt, Homo sapiens
auuaagauccuaaacucucua

SEQ ID NO: 2041787 - RNA, 14 nt, Homo sapiens
guauaaauguacau

SEQ ID NO: 2041788 - RNA, 18 nt, Homo sapiens
uguauaucguuaucacug

SEQ ID NO: 2041789 - RNA, 15 nt, Homo sapiens
ugugaguccaaagaa

SEQ ID NO: 2041790 - RNA, 13 nt, Homo sapiens
accauaacacuug

SEQ ID NO: 2041791 - RNA, 17 nt, Homo sapiens
aaacuucuggugugaua

SEQ ID NO: 2041792 - RNA, 17 nt, Homo sapiens
auaugauuguuucucaa

SEQ ID NO: 2041793 - RNA, 23 nt, Homo sapiens
guuucuuguaacuggguucaaaa

SEQ ID NO: 2041794 - RNA, 22 nt, Homo sapiens
ucaccuggggcugcuggccuga

SEQ ID NO: 2041795 - RNA, 20 nt, Homo sapiens
uagcaugcuacuuggggaca

SEQ ID NO: 2041796 - RNA, 16 nt, Homo sapiens
cuuggcauaagacaga

SEQ ID NO: 2041797 - RNA, 13 nt, Homo sapiens
guccgccaguguu

SEQ ID NO: 2041798 - RNA, 20 nt, Homo sapiens
uccauagauccccccacuga

SEQ ID NO: 2041799 - RNA, 15 nt, Homo sapiens
uggcucacaaacagu

SEQ ID NO: 2041800 - RNA, 16 nt, Homo sapiens
agaagcccuguucucg

SEQ ID NO: 2041801 - RNA, 20 nt, Homo sapiens
augcuuuucugccacuccau

SEQ ID NO: 2041802 - RNA, 16 nt, Homo sapiens
ugacuuccugccaugg

SEQ ID NO: 2041803 - RNA, 16 nt, Homo sapiens
uagaagucacauuccu

SEQ ID NO: 2041804 - RNA, 15 nt, Homo sapiens
cuccaaauccaagga

SEQ ID NO: 2041805 - RNA, 15 nt, Homo sapiens
guuguguaaugucau

SEQ ID NO: 2041806 - RNA, 18 nt, Homo sapiens
uuucaguauaauuuaacu

SEQ ID NO: 2041807 - RNA, 19 nt, Homo sapiens
ggagcaaagaaggagcuga

SEQ ID NO: 2041808 - RNA, 19 nt, Homo sapiens
aauuacauuucacuucaag

SEQ ID NO: 2041809 - RNA, 15 nt, Homo sapiens
cagaagaugugauga

SEQ ID NO: 2041810 - RNA, 15 nt, Homo sapiens
cacuuucucuucaau

SEQ ID NO: 2041811 - RNA, 14 nt, Homo sapiens
gagcauaaacaaua

SEQ ID NO: 2041812 - RNA, 18 nt, Homo sapiens
gcuuccuccgcucugggu

SEQ ID NO: 2041813 - RNA, 14 nt, Homo sapiens
guugcaagacucga

SEQ ID NO: 2041814 - RNA, 15 nt, Homo sapiens
auaauuauuacaugg

SEQ ID NO: 2041815 - RNA, 15 nt, Homo sapiens
acagaacuggugcuc

SEQ ID NO: 2041816 - RNA, 23 nt, Homo sapiens
uguggccucagagaaaucacuga

SEQ ID NO: 2041817 - RNA, 16 nt, Homo sapiens
auccuuaacacauuca

SEQ ID NO: 2041818 - RNA, 15 nt, Homo sapiens
gggugcaaugauaau

SEQ ID NO: 2041819 - RNA, 14 nt, Homo sapiens
ucacuugcccugac

SEQ ID NO: 2041820 - RNA, 14 nt, Homo sapiens
agccuauaguaaau

SEQ ID NO: 2041821 - RNA, 20 nt, Homo sapiens
uaccugcuguggaugcuuca

SEQ ID NO: 2041822 - RNA, 20 nt, Homo sapiens
cuuauaagacucacaguaua

SEQ ID NO: 2041823 - RNA, 22 nt, Homo sapiens
caguuaacuuuaagacugagca

SEQ ID NO: 2041824 - RNA, 12 nt, Homo sapiens
gaagccaugucu

SEQ ID NO: 2041825 - RNA, 19 nt, Homo sapiens
cuuguauuuugugaagacu

SEQ ID NO: 2041826 - RNA, 16 nt, Homo sapiens
guauccugcccagugu

SEQ ID NO: 2041827 - RNA, 20 nt, Homo sapiens
guggcuuaccaagaucacau

SEQ ID NO: 2041828 - RNA, 22 nt, Homo sapiens
ucauaggggcagguccuagucg

SEQ ID NO: 2041829 - RNA, 16 nt, Homo sapiens
cgugcauuagcacaga

SEQ ID NO: 2041830 - RNA, 23 nt, Homo sapiens
gcugacaugcucacacauuacaa

SEQ ID NO: 2041831 - RNA, 16 nt, Homo sapiens
agcacuguuucucuca

SEQ ID NO: 2041832 - RNA, 17 nt, Homo sapiens
aaacauacagaauguuc

SEQ ID NO: 2041833 - RNA, 21 nt, Homo sapiens
cuaaacuucauacaauguaag

SEQ ID NO: 2041834 - RNA, 19 nt, Homo sapiens
cuuaucuagccaaagagcu

SEQ ID NO: 2041835 - RNA, 18 nt, Homo sapiens
uauaaagcuuaaauuuua

SEQ ID NO: 2041836 - RNA, 23 nt, Homo sapiens
aaccucugccccccaaguucaag

SEQ ID NO: 2041837 - RNA, 16 nt, Homo sapiens
agcaucuguaacagca

SEQ ID NO: 2041838 - RNA, 21 nt, Homo sapiens
auuuucaaguuauucagaaau

SEQ ID NO: 2041839 - RNA, 23 nt, Homo sapiens
aaagugaaccacaagacucccuc

SEQ ID NO: 2041840 - RNA, 14 nt, Homo sapiens
acaaagcuaaauac

SEQ ID NO: 2041841 - RNA, 20 nt, Homo sapiens
ggcccuaaaggacucuccag

SEQ ID NO: 2041842 - RNA, 18 nt, Homo sapiens
cauggcgaaaggagugac

SEQ ID NO: 2041843 - RNA, 16 nt, Homo sapiens
uauuuuccaagugugc

SEQ ID NO: 2041844 - RNA, 16 nt, Homo sapiens
guugaauaaugcuguu

SEQ ID NO: 2041845 - RNA, 13 nt, Homo sapiens
accucacacaccu

SEQ ID NO: 2041846 - RNA, 14 nt, Homo sapiens
acucacucacucug

SEQ ID NO: 2041847 - RNA, 21 nt, Homo sapiens
auucucacuccaccacccaaa

SEQ ID NO: 2041848 - RNA, 18 nt, Homo sapiens
ugaaagcuguuucauuug

SEQ ID NO: 2041849 - RNA, 15 nt, Homo sapiens
acgccccgggcaaag

SEQ ID NO: 2041850 - RNA, 16 nt, Homo sapiens
ccucaaagaggccuua

SEQ ID NO: 2041851 - RNA, 14 nt, Homo sapiens
auaugggguuggug

SEQ ID NO: 2041852 - RNA, 15 nt, Homo sapiens
aacuccccuacauca

SEQ ID NO: 2041853 - RNA, 13 nt, Homo sapiens
aaguggauucagu

SEQ ID NO: 2041854 - RNA, 14 nt, Homo sapiens
caacaaagaggaca

SEQ ID NO: 2041855 - RNA, 14 nt, Homo sapiens
uuuuaaggcuucaa

SEQ ID NO: 2041856 - RNA, 21 nt, Homo sapiens
auguaaaauaaguauuuccau

SEQ ID NO: 2041857 - RNA, 18 nt, Homo sapiens
ucuuuugguugccuuaaa

SEQ ID NO: 2041858 - RNA, 22 nt, Homo sapiens
accucuuuugagacuuugccca

SEQ ID NO: 2041859 - RNA, 17 nt, Homo sapiens
uugaaauuaaccauaga

SEQ ID NO: 2041860 - RNA, 19 nt, Homo sapiens
uucugauggccagcaaaug

SEQ ID NO: 2041861 - RNA, 16 nt, Homo sapiens
gcacugagaaagccaa

SEQ ID NO: 2041862 - RNA, 23 nt, Homo sapiens
gauucuauaaaacacaucaucaa

SEQ ID NO: 2041863 - RNA, 20 nt, Homo sapiens
cuuauaucaucagcauaccu

SEQ ID NO: 2041864 - RNA, 23 nt, Homo sapiens
ugugucagaaaaaggaaaccaca

SEQ ID NO: 2041865 - RNA, 21 nt, Homo sapiens
uuugaguagauauuacuuuau

SEQ ID NO: 2041866 - RNA, 14 nt, Homo sapiens
guaucucuaugugg

SEQ ID NO: 2041867 - RNA, 14 nt, Homo sapiens
ucggccuccaugac

SEQ ID NO: 2041868 - RNA, 21 nt, Homo sapiens
ccacugagaagugcacuuuaa

SEQ ID NO: 2041869 - RNA, 16 nt, Homo sapiens
uccaucauuaauguga

SEQ ID NO: 2041870 - RNA, 16 nt, Homo sapiens
uucaguggacuauaau

SEQ ID NO: 2041871 - RNA, 15 nt, Homo sapiens
gacagugaccccagu

SEQ ID NO: 2041872 - RNA, 21 nt, Homo sapiens
ugccauagaacaagauaccag

SEQ ID NO: 2041873 - RNA, 18 nt, Homo sapiens
aaaauaaaauacuuugag

SEQ ID NO: 2041874 - RNA, 20 nt, Homo sapiens
ucccuaaggagccugggaug

SEQ ID NO: 2041875 - RNA, 17 nt, Homo sapiens
agaaaaauaucuuggcc

SEQ ID NO: 2041876 - RNA, 14 nt, Homo sapiens
gaaagaugagcuuu

SEQ ID NO: 2041877 - RNA, 15 nt, Homo sapiens
cugaccuugugaucu

SEQ ID NO: 2041878 - RNA, 11 nt, Homo sapiens
ucagcaauucc

SEQ ID NO: 2041879 - RNA, 16 nt, Homo sapiens
cuuagcugucugcuca

SEQ ID NO: 2041880 - RNA, 13 nt, Homo sapiens
gaacagaaauauu

SEQ ID NO: 2041881 - RNA, 16 nt, Homo sapiens
ugcagacucacugugg

SEQ ID NO: 2041882 - RNA, 23 nt, Homo sapiens
cauuuuuucuuuaucaaggagau

SEQ ID NO: 2041883 - RNA, 15 nt, Homo sapiens
ucagaaauauaugca

SEQ ID NO: 2041884 - RNA, 21 nt, Homo sapiens
aaguauuuaauucauguugcc

SEQ ID NO: 2041885 - RNA, 19 nt, Homo sapiens
gccguguguuuagaagccu

SEQ ID NO: 2041886 - RNA, 19 nt, Homo sapiens
cgcaggucugggagccaga

SEQ ID NO: 2041887 - RNA, 18 nt, Homo sapiens
cccaugguagacugugac

SEQ ID NO: 2041888 - RNA, 19 nt, Homo sapiens
auacuagacucauacucaa

SEQ ID NO: 2041889 - RNA, 21 nt, Homo sapiens
uucaggaacacccccaugaca

SEQ ID NO: 2041890 - RNA, 23 nt, Homo sapiens
gaaaaucuucauggaauucacaa

SEQ ID NO: 2041891 - RNA, 22 nt, Homo sapiens
uacaacacauugaaacuguauu

SEQ ID NO: 2041892 - RNA, 15 nt, Homo sapiens
uacucaaagucaucc

SEQ ID NO: 2041893 - RNA, 16 nt, Homo sapiens
agcagacauuguuaca

SEQ ID NO: 2041894 - RNA, 16 nt, Homo sapiens
cauauuuauuuuuacc

SEQ ID NO: 2041895 - RNA, 16 nt, Homo sapiens
cucuuuucuacauaca

SEQ ID NO: 2041896 - RNA, 23 nt, Homo sapiens
ccuugaauauccccucccaguca

SEQ ID NO: 2041897 - RNA, 14 nt, Homo sapiens
aaaaucgaaugcug

SEQ ID NO: 2041898 - RNA, 15 nt, Homo sapiens
gaauaaagucuuucc

SEQ ID NO: 2041899 - RNA, 19 nt, Homo sapiens
aacugcagugauguauaca

SEQ ID NO: 2041900 - RNA, 13 nt, Homo sapiens
ucuaaucuuguca

SEQ ID NO: 2041901 - RNA, 13 nt, Homo sapiens
ugcauucuucccu

SEQ ID NO: 2041902 - RNA, 18 nt, Homo sapiens
aauguuaauguuauauca

SEQ ID NO: 2041903 - RNA, 17 nt, Homo sapiens
auucauuuucugccuau

SEQ ID NO: 2041904 - RNA, 15 nt, Homo sapiens
uguggacagcccggg

SEQ ID NO: 2041905 - RNA, 15 nt, Homo sapiens
agaauggaaggugga

SEQ ID NO: 2041906 - RNA, 21 nt, Homo sapiens
ccacacuguggccaggccuua

SEQ ID NO: 2041907 - RNA, 17 nt, Homo sapiens
cuggugcuacuccaugc

SEQ ID NO: 2041908 - RNA, 12 nt, Homo sapiens
cuguuagcauua

SEQ ID NO: 2041909 - RNA, 22 nt, Homo sapiens
uaucuuuguguugcagccucaa

SEQ ID NO: 2041910 - RNA, 15 nt, Homo sapiens
aggacuaaguucuca

SEQ ID NO: 2041911 - RNA, 21 nt, Homo sapiens
aggagggucccgguguauccu

SEQ ID NO: 2041912 - RNA, 23 nt, Homo sapiens
uuugagcuaaucuucauuucuaa

SEQ ID NO: 2041913 - RNA, 21 nt, Homo sapiens
uaauguacaauaaagcaaugu

SEQ ID NO: 2041914 - RNA, 15 nt, Homo sapiens
caacaccagaacugu

SEQ ID NO: 2041915 - RNA, 17 nt, Homo sapiens
uggcucucuaauuccac

SEQ ID NO: 2041916 - RNA, 14 nt, Homo sapiens
aaagauucugcauu

SEQ ID NO: 2041917 - RNA, 22 nt, Homo sapiens
ccagcacucugguuaaauuuua

SEQ ID NO: 2041918 - RNA, 18 nt, Homo sapiens
cgaaagaagaaaauauca

SEQ ID NO: 2041919 - RNA, 12 nt, Homo sapiens
cucuugcucaaa

SEQ ID NO: 2041920 - RNA, 23 nt, Homo sapiens
guucuccgugaugcuguuuuucu

SEQ ID NO: 2041921 - RNA, 11 nt, Homo sapiens
aaagcuucccc

SEQ ID NO: 2041922 - RNA, 17 nt, Homo sapiens
ucagugaaaaauaauua

SEQ ID NO: 2041923 - RNA, 15 nt, Homo sapiens
accuaauacagcaga

SEQ ID NO: 2041924 - RNA, 22 nt, Homo sapiens
cuuuguaacuguuuucaaggag

SEQ ID NO: 2041925 - RNA, 10 nt, Homo sapiens
ggaugugaug

SEQ ID NO: 2041926 - RNA, 17 nt, Homo sapiens
ccuucugaucuccaaaa

SEQ ID NO: 2041927 - RNA, 12 nt, Homo sapiens
ccagaguuauuu

SEQ ID NO: 2041928 - RNA, 21 nt, Homo sapiens
auauauauguauauacauauc

SEQ ID NO: 2041929 - RNA, 20 nt, Homo sapiens
uggccaugguccccagcuga

SEQ ID NO: 2041930 - RNA, 12 nt, Homo sapiens
gaggaagcacac

SEQ ID NO: 2041931 - RNA, 23 nt, Homo sapiens
agggggcccucugccucauggca

SEQ ID NO: 2041932 - RNA, 18 nt, Homo sapiens
cuccuuugaaaccugcuc

SEQ ID NO: 2041933 - RNA, 21 nt, Homo sapiens
auagaagaauaagucauggag

SEQ ID NO: 2041934 - RNA, 21 nt, Homo sapiens
gccuggcaggggccaggacaa

SEQ ID NO: 2041935 - RNA, 17 nt, Homo sapiens
aauauaucaauguaaca

SEQ ID NO: 2041936 - RNA, 14 nt, Homo sapiens
ugcauacaguaauu

SEQ ID NO: 2041937 - RNA, 19 nt, Homo sapiens
ccucaaaugcaccauguca

SEQ ID NO: 2041938 - RNA, 21 nt, Homo sapiens
ggagacccucgcccaacucca

SEQ ID NO: 2041939 - RNA, 14 nt, Homo sapiens
guagaaaaccucac

SEQ ID NO: 2041940 - RNA, 20 nt, Homo sapiens
uacaccuuuaucucaagaua

SEQ ID NO: 2041941 - RNA, 19 nt, Homo sapiens
cagacaagucuugcugugc

SEQ ID NO: 2041942 - RNA, 18 nt, Homo sapiens
ucagcuuuuguucuagac

SEQ ID NO: 2041943 - RNA, 12 nt, Homo sapiens
cccuggugggcc

SEQ ID NO: 2041944 - RNA, 12 nt, Homo sapiens
ccuccuuuccaa

SEQ ID NO: 2041945 - RNA, 20 nt, Homo sapiens
cauggcaaaucaggggccag

SEQ ID NO: 2041946 - RNA, 13 nt, Homo sapiens
aacuguugucaua

SEQ ID NO: 2041947 - RNA, 18 nt, Homo sapiens
uuauaacucaacauuugu

SEQ ID NO: 2041948 - RNA, 16 nt, Homo sapiens
gugacaucaguggcau

SEQ ID NO: 2041949 - RNA, 17 nt, Homo sapiens
cuauguuuggaguuuaa

SEQ ID NO: 2041950 - RNA, 20 nt, Homo sapiens
ccaaugcucuggagugugca

SEQ ID NO: 2041951 - RNA, 17 nt, Homo sapiens
ccuguaaucucagcacu

SEQ ID NO: 2041952 - RNA, 20 nt, Homo sapiens
aaguucuuggauuacuuuac

SEQ ID NO: 2041953 - RNA, 19 nt, Homo sapiens
ugcccuguuagcuuuccaa

SEQ ID NO: 2041954 - RNA, 20 nt, Homo sapiens
ccucccaaagugcuaguauu

SEQ ID NO: 2041955 - RNA, 19 nt, Homo sapiens
auucaggcuuuaggcauau

SEQ ID NO: 2041956 - RNA, 13 nt, Homo sapiens
aaagccauugugu

SEQ ID NO: 2041957 - RNA, 17 nt, Homo sapiens
agugcacccacucugcu

SEQ ID NO: 2041958 - RNA, 23 nt, Homo sapiens
gaagccauccugcccuucugacc

SEQ ID NO: 2041959 - RNA, 15 nt, Homo sapiens
agaauuuugcacagu

SEQ ID NO: 2041960 - RNA, 16 nt, Homo sapiens
caggcucaacugagga

SEQ ID NO: 2041961 - RNA, 15 nt, Homo sapiens
cuucagucucuauac

SEQ ID NO: 2041962 - RNA, 19 nt, Homo sapiens
caagauccuccugcugcag

SEQ ID NO: 2041963 - RNA, 18 nt, Homo sapiens
cagauccuuuuccauccc

SEQ ID NO: 2041964 - RNA, 16 nt, Homo sapiens
cucggcucacugcaaa

SEQ ID NO: 2041965 - RNA, 12 nt, Homo sapiens
ugagcagaugau

SEQ ID NO: 2041966 - RNA, 23 nt, Homo sapiens
gaaaaugauugcuuaucaguagu

SEQ ID NO: 2041967 - RNA, 21 nt, Homo sapiens
aauaugaagcaggaucacaaa

SEQ ID NO: 2041968 - RNA, 20 nt, Homo sapiens
aucacugaaaucccucuacc

SEQ ID NO: 2041969 - RNA, 13 nt, Homo sapiens
agccagugcucag

SEQ ID NO: 2041970 - RNA, 14 nt, Homo sapiens
uaaaacagaagccu

SEQ ID NO: 2041971 - RNA, 19 nt, Homo sapiens
uauugcuagagguggcaug

SEQ ID NO: 2041972 - RNA, 16 nt, Homo sapiens
uaucuggccugagaca

SEQ ID NO: 2041973 - RNA, 21 nt, Homo sapiens
caacccagaauguaaaaaaga

SEQ ID NO: 2041974 - RNA, 12 nt, Homo sapiens
gccggcucuuuc

SEQ ID NO: 2041975 - RNA, 18 nt, Homo sapiens
uggggcuuuagcuagaag

SEQ ID NO: 2041976 - RNA, 21 nt, Homo sapiens
cucaggcugagcucccucccc

SEQ ID NO: 2041977 - RNA, 14 nt, Homo sapiens
uuccgagugcagaa

SEQ ID NO: 2041978 - RNA, 15 nt, Homo sapiens
ugaacaccacuuugu

SEQ ID NO: 2041979 - RNA, 19 nt, Homo sapiens
uccauccuucaaauaaaca

SEQ ID NO: 2041980 - RNA, 20 nt, Homo sapiens
uccuuguguuuuguccugcc

SEQ ID NO: 2041981 - RNA, 17 nt, Homo sapiens
ugcacagggauucucac

SEQ ID NO: 2041982 - RNA, 16 nt, Homo sapiens
ucugccaggugcuugg

SEQ ID NO: 2041983 - RNA, 15 nt, Homo sapiens
aucuacuacucuguc

SEQ ID NO: 2041984 - RNA, 17 nt, Homo sapiens
uggagugagaugaagga

SEQ ID NO: 2041985 - RNA, 13 nt, Homo sapiens
auguaacugcauu

SEQ ID NO: 2041986 - RNA, 20 nt, Homo sapiens
gaggaacguggucaacucac

SEQ ID NO: 2041987 - RNA, 20 nt, Homo sapiens
agacaucggccuccaugacc

SEQ ID NO: 2041988 - RNA, 16 nt, Homo sapiens
gugaauaaccacuuaa

SEQ ID NO: 2041989 - RNA, 14 nt, Homo sapiens
guggagacuggcag

SEQ ID NO: 2041990 - RNA, 10 nt, Homo sapiens
uucaugccug

SEQ ID NO: 2041991 - RNA, 17 nt, Homo sapiens
guuuuaaguacuacaca

SEQ ID NO: 2041992 - RNA, 18 nt, Homo sapiens
ccgucuuccggucauucu

SEQ ID NO: 2041993 - RNA, 16 nt, Homo sapiens
cuugcacuguauccaa

SEQ ID NO: 2041994 - RNA, 21 nt, Homo sapiens
aaaaccccaucuuuacuaaaa

SEQ ID NO: 2041995 - RNA, 22 nt, Homo sapiens
gcucaaucucggcucacugcaa

SEQ ID NO: 2041996 - RNA, 22 nt, Homo sapiens
caucauuacuguuccagauucc

SEQ ID NO: 2041997 - RNA, 22 nt, Homo sapiens
uuguauguggguuuuacacuaa

SEQ ID NO: 2041998 - RNA, 15 nt, Homo sapiens
gcuguugacauauuu

SEQ ID NO: 2041999 - RNA, 13 nt, Homo sapiens
cagaucaucucca

SEQ ID NO: 2042000 - RNA, 17 nt, Homo sapiens
ccucccagucucaucuc

SEQ ID NO: 2042001 - RNA, 19 nt, Homo sapiens
gggaugggcagaugggccu

SEQ ID NO: 2042002 - RNA, 22 nt, Homo sapiens
caauacaaguuacauacauuua

SEQ ID NO: 2042003 - RNA, 15 nt, Homo sapiens
caguugcaggugcca

SEQ ID NO: 2042004 - RNA, 21 nt, Homo sapiens
ugagaacugguucuugccuuc

SEQ ID NO: 2042005 - RNA, 16 nt, Homo sapiens
cuaaaagugaugugau

SEQ ID NO: 2042006 - RNA, 21 nt, Homo sapiens
ggcuuuggaagccaugugauu

SEQ ID NO: 2042007 - RNA, 22 nt, Homo sapiens
gccguggggccgccgccucuuu

SEQ ID NO: 2042008 - RNA, 22 nt, Homo sapiens
acacuacagaggggccagggga

SEQ ID NO: 2042009 - RNA, 18 nt, Homo sapiens
uccaaugcacaguugcca

SEQ ID NO: 2042010 - RNA, 18 nt, Homo sapiens
aagaucuuuuauuuugcc

SEQ ID NO: 2042011 - RNA, 17 nt, Homo sapiens
gaaguuuaaagaugccu

SEQ ID NO: 2042012 - RNA, 16 nt, Homo sapiens
agcgugagccacugca

SEQ ID NO: 2042013 - RNA, 23 nt, Homo sapiens
agcuccagcuguuaccugagaua

SEQ ID NO: 2042014 - RNA, 15 nt, Homo sapiens
aaccuuuccccagac

SEQ ID NO: 2042015 - RNA, 22 nt, Homo sapiens
aaugugacuugagcccagagug

SEQ ID NO: 2042016 - RNA, 20 nt, Homo sapiens
cagcuugaguggguucucug

SEQ ID NO: 2042017 - RNA, 18 nt, Homo sapiens
aacaggcucacagagauu

SEQ ID NO: 2042018 - RNA, 19 nt, Homo sapiens
ccauagcucuucacuuccu

SEQ ID NO: 2042019 - RNA, 16 nt, Homo sapiens
gacucagggaccuaag

SEQ ID NO: 2042020 - RNA, 22 nt, Homo sapiens
ucaagcuuuuaaaaacuagagc

SEQ ID NO: 2042021 - RNA, 22 nt, Homo sapiens
uccaccuccaccacaucugcca

SEQ ID NO: 2042022 - RNA, 16 nt, Homo sapiens
uaaaagucuucuccca

SEQ ID NO: 2042023 - RNA, 22 nt, Homo sapiens
gaaaugugugugaugugacauu

SEQ ID NO: 2042024 - RNA, 23 nt, Homo sapiens
uaauguggccuuggcauuucuuc

SEQ ID NO: 2042025 - RNA, 18 nt, Homo sapiens
ugccaggcuggagugcag

SEQ ID NO: 2042026 - RNA, 21 nt, Homo sapiens
gacucuggggaggugaacugg

SEQ ID NO: 2042027 - RNA, 14 nt, Homo sapiens
ugggcagaucuccc

SEQ ID NO: 2042028 - RNA, 16 nt, Homo sapiens
ucccagccacacccag

SEQ ID NO: 2042029 - RNA, 18 nt, Homo sapiens
gagcccaaaugaccaaau

SEQ ID NO: 2042030 - RNA, 18 nt, Homo sapiens
uaucuuaugcuauuauuc

SEQ ID NO: 2042031 - RNA, 16 nt, Homo sapiens
aaaaaguuaaacauug

SEQ ID NO: 2042032 - RNA, 18 nt, Homo sapiens
aaccauguauaugagcuu

SEQ ID NO: 2042033 - RNA, 18 nt, Homo sapiens
aaauucuaguguccauaa

SEQ ID NO: 2042034 - RNA, 17 nt, Homo sapiens
acuugacagaacacugu

SEQ ID NO: 2042035 - RNA, 20 nt, Homo sapiens
guauacuuuuugcauaugua

SEQ ID NO: 2042036 - RNA, 23 nt, Homo sapiens
cccuugccauccuaaaagccacc

SEQ ID NO: 2042037 - RNA, 20 nt, Homo sapiens
caugacugcaugacggagcc

SEQ ID NO: 2042038 - RNA, 19 nt, Homo sapiens
auuuuaaacacauuaggaa

SEQ ID NO: 2042039 - RNA, 22 nt, Homo sapiens
auauguugaugaaaaauagcaa

SEQ ID NO: 2042040 - RNA, 14 nt, Homo sapiens
uauaggacucucag

SEQ ID NO: 2042041 - RNA, 20 nt, Homo sapiens
aucuauuuucacacuaucca

SEQ ID NO: 2042042 - RNA, 18 nt, Homo sapiens
cuccugugaaccaacaca

SEQ ID NO: 2042043 - RNA, 18 nt, Homo sapiens
guacaaaaacacaaauac

SEQ ID NO: 2042044 - RNA, 23 nt, Homo sapiens
caagcuaugaucagaagacuuua

SEQ ID NO: 2042045 - RNA, 19 nt, Homo sapiens
uaaaaggccugucccugca

SEQ ID NO: 2042046 - RNA, 13 nt, Homo sapiens
ggaagggaccugg

SEQ ID NO: 2042047 - RNA, 12 nt, Homo sapiens
uaaauucaucag

SEQ ID NO: 2042048 - RNA, 17 nt, Homo sapiens
cccccagugcagcucgu

SEQ ID NO: 2042049 - RNA, 15 nt, Homo sapiens
cacugaacaugcuca

SEQ ID NO: 2042050 - RNA, 13 nt, Homo sapiens
gagcccccugacc

SEQ ID NO: 2042051 - RNA, 12 nt, Homo sapiens
uaguccacaagg

SEQ ID NO: 2042052 - RNA, 19 nt, Homo sapiens
cuucuucagagcugacaca

SEQ ID NO: 2042053 - RNA, 20 nt, Homo sapiens
aaaaucaccucccaccauaa

SEQ ID NO: 2042054 - RNA, 16 nt, Homo sapiens
aucaucaagaauuuaa

SEQ ID NO: 2042055 - RNA, 18 nt, Homo sapiens
cacuacaccuugccuugc

SEQ ID NO: 2042056 - RNA, 17 nt, Homo sapiens
auguuauuugcucuaau

SEQ ID NO: 2042057 - RNA, 20 nt, Homo sapiens
aaguucuggcaagauugaag

SEQ ID NO: 2042058 - RNA, 18 nt, Homo sapiens
ucccacccacagccauag

SEQ ID NO: 2042059 - RNA, 12 nt, Homo sapiens
cauuugguacac

SEQ ID NO: 2042060 - RNA, 20 nt, Homo sapiens
gaauggguguuguaugggga

SEQ ID NO: 2042061 - RNA, 18 nt, Homo sapiens
uuuauuucuucaccagau

SEQ ID NO: 2042062 - RNA, 18 nt, Homo sapiens
aggcccagaaagaggcag

SEQ ID NO: 2042063 - RNA, 22 nt, Homo sapiens
augcacuauauguuuacacaau

SEQ ID NO: 2042064 - RNA, 15 nt, Homo sapiens
ucaaaagcaccagca

SEQ ID NO: 2042065 - RNA, 20 nt, Homo sapiens
aauuuucuugguucuuucag

SEQ ID NO: 2042066 - RNA, 14 nt, Homo sapiens
aauaaauauuuagu

SEQ ID NO: 2042067 - RNA, 18 nt, Homo sapiens
gaaaaccuucugccucau

SEQ ID NO: 2042068 - RNA, 18 nt, Homo sapiens
agugcaauggcaccaucu

SEQ ID NO: 2042069 - RNA, 16 nt, Homo sapiens
agucucauagcuuugg

SEQ ID NO: 2042070 - RNA, 16 nt, Homo sapiens
ggcuaagucaagauca

SEQ ID NO: 2042071 - RNA, 12 nt, Homo sapiens
gcaguucuccca

SEQ ID NO: 2042072 - RNA, 21 nt, Homo sapiens
ggguucuuggugaugcuggca

SEQ ID NO: 2042073 - RNA, 23 nt, Homo sapiens
agccuauguaugccauggaggca

SEQ ID NO: 2042074 - RNA, 19 nt, Homo sapiens
aaacccagacaaccaaaac

SEQ ID NO: 2042075 - RNA, 23 nt, Homo sapiens
uaacucaccagccccacugccag

SEQ ID NO: 2042076 - RNA, 22 nt, Homo sapiens
cuggcugauuuguuugugaugu

SEQ ID NO: 2042077 - RNA, 14 nt, Homo sapiens
gcugcaaugcagca

SEQ ID NO: 2042078 - RNA, 21 nt, Homo sapiens
aucaggggugcauucuggcca

SEQ ID NO: 2042079 - RNA, 15 nt, Homo sapiens
uggagugccuguaca

SEQ ID NO: 2042080 - RNA, 17 nt, Homo sapiens
caguuugguuucuagca

SEQ ID NO: 2042081 - RNA, 15 nt, Homo sapiens
uuucaaccaguuuga

SEQ ID NO: 2042082 - RNA, 20 nt, Homo sapiens
uaugagucucuaugaucuug

SEQ ID NO: 2042083 - RNA, 22 nt, Homo sapiens
gugugagaacuuccaacaagcc

SEQ ID NO: 2042084 - RNA, 21 nt, Homo sapiens
gaccuaucccaaauguggaau

SEQ ID NO: 2042085 - RNA, 13 nt, Homo sapiens
aagucacucugag

SEQ ID NO: 2042086 - RNA, 17 nt, Homo sapiens
ugcccacccguguucuc

SEQ ID NO: 2042087 - RNA, 18 nt, Homo sapiens
aggcagguccacagagag

SEQ ID NO: 2042088 - RNA, 23 nt, Homo sapiens
cagaguguguuuuugcacugucu

SEQ ID NO: 2042089 - RNA, 16 nt, Homo sapiens
ucccaucugcauuuga

SEQ ID NO: 2042090 - RNA, 20 nt, Homo sapiens
uuauagaugaguuuugccag

SEQ ID NO: 2042091 - RNA, 20 nt, Homo sapiens
ucagcaagcccuacagagcu

SEQ ID NO: 2042092 - RNA, 14 nt, Homo sapiens
agagggaguagggc

SEQ ID NO: 2042093 - RNA, 22 nt, Homo sapiens
augauaaauuuaaaugaccuca

SEQ ID NO: 2042094 - RNA, 16 nt, Homo sapiens
uuccuuugccaauuca

SEQ ID NO: 2042095 - RNA, 23 nt, Homo sapiens
auccucaauucaauguggugaug

SEQ ID NO: 2042096 - RNA, 11 nt, Homo sapiens
uaacugagauu

SEQ ID NO: 2042097 - RNA, 18 nt, Homo sapiens
ucagccuugccagagauc

SEQ ID NO: 2042098 - RNA, 23 nt, Homo sapiens
acauuuuaauuuuaguuucauga

SEQ ID NO: 2042099 - RNA, 14 nt, Homo sapiens
gacugugcuacugu

SEQ ID NO: 2042100 - RNA, 22 nt, Homo sapiens
guaaccaggggcugacaaugcg

SEQ ID NO: 2042101 - RNA, 20 nt, Homo sapiens
cacuaggucaaaacauucag

SEQ ID NO: 2042102 - RNA, 16 nt, Homo sapiens
ccucccucacaugaua

SEQ ID NO: 2042103 - RNA, 16 nt, Homo sapiens
gaaggggaaaaccuca

SEQ ID NO: 2042104 - RNA, 14 nt, Homo sapiens
uaaggaaacugcuu

SEQ ID NO: 2042105 - RNA, 20 nt, Homo sapiens
aacucugucuucaccugauu

SEQ ID NO: 2042106 - RNA, 17 nt, Homo sapiens
ugaaucauuaacagugc

SEQ ID NO: 2042107 - RNA, 14 nt, Homo sapiens
agaaauuagcugug

SEQ ID NO: 2042108 - RNA, 22 nt, Homo sapiens
ccgagcucagggcagcugugcu

SEQ ID NO: 2042109 - RNA, 18 nt, Homo sapiens
ucuguuaucgaacacauu

SEQ ID NO: 2042110 - RNA, 12 nt, Homo sapiens
cucacagaguau

SEQ ID NO: 2042111 - RNA, 21 nt, Homo sapiens
agaacccuccaccccuacccc

SEQ ID NO: 2042112 - RNA, 20 nt, Homo sapiens
uacaguguagaguaacacau

SEQ ID NO: 2042113 - RNA, 16 nt, Homo sapiens
aaaauuuuuuucuuuc

SEQ ID NO: 2042114 - RNA, 19 nt, Homo sapiens
augguuuuaaugcaaugag

SEQ ID NO: 2042115 - RNA, 22 nt, Homo sapiens
aaugauagaaacagacugccug

SEQ ID NO: 2042116 - RNA, 21 nt, Homo sapiens
uguuucauauucaugcaagua

SEQ ID NO: 2042117 - RNA, 17 nt, Homo sapiens
caguaaucccagugacu

SEQ ID NO: 2042118 - RNA, 15 nt, Homo sapiens
agauuucaacauauc

SEQ ID NO: 2042119 - RNA, 14 nt, Homo sapiens
uguucuuauggggu

SEQ ID NO: 2042120 - RNA, 14 nt, Homo sapiens
auauuauaacucau

SEQ ID NO: 2042121 - RNA, 11 nt, Homo sapiens
cuaccaucucc

SEQ ID NO: 2042122 - RNA, 13 nt, Homo sapiens
cuaacaugaauug

SEQ ID NO: 2042123 - RNA, 21 nt, Homo sapiens
ucuaaauaugcccaauuucau

SEQ ID NO: 2042124 - RNA, 19 nt, Homo sapiens
cucacuaccuccucaggga

SEQ ID NO: 2042125 - RNA, 12 nt, Homo sapiens
ggcuaaucucag

SEQ ID NO: 2042126 - RNA, 17 nt, Homo sapiens
ugcuguggcaggcagau

SEQ ID NO: 2042127 - RNA, 17 nt, Homo sapiens
ugugcgugcaugugcac

SEQ ID NO: 2042128 - RNA, 16 nt, Homo sapiens
acugagacuuaaggga

SEQ ID NO: 2042129 - RNA, 20 nt, Homo sapiens
aaaaugugucugcaacaugg

SEQ ID NO: 2042130 - RNA, 16 nt, Homo sapiens
aauuaccucucuugcu

SEQ ID NO: 2042131 - RNA, 17 nt, Homo sapiens
aucuucauguccaguga

SEQ ID NO: 2042132 - RNA, 19 nt, Homo sapiens
gcuaguuaaacagugccau

SEQ ID NO: 2042133 - RNA, 21 nt, Homo sapiens
ugaaaaauaguguguccaugc

SEQ ID NO: 2042134 - RNA, 17 nt, Homo sapiens
ugacaaugggagccuca

SEQ ID NO: 2042135 - RNA, 17 nt, Homo sapiens
agcuaacaaguagcaca

SEQ ID NO: 2042136 - RNA, 15 nt, Homo sapiens
cucuaagcccaggau

SEQ ID NO: 2042137 - RNA, 17 nt, Homo sapiens
auuaagagugaaugugu

SEQ ID NO: 2042138 - RNA, 21 nt, Homo sapiens
uacccuuaagucacccuagcc

SEQ ID NO: 2042139 - RNA, 20 nt, Homo sapiens
uaaugccuuuucucaccugu

SEQ ID NO: 2042140 - RNA, 15 nt, Homo sapiens
agaucccacuggaag

SEQ ID NO: 2042141 - RNA, 16 nt, Homo sapiens
ucaagcuuccugugau

SEQ ID NO: 2042142 - RNA, 19 nt, Homo sapiens
auuuuaggauaauugccua

SEQ ID NO: 2042143 - RNA, 21 nt, Homo sapiens
aaaagucugcauuacauuccu

SEQ ID NO: 2042144 - RNA, 13 nt, Homo sapiens
gaaauaaagggac

SEQ ID NO: 2042145 - RNA, 20 nt, Homo sapiens
uucaucuuguacaaacuuug

SEQ ID NO: 2042146 - RNA, 12 nt, Homo sapiens
agaccugccugu

SEQ ID NO: 2042147 - RNA, 23 nt, Homo sapiens
uuuaauguuuucagcccaucucc

SEQ ID NO: 2042148 - RNA, 23 nt, Homo sapiens
cugaaugcugcuuccauuugaca

SEQ ID NO: 2042149 - RNA, 21 nt, Homo sapiens
accaaggcgggagcaucucuu

SEQ ID NO: 2042150 - RNA, 20 nt, Homo sapiens
aucaggaaggaaaugacacc

SEQ ID NO: 2042151 - RNA, 18 nt, Homo sapiens
cuuagaaaacaaguauug

SEQ ID NO: 2042152 - RNA, 13 nt, Homo sapiens
gcaaagugcugaa

SEQ ID NO: 2042153 - RNA, 16 nt, Homo sapiens
acauuucucaggcuag

SEQ ID NO: 2042154 - RNA, 15 nt, Homo sapiens
gacauucacugagug

SEQ ID NO: 2042155 - RNA, 20 nt, Homo sapiens
cuuuaaaaauaugcaccaaa

SEQ ID NO: 2042156 - RNA, 23 nt, Homo sapiens
aacuugggaauaaaucauagcaa

SEQ ID NO: 2042157 - RNA, 23 nt, Homo sapiens
ccauuccaggcagccucugucag

SEQ ID NO: 2042158 - RNA, 23 nt, Homo sapiens
ucaagaaaucccugagacagauu

SEQ ID NO: 2042159 - RNA, 18 nt, Homo sapiens
ucuacccguuccaaaagc

SEQ ID NO: 2042160 - RNA, 15 nt, Homo sapiens
cagcucugaucugag

SEQ ID NO: 2042161 - RNA, 15 nt, Homo sapiens
aucccaagaaaugga

SEQ ID NO: 2042162 - RNA, 13 nt, Homo sapiens
aaauauauauaca

SEQ ID NO: 2042163 - RNA, 16 nt, Homo sapiens
agcuuugcugccugag

SEQ ID NO: 2042164 - RNA, 22 nt, Homo sapiens
uauguaaucucaccucaccugg

SEQ ID NO: 2042165 - RNA, 14 nt, Homo sapiens
ucugaggacauucc

SEQ ID NO: 2042166 - RNA, 19 nt, Homo sapiens
ggccugagaugcaggugau

SEQ ID NO: 2042167 - RNA, 15 nt, Homo sapiens
aaaauguccugccuu

SEQ ID NO: 2042168 - RNA, 19 nt, Homo sapiens
cuguaaucucagcacuuug

SEQ ID NO: 2042169 - RNA, 21 nt, Homo sapiens
aggaguuugggguaugggaga

SEQ ID NO: 2042170 - RNA, 22 nt, Homo sapiens
agaaguugaaacucacuaguaa

SEQ ID NO: 2042171 - RNA, 16 nt, Homo sapiens
cuccgugcguccuccc

SEQ ID NO: 2042172 - RNA, 19 nt, Homo sapiens
uuaagagagugaacauauc

SEQ ID NO: 2042173 - RNA, 15 nt, Homo sapiens
accaaagcugcccac

SEQ ID NO: 2042174 - RNA, 16 nt, Homo sapiens
ccauuaaaaacuacca

SEQ ID NO: 2042175 - RNA, 15 nt, Homo sapiens
aucauggcuaucugu

SEQ ID NO: 2042176 - RNA, 12 nt, Homo sapiens
ucacacuguaaa

SEQ ID NO: 2042177 - RNA, 14 nt, Homo sapiens
ucaauucuagcauu

SEQ ID NO: 2042178 - RNA, 19 nt, Homo sapiens
uaauacacaaugcaucaua

SEQ ID NO: 2042179 - RNA, 19 nt, Homo sapiens
cuaagacuaacaaaggcag

SEQ ID NO: 2042180 - RNA, 22 nt, Homo sapiens
gagacuugaggagggagggcuu

SEQ ID NO: 2042181 - RNA, 19 nt, Homo sapiens
uauuaacagaaauguuucu

SEQ ID NO: 2042182 - RNA, 20 nt, Homo sapiens
auuuccuuaaaaugugagug

SEQ ID NO: 2042183 - RNA, 14 nt, Homo sapiens
ucuauaccaauaaa

SEQ ID NO: 2042184 - RNA, 14 nt, Homo sapiens
uaaaugccacaaag

SEQ ID NO: 2042185 - RNA, 16 nt, Homo sapiens
caauuugucaguguau

SEQ ID NO: 2042186 - RNA, 14 nt, Homo sapiens
ucaucucugcugaa

SEQ ID NO: 2042187 - RNA, 18 nt, Homo sapiens
uuaaguccuacuuuacau

SEQ ID NO: 2042188 - RNA, 13 nt, Homo sapiens
accucauggaauu

SEQ ID NO: 2042189 - RNA, 18 nt, Homo sapiens
agccaacagaugugucag

SEQ ID NO: 2042190 - RNA, 18 nt, Homo sapiens
agagggauugcugugaaa

SEQ ID NO: 2042191 - RNA, 18 nt, Homo sapiens
ucacaugauuccagccau

SEQ ID NO: 2042192 - RNA, 17 nt, Homo sapiens
uuugcccuguggauucc

SEQ ID NO: 2042193 - RNA, 19 nt, Homo sapiens
gucacuggcccaaccagaa

SEQ ID NO: 2042194 - RNA, 16 nt, Homo sapiens
aaagugguaauccucu

SEQ ID NO: 2042195 - RNA, 18 nt, Homo sapiens
gaaacacccacucacuuu

SEQ ID NO: 2042196 - RNA, 21 nt, Homo sapiens
aaacuuccuaaugauuagcac

SEQ ID NO: 2042197 - RNA, 18 nt, Homo sapiens
ccaagaaugagaagaaug

SEQ ID NO: 2042198 - RNA, 24 nt, Homo sapiens
uccaaucuugcuuuguguaucuca

SEQ ID NO: 2042199 - RNA, 14 nt, Homo sapiens
auaaccgcacagac

SEQ ID NO: 2042200 - RNA, 19 nt, Homo sapiens
ggacgccagguggaccugu

SEQ ID NO: 2042201 - RNA, 18 nt, Homo sapiens
ugccaaagggaaauauca

SEQ ID NO: 2042202 - RNA, 18 nt, Homo sapiens
gaaaaguugggcuuucac

SEQ ID NO: 2042203 - RNA, 13 nt, Homo sapiens
gacauuuuucaau

SEQ ID NO: 2042204 - RNA, 14 nt, Homo sapiens
uaccaucuguagag

SEQ ID NO: 2042205 - RNA, 22 nt, Homo sapiens
cacccaacccuaucuccugaca

SEQ ID NO: 2042206 - RNA, 15 nt, Homo sapiens
acccaaacccuaggu

SEQ ID NO: 2042207 - RNA, 23 nt, Homo sapiens
ucugcuggcugauggguggaccu

SEQ ID NO: 2042208 - RNA, 20 nt, Homo sapiens
gaguugccaggcacuuugag

SEQ ID NO: 2042209 - RNA, 18 nt, Homo sapiens
cuauugcuaguacuagua

SEQ ID NO: 2042210 - RNA, 22 nt, Homo sapiens
cauuuggugggcuuuggagcug

SEQ ID NO: 2042211 - RNA, 14 nt, Homo sapiens
agaacagcuucaug

SEQ ID NO: 2042212 - RNA, 14 nt, Homo sapiens
uaaaacuaggugcu

SEQ ID NO: 2042213 - RNA, 13 nt, Homo sapiens
aggguaggggcaa

SEQ ID NO: 2042214 - RNA, 14 nt, Homo sapiens
acauuaaacacaaa

SEQ ID NO: 2042215 - RNA, 13 nt, Homo sapiens
accaccuucccuu

SEQ ID NO: 2042216 - RNA, 17 nt, Homo sapiens
acauuugaugcaaaaug

SEQ ID NO: 2042217 - RNA, 23 nt, Homo sapiens
uaguccccguacuagguuggaca

SEQ ID NO: 2042218 - RNA, 23 nt, Homo sapiens
ugcuuccuccuuugcucuuggga

SEQ ID NO: 2042219 - RNA, 14 nt, Homo sapiens
caucccaucccauc

SEQ ID NO: 2042220 - RNA, 22 nt, Homo sapiens
aagugacaagggcacaagcuca

SEQ ID NO: 2042221 - RNA, 13 nt, Homo sapiens
ucugaggaccuca

SEQ ID NO: 2042222 - RNA, 11 nt, Homo sapiens
cucagccuuuu

SEQ ID NO: 2042223 - RNA, 23 nt, Homo sapiens
gaagccuuggggcugaugcaguu

SEQ ID NO: 2042224 - RNA, 22 nt, Homo sapiens
aacucuuuaucaagcaacauuc

SEQ ID NO: 2042225 - RNA, 13 nt, Homo sapiens
auguuaaagggau

SEQ ID NO: 2042226 - RNA, 14 nt, Homo sapiens
gcucagacugguug

SEQ ID NO: 2042227 - RNA, 17 nt, Homo sapiens
uauagaaccucuuuguc

SEQ ID NO: 2042228 - RNA, 18 nt, Homo sapiens
accuccgccccagacaca

SEQ ID NO: 2042229 - RNA, 15 nt, Homo sapiens
cguauacauaggcau

SEQ ID NO: 2042230 - RNA, 15 nt, Homo sapiens
cagaaauauaugcag

SEQ ID NO: 2042231 - RNA, 18 nt, Homo sapiens
uaugcagaauggcauuug

SEQ ID NO: 2042232 - RNA, 18 nt, Homo sapiens
ugcuggcagccucaggag

SEQ ID NO: 2042233 - RNA, 18 nt, Homo sapiens
ccuuaaagggaauucgau

SEQ ID NO: 2042234 - RNA, 20 nt, Homo sapiens
uguuuuaaauuuugugguuc

SEQ ID NO: 2042235 - RNA, 15 nt, Homo sapiens
ggaggcccugcacug

SEQ ID NO: 2042236 - RNA, 13 nt, Homo sapiens
aguaacugagauu

SEQ ID NO: 2042237 - RNA, 17 nt, Homo sapiens
cugacuggcaccaacac

SEQ ID NO: 2042238 - RNA, 17 nt, Homo sapiens
cagugcuucagccugag

SEQ ID NO: 2042239 - RNA, 16 nt, Homo sapiens
agcuacuagagauauu

SEQ ID NO: 2042240 - RNA, 22 nt, Homo sapiens
guuuuuuuuuuuuuaaucugca

SEQ ID NO: 2042241 - RNA, 23 nt, Homo sapiens
cuguccacgcaauggaacauuau

SEQ ID NO: 2042242 - RNA, 14 nt, Homo sapiens
aaacgcaugugcag

SEQ ID NO: 2042243 - RNA, 16 nt, Homo sapiens
gcaaaagucauuacac

SEQ ID NO: 2042244 - RNA, 18 nt, Homo sapiens
auuggcuacugacuguau

SEQ ID NO: 2042245 - RNA, 20 nt, Homo sapiens
uaugaggggacugcaugcaa

SEQ ID NO: 2042246 - RNA, 14 nt, Homo sapiens
auggaccacuuuua

SEQ ID NO: 2042247 - RNA, 21 nt, Homo sapiens
accauuguacccugcuguaua

SEQ ID NO: 2042248 - RNA, 15 nt, Homo sapiens
aaacaagcauuucaa

SEQ ID NO: 2042249 - RNA, 19 nt, Homo sapiens
gugucuaguuugcauacuu

SEQ ID NO: 2042250 - RNA, 20 nt, Homo sapiens
cauccuucugucuccagggc

SEQ ID NO: 2042251 - RNA, 23 nt, Homo sapiens
ggcccuccucucccauccuugau

SEQ ID NO: 2042252 - RNA, 23 nt, Homo sapiens
cucagcucccauuucuacucuua

SEQ ID NO: 2042253 - RNA, 15 nt, Homo sapiens
aaucuuagagacaaa

SEQ ID NO: 2042254 - RNA, 17 nt, Homo sapiens
caauucacuagaccaga

SEQ ID NO: 2042255 - RNA, 14 nt, Homo sapiens
ucugauuugcauau

SEQ ID NO: 2042256 - RNA, 19 nt, Homo sapiens
ugccaaaggaugugauaua

SEQ ID NO: 2042257 - RNA, 18 nt, Homo sapiens
gcaauugcacucaugugg

SEQ ID NO: 2042258 - RNA, 17 nt, Homo sapiens
aaggccaccuagcuuuu

SEQ ID NO: 2042259 - RNA, 13 nt, Homo sapiens
uuggaaucuguau

SEQ ID NO: 2042260 - RNA, 14 nt, Homo sapiens
aucacugccacacu

SEQ ID NO: 2042261 - RNA, 14 nt, Homo sapiens
cauugagcauuuga

SEQ ID NO: 2042262 - RNA, 23 nt, Homo sapiens
guagcugggccugugcacugggc

SEQ ID NO: 2042263 - RNA, 21 nt, Homo sapiens
acaagcaagcaaaaugcaaac

SEQ ID NO: 2042264 - RNA, 16 nt, Homo sapiens
ugcucugaauuucuuc

SEQ ID NO: 2042265 - RNA, 12 nt, Homo sapiens
uaaaaaguucca

SEQ ID NO: 2042266 - RNA, 14 nt, Homo sapiens
cacuguaguucucu

SEQ ID NO: 2042267 - RNA, 19 nt, Homo sapiens
agagacacggucccaccau

SEQ ID NO: 2042268 - RNA, 14 nt, Homo sapiens
gccaccacauguau

SEQ ID NO: 2042269 - RNA, 13 nt, Homo sapiens
aggcugacugggg

SEQ ID NO: 2042270 - RNA, 13 nt, Homo sapiens
gccuuuucuuaua

SEQ ID NO: 2042271 - RNA, 12 nt, Homo sapiens
uaaaaauucuug

SEQ ID NO: 2042272 - RNA, 14 nt, Homo sapiens
cuguaggaaccaau

SEQ ID NO: 2042273 - RNA, 22 nt, Homo sapiens
auggcagagcauccucucugcc

SEQ ID NO: 2042274 - RNA, 21 nt, Homo sapiens
gagcaaaagacuugagccauc

SEQ ID NO: 2042275 - RNA, 18 nt, Homo sapiens
uggaaaugaauccaucau

SEQ ID NO: 2042276 - RNA, 15 nt, Homo sapiens
cgggagaacgcagua

SEQ ID NO: 2042277 - RNA, 15 nt, Homo sapiens
cuacuuuuuauacuc

SEQ ID NO: 2042278 - RNA, 15 nt, Homo sapiens
auauacuaaccauuu

SEQ ID NO: 2042279 - RNA, 14 nt, Homo sapiens
caauaacuuuucac

SEQ ID NO: 2042280 - RNA, 19 nt, Homo sapiens
uacuacaguccucccaucu

SEQ ID NO: 2042281 - RNA, 10 nt, Homo sapiens
uacacggugg

SEQ ID NO: 2042282 - RNA, 14 nt, Homo sapiens
uaggggaaagaagg

SEQ ID NO: 2042283 - RNA, 15 nt, Homo sapiens
uccaugguuccacag

SEQ ID NO: 2042284 - RNA, 18 nt, Homo sapiens
cagaacuucccugauuga

SEQ ID NO: 2042285 - RNA, 12 nt, Homo sapiens
agugcagugaau

SEQ ID NO: 2042286 - RNA, 20 nt, Homo sapiens
agauagauaggucagugcaa

SEQ ID NO: 2042287 - RNA, 14 nt, Homo sapiens
accaucauuugcaa

SEQ ID NO: 2042288 - RNA, 15 nt, Homo sapiens
aauguuugcauuucc

SEQ ID NO: 2042289 - RNA, 15 nt, Homo sapiens
cacugauuuuguaca

SEQ ID NO: 2042290 - RNA, 14 nt, Homo sapiens
cauggacuacacca

SEQ ID NO: 2042291 - RNA, 13 nt, Homo sapiens
ccucuccaaagag

SEQ ID NO: 2042292 - RNA, 12 nt, Homo sapiens
uuccucacugcc

SEQ ID NO: 2042293 - RNA, 13 nt, Homo sapiens
auaguaaaugccu

SEQ ID NO: 2042294 - RNA, 16 nt, Homo sapiens
ugaauaggaguucucc

SEQ ID NO: 2042295 - RNA, 15 nt, Homo sapiens
ccguccucacccauc

SEQ ID NO: 2042296 - RNA, 12 nt, Homo sapiens
ugaucacacagc

SEQ ID NO: 2042297 - RNA, 22 nt, Homo sapiens
guucccagcaggaauuucuuuu

SEQ ID NO: 2042298 - RNA, 15 nt, Homo sapiens
auauucacucugugg

SEQ ID NO: 2042299 - RNA, 21 nt, Homo sapiens
agcuguuuuuaggcuguuccu

SEQ ID NO: 2042300 - RNA, 17 nt, Homo sapiens
ugucugcucaguaauuu

SEQ ID NO: 2042301 - RNA, 18 nt, Homo sapiens
cagaagcggagagccugg

SEQ ID NO: 2042302 - RNA, 15 nt, Homo sapiens
gggaggcugagccag

SEQ ID NO: 2042303 - RNA, 14 nt, Homo sapiens
uuuaagaaauuccu

SEQ ID NO: 2042304 - RNA, 14 nt, Homo sapiens
ugcacuaaagccag

SEQ ID NO: 2042305 - RNA, 19 nt, Homo sapiens
auugcuagguuuugcuaca

SEQ ID NO: 2042306 - RNA, 16 nt, Homo sapiens
agaggaaccaauaccu

SEQ ID NO: 2042307 - RNA, 23 nt, Homo sapiens
caucacuggcucucuaauuccac

SEQ ID NO: 2042308 - RNA, 17 nt, Homo sapiens
uccaggaaaguggccaa

SEQ ID NO: 2042309 - RNA, 14 nt, Homo sapiens
aagaauaagacaua

SEQ ID NO: 2042310 - RNA, 19 nt, Homo sapiens
uggugggcccccaaugaca

SEQ ID NO: 2042311 - RNA, 14 nt, Homo sapiens
ugcaauuuccauuc

SEQ ID NO: 2042312 - RNA, 14 nt, Homo sapiens
gacagccaccaaga

SEQ ID NO: 2042313 - RNA, 16 nt, Homo sapiens
cuuauccacuuugacu

SEQ ID NO: 2042314 - RNA, 15 nt, Homo sapiens
aauaguguucugcaa

SEQ ID NO: 2042315 - RNA, 14 nt, Homo sapiens
uauucuggacuaaa

SEQ ID NO: 2042316 - RNA, 23 nt, Homo sapiens
aagcuggugucugauuuuggcca

SEQ ID NO: 2042317 - RNA, 15 nt, Homo sapiens
agaucaugaguuugu

SEQ ID NO: 2042318 - RNA, 15 nt, Homo sapiens
ccuccaagccacuga

SEQ ID NO: 2042319 - RNA, 16 nt, Homo sapiens
guccucacucucgcca

SEQ ID NO: 2042320 - RNA, 22 nt, Homo sapiens
cauguuguugaggcugucacag

SEQ ID NO: 2042321 - RNA, 13 nt, Homo sapiens
aacauuccuccag

SEQ ID NO: 2042322 - RNA, 17 nt, Homo sapiens
aauaaacugcuuugcaa

SEQ ID NO: 2042323 - RNA, 14 nt, Homo sapiens
auccuggacagcuc

SEQ ID NO: 2042324 - RNA, 23 nt, Homo sapiens
ucucuugcugggaacacagccag

SEQ ID NO: 2042325 - RNA, 16 nt, Homo sapiens
gcggccucuucucuca

SEQ ID NO: 2042326 - RNA, 22 nt, Homo sapiens
aaagccccagcccauuccuccc

SEQ ID NO: 2042327 - RNA, 14 nt, Homo sapiens
uuguauaaggugag

SEQ ID NO: 2042328 - RNA, 18 nt, Homo sapiens
aaauagcccagccuuuug

SEQ ID NO: 2042329 - RNA, 12 nt, Homo sapiens
agauuacccaaa

SEQ ID NO: 2042330 - RNA, 16 nt, Homo sapiens
caaaaaaccaauuuac

SEQ ID NO: 2042331 - RNA, 12 nt, Homo sapiens
cugcacucaaga

SEQ ID NO: 2042332 - RNA, 18 nt, Homo sapiens
agaauacuaauaaaauac

SEQ ID NO: 2042333 - RNA, 19 nt, Homo sapiens
ugaagauuuaugaugcacu

SEQ ID NO: 2042334 - RNA, 14 nt, Homo sapiens
ggaagucucaaaga

SEQ ID NO: 2042335 - RNA, 16 nt, Homo sapiens
ccguuaggaaaaccag

SEQ ID NO: 2042336 - RNA, 19 nt, Homo sapiens
gacuuugaggguguauauu

SEQ ID NO: 2042337 - RNA, 19 nt, Homo sapiens
ugaauuuucaagcaucucc

SEQ ID NO: 2042338 - RNA, 14 nt, Homo sapiens
uccugugcugcgau

SEQ ID NO: 2042339 - RNA, 22 nt, Homo sapiens
ccaaacccaucuuuuguucucc

SEQ ID NO: 2042340 - RNA, 16 nt, Homo sapiens
aaugaaccccacuggg

SEQ ID NO: 2042341 - RNA, 15 nt, Homo sapiens
cacagcuaaccacuu

SEQ ID NO: 2042342 - RNA, 15 nt, Homo sapiens
ucacuguguaaccag

SEQ ID NO: 2042343 - RNA, 23 nt, Homo sapiens
ugugcaauguguauaaacaagaa

SEQ ID NO: 2042344 - RNA, 22 nt, Homo sapiens
acucucuuuguaaaaauuuugu

SEQ ID NO: 2042345 - RNA, 21 nt, Homo sapiens
ugccuccccugucucuaagga

SEQ ID NO: 2042346 - RNA, 19 nt, Homo sapiens
cauuugcuggagcucugcc

SEQ ID NO: 2042347 - RNA, 22 nt, Homo sapiens
uggaagaagccauugagcucuc

SEQ ID NO: 2042348 - RNA, 14 nt, Homo sapiens
uccuguuguaaucu

SEQ ID NO: 2042349 - RNA, 17 nt, Homo sapiens
acugugacauuccacag

SEQ ID NO: 2042350 - RNA, 14 nt, Homo sapiens
caggaucugaguua

SEQ ID NO: 2042351 - RNA, 14 nt, Homo sapiens
cugaggcugugagc

SEQ ID NO: 2042352 - RNA, 14 nt, Homo sapiens
ucagcaucacgaca

SEQ ID NO: 2042353 - RNA, 14 nt, Homo sapiens
agaggaucuggaga

SEQ ID NO: 2042354 - RNA, 17 nt, Homo sapiens
guuucuaccuauaugca

SEQ ID NO: 2042355 - RNA, 19 nt, Homo sapiens
uuucaacagaaauauucua

SEQ ID NO: 2042356 - RNA, 16 nt, Homo sapiens
gauaggugagcaacuu

SEQ ID NO: 2042357 - RNA, 16 nt, Homo sapiens
aagucagagacagaua

SEQ ID NO: 2042358 - RNA, 17 nt, Homo sapiens
ucuccucucucuguaau

SEQ ID NO: 2042359 - RNA, 12 nt, Homo sapiens
cucccacuccag

SEQ ID NO: 2042360 - RNA, 19 nt, Homo sapiens
ccacgugccauugucuuuc

SEQ ID NO: 2042361 - RNA, 15 nt, Homo sapiens
cuuugaagaugucau

SEQ ID NO: 2042362 - RNA, 22 nt, Homo sapiens
gacacuucuaaaugaagugcaa

SEQ ID NO: 2042363 - RNA, 21 nt, Homo sapiens
uccagacagacagggggcuaa

SEQ ID NO: 2042364 - RNA, 18 nt, Homo sapiens
uguggaauuuaaaucacu

SEQ ID NO: 2042365 - RNA, 14 nt, Homo sapiens
aaagccgcccagug

SEQ ID NO: 2042366 - RNA, 14 nt, Homo sapiens
acucuucuuaucac

SEQ ID NO: 2042367 - RNA, 20 nt, Homo sapiens
uuuuuauaucuuggcaggua

SEQ ID NO: 2042368 - RNA, 14 nt, Homo sapiens
auaaauaacacuug

SEQ ID NO: 2042369 - RNA, 19 nt, Homo sapiens
ucaggacugugaccaaagc

SEQ ID NO: 2042370 - RNA, 16 nt, Homo sapiens
cacugagcaauguaua

SEQ ID NO: 2042371 - RNA, 19 nt, Homo sapiens
uucagaugcuucugggaga

SEQ ID NO: 2042372 - RNA, 13 nt, Homo sapiens
uccugugggaccu

SEQ ID NO: 2042373 - RNA, 21 nt, Homo sapiens
aaccacuuaaaaaauguccau

SEQ ID NO: 2042374 - RNA, 15 nt, Homo sapiens
acauuuaaauuccac

SEQ ID NO: 2042375 - RNA, 13 nt, Homo sapiens
ucuugcuaugaaa

SEQ ID NO: 2042376 - RNA, 19 nt, Homo sapiens
cugaagaggaaaagucaaa

SEQ ID NO: 2042377 - RNA, 21 nt, Homo sapiens
uuucacauuguuugcugcuau

SEQ ID NO: 2042378 - RNA, 18 nt, Homo sapiens
caauggaaacuguaccau

SEQ ID NO: 2042379 - RNA, 17 nt, Homo sapiens
aguuucacuguacugca

SEQ ID NO: 2042380 - RNA, 13 nt, Homo sapiens
cuccaacugugga

SEQ ID NO: 2042381 - RNA, 23 nt, Homo sapiens
agaauuuucaaaaucaaauucca

SEQ ID NO: 2042382 - RNA, 21 nt, Homo sapiens
caacauggauguguugccccu

SEQ ID NO: 2042383 - RNA, 23 nt, Homo sapiens
auaauaaaguaauugacaaauga

SEQ ID NO: 2042384 - RNA, 16 nt, Homo sapiens
aguucaauacagugaa

SEQ ID NO: 2042385 - RNA, 14 nt, Homo sapiens
aguucauugcucaa

SEQ ID NO: 2042386 - RNA, 22 nt, Homo sapiens
ccucuucccuuccuccauugca

SEQ ID NO: 2042387 - RNA, 18 nt, Homo sapiens
ggacuauuacauccacau

SEQ ID NO: 2042388 - RNA, 18 nt, Homo sapiens
ugcauugaauacucugaa

SEQ ID NO: 2042389 - RNA, 18 nt, Homo sapiens
uggcuacuucccuuccuc

SEQ ID NO: 2042390 - RNA, 18 nt, Homo sapiens
aacaggcuugaaucaaag

SEQ ID NO: 2042391 - RNA, 17 nt, Homo sapiens
cucugcauauucuagua

SEQ ID NO: 2042392 - RNA, 22 nt, Homo sapiens
ugcaggcagauuaauaacagaa

SEQ ID NO: 2042393 - RNA, 17 nt, Homo sapiens
cuggggaccuggcacug

SEQ ID NO: 2042394 - RNA, 21 nt, Homo sapiens
acagaggaugcugacaucauu

SEQ ID NO: 2042395 - RNA, 12 nt, Homo sapiens
acacaugcacac

SEQ ID NO: 2042396 - RNA, 12 nt, Homo sapiens
ucaaaugcucaa

SEQ ID NO: 2042397 - RNA, 21 nt, Homo sapiens
acuuuucaagcugcugaagga

SEQ ID NO: 2042398 - RNA, 21 nt, Homo sapiens
ucgauccaaauugugcuucuc

SEQ ID NO: 2042399 - RNA, 19 nt, Homo sapiens
aaagaugugcaaaaucacu

SEQ ID NO: 2042400 - RNA, 17 nt, Homo sapiens
aagagcucugagucuua

SEQ ID NO: 2042401 - RNA, 16 nt, Homo sapiens
cuuguccugaugcugu

SEQ ID NO: 2042402 - RNA, 12 nt, Homo sapiens
uaucgcucuaaa

SEQ ID NO: 2042403 - RNA, 19 nt, Homo sapiens
auugauuauaagcauguau

SEQ ID NO: 2042404 - RNA, 19 nt, Homo sapiens
gcccacuguccugggccug

SEQ ID NO: 2042405 - RNA, 16 nt, Homo sapiens
gaaaaucacaucucca

SEQ ID NO: 2042406 - RNA, 18 nt, Homo sapiens
ggaggacacacagucuca

SEQ ID NO: 2042407 - RNA, 23 nt, Homo sapiens
gauccucucuggggcuguguuuu

SEQ ID NO: 2042408 - RNA, 18 nt, Homo sapiens
ccaacaacuccaggaaaa

SEQ ID NO: 2042409 - RNA, 18 nt, Homo sapiens
ugggugccagcauacauu

SEQ ID NO: 2042410 - RNA, 17 nt, Homo sapiens
gauauugauuacuauca

SEQ ID NO: 2042411 - RNA, 23 nt, Homo sapiens
uuugaaaaugggcucaaccagaa

SEQ ID NO: 2042412 - RNA, 13 nt, Homo sapiens
gaccuucuaggaa

SEQ ID NO: 2042413 - RNA, 13 nt, Homo sapiens
gcuagugccaaau

SEQ ID NO: 2042414 - RNA, 14 nt, Homo sapiens
auaucuaacuuucc

SEQ ID NO: 2042415 - RNA, 21 nt, Homo sapiens
auucuuuugcacaccuguuau

SEQ ID NO: 2042416 - RNA, 18 nt, Homo sapiens
uuaaacauauucaaggag

SEQ ID NO: 2042417 - RNA, 18 nt, Homo sapiens
aaccccccaccuccacuc

SEQ ID NO: 2042418 - RNA, 14 nt, Homo sapiens
uccccggacacucg

SEQ ID NO: 2042419 - RNA, 15 nt, Homo sapiens
cuuuaaagaaaccau

SEQ ID NO: 2042420 - RNA, 16 nt, Homo sapiens
aagcagucucacugca

SEQ ID NO: 2042421 - RNA, 12 nt, Homo sapiens
uacaaaugacag

SEQ ID NO: 2042422 - RNA, 12 nt, Homo sapiens
caacugccaauc

SEQ ID NO: 2042423 - RNA, 19 nt, Homo sapiens
aagugaucugcccaccuca

SEQ ID NO: 2042424 - RNA, 16 nt, Homo sapiens
gccagcucagucccau

SEQ ID NO: 2042425 - RNA, 16 nt, Homo sapiens
cuccuuagagacauca

SEQ ID NO: 2042426 - RNA, 22 nt, Homo sapiens
aauaaacugucuuuuuccucaa

SEQ ID NO: 2042427 - RNA, 17 nt, Homo sapiens
auauucuuugguuguga

SEQ ID NO: 2042428 - RNA, 23 nt, Homo sapiens
acauucuuauaaauaugaagcuc

SEQ ID NO: 2042429 - RNA, 15 nt, Homo sapiens
accacaccaaaccuc

SEQ ID NO: 2042430 - RNA, 22 nt, Homo sapiens
ccuucuacuuacacaucuucca

SEQ ID NO: 2042431 - RNA, 22 nt, Homo sapiens
ucaaggaccaacaagggcagug

SEQ ID NO: 2042432 - RNA, 15 nt, Homo sapiens
agcagugauucagua

SEQ ID NO: 2042433 - RNA, 20 nt, Homo sapiens
aaagcuagcacuaacucgug

SEQ ID NO: 2042434 - RNA, 15 nt, Homo sapiens
auacuuuugcuuuca

SEQ ID NO: 2042435 - RNA, 17 nt, Homo sapiens
cacaaaggcugaugucu

SEQ ID NO: 2042436 - RNA, 20 nt, Homo sapiens
cuggcucccagggccaugaa

SEQ ID NO: 2042437 - RNA, 18 nt, Homo sapiens
ccuucucgaccacgggaa

SEQ ID NO: 2042438 - RNA, 17 nt, Homo sapiens
uccaaggaacuucaugc

SEQ ID NO: 2042439 - RNA, 14 nt, Homo sapiens
cucuuaugagcucc

SEQ ID NO: 2042440 - RNA, 22 nt, Homo sapiens
cauguuaagauaacuuacugua

SEQ ID NO: 2042441 - RNA, 14 nt, Homo sapiens
agcagaacuuucac

SEQ ID NO: 2042442 - RNA, 21 nt, Homo sapiens
agaccuugauugcaccaacag

SEQ ID NO: 2042443 - RNA, 18 nt, Homo sapiens
cuccagaauccacaaagc

SEQ ID NO: 2042444 - RNA, 19 nt, Homo sapiens
ucucacacauuucugccac

SEQ ID NO: 2042445 - RNA, 16 nt, Homo sapiens
ugaaguacuugccaga

SEQ ID NO: 2042446 - RNA, 12 nt, Homo sapiens
cccgcucugcag

SEQ ID NO: 2042447 - RNA, 18 nt, Homo sapiens
aagcaagggacugaguga

SEQ ID NO: 2042448 - RNA, 13 nt, Homo sapiens
cuuuuaagacaaa

SEQ ID NO: 2042449 - RNA, 23 nt, Homo sapiens
cccaguauucuagguagugcccu

SEQ ID NO: 2042450 - RNA, 16 nt, Homo sapiens
aguuauguucagucac

SEQ ID NO: 2042451 - RNA, 15 nt, Homo sapiens
cuuuaacucauaaaa

SEQ ID NO: 2042452 - RNA, 15 nt, Homo sapiens
aauaaauauccuuua

SEQ ID NO: 2042453 - RNA, 21 nt, Homo sapiens
ccuagauaugaagaaucugcu

SEQ ID NO: 2042454 - RNA, 22 nt, Homo sapiens
augucaacuucuggcuccucaa

SEQ ID NO: 2042455 - RNA, 11 nt, Homo sapiens
uuaauuuccag

SEQ ID NO: 2042456 - RNA, 12 nt, Homo sapiens
cuguuugcacac

SEQ ID NO: 2042457 - RNA, 20 nt, Homo sapiens
cagagucucgcucuguugcc

SEQ ID NO: 2042458 - RNA, 19 nt, Homo sapiens
ccagcccuggcccaggugc

SEQ ID NO: 2042459 - RNA, 20 nt, Homo sapiens
aauacugguuauccugugcu

SEQ ID NO: 2042460 - RNA, 13 nt, Homo sapiens
gauauguggugua

SEQ ID NO: 2042461 - RNA, 15 nt, Homo sapiens
cugugauuagccauu

SEQ ID NO: 2042462 - RNA, 23 nt, Homo sapiens
gaaggcugugcagggacgucuca

SEQ ID NO: 2042463 - RNA, 15 nt, Homo sapiens
aauacaaacacaaaa

SEQ ID NO: 2042464 - RNA, 21 nt, Homo sapiens
cauauucuuaaugacauuuca

SEQ ID NO: 2042465 - RNA, 19 nt, Homo sapiens
uccuaauaaacugcuauua

SEQ ID NO: 2042466 - RNA, 23 nt, Homo sapiens
guacaugauaaaugauagacaau

SEQ ID NO: 2042467 - RNA, 18 nt, Homo sapiens
auuuuaucuugaaacuga

SEQ ID NO: 2042468 - RNA, 16 nt, Homo sapiens
cugcagcuuccuguca

SEQ ID NO: 2042469 - RNA, 16 nt, Homo sapiens
acaaguauucaguucc

SEQ ID NO: 2042470 - RNA, 18 nt, Homo sapiens
uuagaauuccuucagggu

SEQ ID NO: 2042471 - RNA, 15 nt, Homo sapiens
gguauuuuuauagcc

SEQ ID NO: 2042472 - RNA, 22 nt, Homo sapiens
ggcucuugaucagugugcuaac

SEQ ID NO: 2042473 - RNA, 22 nt, Homo sapiens
acacuaagcgaauguguacaaa

SEQ ID NO: 2042474 - RNA, 16 nt, Homo sapiens
aaguuuucuaaacuca

SEQ ID NO: 2042475 - RNA, 20 nt, Homo sapiens
accaggaccaguucacuugc

SEQ ID NO: 2042476 - RNA, 14 nt, Homo sapiens
auaugaagacauaa

SEQ ID NO: 2042477 - RNA, 24 nt, Homo sapiens
ugaccaaguuauaaaucaauguca

SEQ ID NO: 2042478 - RNA, 18 nt, Homo sapiens
ccguuuuccccaugacaa

SEQ ID NO: 2042479 - RNA, 16 nt, Homo sapiens
ucagaugaacucaugu

SEQ ID NO: 2042480 - RNA, 23 nt, Homo sapiens
cucagauggauugauaauugcau

SEQ ID NO: 2042481 - RNA, 22 nt, Homo sapiens
uccucagagaauuucuaccauu

SEQ ID NO: 2042482 - RNA, 21 nt, Homo sapiens
ucggcuuuuugccaucuguga

SEQ ID NO: 2042483 - RNA, 12 nt, Homo sapiens
ugauaaguaaau

SEQ ID NO: 2042484 - RNA, 19 nt, Homo sapiens
ucacuggcuuuagcugcug

SEQ ID NO: 2042485 - RNA, 13 nt, Homo sapiens
uguaucuaugcau

SEQ ID NO: 2042486 - RNA, 19 nt, Homo sapiens
gaggcagagguugcaguga

SEQ ID NO: 2042487 - RNA, 16 nt, Homo sapiens
aaaccugaccccugcu

SEQ ID NO: 2042488 - RNA, 16 nt, Homo sapiens
acagccugucuuguca

SEQ ID NO: 2042489 - RNA, 20 nt, Homo sapiens
ggcuucgcagcucuggccuc

SEQ ID NO: 2042490 - RNA, 18 nt, Homo sapiens
caaaucugugcucuuuca

SEQ ID NO: 2042491 - RNA, 20 nt, Homo sapiens
ucuucuuuuauguaaaucau

SEQ ID NO: 2042492 - RNA, 15 nt, Homo sapiens
uaugacccacacugc

SEQ ID NO: 2042493 - RNA, 23 nt, Homo sapiens
ugcucucuuuuucuccaggguca

SEQ ID NO: 2042494 - RNA, 20 nt, Homo sapiens
agacaguguuuugccauguu

SEQ ID NO: 2042495 - RNA, 20 nt, Homo sapiens
agacggagucucucacuguc

SEQ ID NO: 2042496 - RNA, 16 nt, Homo sapiens
cugcccuugucccacu

SEQ ID NO: 2042497 - RNA, 22 nt, Homo sapiens
uaaccuagaagggucacuuuaa

SEQ ID NO: 2042498 - RNA, 21 nt, Homo sapiens
uaacugcacacaugguuucca

SEQ ID NO: 2042499 - RNA, 16 nt, Homo sapiens
cguuggguuugcucau

SEQ ID NO: 2042500 - RNA, 20 nt, Homo sapiens
ggaggagcccuccauuccaa

SEQ ID NO: 2042501 - RNA, 17 nt, Homo sapiens
caaaucauuuugaugua

SEQ ID NO: 2042502 - RNA, 21 nt, Homo sapiens
ccucagucuggugcuccaguu

SEQ ID NO: 2042503 - RNA, 21 nt, Homo sapiens
cacacaccccucaaaaaaagc

SEQ ID NO: 2042504 - RNA, 17 nt, Homo sapiens
ucaccccuauggugcuc

SEQ ID NO: 2042505 - RNA, 16 nt, Homo sapiens
agcaacuucaaguaua

SEQ ID NO: 2042506 - RNA, 24 nt, Homo sapiens
aauugggauaaacaucacaugaga

SEQ ID NO: 2042507 - RNA, 21 nt, Homo sapiens
aggaccaguuucuugaagucc

SEQ ID NO: 2042508 - RNA, 16 nt, Homo sapiens
uccugugccaaccuga

SEQ ID NO: 2042509 - RNA, 17 nt, Homo sapiens
agugugcuuaauccuga

SEQ ID NO: 2042510 - RNA, 15 nt, Homo sapiens
ucuaaaauuaaggaa

SEQ ID NO: 2042511 - RNA, 16 nt, Homo sapiens
caugaugucaacucac

SEQ ID NO: 2042512 - RNA, 16 nt, Homo sapiens
ugauuguuccauaaua

SEQ ID NO: 2042513 - RNA, 16 nt, Homo sapiens
ccuaaaauuguaugaa

SEQ ID NO: 2042514 - RNA, 22 nt, Homo sapiens
cuugcuucauuguuacauguaa

SEQ ID NO: 2042515 - RNA, 15 nt, Homo sapiens
ucauuuuuaggcaug

SEQ ID NO: 2042516 - RNA, 15 nt, Homo sapiens
caauagcgugagcua

SEQ ID NO: 2042517 - RNA, 19 nt, Homo sapiens
ggcuccuuaucagugccau

SEQ ID NO: 2042518 - RNA, 15 nt, Homo sapiens
uguacaaaguauuaa

SEQ ID NO: 2042519 - RNA, 21 nt, Homo sapiens
caucuccccucagauuccacc

SEQ ID NO: 2042520 - RNA, 18 nt, Homo sapiens
aguuggcuaggggagcag

SEQ ID NO: 2042521 - RNA, 17 nt, Homo sapiens
augucagaggccccaug

SEQ ID NO: 2042522 - RNA, 13 nt, Homo sapiens
caaaaccagugaa

SEQ ID NO: 2042523 - RNA, 15 nt, Homo sapiens
cuggaucacagacac

SEQ ID NO: 2042524 - RNA, 22 nt, Homo sapiens
ucacuagagacaaaucuuuaag

SEQ ID NO: 2042525 - RNA, 17 nt, Homo sapiens
ucccuucaucuuccuca

SEQ ID NO: 2042526 - RNA, 21 nt, Homo sapiens
ccugaagggaaggcaaaggca

SEQ ID NO: 2042527 - RNA, 22 nt, Homo sapiens
cacuuccuuaacagcuguauua

SEQ ID NO: 2042528 - RNA, 17 nt, Homo sapiens
cacuguucaauacugua

SEQ ID NO: 2042529 - RNA, 17 nt, Homo sapiens
cacucuguaauaguuca

SEQ ID NO: 2042530 - RNA, 23 nt, Homo sapiens
caguggcugaauagcuucuccaa

SEQ ID NO: 2042531 - RNA, 12 nt, Homo sapiens
gaguaccuggac

SEQ ID NO: 2042532 - RNA, 21 nt, Homo sapiens
cuuccaacucaaacucuuaaa

SEQ ID NO: 2042533 - RNA, 14 nt, Homo sapiens
uggcacaaagucuu

SEQ ID NO: 2042534 - RNA, 12 nt, Homo sapiens
ugccagugcaga

SEQ ID NO: 2042535 - RNA, 11 nt, Homo sapiens
cauugcugaga

SEQ ID NO: 2042536 - RNA, 23 nt, Homo sapiens
agagagaaacucuauggguauca

SEQ ID NO: 2042537 - RNA, 20 nt, Homo sapiens
auccaguguauaaauccaau

SEQ ID NO: 2042538 - RNA, 15 nt, Homo sapiens
guucccccuguuuca

SEQ ID NO: 2042539 - RNA, 17 nt, Homo sapiens
ugaaucuguuacugaaa

SEQ ID NO: 2042540 - RNA, 19 nt, Homo sapiens
accaaaugcuuuuugaucu

SEQ ID NO: 2042541 - RNA, 16 nt, Homo sapiens
uuagaaagacuuucua

SEQ ID NO: 2042542 - RNA, 17 nt, Homo sapiens
uuauguuugcacuuugu

SEQ ID NO: 2042543 - RNA, 13 nt, Homo sapiens
aggagcguguacu

SEQ ID NO: 2042544 - RNA, 17 nt, Homo sapiens
guaauugacaaaugagg

SEQ ID NO: 2042545 - RNA, 22 nt, Homo sapiens
ugaagaguuguuuauaauguca

SEQ ID NO: 2042546 - RNA, 18 nt, Homo sapiens
cuaccaucuaaucuaugc

SEQ ID NO: 2042547 - RNA, 16 nt, Homo sapiens
accuucaugguguuca

SEQ ID NO: 2042548 - RNA, 14 nt, Homo sapiens
uuaguacccugcag

SEQ ID NO: 2042549 - RNA, 14 nt, Homo sapiens
acagcuauuucuca

SEQ ID NO: 2042550 - RNA, 21 nt, Homo sapiens
caaggcaaagacuauucccuu

SEQ ID NO: 2042551 - RNA, 23 nt, Homo sapiens
cucuauguuuacaaauggacaua

SEQ ID NO: 2042552 - RNA, 15 nt, Homo sapiens
cguuggcucaguccu

SEQ ID NO: 2042553 - RNA, 13 nt, Homo sapiens
aaagaauuugcac

SEQ ID NO: 2042554 - RNA, 18 nt, Homo sapiens
ugaaaucccaucagguca

SEQ ID NO: 2042555 - RNA, 14 nt, Homo sapiens
auacaugaugauuu

SEQ ID NO: 2042556 - RNA, 13 nt, Homo sapiens
uguuccagguuuc

SEQ ID NO: 2042557 - RNA, 22 nt, Homo sapiens
acuggagaggcuagaaccaaga

SEQ ID NO: 2042558 - RNA, 17 nt, Homo sapiens
gccagcagcaccugccc

SEQ ID NO: 2042559 - RNA, 21 nt, Homo sapiens
uugucauuagugagacauauu

SEQ ID NO: 2042560 - RNA, 19 nt, Homo sapiens
cucuugacuggcucaagaa

SEQ ID NO: 2042561 - RNA, 16 nt, Homo sapiens
cuaccucaaacuucca

SEQ ID NO: 2042562 - RNA, 14 nt, Homo sapiens
caaucuaaaauggc

SEQ ID NO: 2042563 - RNA, 22 nt, Homo sapiens
auugcagcuagaggcaucuucu

SEQ ID NO: 2042564 - RNA, 13 nt, Homo sapiens
ucagcugcuucuc

SEQ ID NO: 2042565 - RNA, 21 nt, Homo sapiens
cagcugcucaauaaaguacaa

SEQ ID NO: 2042566 - RNA, 19 nt, Homo sapiens
gauuacuuugcugccuuaa

SEQ ID NO: 2042567 - RNA, 11 nt, Homo sapiens
agcaguguccu

SEQ ID NO: 2042568 - RNA, 15 nt, Homo sapiens
cucaccccccuguau

SEQ ID NO: 2042569 - RNA, 20 nt, Homo sapiens
aagacaaaauuguaagccag

SEQ ID NO: 2042570 - RNA, 20 nt, Homo sapiens
uugccaggcuggagugcagu

SEQ ID NO: 2042571 - RNA, 19 nt, Homo sapiens
auagggguucaugcuuaau

SEQ ID NO: 2042572 - RNA, 14 nt, Homo sapiens
ugauagaaaugcca

SEQ ID NO: 2042573 - RNA, 16 nt, Homo sapiens
acaaggcugaccaaga

SEQ ID NO: 2042574 - RNA, 13 nt, Homo sapiens
cuuuagcaugcua

SEQ ID NO: 2042575 - RNA, 18 nt, Homo sapiens
cccagacccccugaucag

SEQ ID NO: 2042576 - RNA, 10 nt, Homo sapiens
uuucacuccu

SEQ ID NO: 2042577 - RNA, 22 nt, Homo sapiens
gcugucacuugucgggggccca

SEQ ID NO: 2042578 - RNA, 19 nt, Homo sapiens
ugagcuuuggacacacaca

SEQ ID NO: 2042579 - RNA, 15 nt, Homo sapiens
uggauguggccccac

SEQ ID NO: 2042580 - RNA, 22 nt, Homo sapiens
acuucucugagucagcugaccc

SEQ ID NO: 2042581 - RNA, 19 nt, Homo sapiens
accuauggcaauuuagcuc

SEQ ID NO: 2042582 - RNA, 18 nt, Homo sapiens
cauuaucgagcagcauuu

SEQ ID NO: 2042583 - RNA, 14 nt, Homo sapiens
ccucuuacuuugcu

SEQ ID NO: 2042584 - RNA, 17 nt, Homo sapiens
uguagcuguaagggcag

SEQ ID NO: 2042585 - RNA, 20 nt, Homo sapiens
cucccacccacagccauaga

SEQ ID NO: 2042586 - RNA, 14 nt, Homo sapiens
uccucuccaccaga

SEQ ID NO: 2042587 - RNA, 21 nt, Homo sapiens
aaaggccagguugcuaagaaa

SEQ ID NO: 2042588 - RNA, 23 nt, Homo sapiens
aaaauauccacuggacacuguga

SEQ ID NO: 2042589 - RNA, 19 nt, Homo sapiens
ugaagcuuggaggucacag

SEQ ID NO: 2042590 - RNA, 12 nt, Homo sapiens
aauauaagccuu

SEQ ID NO: 2042591 - RNA, 15 nt, Homo sapiens
aaaauggaauuacuc

SEQ ID NO: 2042592 - RNA, 19 nt, Homo sapiens
aacuagcucuauguuuaca

SEQ ID NO: 2042593 - RNA, 12 nt, Homo sapiens
gggccaucuccu

SEQ ID NO: 2042594 - RNA, 18 nt, Homo sapiens
gccagcacacagggcagu

SEQ ID NO: 2042595 - RNA, 13 nt, Homo sapiens
uagcucugagaac

SEQ ID NO: 2042596 - RNA, 18 nt, Homo sapiens
auguagcucaguaauucc

SEQ ID NO: 2042597 - RNA, 22 nt, Homo sapiens
ucuguacuugguccaacugcaa

SEQ ID NO: 2042598 - RNA, 17 nt, Homo sapiens
uagccaggaaguacuuc

SEQ ID NO: 2042599 - RNA, 14 nt, Homo sapiens
acuuuuuuuccuug

SEQ ID NO: 2042600 - RNA, 23 nt, Homo sapiens
augcuuuugugucuaccuuguua

SEQ ID NO: 2042601 - RNA, 15 nt, Homo sapiens
gccagccggacacaa

SEQ ID NO: 2042602 - RNA, 20 nt, Homo sapiens
uugcgcuggaccugguucuu

SEQ ID NO: 2042603 - RNA, 14 nt, Homo sapiens
aaaauaugaaagac

SEQ ID NO: 2042604 - RNA, 14 nt, Homo sapiens
guagggaguaccug

SEQ ID NO: 2042605 - RNA, 17 nt, Homo sapiens
ugauuuaaacacauuaa

SEQ ID NO: 2042606 - RNA, 16 nt, Homo sapiens
auaaauuaacauuaua

SEQ ID NO: 2042607 - RNA, 17 nt, Homo sapiens
cuuuaauugacaguuuc

SEQ ID NO: 2042608 - RNA, 17 nt, Homo sapiens
agcuggagcucuuggaa

SEQ ID NO: 2042609 - RNA, 17 nt, Homo sapiens
acucccuccuucuuuua

SEQ ID NO: 2042610 - RNA, 20 nt, Homo sapiens
uccgccucccauguucaagc

SEQ ID NO: 2042611 - RNA, 19 nt, Homo sapiens
cccaguggccggucagcca

SEQ ID NO: 2042612 - RNA, 19 nt, Homo sapiens
acuuuauucagagcuaaua

SEQ ID NO: 2042613 - RNA, 16 nt, Homo sapiens
ccugauguugagcuga

SEQ ID NO: 2042614 - RNA, 20 nt, Homo sapiens
aaaauaaacauuuuguccac

SEQ ID NO: 2042615 - RNA, 14 nt, Homo sapiens
cuuagauugccacu

SEQ ID NO: 2042616 - RNA, 19 nt, Homo sapiens
ugaucucuuagaagccaug

SEQ ID NO: 2042617 - RNA, 20 nt, Homo sapiens
uaauggucacagagcacugu

SEQ ID NO: 2042618 - RNA, 19 nt, Homo sapiens
gaauuugggccucuuguac

SEQ ID NO: 2042619 - RNA, 19 nt, Homo sapiens
uacacuccagccugggcaa

SEQ ID NO: 2042620 - RNA, 18 nt, Homo sapiens
cuucuguggucaccccau

SEQ ID NO: 2042621 - RNA, 19 nt, Homo sapiens
ucugugacuccuggucuga

SEQ ID NO: 2042622 - RNA, 21 nt, Homo sapiens
gaauucauuaugcugugguca

SEQ ID NO: 2042623 - RNA, 17 nt, Homo sapiens
cauucuagauuacuuuu

SEQ ID NO: 2042624 - RNA, 19 nt, Homo sapiens
uguuuauuugcacuaugag

SEQ ID NO: 2042625 - RNA, 20 nt, Homo sapiens
ccaucuggaccugguacaaa

SEQ ID NO: 2042626 - RNA, 14 nt, Homo sapiens
uccuaaauuuccag

SEQ ID NO: 2042627 - RNA, 18 nt, Homo sapiens
cuuuucaucuccagugug

SEQ ID NO: 2042628 - RNA, 23 nt, Homo sapiens
ucuaaggccaaggccucaggaga

SEQ ID NO: 2042629 - RNA, 20 nt, Homo sapiens
uugaaaugauaugaccaaaa

SEQ ID NO: 2042630 - RNA, 18 nt, Homo sapiens
cugacucagcuaauguca

SEQ ID NO: 2042631 - RNA, 20 nt, Homo sapiens
gaaaauccacuaugacaucu

SEQ ID NO: 2042632 - RNA, 15 nt, Homo sapiens
cuaucaguucuagca

SEQ ID NO: 2042633 - RNA, 18 nt, Homo sapiens
ccaaaaacuaaaauucaa

SEQ ID NO: 2042634 - RNA, 18 nt, Homo sapiens
cuaauguugcuggaucag

SEQ ID NO: 2042635 - RNA, 20 nt, Homo sapiens
accaaagggaaaacucuuca

SEQ ID NO: 2042636 - RNA, 13 nt, Homo sapiens
uccuguguggaag

SEQ ID NO: 2042637 - RNA, 13 nt, Homo sapiens
uuaaacauugccu

SEQ ID NO: 2042638 - RNA, 13 nt, Homo sapiens
ccccaaggcacuu

SEQ ID NO: 2042639 - RNA, 14 nt, Homo sapiens
uuauaauauccaua

SEQ ID NO: 2042640 - RNA, 19 nt, Homo sapiens
ggucaugacaagaugggac

SEQ ID NO: 2042641 - RNA, 15 nt, Homo sapiens
caauaaugaaugagc

SEQ ID NO: 2042642 - RNA, 11 nt, Homo sapiens
caaagugcugg

SEQ ID NO: 2042643 - RNA, 19 nt, Homo sapiens
acucauaauagacuuccca

SEQ ID NO: 2042644 - RNA, 21 nt, Homo sapiens
uucaauagcauaucacagaga

SEQ ID NO: 2042645 - RNA, 16 nt, Homo sapiens
caagaccacguuucua

SEQ ID NO: 2042646 - RNA, 20 nt, Homo sapiens
ccuggcuguccccagcaccu

SEQ ID NO: 2042647 - RNA, 22 nt, Homo sapiens
ccaugauggccuuacacugaaa

SEQ ID NO: 2042648 - RNA, 19 nt, Homo sapiens
cugacuaaagguuaccugu

SEQ ID NO: 2042649 - RNA, 13 nt, Homo sapiens
ccucagauuucca

SEQ ID NO: 2042650 - RNA, 17 nt, Homo sapiens
aggacugugccagcaca

SEQ ID NO: 2042651 - RNA, 16 nt, Homo sapiens
caaaggaagacuuggc

SEQ ID NO: 2042652 - RNA, 17 nt, Homo sapiens
cacuugcaaaugaaugc

SEQ ID NO: 2042653 - RNA, 21 nt, Homo sapiens
uugaacaaaaauguuuccacu

SEQ ID NO: 2042654 - RNA, 21 nt, Homo sapiens
ccuggucagcccaaaccacca

SEQ ID NO: 2042655 - RNA, 20 nt, Homo sapiens
uuguacaggcuggucucaaa

SEQ ID NO: 2042656 - RNA, 19 nt, Homo sapiens
caaacguuuugaacuaaua

SEQ ID NO: 2042657 - RNA, 19 nt, Homo sapiens
auggcaaguacaguacuuu

SEQ ID NO: 2042658 - RNA, 17 nt, Homo sapiens
aacuuauuuugcuuuaa

SEQ ID NO: 2042659 - RNA, 16 nt, Homo sapiens
ucucuuuguacugcuu

SEQ ID NO: 2042660 - RNA, 19 nt, Homo sapiens
uuaaaaauuagcaugcugc

SEQ ID NO: 2042661 - RNA, 22 nt, Homo sapiens
aagcucacacagcaggaacuga

SEQ ID NO: 2042662 - RNA, 16 nt, Homo sapiens
aaauaaaauacuaaac

SEQ ID NO: 2042663 - RNA, 15 nt, Homo sapiens
uuacuauauguugac

SEQ ID NO: 2042664 - RNA, 16 nt, Homo sapiens
aaugaaauccagugag

SEQ ID NO: 2042665 - RNA, 23 nt, Homo sapiens
uauucaugaagcggucacagauc

SEQ ID NO: 2042666 - RNA, 23 nt, Homo sapiens
cccauuggacacguggugcauuu

SEQ ID NO: 2042667 - RNA, 17 nt, Homo sapiens
uggcauucauauuucau

SEQ ID NO: 2042668 - RNA, 18 nt, Homo sapiens
gccuucugucagcaguga

SEQ ID NO: 2042669 - RNA, 22 nt, Homo sapiens
guuugacccaggggucagccuu

SEQ ID NO: 2042670 - RNA, 16 nt, Homo sapiens
aaaugaaccauucaca

SEQ ID NO: 2042671 - RNA, 22 nt, Homo sapiens
cauuaagguuaugcacugccug

SEQ ID NO: 2042672 - RNA, 16 nt, Homo sapiens
agccaggcacacacug

SEQ ID NO: 2042673 - RNA, 15 nt, Homo sapiens
aguaaacaccuggag

SEQ ID NO: 2042674 - RNA, 19 nt, Homo sapiens
gaagcuggcacaucuugga

SEQ ID NO: 2042675 - RNA, 14 nt, Homo sapiens
ugcagcaccuccag

SEQ ID NO: 2042676 - RNA, 20 nt, Homo sapiens
ugugcccauauggucaucca

SEQ ID NO: 2042677 - RNA, 16 nt, Homo sapiens
aguuugagaccagccu

SEQ ID NO: 2042678 - RNA, 23 nt, Homo sapiens
augcugacacuuuuucagggcug

SEQ ID NO: 2042679 - RNA, 20 nt, Homo sapiens
aggaaauggagaagcucugu

SEQ ID NO: 2042680 - RNA, 14 nt, Homo sapiens
gaacaaaucugcac

SEQ ID NO: 2042681 - RNA, 16 nt, Homo sapiens
uugugucaguuucaga

SEQ ID NO: 2042682 - RNA, 22 nt, Homo sapiens
agagugcaguggcgugaucucg

SEQ ID NO: 2042683 - RNA, 22 nt, Homo sapiens
ggaguacaauggcgugaucuca

SEQ ID NO: 2042684 - RNA, 12 nt, Homo sapiens
cauucauugcag

SEQ ID NO: 2042685 - RNA, 12 nt, Homo sapiens
gcuucauucaag

SEQ ID NO: 2042686 - RNA, 11 nt, Homo sapiens
ccaacauguga

SEQ ID NO: 2042687 - RNA, 15 nt, Homo sapiens
acucggaaacuauaa

SEQ ID NO: 2042688 - RNA, 17 nt, Homo sapiens
ugaggagcccuaagcau

SEQ ID NO: 2042689 - RNA, 14 nt, Homo sapiens
uaguuuuacauaua

SEQ ID NO: 2042690 - RNA, 14 nt, Homo sapiens
ucucccuugcccuc

SEQ ID NO: 2042691 - RNA, 13 nt, Homo sapiens
ccaggacccaucu

SEQ ID NO: 2042692 - RNA, 13 nt, Homo sapiens
acuuagcaaaaag

SEQ ID NO: 2042693 - RNA, 15 nt, Homo sapiens
caaggaggaguucca

SEQ ID NO: 2042694 - RNA, 14 nt, Homo sapiens
ugcagauaucacag

SEQ ID NO: 2042695 - RNA, 17 nt, Homo sapiens
gggaagcccacccagau

SEQ ID NO: 2042696 - RNA, 17 nt, Homo sapiens
auuuuuccacacuaugu

SEQ ID NO: 2042697 - RNA, 15 nt, Homo sapiens
uugguguaaaccauu

SEQ ID NO: 2042698 - RNA, 18 nt, Homo sapiens
ucucagcccugaccuucu

SEQ ID NO: 2042699 - RNA, 13 nt, Homo sapiens
cagccucaucucu

SEQ ID NO: 2042700 - RNA, 22 nt, Homo sapiens
cuggggagcgggucugcuccca

SEQ ID NO: 2042701 - RNA, 19 nt, Homo sapiens
gccgcagcccccacugacc

SEQ ID NO: 2042702 - RNA, 17 nt, Homo sapiens
caagauaggaguucucu

SEQ ID NO: 2042703 - RNA, 20 nt, Homo sapiens
uuuauguaacauaguccaga

SEQ ID NO: 2042704 - RNA, 18 nt, Homo sapiens
cuguugggaaccagagag

SEQ ID NO: 2042705 - RNA, 18 nt, Homo sapiens
cacaagaacucccuucuc

SEQ ID NO: 2042706 - RNA, 16 nt, Homo sapiens
ucgccaaggcucacau

SEQ ID NO: 2042707 - RNA, 22 nt, Homo sapiens
gcccuaauuguguuugauuuca

SEQ ID NO: 2042708 - RNA, 22 nt, Homo sapiens
gaaguaggaggaaacaguucuc

SEQ ID NO: 2042709 - RNA, 18 nt, Homo sapiens
aucgcugccuugccaugu

SEQ ID NO: 2042710 - RNA, 19 nt, Homo sapiens
aauaggugugaacagggaa

SEQ ID NO: 2042711 - RNA, 13 nt, Homo sapiens
uaauucucuaggg

SEQ ID NO: 2042712 - RNA, 16 nt, Homo sapiens
uaaaauaaaagacuau

SEQ ID NO: 2042713 - RNA, 17 nt, Homo sapiens
uuggacccgcucuggac

SEQ ID NO: 2042714 - RNA, 17 nt, Homo sapiens
ugccacgcccccagaaa

SEQ ID NO: 2042715 - RNA, 14 nt, Homo sapiens
ugcaagcaaucaaa

SEQ ID NO: 2042716 - RNA, 13 nt, Homo sapiens
uggccucaccugg

SEQ ID NO: 2042717 - RNA, 11 nt, Homo sapiens
ucucccacugc

SEQ ID NO: 2042718 - RNA, 19 nt, Homo sapiens
ggagcacuguucacaucau

SEQ ID NO: 2042719 - RNA, 20 nt, Homo sapiens
aagaccugacagcuugagaa

SEQ ID NO: 2042720 - RNA, 19 nt, Homo sapiens
uggaggccggaaucucagc

SEQ ID NO: 2042721 - RNA, 22 nt, Homo sapiens
uguauuaaaagauuccagucuu

SEQ ID NO: 2042722 - RNA, 18 nt, Homo sapiens
gauuagcuuuugcaacau

SEQ ID NO: 2042723 - RNA, 15 nt, Homo sapiens
uaaggagacugaggc

SEQ ID NO: 2042724 - RNA, 15 nt, Homo sapiens
gaaucuaaaugaagc

SEQ ID NO: 2042725 - RNA, 18 nt, Homo sapiens
acauccaggcaauggccu

SEQ ID NO: 2042726 - RNA, 18 nt, Homo sapiens
aacugaacgacaaagcau

SEQ ID NO: 2042727 - RNA, 13 nt, Homo sapiens
cagaacccagugu

SEQ ID NO: 2042728 - RNA, 19 nt, Homo sapiens
uggggaaauggugaaggaa

SEQ ID NO: 2042729 - RNA, 23 nt, Homo sapiens
agccuguggcaucuuugccuugg

SEQ ID NO: 2042730 - RNA, 15 nt, Homo sapiens
guaaguugaagggaa

SEQ ID NO: 2042731 - RNA, 19 nt, Homo sapiens
gcuggcaccgccuucucua

SEQ ID NO: 2042732 - RNA, 20 nt, Homo sapiens
agagaugggguuucacugug

SEQ ID NO: 2042733 - RNA, 13 nt, Homo sapiens
ccggaaagccuuc

SEQ ID NO: 2042734 - RNA, 13 nt, Homo sapiens
cuuuuguaucuua

SEQ ID NO: 2042735 - RNA, 14 nt, Homo sapiens
uaauguucugggaa

SEQ ID NO: 2042736 - RNA, 21 nt, Homo sapiens
agcugggauuacaggugugca

SEQ ID NO: 2042737 - RNA, 13 nt, Homo sapiens
gagcggcaggacu

SEQ ID NO: 2042738 - RNA, 17 nt, Homo sapiens
gcuucaagugccuuuug

SEQ ID NO: 2042739 - RNA, 12 nt, Homo sapiens
uccauguaucua

SEQ ID NO: 2042740 - RNA, 14 nt, Homo sapiens
gaaauuauuggaaa

SEQ ID NO: 2042741 - RNA, 21 nt, Homo sapiens
guaucuguuuacauccagagu

SEQ ID NO: 2042742 - RNA, 23 nt, Homo sapiens
uggcgacacucagggcagcugcc

SEQ ID NO: 2042743 - RNA, 23 nt, Homo sapiens
aacaaaaaucuguguaacuguaa

SEQ ID NO: 2042744 - RNA, 23 nt, Homo sapiens
uccaaguaaaauauuaacauauu

SEQ ID NO: 2042745 - RNA, 21 nt, Homo sapiens
ugaucaaguccuuugugaaua

SEQ ID NO: 2042746 - RNA, 16 nt, Homo sapiens
ggugccucugugcaca

SEQ ID NO: 2042747 - RNA, 21 nt, Homo sapiens
uggugauggagagggauggaa

SEQ ID NO: 2042748 - RNA, 19 nt, Homo sapiens
uguugcuuaauugugaaca

SEQ ID NO: 2042749 - RNA, 17 nt, Homo sapiens
aacuaaguucucuaucu

SEQ ID NO: 2042750 - RNA, 13 nt, Homo sapiens
gcucagggugcuc

SEQ ID NO: 2042751 - RNA, 16 nt, Homo sapiens
agugcacagcugucca

SEQ ID NO: 2042752 - RNA, 22 nt, Homo sapiens
aguuguauaguuuuacacucua

SEQ ID NO: 2042753 - RNA, 17 nt, Homo sapiens
uacagaaauuaccccgg

SEQ ID NO: 2042754 - RNA, 23 nt, Homo sapiens
gcuucccggcgucccuaccuccu

SEQ ID NO: 2042755 - RNA, 22 nt, Homo sapiens
auccugagcaaacaaaaccacc

SEQ ID NO: 2042756 - RNA, 17 nt, Homo sapiens
ccauucauccuuuaaga

SEQ ID NO: 2042757 - RNA, 17 nt, Homo sapiens
auuacaggaaaugcaaa

SEQ ID NO: 2042758 - RNA, 14 nt, Homo sapiens
uauauguacaugag

SEQ ID NO: 2042759 - RNA, 12 nt, Homo sapiens
accauuaaugaa

SEQ ID NO: 2042760 - RNA, 14 nt, Homo sapiens
ucuucauggccaua

SEQ ID NO: 2042761 - RNA, 11 nt, Homo sapiens
ugccugccauu

SEQ ID NO: 2042762 - RNA, 16 nt, Homo sapiens
gccaggcuggucuuga

SEQ ID NO: 2042763 - RNA, 15 nt, Homo sapiens
aauuuggaaacuaau

SEQ ID NO: 2042764 - RNA, 21 nt, Homo sapiens
caucauucauuuuuguuguug

SEQ ID NO: 2042765 - RNA, 21 nt, Homo sapiens
aaugagacauaggccaugaaa

SEQ ID NO: 2042766 - RNA, 18 nt, Homo sapiens
aacagucaaccaacccca

SEQ ID NO: 2042767 - RNA, 18 nt, Homo sapiens
aagucaccugcccaagaa

SEQ ID NO: 2042768 - RNA, 18 nt, Homo sapiens
aaagccugguuuuucuca

SEQ ID NO: 2042769 - RNA, 21 nt, Homo sapiens
uguuuccauuugugguccuga

SEQ ID NO: 2042770 - RNA, 14 nt, Homo sapiens
gaacacaaggucau

SEQ ID NO: 2042771 - RNA, 17 nt, Homo sapiens
aggacacccaguggggu

SEQ ID NO: 2042772 - RNA, 16 nt, Homo sapiens
agcacuagaaugagaa

SEQ ID NO: 2042773 - RNA, 13 nt, Homo sapiens
gauggauuaacau

SEQ ID NO: 2042774 - RNA, 20 nt, Homo sapiens
uacuuagauauuucaugugc

SEQ ID NO: 2042775 - RNA, 20 nt, Homo sapiens
caggaaugaucccacucacc

SEQ ID NO: 2042776 - RNA, 14 nt, Homo sapiens
agguccuuuggaca

SEQ ID NO: 2042777 - RNA, 23 nt, Homo sapiens
gaaaaauauuuugcacagauuua

SEQ ID NO: 2042778 - RNA, 14 nt, Homo sapiens
uacuugaaccauaa

SEQ ID NO: 2042779 - RNA, 16 nt, Homo sapiens
acacuguccaugaagc

SEQ ID NO: 2042780 - RNA, 16 nt, Homo sapiens
cuggcccagaugauau

SEQ ID NO: 2042781 - RNA, 15 nt, Homo sapiens
acuaaauuucucagu

SEQ ID NO: 2042782 - RNA, 13 nt, Homo sapiens
uauauuuaccaag

SEQ ID NO: 2042783 - RNA, 21 nt, Homo sapiens
ucauugacuuccugaacaacc

SEQ ID NO: 2042784 - RNA, 21 nt, Homo sapiens
uucaaggcucuucuuccucac

SEQ ID NO: 2042785 - RNA, 18 nt, Homo sapiens
cccaguuaauccucacac

SEQ ID NO: 2042786 - RNA, 13 nt, Homo sapiens
gacugcuaccucu

SEQ ID NO: 2042787 - RNA, 17 nt, Homo sapiens
uuacuuuuuugguacua

SEQ ID NO: 2042788 - RNA, 14 nt, Homo sapiens
guugaaucagccau

SEQ ID NO: 2042789 - RNA, 19 nt, Homo sapiens
cauuagucaauaacuaaac

SEQ ID NO: 2042790 - RNA, 23 nt, Homo sapiens
accccaggcagcucgagcaugcc

SEQ ID NO: 2042791 - RNA, 21 nt, Homo sapiens
uuuaccccucacaauccuugc

SEQ ID NO: 2042792 - RNA, 22 nt, Homo sapiens
ugagagucuagauucucuggcu

SEQ ID NO: 2042793 - RNA, 14 nt, Homo sapiens
auaaagaacauucu

SEQ ID NO: 2042794 - RNA, 17 nt, Homo sapiens
aaucacaguuguguucc

SEQ ID NO: 2042795 - RNA, 17 nt, Homo sapiens
ggucaagaacacaguga

SEQ ID NO: 2042796 - RNA, 12 nt, Homo sapiens
ucuaugugcaac

SEQ ID NO: 2042797 - RNA, 17 nt, Homo sapiens
cucuccucgguucaagg

SEQ ID NO: 2042798 - RNA, 15 nt, Homo sapiens
aaugugacucaagac

SEQ ID NO: 2042799 - RNA, 14 nt, Homo sapiens
gccuugugugucag

SEQ ID NO: 2042800 - RNA, 17 nt, Homo sapiens
ccugcagggaucauagc

SEQ ID NO: 2042801 - RNA, 15 nt, Homo sapiens
cucauaaacugccaa

SEQ ID NO: 2042802 - RNA, 15 nt, Homo sapiens
uaaaggaacugcauc

SEQ ID NO: 2042803 - RNA, 13 nt, Homo sapiens
aaacuacuuugcu

SEQ ID NO: 2042804 - RNA, 13 nt, Homo sapiens
aaaauacuuugau

SEQ ID NO: 2042805 - RNA, 20 nt, Homo sapiens
cucuaacucagaaacaucag

SEQ ID NO: 2042806 - RNA, 14 nt, Homo sapiens
aacagccacaaaau

SEQ ID NO: 2042807 - RNA, 19 nt, Homo sapiens
aaugcaugaguaugugcac

SEQ ID NO: 2042808 - RNA, 22 nt, Homo sapiens
aggucagugcuucgugccucga

SEQ ID NO: 2042809 - RNA, 23 nt, Homo sapiens
auacacuguaucuaaaaaauaac

SEQ ID NO: 2042810 - RNA, 15 nt, Homo sapiens
ccugucacucagcug

SEQ ID NO: 2042811 - RNA, 16 nt, Homo sapiens
gcucagcccugagcug

SEQ ID NO: 2042812 - RNA, 22 nt, Homo sapiens
cucagcaauugucuacauucag

SEQ ID NO: 2042813 - RNA, 20 nt, Homo sapiens
ugggugauuugauaacaagu

SEQ ID NO: 2042814 - RNA, 16 nt, Homo sapiens
acuucagccaggugaa

SEQ ID NO: 2042815 - RNA, 21 nt, Homo sapiens
ggguacauggugcugggagag

SEQ ID NO: 2042816 - RNA, 18 nt, Homo sapiens
cuccuuugaagaaggcaa

SEQ ID NO: 2042817 - RNA, 12 nt, Homo sapiens
gcaccacuuauu

SEQ ID NO: 2042818 - RNA, 14 nt, Homo sapiens
caauuaaaggcaaa

SEQ ID NO: 2042819 - RNA, 15 nt, Homo sapiens
acaagaagcccagug

SEQ ID NO: 2042820 - RNA, 23 nt, Homo sapiens
aagagcauccggccaaaugcaaa

SEQ ID NO: 2042821 - RNA, 16 nt, Homo sapiens
auccauuuaugucuca

SEQ ID NO: 2042822 - RNA, 17 nt, Homo sapiens
uggcagggcacagggcc

SEQ ID NO: 2042823 - RNA, 12 nt, Homo sapiens
aauacuaaugaa

SEQ ID NO: 2042824 - RNA, 20 nt, Homo sapiens
accccaaggucagcucccau

SEQ ID NO: 2042825 - RNA, 14 nt, Homo sapiens
guaaauguguugcc

SEQ ID NO: 2042826 - RNA, 19 nt, Homo sapiens
acagucuucuaauuccuca

SEQ ID NO: 2042827 - RNA, 21 nt, Homo sapiens
aacaucuccccucucaccuca

SEQ ID NO: 2042828 - RNA, 16 nt, Homo sapiens
ugagaucuuacaggua

SEQ ID NO: 2042829 - RNA, 12 nt, Homo sapiens
caccuagccucg

SEQ ID NO: 2042830 - RNA, 15 nt, Homo sapiens
caacuagcugggacu

SEQ ID NO: 2042831 - RNA, 17 nt, Homo sapiens
aaugaguugaggccacu

SEQ ID NO: 2042832 - RNA, 20 nt, Homo sapiens
uagcaagauauugaucaaau

SEQ ID NO: 2042833 - RNA, 21 nt, Homo sapiens
uuacaauauagaugacauuuu

SEQ ID NO: 2042834 - RNA, 18 nt, Homo sapiens
ucuccaaaggaucuuugu

SEQ ID NO: 2042835 - RNA, 18 nt, Homo sapiens
cuuccagaugauccuugc

SEQ ID NO: 2042836 - RNA, 18 nt, Homo sapiens
uaauagaggcagugagac

SEQ ID NO: 2042837 - RNA, 12 nt, Homo sapiens
gaaacagccacu

SEQ ID NO: 2042838 - RNA, 13 nt, Homo sapiens
cccugugccagac

SEQ ID NO: 2042839 - RNA, 20 nt, Homo sapiens
ucccuuugaguccagugugg

SEQ ID NO: 2042840 - RNA, 20 nt, Homo sapiens
augcagaaguauucuuuuca

SEQ ID NO: 2042841 - RNA, 14 nt, Homo sapiens
cucugcuccagcaa

SEQ ID NO: 2042842 - RNA, 20 nt, Homo sapiens
cauuccaaaguucuuaucuc

SEQ ID NO: 2042843 - RNA, 21 nt, Homo sapiens
uauaauuuaaaauaugcucua

SEQ ID NO: 2042844 - RNA, 15 nt, Homo sapiens
ucagaagacacugca

SEQ ID NO: 2042845 - RNA, 18 nt, Homo sapiens
uauauuuauauauaucca

SEQ ID NO: 2042846 - RNA, 16 nt, Homo sapiens
ugcaggccuggcugca

SEQ ID NO: 2042847 - RNA, 12 nt, Homo sapiens
agcaagccaugc

SEQ ID NO: 2042848 - RNA, 21 nt, Homo sapiens
aguccuuaaaaaucacacugu

SEQ ID NO: 2042849 - RNA, 13 nt, Homo sapiens
uucaauacaggcu

SEQ ID NO: 2042850 - RNA, 21 nt, Homo sapiens
gauccccacuguccuaccagu

SEQ ID NO: 2042851 - RNA, 19 nt, Homo sapiens
ugguagacuuggacaucuc

SEQ ID NO: 2042852 - RNA, 15 nt, Homo sapiens
ugauaauucagucuu

SEQ ID NO: 2042853 - RNA, 14 nt, Homo sapiens
cccagccucuaggg

SEQ ID NO: 2042854 - RNA, 12 nt, Homo sapiens
cacaggacacag

SEQ ID NO: 2042855 - RNA, 17 nt, Homo sapiens
uaugauuguuucucaaa

SEQ ID NO: 2042856 - RNA, 16 nt, Homo sapiens
cuacuuacaugcauua

SEQ ID NO: 2042857 - RNA, 16 nt, Homo sapiens
aacuauuguuaauucu

SEQ ID NO: 2042858 - RNA, 14 nt, Homo sapiens
augugguuuguaca

SEQ ID NO: 2042859 - RNA, 20 nt, Homo sapiens
aagauggguggaucacuuga

SEQ ID NO: 2042860 - RNA, 23 nt, Homo sapiens
acgaucaaguuguugacugugau

SEQ ID NO: 2042861 - RNA, 16 nt, Homo sapiens
caacccuguugaguau

SEQ ID NO: 2042862 - RNA, 20 nt, Homo sapiens
acacagaucuguaauucacu

SEQ ID NO: 2042863 - RNA, 15 nt, Homo sapiens
uucgcccaccucagc

SEQ ID NO: 2042864 - RNA, 11 nt, Homo sapiens
guuccaagugu

SEQ ID NO: 2042865 - RNA, 18 nt, Homo sapiens
accgagcaggggcagcuu

SEQ ID NO: 2042866 - RNA, 23 nt, Homo sapiens
caaugcuggaaacauucacuuuc

SEQ ID NO: 2042867 - RNA, 16 nt, Homo sapiens
uauguaaguacuucca

SEQ ID NO: 2042868 - RNA, 17 nt, Homo sapiens
ggccccuccagcacaca

SEQ ID NO: 2042869 - RNA, 14 nt, Homo sapiens
ggaguuccacagau

SEQ ID NO: 2042870 - RNA, 22 nt, Homo sapiens
uaaaacuuauaaauuucauuga

SEQ ID NO: 2042871 - RNA, 21 nt, Homo sapiens
ugugacugaggcggagcccag

SEQ ID NO: 2042872 - RNA, 18 nt, Homo sapiens
auugcacuuuccuuucaa

SEQ ID NO: 2042873 - RNA, 15 nt, Homo sapiens
uaauuacucuaacaa

SEQ ID NO: 2042874 - RNA, 23 nt, Homo sapiens
uuaaucaaaccacuguuauuaac

SEQ ID NO: 2042875 - RNA, 15 nt, Homo sapiens
ccggcgugugcagug

SEQ ID NO: 2042876 - RNA, 13 nt, Homo sapiens
gcauguaugugua

SEQ ID NO: 2042877 - RNA, 15 nt, Homo sapiens
aaaauacaacuucau

SEQ ID NO: 2042878 - RNA, 19 nt, Homo sapiens
ugucacucaccacuacauc

SEQ ID NO: 2042879 - RNA, 16 nt, Homo sapiens
gggaaacacacaagca

SEQ ID NO: 2042880 - RNA, 12 nt, Homo sapiens
gccaggacugug

SEQ ID NO: 2042881 - RNA, 21 nt, Homo sapiens
agcuugaauccuucacuuuag

SEQ ID NO: 2042882 - RNA, 16 nt, Homo sapiens
agauucuaaugaugau

SEQ ID NO: 2042883 - RNA, 19 nt, Homo sapiens
auuuuuuuuguaacuucaa

SEQ ID NO: 2042884 - RNA, 15 nt, Homo sapiens
uugaacuggaagaaa

SEQ ID NO: 2042885 - RNA, 20 nt, Homo sapiens
ugaggauaggaguucacuuc

SEQ ID NO: 2042886 - RNA, 20 nt, Homo sapiens
ucuucgguguuuaaagucaa

SEQ ID NO: 2042887 - RNA, 16 nt, Homo sapiens
augaccauaugcacaa

SEQ ID NO: 2042888 - RNA, 16 nt, Homo sapiens
aacacuaaaaccauau

SEQ ID NO: 2042889 - RNA, 20 nt, Homo sapiens
ucauaccagcauacgcucac

SEQ ID NO: 2042890 - RNA, 23 nt, Homo sapiens
caucuauguaucuaccaucuaau

SEQ ID NO: 2042891 - RNA, 17 nt, Homo sapiens
aaauucauaaccaaaga

SEQ ID NO: 2042892 - RNA, 17 nt, Homo sapiens
auccaccaccuugccaa

SEQ ID NO: 2042893 - RNA, 15 nt, Homo sapiens
agccugaccucuagc

SEQ ID NO: 2042894 - RNA, 19 nt, Homo sapiens
auaauucagcacuuaacua

SEQ ID NO: 2042895 - RNA, 11 nt, Homo sapiens
uguuacuguga

SEQ ID NO: 2042896 - RNA, 11 nt, Homo sapiens
ugauacugugu

SEQ ID NO: 2042897 - RNA, 16 nt, Homo sapiens
ccuucucaucuugccu

SEQ ID NO: 2042898 - RNA, 18 nt, Homo sapiens
gccgggaggcagugcuga

SEQ ID NO: 2042899 - RNA, 16 nt, Homo sapiens
gaguucugaagcugac

SEQ ID NO: 2042900 - RNA, 14 nt, Homo sapiens
acagguaccaucuu

SEQ ID NO: 2042901 - RNA, 17 nt, Homo sapiens
uagggcagucaguagua

SEQ ID NO: 2042902 - RNA, 19 nt, Homo sapiens
aagagcaaaacucagucuc

SEQ ID NO: 2042903 - RNA, 16 nt, Homo sapiens
uagacucagugcacau

SEQ ID NO: 2042904 - RNA, 13 nt, Homo sapiens
gcaauaacaguuu

SEQ ID NO: 2042905 - RNA, 20 nt, Homo sapiens
uucacuuauuuagauucacu

SEQ ID NO: 2042906 - RNA, 17 nt, Homo sapiens
agacucgagagggcuga

SEQ ID NO: 2042907 - RNA, 20 nt, Homo sapiens
ggccuccugacagcaauaaa

SEQ ID NO: 2042908 - RNA, 18 nt, Homo sapiens
aaaugugguacauacaca

SEQ ID NO: 2042909 - RNA, 20 nt, Homo sapiens
uccaauggaacaguagcuuu

SEQ ID NO: 2042910 - RNA, 15 nt, Homo sapiens
acccguagaugccag

SEQ ID NO: 2042911 - RNA, 17 nt, Homo sapiens
ucugagagacagaauuc

SEQ ID NO: 2042912 - RNA, 22 nt, Homo sapiens
caucuuagguauaacagcacaa

SEQ ID NO: 2042913 - RNA, 22 nt, Homo sapiens
cugcuugaggaaaacaagcauu

SEQ ID NO: 2042914 - RNA, 14 nt, Homo sapiens
cagguucugagaua

SEQ ID NO: 2042915 - RNA, 17 nt, Homo sapiens
aggcccuggaacucuau

SEQ ID NO: 2042916 - RNA, 22 nt, Homo sapiens
ugggguugaaaauucaaaaagu

SEQ ID NO: 2042917 - RNA, 13 nt, Homo sapiens
cccuagcagugaa

SEQ ID NO: 2042918 - RNA, 13 nt, Homo sapiens
caaugagccuuag

SEQ ID NO: 2042919 - RNA, 12 nt, Homo sapiens
ggggcaggugaa

SEQ ID NO: 2042920 - RNA, 18 nt, Homo sapiens
uuaacaaauugcauuugu

SEQ ID NO: 2042921 - RNA, 17 nt, Homo sapiens
gcugcaguauguugcca

SEQ ID NO: 2042922 - RNA, 17 nt, Homo sapiens
auugugaaggguuuacu

SEQ ID NO: 2042923 - RNA, 18 nt, Homo sapiens
gaaauaaaguagugcuua

SEQ ID NO: 2042924 - RNA, 23 nt, Homo sapiens
uccaugcccccgccaccucccca

SEQ ID NO: 2042925 - RNA, 12 nt, Homo sapiens
uaguaacaacuc

SEQ ID NO: 2042926 - RNA, 20 nt, Homo sapiens
gaauccagaaggaagcucgc

SEQ ID NO: 2042927 - RNA, 18 nt, Homo sapiens
ggacaucagaaagggaga

SEQ ID NO: 2042928 - RNA, 18 nt, Homo sapiens
gaccaugguauauuccua

SEQ ID NO: 2042929 - RNA, 19 nt, Homo sapiens
ugccucugcagcccacugc

SEQ ID NO: 2042930 - RNA, 22 nt, Homo sapiens
aaauaaauauugaugugguaua

SEQ ID NO: 2042931 - RNA, 19 nt, Homo sapiens
uccugaaaagauccuauua

SEQ ID NO: 2042932 - RNA, 12 nt, Homo sapiens
uaucaaaggcac

SEQ ID NO: 2042933 - RNA, 23 nt, Homo sapiens
acacuccagugccagcaaugaca

SEQ ID NO: 2042934 - RNA, 18 nt, Homo sapiens
acaucaagcgaugaaacu

SEQ ID NO: 2042935 - RNA, 15 nt, Homo sapiens
gggacuggagucaga

SEQ ID NO: 2042936 - RNA, 19 nt, Homo sapiens
uccaucagagccagucuca

SEQ ID NO: 2042937 - RNA, 18 nt, Homo sapiens
guaucaaacuacugccau

SEQ ID NO: 2042938 - RNA, 15 nt, Homo sapiens
gcuccuauaggacca

SEQ ID NO: 2042939 - RNA, 18 nt, Homo sapiens
uuaaucagaguaucugaa

SEQ ID NO: 2042940 - RNA, 18 nt, Homo sapiens
cuugcaaagcgacagauu

SEQ ID NO: 2042941 - RNA, 22 nt, Homo sapiens
ggagagccaaggccuaugccac

SEQ ID NO: 2042942 - RNA, 18 nt, Homo sapiens
gauaaaagacagugaaag

SEQ ID NO: 2042943 - RNA, 22 nt, Homo sapiens
caguugggugagaacaaccaaa

SEQ ID NO: 2042944 - RNA, 21 nt, Homo sapiens
auaucuaaauuuaaacaguau

SEQ ID NO: 2042945 - RNA, 23 nt, Homo sapiens
auuuauguuuuuucugauuccau

SEQ ID NO: 2042946 - RNA, 17 nt, Homo sapiens
uagaauauuuauuaccu

SEQ ID NO: 2042947 - RNA, 13 nt, Homo sapiens
ccugaacauauua

SEQ ID NO: 2042948 - RNA, 14 nt, Homo sapiens
aaguaaugaucuca

SEQ ID NO: 2042949 - RNA, 16 nt, Homo sapiens
cuccuggagauagcug

SEQ ID NO: 2042950 - RNA, 15 nt, Homo sapiens
caucccucuguucac

SEQ ID NO: 2042951 - RNA, 16 nt, Homo sapiens
ugaucuauguuguuug

SEQ ID NO: 2042952 - RNA, 15 nt, Homo sapiens
gaaccuggaacuugg

SEQ ID NO: 2042953 - RNA, 15 nt, Homo sapiens
caugcacaaaaagau

SEQ ID NO: 2042954 - RNA, 21 nt, Homo sapiens
cuccauacuuucccacagcac

SEQ ID NO: 2042955 - RNA, 18 nt, Homo sapiens
cugcacagugcaucucag

SEQ ID NO: 2042956 - RNA, 19 nt, Homo sapiens
guugcugucuucagucuca

SEQ ID NO: 2042957 - RNA, 21 nt, Homo sapiens
ucgucugggguggcucugcag

SEQ ID NO: 2042958 - RNA, 20 nt, Homo sapiens
ccugaggcucaagaggccca

SEQ ID NO: 2042959 - RNA, 13 nt, Homo sapiens
augccuuggugcc

SEQ ID NO: 2042960 - RNA, 16 nt, Homo sapiens
cgaggaacucgccuca

SEQ ID NO: 2042961 - RNA, 19 nt, Homo sapiens
uuuuaaaaggagcacauua

SEQ ID NO: 2042962 - RNA, 19 nt, Homo sapiens
cugggacugugcucagaga

SEQ ID NO: 2042963 - RNA, 14 nt, Homo sapiens
ucaccagagcauuu

SEQ ID NO: 2042964 - RNA, 17 nt, Homo sapiens
cccagggcacuacauaa

SEQ ID NO: 2042965 - RNA, 19 nt, Homo sapiens
auucuauucuccagacaug

SEQ ID NO: 2042966 - RNA, 15 nt, Homo sapiens
gcaaaaccaaacugg

SEQ ID NO: 2042967 - RNA, 21 nt, Homo sapiens
auucugaaguuauauuuccua

SEQ ID NO: 2042968 - RNA, 18 nt, Homo sapiens
cagauuugugcccauucc

SEQ ID NO: 2042969 - RNA, 20 nt, Homo sapiens
uggugcauagaacuggguaa

SEQ ID NO: 2042970 - RNA, 14 nt, Homo sapiens
acauuaagcacugu

SEQ ID NO: 2042971 - RNA, 17 nt, Homo sapiens
aaagagagaagggagac

SEQ ID NO: 2042972 - RNA, 19 nt, Homo sapiens
ucuaucugcuuaugcaguu

SEQ ID NO: 2042973 - RNA, 21 nt, Homo sapiens
acugucacugccgacaucccu

SEQ ID NO: 2042974 - RNA, 22 nt, Homo sapiens
gaaguucuccagcuucagcuca

SEQ ID NO: 2042975 - RNA, 23 nt, Homo sapiens
ggacaucaaagugguaaauacug

SEQ ID NO: 2042976 - RNA, 21 nt, Homo sapiens
uuucugucguuaaaaacagau

SEQ ID NO: 2042977 - RNA, 16 nt, Homo sapiens
uugacuuagauauuaa

SEQ ID NO: 2042978 - RNA, 12 nt, Homo sapiens
ccagaucugccu

SEQ ID NO: 2042979 - RNA, 17 nt, Homo sapiens
augauuuuaacaguuuu

SEQ ID NO: 2042980 - RNA, 17 nt, Homo sapiens
ugaacuugcauugugau

SEQ ID NO: 2042981 - RNA, 16 nt, Homo sapiens
cauuauucauucuccc

SEQ ID NO: 2042982 - RNA, 15 nt, Homo sapiens
cucccuccaccuccu

SEQ ID NO: 2042983 - RNA, 22 nt, Homo sapiens
aauacauaaaguaugugcauau

SEQ ID NO: 2042984 - RNA, 12 nt, Homo sapiens
caccccacugug

SEQ ID NO: 2042985 - RNA, 15 nt, Homo sapiens
aagucuucaagggcu

SEQ ID NO: 2042986 - RNA, 16 nt, Homo sapiens
ccacacacagcagcuc

SEQ ID NO: 2042987 - RNA, 16 nt, Homo sapiens
uacauaagcuucucaa

SEQ ID NO: 2042988 - RNA, 20 nt, Homo sapiens
aagaucuuucauuuugcacc

SEQ ID NO: 2042989 - RNA, 13 nt, Homo sapiens
acuguguaccuca

SEQ ID NO: 2042990 - RNA, 21 nt, Homo sapiens
aauuauugcuucuaguccacu

SEQ ID NO: 2042991 - RNA, 23 nt, Homo sapiens
cuaagcaaacccagugucaggau

SEQ ID NO: 2042992 - RNA, 19 nt, Homo sapiens
aaccaggguuuaucuuuug

SEQ ID NO: 2042993 - RNA, 19 nt, Homo sapiens
guucccauuggaugcauuu

SEQ ID NO: 2042994 - RNA, 21 nt, Homo sapiens
cagcacugccugcucccaucc

SEQ ID NO: 2042995 - RNA, 12 nt, Homo sapiens
aacaaaacuugc

SEQ ID NO: 2042996 - RNA, 20 nt, Homo sapiens
ucggauuaccaaaacacugc

SEQ ID NO: 2042997 - RNA, 15 nt, Homo sapiens
cacauuugacuccac

SEQ ID NO: 2042998 - RNA, 21 nt, Homo sapiens
auucuugauuuauuugcuucu

SEQ ID NO: 2042999 - RNA, 11 nt, Homo sapiens
cccuagcuuau

SEQ ID NO: 2043000 - RNA, 13 nt, Homo sapiens
cuccagaggccaa

SEQ ID NO: 2043001 - RNA, 23 nt, Homo sapiens
agcacagaggauggcuuccccau

SEQ ID NO: 2043002 - RNA, 21 nt, Homo sapiens
cgugacccguccauucuucag

SEQ ID NO: 2043003 - RNA, 21 nt, Homo sapiens
agcuacugccgucagugcugu

SEQ ID NO: 2043004 - RNA, 21 nt, Homo sapiens
cagagauaagggugucuuccu

SEQ ID NO: 2043005 - RNA, 21 nt, Homo sapiens
uugucuaaaguuacuacugau

SEQ ID NO: 2043006 - RNA, 14 nt, Homo sapiens
cugcaaauuucaaa

SEQ ID NO: 2043007 - RNA, 15 nt, Homo sapiens
caagcuggcacaaaa

SEQ ID NO: 2043008 - RNA, 15 nt, Homo sapiens
cucuugaggagcuca

SEQ ID NO: 2043009 - RNA, 17 nt, Homo sapiens
accucugggucaucucu

SEQ ID NO: 2043010 - RNA, 17 nt, Homo sapiens
aacaugaaaacauugau

SEQ ID NO: 2043011 - RNA, 14 nt, Homo sapiens
aacacaaccacuca

SEQ ID NO: 2043012 - RNA, 17 nt, Homo sapiens
aaaacugcagucaucaa

SEQ ID NO: 2043013 - RNA, 14 nt, Homo sapiens
ucucuagguccauu

SEQ ID NO: 2043014 - RNA, 20 nt, Homo sapiens
ucuccccacagccucuggcu

SEQ ID NO: 2043015 - RNA, 21 nt, Homo sapiens
auuacuguugcauuuacuuuu

SEQ ID NO: 2043016 - RNA, 16 nt, Homo sapiens
aauuuaacauguguau

SEQ ID NO: 2043017 - RNA, 18 nt, Homo sapiens
uccaaggcacacuguuaa

SEQ ID NO: 2043018 - RNA, 15 nt, Homo sapiens
aaaucaaauauucca

SEQ ID NO: 2043019 - RNA, 15 nt, Homo sapiens
aauucaaauaaucca

SEQ ID NO: 2043020 - RNA, 14 nt, Homo sapiens
agaugagugucugg

SEQ ID NO: 2043021 - RNA, 13 nt, Homo sapiens
agaaagcuggacu

SEQ ID NO: 2043022 - RNA, 16 nt, Homo sapiens
caaguuccagugcaga

SEQ ID NO: 2043023 - RNA, 21 nt, Homo sapiens
acaacuucaguccaacuguca

SEQ ID NO: 2043024 - RNA, 12 nt, Homo sapiens
caaaccauuuaa

SEQ ID NO: 2043025 - RNA, 13 nt, Homo sapiens
aagcaugugaugu

SEQ ID NO: 2043026 - RNA, 18 nt, Homo sapiens
gugcuugagagacacugg

SEQ ID NO: 2043027 - RNA, 21 nt, Homo sapiens
uaaaauaaaggcucugugcuu

SEQ ID NO: 2043028 - RNA, 14 nt, Homo sapiens
gauacugcaauaaa

SEQ ID NO: 2043029 - RNA, 23 nt, Homo sapiens
uggguacugaaagccuuagggaa

SEQ ID NO: 2043030 - RNA, 21 nt, Homo sapiens
auugccuucucaccagcugca

SEQ ID NO: 2043031 - RNA, 13 nt, Homo sapiens
cagugcaaaccac

SEQ ID NO: 2043032 - RNA, 22 nt, Homo sapiens
guccaggccucucucugcucca

SEQ ID NO: 2043033 - RNA, 16 nt, Homo sapiens
aagaaucagucuugca

SEQ ID NO: 2043034 - RNA, 23 nt, Homo sapiens
agaauaaaagaauuacauaugaa

SEQ ID NO: 2043035 - RNA, 15 nt, Homo sapiens
uuaugcaaaagcagc

SEQ ID NO: 2043036 - RNA, 15 nt, Homo sapiens
cccacuaacuggcua

SEQ ID NO: 2043037 - RNA, 13 nt, Homo sapiens
uucccacgaggaa

SEQ ID NO: 2043038 - RNA, 20 nt, Homo sapiens
aaugugucccccaacuucau

SEQ ID NO: 2043039 - RNA, 24 nt, Homo sapiens
ccaacguaugugguuaucugugaa

SEQ ID NO: 2043040 - RNA, 15 nt, Homo sapiens
gaagagccacugcca

SEQ ID NO: 2043041 - RNA, 17 nt, Homo sapiens
gauagccuguuacagga

SEQ ID NO: 2043042 - RNA, 17 nt, Homo sapiens
cauugugcugcaccugg

SEQ ID NO: 2043043 - RNA, 21 nt, Homo sapiens
ugccaguuacuugggcuucaa

SEQ ID NO: 2043044 - RNA, 23 nt, Homo sapiens
gaacuaaaaagagacugugccau

SEQ ID NO: 2043045 - RNA, 21 nt, Homo sapiens
cuguguauaucucuuggaaaa

SEQ ID NO: 2043046 - RNA, 19 nt, Homo sapiens
aaugcacgcacacaucagu

SEQ ID NO: 2043047 - RNA, 23 nt, Homo sapiens
uucugccaggcccccaagccugc

SEQ ID NO: 2043048 - RNA, 18 nt, Homo sapiens
augggcuucacuguauaa

SEQ ID NO: 2043049 - RNA, 21 nt, Homo sapiens
ugauugggaaaacauuugcug

SEQ ID NO: 2043050 - RNA, 20 nt, Homo sapiens
gauacuaauaggugugugag

SEQ ID NO: 2043051 - RNA, 18 nt, Homo sapiens
gcuagaugugucuuacca

SEQ ID NO: 2043052 - RNA, 14 nt, Homo sapiens
uacaagcauaacau

SEQ ID NO: 2043053 - RNA, 17 nt, Homo sapiens
uucauaaggccugcccu

SEQ ID NO: 2043054 - RNA, 14 nt, Homo sapiens
caaagcuguuauug

SEQ ID NO: 2043055 - RNA, 21 nt, Homo sapiens
cauugccuaacuacuaguuuu

SEQ ID NO: 2043056 - RNA, 23 nt, Homo sapiens
cuuuucuacacacucagccacaa

SEQ ID NO: 2043057 - RNA, 20 nt, Homo sapiens
cuuuuuauuuuaguuccuuc

SEQ ID NO: 2043058 - RNA, 22 nt, Homo sapiens
guaguucuaccggcuuugccau

SEQ ID NO: 2043059 - RNA, 19 nt, Homo sapiens
aacuaaaaauuaaaaccuc

SEQ ID NO: 2043060 - RNA, 16 nt, Homo sapiens
gcaggcuacacugaca

SEQ ID NO: 2043061 - RNA, 14 nt, Homo sapiens
aaauauccauuuau

SEQ ID NO: 2043062 - RNA, 21 nt, Homo sapiens
aaccacuucagaaauauaugc

SEQ ID NO: 2043063 - RNA, 11 nt, Homo sapiens
cuuagcucaca

SEQ ID NO: 2043064 - RNA, 16 nt, Homo sapiens
cuaugaaaaugagccc

SEQ ID NO: 2043065 - RNA, 14 nt, Homo sapiens
agugugugugcaug

SEQ ID NO: 2043066 - RNA, 14 nt, Homo sapiens
ucaaaacauuccaa

SEQ ID NO: 2043067 - RNA, 14 nt, Homo sapiens
ccaaaccacuccac

SEQ ID NO: 2043068 - RNA, 22 nt, Homo sapiens
gauauaauuuuauuacauauga

SEQ ID NO: 2043069 - RNA, 16 nt, Homo sapiens
caugauuucauuucaa

SEQ ID NO: 2043070 - RNA, 22 nt, Homo sapiens
cuuaugcguaagugguaugcau

SEQ ID NO: 2043071 - RNA, 15 nt, Homo sapiens
ccuuccacaccccau

SEQ ID NO: 2043072 - RNA, 13 nt, Homo sapiens
cauuugaacaugu

SEQ ID NO: 2043073 - RNA, 17 nt, Homo sapiens
ugcuuuucccacucuca

SEQ ID NO: 2043074 - RNA, 21 nt, Homo sapiens
aucauacaugacucagcauac

SEQ ID NO: 2043075 - RNA, 13 nt, Homo sapiens
cugugaaauacca

SEQ ID NO: 2043076 - RNA, 14 nt, Homo sapiens
agucacaggucaca

SEQ ID NO: 2043077 - RNA, 16 nt, Homo sapiens
cggggacccccaacuc

SEQ ID NO: 2043078 - RNA, 18 nt, Homo sapiens
ucaacuuuuuauugccuu

SEQ ID NO: 2043079 - RNA, 16 nt, Homo sapiens
cuuuaaugcaaugcau

SEQ ID NO: 2043080 - RNA, 12 nt, Homo sapiens
aaccuugcugcu

SEQ ID NO: 2043081 - RNA, 15 nt, Homo sapiens
cuguuuauugaagaa

SEQ ID NO: 2043082 - RNA, 13 nt, Homo sapiens
aagcauaagcaaa

SEQ ID NO: 2043083 - RNA, 22 nt, Homo sapiens
ccuuuccugaucacuaugcauu

SEQ ID NO: 2043084 - RNA, 21 nt, Homo sapiens
cuaagucaggcccugaucuag

SEQ ID NO: 2043085 - RNA, 15 nt, Homo sapiens
ggagcaaaggcucac

SEQ ID NO: 2043086 - RNA, 20 nt, Homo sapiens
ccugccagccccugccauug

SEQ ID NO: 2043087 - RNA, 19 nt, Homo sapiens
uucuccguugucauugacu

SEQ ID NO: 2043088 - RNA, 18 nt, Homo sapiens
cacacuuucugacugcaa

SEQ ID NO: 2043089 - RNA, 18 nt, Homo sapiens
aguuguggugugccaugc

SEQ ID NO: 2043090 - RNA, 19 nt, Homo sapiens
acguugaaacaagugcaag

SEQ ID NO: 2043091 - RNA, 22 nt, Homo sapiens
guuguugauguuuuaacucuau

SEQ ID NO: 2043092 - RNA, 17 nt, Homo sapiens
agagccagcagcaaaaa

SEQ ID NO: 2043093 - RNA, 21 nt, Homo sapiens
agacgugcacuuggugcugcg

SEQ ID NO: 2043094 - RNA, 23 nt, Homo sapiens
cagcugaccgggucacacaaagg

SEQ ID NO: 2043095 - RNA, 14 nt, Homo sapiens
cgagugugugcaug

SEQ ID NO: 2043096 - RNA, 12 nt, Homo sapiens
cgcuauuacaaa

SEQ ID NO: 2043097 - RNA, 16 nt, Homo sapiens
uuuuuguaaaaacagc

SEQ ID NO: 2043098 - RNA, 13 nt, Homo sapiens
uuguucauucuug

SEQ ID NO: 2043099 - RNA, 15 nt, Homo sapiens
aaaccuccagccucc

SEQ ID NO: 2043100 - RNA, 19 nt, Homo sapiens
uucuucaagaaagaauucc

SEQ ID NO: 2043101 - RNA, 14 nt, Homo sapiens
gagaaggaaggcuc

SEQ ID NO: 2043102 - RNA, 20 nt, Homo sapiens
aaggaccacuucucauauua

SEQ ID NO: 2043103 - RNA, 20 nt, Homo sapiens
ugaguccacgcccaccagcc

SEQ ID NO: 2043104 - RNA, 14 nt, Homo sapiens
acuuccaugacaua

SEQ ID NO: 2043105 - RNA, 20 nt, Homo sapiens
uaacagacaauuggucaaaa

SEQ ID NO: 2043106 - RNA, 15 nt, Homo sapiens
gggagggacugcuga

SEQ ID NO: 2043107 - RNA, 17 nt, Homo sapiens
gaucccugagagucucu

SEQ ID NO: 2043108 - RNA, 17 nt, Homo sapiens
aggaaacucacacuccc

SEQ ID NO: 2043109 - RNA, 13 nt, Homo sapiens
ugcacaguacugu

SEQ ID NO: 2043110 - RNA, 15 nt, Homo sapiens
aaccaccuucaccug

SEQ ID NO: 2043111 - RNA, 17 nt, Homo sapiens
aggacacaacccgucag

SEQ ID NO: 2043112 - RNA, 16 nt, Homo sapiens
cuccugaagauacuua

SEQ ID NO: 2043113 - RNA, 15 nt, Homo sapiens
ucuggugggaaaaug

SEQ ID NO: 2043114 - RNA, 15 nt, Homo sapiens
uacgguggucuuuga

SEQ ID NO: 2043115 - RNA, 16 nt, Homo sapiens
cuuugcuucucuccac

SEQ ID NO: 2043116 - RNA, 17 nt, Homo sapiens
agaauagucucacuguc

SEQ ID NO: 2043117 - RNA, 21 nt, Homo sapiens
accaagauauuuuuaucccaa

SEQ ID NO: 2043118 - RNA, 12 nt, Homo sapiens
acuaugacaaau

SEQ ID NO: 2043119 - RNA, 15 nt, Homo sapiens
auaccaguucuugca

SEQ ID NO: 2043120 - RNA, 14 nt, Homo sapiens
aguuugggggcaga

SEQ ID NO: 2043121 - RNA, 22 nt, Homo sapiens
aagucuccugucuuauggucca

SEQ ID NO: 2043122 - RNA, 20 nt, Homo sapiens
uuuuccacggaaacagaacu

SEQ ID NO: 2043123 - RNA, 15 nt, Homo sapiens
auauaaccuucucaa

SEQ ID NO: 2043124 - RNA, 12 nt, Homo sapiens
aacuauccugau

SEQ ID NO: 2043125 - RNA, 20 nt, Homo sapiens
acauugaguagacacauuua

SEQ ID NO: 2043126 - RNA, 14 nt, Homo sapiens
ccacgcauggugca

SEQ ID NO: 2043127 - RNA, 14 nt, Homo sapiens
cauuuugcauucaa

SEQ ID NO: 2043128 - RNA, 19 nt, Homo sapiens
uuaaaaguuauuuguucau

SEQ ID NO: 2043129 - RNA, 23 nt, Homo sapiens
aaacuagacuccauugugccuua

SEQ ID NO: 2043130 - RNA, 17 nt, Homo sapiens
ucaaaguaaccucugag

SEQ ID NO: 2043131 - RNA, 13 nt, Homo sapiens
gcuucuuuacuua

SEQ ID NO: 2043132 - RNA, 20 nt, Homo sapiens
agugacuaaaccauugugca

SEQ ID NO: 2043133 - RNA, 21 nt, Homo sapiens
ucagaauuguucaacuuuuca

SEQ ID NO: 2043134 - RNA, 17 nt, Homo sapiens
ggcuccugcuuccccau

SEQ ID NO: 2043135 - RNA, 21 nt, Homo sapiens
caguaucucuuacaucaguag

SEQ ID NO: 2043136 - RNA, 14 nt, Homo sapiens
cagcuuccuuccaa

SEQ ID NO: 2043137 - RNA, 13 nt, Homo sapiens
ugcacuccaagaa

SEQ ID NO: 2043138 - RNA, 19 nt, Homo sapiens
augcguguguaauagagcc

SEQ ID NO: 2043139 - RNA, 20 nt, Homo sapiens
cauguaccucagaucucucu

SEQ ID NO: 2043140 - RNA, 20 nt, Homo sapiens
gccccaaagaucccacggga

SEQ ID NO: 2043141 - RNA, 16 nt, Homo sapiens
uaauuuugaaugcccu

SEQ ID NO: 2043142 - RNA, 18 nt, Homo sapiens
gguauuagcaaagcaaaa

SEQ ID NO: 2043143 - RNA, 19 nt, Homo sapiens
uuacaauuguaaaacugag

SEQ ID NO: 2043144 - RNA, 13 nt, Homo sapiens
cccuuccaguggg

SEQ ID NO: 2043145 - RNA, 21 nt, Homo sapiens
cuguuggcaucuugcugcuaa

SEQ ID NO: 2043146 - RNA, 22 nt, Homo sapiens
gaagcaguugcaauaaacucag

SEQ ID NO: 2043147 - RNA, 17 nt, Homo sapiens
uaugcauguauaugcca

SEQ ID NO: 2043148 - RNA, 23 nt, Homo sapiens
uacacaauccuccaagaauuuga

SEQ ID NO: 2043149 - RNA, 13 nt, Homo sapiens
ugugcgcacacac

SEQ ID NO: 2043150 - RNA, 12 nt, Homo sapiens
uacuugaugcac

SEQ ID NO: 2043151 - RNA, 15 nt, Homo sapiens
gaauugcacugaaca

SEQ ID NO: 2043152 - RNA, 23 nt, Homo sapiens
aagccauuuuccagugacuugca

SEQ ID NO: 2043153 - RNA, 23 nt, Homo sapiens
cuuagauaaucgagucuaccucu

SEQ ID NO: 2043154 - RNA, 11 nt, Homo sapiens
cuccucugaau

SEQ ID NO: 2043155 - RNA, 13 nt, Homo sapiens
gaauaagaagcaa

SEQ ID NO: 2043156 - RNA, 17 nt, Homo sapiens
uggcaccaggcgcugcc

SEQ ID NO: 2043157 - RNA, 20 nt, Homo sapiens
ccaaaugcuuuuugaucugu

SEQ ID NO: 2043158 - RNA, 12 nt, Homo sapiens
gagagugcccuu

SEQ ID NO: 2043159 - RNA, 19 nt, Homo sapiens
gcuagugcuguagaguuca

SEQ ID NO: 2043160 - RNA, 23 nt, Homo sapiens
aauuggcuaaaagacaugcauuu

SEQ ID NO: 2043161 - RNA, 13 nt, Homo sapiens
cuuaaaacagcug

SEQ ID NO: 2043162 - RNA, 16 nt, Homo sapiens
augagaccacuguuau

SEQ ID NO: 2043163 - RNA, 15 nt, Homo sapiens
cguccaucucccuua

SEQ ID NO: 2043164 - RNA, 19 nt, Homo sapiens
gcaggccagagaaagcaaa

SEQ ID NO: 2043165 - RNA, 16 nt, Homo sapiens
agacuccuagcugucc

SEQ ID NO: 2043166 - RNA, 15 nt, Homo sapiens
uugaaguagcucuuu

SEQ ID NO: 2043167 - RNA, 20 nt, Homo sapiens
accugcuuuacuuugcccag

SEQ ID NO: 2043168 - RNA, 18 nt, Homo sapiens
cacaauguuaaguuauau

SEQ ID NO: 2043169 - RNA, 23 nt, Homo sapiens
ucagaugaccccagaaacugaac

SEQ ID NO: 2043170 - RNA, 13 nt, Homo sapiens
augaaacaucauu

SEQ ID NO: 2043171 - RNA, 21 nt, Homo sapiens
uggggcucagccacagccuga

SEQ ID NO: 2043172 - RNA, 14 nt, Homo sapiens
cuuuaauggguaaa

SEQ ID NO: 2043173 - RNA, 15 nt, Homo sapiens
gcagacaugccuugg

SEQ ID NO: 2043174 - RNA, 14 nt, Homo sapiens
aaaaugagguacuc

SEQ ID NO: 2043175 - RNA, 14 nt, Homo sapiens
cacaaaggcaugcu

SEQ ID NO: 2043176 - RNA, 22 nt, Homo sapiens
cacuuuggggagagcuggagaa

SEQ ID NO: 2043177 - RNA, 15 nt, Homo sapiens
caccauagugucaca

SEQ ID NO: 2043178 - RNA, 16 nt, Homo sapiens
cucaugggaaggggag

SEQ ID NO: 2043179 - RNA, 12 nt, Homo sapiens
uuaggauguaca

SEQ ID NO: 2043180 - RNA, 14 nt, Homo sapiens
ggauggggcuccca

SEQ ID NO: 2043181 - RNA, 19 nt, Homo sapiens
cuggaaggggccacgugga

SEQ ID NO: 2043182 - RNA, 23 nt, Homo sapiens
uuggaagugcagaggcagacagg

SEQ ID NO: 2043183 - RNA, 15 nt, Homo sapiens
agauuguaaagguag

SEQ ID NO: 2043184 - RNA, 15 nt, Homo sapiens
uugaauuacagcagu

SEQ ID NO: 2043185 - RNA, 16 nt, Homo sapiens
auggggacauuccaau

SEQ ID NO: 2043186 - RNA, 19 nt, Homo sapiens
aggacucagugaucccugg

SEQ ID NO: 2043187 - RNA, 22 nt, Homo sapiens
uugguguggguucauuggcauu

SEQ ID NO: 2043188 - RNA, 14 nt, Homo sapiens
gccccucaaccucc

SEQ ID NO: 2043189 - RNA, 20 nt, Homo sapiens
uauacuagggagccauuuga

SEQ ID NO: 2043190 - RNA, 21 nt, Homo sapiens
cccugccgggacccugcucac

SEQ ID NO: 2043191 - RNA, 19 nt, Homo sapiens
ucaugggccccccaugcau

SEQ ID NO: 2043192 - RNA, 12 nt, Homo sapiens
caaucauagcau

SEQ ID NO: 2043193 - RNA, 12 nt, Homo sapiens
aauacaaaaaug

SEQ ID NO: 2043194 - RNA, 12 nt, Homo sapiens
aaggcaaaaaga

SEQ ID NO: 2043195 - RNA, 16 nt, Homo sapiens
caagacucaccucauc

SEQ ID NO: 2043196 - RNA, 21 nt, Homo sapiens
ccacaucccuaacaucaugca

SEQ ID NO: 2043197 - RNA, 21 nt, Homo sapiens
caugaaggauaaaagccccaa

SEQ ID NO: 2043198 - RNA, 15 nt, Homo sapiens
gaaaugggcagugaa

SEQ ID NO: 2043199 - RNA, 18 nt, Homo sapiens
ucaucccuucucuuccag

SEQ ID NO: 2043200 - RNA, 18 nt, Homo sapiens
cuacuuuucuuuccucag

SEQ ID NO: 2043201 - RNA, 18 nt, Homo sapiens
cguguuacuguugcacug

SEQ ID NO: 2043202 - RNA, 18 nt, Homo sapiens
aaaugucucgaguccuaa

SEQ ID NO: 2043203 - RNA, 20 nt, Homo sapiens
cuuucugccgaccccuaguu

SEQ ID NO: 2043204 - RNA, 17 nt, Homo sapiens
ccgugagcgacaaagau

SEQ ID NO: 2043205 - RNA, 19 nt, Homo sapiens
uaaacaagucaauucugug

SEQ ID NO: 2043206 - RNA, 14 nt, Homo sapiens
aaggaaagcagugu

SEQ ID NO: 2043207 - RNA, 16 nt, Homo sapiens
aguggguaggccuugg

SEQ ID NO: 2043208 - RNA, 16 nt, Homo sapiens
aauuauugauguuuuc

SEQ ID NO: 2043209 - RNA, 19 nt, Homo sapiens
agcucagaggcccaggaau

SEQ ID NO: 2043210 - RNA, 13 nt, Homo sapiens
acucuuuccuuca

SEQ ID NO: 2043211 - RNA, 13 nt, Homo sapiens
accaauuccucau

SEQ ID NO: 2043212 - RNA, 13 nt, Homo sapiens
cuuguuucacuga

SEQ ID NO: 2043213 - RNA, 13 nt, Homo sapiens
cuucuuucacuca

SEQ ID NO: 2043214 - RNA, 11 nt, Homo sapiens
gggaccucucc

SEQ ID NO: 2043215 - RNA, 17 nt, Homo sapiens
cugugcauuacaaaguu

SEQ ID NO: 2043216 - RNA, 18 nt, Homo sapiens
uggcuucuguugcgccac

SEQ ID NO: 2043217 - RNA, 14 nt, Homo sapiens
aagugucucuugac

SEQ ID NO: 2043218 - RNA, 21 nt, Homo sapiens
cuuacaacgccgagugcacug

SEQ ID NO: 2043219 - RNA, 21 nt, Homo sapiens
cucccagucucugucguggag

SEQ ID NO: 2043220 - RNA, 14 nt, Homo sapiens
aguaauuguaauac

SEQ ID NO: 2043221 - RNA, 18 nt, Homo sapiens
agcaaaaucaacaugacu

SEQ ID NO: 2043222 - RNA, 21 nt, Homo sapiens
aguucagccugggugugugaa

SEQ ID NO: 2043223 - RNA, 17 nt, Homo sapiens
gugacaugggugugcca

SEQ ID NO: 2043224 - RNA, 18 nt, Homo sapiens
gggccggggaagcugcca

SEQ ID NO: 2043225 - RNA, 16 nt, Homo sapiens
caaauggugcuucaau

SEQ ID NO: 2043226 - RNA, 22 nt, Homo sapiens
aggaugcccaccguuaggauuc

SEQ ID NO: 2043227 - RNA, 13 nt, Homo sapiens
accaaaaccacag

SEQ ID NO: 2043228 - RNA, 13 nt, Homo sapiens
uuuuaucacuugc

SEQ ID NO: 2043229 - RNA, 16 nt, Homo sapiens
cacuuauugacuauua

SEQ ID NO: 2043230 - RNA, 16 nt, Homo sapiens
gagcuugucagcaaga

SEQ ID NO: 2043231 - RNA, 22 nt, Homo sapiens
ccugugcucuaagugaauacuu

SEQ ID NO: 2043232 - RNA, 14 nt, Homo sapiens
accugacuuccucu

SEQ ID NO: 2043233 - RNA, 18 nt, Homo sapiens
aucugggagaauuuucaa

SEQ ID NO: 2043234 - RNA, 14 nt, Homo sapiens
ugccuuuugggcau

SEQ ID NO: 2043235 - RNA, 24 nt, Homo sapiens
auagacugauugauuauucaacac

SEQ ID NO: 2043236 - RNA, 15 nt, Homo sapiens
aguggaauacaguga

SEQ ID NO: 2043237 - RNA, 22 nt, Homo sapiens
ugguaucauuuucuagcaauaa

SEQ ID NO: 2043238 - RNA, 18 nt, Homo sapiens
aacagaugauccauuuga

SEQ ID NO: 2043239 - RNA, 21 nt, Homo sapiens
guaguaaauuuugugaugaau

SEQ ID NO: 2043240 - RNA, 14 nt, Homo sapiens
gcaacagacuugaa

SEQ ID NO: 2043241 - RNA, 18 nt, Homo sapiens
ccaagaacagcaggccca

SEQ ID NO: 2043242 - RNA, 17 nt, Homo sapiens
cagcugugacaauggca

SEQ ID NO: 2043243 - RNA, 15 nt, Homo sapiens
ccaccucacuagcuc

SEQ ID NO: 2043244 - RNA, 21 nt, Homo sapiens
aaagguuucauguucacugug

SEQ ID NO: 2043245 - RNA, 21 nt, Homo sapiens
uuaaauuauuuuuucuaugaa

SEQ ID NO: 2043246 - RNA, 14 nt, Homo sapiens
aaccuaaaauuuca

SEQ ID NO: 2043247 - RNA, 22 nt, Homo sapiens
uuuaagaauucuguacuuccaa

SEQ ID NO: 2043248 - RNA, 21 nt, Homo sapiens
cguguuuuuuuccuucaccga

SEQ ID NO: 2043249 - RNA, 15 nt, Homo sapiens
guaauaccucuaaua

SEQ ID NO: 2043250 - RNA, 21 nt, Homo sapiens
aucuuugcuauggggacauuc

SEQ ID NO: 2043251 - RNA, 14 nt, Homo sapiens
aacucaaugcuuua

SEQ ID NO: 2043252 - RNA, 19 nt, Homo sapiens
gcaaguccggcggaauuca

SEQ ID NO: 2043253 - RNA, 19 nt, Homo sapiens
uucuuuauauaaggucaua

SEQ ID NO: 2043254 - RNA, 23 nt, Homo sapiens
aggcuucccaaaccaagugccuu

SEQ ID NO: 2043255 - RNA, 19 nt, Homo sapiens
cagaggagccaccaguucu

SEQ ID NO: 2043256 - RNA, 16 nt, Homo sapiens
guggggaaaaggcauu

SEQ ID NO: 2043257 - RNA, 24 nt, Homo sapiens
ucucagguaggaagcaacagcuuc

SEQ ID NO: 2043258 - RNA, 21 nt, Homo sapiens
ccauuggaauggaccuuucag

SEQ ID NO: 2043259 - RNA, 17 nt, Homo sapiens
ucuauugucacaugaug

SEQ ID NO: 2043260 - RNA, 20 nt, Homo sapiens
cagcuaaacaccacgucacu

SEQ ID NO: 2043261 - RNA, 16 nt, Homo sapiens
aacaugguaaaacccc

SEQ ID NO: 2043262 - RNA, 19 nt, Homo sapiens
uaaaaugaugauaguauaa

SEQ ID NO: 2043263 - RNA, 12 nt, Homo sapiens
gcucccuaacac

SEQ ID NO: 2043264 - RNA, 16 nt, Homo sapiens
uguacuuaaauuacac

SEQ ID NO: 2043265 - RNA, 16 nt, Homo sapiens
ucacugcagccuccac

SEQ ID NO: 2043266 - RNA, 20 nt, Homo sapiens
cacaaaauguaggguuauaa

SEQ ID NO: 2043267 - RNA, 18 nt, Homo sapiens
cugcagaagucccaagac

SEQ ID NO: 2043268 - RNA, 18 nt, Homo sapiens
aaaugauuuccacaaaca

SEQ ID NO: 2043269 - RNA, 20 nt, Homo sapiens
gcuccuccuugcccagacua

SEQ ID NO: 2043270 - RNA, 14 nt, Homo sapiens
aacuaugaggaugu

SEQ ID NO: 2043271 - RNA, 18 nt, Homo sapiens
cacuaaauaagcuuccac

SEQ ID NO: 2043272 - RNA, 15 nt, Homo sapiens
uuuguuccaggcuca

SEQ ID NO: 2043273 - RNA, 15 nt, Homo sapiens
cacguauuugaaugg

SEQ ID NO: 2043274 - RNA, 14 nt, Homo sapiens
cugaaacaucucaa

SEQ ID NO: 2043275 - RNA, 15 nt, Homo sapiens
aaguauuucugugga

SEQ ID NO: 2043276 - RNA, 13 nt, Homo sapiens
acucagccaagac

SEQ ID NO: 2043277 - RNA, 14 nt, Homo sapiens
aagcagggacuggu

SEQ ID NO: 2043278 - RNA, 13 nt, Homo sapiens
ucaagaaugccag

SEQ ID NO: 2043279 - RNA, 13 nt, Homo sapiens
uuauaaaugucua

SEQ ID NO: 2043280 - RNA, 13 nt, Homo sapiens
ugcaaaauggaaa

SEQ ID NO: 2043281 - RNA, 15 nt, Homo sapiens
ugugcuucacauaau

SEQ ID NO: 2043282 - RNA, 20 nt, Homo sapiens
cugcagcugcuuuugcauuu

SEQ ID NO: 2043283 - RNA, 15 nt, Homo sapiens
aacuuaacauugcau

SEQ ID NO: 2043284 - RNA, 22 nt, Homo sapiens
aaaauuuaaacaugaagcacac

SEQ ID NO: 2043285 - RNA, 16 nt, Homo sapiens
ugucagugaggacucu

SEQ ID NO: 2043286 - RNA, 19 nt, Homo sapiens
acuuuguuucauauucuca

SEQ ID NO: 2043287 - RNA, 18 nt, Homo sapiens
aaucaccauguaagcacu

SEQ ID NO: 2043288 - RNA, 19 nt, Homo sapiens
uagcaugaggccacugcug

SEQ ID NO: 2043289 - RNA, 13 nt, Homo sapiens
agcagaaaugccu

SEQ ID NO: 2043290 - RNA, 16 nt, Homo sapiens
cucaguuccugcagca

SEQ ID NO: 2043291 - RNA, 17 nt, Homo sapiens
uauuuugugcaacauaa

SEQ ID NO: 2043292 - RNA, 19 nt, Homo sapiens
cuugccucuagaggcuuug

SEQ ID NO: 2043293 - RNA, 15 nt, Homo sapiens
uccuuguaaacaaua

SEQ ID NO: 2043294 - RNA, 18 nt, Homo sapiens
gaaaaaguugcagucuca

SEQ ID NO: 2043295 - RNA, 11 nt, Homo sapiens
uacuguguuag

SEQ ID NO: 2043296 - RNA, 19 nt, Homo sapiens
gccuccacucccacuuccc

SEQ ID NO: 2043297 - RNA, 14 nt, Homo sapiens
gauuuucaauaaua

SEQ ID NO: 2043298 - RNA, 16 nt, Homo sapiens
caauauuucugauaua

SEQ ID NO: 2043299 - RNA, 16 nt, Homo sapiens
uaaaaaauuuguuuaa

SEQ ID NO: 2043300 - RNA, 23 nt, Homo sapiens
gaguaauuugggaaaagaagcug

SEQ ID NO: 2043301 - RNA, 17 nt, Homo sapiens
auugccuccauucuccu

SEQ ID NO: 2043302 - RNA, 18 nt, Homo sapiens
caccaaucuuacuuugua

SEQ ID NO: 2043303 - RNA, 21 nt, Homo sapiens
auuuauaagcauugccauuga

SEQ ID NO: 2043304 - RNA, 12 nt, Homo sapiens
uguguccucuaa

SEQ ID NO: 2043305 - RNA, 18 nt, Homo sapiens
ugaagauauuacuacuua

SEQ ID NO: 2043306 - RNA, 16 nt, Homo sapiens
ccaaacccagccucua

SEQ ID NO: 2043307 - RNA, 21 nt, Homo sapiens
uauacauucuuuaucuugaca

SEQ ID NO: 2043308 - RNA, 17 nt, Homo sapiens
gcaacugccuuccugcc

SEQ ID NO: 2043309 - RNA, 18 nt, Homo sapiens
uuagaauaagaauuugca

SEQ ID NO: 2043310 - RNA, 18 nt, Homo sapiens
gaaaaugucuguuuucca

SEQ ID NO: 2043311 - RNA, 19 nt, Homo sapiens
aguacuuccuggacaagau

SEQ ID NO: 2043312 - RNA, 21 nt, Homo sapiens
ugcaccuugugucuguacacg

SEQ ID NO: 2043313 - RNA, 22 nt, Homo sapiens
acuacuguagaagaagugaaca

SEQ ID NO: 2043314 - RNA, 15 nt, Homo sapiens
cugcccguagcacag

SEQ ID NO: 2043315 - RNA, 12 nt, Homo sapiens
gcacgcuccauc

SEQ ID NO: 2043316 - RNA, 17 nt, Homo sapiens
gaaaucuagaagacugu

SEQ ID NO: 2043317 - RNA, 21 nt, Homo sapiens
ucucgcagcuugaugagcccc

SEQ ID NO: 2043318 - RNA, 17 nt, Homo sapiens
agaccgccccucaccaa

SEQ ID NO: 2043319 - RNA, 13 nt, Homo sapiens
auauuaagucguu

SEQ ID NO: 2043320 - RNA, 13 nt, Homo sapiens
cuuuuuguacuga

SEQ ID NO: 2043321 - RNA, 20 nt, Homo sapiens
agcugauguuuugguguauu

SEQ ID NO: 2043322 - RNA, 13 nt, Homo sapiens
acccaucugcaaa

SEQ ID NO: 2043323 - RNA, 18 nt, Homo sapiens
gaccuagauaggucaugc

SEQ ID NO: 2043324 - RNA, 17 nt, Homo sapiens
auguaaaauggagacca

SEQ ID NO: 2043325 - RNA, 16 nt, Homo sapiens
gauuacuucagggcug

SEQ ID NO: 2043326 - RNA, 13 nt, Homo sapiens
gccaucacugagc

SEQ ID NO: 2043327 - RNA, 21 nt, Homo sapiens
auccuuuauuuuaaaugaucu

SEQ ID NO: 2043328 - RNA, 13 nt, Homo sapiens
uuauagaacaguu

SEQ ID NO: 2043329 - RNA, 13 nt, Homo sapiens
cuguuucuggucu

SEQ ID NO: 2043330 - RNA, 17 nt, Homo sapiens
ccagcagcuggguuggg

SEQ ID NO: 2043331 - RNA, 16 nt, Homo sapiens
cucauuagaauuacca

SEQ ID NO: 2043332 - RNA, 20 nt, Homo sapiens
augugcuuguuagcuguuuc

SEQ ID NO: 2043333 - RNA, 14 nt, Homo sapiens
aauuuaccucucau

SEQ ID NO: 2043334 - RNA, 23 nt, Homo sapiens
aaaaucaguuuaggacuauuaaa

SEQ ID NO: 2043335 - RNA, 19 nt, Homo sapiens
gauguuuccagacuuccuu

SEQ ID NO: 2043336 - RNA, 18 nt, Homo sapiens
auagaaguguugagccau

SEQ ID NO: 2043337 - RNA, 20 nt, Homo sapiens
auuuuuguaaauaugacaga

SEQ ID NO: 2043338 - RNA, 19 nt, Homo sapiens
aaaucgaaugcugcauuuu

SEQ ID NO: 2043339 - RNA, 14 nt, Homo sapiens
auggaaguguucag

SEQ ID NO: 2043340 - RNA, 13 nt, Homo sapiens
gaaccaugcagga

SEQ ID NO: 2043341 - RNA, 20 nt, Homo sapiens
ggcauucuaggcucuauuua

SEQ ID NO: 2043342 - RNA, 16 nt, Homo sapiens
cuucuagaauccccac

SEQ ID NO: 2043343 - RNA, 23 nt, Homo sapiens
auuggcucccaagucacacccac

SEQ ID NO: 2043344 - RNA, 17 nt, Homo sapiens
acugcagauuucucacc

SEQ ID NO: 2043345 - RNA, 22 nt, Homo sapiens
auuagugccacaaauaaguuac

SEQ ID NO: 2043346 - RNA, 21 nt, Homo sapiens
cuaaagugauccuaaauauga

SEQ ID NO: 2043347 - RNA, 17 nt, Homo sapiens
ccaauaggcauuugauu

SEQ ID NO: 2043348 - RNA, 14 nt, Homo sapiens
auucuucacugugu

SEQ ID NO: 2043349 - RNA, 14 nt, Homo sapiens
auucuccacugugc

SEQ ID NO: 2043350 - RNA, 12 nt, Homo sapiens
uuuuaggcucug

SEQ ID NO: 2043351 - RNA, 23 nt, Homo sapiens
uugcuagcacaauguguguugcu

SEQ ID NO: 2043352 - RNA, 16 nt, Homo sapiens
uagauuaccuagcuua

SEQ ID NO: 2043353 - RNA, 11 nt, Homo sapiens
ugucucgccag

SEQ ID NO: 2043354 - RNA, 19 nt, Homo sapiens
uauacuguaaucgugcuau

SEQ ID NO: 2043355 - RNA, 21 nt, Homo sapiens
uaaaauagaaauaagugguua

SEQ ID NO: 2043356 - RNA, 21 nt, Homo sapiens
ccaagcuggucuuaaacuccu

SEQ ID NO: 2043357 - RNA, 16 nt, Homo sapiens
uaaucuagauuuuccu

SEQ ID NO: 2043358 - RNA, 12 nt, Homo sapiens
cugccccugugc

SEQ ID NO: 2043359 - RNA, 22 nt, Homo sapiens
gugcccauauggucauccaaau

SEQ ID NO: 2043360 - RNA, 20 nt, Homo sapiens
caaccaaauggagugacuua

SEQ ID NO: 2043361 - RNA, 16 nt, Homo sapiens
acauuuuaaaugaaag

SEQ ID NO: 2043362 - RNA, 12 nt, Homo sapiens
cggcuuuaccaa

SEQ ID NO: 2043363 - RNA, 23 nt, Homo sapiens
caaauggaaagauccccuaauaa

SEQ ID NO: 2043364 - RNA, 18 nt, Homo sapiens
gggccucgacgucccuug

SEQ ID NO: 2043365 - RNA, 14 nt, Homo sapiens
auauuaaguccaaa

SEQ ID NO: 2043366 - RNA, 16 nt, Homo sapiens
uuacgcggagcacuuu

SEQ ID NO: 2043367 - RNA, 14 nt, Homo sapiens
aacauaaugcacuu

SEQ ID NO: 2043368 - RNA, 21 nt, Homo sapiens
cucucuggcgcaucaccugau

SEQ ID NO: 2043369 - RNA, 14 nt, Homo sapiens
ggcuacugcacucu

SEQ ID NO: 2043370 - RNA, 21 nt, Homo sapiens
uaucaaugcccaacagggcaa

SEQ ID NO: 2043371 - RNA, 19 nt, Homo sapiens
ccauacucccuuucagggc

SEQ ID NO: 2043372 - RNA, 19 nt, Homo sapiens
acaaaccuuuaauauauca

SEQ ID NO: 2043373 - RNA, 17 nt, Homo sapiens
cacuugggauugucuua

SEQ ID NO: 2043374 - RNA, 17 nt, Homo sapiens
uuuuacagugcuauuua

SEQ ID NO: 2043375 - RNA, 12 nt, Homo sapiens
cugccugagauu

SEQ ID NO: 2043376 - RNA, 21 nt, Homo sapiens
gccacugagcccagccuacuu

SEQ ID NO: 2043377 - RNA, 15 nt, Homo sapiens
auucagaaugugcaa

SEQ ID NO: 2043378 - RNA, 12 nt, Homo sapiens
ccaccaaauaca

SEQ ID NO: 2043379 - RNA, 17 nt, Homo sapiens
aagagauaaacgaccaa

SEQ ID NO: 2043380 - RNA, 10 nt, Homo sapiens
acaugacugg

SEQ ID NO: 2043381 - RNA, 20 nt, Homo sapiens
ugcacacaccucaugcuagc

SEQ ID NO: 2043382 - RNA, 19 nt, Homo sapiens
gcaagaaaagcgcagagaa

SEQ ID NO: 2043383 - RNA, 17 nt, Homo sapiens
cugauguaguaugcuua

SEQ ID NO: 2043384 - RNA, 15 nt, Homo sapiens
aagacaucagucucc

SEQ ID NO: 2043385 - RNA, 18 nt, Homo sapiens
auauauuugauacauaua

SEQ ID NO: 2043386 - RNA, 17 nt, Homo sapiens
auucagaucguauuaau

SEQ ID NO: 2043387 - RNA, 14 nt, Homo sapiens
ugcuggaaauggac

SEQ ID NO: 2043388 - RNA, 17 nt, Homo sapiens
aacuggaguaucauucu

SEQ ID NO: 2043389 - RNA, 15 nt, Homo sapiens
gaaacauucuuuccu

SEQ ID NO: 2043390 - RNA, 19 nt, Homo sapiens
gcauagauugaucaaagug

SEQ ID NO: 2043391 - RNA, 16 nt, Homo sapiens
agaauggugggcucca

SEQ ID NO: 2043392 - RNA, 16 nt, Homo sapiens
guacaggaaugaaccu

SEQ ID NO: 2043393 - RNA, 20 nt, Homo sapiens
cgugcucauugcuaaccacu

SEQ ID NO: 2043394 - RNA, 16 nt, Homo sapiens
uagcuugaaacauaga

SEQ ID NO: 2043395 - RNA, 14 nt, Homo sapiens
gucucugcugcuaa

SEQ ID NO: 2043396 - RNA, 16 nt, Homo sapiens
accacaaaagcaaaau

SEQ ID NO: 2043397 - RNA, 20 nt, Homo sapiens
cugugauagagcagaacuga

SEQ ID NO: 2043398 - RNA, 19 nt, Homo sapiens
acagagguucccugccuug

SEQ ID NO: 2043399 - RNA, 13 nt, Homo sapiens
ugaggcugugagc

SEQ ID NO: 2043400 - RNA, 13 nt, Homo sapiens
gugagcuggugac

SEQ ID NO: 2043401 - RNA, 16 nt, Homo sapiens
agaagucacugaacaa

SEQ ID NO: 2043402 - RNA, 20 nt, Homo sapiens
ucagcuacuucugaaacugc

SEQ ID NO: 2043403 - RNA, 16 nt, Homo sapiens
cuuccauuugggauau

SEQ ID NO: 2043404 - RNA, 19 nt, Homo sapiens
ccugcgagaggucccugcu

SEQ ID NO: 2043405 - RNA, 20 nt, Homo sapiens
agacaauucauucauuugca

SEQ ID NO: 2043406 - RNA, 18 nt, Homo sapiens
aagacaaccccagccaau

SEQ ID NO: 2043407 - RNA, 19 nt, Homo sapiens
agguaauuuuuacccuaau

SEQ ID NO: 2043408 - RNA, 18 nt, Homo sapiens
uggaauuacaggcacaua

SEQ ID NO: 2043409 - RNA, 20 nt, Homo sapiens
cacugcguacaaacauccaa

SEQ ID NO: 2043410 - RNA, 21 nt, Homo sapiens
uccuuauuuugugugcuuucc

SEQ ID NO: 2043411 - RNA, 16 nt, Homo sapiens
acauuucauaguuuca

SEQ ID NO: 2043412 - RNA, 18 nt, Homo sapiens
cuccaagguaacccggcu

SEQ ID NO: 2043413 - RNA, 22 nt, Homo sapiens
uuucacucucaaacuucacuaa

SEQ ID NO: 2043414 - RNA, 16 nt, Homo sapiens
uugcuggcaaagacag

SEQ ID NO: 2043415 - RNA, 24 nt, Homo sapiens
aaauugucuuuugucauguggcua

SEQ ID NO: 2043416 - RNA, 14 nt, Homo sapiens
cauucaacugaaaa

SEQ ID NO: 2043417 - RNA, 17 nt, Homo sapiens
aacuaaaaggaagucau

SEQ ID NO: 2043418 - RNA, 18 nt, Homo sapiens
auggaauucaaagcucua

SEQ ID NO: 2043419 - RNA, 19 nt, Homo sapiens
auaaagugacccuguucuc

SEQ ID NO: 2043420 - RNA, 13 nt, Homo sapiens
agugcccagugau

SEQ ID NO: 2043421 - RNA, 17 nt, Homo sapiens
gucucagcuaagcucac

SEQ ID NO: 2043422 - RNA, 22 nt, Homo sapiens
ggggacagcuuccucacacccc

SEQ ID NO: 2043423 - RNA, 17 nt, Homo sapiens
ucucaaugaaccauaaa

SEQ ID NO: 2043424 - RNA, 16 nt, Homo sapiens
ccagugccugugagca

SEQ ID NO: 2043425 - RNA, 21 nt, Homo sapiens
auaaauguaccccucucaguc

SEQ ID NO: 2043426 - RNA, 21 nt, Homo sapiens
ugacuguagaacuuauucucu

SEQ ID NO: 2043427 - RNA, 16 nt, Homo sapiens
caccaucucugugauc

SEQ ID NO: 2043428 - RNA, 19 nt, Homo sapiens
aaugacuucuccaggcaga

SEQ ID NO: 2043429 - RNA, 18 nt, Homo sapiens
cuugucccucuguauacu

SEQ ID NO: 2043430 - RNA, 15 nt, Homo sapiens
gcucagugccacaaa

SEQ ID NO: 2043431 - RNA, 18 nt, Homo sapiens
acuucacuaaugaucaca

SEQ ID NO: 2043432 - RNA, 15 nt, Homo sapiens
aaaacuuggaccacu

SEQ ID NO: 2043433 - RNA, 22 nt, Homo sapiens
uaaaaaugucuugcuguugaca

SEQ ID NO: 2043434 - RNA, 20 nt, Homo sapiens
cucuguauaaguugaaggaa

SEQ ID NO: 2043435 - RNA, 19 nt, Homo sapiens
uccagaagcuguacuuuua

SEQ ID NO: 2043436 - RNA, 18 nt, Homo sapiens
gccaugccuggagacaua

SEQ ID NO: 2043437 - RNA, 14 nt, Homo sapiens
cuggcccaggugag

SEQ ID NO: 2043438 - RNA, 18 nt, Homo sapiens
uguauuuuucaaggcauu

SEQ ID NO: 2043439 - RNA, 18 nt, Homo sapiens
cucaacuggucagaaaca

SEQ ID NO: 2043440 - RNA, 20 nt, Homo sapiens
ggcagagguugcaguguggu

SEQ ID NO: 2043441 - RNA, 13 nt, Homo sapiens
uucaaaaacaccc

SEQ ID NO: 2043442 - RNA, 20 nt, Homo sapiens
gcgaauuauagagacaaucu

SEQ ID NO: 2043443 - RNA, 20 nt, Homo sapiens
ccagcccagacccccagugu

SEQ ID NO: 2043444 - RNA, 13 nt, Homo sapiens
cggacucacuucu

SEQ ID NO: 2043445 - RNA, 21 nt, Homo sapiens
auuuuuauacaaaccuaccaa

SEQ ID NO: 2043446 - RNA, 13 nt, Homo sapiens
gaaaggcucaguc

SEQ ID NO: 2043447 - RNA, 15 nt, Homo sapiens
guuauuucugugcaa

SEQ ID NO: 2043448 - RNA, 12 nt, Homo sapiens
uguggcauuuaa

SEQ ID NO: 2043449 - RNA, 20 nt, Homo sapiens
aagagacuggagcaucugac

SEQ ID NO: 2043450 - RNA, 18 nt, Homo sapiens
uucuugccuuguaccuca

SEQ ID NO: 2043451 - RNA, 21 nt, Homo sapiens
aagucagaggauggccagugu

SEQ ID NO: 2043452 - RNA, 15 nt, Homo sapiens
auuuuauaugaaaga

SEQ ID NO: 2043453 - RNA, 16 nt, Homo sapiens
uucaagagauucuugu

SEQ ID NO: 2043454 - RNA, 14 nt, Homo sapiens
uuuugauagauauc

SEQ ID NO: 2043455 - RNA, 20 nt, Homo sapiens
cuugugaugucauacagaga

SEQ ID NO: 2043456 - RNA, 15 nt, Homo sapiens
auuacaggcaccugc

SEQ ID NO: 2043457 - RNA, 14 nt, Homo sapiens
accuugcuguccug

SEQ ID NO: 2043458 - RNA, 13 nt, Homo sapiens
cugucuguuacca

SEQ ID NO: 2043459 - RNA, 20 nt, Homo sapiens
gggaggcggagguugcaaug

SEQ ID NO: 2043460 - RNA, 16 nt, Homo sapiens
cacuguugauguaucu

SEQ ID NO: 2043461 - RNA, 18 nt, Homo sapiens
cuuugcuaacugugcucc

SEQ ID NO: 2043462 - RNA, 15 nt, Homo sapiens
aaugaaucuucacaa

SEQ ID NO: 2043463 - RNA, 14 nt, Homo sapiens
gugaaaaaagucac

SEQ ID NO: 2043464 - RNA, 15 nt, Homo sapiens
cacccauaugguccc

SEQ ID NO: 2043465 - RNA, 15 nt, Homo sapiens
auacacauaagcaua

SEQ ID NO: 2043466 - RNA, 15 nt, Homo sapiens
cucagcuucuucaca

SEQ ID NO: 2043467 - RNA, 13 nt, Homo sapiens
ucuggggcucagc

SEQ ID NO: 2043468 - RNA, 17 nt, Homo sapiens
uuuaauguuuccuuuaa

SEQ ID NO: 2043469 - RNA, 12 nt, Homo sapiens
uuguauuugcca

SEQ ID NO: 2043470 - RNA, 20 nt, Homo sapiens
gaccuacuguucggacaaaa

SEQ ID NO: 2043471 - RNA, 16 nt, Homo sapiens
auaucccuuacuccag

SEQ ID NO: 2043472 - RNA, 23 nt, Homo sapiens
cuuccaagacugaagacugcaca

SEQ ID NO: 2043473 - RNA, 19 nt, Homo sapiens
uucugccuuugccagguga

SEQ ID NO: 2043474 - RNA, 17 nt, Homo sapiens
caaccucccaacccaga

SEQ ID NO: 2043475 - RNA, 11 nt, Homo sapiens
cucugcaaugc

SEQ ID NO: 2043476 - RNA, 22 nt, Homo sapiens
agauugccucucuagacaacua

SEQ ID NO: 2043477 - RNA, 17 nt, Homo sapiens
gacacagaagccuuuga

SEQ ID NO: 2043478 - RNA, 22 nt, Homo sapiens
aaaagcauuugacacacaguug

SEQ ID NO: 2043479 - RNA, 16 nt, Homo sapiens
uuaacgucaucucagg

SEQ ID NO: 2043480 - RNA, 15 nt, Homo sapiens
uguuguauacuuccu

SEQ ID NO: 2043481 - RNA, 19 nt, Homo sapiens
guuugucucaccuacccau

SEQ ID NO: 2043482 - RNA, 20 nt, Homo sapiens
gaccugggagcccucaggca

SEQ ID NO: 2043483 - RNA, 17 nt, Homo sapiens
caagacugaagacugca

SEQ ID NO: 2043484 - RNA, 22 nt, Homo sapiens
uguuucuugccugaacuccugc

SEQ ID NO: 2043485 - RNA, 16 nt, Homo sapiens
cuacagcauauucuuc

SEQ ID NO: 2043486 - RNA, 15 nt, Homo sapiens
aagacaagaacauuc

SEQ ID NO: 2043487 - RNA, 11 nt, Homo sapiens
auguuugcacu

SEQ ID NO: 2043488 - RNA, 13 nt, Homo sapiens
auuuaaaagggaa

SEQ ID NO: 2043489 - RNA, 13 nt, Homo sapiens
agccgaccucagc

SEQ ID NO: 2043490 - RNA, 14 nt, Homo sapiens
uaauagacagcaau

SEQ ID NO: 2043491 - RNA, 21 nt, Homo sapiens
aauuaguuccucauuagcauu

SEQ ID NO: 2043492 - RNA, 14 nt, Homo sapiens
ugcuuuuugucaug

SEQ ID NO: 2043493 - RNA, 17 nt, Homo sapiens
ucaauaaauuugcaaau

SEQ ID NO: 2043494 - RNA, 16 nt, Homo sapiens
agccuggaagcacuac

SEQ ID NO: 2043495 - RNA, 14 nt, Homo sapiens
auuucacaucagcu

SEQ ID NO: 2043496 - RNA, 16 nt, Homo sapiens
guccgaggggcgggac

SEQ ID NO: 2043497 - RNA, 20 nt, Homo sapiens
guaaagccguuguuuacuua

SEQ ID NO: 2043498 - RNA, 19 nt, Homo sapiens
gacaccggaguaugugcag

SEQ ID NO: 2043499 - RNA, 17 nt, Homo sapiens
uggauccagccauuccu

SEQ ID NO: 2043500 - RNA, 21 nt, Homo sapiens
cauuucacagugcccaagagu

SEQ ID NO: 2043501 - RNA, 15 nt, Homo sapiens
ccuaccguagcuuuu

SEQ ID NO: 2043502 - RNA, 21 nt, Homo sapiens
ucuuuaaccucaucuacaagc

SEQ ID NO: 2043503 - RNA, 21 nt, Homo sapiens
ugacugaauuugggccucuug

SEQ ID NO: 2043504 - RNA, 20 nt, Homo sapiens
acacugggagaggugccagc

SEQ ID NO: 2043505 - RNA, 18 nt, Homo sapiens
uagcuuaugaguagcuua

SEQ ID NO: 2043506 - RNA, 23 nt, Homo sapiens
agccuaugaggggguuuggcacc

SEQ ID NO: 2043507 - RNA, 23 nt, Homo sapiens
acagccaacagcuacaacagccu

SEQ ID NO: 2043508 - RNA, 16 nt, Homo sapiens
caauggcuuacuccag

SEQ ID NO: 2043509 - RNA, 22 nt, Homo sapiens
uuauuuuucauauugugccaau

SEQ ID NO: 2043510 - RNA, 18 nt, Homo sapiens
agucauaccuacauucaa

SEQ ID NO: 2043511 - RNA, 20 nt, Homo sapiens
ccaguccagauauuucacau

SEQ ID NO: 2043512 - RNA, 17 nt, Homo sapiens
aaaaaaaucaguguuua

SEQ ID NO: 2043513 - RNA, 21 nt, Homo sapiens
agggccaacgcuugacacaaa

SEQ ID NO: 2043514 - RNA, 20 nt, Homo sapiens
ucuuugcuaguaccaaaagu

SEQ ID NO: 2043515 - RNA, 23 nt, Homo sapiens
accuugggugaacuaaccaaaua

SEQ ID NO: 2043516 - RNA, 22 nt, Homo sapiens
gcucucucucaccaugugacac

SEQ ID NO: 2043517 - RNA, 18 nt, Homo sapiens
cuuccaucagcagugauu

SEQ ID NO: 2043518 - RNA, 15 nt, Homo sapiens
gguggcaugcaccug

SEQ ID NO: 2043519 - RNA, 17 nt, Homo sapiens
uaggaauggaagcuuca

SEQ ID NO: 2043520 - RNA, 23 nt, Homo sapiens
agcucuugugaauauuguggcuc

SEQ ID NO: 2043521 - RNA, 18 nt, Homo sapiens
caucagcaccacgugcca

SEQ ID NO: 2043522 - RNA, 11 nt, Homo sapiens
gacugccacag

SEQ ID NO: 2043523 - RNA, 11 nt, Homo sapiens
cucugccagug

SEQ ID NO: 2043524 - RNA, 17 nt, Homo sapiens
ggcaggggcaguggccu

SEQ ID NO: 2043525 - RNA, 19 nt, Homo sapiens
aacacuggggacuuggccu

SEQ ID NO: 2043526 - RNA, 14 nt, Homo sapiens
uaacagagugagac

SEQ ID NO: 2043527 - RNA, 23 nt, Homo sapiens
gccugacauggacccacuacccu

SEQ ID NO: 2043528 - RNA, 23 nt, Homo sapiens
gacucaguagccauaucuuccaa

SEQ ID NO: 2043529 - RNA, 13 nt, Homo sapiens
aucacuccagugc

SEQ ID NO: 2043530 - RNA, 20 nt, Homo sapiens
caaaggaaguccaaccugag

SEQ ID NO: 2043531 - RNA, 13 nt, Homo sapiens
ucccugagcucuu

SEQ ID NO: 2043532 - RNA, 21 nt, Homo sapiens
uguuuacuucucaccauuuga

SEQ ID NO: 2043533 - RNA, 18 nt, Homo sapiens
cugcucugcaagcccacu

SEQ ID NO: 2043534 - RNA, 16 nt, Homo sapiens
acacaugugcagucac

SEQ ID NO: 2043535 - RNA, 22 nt, Homo sapiens
caaagcccugguaaaagggaua

SEQ ID NO: 2043536 - RNA, 19 nt, Homo sapiens
ugauugaggagcugcacug

SEQ ID NO: 2043537 - RNA, 19 nt, Homo sapiens
aaucaggaauauuuuccaa

SEQ ID NO: 2043538 - RNA, 20 nt, Homo sapiens
aucuuagagacaaaccuuaa

SEQ ID NO: 2043539 - RNA, 19 nt, Homo sapiens
agaagauugagauguguuc

SEQ ID NO: 2043540 - RNA, 14 nt, Homo sapiens
uacagacagaauau

SEQ ID NO: 2043541 - RNA, 14 nt, Homo sapiens
gcccgcacagcagc

SEQ ID NO: 2043542 - RNA, 15 nt, Homo sapiens
gcugggaucugaaua

SEQ ID NO: 2043543 - RNA, 17 nt, Homo sapiens
uaucacugaacaaacua

SEQ ID NO: 2043544 - RNA, 17 nt, Homo sapiens
auucacccuucuuccca

SEQ ID NO: 2043545 - RNA, 23 nt, Homo sapiens
gagacagcuuacugcagcacugu

SEQ ID NO: 2043546 - RNA, 18 nt, Homo sapiens
gacccagggaaugccagg

SEQ ID NO: 2043547 - RNA, 14 nt, Homo sapiens
aaaauauauauuaa

SEQ ID NO: 2043548 - RNA, 17 nt, Homo sapiens
ccugucccaaccccagu

SEQ ID NO: 2043549 - RNA, 21 nt, Homo sapiens
aaacugcugcaaaaguucuca

SEQ ID NO: 2043550 - RNA, 23 nt, Homo sapiens
cugggauuacaggcgugagccac

SEQ ID NO: 2043551 - RNA, 22 nt, Homo sapiens
ugaagcugcggcccugaucucc

SEQ ID NO: 2043552 - RNA, 22 nt, Homo sapiens
agcacaauggucuuacauugga

SEQ ID NO: 2043553 - RNA, 19 nt, Homo sapiens
aaaugucuauguuuucuac

SEQ ID NO: 2043554 - RNA, 15 nt, Homo sapiens
ucacaugaccugauc

SEQ ID NO: 2043555 - RNA, 17 nt, Homo sapiens
cagaaagggccuugaau

SEQ ID NO: 2043556 - RNA, 22 nt, Homo sapiens
uucuauauaguuccuugccuua

SEQ ID NO: 2043557 - RNA, 15 nt, Homo sapiens
guuuuuagugcugac

SEQ ID NO: 2043558 - RNA, 20 nt, Homo sapiens
ccacccggcacuggcgagca

SEQ ID NO: 2043559 - RNA, 18 nt, Homo sapiens
augagugcuaagagccuc

SEQ ID NO: 2043560 - RNA, 16 nt, Homo sapiens
ucaugcuuuguaccaa

SEQ ID NO: 2043561 - RNA, 21 nt, Homo sapiens
cauuuaaauuccacagauuau

SEQ ID NO: 2043562 - RNA, 21 nt, Homo sapiens
uuucaugauuagacaaugugg

SEQ ID NO: 2043563 - RNA, 23 nt, Homo sapiens
ugcccagaauaaguuauugcagu

SEQ ID NO: 2043564 - RNA, 16 nt, Homo sapiens
aucuuagcugccaagu

SEQ ID NO: 2043565 - RNA, 16 nt, Homo sapiens
uggcucucauguacuu

SEQ ID NO: 2043566 - RNA, 16 nt, Homo sapiens
cuagugacaagcuccu

SEQ ID NO: 2043567 - RNA, 20 nt, Homo sapiens
gcauuuggagauauaccuaa

SEQ ID NO: 2043568 - RNA, 17 nt, Homo sapiens
ucacacucauaacucau

SEQ ID NO: 2043569 - RNA, 15 nt, Homo sapiens
ccauuggcuacugac

SEQ ID NO: 2043570 - RNA, 14 nt, Homo sapiens
gaccuuugucugaa

SEQ ID NO: 2043571 - RNA, 24 nt, Homo sapiens
gcugaaaugcaggaagugguggca

SEQ ID NO: 2043572 - RNA, 13 nt, Homo sapiens
uuugucacuucug

SEQ ID NO: 2043573 - RNA, 14 nt, Homo sapiens
agaaacaagcugug

SEQ ID NO: 2043574 - RNA, 14 nt, Homo sapiens
gugugagugcucug

SEQ ID NO: 2043575 - RNA, 19 nt, Homo sapiens
uaauuugcauugugucaga

SEQ ID NO: 2043576 - RNA, 19 nt, Homo sapiens
cacuguuuagauuugccau

SEQ ID NO: 2043577 - RNA, 15 nt, Homo sapiens
uuaaagaaaauugcc

SEQ ID NO: 2043578 - RNA, 11 nt, Homo sapiens
cagcaguauug

SEQ ID NO: 2043579 - RNA, 16 nt, Homo sapiens
augguacaaaccaaau

SEQ ID NO: 2043580 - RNA, 16 nt, Homo sapiens
ugagcuggcuugucca

SEQ ID NO: 2043581 - RNA, 17 nt, Homo sapiens
gggauguuucugucaca

SEQ ID NO: 2043582 - RNA, 13 nt, Homo sapiens
ucucuccagugca

SEQ ID NO: 2043583 - RNA, 13 nt, Homo sapiens
gcccuggcaccug

SEQ ID NO: 2043584 - RNA, 17 nt, Homo sapiens
agacaauaaacccucag

SEQ ID NO: 2043585 - RNA, 19 nt, Homo sapiens
agcagggggggaaaugcau

SEQ ID NO: 2043586 - RNA, 15 nt, Homo sapiens
gcaggcagccuugac

SEQ ID NO: 2043587 - RNA, 17 nt, Homo sapiens
ccaccaccucaccaguu

SEQ ID NO: 2043588 - RNA, 17 nt, Homo sapiens
caauuucuaaauuugca

SEQ ID NO: 2043589 - RNA, 20 nt, Homo sapiens
aauuagcaugaaagcaguuu

SEQ ID NO: 2043590 - RNA, 14 nt, Homo sapiens
caugcaagacuuca

SEQ ID NO: 2043591 - RNA, 18 nt, Homo sapiens
ucccagagcaucuugcau

SEQ ID NO: 2043592 - RNA, 14 nt, Homo sapiens
uaaacucacuagaa

SEQ ID NO: 2043593 - RNA, 15 nt, Homo sapiens
uuaaaacuauaacau

SEQ ID NO: 2043594 - RNA, 19 nt, Homo sapiens
cauagcgccgugcuguaaa

SEQ ID NO: 2043595 - RNA, 15 nt, Homo sapiens
aagcgucauggauau

SEQ ID NO: 2043596 - RNA, 20 nt, Homo sapiens
aacugcucugcccacuguga

SEQ ID NO: 2043597 - RNA, 23 nt, Homo sapiens
uagcugagaagcaaugggucacu

SEQ ID NO: 2043598 - RNA, 14 nt, Homo sapiens
gcaggccuccgucu

SEQ ID NO: 2043599 - RNA, 14 nt, Homo sapiens
gugugccucuagcu

SEQ ID NO: 2043600 - RNA, 20 nt, Homo sapiens
acaggugugaaccacugugc

SEQ ID NO: 2043601 - RNA, 16 nt, Homo sapiens
cuaaauguaacagucu

SEQ ID NO: 2043602 - RNA, 20 nt, Homo sapiens
aauccaaacuauuuccuaaa

SEQ ID NO: 2043603 - RNA, 20 nt, Homo sapiens
auggugcuaauguacuuuca

SEQ ID NO: 2043604 - RNA, 23 nt, Homo sapiens
acaccucacucugcuaccuugcc

SEQ ID NO: 2043605 - RNA, 18 nt, Homo sapiens
auauuuaauggcaaugca

SEQ ID NO: 2043606 - RNA, 23 nt, Homo sapiens
acugaguguucaaacuacuguac

SEQ ID NO: 2043607 - RNA, 14 nt, Homo sapiens
acuucgaaguucua

SEQ ID NO: 2043608 - RNA, 15 nt, Homo sapiens
agauaggaguucucu

SEQ ID NO: 2043609 - RNA, 11 nt, Homo sapiens
gcagaggacau

SEQ ID NO: 2043610 - RNA, 13 nt, Homo sapiens
auauacugcauau

SEQ ID NO: 2043611 - RNA, 14 nt, Homo sapiens
aacaauucucucuu

SEQ ID NO: 2043612 - RNA, 13 nt, Homo sapiens
cggugagaacucu

SEQ ID NO: 2043613 - RNA, 23 nt, Homo sapiens
cuauuuccacugaacaaaaccua

SEQ ID NO: 2043614 - RNA, 19 nt, Homo sapiens
cguccugaggaguguccug

SEQ ID NO: 2043615 - RNA, 12 nt, Homo sapiens
uauaauguauuu

SEQ ID NO: 2043616 - RNA, 14 nt, Homo sapiens
gcuucuaccagaga

SEQ ID NO: 2043617 - RNA, 21 nt, Homo sapiens
guagcaacaacagaagggaaa

SEQ ID NO: 2043618 - RNA, 22 nt, Homo sapiens
aacaguaccaguguaaauucag

SEQ ID NO: 2043619 - RNA, 20 nt, Homo sapiens
uaaaauacuuuuacucugcc

SEQ ID NO: 2043620 - RNA, 16 nt, Homo sapiens
uccuaucccaucccau

SEQ ID NO: 2043621 - RNA, 19 nt, Homo sapiens
ucccuuugacgccauccca

SEQ ID NO: 2043622 - RNA, 12 nt, Homo sapiens
guccauugaaag

SEQ ID NO: 2043623 - RNA, 16 nt, Homo sapiens
caagagccuuaaaaca

SEQ ID NO: 2043624 - RNA, 17 nt, Homo sapiens
agccacgaggugcagua

SEQ ID NO: 2043625 - RNA, 14 nt, Homo sapiens
uaauuaauauucau

SEQ ID NO: 2043626 - RNA, 23 nt, Homo sapiens
uggaagaagccauugagcucucc

SEQ ID NO: 2043627 - RNA, 22 nt, Homo sapiens
aacguagcuucuaccaugaaca

SEQ ID NO: 2043628 - RNA, 23 nt, Homo sapiens
uuuagcccgaggcuggucuuaga

SEQ ID NO: 2043629 - RNA, 15 nt, Homo sapiens
cagagaccccaggaa

SEQ ID NO: 2043630 - RNA, 19 nt, Homo sapiens
uagaaucugugaccucuga

SEQ ID NO: 2043631 - RNA, 20 nt, Homo sapiens
cugggucuugccaugugcug

SEQ ID NO: 2043632 - RNA, 15 nt, Homo sapiens
uauuuucuauuuucc

SEQ ID NO: 2043633 - RNA, 15 nt, Homo sapiens
aucuguuuuacugcu

SEQ ID NO: 2043634 - RNA, 14 nt, Homo sapiens
uuaaauacuacaaa

SEQ ID NO: 2043635 - RNA, 21 nt, Homo sapiens
cuucccaccuacugcacuuuc

SEQ ID NO: 2043636 - RNA, 16 nt, Homo sapiens
acuuguuaaguuuuaa

SEQ ID NO: 2043637 - RNA, 17 nt, Homo sapiens
aguuuaacauuagcuaa

SEQ ID NO: 2043638 - RNA, 16 nt, Homo sapiens
ccaggguggacucugu

SEQ ID NO: 2043639 - RNA, 15 nt, Homo sapiens
uguuugcgcuugacc

SEQ ID NO: 2043640 - RNA, 12 nt, Homo sapiens
cccccauguccu

SEQ ID NO: 2043641 - RNA, 13 nt, Homo sapiens
gagccagccaccc

SEQ ID NO: 2043642 - RNA, 21 nt, Homo sapiens
uuuguuuucccuggcuaacag

SEQ ID NO: 2043643 - RNA, 20 nt, Homo sapiens
ucaugcguuuuauaucuucc

SEQ ID NO: 2043644 - RNA, 20 nt, Homo sapiens
gucgaguuuucaaugugaau

SEQ ID NO: 2043645 - RNA, 14 nt, Homo sapiens
ugucucugccaugu

SEQ ID NO: 2043646 - RNA, 14 nt, Homo sapiens
ccuuucugugguga

SEQ ID NO: 2043647 - RNA, 17 nt, Homo sapiens
gucuacacugccuuugu

SEQ ID NO: 2043648 - RNA, 12 nt, Homo sapiens
ggcaauucagug

SEQ ID NO: 2043649 - RNA, 22 nt, Homo sapiens
aguacuauugcuaguacuagua

SEQ ID NO: 2043650 - RNA, 18 nt, Homo sapiens
cuguuccucaacaagcaa

SEQ ID NO: 2043651 - RNA, 22 nt, Homo sapiens
gcccaucacaggguugggccca

SEQ ID NO: 2043652 - RNA, 15 nt, Homo sapiens
caguggcaucaucuc

SEQ ID NO: 2043653 - RNA, 15 nt, Homo sapiens
augucaauauuuagu

SEQ ID NO: 2043654 - RNA, 15 nt, Homo sapiens
uaagacaaaaaagau

SEQ ID NO: 2043655 - RNA, 15 nt, Homo sapiens
uugaaacccaugauc

SEQ ID NO: 2043656 - RNA, 19 nt, Homo sapiens
ccaucuuacagagacucuc

SEQ ID NO: 2043657 - RNA, 21 nt, Homo sapiens
uauugaaucuaaaaccaaaua

SEQ ID NO: 2043658 - RNA, 17 nt, Homo sapiens
aauugacaagucacaga

SEQ ID NO: 2043659 - RNA, 22 nt, Homo sapiens
aacuuacauacuaggugccuuu

SEQ ID NO: 2043660 - RNA, 22 nt, Homo sapiens
ggaaccguaggacccaagcaga

SEQ ID NO: 2043661 - RNA, 15 nt, Homo sapiens
gcaaccuaguacuuu

SEQ ID NO: 2043662 - RNA, 18 nt, Homo sapiens
cuguaagauaauguugcu

SEQ ID NO: 2043663 - RNA, 23 nt, Homo sapiens
uuggagacagagagacuggccag

SEQ ID NO: 2043664 - RNA, 14 nt, Homo sapiens
gaguccacuuuguu

SEQ ID NO: 2043665 - RNA, 15 nt, Homo sapiens
gucauagcauucacu

SEQ ID NO: 2043666 - RNA, 14 nt, Homo sapiens
uaacuuguuuccaa

SEQ ID NO: 2043667 - RNA, 16 nt, Homo sapiens
aggcagcgcagggcug

SEQ ID NO: 2043668 - RNA, 18 nt, Homo sapiens
acucaaggguuuuccagg

SEQ ID NO: 2043669 - RNA, 13 nt, Homo sapiens
agcgcacagggag

SEQ ID NO: 2043670 - RNA, 12 nt, Homo sapiens
aggaaaccacaa

SEQ ID NO: 2043671 - RNA, 20 nt, Homo sapiens
acaaauacuuagacaguaug

SEQ ID NO: 2043672 - RNA, 22 nt, Homo sapiens
gccaacccggcacugcccucag

SEQ ID NO: 2043673 - RNA, 17 nt, Homo sapiens
aauaagaaacaugaugu

SEQ ID NO: 2043674 - RNA, 22 nt, Homo sapiens
gagugugggcauagcauuagcu

SEQ ID NO: 2043675 - RNA, 20 nt, Homo sapiens
uuuaauggaaucagauauug

SEQ ID NO: 2043676 - RNA, 13 nt, Homo sapiens
cuaaacaguauua

SEQ ID NO: 2043677 - RNA, 21 nt, Homo sapiens
aguauuguuuggaggagcaaa

SEQ ID NO: 2043678 - RNA, 18 nt, Homo sapiens
uggaaagcaucaccucag

SEQ ID NO: 2043679 - RNA, 13 nt, Homo sapiens
ggaugggaccuga

SEQ ID NO: 2043680 - RNA, 21 nt, Homo sapiens
uuccugcaaugaagucucuga

SEQ ID NO: 2043681 - RNA, 20 nt, Homo sapiens
aaaacacccuuuccaaagca

SEQ ID NO: 2043682 - RNA, 20 nt, Homo sapiens
ccaggauuauugucaaagaa

SEQ ID NO: 2043683 - RNA, 18 nt, Homo sapiens
gugguggcccagcuccuc

SEQ ID NO: 2043684 - RNA, 15 nt, Homo sapiens
aacagcuguugacuc

SEQ ID NO: 2043685 - RNA, 14 nt, Homo sapiens
gcaaaaauagcucu

SEQ ID NO: 2043686 - RNA, 19 nt, Homo sapiens
gugagugcuugucauggaa

SEQ ID NO: 2043687 - RNA, 19 nt, Homo sapiens
gaauaaugacguauuguga

SEQ ID NO: 2043688 - RNA, 21 nt, Homo sapiens
aguccaggcgccuggagcaag

SEQ ID NO: 2043689 - RNA, 14 nt, Homo sapiens
uccuaugaucucag

SEQ ID NO: 2043690 - RNA, 14 nt, Homo sapiens
uaucaggauacuau

SEQ ID NO: 2043691 - RNA, 22 nt, Homo sapiens
uggagacaagggcaucaucuau

SEQ ID NO: 2043692 - RNA, 19 nt, Homo sapiens
uaaaaaguuucuaaagugu

SEQ ID NO: 2043693 - RNA, 18 nt, Homo sapiens
augggaaggguccaucuc

SEQ ID NO: 2043694 - RNA, 15 nt, Homo sapiens
caguauuacaguguc

SEQ ID NO: 2043695 - RNA, 23 nt, Homo sapiens
cuuuugacagcugugcuguaaca

SEQ ID NO: 2043696 - RNA, 14 nt, Homo sapiens
cucuucaaggccaa

SEQ ID NO: 2043697 - RNA, 20 nt, Homo sapiens
gaagauccccaacugcucca

SEQ ID NO: 2043698 - RNA, 20 nt, Homo sapiens
cauucgcagugcccagugau

SEQ ID NO: 2043699 - RNA, 18 nt, Homo sapiens
augagaaugacccuguca

SEQ ID NO: 2043700 - RNA, 14 nt, Homo sapiens
uauguaugcgugca

SEQ ID NO: 2043701 - RNA, 14 nt, Homo sapiens
caaauuugugaacu

SEQ ID NO: 2043702 - RNA, 23 nt, Homo sapiens
cucaaucucagcuaacauuccau

SEQ ID NO: 2043703 - RNA, 14 nt, Homo sapiens
cucccagugugguu

SEQ ID NO: 2043704 - RNA, 18 nt, Homo sapiens
ggcaacuuagagauugca

SEQ ID NO: 2043705 - RNA, 10 nt, Homo sapiens
aaacaucagc

SEQ ID NO: 2043706 - RNA, 23 nt, Homo sapiens
aagaagguauuuuguaauauucu

SEQ ID NO: 2043707 - RNA, 17 nt, Homo sapiens
uagaagucuuagaugua

SEQ ID NO: 2043708 - RNA, 13 nt, Homo sapiens
agacaugguggca

SEQ ID NO: 2043709 - RNA, 23 nt, Homo sapiens
uggagacuuccuaugugugcauu

SEQ ID NO: 2043710 - RNA, 12 nt, Homo sapiens
caccuaccacuc

SEQ ID NO: 2043711 - RNA, 13 nt, Homo sapiens
aagaacugugaua

SEQ ID NO: 2043712 - RNA, 14 nt, Homo sapiens
cagaacucccacaa

SEQ ID NO: 2043713 - RNA, 23 nt, Homo sapiens
gacuuuuauaugcuuuuucucag

SEQ ID NO: 2043714 - RNA, 15 nt, Homo sapiens
ccccucggagaagag

SEQ ID NO: 2043715 - RNA, 18 nt, Homo sapiens
auugugcacaucuugucu

SEQ ID NO: 2043716 - RNA, 13 nt, Homo sapiens
ggacagaagcagc

SEQ ID NO: 2043717 - RNA, 17 nt, Homo sapiens
acucgucugacugugug

SEQ ID NO: 2043718 - RNA, 20 nt, Homo sapiens
agaggcagcaagguggccac

SEQ ID NO: 2043719 - RNA, 14 nt, Homo sapiens
ccaccuccaccgcu

SEQ ID NO: 2043720 - RNA, 15 nt, Homo sapiens
ugaggagcucaagaa

SEQ ID NO: 2043721 - RNA, 16 nt, Homo sapiens
aucuugccuggaaaga

SEQ ID NO: 2043722 - RNA, 23 nt, Homo sapiens
ucccuuacuauucccacuuucau

SEQ ID NO: 2043723 - RNA, 17 nt, Homo sapiens
uguaaagaauaaaugaa

SEQ ID NO: 2043724 - RNA, 13 nt, Homo sapiens
aaauggaacauua

SEQ ID NO: 2043725 - RNA, 21 nt, Homo sapiens
acuaaguucucauuguucaaa

SEQ ID NO: 2043726 - RNA, 16 nt, Homo sapiens
gggugggguggcugca

SEQ ID NO: 2043727 - RNA, 17 nt, Homo sapiens
acagcaugaaauguccu

SEQ ID NO: 2043728 - RNA, 24 nt, Homo sapiens
agcuguugcggacaucauucugca

SEQ ID NO: 2043729 - RNA, 19 nt, Homo sapiens
auuaaucuuaguguaugau

SEQ ID NO: 2043730 - RNA, 21 nt, Homo sapiens
augcugggauuacagggguga

SEQ ID NO: 2043731 - RNA, 16 nt, Homo sapiens
cuggucagcagagccg

SEQ ID NO: 2043732 - RNA, 17 nt, Homo sapiens
cucuuucucugccagug

SEQ ID NO: 2043733 - RNA, 14 nt, Homo sapiens
uauacaaacaugug

SEQ ID NO: 2043734 - RNA, 17 nt, Homo sapiens
agccacuauuaacauuu

SEQ ID NO: 2043735 - RNA, 19 nt, Homo sapiens
cauaagggacugugccaga

SEQ ID NO: 2043736 - RNA, 19 nt, Homo sapiens
accugaggcaggagggcau

SEQ ID NO: 2043737 - RNA, 16 nt, Homo sapiens
auagcuaaugugcuga

SEQ ID NO: 2043738 - RNA, 17 nt, Homo sapiens
uacuagcaaaagucuua

SEQ ID NO: 2043739 - RNA, 18 nt, Homo sapiens
augggagugggcaccuca

SEQ ID NO: 2043740 - RNA, 12 nt, Homo sapiens
gacccaugaccg

SEQ ID NO: 2043741 - RNA, 17 nt, Homo sapiens
ggucucccaauacaggc

SEQ ID NO: 2043742 - RNA, 14 nt, Homo sapiens
cugaacuugaauua

SEQ ID NO: 2043743 - RNA, 17 nt, Homo sapiens
cagucggccccaucucu

SEQ ID NO: 2043744 - RNA, 17 nt, Homo sapiens
uccagccacuuauuucc

SEQ ID NO: 2043745 - RNA, 23 nt, Homo sapiens
uuuacagaaucaaaugcaauuuu

SEQ ID NO: 2043746 - RNA, 20 nt, Homo sapiens
uucagucucuauaccaauaa

SEQ ID NO: 2043747 - RNA, 14 nt, Homo sapiens
gcaaaagcaaucau

SEQ ID NO: 2043748 - RNA, 17 nt, Homo sapiens
aggcugggccugaacua

SEQ ID NO: 2043749 - RNA, 16 nt, Homo sapiens
uuccccggaguaccua

SEQ ID NO: 2043750 - RNA, 21 nt, Homo sapiens
cacucuacugcaagacuuaaa

SEQ ID NO: 2043751 - RNA, 17 nt, Homo sapiens
aaagugccuuugcagcu

SEQ ID NO: 2043752 - RNA, 18 nt, Homo sapiens
cacuucggcucucuggac

SEQ ID NO: 2043753 - RNA, 18 nt, Homo sapiens
cugcggcccugaucuccg

SEQ ID NO: 2043754 - RNA, 21 nt, Homo sapiens
acagcuuuuggauuggacaaa

SEQ ID NO: 2043755 - RNA, 20 nt, Homo sapiens
augcagaacaccaauauuaa

SEQ ID NO: 2043756 - RNA, 19 nt, Homo sapiens
guagaugaaacauuaacuc

SEQ ID NO: 2043757 - RNA, 17 nt, Homo sapiens
uguguaccacugggaua

SEQ ID NO: 2043758 - RNA, 18 nt, Homo sapiens
acccucagaaacacuggg

SEQ ID NO: 2043759 - RNA, 19 nt, Homo sapiens
cgagcuagcuucugcaaug

SEQ ID NO: 2043760 - RNA, 15 nt, Homo sapiens
agggaaggggacaag

SEQ ID NO: 2043761 - RNA, 14 nt, Homo sapiens
gaaugggcugagaa

SEQ ID NO: 2043762 - RNA, 14 nt, Homo sapiens
augcaucacacuca

SEQ ID NO: 2043763 - RNA, 20 nt, Homo sapiens
gguaauauaaaguguaauag

SEQ ID NO: 2043764 - RNA, 18 nt, Homo sapiens
auucuguuccaccacugu

SEQ ID NO: 2043765 - RNA, 22 nt, Homo sapiens
aauacacuuauuucagccaaaa

SEQ ID NO: 2043766 - RNA, 14 nt, Homo sapiens
ggcgcaguggcuca

SEQ ID NO: 2043767 - RNA, 22 nt, Homo sapiens
acucccucugugucacuguaug

SEQ ID NO: 2043768 - RNA, 13 nt, Homo sapiens
uauccuguucucu

SEQ ID NO: 2043769 - RNA, 13 nt, Homo sapiens
cccagucagagau

SEQ ID NO: 2043770 - RNA, 17 nt, Homo sapiens
augaaacugcacauugg

SEQ ID NO: 2043771 - RNA, 15 nt, Homo sapiens
auacuuuugcugaug

SEQ ID NO: 2043772 - RNA, 19 nt, Homo sapiens
auuuguguauaucauacau

SEQ ID NO: 2043773 - RNA, 20 nt, Homo sapiens
uuugccaaguuuuaagagaa

SEQ ID NO: 2043774 - RNA, 23 nt, Homo sapiens
uccuucagugaacuaagucccua

SEQ ID NO: 2043775 - RNA, 14 nt, Homo sapiens
ucauuauguuaaua

SEQ ID NO: 2043776 - RNA, 17 nt, Homo sapiens
gcuuucauguuauuaaa

SEQ ID NO: 2043777 - RNA, 14 nt, Homo sapiens
uuccgaaucucuuu

SEQ ID NO: 2043778 - RNA, 22 nt, Homo sapiens
gaaggccucacucaagccugag

SEQ ID NO: 2043779 - RNA, 18 nt, Homo sapiens
ccuggagaaggcauucca

SEQ ID NO: 2043780 - RNA, 22 nt, Homo sapiens
gugaaauggccaaagcacaugc

SEQ ID NO: 2043781 - RNA, 22 nt, Homo sapiens
agucuuggaaaaaaaccacagc

SEQ ID NO: 2043782 - RNA, 15 nt, Homo sapiens
ccuccccaccuguag

SEQ ID NO: 2043783 - RNA, 14 nt, Homo sapiens
gggaagagggcagu

SEQ ID NO: 2043784 - RNA, 12 nt, Homo sapiens
uugagauccaaa

SEQ ID NO: 2043785 - RNA, 21 nt, Homo sapiens
ucaucaaauuauuaaucugaa

SEQ ID NO: 2043786 - RNA, 14 nt, Homo sapiens
ggacucuggacaau

SEQ ID NO: 2043787 - RNA, 22 nt, Homo sapiens
gauccaggaacacaugcacaca

SEQ ID NO: 2043788 - RNA, 12 nt, Homo sapiens
aaaaacuacuuc

SEQ ID NO: 2043789 - RNA, 12 nt, Homo sapiens
ucauucucagua

SEQ ID NO: 2043790 - RNA, 18 nt, Homo sapiens
gcuacaaauuuaugcauu

SEQ ID NO: 2043791 - RNA, 17 nt, Homo sapiens
gagaggaccuccaugcc

SEQ ID NO: 2043792 - RNA, 19 nt, Homo sapiens
auacaggaaaaaugaaaau

SEQ ID NO: 2043793 - RNA, 16 nt, Homo sapiens
aggcuaagagauguga

SEQ ID NO: 2043794 - RNA, 11 nt, Homo sapiens
cugcagguguu

SEQ ID NO: 2043795 - RNA, 23 nt, Homo sapiens
agugaccccugaccucacuguga

SEQ ID NO: 2043796 - RNA, 17 nt, Homo sapiens
ggcuauuuguguguaug

SEQ ID NO: 2043797 - RNA, 21 nt, Homo sapiens
gauggaggguccaauccuagg

SEQ ID NO: 2043798 - RNA, 17 nt, Homo sapiens
uccuuggcucccauuca

SEQ ID NO: 2043799 - RNA, 21 nt, Homo sapiens
ugccuguaaagucugaguaag

SEQ ID NO: 2043800 - RNA, 22 nt, Homo sapiens
ggucaaccccacaagcaccacu

SEQ ID NO: 2043801 - RNA, 11 nt, Homo sapiens
aauacugagcc

SEQ ID NO: 2043802 - RNA, 15 nt, Homo sapiens
cuauucuaaucagua

SEQ ID NO: 2043803 - RNA, 15 nt, Homo sapiens
aucacaccucagugg

SEQ ID NO: 2043804 - RNA, 14 nt, Homo sapiens
aauggcaccuguau

SEQ ID NO: 2043805 - RNA, 14 nt, Homo sapiens
cauggcacauguau

SEQ ID NO: 2043806 - RNA, 18 nt, Homo sapiens
uagauguuacugugugaa

SEQ ID NO: 2043807 - RNA, 16 nt, Homo sapiens
ugcuuuuuuucuacug

SEQ ID NO: 2043808 - RNA, 18 nt, Homo sapiens
acacaauacauguuuuca

SEQ ID NO: 2043809 - RNA, 18 nt, Homo sapiens
gugcaaaauaaaaugagu

SEQ ID NO: 2043810 - RNA, 14 nt, Homo sapiens
aaacacaucaucaa

SEQ ID NO: 2043811 - RNA, 20 nt, Homo sapiens
auguaccacugagccugaga

SEQ ID NO: 2043812 - RNA, 21 nt, Homo sapiens
accuccucccucauucaucuu

SEQ ID NO: 2043813 - RNA, 22 nt, Homo sapiens
ggagcuugcagugagccgagau

SEQ ID NO: 2043814 - RNA, 12 nt, Homo sapiens
cuugagugcucu

SEQ ID NO: 2043815 - RNA, 22 nt, Homo sapiens
ggaaacagauuuaagcaagacc

SEQ ID NO: 2043816 - RNA, 18 nt, Homo sapiens
gcccugccucacugugac

SEQ ID NO: 2043817 - RNA, 15 nt, Homo sapiens
cuaagggggaccaug

SEQ ID NO: 2043818 - RNA, 14 nt, Homo sapiens
cauagaacauugau

SEQ ID NO: 2043819 - RNA, 17 nt, Homo sapiens
auaacgagguuccagua

SEQ ID NO: 2043820 - RNA, 15 nt, Homo sapiens
ccugacccugcuccu

SEQ ID NO: 2043821 - RNA, 19 nt, Homo sapiens
cuagucugcuagccaggau

SEQ ID NO: 2043822 - RNA, 17 nt, Homo sapiens
cuguggccucagcaucu

SEQ ID NO: 2043823 - RNA, 20 nt, Homo sapiens
agaaggcaaccaaagugcag

SEQ ID NO: 2043824 - RNA, 17 nt, Homo sapiens
ugggaggcuguggagcc

SEQ ID NO: 2043825 - RNA, 19 nt, Homo sapiens
ugacaggugccuguccuug

SEQ ID NO: 2043826 - RNA, 22 nt, Homo sapiens
uuguacaggaacugcauugacu

SEQ ID NO: 2043827 - RNA, 16 nt, Homo sapiens
acaugcauugagcucu

SEQ ID NO: 2043828 - RNA, 19 nt, Homo sapiens
cuaagaacaccugcauucu

SEQ ID NO: 2043829 - RNA, 14 nt, Homo sapiens
uaggcuagcuauuu

SEQ ID NO: 2043830 - RNA, 15 nt, Homo sapiens
caccugugaccagca

SEQ ID NO: 2043831 - RNA, 17 nt, Homo sapiens
ucccucacccccagcac

SEQ ID NO: 2043832 - RNA, 13 nt, Homo sapiens
cagggcacugucu

SEQ ID NO: 2043833 - RNA, 21 nt, Homo sapiens
aaauuuuauuaauauuuuaag

SEQ ID NO: 2043834 - RNA, 23 nt, Homo sapiens
agcugagacccucgccacgggga

SEQ ID NO: 2043835 - RNA, 17 nt, Homo sapiens
auaagcaugacauacuu

SEQ ID NO: 2043836 - RNA, 19 nt, Homo sapiens
acuuaaaccugugcuuuca

SEQ ID NO: 2043837 - RNA, 17 nt, Homo sapiens
gagaucgcgccacugca

SEQ ID NO: 2043838 - RNA, 16 nt, Homo sapiens
ugacccagucagaguu

SEQ ID NO: 2043839 - RNA, 18 nt, Homo sapiens
cacacccggggagaagau

SEQ ID NO: 2043840 - RNA, 23 nt, Homo sapiens
cgcacgcggaugcuacuacugca

SEQ ID NO: 2043841 - RNA, 20 nt, Homo sapiens
aggugccuccugacacaccu

SEQ ID NO: 2043842 - RNA, 16 nt, Homo sapiens
cccagaauuugcugca

SEQ ID NO: 2043843 - RNA, 23 nt, Homo sapiens
gaccugaauaccacuuaccucaa

SEQ ID NO: 2043844 - RNA, 23 nt, Homo sapiens
aauuucuucauaguuuauuuuca

SEQ ID NO: 2043845 - RNA, 14 nt, Homo sapiens
acaagauaccggug

SEQ ID NO: 2043846 - RNA, 15 nt, Homo sapiens
ucgcccaccagugac

SEQ ID NO: 2043847 - RNA, 16 nt, Homo sapiens
aucacugggucugcug

SEQ ID NO: 2043848 - RNA, 17 nt, Homo sapiens
agcagacacacaugggc

SEQ ID NO: 2043849 - RNA, 22 nt, Homo sapiens
cuugguuuuuuaaaaucuguaa

SEQ ID NO: 2043850 - RNA, 24 nt, Homo sapiens
aggccgagaugugcaacacucagg

SEQ ID NO: 2043851 - RNA, 22 nt, Homo sapiens
agcauguguuaaucuuaaugua

SEQ ID NO: 2043852 - RNA, 22 nt, Homo sapiens
gccuucugggccuccaaagccc

SEQ ID NO: 2043853 - RNA, 23 nt, Homo sapiens
cagaacugcuugaacccaggagg

SEQ ID NO: 2043854 - RNA, 14 nt, Homo sapiens
uuccccaagacauu

SEQ ID NO: 2043855 - RNA, 12 nt, Homo sapiens
gagcugcagcug

SEQ ID NO: 2043856 - RNA, 12 nt, Homo sapiens
gagggagcugcu

SEQ ID NO: 2043857 - RNA, 23 nt, Homo sapiens
acacaguguuggagguuaaggca

SEQ ID NO: 2043858 - RNA, 17 nt, Homo sapiens
ccccagagcaggagcuu

SEQ ID NO: 2043859 - RNA, 14 nt, Homo sapiens
aaggaguaccaugu

SEQ ID NO: 2043860 - RNA, 20 nt, Homo sapiens
agguguggccugcacugggu

SEQ ID NO: 2043861 - RNA, 22 nt, Homo sapiens
caaaucuaaaguugcuccauac

SEQ ID NO: 2043862 - RNA, 12 nt, Homo sapiens
uuuuugaaucua

SEQ ID NO: 2043863 - RNA, 12 nt, Homo sapiens
acaaugaaauau

SEQ ID NO: 2043864 - RNA, 17 nt, Homo sapiens
uguguguuuaacauuca

SEQ ID NO: 2043865 - RNA, 18 nt, Homo sapiens
acggccacuggccaucuc

SEQ ID NO: 2043866 - RNA, 18 nt, Homo sapiens
ucauuccuuagauaccuu

SEQ ID NO: 2043867 - RNA, 15 nt, Homo sapiens
acacagcgagacucc

SEQ ID NO: 2043868 - RNA, 15 nt, Homo sapiens
ggauaaacugcagag

SEQ ID NO: 2043869 - RNA, 15 nt, Homo sapiens
uauaagucacaaaga

SEQ ID NO: 2043870 - RNA, 15 nt, Homo sapiens
agaaugaauuuaucu

SEQ ID NO: 2043871 - RNA, 14 nt, Homo sapiens
aagagucauuguua

SEQ ID NO: 2043872 - RNA, 15 nt, Homo sapiens
aauguauuugauguc

SEQ ID NO: 2043873 - RNA, 17 nt, Homo sapiens
auggucucuaccuaaug

SEQ ID NO: 2043874 - RNA, 21 nt, Homo sapiens
uaccugggcauucuuguuuca

SEQ ID NO: 2043875 - RNA, 12 nt, Homo sapiens
cucugcaaaagg

SEQ ID NO: 2043876 - RNA, 16 nt, Homo sapiens
cucauuuaucccucaa

SEQ ID NO: 2043877 - RNA, 12 nt, Homo sapiens
auuugguacaaa

SEQ ID NO: 2043878 - RNA, 20 nt, Homo sapiens
aggcuggagugcaauggcag

SEQ ID NO: 2043879 - RNA, 23 nt, Homo sapiens
augcauuuucaagauacauuuca

SEQ ID NO: 2043880 - RNA, 20 nt, Homo sapiens
cugggcucccucaaaugaca

SEQ ID NO: 2043881 - RNA, 14 nt, Homo sapiens
cugacuucccaagc

SEQ ID NO: 2043882 - RNA, 15 nt, Homo sapiens
cacucccgccucagg

SEQ ID NO: 2043883 - RNA, 20 nt, Homo sapiens
augguaggauaucuuggcuu

SEQ ID NO: 2043884 - RNA, 17 nt, Homo sapiens
auaaauacaauauugca

SEQ ID NO: 2043885 - RNA, 15 nt, Homo sapiens
caagcuuugcuccuu

SEQ ID NO: 2043886 - RNA, 14 nt, Homo sapiens
cucuaguacuguga

SEQ ID NO: 2043887 - RNA, 17 nt, Homo sapiens
aucugaaugcuauacug

SEQ ID NO: 2043888 - RNA, 23 nt, Homo sapiens
cugggauuacaggugugagccac

SEQ ID NO: 2043889 - RNA, 19 nt, Homo sapiens
ggcuaggggcuggggccaa

SEQ ID NO: 2043890 - RNA, 16 nt, Homo sapiens
accacauccugaaaag

SEQ ID NO: 2043891 - RNA, 23 nt, Homo sapiens
ugccaagucauuugaggaucuca

SEQ ID NO: 2043892 - RNA, 19 nt, Homo sapiens
ccuccuucggcuuugcccc

SEQ ID NO: 2043893 - RNA, 16 nt, Homo sapiens
gugcagccguuugaga

SEQ ID NO: 2043894 - RNA, 15 nt, Homo sapiens
uuggcacuaugguuu

SEQ ID NO: 2043895 - RNA, 17 nt, Homo sapiens
aaauguacuacauuugc

SEQ ID NO: 2043896 - RNA, 11 nt, Homo sapiens
cccagcacugu

SEQ ID NO: 2043897 - RNA, 11 nt, Homo sapiens
uccaaauaaca

SEQ ID NO: 2043898 - RNA, 22 nt, Homo sapiens
cggagaagagcuguucacagcc

SEQ ID NO: 2043899 - RNA, 20 nt, Homo sapiens
auucccaccccucauaccua

SEQ ID NO: 2043900 - RNA, 22 nt, Homo sapiens
cagggcagucauuggcugucuc

SEQ ID NO: 2043901 - RNA, 16 nt, Homo sapiens
caugaguucugcacau

SEQ ID NO: 2043902 - RNA, 17 nt, Homo sapiens
aagcaaaggaaaccaaa

SEQ ID NO: 2043903 - RNA, 21 nt, Homo sapiens
aguagcucauucuugugacuu

SEQ ID NO: 2043904 - RNA, 12 nt, Homo sapiens
ugcuagaacuuu

SEQ ID NO: 2043905 - RNA, 22 nt, Homo sapiens
agaacauuguaucacauuuuag

SEQ ID NO: 2043906 - RNA, 17 nt, Homo sapiens
uggacauaagacagaca

SEQ ID NO: 2043907 - RNA, 22 nt, Homo sapiens
uccaaugucuggagaccaccag

SEQ ID NO: 2043908 - RNA, 19 nt, Homo sapiens
aaaauagcacauccaccaa

SEQ ID NO: 2043909 - RNA, 17 nt, Homo sapiens
acucaaugguaucauua

SEQ ID NO: 2043910 - RNA, 19 nt, Homo sapiens
cuccuuccaacaggagcug

SEQ ID NO: 2043911 - RNA, 22 nt, Homo sapiens
ucuuucucccccaccucuugcg

SEQ ID NO: 2043912 - RNA, 14 nt, Homo sapiens
acaggaaaaaccaa

SEQ ID NO: 2043913 - RNA, 23 nt, Homo sapiens
uggauaagucacuuaaacucauc

SEQ ID NO: 2043914 - RNA, 11 nt, Homo sapiens
cgucaccaaau

SEQ ID NO: 2043915 - RNA, 13 nt, Homo sapiens
cuagaaggacuca

SEQ ID NO: 2043916 - RNA, 22 nt, Homo sapiens
guacaauuucaacuacagugau

SEQ ID NO: 2043917 - RNA, 20 nt, Homo sapiens
aguacaauauuucaguauug

SEQ ID NO: 2043918 - RNA, 16 nt, Homo sapiens
uguagcugagcacagc

SEQ ID NO: 2043919 - RNA, 14 nt, Homo sapiens
uaaacugugugcaa

SEQ ID NO: 2043920 - RNA, 15 nt, Homo sapiens
auaaaaaagucucua

SEQ ID NO: 2043921 - RNA, 22 nt, Homo sapiens
uucugagaguuggcucaggcag

SEQ ID NO: 2043922 - RNA, 23 nt, Homo sapiens
uuggaaggaaaaggaauuccucu

SEQ ID NO: 2043923 - RNA, 14 nt, Homo sapiens
auguuugaaugagu

SEQ ID NO: 2043924 - RNA, 18 nt, Homo sapiens
gugcuagcuugacacagu

SEQ ID NO: 2043925 - RNA, 13 nt, Homo sapiens
uguugcacccagc

SEQ ID NO: 2043926 - RNA, 13 nt, Homo sapiens
ucucucccaugga

SEQ ID NO: 2043927 - RNA, 20 nt, Homo sapiens
ccuacuugcagguuguuguc

SEQ ID NO: 2043928 - RNA, 16 nt, Homo sapiens
ucaagucuucccugau

SEQ ID NO: 2043929 - RNA, 15 nt, Homo sapiens
cuucaauuauuuccc

SEQ ID NO: 2043930 - RNA, 16 nt, Homo sapiens
ccgccaaacacuccac

SEQ ID NO: 2043931 - RNA, 24 nt, Homo sapiens
acuaguaaucuuggcccuauucau

SEQ ID NO: 2043932 - RNA, 15 nt, Homo sapiens
uuuucaagcuauaau

SEQ ID NO: 2043933 - RNA, 18 nt, Homo sapiens
gccacacuggccggccca

SEQ ID NO: 2043934 - RNA, 16 nt, Homo sapiens
gagacucuagggucca

SEQ ID NO: 2043935 - RNA, 19 nt, Homo sapiens
gcugaaaaaucauccaaga

SEQ ID NO: 2043936 - RNA, 19 nt, Homo sapiens
ccagccaaucuagaggcaa

SEQ ID NO: 2043937 - RNA, 12 nt, Homo sapiens
ugugugaucugu

SEQ ID NO: 2043938 - RNA, 15 nt, Homo sapiens
ccaguggcagcuccc

SEQ ID NO: 2043939 - RNA, 20 nt, Homo sapiens
cugcccauggcaugucuuug

SEQ ID NO: 2043940 - RNA, 23 nt, Homo sapiens
uguguccacugcaauugguggua

SEQ ID NO: 2043941 - RNA, 13 nt, Homo sapiens
cagugucuuccau

SEQ ID NO: 2043942 - RNA, 23 nt, Homo sapiens
gccuuagaaauguaaacugccau

SEQ ID NO: 2043943 - RNA, 19 nt, Homo sapiens
ccagugucgugucugcugu

SEQ ID NO: 2043944 - RNA, 12 nt, Homo sapiens
ggcuauacaugg

SEQ ID NO: 2043945 - RNA, 16 nt, Homo sapiens
uaagaaaugggccuca

SEQ ID NO: 2043946 - RNA, 15 nt, Homo sapiens
caaccuuuuaugugu

SEQ ID NO: 2043947 - RNA, 19 nt, Homo sapiens
aauauuuuaaacuacugau

SEQ ID NO: 2043948 - RNA, 21 nt, Homo sapiens
agaaaaacaucuggauaucaa

SEQ ID NO: 2043949 - RNA, 14 nt, Homo sapiens
uauucugugaucac

SEQ ID NO: 2043950 - RNA, 13 nt, Homo sapiens
cuguagacugcca

SEQ ID NO: 2043951 - RNA, 22 nt, Homo sapiens
acauaccccgaaggucuaggaa

SEQ ID NO: 2043952 - RNA, 15 nt, Homo sapiens
uuccuaauaugaucu

SEQ ID NO: 2043953 - RNA, 17 nt, Homo sapiens
auagggaaaauaaucuc

SEQ ID NO: 2043954 - RNA, 16 nt, Homo sapiens
agaugugcaacacuca

SEQ ID NO: 2043955 - RNA, 16 nt, Homo sapiens
uucauucuguauguga

SEQ ID NO: 2043956 - RNA, 12 nt, Homo sapiens
cucacucuguca

SEQ ID NO: 2043957 - RNA, 12 nt, Homo sapiens
cucucucugucu

SEQ ID NO: 2043958 - RNA, 23 nt, Homo sapiens
uucuugggaaaauaucacuuugu

SEQ ID NO: 2043959 - RNA, 15 nt, Homo sapiens
acaaccucaucagcu

SEQ ID NO: 2043960 - RNA, 22 nt, Homo sapiens
aacgcagaagaaaggguggaaa

SEQ ID NO: 2043961 - RNA, 17 nt, Homo sapiens
augagacagacauucac

SEQ ID NO: 2043962 - RNA, 23 nt, Homo sapiens
ccuaaaauaucuggguggcuuaa

SEQ ID NO: 2043963 - RNA, 18 nt, Homo sapiens
ucauuaaauugcuuuuaa

SEQ ID NO: 2043964 - RNA, 18 nt, Homo sapiens
ggaggaucucuaaccccu

SEQ ID NO: 2043965 - RNA, 22 nt, Homo sapiens
accugguacugagguugggcug

SEQ ID NO: 2043966 - RNA, 13 nt, Homo sapiens
gacagaugugguu

SEQ ID NO: 2043967 - RNA, 16 nt, Homo sapiens
uuggcacuguggagcu

SEQ ID NO: 2043968 - RNA, 22 nt, Homo sapiens
cccgugggcaucucaagcccca

SEQ ID NO: 2043969 - RNA, 12 nt, Homo sapiens
uuauuagcucua

SEQ ID NO: 2043970 - RNA, 15 nt, Homo sapiens
gcccagugaccugac

SEQ ID NO: 2043971 - RNA, 19 nt, Homo sapiens
uacugaugaaaucugcuag

SEQ ID NO: 2043972 - RNA, 17 nt, Homo sapiens
cgugaggucccaggaag

SEQ ID NO: 2043973 - RNA, 14 nt, Homo sapiens
agccagguucacac

SEQ ID NO: 2043974 - RNA, 10 nt, Homo sapiens
gacacugucu

SEQ ID NO: 2043975 - RNA, 12 nt, Homo sapiens
uagcaaccugcc

SEQ ID NO: 2043976 - RNA, 19 nt, Homo sapiens
aggcgccacccuucuucag

SEQ ID NO: 2043977 - RNA, 17 nt, Homo sapiens
uuucuaagauacauaua

SEQ ID NO: 2043978 - RNA, 19 nt, Homo sapiens
cuggagaguaagaauauag

SEQ ID NO: 2043979 - RNA, 14 nt, Homo sapiens
aagaagauggauug

SEQ ID NO: 2043980 - RNA, 21 nt, Homo sapiens
aaauuuuggucauagcauuca

SEQ ID NO: 2043981 - RNA, 16 nt, Homo sapiens
cugaaagaucuuucag

SEQ ID NO: 2043982 - RNA, 19 nt, Homo sapiens
gagcacaaaaugauaauca

SEQ ID NO: 2043983 - RNA, 23 nt, Homo sapiens
aucauuagagaaaugcaaaucga

SEQ ID NO: 2043984 - RNA, 16 nt, Homo sapiens
auggugaaaccaaaca

SEQ ID NO: 2043985 - RNA, 20 nt, Homo sapiens
auaaacggacucaguggaca

SEQ ID NO: 2043986 - RNA, 18 nt, Homo sapiens
cauuuuguucuuacacau

SEQ ID NO: 2043987 - RNA, 20 nt, Homo sapiens
acuuauuggauauucauucu

SEQ ID NO: 2043988 - RNA, 18 nt, Homo sapiens
auaaccccaagacagucu

SEQ ID NO: 2043989 - RNA, 15 nt, Homo sapiens
augugguaggugaua

SEQ ID NO: 2043990 - RNA, 13 nt, Homo sapiens
caaugagaaggcc

SEQ ID NO: 2043991 - RNA, 12 nt, Homo sapiens
gaguuguccuga

SEQ ID NO: 2043992 - RNA, 14 nt, Homo sapiens
cuccuucaccaccc

SEQ ID NO: 2043993 - RNA, 14 nt, Homo sapiens
cagccugucccuga

SEQ ID NO: 2043994 - RNA, 16 nt, Homo sapiens
gaaaugagaucaggcu

SEQ ID NO: 2043995 - RNA, 11 nt, Homo sapiens
caaggccuuca

SEQ ID NO: 2043996 - RNA, 16 nt, Homo sapiens
gagacuagccugggaa

SEQ ID NO: 2043997 - RNA, 17 nt, Homo sapiens
cauguacagacauacau

SEQ ID NO: 2043998 - RNA, 15 nt, Homo sapiens
auuaaacgggcugcg

SEQ ID NO: 2043999 - RNA, 14 nt, Homo sapiens
uuaugacaaugacu

SEQ ID NO: 2044000 - RNA, 20 nt, Homo sapiens
cugcugcuucuccaagcuuu

SEQ ID NO: 2044001 - RNA, 22 nt, Homo sapiens
aggauuauucccaccugccaca

SEQ ID NO: 2044002 - RNA, 16 nt, Homo sapiens
uaugauguauacccau

SEQ ID NO: 2044003 - RNA, 17 nt, Homo sapiens
gugacagagcccagcau

SEQ ID NO: 2044004 - RNA, 22 nt, Homo sapiens
cagagagaagagccccacucuc

SEQ ID NO: 2044005 - RNA, 14 nt, Homo sapiens
guccuuacucagag

SEQ ID NO: 2044006 - RNA, 17 nt, Homo sapiens
acgagacccccauccag

SEQ ID NO: 2044007 - RNA, 16 nt, Homo sapiens
ccuuaucgaaacucau

SEQ ID NO: 2044008 - RNA, 17 nt, Homo sapiens
gaucaguugaggccagg

SEQ ID NO: 2044009 - RNA, 16 nt, Homo sapiens
uccccucagacuagcu

SEQ ID NO: 2044010 - RNA, 17 nt, Homo sapiens
uccauguuggucaggcu

SEQ ID NO: 2044011 - RNA, 14 nt, Homo sapiens
aacuucuacauuca

SEQ ID NO: 2044012 - RNA, 21 nt, Homo sapiens
caacccagcaguucucugcca

SEQ ID NO: 2044013 - RNA, 11 nt, Homo sapiens
acuugggauag

SEQ ID NO: 2044014 - RNA, 21 nt, Homo sapiens
agacugguaggaggaggcaug

SEQ ID NO: 2044015 - RNA, 12 nt, Homo sapiens
ucacaacauucu

SEQ ID NO: 2044016 - RNA, 14 nt, Homo sapiens
ugaauugugccuuu

SEQ ID NO: 2044017 - RNA, 15 nt, Homo sapiens
uguuaauguucauau

SEQ ID NO: 2044018 - RNA, 15 nt, Homo sapiens
cuucuccaaaugaga

SEQ ID NO: 2044019 - RNA, 18 nt, Homo sapiens
ucccuggcauuguuucca

SEQ ID NO: 2044020 - RNA, 13 nt, Homo sapiens
augaaacagggca

SEQ ID NO: 2044021 - RNA, 22 nt, Homo sapiens
ucugcuccuuagacaccugaau

SEQ ID NO: 2044022 - RNA, 20 nt, Homo sapiens
caaaaccuacccucagugag

SEQ ID NO: 2044023 - RNA, 16 nt, Homo sapiens
aacugagaccaaagaa

SEQ ID NO: 2044024 - RNA, 21 nt, Homo sapiens
agccacaccuuaguauacugc

SEQ ID NO: 2044025 - RNA, 19 nt, Homo sapiens
uuuugaccuguaacuuaaa

SEQ ID NO: 2044026 - RNA, 20 nt, Homo sapiens
agugagcacacccgugugca

SEQ ID NO: 2044027 - RNA, 14 nt, Homo sapiens
aggggcacucuccc

SEQ ID NO: 2044028 - RNA, 14 nt, Homo sapiens
cuggucuugaacuc

SEQ ID NO: 2044029 - RNA, 15 nt, Homo sapiens
gaaguccagaacaag

SEQ ID NO: 2044030 - RNA, 21 nt, Homo sapiens
ccuacaaggcuggcagugaca

SEQ ID NO: 2044031 - RNA, 16 nt, Homo sapiens
acacuucggcucucug

SEQ ID NO: 2044032 - RNA, 22 nt, Homo sapiens
cauggaggccaagaacuugcaa

SEQ ID NO: 2044033 - RNA, 19 nt, Homo sapiens
ucaagagaaguacagaaug

SEQ ID NO: 2044034 - RNA, 20 nt, Homo sapiens
cacauaaaagacacagaaca

SEQ ID NO: 2044035 - RNA, 16 nt, Homo sapiens
ugcuauaugauuuagc

SEQ ID NO: 2044036 - RNA, 22 nt, Homo sapiens
cagacagcccuggcaaaugccu

SEQ ID NO: 2044037 - RNA, 13 nt, Homo sapiens
gcuaauuagcucu

SEQ ID NO: 2044038 - RNA, 23 nt, Homo sapiens
ugcaguucuuuuuguacacuuaa

SEQ ID NO: 2044039 - RNA, 15 nt, Homo sapiens
aucaguggcugccuu

SEQ ID NO: 2044040 - RNA, 22 nt, Homo sapiens
cuaccugauggaaguaaagccu

SEQ ID NO: 2044041 - RNA, 22 nt, Homo sapiens
gcuccucuaguaagaugcacug

SEQ ID NO: 2044042 - RNA, 17 nt, Homo sapiens
cugggauuacaggugug

SEQ ID NO: 2044043 - RNA, 21 nt, Homo sapiens
agcaaauguuuaaaauccaaa

SEQ ID NO: 2044044 - RNA, 23 nt, Homo sapiens
ucuauaccaaccaaaccaauuca

SEQ ID NO: 2044045 - RNA, 20 nt, Homo sapiens
ucaaaguaaagaacacgaaa

SEQ ID NO: 2044046 - RNA, 15 nt, Homo sapiens
caucgucaucaucau

SEQ ID NO: 2044047 - RNA, 20 nt, Homo sapiens
uuugcuuguguuuauuacug

SEQ ID NO: 2044048 - RNA, 18 nt, Homo sapiens
uacuugaaaaaauguucu

SEQ ID NO: 2044049 - RNA, 15 nt, Homo sapiens
aauuaauuugugaau

SEQ ID NO: 2044050 - RNA, 15 nt, Homo sapiens
ugaagggaugcugca

SEQ ID NO: 2044051 - RNA, 14 nt, Homo sapiens
gcucucccuaccuu

SEQ ID NO: 2044052 - RNA, 16 nt, Homo sapiens
gguccagacccacucc

SEQ ID NO: 2044053 - RNA, 14 nt, Homo sapiens
uccacuauuuccau

SEQ ID NO: 2044054 - RNA, 21 nt, Homo sapiens
ggccgucugcacuucuguucc

SEQ ID NO: 2044055 - RNA, 21 nt, Homo sapiens
uucuugcucugcucaucuaca

SEQ ID NO: 2044056 - RNA, 14 nt, Homo sapiens
ccuuuuaacaccuu

SEQ ID NO: 2044057 - RNA, 22 nt, Homo sapiens
cucuccauaucuccuuccccua

SEQ ID NO: 2044058 - RNA, 19 nt, Homo sapiens
cuaaaauagcaauaacuga

SEQ ID NO: 2044059 - RNA, 17 nt, Homo sapiens
caaguuuuguggggcuu

SEQ ID NO: 2044060 - RNA, 20 nt, Homo sapiens
guccaggucaccagccugac

SEQ ID NO: 2044061 - RNA, 17 nt, Homo sapiens
uaauaaaaggaguucag

SEQ ID NO: 2044062 - RNA, 13 nt, Homo sapiens
aauugacaaugac

SEQ ID NO: 2044063 - RNA, 18 nt, Homo sapiens
caagugccugcaccaggg

SEQ ID NO: 2044064 - RNA, 16 nt, Homo sapiens
acaagaaucacuugaa

SEQ ID NO: 2044065 - RNA, 19 nt, Homo sapiens
uuccugaauuggaaaggaa

SEQ ID NO: 2044066 - RNA, 23 nt, Homo sapiens
uauguaucuaccaucuaaucuau

SEQ ID NO: 2044067 - RNA, 19 nt, Homo sapiens
uucuccuccagguauuuga

SEQ ID NO: 2044068 - RNA, 23 nt, Homo sapiens
agaaccugucuccuacuuugaaa

SEQ ID NO: 2044069 - RNA, 21 nt, Homo sapiens
cccuggcagcccgcaucagcu

SEQ ID NO: 2044070 - RNA, 16 nt, Homo sapiens
cuguuuuagcugaggg

SEQ ID NO: 2044071 - RNA, 22 nt, Homo sapiens
gacuaacccaaugccugugaag

SEQ ID NO: 2044072 - RNA, 21 nt, Homo sapiens
uucccuguggugauaccuaua

SEQ ID NO: 2044073 - RNA, 13 nt, Homo sapiens
ugccauagcauaa

SEQ ID NO: 2044074 - RNA, 16 nt, Homo sapiens
aaagacuugaugaaua

SEQ ID NO: 2044075 - RNA, 19 nt, Homo sapiens
uguaaucucucauggugaa

SEQ ID NO: 2044076 - RNA, 14 nt, Homo sapiens
uucccuuaacucca

SEQ ID NO: 2044077 - RNA, 19 nt, Homo sapiens
uagaguuagcugauaagga

SEQ ID NO: 2044078 - RNA, 23 nt, Homo sapiens
auguuuuccacugagcaucacaa

SEQ ID NO: 2044079 - RNA, 18 nt, Homo sapiens
gcacauuuccucucuauc

SEQ ID NO: 2044080 - RNA, 13 nt, Homo sapiens
gcuggaucaggaa

SEQ ID NO: 2044081 - RNA, 14 nt, Homo sapiens
ucucuaacagggca

SEQ ID NO: 2044082 - RNA, 22 nt, Homo sapiens
cacagaugauuaaacagacuuu

SEQ ID NO: 2044083 - RNA, 20 nt, Homo sapiens
aggcuggaguacaauggcgu

SEQ ID NO: 2044084 - RNA, 17 nt, Homo sapiens
agccgugucguaugacc

SEQ ID NO: 2044085 - RNA, 15 nt, Homo sapiens
agugcaccaucucac

SEQ ID NO: 2044086 - RNA, 18 nt, Homo sapiens
caaggaauagaguuuucc

SEQ ID NO: 2044087 - RNA, 14 nt, Homo sapiens
agagggaagccaug

SEQ ID NO: 2044088 - RNA, 16 nt, Homo sapiens
aucuuccuguuuaaaa

SEQ ID NO: 2044089 - RNA, 17 nt, Homo sapiens
ccuauccuuacauuuca

SEQ ID NO: 2044090 - RNA, 23 nt, Homo sapiens
ccacauccccaccccagcuguua

SEQ ID NO: 2044091 - RNA, 14 nt, Homo sapiens
ucacacucagaaag

SEQ ID NO: 2044092 - RNA, 20 nt, Homo sapiens
gucucaaccccucacaggag

SEQ ID NO: 2044093 - RNA, 17 nt, Homo sapiens
gauacaaucagcugcuu

SEQ ID NO: 2044094 - RNA, 14 nt, Homo sapiens
cuugagccaggugg

SEQ ID NO: 2044095 - RNA, 13 nt, Homo sapiens
uguuuuauauguu

SEQ ID NO: 2044096 - RNA, 21 nt, Homo sapiens
ggauccaauaugacucagaga

SEQ ID NO: 2044097 - RNA, 18 nt, Homo sapiens
auacugcacacugcacau

SEQ ID NO: 2044098 - RNA, 19 nt, Homo sapiens
ugauauggcagaagacacc

SEQ ID NO: 2044099 - RNA, 23 nt, Homo sapiens
cagaguugcaaagaucuuuucca

SEQ ID NO: 2044100 - RNA, 14 nt, Homo sapiens
gagaccaggggacc

SEQ ID NO: 2044101 - RNA, 14 nt, Homo sapiens
cauucuuccaaaaa

SEQ ID NO: 2044102 - RNA, 20 nt, Homo sapiens
ucuuggauuuuuaaaccaca

SEQ ID NO: 2044103 - RNA, 24 nt, Homo sapiens
ggcaggugaaaaggguacagaugu

SEQ ID NO: 2044104 - RNA, 21 nt, Homo sapiens
ugcugaaaauaacacaacaaa

SEQ ID NO: 2044105 - RNA, 22 nt, Homo sapiens
gagaaguacaaagguugcagug

SEQ ID NO: 2044106 - RNA, 22 nt, Homo sapiens
cauuauucucuaacuauuacac

SEQ ID NO: 2044107 - RNA, 13 nt, Homo sapiens
ggggagcgguggc

SEQ ID NO: 2044108 - RNA, 20 nt, Homo sapiens
cauacauacacugcauccug

SEQ ID NO: 2044109 - RNA, 16 nt, Homo sapiens
ugaguagcugggauua

SEQ ID NO: 2044110 - RNA, 19 nt, Homo sapiens
ugcaaagugccuugcucau

SEQ ID NO: 2044111 - RNA, 19 nt, Homo sapiens
gucaccagcaacaucucga

SEQ ID NO: 2044112 - RNA, 23 nt, Homo sapiens
uuaguucuguagaaggcaagagu

SEQ ID NO: 2044113 - RNA, 14 nt, Homo sapiens
acucuggguuucau

SEQ ID NO: 2044114 - RNA, 17 nt, Homo sapiens
aaaacacaaaaguuucu

SEQ ID NO: 2044115 - RNA, 18 nt, Homo sapiens
auuauggagugucaccag

SEQ ID NO: 2044116 - RNA, 16 nt, Homo sapiens
cagcuuccugugcaga

SEQ ID NO: 2044117 - RNA, 15 nt, Homo sapiens
caggugcugugacac

SEQ ID NO: 2044118 - RNA, 20 nt, Homo sapiens
aaucauaaaggaucagagau

SEQ ID NO: 2044119 - RNA, 21 nt, Homo sapiens
cuaucccuggacgcaugcagg

SEQ ID NO: 2044120 - RNA, 16 nt, Homo sapiens
cacuucuuaacagaca

SEQ ID NO: 2044121 - RNA, 21 nt, Homo sapiens
cauucccuuucuuuucaugcc

SEQ ID NO: 2044122 - RNA, 12 nt, Homo sapiens
acaaaaaugcug

SEQ ID NO: 2044123 - RNA, 12 nt, Homo sapiens
ugaauugcacau

SEQ ID NO: 2044124 - RNA, 12 nt, Homo sapiens
acauuugcugaa

SEQ ID NO: 2044125 - RNA, 16 nt, Homo sapiens
ugcccuacacugccuu

SEQ ID NO: 2044126 - RNA, 18 nt, Homo sapiens
uguaggcagggaaccuua

SEQ ID NO: 2044127 - RNA, 18 nt, Homo sapiens
gcagcuaaaauaagcuca

SEQ ID NO: 2044128 - RNA, 15 nt, Homo sapiens
uaagagacaugaaug

SEQ ID NO: 2044129 - RNA, 16 nt, Homo sapiens
acagcugugagccaug

SEQ ID NO: 2044130 - RNA, 17 nt, Homo sapiens
auuguaaauacuggacu

SEQ ID NO: 2044131 - RNA, 23 nt, Homo sapiens
gcucagcuucuucuuucauucua

SEQ ID NO: 2044132 - RNA, 17 nt, Homo sapiens
auggcugugccucugcc

SEQ ID NO: 2044133 - RNA, 20 nt, Homo sapiens
auguuuaauaucugacugaa

SEQ ID NO: 2044134 - RNA, 18 nt, Homo sapiens
uaaaagagaacuugauag

SEQ ID NO: 2044135 - RNA, 15 nt, Homo sapiens
acacugauggcucaa

SEQ ID NO: 2044136 - RNA, 21 nt, Homo sapiens
cuuuaaaauauuguugaacac

SEQ ID NO: 2044137 - RNA, 19 nt, Homo sapiens
ggacagucuggagguccca

SEQ ID NO: 2044138 - RNA, 17 nt, Homo sapiens
cuauuauuuucuuuaaa

SEQ ID NO: 2044139 - RNA, 20 nt, Homo sapiens
ggacaggcaaagacugcagu

SEQ ID NO: 2044140 - RNA, 21 nt, Homo sapiens
uauauaacuaacaaccaaaga

SEQ ID NO: 2044141 - RNA, 12 nt, Homo sapiens
agcacaugaaua

SEQ ID NO: 2044142 - RNA, 13 nt, Homo sapiens
cuguuuccugaca

SEQ ID NO: 2044143 - RNA, 14 nt, Homo sapiens
aggcuccugugcua

SEQ ID NO: 2044144 - RNA, 21 nt, Homo sapiens
cgcaccugcuucccccacuuc

SEQ ID NO: 2044145 - RNA, 16 nt, Homo sapiens
aaaaacaauacuuuuc

SEQ ID NO: 2044146 - RNA, 20 nt, Homo sapiens
agaaaaauaagcucgaguga

SEQ ID NO: 2044147 - RNA, 13 nt, Homo sapiens
agucaugugccua

SEQ ID NO: 2044148 - RNA, 14 nt, Homo sapiens
auuccuugcacaua

SEQ ID NO: 2044149 - RNA, 17 nt, Homo sapiens
cugaauaaaauauugau

SEQ ID NO: 2044150 - RNA, 14 nt, Homo sapiens
ggcgggcauggcgu

SEQ ID NO: 2044151 - RNA, 15 nt, Homo sapiens
cuagaucucccuuaa

SEQ ID NO: 2044152 - RNA, 16 nt, Homo sapiens
cggggagcaaaccagc

SEQ ID NO: 2044153 - RNA, 17 nt, Homo sapiens
accuucugccagaagac

SEQ ID NO: 2044154 - RNA, 20 nt, Homo sapiens
agcaggcauuucugugaugu

SEQ ID NO: 2044155 - RNA, 17 nt, Homo sapiens
aauacaauucacagcac

SEQ ID NO: 2044156 - RNA, 19 nt, Homo sapiens
ugcaugaaagcacaaggua

SEQ ID NO: 2044157 - RNA, 23 nt, Homo sapiens
uaaaaagcuguucugucuuccca

SEQ ID NO: 2044158 - RNA, 17 nt, Homo sapiens
aacuacauuaguacaca

SEQ ID NO: 2044159 - RNA, 18 nt, Homo sapiens
uccugccuuuaagccaaa

SEQ ID NO: 2044160 - RNA, 15 nt, Homo sapiens
cugcucaaaucauuu

SEQ ID NO: 2044161 - RNA, 12 nt, Homo sapiens
gcacaucuuuga

SEQ ID NO: 2044162 - RNA, 12 nt, Homo sapiens
ucaaaucugugc

SEQ ID NO: 2044163 - RNA, 21 nt, Homo sapiens
guaugcugauuuacuacuuau

SEQ ID NO: 2044164 - RNA, 12 nt, Homo sapiens
ccucaaguucca

SEQ ID NO: 2044165 - RNA, 16 nt, Homo sapiens
accuuucaaacccaga

SEQ ID NO: 2044166 - RNA, 11 nt, Homo sapiens
uuuacucugcu

SEQ ID NO: 2044167 - RNA, 14 nt, Homo sapiens
gaaacuacaaagga

SEQ ID NO: 2044168 - RNA, 21 nt, Homo sapiens
acaaugauaggaaaaauccau

SEQ ID NO: 2044169 - RNA, 15 nt, Homo sapiens
gucauuggaggugaa

SEQ ID NO: 2044170 - RNA, 11 nt, Homo sapiens
augugccaagg

SEQ ID NO: 2044171 - RNA, 20 nt, Homo sapiens
cuucaaagccuucucccuag

SEQ ID NO: 2044172 - RNA, 15 nt, Homo sapiens
gucuccucugucagu

SEQ ID NO: 2044173 - RNA, 16 nt, Homo sapiens
ggaauuauauuugaug

SEQ ID NO: 2044174 - RNA, 14 nt, Homo sapiens
auauccugaucucg

SEQ ID NO: 2044175 - RNA, 19 nt, Homo sapiens
cugacuggggauaauggca

SEQ ID NO: 2044176 - RNA, 13 nt, Homo sapiens
caaaucaaucugu

SEQ ID NO: 2044177 - RNA, 21 nt, Homo sapiens
cacugcaccgggccacagaga

SEQ ID NO: 2044178 - RNA, 22 nt, Homo sapiens
guugaaagaaauuaaguacuua

SEQ ID NO: 2044179 - RNA, 21 nt, Homo sapiens
uauuuaaaaaaaaacauucaa

SEQ ID NO: 2044180 - RNA, 21 nt, Homo sapiens
cugcuuuauaauccuugucag

SEQ ID NO: 2044181 - RNA, 10 nt, Homo sapiens
cagugcaguc

SEQ ID NO: 2044182 - RNA, 18 nt, Homo sapiens
gaguucauccccugugaa

SEQ ID NO: 2044183 - RNA, 20 nt, Homo sapiens
uccuggaggucagcauuuga

SEQ ID NO: 2044184 - RNA, 19 nt, Homo sapiens
ggaggcugucuucucaggc

SEQ ID NO: 2044185 - RNA, 15 nt, Homo sapiens
caugguccugugccc

SEQ ID NO: 2044186 - RNA, 20 nt, Homo sapiens
uacaaaucugugcuacacug

SEQ ID NO: 2044187 - RNA, 14 nt, Homo sapiens
ucuguguaucucag

SEQ ID NO: 2044188 - RNA, 19 nt, Homo sapiens
uugaagacccucaaugcca

SEQ ID NO: 2044189 - RNA, 14 nt, Homo sapiens
aggaagagccagga

SEQ ID NO: 2044190 - RNA, 21 nt, Homo sapiens
uaugaaaaugcuguuuucaac

SEQ ID NO: 2044191 - RNA, 20 nt, Homo sapiens
aggggcugucucccaaugaa

SEQ ID NO: 2044192 - RNA, 15 nt, Homo sapiens
aguauauguucagca

SEQ ID NO: 2044193 - RNA, 22 nt, Homo sapiens
auuguccaccaugcucucucac

SEQ ID NO: 2044194 - RNA, 16 nt, Homo sapiens
aacaucuagcaguaaa

SEQ ID NO: 2044195 - RNA, 22 nt, Homo sapiens
ucaagcagggaagccccaguga

SEQ ID NO: 2044196 - RNA, 19 nt, Homo sapiens
ggugauuucuagaaugguu

SEQ ID NO: 2044197 - RNA, 17 nt, Homo sapiens
cauccaagcaaacugaa

SEQ ID NO: 2044198 - RNA, 16 nt, Homo sapiens
ugcacaucuacuugcu

SEQ ID NO: 2044199 - RNA, 19 nt, Homo sapiens
uaguuuaaaaaucugccac

SEQ ID NO: 2044200 - RNA, 22 nt, Homo sapiens
cauguggaagaaaacaagacau

SEQ ID NO: 2044201 - RNA, 16 nt, Homo sapiens
auuucucaacuuugau

SEQ ID NO: 2044202 - RNA, 17 nt, Homo sapiens
aguuucaaguaccaaaa

SEQ ID NO: 2044203 - RNA, 23 nt, Homo sapiens
cugcuggaggggacgcuggcuaa

SEQ ID NO: 2044204 - RNA, 17 nt, Homo sapiens
acuuuuggaaccaugcc

SEQ ID NO: 2044205 - RNA, 19 nt, Homo sapiens
ccuacugaacccagaguca

SEQ ID NO: 2044206 - RNA, 12 nt, Homo sapiens
aggaugugauau

SEQ ID NO: 2044207 - RNA, 14 nt, Homo sapiens
uauuggucacguca

SEQ ID NO: 2044208 - RNA, 19 nt, Homo sapiens
uguaguguucuccacuaau

SEQ ID NO: 2044209 - RNA, 22 nt, Homo sapiens
cuuccacaauggucucagccua

SEQ ID NO: 2044210 - RNA, 17 nt, Homo sapiens
aagccugguggcaauaa

SEQ ID NO: 2044211 - RNA, 19 nt, Homo sapiens
aucuuguuuguuacuguca

SEQ ID NO: 2044212 - RNA, 13 nt, Homo sapiens
ugaaaucaacuca

SEQ ID NO: 2044213 - RNA, 22 nt, Homo sapiens
ugugggagaccggccugccagg

SEQ ID NO: 2044214 - RNA, 21 nt, Homo sapiens
acaucacuacaguacagugag

SEQ ID NO: 2044215 - RNA, 23 nt, Homo sapiens
auccugauggcacccacacagag

SEQ ID NO: 2044216 - RNA, 22 nt, Homo sapiens
acuuauuguaucugaauuccug

SEQ ID NO: 2044217 - RNA, 16 nt, Homo sapiens
ggcaaauguagcccug

SEQ ID NO: 2044218 - RNA, 21 nt, Homo sapiens
auugaugaaaugcaaaaggaa

SEQ ID NO: 2044219 - RNA, 18 nt, Homo sapiens
cacaaggaccucuuuacu

SEQ ID NO: 2044220 - RNA, 23 nt, Homo sapiens
ugggguuacucgauguaagggau

SEQ ID NO: 2044221 - RNA, 21 nt, Homo sapiens
acucaguuguuccuacucaga

SEQ ID NO: 2044222 - RNA, 13 nt, Homo sapiens
auaaaaaaccaca

SEQ ID NO: 2044223 - RNA, 19 nt, Homo sapiens
uaaauguccugaauccagc

SEQ ID NO: 2044224 - RNA, 14 nt, Homo sapiens
uggggcaugaccuc

SEQ ID NO: 2044225 - RNA, 22 nt, Homo sapiens
uaaacgugaacuaagauuuccu

SEQ ID NO: 2044226 - RNA, 14 nt, Homo sapiens
gaauucuucauccu

SEQ ID NO: 2044227 - RNA, 14 nt, Homo sapiens
uuaauacuguguua

SEQ ID NO: 2044228 - RNA, 16 nt, Homo sapiens
gcuuuacuguuucuca

SEQ ID NO: 2044229 - RNA, 20 nt, Homo sapiens
gauggugaaaaugcacccca

SEQ ID NO: 2044230 - RNA, 22 nt, Homo sapiens
uuccagugcaguagugccaaaa

SEQ ID NO: 2044231 - RNA, 14 nt, Homo sapiens
uggccauguuccac

SEQ ID NO: 2044232 - RNA, 18 nt, Homo sapiens
cauaugaaaaaaaugcau

SEQ ID NO: 2044233 - RNA, 13 nt, Homo sapiens
uuccugggaacau

SEQ ID NO: 2044234 - RNA, 18 nt, Homo sapiens
auccacuuugcucugaau

SEQ ID NO: 2044235 - RNA, 21 nt, Homo sapiens
cacauugcauucuauugccuu

SEQ ID NO: 2044236 - RNA, 21 nt, Homo sapiens
ugagaagccugaugacaucaa

SEQ ID NO: 2044237 - RNA, 16 nt, Homo sapiens
guucacuaccugucag

SEQ ID NO: 2044238 - RNA, 14 nt, Homo sapiens
uauggucauuuaaa

SEQ ID NO: 2044239 - RNA, 19 nt, Homo sapiens
gcuaugaauauaguaccug

SEQ ID NO: 2044240 - RNA, 19 nt, Homo sapiens
cucucuguaggcacagagc

SEQ ID NO: 2044241 - RNA, 20 nt, Homo sapiens
ucacaaaggcugacauucac

SEQ ID NO: 2044242 - RNA, 21 nt, Homo sapiens
cacccuccacucugaggucuc

SEQ ID NO: 2044243 - RNA, 17 nt, Homo sapiens
ggaugaugacuauggaa

SEQ ID NO: 2044244 - RNA, 21 nt, Homo sapiens
aucucugccucucccaggcug

SEQ ID NO: 2044245 - RNA, 21 nt, Homo sapiens
cuaaaugaguaaacccagcug

SEQ ID NO: 2044246 - RNA, 16 nt, Homo sapiens
uacugucuaauuaaua

SEQ ID NO: 2044247 - RNA, 14 nt, Homo sapiens
cggugguugucaca

SEQ ID NO: 2044248 - RNA, 16 nt, Homo sapiens
aacagccuacagccag

SEQ ID NO: 2044249 - RNA, 22 nt, Homo sapiens
ucacauggccuaugcacauaug

SEQ ID NO: 2044250 - RNA, 12 nt, Homo sapiens
uguaaugcauag

SEQ ID NO: 2044251 - RNA, 14 nt, Homo sapiens
guagaccacugucc

SEQ ID NO: 2044252 - RNA, 22 nt, Homo sapiens
ccccucaauccuaucacagucu

SEQ ID NO: 2044253 - RNA, 19 nt, Homo sapiens
acaaaauggagggagccau

SEQ ID NO: 2044254 - RNA, 23 nt, Homo sapiens
caaugccuugacaacagacugaa

SEQ ID NO: 2044255 - RNA, 21 nt, Homo sapiens
gaaaauccuaggugcuacuuu

SEQ ID NO: 2044256 - RNA, 16 nt, Homo sapiens
ccugcacuaaagccag

SEQ ID NO: 2044257 - RNA, 23 nt, Homo sapiens
ccccacacuggagccaucucuuc

SEQ ID NO: 2044258 - RNA, 18 nt, Homo sapiens
aagggucucacacuguga

SEQ ID NO: 2044259 - RNA, 16 nt, Homo sapiens
aaaccucugacuugcu

SEQ ID NO: 2044260 - RNA, 12 nt, Homo sapiens
auuuuucaccuu

SEQ ID NO: 2044261 - RNA, 14 nt, Homo sapiens
auauuucugauacu

SEQ ID NO: 2044262 - RNA, 15 nt, Homo sapiens
aucuggcgaagcuca

SEQ ID NO: 2044263 - RNA, 20 nt, Homo sapiens
uccaggacacacugugagga

SEQ ID NO: 2044264 - RNA, 22 nt, Homo sapiens
uaaaagcaccauugugaagcag

SEQ ID NO: 2044265 - RNA, 19 nt, Homo sapiens
cagccucaguaguagcgaa

SEQ ID NO: 2044266 - RNA, 20 nt, Homo sapiens
cugacaaguuauuacugucu

SEQ ID NO: 2044267 - RNA, 14 nt, Homo sapiens
auggaauaacuauc

SEQ ID NO: 2044268 - RNA, 15 nt, Homo sapiens
cagaagcauuucacc

SEQ ID NO: 2044269 - RNA, 13 nt, Homo sapiens
uuuacagacacac

SEQ ID NO: 2044270 - RNA, 16 nt, Homo sapiens
uccuuuguguccauug

SEQ ID NO: 2044271 - RNA, 18 nt, Homo sapiens
acuucucuuccucccuca

SEQ ID NO: 2044272 - RNA, 16 nt, Homo sapiens
ccaaaucucaguggcu

SEQ ID NO: 2044273 - RNA, 24 nt, Homo sapiens
uggugauguugaaauaugcauacu

SEQ ID NO: 2044274 - RNA, 11 nt, Homo sapiens
uggcugaagaa

SEQ ID NO: 2044275 - RNA, 23 nt, Homo sapiens
cuccaaggguuucgacuggucca

SEQ ID NO: 2044276 - RNA, 20 nt, Homo sapiens
ucaaacaagaaacauuucag

SEQ ID NO: 2044277 - RNA, 22 nt, Homo sapiens
aaagaauccuuagaugccuaaa

SEQ ID NO: 2044278 - RNA, 17 nt, Homo sapiens
guaguuuucaaaacaca

SEQ ID NO: 2044279 - RNA, 13 nt, Homo sapiens
ucugcacuacucc

SEQ ID NO: 2044280 - RNA, 21 nt, Homo sapiens
ucccaucccguaagaccaccu

SEQ ID NO: 2044281 - RNA, 15 nt, Homo sapiens
auuuauuuuuugcca

SEQ ID NO: 2044282 - RNA, 20 nt, Homo sapiens
ugaaguuuagaccucauuaa

SEQ ID NO: 2044283 - RNA, 16 nt, Homo sapiens
cucugauaugggacug

SEQ ID NO: 2044284 - RNA, 19 nt, Homo sapiens
acaaagcuguuaaacuguu

SEQ ID NO: 2044285 - RNA, 13 nt, Homo sapiens
cagcacccuauau

SEQ ID NO: 2044286 - RNA, 15 nt, Homo sapiens
cuguaagaguguuua

SEQ ID NO: 2044287 - RNA, 19 nt, Homo sapiens
cagcacccaggcuccaugg

SEQ ID NO: 2044288 - RNA, 19 nt, Homo sapiens
cuggaagcuuuguagaaau

SEQ ID NO: 2044289 - RNA, 16 nt, Homo sapiens
gcacaaggacauuugg

SEQ ID NO: 2044290 - RNA, 15 nt, Homo sapiens
gauaacggcucucca

SEQ ID NO: 2044291 - RNA, 13 nt, Homo sapiens
ucccuuugcuccc

SEQ ID NO: 2044292 - RNA, 13 nt, Homo sapiens
cuuccuugucucu

SEQ ID NO: 2044293 - RNA, 15 nt, Homo sapiens
cucacacuucauccu

SEQ ID NO: 2044294 - RNA, 20 nt, Homo sapiens
cuccagauguuuccagacuu

SEQ ID NO: 2044295 - RNA, 15 nt, Homo sapiens
uuauagguuuccacu

SEQ ID NO: 2044296 - RNA, 18 nt, Homo sapiens
cacugccaugcagggccu

SEQ ID NO: 2044297 - RNA, 16 nt, Homo sapiens
aaacaugaagcacaaa

SEQ ID NO: 2044298 - RNA, 18 nt, Homo sapiens
aaacaggugcuaauuugu

SEQ ID NO: 2044299 - RNA, 13 nt, Homo sapiens
cccagcugugcug

SEQ ID NO: 2044300 - RNA, 17 nt, Homo sapiens
uuuccauuauguucauc

SEQ ID NO: 2044301 - RNA, 20 nt, Homo sapiens
agaauccuugucauuuccuc

SEQ ID NO: 2044302 - RNA, 15 nt, Homo sapiens
aagguggaaguugca

SEQ ID NO: 2044303 - RNA, 17 nt, Homo sapiens
guaguagcucgugugcu

SEQ ID NO: 2044304 - RNA, 21 nt, Homo sapiens
uuugggaccugcuucauucaa

SEQ ID NO: 2044305 - RNA, 18 nt, Homo sapiens
ucugcauuucauauuauu

SEQ ID NO: 2044306 - RNA, 18 nt, Homo sapiens
auuuauauuuagcaaaau

SEQ ID NO: 2044307 - RNA, 21 nt, Homo sapiens
ugcgacuucacaaaaugcaag

SEQ ID NO: 2044308 - RNA, 16 nt, Homo sapiens
gccccucaccucagga

SEQ ID NO: 2044309 - RNA, 20 nt, Homo sapiens
ugccucaggccaagggacca

SEQ ID NO: 2044310 - RNA, 20 nt, Homo sapiens
uuuuaaaguaaacuugugua

SEQ ID NO: 2044311 - RNA, 18 nt, Homo sapiens
cggcugaggccugagcga

SEQ ID NO: 2044312 - RNA, 14 nt, Homo sapiens
uauucccagccuug

SEQ ID NO: 2044313 - RNA, 15 nt, Homo sapiens
cauaccccuucagcu

SEQ ID NO: 2044314 - RNA, 18 nt, Homo sapiens
uaaacugaaaaaugucag

SEQ ID NO: 2044315 - RNA, 23 nt, Homo sapiens
guuucugaaaagaugguaucaua

SEQ ID NO: 2044316 - RNA, 20 nt, Homo sapiens
auugucuuuaauuucuguca

SEQ ID NO: 2044317 - RNA, 21 nt, Homo sapiens
uguacccagucucaaaggcca

SEQ ID NO: 2044318 - RNA, 18 nt, Homo sapiens
acaaaaugauuuugaaga

SEQ ID NO: 2044319 - RNA, 21 nt, Homo sapiens
ugauccaguuuuguuuggacc

SEQ ID NO: 2044320 - RNA, 18 nt, Homo sapiens
ccagauugacgacaagug

SEQ ID NO: 2044321 - RNA, 14 nt, Homo sapiens
acccuccuagccug

SEQ ID NO: 2044322 - RNA, 11 nt, Homo sapiens
uuaaaaggggg

SEQ ID NO: 2044323 - RNA, 19 nt, Homo sapiens
gucuuucugaauugcacau

SEQ ID NO: 2044324 - RNA, 13 nt, Homo sapiens
gucugcguggaau

SEQ ID NO: 2044325 - RNA, 21 nt, Homo sapiens
uccgaggccccugucucaggg

SEQ ID NO: 2044326 - RNA, 17 nt, Homo sapiens
ucacagaggcaguagga

SEQ ID NO: 2044327 - RNA, 15 nt, Homo sapiens
ggacuacaguagcuc

SEQ ID NO: 2044328 - RNA, 20 nt, Homo sapiens
ccuggggcgagcacugugag

SEQ ID NO: 2044329 - RNA, 22 nt, Homo sapiens
ugcaucacuauucagaagacac

SEQ ID NO: 2044330 - RNA, 17 nt, Homo sapiens
ccugccccagcacucac

SEQ ID NO: 2044331 - RNA, 17 nt, Homo sapiens
acagccaauacaauuag

SEQ ID NO: 2044332 - RNA, 21 nt, Homo sapiens
uaccacugagcccuugcacag

SEQ ID NO: 2044333 - RNA, 18 nt, Homo sapiens
ucugguaucugcauguaa

SEQ ID NO: 2044334 - RNA, 16 nt, Homo sapiens
cucauaaaccaaugug

SEQ ID NO: 2044335 - RNA, 15 nt, Homo sapiens
ugaaauuaugucaaa

SEQ ID NO: 2044336 - RNA, 18 nt, Homo sapiens
caguaaucccauuuccca

SEQ ID NO: 2044337 - RNA, 16 nt, Homo sapiens
cuccuuugcuuagccc

SEQ ID NO: 2044338 - RNA, 19 nt, Homo sapiens
cugcuucacaaaccuugcu

SEQ ID NO: 2044339 - RNA, 16 nt, Homo sapiens
agaugugucuauggcu

SEQ ID NO: 2044340 - RNA, 12 nt, Homo sapiens
acccaauaccuu

SEQ ID NO: 2044341 - RNA, 20 nt, Homo sapiens
cagccaccaccuacagccca

SEQ ID NO: 2044342 - RNA, 20 nt, Homo sapiens
guguaugugcauuaaacaaa

SEQ ID NO: 2044343 - RNA, 13 nt, Homo sapiens
uccgccugccuca

SEQ ID NO: 2044344 - RNA, 20 nt, Homo sapiens
cuuaacaaaacaagugcaag

SEQ ID NO: 2044345 - RNA, 11 nt, Homo sapiens
cuugcauuuau

SEQ ID NO: 2044346 - RNA, 22 nt, Homo sapiens
aggcucugugccuuggucucuc

SEQ ID NO: 2044347 - RNA, 17 nt, Homo sapiens
ucacugccaucacauca

SEQ ID NO: 2044348 - RNA, 23 nt, Homo sapiens
agaaauuaacaaaugugcugcuu

SEQ ID NO: 2044349 - RNA, 13 nt, Homo sapiens
gaauauuaugccc

SEQ ID NO: 2044350 - RNA, 15 nt, Homo sapiens
agugacccacccuag

SEQ ID NO: 2044351 - RNA, 13 nt, Homo sapiens
gaaagaaccagag

SEQ ID NO: 2044352 - RNA, 19 nt, Homo sapiens
cuuuagcaacaguuaucac

SEQ ID NO: 2044353 - RNA, 15 nt, Homo sapiens
ucuuucuauuuaugc

SEQ ID NO: 2044354 - RNA, 14 nt, Homo sapiens
gaaguuuguuguga

SEQ ID NO: 2044355 - RNA, 22 nt, Homo sapiens
uagcacugcacacucaguucug

SEQ ID NO: 2044356 - RNA, 12 nt, Homo sapiens
uugcacuugucu

SEQ ID NO: 2044357 - RNA, 16 nt, Homo sapiens
cugucuuaccauaaca

SEQ ID NO: 2044358 - RNA, 21 nt, Homo sapiens
aaccauggccaauucaguuuc

SEQ ID NO: 2044359 - RNA, 12 nt, Homo sapiens
uauucauguugu

SEQ ID NO: 2044360 - RNA, 12 nt, Homo sapiens
aagacaugauua

SEQ ID NO: 2044361 - RNA, 18 nt, Homo sapiens
cacugugggaaggccagc

SEQ ID NO: 2044362 - RNA, 20 nt, Homo sapiens
uacaaucuaucuuuuccaca

SEQ ID NO: 2044363 - RNA, 12 nt, Homo sapiens
acuguguuggcc

SEQ ID NO: 2044364 - RNA, 20 nt, Homo sapiens
aacaguccaaacuguucuga

SEQ ID NO: 2044365 - RNA, 15 nt, Homo sapiens
ugccuucucuauggc

SEQ ID NO: 2044366 - RNA, 18 nt, Homo sapiens
caaaaggaagacuggaga

SEQ ID NO: 2044367 - RNA, 11 nt, Homo sapiens
cuaaccaucug

SEQ ID NO: 2044368 - RNA, 21 nt, Homo sapiens
cuuccaaagagugcuaagcau

SEQ ID NO: 2044369 - RNA, 21 nt, Homo sapiens
ugcgaaugacaguagcauuau

SEQ ID NO: 2044370 - RNA, 15 nt, Homo sapiens
gcccccagccuuguu

SEQ ID NO: 2044371 - RNA, 21 nt, Homo sapiens
cccuuggaaaugucacugcuu

SEQ ID NO: 2044372 - RNA, 17 nt, Homo sapiens
aagucaugaagcucagu

SEQ ID NO: 2044373 - RNA, 21 nt, Homo sapiens
ggauauuuaguucaacuguau

SEQ ID NO: 2044374 - RNA, 15 nt, Homo sapiens
cagagggcccaggca

SEQ ID NO: 2044375 - RNA, 14 nt, Homo sapiens
uggaaguacaugaa

SEQ ID NO: 2044376 - RNA, 14 nt, Homo sapiens
uggauaacuuuaca

SEQ ID NO: 2044377 - RNA, 22 nt, Homo sapiens
ucagccuuagcacuauggacau

SEQ ID NO: 2044378 - RNA, 21 nt, Homo sapiens
cauuuuuguaauaacauuuaa

SEQ ID NO: 2044379 - RNA, 12 nt, Homo sapiens
ucaauagucuaa

SEQ ID NO: 2044380 - RNA, 23 nt, Homo sapiens
ugaacacaggcaaugacugcgca

SEQ ID NO: 2044381 - RNA, 20 nt, Homo sapiens
cugugaccuuacagccauuu

SEQ ID NO: 2044382 - RNA, 23 nt, Homo sapiens
cugagccaaagccagaguggcca

SEQ ID NO: 2044383 - RNA, 13 nt, Homo sapiens
gaugccuccuugg

SEQ ID NO: 2044384 - RNA, 13 nt, Homo sapiens
gagcgcuccugcc

SEQ ID NO: 2044385 - RNA, 14 nt, Homo sapiens
gcugugaauacuua

SEQ ID NO: 2044386 - RNA, 14 nt, Homo sapiens
aucuucucagcucc

SEQ ID NO: 2044387 - RNA, 14 nt, Homo sapiens
gggcuggccugaca

SEQ ID NO: 2044388 - RNA, 16 nt, Homo sapiens
uuaagcuuucagcuca

SEQ ID NO: 2044389 - RNA, 14 nt, Homo sapiens
cuuuccccagugac

SEQ ID NO: 2044390 - RNA, 21 nt, Homo sapiens
cagcgcuggucgucaccuggg

SEQ ID NO: 2044391 - RNA, 16 nt, Homo sapiens
ucaacaauaaagacug

SEQ ID NO: 2044392 - RNA, 19 nt, Homo sapiens
uguuuaaauucacaucuca

SEQ ID NO: 2044393 - RNA, 14 nt, Homo sapiens
uucacuacuuuaau

SEQ ID NO: 2044394 - RNA, 12 nt, Homo sapiens
ccagagcagcuc

SEQ ID NO: 2044395 - RNA, 20 nt, Homo sapiens
ccaaauuuaauuaaagccuu

SEQ ID NO: 2044396 - RNA, 15 nt, Homo sapiens
uagaaugggauguga

SEQ ID NO: 2044397 - RNA, 18 nt, Homo sapiens
aggcauuuuuccaaagga

SEQ ID NO: 2044398 - RNA, 20 nt, Homo sapiens
uauuuaaauguaaagacaaa

SEQ ID NO: 2044399 - RNA, 22 nt, Homo sapiens
ucaaacgugaaaaugcuguauu

SEQ ID NO: 2044400 - RNA, 21 nt, Homo sapiens
uugucaauauuaaauacagac

SEQ ID NO: 2044401 - RNA, 23 nt, Homo sapiens
gccuccaggcaggacgagacucc

SEQ ID NO: 2044402 - RNA, 20 nt, Homo sapiens
cggacaagcagcuggugcuc

SEQ ID NO: 2044403 - RNA, 20 nt, Homo sapiens
gaggucagaggggacucuga

SEQ ID NO: 2044404 - RNA, 23 nt, Homo sapiens
gaagcagcgagugcaugggcuaa

SEQ ID NO: 2044405 - RNA, 19 nt, Homo sapiens
uggcuuggugagucugugu

SEQ ID NO: 2044406 - RNA, 20 nt, Homo sapiens
ucagauacuugugaacaugc

SEQ ID NO: 2044407 - RNA, 18 nt, Homo sapiens
agccuccauccuaccccc

SEQ ID NO: 2044408 - RNA, 23 nt, Homo sapiens
aaauguaccuucuuucacucugu

SEQ ID NO: 2044409 - RNA, 23 nt, Homo sapiens
cagguugugugugugugcaguga

SEQ ID NO: 2044410 - RNA, 16 nt, Homo sapiens
ucccuucccauaagcu

SEQ ID NO: 2044411 - RNA, 12 nt, Homo sapiens
uuaaauaaucuc

SEQ ID NO: 2044412 - RNA, 12 nt, Homo sapiens
auucagugacau

SEQ ID NO: 2044413 - RNA, 20 nt, Homo sapiens
ucguacaugaauaauaauac

SEQ ID NO: 2044414 - RNA, 17 nt, Homo sapiens
caguucucuacucccuc

SEQ ID NO: 2044415 - RNA, 12 nt, Homo sapiens
ugagaacauucc

SEQ ID NO: 2044416 - RNA, 11 nt, Homo sapiens
uuugcauuugg

SEQ ID NO: 2044417 - RNA, 16 nt, Homo sapiens
acagaaauacaugaaa

SEQ ID NO: 2044418 - RNA, 13 nt, Homo sapiens
agccucacugggg

SEQ ID NO: 2044419 - RNA, 23 nt, Homo sapiens
guaguuaaagggcagaaggggaa

SEQ ID NO: 2044420 - RNA, 20 nt, Homo sapiens
cccagccucuagaacagcca

SEQ ID NO: 2044421 - RNA, 18 nt, Homo sapiens
cuauucuggauauuucau

SEQ ID NO: 2044422 - RNA, 18 nt, Homo sapiens
cggggccugucucaguga

SEQ ID NO: 2044423 - RNA, 21 nt, Homo sapiens
guuaucaguaagaaaaagaag

SEQ ID NO: 2044424 - RNA, 22 nt, Homo sapiens
gauaccauuuuauauuucauca

SEQ ID NO: 2044425 - RNA, 23 nt, Homo sapiens
ugacauacccaaaguagccagcu

SEQ ID NO: 2044426 - RNA, 21 nt, Homo sapiens
uaaagaagucauaaacagcau

SEQ ID NO: 2044427 - RNA, 16 nt, Homo sapiens
gcaagcccugcccaca

SEQ ID NO: 2044428 - RNA, 23 nt, Homo sapiens
uccugaaacuauauuuugucaua

SEQ ID NO: 2044429 - RNA, 14 nt, Homo sapiens
acaauuugcccaag

SEQ ID NO: 2044430 - RNA, 17 nt, Homo sapiens
ggaccaguggucucaca

SEQ ID NO: 2044431 - RNA, 22 nt, Homo sapiens
gugcaauguuccguucaucuga

SEQ ID NO: 2044432 - RNA, 16 nt, Homo sapiens
agguugaacuuugcca

SEQ ID NO: 2044433 - RNA, 16 nt, Homo sapiens
aagcauuucagguugu

SEQ ID NO: 2044434 - RNA, 15 nt, Homo sapiens
gagugagcacucacg

SEQ ID NO: 2044435 - RNA, 17 nt, Homo sapiens
uggcacuggaugcagaa

SEQ ID NO: 2044436 - RNA, 15 nt, Homo sapiens
uuuaagaaacauucu

SEQ ID NO: 2044437 - RNA, 19 nt, Homo sapiens
aaacaguagccccaucaca

SEQ ID NO: 2044438 - RNA, 20 nt, Homo sapiens
ccuuuuaccugagacuuuca

SEQ ID NO: 2044439 - RNA, 15 nt, Homo sapiens
cucaucccucuguca

SEQ ID NO: 2044440 - RNA, 22 nt, Homo sapiens
acgugcauggauaugugccagg

SEQ ID NO: 2044441 - RNA, 22 nt, Homo sapiens
gagcacaaucuguucuacucuu

SEQ ID NO: 2044442 - RNA, 14 nt, Homo sapiens
cagugccaugaggg

SEQ ID NO: 2044443 - RNA, 13 nt, Homo sapiens
ucucaucucugua

SEQ ID NO: 2044444 - RNA, 16 nt, Homo sapiens
cauuuggcaaugccau

SEQ ID NO: 2044445 - RNA, 13 nt, Homo sapiens
agggagccuggaa

SEQ ID NO: 2044446 - RNA, 22 nt, Homo sapiens
gccagaggcucuaauguacaau

SEQ ID NO: 2044447 - RNA, 15 nt, Homo sapiens
aaaacuucacugugc

SEQ ID NO: 2044448 - RNA, 21 nt, Homo sapiens
ucugggccucugacucugagu

SEQ ID NO: 2044449 - RNA, 19 nt, Homo sapiens
guauuuaauucauguugcc

SEQ ID NO: 2044450 - RNA, 17 nt, Homo sapiens
aaugacccccaucccau

SEQ ID NO: 2044451 - RNA, 14 nt, Homo sapiens
cugauacaugacug

SEQ ID NO: 2044452 - RNA, 20 nt, Homo sapiens
ggaguagcauggacucuggg

SEQ ID NO: 2044453 - RNA, 18 nt, Homo sapiens
uucuguuggcagagcuuu

SEQ ID NO: 2044454 - RNA, 15 nt, Homo sapiens
ucgcaccugugcugg

SEQ ID NO: 2044455 - RNA, 17 nt, Homo sapiens
aauauccugauuuucag

SEQ ID NO: 2044456 - RNA, 17 nt, Homo sapiens
cucuccaacaucuucaa

SEQ ID NO: 2044457 - RNA, 17 nt, Homo sapiens
augagcaagacugggcc

SEQ ID NO: 2044458 - RNA, 13 nt, Homo sapiens
ucaccguggaccu

SEQ ID NO: 2044459 - RNA, 13 nt, Homo sapiens
caugcugcuacaa

SEQ ID NO: 2044460 - RNA, 21 nt, Homo sapiens
aucuugaauuguaaggaauga

SEQ ID NO: 2044461 - RNA, 17 nt, Homo sapiens
uacuauucccuuugacu

SEQ ID NO: 2044462 - RNA, 12 nt, Homo sapiens
caacccugugac

SEQ ID NO: 2044463 - RNA, 13 nt, Homo sapiens
uagcucuguccac

SEQ ID NO: 2044464 - RNA, 18 nt, Homo sapiens
uaccuaaaauugcaacuu

SEQ ID NO: 2044465 - RNA, 14 nt, Homo sapiens
auugaggcuuugug

SEQ ID NO: 2044466 - RNA, 22 nt, Homo sapiens
ccuggagaaggcauuccagggu

SEQ ID NO: 2044467 - RNA, 12 nt, Homo sapiens
acuuguguuacu

SEQ ID NO: 2044468 - RNA, 22 nt, Homo sapiens
uccuuauuuaucaacaucuuuu

SEQ ID NO: 2044469 - RNA, 14 nt, Homo sapiens
gugguuccaugcag

SEQ ID NO: 2044470 - RNA, 23 nt, Homo sapiens
agaagccucugggucaguggucc

SEQ ID NO: 2044471 - RNA, 22 nt, Homo sapiens
ggguugcggcgugaugucuuca

SEQ ID NO: 2044472 - RNA, 12 nt, Homo sapiens
aaagguauuuau

SEQ ID NO: 2044473 - RNA, 11 nt, Homo sapiens
ccugcauuucu

SEQ ID NO: 2044474 - RNA, 21 nt, Homo sapiens
acuagacaccuucugugcuca

SEQ ID NO: 2044475 - RNA, 13 nt, Homo sapiens
gauuucagcacau

SEQ ID NO: 2044476 - RNA, 13 nt, Homo sapiens
uugucaccuguga

SEQ ID NO: 2044477 - RNA, 17 nt, Homo sapiens
cugucugucuucuccua

SEQ ID NO: 2044478 - RNA, 14 nt, Homo sapiens
aacugggguugagg

SEQ ID NO: 2044479 - RNA, 13 nt, Homo sapiens
aaccacccaaaac

SEQ ID NO: 2044480 - RNA, 13 nt, Homo sapiens
uggaaaagcacuu

SEQ ID NO: 2044481 - RNA, 13 nt, Homo sapiens
ugguaaagcacau

SEQ ID NO: 2044482 - RNA, 20 nt, Homo sapiens
uggagcuugcaaugagccaa

SEQ ID NO: 2044483 - RNA, 16 nt, Homo sapiens
cuaaauguaaucacga

SEQ ID NO: 2044484 - RNA, 20 nt, Homo sapiens
gccuguaugcaacaggcacu

SEQ ID NO: 2044485 - RNA, 20 nt, Homo sapiens
cagccugugggagaagggac

SEQ ID NO: 2044486 - RNA, 23 nt, Homo sapiens
aucugaguugccaagacaaauca

SEQ ID NO: 2044487 - RNA, 13 nt, Homo sapiens
ucaguuaacauua

SEQ ID NO: 2044488 - RNA, 17 nt, Homo sapiens
agauuucagauuuguga

SEQ ID NO: 2044489 - RNA, 23 nt, Homo sapiens
uaacuacugcuaauguugaucag

SEQ ID NO: 2044490 - RNA, 21 nt, Homo sapiens
ggaagaaacggaauagugugg

SEQ ID NO: 2044491 - RNA, 12 nt, Homo sapiens
aaccaugugcua

SEQ ID NO: 2044492 - RNA, 22 nt, Homo sapiens
ccaagccaucacaggcucugca

SEQ ID NO: 2044493 - RNA, 20 nt, Homo sapiens
guucauauuaagaaugaucu

SEQ ID NO: 2044494 - RNA, 15 nt, Homo sapiens
ccuagaacaagccac

SEQ ID NO: 2044495 - RNA, 18 nt, Homo sapiens
cuguguagcucuguccac

SEQ ID NO: 2044496 - RNA, 17 nt, Homo sapiens
cuggagccaaguccaga

SEQ ID NO: 2044497 - RNA, 24 nt, Homo sapiens
ugaaauguaggcaucaugcauguc

SEQ ID NO: 2044498 - RNA, 14 nt, Homo sapiens
gcaucuccauuuca

SEQ ID NO: 2044499 - RNA, 20 nt, Homo sapiens
uggaaaguccuccuauucca

SEQ ID NO: 2044500 - RNA, 23 nt, Homo sapiens
ugucagggucaaacuacauugag

SEQ ID NO: 2044501 - RNA, 20 nt, Homo sapiens
ucuuguauaagauccuagau

SEQ ID NO: 2044502 - RNA, 21 nt, Homo sapiens
ugaacagaccggagaggacag

SEQ ID NO: 2044503 - RNA, 18 nt, Homo sapiens
guguugccagagccuuaa

SEQ ID NO: 2044504 - RNA, 15 nt, Homo sapiens
ugguagccucacuuu

SEQ ID NO: 2044505 - RNA, 22 nt, Homo sapiens
uagccuggauauuauucuugua

SEQ ID NO: 2044506 - RNA, 15 nt, Homo sapiens
cugucagaaugcuau

SEQ ID NO: 2044507 - RNA, 15 nt, Homo sapiens
ccugagcacucuuau

SEQ ID NO: 2044508 - RNA, 13 nt, Homo sapiens
ucuacucuugaga

SEQ ID NO: 2044509 - RNA, 17 nt, Homo sapiens
gggccagacccugccca

SEQ ID NO: 2044510 - RNA, 13 nt, Homo sapiens
cuaggagacaucu

SEQ ID NO: 2044511 - RNA, 19 nt, Homo sapiens
ccaggcuggagugcaaugg

SEQ ID NO: 2044512 - RNA, 17 nt, Homo sapiens
gcuugguggccugggau

SEQ ID NO: 2044513 - RNA, 22 nt, Homo sapiens
cuccuuggauguagucaguuag

SEQ ID NO: 2044514 - RNA, 17 nt, Homo sapiens
uucucuguaaggcaaaa

SEQ ID NO: 2044515 - RNA, 19 nt, Homo sapiens
uugaaguguuugcuuuucu

SEQ ID NO: 2044516 - RNA, 20 nt, Homo sapiens
gcaugacgggaaaaccaaac

SEQ ID NO: 2044517 - RNA, 21 nt, Homo sapiens
auagcaacaucuuuugauaau

SEQ ID NO: 2044518 - RNA, 20 nt, Homo sapiens
gacaaaugugaagaugcauu

SEQ ID NO: 2044519 - RNA, 14 nt, Homo sapiens
uaaaaauaaauuca

SEQ ID NO: 2044520 - RNA, 18 nt, Homo sapiens
aucauguguuucugugua

SEQ ID NO: 2044521 - RNA, 15 nt, Homo sapiens
acagggaacagcaaa

SEQ ID NO: 2044522 - RNA, 22 nt, Homo sapiens
gauucaaaguguuguguuccug

SEQ ID NO: 2044523 - RNA, 22 nt, Homo sapiens
aguaaauuuguauaaauaagca

SEQ ID NO: 2044524 - RNA, 23 nt, Homo sapiens
aaugaaauuugcaaaaucacuua

SEQ ID NO: 2044525 - RNA, 13 nt, Homo sapiens
acaacugauugca

SEQ ID NO: 2044526 - RNA, 21 nt, Homo sapiens
auaugaagaaucugcucugaa

SEQ ID NO: 2044527 - RNA, 20 nt, Homo sapiens
gccaagguaggcagaucacc

SEQ ID NO: 2044528 - RNA, 16 nt, Homo sapiens
uacugaguauguggaa

SEQ ID NO: 2044529 - RNA, 21 nt, Homo sapiens
acauacucugcuuagaauuug

SEQ ID NO: 2044530 - RNA, 18 nt, Homo sapiens
ccucuccaccugcauuau

SEQ ID NO: 2044531 - RNA, 22 nt, Homo sapiens
auccugcccucacaucuuccac

SEQ ID NO: 2044532 - RNA, 22 nt, Homo sapiens
aagcaaggugucccugccuuca

SEQ ID NO: 2044533 - RNA, 11 nt, Homo sapiens
cuuucuugcag

SEQ ID NO: 2044534 - RNA, 17 nt, Homo sapiens
cuaccuuuguccaggcc

SEQ ID NO: 2044535 - RNA, 18 nt, Homo sapiens
gaaagcauuuucucucau

SEQ ID NO: 2044536 - RNA, 16 nt, Homo sapiens
gucuccaaguagucca

SEQ ID NO: 2044537 - RNA, 17 nt, Homo sapiens
aggccuuacuuaaaccc

SEQ ID NO: 2044538 - RNA, 21 nt, Homo sapiens
gauacuuagaccaaaagcaac

SEQ ID NO: 2044539 - RNA, 19 nt, Homo sapiens
ugccuggugggccacgugu

SEQ ID NO: 2044540 - RNA, 20 nt, Homo sapiens
ucucuaauagaaguccauga

SEQ ID NO: 2044541 - RNA, 17 nt, Homo sapiens
cagacagcagcuggacu

SEQ ID NO: 2044542 - RNA, 14 nt, Homo sapiens
gucccaugcauaac

SEQ ID NO: 2044543 - RNA, 15 nt, Homo sapiens
uaauaauauguacua

SEQ ID NO: 2044544 - RNA, 22 nt, Homo sapiens
caggccgccccagccucugagc

SEQ ID NO: 2044545 - RNA, 20 nt, Homo sapiens
auguauauuugaacuccucu

SEQ ID NO: 2044546 - RNA, 18 nt, Homo sapiens
acagugccaacauuuaaa

SEQ ID NO: 2044547 - RNA, 23 nt, Homo sapiens
agguccuccucucucuacuugaa

SEQ ID NO: 2044548 - RNA, 22 nt, Homo sapiens
ccagccuggccaacauggugaa

SEQ ID NO: 2044549 - RNA, 15 nt, Homo sapiens
ugcucaguggaucac

SEQ ID NO: 2044550 - RNA, 19 nt, Homo sapiens
uccuacagcuaacccucac

SEQ ID NO: 2044551 - RNA, 22 nt, Homo sapiens
gccuucaccuucaccuucaucc

SEQ ID NO: 2044552 - RNA, 12 nt, Homo sapiens
ugaaauaccuca

SEQ ID NO: 2044553 - RNA, 15 nt, Homo sapiens
aaauguaauagccaa

SEQ ID NO: 2044554 - RNA, 19 nt, Homo sapiens
gccaauaccguguggccca

SEQ ID NO: 2044555 - RNA, 18 nt, Homo sapiens
auaaauccuuaacauuuc

SEQ ID NO: 2044556 - RNA, 21 nt, Homo sapiens
uauaugcuuguguaacaggaa

SEQ ID NO: 2044557 - RNA, 22 nt, Homo sapiens
agcccaagaguuagaacaguug

SEQ ID NO: 2044558 - RNA, 18 nt, Homo sapiens
uucuccagaccaaagcaa

SEQ ID NO: 2044559 - RNA, 15 nt, Homo sapiens
auaauauuuuuacag

SEQ ID NO: 2044560 - RNA, 21 nt, Homo sapiens
auacugaggaaugucuuucag

SEQ ID NO: 2044561 - RNA, 16 nt, Homo sapiens
aucgauauuagaagcu

SEQ ID NO: 2044562 - RNA, 16 nt, Homo sapiens
caggacagccacagcc

SEQ ID NO: 2044563 - RNA, 17 nt, Homo sapiens
cauaauuauuuuguuga

SEQ ID NO: 2044564 - RNA, 14 nt, Homo sapiens
gaugagagggaaaa

SEQ ID NO: 2044565 - RNA, 12 nt, Homo sapiens
ucugggggaccc

SEQ ID NO: 2044566 - RNA, 20 nt, Homo sapiens
ucaggcaugaagaagccacu

SEQ ID NO: 2044567 - RNA, 19 nt, Homo sapiens
agugauucuccugccucag

SEQ ID NO: 2044568 - RNA, 14 nt, Homo sapiens
uucugggucuccag

SEQ ID NO: 2044569 - RNA, 14 nt, Homo sapiens
gaaggcaaugccau

SEQ ID NO: 2044570 - RNA, 19 nt, Homo sapiens
gcaugugccuguauuccca

SEQ ID NO: 2044571 - RNA, 14 nt, Homo sapiens
aaauggcuaugaac

SEQ ID NO: 2044572 - RNA, 19 nt, Homo sapiens
ccauuuuggaaguuuucag

SEQ ID NO: 2044573 - RNA, 20 nt, Homo sapiens
aaucuaccugcccuaaggga

SEQ ID NO: 2044574 - RNA, 15 nt, Homo sapiens
cuauuuauaaacaga

SEQ ID NO: 2044575 - RNA, 18 nt, Homo sapiens
uggaacugcugccacuga

SEQ ID NO: 2044576 - RNA, 21 nt, Homo sapiens
agagagggaggcacguaggaa

SEQ ID NO: 2044577 - RNA, 19 nt, Homo sapiens
gauacuccaaccauaugga

SEQ ID NO: 2044578 - RNA, 23 nt, Homo sapiens
aauuguagacagccuuccagugg

SEQ ID NO: 2044579 - RNA, 22 nt, Homo sapiens
aaaauguccucccuuguggcuu

SEQ ID NO: 2044580 - RNA, 17 nt, Homo sapiens
uaugcuacaaucugugu

SEQ ID NO: 2044581 - RNA, 12 nt, Homo sapiens
accggugccaaa

SEQ ID NO: 2044582 - RNA, 22 nt, Homo sapiens
cguuggucuugaacuccugacc

SEQ ID NO: 2044583 - RNA, 15 nt, Homo sapiens
auguauucuuggcua

SEQ ID NO: 2044584 - RNA, 21 nt, Homo sapiens
uuccagaagaaagauggaaau

SEQ ID NO: 2044585 - RNA, 17 nt, Homo sapiens
cugggcacgcacugggu

SEQ ID NO: 2044586 - RNA, 24 nt, Homo sapiens
cuaaugaaacaaaaaauauucauc

SEQ ID NO: 2044587 - RNA, 22 nt, Homo sapiens
gcaguuugaagucaaaugucac

SEQ ID NO: 2044588 - RNA, 16 nt, Homo sapiens
ggcuaucguuagugcu

SEQ ID NO: 2044589 - RNA, 22 nt, Homo sapiens
aacaagagaaaaaacuagagcc

SEQ ID NO: 2044590 - RNA, 19 nt, Homo sapiens
aucuaauuuaauauuccug

SEQ ID NO: 2044591 - RNA, 18 nt, Homo sapiens
caaccuggguccaaauaa

SEQ ID NO: 2044592 - RNA, 20 nt, Homo sapiens
agauccugcauuuauggugu

SEQ ID NO: 2044593 - RNA, 20 nt, Homo sapiens
uccugaugacagaacacaga

SEQ ID NO: 2044594 - RNA, 22 nt, Homo sapiens
gagauuaaguccagaaauguac

SEQ ID NO: 2044595 - RNA, 15 nt, Homo sapiens
auccuugaugaaucu

SEQ ID NO: 2044596 - RNA, 21 nt, Homo sapiens
cuauuguuacauuauguggaa

SEQ ID NO: 2044597 - RNA, 18 nt, Homo sapiens
uggaauacagucauucca

SEQ ID NO: 2044598 - RNA, 18 nt, Homo sapiens
acaaaccacaacugacac

SEQ ID NO: 2044599 - RNA, 15 nt, Homo sapiens
uagugaugaaccaga

SEQ ID NO: 2044600 - RNA, 20 nt, Homo sapiens
aucuccagauggaauggggu

SEQ ID NO: 2044601 - RNA, 21 nt, Homo sapiens
ucaaguauuuuugacauuuac

SEQ ID NO: 2044602 - RNA, 21 nt, Homo sapiens
caaggaggucgggauggggcu

SEQ ID NO: 2044603 - RNA, 12 nt, Homo sapiens
auugagcaccug

SEQ ID NO: 2044604 - RNA, 20 nt, Homo sapiens
aguuggaguugacugcucau

SEQ ID NO: 2044605 - RNA, 18 nt, Homo sapiens
agacgggguuugccaugc

SEQ ID NO: 2044606 - RNA, 23 nt, Homo sapiens
cauugaccgcgacuaauuucaaa

SEQ ID NO: 2044607 - RNA, 18 nt, Homo sapiens
ucuauugauacaauauug

SEQ ID NO: 2044608 - RNA, 17 nt, Homo sapiens
gcaagaaggagcucagu

SEQ ID NO: 2044609 - RNA, 22 nt, Homo sapiens
aagggugaggcugacacagcca

SEQ ID NO: 2044610 - RNA, 23 nt, Homo sapiens
cacauagaggccuucccauccag

SEQ ID NO: 2044611 - RNA, 23 nt, Homo sapiens
aauauuuccaucagcccaucuca

SEQ ID NO: 2044612 - RNA, 15 nt, Homo sapiens
ugacucacaguaggg

SEQ ID NO: 2044613 - RNA, 13 nt, Homo sapiens
aaguaaacaguca

SEQ ID NO: 2044614 - RNA, 13 nt, Homo sapiens
cacacacaccgau

SEQ ID NO: 2044615 - RNA, 20 nt, Homo sapiens
aaaugccacguggucacugu

SEQ ID NO: 2044616 - RNA, 16 nt, Homo sapiens
cagaacgagacuccac

SEQ ID NO: 2044617 - RNA, 21 nt, Homo sapiens
ccccaaguccuggugucucca

SEQ ID NO: 2044618 - RNA, 20 nt, Homo sapiens
uaucuugaaggaaaaauuca

SEQ ID NO: 2044619 - RNA, 14 nt, Homo sapiens
gaaaaauugccaau

SEQ ID NO: 2044620 - RNA, 16 nt, Homo sapiens
cugaccucuugcugcc

SEQ ID NO: 2044621 - RNA, 14 nt, Homo sapiens
caccccucaucagg

SEQ ID NO: 2044622 - RNA, 17 nt, Homo sapiens
ucaggaguuggagacca

SEQ ID NO: 2044623 - RNA, 14 nt, Homo sapiens
caaacugauacaga

SEQ ID NO: 2044624 - RNA, 17 nt, Homo sapiens
guucuucuuaaagucaa

SEQ ID NO: 2044625 - RNA, 13 nt, Homo sapiens
gaaaacucuucau

SEQ ID NO: 2044626 - RNA, 20 nt, Homo sapiens
uauuuccuucucauaaccuc

SEQ ID NO: 2044627 - RNA, 18 nt, Homo sapiens
uacuuaacauuucauugu

SEQ ID NO: 2044628 - RNA, 13 nt, Homo sapiens
ccuaccccaguuc

SEQ ID NO: 2044629 - RNA, 15 nt, Homo sapiens
ucccaggaaguccag

SEQ ID NO: 2044630 - RNA, 15 nt, Homo sapiens
acucaggaugcccag

SEQ ID NO: 2044631 - RNA, 14 nt, Homo sapiens
gcucuguugcccaa

SEQ ID NO: 2044632 - RNA, 22 nt, Homo sapiens
ugaaaaaauacccucugacugu

SEQ ID NO: 2044633 - RNA, 14 nt, Homo sapiens
gacuucuagcagaa

SEQ ID NO: 2044634 - RNA, 21 nt, Homo sapiens
gaagaccuaaagugcuugcuu

SEQ ID NO: 2044635 - RNA, 15 nt, Homo sapiens
uacaugcauacuuca

SEQ ID NO: 2044636 - RNA, 15 nt, Homo sapiens
ucaaggcaucaugca

SEQ ID NO: 2044637 - RNA, 21 nt, Homo sapiens
cugcccagcuuuguucugagg

SEQ ID NO: 2044638 - RNA, 21 nt, Homo sapiens
auguuacuaaaugguguuaca

SEQ ID NO: 2044639 - RNA, 17 nt, Homo sapiens
caguuuaccauccucaa

SEQ ID NO: 2044640 - RNA, 16 nt, Homo sapiens
ccuagucuucugugua

SEQ ID NO: 2044641 - RNA, 18 nt, Homo sapiens
cugaccaaagagaagcaa

SEQ ID NO: 2044642 - RNA, 23 nt, Homo sapiens
cuggaagaaacaguccaguacuu

SEQ ID NO: 2044643 - RNA, 21 nt, Homo sapiens
uaagacaauaggccauguuaa

SEQ ID NO: 2044644 - RNA, 24 nt, Homo sapiens
ccagagggaccggaguuaugacaa

SEQ ID NO: 2044645 - RNA, 16 nt, Homo sapiens
aauguauuaguacaaa

SEQ ID NO: 2044646 - RNA, 21 nt, Homo sapiens
ugguggccacgagguuaaaga

SEQ ID NO: 2044647 - RNA, 13 nt, Homo sapiens
guaguucucagga

SEQ ID NO: 2044648 - RNA, 20 nt, Homo sapiens
guucgcauugaacucuacaa

SEQ ID NO: 2044649 - RNA, 21 nt, Homo sapiens
cugaaauucuucaacuuggaa

SEQ ID NO: 2044650 - RNA, 15 nt, Homo sapiens
cuuacuuauucuucc

SEQ ID NO: 2044651 - RNA, 16 nt, Homo sapiens
gaauauauuuccuuau

SEQ ID NO: 2044652 - RNA, 21 nt, Homo sapiens
aucccgaagaauggagaggaa

SEQ ID NO: 2044653 - RNA, 16 nt, Homo sapiens
gcaaauccacuagcac

SEQ ID NO: 2044654 - RNA, 19 nt, Homo sapiens
uuagcuggccauucaggua

SEQ ID NO: 2044655 - RNA, 20 nt, Homo sapiens
ccauuuuagcaucuacuugu

SEQ ID NO: 2044656 - RNA, 12 nt, Homo sapiens
uguuggcagcuc

SEQ ID NO: 2044657 - RNA, 22 nt, Homo sapiens
cucauuguuuauuaacaaauua

SEQ ID NO: 2044658 - RNA, 18 nt, Homo sapiens
ucugcauccuggcuugaa

SEQ ID NO: 2044659 - RNA, 13 nt, Homo sapiens
uuguuuacagcaa

SEQ ID NO: 2044660 - RNA, 21 nt, Homo sapiens
uuaaucauuaggaaacacuga

SEQ ID NO: 2044661 - RNA, 16 nt, Homo sapiens
cauaaggcuucaaaau

SEQ ID NO: 2044662 - RNA, 22 nt, Homo sapiens
uccuggcacaguuuuuguaaag

SEQ ID NO: 2044663 - RNA, 20 nt, Homo sapiens
guacacugugucucuaugug

SEQ ID NO: 2044664 - RNA, 15 nt, Homo sapiens
ucuucuuugccuucu

SEQ ID NO: 2044665 - RNA, 19 nt, Homo sapiens
aagccauguguuccaaggc

SEQ ID NO: 2044666 - RNA, 17 nt, Homo sapiens
cucuaucugaaauccca

SEQ ID NO: 2044667 - RNA, 18 nt, Homo sapiens
agguccgguguucuaaga

SEQ ID NO: 2044668 - RNA, 13 nt, Homo sapiens
ugcccugccucag

SEQ ID NO: 2044669 - RNA, 19 nt, Homo sapiens
aguauacugggggcaaaau

SEQ ID NO: 2044670 - RNA, 19 nt, Homo sapiens
ccuuuccugcgccccagac

SEQ ID NO: 2044671 - RNA, 15 nt, Homo sapiens
gcacccccuggagag

SEQ ID NO: 2044672 - RNA, 16 nt, Homo sapiens
gcuauccaggauuuug

SEQ ID NO: 2044673 - RNA, 15 nt, Homo sapiens
caaucucucucugug

SEQ ID NO: 2044674 - RNA, 17 nt, Homo sapiens
gacaggacgaggcagaa

SEQ ID NO: 2044675 - RNA, 21 nt, Homo sapiens
caccuccuccaagaagcccuc

SEQ ID NO: 2044676 - RNA, 19 nt, Homo sapiens
ugcuggccgggcacagcug

SEQ ID NO: 2044677 - RNA, 22 nt, Homo sapiens
aaccugucuccacugugccuuu

SEQ ID NO: 2044678 - RNA, 21 nt, Homo sapiens
uauuuugcuuguuaaauucua

SEQ ID NO: 2044679 - RNA, 15 nt, Homo sapiens
aaccacaauauguau

SEQ ID NO: 2044680 - RNA, 13 nt, Homo sapiens
acauaaguaucau

SEQ ID NO: 2044681 - RNA, 20 nt, Homo sapiens
ugaagucagaucugccuaag

SEQ ID NO: 2044682 - RNA, 18 nt, Homo sapiens
aacuugucacaaagugag

SEQ ID NO: 2044683 - RNA, 18 nt, Homo sapiens
aaauuuuagugugccuuc

SEQ ID NO: 2044684 - RNA, 11 nt, Homo sapiens
gagauaugcac

SEQ ID NO: 2044685 - RNA, 22 nt, Homo sapiens
uccagagguauuccucucuuaa

SEQ ID NO: 2044686 - RNA, 15 nt, Homo sapiens
accuuccucucccaa

SEQ ID NO: 2044687 - RNA, 21 nt, Homo sapiens
gacaauauuccagaucuuuca

SEQ ID NO: 2044688 - RNA, 20 nt, Homo sapiens
aguacagcaugugccuuaau

SEQ ID NO: 2044689 - RNA, 19 nt, Homo sapiens
uaagaaugugugugcagaa

SEQ ID NO: 2044690 - RNA, 22 nt, Homo sapiens
aaaggauaugaacucaucauuu

SEQ ID NO: 2044691 - RNA, 20 nt, Homo sapiens
ccaaaauuaccaaaaaucuu

SEQ ID NO: 2044692 - RNA, 17 nt, Homo sapiens
uccauaucuaaccagug

SEQ ID NO: 2044693 - RNA, 21 nt, Homo sapiens
aucacagcuaacaauugugaa

SEQ ID NO: 2044694 - RNA, 21 nt, Homo sapiens
gccucuuccuguugugacugc

SEQ ID NO: 2044695 - RNA, 21 nt, Homo sapiens
cuuacacauaaagcacuaccu

SEQ ID NO: 2044696 - RNA, 21 nt, Homo sapiens
cuguuucagugugagucagaa

SEQ ID NO: 2044697 - RNA, 12 nt, Homo sapiens
acaaauugagac

SEQ ID NO: 2044698 - RNA, 16 nt, Homo sapiens
aagagguuuguauaua

SEQ ID NO: 2044699 - RNA, 13 nt, Homo sapiens
ucacaucucugcc

SEQ ID NO: 2044700 - RNA, 16 nt, Homo sapiens
uugauaccaccuauau

SEQ ID NO: 2044701 - RNA, 13 nt, Homo sapiens
guaacuuacuuag

SEQ ID NO: 2044702 - RNA, 13 nt, Homo sapiens
guuuaugucauca

SEQ ID NO: 2044703 - RNA, 20 nt, Homo sapiens
gcuuucuaccacacacagcc

SEQ ID NO: 2044704 - RNA, 18 nt, Homo sapiens
caauuccugugauuuaug

SEQ ID NO: 2044705 - RNA, 13 nt, Homo sapiens
gcuuuaauauuca

SEQ ID NO: 2044706 - RNA, 18 nt, Homo sapiens
gugaguauugcuuauaug

SEQ ID NO: 2044707 - RNA, 14 nt, Homo sapiens
ucccugagagccac

SEQ ID NO: 2044708 - RNA, 16 nt, Homo sapiens
guaauaugaaugcugu

SEQ ID NO: 2044709 - RNA, 19 nt, Homo sapiens
cagugaguucagccuuuaa

SEQ ID NO: 2044710 - RNA, 19 nt, Homo sapiens
ccugccauagucagacuuc

SEQ ID NO: 2044711 - RNA, 13 nt, Homo sapiens
uuuaaguugugau

SEQ ID NO: 2044712 - RNA, 14 nt, Homo sapiens
acugccacccuuga

SEQ ID NO: 2044713 - RNA, 20 nt, Homo sapiens
cugucauugcgaccauuucu

SEQ ID NO: 2044714 - RNA, 20 nt, Homo sapiens
ugaugagagaauggagacag

SEQ ID NO: 2044715 - RNA, 17 nt, Homo sapiens
aaggggacuggauccca

SEQ ID NO: 2044716 - RNA, 17 nt, Homo sapiens
uauggcugccugcaucu

SEQ ID NO: 2044717 - RNA, 15 nt, Homo sapiens
ccucagccucucaaa

SEQ ID NO: 2044718 - RNA, 17 nt, Homo sapiens
caccauguauuuuguaa

SEQ ID NO: 2044719 - RNA, 22 nt, Homo sapiens
gcuuccagggggcagcccagug

SEQ ID NO: 2044720 - RNA, 17 nt, Homo sapiens
cugcgugugauaagcaa

SEQ ID NO: 2044721 - RNA, 16 nt, Homo sapiens
uuaaaaggaaacugua

SEQ ID NO: 2044722 - RNA, 19 nt, Homo sapiens
gauaccacuuaacagguuu

SEQ ID NO: 2044723 - RNA, 19 nt, Homo sapiens
caauacgccuuuaaagguu

SEQ ID NO: 2044724 - RNA, 20 nt, Homo sapiens
guccucgcacugcccaggga

SEQ ID NO: 2044725 - RNA, 16 nt, Homo sapiens
gcaaacaaaaccaauu

SEQ ID NO: 2044726 - RNA, 15 nt, Homo sapiens
ucuaagccaacuuua

SEQ ID NO: 2044727 - RNA, 12 nt, Homo sapiens
augcacuggccu

SEQ ID NO: 2044728 - RNA, 23 nt, Homo sapiens
uuucuguugcuguuaaaauugcu

SEQ ID NO: 2044729 - RNA, 18 nt, Homo sapiens
aauaaauauuuaaugaau

SEQ ID NO: 2044730 - RNA, 22 nt, Homo sapiens
gagcucuuaacuacaguggcug

SEQ ID NO: 2044731 - RNA, 21 nt, Homo sapiens
caggaccacucaguuaaggaa

SEQ ID NO: 2044732 - RNA, 19 nt, Homo sapiens
cuuuaaucauggagcaaga

SEQ ID NO: 2044733 - RNA, 12 nt, Homo sapiens
aaaccacagcca

SEQ ID NO: 2044734 - RNA, 18 nt, Homo sapiens
auauuaugaccacacaca

SEQ ID NO: 2044735 - RNA, 14 nt, Homo sapiens
guugugcaagcuag

SEQ ID NO: 2044736 - RNA, 23 nt, Homo sapiens
guuuaguuuaacuuccacuguua

SEQ ID NO: 2044737 - RNA, 19 nt, Homo sapiens
uuacauuuacaaacugaag

SEQ ID NO: 2044738 - RNA, 21 nt, Homo sapiens
gcaugugcccuccugagggag

SEQ ID NO: 2044739 - RNA, 14 nt, Homo sapiens
aacauuugccaaac

SEQ ID NO: 2044740 - RNA, 14 nt, Homo sapiens
ugggauguacuguu

SEQ ID NO: 2044741 - RNA, 17 nt, Homo sapiens
gaagagaguauggugcu

SEQ ID NO: 2044742 - RNA, 20 nt, Homo sapiens
guaccuauuuucauuguaaa

SEQ ID NO: 2044743 - RNA, 13 nt, Homo sapiens
agacaaaguuuug

SEQ ID NO: 2044744 - RNA, 13 nt, Homo sapiens
uuucaaagagaug

SEQ ID NO: 2044745 - RNA, 18 nt, Homo sapiens
aaccaucaaaguggcaaa

SEQ ID NO: 2044746 - RNA, 22 nt, Homo sapiens
uuguaaaguguuagauggaaaa

SEQ ID NO: 2044747 - RNA, 18 nt, Homo sapiens
caucuauucaagcacuua

SEQ ID NO: 2044748 - RNA, 21 nt, Homo sapiens
acuguacacagaauuguucca

SEQ ID NO: 2044749 - RNA, 18 nt, Homo sapiens
caauaaauccuuuacuuu

SEQ ID NO: 2044750 - RNA, 20 nt, Homo sapiens
aagauaugccacuaacuucu

SEQ ID NO: 2044751 - RNA, 15 nt, Homo sapiens
aacaaaacaaacuuc

SEQ ID NO: 2044752 - RNA, 20 nt, Homo sapiens
gaccccuccucacuggccau

SEQ ID NO: 2044753 - RNA, 21 nt, Homo sapiens
aaaacacacuacuaccucuua

SEQ ID NO: 2044754 - RNA, 15 nt, Homo sapiens
gcuauucuccauacu

SEQ ID NO: 2044755 - RNA, 21 nt, Homo sapiens
gcaauccacaaucugacauuc

SEQ ID NO: 2044756 - RNA, 18 nt, Homo sapiens
caauuaaguccuacuuua

SEQ ID NO: 2044757 - RNA, 16 nt, Homo sapiens
aaagaucaccagccau

SEQ ID NO: 2044758 - RNA, 14 nt, Homo sapiens
auuuuauuacuaau

SEQ ID NO: 2044759 - RNA, 14 nt, Homo sapiens
auagaccaugcaca

SEQ ID NO: 2044760 - RNA, 16 nt, Homo sapiens
gagccuggaagccaaa

SEQ ID NO: 2044761 - RNA, 16 nt, Homo sapiens
aacuuagagacuuuag

SEQ ID NO: 2044762 - RNA, 12 nt, Homo sapiens
agucagcuacaa

SEQ ID NO: 2044763 - RNA, 21 nt, Homo sapiens
agaacaaaagaauaacauuuu

SEQ ID NO: 2044764 - RNA, 18 nt, Homo sapiens
cugaacugaaaggacugu

SEQ ID NO: 2044765 - RNA, 14 nt, Homo sapiens
acgugucaaugugu

SEQ ID NO: 2044766 - RNA, 15 nt, Homo sapiens
cccuuagugacucuu

SEQ ID NO: 2044767 - RNA, 16 nt, Homo sapiens
acggccgucccugacu

SEQ ID NO: 2044768 - RNA, 16 nt, Homo sapiens
cacggaugcacacaca

SEQ ID NO: 2044769 - RNA, 19 nt, Homo sapiens
auggcaauaucuacagcuu

SEQ ID NO: 2044770 - RNA, 17 nt, Homo sapiens
ugaaaggcauucucuga

SEQ ID NO: 2044771 - RNA, 15 nt, Homo sapiens
cuuuaauauuugcua

SEQ ID NO: 2044772 - RNA, 14 nt, Homo sapiens
cauguauucaucca

SEQ ID NO: 2044773 - RNA, 18 nt, Homo sapiens
gaugcagaaaauugccua

SEQ ID NO: 2044774 - RNA, 23 nt, Homo sapiens
acuguagguauagaagaucugcc

SEQ ID NO: 2044775 - RNA, 22 nt, Homo sapiens
agagugaccucuagaaaaaaga

SEQ ID NO: 2044776 - RNA, 15 nt, Homo sapiens
auccauucuaccugu

SEQ ID NO: 2044777 - RNA, 16 nt, Homo sapiens
ggccagcagcagauaa

SEQ ID NO: 2044778 - RNA, 21 nt, Homo sapiens
aacaaagauucaugauuuaua

SEQ ID NO: 2044779 - RNA, 21 nt, Homo sapiens
aaacacgccugcaaacgcugc

SEQ ID NO: 2044780 - RNA, 20 nt, Homo sapiens
guccagauuuacacugggag

SEQ ID NO: 2044781 - RNA, 22 nt, Homo sapiens
gaagauuuguccaccucugauu

SEQ ID NO: 2044782 - RNA, 20 nt, Homo sapiens
aaaugagucccuguccccac

SEQ ID NO: 2044783 - RNA, 20 nt, Homo sapiens
aacaggaugauggcacugag

SEQ ID NO: 2044784 - RNA, 23 nt, Homo sapiens
ugucucaugucaaugaccauuca

SEQ ID NO: 2044785 - RNA, 16 nt, Homo sapiens
acaaaaucagauugau

SEQ ID NO: 2044786 - RNA, 18 nt, Homo sapiens
auuuaaagggugauguac

SEQ ID NO: 2044787 - RNA, 19 nt, Homo sapiens
cugagccaaacacacugua

SEQ ID NO: 2044788 - RNA, 15 nt, Homo sapiens
ucacagcucacugca

SEQ ID NO: 2044789 - RNA, 18 nt, Homo sapiens
aacauuugcaaaauggaa

SEQ ID NO: 2044790 - RNA, 15 nt, Homo sapiens
uaugcauugaugguu

SEQ ID NO: 2044791 - RNA, 21 nt, Homo sapiens
cgaaucacacagacaguuucu

SEQ ID NO: 2044792 - RNA, 21 nt, Homo sapiens
uauagcacuuugaaauaccuc

SEQ ID NO: 2044793 - RNA, 15 nt, Homo sapiens
ccccaaggcugcaaa

SEQ ID NO: 2044794 - RNA, 18 nt, Homo sapiens
agaugacagugaugcugc

SEQ ID NO: 2044795 - RNA, 15 nt, Homo sapiens
ucacuugacucuuga

SEQ ID NO: 2044796 - RNA, 14 nt, Homo sapiens
gacuucaucuucaa

SEQ ID NO: 2044797 - RNA, 18 nt, Homo sapiens
agcauuuccaacaccaca

SEQ ID NO: 2044798 - RNA, 17 nt, Homo sapiens
caacucuaacucugaga

SEQ ID NO: 2044799 - RNA, 23 nt, Homo sapiens
cuaccuugacuugaaaugcucuu

SEQ ID NO: 2044800 - RNA, 14 nt, Homo sapiens
ugacacauuacaaa

SEQ ID NO: 2044801 - RNA, 18 nt, Homo sapiens
ugagccaguuagacuagu

SEQ ID NO: 2044802 - RNA, 16 nt, Homo sapiens
ccaaggagcaugucac

SEQ ID NO: 2044803 - RNA, 18 nt, Homo sapiens
uucuuugguguaaucucu

SEQ ID NO: 2044804 - RNA, 18 nt, Homo sapiens
acaggugacaugaacuac

SEQ ID NO: 2044805 - RNA, 19 nt, Homo sapiens
aaacugcaaaugugcaguu

SEQ ID NO: 2044806 - RNA, 16 nt, Homo sapiens
uuauaugcacauuucu

SEQ ID NO: 2044807 - RNA, 15 nt, Homo sapiens
aucagcucucugcaa

SEQ ID NO: 2044808 - RNA, 23 nt, Homo sapiens
gcauagcuguuuuagcugaggga

SEQ ID NO: 2044809 - RNA, 15 nt, Homo sapiens
ugaauguaugugcac

SEQ ID NO: 2044810 - RNA, 16 nt, Homo sapiens
auucuaacaagucaua

SEQ ID NO: 2044811 - RNA, 19 nt, Homo sapiens
cuauauaauaaagcuacug

SEQ ID NO: 2044812 - RNA, 13 nt, Homo sapiens
aucgagaccaucc

SEQ ID NO: 2044813 - RNA, 22 nt, Homo sapiens
auucaaauguuuuaaaguuuaa

SEQ ID NO: 2044814 - RNA, 22 nt, Homo sapiens
uuuugucugcuuaguaucucau

SEQ ID NO: 2044815 - RNA, 18 nt, Homo sapiens
cuggugaacacugugacc

SEQ ID NO: 2044816 - RNA, 15 nt, Homo sapiens
agagucuccaguuua

SEQ ID NO: 2044817 - RNA, 13 nt, Homo sapiens
uaaaguaccuuga

SEQ ID NO: 2044818 - RNA, 12 nt, Homo sapiens
agaaacaucuca

SEQ ID NO: 2044819 - RNA, 12 nt, Homo sapiens
uuuguuguaaaa

SEQ ID NO: 2044820 - RNA, 16 nt, Homo sapiens
ugucacacuuugccaa

SEQ ID NO: 2044821 - RNA, 17 nt, Homo sapiens
uuacuggacauaacauu

SEQ ID NO: 2044822 - RNA, 14 nt, Homo sapiens
uggaggauugcuau

SEQ ID NO: 2044823 - RNA, 19 nt, Homo sapiens
cagaggcguuugaaucaga

SEQ ID NO: 2044824 - RNA, 23 nt, Homo sapiens
gaaucaagaggacaaucuagcuc

SEQ ID NO: 2044825 - RNA, 14 nt, Homo sapiens
uuaaaagcccuuuu

SEQ ID NO: 2044826 - RNA, 13 nt, Homo sapiens
gagguugugcaug

SEQ ID NO: 2044827 - RNA, 19 nt, Homo sapiens
ugcuuguguguaugucuau

SEQ ID NO: 2044828 - RNA, 11 nt, Homo sapiens
cugucuaggac

SEQ ID NO: 2044829 - RNA, 20 nt, Homo sapiens
ggcgacaguuuuccuucuca

SEQ ID NO: 2044830 - RNA, 13 nt, Homo sapiens
caccuggccaagc

SEQ ID NO: 2044831 - RNA, 20 nt, Homo sapiens
ucaggccaagaccccagcuu

SEQ ID NO: 2044832 - RNA, 20 nt, Homo sapiens
gcuuuauuuuuuaaguauuu

SEQ ID NO: 2044833 - RNA, 22 nt, Homo sapiens
acacauccccagaauccauaaa

SEQ ID NO: 2044834 - RNA, 21 nt, Homo sapiens
auaguuguuuuauauguugcu

SEQ ID NO: 2044835 - RNA, 17 nt, Homo sapiens
aaaugugaaugaagcua

SEQ ID NO: 2044836 - RNA, 16 nt, Homo sapiens
ggccuuccagugcagg

SEQ ID NO: 2044837 - RNA, 19 nt, Homo sapiens
cccuccagggccacugcuu

SEQ ID NO: 2044838 - RNA, 20 nt, Homo sapiens
gaaugggcuugaaacauuau

SEQ ID NO: 2044839 - RNA, 13 nt, Homo sapiens
ugggaaaggggag

SEQ ID NO: 2044840 - RNA, 22 nt, Homo sapiens
aucccuucccuguccaccucac

SEQ ID NO: 2044841 - RNA, 15 nt, Homo sapiens
aggggcucucucaug

SEQ ID NO: 2044842 - RNA, 23 nt, Homo sapiens
uccuuuuggaacccccacuuuua

SEQ ID NO: 2044843 - RNA, 14 nt, Homo sapiens
ugugggcuucagca

SEQ ID NO: 2044844 - RNA, 12 nt, Homo sapiens
cauuacaaaaga

SEQ ID NO: 2044845 - RNA, 23 nt, Homo sapiens
uccaacccugccgucaccaccac

SEQ ID NO: 2044846 - RNA, 22 nt, Homo sapiens
ugggagauaggccuugcuugcu

SEQ ID NO: 2044847 - RNA, 16 nt, Homo sapiens
cauauugucacugaca

SEQ ID NO: 2044848 - RNA, 11 nt, Homo sapiens
cauugccaagu

SEQ ID NO: 2044849 - RNA, 14 nt, Homo sapiens
ugcuuggcugcugu

SEQ ID NO: 2044850 - RNA, 20 nt, Homo sapiens
acaauccuauuuagcauaug

SEQ ID NO: 2044851 - RNA, 20 nt, Homo sapiens
auuauuuuuguuagcaaaga

SEQ ID NO: 2044852 - RNA, 17 nt, Homo sapiens
cuuuauuaacaaacagg

SEQ ID NO: 2044853 - RNA, 22 nt, Homo sapiens
ccuuucacuuuagaggcuugau

SEQ ID NO: 2044854 - RNA, 18 nt, Homo sapiens
uuugccuuucuucugccc

SEQ ID NO: 2044855 - RNA, 15 nt, Homo sapiens
ccacuucucaucaca

SEQ ID NO: 2044856 - RNA, 21 nt, Homo sapiens
uccuccacauccugugucaga

SEQ ID NO: 2044857 - RNA, 13 nt, Homo sapiens
gaaaaugccucaa

SEQ ID NO: 2044858 - RNA, 17 nt, Homo sapiens
auuaaaagcaaaucauu

SEQ ID NO: 2044859 - RNA, 23 nt, Homo sapiens
cuuguaaaugugguaaagaguua

SEQ ID NO: 2044860 - RNA, 23 nt, Homo sapiens
aaaugucuuuccuuuugcucuua

SEQ ID NO: 2044861 - RNA, 20 nt, Homo sapiens
agcugccucuucucuugaca

SEQ ID NO: 2044862 - RNA, 15 nt, Homo sapiens
gagauagugcuggaa

SEQ ID NO: 2044863 - RNA, 14 nt, Homo sapiens
gaguucaggagaaa

SEQ ID NO: 2044864 - RNA, 22 nt, Homo sapiens
gagcucgcucuugggagucagg

SEQ ID NO: 2044865 - RNA, 15 nt, Homo sapiens
ucccauuucuugcua

SEQ ID NO: 2044866 - RNA, 14 nt, Homo sapiens
uccccuugguucug

SEQ ID NO: 2044867 - RNA, 20 nt, Homo sapiens
caaagaggacucgcuuguaa

SEQ ID NO: 2044868 - RNA, 16 nt, Homo sapiens
augguauuauaucucu

SEQ ID NO: 2044869 - RNA, 23 nt, Homo sapiens
ugcuucaggaaggacauggacaa

SEQ ID NO: 2044870 - RNA, 18 nt, Homo sapiens
acaaacuucuuucacuca

SEQ ID NO: 2044871 - RNA, 18 nt, Homo sapiens
ccagcugcacugaugcug

SEQ ID NO: 2044872 - RNA, 22 nt, Homo sapiens
auuuuuauaugauguauaccca

SEQ ID NO: 2044873 - RNA, 13 nt, Homo sapiens
caaguaugugcua

SEQ ID NO: 2044874 - RNA, 11 nt, Homo sapiens
cagcauuccau

SEQ ID NO: 2044875 - RNA, 16 nt, Homo sapiens
uuaucaguaauuugac

SEQ ID NO: 2044876 - RNA, 17 nt, Homo sapiens
gccuugauaauacuuga

SEQ ID NO: 2044877 - RNA, 17 nt, Homo sapiens
ccacauaugcaaugacu

SEQ ID NO: 2044878 - RNA, 12 nt, Homo sapiens
uaagaaugaaua

SEQ ID NO: 2044879 - RNA, 12 nt, Homo sapiens
uuaaaaugauug

SEQ ID NO: 2044880 - RNA, 12 nt, Homo sapiens
ggcccaggccag

SEQ ID NO: 2044881 - RNA, 22 nt, Homo sapiens
guuguuaacacgugacacugug

SEQ ID NO: 2044882 - RNA, 16 nt, Homo sapiens
auuaccuguuaguauu

SEQ ID NO: 2044883 - RNA, 21 nt, Homo sapiens
ggcuuccauuugugugugugc

SEQ ID NO: 2044884 - RNA, 18 nt, Homo sapiens
cuagggcacuuuaaguca

SEQ ID NO: 2044885 - RNA, 11 nt, Homo sapiens
aaacaaugcca

SEQ ID NO: 2044886 - RNA, 20 nt, Homo sapiens
cacuugcucaaaaucuguga

SEQ ID NO: 2044887 - RNA, 16 nt, Homo sapiens
aagccauucacuuccc

SEQ ID NO: 2044888 - RNA, 14 nt, Homo sapiens
ggcuaacacgguga

SEQ ID NO: 2044889 - RNA, 18 nt, Homo sapiens
aaaauaauaaaagaauca

SEQ ID NO: 2044890 - RNA, 18 nt, Homo sapiens
ugcugcuuugcuucuuca

SEQ ID NO: 2044891 - RNA, 18 nt, Homo sapiens
auuuuacacauugacaau

SEQ ID NO: 2044892 - RNA, 18 nt, Homo sapiens
ucuuuugaaggacuccuu

SEQ ID NO: 2044893 - RNA, 18 nt, Homo sapiens
uaauaggaagaacaguac

SEQ ID NO: 2044894 - RNA, 22 nt, Homo sapiens
acaacaauuuaggaaugcucaa

SEQ ID NO: 2044895 - RNA, 22 nt, Homo sapiens
uuaacagaguuuucuguugcau

SEQ ID NO: 2044896 - RNA, 12 nt, Homo sapiens
cucuucccuggg

SEQ ID NO: 2044897 - RNA, 22 nt, Homo sapiens
ugcuucuaagaugccagcauau

SEQ ID NO: 2044898 - RNA, 13 nt, Homo sapiens
uccaaugcucaag

SEQ ID NO: 2044899 - RNA, 15 nt, Homo sapiens
caaaauaaaccuguu

SEQ ID NO: 2044900 - RNA, 22 nt, Homo sapiens
aaucaaagugucuagacauauu

SEQ ID NO: 2044901 - RNA, 15 nt, Homo sapiens
uugcuaguaccaaaa

SEQ ID NO: 2044902 - RNA, 16 nt, Homo sapiens
cagauggaccaaaaga

SEQ ID NO: 2044903 - RNA, 19 nt, Homo sapiens
ucugugaaugcuaagucca

SEQ ID NO: 2044904 - RNA, 20 nt, Homo sapiens
gugucuuuuaaacauuauuu

SEQ ID NO: 2044905 - RNA, 18 nt, Homo sapiens
gcauuuucuucagaauua

SEQ ID NO: 2044906 - RNA, 23 nt, Homo sapiens
gguaguagaaucucagcacuuug

SEQ ID NO: 2044907 - RNA, 16 nt, Homo sapiens
guuuuuucacugccug

SEQ ID NO: 2044908 - RNA, 16 nt, Homo sapiens
auuguuuggcuuccuc

SEQ ID NO: 2044909 - RNA, 21 nt, Homo sapiens
agccuggaaaaaaacaucaga

SEQ ID NO: 2044910 - RNA, 16 nt, Homo sapiens
auccaagccagaguuu

SEQ ID NO: 2044911 - RNA, 21 nt, Homo sapiens
cugugcagguucccacuuaaa

SEQ ID NO: 2044912 - RNA, 12 nt, Homo sapiens
uaauaaguacuu

SEQ ID NO: 2044913 - RNA, 12 nt, Homo sapiens
uaugaaguacag

SEQ ID NO: 2044914 - RNA, 16 nt, Homo sapiens
auagcuugaagcccaa

SEQ ID NO: 2044915 - RNA, 16 nt, Homo sapiens
cagaagccagaaucac

SEQ ID NO: 2044916 - RNA, 15 nt, Homo sapiens
gagacggccaaguga

SEQ ID NO: 2044917 - RNA, 22 nt, Homo sapiens
cagccuggcgaaaccccaucuc

SEQ ID NO: 2044918 - RNA, 19 nt, Homo sapiens
gaaaccagccaacccaagu

SEQ ID NO: 2044919 - RNA, 16 nt, Homo sapiens
aauuuaagaaacuuau

SEQ ID NO: 2044920 - RNA, 20 nt, Homo sapiens
gaaaaaagcaccaaagggaa

SEQ ID NO: 2044921 - RNA, 15 nt, Homo sapiens
ggugugagcuucaga

SEQ ID NO: 2044922 - RNA, 20 nt, Homo sapiens
gauaucccuuccuacaguaa

SEQ ID NO: 2044923 - RNA, 21 nt, Homo sapiens
ucuaacugaaggugcaguuga

SEQ ID NO: 2044924 - RNA, 17 nt, Homo sapiens
gccaagcuguguucauc

SEQ ID NO: 2044925 - RNA, 17 nt, Homo sapiens
gcaucaauuccaucagc

SEQ ID NO: 2044926 - RNA, 19 nt, Homo sapiens
agaucaugggucaagagau

SEQ ID NO: 2044927 - RNA, 17 nt, Homo sapiens
gaaaagguccuugccuc

SEQ ID NO: 2044928 - RNA, 13 nt, Homo sapiens
uaccuauuugacu

SEQ ID NO: 2044929 - RNA, 19 nt, Homo sapiens
uacauugugggauguucag

SEQ ID NO: 2044930 - RNA, 19 nt, Homo sapiens
agggcaagcucauagcaca

SEQ ID NO: 2044931 - RNA, 23 nt, Homo sapiens
acagacacucccacuuggcauca

SEQ ID NO: 2044932 - RNA, 16 nt, Homo sapiens
cagauggcagugcagc

SEQ ID NO: 2044933 - RNA, 13 nt, Homo sapiens
ccccauuugcaca

SEQ ID NO: 2044934 - RNA, 15 nt, Homo sapiens
cgaaaccccaucucu

SEQ ID NO: 2044935 - RNA, 21 nt, Homo sapiens
aauuucuucuaauaaagucau

SEQ ID NO: 2044936 - RNA, 19 nt, Homo sapiens
ccuguaaucccaacacuuu

SEQ ID NO: 2044937 - RNA, 18 nt, Homo sapiens
cuccagccaagaugaucc

SEQ ID NO: 2044938 - RNA, 16 nt, Homo sapiens
cggaagggacucuggg

SEQ ID NO: 2044939 - RNA, 18 nt, Homo sapiens
acaauaaauagacacgca

SEQ ID NO: 2044940 - RNA, 19 nt, Homo sapiens
uaaccacaaagcacaguuu

SEQ ID NO: 2044941 - RNA, 18 nt, Homo sapiens
ucuguuugauacaguauu

SEQ ID NO: 2044942 - RNA, 15 nt, Homo sapiens
ggauguuuagcagug

SEQ ID NO: 2044943 - RNA, 11 nt, Homo sapiens
uucaucucuug

SEQ ID NO: 2044944 - RNA, 11 nt, Homo sapiens
cacaucuccag

SEQ ID NO: 2044945 - RNA, 20 nt, Homo sapiens
uguuuccaguuguuacugaa

SEQ ID NO: 2044946 - RNA, 15 nt, Homo sapiens
ugggccuuuccagcc

SEQ ID NO: 2044947 - RNA, 17 nt, Homo sapiens
gagacuuuagucuuugg

SEQ ID NO: 2044948 - RNA, 13 nt, Homo sapiens
ucaccaaccaaag

SEQ ID NO: 2044949 - RNA, 18 nt, Homo sapiens
ugaggcuccugugcuacu

SEQ ID NO: 2044950 - RNA, 15 nt, Homo sapiens
gugaaccaucauuau

SEQ ID NO: 2044951 - RNA, 20 nt, Homo sapiens
gccugugguuacagugcaga

SEQ ID NO: 2044952 - RNA, 21 nt, Homo sapiens
ucccuucacuccccuauccca

SEQ ID NO: 2044953 - RNA, 15 nt, Homo sapiens
agcuucugcaauauu

SEQ ID NO: 2044954 - RNA, 21 nt, Homo sapiens
cuagucguggagaugucuucg

SEQ ID NO: 2044955 - RNA, 16 nt, Homo sapiens
cuugguuucagccaag

SEQ ID NO: 2044956 - RNA, 18 nt, Homo sapiens
agacugcuaaguaggggc

SEQ ID NO: 2044957 - RNA, 14 nt, Homo sapiens
guaucgcugagacu

SEQ ID NO: 2044958 - RNA, 23 nt, Homo sapiens
ggccaguauaaagggacuugaag

SEQ ID NO: 2044959 - RNA, 19 nt, Homo sapiens
gagaagccuggguggcuca

SEQ ID NO: 2044960 - RNA, 14 nt, Homo sapiens
uaaauauugcucua

SEQ ID NO: 2044961 - RNA, 19 nt, Homo sapiens
ccacuguguuucugugcuc

SEQ ID NO: 2044962 - RNA, 23 nt, Homo sapiens
aacaguugguuggguaguagguu

SEQ ID NO: 2044963 - RNA, 23 nt, Homo sapiens
uauuuuauguaaacccucaaggg

SEQ ID NO: 2044964 - RNA, 17 nt, Homo sapiens
ucaaauuuuucaucucu

SEQ ID NO: 2044965 - RNA, 17 nt, Homo sapiens
ucccauuucuacucucc

SEQ ID NO: 2044966 - RNA, 20 nt, Homo sapiens
auauccuuaaccauucuguc

SEQ ID NO: 2044967 - RNA, 16 nt, Homo sapiens
cuuuuccccaguccca

SEQ ID NO: 2044968 - RNA, 18 nt, Homo sapiens
auugaacuuuuguacuga

SEQ ID NO: 2044969 - RNA, 18 nt, Homo sapiens
ugucuuaaggucauaaaa

SEQ ID NO: 2044970 - RNA, 15 nt, Homo sapiens
ucucagccagccucc

SEQ ID NO: 2044971 - RNA, 19 nt, Homo sapiens
agagugagcaugagcucac

SEQ ID NO: 2044972 - RNA, 21 nt, Homo sapiens
guacaaggcccccacugccug

SEQ ID NO: 2044973 - RNA, 15 nt, Homo sapiens
caccuucaagcagcu

SEQ ID NO: 2044974 - RNA, 13 nt, Homo sapiens
caaucuguucaau

SEQ ID NO: 2044975 - RNA, 23 nt, Homo sapiens
cgccguguguucaacgacugccg

SEQ ID NO: 2044976 - RNA, 17 nt, Homo sapiens
cgagaggugggccaguc

SEQ ID NO: 2044977 - RNA, 20 nt, Homo sapiens
caugguuuaaauaugaauga

SEQ ID NO: 2044978 - RNA, 10 nt, Homo sapiens
cccuuccuuu

SEQ ID NO: 2044979 - RNA, 23 nt, Homo sapiens
caaguuccaugggauacaaccuc

SEQ ID NO: 2044980 - RNA, 15 nt, Homo sapiens
caugaagcacugagc

SEQ ID NO: 2044981 - RNA, 16 nt, Homo sapiens
gaccucauuccuggga

SEQ ID NO: 2044982 - RNA, 13 nt, Homo sapiens
ucuccagcaugua

SEQ ID NO: 2044983 - RNA, 17 nt, Homo sapiens
uuuacacaggaagagaa

SEQ ID NO: 2044984 - RNA, 15 nt, Homo sapiens
uaacuagagguaaua

SEQ ID NO: 2044985 - RNA, 19 nt, Homo sapiens
caccuguucucacucccug

SEQ ID NO: 2044986 - RNA, 20 nt, Homo sapiens
gacuauggcucuacuuucag

SEQ ID NO: 2044987 - RNA, 17 nt, Homo sapiens
gucaagcugaguauuaa

SEQ ID NO: 2044988 - RNA, 10 nt, Homo sapiens
ucacuauaua

SEQ ID NO: 2044989 - RNA, 22 nt, Homo sapiens
aaggcuugaaguaaccuuauag

SEQ ID NO: 2044990 - RNA, 22 nt, Homo sapiens
aggccugggaccucccacugcc

SEQ ID NO: 2044991 - RNA, 15 nt, Homo sapiens
uaauaaaaccaaaga

SEQ ID NO: 2044992 - RNA, 21 nt, Homo sapiens
acugguuuuaccuccaggaaa

SEQ ID NO: 2044993 - RNA, 20 nt, Homo sapiens
auacucuguccccccagcua

SEQ ID NO: 2044994 - RNA, 21 nt, Homo sapiens
gcaguccugugccucaucacu

SEQ ID NO: 2044995 - RNA, 22 nt, Homo sapiens
aagcaguuguaccaagugaaau

SEQ ID NO: 2044996 - RNA, 21 nt, Homo sapiens
ccagguggagaaaucacagag

SEQ ID NO: 2044997 - RNA, 15 nt, Homo sapiens
ucaguguuaaaugug

SEQ ID NO: 2044998 - RNA, 22 nt, Homo sapiens
acacuacaaguuuauaagccca

SEQ ID NO: 2044999 - RNA, 20 nt, Homo sapiens
aaccaguggccgguugccac

SEQ ID NO: 2045000 - RNA, 20 nt, Homo sapiens
ccugccagugagcucgccau

SEQ ID NO: 2045001 - RNA, 20 nt, Homo sapiens
ugguaucugugaacauguua

SEQ ID NO: 2045002 - RNA, 14 nt, Homo sapiens
aguaucaaacuacu

SEQ ID NO: 2045003 - RNA, 12 nt, Homo sapiens
ucccaauucauc

SEQ ID NO: 2045004 - RNA, 19 nt, Homo sapiens
cagucuuggcucacugcaa

SEQ ID NO: 2045005 - RNA, 17 nt, Homo sapiens
ugcaucaauauguauua

SEQ ID NO: 2045006 - RNA, 22 nt, Homo sapiens
acccuccuagccugcucugcca

SEQ ID NO: 2045007 - RNA, 14 nt, Homo sapiens
gucacuugaucucc

SEQ ID NO: 2045008 - RNA, 15 nt, Homo sapiens
cagaccgccagugac

SEQ ID NO: 2045009 - RNA, 20 nt, Homo sapiens
agccugaggcagccacuucg

SEQ ID NO: 2045010 - RNA, 17 nt, Homo sapiens
gcagaccgccccucacc

SEQ ID NO: 2045011 - RNA, 18 nt, Homo sapiens
augcucugaguagcuuua

SEQ ID NO: 2045012 - RNA, 20 nt, Homo sapiens
ugagcauuuagacucucgac

SEQ ID NO: 2045013 - RNA, 12 nt, Homo sapiens
uccaccuuccau

SEQ ID NO: 2045014 - RNA, 22 nt, Homo sapiens
aagaauauaaugggaaguguac

SEQ ID NO: 2045015 - RNA, 17 nt, Homo sapiens
auggaauuacuccaaaa

SEQ ID NO: 2045016 - RNA, 20 nt, Homo sapiens
aucuaauccuuuaaugaucu

SEQ ID NO: 2045017 - RNA, 19 nt, Homo sapiens
ucaucagcauuuggaccaa

SEQ ID NO: 2045018 - RNA, 21 nt, Homo sapiens
accuauagaaauguauuuuga

SEQ ID NO: 2045019 - RNA, 16 nt, Homo sapiens
guauuuugaaaacacu

SEQ ID NO: 2045020 - RNA, 23 nt, Homo sapiens
caaggaggaguuccaccaugagc

SEQ ID NO: 2045021 - RNA, 13 nt, Homo sapiens
acacugugcuacu

SEQ ID NO: 2045022 - RNA, 23 nt, Homo sapiens
cuaguugaacaucucacuuugcc

SEQ ID NO: 2045023 - RNA, 20 nt, Homo sapiens
cugggaagcucccaccccac

SEQ ID NO: 2045024 - RNA, 17 nt, Homo sapiens
aaacauuuaaagacaaa

SEQ ID NO: 2045025 - RNA, 19 nt, Homo sapiens
ucuccgccccugagcccac

SEQ ID NO: 2045026 - RNA, 22 nt, Homo sapiens
gaccacuuuuuguaauacuuuu

SEQ ID NO: 2045027 - RNA, 20 nt, Homo sapiens
acucucuauugaccaccagu

SEQ ID NO: 2045028 - RNA, 15 nt, Homo sapiens
uuucucuguauagua

SEQ ID NO: 2045029 - RNA, 14 nt, Homo sapiens
aagucuuccacuuu

SEQ ID NO: 2045030 - RNA, 12 nt, Homo sapiens
cuuaagugccua

SEQ ID NO: 2045031 - RNA, 19 nt, Homo sapiens
ccucagaguguggguccuu

SEQ ID NO: 2045032 - RNA, 22 nt, Homo sapiens
auuaaaauuggaugcuagagaa

SEQ ID NO: 2045033 - RNA, 17 nt, Homo sapiens
augugccucuguccuua

SEQ ID NO: 2045034 - RNA, 13 nt, Homo sapiens
aaaaagugucuca

SEQ ID NO: 2045035 - RNA, 20 nt, Homo sapiens
uaaaguccaaagucagaucu

SEQ ID NO: 2045036 - RNA, 13 nt, Homo sapiens
uaaugaucagaug

SEQ ID NO: 2045037 - RNA, 22 nt, Homo sapiens
ccaauaaaagugucacuaagaa

SEQ ID NO: 2045038 - RNA, 17 nt, Homo sapiens
gugcaguugacagcagg

SEQ ID NO: 2045039 - RNA, 20 nt, Homo sapiens
gcuaacugcuugaacccaga

SEQ ID NO: 2045040 - RNA, 20 nt, Homo sapiens
agaaagccuucauaagccua

SEQ ID NO: 2045041 - RNA, 17 nt, Homo sapiens
auauuuggaaugaagga

SEQ ID NO: 2045042 - RNA, 17 nt, Homo sapiens
cuacaugaugcccugcu

SEQ ID NO: 2045043 - RNA, 16 nt, Homo sapiens
aaaugauccucagugc

SEQ ID NO: 2045044 - RNA, 18 nt, Homo sapiens
ucagcagggacuguaaac

SEQ ID NO: 2045045 - RNA, 21 nt, Homo sapiens
gcccgaaaccucauuagcaau

SEQ ID NO: 2045046 - RNA, 21 nt, Homo sapiens
auuaauaguuauuauuuacug

SEQ ID NO: 2045047 - RNA, 19 nt, Homo sapiens
gauuccaaaaagcacauau

SEQ ID NO: 2045048 - RNA, 15 nt, Homo sapiens
gcuggacaugcugac

SEQ ID NO: 2045049 - RNA, 14 nt, Homo sapiens
accgaaaccuugcc

SEQ ID NO: 2045050 - RNA, 13 nt, Homo sapiens
acacgcaguauug

SEQ ID NO: 2045051 - RNA, 18 nt, Homo sapiens
auuuguuaacuguacuga

SEQ ID NO: 2045052 - RNA, 23 nt, Homo sapiens
uccaucauauuaaaaauauacaa

SEQ ID NO: 2045053 - RNA, 16 nt, Homo sapiens
auaauaauaauuugca

SEQ ID NO: 2045054 - RNA, 15 nt, Homo sapiens
ucugugcgucugugu

SEQ ID NO: 2045055 - RNA, 23 nt, Homo sapiens
ccugaaauaaacacuggugccaa

SEQ ID NO: 2045056 - RNA, 17 nt, Homo sapiens
uagugucucgaguacua

SEQ ID NO: 2045057 - RNA, 19 nt, Homo sapiens
aguaauugaaaaaggugau

SEQ ID NO: 2045058 - RNA, 15 nt, Homo sapiens
aaaaacauacuuaca

SEQ ID NO: 2045059 - RNA, 14 nt, Homo sapiens
uauaucaucuauca

SEQ ID NO: 2045060 - RNA, 15 nt, Homo sapiens
ccucuuggugggugu

SEQ ID NO: 2045061 - RNA, 21 nt, Homo sapiens
uagauguauuuucaauaaaga

SEQ ID NO: 2045062 - RNA, 15 nt, Homo sapiens
cucuuggcuuccaga

SEQ ID NO: 2045063 - RNA, 12 nt, Homo sapiens
gacgucuucacc

SEQ ID NO: 2045064 - RNA, 17 nt, Homo sapiens
aucccaucucuaaaaaa

SEQ ID NO: 2045065 - RNA, 15 nt, Homo sapiens
agccauagagauuuu

SEQ ID NO: 2045066 - RNA, 20 nt, Homo sapiens
uucauuguguuaccuguaga

SEQ ID NO: 2045067 - RNA, 22 nt, Homo sapiens
ccuggcccccggguguaaauag

SEQ ID NO: 2045068 - RNA, 16 nt, Homo sapiens
ggcaauaucuuuaaua

SEQ ID NO: 2045069 - RNA, 22 nt, Homo sapiens
ccuugucccgucuggaccuggg

SEQ ID NO: 2045070 - RNA, 18 nt, Homo sapiens
gaaaccagaaaagcaaua

SEQ ID NO: 2045071 - RNA, 16 nt, Homo sapiens
uggaacugcaccaccg

SEQ ID NO: 2045072 - RNA, 20 nt, Homo sapiens
augaaucgcagacgcaagag

SEQ ID NO: 2045073 - RNA, 22 nt, Homo sapiens
uccccaggagcagcaucucuga

SEQ ID NO: 2045074 - RNA, 21 nt, Homo sapiens
gagcuucuguugcugccucau

SEQ ID NO: 2045075 - RNA, 17 nt, Homo sapiens
uauaauacuacuacugu

SEQ ID NO: 2045076 - RNA, 18 nt, Homo sapiens
cuaauagaauuaauggaa

SEQ ID NO: 2045077 - RNA, 18 nt, Homo sapiens
cucacauauaacaugcaa

SEQ ID NO: 2045078 - RNA, 13 nt, Homo sapiens
gggaauucuuaca

SEQ ID NO: 2045079 - RNA, 14 nt, Homo sapiens
uaauaaagcauucu

SEQ ID NO: 2045080 - RNA, 21 nt, Homo sapiens
acccccaaacacaaaacauuc

SEQ ID NO: 2045081 - RNA, 18 nt, Homo sapiens
acaguucaggugagaaac

SEQ ID NO: 2045082 - RNA, 19 nt, Homo sapiens
acagguggggagagacaga

SEQ ID NO: 2045083 - RNA, 21 nt, Homo sapiens
cuggacccccagcuuugccca

SEQ ID NO: 2045084 - RNA, 17 nt, Homo sapiens
gcuucugaaacuggagu

SEQ ID NO: 2045085 - RNA, 20 nt, Homo sapiens
aaauuagaaagcaacuuauc

SEQ ID NO: 2045086 - RNA, 20 nt, Homo sapiens
aagaccuggucgucgucuug

SEQ ID NO: 2045087 - RNA, 21 nt, Homo sapiens
acagacauggacaaggagcug

SEQ ID NO: 2045088 - RNA, 17 nt, Homo sapiens
uuuacaauguucauccc

SEQ ID NO: 2045089 - RNA, 20 nt, Homo sapiens
uggcugaauagcacagguga

SEQ ID NO: 2045090 - RNA, 11 nt, Homo sapiens
uuaaugcuuuc

SEQ ID NO: 2045091 - RNA, 12 nt, Homo sapiens
gcucccugaacu

SEQ ID NO: 2045092 - RNA, 16 nt, Homo sapiens
uucucacccaggcaau

SEQ ID NO: 2045093 - RNA, 13 nt, Homo sapiens
ggggaugucccag

SEQ ID NO: 2045094 - RNA, 21 nt, Homo sapiens
cugugagccuugcaugacauc

SEQ ID NO: 2045095 - RNA, 20 nt, Homo sapiens
ucauggguggugacguggua

SEQ ID NO: 2045096 - RNA, 22 nt, Homo sapiens
uaaaugcaaucucuuuucuaca

SEQ ID NO: 2045097 - RNA, 23 nt, Homo sapiens
ccuuuuauuuuuuaagguaacaa

SEQ ID NO: 2045098 - RNA, 19 nt, Homo sapiens
cauucaggguuauacacag

SEQ ID NO: 2045099 - RNA, 16 nt, Homo sapiens
gcaaucucuugucuca

SEQ ID NO: 2045100 - RNA, 22 nt, Homo sapiens
agaauguuucuggaauucuuca

SEQ ID NO: 2045101 - RNA, 13 nt, Homo sapiens
uuggacugucuau

SEQ ID NO: 2045102 - RNA, 15 nt, Homo sapiens
ccaugaccaggccac

SEQ ID NO: 2045103 - RNA, 23 nt, Homo sapiens
ggaauauauuugugugugugaua

SEQ ID NO: 2045104 - RNA, 21 nt, Homo sapiens
cugcauuguuucaagacugac

SEQ ID NO: 2045105 - RNA, 18 nt, Homo sapiens
guagguuuacauuacuga

SEQ ID NO: 2045106 - RNA, 19 nt, Homo sapiens
agggaccacguugcugccu

SEQ ID NO: 2045107 - RNA, 19 nt, Homo sapiens
gauuuagcaggaagcugug

SEQ ID NO: 2045108 - RNA, 14 nt, Homo sapiens
aagaugaaucacuu

SEQ ID NO: 2045109 - RNA, 18 nt, Homo sapiens
cuccuguuguuacugggu

SEQ ID NO: 2045110 - RNA, 23 nt, Homo sapiens
ugcuggucccggggccagcacuu

SEQ ID NO: 2045111 - RNA, 18 nt, Homo sapiens
gcaacagauagauguugc

SEQ ID NO: 2045112 - RNA, 21 nt, Homo sapiens
aggaggggaaggcaacauaca

SEQ ID NO: 2045113 - RNA, 20 nt, Homo sapiens
cagggaaggaacucuggcca

SEQ ID NO: 2045114 - RNA, 20 nt, Homo sapiens
auacagacagagauggccau

SEQ ID NO: 2045115 - RNA, 16 nt, Homo sapiens
ucucuggacacacuau

SEQ ID NO: 2045116 - RNA, 15 nt, Homo sapiens
augugacucuuucca

SEQ ID NO: 2045117 - RNA, 16 nt, Homo sapiens
guuauucauacaaaua

SEQ ID NO: 2045118 - RNA, 20 nt, Homo sapiens
uuucagagaaaggacugugg

SEQ ID NO: 2045119 - RNA, 18 nt, Homo sapiens
ggacaagggccugggauu

SEQ ID NO: 2045120 - RNA, 23 nt, Homo sapiens
ucagguaacagucguagauacca

SEQ ID NO: 2045121 - RNA, 15 nt, Homo sapiens
acagcauucuuguca

SEQ ID NO: 2045122 - RNA, 21 nt, Homo sapiens
aggcaagggauaacucuucua

SEQ ID NO: 2045123 - RNA, 14 nt, Homo sapiens
gggacaucagggua

SEQ ID NO: 2045124 - RNA, 15 nt, Homo sapiens
uagccagggggacua

SEQ ID NO: 2045125 - RNA, 15 nt, Homo sapiens
cacucaguugcaacu

SEQ ID NO: 2045126 - RNA, 13 nt, Homo sapiens
agauagcccuaaa

SEQ ID NO: 2045127 - RNA, 15 nt, Homo sapiens
agaaaacacauuucu

SEQ ID NO: 2045128 - RNA, 16 nt, Homo sapiens
cuguuccuuaugauau

SEQ ID NO: 2045129 - RNA, 14 nt, Homo sapiens
agagauggugcuaa

SEQ ID NO: 2045130 - RNA, 22 nt, Homo sapiens
guguguccaccugggcauaucc

SEQ ID NO: 2045131 - RNA, 13 nt, Homo sapiens
uagucucuaucau

SEQ ID NO: 2045132 - RNA, 14 nt, Homo sapiens
ccuagaacuuuguu

SEQ ID NO: 2045133 - RNA, 21 nt, Homo sapiens
uauucccaugguagacuguga

SEQ ID NO: 2045134 - RNA, 17 nt, Homo sapiens
uccucacuuuauggaag

SEQ ID NO: 2045135 - RNA, 14 nt, Homo sapiens
uuguccacagcaaa

SEQ ID NO: 2045136 - RNA, 17 nt, Homo sapiens
gaccccuacccacuucc

SEQ ID NO: 2045137 - RNA, 11 nt, Homo sapiens
acaguaucucu

SEQ ID NO: 2045138 - RNA, 18 nt, Homo sapiens
ugcagccaggccacuggc

SEQ ID NO: 2045139 - RNA, 21 nt, Homo sapiens
cuaggagguuccggugucugg

SEQ ID NO: 2045140 - RNA, 18 nt, Homo sapiens
uuugcagaauacauucaa

SEQ ID NO: 2045141 - RNA, 14 nt, Homo sapiens
uccaugcuaagcaa

SEQ ID NO: 2045142 - RNA, 16 nt, Homo sapiens
caggccuucuuugguu

SEQ ID NO: 2045143 - RNA, 17 nt, Homo sapiens
ugacaguccacaggggc

SEQ ID NO: 2045144 - RNA, 16 nt, Homo sapiens
ugcagacgucuggccc

SEQ ID NO: 2045145 - RNA, 13 nt, Homo sapiens
cauuuagauuuug

SEQ ID NO: 2045146 - RNA, 16 nt, Homo sapiens
uggucauucauaucac

SEQ ID NO: 2045147 - RNA, 16 nt, Homo sapiens
gucugccaagugggaa

SEQ ID NO: 2045148 - RNA, 20 nt, Homo sapiens
gagcccagaaaaccuccagu

SEQ ID NO: 2045149 - RNA, 14 nt, Homo sapiens
uuauggcaaauuca

SEQ ID NO: 2045150 - RNA, 15 nt, Homo sapiens
cugccauuuuagugu

SEQ ID NO: 2045151 - RNA, 17 nt, Homo sapiens
uacaaacucccacuugu

SEQ ID NO: 2045152 - RNA, 23 nt, Homo sapiens
augaugaaggggauacgcuggag

SEQ ID NO: 2045153 - RNA, 15 nt, Homo sapiens
uaucugacugaaauu

SEQ ID NO: 2045154 - RNA, 18 nt, Homo sapiens
ggcugucaucagccugug

SEQ ID NO: 2045155 - RNA, 21 nt, Homo sapiens
gucaggaagggaaagccagaa

SEQ ID NO: 2045156 - RNA, 16 nt, Homo sapiens
uucaagagcacacuug

SEQ ID NO: 2045157 - RNA, 15 nt, Homo sapiens
gaaaaugccaccauc

SEQ ID NO: 2045158 - RNA, 16 nt, Homo sapiens
ggaaugggggccaggc

SEQ ID NO: 2045159 - RNA, 18 nt, Homo sapiens
acacuucauccuauagag

SEQ ID NO: 2045160 - RNA, 19 nt, Homo sapiens
cuccucaggcacacagcua

SEQ ID NO: 2045161 - RNA, 21 nt, Homo sapiens
aggugcuacaaaaacacagca

SEQ ID NO: 2045162 - RNA, 14 nt, Homo sapiens
agccaggcuccuac

SEQ ID NO: 2045163 - RNA, 14 nt, Homo sapiens
caccuguacauucu

SEQ ID NO: 2045164 - RNA, 17 nt, Homo sapiens
guuauaauuauuccuuc

SEQ ID NO: 2045165 - RNA, 17 nt, Homo sapiens
cuuugauuuacagugcc

SEQ ID NO: 2045166 - RNA, 12 nt, Homo sapiens
aggcucuuccau

SEQ ID NO: 2045167 - RNA, 12 nt, Homo sapiens
agggugagacac

SEQ ID NO: 2045168 - RNA, 19 nt, Homo sapiens
cuuuccuaagaaagacauc

SEQ ID NO: 2045169 - RNA, 16 nt, Homo sapiens
ugugccugcuccugua

SEQ ID NO: 2045170 - RNA, 16 nt, Homo sapiens
cuccugcgugugccca

SEQ ID NO: 2045171 - RNA, 22 nt, Homo sapiens
uuaguaaaggaaccauuccuuu

SEQ ID NO: 2045172 - RNA, 15 nt, Homo sapiens
uguaauaaagugaac

SEQ ID NO: 2045173 - RNA, 15 nt, Homo sapiens
uugacaacagacuga

SEQ ID NO: 2045174 - RNA, 22 nt, Homo sapiens
caaaaaaaaugaagacacucaa

SEQ ID NO: 2045175 - RNA, 21 nt, Homo sapiens
aagucacccagggacacucca

SEQ ID NO: 2045176 - RNA, 21 nt, Homo sapiens
guuccgccucccggguucaca

SEQ ID NO: 2045177 - RNA, 19 nt, Homo sapiens
uauuuaauuaaaauauaca

SEQ ID NO: 2045178 - RNA, 21 nt, Homo sapiens
acucaguuaggcagugcagua

SEQ ID NO: 2045179 - RNA, 15 nt, Homo sapiens
agggggugaccuccg

SEQ ID NO: 2045180 - RNA, 18 nt, Homo sapiens
auuucucaguaucaguau

SEQ ID NO: 2045181 - RNA, 21 nt, Homo sapiens
cuuagcucacaccugaccaau

SEQ ID NO: 2045182 - RNA, 15 nt, Homo sapiens
agagacccagaucuc

SEQ ID NO: 2045183 - RNA, 16 nt, Homo sapiens
aaaauaucugcucaaa

SEQ ID NO: 2045184 - RNA, 20 nt, Homo sapiens
cuuccucaggggcacagacc

SEQ ID NO: 2045185 - RNA, 14 nt, Homo sapiens
cuucuagcauauag

SEQ ID NO: 2045186 - RNA, 14 nt, Homo sapiens
uggccaaagaccaa

SEQ ID NO: 2045187 - RNA, 21 nt, Homo sapiens
uaaaagugaaacguaauugua

SEQ ID NO: 2045188 - RNA, 13 nt, Homo sapiens
agacaaaggcucu

SEQ ID NO: 2045189 - RNA, 22 nt, Homo sapiens
aaguucuguguuuaauuucuuc

SEQ ID NO: 2045190 - RNA, 22 nt, Homo sapiens
ccaggucagcuguuacuuucuu

SEQ ID NO: 2045191 - RNA, 17 nt, Homo sapiens
uacaggcaugaaccacu

SEQ ID NO: 2045192 - RNA, 18 nt, Homo sapiens
ucgagaauguauggauuu

SEQ ID NO: 2045193 - RNA, 18 nt, Homo sapiens
gucagacuccuagacuca

SEQ ID NO: 2045194 - RNA, 18 nt, Homo sapiens
gucagcagagcuucagag

SEQ ID NO: 2045195 - RNA, 20 nt, Homo sapiens
ccuuccuggacacacucuca

SEQ ID NO: 2045196 - RNA, 16 nt, Homo sapiens
cauuuguuuuuaguua

SEQ ID NO: 2045197 - RNA, 16 nt, Homo sapiens
cuuuuguuauguauuu

SEQ ID NO: 2045198 - RNA, 17 nt, Homo sapiens
ugauuuacaagcaucau

SEQ ID NO: 2045199 - RNA, 16 nt, Homo sapiens
acccacacucagaucc

SEQ ID NO: 2045200 - RNA, 15 nt, Homo sapiens
uaaaaauuaugucca

SEQ ID NO: 2045201 - RNA, 14 nt, Homo sapiens
ccaaagcugcuuuc

SEQ ID NO: 2045202 - RNA, 20 nt, Homo sapiens
caggcgugagccaccaugcc

SEQ ID NO: 2045203 - RNA, 13 nt, Homo sapiens
cugcaagcacugc

SEQ ID NO: 2045204 - RNA, 13 nt, Homo sapiens
cuacagcaaauaa

SEQ ID NO: 2045205 - RNA, 22 nt, Homo sapiens
augaugaaaaauuauaguagcu

SEQ ID NO: 2045206 - RNA, 21 nt, Homo sapiens
uaggucauucuuuugccacau

SEQ ID NO: 2045207 - RNA, 20 nt, Homo sapiens
acaaauguauauuuuugcaa

SEQ ID NO: 2045208 - RNA, 22 nt, Homo sapiens
uaguaaggcaauccuaagcaaa

SEQ ID NO: 2045209 - RNA, 13 nt, Homo sapiens
cccagagcauuug

SEQ ID NO: 2045210 - RNA, 17 nt, Homo sapiens
ggugauggaacaagaga

SEQ ID NO: 2045211 - RNA, 11 nt, Homo sapiens
uaaaugugaca

SEQ ID NO: 2045212 - RNA, 21 nt, Homo sapiens
uugaaaauguguuguugcugu

SEQ ID NO: 2045213 - RNA, 13 nt, Homo sapiens
aaauucagucuuu

SEQ ID NO: 2045214 - RNA, 13 nt, Homo sapiens
caauauacuucac

SEQ ID NO: 2045215 - RNA, 17 nt, Homo sapiens
augucacugaaauugaa

SEQ ID NO: 2045216 - RNA, 15 nt, Homo sapiens
uaccuggaccugucc

SEQ ID NO: 2045217 - RNA, 17 nt, Homo sapiens
ucaaaaccuacacagcu

SEQ ID NO: 2045218 - RNA, 22 nt, Homo sapiens
auagcucuggggugggcaguuu

SEQ ID NO: 2045219 - RNA, 15 nt, Homo sapiens
ccauccuucccgcag

SEQ ID NO: 2045220 - RNA, 21 nt, Homo sapiens
uuuggggagcaggaggccaau

SEQ ID NO: 2045221 - RNA, 15 nt, Homo sapiens
caaauggugcugaau

SEQ ID NO: 2045222 - RNA, 20 nt, Homo sapiens
cauggccuugaaacaguucc

SEQ ID NO: 2045223 - RNA, 22 nt, Homo sapiens
uaauuauauuuuaaauacccau

SEQ ID NO: 2045224 - RNA, 14 nt, Homo sapiens
aaaggggacaagga

SEQ ID NO: 2045225 - RNA, 22 nt, Homo sapiens
aauuuauugauguugugaaauc

SEQ ID NO: 2045226 - RNA, 18 nt, Homo sapiens
gacucugcacaugucuug

SEQ ID NO: 2045227 - RNA, 23 nt, Homo sapiens
aggacggugcaacccaaggacug

SEQ ID NO: 2045228 - RNA, 21 nt, Homo sapiens
guugcugccacucuacagguc

SEQ ID NO: 2045229 - RNA, 13 nt, Homo sapiens
gcucucaaaaugu

SEQ ID NO: 2045230 - RNA, 21 nt, Homo sapiens
cuccacaccucuaaacaucuc

SEQ ID NO: 2045231 - RNA, 20 nt, Homo sapiens
agcccccaccccgagucaca

SEQ ID NO: 2045232 - RNA, 21 nt, Homo sapiens
agcuucaggagggaaccagcu

SEQ ID NO: 2045233 - RNA, 20 nt, Homo sapiens
aauacaggcaugaaccacug

SEQ ID NO: 2045234 - RNA, 22 nt, Homo sapiens
gugucugcuuuaaagggccugc

SEQ ID NO: 2045235 - RNA, 16 nt, Homo sapiens
cuagaaagccaugugc

SEQ ID NO: 2045236 - RNA, 20 nt, Homo sapiens
cuucccuuucugcuuguguu

SEQ ID NO: 2045237 - RNA, 23 nt, Homo sapiens
ggcucaacguuuuuggacacugu

SEQ ID NO: 2045238 - RNA, 19 nt, Homo sapiens
guuucccgguucaggacca

SEQ ID NO: 2045239 - RNA, 12 nt, Homo sapiens
uucucucaauga

SEQ ID NO: 2045240 - RNA, 20 nt, Homo sapiens
gacuguggcugcuagcacuu

SEQ ID NO: 2045241 - RNA, 15 nt, Homo sapiens
uugcggauacuuugc

SEQ ID NO: 2045242 - RNA, 10 nt, Homo sapiens
ucgcuuuaug

SEQ ID NO: 2045243 - RNA, 17 nt, Homo sapiens
cagaucccucuccagug

SEQ ID NO: 2045244 - RNA, 14 nt, Homo sapiens
auagcuucaggacc

SEQ ID NO: 2045245 - RNA, 18 nt, Homo sapiens
ggcuggcugaguggaaug

SEQ ID NO: 2045246 - RNA, 20 nt, Homo sapiens
cccaaauuaaguauguuuga

SEQ ID NO: 2045247 - RNA, 19 nt, Homo sapiens
acuuuaaaaaguaaccaga

SEQ ID NO: 2045248 - RNA, 15 nt, Homo sapiens
cugacuuuuaaccca

SEQ ID NO: 2045249 - RNA, 23 nt, Homo sapiens
gcagcaaggaggaagaggacuca

SEQ ID NO: 2045250 - RNA, 20 nt, Homo sapiens
augccugccaaagacguguc

SEQ ID NO: 2045251 - RNA, 20 nt, Homo sapiens
augugaagaguuucacaaau

SEQ ID NO: 2045252 - RNA, 19 nt, Homo sapiens
cuagagcuccauuucuacu

SEQ ID NO: 2045253 - RNA, 16 nt, Homo sapiens
uucuucaaacaggaau

SEQ ID NO: 2045254 - RNA, 20 nt, Homo sapiens
uuguuacagguguacuaugg

SEQ ID NO: 2045255 - RNA, 23 nt, Homo sapiens
cauacucuagauuuuguuuugcu

SEQ ID NO: 2045256 - RNA, 23 nt, Homo sapiens
ccugacacucaauaaacagucac

SEQ ID NO: 2045257 - RNA, 22 nt, Homo sapiens
aacaugcauaagaaauguagcu

SEQ ID NO: 2045258 - RNA, 19 nt, Homo sapiens
ggcccacagcaggugcuga

SEQ ID NO: 2045259 - RNA, 16 nt, Homo sapiens
gauucucaugccucag

SEQ ID NO: 2045260 - RNA, 11 nt, Homo sapiens
acaccuuccag

SEQ ID NO: 2045261 - RNA, 21 nt, Homo sapiens
aacccugagggacuuggcagu

SEQ ID NO: 2045262 - RNA, 13 nt, Homo sapiens
uaaaacaguauuc

SEQ ID NO: 2045263 - RNA, 20 nt, Homo sapiens
uugguauauacuuugccacu

SEQ ID NO: 2045264 - RNA, 18 nt, Homo sapiens
aauacauaaaaaagggac

SEQ ID NO: 2045265 - RNA, 20 nt, Homo sapiens
cuggccucugugauuacaua

SEQ ID NO: 2045266 - RNA, 22 nt, Homo sapiens
uaaccaucacugguugcacuua

SEQ ID NO: 2045267 - RNA, 15 nt, Homo sapiens
gcguuuccugugcau

SEQ ID NO: 2045268 - RNA, 16 nt, Homo sapiens
ugucuggcguucucaa

SEQ ID NO: 2045269 - RNA, 13 nt, Homo sapiens
uuauaaguucaca

SEQ ID NO: 2045270 - RNA, 12 nt, Homo sapiens
uuuccucuagga

SEQ ID NO: 2045271 - RNA, 21 nt, Homo sapiens
aucagcuucaaggaguaugca

SEQ ID NO: 2045272 - RNA, 14 nt, Homo sapiens
agcucucugcugag

SEQ ID NO: 2045273 - RNA, 20 nt, Homo sapiens
ccguggugagcauacagagu

SEQ ID NO: 2045274 - RNA, 18 nt, Homo sapiens
auuuucuaagaaccaaaa

SEQ ID NO: 2045275 - RNA, 19 nt, Homo sapiens
cauuuaauuguaccauuca

SEQ ID NO: 2045276 - RNA, 13 nt, Homo sapiens
aaauaaucaagau

SEQ ID NO: 2045277 - RNA, 14 nt, Homo sapiens
uucuuaauugcacu

SEQ ID NO: 2045278 - RNA, 15 nt, Homo sapiens
aaaagccacuggaau

SEQ ID NO: 2045279 - RNA, 19 nt, Homo sapiens
aaggacccaauccccagac

SEQ ID NO: 2045280 - RNA, 14 nt, Homo sapiens
uaaaggucccuuag

SEQ ID NO: 2045281 - RNA, 20 nt, Homo sapiens
acggcggcgaagugcuaaaa

SEQ ID NO: 2045282 - RNA, 20 nt, Homo sapiens
ccuguuaggucucaugccca

SEQ ID NO: 2045283 - RNA, 17 nt, Homo sapiens
ugaguaaucauacucaa

SEQ ID NO: 2045284 - RNA, 21 nt, Homo sapiens
gugaagguaugagaauuaaua

SEQ ID NO: 2045285 - RNA, 12 nt, Homo sapiens
auaaaagacuuu

SEQ ID NO: 2045286 - RNA, 16 nt, Homo sapiens
ugcaauacuaauugag

SEQ ID NO: 2045287 - RNA, 17 nt, Homo sapiens
uaggucuccucagggug

SEQ ID NO: 2045288 - RNA, 20 nt, Homo sapiens
uuuugcauaaugcaaucaaa

SEQ ID NO: 2045289 - RNA, 23 nt, Homo sapiens
ccauguauguugcaugaauccau

SEQ ID NO: 2045290 - RNA, 16 nt, Homo sapiens
aaccguccucuuuuuc

SEQ ID NO: 2045291 - RNA, 18 nt, Homo sapiens
ccacuggaaacaacagac

SEQ ID NO: 2045292 - RNA, 13 nt, Homo sapiens
gcauuaaacaaaa

SEQ ID NO: 2045293 - RNA, 18 nt, Homo sapiens
gugaaauauaugcuauau

SEQ ID NO: 2045294 - RNA, 16 nt, Homo sapiens
cauacugcauuucacu

SEQ ID NO: 2045295 - RNA, 18 nt, Homo sapiens
agugcaauggcacaaucu

SEQ ID NO: 2045296 - RNA, 18 nt, Homo sapiens
agugucuaaaauacuuga

SEQ ID NO: 2045297 - RNA, 17 nt, Homo sapiens
caggcugaaauauccac

SEQ ID NO: 2045298 - RNA, 19 nt, Homo sapiens
cuaugcaacagcucucacc

SEQ ID NO: 2045299 - RNA, 17 nt, Homo sapiens
ugaaucuauaaguagua

SEQ ID NO: 2045300 - RNA, 19 nt, Homo sapiens
ugaucaauuucaacaugga

SEQ ID NO: 2045301 - RNA, 22 nt, Homo sapiens
auuuuaaugauaaaauagccaa

SEQ ID NO: 2045302 - RNA, 13 nt, Homo sapiens
augaaauguuuca

SEQ ID NO: 2045303 - RNA, 23 nt, Homo sapiens
accugcugccggaagucauccca

SEQ ID NO: 2045304 - RNA, 21 nt, Homo sapiens
ugauuaaacucgagauacagc

SEQ ID NO: 2045305 - RNA, 23 nt, Homo sapiens
auaauuccuauauccugugacug

SEQ ID NO: 2045306 - RNA, 14 nt, Homo sapiens
gccacacacccgcu

SEQ ID NO: 2045307 - RNA, 14 nt, Homo sapiens
gugacacacuggcu

SEQ ID NO: 2045308 - RNA, 20 nt, Homo sapiens
gaauuguuuuuugcucuuuu

SEQ ID NO: 2045309 - RNA, 15 nt, Homo sapiens
uggaauguaaguaag

SEQ ID NO: 2045310 - RNA, 20 nt, Homo sapiens
agcuucacugucaugugcga

SEQ ID NO: 2045311 - RNA, 18 nt, Homo sapiens
guagacacuaauucuguc

SEQ ID NO: 2045312 - RNA, 22 nt, Homo sapiens
uguggaugggaaacugcuccag

SEQ ID NO: 2045313 - RNA, 15 nt, Homo sapiens
gagggagacuccugg

SEQ ID NO: 2045314 - RNA, 14 nt, Homo sapiens
cauuaaucuugauc

SEQ ID NO: 2045315 - RNA, 22 nt, Homo sapiens
aagaguuuauaaagcacaguga

SEQ ID NO: 2045316 - RNA, 14 nt, Homo sapiens
aguaacauuugccu

SEQ ID NO: 2045317 - RNA, 14 nt, Homo sapiens
aguauaaagugauc

SEQ ID NO: 2045318 - RNA, 23 nt, Homo sapiens
aacaccagaacugugugucucau

SEQ ID NO: 2045319 - RNA, 15 nt, Homo sapiens
guggguguacauuuu

SEQ ID NO: 2045320 - RNA, 18 nt, Homo sapiens
cagccucccaguagcugg

SEQ ID NO: 2045321 - RNA, 18 nt, Homo sapiens
caaauguugaccuuugag

SEQ ID NO: 2045322 - RNA, 22 nt, Homo sapiens
cccagauuggcucacacugaga

SEQ ID NO: 2045323 - RNA, 16 nt, Homo sapiens
aguguaccacuacuua

SEQ ID NO: 2045324 - RNA, 14 nt, Homo sapiens
gaggggaccaggag

SEQ ID NO: 2045325 - RNA, 15 nt, Homo sapiens
gcuucuagacacucc

SEQ ID NO: 2045326 - RNA, 13 nt, Homo sapiens
uaagguguuugaa

SEQ ID NO: 2045327 - RNA, 23 nt, Homo sapiens
agagugccguaacaacugugguc

SEQ ID NO: 2045328 - RNA, 22 nt, Homo sapiens
cauucacaguucuuugggccag

SEQ ID NO: 2045329 - RNA, 22 nt, Homo sapiens
aauccucagguaguacugggaa

SEQ ID NO: 2045330 - RNA, 17 nt, Homo sapiens
aaaaucauucuacugaa

SEQ ID NO: 2045331 - RNA, 15 nt, Homo sapiens
gaugacguccucuca

SEQ ID NO: 2045332 - RNA, 20 nt, Homo sapiens
cagacggccuagugugccaa

SEQ ID NO: 2045333 - RNA, 14 nt, Homo sapiens
acuggggaugggac

SEQ ID NO: 2045334 - RNA, 17 nt, Homo sapiens
auucuuaauucucugca

SEQ ID NO: 2045335 - RNA, 21 nt, Homo sapiens
gagaucguuguuuacagugua

SEQ ID NO: 2045336 - RNA, 15 nt, Homo sapiens
uugcggaaugcauug

SEQ ID NO: 2045337 - RNA, 22 nt, Homo sapiens
ccuugugggcagaauccuuguc

SEQ ID NO: 2045338 - RNA, 22 nt, Homo sapiens
uuuugucagaaaagagccacuu

SEQ ID NO: 2045339 - RNA, 15 nt, Homo sapiens
gcaagauaaacacuu

SEQ ID NO: 2045340 - RNA, 21 nt, Homo sapiens
cgaggauggguuugagaagga

SEQ ID NO: 2045341 - RNA, 24 nt, Homo sapiens
aacuaaagagcugcacagcaaaag

SEQ ID NO: 2045342 - RNA, 17 nt, Homo sapiens
cagguucugacucuugg

SEQ ID NO: 2045343 - RNA, 15 nt, Homo sapiens
uuuccugacagggaa

SEQ ID NO: 2045344 - RNA, 17 nt, Homo sapiens
aagccacagaagccagg

SEQ ID NO: 2045345 - RNA, 16 nt, Homo sapiens
uaauaaaaagguuuaa

SEQ ID NO: 2045346 - RNA, 22 nt, Homo sapiens
cccgccacccucccacugccaa

SEQ ID NO: 2045347 - RNA, 11 nt, Homo sapiens
caacugucagg

SEQ ID NO: 2045348 - RNA, 20 nt, Homo sapiens
aaacaucuuuucacaacuua

SEQ ID NO: 2045349 - RNA, 10 nt, Homo sapiens
aguccucuaa

SEQ ID NO: 2045350 - RNA, 21 nt, Homo sapiens
gagaccaacuacgacuggcau

SEQ ID NO: 2045351 - RNA, 19 nt, Homo sapiens
caauaaacugguaugaaua

SEQ ID NO: 2045352 - RNA, 23 nt, Homo sapiens
ugaaauaagccagacaucaacag

SEQ ID NO: 2045353 - RNA, 22 nt, Homo sapiens
uaaggaaacacuucuauuuaau

SEQ ID NO: 2045354 - RNA, 20 nt, Homo sapiens
ccacguaugugaaacacaca

SEQ ID NO: 2045355 - RNA, 20 nt, Homo sapiens
uaauuuuuauaaauauguga

SEQ ID NO: 2045356 - RNA, 10 nt, Homo sapiens
ucgugcugug

SEQ ID NO: 2045357 - RNA, 14 nt, Homo sapiens
acauacucccaucu

SEQ ID NO: 2045358 - RNA, 14 nt, Homo sapiens
ccagccucacagau

SEQ ID NO: 2045359 - RNA, 17 nt, Homo sapiens
agugauugacacacagc

SEQ ID NO: 2045360 - RNA, 13 nt, Homo sapiens
aagcugacuuuau

SEQ ID NO: 2045361 - RNA, 14 nt, Homo sapiens
uuccaaauucacaa

SEQ ID NO: 2045362 - RNA, 20 nt, Homo sapiens
cugguagggauauggcagga

SEQ ID NO: 2045363 - RNA, 13 nt, Homo sapiens
cgucuaacuggaa

SEQ ID NO: 2045364 - RNA, 13 nt, Homo sapiens
cagguuagccuuu

SEQ ID NO: 2045365 - RNA, 13 nt, Homo sapiens
gugucaccaucau

SEQ ID NO: 2045366 - RNA, 16 nt, Homo sapiens
acaaauaaagugcagu

SEQ ID NO: 2045367 - RNA, 18 nt, Homo sapiens
agugccuggcaaggccuc

SEQ ID NO: 2045368 - RNA, 22 nt, Homo sapiens
acuaaccuaccccaacucugcc

SEQ ID NO: 2045369 - RNA, 21 nt, Homo sapiens
ccaaaggaagcuuucucugcu

SEQ ID NO: 2045370 - RNA, 22 nt, Homo sapiens
agaaacaauauuuaaccaaaga

SEQ ID NO: 2045371 - RNA, 22 nt, Homo sapiens
acauaucauucagaaugugcaa

SEQ ID NO: 2045372 - RNA, 17 nt, Homo sapiens
uugaagcuuuaagcaaa

SEQ ID NO: 2045373 - RNA, 18 nt, Homo sapiens
aauguccuugcuuuacaa

SEQ ID NO: 2045374 - RNA, 15 nt, Homo sapiens
cucaauucaaaucca

SEQ ID NO: 2045375 - RNA, 16 nt, Homo sapiens
gccuuccucugcagcu

SEQ ID NO: 2045376 - RNA, 15 nt, Homo sapiens
uagguaauuugccac

SEQ ID NO: 2045377 - RNA, 19 nt, Homo sapiens
auuagugaaguaugcacua

SEQ ID NO: 2045378 - RNA, 17 nt, Homo sapiens
ugcaccccuccccauuc

SEQ ID NO: 2045379 - RNA, 14 nt, Homo sapiens
ccaucaugaagaag

SEQ ID NO: 2045380 - RNA, 15 nt, Homo sapiens
guacaaauauuccug

SEQ ID NO: 2045381 - RNA, 21 nt, Homo sapiens
caaaaccccccagauaucauc

SEQ ID NO: 2045382 - RNA, 23 nt, Homo sapiens
cucucaagagugcugagaaccac

SEQ ID NO: 2045383 - RNA, 18 nt, Homo sapiens
aaauguuuguuuauauca

SEQ ID NO: 2045384 - RNA, 13 nt, Homo sapiens
gaauuuggaacaa

SEQ ID NO: 2045385 - RNA, 14 nt, Homo sapiens
uguggagggcauuu

SEQ ID NO: 2045386 - RNA, 13 nt, Homo sapiens
agacuaaugcuca

SEQ ID NO: 2045387 - RNA, 11 nt, Homo sapiens
uuuccaaagag

SEQ ID NO: 2045388 - RNA, 17 nt, Homo sapiens
aaucaaaccugaccaag

SEQ ID NO: 2045389 - RNA, 16 nt, Homo sapiens
cuuaagcccagugcac

SEQ ID NO: 2045390 - RNA, 16 nt, Homo sapiens
auuaggcaaaguacaa

SEQ ID NO: 2045391 - RNA, 16 nt, Homo sapiens
uaggaaaucaggcagu

SEQ ID NO: 2045392 - RNA, 18 nt, Homo sapiens
ccagauguuuccagacuu

SEQ ID NO: 2045393 - RNA, 15 nt, Homo sapiens
ucacgcucagcacac

SEQ ID NO: 2045394 - RNA, 13 nt, Homo sapiens
ucccuauguccca

SEQ ID NO: 2045395 - RNA, 22 nt, Homo sapiens
uacauauuaaaggaagcacucu

SEQ ID NO: 2045396 - RNA, 21 nt, Homo sapiens
gcaaugcucaaacacccaagu

SEQ ID NO: 2045397 - RNA, 17 nt, Homo sapiens
ugucauauaagauucau

SEQ ID NO: 2045398 - RNA, 16 nt, Homo sapiens
cuguucuugcugcuag

SEQ ID NO: 2045399 - RNA, 20 nt, Homo sapiens
cccauacucuccuuuugacu

SEQ ID NO: 2045400 - RNA, 15 nt, Homo sapiens
gucucuuccugccuc

SEQ ID NO: 2045401 - RNA, 22 nt, Homo sapiens
ccaauguucuaaaguuuugcaa

SEQ ID NO: 2045402 - RNA, 19 nt, Homo sapiens
aguccacccccauugugaa

SEQ ID NO: 2045403 - RNA, 17 nt, Homo sapiens
caagcugggagcacagg

SEQ ID NO: 2045404 - RNA, 16 nt, Homo sapiens
agggaagcaauugaaa

SEQ ID NO: 2045405 - RNA, 20 nt, Homo sapiens
gcacauucgggccauuuccg

SEQ ID NO: 2045406 - RNA, 11 nt, Homo sapiens
uuagagcauua

SEQ ID NO: 2045407 - RNA, 18 nt, Homo sapiens
aggcugcuggacacgucg

SEQ ID NO: 2045408 - RNA, 23 nt, Homo sapiens
aaacugaacuucagagcaugaaa

SEQ ID NO: 2045409 - RNA, 21 nt, Homo sapiens
cuggugucuaauaaacacaga

SEQ ID NO: 2045410 - RNA, 16 nt, Homo sapiens
cauuugagccauguca

SEQ ID NO: 2045411 - RNA, 22 nt, Homo sapiens
uauauccgccuggcauuucaca

SEQ ID NO: 2045412 - RNA, 23 nt, Homo sapiens
ccaguucuugcaauaagauauua

SEQ ID NO: 2045413 - RNA, 20 nt, Homo sapiens
aagauugcgccauugcacuc

SEQ ID NO: 2045414 - RNA, 18 nt, Homo sapiens
ucuaccagucuauuucca

SEQ ID NO: 2045415 - RNA, 21 nt, Homo sapiens
auguaacgaaugguacuacaa

SEQ ID NO: 2045416 - RNA, 15 nt, Homo sapiens
cagauggggcacuga

SEQ ID NO: 2045417 - RNA, 14 nt, Homo sapiens
caggccuucuaacc

SEQ ID NO: 2045418 - RNA, 19 nt, Homo sapiens
cccaggcugcagugcaaug

SEQ ID NO: 2045419 - RNA, 18 nt, Homo sapiens
gccaugggggcaacagcc

SEQ ID NO: 2045420 - RNA, 20 nt, Homo sapiens
auccaugcaugugcauauag

SEQ ID NO: 2045421 - RNA, 20 nt, Homo sapiens
gauuuccaaaagacuugaag

SEQ ID NO: 2045422 - RNA, 19 nt, Homo sapiens
agucauuugaggaucucac

SEQ ID NO: 2045423 - RNA, 11 nt, Homo sapiens
aagccaagaca

SEQ ID NO: 2045424 - RNA, 12 nt, Homo sapiens
ucuauuagccag

SEQ ID NO: 2045425 - RNA, 15 nt, Homo sapiens
ucucggcucacugaa

SEQ ID NO: 2045426 - RNA, 15 nt, Homo sapiens
ugagcaccuacugug

SEQ ID NO: 2045427 - RNA, 12 nt, Homo sapiens
ugaacauuccag

SEQ ID NO: 2045428 - RNA, 20 nt, Homo sapiens
ucuggaagccuggacucuaa

SEQ ID NO: 2045429 - RNA, 15 nt, Homo sapiens
ccucaaagaaauccu

SEQ ID NO: 2045430 - RNA, 14 nt, Homo sapiens
caaaaugugugcuu

SEQ ID NO: 2045431 - RNA, 14 nt, Homo sapiens
cagauuguguacau

SEQ ID NO: 2045432 - RNA, 11 nt, Homo sapiens
gaauguguucu

SEQ ID NO: 2045433 - RNA, 11 nt, Homo sapiens
gcuuguguuaa

SEQ ID NO: 2045434 - RNA, 21 nt, Homo sapiens
aaccucaugacagccagagcc

SEQ ID NO: 2045435 - RNA, 12 nt, Homo sapiens
agcgcugcagua

SEQ ID NO: 2045436 - RNA, 13 nt, Homo sapiens
auaacagugccag

SEQ ID NO: 2045437 - RNA, 21 nt, Homo sapiens
acaugcauucuaccacuacau

SEQ ID NO: 2045438 - RNA, 11 nt, Homo sapiens
gcugccucuug

SEQ ID NO: 2045439 - RNA, 22 nt, Homo sapiens
uaccuuuuauuuuaauguuucc

SEQ ID NO: 2045440 - RNA, 14 nt, Homo sapiens
cuuaaaacuaaaug

SEQ ID NO: 2045441 - RNA, 15 nt, Homo sapiens
aaaauaaacaucagu

SEQ ID NO: 2045442 - RNA, 19 nt, Homo sapiens
ugcauguaucuucuaagaa

SEQ ID NO: 2045443 - RNA, 22 nt, Homo sapiens
agagauccuuuagugcacccag

SEQ ID NO: 2045444 - RNA, 18 nt, Homo sapiens
ggccuucaguuuccaucc

SEQ ID NO: 2045445 - RNA, 22 nt, Homo sapiens
cagggcucagagugacccucag

SEQ ID NO: 2045446 - RNA, 15 nt, Homo sapiens
uucccuguuugccua

SEQ ID NO: 2045447 - RNA, 16 nt, Homo sapiens
cuuccagguaugggac

SEQ ID NO: 2045448 - RNA, 18 nt, Homo sapiens
aguuccaccaugagcuca

SEQ ID NO: 2045449 - RNA, 14 nt, Homo sapiens
aauguaagcauacu

SEQ ID NO: 2045450 - RNA, 14 nt, Homo sapiens
ucuagccacugagc

SEQ ID NO: 2045451 - RNA, 14 nt, Homo sapiens
uugccccaccuccc

SEQ ID NO: 2045452 - RNA, 19 nt, Homo sapiens
caggacuucucuuuaguca

SEQ ID NO: 2045453 - RNA, 17 nt, Homo sapiens
ccuaagagagcaccugg

SEQ ID NO: 2045454 - RNA, 18 nt, Homo sapiens
cacagccuggcuauacag

SEQ ID NO: 2045455 - RNA, 15 nt, Homo sapiens
agccacccugccaug

SEQ ID NO: 2045456 - RNA, 20 nt, Homo sapiens
ucaauaaaaaauuaugacau

SEQ ID NO: 2045457 - RNA, 17 nt, Homo sapiens
aggaguggcagcugucc

SEQ ID NO: 2045458 - RNA, 13 nt, Homo sapiens
aacuuucuuucac

SEQ ID NO: 2045459 - RNA, 21 nt, Homo sapiens
acaauaggugcuuauucucaa

SEQ ID NO: 2045460 - RNA, 14 nt, Homo sapiens
cagggauggggcca

SEQ ID NO: 2045461 - RNA, 19 nt, Homo sapiens
guucugauauuaauuuauc

SEQ ID NO: 2045462 - RNA, 15 nt, Homo sapiens
uuuuuccaaguguau

SEQ ID NO: 2045463 - RNA, 13 nt, Homo sapiens
aaggcagcaacaa

SEQ ID NO: 2045464 - RNA, 13 nt, Homo sapiens
uuggcagcuucaa

SEQ ID NO: 2045465 - RNA, 16 nt, Homo sapiens
ccagcaccaccccauc

SEQ ID NO: 2045466 - RNA, 15 nt, Homo sapiens
gagagauucuucccc

SEQ ID NO: 2045467 - RNA, 23 nt, Homo sapiens
ccuaugaaauacuuuauagcaca

SEQ ID NO: 2045468 - RNA, 12 nt, Homo sapiens
auuguagcuuuu

SEQ ID NO: 2045469 - RNA, 15 nt, Homo sapiens
cuagguaggggccca

SEQ ID NO: 2045470 - RNA, 18 nt, Homo sapiens
ggagaccuggacacaggc

SEQ ID NO: 2045471 - RNA, 21 nt, Homo sapiens
caaugaccaaggacugcuaca

SEQ ID NO: 2045472 - RNA, 18 nt, Homo sapiens
gugaaccacuucauucug

SEQ ID NO: 2045473 - RNA, 17 nt, Homo sapiens
uuugcagcugugccaua

SEQ ID NO: 2045474 - RNA, 18 nt, Homo sapiens
aaggaagcagauaccuug

SEQ ID NO: 2045475 - RNA, 15 nt, Homo sapiens
cauuuccuaugcaaa

SEQ ID NO: 2045476 - RNA, 19 nt, Homo sapiens
agcccuucccaggcuggau

SEQ ID NO: 2045477 - RNA, 22 nt, Homo sapiens
acauccuaccccuuugcacuug

SEQ ID NO: 2045478 - RNA, 19 nt, Homo sapiens
uauaaucaagaaauaacca

SEQ ID NO: 2045479 - RNA, 15 nt, Homo sapiens
gcagucuuguagcua

SEQ ID NO: 2045480 - RNA, 15 nt, Homo sapiens
agauucuuagcucuu

SEQ ID NO: 2045481 - RNA, 16 nt, Homo sapiens
cuaaauuacaaaugca

SEQ ID NO: 2045482 - RNA, 21 nt, Homo sapiens
cccagcccccacagugcuguc

SEQ ID NO: 2045483 - RNA, 21 nt, Homo sapiens
gaaaggucugaggaugaugua

SEQ ID NO: 2045484 - RNA, 19 nt, Homo sapiens
uucuaaaaccuuagucauc

SEQ ID NO: 2045485 - RNA, 21 nt, Homo sapiens
cuguuggggaccucaccugcu

SEQ ID NO: 2045486 - RNA, 14 nt, Homo sapiens
uuguugcagccaaa

SEQ ID NO: 2045487 - RNA, 14 nt, Homo sapiens
auaugacaacucuu

SEQ ID NO: 2045488 - RNA, 16 nt, Homo sapiens
gaccuuccacacaggg

SEQ ID NO: 2045489 - RNA, 23 nt, Homo sapiens
gcuugagcuccccuggagccagc

SEQ ID NO: 2045490 - RNA, 16 nt, Homo sapiens
gcagaggccaugaaga

SEQ ID NO: 2045491 - RNA, 14 nt, Homo sapiens
acuuguucuugaua

SEQ ID NO: 2045492 - RNA, 20 nt, Homo sapiens
ugaggaaggaagauuugaug

SEQ ID NO: 2045493 - RNA, 15 nt, Homo sapiens
ucaauauucagcaaa

SEQ ID NO: 2045494 - RNA, 16 nt, Homo sapiens
acagcaagucaggguu

SEQ ID NO: 2045495 - RNA, 14 nt, Homo sapiens
gucuccagcccacg

SEQ ID NO: 2045496 - RNA, 18 nt, Homo sapiens
gcauaaauuuguaauaua

SEQ ID NO: 2045497 - RNA, 21 nt, Homo sapiens
gcuuuagguugcuucagcuga

SEQ ID NO: 2045498 - RNA, 18 nt, Homo sapiens
agcauuacauuauuaaac

SEQ ID NO: 2045499 - RNA, 14 nt, Homo sapiens
gugguauuuuaaca

SEQ ID NO: 2045500 - RNA, 22 nt, Homo sapiens
ggguugucaagagagagucaaa

SEQ ID NO: 2045501 - RNA, 14 nt, Homo sapiens
auucacagucucau

SEQ ID NO: 2045502 - RNA, 16 nt, Homo sapiens
aacaucccaagccaga

SEQ ID NO: 2045503 - RNA, 22 nt, Homo sapiens
accauucuccaccugccaggga

SEQ ID NO: 2045504 - RNA, 21 nt, Homo sapiens
agggaacauccugcugcauga

SEQ ID NO: 2045505 - RNA, 12 nt, Homo sapiens
aaaguauucuca

SEQ ID NO: 2045506 - RNA, 23 nt, Homo sapiens
ccuggcacaccagaagugccaug

SEQ ID NO: 2045507 - RNA, 22 nt, Homo sapiens
uuuccgcccucaaaaugacagc

SEQ ID NO: 2045508 - RNA, 13 nt, Homo sapiens
uuguaaucacauu

SEQ ID NO: 2045509 - RNA, 16 nt, Homo sapiens
ugcuuuuugacaugaa

SEQ ID NO: 2045510 - RNA, 15 nt, Homo sapiens
ugaguggacagcagc

SEQ ID NO: 2045511 - RNA, 19 nt, Homo sapiens
uacugugagcuuacauuga

SEQ ID NO: 2045512 - RNA, 19 nt, Homo sapiens
cugccaagagguacuguaa

SEQ ID NO: 2045513 - RNA, 21 nt, Homo sapiens
uggaccuucccuaccaaaggg

SEQ ID NO: 2045514 - RNA, 15 nt, Homo sapiens
aauuuaaguccaccu

SEQ ID NO: 2045515 - RNA, 18 nt, Homo sapiens
ccgggguggagucagggc

SEQ ID NO: 2045516 - RNA, 16 nt, Homo sapiens
gugaagacgucagggg

SEQ ID NO: 2045517 - RNA, 21 nt, Homo sapiens
aguaacauuaacucaguggaa

SEQ ID NO: 2045518 - RNA, 13 nt, Homo sapiens
aguagggggagca

SEQ ID NO: 2045519 - RNA, 22 nt, Homo sapiens
acaguugugauaauagcauuuu

SEQ ID NO: 2045520 - RNA, 17 nt, Homo sapiens
ggaggucagaacauucg

SEQ ID NO: 2045521 - RNA, 21 nt, Homo sapiens
cucagccuuggcagcccugau

SEQ ID NO: 2045522 - RNA, 22 nt, Homo sapiens
cuccagcccagacccaguggac

SEQ ID NO: 2045523 - RNA, 23 nt, Homo sapiens
guagauauuggacaaagaaccuu

SEQ ID NO: 2045524 - RNA, 17 nt, Homo sapiens
guugggauuacagguga

SEQ ID NO: 2045525 - RNA, 14 nt, Homo sapiens
aauuauaaucucuu

SEQ ID NO: 2045526 - RNA, 19 nt, Homo sapiens
gcaugucugccuaugcacu

SEQ ID NO: 2045527 - RNA, 14 nt, Homo sapiens
agcaauaagcacuc

SEQ ID NO: 2045528 - RNA, 22 nt, Homo sapiens
acugcucacguguuugcuguca

SEQ ID NO: 2045529 - RNA, 22 nt, Homo sapiens
gcuggucucaaacuccugaccu

SEQ ID NO: 2045530 - RNA, 14 nt, Homo sapiens
cgcucuguugccca

SEQ ID NO: 2045531 - RNA, 18 nt, Homo sapiens
gaugaccucguacucagg

SEQ ID NO: 2045532 - RNA, 20 nt, Homo sapiens
aacucaaccuggacacucuc

SEQ ID NO: 2045533 - RNA, 19 nt, Homo sapiens
gugccauuacuacuguaca

SEQ ID NO: 2045534 - RNA, 16 nt, Homo sapiens
aaauacuggacucagg

SEQ ID NO: 2045535 - RNA, 20 nt, Homo sapiens
cacugaucacccaaugcauc

SEQ ID NO: 2045536 - RNA, 12 nt, Homo sapiens
guagacugccau

SEQ ID NO: 2045537 - RNA, 20 nt, Homo sapiens
ucuaguauuccagaccugaa

SEQ ID NO: 2045538 - RNA, 14 nt, Homo sapiens
cugaaauuccucug

SEQ ID NO: 2045539 - RNA, 16 nt, Homo sapiens
aaguccccucuacuuu

SEQ ID NO: 2045540 - RNA, 21 nt, Homo sapiens
agcagcucuggcucugccuca

SEQ ID NO: 2045541 - RNA, 21 nt, Homo sapiens
cucgccuguuggggaccucac

SEQ ID NO: 2045542 - RNA, 24 nt, Homo sapiens
gccuggacugaccacaccaaccag

SEQ ID NO: 2045543 - RNA, 17 nt, Homo sapiens
ugugcuagucacuggca

SEQ ID NO: 2045544 - RNA, 17 nt, Homo sapiens
gcaggcacuucacacag

SEQ ID NO: 2045545 - RNA, 22 nt, Homo sapiens
gguucccagaaaacacauuucu

SEQ ID NO: 2045546 - RNA, 15 nt, Homo sapiens
ucauaaacauuugag

SEQ ID NO: 2045547 - RNA, 18 nt, Homo sapiens
cuuuguguagaaagccaa

SEQ ID NO: 2045548 - RNA, 14 nt, Homo sapiens
aagaaucugcucug

SEQ ID NO: 2045549 - RNA, 16 nt, Homo sapiens
ggagacgccaugugau

SEQ ID NO: 2045550 - RNA, 16 nt, Homo sapiens
cucauugcuuaauucu

SEQ ID NO: 2045551 - RNA, 14 nt, Homo sapiens
acggcaagguuuaa

SEQ ID NO: 2045552 - RNA, 17 nt, Homo sapiens
agucuaaauuuucagag

SEQ ID NO: 2045553 - RNA, 16 nt, Homo sapiens
cccgagggugguuuac

SEQ ID NO: 2045554 - RNA, 20 nt, Homo sapiens
aaaauauacuggggcuuccu

SEQ ID NO: 2045555 - RNA, 20 nt, Homo sapiens
cgggcggaucaccugagguc

SEQ ID NO: 2045556 - RNA, 12 nt, Homo sapiens
ccagaguaguuu

SEQ ID NO: 2045557 - RNA, 20 nt, Homo sapiens
augggcaaacccuggugcuu

SEQ ID NO: 2045558 - RNA, 20 nt, Homo sapiens
aagaucagcgacugccacau

SEQ ID NO: 2045559 - RNA, 13 nt, Homo sapiens
aaaucacucucag

SEQ ID NO: 2045560 - RNA, 18 nt, Homo sapiens
uuaauuuggaaacuaaua

SEQ ID NO: 2045561 - RNA, 15 nt, Homo sapiens
gaggguguggugcuu

SEQ ID NO: 2045562 - RNA, 11 nt, Homo sapiens
ccagaccucca

SEQ ID NO: 2045563 - RNA, 18 nt, Homo sapiens
auuagaucaaaagucuac

SEQ ID NO: 2045564 - RNA, 22 nt, Homo sapiens
cuuuggcagaaucccccaaaga

SEQ ID NO: 2045565 - RNA, 15 nt, Homo sapiens
uuggauuccuuuaug

SEQ ID NO: 2045566 - RNA, 18 nt, Homo sapiens
accaacauuguucauucu

SEQ ID NO: 2045567 - RNA, 20 nt, Homo sapiens
aucuaggcacacaaacauuu

SEQ ID NO: 2045568 - RNA, 16 nt, Homo sapiens
uaauggucucaucucc

SEQ ID NO: 2045569 - RNA, 15 nt, Homo sapiens
agcaucaaucuuguu

SEQ ID NO: 2045570 - RNA, 23 nt, Homo sapiens
gcucguucucuucucucuucaau

SEQ ID NO: 2045571 - RNA, 15 nt, Homo sapiens
ucacuuaagccugga

SEQ ID NO: 2045572 - RNA, 17 nt, Homo sapiens
ccuccaaaaugugccua

SEQ ID NO: 2045573 - RNA, 14 nt, Homo sapiens
ugcugcuuagcuug

SEQ ID NO: 2045574 - RNA, 21 nt, Homo sapiens
ucugcaaaaugggaacaauga

SEQ ID NO: 2045575 - RNA, 21 nt, Homo sapiens
ccccagacucuucauucagug

SEQ ID NO: 2045576 - RNA, 15 nt, Homo sapiens
uagaaggauccucca

SEQ ID NO: 2045577 - RNA, 23 nt, Homo sapiens
guuaaacacgugucuauaaugga

SEQ ID NO: 2045578 - RNA, 16 nt, Homo sapiens
ugggacuggggcugaa

SEQ ID NO: 2045579 - RNA, 19 nt, Homo sapiens
cucuggaggccucuggccc

SEQ ID NO: 2045580 - RNA, 16 nt, Homo sapiens
cugucaggugugauaa

SEQ ID NO: 2045581 - RNA, 15 nt, Homo sapiens
ccccagcgauucccu

SEQ ID NO: 2045582 - RNA, 22 nt, Homo sapiens
cugugauggcgggcacugggua

SEQ ID NO: 2045583 - RNA, 21 nt, Homo sapiens
aaugcugauuuaaacuucuua

SEQ ID NO: 2045584 - RNA, 14 nt, Homo sapiens
cacuucaaauucaa

SEQ ID NO: 2045585 - RNA, 16 nt, Homo sapiens
ggccucucacaaaaga

SEQ ID NO: 2045586 - RNA, 20 nt, Homo sapiens
cacaucgcuacgcccaggag

SEQ ID NO: 2045587 - RNA, 19 nt, Homo sapiens
uaaauaucuagaaaugaua

SEQ ID NO: 2045588 - RNA, 19 nt, Homo sapiens
augauuuccaaaauugcaa

SEQ ID NO: 2045589 - RNA, 17 nt, Homo sapiens
aauucuuaagaugugua

SEQ ID NO: 2045590 - RNA, 16 nt, Homo sapiens
auuucagauacuugaa

SEQ ID NO: 2045591 - RNA, 15 nt, Homo sapiens
aggcucucacuccag

SEQ ID NO: 2045592 - RNA, 11 nt, Homo sapiens
auucagugacg

SEQ ID NO: 2045593 - RNA, 17 nt, Homo sapiens
uuccccucauugcauuu

SEQ ID NO: 2045594 - RNA, 18 nt, Homo sapiens
cauugcagucacuuugac

SEQ ID NO: 2045595 - RNA, 21 nt, Homo sapiens
accaugaauuaaaggugccag

SEQ ID NO: 2045596 - RNA, 16 nt, Homo sapiens
uucuugaaaaacuuac

SEQ ID NO: 2045597 - RNA, 13 nt, Homo sapiens
cacugugagcucc

SEQ ID NO: 2045598 - RNA, 17 nt, Homo sapiens
auuucuuuuccaaaauu

SEQ ID NO: 2045599 - RNA, 22 nt, Homo sapiens
aguuagucaauccugucauaua

SEQ ID NO: 2045600 - RNA, 23 nt, Homo sapiens
gggccaacaaggacucagaugag

SEQ ID NO: 2045601 - RNA, 16 nt, Homo sapiens
cacugaagcagaauug

SEQ ID NO: 2045602 - RNA, 15 nt, Homo sapiens
aaaagaaaagaaaau

SEQ ID NO: 2045603 - RNA, 16 nt, Homo sapiens
agcaaaacaguucuca

SEQ ID NO: 2045604 - RNA, 16 nt, Homo sapiens
ugacaugagauuuaua

SEQ ID NO: 2045605 - RNA, 14 nt, Homo sapiens
gaaaccccugacac

SEQ ID NO: 2045606 - RNA, 13 nt, Homo sapiens
auugugguugguu

SEQ ID NO: 2045607 - RNA, 20 nt, Homo sapiens
uagcaggauaugacaacucu

SEQ ID NO: 2045608 - RNA, 14 nt, Homo sapiens
uuuaauagagaacu

SEQ ID NO: 2045609 - RNA, 23 nt, Homo sapiens
cagacucucucuuaucaccccuu

SEQ ID NO: 2045610 - RNA, 14 nt, Homo sapiens
ggucagucacuuga

SEQ ID NO: 2045611 - RNA, 19 nt, Homo sapiens
auguugaggugaccacuua

SEQ ID NO: 2045612 - RNA, 15 nt, Homo sapiens
aucagaaggugacaa

SEQ ID NO: 2045613 - RNA, 16 nt, Homo sapiens
aaaauuucagcauuau

SEQ ID NO: 2045614 - RNA, 18 nt, Homo sapiens
acaaaggagcauugcagu

SEQ ID NO: 2045615 - RNA, 12 nt, Homo sapiens
acuaaacauuuc

SEQ ID NO: 2045616 - RNA, 22 nt, Homo sapiens
ugcagguuggaacuaugcagug

SEQ ID NO: 2045617 - RNA, 21 nt, Homo sapiens
uaucucuucucagaaggaaag

SEQ ID NO: 2045618 - RNA, 19 nt, Homo sapiens
aguccuuucugugaagcua

SEQ ID NO: 2045619 - RNA, 22 nt, Homo sapiens
aaaaccuuucaaaggauaugca

SEQ ID NO: 2045620 - RNA, 12 nt, Homo sapiens
aauaugucuugg

SEQ ID NO: 2045621 - RNA, 14 nt, Homo sapiens
aaguuuaaugccua

SEQ ID NO: 2045622 - RNA, 16 nt, Homo sapiens
gagaaaaaaauugcuc

SEQ ID NO: 2045623 - RNA, 18 nt, Homo sapiens
uucaaagaguccuaagga

SEQ ID NO: 2045624 - RNA, 22 nt, Homo sapiens
ucaagaagucacugucagagaa

SEQ ID NO: 2045625 - RNA, 18 nt, Homo sapiens
ccaagacucccagaucag

SEQ ID NO: 2045626 - RNA, 19 nt, Homo sapiens
ugaaaaaugcucaaucuca

SEQ ID NO: 2045627 - RNA, 21 nt, Homo sapiens
gauuacaggugugagccacca

SEQ ID NO: 2045628 - RNA, 20 nt, Homo sapiens
cauuaccaguaaaggcucuu

SEQ ID NO: 2045629 - RNA, 21 nt, Homo sapiens
gaagcuggcccucagcucccu

SEQ ID NO: 2045630 - RNA, 20 nt, Homo sapiens
ccugccuccugccaccccuu

SEQ ID NO: 2045631 - RNA, 21 nt, Homo sapiens
uauucacaaccacucauucaa

SEQ ID NO: 2045632 - RNA, 12 nt, Homo sapiens
augaacaucucu

SEQ ID NO: 2045633 - RNA, 21 nt, Homo sapiens
ggccucaacuccucccauaga

SEQ ID NO: 2045634 - RNA, 12 nt, Homo sapiens
cuaguguagcug

SEQ ID NO: 2045635 - RNA, 14 nt, Homo sapiens
gacaacacugggaa

SEQ ID NO: 2045636 - RNA, 15 nt, Homo sapiens
acuagauacuacuuu

SEQ ID NO: 2045637 - RNA, 23 nt, Homo sapiens
uuuaaggauguugccacuggcaa

SEQ ID NO: 2045638 - RNA, 13 nt, Homo sapiens
ggggcucuucuca

SEQ ID NO: 2045639 - RNA, 17 nt, Homo sapiens
cacagcaucgggagcac

SEQ ID NO: 2045640 - RNA, 16 nt, Homo sapiens
cccagcguguguaucc

SEQ ID NO: 2045641 - RNA, 21 nt, Homo sapiens
aagcacauuuuaaaaaccaga

SEQ ID NO: 2045642 - RNA, 22 nt, Homo sapiens
aguccggcuaaguggagcucag

SEQ ID NO: 2045643 - RNA, 17 nt, Homo sapiens
caaggcugaccaagaga

SEQ ID NO: 2045644 - RNA, 22 nt, Homo sapiens
cuggaggaagaagacacauucc

SEQ ID NO: 2045645 - RNA, 13 nt, Homo sapiens
gugugucagcuga

SEQ ID NO: 2045646 - RNA, 15 nt, Homo sapiens
ucuccagccacucca

SEQ ID NO: 2045647 - RNA, 14 nt, Homo sapiens
caauaauuacugua

SEQ ID NO: 2045648 - RNA, 15 nt, Homo sapiens
augucuuaaaaccug

SEQ ID NO: 2045649 - RNA, 21 nt, Homo sapiens
ucaagggcuagcaucccugag

SEQ ID NO: 2045650 - RNA, 17 nt, Homo sapiens
gcacuaacacaugcaca

SEQ ID NO: 2045651 - RNA, 20 nt, Homo sapiens
guacuguaauaauaccucaa

SEQ ID NO: 2045652 - RNA, 15 nt, Homo sapiens
uauuuuuauguucuu

SEQ ID NO: 2045653 - RNA, 14 nt, Homo sapiens
gccucuuuguucca

SEQ ID NO: 2045654 - RNA, 15 nt, Homo sapiens
agcuacuuuugccaa

SEQ ID NO: 2045655 - RNA, 14 nt, Homo sapiens
aaaguuauugugau

SEQ ID NO: 2045656 - RNA, 16 nt, Homo sapiens
aagucaccuaaguacu

SEQ ID NO: 2045657 - RNA, 18 nt, Homo sapiens
ugaacaucucacuuugcc

SEQ ID NO: 2045658 - RNA, 15 nt, Homo sapiens
cagcuacaauuguaa

SEQ ID NO: 2045659 - RNA, 19 nt, Homo sapiens
cucucugagagcaaacagg

SEQ ID NO: 2045660 - RNA, 14 nt, Homo sapiens
ggggugcagcagug

SEQ ID NO: 2045661 - RNA, 20 nt, Homo sapiens
cagcauaccuuggacugacu

SEQ ID NO: 2045662 - RNA, 11 nt, Homo sapiens
cuaugguucuc

SEQ ID NO: 2045663 - RNA, 19 nt, Homo sapiens
gcauguggccuuuaucuca

SEQ ID NO: 2045664 - RNA, 23 nt, Homo sapiens
ugaguggucacuggucagggcag

SEQ ID NO: 2045665 - RNA, 22 nt, Homo sapiens
caaugagaaugaugcacacuga

SEQ ID NO: 2045666 - RNA, 22 nt, Homo sapiens
aaacugcucagcgcgucucagc

SEQ ID NO: 2045667 - RNA, 10 nt, Homo sapiens
auuccagcuc

SEQ ID NO: 2045668 - RNA, 20 nt, Homo sapiens
aaaggcaagucaaauaccac

SEQ ID NO: 2045669 - RNA, 18 nt, Homo sapiens
cugggugcaggacacugg

SEQ ID NO: 2045670 - RNA, 20 nt, Homo sapiens
aaaaggcugauuacugaaau

SEQ ID NO: 2045671 - RNA, 19 nt, Homo sapiens
ugagauacuuuacuaauaa

SEQ ID NO: 2045672 - RNA, 20 nt, Homo sapiens
acugcucuccccacccagac

SEQ ID NO: 2045673 - RNA, 16 nt, Homo sapiens
auuggaauuacuguaa

SEQ ID NO: 2045674 - RNA, 22 nt, Homo sapiens
cucauuuaauuuuuauuaaaca

SEQ ID NO: 2045675 - RNA, 19 nt, Homo sapiens
guagaaacacaguuuugaa

SEQ ID NO: 2045676 - RNA, 15 nt, Homo sapiens
caaguaacugaacca

SEQ ID NO: 2045677 - RNA, 12 nt, Homo sapiens
cuggagggauuc

SEQ ID NO: 2045678 - RNA, 15 nt, Homo sapiens
gccucgucauggcca

SEQ ID NO: 2045679 - RNA, 14 nt, Homo sapiens
ggaaacgcacuuac

SEQ ID NO: 2045680 - RNA, 20 nt, Homo sapiens
cucaccgggcuacuaccugg

SEQ ID NO: 2045681 - RNA, 16 nt, Homo sapiens
auguuuucaaaaccaa

SEQ ID NO: 2045682 - RNA, 23 nt, Homo sapiens
cacacugaaauucuaaauauuga

SEQ ID NO: 2045683 - RNA, 15 nt, Homo sapiens
gaguggcggggcccc

SEQ ID NO: 2045684 - RNA, 16 nt, Homo sapiens
ggaaaacagggugcua

SEQ ID NO: 2045685 - RNA, 20 nt, Homo sapiens
aagaauuggacaugauguau

SEQ ID NO: 2045686 - RNA, 18 nt, Homo sapiens
agccugggcaacacagug

SEQ ID NO: 2045687 - RNA, 16 nt, Homo sapiens
uuggacuugcugaauu

SEQ ID NO: 2045688 - RNA, 17 nt, Homo sapiens
uauucucuucacuccca

SEQ ID NO: 2045689 - RNA, 16 nt, Homo sapiens
ccaagcccucaauaag

SEQ ID NO: 2045690 - RNA, 12 nt, Homo sapiens
aggucacucucc

SEQ ID NO: 2045691 - RNA, 12 nt, Homo sapiens
agcucacucugc

SEQ ID NO: 2045692 - RNA, 18 nt, Homo sapiens
auuuuucuuugguuuauu

SEQ ID NO: 2045693 - RNA, 18 nt, Homo sapiens
cuguuuuuaauguucaca

SEQ ID NO: 2045694 - RNA, 23 nt, Homo sapiens
ugucaacaaggggucaaugucau

SEQ ID NO: 2045695 - RNA, 22 nt, Homo sapiens
agggggggccgggccaggagaa

SEQ ID NO: 2045696 - RNA, 14 nt, Homo sapiens
gaauguacucuguu

SEQ ID NO: 2045697 - RNA, 21 nt, Homo sapiens
uggccacugaauuagccaaaa

SEQ ID NO: 2045698 - RNA, 14 nt, Homo sapiens
agagaagaggcugg

SEQ ID NO: 2045699 - RNA, 17 nt, Homo sapiens
ucucccaguaauuuuuc

SEQ ID NO: 2045700 - RNA, 17 nt, Homo sapiens
uauccuagucauucuuc

SEQ ID NO: 2045701 - RNA, 19 nt, Homo sapiens
agccuacauugaugccaag

SEQ ID NO: 2045702 - RNA, 21 nt, Homo sapiens
uuuggucaugugguacuugag

SEQ ID NO: 2045703 - RNA, 19 nt, Homo sapiens
uccggccacacauccugcu

SEQ ID NO: 2045704 - RNA, 23 nt, Homo sapiens
accuggcucuguggcgagccauu

SEQ ID NO: 2045705 - RNA, 21 nt, Homo sapiens
guuuagaaucaagucugugaa

SEQ ID NO: 2045706 - RNA, 23 nt, Homo sapiens
acaccuccgagacaguccagugu

SEQ ID NO: 2045707 - RNA, 16 nt, Homo sapiens
aggcagggcccugaaa

SEQ ID NO: 2045708 - RNA, 17 nt, Homo sapiens
gcccagaaagucucuca

SEQ ID NO: 2045709 - RNA, 15 nt, Homo sapiens
gugaaugaaucucaa

SEQ ID NO: 2045710 - RNA, 17 nt, Homo sapiens
ucucagccuccugagua

SEQ ID NO: 2045711 - RNA, 14 nt, Homo sapiens
gccugucucaguga

SEQ ID NO: 2045712 - RNA, 14 nt, Homo sapiens
ccugguguguuucc

SEQ ID NO: 2045713 - RNA, 13 nt, Homo sapiens
cggggacugcugg

SEQ ID NO: 2045714 - RNA, 14 nt, Homo sapiens
uggguuaaguauua

SEQ ID NO: 2045715 - RNA, 15 nt, Homo sapiens
cucaaaauaaaacca

SEQ ID NO: 2045716 - RNA, 23 nt, Homo sapiens
auagcaccccuacucacauacac

SEQ ID NO: 2045717 - RNA, 17 nt, Homo sapiens
accugcacaaacauaga

SEQ ID NO: 2045718 - RNA, 13 nt, Homo sapiens
gguaguuuugcca

SEQ ID NO: 2045719 - RNA, 13 nt, Homo sapiens
ucucauuugccag

SEQ ID NO: 2045720 - RNA, 16 nt, Homo sapiens
ugucuugucaucuuuu

SEQ ID NO: 2045721 - RNA, 15 nt, Homo sapiens
gggagaugcugggau

SEQ ID NO: 2045722 - RNA, 15 nt, Homo sapiens
aggucaaaacauuca

SEQ ID NO: 2045723 - RNA, 15 nt, Homo sapiens
acuggaguuccuuau

SEQ ID NO: 2045724 - RNA, 14 nt, Homo sapiens
uaaaaugcauuuaa

SEQ ID NO: 2045725 - RNA, 21 nt, Homo sapiens
aguauuaaugaaaagcacaaa

SEQ ID NO: 2045726 - RNA, 16 nt, Homo sapiens
uaaaguaaugaucuca

SEQ ID NO: 2045727 - RNA, 14 nt, Homo sapiens
uauuuuauacugca

SEQ ID NO: 2045728 - RNA, 13 nt, Homo sapiens
gcaucacccagcu

SEQ ID NO: 2045729 - RNA, 22 nt, Homo sapiens
aaguaguaaugauucucaagau

SEQ ID NO: 2045730 - RNA, 15 nt, Homo sapiens
aauagcauuugccac

SEQ ID NO: 2045731 - RNA, 17 nt, Homo sapiens
uaagccuuuugcucaca

SEQ ID NO: 2045732 - RNA, 19 nt, Homo sapiens
ccagggcauuguguucacu

SEQ ID NO: 2045733 - RNA, 16 nt, Homo sapiens
ugaaaugcaaaaggaa

SEQ ID NO: 2045734 - RNA, 18 nt, Homo sapiens
accaauugggucaggaag

SEQ ID NO: 2045735 - RNA, 18 nt, Homo sapiens
gguaucaagacauagcau

SEQ ID NO: 2045736 - RNA, 17 nt, Homo sapiens
ugaccaaugcauuaccu

SEQ ID NO: 2045737 - RNA, 16 nt, Homo sapiens
guuuggauuauuccuc

SEQ ID NO: 2045738 - RNA, 21 nt, Homo sapiens
aaaguaaagaacaacaacaaa

SEQ ID NO: 2045739 - RNA, 21 nt, Homo sapiens
ucgccccaggcccucccugac

SEQ ID NO: 2045740 - RNA, 18 nt, Homo sapiens
uaauacagguaacauuau

SEQ ID NO: 2045741 - RNA, 19 nt, Homo sapiens
accugguacccuccuggcu

SEQ ID NO: 2045742 - RNA, 12 nt, Homo sapiens
guucagaccgac

SEQ ID NO: 2045743 - RNA, 14 nt, Homo sapiens
gugacauauuucau

SEQ ID NO: 2045744 - RNA, 18 nt, Homo sapiens
uaccaagagauucuucua

SEQ ID NO: 2045745 - RNA, 17 nt, Homo sapiens
uacaguguccuaccacu

SEQ ID NO: 2045746 - RNA, 13 nt, Homo sapiens
agagggggccaga

SEQ ID NO: 2045747 - RNA, 12 nt, Homo sapiens
ugugaagcaaaa

SEQ ID NO: 2045748 - RNA, 21 nt, Homo sapiens
cacauaucagcaggaguaaua

SEQ ID NO: 2045749 - RNA, 14 nt, Homo sapiens
uucguacaguucuu

SEQ ID NO: 2045750 - RNA, 21 nt, Homo sapiens
caugguccauuucaugugauc

SEQ ID NO: 2045751 - RNA, 16 nt, Homo sapiens
cggcgcaagaccagcu

SEQ ID NO: 2045752 - RNA, 17 nt, Homo sapiens
gagccuuaccaauaaua

SEQ ID NO: 2045753 - RNA, 17 nt, Homo sapiens
agguaauuuuucaccuu

SEQ ID NO: 2045754 - RNA, 22 nt, Homo sapiens
aucaaauggaagacacauugaa

SEQ ID NO: 2045755 - RNA, 18 nt, Homo sapiens
gccucgcccccacuuuuc

SEQ ID NO: 2045756 - RNA, 19 nt, Homo sapiens
gaaaggacugugugaccuc

SEQ ID NO: 2045757 - RNA, 21 nt, Homo sapiens
ccggugugaggaggggcggga

SEQ ID NO: 2045758 - RNA, 21 nt, Homo sapiens
agagucagcucucugcccugu

SEQ ID NO: 2045759 - RNA, 20 nt, Homo sapiens
aucaucucuuuucccacucc

SEQ ID NO: 2045760 - RNA, 20 nt, Homo sapiens
aaaccuuauuuuuucccaaa

SEQ ID NO: 2045761 - RNA, 18 nt, Homo sapiens
agacucugggcugucagc

SEQ ID NO: 2045762 - RNA, 23 nt, Homo sapiens
ccucagggaguuugacgagcuca

SEQ ID NO: 2045763 - RNA, 19 nt, Homo sapiens
auuaggggguuuguugcac

SEQ ID NO: 2045764 - RNA, 14 nt, Homo sapiens
acuggcagcauuga

SEQ ID NO: 2045765 - RNA, 19 nt, Homo sapiens
gcgaaaccccucucuacua

SEQ ID NO: 2045766 - RNA, 17 nt, Homo sapiens
cgaaucuacuaauucca

SEQ ID NO: 2045767 - RNA, 12 nt, Homo sapiens
ucgcugugaaaa

SEQ ID NO: 2045768 - RNA, 16 nt, Homo sapiens
uguucugcuuccaaca

SEQ ID NO: 2045769 - RNA, 13 nt, Homo sapiens
ucaaagccuucuc

SEQ ID NO: 2045770 - RNA, 13 nt, Homo sapiens
uuaaagccuccuc

SEQ ID NO: 2045771 - RNA, 20 nt, Homo sapiens
acuugagaagucuaauucac

SEQ ID NO: 2045772 - RNA, 23 nt, Homo sapiens
cuaaauuuuccuguccucuuuca

SEQ ID NO: 2045773 - RNA, 20 nt, Homo sapiens
uguacaauaaagcaaugugg

SEQ ID NO: 2045774 - RNA, 13 nt, Homo sapiens
cucuugaacacaa

SEQ ID NO: 2045775 - RNA, 19 nt, Homo sapiens
gcccccagggccuccaggg

SEQ ID NO: 2045776 - RNA, 22 nt, Homo sapiens
cuguuggaagaaaagaaucaca

SEQ ID NO: 2045777 - RNA, 22 nt, Homo sapiens
ccccaaaucccccgacucccuc

SEQ ID NO: 2045778 - RNA, 20 nt, Homo sapiens
ggccacuaggaggaaugugu

SEQ ID NO: 2045779 - RNA, 23 nt, Homo sapiens
cuucuuaaaauucaaacauauuc

SEQ ID NO: 2045780 - RNA, 22 nt, Homo sapiens
uuggcugugcccucagauuccg

SEQ ID NO: 2045781 - RNA, 11 nt, Homo sapiens
ccuaaagccaa

SEQ ID NO: 2045782 - RNA, 16 nt, Homo sapiens
aauauacugcauaucc

SEQ ID NO: 2045783 - RNA, 15 nt, Homo sapiens
gaaaacuugugcccu

SEQ ID NO: 2045784 - RNA, 15 nt, Homo sapiens
cagaaaaucuaccaa

SEQ ID NO: 2045785 - RNA, 22 nt, Homo sapiens
uugcugauaaauauaaccauca

SEQ ID NO: 2045786 - RNA, 16 nt, Homo sapiens
uggggaagcugugaaa

SEQ ID NO: 2045787 - RNA, 18 nt, Homo sapiens
cuuauaauauacauaacu

SEQ ID NO: 2045788 - RNA, 20 nt, Homo sapiens
ugcugacaggugaugcucug

SEQ ID NO: 2045789 - RNA, 19 nt, Homo sapiens
ucaaaacacacuacuaccu

SEQ ID NO: 2045790 - RNA, 16 nt, Homo sapiens
auccuugaauguucuc

SEQ ID NO: 2045791 - RNA, 18 nt, Homo sapiens
aaucacgccgcaugcaca

SEQ ID NO: 2045792 - RNA, 20 nt, Homo sapiens
uauguacccuacccugcaca

SEQ ID NO: 2045793 - RNA, 14 nt, Homo sapiens
auggagagguuugu

SEQ ID NO: 2045794 - RNA, 14 nt, Homo sapiens
auuggagcagggac

SEQ ID NO: 2045795 - RNA, 21 nt, Homo sapiens
ccagguccggagggguugcgg

SEQ ID NO: 2045796 - RNA, 16 nt, Homo sapiens
cagucccacacugugg

SEQ ID NO: 2045797 - RNA, 14 nt, Homo sapiens
gauugaagucuucu

SEQ ID NO: 2045798 - RNA, 17 nt, Homo sapiens
ugccaauagugucaucc

SEQ ID NO: 2045799 - RNA, 13 nt, Homo sapiens
accaagacugagc

SEQ ID NO: 2045800 - RNA, 18 nt, Homo sapiens
uagcugcauuccuagaaa

SEQ ID NO: 2045801 - RNA, 14 nt, Homo sapiens
auaaccauaaauca

SEQ ID NO: 2045802 - RNA, 12 nt, Homo sapiens
ucaggacaaugu

SEQ ID NO: 2045803 - RNA, 19 nt, Homo sapiens
cuucuauacccacccagaa

SEQ ID NO: 2045804 - RNA, 19 nt, Homo sapiens
gaccuuuaccuccugccuu

SEQ ID NO: 2045805 - RNA, 12 nt, Homo sapiens
aggaaucucaga

SEQ ID NO: 2045806 - RNA, 20 nt, Homo sapiens
ucaugagcuugaacaaggac

SEQ ID NO: 2045807 - RNA, 18 nt, Homo sapiens
cuauagacuguaagcucc

SEQ ID NO: 2045808 - RNA, 17 nt, Homo sapiens
gagaacuugaaacagau

SEQ ID NO: 2045809 - RNA, 15 nt, Homo sapiens
ugauggccaccagcu

SEQ ID NO: 2045810 - RNA, 17 nt, Homo sapiens
uugucaguuuacaccaa

SEQ ID NO: 2045811 - RNA, 21 nt, Homo sapiens
acagagaagaccuucuaguga

SEQ ID NO: 2045812 - RNA, 17 nt, Homo sapiens
uccaguccugcucucua

SEQ ID NO: 2045813 - RNA, 14 nt, Homo sapiens
cuguagacugccau

SEQ ID NO: 2045814 - RNA, 23 nt, Homo sapiens
uacugccaagggcaggaccaaug

SEQ ID NO: 2045815 - RNA, 22 nt, Homo sapiens
acaucaagcgaugaaacuggaa

SEQ ID NO: 2045816 - RNA, 22 nt, Homo sapiens
ccagaagcucaaggcugcagug

SEQ ID NO: 2045817 - RNA, 15 nt, Homo sapiens
uaagaaauucacuuc

SEQ ID NO: 2045818 - RNA, 15 nt, Homo sapiens
caucccaguguccua

SEQ ID NO: 2045819 - RNA, 14 nt, Homo sapiens
agggcaucaucuau

SEQ ID NO: 2045820 - RNA, 15 nt, Homo sapiens
uagcuuucagucuuc

SEQ ID NO: 2045821 - RNA, 18 nt, Homo sapiens
ugucacccugcagagcua

SEQ ID NO: 2045822 - RNA, 13 nt, Homo sapiens
uagguuccagcau

SEQ ID NO: 2045823 - RNA, 16 nt, Homo sapiens
aauuuaaguacuugag

SEQ ID NO: 2045824 - RNA, 14 nt, Homo sapiens
cugguaugugccag

SEQ ID NO: 2045825 - RNA, 18 nt, Homo sapiens
uugcaaaucacucugcaa

SEQ ID NO: 2045826 - RNA, 20 nt, Homo sapiens
ucggagaaacgggugagcug

SEQ ID NO: 2045827 - RNA, 11 nt, Homo sapiens
ccuugaagcuu

SEQ ID NO: 2045828 - RNA, 18 nt, Homo sapiens
ugcucuauacuguggccu

SEQ ID NO: 2045829 - RNA, 13 nt, Homo sapiens
cugccccaugugu

SEQ ID NO: 2045830 - RNA, 18 nt, Homo sapiens
aacagggaugcuaucucg

SEQ ID NO: 2045831 - RNA, 22 nt, Homo sapiens
ugauuuagggaagcagggacac

SEQ ID NO: 2045832 - RNA, 13 nt, Homo sapiens
augcagacuuccu

SEQ ID NO: 2045833 - RNA, 14 nt, Homo sapiens
uggaaauaaaccug

SEQ ID NO: 2045834 - RNA, 19 nt, Homo sapiens
acucuguaaaaugcaccaa

SEQ ID NO: 2045835 - RNA, 16 nt, Homo sapiens
augcaaaguuacauga

SEQ ID NO: 2045836 - RNA, 19 nt, Homo sapiens
aacccauguugaucuuucu

SEQ ID NO: 2045837 - RNA, 17 nt, Homo sapiens
uuagauuagcucuggac

SEQ ID NO: 2045838 - RNA, 20 nt, Homo sapiens
caaugcugacuggacugugu

SEQ ID NO: 2045839 - RNA, 19 nt, Homo sapiens
uaggaagaugauggcucau

SEQ ID NO: 2045840 - RNA, 19 nt, Homo sapiens
aguauauuaggaaacuggg

SEQ ID NO: 2045841 - RNA, 22 nt, Homo sapiens
aauuauaaucaaaaucaaugca

SEQ ID NO: 2045842 - RNA, 12 nt, Homo sapiens
agaaaagccacg

SEQ ID NO: 2045843 - RNA, 18 nt, Homo sapiens
uccuucucguuugcucua

SEQ ID NO: 2045844 - RNA, 15 nt, Homo sapiens
gaauggggaccuggg

SEQ ID NO: 2045845 - RNA, 23 nt, Homo sapiens
uagacucacucuuccacauuccc

SEQ ID NO: 2045846 - RNA, 16 nt, Homo sapiens
augucaucaagcucca

SEQ ID NO: 2045847 - RNA, 16 nt, Homo sapiens
uccugguuuccacugu

SEQ ID NO: 2045848 - RNA, 21 nt, Homo sapiens
ucaccuagcuugucccaagcu

SEQ ID NO: 2045849 - RNA, 22 nt, Homo sapiens
agccaugugaaacucaucucau

SEQ ID NO: 2045850 - RNA, 13 nt, Homo sapiens
acacaaugcauca

SEQ ID NO: 2045851 - RNA, 19 nt, Homo sapiens
ugcaaaaaugaaauccagu

SEQ ID NO: 2045852 - RNA, 15 nt, Homo sapiens
ugugagaccagggga

SEQ ID NO: 2045853 - RNA, 15 nt, Homo sapiens
cgucccauccagcua

SEQ ID NO: 2045854 - RNA, 15 nt, Homo sapiens
agcgauuaauaacag

SEQ ID NO: 2045855 - RNA, 21 nt, Homo sapiens
uggcuacacacaaaccaguau

SEQ ID NO: 2045856 - RNA, 14 nt, Homo sapiens
accaauacuacuga

SEQ ID NO: 2045857 - RNA, 14 nt, Homo sapiens
acaaguacuaauaa

SEQ ID NO: 2045858 - RNA, 20 nt, Homo sapiens
uagaauccaauuaaugauuc

SEQ ID NO: 2045859 - RNA, 16 nt, Homo sapiens
ccauuagucuagccuu

SEQ ID NO: 2045860 - RNA, 13 nt, Homo sapiens
agacaaugggaau

SEQ ID NO: 2045861 - RNA, 22 nt, Homo sapiens
aaagauccacccucaaauguca

SEQ ID NO: 2045862 - RNA, 20 nt, Homo sapiens
uccuuaugacuccauucaaa

SEQ ID NO: 2045863 - RNA, 20 nt, Homo sapiens
cccaugaucaccccuuugag

SEQ ID NO: 2045864 - RNA, 12 nt, Homo sapiens
ccauucaggaca

SEQ ID NO: 2045865 - RNA, 16 nt, Homo sapiens
ccaaagugcaugucac

SEQ ID NO: 2045866 - RNA, 22 nt, Homo sapiens
uguggccacuuuccagggugga

SEQ ID NO: 2045867 - RNA, 20 nt, Homo sapiens
ugcaaggauucagcauuauu

SEQ ID NO: 2045868 - RNA, 17 nt, Homo sapiens
cgagccaggaccacaga

SEQ ID NO: 2045869 - RNA, 14 nt, Homo sapiens
uacauaacugccuu

SEQ ID NO: 2045870 - RNA, 23 nt, Homo sapiens
gcaggagagaaugcccagugacc

SEQ ID NO: 2045871 - RNA, 13 nt, Homo sapiens
ggaaccaugaagc

SEQ ID NO: 2045872 - RNA, 19 nt, Homo sapiens
uaguuagccaauaugcaau

SEQ ID NO: 2045873 - RNA, 23 nt, Homo sapiens
gucauuggaaacacugccuuugu

SEQ ID NO: 2045874 - RNA, 17 nt, Homo sapiens
guuuucaucaagacugg

SEQ ID NO: 2045875 - RNA, 19 nt, Homo sapiens
uuaugucucuugagcauca

SEQ ID NO: 2045876 - RNA, 14 nt, Homo sapiens
ucucagaggacaau

SEQ ID NO: 2045877 - RNA, 14 nt, Homo sapiens
guuugugauugcca

SEQ ID NO: 2045878 - RNA, 16 nt, Homo sapiens
cuagccucuuucuccc

SEQ ID NO: 2045879 - RNA, 23 nt, Homo sapiens
aggccggaaaaggcgcaucuaac

SEQ ID NO: 2045880 - RNA, 18 nt, Homo sapiens
ggucauuuccuaugcaaa

SEQ ID NO: 2045881 - RNA, 23 nt, Homo sapiens
acaaggugagugugacuucccuu

SEQ ID NO: 2045882 - RNA, 14 nt, Homo sapiens
aggacaauuucaaa

SEQ ID NO: 2045883 - RNA, 13 nt, Homo sapiens
cugccaagcccuc

SEQ ID NO: 2045884 - RNA, 21 nt, Homo sapiens
cuaauuccccuuccauuccca

SEQ ID NO: 2045885 - RNA, 19 nt, Homo sapiens
aaaguguaacaauugugua

SEQ ID NO: 2045886 - RNA, 15 nt, Homo sapiens
gcuuaaagcuugauu

SEQ ID NO: 2045887 - RNA, 17 nt, Homo sapiens
aaguuuaaaacccaaac

SEQ ID NO: 2045888 - RNA, 19 nt, Homo sapiens
agucagucaugucacugaa

SEQ ID NO: 2045889 - RNA, 19 nt, Homo sapiens
caugauggcuguagcuguu

SEQ ID NO: 2045890 - RNA, 22 nt, Homo sapiens
uucuauuucaacuucaggaaag

SEQ ID NO: 2045891 - RNA, 21 nt, Homo sapiens
cauuaaauagcugcaccaucc

SEQ ID NO: 2045892 - RNA, 16 nt, Homo sapiens
ccugauauaacacuuu

SEQ ID NO: 2045893 - RNA, 23 nt, Homo sapiens
gugguggcaggcaccuguagucc

SEQ ID NO: 2045894 - RNA, 17 nt, Homo sapiens
cggcuugugaggcuucc

SEQ ID NO: 2045895 - RNA, 23 nt, Homo sapiens
uaaaaugaccaguaauugugaaa

SEQ ID NO: 2045896 - RNA, 15 nt, Homo sapiens
cucaguguccucauc

SEQ ID NO: 2045897 - RNA, 22 nt, Homo sapiens
ugaguaccaugggcuacagugu

SEQ ID NO: 2045898 - RNA, 15 nt, Homo sapiens
ggccaugggcauuug

SEQ ID NO: 2045899 - RNA, 22 nt, Homo sapiens
gcaaacaguggggugaucugca

SEQ ID NO: 2045900 - RNA, 20 nt, Homo sapiens
ccuagaaaggaacugcaaua

SEQ ID NO: 2045901 - RNA, 22 nt, Homo sapiens
gcuaaauaaucuuacucuagau

SEQ ID NO: 2045902 - RNA, 16 nt, Homo sapiens
agauucuugacuuaua

SEQ ID NO: 2045903 - RNA, 18 nt, Homo sapiens
agucaucuugaccaagca

SEQ ID NO: 2045904 - RNA, 23 nt, Homo sapiens
aucucaggcuucugcaguucuca

SEQ ID NO: 2045905 - RNA, 16 nt, Homo sapiens
cucuacagacuucucc

SEQ ID NO: 2045906 - RNA, 20 nt, Homo sapiens
auagauccuauuacuguuuc

SEQ ID NO: 2045907 - RNA, 22 nt, Homo sapiens
cccccaaaaaacaauuauguaa

SEQ ID NO: 2045908 - RNA, 20 nt, Homo sapiens
auuuguuaaugguuugaaua

SEQ ID NO: 2045909 - RNA, 22 nt, Homo sapiens
aaggucuuugacggcaccaucu

SEQ ID NO: 2045910 - RNA, 17 nt, Homo sapiens
guuaacacucaugaagc

SEQ ID NO: 2045911 - RNA, 23 nt, Homo sapiens
gcugcuuuccaaagccaauguga

SEQ ID NO: 2045912 - RNA, 23 nt, Homo sapiens
ugacacaggccagccuuggcacg

SEQ ID NO: 2045913 - RNA, 14 nt, Homo sapiens
gccaucaagaaaca

SEQ ID NO: 2045914 - RNA, 20 nt, Homo sapiens
aucucacuucaucaaucaaa

SEQ ID NO: 2045915 - RNA, 20 nt, Homo sapiens
aaaauucacccccauccaca

SEQ ID NO: 2045916 - RNA, 11 nt, Homo sapiens
uggaggggugu

SEQ ID NO: 2045917 - RNA, 22 nt, Homo sapiens
ccauuccauuuaucuuucuaca

SEQ ID NO: 2045918 - RNA, 15 nt, Homo sapiens
gacuggccugcugga

SEQ ID NO: 2045919 - RNA, 12 nt, Homo sapiens
caguucaugcag

SEQ ID NO: 2045920 - RNA, 18 nt, Homo sapiens
aauuagaauauccaugac

SEQ ID NO: 2045921 - RNA, 16 nt, Homo sapiens
aauggcaaaugcacug

SEQ ID NO: 2045922 - RNA, 14 nt, Homo sapiens
gucucaauggugcu

SEQ ID NO: 2045923 - RNA, 20 nt, Homo sapiens
aauucucauuuuucauuucu

SEQ ID NO: 2045924 - RNA, 19 nt, Homo sapiens
ugacauguacauacuguau

SEQ ID NO: 2045925 - RNA, 11 nt, Homo sapiens
gccccuggaca

SEQ ID NO: 2045926 - RNA, 17 nt, Homo sapiens
augacccuccuguccag

SEQ ID NO: 2045927 - RNA, 16 nt, Homo sapiens
aucuuucacuauacag

SEQ ID NO: 2045928 - RNA, 22 nt, Homo sapiens
ugaccaggaucccaagccuccu

SEQ ID NO: 2045929 - RNA, 16 nt, Homo sapiens
agugcugggauuacag

SEQ ID NO: 2045930 - RNA, 16 nt, Homo sapiens
auaugauuguauaaug

SEQ ID NO: 2045931 - RNA, 20 nt, Homo sapiens
cuaguuuugucaaacuguag

SEQ ID NO: 2045932 - RNA, 15 nt, Homo sapiens
uggccuuacacugaa

SEQ ID NO: 2045933 - RNA, 20 nt, Homo sapiens
uuuaaccuaauaucacuuaa

SEQ ID NO: 2045934 - RNA, 14 nt, Homo sapiens
gaaugugaagccag

SEQ ID NO: 2045935 - RNA, 20 nt, Homo sapiens
uuauguauguauguauuuau

SEQ ID NO: 2045936 - RNA, 20 nt, Homo sapiens
aaauaccagugaaccaaaga

SEQ ID NO: 2045937 - RNA, 23 nt, Homo sapiens
ugguaagaaaaagcaaaaggcau

SEQ ID NO: 2045938 - RNA, 16 nt, Homo sapiens
uuaaaaauaaauucaa

SEQ ID NO: 2045939 - RNA, 19 nt, Homo sapiens
cugauuagaaaugaccaau

SEQ ID NO: 2045940 - RNA, 16 nt, Homo sapiens
uguccuguuccugcca

SEQ ID NO: 2045941 - RNA, 14 nt, Homo sapiens
uuaaugaugguguu

SEQ ID NO: 2045942 - RNA, 18 nt, Homo sapiens
uugagaaaggcacauauu

SEQ ID NO: 2045943 - RNA, 16 nt, Homo sapiens
aucuggugacaaauau

SEQ ID NO: 2045944 - RNA, 14 nt, Homo sapiens
ugcucccucugugu

SEQ ID NO: 2045945 - RNA, 16 nt, Homo sapiens
uaaacggacucagugg

SEQ ID NO: 2045946 - RNA, 14 nt, Homo sapiens
ccuaucacugauag

SEQ ID NO: 2045947 - RNA, 20 nt, Homo sapiens
gaagaaaagcugccauuucc

SEQ ID NO: 2045948 - RNA, 14 nt, Homo sapiens
auuauauucauucu

SEQ ID NO: 2045949 - RNA, 14 nt, Homo sapiens
cucauuuuaacuca

SEQ ID NO: 2045950 - RNA, 22 nt, Homo sapiens
ggguugcacuggccacccaagg

SEQ ID NO: 2045951 - RNA, 13 nt, Homo sapiens
cagagcucacaau

SEQ ID NO: 2045952 - RNA, 22 nt, Homo sapiens
aaagacauuuguucucccaaaa

SEQ ID NO: 2045953 - RNA, 22 nt, Homo sapiens
cacagaaauguuaaacugagac

SEQ ID NO: 2045954 - RNA, 15 nt, Homo sapiens
uuaaacuacugauug

SEQ ID NO: 2045955 - RNA, 16 nt, Homo sapiens
auaauucuguacugau

SEQ ID NO: 2045956 - RNA, 16 nt, Homo sapiens
uugguaagcuuccagg

SEQ ID NO: 2045957 - RNA, 12 nt, Homo sapiens
uuuggguauuaa

SEQ ID NO: 2045958 - RNA, 24 nt, Homo sapiens
cuguguaugucuauuugcacaaga

SEQ ID NO: 2045959 - RNA, 12 nt, Homo sapiens
aucuauaccacc

SEQ ID NO: 2045960 - RNA, 19 nt, Homo sapiens
cucaaguccaaggcuuuau

SEQ ID NO: 2045961 - RNA, 17 nt, Homo sapiens
guuucucugggagguag

SEQ ID NO: 2045962 - RNA, 19 nt, Homo sapiens
agcccuccucugcacuccc

SEQ ID NO: 2045963 - RNA, 23 nt, Homo sapiens
gguggucaccagguccugugagc

SEQ ID NO: 2045964 - RNA, 15 nt, Homo sapiens
uuauuuuaucugcua

SEQ ID NO: 2045965 - RNA, 15 nt, Homo sapiens
agaaaucaaguuaau

SEQ ID NO: 2045966 - RNA, 16 nt, Homo sapiens
caaaauguuauuuccc

SEQ ID NO: 2045967 - RNA, 20 nt, Homo sapiens
cauaaacauuugcaccacuu

SEQ ID NO: 2045968 - RNA, 23 nt, Homo sapiens
ugugaacuggaagaaagcaacaa

SEQ ID NO: 2045969 - RNA, 14 nt, Homo sapiens
agacaagcacuauu

SEQ ID NO: 2045970 - RNA, 14 nt, Homo sapiens
auauaauuuauuga

SEQ ID NO: 2045971 - RNA, 20 nt, Homo sapiens
gaaaauauuuuuuuccuuug

SEQ ID NO: 2045972 - RNA, 16 nt, Homo sapiens
guaguugaugacuguu

SEQ ID NO: 2045973 - RNA, 18 nt, Homo sapiens
acaaagcaauucuuucaa

SEQ ID NO: 2045974 - RNA, 21 nt, Homo sapiens
ucuuuguauauuuacaugcuu

SEQ ID NO: 2045975 - RNA, 15 nt, Homo sapiens
cucguuuaaggccua

SEQ ID NO: 2045976 - RNA, 14 nt, Homo sapiens
aaggagaaaaugca

SEQ ID NO: 2045977 - RNA, 12 nt, Homo sapiens
ugagcuuugaaa

SEQ ID NO: 2045978 - RNA, 23 nt, Homo sapiens
ugcaaguggccauuaccaucucu

SEQ ID NO: 2045979 - RNA, 19 nt, Homo sapiens
uaaaugacugaagugcuau

SEQ ID NO: 2045980 - RNA, 14 nt, Homo sapiens
gagcagccaggugg

SEQ ID NO: 2045981 - RNA, 10 nt, Homo sapiens
auuugaugug

SEQ ID NO: 2045982 - RNA, 22 nt, Homo sapiens
gggaagcugcagcuugggagag

SEQ ID NO: 2045983 - RNA, 17 nt, Homo sapiens
accacggcuggauacuc

SEQ ID NO: 2045984 - RNA, 20 nt, Homo sapiens
gggcaaugaccguuugacug

SEQ ID NO: 2045985 - RNA, 16 nt, Homo sapiens
gcuccugcccagccac

SEQ ID NO: 2045986 - RNA, 19 nt, Homo sapiens
acacugugaacucaaucuc

SEQ ID NO: 2045987 - RNA, 23 nt, Homo sapiens
ucuguacaaaggggaaagaacau

SEQ ID NO: 2045988 - RNA, 19 nt, Homo sapiens
aguuucuucuuuaggcauu

SEQ ID NO: 2045989 - RNA, 19 nt, Homo sapiens
uaaaaugccccacauuuua

SEQ ID NO: 2045990 - RNA, 15 nt, Homo sapiens
agggcagagccaugg

SEQ ID NO: 2045991 - RNA, 18 nt, Homo sapiens
cucuuucaauucugugau

SEQ ID NO: 2045992 - RNA, 23 nt, Homo sapiens
gugaaccaccacacccagcccac

SEQ ID NO: 2045993 - RNA, 15 nt, Homo sapiens
caagcacuugaugcc

SEQ ID NO: 2045994 - RNA, 22 nt, Homo sapiens
uauuuacuccuuaccaagggaa

SEQ ID NO: 2045995 - RNA, 20 nt, Homo sapiens
ucacacaguucaacauaaag

SEQ ID NO: 2045996 - RNA, 13 nt, Homo sapiens
auauauauauaca

SEQ ID NO: 2045997 - RNA, 20 nt, Homo sapiens
cuuauaagaaagaucaaaga

SEQ ID NO: 2045998 - RNA, 22 nt, Homo sapiens
acagacacuuuucaaaagaaga

SEQ ID NO: 2045999 - RNA, 15 nt, Homo sapiens
cucacgacuggucac

SEQ ID NO: 2046000 - RNA, 15 nt, Homo sapiens
auggcuggggggcca

SEQ ID NO: 2046001 - RNA, 19 nt, Homo sapiens
caacugccauguuuugcca

SEQ ID NO: 2046002 - RNA, 15 nt, Homo sapiens
auccuuucuauugaa

SEQ ID NO: 2046003 - RNA, 20 nt, Homo sapiens
ugaaaaauucccucuuucca

SEQ ID NO: 2046004 - RNA, 22 nt, Homo sapiens
uaauucacccaccagacuuuuu

SEQ ID NO: 2046005 - RNA, 21 nt, Homo sapiens
agaaagcauccuaaauauauc

SEQ ID NO: 2046006 - RNA, 21 nt, Homo sapiens
uggcucccugggcagugcucc

SEQ ID NO: 2046007 - RNA, 19 nt, Homo sapiens
uccaaacuaccuuccaguu

SEQ ID NO: 2046008 - RNA, 22 nt, Homo sapiens
agcccucuuucucucugugugg

SEQ ID NO: 2046009 - RNA, 16 nt, Homo sapiens
ggacugggcagauccu

SEQ ID NO: 2046010 - RNA, 18 nt, Homo sapiens
gaauuguucaacuuuuca

SEQ ID NO: 2046011 - RNA, 21 nt, Homo sapiens
guuacugguugguguucuucc

SEQ ID NO: 2046012 - RNA, 17 nt, Homo sapiens
acugucugucuggcuac

SEQ ID NO: 2046013 - RNA, 14 nt, Homo sapiens
ugauaucaugggga

SEQ ID NO: 2046014 - RNA, 17 nt, Homo sapiens
cgcaaaacccacugacc

SEQ ID NO: 2046015 - RNA, 14 nt, Homo sapiens
aaaccucaaaaugu

SEQ ID NO: 2046016 - RNA, 14 nt, Homo sapiens
ccaugccaccaccc

SEQ ID NO: 2046017 - RNA, 21 nt, Homo sapiens
agugcaacccagucacacugu

SEQ ID NO: 2046018 - RNA, 23 nt, Homo sapiens
ucuggaagggauggguggugcuc

SEQ ID NO: 2046019 - RNA, 21 nt, Homo sapiens
auuagaaaauggaaccacuag

SEQ ID NO: 2046020 - RNA, 23 nt, Homo sapiens
ucuccuuuugaccaaauaaagua

SEQ ID NO: 2046021 - RNA, 15 nt, Homo sapiens
acaaaaacuuuccau

SEQ ID NO: 2046022 - RNA, 12 nt, Homo sapiens
ccagggagaccc

SEQ ID NO: 2046023 - RNA, 19 nt, Homo sapiens
cugauagaauuauuucaca

SEQ ID NO: 2046024 - RNA, 14 nt, Homo sapiens
ugcacacugcacau

SEQ ID NO: 2046025 - RNA, 15 nt, Homo sapiens
auguuuaugagccag

SEQ ID NO: 2046026 - RNA, 23 nt, Homo sapiens
uugcccaucauacgcaugguccu

SEQ ID NO: 2046027 - RNA, 18 nt, Homo sapiens
uguauaaugugcuuuauu

SEQ ID NO: 2046028 - RNA, 19 nt, Homo sapiens
ucccugcuuugaggacaaa

SEQ ID NO: 2046029 - RNA, 19 nt, Homo sapiens
ugucucauagaacugccug

SEQ ID NO: 2046030 - RNA, 21 nt, Homo sapiens
uccacagaguuuguaguaaau

SEQ ID NO: 2046031 - RNA, 15 nt, Homo sapiens
augagcuugccuaaa

SEQ ID NO: 2046032 - RNA, 22 nt, Homo sapiens
caacaggccaaugcuacuuuca

SEQ ID NO: 2046033 - RNA, 20 nt, Homo sapiens
uuaugagaugccugaagcca

SEQ ID NO: 2046034 - RNA, 13 nt, Homo sapiens
ggcuucuggaaua

SEQ ID NO: 2046035 - RNA, 20 nt, Homo sapiens
uucuuugguauuccauccac

SEQ ID NO: 2046036 - RNA, 17 nt, Homo sapiens
gcacaaccuuuuccuca

SEQ ID NO: 2046037 - RNA, 20 nt, Homo sapiens
cuuuucuaaucacaguguug

SEQ ID NO: 2046038 - RNA, 17 nt, Homo sapiens
uaggaaaaaaacuauua

SEQ ID NO: 2046039 - RNA, 21 nt, Homo sapiens
uauagaugucuguguauacau

SEQ ID NO: 2046040 - RNA, 21 nt, Homo sapiens
uccuguugagaugggggacug

SEQ ID NO: 2046041 - RNA, 17 nt, Homo sapiens
ggacauaaugggguccu

SEQ ID NO: 2046042 - RNA, 15 nt, Homo sapiens
cucugggaagugugg

SEQ ID NO: 2046043 - RNA, 21 nt, Homo sapiens
uaucuccagauggaauggggu

SEQ ID NO: 2046044 - RNA, 13 nt, Homo sapiens
caggcccagugac

SEQ ID NO: 2046045 - RNA, 21 nt, Homo sapiens
ccaagcugccucugggccaug

SEQ ID NO: 2046046 - RNA, 13 nt, Homo sapiens
caacucuauuuaa

SEQ ID NO: 2046047 - RNA, 19 nt, Homo sapiens
ugaaguguuauuucaucca

SEQ ID NO: 2046048 - RNA, 19 nt, Homo sapiens
uaaaguaguaaauucauau

SEQ ID NO: 2046049 - RNA, 20 nt, Homo sapiens
uggagcaacccaauauugcu

SEQ ID NO: 2046050 - RNA, 20 nt, Homo sapiens
agauugcgccacugcacucc

SEQ ID NO: 2046051 - RNA, 20 nt, Homo sapiens
agauugcaccauugcgcucu

SEQ ID NO: 2046052 - RNA, 17 nt, Homo sapiens
guauuuaguaagugcuu

SEQ ID NO: 2046053 - RNA, 10 nt, Homo sapiens
acaagcaaaa

SEQ ID NO: 2046054 - RNA, 14 nt, Homo sapiens
cuguuugaugcuau

SEQ ID NO: 2046055 - RNA, 18 nt, Homo sapiens
acaaacauuugcugaaua

SEQ ID NO: 2046056 - RNA, 22 nt, Homo sapiens
auuuucaucaccccaaaagcaa

SEQ ID NO: 2046057 - RNA, 18 nt, Homo sapiens
cugaaccacauucaggga

SEQ ID NO: 2046058 - RNA, 24 nt, Homo sapiens
uuuguuuaaacccaagugcugcac

SEQ ID NO: 2046059 - RNA, 17 nt, Homo sapiens
augucucuucugagcua

SEQ ID NO: 2046060 - RNA, 16 nt, Homo sapiens
caauggguuugccaag

SEQ ID NO: 2046061 - RNA, 13 nt, Homo sapiens
aaagagcagucag

SEQ ID NO: 2046062 - RNA, 14 nt, Homo sapiens
ucaauaaauuucag

SEQ ID NO: 2046063 - RNA, 15 nt, Homo sapiens
cacaaugaugaugau

SEQ ID NO: 2046064 - RNA, 23 nt, Homo sapiens
cccaccagcuuuauuuuuuaaca

SEQ ID NO: 2046065 - RNA, 18 nt, Homo sapiens
ucuucauguuucaggaga

SEQ ID NO: 2046066 - RNA, 17 nt, Homo sapiens
acagcaaaccaaugcua

SEQ ID NO: 2046067 - RNA, 23 nt, Homo sapiens
gucaagaagcguuaugugcagua

SEQ ID NO: 2046068 - RNA, 18 nt, Homo sapiens
ccugacgcagcacaagcu

SEQ ID NO: 2046069 - RNA, 23 nt, Homo sapiens
uguacaggaaggugccuggccau

SEQ ID NO: 2046070 - RNA, 22 nt, Homo sapiens
cacugauaaaaguuuugauauu

SEQ ID NO: 2046071 - RNA, 13 nt, Homo sapiens
gaacacagaucau

SEQ ID NO: 2046072 - RNA, 13 nt, Homo sapiens
agaccaguaguga

SEQ ID NO: 2046073 - RNA, 23 nt, Homo sapiens
caaaauguguuucauaguauucu

SEQ ID NO: 2046074 - RNA, 22 nt, Homo sapiens
aggaugauuuccuggggcacag

SEQ ID NO: 2046075 - RNA, 17 nt, Homo sapiens
aguaucauguacuacac

SEQ ID NO: 2046076 - RNA, 18 nt, Homo sapiens
aaggaugaaagacaaaga

SEQ ID NO: 2046077 - RNA, 20 nt, Homo sapiens
guauauuauuauuaauuaca

SEQ ID NO: 2046078 - RNA, 20 nt, Homo sapiens
aaccuacuagacaaugaugu

SEQ ID NO: 2046079 - RNA, 18 nt, Homo sapiens
auuguucuuugccagaga

SEQ ID NO: 2046080 - RNA, 13 nt, Homo sapiens
gacuaauguugga

SEQ ID NO: 2046081 - RNA, 15 nt, Homo sapiens
acagugagaaaccau

SEQ ID NO: 2046082 - RNA, 23 nt, Homo sapiens
uaccugcccccaucauaagggca

SEQ ID NO: 2046083 - RNA, 18 nt, Homo sapiens
augacacccacccugugc

SEQ ID NO: 2046084 - RNA, 18 nt, Homo sapiens
uuaauuuacuuuaagcau

SEQ ID NO: 2046085 - RNA, 18 nt, Homo sapiens
cugaaaggaauauaguca

SEQ ID NO: 2046086 - RNA, 23 nt, Homo sapiens
acuuccucaucaugaaaacuggg

SEQ ID NO: 2046087 - RNA, 20 nt, Homo sapiens
agguaucaguuauaugauau

SEQ ID NO: 2046088 - RNA, 22 nt, Homo sapiens
accugcucugugcccacccucc

SEQ ID NO: 2046089 - RNA, 15 nt, Homo sapiens
ucucucuuacugcuu

SEQ ID NO: 2046090 - RNA, 14 nt, Homo sapiens
cagauuaguaguua

SEQ ID NO: 2046091 - RNA, 12 nt, Homo sapiens
auucucaccagg

SEQ ID NO: 2046092 - RNA, 23 nt, Homo sapiens
uaaucaucaaguaauacaaacua

SEQ ID NO: 2046093 - RNA, 19 nt, Homo sapiens
cugagcugcaucccugcuc

SEQ ID NO: 2046094 - RNA, 19 nt, Homo sapiens
cuaccaggcacgucugcag

SEQ ID NO: 2046095 - RNA, 18 nt, Homo sapiens
acucacccuuugagcuac

SEQ ID NO: 2046096 - RNA, 17 nt, Homo sapiens
uggauaaagaccuucca

SEQ ID NO: 2046097 - RNA, 12 nt, Homo sapiens
gucaaugugcag

SEQ ID NO: 2046098 - RNA, 12 nt, Homo sapiens
ucagauguuuca

SEQ ID NO: 2046099 - RNA, 16 nt, Homo sapiens
acaccugacagaauga

SEQ ID NO: 2046100 - RNA, 18 nt, Homo sapiens
acucuaagcuggagcucu

SEQ ID NO: 2046101 - RNA, 14 nt, Homo sapiens
aaaccauaacugac

SEQ ID NO: 2046102 - RNA, 23 nt, Homo sapiens
caggaguuugagguuacagugau

SEQ ID NO: 2046103 - RNA, 16 nt, Homo sapiens
cuccccagcccagaga

SEQ ID NO: 2046104 - RNA, 16 nt, Homo sapiens
guucagacaugugaag

SEQ ID NO: 2046105 - RNA, 13 nt, Homo sapiens
accucccaaagug

SEQ ID NO: 2046106 - RNA, 20 nt, Homo sapiens
ugcugccaacuccaugucag

SEQ ID NO: 2046107 - RNA, 21 nt, Homo sapiens
uucccacugaaauggacugac

SEQ ID NO: 2046108 - RNA, 16 nt, Homo sapiens
aaguagaggaauccau

SEQ ID NO: 2046109 - RNA, 18 nt, Homo sapiens
ggaaacccccaguguaau

SEQ ID NO: 2046110 - RNA, 17 nt, Homo sapiens
acugccgucccaaauac

SEQ ID NO: 2046111 - RNA, 15 nt, Homo sapiens
auaccagcugagucu

SEQ ID NO: 2046112 - RNA, 14 nt, Homo sapiens
agucuuugcucagu

SEQ ID NO: 2046113 - RNA, 18 nt, Homo sapiens
aacagacauuguuuugcc

SEQ ID NO: 2046114 - RNA, 20 nt, Homo sapiens
agaggccccaggucaccucg

SEQ ID NO: 2046115 - RNA, 19 nt, Homo sapiens
ugagcgggugccgaagcua

SEQ ID NO: 2046116 - RNA, 21 nt, Homo sapiens
gggcgcaugccucccaggcca

SEQ ID NO: 2046117 - RNA, 22 nt, Homo sapiens
ugcugauucaauaaaaugcacu

SEQ ID NO: 2046118 - RNA, 17 nt, Homo sapiens
cuaacaggucuagaaaa

SEQ ID NO: 2046119 - RNA, 19 nt, Homo sapiens
gacugcuucaucugcugua

SEQ ID NO: 2046120 - RNA, 14 nt, Homo sapiens
agcggcuguucccc

SEQ ID NO: 2046121 - RNA, 21 nt, Homo sapiens
aaggaaauaguaccuucaaua

SEQ ID NO: 2046122 - RNA, 20 nt, Homo sapiens
auaauuuuaguuuauauuaa

SEQ ID NO: 2046123 - RNA, 21 nt, Homo sapiens
ggcucauacaggucacccuga

SEQ ID NO: 2046124 - RNA, 17 nt, Homo sapiens
ugaaucucugaauuuga

SEQ ID NO: 2046125 - RNA, 18 nt, Homo sapiens
aucugcccaauccugggu

SEQ ID NO: 2046126 - RNA, 15 nt, Homo sapiens
agccuggaugccauc

SEQ ID NO: 2046127 - RNA, 13 nt, Homo sapiens
agaagcucagcug

SEQ ID NO: 2046128 - RNA, 23 nt, Homo sapiens
ccuguagcaaccuucugcauuca

SEQ ID NO: 2046129 - RNA, 16 nt, Homo sapiens
auguaucaaucacuau

SEQ ID NO: 2046130 - RNA, 23 nt, Homo sapiens
gcagccuaaugagagugcacugc

SEQ ID NO: 2046131 - RNA, 19 nt, Homo sapiens
guauaaugcaguacauuaa

SEQ ID NO: 2046132 - RNA, 17 nt, Homo sapiens
uagcauacugaugagac

SEQ ID NO: 2046133 - RNA, 20 nt, Homo sapiens
acaggacccugggaccacag

SEQ ID NO: 2046134 - RNA, 18 nt, Homo sapiens
cauucucuuauauaguau

SEQ ID NO: 2046135 - RNA, 14 nt, Homo sapiens
caggcacgucugca

SEQ ID NO: 2046136 - RNA, 16 nt, Homo sapiens
guccacgcccaccagc

SEQ ID NO: 2046137 - RNA, 12 nt, Homo sapiens
caagcaccucca

SEQ ID NO: 2046138 - RNA, 15 nt, Homo sapiens
aagaccagcuuugca

SEQ ID NO: 2046139 - RNA, 23 nt, Homo sapiens
cccaguguguguuuaacauucac

SEQ ID NO: 2046140 - RNA, 14 nt, Homo sapiens
ucucuucaaauaau

SEQ ID NO: 2046141 - RNA, 15 nt, Homo sapiens
gacacuagccugugc

SEQ ID NO: 2046142 - RNA, 13 nt, Homo sapiens
auaauaagaagga

SEQ ID NO: 2046143 - RNA, 16 nt, Homo sapiens
auguaagucucaacuc

SEQ ID NO: 2046144 - RNA, 16 nt, Homo sapiens
gcugugaauuagcuca

SEQ ID NO: 2046145 - RNA, 23 nt, Homo sapiens
uaucagcauagugacuaaacuac

SEQ ID NO: 2046146 - RNA, 20 nt, Homo sapiens
uuaauccaauauuuugccuu

SEQ ID NO: 2046147 - RNA, 20 nt, Homo sapiens
ucucaagcgcuauccacaga

SEQ ID NO: 2046148 - RNA, 20 nt, Homo sapiens
uaagcauuugaguuugcaaa

SEQ ID NO: 2046149 - RNA, 14 nt, Homo sapiens
ugccuccaccagca

SEQ ID NO: 2046150 - RNA, 18 nt, Homo sapiens
ucucacgcugccauuucc

SEQ ID NO: 2046151 - RNA, 19 nt, Homo sapiens
uggaaccuuguuuuggaca

SEQ ID NO: 2046152 - RNA, 18 nt, Homo sapiens
accuugaaugaugccaug

SEQ ID NO: 2046153 - RNA, 16 nt, Homo sapiens
ggaaagggagggaaua

SEQ ID NO: 2046154 - RNA, 14 nt, Homo sapiens
gaguccacaggcuc

SEQ ID NO: 2046155 - RNA, 22 nt, Homo sapiens
gucaguauuucaacugcuguaa

SEQ ID NO: 2046156 - RNA, 13 nt, Homo sapiens
uauauauauauca

SEQ ID NO: 2046157 - RNA, 21 nt, Homo sapiens
gagaagcacaacugaaaccag

SEQ ID NO: 2046158 - RNA, 21 nt, Homo sapiens
cagccucccacaggugguaca

SEQ ID NO: 2046159 - RNA, 22 nt, Homo sapiens
caauuugguaaaaaugcugcuc

SEQ ID NO: 2046160 - RNA, 22 nt, Homo sapiens
accuacuaauccucucugcaag

SEQ ID NO: 2046161 - RNA, 14 nt, Homo sapiens
agaggcuacagggc

SEQ ID NO: 2046162 - RNA, 18 nt, Homo sapiens
uccaguguggcucccaca

SEQ ID NO: 2046163 - RNA, 24 nt, Homo sapiens
gaagggaccaaggcaaggcaggug

SEQ ID NO: 2046164 - RNA, 15 nt, Homo sapiens
gaagggcaauaucua

SEQ ID NO: 2046165 - RNA, 18 nt, Homo sapiens
auguggcuguauccacuu

SEQ ID NO: 2046166 - RNA, 17 nt, Homo sapiens
ccucgguacucccauaa

SEQ ID NO: 2046167 - RNA, 19 nt, Homo sapiens
ugggcaaaagcuuacaaau

SEQ ID NO: 2046168 - RNA, 19 nt, Homo sapiens
ugcagaauugagagugauu

SEQ ID NO: 2046169 - RNA, 15 nt, Homo sapiens
ugcccauuugugauc

SEQ ID NO: 2046170 - RNA, 21 nt, Homo sapiens
uuaaggaggcugagagcccaa

SEQ ID NO: 2046171 - RNA, 17 nt, Homo sapiens
aagcaccugccgaccuc

SEQ ID NO: 2046172 - RNA, 13 nt, Homo sapiens
cuaauucagccau

SEQ ID NO: 2046173 - RNA, 23 nt, Homo sapiens
gcagccucaggcccaauucugcc

SEQ ID NO: 2046174 - RNA, 20 nt, Homo sapiens
ggccuggaguaacacaaagu

SEQ ID NO: 2046175 - RNA, 18 nt, Homo sapiens
uugaaucuacaacucuga

SEQ ID NO: 2046176 - RNA, 18 nt, Homo sapiens
auaaaauccugugcaaua

SEQ ID NO: 2046177 - RNA, 10 nt, Homo sapiens
ccuccagggc

SEQ ID NO: 2046178 - RNA, 18 nt, Homo sapiens
gccagacugucucaaaua

SEQ ID NO: 2046179 - RNA, 20 nt, Homo sapiens
cacauuucuuugcauuccag

SEQ ID NO: 2046180 - RNA, 14 nt, Homo sapiens
gcaggcucucaggc

SEQ ID NO: 2046181 - RNA, 19 nt, Homo sapiens
uggaccagccgcccagauc

SEQ ID NO: 2046182 - RNA, 19 nt, Homo sapiens
ucucuguauaacuugugau

SEQ ID NO: 2046183 - RNA, 23 nt, Homo sapiens
augugggcugggggaagaugccc

SEQ ID NO: 2046184 - RNA, 14 nt, Homo sapiens
uugggcuggaugau

SEQ ID NO: 2046185 - RNA, 19 nt, Homo sapiens
acccuaaagaucuucugua

SEQ ID NO: 2046186 - RNA, 20 nt, Homo sapiens
acuuccugccauggaucucu

SEQ ID NO: 2046187 - RNA, 14 nt, Homo sapiens
ucugccgcugccau

SEQ ID NO: 2046188 - RNA, 15 nt, Homo sapiens
uuagaguauuccuca

SEQ ID NO: 2046189 - RNA, 20 nt, Homo sapiens
caagacaaugggaauggccu

SEQ ID NO: 2046190 - RNA, 18 nt, Homo sapiens
aggaacuugucucuucau

SEQ ID NO: 2046191 - RNA, 17 nt, Homo sapiens
gaccauaacagugccag

SEQ ID NO: 2046192 - RNA, 19 nt, Homo sapiens
agaucugccagaccugcau

SEQ ID NO: 2046193 - RNA, 16 nt, Homo sapiens
acucagagggccucau

SEQ ID NO: 2046194 - RNA, 17 nt, Homo sapiens
caccagaacacaaugcu

SEQ ID NO: 2046195 - RNA, 23 nt, Homo sapiens
ugaagagagggacaggcacucca

SEQ ID NO: 2046196 - RNA, 20 nt, Homo sapiens
gagggcgaagcugaccugca

SEQ ID NO: 2046197 - RNA, 16 nt, Homo sapiens
aaucccggugcuugca

SEQ ID NO: 2046198 - RNA, 14 nt, Homo sapiens
aagaaaaacaauaa

SEQ ID NO: 2046199 - RNA, 16 nt, Homo sapiens
cuguccccacagcagg

SEQ ID NO: 2046200 - RNA, 22 nt, Homo sapiens
aacuaagaaaaaaagcacaaag

SEQ ID NO: 2046201 - RNA, 22 nt, Homo sapiens
agucuacaggccuuucaggaag

SEQ ID NO: 2046202 - RNA, 18 nt, Homo sapiens
uuucaucuaacgugcauu

SEQ ID NO: 2046203 - RNA, 16 nt, Homo sapiens
gagcuacuugggccau

SEQ ID NO: 2046204 - RNA, 14 nt, Homo sapiens
aguucagacuguua

SEQ ID NO: 2046205 - RNA, 16 nt, Homo sapiens
cuggauacuaagcaca

SEQ ID NO: 2046206 - RNA, 21 nt, Homo sapiens
uaagaggcugcugaaaaccau

SEQ ID NO: 2046207 - RNA, 15 nt, Homo sapiens
uguuccccacuggag

SEQ ID NO: 2046208 - RNA, 14 nt, Homo sapiens
aaguacaaguauau

SEQ ID NO: 2046209 - RNA, 14 nt, Homo sapiens
ucugcuuaaucuga

SEQ ID NO: 2046210 - RNA, 17 nt, Homo sapiens
acuucuggggacagaca

SEQ ID NO: 2046211 - RNA, 20 nt, Homo sapiens
uugugacagagccauggugu

SEQ ID NO: 2046212 - RNA, 22 nt, Homo sapiens
auaacuaggcguggacuuacua

SEQ ID NO: 2046213 - RNA, 17 nt, Homo sapiens
uagucaauuucuacuuc

SEQ ID NO: 2046214 - RNA, 23 nt, Homo sapiens
uaccuucaugugauucacugccu

SEQ ID NO: 2046215 - RNA, 16 nt, Homo sapiens
cauauguuugcuugua

SEQ ID NO: 2046216 - RNA, 14 nt, Homo sapiens
uauuugacuuacca

SEQ ID NO: 2046217 - RNA, 21 nt, Homo sapiens
gcuccccuccccaacugacca

SEQ ID NO: 2046218 - RNA, 13 nt, Homo sapiens
cauuacugcaugc

SEQ ID NO: 2046219 - RNA, 17 nt, Homo sapiens
uaacauacugcauuuca

SEQ ID NO: 2046220 - RNA, 20 nt, Homo sapiens
uaaucccagcuacucgggaa

SEQ ID NO: 2046221 - RNA, 14 nt, Homo sapiens
caagauccaggcag

SEQ ID NO: 2046222 - RNA, 22 nt, Homo sapiens
auauucaggcuacucauucagu

SEQ ID NO: 2046223 - RNA, 13 nt, Homo sapiens
ugaguggccugua

SEQ ID NO: 2046224 - RNA, 13 nt, Homo sapiens
acucacaccugua

SEQ ID NO: 2046225 - RNA, 16 nt, Homo sapiens
ucaugagcacuuugua

SEQ ID NO: 2046226 - RNA, 20 nt, Homo sapiens
cagaagaaaauuugccaauc

SEQ ID NO: 2046227 - RNA, 21 nt, Homo sapiens
ccacccuggugggccaacaaa

SEQ ID NO: 2046228 - RNA, 16 nt, Homo sapiens
gaauagcaugucacua

SEQ ID NO: 2046229 - RNA, 16 nt, Homo sapiens
uccucuuggugucaua

SEQ ID NO: 2046230 - RNA, 18 nt, Homo sapiens
gcucacccauugucucau

SEQ ID NO: 2046231 - RNA, 14 nt, Homo sapiens
agaguauacuuugu

SEQ ID NO: 2046232 - RNA, 21 nt, Homo sapiens
agauggcaugaaucgggcuaa

SEQ ID NO: 2046233 - RNA, 18 nt, Homo sapiens
agggcgggcagagggcug

SEQ ID NO: 2046234 - RNA, 18 nt, Homo sapiens
ggcacucagaagacacug

SEQ ID NO: 2046235 - RNA, 14 nt, Homo sapiens
ugagcuaacuuaua

SEQ ID NO: 2046236 - RNA, 20 nt, Homo sapiens
gcagguggggagacugggcu

SEQ ID NO: 2046237 - RNA, 15 nt, Homo sapiens
gaggcccccaucucc

SEQ ID NO: 2046238 - RNA, 16 nt, Homo sapiens
agacccaaggcucacu

SEQ ID NO: 2046239 - RNA, 19 nt, Homo sapiens
uugugccacuacacuccag

SEQ ID NO: 2046240 - RNA, 21 nt, Homo sapiens
uacagaaaugauuacuaagga

SEQ ID NO: 2046241 - RNA, 18 nt, Homo sapiens
caguggcuggaucuguga

SEQ ID NO: 2046242 - RNA, 18 nt, Homo sapiens
gacuguucuuuuacaaga

SEQ ID NO: 2046243 - RNA, 17 nt, Homo sapiens
aaucccucagaucccac

SEQ ID NO: 2046244 - RNA, 16 nt, Homo sapiens
gccagaaagaugcccu

SEQ ID NO: 2046245 - RNA, 16 nt, Homo sapiens
uuccuuugaagauagu

SEQ ID NO: 2046246 - RNA, 23 nt, Homo sapiens
gaccaaacuggauagaaccacca

SEQ ID NO: 2046247 - RNA, 17 nt, Homo sapiens
aguuguugacugugauu

SEQ ID NO: 2046248 - RNA, 17 nt, Homo sapiens
auuugacuaagagucuc

SEQ ID NO: 2046249 - RNA, 15 nt, Homo sapiens
augcguuuaaucaca

SEQ ID NO: 2046250 - RNA, 15 nt, Homo sapiens
uguugacacggccau

SEQ ID NO: 2046251 - RNA, 16 nt, Homo sapiens
ugacggggcagucaga

SEQ ID NO: 2046252 - RNA, 20 nt, Homo sapiens
aagugauucuuccaccucag

SEQ ID NO: 2046253 - RNA, 18 nt, Homo sapiens
acagaacaccuaugcaaa

SEQ ID NO: 2046254 - RNA, 22 nt, Homo sapiens
ugggcgagccccuccuucuccc

SEQ ID NO: 2046255 - RNA, 20 nt, Homo sapiens
agcaaaccacauaaucucuc

SEQ ID NO: 2046256 - RNA, 14 nt, Homo sapiens
gccuuugugcucug

SEQ ID NO: 2046257 - RNA, 15 nt, Homo sapiens
uagugcaaaacugug

SEQ ID NO: 2046258 - RNA, 15 nt, Homo sapiens
uuagaguacagaucc

SEQ ID NO: 2046259 - RNA, 14 nt, Homo sapiens
accuaaaugaguca

SEQ ID NO: 2046260 - RNA, 22 nt, Homo sapiens
uggccguuugcuuaaugccaga

SEQ ID NO: 2046261 - RNA, 15 nt, Homo sapiens
gaacugagcacaggg

SEQ ID NO: 2046262 - RNA, 14 nt, Homo sapiens
uaacucauugcucu

SEQ ID NO: 2046263 - RNA, 14 nt, Homo sapiens
uguuccugugaucu

SEQ ID NO: 2046264 - RNA, 14 nt, Homo sapiens
ccagugcaacagca

SEQ ID NO: 2046265 - RNA, 16 nt, Homo sapiens
auaaaaugaaccugau

SEQ ID NO: 2046266 - RNA, 21 nt, Homo sapiens
ggcaggaggaucauuugagcu

SEQ ID NO: 2046267 - RNA, 21 nt, Homo sapiens
ccuguggcucaggggagcaag

SEQ ID NO: 2046268 - RNA, 20 nt, Homo sapiens
gucuuuaugaaguuugcuau

SEQ ID NO: 2046269 - RNA, 14 nt, Homo sapiens
cagaggauggugag

SEQ ID NO: 2046270 - RNA, 15 nt, Homo sapiens
gcaaguuucagugaa

SEQ ID NO: 2046271 - RNA, 13 nt, Homo sapiens
ccccaaccacaga

SEQ ID NO: 2046272 - RNA, 19 nt, Homo sapiens
acacugcgcaucaccuacc

SEQ ID NO: 2046273 - RNA, 23 nt, Homo sapiens
ccggccaaaauaaugcaccacuu

SEQ ID NO: 2046274 - RNA, 11 nt, Homo sapiens
uccuugcagac

SEQ ID NO: 2046275 - RNA, 21 nt, Homo sapiens
agcauacuggcuucaccauca

SEQ ID NO: 2046276 - RNA, 14 nt, Homo sapiens
uacaaauugugaug

SEQ ID NO: 2046277 - RNA, 14 nt, Homo sapiens
gugaucacagcagc

SEQ ID NO: 2046278 - RNA, 22 nt, Homo sapiens
acauaagaaauguauuccugaa

SEQ ID NO: 2046279 - RNA, 17 nt, Homo sapiens
agucagcuguaccaagc

SEQ ID NO: 2046280 - RNA, 14 nt, Homo sapiens
ugaggggcugugac

SEQ ID NO: 2046281 - RNA, 15 nt, Homo sapiens
aggcauccacuucac

SEQ ID NO: 2046282 - RNA, 21 nt, Homo sapiens
agcgcaguggggugaucucau

SEQ ID NO: 2046283 - RNA, 17 nt, Homo sapiens
auaccuccauguuucua

SEQ ID NO: 2046284 - RNA, 21 nt, Homo sapiens
caaaagcguccagaaaggaga

SEQ ID NO: 2046285 - RNA, 20 nt, Homo sapiens
gauacaugauugaaaccaag

SEQ ID NO: 2046286 - RNA, 23 nt, Homo sapiens
cacuccacccccuccagcuccag

SEQ ID NO: 2046287 - RNA, 17 nt, Homo sapiens
gccuggugcugagugca

SEQ ID NO: 2046288 - RNA, 21 nt, Homo sapiens
cacagcuaaaauaauagauaa

SEQ ID NO: 2046289 - RNA, 15 nt, Homo sapiens
aauguauaugucauu

SEQ ID NO: 2046290 - RNA, 14 nt, Homo sapiens
ccaguuguggcagg

SEQ ID NO: 2046291 - RNA, 17 nt, Homo sapiens
agcacugagcaaagcau

SEQ ID NO: 2046292 - RNA, 13 nt, Homo sapiens
cugccaugucaga

SEQ ID NO: 2046293 - RNA, 18 nt, Homo sapiens
gaaggccaccugcagguc

SEQ ID NO: 2046294 - RNA, 17 nt, Homo sapiens
aguggucuuuguaagag

SEQ ID NO: 2046295 - RNA, 19 nt, Homo sapiens
cguuacuuucauguacuau

SEQ ID NO: 2046296 - RNA, 15 nt, Homo sapiens
caugugacaagcaca

SEQ ID NO: 2046297 - RNA, 17 nt, Homo sapiens
uuaguuuaaaaagaaau

SEQ ID NO: 2046298 - RNA, 14 nt, Homo sapiens
uagguucuacagga

SEQ ID NO: 2046299 - RNA, 18 nt, Homo sapiens
uagucaaucaaacaggga

SEQ ID NO: 2046300 - RNA, 15 nt, Homo sapiens
uuguauuuaaggauu

SEQ ID NO: 2046301 - RNA, 16 nt, Homo sapiens
auuauuuuacaaucaa

SEQ ID NO: 2046302 - RNA, 15 nt, Homo sapiens
uggcccucuuugaaa

SEQ ID NO: 2046303 - RNA, 11 nt, Homo sapiens
ucauuaccuca

SEQ ID NO: 2046304 - RNA, 19 nt, Homo sapiens
cauguacccaaaguguucu

SEQ ID NO: 2046305 - RNA, 18 nt, Homo sapiens
gaggcugagacaggagaa

SEQ ID NO: 2046306 - RNA, 17 nt, Homo sapiens
uguuucccgcuccaaga

SEQ ID NO: 2046307 - RNA, 16 nt, Homo sapiens
uuagaaacacacuuuu

SEQ ID NO: 2046308 - RNA, 14 nt, Homo sapiens
ugccaccugcugcu

SEQ ID NO: 2046309 - RNA, 20 nt, Homo sapiens
uaaauccucauguuacucag

SEQ ID NO: 2046310 - RNA, 18 nt, Homo sapiens
uagaauggaugugcucac

SEQ ID NO: 2046311 - RNA, 21 nt, Homo sapiens
ccccaccacggccacuggcca

SEQ ID NO: 2046312 - RNA, 21 nt, Homo sapiens
cuguauuuuauauaggcauuu

SEQ ID NO: 2046313 - RNA, 23 nt, Homo sapiens
aaagcauuuuguaauaauaaaga

SEQ ID NO: 2046314 - RNA, 15 nt, Homo sapiens
cuacacacacacucc

SEQ ID NO: 2046315 - RNA, 20 nt, Homo sapiens
uuggaaauguggucaucaaa

SEQ ID NO: 2046316 - RNA, 14 nt, Homo sapiens
gccagcagcaccug

SEQ ID NO: 2046317 - RNA, 14 nt, Homo sapiens
aaauacuacugugu

SEQ ID NO: 2046318 - RNA, 19 nt, Homo sapiens
aucacaucuaaagcuuuau

SEQ ID NO: 2046319 - RNA, 22 nt, Homo sapiens
guauucaggcacugagaaugau

SEQ ID NO: 2046320 - RNA, 16 nt, Homo sapiens
ugcuguuaucccugcc

SEQ ID NO: 2046321 - RNA, 18 nt, Homo sapiens
uaggauggaacgugacug

SEQ ID NO: 2046322 - RNA, 19 nt, Homo sapiens
cuuugcugaaugucauuuu

SEQ ID NO: 2046323 - RNA, 13 nt, Homo sapiens
ccaaaacauuucu

SEQ ID NO: 2046324 - RNA, 15 nt, Homo sapiens
ucccaggaccacagg

SEQ ID NO: 2046325 - RNA, 14 nt, Homo sapiens
cugagauaccagcg

SEQ ID NO: 2046326 - RNA, 21 nt, Homo sapiens
augaagcuuuauacguguagc

SEQ ID NO: 2046327 - RNA, 16 nt, Homo sapiens
uucagaaggaaaccga

SEQ ID NO: 2046328 - RNA, 14 nt, Homo sapiens
uuaaauguuuuaca

SEQ ID NO: 2046329 - RNA, 16 nt, Homo sapiens
ucaccucaaccuccgc

SEQ ID NO: 2046330 - RNA, 16 nt, Homo sapiens
auccuggcaaauaaua

SEQ ID NO: 2046331 - RNA, 14 nt, Homo sapiens
agccugaacccaag

SEQ ID NO: 2046332 - RNA, 15 nt, Homo sapiens
uugcucucagcugcc

SEQ ID NO: 2046333 - RNA, 16 nt, Homo sapiens
aucccauggaaccacu

SEQ ID NO: 2046334 - RNA, 16 nt, Homo sapiens
cgugguacauucacag

SEQ ID NO: 2046335 - RNA, 17 nt, Homo sapiens
caccucagccuggagag

SEQ ID NO: 2046336 - RNA, 18 nt, Homo sapiens
aucugauguuaaccaaug

SEQ ID NO: 2046337 - RNA, 20 nt, Homo sapiens
acguguucuuuugugcucuu

SEQ ID NO: 2046338 - RNA, 22 nt, Homo sapiens
ccuggggcggugugugugccau

SEQ ID NO: 2046339 - RNA, 17 nt, Homo sapiens
acccccauuauaauauu

SEQ ID NO: 2046340 - RNA, 11 nt, Homo sapiens
gcgagcacuuu

SEQ ID NO: 2046341 - RNA, 19 nt, Homo sapiens
cuaauauuuuuagcucugu

SEQ ID NO: 2046342 - RNA, 19 nt, Homo sapiens
ccucuucuaccauuuccca

SEQ ID NO: 2046343 - RNA, 20 nt, Homo sapiens
gaggaagaagcuuaggcagg

SEQ ID NO: 2046344 - RNA, 21 nt, Homo sapiens
acccugguuauugauguggcc

SEQ ID NO: 2046345 - RNA, 11 nt, Homo sapiens
ugaaagcucuc

SEQ ID NO: 2046346 - RNA, 15 nt, Homo sapiens
auggaaaacuguguu

SEQ ID NO: 2046347 - RNA, 20 nt, Homo sapiens
aauggaauuucucaguagca

SEQ ID NO: 2046348 - RNA, 16 nt, Homo sapiens
gacuaugaaacgaaua

SEQ ID NO: 2046349 - RNA, 21 nt, Homo sapiens
gccagagccaagaaacacuuu

SEQ ID NO: 2046350 - RNA, 18 nt, Homo sapiens
ucaacugcuuguaaaggu

SEQ ID NO: 2046351 - RNA, 17 nt, Homo sapiens
cuaucuagaacuugaga

SEQ ID NO: 2046352 - RNA, 23 nt, Homo sapiens
cucacacuuuuggaaccaugccu

SEQ ID NO: 2046353 - RNA, 14 nt, Homo sapiens
uauauuaccucaaa

SEQ ID NO: 2046354 - RNA, 22 nt, Homo sapiens
uaaaauagauccuaggugcugg

SEQ ID NO: 2046355 - RNA, 15 nt, Homo sapiens
acccuaaagucucag

SEQ ID NO: 2046356 - RNA, 21 nt, Homo sapiens
cuuggaauuggaauuacugua

SEQ ID NO: 2046357 - RNA, 21 nt, Homo sapiens
uuugcaggguccucuucuggg

SEQ ID NO: 2046358 - RNA, 14 nt, Homo sapiens
aacacccuuuccaa

SEQ ID NO: 2046359 - RNA, 14 nt, Homo sapiens
ugcugaugaucaaa

SEQ ID NO: 2046360 - RNA, 22 nt, Homo sapiens
uauugaaaugauuucacagugu

SEQ ID NO: 2046361 - RNA, 17 nt, Homo sapiens
cauacaccaaacauuuc

SEQ ID NO: 2046362 - RNA, 15 nt, Homo sapiens
gcuuuuuguuugcau

SEQ ID NO: 2046363 - RNA, 22 nt, Homo sapiens
ggauagcuucaucuugagccug

SEQ ID NO: 2046364 - RNA, 22 nt, Homo sapiens
aaauaaaaagugacacagcagc

SEQ ID NO: 2046365 - RNA, 20 nt, Homo sapiens
ucuaggcccugugagcacaa

SEQ ID NO: 2046366 - RNA, 14 nt, Homo sapiens
gaccugacaccuuu

SEQ ID NO: 2046367 - RNA, 18 nt, Homo sapiens
ucuuucuaacuccaguga

SEQ ID NO: 2046368 - RNA, 20 nt, Homo sapiens
uucugauaaaaauaauauua

SEQ ID NO: 2046369 - RNA, 12 nt, Homo sapiens
auuaaacauucu

SEQ ID NO: 2046370 - RNA, 22 nt, Homo sapiens
gccaugcucaaccccccuccca

SEQ ID NO: 2046371 - RNA, 22 nt, Homo sapiens
ugugaauuguuuuuguacaguu

SEQ ID NO: 2046372 - RNA, 23 nt, Homo sapiens
accuccuaauuccacacccucac

SEQ ID NO: 2046373 - RNA, 13 nt, Homo sapiens
uugggagcacugg

SEQ ID NO: 2046374 - RNA, 13 nt, Homo sapiens
caaaugaugccau

SEQ ID NO: 2046375 - RNA, 19 nt, Homo sapiens
auaauaggccaggcacugu

SEQ ID NO: 2046376 - RNA, 19 nt, Homo sapiens
gguugaaaaccacagucag

SEQ ID NO: 2046377 - RNA, 21 nt, Homo sapiens
uaacaaagcccuuauucucuu

SEQ ID NO: 2046378 - RNA, 14 nt, Homo sapiens
aacuggauacugua

SEQ ID NO: 2046379 - RNA, 14 nt, Homo sapiens
aaaugcacaaacaa

SEQ ID NO: 2046380 - RNA, 15 nt, Homo sapiens
ccaggggagcaguaa

SEQ ID NO: 2046381 - RNA, 23 nt, Homo sapiens
uccuuaauuuaauugcuuugaag

SEQ ID NO: 2046382 - RNA, 20 nt, Homo sapiens
ugaagggccacugggacccu

SEQ ID NO: 2046383 - RNA, 19 nt, Homo sapiens
gcacaguggcucaugccug

SEQ ID NO: 2046384 - RNA, 16 nt, Homo sapiens
gggaccucuccaugau

SEQ ID NO: 2046385 - RNA, 18 nt, Homo sapiens
gagaaguacuuuaccuga

SEQ ID NO: 2046386 - RNA, 20 nt, Homo sapiens
ccuucaaaauaaaaaguaau

SEQ ID NO: 2046387 - RNA, 15 nt, Homo sapiens
caaagugccaaagaa

SEQ ID NO: 2046388 - RNA, 19 nt, Homo sapiens
cuuuucuggugauucucca

SEQ ID NO: 2046389 - RNA, 16 nt, Homo sapiens
uuauuauuucuaaucc

SEQ ID NO: 2046390 - RNA, 14 nt, Homo sapiens
caauacaaauagau

SEQ ID NO: 2046391 - RNA, 18 nt, Homo sapiens
ugcaccccaacauugaga

SEQ ID NO: 2046392 - RNA, 17 nt, Homo sapiens
aucaguccaaagggcau

SEQ ID NO: 2046393 - RNA, 22 nt, Homo sapiens
agcaauccaugagauagcuauu

SEQ ID NO: 2046394 - RNA, 15 nt, Homo sapiens
cucugaacaauugcu

SEQ ID NO: 2046395 - RNA, 23 nt, Homo sapiens
gccggcaaccccaguucugcucc

SEQ ID NO: 2046396 - RNA, 14 nt, Homo sapiens
aaaugagcaaaagu

SEQ ID NO: 2046397 - RNA, 21 nt, Homo sapiens
aauucuuacacugccuguaua

SEQ ID NO: 2046398 - RNA, 17 nt, Homo sapiens
guucauguuuugcuaau

SEQ ID NO: 2046399 - RNA, 19 nt, Homo sapiens
aggaacaagaauugcuaaa

SEQ ID NO: 2046400 - RNA, 19 nt, Homo sapiens
aagagccgggaacagagaa

SEQ ID NO: 2046401 - RNA, 21 nt, Homo sapiens
ggcagcuggggggcaccggcu

SEQ ID NO: 2046402 - RNA, 20 nt, Homo sapiens
acacauguaucuaugcauuu

SEQ ID NO: 2046403 - RNA, 14 nt, Homo sapiens
aaaaguuucacagg

SEQ ID NO: 2046404 - RNA, 23 nt, Homo sapiens
uggagacccugccacagccagag

SEQ ID NO: 2046405 - RNA, 21 nt, Homo sapiens
auagggguaagguaugggaga

SEQ ID NO: 2046406 - RNA, 15 nt, Homo sapiens
agcuggucuagacug

SEQ ID NO: 2046407 - RNA, 12 nt, Homo sapiens
cucaacuugugu

SEQ ID NO: 2046408 - RNA, 20 nt, Homo sapiens
agaacauuuucuuaugucuc

SEQ ID NO: 2046409 - RNA, 23 nt, Homo sapiens
gaauugcuaauucugagggaauu

SEQ ID NO: 2046410 - RNA, 22 nt, Homo sapiens
ugaaaaaaaaauuaaacuuccu

SEQ ID NO: 2046411 - RNA, 22 nt, Homo sapiens
auccauagugcacuagcauuuu

SEQ ID NO: 2046412 - RNA, 16 nt, Homo sapiens
auugcaugcugauaau

SEQ ID NO: 2046413 - RNA, 20 nt, Homo sapiens
ggcaggaaaauuguuugaac

SEQ ID NO: 2046414 - RNA, 18 nt, Homo sapiens
gacuguccuacaauauca

SEQ ID NO: 2046415 - RNA, 22 nt, Homo sapiens
ccaaacggaagacuacagcaug

SEQ ID NO: 2046416 - RNA, 21 nt, Homo sapiens
gauguuagaaagugcugauaa

SEQ ID NO: 2046417 - RNA, 20 nt, Homo sapiens
auucucccuaaaguguugug

SEQ ID NO: 2046418 - RNA, 16 nt, Homo sapiens
ccaggagcaacagccu

SEQ ID NO: 2046419 - RNA, 16 nt, Homo sapiens
cagucagaaccacuaa

SEQ ID NO: 2046420 - RNA, 13 nt, Homo sapiens
aaaagacagugaa

SEQ ID NO: 2046421 - RNA, 13 nt, Homo sapiens
guaaaacaaagag

SEQ ID NO: 2046422 - RNA, 18 nt, Homo sapiens
aauggcccaguccucucc

SEQ ID NO: 2046423 - RNA, 16 nt, Homo sapiens
gaaagguuuuccuuau

SEQ ID NO: 2046424 - RNA, 20 nt, Homo sapiens
uaacacugagauccagagag

SEQ ID NO: 2046425 - RNA, 19 nt, Homo sapiens
augaggacaagagggacaa

SEQ ID NO: 2046426 - RNA, 16 nt, Homo sapiens
aucccuuuuuuuacau

SEQ ID NO: 2046427 - RNA, 23 nt, Homo sapiens
ccaucguauuaaaaaacaauuaa

SEQ ID NO: 2046428 - RNA, 16 nt, Homo sapiens
gguugugcacuguuua

SEQ ID NO: 2046429 - RNA, 13 nt, Homo sapiens
cuggagugaucuc

SEQ ID NO: 2046430 - RNA, 15 nt, Homo sapiens
acccaguucagugag

SEQ ID NO: 2046431 - RNA, 13 nt, Homo sapiens
aguuguacuucug

SEQ ID NO: 2046432 - RNA, 14 nt, Homo sapiens
caaaaccuugcaca

SEQ ID NO: 2046433 - RNA, 10 nt, Homo sapiens
uccugccacc

SEQ ID NO: 2046434 - RNA, 17 nt, Homo sapiens
uauucuccauccuccca

SEQ ID NO: 2046435 - RNA, 12 nt, Homo sapiens
ugcugcugcuuc

SEQ ID NO: 2046436 - RNA, 14 nt, Homo sapiens
ggcugcagguguuc

SEQ ID NO: 2046437 - RNA, 20 nt, Homo sapiens
cucccuggcuacauggucaa

SEQ ID NO: 2046438 - RNA, 16 nt, Homo sapiens
uugaaccuccaaaugg

SEQ ID NO: 2046439 - RNA, 19 nt, Homo sapiens
aacagaaaggaauggccuu

SEQ ID NO: 2046440 - RNA, 19 nt, Homo sapiens
uaagauguccuccuugaua

SEQ ID NO: 2046441 - RNA, 23 nt, Homo sapiens
aagagagcucaucaucagucuua

SEQ ID NO: 2046442 - RNA, 17 nt, Homo sapiens
agcauaccaccaugccu

SEQ ID NO: 2046443 - RNA, 20 nt, Homo sapiens
auugaaaagaccuacagacu

SEQ ID NO: 2046444 - RNA, 18 nt, Homo sapiens
ucacggaccacucgaggc

SEQ ID NO: 2046445 - RNA, 16 nt, Homo sapiens
cugucugucaccagcu

SEQ ID NO: 2046446 - RNA, 16 nt, Homo sapiens
agcacauagcuugccu

SEQ ID NO: 2046447 - RNA, 20 nt, Homo sapiens
uuccacauaggaaaaugcca

SEQ ID NO: 2046448 - RNA, 16 nt, Homo sapiens
ugguggccggcagaag

SEQ ID NO: 2046449 - RNA, 19 nt, Homo sapiens
cugccuucacaaaugucau

SEQ ID NO: 2046450 - RNA, 12 nt, Homo sapiens
acaugugacauu

SEQ ID NO: 2046451 - RNA, 12 nt, Homo sapiens
acaggugacaug

SEQ ID NO: 2046452 - RNA, 19 nt, Homo sapiens
ucugcuggaaagucaacau

SEQ ID NO: 2046453 - RNA, 23 nt, Homo sapiens
gcugcaggccugacuacugccca

SEQ ID NO: 2046454 - RNA, 18 nt, Homo sapiens
ugccccgugguacauuca

SEQ ID NO: 2046455 - RNA, 20 nt, Homo sapiens
aggccauggguucaccagcc

SEQ ID NO: 2046456 - RNA, 14 nt, Homo sapiens
gaccagagcugcca

SEQ ID NO: 2046457 - RNA, 23 nt, Homo sapiens
uuaucagugaauauaaauguacu

SEQ ID NO: 2046458 - RNA, 15 nt, Homo sapiens
uuugggaagucucag

SEQ ID NO: 2046459 - RNA, 22 nt, Homo sapiens
uuccuuaaaugaacuacugcua

SEQ ID NO: 2046460 - RNA, 23 nt, Homo sapiens
uggauguaaagcgggaaggacau

SEQ ID NO: 2046461 - RNA, 15 nt, Homo sapiens
aauacauaagaccau

SEQ ID NO: 2046462 - RNA, 19 nt, Homo sapiens
gugcucggcuguaaacagc

SEQ ID NO: 2046463 - RNA, 18 nt, Homo sapiens
agccugcuggcacccacc

SEQ ID NO: 2046464 - RNA, 20 nt, Homo sapiens
agaaucagugcaaagauuug

SEQ ID NO: 2046465 - RNA, 14 nt, Homo sapiens
uaaaagaaucauuu

SEQ ID NO: 2046466 - RNA, 13 nt, Homo sapiens
cacagucucaguc

SEQ ID NO: 2046467 - RNA, 17 nt, Homo sapiens
uggcaagaucauagcuc

SEQ ID NO: 2046468 - RNA, 18 nt, Homo sapiens
cgaggccuauuguugaau

SEQ ID NO: 2046469 - RNA, 20 nt, Homo sapiens
cccaccuccacucugccauu

SEQ ID NO: 2046470 - RNA, 24 nt, Homo sapiens
agacucccaugagggagaugccau

SEQ ID NO: 2046471 - RNA, 15 nt, Homo sapiens
cagccagucuugccu

SEQ ID NO: 2046472 - RNA, 15 nt, Homo sapiens
aaggcaguauucccu

SEQ ID NO: 2046473 - RNA, 17 nt, Homo sapiens
aagcaaaacucacuaag

SEQ ID NO: 2046474 - RNA, 12 nt, Homo sapiens
uaugcaagcaca

SEQ ID NO: 2046475 - RNA, 16 nt, Homo sapiens
uugauuuacagugccu

SEQ ID NO: 2046476 - RNA, 17 nt, Homo sapiens
uuuguaagacuuacaaa

SEQ ID NO: 2046477 - RNA, 15 nt, Homo sapiens
aguucugguugauuc

SEQ ID NO: 2046478 - RNA, 17 nt, Homo sapiens
uuaagauacaaauuaau

SEQ ID NO: 2046479 - RNA, 19 nt, Homo sapiens
gcucauauuucuuuucuau

SEQ ID NO: 2046480 - RNA, 19 nt, Homo sapiens
cuuuuucuagggucccuga

SEQ ID NO: 2046481 - RNA, 16 nt, Homo sapiens
aagccuuaccuugaaa

SEQ ID NO: 2046482 - RNA, 18 nt, Homo sapiens
ucugaaauaggaaacaag

SEQ ID NO: 2046483 - RNA, 16 nt, Homo sapiens
accaacaagggcagug

SEQ ID NO: 2046484 - RNA, 11 nt, Homo sapiens
agagugguggg

SEQ ID NO: 2046485 - RNA, 13 nt, Homo sapiens
agcagaaccuugg

SEQ ID NO: 2046486 - RNA, 17 nt, Homo sapiens
uccaaaggaguggucaa

SEQ ID NO: 2046487 - RNA, 21 nt, Homo sapiens
caaguaaaugcacaacuuuag

SEQ ID NO: 2046488 - RNA, 23 nt, Homo sapiens
aagucuuccauagagacuuugug

SEQ ID NO: 2046489 - RNA, 19 nt, Homo sapiens
cagaauguguuauuuguca

SEQ ID NO: 2046490 - RNA, 20 nt, Homo sapiens
gcagggcuauauuucaguga

SEQ ID NO: 2046491 - RNA, 23 nt, Homo sapiens
uggguaucaggacugugaccaaa

SEQ ID NO: 2046492 - RNA, 11 nt, Homo sapiens
gaacacugaga

SEQ ID NO: 2046493 - RNA, 14 nt, Homo sapiens
uauaugugugccua

SEQ ID NO: 2046494 - RNA, 21 nt, Homo sapiens
agauucuucaggcuuccugca

SEQ ID NO: 2046495 - RNA, 11 nt, Homo sapiens
auuuuugcucu

SEQ ID NO: 2046496 - RNA, 16 nt, Homo sapiens
uagagagaaacagcuu

SEQ ID NO: 2046497 - RNA, 19 nt, Homo sapiens
gucccccugcuugucuuca

SEQ ID NO: 2046498 - RNA, 14 nt, Homo sapiens
aagugaacuugaug

SEQ ID NO: 2046499 - RNA, 16 nt, Homo sapiens
ucaagaagucacuguc

SEQ ID NO: 2046500 - RNA, 22 nt, Homo sapiens
uucaaaugucauuucauacaaa

SEQ ID NO: 2046501 - RNA, 16 nt, Homo sapiens
uaaccccauucuuugc

SEQ ID NO: 2046502 - RNA, 22 nt, Homo sapiens
aagauguggggaaaauucucau

SEQ ID NO: 2046503 - RNA, 22 nt, Homo sapiens
cugcccagacugaugagcacau

SEQ ID NO: 2046504 - RNA, 18 nt, Homo sapiens
aaauuuggaaaggaccaa

SEQ ID NO: 2046505 - RNA, 19 nt, Homo sapiens
gcugcuccccaacaccugc

SEQ ID NO: 2046506 - RNA, 22 nt, Homo sapiens
agaauauuaaaacugcuuugca

SEQ ID NO: 2046507 - RNA, 14 nt, Homo sapiens
uccugauaaacauu

SEQ ID NO: 2046508 - RNA, 19 nt, Homo sapiens
uuuacuuauaccucucuca

SEQ ID NO: 2046509 - RNA, 21 nt, Homo sapiens
augacugcaccaacaucauca

SEQ ID NO: 2046510 - RNA, 22 nt, Homo sapiens
gaaaggcuuuucaaccacaaaa

SEQ ID NO: 2046511 - RNA, 13 nt, Homo sapiens
uaaacuaguuuaa

SEQ ID NO: 2046512 - RNA, 22 nt, Homo sapiens
caguuugcuuuccguaaaugca

SEQ ID NO: 2046513 - RNA, 22 nt, Homo sapiens
gcuauccguguugcagguucau

SEQ ID NO: 2046514 - RNA, 19 nt, Homo sapiens
guuaccacagcaacugacc

SEQ ID NO: 2046515 - RNA, 12 nt, Homo sapiens
agguuaucagug

SEQ ID NO: 2046516 - RNA, 18 nt, Homo sapiens
agcacuuugggaggccaa

SEQ ID NO: 2046517 - RNA, 16 nt, Homo sapiens
uaaaggugguuuuauu

SEQ ID NO: 2046518 - RNA, 15 nt, Homo sapiens
ccuucccaugaccca

SEQ ID NO: 2046519 - RNA, 15 nt, Homo sapiens
cuugcaugugcugca

SEQ ID NO: 2046520 - RNA, 20 nt, Homo sapiens
cuucccucaugcuguuccac

SEQ ID NO: 2046521 - RNA, 14 nt, Homo sapiens
aguucaucucaugg

SEQ ID NO: 2046522 - RNA, 21 nt, Homo sapiens
aagggcuuaucuagccaaaga

SEQ ID NO: 2046523 - RNA, 19 nt, Homo sapiens
ccagccagaggaugcauag

SEQ ID NO: 2046524 - RNA, 17 nt, Homo sapiens
ccuuccucacuuccaua

SEQ ID NO: 2046525 - RNA, 17 nt, Homo sapiens
aucaggggauacaggcc

SEQ ID NO: 2046526 - RNA, 19 nt, Homo sapiens
caucauuacuuaugaugau

SEQ ID NO: 2046527 - RNA, 18 nt, Homo sapiens
cugagauugggcaugggg

SEQ ID NO: 2046528 - RNA, 14 nt, Homo sapiens
uacuuaauacucau

SEQ ID NO: 2046529 - RNA, 18 nt, Homo sapiens
ggcaggggaggccaucug

SEQ ID NO: 2046530 - RNA, 18 nt, Homo sapiens
ugaucucauggcuuugau

SEQ ID NO: 2046531 - RNA, 19 nt, Homo sapiens
agaaugugaaaaaggaaua

SEQ ID NO: 2046532 - RNA, 14 nt, Homo sapiens
accaaaaacacagu

SEQ ID NO: 2046533 - RNA, 19 nt, Homo sapiens
agguccugcuccgcugccu

SEQ ID NO: 2046534 - RNA, 16 nt, Homo sapiens
aggcuugucagcacuu

SEQ ID NO: 2046535 - RNA, 17 nt, Homo sapiens
aaacuggcuguuugaua

SEQ ID NO: 2046536 - RNA, 11 nt, Homo sapiens
aauccuuguag

SEQ ID NO: 2046537 - RNA, 14 nt, Homo sapiens
auaaagacaucucc

SEQ ID NO: 2046538 - RNA, 17 nt, Homo sapiens
uggcuucccagagcucc

SEQ ID NO: 2046539 - RNA, 18 nt, Homo sapiens
aaaguaauuguaugugcu

SEQ ID NO: 2046540 - RNA, 11 nt, Homo sapiens
ccaaagggaua

SEQ ID NO: 2046541 - RNA, 22 nt, Homo sapiens
aaccuacuagacaaugauguga

SEQ ID NO: 2046542 - RNA, 16 nt, Homo sapiens
gagggguguaccuaaa

SEQ ID NO: 2046543 - RNA, 13 nt, Homo sapiens
cauuugucauuuu

SEQ ID NO: 2046544 - RNA, 13 nt, Homo sapiens
cagcagucaugca

SEQ ID NO: 2046545 - RNA, 19 nt, Homo sapiens
aucaguucuuuugucuuag

SEQ ID NO: 2046546 - RNA, 16 nt, Homo sapiens
gaaugcagugguauga

SEQ ID NO: 2046547 - RNA, 16 nt, Homo sapiens
accaaggcagugcaug

SEQ ID NO: 2046548 - RNA, 12 nt, Homo sapiens
gugccaauguau

SEQ ID NO: 2046549 - RNA, 23 nt, Homo sapiens
auuauuccuccaggaaggagcaa

SEQ ID NO: 2046550 - RNA, 18 nt, Homo sapiens
ggugucuagcauuaacuu

SEQ ID NO: 2046551 - RNA, 18 nt, Homo sapiens
aaauagaagacauauaaa

SEQ ID NO: 2046552 - RNA, 23 nt, Homo sapiens
agguccuggcaaagaugaucagu

SEQ ID NO: 2046553 - RNA, 23 nt, Homo sapiens
ugccucgucauggccagcugcca

SEQ ID NO: 2046554 - RNA, 15 nt, Homo sapiens
caauauuugaucuaa

SEQ ID NO: 2046555 - RNA, 20 nt, Homo sapiens
aauuuaugugaaagaguucu

SEQ ID NO: 2046556 - RNA, 15 nt, Homo sapiens
uugcucuaugucugc

SEQ ID NO: 2046557 - RNA, 17 nt, Homo sapiens
gcacauaugugccaaug

SEQ ID NO: 2046558 - RNA, 17 nt, Homo sapiens
uacuccuuaauacuaga

SEQ ID NO: 2046559 - RNA, 13 nt, Homo sapiens
aacuuagugacaa

SEQ ID NO: 2046560 - RNA, 14 nt, Homo sapiens
gucacccacagacc

SEQ ID NO: 2046561 - RNA, 18 nt, Homo sapiens
uuaaccaaucagaugaca

SEQ ID NO: 2046562 - RNA, 15 nt, Homo sapiens
acacuguucugaaag

SEQ ID NO: 2046563 - RNA, 19 nt, Homo sapiens
aucacuugacuuugccaca

SEQ ID NO: 2046564 - RNA, 22 nt, Homo sapiens
uuuaucucacaaauaaguaaua

SEQ ID NO: 2046565 - RNA, 21 nt, Homo sapiens
uagaagagccugacuguguuc

SEQ ID NO: 2046566 - RNA, 18 nt, Homo sapiens
auagauagguagaacuau

SEQ ID NO: 2046567 - RNA, 14 nt, Homo sapiens
ccccugucucaggg

SEQ ID NO: 2046568 - RNA, 13 nt, Homo sapiens
cucuguguuccca

SEQ ID NO: 2046569 - RNA, 15 nt, Homo sapiens
uaaauaaagucuuac

SEQ ID NO: 2046570 - RNA, 14 nt, Homo sapiens
agugucgugucugc

SEQ ID NO: 2046571 - RNA, 20 nt, Homo sapiens
cuugguuugaguuucucuca

SEQ ID NO: 2046572 - RNA, 15 nt, Homo sapiens
agagcugagcacuuu

SEQ ID NO: 2046573 - RNA, 21 nt, Homo sapiens
ggaaagggcuaaacaugugag

SEQ ID NO: 2046574 - RNA, 16 nt, Homo sapiens
ccuggccucaucucag

SEQ ID NO: 2046575 - RNA, 17 nt, Homo sapiens
ugaaguugggaaauuca

SEQ ID NO: 2046576 - RNA, 22 nt, Homo sapiens
acguguuugcugucaagccauu

SEQ ID NO: 2046577 - RNA, 19 nt, Homo sapiens
aauuguuugauauugucac

SEQ ID NO: 2046578 - RNA, 21 nt, Homo sapiens
gaaugacuccaccuucucacc

SEQ ID NO: 2046579 - RNA, 21 nt, Homo sapiens
auaauuaaagaaaauugccaa

SEQ ID NO: 2046580 - RNA, 21 nt, Homo sapiens
aagcacuugaaucaguuuuua

SEQ ID NO: 2046581 - RNA, 14 nt, Homo sapiens
ucaugucucacuuc

SEQ ID NO: 2046582 - RNA, 20 nt, Homo sapiens
ugcacaaauugaaaacacac

SEQ ID NO: 2046583 - RNA, 14 nt, Homo sapiens
guagagccagccuu

SEQ ID NO: 2046584 - RNA, 23 nt, Homo sapiens
uuucccuguagauguaucaaaau

SEQ ID NO: 2046585 - RNA, 17 nt, Homo sapiens
uaauuuagauauuuucc

SEQ ID NO: 2046586 - RNA, 17 nt, Homo sapiens
auaguaggacugcugac

SEQ ID NO: 2046587 - RNA, 19 nt, Homo sapiens
gagcccccaacacaggcaa

SEQ ID NO: 2046588 - RNA, 14 nt, Homo sapiens
cuuacuuauucuuc

SEQ ID NO: 2046589 - RNA, 18 nt, Homo sapiens
auaugauuguaacauauu

SEQ ID NO: 2046590 - RNA, 14 nt, Homo sapiens
uacaaguguuuacu

SEQ ID NO: 2046591 - RNA, 21 nt, Homo sapiens
cuccaggaugaguuacuugaa

SEQ ID NO: 2046592 - RNA, 21 nt, Homo sapiens
aaucaauacccuuggcacuga

SEQ ID NO: 2046593 - RNA, 23 nt, Homo sapiens
gaauuuuuugagagaaugagaug

SEQ ID NO: 2046594 - RNA, 18 nt, Homo sapiens
agucuggccacugucaag

SEQ ID NO: 2046595 - RNA, 23 nt, Homo sapiens
uaacuguucucauuuuauugcua

SEQ ID NO: 2046596 - RNA, 16 nt, Homo sapiens
cccccuuguuguaaaa

SEQ ID NO: 2046597 - RNA, 18 nt, Homo sapiens
uuugaaaaacaaacagaa

SEQ ID NO: 2046598 - RNA, 15 nt, Homo sapiens
caggggccauguccu

SEQ ID NO: 2046599 - RNA, 14 nt, Homo sapiens
aggcugaacauaaa

SEQ ID NO: 2046600 - RNA, 18 nt, Homo sapiens
uaaccugcgucauuucag

SEQ ID NO: 2046601 - RNA, 22 nt, Homo sapiens
uacauaggcuuauauacaaugc

SEQ ID NO: 2046602 - RNA, 12 nt, Homo sapiens
gccugaaccugg

SEQ ID NO: 2046603 - RNA, 16 nt, Homo sapiens
auaagaaaacauguaa

SEQ ID NO: 2046604 - RNA, 20 nt, Homo sapiens
uuuccaguucaucuauggca

SEQ ID NO: 2046605 - RNA, 22 nt, Homo sapiens
cugaaagccauggagauucuca

SEQ ID NO: 2046606 - RNA, 21 nt, Homo sapiens
uaaucagaaaccccacuucca

SEQ ID NO: 2046607 - RNA, 12 nt, Homo sapiens
aaaauaccucuu

SEQ ID NO: 2046608 - RNA, 12 nt, Homo sapiens
ucauuaccaaua

SEQ ID NO: 2046609 - RNA, 16 nt, Homo sapiens
auugagucauugucag

SEQ ID NO: 2046610 - RNA, 15 nt, Homo sapiens
ggagggccugcagug

SEQ ID NO: 2046611 - RNA, 21 nt, Homo sapiens
uacccuucuuuaaaucaaaag

SEQ ID NO: 2046612 - RNA, 19 nt, Homo sapiens
uuguguucguggaacacau

SEQ ID NO: 2046613 - RNA, 14 nt, Homo sapiens
ggaucgaguguagc

SEQ ID NO: 2046614 - RNA, 19 nt, Homo sapiens
uggaaaaaugguugaugga

SEQ ID NO: 2046615 - RNA, 16 nt, Homo sapiens
aauuaggcagugcuaa

SEQ ID NO: 2046616 - RNA, 19 nt, Homo sapiens
ccucccuggaugacauuaa

SEQ ID NO: 2046617 - RNA, 18 nt, Homo sapiens
ugccggucccccaugcca

SEQ ID NO: 2046618 - RNA, 20 nt, Homo sapiens
aauaaaauaugagagcaaua

SEQ ID NO: 2046619 - RNA, 11 nt, Homo sapiens
ucugugccugg

SEQ ID NO: 2046620 - RNA, 21 nt, Homo sapiens
accaugugacuaaaaaugcau

SEQ ID NO: 2046621 - RNA, 19 nt, Homo sapiens
uuccagagcuauuauuuac

SEQ ID NO: 2046622 - RNA, 22 nt, Homo sapiens
aucaugaagcacaucaauuaca

SEQ ID NO: 2046623 - RNA, 21 nt, Homo sapiens
ggagcuuuuccugauguucca

SEQ ID NO: 2046624 - RNA, 22 nt, Homo sapiens
cagugguuggcaauuguuucaa

SEQ ID NO: 2046625 - RNA, 13 nt, Homo sapiens
ggccacccaggaa

SEQ ID NO: 2046626 - RNA, 15 nt, Homo sapiens
caguaauacaguaca

SEQ ID NO: 2046627 - RNA, 14 nt, Homo sapiens
uagggcaguggagu

SEQ ID NO: 2046628 - RNA, 17 nt, Homo sapiens
acuuuacaaccugaugu

SEQ ID NO: 2046629 - RNA, 21 nt, Homo sapiens
uuaauaaaugaauucauggac

SEQ ID NO: 2046630 - RNA, 17 nt, Homo sapiens
aaagugagacauuguga

SEQ ID NO: 2046631 - RNA, 21 nt, Homo sapiens
agcaugagcucacuccaucac

SEQ ID NO: 2046632 - RNA, 13 nt, Homo sapiens
caauggugcaaaa

SEQ ID NO: 2046633 - RNA, 24 nt, Homo sapiens
ugagcgaugacucaagugucucag

SEQ ID NO: 2046634 - RNA, 19 nt, Homo sapiens
gagccaccgcgcccggccu

SEQ ID NO: 2046635 - RNA, 14 nt, Homo sapiens
uauaaaacuugaua

SEQ ID NO: 2046636 - RNA, 16 nt, Homo sapiens
cuucugcuuucacuua

SEQ ID NO: 2046637 - RNA, 15 nt, Homo sapiens
gccuaagcugggauc

SEQ ID NO: 2046638 - RNA, 22 nt, Homo sapiens
aagcacuggaauucagaugcaa

SEQ ID NO: 2046639 - RNA, 15 nt, Homo sapiens
cagugcuguacuuga

SEQ ID NO: 2046640 - RNA, 21 nt, Homo sapiens
ugacuaacagccucagcacau

SEQ ID NO: 2046641 - RNA, 18 nt, Homo sapiens
ucucuguaaccagacuuu

SEQ ID NO: 2046642 - RNA, 19 nt, Homo sapiens
ggcaauuucaccaccaaau

SEQ ID NO: 2046643 - RNA, 14 nt, Homo sapiens
agaaugaaaacaau

SEQ ID NO: 2046644 - RNA, 22 nt, Homo sapiens
cugaugacuuuauccugagucc

SEQ ID NO: 2046645 - RNA, 18 nt, Homo sapiens
acaaaaaauagcuuucaa

SEQ ID NO: 2046646 - RNA, 23 nt, Homo sapiens
aauccaucguauuaaaaaacaau

SEQ ID NO: 2046647 - RNA, 19 nt, Homo sapiens
uccuuugcucccuguugcu

SEQ ID NO: 2046648 - RNA, 14 nt, Homo sapiens
uaagaaaaugaucu

SEQ ID NO: 2046649 - RNA, 14 nt, Homo sapiens
agacuuuacaugga

SEQ ID NO: 2046650 - RNA, 15 nt, Homo sapiens
uaaaaaccgaauaaa

SEQ ID NO: 2046651 - RNA, 16 nt, Homo sapiens
uuaggauuugugguaa

SEQ ID NO: 2046652 - RNA, 17 nt, Homo sapiens
accuccgccucccgggu

SEQ ID NO: 2046653 - RNA, 17 nt, Homo sapiens
aguauaaauuuguguaa

SEQ ID NO: 2046654 - RNA, 18 nt, Homo sapiens
ccaugguagaaaaugcac

SEQ ID NO: 2046655 - RNA, 16 nt, Homo sapiens
ugacgaagaagcaacu

SEQ ID NO: 2046656 - RNA, 17 nt, Homo sapiens
agcuggugcugcaagga

SEQ ID NO: 2046657 - RNA, 16 nt, Homo sapiens
uaagacagagaaacag

SEQ ID NO: 2046658 - RNA, 21 nt, Homo sapiens
aguccugcaaguccauagcug

SEQ ID NO: 2046659 - RNA, 16 nt, Homo sapiens
acugcaugacggagcc

SEQ ID NO: 2046660 - RNA, 15 nt, Homo sapiens
aaugcacccaucagc

SEQ ID NO: 2046661 - RNA, 23 nt, Homo sapiens
uaccuuuggauacgaagaccaua

SEQ ID NO: 2046662 - RNA, 14 nt, Homo sapiens
gcccucauacccau

SEQ ID NO: 2046663 - RNA, 14 nt, Homo sapiens
caucuguuccagaa

SEQ ID NO: 2046664 - RNA, 19 nt, Homo sapiens
accguccagcaagugucau

SEQ ID NO: 2046665 - RNA, 22 nt, Homo sapiens
uguugaggacaauuucauucca

SEQ ID NO: 2046666 - RNA, 17 nt, Homo sapiens
caggcagaucacaaggu

SEQ ID NO: 2046667 - RNA, 14 nt, Homo sapiens
agggaaagcauuua

SEQ ID NO: 2046668 - RNA, 19 nt, Homo sapiens
aaucagcacauuccuccua

SEQ ID NO: 2046669 - RNA, 16 nt, Homo sapiens
aaagacccuaucauag

SEQ ID NO: 2046670 - RNA, 16 nt, Homo sapiens
auaaaacaaaaccaag

SEQ ID NO: 2046671 - RNA, 16 nt, Homo sapiens
caugcaaugccaaaua

SEQ ID NO: 2046672 - RNA, 20 nt, Homo sapiens
aucaacaaaucuucacugag

SEQ ID NO: 2046673 - RNA, 18 nt, Homo sapiens
cucaccuacccaugaccu

SEQ ID NO: 2046674 - RNA, 15 nt, Homo sapiens
ucgcuaauagaauau

SEQ ID NO: 2046675 - RNA, 22 nt, Homo sapiens
ucugagaaagccuggcuuguau

SEQ ID NO: 2046676 - RNA, 19 nt, Homo sapiens
gauuuuuuucauuuugcca

SEQ ID NO: 2046677 - RNA, 15 nt, Homo sapiens
accaaugggccucca

SEQ ID NO: 2046678 - RNA, 23 nt, Homo sapiens
caguuagaagagguagugugaau

SEQ ID NO: 2046679 - RNA, 11 nt, Homo sapiens
ccccaucacac

SEQ ID NO: 2046680 - RNA, 22 nt, Homo sapiens
cccucggacagcccaucugccu

SEQ ID NO: 2046681 - RNA, 14 nt, Homo sapiens
acuuccugcaguga

SEQ ID NO: 2046682 - RNA, 18 nt, Homo sapiens
gccugccccccucaucuc

SEQ ID NO: 2046683 - RNA, 15 nt, Homo sapiens
gguguuuucagaaag

SEQ ID NO: 2046684 - RNA, 18 nt, Homo sapiens
cuucuaaaugaagugcaa

SEQ ID NO: 2046685 - RNA, 19 nt, Homo sapiens
gccacaugguguggccauc

SEQ ID NO: 2046686 - RNA, 16 nt, Homo sapiens
ggcacacugccagugu

SEQ ID NO: 2046687 - RNA, 14 nt, Homo sapiens
cucugugucaggug

SEQ ID NO: 2046688 - RNA, 15 nt, Homo sapiens
uggggccccucucau

SEQ ID NO: 2046689 - RNA, 14 nt, Homo sapiens
agguaaauaaucau

SEQ ID NO: 2046690 - RNA, 18 nt, Homo sapiens
gcuauuuucugaccaaaa

SEQ ID NO: 2046691 - RNA, 13 nt, Homo sapiens
caguggguuugua

SEQ ID NO: 2046692 - RNA, 19 nt, Homo sapiens
auggguggaccuguguaug

SEQ ID NO: 2046693 - RNA, 14 nt, Homo sapiens
gagugacagucaua

SEQ ID NO: 2046694 - RNA, 14 nt, Homo sapiens
uuuuccauuguguu

SEQ ID NO: 2046695 - RNA, 12 nt, Homo sapiens
cacagccauagc

SEQ ID NO: 2046696 - RNA, 23 nt, Homo sapiens
uucaaaggccagagucacaggaa

SEQ ID NO: 2046697 - RNA, 13 nt, Homo sapiens
uccccccacaaga

SEQ ID NO: 2046698 - RNA, 14 nt, Homo sapiens
auauuucuguguag

SEQ ID NO: 2046699 - RNA, 22 nt, Homo sapiens
caggugccuccaggugugcacg

SEQ ID NO: 2046700 - RNA, 13 nt, Homo sapiens
accaccagucuag

SEQ ID NO: 2046701 - RNA, 14 nt, Homo sapiens
ugcuggggaagaca

SEQ ID NO: 2046702 - RNA, 14 nt, Homo sapiens
caccugugagacca

SEQ ID NO: 2046703 - RNA, 18 nt, Homo sapiens
gccccugccucccaaacc

SEQ ID NO: 2046704 - RNA, 20 nt, Homo sapiens
aaguuaaaaagucaaacuuu

SEQ ID NO: 2046705 - RNA, 19 nt, Homo sapiens
cugucugaauauucuagaa

SEQ ID NO: 2046706 - RNA, 20 nt, Homo sapiens
ucaugacugagucuggcaaa

SEQ ID NO: 2046707 - RNA, 19 nt, Homo sapiens
aguugcauuuagcuucuuu

SEQ ID NO: 2046708 - RNA, 13 nt, Homo sapiens
acauguacagaga

SEQ ID NO: 2046709 - RNA, 13 nt, Homo sapiens
ucuuguacuguga

SEQ ID NO: 2046710 - RNA, 18 nt, Homo sapiens
aaucauccucugaguuaa

SEQ ID NO: 2046711 - RNA, 16 nt, Homo sapiens
aucuuucacuaucugu

SEQ ID NO: 2046712 - RNA, 18 nt, Homo sapiens
gauucuuuuuucaaugua

SEQ ID NO: 2046713 - RNA, 15 nt, Homo sapiens
aggaugaugccaguu

SEQ ID NO: 2046714 - RNA, 17 nt, Homo sapiens
acuauuuuaaauaucca

SEQ ID NO: 2046715 - RNA, 17 nt, Homo sapiens
ccaaauuuuagauuuac

SEQ ID NO: 2046716 - RNA, 17 nt, Homo sapiens
gaccuccaggaagggac

SEQ ID NO: 2046717 - RNA, 15 nt, Homo sapiens
ugaacucaucauuuu

SEQ ID NO: 2046718 - RNA, 21 nt, Homo sapiens
gagccaaagcuuaugugacau

SEQ ID NO: 2046719 - RNA, 19 nt, Homo sapiens
caucaaauauuaccaaaaa

SEQ ID NO: 2046720 - RNA, 15 nt, Homo sapiens
aauggcaagcauagu

SEQ ID NO: 2046721 - RNA, 14 nt, Homo sapiens
auauguagcauuaa

SEQ ID NO: 2046722 - RNA, 14 nt, Homo sapiens
uccccaaggccaca

SEQ ID NO: 2046723 - RNA, 21 nt, Homo sapiens
gggaggcccugagacagggau

SEQ ID NO: 2046724 - RNA, 22 nt, Homo sapiens
aaauuaagaaguacaauaagca

SEQ ID NO: 2046725 - RNA, 21 nt, Homo sapiens
acugccaucaagaugagagaa

SEQ ID NO: 2046726 - RNA, 16 nt, Homo sapiens
acacagucugcaagau

SEQ ID NO: 2046727 - RNA, 15 nt, Homo sapiens
caagcacagaaggag

SEQ ID NO: 2046728 - RNA, 23 nt, Homo sapiens
agagcuggcgcucagcagcccua

SEQ ID NO: 2046729 - RNA, 17 nt, Homo sapiens
gcacaacaugcacauuc

SEQ ID NO: 2046730 - RNA, 22 nt, Homo sapiens
auuguuuccaaagugcauguca

SEQ ID NO: 2046731 - RNA, 18 nt, Homo sapiens
uucugcacaguguuccca

SEQ ID NO: 2046732 - RNA, 20 nt, Homo sapiens
uacuccuggagcacuguaaa

SEQ ID NO: 2046733 - RNA, 16 nt, Homo sapiens
aagaucuuucuuaaua

SEQ ID NO: 2046734 - RNA, 17 nt, Homo sapiens
gaaaaaagguuacuuug

SEQ ID NO: 2046735 - RNA, 16 nt, Homo sapiens
uguagcccauccuucc

SEQ ID NO: 2046736 - RNA, 21 nt, Homo sapiens
gucaguauuucaguguaguua

SEQ ID NO: 2046737 - RNA, 12 nt, Homo sapiens
auaucuaugacu

SEQ ID NO: 2046738 - RNA, 23 nt, Homo sapiens
gcugacaugaagcuguuguguga

SEQ ID NO: 2046739 - RNA, 18 nt, Homo sapiens
acaaggcgagcuugaguu

SEQ ID NO: 2046740 - RNA, 21 nt, Homo sapiens
accucaagugccuuauucuca

SEQ ID NO: 2046741 - RNA, 15 nt, Homo sapiens
auaaccuuucacuua

SEQ ID NO: 2046742 - RNA, 22 nt, Homo sapiens
ucaaaguguuuuucaagccugu

SEQ ID NO: 2046743 - RNA, 15 nt, Homo sapiens
cuucacggcugacau

SEQ ID NO: 2046744 - RNA, 16 nt, Homo sapiens
gaaucacuugaaccca

SEQ ID NO: 2046745 - RNA, 15 nt, Homo sapiens
gucucaaaggccagg

SEQ ID NO: 2046746 - RNA, 18 nt, Homo sapiens
ugcucaaucaugugccag

SEQ ID NO: 2046747 - RNA, 18 nt, Homo sapiens
auaaugccucuccuuaaa

SEQ ID NO: 2046748 - RNA, 20 nt, Homo sapiens
caccuucccucgacuugacc

SEQ ID NO: 2046749 - RNA, 21 nt, Homo sapiens
gccagagggugggaggggcca

SEQ ID NO: 2046750 - RNA, 15 nt, Homo sapiens
uuaaaacuuugccau

SEQ ID NO: 2046751 - RNA, 14 nt, Homo sapiens
aaaaaugucuuuca

SEQ ID NO: 2046752 - RNA, 16 nt, Homo sapiens
ucacugaaaccaggug

SEQ ID NO: 2046753 - RNA, 20 nt, Homo sapiens
uuaauauuguuguuuaccaa

SEQ ID NO: 2046754 - RNA, 23 nt, Homo sapiens
ugagauguagccuggcccuggaa

SEQ ID NO: 2046755 - RNA, 14 nt, Homo sapiens
gcaaaauaaucuaa

SEQ ID NO: 2046756 - RNA, 21 nt, Homo sapiens
uuuauaauauaaaucaaucuu

SEQ ID NO: 2046757 - RNA, 23 nt, Homo sapiens
auuagcuguaaauacaugugugg

SEQ ID NO: 2046758 - RNA, 24 nt, Homo sapiens
cuuguuccccaucaucuguggaac

SEQ ID NO: 2046759 - RNA, 23 nt, Homo sapiens
cuguccugcuucugaaugugcug

SEQ ID NO: 2046760 - RNA, 13 nt, Homo sapiens
ugcuucuccauga

SEQ ID NO: 2046761 - RNA, 17 nt, Homo sapiens
uguuaaguuaagcuuuu

SEQ ID NO: 2046762 - RNA, 20 nt, Homo sapiens
uucuuucuccucugauuuca

SEQ ID NO: 2046763 - RNA, 15 nt, Homo sapiens
ggcugagggugcccu

SEQ ID NO: 2046764 - RNA, 23 nt, Homo sapiens
gaagcucuggccaaccaaagaca

SEQ ID NO: 2046765 - RNA, 20 nt, Homo sapiens
gcauuuugccuaccuggguc

SEQ ID NO: 2046766 - RNA, 12 nt, Homo sapiens
auuuugaaaaua

SEQ ID NO: 2046767 - RNA, 18 nt, Homo sapiens
uauaagaaagaucaaaga

SEQ ID NO: 2046768 - RNA, 14 nt, Homo sapiens
caggaaaccagaaa

SEQ ID NO: 2046769 - RNA, 14 nt, Homo sapiens
ugaaauacugagau

SEQ ID NO: 2046770 - RNA, 14 nt, Homo sapiens
ugugagacuguaag

SEQ ID NO: 2046771 - RNA, 14 nt, Homo sapiens
ucaacuacucagcu

SEQ ID NO: 2046772 - RNA, 14 nt, Homo sapiens
acuaaaacacugaa

SEQ ID NO: 2046773 - RNA, 16 nt, Homo sapiens
acccaggaccaagcca

SEQ ID NO: 2046774 - RNA, 13 nt, Homo sapiens
uaaguaauuucag

SEQ ID NO: 2046775 - RNA, 22 nt, Homo sapiens
ugcuguggccaggccugcagac

SEQ ID NO: 2046776 - RNA, 19 nt, Homo sapiens
aaugugaagacaaguagua

SEQ ID NO: 2046777 - RNA, 19 nt, Homo sapiens
uuguugaaacaaaacugga

SEQ ID NO: 2046778 - RNA, 23 nt, Homo sapiens
cagaguaacacaauuuucacuuu

SEQ ID NO: 2046779 - RNA, 19 nt, Homo sapiens
cuuaaaaugacaaagccau

SEQ ID NO: 2046780 - RNA, 15 nt, Homo sapiens
uuuaauucauaguaa

SEQ ID NO: 2046781 - RNA, 20 nt, Homo sapiens
uggagagagauguuccucuu

SEQ ID NO: 2046782 - RNA, 19 nt, Homo sapiens
cucuuauagaaaguucaaa

SEQ ID NO: 2046783 - RNA, 21 nt, Homo sapiens
ucaaucugcaguuuaacaaaa

SEQ ID NO: 2046784 - RNA, 19 nt, Homo sapiens
uugaauaaauguaucugaa

SEQ ID NO: 2046785 - RNA, 15 nt, Homo sapiens
gaaaaugaacugcuu

SEQ ID NO: 2046786 - RNA, 15 nt, Homo sapiens
agaugugucuuacca

SEQ ID NO: 2046787 - RNA, 22 nt, Homo sapiens
auuucuuucaauaaacuaaaga

SEQ ID NO: 2046788 - RNA, 20 nt, Homo sapiens
aacccaaucccucuccacuc

SEQ ID NO: 2046789 - RNA, 21 nt, Homo sapiens
aagguacuggugagggcaaga

SEQ ID NO: 2046790 - RNA, 12 nt, Homo sapiens
guuacaugaauu

SEQ ID NO: 2046791 - RNA, 19 nt, Homo sapiens
aaugugugccuuguucaag

SEQ ID NO: 2046792 - RNA, 11 nt, Homo sapiens
cuaugcacuga

SEQ ID NO: 2046793 - RNA, 22 nt, Homo sapiens
ucuguuauuuguccucauguga

SEQ ID NO: 2046794 - RNA, 13 nt, Homo sapiens
ugugggacccgcc

SEQ ID NO: 2046795 - RNA, 21 nt, Homo sapiens
gcaagcgucugggcaagagga

SEQ ID NO: 2046796 - RNA, 15 nt, Homo sapiens
cauggugguggacac

SEQ ID NO: 2046797 - RNA, 20 nt, Homo sapiens
augaucaugccacugcacuc

SEQ ID NO: 2046798 - RNA, 15 nt, Homo sapiens
uuuucucugcauuua

SEQ ID NO: 2046799 - RNA, 12 nt, Homo sapiens
aacagguguguu

SEQ ID NO: 2046800 - RNA, 16 nt, Homo sapiens
gccuccaaacacagau

SEQ ID NO: 2046801 - RNA, 19 nt, Homo sapiens
gucacccccacucugcaua

SEQ ID NO: 2046802 - RNA, 22 nt, Homo sapiens
gcugucuuugcagggcacagau

SEQ ID NO: 2046803 - RNA, 14 nt, Homo sapiens
aauaagcaggaugu

SEQ ID NO: 2046804 - RNA, 15 nt, Homo sapiens
acuuacuauugguca

SEQ ID NO: 2046805 - RNA, 20 nt, Homo sapiens
cugccuccucagccauggga

SEQ ID NO: 2046806 - RNA, 12 nt, Homo sapiens
ucucaacuucau

SEQ ID NO: 2046807 - RNA, 12 nt, Homo sapiens
uaauaacuuauc

SEQ ID NO: 2046808 - RNA, 19 nt, Homo sapiens
ugaaccaccuguguagucu

SEQ ID NO: 2046809 - RNA, 13 nt, Homo sapiens
ugcuuuguugcac

SEQ ID NO: 2046810 - RNA, 12 nt, Homo sapiens
ugcagcugucac

SEQ ID NO: 2046811 - RNA, 21 nt, Homo sapiens
aagcagguucccaagcucaga

SEQ ID NO: 2046812 - RNA, 20 nt, Homo sapiens
aguuuuucccuucaucuggg

SEQ ID NO: 2046813 - RNA, 15 nt, Homo sapiens
agcugugcgugugug

SEQ ID NO: 2046814 - RNA, 19 nt, Homo sapiens
ggacuugggcgggacacag

SEQ ID NO: 2046815 - RNA, 12 nt, Homo sapiens
caugaccagaaa

SEQ ID NO: 2046816 - RNA, 22 nt, Homo sapiens
gaaagcacuauuaauacucugc

SEQ ID NO: 2046817 - RNA, 19 nt, Homo sapiens
ggacuaaguguaccagaga

SEQ ID NO: 2046818 - RNA, 14 nt, Homo sapiens
acuguccuacccac

SEQ ID NO: 2046819 - RNA, 12 nt, Homo sapiens
uagugccuugcc

SEQ ID NO: 2046820 - RNA, 21 nt, Homo sapiens
ugaagauaguaacuguagaug

SEQ ID NO: 2046821 - RNA, 15 nt, Homo sapiens
guucccccagcaagc

SEQ ID NO: 2046822 - RNA, 18 nt, Homo sapiens
ugcucccaguccugccug

SEQ ID NO: 2046823 - RNA, 19 nt, Homo sapiens
caguguagcccacacuuga

SEQ ID NO: 2046824 - RNA, 18 nt, Homo sapiens
cucgcugccaucaccgcu

SEQ ID NO: 2046825 - RNA, 20 nt, Homo sapiens
gcuuuccacauuugucacag

SEQ ID NO: 2046826 - RNA, 20 nt, Homo sapiens
cucagaggcugagcccugua

SEQ ID NO: 2046827 - RNA, 13 nt, Homo sapiens
uccaaauucacaa

SEQ ID NO: 2046828 - RNA, 14 nt, Homo sapiens
cuauggucaguuga

SEQ ID NO: 2046829 - RNA, 15 nt, Homo sapiens
aauagcuauggaauc

SEQ ID NO: 2046830 - RNA, 21 nt, Homo sapiens
ggugaccagccacucaaagga

SEQ ID NO: 2046831 - RNA, 22 nt, Homo sapiens
aagaaauuccuuccuuaccuga

SEQ ID NO: 2046832 - RNA, 12 nt, Homo sapiens
aaucuucacuuu

SEQ ID NO: 2046833 - RNA, 22 nt, Homo sapiens
caucgcuuuauuggcugagaua

SEQ ID NO: 2046834 - RNA, 21 nt, Homo sapiens
ucagagaaaagagauugagau

SEQ ID NO: 2046835 - RNA, 13 nt, Homo sapiens
gcagggcaugacu

SEQ ID NO: 2046836 - RNA, 23 nt, Homo sapiens
agaaaucuugaauagcuuaugua

SEQ ID NO: 2046837 - RNA, 17 nt, Homo sapiens
caagcacuggacuacaa

SEQ ID NO: 2046838 - RNA, 15 nt, Homo sapiens
cauacuguucacuca

SEQ ID NO: 2046839 - RNA, 11 nt, Homo sapiens
agggccaguga

SEQ ID NO: 2046840 - RNA, 14 nt, Homo sapiens
gauaacugcauaaa

SEQ ID NO: 2046841 - RNA, 14 nt, Homo sapiens
cccuccuggccuca

SEQ ID NO: 2046842 - RNA, 20 nt, Homo sapiens
uauguucaaugcaaaguaaa

SEQ ID NO: 2046843 - RNA, 13 nt, Homo sapiens
caccucacaacuc

SEQ ID NO: 2046844 - RNA, 13 nt, Homo sapiens
cccuucacacccc

SEQ ID NO: 2046845 - RNA, 16 nt, Homo sapiens
caccuugcccuuuacg

SEQ ID NO: 2046846 - RNA, 18 nt, Homo sapiens
cagcagaaauuaaaugaa

SEQ ID NO: 2046847 - RNA, 22 nt, Homo sapiens
cauuccauccuugagucaaaaa

SEQ ID NO: 2046848 - RNA, 13 nt, Homo sapiens
aggcuacuugagc

SEQ ID NO: 2046849 - RNA, 18 nt, Homo sapiens
caauagaguugggacaau

SEQ ID NO: 2046850 - RNA, 20 nt, Homo sapiens
cuaguuuuuuugaaauccaa

SEQ ID NO: 2046851 - RNA, 17 nt, Homo sapiens
uucuaagcaaaauugcu

SEQ ID NO: 2046852 - RNA, 20 nt, Homo sapiens
ugaaggcucauuuacuugaa

SEQ ID NO: 2046853 - RNA, 11 nt, Homo sapiens
cgcaagggagg

SEQ ID NO: 2046854 - RNA, 14 nt, Homo sapiens
ccucauccuuucag

SEQ ID NO: 2046855 - RNA, 20 nt, Homo sapiens
ggccuguccaccugugcugc

SEQ ID NO: 2046856 - RNA, 18 nt, Homo sapiens
cccucucuuauaauucca

SEQ ID NO: 2046857 - RNA, 14 nt, Homo sapiens
ccaaguugcucugu

SEQ ID NO: 2046858 - RNA, 22 nt, Homo sapiens
aacaugaagcacacacacaaaa

SEQ ID NO: 2046859 - RNA, 19 nt, Homo sapiens
gaauauggugggcacagaa

SEQ ID NO: 2046860 - RNA, 18 nt, Homo sapiens
cauacaagccaacuggua

SEQ ID NO: 2046861 - RNA, 17 nt, Homo sapiens
ggcuccaggacuccacu

SEQ ID NO: 2046862 - RNA, 20 nt, Homo sapiens
uuacgcucggaacacauucu

SEQ ID NO: 2046863 - RNA, 12 nt, Homo sapiens
aacacagccugg

SEQ ID NO: 2046864 - RNA, 19 nt, Homo sapiens
uccacccccuccugucacc

SEQ ID NO: 2046865 - RNA, 18 nt, Homo sapiens
cucucaguguguuugcua

SEQ ID NO: 2046866 - RNA, 18 nt, Homo sapiens
gagcacuguagcacuuaa

SEQ ID NO: 2046867 - RNA, 16 nt, Homo sapiens
ccuuggcagcccugau

SEQ ID NO: 2046868 - RNA, 14 nt, Homo sapiens
cuugcacugauaaa

SEQ ID NO: 2046869 - RNA, 22 nt, Homo sapiens
cugagcugaacacauuugccca

SEQ ID NO: 2046870 - RNA, 14 nt, Homo sapiens
uaggugguguuugu

SEQ ID NO: 2046871 - RNA, 17 nt, Homo sapiens
gcgauugaaagggcaau

SEQ ID NO: 2046872 - RNA, 20 nt, Homo sapiens
augcaaaaugacuuauuagg

SEQ ID NO: 2046873 - RNA, 16 nt, Homo sapiens
ggggucagaugcacug

SEQ ID NO: 2046874 - RNA, 20 nt, Homo sapiens
cagagaaagcuugaggccau

SEQ ID NO: 2046875 - RNA, 14 nt, Homo sapiens
ugacugaagcacag

SEQ ID NO: 2046876 - RNA, 19 nt, Homo sapiens
aguaggcaucaguauguca

SEQ ID NO: 2046877 - RNA, 14 nt, Homo sapiens
uauaguugcuugcc

SEQ ID NO: 2046878 - RNA, 20 nt, Homo sapiens
augcugagauccucauuuau

SEQ ID NO: 2046879 - RNA, 18 nt, Homo sapiens
acaauaauuuaacaagcu

SEQ ID NO: 2046880 - RNA, 23 nt, Homo sapiens
gagcaccugcaggcgugaccuga

SEQ ID NO: 2046881 - RNA, 16 nt, Homo sapiens
accuccuccucuggac

SEQ ID NO: 2046882 - RNA, 23 nt, Homo sapiens
augcacacacacagagauaugca

SEQ ID NO: 2046883 - RNA, 11 nt, Homo sapiens
aucacagucag

SEQ ID NO: 2046884 - RNA, 13 nt, Homo sapiens
aucauuagggcuu

SEQ ID NO: 2046885 - RNA, 16 nt, Homo sapiens
uccaggccugcagcag

SEQ ID NO: 2046886 - RNA, 16 nt, Homo sapiens
agauuuacuaaaucaa

SEQ ID NO: 2046887 - RNA, 17 nt, Homo sapiens
caagauugcaccacugc

SEQ ID NO: 2046888 - RNA, 12 nt, Homo sapiens
aacagacucuca

SEQ ID NO: 2046889 - RNA, 22 nt, Homo sapiens
accccugcucaguaaagcacuu

SEQ ID NO: 2046890 - RNA, 17 nt, Homo sapiens
aagguugugcccuccac

SEQ ID NO: 2046891 - RNA, 21 nt, Homo sapiens
auaaaauauacaaacaugugg

SEQ ID NO: 2046892 - RNA, 12 nt, Homo sapiens
ugguuuuggaca

SEQ ID NO: 2046893 - RNA, 21 nt, Homo sapiens
cuguaguuuuaucacauguau

SEQ ID NO: 2046894 - RNA, 15 nt, Homo sapiens
gaagaaugaacaaau

SEQ ID NO: 2046895 - RNA, 19 nt, Homo sapiens
uaaagaaaaguuuuguaaa

SEQ ID NO: 2046896 - RNA, 15 nt, Homo sapiens
uguaacacuugucaa

SEQ ID NO: 2046897 - RNA, 15 nt, Homo sapiens
agucauugaggcccu

SEQ ID NO: 2046898 - RNA, 22 nt, Homo sapiens
augagguuggaaagaguugcca

SEQ ID NO: 2046899 - RNA, 18 nt, Homo sapiens
agauagcaccauugcacu

SEQ ID NO: 2046900 - RNA, 18 nt, Homo sapiens
gaaaccacagucuuccca

SEQ ID NO: 2046901 - RNA, 15 nt, Homo sapiens
aauuugaauucaauu

SEQ ID NO: 2046902 - RNA, 19 nt, Homo sapiens
gaggcuucccuacacaggg

SEQ ID NO: 2046903 - RNA, 17 nt, Homo sapiens
ccugagauuucaucugc

SEQ ID NO: 2046904 - RNA, 13 nt, Homo sapiens
uaaaacauuugaa

SEQ ID NO: 2046905 - RNA, 14 nt, Homo sapiens
ucugccaugcucug

SEQ ID NO: 2046906 - RNA, 18 nt, Homo sapiens
aucucaagauucaguaga

SEQ ID NO: 2046907 - RNA, 18 nt, Homo sapiens
aacagcccucucucucac

SEQ ID NO: 2046908 - RNA, 14 nt, Homo sapiens
cuuuguagcuacuu

SEQ ID NO: 2046909 - RNA, 12 nt, Homo sapiens
agaacacauucu

SEQ ID NO: 2046910 - RNA, 17 nt, Homo sapiens
gcaccuguaaugugcga

SEQ ID NO: 2046911 - RNA, 21 nt, Homo sapiens
aaaguccucuggauugagaua

SEQ ID NO: 2046912 - RNA, 14 nt, Homo sapiens
aaaguggccaugcc

SEQ ID NO: 2046913 - RNA, 14 nt, Homo sapiens
uguuaaaugugcua

SEQ ID NO: 2046914 - RNA, 13 nt, Homo sapiens
cauauucuuaaca

SEQ ID NO: 2046915 - RNA, 19 nt, Homo sapiens
uauucacuuguguguguac

SEQ ID NO: 2046916 - RNA, 15 nt, Homo sapiens
cucacugugcuccua

SEQ ID NO: 2046917 - RNA, 19 nt, Homo sapiens
augccacaaauaacaucuc

SEQ ID NO: 2046918 - RNA, 21 nt, Homo sapiens
uacccucuaaaaaagaacuuu

SEQ ID NO: 2046919 - RNA, 23 nt, Homo sapiens
gaaguuuuuauuuuaaacauuuu

SEQ ID NO: 2046920 - RNA, 15 nt, Homo sapiens
ucugaagugugucca

SEQ ID NO: 2046921 - RNA, 16 nt, Homo sapiens
acccaggcaugggcag

SEQ ID NO: 2046922 - RNA, 23 nt, Homo sapiens
caggccccccagccaagaaagcu

SEQ ID NO: 2046923 - RNA, 24 nt, Homo sapiens
ucacugugcuuauuuuguuucaau

SEQ ID NO: 2046924 - RNA, 14 nt, Homo sapiens
gugcuacaugaugc

SEQ ID NO: 2046925 - RNA, 17 nt, Homo sapiens
augaguaagaugaugaa

SEQ ID NO: 2046926 - RNA, 17 nt, Homo sapiens
ucuuccuggauggggca

SEQ ID NO: 2046927 - RNA, 13 nt, Homo sapiens
ugaacccaaaaag

SEQ ID NO: 2046928 - RNA, 22 nt, Homo sapiens
ucaccccuguccucacugcucc

SEQ ID NO: 2046929 - RNA, 21 nt, Homo sapiens
ccucccuagauccaggcuucu

SEQ ID NO: 2046930 - RNA, 16 nt, Homo sapiens
uuuaaaaaaguaugaa

SEQ ID NO: 2046931 - RNA, 16 nt, Homo sapiens
agccacacuucucagg

SEQ ID NO: 2046932 - RNA, 19 nt, Homo sapiens
ucauaccucagaauguaaa

SEQ ID NO: 2046933 - RNA, 18 nt, Homo sapiens
guccacagaagugagcuc

SEQ ID NO: 2046934 - RNA, 13 nt, Homo sapiens
augugugugccaa

SEQ ID NO: 2046935 - RNA, 22 nt, Homo sapiens
acugcagaacagcaucauguca

SEQ ID NO: 2046936 - RNA, 18 nt, Homo sapiens
gcuccuuaucagugccau

SEQ ID NO: 2046937 - RNA, 16 nt, Homo sapiens
aagaauaagacauaaa

SEQ ID NO: 2046938 - RNA, 15 nt, Homo sapiens
acagugacacccaga

SEQ ID NO: 2046939 - RNA, 22 nt, Homo sapiens
aggggcugccgagugcugugca

SEQ ID NO: 2046940 - RNA, 23 nt, Homo sapiens
cauuuuuaccuuguggaugcuag

SEQ ID NO: 2046941 - RNA, 16 nt, Homo sapiens
guaugugcacugucac

SEQ ID NO: 2046942 - RNA, 14 nt, Homo sapiens
cagaaguuugcauc

SEQ ID NO: 2046943 - RNA, 17 nt, Homo sapiens
uuaaaugugaauuucaa

SEQ ID NO: 2046944 - RNA, 21 nt, Homo sapiens
agcaaaucuccugccucagcc

SEQ ID NO: 2046945 - RNA, 15 nt, Homo sapiens
uauaagaaagccuga

SEQ ID NO: 2046946 - RNA, 15 nt, Homo sapiens
ucgagcaacugcugu

SEQ ID NO: 2046947 - RNA, 21 nt, Homo sapiens
guugagcuguugccucagucc

SEQ ID NO: 2046948 - RNA, 19 nt, Homo sapiens
gauucuggguuugcccagu

SEQ ID NO: 2046949 - RNA, 14 nt, Homo sapiens
agguccaagcacau

SEQ ID NO: 2046950 - RNA, 13 nt, Homo sapiens
gucauucugcuaa

SEQ ID NO: 2046951 - RNA, 13 nt, Homo sapiens
uuucuucuuccca

SEQ ID NO: 2046952 - RNA, 16 nt, Homo sapiens
cccagauacaugguga

SEQ ID NO: 2046953 - RNA, 16 nt, Homo sapiens
caagagcaucaggcuc

SEQ ID NO: 2046954 - RNA, 12 nt, Homo sapiens
uuaaacugccaa

SEQ ID NO: 2046955 - RNA, 22 nt, Homo sapiens
aauuuccaaagcagccugugaa

SEQ ID NO: 2046956 - RNA, 16 nt, Homo sapiens
gaggagggagugcugu

SEQ ID NO: 2046957 - RNA, 15 nt, Homo sapiens
caagcauuccugcuc

SEQ ID NO: 2046958 - RNA, 21 nt, Homo sapiens
uacugagugccugcagcaucu

SEQ ID NO: 2046959 - RNA, 14 nt, Homo sapiens
ucggccucccaaag

SEQ ID NO: 2046960 - RNA, 13 nt, Homo sapiens
agaggggaaaaug

SEQ ID NO: 2046961 - RNA, 14 nt, Homo sapiens
guaaaaacugaacu

SEQ ID NO: 2046962 - RNA, 23 nt, Homo sapiens
augcuuggguacacuucucuuaa

SEQ ID NO: 2046963 - RNA, 19 nt, Homo sapiens
auuacugaaauauaccuuu

SEQ ID NO: 2046964 - RNA, 16 nt, Homo sapiens
ggaagcuccacuguca

SEQ ID NO: 2046965 - RNA, 20 nt, Homo sapiens
uagccacggaaacauagaaa

SEQ ID NO: 2046966 - RNA, 15 nt, Homo sapiens
uucaaaccuaaaaau

SEQ ID NO: 2046967 - RNA, 18 nt, Homo sapiens
gcauuuuacuaugccugu

SEQ ID NO: 2046968 - RNA, 13 nt, Homo sapiens
ucggaggacccug

SEQ ID NO: 2046969 - RNA, 18 nt, Homo sapiens
ccauggcacugacaaugg

SEQ ID NO: 2046970 - RNA, 17 nt, Homo sapiens
aaaguauaacuuauuca

SEQ ID NO: 2046971 - RNA, 22 nt, Homo sapiens
aucaaaugugacauuauaugca

SEQ ID NO: 2046972 - RNA, 21 nt, Homo sapiens
accccgcacugcagacgggaa

SEQ ID NO: 2046973 - RNA, 22 nt, Homo sapiens
cccagcugacaguccucuccac

SEQ ID NO: 2046974 - RNA, 17 nt, Homo sapiens
ugcaaagaucuuuucca

SEQ ID NO: 2046975 - RNA, 14 nt, Homo sapiens
gugguguguguaug

SEQ ID NO: 2046976 - RNA, 14 nt, Homo sapiens
uuggccucugcccu

SEQ ID NO: 2046977 - RNA, 19 nt, Homo sapiens
uauggaggccucacaccca

SEQ ID NO: 2046978 - RNA, 23 nt, Homo sapiens
gucacaucucagggaacugaccc

SEQ ID NO: 2046979 - RNA, 18 nt, Homo sapiens
auuccacuccacucaggu

SEQ ID NO: 2046980 - RNA, 17 nt, Homo sapiens
guguuuccacagccugc

SEQ ID NO: 2046981 - RNA, 17 nt, Homo sapiens
aauagaacuggucuucc

SEQ ID NO: 2046982 - RNA, 16 nt, Homo sapiens
auaagugcuuuccuua

SEQ ID NO: 2046983 - RNA, 23 nt, Homo sapiens
ugaguuguugcuuauacuguugu

SEQ ID NO: 2046984 - RNA, 17 nt, Homo sapiens
uugaaaaaagcugaauu

SEQ ID NO: 2046985 - RNA, 13 nt, Homo sapiens
ccugcgucuuccg

SEQ ID NO: 2046986 - RNA, 17 nt, Homo sapiens
ccuuggagucuguucua

SEQ ID NO: 2046987 - RNA, 15 nt, Homo sapiens
gaagcaaacaagcuu

SEQ ID NO: 2046988 - RNA, 15 nt, Homo sapiens
guuuguuacuuugaa

SEQ ID NO: 2046989 - RNA, 19 nt, Homo sapiens
auccuuuuaaaucuugaua

SEQ ID NO: 2046990 - RNA, 21 nt, Homo sapiens
gaaacugcccaggcaaagugc

SEQ ID NO: 2046991 - RNA, 14 nt, Homo sapiens
ucugcgcaccaagg

SEQ ID NO: 2046992 - RNA, 14 nt, Homo sapiens
cugucugugccaug

SEQ ID NO: 2046993 - RNA, 20 nt, Homo sapiens
uauuugcacaaguucaguga

SEQ ID NO: 2046994 - RNA, 15 nt, Homo sapiens
aaauuuuacauaugu

SEQ ID NO: 2046995 - RNA, 16 nt, Homo sapiens
aaagagacuucuccca

SEQ ID NO: 2046996 - RNA, 16 nt, Homo sapiens
uuuuacucugccuaca

SEQ ID NO: 2046997 - RNA, 22 nt, Homo sapiens
augguguuauuuucugagagac

SEQ ID NO: 2046998 - RNA, 14 nt, Homo sapiens
ucuguauuuuccac

SEQ ID NO: 2046999 - RNA, 16 nt, Homo sapiens
agagauugauggguua

SEQ ID NO: 2047000 - RNA, 15 nt, Homo sapiens
uggccuucaguguac

SEQ ID NO: 2047001 - RNA, 21 nt, Homo sapiens
gcaucccuguguccacugaga

SEQ ID NO: 2047002 - RNA, 12 nt, Homo sapiens
gaaagauaugua

SEQ ID NO: 2047003 - RNA, 22 nt, Homo sapiens
ucuacccacccccaucaccuac

SEQ ID NO: 2047004 - RNA, 13 nt, Homo sapiens
aauuaagcuuaaa

SEQ ID NO: 2047005 - RNA, 14 nt, Homo sapiens
gaaggaggggaccu

SEQ ID NO: 2047006 - RNA, 14 nt, Homo sapiens
cguugcagcacugc

SEQ ID NO: 2047007 - RNA, 21 nt, Homo sapiens
auguagcaaaacgcauggagu

SEQ ID NO: 2047008 - RNA, 17 nt, Homo sapiens
cauauaauuucuuuaaa

SEQ ID NO: 2047009 - RNA, 23 nt, Homo sapiens
agauauggaaacagaagacaaaa

SEQ ID NO: 2047010 - RNA, 20 nt, Homo sapiens
cugugucagggaacauauuu

SEQ ID NO: 2047011 - RNA, 18 nt, Homo sapiens
aggugggagagagugcau

SEQ ID NO: 2047012 - RNA, 14 nt, Homo sapiens
uaacggaccaaagc

SEQ ID NO: 2047013 - RNA, 17 nt, Homo sapiens
aucgcugaugcagacac

SEQ ID NO: 2047014 - RNA, 20 nt, Homo sapiens
gacaacuguggacuccaguu

SEQ ID NO: 2047015 - RNA, 23 nt, Homo sapiens
augauguacaggcagaugaaacc

SEQ ID NO: 2047016 - RNA, 17 nt, Homo sapiens
guucacucuacuuagca

SEQ ID NO: 2047017 - RNA, 14 nt, Homo sapiens
aacagauuugagaa

SEQ ID NO: 2047018 - RNA, 20 nt, Homo sapiens
ucccaaagugcugagauuac

SEQ ID NO: 2047019 - RNA, 23 nt, Homo sapiens
ccucaguuacacaaaggaccuca

SEQ ID NO: 2047020 - RNA, 21 nt, Homo sapiens
aaaaucauuuuauaugucaaa

SEQ ID NO: 2047021 - RNA, 13 nt, Homo sapiens
auagccucugucu

SEQ ID NO: 2047022 - RNA, 13 nt, Homo sapiens
cgaugaaacugga

SEQ ID NO: 2047023 - RNA, 15 nt, Homo sapiens
caacaucaguuuaaa

SEQ ID NO: 2047024 - RNA, 22 nt, Homo sapiens
gcagcuuaggauggcuauguga

SEQ ID NO: 2047025 - RNA, 14 nt, Homo sapiens
ucaucucauuccaa

SEQ ID NO: 2047026 - RNA, 19 nt, Homo sapiens
auucaauuuuaaagacuca

SEQ ID NO: 2047027 - RNA, 14 nt, Homo sapiens
accccccuugccca

SEQ ID NO: 2047028 - RNA, 14 nt, Homo sapiens
acacaccuugacaa

SEQ ID NO: 2047029 - RNA, 18 nt, Homo sapiens
auauccccugugcccugc

SEQ ID NO: 2047030 - RNA, 23 nt, Homo sapiens
ggaacugggccaacucaccugag

SEQ ID NO: 2047031 - RNA, 20 nt, Homo sapiens
uguguagcaaauuucgagca

SEQ ID NO: 2047032 - RNA, 16 nt, Homo sapiens
ucuugacauuccacug

SEQ ID NO: 2047033 - RNA, 22 nt, Homo sapiens
uaagaauagugaaaaauaacaa

SEQ ID NO: 2047034 - RNA, 17 nt, Homo sapiens
ucugcauuaucuaugca

SEQ ID NO: 2047035 - RNA, 15 nt, Homo sapiens
cugcaccaugcugcu

SEQ ID NO: 2047036 - RNA, 21 nt, Homo sapiens
cuuuaagcauugguuauucaa

SEQ ID NO: 2047037 - RNA, 15 nt, Homo sapiens
auugcaaaggguaau

SEQ ID NO: 2047038 - RNA, 18 nt, Homo sapiens
uuucucgggugcauuuga

SEQ ID NO: 2047039 - RNA, 17 nt, Homo sapiens
guuuccuucugacuuaa

SEQ ID NO: 2047040 - RNA, 16 nt, Homo sapiens
agccaaccccugugga

SEQ ID NO: 2047041 - RNA, 23 nt, Homo sapiens
ugagucauuuaaauguguacaau

SEQ ID NO: 2047042 - RNA, 23 nt, Homo sapiens
uacucuuccgauguuugugucac

SEQ ID NO: 2047043 - RNA, 20 nt, Homo sapiens
ucuacccaguagaugccacu

SEQ ID NO: 2047044 - RNA, 20 nt, Homo sapiens
gaaguuuggauaaccuuccu

SEQ ID NO: 2047045 - RNA, 12 nt, Homo sapiens
gggccagggaag

SEQ ID NO: 2047046 - RNA, 20 nt, Homo sapiens
ugacaugaaaauuacaacag

SEQ ID NO: 2047047 - RNA, 14 nt, Homo sapiens
agaagcaugaaguc

SEQ ID NO: 2047048 - RNA, 21 nt, Homo sapiens
uacaaucuuagugaaugggaa

SEQ ID NO: 2047049 - RNA, 21 nt, Homo sapiens
ccugaagauggagccucagga

SEQ ID NO: 2047050 - RNA, 15 nt, Homo sapiens
gccacauuucucugc

SEQ ID NO: 2047051 - RNA, 19 nt, Homo sapiens
uuagucaccugccccagca

SEQ ID NO: 2047052 - RNA, 22 nt, Homo sapiens
agagccuggggaggccagggua

SEQ ID NO: 2047053 - RNA, 23 nt, Homo sapiens
acccugacuccucuuugugcaga

SEQ ID NO: 2047054 - RNA, 13 nt, Homo sapiens
cagaugcuaucac

SEQ ID NO: 2047055 - RNA, 16 nt, Homo sapiens
accaagggcaccugga

SEQ ID NO: 2047056 - RNA, 13 nt, Homo sapiens
gauuuccagugag

SEQ ID NO: 2047057 - RNA, 17 nt, Homo sapiens
aggcauucuaagucaca

SEQ ID NO: 2047058 - RNA, 17 nt, Homo sapiens
ugacuuauuaggacuuu

SEQ ID NO: 2047059 - RNA, 20 nt, Homo sapiens
augcauacuuacagacugga

SEQ ID NO: 2047060 - RNA, 14 nt, Homo sapiens
auuacaauugugag

SEQ ID NO: 2047061 - RNA, 15 nt, Homo sapiens
ucacuacagacgauu

SEQ ID NO: 2047062 - RNA, 16 nt, Homo sapiens
uuuuaucucacaaaua

SEQ ID NO: 2047063 - RNA, 19 nt, Homo sapiens
agaauuuaaaauaacacuu

SEQ ID NO: 2047064 - RNA, 17 nt, Homo sapiens
cggaaccugugagcugc

SEQ ID NO: 2047065 - RNA, 14 nt, Homo sapiens
aaauucugccuuga

SEQ ID NO: 2047066 - RNA, 18 nt, Homo sapiens
ccugcgcaaagggcgggc

SEQ ID NO: 2047067 - RNA, 17 nt, Homo sapiens
ccugggcaacacaguga

SEQ ID NO: 2047068 - RNA, 22 nt, Homo sapiens
uugcucucucucaccaugugac

SEQ ID NO: 2047069 - RNA, 23 nt, Homo sapiens
caacaggcuguucugcacugaaa

SEQ ID NO: 2047070 - RNA, 16 nt, Homo sapiens
caauaaaucaacucca

SEQ ID NO: 2047071 - RNA, 19 nt, Homo sapiens
aucucaauugugcuuugua

SEQ ID NO: 2047072 - RNA, 15 nt, Homo sapiens
cccccagccaugaag

SEQ ID NO: 2047073 - RNA, 15 nt, Homo sapiens
uacugcaucccagcc

SEQ ID NO: 2047074 - RNA, 11 nt, Homo sapiens
aaaaacugaag

SEQ ID NO: 2047075 - RNA, 20 nt, Homo sapiens
ugaaauaaaauuaguuccau

SEQ ID NO: 2047076 - RNA, 21 nt, Homo sapiens
gcaggagaaucacuugcacuc

SEQ ID NO: 2047077 - RNA, 20 nt, Homo sapiens
uggcuucuuaaucuuuucac

SEQ ID NO: 2047078 - RNA, 15 nt, Homo sapiens
ccaggcugggaacuc

SEQ ID NO: 2047079 - RNA, 18 nt, Homo sapiens
ccuucagaaaagacacuu

SEQ ID NO: 2047080 - RNA, 17 nt, Homo sapiens
ccaaaggccaacagcau

SEQ ID NO: 2047081 - RNA, 17 nt, Homo sapiens
aauaaacuucaacacuc

SEQ ID NO: 2047082 - RNA, 16 nt, Homo sapiens
ccuuuccuucacugcc

SEQ ID NO: 2047083 - RNA, 12 nt, Homo sapiens
accuacugcacu

SEQ ID NO: 2047084 - RNA, 12 nt, Homo sapiens
aaagacugccag

SEQ ID NO: 2047085 - RNA, 15 nt, Homo sapiens
uccagcuaacacacu

SEQ ID NO: 2047086 - RNA, 20 nt, Homo sapiens
gccugucugugaccugcauc

SEQ ID NO: 2047087 - RNA, 14 nt, Homo sapiens
cuaaaagauucuuu

SEQ ID NO: 2047088 - RNA, 20 nt, Homo sapiens
uuuuagugacuguaauuaau

SEQ ID NO: 2047089 - RNA, 19 nt, Homo sapiens
guaaucccagcuacucagg

SEQ ID NO: 2047090 - RNA, 17 nt, Homo sapiens
ucacuaaaguauccuga

SEQ ID NO: 2047091 - RNA, 19 nt, Homo sapiens
auauuuauagcaauccaug

SEQ ID NO: 2047092 - RNA, 19 nt, Homo sapiens
cugggugagcucuuccagg

SEQ ID NO: 2047093 - RNA, 16 nt, Homo sapiens
ggcaucggcagcugaa

SEQ ID NO: 2047094 - RNA, 16 nt, Homo sapiens
agcugcaucugauaaa

SEQ ID NO: 2047095 - RNA, 19 nt, Homo sapiens
gccugugcguucccuucag

SEQ ID NO: 2047096 - RNA, 14 nt, Homo sapiens
gacgccaccuuccc

SEQ ID NO: 2047097 - RNA, 16 nt, Homo sapiens
accugugcugaacaua

SEQ ID NO: 2047098 - RNA, 13 nt, Homo sapiens
auugaucccacau

SEQ ID NO: 2047099 - RNA, 16 nt, Homo sapiens
aagcugagauugagca

SEQ ID NO: 2047100 - RNA, 15 nt, Homo sapiens
cuugugcuccaguca

SEQ ID NO: 2047101 - RNA, 21 nt, Homo sapiens
aagauacaguaccccucuagc

SEQ ID NO: 2047102 - RNA, 14 nt, Homo sapiens
cgaggaaacucaga

SEQ ID NO: 2047103 - RNA, 17 nt, Homo sapiens
cacugggagaggugcca

SEQ ID NO: 2047104 - RNA, 15 nt, Homo sapiens
agacucccaugaagc

SEQ ID NO: 2047105 - RNA, 15 nt, Homo sapiens
ccagccagugccauu

SEQ ID NO: 2047106 - RNA, 11 nt, Homo sapiens
uccagcauuug

SEQ ID NO: 2047107 - RNA, 14 nt, Homo sapiens
acugggaucacagg

SEQ ID NO: 2047108 - RNA, 18 nt, Homo sapiens
cacguuugauuucuuccu

SEQ ID NO: 2047109 - RNA, 15 nt, Homo sapiens
gcuguacccuugaga

SEQ ID NO: 2047110 - RNA, 21 nt, Homo sapiens
guucuuuuuuguuacagcuau

SEQ ID NO: 2047111 - RNA, 18 nt, Homo sapiens
cucaucugaaauguuaca

SEQ ID NO: 2047112 - RNA, 19 nt, Homo sapiens
aggcauccaggccagggcu

SEQ ID NO: 2047113 - RNA, 20 nt, Homo sapiens
cgugcccaucaagugcaguc

SEQ ID NO: 2047114 - RNA, 18 nt, Homo sapiens
ucacuaaacucugaauaa

SEQ ID NO: 2047115 - RNA, 13 nt, Homo sapiens
cuugccaaccugu

SEQ ID NO: 2047116 - RNA, 17 nt, Homo sapiens
gagguguggauaaggcu

SEQ ID NO: 2047117 - RNA, 20 nt, Homo sapiens
uauuuuaggcaaaguccaua

SEQ ID NO: 2047118 - RNA, 13 nt, Homo sapiens
uuuuuauuucuga

SEQ ID NO: 2047119 - RNA, 13 nt, Homo sapiens
cugaagagccuga

SEQ ID NO: 2047120 - RNA, 23 nt, Homo sapiens
aaaugguugucaccucucucuga

SEQ ID NO: 2047121 - RNA, 20 nt, Homo sapiens
gagguaggcacaaauacauu

SEQ ID NO: 2047122 - RNA, 19 nt, Homo sapiens
uguaauuauuugaacauug

SEQ ID NO: 2047123 - RNA, 19 nt, Homo sapiens
gccaugcugcuuugcacac

SEQ ID NO: 2047124 - RNA, 15 nt, Homo sapiens
auucaaguuuaguuu

SEQ ID NO: 2047125 - RNA, 24 nt, Homo sapiens
aguucucccuguacaguguuacca

SEQ ID NO: 2047126 - RNA, 17 nt, Homo sapiens
auauuucaucaugauaa

SEQ ID NO: 2047127 - RNA, 14 nt, Homo sapiens
ugcugaugggccag

SEQ ID NO: 2047128 - RNA, 22 nt, Homo sapiens
aauaauauaucaaauaacucaa

SEQ ID NO: 2047129 - RNA, 22 nt, Homo sapiens
acauguuccuuuaagguacuga

SEQ ID NO: 2047130 - RNA, 16 nt, Homo sapiens
accuuaggcagggaag

SEQ ID NO: 2047131 - RNA, 19 nt, Homo sapiens
augacuugggcacccccag

SEQ ID NO: 2047132 - RNA, 16 nt, Homo sapiens
uucauagcaaugucuc

SEQ ID NO: 2047133 - RNA, 23 nt, Homo sapiens
ugauggacaaacaccaaucucuc

SEQ ID NO: 2047134 - RNA, 12 nt, Homo sapiens
cuuuguguaaag

SEQ ID NO: 2047135 - RNA, 16 nt, Homo sapiens
acaccugcacaccguc

SEQ ID NO: 2047136 - RNA, 20 nt, Homo sapiens
gugauggagagggauggaaa

SEQ ID NO: 2047137 - RNA, 14 nt, Homo sapiens
ggccccucacccac

SEQ ID NO: 2047138 - RNA, 14 nt, Homo sapiens
aggauguucuagca

SEQ ID NO: 2047139 - RNA, 21 nt, Homo sapiens
aggguucaccaggucagggag

SEQ ID NO: 2047140 - RNA, 12 nt, Homo sapiens
cgguucccugaa

SEQ ID NO: 2047141 - RNA, 12 nt, Homo sapiens
uaguuccccaaa

SEQ ID NO: 2047142 - RNA, 20 nt, Homo sapiens
uugauaacuaugaaaguaac

SEQ ID NO: 2047143 - RNA, 21 nt, Homo sapiens
ccuaccucacagagugcauug

SEQ ID NO: 2047144 - RNA, 18 nt, Homo sapiens
uagacauuucuccaaaga

SEQ ID NO: 2047145 - RNA, 19 nt, Homo sapiens
cuacauauuuuaauaauaa

SEQ ID NO: 2047146 - RNA, 22 nt, Homo sapiens
auccuugccaauagugucaucc

SEQ ID NO: 2047147 - RNA, 21 nt, Homo sapiens
gaggcagcuucaagugccuuu

SEQ ID NO: 2047148 - RNA, 19 nt, Homo sapiens
uguccaucuuugugguuua

SEQ ID NO: 2047149 - RNA, 16 nt, Homo sapiens
gcucucaaaugugacc

SEQ ID NO: 2047150 - RNA, 21 nt, Homo sapiens
cuuuucucaccugucaucuca

SEQ ID NO: 2047151 - RNA, 23 nt, Homo sapiens
acccagggucccagccuggccac

SEQ ID NO: 2047152 - RNA, 19 nt, Homo sapiens
guauacauguguacauaua

SEQ ID NO: 2047153 - RNA, 22 nt, Homo sapiens
ggucucccaaagugcugggauu

SEQ ID NO: 2047154 - RNA, 22 nt, Homo sapiens
ucuucaccccuacacugugaag

SEQ ID NO: 2047155 - RNA, 23 nt, Homo sapiens
acauuuuuaaagguacacuggua

SEQ ID NO: 2047156 - RNA, 15 nt, Homo sapiens
cuggcaaaucucugu

SEQ ID NO: 2047157 - RNA, 13 nt, Homo sapiens
cucggaggcugcc

SEQ ID NO: 2047158 - RNA, 19 nt, Homo sapiens
acgcaagccucagccacuc

SEQ ID NO: 2047159 - RNA, 21 nt, Homo sapiens
ugcccgcugccugcacuggaa

SEQ ID NO: 2047160 - RNA, 14 nt, Homo sapiens
uuuauaauuacaau

SEQ ID NO: 2047161 - RNA, 18 nt, Homo sapiens
cuuccucaucaugaaaac

SEQ ID NO: 2047162 - RNA, 21 nt, Homo sapiens
caggguccaggaauggugcuu

SEQ ID NO: 2047163 - RNA, 20 nt, Homo sapiens
uuaggagacgcugcacuuga

SEQ ID NO: 2047164 - RNA, 18 nt, Homo sapiens
ggaccucagugacucaga

SEQ ID NO: 2047165 - RNA, 15 nt, Homo sapiens
uaaguaugauugaca

SEQ ID NO: 2047166 - RNA, 14 nt, Homo sapiens
ggccacacuaccca

SEQ ID NO: 2047167 - RNA, 14 nt, Homo sapiens
uucauaacaucgaa

SEQ ID NO: 2047168 - RNA, 14 nt, Homo sapiens
uugauaacauggaa

SEQ ID NO: 2047169 - RNA, 14 nt, Homo sapiens
aagauaacuaggaa

SEQ ID NO: 2047170 - RNA, 14 nt, Homo sapiens
gagcccccuugaca

SEQ ID NO: 2047171 - RNA, 14 nt, Homo sapiens
cccccagcuaagaa

SEQ ID NO: 2047172 - RNA, 18 nt, Homo sapiens
uuacaaaaaaauacaaaa

SEQ ID NO: 2047173 - RNA, 15 nt, Homo sapiens
agccugagucagggc

SEQ ID NO: 2047174 - RNA, 20 nt, Homo sapiens
uaugguaaaaguuacuuauu

SEQ ID NO: 2047175 - RNA, 18 nt, Homo sapiens
ccaccaauugagcaagau

SEQ ID NO: 2047176 - RNA, 13 nt, Homo sapiens
auguacacccacc

SEQ ID NO: 2047177 - RNA, 12 nt, Homo sapiens
ucuguguguuga

SEQ ID NO: 2047178 - RNA, 18 nt, Homo sapiens
auauauuuuucugagauu

SEQ ID NO: 2047179 - RNA, 16 nt, Homo sapiens
acgaagaaagacuccu

SEQ ID NO: 2047180 - RNA, 13 nt, Homo sapiens
uaggacacagugu

SEQ ID NO: 2047181 - RNA, 17 nt, Homo sapiens
uggcccuggacaagcca

SEQ ID NO: 2047182 - RNA, 20 nt, Homo sapiens
uaguguuucguuaagcagua

SEQ ID NO: 2047183 - RNA, 19 nt, Homo sapiens
cugaaaguccugcuuuccu

SEQ ID NO: 2047184 - RNA, 19 nt, Homo sapiens
ccagagcaggaaagaugau

SEQ ID NO: 2047185 - RNA, 19 nt, Homo sapiens
aggggccuuugucuuguca

SEQ ID NO: 2047186 - RNA, 14 nt, Homo sapiens
agacgacuguggug

SEQ ID NO: 2047187 - RNA, 14 nt, Homo sapiens
gauguagugccucu

SEQ ID NO: 2047188 - RNA, 23 nt, Homo sapiens
aggaacacccccaugacauugca

SEQ ID NO: 2047189 - RNA, 18 nt, Homo sapiens
gcagaaaugccgggcaca

SEQ ID NO: 2047190 - RNA, 14 nt, Homo sapiens
uguauuuucuucca

SEQ ID NO: 2047191 - RNA, 18 nt, Homo sapiens
aucucugaauuugagaua

SEQ ID NO: 2047192 - RNA, 19 nt, Homo sapiens
aagacccccagcacuuggg

SEQ ID NO: 2047193 - RNA, 22 nt, Homo sapiens
uauuaucgcauacagauauucu

SEQ ID NO: 2047194 - RNA, 20 nt, Homo sapiens
agaaugaacacaaucacguu

SEQ ID NO: 2047195 - RNA, 20 nt, Homo sapiens
ucuucuggacuuggucuuga

SEQ ID NO: 2047196 - RNA, 16 nt, Homo sapiens
cugagaaucuaggcca

SEQ ID NO: 2047197 - RNA, 13 nt, Homo sapiens
gaaccgcacagcu

SEQ ID NO: 2047198 - RNA, 14 nt, Homo sapiens
guggcaacugagau

SEQ ID NO: 2047199 - RNA, 13 nt, Homo sapiens
cagcacuuugcaa

SEQ ID NO: 2047200 - RNA, 22 nt, Homo sapiens
augcgcugaucguuucuuccag

SEQ ID NO: 2047201 - RNA, 17 nt, Homo sapiens
cuuucggggugcuccug

SEQ ID NO: 2047202 - RNA, 20 nt, Homo sapiens
cggccuagugugccaagaau

SEQ ID NO: 2047203 - RNA, 18 nt, Homo sapiens
acuauguugcccaggcug

SEQ ID NO: 2047204 - RNA, 15 nt, Homo sapiens
caaucugcagccauu

SEQ ID NO: 2047205 - RNA, 18 nt, Homo sapiens
ugguucaagcgauucucu

SEQ ID NO: 2047206 - RNA, 15 nt, Homo sapiens
ccaacaccaucacag

SEQ ID NO: 2047207 - RNA, 16 nt, Homo sapiens
aaaagguccuugccuc

SEQ ID NO: 2047208 - RNA, 14 nt, Homo sapiens
gaggcggaucuuug

SEQ ID NO: 2047209 - RNA, 23 nt, Homo sapiens
ugcugacugaggccugcuucccc

SEQ ID NO: 2047210 - RNA, 17 nt, Homo sapiens
uuguuucuaugcagaug

SEQ ID NO: 2047211 - RNA, 21 nt, Homo sapiens
agaauaaaauuccuaucucau

SEQ ID NO: 2047212 - RNA, 14 nt, Homo sapiens
ucagaacacacaga

SEQ ID NO: 2047213 - RNA, 18 nt, Homo sapiens
uuggaagcugucauaaaa

SEQ ID NO: 2047214 - RNA, 19 nt, Homo sapiens
acucugcgguggugccaga

SEQ ID NO: 2047215 - RNA, 22 nt, Homo sapiens
uuaacagagcaaauuugaauaa

SEQ ID NO: 2047216 - RNA, 18 nt, Homo sapiens
ucuuuuuuaaacuguaaa

SEQ ID NO: 2047217 - RNA, 14 nt, Homo sapiens
uccucccucugauu

SEQ ID NO: 2047218 - RNA, 15 nt, Homo sapiens
cuagcgucaguauuu

SEQ ID NO: 2047219 - RNA, 14 nt, Homo sapiens
uguaaauuaacuca

SEQ ID NO: 2047220 - RNA, 14 nt, Homo sapiens
auuuaugagucuca

SEQ ID NO: 2047221 - RNA, 17 nt, Homo sapiens
gaaaugcugcaggauua

SEQ ID NO: 2047222 - RNA, 15 nt, Homo sapiens
aaacaaucacacuca

SEQ ID NO: 2047223 - RNA, 15 nt, Homo sapiens
guccagaauucacuu

SEQ ID NO: 2047224 - RNA, 22 nt, Homo sapiens
gcuccacaccuccaaugcugcc

SEQ ID NO: 2047225 - RNA, 18 nt, Homo sapiens
gcuggacuucuaccugcc

SEQ ID NO: 2047226 - RNA, 17 nt, Homo sapiens
agguuaauuccauucaa

SEQ ID NO: 2047227 - RNA, 22 nt, Homo sapiens
uccuggucugaacucccgccac

SEQ ID NO: 2047228 - RNA, 13 nt, Homo sapiens
uuucaaagcacaa

SEQ ID NO: 2047229 - RNA, 18 nt, Homo sapiens
ugcauaaagguucugggg

SEQ ID NO: 2047230 - RNA, 18 nt, Homo sapiens
cccagcccuccugcucca

SEQ ID NO: 2047231 - RNA, 21 nt, Homo sapiens
aacccacaguguuaccugacu

SEQ ID NO: 2047232 - RNA, 16 nt, Homo sapiens
agccaagaccaucucu

SEQ ID NO: 2047233 - RNA, 18 nt, Homo sapiens
aagauaaauucaugcacu

SEQ ID NO: 2047234 - RNA, 20 nt, Homo sapiens
ccuggguggggcagggccug

SEQ ID NO: 2047235 - RNA, 15 nt, Homo sapiens
augcaauacauacca

SEQ ID NO: 2047236 - RNA, 15 nt, Homo sapiens
caaguugcaucagaa

SEQ ID NO: 2047237 - RNA, 17 nt, Homo sapiens
gaggaagcaagugacaa

SEQ ID NO: 2047238 - RNA, 16 nt, Homo sapiens
uuucacaacauuugca

SEQ ID NO: 2047239 - RNA, 19 nt, Homo sapiens
caacuggguggcacugcug

SEQ ID NO: 2047240 - RNA, 15 nt, Homo sapiens
caugcccugccaagc

SEQ ID NO: 2047241 - RNA, 15 nt, Homo sapiens
ggcuggggccggggc

SEQ ID NO: 2047242 - RNA, 23 nt, Homo sapiens
accgaaggugacagccgucccaa

SEQ ID NO: 2047243 - RNA, 17 nt, Homo sapiens
uucccaaucaucuggcu

SEQ ID NO: 2047244 - RNA, 11 nt, Homo sapiens
uucacagugca

SEQ ID NO: 2047245 - RNA, 23 nt, Homo sapiens
gcuuguaauaaauacugcagcuu

SEQ ID NO: 2047246 - RNA, 16 nt, Homo sapiens
gaggucccugccagug

SEQ ID NO: 2047247 - RNA, 19 nt, Homo sapiens
uccaaauaacaaguaccaa

SEQ ID NO: 2047248 - RNA, 17 nt, Homo sapiens
aaguaucacacuguaua

SEQ ID NO: 2047249 - RNA, 21 nt, Homo sapiens
cuaaacaccacgucacuucau

SEQ ID NO: 2047250 - RNA, 17 nt, Homo sapiens
cugggaccucccacugc

SEQ ID NO: 2047251 - RNA, 15 nt, Homo sapiens
ugcuauuucccaagc

SEQ ID NO: 2047252 - RNA, 12 nt, Homo sapiens
ccaagagaccag

SEQ ID NO: 2047253 - RNA, 21 nt, Homo sapiens
uccagguuauugcaauaaagu

SEQ ID NO: 2047254 - RNA, 23 nt, Homo sapiens
aucacacgucuggcuucacagau

SEQ ID NO: 2047255 - RNA, 20 nt, Homo sapiens
ugaaaucccugccucaggcc

SEQ ID NO: 2047256 - RNA, 23 nt, Homo sapiens
ucuaaaugaagugcaaauuugau

SEQ ID NO: 2047257 - RNA, 21 nt, Homo sapiens
ugacaugggggugccaggugc

SEQ ID NO: 2047258 - RNA, 17 nt, Homo sapiens
uaagauauuuaguaaua

SEQ ID NO: 2047259 - RNA, 15 nt, Homo sapiens
gcuaggcggagcuca

SEQ ID NO: 2047260 - RNA, 20 nt, Homo sapiens
ccucucagaagguaggggaa

SEQ ID NO: 2047261 - RNA, 17 nt, Homo sapiens
uuuauuuguauuugcca

SEQ ID NO: 2047262 - RNA, 18 nt, Homo sapiens
uggcaguguggacaugag

SEQ ID NO: 2047263 - RNA, 13 nt, Homo sapiens
aaaagagaauaau

SEQ ID NO: 2047264 - RNA, 22 nt, Homo sapiens
caagaccucacacacacaaaaa

SEQ ID NO: 2047265 - RNA, 14 nt, Homo sapiens
uaguuaacacugaa

SEQ ID NO: 2047266 - RNA, 16 nt, Homo sapiens
cacugaguugcacaua

SEQ ID NO: 2047267 - RNA, 14 nt, Homo sapiens
acagaaaaucacug

SEQ ID NO: 2047268 - RNA, 17 nt, Homo sapiens
uaaaauugaaaguaaua

SEQ ID NO: 2047269 - RNA, 16 nt, Homo sapiens
guccuucacauuuacu

SEQ ID NO: 2047270 - RNA, 16 nt, Homo sapiens
gacuuucucuucuaca

SEQ ID NO: 2047271 - RNA, 16 nt, Homo sapiens
auuauuccccuaggcu

SEQ ID NO: 2047272 - RNA, 22 nt, Homo sapiens
caggcugaccaggcgcccggga

SEQ ID NO: 2047273 - RNA, 22 nt, Homo sapiens
aggagaaaacaauuccuuagaa

SEQ ID NO: 2047274 - RNA, 15 nt, Homo sapiens
cagcacucuuaucua

SEQ ID NO: 2047275 - RNA, 17 nt, Homo sapiens
guuuuaacuuccagugg

SEQ ID NO: 2047276 - RNA, 18 nt, Homo sapiens
ccucaugucuucucacaa

SEQ ID NO: 2047277 - RNA, 22 nt, Homo sapiens
uaucaaaacucuaucaaaugug

SEQ ID NO: 2047278 - RNA, 13 nt, Homo sapiens
acacaagugcaca

SEQ ID NO: 2047279 - RNA, 15 nt, Homo sapiens
cuguugacuggcugu

SEQ ID NO: 2047280 - RNA, 12 nt, Homo sapiens
ggaugucucuca

SEQ ID NO: 2047281 - RNA, 17 nt, Homo sapiens
cucaaacggcaacauuc

SEQ ID NO: 2047282 - RNA, 21 nt, Homo sapiens
ccaggggcugcgucugacauc

SEQ ID NO: 2047283 - RNA, 14 nt, Homo sapiens
gcuucucugaggaa

SEQ ID NO: 2047284 - RNA, 14 nt, Homo sapiens
aaucaugaagugau

SEQ ID NO: 2047285 - RNA, 22 nt, Homo sapiens
ucucacaagauggaaaucacau

SEQ ID NO: 2047286 - RNA, 19 nt, Homo sapiens
uacuugauauaauuacuua

SEQ ID NO: 2047287 - RNA, 16 nt, Homo sapiens
cuuuaaaaugcgaaau

SEQ ID NO: 2047288 - RNA, 16 nt, Homo sapiens
acccccaucuuuacaa

SEQ ID NO: 2047289 - RNA, 19 nt, Homo sapiens
aaguauaucuuuaauucug

SEQ ID NO: 2047290 - RNA, 21 nt, Homo sapiens
uucauagugauagagugcagu

SEQ ID NO: 2047291 - RNA, 18 nt, Homo sapiens
ugaacggcugaauaugaa

SEQ ID NO: 2047292 - RNA, 21 nt, Homo sapiens
uagaggacagcaacuggugau

SEQ ID NO: 2047293 - RNA, 19 nt, Homo sapiens
gacuacuuggaacuaggcu

SEQ ID NO: 2047294 - RNA, 21 nt, Homo sapiens
gcagacuggugagcagacugg

SEQ ID NO: 2047295 - RNA, 19 nt, Homo sapiens
cagccuccugaguagcugg

SEQ ID NO: 2047296 - RNA, 14 nt, Homo sapiens
uauuuaauucuuau

SEQ ID NO: 2047297 - RNA, 17 nt, Homo sapiens
cugcacugccagcaucu

SEQ ID NO: 2047298 - RNA, 15 nt, Homo sapiens
uagagaaauggauuc

SEQ ID NO: 2047299 - RNA, 23 nt, Homo sapiens
aaaacugaucaaaaauaaacuag

SEQ ID NO: 2047300 - RNA, 17 nt, Homo sapiens
ccaaucuccaucuguca

SEQ ID NO: 2047301 - RNA, 21 nt, Homo sapiens
caaggugauuucagacugcag

SEQ ID NO: 2047302 - RNA, 23 nt, Homo sapiens
acguggauuguauuuaagacaua

SEQ ID NO: 2047303 - RNA, 21 nt, Homo sapiens
aggcacccgcccuuuccuugc

SEQ ID NO: 2047304 - RNA, 17 nt, Homo sapiens
ggcuccaggagccucau

SEQ ID NO: 2047305 - RNA, 14 nt, Homo sapiens
ggccauucagagac

SEQ ID NO: 2047306 - RNA, 19 nt, Homo sapiens
acccugaggugagcaucau

SEQ ID NO: 2047307 - RNA, 21 nt, Homo sapiens
gcuaucuggccugagacaaca

SEQ ID NO: 2047308 - RNA, 14 nt, Homo sapiens
ucucuuuugagcua

SEQ ID NO: 2047309 - RNA, 20 nt, Homo sapiens
auagagucaaccaccacaga

SEQ ID NO: 2047310 - RNA, 20 nt, Homo sapiens
gcucaggugucccugcacuu

SEQ ID NO: 2047311 - RNA, 13 nt, Homo sapiens
gucauggacugua

SEQ ID NO: 2047312 - RNA, 22 nt, Homo sapiens
ucuugaauuuuuuucugcacag

SEQ ID NO: 2047313 - RNA, 24 nt, Homo sapiens
ugccaaauaucuugauccuaugag

SEQ ID NO: 2047314 - RNA, 17 nt, Homo sapiens
caaaaagccaacaaacc

SEQ ID NO: 2047315 - RNA, 16 nt, Homo sapiens
uauagaucagccagug

SEQ ID NO: 2047316 - RNA, 18 nt, Homo sapiens
caaguagcugggauuaca

SEQ ID NO: 2047317 - RNA, 19 nt, Homo sapiens
ucuguuugaucacugugaa

SEQ ID NO: 2047318 - RNA, 19 nt, Homo sapiens
gcaucagagagacuguuau

SEQ ID NO: 2047319 - RNA, 19 nt, Homo sapiens
cagcuuagaaugcaucuca

SEQ ID NO: 2047320 - RNA, 17 nt, Homo sapiens
caguaaacuuucucugc

SEQ ID NO: 2047321 - RNA, 17 nt, Homo sapiens
aacugcauuccuucccc

SEQ ID NO: 2047322 - RNA, 15 nt, Homo sapiens
cuguugcauuuacuu

SEQ ID NO: 2047323 - RNA, 18 nt, Homo sapiens
cuuuuggcauuuuacugu

SEQ ID NO: 2047324 - RNA, 17 nt, Homo sapiens
ccgaggacaguggcaga

SEQ ID NO: 2047325 - RNA, 14 nt, Homo sapiens
cacucugaaacuga

SEQ ID NO: 2047326 - RNA, 15 nt, Homo sapiens
aucacuggugcuaua

SEQ ID NO: 2047327 - RNA, 19 nt, Homo sapiens
ggaaacuaguguacauuuc

SEQ ID NO: 2047328 - RNA, 16 nt, Homo sapiens
gccugcucccuagcca

SEQ ID NO: 2047329 - RNA, 20 nt, Homo sapiens
auuccuguugcugucuucag

SEQ ID NO: 2047330 - RNA, 22 nt, Homo sapiens
caugacagucagcaacaugaua

SEQ ID NO: 2047331 - RNA, 17 nt, Homo sapiens
uguccagcauggaugaa

SEQ ID NO: 2047332 - RNA, 13 nt, Homo sapiens
gacugcagggaca

SEQ ID NO: 2047333 - RNA, 19 nt, Homo sapiens
uaaucaagaaauaaccaug

SEQ ID NO: 2047334 - RNA, 22 nt, Homo sapiens
aucucuuaaauuggguucauga

SEQ ID NO: 2047335 - RNA, 14 nt, Homo sapiens
aucuguacuaucua

SEQ ID NO: 2047336 - RNA, 17 nt, Homo sapiens
cuagaaaugcagcaucu

SEQ ID NO: 2047337 - RNA, 16 nt, Homo sapiens
ugcagauuccucagau

SEQ ID NO: 2047338 - RNA, 15 nt, Homo sapiens
cuguggccaugaccc

SEQ ID NO: 2047339 - RNA, 17 nt, Homo sapiens
guacauaggcagcacua

SEQ ID NO: 2047340 - RNA, 17 nt, Homo sapiens
acugaggggguuggggu

SEQ ID NO: 2047341 - RNA, 20 nt, Homo sapiens
aagaucuuuccaaauaccca

SEQ ID NO: 2047342 - RNA, 16 nt, Homo sapiens
gacaaauguugaccuu

SEQ ID NO: 2047343 - RNA, 16 nt, Homo sapiens
acugcuacugaccauc

SEQ ID NO: 2047344 - RNA, 21 nt, Homo sapiens
auagaaacaccaguaccugaa

SEQ ID NO: 2047345 - RNA, 15 nt, Homo sapiens
aggcuucccuacaca

SEQ ID NO: 2047346 - RNA, 14 nt, Homo sapiens
auauauuaagugac

SEQ ID NO: 2047347 - RNA, 16 nt, Homo sapiens
agccugacuguguuca

SEQ ID NO: 2047348 - RNA, 22 nt, Homo sapiens
uggauauucuccucggacugug

SEQ ID NO: 2047349 - RNA, 19 nt, Homo sapiens
cuugagagcucagccugcc

SEQ ID NO: 2047350 - RNA, 12 nt, Homo sapiens
cugggcacaauc

SEQ ID NO: 2047351 - RNA, 16 nt, Homo sapiens
aaaugccuccauggca

SEQ ID NO: 2047352 - RNA, 17 nt, Homo sapiens
ccaagugccuaugcaaa

SEQ ID NO: 2047353 - RNA, 15 nt, Homo sapiens
cuuccagccuccuuu

SEQ ID NO: 2047354 - RNA, 21 nt, Homo sapiens
uugcuuuauccagcagucaau

SEQ ID NO: 2047355 - RNA, 12 nt, Homo sapiens
agggcacucugu

SEQ ID NO: 2047356 - RNA, 12 nt, Homo sapiens
aggucacucugg

SEQ ID NO: 2047357 - RNA, 16 nt, Homo sapiens
aaaacaaguacugguu

SEQ ID NO: 2047358 - RNA, 19 nt, Homo sapiens
gaagcgucucccuuggcca

SEQ ID NO: 2047359 - RNA, 16 nt, Homo sapiens
ugugaauuauugacac

SEQ ID NO: 2047360 - RNA, 19 nt, Homo sapiens
caaccuaaugcucucaggg

SEQ ID NO: 2047361 - RNA, 22 nt, Homo sapiens
aagaugaaucauuuaauaccgu

SEQ ID NO: 2047362 - RNA, 20 nt, Homo sapiens
aaauaaaggcaaaguggaau

SEQ ID NO: 2047363 - RNA, 15 nt, Homo sapiens
gauccagaauggagu

SEQ ID NO: 2047364 - RNA, 15 nt, Homo sapiens
cuuugcucccugcaa

SEQ ID NO: 2047365 - RNA, 18 nt, Homo sapiens
ugaaaaaaaaaacuauca

SEQ ID NO: 2047366 - RNA, 18 nt, Homo sapiens
aauuauuuuguucauaca

SEQ ID NO: 2047367 - RNA, 12 nt, Homo sapiens
uggucuuugaau

SEQ ID NO: 2047368 - RNA, 23 nt, Homo sapiens
aggagucugccuccaugcugcag

SEQ ID NO: 2047369 - RNA, 14 nt, Homo sapiens
augagggcugagau

SEQ ID NO: 2047370 - RNA, 18 nt, Homo sapiens
cuuugcccccuugcccau

SEQ ID NO: 2047371 - RNA, 16 nt, Homo sapiens
acuuagauacuaauaa

SEQ ID NO: 2047372 - RNA, 14 nt, Homo sapiens
agccugcucccuag

SEQ ID NO: 2047373 - RNA, 12 nt, Homo sapiens
uccaaagcuuuc

SEQ ID NO: 2047374 - RNA, 19 nt, Homo sapiens
ugucugccuggagugcugu

SEQ ID NO: 2047375 - RNA, 13 nt, Homo sapiens
cuuaaaucacuga

SEQ ID NO: 2047376 - RNA, 18 nt, Homo sapiens
cacaccauuuuguaaaug

SEQ ID NO: 2047377 - RNA, 15 nt, Homo sapiens
gucuccaugcuggau

SEQ ID NO: 2047378 - RNA, 22 nt, Homo sapiens
ucucacuuaccccgagaccuca

SEQ ID NO: 2047379 - RNA, 23 nt, Homo sapiens
agggcgaggggccuagagcucua

SEQ ID NO: 2047380 - RNA, 13 nt, Homo sapiens
ccuugaugacugc

SEQ ID NO: 2047381 - RNA, 14 nt, Homo sapiens
gccugcacuuugau

SEQ ID NO: 2047382 - RNA, 16 nt, Homo sapiens
uaaucuguaagcauaa

SEQ ID NO: 2047383 - RNA, 16 nt, Homo sapiens
auuuccuaaucaaaaa

SEQ ID NO: 2047384 - RNA, 20 nt, Homo sapiens
uuuaaaauaaauuccuacaa

SEQ ID NO: 2047385 - RNA, 16 nt, Homo sapiens
aggaagagcaggacuc

SEQ ID NO: 2047386 - RNA, 22 nt, Homo sapiens
cacccuaucccuguacagagua

SEQ ID NO: 2047387 - RNA, 22 nt, Homo sapiens
ccaaucuccggugugagcccac

SEQ ID NO: 2047388 - RNA, 20 nt, Homo sapiens
agaaacacggcugauaucuu

SEQ ID NO: 2047389 - RNA, 12 nt, Homo sapiens
augggccccaga

SEQ ID NO: 2047390 - RNA, 19 nt, Homo sapiens
uuuccucauaaacauuuga

SEQ ID NO: 2047391 - RNA, 14 nt, Homo sapiens
acucuuccuggaau

SEQ ID NO: 2047392 - RNA, 20 nt, Homo sapiens
ccuucucucaccuccuaaag

SEQ ID NO: 2047393 - RNA, 16 nt, Homo sapiens
uuccuacagauaguca

SEQ ID NO: 2047394 - RNA, 22 nt, Homo sapiens
gcacaugugguuuuuugguguu

SEQ ID NO: 2047395 - RNA, 16 nt, Homo sapiens
cucaggaauucagugc

SEQ ID NO: 2047396 - RNA, 16 nt, Homo sapiens
caaguugcuaagugaa

SEQ ID NO: 2047397 - RNA, 16 nt, Homo sapiens
aauaaaaucauguagu

SEQ ID NO: 2047398 - RNA, 16 nt, Homo sapiens
ccuaagggacugugag

SEQ ID NO: 2047399 - RNA, 18 nt, Homo sapiens
cucaucaucagagccuuu

SEQ ID NO: 2047400 - RNA, 15 nt, Homo sapiens
accaccgugucauga

SEQ ID NO: 2047401 - RNA, 17 nt, Homo sapiens
ucccagagugcugggau

SEQ ID NO: 2047402 - RNA, 15 nt, Homo sapiens
cagcuucacucgaca

SEQ ID NO: 2047403 - RNA, 18 nt, Homo sapiens
cuuaauauuaaauauaug

SEQ ID NO: 2047404 - RNA, 12 nt, Homo sapiens
ugggcagaggaa

SEQ ID NO: 2047405 - RNA, 12 nt, Homo sapiens
aaaaacaauuau

SEQ ID NO: 2047406 - RNA, 23 nt, Homo sapiens
gucucuucuuuagaacagggaaa

SEQ ID NO: 2047407 - RNA, 16 nt, Homo sapiens
gccacgaggugcagua

SEQ ID NO: 2047408 - RNA, 16 nt, Homo sapiens
ugcccaaaaugugaag

SEQ ID NO: 2047409 - RNA, 16 nt, Homo sapiens
gugcaagagacagagc

SEQ ID NO: 2047410 - RNA, 16 nt, Homo sapiens
cugaccaaaacaaaca

SEQ ID NO: 2047411 - RNA, 15 nt, Homo sapiens
ggccucucucaggag

SEQ ID NO: 2047412 - RNA, 23 nt, Homo sapiens
uuccaacaccacagacacacaca

SEQ ID NO: 2047413 - RNA, 18 nt, Homo sapiens
agcacgggggccaaggau

SEQ ID NO: 2047414 - RNA, 19 nt, Homo sapiens
cugugccaggacugugacu

SEQ ID NO: 2047415 - RNA, 23 nt, Homo sapiens
guaaaaugcaccaaucagcagga

SEQ ID NO: 2047416 - RNA, 18 nt, Homo sapiens
aagucucuauuuaaauuc

SEQ ID NO: 2047417 - RNA, 17 nt, Homo sapiens
auuugagaguucacaga

SEQ ID NO: 2047418 - RNA, 21 nt, Homo sapiens
ggcacauaggcugguggccuu

SEQ ID NO: 2047419 - RNA, 12 nt, Homo sapiens
aauaaugugcaa

SEQ ID NO: 2047420 - RNA, 17 nt, Homo sapiens
cuacuaccuagggcacu

SEQ ID NO: 2047421 - RNA, 22 nt, Homo sapiens
gcuuucuuuaaaguucuucuaa

SEQ ID NO: 2047422 - RNA, 19 nt, Homo sapiens
uuuuuauaauauucauaca

SEQ ID NO: 2047423 - RNA, 18 nt, Homo sapiens
agagcaagcgucugggca

SEQ ID NO: 2047424 - RNA, 18 nt, Homo sapiens
uccugcuuaaucuucaaa

SEQ ID NO: 2047425 - RNA, 15 nt, Homo sapiens
ccaagucaguucucu

SEQ ID NO: 2047426 - RNA, 14 nt, Homo sapiens
gcccggcugugauu

SEQ ID NO: 2047427 - RNA, 14 nt, Homo sapiens
gcaauuccucugaa

SEQ ID NO: 2047428 - RNA, 20 nt, Homo sapiens
cuacuggggaggcugaggca

SEQ ID NO: 2047429 - RNA, 20 nt, Homo sapiens
uuccagugucugucauuuca

SEQ ID NO: 2047430 - RNA, 14 nt, Homo sapiens
aaugaauaaauccu

SEQ ID NO: 2047431 - RNA, 19 nt, Homo sapiens
ccaacugcucucaaaaugu

SEQ ID NO: 2047432 - RNA, 19 nt, Homo sapiens
auugaaauguuugcauaaa

SEQ ID NO: 2047433 - RNA, 18 nt, Homo sapiens
ccacagccaggccgagag

SEQ ID NO: 2047434 - RNA, 16 nt, Homo sapiens
agagguuaaugcaggg

SEQ ID NO: 2047435 - RNA, 20 nt, Homo sapiens
uuuaaauaaaguuacuugaa

SEQ ID NO: 2047436 - RNA, 20 nt, Homo sapiens
gaguccauggugucaugcca

SEQ ID NO: 2047437 - RNA, 21 nt, Homo sapiens
gauggcacuguccagggccca

SEQ ID NO: 2047438 - RNA, 13 nt, Homo sapiens
ugaaggggccaug

SEQ ID NO: 2047439 - RNA, 17 nt, Homo sapiens
cagagucagcugcugac

SEQ ID NO: 2047440 - RNA, 17 nt, Homo sapiens
gcaaccucccauuuuag

SEQ ID NO: 2047441 - RNA, 21 nt, Homo sapiens
accgagucucuucuccacugg

SEQ ID NO: 2047442 - RNA, 19 nt, Homo sapiens
gggguagccuccuauccac

SEQ ID NO: 2047443 - RNA, 12 nt, Homo sapiens
uauacauuguga

SEQ ID NO: 2047444 - RNA, 18 nt, Homo sapiens
aauaaaauuuaggaccaa

SEQ ID NO: 2047445 - RNA, 16 nt, Homo sapiens
cccugauuugaaggga

SEQ ID NO: 2047446 - RNA, 13 nt, Homo sapiens
gacaaaacacagc

SEQ ID NO: 2047447 - RNA, 15 nt, Homo sapiens
aauaguggcauacca

SEQ ID NO: 2047448 - RNA, 14 nt, Homo sapiens
aauuuguauuuccc

SEQ ID NO: 2047449 - RNA, 12 nt, Homo sapiens
agagacccaagg

SEQ ID NO: 2047450 - RNA, 19 nt, Homo sapiens
ggcuuccccagguggccug

SEQ ID NO: 2047451 - RNA, 20 nt, Homo sapiens
gccuccaccuccuaggcuca

SEQ ID NO: 2047452 - RNA, 15 nt, Homo sapiens
cagagucaugggaga

SEQ ID NO: 2047453 - RNA, 21 nt, Homo sapiens
acaacucguguucacucagca

SEQ ID NO: 2047454 - RNA, 23 nt, Homo sapiens
cccauagguggcugagcaucgga

SEQ ID NO: 2047455 - RNA, 17 nt, Homo sapiens
accagccugcacuacuc

SEQ ID NO: 2047456 - RNA, 19 nt, Homo sapiens
accugcucccaguccugcc

SEQ ID NO: 2047457 - RNA, 17 nt, Homo sapiens
aaaaugucauuguucuc

SEQ ID NO: 2047458 - RNA, 17 nt, Homo sapiens
cugggaggggugcugcc

SEQ ID NO: 2047459 - RNA, 15 nt, Homo sapiens
acugaggugcaaagg

SEQ ID NO: 2047460 - RNA, 15 nt, Homo sapiens
acugaauugcaaaau

SEQ ID NO: 2047461 - RNA, 23 nt, Homo sapiens
uacucagugcauagcgaagacca

SEQ ID NO: 2047462 - RNA, 19 nt, Homo sapiens
uauaaaaucuuagaaagaa

SEQ ID NO: 2047463 - RNA, 20 nt, Homo sapiens
cacauugaaaaauguccaca

SEQ ID NO: 2047464 - RNA, 15 nt, Homo sapiens
uagagcuacuuugag

SEQ ID NO: 2047465 - RNA, 15 nt, Homo sapiens
ucgaaaccugugauu

SEQ ID NO: 2047466 - RNA, 21 nt, Homo sapiens
gcucaguaaggcagugcaaua

SEQ ID NO: 2047467 - RNA, 20 nt, Homo sapiens
ggucauauuaauauauuucc

SEQ ID NO: 2047468 - RNA, 17 nt, Homo sapiens
acugucuaagauuaaua

SEQ ID NO: 2047469 - RNA, 17 nt, Homo sapiens
auaaacagcuucuccaa

SEQ ID NO: 2047470 - RNA, 14 nt, Homo sapiens
uaaaacaagcugau

SEQ ID NO: 2047471 - RNA, 13 nt, Homo sapiens
gucaaauaucuca

SEQ ID NO: 2047472 - RNA, 12 nt, Homo sapiens
uggucauucaca

SEQ ID NO: 2047473 - RNA, 17 nt, Homo sapiens
gggaauuuucucuccau

SEQ ID NO: 2047474 - RNA, 12 nt, Homo sapiens
aauaaaugugaa

SEQ ID NO: 2047475 - RNA, 19 nt, Homo sapiens
ucaguggcauucacaucuc

SEQ ID NO: 2047476 - RNA, 15 nt, Homo sapiens
uuucaguuacuuucc

SEQ ID NO: 2047477 - RNA, 16 nt, Homo sapiens
augacguuccugucua

SEQ ID NO: 2047478 - RNA, 21 nt, Homo sapiens
acgccuguaaucccagcacuu

SEQ ID NO: 2047479 - RNA, 13 nt, Homo sapiens
cacagguguaaau

SEQ ID NO: 2047480 - RNA, 16 nt, Homo sapiens
ucccugcucacugcag

SEQ ID NO: 2047481 - RNA, 16 nt, Homo sapiens
aagccaucugacagca

SEQ ID NO: 2047482 - RNA, 21 nt, Homo sapiens
ucaggaaggaugagcauuuag

SEQ ID NO: 2047483 - RNA, 20 nt, Homo sapiens
acuaggugccugcccaggga

SEQ ID NO: 2047484 - RNA, 21 nt, Homo sapiens
acccauuauccaggacuguuu

SEQ ID NO: 2047485 - RNA, 18 nt, Homo sapiens
agcaguauguacaggcug

SEQ ID NO: 2047486 - RNA, 17 nt, Homo sapiens
gcccccaggcugcugga

SEQ ID NO: 2047487 - RNA, 13 nt, Homo sapiens
cugacagcaauaa

SEQ ID NO: 2047488 - RNA, 23 nt, Homo sapiens
ucugcugccaugagaaaagggaa

SEQ ID NO: 2047489 - RNA, 17 nt, Homo sapiens
acacauuacgugcuccc

SEQ ID NO: 2047490 - RNA, 20 nt, Homo sapiens
ucaaauggcuuaagcaauaa

SEQ ID NO: 2047491 - RNA, 12 nt, Homo sapiens
agauaacuuccu

SEQ ID NO: 2047492 - RNA, 21 nt, Homo sapiens
gcaggcaagguuuacacugcg

SEQ ID NO: 2047493 - RNA, 11 nt, Homo sapiens
cugcuccauga

SEQ ID NO: 2047494 - RNA, 15 nt, Homo sapiens
cucuucaaguacugu

SEQ ID NO: 2047495 - RNA, 12 nt, Homo sapiens
uccgaagggaaa

SEQ ID NO: 2047496 - RNA, 14 nt, Homo sapiens
caacucaaggcuca

SEQ ID NO: 2047497 - RNA, 16 nt, Homo sapiens
cucaccauccaguggg

SEQ ID NO: 2047498 - RNA, 19 nt, Homo sapiens
uccugaguagcuggauuac

SEQ ID NO: 2047499 - RNA, 16 nt, Homo sapiens
uacaacccauaaucau

SEQ ID NO: 2047500 - RNA, 22 nt, Homo sapiens
acugaucucaaguauaugucau

SEQ ID NO: 2047501 - RNA, 22 nt, Homo sapiens
ccauguuuucccuuuauucauc

SEQ ID NO: 2047502 - RNA, 16 nt, Homo sapiens
uguauaccaugaugca

SEQ ID NO: 2047503 - RNA, 16 nt, Homo sapiens
gcucuuuuuuacucau

SEQ ID NO: 2047504 - RNA, 21 nt, Homo sapiens
uaagagggcauauacagugaa

SEQ ID NO: 2047505 - RNA, 16 nt, Homo sapiens
uaaaugauuucauuca

SEQ ID NO: 2047506 - RNA, 19 nt, Homo sapiens
caauaaauauuauuugaug

SEQ ID NO: 2047507 - RNA, 18 nt, Homo sapiens
ugacauucaggcaauguc

SEQ ID NO: 2047508 - RNA, 23 nt, Homo sapiens
gccugaaguggaaugacugaaag

SEQ ID NO: 2047509 - RNA, 20 nt, Homo sapiens
gucauaaaaugcauacuguu

SEQ ID NO: 2047510 - RNA, 19 nt, Homo sapiens
auccuucgugaacaucccc

SEQ ID NO: 2047511 - RNA, 13 nt, Homo sapiens
gcuuuccaaagaa

SEQ ID NO: 2047512 - RNA, 15 nt, Homo sapiens
guugagauccagugc

SEQ ID NO: 2047513 - RNA, 15 nt, Homo sapiens
aguuuucuaaacuca

SEQ ID NO: 2047514 - RNA, 22 nt, Homo sapiens
cuuuaugcaugaagauaaugua

SEQ ID NO: 2047515 - RNA, 20 nt, Homo sapiens
aaauccuaaagaaggugaua

SEQ ID NO: 2047516 - RNA, 15 nt, Homo sapiens
acuauguugccuaag

SEQ ID NO: 2047517 - RNA, 15 nt, Homo sapiens
cacuuaguaugcagu

SEQ ID NO: 2047518 - RNA, 20 nt, Homo sapiens
aguauuuuaucugccuuaga

SEQ ID NO: 2047519 - RNA, 23 nt, Homo sapiens
ggaaaggcaucuaagacauucac

SEQ ID NO: 2047520 - RNA, 18 nt, Homo sapiens
aaagaguagugcauuuaa

SEQ ID NO: 2047521 - RNA, 22 nt, Homo sapiens
cuaugagaccguucgcauggca

SEQ ID NO: 2047522 - RNA, 17 nt, Homo sapiens
uauucaauaaagcugcu

SEQ ID NO: 2047523 - RNA, 20 nt, Homo sapiens
gcuagaauauccuauacugg

SEQ ID NO: 2047524 - RNA, 19 nt, Homo sapiens
acucuugauaacaccaaga

SEQ ID NO: 2047525 - RNA, 14 nt, Homo sapiens
ucacccacucccuu

SEQ ID NO: 2047526 - RNA, 14 nt, Homo sapiens
ucaaauuuugccag

SEQ ID NO: 2047527 - RNA, 22 nt, Homo sapiens
uaaaagguuaauuucugucaaa

SEQ ID NO: 2047528 - RNA, 19 nt, Homo sapiens
caggagcaagaacgaggaa

SEQ ID NO: 2047529 - RNA, 20 nt, Homo sapiens
caaagcggcucuaaaccuca

SEQ ID NO: 2047530 - RNA, 14 nt, Homo sapiens
auauaucuugucua

SEQ ID NO: 2047531 - RNA, 18 nt, Homo sapiens
aacuucuaaacacuucau

SEQ ID NO: 2047532 - RNA, 15 nt, Homo sapiens
cacauuuaugaauca

SEQ ID NO: 2047533 - RNA, 14 nt, Homo sapiens
aguauuugcuguuu

SEQ ID NO: 2047534 - RNA, 14 nt, Homo sapiens
aguaucugcuguuc

SEQ ID NO: 2047535 - RNA, 14 nt, Homo sapiens
aauauugugcaaac

SEQ ID NO: 2047536 - RNA, 21 nt, Homo sapiens
uaacaaggugucuuuuccacu

SEQ ID NO: 2047537 - RNA, 15 nt, Homo sapiens
aaugauacaguugca

SEQ ID NO: 2047538 - RNA, 18 nt, Homo sapiens
auaaaaugaauacaauua

SEQ ID NO: 2047539 - RNA, 16 nt, Homo sapiens
uaaggacuucugcagc

SEQ ID NO: 2047540 - RNA, 19 nt, Homo sapiens
gcagcugucagaacacucc

SEQ ID NO: 2047541 - RNA, 15 nt, Homo sapiens
accacagucccucac

SEQ ID NO: 2047542 - RNA, 20 nt, Homo sapiens
aaaaccucaugacagccaga

SEQ ID NO: 2047543 - RNA, 18 nt, Homo sapiens
aggagguucuaauauuca

SEQ ID NO: 2047544 - RNA, 20 nt, Homo sapiens
cauggcuguuggugggaccc

SEQ ID NO: 2047545 - RNA, 14 nt, Homo sapiens
uaguagggacuuaa

SEQ ID NO: 2047546 - RNA, 13 nt, Homo sapiens
aacccucuugcca

SEQ ID NO: 2047547 - RNA, 15 nt, Homo sapiens
ccuauguuuguguau

SEQ ID NO: 2047548 - RNA, 23 nt, Homo sapiens
uccucagcccccaggccagguga

SEQ ID NO: 2047549 - RNA, 14 nt, Homo sapiens
uccuugucacugaa

SEQ ID NO: 2047550 - RNA, 16 nt, Homo sapiens
aaucugagcugcaggu

SEQ ID NO: 2047551 - RNA, 23 nt, Homo sapiens
auaaauguacuuuuucuuccaga

SEQ ID NO: 2047552 - RNA, 22 nt, Homo sapiens
ggcuauguugagcugagaucac

SEQ ID NO: 2047553 - RNA, 21 nt, Homo sapiens
cuaccuaguuuguuagugcau

SEQ ID NO: 2047554 - RNA, 18 nt, Homo sapiens
ucuucccaggcuggggcu

SEQ ID NO: 2047555 - RNA, 18 nt, Homo sapiens
aauuacugccuuacugua

SEQ ID NO: 2047556 - RNA, 18 nt, Homo sapiens
cuuguugcuuuguugcac

SEQ ID NO: 2047557 - RNA, 23 nt, Homo sapiens
aaaguguaacaauuguguagccu

SEQ ID NO: 2047558 - RNA, 22 nt, Homo sapiens
acacaugagaugguauauccuu

SEQ ID NO: 2047559 - RNA, 19 nt, Homo sapiens
ugggguggcgggaauccua

SEQ ID NO: 2047560 - RNA, 14 nt, Homo sapiens
gguaggucauucuu

SEQ ID NO: 2047561 - RNA, 20 nt, Homo sapiens
gaagucacucacacuggcca

SEQ ID NO: 2047562 - RNA, 12 nt, Homo sapiens
caugucucugau

SEQ ID NO: 2047563 - RNA, 15 nt, Homo sapiens
gcaacuuagcucaca

SEQ ID NO: 2047564 - RNA, 14 nt, Homo sapiens
uucaugcaggugaa

SEQ ID NO: 2047565 - RNA, 23 nt, Homo sapiens
ggcaaugcucaccucuucuuuac

SEQ ID NO: 2047566 - RNA, 14 nt, Homo sapiens
caaaguaucuaaca

SEQ ID NO: 2047567 - RNA, 14 nt, Homo sapiens
cuuuguaucauuca

SEQ ID NO: 2047568 - RNA, 23 nt, Homo sapiens
cuugaccaagcaggaagcucaga

SEQ ID NO: 2047569 - RNA, 21 nt, Homo sapiens
cuugcaggagugacucaagaa

SEQ ID NO: 2047570 - RNA, 19 nt, Homo sapiens
ucucgaacuccuaaccuca

SEQ ID NO: 2047571 - RNA, 22 nt, Homo sapiens
agaccaaggcgggagcaucucu

SEQ ID NO: 2047572 - RNA, 14 nt, Homo sapiens
uauauuucagugac

SEQ ID NO: 2047573 - RNA, 17 nt, Homo sapiens
gcacacccuccagagac

SEQ ID NO: 2047574 - RNA, 22 nt, Homo sapiens
gaaauaaagcguccucucagua

SEQ ID NO: 2047575 - RNA, 22 nt, Homo sapiens
ucuuaacuuuucaccaggggug

SEQ ID NO: 2047576 - RNA, 22 nt, Homo sapiens
gccuccuuuuuaauacauuaag

SEQ ID NO: 2047577 - RNA, 16 nt, Homo sapiens
ccagugccuacagggc

SEQ ID NO: 2047578 - RNA, 22 nt, Homo sapiens
augcuugacauaccuaccagua

SEQ ID NO: 2047579 - RNA, 19 nt, Homo sapiens
uucuuuuauacugacacaa

SEQ ID NO: 2047580 - RNA, 15 nt, Homo sapiens
guuaauguuaauuaa

SEQ ID NO: 2047581 - RNA, 14 nt, Homo sapiens
auaucuacauuaua

SEQ ID NO: 2047582 - RNA, 12 nt, Homo sapiens
aguuaugugauu

SEQ ID NO: 2047583 - RNA, 22 nt, Homo sapiens
ccucucccaaaaaacuacuucu

SEQ ID NO: 2047584 - RNA, 17 nt, Homo sapiens
ucccuccucacucccua

SEQ ID NO: 2047585 - RNA, 18 nt, Homo sapiens
gaaaaauauuuauucauu

SEQ ID NO: 2047586 - RNA, 23 nt, Homo sapiens
gugaucuguccuuccaaccuguu

SEQ ID NO: 2047587 - RNA, 13 nt, Homo sapiens
auaagacuacuau

SEQ ID NO: 2047588 - RNA, 15 nt, Homo sapiens
guuacugaccagcaa

SEQ ID NO: 2047589 - RNA, 21 nt, Homo sapiens
uuaaaagggucguuaccagag

SEQ ID NO: 2047590 - RNA, 17 nt, Homo sapiens
gugagaaaaugccucaa

SEQ ID NO: 2047591 - RNA, 22 nt, Homo sapiens
ucauaugauugugcacauacuu

SEQ ID NO: 2047592 - RNA, 17 nt, Homo sapiens
gaacucucccucugguc

SEQ ID NO: 2047593 - RNA, 14 nt, Homo sapiens
cuguaugaagucau

SEQ ID NO: 2047594 - RNA, 16 nt, Homo sapiens
uuuauaaaaguguuca

SEQ ID NO: 2047595 - RNA, 19 nt, Homo sapiens
uaaggacacaaacuuucaa

SEQ ID NO: 2047596 - RNA, 23 nt, Homo sapiens
gggcccuggagcucaggguccuu

SEQ ID NO: 2047597 - RNA, 21 nt, Homo sapiens
guagaaucucuucaugcuuga

SEQ ID NO: 2047598 - RNA, 17 nt, Homo sapiens
uugaguugaguauuaca

SEQ ID NO: 2047599 - RNA, 22 nt, Homo sapiens
gaaacuguacauacugcagugu

SEQ ID NO: 2047600 - RNA, 18 nt, Homo sapiens
acaauuucaaaaugcaug

SEQ ID NO: 2047601 - RNA, 17 nt, Homo sapiens
ccugauguuuacagugu

SEQ ID NO: 2047602 - RNA, 14 nt, Homo sapiens
ggcugaucuuugcc

SEQ ID NO: 2047603 - RNA, 23 nt, Homo sapiens
cccaagcuggccacuaucacaua

SEQ ID NO: 2047604 - RNA, 18 nt, Homo sapiens
gcucucuugugacgugca

SEQ ID NO: 2047605 - RNA, 23 nt, Homo sapiens
agucaguuguggccccagccccu

SEQ ID NO: 2047606 - RNA, 21 nt, Homo sapiens
aaguggccggaaaacaagccu

SEQ ID NO: 2047607 - RNA, 15 nt, Homo sapiens
cugccccucucacca

SEQ ID NO: 2047608 - RNA, 16 nt, Homo sapiens
uacuuuuuuacacuga

SEQ ID NO: 2047609 - RNA, 23 nt, Homo sapiens
uugcugcugauuuaaacacauua

SEQ ID NO: 2047610 - RNA, 21 nt, Homo sapiens
gcuagacgucucacucaaaga

SEQ ID NO: 2047611 - RNA, 17 nt, Homo sapiens
uucaucuucaaccuuaa

SEQ ID NO: 2047612 - RNA, 20 nt, Homo sapiens
caccagcaccgugacaguuu

SEQ ID NO: 2047613 - RNA, 17 nt, Homo sapiens
gaaaggauuuuaccaaa

SEQ ID NO: 2047614 - RNA, 20 nt, Homo sapiens
ugggcuuucaaaaaccauau

SEQ ID NO: 2047615 - RNA, 17 nt, Homo sapiens
ucagugaagcccaggag

SEQ ID NO: 2047616 - RNA, 19 nt, Homo sapiens
aguugguaaauucacaaau

SEQ ID NO: 2047617 - RNA, 14 nt, Homo sapiens
aauucgcuguuacc

SEQ ID NO: 2047618 - RNA, 22 nt, Homo sapiens
ucuuaugcuguacccaguuucu

SEQ ID NO: 2047619 - RNA, 20 nt, Homo sapiens
cuacuucccagcuaaucucc

SEQ ID NO: 2047620 - RNA, 14 nt, Homo sapiens
guaaaucuauauga

SEQ ID NO: 2047621 - RNA, 15 nt, Homo sapiens
agcagccagucucag

SEQ ID NO: 2047622 - RNA, 21 nt, Homo sapiens
uuccuggagaaggcauuccag

SEQ ID NO: 2047623 - RNA, 14 nt, Homo sapiens
gagaacuccagcug

SEQ ID NO: 2047624 - RNA, 16 nt, Homo sapiens
cacuagugcaauucca

SEQ ID NO: 2047625 - RNA, 19 nt, Homo sapiens
uucuguccuggugucacuu

SEQ ID NO: 2047626 - RNA, 14 nt, Homo sapiens
accaaaucaucucu

SEQ ID NO: 2047627 - RNA, 23 nt, Homo sapiens
acaguaaauggcuuauccagcug

SEQ ID NO: 2047628 - RNA, 17 nt, Homo sapiens
gaaaauguauugauuca

SEQ ID NO: 2047629 - RNA, 15 nt, Homo sapiens
uaaacucuguugcaa

SEQ ID NO: 2047630 - RNA, 18 nt, Homo sapiens
uaagcgauucucuugccu

SEQ ID NO: 2047631 - RNA, 22 nt, Homo sapiens
ucuugcugccaggcccacacau

SEQ ID NO: 2047632 - RNA, 18 nt, Homo sapiens
uuuaccuggaaaccagaa

SEQ ID NO: 2047633 - RNA, 14 nt, Homo sapiens
accaagacuaagca

SEQ ID NO: 2047634 - RNA, 16 nt, Homo sapiens
uguacugccuuagugc

SEQ ID NO: 2047635 - RNA, 15 nt, Homo sapiens
caugcaagugagaaa

SEQ ID NO: 2047636 - RNA, 18 nt, Homo sapiens
ucaacaaccugaaugucc

SEQ ID NO: 2047637 - RNA, 20 nt, Homo sapiens
aagaccagagggacacuagg

SEQ ID NO: 2047638 - RNA, 16 nt, Homo sapiens
aguccacaucuucuca

SEQ ID NO: 2047639 - RNA, 22 nt, Homo sapiens
uuuaccaugaggcuugugugaa

SEQ ID NO: 2047640 - RNA, 13 nt, Homo sapiens
cacacacacaaac

SEQ ID NO: 2047641 - RNA, 13 nt, Homo sapiens
guacuacaguccu

SEQ ID NO: 2047642 - RNA, 13 nt, Homo sapiens
auaucacaaucuc

SEQ ID NO: 2047643 - RNA, 16 nt, Homo sapiens
uucauucugaugucca

SEQ ID NO: 2047644 - RNA, 16 nt, Homo sapiens
agcccaagguuaaaaa

SEQ ID NO: 2047645 - RNA, 17 nt, Homo sapiens
cagaagaaagauggaaa

SEQ ID NO: 2047646 - RNA, 23 nt, Homo sapiens
cccaucuuccaacccacuggccc

SEQ ID NO: 2047647 - RNA, 19 nt, Homo sapiens
cacuccucgguacucccau

SEQ ID NO: 2047648 - RNA, 15 nt, Homo sapiens
uuaaaacaaugaagu

SEQ ID NO: 2047649 - RNA, 18 nt, Homo sapiens
gauaaucuuagcugccaa

SEQ ID NO: 2047650 - RNA, 19 nt, Homo sapiens
acucaacucugagcccaua

SEQ ID NO: 2047651 - RNA, 22 nt, Homo sapiens
cugaaggauccuggaaccacug

SEQ ID NO: 2047652 - RNA, 21 nt, Homo sapiens
gaaaacuuugaggaacauuca

SEQ ID NO: 2047653 - RNA, 15 nt, Homo sapiens
gguuggcaccugcac

SEQ ID NO: 2047654 - RNA, 18 nt, Homo sapiens
guaacuuuuguagucuua

SEQ ID NO: 2047655 - RNA, 22 nt, Homo sapiens
uuaagaaagauuaaauauaucu

SEQ ID NO: 2047656 - RNA, 18 nt, Homo sapiens
aagagcguagacaggugu

SEQ ID NO: 2047657 - RNA, 15 nt, Homo sapiens
accagaaacaccccu

SEQ ID NO: 2047658 - RNA, 21 nt, Homo sapiens
gauggcaggaugggcacugcc

SEQ ID NO: 2047659 - RNA, 19 nt, Homo sapiens
auggggcccuguccaggua

SEQ ID NO: 2047660 - RNA, 23 nt, Homo sapiens
gcuuacuaugaccuuccaaguuu

SEQ ID NO: 2047661 - RNA, 17 nt, Homo sapiens
augauuccagacagugg

SEQ ID NO: 2047662 - RNA, 22 nt, Homo sapiens
uguguuuugaaugguguuguau

SEQ ID NO: 2047663 - RNA, 20 nt, Homo sapiens
cuacucaggaggcugagaca

SEQ ID NO: 2047664 - RNA, 14 nt, Homo sapiens
ggagagucaaggga

SEQ ID NO: 2047665 - RNA, 13 nt, Homo sapiens
ugacagagugccu

SEQ ID NO: 2047666 - RNA, 13 nt, Homo sapiens
uaauagaguacuu

SEQ ID NO: 2047667 - RNA, 17 nt, Homo sapiens
ggauagaggaaagggau

SEQ ID NO: 2047668 - RNA, 20 nt, Homo sapiens
acagcacagaugugaaggac

SEQ ID NO: 2047669 - RNA, 13 nt, Homo sapiens
ucaaaaccugugc

SEQ ID NO: 2047670 - RNA, 22 nt, Homo sapiens
uucaucgcaguggacugugucc

SEQ ID NO: 2047671 - RNA, 18 nt, Homo sapiens
uggaggacggucagucca

SEQ ID NO: 2047672 - RNA, 14 nt, Homo sapiens
uugccccacucugc

SEQ ID NO: 2047673 - RNA, 12 nt, Homo sapiens
auacaacuuuac

SEQ ID NO: 2047674 - RNA, 14 nt, Homo sapiens
ugaucggaaagcuc

SEQ ID NO: 2047675 - RNA, 12 nt, Homo sapiens
uaaaaacuaaaa

SEQ ID NO: 2047676 - RNA, 19 nt, Homo sapiens
uccagaugugccuagacac

SEQ ID NO: 2047677 - RNA, 18 nt, Homo sapiens
ugccaccuccugccucag

SEQ ID NO: 2047678 - RNA, 23 nt, Homo sapiens
uucgaauccagagagcagugugg

SEQ ID NO: 2047679 - RNA, 14 nt, Homo sapiens
gcgugccuguaauc

SEQ ID NO: 2047680 - RNA, 12 nt, Homo sapiens
cagacauuccaa

SEQ ID NO: 2047681 - RNA, 18 nt, Homo sapiens
ucuaaaaugugugccaga

SEQ ID NO: 2047682 - RNA, 14 nt, Homo sapiens
uuccagaaaccaaa

SEQ ID NO: 2047683 - RNA, 13 nt, Homo sapiens
ugcuggcauuugc

SEQ ID NO: 2047684 - RNA, 17 nt, Homo sapiens
cauuaagagauuuucaa

SEQ ID NO: 2047685 - RNA, 22 nt, Homo sapiens
cucaugaaggagaggauuuggc

SEQ ID NO: 2047686 - RNA, 21 nt, Homo sapiens
agauugggagguguaucugag

SEQ ID NO: 2047687 - RNA, 12 nt, Homo sapiens
gacuccaucuca

SEQ ID NO: 2047688 - RNA, 14 nt, Homo sapiens
cuagacaaguaaaa

SEQ ID NO: 2047689 - RNA, 18 nt, Homo sapiens
ugucuuauaagaaaacau

SEQ ID NO: 2047690 - RNA, 13 nt, Homo sapiens
cugauuucucaca

SEQ ID NO: 2047691 - RNA, 15 nt, Homo sapiens
cuggauucgugacaa

SEQ ID NO: 2047692 - RNA, 21 nt, Homo sapiens
acaauugucgaaaagagucuu

SEQ ID NO: 2047693 - RNA, 13 nt, Homo sapiens
caacccuuucauu

SEQ ID NO: 2047694 - RNA, 20 nt, Homo sapiens
ugcucaaaaucuuuccaaau

SEQ ID NO: 2047695 - RNA, 23 nt, Homo sapiens
gaaagauucauuggcaugccaca

SEQ ID NO: 2047696 - RNA, 17 nt, Homo sapiens
cuuggaguuacaacaga

SEQ ID NO: 2047697 - RNA, 13 nt, Homo sapiens
agcccuguuggca

SEQ ID NO: 2047698 - RNA, 14 nt, Homo sapiens
uccagcagagccuu

SEQ ID NO: 2047699 - RNA, 17 nt, Homo sapiens
uucagaucauauuucac

SEQ ID NO: 2047700 - RNA, 18 nt, Homo sapiens
uauaauuacaaugcacaa

SEQ ID NO: 2047701 - RNA, 20 nt, Homo sapiens
aaucacaaggcaacugugag

SEQ ID NO: 2047702 - RNA, 21 nt, Homo sapiens
ccgacugcuagggaguggucu

SEQ ID NO: 2047703 - RNA, 20 nt, Homo sapiens
ugggaagacauuucugcaca

SEQ ID NO: 2047704 - RNA, 12 nt, Homo sapiens
cuaaguccucag

SEQ ID NO: 2047705 - RNA, 14 nt, Homo sapiens
gcuugaauguuugu

SEQ ID NO: 2047706 - RNA, 14 nt, Homo sapiens
uuuaaaauucuaau

SEQ ID NO: 2047707 - RNA, 19 nt, Homo sapiens
auuuacuguggcuucuuaa

SEQ ID NO: 2047708 - RNA, 22 nt, Homo sapiens
cugcaccgagagagauggaaua

SEQ ID NO: 2047709 - RNA, 20 nt, Homo sapiens
aauugucacaucaagcauca

SEQ ID NO: 2047710 - RNA, 20 nt, Homo sapiens
uuggcacuguuugccauucu

SEQ ID NO: 2047711 - RNA, 23 nt, Homo sapiens
ggacucagguugucugaagucac

SEQ ID NO: 2047712 - RNA, 20 nt, Homo sapiens
uguggggacacagcagugag

SEQ ID NO: 2047713 - RNA, 17 nt, Homo sapiens
ccaaacuugacaguaaa

SEQ ID NO: 2047714 - RNA, 14 nt, Homo sapiens
cuuaguauuugcau

SEQ ID NO: 2047715 - RNA, 13 nt, Homo sapiens
auccugauuccaa

SEQ ID NO: 2047716 - RNA, 16 nt, Homo sapiens
gcugccaucuccaggc

SEQ ID NO: 2047717 - RNA, 21 nt, Homo sapiens
auauguguauauauacauaca

SEQ ID NO: 2047718 - RNA, 23 nt, Homo sapiens
caggggcuggcccagggcugcaa

SEQ ID NO: 2047719 - RNA, 14 nt, Homo sapiens
agugagaugaagga

SEQ ID NO: 2047720 - RNA, 20 nt, Homo sapiens
auuguacaagagucccuuug

SEQ ID NO: 2047721 - RNA, 22 nt, Homo sapiens
auuuuauaaaugauaucaaaga

SEQ ID NO: 2047722 - RNA, 23 nt, Homo sapiens
aaagauuggacaccccugcuaua

SEQ ID NO: 2047723 - RNA, 22 nt, Homo sapiens
aagacauaacguuuuuccuuua

SEQ ID NO: 2047724 - RNA, 22 nt, Homo sapiens
uuugcauauuuuuaaacaaaga

SEQ ID NO: 2047725 - RNA, 23 nt, Homo sapiens
aguucugcuuucuccccaaugag

SEQ ID NO: 2047726 - RNA, 14 nt, Homo sapiens
cugucuucuggucu

SEQ ID NO: 2047727 - RNA, 14 nt, Homo sapiens
cugaauucuggaau

SEQ ID NO: 2047728 - RNA, 12 nt, Homo sapiens
aaauucugauga

SEQ ID NO: 2047729 - RNA, 17 nt, Homo sapiens
uaugaaauuauaaucug

SEQ ID NO: 2047730 - RNA, 17 nt, Homo sapiens
aaaauuaagaaguacaa

SEQ ID NO: 2047731 - RNA, 16 nt, Homo sapiens
aaaugcuccagcacuc

SEQ ID NO: 2047732 - RNA, 17 nt, Homo sapiens
uacuccucaguuccuca

SEQ ID NO: 2047733 - RNA, 17 nt, Homo sapiens
uguauauacacauauac

SEQ ID NO: 2047734 - RNA, 12 nt, Homo sapiens
gaaaagccaguu

SEQ ID NO: 2047735 - RNA, 21 nt, Homo sapiens
ccucuuuugagacuuugccca

SEQ ID NO: 2047736 - RNA, 15 nt, Homo sapiens
guucugaugaggcau

SEQ ID NO: 2047737 - RNA, 22 nt, Homo sapiens
auccuagggccuggguuuucau

SEQ ID NO: 2047738 - RNA, 15 nt, Homo sapiens
uggcuggucuucacu

SEQ ID NO: 2047739 - RNA, 21 nt, Homo sapiens
ccuaggccgcccugagcaucc

SEQ ID NO: 2047740 - RNA, 18 nt, Homo sapiens
cuucuaucaggucccauc

SEQ ID NO: 2047741 - RNA, 18 nt, Homo sapiens
caaugaaagucaaauuua

SEQ ID NO: 2047742 - RNA, 22 nt, Homo sapiens
ccaaaagacuccaguacuauuu

SEQ ID NO: 2047743 - RNA, 22 nt, Homo sapiens
cauuguaagcccacaguaggca

SEQ ID NO: 2047744 - RNA, 18 nt, Homo sapiens
ugaauaaauguaucugaa

SEQ ID NO: 2047745 - RNA, 17 nt, Homo sapiens
ugggcuggagcaguuug

SEQ ID NO: 2047746 - RNA, 19 nt, Homo sapiens
ccaugguaugaaggugauu

SEQ ID NO: 2047747 - RNA, 19 nt, Homo sapiens
aagaggagauuaaccucuu

SEQ ID NO: 2047748 - RNA, 16 nt, Homo sapiens
gugaccucagcuuuga

SEQ ID NO: 2047749 - RNA, 21 nt, Homo sapiens
ucaacagaugaccguguacaa

SEQ ID NO: 2047750 - RNA, 14 nt, Homo sapiens
cauaucuucuauau

SEQ ID NO: 2047751 - RNA, 21 nt, Homo sapiens
uguugcauuuacuuuuaauaa

SEQ ID NO: 2047752 - RNA, 18 nt, Homo sapiens
ugcccuucucaagacuuu

SEQ ID NO: 2047753 - RNA, 23 nt, Homo sapiens
uauuccuaucaguauaauacuaa

SEQ ID NO: 2047754 - RNA, 22 nt, Homo sapiens
gaaggaaaaggaauuccucuau

SEQ ID NO: 2047755 - RNA, 22 nt, Homo sapiens
agaagggccagauuucauucuc

SEQ ID NO: 2047756 - RNA, 21 nt, Homo sapiens
auuugccaaaauaaugucuug

SEQ ID NO: 2047757 - RNA, 12 nt, Homo sapiens
caagccacagaa

SEQ ID NO: 2047758 - RNA, 15 nt, Homo sapiens
aggcagagacaauaa

SEQ ID NO: 2047759 - RNA, 19 nt, Homo sapiens
cuuugacucaccuguuacu

SEQ ID NO: 2047760 - RNA, 19 nt, Homo sapiens
ccuggguauagugcagaaa

SEQ ID NO: 2047761 - RNA, 19 nt, Homo sapiens
cgaaaaagagguagcacua

SEQ ID NO: 2047762 - RNA, 19 nt, Homo sapiens
uccgugccaggcauucaau

SEQ ID NO: 2047763 - RNA, 20 nt, Homo sapiens
cauucugcauacuaaccuau

SEQ ID NO: 2047764 - RNA, 22 nt, Homo sapiens
gagccgagcggggagccaggaa

SEQ ID NO: 2047765 - RNA, 13 nt, Homo sapiens
cauggugagcucu

SEQ ID NO: 2047766 - RNA, 13 nt, Homo sapiens
uuaaacagauguc

SEQ ID NO: 2047767 - RNA, 20 nt, Homo sapiens
auuuggagaugucucugugu

SEQ ID NO: 2047768 - RNA, 13 nt, Homo sapiens
gcauguauacuua

SEQ ID NO: 2047769 - RNA, 17 nt, Homo sapiens
aucauguaaaugauuau

SEQ ID NO: 2047770 - RNA, 19 nt, Homo sapiens
acuugcccugaacauacac

SEQ ID NO: 2047771 - RNA, 17 nt, Homo sapiens
acagagagagauacucu

SEQ ID NO: 2047772 - RNA, 18 nt, Homo sapiens
uuguucagggcugugauc

SEQ ID NO: 2047773 - RNA, 17 nt, Homo sapiens
uuaaacaaucuuucaug

SEQ ID NO: 2047774 - RNA, 14 nt, Homo sapiens
auaccacagcuuuu

SEQ ID NO: 2047775 - RNA, 14 nt, Homo sapiens
aguuggaguacuau

SEQ ID NO: 2047776 - RNA, 15 nt, Homo sapiens
auugauuucuucuca

SEQ ID NO: 2047777 - RNA, 22 nt, Homo sapiens
cagagcacuuuagcagaugugg

SEQ ID NO: 2047778 - RNA, 17 nt, Homo sapiens
uuuaucauuucuacuga

SEQ ID NO: 2047779 - RNA, 17 nt, Homo sapiens
cacucaagccaagcagc

SEQ ID NO: 2047780 - RNA, 18 nt, Homo sapiens
ugcauugcuaaaauauua

SEQ ID NO: 2047781 - RNA, 16 nt, Homo sapiens
ucagugauuacuguca

SEQ ID NO: 2047782 - RNA, 16 nt, Homo sapiens
uucuggacagacagau

SEQ ID NO: 2047783 - RNA, 23 nt, Homo sapiens
cauugagaacugcauauguuucg

SEQ ID NO: 2047784 - RNA, 22 nt, Homo sapiens
ugcaaccuccgccucucagguu

SEQ ID NO: 2047785 - RNA, 14 nt, Homo sapiens
cugcuuagaauuaa

SEQ ID NO: 2047786 - RNA, 16 nt, Homo sapiens
gcaaucacagcucacu

SEQ ID NO: 2047787 - RNA, 15 nt, Homo sapiens
uaaguauuuugauca

SEQ ID NO: 2047788 - RNA, 19 nt, Homo sapiens
uuuuuaaauguucauguca

SEQ ID NO: 2047789 - RNA, 16 nt, Homo sapiens
ugaaacuuaccauuca

SEQ ID NO: 2047790 - RNA, 19 nt, Homo sapiens
uuucaacugucuuccucaa

SEQ ID NO: 2047791 - RNA, 21 nt, Homo sapiens
aaccauggauagaaucaauau

SEQ ID NO: 2047792 - RNA, 19 nt, Homo sapiens
auaaagaagcuaaccugcc

SEQ ID NO: 2047793 - RNA, 17 nt, Homo sapiens
guuacaugaaugaauga

SEQ ID NO: 2047794 - RNA, 20 nt, Homo sapiens
ucagcacuagaucaugggau

SEQ ID NO: 2047795 - RNA, 15 nt, Homo sapiens
uccacaucuaacaaa

SEQ ID NO: 2047796 - RNA, 21 nt, Homo sapiens
aaccuuuugagugccuuacac

SEQ ID NO: 2047797 - RNA, 16 nt, Homo sapiens
uaacugacaacuugaa

SEQ ID NO: 2047798 - RNA, 15 nt, Homo sapiens
gaggacuucugcauc

SEQ ID NO: 2047799 - RNA, 22 nt, Homo sapiens
uccccagguggaggugccagga

SEQ ID NO: 2047800 - RNA, 21 nt, Homo sapiens
acaugcauaagaaauguagcu

SEQ ID NO: 2047801 - RNA, 18 nt, Homo sapiens
acccuacaccucugggcc

SEQ ID NO: 2047802 - RNA, 22 nt, Homo sapiens
aauaccccauuaccagcauuua

SEQ ID NO: 2047803 - RNA, 22 nt, Homo sapiens
uucauauaggccagaguugcaa

SEQ ID NO: 2047804 - RNA, 15 nt, Homo sapiens
uacagaugaaugaua

SEQ ID NO: 2047805 - RNA, 21 nt, Homo sapiens
ugaccugucaccgugagcagc

SEQ ID NO: 2047806 - RNA, 17 nt, Homo sapiens
agccuacccuauucuau

SEQ ID NO: 2047807 - RNA, 19 nt, Homo sapiens
cuauucaaaaggaaauaua

SEQ ID NO: 2047808 - RNA, 21 nt, Homo sapiens
caaguagauuggcugggcaaa

SEQ ID NO: 2047809 - RNA, 15 nt, Homo sapiens
ggcuucagccaucca

SEQ ID NO: 2047810 - RNA, 23 nt, Homo sapiens
cuugcgaacuagagaugugcaau

SEQ ID NO: 2047811 - RNA, 18 nt, Homo sapiens
aaaauguagacugaaaag

SEQ ID NO: 2047812 - RNA, 14 nt, Homo sapiens
augagaacaagcua

SEQ ID NO: 2047813 - RNA, 21 nt, Homo sapiens
auuucuagucccuucucucuu

SEQ ID NO: 2047814 - RNA, 14 nt, Homo sapiens
uaucucccauaaac

SEQ ID NO: 2047815 - RNA, 21 nt, Homo sapiens
caaguucgucuguugugcgaa

SEQ ID NO: 2047816 - RNA, 21 nt, Homo sapiens
ccuuggaaaucugccaugagc

SEQ ID NO: 2047817 - RNA, 20 nt, Homo sapiens
ugcagccacuguuaagccau

SEQ ID NO: 2047818 - RNA, 21 nt, Homo sapiens
auuuggaggcaauccuaccuu

SEQ ID NO: 2047819 - RNA, 21 nt, Homo sapiens
uucccgacgacacauauacau

SEQ ID NO: 2047820 - RNA, 21 nt, Homo sapiens
agccucugcccaggcacugcu

SEQ ID NO: 2047821 - RNA, 21 nt, Homo sapiens
aagugcauuuuuaucugugag

SEQ ID NO: 2047822 - RNA, 17 nt, Homo sapiens
uguuucuuuguaaugaa

SEQ ID NO: 2047823 - RNA, 12 nt, Homo sapiens
gacucagggcau

SEQ ID NO: 2047824 - RNA, 21 nt, Homo sapiens
aggaauucguaaucaucccca

SEQ ID NO: 2047825 - RNA, 19 nt, Homo sapiens
uuuugguuccucacauauu

SEQ ID NO: 2047826 - RNA, 18 nt, Homo sapiens
uuggcaggcuggccaguc

SEQ ID NO: 2047827 - RNA, 16 nt, Homo sapiens
uagaggaccagugagu

SEQ ID NO: 2047828 - RNA, 22 nt, Homo sapiens
acagagcucuccagcuccaaga

SEQ ID NO: 2047829 - RNA, 11 nt, Homo sapiens
agcuguucuca

SEQ ID NO: 2047830 - RNA, 17 nt, Homo sapiens
ugucucuuuccacuuug

SEQ ID NO: 2047831 - RNA, 19 nt, Homo sapiens
uuuccagacuuccuugaga

SEQ ID NO: 2047832 - RNA, 18 nt, Homo sapiens
aagaacacuacugcuaaa

SEQ ID NO: 2047833 - RNA, 15 nt, Homo sapiens
ugccauuuccugucu

SEQ ID NO: 2047834 - RNA, 19 nt, Homo sapiens
cuguaaugcuuuacacagg

SEQ ID NO: 2047835 - RNA, 21 nt, Homo sapiens
cguggucacugcugucaucaa

SEQ ID NO: 2047836 - RNA, 15 nt, Homo sapiens
aaaugccaccaucca

SEQ ID NO: 2047837 - RNA, 19 nt, Homo sapiens
ggcaaagguggcucuccag

SEQ ID NO: 2047838 - RNA, 13 nt, Homo sapiens
aaggaaccauaug

SEQ ID NO: 2047839 - RNA, 21 nt, Homo sapiens
uguguuuuuaauaaagacagg

SEQ ID NO: 2047840 - RNA, 23 nt, Homo sapiens
uucccuuuuggggcaagacagac

SEQ ID NO: 2047841 - RNA, 14 nt, Homo sapiens
aaaugcagcuuuca

SEQ ID NO: 2047842 - RNA, 16 nt, Homo sapiens
acccacagcccugaaa

SEQ ID NO: 2047843 - RNA, 16 nt, Homo sapiens
gaugauguuauucaca

SEQ ID NO: 2047844 - RNA, 19 nt, Homo sapiens
uguaaauauuacacaucaa

SEQ ID NO: 2047845 - RNA, 14 nt, Homo sapiens
uuugugucacugua

SEQ ID NO: 2047846 - RNA, 19 nt, Homo sapiens
caugugauuacccucuggg

SEQ ID NO: 2047847 - RNA, 18 nt, Homo sapiens
ucacacaauacaauaagu

SEQ ID NO: 2047848 - RNA, 15 nt, Homo sapiens
cugcacuucauaucu

SEQ ID NO: 2047849 - RNA, 15 nt, Homo sapiens
aacgagccuggaagc

SEQ ID NO: 2047850 - RNA, 23 nt, Homo sapiens
gcauguuggacucugagcucauu

SEQ ID NO: 2047851 - RNA, 16 nt, Homo sapiens
aaaagaugauuucuca

SEQ ID NO: 2047852 - RNA, 18 nt, Homo sapiens
cuuauuauuuuauccuga

SEQ ID NO: 2047853 - RNA, 19 nt, Homo sapiens
uagaucuuaaaaaaugaau

SEQ ID NO: 2047854 - RNA, 14 nt, Homo sapiens
acaccugcugagaa

SEQ ID NO: 2047855 - RNA, 14 nt, Homo sapiens
agaaggcucuaucu

SEQ ID NO: 2047856 - RNA, 23 nt, Homo sapiens
uuggcugccuggcccaugugccc

SEQ ID NO: 2047857 - RNA, 15 nt, Homo sapiens
ugccuuccuguuuaa

SEQ ID NO: 2047858 - RNA, 12 nt, Homo sapiens
guaaauugaacu

SEQ ID NO: 2047859 - RNA, 18 nt, Homo sapiens
aagccccccuuuggcacu

SEQ ID NO: 2047860 - RNA, 23 nt, Homo sapiens
uccuaacauccuuggacugagaa

SEQ ID NO: 2047861 - RNA, 22 nt, Homo sapiens
aaauuauuuauuacuugugcac

SEQ ID NO: 2047862 - RNA, 16 nt, Homo sapiens
caaaauaaaggcgcua

SEQ ID NO: 2047863 - RNA, 14 nt, Homo sapiens
aaccagaggguugu

SEQ ID NO: 2047864 - RNA, 21 nt, Homo sapiens
ucccuugcuggaaaacccaaa

SEQ ID NO: 2047865 - RNA, 14 nt, Homo sapiens
uaguagaugcaucu

SEQ ID NO: 2047866 - RNA, 21 nt, Homo sapiens
auucaaaguuaaaagcaaaca

SEQ ID NO: 2047867 - RNA, 21 nt, Homo sapiens
aacaagcaagcaaaaugcaaa

SEQ ID NO: 2047868 - RNA, 14 nt, Homo sapiens
ucuuuauacuuaaa

SEQ ID NO: 2047869 - RNA, 23 nt, Homo sapiens
uuuauaaaagaauaaaauugcac

SEQ ID NO: 2047870 - RNA, 12 nt, Homo sapiens
augagccagcuc

SEQ ID NO: 2047871 - RNA, 21 nt, Homo sapiens
gccagaggccuggugcccugg

SEQ ID NO: 2047872 - RNA, 20 nt, Homo sapiens
gaagagccugacuguguuca

SEQ ID NO: 2047873 - RNA, 16 nt, Homo sapiens
caaagcaggaguggaa

SEQ ID NO: 2047874 - RNA, 23 nt, Homo sapiens
aauccaagaaaauggccagugag

SEQ ID NO: 2047875 - RNA, 11 nt, Homo sapiens
cuuaagacaga

SEQ ID NO: 2047876 - RNA, 16 nt, Homo sapiens
uuccucuuaauuccca

SEQ ID NO: 2047877 - RNA, 15 nt, Homo sapiens
gcagggacuccaugc

SEQ ID NO: 2047878 - RNA, 11 nt, Homo sapiens
acccuggugcu

SEQ ID NO: 2047879 - RNA, 17 nt, Homo sapiens
uuggcuccauaucauuu

SEQ ID NO: 2047880 - RNA, 22 nt, Homo sapiens
ucugagcacaggugacagauca

SEQ ID NO: 2047881 - RNA, 14 nt, Homo sapiens
aaauugaauuucca

SEQ ID NO: 2047882 - RNA, 23 nt, Homo sapiens
agaacaggccucuccauuugcuc

SEQ ID NO: 2047883 - RNA, 16 nt, Homo sapiens
agggaagcaccaugaa

SEQ ID NO: 2047884 - RNA, 19 nt, Homo sapiens
acuaaaaaggccccugugg

SEQ ID NO: 2047885 - RNA, 22 nt, Homo sapiens
guucaaagaaccccccucccca

SEQ ID NO: 2047886 - RNA, 23 nt, Homo sapiens
aucacuuaaacuugcaucacuua

SEQ ID NO: 2047887 - RNA, 16 nt, Homo sapiens
cuuaguaaguauuucc

SEQ ID NO: 2047888 - RNA, 17 nt, Homo sapiens
uggaaaaagccugugaa

SEQ ID NO: 2047889 - RNA, 20 nt, Homo sapiens
cuguaaagucuaaucucuaa

SEQ ID NO: 2047890 - RNA, 19 nt, Homo sapiens
augcugcaggaaaagcaaa

SEQ ID NO: 2047891 - RNA, 10 nt, Homo sapiens
acucagucuu

SEQ ID NO: 2047892 - RNA, 18 nt, Homo sapiens
gcuggcagccuccagugg

SEQ ID NO: 2047893 - RNA, 18 nt, Homo sapiens
ugcuacuguguagacuca

SEQ ID NO: 2047894 - RNA, 22 nt, Homo sapiens
gccaagauugcgccauugcacu

SEQ ID NO: 2047895 - RNA, 22 nt, Homo sapiens
cuauaaagaagaacuugcaugg

SEQ ID NO: 2047896 - RNA, 14 nt, Homo sapiens
aagcacugugcuaa

SEQ ID NO: 2047897 - RNA, 11 nt, Homo sapiens
gauuugcaaua

SEQ ID NO: 2047898 - RNA, 14 nt, Homo sapiens
aaucccagcacuuu

SEQ ID NO: 2047899 - RNA, 17 nt, Homo sapiens
ggaggaacacugcacuc

SEQ ID NO: 2047900 - RNA, 13 nt, Homo sapiens
uucuucugucaag

SEQ ID NO: 2047901 - RNA, 20 nt, Homo sapiens
agccagcccuggcccacccc

SEQ ID NO: 2047902 - RNA, 21 nt, Homo sapiens
cuguauauaaacgugucccga

SEQ ID NO: 2047903 - RNA, 16 nt, Homo sapiens
ucuucccccuuccaaa

SEQ ID NO: 2047904 - RNA, 21 nt, Homo sapiens
aguuugugaaugugacuacuu

SEQ ID NO: 2047905 - RNA, 15 nt, Homo sapiens
uaaguaacauauaaa

SEQ ID NO: 2047906 - RNA, 14 nt, Homo sapiens
ugggucuaugccuu

SEQ ID NO: 2047907 - RNA, 18 nt, Homo sapiens
gucaagucaccaugcuga

SEQ ID NO: 2047908 - RNA, 21 nt, Homo sapiens
guugaaaauguguuugcugcc

SEQ ID NO: 2047909 - RNA, 15 nt, Homo sapiens
aauguaaucauuccu

SEQ ID NO: 2047910 - RNA, 21 nt, Homo sapiens
cucaggaagcccccaaguuga

SEQ ID NO: 2047911 - RNA, 23 nt, Homo sapiens
uuuaaaaggcaagucaaauacca

SEQ ID NO: 2047912 - RNA, 23 nt, Homo sapiens
uuagcuaccucacuaugcugcuu

SEQ ID NO: 2047913 - RNA, 12 nt, Homo sapiens
ggaaaauucucu

SEQ ID NO: 2047914 - RNA, 14 nt, Homo sapiens
uacaauuuagcuua

SEQ ID NO: 2047915 - RNA, 18 nt, Homo sapiens
ucagcaacaagacugcca

SEQ ID NO: 2047916 - RNA, 20 nt, Homo sapiens
ccagacucucacaugcagua

SEQ ID NO: 2047917 - RNA, 18 nt, Homo sapiens
cucccuuugccagccuug

SEQ ID NO: 2047918 - RNA, 22 nt, Homo sapiens
cccuacaucaaaugcucaagcc

SEQ ID NO: 2047919 - RNA, 12 nt, Homo sapiens
uguguguucuca

SEQ ID NO: 2047920 - RNA, 14 nt, Homo sapiens
caccucacccggcc

SEQ ID NO: 2047921 - RNA, 18 nt, Homo sapiens
ugcauaaaaaggucuuua

SEQ ID NO: 2047922 - RNA, 21 nt, Homo sapiens
ucuuuggucaugggggccaag

SEQ ID NO: 2047923 - RNA, 15 nt, Homo sapiens
agcaggcuacacuga

SEQ ID NO: 2047924 - RNA, 18 nt, Homo sapiens
augugugcauauuuagca

SEQ ID NO: 2047925 - RNA, 20 nt, Homo sapiens
aauuugggggaaaauggcac

SEQ ID NO: 2047926 - RNA, 22 nt, Homo sapiens
cacacucucccauuauauuuau

SEQ ID NO: 2047927 - RNA, 13 nt, Homo sapiens
caagaagggcuag

SEQ ID NO: 2047928 - RNA, 13 nt, Homo sapiens
uuuuacacuguac

SEQ ID NO: 2047929 - RNA, 16 nt, Homo sapiens
cucaaggcugugcagg

SEQ ID NO: 2047930 - RNA, 13 nt, Homo sapiens
acaauacaguauu

SEQ ID NO: 2047931 - RNA, 22 nt, Homo sapiens
agcgaggacauucucugaccua

SEQ ID NO: 2047932 - RNA, 18 nt, Homo sapiens
cucugucgcccuuaguca

SEQ ID NO: 2047933 - RNA, 21 nt, Homo sapiens
uuuguccuccugggucaggga

SEQ ID NO: 2047934 - RNA, 17 nt, Homo sapiens
aguucgaccugcggcug

SEQ ID NO: 2047935 - RNA, 21 nt, Homo sapiens
guggaauuuaaaucacucaaa

SEQ ID NO: 2047936 - RNA, 20 nt, Homo sapiens
gaguugaugggggugugauu

SEQ ID NO: 2047937 - RNA, 21 nt, Homo sapiens
ggcaugauuagauugcaaagc

SEQ ID NO: 2047938 - RNA, 21 nt, Homo sapiens
ccagcgagcaucccgggcaag

SEQ ID NO: 2047939 - RNA, 14 nt, Homo sapiens
caucauaucuacua

SEQ ID NO: 2047940 - RNA, 22 nt, Homo sapiens
uggaaaugacccuauuugauau

SEQ ID NO: 2047941 - RNA, 11 nt, Homo sapiens
cauaccaaaua

SEQ ID NO: 2047942 - RNA, 20 nt, Homo sapiens
acagcuggacccauuugcca

SEQ ID NO: 2047943 - RNA, 16 nt, Homo sapiens
ggcuguguuuccaucu

SEQ ID NO: 2047944 - RNA, 14 nt, Homo sapiens
agucugauauugca

SEQ ID NO: 2047945 - RNA, 20 nt, Homo sapiens
agggguuugagaugcuguag

SEQ ID NO: 2047946 - RNA, 17 nt, Homo sapiens
cuguaugguauaugcau

SEQ ID NO: 2047947 - RNA, 13 nt, Homo sapiens
uaaaaauguccug

SEQ ID NO: 2047948 - RNA, 22 nt, Homo sapiens
auugacuugcacaucucugcag

SEQ ID NO: 2047949 - RNA, 16 nt, Homo sapiens
augugagcucaccagu

SEQ ID NO: 2047950 - RNA, 23 nt, Homo sapiens
aguuaagcaaauuucauuucaca

SEQ ID NO: 2047951 - RNA, 16 nt, Homo sapiens
uaaacagaaauugcaa

SEQ ID NO: 2047952 - RNA, 20 nt, Homo sapiens
ugugccucccuccccagugc

SEQ ID NO: 2047953 - RNA, 23 nt, Homo sapiens
guugcuaaugccuuucaucuuga

SEQ ID NO: 2047954 - RNA, 18 nt, Homo sapiens
cagggccccugugacccc

SEQ ID NO: 2047955 - RNA, 15 nt, Homo sapiens
cagaagaaucuuccu

SEQ ID NO: 2047956 - RNA, 17 nt, Homo sapiens
uuaguuguccucagguu

SEQ ID NO: 2047957 - RNA, 13 nt, Homo sapiens
auaguugucugug

SEQ ID NO: 2047958 - RNA, 23 nt, Homo sapiens
gggcuugaauuugcaugucuaau

SEQ ID NO: 2047959 - RNA, 19 nt, Homo sapiens
acucuuccuggaaugcauu

SEQ ID NO: 2047960 - RNA, 14 nt, Homo sapiens
cuuugucagcauca

SEQ ID NO: 2047961 - RNA, 14 nt, Homo sapiens
uauuguugcaauau

SEQ ID NO: 2047962 - RNA, 19 nt, Homo sapiens
ugccuaguaacacauaugu

SEQ ID NO: 2047963 - RNA, 19 nt, Homo sapiens
ugucucaggccacaccggc

SEQ ID NO: 2047964 - RNA, 21 nt, Homo sapiens
aucugcagggguuugccaaac

SEQ ID NO: 2047965 - RNA, 20 nt, Homo sapiens
uguuauuuccccagccacag

SEQ ID NO: 2047966 - RNA, 19 nt, Homo sapiens
accagagauaauaugagaa

SEQ ID NO: 2047967 - RNA, 17 nt, Homo sapiens
caaccccccagcacuga

SEQ ID NO: 2047968 - RNA, 15 nt, Homo sapiens
gaacagagugcaacc

SEQ ID NO: 2047969 - RNA, 17 nt, Homo sapiens
ugcaaauauaucugcua

SEQ ID NO: 2047970 - RNA, 12 nt, Homo sapiens
augcggccaaag

SEQ ID NO: 2047971 - RNA, 16 nt, Homo sapiens
uuaaagcauaugcuau

SEQ ID NO: 2047972 - RNA, 15 nt, Homo sapiens
caagucauggucaca

SEQ ID NO: 2047973 - RNA, 13 nt, Homo sapiens
ucugcuccugcuu

SEQ ID NO: 2047974 - RNA, 13 nt, Homo sapiens
gugggcaucucaa

SEQ ID NO: 2047975 - RNA, 19 nt, Homo sapiens
uagccauaucagggguaca

SEQ ID NO: 2047976 - RNA, 12 nt, Homo sapiens
uuuaaaucugag

SEQ ID NO: 2047977 - RNA, 14 nt, Homo sapiens
aacaguuacuccag

SEQ ID NO: 2047978 - RNA, 12 nt, Homo sapiens
gaucuguagaag

SEQ ID NO: 2047979 - RNA, 20 nt, Homo sapiens
cagaaaauauuauguguuuc

SEQ ID NO: 2047980 - RNA, 20 nt, Homo sapiens
gacuucuggagaaagcucau

SEQ ID NO: 2047981 - RNA, 13 nt, Homo sapiens
auuaaacuuccuu

SEQ ID NO: 2047982 - RNA, 13 nt, Homo sapiens
agguauaccucag

SEQ ID NO: 2047983 - RNA, 16 nt, Homo sapiens
aagagcugaaacuaua

SEQ ID NO: 2047984 - RNA, 11 nt, Homo sapiens
gggcagggaua

SEQ ID NO: 2047985 - RNA, 20 nt, Homo sapiens
caugacauauuuuugcuuua

SEQ ID NO: 2047986 - RNA, 14 nt, Homo sapiens
ccgggauccagcuc

SEQ ID NO: 2047987 - RNA, 22 nt, Homo sapiens
cucuguuucgguugacccaggu

SEQ ID NO: 2047988 - RNA, 15 nt, Homo sapiens
aagagcuuacaagac

SEQ ID NO: 2047989 - RNA, 18 nt, Homo sapiens
caaaaguuauaggauuag

SEQ ID NO: 2047990 - RNA, 14 nt, Homo sapiens
gucuaacaguuaau

SEQ ID NO: 2047991 - RNA, 15 nt, Homo sapiens
cuagggacuguccua

SEQ ID NO: 2047992 - RNA, 14 nt, Homo sapiens
gggaauauugccaa

SEQ ID NO: 2047993 - RNA, 14 nt, Homo sapiens
cugcucaugacaca

SEQ ID NO: 2047994 - RNA, 18 nt, Homo sapiens
ugaaugcccucacuauug

SEQ ID NO: 2047995 - RNA, 13 nt, Homo sapiens
cucauuuaagaaa

SEQ ID NO: 2047996 - RNA, 15 nt, Homo sapiens
agccugaaccuuaau

SEQ ID NO: 2047997 - RNA, 17 nt, Homo sapiens
cucuaaugucugcagcu

SEQ ID NO: 2047998 - RNA, 16 nt, Homo sapiens
ucacugaucuugucau

SEQ ID NO: 2047999 - RNA, 19 nt, Homo sapiens
uagaccaccuaauaucaau

SEQ ID NO: 2048000 - RNA, 22 nt, Homo sapiens
ucaguagcaucuguaacagcau

SEQ ID NO: 2048001 - RNA, 16 nt, Homo sapiens
ggccucuggcucucau

SEQ ID NO: 2048002 - RNA, 14 nt, Homo sapiens
cucuucaacaugac

SEQ ID NO: 2048003 - RNA, 11 nt, Homo sapiens
guucagacucu

SEQ ID NO: 2048004 - RNA, 17 nt, Homo sapiens
agggguaauugcauucu

SEQ ID NO: 2048005 - RNA, 14 nt, Homo sapiens
agcggccgcugccg

SEQ ID NO: 2048006 - RNA, 18 nt, Homo sapiens
cagcgcaugugugcaugu

SEQ ID NO: 2048007 - RNA, 16 nt, Homo sapiens
uaugauugcauuguau

SEQ ID NO: 2048008 - RNA, 20 nt, Homo sapiens
aguagcaggaccugccaaga

SEQ ID NO: 2048009 - RNA, 23 nt, Homo sapiens
uucuuuaacauacaucuaaguca

SEQ ID NO: 2048010 - RNA, 22 nt, Homo sapiens
ccuccugugucacugaauauca

SEQ ID NO: 2048011 - RNA, 20 nt, Homo sapiens
guuauauuauccaguagaaa

SEQ ID NO: 2048012 - RNA, 21 nt, Homo sapiens
aaaauuuuguaaauaugcaaa

SEQ ID NO: 2048013 - RNA, 20 nt, Homo sapiens
aaacaaagccuuauccagca

SEQ ID NO: 2048014 - RNA, 17 nt, Homo sapiens
gaguggaaucucuugga

SEQ ID NO: 2048015 - RNA, 23 nt, Homo sapiens
guuuguucuguucugggggacag

SEQ ID NO: 2048016 - RNA, 14 nt, Homo sapiens
cagguaaugugaau

SEQ ID NO: 2048017 - RNA, 15 nt, Homo sapiens
cagguaauggcauga

SEQ ID NO: 2048018 - RNA, 21 nt, Homo sapiens
auagugccucagcgcugccca

SEQ ID NO: 2048019 - RNA, 14 nt, Homo sapiens
cauaacuaggauua

SEQ ID NO: 2048020 - RNA, 20 nt, Homo sapiens
uaguuagaauuauaucacuu

SEQ ID NO: 2048021 - RNA, 14 nt, Homo sapiens
gacagcagccuccc

SEQ ID NO: 2048022 - RNA, 13 nt, Homo sapiens
auaaauaugugaa

SEQ ID NO: 2048023 - RNA, 14 nt, Homo sapiens
accucacauacccu

SEQ ID NO: 2048024 - RNA, 18 nt, Homo sapiens
ucacuuauccuguucucu

SEQ ID NO: 2048025 - RNA, 19 nt, Homo sapiens
agcuauuuugguuuagugc

SEQ ID NO: 2048026 - RNA, 14 nt, Homo sapiens
caugcugugcugug

SEQ ID NO: 2048027 - RNA, 13 nt, Homo sapiens
uaaugcugcagga

SEQ ID NO: 2048028 - RNA, 16 nt, Homo sapiens
aggaagcacccguuga

SEQ ID NO: 2048029 - RNA, 13 nt, Homo sapiens
ucagacauuccaa

SEQ ID NO: 2048030 - RNA, 23 nt, Homo sapiens
cuguguauaucucuguaaucucu

SEQ ID NO: 2048031 - RNA, 18 nt, Homo sapiens
aggaaauguaagauuuca

SEQ ID NO: 2048032 - RNA, 16 nt, Homo sapiens
uaaacucacaacucuc

SEQ ID NO: 2048033 - RNA, 22 nt, Homo sapiens
gugaccaacuguuggauucaga

SEQ ID NO: 2048034 - RNA, 12 nt, Homo sapiens
gaggcugugauu

SEQ ID NO: 2048035 - RNA, 21 nt, Homo sapiens
cuuucuacaccuguugcaccu

SEQ ID NO: 2048036 - RNA, 17 nt, Homo sapiens
cgaaguccagcuuucug

SEQ ID NO: 2048037 - RNA, 21 nt, Homo sapiens
uauguuuaucaaagagcacuu

SEQ ID NO: 2048038 - RNA, 15 nt, Homo sapiens
uccucucccagugac

SEQ ID NO: 2048039 - RNA, 14 nt, Homo sapiens
gacucaacauuaca

SEQ ID NO: 2048040 - RNA, 14 nt, Homo sapiens
uuaacaauugccag

SEQ ID NO: 2048041 - RNA, 23 nt, Homo sapiens
aggucgguuuagaugaaugcucc

SEQ ID NO: 2048042 - RNA, 17 nt, Homo sapiens
uaaaauuccuaucucau

SEQ ID NO: 2048043 - RNA, 13 nt, Homo sapiens
uggcaccagauga

SEQ ID NO: 2048044 - RNA, 23 nt, Homo sapiens
uacuuuccuaauuaaacuaugau

SEQ ID NO: 2048045 - RNA, 20 nt, Homo sapiens
gcuccauccuugcaucacug

SEQ ID NO: 2048046 - RNA, 18 nt, Homo sapiens
uauucuccuuugcacugu

SEQ ID NO: 2048047 - RNA, 18 nt, Homo sapiens
gagggaccaggugucuag

SEQ ID NO: 2048048 - RNA, 22 nt, Homo sapiens
augcaugagcucccucgcugua

SEQ ID NO: 2048049 - RNA, 14 nt, Homo sapiens
uguaccacauaaca

SEQ ID NO: 2048050 - RNA, 13 nt, Homo sapiens
uggagcacgugga

SEQ ID NO: 2048051 - RNA, 22 nt, Homo sapiens
ugugagcuaggaauuguguuua

SEQ ID NO: 2048052 - RNA, 15 nt, Homo sapiens
cacagcaacaaugac

SEQ ID NO: 2048053 - RNA, 16 nt, Homo sapiens
aagauggaaagaacca

SEQ ID NO: 2048054 - RNA, 13 nt, Homo sapiens
aaggccaaugggc

SEQ ID NO: 2048055 - RNA, 22 nt, Homo sapiens
ccagaaaguuguguaggcacca

SEQ ID NO: 2048056 - RNA, 22 nt, Homo sapiens
ucauuuccuccgucaccucaga

SEQ ID NO: 2048057 - RNA, 17 nt, Homo sapiens
gaacaguuuaugcagug

SEQ ID NO: 2048058 - RNA, 15 nt, Homo sapiens
agcuuugcagugaaa

SEQ ID NO: 2048059 - RNA, 16 nt, Homo sapiens
guuucuccacaacagc

SEQ ID NO: 2048060 - RNA, 17 nt, Homo sapiens
cuuucucuucccaugca

SEQ ID NO: 2048061 - RNA, 15 nt, Homo sapiens
uacauaacacauauc

SEQ ID NO: 2048062 - RNA, 20 nt, Homo sapiens
cuggaauuuucauacacgua

SEQ ID NO: 2048063 - RNA, 20 nt, Homo sapiens
uauguuuacauaucaccuca

SEQ ID NO: 2048064 - RNA, 18 nt, Homo sapiens
ugaagcugcugucucuag

SEQ ID NO: 2048065 - RNA, 13 nt, Homo sapiens
uagagaugauuca

SEQ ID NO: 2048066 - RNA, 22 nt, Homo sapiens
caccuacaaaauuucaccugca

SEQ ID NO: 2048067 - RNA, 23 nt, Homo sapiens
augcagagggugggguacuggag

SEQ ID NO: 2048068 - RNA, 21 nt, Homo sapiens
gaagcggagagagccaagacg

SEQ ID NO: 2048069 - RNA, 14 nt, Homo sapiens
gccacacacuguuc

SEQ ID NO: 2048070 - RNA, 18 nt, Homo sapiens
caucauuuugcauucaaa

SEQ ID NO: 2048071 - RNA, 16 nt, Homo sapiens
guuguuuaacugugca

SEQ ID NO: 2048072 - RNA, 14 nt, Homo sapiens
ugaaugcuauacug

SEQ ID NO: 2048073 - RNA, 14 nt, Homo sapiens
uuaaaucuagacau

SEQ ID NO: 2048074 - RNA, 21 nt, Homo sapiens
cagcuuuuagaaaaugcaguc

SEQ ID NO: 2048075 - RNA, 18 nt, Homo sapiens
acagagcgagaccgucuc

SEQ ID NO: 2048076 - RNA, 16 nt, Homo sapiens
aagaaucuauaguuca

SEQ ID NO: 2048077 - RNA, 21 nt, Homo sapiens
ggcuuucagcugauuugcaga

SEQ ID NO: 2048078 - RNA, 13 nt, Homo sapiens
acagcucuuggca

SEQ ID NO: 2048079 - RNA, 17 nt, Homo sapiens
aaagucagcgugacaau

SEQ ID NO: 2048080 - RNA, 19 nt, Homo sapiens
ucaaaacaguaauuuccug

SEQ ID NO: 2048081 - RNA, 11 nt, Homo sapiens
uuuaacauuau

SEQ ID NO: 2048082 - RNA, 14 nt, Homo sapiens
ugguuuacugcugu

SEQ ID NO: 2048083 - RNA, 23 nt, Homo sapiens
aauuguuugucuuuaacugucaa

SEQ ID NO: 2048084 - RNA, 15 nt, Homo sapiens
cuguggggacugaac

SEQ ID NO: 2048085 - RNA, 23 nt, Homo sapiens
gacacugauccagucacagccau

SEQ ID NO: 2048086 - RNA, 23 nt, Homo sapiens
ugaagcaagcuguguuacuugaa

SEQ ID NO: 2048087 - RNA, 23 nt, Homo sapiens
ugucucugccucccucacccuga

SEQ ID NO: 2048088 - RNA, 17 nt, Homo sapiens
aggggccacauccaaaa

SEQ ID NO: 2048089 - RNA, 15 nt, Homo sapiens
caucuuggucuuguu

SEQ ID NO: 2048090 - RNA, 14 nt, Homo sapiens
ggaugcgaggacca

SEQ ID NO: 2048091 - RNA, 14 nt, Homo sapiens
gaaacaugugcccc

SEQ ID NO: 2048092 - RNA, 18 nt, Homo sapiens
ucugagggggugggggug

SEQ ID NO: 2048093 - RNA, 20 nt, Homo sapiens
agaggauaauuagcaucuca

SEQ ID NO: 2048094 - RNA, 12 nt, Homo sapiens
aaaguccugaca

SEQ ID NO: 2048095 - RNA, 19 nt, Homo sapiens
gugugcuccagauggugcu

SEQ ID NO: 2048096 - RNA, 16 nt, Homo sapiens
augcaccauggucaaa

SEQ ID NO: 2048097 - RNA, 16 nt, Homo sapiens
uauuuuagaaccacaa

SEQ ID NO: 2048098 - RNA, 14 nt, Homo sapiens
ggcaucauugugac

SEQ ID NO: 2048099 - RNA, 13 nt, Homo sapiens
cucuucuaugcaa

SEQ ID NO: 2048100 - RNA, 15 nt, Homo sapiens
gcucuguaacaucgc

SEQ ID NO: 2048101 - RNA, 16 nt, Homo sapiens
auccaugcuucucauc

SEQ ID NO: 2048102 - RNA, 22 nt, Homo sapiens
gaaaauaaacaucugagucauu

SEQ ID NO: 2048103 - RNA, 11 nt, Homo sapiens
uguguauugac

SEQ ID NO: 2048104 - RNA, 20 nt, Homo sapiens
ccagcgggcccucugccgac

SEQ ID NO: 2048105 - RNA, 18 nt, Homo sapiens
ucgauuuucuauuaugga

SEQ ID NO: 2048106 - RNA, 17 nt, Homo sapiens
uaaaauauggacuucca

SEQ ID NO: 2048107 - RNA, 13 nt, Homo sapiens
cuaaaauauuauu

SEQ ID NO: 2048108 - RNA, 17 nt, Homo sapiens
uggcuuaaaccagaacc

SEQ ID NO: 2048109 - RNA, 22 nt, Homo sapiens
cugggaaggggaacacagacca

SEQ ID NO: 2048110 - RNA, 16 nt, Homo sapiens
uucagauacaaacugc

SEQ ID NO: 2048111 - RNA, 15 nt, Homo sapiens
ccagggcaaauggaa

SEQ ID NO: 2048112 - RNA, 17 nt, Homo sapiens
agauauuuuuaucccaa

SEQ ID NO: 2048113 - RNA, 17 nt, Homo sapiens
ggguuugccaagcccuu

SEQ ID NO: 2048114 - RNA, 19 nt, Homo sapiens
aguuuauggauaugcugcu

SEQ ID NO: 2048115 - RNA, 16 nt, Homo sapiens
acuguugauccugagu

SEQ ID NO: 2048116 - RNA, 18 nt, Homo sapiens
uagauuccuuuccugugu

SEQ ID NO: 2048117 - RNA, 11 nt, Homo sapiens
agacagaccac

SEQ ID NO: 2048118 - RNA, 22 nt, Homo sapiens
aggccuucugggccuccaaagc

SEQ ID NO: 2048119 - RNA, 11 nt, Homo sapiens
guauggaagaa

SEQ ID NO: 2048120 - RNA, 20 nt, Homo sapiens
auucuuaaaucugccuaguu

SEQ ID NO: 2048121 - RNA, 20 nt, Homo sapiens
agccucaugggagucaggga

SEQ ID NO: 2048122 - RNA, 15 nt, Homo sapiens
auaauuccagucaca

SEQ ID NO: 2048123 - RNA, 23 nt, Homo sapiens
aaaauagucauuuuuagcacugg

SEQ ID NO: 2048124 - RNA, 14 nt, Homo sapiens
guuggggugacagu

SEQ ID NO: 2048125 - RNA, 13 nt, Homo sapiens
cagugacuugcaa

SEQ ID NO: 2048126 - RNA, 22 nt, Homo sapiens
gcaagaguuucuuguaagccau

SEQ ID NO: 2048127 - RNA, 15 nt, Homo sapiens
ucagauaccaugcaa

SEQ ID NO: 2048128 - RNA, 20 nt, Homo sapiens
cuuucugccagcaucugcag

SEQ ID NO: 2048129 - RNA, 10 nt, Homo sapiens
ucaaagccag

SEQ ID NO: 2048130 - RNA, 14 nt, Homo sapiens
aggauggcucagac

SEQ ID NO: 2048131 - RNA, 21 nt, Homo sapiens
auuaucccccaaaaugcauuu

SEQ ID NO: 2048132 - RNA, 19 nt, Homo sapiens
gaaacacguaucccaccug

SEQ ID NO: 2048133 - RNA, 14 nt, Homo sapiens
cugcagaggauuua

SEQ ID NO: 2048134 - RNA, 22 nt, Homo sapiens
ugcuuaagguaugguacaagca

SEQ ID NO: 2048135 - RNA, 17 nt, Homo sapiens
acacuaagaaugaggaa

SEQ ID NO: 2048136 - RNA, 13 nt, Homo sapiens
cacucuucugucu

SEQ ID NO: 2048137 - RNA, 16 nt, Homo sapiens
gaaccaacacagacac

SEQ ID NO: 2048138 - RNA, 19 nt, Homo sapiens
guuaaacagccuauuccug

SEQ ID NO: 2048139 - RNA, 14 nt, Homo sapiens
ccuuugggauuugc

SEQ ID NO: 2048140 - RNA, 20 nt, Homo sapiens
agaauaaggcuuuuucuucc

SEQ ID NO: 2048141 - RNA, 20 nt, Homo sapiens
caaagaaaaauaacccuuug

SEQ ID NO: 2048142 - RNA, 15 nt, Homo sapiens
cucacacuuugccau

SEQ ID NO: 2048143 - RNA, 15 nt, Homo sapiens
uacaucuucagcucc

SEQ ID NO: 2048144 - RNA, 18 nt, Homo sapiens
gggcaucugccccucccc

SEQ ID NO: 2048145 - RNA, 19 nt, Homo sapiens
uuaggcuucuauuuccuuu

SEQ ID NO: 2048146 - RNA, 19 nt, Homo sapiens
acagagggaagccaugugg

SEQ ID NO: 2048147 - RNA, 19 nt, Homo sapiens
guccauugaugucauucag

SEQ ID NO: 2048148 - RNA, 20 nt, Homo sapiens
caaaaaaauccuagagauuc

SEQ ID NO: 2048149 - RNA, 22 nt, Homo sapiens
cugauuuuuaaaguacuuucuu

SEQ ID NO: 2048150 - RNA, 21 nt, Homo sapiens
aagcuuuauuaccaguggcgu

SEQ ID NO: 2048151 - RNA, 15 nt, Homo sapiens
aacucggacaaguga

SEQ ID NO: 2048152 - RNA, 16 nt, Homo sapiens
uauaauugaguuuuca

SEQ ID NO: 2048153 - RNA, 15 nt, Homo sapiens
agacaaggaaauacc

SEQ ID NO: 2048154 - RNA, 14 nt, Homo sapiens
agcugcagcucucc

SEQ ID NO: 2048155 - RNA, 14 nt, Homo sapiens
cgcuccagaucugc

SEQ ID NO: 2048156 - RNA, 14 nt, Homo sapiens
caccagccauccuc

SEQ ID NO: 2048157 - RNA, 21 nt, Homo sapiens
caagugauugaagcccaguga

SEQ ID NO: 2048158 - RNA, 13 nt, Homo sapiens
cgcacuguauucc

SEQ ID NO: 2048159 - RNA, 17 nt, Homo sapiens
ucaguaagacagugcag

SEQ ID NO: 2048160 - RNA, 17 nt, Homo sapiens
ucaguaaggcagugcaa

SEQ ID NO: 2048161 - RNA, 18 nt, Homo sapiens
ccucagcucucugggacc

SEQ ID NO: 2048162 - RNA, 18 nt, Homo sapiens
uacguacaccucuugccu

SEQ ID NO: 2048163 - RNA, 17 nt, Homo sapiens
uuuaauuuucuuguaua

SEQ ID NO: 2048164 - RNA, 16 nt, Homo sapiens
ucccauuggucugcau

SEQ ID NO: 2048165 - RNA, 23 nt, Homo sapiens
uguuccacuuguuugcacugugu

SEQ ID NO: 2048166 - RNA, 22 nt, Homo sapiens
gagagcuguucccaaauuuucu

SEQ ID NO: 2048167 - RNA, 14 nt, Homo sapiens
aagacaaacugcau

SEQ ID NO: 2048168 - RNA, 22 nt, Homo sapiens
augcuuuguuuucccacacaua

SEQ ID NO: 2048169 - RNA, 14 nt, Homo sapiens
cagacaccuggacu

SEQ ID NO: 2048170 - RNA, 19 nt, Homo sapiens
cguuggccuaacacugggc

SEQ ID NO: 2048171 - RNA, 20 nt, Homo sapiens
cguaggauuuggggugaaug

SEQ ID NO: 2048172 - RNA, 22 nt, Homo sapiens
aacacuuuggacuucucugaaa

SEQ ID NO: 2048173 - RNA, 13 nt, Homo sapiens
ugucaucugccaa

SEQ ID NO: 2048174 - RNA, 15 nt, Homo sapiens
ugugggcagcuggcu

SEQ ID NO: 2048175 - RNA, 13 nt, Homo sapiens
uucuaaaguaaaa

SEQ ID NO: 2048176 - RNA, 15 nt, Homo sapiens
uucacagugaucgau

SEQ ID NO: 2048177 - RNA, 21 nt, Homo sapiens
cucaauaaacuuuuaccacaa

SEQ ID NO: 2048178 - RNA, 18 nt, Homo sapiens
agccagggcugucuucgu

SEQ ID NO: 2048179 - RNA, 17 nt, Homo sapiens
agacacuguucccaaag

SEQ ID NO: 2048180 - RNA, 13 nt, Homo sapiens
uugaagggccaga

SEQ ID NO: 2048181 - RNA, 12 nt, Homo sapiens
uauaaaccugau

SEQ ID NO: 2048182 - RNA, 19 nt, Homo sapiens
ucuagaauuauaagucaca

SEQ ID NO: 2048183 - RNA, 22 nt, Homo sapiens
augccacacggcucucaccagu

SEQ ID NO: 2048184 - RNA, 16 nt, Homo sapiens
agcugagauugcacua

SEQ ID NO: 2048185 - RNA, 19 nt, Homo sapiens
accuuuggaugcacuuuau

SEQ ID NO: 2048186 - RNA, 15 nt, Homo sapiens
caccagaugaugucc

SEQ ID NO: 2048187 - RNA, 20 nt, Homo sapiens
cacugaucugcuagugcugu

SEQ ID NO: 2048188 - RNA, 15 nt, Homo sapiens
cuguugaaaagcaca

SEQ ID NO: 2048189 - RNA, 19 nt, Homo sapiens
caggauaccagcaaaugga

SEQ ID NO: 2048190 - RNA, 16 nt, Homo sapiens
uuaaccuuugcuaugu

SEQ ID NO: 2048191 - RNA, 20 nt, Homo sapiens
ggccucagguccuacugggg

SEQ ID NO: 2048192 - RNA, 13 nt, Homo sapiens
uuucuccagugcu

SEQ ID NO: 2048193 - RNA, 19 nt, Homo sapiens
cuauaaagaagaacuugca

SEQ ID NO: 2048194 - RNA, 10 nt, Homo sapiens
caauuucacu

SEQ ID NO: 2048195 - RNA, 18 nt, Homo sapiens
gaaaaagacaauaguauu

SEQ ID NO: 2048196 - RNA, 21 nt, Homo sapiens
gacucagggccccagcacuaa

SEQ ID NO: 2048197 - RNA, 17 nt, Homo sapiens
auaaaccuggagaugau

SEQ ID NO: 2048198 - RNA, 16 nt, Homo sapiens
uaaaaagauccugcau

SEQ ID NO: 2048199 - RNA, 14 nt, Homo sapiens
cagaucugugccug

SEQ ID NO: 2048200 - RNA, 15 nt, Homo sapiens
cagugacuccagggu

SEQ ID NO: 2048201 - RNA, 12 nt, Homo sapiens
auccacaagcaa

SEQ ID NO: 2048202 - RNA, 20 nt, Homo sapiens
agaagucucuuccaguuugc

SEQ ID NO: 2048203 - RNA, 21 nt, Homo sapiens
gugugccuccuagagugcagg

SEQ ID NO: 2048204 - RNA, 20 nt, Homo sapiens
cuccuccaccucaccuccau

SEQ ID NO: 2048205 - RNA, 14 nt, Homo sapiens
gcgucuaugcugcu

SEQ ID NO: 2048206 - RNA, 17 nt, Homo sapiens
uccuucgggugcuggaa

SEQ ID NO: 2048207 - RNA, 21 nt, Homo sapiens
gauuacaggcaugagccaccg

SEQ ID NO: 2048208 - RNA, 19 nt, Homo sapiens
caucuccccucagauucca

SEQ ID NO: 2048209 - RNA, 18 nt, Homo sapiens
ucaaggaaaaaugcugcu

SEQ ID NO: 2048210 - RNA, 18 nt, Homo sapiens
ucccaguguuccauuuga

SEQ ID NO: 2048211 - RNA, 11 nt, Homo sapiens
aacuacuuucu

SEQ ID NO: 2048212 - RNA, 19 nt, Homo sapiens
ucugcaucccagcaccugc

SEQ ID NO: 2048213 - RNA, 19 nt, Homo sapiens
acauacauauauaucugau

SEQ ID NO: 2048214 - RNA, 17 nt, Homo sapiens
aggagggggugaccucc

SEQ ID NO: 2048215 - RNA, 22 nt, Homo sapiens
auccuguuacuugcuucagugg

SEQ ID NO: 2048216 - RNA, 15 nt, Homo sapiens
ccucuccaugcaagu

SEQ ID NO: 2048217 - RNA, 13 nt, Homo sapiens
guuaauaacucuc

SEQ ID NO: 2048218 - RNA, 18 nt, Homo sapiens
aggcaagugcaauaaucc

SEQ ID NO: 2048219 - RNA, 18 nt, Homo sapiens
caggcgggggcugcucag

SEQ ID NO: 2048220 - RNA, 16 nt, Homo sapiens
uauucuuugccuuagc

SEQ ID NO: 2048221 - RNA, 21 nt, Homo sapiens
ggucuuauauuuacaacacuu

SEQ ID NO: 2048222 - RNA, 19 nt, Homo sapiens
ugggccccagauaccauga

SEQ ID NO: 2048223 - RNA, 21 nt, Homo sapiens
gacugaggcaggcauggaguu

SEQ ID NO: 2048224 - RNA, 14 nt, Homo sapiens
caggcgaccgggcc

SEQ ID NO: 2048225 - RNA, 21 nt, Homo sapiens
agcauaaaucuguuagcauua

SEQ ID NO: 2048226 - RNA, 15 nt, Homo sapiens
cgugugagcagucuc

SEQ ID NO: 2048227 - RNA, 12 nt, Homo sapiens
cagcaaauuaau

SEQ ID NO: 2048228 - RNA, 20 nt, Homo sapiens
cagcucccacaaaugacagc

SEQ ID NO: 2048229 - RNA, 16 nt, Homo sapiens
gacuccaccucuacca

SEQ ID NO: 2048230 - RNA, 17 nt, Homo sapiens
ucagcaauuuccugcuc

SEQ ID NO: 2048231 - RNA, 20 nt, Homo sapiens
aguguuccccgauaccaugc

SEQ ID NO: 2048232 - RNA, 15 nt, Homo sapiens
gugacaacauuucau

SEQ ID NO: 2048233 - RNA, 16 nt, Homo sapiens
gguggacuuccagcuu

SEQ ID NO: 2048234 - RNA, 19 nt, Homo sapiens
ugcaagcacaucugcauuu

SEQ ID NO: 2048235 - RNA, 14 nt, Homo sapiens
cuggaugguggugc

SEQ ID NO: 2048236 - RNA, 22 nt, Homo sapiens
uguuucgguugacccaggucau

SEQ ID NO: 2048237 - RNA, 15 nt, Homo sapiens
uaauaauguuuaaua

SEQ ID NO: 2048238 - RNA, 23 nt, Homo sapiens
agcacuaauucaacauauaccuu

SEQ ID NO: 2048239 - RNA, 19 nt, Homo sapiens
accagaggagcagaccagc

SEQ ID NO: 2048240 - RNA, 18 nt, Homo sapiens
agacagauggacacugcc

SEQ ID NO: 2048241 - RNA, 21 nt, Homo sapiens
guaaaacugaacuucagagca

SEQ ID NO: 2048242 - RNA, 12 nt, Homo sapiens
caggauuucuca

SEQ ID NO: 2048243 - RNA, 16 nt, Homo sapiens
caucuccauguagaau

SEQ ID NO: 2048244 - RNA, 14 nt, Homo sapiens
cuauaacacuguga

SEQ ID NO: 2048245 - RNA, 14 nt, Homo sapiens
cagaagcacaaagg

SEQ ID NO: 2048246 - RNA, 18 nt, Homo sapiens
gccccugcucacugggcc

SEQ ID NO: 2048247 - RNA, 22 nt, Homo sapiens
cuuaaacuaugaaccuucuuaa

SEQ ID NO: 2048248 - RNA, 16 nt, Homo sapiens
uucugcacuucauauc

SEQ ID NO: 2048249 - RNA, 15 nt, Homo sapiens
cuccuuaaacuacca

SEQ ID NO: 2048250 - RNA, 21 nt, Homo sapiens
aauagauuguuuugccacuua

SEQ ID NO: 2048251 - RNA, 16 nt, Homo sapiens
uccaccucacuagcuc

SEQ ID NO: 2048252 - RNA, 16 nt, Homo sapiens
ucccgcucacucccuc

SEQ ID NO: 2048253 - RNA, 21 nt, Homo sapiens
aaagaaauaaagggugucuau

SEQ ID NO: 2048254 - RNA, 16 nt, Homo sapiens
uauuccucucacccca

SEQ ID NO: 2048255 - RNA, 14 nt, Homo sapiens
uucauccacugaau

SEQ ID NO: 2048256 - RNA, 19 nt, Homo sapiens
auaauguuaacauggacau

SEQ ID NO: 2048257 - RNA, 19 nt, Homo sapiens
cugaagcaaagugcccaug

SEQ ID NO: 2048258 - RNA, 20 nt, Homo sapiens
aaauacuaugcaguaucucu

SEQ ID NO: 2048259 - RNA, 20 nt, Homo sapiens
agacuuuauggagaguucag

SEQ ID NO: 2048260 - RNA, 15 nt, Homo sapiens
gacugugacuuucaa

SEQ ID NO: 2048261 - RNA, 23 nt, Homo sapiens
auuacuugguuugugaauccauc

SEQ ID NO: 2048262 - RNA, 13 nt, Homo sapiens
aauuaucugugau

SEQ ID NO: 2048263 - RNA, 15 nt, Homo sapiens
gcuccuccuccaugc

SEQ ID NO: 2048264 - RNA, 21 nt, Homo sapiens
cauugucucguguacagcucc

SEQ ID NO: 2048265 - RNA, 22 nt, Homo sapiens
aacccauuccaguacaguauuc

SEQ ID NO: 2048266 - RNA, 14 nt, Homo sapiens
auguauauuuacca

SEQ ID NO: 2048267 - RNA, 17 nt, Homo sapiens
ccugggauguaaaccau

SEQ ID NO: 2048268 - RNA, 17 nt, Homo sapiens
ccaaugcacugaugugu

SEQ ID NO: 2048269 - RNA, 12 nt, Homo sapiens
aaagacuggccc

SEQ ID NO: 2048270 - RNA, 14 nt, Homo sapiens
ggccauguccaaag

SEQ ID NO: 2048271 - RNA, 17 nt, Homo sapiens
ugccagcuacucaggag

SEQ ID NO: 2048272 - RNA, 18 nt, Homo sapiens
agcucucugauuccccaa

SEQ ID NO: 2048273 - RNA, 21 nt, Homo sapiens
uuagcauguguugcagcuguc

SEQ ID NO: 2048274 - RNA, 19 nt, Homo sapiens
ugauuacuaucauggcaua

SEQ ID NO: 2048275 - RNA, 15 nt, Homo sapiens
agugaaguugcugcu

SEQ ID NO: 2048276 - RNA, 13 nt, Homo sapiens
aaaauuuaccuaa

SEQ ID NO: 2048277 - RNA, 13 nt, Homo sapiens
caucuuuaacaca

SEQ ID NO: 2048278 - RNA, 12 nt, Homo sapiens
acaaaaaaccag

SEQ ID NO: 2048279 - RNA, 17 nt, Homo sapiens
cauguuauggugcuaau

SEQ ID NO: 2048280 - RNA, 16 nt, Homo sapiens
ccaaagagagcacugu

SEQ ID NO: 2048281 - RNA, 14 nt, Homo sapiens
uggguccuuuucag

SEQ ID NO: 2048282 - RNA, 12 nt, Homo sapiens
uuaauggugccu

SEQ ID NO: 2048283 - RNA, 19 nt, Homo sapiens
cccuccaagaggcuggaaa

SEQ ID NO: 2048284 - RNA, 11 nt, Homo sapiens
ugucucaggag

SEQ ID NO: 2048285 - RNA, 17 nt, Homo sapiens
ugcauuucugucucucu

SEQ ID NO: 2048286 - RNA, 13 nt, Homo sapiens
ccgacugccugug

SEQ ID NO: 2048287 - RNA, 17 nt, Homo sapiens
ugguguaaaaaacaaac

SEQ ID NO: 2048288 - RNA, 22 nt, Homo sapiens
uuuucuuuuguucaacauugua

SEQ ID NO: 2048289 - RNA, 17 nt, Homo sapiens
ugcuaauucaaagcucu

SEQ ID NO: 2048290 - RNA, 13 nt, Homo sapiens
uggaguugcugaa

SEQ ID NO: 2048291 - RNA, 15 nt, Homo sapiens
ccuguaaagucugag

SEQ ID NO: 2048292 - RNA, 18 nt, Homo sapiens
auaaauugcuccuugaca

SEQ ID NO: 2048293 - RNA, 20 nt, Homo sapiens
cagcauguuuccagcacuau

SEQ ID NO: 2048294 - RNA, 23 nt, Homo sapiens
gaauuguuuccuuauuugcacuu

SEQ ID NO: 2048295 - RNA, 17 nt, Homo sapiens
agcaugguuugcaugac

SEQ ID NO: 2048296 - RNA, 17 nt, Homo sapiens
uaaagggagaaaugcca

SEQ ID NO: 2048297 - RNA, 15 nt, Homo sapiens
uuuuuaaaucauuca

SEQ ID NO: 2048298 - RNA, 15 nt, Homo sapiens
acagcauaauugccu

SEQ ID NO: 2048299 - RNA, 12 nt, Homo sapiens
gucccccaaccc

SEQ ID NO: 2048300 - RNA, 21 nt, Homo sapiens
auggucauaaauguuugcugc

SEQ ID NO: 2048301 - RNA, 17 nt, Homo sapiens
augguuuccaauuucau

SEQ ID NO: 2048302 - RNA, 22 nt, Homo sapiens
gcugagugcuagaguaggugca

SEQ ID NO: 2048303 - RNA, 15 nt, Homo sapiens
acgcacccccacugc

SEQ ID NO: 2048304 - RNA, 13 nt, Homo sapiens
ugagaagcugcca

SEQ ID NO: 2048305 - RNA, 13 nt, Homo sapiens
ucccaagcucaga

SEQ ID NO: 2048306 - RNA, 18 nt, Homo sapiens
augaucagcaucugugau

SEQ ID NO: 2048307 - RNA, 18 nt, Homo sapiens
uccacaauucaaaagcac

SEQ ID NO: 2048308 - RNA, 17 nt, Homo sapiens
ucaguuucccuaucucg

SEQ ID NO: 2048309 - RNA, 14 nt, Homo sapiens
ucugcuccaugcag

SEQ ID NO: 2048310 - RNA, 14 nt, Homo sapiens
uuugcugccaaaca

SEQ ID NO: 2048311 - RNA, 17 nt, Homo sapiens
gaaaacugggacgugua

SEQ ID NO: 2048312 - RNA, 19 nt, Homo sapiens
agcacccauuucaaugugu

SEQ ID NO: 2048313 - RNA, 14 nt, Homo sapiens
cuccugggauuuuc

SEQ ID NO: 2048314 - RNA, 20 nt, Homo sapiens
ucaagcgauccuccuuccuc

SEQ ID NO: 2048315 - RNA, 16 nt, Homo sapiens
uuucagcacucagaaa

SEQ ID NO: 2048316 - RNA, 10 nt, Homo sapiens
ccagcacuuu

SEQ ID NO: 2048317 - RNA, 12 nt, Homo sapiens
cuuugugugcau

SEQ ID NO: 2048318 - RNA, 12 nt, Homo sapiens
gcuggugucuag

SEQ ID NO: 2048319 - RNA, 13 nt, Homo sapiens
cuacuaacauccc

SEQ ID NO: 2048320 - RNA, 17 nt, Homo sapiens
agggaauucucuuggcu

SEQ ID NO: 2048321 - RNA, 13 nt, Homo sapiens
acucaggacaucc

SEQ ID NO: 2048322 - RNA, 17 nt, Homo sapiens
uccauuucccacuucca

SEQ ID NO: 2048323 - RNA, 14 nt, Homo sapiens
aggguaaguuguua

SEQ ID NO: 2048324 - RNA, 19 nt, Homo sapiens
uguauaagaagauacacug

SEQ ID NO: 2048325 - RNA, 19 nt, Homo sapiens
gagggacaaaggagccugu

SEQ ID NO: 2048326 - RNA, 22 nt, Homo sapiens
cuugguggccgggggugggggc

SEQ ID NO: 2048327 - RNA, 16 nt, Homo sapiens
aagaugaugaugaucu

SEQ ID NO: 2048328 - RNA, 20 nt, Homo sapiens
auugcuuuucuagauuugau

SEQ ID NO: 2048329 - RNA, 17 nt, Homo sapiens
caaguaggagacacaga

SEQ ID NO: 2048330 - RNA, 20 nt, Homo sapiens
agagaucagcgacccugagg

SEQ ID NO: 2048331 - RNA, 22 nt, Homo sapiens
ucgggaaauuauuaugacucaa

SEQ ID NO: 2048332 - RNA, 22 nt, Homo sapiens
cuccaucuuuauagaaggaauu

SEQ ID NO: 2048333 - RNA, 21 nt, Homo sapiens
acaauucaaacaauucaauca

SEQ ID NO: 2048334 - RNA, 21 nt, Homo sapiens
uccccgcagugugcacuaagg

SEQ ID NO: 2048335 - RNA, 13 nt, Homo sapiens
uuaauacaaagaa

SEQ ID NO: 2048336 - RNA, 19 nt, Homo sapiens
uccuccagcguggugugag

SEQ ID NO: 2048337 - RNA, 16 nt, Homo sapiens
agugguauccugugac

SEQ ID NO: 2048338 - RNA, 22 nt, Homo sapiens
cuguuuggauuauuccucuaca

SEQ ID NO: 2048339 - RNA, 14 nt, Homo sapiens
gaguguaaaccaaa

SEQ ID NO: 2048340 - RNA, 19 nt, Homo sapiens
gcagacgccacagucuccc

SEQ ID NO: 2048341 - RNA, 19 nt, Homo sapiens
gcuuugcggaauugcauac

SEQ ID NO: 2048342 - RNA, 22 nt, Homo sapiens
acuauuuugguaagugcagcuu

SEQ ID NO: 2048343 - RNA, 20 nt, Homo sapiens
gaacccucaggucacaagag

SEQ ID NO: 2048344 - RNA, 12 nt, Homo sapiens
augaggcauuuu

SEQ ID NO: 2048345 - RNA, 19 nt, Homo sapiens
caacagagcgagauuccau

SEQ ID NO: 2048346 - RNA, 16 nt, Homo sapiens
cauuagucucauguga

SEQ ID NO: 2048347 - RNA, 14 nt, Homo sapiens
cugccuuugaucac

SEQ ID NO: 2048348 - RNA, 12 nt, Homo sapiens
aguccucuuucc

SEQ ID NO: 2048349 - RNA, 12 nt, Homo sapiens
auuccucuugcc

SEQ ID NO: 2048350 - RNA, 16 nt, Homo sapiens
gacauaaggagugccu

SEQ ID NO: 2048351 - RNA, 15 nt, Homo sapiens
gccacuucaccaagg

SEQ ID NO: 2048352 - RNA, 15 nt, Homo sapiens
uauuccauaugucua

SEQ ID NO: 2048353 - RNA, 18 nt, Homo sapiens
ugcuuuuccaaacauucu

SEQ ID NO: 2048354 - RNA, 19 nt, Homo sapiens
ccuguuuauauugguauaa

SEQ ID NO: 2048355 - RNA, 14 nt, Homo sapiens
ccuaucuguuuaca

SEQ ID NO: 2048356 - RNA, 15 nt, Homo sapiens
auggguugcauuugg

SEQ ID NO: 2048357 - RNA, 18 nt, Homo sapiens
cugcagcccaaaacccag

SEQ ID NO: 2048358 - RNA, 20 nt, Homo sapiens
ugaccauucuuuugccaaug

SEQ ID NO: 2048359 - RNA, 18 nt, Homo sapiens
agugugggcauagcauua

SEQ ID NO: 2048360 - RNA, 13 nt, Homo sapiens
agagugagugcau

SEQ ID NO: 2048361 - RNA, 18 nt, Homo sapiens
gaugaggcacuucuguca

SEQ ID NO: 2048362 - RNA, 15 nt, Homo sapiens
agaggcuccagaaau

SEQ ID NO: 2048363 - RNA, 12 nt, Homo sapiens
gauuauauucac

SEQ ID NO: 2048364 - RNA, 17 nt, Homo sapiens
ggcuggccgcugugcca

SEQ ID NO: 2048365 - RNA, 17 nt, Homo sapiens
ugaggcuuucagugaua

SEQ ID NO: 2048366 - RNA, 14 nt, Homo sapiens
gcacugaaccacau

SEQ ID NO: 2048367 - RNA, 18 nt, Homo sapiens
agcugcauccuccaagaa

SEQ ID NO: 2048368 - RNA, 14 nt, Homo sapiens
aguauauagccuua

SEQ ID NO: 2048369 - RNA, 14 nt, Homo sapiens
cugagagucugcac

SEQ ID NO: 2048370 - RNA, 15 nt, Homo sapiens
auauagaaguauaaa

SEQ ID NO: 2048371 - RNA, 21 nt, Homo sapiens
gggcgugaaccaccaugccca

SEQ ID NO: 2048372 - RNA, 16 nt, Homo sapiens
uucauuuaguaauuaa

SEQ ID NO: 2048373 - RNA, 17 nt, Homo sapiens
uacuaaaacacugaaaa

SEQ ID NO: 2048374 - RNA, 17 nt, Homo sapiens
cucagagaaucaaagau

SEQ ID NO: 2048375 - RNA, 23 nt, Homo sapiens
uuugauaagcaagaaagauuuca

SEQ ID NO: 2048376 - RNA, 11 nt, Homo sapiens
acuuccaaagg

SEQ ID NO: 2048377 - RNA, 17 nt, Homo sapiens
ucacauguggacuuuua

SEQ ID NO: 2048378 - RNA, 21 nt, Homo sapiens
augaaggagagcccagucucc

SEQ ID NO: 2048379 - RNA, 21 nt, Homo sapiens
ugauaucuauauauguaucua

SEQ ID NO: 2048380 - RNA, 17 nt, Homo sapiens
uuguuuucuacugcuau

SEQ ID NO: 2048381 - RNA, 19 nt, Homo sapiens
gaaucucuuggaugcagcu

SEQ ID NO: 2048382 - RNA, 14 nt, Homo sapiens
cccagauguugcau

SEQ ID NO: 2048383 - RNA, 16 nt, Homo sapiens
ggaccagccucuccac

SEQ ID NO: 2048384 - RNA, 23 nt, Homo sapiens
auuauuuaauugcaacaugaagu

SEQ ID NO: 2048385 - RNA, 15 nt, Homo sapiens
caaugaaaccuuccu

SEQ ID NO: 2048386 - RNA, 22 nt, Homo sapiens
cuggcaguaaccuagugaauuu

SEQ ID NO: 2048387 - RNA, 14 nt, Homo sapiens
ggaaggacauuucc

SEQ ID NO: 2048388 - RNA, 16 nt, Homo sapiens
ugaaguaggugugacu

SEQ ID NO: 2048389 - RNA, 23 nt, Homo sapiens
gcauugagacaucuggcggccaa

SEQ ID NO: 2048390 - RNA, 17 nt, Homo sapiens
uucaggaagguaucaca

SEQ ID NO: 2048391 - RNA, 19 nt, Homo sapiens
ugaaacagcugcccugugu

SEQ ID NO: 2048392 - RNA, 18 nt, Homo sapiens
cuuccuuuaggaucucag

SEQ ID NO: 2048393 - RNA, 15 nt, Homo sapiens
auacauaauacauga

SEQ ID NO: 2048394 - RNA, 15 nt, Homo sapiens
aacauuccagagaaa

SEQ ID NO: 2048395 - RNA, 22 nt, Homo sapiens
ccuguuacugagaugucuucaa

SEQ ID NO: 2048396 - RNA, 20 nt, Homo sapiens
ugguguggagggcgccaucu

SEQ ID NO: 2048397 - RNA, 23 nt, Homo sapiens
acucagguucuucagggccaguc

SEQ ID NO: 2048398 - RNA, 13 nt, Homo sapiens
cuugcaguaucuc

SEQ ID NO: 2048399 - RNA, 15 nt, Homo sapiens
aguguuccauuugaa

SEQ ID NO: 2048400 - RNA, 21 nt, Homo sapiens
ccagcacuuuagaucacuuga

SEQ ID NO: 2048401 - RNA, 20 nt, Homo sapiens
uaaauauggacugcucagga

SEQ ID NO: 2048402 - RNA, 19 nt, Homo sapiens
ccaaagauagacagguccu

SEQ ID NO: 2048403 - RNA, 16 nt, Homo sapiens
ucaagcagucgugccu

SEQ ID NO: 2048404 - RNA, 13 nt, Homo sapiens
acuauuucuuuca

SEQ ID NO: 2048405 - RNA, 19 nt, Homo sapiens
agcauguggugauuggcca

SEQ ID NO: 2048406 - RNA, 21 nt, Homo sapiens
aaaggaaaaccaucucuguga

SEQ ID NO: 2048407 - RNA, 12 nt, Homo sapiens
gaguauaccucc

SEQ ID NO: 2048408 - RNA, 22 nt, Homo sapiens
uaguccaaauaacaaguaccaa

SEQ ID NO: 2048409 - RNA, 16 nt, Homo sapiens
acacugccuguauacu

SEQ ID NO: 2048410 - RNA, 11 nt, Homo sapiens
cugugccuaac

SEQ ID NO: 2048411 - RNA, 22 nt, Homo sapiens
aggcccacccugcuuggcccag

SEQ ID NO: 2048412 - RNA, 22 nt, Homo sapiens
gguggucacaggcugugccuug

SEQ ID NO: 2048413 - RNA, 16 nt, Homo sapiens
agggacgccugggggu

SEQ ID NO: 2048414 - RNA, 16 nt, Homo sapiens
cuccccgagggcucag

SEQ ID NO: 2048415 - RNA, 16 nt, Homo sapiens
aguuagagcugacaca

SEQ ID NO: 2048416 - RNA, 14 nt, Homo sapiens
cccagaacuaggag

SEQ ID NO: 2048417 - RNA, 20 nt, Homo sapiens
cuuuaaugauaugcuuguaa

SEQ ID NO: 2048418 - RNA, 18 nt, Homo sapiens
uccagugacuuucaggaa

SEQ ID NO: 2048419 - RNA, 12 nt, Homo sapiens
aaccacacugga

SEQ ID NO: 2048420 - RNA, 16 nt, Homo sapiens
ugacauaaguauuuaa

SEQ ID NO: 2048421 - RNA, 14 nt, Homo sapiens
uggccaguugccca

SEQ ID NO: 2048422 - RNA, 19 nt, Homo sapiens
ucccuggucccucguccac

SEQ ID NO: 2048423 - RNA, 21 nt, Homo sapiens
uaacuaaaagguaugcaauca

SEQ ID NO: 2048424 - RNA, 23 nt, Homo sapiens
uaaagcuguuauucuuguuauac

SEQ ID NO: 2048425 - RNA, 13 nt, Homo sapiens
aucuaguuuacag

SEQ ID NO: 2048426 - RNA, 13 nt, Homo sapiens
aagagacagagcc

SEQ ID NO: 2048427 - RNA, 13 nt, Homo sapiens
aggccacagggag

SEQ ID NO: 2048428 - RNA, 17 nt, Homo sapiens
cauagguaaaaacugga

SEQ ID NO: 2048429 - RNA, 15 nt, Homo sapiens
aaauauacauauaaa

SEQ ID NO: 2048430 - RNA, 19 nt, Homo sapiens
auacacacacacacacagc

SEQ ID NO: 2048431 - RNA, 19 nt, Homo sapiens
ccucucagagccucagcuu

SEQ ID NO: 2048432 - RNA, 21 nt, Homo sapiens
gcccugacuuucuaaugggcu

SEQ ID NO: 2048433 - RNA, 14 nt, Homo sapiens
cagcccggcugcug

SEQ ID NO: 2048434 - RNA, 17 nt, Homo sapiens
agcagagaaaauuguga

SEQ ID NO: 2048435 - RNA, 15 nt, Homo sapiens
accgccauggugcug

SEQ ID NO: 2048436 - RNA, 17 nt, Homo sapiens
aaaauuaacaugucaca

SEQ ID NO: 2048437 - RNA, 14 nt, Homo sapiens
caaggaaaauggac

SEQ ID NO: 2048438 - RNA, 21 nt, Homo sapiens
acccuccuguaaaauacuauu

SEQ ID NO: 2048439 - RNA, 23 nt, Homo sapiens
ucgggaaccucacucuugccaac

SEQ ID NO: 2048440 - RNA, 15 nt, Homo sapiens
ugugggaaauccaca

SEQ ID NO: 2048441 - RNA, 12 nt, Homo sapiens
aaaaguuuacaa

SEQ ID NO: 2048442 - RNA, 19 nt, Homo sapiens
ggcauuuuccacuaguuuu

SEQ ID NO: 2048443 - RNA, 21 nt, Homo sapiens
gugcuuuuugggaccaucacu

SEQ ID NO: 2048444 - RNA, 15 nt, Homo sapiens
uguauucccagccug

SEQ ID NO: 2048445 - RNA, 15 nt, Homo sapiens
cugcagaaauuugca

SEQ ID NO: 2048446 - RNA, 15 nt, Homo sapiens
uaaucuuuaaacugg

SEQ ID NO: 2048447 - RNA, 13 nt, Homo sapiens
aaaacaugcagaa

SEQ ID NO: 2048448 - RNA, 15 nt, Homo sapiens
accaugaaaacaaug

SEQ ID NO: 2048449 - RNA, 14 nt, Homo sapiens
uucaaaacuuucag

SEQ ID NO: 2048450 - RNA, 13 nt, Homo sapiens
uccuuggcuuuau

SEQ ID NO: 2048451 - RNA, 14 nt, Homo sapiens
cagagagacuggcc

SEQ ID NO: 2048452 - RNA, 22 nt, Homo sapiens
aagaugcuucucacugccaugc

SEQ ID NO: 2048453 - RNA, 15 nt, Homo sapiens
cauagaaucugugac

SEQ ID NO: 2048454 - RNA, 16 nt, Homo sapiens
uguugccaaaaccaaa

SEQ ID NO: 2048455 - RNA, 16 nt, Homo sapiens
aauuauuguaaacuuu

SEQ ID NO: 2048456 - RNA, 23 nt, Homo sapiens
uggugcuaauguacuuucacuuu

SEQ ID NO: 2048457 - RNA, 12 nt, Homo sapiens
auuccaaagcaa

SEQ ID NO: 2048458 - RNA, 16 nt, Homo sapiens
ugcuaaauaaacaaca

SEQ ID NO: 2048459 - RNA, 22 nt, Homo sapiens
uguauauccauauaacaauuca

SEQ ID NO: 2048460 - RNA, 22 nt, Homo sapiens
agucaauccaagagucugauga

SEQ ID NO: 2048461 - RNA, 20 nt, Homo sapiens
aguaugugguacuacuguaa

SEQ ID NO: 2048462 - RNA, 13 nt, Homo sapiens
uccucagcugaca

SEQ ID NO: 2048463 - RNA, 14 nt, Homo sapiens
gcuuaugagcacag

SEQ ID NO: 2048464 - RNA, 19 nt, Homo sapiens
ucuacuaaaaauacaaaaa

SEQ ID NO: 2048465 - RNA, 13 nt, Homo sapiens
ugucuccacugug

SEQ ID NO: 2048466 - RNA, 18 nt, Homo sapiens
cugccauuucugagauca

SEQ ID NO: 2048467 - RNA, 19 nt, Homo sapiens
augauuccaccuacaugag

SEQ ID NO: 2048468 - RNA, 12 nt, Homo sapiens
aagcgauucuca

SEQ ID NO: 2048469 - RNA, 17 nt, Homo sapiens
uggcugagguuccucug

SEQ ID NO: 2048470 - RNA, 19 nt, Homo sapiens
caaucucagcucacugcaa

SEQ ID NO: 2048471 - RNA, 15 nt, Homo sapiens
ggaucuaccccagga

SEQ ID NO: 2048472 - RNA, 14 nt, Homo sapiens
cugggccaggagcc

SEQ ID NO: 2048473 - RNA, 20 nt, Homo sapiens
agcacgcuaccaaaucucaa

SEQ ID NO: 2048474 - RNA, 18 nt, Homo sapiens
agcugaccugguacugag

SEQ ID NO: 2048475 - RNA, 23 nt, Homo sapiens
gaauccuagcacuugucucagga

SEQ ID NO: 2048476 - RNA, 14 nt, Homo sapiens
aguaaaugcgugcu

SEQ ID NO: 2048477 - RNA, 21 nt, Homo sapiens
gcucaugcacaucagcuggug

SEQ ID NO: 2048478 - RNA, 14 nt, Homo sapiens
acuuucuguaauca

SEQ ID NO: 2048479 - RNA, 14 nt, Homo sapiens
aaacccugucucua

SEQ ID NO: 2048480 - RNA, 19 nt, Homo sapiens
uggaugcaugcccuaagag

SEQ ID NO: 2048481 - RNA, 19 nt, Homo sapiens
ccaaguagcugggauuaca

SEQ ID NO: 2048482 - RNA, 21 nt, Homo sapiens
cccauggcuuuagcuaccuca

SEQ ID NO: 2048483 - RNA, 15 nt, Homo sapiens
uggcuucuuuacuua

SEQ ID NO: 2048484 - RNA, 14 nt, Homo sapiens
cauggcagagcagu

SEQ ID NO: 2048485 - RNA, 20 nt, Homo sapiens
aaugguaguuuuacaguguu

SEQ ID NO: 2048486 - RNA, 15 nt, Homo sapiens
uuuuggaacauuucu

SEQ ID NO: 2048487 - RNA, 12 nt, Homo sapiens
ucagcagucagu

SEQ ID NO: 2048488 - RNA, 24 nt, Homo sapiens
ugaacuuggaaagaaaugcccauc

SEQ ID NO: 2048489 - RNA, 22 nt, Homo sapiens
caccccaauugggaaugcaaua

SEQ ID NO: 2048490 - RNA, 16 nt, Homo sapiens
cagaauuuuaaagagc

SEQ ID NO: 2048491 - RNA, 15 nt, Homo sapiens
agaauguaucuguga

SEQ ID NO: 2048492 - RNA, 22 nt, Homo sapiens
ugacagguuggccguuugcuua

SEQ ID NO: 2048493 - RNA, 17 nt, Homo sapiens
aguucuguuguccauca

SEQ ID NO: 2048494 - RNA, 19 nt, Homo sapiens
guaccaaauuuaagcaaga

SEQ ID NO: 2048495 - RNA, 14 nt, Homo sapiens
ccaaugccuugaca

SEQ ID NO: 2048496 - RNA, 14 nt, Homo sapiens
aguuuuuugaacau

SEQ ID NO: 2048497 - RNA, 20 nt, Homo sapiens
gggcagggaggcaacacugc

SEQ ID NO: 2048498 - RNA, 17 nt, Homo sapiens
agcugaaaguucuugcu

SEQ ID NO: 2048499 - RNA, 16 nt, Homo sapiens
acuucugccucuaagc

SEQ ID NO: 2048500 - RNA, 22 nt, Homo sapiens
ccaucucccaaggcugccagac

SEQ ID NO: 2048501 - RNA, 14 nt, Homo sapiens
ccccagcauuccag

SEQ ID NO: 2048502 - RNA, 16 nt, Homo sapiens
gaagguuuucauuugc

SEQ ID NO: 2048503 - RNA, 17 nt, Homo sapiens
aaggaauuuucaccucc

SEQ ID NO: 2048504 - RNA, 19 nt, Homo sapiens
uugugauuagacagaacac

SEQ ID NO: 2048505 - RNA, 19 nt, Homo sapiens
aaagcuuggugucuuggca

SEQ ID NO: 2048506 - RNA, 18 nt, Homo sapiens
uuacuaaagggugcaugu

SEQ ID NO: 2048507 - RNA, 21 nt, Homo sapiens
cuucacgccuccccuuuguga

SEQ ID NO: 2048508 - RNA, 23 nt, Homo sapiens
gccgaauugucuuuggugcuuuu

SEQ ID NO: 2048509 - RNA, 23 nt, Homo sapiens
uguuaauguuugcauuuccucag

SEQ ID NO: 2048510 - RNA, 15 nt, Homo sapiens
cagcacucagagaca

SEQ ID NO: 2048511 - RNA, 17 nt, Homo sapiens
gcuagguagaacacugc

SEQ ID NO: 2048512 - RNA, 17 nt, Homo sapiens
uuaaaaaggaacugcag

SEQ ID NO: 2048513 - RNA, 18 nt, Homo sapiens
ucacacagggcucuuuga

SEQ ID NO: 2048514 - RNA, 21 nt, Homo sapiens
caacuccauuuucugugagaa

SEQ ID NO: 2048515 - RNA, 13 nt, Homo sapiens
auuauaugugcac

SEQ ID NO: 2048516 - RNA, 20 nt, Homo sapiens
ugccaaggcuggagugcagu

SEQ ID NO: 2048517 - RNA, 20 nt, Homo sapiens
ugcccaggcuggcgugcagu

SEQ ID NO: 2048518 - RNA, 14 nt, Homo sapiens
aauccugaccugag

SEQ ID NO: 2048519 - RNA, 19 nt, Homo sapiens
acaggggauucuccuccuu

SEQ ID NO: 2048520 - RNA, 18 nt, Homo sapiens
cuuggcacacugccagug

SEQ ID NO: 2048521 - RNA, 18 nt, Homo sapiens
ucaugugacucuuuccaa

SEQ ID NO: 2048522 - RNA, 18 nt, Homo sapiens
aaccugcacuucauaucu

SEQ ID NO: 2048523 - RNA, 18 nt, Homo sapiens
cgagggucaggacuguga

SEQ ID NO: 2048524 - RNA, 23 nt, Homo sapiens
auuuuagcuaaauucagggagau

SEQ ID NO: 2048525 - RNA, 20 nt, Homo sapiens
gcacuuuuuuuauaagcaaa

SEQ ID NO: 2048526 - RNA, 17 nt, Homo sapiens
gguuuaucagcaaaaaa

SEQ ID NO: 2048527 - RNA, 16 nt, Homo sapiens
ucaaagauguacugag

SEQ ID NO: 2048528 - RNA, 15 nt, Homo sapiens
agauaauacaccacu

SEQ ID NO: 2048529 - RNA, 14 nt, Homo sapiens
uaaugagagcacuu

SEQ ID NO: 2048530 - RNA, 17 nt, Homo sapiens
auaguaaacacagggaa

SEQ ID NO: 2048531 - RNA, 15 nt, Homo sapiens
augaugacucaaggc

SEQ ID NO: 2048532 - RNA, 17 nt, Homo sapiens
cugguauaaagcucuca

SEQ ID NO: 2048533 - RNA, 18 nt, Homo sapiens
uuaucccagugaucaccu

SEQ ID NO: 2048534 - RNA, 22 nt, Homo sapiens
cagcaaaaaucucccagugaca

SEQ ID NO: 2048535 - RNA, 19 nt, Homo sapiens
cauguggccccaggugcca

SEQ ID NO: 2048536 - RNA, 23 nt, Homo sapiens
ccaccucagagcuguucaggaag

SEQ ID NO: 2048537 - RNA, 10 nt, Homo sapiens
ccagaaggca

SEQ ID NO: 2048538 - RNA, 19 nt, Homo sapiens
cacuauaauguaagcucua

SEQ ID NO: 2048539 - RNA, 15 nt, Homo sapiens
uuggugacucugucc

SEQ ID NO: 2048540 - RNA, 16 nt, Homo sapiens
ugucuucccucucuau

SEQ ID NO: 2048541 - RNA, 19 nt, Homo sapiens
aagcaguaagcuaucuuca

SEQ ID NO: 2048542 - RNA, 16 nt, Homo sapiens
cuuccagcccuuucag

SEQ ID NO: 2048543 - RNA, 14 nt, Homo sapiens
uuugcuugacuuca

SEQ ID NO: 2048544 - RNA, 17 nt, Homo sapiens
uaaacccauaaguuuaa

SEQ ID NO: 2048545 - RNA, 20 nt, Homo sapiens
acagggaaaacugcaaagcu

SEQ ID NO: 2048546 - RNA, 18 nt, Homo sapiens
ugauauguaaacauaauu

SEQ ID NO: 2048547 - RNA, 23 nt, Homo sapiens
ucaggaggaaagaauugcuccaa

SEQ ID NO: 2048548 - RNA, 19 nt, Homo sapiens
ggcccccacccaccuggau

SEQ ID NO: 2048549 - RNA, 15 nt, Homo sapiens
gaugacacuagucag

SEQ ID NO: 2048550 - RNA, 15 nt, Homo sapiens
ugcgagcauuucccu

SEQ ID NO: 2048551 - RNA, 21 nt, Homo sapiens
agccuggucccacgagggugc

SEQ ID NO: 2048552 - RNA, 22 nt, Homo sapiens
ggauaaagaauacuauuuccaa

SEQ ID NO: 2048553 - RNA, 19 nt, Homo sapiens
uauuaucugucagcugcaa

SEQ ID NO: 2048554 - RNA, 14 nt, Homo sapiens
uccagaagcugccc

SEQ ID NO: 2048555 - RNA, 23 nt, Homo sapiens
agccaucaauauucagcaaaaug

SEQ ID NO: 2048556 - RNA, 22 nt, Homo sapiens
accuaaacauagaaauugccug

SEQ ID NO: 2048557 - RNA, 14 nt, Homo sapiens
uguguauacauaca

SEQ ID NO: 2048558 - RNA, 12 nt, Homo sapiens
ugacauaccuac

SEQ ID NO: 2048559 - RNA, 15 nt, Homo sapiens
ugcccguauccagag

SEQ ID NO: 2048560 - RNA, 17 nt, Homo sapiens
aggcagagguggugggg

SEQ ID NO: 2048561 - RNA, 12 nt, Homo sapiens
caguaaucuuua

SEQ ID NO: 2048562 - RNA, 20 nt, Homo sapiens
cacugcccacaugggaccug

SEQ ID NO: 2048563 - RNA, 18 nt, Homo sapiens
agcugguucaguacuguc

SEQ ID NO: 2048564 - RNA, 13 nt, Homo sapiens
cagcaugccccuu

SEQ ID NO: 2048565 - RNA, 20 nt, Homo sapiens
aaaaugguguuuucauguaa

SEQ ID NO: 2048566 - RNA, 16 nt, Homo sapiens
gcucugguuagaaaaa

SEQ ID NO: 2048567 - RNA, 13 nt, Homo sapiens
ugaacaguaacau

SEQ ID NO: 2048568 - RNA, 13 nt, Homo sapiens
gaggauaaagggc

SEQ ID NO: 2048569 - RNA, 13 nt, Homo sapiens
caagagugggggg

SEQ ID NO: 2048570 - RNA, 15 nt, Homo sapiens
gcugcucuccugaca

SEQ ID NO: 2048571 - RNA, 22 nt, Homo sapiens
gaauuuuuacuuagauacuaau

SEQ ID NO: 2048572 - RNA, 20 nt, Homo sapiens
acaggaaguacuggagaaaa

SEQ ID NO: 2048573 - RNA, 22 nt, Homo sapiens
gaguuuagcuguaacaguucuu

SEQ ID NO: 2048574 - RNA, 13 nt, Homo sapiens
uuccucuugccuc

SEQ ID NO: 2048575 - RNA, 21 nt, Homo sapiens
ccuucugaacaugagugucaa

SEQ ID NO: 2048576 - RNA, 18 nt, Homo sapiens
aucucaguccucaaagcu

SEQ ID NO: 2048577 - RNA, 11 nt, Homo sapiens
aaccugcaaau

SEQ ID NO: 2048578 - RNA, 15 nt, Homo sapiens
aggccaguaauccca

SEQ ID NO: 2048579 - RNA, 18 nt, Homo sapiens
cuucuuuaaaaaaacaca

SEQ ID NO: 2048580 - RNA, 16 nt, Homo sapiens
caggaguccaagacca

SEQ ID NO: 2048581 - RNA, 15 nt, Homo sapiens
auggcaccgagacaa

SEQ ID NO: 2048582 - RNA, 20 nt, Homo sapiens
gccccagaguagcuggaauu

SEQ ID NO: 2048583 - RNA, 16 nt, Homo sapiens
ccaucagcacucugua

SEQ ID NO: 2048584 - RNA, 20 nt, Homo sapiens
gauugucuuagacacugugg

SEQ ID NO: 2048585 - RNA, 21 nt, Homo sapiens
ugauacuaucucuugucauau

SEQ ID NO: 2048586 - RNA, 20 nt, Homo sapiens
aauguacguuacagcuuuca

SEQ ID NO: 2048587 - RNA, 17 nt, Homo sapiens
gaggggacugcaugcaa

SEQ ID NO: 2048588 - RNA, 12 nt, Homo sapiens
accuacuuccuc

SEQ ID NO: 2048589 - RNA, 22 nt, Homo sapiens
gugucacuacucacagucucuu

SEQ ID NO: 2048590 - RNA, 23 nt, Homo sapiens
aacacuagagaccaaaaagggga

SEQ ID NO: 2048591 - RNA, 20 nt, Homo sapiens
agcaaauuccaauacauuau

SEQ ID NO: 2048592 - RNA, 20 nt, Homo sapiens
acugguaaaauacauauaaa

SEQ ID NO: 2048593 - RNA, 21 nt, Homo sapiens
agcucccacacccaccucugc

SEQ ID NO: 2048594 - RNA, 20 nt, Homo sapiens
guaaucccagcacuauggga

SEQ ID NO: 2048595 - RNA, 14 nt, Homo sapiens
agcgcgugcacagc

SEQ ID NO: 2048596 - RNA, 23 nt, Homo sapiens
uggauaaccacagggcugggcua

SEQ ID NO: 2048597 - RNA, 19 nt, Homo sapiens
uguaacacuguuuauugaa

SEQ ID NO: 2048598 - RNA, 17 nt, Homo sapiens
caaauccauaauuauua

SEQ ID NO: 2048599 - RNA, 19 nt, Homo sapiens
cuugugaggcaucacggaa

SEQ ID NO: 2048600 - RNA, 14 nt, Homo sapiens
uuuacgaaaccaaa

SEQ ID NO: 2048601 - RNA, 14 nt, Homo sapiens
ugauccuaaccuug

SEQ ID NO: 2048602 - RNA, 20 nt, Homo sapiens
ucgcuaugugacuugcgcuu

SEQ ID NO: 2048603 - RNA, 18 nt, Homo sapiens
cucucuuagggaaaccaa

SEQ ID NO: 2048604 - RNA, 15 nt, Homo sapiens
gaaccauuacuguaa

SEQ ID NO: 2048605 - RNA, 15 nt, Homo sapiens
aacccucagcacugu

SEQ ID NO: 2048606 - RNA, 22 nt, Homo sapiens
aaaaccauaaacauuugccaaa

SEQ ID NO: 2048607 - RNA, 23 nt, Homo sapiens
uucuuaaccaagaaacaaauaau

SEQ ID NO: 2048608 - RNA, 12 nt, Homo sapiens
gacuugaucacu

SEQ ID NO: 2048609 - RNA, 12 nt, Homo sapiens
uuccaagacagu

SEQ ID NO: 2048610 - RNA, 15 nt, Homo sapiens
cuucugauacgugua

SEQ ID NO: 2048611 - RNA, 22 nt, Homo sapiens
caaacauggagaaaucuacuga

SEQ ID NO: 2048612 - RNA, 14 nt, Homo sapiens
ccaaauaagauucc

SEQ ID NO: 2048613 - RNA, 22 nt, Homo sapiens
ccuuaaugucaccaugcuugug

SEQ ID NO: 2048614 - RNA, 22 nt, Homo sapiens
guagcagggggagugcugguca

SEQ ID NO: 2048615 - RNA, 18 nt, Homo sapiens
gcccaagugccaucccac

SEQ ID NO: 2048616 - RNA, 22 nt, Homo sapiens
cagaucgggagcaaaccaaaga

SEQ ID NO: 2048617 - RNA, 21 nt, Homo sapiens
caaccauuagauaaacacagg

SEQ ID NO: 2048618 - RNA, 21 nt, Homo sapiens
ggcaagauccaggugguccca

SEQ ID NO: 2048619 - RNA, 15 nt, Homo sapiens
ggaacauuugauauu

SEQ ID NO: 2048620 - RNA, 14 nt, Homo sapiens
ccucucacuuucag

SEQ ID NO: 2048621 - RNA, 17 nt, Homo sapiens
uguagaacacuaauuca

SEQ ID NO: 2048622 - RNA, 19 nt, Homo sapiens
uaccuguacacacacagac

SEQ ID NO: 2048623 - RNA, 15 nt, Homo sapiens
agugaagaacacuac

SEQ ID NO: 2048624 - RNA, 19 nt, Homo sapiens
ugaauguuuaccaugaaga

SEQ ID NO: 2048625 - RNA, 16 nt, Homo sapiens
gccaguccuguccuuu

SEQ ID NO: 2048626 - RNA, 21 nt, Homo sapiens
gauugaaauuccaguugcaau

SEQ ID NO: 2048627 - RNA, 12 nt, Homo sapiens
uucuguauuuga

SEQ ID NO: 2048628 - RNA, 15 nt, Homo sapiens
gccaguacuacugcu

SEQ ID NO: 2048629 - RNA, 14 nt, Homo sapiens
ccugcuccuggagu

SEQ ID NO: 2048630 - RNA, 17 nt, Homo sapiens
ggcugaacagugcucug

SEQ ID NO: 2048631 - RNA, 13 nt, Homo sapiens
aguugucuguccu

SEQ ID NO: 2048632 - RNA, 14 nt, Homo sapiens
cuccccagagcacu

SEQ ID NO: 2048633 - RNA, 21 nt, Homo sapiens
ugggccuccugacagcaauaa

SEQ ID NO: 2048634 - RNA, 14 nt, Homo sapiens
uugugucuggugca

SEQ ID NO: 2048635 - RNA, 13 nt, Homo sapiens
gagggaugggaga

SEQ ID NO: 2048636 - RNA, 16 nt, Homo sapiens
gaaugauugcuuuuaa

SEQ ID NO: 2048637 - RNA, 15 nt, Homo sapiens
acacucaccaguggc

SEQ ID NO: 2048638 - RNA, 19 nt, Homo sapiens
gaucaucuauguauucaag

SEQ ID NO: 2048639 - RNA, 14 nt, Homo sapiens
guuguuacuggaag

SEQ ID NO: 2048640 - RNA, 15 nt, Homo sapiens
augaugucuaccuca

SEQ ID NO: 2048641 - RNA, 19 nt, Homo sapiens
cagcaaacguugggcauca

SEQ ID NO: 2048642 - RNA, 18 nt, Homo sapiens
ccucggcagucacuucca

SEQ ID NO: 2048643 - RNA, 13 nt, Homo sapiens
acaacagccaaaa

SEQ ID NO: 2048644 - RNA, 13 nt, Homo sapiens
aaaaaagcccaac

SEQ ID NO: 2048645 - RNA, 15 nt, Homo sapiens
gaacuauuaauucca

SEQ ID NO: 2048646 - RNA, 16 nt, Homo sapiens
acauuauuagcacuuc

SEQ ID NO: 2048647 - RNA, 21 nt, Homo sapiens
ccucacuucagguauaccuca

SEQ ID NO: 2048648 - RNA, 18 nt, Homo sapiens
aaaaggcacugugaacua

SEQ ID NO: 2048649 - RNA, 18 nt, Homo sapiens
auaggauuuucacacauu

SEQ ID NO: 2048650 - RNA, 20 nt, Homo sapiens
ugugaaggacaugagacuaa

SEQ ID NO: 2048651 - RNA, 15 nt, Homo sapiens
accuuccaacacucc

SEQ ID NO: 2048652 - RNA, 14 nt, Homo sapiens
agcccccacccggu

SEQ ID NO: 2048653 - RNA, 17 nt, Homo sapiens
aauauuuaaguauauag

SEQ ID NO: 2048654 - RNA, 22 nt, Homo sapiens
uucuaguguaaaucaugcaagc

SEQ ID NO: 2048655 - RNA, 23 nt, Homo sapiens
gaauuuguauaauaaagcuuuca

SEQ ID NO: 2048656 - RNA, 23 nt, Homo sapiens
agcauugccagcucuuccaaucu

SEQ ID NO: 2048657 - RNA, 17 nt, Homo sapiens
gcugaguagcucugccu

SEQ ID NO: 2048658 - RNA, 21 nt, Homo sapiens
ugcccucuuaagugugcacag

SEQ ID NO: 2048659 - RNA, 19 nt, Homo sapiens
aaaugccugcuuugaauaa

SEQ ID NO: 2048660 - RNA, 13 nt, Homo sapiens
uaaaaacuaguag

SEQ ID NO: 2048661 - RNA, 18 nt, Homo sapiens
uacuguuuauaucuucac

SEQ ID NO: 2048662 - RNA, 16 nt, Homo sapiens
cacucaugaagcauac

SEQ ID NO: 2048663 - RNA, 23 nt, Homo sapiens
aguuucuccuuuugaccaaauaa

SEQ ID NO: 2048664 - RNA, 14 nt, Homo sapiens
aguggcaacguagu

SEQ ID NO: 2048665 - RNA, 14 nt, Homo sapiens
caaaacaaaaagau

SEQ ID NO: 2048666 - RNA, 19 nt, Homo sapiens
aggccugaaauguuuccag

SEQ ID NO: 2048667 - RNA, 14 nt, Homo sapiens
aucuuguagcuuua

SEQ ID NO: 2048668 - RNA, 16 nt, Homo sapiens
ugcaggaucucaccag

SEQ ID NO: 2048669 - RNA, 17 nt, Homo sapiens
aucuuccauaugcucuu

SEQ ID NO: 2048670 - RNA, 12 nt, Homo sapiens
aauacaguauac

SEQ ID NO: 2048671 - RNA, 12 nt, Homo sapiens
aaaacaguauuc

SEQ ID NO: 2048672 - RNA, 15 nt, Homo sapiens
ccgcagugaucaaag

SEQ ID NO: 2048673 - RNA, 13 nt, Homo sapiens
ucgaccaaaagga

SEQ ID NO: 2048674 - RNA, 18 nt, Homo sapiens
aguuuuaagggcauuuaa

SEQ ID NO: 2048675 - RNA, 19 nt, Homo sapiens
aacugucuuguuucaguga

SEQ ID NO: 2048676 - RNA, 19 nt, Homo sapiens
uaccaccaaaaaagcugua

SEQ ID NO: 2048677 - RNA, 14 nt, Homo sapiens
cucaguuccaaagu

SEQ ID NO: 2048678 - RNA, 20 nt, Homo sapiens
auugaagcgguuucacuccg

SEQ ID NO: 2048679 - RNA, 13 nt, Homo sapiens
ucuuccuauccca

SEQ ID NO: 2048680 - RNA, 21 nt, Homo sapiens
cuaccccucccagcugacagu

SEQ ID NO: 2048681 - RNA, 16 nt, Homo sapiens
cugaaagcaauaagcu

SEQ ID NO: 2048682 - RNA, 20 nt, Homo sapiens
uuugcacaggaaagagucac

SEQ ID NO: 2048683 - RNA, 17 nt, Homo sapiens
cagagcacauuugucag

SEQ ID NO: 2048684 - RNA, 18 nt, Homo sapiens
augguuuuaaugcaauga

SEQ ID NO: 2048685 - RNA, 17 nt, Homo sapiens
uauugcugaaugcaaga

SEQ ID NO: 2048686 - RNA, 17 nt, Homo sapiens
cuuggauucuuuccauu

SEQ ID NO: 2048687 - RNA, 22 nt, Homo sapiens
ugguguucucuggcucuugucc

SEQ ID NO: 2048688 - RNA, 16 nt, Homo sapiens
accagauauuuuguuc

SEQ ID NO: 2048689 - RNA, 21 nt, Homo sapiens
ucucucugaagaugucaaauc

SEQ ID NO: 2048690 - RNA, 15 nt, Homo sapiens
gcuggcaucaagagg

SEQ ID NO: 2048691 - RNA, 14 nt, Homo sapiens
gcugcacacagacg

SEQ ID NO: 2048692 - RNA, 17 nt, Homo sapiens
ucaaucuggauucauau

SEQ ID NO: 2048693 - RNA, 19 nt, Homo sapiens
uaaaaaugcugcucucagc

SEQ ID NO: 2048694 - RNA, 20 nt, Homo sapiens
agcgccugcccucccugggg

SEQ ID NO: 2048695 - RNA, 21 nt, Homo sapiens
cccugcuuccaccucacccca

SEQ ID NO: 2048696 - RNA, 14 nt, Homo sapiens
gaacaggugguggu

SEQ ID NO: 2048697 - RNA, 12 nt, Homo sapiens
guucaggccagu

SEQ ID NO: 2048698 - RNA, 12 nt, Homo sapiens
uaaaugcauugg

SEQ ID NO: 2048699 - RNA, 17 nt, Homo sapiens
uaccauauucagcauuu

SEQ ID NO: 2048700 - RNA, 20 nt, Homo sapiens
gaugcauguugaccaugucu

SEQ ID NO: 2048701 - RNA, 14 nt, Homo sapiens
ugggccgggaccca

SEQ ID NO: 2048702 - RNA, 23 nt, Homo sapiens
gaacucccucugugucacuguau

SEQ ID NO: 2048703 - RNA, 22 nt, Homo sapiens
uggaguugggggcggcuugucu

SEQ ID NO: 2048704 - RNA, 20 nt, Homo sapiens
acucgagaagauucaaucac

SEQ ID NO: 2048705 - RNA, 20 nt, Homo sapiens
aucaauguuuguccuguaua

SEQ ID NO: 2048706 - RNA, 20 nt, Homo sapiens
uaacugaaaaaggacuuuuc

SEQ ID NO: 2048707 - RNA, 14 nt, Homo sapiens
auaccacugaauga

SEQ ID NO: 2048708 - RNA, 17 nt, Homo sapiens
ugaacaaccugcucaca

SEQ ID NO: 2048709 - RNA, 15 nt, Homo sapiens
gucuugccagccaga

SEQ ID NO: 2048710 - RNA, 22 nt, Homo sapiens
uacacuuuaugccggaugugcu

SEQ ID NO: 2048711 - RNA, 21 nt, Homo sapiens
aaaaauuuugugacauuccuu

SEQ ID NO: 2048712 - RNA, 15 nt, Homo sapiens
uccucgcugugccac

SEQ ID NO: 2048713 - RNA, 12 nt, Homo sapiens
aucaguugcuau

SEQ ID NO: 2048714 - RNA, 16 nt, Homo sapiens
gaggaauaaagcuucu

SEQ ID NO: 2048715 - RNA, 20 nt, Homo sapiens
acaggauuccagaaugauca

SEQ ID NO: 2048716 - RNA, 21 nt, Homo sapiens
aauaggcaaacuuuuaugcag

SEQ ID NO: 2048717 - RNA, 16 nt, Homo sapiens
ugugcugauccugcug

SEQ ID NO: 2048718 - RNA, 23 nt, Homo sapiens
cuugcuuguugggauuccugacc

SEQ ID NO: 2048719 - RNA, 17 nt, Homo sapiens
uaugaagccaacugaca

SEQ ID NO: 2048720 - RNA, 20 nt, Homo sapiens
auuguguuaggacagcauau

SEQ ID NO: 2048721 - RNA, 18 nt, Homo sapiens
uaggccuuaacacacugg

SEQ ID NO: 2048722 - RNA, 13 nt, Homo sapiens
uguaauucuucca

SEQ ID NO: 2048723 - RNA, 18 nt, Homo sapiens
auuuuauauauuauguca

SEQ ID NO: 2048724 - RNA, 11 nt, Homo sapiens
caacuugagau

SEQ ID NO: 2048725 - RNA, 19 nt, Homo sapiens
gaauuuucucuaacuucaa

SEQ ID NO: 2048726 - RNA, 20 nt, Homo sapiens
aauaauuggagaagauuuau

SEQ ID NO: 2048727 - RNA, 21 nt, Homo sapiens
aaaugugagaaguacacauuu

SEQ ID NO: 2048728 - RNA, 15 nt, Homo sapiens
auaaauauuuagucu

SEQ ID NO: 2048729 - RNA, 15 nt, Homo sapiens
ucuuaucaaucccaa

SEQ ID NO: 2048730 - RNA, 19 nt, Homo sapiens
uagcacggccaccucucag

SEQ ID NO: 2048731 - RNA, 19 nt, Homo sapiens
gcuucuaguuugcaacuuc

SEQ ID NO: 2048732 - RNA, 18 nt, Homo sapiens
ggggacagaguucaggga

SEQ ID NO: 2048733 - RNA, 23 nt, Homo sapiens
uccuggcacagaagaggagucaa

SEQ ID NO: 2048734 - RNA, 13 nt, Homo sapiens
accugggcaggga

SEQ ID NO: 2048735 - RNA, 17 nt, Homo sapiens
ccugacuccuucugcca

SEQ ID NO: 2048736 - RNA, 19 nt, Homo sapiens
uucaccuaacuuucauuaa

SEQ ID NO: 2048737 - RNA, 12 nt, Homo sapiens
ucucccagaugu

SEQ ID NO: 2048738 - RNA, 14 nt, Homo sapiens
uuugaaaguacucc

SEQ ID NO: 2048739 - RNA, 20 nt, Homo sapiens
ugcaagagugggcuuuccag

SEQ ID NO: 2048740 - RNA, 13 nt, Homo sapiens
cacuagacugugc

SEQ ID NO: 2048741 - RNA, 14 nt, Homo sapiens
cgauccccugucac

SEQ ID NO: 2048742 - RNA, 16 nt, Homo sapiens
gcaugucugccaaaau

SEQ ID NO: 2048743 - RNA, 14 nt, Homo sapiens
gagcugucuuguca

SEQ ID NO: 2048744 - RNA, 15 nt, Homo sapiens
ugacuuuuaauguca

SEQ ID NO: 2048745 - RNA, 15 nt, Homo sapiens
cugguucagugccac

SEQ ID NO: 2048746 - RNA, 20 nt, Homo sapiens
uguuuuccccuaauuuucca

SEQ ID NO: 2048747 - RNA, 18 nt, Homo sapiens
gagccaaccaacagagaa

SEQ ID NO: 2048748 - RNA, 21 nt, Homo sapiens
gcuucuuaauauaacugccuu

SEQ ID NO: 2048749 - RNA, 18 nt, Homo sapiens
uggaucuacccucuaguu

SEQ ID NO: 2048750 - RNA, 21 nt, Homo sapiens
auaacuuuggaaacaugggaa

SEQ ID NO: 2048751 - RNA, 23 nt, Homo sapiens
uagaaguugaaacucacuaguaa

SEQ ID NO: 2048752 - RNA, 15 nt, Homo sapiens
uuaacauaucauuca

SEQ ID NO: 2048753 - RNA, 12 nt, Homo sapiens
ugacacugcucc

SEQ ID NO: 2048754 - RNA, 20 nt, Homo sapiens
cugagucccaauuacauuca

SEQ ID NO: 2048755 - RNA, 15 nt, Homo sapiens
guaagagauaugcuc

SEQ ID NO: 2048756 - RNA, 21 nt, Homo sapiens
auucaauuacauaguccagug

SEQ ID NO: 2048757 - RNA, 20 nt, Homo sapiens
ggaauuauuagcaccagcuu

SEQ ID NO: 2048758 - RNA, 16 nt, Homo sapiens
uuaugaguggcuuuaa

SEQ ID NO: 2048759 - RNA, 15 nt, Homo sapiens
agauaugcuuauaca

SEQ ID NO: 2048760 - RNA, 23 nt, Homo sapiens
aguuauugcugcauaaauuugua

SEQ ID NO: 2048761 - RNA, 21 nt, Homo sapiens
gccccgccugcucuuuccucc

SEQ ID NO: 2048762 - RNA, 14 nt, Homo sapiens
aggcaccagaagaa

SEQ ID NO: 2048763 - RNA, 15 nt, Homo sapiens
ugacauguugcucuu

SEQ ID NO: 2048764 - RNA, 19 nt, Homo sapiens
aggagaaaaaaacuucuuu

SEQ ID NO: 2048765 - RNA, 13 nt, Homo sapiens
acucugcacuggu

SEQ ID NO: 2048766 - RNA, 17 nt, Homo sapiens
augacuuaccuguucag

SEQ ID NO: 2048767 - RNA, 20 nt, Homo sapiens
uaucggccuggagaggacaa

SEQ ID NO: 2048768 - RNA, 18 nt, Homo sapiens
ucauaugauugugcacau

SEQ ID NO: 2048769 - RNA, 12 nt, Homo sapiens
gacaaacaguga

SEQ ID NO: 2048770 - RNA, 19 nt, Homo sapiens
cucucugcaccugucucau

SEQ ID NO: 2048771 - RNA, 14 nt, Homo sapiens
uguguugucagcac

SEQ ID NO: 2048772 - RNA, 12 nt, Homo sapiens
uugucagugugu

SEQ ID NO: 2048773 - RNA, 19 nt, Homo sapiens
aauucuaaguuauuuacuu

SEQ ID NO: 2048774 - RNA, 15 nt, Homo sapiens
uccuuguaaguuauu

SEQ ID NO: 2048775 - RNA, 16 nt, Homo sapiens
acauucccuaucaaaa

SEQ ID NO: 2048776 - RNA, 21 nt, Homo sapiens
auguaaaaaugaaaagccaaa

SEQ ID NO: 2048777 - RNA, 21 nt, Homo sapiens
ggaauggcugcaccuuuuugc

SEQ ID NO: 2048778 - RNA, 18 nt, Homo sapiens
uguguuuauaauuguuau

SEQ ID NO: 2048779 - RNA, 16 nt, Homo sapiens
ucccugcagacaugag

SEQ ID NO: 2048780 - RNA, 14 nt, Homo sapiens
cuuggaaaugacca

SEQ ID NO: 2048781 - RNA, 12 nt, Homo sapiens
ugugaggcuucu

SEQ ID NO: 2048782 - RNA, 14 nt, Homo sapiens
cccaucguugcccc

SEQ ID NO: 2048783 - RNA, 22 nt, Homo sapiens
cucugcacaagcugcacccuca

SEQ ID NO: 2048784 - RNA, 11 nt, Homo sapiens
aggugagcugg

SEQ ID NO: 2048785 - RNA, 16 nt, Homo sapiens
uaguaacaucaaagau

SEQ ID NO: 2048786 - RNA, 15 nt, Homo sapiens
uaauuuccugugagg

SEQ ID NO: 2048787 - RNA, 20 nt, Homo sapiens
auauuauaucagacugcuuu

SEQ ID NO: 2048788 - RNA, 20 nt, Homo sapiens
uguucucuggcucuugucca

SEQ ID NO: 2048789 - RNA, 17 nt, Homo sapiens
guauugugauuaucaau

SEQ ID NO: 2048790 - RNA, 14 nt, Homo sapiens
aguauaauuuaacu

SEQ ID NO: 2048791 - RNA, 22 nt, Homo sapiens
ggcuggggccaggggaccuucc

SEQ ID NO: 2048792 - RNA, 15 nt, Homo sapiens
cauucaagagucuca

SEQ ID NO: 2048793 - RNA, 19 nt, Homo sapiens
ccugaaagcaacuacagaa

SEQ ID NO: 2048794 - RNA, 19 nt, Homo sapiens
aaagccaccucucccucaa

SEQ ID NO: 2048795 - RNA, 20 nt, Homo sapiens
agcccagaggccaacacugu

SEQ ID NO: 2048796 - RNA, 17 nt, Homo sapiens
ucuuagcuuacaggaag

SEQ ID NO: 2048797 - RNA, 21 nt, Homo sapiens
gguguccuguuccugccacau

SEQ ID NO: 2048798 - RNA, 21 nt, Homo sapiens
accuagugcaaaaacuguaaa

SEQ ID NO: 2048799 - RNA, 17 nt, Homo sapiens
aaguugccuaaauccau

SEQ ID NO: 2048800 - RNA, 21 nt, Homo sapiens
ugaaacuguguacgacaaagc

SEQ ID NO: 2048801 - RNA, 23 nt, Homo sapiens
aaccaggcagcugagaccagggu

SEQ ID NO: 2048802 - RNA, 21 nt, Homo sapiens
guucagaucucauagaugacc

SEQ ID NO: 2048803 - RNA, 14 nt, Homo sapiens
uacuuaaacagcuu

SEQ ID NO: 2048804 - RNA, 20 nt, Homo sapiens
uccccgggucucucacuguu

SEQ ID NO: 2048805 - RNA, 20 nt, Homo sapiens
gccccccuugccagacaugu

SEQ ID NO: 2048806 - RNA, 16 nt, Homo sapiens
auuucaguucaaucaa

SEQ ID NO: 2048807 - RNA, 14 nt, Homo sapiens
uuccaguaaucuga

SEQ ID NO: 2048808 - RNA, 17 nt, Homo sapiens
ucaccacauucugucuc

SEQ ID NO: 2048809 - RNA, 12 nt, Homo sapiens
ucccugccacau

SEQ ID NO: 2048810 - RNA, 18 nt, Homo sapiens
auggauuuauaucagcua

SEQ ID NO: 2048811 - RNA, 16 nt, Homo sapiens
acaaaaugccaagggg

SEQ ID NO: 2048812 - RNA, 16 nt, Homo sapiens
aaagaguguagaucag

SEQ ID NO: 2048813 - RNA, 17 nt, Homo sapiens
ucagugaaguacaccug

SEQ ID NO: 2048814 - RNA, 17 nt, Homo sapiens
uuuggugauacugucaa

SEQ ID NO: 2048815 - RNA, 17 nt, Homo sapiens
ccucuugacuuccccac

SEQ ID NO: 2048816 - RNA, 20 nt, Homo sapiens
gcagaugcguagcauuugcu

SEQ ID NO: 2048817 - RNA, 19 nt, Homo sapiens
uagauaaucuugugcaaaa

SEQ ID NO: 2048818 - RNA, 14 nt, Homo sapiens
uugccacaucuuaa

SEQ ID NO: 2048819 - RNA, 16 nt, Homo sapiens
gcccuacucccugcag

SEQ ID NO: 2048820 - RNA, 20 nt, Homo sapiens
agcagcuuagaguuggccau

SEQ ID NO: 2048821 - RNA, 21 nt, Homo sapiens
ugccacguggccgcugcccac

SEQ ID NO: 2048822 - RNA, 16 nt, Homo sapiens
cugugaucugagggua

SEQ ID NO: 2048823 - RNA, 15 nt, Homo sapiens
aagucaucccagugc

SEQ ID NO: 2048824 - RNA, 21 nt, Homo sapiens
cguauuaguugccaauaugcc

SEQ ID NO: 2048825 - RNA, 23 nt, Homo sapiens
ucuccagcccuauggaagucuca

SEQ ID NO: 2048826 - RNA, 15 nt, Homo sapiens
ucauaaucacaaaua

SEQ ID NO: 2048827 - RNA, 17 nt, Homo sapiens
aggagccggugcucugg

SEQ ID NO: 2048828 - RNA, 22 nt, Homo sapiens
acugcauuuggggccuuuccca

SEQ ID NO: 2048829 - RNA, 23 nt, Homo sapiens
cugaauagcuuggaaaaguaaca

SEQ ID NO: 2048830 - RNA, 15 nt, Homo sapiens
auaaagcaauguggu

SEQ ID NO: 2048831 - RNA, 17 nt, Homo sapiens
aagugcuucacauuugu

SEQ ID NO: 2048832 - RNA, 17 nt, Homo sapiens
aagggcuagaaccugga

SEQ ID NO: 2048833 - RNA, 17 nt, Homo sapiens
ugagauaauacauuccg

SEQ ID NO: 2048834 - RNA, 23 nt, Homo sapiens
uccuagagagugugauguucacu

SEQ ID NO: 2048835 - RNA, 14 nt, Homo sapiens
aaucacugcauuca

SEQ ID NO: 2048836 - RNA, 23 nt, Homo sapiens
gaaaauugugcuggaaauggaca

SEQ ID NO: 2048837 - RNA, 17 nt, Homo sapiens
cuuuccuuuucuuccuu

SEQ ID NO: 2048838 - RNA, 19 nt, Homo sapiens
cuguuuagaugaaugucag

SEQ ID NO: 2048839 - RNA, 22 nt, Homo sapiens
gauagugacaugauacaaacac

SEQ ID NO: 2048840 - RNA, 15 nt, Homo sapiens
cugcaucuugcugcu

SEQ ID NO: 2048841 - RNA, 15 nt, Homo sapiens
uggcuggccacugca

SEQ ID NO: 2048842 - RNA, 15 nt, Homo sapiens
uagcaagcacuugau

SEQ ID NO: 2048843 - RNA, 12 nt, Homo sapiens
aacacauuucac

SEQ ID NO: 2048844 - RNA, 18 nt, Homo sapiens
cugugcuaccugagccaa

SEQ ID NO: 2048845 - RNA, 23 nt, Homo sapiens
cccuccugcccaggacugcauug

SEQ ID NO: 2048846 - RNA, 20 nt, Homo sapiens
gaccccaaaaagaguuacac

SEQ ID NO: 2048847 - RNA, 21 nt, Homo sapiens
ugaauagacacuucaccaaag

SEQ ID NO: 2048848 - RNA, 17 nt, Homo sapiens
gugagcucaaacuggcc

SEQ ID NO: 2048849 - RNA, 23 nt, Homo sapiens
cacucaauuucucugaggacaca

SEQ ID NO: 2048850 - RNA, 18 nt, Homo sapiens
cagaaauccuuucauaaa

SEQ ID NO: 2048851 - RNA, 22 nt, Homo sapiens
aauggaauccgugauaccgaag

SEQ ID NO: 2048852 - RNA, 15 nt, Homo sapiens
uuaaaacuucaguuu

SEQ ID NO: 2048853 - RNA, 14 nt, Homo sapiens
augcauucccggug

SEQ ID NO: 2048854 - RNA, 13 nt, Homo sapiens
ccugagagugggu

SEQ ID NO: 2048855 - RNA, 18 nt, Homo sapiens
gaucaagaaaaaaaggga

SEQ ID NO: 2048856 - RNA, 12 nt, Homo sapiens
cuuguccugacu

SEQ ID NO: 2048857 - RNA, 21 nt, Homo sapiens
uaguucugggcccagcgcagu

SEQ ID NO: 2048858 - RNA, 23 nt, Homo sapiens
gcccaggguucccccagcccugu

SEQ ID NO: 2048859 - RNA, 16 nt, Homo sapiens
auuuucacaucaaaga

SEQ ID NO: 2048860 - RNA, 18 nt, Homo sapiens
gauauaaaaauaauguca

SEQ ID NO: 2048861 - RNA, 15 nt, Homo sapiens
cuuuaaagacuugau

SEQ ID NO: 2048862 - RNA, 18 nt, Homo sapiens
cauuguaucugucuuucc

SEQ ID NO: 2048863 - RNA, 21 nt, Homo sapiens
uugcacaggccacuugcucag

SEQ ID NO: 2048864 - RNA, 11 nt, Homo sapiens
ccacagugacu

SEQ ID NO: 2048865 - RNA, 21 nt, Homo sapiens
gugcagcuucgaggacaggaa

SEQ ID NO: 2048866 - RNA, 20 nt, Homo sapiens
agcugaacacauuugcccaa

SEQ ID NO: 2048867 - RNA, 20 nt, Homo sapiens
aaaaguuaacuacagaccau

SEQ ID NO: 2048868 - RNA, 16 nt, Homo sapiens
agaauuucccagugaa

SEQ ID NO: 2048869 - RNA, 17 nt, Homo sapiens
aguaggaguuugcuaag

SEQ ID NO: 2048870 - RNA, 16 nt, Homo sapiens
uggggacgcagaugag

SEQ ID NO: 2048871 - RNA, 15 nt, Homo sapiens
uugguaaauggcaaa

SEQ ID NO: 2048872 - RNA, 19 nt, Homo sapiens
gacuagaacacaaauccaa

SEQ ID NO: 2048873 - RNA, 17 nt, Homo sapiens
uccacuuaucuuggaau

SEQ ID NO: 2048874 - RNA, 14 nt, Homo sapiens
gcuucuuauccuua

SEQ ID NO: 2048875 - RNA, 14 nt, Homo sapiens
caaauauacuuuac

SEQ ID NO: 2048876 - RNA, 11 nt, Homo sapiens
aagaagcuuua

SEQ ID NO: 2048877 - RNA, 17 nt, Homo sapiens
cccagggggcggggugc

SEQ ID NO: 2048878 - RNA, 17 nt, Homo sapiens
gugacagaaucuuguau

SEQ ID NO: 2048879 - RNA, 12 nt, Homo sapiens
accagugaaaag

SEQ ID NO: 2048880 - RNA, 23 nt, Homo sapiens
auuuaugcugcucauccaaaguu

SEQ ID NO: 2048881 - RNA, 15 nt, Homo sapiens
auuacuuccacugag

SEQ ID NO: 2048882 - RNA, 18 nt, Homo sapiens
guuugugguaaccagccc

SEQ ID NO: 2048883 - RNA, 16 nt, Homo sapiens
cagaucgcucacuguu

SEQ ID NO: 2048884 - RNA, 23 nt, Homo sapiens
ugugcucucuuuaaaucaagucc

SEQ ID NO: 2048885 - RNA, 22 nt, Homo sapiens
cacugaaaugcuagcugcaagu

SEQ ID NO: 2048886 - RNA, 14 nt, Homo sapiens
ugagcugagugcug

SEQ ID NO: 2048887 - RNA, 12 nt, Homo sapiens
cugacuagucau

SEQ ID NO: 2048888 - RNA, 20 nt, Homo sapiens
gauaaacugcagagagacaa

SEQ ID NO: 2048889 - RNA, 14 nt, Homo sapiens
auaaagcuuuugca

SEQ ID NO: 2048890 - RNA, 16 nt, Homo sapiens
aggccccugucucagg

SEQ ID NO: 2048891 - RNA, 15 nt, Homo sapiens
uuaugcaucugcuac

SEQ ID NO: 2048892 - RNA, 16 nt, Homo sapiens
cuguuauuaacagaua

SEQ ID NO: 2048893 - RNA, 19 nt, Homo sapiens
agccccccacaaugaugau

SEQ ID NO: 2048894 - RNA, 18 nt, Homo sapiens
gucucucauucuaggccu

SEQ ID NO: 2048895 - RNA, 12 nt, Homo sapiens
uccacacuguug

SEQ ID NO: 2048896 - RNA, 13 nt, Homo sapiens
uaaagacuugugc

SEQ ID NO: 2048897 - RNA, 15 nt, Homo sapiens
ugcccaucauacgca

SEQ ID NO: 2048898 - RNA, 16 nt, Homo sapiens
cuucaguuaagccuuu

SEQ ID NO: 2048899 - RNA, 16 nt, Homo sapiens
aguaucggcacuguac

SEQ ID NO: 2048900 - RNA, 17 nt, Homo sapiens
augccacucagaaucuc

SEQ ID NO: 2048901 - RNA, 15 nt, Homo sapiens
agggaaggcugugca

SEQ ID NO: 2048902 - RNA, 14 nt, Homo sapiens
ugguguucccaaga

SEQ ID NO: 2048903 - RNA, 24 nt, Homo sapiens
caagcaaaaccaaagaauauguag

SEQ ID NO: 2048904 - RNA, 16 nt, Homo sapiens
aguaggaggccuccac

SEQ ID NO: 2048905 - RNA, 20 nt, Homo sapiens
uaaucauggcucuuagaaac

SEQ ID NO: 2048906 - RNA, 15 nt, Homo sapiens
cuuuguuccacugga

SEQ ID NO: 2048907 - RNA, 23 nt, Homo sapiens
augucaaagcaggggaguaugca

SEQ ID NO: 2048908 - RNA, 20 nt, Homo sapiens
aagacaccugccuuaugcaa

SEQ ID NO: 2048909 - RNA, 16 nt, Homo sapiens
aucauuugaaagggcu

SEQ ID NO: 2048910 - RNA, 18 nt, Homo sapiens
agugguuaacagagcuaa

SEQ ID NO: 2048911 - RNA, 18 nt, Homo sapiens
ggaaaaucacaucuccag

SEQ ID NO: 2048912 - RNA, 22 nt, Homo sapiens
accccuuguccgcaagggguga

SEQ ID NO: 2048913 - RNA, 13 nt, Homo sapiens
uuuguggccucag

SEQ ID NO: 2048914 - RNA, 14 nt, Homo sapiens
aguauaugucaugc

SEQ ID NO: 2048915 - RNA, 15 nt, Homo sapiens
uuggccaucucugga

SEQ ID NO: 2048916 - RNA, 22 nt, Homo sapiens
aacugagacacauuggcuuugu

SEQ ID NO: 2048917 - RNA, 18 nt, Homo sapiens
aagagguggguggugggc

SEQ ID NO: 2048918 - RNA, 20 nt, Homo sapiens
uauaaaaaacagccuguuga

SEQ ID NO: 2048919 - RNA, 16 nt, Homo sapiens
ccagcaucuggaagau

SEQ ID NO: 2048920 - RNA, 22 nt, Homo sapiens
ggaugcaggguuugagaauguu

SEQ ID NO: 2048921 - RNA, 20 nt, Homo sapiens
cugcagggcuggucagggug

SEQ ID NO: 2048922 - RNA, 23 nt, Homo sapiens
uucaaaaaguaaucauauaucaa

SEQ ID NO: 2048923 - RNA, 20 nt, Homo sapiens
guccccggccacgucugugc

SEQ ID NO: 2048924 - RNA, 21 nt, Homo sapiens
aauggguuugccaagcccuuu

SEQ ID NO: 2048925 - RNA, 16 nt, Homo sapiens
caugugucacuugugc

SEQ ID NO: 2048926 - RNA, 16 nt, Homo sapiens
cucugggcuauggaca

SEQ ID NO: 2048927 - RNA, 19 nt, Homo sapiens
caaugguugaugauacuuc

SEQ ID NO: 2048928 - RNA, 19 nt, Homo sapiens
ugcgccugggaucucgcca

SEQ ID NO: 2048929 - RNA, 13 nt, Homo sapiens
ggcaccaguagca

SEQ ID NO: 2048930 - RNA, 22 nt, Homo sapiens
gacccaagagguggggaccaaa

SEQ ID NO: 2048931 - RNA, 17 nt, Homo sapiens
aggguuggaggcaaugu

SEQ ID NO: 2048932 - RNA, 22 nt, Homo sapiens
cucgauuauucccuguacaaua

SEQ ID NO: 2048933 - RNA, 20 nt, Homo sapiens
uaacucuguccuuacauacu

SEQ ID NO: 2048934 - RNA, 15 nt, Homo sapiens
uguuauuuaacagcu

SEQ ID NO: 2048935 - RNA, 16 nt, Homo sapiens
ugccaagaccuuucaa

SEQ ID NO: 2048936 - RNA, 17 nt, Homo sapiens
gaugcccuaguugugau

SEQ ID NO: 2048937 - RNA, 15 nt, Homo sapiens
acaucaaaugcucaa

SEQ ID NO: 2048938 - RNA, 23 nt, Homo sapiens
uaauacuacccauagaaaacuug

SEQ ID NO: 2048939 - RNA, 18 nt, Homo sapiens
cuggggccaugggugcau

SEQ ID NO: 2048940 - RNA, 15 nt, Homo sapiens
aaccugccaccaaaa

SEQ ID NO: 2048941 - RNA, 13 nt, Homo sapiens
caggggcugcauc

SEQ ID NO: 2048942 - RNA, 18 nt, Homo sapiens
cauaaugacuuaagcaca

SEQ ID NO: 2048943 - RNA, 18 nt, Homo sapiens
caucucagaguccaguca

SEQ ID NO: 2048944 - RNA, 16 nt, Homo sapiens
auucaacucagacuag

SEQ ID NO: 2048945 - RNA, 17 nt, Homo sapiens
cugcaaaacuccaggca

SEQ ID NO: 2048946 - RNA, 20 nt, Homo sapiens
ggccagcugucgcaucucag

SEQ ID NO: 2048947 - RNA, 21 nt, Homo sapiens
aagugugacuaccuccacuca

SEQ ID NO: 2048948 - RNA, 21 nt, Homo sapiens
agauccucaucuuggagcuuu

SEQ ID NO: 2048949 - RNA, 21 nt, Homo sapiens
cagcuggacauacugcuggag

SEQ ID NO: 2048950 - RNA, 15 nt, Homo sapiens
caagagagugugacu

SEQ ID NO: 2048951 - RNA, 12 nt, Homo sapiens
gggggcacucag

SEQ ID NO: 2048952 - RNA, 16 nt, Homo sapiens
cuccucaggcacacag

SEQ ID NO: 2048953 - RNA, 15 nt, Homo sapiens
agcuacaggacauuu

SEQ ID NO: 2048954 - RNA, 22 nt, Homo sapiens
cugauagauauccuuggcacau

SEQ ID NO: 2048955 - RNA, 19 nt, Homo sapiens
uaaaaguuguuaccaaaua

SEQ ID NO: 2048956 - RNA, 22 nt, Homo sapiens
ccaacuuuguggaugucuuccu

SEQ ID NO: 2048957 - RNA, 19 nt, Homo sapiens
aaguuaauuuugaccaaaa

SEQ ID NO: 2048958 - RNA, 21 nt, Homo sapiens
uaaacugcaggagcaguuugc

SEQ ID NO: 2048959 - RNA, 13 nt, Homo sapiens
cgaaacacuucaa

SEQ ID NO: 2048960 - RNA, 19 nt, Homo sapiens
gccuuggccuugcagcugg

SEQ ID NO: 2048961 - RNA, 20 nt, Homo sapiens
ccugaauugagaauuuugau

SEQ ID NO: 2048962 - RNA, 14 nt, Homo sapiens
agugccuggcaagg

SEQ ID NO: 2048963 - RNA, 17 nt, Homo sapiens
ggggagugggcgcagug

SEQ ID NO: 2048964 - RNA, 11 nt, Homo sapiens
cucauuuacuu

SEQ ID NO: 2048965 - RNA, 22 nt, Homo sapiens
aauaguguuggaaaaugugcaa

SEQ ID NO: 2048966 - RNA, 11 nt, Homo sapiens
uguuaugucaa

SEQ ID NO: 2048967 - RNA, 19 nt, Homo sapiens
gggaacagcauaugcaaag

SEQ ID NO: 2048968 - RNA, 12 nt, Homo sapiens
cuucuguguuca

SEQ ID NO: 2048969 - RNA, 16 nt, Homo sapiens
uuaccgugggcacuga

SEQ ID NO: 2048970 - RNA, 20 nt, Homo sapiens
uaguaacucccaucaccucu

SEQ ID NO: 2048971 - RNA, 13 nt, Homo sapiens
agcccuaaucuca

SEQ ID NO: 2048972 - RNA, 22 nt, Homo sapiens
auucuuaguuguucaguugcca

SEQ ID NO: 2048973 - RNA, 16 nt, Homo sapiens
ggaacacucugagacu

SEQ ID NO: 2048974 - RNA, 22 nt, Homo sapiens
cagccuccagagaguaucugag

SEQ ID NO: 2048975 - RNA, 22 nt, Homo sapiens
aggucagauggagguucucaga

SEQ ID NO: 2048976 - RNA, 18 nt, Homo sapiens
aaaagccuuucagauuca

SEQ ID NO: 2048977 - RNA, 16 nt, Homo sapiens
aaccagaaaagcaaua

SEQ ID NO: 2048978 - RNA, 21 nt, Homo sapiens
caauguauuuucuucaccucu

SEQ ID NO: 2048979 - RNA, 20 nt, Homo sapiens
acuggccugauugcagagua

SEQ ID NO: 2048980 - RNA, 16 nt, Homo sapiens
cagaauccacaguguc

SEQ ID NO: 2048981 - RNA, 17 nt, Homo sapiens
agaacugggcaacuauu

SEQ ID NO: 2048982 - RNA, 20 nt, Homo sapiens
ucuuucucaaagaaauauua

SEQ ID NO: 2048983 - RNA, 14 nt, Homo sapiens
auuccaaguucuca

SEQ ID NO: 2048984 - RNA, 14 nt, Homo sapiens
uccaccaugagcuc

SEQ ID NO: 2048985 - RNA, 14 nt, Homo sapiens
gagguugaagccaa

SEQ ID NO: 2048986 - RNA, 21 nt, Homo sapiens
acucucugcauugacuuauga

SEQ ID NO: 2048987 - RNA, 15 nt, Homo sapiens
uccaguuaaguaaua

SEQ ID NO: 2048988 - RNA, 19 nt, Homo sapiens
agccuccugccuaccccaa

SEQ ID NO: 2048989 - RNA, 19 nt, Homo sapiens
uacccugagauacuuccca

SEQ ID NO: 2048990 - RNA, 12 nt, Homo sapiens
cgacaagaccac

SEQ ID NO: 2048991 - RNA, 17 nt, Homo sapiens
cccucgugcgcaucuca

SEQ ID NO: 2048992 - RNA, 20 nt, Homo sapiens
ccagccaucaugugccugga

SEQ ID NO: 2048993 - RNA, 19 nt, Homo sapiens
gcaaaaaaaaaaaugucaa

SEQ ID NO: 2048994 - RNA, 22 nt, Homo sapiens
uuauagcaacaacaauugguaa

SEQ ID NO: 2048995 - RNA, 20 nt, Homo sapiens
aaaaugguguuuuaucuucu

SEQ ID NO: 2048996 - RNA, 17 nt, Homo sapiens
auguagauaaagcacug

SEQ ID NO: 2048997 - RNA, 15 nt, Homo sapiens
aguguaaacaccaua

SEQ ID NO: 2048998 - RNA, 14 nt, Homo sapiens
ggccugccaugcca

SEQ ID NO: 2048999 - RNA, 19 nt, Homo sapiens
uaaccauuuuccuuuggac

SEQ ID NO: 2049000 - RNA, 20 nt, Homo sapiens
uuuuagauucccagugucua

SEQ ID NO: 2049001 - RNA, 16 nt, Homo sapiens
ccuagaagcaaaugga

SEQ ID NO: 2049002 - RNA, 15 nt, Homo sapiens
acaaauucuacagca

SEQ ID NO: 2049003 - RNA, 21 nt, Homo sapiens
caaaauuuuguaaauaugcaa

SEQ ID NO: 2049004 - RNA, 17 nt, Homo sapiens
uggccagugugauccca

SEQ ID NO: 2049005 - RNA, 17 nt, Homo sapiens
agaccuggccucugcca

SEQ ID NO: 2049006 - RNA, 18 nt, Homo sapiens
caaguuggucuuacuuug

SEQ ID NO: 2049007 - RNA, 18 nt, Homo sapiens
uguuuauuauuugcacag

SEQ ID NO: 2049008 - RNA, 22 nt, Homo sapiens
gaauacaguaagcugcucuauu

SEQ ID NO: 2049009 - RNA, 15 nt, Homo sapiens
auuuaugaaguuuaa

SEQ ID NO: 2049010 - RNA, 14 nt, Homo sapiens
gguccucugcagug

SEQ ID NO: 2049011 - RNA, 19 nt, Homo sapiens
caaaauccaagauucugcu

SEQ ID NO: 2049012 - RNA, 19 nt, Homo sapiens
cagcaauugucuacauuca

SEQ ID NO: 2049013 - RNA, 16 nt, Homo sapiens
augacuucuccaggca

SEQ ID NO: 2049014 - RNA, 15 nt, Homo sapiens
aaggugccucaagaa

SEQ ID NO: 2049015 - RNA, 23 nt, Homo sapiens
ggucuaagaaugacgaugccuuc

SEQ ID NO: 2049016 - RNA, 21 nt, Homo sapiens
ggcccagcacauggccauaga

SEQ ID NO: 2049017 - RNA, 19 nt, Homo sapiens
cuccuuccuucaagccaag

SEQ ID NO: 2049018 - RNA, 14 nt, Homo sapiens
acaagaaccucucc

SEQ ID NO: 2049019 - RNA, 23 nt, Homo sapiens
acucauggccuugucuaacuuuu

SEQ ID NO: 2049020 - RNA, 19 nt, Homo sapiens
uguauauuuugaugagcuu

SEQ ID NO: 2049021 - RNA, 15 nt, Homo sapiens
gaaauaccuucuccc

SEQ ID NO: 2049022 - RNA, 16 nt, Homo sapiens
aggacccugggaccac

SEQ ID NO: 2049023 - RNA, 16 nt, Homo sapiens
auaccagaauguugcu

SEQ ID NO: 2049024 - RNA, 15 nt, Homo sapiens
gcuagaguaggugca

SEQ ID NO: 2049025 - RNA, 21 nt, Homo sapiens
aaugucucuucauaauacuuu

SEQ ID NO: 2049026 - RNA, 15 nt, Homo sapiens
uggccaccaguauga

SEQ ID NO: 2049027 - RNA, 20 nt, Homo sapiens
gguccuacugcugugagcau

SEQ ID NO: 2049028 - RNA, 19 nt, Homo sapiens
uauacagauucuagccaaa

SEQ ID NO: 2049029 - RNA, 21 nt, Homo sapiens
augaaccacguguuuugacau

SEQ ID NO: 2049030 - RNA, 15 nt, Homo sapiens
ugugugugcaauguu

SEQ ID NO: 2049031 - RNA, 19 nt, Homo sapiens
gcccuggcauguuccugcc

SEQ ID NO: 2049032 - RNA, 15 nt, Homo sapiens
cagagcuguccuccu

SEQ ID NO: 2049033 - RNA, 13 nt, Homo sapiens
cuacaugaaguug

SEQ ID NO: 2049034 - RNA, 23 nt, Homo sapiens
auugcaugcagugccggcugcca

SEQ ID NO: 2049035 - RNA, 16 nt, Homo sapiens
uaaaaaggaacaaaua

SEQ ID NO: 2049036 - RNA, 17 nt, Homo sapiens
cuucuuuccucuuaaug

SEQ ID NO: 2049037 - RNA, 18 nt, Homo sapiens
auuuguuuuucagagaua

SEQ ID NO: 2049038 - RNA, 23 nt, Homo sapiens
ucugcuggggauggccacuguga

SEQ ID NO: 2049039 - RNA, 12 nt, Homo sapiens
aaccagugccaa

SEQ ID NO: 2049040 - RNA, 21 nt, Homo sapiens
accauaagcuuuuucucugaa

SEQ ID NO: 2049041 - RNA, 20 nt, Homo sapiens
ggagaaaagggauggagcug

SEQ ID NO: 2049042 - RNA, 18 nt, Homo sapiens
ugcucagcccaggcacaa

SEQ ID NO: 2049043 - RNA, 19 nt, Homo sapiens
cugccaauaaacuguuaca

SEQ ID NO: 2049044 - RNA, 15 nt, Homo sapiens
aaggcaguagaacuc

SEQ ID NO: 2049045 - RNA, 17 nt, Homo sapiens
gaguaacaugccagcuu

SEQ ID NO: 2049046 - RNA, 15 nt, Homo sapiens
cuggcauggacauca

SEQ ID NO: 2049047 - RNA, 20 nt, Homo sapiens
ucagccuccugaacagcugg

SEQ ID NO: 2049048 - RNA, 12 nt, Homo sapiens
auguacaaacua

SEQ ID NO: 2049049 - RNA, 15 nt, Homo sapiens
ggugggggugccgcu

SEQ ID NO: 2049050 - RNA, 22 nt, Homo sapiens
aacaauaguucuuagcuuugaa

SEQ ID NO: 2049051 - RNA, 21 nt, Homo sapiens
gauauacauuuauuuacacuc

SEQ ID NO: 2049052 - RNA, 20 nt, Homo sapiens
agcaaugcaagcagccuagc

SEQ ID NO: 2049053 - RNA, 17 nt, Homo sapiens
aaccacaaccaacacca

SEQ ID NO: 2049054 - RNA, 22 nt, Homo sapiens
uagccucgccgucugugaauug

SEQ ID NO: 2049055 - RNA, 12 nt, Homo sapiens
cccucaagugcc

SEQ ID NO: 2049056 - RNA, 17 nt, Homo sapiens
ucagaucugaaguagug

SEQ ID NO: 2049057 - RNA, 14 nt, Homo sapiens
aauauauccaugau

SEQ ID NO: 2049058 - RNA, 19 nt, Homo sapiens
uccuuaggcuacuguaaug

SEQ ID NO: 2049059 - RNA, 18 nt, Homo sapiens
gucucaccucauagcuaa

SEQ ID NO: 2049060 - RNA, 23 nt, Homo sapiens
auauuuuuuuccuuugcauucau

SEQ ID NO: 2049061 - RNA, 14 nt, Homo sapiens
augggccuggccac

SEQ ID NO: 2049062 - RNA, 14 nt, Homo sapiens
cuucuggccaggaa

SEQ ID NO: 2049063 - RNA, 19 nt, Homo sapiens
accauguggccauuaacaa

SEQ ID NO: 2049064 - RNA, 14 nt, Homo sapiens
uugggaaaauauca

SEQ ID NO: 2049065 - RNA, 21 nt, Homo sapiens
aacaaaaaaaaauuacccuuu

SEQ ID NO: 2049066 - RNA, 16 nt, Homo sapiens
auaaaaaugcaacgcu

SEQ ID NO: 2049067 - RNA, 18 nt, Homo sapiens
aaaguagaauaagccuuc

SEQ ID NO: 2049068 - RNA, 20 nt, Homo sapiens
aacguguuaaagguuuucuc

SEQ ID NO: 2049069 - RNA, 19 nt, Homo sapiens
ggguauuuaccacagcagc

SEQ ID NO: 2049070 - RNA, 18 nt, Homo sapiens
agugauccuccugccuca

SEQ ID NO: 2049071 - RNA, 19 nt, Homo sapiens
ugacuuugggcaagccaag

SEQ ID NO: 2049072 - RNA, 14 nt, Homo sapiens
caacuuaacucacu

SEQ ID NO: 2049073 - RNA, 22 nt, Homo sapiens
guggauaaagauggauggcugu

SEQ ID NO: 2049074 - RNA, 15 nt, Homo sapiens
gccccuuccauggua

SEQ ID NO: 2049075 - RNA, 16 nt, Homo sapiens
gcagagagguuugcag

SEQ ID NO: 2049076 - RNA, 17 nt, Homo sapiens
uuuaauuuuacauuucc

SEQ ID NO: 2049077 - RNA, 15 nt, Homo sapiens
ugaagccucacuuau

SEQ ID NO: 2049078 - RNA, 16 nt, Homo sapiens
cucaagaacugccaua

SEQ ID NO: 2049079 - RNA, 19 nt, Homo sapiens
uuuuguauaggagccccag

SEQ ID NO: 2049080 - RNA, 15 nt, Homo sapiens
ugccaugacauuuca

SEQ ID NO: 2049081 - RNA, 19 nt, Homo sapiens
uguuucguaagacaaaaau

SEQ ID NO: 2049082 - RNA, 22 nt, Homo sapiens
agaagauccaagaggcccugca

SEQ ID NO: 2049083 - RNA, 18 nt, Homo sapiens
uguuaauucagcacugau

SEQ ID NO: 2049084 - RNA, 17 nt, Homo sapiens
caugagcaguccagagc

SEQ ID NO: 2049085 - RNA, 13 nt, Homo sapiens
ucucuuguaaaag

SEQ ID NO: 2049086 - RNA, 21 nt, Homo sapiens
cauuauuuaaccuaguucaau

SEQ ID NO: 2049087 - RNA, 22 nt, Homo sapiens
aucccuaccauuucuagccucu

SEQ ID NO: 2049088 - RNA, 14 nt, Homo sapiens
aaacggaacucuuc

SEQ ID NO: 2049089 - RNA, 14 nt, Homo sapiens
auugaugacccucu

SEQ ID NO: 2049090 - RNA, 20 nt, Homo sapiens
gaaauucuaaagagcacuua

SEQ ID NO: 2049091 - RNA, 17 nt, Homo sapiens
ucugucuggcauuacaa

SEQ ID NO: 2049092 - RNA, 16 nt, Homo sapiens
ucuuguuguuauugau

SEQ ID NO: 2049093 - RNA, 21 nt, Homo sapiens
augugagcucuuccuaucccu

SEQ ID NO: 2049094 - RNA, 16 nt, Homo sapiens
uuuauaagcuacaugu

SEQ ID NO: 2049095 - RNA, 11 nt, Homo sapiens
gacuucauccc

SEQ ID NO: 2049096 - RNA, 15 nt, Homo sapiens
cugaccaagagagaa

SEQ ID NO: 2049097 - RNA, 22 nt, Homo sapiens
uggauauuuaguucaacuguau

SEQ ID NO: 2049098 - RNA, 20 nt, Homo sapiens
uguaaagacaaaaaacuaua

SEQ ID NO: 2049099 - RNA, 22 nt, Homo sapiens
acuuggucuggccacuguccca

SEQ ID NO: 2049100 - RNA, 21 nt, Homo sapiens
caaaauggucaguauuaucua

SEQ ID NO: 2049101 - RNA, 15 nt, Homo sapiens
aauauugucugccuu

SEQ ID NO: 2049102 - RNA, 12 nt, Homo sapiens
ccuuuuccuuag

SEQ ID NO: 2049103 - RNA, 20 nt, Homo sapiens
ccugccaaugccacagccaa

SEQ ID NO: 2049104 - RNA, 12 nt, Homo sapiens
aaaugcuuaugu

SEQ ID NO: 2049105 - RNA, 13 nt, Homo sapiens
cuaagcagcuuau

SEQ ID NO: 2049106 - RNA, 16 nt, Homo sapiens
uccugccuugaaaaag

SEQ ID NO: 2049107 - RNA, 12 nt, Homo sapiens
ucccaccccagg

SEQ ID NO: 2049108 - RNA, 18 nt, Homo sapiens
aaagaucuugaauagucu

SEQ ID NO: 2049109 - RNA, 23 nt, Homo sapiens
ccuugaacugaggcccugugaua

SEQ ID NO: 2049110 - RNA, 11 nt, Homo sapiens
uuggcugugag

SEQ ID NO: 2049111 - RNA, 18 nt, Homo sapiens
caguggggccccaaagcc

SEQ ID NO: 2049112 - RNA, 13 nt, Homo sapiens
ugacaauaagaaa

SEQ ID NO: 2049113 - RNA, 11 nt, Homo sapiens
ccccucagcug

SEQ ID NO: 2049114 - RNA, 20 nt, Homo sapiens
aagcugccugugccaugccc

SEQ ID NO: 2049115 - RNA, 20 nt, Homo sapiens
ucauauuauuuuagugugua

SEQ ID NO: 2049116 - RNA, 13 nt, Homo sapiens
gugcucauagaaa

SEQ ID NO: 2049117 - RNA, 18 nt, Homo sapiens
ucauuucagcucuugcuu

SEQ ID NO: 2049118 - RNA, 16 nt, Homo sapiens
auggaugaaaguugca

SEQ ID NO: 2049119 - RNA, 17 nt, Homo sapiens
ucuguggcacucagaua

SEQ ID NO: 2049120 - RNA, 12 nt, Homo sapiens
uacucaaaagag

SEQ ID NO: 2049121 - RNA, 19 nt, Homo sapiens
caaggaugucugagaccac

SEQ ID NO: 2049122 - RNA, 19 nt, Homo sapiens
uggggaguaggacauacca

SEQ ID NO: 2049123 - RNA, 14 nt, Homo sapiens
aguggcugccaugg

SEQ ID NO: 2049124 - RNA, 14 nt, Homo sapiens
ugcagcaagcaaua

SEQ ID NO: 2049125 - RNA, 20 nt, Homo sapiens
gcaaacacugugauuacucu

SEQ ID NO: 2049126 - RNA, 21 nt, Homo sapiens
caacccgacauguguaccuca

SEQ ID NO: 2049127 - RNA, 23 nt, Homo sapiens
ugccgucaccucuccgcucauac

SEQ ID NO: 2049128 - RNA, 18 nt, Homo sapiens
uuuuucaaaaaaucagca

SEQ ID NO: 2049129 - RNA, 18 nt, Homo sapiens
auuuccuacuaaccuguu

SEQ ID NO: 2049130 - RNA, 20 nt, Homo sapiens
ucuuccugcuuuccaugggc

SEQ ID NO: 2049131 - RNA, 13 nt, Homo sapiens
uucuuuucacuuc

SEQ ID NO: 2049132 - RNA, 13 nt, Homo sapiens
uuuuuuucaccuc

SEQ ID NO: 2049133 - RNA, 14 nt, Homo sapiens
uuuucuaauuugca

SEQ ID NO: 2049134 - RNA, 22 nt, Homo sapiens
ccuuggcuuuuacugaagccuu

SEQ ID NO: 2049135 - RNA, 14 nt, Homo sapiens
aucaugcauguuau

SEQ ID NO: 2049136 - RNA, 15 nt, Homo sapiens
acuuucccucaucca

SEQ ID NO: 2049137 - RNA, 14 nt, Homo sapiens
ccuuccuugccagu

SEQ ID NO: 2049138 - RNA, 23 nt, Homo sapiens
ggcccccacauuugugccgacac

SEQ ID NO: 2049139 - RNA, 19 nt, Homo sapiens
aaucauaacucacuuuaaa

SEQ ID NO: 2049140 - RNA, 22 nt, Homo sapiens
gcccaccucuuguuuuccccuu

SEQ ID NO: 2049141 - RNA, 21 nt, Homo sapiens
uguuaaauauuuacauaugaa

SEQ ID NO: 2049142 - RNA, 21 nt, Homo sapiens
uugauaauuuagacauugagu

SEQ ID NO: 2049143 - RNA, 18 nt, Homo sapiens
agcagguuaccacucugg

SEQ ID NO: 2049144 - RNA, 12 nt, Homo sapiens
ggacucuuccac

SEQ ID NO: 2049145 - RNA, 12 nt, Homo sapiens
cgcuucuugccu

SEQ ID NO: 2049146 - RNA, 22 nt, Homo sapiens
gaagaacagauaaucccuguau

SEQ ID NO: 2049147 - RNA, 14 nt, Homo sapiens
cagaucacucaaaa

SEQ ID NO: 2049148 - RNA, 17 nt, Homo sapiens
uagugguggcagugcag

SEQ ID NO: 2049149 - RNA, 13 nt, Homo sapiens
aaaugugugacug

SEQ ID NO: 2049150 - RNA, 23 nt, Homo sapiens
gaauugucuuuggugcuuuucac

SEQ ID NO: 2049151 - RNA, 15 nt, Homo sapiens
uguacuaaaaauaca

SEQ ID NO: 2049152 - RNA, 19 nt, Homo sapiens
cugagguucccgacaccag

SEQ ID NO: 2049153 - RNA, 20 nt, Homo sapiens
ucccaagcacuucaaaggaa

SEQ ID NO: 2049154 - RNA, 16 nt, Homo sapiens
cauccucacaccuucu

SEQ ID NO: 2049155 - RNA, 15 nt, Homo sapiens
aggagcugccauguc

SEQ ID NO: 2049156 - RNA, 15 nt, Homo sapiens
gcagguguucugggc

SEQ ID NO: 2049157 - RNA, 14 nt, Homo sapiens
auaaauggaaucau

SEQ ID NO: 2049158 - RNA, 16 nt, Homo sapiens
auguguuaagugcagg

SEQ ID NO: 2049159 - RNA, 20 nt, Homo sapiens
gagagauauuuugauucuca

SEQ ID NO: 2049160 - RNA, 22 nt, Homo sapiens
ucacagauuuccaaaaguacua

SEQ ID NO: 2049161 - RNA, 14 nt, Homo sapiens
guacccagugccua

SEQ ID NO: 2049162 - RNA, 16 nt, Homo sapiens
accauaaacuguacaa

SEQ ID NO: 2049163 - RNA, 12 nt, Homo sapiens
uuaaauuuucca

SEQ ID NO: 2049164 - RNA, 17 nt, Homo sapiens
aaauccuuccaaaaauu

SEQ ID NO: 2049165 - RNA, 14 nt, Homo sapiens
aagcauuugacaca

SEQ ID NO: 2049166 - RNA, 18 nt, Homo sapiens
ccacuuaaguucuuugau

SEQ ID NO: 2049167 - RNA, 23 nt, Homo sapiens
ucauuaaugacacuuguccccaa

SEQ ID NO: 2049168 - RNA, 23 nt, Homo sapiens
gccaggacugggguucacgucac

SEQ ID NO: 2049169 - RNA, 21 nt, Homo sapiens
cacucaaugccaggcagugca

SEQ ID NO: 2049170 - RNA, 14 nt, Homo sapiens
cuuuaccuuuucag

SEQ ID NO: 2049171 - RNA, 13 nt, Homo sapiens
aucacagcucacu

SEQ ID NO: 2049172 - RNA, 19 nt, Homo sapiens
acaacuucccaaagcacaa

SEQ ID NO: 2049173 - RNA, 20 nt, Homo sapiens
caguauuuucuccacuucau

SEQ ID NO: 2049174 - RNA, 23 nt, Homo sapiens
aaauuuuuacucaggcuuucuau

SEQ ID NO: 2049175 - RNA, 22 nt, Homo sapiens
ucagagccagccggcuaugaaa

SEQ ID NO: 2049176 - RNA, 22 nt, Homo sapiens
caccaccggggcacuggcugcu

SEQ ID NO: 2049177 - RNA, 14 nt, Homo sapiens
ucaugagugaauaa

SEQ ID NO: 2049178 - RNA, 14 nt, Homo sapiens
ucgagagugagaaa

SEQ ID NO: 2049179 - RNA, 14 nt, Homo sapiens
uggcaaaauugcca

SEQ ID NO: 2049180 - RNA, 14 nt, Homo sapiens
aauaaugugcacug

SEQ ID NO: 2049181 - RNA, 15 nt, Homo sapiens
ucucucugcaagaca

SEQ ID NO: 2049182 - RNA, 21 nt, Homo sapiens
cuaaagaauguguucuaaaac

SEQ ID NO: 2049183 - RNA, 16 nt, Homo sapiens
ugguguggucuacuaa

SEQ ID NO: 2049184 - RNA, 17 nt, Homo sapiens
gauugccauaugugcaa

SEQ ID NO: 2049185 - RNA, 23 nt, Homo sapiens
uggaugugguuaccgaguaucug

SEQ ID NO: 2049186 - RNA, 16 nt, Homo sapiens
ucuguaacacagaaua

SEQ ID NO: 2049187 - RNA, 20 nt, Homo sapiens
caucuggauaucaaggugga

SEQ ID NO: 2049188 - RNA, 19 nt, Homo sapiens
aaagauguuugucagauau

SEQ ID NO: 2049189 - RNA, 18 nt, Homo sapiens
gguugaucacacucuggg

SEQ ID NO: 2049190 - RNA, 21 nt, Homo sapiens
acuuuugcagcuuccuuccaa

SEQ ID NO: 2049191 - RNA, 14 nt, Homo sapiens
agauuugaggcugg

SEQ ID NO: 2049192 - RNA, 22 nt, Homo sapiens
ucagacugcaugacagucacag

SEQ ID NO: 2049193 - RNA, 14 nt, Homo sapiens
accauauugcccag

SEQ ID NO: 2049194 - RNA, 15 nt, Homo sapiens
gaacauacuguucuc

SEQ ID NO: 2049195 - RNA, 14 nt, Homo sapiens
gacaaguguuuauu

SEQ ID NO: 2049196 - RNA, 18 nt, Homo sapiens
aauauuuuaagacuauaa

SEQ ID NO: 2049197 - RNA, 14 nt, Homo sapiens
aaaaggaguauaca

SEQ ID NO: 2049198 - RNA, 15 nt, Homo sapiens
cucauuuggggacca

SEQ ID NO: 2049199 - RNA, 17 nt, Homo sapiens
aacccccaucucuacua

SEQ ID NO: 2049200 - RNA, 21 nt, Homo sapiens
cagcaugaaaaugcaguuucu

SEQ ID NO: 2049201 - RNA, 20 nt, Homo sapiens
acgguuuuaaauguguugcu

SEQ ID NO: 2049202 - RNA, 21 nt, Homo sapiens
accucugacgcaccacugcca

SEQ ID NO: 2049203 - RNA, 22 nt, Homo sapiens
uggcuuugccuuggcuuugcca

SEQ ID NO: 2049204 - RNA, 15 nt, Homo sapiens
gcucaggggcgugug

SEQ ID NO: 2049205 - RNA, 18 nt, Homo sapiens
cuacuuuaaauuguggau

SEQ ID NO: 2049206 - RNA, 14 nt, Homo sapiens
aguguauuaaucuc

SEQ ID NO: 2049207 - RNA, 18 nt, Homo sapiens
cuaccacgggucugccau

SEQ ID NO: 2049208 - RNA, 15 nt, Homo sapiens
cuacuccucugcagu

SEQ ID NO: 2049209 - RNA, 15 nt, Homo sapiens
ugcagauugcuacua

SEQ ID NO: 2049210 - RNA, 13 nt, Homo sapiens
agcucaaacuggc

SEQ ID NO: 2049211 - RNA, 15 nt, Homo sapiens
gauuucuauucccua

SEQ ID NO: 2049212 - RNA, 19 nt, Homo sapiens
agagguuugucaacaaaaa

SEQ ID NO: 2049213 - RNA, 19 nt, Homo sapiens
uuauaccaaagauuacuaa

SEQ ID NO: 2049214 - RNA, 22 nt, Homo sapiens
cagugccgcucuguagagggua

SEQ ID NO: 2049215 - RNA, 14 nt, Homo sapiens
gagggagggcggug

SEQ ID NO: 2049216 - RNA, 23 nt, Homo sapiens
cauugcaacaagguuaccucuau

SEQ ID NO: 2049217 - RNA, 14 nt, Homo sapiens
cccaugcccagcug

SEQ ID NO: 2049218 - RNA, 18 nt, Homo sapiens
gaucugcaucugauagaa

SEQ ID NO: 2049219 - RNA, 21 nt, Homo sapiens
cagucaaaacccaccaaaacc

SEQ ID NO: 2049220 - RNA, 17 nt, Homo sapiens
aagccuggcccagugag

SEQ ID NO: 2049221 - RNA, 18 nt, Homo sapiens
uggagugcaguggcacaa

SEQ ID NO: 2049222 - RNA, 18 nt, Homo sapiens
gaaguaaaggcauuccac

SEQ ID NO: 2049223 - RNA, 20 nt, Homo sapiens
gagaaaaagaaagaacuguc

SEQ ID NO: 2049224 - RNA, 18 nt, Homo sapiens
guuauaaaucaaugucac

SEQ ID NO: 2049225 - RNA, 18 nt, Homo sapiens
uaggggccgaguccagga

SEQ ID NO: 2049226 - RNA, 18 nt, Homo sapiens
gauggggaaggcuuucag

SEQ ID NO: 2049227 - RNA, 21 nt, Homo sapiens
ugguaaggccucuggacuggc

SEQ ID NO: 2049228 - RNA, 20 nt, Homo sapiens
acuguuauagaauagccuga

SEQ ID NO: 2049229 - RNA, 23 nt, Homo sapiens
cuaggcauuacuggccuuuucac

SEQ ID NO: 2049230 - RNA, 19 nt, Homo sapiens
auuuaccugauuuuaauca

SEQ ID NO: 2049231 - RNA, 14 nt, Homo sapiens
aaggggugggccac

SEQ ID NO: 2049232 - RNA, 16 nt, Homo sapiens
uaaagucaacaaccau

SEQ ID NO: 2049233 - RNA, 17 nt, Homo sapiens
aagguuccaacuguaua

SEQ ID NO: 2049234 - RNA, 11 nt, Homo sapiens
agagcuucucc

SEQ ID NO: 2049235 - RNA, 21 nt, Homo sapiens
ugcaggggguggguguguuag

SEQ ID NO: 2049236 - RNA, 16 nt, Homo sapiens
uuucuaaauugcauga

SEQ ID NO: 2049237 - RNA, 22 nt, Homo sapiens
accgaugggcuuagagcucuca

SEQ ID NO: 2049238 - RNA, 21 nt, Homo sapiens
uacagcuggguggcacugcca

SEQ ID NO: 2049239 - RNA, 17 nt, Homo sapiens
aggagcuugggugugcu

SEQ ID NO: 2049240 - RNA, 19 nt, Homo sapiens
ggaccccuuguuacucagg

SEQ ID NO: 2049241 - RNA, 19 nt, Homo sapiens
cguccccuccuucccucac

SEQ ID NO: 2049242 - RNA, 20 nt, Homo sapiens
gcuuguccugcucucuucag

SEQ ID NO: 2049243 - RNA, 17 nt, Homo sapiens
augaaugacauugaacu

SEQ ID NO: 2049244 - RNA, 22 nt, Homo sapiens
aacuaaagccaaggguauccaa

SEQ ID NO: 2049245 - RNA, 16 nt, Homo sapiens
aagaaucuguagcuug

SEQ ID NO: 2049246 - RNA, 14 nt, Homo sapiens
uaccacugcacugu

SEQ ID NO: 2049247 - RNA, 14 nt, Homo sapiens
ccccacuguccugu

SEQ ID NO: 2049248 - RNA, 18 nt, Homo sapiens
uaugaaagcacugcauga

SEQ ID NO: 2049249 - RNA, 18 nt, Homo sapiens
acuaguucaaaugaugaa

SEQ ID NO: 2049250 - RNA, 19 nt, Homo sapiens
acuugaaugcuaguuauac

SEQ ID NO: 2049251 - RNA, 17 nt, Homo sapiens
cccgugacacaugcucu

SEQ ID NO: 2049252 - RNA, 16 nt, Homo sapiens
ucuaacugcuguuaaa

SEQ ID NO: 2049253 - RNA, 20 nt, Homo sapiens
caauucagauugucuugcaa

SEQ ID NO: 2049254 - RNA, 19 nt, Homo sapiens
aucucccuuuguuggaaag

SEQ ID NO: 2049255 - RNA, 16 nt, Homo sapiens
uaaaugcaugucuuaa

SEQ ID NO: 2049256 - RNA, 12 nt, Homo sapiens
gucuugaacucc

SEQ ID NO: 2049257 - RNA, 11 nt, Homo sapiens
auaguucuucu

SEQ ID NO: 2049258 - RNA, 16 nt, Homo sapiens
gaggagaagcaauggg

SEQ ID NO: 2049259 - RNA, 12 nt, Homo sapiens
ugaugcuagcca

SEQ ID NO: 2049260 - RNA, 22 nt, Homo sapiens
auuuauugugaaucgauuccca

SEQ ID NO: 2049261 - RNA, 13 nt, Homo sapiens
cacagggugguuu

SEQ ID NO: 2049262 - RNA, 12 nt, Homo sapiens
ccauaagcuauu

SEQ ID NO: 2049263 - RNA, 21 nt, Homo sapiens
gcccagggacacccacacagg

SEQ ID NO: 2049264 - RNA, 15 nt, Homo sapiens
ccaucauuguaacau

SEQ ID NO: 2049265 - RNA, 19 nt, Homo sapiens
aaaaucagccugcuccagc

SEQ ID NO: 2049266 - RNA, 17 nt, Homo sapiens
cacugcuguaaagcaaa

SEQ ID NO: 2049267 - RNA, 21 nt, Homo sapiens
aaucagugaagaugcaaucag

SEQ ID NO: 2049268 - RNA, 16 nt, Homo sapiens
ggaaugaaaacauuca

SEQ ID NO: 2049269 - RNA, 14 nt, Homo sapiens
ucagagucuaucaa

SEQ ID NO: 2049270 - RNA, 21 nt, Homo sapiens
uugaagaaaaagacacagaca

SEQ ID NO: 2049271 - RNA, 15 nt, Homo sapiens
ccccgggccucgggc

SEQ ID NO: 2049272 - RNA, 17 nt, Homo sapiens
cuaagcacguagagaug

SEQ ID NO: 2049273 - RNA, 12 nt, Homo sapiens
aaacucuucccu

SEQ ID NO: 2049274 - RNA, 21 nt, Homo sapiens
caaauaaagaccugagaaccu

SEQ ID NO: 2049275 - RNA, 15 nt, Homo sapiens
uugcugguacuaaga

SEQ ID NO: 2049276 - RNA, 19 nt, Homo sapiens
gaaaaaaguuuugaugaaa

SEQ ID NO: 2049277 - RNA, 18 nt, Homo sapiens
ugccuaguauugacaaaa

SEQ ID NO: 2049278 - RNA, 13 nt, Homo sapiens
ccacuuaugcaua

SEQ ID NO: 2049279 - RNA, 16 nt, Homo sapiens
ugaauauuauacuucu

SEQ ID NO: 2049280 - RNA, 14 nt, Homo sapiens
aacacaagccacag

SEQ ID NO: 2049281 - RNA, 21 nt, Homo sapiens
uguuucuuucucugaggacaa

SEQ ID NO: 2049282 - RNA, 16 nt, Homo sapiens
uaaugauucaauguga

SEQ ID NO: 2049283 - RNA, 21 nt, Homo sapiens
acccacgaggauggccuggaa

SEQ ID NO: 2049284 - RNA, 15 nt, Homo sapiens
caauccuuuaccacu

SEQ ID NO: 2049285 - RNA, 13 nt, Homo sapiens
cuuguaguaugcu

SEQ ID NO: 2049286 - RNA, 20 nt, Homo sapiens
cugaaaggagacauugcucu

SEQ ID NO: 2049287 - RNA, 20 nt, Homo sapiens
ggcaaagaacucauuugaau

SEQ ID NO: 2049288 - RNA, 24 nt, Homo sapiens
cagccuuaugauuaaacuuccuuc

SEQ ID NO: 2049289 - RNA, 15 nt, Homo sapiens
uagaagcuucuugcu

SEQ ID NO: 2049290 - RNA, 22 nt, Homo sapiens
auguucacuuauugacuauuau

SEQ ID NO: 2049291 - RNA, 19 nt, Homo sapiens
aaugcuaagaaaugcugaa

SEQ ID NO: 2049292 - RNA, 20 nt, Homo sapiens
cuggcaugggaaugaauguc

SEQ ID NO: 2049293 - RNA, 13 nt, Homo sapiens
cuaagaagggaac

SEQ ID NO: 2049294 - RNA, 15 nt, Homo sapiens
agaguaucugagaac

SEQ ID NO: 2049295 - RNA, 14 nt, Homo sapiens
ggcaucaucaauaa

SEQ ID NO: 2049296 - RNA, 13 nt, Homo sapiens
augaaaagugcau

SEQ ID NO: 2049297 - RNA, 13 nt, Homo sapiens
uugcuaagagcca

SEQ ID NO: 2049298 - RNA, 21 nt, Homo sapiens
ggcaaaaugaacuaacugcca

SEQ ID NO: 2049299 - RNA, 14 nt, Homo sapiens
caauuucuaugugg

SEQ ID NO: 2049300 - RNA, 12 nt, Homo sapiens
cucaacuauaac

SEQ ID NO: 2049301 - RNA, 21 nt, Homo sapiens
guucauuuagauaauuugaaa

SEQ ID NO: 2049302 - RNA, 21 nt, Homo sapiens
ucuuguauaaugaacauguua

SEQ ID NO: 2049303 - RNA, 21 nt, Homo sapiens
caaugugaaaccaucacagcu

SEQ ID NO: 2049304 - RNA, 21 nt, Homo sapiens
aucaccuuaagaaagugucuc

SEQ ID NO: 2049305 - RNA, 13 nt, Homo sapiens
uggcaucugugug

SEQ ID NO: 2049306 - RNA, 17 nt, Homo sapiens
uacucccauuaaauuca

SEQ ID NO: 2049307 - RNA, 17 nt, Homo sapiens
aacuccuacuaaauccc

SEQ ID NO: 2049308 - RNA, 19 nt, Homo sapiens
auggggaagguuaucagug

SEQ ID NO: 2049309 - RNA, 14 nt, Homo sapiens
augguccugugaug

SEQ ID NO: 2049310 - RNA, 14 nt, Homo sapiens
gaaacaucauuuca

SEQ ID NO: 2049311 - RNA, 21 nt, Homo sapiens
cuuucuggauggcaucuagcc

SEQ ID NO: 2049312 - RNA, 20 nt, Homo sapiens
gacaaacuccggcacugggu

SEQ ID NO: 2049313 - RNA, 20 nt, Homo sapiens
gaauugaaccgucaauguga

SEQ ID NO: 2049314 - RNA, 14 nt, Homo sapiens
uccugacacauucu

SEQ ID NO: 2049315 - RNA, 13 nt, Homo sapiens
caggcaucgccau

SEQ ID NO: 2049316 - RNA, 22 nt, Homo sapiens
cucccuuuuaaaaggagcacau

SEQ ID NO: 2049317 - RNA, 14 nt, Homo sapiens
augucccacaggga

SEQ ID NO: 2049318 - RNA, 14 nt, Homo sapiens
cgaccccaucucau

SEQ ID NO: 2049319 - RNA, 18 nt, Homo sapiens
aaauguccaagcuaugua

SEQ ID NO: 2049320 - RNA, 14 nt, Homo sapiens
uaaguccuaauaaa

SEQ ID NO: 2049321 - RNA, 12 nt, Homo sapiens
ggagaguggcau

SEQ ID NO: 2049322 - RNA, 22 nt, Homo sapiens
agguaugggaccugcuaagugu

SEQ ID NO: 2049323 - RNA, 17 nt, Homo sapiens
cuagacuccucaggaga

SEQ ID NO: 2049324 - RNA, 14 nt, Homo sapiens
uccucaggauuuca

SEQ ID NO: 2049325 - RNA, 13 nt, Homo sapiens
cgcuuauguuaau

SEQ ID NO: 2049326 - RNA, 21 nt, Homo sapiens
uucaggaacguugccacacca

SEQ ID NO: 2049327 - RNA, 16 nt, Homo sapiens
agagauguagcagaau

SEQ ID NO: 2049328 - RNA, 19 nt, Homo sapiens
auaccaaagacacaagcaa

SEQ ID NO: 2049329 - RNA, 13 nt, Homo sapiens
gauauaagcaaaa

SEQ ID NO: 2049330 - RNA, 20 nt, Homo sapiens
uuuuuaaguauuucagaugc

SEQ ID NO: 2049331 - RNA, 16 nt, Homo sapiens
uaaaacaaaagcucau

SEQ ID NO: 2049332 - RNA, 24 nt, Homo sapiens
agacaugguggcaugcaccugcaa

SEQ ID NO: 2049333 - RNA, 15 nt, Homo sapiens
aaguuggcaaaacag

SEQ ID NO: 2049334 - RNA, 12 nt, Homo sapiens
ccccuuugcccu

SEQ ID NO: 2049335 - RNA, 13 nt, Homo sapiens
ugccauuugauac

SEQ ID NO: 2049336 - RNA, 19 nt, Homo sapiens
uguaugacugaaguaauaa

SEQ ID NO: 2049337 - RNA, 18 nt, Homo sapiens
caauaugcaagcagcuuu

SEQ ID NO: 2049338 - RNA, 16 nt, Homo sapiens
ucaguugacaaaauau

SEQ ID NO: 2049339 - RNA, 19 nt, Homo sapiens
uagagaccgagccucuguc

SEQ ID NO: 2049340 - RNA, 20 nt, Homo sapiens
gaacuauuuucaaagacuua

SEQ ID NO: 2049341 - RNA, 12 nt, Homo sapiens
ugcuaucugggc

SEQ ID NO: 2049342 - RNA, 14 nt, Homo sapiens
caggccaggccuca

SEQ ID NO: 2049343 - RNA, 16 nt, Homo sapiens
agaagguuacuaccua

SEQ ID NO: 2049344 - RNA, 22 nt, Homo sapiens
ugaggugccugcucaggugcua

SEQ ID NO: 2049345 - RNA, 19 nt, Homo sapiens
gauguuuacagacugugag

SEQ ID NO: 2049346 - RNA, 20 nt, Homo sapiens
agcccaaucugccagacuua

SEQ ID NO: 2049347 - RNA, 16 nt, Homo sapiens
aggggccagacccugc

SEQ ID NO: 2049348 - RNA, 17 nt, Homo sapiens
agaacaggacuccacac

SEQ ID NO: 2049349 - RNA, 17 nt, Homo sapiens
agggcauaccuugugca

SEQ ID NO: 2049350 - RNA, 17 nt, Homo sapiens
uugacaacugcacauga

SEQ ID NO: 2049351 - RNA, 21 nt, Homo sapiens
guggcccccacccaguaccgc

SEQ ID NO: 2049352 - RNA, 21 nt, Homo sapiens
guucacugcuccuugcugcau

SEQ ID NO: 2049353 - RNA, 17 nt, Homo sapiens
aaugcauguccucaaaa

SEQ ID NO: 2049354 - RNA, 19 nt, Homo sapiens
gaugaccuugaaugaugcc

SEQ ID NO: 2049355 - RNA, 22 nt, Homo sapiens
agccagauggaguaccaugagg

SEQ ID NO: 2049356 - RNA, 18 nt, Homo sapiens
caugugcuagucacuggc

SEQ ID NO: 2049357 - RNA, 16 nt, Homo sapiens
ugccuguauuuccaac

SEQ ID NO: 2049358 - RNA, 18 nt, Homo sapiens
ucagucuuccuuguggaa

SEQ ID NO: 2049359 - RNA, 14 nt, Homo sapiens
agccugggcaacau

SEQ ID NO: 2049360 - RNA, 12 nt, Homo sapiens
acugugacugua

SEQ ID NO: 2049361 - RNA, 12 nt, Homo sapiens
gcaaaggaacua

SEQ ID NO: 2049362 - RNA, 17 nt, Homo sapiens
uucagauaugauucaaa

SEQ ID NO: 2049363 - RNA, 22 nt, Homo sapiens
ccuuuagauauuauucauucau

SEQ ID NO: 2049364 - RNA, 21 nt, Homo sapiens
ugcugcacccacuuaaucuac

SEQ ID NO: 2049365 - RNA, 20 nt, Homo sapiens
ugccucaagccccagagugg

SEQ ID NO: 2049366 - RNA, 21 nt, Homo sapiens
gcccucuuaucucauccuuuc

SEQ ID NO: 2049367 - RNA, 13 nt, Homo sapiens
ggacauaagacag

SEQ ID NO: 2049368 - RNA, 14 nt, Homo sapiens
gccccgucucaggu

SEQ ID NO: 2049369 - RNA, 16 nt, Homo sapiens
ucaaaacuaccuguga

SEQ ID NO: 2049370 - RNA, 19 nt, Homo sapiens
cucuagagguucaaaggca

SEQ ID NO: 2049371 - RNA, 22 nt, Homo sapiens
uuugcucggauacuugccaaaa

SEQ ID NO: 2049372 - RNA, 23 nt, Homo sapiens
aggccaagcauuucuagcaguga

SEQ ID NO: 2049373 - RNA, 15 nt, Homo sapiens
cagugacaaccaaaa

SEQ ID NO: 2049374 - RNA, 20 nt, Homo sapiens
cuugguugucuggcaaggac

SEQ ID NO: 2049375 - RNA, 23 nt, Homo sapiens
agcaagaggugguagaaccacuu

SEQ ID NO: 2049376 - RNA, 21 nt, Homo sapiens
ucugaaauccauaaacuaaga

SEQ ID NO: 2049377 - RNA, 14 nt, Homo sapiens
uucacuaaugauug

SEQ ID NO: 2049378 - RNA, 22 nt, Homo sapiens
cugagaaaaguauucucaaaga

SEQ ID NO: 2049379 - RNA, 14 nt, Homo sapiens
agcgcaaugccauc

SEQ ID NO: 2049380 - RNA, 20 nt, Homo sapiens
auaauaugaagaccaaauga

SEQ ID NO: 2049381 - RNA, 16 nt, Homo sapiens
aguuacaucucagugc

SEQ ID NO: 2049382 - RNA, 21 nt, Homo sapiens
ugaugcgucuacccagacuca

SEQ ID NO: 2049383 - RNA, 16 nt, Homo sapiens
uuuuggcaucugcaaa

SEQ ID NO: 2049384 - RNA, 14 nt, Homo sapiens
uucauguaucuuau

SEQ ID NO: 2049385 - RNA, 18 nt, Homo sapiens
aguuugucauauacugcu

SEQ ID NO: 2049386 - RNA, 15 nt, Homo sapiens
ugcaauucuuuuugg

SEQ ID NO: 2049387 - RNA, 18 nt, Homo sapiens
ggugccuggccaugucac

SEQ ID NO: 2049388 - RNA, 22 nt, Homo sapiens
acuccuuacagaagggagugaa

SEQ ID NO: 2049389 - RNA, 22 nt, Homo sapiens
guuuguccuuuuucacuuugaa

SEQ ID NO: 2049390 - RNA, 18 nt, Homo sapiens
ugccuucacugugcucca

SEQ ID NO: 2049391 - RNA, 16 nt, Homo sapiens
uggccucgcuguucuc

SEQ ID NO: 2049392 - RNA, 16 nt, Homo sapiens
ugacauuacaauccug

SEQ ID NO: 2049393 - RNA, 22 nt, Homo sapiens
uuucuaaaaagaaaaagagaua

SEQ ID NO: 2049394 - RNA, 21 nt, Homo sapiens
ugagaucuugguccuguguuu

SEQ ID NO: 2049395 - RNA, 11 nt, Homo sapiens
ucgggacauca

SEQ ID NO: 2049396 - RNA, 23 nt, Homo sapiens
ucacuaaauaaacacgauuuuau

SEQ ID NO: 2049397 - RNA, 18 nt, Homo sapiens
gaaagcugacauugccaa

SEQ ID NO: 2049398 - RNA, 19 nt, Homo sapiens
uaacuugcaccucugaccu

SEQ ID NO: 2049399 - RNA, 19 nt, Homo sapiens
ccuaggaucccgucuucca

SEQ ID NO: 2049400 - RNA, 13 nt, Homo sapiens
acaucuuuacuca

SEQ ID NO: 2049401 - RNA, 18 nt, Homo sapiens
acauacucaagagcauaa

SEQ ID NO: 2049402 - RNA, 20 nt, Homo sapiens
ucugugauccuuggugcugu

SEQ ID NO: 2049403 - RNA, 20 nt, Homo sapiens
ggucauuacaaaaaaacacg

SEQ ID NO: 2049404 - RNA, 15 nt, Homo sapiens
uguuguuuucugacu

SEQ ID NO: 2049405 - RNA, 22 nt, Homo sapiens
agauuuugaaugcuuccugaca

SEQ ID NO: 2049406 - RNA, 23 nt, Homo sapiens
aucacagggccccagaaggcagg

SEQ ID NO: 2049407 - RNA, 18 nt, Homo sapiens
gagccagcagacauuguc

SEQ ID NO: 2049408 - RNA, 11 nt, Homo sapiens
caaaguaccuu

SEQ ID NO: 2049409 - RNA, 18 nt, Homo sapiens
auccuucuuucuaguuca

SEQ ID NO: 2049410 - RNA, 12 nt, Homo sapiens
ucucuacugugg

SEQ ID NO: 2049411 - RNA, 12 nt, Homo sapiens
aaaaagccucca

SEQ ID NO: 2049412 - RNA, 14 nt, Homo sapiens
aucuuugugcuuca

SEQ ID NO: 2049413 - RNA, 14 nt, Homo sapiens
accuuaguguuucu

SEQ ID NO: 2049414 - RNA, 15 nt, Homo sapiens
aauuauagauuagau

SEQ ID NO: 2049415 - RNA, 12 nt, Homo sapiens
gaaauguagaau

SEQ ID NO: 2049416 - RNA, 18 nt, Homo sapiens
acagagauugaacuccaa

SEQ ID NO: 2049417 - RNA, 18 nt, Homo sapiens
gucccugcagaagccaga

SEQ ID NO: 2049418 - RNA, 13 nt, Homo sapiens
cuuuauugcacua

SEQ ID NO: 2049419 - RNA, 21 nt, Homo sapiens
caaaacuauccuaugccuuca

SEQ ID NO: 2049420 - RNA, 14 nt, Homo sapiens
agcuggcgucuguc

SEQ ID NO: 2049421 - RNA, 20 nt, Homo sapiens
agagaggccuuuuguuuaaa

SEQ ID NO: 2049422 - RNA, 14 nt, Homo sapiens
ccucagaaagggau

SEQ ID NO: 2049423 - RNA, 15 nt, Homo sapiens
caacauucauagucu

SEQ ID NO: 2049424 - RNA, 20 nt, Homo sapiens
ugcacuauguauauacauau

SEQ ID NO: 2049425 - RNA, 16 nt, Homo sapiens
cacagcacucucuaaa

SEQ ID NO: 2049426 - RNA, 12 nt, Homo sapiens
gcucgggugcug

SEQ ID NO: 2049427 - RNA, 23 nt, Homo sapiens
ucagccuugagagaggccacacu

SEQ ID NO: 2049428 - RNA, 14 nt, Homo sapiens
guauuuugugcaag

SEQ ID NO: 2049429 - RNA, 23 nt, Homo sapiens
ggccaguugcccagagcacuuua

SEQ ID NO: 2049430 - RNA, 12 nt, Homo sapiens
aauuaacauauc

SEQ ID NO: 2049431 - RNA, 16 nt, Homo sapiens
cccagggccuccagga

SEQ ID NO: 2049432 - RNA, 18 nt, Homo sapiens
auguuaaggaaacucuua

SEQ ID NO: 2049433 - RNA, 16 nt, Homo sapiens
agaguucuugcacccu

SEQ ID NO: 2049434 - RNA, 13 nt, Homo sapiens
uuugggccagaca

SEQ ID NO: 2049435 - RNA, 23 nt, Homo sapiens
uaccuuuaucuuucaccuuucua

SEQ ID NO: 2049436 - RNA, 18 nt, Homo sapiens
aucuuaacccugugcugu

SEQ ID NO: 2049437 - RNA, 23 nt, Homo sapiens
aauaaauuggugauaaguggaaa

SEQ ID NO: 2049438 - RNA, 16 nt, Homo sapiens
cuuaauugaaacaaca

SEQ ID NO: 2049439 - RNA, 20 nt, Homo sapiens
ucuuuugauaaggcuguuaa

SEQ ID NO: 2049440 - RNA, 16 nt, Homo sapiens
cgucgccacucgggag

SEQ ID NO: 2049441 - RNA, 21 nt, Homo sapiens
gagguaaaagugugagcagug

SEQ ID NO: 2049442 - RNA, 14 nt, Homo sapiens
cccaaauauuuagc

SEQ ID NO: 2049443 - RNA, 17 nt, Homo sapiens
ucuauacacauaagcau

SEQ ID NO: 2049444 - RNA, 13 nt, Homo sapiens
cacugcuuuacag

SEQ ID NO: 2049445 - RNA, 16 nt, Homo sapiens
uuuaaacaaaagugua

SEQ ID NO: 2049446 - RNA, 16 nt, Homo sapiens
auaaaggaugggacca

SEQ ID NO: 2049447 - RNA, 20 nt, Homo sapiens
uaaaaauaucacacugaaua

SEQ ID NO: 2049448 - RNA, 15 nt, Homo sapiens
ggcguacacaugcac

SEQ ID NO: 2049449 - RNA, 12 nt, Homo sapiens
ucucuacaagag

SEQ ID NO: 2049450 - RNA, 23 nt, Homo sapiens
acccaaggauucuguucugcaac

SEQ ID NO: 2049451 - RNA, 17 nt, Homo sapiens
aggcuggagugcagugg

SEQ ID NO: 2049452 - RNA, 14 nt, Homo sapiens
aauacagucauucc

SEQ ID NO: 2049453 - RNA, 17 nt, Homo sapiens
aaauaaaaauagcuaua

SEQ ID NO: 2049454 - RNA, 14 nt, Homo sapiens
uccaagaagcccuc

SEQ ID NO: 2049455 - RNA, 16 nt, Homo sapiens
agcuccacugccaugu

SEQ ID NO: 2049456 - RNA, 18 nt, Homo sapiens
ggaccuccaggcuccagc

SEQ ID NO: 2049457 - RNA, 13 nt, Homo sapiens
aaaucacaucucc

SEQ ID NO: 2049458 - RNA, 13 nt, Homo sapiens
aaauaacaucuca

SEQ ID NO: 2049459 - RNA, 17 nt, Homo sapiens
acuuuccagugaggaaa

SEQ ID NO: 2049460 - RNA, 19 nt, Homo sapiens
gagacuguggagacugcuc

SEQ ID NO: 2049461 - RNA, 16 nt, Homo sapiens
cauacagagacagaua

SEQ ID NO: 2049462 - RNA, 15 nt, Homo sapiens
cacugagaaagccaa

SEQ ID NO: 2049463 - RNA, 22 nt, Homo sapiens
gggaaagagccuaacaucucca

SEQ ID NO: 2049464 - RNA, 13 nt, Homo sapiens
cagcaucuuucac

SEQ ID NO: 2049465 - RNA, 19 nt, Homo sapiens
cacaggggccccuccucua

SEQ ID NO: 2049466 - RNA, 16 nt, Homo sapiens
uaggagaugaaacugg

SEQ ID NO: 2049467 - RNA, 19 nt, Homo sapiens
caggugccaaguuccacuu

SEQ ID NO: 2049468 - RNA, 13 nt, Homo sapiens
aagaugacugugu

SEQ ID NO: 2049469 - RNA, 14 nt, Homo sapiens
gagcugaaagggag

SEQ ID NO: 2049470 - RNA, 16 nt, Homo sapiens
uaguuucauuuccuug

SEQ ID NO: 2049471 - RNA, 15 nt, Homo sapiens
uccaccacugcuuaa

SEQ ID NO: 2049472 - RNA, 21 nt, Homo sapiens
ugagcucgguggcucaugccu

SEQ ID NO: 2049473 - RNA, 23 nt, Homo sapiens
cuuuuaaaacaauauuuaugucc

SEQ ID NO: 2049474 - RNA, 22 nt, Homo sapiens
agagaucuuucuuuccaaaaca

SEQ ID NO: 2049475 - RNA, 13 nt, Homo sapiens
cacaacagugaaa

SEQ ID NO: 2049476 - RNA, 15 nt, Homo sapiens
uuuucuuuaggacau

SEQ ID NO: 2049477 - RNA, 17 nt, Homo sapiens
ucacacagagaggcaga

SEQ ID NO: 2049478 - RNA, 15 nt, Homo sapiens
ugccagagcacacau

SEQ ID NO: 2049479 - RNA, 16 nt, Homo sapiens
ggaugucacucaugua

SEQ ID NO: 2049480 - RNA, 16 nt, Homo sapiens
agguggcacuagggau

SEQ ID NO: 2049481 - RNA, 21 nt, Homo sapiens
gacugccaugcuagacaagcu

SEQ ID NO: 2049482 - RNA, 19 nt, Homo sapiens
auguggacgugcacugaca

SEQ ID NO: 2049483 - RNA, 15 nt, Homo sapiens
ggaacacaaccauag

SEQ ID NO: 2049484 - RNA, 22 nt, Homo sapiens
ccgugacaguuuacaaaugaca

SEQ ID NO: 2049485 - RNA, 12 nt, Homo sapiens
ucauuucuagca

SEQ ID NO: 2049486 - RNA, 20 nt, Homo sapiens
uauugaagaugcugccugua

SEQ ID NO: 2049487 - RNA, 19 nt, Homo sapiens
uguaauccuagcuacuugg

SEQ ID NO: 2049488 - RNA, 15 nt, Homo sapiens
guaaauccaggaaua

SEQ ID NO: 2049489 - RNA, 12 nt, Homo sapiens
uucuggcuuuac

SEQ ID NO: 2049490 - RNA, 16 nt, Homo sapiens
aagaguaugagucuuc

SEQ ID NO: 2049491 - RNA, 15 nt, Homo sapiens
aagauaaaacuaauu

SEQ ID NO: 2049492 - RNA, 14 nt, Homo sapiens
gaaaaaaguauagg

SEQ ID NO: 2049493 - RNA, 13 nt, Homo sapiens
auauaauuacuua

SEQ ID NO: 2049494 - RNA, 23 nt, Homo sapiens
uauaaauuauagaaucuacuuua

SEQ ID NO: 2049495 - RNA, 19 nt, Homo sapiens
ggaguuacaacagaagcug

SEQ ID NO: 2049496 - RNA, 18 nt, Homo sapiens
ugacaaugcuuauggaaa

SEQ ID NO: 2049497 - RNA, 12 nt, Homo sapiens
aaccccaucucu

SEQ ID NO: 2049498 - RNA, 21 nt, Homo sapiens
uguaaccuugucgacaaagag

SEQ ID NO: 2049499 - RNA, 20 nt, Homo sapiens
gaggccugcccucagggauc

SEQ ID NO: 2049500 - RNA, 19 nt, Homo sapiens
gaaagagaauagacaguau

SEQ ID NO: 2049501 - RNA, 15 nt, Homo sapiens
ugugaagcuaauaca

SEQ ID NO: 2049502 - RNA, 15 nt, Homo sapiens
cagggccucugcucu

SEQ ID NO: 2049503 - RNA, 15 nt, Homo sapiens
ucacccauggccuca

SEQ ID NO: 2049504 - RNA, 22 nt, Homo sapiens
ccgagaggcaggucaagaucug

SEQ ID NO: 2049505 - RNA, 15 nt, Homo sapiens
ugaucaaaaacuauu

SEQ ID NO: 2049506 - RNA, 15 nt, Homo sapiens
cauugaauacucuga

SEQ ID NO: 2049507 - RNA, 20 nt, Homo sapiens
aaacacuacuccuuuuccuc

SEQ ID NO: 2049508 - RNA, 21 nt, Homo sapiens
aaccucauuccccaaccacuu

SEQ ID NO: 2049509 - RNA, 16 nt, Homo sapiens
uccuacacuugagaug

SEQ ID NO: 2049510 - RNA, 17 nt, Homo sapiens
cagaauugugucugcag

SEQ ID NO: 2049511 - RNA, 11 nt, Homo sapiens
acacacucacu

SEQ ID NO: 2049512 - RNA, 16 nt, Homo sapiens
cugugguaaaugccac

SEQ ID NO: 2049513 - RNA, 18 nt, Homo sapiens
gucauuuuuuaagugacu

SEQ ID NO: 2049514 - RNA, 19 nt, Homo sapiens
aaaucaacccugcaaucac

SEQ ID NO: 2049515 - RNA, 13 nt, Homo sapiens
ccucuuaaaucau

SEQ ID NO: 2049516 - RNA, 23 nt, Homo sapiens
ugaacugucagcccacagcagca

SEQ ID NO: 2049517 - RNA, 22 nt, Homo sapiens
aaucaaucuuuaacaaccucug

SEQ ID NO: 2049518 - RNA, 20 nt, Homo sapiens
acauauuacuguugcauuua

SEQ ID NO: 2049519 - RNA, 14 nt, Homo sapiens
ugcaacagcacugg

SEQ ID NO: 2049520 - RNA, 21 nt, Homo sapiens
ggcaugagcuacuaugcccaa

SEQ ID NO: 2049521 - RNA, 17 nt, Homo sapiens
gcugccaguguccugag

SEQ ID NO: 2049522 - RNA, 16 nt, Homo sapiens
acuguaacugcucaga

SEQ ID NO: 2049523 - RNA, 18 nt, Homo sapiens
uagagaucugguuuugcu

SEQ ID NO: 2049524 - RNA, 16 nt, Homo sapiens
caauuacucacuaaag

SEQ ID NO: 2049525 - RNA, 21 nt, Homo sapiens
aaucuuuauaguucuacucca

SEQ ID NO: 2049526 - RNA, 24 nt, Homo sapiens
accccagugccugucuggagcuca

SEQ ID NO: 2049527 - RNA, 17 nt, Homo sapiens
caaugcuucuagaguuu

SEQ ID NO: 2049528 - RNA, 14 nt, Homo sapiens
guuguuuaccuguu

SEQ ID NO: 2049529 - RNA, 22 nt, Homo sapiens
uaaauuaccuuaaacuugcagu

SEQ ID NO: 2049530 - RNA, 22 nt, Homo sapiens
uuacuauuauagcaacuuuaag

SEQ ID NO: 2049531 - RNA, 22 nt, Homo sapiens
ucaguugucucugaugcagcuu

SEQ ID NO: 2049532 - RNA, 15 nt, Homo sapiens
cagggccacauagau

SEQ ID NO: 2049533 - RNA, 18 nt, Homo sapiens
ucccauagcgcuggcuca

SEQ ID NO: 2049534 - RNA, 16 nt, Homo sapiens
uggugccaccucagac

SEQ ID NO: 2049535 - RNA, 23 nt, Homo sapiens
cuaaucaguccuuauuaucccag

SEQ ID NO: 2049536 - RNA, 12 nt, Homo sapiens
aaaaucacagau

SEQ ID NO: 2049537 - RNA, 18 nt, Homo sapiens
ugguuucuagcaugaaga

SEQ ID NO: 2049538 - RNA, 12 nt, Homo sapiens
ggcugguccugg

SEQ ID NO: 2049539 - RNA, 17 nt, Homo sapiens
cucacuaaaaugcuaau

SEQ ID NO: 2049540 - RNA, 19 nt, Homo sapiens
guaacuuguuuuuauugca

SEQ ID NO: 2049541 - RNA, 21 nt, Homo sapiens
uuuauguugguugauauaaca

SEQ ID NO: 2049542 - RNA, 18 nt, Homo sapiens
uauaagaugucauccccu

SEQ ID NO: 2049543 - RNA, 16 nt, Homo sapiens
uggugguucauuccac

SEQ ID NO: 2049544 - RNA, 15 nt, Homo sapiens
ccccacagauccauc

SEQ ID NO: 2049545 - RNA, 17 nt, Homo sapiens
aauaaacucacaacucu

SEQ ID NO: 2049546 - RNA, 19 nt, Homo sapiens
aauugcuucugugcaauaa

SEQ ID NO: 2049547 - RNA, 17 nt, Homo sapiens
agaaaagccucagcuca

SEQ ID NO: 2049548 - RNA, 16 nt, Homo sapiens
cccucuacuccaugca

SEQ ID NO: 2049549 - RNA, 21 nt, Homo sapiens
gagugccagucagcagucaug

SEQ ID NO: 2049550 - RNA, 23 nt, Homo sapiens
acugcacuuuggaaaccaagcaa

SEQ ID NO: 2049551 - RNA, 20 nt, Homo sapiens
caacuuccccucuaacugga

SEQ ID NO: 2049552 - RNA, 17 nt, Homo sapiens
caauguuccauucuucg

SEQ ID NO: 2049553 - RNA, 17 nt, Homo sapiens
guaaaaggcacugcaca

SEQ ID NO: 2049554 - RNA, 17 nt, Homo sapiens
agcucuucaggccuccc

SEQ ID NO: 2049555 - RNA, 23 nt, Homo sapiens
aguauuccaugguguauaugugc

SEQ ID NO: 2049556 - RNA, 16 nt, Homo sapiens
gcagggccugauuuau

SEQ ID NO: 2049557 - RNA, 17 nt, Homo sapiens
agcugaauaaccugcac

SEQ ID NO: 2049558 - RNA, 13 nt, Homo sapiens
ucaccagcugcaa

SEQ ID NO: 2049559 - RNA, 19 nt, Homo sapiens
auuguacccccucauuugu

SEQ ID NO: 2049560 - RNA, 17 nt, Homo sapiens
agccauauuaaguauuu

SEQ ID NO: 2049561 - RNA, 14 nt, Homo sapiens
auggaaugccaaaa

SEQ ID NO: 2049562 - RNA, 19 nt, Homo sapiens
aauacauuuaaaacauuaa

SEQ ID NO: 2049563 - RNA, 16 nt, Homo sapiens
acaccacuuugucucu

SEQ ID NO: 2049564 - RNA, 15 nt, Homo sapiens
cagaguuauggugcc

SEQ ID NO: 2049565 - RNA, 18 nt, Homo sapiens
uuccuucgaggguuccag

SEQ ID NO: 2049566 - RNA, 20 nt, Homo sapiens
caccacuuugucucugagaa

SEQ ID NO: 2049567 - RNA, 22 nt, Homo sapiens
aaacagaagcuuuuuguuugca

SEQ ID NO: 2049568 - RNA, 23 nt, Homo sapiens
gcaagauuccaaguucucaccuc

SEQ ID NO: 2049569 - RNA, 12 nt, Homo sapiens
ugggcaggguga

SEQ ID NO: 2049570 - RNA, 13 nt, Homo sapiens
aggccgugugucu

SEQ ID NO: 2049571 - RNA, 18 nt, Homo sapiens
uuccacucaaauguccug

SEQ ID NO: 2049572 - RNA, 21 nt, Homo sapiens
aauccucaaaucagucuuccu

SEQ ID NO: 2049573 - RNA, 21 nt, Homo sapiens
cuccaucuccaagaaugcuga

SEQ ID NO: 2049574 - RNA, 16 nt, Homo sapiens
gacaauuucauuccau

SEQ ID NO: 2049575 - RNA, 17 nt, Homo sapiens
uauaaagaaacuuuauu

SEQ ID NO: 2049576 - RNA, 15 nt, Homo sapiens
ucugacuucaaggaa

SEQ ID NO: 2049577 - RNA, 14 nt, Homo sapiens
gaaaaugcauugua

SEQ ID NO: 2049578 - RNA, 17 nt, Homo sapiens
aaaauucuuaaguaugu

SEQ ID NO: 2049579 - RNA, 14 nt, Homo sapiens
cauuuuguaauaau

SEQ ID NO: 2049580 - RNA, 17 nt, Homo sapiens
gucuaaguaugccucag

SEQ ID NO: 2049581 - RNA, 18 nt, Homo sapiens
acuauuuccaaaagcaca

SEQ ID NO: 2049582 - RNA, 15 nt, Homo sapiens
cucaaggacuugaaa

SEQ ID NO: 2049583 - RNA, 15 nt, Homo sapiens
gacauggagauguaa

SEQ ID NO: 2049584 - RNA, 12 nt, Homo sapiens
aaaucuccagug

SEQ ID NO: 2049585 - RNA, 15 nt, Homo sapiens
ggauacgacacaugc

SEQ ID NO: 2049586 - RNA, 15 nt, Homo sapiens
cuuuuauuacaguca

SEQ ID NO: 2049587 - RNA, 18 nt, Homo sapiens
uggaaacaguuuggguua

SEQ ID NO: 2049588 - RNA, 16 nt, Homo sapiens
uuauauguugcuauaa

SEQ ID NO: 2049589 - RNA, 15 nt, Homo sapiens
auauauaaacuuugu

SEQ ID NO: 2049590 - RNA, 17 nt, Homo sapiens
cugggcuccuccagggu

SEQ ID NO: 2049591 - RNA, 21 nt, Homo sapiens
caauaaacuccuacuaaaucc

SEQ ID NO: 2049592 - RNA, 19 nt, Homo sapiens
uacugacggaguccugugu

SEQ ID NO: 2049593 - RNA, 15 nt, Homo sapiens
ucuggaccagccugu

SEQ ID NO: 2049594 - RNA, 13 nt, Homo sapiens
ggaauucagccau

SEQ ID NO: 2049595 - RNA, 13 nt, Homo sapiens
ucauuucaugcuu

SEQ ID NO: 2049596 - RNA, 21 nt, Homo sapiens
ccccacccacccucugguccu

SEQ ID NO: 2049597 - RNA, 17 nt, Homo sapiens
uacacaagaaucuagaa

SEQ ID NO: 2049598 - RNA, 19 nt, Homo sapiens
gaggugucucaggcugccu

SEQ ID NO: 2049599 - RNA, 17 nt, Homo sapiens
ccuuggcgggcacgggu

SEQ ID NO: 2049600 - RNA, 22 nt, Homo sapiens
caguugacagaauggugccaug

SEQ ID NO: 2049601 - RNA, 20 nt, Homo sapiens
uuccaggauaaggagacuga

SEQ ID NO: 2049602 - RNA, 19 nt, Homo sapiens
caucauucacuucacugug

SEQ ID NO: 2049603 - RNA, 18 nt, Homo sapiens
ugcaggguuucucgccac

SEQ ID NO: 2049604 - RNA, 16 nt, Homo sapiens
gacaugagaaagggag

SEQ ID NO: 2049605 - RNA, 15 nt, Homo sapiens
caccaggucagggag

SEQ ID NO: 2049606 - RNA, 12 nt, Homo sapiens
caucgacuuccu

SEQ ID NO: 2049607 - RNA, 16 nt, Homo sapiens
gcacauuuaauaauca

SEQ ID NO: 2049608 - RNA, 20 nt, Homo sapiens
caguaagguagaaauagaga

SEQ ID NO: 2049609 - RNA, 22 nt, Homo sapiens
ucuuggguaaggaaauggaaua

SEQ ID NO: 2049610 - RNA, 23 nt, Homo sapiens
agcgagcugagaucacaccacug

SEQ ID NO: 2049611 - RNA, 22 nt, Homo sapiens
cgggccacgggaagaaccaagc

SEQ ID NO: 2049612 - RNA, 15 nt, Homo sapiens
cugugcaccccauga

SEQ ID NO: 2049613 - RNA, 23 nt, Homo sapiens
cuucugaggcgcugcuuugucaa

SEQ ID NO: 2049614 - RNA, 23 nt, Homo sapiens
aagaaacuaaacagaaaacuccc

SEQ ID NO: 2049615 - RNA, 11 nt, Homo sapiens
aggagcucucu

SEQ ID NO: 2049616 - RNA, 18 nt, Homo sapiens
aggcaugcgaaugagcug

SEQ ID NO: 2049617 - RNA, 18 nt, Homo sapiens
ggagccucguccaaggca

SEQ ID NO: 2049618 - RNA, 18 nt, Homo sapiens
ggcuuguaaaugugacac

SEQ ID NO: 2049619 - RNA, 15 nt, Homo sapiens
cagauuuugugaacu

SEQ ID NO: 2049620 - RNA, 22 nt, Homo sapiens
augaucugagcaaaaugugaac

SEQ ID NO: 2049621 - RNA, 12 nt, Homo sapiens
ugguucuuucag

SEQ ID NO: 2049622 - RNA, 14 nt, Homo sapiens
ccagaccucaggga

SEQ ID NO: 2049623 - RNA, 17 nt, Homo sapiens
aagauucuccugugcua

SEQ ID NO: 2049624 - RNA, 18 nt, Homo sapiens
gcucauaggaccugcauc

SEQ ID NO: 2049625 - RNA, 19 nt, Homo sapiens
ccuuuuuuauacaggaaaa

SEQ ID NO: 2049626 - RNA, 16 nt, Homo sapiens
ucagggagaggucacc

SEQ ID NO: 2049627 - RNA, 17 nt, Homo sapiens
aaagaaguaacuacagu

SEQ ID NO: 2049628 - RNA, 18 nt, Homo sapiens
acuuuucggucuuuccca

SEQ ID NO: 2049629 - RNA, 18 nt, Homo sapiens
uuuucuuuccuccccacc

SEQ ID NO: 2049630 - RNA, 21 nt, Homo sapiens
aagugcgugccgugugagugu

SEQ ID NO: 2049631 - RNA, 17 nt, Homo sapiens
ugaggaccucauccaaa

SEQ ID NO: 2049632 - RNA, 20 nt, Homo sapiens
uacaaugaguaaaaucacag

SEQ ID NO: 2049633 - RNA, 13 nt, Homo sapiens
auuaucaugcaaa

SEQ ID NO: 2049634 - RNA, 14 nt, Homo sapiens
cauuccugacaaag

SEQ ID NO: 2049635 - RNA, 19 nt, Homo sapiens
cggcagacgggaggggaaa

SEQ ID NO: 2049636 - RNA, 24 nt, Homo sapiens
aaaaugcucaaucucagcuaacau

SEQ ID NO: 2049637 - RNA, 23 nt, Homo sapiens
cccagggcgucccugacagaggu

SEQ ID NO: 2049638 - RNA, 16 nt, Homo sapiens
uuucauagugaccugu

SEQ ID NO: 2049639 - RNA, 15 nt, Homo sapiens
acuagccccccagug

SEQ ID NO: 2049640 - RNA, 18 nt, Homo sapiens
augcacucucagaccaag

SEQ ID NO: 2049641 - RNA, 20 nt, Homo sapiens
uccauuuugugaauugugac

SEQ ID NO: 2049642 - RNA, 16 nt, Homo sapiens
cuuccuugaacugucu

SEQ ID NO: 2049643 - RNA, 19 nt, Homo sapiens
aaucucuacugcuuuggau

SEQ ID NO: 2049644 - RNA, 20 nt, Homo sapiens
accauuccuggaaaccacag

SEQ ID NO: 2049645 - RNA, 14 nt, Homo sapiens
gugguaaacaaaga

SEQ ID NO: 2049646 - RNA, 15 nt, Homo sapiens
cauucucucugaaca

SEQ ID NO: 2049647 - RNA, 19 nt, Homo sapiens
ggaaccucacucuugccaa

SEQ ID NO: 2049648 - RNA, 14 nt, Homo sapiens
acuccuccaaggca

SEQ ID NO: 2049649 - RNA, 23 nt, Homo sapiens
uccauagauuuauuuuacauuua

SEQ ID NO: 2049650 - RNA, 14 nt, Homo sapiens
agaguauguguaug

SEQ ID NO: 2049651 - RNA, 23 nt, Homo sapiens
caugccagaaggaaucuucucau

SEQ ID NO: 2049652 - RNA, 12 nt, Homo sapiens
ccugaccuguca

SEQ ID NO: 2049653 - RNA, 17 nt, Homo sapiens
caaaccccugaccucaa

SEQ ID NO: 2049654 - RNA, 15 nt, Homo sapiens
gaauuaaucuugcuu

SEQ ID NO: 2049655 - RNA, 18 nt, Homo sapiens
uguuaauauaccccaaau

SEQ ID NO: 2049656 - RNA, 13 nt, Homo sapiens
uuugggaaauucu

SEQ ID NO: 2049657 - RNA, 21 nt, Homo sapiens
gaagccuuuaucuaugggaga

SEQ ID NO: 2049658 - RNA, 15 nt, Homo sapiens
cuaugaugaaugcag

SEQ ID NO: 2049659 - RNA, 21 nt, Homo sapiens
ucugagucucugaaugaagcu

SEQ ID NO: 2049660 - RNA, 23 nt, Homo sapiens
cuggauauuucauauaaauggaa

SEQ ID NO: 2049661 - RNA, 16 nt, Homo sapiens
cuucuuuuugcuucaa

SEQ ID NO: 2049662 - RNA, 18 nt, Homo sapiens
acuuugggaggccaagga

SEQ ID NO: 2049663 - RNA, 19 nt, Homo sapiens
ucaguuguggccucauuca

SEQ ID NO: 2049664 - RNA, 20 nt, Homo sapiens
ggcaggagaauggcgugaac

SEQ ID NO: 2049665 - RNA, 20 nt, Homo sapiens
cuauaauuccgaaacauaca

SEQ ID NO: 2049666 - RNA, 24 nt, Homo sapiens
cuccucccagcacaggcaccuaug

SEQ ID NO: 2049667 - RNA, 19 nt, Homo sapiens
aagcacagauguucuucaa

SEQ ID NO: 2049668 - RNA, 20 nt, Homo sapiens
cugcugguaauuuguaucug

SEQ ID NO: 2049669 - RNA, 21 nt, Homo sapiens
gaaugugugaaggucuugccu

SEQ ID NO: 2049670 - RNA, 22 nt, Homo sapiens
gcagucauagggcugauaauac

SEQ ID NO: 2049671 - RNA, 16 nt, Homo sapiens
uucaaucuggauucau

SEQ ID NO: 2049672 - RNA, 22 nt, Homo sapiens
cagaucgauccuggauucacuc

SEQ ID NO: 2049673 - RNA, 20 nt, Homo sapiens
caacaguggggaagagugac

SEQ ID NO: 2049674 - RNA, 12 nt, Homo sapiens
agggcacugggu

SEQ ID NO: 2049675 - RNA, 19 nt, Homo sapiens
ucuucacaaucuugaacau

SEQ ID NO: 2049676 - RNA, 16 nt, Homo sapiens
gacaucuguggccaac

SEQ ID NO: 2049677 - RNA, 20 nt, Homo sapiens
cucccucuuucucaguuccu

SEQ ID NO: 2049678 - RNA, 19 nt, Homo sapiens
ugcacagggggaggccaua

SEQ ID NO: 2049679 - RNA, 15 nt, Homo sapiens
ccagacaugguggca

SEQ ID NO: 2049680 - RNA, 22 nt, Homo sapiens
uucuuugcaccaaagacaucag

SEQ ID NO: 2049681 - RNA, 13 nt, Homo sapiens
aacagaacuugac

SEQ ID NO: 2049682 - RNA, 21 nt, Homo sapiens
cacugaaauggacugacugua

SEQ ID NO: 2049683 - RNA, 21 nt, Homo sapiens
agaugaagacugggugugcaa

SEQ ID NO: 2049684 - RNA, 15 nt, Homo sapiens
aggacagacagcagg

SEQ ID NO: 2049685 - RNA, 15 nt, Homo sapiens
agagagggccugcug

SEQ ID NO: 2049686 - RNA, 14 nt, Homo sapiens
gguaucuucuuuag

SEQ ID NO: 2049687 - RNA, 19 nt, Homo sapiens
ucucccuggauuuuuacca

SEQ ID NO: 2049688 - RNA, 14 nt, Homo sapiens
uuaaacuuugucac

SEQ ID NO: 2049689 - RNA, 18 nt, Homo sapiens
agucauccagucuauuca

SEQ ID NO: 2049690 - RNA, 19 nt, Homo sapiens
ucaaagaaucuuuaaggga

SEQ ID NO: 2049691 - RNA, 19 nt, Homo sapiens
uuaaaaaugcaauaucuga

SEQ ID NO: 2049692 - RNA, 16 nt, Homo sapiens
uccuuagaaguggaag

SEQ ID NO: 2049693 - RNA, 23 nt, Homo sapiens
ccuucuuaggucgccauucccuu

SEQ ID NO: 2049694 - RNA, 11 nt, Homo sapiens
gcgcucgccac

SEQ ID NO: 2049695 - RNA, 15 nt, Homo sapiens
guuacagagauacug

SEQ ID NO: 2049696 - RNA, 13 nt, Homo sapiens
uuaauacagaauc

SEQ ID NO: 2049697 - RNA, 17 nt, Homo sapiens
cucugggccuucucacc

SEQ ID NO: 2049698 - RNA, 21 nt, Homo sapiens
uauuggccaaacuggugcaug

SEQ ID NO: 2049699 - RNA, 13 nt, Homo sapiens
acaauccaucaaa

SEQ ID NO: 2049700 - RNA, 20 nt, Homo sapiens
gcaugauauuguauguaccu

SEQ ID NO: 2049701 - RNA, 20 nt, Homo sapiens
uucaguauguuuuacacugu

SEQ ID NO: 2049702 - RNA, 15 nt, Homo sapiens
uuaaaugcauguccu

SEQ ID NO: 2049703 - RNA, 15 nt, Homo sapiens
cauuugcuagugaca

SEQ ID NO: 2049704 - RNA, 13 nt, Homo sapiens
aaaaucaauacaa

SEQ ID NO: 2049705 - RNA, 14 nt, Homo sapiens
cugugugugcccuc

SEQ ID NO: 2049706 - RNA, 16 nt, Homo sapiens
uccugggcuacaagga

SEQ ID NO: 2049707 - RNA, 17 nt, Homo sapiens
ccuauucuccucaucuc

SEQ ID NO: 2049708 - RNA, 17 nt, Homo sapiens
aauaaguccaucuguca

SEQ ID NO: 2049709 - RNA, 22 nt, Homo sapiens
uucuucucaaaggguacuucca

SEQ ID NO: 2049710 - RNA, 12 nt, Homo sapiens
ggucuccagcuc

SEQ ID NO: 2049711 - RNA, 15 nt, Homo sapiens
cagcacugccugcca

SEQ ID NO: 2049712 - RNA, 17 nt, Homo sapiens
uucaaugugaaacacau

SEQ ID NO: 2049713 - RNA, 13 nt, Homo sapiens
ugaaggacacuuc

SEQ ID NO: 2049714 - RNA, 17 nt, Homo sapiens
acccaugcacaguacaa

SEQ ID NO: 2049715 - RNA, 13 nt, Homo sapiens
gacgccacucuga

SEQ ID NO: 2049716 - RNA, 17 nt, Homo sapiens
gcacacacagauaugca

SEQ ID NO: 2049717 - RNA, 13 nt, Homo sapiens
ucagcuucucaaa

SEQ ID NO: 2049718 - RNA, 17 nt, Homo sapiens
ucaccugaggucaggag

SEQ ID NO: 2049719 - RNA, 18 nt, Homo sapiens
ccuagcuuuuugcagaua

SEQ ID NO: 2049720 - RNA, 19 nt, Homo sapiens
gucaauaaaagagcugucu

SEQ ID NO: 2049721 - RNA, 20 nt, Homo sapiens
gaacuauguaaaugacucua

SEQ ID NO: 2049722 - RNA, 21 nt, Homo sapiens
ccuuuugggcucaaagcccuu

SEQ ID NO: 2049723 - RNA, 17 nt, Homo sapiens
acgcgguggcaugcaug

SEQ ID NO: 2049724 - RNA, 12 nt, Homo sapiens
auauuguugccg

SEQ ID NO: 2049725 - RNA, 15 nt, Homo sapiens
auccuuacaauguga

SEQ ID NO: 2049726 - RNA, 20 nt, Homo sapiens
acuggcaggaucacagcuca

SEQ ID NO: 2049727 - RNA, 14 nt, Homo sapiens
gagucacugauaca

SEQ ID NO: 2049728 - RNA, 23 nt, Homo sapiens
auugccauagcugacuacaaauu

SEQ ID NO: 2049729 - RNA, 14 nt, Homo sapiens
cuaaucugcagugg

SEQ ID NO: 2049730 - RNA, 17 nt, Homo sapiens
aagggccugcccagaca

SEQ ID NO: 2049731 - RNA, 21 nt, Homo sapiens
aaaagucagagacagauaccu

SEQ ID NO: 2049732 - RNA, 15 nt, Homo sapiens
uaaugucaccaccuu

SEQ ID NO: 2049733 - RNA, 15 nt, Homo sapiens
uuucccaacaccucu

SEQ ID NO: 2049734 - RNA, 23 nt, Homo sapiens
aaaugaggguaaauauaguuuau

SEQ ID NO: 2049735 - RNA, 13 nt, Homo sapiens
cuuguuuuggaca

SEQ ID NO: 2049736 - RNA, 14 nt, Homo sapiens
gauagaccaaagac

SEQ ID NO: 2049737 - RNA, 16 nt, Homo sapiens
auacauccauuuugau

SEQ ID NO: 2049738 - RNA, 19 nt, Homo sapiens
gagacggagucucagucug

SEQ ID NO: 2049739 - RNA, 19 nt, Homo sapiens
aguaaucaaguuaaaaccu

SEQ ID NO: 2049740 - RNA, 18 nt, Homo sapiens
cuguaucggagacaguga

SEQ ID NO: 2049741 - RNA, 12 nt, Homo sapiens
caccucagccau

SEQ ID NO: 2049742 - RNA, 16 nt, Homo sapiens
gagcccaaaugaccaa

SEQ ID NO: 2049743 - RNA, 21 nt, Homo sapiens
gaggaguucaaugaucuaggu

SEQ ID NO: 2049744 - RNA, 16 nt, Homo sapiens
uggcaccuucagacuu

SEQ ID NO: 2049745 - RNA, 20 nt, Homo sapiens
auuuaaguauggaauauuca

SEQ ID NO: 2049746 - RNA, 14 nt, Homo sapiens
uaagauuuugcacc

SEQ ID NO: 2049747 - RNA, 17 nt, Homo sapiens
aagccuuugagacuguu

SEQ ID NO: 2049748 - RNA, 17 nt, Homo sapiens
ugccugugagcaugggg

SEQ ID NO: 2049749 - RNA, 20 nt, Homo sapiens
gaucaaugcauguuacccau

SEQ ID NO: 2049750 - RNA, 18 nt, Homo sapiens
uuguaggagaaacuccca

SEQ ID NO: 2049751 - RNA, 13 nt, Homo sapiens
cuuacagugccaa

SEQ ID NO: 2049752 - RNA, 20 nt, Homo sapiens
aaaacuauauucauuuccac

SEQ ID NO: 2049753 - RNA, 15 nt, Homo sapiens
cucuuucuagccugg

SEQ ID NO: 2049754 - RNA, 13 nt, Homo sapiens
caagcaccuguua

SEQ ID NO: 2049755 - RNA, 23 nt, Homo sapiens
aggacuguauaguuuaaagggag

SEQ ID NO: 2049756 - RNA, 18 nt, Homo sapiens
augcuuuucccacucuca

SEQ ID NO: 2049757 - RNA, 20 nt, Homo sapiens
ugcugggcacuucaucugau

SEQ ID NO: 2049758 - RNA, 13 nt, Homo sapiens
ccucaugcaucuc

SEQ ID NO: 2049759 - RNA, 12 nt, Homo sapiens
cuuaugugacau

SEQ ID NO: 2049760 - RNA, 18 nt, Homo sapiens
caagccuggcccagugag

SEQ ID NO: 2049761 - RNA, 16 nt, Homo sapiens
ggacuuccuugcucuc

SEQ ID NO: 2049762 - RNA, 18 nt, Homo sapiens
auuguggauaacaaagau

SEQ ID NO: 2049763 - RNA, 20 nt, Homo sapiens
uuagcagcaacugaagacaa

SEQ ID NO: 2049764 - RNA, 15 nt, Homo sapiens
acuccagguggaaca

SEQ ID NO: 2049765 - RNA, 12 nt, Homo sapiens
aagcucuaguuc

SEQ ID NO: 2049766 - RNA, 15 nt, Homo sapiens
agaaaaccacaacua

SEQ ID NO: 2049767 - RNA, 23 nt, Homo sapiens
gaggcagugugguuauguuccca

SEQ ID NO: 2049768 - RNA, 18 nt, Homo sapiens
acaaaguccacuuuacuc

SEQ ID NO: 2049769 - RNA, 13 nt, Homo sapiens
aaaaaauguucau

SEQ ID NO: 2049770 - RNA, 22 nt, Homo sapiens
acuaggggcccggauccaggau

SEQ ID NO: 2049771 - RNA, 14 nt, Homo sapiens
guagcuuaagggaa

SEQ ID NO: 2049772 - RNA, 15 nt, Homo sapiens
acaaaaaacaacuga

SEQ ID NO: 2049773 - RNA, 17 nt, Homo sapiens
gcugagcuugugccuug

SEQ ID NO: 2049774 - RNA, 20 nt, Homo sapiens
uuauguggauuucaucacua

SEQ ID NO: 2049775 - RNA, 21 nt, Homo sapiens
accaugcugagacaucccuca

SEQ ID NO: 2049776 - RNA, 21 nt, Homo sapiens
ugcuguaugcugaucaucgcc

SEQ ID NO: 2049777 - RNA, 13 nt, Homo sapiens
uauauauaaucua

SEQ ID NO: 2049778 - RNA, 20 nt, Homo sapiens
cuauuauuugacuuguugcu

SEQ ID NO: 2049779 - RNA, 16 nt, Homo sapiens
auaugugcagucuugc

SEQ ID NO: 2049780 - RNA, 19 nt, Homo sapiens
aaagaaaccauggcauaaa

SEQ ID NO: 2049781 - RNA, 23 nt, Homo sapiens
agaagaaacuccuggaucccuuu

SEQ ID NO: 2049782 - RNA, 17 nt, Homo sapiens
agcuaccugaauggaga

SEQ ID NO: 2049783 - RNA, 18 nt, Homo sapiens
uucaagcacccuguuccc

SEQ ID NO: 2049784 - RNA, 21 nt, Homo sapiens
cucuagcuuugucauaguuau

SEQ ID NO: 2049785 - RNA, 13 nt, Homo sapiens
ggcaaaguguuuu

SEQ ID NO: 2049786 - RNA, 14 nt, Homo sapiens
uggaaugcaugcca

SEQ ID NO: 2049787 - RNA, 12 nt, Homo sapiens
augagaccuccc

SEQ ID NO: 2049788 - RNA, 14 nt, Homo sapiens
aagugaacuaugaa

SEQ ID NO: 2049789 - RNA, 23 nt, Homo sapiens
acuuauguauuguuuucgaauac

SEQ ID NO: 2049790 - RNA, 19 nt, Homo sapiens
aagugcuagccacuggaaa

SEQ ID NO: 2049791 - RNA, 16 nt, Homo sapiens
ggcagccauagugcau

SEQ ID NO: 2049792 - RNA, 21 nt, Homo sapiens
gcucagccucccgaguagcug

SEQ ID NO: 2049793 - RNA, 14 nt, Homo sapiens
uacuuagcaaaaag

SEQ ID NO: 2049794 - RNA, 11 nt, Homo sapiens
uagcugcauuu

SEQ ID NO: 2049795 - RNA, 19 nt, Homo sapiens
uaugcaggacaugugcucu

SEQ ID NO: 2049796 - RNA, 14 nt, Homo sapiens
aggcuccagcacuu

SEQ ID NO: 2049797 - RNA, 20 nt, Homo sapiens
caugagcuggcgggauugaa

SEQ ID NO: 2049798 - RNA, 17 nt, Homo sapiens
accaaaaggccgugugu

SEQ ID NO: 2049799 - RNA, 16 nt, Homo sapiens
gaucaauuaccuaacu

SEQ ID NO: 2049800 - RNA, 12 nt, Homo sapiens
caggaugcugcu

SEQ ID NO: 2049801 - RNA, 23 nt, Homo sapiens
guucccucuguugggaugccagu

SEQ ID NO: 2049802 - RNA, 21 nt, Homo sapiens
uuuaauuuugucagauucaca

SEQ ID NO: 2049803 - RNA, 14 nt, Homo sapiens
ucgcuugccaaagc

SEQ ID NO: 2049804 - RNA, 14 nt, Homo sapiens
gagaaggugccugc

SEQ ID NO: 2049805 - RNA, 21 nt, Homo sapiens
gagggcuacaaaggaggacaa

SEQ ID NO: 2049806 - RNA, 17 nt, Homo sapiens
aaaggacagcucagaaa

SEQ ID NO: 2049807 - RNA, 20 nt, Homo sapiens
aaacucaggugauuccagga

SEQ ID NO: 2049808 - RNA, 22 nt, Homo sapiens
guaauuuugaguacagaauuca

SEQ ID NO: 2049809 - RNA, 13 nt, Homo sapiens
caaaaaugacucu

SEQ ID NO: 2049810 - RNA, 20 nt, Homo sapiens
uggucucaagcaguccuccu

SEQ ID NO: 2049811 - RNA, 14 nt, Homo sapiens
ccaagacccaacag

SEQ ID NO: 2049812 - RNA, 22 nt, Homo sapiens
gcgcuuugagaggcugaggcag

SEQ ID NO: 2049813 - RNA, 16 nt, Homo sapiens
gagacaccaagcucac

SEQ ID NO: 2049814 - RNA, 15 nt, Homo sapiens
gccauaaaccaauaa

SEQ ID NO: 2049815 - RNA, 19 nt, Homo sapiens
aagcugguuuuaaguggaa

SEQ ID NO: 2049816 - RNA, 16 nt, Homo sapiens
accccaucuggcugug

SEQ ID NO: 2049817 - RNA, 22 nt, Homo sapiens
ccugaaagcaacuacagaauuu

SEQ ID NO: 2049818 - RNA, 16 nt, Homo sapiens
guuccauccaccaccu

SEQ ID NO: 2049819 - RNA, 16 nt, Homo sapiens
uggggauuaccauuca

SEQ ID NO: 2049820 - RNA, 17 nt, Homo sapiens
accaguucuuugggcug

SEQ ID NO: 2049821 - RNA, 21 nt, Homo sapiens
ccaaagaagcugcuguucuua

SEQ ID NO: 2049822 - RNA, 14 nt, Homo sapiens
gaagaugugugaua

SEQ ID NO: 2049823 - RNA, 17 nt, Homo sapiens
gaagucccggcuuccac

SEQ ID NO: 2049824 - RNA, 20 nt, Homo sapiens
ugccggccgggugugguggc

SEQ ID NO: 2049825 - RNA, 12 nt, Homo sapiens
ccuaggcuaccc

SEQ ID NO: 2049826 - RNA, 22 nt, Homo sapiens
uaacuaugguaaauaacuguga

SEQ ID NO: 2049827 - RNA, 18 nt, Homo sapiens
aauuauuugucaagcaaa

SEQ ID NO: 2049828 - RNA, 19 nt, Homo sapiens
aucauguuaccauuacaaa

SEQ ID NO: 2049829 - RNA, 15 nt, Homo sapiens
auauugucauuguca

SEQ ID NO: 2049830 - RNA, 15 nt, Homo sapiens
agugugacucauuaa

SEQ ID NO: 2049831 - RNA, 19 nt, Homo sapiens
aaugaauguaaucuaauag

SEQ ID NO: 2049832 - RNA, 19 nt, Homo sapiens
cucuauugaccaccaguua

SEQ ID NO: 2049833 - RNA, 21 nt, Homo sapiens
aaugacacuaaacuccaugau

SEQ ID NO: 2049834 - RNA, 15 nt, Homo sapiens
cacaguggggcugca

SEQ ID NO: 2049835 - RNA, 17 nt, Homo sapiens
auugacuucuuuuuggc

SEQ ID NO: 2049836 - RNA, 21 nt, Homo sapiens
caguauaggccaucaauauca

SEQ ID NO: 2049837 - RNA, 21 nt, Homo sapiens
uuguucccauuggaugcauuu

SEQ ID NO: 2049838 - RNA, 14 nt, Homo sapiens
acauaaacaccauu

SEQ ID NO: 2049839 - RNA, 12 nt, Homo sapiens
cucuuccagcaa

SEQ ID NO: 2049840 - RNA, 19 nt, Homo sapiens
gacacuguccaugaagcac

SEQ ID NO: 2049841 - RNA, 21 nt, Homo sapiens
ucacccccaccccuguaccca

SEQ ID NO: 2049842 - RNA, 19 nt, Homo sapiens
gcuucuuaaaauagccaua

SEQ ID NO: 2049843 - RNA, 16 nt, Homo sapiens
gaauaaugagucugca

SEQ ID NO: 2049844 - RNA, 19 nt, Homo sapiens
guacaaugaguguuauaac

SEQ ID NO: 2049845 - RNA, 16 nt, Homo sapiens
uagauugccucucuag

SEQ ID NO: 2049846 - RNA, 21 nt, Homo sapiens
ugaaguuuaaacucugcucag

SEQ ID NO: 2049847 - RNA, 13 nt, Homo sapiens
cucaaauauagua

SEQ ID NO: 2049848 - RNA, 15 nt, Homo sapiens
cgucccaugugcaug

SEQ ID NO: 2049849 - RNA, 12 nt, Homo sapiens
caauaugaagua

SEQ ID NO: 2049850 - RNA, 16 nt, Homo sapiens
aagagucugucucaaa

SEQ ID NO: 2049851 - RNA, 18 nt, Homo sapiens
aggcucagagggaccuca

SEQ ID NO: 2049852 - RNA, 14 nt, Homo sapiens
auuauccacaugaa

SEQ ID NO: 2049853 - RNA, 16 nt, Homo sapiens
cagaggacggcuuccc

SEQ ID NO: 2049854 - RNA, 18 nt, Homo sapiens
uugucucgaagucucuuu

SEQ ID NO: 2049855 - RNA, 21 nt, Homo sapiens
uggccaagaucacaguggcca

SEQ ID NO: 2049856 - RNA, 23 nt, Homo sapiens
cauuuaacucuuugaaacuguau

SEQ ID NO: 2049857 - RNA, 21 nt, Homo sapiens
auuugacugaagaugcagcuc

SEQ ID NO: 2049858 - RNA, 20 nt, Homo sapiens
aggaggagacagagagcucc

SEQ ID NO: 2049859 - RNA, 12 nt, Homo sapiens
cucaucagaaac

SEQ ID NO: 2049860 - RNA, 20 nt, Homo sapiens
ucagccaucguccugggacu

SEQ ID NO: 2049861 - RNA, 20 nt, Homo sapiens
ugcugagaccccccaccacc

SEQ ID NO: 2049862 - RNA, 12 nt, Homo sapiens
aucaugagauaa

SEQ ID NO: 2049863 - RNA, 15 nt, Homo sapiens
uguaagccuucaaag

SEQ ID NO: 2049864 - RNA, 17 nt, Homo sapiens
accagcuuuuucucuca

SEQ ID NO: 2049865 - RNA, 14 nt, Homo sapiens
cuucaucuucucag

SEQ ID NO: 2049866 - RNA, 22 nt, Homo sapiens
ugucaggcacaguaagcaugcu

SEQ ID NO: 2049867 - RNA, 20 nt, Homo sapiens
agcccagcccuccucuguca

SEQ ID NO: 2049868 - RNA, 22 nt, Homo sapiens
ccucugggagccuaaaccaggc

SEQ ID NO: 2049869 - RNA, 12 nt, Homo sapiens
acucccaaagag

SEQ ID NO: 2049870 - RNA, 11 nt, Homo sapiens
uucuucagggc

SEQ ID NO: 2049871 - RNA, 11 nt, Homo sapiens
guuuucagugu

SEQ ID NO: 2049872 - RNA, 17 nt, Homo sapiens
accagaaaagcaauacu

SEQ ID NO: 2049873 - RNA, 13 nt, Homo sapiens
uuuucaugcaaaa

SEQ ID NO: 2049874 - RNA, 14 nt, Homo sapiens
uaacacaagccaca

SEQ ID NO: 2049875 - RNA, 15 nt, Homo sapiens
cguuagaaguugaau

SEQ ID NO: 2049876 - RNA, 16 nt, Homo sapiens
uggaaaaauccuguca

SEQ ID NO: 2049877 - RNA, 15 nt, Homo sapiens
agcuguaaacauauu

SEQ ID NO: 2049878 - RNA, 13 nt, Homo sapiens
gaaauaaacugag

SEQ ID NO: 2049879 - RNA, 15 nt, Homo sapiens
cagcuccuguggcca

SEQ ID NO: 2049880 - RNA, 23 nt, Homo sapiens
uacgguggcacgugccugugauc

SEQ ID NO: 2049881 - RNA, 20 nt, Homo sapiens
cugagagucugaaagacaga

SEQ ID NO: 2049882 - RNA, 11 nt, Homo sapiens
auaaaaaccau

SEQ ID NO: 2049883 - RNA, 11 nt, Homo sapiens
auuaaaaccaa

SEQ ID NO: 2049884 - RNA, 16 nt, Homo sapiens
uggcucagaacugcaa

SEQ ID NO: 2049885 - RNA, 23 nt, Homo sapiens
ggaauaugcauugucugcaaugg

SEQ ID NO: 2049886 - RNA, 18 nt, Homo sapiens
gaugucccccacugcuaa

SEQ ID NO: 2049887 - RNA, 17 nt, Homo sapiens
cuaaauaaaacuguggc

SEQ ID NO: 2049888 - RNA, 23 nt, Homo sapiens
agacucauucccuagaucuuucu

SEQ ID NO: 2049889 - RNA, 17 nt, Homo sapiens
aucaguagcaucuguaa

SEQ ID NO: 2049890 - RNA, 22 nt, Homo sapiens
acuaguaguucucuugguguua

SEQ ID NO: 2049891 - RNA, 18 nt, Homo sapiens
cagguaggggcacaguga

SEQ ID NO: 2049892 - RNA, 14 nt, Homo sapiens
uaacgaugcacuuu

SEQ ID NO: 2049893 - RNA, 16 nt, Homo sapiens
ugaauuuucacaugaa

SEQ ID NO: 2049894 - RNA, 20 nt, Homo sapiens
cauaggggacugaggagcaa

SEQ ID NO: 2049895 - RNA, 22 nt, Homo sapiens
ugucuucagcuguacauacuca

SEQ ID NO: 2049896 - RNA, 17 nt, Homo sapiens
ggcguggagacuggcag

SEQ ID NO: 2049897 - RNA, 22 nt, Homo sapiens
gcugcagguuccuuaucuguca

SEQ ID NO: 2049898 - RNA, 18 nt, Homo sapiens
cacagcugggcaggguga

SEQ ID NO: 2049899 - RNA, 17 nt, Homo sapiens
agaagcagguucuugau

SEQ ID NO: 2049900 - RNA, 19 nt, Homo sapiens
cgugcuacugcacuccagc

SEQ ID NO: 2049901 - RNA, 14 nt, Homo sapiens
auauuaauguggaa

SEQ ID NO: 2049902 - RNA, 23 nt, Homo sapiens
auuuuauguuuaaaaaguauguu

SEQ ID NO: 2049903 - RNA, 19 nt, Homo sapiens
cuuacauuagugauuccau

SEQ ID NO: 2049904 - RNA, 14 nt, Homo sapiens
gucaggacucagaa

SEQ ID NO: 2049905 - RNA, 23 nt, Homo sapiens
uaaagcagacaggugugcagauu

SEQ ID NO: 2049906 - RNA, 17 nt, Homo sapiens
gaaguaggugugacuug

SEQ ID NO: 2049907 - RNA, 23 nt, Homo sapiens
auccaaaaguggaagugacauug

SEQ ID NO: 2049908 - RNA, 17 nt, Homo sapiens
cacauuucuaugccaaa

SEQ ID NO: 2049909 - RNA, 23 nt, Homo sapiens
uuuacagccagugggagauguua

SEQ ID NO: 2049910 - RNA, 22 nt, Homo sapiens
acugucccaaguugcuaaguga

SEQ ID NO: 2049911 - RNA, 17 nt, Homo sapiens
gugcuggaaauggacac

SEQ ID NO: 2049912 - RNA, 15 nt, Homo sapiens
caauaucuacagcuu

SEQ ID NO: 2049913 - RNA, 19 nt, Homo sapiens
agaaaccagaaaagcaaua

SEQ ID NO: 2049914 - RNA, 14 nt, Homo sapiens
caugaaacugucca

SEQ ID NO: 2049915 - RNA, 19 nt, Homo sapiens
gcuuauugucuagugaaac

SEQ ID NO: 2049916 - RNA, 12 nt, Homo sapiens
cugcuccagaag

SEQ ID NO: 2049917 - RNA, 19 nt, Homo sapiens
agauauucuggcccaggga

SEQ ID NO: 2049918 - RNA, 22 nt, Homo sapiens
aagcauggcuuuggcuuugcaa

SEQ ID NO: 2049919 - RNA, 17 nt, Homo sapiens
caagccugugcaaaaaa

SEQ ID NO: 2049920 - RNA, 16 nt, Homo sapiens
gaugggcccugacucu

SEQ ID NO: 2049921 - RNA, 15 nt, Homo sapiens
cagcccagcuggugg

SEQ ID NO: 2049922 - RNA, 20 nt, Homo sapiens
accucggcuguuuacagugu

SEQ ID NO: 2049923 - RNA, 19 nt, Homo sapiens
agccuuaauagacuucucu

SEQ ID NO: 2049924 - RNA, 21 nt, Homo sapiens
uugaagcucgugacaagugcc

SEQ ID NO: 2049925 - RNA, 13 nt, Homo sapiens
uuuccgaaucucu

SEQ ID NO: 2049926 - RNA, 13 nt, Homo sapiens
uaugaaguacuuu

SEQ ID NO: 2049927 - RNA, 10 nt, Homo sapiens
ucacacuccu

SEQ ID NO: 2049928 - RNA, 19 nt, Homo sapiens
aaaaugaauugccuuugau

SEQ ID NO: 2049929 - RNA, 19 nt, Homo sapiens
gugauuugggggugcaaug

SEQ ID NO: 2049930 - RNA, 12 nt, Homo sapiens
cuucaguguguu

SEQ ID NO: 2049931 - RNA, 12 nt, Homo sapiens
ugcagagucacu

SEQ ID NO: 2049932 - RNA, 17 nt, Homo sapiens
cucugaggccucacuac

SEQ ID NO: 2049933 - RNA, 13 nt, Homo sapiens
aagcucuaaugga

SEQ ID NO: 2049934 - RNA, 14 nt, Homo sapiens
aacuggaugggaga

SEQ ID NO: 2049935 - RNA, 19 nt, Homo sapiens
uccaggcacucagaaggca

SEQ ID NO: 2049936 - RNA, 14 nt, Homo sapiens
guuaguagcccuuc

SEQ ID NO: 2049937 - RNA, 24 nt, Homo sapiens
ccucuuccccagaaaggagacuag

SEQ ID NO: 2049938 - RNA, 15 nt, Homo sapiens
ggcuguugcauuuuu

SEQ ID NO: 2049939 - RNA, 14 nt, Homo sapiens
uccccgcucuugcc

SEQ ID NO: 2049940 - RNA, 13 nt, Homo sapiens
acauaaaauccaa

SEQ ID NO: 2049941 - RNA, 18 nt, Homo sapiens
auuauguuaaacuagcau

SEQ ID NO: 2049942 - RNA, 21 nt, Homo sapiens
caauuaauuccuucagcacuu

SEQ ID NO: 2049943 - RNA, 14 nt, Homo sapiens
aauaaaggcagcug

SEQ ID NO: 2049944 - RNA, 20 nt, Homo sapiens
auccagugcaguugugauuu

SEQ ID NO: 2049945 - RNA, 15 nt, Homo sapiens
acuugcuccauucau

SEQ ID NO: 2049946 - RNA, 12 nt, Homo sapiens
cugccauuuccc

SEQ ID NO: 2049947 - RNA, 17 nt, Homo sapiens
cagcaggaggcuagcaa

SEQ ID NO: 2049948 - RNA, 15 nt, Homo sapiens
ggaggcaacgccaga

SEQ ID NO: 2049949 - RNA, 21 nt, Homo sapiens
guuucuccagagggaauugca

SEQ ID NO: 2049950 - RNA, 14 nt, Homo sapiens
aaauggcaugacaa

SEQ ID NO: 2049951 - RNA, 16 nt, Homo sapiens
guuggacagacacugu

SEQ ID NO: 2049952 - RNA, 17 nt, Homo sapiens
ugcccuguaaccugacu

SEQ ID NO: 2049953 - RNA, 16 nt, Homo sapiens
acucagacauuccaag

SEQ ID NO: 2049954 - RNA, 21 nt, Homo sapiens
ugcugaaagggaaggagacac

SEQ ID NO: 2049955 - RNA, 16 nt, Homo sapiens
cucuccuucccacaaa

SEQ ID NO: 2049956 - RNA, 13 nt, Homo sapiens
auacccaguuuag

SEQ ID NO: 2049957 - RNA, 13 nt, Homo sapiens
auguaugugucac

SEQ ID NO: 2049958 - RNA, 13 nt, Homo sapiens
agauagaagugaa

SEQ ID NO: 2049959 - RNA, 20 nt, Homo sapiens
auccuacugagcauuugcac

SEQ ID NO: 2049960 - RNA, 18 nt, Homo sapiens
uccccacugccugcugga

SEQ ID NO: 2049961 - RNA, 12 nt, Homo sapiens
agacuacaggug

SEQ ID NO: 2049962 - RNA, 20 nt, Homo sapiens
cccaaauuaagaaucuagga

SEQ ID NO: 2049963 - RNA, 12 nt, Homo sapiens
ccuccugaaccg

SEQ ID NO: 2049964 - RNA, 13 nt, Homo sapiens
acuacaggcacac

SEQ ID NO: 2049965 - RNA, 16 nt, Homo sapiens
aagaaaaaaacuuacu

SEQ ID NO: 2049966 - RNA, 15 nt, Homo sapiens
aauaaacagccagga

SEQ ID NO: 2049967 - RNA, 19 nt, Homo sapiens
aacaacagcuucaguccau

SEQ ID NO: 2049968 - RNA, 18 nt, Homo sapiens
gugguaauuuuuguacau

SEQ ID NO: 2049969 - RNA, 12 nt, Homo sapiens
ucucuguacuuu

SEQ ID NO: 2049970 - RNA, 14 nt, Homo sapiens
uccuucaauucaaa

SEQ ID NO: 2049971 - RNA, 16 nt, Homo sapiens
ugcaauuaaagugaua

SEQ ID NO: 2049972 - RNA, 18 nt, Homo sapiens
uuuauuuaagcaucaaau

SEQ ID NO: 2049973 - RNA, 22 nt, Homo sapiens
gccuuugcccaaaacugucauc

SEQ ID NO: 2049974 - RNA, 14 nt, Homo sapiens
ugaagacucugcag

SEQ ID NO: 2049975 - RNA, 15 nt, Homo sapiens
auaccauuuccucag

SEQ ID NO: 2049976 - RNA, 21 nt, Homo sapiens
cuggaauuauucuaugucaau

SEQ ID NO: 2049977 - RNA, 22 nt, Homo sapiens
acaaaucuuuuucuauauucuc

SEQ ID NO: 2049978 - RNA, 23 nt, Homo sapiens
caggucuucucuccaacucuuca

SEQ ID NO: 2049979 - RNA, 12 nt, Homo sapiens
uacuaaagccaa

SEQ ID NO: 2049980 - RNA, 17 nt, Homo sapiens
gugguacccaggcuucc

SEQ ID NO: 2049981 - RNA, 21 nt, Homo sapiens
accucagggguuaagagcuca

SEQ ID NO: 2049982 - RNA, 16 nt, Homo sapiens
cugcuuuggucuugcc

SEQ ID NO: 2049983 - RNA, 14 nt, Homo sapiens
aucuuaggcaaaau

SEQ ID NO: 2049984 - RNA, 14 nt, Homo sapiens
cugacuucucugaa

SEQ ID NO: 2049985 - RNA, 16 nt, Homo sapiens
cucacaagcaauccau

SEQ ID NO: 2049986 - RNA, 20 nt, Homo sapiens
aaaguaauuguaaacuagua

SEQ ID NO: 2049987 - RNA, 20 nt, Homo sapiens
ggcucaagcaauccaaguga

SEQ ID NO: 2049988 - RNA, 19 nt, Homo sapiens
agcaacccuggguuuucag

SEQ ID NO: 2049989 - RNA, 17 nt, Homo sapiens
uguaaagcauccucuac

SEQ ID NO: 2049990 - RNA, 17 nt, Homo sapiens
aggccaagaacuugcaa

SEQ ID NO: 2049991 - RNA, 18 nt, Homo sapiens
agcucacugaaucuucac

SEQ ID NO: 2049992 - RNA, 20 nt, Homo sapiens
gacacccaguggaaccaaaa

SEQ ID NO: 2049993 - RNA, 10 nt, Homo sapiens
aucugugcac

SEQ ID NO: 2049994 - RNA, 13 nt, Homo sapiens
agaacuguucauu

SEQ ID NO: 2049995 - RNA, 23 nt, Homo sapiens
gcaacgcaggcccccaggugcca

SEQ ID NO: 2049996 - RNA, 14 nt, Homo sapiens
aacagucucaggaa

SEQ ID NO: 2049997 - RNA, 13 nt, Homo sapiens
cacaaacuccauc

SEQ ID NO: 2049998 - RNA, 17 nt, Homo sapiens
aggaaguagcugucaga

SEQ ID NO: 2049999 - RNA, 13 nt, Homo sapiens
cucaucugccaaa

SEQ ID NO: 2050000 - RNA, 17 nt, Homo sapiens
uuccuguccucuuucag

SEQ ID NO: 2050001 - RNA, 19 nt, Homo sapiens
gugauuucagagagggcag

SEQ ID NO: 2050002 - RNA, 17 nt, Homo sapiens
gagacuggaccgcugac

SEQ ID NO: 2050003 - RNA, 16 nt, Homo sapiens
gggcgacagagcaaga

SEQ ID NO: 2050004 - RNA, 21 nt, Homo sapiens
ggcuuuguuuuuugugcuauu

SEQ ID NO: 2050005 - RNA, 18 nt, Homo sapiens
cccacgagaccccggcuu

SEQ ID NO: 2050006 - RNA, 18 nt, Homo sapiens
cucauagguugagcaauu

SEQ ID NO: 2050007 - RNA, 20 nt, Homo sapiens
gccuucuccccuccaaguga

SEQ ID NO: 2050008 - RNA, 19 nt, Homo sapiens
aaggaaaaucacaucucca

SEQ ID NO: 2050009 - RNA, 16 nt, Homo sapiens
cgccugugucacgagc

SEQ ID NO: 2050010 - RNA, 15 nt, Homo sapiens
agaaacguggaucuc

SEQ ID NO: 2050011 - RNA, 24 nt, Homo sapiens
agauugcaccacugcacuccaguc

SEQ ID NO: 2050012 - RNA, 16 nt, Homo sapiens
cuguuucacuugcucu

SEQ ID NO: 2050013 - RNA, 16 nt, Homo sapiens
cuguucaucuugccaa

SEQ ID NO: 2050014 - RNA, 13 nt, Homo sapiens
acucucauguggc

SEQ ID NO: 2050015 - RNA, 17 nt, Homo sapiens
uucucaccagcccgcca

SEQ ID NO: 2050016 - RNA, 16 nt, Homo sapiens
aaagccaagaccucac

SEQ ID NO: 2050017 - RNA, 14 nt, Homo sapiens
ucuuaguuugcagu

SEQ ID NO: 2050018 - RNA, 13 nt, Homo sapiens
uguuuucccuccu

SEQ ID NO: 2050019 - RNA, 12 nt, Homo sapiens
cacugcuuuaaa

SEQ ID NO: 2050020 - RNA, 14 nt, Homo sapiens
ucuguaacugucac

SEQ ID NO: 2050021 - RNA, 16 nt, Homo sapiens
ccgugaacugugcaua

SEQ ID NO: 2050022 - RNA, 13 nt, Homo sapiens
ucuguucacuuuu

SEQ ID NO: 2050023 - RNA, 19 nt, Homo sapiens
ggaacagccccagugcacu

SEQ ID NO: 2050024 - RNA, 12 nt, Homo sapiens
gggccccagcca

SEQ ID NO: 2050025 - RNA, 23 nt, Homo sapiens
aaaaauaaaaggcuuccagagga

SEQ ID NO: 2050026 - RNA, 13 nt, Homo sapiens
caugaaaucugag

SEQ ID NO: 2050027 - RNA, 19 nt, Homo sapiens
ugccuuccgacaccacugg

SEQ ID NO: 2050028 - RNA, 15 nt, Homo sapiens
gucacaugugcucuc

SEQ ID NO: 2050029 - RNA, 13 nt, Homo sapiens
agagauacuugua

SEQ ID NO: 2050030 - RNA, 13 nt, Homo sapiens
uuaugaaaacuga

SEQ ID NO: 2050031 - RNA, 15 nt, Homo sapiens
ggcuuguucagucac

SEQ ID NO: 2050032 - RNA, 17 nt, Homo sapiens
cucaugcucucuauaga

SEQ ID NO: 2050033 - RNA, 17 nt, Homo sapiens
agugagaaaaagcuccu

SEQ ID NO: 2050034 - RNA, 17 nt, Homo sapiens
ugagaacugacuuucuc

SEQ ID NO: 2050035 - RNA, 19 nt, Homo sapiens
uguacauuggucuuucuac

SEQ ID NO: 2050036 - RNA, 14 nt, Homo sapiens
cucacgcuucacag

SEQ ID NO: 2050037 - RNA, 17 nt, Homo sapiens
uaggcaugccugggaau

SEQ ID NO: 2050038 - RNA, 16 nt, Homo sapiens
ucggucaccugugcua

SEQ ID NO: 2050039 - RNA, 18 nt, Homo sapiens
auaaugcuguugccucau

SEQ ID NO: 2050040 - RNA, 14 nt, Homo sapiens
caggcuuggcaaag

SEQ ID NO: 2050041 - RNA, 15 nt, Homo sapiens
aauuuuguaaucuca

SEQ ID NO: 2050042 - RNA, 15 nt, Homo sapiens
uguccugaucuguga

SEQ ID NO: 2050043 - RNA, 11 nt, Homo sapiens
accacuuucuu

SEQ ID NO: 2050044 - RNA, 17 nt, Homo sapiens
aguuucaaaacauacaa

SEQ ID NO: 2050045 - RNA, 16 nt, Homo sapiens
cugcgagcauuucccu

SEQ ID NO: 2050046 - RNA, 20 nt, Homo sapiens
gagaaaugcagagaagaaua

SEQ ID NO: 2050047 - RNA, 14 nt, Homo sapiens
gaaacccccagugu

SEQ ID NO: 2050048 - RNA, 22 nt, Homo sapiens
gauuaugaagugacucucacaa

SEQ ID NO: 2050049 - RNA, 15 nt, Homo sapiens
cccucgaagugggcc

SEQ ID NO: 2050050 - RNA, 15 nt, Homo sapiens
ugaaaaagauggcua

SEQ ID NO: 2050051 - RNA, 12 nt, Homo sapiens
uccucacgugca

SEQ ID NO: 2050052 - RNA, 22 nt, Homo sapiens
cuuagcagcuaucucucaguga

SEQ ID NO: 2050053 - RNA, 23 nt, Homo sapiens
uaaugccuuuucucaccugucau

SEQ ID NO: 2050054 - RNA, 14 nt, Homo sapiens
ccaauagaaugagu

SEQ ID NO: 2050055 - RNA, 15 nt, Homo sapiens
uaugaagucccucua

SEQ ID NO: 2050056 - RNA, 18 nt, Homo sapiens
gaagcacagaguggcuug

SEQ ID NO: 2050057 - RNA, 16 nt, Homo sapiens
cauagaguagaccuga

SEQ ID NO: 2050058 - RNA, 17 nt, Homo sapiens
agguggcacuagggauc

SEQ ID NO: 2050059 - RNA, 14 nt, Homo sapiens
aggaaagugguugu

SEQ ID NO: 2050060 - RNA, 13 nt, Homo sapiens
ugcucauuauuac

SEQ ID NO: 2050061 - RNA, 21 nt, Homo sapiens
ucauccgcaaauuuucuucca

SEQ ID NO: 2050062 - RNA, 17 nt, Homo sapiens
cuaacaucaugcauuca

SEQ ID NO: 2050063 - RNA, 15 nt, Homo sapiens
uucuuguaaggcaua

SEQ ID NO: 2050064 - RNA, 13 nt, Homo sapiens
aguaugccuuaag

SEQ ID NO: 2050065 - RNA, 15 nt, Homo sapiens
ugaagccuucugacc

SEQ ID NO: 2050066 - RNA, 19 nt, Homo sapiens
acuguguucagugccuugg

SEQ ID NO: 2050067 - RNA, 17 nt, Homo sapiens
acaccacuugugagcug

SEQ ID NO: 2050068 - RNA, 13 nt, Homo sapiens
aaccauuuacuua

SEQ ID NO: 2050069 - RNA, 13 nt, Homo sapiens
gauuauuugccca

SEQ ID NO: 2050070 - RNA, 13 nt, Homo sapiens
cacaaugaaugua

SEQ ID NO: 2050071 - RNA, 22 nt, Homo sapiens
gccaaauuuuagauuuaccuug

SEQ ID NO: 2050072 - RNA, 13 nt, Homo sapiens
cuguauacuguac

SEQ ID NO: 2050073 - RNA, 23 nt, Homo sapiens
cuggccaguccugguccuggcug

SEQ ID NO: 2050074 - RNA, 14 nt, Homo sapiens
gagcugaguucaug

SEQ ID NO: 2050075 - RNA, 19 nt, Homo sapiens
aaaggaaaauaguaauguu

SEQ ID NO: 2050076 - RNA, 19 nt, Homo sapiens
ucaaguugagaacaaaaau

SEQ ID NO: 2050077 - RNA, 12 nt, Homo sapiens
cucuuccugacg

SEQ ID NO: 2050078 - RNA, 18 nt, Homo sapiens
accuccggccaggugccu

SEQ ID NO: 2050079 - RNA, 15 nt, Homo sapiens
accugcggguccuca

SEQ ID NO: 2050080 - RNA, 23 nt, Homo sapiens
cagcaucugaccucuaccuucau

SEQ ID NO: 2050081 - RNA, 16 nt, Homo sapiens
ccaagaagugggugcc

SEQ ID NO: 2050082 - RNA, 15 nt, Homo sapiens
ugaagugugcuguga

SEQ ID NO: 2050083 - RNA, 20 nt, Homo sapiens
uccuccaaagccugggcaga

SEQ ID NO: 2050084 - RNA, 17 nt, Homo sapiens
uaugaaaauaaaucauc

SEQ ID NO: 2050085 - RNA, 12 nt, Homo sapiens
uggugcaucuca

SEQ ID NO: 2050086 - RNA, 22 nt, Homo sapiens
uacuauucaaucuuuacacaau

SEQ ID NO: 2050087 - RNA, 18 nt, Homo sapiens
cugaauauuaaagcucuu

SEQ ID NO: 2050088 - RNA, 21 nt, Homo sapiens
uuuauuucuucccgcacaaau

SEQ ID NO: 2050089 - RNA, 17 nt, Homo sapiens
cugaacuaggugaucuc

SEQ ID NO: 2050090 - RNA, 19 nt, Homo sapiens
agcuuaccugggcacaaac

SEQ ID NO: 2050091 - RNA, 19 nt, Homo sapiens
uauuuaacagugcaaaagg

SEQ ID NO: 2050092 - RNA, 23 nt, Homo sapiens
aauacuaccucacuacuacaucu

SEQ ID NO: 2050093 - RNA, 20 nt, Homo sapiens
ggagacucaggacugcugaa

SEQ ID NO: 2050094 - RNA, 23 nt, Homo sapiens
uauacugccuuguguucagugaa

SEQ ID NO: 2050095 - RNA, 16 nt, Homo sapiens
gcuggggcacuuuaaa

SEQ ID NO: 2050096 - RNA, 16 nt, Homo sapiens
agccaugggaccuccu

SEQ ID NO: 2050097 - RNA, 13 nt, Homo sapiens
caucaagcuccug

SEQ ID NO: 2050098 - RNA, 15 nt, Homo sapiens
cagaagugauuuagu

SEQ ID NO: 2050099 - RNA, 16 nt, Homo sapiens
agcuuugcugggagag

SEQ ID NO: 2050100 - RNA, 19 nt, Homo sapiens
uccugaaaaggguguugcu

SEQ ID NO: 2050101 - RNA, 14 nt, Homo sapiens
uuuggauaauguua

SEQ ID NO: 2050102 - RNA, 15 nt, Homo sapiens
cacacgccagcuccu

SEQ ID NO: 2050103 - RNA, 13 nt, Homo sapiens
gauuuccuuccaa

SEQ ID NO: 2050104 - RNA, 13 nt, Homo sapiens
aauguauuuacuu

SEQ ID NO: 2050105 - RNA, 19 nt, Homo sapiens
ucugaugucccagugcuca

SEQ ID NO: 2050106 - RNA, 19 nt, Homo sapiens
augccagggacugacaaaa

SEQ ID NO: 2050107 - RNA, 19 nt, Homo sapiens
gagacagauauacugggag

SEQ ID NO: 2050108 - RNA, 22 nt, Homo sapiens
ugggggugccgcugucucugag

SEQ ID NO: 2050109 - RNA, 13 nt, Homo sapiens
caauguucuauua

SEQ ID NO: 2050110 - RNA, 17 nt, Homo sapiens
auuuucgacuugacuuu

SEQ ID NO: 2050111 - RNA, 22 nt, Homo sapiens
ucuccagugguugcuguugaug

SEQ ID NO: 2050112 - RNA, 16 nt, Homo sapiens
ccucauuuaucacucu

SEQ ID NO: 2050113 - RNA, 14 nt, Homo sapiens
aaaucugcuuucau

SEQ ID NO: 2050114 - RNA, 17 nt, Homo sapiens
cacuacucucuuccucc

SEQ ID NO: 2050115 - RNA, 20 nt, Homo sapiens
ugaauuguuuuuguacaguu

SEQ ID NO: 2050116 - RNA, 14 nt, Homo sapiens
ggagaacaguuuca

SEQ ID NO: 2050117 - RNA, 18 nt, Homo sapiens
gucccgcgugcaaaggaa

SEQ ID NO: 2050118 - RNA, 14 nt, Homo sapiens
uuauacauggguag

SEQ ID NO: 2050119 - RNA, 23 nt, Homo sapiens
ucccugcuggauucccugguuaa

SEQ ID NO: 2050120 - RNA, 13 nt, Homo sapiens
accagcaaauccu

SEQ ID NO: 2050121 - RNA, 16 nt, Homo sapiens
ccugggugugugugag

SEQ ID NO: 2050122 - RNA, 17 nt, Homo sapiens
acucucgcacacacagu

SEQ ID NO: 2050123 - RNA, 15 nt, Homo sapiens
cuccuuuugaccaaa

SEQ ID NO: 2050124 - RNA, 19 nt, Homo sapiens
gucuaccaacauuguucau

SEQ ID NO: 2050125 - RNA, 22 nt, Homo sapiens
caucuggggcaccugcuuccac

SEQ ID NO: 2050126 - RNA, 16 nt, Homo sapiens
ccuuucuugaauuagc

SEQ ID NO: 2050127 - RNA, 20 nt, Homo sapiens
ucccaggacacgacuuguaa

SEQ ID NO: 2050128 - RNA, 18 nt, Homo sapiens
ccuugacuucugcccaaa

SEQ ID NO: 2050129 - RNA, 15 nt, Homo sapiens
uccacagucauuucu

SEQ ID NO: 2050130 - RNA, 23 nt, Homo sapiens
agcaguaguuuguuguagguuuc

SEQ ID NO: 2050131 - RNA, 22 nt, Homo sapiens
acuuguguauauuuuaaugaau

SEQ ID NO: 2050132 - RNA, 19 nt, Homo sapiens
uuaucuagcauagcacaaa

SEQ ID NO: 2050133 - RNA, 13 nt, Homo sapiens
acaucaauguuua

SEQ ID NO: 2050134 - RNA, 14 nt, Homo sapiens
ggacaucauucugc

SEQ ID NO: 2050135 - RNA, 14 nt, Homo sapiens
ugaacugugcauag

SEQ ID NO: 2050136 - RNA, 17 nt, Homo sapiens
agaguuuugucauucag

SEQ ID NO: 2050137 - RNA, 21 nt, Homo sapiens
caacuggggaauugaagccaa

SEQ ID NO: 2050138 - RNA, 16 nt, Homo sapiens
aaggcauuguccaaag

SEQ ID NO: 2050139 - RNA, 13 nt, Homo sapiens
uuggcaacagaag

SEQ ID NO: 2050140 - RNA, 19 nt, Homo sapiens
ugaguaaugguguagaaca

SEQ ID NO: 2050141 - RNA, 15 nt, Homo sapiens
ugauccagauguuau

SEQ ID NO: 2050142 - RNA, 16 nt, Homo sapiens
caaacuucagacugaa

SEQ ID NO: 2050143 - RNA, 16 nt, Homo sapiens
acccagggaggcgaug

SEQ ID NO: 2050144 - RNA, 17 nt, Homo sapiens
uuuguuauguaccauaa

SEQ ID NO: 2050145 - RNA, 21 nt, Homo sapiens
cuugaccgugaggccagagac

SEQ ID NO: 2050146 - RNA, 11 nt, Homo sapiens
cuuuucucugc

SEQ ID NO: 2050147 - RNA, 19 nt, Homo sapiens
ugcuccagcacucaauaaa

SEQ ID NO: 2050148 - RNA, 14 nt, Homo sapiens
ugguuuuugagcca

SEQ ID NO: 2050149 - RNA, 23 nt, Homo sapiens
ggugaagaguccaagaagccagc

SEQ ID NO: 2050150 - RNA, 20 nt, Homo sapiens
cccaggucucucaacuucau

SEQ ID NO: 2050151 - RNA, 20 nt, Homo sapiens
acuuugcuugcucauaugca

SEQ ID NO: 2050152 - RNA, 20 nt, Homo sapiens
uacugugagaacugugaaua

SEQ ID NO: 2050153 - RNA, 23 nt, Homo sapiens
cccuggaagaggaauccagugaa

SEQ ID NO: 2050154 - RNA, 12 nt, Homo sapiens
cucagaggccag

SEQ ID NO: 2050155 - RNA, 23 nt, Homo sapiens
gaaaauuauguuccuagaacaaa

SEQ ID NO: 2050156 - RNA, 21 nt, Homo sapiens
uagcuaauuauuuuagcacaa

SEQ ID NO: 2050157 - RNA, 22 nt, Homo sapiens
agggucucuugcccaucucucc

SEQ ID NO: 2050158 - RNA, 18 nt, Homo sapiens
auuucuuuuucauuugac

SEQ ID NO: 2050159 - RNA, 12 nt, Homo sapiens
agccucacuuau

SEQ ID NO: 2050160 - RNA, 15 nt, Homo sapiens
ccaaaugcaauguga

SEQ ID NO: 2050161 - RNA, 17 nt, Homo sapiens
acacccuuccuucugua

SEQ ID NO: 2050162 - RNA, 17 nt, Homo sapiens
uucucuucgcugugaug

SEQ ID NO: 2050163 - RNA, 16 nt, Homo sapiens
cucuaagggaccucaa

SEQ ID NO: 2050164 - RNA, 20 nt, Homo sapiens
cuuucccauuucuaccuaag

SEQ ID NO: 2050165 - RNA, 19 nt, Homo sapiens
uccuaaccuuccuguaaac

SEQ ID NO: 2050166 - RNA, 14 nt, Homo sapiens
aacugaaaaccagu

SEQ ID NO: 2050167 - RNA, 19 nt, Homo sapiens
ccauaacuuguuuguaaaa

SEQ ID NO: 2050168 - RNA, 16 nt, Homo sapiens
ccucgagggcagggac

SEQ ID NO: 2050169 - RNA, 22 nt, Homo sapiens
ucccauuaaagagccaguuuau

SEQ ID NO: 2050170 - RNA, 14 nt, Homo sapiens
uucaaaacauacaa

SEQ ID NO: 2050171 - RNA, 17 nt, Homo sapiens
gcagcauuggugcucac

SEQ ID NO: 2050172 - RNA, 22 nt, Homo sapiens
cgggcaggggucagagcacucc

SEQ ID NO: 2050173 - RNA, 18 nt, Homo sapiens
uccaucugugccauacuu

SEQ ID NO: 2050174 - RNA, 16 nt, Homo sapiens
uuucaacauaucauuu

SEQ ID NO: 2050175 - RNA, 19 nt, Homo sapiens
gucuguguguuuaugugug

SEQ ID NO: 2050176 - RNA, 14 nt, Homo sapiens
uucugugucccaug

SEQ ID NO: 2050177 - RNA, 16 nt, Homo sapiens
agcuccauaauugcaa

SEQ ID NO: 2050178 - RNA, 13 nt, Homo sapiens
gggcaacugagag

SEQ ID NO: 2050179 - RNA, 21 nt, Homo sapiens
cauuuuuauaaaaaugagugc

SEQ ID NO: 2050180 - RNA, 18 nt, Homo sapiens
guuuaauggguaugcuca

SEQ ID NO: 2050181 - RNA, 15 nt, Homo sapiens
acaguaucacucuaa

SEQ ID NO: 2050182 - RNA, 23 nt, Homo sapiens
ucccucccagauccucugcugac

SEQ ID NO: 2050183 - RNA, 16 nt, Homo sapiens
guaaucuuuauacugg

SEQ ID NO: 2050184 - RNA, 20 nt, Homo sapiens
caucucagacaucaagucaa

SEQ ID NO: 2050185 - RNA, 13 nt, Homo sapiens
uacuacaguauac

SEQ ID NO: 2050186 - RNA, 17 nt, Homo sapiens
cauccuccacaauagca

SEQ ID NO: 2050187 - RNA, 14 nt, Homo sapiens
cugugccaaagcca

SEQ ID NO: 2050188 - RNA, 22 nt, Homo sapiens
gcaguccuuaucaccagccuca

SEQ ID NO: 2050189 - RNA, 19 nt, Homo sapiens
ugagaaaaguucaauacuc

SEQ ID NO: 2050190 - RNA, 21 nt, Homo sapiens
ucagcaaguuagaacuagcca

SEQ ID NO: 2050191 - RNA, 22 nt, Homo sapiens
gcugagaaggguugauccugca

SEQ ID NO: 2050192 - RNA, 13 nt, Homo sapiens
auauacauaugac

SEQ ID NO: 2050193 - RNA, 16 nt, Homo sapiens
ccacagguccuccauc

SEQ ID NO: 2050194 - RNA, 21 nt, Homo sapiens
acucuugaaguacuuaacaua

SEQ ID NO: 2050195 - RNA, 15 nt, Homo sapiens
caaugccugccugaa

SEQ ID NO: 2050196 - RNA, 22 nt, Homo sapiens
gagacaaaccuuaaaacagcug

SEQ ID NO: 2050197 - RNA, 21 nt, Homo sapiens
caccccagccucauugugcca

SEQ ID NO: 2050198 - RNA, 17 nt, Homo sapiens
uggauuuucaucagggg

SEQ ID NO: 2050199 - RNA, 22 nt, Homo sapiens
uaaaguucaauuucaacaugua

SEQ ID NO: 2050200 - RNA, 13 nt, Homo sapiens
ccuuggagccuga

SEQ ID NO: 2050201 - RNA, 18 nt, Homo sapiens
aauagaaggauucaguca

SEQ ID NO: 2050202 - RNA, 14 nt, Homo sapiens
uuucaaagcacuua

SEQ ID NO: 2050203 - RNA, 13 nt, Homo sapiens
aucaucucagcuc

SEQ ID NO: 2050204 - RNA, 15 nt, Homo sapiens
cggcccuaagccacu

SEQ ID NO: 2050205 - RNA, 20 nt, Homo sapiens
ggcuagagugcaauggcgcg

SEQ ID NO: 2050206 - RNA, 20 nt, Homo sapiens
ggcuggagugcaguggcgcg

SEQ ID NO: 2050207 - RNA, 20 nt, Homo sapiens
ggcuggagugcgguggcgca

SEQ ID NO: 2050208 - RNA, 20 nt, Homo sapiens
gguuggagugcaguggcgug

SEQ ID NO: 2050209 - RNA, 16 nt, Homo sapiens
uguaaauucagucuuu

SEQ ID NO: 2050210 - RNA, 15 nt, Homo sapiens
caacugccaaucaag

SEQ ID NO: 2050211 - RNA, 19 nt, Homo sapiens
ccuacugagcauuugcacc

SEQ ID NO: 2050212 - RNA, 15 nt, Homo sapiens
cuaacacagccauca

SEQ ID NO: 2050213 - RNA, 16 nt, Homo sapiens
ggccuauguugaucca

SEQ ID NO: 2050214 - RNA, 18 nt, Homo sapiens
gggcucuaggauggggca

SEQ ID NO: 2050215 - RNA, 22 nt, Homo sapiens
agugaaguuuuacugucuauua

SEQ ID NO: 2050216 - RNA, 12 nt, Homo sapiens
guucccuuuaaa

SEQ ID NO: 2050217 - RNA, 22 nt, Homo sapiens
aguuagguagcuuuagggcaau

SEQ ID NO: 2050218 - RNA, 19 nt, Homo sapiens
uuuaguuuuacacuaggaa

SEQ ID NO: 2050219 - RNA, 23 nt, Homo sapiens
agggaagugugagcgccuuggua

SEQ ID NO: 2050220 - RNA, 15 nt, Homo sapiens
acaaagcuacuugaa

SEQ ID NO: 2050221 - RNA, 15 nt, Homo sapiens
uuaauccaauccacu

SEQ ID NO: 2050222 - RNA, 17 nt, Homo sapiens
ugauauauaaaugugau

SEQ ID NO: 2050223 - RNA, 12 nt, Homo sapiens
ggucccaagaca

SEQ ID NO: 2050224 - RNA, 21 nt, Homo sapiens
uauuugaagcaucacauaaaa

SEQ ID NO: 2050225 - RNA, 14 nt, Homo sapiens
aaucugaacucuca

SEQ ID NO: 2050226 - RNA, 23 nt, Homo sapiens
aagaguacacucagccacuguca

SEQ ID NO: 2050227 - RNA, 20 nt, Homo sapiens
cuacaaaauuucaccugcaa

SEQ ID NO: 2050228 - RNA, 19 nt, Homo sapiens
aauaaaccuccgccaaugc

SEQ ID NO: 2050229 - RNA, 13 nt, Homo sapiens
guccaaggucucc

SEQ ID NO: 2050230 - RNA, 13 nt, Homo sapiens
acuggacgcccag

SEQ ID NO: 2050231 - RNA, 16 nt, Homo sapiens
uaucggggaagccaga

SEQ ID NO: 2050232 - RNA, 12 nt, Homo sapiens
guggaucacuug

SEQ ID NO: 2050233 - RNA, 20 nt, Homo sapiens
ccucugcccaaccagguugc

SEQ ID NO: 2050234 - RNA, 17 nt, Homo sapiens
caccucuucuuuaccag

SEQ ID NO: 2050235 - RNA, 17 nt, Homo sapiens
cauggacacaucaggaa

SEQ ID NO: 2050236 - RNA, 18 nt, Homo sapiens
ugaaguccaggacugggu

SEQ ID NO: 2050237 - RNA, 17 nt, Homo sapiens
uucuagguaggggccca

SEQ ID NO: 2050238 - RNA, 18 nt, Homo sapiens
guauuaauguaaagauac

SEQ ID NO: 2050239 - RNA, 13 nt, Homo sapiens
gcacagccauggc

SEQ ID NO: 2050240 - RNA, 13 nt, Homo sapiens
gaaacccacagau

SEQ ID NO: 2050241 - RNA, 16 nt, Homo sapiens
agagugaaauaauuaa

SEQ ID NO: 2050242 - RNA, 19 nt, Homo sapiens
auucuuagcauacauucag

SEQ ID NO: 2050243 - RNA, 22 nt, Homo sapiens
acuuugaaggacaacagcaucu

SEQ ID NO: 2050244 - RNA, 17 nt, Homo sapiens
acaugguuacauaucaa

SEQ ID NO: 2050245 - RNA, 17 nt, Homo sapiens
uguggagccccagcaua

SEQ ID NO: 2050246 - RNA, 20 nt, Homo sapiens
agacaaacuccggcacuggg

SEQ ID NO: 2050247 - RNA, 14 nt, Homo sapiens
ucacaugacucuca

SEQ ID NO: 2050248 - RNA, 15 nt, Homo sapiens
cauagaaauguaggu

SEQ ID NO: 2050249 - RNA, 22 nt, Homo sapiens
aaugucccccauaucuguaugu

SEQ ID NO: 2050250 - RNA, 23 nt, Homo sapiens
ucaacauggaaaaauccugucau

SEQ ID NO: 2050251 - RNA, 21 nt, Homo sapiens
cacaagguugcuggcauuugc

SEQ ID NO: 2050252 - RNA, 17 nt, Homo sapiens
acugguagguugggaca

SEQ ID NO: 2050253 - RNA, 22 nt, Homo sapiens
cccuuccuggaaacagcaugaa

SEQ ID NO: 2050254 - RNA, 20 nt, Homo sapiens
uuuaucuaaauuacagugca

SEQ ID NO: 2050255 - RNA, 18 nt, Homo sapiens
gauugcuacguaaucuca

SEQ ID NO: 2050256 - RNA, 18 nt, Homo sapiens
agauggcuuuuccuggac

SEQ ID NO: 2050257 - RNA, 14 nt, Homo sapiens
agugagugaucacu

SEQ ID NO: 2050258 - RNA, 17 nt, Homo sapiens
guagagaagcaaguaaa

SEQ ID NO: 2050259 - RNA, 21 nt, Homo sapiens
cuaaagacccuaaaucugagg

SEQ ID NO: 2050260 - RNA, 23 nt, Homo sapiens
acaggaguguccucuucccucuc

SEQ ID NO: 2050261 - RNA, 19 nt, Homo sapiens
cuaguaagaugcacugaaa

SEQ ID NO: 2050262 - RNA, 20 nt, Homo sapiens
uaucuuccaaaugcaauuug

SEQ ID NO: 2050263 - RNA, 18 nt, Homo sapiens
ugagucuucaucuuaggg

SEQ ID NO: 2050264 - RNA, 20 nt, Homo sapiens
cuuuuucacuugggucucug

SEQ ID NO: 2050265 - RNA, 18 nt, Homo sapiens
aaaugucuuucuauucau

SEQ ID NO: 2050266 - RNA, 17 nt, Homo sapiens
uuucucccccuuuccaa

SEQ ID NO: 2050267 - RNA, 21 nt, Homo sapiens
ccucaguuucauuaacuggug

SEQ ID NO: 2050268 - RNA, 14 nt, Homo sapiens
cuaggcugcuuccg

SEQ ID NO: 2050269 - RNA, 14 nt, Homo sapiens
augcauaaagccaa

SEQ ID NO: 2050270 - RNA, 18 nt, Homo sapiens
ucaugaguuucccagaga

SEQ ID NO: 2050271 - RNA, 23 nt, Homo sapiens
ucuguguagucaauaaaaugaac

SEQ ID NO: 2050272 - RNA, 16 nt, Homo sapiens
ucagacuuacuuacuc

SEQ ID NO: 2050273 - RNA, 17 nt, Homo sapiens
uuagauaaccauauuca

SEQ ID NO: 2050274 - RNA, 17 nt, Homo sapiens
acagcagcugaagccag

SEQ ID NO: 2050275 - RNA, 21 nt, Homo sapiens
aauccaagugaacacuagcca

SEQ ID NO: 2050276 - RNA, 15 nt, Homo sapiens
ggaaaugcugacuuu

SEQ ID NO: 2050277 - RNA, 18 nt, Homo sapiens
aagauuguccagugcaac

SEQ ID NO: 2050278 - RNA, 19 nt, Homo sapiens
cggaagcccuugccugaaa

SEQ ID NO: 2050279 - RNA, 20 nt, Homo sapiens
cuccauuaaauggucuaaaa

SEQ ID NO: 2050280 - RNA, 23 nt, Homo sapiens
aggcaguauuuuguguccuccag

SEQ ID NO: 2050281 - RNA, 15 nt, Homo sapiens
acagagggucccauu

SEQ ID NO: 2050282 - RNA, 22 nt, Homo sapiens
gagugacgcaucuccaagccaa

SEQ ID NO: 2050283 - RNA, 20 nt, Homo sapiens
agcagagcuuccacaagaca

SEQ ID NO: 2050284 - RNA, 16 nt, Homo sapiens
ucuagauacuguauca

SEQ ID NO: 2050285 - RNA, 17 nt, Homo sapiens
cucugugauuaccucuc

SEQ ID NO: 2050286 - RNA, 17 nt, Homo sapiens
caucuucucauuuugca

SEQ ID NO: 2050287 - RNA, 14 nt, Homo sapiens
cugggcaccccuca

SEQ ID NO: 2050288 - RNA, 16 nt, Homo sapiens
cuuuuucuaaaaagcu

SEQ ID NO: 2050289 - RNA, 20 nt, Homo sapiens
auuucuuugaucuggacaga

SEQ ID NO: 2050290 - RNA, 15 nt, Homo sapiens
ucuucccugaccucc

SEQ ID NO: 2050291 - RNA, 22 nt, Homo sapiens
uaggcaaagaaagcucuagaca

SEQ ID NO: 2050292 - RNA, 17 nt, Homo sapiens
gucaugugggucuucca

SEQ ID NO: 2050293 - RNA, 21 nt, Homo sapiens
auuuguucauuauuugugcua

SEQ ID NO: 2050294 - RNA, 14 nt, Homo sapiens
gcuguucugcugaa

SEQ ID NO: 2050295 - RNA, 14 nt, Homo sapiens
aaguagggacuucu

SEQ ID NO: 2050296 - RNA, 21 nt, Homo sapiens
gcaauugaauuaaauuaggaa

SEQ ID NO: 2050297 - RNA, 14 nt, Homo sapiens
caaacaaaauuucu

SEQ ID NO: 2050298 - RNA, 14 nt, Homo sapiens
ugugguacuuugca

SEQ ID NO: 2050299 - RNA, 19 nt, Homo sapiens
cuuugccagaaagcauaaa

SEQ ID NO: 2050300 - RNA, 21 nt, Homo sapiens
ugaaacucuaccaacagccac

SEQ ID NO: 2050301 - RNA, 15 nt, Homo sapiens
ugaccuaguuuucca

SEQ ID NO: 2050302 - RNA, 14 nt, Homo sapiens
cucacacuacuuga

SEQ ID NO: 2050303 - RNA, 20 nt, Homo sapiens
uuaucaugugaaaucauuca

SEQ ID NO: 2050304 - RNA, 20 nt, Homo sapiens
caguggccacguucagggag

SEQ ID NO: 2050305 - RNA, 19 nt, Homo sapiens
ccaaauauugugcacauuu

SEQ ID NO: 2050306 - RNA, 17 nt, Homo sapiens
cuucuugaacuuggaca

SEQ ID NO: 2050307 - RNA, 22 nt, Homo sapiens
gauagugggcaccccacugcaa

SEQ ID NO: 2050308 - RNA, 16 nt, Homo sapiens
ucaguaaacaaaucag

SEQ ID NO: 2050309 - RNA, 15 nt, Homo sapiens
cuuuaaauccuucca

SEQ ID NO: 2050310 - RNA, 19 nt, Homo sapiens
uacucgggaggcugagaca

SEQ ID NO: 2050311 - RNA, 16 nt, Homo sapiens
ucagguaguacuggga

SEQ ID NO: 2050312 - RNA, 20 nt, Homo sapiens
auccagguuuaugaaugaca

SEQ ID NO: 2050313 - RNA, 15 nt, Homo sapiens
ucauggaauugguuu

SEQ ID NO: 2050314 - RNA, 21 nt, Homo sapiens
aucccaggggaccacaccucc

SEQ ID NO: 2050315 - RNA, 21 nt, Homo sapiens
uuaucccccgcaaagacauca

SEQ ID NO: 2050316 - RNA, 17 nt, Homo sapiens
gaagcuucaugccaggu

SEQ ID NO: 2050317 - RNA, 12 nt, Homo sapiens
gauuauucugau

SEQ ID NO: 2050318 - RNA, 13 nt, Homo sapiens
gagaagggcugcu

SEQ ID NO: 2050319 - RNA, 17 nt, Homo sapiens
aggccagcccacugggc

SEQ ID NO: 2050320 - RNA, 17 nt, Homo sapiens
agggacaggcacuccaa

SEQ ID NO: 2050321 - RNA, 15 nt, Homo sapiens
agaauuuguccaaua

SEQ ID NO: 2050322 - RNA, 22 nt, Homo sapiens
uguuugcccuuuggccagugac

SEQ ID NO: 2050323 - RNA, 14 nt, Homo sapiens
cugggggugggggc

SEQ ID NO: 2050324 - RNA, 20 nt, Homo sapiens
ccagcagacaucaagcucaa

SEQ ID NO: 2050325 - RNA, 16 nt, Homo sapiens
uaacaugacacuuaga

SEQ ID NO: 2050326 - RNA, 23 nt, Homo sapiens
ccugagcuucccccccaccacag

SEQ ID NO: 2050327 - RNA, 15 nt, Homo sapiens
cucggguucucucuc

SEQ ID NO: 2050328 - RNA, 13 nt, Homo sapiens
uacuacacuccau

SEQ ID NO: 2050329 - RNA, 15 nt, Homo sapiens
cuuguaaauauuguu

SEQ ID NO: 2050330 - RNA, 20 nt, Homo sapiens
agaugacaacacacaccaau

SEQ ID NO: 2050331 - RNA, 22 nt, Homo sapiens
uacucugaagggcaucaugcau

SEQ ID NO: 2050332 - RNA, 17 nt, Homo sapiens
cuuuauagcacauggca

SEQ ID NO: 2050333 - RNA, 17 nt, Homo sapiens
uaaacacaaauugugaa

SEQ ID NO: 2050334 - RNA, 16 nt, Homo sapiens
agacucugccauuaaa

SEQ ID NO: 2050335 - RNA, 23 nt, Homo sapiens
aaguugcagaacagacacuuuaa

SEQ ID NO: 2050336 - RNA, 16 nt, Homo sapiens
ugcuguggggaccaca

SEQ ID NO: 2050337 - RNA, 21 nt, Homo sapiens
gucacaauaaauggccagugc

SEQ ID NO: 2050338 - RNA, 18 nt, Homo sapiens
ggugccccagacccagag

SEQ ID NO: 2050339 - RNA, 19 nt, Homo sapiens
ccugagcaacagagugaga

SEQ ID NO: 2050340 - RNA, 19 nt, Homo sapiens
gaggagcacacauccaaga

SEQ ID NO: 2050341 - RNA, 16 nt, Homo sapiens
uugaauauuacuggau

SEQ ID NO: 2050342 - RNA, 15 nt, Homo sapiens
uggugaagucacauu

SEQ ID NO: 2050343 - RNA, 17 nt, Homo sapiens
aaguuaauccacuguga

SEQ ID NO: 2050344 - RNA, 13 nt, Homo sapiens
uaaagaagccagc

SEQ ID NO: 2050345 - RNA, 18 nt, Homo sapiens
aggcagaaaagucaucau

SEQ ID NO: 2050346 - RNA, 16 nt, Homo sapiens
agaacccuauccagug

SEQ ID NO: 2050347 - RNA, 14 nt, Homo sapiens
uggcuacaucucca

SEQ ID NO: 2050348 - RNA, 20 nt, Homo sapiens
aguugaagaaaaaauggcaa

SEQ ID NO: 2050349 - RNA, 23 nt, Homo sapiens
caucaaucuaaagauacaguguc

SEQ ID NO: 2050350 - RNA, 17 nt, Homo sapiens
aucaucaguggagccau

SEQ ID NO: 2050351 - RNA, 22 nt, Homo sapiens
auuaacuaucaucaguccugca

SEQ ID NO: 2050352 - RNA, 16 nt, Homo sapiens
uuccugaucacuaugc

SEQ ID NO: 2050353 - RNA, 14 nt, Homo sapiens
gcaccacccuaguc

SEQ ID NO: 2050354 - RNA, 16 nt, Homo sapiens
ccauuguuugaaacaa

SEQ ID NO: 2050355 - RNA, 20 nt, Homo sapiens
gugauucaccucuucuuucc

SEQ ID NO: 2050356 - RNA, 20 nt, Homo sapiens
acuccugaggacagcugucc

SEQ ID NO: 2050357 - RNA, 12 nt, Homo sapiens
cuggccagagag

SEQ ID NO: 2050358 - RNA, 23 nt, Homo sapiens
aguauuccuuuauacacagugga

SEQ ID NO: 2050359 - RNA, 20 nt, Homo sapiens
auauaauucacucaagcacu

SEQ ID NO: 2050360 - RNA, 23 nt, Homo sapiens
ggcccuagcuaauaaaccuguaa

SEQ ID NO: 2050361 - RNA, 18 nt, Homo sapiens
gaaggaagcaagcaucuc

SEQ ID NO: 2050362 - RNA, 21 nt, Homo sapiens
auuccaaacucuccagccacu

SEQ ID NO: 2050363 - RNA, 22 nt, Homo sapiens
ucaaacucccgaccucagguga

SEQ ID NO: 2050364 - RNA, 10 nt, Homo sapiens
aacacauguu

SEQ ID NO: 2050365 - RNA, 14 nt, Homo sapiens
gguggaguuucuga

SEQ ID NO: 2050366 - RNA, 14 nt, Homo sapiens
uucucaguggugca

SEQ ID NO: 2050367 - RNA, 13 nt, Homo sapiens
uaaucugcaguga

SEQ ID NO: 2050368 - RNA, 20 nt, Homo sapiens
ugagugggugcauauguaca

SEQ ID NO: 2050369 - RNA, 21 nt, Homo sapiens
cuuucuuaaaacugacauuug

SEQ ID NO: 2050370 - RNA, 21 nt, Homo sapiens
cuuaauacuaaggaaccaaca

SEQ ID NO: 2050371 - RNA, 18 nt, Homo sapiens
ggcccaaaggcccaggga

SEQ ID NO: 2050372 - RNA, 21 nt, Homo sapiens
ugcuuuuggcagagaccauaa

SEQ ID NO: 2050373 - RNA, 13 nt, Homo sapiens
ucccuaccugacu

SEQ ID NO: 2050374 - RNA, 18 nt, Homo sapiens
aucucucugcagcugccg

SEQ ID NO: 2050375 - RNA, 18 nt, Homo sapiens
ugccauuaaaacauuacc

SEQ ID NO: 2050376 - RNA, 13 nt, Homo sapiens
aaggacaggccac

SEQ ID NO: 2050377 - RNA, 15 nt, Homo sapiens
uuucagaucauggca

SEQ ID NO: 2050378 - RNA, 12 nt, Homo sapiens
agaaucuagagc

SEQ ID NO: 2050379 - RNA, 18 nt, Homo sapiens
cggccccucccccugaga

SEQ ID NO: 2050380 - RNA, 19 nt, Homo sapiens
agaaagcuccuuccagacc

SEQ ID NO: 2050381 - RNA, 14 nt, Homo sapiens
aguugcaaguuuaa

SEQ ID NO: 2050382 - RNA, 18 nt, Homo sapiens
uguagucccagcuaccca

SEQ ID NO: 2050383 - RNA, 17 nt, Homo sapiens
auaacuauugaguuaca

SEQ ID NO: 2050384 - RNA, 15 nt, Homo sapiens
agggcugaaagccau

SEQ ID NO: 2050385 - RNA, 16 nt, Homo sapiens
acaguaugagucaaug

SEQ ID NO: 2050386 - RNA, 17 nt, Homo sapiens
ucagccugcuucuuccc

SEQ ID NO: 2050387 - RNA, 16 nt, Homo sapiens
accaucugaggaauga

SEQ ID NO: 2050388 - RNA, 19 nt, Homo sapiens
ucuccaucccucuaaugag

SEQ ID NO: 2050389 - RNA, 15 nt, Homo sapiens
ucguucuucugggaa

SEQ ID NO: 2050390 - RNA, 16 nt, Homo sapiens
uucacaaccucaccaa

SEQ ID NO: 2050391 - RNA, 20 nt, Homo sapiens
agauuguaucaugugcuaga

SEQ ID NO: 2050392 - RNA, 15 nt, Homo sapiens
cgcauuggugacuca

SEQ ID NO: 2050393 - RNA, 20 nt, Homo sapiens
gacacauucaggaguuaaau

SEQ ID NO: 2050394 - RNA, 12 nt, Homo sapiens
cugguggccgau

SEQ ID NO: 2050395 - RNA, 13 nt, Homo sapiens
ccaccacacaucc

SEQ ID NO: 2050396 - RNA, 14 nt, Homo sapiens
aauuaaaauacuau

SEQ ID NO: 2050397 - RNA, 19 nt, Homo sapiens
cuguucuuggaacaacgca

SEQ ID NO: 2050398 - RNA, 17 nt, Homo sapiens
ugcgugguccauuccau

SEQ ID NO: 2050399 - RNA, 17 nt, Homo sapiens
aguguaacaaccuaucu

SEQ ID NO: 2050400 - RNA, 24 nt, Homo sapiens
agaaaaaaguuuacaacauaaucu

SEQ ID NO: 2050401 - RNA, 21 nt, Homo sapiens
uugugcauuaucuagauacug

SEQ ID NO: 2050402 - RNA, 10 nt, Homo sapiens
uuuaccucag

SEQ ID NO: 2050403 - RNA, 15 nt, Homo sapiens
gugcacgcacacugu

SEQ ID NO: 2050404 - RNA, 15 nt, Homo sapiens
caaauacaucuccag

SEQ ID NO: 2050405 - RNA, 19 nt, Homo sapiens
auucuuuuucaguuuuacc

SEQ ID NO: 2050406 - RNA, 19 nt, Homo sapiens
agaccuugggggaagacuu

SEQ ID NO: 2050407 - RNA, 20 nt, Homo sapiens
aaauugccuuuguaauauga

SEQ ID NO: 2050408 - RNA, 18 nt, Homo sapiens
agagcuacacaggggaaa

SEQ ID NO: 2050409 - RNA, 14 nt, Homo sapiens
gccaaaacccagcu

SEQ ID NO: 2050410 - RNA, 19 nt, Homo sapiens
aaggauaaaugucuuucca

SEQ ID NO: 2050411 - RNA, 14 nt, Homo sapiens
cgcucgcugccauc

SEQ ID NO: 2050412 - RNA, 23 nt, Homo sapiens
auguuugucuuuuaaugcuucau

SEQ ID NO: 2050413 - RNA, 20 nt, Homo sapiens
cacagacgccuuacuggcaa

SEQ ID NO: 2050414 - RNA, 17 nt, Homo sapiens
cauagagauaugcacac

SEQ ID NO: 2050415 - RNA, 17 nt, Homo sapiens
aguaaauauuucaggca

SEQ ID NO: 2050416 - RNA, 17 nt, Homo sapiens
ugcauguaauccuagca

SEQ ID NO: 2050417 - RNA, 15 nt, Homo sapiens
uuccacugagcauca

SEQ ID NO: 2050418 - RNA, 20 nt, Homo sapiens
uugugguuuaugucaucaua

SEQ ID NO: 2050419 - RNA, 19 nt, Homo sapiens
gcccuuggcuucugugaug

SEQ ID NO: 2050420 - RNA, 15 nt, Homo sapiens
ccugcccaccucucc

SEQ ID NO: 2050421 - RNA, 17 nt, Homo sapiens
auuucuacaaguucaga

SEQ ID NO: 2050422 - RNA, 17 nt, Homo sapiens
agaaggaaaaauuccag

SEQ ID NO: 2050423 - RNA, 21 nt, Homo sapiens
aggauuaaugguccugugaug

SEQ ID NO: 2050424 - RNA, 15 nt, Homo sapiens
agccacugcagcaca

SEQ ID NO: 2050425 - RNA, 17 nt, Homo sapiens
aaacauuaguacuuuau

SEQ ID NO: 2050426 - RNA, 19 nt, Homo sapiens
ugguccaaaauaaaaccuc

SEQ ID NO: 2050427 - RNA, 17 nt, Homo sapiens
agggaugcugccugagu

SEQ ID NO: 2050428 - RNA, 20 nt, Homo sapiens
caacagaagggaaauuucaa

SEQ ID NO: 2050429 - RNA, 19 nt, Homo sapiens
aaaguuacuugaauuucaa

SEQ ID NO: 2050430 - RNA, 12 nt, Homo sapiens
aguugugaaaga

SEQ ID NO: 2050431 - RNA, 20 nt, Homo sapiens
cagacaucggccuccaugac

SEQ ID NO: 2050432 - RNA, 11 nt, Homo sapiens
ucaugugcugg

SEQ ID NO: 2050433 - RNA, 15 nt, Homo sapiens
gugaugcaugagcuc

SEQ ID NO: 2050434 - RNA, 22 nt, Homo sapiens
aaccucaucucucuaacaauau

SEQ ID NO: 2050435 - RNA, 24 nt, Homo sapiens
gccucccucccugugccagaccuc

SEQ ID NO: 2050436 - RNA, 17 nt, Homo sapiens
uugaagaugucauccca

SEQ ID NO: 2050437 - RNA, 20 nt, Homo sapiens
agccucccgaguagcugaga

SEQ ID NO: 2050438 - RNA, 13 nt, Homo sapiens
gagaagcuggaag

SEQ ID NO: 2050439 - RNA, 21 nt, Homo sapiens
ccuggcuccaacacugcugcu

SEQ ID NO: 2050440 - RNA, 16 nt, Homo sapiens
caagaaguacugccaa

SEQ ID NO: 2050441 - RNA, 15 nt, Homo sapiens
acauagaagagccaa

SEQ ID NO: 2050442 - RNA, 22 nt, Homo sapiens
ccagccugggggccagugggga

SEQ ID NO: 2050443 - RNA, 23 nt, Homo sapiens
uggagauuuaucucuguuuccuu

SEQ ID NO: 2050444 - RNA, 14 nt, Homo sapiens
uugauuuuugccca

SEQ ID NO: 2050445 - RNA, 22 nt, Homo sapiens
ucuugaauuagcauuuuucaaa

SEQ ID NO: 2050446 - RNA, 16 nt, Homo sapiens
ucaagccuuccaggga

SEQ ID NO: 2050447 - RNA, 16 nt, Homo sapiens
aacauggaaaaauccu

SEQ ID NO: 2050448 - RNA, 16 nt, Homo sapiens
cucaugagaagccaag

SEQ ID NO: 2050449 - RNA, 16 nt, Homo sapiens
guuacagcuguucuga

SEQ ID NO: 2050450 - RNA, 20 nt, Homo sapiens
gcagagcuuguuuuguuuca

SEQ ID NO: 2050451 - RNA, 14 nt, Homo sapiens
uccaaaucucaugu

SEQ ID NO: 2050452 - RNA, 21 nt, Homo sapiens
cuuucuacaggccagcagggg

SEQ ID NO: 2050453 - RNA, 22 nt, Homo sapiens
aaccaacugcugcugugcacau

SEQ ID NO: 2050454 - RNA, 22 nt, Homo sapiens
ccuccaaggaggggcuguaaaa

SEQ ID NO: 2050455 - RNA, 12 nt, Homo sapiens
uuccugaggcug

SEQ ID NO: 2050456 - RNA, 12 nt, Homo sapiens
cacguaccuuca

SEQ ID NO: 2050457 - RNA, 15 nt, Homo sapiens
ucuuuccaggcuucc

SEQ ID NO: 2050458 - RNA, 18 nt, Homo sapiens
uguauaagucaagcucca

SEQ ID NO: 2050459 - RNA, 14 nt, Homo sapiens
uugcuccuugacau

SEQ ID NO: 2050460 - RNA, 20 nt, Homo sapiens
gugguggcacacaccuguag

SEQ ID NO: 2050461 - RNA, 14 nt, Homo sapiens
acaagcauuugccc

SEQ ID NO: 2050462 - RNA, 14 nt, Homo sapiens
auuuuucaaagcaa

SEQ ID NO: 2050463 - RNA, 17 nt, Homo sapiens
ucagagaccauugcaau

SEQ ID NO: 2050464 - RNA, 23 nt, Homo sapiens
aauccucaacaacaaaccaaaac

SEQ ID NO: 2050465 - RNA, 17 nt, Homo sapiens
ccaguccuuuguugcug

SEQ ID NO: 2050466 - RNA, 13 nt, Homo sapiens
gucuauuagcucc

SEQ ID NO: 2050467 - RNA, 17 nt, Homo sapiens
ucuacauccaauguaug

SEQ ID NO: 2050468 - RNA, 19 nt, Homo sapiens
gccuccggcgucuugccca

SEQ ID NO: 2050469 - RNA, 23 nt, Homo sapiens
cucauauauaguagacaaagagc

SEQ ID NO: 2050470 - RNA, 14 nt, Homo sapiens
auggaacacggcca

SEQ ID NO: 2050471 - RNA, 20 nt, Homo sapiens
gacugcaaacauguugccuc

SEQ ID NO: 2050472 - RNA, 14 nt, Homo sapiens
auccaugcccuccc

SEQ ID NO: 2050473 - RNA, 14 nt, Homo sapiens
cauacgugugcaug

SEQ ID NO: 2050474 - RNA, 21 nt, Homo sapiens
uaaugguaguuuuacaguguu

SEQ ID NO: 2050475 - RNA, 15 nt, Homo sapiens
uuaauuauauguaua

SEQ ID NO: 2050476 - RNA, 13 nt, Homo sapiens
uugcacagaauuu

SEQ ID NO: 2050477 - RNA, 24 nt, Homo sapiens
gugcucugccucagacguugccug

SEQ ID NO: 2050478 - RNA, 16 nt, Homo sapiens
aacaaagcagccacga

SEQ ID NO: 2050479 - RNA, 20 nt, Homo sapiens
gcccuggcugaccccaaaga

SEQ ID NO: 2050480 - RNA, 19 nt, Homo sapiens
acauggacacaccagagug

SEQ ID NO: 2050481 - RNA, 17 nt, Homo sapiens
ugaccagagcaccucag

SEQ ID NO: 2050482 - RNA, 23 nt, Homo sapiens
cuaauguuugaacaaagcucaaa

SEQ ID NO: 2050483 - RNA, 15 nt, Homo sapiens
uuagucaaucacugc

SEQ ID NO: 2050484 - RNA, 22 nt, Homo sapiens
gaaccugcuaaggcugccucag

SEQ ID NO: 2050485 - RNA, 21 nt, Homo sapiens
ccauauaggauuauagauacu

SEQ ID NO: 2050486 - RNA, 22 nt, Homo sapiens
ccucucaaauucagcucugauc

SEQ ID NO: 2050487 - RNA, 17 nt, Homo sapiens
ucugugagugcgucuga

SEQ ID NO: 2050488 - RNA, 16 nt, Homo sapiens
gaugauuaagugcaca

SEQ ID NO: 2050489 - RNA, 18 nt, Homo sapiens
gaaauguuugcugaguua

SEQ ID NO: 2050490 - RNA, 17 nt, Homo sapiens
uuuaagcucugagcugu

SEQ ID NO: 2050491 - RNA, 13 nt, Homo sapiens
ugacccaaagacc

SEQ ID NO: 2050492 - RNA, 14 nt, Homo sapiens
aaaugugugccaga

SEQ ID NO: 2050493 - RNA, 22 nt, Homo sapiens
agcaaaucuacuucaacacuuc

SEQ ID NO: 2050494 - RNA, 14 nt, Homo sapiens
agagaaauuugcca

SEQ ID NO: 2050495 - RNA, 22 nt, Homo sapiens
cugcagguggcagagugaaugu

SEQ ID NO: 2050496 - RNA, 22 nt, Homo sapiens
guuucuguauacaacccuggca

SEQ ID NO: 2050497 - RNA, 21 nt, Homo sapiens
guacagacugcagacauucuc

SEQ ID NO: 2050498 - RNA, 16 nt, Homo sapiens
auaguggagagaacug

SEQ ID NO: 2050499 - RNA, 13 nt, Homo sapiens
aaacaacuuugua

SEQ ID NO: 2050500 - RNA, 13 nt, Homo sapiens
ucugaauccucau

SEQ ID NO: 2050501 - RNA, 17 nt, Homo sapiens
acucacacaaccaugac

SEQ ID NO: 2050502 - RNA, 19 nt, Homo sapiens
ugaauuagagaauuuucug

SEQ ID NO: 2050503 - RNA, 23 nt, Homo sapiens
caggauggugggcaggaucucaa

SEQ ID NO: 2050504 - RNA, 17 nt, Homo sapiens
uccucucgcacaaugca

SEQ ID NO: 2050505 - RNA, 18 nt, Homo sapiens
aagggguaauugcauucu

SEQ ID NO: 2050506 - RNA, 13 nt, Homo sapiens
agcuacuucuuau

SEQ ID NO: 2050507 - RNA, 11 nt, Homo sapiens
cugcugaauaa

SEQ ID NO: 2050508 - RNA, 13 nt, Homo sapiens
cuuaccuguucag

SEQ ID NO: 2050509 - RNA, 21 nt, Homo sapiens
guuaaaaugguuuuugccuaa

SEQ ID NO: 2050510 - RNA, 18 nt, Homo sapiens
ugguccaucacuauucaa

SEQ ID NO: 2050511 - RNA, 19 nt, Homo sapiens
auuugucuagcaugcugag

SEQ ID NO: 2050512 - RNA, 17 nt, Homo sapiens
uuuuggaaccuaauaaa

SEQ ID NO: 2050513 - RNA, 17 nt, Homo sapiens
aagugagaaaacugaga

SEQ ID NO: 2050514 - RNA, 13 nt, Homo sapiens
gcuuguacagugu

SEQ ID NO: 2050515 - RNA, 18 nt, Homo sapiens
acuauguuuggaguuuaa

SEQ ID NO: 2050516 - RNA, 16 nt, Homo sapiens
ggaugugguggcagug

SEQ ID NO: 2050517 - RNA, 21 nt, Homo sapiens
uaaacuguuuauuugcacuau

SEQ ID NO: 2050518 - RNA, 19 nt, Homo sapiens
aagugccaaagaaaguggu

SEQ ID NO: 2050519 - RNA, 14 nt, Homo sapiens
ggaguuaguggaua

SEQ ID NO: 2050520 - RNA, 22 nt, Homo sapiens
aagaauagccuauugucuuuca

SEQ ID NO: 2050521 - RNA, 13 nt, Homo sapiens
cauaaugaguucc

SEQ ID NO: 2050522 - RNA, 15 nt, Homo sapiens
cuacaaaaaacaaca

SEQ ID NO: 2050523 - RNA, 13 nt, Homo sapiens
gcuucaucugugg

SEQ ID NO: 2050524 - RNA, 15 nt, Homo sapiens
auauauaaaccuuaa

SEQ ID NO: 2050525 - RNA, 21 nt, Homo sapiens
aaguaccacauuccaugacgc

SEQ ID NO: 2050526 - RNA, 16 nt, Homo sapiens
uccacuccaaccagaa

SEQ ID NO: 2050527 - RNA, 12 nt, Homo sapiens
cugcaggggugc

SEQ ID NO: 2050528 - RNA, 14 nt, Homo sapiens
cuuguguguaugca

SEQ ID NO: 2050529 - RNA, 12 nt, Homo sapiens
agcccaucucaa

SEQ ID NO: 2050530 - RNA, 23 nt, Homo sapiens
guaaugagggcugaguuugcaca

SEQ ID NO: 2050531 - RNA, 14 nt, Homo sapiens
aaccugaugcaguc

SEQ ID NO: 2050532 - RNA, 15 nt, Homo sapiens
ugcccagagugccgu

SEQ ID NO: 2050533 - RNA, 16 nt, Homo sapiens
cauaugaaaggugcca

SEQ ID NO: 2050534 - RNA, 17 nt, Homo sapiens
gccuagcugcuacaaag

SEQ ID NO: 2050535 - RNA, 22 nt, Homo sapiens
aucacauagaagcuguccuuga

SEQ ID NO: 2050536 - RNA, 15 nt, Homo sapiens
uuaacagaacagaca

SEQ ID NO: 2050537 - RNA, 22 nt, Homo sapiens
auuuuuuuuuuuccaagacaga

SEQ ID NO: 2050538 - RNA, 19 nt, Homo sapiens
cuagauguguucuaagcaa

SEQ ID NO: 2050539 - RNA, 13 nt, Homo sapiens
uuuguuucaauga

SEQ ID NO: 2050540 - RNA, 22 nt, Homo sapiens
caugcaggugaaacccagucac

SEQ ID NO: 2050541 - RNA, 12 nt, Homo sapiens
aaauucuuaacc

SEQ ID NO: 2050542 - RNA, 16 nt, Homo sapiens
ggcaugacacaccugg

SEQ ID NO: 2050543 - RNA, 14 nt, Homo sapiens
cauccagcuacuua

SEQ ID NO: 2050544 - RNA, 15 nt, Homo sapiens
aauuucaacauguau

SEQ ID NO: 2050545 - RNA, 14 nt, Homo sapiens
acugccgcugagaa

SEQ ID NO: 2050546 - RNA, 15 nt, Homo sapiens
gacuuuggcaaguga

SEQ ID NO: 2050547 - RNA, 18 nt, Homo sapiens
uaaaagaaacuaugaugu

SEQ ID NO: 2050548 - RNA, 14 nt, Homo sapiens
guauauacauauua

SEQ ID NO: 2050549 - RNA, 23 nt, Homo sapiens
auaaaagguaacaucuaaagcuu

SEQ ID NO: 2050550 - RNA, 15 nt, Homo sapiens
gcagagaaccugcuc

SEQ ID NO: 2050551 - RNA, 20 nt, Homo sapiens
cgaagaugauuucaguucau

SEQ ID NO: 2050552 - RNA, 20 nt, Homo sapiens
cuccaugaugcaagccagcu

SEQ ID NO: 2050553 - RNA, 18 nt, Homo sapiens
caggaaagagaacuucca

SEQ ID NO: 2050554 - RNA, 22 nt, Homo sapiens
auaugaggcuugacagagucug

SEQ ID NO: 2050555 - RNA, 16 nt, Homo sapiens
agccaaccuugcucuu

SEQ ID NO: 2050556 - RNA, 21 nt, Homo sapiens
uaaccucucugaacugcaaca

SEQ ID NO: 2050557 - RNA, 14 nt, Homo sapiens
ugcguuuacucuug

SEQ ID NO: 2050558 - RNA, 13 nt, Homo sapiens
gccagccaucaca

SEQ ID NO: 2050559 - RNA, 12 nt, Homo sapiens
ugcacauuucau

SEQ ID NO: 2050560 - RNA, 12 nt, Homo sapiens
ucaucauuugca

SEQ ID NO: 2050561 - RNA, 20 nt, Homo sapiens
uggcuugagaugauaagaga

SEQ ID NO: 2050562 - RNA, 20 nt, Homo sapiens
ucucacggcuuguaaaugug

SEQ ID NO: 2050563 - RNA, 17 nt, Homo sapiens
acuuaagauuugcucau

SEQ ID NO: 2050564 - RNA, 22 nt, Homo sapiens
ucaaugagcauguuuagacuuu

SEQ ID NO: 2050565 - RNA, 18 nt, Homo sapiens
ucauauucaagcuucaga

SEQ ID NO: 2050566 - RNA, 17 nt, Homo sapiens
gguuaaagaaaggcaga

SEQ ID NO: 2050567 - RNA, 21 nt, Homo sapiens
acaaacucagauccuugguac

SEQ ID NO: 2050568 - RNA, 21 nt, Homo sapiens
cuguuucuuaagggcacacac

SEQ ID NO: 2050569 - RNA, 16 nt, Homo sapiens
ccacugagcaagcaag

SEQ ID NO: 2050570 - RNA, 14 nt, Homo sapiens
aggcgcuaauuuau

SEQ ID NO: 2050571 - RNA, 22 nt, Homo sapiens
agcggugccccuauacaaaaca

SEQ ID NO: 2050572 - RNA, 17 nt, Homo sapiens
uaaauacuuauggcuca

SEQ ID NO: 2050573 - RNA, 21 nt, Homo sapiens
uucccugaggaaugaaaaagg

SEQ ID NO: 2050574 - RNA, 14 nt, Homo sapiens
uggccacagacuga

SEQ ID NO: 2050575 - RNA, 19 nt, Homo sapiens
gaggacagagcuggugaua

SEQ ID NO: 2050576 - RNA, 14 nt, Homo sapiens
uuauagagcacaau

SEQ ID NO: 2050577 - RNA, 22 nt, Homo sapiens
cagauguggacaugcacccgca

SEQ ID NO: 2050578 - RNA, 12 nt, Homo sapiens
uauuaccaaaaa

SEQ ID NO: 2050579 - RNA, 18 nt, Homo sapiens
ugcuccgugugucucaug

SEQ ID NO: 2050580 - RNA, 12 nt, Homo sapiens
aacugacauuug

SEQ ID NO: 2050581 - RNA, 16 nt, Homo sapiens
aguucugacacugugu

SEQ ID NO: 2050582 - RNA, 13 nt, Homo sapiens
uucaaaacauucc

SEQ ID NO: 2050583 - RNA, 16 nt, Homo sapiens
ucaagcuaugugagcu

SEQ ID NO: 2050584 - RNA, 16 nt, Homo sapiens
uggaucuaccccagga

SEQ ID NO: 2050585 - RNA, 23 nt, Homo sapiens
gcacagguuagggugugugccac

SEQ ID NO: 2050586 - RNA, 21 nt, Homo sapiens
gcuguggguauucaccacccu

SEQ ID NO: 2050587 - RNA, 15 nt, Homo sapiens
gccacaccucuccaa

SEQ ID NO: 2050588 - RNA, 12 nt, Homo sapiens
gaaucucucuuc

SEQ ID NO: 2050589 - RNA, 14 nt, Homo sapiens
gccgcucuccgccc

SEQ ID NO: 2050590 - RNA, 22 nt, Homo sapiens
uguccagaccauugucuuccaa

SEQ ID NO: 2050591 - RNA, 23 nt, Homo sapiens
uacaaaagcuuguguaucuugau

SEQ ID NO: 2050592 - RNA, 18 nt, Homo sapiens
cacauggaacgcuuucau

SEQ ID NO: 2050593 - RNA, 15 nt, Homo sapiens
gagaaaugauguugu

SEQ ID NO: 2050594 - RNA, 17 nt, Homo sapiens
uggagcaaacagcugua

SEQ ID NO: 2050595 - RNA, 20 nt, Homo sapiens
gcccuuggcaccaccagggu

SEQ ID NO: 2050596 - RNA, 15 nt, Homo sapiens
ccaaggcaguggaaa

SEQ ID NO: 2050597 - RNA, 21 nt, Homo sapiens
gaaauauugcucuaauucuuu

SEQ ID NO: 2050598 - RNA, 23 nt, Homo sapiens
aaaagucaccauucugcauuuag

SEQ ID NO: 2050599 - RNA, 18 nt, Homo sapiens
ccaagcacagugccugca

SEQ ID NO: 2050600 - RNA, 18 nt, Homo sapiens
gugccagcacccaguccu

SEQ ID NO: 2050601 - RNA, 17 nt, Homo sapiens
uuuaauauacuccuuaa

SEQ ID NO: 2050602 - RNA, 23 nt, Homo sapiens
cuuuuaaguugcugaugaacucu

SEQ ID NO: 2050603 - RNA, 18 nt, Homo sapiens
cuuagacucgggugguua

SEQ ID NO: 2050604 - RNA, 11 nt, Homo sapiens
caagaccaaag

SEQ ID NO: 2050605 - RNA, 14 nt, Homo sapiens
ugguuuucuagccc

SEQ ID NO: 2050606 - RNA, 20 nt, Homo sapiens
cccugccuugcugacaauaa

SEQ ID NO: 2050607 - RNA, 18 nt, Homo sapiens
gagaugaaccacauuaua

SEQ ID NO: 2050608 - RNA, 21 nt, Homo sapiens
aaccagacagagggucacagu

SEQ ID NO: 2050609 - RNA, 22 nt, Homo sapiens
agaccuuuuuuuuuuuuccaau

SEQ ID NO: 2050610 - RNA, 21 nt, Homo sapiens
caaacucccgaccucagguga

SEQ ID NO: 2050611 - RNA, 13 nt, Homo sapiens
ucaaaaucugcac

SEQ ID NO: 2050612 - RNA, 13 nt, Homo sapiens
ugaccaucuccca

SEQ ID NO: 2050613 - RNA, 21 nt, Homo sapiens
cuccuuccccuugucccuggg

SEQ ID NO: 2050614 - RNA, 15 nt, Homo sapiens
uugauaagaugguuu

SEQ ID NO: 2050615 - RNA, 16 nt, Homo sapiens
auuggaacugcaauga

SEQ ID NO: 2050616 - RNA, 18 nt, Homo sapiens
acccaaucugcacacucc

SEQ ID NO: 2050617 - RNA, 19 nt, Homo sapiens
cucagaccggcaacaucag

SEQ ID NO: 2050618 - RNA, 22 nt, Homo sapiens
auugccuguuaaauauacacua

SEQ ID NO: 2050619 - RNA, 23 nt, Homo sapiens
ucauuuucuagcccucucccuca

SEQ ID NO: 2050620 - RNA, 21 nt, Homo sapiens
uccgugugauugucuuugaau

SEQ ID NO: 2050621 - RNA, 15 nt, Homo sapiens
gauggaacuggccac

SEQ ID NO: 2050622 - RNA, 19 nt, Homo sapiens
auugucuugguugccagua

SEQ ID NO: 2050623 - RNA, 18 nt, Homo sapiens
cuuccgcuuggagcuauu

SEQ ID NO: 2050624 - RNA, 19 nt, Homo sapiens
cgcccuugucucagucauu

SEQ ID NO: 2050625 - RNA, 13 nt, Homo sapiens
aacaaaauuagaa

SEQ ID NO: 2050626 - RNA, 24 nt, Homo sapiens
gagacuaggauagcuucaucuuga

SEQ ID NO: 2050627 - RNA, 14 nt, Homo sapiens
gaugauaaacacug

SEQ ID NO: 2050628 - RNA, 14 nt, Homo sapiens
uagcucugacuuug

SEQ ID NO: 2050629 - RNA, 14 nt, Homo sapiens
caagaaaacuggaa

SEQ ID NO: 2050630 - RNA, 16 nt, Homo sapiens
uuugggauaacuucaa

SEQ ID NO: 2050631 - RNA, 13 nt, Homo sapiens
ucgauuauauucc

SEQ ID NO: 2050632 - RNA, 21 nt, Homo sapiens
guauuuuucuuuaaccaaaca

SEQ ID NO: 2050633 - RNA, 14 nt, Homo sapiens
cugacuacugccca

SEQ ID NO: 2050634 - RNA, 23 nt, Homo sapiens
uccaccuccaccacaucugccag

SEQ ID NO: 2050635 - RNA, 20 nt, Homo sapiens
ccagccuuggugccaccaaa

SEQ ID NO: 2050636 - RNA, 21 nt, Homo sapiens
cccagaaaaacuggcucugau

SEQ ID NO: 2050637 - RNA, 20 nt, Homo sapiens
agaggaccccauucugggac

SEQ ID NO: 2050638 - RNA, 16 nt, Homo sapiens
acaguccuguccucug

SEQ ID NO: 2050639 - RNA, 14 nt, Homo sapiens
cagcggggaugcuu

SEQ ID NO: 2050640 - RNA, 12 nt, Homo sapiens
uugucucgcuug

SEQ ID NO: 2050641 - RNA, 16 nt, Homo sapiens
uaugacgcaaagauca

SEQ ID NO: 2050642 - RNA, 22 nt, Homo sapiens
cauagaguagguacuccauaaa

SEQ ID NO: 2050643 - RNA, 20 nt, Homo sapiens
agugggagcugagcuggaag

SEQ ID NO: 2050644 - RNA, 21 nt, Homo sapiens
gagaucacgccacugcacuau

SEQ ID NO: 2050645 - RNA, 21 nt, Homo sapiens
ggcuggggguggacuugggaa

SEQ ID NO: 2050646 - RNA, 15 nt, Homo sapiens
cuuuguauauuacau

SEQ ID NO: 2050647 - RNA, 15 nt, Homo sapiens
cccaguauaccucau

SEQ ID NO: 2050648 - RNA, 18 nt, Homo sapiens
ucccaggcuggagugcag

SEQ ID NO: 2050649 - RNA, 16 nt, Homo sapiens
agugaaauauaugcua

SEQ ID NO: 2050650 - RNA, 21 nt, Homo sapiens
cuugauuuaucacacaaagca

SEQ ID NO: 2050651 - RNA, 20 nt, Homo sapiens
ucuguuaugcaagcacaaau

SEQ ID NO: 2050652 - RNA, 17 nt, Homo sapiens
aauuguaauugcaugac

SEQ ID NO: 2050653 - RNA, 17 nt, Homo sapiens
aaggauuuuaccaaagc

SEQ ID NO: 2050654 - RNA, 12 nt, Homo sapiens
aacgcuugugaa

SEQ ID NO: 2050655 - RNA, 16 nt, Homo sapiens
gcucuccuugcccugg

SEQ ID NO: 2050656 - RNA, 18 nt, Homo sapiens
auucuacuucugucuucc

SEQ ID NO: 2050657 - RNA, 21 nt, Homo sapiens
cccucccuguauaagacacuu

SEQ ID NO: 2050658 - RNA, 17 nt, Homo sapiens
ccuuacgugauuguuag

SEQ ID NO: 2050659 - RNA, 16 nt, Homo sapiens
ucuacacugccuuugu

SEQ ID NO: 2050660 - RNA, 13 nt, Homo sapiens
gccaaauuuccag

SEQ ID NO: 2050661 - RNA, 13 nt, Homo sapiens
uuuagauuguuaa

SEQ ID NO: 2050662 - RNA, 22 nt, Homo sapiens
cccuggauuccucgaaacugcc

SEQ ID NO: 2050663 - RNA, 11 nt, Homo sapiens
guucauauaau

SEQ ID NO: 2050664 - RNA, 16 nt, Homo sapiens
agcauggacucugggu

SEQ ID NO: 2050665 - RNA, 16 nt, Homo sapiens
gaagaugggguuugua

SEQ ID NO: 2050666 - RNA, 12 nt, Homo sapiens
agaaccaaaggg

SEQ ID NO: 2050667 - RNA, 12 nt, Homo sapiens
agggccaaagaa

SEQ ID NO: 2050668 - RNA, 13 nt, Homo sapiens
gaaugucacuggu

SEQ ID NO: 2050669 - RNA, 17 nt, Homo sapiens
uggcagccgugccuuca

SEQ ID NO: 2050670 - RNA, 19 nt, Homo sapiens
cugccuguagcaauggcca

SEQ ID NO: 2050671 - RNA, 16 nt, Homo sapiens
uaaaagugcuacuuga

SEQ ID NO: 2050672 - RNA, 16 nt, Homo sapiens
agucucauucaaauac

SEQ ID NO: 2050673 - RNA, 17 nt, Homo sapiens
caugacuauauauacau

SEQ ID NO: 2050674 - RNA, 21 nt, Homo sapiens
ccaguguaaagaauaaaugaa

SEQ ID NO: 2050675 - RNA, 21 nt, Homo sapiens
caaguucuucaccucuaucca

SEQ ID NO: 2050676 - RNA, 18 nt, Homo sapiens
auuuauugcuguguaaca

SEQ ID NO: 2050677 - RNA, 13 nt, Homo sapiens
ccgggcauggugg

SEQ ID NO: 2050678 - RNA, 22 nt, Homo sapiens
ccggucgggggggacccuccaa

SEQ ID NO: 2050679 - RNA, 22 nt, Homo sapiens
ccucacucuguuuccuggucag

SEQ ID NO: 2050680 - RNA, 17 nt, Homo sapiens
aggagugccacuucaug

SEQ ID NO: 2050681 - RNA, 16 nt, Homo sapiens
gcaguggaacuaagaa

SEQ ID NO: 2050682 - RNA, 15 nt, Homo sapiens
uuauguucaaugaau

SEQ ID NO: 2050683 - RNA, 19 nt, Homo sapiens
caugugguuucuaugcaaa

SEQ ID NO: 2050684 - RNA, 16 nt, Homo sapiens
cuacugcuuacuguug

SEQ ID NO: 2050685 - RNA, 21 nt, Homo sapiens
gcuaaccugcacguugugcac

SEQ ID NO: 2050686 - RNA, 21 nt, Homo sapiens
ucaagccuagcccuucucuca

SEQ ID NO: 2050687 - RNA, 16 nt, Homo sapiens
cuauacuggauacucu

SEQ ID NO: 2050688 - RNA, 18 nt, Homo sapiens
gauagaaaagguccaaaa

SEQ ID NO: 2050689 - RNA, 16 nt, Homo sapiens
gccagugccagggugg

SEQ ID NO: 2050690 - RNA, 15 nt, Homo sapiens
ugcccaaaacuguca

SEQ ID NO: 2050691 - RNA, 20 nt, Homo sapiens
cuccuuugguauuucacuga

SEQ ID NO: 2050692 - RNA, 18 nt, Homo sapiens
gugccauccccaccuuca

SEQ ID NO: 2050693 - RNA, 17 nt, Homo sapiens
gacacugggaggccagu

SEQ ID NO: 2050694 - RNA, 15 nt, Homo sapiens
cauauugucuggaaa

SEQ ID NO: 2050695 - RNA, 23 nt, Homo sapiens
uaccaguuuguccaucuugagau

SEQ ID NO: 2050696 - RNA, 20 nt, Homo sapiens
cacauguccuccaucagggg

SEQ ID NO: 2050697 - RNA, 16 nt, Homo sapiens
ccaagccauagucucu

SEQ ID NO: 2050698 - RNA, 20 nt, Homo sapiens
uucucuaacaagcuauggga

SEQ ID NO: 2050699 - RNA, 18 nt, Homo sapiens
cagugaaaccccgucucu

SEQ ID NO: 2050700 - RNA, 17 nt, Homo sapiens
ugcuuuagguaaaaagc

SEQ ID NO: 2050701 - RNA, 16 nt, Homo sapiens
acuucagcugccugaa

SEQ ID NO: 2050702 - RNA, 21 nt, Homo sapiens
ccuggucccccacgugugaag

SEQ ID NO: 2050703 - RNA, 18 nt, Homo sapiens
uuguaccucuaaguacau

SEQ ID NO: 2050704 - RNA, 23 nt, Homo sapiens
ggucuguuuugguccccucccuc

SEQ ID NO: 2050705 - RNA, 18 nt, Homo sapiens
uuuaagacagucuuuggg

SEQ ID NO: 2050706 - RNA, 23 nt, Homo sapiens
ugcuccaguguaucucaaaagac

SEQ ID NO: 2050707 - RNA, 18 nt, Homo sapiens
gccuauagucccacuacu

SEQ ID NO: 2050708 - RNA, 18 nt, Homo sapiens
guaggaaucugccuucca

SEQ ID NO: 2050709 - RNA, 21 nt, Homo sapiens
cugaaaagauguugugucuug

SEQ ID NO: 2050710 - RNA, 13 nt, Homo sapiens
cugggaacacagc

SEQ ID NO: 2050711 - RNA, 18 nt, Homo sapiens
aaagauuuuuggcacuuu

SEQ ID NO: 2050712 - RNA, 15 nt, Homo sapiens
ucuaaaaacauuugu

SEQ ID NO: 2050713 - RNA, 13 nt, Homo sapiens
guaacugccuaga

SEQ ID NO: 2050714 - RNA, 14 nt, Homo sapiens
uuggguugaucucu

SEQ ID NO: 2050715 - RNA, 14 nt, Homo sapiens
acuucuuccaggga

SEQ ID NO: 2050716 - RNA, 19 nt, Homo sapiens
aggcgccuggcacauuuca

SEQ ID NO: 2050717 - RNA, 20 nt, Homo sapiens
uuccccaacagggcaacugu

SEQ ID NO: 2050718 - RNA, 20 nt, Homo sapiens
acauccaaaagcaaccacaa

SEQ ID NO: 2050719 - RNA, 17 nt, Homo sapiens
cucauacuuaagcaaaa

SEQ ID NO: 2050720 - RNA, 15 nt, Homo sapiens
agacucuggagccaa

SEQ ID NO: 2050721 - RNA, 22 nt, Homo sapiens
cuuugugggcccagcuacaagg

SEQ ID NO: 2050722 - RNA, 21 nt, Homo sapiens
caauugugcuuuguaucaguc

SEQ ID NO: 2050723 - RNA, 21 nt, Homo sapiens
uauuugggagggaaaagggaa

SEQ ID NO: 2050724 - RNA, 19 nt, Homo sapiens
uacacagaaacacugccuu

SEQ ID NO: 2050725 - RNA, 20 nt, Homo sapiens
gacucuaacaguaguugcaa

SEQ ID NO: 2050726 - RNA, 21 nt, Homo sapiens
cauuguucuugugaacccaaa

SEQ ID NO: 2050727 - RNA, 13 nt, Homo sapiens
guggagguugcag

SEQ ID NO: 2050728 - RNA, 19 nt, Homo sapiens
agguccugagagcugcuuu

SEQ ID NO: 2050729 - RNA, 14 nt, Homo sapiens
aggcuggggccagu

SEQ ID NO: 2050730 - RNA, 18 nt, Homo sapiens
ugggacaugguaccuaag

SEQ ID NO: 2050731 - RNA, 16 nt, Homo sapiens
aaguguguaugugcau

SEQ ID NO: 2050732 - RNA, 18 nt, Homo sapiens
cauuugagaaaugcauau

SEQ ID NO: 2050733 - RNA, 21 nt, Homo sapiens
cacagagagguaaaauggagg

SEQ ID NO: 2050734 - RNA, 21 nt, Homo sapiens
uucaaaaauacucacauggcu

SEQ ID NO: 2050735 - RNA, 19 nt, Homo sapiens
uaagaggugaucucuggga

SEQ ID NO: 2050736 - RNA, 14 nt, Homo sapiens
ucuuucuuguuuca

SEQ ID NO: 2050737 - RNA, 21 nt, Homo sapiens
ugagcuuggaaaggaccagua

SEQ ID NO: 2050738 - RNA, 17 nt, Homo sapiens
ugggagucacacagugu

SEQ ID NO: 2050739 - RNA, 18 nt, Homo sapiens
agcucugcggcuugccac

SEQ ID NO: 2050740 - RNA, 23 nt, Homo sapiens
uuuuucguguggaucuugccaca

SEQ ID NO: 2050741 - RNA, 20 nt, Homo sapiens
gccugccgguaaacacgccu

SEQ ID NO: 2050742 - RNA, 17 nt, Homo sapiens
guucucauuccuguucu

SEQ ID NO: 2050743 - RNA, 12 nt, Homo sapiens
gaggaugaccag

SEQ ID NO: 2050744 - RNA, 14 nt, Homo sapiens
auuacucaguuuau

SEQ ID NO: 2050745 - RNA, 16 nt, Homo sapiens
gugagucuugguucua

SEQ ID NO: 2050746 - RNA, 16 nt, Homo sapiens
aagguguguccuugaa

SEQ ID NO: 2050747 - RNA, 22 nt, Homo sapiens
gcauuuuuuaaaagcauggcua

SEQ ID NO: 2050748 - RNA, 14 nt, Homo sapiens
caggcgcaugugcc

SEQ ID NO: 2050749 - RNA, 16 nt, Homo sapiens
cauuaacaagaucauu

SEQ ID NO: 2050750 - RNA, 14 nt, Homo sapiens
uaaauacaguggau

SEQ ID NO: 2050751 - RNA, 20 nt, Homo sapiens
uguccagaggcugcaaggau

SEQ ID NO: 2050752 - RNA, 21 nt, Homo sapiens
agcuuuucuccucaugagcug

SEQ ID NO: 2050753 - RNA, 16 nt, Homo sapiens
uacuagcaggaauauu

SEQ ID NO: 2050754 - RNA, 13 nt, Homo sapiens
caagguugcacag

SEQ ID NO: 2050755 - RNA, 17 nt, Homo sapiens
cucuuuuucuccagggu

SEQ ID NO: 2050756 - RNA, 20 nt, Homo sapiens
uguuuuaacguucugcugcu

SEQ ID NO: 2050757 - RNA, 20 nt, Homo sapiens
uagagaucuaugggcauuug

SEQ ID NO: 2050758 - RNA, 12 nt, Homo sapiens
gaacucuuggcc

SEQ ID NO: 2050759 - RNA, 13 nt, Homo sapiens
ccuaagaauuccc

SEQ ID NO: 2050760 - RNA, 21 nt, Homo sapiens
ccugucaaacauuaguacuuu

SEQ ID NO: 2050761 - RNA, 19 nt, Homo sapiens
ucacgccauugcacuccag

SEQ ID NO: 2050762 - RNA, 12 nt, Homo sapiens
cuuuaagaaugu

SEQ ID NO: 2050763 - RNA, 21 nt, Homo sapiens
caauagugaaaugccacaccu

SEQ ID NO: 2050764 - RNA, 23 nt, Homo sapiens
acagaugguguccugcauguaug

SEQ ID NO: 2050765 - RNA, 15 nt, Homo sapiens
cagucucauugucac

SEQ ID NO: 2050766 - RNA, 18 nt, Homo sapiens
acuuuucaguucaguggc

SEQ ID NO: 2050767 - RNA, 21 nt, Homo sapiens
guauuucauugcugugucaca

SEQ ID NO: 2050768 - RNA, 19 nt, Homo sapiens
cuauaauggguccccaaaa

SEQ ID NO: 2050769 - RNA, 18 nt, Homo sapiens
cuguaccugugcacguug

SEQ ID NO: 2050770 - RNA, 19 nt, Homo sapiens
auugcaaccuaguacuuua

SEQ ID NO: 2050771 - RNA, 23 nt, Homo sapiens
ugccucgggaaccucacucuugc

SEQ ID NO: 2050772 - RNA, 15 nt, Homo sapiens
gaucaacaauaccuu

SEQ ID NO: 2050773 - RNA, 15 nt, Homo sapiens
cuuaaguauugucac

SEQ ID NO: 2050774 - RNA, 13 nt, Homo sapiens
ccaaacacaggca

SEQ ID NO: 2050775 - RNA, 20 nt, Homo sapiens
ggcacagcauggagucacag

SEQ ID NO: 2050776 - RNA, 21 nt, Homo sapiens
acagcaaaaccauugcuucac

SEQ ID NO: 2050777 - RNA, 20 nt, Homo sapiens
gcuuccucccagacuugccu

SEQ ID NO: 2050778 - RNA, 21 nt, Homo sapiens
auuucaaaugcaguccaguga

SEQ ID NO: 2050779 - RNA, 22 nt, Homo sapiens
ucagucauuucuucauguacag

SEQ ID NO: 2050780 - RNA, 16 nt, Homo sapiens
ugcuucagugcugcuc

SEQ ID NO: 2050781 - RNA, 19 nt, Homo sapiens
guauaaacauaaguugcau

SEQ ID NO: 2050782 - RNA, 21 nt, Homo sapiens
cuguagccuaaacuccaaaca

SEQ ID NO: 2050783 - RNA, 22 nt, Homo sapiens
cuguuuucucuuuguacugcuu

SEQ ID NO: 2050784 - RNA, 18 nt, Homo sapiens
ugauguaaaaaauacaaa

SEQ ID NO: 2050785 - RNA, 21 nt, Homo sapiens
cuaacaagucaccaaaagaca

SEQ ID NO: 2050786 - RNA, 18 nt, Homo sapiens
ucacucuguaguuacugu

SEQ ID NO: 2050787 - RNA, 18 nt, Homo sapiens
aagaguaaaaccaaaggu

SEQ ID NO: 2050788 - RNA, 16 nt, Homo sapiens
ccucaaucucccaucu

SEQ ID NO: 2050789 - RNA, 21 nt, Homo sapiens
cagcauuggccuggccagacc

SEQ ID NO: 2050790 - RNA, 14 nt, Homo sapiens
auucauccaacaga

SEQ ID NO: 2050791 - RNA, 23 nt, Homo sapiens
guggacccugucuucugggcaca

SEQ ID NO: 2050792 - RNA, 14 nt, Homo sapiens
aaauaccacaguug

SEQ ID NO: 2050793 - RNA, 14 nt, Homo sapiens
uacauaacugauaa

SEQ ID NO: 2050794 - RNA, 18 nt, Homo sapiens
ccucacuugauucaucuc

SEQ ID NO: 2050795 - RNA, 13 nt, Homo sapiens
ugguccacugugu

SEQ ID NO: 2050796 - RNA, 15 nt, Homo sapiens
uugaacucuguaaaa

SEQ ID NO: 2050797 - RNA, 14 nt, Homo sapiens
uuaguacacacuug

SEQ ID NO: 2050798 - RNA, 14 nt, Homo sapiens
aaagauguauuuau

SEQ ID NO: 2050799 - RNA, 14 nt, Homo sapiens
aaagaaguauuuaa

SEQ ID NO: 2050800 - RNA, 13 nt, Homo sapiens
ggaacuccugacu

SEQ ID NO: 2050801 - RNA, 21 nt, Homo sapiens
gcucuauauaugaagugaaaa

SEQ ID NO: 2050802 - RNA, 16 nt, Homo sapiens
aucauauucucauggc

SEQ ID NO: 2050803 - RNA, 22 nt, Homo sapiens
uugauaaaauaaaaaucauucu

SEQ ID NO: 2050804 - RNA, 17 nt, Homo sapiens
caaaguacuguaagaau

SEQ ID NO: 2050805 - RNA, 20 nt, Homo sapiens
agcucccagcugaccagaca

SEQ ID NO: 2050806 - RNA, 15 nt, Homo sapiens
acaucuaugauauaa

SEQ ID NO: 2050807 - RNA, 13 nt, Homo sapiens
ucauugcacuuuc

SEQ ID NO: 2050808 - RNA, 19 nt, Homo sapiens
cacuuccuuguaaaaucua

SEQ ID NO: 2050809 - RNA, 15 nt, Homo sapiens
acuacauuuucacaa

SEQ ID NO: 2050810 - RNA, 16 nt, Homo sapiens
ugcuuuggcugagggg

SEQ ID NO: 2050811 - RNA, 16 nt, Homo sapiens
agcagguccugcggaa

SEQ ID NO: 2050812 - RNA, 22 nt, Homo sapiens
guaaagguuuuuggaauuaugu

SEQ ID NO: 2050813 - RNA, 13 nt, Homo sapiens
guguauguauaca

SEQ ID NO: 2050814 - RNA, 17 nt, Homo sapiens
cagcccagugucccuga

SEQ ID NO: 2050815 - RNA, 19 nt, Homo sapiens
ucacauccaucccuccauu

SEQ ID NO: 2050816 - RNA, 13 nt, Homo sapiens
cacuucacuccag

SEQ ID NO: 2050817 - RNA, 14 nt, Homo sapiens
auuucuacugucaa

SEQ ID NO: 2050818 - RNA, 22 nt, Homo sapiens
ggcucccucgcccuaagaggcu

SEQ ID NO: 2050819 - RNA, 16 nt, Homo sapiens
uagugcaccaucucac

SEQ ID NO: 2050820 - RNA, 21 nt, Homo sapiens
cuuguacauaaugcgugcaua

SEQ ID NO: 2050821 - RNA, 23 nt, Homo sapiens
cuguuuguuuggcuguccagcga

SEQ ID NO: 2050822 - RNA, 13 nt, Homo sapiens
ucagaccacaagg

SEQ ID NO: 2050823 - RNA, 19 nt, Homo sapiens
aacacuuggugcugggaac

SEQ ID NO: 2050824 - RNA, 17 nt, Homo sapiens
agcuccucaaagccuca

SEQ ID NO: 2050825 - RNA, 14 nt, Homo sapiens
ugauauagaaguau

SEQ ID NO: 2050826 - RNA, 14 nt, Homo sapiens
uuguaaaagcauuu

SEQ ID NO: 2050827 - RNA, 19 nt, Homo sapiens
cagggagugcacauaucca

SEQ ID NO: 2050828 - RNA, 23 nt, Homo sapiens
agggcuccuguacccauucuguu

SEQ ID NO: 2050829 - RNA, 14 nt, Homo sapiens
gauuuuccuuugua

SEQ ID NO: 2050830 - RNA, 23 nt, Homo sapiens
gacagaaagcaguucugaugcuu

SEQ ID NO: 2050831 - RNA, 17 nt, Homo sapiens
cagcgggcacagggcac

SEQ ID NO: 2050832 - RNA, 20 nt, Homo sapiens
cuaaagcagaggcaacacug

SEQ ID NO: 2050833 - RNA, 23 nt, Homo sapiens
aggcauacaaggggguaacucau

SEQ ID NO: 2050834 - RNA, 15 nt, Homo sapiens
gaagauuacccucaa

SEQ ID NO: 2050835 - RNA, 17 nt, Homo sapiens
uacccucaucaaaaaca

SEQ ID NO: 2050836 - RNA, 21 nt, Homo sapiens
uguugacuuuuuaaaauauaa

SEQ ID NO: 2050837 - RNA, 13 nt, Homo sapiens
auauuccuaugcu

SEQ ID NO: 2050838 - RNA, 20 nt, Homo sapiens
agcagguucccaagcucaga

SEQ ID NO: 2050839 - RNA, 14 nt, Homo sapiens
uuuauuaacuauuu

SEQ ID NO: 2050840 - RNA, 17 nt, Homo sapiens
gccaggauccucuccuu

SEQ ID NO: 2050841 - RNA, 16 nt, Homo sapiens
cuuacuuccagcaaaa

SEQ ID NO: 2050842 - RNA, 13 nt, Homo sapiens
ugcaacaacaugu

SEQ ID NO: 2050843 - RNA, 11 nt, Homo sapiens
ugaaggugcug

SEQ ID NO: 2050844 - RNA, 19 nt, Homo sapiens
ucucacccauuaucuggaa

SEQ ID NO: 2050845 - RNA, 18 nt, Homo sapiens
agcaccaggaaguguuua

SEQ ID NO: 2050846 - RNA, 13 nt, Homo sapiens
gagcugagugcug

SEQ ID NO: 2050847 - RNA, 17 nt, Homo sapiens
uuaauuuuauugcaaag

SEQ ID NO: 2050848 - RNA, 13 nt, Homo sapiens
uagcauggcauau

SEQ ID NO: 2050849 - RNA, 16 nt, Homo sapiens
auuaugaucuaauaaa

SEQ ID NO: 2050850 - RNA, 16 nt, Homo sapiens
uuagucugucacucca

SEQ ID NO: 2050851 - RNA, 13 nt, Homo sapiens
accgagcaauuuu

SEQ ID NO: 2050852 - RNA, 13 nt, Homo sapiens
uccuagcauuugu

SEQ ID NO: 2050853 - RNA, 23 nt, Homo sapiens
ucugugacauacauauuaucuca

SEQ ID NO: 2050854 - RNA, 17 nt, Homo sapiens
ggcacccuuagccacuu

SEQ ID NO: 2050855 - RNA, 22 nt, Homo sapiens
gucugccugguucccuccccaa

SEQ ID NO: 2050856 - RNA, 13 nt, Homo sapiens
ugucauauggaau

SEQ ID NO: 2050857 - RNA, 21 nt, Homo sapiens
cugcauuuucugaaacuaaug

SEQ ID NO: 2050858 - RNA, 15 nt, Homo sapiens
cuuucugauacuuau

SEQ ID NO: 2050859 - RNA, 21 nt, Homo sapiens
gaugguucuagcauggcauau

SEQ ID NO: 2050860 - RNA, 16 nt, Homo sapiens
cacugaugcuguucuc

SEQ ID NO: 2050861 - RNA, 21 nt, Homo sapiens
gaaaaagcaggacugugccuc

SEQ ID NO: 2050862 - RNA, 12 nt, Homo sapiens
ugguuacauuua

SEQ ID NO: 2050863 - RNA, 19 nt, Homo sapiens
aauugauauugaaugaugu

SEQ ID NO: 2050864 - RNA, 16 nt, Homo sapiens
aguaacaaugcaugcu

SEQ ID NO: 2050865 - RNA, 21 nt, Homo sapiens
uaagagccauauaaguuugaa

SEQ ID NO: 2050866 - RNA, 18 nt, Homo sapiens
gguccugaguggcugaaa

SEQ ID NO: 2050867 - RNA, 18 nt, Homo sapiens
auuauguggcccucugga

SEQ ID NO: 2050868 - RNA, 12 nt, Homo sapiens
guaaugagcucc

SEQ ID NO: 2050869 - RNA, 15 nt, Homo sapiens
uacggcaagaaggca

SEQ ID NO: 2050870 - RNA, 17 nt, Homo sapiens
cgagaucacgccacugc

SEQ ID NO: 2050871 - RNA, 14 nt, Homo sapiens
ucaggccucugagg

SEQ ID NO: 2050872 - RNA, 18 nt, Homo sapiens
uaugucuaaaauccugcu

SEQ ID NO: 2050873 - RNA, 14 nt, Homo sapiens
aagugcucacguua

SEQ ID NO: 2050874 - RNA, 19 nt, Homo sapiens
gcugugaggccccuggaca

SEQ ID NO: 2050875 - RNA, 17 nt, Homo sapiens
gaacaguaugaauuuga

SEQ ID NO: 2050876 - RNA, 17 nt, Homo sapiens
ugaccaaacagccaaga

SEQ ID NO: 2050877 - RNA, 22 nt, Homo sapiens
caauuuugucuuaaguguuucu

SEQ ID NO: 2050878 - RNA, 17 nt, Homo sapiens
accagaaucagauucag

SEQ ID NO: 2050879 - RNA, 16 nt, Homo sapiens
acaacagccugagaaa

SEQ ID NO: 2050880 - RNA, 15 nt, Homo sapiens
uaauuuucaagcaaa

SEQ ID NO: 2050881 - RNA, 18 nt, Homo sapiens
agucuagaagcagcagcu

SEQ ID NO: 2050882 - RNA, 12 nt, Homo sapiens
gcaaaaauauca

SEQ ID NO: 2050883 - RNA, 17 nt, Homo sapiens
caccccuacacugugaa

SEQ ID NO: 2050884 - RNA, 18 nt, Homo sapiens
guaaauacuguaaaugca

SEQ ID NO: 2050885 - RNA, 15 nt, Homo sapiens
cuggggaaaggggac

SEQ ID NO: 2050886 - RNA, 22 nt, Homo sapiens
agauaagggugucuuccuagaa

SEQ ID NO: 2050887 - RNA, 17 nt, Homo sapiens
auagaaguagcaaaaag

SEQ ID NO: 2050888 - RNA, 18 nt, Homo sapiens
guaacuggaacacacuug

SEQ ID NO: 2050889 - RNA, 16 nt, Homo sapiens
cugagacagugaauuu

SEQ ID NO: 2050890 - RNA, 20 nt, Homo sapiens
caucuugcugcuaauccuga

SEQ ID NO: 2050891 - RNA, 13 nt, Homo sapiens
ccauaauguuaca

SEQ ID NO: 2050892 - RNA, 14 nt, Homo sapiens
gggucggagucugu

SEQ ID NO: 2050893 - RNA, 24 nt, Homo sapiens
gcuauggaaugguuaugaagggaa

SEQ ID NO: 2050894 - RNA, 15 nt, Homo sapiens
auuucucacacucua

SEQ ID NO: 2050895 - RNA, 21 nt, Homo sapiens
auaaauugggauaaacaucac

SEQ ID NO: 2050896 - RNA, 15 nt, Homo sapiens
cggauuccuuuauga

SEQ ID NO: 2050897 - RNA, 19 nt, Homo sapiens
uucagauauauuuuucaca

SEQ ID NO: 2050898 - RNA, 13 nt, Homo sapiens
ugaaaaauacauc

SEQ ID NO: 2050899 - RNA, 21 nt, Homo sapiens
aaaaauuucaaccagcauuca

SEQ ID NO: 2050900 - RNA, 17 nt, Homo sapiens
cuauauacuauaugauu

SEQ ID NO: 2050901 - RNA, 21 nt, Homo sapiens
uguaacugacugccuugcuaa

SEQ ID NO: 2050902 - RNA, 20 nt, Homo sapiens
gcuugucuuaaaauaaugaa

SEQ ID NO: 2050903 - RNA, 21 nt, Homo sapiens
gcuggcuggggccuaucagug

SEQ ID NO: 2050904 - RNA, 18 nt, Homo sapiens
aaccugccaugccaggaa

SEQ ID NO: 2050905 - RNA, 21 nt, Homo sapiens
acaaucuuuccuugucucuca

SEQ ID NO: 2050906 - RNA, 15 nt, Homo sapiens
uacacaaguguuuca

SEQ ID NO: 2050907 - RNA, 20 nt, Homo sapiens
auccaacaugugcucaggga

SEQ ID NO: 2050908 - RNA, 18 nt, Homo sapiens
ugaaguugcaaugcuuca

SEQ ID NO: 2050909 - RNA, 17 nt, Homo sapiens
uucugucacucaccacu

SEQ ID NO: 2050910 - RNA, 15 nt, Homo sapiens
acucacacauucccc

SEQ ID NO: 2050911 - RNA, 16 nt, Homo sapiens
ccauuaccuccaucca

SEQ ID NO: 2050912 - RNA, 23 nt, Homo sapiens
aaauccacuagcaccgaccccac

SEQ ID NO: 2050913 - RNA, 17 nt, Homo sapiens
aaaggaauacauugcaa

SEQ ID NO: 2050914 - RNA, 17 nt, Homo sapiens
gagaggaagcucucuuu

SEQ ID NO: 2050915 - RNA, 17 nt, Homo sapiens
ggaugacaugugccauu

SEQ ID NO: 2050916 - RNA, 21 nt, Homo sapiens
guaauaaguaucacacuguau

SEQ ID NO: 2050917 - RNA, 19 nt, Homo sapiens
ccauauuuaauaaagcaca

SEQ ID NO: 2050918 - RNA, 14 nt, Homo sapiens
aaaguauggcagug

SEQ ID NO: 2050919 - RNA, 19 nt, Homo sapiens
gucaggacuugaacccagg

SEQ ID NO: 2050920 - RNA, 23 nt, Homo sapiens
acacucaccugcacuaacagagu

SEQ ID NO: 2050921 - RNA, 20 nt, Homo sapiens
agacguggugggacuccagc

SEQ ID NO: 2050922 - RNA, 13 nt, Homo sapiens
caucuauucaagc

SEQ ID NO: 2050923 - RNA, 18 nt, Homo sapiens
cauccugucaccaugacu

SEQ ID NO: 2050924 - RNA, 14 nt, Homo sapiens
ccucgcggucuugg

SEQ ID NO: 2050925 - RNA, 17 nt, Homo sapiens
aggaagcuuucugucuc

SEQ ID NO: 2050926 - RNA, 12 nt, Homo sapiens
ccaaaguguccu

SEQ ID NO: 2050927 - RNA, 14 nt, Homo sapiens
uaccaaauggcacu

SEQ ID NO: 2050928 - RNA, 18 nt, Homo sapiens
gaagaaaagcugccauuu

SEQ ID NO: 2050929 - RNA, 16 nt, Homo sapiens
uaaaccagaggacaaa

SEQ ID NO: 2050930 - RNA, 22 nt, Homo sapiens
gucuucacauuuagaauuugaa

SEQ ID NO: 2050931 - RNA, 16 nt, Homo sapiens
uacucuuaugaucaau

SEQ ID NO: 2050932 - RNA, 20 nt, Homo sapiens
gacugagaaccgugacauca

SEQ ID NO: 2050933 - RNA, 16 nt, Homo sapiens
uucacagauaacauaa

SEQ ID NO: 2050934 - RNA, 19 nt, Homo sapiens
cccugcucacucuuccaca

SEQ ID NO: 2050935 - RNA, 15 nt, Homo sapiens
gaaagucccagauca

SEQ ID NO: 2050936 - RNA, 22 nt, Homo sapiens
caacuugaaauuauaucugugg

SEQ ID NO: 2050937 - RNA, 12 nt, Homo sapiens
agaaguuacuaa

SEQ ID NO: 2050938 - RNA, 18 nt, Homo sapiens
cuaacuccugccuaugac

SEQ ID NO: 2050939 - RNA, 22 nt, Homo sapiens
uugaaccucauuaaauggugau

SEQ ID NO: 2050940 - RNA, 16 nt, Homo sapiens
ugcucuucaucccauu

SEQ ID NO: 2050941 - RNA, 16 nt, Homo sapiens
auaaguuaucuuguuu

SEQ ID NO: 2050942 - RNA, 12 nt, Homo sapiens
uaggaacauacu

SEQ ID NO: 2050943 - RNA, 19 nt, Homo sapiens
uuaucuaagguccccagca

SEQ ID NO: 2050944 - RNA, 11 nt, Homo sapiens
acugaccagca

SEQ ID NO: 2050945 - RNA, 15 nt, Homo sapiens
cuauucaugucucua

SEQ ID NO: 2050946 - RNA, 21 nt, Homo sapiens
ccgcaccgggcccuccuugcc

SEQ ID NO: 2050947 - RNA, 12 nt, Homo sapiens
uccaaauccauc

SEQ ID NO: 2050948 - RNA, 19 nt, Homo sapiens
ugaaauggagaacaguuuc

SEQ ID NO: 2050949 - RNA, 18 nt, Homo sapiens
ggccacuggccaucucca

SEQ ID NO: 2050950 - RNA, 22 nt, Homo sapiens
ucauuaagcccucuuccaucau

SEQ ID NO: 2050951 - RNA, 18 nt, Homo sapiens
cuccuauuccuucacaca

SEQ ID NO: 2050952 - RNA, 19 nt, Homo sapiens
uauagaaugaucuauugcu

SEQ ID NO: 2050953 - RNA, 21 nt, Homo sapiens
ggugcaguuuuccaggaauag

SEQ ID NO: 2050954 - RNA, 21 nt, Homo sapiens
gagugccuucauacacuguac

SEQ ID NO: 2050955 - RNA, 22 nt, Homo sapiens
ucagguagaagguugacacagu

SEQ ID NO: 2050956 - RNA, 12 nt, Homo sapiens
cauguccucaaa

SEQ ID NO: 2050957 - RNA, 17 nt, Homo sapiens
gccuugcacauaggaaa

SEQ ID NO: 2050958 - RNA, 21 nt, Homo sapiens
guggagaagggaggguggcca

SEQ ID NO: 2050959 - RNA, 18 nt, Homo sapiens
cuagcgccucuccccggg

SEQ ID NO: 2050960 - RNA, 14 nt, Homo sapiens
aguucuacugaccu

SEQ ID NO: 2050961 - RNA, 16 nt, Homo sapiens
accaccuguguagucu

SEQ ID NO: 2050962 - RNA, 12 nt, Homo sapiens
gcuuaaugccag

SEQ ID NO: 2050963 - RNA, 14 nt, Homo sapiens
uguauaugcugcau

SEQ ID NO: 2050964 - RNA, 20 nt, Homo sapiens
acagugaaacuccaucucaa

SEQ ID NO: 2050965 - RNA, 18 nt, Homo sapiens
agauauucagaaguauau

SEQ ID NO: 2050966 - RNA, 16 nt, Homo sapiens
cuguucuuggaucugc

SEQ ID NO: 2050967 - RNA, 22 nt, Homo sapiens
cagaauauccaaauaagccuug

SEQ ID NO: 2050968 - RNA, 16 nt, Homo sapiens
aauucaaagcauguca

SEQ ID NO: 2050969 - RNA, 13 nt, Homo sapiens
uuacucuugagaa

SEQ ID NO: 2050970 - RNA, 22 nt, Homo sapiens
gaagcugcugaccaauugugcu

SEQ ID NO: 2050971 - RNA, 20 nt, Homo sapiens
cuaauuguccacagcaaagg

SEQ ID NO: 2050972 - RNA, 17 nt, Homo sapiens
gcaagaauauugucccu

SEQ ID NO: 2050973 - RNA, 14 nt, Homo sapiens
cuguacccuauguu

SEQ ID NO: 2050974 - RNA, 16 nt, Homo sapiens
gacaguuuuuauuuga

SEQ ID NO: 2050975 - RNA, 13 nt, Homo sapiens
acagcagugcaua

SEQ ID NO: 2050976 - RNA, 23 nt, Homo sapiens
aggaaauccauucacaguucuuu

SEQ ID NO: 2050977 - RNA, 19 nt, Homo sapiens
aacuuuuuccagcaaaaug

SEQ ID NO: 2050978 - RNA, 21 nt, Homo sapiens
uaugauaugugcuugugugua

SEQ ID NO: 2050979 - RNA, 13 nt, Homo sapiens
auguaugcauuca

SEQ ID NO: 2050980 - RNA, 23 nt, Homo sapiens
gccucagccucccaaagugcugg

SEQ ID NO: 2050981 - RNA, 15 nt, Homo sapiens
uagaauuaagucaga

SEQ ID NO: 2050982 - RNA, 15 nt, Homo sapiens
acuuuucacaguaug

SEQ ID NO: 2050983 - RNA, 22 nt, Homo sapiens
ucuaguccacuuuucuuuacau

SEQ ID NO: 2050984 - RNA, 20 nt, Homo sapiens
cccugcauggcugagagggu

SEQ ID NO: 2050985 - RNA, 21 nt, Homo sapiens
auuguucuuuuuuaagacuca

SEQ ID NO: 2050986 - RNA, 16 nt, Homo sapiens
agcaggaggugccuga

SEQ ID NO: 2050987 - RNA, 17 nt, Homo sapiens
ugaaacagccaugucca

SEQ ID NO: 2050988 - RNA, 23 nt, Homo sapiens
gagaagaagaaaaucaaccagca

SEQ ID NO: 2050989 - RNA, 16 nt, Homo sapiens
augaagacagaggcag

SEQ ID NO: 2050990 - RNA, 16 nt, Homo sapiens
aagcuucacauuugcg

SEQ ID NO: 2050991 - RNA, 19 nt, Homo sapiens
uaaaaaugucuuauugucc

SEQ ID NO: 2050992 - RNA, 22 nt, Homo sapiens
caucuaaccucaucuucuucac

SEQ ID NO: 2050993 - RNA, 19 nt, Homo sapiens
cauuccuuagauaccuuga

SEQ ID NO: 2050994 - RNA, 19 nt, Homo sapiens
caugaaucacugcaccucu

SEQ ID NO: 2050995 - RNA, 14 nt, Homo sapiens
guguccugccuuga

SEQ ID NO: 2050996 - RNA, 23 nt, Homo sapiens
gcuuuagacacuggcugccagcu

SEQ ID NO: 2050997 - RNA, 18 nt, Homo sapiens
acuggaggggucauccuu

SEQ ID NO: 2050998 - RNA, 22 nt, Homo sapiens
uuaaauguuauauacaucucaa

SEQ ID NO: 2050999 - RNA, 19 nt, Homo sapiens
gaugcuaccuugugaccca

SEQ ID NO: 2051000 - RNA, 14 nt, Homo sapiens
gaucuaacuauguu

SEQ ID NO: 2051001 - RNA, 12 nt, Homo sapiens
accccacugcaa

SEQ ID NO: 2051002 - RNA, 21 nt, Homo sapiens
caccguggaccuuccugccac

SEQ ID NO: 2051003 - RNA, 16 nt, Homo sapiens
auggagcugaauuuga

SEQ ID NO: 2051004 - RNA, 22 nt, Homo sapiens
cgggagaucaugucucacuuca

SEQ ID NO: 2051005 - RNA, 18 nt, Homo sapiens
acugaccagccuugacac

SEQ ID NO: 2051006 - RNA, 21 nt, Homo sapiens
gaggcucuguaaccuuaucua

SEQ ID NO: 2051007 - RNA, 20 nt, Homo sapiens
gggacugcuaccucugagaa

SEQ ID NO: 2051008 - RNA, 22 nt, Homo sapiens
acaugcauuacugcaugcacuu

SEQ ID NO: 2051009 - RNA, 13 nt, Homo sapiens
gggaggggguccg

SEQ ID NO: 2051010 - RNA, 21 nt, Homo sapiens
uuuuggaauuaugucugcuga

SEQ ID NO: 2051011 - RNA, 16 nt, Homo sapiens
acggccuaugagauga

SEQ ID NO: 2051012 - RNA, 22 nt, Homo sapiens
ccauggauuucauggugauucc

SEQ ID NO: 2051013 - RNA, 21 nt, Homo sapiens
caaccugcucuccucuugcca

SEQ ID NO: 2051014 - RNA, 17 nt, Homo sapiens
ucccccgccuccaguca

SEQ ID NO: 2051015 - RNA, 18 nt, Homo sapiens
ccacuccccagugcuccu

SEQ ID NO: 2051016 - RNA, 17 nt, Homo sapiens
ugauuuacauguauggu

SEQ ID NO: 2051017 - RNA, 16 nt, Homo sapiens
uaaagcauguuucauu

SEQ ID NO: 2051018 - RNA, 19 nt, Homo sapiens
acugcuguguuugagcucu

SEQ ID NO: 2051019 - RNA, 17 nt, Homo sapiens
uguuuacugagccuuaa

SEQ ID NO: 2051020 - RNA, 13 nt, Homo sapiens
auugccuuuccag

SEQ ID NO: 2051021 - RNA, 14 nt, Homo sapiens
aucaaucuuuaaca

SEQ ID NO: 2051022 - RNA, 23 nt, Homo sapiens
ccuuggugugcuguauccaucca

SEQ ID NO: 2051023 - RNA, 14 nt, Homo sapiens
aggagacauuggua

SEQ ID NO: 2051024 - RNA, 22 nt, Homo sapiens
ggaaacugcucccaucauuccu

SEQ ID NO: 2051025 - RNA, 21 nt, Homo sapiens
acuugguaagaugacucugag

SEQ ID NO: 2051026 - RNA, 19 nt, Homo sapiens
aacaaguucauuauauuca

SEQ ID NO: 2051027 - RNA, 19 nt, Homo sapiens
cuuuuggugguauguuggu

SEQ ID NO: 2051028 - RNA, 20 nt, Homo sapiens
ugucacauagagugaucuuu

SEQ ID NO: 2051029 - RNA, 22 nt, Homo sapiens
agguggaaacuccugugucugu

SEQ ID NO: 2051030 - RNA, 17 nt, Homo sapiens
uuugucaacauugugau

SEQ ID NO: 2051031 - RNA, 15 nt, Homo sapiens
acucuacugcugcug

SEQ ID NO: 2051032 - RNA, 15 nt, Homo sapiens
ggucuugccaugugc

SEQ ID NO: 2051033 - RNA, 15 nt, Homo sapiens
ggacuacauauuugc

SEQ ID NO: 2051034 - RNA, 22 nt, Homo sapiens
cagagcuuuacagugccacgac

SEQ ID NO: 2051035 - RNA, 15 nt, Homo sapiens
cucaagaauaaaaua

SEQ ID NO: 2051036 - RNA, 14 nt, Homo sapiens
ugucuuaaaaccag

SEQ ID NO: 2051037 - RNA, 17 nt, Homo sapiens
gaaguuaucaacaugca

SEQ ID NO: 2051038 - RNA, 23 nt, Homo sapiens
acaggugugagccacugugccca

SEQ ID NO: 2051039 - RNA, 20 nt, Homo sapiens
uucauggaagccaccaguga

SEQ ID NO: 2051040 - RNA, 23 nt, Homo sapiens
agggaaguucaggcucugagaca

SEQ ID NO: 2051041 - RNA, 13 nt, Homo sapiens
agguuaugcacug

SEQ ID NO: 2051042 - RNA, 16 nt, Homo sapiens
acuacuacucaauggc

SEQ ID NO: 2051043 - RNA, 15 nt, Homo sapiens
uuaagaaauuccuag

SEQ ID NO: 2051044 - RNA, 16 nt, Homo sapiens
ugugauugcacgugcc

SEQ ID NO: 2051045 - RNA, 18 nt, Homo sapiens
gauuagcaaggucauuuc

SEQ ID NO: 2051046 - RNA, 20 nt, Homo sapiens
cauggccacacugugacaca

SEQ ID NO: 2051047 - RNA, 18 nt, Homo sapiens
uacacaguaagucauuua

SEQ ID NO: 2051048 - RNA, 17 nt, Homo sapiens
gcccacugaggggccag

SEQ ID NO: 2051049 - RNA, 17 nt, Homo sapiens
gacucuaaauauuucau

SEQ ID NO: 2051050 - RNA, 20 nt, Homo sapiens
auaggcccuggaugugccca

SEQ ID NO: 2051051 - RNA, 11 nt, Homo sapiens
uuguugcucag

SEQ ID NO: 2051052 - RNA, 19 nt, Homo sapiens
agaguagguacuccauaaa

SEQ ID NO: 2051053 - RNA, 20 nt, Homo sapiens
cauccagaggccauguucca

SEQ ID NO: 2051054 - RNA, 14 nt, Homo sapiens
cacuuguacaauua

SEQ ID NO: 2051055 - RNA, 14 nt, Homo sapiens
cacauauacaaaug

SEQ ID NO: 2051056 - RNA, 14 nt, Homo sapiens
aaacagccucacuc

SEQ ID NO: 2051057 - RNA, 16 nt, Homo sapiens
gaguuacagacaaagc

SEQ ID NO: 2051058 - RNA, 18 nt, Homo sapiens
cuccaucuuagauagaug

SEQ ID NO: 2051059 - RNA, 15 nt, Homo sapiens
ugaccaucaugcccu

SEQ ID NO: 2051060 - RNA, 17 nt, Homo sapiens
ucuuggcccucaguuug

SEQ ID NO: 2051061 - RNA, 12 nt, Homo sapiens
aucuuaacucuu

SEQ ID NO: 2051062 - RNA, 21 nt, Homo sapiens
gacagagaggggcagguugac

SEQ ID NO: 2051063 - RNA, 21 nt, Homo sapiens
aaacauugcuuuagacaaauu

SEQ ID NO: 2051064 - RNA, 14 nt, Homo sapiens
gaugacuucaguga

SEQ ID NO: 2051065 - RNA, 21 nt, Homo sapiens
acuauggagucuugugaaagu

SEQ ID NO: 2051066 - RNA, 19 nt, Homo sapiens
augguucucagaaccauuu

SEQ ID NO: 2051067 - RNA, 20 nt, Homo sapiens
accacugaggaaucaugaaa

SEQ ID NO: 2051068 - RNA, 22 nt, Homo sapiens
aaugcccugccuugcugccuuc

SEQ ID NO: 2051069 - RNA, 21 nt, Homo sapiens
uauuacguaugucugguucuc

SEQ ID NO: 2051070 - RNA, 20 nt, Homo sapiens
augccaccaacacugcucac

SEQ ID NO: 2051071 - RNA, 19 nt, Homo sapiens
cccaggagccuaguacaau

SEQ ID NO: 2051072 - RNA, 15 nt, Homo sapiens
caagacacugagaua

SEQ ID NO: 2051073 - RNA, 16 nt, Homo sapiens
cuaaagcuucuauaaa

SEQ ID NO: 2051074 - RNA, 15 nt, Homo sapiens
ggcucugggggaccc

SEQ ID NO: 2051075 - RNA, 19 nt, Homo sapiens
agggacugaccagcagcuu

SEQ ID NO: 2051076 - RNA, 17 nt, Homo sapiens
aucuacuucuacaucca

SEQ ID NO: 2051077 - RNA, 13 nt, Homo sapiens
caagcgagucacg

SEQ ID NO: 2051078 - RNA, 22 nt, Homo sapiens
cuuguuauucgaaccacugaga

SEQ ID NO: 2051079 - RNA, 22 nt, Homo sapiens
ggucaggaacaguggcugggug

SEQ ID NO: 2051080 - RNA, 13 nt, Homo sapiens
gugaagcucuucc

SEQ ID NO: 2051081 - RNA, 15 nt, Homo sapiens
cguucagaggugcag

SEQ ID NO: 2051082 - RNA, 16 nt, Homo sapiens
auuuuaaaauuaggaa

SEQ ID NO: 2051083 - RNA, 22 nt, Homo sapiens
aacuaaucaagaaaaacaucuu

SEQ ID NO: 2051084 - RNA, 21 nt, Homo sapiens
agucacccucuucaagcuuuu

SEQ ID NO: 2051085 - RNA, 23 nt, Homo sapiens
auuucuccagaaauuuaccacaa

SEQ ID NO: 2051086 - RNA, 22 nt, Homo sapiens
uucugauuugaagguauaaccu

SEQ ID NO: 2051087 - RNA, 22 nt, Homo sapiens
caccuaccaucagggacaggau

SEQ ID NO: 2051088 - RNA, 23 nt, Homo sapiens
uucuuaaaaugugcuauuugcaa

SEQ ID NO: 2051089 - RNA, 17 nt, Homo sapiens
aagaagugugugaccua

SEQ ID NO: 2051090 - RNA, 14 nt, Homo sapiens
aggugguccuucca

SEQ ID NO: 2051091 - RNA, 16 nt, Homo sapiens
ucuucuuuuauguaaa

SEQ ID NO: 2051092 - RNA, 18 nt, Homo sapiens
ucccugucauuuuuaaca

SEQ ID NO: 2051093 - RNA, 20 nt, Homo sapiens
aggaccucagcuugcacaaa

SEQ ID NO: 2051094 - RNA, 18 nt, Homo sapiens
aggcagugauuagcacuu

SEQ ID NO: 2051095 - RNA, 12 nt, Homo sapiens
uauuuauacucu

SEQ ID NO: 2051096 - RNA, 16 nt, Homo sapiens
acuugucuucaccaac

SEQ ID NO: 2051097 - RNA, 13 nt, Homo sapiens
guguaaaccaaag

SEQ ID NO: 2051098 - RNA, 16 nt, Homo sapiens
aucacuuuaugucuca

SEQ ID NO: 2051099 - RNA, 18 nt, Homo sapiens
aaaaauguuuuucaaaac

SEQ ID NO: 2051100 - RNA, 17 nt, Homo sapiens
uggucaggcaucuuccc

SEQ ID NO: 2051101 - RNA, 22 nt, Homo sapiens
acaaauaaauaagaucagacuc

SEQ ID NO: 2051102 - RNA, 20 nt, Homo sapiens
cccccaggaggcagcucagg

SEQ ID NO: 2051103 - RNA, 18 nt, Homo sapiens
caaccucgcuccaacucc

SEQ ID NO: 2051104 - RNA, 21 nt, Homo sapiens
gagcuaggggggucagccagc

SEQ ID NO: 2051105 - RNA, 14 nt, Homo sapiens
agagaaacgugaaa

SEQ ID NO: 2051106 - RNA, 12 nt, Homo sapiens
cgcaccacugca

SEQ ID NO: 2051107 - RNA, 16 nt, Homo sapiens
gggccggaaggaaugu

SEQ ID NO: 2051108 - RNA, 13 nt, Homo sapiens
aggugaauagcca

SEQ ID NO: 2051109 - RNA, 15 nt, Homo sapiens
guggcaugcaccugc

SEQ ID NO: 2051110 - RNA, 11 nt, Homo sapiens
cccaguagcca

SEQ ID NO: 2051111 - RNA, 15 nt, Homo sapiens
uggcuuaagcaauaa

SEQ ID NO: 2051112 - RNA, 16 nt, Homo sapiens
uagggcaacaauacau

SEQ ID NO: 2051113 - RNA, 12 nt, Homo sapiens
acucacacuccc

SEQ ID NO: 2051114 - RNA, 17 nt, Homo sapiens
agcaguguucucucuga

SEQ ID NO: 2051115 - RNA, 22 nt, Homo sapiens
agaacagccagguagagcccuu

SEQ ID NO: 2051116 - RNA, 14 nt, Homo sapiens
acauagaacucaga

SEQ ID NO: 2051117 - RNA, 23 nt, Homo sapiens
aguagcagggggggaaaugcauu

SEQ ID NO: 2051118 - RNA, 17 nt, Homo sapiens
ccacgggccacgggaag

SEQ ID NO: 2051119 - RNA, 15 nt, Homo sapiens
augcagcccaugccc

SEQ ID NO: 2051120 - RNA, 18 nt, Homo sapiens
aguaugaaaaugauuuau

SEQ ID NO: 2051121 - RNA, 14 nt, Homo sapiens
ucauuucucuauga

SEQ ID NO: 2051122 - RNA, 23 nt, Homo sapiens
uaacugaguuauauuggaauuau

SEQ ID NO: 2051123 - RNA, 16 nt, Homo sapiens
acgcaugugugcugca

SEQ ID NO: 2051124 - RNA, 20 nt, Homo sapiens
cggggcagucagauuuuuaa

SEQ ID NO: 2051125 - RNA, 17 nt, Homo sapiens
agaugguuucuugcaag

SEQ ID NO: 2051126 - RNA, 18 nt, Homo sapiens
gcgcucugccacuguccg

SEQ ID NO: 2051127 - RNA, 17 nt, Homo sapiens
cguuuuuuucauuccau

SEQ ID NO: 2051128 - RNA, 21 nt, Homo sapiens
ugcuuucagaagugcccuucc

SEQ ID NO: 2051129 - RNA, 15 nt, Homo sapiens
gcccucuguggucac

SEQ ID NO: 2051130 - RNA, 22 nt, Homo sapiens
gggcuucauacacaugagauaa

SEQ ID NO: 2051131 - RNA, 21 nt, Homo sapiens
accagccuugaacuguggcca

SEQ ID NO: 2051132 - RNA, 22 nt, Homo sapiens
uuaacugugaaauaccacaagc

SEQ ID NO: 2051133 - RNA, 13 nt, Homo sapiens
gagggcuggguuu

SEQ ID NO: 2051134 - RNA, 19 nt, Homo sapiens
cagagggggaguagccaag

SEQ ID NO: 2051135 - RNA, 16 nt, Homo sapiens
auauaauuacucccau

SEQ ID NO: 2051136 - RNA, 19 nt, Homo sapiens
ggaaguaaccauuugcacu

SEQ ID NO: 2051137 - RNA, 20 nt, Homo sapiens
aauagggcuaaauguuuaaa

SEQ ID NO: 2051138 - RNA, 17 nt, Homo sapiens
auaaacaagcauuucaa

SEQ ID NO: 2051139 - RNA, 22 nt, Homo sapiens
agggaagcuuuguuugaaaauu

SEQ ID NO: 2051140 - RNA, 18 nt, Homo sapiens
cauggauuucauggugau

SEQ ID NO: 2051141 - RNA, 17 nt, Homo sapiens
cgcacaaggcugaccaa

SEQ ID NO: 2051142 - RNA, 14 nt, Homo sapiens
ugcacaugccucug

SEQ ID NO: 2051143 - RNA, 22 nt, Homo sapiens
agucauaaugaauaaagugcaa

SEQ ID NO: 2051144 - RNA, 22 nt, Homo sapiens
ugucaauucgcuauucgccagc

SEQ ID NO: 2051145 - RNA, 19 nt, Homo sapiens
ggggacauagcugugcuau

SEQ ID NO: 2051146 - RNA, 23 nt, Homo sapiens
uggcacuccucucgcauggugug

SEQ ID NO: 2051147 - RNA, 12 nt, Homo sapiens
caacuuccucuc

SEQ ID NO: 2051148 - RNA, 14 nt, Homo sapiens
guguggcauuugga

SEQ ID NO: 2051149 - RNA, 15 nt, Homo sapiens
cauauauacuacaug

SEQ ID NO: 2051150 - RNA, 24 nt, Homo sapiens
gucacuuggugcauaagcacagaa

SEQ ID NO: 2051151 - RNA, 21 nt, Homo sapiens
aacgacgguuucaaaccagga

SEQ ID NO: 2051152 - RNA, 16 nt, Homo sapiens
uaacggccgucugcuc

SEQ ID NO: 2051153 - RNA, 19 nt, Homo sapiens
cccaucugaagaguggaaa

SEQ ID NO: 2051154 - RNA, 22 nt, Homo sapiens
cucuguaaagcuaaaauaaaga

SEQ ID NO: 2051155 - RNA, 13 nt, Homo sapiens
ugaaccuuaucaa

SEQ ID NO: 2051156 - RNA, 22 nt, Homo sapiens
aaacugauuacaacugcuacag

SEQ ID NO: 2051157 - RNA, 18 nt, Homo sapiens
aggcuacaguaaccaaaa

SEQ ID NO: 2051158 - RNA, 15 nt, Homo sapiens
gcccaggcuggagcu

SEQ ID NO: 2051159 - RNA, 13 nt, Homo sapiens
gaaucccaagacc

SEQ ID NO: 2051160 - RNA, 20 nt, Homo sapiens
ccaccuuugggaucagccuc

SEQ ID NO: 2051161 - RNA, 20 nt, Homo sapiens
ucaggaagccuccugcugag

SEQ ID NO: 2051162 - RNA, 19 nt, Homo sapiens
gaaguacuuaaacuuccac

SEQ ID NO: 2051163 - RNA, 21 nt, Homo sapiens
aaauucuauaggaacauauga

SEQ ID NO: 2051164 - RNA, 23 nt, Homo sapiens
ggagacaaccagaucaggagagc

SEQ ID NO: 2051165 - RNA, 18 nt, Homo sapiens
ggccacucccugccaacu

SEQ ID NO: 2051166 - RNA, 17 nt, Homo sapiens
cuucuccaauucugaaa

SEQ ID NO: 2051167 - RNA, 13 nt, Homo sapiens
uuaauaaagauuc

SEQ ID NO: 2051168 - RNA, 16 nt, Homo sapiens
ggucuuugaaauaugc

SEQ ID NO: 2051169 - RNA, 16 nt, Homo sapiens
uguauaaaaaggaaau

SEQ ID NO: 2051170 - RNA, 22 nt, Homo sapiens
cccugcuggggaagaacagccc

SEQ ID NO: 2051171 - RNA, 21 nt, Homo sapiens
uugcugugugaaaucuuucaa

SEQ ID NO: 2051172 - RNA, 20 nt, Homo sapiens
agauaccggugcuucuggaa

SEQ ID NO: 2051173 - RNA, 14 nt, Homo sapiens
acacagcauuguau

SEQ ID NO: 2051174 - RNA, 20 nt, Homo sapiens
ucuguuuagaggaggcaaca

SEQ ID NO: 2051175 - RNA, 13 nt, Homo sapiens
aguauuuuugcca

SEQ ID NO: 2051176 - RNA, 22 nt, Homo sapiens
ccuguaucuacuaaaaauacaa

SEQ ID NO: 2051177 - RNA, 18 nt, Homo sapiens
uuucagggcugggcuaua

SEQ ID NO: 2051178 - RNA, 20 nt, Homo sapiens
caugucccaaaccagacacc

SEQ ID NO: 2051179 - RNA, 14 nt, Homo sapiens
aggaaaaggaauuc

SEQ ID NO: 2051180 - RNA, 18 nt, Homo sapiens
caaauuucuaucagccuu

SEQ ID NO: 2051181 - RNA, 20 nt, Homo sapiens
auggucccaggcuucccaaa

SEQ ID NO: 2051182 - RNA, 13 nt, Homo sapiens
aguaaguguacaa

SEQ ID NO: 2051183 - RNA, 17 nt, Homo sapiens
uugccuccucacccacc

SEQ ID NO: 2051184 - RNA, 17 nt, Homo sapiens
auaucugguauauguca

SEQ ID NO: 2051185 - RNA, 18 nt, Homo sapiens
cucccuggcuucuguggg

SEQ ID NO: 2051186 - RNA, 13 nt, Homo sapiens
acauuugaaauca

SEQ ID NO: 2051187 - RNA, 11 nt, Homo sapiens
auaauugccac

SEQ ID NO: 2051188 - RNA, 18 nt, Homo sapiens
aaauauuuuaaacuacug

SEQ ID NO: 2051189 - RNA, 19 nt, Homo sapiens
ugaauuggaacugcaauga

SEQ ID NO: 2051190 - RNA, 20 nt, Homo sapiens
acuccagccugagugacaga

SEQ ID NO: 2051191 - RNA, 14 nt, Homo sapiens
auccgccugccucu

SEQ ID NO: 2051192 - RNA, 17 nt, Homo sapiens
uauucucuuaaaagaca

SEQ ID NO: 2051193 - RNA, 23 nt, Homo sapiens
cauucaauaaauauuaguuaaua

SEQ ID NO: 2051194 - RNA, 13 nt, Homo sapiens
gcacuauguauau

SEQ ID NO: 2051195 - RNA, 23 nt, Homo sapiens
acaugcacacacacacaucucau

SEQ ID NO: 2051196 - RNA, 17 nt, Homo sapiens
acaacuuugccuucaaa

SEQ ID NO: 2051197 - RNA, 21 nt, Homo sapiens
uugcaaaaugagacuuucuaa

SEQ ID NO: 2051198 - RNA, 13 nt, Homo sapiens
uuuucuacuuuga

SEQ ID NO: 2051199 - RNA, 12 nt, Homo sapiens
agucccauucau

SEQ ID NO: 2051200 - RNA, 13 nt, Homo sapiens
auuucuucagucc

SEQ ID NO: 2051201 - RNA, 16 nt, Homo sapiens
guaaauagcuaagaua

SEQ ID NO: 2051202 - RNA, 16 nt, Homo sapiens
ugaaauugaaccuggu

SEQ ID NO: 2051203 - RNA, 18 nt, Homo sapiens
agggcuugaaauguguac

SEQ ID NO: 2051204 - RNA, 21 nt, Homo sapiens
aauuaaauaaacuguuuucaa

SEQ ID NO: 2051205 - RNA, 22 nt, Homo sapiens
ugggaaaggaaaaccagggaua

SEQ ID NO: 2051206 - RNA, 21 nt, Homo sapiens
gagccucgccccuccaguguu

SEQ ID NO: 2051207 - RNA, 14 nt, Homo sapiens
uauuuuuguagcac

SEQ ID NO: 2051208 - RNA, 20 nt, Homo sapiens
accucaugaggaccagggug

SEQ ID NO: 2051209 - RNA, 18 nt, Homo sapiens
gaggcccagcccucagaa

SEQ ID NO: 2051210 - RNA, 15 nt, Homo sapiens
aaagcauucuuuaac

SEQ ID NO: 2051211 - RNA, 17 nt, Homo sapiens
acguggagcugcucaac

SEQ ID NO: 2051212 - RNA, 14 nt, Homo sapiens
gccaaagaucacuu

SEQ ID NO: 2051213 - RNA, 14 nt, Homo sapiens
cuguguccaacucc

SEQ ID NO: 2051214 - RNA, 16 nt, Homo sapiens
cuuuacuaacacuggc

SEQ ID NO: 2051215 - RNA, 21 nt, Homo sapiens
aaaaacacccgacgucaugua

SEQ ID NO: 2051216 - RNA, 21 nt, Homo sapiens
ccacaucuugcucugcugaca

SEQ ID NO: 2051217 - RNA, 13 nt, Homo sapiens
cacuguacuugua

SEQ ID NO: 2051218 - RNA, 17 nt, Homo sapiens
augugcacuucacugga

SEQ ID NO: 2051219 - RNA, 17 nt, Homo sapiens
ugucauggugcaauuug

SEQ ID NO: 2051220 - RNA, 15 nt, Homo sapiens
auccuuccaccucag

SEQ ID NO: 2051221 - RNA, 18 nt, Homo sapiens
acaauugaacugcuuauu

SEQ ID NO: 2051222 - RNA, 15 nt, Homo sapiens
acuguaacacuguau

SEQ ID NO: 2051223 - RNA, 15 nt, Homo sapiens
cuuucuuccuuucua

SEQ ID NO: 2051224 - RNA, 15 nt, Homo sapiens
cucccuuccucccua

SEQ ID NO: 2051225 - RNA, 16 nt, Homo sapiens
cuuugugccaaacaaa

SEQ ID NO: 2051226 - RNA, 14 nt, Homo sapiens
gcuauguugcccaa

SEQ ID NO: 2051227 - RNA, 21 nt, Homo sapiens
ucuacucugucuuaaaugaga

SEQ ID NO: 2051228 - RNA, 19 nt, Homo sapiens
acugcaaaucugccugaua

SEQ ID NO: 2051229 - RNA, 14 nt, Homo sapiens
aaggguuaccccac

SEQ ID NO: 2051230 - RNA, 16 nt, Homo sapiens
ggcaauuuauuuuaag

SEQ ID NO: 2051231 - RNA, 22 nt, Homo sapiens
ucuuuaucaugaagcacaucaa

SEQ ID NO: 2051232 - RNA, 15 nt, Homo sapiens
gagcauuagauuucu

SEQ ID NO: 2051233 - RNA, 16 nt, Homo sapiens
cagaugcuaaaagcua

SEQ ID NO: 2051234 - RNA, 14 nt, Homo sapiens
ccuaagcccaaaua

SEQ ID NO: 2051235 - RNA, 13 nt, Homo sapiens
cccagagcacuuu

SEQ ID NO: 2051236 - RNA, 18 nt, Homo sapiens
gucugagaauuuccaaaa

SEQ ID NO: 2051237 - RNA, 16 nt, Homo sapiens
agugaauacacuggaa

SEQ ID NO: 2051238 - RNA, 14 nt, Homo sapiens
uugccuuuggcaau

SEQ ID NO: 2051239 - RNA, 23 nt, Homo sapiens
ucauguuuuugaaacagaaccau

SEQ ID NO: 2051240 - RNA, 21 nt, Homo sapiens
ugcauggauguuuuagccauu

SEQ ID NO: 2051241 - RNA, 15 nt, Homo sapiens
cuuguguucugagua

SEQ ID NO: 2051242 - RNA, 12 nt, Homo sapiens
caguucugauga

SEQ ID NO: 2051243 - RNA, 13 nt, Homo sapiens
ccgggugccauuc

SEQ ID NO: 2051244 - RNA, 15 nt, Homo sapiens
gcuagaaaacauuuu

SEQ ID NO: 2051245 - RNA, 12 nt, Homo sapiens
ggguugggcucu

SEQ ID NO: 2051246 - RNA, 18 nt, Homo sapiens
aagcauuguuugugauau

SEQ ID NO: 2051247 - RNA, 14 nt, Homo sapiens
cuauaacauucuga

SEQ ID NO: 2051248 - RNA, 21 nt, Homo sapiens
gggcccacagggaacccugcu

SEQ ID NO: 2051249 - RNA, 14 nt, Homo sapiens
augagcgucacugc

SEQ ID NO: 2051250 - RNA, 19 nt, Homo sapiens
ucccaugagcuuaggcauu

SEQ ID NO: 2051251 - RNA, 16 nt, Homo sapiens
acagaugaauaccuuu

SEQ ID NO: 2051252 - RNA, 11 nt, Homo sapiens
ggacucuccau

SEQ ID NO: 2051253 - RNA, 17 nt, Homo sapiens
uggggauguaaccaagc

SEQ ID NO: 2051254 - RNA, 17 nt, Homo sapiens
caacccuacaguauaua

SEQ ID NO: 2051255 - RNA, 12 nt, Homo sapiens
uuaggcuuugua

SEQ ID NO: 2051256 - RNA, 15 nt, Homo sapiens
ucagcaucugaccau

SEQ ID NO: 2051257 - RNA, 18 nt, Homo sapiens
ucucauucccuccccaga

SEQ ID NO: 2051258 - RNA, 22 nt, Homo sapiens
aaggucuugcuauguugcccag

SEQ ID NO: 2051259 - RNA, 12 nt, Homo sapiens
acaccacagccu

SEQ ID NO: 2051260 - RNA, 21 nt, Homo sapiens
ggauuaugaagugacucucac

SEQ ID NO: 2051261 - RNA, 16 nt, Homo sapiens
ccccuuguuguaaaaa

SEQ ID NO: 2051262 - RNA, 18 nt, Homo sapiens
auucccauuuccugucau

SEQ ID NO: 2051263 - RNA, 18 nt, Homo sapiens
uaaugacaaaggcacuga

SEQ ID NO: 2051264 - RNA, 21 nt, Homo sapiens
cuggcccuugcuuaccucuca

SEQ ID NO: 2051265 - RNA, 15 nt, Homo sapiens
aauuccagugccagg

SEQ ID NO: 2051266 - RNA, 18 nt, Homo sapiens
uaaucgagucuaccucuu

SEQ ID NO: 2051267 - RNA, 15 nt, Homo sapiens
aauuaaggcagcuga

SEQ ID NO: 2051268 - RNA, 22 nt, Homo sapiens
gcagaacagaucuuuuacuuug

SEQ ID NO: 2051269 - RNA, 14 nt, Homo sapiens
ggcagauugaaaag

SEQ ID NO: 2051270 - RNA, 16 nt, Homo sapiens
cuuguaucaacacugu

SEQ ID NO: 2051271 - RNA, 20 nt, Homo sapiens
acuccacuggccuccuggca

SEQ ID NO: 2051272 - RNA, 11 nt, Homo sapiens
aagugagccaa

SEQ ID NO: 2051273 - RNA, 18 nt, Homo sapiens
gaagagcagcuggucaac

SEQ ID NO: 2051274 - RNA, 16 nt, Homo sapiens
uccgacucaacaccag

SEQ ID NO: 2051275 - RNA, 21 nt, Homo sapiens
cugcuggagugaaggggccaa

SEQ ID NO: 2051276 - RNA, 18 nt, Homo sapiens
uuucaacuucaucucaau

SEQ ID NO: 2051277 - RNA, 16 nt, Homo sapiens
gacagccaccaagaag

SEQ ID NO: 2051278 - RNA, 20 nt, Homo sapiens
uguaggaaucugccuuccag

SEQ ID NO: 2051279 - RNA, 18 nt, Homo sapiens
ccugcugagggaccagcc

SEQ ID NO: 2051280 - RNA, 21 nt, Homo sapiens
uguuaaguuacaguuugcaca

SEQ ID NO: 2051281 - RNA, 22 nt, Homo sapiens
uccacaaugaugaugauuucag

SEQ ID NO: 2051282 - RNA, 13 nt, Homo sapiens
acaggcacuauaa

SEQ ID NO: 2051283 - RNA, 21 nt, Homo sapiens
augaaaagcacagccucagaa

SEQ ID NO: 2051284 - RNA, 13 nt, Homo sapiens
cugaucucaggga

SEQ ID NO: 2051285 - RNA, 13 nt, Homo sapiens
cuggacucaggau

SEQ ID NO: 2051286 - RNA, 17 nt, Homo sapiens
gaggaaccuacugccag

SEQ ID NO: 2051287 - RNA, 13 nt, Homo sapiens
ucacugcauuugg

SEQ ID NO: 2051288 - RNA, 16 nt, Homo sapiens
cagauucaugcacugu

SEQ ID NO: 2051289 - RNA, 22 nt, Homo sapiens
caaccaaugaaaacagucccau

SEQ ID NO: 2051290 - RNA, 22 nt, Homo sapiens
acaggaggaggagauggccaua

SEQ ID NO: 2051291 - RNA, 23 nt, Homo sapiens
auucccuucaucuggaaccauca

SEQ ID NO: 2051292 - RNA, 18 nt, Homo sapiens
auuuagaacuguauguca

SEQ ID NO: 2051293 - RNA, 22 nt, Homo sapiens
ggaugaaacuaaagcaauagaa

SEQ ID NO: 2051294 - RNA, 24 nt, Homo sapiens
gaacacugguuauguugauagaau

SEQ ID NO: 2051295 - RNA, 20 nt, Homo sapiens
ugugggcccagcuacaagga

SEQ ID NO: 2051296 - RNA, 18 nt, Homo sapiens
cagagacugcaagcugcu

SEQ ID NO: 2051297 - RNA, 18 nt, Homo sapiens
auuguugcaaacuaugca

SEQ ID NO: 2051298 - RNA, 16 nt, Homo sapiens
aguggcccucccucag

SEQ ID NO: 2051299 - RNA, 18 nt, Homo sapiens
uuuauacuaggacuccuu

SEQ ID NO: 2051300 - RNA, 13 nt, Homo sapiens
uaaauauuucaca

SEQ ID NO: 2051301 - RNA, 21 nt, Homo sapiens
cacuaagaaaauagcaagagu

SEQ ID NO: 2051302 - RNA, 19 nt, Homo sapiens
cucacuuuucuccaugagu

SEQ ID NO: 2051303 - RNA, 19 nt, Homo sapiens
accuccccugguccugcac

SEQ ID NO: 2051304 - RNA, 22 nt, Homo sapiens
cauaagaaauguauuccugaaa

SEQ ID NO: 2051305 - RNA, 16 nt, Homo sapiens
augugggugggaccac

SEQ ID NO: 2051306 - RNA, 13 nt, Homo sapiens
caagucauuccua

SEQ ID NO: 2051307 - RNA, 18 nt, Homo sapiens
auugucucugugacugaa

SEQ ID NO: 2051308 - RNA, 14 nt, Homo sapiens
ugaacagaaccucc

SEQ ID NO: 2051309 - RNA, 13 nt, Homo sapiens
gaauaauaacuuu

SEQ ID NO: 2051310 - RNA, 21 nt, Homo sapiens
augucauuacauagaacacuu

SEQ ID NO: 2051311 - RNA, 16 nt, Homo sapiens
gggcuggaguccucuc

SEQ ID NO: 2051312 - RNA, 23 nt, Homo sapiens
aagugaaggacauagagguauau

SEQ ID NO: 2051313 - RNA, 16 nt, Homo sapiens
cauugccuuugaaugu

SEQ ID NO: 2051314 - RNA, 20 nt, Homo sapiens
ccagggcccucccagcccau

SEQ ID NO: 2051315 - RNA, 17 nt, Homo sapiens
aaguccacaucuucuca

SEQ ID NO: 2051316 - RNA, 13 nt, Homo sapiens
uaaagacaaccau

SEQ ID NO: 2051317 - RNA, 18 nt, Homo sapiens
agccagguaccuucucac

SEQ ID NO: 2051318 - RNA, 23 nt, Homo sapiens
gaugaaacaaccguauaccugag

SEQ ID NO: 2051319 - RNA, 19 nt, Homo sapiens
cuuucugaccuucagcuca

SEQ ID NO: 2051320 - RNA, 16 nt, Homo sapiens
cuuccaaagguuuaaa

SEQ ID NO: 2051321 - RNA, 17 nt, Homo sapiens
uaaucuguuuuauaccu

SEQ ID NO: 2051322 - RNA, 21 nt, Homo sapiens
cuggaggcagaaucccggcug

SEQ ID NO: 2051323 - RNA, 16 nt, Homo sapiens
agacucccaagcugga

SEQ ID NO: 2051324 - RNA, 20 nt, Homo sapiens
uacaauauagugaugccauc

SEQ ID NO: 2051325 - RNA, 12 nt, Homo sapiens
aagaacuguauu

SEQ ID NO: 2051326 - RNA, 12 nt, Homo sapiens
gaaaaacagagg

SEQ ID NO: 2051327 - RNA, 15 nt, Homo sapiens
ccugaacaagaaaga

SEQ ID NO: 2051328 - RNA, 21 nt, Homo sapiens
ucacuggccacaguuguuuga

SEQ ID NO: 2051329 - RNA, 20 nt, Homo sapiens
gucagggugaacugcaaagc

SEQ ID NO: 2051330 - RNA, 17 nt, Homo sapiens
ccacccgguccccacuu

SEQ ID NO: 2051331 - RNA, 19 nt, Homo sapiens
auacauaaaaucgcuuuca

SEQ ID NO: 2051332 - RNA, 13 nt, Homo sapiens
ucauuugagauaa

SEQ ID NO: 2051333 - RNA, 19 nt, Homo sapiens
auaaaauuggauuacagua

SEQ ID NO: 2051334 - RNA, 13 nt, Homo sapiens
auggcaaaauuag

SEQ ID NO: 2051335 - RNA, 22 nt, Homo sapiens
agaacaugaaucaaaagugccu

SEQ ID NO: 2051336 - RNA, 15 nt, Homo sapiens
acauuuauguacaaa

SEQ ID NO: 2051337 - RNA, 15 nt, Homo sapiens
uaauuaggaucuaug

SEQ ID NO: 2051338 - RNA, 12 nt, Homo sapiens
aauugauuucaa

SEQ ID NO: 2051339 - RNA, 12 nt, Homo sapiens
uauugauuacaa

SEQ ID NO: 2051340 - RNA, 15 nt, Homo sapiens
uauuauagugaaaca

SEQ ID NO: 2051341 - RNA, 15 nt, Homo sapiens
guuagugacugaugu

SEQ ID NO: 2051342 - RNA, 20 nt, Homo sapiens
acuucuagugccucuguuac

SEQ ID NO: 2051343 - RNA, 16 nt, Homo sapiens
guugaagccacugccu

SEQ ID NO: 2051344 - RNA, 18 nt, Homo sapiens
agguuugucccagucaga

SEQ ID NO: 2051345 - RNA, 16 nt, Homo sapiens
gaaauguaaacugcca

SEQ ID NO: 2051346 - RNA, 15 nt, Homo sapiens
acaccgacucugagc

SEQ ID NO: 2051347 - RNA, 14 nt, Homo sapiens
caagaaguacauga

SEQ ID NO: 2051348 - RNA, 19 nt, Homo sapiens
ugaauauuagcauugccaa

SEQ ID NO: 2051349 - RNA, 15 nt, Homo sapiens
ccucaugaugggaug

SEQ ID NO: 2051350 - RNA, 21 nt, Homo sapiens
aguagagcuucuuauauuaaa

SEQ ID NO: 2051351 - RNA, 18 nt, Homo sapiens
gcugauauuaacugucaa

SEQ ID NO: 2051352 - RNA, 19 nt, Homo sapiens
ugacaaguuaccccugaaa

SEQ ID NO: 2051353 - RNA, 14 nt, Homo sapiens
gaaucucagcacuu

SEQ ID NO: 2051354 - RNA, 14 nt, Homo sapiens
gauccccagcuuuc

SEQ ID NO: 2051355 - RNA, 15 nt, Homo sapiens
cuuaacuuaauucaa

SEQ ID NO: 2051356 - RNA, 18 nt, Homo sapiens
gagagaggcugccucagc

SEQ ID NO: 2051357 - RNA, 18 nt, Homo sapiens
aggcuagcuagcuguguu

SEQ ID NO: 2051358 - RNA, 15 nt, Homo sapiens
guuugcaaaugucag

SEQ ID NO: 2051359 - RNA, 12 nt, Homo sapiens
cagaucuugccu

SEQ ID NO: 2051360 - RNA, 14 nt, Homo sapiens
uccagaacugaggu

SEQ ID NO: 2051361 - RNA, 22 nt, Homo sapiens
uguuuuuuggugguucugcugu

SEQ ID NO: 2051362 - RNA, 23 nt, Homo sapiens
caacuguuuuaauaaaagauuua

SEQ ID NO: 2051363 - RNA, 19 nt, Homo sapiens
gcuccaggacuccacugga

SEQ ID NO: 2051364 - RNA, 14 nt, Homo sapiens
ccaggcagggauaa

SEQ ID NO: 2051365 - RNA, 22 nt, Homo sapiens
agaugugauuuggaccauggca

SEQ ID NO: 2051366 - RNA, 14 nt, Homo sapiens
cacuccagugccca

SEQ ID NO: 2051367 - RNA, 19 nt, Homo sapiens
caagacuuuaaacauuuau

SEQ ID NO: 2051368 - RNA, 18 nt, Homo sapiens
caggggaguguucagggc

SEQ ID NO: 2051369 - RNA, 22 nt, Homo sapiens
uagcagccuggggugaccucua

SEQ ID NO: 2051370 - RNA, 18 nt, Homo sapiens
uauguuuacacugucaaa

SEQ ID NO: 2051371 - RNA, 13 nt, Homo sapiens
uggaugcucgcca

SEQ ID NO: 2051372 - RNA, 23 nt, Homo sapiens
ugccuuggaggaaaugugcucaa

SEQ ID NO: 2051373 - RNA, 13 nt, Homo sapiens
cagaagaagacag

SEQ ID NO: 2051374 - RNA, 19 nt, Homo sapiens
auuacaggugugagccacu

SEQ ID NO: 2051375 - RNA, 20 nt, Homo sapiens
caauucugugacauacauau

SEQ ID NO: 2051376 - RNA, 19 nt, Homo sapiens
uauauuggguuccauucuc

SEQ ID NO: 2051377 - RNA, 15 nt, Homo sapiens
augaugcugucugaa

SEQ ID NO: 2051378 - RNA, 15 nt, Homo sapiens
cuucaagcagggaag

SEQ ID NO: 2051379 - RNA, 22 nt, Homo sapiens
ugcccauaaucccagcacuuug

SEQ ID NO: 2051380 - RNA, 21 nt, Homo sapiens
gauauucauuggcagcucaaa

SEQ ID NO: 2051381 - RNA, 20 nt, Homo sapiens
cuagaggccuuuaguuauaa

SEQ ID NO: 2051382 - RNA, 16 nt, Homo sapiens
cuggaacugucucuca

SEQ ID NO: 2051383 - RNA, 19 nt, Homo sapiens
uggcuucugcuugucaucc

SEQ ID NO: 2051384 - RNA, 13 nt, Homo sapiens
ucugagauacuaa

SEQ ID NO: 2051385 - RNA, 13 nt, Homo sapiens
ucuggccuguggc

SEQ ID NO: 2051386 - RNA, 22 nt, Homo sapiens
uugucagggaguguucccuauc

SEQ ID NO: 2051387 - RNA, 21 nt, Homo sapiens
ccuggagugcucaauuggaag

SEQ ID NO: 2051388 - RNA, 16 nt, Homo sapiens
cagaaaguuauugaua

SEQ ID NO: 2051389 - RNA, 21 nt, Homo sapiens
ucccccccaagauagagucaa

SEQ ID NO: 2051390 - RNA, 18 nt, Homo sapiens
auguguuauuacuuccuc

SEQ ID NO: 2051391 - RNA, 18 nt, Homo sapiens
cuggggcuggcaccagca

SEQ ID NO: 2051392 - RNA, 14 nt, Homo sapiens
agacauggccucug

SEQ ID NO: 2051393 - RNA, 12 nt, Homo sapiens
ugcuuaauucaa

SEQ ID NO: 2051394 - RNA, 22 nt, Homo sapiens
uaaguauaaaauacaacaaagg

SEQ ID NO: 2051395 - RNA, 19 nt, Homo sapiens
gccugugaucccagcuacu

SEQ ID NO: 2051396 - RNA, 17 nt, Homo sapiens
caaaacuguaacugcau

SEQ ID NO: 2051397 - RNA, 17 nt, Homo sapiens
guucaaauccucaccau

SEQ ID NO: 2051398 - RNA, 18 nt, Homo sapiens
gcacuuaauaguacauca

SEQ ID NO: 2051399 - RNA, 19 nt, Homo sapiens
agcuugaaauagugucuga

SEQ ID NO: 2051400 - RNA, 17 nt, Homo sapiens
acuagccagcacaaaag

SEQ ID NO: 2051401 - RNA, 15 nt, Homo sapiens
ucagcaaguguacag

SEQ ID NO: 2051402 - RNA, 16 nt, Homo sapiens
caaacuuuguuuguca

SEQ ID NO: 2051403 - RNA, 13 nt, Homo sapiens
uuauuauuugaca

SEQ ID NO: 2051404 - RNA, 12 nt, Homo sapiens
caguacagggca

SEQ ID NO: 2051405 - RNA, 18 nt, Homo sapiens
cugagcgugaugaucuag

SEQ ID NO: 2051406 - RNA, 15 nt, Homo sapiens
agaucauauuucaca

SEQ ID NO: 2051407 - RNA, 17 nt, Homo sapiens
cuuccccaacuucccua

SEQ ID NO: 2051408 - RNA, 17 nt, Homo sapiens
auccaccucccuaccaa

SEQ ID NO: 2051409 - RNA, 21 nt, Homo sapiens
aguuuuaaagaagucucuuaa

SEQ ID NO: 2051410 - RNA, 19 nt, Homo sapiens
gaaauacuugaacuugccu

SEQ ID NO: 2051411 - RNA, 17 nt, Homo sapiens
cuauauucaaaauucaa

SEQ ID NO: 2051412 - RNA, 17 nt, Homo sapiens
uguuuacaugaguucaa

SEQ ID NO: 2051413 - RNA, 22 nt, Homo sapiens
cauucgggagaucaugucucac

SEQ ID NO: 2051414 - RNA, 18 nt, Homo sapiens
aauucuuagccaggugua

SEQ ID NO: 2051415 - RNA, 22 nt, Homo sapiens
aaacaaucuguuuuggcuuuau

SEQ ID NO: 2051416 - RNA, 21 nt, Homo sapiens
auauucucaguguagggcaga

SEQ ID NO: 2051417 - RNA, 15 nt, Homo sapiens
ucaguguuagaggug

SEQ ID NO: 2051418 - RNA, 24 nt, Homo sapiens
aaacuaacacagccaucaagggaa

SEQ ID NO: 2051419 - RNA, 13 nt, Homo sapiens
aagccuugguaaa

SEQ ID NO: 2051420 - RNA, 15 nt, Homo sapiens
uguauauacauauau

SEQ ID NO: 2051421 - RNA, 15 nt, Homo sapiens
cacacacaugcacac

SEQ ID NO: 2051422 - RNA, 18 nt, Homo sapiens
cucuuucuguauauacuu

SEQ ID NO: 2051423 - RNA, 21 nt, Homo sapiens
uuuauucauuagcugugauuu

SEQ ID NO: 2051424 - RNA, 14 nt, Homo sapiens
aaaaugcaacgcug

SEQ ID NO: 2051425 - RNA, 22 nt, Homo sapiens
auacaaguuugccccauucucu

SEQ ID NO: 2051426 - RNA, 14 nt, Homo sapiens
cuuuccacauucag

SEQ ID NO: 2051427 - RNA, 15 nt, Homo sapiens
aacgaugcagaugca

SEQ ID NO: 2051428 - RNA, 21 nt, Homo sapiens
ucucucauuuccaaaccauca

SEQ ID NO: 2051429 - RNA, 23 nt, Homo sapiens
cuauggucagguuauacuccucc

SEQ ID NO: 2051430 - RNA, 22 nt, Homo sapiens
uguucuaagucuuuccauugga

SEQ ID NO: 2051431 - RNA, 17 nt, Homo sapiens
acuagaagcaacuagga

SEQ ID NO: 2051432 - RNA, 15 nt, Homo sapiens
aaugcucaagaaaca

SEQ ID NO: 2051433 - RNA, 16 nt, Homo sapiens
acaugagcuauuucca

SEQ ID NO: 2051434 - RNA, 15 nt, Homo sapiens
agccaucuugaucug

SEQ ID NO: 2051435 - RNA, 21 nt, Homo sapiens
uucaugcagccuaaaguacag

SEQ ID NO: 2051436 - RNA, 14 nt, Homo sapiens
uuaaaauaccuaga

SEQ ID NO: 2051437 - RNA, 16 nt, Homo sapiens
ggcccugccuccuuug

SEQ ID NO: 2051438 - RNA, 20 nt, Homo sapiens
aauuagugguacuucagguu

SEQ ID NO: 2051439 - RNA, 23 nt, Homo sapiens
cuauucugagcauacucaacaaa

SEQ ID NO: 2051440 - RNA, 14 nt, Homo sapiens
guccguggaaccag

SEQ ID NO: 2051441 - RNA, 18 nt, Homo sapiens
cuugcauacagagacaga

SEQ ID NO: 2051442 - RNA, 16 nt, Homo sapiens
uuaaaguauucuucuc

SEQ ID NO: 2051443 - RNA, 13 nt, Homo sapiens
gcaacucaaagag

SEQ ID NO: 2051444 - RNA, 15 nt, Homo sapiens
gaaguugcccuccag

SEQ ID NO: 2051445 - RNA, 18 nt, Homo sapiens
uaaaguauauuauuguga

SEQ ID NO: 2051446 - RNA, 14 nt, Homo sapiens
aauauaaaaggaaa

SEQ ID NO: 2051447 - RNA, 19 nt, Homo sapiens
cuauuaaaauucugauguu

SEQ ID NO: 2051448 - RNA, 21 nt, Homo sapiens
aggauuugcucuggacagaga

SEQ ID NO: 2051449 - RNA, 20 nt, Homo sapiens
uaaaauucagguauuacuga

SEQ ID NO: 2051450 - RNA, 21 nt, Homo sapiens
gugggucaguccucuuuccuu

SEQ ID NO: 2051451 - RNA, 18 nt, Homo sapiens
uugcauucguaaacacca

SEQ ID NO: 2051452 - RNA, 20 nt, Homo sapiens
guagacagguguuacuuaca

SEQ ID NO: 2051453 - RNA, 21 nt, Homo sapiens
ccaggcccacgaggagcagca

SEQ ID NO: 2051454 - RNA, 19 nt, Homo sapiens
cuucccucgcaugucuccc

SEQ ID NO: 2051455 - RNA, 11 nt, Homo sapiens
gggugccauuc

SEQ ID NO: 2051456 - RNA, 17 nt, Homo sapiens
uuccacuuugauaccau

SEQ ID NO: 2051457 - RNA, 22 nt, Homo sapiens
acucaguaaggcagugcaguac

SEQ ID NO: 2051458 - RNA, 23 nt, Homo sapiens
ugguccgccacgaggagcuucca

SEQ ID NO: 2051459 - RNA, 20 nt, Homo sapiens
guuaaaacuguacauuuaaa

SEQ ID NO: 2051460 - RNA, 22 nt, Homo sapiens
ggauguauguguauauguuuau

SEQ ID NO: 2051461 - RNA, 16 nt, Homo sapiens
acaauuaaaucucucc

SEQ ID NO: 2051462 - RNA, 23 nt, Homo sapiens
cgggucacccugugacccucuca

SEQ ID NO: 2051463 - RNA, 21 nt, Homo sapiens
uacuuuuuggugucucauacc

SEQ ID NO: 2051464 - RNA, 14 nt, Homo sapiens
gaaugccugucacg

SEQ ID NO: 2051465 - RNA, 21 nt, Homo sapiens
cucaauuucucugaggacaca

SEQ ID NO: 2051466 - RNA, 20 nt, Homo sapiens
auaaagguucaugcaaacuu

SEQ ID NO: 2051467 - RNA, 14 nt, Homo sapiens
cugccucuuggccu

SEQ ID NO: 2051468 - RNA, 23 nt, Homo sapiens
acugacugaaaucagugguguua

SEQ ID NO: 2051469 - RNA, 15 nt, Homo sapiens
aggaaaaccagugaa

SEQ ID NO: 2051470 - RNA, 18 nt, Homo sapiens
uagaucugauggugagcu

SEQ ID NO: 2051471 - RNA, 19 nt, Homo sapiens
cuacaguaacugugacuga

SEQ ID NO: 2051472 - RNA, 21 nt, Homo sapiens
aaagaaggcacagguguaaau

SEQ ID NO: 2051473 - RNA, 23 nt, Homo sapiens
guggugaaaagcagguugauaaa

SEQ ID NO: 2051474 - RNA, 16 nt, Homo sapiens
gccauaggagaguuug

SEQ ID NO: 2051475 - RNA, 17 nt, Homo sapiens
ccucuaucccuggccac

SEQ ID NO: 2051476 - RNA, 19 nt, Homo sapiens
ucgaugcucacugcuucug

SEQ ID NO: 2051477 - RNA, 11 nt, Homo sapiens
aauaaaaagcu

SEQ ID NO: 2051478 - RNA, 11 nt, Homo sapiens
aaaaaaaagca

SEQ ID NO: 2051479 - RNA, 11 nt, Homo sapiens
aacaaaaagcc

SEQ ID NO: 2051480 - RNA, 16 nt, Homo sapiens
aaauggaaaguaacuc

SEQ ID NO: 2051481 - RNA, 19 nt, Homo sapiens
ucuccauccuuaacugucc

SEQ ID NO: 2051482 - RNA, 13 nt, Homo sapiens
ugauucuaugucu

SEQ ID NO: 2051483 - RNA, 20 nt, Homo sapiens
acuaaacuaacaagauuaaa

SEQ ID NO: 2051484 - RNA, 20 nt, Homo sapiens
cuccucacaguugccaugua

SEQ ID NO: 2051485 - RNA, 16 nt, Homo sapiens
uaagaaugaucugauu

SEQ ID NO: 2051486 - RNA, 12 nt, Homo sapiens
ccaauacauuau

SEQ ID NO: 2051487 - RNA, 22 nt, Homo sapiens
guuuccccuccuuggcuuuaug

SEQ ID NO: 2051488 - RNA, 14 nt, Homo sapiens
cuggggcaauggga

SEQ ID NO: 2051489 - RNA, 19 nt, Homo sapiens
cacuuucuucaaagccaca

SEQ ID NO: 2051490 - RNA, 17 nt, Homo sapiens
cacaccugcacaccccu

SEQ ID NO: 2051491 - RNA, 15 nt, Homo sapiens
caggguuucucugaa

SEQ ID NO: 2051492 - RNA, 17 nt, Homo sapiens
cucuaagguaacauuua

SEQ ID NO: 2051493 - RNA, 22 nt, Homo sapiens
aaccccuuuucaguuugaacuc

SEQ ID NO: 2051494 - RNA, 15 nt, Homo sapiens
accccuaacauacug

SEQ ID NO: 2051495 - RNA, 15 nt, Homo sapiens
agagaugugccccca

SEQ ID NO: 2051496 - RNA, 16 nt, Homo sapiens
aaugaucuagguuuaa

SEQ ID NO: 2051497 - RNA, 14 nt, Homo sapiens
ugaauaaagugcaa

SEQ ID NO: 2051498 - RNA, 18 nt, Homo sapiens
uaaacuaguguuauacuu

SEQ ID NO: 2051499 - RNA, 19 nt, Homo sapiens
ccgugaggaugucacucag

SEQ ID NO: 2051500 - RNA, 21 nt, Homo sapiens
cagucguacugauucuaaugg

SEQ ID NO: 2051501 - RNA, 22 nt, Homo sapiens
cacucuggggcuggcaccagca

SEQ ID NO: 2051502 - RNA, 19 nt, Homo sapiens
gaaacauacagaauguucu

SEQ ID NO: 2051503 - RNA, 19 nt, Homo sapiens
aguauauacagagccuguu

SEQ ID NO: 2051504 - RNA, 19 nt, Homo sapiens
uucaucuaaaugaaagugg

SEQ ID NO: 2051505 - RNA, 23 nt, Homo sapiens
cuggccagggccuggaagacaga

SEQ ID NO: 2051506 - RNA, 23 nt, Homo sapiens
ggguucauuauuggaauuaaccu

SEQ ID NO: 2051507 - RNA, 14 nt, Homo sapiens
gcaggauaaucgcu

SEQ ID NO: 2051508 - RNA, 15 nt, Homo sapiens
agccuagcggagccc

SEQ ID NO: 2051509 - RNA, 17 nt, Homo sapiens
guaaaugaaguaacuug

SEQ ID NO: 2051510 - RNA, 15 nt, Homo sapiens
agaguauuaucacug

SEQ ID NO: 2051511 - RNA, 14 nt, Homo sapiens
guaaaauuaaugua

SEQ ID NO: 2051512 - RNA, 15 nt, Homo sapiens
caagacuuccaggua

SEQ ID NO: 2051513 - RNA, 13 nt, Homo sapiens
aggucuccaaaau

SEQ ID NO: 2051514 - RNA, 18 nt, Homo sapiens
uccacuccacacucuuga

SEQ ID NO: 2051515 - RNA, 14 nt, Homo sapiens
caucccagcacugc

SEQ ID NO: 2051516 - RNA, 14 nt, Homo sapiens
agcuguagaguccu

SEQ ID NO: 2051517 - RNA, 18 nt, Homo sapiens
guacucuguccaguuccu

SEQ ID NO: 2051518 - RNA, 14 nt, Homo sapiens
gcggcucugguccu

SEQ ID NO: 2051519 - RNA, 11 nt, Homo sapiens
aagacuugaga

SEQ ID NO: 2051520 - RNA, 19 nt, Homo sapiens
agaguugaccccuccugaa

SEQ ID NO: 2051521 - RNA, 17 nt, Homo sapiens
ucacuuaaacaaugucc

SEQ ID NO: 2051522 - RNA, 14 nt, Homo sapiens
ucccggaccugugg

SEQ ID NO: 2051523 - RNA, 24 nt, Homo sapiens
cagaguugcuuuaaaguaccugua

SEQ ID NO: 2051524 - RNA, 22 nt, Homo sapiens
uaacuuuaggaaccaccauauu

SEQ ID NO: 2051525 - RNA, 19 nt, Homo sapiens
guccugcugucccugucag

SEQ ID NO: 2051526 - RNA, 16 nt, Homo sapiens
augauccuuguguuca

SEQ ID NO: 2051527 - RNA, 13 nt, Homo sapiens
ugaucucagggca

SEQ ID NO: 2051528 - RNA, 20 nt, Homo sapiens
gagccuccaugccuggccca

SEQ ID NO: 2051529 - RNA, 16 nt, Homo sapiens
aucucauccaucacag

SEQ ID NO: 2051530 - RNA, 15 nt, Homo sapiens
acuucacacagacaa

SEQ ID NO: 2051531 - RNA, 15 nt, Homo sapiens
gcacuugggacaaaa

SEQ ID NO: 2051532 - RNA, 18 nt, Homo sapiens
uccucuuugaauucuucc

SEQ ID NO: 2051533 - RNA, 17 nt, Homo sapiens
caugaugucaacucacu

SEQ ID NO: 2051534 - RNA, 17 nt, Homo sapiens
uaucaugucuugugcau

SEQ ID NO: 2051535 - RNA, 17 nt, Homo sapiens
uggaggcagggguucca

SEQ ID NO: 2051536 - RNA, 19 nt, Homo sapiens
gauugguguucguuuccau

SEQ ID NO: 2051537 - RNA, 20 nt, Homo sapiens
gacccagacaggacugcaga

SEQ ID NO: 2051538 - RNA, 16 nt, Homo sapiens
uuauccaucaauauua

SEQ ID NO: 2051539 - RNA, 20 nt, Homo sapiens
uucccaggagaaagaugaaa

SEQ ID NO: 2051540 - RNA, 21 nt, Homo sapiens
augccuguugaucuaugggaa

SEQ ID NO: 2051541 - RNA, 20 nt, Homo sapiens
caauagggugcaguuuucca

SEQ ID NO: 2051542 - RNA, 15 nt, Homo sapiens
ccguguaaaccaaag

SEQ ID NO: 2051543 - RNA, 17 nt, Homo sapiens
agcauuuagacccugca

SEQ ID NO: 2051544 - RNA, 13 nt, Homo sapiens
ugcuuugccucua

SEQ ID NO: 2051545 - RNA, 21 nt, Homo sapiens
auugugaugcauuuaucuuaa

SEQ ID NO: 2051546 - RNA, 15 nt, Homo sapiens
gacaugcacacgugu

SEQ ID NO: 2051547 - RNA, 17 nt, Homo sapiens
caugcuggaguacccag

SEQ ID NO: 2051548 - RNA, 14 nt, Homo sapiens
cacacauacaguau

SEQ ID NO: 2051549 - RNA, 16 nt, Homo sapiens
cucucgacaguaucca

SEQ ID NO: 2051550 - RNA, 11 nt, Homo sapiens
ccuugccuuau

SEQ ID NO: 2051551 - RNA, 15 nt, Homo sapiens
uccuaggaguacaag

SEQ ID NO: 2051552 - RNA, 17 nt, Homo sapiens
ugguguuccaugacuuc

SEQ ID NO: 2051553 - RNA, 13 nt, Homo sapiens
aguucagacuuuu

SEQ ID NO: 2051554 - RNA, 16 nt, Homo sapiens
gacuucucuuugccuc

SEQ ID NO: 2051555 - RNA, 18 nt, Homo sapiens
auacuuacuauaauuuga

SEQ ID NO: 2051556 - RNA, 13 nt, Homo sapiens
ccauguugaucuu

SEQ ID NO: 2051557 - RNA, 22 nt, Homo sapiens
uguaaaauauuuauucaucugc

SEQ ID NO: 2051558 - RNA, 16 nt, Homo sapiens
cggcucgauuucucca

SEQ ID NO: 2051559 - RNA, 13 nt, Homo sapiens
ugccacacugugg

SEQ ID NO: 2051560 - RNA, 12 nt, Homo sapiens
uagcaucucagg

SEQ ID NO: 2051561 - RNA, 12 nt, Homo sapiens
ucacaucuccag

SEQ ID NO: 2051562 - RNA, 14 nt, Homo sapiens
uagguuggacugga

SEQ ID NO: 2051563 - RNA, 15 nt, Homo sapiens
aaaaugccagucuca

SEQ ID NO: 2051564 - RNA, 17 nt, Homo sapiens
ucaugugacucuuucca

SEQ ID NO: 2051565 - RNA, 18 nt, Homo sapiens
agccuggcuccaaacccu

SEQ ID NO: 2051566 - RNA, 17 nt, Homo sapiens
aauuuuuuaaacuguag

SEQ ID NO: 2051567 - RNA, 12 nt, Homo sapiens
ccuugugccuug

SEQ ID NO: 2051568 - RNA, 21 nt, Homo sapiens
gucccucaaaugacccaaaga

SEQ ID NO: 2051569 - RNA, 21 nt, Homo sapiens
caaaucauccauccuugccaa

SEQ ID NO: 2051570 - RNA, 19 nt, Homo sapiens
gcaacccaaauguucauca

SEQ ID NO: 2051571 - RNA, 23 nt, Homo sapiens
ccucugccggucccccaugccac

SEQ ID NO: 2051572 - RNA, 20 nt, Homo sapiens
uggggauugcccauccaucu

SEQ ID NO: 2051573 - RNA, 15 nt, Homo sapiens
gaaugcuucuucuca

SEQ ID NO: 2051574 - RNA, 16 nt, Homo sapiens
auuuugacacaugugu

SEQ ID NO: 2051575 - RNA, 10 nt, Homo sapiens
caaaaacacc

SEQ ID NO: 2051576 - RNA, 18 nt, Homo sapiens
aguagacaaagagccaga

SEQ ID NO: 2051577 - RNA, 14 nt, Homo sapiens
acugugacaccaga

SEQ ID NO: 2051578 - RNA, 15 nt, Homo sapiens
gagaggcaugugaug

SEQ ID NO: 2051579 - RNA, 14 nt, Homo sapiens
cggacacuucucag

SEQ ID NO: 2051580 - RNA, 12 nt, Homo sapiens
gcacccuggauu

SEQ ID NO: 2051581 - RNA, 16 nt, Homo sapiens
caaggccaguaccaca

SEQ ID NO: 2051582 - RNA, 13 nt, Homo sapiens
cuuugauucuccu

SEQ ID NO: 2051583 - RNA, 17 nt, Homo sapiens
agaaagaaacaaccugc

SEQ ID NO: 2051584 - RNA, 22 nt, Homo sapiens
agggaccaucugcugcaguuac

SEQ ID NO: 2051585 - RNA, 18 nt, Homo sapiens
ucaaaggcaaugcucaaa

SEQ ID NO: 2051586 - RNA, 20 nt, Homo sapiens
uauuaaauaaaugugcaugc

SEQ ID NO: 2051587 - RNA, 23 nt, Homo sapiens
gaagaucaggccaaccccaaaga

SEQ ID NO: 2051588 - RNA, 13 nt, Homo sapiens
uuuuaaugcuguu

SEQ ID NO: 2051589 - RNA, 21 nt, Homo sapiens
ccugcauuggccuggccucca

SEQ ID NO: 2051590 - RNA, 21 nt, Homo sapiens
cagugguucguuuaccaaaua

SEQ ID NO: 2051591 - RNA, 19 nt, Homo sapiens
cucaaagauguacugagag

SEQ ID NO: 2051592 - RNA, 20 nt, Homo sapiens
aucuaaagccaguggcagug

SEQ ID NO: 2051593 - RNA, 18 nt, Homo sapiens
acugugaaagcuagacug

SEQ ID NO: 2051594 - RNA, 22 nt, Homo sapiens
uggccaggccuuacaucuggcu

SEQ ID NO: 2051595 - RNA, 17 nt, Homo sapiens
caaaggcugaacuggau

SEQ ID NO: 2051596 - RNA, 15 nt, Homo sapiens
ccacacagcagcagu

SEQ ID NO: 2051597 - RNA, 19 nt, Homo sapiens
uggucauaaugaacacuca

SEQ ID NO: 2051598 - RNA, 18 nt, Homo sapiens
aaguugaaugggcacagc

SEQ ID NO: 2051599 - RNA, 21 nt, Homo sapiens
uccuacaagacacagugacca

SEQ ID NO: 2051600 - RNA, 18 nt, Homo sapiens
cucaagacggggugggga

SEQ ID NO: 2051601 - RNA, 17 nt, Homo sapiens
caagugucucuugacug

SEQ ID NO: 2051602 - RNA, 17 nt, Homo sapiens
augcuuucccacucuca

SEQ ID NO: 2051603 - RNA, 20 nt, Homo sapiens
uguaaaaugcacccaucagc

SEQ ID NO: 2051604 - RNA, 16 nt, Homo sapiens
ggccugaccagggggc

SEQ ID NO: 2051605 - RNA, 17 nt, Homo sapiens
ucucauuuucaucuucu

SEQ ID NO: 2051606 - RNA, 15 nt, Homo sapiens
ucuguuagcugcuca

SEQ ID NO: 2051607 - RNA, 16 nt, Homo sapiens
ccuugcucagugccuc

SEQ ID NO: 2051608 - RNA, 18 nt, Homo sapiens
guagccuuagggugcuga

SEQ ID NO: 2051609 - RNA, 18 nt, Homo sapiens
auauacuauuuucauucu

SEQ ID NO: 2051610 - RNA, 14 nt, Homo sapiens
agaaacaauaugcu

SEQ ID NO: 2051611 - RNA, 13 nt, Homo sapiens
cucaaaaugcaaa

SEQ ID NO: 2051612 - RNA, 16 nt, Homo sapiens
uguaaugaauaccuua

SEQ ID NO: 2051613 - RNA, 18 nt, Homo sapiens
auugggggggccaaaagg

SEQ ID NO: 2051614 - RNA, 20 nt, Homo sapiens
gauugcugaaaaaguagauu

SEQ ID NO: 2051615 - RNA, 20 nt, Homo sapiens
uuacagagagcuugcuguga

SEQ ID NO: 2051616 - RNA, 23 nt, Homo sapiens
ggcuggucccacacuuaucagca

SEQ ID NO: 2051617 - RNA, 15 nt, Homo sapiens
auucuaguucagagc

SEQ ID NO: 2051618 - RNA, 20 nt, Homo sapiens
agacuuugacucuccagaaa

SEQ ID NO: 2051619 - RNA, 17 nt, Homo sapiens
ugagcuggaucacuuga

SEQ ID NO: 2051620 - RNA, 20 nt, Homo sapiens
guccuuagccccaucugcca

SEQ ID NO: 2051621 - RNA, 15 nt, Homo sapiens
ggaaguguaacagcu

SEQ ID NO: 2051622 - RNA, 22 nt, Homo sapiens
agcagcagaggcggucuucaac

SEQ ID NO: 2051623 - RNA, 15 nt, Homo sapiens
gagaugagaagccag

SEQ ID NO: 2051624 - RNA, 13 nt, Homo sapiens
uagcaaacuccag

SEQ ID NO: 2051625 - RNA, 14 nt, Homo sapiens
acucagagacuuca

SEQ ID NO: 2051626 - RNA, 19 nt, Homo sapiens
aguguacauguacauagua

SEQ ID NO: 2051627 - RNA, 15 nt, Homo sapiens
ugcagcucugaccca

SEQ ID NO: 2051628 - RNA, 23 nt, Homo sapiens
auuuccccaccccagcucaugcc

SEQ ID NO: 2051629 - RNA, 19 nt, Homo sapiens
gaaccccacgcccugucua

SEQ ID NO: 2051630 - RNA, 18 nt, Homo sapiens
agugacaggacuuucauu

SEQ ID NO: 2051631 - RNA, 20 nt, Homo sapiens
agaaagcacuucuuauugaa

SEQ ID NO: 2051632 - RNA, 20 nt, Homo sapiens
ucacuccaggauauugacaa

SEQ ID NO: 2051633 - RNA, 17 nt, Homo sapiens
cuguucagagcacucau

SEQ ID NO: 2051634 - RNA, 22 nt, Homo sapiens
aggccacacuucaaacuacuuu

SEQ ID NO: 2051635 - RNA, 20 nt, Homo sapiens
cuguaaucagcucuccuggc

SEQ ID NO: 2051636 - RNA, 17 nt, Homo sapiens
aauggcuaacugaugaa

SEQ ID NO: 2051637 - RNA, 12 nt, Homo sapiens
gcaucaguauuu

SEQ ID NO: 2051638 - RNA, 16 nt, Homo sapiens
acaucagaacagacaa

SEQ ID NO: 2051639 - RNA, 13 nt, Homo sapiens
aaauugaaccugg

SEQ ID NO: 2051640 - RNA, 19 nt, Homo sapiens
cauggauucauuacagcuu

SEQ ID NO: 2051641 - RNA, 15 nt, Homo sapiens
aaggucuaaucagug

SEQ ID NO: 2051642 - RNA, 23 nt, Homo sapiens
ugaaggcaaaaaucuacaguguu

SEQ ID NO: 2051643 - RNA, 14 nt, Homo sapiens
uaagagcucaggau

SEQ ID NO: 2051644 - RNA, 15 nt, Homo sapiens
ucaaaucgugguuua

SEQ ID NO: 2051645 - RNA, 14 nt, Homo sapiens
gucccgggguccug

SEQ ID NO: 2051646 - RNA, 14 nt, Homo sapiens
ccccuuggcccccu

SEQ ID NO: 2051647 - RNA, 14 nt, Homo sapiens
ucaucaggucauua

SEQ ID NO: 2051648 - RNA, 14 nt, Homo sapiens
auauuaggauauca

SEQ ID NO: 2051649 - RNA, 13 nt, Homo sapiens
agcauguccuaau

SEQ ID NO: 2051650 - RNA, 23 nt, Homo sapiens
auucaacagggaagaaacuuucu

SEQ ID NO: 2051651 - RNA, 15 nt, Homo sapiens
ugaaaggugccaugg

SEQ ID NO: 2051652 - RNA, 17 nt, Homo sapiens
uggaggccgcugcugac

SEQ ID NO: 2051653 - RNA, 12 nt, Homo sapiens
ccaggaugcaug

SEQ ID NO: 2051654 - RNA, 14 nt, Homo sapiens
uccaguauugaaaa

SEQ ID NO: 2051655 - RNA, 14 nt, Homo sapiens
cugucagaccuucu

SEQ ID NO: 2051656 - RNA, 16 nt, Homo sapiens
ucuuuacuaacacugg

SEQ ID NO: 2051657 - RNA, 23 nt, Homo sapiens
uucccaagcgucaucuguguaaa

SEQ ID NO: 2051658 - RNA, 16 nt, Homo sapiens
gcccuguucagcuacu

SEQ ID NO: 2051659 - RNA, 19 nt, Homo sapiens
gagggcaccuugugaucau

SEQ ID NO: 2051660 - RNA, 15 nt, Homo sapiens
aggaccccucgccuu

SEQ ID NO: 2051661 - RNA, 21 nt, Homo sapiens
ccaugauguaaguuuaccuau

SEQ ID NO: 2051662 - RNA, 18 nt, Homo sapiens
aaaaccacauagaacuga

SEQ ID NO: 2051663 - RNA, 23 nt, Homo sapiens
aucugaguagucuguagcuugag

SEQ ID NO: 2051664 - RNA, 18 nt, Homo sapiens
ucaaucuaaggccuuccc

SEQ ID NO: 2051665 - RNA, 21 nt, Homo sapiens
gcuccucuaggccucacucaa

SEQ ID NO: 2051666 - RNA, 20 nt, Homo sapiens
cucuccuguaagccaaagaa

SEQ ID NO: 2051667 - RNA, 19 nt, Homo sapiens
aguccggccccaguacaca

SEQ ID NO: 2051668 - RNA, 17 nt, Homo sapiens
ugucaacaaaaagacau

SEQ ID NO: 2051669 - RNA, 12 nt, Homo sapiens
aaugguucucau

SEQ ID NO: 2051670 - RNA, 16 nt, Homo sapiens
gacuuaagaagccuua

SEQ ID NO: 2051671 - RNA, 12 nt, Homo sapiens
aagccacacagc

SEQ ID NO: 2051672 - RNA, 12 nt, Homo sapiens
caaccacaaaac

SEQ ID NO: 2051673 - RNA, 12 nt, Homo sapiens
aagucacacagu

SEQ ID NO: 2051674 - RNA, 21 nt, Homo sapiens
aauucuuacccuguacauaug

SEQ ID NO: 2051675 - RNA, 15 nt, Homo sapiens
auaacagugcauauu

SEQ ID NO: 2051676 - RNA, 17 nt, Homo sapiens
ugcauccaggacugugc

SEQ ID NO: 2051677 - RNA, 15 nt, Homo sapiens
aguuuguuauguguc

SEQ ID NO: 2051678 - RNA, 18 nt, Homo sapiens
cuagcauucuaguuucau

SEQ ID NO: 2051679 - RNA, 15 nt, Homo sapiens
gguguuuaaagucaa

SEQ ID NO: 2051680 - RNA, 13 nt, Homo sapiens
uaacuuagaagga

SEQ ID NO: 2051681 - RNA, 15 nt, Homo sapiens
ucacucuguugccau

SEQ ID NO: 2051682 - RNA, 23 nt, Homo sapiens
aacguccuuccacuucaggguuc

SEQ ID NO: 2051683 - RNA, 20 nt, Homo sapiens
gcuggcaagucuuccaugac

SEQ ID NO: 2051684 - RNA, 22 nt, Homo sapiens
cacaaagugaggggaacagggu

SEQ ID NO: 2051685 - RNA, 21 nt, Homo sapiens
guccuaugucaauuuguauau

SEQ ID NO: 2051686 - RNA, 16 nt, Homo sapiens
uaggauggauugcagu

SEQ ID NO: 2051687 - RNA, 16 nt, Homo sapiens
ccccacccugcacuuu

SEQ ID NO: 2051688 - RNA, 13 nt, Homo sapiens
gggacuguuccaa

SEQ ID NO: 2051689 - RNA, 13 nt, Homo sapiens
uccuuugauauua

SEQ ID NO: 2051690 - RNA, 15 nt, Homo sapiens
ugugaaacacaugcc

SEQ ID NO: 2051691 - RNA, 12 nt, Homo sapiens
aauagcugcuag

SEQ ID NO: 2051692 - RNA, 19 nt, Homo sapiens
cuccccacugccuacugca

SEQ ID NO: 2051693 - RNA, 17 nt, Homo sapiens
uacaucucccagacucu

SEQ ID NO: 2051694 - RNA, 17 nt, Homo sapiens
uauucuugaagucagau

SEQ ID NO: 2051695 - RNA, 15 nt, Homo sapiens
uaacauacucauuua

SEQ ID NO: 2051696 - RNA, 16 nt, Homo sapiens
gaugccuucuccagac

SEQ ID NO: 2051697 - RNA, 23 nt, Homo sapiens
caggaaaggccccaaucuugccc

SEQ ID NO: 2051698 - RNA, 16 nt, Homo sapiens
cuaccugggcuucugg

SEQ ID NO: 2051699 - RNA, 18 nt, Homo sapiens
acacacacugucuggggc

SEQ ID NO: 2051700 - RNA, 21 nt, Homo sapiens
uugccaaggcuggagugcagu

SEQ ID NO: 2051701 - RNA, 10 nt, Homo sapiens
gggacucugc

SEQ ID NO: 2051702 - RNA, 13 nt, Homo sapiens
uuauuguaaucau

SEQ ID NO: 2051703 - RNA, 15 nt, Homo sapiens
cuggccuucuaggaa

SEQ ID NO: 2051704 - RNA, 18 nt, Homo sapiens
agcucauuuuuaaaggag

SEQ ID NO: 2051705 - RNA, 22 nt, Homo sapiens
cggugaugaggaaggacuugac

SEQ ID NO: 2051706 - RNA, 17 nt, Homo sapiens
aggcugguuuucuugua

SEQ ID NO: 2051707 - RNA, 16 nt, Homo sapiens
uaaucugagaggccac

SEQ ID NO: 2051708 - RNA, 18 nt, Homo sapiens
gcugucucucccuuccag

SEQ ID NO: 2051709 - RNA, 20 nt, Homo sapiens
uucagucacacacacauaca

SEQ ID NO: 2051710 - RNA, 19 nt, Homo sapiens
cggcaggugcucuguggau

SEQ ID NO: 2051711 - RNA, 13 nt, Homo sapiens
acggccccagcgc

SEQ ID NO: 2051712 - RNA, 21 nt, Homo sapiens
uccuauccuuggagagcagcu

SEQ ID NO: 2051713 - RNA, 16 nt, Homo sapiens
gcuggagcccagcauu

SEQ ID NO: 2051714 - RNA, 23 nt, Homo sapiens
aaagcacuuggacucuugcucuu

SEQ ID NO: 2051715 - RNA, 15 nt, Homo sapiens
gaccaacugggccca

SEQ ID NO: 2051716 - RNA, 13 nt, Homo sapiens
ggacuacaaccaa

SEQ ID NO: 2051717 - RNA, 17 nt, Homo sapiens
uagcuuaacacuaccaa

SEQ ID NO: 2051718 - RNA, 13 nt, Homo sapiens
gcaacugcugauc

SEQ ID NO: 2051719 - RNA, 18 nt, Homo sapiens
gaaaaggcugcugugaac

SEQ ID NO: 2051720 - RNA, 22 nt, Homo sapiens
aauguuucccucaagaacaaac

SEQ ID NO: 2051721 - RNA, 16 nt, Homo sapiens
aaaauccuacuuucau

SEQ ID NO: 2051722 - RNA, 18 nt, Homo sapiens
gcaguuaugugaccucac

SEQ ID NO: 2051723 - RNA, 18 nt, Homo sapiens
aauggacaauggacugua

SEQ ID NO: 2051724 - RNA, 20 nt, Homo sapiens
aguaagcaguguuacuugca

SEQ ID NO: 2051725 - RNA, 18 nt, Homo sapiens
acuuucccacgucacuug

SEQ ID NO: 2051726 - RNA, 23 nt, Homo sapiens
aaacaccguguuuucugacacag

SEQ ID NO: 2051727 - RNA, 18 nt, Homo sapiens
uucugcuggugaauaacu

SEQ ID NO: 2051728 - RNA, 22 nt, Homo sapiens
uugcuaaacgccacggagcuca

SEQ ID NO: 2051729 - RNA, 21 nt, Homo sapiens
uuuccuaaauuuuuacaucaa

SEQ ID NO: 2051730 - RNA, 16 nt, Homo sapiens
cagggagggccaggga

SEQ ID NO: 2051731 - RNA, 12 nt, Homo sapiens
cagucacauuca

SEQ ID NO: 2051732 - RNA, 12 nt, Homo sapiens
cagacacauucu

SEQ ID NO: 2051733 - RNA, 22 nt, Homo sapiens
ugucuauaucauaacuauacuu

SEQ ID NO: 2051734 - RNA, 22 nt, Homo sapiens
guagcuuuuuaccguucacuuc

SEQ ID NO: 2051735 - RNA, 17 nt, Homo sapiens
acuaguuuuuauuccuu

SEQ ID NO: 2051736 - RNA, 14 nt, Homo sapiens
gucuuuccaaaagu

SEQ ID NO: 2051737 - RNA, 19 nt, Homo sapiens
ucaacaaagcacaguguua

SEQ ID NO: 2051738 - RNA, 21 nt, Homo sapiens
caucugucuugucauuccagg

SEQ ID NO: 2051739 - RNA, 21 nt, Homo sapiens
aaauaucagugggcucucuua

SEQ ID NO: 2051740 - RNA, 17 nt, Homo sapiens
gcgagccauuuguccca

SEQ ID NO: 2051741 - RNA, 18 nt, Homo sapiens
augcagaaagcaucccuc

SEQ ID NO: 2051742 - RNA, 22 nt, Homo sapiens
agguuuugagauuuagagcaau

SEQ ID NO: 2051743 - RNA, 14 nt, Homo sapiens
aaucucagcacuuu

SEQ ID NO: 2051744 - RNA, 14 nt, Homo sapiens
auccccagcuuucu

SEQ ID NO: 2051745 - RNA, 22 nt, Homo sapiens
gcuacaccugaggcugaggcag

SEQ ID NO: 2051746 - RNA, 17 nt, Homo sapiens
uacuccucugacuggag

SEQ ID NO: 2051747 - RNA, 12 nt, Homo sapiens
ggccucugugau

SEQ ID NO: 2051748 - RNA, 22 nt, Homo sapiens
aggcuucaauuuauugcacaaa

SEQ ID NO: 2051749 - RNA, 13 nt, Homo sapiens
cuugucuacauau

SEQ ID NO: 2051750 - RNA, 20 nt, Homo sapiens
ucuuacuucccuaaugaagu

SEQ ID NO: 2051751 - RNA, 14 nt, Homo sapiens
acugugaguccuga

SEQ ID NO: 2051752 - RNA, 17 nt, Homo sapiens
cugacagcugucccugc

SEQ ID NO: 2051753 - RNA, 15 nt, Homo sapiens
agcaggaaaccugug

SEQ ID NO: 2051754 - RNA, 17 nt, Homo sapiens
ugaacuuggauauucaa

SEQ ID NO: 2051755 - RNA, 21 nt, Homo sapiens
caccaagugaggccauagcaa

SEQ ID NO: 2051756 - RNA, 13 nt, Homo sapiens
gccagagccuuaa

SEQ ID NO: 2051757 - RNA, 12 nt, Homo sapiens
gcacaaagaugg

SEQ ID NO: 2051758 - RNA, 19 nt, Homo sapiens
acgccacucauuucaucuc

SEQ ID NO: 2051759 - RNA, 15 nt, Homo sapiens
aacaucauaacccau

SEQ ID NO: 2051760 - RNA, 17 nt, Homo sapiens
gggauggaaauaacggg

SEQ ID NO: 2051761 - RNA, 21 nt, Homo sapiens
acacagggguggaguuucuga

SEQ ID NO: 2051762 - RNA, 16 nt, Homo sapiens
gaacaugaccaaaaac

SEQ ID NO: 2051763 - RNA, 23 nt, Homo sapiens
ccugagagauuuaacauuaucua

SEQ ID NO: 2051764 - RNA, 17 nt, Homo sapiens
cagaauaaauaugcuca

SEQ ID NO: 2051765 - RNA, 17 nt, Homo sapiens
cagaacacuuauguuau

SEQ ID NO: 2051766 - RNA, 12 nt, Homo sapiens
auuuauucacau

SEQ ID NO: 2051767 - RNA, 15 nt, Homo sapiens
ugcuuaccugugaga

SEQ ID NO: 2051768 - RNA, 23 nt, Homo sapiens
acagcuuccuguuacugagaugu

SEQ ID NO: 2051769 - RNA, 13 nt, Homo sapiens
uuuuaugucuaaa

SEQ ID NO: 2051770 - RNA, 18 nt, Homo sapiens
cugaucgacguggugacg

SEQ ID NO: 2051771 - RNA, 21 nt, Homo sapiens
gacugcugaaucaucauaucu

SEQ ID NO: 2051772 - RNA, 17 nt, Homo sapiens
cuuuaggaucucaggcu

SEQ ID NO: 2051773 - RNA, 18 nt, Homo sapiens
uguuuucauaauaccuca

SEQ ID NO: 2051774 - RNA, 17 nt, Homo sapiens
guccuguuuauugagac

SEQ ID NO: 2051775 - RNA, 13 nt, Homo sapiens
cagccguuuguuc

SEQ ID NO: 2051776 - RNA, 20 nt, Homo sapiens
uaauuccacagcugcucaau

SEQ ID NO: 2051777 - RNA, 18 nt, Homo sapiens
acuuuauguuacuacaug

SEQ ID NO: 2051778 - RNA, 13 nt, Homo sapiens
gaaagacucuuaa

SEQ ID NO: 2051779 - RNA, 19 nt, Homo sapiens
aaccacuaagagucucuau

SEQ ID NO: 2051780 - RNA, 17 nt, Homo sapiens
cuguaaaauacuucuuu

SEQ ID NO: 2051781 - RNA, 23 nt, Homo sapiens
uggaacucugugcaggugcugcc

SEQ ID NO: 2051782 - RNA, 15 nt, Homo sapiens
aaucagaacuaacca

SEQ ID NO: 2051783 - RNA, 17 nt, Homo sapiens
auuucacauuucuacuc

SEQ ID NO: 2051784 - RNA, 18 nt, Homo sapiens
uuccugaaaauugcaaua

SEQ ID NO: 2051785 - RNA, 20 nt, Homo sapiens
uagucaguaaagauauuuga

SEQ ID NO: 2051786 - RNA, 14 nt, Homo sapiens
ccaaggagccagug

SEQ ID NO: 2051787 - RNA, 15 nt, Homo sapiens
cucuguaauugaaua

SEQ ID NO: 2051788 - RNA, 17 nt, Homo sapiens
uggagaaggcauuccag

SEQ ID NO: 2051789 - RNA, 14 nt, Homo sapiens
gcucaccauggaau

SEQ ID NO: 2051790 - RNA, 22 nt, Homo sapiens
gcuauuuuaauaaagauucuau

SEQ ID NO: 2051791 - RNA, 20 nt, Homo sapiens
caccauagagacccauguca

SEQ ID NO: 2051792 - RNA, 18 nt, Homo sapiens
uuccuugacuauuacacu

SEQ ID NO: 2051793 - RNA, 20 nt, Homo sapiens
ccuuagccaggaggccaggc

SEQ ID NO: 2051794 - RNA, 21 nt, Homo sapiens
uuuugaugacuucagugaaau

SEQ ID NO: 2051795 - RNA, 22 nt, Homo sapiens
augggauuucauguaaccaaga

SEQ ID NO: 2051796 - RNA, 17 nt, Homo sapiens
cacucuauuaaaucuug

SEQ ID NO: 2051797 - RNA, 12 nt, Homo sapiens
augcuagugaua

SEQ ID NO: 2051798 - RNA, 14 nt, Homo sapiens
ccugguccaucuca

SEQ ID NO: 2051799 - RNA, 15 nt, Homo sapiens
auugacagcauauag

SEQ ID NO: 2051800 - RNA, 18 nt, Homo sapiens
gcagccccaucugugcau

SEQ ID NO: 2051801 - RNA, 9 nt, Homo sapiens
cgcucugau

SEQ ID NO: 2051802 - RNA, 21 nt, Homo sapiens
cuguggacguggguugcacug

SEQ ID NO: 2051803 - RNA, 20 nt, Homo sapiens
auuuuuuuuaacauuccaau

SEQ ID NO: 2051804 - RNA, 23 nt, Homo sapiens
gccuauagcagaagcacauuuuc

SEQ ID NO: 2051805 - RNA, 14 nt, Homo sapiens
cauuuccuacccuu

SEQ ID NO: 2051806 - RNA, 20 nt, Homo sapiens
acguggcaccuccucggcug

SEQ ID NO: 2051807 - RNA, 19 nt, Homo sapiens
uguguccaagugugugugc

SEQ ID NO: 2051808 - RNA, 15 nt, Homo sapiens
gacagcuuugcugcu

SEQ ID NO: 2051809 - RNA, 20 nt, Homo sapiens
auugagauaaugauacuuaa

SEQ ID NO: 2051810 - RNA, 22 nt, Homo sapiens
uuaugaccaugguauauuccua

SEQ ID NO: 2051811 - RNA, 19 nt, Homo sapiens
gacacccucuggggguccu

SEQ ID NO: 2051812 - RNA, 22 nt, Homo sapiens
guuacuauuuucuacaauuaau

SEQ ID NO: 2051813 - RNA, 17 nt, Homo sapiens
aauacaggcaugaacca

SEQ ID NO: 2051814 - RNA, 19 nt, Homo sapiens
cuugacagaaagcaguucu

SEQ ID NO: 2051815 - RNA, 19 nt, Homo sapiens
cuauccagccgcaaaucca

SEQ ID NO: 2051816 - RNA, 15 nt, Homo sapiens
cucacucacucuggg

SEQ ID NO: 2051817 - RNA, 17 nt, Homo sapiens
aagcccauucauuccau

SEQ ID NO: 2051818 - RNA, 22 nt, Homo sapiens
aaagaaacguacuuaacugugu

SEQ ID NO: 2051819 - RNA, 16 nt, Homo sapiens
ucuuuauguaaucuau

SEQ ID NO: 2051820 - RNA, 15 nt, Homo sapiens
ucccuugagugaggc

SEQ ID NO: 2051821 - RNA, 18 nt, Homo sapiens
cuagacuucugaguaauu

SEQ ID NO: 2051822 - RNA, 12 nt, Homo sapiens
ugcucagugucu

SEQ ID NO: 2051823 - RNA, 17 nt, Homo sapiens
auaugaagaccaaauga

SEQ ID NO: 2051824 - RNA, 16 nt, Homo sapiens
aacuucuccccauuuc

SEQ ID NO: 2051825 - RNA, 21 nt, Homo sapiens
cagauuuucuaagaaccaaaa

SEQ ID NO: 2051826 - RNA, 22 nt, Homo sapiens
ugaaguuguguuaacaaugcag

SEQ ID NO: 2051827 - RNA, 18 nt, Homo sapiens
aaaauggcagugguggcc

SEQ ID NO: 2051828 - RNA, 15 nt, Homo sapiens
acauagaaagccaug

SEQ ID NO: 2051829 - RNA, 16 nt, Homo sapiens
gaaagucaccaggacu

SEQ ID NO: 2051830 - RNA, 21 nt, Homo sapiens
uuuuaucuuuaaucuccucuu

SEQ ID NO: 2051831 - RNA, 20 nt, Homo sapiens
gaaaaccgaguaucuggccu

SEQ ID NO: 2051832 - RNA, 18 nt, Homo sapiens
aaguacuuuccaaucuca

SEQ ID NO: 2051833 - RNA, 23 nt, Homo sapiens
ggaagaaccuguagaagaugacc

SEQ ID NO: 2051834 - RNA, 18 nt, Homo sapiens
gacacaugccagggccau

SEQ ID NO: 2051835 - RNA, 16 nt, Homo sapiens
acauuacugauuucca

SEQ ID NO: 2051836 - RNA, 16 nt, Homo sapiens
ucccuggcuacuuccc

SEQ ID NO: 2051837 - RNA, 23 nt, Homo sapiens
ggccuggaccugcccugggccac

SEQ ID NO: 2051838 - RNA, 19 nt, Homo sapiens
agcucuuuguucaguugac

SEQ ID NO: 2051839 - RNA, 19 nt, Homo sapiens
acucccaagucuacagagu

SEQ ID NO: 2051840 - RNA, 23 nt, Homo sapiens
uuacgcccuguucccuuccugcc

SEQ ID NO: 2051841 - RNA, 14 nt, Homo sapiens
uuugcuaacugguu

SEQ ID NO: 2051842 - RNA, 19 nt, Homo sapiens
ucacuaauucauuaaucug

SEQ ID NO: 2051843 - RNA, 17 nt, Homo sapiens
aacuuuuugcaugcuua

SEQ ID NO: 2051844 - RNA, 23 nt, Homo sapiens
ccccaaacauuaaucaccaaagu

SEQ ID NO: 2051845 - RNA, 18 nt, Homo sapiens
auaaaacuaugcuauuaa

SEQ ID NO: 2051846 - RNA, 14 nt, Homo sapiens
ugauaaacaguuuc

SEQ ID NO: 2051847 - RNA, 21 nt, Homo sapiens
gcuccaugcagaucuagccag

SEQ ID NO: 2051848 - RNA, 16 nt, Homo sapiens
caaaugcuauuugaua

SEQ ID NO: 2051849 - RNA, 16 nt, Homo sapiens
ugaaucccgacucuga

SEQ ID NO: 2051850 - RNA, 20 nt, Homo sapiens
aggcacccaccacaucuggc

SEQ ID NO: 2051851 - RNA, 17 nt, Homo sapiens
cacacgcugucucuuga

SEQ ID NO: 2051852 - RNA, 23 nt, Homo sapiens
ucugugucaaggugaagcacaua

SEQ ID NO: 2051853 - RNA, 17 nt, Homo sapiens
auaaucuuagagacaaa

SEQ ID NO: 2051854 - RNA, 12 nt, Homo sapiens
accucuuccuuc

SEQ ID NO: 2051855 - RNA, 17 nt, Homo sapiens
agcuccuaguagcuuuc

SEQ ID NO: 2051856 - RNA, 17 nt, Homo sapiens
cagagacggaagccuuu

SEQ ID NO: 2051857 - RNA, 17 nt, Homo sapiens
uguccugccuugaugaa

SEQ ID NO: 2051858 - RNA, 15 nt, Homo sapiens
gauauaagaaauaca

SEQ ID NO: 2051859 - RNA, 20 nt, Homo sapiens
uguuuucuugccaaugaggu

SEQ ID NO: 2051860 - RNA, 17 nt, Homo sapiens
caaauuuuuacugagaa

SEQ ID NO: 2051861 - RNA, 20 nt, Homo sapiens
uaauuaacuguaaacuugga

SEQ ID NO: 2051862 - RNA, 20 nt, Homo sapiens
gacgcauuguauauaauaua

SEQ ID NO: 2051863 - RNA, 21 nt, Homo sapiens
aaugcacaaauugaaaacaca

SEQ ID NO: 2051864 - RNA, 16 nt, Homo sapiens
cugaccucccagugac

SEQ ID NO: 2051865 - RNA, 13 nt, Homo sapiens
cugcagccaguca

SEQ ID NO: 2051866 - RNA, 15 nt, Homo sapiens
aucuguucacuuuca

SEQ ID NO: 2051867 - RNA, 15 nt, Homo sapiens
auuauuucaccagca

SEQ ID NO: 2051868 - RNA, 16 nt, Homo sapiens
gcccaugugcaccugc

SEQ ID NO: 2051869 - RNA, 15 nt, Homo sapiens
agaccauaauguuac

SEQ ID NO: 2051870 - RNA, 16 nt, Homo sapiens
aggcagccugccuuua

SEQ ID NO: 2051871 - RNA, 17 nt, Homo sapiens
agcauguuucacagugg

SEQ ID NO: 2051872 - RNA, 17 nt, Homo sapiens
aguugccuaagcauugc

SEQ ID NO: 2051873 - RNA, 14 nt, Homo sapiens
ugacacauaaaagu

SEQ ID NO: 2051874 - RNA, 21 nt, Homo sapiens
guuggccgugguccagcucuu

SEQ ID NO: 2051875 - RNA, 23 nt, Homo sapiens
cauucauaggcaguaauguuccu

SEQ ID NO: 2051876 - RNA, 18 nt, Homo sapiens
gcuggagagcacugccag

SEQ ID NO: 2051877 - RNA, 21 nt, Homo sapiens
cuugcuccacagggcccuguu

SEQ ID NO: 2051878 - RNA, 15 nt, Homo sapiens
acggaggccagacac

SEQ ID NO: 2051879 - RNA, 24 nt, Homo sapiens
caauauuaagucauuguuucccau

SEQ ID NO: 2051880 - RNA, 14 nt, Homo sapiens
ucaggagcugcuaa

SEQ ID NO: 2051881 - RNA, 23 nt, Homo sapiens
uuuuaaaaaagauggauuugaca

SEQ ID NO: 2051882 - RNA, 21 nt, Homo sapiens
aagauauccacuuaccugagu

SEQ ID NO: 2051883 - RNA, 15 nt, Homo sapiens
caucuggaaucugga

SEQ ID NO: 2051884 - RNA, 19 nt, Homo sapiens
agguacaaguaaagcccag

SEQ ID NO: 2051885 - RNA, 17 nt, Homo sapiens
guccacaggaagugaag

SEQ ID NO: 2051886 - RNA, 14 nt, Homo sapiens
gucaacuaugauau

SEQ ID NO: 2051887 - RNA, 17 nt, Homo sapiens
agcuaagcugcaggcac

SEQ ID NO: 2051888 - RNA, 17 nt, Homo sapiens
ugguuauuucugugcaa

SEQ ID NO: 2051889 - RNA, 15 nt, Homo sapiens
auggaauaaagcccu

SEQ ID NO: 2051890 - RNA, 18 nt, Homo sapiens
uaccuucuguaguuuuau

SEQ ID NO: 2051891 - RNA, 21 nt, Homo sapiens
uaguguccuuuucucauuugu

SEQ ID NO: 2051892 - RNA, 15 nt, Homo sapiens
ucuaaccuuucuaac

SEQ ID NO: 2051893 - RNA, 18 nt, Homo sapiens
uugucucguguacagcuc

SEQ ID NO: 2051894 - RNA, 15 nt, Homo sapiens
auccccucucuuccu

SEQ ID NO: 2051895 - RNA, 15 nt, Homo sapiens
auucucccuccuucc

SEQ ID NO: 2051896 - RNA, 15 nt, Homo sapiens
cuucugcaacugaaa

SEQ ID NO: 2051897 - RNA, 22 nt, Homo sapiens
uguaacuacccucucaaaugga

SEQ ID NO: 2051898 - RNA, 15 nt, Homo sapiens
aaguuucucagcucc

SEQ ID NO: 2051899 - RNA, 13 nt, Homo sapiens
cucuacucuggaa

SEQ ID NO: 2051900 - RNA, 18 nt, Homo sapiens
accccucucugcaucuga

SEQ ID NO: 2051901 - RNA, 22 nt, Homo sapiens
augcuacccgagguuugcaaau

SEQ ID NO: 2051902 - RNA, 13 nt, Homo sapiens
cacaaauucaugu

SEQ ID NO: 2051903 - RNA, 14 nt, Homo sapiens
ugugcugaccaaag

SEQ ID NO: 2051904 - RNA, 11 nt, Homo sapiens
uucaaucucaa

SEQ ID NO: 2051905 - RNA, 12 nt, Homo sapiens
auauccacagac

SEQ ID NO: 2051906 - RNA, 20 nt, Homo sapiens
aguaaucccccuugccaaau

SEQ ID NO: 2051907 - RNA, 20 nt, Homo sapiens
auccucuugccaccguccca

SEQ ID NO: 2051908 - RNA, 13 nt, Homo sapiens
gacacugcuuuaa

SEQ ID NO: 2051909 - RNA, 16 nt, Homo sapiens
aaaagauuuaacaaau

SEQ ID NO: 2051910 - RNA, 17 nt, Homo sapiens
gagcugucuugucaucu

SEQ ID NO: 2051911 - RNA, 22 nt, Homo sapiens
cuucccgccagagggcuuguga

SEQ ID NO: 2051912 - RNA, 12 nt, Homo sapiens
cauguuuuccag

SEQ ID NO: 2051913 - RNA, 13 nt, Homo sapiens
uggaauucugcuu

SEQ ID NO: 2051914 - RNA, 22 nt, Homo sapiens
aacugauuaaauaauacauuua

SEQ ID NO: 2051915 - RNA, 17 nt, Homo sapiens
uggaauucuacuggaaa

SEQ ID NO: 2051916 - RNA, 20 nt, Homo sapiens
uaccuuccccagacuugcac

SEQ ID NO: 2051917 - RNA, 14 nt, Homo sapiens
ccugagccagagac

SEQ ID NO: 2051918 - RNA, 12 nt, Homo sapiens
uauacuaugaaa

SEQ ID NO: 2051919 - RNA, 23 nt, Homo sapiens
uccaaacauguaucucuaaugaa

SEQ ID NO: 2051920 - RNA, 15 nt, Homo sapiens
uugguagaugacaaa

SEQ ID NO: 2051921 - RNA, 13 nt, Homo sapiens
ucacaugugaaaa

SEQ ID NO: 2051922 - RNA, 13 nt, Homo sapiens
uaaacugugcacc

SEQ ID NO: 2051923 - RNA, 21 nt, Homo sapiens
ucuaguuuuaugcgacagcuu

SEQ ID NO: 2051924 - RNA, 13 nt, Homo sapiens
aaucucagcacuu

SEQ ID NO: 2051925 - RNA, 19 nt, Homo sapiens
uucugcaggcuguauggga

SEQ ID NO: 2051926 - RNA, 23 nt, Homo sapiens
gauguguccaaucggagacaaaa

SEQ ID NO: 2051927 - RNA, 22 nt, Homo sapiens
cugauuaaugauuguuugucaa

SEQ ID NO: 2051928 - RNA, 13 nt, Homo sapiens
cucaaaucuccag

SEQ ID NO: 2051929 - RNA, 20 nt, Homo sapiens
uucaacaacuacuacuugau

SEQ ID NO: 2051930 - RNA, 19 nt, Homo sapiens
cggagggaggacaucauaa

SEQ ID NO: 2051931 - RNA, 16 nt, Homo sapiens
uaagaugaaaggagaa

SEQ ID NO: 2051932 - RNA, 21 nt, Homo sapiens
aauggcuaagcaaaaugugau

SEQ ID NO: 2051933 - RNA, 20 nt, Homo sapiens
cacaguggcaaaacaaaagu

SEQ ID NO: 2051934 - RNA, 13 nt, Homo sapiens
caugggguuuugg

SEQ ID NO: 2051935 - RNA, 18 nt, Homo sapiens
uccaugagggacuccucc

SEQ ID NO: 2051936 - RNA, 18 nt, Homo sapiens
uacucaagugucuaccug

SEQ ID NO: 2051937 - RNA, 19 nt, Homo sapiens
cauguucaccaagauuugg

SEQ ID NO: 2051938 - RNA, 13 nt, Homo sapiens
cucuaacugaugu

SEQ ID NO: 2051939 - RNA, 21 nt, Homo sapiens
uuauauauuuuucugagauuu

SEQ ID NO: 2051940 - RNA, 22 nt, Homo sapiens
uaaaguauguccuucagcugac

SEQ ID NO: 2051941 - RNA, 14 nt, Homo sapiens
aauguaaagccagc

SEQ ID NO: 2051942 - RNA, 16 nt, Homo sapiens
cucccacgugcacagc

SEQ ID NO: 2051943 - RNA, 19 nt, Homo sapiens
ugauguguuuacauuuacu

SEQ ID NO: 2051944 - RNA, 18 nt, Homo sapiens
cacugaaaacaucuggaa

SEQ ID NO: 2051945 - RNA, 19 nt, Homo sapiens
agacaggaggucagcacaa

SEQ ID NO: 2051946 - RNA, 13 nt, Homo sapiens
auaacaagccaaa

SEQ ID NO: 2051947 - RNA, 13 nt, Homo sapiens
acuuaaagcuuuc

SEQ ID NO: 2051948 - RNA, 16 nt, Homo sapiens
gugaccaauacauuug

SEQ ID NO: 2051949 - RNA, 22 nt, Homo sapiens
cauaaacacccaugaaucaaag

SEQ ID NO: 2051950 - RNA, 23 nt, Homo sapiens
cauaagacaaacuccugaaaugc

SEQ ID NO: 2051951 - RNA, 17 nt, Homo sapiens
uaucaaggcugacuugu

SEQ ID NO: 2051952 - RNA, 16 nt, Homo sapiens
cucacucccuguuuua

SEQ ID NO: 2051953 - RNA, 15 nt, Homo sapiens
uggcuccgcaggggu

SEQ ID NO: 2051954 - RNA, 17 nt, Homo sapiens
gaagcagaaauguacuu

SEQ ID NO: 2051955 - RNA, 17 nt, Homo sapiens
caccuuugucgcugggu

SEQ ID NO: 2051956 - RNA, 16 nt, Homo sapiens
uacaauauguacauuu

SEQ ID NO: 2051957 - RNA, 14 nt, Homo sapiens
agaguuccuucuca

SEQ ID NO: 2051958 - RNA, 15 nt, Homo sapiens
aacuugcuuucacuu

SEQ ID NO: 2051959 - RNA, 21 nt, Homo sapiens
cugaauuaaagucuacacugc

SEQ ID NO: 2051960 - RNA, 15 nt, Homo sapiens
agacucugguguucu

SEQ ID NO: 2051961 - RNA, 13 nt, Homo sapiens
aucuugcauguaa

SEQ ID NO: 2051962 - RNA, 16 nt, Homo sapiens
auucacauuugaugua

SEQ ID NO: 2051963 - RNA, 16 nt, Homo sapiens
uaaggcauagggaaua

SEQ ID NO: 2051964 - RNA, 13 nt, Homo sapiens
ugcccagugcacu

SEQ ID NO: 2051965 - RNA, 22 nt, Homo sapiens
ucuccugugaugucccaguuuc

SEQ ID NO: 2051966 - RNA, 12 nt, Homo sapiens
uauaaaccugga

SEQ ID NO: 2051967 - RNA, 21 nt, Homo sapiens
uauaauaaaaagcuucaggga

SEQ ID NO: 2051968 - RNA, 21 nt, Homo sapiens
acauagauuaauggcacugau

SEQ ID NO: 2051969 - RNA, 16 nt, Homo sapiens
caaaacaagugcaaga

SEQ ID NO: 2051970 - RNA, 14 nt, Homo sapiens
ugugucaccccaga

SEQ ID NO: 2051971 - RNA, 13 nt, Homo sapiens
ucugccacccacu

SEQ ID NO: 2051972 - RNA, 16 nt, Homo sapiens
gggacugagagacagg

SEQ ID NO: 2051973 - RNA, 13 nt, Homo sapiens
agcagcacuguga

SEQ ID NO: 2051974 - RNA, 16 nt, Homo sapiens
caucccuacuuuucaa

SEQ ID NO: 2051975 - RNA, 16 nt, Homo sapiens
auucucaaaauuccua

SEQ ID NO: 2051976 - RNA, 12 nt, Homo sapiens
aaggauugcaau

SEQ ID NO: 2051977 - RNA, 22 nt, Homo sapiens
uuccucaccuuguaaccagugc

SEQ ID NO: 2051978 - RNA, 20 nt, Homo sapiens
uguaucaauaaaauacuuug

SEQ ID NO: 2051979 - RNA, 13 nt, Homo sapiens
uaaaaaucuaccu

SEQ ID NO: 2051980 - RNA, 23 nt, Homo sapiens
aaugguauuuucuagacugugaa

SEQ ID NO: 2051981 - RNA, 17 nt, Homo sapiens
gucaugugguacuugag

SEQ ID NO: 2051982 - RNA, 16 nt, Homo sapiens
gaacacaaaacauuua

SEQ ID NO: 2051983 - RNA, 15 nt, Homo sapiens
agcccucaggccagu

SEQ ID NO: 2051984 - RNA, 17 nt, Homo sapiens
uauaucuauaguaguca

SEQ ID NO: 2051985 - RNA, 21 nt, Homo sapiens
ccaugcucucuguggccucca

SEQ ID NO: 2051986 - RNA, 22 nt, Homo sapiens
acccgguccugcccuuccugaa

SEQ ID NO: 2051987 - RNA, 21 nt, Homo sapiens
agacaaccuugucccaaggaa

SEQ ID NO: 2051988 - RNA, 15 nt, Homo sapiens
gcaacuucaucccag

SEQ ID NO: 2051989 - RNA, 16 nt, Homo sapiens
ccucucggugcuccau

SEQ ID NO: 2051990 - RNA, 18 nt, Homo sapiens
ccuggagcaagcucugcc

SEQ ID NO: 2051991 - RNA, 19 nt, Homo sapiens
ggagcaaauaucuaaauaa

SEQ ID NO: 2051992 - RNA, 20 nt, Homo sapiens
ccuagauuccauacagugac

SEQ ID NO: 2051993 - RNA, 16 nt, Homo sapiens
aauugaugauccauua

SEQ ID NO: 2051994 - RNA, 20 nt, Homo sapiens
acacaugcuauguucugucu

SEQ ID NO: 2051995 - RNA, 17 nt, Homo sapiens
ucuuuaaagacuugaug

SEQ ID NO: 2051996 - RNA, 17 nt, Homo sapiens
acuuuguuuacuuauaa

SEQ ID NO: 2051997 - RNA, 18 nt, Homo sapiens
cauuaaaaagugggcaaa

SEQ ID NO: 2051998 - RNA, 20 nt, Homo sapiens
augucauuuugguacuuugg

SEQ ID NO: 2051999 - RNA, 21 nt, Homo sapiens
ggagacugaccaucaugcccu

SEQ ID NO: 2052000 - RNA, 22 nt, Homo sapiens
ccaaacuuauagcgcugaccaa

SEQ ID NO: 2052001 - RNA, 16 nt, Homo sapiens
agccugaggcucaggc

SEQ ID NO: 2052002 - RNA, 18 nt, Homo sapiens
uucaggagcgcaagauag

SEQ ID NO: 2052003 - RNA, 15 nt, Homo sapiens
acaucaugcauucac

SEQ ID NO: 2052004 - RNA, 11 nt, Homo sapiens
uagcuguucua

SEQ ID NO: 2052005 - RNA, 23 nt, Homo sapiens
auguacagacauacauuuaugca

SEQ ID NO: 2052006 - RNA, 18 nt, Homo sapiens
gccuccaaggggcuuugu

SEQ ID NO: 2052007 - RNA, 17 nt, Homo sapiens
aguaugugugcucuuau

SEQ ID NO: 2052008 - RNA, 21 nt, Homo sapiens
uguggggagggauuuggggcu

SEQ ID NO: 2052009 - RNA, 14 nt, Homo sapiens
aauuaucugggcau

SEQ ID NO: 2052010 - RNA, 22 nt, Homo sapiens
ugggcaaagcugugcacuugca

SEQ ID NO: 2052011 - RNA, 21 nt, Homo sapiens
uaguauuccuaaccugucaga

SEQ ID NO: 2052012 - RNA, 21 nt, Homo sapiens
cuguguugccaagcuccaagc

SEQ ID NO: 2052013 - RNA, 20 nt, Homo sapiens
acuaccuuuauagcucucau

SEQ ID NO: 2052014 - RNA, 19 nt, Homo sapiens
guaauaggaagaacaguac

SEQ ID NO: 2052015 - RNA, 16 nt, Homo sapiens
agcucagacaucuacu

SEQ ID NO: 2052016 - RNA, 15 nt, Homo sapiens
aaagcguccucucag

SEQ ID NO: 2052017 - RNA, 14 nt, Homo sapiens
ccacacuucuugaa

SEQ ID NO: 2052018 - RNA, 19 nt, Homo sapiens
cucuacugcaagacuuaaa

SEQ ID NO: 2052019 - RNA, 19 nt, Homo sapiens
uauccuagucauucuuccc

SEQ ID NO: 2052020 - RNA, 14 nt, Homo sapiens
aaauggcaugacau

SEQ ID NO: 2052021 - RNA, 13 nt, Homo sapiens
guuuuuucuccag

SEQ ID NO: 2052022 - RNA, 13 nt, Homo sapiens
accacaagagcuc

SEQ ID NO: 2052023 - RNA, 19 nt, Homo sapiens
caauaguguccuaugcaau

SEQ ID NO: 2052024 - RNA, 20 nt, Homo sapiens
gauggacaucuugucauuuu

SEQ ID NO: 2052025 - RNA, 17 nt, Homo sapiens
uuccacuaugagcugcu

SEQ ID NO: 2052026 - RNA, 12 nt, Homo sapiens
cuuaaacugcca

SEQ ID NO: 2052027 - RNA, 19 nt, Homo sapiens
cuacauauugaauagggcu

SEQ ID NO: 2052028 - RNA, 22 nt, Homo sapiens
cucaaagacaauguuauuuucc

SEQ ID NO: 2052029 - RNA, 14 nt, Homo sapiens
guuguguguggaag

SEQ ID NO: 2052030 - RNA, 14 nt, Homo sapiens
guggaauguguaua

SEQ ID NO: 2052031 - RNA, 19 nt, Homo sapiens
agagugcuccuguauugaa

SEQ ID NO: 2052032 - RNA, 22 nt, Homo sapiens
uugcagaagcaaucgggauaaa

SEQ ID NO: 2052033 - RNA, 13 nt, Homo sapiens
cucucacacuggc

SEQ ID NO: 2052034 - RNA, 18 nt, Homo sapiens
auuaaaauuaaauacuuu

SEQ ID NO: 2052035 - RNA, 23 nt, Homo sapiens
acuggauguuucucauguagaac

SEQ ID NO: 2052036 - RNA, 15 nt, Homo sapiens
aagaauaauaauuaa

SEQ ID NO: 2052037 - RNA, 16 nt, Homo sapiens
gcaucuaagacauuca

SEQ ID NO: 2052038 - RNA, 16 nt, Homo sapiens
auuaaacugugaaugu

SEQ ID NO: 2052039 - RNA, 15 nt, Homo sapiens
guauauggugauuca

SEQ ID NO: 2052040 - RNA, 19 nt, Homo sapiens
augauaaauuugacuguua

SEQ ID NO: 2052041 - RNA, 21 nt, Homo sapiens
ccgcucugauuucaggcagca

SEQ ID NO: 2052042 - RNA, 19 nt, Homo sapiens
gugguuauuuuacauuaag

SEQ ID NO: 2052043 - RNA, 21 nt, Homo sapiens
uauaauaguagauuugaacag

SEQ ID NO: 2052044 - RNA, 23 nt, Homo sapiens
cagaagcaguugagucgucauca

SEQ ID NO: 2052045 - RNA, 15 nt, Homo sapiens
aggacuuguuucccu

SEQ ID NO: 2052046 - RNA, 16 nt, Homo sapiens
aagaugggaacacugg

SEQ ID NO: 2052047 - RNA, 18 nt, Homo sapiens
ccaacacuuccagcauuu

SEQ ID NO: 2052048 - RNA, 15 nt, Homo sapiens
accuacccuguccua

SEQ ID NO: 2052049 - RNA, 18 nt, Homo sapiens
cggaaggucccucagaca

SEQ ID NO: 2052050 - RNA, 20 nt, Homo sapiens
ccaacugcaaaaaaagccuc

SEQ ID NO: 2052051 - RNA, 19 nt, Homo sapiens
cuaacaguugccacaucac

SEQ ID NO: 2052052 - RNA, 19 nt, Homo sapiens
accgggaaaagggaaccau

SEQ ID NO: 2052053 - RNA, 22 nt, Homo sapiens
ucuguacaucagacaauugcau

SEQ ID NO: 2052054 - RNA, 16 nt, Homo sapiens
ucaacugaguucagga

SEQ ID NO: 2052055 - RNA, 18 nt, Homo sapiens
caugccuaauguuaguua

SEQ ID NO: 2052056 - RNA, 11 nt, Homo sapiens
ugaaugcuauu

SEQ ID NO: 2052057 - RNA, 14 nt, Homo sapiens
aaaaagaacuguau

SEQ ID NO: 2052058 - RNA, 16 nt, Homo sapiens
aguuugcugcaaccca

SEQ ID NO: 2052059 - RNA, 14 nt, Homo sapiens
cugcacauuacaug

SEQ ID NO: 2052060 - RNA, 16 nt, Homo sapiens
cucaggguucaucugu

SEQ ID NO: 2052061 - RNA, 18 nt, Homo sapiens
uuauuagaacauucacuu

SEQ ID NO: 2052062 - RNA, 10 nt, Homo sapiens
ccccaccaga

SEQ ID NO: 2052063 - RNA, 15 nt, Homo sapiens
cuaugugauguuaac

SEQ ID NO: 2052064 - RNA, 22 nt, Homo sapiens
uccagugauccucaaacacaca

SEQ ID NO: 2052065 - RNA, 12 nt, Homo sapiens
gcucuggaagac

SEQ ID NO: 2052066 - RNA, 18 nt, Homo sapiens
cauuucauauaaauggaa

SEQ ID NO: 2052067 - RNA, 15 nt, Homo sapiens
ccuuuuaacucaccu

SEQ ID NO: 2052068 - RNA, 19 nt, Homo sapiens
aaaucagauuuucuccugu

SEQ ID NO: 2052069 - RNA, 16 nt, Homo sapiens
cauagcugacuacaaa

SEQ ID NO: 2052070 - RNA, 15 nt, Homo sapiens
gcuucuuucauuuuc

SEQ ID NO: 2052071 - RNA, 15 nt, Homo sapiens
ugguauugcagagaa

SEQ ID NO: 2052072 - RNA, 15 nt, Homo sapiens
gacacaucaguuaua

SEQ ID NO: 2052073 - RNA, 16 nt, Homo sapiens
ucaaaacacucaucuc

SEQ ID NO: 2052074 - RNA, 16 nt, Homo sapiens
cucaccaacccagaga

SEQ ID NO: 2052075 - RNA, 16 nt, Homo sapiens
ugcuuucauauuuucc

SEQ ID NO: 2052076 - RNA, 12 nt, Homo sapiens
gcccaucucaac

SEQ ID NO: 2052077 - RNA, 21 nt, Homo sapiens
gucuuucacuggaaugaagac

SEQ ID NO: 2052078 - RNA, 22 nt, Homo sapiens
uucuuaauggggacgagcagac

SEQ ID NO: 2052079 - RNA, 17 nt, Homo sapiens
cauuuuuucccagugag

SEQ ID NO: 2052080 - RNA, 12 nt, Homo sapiens
gugcacugggca

SEQ ID NO: 2052081 - RNA, 19 nt, Homo sapiens
acaucaaagugguaaauac

SEQ ID NO: 2052082 - RNA, 16 nt, Homo sapiens
uaauaagaauuuggag

SEQ ID NO: 2052083 - RNA, 22 nt, Homo sapiens
ucuccagcuggaucccagggaa

SEQ ID NO: 2052084 - RNA, 17 nt, Homo sapiens
ugggaugccucaccaca

SEQ ID NO: 2052085 - RNA, 22 nt, Homo sapiens
gccaggaacuguguguguugca

SEQ ID NO: 2052086 - RNA, 17 nt, Homo sapiens
gccucuuguacaguuaa

SEQ ID NO: 2052087 - RNA, 20 nt, Homo sapiens
cauacaacauauacuuccau

SEQ ID NO: 2052088 - RNA, 12 nt, Homo sapiens
acucuagugcca

SEQ ID NO: 2052089 - RNA, 21 nt, Homo sapiens
auucuuccucccauucaggau

SEQ ID NO: 2052090 - RNA, 13 nt, Homo sapiens
accugauucucac

SEQ ID NO: 2052091 - RNA, 22 nt, Homo sapiens
uucugcucugguuagaaaaagg

SEQ ID NO: 2052092 - RNA, 13 nt, Homo sapiens
aggacauucacca

SEQ ID NO: 2052093 - RNA, 22 nt, Homo sapiens
aauucucccagcguuaacacaa

SEQ ID NO: 2052094 - RNA, 13 nt, Homo sapiens
gugccugcugcug

SEQ ID NO: 2052095 - RNA, 17 nt, Homo sapiens
cagugagaagcugaggc

SEQ ID NO: 2052096 - RNA, 20 nt, Homo sapiens
caaaugcuuuggacuuuuga

SEQ ID NO: 2052097 - RNA, 15 nt, Homo sapiens
auuucauuaucacau

SEQ ID NO: 2052098 - RNA, 20 nt, Homo sapiens
augcggcccaggauggcuuu

SEQ ID NO: 2052099 - RNA, 14 nt, Homo sapiens
uggaccugagcuau

SEQ ID NO: 2052100 - RNA, 16 nt, Homo sapiens
uacccaaauauguuua

SEQ ID NO: 2052101 - RNA, 14 nt, Homo sapiens
uuugacugucagca

SEQ ID NO: 2052102 - RNA, 13 nt, Homo sapiens
uaaaagucuacca

SEQ ID NO: 2052103 - RNA, 21 nt, Homo sapiens
ucauuggacccugacuguaua

SEQ ID NO: 2052104 - RNA, 13 nt, Homo sapiens
uuaaagucuucca

SEQ ID NO: 2052105 - RNA, 20 nt, Homo sapiens
aauguuauccucuugcuaua

SEQ ID NO: 2052106 - RNA, 17 nt, Homo sapiens
uauccagaacaauaagc

SEQ ID NO: 2052107 - RNA, 22 nt, Homo sapiens
cagguggccucccuccagagac

SEQ ID NO: 2052108 - RNA, 16 nt, Homo sapiens
cccaucuuaucaagga

SEQ ID NO: 2052109 - RNA, 12 nt, Homo sapiens
uaaaugugaaug

SEQ ID NO: 2052110 - RNA, 17 nt, Homo sapiens
auaaacauaaguugcau

SEQ ID NO: 2052111 - RNA, 22 nt, Homo sapiens
ccuggagaguaucugagaacca

SEQ ID NO: 2052112 - RNA, 18 nt, Homo sapiens
aauaauucaugauucaac

SEQ ID NO: 2052113 - RNA, 13 nt, Homo sapiens
cacugcaagaagu

SEQ ID NO: 2052114 - RNA, 22 nt, Homo sapiens
ugccucacaucagcccugugua

SEQ ID NO: 2052115 - RNA, 18 nt, Homo sapiens
auaggcauuucacaaaaa

SEQ ID NO: 2052116 - RNA, 19 nt, Homo sapiens
aaaaugauuuuuaacauua

SEQ ID NO: 2052117 - RNA, 21 nt, Homo sapiens
agaaguggcauaaaugucuaa

SEQ ID NO: 2052118 - RNA, 14 nt, Homo sapiens
ugcaucauuuacaa

SEQ ID NO: 2052119 - RNA, 16 nt, Homo sapiens
uugcuucagacaugua

SEQ ID NO: 2052120 - RNA, 19 nt, Homo sapiens
agccgaagggcaauaucua

SEQ ID NO: 2052121 - RNA, 14 nt, Homo sapiens
ucaauacuaccucu

SEQ ID NO: 2052122 - RNA, 16 nt, Homo sapiens
cagcguaaaugacccc

SEQ ID NO: 2052123 - RNA, 17 nt, Homo sapiens
ugugugaauuuuucuaa

SEQ ID NO: 2052124 - RNA, 14 nt, Homo sapiens
cuccaggcucuuug

SEQ ID NO: 2052125 - RNA, 21 nt, Homo sapiens
uaucucgaauuugaagagauu

SEQ ID NO: 2052126 - RNA, 22 nt, Homo sapiens
uguauaagcacugaaaaacaac

SEQ ID NO: 2052127 - RNA, 15 nt, Homo sapiens
ccagaaaucaaaaag

SEQ ID NO: 2052128 - RNA, 15 nt, Homo sapiens
ucaugcgcaacugga

SEQ ID NO: 2052129 - RNA, 14 nt, Homo sapiens
uugacucugcauuu

SEQ ID NO: 2052130 - RNA, 13 nt, Homo sapiens
acuuaugccauag

SEQ ID NO: 2052131 - RNA, 17 nt, Homo sapiens
aggacaccagccuggug

SEQ ID NO: 2052132 - RNA, 18 nt, Homo sapiens
aagcgagguccaagcaca

SEQ ID NO: 2052133 - RNA, 15 nt, Homo sapiens
cacagccuccagggc

SEQ ID NO: 2052134 - RNA, 15 nt, Homo sapiens
uccagcuuuaagggu

SEQ ID NO: 2052135 - RNA, 12 nt, Homo sapiens
augccaagcuuu

SEQ ID NO: 2052136 - RNA, 14 nt, Homo sapiens
ggauuacaggugac

SEQ ID NO: 2052137 - RNA, 13 nt, Homo sapiens
gauuuuccuuccu

SEQ ID NO: 2052138 - RNA, 22 nt, Homo sapiens
cuugaaacauagagaucuaugu

SEQ ID NO: 2052139 - RNA, 13 nt, Homo sapiens
cugcaaauucagu

SEQ ID NO: 2052140 - RNA, 19 nt, Homo sapiens
aagauuuauacaguugaaa

SEQ ID NO: 2052141 - RNA, 20 nt, Homo sapiens
aguacacugccugccuuaag

SEQ ID NO: 2052142 - RNA, 12 nt, Homo sapiens
ugauuacugccu

SEQ ID NO: 2052143 - RNA, 14 nt, Homo sapiens
uguguacugccuua

SEQ ID NO: 2052144 - RNA, 15 nt, Homo sapiens
uaauucuuaccucau

SEQ ID NO: 2052145 - RNA, 16 nt, Homo sapiens
cuaugaaagacucaaa

SEQ ID NO: 2052146 - RNA, 13 nt, Homo sapiens
guaaaauacauau

SEQ ID NO: 2052147 - RNA, 22 nt, Homo sapiens
aaaacguugaauugaugaugca

SEQ ID NO: 2052148 - RNA, 20 nt, Homo sapiens
aaggugaaugaaagaucuuc

SEQ ID NO: 2052149 - RNA, 17 nt, Homo sapiens
gaagugugagcgccuug

SEQ ID NO: 2052150 - RNA, 22 nt, Homo sapiens
auaguucauagcaauuaacuga

SEQ ID NO: 2052151 - RNA, 16 nt, Homo sapiens
gacuaauggaaauauu

SEQ ID NO: 2052152 - RNA, 19 nt, Homo sapiens
aucugcaccccacuucaga

SEQ ID NO: 2052153 - RNA, 13 nt, Homo sapiens
uggaaaaguuuga

SEQ ID NO: 2052154 - RNA, 16 nt, Homo sapiens
acuugcccugagcacu

SEQ ID NO: 2052155 - RNA, 15 nt, Homo sapiens
gguuguuccccucau

SEQ ID NO: 2052156 - RNA, 21 nt, Homo sapiens
ugcagccaccacaucccuuca

SEQ ID NO: 2052157 - RNA, 17 nt, Homo sapiens
acuuauguuauacaaua

SEQ ID NO: 2052158 - RNA, 22 nt, Homo sapiens
ccuccccccacaagaacucccu

SEQ ID NO: 2052159 - RNA, 18 nt, Homo sapiens
uggggagccugagccaca

SEQ ID NO: 2052160 - RNA, 17 nt, Homo sapiens
ugaugucguuugaauca

SEQ ID NO: 2052161 - RNA, 19 nt, Homo sapiens
aagugauccucccaccuca

SEQ ID NO: 2052162 - RNA, 18 nt, Homo sapiens
ugaaacaguguggaugua

SEQ ID NO: 2052163 - RNA, 23 nt, Homo sapiens
ccuggaguuugggggaaggggaa

SEQ ID NO: 2052164 - RNA, 16 nt, Homo sapiens
agguccaaguucaagc

SEQ ID NO: 2052165 - RNA, 17 nt, Homo sapiens
ugcacagucacugcucu

SEQ ID NO: 2052166 - RNA, 19 nt, Homo sapiens
gcuaacuuaguaagugcuu

SEQ ID NO: 2052167 - RNA, 20 nt, Homo sapiens
guagccucugggaucugcca

SEQ ID NO: 2052168 - RNA, 22 nt, Homo sapiens
ggugcagucacggcucacugca

SEQ ID NO: 2052169 - RNA, 18 nt, Homo sapiens
auuauuuuguuaguggaa

SEQ ID NO: 2052170 - RNA, 20 nt, Homo sapiens
ccuggccucagggcucugac

SEQ ID NO: 2052171 - RNA, 15 nt, Homo sapiens
cuuuucccauauaca

SEQ ID NO: 2052172 - RNA, 13 nt, Homo sapiens
cccucuguauacu

SEQ ID NO: 2052173 - RNA, 20 nt, Homo sapiens
ccuucacuccccuaucccau

SEQ ID NO: 2052174 - RNA, 17 nt, Homo sapiens
ugccucccccuagccau

SEQ ID NO: 2052175 - RNA, 19 nt, Homo sapiens
caagguuggagagucuccu

SEQ ID NO: 2052176 - RNA, 14 nt, Homo sapiens
uauauuacuugccu

SEQ ID NO: 2052177 - RNA, 15 nt, Homo sapiens
acgugcaaagccaag

SEQ ID NO: 2052178 - RNA, 15 nt, Homo sapiens
auuccugccuggucc

SEQ ID NO: 2052179 - RNA, 19 nt, Homo sapiens
aacauccauaacucuguau

SEQ ID NO: 2052180 - RNA, 19 nt, Homo sapiens
agaccaggucuacagugau

SEQ ID NO: 2052181 - RNA, 13 nt, Homo sapiens
uuguuacagcuuc

SEQ ID NO: 2052182 - RNA, 18 nt, Homo sapiens
uugcagacaggaaucuua

SEQ ID NO: 2052183 - RNA, 17 nt, Homo sapiens
agcgggcggaggggauc

SEQ ID NO: 2052184 - RNA, 18 nt, Homo sapiens
cauggaugagcacacaca

SEQ ID NO: 2052185 - RNA, 23 nt, Homo sapiens
guuggagucacucuuaugcugua

SEQ ID NO: 2052186 - RNA, 14 nt, Homo sapiens
ugguacaaggaaua

SEQ ID NO: 2052187 - RNA, 16 nt, Homo sapiens
ucacagauaacauaaa

SEQ ID NO: 2052188 - RNA, 20 nt, Homo sapiens
agccggagaucugaggugcu

SEQ ID NO: 2052189 - RNA, 19 nt, Homo sapiens
auuccauuuuacuuccaug

SEQ ID NO: 2052190 - RNA, 14 nt, Homo sapiens
ugacaucagcacug

SEQ ID NO: 2052191 - RNA, 14 nt, Homo sapiens
cugcaacacuuuga

SEQ ID NO: 2052192 - RNA, 14 nt, Homo sapiens
auuugucaaugcau

SEQ ID NO: 2052193 - RNA, 15 nt, Homo sapiens
aacaauccaaaaaug

SEQ ID NO: 2052194 - RNA, 15 nt, Homo sapiens
agaccuccagcccug

SEQ ID NO: 2052195 - RNA, 22 nt, Homo sapiens
cauuuguuaucugggaacuuau

SEQ ID NO: 2052196 - RNA, 18 nt, Homo sapiens
cgguguaaauauguuuca

SEQ ID NO: 2052197 - RNA, 21 nt, Homo sapiens
gcacaccucugcaccuuugca

SEQ ID NO: 2052198 - RNA, 21 nt, Homo sapiens
ugggcuuaguauuucucagga

SEQ ID NO: 2052199 - RNA, 17 nt, Homo sapiens
cuuccugucaacacuuc

SEQ ID NO: 2052200 - RNA, 21 nt, Homo sapiens
auggacacuccagugccagca

SEQ ID NO: 2052201 - RNA, 18 nt, Homo sapiens
ccucaaagaagucggaau

SEQ ID NO: 2052202 - RNA, 23 nt, Homo sapiens
cuguggcuucuccgucacuccau

SEQ ID NO: 2052203 - RNA, 12 nt, Homo sapiens
cuaaaagcuuuc

SEQ ID NO: 2052204 - RNA, 14 nt, Homo sapiens
aucucuucuggugu

SEQ ID NO: 2052205 - RNA, 18 nt, Homo sapiens
auacgcgggcgcugccug

SEQ ID NO: 2052206 - RNA, 20 nt, Homo sapiens
gugggauacuuagugguaug

SEQ ID NO: 2052207 - RNA, 13 nt, Homo sapiens
gaaggacaugaga

SEQ ID NO: 2052208 - RNA, 13 nt, Homo sapiens
gacccuuugccuu

SEQ ID NO: 2052209 - RNA, 15 nt, Homo sapiens
cucauauaagacaaa

SEQ ID NO: 2052210 - RNA, 21 nt, Homo sapiens
aaagccaagggcaacagauca

SEQ ID NO: 2052211 - RNA, 21 nt, Homo sapiens
ugguguucaaaaaaacacuag

SEQ ID NO: 2052212 - RNA, 22 nt, Homo sapiens
agaguucuuuuugaaguauuua

SEQ ID NO: 2052213 - RNA, 15 nt, Homo sapiens
acuuuggaucaggaa

SEQ ID NO: 2052214 - RNA, 15 nt, Homo sapiens
ucuuuagaacaggga

SEQ ID NO: 2052215 - RNA, 15 nt, Homo sapiens
uaagaguagcugucu

SEQ ID NO: 2052216 - RNA, 23 nt, Homo sapiens
caaauguuacuucuaaaauuaca

SEQ ID NO: 2052217 - RNA, 15 nt, Homo sapiens
aacugccuccuugcc

SEQ ID NO: 2052218 - RNA, 18 nt, Homo sapiens
acuuugccauuucaucug

SEQ ID NO: 2052219 - RNA, 20 nt, Homo sapiens
gauucuucucuuaauuucau

SEQ ID NO: 2052220 - RNA, 12 nt, Homo sapiens
caaaaaacaacu

SEQ ID NO: 2052221 - RNA, 20 nt, Homo sapiens
ugcuguagacauuugcuaug

SEQ ID NO: 2052222 - RNA, 17 nt, Homo sapiens
gcgucuacccagacuca

SEQ ID NO: 2052223 - RNA, 15 nt, Homo sapiens
uaauuuuuaccuaau

SEQ ID NO: 2052224 - RNA, 21 nt, Homo sapiens
accccuagagacagugaugcc

SEQ ID NO: 2052225 - RNA, 16 nt, Homo sapiens
cagaucaaagaacuca

SEQ ID NO: 2052226 - RNA, 23 nt, Homo sapiens
ccagcauuugguuuuacacagga

SEQ ID NO: 2052227 - RNA, 19 nt, Homo sapiens
caguuucccacucugaaga

SEQ ID NO: 2052228 - RNA, 17 nt, Homo sapiens
uuaaaggaaaagcacaa

SEQ ID NO: 2052229 - RNA, 17 nt, Homo sapiens
ccagcuccaugcuccag

SEQ ID NO: 2052230 - RNA, 13 nt, Homo sapiens
gcagcucugugac

SEQ ID NO: 2052231 - RNA, 18 nt, Homo sapiens
caacaacuuuguuucuca

SEQ ID NO: 2052232 - RNA, 21 nt, Homo sapiens
agucccuuagaagaucugcuu

SEQ ID NO: 2052233 - RNA, 18 nt, Homo sapiens
uucccuuuggcagcugca

SEQ ID NO: 2052234 - RNA, 20 nt, Homo sapiens
aauuuuauaugcuuacugau

SEQ ID NO: 2052235 - RNA, 18 nt, Homo sapiens
caaguugcuucucaugga

SEQ ID NO: 2052236 - RNA, 15 nt, Homo sapiens
uggucacaaagcuau

SEQ ID NO: 2052237 - RNA, 13 nt, Homo sapiens
cucuucuacccuu

SEQ ID NO: 2052238 - RNA, 13 nt, Homo sapiens
cccagcuacucag

SEQ ID NO: 2052239 - RNA, 20 nt, Homo sapiens
cucucccaacucuugcacag

SEQ ID NO: 2052240 - RNA, 19 nt, Homo sapiens
cuguggccugucucuauua

SEQ ID NO: 2052241 - RNA, 19 nt, Homo sapiens
gaacaaggaguucucuucc

SEQ ID NO: 2052242 - RNA, 15 nt, Homo sapiens
uaugauucguguaau

SEQ ID NO: 2052243 - RNA, 16 nt, Homo sapiens
caaaacguaacuugca

SEQ ID NO: 2052244 - RNA, 16 nt, Homo sapiens
cauuucacacagugaa

SEQ ID NO: 2052245 - RNA, 19 nt, Homo sapiens
caggcaaagucugaaguca

SEQ ID NO: 2052246 - RNA, 20 nt, Homo sapiens
cauggaagauuagagguuug

SEQ ID NO: 2052247 - RNA, 20 nt, Homo sapiens
agcuccgcuaagaccucccc

SEQ ID NO: 2052248 - RNA, 22 nt, Homo sapiens
caaguccguuccgaaggcauuu

SEQ ID NO: 2052249 - RNA, 18 nt, Homo sapiens
ucuccugugcaccugacu

SEQ ID NO: 2052250 - RNA, 16 nt, Homo sapiens
caucagugcucuguaa

SEQ ID NO: 2052251 - RNA, 15 nt, Homo sapiens
uacuggccuuuucac

SEQ ID NO: 2052252 - RNA, 19 nt, Homo sapiens
cauuuuugcacuuaucucg

SEQ ID NO: 2052253 - RNA, 14 nt, Homo sapiens
ccaccgcccagaga

SEQ ID NO: 2052254 - RNA, 22 nt, Homo sapiens
aucacuaucaauuuuaaggaaa

SEQ ID NO: 2052255 - RNA, 15 nt, Homo sapiens
uacugaaagaucucu

SEQ ID NO: 2052256 - RNA, 14 nt, Homo sapiens
aaggacuaugacaa

SEQ ID NO: 2052257 - RNA, 21 nt, Homo sapiens
aacccuuccuuucccaaguau

SEQ ID NO: 2052258 - RNA, 14 nt, Homo sapiens
cuuuacuccuggcu

SEQ ID NO: 2052259 - RNA, 24 nt, Homo sapiens
cagcccaguguagagauuggcacu

SEQ ID NO: 2052260 - RNA, 15 nt, Homo sapiens
uguucagcaugcaau

SEQ ID NO: 2052261 - RNA, 20 nt, Homo sapiens
caauguucuggcacuauuau

SEQ ID NO: 2052262 - RNA, 12 nt, Homo sapiens
gaauaucuagca

SEQ ID NO: 2052263 - RNA, 18 nt, Homo sapiens
ucauagggaggccuuuag

SEQ ID NO: 2052264 - RNA, 15 nt, Homo sapiens
gcuuauauacaaugc

SEQ ID NO: 2052265 - RNA, 20 nt, Homo sapiens
cgcccaggauggagugcagu

SEQ ID NO: 2052266 - RNA, 18 nt, Homo sapiens
cuaguauugaaaacuaga

SEQ ID NO: 2052267 - RNA, 18 nt, Homo sapiens
cagugacugggcccuguc

SEQ ID NO: 2052268 - RNA, 20 nt, Homo sapiens
aaggucagcucccaucucau

SEQ ID NO: 2052269 - RNA, 21 nt, Homo sapiens
aggggccuuagggcacugggc

SEQ ID NO: 2052270 - RNA, 19 nt, Homo sapiens
guguaugcacgugugcaca

SEQ ID NO: 2052271 - RNA, 20 nt, Homo sapiens
aaaaugaauugccuuugaua

SEQ ID NO: 2052272 - RNA, 18 nt, Homo sapiens
cccugaguuggcaucacc

SEQ ID NO: 2052273 - RNA, 19 nt, Homo sapiens
acuucaaaggaacuggaau

SEQ ID NO: 2052274 - RNA, 19 nt, Homo sapiens
cuauugaaaaaucaccaca

SEQ ID NO: 2052275 - RNA, 13 nt, Homo sapiens
ccuucuucaggga

SEQ ID NO: 2052276 - RNA, 23 nt, Homo sapiens
ccacagcaguugaaaagacucca

SEQ ID NO: 2052277 - RNA, 17 nt, Homo sapiens
guuuaguugcagacuca

SEQ ID NO: 2052278 - RNA, 16 nt, Homo sapiens
ccugaggaguguccug

SEQ ID NO: 2052279 - RNA, 15 nt, Homo sapiens
ccagaauugugcaaa

SEQ ID NO: 2052280 - RNA, 15 nt, Homo sapiens
aaguuuagcucugag

SEQ ID NO: 2052281 - RNA, 23 nt, Homo sapiens
acaaaaauguaauuguucaucuu

SEQ ID NO: 2052282 - RNA, 14 nt, Homo sapiens
ucuaaaauccugcu

SEQ ID NO: 2052283 - RNA, 22 nt, Homo sapiens
cugcucuaauugcugccaggau

SEQ ID NO: 2052284 - RNA, 18 nt, Homo sapiens
uacaaucgagacugcaau

SEQ ID NO: 2052285 - RNA, 19 nt, Homo sapiens
cuuuuguaguauacuuuca

SEQ ID NO: 2052286 - RNA, 14 nt, Homo sapiens
acacuagacuguau

SEQ ID NO: 2052287 - RNA, 21 nt, Homo sapiens
aguccagucucuccagcauca

SEQ ID NO: 2052288 - RNA, 13 nt, Homo sapiens
uauauuguuucau

SEQ ID NO: 2052289 - RNA, 23 nt, Homo sapiens
gaauuuuuuuuuaacaucucuuu

SEQ ID NO: 2052290 - RNA, 14 nt, Homo sapiens
aguuucuaagcaug

SEQ ID NO: 2052291 - RNA, 16 nt, Homo sapiens
cagcucuacaggugag

SEQ ID NO: 2052292 - RNA, 21 nt, Homo sapiens
uaacauaaaagugcuacuuga

SEQ ID NO: 2052293 - RNA, 15 nt, Homo sapiens
uccacucgccuucau

SEQ ID NO: 2052294 - RNA, 15 nt, Homo sapiens
agccccuccuuccuu

SEQ ID NO: 2052295 - RNA, 20 nt, Homo sapiens
uaaaguauguuauugcauaa

SEQ ID NO: 2052296 - RNA, 15 nt, Homo sapiens
guuugauuugucuca

SEQ ID NO: 2052297 - RNA, 17 nt, Homo sapiens
caucguggagacagggc

SEQ ID NO: 2052298 - RNA, 23 nt, Homo sapiens
guggaucaccugaggucaggagu

SEQ ID NO: 2052299 - RNA, 22 nt, Homo sapiens
auugacuuucaguaaacauaaa

SEQ ID NO: 2052300 - RNA, 14 nt, Homo sapiens
cguaguucccugaa

SEQ ID NO: 2052301 - RNA, 16 nt, Homo sapiens
ugaggcaaaguguagu

SEQ ID NO: 2052302 - RNA, 16 nt, Homo sapiens
cuaccucaagacucac

SEQ ID NO: 2052303 - RNA, 22 nt, Homo sapiens
cucacgaauauuaugcccaguu

SEQ ID NO: 2052304 - RNA, 15 nt, Homo sapiens
uauuaacccucugag

SEQ ID NO: 2052305 - RNA, 22 nt, Homo sapiens
cagggacucaaggguccagaag

SEQ ID NO: 2052306 - RNA, 23 nt, Homo sapiens
cuaauucugagggaauuuaacca

SEQ ID NO: 2052307 - RNA, 14 nt, Homo sapiens
gccuguuaaauaua

SEQ ID NO: 2052308 - RNA, 23 nt, Homo sapiens
aauaguaaaggaaagcaguguug

SEQ ID NO: 2052309 - RNA, 18 nt, Homo sapiens
agaccagaagauucuauc

SEQ ID NO: 2052310 - RNA, 17 nt, Homo sapiens
accagccuaagaagcuc

SEQ ID NO: 2052311 - RNA, 15 nt, Homo sapiens
cagcuucaucaauuu

SEQ ID NO: 2052312 - RNA, 15 nt, Homo sapiens
ucacgguacagaggc

SEQ ID NO: 2052313 - RNA, 18 nt, Homo sapiens
cuucaguccaacugucaa

SEQ ID NO: 2052314 - RNA, 16 nt, Homo sapiens
gacaguugcagcccuu

SEQ ID NO: 2052315 - RNA, 21 nt, Homo sapiens
agccaugaguggaguuuccaa

SEQ ID NO: 2052316 - RNA, 15 nt, Homo sapiens
guuuauacacugugu

SEQ ID NO: 2052317 - RNA, 11 nt, Homo sapiens
cuguuccugcc

SEQ ID NO: 2052318 - RNA, 17 nt, Homo sapiens
uuaugacuccagaauuu

SEQ ID NO: 2052319 - RNA, 16 nt, Homo sapiens
ugccugcccugccuca

SEQ ID NO: 2052320 - RNA, 17 nt, Homo sapiens
uugcacuccaaucauuc

SEQ ID NO: 2052321 - RNA, 16 nt, Homo sapiens
uauaauacauccauuc

SEQ ID NO: 2052322 - RNA, 15 nt, Homo sapiens
aggugcugacaaaga

SEQ ID NO: 2052323 - RNA, 17 nt, Homo sapiens
gauccuggaaccacuga

SEQ ID NO: 2052324 - RNA, 21 nt, Homo sapiens
aucucacacugcaccaagcac

SEQ ID NO: 2052325 - RNA, 20 nt, Homo sapiens
auggucugcccucugcaucc

SEQ ID NO: 2052326 - RNA, 20 nt, Homo sapiens
uauucuaacaaaaagcaauu

SEQ ID NO: 2052327 - RNA, 23 nt, Homo sapiens
gauaugucuuggccacuauggac

SEQ ID NO: 2052328 - RNA, 15 nt, Homo sapiens
uggagucaguagcca

SEQ ID NO: 2052329 - RNA, 21 nt, Homo sapiens
auguugaagugagcugagauu

SEQ ID NO: 2052330 - RNA, 18 nt, Homo sapiens
uugaaaugccucuugacc

SEQ ID NO: 2052331 - RNA, 17 nt, Homo sapiens
caagccgagcucuccuu

SEQ ID NO: 2052332 - RNA, 14 nt, Homo sapiens
ucucucgcucgcuc

SEQ ID NO: 2052333 - RNA, 22 nt, Homo sapiens
aaauacaaucagcccagugcaa

SEQ ID NO: 2052334 - RNA, 19 nt, Homo sapiens
accagguaguuuguugcau

SEQ ID NO: 2052335 - RNA, 17 nt, Homo sapiens
cagcagaguaucugucu

SEQ ID NO: 2052336 - RNA, 22 nt, Homo sapiens
caaacaauuuaaaaaugagugu

SEQ ID NO: 2052337 - RNA, 20 nt, Homo sapiens
ggcaggagaaucacuugaac

SEQ ID NO: 2052338 - RNA, 23 nt, Homo sapiens
guauauauaaaagguuguguaca

SEQ ID NO: 2052339 - RNA, 17 nt, Homo sapiens
uuugcaaaauaaguaaa

SEQ ID NO: 2052340 - RNA, 18 nt, Homo sapiens
cgcccuggacuugguaca

SEQ ID NO: 2052341 - RNA, 21 nt, Homo sapiens
ccucuccuccccccaagcuca

SEQ ID NO: 2052342 - RNA, 20 nt, Homo sapiens
auguuauguaccauaugauc

SEQ ID NO: 2052343 - RNA, 13 nt, Homo sapiens
ccaguagcugcca

SEQ ID NO: 2052344 - RNA, 15 nt, Homo sapiens
gaacaagucaccucc

SEQ ID NO: 2052345 - RNA, 15 nt, Homo sapiens
acuguaaaguucaau

SEQ ID NO: 2052346 - RNA, 21 nt, Homo sapiens
uacaucuguguucuaugcaaa

SEQ ID NO: 2052347 - RNA, 18 nt, Homo sapiens
cuauucauggcuaccuca

SEQ ID NO: 2052348 - RNA, 16 nt, Homo sapiens
acaacuauuuuuccaa

SEQ ID NO: 2052349 - RNA, 16 nt, Homo sapiens
uaaaauugcugugcuu

SEQ ID NO: 2052350 - RNA, 19 nt, Homo sapiens
caucccagacacauucaca

SEQ ID NO: 2052351 - RNA, 18 nt, Homo sapiens
cccaccugaccucugcaa

SEQ ID NO: 2052352 - RNA, 20 nt, Homo sapiens
caucugcgggggugauguga

SEQ ID NO: 2052353 - RNA, 15 nt, Homo sapiens
agacaucugaggaaa

SEQ ID NO: 2052354 - RNA, 18 nt, Homo sapiens
agccauucauguauguca

SEQ ID NO: 2052355 - RNA, 20 nt, Homo sapiens
cacacucucuucuuacugua

SEQ ID NO: 2052356 - RNA, 19 nt, Homo sapiens
ucaucuacccccaaaagaa

SEQ ID NO: 2052357 - RNA, 22 nt, Homo sapiens
gacauccgucccacaucagggc

SEQ ID NO: 2052358 - RNA, 20 nt, Homo sapiens
acacugccuuggguggacca

SEQ ID NO: 2052359 - RNA, 23 nt, Homo sapiens
augcucacuggggucaggcugau

SEQ ID NO: 2052360 - RNA, 20 nt, Homo sapiens
uuacaguugaaagcuguauu

SEQ ID NO: 2052361 - RNA, 11 nt, Homo sapiens
uguaaauugca

SEQ ID NO: 2052362 - RNA, 22 nt, Homo sapiens
ccuuucaauaaaguuguugcau

SEQ ID NO: 2052363 - RNA, 17 nt, Homo sapiens
acaccgugugccauaga

SEQ ID NO: 2052364 - RNA, 19 nt, Homo sapiens
ugcccguguaguccccaac

SEQ ID NO: 2052365 - RNA, 20 nt, Homo sapiens
uuguccuuuuucacuuugaa

SEQ ID NO: 2052366 - RNA, 19 nt, Homo sapiens
ccaacuguauauauuccca

SEQ ID NO: 2052367 - RNA, 22 nt, Homo sapiens
aaagacuuuuuuuuaacacuuu

SEQ ID NO: 2052368 - RNA, 21 nt, Homo sapiens
aaaauggacguguuaugacuc

SEQ ID NO: 2052369 - RNA, 12 nt, Homo sapiens
aguucacuucag

SEQ ID NO: 2052370 - RNA, 12 nt, Homo sapiens
cgcucaccugca

SEQ ID NO: 2052371 - RNA, 18 nt, Homo sapiens
gaaaucagccuugcacaa

SEQ ID NO: 2052372 - RNA, 21 nt, Homo sapiens
ugaagaauauaccauuucaaa

SEQ ID NO: 2052373 - RNA, 17 nt, Homo sapiens
agggucugugugaaugu

SEQ ID NO: 2052374 - RNA, 17 nt, Homo sapiens
ugcaguggcacgaucuc

SEQ ID NO: 2052375 - RNA, 19 nt, Homo sapiens
guuucaggacauggggcau

SEQ ID NO: 2052376 - RNA, 13 nt, Homo sapiens
cuucugauggugu

SEQ ID NO: 2052377 - RNA, 22 nt, Homo sapiens
cuauuucacacagaaaccaagg

SEQ ID NO: 2052378 - RNA, 19 nt, Homo sapiens
ggugggccuccucugucca

SEQ ID NO: 2052379 - RNA, 18 nt, Homo sapiens
gccaggcugcggugggca

SEQ ID NO: 2052380 - RNA, 22 nt, Homo sapiens
ccuggugucugcccugcuggga

SEQ ID NO: 2052381 - RNA, 16 nt, Homo sapiens
ucugcagcccacagag

SEQ ID NO: 2052382 - RNA, 12 nt, Homo sapiens
uuuuuuaaucua

SEQ ID NO: 2052383 - RNA, 23 nt, Homo sapiens
ucucuggccuguacccaguagau

SEQ ID NO: 2052384 - RNA, 24 nt, Homo sapiens
accauuuuuaggaagcuagacuag

SEQ ID NO: 2052385 - RNA, 16 nt, Homo sapiens
aacagcuaugcaggga

SEQ ID NO: 2052386 - RNA, 15 nt, Homo sapiens
cgagauggugcagau

SEQ ID NO: 2052387 - RNA, 13 nt, Homo sapiens
ccuggaugugaau

SEQ ID NO: 2052388 - RNA, 22 nt, Homo sapiens
gacuacauuuugcucugugaac

SEQ ID NO: 2052389 - RNA, 18 nt, Homo sapiens
uucaaaugaaaauuccau

SEQ ID NO: 2052390 - RNA, 19 nt, Homo sapiens
ucuucucauucccaugugg

SEQ ID NO: 2052391 - RNA, 14 nt, Homo sapiens
uccuuauuugccuu

SEQ ID NO: 2052392 - RNA, 13 nt, Homo sapiens
aguuagugccaua

SEQ ID NO: 2052393 - RNA, 23 nt, Homo sapiens
gagugggcccaaugcacuuuguu

SEQ ID NO: 2052394 - RNA, 15 nt, Homo sapiens
aaaggaaaugacuag

SEQ ID NO: 2052395 - RNA, 18 nt, Homo sapiens
caggccgggguggagcau

SEQ ID NO: 2052396 - RNA, 15 nt, Homo sapiens
cccuaccucuaguaa

SEQ ID NO: 2052397 - RNA, 19 nt, Homo sapiens
agagcgaaacuccaucuca

SEQ ID NO: 2052398 - RNA, 19 nt, Homo sapiens
agagcaaaacuccgucuca

SEQ ID NO: 2052399 - RNA, 11 nt, Homo sapiens
cuauugcugag

SEQ ID NO: 2052400 - RNA, 19 nt, Homo sapiens
auccagccucccacaagaa

SEQ ID NO: 2052401 - RNA, 19 nt, Homo sapiens
agacuucucugugaacuuc

SEQ ID NO: 2052402 - RNA, 21 nt, Homo sapiens
auuacuccuucagcucugggg

SEQ ID NO: 2052403 - RNA, 18 nt, Homo sapiens
ugugacuauguuccaaua

SEQ ID NO: 2052404 - RNA, 16 nt, Homo sapiens
cauauguauacaugug

SEQ ID NO: 2052405 - RNA, 16 nt, Homo sapiens
ccucacaaucccacag

SEQ ID NO: 2052406 - RNA, 14 nt, Homo sapiens
gaggaguaauggca

SEQ ID NO: 2052407 - RNA, 11 nt, Homo sapiens
ucagcaaaaaa

SEQ ID NO: 2052408 - RNA, 22 nt, Homo sapiens
cuuuuucugcgcuucaguaaca

SEQ ID NO: 2052409 - RNA, 16 nt, Homo sapiens
aagaacaauucacagu

SEQ ID NO: 2052410 - RNA, 18 nt, Homo sapiens
uaauuaggguacauuuau

SEQ ID NO: 2052411 - RNA, 12 nt, Homo sapiens
uaaguacaaaua

SEQ ID NO: 2052412 - RNA, 12 nt, Homo sapiens
aguguacaugaa

SEQ ID NO: 2052413 - RNA, 16 nt, Homo sapiens
aggcucaacugaggau

SEQ ID NO: 2052414 - RNA, 15 nt, Homo sapiens
agucuaagcauacgu

SEQ ID NO: 2052415 - RNA, 21 nt, Homo sapiens
uuuacaaagcuggcaauauua

SEQ ID NO: 2052416 - RNA, 22 nt, Homo sapiens
agccuuccccuaccccuugucg

SEQ ID NO: 2052417 - RNA, 20 nt, Homo sapiens
aguuuagaaaguaacuuaau

SEQ ID NO: 2052418 - RNA, 16 nt, Homo sapiens
agcacugccugccaag

SEQ ID NO: 2052419 - RNA, 13 nt, Homo sapiens
acuccacuauguu

SEQ ID NO: 2052420 - RNA, 21 nt, Homo sapiens
uuaaauugggcuucaaucacu

SEQ ID NO: 2052421 - RNA, 21 nt, Homo sapiens
gccucugcccaggcacugcua

SEQ ID NO: 2052422 - RNA, 17 nt, Homo sapiens
aacaaaaaacuauguga

SEQ ID NO: 2052423 - RNA, 13 nt, Homo sapiens
uguucuucagaga

SEQ ID NO: 2052424 - RNA, 16 nt, Homo sapiens
acccugaggguuucca

SEQ ID NO: 2052425 - RNA, 9 nt, Homo sapiens
agcaauacu

SEQ ID NO: 2052426 - RNA, 19 nt, Homo sapiens
aguccauggugucaugcca

SEQ ID NO: 2052427 - RNA, 22 nt, Homo sapiens
uuugcuuuccucugagauucua

SEQ ID NO: 2052428 - RNA, 16 nt, Homo sapiens
agccuauuuuuuuaga

SEQ ID NO: 2052429 - RNA, 20 nt, Homo sapiens
cuuucuagaguagcucccau

SEQ ID NO: 2052430 - RNA, 16 nt, Homo sapiens
agugucacugaugaac

SEQ ID NO: 2052431 - RNA, 13 nt, Homo sapiens
uaggcagugcagu

SEQ ID NO: 2052432 - RNA, 15 nt, Homo sapiens
gccuuugcugccuuc

SEQ ID NO: 2052433 - RNA, 11 nt, Homo sapiens
aacaagcuauu

SEQ ID NO: 2052434 - RNA, 17 nt, Homo sapiens
gacaugaaauaaaugcc

SEQ ID NO: 2052435 - RNA, 16 nt, Homo sapiens
uguuaucaauucacau

SEQ ID NO: 2052436 - RNA, 22 nt, Homo sapiens
cuagggcccuuucuugcacugu

SEQ ID NO: 2052437 - RNA, 22 nt, Homo sapiens
agaaagaaaaauuaucuugaau

SEQ ID NO: 2052438 - RNA, 21 nt, Homo sapiens
gaguguuccccuuccacugag

SEQ ID NO: 2052439 - RNA, 16 nt, Homo sapiens
auaguccuccaaaaca

SEQ ID NO: 2052440 - RNA, 19 nt, Homo sapiens
uaacuuuguuuuauuuuca

SEQ ID NO: 2052441 - RNA, 15 nt, Homo sapiens
uacaaucugggauag

SEQ ID NO: 2052442 - RNA, 18 nt, Homo sapiens
gcuuuaaugucuaaccaa

SEQ ID NO: 2052443 - RNA, 18 nt, Homo sapiens
aaaguuauuauguagcug

SEQ ID NO: 2052444 - RNA, 14 nt, Homo sapiens
cucuaccuccuagc

SEQ ID NO: 2052445 - RNA, 23 nt, Homo sapiens
aaagcuguuuauuuauucacugu

SEQ ID NO: 2052446 - RNA, 14 nt, Homo sapiens
uguuaauaucacuc

SEQ ID NO: 2052447 - RNA, 22 nt, Homo sapiens
ugcaguaaauuaucuugggaua

SEQ ID NO: 2052448 - RNA, 15 nt, Homo sapiens
agggcuauagcagaa

SEQ ID NO: 2052449 - RNA, 17 nt, Homo sapiens
ggccgucugcacuucug

SEQ ID NO: 2052450 - RNA, 13 nt, Homo sapiens
cgugggcaaguca

SEQ ID NO: 2052451 - RNA, 17 nt, Homo sapiens
aagaauucaugaugcua

SEQ ID NO: 2052452 - RNA, 16 nt, Homo sapiens
uggcugggaugcuggu

SEQ ID NO: 2052453 - RNA, 22 nt, Homo sapiens
uuuccaguggaucauaagacaa

SEQ ID NO: 2052454 - RNA, 15 nt, Homo sapiens
uggacauccccagaa

SEQ ID NO: 2052455 - RNA, 21 nt, Homo sapiens
cuuuccccuccccuggcaugg

SEQ ID NO: 2052456 - RNA, 16 nt, Homo sapiens
gcaccaggagaggaca

SEQ ID NO: 2052457 - RNA, 17 nt, Homo sapiens
cuagggugugauuuagg

SEQ ID NO: 2052458 - RNA, 16 nt, Homo sapiens
aauaaggaucuuccca

SEQ ID NO: 2052459 - RNA, 17 nt, Homo sapiens
ucuugucccucuguaua

SEQ ID NO: 2052460 - RNA, 20 nt, Homo sapiens
cuucaaaaauuaaaauccag

SEQ ID NO: 2052461 - RNA, 15 nt, Homo sapiens
cuggaaaaauuccag

SEQ ID NO: 2052462 - RNA, 21 nt, Homo sapiens
aagauggcauaaccugucuca

SEQ ID NO: 2052463 - RNA, 16 nt, Homo sapiens
uuacaugaaacuacuc

SEQ ID NO: 2052464 - RNA, 13 nt, Homo sapiens
uagcuucagccag

SEQ ID NO: 2052465 - RNA, 11 nt, Homo sapiens
auccuguucua

SEQ ID NO: 2052466 - RNA, 12 nt, Homo sapiens
accuacugcuga

SEQ ID NO: 2052467 - RNA, 17 nt, Homo sapiens
auggcggggaucuggga

SEQ ID NO: 2052468 - RNA, 14 nt, Homo sapiens
cauuaagcacugug

SEQ ID NO: 2052469 - RNA, 16 nt, Homo sapiens
uggcuuuucuuucuac

SEQ ID NO: 2052470 - RNA, 15 nt, Homo sapiens
gacucaucauuucca

SEQ ID NO: 2052471 - RNA, 19 nt, Homo sapiens
cuaauucauuaaucugccu

SEQ ID NO: 2052472 - RNA, 21 nt, Homo sapiens
auuucuugaagaauaaauucu

SEQ ID NO: 2052473 - RNA, 22 nt, Homo sapiens
uuguacguucugcaaaacauuu

SEQ ID NO: 2052474 - RNA, 19 nt, Homo sapiens
augaaacuauuuuaccuga

SEQ ID NO: 2052475 - RNA, 14 nt, Homo sapiens
uacuacauuuccaa

SEQ ID NO: 2052476 - RNA, 13 nt, Homo sapiens
aagcacuuuguua

SEQ ID NO: 2052477 - RNA, 15 nt, Homo sapiens
ccaagcuggagugaa

SEQ ID NO: 2052478 - RNA, 14 nt, Homo sapiens
ucaaauugcugcuu

SEQ ID NO: 2052479 - RNA, 18 nt, Homo sapiens
cagcugugggacaauuau

SEQ ID NO: 2052480 - RNA, 15 nt, Homo sapiens
acucacagcuucucc

SEQ ID NO: 2052481 - RNA, 21 nt, Homo sapiens
uguucugggaguccugucagc

SEQ ID NO: 2052482 - RNA, 21 nt, Homo sapiens
accacuugaauuuauugauau

SEQ ID NO: 2052483 - RNA, 16 nt, Homo sapiens
ggcagccuccuugccu

SEQ ID NO: 2052484 - RNA, 23 nt, Homo sapiens
gaaaauaguggcaggacuguccc

SEQ ID NO: 2052485 - RNA, 17 nt, Homo sapiens
ucaccccaguggccacu

SEQ ID NO: 2052486 - RNA, 12 nt, Homo sapiens
ccgucucaagga

SEQ ID NO: 2052487 - RNA, 16 nt, Homo sapiens
uuauggaaaacugugu

SEQ ID NO: 2052488 - RNA, 19 nt, Homo sapiens
aggcuggagugcaaugcac

SEQ ID NO: 2052489 - RNA, 12 nt, Homo sapiens
gguccugcacug

SEQ ID NO: 2052490 - RNA, 12 nt, Homo sapiens
accccacugagc

SEQ ID NO: 2052491 - RNA, 22 nt, Homo sapiens
gagcugaacccauuuugaguga

SEQ ID NO: 2052492 - RNA, 20 nt, Homo sapiens
ccuuuuacagucacauucag

SEQ ID NO: 2052493 - RNA, 18 nt, Homo sapiens
uaggacuuuuauugugaa

SEQ ID NO: 2052494 - RNA, 20 nt, Homo sapiens
acagcaggcugccagugccu

SEQ ID NO: 2052495 - RNA, 13 nt, Homo sapiens
ccacuuccugcua

SEQ ID NO: 2052496 - RNA, 16 nt, Homo sapiens
cuaugcagaacaguga

SEQ ID NO: 2052497 - RNA, 13 nt, Homo sapiens
agaaauuccugua

SEQ ID NO: 2052498 - RNA, 22 nt, Homo sapiens
ucuuacggaaaauccgacaagc

SEQ ID NO: 2052499 - RNA, 16 nt, Homo sapiens
cagauccucugcugac

SEQ ID NO: 2052500 - RNA, 20 nt, Homo sapiens
aaggcaucuaagacauucac

SEQ ID NO: 2052501 - RNA, 15 nt, Homo sapiens
cuucauuguucuucu

SEQ ID NO: 2052502 - RNA, 14 nt, Homo sapiens
ugauaugguuuuau

SEQ ID NO: 2052503 - RNA, 20 nt, Homo sapiens
uauugagaaccuaaugcacu

SEQ ID NO: 2052504 - RNA, 14 nt, Homo sapiens
gagguuaaagcaaa

SEQ ID NO: 2052505 - RNA, 15 nt, Homo sapiens
cacagaaauugcaua

SEQ ID NO: 2052506 - RNA, 18 nt, Homo sapiens
uaguucuaggguuucccu

SEQ ID NO: 2052507 - RNA, 22 nt, Homo sapiens
gauauuuuucagcuacagcaaa

SEQ ID NO: 2052508 - RNA, 18 nt, Homo sapiens
gcauggauggguccucac

SEQ ID NO: 2052509 - RNA, 15 nt, Homo sapiens
cuccaucagcuccug

SEQ ID NO: 2052510 - RNA, 15 nt, Homo sapiens
caucuaacaaacaca

SEQ ID NO: 2052511 - RNA, 13 nt, Homo sapiens
cgaagucuuccau

SEQ ID NO: 2052512 - RNA, 23 nt, Homo sapiens
cacgucaugucucuaaacugcgg

SEQ ID NO: 2052513 - RNA, 15 nt, Homo sapiens
auaaauggagauuca

SEQ ID NO: 2052514 - RNA, 15 nt, Homo sapiens
acccaugacuuuaua

SEQ ID NO: 2052515 - RNA, 19 nt, Homo sapiens
cagucagagauaacaucca

SEQ ID NO: 2052516 - RNA, 18 nt, Homo sapiens
ggaaaaugaauaauacau

SEQ ID NO: 2052517 - RNA, 23 nt, Homo sapiens
uugaacuguauucuaguggcugu

SEQ ID NO: 2052518 - RNA, 12 nt, Homo sapiens
acauuuauguac

SEQ ID NO: 2052519 - RNA, 16 nt, Homo sapiens
gcauagcacuugcaga

SEQ ID NO: 2052520 - RNA, 19 nt, Homo sapiens
uccaggcaguucucucgaa

SEQ ID NO: 2052521 - RNA, 17 nt, Homo sapiens
caggcucccacugcccc

SEQ ID NO: 2052522 - RNA, 19 nt, Homo sapiens
ugauguuugccauuugcug

SEQ ID NO: 2052523 - RNA, 22 nt, Homo sapiens
aaaacuggcaacauuccaagaa

SEQ ID NO: 2052524 - RNA, 11 nt, Homo sapiens
cugcuguaaau

SEQ ID NO: 2052525 - RNA, 19 nt, Homo sapiens
uacaaguguucuuagguuu

SEQ ID NO: 2052526 - RNA, 14 nt, Homo sapiens
agacucugucucaa

SEQ ID NO: 2052527 - RNA, 16 nt, Homo sapiens
aaaacuuagugacaaa

SEQ ID NO: 2052528 - RNA, 18 nt, Homo sapiens
uguguccuaugcgcucau

SEQ ID NO: 2052529 - RNA, 19 nt, Homo sapiens
uaaucaugaaagcaucuga

SEQ ID NO: 2052530 - RNA, 17 nt, Homo sapiens
uacauaggucuguaugg

SEQ ID NO: 2052531 - RNA, 13 nt, Homo sapiens
gaggaucauauga

SEQ ID NO: 2052532 - RNA, 13 nt, Homo sapiens
uuuaaucagugaa

SEQ ID NO: 2052533 - RNA, 17 nt, Homo sapiens
guugaauguuucacuag

SEQ ID NO: 2052534 - RNA, 23 nt, Homo sapiens
acagaguacgugaaaugcucaag

SEQ ID NO: 2052535 - RNA, 18 nt, Homo sapiens
cccagaggauaagccacu

SEQ ID NO: 2052536 - RNA, 17 nt, Homo sapiens
ggcccugacuucuggag

SEQ ID NO: 2052537 - RNA, 13 nt, Homo sapiens
cacaccucccuuc

SEQ ID NO: 2052538 - RNA, 18 nt, Homo sapiens
gcacccugcccaccaaga

SEQ ID NO: 2052539 - RNA, 14 nt, Homo sapiens
uaauuuuacacaaa

SEQ ID NO: 2052540 - RNA, 19 nt, Homo sapiens
ccuggcuugucggagcaag

SEQ ID NO: 2052541 - RNA, 20 nt, Homo sapiens
ucuaagagaacaaugugcua

SEQ ID NO: 2052542 - RNA, 20 nt, Homo sapiens
caaaaggcccuuuucagggc

SEQ ID NO: 2052543 - RNA, 13 nt, Homo sapiens
aagagacugaguc

SEQ ID NO: 2052544 - RNA, 13 nt, Homo sapiens
accugacugccac

SEQ ID NO: 2052545 - RNA, 15 nt, Homo sapiens
aggaaaaaacccagc

SEQ ID NO: 2052546 - RNA, 13 nt, Homo sapiens
acaacugugacug

SEQ ID NO: 2052547 - RNA, 14 nt, Homo sapiens
gaccccuuccucca

SEQ ID NO: 2052548 - RNA, 19 nt, Homo sapiens
agagaggugggcagcagcu

SEQ ID NO: 2052549 - RNA, 17 nt, Homo sapiens
uaccacugcacccagcu

SEQ ID NO: 2052550 - RNA, 23 nt, Homo sapiens
gaauagaaauaaaggaugugauu

SEQ ID NO: 2052551 - RNA, 20 nt, Homo sapiens
uggauucuggauucacagac

SEQ ID NO: 2052552 - RNA, 17 nt, Homo sapiens
aagugcagucugaucca

SEQ ID NO: 2052553 - RNA, 21 nt, Homo sapiens
gcuuucucuggacacugccac

SEQ ID NO: 2052554 - RNA, 10 nt, Homo sapiens
ccgugaugcu

SEQ ID NO: 2052555 - RNA, 15 nt, Homo sapiens
gguaccaagcauuua

SEQ ID NO: 2052556 - RNA, 19 nt, Homo sapiens
auucguucuacaacaugau

SEQ ID NO: 2052557 - RNA, 17 nt, Homo sapiens
cacuuuucuauauugca

SEQ ID NO: 2052558 - RNA, 14 nt, Homo sapiens
auucagggcuuuaa

SEQ ID NO: 2052559 - RNA, 16 nt, Homo sapiens
uuuacugacugcuuau

SEQ ID NO: 2052560 - RNA, 20 nt, Homo sapiens
guuccuuaccucccuggucc

SEQ ID NO: 2052561 - RNA, 21 nt, Homo sapiens
gagaggacaaaauaaagugug

SEQ ID NO: 2052562 - RNA, 21 nt, Homo sapiens
aguauuugguuuuccauuccu

SEQ ID NO: 2052563 - RNA, 16 nt, Homo sapiens
cugggcacagagguca

SEQ ID NO: 2052564 - RNA, 12 nt, Homo sapiens
aagcugccucaa

SEQ ID NO: 2052565 - RNA, 14 nt, Homo sapiens
gccauagcuugauu

SEQ ID NO: 2052566 - RNA, 18 nt, Homo sapiens
cuccagugcuguccaugc

SEQ ID NO: 2052567 - RNA, 22 nt, Homo sapiens
gaugcugucuucguacugggaa

SEQ ID NO: 2052568 - RNA, 21 nt, Homo sapiens
gcuucaucugugggaugcuga

SEQ ID NO: 2052569 - RNA, 12 nt, Homo sapiens
ucauaaacacug

SEQ ID NO: 2052570 - RNA, 20 nt, Homo sapiens
cacugccugcccagugccau

SEQ ID NO: 2052571 - RNA, 13 nt, Homo sapiens
acuguguagcauc

SEQ ID NO: 2052572 - RNA, 22 nt, Homo sapiens
guuuaucugugggaauguggua

SEQ ID NO: 2052573 - RNA, 16 nt, Homo sapiens
aggugcuagaagccua

SEQ ID NO: 2052574 - RNA, 17 nt, Homo sapiens
agugccaggugaucucc

SEQ ID NO: 2052575 - RNA, 13 nt, Homo sapiens
aauuaacaucaaa

SEQ ID NO: 2052576 - RNA, 15 nt, Homo sapiens
auaaacuagucuguu

SEQ ID NO: 2052577 - RNA, 14 nt, Homo sapiens
uaguguacaugaaa

SEQ ID NO: 2052578 - RNA, 23 nt, Homo sapiens
augcuaacccccaaauacucuga

SEQ ID NO: 2052579 - RNA, 14 nt, Homo sapiens
aaauuuuacaauag

SEQ ID NO: 2052580 - RNA, 21 nt, Homo sapiens
auggacuuacccuaaagaucu

SEQ ID NO: 2052581 - RNA, 20 nt, Homo sapiens
gccucaaaaaucagggccac

SEQ ID NO: 2052582 - RNA, 13 nt, Homo sapiens
cuaaagcuuagaa

SEQ ID NO: 2052583 - RNA, 20 nt, Homo sapiens
cugugugucgcuuaugucua

SEQ ID NO: 2052584 - RNA, 17 nt, Homo sapiens
aucucccuucacaaguu

SEQ ID NO: 2052585 - RNA, 16 nt, Homo sapiens
ugcacuccagccuggg

SEQ ID NO: 2052586 - RNA, 18 nt, Homo sapiens
aguauuaaaauguaugca

SEQ ID NO: 2052587 - RNA, 20 nt, Homo sapiens
ucuaccucuuggcugccuug

SEQ ID NO: 2052588 - RNA, 19 nt, Homo sapiens
gaacauuuuaauucauccc

SEQ ID NO: 2052589 - RNA, 22 nt, Homo sapiens
auuuaauuggauauugaugaaa

SEQ ID NO: 2052590 - RNA, 20 nt, Homo sapiens
uuuauuuuucauauugugcc

SEQ ID NO: 2052591 - RNA, 15 nt, Homo sapiens
caugucggucccuga

SEQ ID NO: 2052592 - RNA, 16 nt, Homo sapiens
ucccaaguaugccuua

SEQ ID NO: 2052593 - RNA, 16 nt, Homo sapiens
ugugaagccugcagag

SEQ ID NO: 2052594 - RNA, 16 nt, Homo sapiens
cugguccugagucuug

SEQ ID NO: 2052595 - RNA, 23 nt, Homo sapiens
ugagcucccaggugcagccagag

SEQ ID NO: 2052596 - RNA, 15 nt, Homo sapiens
caggacaaccugcug

SEQ ID NO: 2052597 - RNA, 23 nt, Homo sapiens
aucauaggcaccuuuuacuguga

SEQ ID NO: 2052598 - RNA, 23 nt, Homo sapiens
uaugcaccaggucucaagguucu

SEQ ID NO: 2052599 - RNA, 21 nt, Homo sapiens
ccuguguccaccugugggugu

SEQ ID NO: 2052600 - RNA, 18 nt, Homo sapiens
uuuccaagauaaaaccag

SEQ ID NO: 2052601 - RNA, 18 nt, Homo sapiens
ccugcugcccaaucucca

SEQ ID NO: 2052602 - RNA, 23 nt, Homo sapiens
cauuuauuuaagacacuguuaca

SEQ ID NO: 2052603 - RNA, 18 nt, Homo sapiens
caaccccagccaaucaca

SEQ ID NO: 2052604 - RNA, 16 nt, Homo sapiens
aguucuuugggccaga

SEQ ID NO: 2052605 - RNA, 14 nt, Homo sapiens
gagggggcgcugga

SEQ ID NO: 2052606 - RNA, 18 nt, Homo sapiens
aggguccacgccucugcu

SEQ ID NO: 2052607 - RNA, 22 nt, Homo sapiens
uucaccauauugcccagggugg

SEQ ID NO: 2052608 - RNA, 14 nt, Homo sapiens
cugcagggugggau

SEQ ID NO: 2052609 - RNA, 12 nt, Homo sapiens
cagccugucacc

SEQ ID NO: 2052610 - RNA, 16 nt, Homo sapiens
augagcccacccugcu

SEQ ID NO: 2052611 - RNA, 20 nt, Homo sapiens
auggguagcagagagaacaa

SEQ ID NO: 2052612 - RNA, 23 nt, Homo sapiens
cauguguccccucacucugucag

SEQ ID NO: 2052613 - RNA, 22 nt, Homo sapiens
agguggagaaagcauaucccac

SEQ ID NO: 2052614 - RNA, 12 nt, Homo sapiens
gcugagugcuga

SEQ ID NO: 2052615 - RNA, 13 nt, Homo sapiens
ccuccguccagcc

SEQ ID NO: 2052616 - RNA, 22 nt, Homo sapiens
aagcacugaaaaacaacaacac

SEQ ID NO: 2052617 - RNA, 12 nt, Homo sapiens
uuccuaggucau

SEQ ID NO: 2052618 - RNA, 15 nt, Homo sapiens
cuguacuaauacagc

SEQ ID NO: 2052619 - RNA, 20 nt, Homo sapiens
agugcaguggcgcgaucuca

SEQ ID NO: 2052620 - RNA, 20 nt, Homo sapiens
agugcaguggcacgaucucg

SEQ ID NO: 2052621 - RNA, 15 nt, Homo sapiens
acaaguauuuugcua

SEQ ID NO: 2052622 - RNA, 21 nt, Homo sapiens
cccuccacucucuaccagaua

SEQ ID NO: 2052623 - RNA, 23 nt, Homo sapiens
gcccuauccuucucugccucuua

SEQ ID NO: 2052624 - RNA, 19 nt, Homo sapiens
ccagagaggaccuauccca

SEQ ID NO: 2052625 - RNA, 20 nt, Homo sapiens
acaacugauacuucacuacu

SEQ ID NO: 2052626 - RNA, 13 nt, Homo sapiens
aaggaauggugcg

SEQ ID NO: 2052627 - RNA, 21 nt, Homo sapiens
uguggcucccuuggugcccuc

SEQ ID NO: 2052628 - RNA, 13 nt, Homo sapiens
cagucccagcaca

SEQ ID NO: 2052629 - RNA, 11 nt, Homo sapiens
aaaugccucau

SEQ ID NO: 2052630 - RNA, 17 nt, Homo sapiens
auacaaaccacugugaa

SEQ ID NO: 2052631 - RNA, 21 nt, Homo sapiens
gacauggacccacuacccuuc

SEQ ID NO: 2052632 - RNA, 16 nt, Homo sapiens
gaggcaccaguguccu

SEQ ID NO: 2052633 - RNA, 15 nt, Homo sapiens
aucuggaugaaucuu

SEQ ID NO: 2052634 - RNA, 16 nt, Homo sapiens
ugucucuacuaaaaau

SEQ ID NO: 2052635 - RNA, 14 nt, Homo sapiens
accucugaccaaca

SEQ ID NO: 2052636 - RNA, 21 nt, Homo sapiens
guaauaauacagccaaagaua

SEQ ID NO: 2052637 - RNA, 16 nt, Homo sapiens
ccuaugcagaggucca

SEQ ID NO: 2052638 - RNA, 17 nt, Homo sapiens
uuagaaacaccauucau

SEQ ID NO: 2052639 - RNA, 12 nt, Homo sapiens
caccuguagcug

SEQ ID NO: 2052640 - RNA, 22 nt, Homo sapiens
uucaacugccauguuuugccac

SEQ ID NO: 2052641 - RNA, 15 nt, Homo sapiens
cugccuccugugacg

SEQ ID NO: 2052642 - RNA, 13 nt, Homo sapiens
caguccaugucuc

SEQ ID NO: 2052643 - RNA, 12 nt, Homo sapiens
agauguacuugu

SEQ ID NO: 2052644 - RNA, 13 nt, Homo sapiens
aauaaaaugaugu

SEQ ID NO: 2052645 - RNA, 11 nt, Homo sapiens
uccuugcccac

SEQ ID NO: 2052646 - RNA, 19 nt, Homo sapiens
ugcaaaucaaacauauucu

SEQ ID NO: 2052647 - RNA, 17 nt, Homo sapiens
gcaaaucuuuuaacaua

SEQ ID NO: 2052648 - RNA, 14 nt, Homo sapiens
cugauccugaacaa

SEQ ID NO: 2052649 - RNA, 18 nt, Homo sapiens
aaaguauuaucagaugcu

SEQ ID NO: 2052650 - RNA, 24 nt, Homo sapiens
gaaaugaccaggccaagacucaag

SEQ ID NO: 2052651 - RNA, 14 nt, Homo sapiens
cccccgccaccuca

SEQ ID NO: 2052652 - RNA, 13 nt, Homo sapiens
agcaacaucagcu

SEQ ID NO: 2052653 - RNA, 22 nt, Homo sapiens
gagcaccuacuuacaugcauua

SEQ ID NO: 2052654 - RNA, 21 nt, Homo sapiens
agugagcagagauguacugca

SEQ ID NO: 2052655 - RNA, 17 nt, Homo sapiens
acacucucuucucugcu

SEQ ID NO: 2052656 - RNA, 21 nt, Homo sapiens
auaaaucuaucaaaauuaccc

SEQ ID NO: 2052657 - RNA, 16 nt, Homo sapiens
uggucaaaaucugcaa

SEQ ID NO: 2052658 - RNA, 20 nt, Homo sapiens
aggggggccagggguucuga

SEQ ID NO: 2052659 - RNA, 13 nt, Homo sapiens
agauaaacaguag

SEQ ID NO: 2052660 - RNA, 17 nt, Homo sapiens
acacagcugcagagaca

SEQ ID NO: 2052661 - RNA, 23 nt, Homo sapiens
uaugaguuuuugauagcuuuauu

SEQ ID NO: 2052662 - RNA, 18 nt, Homo sapiens
cauucgaucgagcuauuc

SEQ ID NO: 2052663 - RNA, 20 nt, Homo sapiens
cagcauuugauaaaauccaa

SEQ ID NO: 2052664 - RNA, 13 nt, Homo sapiens
uccugcacacagg

SEQ ID NO: 2052665 - RNA, 15 nt, Homo sapiens
augagaaguacuugg

SEQ ID NO: 2052666 - RNA, 20 nt, Homo sapiens
acacuaaccuggguucccuu

SEQ ID NO: 2052667 - RNA, 14 nt, Homo sapiens
acaucagucuccaa

SEQ ID NO: 2052668 - RNA, 11 nt, Homo sapiens
uuuguggcauc

SEQ ID NO: 2052669 - RNA, 17 nt, Homo sapiens
gccuaaagaaacucagc

SEQ ID NO: 2052670 - RNA, 20 nt, Homo sapiens
cagccaagaaagcuaucucu

SEQ ID NO: 2052671 - RNA, 15 nt, Homo sapiens
uggagaugaugauga

SEQ ID NO: 2052672 - RNA, 20 nt, Homo sapiens
gcuaauggaauuacugccuu

SEQ ID NO: 2052673 - RNA, 22 nt, Homo sapiens
cgugcuuuucugcggcugugua

SEQ ID NO: 2052674 - RNA, 15 nt, Homo sapiens
aaagagauaguucua

SEQ ID NO: 2052675 - RNA, 22 nt, Homo sapiens
ccaguauucuaaaguuuugcaa

SEQ ID NO: 2052676 - RNA, 12 nt, Homo sapiens
ucgccucuggau

SEQ ID NO: 2052677 - RNA, 23 nt, Homo sapiens
accuuuuuuuuacggaauuccaa

SEQ ID NO: 2052678 - RNA, 21 nt, Homo sapiens
cccuucauccuucuggaauaa

SEQ ID NO: 2052679 - RNA, 14 nt, Homo sapiens
cgaucgacugccaa

SEQ ID NO: 2052680 - RNA, 14 nt, Homo sapiens
agguuaugagaaaa

SEQ ID NO: 2052681 - RNA, 18 nt, Homo sapiens
aacagguaaaacagggcc

SEQ ID NO: 2052682 - RNA, 21 nt, Homo sapiens
gccaucaggacuuucccugac

SEQ ID NO: 2052683 - RNA, 20 nt, Homo sapiens
cuaacucaaaggagccuuuu

SEQ ID NO: 2052684 - RNA, 17 nt, Homo sapiens
ccaguggaccugaagga

SEQ ID NO: 2052685 - RNA, 14 nt, Homo sapiens
aucuuuauugaacu

SEQ ID NO: 2052686 - RNA, 22 nt, Homo sapiens
agugugaggcggcccugaccaa

SEQ ID NO: 2052687 - RNA, 16 nt, Homo sapiens
acagacuugaaugcua

SEQ ID NO: 2052688 - RNA, 21 nt, Homo sapiens
cuuccaauuuacauacucugc

SEQ ID NO: 2052689 - RNA, 17 nt, Homo sapiens
acuuuaauucucuuacu

SEQ ID NO: 2052690 - RNA, 20 nt, Homo sapiens
ggauuauucugggggcugca

SEQ ID NO: 2052691 - RNA, 23 nt, Homo sapiens
caaugaucagacuugauuuacaa

SEQ ID NO: 2052692 - RNA, 21 nt, Homo sapiens
ucgcaacuguccacgcgugcc

SEQ ID NO: 2052693 - RNA, 15 nt, Homo sapiens
ccauuaaaguucuca

SEQ ID NO: 2052694 - RNA, 15 nt, Homo sapiens
cucugcagaagccaa

SEQ ID NO: 2052695 - RNA, 19 nt, Homo sapiens
cuugguuuccaaaggcauu

SEQ ID NO: 2052696 - RNA, 16 nt, Homo sapiens
agacucauccugaaca

SEQ ID NO: 2052697 - RNA, 17 nt, Homo sapiens
uuucuuuuguauguaaa

SEQ ID NO: 2052698 - RNA, 17 nt, Homo sapiens
acccagcacugcccaaa

SEQ ID NO: 2052699 - RNA, 18 nt, Homo sapiens
cacuugccuaugauacug

SEQ ID NO: 2052700 - RNA, 15 nt, Homo sapiens
gcugcucaaaaugcc

SEQ ID NO: 2052701 - RNA, 14 nt, Homo sapiens
aaguagucauggau

SEQ ID NO: 2052702 - RNA, 14 nt, Homo sapiens
aagcaaauuuugua

SEQ ID NO: 2052703 - RNA, 21 nt, Homo sapiens
uucauuuuuacccuuacuugg

SEQ ID NO: 2052704 - RNA, 22 nt, Homo sapiens
uccggcugaaggcugagugucc

SEQ ID NO: 2052705 - RNA, 14 nt, Homo sapiens
guuuuuauucugua

SEQ ID NO: 2052706 - RNA, 16 nt, Homo sapiens
uccuggugauucugau

SEQ ID NO: 2052707 - RNA, 12 nt, Homo sapiens
uuggaaaccaca

SEQ ID NO: 2052708 - RNA, 16 nt, Homo sapiens
uugcuuaaaugugaau

SEQ ID NO: 2052709 - RNA, 19 nt, Homo sapiens
ggcccucuguccacaugug

SEQ ID NO: 2052710 - RNA, 16 nt, Homo sapiens
aggagcgcgcgugaua

SEQ ID NO: 2052711 - RNA, 13 nt, Homo sapiens
auggggcuguuga

SEQ ID NO: 2052712 - RNA, 15 nt, Homo sapiens
cagacuugcacugaa

SEQ ID NO: 2052713 - RNA, 15 nt, Homo sapiens
cacauaauuugcaua

SEQ ID NO: 2052714 - RNA, 19 nt, Homo sapiens
gccauggguucaccagccc

SEQ ID NO: 2052715 - RNA, 20 nt, Homo sapiens
acgcuagggcggggcacaga

SEQ ID NO: 2052716 - RNA, 20 nt, Homo sapiens
auugugccccugcacuccag

SEQ ID NO: 2052717 - RNA, 14 nt, Homo sapiens
gcaagcgcacuuga

SEQ ID NO: 2052718 - RNA, 15 nt, Homo sapiens
cccucuuucuagccu

SEQ ID NO: 2052719 - RNA, 16 nt, Homo sapiens
cuggggccugggacaa

SEQ ID NO: 2052720 - RNA, 22 nt, Homo sapiens
augaagguuuguuccuuuguua

SEQ ID NO: 2052721 - RNA, 13 nt, Homo sapiens
agcagcucaagaa

SEQ ID NO: 2052722 - RNA, 20 nt, Homo sapiens
gauaauuuuuagacuaacuu

SEQ ID NO: 2052723 - RNA, 19 nt, Homo sapiens
ucucuucaaauuuagcaac

SEQ ID NO: 2052724 - RNA, 16 nt, Homo sapiens
aagauguuguuuuagg

SEQ ID NO: 2052725 - RNA, 17 nt, Homo sapiens
uuugauuaaauuaugaa

SEQ ID NO: 2052726 - RNA, 15 nt, Homo sapiens
gagaaaaugccucaa

SEQ ID NO: 2052727 - RNA, 13 nt, Homo sapiens
gcuggcaccagca

SEQ ID NO: 2052728 - RNA, 18 nt, Homo sapiens
cuggaggcugccucccaa

SEQ ID NO: 2052729 - RNA, 13 nt, Homo sapiens
cuguuuacugaaa

SEQ ID NO: 2052730 - RNA, 17 nt, Homo sapiens
gacaaccccagccaauc

SEQ ID NO: 2052731 - RNA, 15 nt, Homo sapiens
gaaagacugaagaaa

SEQ ID NO: 2052732 - RNA, 23 nt, Homo sapiens
guaaaagucuaguuaccuacuuu

SEQ ID NO: 2052733 - RNA, 22 nt, Homo sapiens
cauguacaugguauuaacacuu

SEQ ID NO: 2052734 - RNA, 14 nt, Homo sapiens
acucaagccuuuca

SEQ ID NO: 2052735 - RNA, 19 nt, Homo sapiens
uuccaacaccugacagaau

SEQ ID NO: 2052736 - RNA, 15 nt, Homo sapiens
gccagcauuuuugca

SEQ ID NO: 2052737 - RNA, 19 nt, Homo sapiens
ccuagggaauggggaaccc

SEQ ID NO: 2052738 - RNA, 16 nt, Homo sapiens
aaaggcucccauguga

SEQ ID NO: 2052739 - RNA, 18 nt, Homo sapiens
guguagcucacacacagu

SEQ ID NO: 2052740 - RNA, 16 nt, Homo sapiens
uggaagaugugugaua

SEQ ID NO: 2052741 - RNA, 21 nt, Homo sapiens
cagcgugggaccccaagugaa

SEQ ID NO: 2052742 - RNA, 19 nt, Homo sapiens
augucaccucaggaccaug

SEQ ID NO: 2052743 - RNA, 21 nt, Homo sapiens
gguaucuugagucuugguuca

SEQ ID NO: 2052744 - RNA, 23 nt, Homo sapiens
cagacggcggccaggcacagggc

SEQ ID NO: 2052745 - RNA, 22 nt, Homo sapiens
cugccauucacuucauaaucca

SEQ ID NO: 2052746 - RNA, 22 nt, Homo sapiens
agguuguagacguuguguaaug

SEQ ID NO: 2052747 - RNA, 16 nt, Homo sapiens
agagcaucccacagga

SEQ ID NO: 2052748 - RNA, 19 nt, Homo sapiens
aauaguucccuagucuauu

SEQ ID NO: 2052749 - RNA, 20 nt, Homo sapiens
uggauaaaucauuucaguau

SEQ ID NO: 2052750 - RNA, 19 nt, Homo sapiens
gucuuuccuaaggcugcaa

SEQ ID NO: 2052751 - RNA, 13 nt, Homo sapiens
aguuacugugguc

SEQ ID NO: 2052752 - RNA, 19 nt, Homo sapiens
gcuuugaauaaauguguug

SEQ ID NO: 2052753 - RNA, 21 nt, Homo sapiens
cauguguguguacaacacugg

SEQ ID NO: 2052754 - RNA, 13 nt, Homo sapiens
ccgaaggugacag

SEQ ID NO: 2052755 - RNA, 13 nt, Homo sapiens
accucuuucccca

SEQ ID NO: 2052756 - RNA, 21 nt, Homo sapiens
accuucuaggaagcuccaguu

SEQ ID NO: 2052757 - RNA, 15 nt, Homo sapiens
uucaaguaugugcua

SEQ ID NO: 2052758 - RNA, 21 nt, Homo sapiens
aauuauuaugucucaaaauaa

SEQ ID NO: 2052759 - RNA, 22 nt, Homo sapiens
auauugaaugaugugauacaaa

SEQ ID NO: 2052760 - RNA, 14 nt, Homo sapiens
ccagguuagcacag

SEQ ID NO: 2052761 - RNA, 15 nt, Homo sapiens
cagcacuacucugug

SEQ ID NO: 2052762 - RNA, 16 nt, Homo sapiens
ugagcaagacauacuu

SEQ ID NO: 2052763 - RNA, 14 nt, Homo sapiens
cagagguuucuuga

SEQ ID NO: 2052764 - RNA, 14 nt, Homo sapiens
ggaaacugcuaaau

SEQ ID NO: 2052765 - RNA, 22 nt, Homo sapiens
aacuucugccucccaugcuuac

SEQ ID NO: 2052766 - RNA, 13 nt, Homo sapiens
cucugcaucucau

SEQ ID NO: 2052767 - RNA, 21 nt, Homo sapiens
gagaggggcuguccauggcag

SEQ ID NO: 2052768 - RNA, 23 nt, Homo sapiens
aagauguagaggagaaacuggaa

SEQ ID NO: 2052769 - RNA, 22 nt, Homo sapiens
uaaaacucacugaaucuaacca

SEQ ID NO: 2052770 - RNA, 16 nt, Homo sapiens
ucuuggccuaaaccuc

SEQ ID NO: 2052771 - RNA, 19 nt, Homo sapiens
cgagaucgcgccacugcac

SEQ ID NO: 2052772 - RNA, 21 nt, Homo sapiens
agacuccaccucuaccaaaaa

SEQ ID NO: 2052773 - RNA, 23 nt, Homo sapiens
uuuaggauaaccuugugccuugg

SEQ ID NO: 2052774 - RNA, 19 nt, Homo sapiens
gaaguucuagccacagcag

SEQ ID NO: 2052775 - RNA, 23 nt, Homo sapiens
aacauggagcugucaucacucaa

SEQ ID NO: 2052776 - RNA, 19 nt, Homo sapiens
cucagcuaucacaucacaa

SEQ ID NO: 2052777 - RNA, 18 nt, Homo sapiens
ugcucugagcacagguga

SEQ ID NO: 2052778 - RNA, 14 nt, Homo sapiens
ggcacugagcccuu

SEQ ID NO: 2052779 - RNA, 14 nt, Homo sapiens
gccauagaggccca

SEQ ID NO: 2052780 - RNA, 21 nt, Homo sapiens
gugcaucacggauggugcaug

SEQ ID NO: 2052781 - RNA, 20 nt, Homo sapiens
aaugaccagguaacaucauc

SEQ ID NO: 2052782 - RNA, 19 nt, Homo sapiens
cccaggcuggagugcaaug

SEQ ID NO: 2052783 - RNA, 19 nt, Homo sapiens
cccaggcuagagugcagug

SEQ ID NO: 2052784 - RNA, 20 nt, Homo sapiens
agagugaccucggacagagc

SEQ ID NO: 2052785 - RNA, 19 nt, Homo sapiens
cgacugcgacgcaggugua

SEQ ID NO: 2052786 - RNA, 18 nt, Homo sapiens
uggcccguggccuggcau

SEQ ID NO: 2052787 - RNA, 21 nt, Homo sapiens
cgggagaagaaguuugaccau

SEQ ID NO: 2052788 - RNA, 21 nt, Homo sapiens
accauaugaauuuacuacuuu

SEQ ID NO: 2052789 - RNA, 15 nt, Homo sapiens
cccagagcaccugcu

SEQ ID NO: 2052790 - RNA, 18 nt, Homo sapiens
ccgagauaggguggcaca

SEQ ID NO: 2052791 - RNA, 19 nt, Homo sapiens
gcucuggugacaccagccu

SEQ ID NO: 2052792 - RNA, 17 nt, Homo sapiens
acauggacccacuaccc

SEQ ID NO: 2052793 - RNA, 22 nt, Homo sapiens
uuugccaaggcuaauccaauua

SEQ ID NO: 2052794 - RNA, 21 nt, Homo sapiens
ugaaaagauacugaugcauug

SEQ ID NO: 2052795 - RNA, 15 nt, Homo sapiens
aauauaguugguaca

SEQ ID NO: 2052796 - RNA, 19 nt, Homo sapiens
cuauaaaacucugcaugua

SEQ ID NO: 2052797 - RNA, 21 nt, Homo sapiens
uagagaugauucagaggucac

SEQ ID NO: 2052798 - RNA, 12 nt, Homo sapiens
gccagggaccca

SEQ ID NO: 2052799 - RNA, 12 nt, Homo sapiens
gaaggggacaag

SEQ ID NO: 2052800 - RNA, 22 nt, Homo sapiens
gauccguuugaccaauuugcac

SEQ ID NO: 2052801 - RNA, 12 nt, Homo sapiens
aucugauuccag

SEQ ID NO: 2052802 - RNA, 13 nt, Homo sapiens
ugagaaggguuga

SEQ ID NO: 2052803 - RNA, 14 nt, Homo sapiens
uaugccugucuuua

SEQ ID NO: 2052804 - RNA, 13 nt, Homo sapiens
aagaaaagccuaa

SEQ ID NO: 2052805 - RNA, 14 nt, Homo sapiens
agccuucagucaca

SEQ ID NO: 2052806 - RNA, 22 nt, Homo sapiens
aaguuucaucagucaaugagga

SEQ ID NO: 2052807 - RNA, 20 nt, Homo sapiens
gcuuucauuuugcauuuugu

SEQ ID NO: 2052808 - RNA, 15 nt, Homo sapiens
gauucccaccaaggu

SEQ ID NO: 2052809 - RNA, 16 nt, Homo sapiens
uuccauaagaagucgu

SEQ ID NO: 2052810 - RNA, 23 nt, Homo sapiens
gcccuuuucuuacaguaacugag

SEQ ID NO: 2052811 - RNA, 18 nt, Homo sapiens
guuacugaauauuaaaaa

SEQ ID NO: 2052812 - RNA, 19 nt, Homo sapiens
uauuucuauguguaugcaa

SEQ ID NO: 2052813 - RNA, 21 nt, Homo sapiens
auguaugcugauuuacuacuu

SEQ ID NO: 2052814 - RNA, 15 nt, Homo sapiens
acaaucuguauauaa

SEQ ID NO: 2052815 - RNA, 12 nt, Homo sapiens
uuguugcaguuc

SEQ ID NO: 2052816 - RNA, 17 nt, Homo sapiens
agcugggcaaagccaca

SEQ ID NO: 2052817 - RNA, 20 nt, Homo sapiens
gggcuggaaggaccugcucc

SEQ ID NO: 2052818 - RNA, 16 nt, Homo sapiens
acuaacuccugagaaa

SEQ ID NO: 2052819 - RNA, 16 nt, Homo sapiens
ccuugcuuccuucuca

SEQ ID NO: 2052820 - RNA, 17 nt, Homo sapiens
ccacccaccuggcuuca

SEQ ID NO: 2052821 - RNA, 17 nt, Homo sapiens
acaaaaugagcucuccu

SEQ ID NO: 2052822 - RNA, 12 nt, Homo sapiens
cuuaaaagagua

SEQ ID NO: 2052823 - RNA, 14 nt, Homo sapiens
auauuaucuaccug

SEQ ID NO: 2052824 - RNA, 18 nt, Homo sapiens
gagcuucaaggugaucaa

SEQ ID NO: 2052825 - RNA, 14 nt, Homo sapiens
gcugggagagccaa

SEQ ID NO: 2052826 - RNA, 17 nt, Homo sapiens
ggucugggacuuccuug

SEQ ID NO: 2052827 - RNA, 21 nt, Homo sapiens
agcugcauuucacaugccuug

SEQ ID NO: 2052828 - RNA, 16 nt, Homo sapiens
ucaggaagcucagggc

SEQ ID NO: 2052829 - RNA, 16 nt, Homo sapiens
gcugagaucguaccua

SEQ ID NO: 2052830 - RNA, 15 nt, Homo sapiens
uuguaucuccuucag

SEQ ID NO: 2052831 - RNA, 17 nt, Homo sapiens
guagcuauaucuauaua

SEQ ID NO: 2052832 - RNA, 17 nt, Homo sapiens
agaaguuucccuuccuc

SEQ ID NO: 2052833 - RNA, 16 nt, Homo sapiens
cuccagagaaccuuua

SEQ ID NO: 2052834 - RNA, 10 nt, Homo sapiens
gcuguuaaaa

SEQ ID NO: 2052835 - RNA, 18 nt, Homo sapiens
aggguacaugugcacauu

SEQ ID NO: 2052836 - RNA, 15 nt, Homo sapiens
caaugcauuuuucaa

SEQ ID NO: 2052837 - RNA, 18 nt, Homo sapiens
cuuagcugucucagagau

SEQ ID NO: 2052838 - RNA, 20 nt, Homo sapiens
ugucacuggcagagcacagc

SEQ ID NO: 2052839 - RNA, 18 nt, Homo sapiens
gccuccaccucuccuugg

SEQ ID NO: 2052840 - RNA, 18 nt, Homo sapiens
uuuagauucccagugucu

SEQ ID NO: 2052841 - RNA, 18 nt, Homo sapiens
uccaaaauaaaaccucag

SEQ ID NO: 2052842 - RNA, 23 nt, Homo sapiens
caguauuuagaagccaacuauga

SEQ ID NO: 2052843 - RNA, 13 nt, Homo sapiens
cuacuuauuucag

SEQ ID NO: 2052844 - RNA, 20 nt, Homo sapiens
auacuccugcccaugaucca

SEQ ID NO: 2052845 - RNA, 21 nt, Homo sapiens
cucucuaucccugaaauccag

SEQ ID NO: 2052846 - RNA, 23 nt, Homo sapiens
cggccuggcggggcgcagugcug

SEQ ID NO: 2052847 - RNA, 11 nt, Homo sapiens
ucuugaucucc

SEQ ID NO: 2052848 - RNA, 11 nt, Homo sapiens
agcugaucagu

SEQ ID NO: 2052849 - RNA, 15 nt, Homo sapiens
cugggacugcugcuu

SEQ ID NO: 2052850 - RNA, 20 nt, Homo sapiens
ucccucccuggcucugccag

SEQ ID NO: 2052851 - RNA, 22 nt, Homo sapiens
agaucuggucccuugcagcuag

SEQ ID NO: 2052852 - RNA, 21 nt, Homo sapiens
caccccauauuguucuucaaa

SEQ ID NO: 2052853 - RNA, 14 nt, Homo sapiens
auaacaagggugua

SEQ ID NO: 2052854 - RNA, 15 nt, Homo sapiens
cagggucugcugagg

SEQ ID NO: 2052855 - RNA, 14 nt, Homo sapiens
uacuuagcuggcca

SEQ ID NO: 2052856 - RNA, 19 nt, Homo sapiens
gucugugugaaugugggca

SEQ ID NO: 2052857 - RNA, 22 nt, Homo sapiens
gagccaggagccuccugacccu

SEQ ID NO: 2052858 - RNA, 22 nt, Homo sapiens
augacagucagcaacaugauac

SEQ ID NO: 2052859 - RNA, 16 nt, Homo sapiens
gcaggcaugcuucuca

SEQ ID NO: 2052860 - RNA, 22 nt, Homo sapiens
acuucuuuuuggcauuaucucu

SEQ ID NO: 2052861 - RNA, 21 nt, Homo sapiens
auauuggcugguaaauugcca

SEQ ID NO: 2052862 - RNA, 22 nt, Homo sapiens
ccuauguuugcggaaugcauug

SEQ ID NO: 2052863 - RNA, 17 nt, Homo sapiens
cuuucccugauccugca

SEQ ID NO: 2052864 - RNA, 19 nt, Homo sapiens
gggaugggaccugaugacc

SEQ ID NO: 2052865 - RNA, 15 nt, Homo sapiens
ucuuauguuugcuuu

SEQ ID NO: 2052866 - RNA, 21 nt, Homo sapiens
aaauaaacagauacauucaca

SEQ ID NO: 2052867 - RNA, 11 nt, Homo sapiens
uaaacagugcc

SEQ ID NO: 2052868 - RNA, 21 nt, Homo sapiens
uguuagaaaaauagcugugaa

SEQ ID NO: 2052869 - RNA, 18 nt, Homo sapiens
cuaguacuauuacuagua

SEQ ID NO: 2052870 - RNA, 14 nt, Homo sapiens
caggccauggcuca

SEQ ID NO: 2052871 - RNA, 21 nt, Homo sapiens
auguacuuuuuaaaucauguu

SEQ ID NO: 2052872 - RNA, 13 nt, Homo sapiens
cuugcacuguuac

SEQ ID NO: 2052873 - RNA, 15 nt, Homo sapiens
aagagaaaggggcaa

SEQ ID NO: 2052874 - RNA, 14 nt, Homo sapiens
cauuuauaaaggga

SEQ ID NO: 2052875 - RNA, 14 nt, Homo sapiens
gcagcucuugcccu

SEQ ID NO: 2052876 - RNA, 19 nt, Homo sapiens
uucuauaaagaucauauau

SEQ ID NO: 2052877 - RNA, 21 nt, Homo sapiens
gaaucccccuugccaccccac

SEQ ID NO: 2052878 - RNA, 23 nt, Homo sapiens
ucuuggaaagacacaaaaaaaga

SEQ ID NO: 2052879 - RNA, 20 nt, Homo sapiens
cacuuucugccagcaucugc

SEQ ID NO: 2052880 - RNA, 20 nt, Homo sapiens
uuauaggauuuuugagcaca

SEQ ID NO: 2052881 - RNA, 21 nt, Homo sapiens
uagauuguaauacacauaucu

SEQ ID NO: 2052882 - RNA, 14 nt, Homo sapiens
caaccucuaccucc

SEQ ID NO: 2052883 - RNA, 13 nt, Homo sapiens
auucaaagcugcu

SEQ ID NO: 2052884 - RNA, 20 nt, Homo sapiens
ugguuauuucucaacaaagc

SEQ ID NO: 2052885 - RNA, 23 nt, Homo sapiens
acuguuuuugcuauuacaugugu

SEQ ID NO: 2052886 - RNA, 16 nt, Homo sapiens
ggggccugaggucauc

SEQ ID NO: 2052887 - RNA, 22 nt, Homo sapiens
acgcgcagaugugcagcagauu

SEQ ID NO: 2052888 - RNA, 16 nt, Homo sapiens
uuuugaaaaugggcuc

SEQ ID NO: 2052889 - RNA, 12 nt, Homo sapiens
ucauagcuaaaa

SEQ ID NO: 2052890 - RNA, 15 nt, Homo sapiens
acacuuguauuugga

SEQ ID NO: 2052891 - RNA, 13 nt, Homo sapiens
ccaggaguaccug

SEQ ID NO: 2052892 - RNA, 16 nt, Homo sapiens
cccugaagucuugcau

SEQ ID NO: 2052893 - RNA, 16 nt, Homo sapiens
agcaauccaugaucua

SEQ ID NO: 2052894 - RNA, 17 nt, Homo sapiens
aaucaaaguaaccucug

SEQ ID NO: 2052895 - RNA, 15 nt, Homo sapiens
ggcaaagagaccacu

SEQ ID NO: 2052896 - RNA, 18 nt, Homo sapiens
cacacacauaagcacuga

SEQ ID NO: 2052897 - RNA, 17 nt, Homo sapiens
uaaaaaaaaagaauucu

SEQ ID NO: 2052898 - RNA, 22 nt, Homo sapiens
caucagauccugggcacauucu

SEQ ID NO: 2052899 - RNA, 17 nt, Homo sapiens
uccaggaagcacaggcc

SEQ ID NO: 2052900 - RNA, 17 nt, Homo sapiens
cuauguucuguuaggag

SEQ ID NO: 2052901 - RNA, 12 nt, Homo sapiens
aacgcugccugc

SEQ ID NO: 2052902 - RNA, 18 nt, Homo sapiens
uaaaagcuucugcaauau

SEQ ID NO: 2052903 - RNA, 19 nt, Homo sapiens
uaaauggauuuccuagugg

SEQ ID NO: 2052904 - RNA, 19 nt, Homo sapiens
ccagcaacuugaacuucac

SEQ ID NO: 2052905 - RNA, 22 nt, Homo sapiens
ugugcuggccugaaaccaguga

SEQ ID NO: 2052906 - RNA, 15 nt, Homo sapiens
ccacauaagcacucc

SEQ ID NO: 2052907 - RNA, 11 nt, Homo sapiens
auuuacauuca

SEQ ID NO: 2052908 - RNA, 21 nt, Homo sapiens
uuagaauauaagaaaucuuua

SEQ ID NO: 2052909 - RNA, 19 nt, Homo sapiens
gacuugauguuccuuccag

SEQ ID NO: 2052910 - RNA, 22 nt, Homo sapiens
ccgucucuacuaaaaauacaaa

SEQ ID NO: 2052911 - RNA, 22 nt, Homo sapiens
uauuugggauauguauggguag

SEQ ID NO: 2052912 - RNA, 19 nt, Homo sapiens
agacuuggcuccaccacug

SEQ ID NO: 2052913 - RNA, 15 nt, Homo sapiens
cauuguccucugagc

SEQ ID NO: 2052914 - RNA, 14 nt, Homo sapiens
acucgggaagggaa

SEQ ID NO: 2052915 - RNA, 10 nt, Homo sapiens
uaaacauuca

SEQ ID NO: 2052916 - RNA, 18 nt, Homo sapiens
aagcucggugagugaugg

SEQ ID NO: 2052917 - RNA, 18 nt, Homo sapiens
ucacucuugccaaccugu

SEQ ID NO: 2052918 - RNA, 17 nt, Homo sapiens
cacauccacaugguuca

SEQ ID NO: 2052919 - RNA, 13 nt, Homo sapiens
cuguacugaggaa

SEQ ID NO: 2052920 - RNA, 21 nt, Homo sapiens
gagugugugauuagaagcuaa

SEQ ID NO: 2052921 - RNA, 16 nt, Homo sapiens
uuuuagcauugucuug

SEQ ID NO: 2052922 - RNA, 19 nt, Homo sapiens
aacccugccccacuucucu

SEQ ID NO: 2052923 - RNA, 12 nt, Homo sapiens
aguauuuggacu

SEQ ID NO: 2052924 - RNA, 17 nt, Homo sapiens
cuagcaagaccuguugg

SEQ ID NO: 2052925 - RNA, 22 nt, Homo sapiens
aucaggguagcugaaggaaauc

SEQ ID NO: 2052926 - RNA, 17 nt, Homo sapiens
uuuaaugggcacagggu

SEQ ID NO: 2052927 - RNA, 14 nt, Homo sapiens
gcacagcugcauua

SEQ ID NO: 2052928 - RNA, 22 nt, Homo sapiens
cugcauuugccugcuucuuucc

SEQ ID NO: 2052929 - RNA, 18 nt, Homo sapiens
aacagauuuuguauauac

SEQ ID NO: 2052930 - RNA, 15 nt, Homo sapiens
uaaacgggaacaugc

SEQ ID NO: 2052931 - RNA, 15 nt, Homo sapiens
ucccugcagaccuca

SEQ ID NO: 2052932 - RNA, 14 nt, Homo sapiens
uucagccaggagau

SEQ ID NO: 2052933 - RNA, 18 nt, Homo sapiens
gccagacuucccacggcu

SEQ ID NO: 2052934 - RNA, 22 nt, Homo sapiens
gugagcauaggugauccaugua

SEQ ID NO: 2052935 - RNA, 16 nt, Homo sapiens
ucaacuaugcaaugaa

SEQ ID NO: 2052936 - RNA, 14 nt, Homo sapiens
agagcaaacuuuag

SEQ ID NO: 2052937 - RNA, 18 nt, Homo sapiens
cauguaaggcuuaacaca

SEQ ID NO: 2052938 - RNA, 19 nt, Homo sapiens
acuccaccucuaccaaaaa

SEQ ID NO: 2052939 - RNA, 16 nt, Homo sapiens
aacauguacuuugagc

SEQ ID NO: 2052940 - RNA, 16 nt, Homo sapiens
ggagagcuggagccug

SEQ ID NO: 2052941 - RNA, 13 nt, Homo sapiens
gaccccaucucuu

SEQ ID NO: 2052942 - RNA, 20 nt, Homo sapiens
aggucagcgcgguccugacu

SEQ ID NO: 2052943 - RNA, 15 nt, Homo sapiens
aguuagaucuacccu

SEQ ID NO: 2052944 - RNA, 22 nt, Homo sapiens
aaguggcuugacaaucauuuga

SEQ ID NO: 2052945 - RNA, 16 nt, Homo sapiens
gccuugggccugggaa

SEQ ID NO: 2052946 - RNA, 19 nt, Homo sapiens
ugagggugcccagcuuaua

SEQ ID NO: 2052947 - RNA, 22 nt, Homo sapiens
cuccauauugcucucauuucaa

SEQ ID NO: 2052948 - RNA, 20 nt, Homo sapiens
uggacgacacggccucgcag

SEQ ID NO: 2052949 - RNA, 21 nt, Homo sapiens
augcacuauauguuuacacaa

SEQ ID NO: 2052950 - RNA, 13 nt, Homo sapiens
ucccuuggacauu

SEQ ID NO: 2052951 - RNA, 22 nt, Homo sapiens
cuguagagagcagcauucccag

SEQ ID NO: 2052952 - RNA, 22 nt, Homo sapiens
ccacacccuggaguggcauggu

SEQ ID NO: 2052953 - RNA, 15 nt, Homo sapiens
augacugaguaugga

SEQ ID NO: 2052954 - RNA, 15 nt, Homo sapiens
uagaauaaauuccca

SEQ ID NO: 2052955 - RNA, 17 nt, Homo sapiens
ugagcugguuugacuca

SEQ ID NO: 2052956 - RNA, 20 nt, Homo sapiens
gccucuacuuugauucugau

SEQ ID NO: 2052957 - RNA, 18 nt, Homo sapiens
auguggaaucuccaggcu

SEQ ID NO: 2052958 - RNA, 20 nt, Homo sapiens
gagcaucccauuuugccaau

SEQ ID NO: 2052959 - RNA, 12 nt, Homo sapiens
augauuaguaaa

SEQ ID NO: 2052960 - RNA, 21 nt, Homo sapiens
gugccagcccugcauugcuga

SEQ ID NO: 2052961 - RNA, 15 nt, Homo sapiens
augcuuugcuucaaa

SEQ ID NO: 2052962 - RNA, 17 nt, Homo sapiens
gguaagggacuccagaa

SEQ ID NO: 2052963 - RNA, 22 nt, Homo sapiens
uuucugcaaugguuuaguggcu

SEQ ID NO: 2052964 - RNA, 18 nt, Homo sapiens
cuccgcccccaugcucuc

SEQ ID NO: 2052965 - RNA, 21 nt, Homo sapiens
uaaauagggaaaauaaucuca

SEQ ID NO: 2052966 - RNA, 17 nt, Homo sapiens
gccaguuucuccaucca

SEQ ID NO: 2052967 - RNA, 15 nt, Homo sapiens
gaagaaaucaugaua

SEQ ID NO: 2052968 - RNA, 16 nt, Homo sapiens
gcagcugccauugcag

SEQ ID NO: 2052969 - RNA, 13 nt, Homo sapiens
uauaaugcuugga

SEQ ID NO: 2052970 - RNA, 21 nt, Homo sapiens
acauaacagugcagggcaaaa

SEQ ID NO: 2052971 - RNA, 15 nt, Homo sapiens
gagucagcugacccc

SEQ ID NO: 2052972 - RNA, 21 nt, Homo sapiens
cucuuugaacuccgcugccuu

SEQ ID NO: 2052973 - RNA, 17 nt, Homo sapiens
aacaacuguggucaauc

SEQ ID NO: 2052974 - RNA, 12 nt, Homo sapiens
gaugacaaagaa

SEQ ID NO: 2052975 - RNA, 22 nt, Homo sapiens
ucuucucgagcuacgagaccuu

SEQ ID NO: 2052976 - RNA, 16 nt, Homo sapiens
guaaaggccaugugaa

SEQ ID NO: 2052977 - RNA, 23 nt, Homo sapiens
caaacugcuuuuuccaacucaga

SEQ ID NO: 2052978 - RNA, 20 nt, Homo sapiens
guugucuacaccaaugccca

SEQ ID NO: 2052979 - RNA, 22 nt, Homo sapiens
ccugccagauuaucagaccucu

SEQ ID NO: 2052980 - RNA, 17 nt, Homo sapiens
uaaguuaaaauucugga

SEQ ID NO: 2052981 - RNA, 20 nt, Homo sapiens
cuuaaagggcccaaugaauu

SEQ ID NO: 2052982 - RNA, 22 nt, Homo sapiens
cuccgcugggaggaaccugaac

SEQ ID NO: 2052983 - RNA, 17 nt, Homo sapiens
ccuuccaggggugggac

SEQ ID NO: 2052984 - RNA, 23 nt, Homo sapiens
uacuugagugguguguguuauca

SEQ ID NO: 2052985 - RNA, 18 nt, Homo sapiens
ugauccugcugaccucac

SEQ ID NO: 2052986 - RNA, 14 nt, Homo sapiens
acuuucuaaaucaa

SEQ ID NO: 2052987 - RNA, 14 nt, Homo sapiens
caucacuaccuuua

SEQ ID NO: 2052988 - RNA, 14 nt, Homo sapiens
uauuuauaucucac

SEQ ID NO: 2052989 - RNA, 14 nt, Homo sapiens
acauaugacuugau

SEQ ID NO: 2052990 - RNA, 19 nt, Homo sapiens
gugcuuggucuguuugacu

SEQ ID NO: 2052991 - RNA, 14 nt, Homo sapiens
agccucacuuccuu

SEQ ID NO: 2052992 - RNA, 17 nt, Homo sapiens
agcugccuuccuggggc

SEQ ID NO: 2052993 - RNA, 22 nt, Homo sapiens
cauacaagaggcucccucuuga

SEQ ID NO: 2052994 - RNA, 21 nt, Homo sapiens
ucauacgucuuuauuacccaa

SEQ ID NO: 2052995 - RNA, 23 nt, Homo sapiens
aaaagacauguuggaaauguagu

SEQ ID NO: 2052996 - RNA, 21 nt, Homo sapiens
agccacagccugacacagugc

SEQ ID NO: 2052997 - RNA, 13 nt, Homo sapiens
gccgccacuggcu

SEQ ID NO: 2052998 - RNA, 17 nt, Homo sapiens
acagagacaggcccaag

SEQ ID NO: 2052999 - RNA, 18 nt, Homo sapiens
uuuccuaugacacucauc

SEQ ID NO: 2053000 - RNA, 18 nt, Homo sapiens
caggcugggcagggacaa

SEQ ID NO: 2053001 - RNA, 23 nt, Homo sapiens
caagagcugcccuccuuguccac

SEQ ID NO: 2053002 - RNA, 19 nt, Homo sapiens
cuuccuaagccuguggcug

SEQ ID NO: 2053003 - RNA, 20 nt, Homo sapiens
ucccuauucuguggauacag

SEQ ID NO: 2053004 - RNA, 12 nt, Homo sapiens
ugguuaaucucu

SEQ ID NO: 2053005 - RNA, 14 nt, Homo sapiens
cagaaacuacugac

SEQ ID NO: 2053006 - RNA, 20 nt, Homo sapiens
ugcaucccacguucuguuaa

SEQ ID NO: 2053007 - RNA, 20 nt, Homo sapiens
cucuaucaccaaggagccaa

SEQ ID NO: 2053008 - RNA, 21 nt, Homo sapiens
ucaucaaaaacacucucacua

SEQ ID NO: 2053009 - RNA, 19 nt, Homo sapiens
gcaaagacugcaguaucca

SEQ ID NO: 2053010 - RNA, 22 nt, Homo sapiens
uaaacuuggauucucuaaccuu

SEQ ID NO: 2053011 - RNA, 20 nt, Homo sapiens
auguauuucagggaccucag

SEQ ID NO: 2053012 - RNA, 15 nt, Homo sapiens
cagccugagauggau

SEQ ID NO: 2053013 - RNA, 19 nt, Homo sapiens
uacaguauauguugcaaaa

SEQ ID NO: 2053014 - RNA, 18 nt, Homo sapiens
ggcuuaaugaaggucaua

SEQ ID NO: 2053015 - RNA, 22 nt, Homo sapiens
aauauuguugacaacugugacu

SEQ ID NO: 2053016 - RNA, 18 nt, Homo sapiens
uacagccuucacuggaga

SEQ ID NO: 2053017 - RNA, 18 nt, Homo sapiens
aguugcaacuuuguauaa

SEQ ID NO: 2053018 - RNA, 13 nt, Homo sapiens
acucaagccugag

SEQ ID NO: 2053019 - RNA, 13 nt, Homo sapiens
ccucaagcaugag

SEQ ID NO: 2053020 - RNA, 15 nt, Homo sapiens
uguugaaugacugac

SEQ ID NO: 2053021 - RNA, 21 nt, Homo sapiens
agauggagucuggcucugucu

SEQ ID NO: 2053022 - RNA, 15 nt, Homo sapiens
aucaguuuuuguucu

SEQ ID NO: 2053023 - RNA, 21 nt, Homo sapiens
augugcuguugauucuuucaa

SEQ ID NO: 2053024 - RNA, 23 nt, Homo sapiens
uccaugguccugucuguccuucu

SEQ ID NO: 2053025 - RNA, 23 nt, Homo sapiens
caacagccaagcuggcacaaaag

SEQ ID NO: 2053026 - RNA, 18 nt, Homo sapiens
ccaggucaccauccucag

SEQ ID NO: 2053027 - RNA, 14 nt, Homo sapiens
uggaacguucucua

SEQ ID NO: 2053028 - RNA, 18 nt, Homo sapiens
uuaugauggucugcauua

SEQ ID NO: 2053029 - RNA, 22 nt, Homo sapiens
gaaauguuaaagguucacaggg

SEQ ID NO: 2053030 - RNA, 22 nt, Homo sapiens
guuauaaaacuauguguucaau

SEQ ID NO: 2053031 - RNA, 19 nt, Homo sapiens
aaucauuauuuucaaccau

SEQ ID NO: 2053032 - RNA, 17 nt, Homo sapiens
gcgcaggcccuggugga

SEQ ID NO: 2053033 - RNA, 15 nt, Homo sapiens
ggcccaaguugcagu

SEQ ID NO: 2053034 - RNA, 13 nt, Homo sapiens
ucaauuucuagua

SEQ ID NO: 2053035 - RNA, 19 nt, Homo sapiens
gcacuaguauuucuaugaa

SEQ ID NO: 2053036 - RNA, 12 nt, Homo sapiens
uagcucuuucag

SEQ ID NO: 2053037 - RNA, 20 nt, Homo sapiens
agaaaaggcagcuaaaggaa

SEQ ID NO: 2053038 - RNA, 17 nt, Homo sapiens
gaaucuauuuaucuuca

SEQ ID NO: 2053039 - RNA, 20 nt, Homo sapiens
uggugagaaauuucugugaa

SEQ ID NO: 2053040 - RNA, 16 nt, Homo sapiens
gaacgucagccagcuc

SEQ ID NO: 2053041 - RNA, 15 nt, Homo sapiens
aaucaugugaggaaa

SEQ ID NO: 2053042 - RNA, 21 nt, Homo sapiens
aauuaccgugagugacauagc

SEQ ID NO: 2053043 - RNA, 14 nt, Homo sapiens
cucagguguagcug

SEQ ID NO: 2053044 - RNA, 23 nt, Homo sapiens
cuaccgagucucuucuccacugg

SEQ ID NO: 2053045 - RNA, 12 nt, Homo sapiens
uuucacacugug

SEQ ID NO: 2053046 - RNA, 19 nt, Homo sapiens
uuccuucucaucugugauu

SEQ ID NO: 2053047 - RNA, 14 nt, Homo sapiens
acagucacaugccc

SEQ ID NO: 2053048 - RNA, 13 nt, Homo sapiens
ugugugccugccu

SEQ ID NO: 2053049 - RNA, 19 nt, Homo sapiens
caguaacugugacugauga

SEQ ID NO: 2053050 - RNA, 21 nt, Homo sapiens
acccagcccagaccucugaca

SEQ ID NO: 2053051 - RNA, 15 nt, Homo sapiens
aggauauaaugugug

SEQ ID NO: 2053052 - RNA, 16 nt, Homo sapiens
acacaaagacacagga

SEQ ID NO: 2053053 - RNA, 14 nt, Homo sapiens
uuuaaaaauaaagg

SEQ ID NO: 2053054 - RNA, 15 nt, Homo sapiens
cucugaagcaagagu

SEQ ID NO: 2053055 - RNA, 21 nt, Homo sapiens
caagaccaccaacguguccuu

SEQ ID NO: 2053056 - RNA, 13 nt, Homo sapiens
uuuccugugacac

SEQ ID NO: 2053057 - RNA, 19 nt, Homo sapiens
caugauggagucagguuug

SEQ ID NO: 2053058 - RNA, 13 nt, Homo sapiens
gucagauauuuga

SEQ ID NO: 2053059 - RNA, 12 nt, Homo sapiens
cacguaucccac

SEQ ID NO: 2053060 - RNA, 21 nt, Homo sapiens
aagagccggagccuccagcug

SEQ ID NO: 2053061 - RNA, 18 nt, Homo sapiens
aaagaaugggcaguuaca

SEQ ID NO: 2053062 - RNA, 17 nt, Homo sapiens
uuggaaagacuucucaa

SEQ ID NO: 2053063 - RNA, 17 nt, Homo sapiens
gcaccccaggcagccac

SEQ ID NO: 2053064 - RNA, 15 nt, Homo sapiens
uaauuagaccuaggc

SEQ ID NO: 2053065 - RNA, 16 nt, Homo sapiens
caacauuauccugugu

SEQ ID NO: 2053066 - RNA, 17 nt, Homo sapiens
uacugaaauacauauga

SEQ ID NO: 2053067 - RNA, 21 nt, Homo sapiens
aaucauaguuuaaacugcauu

SEQ ID NO: 2053068 - RNA, 17 nt, Homo sapiens
gaagauguguaaacagg

SEQ ID NO: 2053069 - RNA, 18 nt, Homo sapiens
cacuggggcagacaauaa

SEQ ID NO: 2053070 - RNA, 15 nt, Homo sapiens
uccuaaaguacugga

SEQ ID NO: 2053071 - RNA, 14 nt, Homo sapiens
uagaaagaaacuaa

SEQ ID NO: 2053072 - RNA, 16 nt, Homo sapiens
uuuggacccaguucag

SEQ ID NO: 2053073 - RNA, 20 nt, Homo sapiens
uguccuaaugcuugcugcug

SEQ ID NO: 2053074 - RNA, 14 nt, Homo sapiens
cuuucacucaggcu

SEQ ID NO: 2053075 - RNA, 14 nt, Homo sapiens
cugugucucaugga

SEQ ID NO: 2053076 - RNA, 16 nt, Homo sapiens
gaagggcauuaaccug

SEQ ID NO: 2053077 - RNA, 11 nt, Homo sapiens
uuuaaaguaaa

SEQ ID NO: 2053078 - RNA, 15 nt, Homo sapiens
ccuauacucuauaac

SEQ ID NO: 2053079 - RNA, 12 nt, Homo sapiens
ccuauaagcuua

SEQ ID NO: 2053080 - RNA, 21 nt, Homo sapiens
cuaaauaaaagaagucaagca

SEQ ID NO: 2053081 - RNA, 22 nt, Homo sapiens
accccugcuccccugagcugaa

SEQ ID NO: 2053082 - RNA, 19 nt, Homo sapiens
ugaauuguuacaucaugcu

SEQ ID NO: 2053083 - RNA, 14 nt, Homo sapiens
uaaggaucucucag

SEQ ID NO: 2053084 - RNA, 20 nt, Homo sapiens
ccugauaggacccauauucc

SEQ ID NO: 2053085 - RNA, 19 nt, Homo sapiens
ugaguagccccaacccaaa

SEQ ID NO: 2053086 - RNA, 19 nt, Homo sapiens
gaagggcuagaaccuggag

SEQ ID NO: 2053087 - RNA, 19 nt, Homo sapiens
cuuuccaaagaaauggaaa

SEQ ID NO: 2053088 - RNA, 13 nt, Homo sapiens
aguauuauuaaca

SEQ ID NO: 2053089 - RNA, 22 nt, Homo sapiens
uuugcuccuaaaccauugagcu

SEQ ID NO: 2053090 - RNA, 15 nt, Homo sapiens
caagcauucuguuua

SEQ ID NO: 2053091 - RNA, 19 nt, Homo sapiens
gauuaccugccaauugcua

SEQ ID NO: 2053092 - RNA, 13 nt, Homo sapiens
uucaagcucucug

SEQ ID NO: 2053093 - RNA, 13 nt, Homo sapiens
cucaggcuuucua

SEQ ID NO: 2053094 - RNA, 19 nt, Homo sapiens
ugaagaugaagaagccuuu

SEQ ID NO: 2053095 - RNA, 17 nt, Homo sapiens
cagaaauaguugucugu

SEQ ID NO: 2053096 - RNA, 22 nt, Homo sapiens
ccugcccuuaccugccaggaag

SEQ ID NO: 2053097 - RNA, 16 nt, Homo sapiens
gaaguagcuucagagg

SEQ ID NO: 2053098 - RNA, 20 nt, Homo sapiens
aaaauucucagaggacuugg

SEQ ID NO: 2053099 - RNA, 17 nt, Homo sapiens
uuuucacagucacugau

SEQ ID NO: 2053100 - RNA, 18 nt, Homo sapiens
uuuugcuuuugacuccag

SEQ ID NO: 2053101 - RNA, 20 nt, Homo sapiens
cucacgauuccagugcagua

SEQ ID NO: 2053102 - RNA, 20 nt, Homo sapiens
ccaaggggaauuacugaaaa

SEQ ID NO: 2053103 - RNA, 15 nt, Homo sapiens
ugcucuuugcugcac

SEQ ID NO: 2053104 - RNA, 15 nt, Homo sapiens
ggugcucuuccucau

SEQ ID NO: 2053105 - RNA, 19 nt, Homo sapiens
augaauguaaacucggggg

SEQ ID NO: 2053106 - RNA, 19 nt, Homo sapiens
uucucauguuugugcaugu

SEQ ID NO: 2053107 - RNA, 16 nt, Homo sapiens
ugaaauuagggcccaa

SEQ ID NO: 2053108 - RNA, 19 nt, Homo sapiens
aagggcugcaaugcccuca

SEQ ID NO: 2053109 - RNA, 14 nt, Homo sapiens
auuauucuucucaa

SEQ ID NO: 2053110 - RNA, 14 nt, Homo sapiens
aaugcccugugcau

SEQ ID NO: 2053111 - RNA, 12 nt, Homo sapiens
ggaaacaaguca

SEQ ID NO: 2053112 - RNA, 12 nt, Homo sapiens
aucaacaaagaa

SEQ ID NO: 2053113 - RNA, 14 nt, Homo sapiens
cagcaucauugcau

SEQ ID NO: 2053114 - RNA, 14 nt, Homo sapiens
cacaaacauucaaa

SEQ ID NO: 2053115 - RNA, 15 nt, Homo sapiens
agcugccucugcucc

SEQ ID NO: 2053116 - RNA, 18 nt, Homo sapiens
gggacucaguucuuggcc

SEQ ID NO: 2053117 - RNA, 14 nt, Homo sapiens
uuacucucaaugca

SEQ ID NO: 2053118 - RNA, 20 nt, Homo sapiens
ucuuagaguuuacaguuugu

SEQ ID NO: 2053119 - RNA, 22 nt, Homo sapiens
cacccccacccaccuccaccca

SEQ ID NO: 2053120 - RNA, 14 nt, Homo sapiens
agggugauaaauca

SEQ ID NO: 2053121 - RNA, 19 nt, Homo sapiens
uacuuugagccucuuaggc

SEQ ID NO: 2053122 - RNA, 21 nt, Homo sapiens
cagcauuuucacauuuugccu

SEQ ID NO: 2053123 - RNA, 21 nt, Homo sapiens
uauuuuuauacaaaccuacca

SEQ ID NO: 2053124 - RNA, 14 nt, Homo sapiens
cucugccauggccu

SEQ ID NO: 2053125 - RNA, 17 nt, Homo sapiens
uaagcauacaacuggac

SEQ ID NO: 2053126 - RNA, 20 nt, Homo sapiens
ugaaaugcuuuagcauacua

SEQ ID NO: 2053127 - RNA, 12 nt, Homo sapiens
uaacgacaauuu

SEQ ID NO: 2053128 - RNA, 20 nt, Homo sapiens
cuggaaugcaguggugcgau

SEQ ID NO: 2053129 - RNA, 14 nt, Homo sapiens
gacuaucaguuccc

SEQ ID NO: 2053130 - RNA, 16 nt, Homo sapiens
uuugaggaaagcaaga

SEQ ID NO: 2053131 - RNA, 17 nt, Homo sapiens
aaguguguguuucuugc

SEQ ID NO: 2053132 - RNA, 17 nt, Homo sapiens
ccuuggagaaguggcau

SEQ ID NO: 2053133 - RNA, 21 nt, Homo sapiens
ugacacacaaaucccauuaaa

SEQ ID NO: 2053134 - RNA, 16 nt, Homo sapiens
ccucaguccauuuaua

SEQ ID NO: 2053135 - RNA, 19 nt, Homo sapiens
ugcagaggccugggggacc

SEQ ID NO: 2053136 - RNA, 15 nt, Homo sapiens
uagacuauuugcuua

SEQ ID NO: 2053137 - RNA, 21 nt, Homo sapiens
ucuggaggacggucaguccau

SEQ ID NO: 2053138 - RNA, 14 nt, Homo sapiens
aaucuacacugccu

SEQ ID NO: 2053139 - RNA, 12 nt, Homo sapiens
aaagcuacugua

SEQ ID NO: 2053140 - RNA, 22 nt, Homo sapiens
cuguccugcagcaaacacucca

SEQ ID NO: 2053141 - RNA, 12 nt, Homo sapiens
aaagauaucuau

SEQ ID NO: 2053142 - RNA, 20 nt, Homo sapiens
cucccgaguaguugggauua

SEQ ID NO: 2053143 - RNA, 23 nt, Homo sapiens
gcccuggugaccagaccaaggca

SEQ ID NO: 2053144 - RNA, 21 nt, Homo sapiens
aacacaaggcuccaagaccua

SEQ ID NO: 2053145 - RNA, 12 nt, Homo sapiens
auuucauugcac

SEQ ID NO: 2053146 - RNA, 13 nt, Homo sapiens
acccucaggacaa

SEQ ID NO: 2053147 - RNA, 16 nt, Homo sapiens
cauuacaguucuuucc

SEQ ID NO: 2053148 - RNA, 18 nt, Homo sapiens
aguguaauugagaaggaa

SEQ ID NO: 2053149 - RNA, 16 nt, Homo sapiens
ugcuuguaaaaccaac

SEQ ID NO: 2053150 - RNA, 22 nt, Homo sapiens
accaggagcagcagccagcacc

SEQ ID NO: 2053151 - RNA, 17 nt, Homo sapiens
acagccacuaaaacaca

SEQ ID NO: 2053152 - RNA, 18 nt, Homo sapiens
cuccuuggcuuuaugcaa

SEQ ID NO: 2053153 - RNA, 17 nt, Homo sapiens
gaugucaugucugcuug

SEQ ID NO: 2053154 - RNA, 17 nt, Homo sapiens
gacuucuuuuuggcauu

SEQ ID NO: 2053155 - RNA, 16 nt, Homo sapiens
aacauacuucagcuca

SEQ ID NO: 2053156 - RNA, 16 nt, Homo sapiens
ccuucgccucccagga

SEQ ID NO: 2053157 - RNA, 21 nt, Homo sapiens
gacgugccuaccucuuagaca

SEQ ID NO: 2053158 - RNA, 14 nt, Homo sapiens
acacggaugcacag

SEQ ID NO: 2053159 - RNA, 17 nt, Homo sapiens
uaccgaugcagcucucu

SEQ ID NO: 2053160 - RNA, 18 nt, Homo sapiens
ucuuuguucaaauguacu

SEQ ID NO: 2053161 - RNA, 16 nt, Homo sapiens
uggaugcgugugaacg

SEQ ID NO: 2053162 - RNA, 16 nt, Homo sapiens
aacagcaagucaccca

SEQ ID NO: 2053163 - RNA, 22 nt, Homo sapiens
acagucacugcucuucagccau

SEQ ID NO: 2053164 - RNA, 21 nt, Homo sapiens
caugaagccuguggaugauca

SEQ ID NO: 2053165 - RNA, 19 nt, Homo sapiens
gaggagggggcccggcugg

SEQ ID NO: 2053166 - RNA, 14 nt, Homo sapiens
gaagauaaacacaa

SEQ ID NO: 2053167 - RNA, 19 nt, Homo sapiens
ccauuucauauucuuucaa

SEQ ID NO: 2053168 - RNA, 17 nt, Homo sapiens
aauuauaaucuguggau

SEQ ID NO: 2053169 - RNA, 14 nt, Homo sapiens
cagucaccacucca

SEQ ID NO: 2053170 - RNA, 16 nt, Homo sapiens
cucugccgguccccca

SEQ ID NO: 2053171 - RNA, 20 nt, Homo sapiens
gggucacugggggacacugu

SEQ ID NO: 2053172 - RNA, 19 nt, Homo sapiens
cucaaaggagccuuuucaa

SEQ ID NO: 2053173 - RNA, 23 nt, Homo sapiens
agcaaacuuauaaaucauauucu

SEQ ID NO: 2053174 - RNA, 22 nt, Homo sapiens
uaaccuauucccaaaugccuuc

SEQ ID NO: 2053175 - RNA, 21 nt, Homo sapiens
caaggccaucugcuuaccaca

SEQ ID NO: 2053176 - RNA, 18 nt, Homo sapiens
gcagugcuaaagccugug

SEQ ID NO: 2053177 - RNA, 22 nt, Homo sapiens
gggaaaagcccaugaucuucaa

SEQ ID NO: 2053178 - RNA, 11 nt, Homo sapiens
caaauguguac

SEQ ID NO: 2053179 - RNA, 11 nt, Homo sapiens
uuaaugugcuc

SEQ ID NO: 2053180 - RNA, 15 nt, Homo sapiens
agggguuaagagcuc

SEQ ID NO: 2053181 - RNA, 15 nt, Homo sapiens
auaagacaaugacau

SEQ ID NO: 2053182 - RNA, 18 nt, Homo sapiens
aggcaauuucucugcaca

SEQ ID NO: 2053183 - RNA, 20 nt, Homo sapiens
uuuaacuuuaaggauuugaa

SEQ ID NO: 2053184 - RNA, 22 nt, Homo sapiens
acccugcgcccaguccuuccac

SEQ ID NO: 2053185 - RNA, 14 nt, Homo sapiens
cucuugcuuucaca

SEQ ID NO: 2053186 - RNA, 14 nt, Homo sapiens
uuacaggcacgugc

SEQ ID NO: 2053187 - RNA, 22 nt, Homo sapiens
gccccacccccaugaccacugc

SEQ ID NO: 2053188 - RNA, 14 nt, Homo sapiens
agggaacagucaua

SEQ ID NO: 2053189 - RNA, 16 nt, Homo sapiens
gucuaauuugcaccuu

SEQ ID NO: 2053190 - RNA, 15 nt, Homo sapiens
ucuauuuucugcaga

SEQ ID NO: 2053191 - RNA, 21 nt, Homo sapiens
cugaggugagcaucaucuucu

SEQ ID NO: 2053192 - RNA, 20 nt, Homo sapiens
aggcuuuguacagagugcuu

SEQ ID NO: 2053193 - RNA, 19 nt, Homo sapiens
ucccgugugccucuuuuau

SEQ ID NO: 2053194 - RNA, 16 nt, Homo sapiens
cagaugaacauuucaa

SEQ ID NO: 2053195 - RNA, 20 nt, Homo sapiens
cagauuccccccaucuccau

SEQ ID NO: 2053196 - RNA, 12 nt, Homo sapiens
agggacucucca

SEQ ID NO: 2053197 - RNA, 22 nt, Homo sapiens
ccaauuaaaaguaugcagauua

SEQ ID NO: 2053198 - RNA, 21 nt, Homo sapiens
cucugagcacgccccacgcau

SEQ ID NO: 2053199 - RNA, 13 nt, Homo sapiens
uacuuacccucac

SEQ ID NO: 2053200 - RNA, 14 nt, Homo sapiens
agaauggcauuugc

SEQ ID NO: 2053201 - RNA, 20 nt, Homo sapiens
ugucuaacuggggauauaau

SEQ ID NO: 2053202 - RNA, 19 nt, Homo sapiens
cuugauuuucuuucuccuc

SEQ ID NO: 2053203 - RNA, 16 nt, Homo sapiens
aggaccuggcugccau

SEQ ID NO: 2053204 - RNA, 12 nt, Homo sapiens
aggacagcauua

SEQ ID NO: 2053205 - RNA, 12 nt, Homo sapiens
auggcagcagug

SEQ ID NO: 2053206 - RNA, 17 nt, Homo sapiens
ugccaacuccaugucag

SEQ ID NO: 2053207 - RNA, 20 nt, Homo sapiens
uaaagugagcaugcuuucug

SEQ ID NO: 2053208 - RNA, 19 nt, Homo sapiens
gaauuccucuuuugcuuaa

SEQ ID NO: 2053209 - RNA, 16 nt, Homo sapiens
gauuuuaaaaagggua

SEQ ID NO: 2053210 - RNA, 14 nt, Homo sapiens
acauagagccagcu

SEQ ID NO: 2053211 - RNA, 15 nt, Homo sapiens
agagaccccaggaac

SEQ ID NO: 2053212 - RNA, 12 nt, Homo sapiens
cacaaagugaaa

SEQ ID NO: 2053213 - RNA, 22 nt, Homo sapiens
gaguuuagcccugaacauuuca

SEQ ID NO: 2053214 - RNA, 19 nt, Homo sapiens
gagggcuugaaauguguac

SEQ ID NO: 2053215 - RNA, 21 nt, Homo sapiens
caaaccuccugucagugagga

SEQ ID NO: 2053216 - RNA, 14 nt, Homo sapiens
cuugaggggaccag

SEQ ID NO: 2053217 - RNA, 18 nt, Homo sapiens
uuaacuccauauguguuc

SEQ ID NO: 2053218 - RNA, 22 nt, Homo sapiens
uuaaacaacaaacaaaacgcaa

SEQ ID NO: 2053219 - RNA, 19 nt, Homo sapiens
auccgauuccccuguagca

SEQ ID NO: 2053220 - RNA, 18 nt, Homo sapiens
auaugaguaauacaucaa

SEQ ID NO: 2053221 - RNA, 14 nt, Homo sapiens
aucaucucagcuca

SEQ ID NO: 2053222 - RNA, 12 nt, Homo sapiens
cucaggaccagg

SEQ ID NO: 2053223 - RNA, 22 nt, Homo sapiens
ugggcucccucuugugggauaa

SEQ ID NO: 2053224 - RNA, 15 nt, Homo sapiens
aaguaucccaucuaa

SEQ ID NO: 2053225 - RNA, 15 nt, Homo sapiens
agaaauaauaugcau

SEQ ID NO: 2053226 - RNA, 21 nt, Homo sapiens
caagaaugucuccauuguuaa

SEQ ID NO: 2053227 - RNA, 21 nt, Homo sapiens
ucaucucuuuucccacucccu

SEQ ID NO: 2053228 - RNA, 21 nt, Homo sapiens
uuguaagaaaaugagacaaaa

SEQ ID NO: 2053229 - RNA, 13 nt, Homo sapiens
aacagcauaacua

SEQ ID NO: 2053230 - RNA, 21 nt, Homo sapiens
aaaacucaaccaaaugguaca

SEQ ID NO: 2053231 - RNA, 21 nt, Homo sapiens
cuguccaaggcacaaaccuua

SEQ ID NO: 2053232 - RNA, 13 nt, Homo sapiens
cucauccaugcac

SEQ ID NO: 2053233 - RNA, 20 nt, Homo sapiens
ucugagguaaagguccauga

SEQ ID NO: 2053234 - RNA, 13 nt, Homo sapiens
cuucaaagccacu

SEQ ID NO: 2053235 - RNA, 20 nt, Homo sapiens
aggcaggaccagaaggcaau

SEQ ID NO: 2053236 - RNA, 15 nt, Homo sapiens
cuuauauuguucacu

SEQ ID NO: 2053237 - RNA, 22 nt, Homo sapiens
uuguauuuaauacacaaugcau

SEQ ID NO: 2053238 - RNA, 17 nt, Homo sapiens
gccacaaaauguugcaa

SEQ ID NO: 2053239 - RNA, 22 nt, Homo sapiens
gucuauuucaucagaacagcug

SEQ ID NO: 2053240 - RNA, 13 nt, Homo sapiens
gaagaagcuacug

SEQ ID NO: 2053241 - RNA, 12 nt, Homo sapiens
gauuuuauacau

SEQ ID NO: 2053242 - RNA, 22 nt, Homo sapiens
uagugcaauaaaacucccuucc

SEQ ID NO: 2053243 - RNA, 21 nt, Homo sapiens
uuaaacacggggcuugcaacu

SEQ ID NO: 2053244 - RNA, 21 nt, Homo sapiens
ucaugcaagacuucacugcag

SEQ ID NO: 2053245 - RNA, 18 nt, Homo sapiens
gacuuauuuaaacucugu

SEQ ID NO: 2053246 - RNA, 22 nt, Homo sapiens
cuugccugcaugaaacauguuc

SEQ ID NO: 2053247 - RNA, 13 nt, Homo sapiens
cugagcuauuuca

SEQ ID NO: 2053248 - RNA, 13 nt, Homo sapiens
uugagcuacuuca

SEQ ID NO: 2053249 - RNA, 14 nt, Homo sapiens
cuuaguagucaaaa

SEQ ID NO: 2053250 - RNA, 18 nt, Homo sapiens
cucccccacuccucccua

SEQ ID NO: 2053251 - RNA, 23 nt, Homo sapiens
ggggccaggucacccuuugcugu

SEQ ID NO: 2053252 - RNA, 23 nt, Homo sapiens
caaggagucacugagaccaaggc

SEQ ID NO: 2053253 - RNA, 21 nt, Homo sapiens
ccuggcagcccgcaucagcug

SEQ ID NO: 2053254 - RNA, 15 nt, Homo sapiens
uaaauaacugugacu

SEQ ID NO: 2053255 - RNA, 16 nt, Homo sapiens
agccugggagcccaga

SEQ ID NO: 2053256 - RNA, 20 nt, Homo sapiens
uccacaagauucccagagac

SEQ ID NO: 2053257 - RNA, 21 nt, Homo sapiens
aggagcauuuugugucuuaag

SEQ ID NO: 2053258 - RNA, 14 nt, Homo sapiens
aauucuccuccuga

SEQ ID NO: 2053259 - RNA, 20 nt, Homo sapiens
gcuucugggccacucaggcc

SEQ ID NO: 2053260 - RNA, 21 nt, Homo sapiens
cccagugggaacugugcaaag

SEQ ID NO: 2053261 - RNA, 16 nt, Homo sapiens
agugaguuacagcgag

SEQ ID NO: 2053262 - RNA, 17 nt, Homo sapiens
uauaagcccugcauaau

SEQ ID NO: 2053263 - RNA, 13 nt, Homo sapiens
ggagugugccccu

SEQ ID NO: 2053264 - RNA, 13 nt, Homo sapiens
uaacacaacaaua

SEQ ID NO: 2053265 - RNA, 22 nt, Homo sapiens
ucucaaacuccugaccucaggc

SEQ ID NO: 2053266 - RNA, 15 nt, Homo sapiens
cucgacccacgcaga

SEQ ID NO: 2053267 - RNA, 11 nt, Homo sapiens
ugaaugugcug

SEQ ID NO: 2053268 - RNA, 20 nt, Homo sapiens
gauuaaauuuaauauacugc

SEQ ID NO: 2053269 - RNA, 20 nt, Homo sapiens
uagagauagcuacaguguaa

SEQ ID NO: 2053270 - RNA, 12 nt, Homo sapiens
uuuaagucucac

SEQ ID NO: 2053271 - RNA, 15 nt, Homo sapiens
augugaggauguauc

SEQ ID NO: 2053272 - RNA, 22 nt, Homo sapiens
uguuagcaauauguuagcaaga

SEQ ID NO: 2053273 - RNA, 15 nt, Homo sapiens
aaugacauucaauaa

SEQ ID NO: 2053274 - RNA, 18 nt, Homo sapiens
agaagaaauuauuuaaua

SEQ ID NO: 2053275 - RNA, 12 nt, Homo sapiens
gaauaauugcau

SEQ ID NO: 2053276 - RNA, 12 nt, Homo sapiens
aaagaauuacag

SEQ ID NO: 2053277 - RNA, 14 nt, Homo sapiens
ucaguuguuuuccc

SEQ ID NO: 2053278 - RNA, 14 nt, Homo sapiens
auaaugauacuuaa

SEQ ID NO: 2053279 - RNA, 15 nt, Homo sapiens
cagccugcacagugg

SEQ ID NO: 2053280 - RNA, 16 nt, Homo sapiens
agugauucucuugacg

SEQ ID NO: 2053281 - RNA, 18 nt, Homo sapiens
cacaggauccuauucuca

SEQ ID NO: 2053282 - RNA, 20 nt, Homo sapiens
gcccccauacuuggcugcuu

SEQ ID NO: 2053283 - RNA, 11 nt, Homo sapiens
caugugcugca

SEQ ID NO: 2053284 - RNA, 17 nt, Homo sapiens
augcacacacauggaug

SEQ ID NO: 2053285 - RNA, 23 nt, Homo sapiens
auuggacacguaaccuggcucua

SEQ ID NO: 2053286 - RNA, 17 nt, Homo sapiens
gugccacaccccaugca

SEQ ID NO: 2053287 - RNA, 19 nt, Homo sapiens
ugagguaucacugcaguca

SEQ ID NO: 2053288 - RNA, 18 nt, Homo sapiens
cuauauuuauacuguaua

SEQ ID NO: 2053289 - RNA, 20 nt, Homo sapiens
agugguguuccaugacuuca

SEQ ID NO: 2053290 - RNA, 20 nt, Homo sapiens
cuuauaagaauuaaucuuaa

SEQ ID NO: 2053291 - RNA, 13 nt, Homo sapiens
augggcagaagau

SEQ ID NO: 2053292 - RNA, 17 nt, Homo sapiens
uacuuugguaguggaau

SEQ ID NO: 2053293 - RNA, 19 nt, Homo sapiens
uugagaacuacagcuuuua

SEQ ID NO: 2053294 - RNA, 15 nt, Homo sapiens
gucaauguguucuua

SEQ ID NO: 2053295 - RNA, 15 nt, Homo sapiens
gcaccgccucagggu

SEQ ID NO: 2053296 - RNA, 13 nt, Homo sapiens
cuuccccucucag

SEQ ID NO: 2053297 - RNA, 18 nt, Homo sapiens
acuccuuaauaugaucug

SEQ ID NO: 2053298 - RNA, 16 nt, Homo sapiens
cuaccuuaaacuuaag

SEQ ID NO: 2053299 - RNA, 17 nt, Homo sapiens
cugugccuaacaccagc

SEQ ID NO: 2053300 - RNA, 19 nt, Homo sapiens
aaucugccuguaucucuca

SEQ ID NO: 2053301 - RNA, 18 nt, Homo sapiens
uuacaaguuucaguaaua

SEQ ID NO: 2053302 - RNA, 23 nt, Homo sapiens
cuacccugagaucugcacaguca

SEQ ID NO: 2053303 - RNA, 18 nt, Homo sapiens
ccaccaacauucuuggca

SEQ ID NO: 2053304 - RNA, 21 nt, Homo sapiens
ugauccaugaguuugcccugg

SEQ ID NO: 2053305 - RNA, 13 nt, Homo sapiens
caucauagggaua

SEQ ID NO: 2053306 - RNA, 16 nt, Homo sapiens
ugccacaaggaagaaa

SEQ ID NO: 2053307 - RNA, 16 nt, Homo sapiens
agugugauugugaacu

SEQ ID NO: 2053308 - RNA, 16 nt, Homo sapiens
auauagaauuauuaca

SEQ ID NO: 2053309 - RNA, 18 nt, Homo sapiens
acuaccuuuauagcucau

SEQ ID NO: 2053310 - RNA, 13 nt, Homo sapiens
gccucugcuuguu

SEQ ID NO: 2053311 - RNA, 14 nt, Homo sapiens
acugaacauccaaa

SEQ ID NO: 2053312 - RNA, 17 nt, Homo sapiens
uaaucugaaacacaguc

SEQ ID NO: 2053313 - RNA, 17 nt, Homo sapiens
cuagauacaugcuuuuu

SEQ ID NO: 2053314 - RNA, 18 nt, Homo sapiens
caaacccugugucacugu

SEQ ID NO: 2053315 - RNA, 21 nt, Homo sapiens
ccuaugacuaauucacaaaaa

SEQ ID NO: 2053316 - RNA, 14 nt, Homo sapiens
uguaacaucaggga

SEQ ID NO: 2053317 - RNA, 13 nt, Homo sapiens
gguaugaccagug

SEQ ID NO: 2053318 - RNA, 14 nt, Homo sapiens
ugucucucugccaa

SEQ ID NO: 2053319 - RNA, 18 nt, Homo sapiens
cuccaacaucacagccca

SEQ ID NO: 2053320 - RNA, 16 nt, Homo sapiens
cauuugcguguaucua

SEQ ID NO: 2053321 - RNA, 17 nt, Homo sapiens
acaaauaaguaauaucu

SEQ ID NO: 2053322 - RNA, 15 nt, Homo sapiens
cuacuugucauauca

SEQ ID NO: 2053323 - RNA, 15 nt, Homo sapiens
aauaauguauacaca

SEQ ID NO: 2053324 - RNA, 21 nt, Homo sapiens
uuaaacccuugcugcugaauu

SEQ ID NO: 2053325 - RNA, 18 nt, Homo sapiens
cagagacccagaucucau

SEQ ID NO: 2053326 - RNA, 17 nt, Homo sapiens
aucaagaaaucccugag

SEQ ID NO: 2053327 - RNA, 18 nt, Homo sapiens
uauggguuaaaucaaaga

SEQ ID NO: 2053328 - RNA, 21 nt, Homo sapiens
aauuagauaaauguccauucu

SEQ ID NO: 2053329 - RNA, 19 nt, Homo sapiens
cuuuauguuacuacaugca

SEQ ID NO: 2053330 - RNA, 23 nt, Homo sapiens
guagaggggccccugauccucac

SEQ ID NO: 2053331 - RNA, 18 nt, Homo sapiens
cacaccaaugcgcacaca

SEQ ID NO: 2053332 - RNA, 21 nt, Homo sapiens
cgaaaccaguuaagaauggaa

SEQ ID NO: 2053333 - RNA, 19 nt, Homo sapiens
cuucugguauaauugugua

SEQ ID NO: 2053334 - RNA, 18 nt, Homo sapiens
uaagaagacugcauuaua

SEQ ID NO: 2053335 - RNA, 13 nt, Homo sapiens
uaaacaauauuac

SEQ ID NO: 2053336 - RNA, 12 nt, Homo sapiens
ucaccauuucau

SEQ ID NO: 2053337 - RNA, 15 nt, Homo sapiens
ucagucacagccacc

SEQ ID NO: 2053338 - RNA, 22 nt, Homo sapiens
aagguuccaacuggaaacccuu

SEQ ID NO: 2053339 - RNA, 20 nt, Homo sapiens
guucugaauaugcugcucau

SEQ ID NO: 2053340 - RNA, 16 nt, Homo sapiens
gagugagaucuuacag

SEQ ID NO: 2053341 - RNA, 15 nt, Homo sapiens
cucuacuaugaagug

SEQ ID NO: 2053342 - RNA, 20 nt, Homo sapiens
uccugagcagugccagcuuu

SEQ ID NO: 2053343 - RNA, 15 nt, Homo sapiens
caggcagacacagcu

SEQ ID NO: 2053344 - RNA, 11 nt, Homo sapiens
aucauaacuca

SEQ ID NO: 2053345 - RNA, 20 nt, Homo sapiens
cuuccacaacugcugcaugu

SEQ ID NO: 2053346 - RNA, 14 nt, Homo sapiens
aaugucaaacuuga

SEQ ID NO: 2053347 - RNA, 16 nt, Homo sapiens
aucccccaaugaccuu

SEQ ID NO: 2053348 - RNA, 12 nt, Homo sapiens
agugugauccca

SEQ ID NO: 2053349 - RNA, 17 nt, Homo sapiens
aguggacgugguaugaa

SEQ ID NO: 2053350 - RNA, 14 nt, Homo sapiens
ugcuguuaccaaau

SEQ ID NO: 2053351 - RNA, 22 nt, Homo sapiens
caaacauauccuuucaagacag

SEQ ID NO: 2053352 - RNA, 18 nt, Homo sapiens
uuccuucugcacccagaa

SEQ ID NO: 2053353 - RNA, 21 nt, Homo sapiens
cuucccaaauagcagcacagc

SEQ ID NO: 2053354 - RNA, 18 nt, Homo sapiens
agaccccuuguugcacug

SEQ ID NO: 2053355 - RNA, 22 nt, Homo sapiens
cagacagguguauggagucacc

SEQ ID NO: 2053356 - RNA, 19 nt, Homo sapiens
acuaguacuguguacugua

SEQ ID NO: 2053357 - RNA, 19 nt, Homo sapiens
gaauaaaguugcugugaau

SEQ ID NO: 2053358 - RNA, 13 nt, Homo sapiens
accuuagaauaca

SEQ ID NO: 2053359 - RNA, 16 nt, Homo sapiens
uuaauaaaggccacag

SEQ ID NO: 2053360 - RNA, 22 nt, Homo sapiens
uuacgaaaaaaugguagcauuu

SEQ ID NO: 2053361 - RNA, 20 nt, Homo sapiens
ccuaguagcugggaugacag

SEQ ID NO: 2053362 - RNA, 23 nt, Homo sapiens
uuggagggguauuuuugcccuga

SEQ ID NO: 2053363 - RNA, 12 nt, Homo sapiens
cuccuagccuug

SEQ ID NO: 2053364 - RNA, 14 nt, Homo sapiens
auuuuaauuauaau

SEQ ID NO: 2053365 - RNA, 18 nt, Homo sapiens
cuuuugcugugugaaauc

SEQ ID NO: 2053366 - RNA, 23 nt, Homo sapiens
guuucuggacauucucuuugaua

SEQ ID NO: 2053367 - RNA, 20 nt, Homo sapiens
gcagaggcuaauucaguguc

SEQ ID NO: 2053368 - RNA, 17 nt, Homo sapiens
gcuaugccuccauuuca

SEQ ID NO: 2053369 - RNA, 19 nt, Homo sapiens
acuccaaaguccacacaaa

SEQ ID NO: 2053370 - RNA, 23 nt, Homo sapiens
caucacccgggaacuuuuuuaga

SEQ ID NO: 2053371 - RNA, 13 nt, Homo sapiens
cuuccaaaagccu

SEQ ID NO: 2053372 - RNA, 21 nt, Homo sapiens
gaauauuguuucuuuaucacc

SEQ ID NO: 2053373 - RNA, 23 nt, Homo sapiens
accuugcccacggcaacugccuu

SEQ ID NO: 2053374 - RNA, 19 nt, Homo sapiens
ccagagacagaggaugugg

SEQ ID NO: 2053375 - RNA, 22 nt, Homo sapiens
acaaugguagcucugaagggag

SEQ ID NO: 2053376 - RNA, 16 nt, Homo sapiens
accuagcagccucaaa

SEQ ID NO: 2053377 - RNA, 10 nt, Homo sapiens
augcccuccc

SEQ ID NO: 2053378 - RNA, 17 nt, Homo sapiens
uggaucuuuugguggag

SEQ ID NO: 2053379 - RNA, 22 nt, Homo sapiens
cuggugauggauuaacauauag

SEQ ID NO: 2053380 - RNA, 18 nt, Homo sapiens
cuauccaccacugcuuaa

SEQ ID NO: 2053381 - RNA, 20 nt, Homo sapiens
aauaaucuaaacaccaaaaa

SEQ ID NO: 2053382 - RNA, 17 nt, Homo sapiens
ucacucugacaguauua

SEQ ID NO: 2053383 - RNA, 17 nt, Homo sapiens
uaagacauaaacaaaga

SEQ ID NO: 2053384 - RNA, 22 nt, Homo sapiens
uggaaaauaauaaaagaaucau

SEQ ID NO: 2053385 - RNA, 16 nt, Homo sapiens
cguuuucuacuuugaa

SEQ ID NO: 2053386 - RNA, 22 nt, Homo sapiens
cguuuaaucaguuucugaaaug

SEQ ID NO: 2053387 - RNA, 15 nt, Homo sapiens
aggcgugguggugca

SEQ ID NO: 2053388 - RNA, 15 nt, Homo sapiens
uacagacuccaaaag

SEQ ID NO: 2053389 - RNA, 23 nt, Homo sapiens
gcuaaccugcacguugugcacau

SEQ ID NO: 2053390 - RNA, 17 nt, Homo sapiens
aggauauccucccucca

SEQ ID NO: 2053391 - RNA, 22 nt, Homo sapiens
aacaucucuuucucauuagaga

SEQ ID NO: 2053392 - RNA, 16 nt, Homo sapiens
agauggggcacugacc

SEQ ID NO: 2053393 - RNA, 22 nt, Homo sapiens
gcagagagguggagaacuggga

SEQ ID NO: 2053394 - RNA, 21 nt, Homo sapiens
cugcccuccccagagcacugg

SEQ ID NO: 2053395 - RNA, 13 nt, Homo sapiens
uauuccuuuucau

SEQ ID NO: 2053396 - RNA, 23 nt, Homo sapiens
gugauggccagucaugugcuggu

SEQ ID NO: 2053397 - RNA, 18 nt, Homo sapiens
uaccauauguagcauuaa

SEQ ID NO: 2053398 - RNA, 22 nt, Homo sapiens
auuugaauagccuguuccuuua

SEQ ID NO: 2053399 - RNA, 18 nt, Homo sapiens
acaagagacuuaacuuau

SEQ ID NO: 2053400 - RNA, 21 nt, Homo sapiens
agccccugccagcuuccccua

SEQ ID NO: 2053401 - RNA, 22 nt, Homo sapiens
auaugcaggacagcaguacuca

SEQ ID NO: 2053402 - RNA, 16 nt, Homo sapiens
guagauucacauacag

SEQ ID NO: 2053403 - RNA, 12 nt, Homo sapiens
uauggacucugc

SEQ ID NO: 2053404 - RNA, 21 nt, Homo sapiens
gagcagaugcaaucucuuguc

SEQ ID NO: 2053405 - RNA, 19 nt, Homo sapiens
cuggaguaucauucuuuac

SEQ ID NO: 2053406 - RNA, 19 nt, Homo sapiens
aaaaaccaacaaugugauu

SEQ ID NO: 2053407 - RNA, 21 nt, Homo sapiens
gugaugggccccucagccagg

SEQ ID NO: 2053408 - RNA, 18 nt, Homo sapiens
ccacugguccugcugcug

SEQ ID NO: 2053409 - RNA, 18 nt, Homo sapiens
ucacuuguuuuauugacu

SEQ ID NO: 2053410 - RNA, 18 nt, Homo sapiens
ugcauuugcagugcauca

SEQ ID NO: 2053411 - RNA, 16 nt, Homo sapiens
uacuguacugagacau

SEQ ID NO: 2053412 - RNA, 17 nt, Homo sapiens
cucagcuugcacaaaga

SEQ ID NO: 2053413 - RNA, 21 nt, Homo sapiens
auccaauauguuuccaucacu

SEQ ID NO: 2053414 - RNA, 16 nt, Homo sapiens
caaaguuucuguugaa

SEQ ID NO: 2053415 - RNA, 13 nt, Homo sapiens
cuguuagguccau

SEQ ID NO: 2053416 - RNA, 15 nt, Homo sapiens
gcuguagacaucugu

SEQ ID NO: 2053417 - RNA, 13 nt, Homo sapiens
aaacauuccaaga

SEQ ID NO: 2053418 - RNA, 18 nt, Homo sapiens
gcaagucuuccaugaccc

SEQ ID NO: 2053419 - RNA, 19 nt, Homo sapiens
guguuuucaauuuuaaaca

SEQ ID NO: 2053420 - RNA, 20 nt, Homo sapiens
uguucugcagagacuucuag

SEQ ID NO: 2053421 - RNA, 17 nt, Homo sapiens
ucugugcaaaacuacca

SEQ ID NO: 2053422 - RNA, 21 nt, Homo sapiens
gucccuucucccaucaggguc

SEQ ID NO: 2053423 - RNA, 19 nt, Homo sapiens
ucagggucuaagcaccuug

SEQ ID NO: 2053424 - RNA, 18 nt, Homo sapiens
acugucagcugagcuuga

SEQ ID NO: 2053425 - RNA, 19 nt, Homo sapiens
cagaguugauaaauuagau

SEQ ID NO: 2053426 - RNA, 14 nt, Homo sapiens
aaauacaaucagcc

SEQ ID NO: 2053427 - RNA, 18 nt, Homo sapiens
ccuauagcacugagcuca

SEQ ID NO: 2053428 - RNA, 23 nt, Homo sapiens
ugccuauaaauuuacucuguuga

SEQ ID NO: 2053429 - RNA, 20 nt, Homo sapiens
acaccuccauuucucuccag

SEQ ID NO: 2053430 - RNA, 12 nt, Homo sapiens
aaacucacugaa

SEQ ID NO: 2053431 - RNA, 15 nt, Homo sapiens
gcucaauauuccuga

SEQ ID NO: 2053432 - RNA, 13 nt, Homo sapiens
ucggucacuccaa

SEQ ID NO: 2053433 - RNA, 15 nt, Homo sapiens
gagcaagggcacaaa

SEQ ID NO: 2053434 - RNA, 12 nt, Homo sapiens
uuuagggagaac

SEQ ID NO: 2053435 - RNA, 16 nt, Homo sapiens
auaaucccagcacuuu

SEQ ID NO: 2053436 - RNA, 16 nt, Homo sapiens
auucugccuagagugu

SEQ ID NO: 2053437 - RNA, 16 nt, Homo sapiens
aaaggcaagccagcau

SEQ ID NO: 2053438 - RNA, 23 nt, Homo sapiens
cuagagaagaggcuggugcugug

SEQ ID NO: 2053439 - RNA, 23 nt, Homo sapiens
aacacuggaacauuccaguggac

SEQ ID NO: 2053440 - RNA, 21 nt, Homo sapiens
cuuuguuuguugucagcugaa

SEQ ID NO: 2053441 - RNA, 21 nt, Homo sapiens
aaaaagauucucaucacucaa

SEQ ID NO: 2053442 - RNA, 18 nt, Homo sapiens
cugcccagagccacagaa

SEQ ID NO: 2053443 - RNA, 16 nt, Homo sapiens
cuuuuauuacagucaa

SEQ ID NO: 2053444 - RNA, 21 nt, Homo sapiens
cuaagaagcucguuucuuaga

SEQ ID NO: 2053445 - RNA, 16 nt, Homo sapiens
cuauauuuccaccucu

SEQ ID NO: 2053446 - RNA, 19 nt, Homo sapiens
aacagaucuuuacucuuga

SEQ ID NO: 2053447 - RNA, 18 nt, Homo sapiens
uggcagagagaucuuccc

SEQ ID NO: 2053448 - RNA, 17 nt, Homo sapiens
cugucugucaccagcua

SEQ ID NO: 2053449 - RNA, 18 nt, Homo sapiens
cccagagugcugggauua

SEQ ID NO: 2053450 - RNA, 14 nt, Homo sapiens
uaccugagagauuu

SEQ ID NO: 2053451 - RNA, 16 nt, Homo sapiens
gggccuggcuggcuga

SEQ ID NO: 2053452 - RNA, 17 nt, Homo sapiens
gcuacucgauagccuga

SEQ ID NO: 2053453 - RNA, 12 nt, Homo sapiens
ugaaaauguuca

SEQ ID NO: 2053454 - RNA, 16 nt, Homo sapiens
ccauggauugauucag

SEQ ID NO: 2053455 - RNA, 22 nt, Homo sapiens
uguuuucuguguaaccauuuua

SEQ ID NO: 2053456 - RNA, 21 nt, Homo sapiens
uuaauguuugcauuuccucag

SEQ ID NO: 2053457 - RNA, 22 nt, Homo sapiens
aaggccaggaaaagaaagagcu

SEQ ID NO: 2053458 - RNA, 17 nt, Homo sapiens
gaaaguauuggcauuca

SEQ ID NO: 2053459 - RNA, 12 nt, Homo sapiens
cagcacuggaag

SEQ ID NO: 2053460 - RNA, 13 nt, Homo sapiens
ugacaugcacuga

SEQ ID NO: 2053461 - RNA, 17 nt, Homo sapiens
aggcugauuccucucau

SEQ ID NO: 2053462 - RNA, 17 nt, Homo sapiens
uaaacuuucucugcaaa

SEQ ID NO: 2053463 - RNA, 19 nt, Homo sapiens
acuggauccaaacccaucu

SEQ ID NO: 2053464 - RNA, 12 nt, Homo sapiens
uggccuuucaua

SEQ ID NO: 2053465 - RNA, 21 nt, Homo sapiens
ccuuuguacgcuuugcucaaa

SEQ ID NO: 2053466 - RNA, 16 nt, Homo sapiens
agcuaagccugaugau

SEQ ID NO: 2053467 - RNA, 22 nt, Homo sapiens
ggaaacagacaagcaacccaaa

SEQ ID NO: 2053468 - RNA, 16 nt, Homo sapiens
gauaccagcucagggg

SEQ ID NO: 2053469 - RNA, 15 nt, Homo sapiens
acaugcacuacugaa

SEQ ID NO: 2053470 - RNA, 13 nt, Homo sapiens
caaaugcagacac

SEQ ID NO: 2053471 - RNA, 14 nt, Homo sapiens
uccaauaaauguga

SEQ ID NO: 2053472 - RNA, 16 nt, Homo sapiens
aaaaugaaaagccaaa

SEQ ID NO: 2053473 - RNA, 19 nt, Homo sapiens
agauuaccgacacugucac

SEQ ID NO: 2053474 - RNA, 14 nt, Homo sapiens
auuauccugaucaa

SEQ ID NO: 2053475 - RNA, 13 nt, Homo sapiens
agucagccagcuu

SEQ ID NO: 2053476 - RNA, 23 nt, Homo sapiens
cuguaucgcauauugcugaguuu

SEQ ID NO: 2053477 - RNA, 17 nt, Homo sapiens
uuuuaucaauaaagcac

SEQ ID NO: 2053478 - RNA, 16 nt, Homo sapiens
uuguaauugccaucua

SEQ ID NO: 2053479 - RNA, 19 nt, Homo sapiens
gggccggucgggggggacc

SEQ ID NO: 2053480 - RNA, 21 nt, Homo sapiens
uaguuuacuccugaccacuaa

SEQ ID NO: 2053481 - RNA, 22 nt, Homo sapiens
ugcacauuagagggacagccaa

SEQ ID NO: 2053482 - RNA, 16 nt, Homo sapiens
ucucuaggccucucca

SEQ ID NO: 2053483 - RNA, 23 nt, Homo sapiens
agcuaacccucacaagcaugaag

SEQ ID NO: 2053484 - RNA, 13 nt, Homo sapiens
gcacauaccaaag

SEQ ID NO: 2053485 - RNA, 14 nt, Homo sapiens
aaauagucuaucaa

SEQ ID NO: 2053486 - RNA, 11 nt, Homo sapiens
cucagcucacu

SEQ ID NO: 2053487 - RNA, 16 nt, Homo sapiens
acaguacuuccagaug

SEQ ID NO: 2053488 - RNA, 19 nt, Homo sapiens
auagacuuagccccaugag

SEQ ID NO: 2053489 - RNA, 23 nt, Homo sapiens
aagcauuuucuagauaccacuua

SEQ ID NO: 2053490 - RNA, 21 nt, Homo sapiens
aaauauucuacuggccuguaa

SEQ ID NO: 2053491 - RNA, 20 nt, Homo sapiens
cagaaugcaaccaagucaca

SEQ ID NO: 2053492 - RNA, 16 nt, Homo sapiens
aggggaggaacaggga

SEQ ID NO: 2053493 - RNA, 23 nt, Homo sapiens
guuccccagccccuuggauguga

SEQ ID NO: 2053494 - RNA, 13 nt, Homo sapiens
gucagacuuugcu

SEQ ID NO: 2053495 - RNA, 19 nt, Homo sapiens
cucuacuuccccuucuugc

SEQ ID NO: 2053496 - RNA, 23 nt, Homo sapiens
cccugguaaaauaguggaucuca

SEQ ID NO: 2053497 - RNA, 19 nt, Homo sapiens
gccccaccccagguccugc

SEQ ID NO: 2053498 - RNA, 14 nt, Homo sapiens
uuccagcauuugcc

SEQ ID NO: 2053499 - RNA, 16 nt, Homo sapiens
acaccccuuuuccagu

SEQ ID NO: 2053500 - RNA, 13 nt, Homo sapiens
gguuauaaugugu

SEQ ID NO: 2053501 - RNA, 15 nt, Homo sapiens
gaaagcaacaaagau

SEQ ID NO: 2053502 - RNA, 15 nt, Homo sapiens
cauuuuaucccaugg

SEQ ID NO: 2053503 - RNA, 20 nt, Homo sapiens
uaucagacuguaggauuuga

SEQ ID NO: 2053504 - RNA, 13 nt, Homo sapiens
uuagcuuuugcaa

SEQ ID NO: 2053505 - RNA, 14 nt, Homo sapiens
accagaagugaaaa

SEQ ID NO: 2053506 - RNA, 16 nt, Homo sapiens
guugccuucugugcau

SEQ ID NO: 2053507 - RNA, 20 nt, Homo sapiens
agugaacaaauuuacagaga

SEQ ID NO: 2053508 - RNA, 16 nt, Homo sapiens
uugcaucgauguaauc

SEQ ID NO: 2053509 - RNA, 16 nt, Homo sapiens
aaacuuugcaucucag

SEQ ID NO: 2053510 - RNA, 17 nt, Homo sapiens
uguggugacuuuggaua

SEQ ID NO: 2053511 - RNA, 16 nt, Homo sapiens
cucacugcaguagugc

SEQ ID NO: 2053512 - RNA, 18 nt, Homo sapiens
auuuuaguuauacuccuc

SEQ ID NO: 2053513 - RNA, 14 nt, Homo sapiens
aguugucaguauua

SEQ ID NO: 2053514 - RNA, 15 nt, Homo sapiens
uucuauccuguucuu

SEQ ID NO: 2053515 - RNA, 14 nt, Homo sapiens
auuaaaaccagaga

SEQ ID NO: 2053516 - RNA, 19 nt, Homo sapiens
ucaggguucaucugaagau

SEQ ID NO: 2053517 - RNA, 18 nt, Homo sapiens
gggcaagaaccuaaagua

SEQ ID NO: 2053518 - RNA, 21 nt, Homo sapiens
caggaagggacugccaaaguu

SEQ ID NO: 2053519 - RNA, 15 nt, Homo sapiens
cugacauauuaugcc

SEQ ID NO: 2053520 - RNA, 13 nt, Homo sapiens
ucaguauugcaau

SEQ ID NO: 2053521 - RNA, 13 nt, Homo sapiens
ggagaauuugaaa

SEQ ID NO: 2053522 - RNA, 19 nt, Homo sapiens
gaggagcaacagcuggaag

SEQ ID NO: 2053523 - RNA, 22 nt, Homo sapiens
ugggcccagccccugccagcuu

SEQ ID NO: 2053524 - RNA, 14 nt, Homo sapiens
ccaauaugacucag

SEQ ID NO: 2053525 - RNA, 21 nt, Homo sapiens
gggcccuugucgggcacagau

SEQ ID NO: 2053526 - RNA, 15 nt, Homo sapiens
caguucucuacuccc

SEQ ID NO: 2053527 - RNA, 15 nt, Homo sapiens
cuaguaaaagccauc

SEQ ID NO: 2053528 - RNA, 17 nt, Homo sapiens
ccucacccccaccucaa

SEQ ID NO: 2053529 - RNA, 23 nt, Homo sapiens
cugcaccaccgaccaacuccaga

SEQ ID NO: 2053530 - RNA, 23 nt, Homo sapiens
gauagcaucuuauacgaguaaua

SEQ ID NO: 2053531 - RNA, 12 nt, Homo sapiens
cuuccugugauc

SEQ ID NO: 2053532 - RNA, 21 nt, Homo sapiens
cuccaaaugagacacauuaaa

SEQ ID NO: 2053533 - RNA, 15 nt, Homo sapiens
augccuuaagccaau

SEQ ID NO: 2053534 - RNA, 13 nt, Homo sapiens
cuagacaguauug

SEQ ID NO: 2053535 - RNA, 19 nt, Homo sapiens
uccagagaggcuggaugac

SEQ ID NO: 2053536 - RNA, 20 nt, Homo sapiens
uggcgaaaggagugacuuug

SEQ ID NO: 2053537 - RNA, 20 nt, Homo sapiens
cccccagccucagcccaacu

SEQ ID NO: 2053538 - RNA, 15 nt, Homo sapiens
acaauuuucauccca

SEQ ID NO: 2053539 - RNA, 21 nt, Homo sapiens
gcagaaauacaguaugaucuc

SEQ ID NO: 2053540 - RNA, 16 nt, Homo sapiens
gggaaugcaccucccc

SEQ ID NO: 2053541 - RNA, 22 nt, Homo sapiens
ugaaacucaucucauuacccuu

SEQ ID NO: 2053542 - RNA, 13 nt, Homo sapiens
aaaccaaugauuc

SEQ ID NO: 2053543 - RNA, 22 nt, Homo sapiens
acaucucaauaaagugcuuuaa

SEQ ID NO: 2053544 - RNA, 13 nt, Homo sapiens
aaaauggcagugg

SEQ ID NO: 2053545 - RNA, 19 nt, Homo sapiens
cuuuaguuucagagugugg

SEQ ID NO: 2053546 - RNA, 12 nt, Homo sapiens
gucuacacugcc

SEQ ID NO: 2053547 - RNA, 18 nt, Homo sapiens
caauuguauucccagccu

SEQ ID NO: 2053548 - RNA, 14 nt, Homo sapiens
ucuugguucugaaa

SEQ ID NO: 2053549 - RNA, 18 nt, Homo sapiens
ucaaggagcaagaaauga

SEQ ID NO: 2053550 - RNA, 23 nt, Homo sapiens
gcccaacaguaaucugcaucaua

SEQ ID NO: 2053551 - RNA, 23 nt, Homo sapiens
gcaguuuuguuuuuuauuuugcc

SEQ ID NO: 2053552 - RNA, 21 nt, Homo sapiens
aaaacgcgucugccugggccg

SEQ ID NO: 2053553 - RNA, 14 nt, Homo sapiens
cugaaagaagacau

SEQ ID NO: 2053554 - RNA, 14 nt, Homo sapiens
cuucagaauuccau

SEQ ID NO: 2053555 - RNA, 14 nt, Homo sapiens
cucaagaauuuaau

SEQ ID NO: 2053556 - RNA, 14 nt, Homo sapiens
ugugcuucagugcc

SEQ ID NO: 2053557 - RNA, 19 nt, Homo sapiens
uacauguacacgugcacag

SEQ ID NO: 2053558 - RNA, 14 nt, Homo sapiens
uagaaaaccucacc

SEQ ID NO: 2053559 - RNA, 14 nt, Homo sapiens
gacgugcacugaca

SEQ ID NO: 2053560 - RNA, 13 nt, Homo sapiens
acaggaacccagc

SEQ ID NO: 2053561 - RNA, 13 nt, Homo sapiens
acaugaacccauc

SEQ ID NO: 2053562 - RNA, 16 nt, Homo sapiens
aaaugugggaguucau

SEQ ID NO: 2053563 - RNA, 22 nt, Homo sapiens
cagaggcucagacucacuguua

SEQ ID NO: 2053564 - RNA, 18 nt, Homo sapiens
ugugagauuucucauuga

SEQ ID NO: 2053565 - RNA, 15 nt, Homo sapiens
uguagccagaauucu

SEQ ID NO: 2053566 - RNA, 16 nt, Homo sapiens
gggcaagucccugacu

SEQ ID NO: 2053567 - RNA, 15 nt, Homo sapiens
ugugagcagucucag

SEQ ID NO: 2053568 - RNA, 22 nt, Homo sapiens
gcugccgugggccugagaccaa

SEQ ID NO: 2053569 - RNA, 18 nt, Homo sapiens
ucaggacagaaccacuga

SEQ ID NO: 2053570 - RNA, 19 nt, Homo sapiens
gccagaguggccuggccag

SEQ ID NO: 2053571 - RNA, 16 nt, Homo sapiens
gaaaggccaucagagc

SEQ ID NO: 2053572 - RNA, 14 nt, Homo sapiens
auaaauacguguca

SEQ ID NO: 2053573 - RNA, 18 nt, Homo sapiens
auuaauacauaaguuaau

SEQ ID NO: 2053574 - RNA, 23 nt, Homo sapiens
acaugugugugguggugacucau

SEQ ID NO: 2053575 - RNA, 21 nt, Homo sapiens
ucucaaugugaaaaauguguc

SEQ ID NO: 2053576 - RNA, 14 nt, Homo sapiens
caauaaauguugcu

SEQ ID NO: 2053577 - RNA, 20 nt, Homo sapiens
auuugcucagaauugcacau

SEQ ID NO: 2053578 - RNA, 16 nt, Homo sapiens
acuccugaccucguga

SEQ ID NO: 2053579 - RNA, 14 nt, Homo sapiens
ugcggaaagcccug

SEQ ID NO: 2053580 - RNA, 20 nt, Homo sapiens
uuuucucccacacaaaauag

SEQ ID NO: 2053581 - RNA, 16 nt, Homo sapiens
cguguuuuuguaucuu

SEQ ID NO: 2053582 - RNA, 13 nt, Homo sapiens
cguucacucccaa

SEQ ID NO: 2053583 - RNA, 11 nt, Homo sapiens
gugaauuguga

SEQ ID NO: 2053584 - RNA, 15 nt, Homo sapiens
cagauuuuugcaaua

SEQ ID NO: 2053585 - RNA, 20 nt, Homo sapiens
acucaguaacagugcaguac

SEQ ID NO: 2053586 - RNA, 14 nt, Homo sapiens
uccuaucccauccc

SEQ ID NO: 2053587 - RNA, 20 nt, Homo sapiens
augucuccuggacucagggu

SEQ ID NO: 2053588 - RNA, 22 nt, Homo sapiens
uccuuuccccagcccagggugg

SEQ ID NO: 2053589 - RNA, 19 nt, Homo sapiens
ccaaaccugguaaauuuua

SEQ ID NO: 2053590 - RNA, 20 nt, Homo sapiens
acaccaucuuaaaugacagu

SEQ ID NO: 2053591 - RNA, 17 nt, Homo sapiens
auggcagcugguugcuc

SEQ ID NO: 2053592 - RNA, 17 nt, Homo sapiens
uuccccauaacucaaug

SEQ ID NO: 2053593 - RNA, 20 nt, Homo sapiens
auggagguuaagcacuuuaa

SEQ ID NO: 2053594 - RNA, 22 nt, Homo sapiens
uccaggacuuagaauagugccu

SEQ ID NO: 2053595 - RNA, 19 nt, Homo sapiens
ggcucacacugugcucaga

SEQ ID NO: 2053596 - RNA, 16 nt, Homo sapiens
agcucaccguggugcu

SEQ ID NO: 2053597 - RNA, 21 nt, Homo sapiens
ucagugccuuauggaacacuc

SEQ ID NO: 2053598 - RNA, 12 nt, Homo sapiens
cgggucugucag

SEQ ID NO: 2053599 - RNA, 18 nt, Homo sapiens
aggugucuagacugccag

SEQ ID NO: 2053600 - RNA, 17 nt, Homo sapiens
uagcaccaggacucaga

SEQ ID NO: 2053601 - RNA, 20 nt, Homo sapiens
cgagggccgcccgcucccuu

SEQ ID NO: 2053602 - RNA, 20 nt, Homo sapiens
cauuccuuuucguuuagaau

SEQ ID NO: 2053603 - RNA, 17 nt, Homo sapiens
uuugccuaauacauuaa

SEQ ID NO: 2053604 - RNA, 19 nt, Homo sapiens
uauuuuguauuauugcugu

SEQ ID NO: 2053605 - RNA, 19 nt, Homo sapiens
ucuugccccccaccccagc

SEQ ID NO: 2053606 - RNA, 13 nt, Homo sapiens
cagcuuguaugca

SEQ ID NO: 2053607 - RNA, 21 nt, Homo sapiens
aagagagaaagaaguaggcau

SEQ ID NO: 2053608 - RNA, 21 nt, Homo sapiens
gagcauggccgcaacuuccca

SEQ ID NO: 2053609 - RNA, 15 nt, Homo sapiens
uggaccuguucaaaa

SEQ ID NO: 2053610 - RNA, 21 nt, Homo sapiens
cgagcugugcaacgugggcaa

SEQ ID NO: 2053611 - RNA, 15 nt, Homo sapiens
agaaauuugaugaag

SEQ ID NO: 2053612 - RNA, 15 nt, Homo sapiens
aacuuauugucuagg

SEQ ID NO: 2053613 - RNA, 16 nt, Homo sapiens
ccuuaaacuccuguga

SEQ ID NO: 2053614 - RNA, 22 nt, Homo sapiens
aauuuucuaugaauugcuaauu

SEQ ID NO: 2053615 - RNA, 15 nt, Homo sapiens
gaaugaaugacauga

SEQ ID NO: 2053616 - RNA, 23 nt, Homo sapiens
ugaucauuuuccccccacucucc

SEQ ID NO: 2053617 - RNA, 21 nt, Homo sapiens
uggaucuaucaccugucauca

SEQ ID NO: 2053618 - RNA, 20 nt, Homo sapiens
guuucuaguauguacuuuga

SEQ ID NO: 2053619 - RNA, 13 nt, Homo sapiens
gauuuggggagaa

SEQ ID NO: 2053620 - RNA, 12 nt, Homo sapiens
ugaacacuguga

SEQ ID NO: 2053621 - RNA, 13 nt, Homo sapiens
aaacuucaaagag

SEQ ID NO: 2053622 - RNA, 13 nt, Homo sapiens
aagcuucaaaaag

SEQ ID NO: 2053623 - RNA, 14 nt, Homo sapiens
uaaagagcuguuau

SEQ ID NO: 2053624 - RNA, 19 nt, Homo sapiens
uccuggacuuuuccucuca

SEQ ID NO: 2053625 - RNA, 19 nt, Homo sapiens
ugcagaaauuugaaugaca

SEQ ID NO: 2053626 - RNA, 22 nt, Homo sapiens
uuguucauaauacaaaggugcu

SEQ ID NO: 2053627 - RNA, 16 nt, Homo sapiens
ccuguauacucuugaa

SEQ ID NO: 2053628 - RNA, 21 nt, Homo sapiens
cugauacaaauugcagacugu

SEQ ID NO: 2053629 - RNA, 17 nt, Homo sapiens
ggaugagcgugcacucc

SEQ ID NO: 2053630 - RNA, 15 nt, Homo sapiens
gaaaucccaguucau

SEQ ID NO: 2053631 - RNA, 23 nt, Homo sapiens
cucuggaagagggaggggcccug

SEQ ID NO: 2053632 - RNA, 21 nt, Homo sapiens
ucccaccuagugccccagacu

SEQ ID NO: 2053633 - RNA, 14 nt, Homo sapiens
ccucucuuucacac

SEQ ID NO: 2053634 - RNA, 14 nt, Homo sapiens
cauuaauuuaauua

SEQ ID NO: 2053635 - RNA, 13 nt, Homo sapiens
cuggggacaccag

SEQ ID NO: 2053636 - RNA, 23 nt, Homo sapiens
gaaggagccacgugaauggcccu

SEQ ID NO: 2053637 - RNA, 13 nt, Homo sapiens
cagugacuugauu

SEQ ID NO: 2053638 - RNA, 19 nt, Homo sapiens
aucccccagccucaagucu

SEQ ID NO: 2053639 - RNA, 22 nt, Homo sapiens
agcacggacucuuacugcuaac

SEQ ID NO: 2053640 - RNA, 22 nt, Homo sapiens
gccagacuggacaggcaaagac

SEQ ID NO: 2053641 - RNA, 12 nt, Homo sapiens
gaguucagaggg

SEQ ID NO: 2053642 - RNA, 15 nt, Homo sapiens
gcaacagagcaagac

SEQ ID NO: 2053643 - RNA, 14 nt, Homo sapiens
ccacacacagcugg

SEQ ID NO: 2053644 - RNA, 14 nt, Homo sapiens
aauauucuugucca

SEQ ID NO: 2053645 - RNA, 23 nt, Homo sapiens
aguugggggagggaagaccagaa

SEQ ID NO: 2053646 - RNA, 19 nt, Homo sapiens
auuugauguaaguuacuga

SEQ ID NO: 2053647 - RNA, 23 nt, Homo sapiens
cacucccaccugacacaccaggc

SEQ ID NO: 2053648 - RNA, 15 nt, Homo sapiens
accucaccaacugca

SEQ ID NO: 2053649 - RNA, 16 nt, Homo sapiens
accggccggucacugc

SEQ ID NO: 2053650 - RNA, 19 nt, Homo sapiens
gcggcccugagcuccaugg

SEQ ID NO: 2053651 - RNA, 12 nt, Homo sapiens
uuagaucuggca

SEQ ID NO: 2053652 - RNA, 23 nt, Homo sapiens
ucacaccuuguggagaacaugca

SEQ ID NO: 2053653 - RNA, 17 nt, Homo sapiens
uuuaugagaaacuuaaa

SEQ ID NO: 2053654 - RNA, 17 nt, Homo sapiens
uuuuaaguugucugucu

SEQ ID NO: 2053655 - RNA, 20 nt, Homo sapiens
acagugacuccacucugagu

SEQ ID NO: 2053656 - RNA, 18 nt, Homo sapiens
cuuuucaucaauucuuaa

SEQ ID NO: 2053657 - RNA, 18 nt, Homo sapiens
auaauguuuuuaugauuu

SEQ ID NO: 2053658 - RNA, 11 nt, Homo sapiens
aggcauaugca

SEQ ID NO: 2053659 - RNA, 22 nt, Homo sapiens
uguuaaugcuuucccacucuca

SEQ ID NO: 2053660 - RNA, 15 nt, Homo sapiens
ccagaggggugcgca

SEQ ID NO: 2053661 - RNA, 15 nt, Homo sapiens
agauauaccuaaugu

SEQ ID NO: 2053662 - RNA, 21 nt, Homo sapiens
aguccuggagcuggcucuaua

SEQ ID NO: 2053663 - RNA, 20 nt, Homo sapiens
cuauagcaucacuuaaaaca

SEQ ID NO: 2053664 - RNA, 13 nt, Homo sapiens
gcauuuagcuucu

SEQ ID NO: 2053665 - RNA, 18 nt, Homo sapiens
ccugaugcgucuacccag

SEQ ID NO: 2053666 - RNA, 17 nt, Homo sapiens
acccaguggacucuucc

SEQ ID NO: 2053667 - RNA, 13 nt, Homo sapiens
caucucucaggaa

SEQ ID NO: 2053668 - RNA, 19 nt, Homo sapiens
aaaauaugauauauaugua

SEQ ID NO: 2053669 - RNA, 22 nt, Homo sapiens
ccgcucggacuuacugccugac

SEQ ID NO: 2053670 - RNA, 15 nt, Homo sapiens
cuuugugcuugucau

SEQ ID NO: 2053671 - RNA, 14 nt, Homo sapiens
auugaaugugauuu

SEQ ID NO: 2053672 - RNA, 13 nt, Homo sapiens
cucacaguacugg

SEQ ID NO: 2053673 - RNA, 16 nt, Homo sapiens
uucagaaggaagcaaa

SEQ ID NO: 2053674 - RNA, 15 nt, Homo sapiens
ugcguucuucauuca

SEQ ID NO: 2053675 - RNA, 20 nt, Homo sapiens
aacucauuccugccugucuc

SEQ ID NO: 2053676 - RNA, 17 nt, Homo sapiens
ccacaggcucugaccag

SEQ ID NO: 2053677 - RNA, 20 nt, Homo sapiens
aagcacuggccuugccucca

SEQ ID NO: 2053678 - RNA, 22 nt, Homo sapiens
agccauacuuaucucucugugc

SEQ ID NO: 2053679 - RNA, 17 nt, Homo sapiens
aaagcccugugcuccau

SEQ ID NO: 2053680 - RNA, 13 nt, Homo sapiens
guguugcauaaac

SEQ ID NO: 2053681 - RNA, 23 nt, Homo sapiens
caucgggcucaccuuaaagguca

SEQ ID NO: 2053682 - RNA, 19 nt, Homo sapiens
acuauggcucuacuuucag

SEQ ID NO: 2053683 - RNA, 17 nt, Homo sapiens
gucucaauggugcuaua

SEQ ID NO: 2053684 - RNA, 14 nt, Homo sapiens
cugggaaagacauc

SEQ ID NO: 2053685 - RNA, 20 nt, Homo sapiens
uuaccagcauccacucuccc

SEQ ID NO: 2053686 - RNA, 20 nt, Homo sapiens
auaucaguuuuuacuuucuc

SEQ ID NO: 2053687 - RNA, 14 nt, Homo sapiens
aaauucaggugcua

SEQ ID NO: 2053688 - RNA, 22 nt, Homo sapiens
caagaggguccuuuaguaccug

SEQ ID NO: 2053689 - RNA, 15 nt, Homo sapiens
aauuaugcuuucuau

SEQ ID NO: 2053690 - RNA, 18 nt, Homo sapiens
ugacccaccccugugcuc

SEQ ID NO: 2053691 - RNA, 20 nt, Homo sapiens
aucuagguguggcugugaag

SEQ ID NO: 2053692 - RNA, 16 nt, Homo sapiens
cccuccugucuuccca

SEQ ID NO: 2053693 - RNA, 14 nt, Homo sapiens
agaacucuaucugu

SEQ ID NO: 2053694 - RNA, 13 nt, Homo sapiens
uggaugacagaga

SEQ ID NO: 2053695 - RNA, 17 nt, Homo sapiens
ugauccuccaacagcug

SEQ ID NO: 2053696 - RNA, 14 nt, Homo sapiens
uuuaucuauuggcc

SEQ ID NO: 2053697 - RNA, 17 nt, Homo sapiens
aucugaacuggaccagu

SEQ ID NO: 2053698 - RNA, 14 nt, Homo sapiens
ccauguugcacugu

SEQ ID NO: 2053699 - RNA, 22 nt, Homo sapiens
aagccugggcagaaaugugcug

SEQ ID NO: 2053700 - RNA, 17 nt, Homo sapiens
uaccaguuguucauuga

SEQ ID NO: 2053701 - RNA, 13 nt, Homo sapiens
aaacgugcgcuca

SEQ ID NO: 2053702 - RNA, 18 nt, Homo sapiens
guccugucacugagcaca

SEQ ID NO: 2053703 - RNA, 12 nt, Homo sapiens
uauuaugcauaa

SEQ ID NO: 2053704 - RNA, 21 nt, Homo sapiens
guggcuggggaggcccuggca

SEQ ID NO: 2053705 - RNA, 13 nt, Homo sapiens
cuggaaccuugcu

SEQ ID NO: 2053706 - RNA, 20 nt, Homo sapiens
ggagccccacccagaccuga

SEQ ID NO: 2053707 - RNA, 17 nt, Homo sapiens
guuauuggguaucacca

SEQ ID NO: 2053708 - RNA, 16 nt, Homo sapiens
ugaauauagaugcugg

SEQ ID NO: 2053709 - RNA, 13 nt, Homo sapiens
uaaauacagguag

SEQ ID NO: 2053710 - RNA, 21 nt, Homo sapiens
cuuuaucuuuggagaaggcaa

SEQ ID NO: 2053711 - RNA, 17 nt, Homo sapiens
ccugccuuuucauugcc

SEQ ID NO: 2053712 - RNA, 20 nt, Homo sapiens
auuuacggaggcguugugaa

SEQ ID NO: 2053713 - RNA, 16 nt, Homo sapiens
ugcaaaugucuuccag

SEQ ID NO: 2053714 - RNA, 22 nt, Homo sapiens
cacaccucacugucaucugcca

SEQ ID NO: 2053715 - RNA, 15 nt, Homo sapiens
auuuucagccuacag

SEQ ID NO: 2053716 - RNA, 14 nt, Homo sapiens
uaaaauucacuuag

SEQ ID NO: 2053717 - RNA, 14 nt, Homo sapiens
uccccauugcuuaa

SEQ ID NO: 2053718 - RNA, 17 nt, Homo sapiens
gcagccaggggcugcuc

SEQ ID NO: 2053719 - RNA, 14 nt, Homo sapiens
auccuugcaggugg

SEQ ID NO: 2053720 - RNA, 15 nt, Homo sapiens
gucaaaggagaacaa

SEQ ID NO: 2053721 - RNA, 19 nt, Homo sapiens
ugaaggaccuaaauucgua

SEQ ID NO: 2053722 - RNA, 15 nt, Homo sapiens
ugggccugcacccuu

SEQ ID NO: 2053723 - RNA, 14 nt, Homo sapiens
uauauuccaccagg

SEQ ID NO: 2053724 - RNA, 17 nt, Homo sapiens
ugccuuagguugcugac

SEQ ID NO: 2053725 - RNA, 18 nt, Homo sapiens
gcuuccacaaaauuagaa

SEQ ID NO: 2053726 - RNA, 14 nt, Homo sapiens
ucccuuugauucuc

SEQ ID NO: 2053727 - RNA, 17 nt, Homo sapiens
aggcaagggauaacucu

SEQ ID NO: 2053728 - RNA, 12 nt, Homo sapiens
agagaagccaua

SEQ ID NO: 2053729 - RNA, 21 nt, Homo sapiens
cagccaucccgucuucuccaa

SEQ ID NO: 2053730 - RNA, 20 nt, Homo sapiens
agucuuugagcgagcccauu

SEQ ID NO: 2053731 - RNA, 15 nt, Homo sapiens
uucagucuuauuuac

SEQ ID NO: 2053732 - RNA, 11 nt, Homo sapiens
ccagcuuuaag

SEQ ID NO: 2053733 - RNA, 22 nt, Homo sapiens
accuugaugcuuggccucccaa

SEQ ID NO: 2053734 - RNA, 14 nt, Homo sapiens
ucccaauacaggca

SEQ ID NO: 2053735 - RNA, 20 nt, Homo sapiens
aauaauuuuauuccagacag

SEQ ID NO: 2053736 - RNA, 15 nt, Homo sapiens
aggugcaugccuaau

SEQ ID NO: 2053737 - RNA, 17 nt, Homo sapiens
uucuucccuuaacucca

SEQ ID NO: 2053738 - RNA, 20 nt, Homo sapiens
cugguaauaaaugugacuca

SEQ ID NO: 2053739 - RNA, 12 nt, Homo sapiens
guggagaacucc

SEQ ID NO: 2053740 - RNA, 22 nt, Homo sapiens
ugggaccacacagacaggguuu

SEQ ID NO: 2053741 - RNA, 15 nt, Homo sapiens
cccauggcaugucuu

SEQ ID NO: 2053742 - RNA, 13 nt, Homo sapiens
auagugaagcaau

SEQ ID NO: 2053743 - RNA, 15 nt, Homo sapiens
caagaaacacauucu

SEQ ID NO: 2053744 - RNA, 13 nt, Homo sapiens
acuuugguauucu

SEQ ID NO: 2053745 - RNA, 23 nt, Homo sapiens
gauuugaacccagcugcucugua

SEQ ID NO: 2053746 - RNA, 22 nt, Homo sapiens
ucuuucucuccccuccucugaa

SEQ ID NO: 2053747 - RNA, 13 nt, Homo sapiens
uuggggcuuuuac

SEQ ID NO: 2053748 - RNA, 23 nt, Homo sapiens
cugcaucccgagcaacccucuga

SEQ ID NO: 2053749 - RNA, 15 nt, Homo sapiens
uuccccacucaauga

SEQ ID NO: 2053750 - RNA, 16 nt, Homo sapiens
cugggcggcugugcuu

SEQ ID NO: 2053751 - RNA, 11 nt, Homo sapiens
cuggguccuug

SEQ ID NO: 2053752 - RNA, 13 nt, Homo sapiens
acuacacauccaa

SEQ ID NO: 2053753 - RNA, 15 nt, Homo sapiens
aagagauccaaagac

SEQ ID NO: 2053754 - RNA, 21 nt, Homo sapiens
uauguucaacuaggaucagaa

SEQ ID NO: 2053755 - RNA, 19 nt, Homo sapiens
ggcaaagauagagaaugcc

SEQ ID NO: 2053756 - RNA, 19 nt, Homo sapiens
gcgugauccaccacaccug

SEQ ID NO: 2053757 - RNA, 19 nt, Homo sapiens
uuuuaaugaagugcaauac

SEQ ID NO: 2053758 - RNA, 11 nt, Homo sapiens
uugaguaccaa

SEQ ID NO: 2053759 - RNA, 19 nt, Homo sapiens
uguccuaagaaaauacugg

SEQ ID NO: 2053760 - RNA, 23 nt, Homo sapiens
gagaaaccagggagccccuuuga

SEQ ID NO: 2053761 - RNA, 19 nt, Homo sapiens
auuuauauuuuuuugcaag

SEQ ID NO: 2053762 - RNA, 21 nt, Homo sapiens
aguccaaacuggcaagcucaa

SEQ ID NO: 2053763 - RNA, 13 nt, Homo sapiens
uuauuucuagcaa

SEQ ID NO: 2053764 - RNA, 14 nt, Homo sapiens
auauggucauccaa

SEQ ID NO: 2053765 - RNA, 15 nt, Homo sapiens
uuuuaagaacuucau

SEQ ID NO: 2053766 - RNA, 22 nt, Homo sapiens
aagaaauaauuuuauuccagac

SEQ ID NO: 2053767 - RNA, 21 nt, Homo sapiens
gggaccgggccuggaaagggg

SEQ ID NO: 2053768 - RNA, 15 nt, Homo sapiens
auuaaauauucugua

SEQ ID NO: 2053769 - RNA, 12 nt, Homo sapiens
gucaaagcagua

SEQ ID NO: 2053770 - RNA, 21 nt, Homo sapiens
uccuguguuaucugugguuuu

SEQ ID NO: 2053771 - RNA, 12 nt, Homo sapiens
caucagggacag

SEQ ID NO: 2053772 - RNA, 18 nt, Homo sapiens
aaagcugacaucuguaaa

SEQ ID NO: 2053773 - RNA, 12 nt, Homo sapiens
cguuucuacuaa

SEQ ID NO: 2053774 - RNA, 15 nt, Homo sapiens
aagaugaaguuuuau

SEQ ID NO: 2053775 - RNA, 22 nt, Homo sapiens
uucugguggccccuucuaugcc

SEQ ID NO: 2053776 - RNA, 23 nt, Homo sapiens
uccuagcgcagccaugugauuac

SEQ ID NO: 2053777 - RNA, 15 nt, Homo sapiens
uaaaaaugcugcauu

SEQ ID NO: 2053778 - RNA, 15 nt, Homo sapiens
uuacaaugcagaauu

SEQ ID NO: 2053779 - RNA, 14 nt, Homo sapiens
ccaagcgagagcag

SEQ ID NO: 2053780 - RNA, 16 nt, Homo sapiens
uuuaaggaaaugugca

SEQ ID NO: 2053781 - RNA, 23 nt, Homo sapiens
uuauccauggguuccuacgccuu

SEQ ID NO: 2053782 - RNA, 17 nt, Homo sapiens
caccagagacaagcaga

SEQ ID NO: 2053783 - RNA, 19 nt, Homo sapiens
agccugggcucacugugcu

SEQ ID NO: 2053784 - RNA, 20 nt, Homo sapiens
cuggauggggagucucaugc

SEQ ID NO: 2053785 - RNA, 20 nt, Homo sapiens
uaaauuccagaggacucugc

SEQ ID NO: 2053786 - RNA, 19 nt, Homo sapiens
uucccuaaaagaaaaccaa

SEQ ID NO: 2053787 - RNA, 20 nt, Homo sapiens
gcuccuaguagcuuuccucc

SEQ ID NO: 2053788 - RNA, 19 nt, Homo sapiens
ccaucugaagaaacuuccc

SEQ ID NO: 2053789 - RNA, 18 nt, Homo sapiens
agaugcagcuacuggaau

SEQ ID NO: 2053790 - RNA, 19 nt, Homo sapiens
cgagcauaguccaaaaagc

SEQ ID NO: 2053791 - RNA, 20 nt, Homo sapiens
accuguaaucccaacacuuu

SEQ ID NO: 2053792 - RNA, 19 nt, Homo sapiens
auuuuccuuauuguuugua

SEQ ID NO: 2053793 - RNA, 12 nt, Homo sapiens
ugagcgucagca

SEQ ID NO: 2053794 - RNA, 21 nt, Homo sapiens
ccuuaaaauuuuuuucuuucg

SEQ ID NO: 2053795 - RNA, 21 nt, Homo sapiens
auuuaaaccuuuguuaacucu

SEQ ID NO: 2053796 - RNA, 22 nt, Homo sapiens
auuacaaccacagaaagcacuc

SEQ ID NO: 2053797 - RNA, 19 nt, Homo sapiens
caucauaagcugauuugau

SEQ ID NO: 2053798 - RNA, 21 nt, Homo sapiens
agacaagagugguauauacaa

SEQ ID NO: 2053799 - RNA, 20 nt, Homo sapiens
agauuucagggaagcccuga

SEQ ID NO: 2053800 - RNA, 16 nt, Homo sapiens
caagauagcaucccau

SEQ ID NO: 2053801 - RNA, 15 nt, Homo sapiens
augcuggcauuugca

SEQ ID NO: 2053802 - RNA, 20 nt, Homo sapiens
accucuucugggaacuuccu

SEQ ID NO: 2053803 - RNA, 18 nt, Homo sapiens
cugaguucuggucaaaga

SEQ ID NO: 2053804 - RNA, 21 nt, Homo sapiens
guguuuaccuggugcucucaa

SEQ ID NO: 2053805 - RNA, 22 nt, Homo sapiens
uaaaucccagacugacagacuu

SEQ ID NO: 2053806 - RNA, 17 nt, Homo sapiens
accaaauuagugaacca

SEQ ID NO: 2053807 - RNA, 22 nt, Homo sapiens
guuguugaaagcugaaaagcau

SEQ ID NO: 2053808 - RNA, 16 nt, Homo sapiens
uaagacugcugcugaa

SEQ ID NO: 2053809 - RNA, 18 nt, Homo sapiens
uuucccucccacuauuaa

SEQ ID NO: 2053810 - RNA, 14 nt, Homo sapiens
gacaagcauugggu

SEQ ID NO: 2053811 - RNA, 23 nt, Homo sapiens
gcugaagccuggacgcagccaca

SEQ ID NO: 2053812 - RNA, 21 nt, Homo sapiens
agagauggcagagccauccac

SEQ ID NO: 2053813 - RNA, 21 nt, Homo sapiens
aggugagugcuugucauggaa

SEQ ID NO: 2053814 - RNA, 20 nt, Homo sapiens
cugaauaguuacugcugcac

SEQ ID NO: 2053815 - RNA, 22 nt, Homo sapiens
aucugugcaaauccuugauacu

SEQ ID NO: 2053816 - RNA, 14 nt, Homo sapiens
aaauuauuugucau

SEQ ID NO: 2053817 - RNA, 13 nt, Homo sapiens
cuauaaccaaaug

SEQ ID NO: 2053818 - RNA, 19 nt, Homo sapiens
ugggccuggagggggagca

SEQ ID NO: 2053819 - RNA, 12 nt, Homo sapiens
aaauguuugaua

SEQ ID NO: 2053820 - RNA, 16 nt, Homo sapiens
caaagggcacauauac

SEQ ID NO: 2053821 - RNA, 19 nt, Homo sapiens
caguuacuuccuuccugcc

SEQ ID NO: 2053822 - RNA, 14 nt, Homo sapiens
agacaaaugcugcg

SEQ ID NO: 2053823 - RNA, 15 nt, Homo sapiens
caugcuucgugccac

SEQ ID NO: 2053824 - RNA, 13 nt, Homo sapiens
auaucuaccccag

SEQ ID NO: 2053825 - RNA, 15 nt, Homo sapiens
cucucaggguucuga

SEQ ID NO: 2053826 - RNA, 14 nt, Homo sapiens
ugcacgcacacugu

SEQ ID NO: 2053827 - RNA, 15 nt, Homo sapiens
auaguuaugccugua

SEQ ID NO: 2053828 - RNA, 14 nt, Homo sapiens
auaaaaccaaguuu

SEQ ID NO: 2053829 - RNA, 20 nt, Homo sapiens
gucugugccauuucucaggg

SEQ ID NO: 2053830 - RNA, 18 nt, Homo sapiens
cacuaguaugugugcgug

SEQ ID NO: 2053831 - RNA, 18 nt, Homo sapiens
ccugagaaaggugaggag

SEQ ID NO: 2053832 - RNA, 17 nt, Homo sapiens
accucuguggaugaugu

SEQ ID NO: 2053833 - RNA, 13 nt, Homo sapiens
aaaaagcaucaug

SEQ ID NO: 2053834 - RNA, 18 nt, Homo sapiens
uucauccugacucugccc

SEQ ID NO: 2053835 - RNA, 16 nt, Homo sapiens
augggguucuggaaau

SEQ ID NO: 2053836 - RNA, 15 nt, Homo sapiens
gagagcccagucauu

SEQ ID NO: 2053837 - RNA, 22 nt, Homo sapiens
ugccagggugcggccugagaua

SEQ ID NO: 2053838 - RNA, 16 nt, Homo sapiens
caaaugggucccucag

SEQ ID NO: 2053839 - RNA, 19 nt, Homo sapiens
uaucaggaaauaucuguga

SEQ ID NO: 2053840 - RNA, 15 nt, Homo sapiens
ugacugaacuagagc

SEQ ID NO: 2053841 - RNA, 21 nt, Homo sapiens
uuuuaauaacuuaucuauaaa

SEQ ID NO: 2053842 - RNA, 18 nt, Homo sapiens
uauuaaagguaugcauuu

SEQ ID NO: 2053843 - RNA, 17 nt, Homo sapiens
uuguuuguggucacaga

SEQ ID NO: 2053844 - RNA, 13 nt, Homo sapiens
cuuuccagccugu

SEQ ID NO: 2053845 - RNA, 13 nt, Homo sapiens
auuuucagacugc

SEQ ID NO: 2053846 - RNA, 13 nt, Homo sapiens
gguccugcugaau

SEQ ID NO: 2053847 - RNA, 21 nt, Homo sapiens
acaagguguuucucuguaaaa

SEQ ID NO: 2053848 - RNA, 17 nt, Homo sapiens
ugaccaguuuugauauu

SEQ ID NO: 2053849 - RNA, 22 nt, Homo sapiens
agcacuauuuaaaauaagcaca

SEQ ID NO: 2053850 - RNA, 12 nt, Homo sapiens
gcagaggccaug

SEQ ID NO: 2053851 - RNA, 16 nt, Homo sapiens
uuccaaguguauuuaa

SEQ ID NO: 2053852 - RNA, 21 nt, Homo sapiens
uccaccucaucacuggacugc

SEQ ID NO: 2053853 - RNA, 21 nt, Homo sapiens
ccagcauugcaguauggugug

SEQ ID NO: 2053854 - RNA, 13 nt, Homo sapiens
auuagaagcacac

SEQ ID NO: 2053855 - RNA, 13 nt, Homo sapiens
uugcaguauacac

SEQ ID NO: 2053856 - RNA, 23 nt, Homo sapiens
aaguuaaaaguguugauuacaua

SEQ ID NO: 2053857 - RNA, 14 nt, Homo sapiens
ccugccacugugua

SEQ ID NO: 2053858 - RNA, 15 nt, Homo sapiens
guggaacaagcacag

SEQ ID NO: 2053859 - RNA, 20 nt, Homo sapiens
cuuugcugcagaacugaaga

SEQ ID NO: 2053860 - RNA, 18 nt, Homo sapiens
ccagaggaugucacaaag

SEQ ID NO: 2053861 - RNA, 16 nt, Homo sapiens
gcuaaggaacaaugcc

SEQ ID NO: 2053862 - RNA, 19 nt, Homo sapiens
ccagccugcuuuuucucag

SEQ ID NO: 2053863 - RNA, 14 nt, Homo sapiens
guguuaaaugugau

SEQ ID NO: 2053864 - RNA, 13 nt, Homo sapiens
uaaacucuacuuc

SEQ ID NO: 2053865 - RNA, 16 nt, Homo sapiens
agcagauuguguaaca

SEQ ID NO: 2053866 - RNA, 16 nt, Homo sapiens
uggcagcaauggauga

SEQ ID NO: 2053867 - RNA, 21 nt, Homo sapiens
gcaacaggauugaucauucuu

SEQ ID NO: 2053868 - RNA, 19 nt, Homo sapiens
cugcacaugucuuguacau

SEQ ID NO: 2053869 - RNA, 20 nt, Homo sapiens
uuacagaaaacaagguccag

SEQ ID NO: 2053870 - RNA, 18 nt, Homo sapiens
uaaacauuaguguucaua

SEQ ID NO: 2053871 - RNA, 17 nt, Homo sapiens
cauacaccagaagacaa

SEQ ID NO: 2053872 - RNA, 18 nt, Homo sapiens
aggcauauaguauuuuca

SEQ ID NO: 2053873 - RNA, 13 nt, Homo sapiens
ucugcauugcugg

SEQ ID NO: 2053874 - RNA, 22 nt, Homo sapiens
aaaaaucaaucauuuucuagcc

SEQ ID NO: 2053875 - RNA, 21 nt, Homo sapiens
uuuggauaauauccacugcaa

SEQ ID NO: 2053876 - RNA, 15 nt, Homo sapiens
uucgaagccacagag

SEQ ID NO: 2053877 - RNA, 16 nt, Homo sapiens
aauaacaucaacaaca

SEQ ID NO: 2053878 - RNA, 20 nt, Homo sapiens
augaugaguccagaaccccu

SEQ ID NO: 2053879 - RNA, 15 nt, Homo sapiens
ugcuuugacaaggca

SEQ ID NO: 2053880 - RNA, 23 nt, Homo sapiens
cugaugacucaagauucccagga

SEQ ID NO: 2053881 - RNA, 20 nt, Homo sapiens
ugggcauugacaaaucugug

SEQ ID NO: 2053882 - RNA, 15 nt, Homo sapiens
acagccuccaaaaau

SEQ ID NO: 2053883 - RNA, 20 nt, Homo sapiens
caaagcauaggaaggcucua

SEQ ID NO: 2053884 - RNA, 19 nt, Homo sapiens
ccaguuguaauagugccaa

SEQ ID NO: 2053885 - RNA, 21 nt, Homo sapiens
agacaagcuuguccauguaau

SEQ ID NO: 2053886 - RNA, 14 nt, Homo sapiens
aaauuccccuuccc

SEQ ID NO: 2053887 - RNA, 17 nt, Homo sapiens
ugcuuugguuaaucucu

SEQ ID NO: 2053888 - RNA, 16 nt, Homo sapiens
agcugcugacucacuu

SEQ ID NO: 2053889 - RNA, 13 nt, Homo sapiens
aaggcugccucag

SEQ ID NO: 2053890 - RNA, 13 nt, Homo sapiens
aagaaaagcaauc

SEQ ID NO: 2053891 - RNA, 20 nt, Homo sapiens
aagcaaauuucuaucagccu

SEQ ID NO: 2053892 - RNA, 18 nt, Homo sapiens
uucuucccucauguucuc

SEQ ID NO: 2053893 - RNA, 11 nt, Homo sapiens
aagaaaugggc

SEQ ID NO: 2053894 - RNA, 21 nt, Homo sapiens
cugagaagauggcacugucca

SEQ ID NO: 2053895 - RNA, 21 nt, Homo sapiens
aaaggaccucuucugaagcua

SEQ ID NO: 2053896 - RNA, 17 nt, Homo sapiens
cauugguaagaaugagc

SEQ ID NO: 2053897 - RNA, 22 nt, Homo sapiens
ccgcaccauaaugagaugugag

SEQ ID NO: 2053898 - RNA, 17 nt, Homo sapiens
auacacacuguugucaa

SEQ ID NO: 2053899 - RNA, 17 nt, Homo sapiens
auaauacaguaucucag

SEQ ID NO: 2053900 - RNA, 17 nt, Homo sapiens
augugucagaauaggaa

SEQ ID NO: 2053901 - RNA, 18 nt, Homo sapiens
ucccuuccucuuccugcc

SEQ ID NO: 2053902 - RNA, 11 nt, Homo sapiens
ugccugcugaa

SEQ ID NO: 2053903 - RNA, 11 nt, Homo sapiens
augcaccucag

SEQ ID NO: 2053904 - RNA, 21 nt, Homo sapiens
aaaaauguauagacucagugc

SEQ ID NO: 2053905 - RNA, 21 nt, Homo sapiens
caguggcacgaucucaacuca

SEQ ID NO: 2053906 - RNA, 15 nt, Homo sapiens
gccaggcugaucucg

SEQ ID NO: 2053907 - RNA, 12 nt, Homo sapiens
uucuagccuuag

SEQ ID NO: 2053908 - RNA, 18 nt, Homo sapiens
uggaaagugcucagugaa

SEQ ID NO: 2053909 - RNA, 18 nt, Homo sapiens
auaccuggggacuugaug

SEQ ID NO: 2053910 - RNA, 22 nt, Homo sapiens
acaggccauggugcacaaaagg

SEQ ID NO: 2053911 - RNA, 19 nt, Homo sapiens
guucagagaucguuccuau

SEQ ID NO: 2053912 - RNA, 19 nt, Homo sapiens
caacagcuacagucuaaaa

SEQ ID NO: 2053913 - RNA, 18 nt, Homo sapiens
guaucaguggauuuccca

SEQ ID NO: 2053914 - RNA, 19 nt, Homo sapiens
auaugcugacagcucuuca

SEQ ID NO: 2053915 - RNA, 15 nt, Homo sapiens
acuuugguaaugugu

SEQ ID NO: 2053916 - RNA, 15 nt, Homo sapiens
ucaccuuaucuggaa

SEQ ID NO: 2053917 - RNA, 17 nt, Homo sapiens
aacuuucuuacacugaa

SEQ ID NO: 2053918 - RNA, 14 nt, Homo sapiens
ucacuggaacacua

SEQ ID NO: 2053919 - RNA, 18 nt, Homo sapiens
gcugcucaacuugcaaaa

SEQ ID NO: 2053920 - RNA, 20 nt, Homo sapiens
ggaacggggguacacggugg

SEQ ID NO: 2053921 - RNA, 20 nt, Homo sapiens
cgcccaggccagugcuguga

SEQ ID NO: 2053922 - RNA, 17 nt, Homo sapiens
ucccagcgcucugggag

SEQ ID NO: 2053923 - RNA, 22 nt, Homo sapiens
augggaacaaggcaauggucua

SEQ ID NO: 2053924 - RNA, 12 nt, Homo sapiens
ucaccaugccug

SEQ ID NO: 2053925 - RNA, 18 nt, Homo sapiens
uagccuauuuaccugcag

SEQ ID NO: 2053926 - RNA, 16 nt, Homo sapiens
acugagcuauaacuua

SEQ ID NO: 2053927 - RNA, 10 nt, Homo sapiens
uccugugacg

SEQ ID NO: 2053928 - RNA, 13 nt, Homo sapiens
gggcagucaccug

SEQ ID NO: 2053929 - RNA, 15 nt, Homo sapiens
cgggucacacaaagg

SEQ ID NO: 2053930 - RNA, 22 nt, Homo sapiens
cuaaguguuucauaaauuugag

SEQ ID NO: 2053931 - RNA, 14 nt, Homo sapiens
ggggcccagugcau

SEQ ID NO: 2053932 - RNA, 15 nt, Homo sapiens
gaaaaugcauuauuu

SEQ ID NO: 2053933 - RNA, 22 nt, Homo sapiens
uaguuccucuucuuaaggggau

SEQ ID NO: 2053934 - RNA, 14 nt, Homo sapiens
ggccugacucucag

SEQ ID NO: 2053935 - RNA, 19 nt, Homo sapiens
ggaagacuccccugccucc

SEQ ID NO: 2053936 - RNA, 19 nt, Homo sapiens
cuccauaugucucaucugu

SEQ ID NO: 2053937 - RNA, 13 nt, Homo sapiens
cagggaaaauaua

SEQ ID NO: 2053938 - RNA, 22 nt, Homo sapiens
ccagccgggguggggugccuga

SEQ ID NO: 2053939 - RNA, 22 nt, Homo sapiens
ugcauuuccuucuuaacucucu

SEQ ID NO: 2053940 - RNA, 18 nt, Homo sapiens
auuccauuuccaguucau

SEQ ID NO: 2053941 - RNA, 14 nt, Homo sapiens
auuuuaaaauuuca

SEQ ID NO: 2053942 - RNA, 14 nt, Homo sapiens
acauucaucaagcu

SEQ ID NO: 2053943 - RNA, 17 nt, Homo sapiens
uaaaacccaaacuucca

SEQ ID NO: 2053944 - RNA, 16 nt, Homo sapiens
cacugaccugcccaug

SEQ ID NO: 2053945 - RNA, 22 nt, Homo sapiens
ucucccuggugcuuaugcucuu

SEQ ID NO: 2053946 - RNA, 23 nt, Homo sapiens
aucccacggaaaaugccaaucuc

SEQ ID NO: 2053947 - RNA, 14 nt, Homo sapiens
uauuuccaaaagca

SEQ ID NO: 2053948 - RNA, 16 nt, Homo sapiens
cagagggcuugugaac

SEQ ID NO: 2053949 - RNA, 18 nt, Homo sapiens
caguaagacagugcagug

SEQ ID NO: 2053950 - RNA, 12 nt, Homo sapiens
agaaaagaccuu

SEQ ID NO: 2053951 - RNA, 12 nt, Homo sapiens
aguaaagaccau

SEQ ID NO: 2053952 - RNA, 16 nt, Homo sapiens
acuuuaugaaaacuga

SEQ ID NO: 2053953 - RNA, 17 nt, Homo sapiens
auguucuugagcagcug

SEQ ID NO: 2053954 - RNA, 14 nt, Homo sapiens
cuaggauaaugucc

SEQ ID NO: 2053955 - RNA, 19 nt, Homo sapiens
ugcaaaaagauuuaacaaa

SEQ ID NO: 2053956 - RNA, 22 nt, Homo sapiens
uuaauauaguaacacacuucca

SEQ ID NO: 2053957 - RNA, 22 nt, Homo sapiens
gacaucuucucaaccuuaucaa

SEQ ID NO: 2053958 - RNA, 22 nt, Homo sapiens
gccucaguggccagaggaucac

SEQ ID NO: 2053959 - RNA, 17 nt, Homo sapiens
uaaauuuaaguccaccu

SEQ ID NO: 2053960 - RNA, 15 nt, Homo sapiens
acuagauucuuguca

SEQ ID NO: 2053961 - RNA, 21 nt, Homo sapiens
gacugcuagaaccaagcacua

SEQ ID NO: 2053962 - RNA, 18 nt, Homo sapiens
ggaggcuuccccucacua

SEQ ID NO: 2053963 - RNA, 13 nt, Homo sapiens
aggaugcugugcc

SEQ ID NO: 2053964 - RNA, 18 nt, Homo sapiens
auguaagaaucauuguaa

SEQ ID NO: 2053965 - RNA, 22 nt, Homo sapiens
uggcauccaagacucuuuauga

SEQ ID NO: 2053966 - RNA, 16 nt, Homo sapiens
uugugugguggcaccu

SEQ ID NO: 2053967 - RNA, 21 nt, Homo sapiens
ucagauuuucuaagaaccaaa

SEQ ID NO: 2053968 - RNA, 18 nt, Homo sapiens
caaauaaaacaaaaccaa

SEQ ID NO: 2053969 - RNA, 14 nt, Homo sapiens
ugauugugcaugga

SEQ ID NO: 2053970 - RNA, 21 nt, Homo sapiens
aggaauuuucuugaaacugug

SEQ ID NO: 2053971 - RNA, 13 nt, Homo sapiens
aaucacagucuca

SEQ ID NO: 2053972 - RNA, 19 nt, Homo sapiens
auaugugaaauuaauacac

SEQ ID NO: 2053973 - RNA, 17 nt, Homo sapiens
cugagggcugaaaacgg

SEQ ID NO: 2053974 - RNA, 16 nt, Homo sapiens
aaauauggaacuuaca

SEQ ID NO: 2053975 - RNA, 20 nt, Homo sapiens
uuggccuagcccacccugcu

SEQ ID NO: 2053976 - RNA, 21 nt, Homo sapiens
auguacuuccaguauccugaa

SEQ ID NO: 2053977 - RNA, 17 nt, Homo sapiens
uaguguaccauucucag

SEQ ID NO: 2053978 - RNA, 22 nt, Homo sapiens
gcaggcaaucguggaugucucu

SEQ ID NO: 2053979 - RNA, 19 nt, Homo sapiens
auauauucaguauuguaga

SEQ ID NO: 2053980 - RNA, 18 nt, Homo sapiens
ugcaacagugccauguua

SEQ ID NO: 2053981 - RNA, 15 nt, Homo sapiens
uggcagcaacaauaa

SEQ ID NO: 2053982 - RNA, 23 nt, Homo sapiens
gaagagggcgaguucagcaaaga

SEQ ID NO: 2053983 - RNA, 14 nt, Homo sapiens
aaaugauucacuuu

SEQ ID NO: 2053984 - RNA, 11 nt, Homo sapiens
cagcacuuugg

SEQ ID NO: 2053985 - RNA, 19 nt, Homo sapiens
ggcccagaguuuacauucu

SEQ ID NO: 2053986 - RNA, 14 nt, Homo sapiens
caagggucauggca

SEQ ID NO: 2053987 - RNA, 13 nt, Homo sapiens
aaguucagcacuu

SEQ ID NO: 2053988 - RNA, 11 nt, Homo sapiens
aaaagcacuua

SEQ ID NO: 2053989 - RNA, 18 nt, Homo sapiens
acagaaauccuuucauaa

SEQ ID NO: 2053990 - RNA, 17 nt, Homo sapiens
auucuuuauucuuuacu

SEQ ID NO: 2053991 - RNA, 15 nt, Homo sapiens
agggcgggccuguuu

SEQ ID NO: 2053992 - RNA, 21 nt, Homo sapiens
cucagcauaccugcuggugca

SEQ ID NO: 2053993 - RNA, 17 nt, Homo sapiens
caugucugccuaugcac

SEQ ID NO: 2053994 - RNA, 21 nt, Homo sapiens
aguggcuuuuuuccuccugug

SEQ ID NO: 2053995 - RNA, 17 nt, Homo sapiens
ugcugggagcagaacag

SEQ ID NO: 2053996 - RNA, 18 nt, Homo sapiens
uucaaccagcacauucgu

SEQ ID NO: 2053997 - RNA, 17 nt, Homo sapiens
acaagcuggaagcacau

SEQ ID NO: 2053998 - RNA, 18 nt, Homo sapiens
acauacuggccuggacug

SEQ ID NO: 2053999 - RNA, 14 nt, Homo sapiens
caucccugugagca

SEQ ID NO: 2054000 - RNA, 12 nt, Homo sapiens
auuaucaugaca

SEQ ID NO: 2054001 - RNA, 22 nt, Homo sapiens
uagcagcaggcucaggcacaua

SEQ ID NO: 2054002 - RNA, 19 nt, Homo sapiens
ucuucuuucuacaguauua

SEQ ID NO: 2054003 - RNA, 20 nt, Homo sapiens
cccagaacuucccugauuga

SEQ ID NO: 2054004 - RNA, 16 nt, Homo sapiens
ucaaccuaacacauua

SEQ ID NO: 2054005 - RNA, 18 nt, Homo sapiens
cuugcagcugauguugga

SEQ ID NO: 2054006 - RNA, 22 nt, Homo sapiens
ccuacaaccaucccugccacau

SEQ ID NO: 2054007 - RNA, 14 nt, Homo sapiens
ccacucuucuugca

SEQ ID NO: 2054008 - RNA, 12 nt, Homo sapiens
acccuguaccuc

SEQ ID NO: 2054009 - RNA, 20 nt, Homo sapiens
agugggcagugcauguggaa

SEQ ID NO: 2054010 - RNA, 16 nt, Homo sapiens
acugaaaaaugucagu

SEQ ID NO: 2054011 - RNA, 23 nt, Homo sapiens
cuguaccuugcuguggggcuaca

SEQ ID NO: 2054012 - RNA, 13 nt, Homo sapiens
gauacugcugaug

SEQ ID NO: 2054013 - RNA, 21 nt, Homo sapiens
agcauaccaguacucaguaua

SEQ ID NO: 2054014 - RNA, 18 nt, Homo sapiens
ccugcagugcucauucau

SEQ ID NO: 2054015 - RNA, 17 nt, Homo sapiens
cacagcccgggugugcc

SEQ ID NO: 2054016 - RNA, 18 nt, Homo sapiens
cuuauucaguucuuacac

SEQ ID NO: 2054017 - RNA, 19 nt, Homo sapiens
agcucagagguauccucuu

SEQ ID NO: 2054018 - RNA, 20 nt, Homo sapiens
cugcaaaaugucauagcuua

SEQ ID NO: 2054019 - RNA, 15 nt, Homo sapiens
ucucacccaggcaau

SEQ ID NO: 2054020 - RNA, 11 nt, Homo sapiens
uauuccacuua

SEQ ID NO: 2054021 - RNA, 12 nt, Homo sapiens
ugcuuagcugua

SEQ ID NO: 2054022 - RNA, 17 nt, Homo sapiens
augugguauacaauucu

SEQ ID NO: 2054023 - RNA, 16 nt, Homo sapiens
cugccuaugguuuuuc

SEQ ID NO: 2054024 - RNA, 14 nt, Homo sapiens
cacugaauucacuc

SEQ ID NO: 2054025 - RNA, 13 nt, Homo sapiens
gucuucacuugca

SEQ ID NO: 2054026 - RNA, 22 nt, Homo sapiens
uuugcgacugcucugauggcac

SEQ ID NO: 2054027 - RNA, 15 nt, Homo sapiens
cuaguugaguagcca

SEQ ID NO: 2054028 - RNA, 20 nt, Homo sapiens
agcgcuguauuuacagacac

SEQ ID NO: 2054029 - RNA, 19 nt, Homo sapiens
cuguuuggccaaugugcau

SEQ ID NO: 2054030 - RNA, 22 nt, Homo sapiens
uagaucucccuuaauaaacuca

SEQ ID NO: 2054031 - RNA, 20 nt, Homo sapiens
uuuggaaaccacagucagug

SEQ ID NO: 2054032 - RNA, 18 nt, Homo sapiens
aguguuagagugucuuaa

SEQ ID NO: 2054033 - RNA, 14 nt, Homo sapiens
cacauggcugggau

SEQ ID NO: 2054034 - RNA, 16 nt, Homo sapiens
aagucugacucuccac

SEQ ID NO: 2054035 - RNA, 17 nt, Homo sapiens
uuugcuuuucacuggca

SEQ ID NO: 2054036 - RNA, 14 nt, Homo sapiens
ugugaagaaagggu

SEQ ID NO: 2054037 - RNA, 19 nt, Homo sapiens
uguaaaacuaaacauacau

SEQ ID NO: 2054038 - RNA, 19 nt, Homo sapiens
uacucugccugaacacugc

SEQ ID NO: 2054039 - RNA, 18 nt, Homo sapiens
caaggcauaccuguccua

SEQ ID NO: 2054040 - RNA, 17 nt, Homo sapiens
gagaagccaaacagcaa

SEQ ID NO: 2054041 - RNA, 19 nt, Homo sapiens
acaagccacaagucuucca

SEQ ID NO: 2054042 - RNA, 13 nt, Homo sapiens
ugcauuugccuug

SEQ ID NO: 2054043 - RNA, 22 nt, Homo sapiens
guuagaauuagguaauggauau

SEQ ID NO: 2054044 - RNA, 24 nt, Homo sapiens
cugagaggugaggugacuugccug

SEQ ID NO: 2054045 - RNA, 17 nt, Homo sapiens
ugugacccuccaugcca

SEQ ID NO: 2054046 - RNA, 14 nt, Homo sapiens
gcccaucacuguau

SEQ ID NO: 2054047 - RNA, 17 nt, Homo sapiens
ucuuauuugaugguggu

SEQ ID NO: 2054048 - RNA, 18 nt, Homo sapiens
auuucauuuuuacccuua

SEQ ID NO: 2054049 - RNA, 13 nt, Homo sapiens
cccaccuccagcc

SEQ ID NO: 2054050 - RNA, 14 nt, Homo sapiens
ugcaauucuagcca

SEQ ID NO: 2054051 - RNA, 22 nt, Homo sapiens
agaacuugaacuaacauaaucu

SEQ ID NO: 2054052 - RNA, 17 nt, Homo sapiens
uaaucuguacuauccag

SEQ ID NO: 2054053 - RNA, 18 nt, Homo sapiens
gaaaaauaaaaaccauaa

SEQ ID NO: 2054054 - RNA, 21 nt, Homo sapiens
augauuguuuuugcucaaggc

SEQ ID NO: 2054055 - RNA, 20 nt, Homo sapiens
ugccaggcagaaaacuggca

SEQ ID NO: 2054056 - RNA, 15 nt, Homo sapiens
uccuuccuucagggu

SEQ ID NO: 2054057 - RNA, 14 nt, Homo sapiens
cuagacauugcaau

SEQ ID NO: 2054058 - RNA, 14 nt, Homo sapiens
ucuuuggugccagc

SEQ ID NO: 2054059 - RNA, 13 nt, Homo sapiens
cacuugaccucau

SEQ ID NO: 2054060 - RNA, 15 nt, Homo sapiens
accgacucaccugcg

SEQ ID NO: 2054061 - RNA, 20 nt, Homo sapiens
aauuuaaugaaaagguacaa

SEQ ID NO: 2054062 - RNA, 19 nt, Homo sapiens
aguccuggucccucugagg

SEQ ID NO: 2054063 - RNA, 18 nt, Homo sapiens
ccgcaggccuuacagucu

SEQ ID NO: 2054064 - RNA, 17 nt, Homo sapiens
accaagcuauuccuuuc

SEQ ID NO: 2054065 - RNA, 16 nt, Homo sapiens
cuccuggacuguagga

SEQ ID NO: 2054066 - RNA, 16 nt, Homo sapiens
acgcacauaccuucau

SEQ ID NO: 2054067 - RNA, 23 nt, Homo sapiens
ugaagccccccuuuggcacugga

SEQ ID NO: 2054068 - RNA, 14 nt, Homo sapiens
aaucccauuugcag

SEQ ID NO: 2054069 - RNA, 15 nt, Homo sapiens
aagccccacaccagu

SEQ ID NO: 2054070 - RNA, 22 nt, Homo sapiens
cuucuuaauauaacugccuuaa

SEQ ID NO: 2054071 - RNA, 21 nt, Homo sapiens
cuccacucugauucaccucuu

SEQ ID NO: 2054072 - RNA, 19 nt, Homo sapiens
gaauguguuauuugucaca

SEQ ID NO: 2054073 - RNA, 14 nt, Homo sapiens
uugggauuacaggu

SEQ ID NO: 2054074 - RNA, 20 nt, Homo sapiens
ggcccagcuguagccauggc

SEQ ID NO: 2054075 - RNA, 19 nt, Homo sapiens
ccaucccgcucuuuuccua

SEQ ID NO: 2054076 - RNA, 20 nt, Homo sapiens
agagggagacuccaucucaa

SEQ ID NO: 2054077 - RNA, 21 nt, Homo sapiens
agucucugaggggcuaccagg

SEQ ID NO: 2054078 - RNA, 13 nt, Homo sapiens
auugcuguuucag

SEQ ID NO: 2054079 - RNA, 13 nt, Homo sapiens
ucucugugccauc

SEQ ID NO: 2054080 - RNA, 16 nt, Homo sapiens
gaacaagcaaugagaa

SEQ ID NO: 2054081 - RNA, 21 nt, Homo sapiens
uacugaaaaaugcaaauugca

SEQ ID NO: 2054082 - RNA, 15 nt, Homo sapiens
aagugcuaauuuuga

SEQ ID NO: 2054083 - RNA, 17 nt, Homo sapiens
cucaguguuaggaacuu

SEQ ID NO: 2054084 - RNA, 12 nt, Homo sapiens
uccaccaagaaa

SEQ ID NO: 2054085 - RNA, 17 nt, Homo sapiens
ugguuuagucauugcag

SEQ ID NO: 2054086 - RNA, 20 nt, Homo sapiens
cagcugaccuuugucaucuu

SEQ ID NO: 2054087 - RNA, 20 nt, Homo sapiens
ugaacacucuuuugcuuuau

SEQ ID NO: 2054088 - RNA, 22 nt, Homo sapiens
ccagaccuagcaggcuguucca

SEQ ID NO: 2054089 - RNA, 22 nt, Homo sapiens
aaauguaaaauaaguauuucca

SEQ ID NO: 2054090 - RNA, 15 nt, Homo sapiens
aaugagagagugugg

SEQ ID NO: 2054091 - RNA, 14 nt, Homo sapiens
uguccuuccugacc

SEQ ID NO: 2054092 - RNA, 17 nt, Homo sapiens
aaucucaauucuucccu

SEQ ID NO: 2054093 - RNA, 19 nt, Homo sapiens
augucuccuaagcaccugu

SEQ ID NO: 2054094 - RNA, 14 nt, Homo sapiens
auaacuaaaauucu

SEQ ID NO: 2054095 - RNA, 17 nt, Homo sapiens
acagacacuguugcaaa

SEQ ID NO: 2054096 - RNA, 14 nt, Homo sapiens
aaauaaaaauuaaa

SEQ ID NO: 2054097 - RNA, 12 nt, Homo sapiens
aguugcauuuaa

SEQ ID NO: 2054098 - RNA, 20 nt, Homo sapiens
ggacagccaggagcucucca

SEQ ID NO: 2054099 - RNA, 21 nt, Homo sapiens
gcagcaggggccaagcaggca

SEQ ID NO: 2054100 - RNA, 21 nt, Homo sapiens
aaguugaggagguuucugcau

SEQ ID NO: 2054101 - RNA, 21 nt, Homo sapiens
gcugccaaguaaauagcaaca

SEQ ID NO: 2054102 - RNA, 13 nt, Homo sapiens
ugcuguuguugca

SEQ ID NO: 2054103 - RNA, 20 nt, Homo sapiens
gcaccucugaccuaucacuu

SEQ ID NO: 2054104 - RNA, 18 nt, Homo sapiens
uuaaauguaaguugagaa

SEQ ID NO: 2054105 - RNA, 17 nt, Homo sapiens
ucucuuccuugugauug

SEQ ID NO: 2054106 - RNA, 19 nt, Homo sapiens
agaacaacuugcuacugac

SEQ ID NO: 2054107 - RNA, 14 nt, Homo sapiens
uagcugcacuguuu

SEQ ID NO: 2054108 - RNA, 13 nt, Homo sapiens
auugaauucuaaa

SEQ ID NO: 2054109 - RNA, 14 nt, Homo sapiens
cagcagugaguaau

SEQ ID NO: 2054110 - RNA, 23 nt, Homo sapiens
acaauguaaauauuacacaucaa

SEQ ID NO: 2054111 - RNA, 15 nt, Homo sapiens
gcuuagcggcaagaa

SEQ ID NO: 2054112 - RNA, 21 nt, Homo sapiens
caaccugaaauuuauucacau

SEQ ID NO: 2054113 - RNA, 20 nt, Homo sapiens
ccagcuggccuguaauccca

SEQ ID NO: 2054114 - RNA, 18 nt, Homo sapiens
ucacauacaaaucaucca

SEQ ID NO: 2054115 - RNA, 18 nt, Homo sapiens
cuccaaguaguccaccuu

SEQ ID NO: 2054116 - RNA, 18 nt, Homo sapiens
agucccagcuacucagga

SEQ ID NO: 2054117 - RNA, 15 nt, Homo sapiens
cgccuggcucaguca

SEQ ID NO: 2054118 - RNA, 17 nt, Homo sapiens
ggguggugcugggucau

SEQ ID NO: 2054119 - RNA, 21 nt, Homo sapiens
cggggcgaccccucagugcuc

SEQ ID NO: 2054120 - RNA, 22 nt, Homo sapiens
cucuacaggugcaacagguuca

SEQ ID NO: 2054121 - RNA, 18 nt, Homo sapiens
uuaggaaguauggcaaaa

SEQ ID NO: 2054122 - RNA, 23 nt, Homo sapiens
cuaggagccagugugaggcugua

SEQ ID NO: 2054123 - RNA, 19 nt, Homo sapiens
ggugcugggaauacaucug

SEQ ID NO: 2054124 - RNA, 19 nt, Homo sapiens
uagacuuuucccaagccua

SEQ ID NO: 2054125 - RNA, 16 nt, Homo sapiens
ccuuugauuuuugccc

SEQ ID NO: 2054126 - RNA, 17 nt, Homo sapiens
ccaaguccagauuuaca

SEQ ID NO: 2054127 - RNA, 18 nt, Homo sapiens
cacuggaaauguuugucc

SEQ ID NO: 2054128 - RNA, 22 nt, Homo sapiens
aaaaccucaagggcuuucccac

SEQ ID NO: 2054129 - RNA, 20 nt, Homo sapiens
ccuguaauuaaacuaguuua

SEQ ID NO: 2054130 - RNA, 24 nt, Homo sapiens
acuguucuuugccagaacacaaga

SEQ ID NO: 2054131 - RNA, 15 nt, Homo sapiens
aaacagcuuucccac

SEQ ID NO: 2054132 - RNA, 21 nt, Homo sapiens
ucaacuuuugacaaucaaaga

SEQ ID NO: 2054133 - RNA, 17 nt, Homo sapiens
acuggggcugggagcag

SEQ ID NO: 2054134 - RNA, 17 nt, Homo sapiens
caucuuguugccaugga

SEQ ID NO: 2054135 - RNA, 18 nt, Homo sapiens
cugcuuuucacugcugca

SEQ ID NO: 2054136 - RNA, 21 nt, Homo sapiens
agcaaaauaauaaaauacuuc

SEQ ID NO: 2054137 - RNA, 19 nt, Homo sapiens
uuuaaaaggauuuggacug

SEQ ID NO: 2054138 - RNA, 17 nt, Homo sapiens
uuuuaaaaacaaacaaa

SEQ ID NO: 2054139 - RNA, 17 nt, Homo sapiens
aaacauuggacagugag

SEQ ID NO: 2054140 - RNA, 14 nt, Homo sapiens
gugcccuacucauu

SEQ ID NO: 2054141 - RNA, 17 nt, Homo sapiens
uguuaggagaagcugca

SEQ ID NO: 2054142 - RNA, 16 nt, Homo sapiens
cgugaguggucuucaa

SEQ ID NO: 2054143 - RNA, 19 nt, Homo sapiens
uuuuaguagagaugggguu

SEQ ID NO: 2054144 - RNA, 17 nt, Homo sapiens
cugugaauggaagcaaa

SEQ ID NO: 2054145 - RNA, 16 nt, Homo sapiens
cccuuaucaccagcug

SEQ ID NO: 2054146 - RNA, 11 nt, Homo sapiens
gauagucacag

SEQ ID NO: 2054147 - RNA, 20 nt, Homo sapiens
acaauuuagaaaacauucau

SEQ ID NO: 2054148 - RNA, 17 nt, Homo sapiens
aaaaguguugacugugu

SEQ ID NO: 2054149 - RNA, 14 nt, Homo sapiens
gaagggaaguugcu

SEQ ID NO: 2054150 - RNA, 14 nt, Homo sapiens
aaguguacauaugu

SEQ ID NO: 2054151 - RNA, 14 nt, Homo sapiens
aaauagacauguag

SEQ ID NO: 2054152 - RNA, 14 nt, Homo sapiens
augcacacaaacac

SEQ ID NO: 2054153 - RNA, 20 nt, Homo sapiens
cacuuaaacaauguccucuu

SEQ ID NO: 2054154 - RNA, 16 nt, Homo sapiens
aacuauccaaguguua

SEQ ID NO: 2054155 - RNA, 16 nt, Homo sapiens
uagcaggcacaggaca

SEQ ID NO: 2054156 - RNA, 14 nt, Homo sapiens
auccacgcucaucu

SEQ ID NO: 2054157 - RNA, 19 nt, Homo sapiens
caggggccaaccucaggcu

SEQ ID NO: 2054158 - RNA, 17 nt, Homo sapiens
acaucagucuccaacau

SEQ ID NO: 2054159 - RNA, 17 nt, Homo sapiens
aggcuggaguacaguga

SEQ ID NO: 2054160 - RNA, 22 nt, Homo sapiens
acaggggcuugcuauagugucc

SEQ ID NO: 2054161 - RNA, 18 nt, Homo sapiens
ccucucuugccaaaaagc

SEQ ID NO: 2054162 - RNA, 19 nt, Homo sapiens
aaauaacaaaauaguuacu

SEQ ID NO: 2054163 - RNA, 19 nt, Homo sapiens
ucugucuccuuaacacuga

SEQ ID NO: 2054164 - RNA, 19 nt, Homo sapiens
gcaagaccuugauugcacc

SEQ ID NO: 2054165 - RNA, 19 nt, Homo sapiens
auaacaagugggugaaugu

SEQ ID NO: 2054166 - RNA, 19 nt, Homo sapiens
auggugaggagauccuguu

SEQ ID NO: 2054167 - RNA, 17 nt, Homo sapiens
cucugaguacauugugc

SEQ ID NO: 2054168 - RNA, 23 nt, Homo sapiens
aagucuucucccguccauuccag

SEQ ID NO: 2054169 - RNA, 15 nt, Homo sapiens
uccauaaaaggugug

SEQ ID NO: 2054170 - RNA, 13 nt, Homo sapiens
uuaaaaaucuuuc

SEQ ID NO: 2054171 - RNA, 19 nt, Homo sapiens
uggcuaccucagaaagauu

SEQ ID NO: 2054172 - RNA, 17 nt, Homo sapiens
ugacuggcacagucuuu

SEQ ID NO: 2054173 - RNA, 16 nt, Homo sapiens
cugggcccuugugcuc

SEQ ID NO: 2054174 - RNA, 14 nt, Homo sapiens
gaaacaucauucua

SEQ ID NO: 2054175 - RNA, 16 nt, Homo sapiens
uaauguaauuuagcua

SEQ ID NO: 2054176 - RNA, 14 nt, Homo sapiens
ggcuaguugggaug

SEQ ID NO: 2054177 - RNA, 19 nt, Homo sapiens
agccccaggccucuguguc

SEQ ID NO: 2054178 - RNA, 16 nt, Homo sapiens
uacugucuaagcaguu

SEQ ID NO: 2054179 - RNA, 19 nt, Homo sapiens
cagggucucacucugucac

SEQ ID NO: 2054180 - RNA, 15 nt, Homo sapiens
aauucucuuugguca

SEQ ID NO: 2054181 - RNA, 18 nt, Homo sapiens
uagaaauauugacucaaa

SEQ ID NO: 2054182 - RNA, 16 nt, Homo sapiens
gcaggagaagaacaag

SEQ ID NO: 2054183 - RNA, 22 nt, Homo sapiens
ccaaucuaauuaugagcuaaaa

SEQ ID NO: 2054184 - RNA, 17 nt, Homo sapiens
guggcaaguuugcagau

SEQ ID NO: 2054185 - RNA, 11 nt, Homo sapiens
aacugcuugug

SEQ ID NO: 2054186 - RNA, 20 nt, Homo sapiens
uacaacuggaagauacauaa

SEQ ID NO: 2054187 - RNA, 19 nt, Homo sapiens
cugcaaaaaugaaauccag

SEQ ID NO: 2054188 - RNA, 12 nt, Homo sapiens
auaccaguucuu

SEQ ID NO: 2054189 - RNA, 12 nt, Homo sapiens
auuucaguucac

SEQ ID NO: 2054190 - RNA, 23 nt, Homo sapiens
gucaaccugaauuaaagucuaca

SEQ ID NO: 2054191 - RNA, 17 nt, Homo sapiens
agacuggaagcacagcu

SEQ ID NO: 2054192 - RNA, 20 nt, Homo sapiens
uggaauaaaguugcagauga

SEQ ID NO: 2054193 - RNA, 19 nt, Homo sapiens
ggagaaugcaccauacuca

SEQ ID NO: 2054194 - RNA, 14 nt, Homo sapiens
cugcugaagcugcu

SEQ ID NO: 2054195 - RNA, 14 nt, Homo sapiens
gagccugcucuuug

SEQ ID NO: 2054196 - RNA, 15 nt, Homo sapiens
cccuuuuguacauuu

SEQ ID NO: 2054197 - RNA, 15 nt, Homo sapiens
ucuaugggcauuugg

SEQ ID NO: 2054198 - RNA, 15 nt, Homo sapiens
ucaagauuccauuuc

SEQ ID NO: 2054199 - RNA, 19 nt, Homo sapiens
gcucuuaggugcuucuuca

SEQ ID NO: 2054200 - RNA, 19 nt, Homo sapiens
gugugcgugugcgugcgug

SEQ ID NO: 2054201 - RNA, 13 nt, Homo sapiens
ccgcucacccucc

SEQ ID NO: 2054202 - RNA, 13 nt, Homo sapiens
cagcucaccaucc

SEQ ID NO: 2054203 - RNA, 15 nt, Homo sapiens
ccaugugcaccugcc

SEQ ID NO: 2054204 - RNA, 22 nt, Homo sapiens
auccaccguccccucccaggga

SEQ ID NO: 2054205 - RNA, 15 nt, Homo sapiens
caggagaaucacuug

SEQ ID NO: 2054206 - RNA, 20 nt, Homo sapiens
cgccauugggcuacuguaga

SEQ ID NO: 2054207 - RNA, 18 nt, Homo sapiens
uaugacauggaggcacug

SEQ ID NO: 2054208 - RNA, 21 nt, Homo sapiens
acccagggccugacuugagcc

SEQ ID NO: 2054209 - RNA, 20 nt, Homo sapiens
caggugugggccacugcacc

SEQ ID NO: 2054210 - RNA, 19 nt, Homo sapiens
ucuuuguuaugacagugaa

SEQ ID NO: 2054211 - RNA, 18 nt, Homo sapiens
auuccuuagauaccuuga

SEQ ID NO: 2054212 - RNA, 18 nt, Homo sapiens
aacauucauagcuggucu

SEQ ID NO: 2054213 - RNA, 15 nt, Homo sapiens
gagauauacauugug

SEQ ID NO: 2054214 - RNA, 14 nt, Homo sapiens
gacuugcuguguau

SEQ ID NO: 2054215 - RNA, 12 nt, Homo sapiens
ugucaugaagaa

SEQ ID NO: 2054216 - RNA, 15 nt, Homo sapiens
uucucucguaacugg

SEQ ID NO: 2054217 - RNA, 18 nt, Homo sapiens
cccugucucuagccacuu

SEQ ID NO: 2054218 - RNA, 17 nt, Homo sapiens
aucuuugagaccaucca

SEQ ID NO: 2054219 - RNA, 18 nt, Homo sapiens
acuaccaaaugagcauua

SEQ ID NO: 2054220 - RNA, 14 nt, Homo sapiens
acggccaacaaagc

SEQ ID NO: 2054221 - RNA, 22 nt, Homo sapiens
aaagauuguuuuauauguagua

SEQ ID NO: 2054222 - RNA, 22 nt, Homo sapiens
guagauaccaaaugaaacacuu

SEQ ID NO: 2054223 - RNA, 16 nt, Homo sapiens
agacuucgacucagga

SEQ ID NO: 2054224 - RNA, 17 nt, Homo sapiens
aauugaaucuacaaaag

SEQ ID NO: 2054225 - RNA, 20 nt, Homo sapiens
auuuggaggaaucaccccau

SEQ ID NO: 2054226 - RNA, 16 nt, Homo sapiens
uucugcagucaucucc

SEQ ID NO: 2054227 - RNA, 22 nt, Homo sapiens
uuccaagacugaagacugcaca

SEQ ID NO: 2054228 - RNA, 13 nt, Homo sapiens
accacucucagga

SEQ ID NO: 2054229 - RNA, 13 nt, Homo sapiens
gacuaagccagac

SEQ ID NO: 2054230 - RNA, 19 nt, Homo sapiens
aggucaccaagcaguggcc

SEQ ID NO: 2054231 - RNA, 20 nt, Homo sapiens
ccagguaagggggugcagca

SEQ ID NO: 2054232 - RNA, 22 nt, Homo sapiens
cuuagaaaugaaggcagaaaaa

SEQ ID NO: 2054233 - RNA, 16 nt, Homo sapiens
cagggaaggcugugca

SEQ ID NO: 2054234 - RNA, 13 nt, Homo sapiens
auccuuauuccuc

SEQ ID NO: 2054235 - RNA, 13 nt, Homo sapiens
uuaccuauacauu

SEQ ID NO: 2054236 - RNA, 15 nt, Homo sapiens
augggaugcacucuc

SEQ ID NO: 2054237 - RNA, 18 nt, Homo sapiens
uuagcauucugaaagaag

SEQ ID NO: 2054238 - RNA, 16 nt, Homo sapiens
auuaaaaugugcagua

SEQ ID NO: 2054239 - RNA, 16 nt, Homo sapiens
gaacugagguuuacau

SEQ ID NO: 2054240 - RNA, 16 nt, Homo sapiens
ugcuggaaaugcugac

SEQ ID NO: 2054241 - RNA, 21 nt, Homo sapiens
gcacaaaagcagauacuugag

SEQ ID NO: 2054242 - RNA, 22 nt, Homo sapiens
ugccucauuaccuugugcuaau

SEQ ID NO: 2054243 - RNA, 19 nt, Homo sapiens
ucuuuaaaaacucacuuac

SEQ ID NO: 2054244 - RNA, 22 nt, Homo sapiens
aaaacagcagcucauagaauuu

SEQ ID NO: 2054245 - RNA, 17 nt, Homo sapiens
cuacaacauauggggug

SEQ ID NO: 2054246 - RNA, 14 nt, Homo sapiens
uuugucucauccca

SEQ ID NO: 2054247 - RNA, 20 nt, Homo sapiens
gguucuucuuccugaagcug

SEQ ID NO: 2054248 - RNA, 18 nt, Homo sapiens
uuacagugccacugcaau

SEQ ID NO: 2054249 - RNA, 21 nt, Homo sapiens
gcacagaaggaaucugugcag

SEQ ID NO: 2054250 - RNA, 17 nt, Homo sapiens
caaggaaagaccaguuu

SEQ ID NO: 2054251 - RNA, 17 nt, Homo sapiens
uuauuuuuguaucuuaa

SEQ ID NO: 2054252 - RNA, 21 nt, Homo sapiens
augaaauaaaagaaacaaaug

SEQ ID NO: 2054253 - RNA, 16 nt, Homo sapiens
augcaugcagucuugu

SEQ ID NO: 2054254 - RNA, 15 nt, Homo sapiens
uguaauguaaauaca

SEQ ID NO: 2054255 - RNA, 16 nt, Homo sapiens
cugcuucuccucccag

SEQ ID NO: 2054256 - RNA, 15 nt, Homo sapiens
caguuugcaaucuua

SEQ ID NO: 2054257 - RNA, 17 nt, Homo sapiens
gacuguggcacacgccu

SEQ ID NO: 2054258 - RNA, 16 nt, Homo sapiens
gcuuaguuaucagcuu

SEQ ID NO: 2054259 - RNA, 18 nt, Homo sapiens
cuuguugaugacauuugg

SEQ ID NO: 2054260 - RNA, 20 nt, Homo sapiens
agauagccaaggccaaagga

SEQ ID NO: 2054261 - RNA, 22 nt, Homo sapiens
uagccuguggccuuugcaauuu

SEQ ID NO: 2054262 - RNA, 11 nt, Homo sapiens
uacacugccuu

SEQ ID NO: 2054263 - RNA, 16 nt, Homo sapiens
ugagacccugucucaa

SEQ ID NO: 2054264 - RNA, 15 nt, Homo sapiens
ucuggggacaccagc

SEQ ID NO: 2054265 - RNA, 21 nt, Homo sapiens
ugcccagugcacuugcuggaa

SEQ ID NO: 2054266 - RNA, 18 nt, Homo sapiens
agaagaagugaccaagga

SEQ ID NO: 2054267 - RNA, 12 nt, Homo sapiens
uauuaauugaga

SEQ ID NO: 2054268 - RNA, 21 nt, Homo sapiens
ccucagccuugaaaaacaagu

SEQ ID NO: 2054269 - RNA, 16 nt, Homo sapiens
gcccugccguugggga

SEQ ID NO: 2054270 - RNA, 19 nt, Homo sapiens
aaggaacccccucaccacc

SEQ ID NO: 2054271 - RNA, 21 nt, Homo sapiens
ggcucuccugucucugcagcu

SEQ ID NO: 2054272 - RNA, 13 nt, Homo sapiens
cucugcaccugua

SEQ ID NO: 2054273 - RNA, 15 nt, Homo sapiens
uaagaucacagugaa

SEQ ID NO: 2054274 - RNA, 18 nt, Homo sapiens
gaaaacuacaagccacga

SEQ ID NO: 2054275 - RNA, 15 nt, Homo sapiens
aagccuuccucaaga

SEQ ID NO: 2054276 - RNA, 21 nt, Homo sapiens
uccuuuguaauugacacuaua

SEQ ID NO: 2054277 - RNA, 22 nt, Homo sapiens
ucugugggucaguccucuuucc

SEQ ID NO: 2054278 - RNA, 19 nt, Homo sapiens
agggugcaagaagccauuu

SEQ ID NO: 2054279 - RNA, 13 nt, Homo sapiens
gcuuuguacuugu

SEQ ID NO: 2054280 - RNA, 23 nt, Homo sapiens
ugugccugucuguuacacuggag

SEQ ID NO: 2054281 - RNA, 19 nt, Homo sapiens
aaagaacgcugcagcuuuu

SEQ ID NO: 2054282 - RNA, 21 nt, Homo sapiens
cauacagagguaacuaucaau

SEQ ID NO: 2054283 - RNA, 16 nt, Homo sapiens
gcuggcccgugacaga

SEQ ID NO: 2054284 - RNA, 15 nt, Homo sapiens
ucacaugauaccccu

SEQ ID NO: 2054285 - RNA, 15 nt, Homo sapiens
caauaagcaaaaaca

SEQ ID NO: 2054286 - RNA, 17 nt, Homo sapiens
aagucaacuuagcauuu

SEQ ID NO: 2054287 - RNA, 23 nt, Homo sapiens
auuuuaaaauuuugcuaccaaag

SEQ ID NO: 2054288 - RNA, 20 nt, Homo sapiens
gaguccacugccuccaugau

SEQ ID NO: 2054289 - RNA, 15 nt, Homo sapiens
guuagagaaaaaugc

SEQ ID NO: 2054290 - RNA, 17 nt, Homo sapiens
gacuuguccagugcucc

SEQ ID NO: 2054291 - RNA, 16 nt, Homo sapiens
aacuuggugccuaaug

SEQ ID NO: 2054292 - RNA, 22 nt, Homo sapiens
cuccuuuauuucagcauggagg

SEQ ID NO: 2054293 - RNA, 15 nt, Homo sapiens
ucaagaauaaucacg

SEQ ID NO: 2054294 - RNA, 14 nt, Homo sapiens
acuuugcaucacag

SEQ ID NO: 2054295 - RNA, 17 nt, Homo sapiens
aguaucucuucagucuc

SEQ ID NO: 2054296 - RNA, 14 nt, Homo sapiens
caaauuacaaguau

SEQ ID NO: 2054297 - RNA, 13 nt, Homo sapiens
caaucuauggcaa

SEQ ID NO: 2054298 - RNA, 11 nt, Homo sapiens
ccucacugcag

SEQ ID NO: 2054299 - RNA, 16 nt, Homo sapiens
ggaagccccacuugaa

SEQ ID NO: 2054300 - RNA, 16 nt, Homo sapiens
gaaaacugagacucag

SEQ ID NO: 2054301 - RNA, 22 nt, Homo sapiens
ggauucuccacucaguugcaac

SEQ ID NO: 2054302 - RNA, 14 nt, Homo sapiens
agggcacugggcug

SEQ ID NO: 2054303 - RNA, 16 nt, Homo sapiens
gcuuaguauuucucag

SEQ ID NO: 2054304 - RNA, 19 nt, Homo sapiens
ccaggcuggagugaucuca

SEQ ID NO: 2054305 - RNA, 20 nt, Homo sapiens
gauguuaacaagaggggaaa

SEQ ID NO: 2054306 - RNA, 22 nt, Homo sapiens
caugccuguaaucccagcacuu

SEQ ID NO: 2054307 - RNA, 13 nt, Homo sapiens
auuucagcaaacg

SEQ ID NO: 2054308 - RNA, 21 nt, Homo sapiens
aguaucuaccuggaaacagcu

SEQ ID NO: 2054309 - RNA, 23 nt, Homo sapiens
auaaccucggcuguuuacagugu

SEQ ID NO: 2054310 - RNA, 18 nt, Homo sapiens
acuauuuucaaagacuua

SEQ ID NO: 2054311 - RNA, 19 nt, Homo sapiens
agugauccuuccaccucag

SEQ ID NO: 2054312 - RNA, 16 nt, Homo sapiens
ugaaauuauacagaua

SEQ ID NO: 2054313 - RNA, 21 nt, Homo sapiens
uggcuaagcaaaaugugauau

SEQ ID NO: 2054314 - RNA, 20 nt, Homo sapiens
ugguacacacuugaccuucu

SEQ ID NO: 2054315 - RNA, 17 nt, Homo sapiens
cucgcgacaaugcaaac

SEQ ID NO: 2054316 - RNA, 18 nt, Homo sapiens
gccaagaccccagcuuca

SEQ ID NO: 2054317 - RNA, 16 nt, Homo sapiens
cauguugguugcacuu

SEQ ID NO: 2054318 - RNA, 14 nt, Homo sapiens
gagcaacagaguga

SEQ ID NO: 2054319 - RNA, 21 nt, Homo sapiens
gaauaaagcccuugaaccagc

SEQ ID NO: 2054320 - RNA, 17 nt, Homo sapiens
uauuuaaccuaguucaa

SEQ ID NO: 2054321 - RNA, 23 nt, Homo sapiens
ucuuccugacauuugucagugau

SEQ ID NO: 2054322 - RNA, 21 nt, Homo sapiens
aacacugaucccccagaugca

SEQ ID NO: 2054323 - RNA, 17 nt, Homo sapiens
uugguggcaaaauugcc

SEQ ID NO: 2054324 - RNA, 13 nt, Homo sapiens
gugcuuugugaua

SEQ ID NO: 2054325 - RNA, 11 nt, Homo sapiens
ggggcucagaa

SEQ ID NO: 2054326 - RNA, 21 nt, Homo sapiens
aggauugucugcugccuccaa

SEQ ID NO: 2054327 - RNA, 19 nt, Homo sapiens
uauuguaagaaauacugua

SEQ ID NO: 2054328 - RNA, 15 nt, Homo sapiens
cuucugugugcugcu

SEQ ID NO: 2054329 - RNA, 17 nt, Homo sapiens
accacucaaaggccaga

SEQ ID NO: 2054330 - RNA, 14 nt, Homo sapiens
cuguaaaagacugg

SEQ ID NO: 2054331 - RNA, 16 nt, Homo sapiens
agcucacagugacauu

SEQ ID NO: 2054332 - RNA, 14 nt, Homo sapiens
ggauggguccagaa

SEQ ID NO: 2054333 - RNA, 20 nt, Homo sapiens
gucacauagcugggauuuga

SEQ ID NO: 2054334 - RNA, 20 nt, Homo sapiens
guggguacucaauguguacu

SEQ ID NO: 2054335 - RNA, 22 nt, Homo sapiens
caaguugugccuuucacagcuu

SEQ ID NO: 2054336 - RNA, 21 nt, Homo sapiens
cacgcuucaaggauauacugc

SEQ ID NO: 2054337 - RNA, 13 nt, Homo sapiens
cuucugcaguuag

SEQ ID NO: 2054338 - RNA, 20 nt, Homo sapiens
auaaggggaagagucauuuu

SEQ ID NO: 2054339 - RNA, 16 nt, Homo sapiens
aggugugaaccacugu

SEQ ID NO: 2054340 - RNA, 16 nt, Homo sapiens
gauuuuugagcacaaa

SEQ ID NO: 2054341 - RNA, 19 nt, Homo sapiens
ucuacuaaaaacacaaaaa

SEQ ID NO: 2054342 - RNA, 13 nt, Homo sapiens
ugcagugagccau

SEQ ID NO: 2054343 - RNA, 13 nt, Homo sapiens
auuuauccaccuc

SEQ ID NO: 2054344 - RNA, 16 nt, Homo sapiens
uuguuccacuuguuug

SEQ ID NO: 2054345 - RNA, 13 nt, Homo sapiens
ggcauccaguauc

SEQ ID NO: 2054346 - RNA, 15 nt, Homo sapiens
gccuggcccuggaac

SEQ ID NO: 2054347 - RNA, 12 nt, Homo sapiens
cuguucugugac

SEQ ID NO: 2054348 - RNA, 15 nt, Homo sapiens
agugagccaagauca

SEQ ID NO: 2054349 - RNA, 20 nt, Homo sapiens
ggcuggaaaucaauacugca

SEQ ID NO: 2054350 - RNA, 21 nt, Homo sapiens
gaccagucccgucgugcaguc

SEQ ID NO: 2054351 - RNA, 15 nt, Homo sapiens
ugcaaccacugcuuc

SEQ ID NO: 2054352 - RNA, 16 nt, Homo sapiens
ucuaagcaaugcaaau

SEQ ID NO: 2054353 - RNA, 18 nt, Homo sapiens
uacuuccccuucuugcca

SEQ ID NO: 2054354 - RNA, 18 nt, Homo sapiens
acaguaugagucaaugug

SEQ ID NO: 2054355 - RNA, 18 nt, Homo sapiens
uuucaacuccaguacucu

SEQ ID NO: 2054356 - RNA, 16 nt, Homo sapiens
cuauaucuguauauaa

SEQ ID NO: 2054357 - RNA, 18 nt, Homo sapiens
cacaucaaaaaccuggag

SEQ ID NO: 2054358 - RNA, 21 nt, Homo sapiens
acaaucggcugcauugaagau

SEQ ID NO: 2054359 - RNA, 16 nt, Homo sapiens
uauaagguaugugcua

SEQ ID NO: 2054360 - RNA, 16 nt, Homo sapiens
gagccgcgucccggca

SEQ ID NO: 2054361 - RNA, 22 nt, Homo sapiens
aaggcauuccacaggaucauca

SEQ ID NO: 2054362 - RNA, 19 nt, Homo sapiens
gcgugagauccggcagcac

SEQ ID NO: 2054363 - RNA, 23 nt, Homo sapiens
uaaauuugaugcuuuaacugauc

SEQ ID NO: 2054364 - RNA, 14 nt, Homo sapiens
gggcagauauucuc

SEQ ID NO: 2054365 - RNA, 23 nt, Homo sapiens
cucccagcuccuuucuccuguga

SEQ ID NO: 2054366 - RNA, 16 nt, Homo sapiens
acaugcuggugcauau

SEQ ID NO: 2054367 - RNA, 17 nt, Homo sapiens
ucugagaauuccaagga

SEQ ID NO: 2054368 - RNA, 19 nt, Homo sapiens
gcaugaaugagacccagcu

SEQ ID NO: 2054369 - RNA, 14 nt, Homo sapiens
ccggugugccugug

SEQ ID NO: 2054370 - RNA, 14 nt, Homo sapiens
uggacauguguaca

SEQ ID NO: 2054371 - RNA, 14 nt, Homo sapiens
aaucaaugaagcaa

SEQ ID NO: 2054372 - RNA, 14 nt, Homo sapiens
uuguuagaaagugc

SEQ ID NO: 2054373 - RNA, 13 nt, Homo sapiens
cuuaauacugucc

SEQ ID NO: 2054374 - RNA, 16 nt, Homo sapiens
ccaaacuacgaccuca

SEQ ID NO: 2054375 - RNA, 17 nt, Homo sapiens
agacagagggcaaugau

SEQ ID NO: 2054376 - RNA, 20 nt, Homo sapiens
augaguugaggccacugugu

SEQ ID NO: 2054377 - RNA, 21 nt, Homo sapiens
aaggcugccagguguggaaca

SEQ ID NO: 2054378 - RNA, 15 nt, Homo sapiens
ucagcacacacuuac

SEQ ID NO: 2054379 - RNA, 18 nt, Homo sapiens
cuugauucagaaccauuu

SEQ ID NO: 2054380 - RNA, 22 nt, Homo sapiens
gacagguuggccguuugcuuaa

SEQ ID NO: 2054381 - RNA, 21 nt, Homo sapiens
uuugggaguguucugugggcu

SEQ ID NO: 2054382 - RNA, 22 nt, Homo sapiens
aauaaaguugcugugaauacuu

SEQ ID NO: 2054383 - RNA, 20 nt, Homo sapiens
agaguaccccccugagagca

SEQ ID NO: 2054384 - RNA, 20 nt, Homo sapiens
cuaagccaggaggcuuuaag

SEQ ID NO: 2054385 - RNA, 12 nt, Homo sapiens
gagcuacaguag

SEQ ID NO: 2054386 - RNA, 14 nt, Homo sapiens
cagccgaggccaca

SEQ ID NO: 2054387 - RNA, 12 nt, Homo sapiens
acggccacugca

SEQ ID NO: 2054388 - RNA, 18 nt, Homo sapiens
ucaucaaaacaaaacagc

SEQ ID NO: 2054389 - RNA, 20 nt, Homo sapiens
cacuggacugacgacuugag

SEQ ID NO: 2054390 - RNA, 15 nt, Homo sapiens
ucaauaaaaguugau

SEQ ID NO: 2054391 - RNA, 15 nt, Homo sapiens
aguuuaaaucaagau

SEQ ID NO: 2054392 - RNA, 12 nt, Homo sapiens
ucacuugcaauu

SEQ ID NO: 2054393 - RNA, 16 nt, Homo sapiens
ucucagccccucagag

SEQ ID NO: 2054394 - RNA, 21 nt, Homo sapiens
caucuuggccaggcuggucuu

SEQ ID NO: 2054395 - RNA, 19 nt, Homo sapiens
accuuccuuaagccaggaa

SEQ ID NO: 2054396 - RNA, 16 nt, Homo sapiens
accccagaaacugaac

SEQ ID NO: 2054397 - RNA, 22 nt, Homo sapiens
aucaccagcacauucacugaca

SEQ ID NO: 2054398 - RNA, 20 nt, Homo sapiens
gccugaaccguuacaaaaga

SEQ ID NO: 2054399 - RNA, 15 nt, Homo sapiens
cucccuguaacucca

SEQ ID NO: 2054400 - RNA, 16 nt, Homo sapiens
uuuaacccucucuucc

SEQ ID NO: 2054401 - RNA, 14 nt, Homo sapiens
ucuuuagugucuga

SEQ ID NO: 2054402 - RNA, 13 nt, Homo sapiens
ugcugacacugug

SEQ ID NO: 2054403 - RNA, 17 nt, Homo sapiens
ccaccccaucugcauuc

SEQ ID NO: 2054404 - RNA, 20 nt, Homo sapiens
gauuacuaucauggcauaua

SEQ ID NO: 2054405 - RNA, 20 nt, Homo sapiens
ccuucaucuucacugcaauu

SEQ ID NO: 2054406 - RNA, 20 nt, Homo sapiens
ucagauuccuucccauggag

SEQ ID NO: 2054407 - RNA, 20 nt, Homo sapiens
gaauccauaaauguguuccu

SEQ ID NO: 2054408 - RNA, 12 nt, Homo sapiens
agcucacgucac

SEQ ID NO: 2054409 - RNA, 23 nt, Homo sapiens
agcuacuugggaggcugagccag

SEQ ID NO: 2054410 - RNA, 23 nt, Homo sapiens
uucuaacauaaguaagacuugau

SEQ ID NO: 2054411 - RNA, 20 nt, Homo sapiens
uguuauuauaaaaguacuag

SEQ ID NO: 2054412 - RNA, 18 nt, Homo sapiens
cucacagaagaugaagca

SEQ ID NO: 2054413 - RNA, 17 nt, Homo sapiens
cuauugccugagagcac

SEQ ID NO: 2054414 - RNA, 15 nt, Homo sapiens
cuguuauaauuugca

SEQ ID NO: 2054415 - RNA, 18 nt, Homo sapiens
uaccuuguguacuuucuu

SEQ ID NO: 2054416 - RNA, 22 nt, Homo sapiens
auaaaaguccugucaccaagga

SEQ ID NO: 2054417 - RNA, 14 nt, Homo sapiens
cuuaaaauugauau

SEQ ID NO: 2054418 - RNA, 15 nt, Homo sapiens
agauucuaaagauuc

SEQ ID NO: 2054419 - RNA, 23 nt, Homo sapiens
augguguugauacgugugugaag

SEQ ID NO: 2054420 - RNA, 20 nt, Homo sapiens
guuguaaaccaagugaucaa

SEQ ID NO: 2054421 - RNA, 13 nt, Homo sapiens
aagcugucacuca

SEQ ID NO: 2054422 - RNA, 19 nt, Homo sapiens
uuuuauguguugaugacuc

SEQ ID NO: 2054423 - RNA, 17 nt, Homo sapiens
uccuucuuaacucugca

SEQ ID NO: 2054424 - RNA, 20 nt, Homo sapiens
acacagcccuggaaacauac

SEQ ID NO: 2054425 - RNA, 15 nt, Homo sapiens
cagggggaugugucc

SEQ ID NO: 2054426 - RNA, 16 nt, Homo sapiens
aauuucucugaggaca

SEQ ID NO: 2054427 - RNA, 15 nt, Homo sapiens
aggauuacuacuuug

SEQ ID NO: 2054428 - RNA, 15 nt, Homo sapiens
aaaaucaaaugugca

SEQ ID NO: 2054429 - RNA, 20 nt, Homo sapiens
ugauauguugguagauucua

SEQ ID NO: 2054430 - RNA, 15 nt, Homo sapiens
auccuucaccagagc

SEQ ID NO: 2054431 - RNA, 14 nt, Homo sapiens
cacaaacggagccc

SEQ ID NO: 2054432 - RNA, 18 nt, Homo sapiens
auuuuuugagucuguucu

SEQ ID NO: 2054433 - RNA, 14 nt, Homo sapiens
uugccagagccaaa

SEQ ID NO: 2054434 - RNA, 16 nt, Homo sapiens
aaauugaugugcccua

SEQ ID NO: 2054435 - RNA, 15 nt, Homo sapiens
gaccugccugcauuc

SEQ ID NO: 2054436 - RNA, 13 nt, Homo sapiens
cugaaaaauguca

SEQ ID NO: 2054437 - RNA, 15 nt, Homo sapiens
acuuuauacacuucu

SEQ ID NO: 2054438 - RNA, 17 nt, Homo sapiens
caguuuuuauauagucu

SEQ ID NO: 2054439 - RNA, 21 nt, Homo sapiens
aauagaagcuucuugcuccug

SEQ ID NO: 2054440 - RNA, 15 nt, Homo sapiens
cuugaacccugagag

SEQ ID NO: 2054441 - RNA, 12 nt, Homo sapiens
uugcaugcaugc

SEQ ID NO: 2054442 - RNA, 13 nt, Homo sapiens
ucgcaaaucacaa

SEQ ID NO: 2054443 - RNA, 18 nt, Homo sapiens
accaggacuacagcuuuc

SEQ ID NO: 2054444 - RNA, 22 nt, Homo sapiens
gaccagaaccagagcucagaga

SEQ ID NO: 2054445 - RNA, 17 nt, Homo sapiens
ggcucacucagcacuug

SEQ ID NO: 2054446 - RNA, 13 nt, Homo sapiens
ucugucuggccag

SEQ ID NO: 2054447 - RNA, 18 nt, Homo sapiens
cccaagauugagcucucu

SEQ ID NO: 2054448 - RNA, 23 nt, Homo sapiens
acuaguugucaacuaaugaaaau

SEQ ID NO: 2054449 - RNA, 14 nt, Homo sapiens
agcuggagucuguc

SEQ ID NO: 2054450 - RNA, 13 nt, Homo sapiens
ccuucacuggaga

SEQ ID NO: 2054451 - RNA, 15 nt, Homo sapiens
uauauacauacugca

SEQ ID NO: 2054452 - RNA, 22 nt, Homo sapiens
gacacugugguugcaaaaccca

SEQ ID NO: 2054453 - RNA, 14 nt, Homo sapiens
cccuggcugacugg

SEQ ID NO: 2054454 - RNA, 13 nt, Homo sapiens
aagaagcucucca

SEQ ID NO: 2054455 - RNA, 22 nt, Homo sapiens
agcacugcccaaagugcuucca

SEQ ID NO: 2054456 - RNA, 18 nt, Homo sapiens
auuacaugcccaucccag

SEQ ID NO: 2054457 - RNA, 22 nt, Homo sapiens
auaauguaauguuuuuauuuca

SEQ ID NO: 2054458 - RNA, 21 nt, Homo sapiens
ggcuaaaagacaugcauuuuu

SEQ ID NO: 2054459 - RNA, 12 nt, Homo sapiens
aucaaacaugaa

SEQ ID NO: 2054460 - RNA, 21 nt, Homo sapiens
ccuuucaucucucuaccucca

SEQ ID NO: 2054461 - RNA, 15 nt, Homo sapiens
guauaauacuuugua

SEQ ID NO: 2054462 - RNA, 14 nt, Homo sapiens
caguauacaguccu

SEQ ID NO: 2054463 - RNA, 15 nt, Homo sapiens
uacauaauguauugu

SEQ ID NO: 2054464 - RNA, 20 nt, Homo sapiens
cagcaucuagugguggaccg

SEQ ID NO: 2054465 - RNA, 13 nt, Homo sapiens
aaaaauucacacu

SEQ ID NO: 2054466 - RNA, 17 nt, Homo sapiens
ccugggcugugcugcuu

SEQ ID NO: 2054467 - RNA, 16 nt, Homo sapiens
uuggcccaucccgccu

SEQ ID NO: 2054468 - RNA, 20 nt, Homo sapiens
cucccugucauagagcugca

SEQ ID NO: 2054469 - RNA, 15 nt, Homo sapiens
cuuaguagagauuuc

SEQ ID NO: 2054470 - RNA, 14 nt, Homo sapiens
uuugaucccagaaa

SEQ ID NO: 2054471 - RNA, 14 nt, Homo sapiens
uauccucauuccau

SEQ ID NO: 2054472 - RNA, 14 nt, Homo sapiens
uuuuccugccaggc

SEQ ID NO: 2054473 - RNA, 17 nt, Homo sapiens
cuuggguucacagugca

SEQ ID NO: 2054474 - RNA, 16 nt, Homo sapiens
uuauauguaguacuaa

SEQ ID NO: 2054475 - RNA, 12 nt, Homo sapiens
cugccuucacaa

SEQ ID NO: 2054476 - RNA, 20 nt, Homo sapiens
agaauggaagccuccaccug

SEQ ID NO: 2054477 - RNA, 20 nt, Homo sapiens
aucaaaauaaaaagugacac

SEQ ID NO: 2054478 - RNA, 23 nt, Homo sapiens
gacccucaccuuccuucugccca

SEQ ID NO: 2054479 - RNA, 16 nt, Homo sapiens
accucacuccuguuac

SEQ ID NO: 2054480 - RNA, 23 nt, Homo sapiens
guuuccugacagaugccugguga

SEQ ID NO: 2054481 - RNA, 12 nt, Homo sapiens
agcuugcugcua

SEQ ID NO: 2054482 - RNA, 18 nt, Homo sapiens
aaggaaaggcucauuuaa

SEQ ID NO: 2054483 - RNA, 20 nt, Homo sapiens
uggugcuggaaccagcucuc

SEQ ID NO: 2054484 - RNA, 15 nt, Homo sapiens
agccuccgucaucca

SEQ ID NO: 2054485 - RNA, 15 nt, Homo sapiens
uguuaucuucacuuu

SEQ ID NO: 2054486 - RNA, 22 nt, Homo sapiens
ucccgguugugagagccuguga

SEQ ID NO: 2054487 - RNA, 14 nt, Homo sapiens
auuagccaggcgug

SEQ ID NO: 2054488 - RNA, 18 nt, Homo sapiens
aauauaaaauacauaaaa

SEQ ID NO: 2054489 - RNA, 14 nt, Homo sapiens
gaagauaccauaag

SEQ ID NO: 2054490 - RNA, 21 nt, Homo sapiens
ucgcaggccucccugccagua

SEQ ID NO: 2054491 - RNA, 22 nt, Homo sapiens
aggggaagucucuuccugccuc

SEQ ID NO: 2054492 - RNA, 14 nt, Homo sapiens
agugucacuaagaa

SEQ ID NO: 2054493 - RNA, 22 nt, Homo sapiens
cacuucaagaagucacugucag

SEQ ID NO: 2054494 - RNA, 19 nt, Homo sapiens
cuuuaaguaaaauguuuca

SEQ ID NO: 2054495 - RNA, 16 nt, Homo sapiens
uacccagugggacaga

SEQ ID NO: 2054496 - RNA, 18 nt, Homo sapiens
aggaguuuauuacaaugu

SEQ ID NO: 2054497 - RNA, 14 nt, Homo sapiens
ucacuucucuuccu

SEQ ID NO: 2054498 - RNA, 23 nt, Homo sapiens
cugugccaauacagacaaagcau

SEQ ID NO: 2054499 - RNA, 19 nt, Homo sapiens
uccccauuugggacaucaa

SEQ ID NO: 2054500 - RNA, 23 nt, Homo sapiens
aggggcccaaauucuuucagugg

SEQ ID NO: 2054501 - RNA, 20 nt, Homo sapiens
gaaauuaucugucauuugag

SEQ ID NO: 2054502 - RNA, 12 nt, Homo sapiens
uacacacaggag

SEQ ID NO: 2054503 - RNA, 18 nt, Homo sapiens
uuccucccuggugugaac

SEQ ID NO: 2054504 - RNA, 18 nt, Homo sapiens
cucaguuugugugucuua

SEQ ID NO: 2054505 - RNA, 22 nt, Homo sapiens
uacugaaucuucaagaccaaag

SEQ ID NO: 2054506 - RNA, 15 nt, Homo sapiens
gguuuuguacuggau

SEQ ID NO: 2054507 - RNA, 18 nt, Homo sapiens
acacacgugcugugggcc

SEQ ID NO: 2054508 - RNA, 11 nt, Homo sapiens
gcaaacauaau

SEQ ID NO: 2054509 - RNA, 15 nt, Homo sapiens
acugauucaagaaca

SEQ ID NO: 2054510 - RNA, 23 nt, Homo sapiens
accugaggcucagcccuagcccu

SEQ ID NO: 2054511 - RNA, 21 nt, Homo sapiens
cacaggagggcugggcuccac

SEQ ID NO: 2054512 - RNA, 18 nt, Homo sapiens
gcagaugcuguugugaag

SEQ ID NO: 2054513 - RNA, 14 nt, Homo sapiens
uguuguacauuuca

SEQ ID NO: 2054514 - RNA, 13 nt, Homo sapiens
uugagcucuguaa

SEQ ID NO: 2054515 - RNA, 15 nt, Homo sapiens
uagcaugaaccaccc

SEQ ID NO: 2054516 - RNA, 18 nt, Homo sapiens
uauauguacauacauuca

SEQ ID NO: 2054517 - RNA, 22 nt, Homo sapiens
ccagugauccucaaacacacaa

SEQ ID NO: 2054518 - RNA, 15 nt, Homo sapiens
gagguggacaguccu

SEQ ID NO: 2054519 - RNA, 15 nt, Homo sapiens
ccacucugggcacaa

SEQ ID NO: 2054520 - RNA, 21 nt, Homo sapiens
aagggccugcccagacaagau

SEQ ID NO: 2054521 - RNA, 13 nt, Homo sapiens
ucuucagaugcca

SEQ ID NO: 2054522 - RNA, 16 nt, Homo sapiens
acuguuaacuaugaca

SEQ ID NO: 2054523 - RNA, 22 nt, Homo sapiens
uaccugaagucuuuguacagac

SEQ ID NO: 2054524 - RNA, 21 nt, Homo sapiens
cuucucaaaguacugggauua

SEQ ID NO: 2054525 - RNA, 22 nt, Homo sapiens
gucuguccuugggaugcucucu

SEQ ID NO: 2054526 - RNA, 20 nt, Homo sapiens
cuucccggcgucccuaccuc

SEQ ID NO: 2054527 - RNA, 21 nt, Homo sapiens
agccuaggggucagggaccaa

SEQ ID NO: 2054528 - RNA, 13 nt, Homo sapiens
ugaaacaucucaa

SEQ ID NO: 2054529 - RNA, 17 nt, Homo sapiens
gggaauugaggucugcu

SEQ ID NO: 2054530 - RNA, 20 nt, Homo sapiens
accuagaaacacacauuucu

SEQ ID NO: 2054531 - RNA, 20 nt, Homo sapiens
cauuuaugguguaguucuga

SEQ ID NO: 2054532 - RNA, 15 nt, Homo sapiens
uauuuauugugaugc

SEQ ID NO: 2054533 - RNA, 13 nt, Homo sapiens
auauaauauguau

SEQ ID NO: 2054534 - RNA, 18 nt, Homo sapiens
aaauauauuuuggaaaac

SEQ ID NO: 2054535 - RNA, 14 nt, Homo sapiens
agggccuggaagac

SEQ ID NO: 2054536 - RNA, 17 nt, Homo sapiens
cuccccaaggcugcaaa

SEQ ID NO: 2054537 - RNA, 17 nt, Homo sapiens
uccuacagccagcagca

SEQ ID NO: 2054538 - RNA, 18 nt, Homo sapiens
ccaaagugucuuuugaca

SEQ ID NO: 2054539 - RNA, 14 nt, Homo sapiens
gugaauucacccau

SEQ ID NO: 2054540 - RNA, 16 nt, Homo sapiens
cucucacccaccagcu

SEQ ID NO: 2054541 - RNA, 19 nt, Homo sapiens
uaguuuugugaaggugauu

SEQ ID NO: 2054542 - RNA, 19 nt, Homo sapiens
ccagggcugggcacuccuc

SEQ ID NO: 2054543 - RNA, 16 nt, Homo sapiens
ugucaugaauguugca

SEQ ID NO: 2054544 - RNA, 18 nt, Homo sapiens
cuccugugaacacuggag

SEQ ID NO: 2054545 - RNA, 15 nt, Homo sapiens
aacuucaucuucccc

SEQ ID NO: 2054546 - RNA, 22 nt, Homo sapiens
aacaguugcauugacugucaca

SEQ ID NO: 2054547 - RNA, 14 nt, Homo sapiens
aagguggaugccaa

SEQ ID NO: 2054548 - RNA, 18 nt, Homo sapiens
aaucaaguuggcuucuaa

SEQ ID NO: 2054549 - RNA, 20 nt, Homo sapiens
cuucauaauuucuucacuca

SEQ ID NO: 2054550 - RNA, 14 nt, Homo sapiens
uaaagaaguuugaa

SEQ ID NO: 2054551 - RNA, 16 nt, Homo sapiens
auauaguuagcuuuau

SEQ ID NO: 2054552 - RNA, 16 nt, Homo sapiens
aacguuuaacauugau

SEQ ID NO: 2054553 - RNA, 13 nt, Homo sapiens
uaguucuaccuca

SEQ ID NO: 2054554 - RNA, 14 nt, Homo sapiens
ggcgggucccaggc

SEQ ID NO: 2054555 - RNA, 21 nt, Homo sapiens
aagcggugguuuguaauuccu

SEQ ID NO: 2054556 - RNA, 20 nt, Homo sapiens
caggaaaguuuacccaugaa

SEQ ID NO: 2054557 - RNA, 21 nt, Homo sapiens
ucgcccaggcuggagggcagu

SEQ ID NO: 2054558 - RNA, 12 nt, Homo sapiens
uuucaauugcau

SEQ ID NO: 2054559 - RNA, 23 nt, Homo sapiens
agaagugauauggugaagggaag

SEQ ID NO: 2054560 - RNA, 19 nt, Homo sapiens
agcccauaauggcaaagac

SEQ ID NO: 2054561 - RNA, 18 nt, Homo sapiens
cacugaguuugaacacag

SEQ ID NO: 2054562 - RNA, 13 nt, Homo sapiens
uguagacacuuac

SEQ ID NO: 2054563 - RNA, 18 nt, Homo sapiens
gcuuugaaagaagcaaga

SEQ ID NO: 2054564 - RNA, 21 nt, Homo sapiens
aauaugcacuuucccuagaaa

SEQ ID NO: 2054565 - RNA, 14 nt, Homo sapiens
cauaaacauuugca

SEQ ID NO: 2054566 - RNA, 18 nt, Homo sapiens
agcugguaaucuugcucu

SEQ ID NO: 2054567 - RNA, 20 nt, Homo sapiens
ugguuuguuauaucagggaa

SEQ ID NO: 2054568 - RNA, 21 nt, Homo sapiens
uauuucccaacccaggauuca

SEQ ID NO: 2054569 - RNA, 18 nt, Homo sapiens
gaugaccagaacaagguu

SEQ ID NO: 2054570 - RNA, 19 nt, Homo sapiens
aauuuacuuuaaacuacau

SEQ ID NO: 2054571 - RNA, 21 nt, Homo sapiens
auauguaauauauacauauuc

SEQ ID NO: 2054572 - RNA, 22 nt, Homo sapiens
uaugcucagggucaauuucuuu

SEQ ID NO: 2054573 - RNA, 14 nt, Homo sapiens
acuauuuacaguag

SEQ ID NO: 2054574 - RNA, 16 nt, Homo sapiens
uuuccugugccuaaca

SEQ ID NO: 2054575 - RNA, 16 nt, Homo sapiens
aauaaaguuccuguca

SEQ ID NO: 2054576 - RNA, 13 nt, Homo sapiens
agcugcuggccag

SEQ ID NO: 2054577 - RNA, 13 nt, Homo sapiens
uaacuuacacuga

SEQ ID NO: 2054578 - RNA, 19 nt, Homo sapiens
gagcccuauauauucaaaa

SEQ ID NO: 2054579 - RNA, 19 nt, Homo sapiens
gccagaggcagccucugca

SEQ ID NO: 2054580 - RNA, 21 nt, Homo sapiens
aggagaacaucauaacccaug

SEQ ID NO: 2054581 - RNA, 21 nt, Homo sapiens
cuugauuuuuuuaaacauaag

SEQ ID NO: 2054582 - RNA, 17 nt, Homo sapiens
ugggcuagauaggauau

SEQ ID NO: 2054583 - RNA, 14 nt, Homo sapiens
aguguccaggagau

SEQ ID NO: 2054584 - RNA, 23 nt, Homo sapiens
aauuaucuugaauguaguauuca

SEQ ID NO: 2054585 - RNA, 14 nt, Homo sapiens
caggggggcugugg

SEQ ID NO: 2054586 - RNA, 15 nt, Homo sapiens
ccuuuguacuuugug

SEQ ID NO: 2054587 - RNA, 16 nt, Homo sapiens
gugauacaaauugaua

SEQ ID NO: 2054588 - RNA, 16 nt, Homo sapiens
aggcacugagcaggga

SEQ ID NO: 2054589 - RNA, 20 nt, Homo sapiens
aucgucucugccacuccuga

SEQ ID NO: 2054590 - RNA, 22 nt, Homo sapiens
caaccuacuaauccucucugca

SEQ ID NO: 2054591 - RNA, 15 nt, Homo sapiens
gcguccccacucccu

SEQ ID NO: 2054592 - RNA, 13 nt, Homo sapiens
guaucacagucag

SEQ ID NO: 2054593 - RNA, 15 nt, Homo sapiens
cuuaacacauucaau

SEQ ID NO: 2054594 - RNA, 22 nt, Homo sapiens
uuguugaccucaacaauggcaa

SEQ ID NO: 2054595 - RNA, 16 nt, Homo sapiens
gagacagaccacuugc

SEQ ID NO: 2054596 - RNA, 23 nt, Homo sapiens
caagccagccuugcuccuggcug

SEQ ID NO: 2054597 - RNA, 10 nt, Homo sapiens
gaaaacagaa

SEQ ID NO: 2054598 - RNA, 13 nt, Homo sapiens
uuaaacaccugac

SEQ ID NO: 2054599 - RNA, 19 nt, Homo sapiens
ugagucuguggacacugug

SEQ ID NO: 2054600 - RNA, 14 nt, Homo sapiens
cccuucguguuucc

SEQ ID NO: 2054601 - RNA, 13 nt, Homo sapiens
ucucccguuacaa

SEQ ID NO: 2054602 - RNA, 13 nt, Homo sapiens
uccauaauugcaa

SEQ ID NO: 2054603 - RNA, 13 nt, Homo sapiens
aguaaaauacuau

SEQ ID NO: 2054604 - RNA, 17 nt, Homo sapiens
cauacuuugacaaggaa

SEQ ID NO: 2054605 - RNA, 23 nt, Homo sapiens
cuguauaguuaggauagcauuuu

SEQ ID NO: 2054606 - RNA, 17 nt, Homo sapiens
cugaccucuugcugcca

SEQ ID NO: 2054607 - RNA, 16 nt, Homo sapiens
caggccucugcucucc

SEQ ID NO: 2054608 - RNA, 15 nt, Homo sapiens
aagguguucucugua

SEQ ID NO: 2054609 - RNA, 18 nt, Homo sapiens
uacuccaucauggcugcu

SEQ ID NO: 2054610 - RNA, 19 nt, Homo sapiens
aucugagaaaaaaagugag

SEQ ID NO: 2054611 - RNA, 18 nt, Homo sapiens
agggggcaugaagcacau

SEQ ID NO: 2054612 - RNA, 16 nt, Homo sapiens
gaguaagaaaugcugc

SEQ ID NO: 2054613 - RNA, 14 nt, Homo sapiens
aaggcugagcucuu

SEQ ID NO: 2054614 - RNA, 12 nt, Homo sapiens
uucaaugaacaa

SEQ ID NO: 2054615 - RNA, 19 nt, Homo sapiens
aaugagucacuuacuucau

SEQ ID NO: 2054616 - RNA, 18 nt, Homo sapiens
uucaccagagcauuucca

SEQ ID NO: 2054617 - RNA, 12 nt, Homo sapiens
uccccuauggaa

SEQ ID NO: 2054618 - RNA, 17 nt, Homo sapiens
cagggccccugaaguga

SEQ ID NO: 2054619 - RNA, 11 nt, Homo sapiens
uuucucaaaaa

SEQ ID NO: 2054620 - RNA, 17 nt, Homo sapiens
uggaaggugacuuuuca

SEQ ID NO: 2054621 - RNA, 13 nt, Homo sapiens
aacugagguguua

SEQ ID NO: 2054622 - RNA, 17 nt, Homo sapiens
auacauguguguauaua

SEQ ID NO: 2054623 - RNA, 16 nt, Homo sapiens
aaagaagauucugugg

SEQ ID NO: 2054624 - RNA, 22 nt, Homo sapiens
ggcgugguagcgggcgccugua

SEQ ID NO: 2054625 - RNA, 21 nt, Homo sapiens
gaggcuucuccgccagccucc

SEQ ID NO: 2054626 - RNA, 20 nt, Homo sapiens
guaacaugacacauuugaaa

SEQ ID NO: 2054627 - RNA, 18 nt, Homo sapiens
auaauacaggauugucua

SEQ ID NO: 2054628 - RNA, 23 nt, Homo sapiens
agcugagaccagggucuuaccuc

SEQ ID NO: 2054629 - RNA, 14 nt, Homo sapiens
cuacccugcugacc

SEQ ID NO: 2054630 - RNA, 16 nt, Homo sapiens
ugccgacacugagcug

SEQ ID NO: 2054631 - RNA, 20 nt, Homo sapiens
ugauuaaaauguuugagcac

SEQ ID NO: 2054632 - RNA, 15 nt, Homo sapiens
gaacuugagcgugaa

SEQ ID NO: 2054633 - RNA, 15 nt, Homo sapiens
aauguuuugcuuaaa

SEQ ID NO: 2054634 - RNA, 21 nt, Homo sapiens
gccaaagaaaugaacauucca

SEQ ID NO: 2054635 - RNA, 15 nt, Homo sapiens
uugacucuacugauc

SEQ ID NO: 2054636 - RNA, 21 nt, Homo sapiens
cagggucucgcucuguugccc

SEQ ID NO: 2054637 - RNA, 16 nt, Homo sapiens
aauaaaaguuuacaga

SEQ ID NO: 2054638 - RNA, 12 nt, Homo sapiens
agugcugugagc

SEQ ID NO: 2054639 - RNA, 13 nt, Homo sapiens
uggacucaccucc

SEQ ID NO: 2054640 - RNA, 16 nt, Homo sapiens
ccaugucuacaaaagc

SEQ ID NO: 2054641 - RNA, 17 nt, Homo sapiens
auucuggaccucugggu

SEQ ID NO: 2054642 - RNA, 17 nt, Homo sapiens
acaagcagcuaagcaau

SEQ ID NO: 2054643 - RNA, 17 nt, Homo sapiens
auaacuuugaagccaua

SEQ ID NO: 2054644 - RNA, 23 nt, Homo sapiens
cugucaguuauucuugcaaagau

SEQ ID NO: 2054645 - RNA, 15 nt, Homo sapiens
ugagggaaagugcau

SEQ ID NO: 2054646 - RNA, 20 nt, Homo sapiens
auauaauaacuuuauugcau

SEQ ID NO: 2054647 - RNA, 20 nt, Homo sapiens
uaagagaagaugugauuuau

SEQ ID NO: 2054648 - RNA, 12 nt, Homo sapiens
uucccccaguca

SEQ ID NO: 2054649 - RNA, 21 nt, Homo sapiens
cccgugccacgcgcucugcau

SEQ ID NO: 2054650 - RNA, 14 nt, Homo sapiens
uuuauaccaagaga

SEQ ID NO: 2054651 - RNA, 21 nt, Homo sapiens
aggauggcaggaggcauccaa

SEQ ID NO: 2054652 - RNA, 13 nt, Homo sapiens
guuuauucuucca

SEQ ID NO: 2054653 - RNA, 17 nt, Homo sapiens
accaaacugccucaauc

SEQ ID NO: 2054654 - RNA, 13 nt, Homo sapiens
uagaaagaugaca

SEQ ID NO: 2054655 - RNA, 21 nt, Homo sapiens
uggcggggcuuuccugcacau

SEQ ID NO: 2054656 - RNA, 12 nt, Homo sapiens
uccauauaguuu

SEQ ID NO: 2054657 - RNA, 16 nt, Homo sapiens
ugcaggaaaagcaaaa

SEQ ID NO: 2054658 - RNA, 14 nt, Homo sapiens
ucuguacccaugaa

SEQ ID NO: 2054659 - RNA, 14 nt, Homo sapiens
uaaaugccccaaag

SEQ ID NO: 2054660 - RNA, 23 nt, Homo sapiens
aaucuacaaaagugaaccaucuc

SEQ ID NO: 2054661 - RNA, 12 nt, Homo sapiens
cccauuugggca

SEQ ID NO: 2054662 - RNA, 16 nt, Homo sapiens
aaaagcaacaggccau

SEQ ID NO: 2054663 - RNA, 16 nt, Homo sapiens
uggucagaaacacaga

SEQ ID NO: 2054664 - RNA, 23 nt, Homo sapiens
cuuccagguguuacuguaauucc

SEQ ID NO: 2054665 - RNA, 19 nt, Homo sapiens
ggguuuucaccuuagcaac

SEQ ID NO: 2054666 - RNA, 12 nt, Homo sapiens
cuuccauucccu

SEQ ID NO: 2054667 - RNA, 17 nt, Homo sapiens
gaucuccauauguuaca

SEQ ID NO: 2054668 - RNA, 22 nt, Homo sapiens
agcucgcacggcgccaggugau

SEQ ID NO: 2054669 - RNA, 19 nt, Homo sapiens
agaauugacugcaguugaa

SEQ ID NO: 2054670 - RNA, 22 nt, Homo sapiens
gaaauaaagcagggacugugaa

SEQ ID NO: 2054671 - RNA, 12 nt, Homo sapiens
uccugcauuucu

SEQ ID NO: 2054672 - RNA, 23 nt, Homo sapiens
gaacccccuuccccgcucuugcc

SEQ ID NO: 2054673 - RNA, 13 nt, Homo sapiens
ucccgaguacagu

SEQ ID NO: 2054674 - RNA, 20 nt, Homo sapiens
cagaaagaacgugaucuccu

SEQ ID NO: 2054675 - RNA, 23 nt, Homo sapiens
cucuuuggucuauuuucugcaga

SEQ ID NO: 2054676 - RNA, 16 nt, Homo sapiens
aaauugcagcaguugc

SEQ ID NO: 2054677 - RNA, 20 nt, Homo sapiens
ggcuccucaccaccgagaca

SEQ ID NO: 2054678 - RNA, 22 nt, Homo sapiens
cuuuuguuccccagcccuaaga

SEQ ID NO: 2054679 - RNA, 22 nt, Homo sapiens
gugacauccacaaaugcaguuu

SEQ ID NO: 2054680 - RNA, 23 nt, Homo sapiens
aggucuccaagacaauaauuaca

SEQ ID NO: 2054681 - RNA, 14 nt, Homo sapiens
uuccaauuuacaua

SEQ ID NO: 2054682 - RNA, 19 nt, Homo sapiens
cagcugggaucacaugugg

SEQ ID NO: 2054683 - RNA, 20 nt, Homo sapiens
cuaagaaaucauggcauuca

SEQ ID NO: 2054684 - RNA, 12 nt, Homo sapiens
gcauccacugau

SEQ ID NO: 2054685 - RNA, 17 nt, Homo sapiens
uucucuugagcuggccu

SEQ ID NO: 2054686 - RNA, 14 nt, Homo sapiens
cagggaagggagca

SEQ ID NO: 2054687 - RNA, 14 nt, Homo sapiens
agugucacaucucu

SEQ ID NO: 2054688 - RNA, 20 nt, Homo sapiens
cacaaacugcagcugugagu

SEQ ID NO: 2054689 - RNA, 23 nt, Homo sapiens
ccugugccguuuucuugcucaaa

SEQ ID NO: 2054690 - RNA, 18 nt, Homo sapiens
uacauauguaaacauaag

SEQ ID NO: 2054691 - RNA, 21 nt, Homo sapiens
gauuacaauacugaaugggaa

SEQ ID NO: 2054692 - RNA, 17 nt, Homo sapiens
uggcaacaucuugcaaa

SEQ ID NO: 2054693 - RNA, 21 nt, Homo sapiens
uuaauaggugcagucuuugag

SEQ ID NO: 2054694 - RNA, 20 nt, Homo sapiens
aaacaauggccugguucaau

SEQ ID NO: 2054695 - RNA, 20 nt, Homo sapiens
ggugaaaccccaucucuauu

SEQ ID NO: 2054696 - RNA, 18 nt, Homo sapiens
aucuuugucuuaucuacc

SEQ ID NO: 2054697 - RNA, 20 nt, Homo sapiens
cuggagccuccacugccucu

SEQ ID NO: 2054698 - RNA, 16 nt, Homo sapiens
cuugcucucucucacc

SEQ ID NO: 2054699 - RNA, 21 nt, Homo sapiens
agggaagagagggguacauuu

SEQ ID NO: 2054700 - RNA, 18 nt, Homo sapiens
ucuguacgucugacaggc

SEQ ID NO: 2054701 - RNA, 19 nt, Homo sapiens
auuuuaaaacucuacagau

SEQ ID NO: 2054702 - RNA, 23 nt, Homo sapiens
acaccucggccguacaucucugu

SEQ ID NO: 2054703 - RNA, 19 nt, Homo sapiens
aucagagacaguaucucua

SEQ ID NO: 2054704 - RNA, 17 nt, Homo sapiens
uuacuuauuuucuggau

SEQ ID NO: 2054705 - RNA, 13 nt, Homo sapiens
acgcacacaucag

SEQ ID NO: 2054706 - RNA, 15 nt, Homo sapiens
aaacauacaguccau

SEQ ID NO: 2054707 - RNA, 19 nt, Homo sapiens
uauuugugauguacuguaa

SEQ ID NO: 2054708 - RNA, 17 nt, Homo sapiens
accugguuauguuguua

SEQ ID NO: 2054709 - RNA, 14 nt, Homo sapiens
augcaccaaucagc

SEQ ID NO: 2054710 - RNA, 22 nt, Homo sapiens
cuacaucuuuuuuucuaugaaa

SEQ ID NO: 2054711 - RNA, 14 nt, Homo sapiens
gagugccuacucuu

SEQ ID NO: 2054712 - RNA, 12 nt, Homo sapiens
aauuacuggaau

SEQ ID NO: 2054713 - RNA, 22 nt, Homo sapiens
gcaggugggguuuucacuuccu

SEQ ID NO: 2054714 - RNA, 19 nt, Homo sapiens
agccucugccugacagcau

SEQ ID NO: 2054715 - RNA, 14 nt, Homo sapiens
aagaaagaucaaag

SEQ ID NO: 2054716 - RNA, 13 nt, Homo sapiens
aaaaacucacuua

SEQ ID NO: 2054717 - RNA, 22 nt, Homo sapiens
augcagcaggaaggaacaaaga

SEQ ID NO: 2054718 - RNA, 17 nt, Homo sapiens
auuucauguaaccaaga

SEQ ID NO: 2054719 - RNA, 18 nt, Homo sapiens
aaauaacccugaaucaga

SEQ ID NO: 2054720 - RNA, 14 nt, Homo sapiens
aagaacacugagau

SEQ ID NO: 2054721 - RNA, 22 nt, Homo sapiens
accaguuuaaccugaugcaguc

SEQ ID NO: 2054722 - RNA, 22 nt, Homo sapiens
gaacagucuggcgucuccagac

SEQ ID NO: 2054723 - RNA, 17 nt, Homo sapiens
cacuugccaauguacau

SEQ ID NO: 2054724 - RNA, 15 nt, Homo sapiens
aagcagucagcccuu

SEQ ID NO: 2054725 - RNA, 16 nt, Homo sapiens
cgaaacaacaacgaga

SEQ ID NO: 2054726 - RNA, 16 nt, Homo sapiens
agccacccagccagga

SEQ ID NO: 2054727 - RNA, 16 nt, Homo sapiens
agugaggcagugacca

SEQ ID NO: 2054728 - RNA, 19 nt, Homo sapiens
ucuaagcaguuauggugau

SEQ ID NO: 2054729 - RNA, 21 nt, Homo sapiens
agcuguuguaguuacaguaaa

SEQ ID NO: 2054730 - RNA, 17 nt, Homo sapiens
auuauguauuuuuguca

SEQ ID NO: 2054731 - RNA, 20 nt, Homo sapiens
ugcccacgcuggagugcagu

SEQ ID NO: 2054732 - RNA, 13 nt, Homo sapiens
aacugauugcaac

SEQ ID NO: 2054733 - RNA, 24 nt, Homo sapiens
gcuacagugucucgaugccauaau

SEQ ID NO: 2054734 - RNA, 18 nt, Homo sapiens
ugauuuaccuuuggaauu

SEQ ID NO: 2054735 - RNA, 23 nt, Homo sapiens
cuuccugcguagaagauauggaa

SEQ ID NO: 2054736 - RNA, 15 nt, Homo sapiens
aagacagcagacaaa

SEQ ID NO: 2054737 - RNA, 19 nt, Homo sapiens
ccuguaagcaacacuuuaa

SEQ ID NO: 2054738 - RNA, 17 nt, Homo sapiens
gcuuagaaaguuccaaa

SEQ ID NO: 2054739 - RNA, 22 nt, Homo sapiens
aaagucugaguaagaaacuuca

SEQ ID NO: 2054740 - RNA, 14 nt, Homo sapiens
ucugguccuaccca

SEQ ID NO: 2054741 - RNA, 20 nt, Homo sapiens
ccacaguggaaagacagcuu

SEQ ID NO: 2054742 - RNA, 18 nt, Homo sapiens
gcccacugccgaugccca

SEQ ID NO: 2054743 - RNA, 14 nt, Homo sapiens
agaugcacaacacu

SEQ ID NO: 2054744 - RNA, 15 nt, Homo sapiens
cucuucuuacuucac

SEQ ID NO: 2054745 - RNA, 12 nt, Homo sapiens
gauugagugcuc

SEQ ID NO: 2054746 - RNA, 12 nt, Homo sapiens
ggucuguaauau

SEQ ID NO: 2054747 - RNA, 12 nt, Homo sapiens
caagaaggccaa

SEQ ID NO: 2054748 - RNA, 17 nt, Homo sapiens
cucggggauguguccug

SEQ ID NO: 2054749 - RNA, 23 nt, Homo sapiens
accaaaaagagacugaucaucca

SEQ ID NO: 2054750 - RNA, 20 nt, Homo sapiens
auagcaccuccacauaccug

SEQ ID NO: 2054751 - RNA, 21 nt, Homo sapiens
gaagugagcaaggugcucuug

SEQ ID NO: 2054752 - RNA, 21 nt, Homo sapiens
acuuggaaguggggacaucag

SEQ ID NO: 2054753 - RNA, 15 nt, Homo sapiens
uaauuccccuuccau

SEQ ID NO: 2054754 - RNA, 16 nt, Homo sapiens
aaucagcaaccugacu

SEQ ID NO: 2054755 - RNA, 14 nt, Homo sapiens
ucccacacugugaa

SEQ ID NO: 2054756 - RNA, 21 nt, Homo sapiens
cucucccuuguccuucugggg

SEQ ID NO: 2054757 - RNA, 23 nt, Homo sapiens
ucuuaaaaugugcuauuugcaaa

SEQ ID NO: 2054758 - RNA, 20 nt, Homo sapiens
guccugcagcaaacacucca

SEQ ID NO: 2054759 - RNA, 16 nt, Homo sapiens
ccuagccugcucugcc

SEQ ID NO: 2054760 - RNA, 20 nt, Homo sapiens
aacacuguuggcacuuauag

SEQ ID NO: 2054761 - RNA, 16 nt, Homo sapiens
uauaauacuaaagugu

SEQ ID NO: 2054762 - RNA, 17 nt, Homo sapiens
gaaucuagcccaaccua

SEQ ID NO: 2054763 - RNA, 16 nt, Homo sapiens
aauauuuuuacagaag

SEQ ID NO: 2054764 - RNA, 15 nt, Homo sapiens
cuguaacaauacugg

SEQ ID NO: 2054765 - RNA, 15 nt, Homo sapiens
auauaagacugcugc

SEQ ID NO: 2054766 - RNA, 14 nt, Homo sapiens
cguccccucccucu

SEQ ID NO: 2054767 - RNA, 18 nt, Homo sapiens
auuauuauucuucauaac

SEQ ID NO: 2054768 - RNA, 19 nt, Homo sapiens
guaauucuuuucuguuucu

SEQ ID NO: 2054769 - RNA, 18 nt, Homo sapiens
uaaaaagaaaaguguaau

SEQ ID NO: 2054770 - RNA, 14 nt, Homo sapiens
ucacuaccuccuca

SEQ ID NO: 2054771 - RNA, 20 nt, Homo sapiens
cugccuuauuaaagcaaaaa

SEQ ID NO: 2054772 - RNA, 20 nt, Homo sapiens
uugaaaaugcaucacaugau

SEQ ID NO: 2054773 - RNA, 18 nt, Homo sapiens
ucuucugggcuacugcca

SEQ ID NO: 2054774 - RNA, 16 nt, Homo sapiens
uacauaaggaugacuu

SEQ ID NO: 2054775 - RNA, 14 nt, Homo sapiens
ccuuaaaugagauu

SEQ ID NO: 2054776 - RNA, 20 nt, Homo sapiens
acuaaacagaaaacucccaa

SEQ ID NO: 2054777 - RNA, 15 nt, Homo sapiens
ugcuuucuguuccaa

SEQ ID NO: 2054778 - RNA, 18 nt, Homo sapiens
caccauccugcagccucc

SEQ ID NO: 2054779 - RNA, 18 nt, Homo sapiens
auggaucagcucuuccug

SEQ ID NO: 2054780 - RNA, 19 nt, Homo sapiens
guugagaguugcuggugua

SEQ ID NO: 2054781 - RNA, 15 nt, Homo sapiens
ugcagucacagcuac

SEQ ID NO: 2054782 - RNA, 13 nt, Homo sapiens
ggaacacaugcac

SEQ ID NO: 2054783 - RNA, 15 nt, Homo sapiens
cagggggccagcugg

SEQ ID NO: 2054784 - RNA, 14 nt, Homo sapiens
uagaccacugccau

SEQ ID NO: 2054785 - RNA, 18 nt, Homo sapiens
uccaucuaaauaccugcc

SEQ ID NO: 2054786 - RNA, 23 nt, Homo sapiens
gcaguuucaucaaagaacaaaca

SEQ ID NO: 2054787 - RNA, 14 nt, Homo sapiens
auccagaugaagga

SEQ ID NO: 2054788 - RNA, 20 nt, Homo sapiens
augcaaggggaaaccuguga

SEQ ID NO: 2054789 - RNA, 23 nt, Homo sapiens
aagauucaguuuucccacuuuuu

SEQ ID NO: 2054790 - RNA, 18 nt, Homo sapiens
aaauauacuugacucuaa

SEQ ID NO: 2054791 - RNA, 20 nt, Homo sapiens
aagucccugacucucuguga

SEQ ID NO: 2054792 - RNA, 20 nt, Homo sapiens
aucagccuuuaggucuuuag

SEQ ID NO: 2054793 - RNA, 19 nt, Homo sapiens
uccgcggccugcaccgacc

SEQ ID NO: 2054794 - RNA, 22 nt, Homo sapiens
ccaugugcagccaccaguccau

SEQ ID NO: 2054795 - RNA, 19 nt, Homo sapiens
auucuuucagcuaucagua

SEQ ID NO: 2054796 - RNA, 17 nt, Homo sapiens
uuuuccuuagcuguaaa

SEQ ID NO: 2054797 - RNA, 20 nt, Homo sapiens
uugcacaggccacuugcuca

SEQ ID NO: 2054798 - RNA, 21 nt, Homo sapiens
uucccaucuuaaauuucuaaa

SEQ ID NO: 2054799 - RNA, 12 nt, Homo sapiens
uacuacucucca

SEQ ID NO: 2054800 - RNA, 19 nt, Homo sapiens
acuccauuucccacuucca

SEQ ID NO: 2054801 - RNA, 14 nt, Homo sapiens
ucauuucauguaua

SEQ ID NO: 2054802 - RNA, 14 nt, Homo sapiens
acugcaccuuguga

SEQ ID NO: 2054803 - RNA, 17 nt, Homo sapiens
ucuacaggaucuuuauu

SEQ ID NO: 2054804 - RNA, 17 nt, Homo sapiens
acuguucuuugcaguga

SEQ ID NO: 2054805 - RNA, 14 nt, Homo sapiens
cuuucaaauccuuc

SEQ ID NO: 2054806 - RNA, 13 nt, Homo sapiens
gccugcaagcuuc

SEQ ID NO: 2054807 - RNA, 22 nt, Homo sapiens
auuauuugaagcgagucauuuc

SEQ ID NO: 2054808 - RNA, 20 nt, Homo sapiens
caaguuggucuagugugcug

SEQ ID NO: 2054809 - RNA, 21 nt, Homo sapiens
uuuucagcacccccacccacc

SEQ ID NO: 2054810 - RNA, 21 nt, Homo sapiens
augacaugcacucagcucuug

SEQ ID NO: 2054811 - RNA, 12 nt, Homo sapiens
uacacccagaaa

SEQ ID NO: 2054812 - RNA, 16 nt, Homo sapiens
aacaauggaguauucu

SEQ ID NO: 2054813 - RNA, 17 nt, Homo sapiens
ugaaaugugguuuuccu

SEQ ID NO: 2054814 - RNA, 15 nt, Homo sapiens
uguaauuuaugcaag

SEQ ID NO: 2054815 - RNA, 17 nt, Homo sapiens
ugaggugacuauucuga

SEQ ID NO: 2054816 - RNA, 18 nt, Homo sapiens
aagcuggugcccuuccuc

SEQ ID NO: 2054817 - RNA, 18 nt, Homo sapiens
uccuucaagccuagcccu

SEQ ID NO: 2054818 - RNA, 16 nt, Homo sapiens
ucaacccugugaucua

SEQ ID NO: 2054819 - RNA, 18 nt, Homo sapiens
gggaaaauaccccaucau

SEQ ID NO: 2054820 - RNA, 16 nt, Homo sapiens
aaguugagacuucuga

SEQ ID NO: 2054821 - RNA, 16 nt, Homo sapiens
gcguaguccgcuuucu

SEQ ID NO: 2054822 - RNA, 20 nt, Homo sapiens
ugggaguucagcugcuucuc

SEQ ID NO: 2054823 - RNA, 21 nt, Homo sapiens
uaauaucugagaaguguauau

SEQ ID NO: 2054824 - RNA, 23 nt, Homo sapiens
cuuugcucuuggaauuacugaaa

SEQ ID NO: 2054825 - RNA, 11 nt, Homo sapiens
aaaugugcaca

SEQ ID NO: 2054826 - RNA, 18 nt, Homo sapiens
auucagagcuauggugcu

SEQ ID NO: 2054827 - RNA, 15 nt, Homo sapiens
augcaauuacugcug

SEQ ID NO: 2054828 - RNA, 13 nt, Homo sapiens
gcauucaaauggg

SEQ ID NO: 2054829 - RNA, 14 nt, Homo sapiens
cuaaaauuaaguau

SEQ ID NO: 2054830 - RNA, 14 nt, Homo sapiens
aagauuuucuauua

SEQ ID NO: 2054831 - RNA, 17 nt, Homo sapiens
ucaguaacagugcagua

SEQ ID NO: 2054832 - RNA, 14 nt, Homo sapiens
ucaggauccaguga

SEQ ID NO: 2054833 - RNA, 15 nt, Homo sapiens
accgaaaugcuuaaa

SEQ ID NO: 2054834 - RNA, 17 nt, Homo sapiens
ugcagacaccugccuua

SEQ ID NO: 2054835 - RNA, 22 nt, Homo sapiens
uuaagugcacaccgugugccau

SEQ ID NO: 2054836 - RNA, 23 nt, Homo sapiens
uuucaucuucaguugucucugau

SEQ ID NO: 2054837 - RNA, 19 nt, Homo sapiens
uggucagguuauacuccuc

SEQ ID NO: 2054838 - RNA, 14 nt, Homo sapiens
gacucccuccccac

SEQ ID NO: 2054839 - RNA, 10 nt, Homo sapiens
agcucaccag

SEQ ID NO: 2054840 - RNA, 14 nt, Homo sapiens
uaacaucaacaaca

SEQ ID NO: 2054841 - RNA, 14 nt, Homo sapiens
agggcaugcuuuau

SEQ ID NO: 2054842 - RNA, 15 nt, Homo sapiens
acguguaaacaggau

SEQ ID NO: 2054843 - RNA, 17 nt, Homo sapiens
aauaugugaaagacaau

SEQ ID NO: 2054844 - RNA, 22 nt, Homo sapiens
aguccaaaggguuuuaagccag

SEQ ID NO: 2054845 - RNA, 13 nt, Homo sapiens
agggguguuccaa

SEQ ID NO: 2054846 - RNA, 15 nt, Homo sapiens
ccaugguagacugug

SEQ ID NO: 2054847 - RNA, 18 nt, Homo sapiens
agcuguggaggauugcua

SEQ ID NO: 2054848 - RNA, 13 nt, Homo sapiens
caggugaccuccc

SEQ ID NO: 2054849 - RNA, 18 nt, Homo sapiens
aucuaaccuguuccauuc

SEQ ID NO: 2054850 - RNA, 14 nt, Homo sapiens
cccugaacuggccc

SEQ ID NO: 2054851 - RNA, 22 nt, Homo sapiens
ugccuucagaggauaaauauca

SEQ ID NO: 2054852 - RNA, 16 nt, Homo sapiens
gaugccagggacccac

SEQ ID NO: 2054853 - RNA, 15 nt, Homo sapiens
ccccaguucugcucc

SEQ ID NO: 2054854 - RNA, 19 nt, Homo sapiens
uccaccccauccaauuuau

SEQ ID NO: 2054855 - RNA, 13 nt, Homo sapiens
aaucaaaugauuc

SEQ ID NO: 2054856 - RNA, 21 nt, Homo sapiens
ugagguuucuuugacuucaau

SEQ ID NO: 2054857 - RNA, 20 nt, Homo sapiens
auuaggaaucauucuguaaa

SEQ ID NO: 2054858 - RNA, 14 nt, Homo sapiens
agugaccauuauuc

SEQ ID NO: 2054859 - RNA, 21 nt, Homo sapiens
cucuggucuaccugagaucua

SEQ ID NO: 2054860 - RNA, 15 nt, Homo sapiens
acaugguaugaaggu

SEQ ID NO: 2054861 - RNA, 23 nt, Homo sapiens
uuacuucucuauaaaaaauaugu

SEQ ID NO: 2054862 - RNA, 24 nt, Homo sapiens
agcaagucucuuuauauggccuca

SEQ ID NO: 2054863 - RNA, 21 nt, Homo sapiens
acacagaggggagucaccagc

SEQ ID NO: 2054864 - RNA, 16 nt, Homo sapiens
accaccaccugcucac

SEQ ID NO: 2054865 - RNA, 15 nt, Homo sapiens
uuuguaaaaugcacc

SEQ ID NO: 2054866 - RNA, 15 nt, Homo sapiens
gauaacugagaauuu

SEQ ID NO: 2054867 - RNA, 15 nt, Homo sapiens
agauauggcacuucu

SEQ ID NO: 2054868 - RNA, 18 nt, Homo sapiens
aagcaacuugcuucuaaa

SEQ ID NO: 2054869 - RNA, 14 nt, Homo sapiens
cgucuucucuccau

SEQ ID NO: 2054870 - RNA, 17 nt, Homo sapiens
uaucugguuauaucauu

SEQ ID NO: 2054871 - RNA, 14 nt, Homo sapiens
accccuaccucuag

SEQ ID NO: 2054872 - RNA, 15 nt, Homo sapiens
ccaggagcccggcuu

SEQ ID NO: 2054873 - RNA, 15 nt, Homo sapiens
auaagugcaugacau

SEQ ID NO: 2054874 - RNA, 18 nt, Homo sapiens
aacgccgcugacugccac

SEQ ID NO: 2054875 - RNA, 12 nt, Homo sapiens
auaaaaugauaa

SEQ ID NO: 2054876 - RNA, 12 nt, Homo sapiens
ccaaaaugccaa

SEQ ID NO: 2054877 - RNA, 16 nt, Homo sapiens
uguuuguacugugcag

SEQ ID NO: 2054878 - RNA, 16 nt, Homo sapiens
uguucugaaggucugg

SEQ ID NO: 2054879 - RNA, 13 nt, Homo sapiens
acuucccauuuac

SEQ ID NO: 2054880 - RNA, 13 nt, Homo sapiens
uauguucaugagu

SEQ ID NO: 2054881 - RNA, 17 nt, Homo sapiens
gaacacaagaagaccca

SEQ ID NO: 2054882 - RNA, 15 nt, Homo sapiens
caccuggggauuuua

SEQ ID NO: 2054883 - RNA, 16 nt, Homo sapiens
gugccaggccaaagau

SEQ ID NO: 2054884 - RNA, 16 nt, Homo sapiens
ucgcacacacagugau

SEQ ID NO: 2054885 - RNA, 17 nt, Homo sapiens
accagccuugcucucuu

SEQ ID NO: 2054886 - RNA, 13 nt, Homo sapiens
caagccugaucca

SEQ ID NO: 2054887 - RNA, 17 nt, Homo sapiens
aagacuauauuguacac

SEQ ID NO: 2054888 - RNA, 20 nt, Homo sapiens
augcagcaaggggacaucuu

SEQ ID NO: 2054889 - RNA, 15 nt, Homo sapiens
gagcuuaaucuuuga

SEQ ID NO: 2054890 - RNA, 16 nt, Homo sapiens
gauaaagcaguauuug

SEQ ID NO: 2054891 - RNA, 13 nt, Homo sapiens
ccaacuaacaguc

SEQ ID NO: 2054892 - RNA, 20 nt, Homo sapiens
cugcagagcagcagcaccuu

SEQ ID NO: 2054893 - RNA, 17 nt, Homo sapiens
ucuugauaccugggaua

SEQ ID NO: 2054894 - RNA, 12 nt, Homo sapiens
uggaggccugug

SEQ ID NO: 2054895 - RNA, 13 nt, Homo sapiens
agugugugcucag

SEQ ID NO: 2054896 - RNA, 11 nt, Homo sapiens
ccugguggugg

SEQ ID NO: 2054897 - RNA, 18 nt, Homo sapiens
acccugcugcugcuccuc

SEQ ID NO: 2054898 - RNA, 15 nt, Homo sapiens
ccuuugcauguuugu

SEQ ID NO: 2054899 - RNA, 15 nt, Homo sapiens
ccuuaauauguuaac

SEQ ID NO: 2054900 - RNA, 19 nt, Homo sapiens
guucuaagcccccacacag

SEQ ID NO: 2054901 - RNA, 19 nt, Homo sapiens
agcagcaccuccuccaugc

SEQ ID NO: 2054902 - RNA, 18 nt, Homo sapiens
uuaacuuuuaagguugaa

SEQ ID NO: 2054903 - RNA, 15 nt, Homo sapiens
agauucugugaucuu

SEQ ID NO: 2054904 - RNA, 15 nt, Homo sapiens
aucuuuuguucuccu

SEQ ID NO: 2054905 - RNA, 15 nt, Homo sapiens
agcuccagugcuuua

SEQ ID NO: 2054906 - RNA, 14 nt, Homo sapiens
ugaaucaagcaaua

SEQ ID NO: 2054907 - RNA, 18 nt, Homo sapiens
auguuggcugggaacuca

SEQ ID NO: 2054908 - RNA, 13 nt, Homo sapiens
agaaggcugucuu

SEQ ID NO: 2054909 - RNA, 13 nt, Homo sapiens
aagugcuauuuca

SEQ ID NO: 2054910 - RNA, 15 nt, Homo sapiens
aggcugcaugcucug

SEQ ID NO: 2054911 - RNA, 13 nt, Homo sapiens
cugcuuguguuaa

SEQ ID NO: 2054912 - RNA, 12 nt, Homo sapiens
gauggcugugaa

SEQ ID NO: 2054913 - RNA, 20 nt, Homo sapiens
ccucacuggugcauuuaaaa

SEQ ID NO: 2054914 - RNA, 12 nt, Homo sapiens
ugaaacaugaac

SEQ ID NO: 2054915 - RNA, 23 nt, Homo sapiens
ucuaggcccugugagcacaaaga

SEQ ID NO: 2054916 - RNA, 20 nt, Homo sapiens
cacaaacagaaaacauguaa

SEQ ID NO: 2054917 - RNA, 23 nt, Homo sapiens
uacauuuucuuguggagcaauag

SEQ ID NO: 2054918 - RNA, 20 nt, Homo sapiens
acagcacuaacacaugcaca

SEQ ID NO: 2054919 - RNA, 19 nt, Homo sapiens
uucaacagccaagcuggca

SEQ ID NO: 2054920 - RNA, 19 nt, Homo sapiens
agccagacuguccagggaa

SEQ ID NO: 2054921 - RNA, 23 nt, Homo sapiens
agcaagucuuaguacauccucac

SEQ ID NO: 2054922 - RNA, 12 nt, Homo sapiens
aagcagcacugu

SEQ ID NO: 2054923 - RNA, 13 nt, Homo sapiens
gcccgggacaggg

SEQ ID NO: 2054924 - RNA, 17 nt, Homo sapiens
gacuaaccccaccacac

SEQ ID NO: 2054925 - RNA, 17 nt, Homo sapiens
uaaauccauccauccaa

SEQ ID NO: 2054926 - RNA, 19 nt, Homo sapiens
caauucugauuccaaauaa

SEQ ID NO: 2054927 - RNA, 17 nt, Homo sapiens
aauauaguuauugcaca

SEQ ID NO: 2054928 - RNA, 13 nt, Homo sapiens
aggggcacagggu

SEQ ID NO: 2054929 - RNA, 15 nt, Homo sapiens
gcaggcugggccaug

SEQ ID NO: 2054930 - RNA, 16 nt, Homo sapiens
ugaaaaccucuccuca

SEQ ID NO: 2054931 - RNA, 16 nt, Homo sapiens
cuugauagaaaugcca

SEQ ID NO: 2054932 - RNA, 18 nt, Homo sapiens
agcaauuucucuuuaaaa

SEQ ID NO: 2054933 - RNA, 18 nt, Homo sapiens
gaaagcuggacugaccaa

SEQ ID NO: 2054934 - RNA, 15 nt, Homo sapiens
uguuucuuugaucau

SEQ ID NO: 2054935 - RNA, 17 nt, Homo sapiens
cagcucaccaacuacag

SEQ ID NO: 2054936 - RNA, 23 nt, Homo sapiens
ccaagccauguuccccaguucag

SEQ ID NO: 2054937 - RNA, 17 nt, Homo sapiens
aggcaaaggcuuguaaa

SEQ ID NO: 2054938 - RNA, 22 nt, Homo sapiens
cacagguuuaguugacuaauga

SEQ ID NO: 2054939 - RNA, 19 nt, Homo sapiens
acaacccaccccgcuuucg

SEQ ID NO: 2054940 - RNA, 16 nt, Homo sapiens
gaaaguugcuuuuauu

SEQ ID NO: 2054941 - RNA, 17 nt, Homo sapiens
aaacuaucuguauuuau

SEQ ID NO: 2054942 - RNA, 15 nt, Homo sapiens
cagcugcuacaagaa

SEQ ID NO: 2054943 - RNA, 22 nt, Homo sapiens
aauacaaucagcccagugcaaa

SEQ ID NO: 2054944 - RNA, 17 nt, Homo sapiens
agaaacuuugccucaag

SEQ ID NO: 2054945 - RNA, 23 nt, Homo sapiens
cagauaaaggaaggagauacuca

SEQ ID NO: 2054946 - RNA, 21 nt, Homo sapiens
cugcgugcacuucccagagca

SEQ ID NO: 2054947 - RNA, 20 nt, Homo sapiens
aaaaauuagcaugcugcuuu

SEQ ID NO: 2054948 - RNA, 22 nt, Homo sapiens
uguuuccuuuaauuuuuuacua

SEQ ID NO: 2054949 - RNA, 22 nt, Homo sapiens
aucauguuuuuucugcaaugac

SEQ ID NO: 2054950 - RNA, 15 nt, Homo sapiens
ugcccccuccacugg

SEQ ID NO: 2054951 - RNA, 15 nt, Homo sapiens
caaagcaacuggaua

SEQ ID NO: 2054952 - RNA, 18 nt, Homo sapiens
ucaugcaaacugcuuuau

SEQ ID NO: 2054953 - RNA, 13 nt, Homo sapiens
acuucucuuccuu

SEQ ID NO: 2054954 - RNA, 14 nt, Homo sapiens
uauuauaaagccaa

SEQ ID NO: 2054955 - RNA, 23 nt, Homo sapiens
gucacuagagaaauaaaauaugg

SEQ ID NO: 2054956 - RNA, 18 nt, Homo sapiens
uuucaccauguugcccag

SEQ ID NO: 2054957 - RNA, 23 nt, Homo sapiens
ccaucugggcuccuccagggugu

SEQ ID NO: 2054958 - RNA, 20 nt, Homo sapiens
aauguaauguuuuagugccu

SEQ ID NO: 2054959 - RNA, 19 nt, Homo sapiens
ggcaggaccagguggcacu

SEQ ID NO: 2054960 - RNA, 16 nt, Homo sapiens
cuuugaaagcuguaua

SEQ ID NO: 2054961 - RNA, 13 nt, Homo sapiens
gcugcuccagugc

SEQ ID NO: 2054962 - RNA, 19 nt, Homo sapiens
ucucaguuaugaguauaau

SEQ ID NO: 2054963 - RNA, 18 nt, Homo sapiens
aaaugugacucagcauca

SEQ ID NO: 2054964 - RNA, 22 nt, Homo sapiens
aaaaacaaacaaacaaacuguu

SEQ ID NO: 2054965 - RNA, 14 nt, Homo sapiens
aggcgaugugcaag

SEQ ID NO: 2054966 - RNA, 18 nt, Homo sapiens
agcagguggaauguguau

SEQ ID NO: 2054967 - RNA, 15 nt, Homo sapiens
guugcauuuuggcaa

SEQ ID NO: 2054968 - RNA, 21 nt, Homo sapiens
aaccucaguuauuacauguaa

SEQ ID NO: 2054969 - RNA, 20 nt, Homo sapiens
caccuuccaaagagugcuaa

SEQ ID NO: 2054970 - RNA, 12 nt, Homo sapiens
uguacuauccag

SEQ ID NO: 2054971 - RNA, 18 nt, Homo sapiens
acaaccuuuucucuggac

SEQ ID NO: 2054972 - RNA, 15 nt, Homo sapiens
ugcagaacugccauu

SEQ ID NO: 2054973 - RNA, 16 nt, Homo sapiens
aaacagggcaucucca

SEQ ID NO: 2054974 - RNA, 12 nt, Homo sapiens
cuaaaguucuaa

SEQ ID NO: 2054975 - RNA, 15 nt, Homo sapiens
aaagaaauugugaaa

SEQ ID NO: 2054976 - RNA, 19 nt, Homo sapiens
ugcaagugugugcaugugu

SEQ ID NO: 2054977 - RNA, 21 nt, Homo sapiens
ugauuauucuuguucagggag

SEQ ID NO: 2054978 - RNA, 14 nt, Homo sapiens
ucucccugccaagu

SEQ ID NO: 2054979 - RNA, 15 nt, Homo sapiens
agcugcacagcaaaa

SEQ ID NO: 2054980 - RNA, 15 nt, Homo sapiens
guuuuaaucuccucu

SEQ ID NO: 2054981 - RNA, 21 nt, Homo sapiens
aaacuuaucucugauauacaa

SEQ ID NO: 2054982 - RNA, 15 nt, Homo sapiens
uggcuauaaauauau

SEQ ID NO: 2054983 - RNA, 19 nt, Homo sapiens
ccauggguuccuacgccuu

SEQ ID NO: 2054984 - RNA, 13 nt, Homo sapiens
ucaaagacagaga

SEQ ID NO: 2054985 - RNA, 20 nt, Homo sapiens
cagggaagccccacuugaag

SEQ ID NO: 2054986 - RNA, 18 nt, Homo sapiens
auuuauacaccagcaauu

SEQ ID NO: 2054987 - RNA, 14 nt, Homo sapiens
aacuacaaugaugg

SEQ ID NO: 2054988 - RNA, 14 nt, Homo sapiens
aguggcucaaugca

SEQ ID NO: 2054989 - RNA, 19 nt, Homo sapiens
gaccugcucuuaaccucaa

SEQ ID NO: 2054990 - RNA, 18 nt, Homo sapiens
ugaaaugccacugggaca

SEQ ID NO: 2054991 - RNA, 19 nt, Homo sapiens
uuuccuucuaacacuugua

SEQ ID NO: 2054992 - RNA, 17 nt, Homo sapiens
gccgugccugagcugca

SEQ ID NO: 2054993 - RNA, 20 nt, Homo sapiens
uuugcccccgacggcuguga

SEQ ID NO: 2054994 - RNA, 16 nt, Homo sapiens
gccaucaaacuguaaa

SEQ ID NO: 2054995 - RNA, 13 nt, Homo sapiens
aauauuagccagu

SEQ ID NO: 2054996 - RNA, 14 nt, Homo sapiens
auuauauuucuaca

SEQ ID NO: 2054997 - RNA, 20 nt, Homo sapiens
cuuuggagcagcuucuggga

SEQ ID NO: 2054998 - RNA, 14 nt, Homo sapiens
cuugccuaagacuu

SEQ ID NO: 2054999 - RNA, 20 nt, Homo sapiens
ccugugugugucuagguaga

SEQ ID NO: 2055000 - RNA, 18 nt, Homo sapiens
cugcuggugucuaguguu

SEQ ID NO: 2055001 - RNA, 20 nt, Homo sapiens
ucaacagugagagacuccau

SEQ ID NO: 2055002 - RNA, 17 nt, Homo sapiens
ccaacagcgaagccagu

SEQ ID NO: 2055003 - RNA, 22 nt, Homo sapiens
ugcaccuuaucuuaaagcacuu

SEQ ID NO: 2055004 - RNA, 18 nt, Homo sapiens
guaagugugaauugcugc

SEQ ID NO: 2055005 - RNA, 14 nt, Homo sapiens
ccgaugauucuuaa

SEQ ID NO: 2055006 - RNA, 19 nt, Homo sapiens
gucugcagaagcauuugaa

SEQ ID NO: 2055007 - RNA, 22 nt, Homo sapiens
guuuucuccuugauaucauuca

SEQ ID NO: 2055008 - RNA, 12 nt, Homo sapiens
cucaacuaccuc

SEQ ID NO: 2055009 - RNA, 17 nt, Homo sapiens
gcagcauuccaugacca

SEQ ID NO: 2055010 - RNA, 20 nt, Homo sapiens
cucaucagucuccauacccc

SEQ ID NO: 2055011 - RNA, 15 nt, Homo sapiens
cuaacuugaaaagaa

SEQ ID NO: 2055012 - RNA, 21 nt, Homo sapiens
aauaacuuuucuaaagccuua

SEQ ID NO: 2055013 - RNA, 11 nt, Homo sapiens
gaccucaggug

SEQ ID NO: 2055014 - RNA, 15 nt, Homo sapiens
gauguagcuuuucac

SEQ ID NO: 2055015 - RNA, 21 nt, Homo sapiens
ccagcccauggcccccaauaa

SEQ ID NO: 2055016 - RNA, 12 nt, Homo sapiens
aaacaacagcuc

SEQ ID NO: 2055017 - RNA, 22 nt, Homo sapiens
aauauccuguaauaaagcucuu

SEQ ID NO: 2055018 - RNA, 19 nt, Homo sapiens
ucuccaggggugccccaga

SEQ ID NO: 2055019 - RNA, 15 nt, Homo sapiens
cauugccugcagauu

SEQ ID NO: 2055020 - RNA, 14 nt, Homo sapiens
ugggaaguguacag

SEQ ID NO: 2055021 - RNA, 19 nt, Homo sapiens
ugguaccuuucuagccuua

SEQ ID NO: 2055022 - RNA, 23 nt, Homo sapiens
gaauguaugcuucauacagggau

SEQ ID NO: 2055023 - RNA, 20 nt, Homo sapiens
ggccucccacccgaugcugc

SEQ ID NO: 2055024 - RNA, 15 nt, Homo sapiens
uaaaaggacugugau

SEQ ID NO: 2055025 - RNA, 16 nt, Homo sapiens
aaaacuaaugugucuc

SEQ ID NO: 2055026 - RNA, 21 nt, Homo sapiens
agugggcaucagcagcagggu

SEQ ID NO: 2055027 - RNA, 17 nt, Homo sapiens
accuccagcucucaguu

SEQ ID NO: 2055028 - RNA, 10 nt, Homo sapiens
ugacugggaa

SEQ ID NO: 2055029 - RNA, 16 nt, Homo sapiens
uucgaaaccugugauu

SEQ ID NO: 2055030 - RNA, 16 nt, Homo sapiens
uuuaagaacaauguug

SEQ ID NO: 2055031 - RNA, 18 nt, Homo sapiens
aggugaggcucuucacau

SEQ ID NO: 2055032 - RNA, 19 nt, Homo sapiens
uuaaaaaaaacaauuccac

SEQ ID NO: 2055033 - RNA, 22 nt, Homo sapiens
uuaagaagcauuugggaaagaa

SEQ ID NO: 2055034 - RNA, 15 nt, Homo sapiens
acugcugaguucugg

SEQ ID NO: 2055035 - RNA, 20 nt, Homo sapiens
agggaagcagagccuggggu

SEQ ID NO: 2055036 - RNA, 22 nt, Homo sapiens
augucacgaauauggacauauc

SEQ ID NO: 2055037 - RNA, 15 nt, Homo sapiens
acuggccacccaagg

SEQ ID NO: 2055038 - RNA, 19 nt, Homo sapiens
caggcucagacucuggguc

SEQ ID NO: 2055039 - RNA, 15 nt, Homo sapiens
uagcagcacacacuu

SEQ ID NO: 2055040 - RNA, 17 nt, Homo sapiens
aaaacuugugcuauaaa

SEQ ID NO: 2055041 - RNA, 24 nt, Homo sapiens
cugaauucucugcucagugauuaa

SEQ ID NO: 2055042 - RNA, 17 nt, Homo sapiens
aagaguuagaacaguug

SEQ ID NO: 2055043 - RNA, 15 nt, Homo sapiens
acccucacaucagag

SEQ ID NO: 2055044 - RNA, 13 nt, Homo sapiens
gacccaugcaaua

SEQ ID NO: 2055045 - RNA, 17 nt, Homo sapiens
uucacacuuccaccagc

SEQ ID NO: 2055046 - RNA, 16 nt, Homo sapiens
uauccaggaauugaua

SEQ ID NO: 2055047 - RNA, 15 nt, Homo sapiens
aaaaugaaagccaaa

SEQ ID NO: 2055048 - RNA, 13 nt, Homo sapiens
ggugcucagucuc

SEQ ID NO: 2055049 - RNA, 17 nt, Homo sapiens
cugcugaccagcacuga

SEQ ID NO: 2055050 - RNA, 13 nt, Homo sapiens
aguuaaaguauau

SEQ ID NO: 2055051 - RNA, 17 nt, Homo sapiens
uuaaagcuuggugcuaa

SEQ ID NO: 2055052 - RNA, 14 nt, Homo sapiens
cucggggugggggu

SEQ ID NO: 2055053 - RNA, 17 nt, Homo sapiens
aaucagaacuaaccagu

SEQ ID NO: 2055054 - RNA, 11 nt, Homo sapiens
uauugccuugg

SEQ ID NO: 2055055 - RNA, 21 nt, Homo sapiens
caaagcacuugcuuacauccu

SEQ ID NO: 2055056 - RNA, 16 nt, Homo sapiens
aauacaaaaggcauuu

SEQ ID NO: 2055057 - RNA, 17 nt, Homo sapiens
uccaucagaaaaccaaa

SEQ ID NO: 2055058 - RNA, 16 nt, Homo sapiens
ucaaucuuuuaccuuu

SEQ ID NO: 2055059 - RNA, 18 nt, Homo sapiens
ggucuccaccccaggguc

SEQ ID NO: 2055060 - RNA, 17 nt, Homo sapiens
agucacccaaacacuuc

SEQ ID NO: 2055061 - RNA, 20 nt, Homo sapiens
uacugcccuuucaaagcacu

SEQ ID NO: 2055062 - RNA, 16 nt, Homo sapiens
uguacaacuuaacuca

SEQ ID NO: 2055063 - RNA, 15 nt, Homo sapiens
uauaaggcauuccac

SEQ ID NO: 2055064 - RNA, 18 nt, Homo sapiens
ccuuugcagaaugaugca

SEQ ID NO: 2055065 - RNA, 18 nt, Homo sapiens
gcacuagaucucccuuaa

SEQ ID NO: 2055066 - RNA, 22 nt, Homo sapiens
uagguuugucaacacaaagaca

SEQ ID NO: 2055067 - RNA, 14 nt, Homo sapiens
uacacuuugcuagu

SEQ ID NO: 2055068 - RNA, 20 nt, Homo sapiens
cauccauagacacaguauug

SEQ ID NO: 2055069 - RNA, 22 nt, Homo sapiens
uuaaaucaaucaggaaugaguc

SEQ ID NO: 2055070 - RNA, 23 nt, Homo sapiens
uuguuggguggcagcugcuccuu

SEQ ID NO: 2055071 - RNA, 14 nt, Homo sapiens
ucacucauccaucc

SEQ ID NO: 2055072 - RNA, 14 nt, Homo sapiens
agugccuucucuau

SEQ ID NO: 2055073 - RNA, 13 nt, Homo sapiens
caagaucuuucag

SEQ ID NO: 2055074 - RNA, 22 nt, Homo sapiens
cagggcagcggucuucuccauc

SEQ ID NO: 2055075 - RNA, 21 nt, Homo sapiens
ccaggaggggcuguccaauca

SEQ ID NO: 2055076 - RNA, 16 nt, Homo sapiens
ggcgcccugcaccuga

SEQ ID NO: 2055077 - RNA, 21 nt, Homo sapiens
uacuguaggcacacuuugcac

SEQ ID NO: 2055078 - RNA, 22 nt, Homo sapiens
uccccaauuaucuuauuuaauu

SEQ ID NO: 2055079 - RNA, 22 nt, Homo sapiens
cagucaguuugcacaacaagau

SEQ ID NO: 2055080 - RNA, 14 nt, Homo sapiens
uugagcuacaguag

SEQ ID NO: 2055081 - RNA, 14 nt, Homo sapiens
cuaaacugagacaa

SEQ ID NO: 2055082 - RNA, 14 nt, Homo sapiens
caauuuauucugau

SEQ ID NO: 2055083 - RNA, 18 nt, Homo sapiens
aauucuaaagagcacuua

SEQ ID NO: 2055084 - RNA, 13 nt, Homo sapiens
gccaaaaugcucu

SEQ ID NO: 2055085 - RNA, 19 nt, Homo sapiens
cgacuuguuuuugcacaug

SEQ ID NO: 2055086 - RNA, 21 nt, Homo sapiens
gagagagcuagagggacaaag

SEQ ID NO: 2055087 - RNA, 21 nt, Homo sapiens
ugagaauaauucuuuccaugc

SEQ ID NO: 2055088 - RNA, 19 nt, Homo sapiens
gccuaggugggagccacca

SEQ ID NO: 2055089 - RNA, 16 nt, Homo sapiens
acaaaggaaguucucc

SEQ ID NO: 2055090 - RNA, 20 nt, Homo sapiens
agggacacccacacaggugg

SEQ ID NO: 2055091 - RNA, 23 nt, Homo sapiens
auuacaggcgugagccacugcgc

SEQ ID NO: 2055092 - RNA, 17 nt, Homo sapiens
augcaugauacuaucug

SEQ ID NO: 2055093 - RNA, 19 nt, Homo sapiens
cgcaggaagacccaacaca

SEQ ID NO: 2055094 - RNA, 18 nt, Homo sapiens
ucacagguagacaguaua

SEQ ID NO: 2055095 - RNA, 12 nt, Homo sapiens
ucccacuggaac

SEQ ID NO: 2055096 - RNA, 22 nt, Homo sapiens
caacccugagguaucuguguua

SEQ ID NO: 2055097 - RNA, 23 nt, Homo sapiens
uucucaucaguaguucacauaca

SEQ ID NO: 2055098 - RNA, 19 nt, Homo sapiens
ucaauaaaguuguugcauu

SEQ ID NO: 2055099 - RNA, 23 nt, Homo sapiens
uuacagagaggagaaacacaucu

SEQ ID NO: 2055100 - RNA, 23 nt, Homo sapiens
ugggauuacaggugugagccacc

SEQ ID NO: 2055101 - RNA, 12 nt, Homo sapiens
aguguuauugca

SEQ ID NO: 2055102 - RNA, 22 nt, Homo sapiens
ccagcuccauccuugcaucacu

SEQ ID NO: 2055103 - RNA, 17 nt, Homo sapiens
acugggaagaugcuggc

SEQ ID NO: 2055104 - RNA, 20 nt, Homo sapiens
gauuuuacaugaaguauuuu

SEQ ID NO: 2055105 - RNA, 19 nt, Homo sapiens
ucuuuucauaucucuugcc

SEQ ID NO: 2055106 - RNA, 17 nt, Homo sapiens
uucucuugacagucuga

SEQ ID NO: 2055107 - RNA, 21 nt, Homo sapiens
ugcccauggaagucucaaaga

SEQ ID NO: 2055108 - RNA, 17 nt, Homo sapiens
uaaauguguggugcuaa

SEQ ID NO: 2055109 - RNA, 22 nt, Homo sapiens
aacaccuguggauaaaacauua

SEQ ID NO: 2055110 - RNA, 19 nt, Homo sapiens
auguguucucugaucugcc

SEQ ID NO: 2055111 - RNA, 12 nt, Homo sapiens
agaaaacacugu

SEQ ID NO: 2055112 - RNA, 23 nt, Homo sapiens
gccgggccuagaccuggugcuga

SEQ ID NO: 2055113 - RNA, 15 nt, Homo sapiens
uagggaguaccugcu

SEQ ID NO: 2055114 - RNA, 22 nt, Homo sapiens
aaagaauuggccaggcauggug

SEQ ID NO: 2055115 - RNA, 15 nt, Homo sapiens
gaaccaaccagggaa

SEQ ID NO: 2055116 - RNA, 19 nt, Homo sapiens
caagaaagucaaugucaau

SEQ ID NO: 2055117 - RNA, 15 nt, Homo sapiens
aauaauauacaugca

SEQ ID NO: 2055118 - RNA, 20 nt, Homo sapiens
uggcuuuucugauccaguuu

SEQ ID NO: 2055119 - RNA, 15 nt, Homo sapiens
agugguaacagcucu

SEQ ID NO: 2055120 - RNA, 15 nt, Homo sapiens
cagacugccaaagaa

SEQ ID NO: 2055121 - RNA, 21 nt, Homo sapiens
auggaaggaagaaaagcugcc

SEQ ID NO: 2055122 - RNA, 20 nt, Homo sapiens
gccauaauuacuaugucauu

SEQ ID NO: 2055123 - RNA, 15 nt, Homo sapiens
auucccuugaucuca

SEQ ID NO: 2055124 - RNA, 15 nt, Homo sapiens
aaaguaauguagcau

SEQ ID NO: 2055125 - RNA, 18 nt, Homo sapiens
cugggaaacugaaacuca

SEQ ID NO: 2055126 - RNA, 18 nt, Homo sapiens
aagagugauauacuccag

SEQ ID NO: 2055127 - RNA, 17 nt, Homo sapiens
uuuggaauugucuugau

SEQ ID NO: 2055128 - RNA, 21 nt, Homo sapiens
aaugguuuauagcccugugaa

SEQ ID NO: 2055129 - RNA, 20 nt, Homo sapiens
ccaugacugaggcaggcaug

SEQ ID NO: 2055130 - RNA, 18 nt, Homo sapiens
cauguaaaaagugcagua

SEQ ID NO: 2055131 - RNA, 20 nt, Homo sapiens
aagccuuuugcaaauaguag

SEQ ID NO: 2055132 - RNA, 16 nt, Homo sapiens
gagcugcucaccggag

SEQ ID NO: 2055133 - RNA, 14 nt, Homo sapiens
ccaucacugagcau

SEQ ID NO: 2055134 - RNA, 23 nt, Homo sapiens
uucuguuccauauggguaguuau

SEQ ID NO: 2055135 - RNA, 23 nt, Homo sapiens
acaagggagaagagugucagaau

SEQ ID NO: 2055136 - RNA, 18 nt, Homo sapiens
agcaagacucugucucaa

SEQ ID NO: 2055137 - RNA, 18 nt, Homo sapiens
agugagacuccaucucaa

SEQ ID NO: 2055138 - RNA, 23 nt, Homo sapiens
acucucacaagauggaaaucaca

SEQ ID NO: 2055139 - RNA, 23 nt, Homo sapiens
aauuaagugaaaggucacacuac

SEQ ID NO: 2055140 - RNA, 12 nt, Homo sapiens
uuuuaagccagg

SEQ ID NO: 2055141 - RNA, 16 nt, Homo sapiens
gcacaaucuacacugc

SEQ ID NO: 2055142 - RNA, 15 nt, Homo sapiens
gcgagaugagcccac

SEQ ID NO: 2055143 - RNA, 13 nt, Homo sapiens
cuucugcacacaa

SEQ ID NO: 2055144 - RNA, 20 nt, Homo sapiens
agaagugccaucucaauugu

SEQ ID NO: 2055145 - RNA, 14 nt, Homo sapiens
cacauucuacuuca

SEQ ID NO: 2055146 - RNA, 13 nt, Homo sapiens
uucgaaaggccuu

SEQ ID NO: 2055147 - RNA, 16 nt, Homo sapiens
uaauuuuuaacuuauu

SEQ ID NO: 2055148 - RNA, 15 nt, Homo sapiens
auccaagacagccac

SEQ ID NO: 2055149 - RNA, 16 nt, Homo sapiens
gcagcaucucuggccu

SEQ ID NO: 2055150 - RNA, 21 nt, Homo sapiens
gcaauuguauauauaugugaa

SEQ ID NO: 2055151 - RNA, 16 nt, Homo sapiens
aaaucccaacauuucu

SEQ ID NO: 2055152 - RNA, 18 nt, Homo sapiens
ucugucaaaacacugugg

SEQ ID NO: 2055153 - RNA, 23 nt, Homo sapiens
ccuuauuuugugugcuuucccag

SEQ ID NO: 2055154 - RNA, 19 nt, Homo sapiens
gcagccaccaguggaccua

SEQ ID NO: 2055155 - RNA, 14 nt, Homo sapiens
cagaguuuguauug

SEQ ID NO: 2055156 - RNA, 16 nt, Homo sapiens
gcuaggggacaucaga

SEQ ID NO: 2055157 - RNA, 16 nt, Homo sapiens
ggagacggaaucugcc

SEQ ID NO: 2055158 - RNA, 15 nt, Homo sapiens
gacaacugugacugu

SEQ ID NO: 2055159 - RNA, 17 nt, Homo sapiens
ucaugucucacuucaca

SEQ ID NO: 2055160 - RNA, 13 nt, Homo sapiens
guucauacuuugg

SEQ ID NO: 2055161 - RNA, 19 nt, Homo sapiens
uggggccagcgcugaacag

SEQ ID NO: 2055162 - RNA, 22 nt, Homo sapiens
gauaaaaaaauauguagcaaug

SEQ ID NO: 2055163 - RNA, 20 nt, Homo sapiens
caauguucaggagaguaaaa

SEQ ID NO: 2055164 - RNA, 17 nt, Homo sapiens
ucuuuugcacaaggaaa

SEQ ID NO: 2055165 - RNA, 23 nt, Homo sapiens
aguaacuguaugaagucauagau

SEQ ID NO: 2055166 - RNA, 23 nt, Homo sapiens
cccaaguguugaggggaccaaag

SEQ ID NO: 2055167 - RNA, 13 nt, Homo sapiens
uuagccaaaggau

SEQ ID NO: 2055168 - RNA, 20 nt, Homo sapiens
ucaaauguaaauuuacugag

SEQ ID NO: 2055169 - RNA, 13 nt, Homo sapiens
aaaucucuuccac

SEQ ID NO: 2055170 - RNA, 16 nt, Homo sapiens
ucacucugacaguauu

SEQ ID NO: 2055171 - RNA, 14 nt, Homo sapiens
ugagagucaaagcu

SEQ ID NO: 2055172 - RNA, 13 nt, Homo sapiens
ucacuggaugaaa

SEQ ID NO: 2055173 - RNA, 17 nt, Homo sapiens
acauaaggaaacugggu

SEQ ID NO: 2055174 - RNA, 21 nt, Homo sapiens
gaauaaagcauccaaguauau

SEQ ID NO: 2055175 - RNA, 19 nt, Homo sapiens
ccuauguuucacugugcaa

SEQ ID NO: 2055176 - RNA, 17 nt, Homo sapiens
uuuccaucuguacuuug

SEQ ID NO: 2055177 - RNA, 13 nt, Homo sapiens
acacaaagcacau

SEQ ID NO: 2055178 - RNA, 14 nt, Homo sapiens
acauuguuaugcac

SEQ ID NO: 2055179 - RNA, 20 nt, Homo sapiens
cauuaugaaaaacaucccaa

SEQ ID NO: 2055180 - RNA, 15 nt, Homo sapiens
augauuucacagugu

SEQ ID NO: 2055181 - RNA, 22 nt, Homo sapiens
guuggaacuaugcagugugcuc

SEQ ID NO: 2055182 - RNA, 14 nt, Homo sapiens
gcccccagugccuc

SEQ ID NO: 2055183 - RNA, 12 nt, Homo sapiens
gagagaacugaa

SEQ ID NO: 2055184 - RNA, 15 nt, Homo sapiens
cacagccaggggagc

SEQ ID NO: 2055185 - RNA, 21 nt, Homo sapiens
aacccugcguggggacagggc

SEQ ID NO: 2055186 - RNA, 15 nt, Homo sapiens
ugcugcgcuuaccuu

SEQ ID NO: 2055187 - RNA, 18 nt, Homo sapiens
ugaugggggccaggacac

SEQ ID NO: 2055188 - RNA, 20 nt, Homo sapiens
uguauauaaauacaugcaca

SEQ ID NO: 2055189 - RNA, 12 nt, Homo sapiens
ugugacuuuuau

SEQ ID NO: 2055190 - RNA, 23 nt, Homo sapiens
augucguaguuacucucaggcau

SEQ ID NO: 2055191 - RNA, 14 nt, Homo sapiens
ucuuuaaaggcauc

SEQ ID NO: 2055192 - RNA, 16 nt, Homo sapiens
uaaauaaaccacugug

SEQ ID NO: 2055193 - RNA, 18 nt, Homo sapiens
uguacacuuucugucuca

SEQ ID NO: 2055194 - RNA, 20 nt, Homo sapiens
uaagacucucgcaucuuccc

SEQ ID NO: 2055195 - RNA, 21 nt, Homo sapiens
uuaaaaaaaaaccugagcccc

SEQ ID NO: 2055196 - RNA, 16 nt, Homo sapiens
ugccagcuucagguga

SEQ ID NO: 2055197 - RNA, 17 nt, Homo sapiens
cuuaguuaucaguauuu

SEQ ID NO: 2055198 - RNA, 17 nt, Homo sapiens
uaggcggggcacggugg

SEQ ID NO: 2055199 - RNA, 17 nt, Homo sapiens
uccagccucuccuccau

SEQ ID NO: 2055200 - RNA, 21 nt, Homo sapiens
agugccuuuugguuucaccuu

SEQ ID NO: 2055201 - RNA, 20 nt, Homo sapiens
auugauuuuugauagacuga

SEQ ID NO: 2055202 - RNA, 20 nt, Homo sapiens
cagguaugguggcauauacu

SEQ ID NO: 2055203 - RNA, 16 nt, Homo sapiens
accuugugacccagca

SEQ ID NO: 2055204 - RNA, 19 nt, Homo sapiens
caccacgugccaaggagcu

SEQ ID NO: 2055205 - RNA, 23 nt, Homo sapiens
aacacuugacuauaaaaacugcc

SEQ ID NO: 2055206 - RNA, 20 nt, Homo sapiens
ggucccggggccagcacuuc

SEQ ID NO: 2055207 - RNA, 17 nt, Homo sapiens
aucucaauguacauaga

SEQ ID NO: 2055208 - RNA, 22 nt, Homo sapiens
auaaacacccaugaaucaaaga

SEQ ID NO: 2055209 - RNA, 22 nt, Homo sapiens
cauuaaaauaaaacaagccuua

SEQ ID NO: 2055210 - RNA, 12 nt, Homo sapiens
uuuuugcugcag

SEQ ID NO: 2055211 - RNA, 21 nt, Homo sapiens
uuguuagcauuuucaauguga

SEQ ID NO: 2055212 - RNA, 14 nt, Homo sapiens
uguauaagcacuga

SEQ ID NO: 2055213 - RNA, 13 nt, Homo sapiens
cccugccgugggc

SEQ ID NO: 2055214 - RNA, 19 nt, Homo sapiens
gauguaggguaaggugccu

SEQ ID NO: 2055215 - RNA, 19 nt, Homo sapiens
gggguuagucaagaagcug

SEQ ID NO: 2055216 - RNA, 19 nt, Homo sapiens
aaaguacaaaauugccuau

SEQ ID NO: 2055217 - RNA, 18 nt, Homo sapiens
ccacuagacaaguccagc

SEQ ID NO: 2055218 - RNA, 14 nt, Homo sapiens
acggcccugcaaug

SEQ ID NO: 2055219 - RNA, 19 nt, Homo sapiens
aagaauaaaguaccuugac

SEQ ID NO: 2055220 - RNA, 20 nt, Homo sapiens
cucuagcuuaaguguaaaug

SEQ ID NO: 2055221 - RNA, 15 nt, Homo sapiens
ggaaauaucugugaa

SEQ ID NO: 2055222 - RNA, 19 nt, Homo sapiens
uauggcucacacagcuuaa

SEQ ID NO: 2055223 - RNA, 15 nt, Homo sapiens
ccacaacaacaaaag

SEQ ID NO: 2055224 - RNA, 12 nt, Homo sapiens
aagcagcccuuc

SEQ ID NO: 2055225 - RNA, 21 nt, Homo sapiens
ugucaucuuccuggaagcaga

SEQ ID NO: 2055226 - RNA, 22 nt, Homo sapiens
auuuuuauuuuuggcaaagcca

SEQ ID NO: 2055227 - RNA, 16 nt, Homo sapiens
cagcagccucccugaa

SEQ ID NO: 2055228 - RNA, 16 nt, Homo sapiens
caauuagccaggugug

SEQ ID NO: 2055229 - RNA, 21 nt, Homo sapiens
ucagcagcaaaaccaaacugg

SEQ ID NO: 2055230 - RNA, 15 nt, Homo sapiens
gcacuagaagcacag

SEQ ID NO: 2055231 - RNA, 14 nt, Homo sapiens
aauccuaagcaaaa

SEQ ID NO: 2055232 - RNA, 17 nt, Homo sapiens
acuaaaacugcauuucc

SEQ ID NO: 2055233 - RNA, 16 nt, Homo sapiens
ggucccccgacugccu

SEQ ID NO: 2055234 - RNA, 11 nt, Homo sapiens
gucccuggaau

SEQ ID NO: 2055235 - RNA, 12 nt, Homo sapiens
caggcacagggc

SEQ ID NO: 2055236 - RNA, 14 nt, Homo sapiens
ggacacuggugcca

SEQ ID NO: 2055237 - RNA, 19 nt, Homo sapiens
uuuacuguuucucaagugu

SEQ ID NO: 2055238 - RNA, 13 nt, Homo sapiens
aaucaucauaucu

SEQ ID NO: 2055239 - RNA, 13 nt, Homo sapiens
ugaauucaagaaa

SEQ ID NO: 2055240 - RNA, 21 nt, Homo sapiens
uacaaacauaaggcacauugu

SEQ ID NO: 2055241 - RNA, 21 nt, Homo sapiens
gguggaggcagaggugacagu

SEQ ID NO: 2055242 - RNA, 14 nt, Homo sapiens
ucagcucaaccaca

SEQ ID NO: 2055243 - RNA, 21 nt, Homo sapiens
ugcuuuucuucccagcaaagg

SEQ ID NO: 2055244 - RNA, 15 nt, Homo sapiens
caaauggacuauaca

SEQ ID NO: 2055245 - RNA, 17 nt, Homo sapiens
acaagccagaacuugac

SEQ ID NO: 2055246 - RNA, 22 nt, Homo sapiens
cucaucacacgucacaaugucc

SEQ ID NO: 2055247 - RNA, 14 nt, Homo sapiens
ugucaaugggaccu

SEQ ID NO: 2055248 - RNA, 18 nt, Homo sapiens
cuccagaagaacaaagag

SEQ ID NO: 2055249 - RNA, 13 nt, Homo sapiens
cuaacauggugaa

SEQ ID NO: 2055250 - RNA, 22 nt, Homo sapiens
ccagaguagagaugcugggacu

SEQ ID NO: 2055251 - RNA, 15 nt, Homo sapiens
acagaaacugaugcc

SEQ ID NO: 2055252 - RNA, 24 nt, Homo sapiens
ucauguacuacccucagucuacac

SEQ ID NO: 2055253 - RNA, 14 nt, Homo sapiens
ucuugagcagauga

SEQ ID NO: 2055254 - RNA, 14 nt, Homo sapiens
caccaguugccguu

SEQ ID NO: 2055255 - RNA, 11 nt, Homo sapiens
uuuacauuucu

SEQ ID NO: 2055256 - RNA, 17 nt, Homo sapiens
cuaacauguaauugcag

SEQ ID NO: 2055257 - RNA, 21 nt, Homo sapiens
ucacugugauguauauugugu

SEQ ID NO: 2055258 - RNA, 23 nt, Homo sapiens
uguaauuuugaguacagaauuca

SEQ ID NO: 2055259 - RNA, 23 nt, Homo sapiens
acgucacaaagaccuugcugaua

SEQ ID NO: 2055260 - RNA, 22 nt, Homo sapiens
cacuuaaugaaugaaugaauuc

SEQ ID NO: 2055261 - RNA, 22 nt, Homo sapiens
cucugcuccugugguccagugg

SEQ ID NO: 2055262 - RNA, 13 nt, Homo sapiens
aggugaggcccaa

SEQ ID NO: 2055263 - RNA, 18 nt, Homo sapiens
accuccaggaaacaugaa

SEQ ID NO: 2055264 - RNA, 19 nt, Homo sapiens
ugggacgcacagugcaguu

SEQ ID NO: 2055265 - RNA, 14 nt, Homo sapiens
ugagacuguaaaac

SEQ ID NO: 2055266 - RNA, 16 nt, Homo sapiens
uucauuuuuaggcaug

SEQ ID NO: 2055267 - RNA, 19 nt, Homo sapiens
aaaaugaaaugcauuuugc

SEQ ID NO: 2055268 - RNA, 19 nt, Homo sapiens
agaagccuaaaaaaagcua

SEQ ID NO: 2055269 - RNA, 21 nt, Homo sapiens
ucagcuggcacugucucugcu

SEQ ID NO: 2055270 - RNA, 21 nt, Homo sapiens
cuguucauuucacacagugaa

SEQ ID NO: 2055271 - RNA, 21 nt, Homo sapiens
gagaauaaacuagacucugaa

SEQ ID NO: 2055272 - RNA, 18 nt, Homo sapiens
guuccuucgaggguucca

SEQ ID NO: 2055273 - RNA, 18 nt, Homo sapiens
ggugaaaccccgucucua

SEQ ID NO: 2055274 - RNA, 16 nt, Homo sapiens
ugcacaauuccaugac

SEQ ID NO: 2055275 - RNA, 15 nt, Homo sapiens
aauguuucuguguca

SEQ ID NO: 2055276 - RNA, 16 nt, Homo sapiens
guuuguucugcagaga

SEQ ID NO: 2055277 - RNA, 18 nt, Homo sapiens
uuuguaccuaaguggaua

SEQ ID NO: 2055278 - RNA, 14 nt, Homo sapiens
ucacucuguugccu

SEQ ID NO: 2055279 - RNA, 18 nt, Homo sapiens
aauuuuuccagcauuuau

SEQ ID NO: 2055280 - RNA, 20 nt, Homo sapiens
aaagugucguaucugggaga

SEQ ID NO: 2055281 - RNA, 18 nt, Homo sapiens
uacuaaauuuucuaauua

SEQ ID NO: 2055282 - RNA, 16 nt, Homo sapiens
cauuugugugcucaug

SEQ ID NO: 2055283 - RNA, 20 nt, Homo sapiens
aggaggcaagcaagcucucu

SEQ ID NO: 2055284 - RNA, 21 nt, Homo sapiens
gucccuaauaaaaacuugcug

SEQ ID NO: 2055285 - RNA, 15 nt, Homo sapiens
gugugagugugugca

SEQ ID NO: 2055286 - RNA, 21 nt, Homo sapiens
uauguuauagaacuucaugga

SEQ ID NO: 2055287 - RNA, 21 nt, Homo sapiens
uguuauagaaugaacuugcau

SEQ ID NO: 2055288 - RNA, 23 nt, Homo sapiens
aauauaagcuuaaaauaagugaa

SEQ ID NO: 2055289 - RNA, 21 nt, Homo sapiens
uuugguaucuuacacauuaau

SEQ ID NO: 2055290 - RNA, 18 nt, Homo sapiens
ugccaaacaucagucaau

SEQ ID NO: 2055291 - RNA, 21 nt, Homo sapiens
uucuguccuuuuggcacugag

SEQ ID NO: 2055292 - RNA, 23 nt, Homo sapiens
uauaauaaagaaaaccuuucuac

SEQ ID NO: 2055293 - RNA, 16 nt, Homo sapiens
ugcaggggucucaugu

SEQ ID NO: 2055294 - RNA, 20 nt, Homo sapiens
gaauaucauuaaauuggaau

SEQ ID NO: 2055295 - RNA, 18 nt, Homo sapiens
gguuuguuaggaggccac

SEQ ID NO: 2055296 - RNA, 23 nt, Homo sapiens
cuuuucauuagcaguugcucaca

SEQ ID NO: 2055297 - RNA, 20 nt, Homo sapiens
ccuagaucugcacucaccuc

SEQ ID NO: 2055298 - RNA, 13 nt, Homo sapiens
aguaucagcacua

SEQ ID NO: 2055299 - RNA, 12 nt, Homo sapiens
ucuaccacccac

SEQ ID NO: 2055300 - RNA, 22 nt, Homo sapiens
auagcauuaauaaaacugugca

SEQ ID NO: 2055301 - RNA, 17 nt, Homo sapiens
auuaaguccuacuuuac

SEQ ID NO: 2055302 - RNA, 21 nt, Homo sapiens
uucuuguuuuaagagacagag

SEQ ID NO: 2055303 - RNA, 21 nt, Homo sapiens
gcagaguuuccaaaaccagaa

SEQ ID NO: 2055304 - RNA, 18 nt, Homo sapiens
uccuguugaagacuuccu

SEQ ID NO: 2055305 - RNA, 13 nt, Homo sapiens
ccccaugcacugu

SEQ ID NO: 2055306 - RNA, 14 nt, Homo sapiens
cuuaacaguuuuag

SEQ ID NO: 2055307 - RNA, 17 nt, Homo sapiens
cacuauguauauacaua

SEQ ID NO: 2055308 - RNA, 20 nt, Homo sapiens
uuccuugcaggagugacuca

SEQ ID NO: 2055309 - RNA, 19 nt, Homo sapiens
acagugcccaccugcucuu

SEQ ID NO: 2055310 - RNA, 13 nt, Homo sapiens
uaugaugcacuua

SEQ ID NO: 2055311 - RNA, 15 nt, Homo sapiens
cagguugcagcugcu

SEQ ID NO: 2055312 - RNA, 23 nt, Homo sapiens
cuuuccugugugaagaaagccuc

SEQ ID NO: 2055313 - RNA, 15 nt, Homo sapiens
aguggcucaucauca

SEQ ID NO: 2055314 - RNA, 21 nt, Homo sapiens
gcaguugacucagagugcaag

SEQ ID NO: 2055315 - RNA, 16 nt, Homo sapiens
cugcucacaguccuca

SEQ ID NO: 2055316 - RNA, 21 nt, Homo sapiens
cuagcauuuuuggcuuacuca

SEQ ID NO: 2055317 - RNA, 18 nt, Homo sapiens
auuggagcugaagaccua

SEQ ID NO: 2055318 - RNA, 23 nt, Homo sapiens
caaggcucugcuauacagucuau

SEQ ID NO: 2055319 - RNA, 18 nt, Homo sapiens
uaaaugauagacaauuga

SEQ ID NO: 2055320 - RNA, 21 nt, Homo sapiens
ggucagaaacaggaccgggug

SEQ ID NO: 2055321 - RNA, 19 nt, Homo sapiens
ccaggaagcucggugagug

SEQ ID NO: 2055322 - RNA, 21 nt, Homo sapiens
agcucuuuuauuuuccugcug

SEQ ID NO: 2055323 - RNA, 14 nt, Homo sapiens
guuacuugcuauaa

SEQ ID NO: 2055324 - RNA, 17 nt, Homo sapiens
cuucagaucucuaauua

SEQ ID NO: 2055325 - RNA, 17 nt, Homo sapiens
gucggggggacagcucc

SEQ ID NO: 2055326 - RNA, 22 nt, Homo sapiens
cugcuggaggaauuuugucaac

SEQ ID NO: 2055327 - RNA, 15 nt, Homo sapiens
aagaucuuugcccuc

SEQ ID NO: 2055328 - RNA, 15 nt, Homo sapiens
guaaaggauuguuaa

SEQ ID NO: 2055329 - RNA, 17 nt, Homo sapiens
cccagagccacacaugg

SEQ ID NO: 2055330 - RNA, 14 nt, Homo sapiens
gaaaauauaugccu

SEQ ID NO: 2055331 - RNA, 22 nt, Homo sapiens
cuaaaugcagacaacaccuucc

SEQ ID NO: 2055332 - RNA, 14 nt, Homo sapiens
aucuuccugugucc

SEQ ID NO: 2055333 - RNA, 13 nt, Homo sapiens
ucuucccuuugug

SEQ ID NO: 2055334 - RNA, 22 nt, Homo sapiens
accugaucacuagccugucauc

SEQ ID NO: 2055335 - RNA, 14 nt, Homo sapiens
aguuaauucuugcc

SEQ ID NO: 2055336 - RNA, 18 nt, Homo sapiens
uuccaguaguuagcuuuc

SEQ ID NO: 2055337 - RNA, 20 nt, Homo sapiens
ggaggaaccacaauguuucu

SEQ ID NO: 2055338 - RNA, 17 nt, Homo sapiens
ucagggcacugcugcug

SEQ ID NO: 2055339 - RNA, 22 nt, Homo sapiens
aggacaaccacagagggauaua

SEQ ID NO: 2055340 - RNA, 17 nt, Homo sapiens
agucccgucgugcaguc

SEQ ID NO: 2055341 - RNA, 17 nt, Homo sapiens
cccagagccacaguucc

SEQ ID NO: 2055342 - RNA, 21 nt, Homo sapiens
uuauucuguuuugcacaguua

SEQ ID NO: 2055343 - RNA, 19 nt, Homo sapiens
gguuguuuaaaagagccug

SEQ ID NO: 2055344 - RNA, 14 nt, Homo sapiens
aaaccauccaguga

SEQ ID NO: 2055345 - RNA, 13 nt, Homo sapiens
cuuacacaucuca

SEQ ID NO: 2055346 - RNA, 19 nt, Homo sapiens
acacugaauugaaucuaca

SEQ ID NO: 2055347 - RNA, 13 nt, Homo sapiens
cucccacccugac

SEQ ID NO: 2055348 - RNA, 13 nt, Homo sapiens
cuccuacccugau

SEQ ID NO: 2055349 - RNA, 14 nt, Homo sapiens
ugcuucuccaaaua

SEQ ID NO: 2055350 - RNA, 11 nt, Homo sapiens
aacacauuaag

SEQ ID NO: 2055351 - RNA, 17 nt, Homo sapiens
acgaggccacagcugcc

SEQ ID NO: 2055352 - RNA, 18 nt, Homo sapiens
gaggaucauuugagcuca

SEQ ID NO: 2055353 - RNA, 15 nt, Homo sapiens
uuucaugcuccauuu

SEQ ID NO: 2055354 - RNA, 17 nt, Homo sapiens
uuugcacugaagcagaa

SEQ ID NO: 2055355 - RNA, 18 nt, Homo sapiens
gacuugaaugcacuuuug

SEQ ID NO: 2055356 - RNA, 19 nt, Homo sapiens
uaugaguuuucuccuugau

SEQ ID NO: 2055357 - RNA, 17 nt, Homo sapiens
uccugguucagugccac

SEQ ID NO: 2055358 - RNA, 23 nt, Homo sapiens
gcagaguuuguguguugucuuga

SEQ ID NO: 2055359 - RNA, 21 nt, Homo sapiens
cccauacaauguauguacaau

SEQ ID NO: 2055360 - RNA, 15 nt, Homo sapiens
ucugacuuugagacg

SEQ ID NO: 2055361 - RNA, 22 nt, Homo sapiens
aaagcauaaaaaaccacagcaa

SEQ ID NO: 2055362 - RNA, 20 nt, Homo sapiens
ggaggcagcuguugcaguga

SEQ ID NO: 2055363 - RNA, 15 nt, Homo sapiens
caccaaguuaccuac

SEQ ID NO: 2055364 - RNA, 21 nt, Homo sapiens
ccuggggccuggaccugccuc

SEQ ID NO: 2055365 - RNA, 21 nt, Homo sapiens
cuuagucuguggagaacagaa

SEQ ID NO: 2055366 - RNA, 14 nt, Homo sapiens
cucccugcuaccaa

SEQ ID NO: 2055367 - RNA, 13 nt, Homo sapiens
ugacauugauaca

SEQ ID NO: 2055368 - RNA, 17 nt, Homo sapiens
aucuuggcucacugcaa

SEQ ID NO: 2055369 - RNA, 19 nt, Homo sapiens
acacaguaauugugacaau

SEQ ID NO: 2055370 - RNA, 20 nt, Homo sapiens
gcagcgccugccgccccggg

SEQ ID NO: 2055371 - RNA, 13 nt, Homo sapiens
uguucuuacacau

SEQ ID NO: 2055372 - RNA, 17 nt, Homo sapiens
gucuuuuguaauaucaa

SEQ ID NO: 2055373 - RNA, 21 nt, Homo sapiens
gauuuguuuguuuucuugucu

SEQ ID NO: 2055374 - RNA, 21 nt, Homo sapiens
acucaucugaaauguuacaaa

SEQ ID NO: 2055375 - RNA, 19 nt, Homo sapiens
gugaacauuacauugccau

SEQ ID NO: 2055376 - RNA, 14 nt, Homo sapiens
auggcauccaagac

SEQ ID NO: 2055377 - RNA, 16 nt, Homo sapiens
augcuucagugcugcu

SEQ ID NO: 2055378 - RNA, 19 nt, Homo sapiens
guccaggcuggagugcaau

SEQ ID NO: 2055379 - RNA, 19 nt, Homo sapiens
ucuaggcccacaaguguaa

SEQ ID NO: 2055380 - RNA, 17 nt, Homo sapiens
gucuucugccuguuaua

SEQ ID NO: 2055381 - RNA, 22 nt, Homo sapiens
ccauaucuuaaagaaacagcuu

SEQ ID NO: 2055382 - RNA, 18 nt, Homo sapiens
ugacauaaccaacauuaa

SEQ ID NO: 2055383 - RNA, 13 nt, Homo sapiens
ugcagucaucucc

SEQ ID NO: 2055384 - RNA, 20 nt, Homo sapiens
uaguggccugugcuuuucag

SEQ ID NO: 2055385 - RNA, 12 nt, Homo sapiens
gccauguucucc

SEQ ID NO: 2055386 - RNA, 16 nt, Homo sapiens
augguaaaaguuacuu

SEQ ID NO: 2055387 - RNA, 14 nt, Homo sapiens
uucccccaaagugg

SEQ ID NO: 2055388 - RNA, 15 nt, Homo sapiens
gacccagcucuucuc

SEQ ID NO: 2055389 - RNA, 11 nt, Homo sapiens
acacccuguga

SEQ ID NO: 2055390 - RNA, 13 nt, Homo sapiens
gcauagagcaauu

SEQ ID NO: 2055391 - RNA, 16 nt, Homo sapiens
ugagccccaacaacuu

SEQ ID NO: 2055392 - RNA, 21 nt, Homo sapiens
gauauucaaucuuaacaaaag

SEQ ID NO: 2055393 - RNA, 19 nt, Homo sapiens
acacugcaguuuccuggaa

SEQ ID NO: 2055394 - RNA, 20 nt, Homo sapiens
guucugcaaauuaauguaua

SEQ ID NO: 2055395 - RNA, 21 nt, Homo sapiens
agauugcagaaauacaguaug

SEQ ID NO: 2055396 - RNA, 20 nt, Homo sapiens
ccauuuuaaaaugcaucauu

SEQ ID NO: 2055397 - RNA, 14 nt, Homo sapiens
agaacaaaaccucu

SEQ ID NO: 2055398 - RNA, 14 nt, Homo sapiens
ggaauaaagccuuu

SEQ ID NO: 2055399 - RNA, 15 nt, Homo sapiens
guagaguuugaucau

SEQ ID NO: 2055400 - RNA, 12 nt, Homo sapiens
uugggaacagaa

SEQ ID NO: 2055401 - RNA, 15 nt, Homo sapiens
accuuggaccucagu

SEQ ID NO: 2055402 - RNA, 15 nt, Homo sapiens
aagacaucauguauc

SEQ ID NO: 2055403 - RNA, 12 nt, Homo sapiens
ccugggggccug

SEQ ID NO: 2055404 - RNA, 23 nt, Homo sapiens
uacauuauguguuucuccucaga

SEQ ID NO: 2055405 - RNA, 21 nt, Homo sapiens
uccuagaauggaugugcucac

SEQ ID NO: 2055406 - RNA, 17 nt, Homo sapiens
cauuuccaugcauaaau

SEQ ID NO: 2055407 - RNA, 22 nt, Homo sapiens
aucugccuaggguccuguccau

SEQ ID NO: 2055408 - RNA, 16 nt, Homo sapiens
auuucuguaaauacca

SEQ ID NO: 2055409 - RNA, 17 nt, Homo sapiens
aagauugcacuguucug

SEQ ID NO: 2055410 - RNA, 18 nt, Homo sapiens
aacuugggggaggaggaa

SEQ ID NO: 2055411 - RNA, 11 nt, Homo sapiens
gagucacugac

SEQ ID NO: 2055412 - RNA, 16 nt, Homo sapiens
ccugaaaaacuaguaa

SEQ ID NO: 2055413 - RNA, 18 nt, Homo sapiens
agaugcaaucucuugucu

SEQ ID NO: 2055414 - RNA, 22 nt, Homo sapiens
uccagucuuccgacaaacuaac

SEQ ID NO: 2055415 - RNA, 15 nt, Homo sapiens
ccgagccgagcucuc

SEQ ID NO: 2055416 - RNA, 14 nt, Homo sapiens
acacauagauucac

SEQ ID NO: 2055417 - RNA, 18 nt, Homo sapiens
ccuggccuguggagagaa

SEQ ID NO: 2055418 - RNA, 22 nt, Homo sapiens
cagacccaguggacucuuccac

SEQ ID NO: 2055419 - RNA, 15 nt, Homo sapiens
auacuuugaagugca

SEQ ID NO: 2055420 - RNA, 15 nt, Homo sapiens
aagcaauuuguugcu

SEQ ID NO: 2055421 - RNA, 17 nt, Homo sapiens
gaaaaccauucuggaca

SEQ ID NO: 2055422 - RNA, 20 nt, Homo sapiens
uccgcccccaugcucucugu

SEQ ID NO: 2055423 - RNA, 20 nt, Homo sapiens
ugauuauagcaaugugauuu

SEQ ID NO: 2055424 - RNA, 13 nt, Homo sapiens
acucuagccaaau

SEQ ID NO: 2055425 - RNA, 22 nt, Homo sapiens
gcuggcaaugcccuaccugccu

SEQ ID NO: 2055426 - RNA, 15 nt, Homo sapiens
gcaggacagcuccug

SEQ ID NO: 2055427 - RNA, 21 nt, Homo sapiens
gcauucuguggccagccaaaa

SEQ ID NO: 2055428 - RNA, 20 nt, Homo sapiens
gcauuuuguggcugauuuca

SEQ ID NO: 2055429 - RNA, 14 nt, Homo sapiens
ucucagucccugac

SEQ ID NO: 2055430 - RNA, 13 nt, Homo sapiens
uguaccauguaca

SEQ ID NO: 2055431 - RNA, 19 nt, Homo sapiens
ucuacaaacucccacuugu

SEQ ID NO: 2055432 - RNA, 22 nt, Homo sapiens
auauaguauauuuauacucuag

SEQ ID NO: 2055433 - RNA, 19 nt, Homo sapiens
ugucugggaaagcagagug

SEQ ID NO: 2055434 - RNA, 21 nt, Homo sapiens
uccauuaaauauaaagcaaga

SEQ ID NO: 2055435 - RNA, 14 nt, Homo sapiens
cccuuccucccauu

SEQ ID NO: 2055436 - RNA, 16 nt, Homo sapiens
ggugcuguuuugccag

SEQ ID NO: 2055437 - RNA, 13 nt, Homo sapiens
cugugguccccga

SEQ ID NO: 2055438 - RNA, 16 nt, Homo sapiens
agccuguacaaccuac

SEQ ID NO: 2055439 - RNA, 18 nt, Homo sapiens
acaguuuuuuacauauua

SEQ ID NO: 2055440 - RNA, 14 nt, Homo sapiens
caacacccugaggu

SEQ ID NO: 2055441 - RNA, 15 nt, Homo sapiens
cggguggaucaccug

SEQ ID NO: 2055442 - RNA, 18 nt, Homo sapiens
aacagcacuggcucucuc

SEQ ID NO: 2055443 - RNA, 14 nt, Homo sapiens
ucacagccauuuca

SEQ ID NO: 2055444 - RNA, 19 nt, Homo sapiens
ugcuccaagggacaggugg

SEQ ID NO: 2055445 - RNA, 17 nt, Homo sapiens
augaggguccccgggag

SEQ ID NO: 2055446 - RNA, 22 nt, Homo sapiens
caccauugaacuguaccaugug

SEQ ID NO: 2055447 - RNA, 17 nt, Homo sapiens
cuccagcccugcagcua

SEQ ID NO: 2055448 - RNA, 20 nt, Homo sapiens
gacauuuuacuauuugccaa

SEQ ID NO: 2055449 - RNA, 23 nt, Homo sapiens
aggacucacccuccacaaagcaa

SEQ ID NO: 2055450 - RNA, 22 nt, Homo sapiens
caguuguguuccugacacucaa

SEQ ID NO: 2055451 - RNA, 16 nt, Homo sapiens
aucugaggaaugagaa

SEQ ID NO: 2055452 - RNA, 23 nt, Homo sapiens
ccagagcuugugcuccucuugau

SEQ ID NO: 2055453 - RNA, 19 nt, Homo sapiens
uaagugaauuuaugagauu

SEQ ID NO: 2055454 - RNA, 19 nt, Homo sapiens
cugagguuuugaauaaaaa

SEQ ID NO: 2055455 - RNA, 19 nt, Homo sapiens
auccugcaauuccacuuau

SEQ ID NO: 2055456 - RNA, 16 nt, Homo sapiens
ucuccccagagcauuu

SEQ ID NO: 2055457 - RNA, 15 nt, Homo sapiens
gucucaguuucacuu

SEQ ID NO: 2055458 - RNA, 16 nt, Homo sapiens
caagaguucuaaauac

SEQ ID NO: 2055459 - RNA, 23 nt, Homo sapiens
agugcugccccuugcaagccaua

SEQ ID NO: 2055460 - RNA, 19 nt, Homo sapiens
agugccugaacauggcagu

SEQ ID NO: 2055461 - RNA, 19 nt, Homo sapiens
acagcugucuucacaugua

SEQ ID NO: 2055462 - RNA, 16 nt, Homo sapiens
gccuccgcuacuucca

SEQ ID NO: 2055463 - RNA, 16 nt, Homo sapiens
uuaaaacuuacuaugg

SEQ ID NO: 2055464 - RNA, 20 nt, Homo sapiens
ugcaguguaacgaugcacuu

SEQ ID NO: 2055465 - RNA, 18 nt, Homo sapiens
guuaaaaucuauucugug

SEQ ID NO: 2055466 - RNA, 22 nt, Homo sapiens
ccacaaggccugaggagcagug

SEQ ID NO: 2055467 - RNA, 18 nt, Homo sapiens
uaguaagaaacaaugggc

SEQ ID NO: 2055468 - RNA, 14 nt, Homo sapiens
ccuugucuaaagau

SEQ ID NO: 2055469 - RNA, 18 nt, Homo sapiens
gcaggccgacagucggug

SEQ ID NO: 2055470 - RNA, 17 nt, Homo sapiens
cccagucagaaguucug

SEQ ID NO: 2055471 - RNA, 15 nt, Homo sapiens
ccaacuuuuucauag

SEQ ID NO: 2055472 - RNA, 18 nt, Homo sapiens
augauccagggauugggc

SEQ ID NO: 2055473 - RNA, 13 nt, Homo sapiens
aggcuacuuuuca

SEQ ID NO: 2055474 - RNA, 21 nt, Homo sapiens
gauguucauccuaacaugaca

SEQ ID NO: 2055475 - RNA, 18 nt, Homo sapiens
cuuccagaaacuacauga

SEQ ID NO: 2055476 - RNA, 14 nt, Homo sapiens
ggccuuucccauug

SEQ ID NO: 2055477 - RNA, 16 nt, Homo sapiens
acgcuggcaacacaga

SEQ ID NO: 2055478 - RNA, 14 nt, Homo sapiens
acacguuggcucag

SEQ ID NO: 2055479 - RNA, 22 nt, Homo sapiens
aaaauuagaaucugaguauaaa

SEQ ID NO: 2055480 - RNA, 17 nt, Homo sapiens
augucuuuuuaagaaua

SEQ ID NO: 2055481 - RNA, 19 nt, Homo sapiens
uguccuccugggggcauau

SEQ ID NO: 2055482 - RNA, 16 nt, Homo sapiens
uaguacauaaucuuua

SEQ ID NO: 2055483 - RNA, 23 nt, Homo sapiens
cacuuaccugcaaacuccuugua

SEQ ID NO: 2055484 - RNA, 14 nt, Homo sapiens
caggacuaacaacu

SEQ ID NO: 2055485 - RNA, 17 nt, Homo sapiens
auguggaauaauacaua

SEQ ID NO: 2055486 - RNA, 11 nt, Homo sapiens
uucaagaccag

SEQ ID NO: 2055487 - RNA, 13 nt, Homo sapiens
acauuucaccaug

SEQ ID NO: 2055488 - RNA, 16 nt, Homo sapiens
uagacugaagauuuau

SEQ ID NO: 2055489 - RNA, 20 nt, Homo sapiens
ggcggcuccauccguggcug

SEQ ID NO: 2055490 - RNA, 17 nt, Homo sapiens
aacagcauugaaccaag

SEQ ID NO: 2055491 - RNA, 19 nt, Homo sapiens
cugaagggggacacuccau

SEQ ID NO: 2055492 - RNA, 16 nt, Homo sapiens
uggauacuggggggca

SEQ ID NO: 2055493 - RNA, 14 nt, Homo sapiens
aucagcacauauuu

SEQ ID NO: 2055494 - RNA, 18 nt, Homo sapiens
cagucuugccuuugaagg

SEQ ID NO: 2055495 - RNA, 14 nt, Homo sapiens
ugucuaagaacuuc

SEQ ID NO: 2055496 - RNA, 20 nt, Homo sapiens
uucuguucaacauguaccuc

SEQ ID NO: 2055497 - RNA, 21 nt, Homo sapiens
gccaacacacguccacuccca

SEQ ID NO: 2055498 - RNA, 16 nt, Homo sapiens
uacuguagaccuuucu

SEQ ID NO: 2055499 - RNA, 22 nt, Homo sapiens
gccuguagucccagcuacucag

SEQ ID NO: 2055500 - RNA, 23 nt, Homo sapiens
ugagacagcaguaucacaggcca

SEQ ID NO: 2055501 - RNA, 23 nt, Homo sapiens
cuuuagaguagcaugagagaauu

SEQ ID NO: 2055502 - RNA, 21 nt, Homo sapiens
gcuuaacucccccucauucac

SEQ ID NO: 2055503 - RNA, 21 nt, Homo sapiens
cucuaaguuccacugagcucc

SEQ ID NO: 2055504 - RNA, 18 nt, Homo sapiens
acccuucaucuuccugug

SEQ ID NO: 2055505 - RNA, 22 nt, Homo sapiens
ugcacucuugaacugggcgaau

SEQ ID NO: 2055506 - RNA, 13 nt, Homo sapiens
caggaaugaguca

SEQ ID NO: 2055507 - RNA, 14 nt, Homo sapiens
cuauggaagcauau

SEQ ID NO: 2055508 - RNA, 15 nt, Homo sapiens
ggcugucccgugcau

SEQ ID NO: 2055509 - RNA, 21 nt, Homo sapiens
auucgcccuccucccugucau

SEQ ID NO: 2055510 - RNA, 14 nt, Homo sapiens
aggaacccaucuaa

SEQ ID NO: 2055511 - RNA, 18 nt, Homo sapiens
aauuucucuacugucuca

SEQ ID NO: 2055512 - RNA, 12 nt, Homo sapiens
guuuuugagggg

SEQ ID NO: 2055513 - RNA, 21 nt, Homo sapiens
ucuuccccauaaucacugacc

SEQ ID NO: 2055514 - RNA, 16 nt, Homo sapiens
aucggaauucagccau

SEQ ID NO: 2055515 - RNA, 20 nt, Homo sapiens
acugugacacuuaucucacu

SEQ ID NO: 2055516 - RNA, 14 nt, Homo sapiens
agcucuugcuuuga

SEQ ID NO: 2055517 - RNA, 18 nt, Homo sapiens
accuggcccuuagaaaua

SEQ ID NO: 2055518 - RNA, 23 nt, Homo sapiens
uauggcaccccaaccccagugau

SEQ ID NO: 2055519 - RNA, 16 nt, Homo sapiens
ccagaauaacuagcac

SEQ ID NO: 2055520 - RNA, 22 nt, Homo sapiens
ccccaugccaccggcuccacuu

SEQ ID NO: 2055521 - RNA, 17 nt, Homo sapiens
cuggcuccuucacugaa

SEQ ID NO: 2055522 - RNA, 14 nt, Homo sapiens
auaacugcaguguu

SEQ ID NO: 2055523 - RNA, 12 nt, Homo sapiens
aauuucaaucaa

SEQ ID NO: 2055524 - RNA, 16 nt, Homo sapiens
uuuggaaccaugccuu

SEQ ID NO: 2055525 - RNA, 16 nt, Homo sapiens
ugugugugcguguguc

SEQ ID NO: 2055526 - RNA, 16 nt, Homo sapiens
caggcagcuaggcagg

SEQ ID NO: 2055527 - RNA, 20 nt, Homo sapiens
cuuguuuuuuuucaaacgga

SEQ ID NO: 2055528 - RNA, 14 nt, Homo sapiens
cccaugucaccuca

SEQ ID NO: 2055529 - RNA, 15 nt, Homo sapiens
ugcauuccagcgucu

SEQ ID NO: 2055530 - RNA, 17 nt, Homo sapiens
auauauggacagcuuua

SEQ ID NO: 2055531 - RNA, 22 nt, Homo sapiens
ggucauauuaauauauuuccau

SEQ ID NO: 2055532 - RNA, 22 nt, Homo sapiens
ucuuuuauggcaaaaguaauca

SEQ ID NO: 2055533 - RNA, 21 nt, Homo sapiens
gcuaccuguugguuagauuca

SEQ ID NO: 2055534 - RNA, 19 nt, Homo sapiens
uuuugaaaagcucacuuca

SEQ ID NO: 2055535 - RNA, 16 nt, Homo sapiens
uguauuugucaaugca

SEQ ID NO: 2055536 - RNA, 14 nt, Homo sapiens
ucauaccagucagu

SEQ ID NO: 2055537 - RNA, 20 nt, Homo sapiens
gaaugauaauggaaacuguc

SEQ ID NO: 2055538 - RNA, 21 nt, Homo sapiens
cagcuggaucugcuuguugca

SEQ ID NO: 2055539 - RNA, 22 nt, Homo sapiens
ggcgaggccgccagacauacac

SEQ ID NO: 2055540 - RNA, 15 nt, Homo sapiens
ucaaagaaauccaaa

SEQ ID NO: 2055541 - RNA, 18 nt, Homo sapiens
gaacaguuuuuaagcuau

SEQ ID NO: 2055542 - RNA, 16 nt, Homo sapiens
aagaugucucugcaaa

SEQ ID NO: 2055543 - RNA, 23 nt, Homo sapiens
acccuuuaagauauccaucuuuu

SEQ ID NO: 2055544 - RNA, 20 nt, Homo sapiens
auucaaaagguuauauacca

SEQ ID NO: 2055545 - RNA, 11 nt, Homo sapiens
agccugggaag

SEQ ID NO: 2055546 - RNA, 11 nt, Homo sapiens
cauaacugcua

SEQ ID NO: 2055547 - RNA, 12 nt, Homo sapiens
aauagaaaaagu

SEQ ID NO: 2055548 - RNA, 19 nt, Homo sapiens
uacugcuagauaucacuua

SEQ ID NO: 2055549 - RNA, 15 nt, Homo sapiens
agggcugcaaugccc

SEQ ID NO: 2055550 - RNA, 19 nt, Homo sapiens
aucugcacucuaaacugca

SEQ ID NO: 2055551 - RNA, 18 nt, Homo sapiens
cacacccucacucugcca

SEQ ID NO: 2055552 - RNA, 21 nt, Homo sapiens
agccuguuuccccaauuccuc

SEQ ID NO: 2055553 - RNA, 21 nt, Homo sapiens
ugagagggauuuggguguuua

SEQ ID NO: 2055554 - RNA, 13 nt, Homo sapiens
uuagucugcauau

SEQ ID NO: 2055555 - RNA, 15 nt, Homo sapiens
auaauucagcacuua

SEQ ID NO: 2055556 - RNA, 18 nt, Homo sapiens
uuacuaaaguacagacau

SEQ ID NO: 2055557 - RNA, 19 nt, Homo sapiens
uuugaucaagaaugcaaua

SEQ ID NO: 2055558 - RNA, 20 nt, Homo sapiens
ugaaaaccacccuaucauca

SEQ ID NO: 2055559 - RNA, 23 nt, Homo sapiens
augucucuacccacuaugcacag

SEQ ID NO: 2055560 - RNA, 20 nt, Homo sapiens
accccagaacgcaugcaggg

SEQ ID NO: 2055561 - RNA, 15 nt, Homo sapiens
cuagauggcuccucu

SEQ ID NO: 2055562 - RNA, 14 nt, Homo sapiens
ccuguguaccucua

SEQ ID NO: 2055563 - RNA, 15 nt, Homo sapiens
cagaagcgcccugua

SEQ ID NO: 2055564 - RNA, 17 nt, Homo sapiens
ccuaguggaugacuguu

SEQ ID NO: 2055565 - RNA, 19 nt, Homo sapiens
agccagguaugguggcaua

SEQ ID NO: 2055566 - RNA, 19 nt, Homo sapiens
ggaagaagacuguuuccaa

SEQ ID NO: 2055567 - RNA, 18 nt, Homo sapiens
aggagaaucaaaaugcaa

SEQ ID NO: 2055568 - RNA, 20 nt, Homo sapiens
gcaugacucuucaaccccga

SEQ ID NO: 2055569 - RNA, 20 nt, Homo sapiens
uauguguaguuauaaaccaa

SEQ ID NO: 2055570 - RNA, 22 nt, Homo sapiens
cugggaugacaggugugagcca

SEQ ID NO: 2055571 - RNA, 14 nt, Homo sapiens
uucaacuuccaaag

SEQ ID NO: 2055572 - RNA, 18 nt, Homo sapiens
gacuuugauuuccuuaau

SEQ ID NO: 2055573 - RNA, 13 nt, Homo sapiens
uucuguaccaguu

SEQ ID NO: 2055574 - RNA, 11 nt, Homo sapiens
ucaaaaaucau

SEQ ID NO: 2055575 - RNA, 17 nt, Homo sapiens
augaagaaugcauucaa

SEQ ID NO: 2055576 - RNA, 17 nt, Homo sapiens
ccucuucuuccuaccuu

SEQ ID NO: 2055577 - RNA, 17 nt, Homo sapiens
agggcaggccuguuccc

SEQ ID NO: 2055578 - RNA, 17 nt, Homo sapiens
cuucaguuuauaccuug

SEQ ID NO: 2055579 - RNA, 12 nt, Homo sapiens
ugggaagugaag

SEQ ID NO: 2055580 - RNA, 13 nt, Homo sapiens
cugacacagccac

SEQ ID NO: 2055581 - RNA, 19 nt, Homo sapiens
caucaggaaggaaaugaca

SEQ ID NO: 2055582 - RNA, 16 nt, Homo sapiens
ccuucagcgauuauuu

SEQ ID NO: 2055583 - RNA, 20 nt, Homo sapiens
uguagaaugauuucaugcua

SEQ ID NO: 2055584 - RNA, 20 nt, Homo sapiens
ccaaggcuauauuucuggga

SEQ ID NO: 2055585 - RNA, 17 nt, Homo sapiens
ggugguuucuacgguga

SEQ ID NO: 2055586 - RNA, 21 nt, Homo sapiens
aaucuaggccaccccaaccuc

SEQ ID NO: 2055587 - RNA, 17 nt, Homo sapiens
aguacaccaaccagacc

SEQ ID NO: 2055588 - RNA, 12 nt, Homo sapiens
cuggaacccagg

SEQ ID NO: 2055589 - RNA, 15 nt, Homo sapiens
uacauauugugaaug

SEQ ID NO: 2055590 - RNA, 16 nt, Homo sapiens
agcagggaagugacag

SEQ ID NO: 2055591 - RNA, 13 nt, Homo sapiens
uuaaaaccaucug

SEQ ID NO: 2055592 - RNA, 23 nt, Homo sapiens
uaugaauggguggaaagguguga

SEQ ID NO: 2055593 - RNA, 15 nt, Homo sapiens
cacuacauucauuua

SEQ ID NO: 2055594 - RNA, 20 nt, Homo sapiens
ugucaacuccaggacuugcu

SEQ ID NO: 2055595 - RNA, 18 nt, Homo sapiens
uuaaagcuguacacccca

SEQ ID NO: 2055596 - RNA, 19 nt, Homo sapiens
cucagugaaguugcugcuu

SEQ ID NO: 2055597 - RNA, 22 nt, Homo sapiens
gaucaaaauaaaaagugacaca

SEQ ID NO: 2055598 - RNA, 15 nt, Homo sapiens
cgcauccaccgccac

SEQ ID NO: 2055599 - RNA, 15 nt, Homo sapiens
uggcucugggggacc

SEQ ID NO: 2055600 - RNA, 22 nt, Homo sapiens
acuucgguuccucugauuucaa

SEQ ID NO: 2055601 - RNA, 20 nt, Homo sapiens
gacgcccucagucuagggau

SEQ ID NO: 2055602 - RNA, 22 nt, Homo sapiens
auacauucacccagauaaucau

SEQ ID NO: 2055603 - RNA, 12 nt, Homo sapiens
gcagccaaggga

SEQ ID NO: 2055604 - RNA, 23 nt, Homo sapiens
ccuuaagcuuuggacccaaggaa

SEQ ID NO: 2055605 - RNA, 15 nt, Homo sapiens
agugccucaugccug

SEQ ID NO: 2055606 - RNA, 18 nt, Homo sapiens
cauuaguguguugucucu

SEQ ID NO: 2055607 - RNA, 16 nt, Homo sapiens
uucagaacucacauug

SEQ ID NO: 2055608 - RNA, 14 nt, Homo sapiens
cuugagaagccaac

SEQ ID NO: 2055609 - RNA, 16 nt, Homo sapiens
caaugaaauacugaga

SEQ ID NO: 2055610 - RNA, 21 nt, Homo sapiens
ucccaggcugcuggagugcag

SEQ ID NO: 2055611 - RNA, 11 nt, Homo sapiens
uggaaccuaau

SEQ ID NO: 2055612 - RNA, 17 nt, Homo sapiens
cucacgucuguaauccc

SEQ ID NO: 2055613 - RNA, 13 nt, Homo sapiens
acccucgcugcca

SEQ ID NO: 2055614 - RNA, 21 nt, Homo sapiens
uaaaucacggauggcagauug

SEQ ID NO: 2055615 - RNA, 23 nt, Homo sapiens
cuaugugcaaaaaucaacucaaa

SEQ ID NO: 2055616 - RNA, 23 nt, Homo sapiens
ggacaaacagccucacuccucag

SEQ ID NO: 2055617 - RNA, 17 nt, Homo sapiens
aggccuuaacacacugg

SEQ ID NO: 2055618 - RNA, 17 nt, Homo sapiens
gcaaacggaggacugaa

SEQ ID NO: 2055619 - RNA, 17 nt, Homo sapiens
gcucuuguucuacugag

SEQ ID NO: 2055620 - RNA, 18 nt, Homo sapiens
cuccccuggggacagcaa

SEQ ID NO: 2055621 - RNA, 21 nt, Homo sapiens
ucagaguugcugcaaaccuga

SEQ ID NO: 2055622 - RNA, 13 nt, Homo sapiens
aaaucauagcugg

SEQ ID NO: 2055623 - RNA, 18 nt, Homo sapiens
caggggagugugaagguc

SEQ ID NO: 2055624 - RNA, 12 nt, Homo sapiens
cuccgcauccuc

SEQ ID NO: 2055625 - RNA, 12 nt, Homo sapiens
acccagugcaga

SEQ ID NO: 2055626 - RNA, 18 nt, Homo sapiens
uuuuguuuugaagcuguu

SEQ ID NO: 2055627 - RNA, 23 nt, Homo sapiens
acucgucccccuccugccucauc

SEQ ID NO: 2055628 - RNA, 12 nt, Homo sapiens
agcaguguucag

SEQ ID NO: 2055629 - RNA, 21 nt, Homo sapiens
ccaagccaggguuccagacag

SEQ ID NO: 2055630 - RNA, 16 nt, Homo sapiens
gcuaggaacauguggu

SEQ ID NO: 2055631 - RNA, 13 nt, Homo sapiens
aaauuuuauauca

SEQ ID NO: 2055632 - RNA, 21 nt, Homo sapiens
agcuaauuuaaaaacaugaug

SEQ ID NO: 2055633 - RNA, 18 nt, Homo sapiens
auugagaucagcauucaa

SEQ ID NO: 2055634 - RNA, 17 nt, Homo sapiens
ucaugcguguguguugu

SEQ ID NO: 2055635 - RNA, 14 nt, Homo sapiens
uccauagugcacua

SEQ ID NO: 2055636 - RNA, 14 nt, Homo sapiens
uuccaaguguaaaa

SEQ ID NO: 2055637 - RNA, 14 nt, Homo sapiens
aucagauacaucac

SEQ ID NO: 2055638 - RNA, 13 nt, Homo sapiens
agucaauucugau

SEQ ID NO: 2055639 - RNA, 20 nt, Homo sapiens
gagcuggucguuuugugauu

SEQ ID NO: 2055640 - RNA, 22 nt, Homo sapiens
gggacugugaggccauacuugu

SEQ ID NO: 2055641 - RNA, 22 nt, Homo sapiens
gcugaaaaaacaccuagcuuua

SEQ ID NO: 2055642 - RNA, 12 nt, Homo sapiens
ccuaaaauccau

SEQ ID NO: 2055643 - RNA, 16 nt, Homo sapiens
agaaugagaagacaug

SEQ ID NO: 2055644 - RNA, 17 nt, Homo sapiens
ugcugggauuacuggca

SEQ ID NO: 2055645 - RNA, 23 nt, Homo sapiens
cuuuuauauugauaacagcacug

SEQ ID NO: 2055646 - RNA, 18 nt, Homo sapiens
caguuagcauggauuuau

SEQ ID NO: 2055647 - RNA, 21 nt, Homo sapiens
acaggcuguucugcacugaaa

SEQ ID NO: 2055648 - RNA, 20 nt, Homo sapiens
cgauuuaugccucagccacu

SEQ ID NO: 2055649 - RNA, 21 nt, Homo sapiens
uaaauguaccccucucagucu

SEQ ID NO: 2055650 - RNA, 21 nt, Homo sapiens
cccacuagaagcaacuaggaa

SEQ ID NO: 2055651 - RNA, 17 nt, Homo sapiens
cccuugcugcaaaccca

SEQ ID NO: 2055652 - RNA, 14 nt, Homo sapiens
caugccaaugaagg

SEQ ID NO: 2055653 - RNA, 18 nt, Homo sapiens
gcuuguggagaucacagc

SEQ ID NO: 2055654 - RNA, 17 nt, Homo sapiens
ugaauauaaacacuaua

SEQ ID NO: 2055655 - RNA, 22 nt, Homo sapiens
cacccagucuguugcugcucca

SEQ ID NO: 2055656 - RNA, 18 nt, Homo sapiens
cuguugaaucugagcugc

SEQ ID NO: 2055657 - RNA, 14 nt, Homo sapiens
caauaaacaucuga

SEQ ID NO: 2055658 - RNA, 20 nt, Homo sapiens
aaaaaugugccuaguuuuau

SEQ ID NO: 2055659 - RNA, 19 nt, Homo sapiens
gcucuguacugcacuuaga

SEQ ID NO: 2055660 - RNA, 14 nt, Homo sapiens
gaccucaagugucc

SEQ ID NO: 2055661 - RNA, 14 nt, Homo sapiens
aaucucggcucacu

SEQ ID NO: 2055662 - RNA, 16 nt, Homo sapiens
uguguucgcgugugug

SEQ ID NO: 2055663 - RNA, 19 nt, Homo sapiens
cuuugccacauccauugac

SEQ ID NO: 2055664 - RNA, 16 nt, Homo sapiens
uucuugguuccuggga

SEQ ID NO: 2055665 - RNA, 13 nt, Homo sapiens
gugaagacaugua

SEQ ID NO: 2055666 - RNA, 14 nt, Homo sapiens
uccaucugucuguc

SEQ ID NO: 2055667 - RNA, 15 nt, Homo sapiens
agcuagugcauugga

SEQ ID NO: 2055668 - RNA, 21 nt, Homo sapiens
acaccauccaggaagacccca

SEQ ID NO: 2055669 - RNA, 21 nt, Homo sapiens
ggcuucugugcaccugggcuc

SEQ ID NO: 2055670 - RNA, 21 nt, Homo sapiens
agaaugagaccuggagucaug

SEQ ID NO: 2055671 - RNA, 13 nt, Homo sapiens
agacuguacuaac

SEQ ID NO: 2055672 - RNA, 16 nt, Homo sapiens
aagcacugacugggac

SEQ ID NO: 2055673 - RNA, 22 nt, Homo sapiens
cagggcagccuccaccuugcuc

SEQ ID NO: 2055674 - RNA, 15 nt, Homo sapiens
uagagaugcuacugu

SEQ ID NO: 2055675 - RNA, 17 nt, Homo sapiens
gagcaccagguguuaaa

SEQ ID NO: 2055676 - RNA, 14 nt, Homo sapiens
ucagcugcugcuua

SEQ ID NO: 2055677 - RNA, 16 nt, Homo sapiens
aaccugaugcugacua

SEQ ID NO: 2055678 - RNA, 17 nt, Homo sapiens
ugccaccccaacccaau

SEQ ID NO: 2055679 - RNA, 16 nt, Homo sapiens
ugauuaaugauuuuuc

SEQ ID NO: 2055680 - RNA, 15 nt, Homo sapiens
uggauuguggaugug

SEQ ID NO: 2055681 - RNA, 14 nt, Homo sapiens
cuggccauugcacu

SEQ ID NO: 2055682 - RNA, 15 nt, Homo sapiens
caaauuugcauuaaa

SEQ ID NO: 2055683 - RNA, 17 nt, Homo sapiens
agagcaagaccccaucu

SEQ ID NO: 2055684 - RNA, 18 nt, Homo sapiens
uuggcugcaggaaucuuu

SEQ ID NO: 2055685 - RNA, 17 nt, Homo sapiens
guggccucucagucaaa

SEQ ID NO: 2055686 - RNA, 19 nt, Homo sapiens
gugagugggagaguaccug

SEQ ID NO: 2055687 - RNA, 17 nt, Homo sapiens
acgucccgggcacuguc

SEQ ID NO: 2055688 - RNA, 20 nt, Homo sapiens
gcuuuugaaaaacaacugca

SEQ ID NO: 2055689 - RNA, 18 nt, Homo sapiens
ucacuaggaggucaucaa

SEQ ID NO: 2055690 - RNA, 23 nt, Homo sapiens
uucagcgcugucaggauugcgag

SEQ ID NO: 2055691 - RNA, 15 nt, Homo sapiens
cugccuaugucauac

SEQ ID NO: 2055692 - RNA, 21 nt, Homo sapiens
caggagcagcuggcacugaca

SEQ ID NO: 2055693 - RNA, 22 nt, Homo sapiens
augaauguacauuuucuaacaa

SEQ ID NO: 2055694 - RNA, 23 nt, Homo sapiens
uuuuauguguggcccaagacaau

SEQ ID NO: 2055695 - RNA, 14 nt, Homo sapiens
ugcuuaauugcuga

SEQ ID NO: 2055696 - RNA, 18 nt, Homo sapiens
uggcgugaucucagcuca

SEQ ID NO: 2055697 - RNA, 15 nt, Homo sapiens
ggagagcccaggccu

SEQ ID NO: 2055698 - RNA, 15 nt, Homo sapiens
ccucgacaagaccac

SEQ ID NO: 2055699 - RNA, 17 nt, Homo sapiens
ugcaaagaccuaccucc

SEQ ID NO: 2055700 - RNA, 19 nt, Homo sapiens
aggugaggguuacacugaa

SEQ ID NO: 2055701 - RNA, 22 nt, Homo sapiens
aacuuuacuguccuaacauggu

SEQ ID NO: 2055702 - RNA, 14 nt, Homo sapiens
aagauuaaaaccaa

SEQ ID NO: 2055703 - RNA, 13 nt, Homo sapiens
auuacaaguggcu

SEQ ID NO: 2055704 - RNA, 20 nt, Homo sapiens
gaauuuuguuuuugguuucu

SEQ ID NO: 2055705 - RNA, 16 nt, Homo sapiens
acacuaucauggacua

SEQ ID NO: 2055706 - RNA, 23 nt, Homo sapiens
guaaucccccaggagaacaucuu

SEQ ID NO: 2055707 - RNA, 17 nt, Homo sapiens
ugaaggaugugggccca

SEQ ID NO: 2055708 - RNA, 17 nt, Homo sapiens
uauuagugcuagucuca

SEQ ID NO: 2055709 - RNA, 15 nt, Homo sapiens
uggaacucaaggaaa

SEQ ID NO: 2055710 - RNA, 20 nt, Homo sapiens
ucagcuggguacgguggcac

SEQ ID NO: 2055711 - RNA, 17 nt, Homo sapiens
cuuaaugaucuuuccau

SEQ ID NO: 2055712 - RNA, 15 nt, Homo sapiens
ccauguccauaugca

SEQ ID NO: 2055713 - RNA, 18 nt, Homo sapiens
ggacaauuaucuguguca

SEQ ID NO: 2055714 - RNA, 15 nt, Homo sapiens
ccaggccaaugcagc

SEQ ID NO: 2055715 - RNA, 23 nt, Homo sapiens
uaaaucaguuuauuaaaucugaa

SEQ ID NO: 2055716 - RNA, 15 nt, Homo sapiens
ccagcagacucugga

SEQ ID NO: 2055717 - RNA, 22 nt, Homo sapiens
ccaacuccucuagucagcacua

SEQ ID NO: 2055718 - RNA, 21 nt, Homo sapiens
ugaaagaaauuaaguacuuaa

SEQ ID NO: 2055719 - RNA, 20 nt, Homo sapiens
cuagucaaugacaugaauuu

SEQ ID NO: 2055720 - RNA, 15 nt, Homo sapiens
ugcugaccaaauggc

SEQ ID NO: 2055721 - RNA, 16 nt, Homo sapiens
ucuuuuaaacaggcaa

SEQ ID NO: 2055722 - RNA, 21 nt, Homo sapiens
uauggugccuaguauugacaa

SEQ ID NO: 2055723 - RNA, 20 nt, Homo sapiens
cugauuuugugaauugccag

SEQ ID NO: 2055724 - RNA, 16 nt, Homo sapiens
aagagccgccguggcu

SEQ ID NO: 2055725 - RNA, 15 nt, Homo sapiens
aguguggcuaaccaa

SEQ ID NO: 2055726 - RNA, 19 nt, Homo sapiens
uaaaagucauuuaauguag

SEQ ID NO: 2055727 - RNA, 15 nt, Homo sapiens
gagugacacccaaga

SEQ ID NO: 2055728 - RNA, 23 nt, Homo sapiens
agcaguguuggggguagcggcau

SEQ ID NO: 2055729 - RNA, 13 nt, Homo sapiens
guguuacuugcca

SEQ ID NO: 2055730 - RNA, 16 nt, Homo sapiens
cagagcccacuuccau

SEQ ID NO: 2055731 - RNA, 14 nt, Homo sapiens
ggccaagccacuca

SEQ ID NO: 2055732 - RNA, 16 nt, Homo sapiens
gaaacuuacacuguuu

SEQ ID NO: 2055733 - RNA, 23 nt, Homo sapiens
gaguagguaccauuugugucucu

SEQ ID NO: 2055734 - RNA, 22 nt, Homo sapiens
ccucugcauggaacagcauuac

SEQ ID NO: 2055735 - RNA, 21 nt, Homo sapiens
agugaaguucuuuuacuguaa

SEQ ID NO: 2055736 - RNA, 18 nt, Homo sapiens
guaaauauuaaguguuua

SEQ ID NO: 2055737 - RNA, 16 nt, Homo sapiens
gcugagucgcucucau

SEQ ID NO: 2055738 - RNA, 21 nt, Homo sapiens
cagucagacgccaggcaccac

SEQ ID NO: 2055739 - RNA, 15 nt, Homo sapiens
acacguuugccaaau

SEQ ID NO: 2055740 - RNA, 16 nt, Homo sapiens
ccucaaauuaagcaua

SEQ ID NO: 2055741 - RNA, 21 nt, Homo sapiens
ugauaaaauaaguaacauaua

SEQ ID NO: 2055742 - RNA, 18 nt, Homo sapiens
caggccuaagacauguga

SEQ ID NO: 2055743 - RNA, 14 nt, Homo sapiens
ugaacacuuaccug

SEQ ID NO: 2055744 - RNA, 20 nt, Homo sapiens
ucuaaacaucuuuguugaug

SEQ ID NO: 2055745 - RNA, 20 nt, Homo sapiens
aaaaaauuaaauugcagaug

SEQ ID NO: 2055746 - RNA, 18 nt, Homo sapiens
aaaauuugcaacauauaa

SEQ ID NO: 2055747 - RNA, 18 nt, Homo sapiens
uguauuuuugucauagca

SEQ ID NO: 2055748 - RNA, 22 nt, Homo sapiens
cucaauaaacagucacuggaaa

SEQ ID NO: 2055749 - RNA, 16 nt, Homo sapiens
ucugagagcaucaggc

SEQ ID NO: 2055750 - RNA, 21 nt, Homo sapiens
uagaggguugcugccuuucaa

SEQ ID NO: 2055751 - RNA, 21 nt, Homo sapiens
gcuccacuuggucugugagau

SEQ ID NO: 2055752 - RNA, 21 nt, Homo sapiens
uacugaugcagaaagaccgug

SEQ ID NO: 2055753 - RNA, 22 nt, Homo sapiens
uuucuaagauacauauacugau

SEQ ID NO: 2055754 - RNA, 16 nt, Homo sapiens
acagggaacacauucc

SEQ ID NO: 2055755 - RNA, 15 nt, Homo sapiens
auccacaacuuguac

SEQ ID NO: 2055756 - RNA, 17 nt, Homo sapiens
agucuccgugguugaag

SEQ ID NO: 2055757 - RNA, 19 nt, Homo sapiens
gguaaaaacagcagcucau

SEQ ID NO: 2055758 - RNA, 19 nt, Homo sapiens
gcuauugugaauagugccg

SEQ ID NO: 2055759 - RNA, 16 nt, Homo sapiens
ugcucuggucuauaua

SEQ ID NO: 2055760 - RNA, 20 nt, Homo sapiens
accugaaggacgagggaugg

SEQ ID NO: 2055761 - RNA, 15 nt, Homo sapiens
gggccagggguggga

SEQ ID NO: 2055762 - RNA, 21 nt, Homo sapiens
caugucuccauuuucuucucu

SEQ ID NO: 2055763 - RNA, 19 nt, Homo sapiens
cucugugcagggcacagaa

SEQ ID NO: 2055764 - RNA, 23 nt, Homo sapiens
gcuaaauaaauggguguauauaa

SEQ ID NO: 2055765 - RNA, 20 nt, Homo sapiens
cacagacccaaaccauacca

SEQ ID NO: 2055766 - RNA, 22 nt, Homo sapiens
agaacuuaagucucgaauguaa

SEQ ID NO: 2055767 - RNA, 20 nt, Homo sapiens
gaaguguguccauccugacc

SEQ ID NO: 2055768 - RNA, 12 nt, Homo sapiens
aaauauacauaa

SEQ ID NO: 2055769 - RNA, 15 nt, Homo sapiens
gacuugauacugcaa

SEQ ID NO: 2055770 - RNA, 19 nt, Homo sapiens
guaacaaaccugcacuuau

SEQ ID NO: 2055771 - RNA, 22 nt, Homo sapiens
aacugcccugucuaggucagua

SEQ ID NO: 2055772 - RNA, 14 nt, Homo sapiens
auuucucugagauc

SEQ ID NO: 2055773 - RNA, 18 nt, Homo sapiens
cccuuguccaaaccuggg

SEQ ID NO: 2055774 - RNA, 18 nt, Homo sapiens
ucaguaguaucaaugauu

SEQ ID NO: 2055775 - RNA, 16 nt, Homo sapiens
uagucucuacccagua

SEQ ID NO: 2055776 - RNA, 16 nt, Homo sapiens
accugccgagagucca

SEQ ID NO: 2055777 - RNA, 13 nt, Homo sapiens
aaaguaccacaca

SEQ ID NO: 2055778 - RNA, 19 nt, Homo sapiens
gagccacagaaauugcaua

SEQ ID NO: 2055779 - RNA, 14 nt, Homo sapiens
cacuggcaggugug

SEQ ID NO: 2055780 - RNA, 15 nt, Homo sapiens
uacuugaaccuggga

SEQ ID NO: 2055781 - RNA, 15 nt, Homo sapiens
agacagugggaaaua

SEQ ID NO: 2055782 - RNA, 22 nt, Homo sapiens
agcaccuucccucucaccaucc

SEQ ID NO: 2055783 - RNA, 14 nt, Homo sapiens
ugcacucacgcuca

SEQ ID NO: 2055784 - RNA, 13 nt, Homo sapiens
auucccuuuccca

SEQ ID NO: 2055785 - RNA, 16 nt, Homo sapiens
auuucucuuccuaaau

SEQ ID NO: 2055786 - RNA, 12 nt, Homo sapiens
cuguaauaaaua

SEQ ID NO: 2055787 - RNA, 16 nt, Homo sapiens
cuuaaagaauuuucaa

SEQ ID NO: 2055788 - RNA, 20 nt, Homo sapiens
acugucuauuuucucaguca

SEQ ID NO: 2055789 - RNA, 14 nt, Homo sapiens
caguccuuccacac

SEQ ID NO: 2055790 - RNA, 18 nt, Homo sapiens
cagcaguggccuuugcaa

SEQ ID NO: 2055791 - RNA, 21 nt, Homo sapiens
gcaagccagggaugaagaaag

SEQ ID NO: 2055792 - RNA, 23 nt, Homo sapiens
uaacauuucauuaaccaaagaaa

SEQ ID NO: 2055793 - RNA, 14 nt, Homo sapiens
uucugagcacuguu

SEQ ID NO: 2055794 - RNA, 18 nt, Homo sapiens
augccuuggggaggacaa

SEQ ID NO: 2055795 - RNA, 18 nt, Homo sapiens
cauggaauggcagguguc

SEQ ID NO: 2055796 - RNA, 15 nt, Homo sapiens
agcaauccuccugcc

SEQ ID NO: 2055797 - RNA, 16 nt, Homo sapiens
agcaucacacuugucu

SEQ ID NO: 2055798 - RNA, 15 nt, Homo sapiens
ggagccagugcccac

SEQ ID NO: 2055799 - RNA, 21 nt, Homo sapiens
aacucagaaugcucuacuucu

SEQ ID NO: 2055800 - RNA, 23 nt, Homo sapiens
gugggggugccgcucucucugag

SEQ ID NO: 2055801 - RNA, 16 nt, Homo sapiens
ucuaaaacucauacaa

SEQ ID NO: 2055802 - RNA, 24 nt, Homo sapiens
uggggaccccaccccucaucagga

SEQ ID NO: 2055803 - RNA, 20 nt, Homo sapiens
uaccaaguuauaauagcauu

SEQ ID NO: 2055804 - RNA, 17 nt, Homo sapiens
auuguugguuaucuuaa

SEQ ID NO: 2055805 - RNA, 20 nt, Homo sapiens
agcacucuguaaaaugcacc

SEQ ID NO: 2055806 - RNA, 23 nt, Homo sapiens
uauaaauuuucccaaaacugaua

SEQ ID NO: 2055807 - RNA, 21 nt, Homo sapiens
auuuugguaaaucacacugaa

SEQ ID NO: 2055808 - RNA, 16 nt, Homo sapiens
gaugauagaucauaac

SEQ ID NO: 2055809 - RNA, 14 nt, Homo sapiens
agcgcuuucuggaa

SEQ ID NO: 2055810 - RNA, 15 nt, Homo sapiens
gccucauugauguca

SEQ ID NO: 2055811 - RNA, 13 nt, Homo sapiens
cagccaagaccau

SEQ ID NO: 2055812 - RNA, 20 nt, Homo sapiens
guucccucuuucuuucuuuu

SEQ ID NO: 2055813 - RNA, 19 nt, Homo sapiens
uggcugucucaaaccaagc

SEQ ID NO: 2055814 - RNA, 10 nt, Homo sapiens
cacugccaaa

SEQ ID NO: 2055815 - RNA, 14 nt, Homo sapiens
uuuaagaaauaacu

SEQ ID NO: 2055816 - RNA, 18 nt, Homo sapiens
aauucuaccuccuugugu

SEQ ID NO: 2055817 - RNA, 20 nt, Homo sapiens
cuggguuuguuuacagcaau

SEQ ID NO: 2055818 - RNA, 22 nt, Homo sapiens
gaaacaaauaauuugaacuuug

SEQ ID NO: 2055819 - RNA, 23 nt, Homo sapiens
uuucucaguaucaguauuuacau

SEQ ID NO: 2055820 - RNA, 15 nt, Homo sapiens
auucauaugcauauu

SEQ ID NO: 2055821 - RNA, 21 nt, Homo sapiens
uugcauaauuauauacuccuu

SEQ ID NO: 2055822 - RNA, 23 nt, Homo sapiens
ggcuucugugccugacucugugc

SEQ ID NO: 2055823 - RNA, 18 nt, Homo sapiens
auguuaccucugaauuua

SEQ ID NO: 2055824 - RNA, 20 nt, Homo sapiens
cuuuuauuucauucauaucc

SEQ ID NO: 2055825 - RNA, 14 nt, Homo sapiens
auuuaaguuucaca

SEQ ID NO: 2055826 - RNA, 19 nt, Homo sapiens
guguugccucuugcaaugc

SEQ ID NO: 2055827 - RNA, 19 nt, Homo sapiens
aauagauccagugcugagc

SEQ ID NO: 2055828 - RNA, 16 nt, Homo sapiens
cggccaccaugcugca

SEQ ID NO: 2055829 - RNA, 23 nt, Homo sapiens
acuugcuuuaccuuuucagggcu

SEQ ID NO: 2055830 - RNA, 20 nt, Homo sapiens
auuauguuuccuaacuguga

SEQ ID NO: 2055831 - RNA, 17 nt, Homo sapiens
aguggcuucugggagau

SEQ ID NO: 2055832 - RNA, 21 nt, Homo sapiens
ugaacaaagugaggagaauga

SEQ ID NO: 2055833 - RNA, 18 nt, Homo sapiens
gacccucgcccaacucca

SEQ ID NO: 2055834 - RNA, 18 nt, Homo sapiens
aucauucuaauuacaaag

SEQ ID NO: 2055835 - RNA, 12 nt, Homo sapiens
gacagcagagaa

SEQ ID NO: 2055836 - RNA, 16 nt, Homo sapiens
uauuuaaaugcaaagu

SEQ ID NO: 2055837 - RNA, 14 nt, Homo sapiens
uauuuaaccaaaga

SEQ ID NO: 2055838 - RNA, 19 nt, Homo sapiens
gaaauuauuagauugccaa

SEQ ID NO: 2055839 - RNA, 17 nt, Homo sapiens
aucggggccagaggcag

SEQ ID NO: 2055840 - RNA, 13 nt, Homo sapiens
aagaacagcucau

SEQ ID NO: 2055841 - RNA, 17 nt, Homo sapiens
auaucuaaaacauguag

SEQ ID NO: 2055842 - RNA, 18 nt, Homo sapiens
uggaugcauuucucuggg

SEQ ID NO: 2055843 - RNA, 21 nt, Homo sapiens
ccuucuucccucggggagcca

SEQ ID NO: 2055844 - RNA, 16 nt, Homo sapiens
caaccuggcaaaaaug

SEQ ID NO: 2055845 - RNA, 19 nt, Homo sapiens
ccuggugcucuaaugccaa

SEQ ID NO: 2055846 - RNA, 18 nt, Homo sapiens
cacgggcaugggcacucc

SEQ ID NO: 2055847 - RNA, 18 nt, Homo sapiens
cagccacuccccggcaug

SEQ ID NO: 2055848 - RNA, 17 nt, Homo sapiens
gaauaaaauugcacuuu

SEQ ID NO: 2055849 - RNA, 23 nt, Homo sapiens
gggugaccugcuuccccaaaggc

SEQ ID NO: 2055850 - RNA, 13 nt, Homo sapiens
caggauucccaga

SEQ ID NO: 2055851 - RNA, 14 nt, Homo sapiens
agagccacaggugc

SEQ ID NO: 2055852 - RNA, 14 nt, Homo sapiens
auggccagcaaaug

SEQ ID NO: 2055853 - RNA, 16 nt, Homo sapiens
caagauuuucuacuuu

SEQ ID NO: 2055854 - RNA, 21 nt, Homo sapiens
gucuugcgggucugucagggu

SEQ ID NO: 2055855 - RNA, 13 nt, Homo sapiens
cuuccugacccuc

SEQ ID NO: 2055856 - RNA, 14 nt, Homo sapiens
ugacaccuuucaua

SEQ ID NO: 2055857 - RNA, 23 nt, Homo sapiens
gcccaucuuucaagggaccucuc

SEQ ID NO: 2055858 - RNA, 16 nt, Homo sapiens
ucuuauuuauauauga

SEQ ID NO: 2055859 - RNA, 23 nt, Homo sapiens
gaaaaucaucaagaagggcugca

SEQ ID NO: 2055860 - RNA, 15 nt, Homo sapiens
uagggggugucucag

SEQ ID NO: 2055861 - RNA, 19 nt, Homo sapiens
auucuauaaaacacaucau

SEQ ID NO: 2055862 - RNA, 15 nt, Homo sapiens
uacuuuaucacuuuu

SEQ ID NO: 2055863 - RNA, 17 nt, Homo sapiens
aguauaacuaauuugcu

SEQ ID NO: 2055864 - RNA, 19 nt, Homo sapiens
uccaauuuggaaucuucuc

SEQ ID NO: 2055865 - RNA, 14 nt, Homo sapiens
ccacacuuuguaca

SEQ ID NO: 2055866 - RNA, 14 nt, Homo sapiens
gaucaaauguacau

SEQ ID NO: 2055867 - RNA, 14 nt, Homo sapiens
gcccuugucugaga

SEQ ID NO: 2055868 - RNA, 14 nt, Homo sapiens
cuaaaauguucuaa

SEQ ID NO: 2055869 - RNA, 22 nt, Homo sapiens
ucucauuauugagauucaucca

SEQ ID NO: 2055870 - RNA, 15 nt, Homo sapiens
ugaugggacaucaaa

SEQ ID NO: 2055871 - RNA, 12 nt, Homo sapiens
aaucaacucuaa

SEQ ID NO: 2055872 - RNA, 23 nt, Homo sapiens
gauuucagaagccaaguuuuucu

SEQ ID NO: 2055873 - RNA, 15 nt, Homo sapiens
gaaauggagaagcuc

SEQ ID NO: 2055874 - RNA, 16 nt, Homo sapiens
cucgcuccucaacccc

SEQ ID NO: 2055875 - RNA, 12 nt, Homo sapiens
cugaauccucau

SEQ ID NO: 2055876 - RNA, 22 nt, Homo sapiens
cccaguucacccugauuuagga

SEQ ID NO: 2055877 - RNA, 19 nt, Homo sapiens
aagaaaacaucuauucucu

SEQ ID NO: 2055878 - RNA, 24 nt, Homo sapiens
cuccuccagggagucucagcuuca

SEQ ID NO: 2055879 - RNA, 14 nt, Homo sapiens
cguccauggcacca

SEQ ID NO: 2055880 - RNA, 16 nt, Homo sapiens
uugccagcucuuccaa

SEQ ID NO: 2055881 - RNA, 13 nt, Homo sapiens
aacuuagaacuau

SEQ ID NO: 2055882 - RNA, 17 nt, Homo sapiens
acguacgucaacuguau

SEQ ID NO: 2055883 - RNA, 22 nt, Homo sapiens
gucacaacaacaacaacaaaaa

SEQ ID NO: 2055884 - RNA, 13 nt, Homo sapiens
ugaaaaguguccu

SEQ ID NO: 2055885 - RNA, 17 nt, Homo sapiens
ugugcucauuuugcaau

SEQ ID NO: 2055886 - RNA, 13 nt, Homo sapiens
acuaaaugaacau

SEQ ID NO: 2055887 - RNA, 23 nt, Homo sapiens
cagacagcuuacagaaugggaga

SEQ ID NO: 2055888 - RNA, 20 nt, Homo sapiens
caguguugccucuugcaaug

SEQ ID NO: 2055889 - RNA, 20 nt, Homo sapiens
ugagggacuggaaccaggga

SEQ ID NO: 2055890 - RNA, 15 nt, Homo sapiens
aaauaaaacuucaca

SEQ ID NO: 2055891 - RNA, 15 nt, Homo sapiens
cuuuaaaaaaacaca

SEQ ID NO: 2055892 - RNA, 18 nt, Homo sapiens
uuuacuaucacacaugaa

SEQ ID NO: 2055893 - RNA, 15 nt, Homo sapiens
cugucaauacagguu

SEQ ID NO: 2055894 - RNA, 16 nt, Homo sapiens
gcaugaaggaugccaa

SEQ ID NO: 2055895 - RNA, 12 nt, Homo sapiens
cucuguauuccg

SEQ ID NO: 2055896 - RNA, 20 nt, Homo sapiens
uguguauaaagccauuauuc

SEQ ID NO: 2055897 - RNA, 19 nt, Homo sapiens
cagcugugauuuggaaggg

SEQ ID NO: 2055898 - RNA, 23 nt, Homo sapiens
ccauaauucuaaguuauuuacuu

SEQ ID NO: 2055899 - RNA, 14 nt, Homo sapiens
uggccgcuucccua

SEQ ID NO: 2055900 - RNA, 21 nt, Homo sapiens
agcuugaauucauguuggucu

SEQ ID NO: 2055901 - RNA, 16 nt, Homo sapiens
auacaaaugcaucuuu

SEQ ID NO: 2055902 - RNA, 12 nt, Homo sapiens
guccacucccag

SEQ ID NO: 2055903 - RNA, 15 nt, Homo sapiens
aagaaugaugcuaug

SEQ ID NO: 2055904 - RNA, 16 nt, Homo sapiens
agaaaucuaagcugug

SEQ ID NO: 2055905 - RNA, 15 nt, Homo sapiens
cacugccugcuggaa

SEQ ID NO: 2055906 - RNA, 17 nt, Homo sapiens
augcccacaacuuguca

SEQ ID NO: 2055907 - RNA, 14 nt, Homo sapiens
aucaguaucagaau

SEQ ID NO: 2055908 - RNA, 23 nt, Homo sapiens
acucccaugagggagaugccaug

SEQ ID NO: 2055909 - RNA, 14 nt, Homo sapiens
cagcaccuccggga

SEQ ID NO: 2055910 - RNA, 19 nt, Homo sapiens
aucuauaaaaugacagauc

SEQ ID NO: 2055911 - RNA, 15 nt, Homo sapiens
cucaacaucucagga

SEQ ID NO: 2055912 - RNA, 15 nt, Homo sapiens
cucauguagccucaa

SEQ ID NO: 2055913 - RNA, 20 nt, Homo sapiens
ggcucccugaugacacccac

SEQ ID NO: 2055914 - RNA, 16 nt, Homo sapiens
cagaccugucgucucu

SEQ ID NO: 2055915 - RNA, 20 nt, Homo sapiens
aaaacgcuuaggccaugaug

SEQ ID NO: 2055916 - RNA, 16 nt, Homo sapiens
ucucagcaucgugcug

SEQ ID NO: 2055917 - RNA, 22 nt, Homo sapiens
gaauccaagugaacacuagcca

SEQ ID NO: 2055918 - RNA, 16 nt, Homo sapiens
ccacauaugcaaugac

SEQ ID NO: 2055919 - RNA, 22 nt, Homo sapiens
uggcccuuuccuuccagauccu

SEQ ID NO: 2055920 - RNA, 19 nt, Homo sapiens
ucaagguuuuagguucuaa

SEQ ID NO: 2055921 - RNA, 16 nt, Homo sapiens
agggaaacacagcagc

SEQ ID NO: 2055922 - RNA, 12 nt, Homo sapiens
caccguucugug

SEQ ID NO: 2055923 - RNA, 16 nt, Homo sapiens
auuaugagaggcaaug

SEQ ID NO: 2055924 - RNA, 18 nt, Homo sapiens
gaaggcaucugaguguga

SEQ ID NO: 2055925 - RNA, 23 nt, Homo sapiens
gacaagugggcagcauaaaguca

SEQ ID NO: 2055926 - RNA, 20 nt, Homo sapiens
caugccucucucaggccaaa

SEQ ID NO: 2055927 - RNA, 21 nt, Homo sapiens
ugcauguugcccuguugcugc

SEQ ID NO: 2055928 - RNA, 20 nt, Homo sapiens
acaauuguguauaacuggau

SEQ ID NO: 2055929 - RNA, 19 nt, Homo sapiens
guaacuugaagauauuuau

SEQ ID NO: 2055930 - RNA, 12 nt, Homo sapiens
aaaaaacauaua

SEQ ID NO: 2055931 - RNA, 16 nt, Homo sapiens
aucuucucucuugauu

SEQ ID NO: 2055932 - RNA, 13 nt, Homo sapiens
cuguccugagaug

SEQ ID NO: 2055933 - RNA, 19 nt, Homo sapiens
cccaggccccagacagggu

SEQ ID NO: 2055934 - RNA, 16 nt, Homo sapiens
aucuguccccugcuac

SEQ ID NO: 2055935 - RNA, 22 nt, Homo sapiens
gacacucuauaagauuccaaaa

SEQ ID NO: 2055936 - RNA, 14 nt, Homo sapiens
agaaacauccuguu

SEQ ID NO: 2055937 - RNA, 12 nt, Homo sapiens
uuguuagcuuuu

SEQ ID NO: 2055938 - RNA, 23 nt, Homo sapiens
ugcuaacucuguuauucuucaaa

SEQ ID NO: 2055939 - RNA, 23 nt, Homo sapiens
cucauguugaagccacugccuuc

SEQ ID NO: 2055940 - RNA, 20 nt, Homo sapiens
gaagaaagagcaacaaucca

SEQ ID NO: 2055941 - RNA, 17 nt, Homo sapiens
ggugagagugcagaaag

SEQ ID NO: 2055942 - RNA, 19 nt, Homo sapiens
gaccuccuccugcccuccc

SEQ ID NO: 2055943 - RNA, 18 nt, Homo sapiens
agacagaagucagguguc

SEQ ID NO: 2055944 - RNA, 14 nt, Homo sapiens
cucaggcacaccuu

SEQ ID NO: 2055945 - RNA, 21 nt, Homo sapiens
uuucagauaaauuucaauuag

SEQ ID NO: 2055946 - RNA, 21 nt, Homo sapiens
acaagagugagacuccaccuc

SEQ ID NO: 2055947 - RNA, 20 nt, Homo sapiens
ugccuuaguuguuaucaucu

SEQ ID NO: 2055948 - RNA, 21 nt, Homo sapiens
cugcuagugaagaaugcaugu

SEQ ID NO: 2055949 - RNA, 17 nt, Homo sapiens
gacggagucuugcucug

SEQ ID NO: 2055950 - RNA, 20 nt, Homo sapiens
gauuugccguaccaaucucu

SEQ ID NO: 2055951 - RNA, 12 nt, Homo sapiens
cuaaagccagca

SEQ ID NO: 2055952 - RNA, 13 nt, Homo sapiens
cucacagcauuug

SEQ ID NO: 2055953 - RNA, 16 nt, Homo sapiens
aguccaccugaggaac

SEQ ID NO: 2055954 - RNA, 22 nt, Homo sapiens
caaaggucagggacacaucccc

SEQ ID NO: 2055955 - RNA, 17 nt, Homo sapiens
cauaaacugugugcaga

SEQ ID NO: 2055956 - RNA, 15 nt, Homo sapiens
ugcagcaagcaauaa

SEQ ID NO: 2055957 - RNA, 23 nt, Homo sapiens
uguccugaaacaugaacccaaaa

SEQ ID NO: 2055958 - RNA, 18 nt, Homo sapiens
ccauucuaaaucaaggca

SEQ ID NO: 2055959 - RNA, 17 nt, Homo sapiens
ugacaaugcugccaugc

SEQ ID NO: 2055960 - RNA, 18 nt, Homo sapiens
aauuacuuguaucauuga

SEQ ID NO: 2055961 - RNA, 14 nt, Homo sapiens
cauaggugauccau

SEQ ID NO: 2055962 - RNA, 21 nt, Homo sapiens
uguggaccgaggaacaacuug

SEQ ID NO: 2055963 - RNA, 17 nt, Homo sapiens
ggagaccuggcacugga

SEQ ID NO: 2055964 - RNA, 12 nt, Homo sapiens
uauuuaagcaau

SEQ ID NO: 2055965 - RNA, 13 nt, Homo sapiens
caggggucacuga

SEQ ID NO: 2055966 - RNA, 13 nt, Homo sapiens
ggcuggucacucu

SEQ ID NO: 2055967 - RNA, 23 nt, Homo sapiens
uuauuuagcucugaagcaagagu

SEQ ID NO: 2055968 - RNA, 19 nt, Homo sapiens
uauagagucaaccaccaca

SEQ ID NO: 2055969 - RNA, 21 nt, Homo sapiens
acaguucuuugggccagacau

SEQ ID NO: 2055970 - RNA, 21 nt, Homo sapiens
aaauuuuaauguaaaauucau

SEQ ID NO: 2055971 - RNA, 17 nt, Homo sapiens
uuaaaacuugaaguagg

SEQ ID NO: 2055972 - RNA, 16 nt, Homo sapiens
cagcuuggcccuuucc

SEQ ID NO: 2055973 - RNA, 11 nt, Homo sapiens
uuucaaaaaga

SEQ ID NO: 2055974 - RNA, 15 nt, Homo sapiens
uuugcauugugugag

SEQ ID NO: 2055975 - RNA, 13 nt, Homo sapiens
agagaaugaucac

SEQ ID NO: 2055976 - RNA, 22 nt, Homo sapiens
uuuauaauuuuaaaauugcagc

SEQ ID NO: 2055977 - RNA, 18 nt, Homo sapiens
ccuucacuucugaccaca

SEQ ID NO: 2055978 - RNA, 13 nt, Homo sapiens
ucauauaccagca

SEQ ID NO: 2055979 - RNA, 21 nt, Homo sapiens
auauuuuuauucaaacuaccu

SEQ ID NO: 2055980 - RNA, 24 nt, Homo sapiens
aagugugcauuaccacacucagcu

SEQ ID NO: 2055981 - RNA, 23 nt, Homo sapiens
ucuuccuccgaggccaguaccuu

SEQ ID NO: 2055982 - RNA, 21 nt, Homo sapiens
uuuaaaaaaaaagucagagac

SEQ ID NO: 2055983 - RNA, 15 nt, Homo sapiens
uucccaauaucaugu

SEQ ID NO: 2055984 - RNA, 18 nt, Homo sapiens
auaggguauauuuuccua

SEQ ID NO: 2055985 - RNA, 18 nt, Homo sapiens
gucccuggaaccuucuag

SEQ ID NO: 2055986 - RNA, 13 nt, Homo sapiens
aguaauugugaaa

SEQ ID NO: 2055987 - RNA, 20 nt, Homo sapiens
cacuacaccacacacaacag

SEQ ID NO: 2055988 - RNA, 23 nt, Homo sapiens
auguuucaaacuuuggaacaaga

SEQ ID NO: 2055989 - RNA, 17 nt, Homo sapiens
gcaaggacggccuucaa

SEQ ID NO: 2055990 - RNA, 15 nt, Homo sapiens
ccaguauaaaacacc

SEQ ID NO: 2055991 - RNA, 20 nt, Homo sapiens
uaaauuuuaaaaaggaauuu

SEQ ID NO: 2055992 - RNA, 21 nt, Homo sapiens
uggaaauuccaggaaccaaaa

SEQ ID NO: 2055993 - RNA, 20 nt, Homo sapiens
uaacaccgucccagggcucu

SEQ ID NO: 2055994 - RNA, 23 nt, Homo sapiens
gggguaccuuaagagacacucca

SEQ ID NO: 2055995 - RNA, 18 nt, Homo sapiens
ugaacuagggaagcucag

SEQ ID NO: 2055996 - RNA, 23 nt, Homo sapiens
cauuucuacuaugaucagaagaa

SEQ ID NO: 2055997 - RNA, 19 nt, Homo sapiens
ucaggagaguguauaugaa

SEQ ID NO: 2055998 - RNA, 24 nt, Homo sapiens
acauggcuaaauacaauggguauc

SEQ ID NO: 2055999 - RNA, 19 nt, Homo sapiens
uauuccaaguacagaauua

SEQ ID NO: 2056000 - RNA, 13 nt, Homo sapiens
gcauggccuuagc

SEQ ID NO: 2056001 - RNA, 20 nt, Homo sapiens
gaagaaguuuaaaaaaccau

SEQ ID NO: 2056002 - RNA, 15 nt, Homo sapiens
cagggacagagccau

SEQ ID NO: 2056003 - RNA, 22 nt, Homo sapiens
ugccguguccaagggccgugcc

SEQ ID NO: 2056004 - RNA, 16 nt, Homo sapiens
aagagcaauauuccag

SEQ ID NO: 2056005 - RNA, 18 nt, Homo sapiens
ucaggcucugaaucucuc

SEQ ID NO: 2056006 - RNA, 14 nt, Homo sapiens
ggaagccucugggu

SEQ ID NO: 2056007 - RNA, 16 nt, Homo sapiens
acaugggagcagucca

SEQ ID NO: 2056008 - RNA, 16 nt, Homo sapiens
ccuuuacugugcuuau

SEQ ID NO: 2056009 - RNA, 15 nt, Homo sapiens
ugcagugucuuguaa

SEQ ID NO: 2056010 - RNA, 18 nt, Homo sapiens
cugacagauacauagaug

SEQ ID NO: 2056011 - RNA, 11 nt, Homo sapiens
aaauaucucaa

SEQ ID NO: 2056012 - RNA, 15 nt, Homo sapiens
ugguucagugccuuc

SEQ ID NO: 2056013 - RNA, 19 nt, Homo sapiens
agaugacuggaaacaagga

SEQ ID NO: 2056014 - RNA, 19 nt, Homo sapiens
accccuacagccugcacac

SEQ ID NO: 2056015 - RNA, 13 nt, Homo sapiens
gccaagugccaua

SEQ ID NO: 2056016 - RNA, 19 nt, Homo sapiens
cagcccuagaggcgagcca

SEQ ID NO: 2056017 - RNA, 17 nt, Homo sapiens
aacuugcucaagugcag

SEQ ID NO: 2056018 - RNA, 20 nt, Homo sapiens
acuuggcuacacagggaugu

SEQ ID NO: 2056019 - RNA, 17 nt, Homo sapiens
agagccacgcuggccuu

SEQ ID NO: 2056020 - RNA, 15 nt, Homo sapiens
cuuagaaauaacaga

SEQ ID NO: 2056021 - RNA, 21 nt, Homo sapiens
cacugcugaggagucugagga

SEQ ID NO: 2056022 - RNA, 23 nt, Homo sapiens
gaauuuccucaucccuccaucuc

SEQ ID NO: 2056023 - RNA, 22 nt, Homo sapiens
aacagauaaucccuguauuuca

SEQ ID NO: 2056024 - RNA, 19 nt, Homo sapiens
cuaaaaaaauaaacaaagu

SEQ ID NO: 2056025 - RNA, 15 nt, Homo sapiens
aaagaugacaaaaga

SEQ ID NO: 2056026 - RNA, 18 nt, Homo sapiens
auuucauuaugcuuugaa

SEQ ID NO: 2056027 - RNA, 21 nt, Homo sapiens
gggugaccuccggccaggugc

SEQ ID NO: 2056028 - RNA, 15 nt, Homo sapiens
agugugacugaucuc

SEQ ID NO: 2056029 - RNA, 19 nt, Homo sapiens
ccaugccccacucugcuga

SEQ ID NO: 2056030 - RNA, 13 nt, Homo sapiens
ccaguaucuugaa

SEQ ID NO: 2056031 - RNA, 15 nt, Homo sapiens
cuauguucaaagacu

SEQ ID NO: 2056032 - RNA, 18 nt, Homo sapiens
uggacucuguggggccac

SEQ ID NO: 2056033 - RNA, 13 nt, Homo sapiens
uuacaauugcagu

SEQ ID NO: 2056034 - RNA, 19 nt, Homo sapiens
caccucagccccacugaca

SEQ ID NO: 2056035 - RNA, 15 nt, Homo sapiens
agacuacagccagaa

SEQ ID NO: 2056036 - RNA, 22 nt, Homo sapiens
ucagucacagccaccccugaga

SEQ ID NO: 2056037 - RNA, 19 nt, Homo sapiens
uguuuauccuuagcucaca

SEQ ID NO: 2056038 - RNA, 20 nt, Homo sapiens
ucaaaguguuuucucugaac

SEQ ID NO: 2056039 - RNA, 22 nt, Homo sapiens
ccaacugaguguuauuugcaca

SEQ ID NO: 2056040 - RNA, 20 nt, Homo sapiens
guuugugcucuacuguuacu

SEQ ID NO: 2056041 - RNA, 17 nt, Homo sapiens
cucgccuaggccuguga

SEQ ID NO: 2056042 - RNA, 15 nt, Homo sapiens
gccucccauguucaa

SEQ ID NO: 2056043 - RNA, 21 nt, Homo sapiens
ggaaaagaaauugcaugcagu

SEQ ID NO: 2056044 - RNA, 21 nt, Homo sapiens
ucuuguaguaagaaacaucca

SEQ ID NO: 2056045 - RNA, 17 nt, Homo sapiens
uaaagaucaugacauau

SEQ ID NO: 2056046 - RNA, 20 nt, Homo sapiens
cuagagggagaagacugugc

SEQ ID NO: 2056047 - RNA, 21 nt, Homo sapiens
uacuucccaauugccacauuu

SEQ ID NO: 2056048 - RNA, 17 nt, Homo sapiens
guagcccagcacuguga

SEQ ID NO: 2056049 - RNA, 15 nt, Homo sapiens
ccucaagugaucugc

SEQ ID NO: 2056050 - RNA, 20 nt, Homo sapiens
ucaauuacggacucuggaua

SEQ ID NO: 2056051 - RNA, 20 nt, Homo sapiens
uccuaggccacaccaucucc

SEQ ID NO: 2056052 - RNA, 15 nt, Homo sapiens
acauuccaauuugca

SEQ ID NO: 2056053 - RNA, 20 nt, Homo sapiens
augaauagcgaaucaucuca

SEQ ID NO: 2056054 - RNA, 19 nt, Homo sapiens
caggcagauaacugcugua

SEQ ID NO: 2056055 - RNA, 16 nt, Homo sapiens
uggucuccaguggaag

SEQ ID NO: 2056056 - RNA, 22 nt, Homo sapiens
gucaaccccaaguuaguucaau

SEQ ID NO: 2056057 - RNA, 23 nt, Homo sapiens
gucaaggcagggaaggggccaug

SEQ ID NO: 2056058 - RNA, 14 nt, Homo sapiens
acuuggagauuuau

SEQ ID NO: 2056059 - RNA, 14 nt, Homo sapiens
cagauauauagaag

SEQ ID NO: 2056060 - RNA, 19 nt, Homo sapiens
cccagucuggaaugcagug

SEQ ID NO: 2056061 - RNA, 16 nt, Homo sapiens
aaguggggaaugcaac

SEQ ID NO: 2056062 - RNA, 17 nt, Homo sapiens
ggaugaaagcaaucuga

SEQ ID NO: 2056063 - RNA, 18 nt, Homo sapiens
gucagucugggugucuca

SEQ ID NO: 2056064 - RNA, 15 nt, Homo sapiens
cuuuucccacucuca

SEQ ID NO: 2056065 - RNA, 14 nt, Homo sapiens
uauucucuaauaaa

SEQ ID NO: 2056066 - RNA, 13 nt, Homo sapiens
aagcuccucguga

SEQ ID NO: 2056067 - RNA, 12 nt, Homo sapiens
ugugcuuucaug

SEQ ID NO: 2056068 - RNA, 15 nt, Homo sapiens
gucuuggccugccuc

SEQ ID NO: 2056069 - RNA, 17 nt, Homo sapiens
auccaggaaagaugucc

SEQ ID NO: 2056070 - RNA, 21 nt, Homo sapiens
caugaaaaaauacaggugucu

SEQ ID NO: 2056071 - RNA, 18 nt, Homo sapiens
aaaaguggauggaagugu

SEQ ID NO: 2056072 - RNA, 20 nt, Homo sapiens
ccccuggugggacaacaaag

SEQ ID NO: 2056073 - RNA, 16 nt, Homo sapiens
accugcccugggccac

SEQ ID NO: 2056074 - RNA, 16 nt, Homo sapiens
auucuucaagauccca

SEQ ID NO: 2056075 - RNA, 18 nt, Homo sapiens
agaaacacacuuuugcac

SEQ ID NO: 2056076 - RNA, 13 nt, Homo sapiens
uacauucuagccu

SEQ ID NO: 2056077 - RNA, 17 nt, Homo sapiens
ugauaaguuucauacuc

SEQ ID NO: 2056078 - RNA, 16 nt, Homo sapiens
accuugaugugccugu

SEQ ID NO: 2056079 - RNA, 18 nt, Homo sapiens
aagaaaaugaugaugaca

SEQ ID NO: 2056080 - RNA, 18 nt, Homo sapiens
uguaaaggaaacauauuu

SEQ ID NO: 2056081 - RNA, 22 nt, Homo sapiens
uuucuggggaugucccagggug

SEQ ID NO: 2056082 - RNA, 18 nt, Homo sapiens
acuguucugauuauguaa

SEQ ID NO: 2056083 - RNA, 18 nt, Homo sapiens
gcuuaggaugugugcaug

SEQ ID NO: 2056084 - RNA, 13 nt, Homo sapiens
agacaacacacac

SEQ ID NO: 2056085 - RNA, 19 nt, Homo sapiens
cuuuuugcguacacagaga

SEQ ID NO: 2056086 - RNA, 17 nt, Homo sapiens
aaaaugaggaauccaaa

SEQ ID NO: 2056087 - RNA, 12 nt, Homo sapiens
gggggauaccag

SEQ ID NO: 2056088 - RNA, 21 nt, Homo sapiens
gggcucccguggccuguagaa

SEQ ID NO: 2056089 - RNA, 14 nt, Homo sapiens
cagcaaaaugugaa

SEQ ID NO: 2056090 - RNA, 17 nt, Homo sapiens
aaucccauuccugggcu

SEQ ID NO: 2056091 - RNA, 18 nt, Homo sapiens
uccacccuguccuaugac

SEQ ID NO: 2056092 - RNA, 14 nt, Homo sapiens
aaacuauauucuca

SEQ ID NO: 2056093 - RNA, 22 nt, Homo sapiens
cucaacacccugggcagcuaca

SEQ ID NO: 2056094 - RNA, 23 nt, Homo sapiens
ucaguuuuuuuuuauacacugua

SEQ ID NO: 2056095 - RNA, 16 nt, Homo sapiens
cuggcccuuggggaga

SEQ ID NO: 2056096 - RNA, 13 nt, Homo sapiens
uucccaagccaug

SEQ ID NO: 2056097 - RNA, 17 nt, Homo sapiens
ggcucacuacaugggcc

SEQ ID NO: 2056098 - RNA, 14 nt, Homo sapiens
gugugagcuaugca

SEQ ID NO: 2056099 - RNA, 18 nt, Homo sapiens
ccgcugggagaaaagcca

SEQ ID NO: 2056100 - RNA, 11 nt, Homo sapiens
caaaugcaguc

SEQ ID NO: 2056101 - RNA, 14 nt, Homo sapiens
ccaauaaagaaauu

SEQ ID NO: 2056102 - RNA, 17 nt, Homo sapiens
cuggaaaaaaugagccg

SEQ ID NO: 2056103 - RNA, 22 nt, Homo sapiens
gcucggggcccccgcagcagca

SEQ ID NO: 2056104 - RNA, 22 nt, Homo sapiens
aacaucacugucuugccagauu

SEQ ID NO: 2056105 - RNA, 19 nt, Homo sapiens
aucuucuuagcucaucuua

SEQ ID NO: 2056106 - RNA, 13 nt, Homo sapiens
aggccucagggag

SEQ ID NO: 2056107 - RNA, 18 nt, Homo sapiens
augccauguuugcucuaa

SEQ ID NO: 2056108 - RNA, 12 nt, Homo sapiens
augaccaaaaac

SEQ ID NO: 2056109 - RNA, 23 nt, Homo sapiens
caggcugagaacucguucaccuc

SEQ ID NO: 2056110 - RNA, 18 nt, Homo sapiens
gagcucagccgugcacuc

SEQ ID NO: 2056111 - RNA, 16 nt, Homo sapiens
uacacaacuuagaaac

SEQ ID NO: 2056112 - RNA, 13 nt, Homo sapiens
uauaauuacuuaa

SEQ ID NO: 2056113 - RNA, 17 nt, Homo sapiens
cccuguccuuugcaauu

SEQ ID NO: 2056114 - RNA, 16 nt, Homo sapiens
cucuccuuguucugau

SEQ ID NO: 2056115 - RNA, 15 nt, Homo sapiens
uaagugcaacugcaa

SEQ ID NO: 2056116 - RNA, 16 nt, Homo sapiens
uuuagccagugacuuu

SEQ ID NO: 2056117 - RNA, 15 nt, Homo sapiens
aagaaacacuuucag

SEQ ID NO: 2056118 - RNA, 21 nt, Homo sapiens
uggaauacuugaaaaccucau

SEQ ID NO: 2056119 - RNA, 14 nt, Homo sapiens
auuauaaguugacc

SEQ ID NO: 2056120 - RNA, 17 nt, Homo sapiens
accuuccaacacuccau

SEQ ID NO: 2056121 - RNA, 11 nt, Homo sapiens
uucaauaacaa

SEQ ID NO: 2056122 - RNA, 13 nt, Homo sapiens
ggugccugggaug

SEQ ID NO: 2056123 - RNA, 21 nt, Homo sapiens
acucaaggacagccaccaaga

SEQ ID NO: 2056124 - RNA, 17 nt, Homo sapiens
agccuaaccccauuccu

SEQ ID NO: 2056125 - RNA, 21 nt, Homo sapiens
aaaaagcugcuauccaaugau

SEQ ID NO: 2056126 - RNA, 16 nt, Homo sapiens
ucaaacuccugagcuc

SEQ ID NO: 2056127 - RNA, 12 nt, Homo sapiens
accuuugucaac

SEQ ID NO: 2056128 - RNA, 23 nt, Homo sapiens
ugugagugaccucacuucuggca

SEQ ID NO: 2056129 - RNA, 13 nt, Homo sapiens
ugacuccaagaac

SEQ ID NO: 2056130 - RNA, 18 nt, Homo sapiens
caaagaacuauguaaaca

SEQ ID NO: 2056131 - RNA, 16 nt, Homo sapiens
cagauggggaaacuga

SEQ ID NO: 2056132 - RNA, 11 nt, Homo sapiens
uuuugauugcc

SEQ ID NO: 2056133 - RNA, 12 nt, Homo sapiens
cacuuacuauug

SEQ ID NO: 2056134 - RNA, 21 nt, Homo sapiens
ugcaaaaaaaaaaaaagcaau

SEQ ID NO: 2056135 - RNA, 14 nt, Homo sapiens
aaauaccauguaca

SEQ ID NO: 2056136 - RNA, 14 nt, Homo sapiens
acaacuuauaauua

SEQ ID NO: 2056137 - RNA, 15 nt, Homo sapiens
augggaaccagaaua

SEQ ID NO: 2056138 - RNA, 18 nt, Homo sapiens
aagcauuucccccaggga

SEQ ID NO: 2056139 - RNA, 14 nt, Homo sapiens
caaccccaccacuu

SEQ ID NO: 2056140 - RNA, 18 nt, Homo sapiens
cucuuccccuugcccuug

SEQ ID NO: 2056141 - RNA, 16 nt, Homo sapiens
uuaauucacucccaca

SEQ ID NO: 2056142 - RNA, 13 nt, Homo sapiens
cuacugugugcca

SEQ ID NO: 2056143 - RNA, 13 nt, Homo sapiens
ugccugugcuaca

SEQ ID NO: 2056144 - RNA, 12 nt, Homo sapiens
ccaguuaacugu

SEQ ID NO: 2056145 - RNA, 20 nt, Homo sapiens
agcguucuaaauaugaauga

SEQ ID NO: 2056146 - RNA, 17 nt, Homo sapiens
auaacuuagguggcaag

SEQ ID NO: 2056147 - RNA, 17 nt, Homo sapiens
ugaaguaauuugccuaa

SEQ ID NO: 2056148 - RNA, 17 nt, Homo sapiens
ucccaugugcugagaac

SEQ ID NO: 2056149 - RNA, 19 nt, Homo sapiens
cuggauuucugguucugau

SEQ ID NO: 2056150 - RNA, 19 nt, Homo sapiens
ggauaccuuaauucuuugu

SEQ ID NO: 2056151 - RNA, 17 nt, Homo sapiens
uaugcccauuuccuuga

SEQ ID NO: 2056152 - RNA, 16 nt, Homo sapiens
ucugggggacagagaa

SEQ ID NO: 2056153 - RNA, 22 nt, Homo sapiens
cuggcugcuuuguucaaugcua

SEQ ID NO: 2056154 - RNA, 14 nt, Homo sapiens
aucaaaaacacucu

SEQ ID NO: 2056155 - RNA, 20 nt, Homo sapiens
ggaguggggaagugugucaa

SEQ ID NO: 2056156 - RNA, 15 nt, Homo sapiens
cugcccggcacuggg

SEQ ID NO: 2056157 - RNA, 13 nt, Homo sapiens
acgccuccccaau

SEQ ID NO: 2056158 - RNA, 22 nt, Homo sapiens
cuguggaacccagcaguucugu

SEQ ID NO: 2056159 - RNA, 15 nt, Homo sapiens
cuugccuaucaaaga

SEQ ID NO: 2056160 - RNA, 18 nt, Homo sapiens
agggcuagcaucccugag

SEQ ID NO: 2056161 - RNA, 19 nt, Homo sapiens
agcuaugacuuaacauagc

SEQ ID NO: 2056162 - RNA, 21 nt, Homo sapiens
agacuggaaguucauaccuaa

SEQ ID NO: 2056163 - RNA, 23 nt, Homo sapiens
aagaacaugcuauccaaucucau

SEQ ID NO: 2056164 - RNA, 22 nt, Homo sapiens
caucagacagguaaaugggcag

SEQ ID NO: 2056165 - RNA, 17 nt, Homo sapiens
auaugguuuuauuuccu

SEQ ID NO: 2056166 - RNA, 21 nt, Homo sapiens
ggaucguugucccuacaggag

SEQ ID NO: 2056167 - RNA, 12 nt, Homo sapiens
augccugggaau

SEQ ID NO: 2056168 - RNA, 19 nt, Homo sapiens
uuagaagauagaugcacuu

SEQ ID NO: 2056169 - RNA, 21 nt, Homo sapiens
auuaauuauauuucuacagag

SEQ ID NO: 2056170 - RNA, 15 nt, Homo sapiens
cuaugcagaggccug

SEQ ID NO: 2056171 - RNA, 14 nt, Homo sapiens
agccugugauuaac

SEQ ID NO: 2056172 - RNA, 20 nt, Homo sapiens
cagaagaccucccugugaga

SEQ ID NO: 2056173 - RNA, 17 nt, Homo sapiens
augagaacaaacagauc

SEQ ID NO: 2056174 - RNA, 18 nt, Homo sapiens
aaggagugcccgccuuga

SEQ ID NO: 2056175 - RNA, 18 nt, Homo sapiens
cuguacauguucuuguca

SEQ ID NO: 2056176 - RNA, 18 nt, Homo sapiens
caucugggugcccugaaa

SEQ ID NO: 2056177 - RNA, 21 nt, Homo sapiens
agggaagugacaggacuuuca

SEQ ID NO: 2056178 - RNA, 21 nt, Homo sapiens
acuugcaucguggagacaggg

SEQ ID NO: 2056179 - RNA, 15 nt, Homo sapiens
gaccucuacaagcaa

SEQ ID NO: 2056180 - RNA, 16 nt, Homo sapiens
gaaauaaaccuggaga

SEQ ID NO: 2056181 - RNA, 18 nt, Homo sapiens
acucauagggugcucuga

SEQ ID NO: 2056182 - RNA, 15 nt, Homo sapiens
aaaaaugcaugauaa

SEQ ID NO: 2056183 - RNA, 23 nt, Homo sapiens
gaaacguauucaaacaauuugaa

SEQ ID NO: 2056184 - RNA, 19 nt, Homo sapiens
ccacuuccccuccuacccc

SEQ ID NO: 2056185 - RNA, 20 nt, Homo sapiens
ugcugcccugcucuggggau

SEQ ID NO: 2056186 - RNA, 16 nt, Homo sapiens
aauugcuucaagcauu

SEQ ID NO: 2056187 - RNA, 14 nt, Homo sapiens
ugggguggggucau

SEQ ID NO: 2056188 - RNA, 14 nt, Homo sapiens
uccaguuccgggag

SEQ ID NO: 2056189 - RNA, 13 nt, Homo sapiens
ucugacaggugaa

SEQ ID NO: 2056190 - RNA, 14 nt, Homo sapiens
aucuaaaaguguca

SEQ ID NO: 2056191 - RNA, 20 nt, Homo sapiens
uuaucuuauuuaauuuuugc

SEQ ID NO: 2056192 - RNA, 12 nt, Homo sapiens
uugcaugggcua

SEQ ID NO: 2056193 - RNA, 15 nt, Homo sapiens
aaaguauaacauguc

SEQ ID NO: 2056194 - RNA, 17 nt, Homo sapiens
cccauuggugaccugcg

SEQ ID NO: 2056195 - RNA, 12 nt, Homo sapiens
agcagacacugc

SEQ ID NO: 2056196 - RNA, 16 nt, Homo sapiens
cugcacacaaucuagc

SEQ ID NO: 2056197 - RNA, 14 nt, Homo sapiens
acugaaacuucccu

SEQ ID NO: 2056198 - RNA, 13 nt, Homo sapiens
uuuagucugugua

SEQ ID NO: 2056199 - RNA, 18 nt, Homo sapiens
guauuauucuguuuugca

SEQ ID NO: 2056200 - RNA, 14 nt, Homo sapiens
cuuuccccaaagac

SEQ ID NO: 2056201 - RNA, 20 nt, Homo sapiens
uccuugucaacaaagugcuu

SEQ ID NO: 2056202 - RNA, 13 nt, Homo sapiens
agucauucagauu

SEQ ID NO: 2056203 - RNA, 15 nt, Homo sapiens
ggaauuaagugaaag

SEQ ID NO: 2056204 - RNA, 17 nt, Homo sapiens
gaaaagagcacuucaca

SEQ ID NO: 2056205 - RNA, 14 nt, Homo sapiens
uagguuuuguacaa

SEQ ID NO: 2056206 - RNA, 21 nt, Homo sapiens
caacauggaaaaauccuguca

SEQ ID NO: 2056207 - RNA, 16 nt, Homo sapiens
auaaaaaacauauaca

SEQ ID NO: 2056208 - RNA, 13 nt, Homo sapiens
cuuccuugcuaau

SEQ ID NO: 2056209 - RNA, 11 nt, Homo sapiens
gcugugccacc

SEQ ID NO: 2056210 - RNA, 23 nt, Homo sapiens
auggaagauuagagguuugucaa

SEQ ID NO: 2056211 - RNA, 16 nt, Homo sapiens
accaauuaagcagcuu

SEQ ID NO: 2056212 - RNA, 20 nt, Homo sapiens
uuuaagcaaauaaacuguaa

SEQ ID NO: 2056213 - RNA, 20 nt, Homo sapiens
aguguacauaugugcuggaa

SEQ ID NO: 2056214 - RNA, 14 nt, Homo sapiens
aaccuuaccaaaaa

SEQ ID NO: 2056215 - RNA, 15 nt, Homo sapiens
ugaguugcacauuaa

SEQ ID NO: 2056216 - RNA, 13 nt, Homo sapiens
ugccaucuuuauc

SEQ ID NO: 2056217 - RNA, 22 nt, Homo sapiens
ggaguacaaaacaaucucucaa

SEQ ID NO: 2056218 - RNA, 16 nt, Homo sapiens
uaaaagauaaguuugu

SEQ ID NO: 2056219 - RNA, 21 nt, Homo sapiens
agggggcgcuggagcuuccaa

SEQ ID NO: 2056220 - RNA, 21 nt, Homo sapiens
gacggcccucaucuaugagga

SEQ ID NO: 2056221 - RNA, 15 nt, Homo sapiens
aaagggcuugggaga

SEQ ID NO: 2056222 - RNA, 14 nt, Homo sapiens
cgggcacggucaca

SEQ ID NO: 2056223 - RNA, 13 nt, Homo sapiens
uacaaucuggcuc

SEQ ID NO: 2056224 - RNA, 14 nt, Homo sapiens
caccuccaugucau

SEQ ID NO: 2056225 - RNA, 17 nt, Homo sapiens
cccauugcucuaugaaa

SEQ ID NO: 2056226 - RNA, 18 nt, Homo sapiens
auuucaaccagcacauuc

SEQ ID NO: 2056227 - RNA, 19 nt, Homo sapiens
caaauauuuugucacugcu

SEQ ID NO: 2056228 - RNA, 14 nt, Homo sapiens
auacuacuguguaa

SEQ ID NO: 2056229 - RNA, 18 nt, Homo sapiens
acugaaugaccacuugau

SEQ ID NO: 2056230 - RNA, 21 nt, Homo sapiens
augcauguaauggacuaugca

SEQ ID NO: 2056231 - RNA, 11 nt, Homo sapiens
acaaaccaccc

SEQ ID NO: 2056232 - RNA, 11 nt, Homo sapiens
caaaaccaaac

SEQ ID NO: 2056233 - RNA, 21 nt, Homo sapiens
ucucucagugaacugugaggg

SEQ ID NO: 2056234 - RNA, 15 nt, Homo sapiens
uuugaagaguacaaa

SEQ ID NO: 2056235 - RNA, 14 nt, Homo sapiens
uuaagaugggcaua

SEQ ID NO: 2056236 - RNA, 14 nt, Homo sapiens
gguaaagugcaaug

SEQ ID NO: 2056237 - RNA, 14 nt, Homo sapiens
gcuccaagaauuuc

SEQ ID NO: 2056238 - RNA, 15 nt, Homo sapiens
gaaaguaugugauau

SEQ ID NO: 2056239 - RNA, 22 nt, Homo sapiens
aaggcuucaauuuauugcacaa

SEQ ID NO: 2056240 - RNA, 22 nt, Homo sapiens
cggacuuccuuuaggaucucag

SEQ ID NO: 2056241 - RNA, 21 nt, Homo sapiens
augggggacaggauuuggcca

SEQ ID NO: 2056242 - RNA, 13 nt, Homo sapiens
uguuccaccuccc

SEQ ID NO: 2056243 - RNA, 19 nt, Homo sapiens
gaggcaggggacaagggag

SEQ ID NO: 2056244 - RNA, 16 nt, Homo sapiens
uaaaaagauaaucuca

SEQ ID NO: 2056245 - RNA, 13 nt, Homo sapiens
aucucugucacau

SEQ ID NO: 2056246 - RNA, 21 nt, Homo sapiens
uugcaaauauugguuaguauu

SEQ ID NO: 2056247 - RNA, 15 nt, Homo sapiens
gaagauggacauuuu

SEQ ID NO: 2056248 - RNA, 16 nt, Homo sapiens
ucacuaaggacuuaaa

SEQ ID NO: 2056249 - RNA, 12 nt, Homo sapiens
cagucucagucc

SEQ ID NO: 2056250 - RNA, 13 nt, Homo sapiens
uuuauuucucggg

SEQ ID NO: 2056251 - RNA, 12 nt, Homo sapiens
ugacacuauuca

SEQ ID NO: 2056252 - RNA, 22 nt, Homo sapiens
caaauugugaagauuucaugga

SEQ ID NO: 2056253 - RNA, 18 nt, Homo sapiens
gauaucaccuucuucccc

SEQ ID NO: 2056254 - RNA, 22 nt, Homo sapiens
agagggaggcacguaggaacaa

SEQ ID NO: 2056255 - RNA, 16 nt, Homo sapiens
gccagccuacacugcc

SEQ ID NO: 2056256 - RNA, 21 nt, Homo sapiens
cucacauuagaucuaguuacu

SEQ ID NO: 2056257 - RNA, 23 nt, Homo sapiens
accuuuucucgcugaaagcacua

SEQ ID NO: 2056258 - RNA, 12 nt, Homo sapiens
ggugcguggcug

SEQ ID NO: 2056259 - RNA, 14 nt, Homo sapiens
ugaaaacaguguga

SEQ ID NO: 2056260 - RNA, 21 nt, Homo sapiens
aaccagggggaagcaccagcc

SEQ ID NO: 2056261 - RNA, 19 nt, Homo sapiens
ugacacgccuaaggucaca

SEQ ID NO: 2056262 - RNA, 16 nt, Homo sapiens
cgacaccacugggaac

SEQ ID NO: 2056263 - RNA, 14 nt, Homo sapiens
ucaucugguuguga

SEQ ID NO: 2056264 - RNA, 20 nt, Homo sapiens
uaauggacauugacuuguga

SEQ ID NO: 2056265 - RNA, 12 nt, Homo sapiens
gaugaaggugaa

SEQ ID NO: 2056266 - RNA, 16 nt, Homo sapiens
agcuccaccacuuccu

SEQ ID NO: 2056267 - RNA, 18 nt, Homo sapiens
ugaggaugcagagucagc

SEQ ID NO: 2056268 - RNA, 17 nt, Homo sapiens
cuagggaggaccuuauc

SEQ ID NO: 2056269 - RNA, 15 nt, Homo sapiens
ggcucuucucauuuc

SEQ ID NO: 2056270 - RNA, 14 nt, Homo sapiens
aggauucuauauca

SEQ ID NO: 2056271 - RNA, 22 nt, Homo sapiens
aucacuaacauuauauugcaau

SEQ ID NO: 2056272 - RNA, 18 nt, Homo sapiens
cagcacuuguguugucug

SEQ ID NO: 2056273 - RNA, 11 nt, Homo sapiens
uagcucaggug

SEQ ID NO: 2056274 - RNA, 22 nt, Homo sapiens
guccaacauuccuuguuuguaa

SEQ ID NO: 2056275 - RNA, 11 nt, Homo sapiens
aauacugaugu

SEQ ID NO: 2056276 - RNA, 15 nt, Homo sapiens
uguaugucugccuaa

SEQ ID NO: 2056277 - RNA, 15 nt, Homo sapiens
gccugcaaacuggga

SEQ ID NO: 2056278 - RNA, 20 nt, Homo sapiens
ugcacuuucaggaacacucu

SEQ ID NO: 2056279 - RNA, 16 nt, Homo sapiens
uucuacacauuucauc

SEQ ID NO: 2056280 - RNA, 13 nt, Homo sapiens
uuauccugcauuu

SEQ ID NO: 2056281 - RNA, 11 nt, Homo sapiens
ggaaaauggau

SEQ ID NO: 2056282 - RNA, 13 nt, Homo sapiens
caagugcuaccuu

SEQ ID NO: 2056283 - RNA, 20 nt, Homo sapiens
cuucaaugaacugugcuuuu

SEQ ID NO: 2056284 - RNA, 12 nt, Homo sapiens
gacuauggagcu

SEQ ID NO: 2056285 - RNA, 19 nt, Homo sapiens
cauucauccaacagaguua

SEQ ID NO: 2056286 - RNA, 12 nt, Homo sapiens
caugaugaauga

SEQ ID NO: 2056287 - RNA, 19 nt, Homo sapiens
auugaauuuacauauagcu

SEQ ID NO: 2056288 - RNA, 13 nt, Homo sapiens
ccugggaacauca

SEQ ID NO: 2056289 - RNA, 18 nt, Homo sapiens
aagcaugaucacagcuca

SEQ ID NO: 2056290 - RNA, 21 nt, Homo sapiens
gccaggauggucucgaucucc

SEQ ID NO: 2056291 - RNA, 17 nt, Homo sapiens
cuuugcuauggggacau

SEQ ID NO: 2056292 - RNA, 22 nt, Homo sapiens
guauaauuugaggugaaauuca

SEQ ID NO: 2056293 - RNA, 20 nt, Homo sapiens
ccagcccuauggaagucuca

SEQ ID NO: 2056294 - RNA, 19 nt, Homo sapiens
caccugggcgccaacugcu

SEQ ID NO: 2056295 - RNA, 15 nt, Homo sapiens
augugauauguguaa

SEQ ID NO: 2056296 - RNA, 16 nt, Homo sapiens
gcacaauuguaauuga

SEQ ID NO: 2056297 - RNA, 22 nt, Homo sapiens
gggcucaccagcugggguccug

SEQ ID NO: 2056298 - RNA, 17 nt, Homo sapiens
accucuuccuccugaca

SEQ ID NO: 2056299 - RNA, 22 nt, Homo sapiens
uagcauugccaauauccuguau

SEQ ID NO: 2056300 - RNA, 17 nt, Homo sapiens
aaaugucacaguaaugc

SEQ ID NO: 2056301 - RNA, 21 nt, Homo sapiens
guuuuacuaucucacugcugu

SEQ ID NO: 2056302 - RNA, 22 nt, Homo sapiens
aaaggcuagaacacuacagggg

SEQ ID NO: 2056303 - RNA, 23 nt, Homo sapiens
gguguaguggcucaugccuguaa

SEQ ID NO: 2056304 - RNA, 14 nt, Homo sapiens
acuggugagcagac

SEQ ID NO: 2056305 - RNA, 17 nt, Homo sapiens
uaggauacguacaccuc

SEQ ID NO: 2056306 - RNA, 14 nt, Homo sapiens
gauacuuguaacuu

SEQ ID NO: 2056307 - RNA, 18 nt, Homo sapiens
aggucuggcgccaggggc

SEQ ID NO: 2056308 - RNA, 19 nt, Homo sapiens
gcuaagcggaacaugugcu

SEQ ID NO: 2056309 - RNA, 17 nt, Homo sapiens
cauguaaucagauuuau

SEQ ID NO: 2056310 - RNA, 17 nt, Homo sapiens
uaaaugcucuaacugga

SEQ ID NO: 2056311 - RNA, 17 nt, Homo sapiens
ucuuuggccuacauucu

SEQ ID NO: 2056312 - RNA, 13 nt, Homo sapiens
caguguuuggaca

SEQ ID NO: 2056313 - RNA, 24 nt, Homo sapiens
augcuuaugacaaugacugugcua

SEQ ID NO: 2056314 - RNA, 14 nt, Homo sapiens
cuaagaauucucuc

SEQ ID NO: 2056315 - RNA, 18 nt, Homo sapiens
ccuucuuacucuccucuu

SEQ ID NO: 2056316 - RNA, 19 nt, Homo sapiens
cgcccucacugcaggcucc

SEQ ID NO: 2056317 - RNA, 22 nt, Homo sapiens
gacagugacuguacaguuauca

SEQ ID NO: 2056318 - RNA, 10 nt, Homo sapiens
cagugccuuc

SEQ ID NO: 2056319 - RNA, 17 nt, Homo sapiens
ggcaguuggaggacaca

SEQ ID NO: 2056320 - RNA, 18 nt, Homo sapiens
aauuaucggaagcagugc

SEQ ID NO: 2056321 - RNA, 16 nt, Homo sapiens
uacaaccucccucuug

SEQ ID NO: 2056322 - RNA, 16 nt, Homo sapiens
gcccacauauuucaau

SEQ ID NO: 2056323 - RNA, 19 nt, Homo sapiens
gcuuauuaaaaaaguaaac

SEQ ID NO: 2056324 - RNA, 21 nt, Homo sapiens
auaaugaguuuuacauuacaa

SEQ ID NO: 2056325 - RNA, 18 nt, Homo sapiens
cuagauuuucuacuuuau

SEQ ID NO: 2056326 - RNA, 13 nt, Homo sapiens
guccaaaugcaau

SEQ ID NO: 2056327 - RNA, 20 nt, Homo sapiens
aagccagacgugguggcuca

SEQ ID NO: 2056328 - RNA, 22 nt, Homo sapiens
accaugcugugagcagcagggc

SEQ ID NO: 2056329 - RNA, 17 nt, Homo sapiens
acgcucacccagucacc

SEQ ID NO: 2056330 - RNA, 21 nt, Homo sapiens
caaguagguuuacauuacuga

SEQ ID NO: 2056331 - RNA, 15 nt, Homo sapiens
cuuauagcacuuuga

SEQ ID NO: 2056332 - RNA, 20 nt, Homo sapiens
accccugaccccucauagcc

SEQ ID NO: 2056333 - RNA, 23 nt, Homo sapiens
aaaucacucaaauuguucucuaa

SEQ ID NO: 2056334 - RNA, 15 nt, Homo sapiens
aggaaagagaaaccu

SEQ ID NO: 2056335 - RNA, 22 nt, Homo sapiens
cauguacagacaaauacuuaga

SEQ ID NO: 2056336 - RNA, 16 nt, Homo sapiens
uggagugcucucucag

SEQ ID NO: 2056337 - RNA, 12 nt, Homo sapiens
auacaauucauu

SEQ ID NO: 2056338 - RNA, 13 nt, Homo sapiens
cuugaugccagug

SEQ ID NO: 2056339 - RNA, 18 nt, Homo sapiens
gguuucuagcgcauuuga

SEQ ID NO: 2056340 - RNA, 16 nt, Homo sapiens
gggccagcucuuggcu

SEQ ID NO: 2056341 - RNA, 14 nt, Homo sapiens
aggccagagccaag

SEQ ID NO: 2056342 - RNA, 16 nt, Homo sapiens
cagacaagcuugaaua

SEQ ID NO: 2056343 - RNA, 20 nt, Homo sapiens
uagcuguuuugaauaacaua

SEQ ID NO: 2056344 - RNA, 23 nt, Homo sapiens
cacuguccaugaagcacugagca

SEQ ID NO: 2056345 - RNA, 23 nt, Homo sapiens
uucccugcuuccaggaaacucca

SEQ ID NO: 2056346 - RNA, 19 nt, Homo sapiens
ugcccugugccgcacucug

SEQ ID NO: 2056347 - RNA, 23 nt, Homo sapiens
cuccccagaggugaccacuuuca

SEQ ID NO: 2056348 - RNA, 13 nt, Homo sapiens
ucauacugccuug

SEQ ID NO: 2056349 - RNA, 22 nt, Homo sapiens
aaguguucucuagaauccagca

SEQ ID NO: 2056350 - RNA, 16 nt, Homo sapiens
caggguggaugaucuc

SEQ ID NO: 2056351 - RNA, 15 nt, Homo sapiens
gaagcucugugugua

SEQ ID NO: 2056352 - RNA, 13 nt, Homo sapiens
uagagacaggguc

SEQ ID NO: 2056353 - RNA, 15 nt, Homo sapiens
cuucagccacaggga

SEQ ID NO: 2056354 - RNA, 15 nt, Homo sapiens
aaagcacaguuugaa

SEQ ID NO: 2056355 - RNA, 13 nt, Homo sapiens
gucgaagcuuuga

SEQ ID NO: 2056356 - RNA, 13 nt, Homo sapiens
acugcucugagaa

SEQ ID NO: 2056357 - RNA, 21 nt, Homo sapiens
auccccguuccugacaucaca

SEQ ID NO: 2056358 - RNA, 12 nt, Homo sapiens
agucugccaagu

SEQ ID NO: 2056359 - RNA, 19 nt, Homo sapiens
acauuauuucuaguccaaa

SEQ ID NO: 2056360 - RNA, 20 nt, Homo sapiens
ucuaguugaggaguuuccua

SEQ ID NO: 2056361 - RNA, 16 nt, Homo sapiens
cugcuucaaauauuuc

SEQ ID NO: 2056362 - RNA, 14 nt, Homo sapiens
gcuggggcugguga

SEQ ID NO: 2056363 - RNA, 17 nt, Homo sapiens
uuaguacaauaaucucu

SEQ ID NO: 2056364 - RNA, 17 nt, Homo sapiens
aagagcucaagggacaa

SEQ ID NO: 2056365 - RNA, 17 nt, Homo sapiens
uuugcucuugccaaaaa

SEQ ID NO: 2056366 - RNA, 23 nt, Homo sapiens
ugcuagugauuucauuaccaagu

SEQ ID NO: 2056367 - RNA, 16 nt, Homo sapiens
uauaaagcauuacucu

SEQ ID NO: 2056368 - RNA, 22 nt, Homo sapiens
cuagugccccagacugagcucu

SEQ ID NO: 2056369 - RNA, 13 nt, Homo sapiens
uguaaaaugcacc

SEQ ID NO: 2056370 - RNA, 22 nt, Homo sapiens
ccaugaaaggggaaauacuuag

SEQ ID NO: 2056371 - RNA, 22 nt, Homo sapiens
ugugccuuaggaaaagcauuug

SEQ ID NO: 2056372 - RNA, 19 nt, Homo sapiens
uuggaaagcagguuucaag

SEQ ID NO: 2056373 - RNA, 18 nt, Homo sapiens
ugaggauaaauugccaua

SEQ ID NO: 2056374 - RNA, 23 nt, Homo sapiens
ccuucagucacaugcuagcagcu

SEQ ID NO: 2056375 - RNA, 21 nt, Homo sapiens
augaacaaacuaugaucacag

SEQ ID NO: 2056376 - RNA, 16 nt, Homo sapiens
gcuccuccauggugcu

SEQ ID NO: 2056377 - RNA, 15 nt, Homo sapiens
cauugugacacuucc

SEQ ID NO: 2056378 - RNA, 12 nt, Homo sapiens
gcgaaugugcag

SEQ ID NO: 2056379 - RNA, 20 nt, Homo sapiens
uuuaaucaaugaucaucuca

SEQ ID NO: 2056380 - RNA, 13 nt, Homo sapiens
ccugcgggcaccu

SEQ ID NO: 2056381 - RNA, 15 nt, Homo sapiens
caguguaaucucuau

SEQ ID NO: 2056382 - RNA, 16 nt, Homo sapiens
ggccuagaaagggcaa

SEQ ID NO: 2056383 - RNA, 19 nt, Homo sapiens
accuugagggugggccagc

SEQ ID NO: 2056384 - RNA, 20 nt, Homo sapiens
gaggcuugccccacccaaca

SEQ ID NO: 2056385 - RNA, 18 nt, Homo sapiens
cugccuccagccuggugg

SEQ ID NO: 2056386 - RNA, 13 nt, Homo sapiens
ugguaugugacac

SEQ ID NO: 2056387 - RNA, 15 nt, Homo sapiens
acuuuauguauggag

SEQ ID NO: 2056388 - RNA, 22 nt, Homo sapiens
uauccaagaccuuacaaccaca

SEQ ID NO: 2056389 - RNA, 15 nt, Homo sapiens
acacuucagaucuga

SEQ ID NO: 2056390 - RNA, 15 nt, Homo sapiens
acguuuguuccccac

SEQ ID NO: 2056391 - RNA, 23 nt, Homo sapiens
gaaaggucacacuaccauuauuu

SEQ ID NO: 2056392 - RNA, 22 nt, Homo sapiens
cuuucuuuuuuaaaaauggaaa

SEQ ID NO: 2056393 - RNA, 17 nt, Homo sapiens
aguuugcuagugacuaa

SEQ ID NO: 2056394 - RNA, 23 nt, Homo sapiens
ccaggacucugaccccagcauuc

SEQ ID NO: 2056395 - RNA, 16 nt, Homo sapiens
gaaauugacagaucaa

SEQ ID NO: 2056396 - RNA, 18 nt, Homo sapiens
ucugcuucugaaacugga

SEQ ID NO: 2056397 - RNA, 17 nt, Homo sapiens
cauaaaaagacaacuca

SEQ ID NO: 2056398 - RNA, 17 nt, Homo sapiens
uacaugccgaaugccac

SEQ ID NO: 2056399 - RNA, 15 nt, Homo sapiens
augguucuccaagaa

SEQ ID NO: 2056400 - RNA, 20 nt, Homo sapiens
agaagccugucuguacuuca

SEQ ID NO: 2056401 - RNA, 15 nt, Homo sapiens
uguuuaaaaugucau

SEQ ID NO: 2056402 - RNA, 19 nt, Homo sapiens
auuuucuuucauacauuau

SEQ ID NO: 2056403 - RNA, 18 nt, Homo sapiens
gucauggaggccaagaac

SEQ ID NO: 2056404 - RNA, 17 nt, Homo sapiens
gaagugcuuucuucucc

SEQ ID NO: 2056405 - RNA, 19 nt, Homo sapiens
ggcucgaccucgcugcugc

SEQ ID NO: 2056406 - RNA, 23 nt, Homo sapiens
aacauggccuuggagggcaugaa

SEQ ID NO: 2056407 - RNA, 17 nt, Homo sapiens
ccagcuucaaaugcaaa

SEQ ID NO: 2056408 - RNA, 13 nt, Homo sapiens
guagagaugggau

SEQ ID NO: 2056409 - RNA, 17 nt, Homo sapiens
gcgggcgccaucuucca

SEQ ID NO: 2056410 - RNA, 21 nt, Homo sapiens
ccauuucagaggggaggcuca

SEQ ID NO: 2056411 - RNA, 21 nt, Homo sapiens
accacggugaaagugcugcuc

SEQ ID NO: 2056412 - RNA, 23 nt, Homo sapiens
cuccuggggcucagccuagugaa

SEQ ID NO: 2056413 - RNA, 18 nt, Homo sapiens
uguuuaaccuguuuucag

SEQ ID NO: 2056414 - RNA, 17 nt, Homo sapiens
cuggggccgaaagaaca

SEQ ID NO: 2056415 - RNA, 16 nt, Homo sapiens
uaguaacuguagaugg

SEQ ID NO: 2056416 - RNA, 17 nt, Homo sapiens
ggggagucugaagcaga

SEQ ID NO: 2056417 - RNA, 16 nt, Homo sapiens
uaaagucacagaauua

SEQ ID NO: 2056418 - RNA, 16 nt, Homo sapiens
cuagaaauagucauuu

SEQ ID NO: 2056419 - RNA, 12 nt, Homo sapiens
cucaggccaaag

SEQ ID NO: 2056420 - RNA, 18 nt, Homo sapiens
cauaguuauuuacuugaa

SEQ ID NO: 2056421 - RNA, 19 nt, Homo sapiens
gcuuuucaaacugcaguuu

SEQ ID NO: 2056422 - RNA, 21 nt, Homo sapiens
uaugauguuaacauuucaggu

SEQ ID NO: 2056423 - RNA, 18 nt, Homo sapiens
gaaaaggggacaguuuuu

SEQ ID NO: 2056424 - RNA, 15 nt, Homo sapiens
agcccugaggggugg

SEQ ID NO: 2056425 - RNA, 18 nt, Homo sapiens
auuccggugccuccugaa

SEQ ID NO: 2056426 - RNA, 23 nt, Homo sapiens
ccaucccagcugaaauacugagg

SEQ ID NO: 2056427 - RNA, 16 nt, Homo sapiens
agggagacagaccacu

SEQ ID NO: 2056428 - RNA, 23 nt, Homo sapiens
cuucacacacaccucaugugaga

SEQ ID NO: 2056429 - RNA, 18 nt, Homo sapiens
uaguuuugugaugcauuu

SEQ ID NO: 2056430 - RNA, 20 nt, Homo sapiens
uauccucugaccuacauacg

SEQ ID NO: 2056431 - RNA, 22 nt, Homo sapiens
agcuaacgugcugucagcauua

SEQ ID NO: 2056432 - RNA, 17 nt, Homo sapiens
ugucaguguagaucaac

SEQ ID NO: 2056433 - RNA, 16 nt, Homo sapiens
aucccaagaaugcaag

SEQ ID NO: 2056434 - RNA, 21 nt, Homo sapiens
acaggacauuggcauuaucua

SEQ ID NO: 2056435 - RNA, 23 nt, Homo sapiens
cguuccugggacugucagauaau

SEQ ID NO: 2056436 - RNA, 18 nt, Homo sapiens
ccacacacacacacaugc

SEQ ID NO: 2056437 - RNA, 18 nt, Homo sapiens
guaugugcacaugugucu

SEQ ID NO: 2056438 - RNA, 16 nt, Homo sapiens
uccauuaaccaagaaa

SEQ ID NO: 2056439 - RNA, 16 nt, Homo sapiens
cugccuuaaaaccaaa

SEQ ID NO: 2056440 - RNA, 20 nt, Homo sapiens
caguaacaguguaguacuca

SEQ ID NO: 2056441 - RNA, 18 nt, Homo sapiens
ucuaauucucuuacccag

SEQ ID NO: 2056442 - RNA, 13 nt, Homo sapiens
gggacuacaggcg

SEQ ID NO: 2056443 - RNA, 14 nt, Homo sapiens
cccacccugugcca

SEQ ID NO: 2056444 - RNA, 11 nt, Homo sapiens
uugaaauccaa

SEQ ID NO: 2056445 - RNA, 20 nt, Homo sapiens
aacuggaggaguuccuugau

SEQ ID NO: 2056446 - RNA, 23 nt, Homo sapiens
cucaaccccuccccuccaucccu

SEQ ID NO: 2056447 - RNA, 16 nt, Homo sapiens
ggauaagccacugggc

SEQ ID NO: 2056448 - RNA, 22 nt, Homo sapiens
auuccuuagaggaagaauauaa

SEQ ID NO: 2056449 - RNA, 19 nt, Homo sapiens
cacucucacuaugcugcua

SEQ ID NO: 2056450 - RNA, 17 nt, Homo sapiens
auuccuguuugucuaca

SEQ ID NO: 2056451 - RNA, 19 nt, Homo sapiens
agaagucacucacacuggc

SEQ ID NO: 2056452 - RNA, 20 nt, Homo sapiens
uaaguucucaagcugccuau

SEQ ID NO: 2056453 - RNA, 11 nt, Homo sapiens
aaaacuuuauu

SEQ ID NO: 2056454 - RNA, 11 nt, Homo sapiens
cuaacuuucau

SEQ ID NO: 2056455 - RNA, 21 nt, Homo sapiens
aggagcagcucuucagcacaa

SEQ ID NO: 2056456 - RNA, 14 nt, Homo sapiens
agggcagcugugau

SEQ ID NO: 2056457 - RNA, 15 nt, Homo sapiens
ccaucugccugaccc

SEQ ID NO: 2056458 - RNA, 22 nt, Homo sapiens
ucagaguucuuuuugaaguauu

SEQ ID NO: 2056459 - RNA, 18 nt, Homo sapiens
aauauuuaaacagcagug

SEQ ID NO: 2056460 - RNA, 15 nt, Homo sapiens
cuaaacuacauuuua

SEQ ID NO: 2056461 - RNA, 16 nt, Homo sapiens
auuaucuuugcuguua

SEQ ID NO: 2056462 - RNA, 13 nt, Homo sapiens
ugagaguggcuuu

SEQ ID NO: 2056463 - RNA, 23 nt, Homo sapiens
gcuuucuggauggcaucuagcca

SEQ ID NO: 2056464 - RNA, 15 nt, Homo sapiens
gagacaggcccaaga

SEQ ID NO: 2056465 - RNA, 18 nt, Homo sapiens
auaaugcggacacuuuug

SEQ ID NO: 2056466 - RNA, 13 nt, Homo sapiens
gcugauuacugaa

SEQ ID NO: 2056467 - RNA, 19 nt, Homo sapiens
agcagaaacccccaggagg

SEQ ID NO: 2056468 - RNA, 11 nt, Homo sapiens
agcaucaucug

SEQ ID NO: 2056469 - RNA, 18 nt, Homo sapiens
caucccgucgacguagaa

SEQ ID NO: 2056470 - RNA, 20 nt, Homo sapiens
ccagcacuuugggaggccaa

SEQ ID NO: 2056471 - RNA, 16 nt, Homo sapiens
gcugagagaaccucac

SEQ ID NO: 2056472 - RNA, 19 nt, Homo sapiens
acuaaaagguaugcaauca

SEQ ID NO: 2056473 - RNA, 16 nt, Homo sapiens
accauauugcucuuaa

SEQ ID NO: 2056474 - RNA, 23 nt, Homo sapiens
cagaugccaauuacgguguacag

SEQ ID NO: 2056475 - RNA, 17 nt, Homo sapiens
uccaugcucaccaagga

SEQ ID NO: 2056476 - RNA, 18 nt, Homo sapiens
aaacucuucagugcaaau

SEQ ID NO: 2056477 - RNA, 14 nt, Homo sapiens
accauucauuccau

SEQ ID NO: 2056478 - RNA, 16 nt, Homo sapiens
cucuugaaauguagaa

SEQ ID NO: 2056479 - RNA, 16 nt, Homo sapiens
ccuggccaaagggaua

SEQ ID NO: 2056480 - RNA, 18 nt, Homo sapiens
guaaucccagcuacucga

SEQ ID NO: 2056481 - RNA, 11 nt, Homo sapiens
aagagcacagc

SEQ ID NO: 2056482 - RNA, 20 nt, Homo sapiens
augcucaggagccaccagca

SEQ ID NO: 2056483 - RNA, 13 nt, Homo sapiens
acuguuccaaagc

SEQ ID NO: 2056484 - RNA, 13 nt, Homo sapiens
guguuucuuacag

SEQ ID NO: 2056485 - RNA, 20 nt, Homo sapiens
cagaauuccaccggugcaag

SEQ ID NO: 2056486 - RNA, 13 nt, Homo sapiens
caggugggcugua

SEQ ID NO: 2056487 - RNA, 17 nt, Homo sapiens
gcgugacucacccaagc

SEQ ID NO: 2056488 - RNA, 17 nt, Homo sapiens
gcaauaucuacauucua

SEQ ID NO: 2056489 - RNA, 18 nt, Homo sapiens
cacacacaaaaacagaaa

SEQ ID NO: 2056490 - RNA, 15 nt, Homo sapiens
uuaacccggagcuaa

SEQ ID NO: 2056491 - RNA, 20 nt, Homo sapiens
caugucugccuaugcacuga

SEQ ID NO: 2056492 - RNA, 16 nt, Homo sapiens
ugcuuuagccauacac

SEQ ID NO: 2056493 - RNA, 12 nt, Homo sapiens
uucucuagacau

SEQ ID NO: 2056494 - RNA, 21 nt, Homo sapiens
ugacaggaagcgacgccucug

SEQ ID NO: 2056495 - RNA, 14 nt, Homo sapiens
cuugcacuauucca

SEQ ID NO: 2056496 - RNA, 13 nt, Homo sapiens
uggaagcaacagg

SEQ ID NO: 2056497 - RNA, 18 nt, Homo sapiens
cuucucugguucaugucc

SEQ ID NO: 2056498 - RNA, 21 nt, Homo sapiens
uuccccaucugugugugaauu

SEQ ID NO: 2056499 - RNA, 19 nt, Homo sapiens
caucagcugaauucacuua

SEQ ID NO: 2056500 - RNA, 14 nt, Homo sapiens
gaauaauaaauauu

SEQ ID NO: 2056501 - RNA, 16 nt, Homo sapiens
cuacagaagggcagug

SEQ ID NO: 2056502 - RNA, 17 nt, Homo sapiens
acagcauaugcaaaggc

SEQ ID NO: 2056503 - RNA, 21 nt, Homo sapiens
gcaugugcugugaccauuuau

SEQ ID NO: 2056504 - RNA, 23 nt, Homo sapiens
caugggccagcccuugcucuacc

SEQ ID NO: 2056505 - RNA, 12 nt, Homo sapiens
cucacacacugg

SEQ ID NO: 2056506 - RNA, 20 nt, Homo sapiens
ugccugaccaucccaugagc

SEQ ID NO: 2056507 - RNA, 21 nt, Homo sapiens
cugguaaauuuuauaauguca

SEQ ID NO: 2056508 - RNA, 15 nt, Homo sapiens
aaaguuaguauuaaa

SEQ ID NO: 2056509 - RNA, 21 nt, Homo sapiens
uucagggcugggcagguccug

SEQ ID NO: 2056510 - RNA, 21 nt, Homo sapiens
acuauucacugaugcagaaag

SEQ ID NO: 2056511 - RNA, 21 nt, Homo sapiens
ccagaugugugcaauguggca

SEQ ID NO: 2056512 - RNA, 14 nt, Homo sapiens
uaugaaaagauaac

SEQ ID NO: 2056513 - RNA, 22 nt, Homo sapiens
cuuuucacucccuccaucaaga

SEQ ID NO: 2056514 - RNA, 16 nt, Homo sapiens
auguacagacauauuu

SEQ ID NO: 2056515 - RNA, 14 nt, Homo sapiens
cugcucauccaaag

SEQ ID NO: 2056516 - RNA, 22 nt, Homo sapiens
acaugggagcaguccaugcaug

SEQ ID NO: 2056517 - RNA, 16 nt, Homo sapiens
uucauugccuuuccag

SEQ ID NO: 2056518 - RNA, 18 nt, Homo sapiens
gacuauuuauaacuaaua

SEQ ID NO: 2056519 - RNA, 19 nt, Homo sapiens
uggaaaagaacuguacugu

SEQ ID NO: 2056520 - RNA, 17 nt, Homo sapiens
aguacucauacauguua

SEQ ID NO: 2056521 - RNA, 16 nt, Homo sapiens
cuccacagugcugcuu

SEQ ID NO: 2056522 - RNA, 15 nt, Homo sapiens
cugcuugacaaagga

SEQ ID NO: 2056523 - RNA, 14 nt, Homo sapiens
aaucaacagaucaa

SEQ ID NO: 2056524 - RNA, 12 nt, Homo sapiens
ccagaacacucu

SEQ ID NO: 2056525 - RNA, 13 nt, Homo sapiens
cccucuuaucuca

SEQ ID NO: 2056526 - RNA, 12 nt, Homo sapiens
ccuuacacugaa

SEQ ID NO: 2056527 - RNA, 23 nt, Homo sapiens
ugcuugggaccagaaguguuuca

SEQ ID NO: 2056528 - RNA, 21 nt, Homo sapiens
cuguaauagaucagcauccaa

SEQ ID NO: 2056529 - RNA, 21 nt, Homo sapiens
uuacagccacaggcacugugu

SEQ ID NO: 2056530 - RNA, 14 nt, Homo sapiens
cccagcugcucagu

SEQ ID NO: 2056531 - RNA, 23 nt, Homo sapiens
cuccugaagggaaggcaaaggca

SEQ ID NO: 2056532 - RNA, 22 nt, Homo sapiens
aaugauucauaagacacuuaga

SEQ ID NO: 2056533 - RNA, 19 nt, Homo sapiens
accugauacaauuugccca

SEQ ID NO: 2056534 - RNA, 17 nt, Homo sapiens
guuuuugucuacguuau

SEQ ID NO: 2056535 - RNA, 22 nt, Homo sapiens
cagggaugaagaaagacucuga

SEQ ID NO: 2056536 - RNA, 18 nt, Homo sapiens
gagagauuagaauaucug

SEQ ID NO: 2056537 - RNA, 18 nt, Homo sapiens
ucuggauggugugccuuc

SEQ ID NO: 2056538 - RNA, 13 nt, Homo sapiens
cucuugaggccag

SEQ ID NO: 2056539 - RNA, 20 nt, Homo sapiens
uccaagcaaaugugaaucau

SEQ ID NO: 2056540 - RNA, 17 nt, Homo sapiens
ccuuaauccuauuuuca

SEQ ID NO: 2056541 - RNA, 16 nt, Homo sapiens
ggcugcacauugccug

SEQ ID NO: 2056542 - RNA, 13 nt, Homo sapiens
uaaaugaccaaga

SEQ ID NO: 2056543 - RNA, 17 nt, Homo sapiens
acaguauguuacaugca

SEQ ID NO: 2056544 - RNA, 14 nt, Homo sapiens
acuguggccuggca

SEQ ID NO: 2056545 - RNA, 18 nt, Homo sapiens
caaaauguaugucugguu

SEQ ID NO: 2056546 - RNA, 15 nt, Homo sapiens
cugagaagacaauau

SEQ ID NO: 2056547 - RNA, 23 nt, Homo sapiens
acacuucaguuaucuugaucucc

SEQ ID NO: 2056548 - RNA, 19 nt, Homo sapiens
cccagacaaccaaaacaua

SEQ ID NO: 2056549 - RNA, 22 nt, Homo sapiens
uaucaacuggggggaccaaaua

SEQ ID NO: 2056550 - RNA, 20 nt, Homo sapiens
accuaaugggaaucauucca

SEQ ID NO: 2056551 - RNA, 21 nt, Homo sapiens
uuucucaaugaaugaacaaau

SEQ ID NO: 2056552 - RNA, 15 nt, Homo sapiens
uuaagugaagccuac

SEQ ID NO: 2056553 - RNA, 23 nt, Homo sapiens
acugugccaccgccuucccugac

SEQ ID NO: 2056554 - RNA, 14 nt, Homo sapiens
ucuugucucaaugc

SEQ ID NO: 2056555 - RNA, 13 nt, Homo sapiens
aagggacugagag

SEQ ID NO: 2056556 - RNA, 12 nt, Homo sapiens
uagagacauccu

SEQ ID NO: 2056557 - RNA, 16 nt, Homo sapiens
uugaaaauaaugcugu

SEQ ID NO: 2056558 - RNA, 22 nt, Homo sapiens
ucuuugacguggagcugcucaa

SEQ ID NO: 2056559 - RNA, 13 nt, Homo sapiens
cuuaaaauuguau

SEQ ID NO: 2056560 - RNA, 18 nt, Homo sapiens
caauaaagauauuuccaa

SEQ ID NO: 2056561 - RNA, 19 nt, Homo sapiens
augacccaccccugugcuc

SEQ ID NO: 2056562 - RNA, 12 nt, Homo sapiens
auaccuuaucca

SEQ ID NO: 2056563 - RNA, 21 nt, Homo sapiens
ccauuucuugaaaagccuugg

SEQ ID NO: 2056564 - RNA, 12 nt, Homo sapiens
acaggcaugcac

SEQ ID NO: 2056565 - RNA, 16 nt, Homo sapiens
uuaucucucaaaacaa

SEQ ID NO: 2056566 - RNA, 18 nt, Homo sapiens
gccucccuuguggcagca

SEQ ID NO: 2056567 - RNA, 15 nt, Homo sapiens
aaccucuagagucac

SEQ ID NO: 2056568 - RNA, 18 nt, Homo sapiens
aacuuuuuugaggccuuu

SEQ ID NO: 2056569 - RNA, 18 nt, Homo sapiens
aaacaaaaaacccaagaa

SEQ ID NO: 2056570 - RNA, 22 nt, Homo sapiens
gucgcuaacuuaguaagugcuu

SEQ ID NO: 2056571 - RNA, 14 nt, Homo sapiens
aggaaaguacugca

SEQ ID NO: 2056572 - RNA, 24 nt, Homo sapiens
caggcaggcucauuucacuaagcu

SEQ ID NO: 2056573 - RNA, 22 nt, Homo sapiens
uguaaaaugcuuuucacuuucu

SEQ ID NO: 2056574 - RNA, 18 nt, Homo sapiens
auccacccaccuuggccu

SEQ ID NO: 2056575 - RNA, 14 nt, Homo sapiens
uuaaugaacauaug

SEQ ID NO: 2056576 - RNA, 21 nt, Homo sapiens
acucugauguugggauggaau

SEQ ID NO: 2056577 - RNA, 23 nt, Homo sapiens
ugacucgaguguuuaaaugcugu

SEQ ID NO: 2056578 - RNA, 23 nt, Homo sapiens
aaggacccuauauguggcauucc

SEQ ID NO: 2056579 - RNA, 18 nt, Homo sapiens
ggcaccagaaugcuaaag

SEQ ID NO: 2056580 - RNA, 22 nt, Homo sapiens
acccuucugcuguauacuguac

SEQ ID NO: 2056581 - RNA, 16 nt, Homo sapiens
uuaauacauugaucag

SEQ ID NO: 2056582 - RNA, 14 nt, Homo sapiens
uauaguacaugaua

SEQ ID NO: 2056583 - RNA, 13 nt, Homo sapiens
cccauuuccugua

SEQ ID NO: 2056584 - RNA, 23 nt, Homo sapiens
cucuuuuuuauguuuuagacugu

SEQ ID NO: 2056585 - RNA, 15 nt, Homo sapiens
guaaugaauaccuua

SEQ ID NO: 2056586 - RNA, 23 nt, Homo sapiens
gcugauuggaaaauaauaaaaga

SEQ ID NO: 2056587 - RNA, 16 nt, Homo sapiens
uuucuaaaaucuaaaa

SEQ ID NO: 2056588 - RNA, 14 nt, Homo sapiens
cugguucuugcaaa

SEQ ID NO: 2056589 - RNA, 16 nt, Homo sapiens
aaaugcaccucauucc

SEQ ID NO: 2056590 - RNA, 14 nt, Homo sapiens
ugacagaaaugcaa

SEQ ID NO: 2056591 - RNA, 14 nt, Homo sapiens
acuccagcugcaag

SEQ ID NO: 2056592 - RNA, 19 nt, Homo sapiens
guauuugagagacugccau

SEQ ID NO: 2056593 - RNA, 17 nt, Homo sapiens
aauacuuuuuguggaau

SEQ ID NO: 2056594 - RNA, 17 nt, Homo sapiens
agaugugggcagugaug

SEQ ID NO: 2056595 - RNA, 20 nt, Homo sapiens
uuauacaaaauaauuuaacu

SEQ ID NO: 2056596 - RNA, 14 nt, Homo sapiens
caaauugccugcaa

SEQ ID NO: 2056597 - RNA, 13 nt, Homo sapiens
cauucuuggccca

SEQ ID NO: 2056598 - RNA, 13 nt, Homo sapiens
cuguuccuuauga

SEQ ID NO: 2056599 - RNA, 16 nt, Homo sapiens
cucacgugacugccag

SEQ ID NO: 2056600 - RNA, 16 nt, Homo sapiens
auauuaauaauuccaa

SEQ ID NO: 2056601 - RNA, 13 nt, Homo sapiens
gaaucaaacaaaa

SEQ ID NO: 2056602 - RNA, 20 nt, Homo sapiens
ucugaacaaagagagcucau

SEQ ID NO: 2056603 - RNA, 16 nt, Homo sapiens
uaauguauuauaugua

SEQ ID NO: 2056604 - RNA, 15 nt, Homo sapiens
ugacaacuacuuuaa

SEQ ID NO: 2056605 - RNA, 20 nt, Homo sapiens
caaguauuuuaucuguguug

SEQ ID NO: 2056606 - RNA, 19 nt, Homo sapiens
accucacugucaucugcca

SEQ ID NO: 2056607 - RNA, 17 nt, Homo sapiens
ugcuacugucuuuggaa

SEQ ID NO: 2056608 - RNA, 16 nt, Homo sapiens
gaagccugcugauuuc

SEQ ID NO: 2056609 - RNA, 13 nt, Homo sapiens
caaggccuugcuc

SEQ ID NO: 2056610 - RNA, 14 nt, Homo sapiens
ccagcuaugccaaa

SEQ ID NO: 2056611 - RNA, 15 nt, Homo sapiens
auaccagaaagcucu

SEQ ID NO: 2056612 - RNA, 17 nt, Homo sapiens
agaaauugugugugcaa

SEQ ID NO: 2056613 - RNA, 14 nt, Homo sapiens
ugcaaaccauccca

SEQ ID NO: 2056614 - RNA, 12 nt, Homo sapiens
aaauaccaguuc

SEQ ID NO: 2056615 - RNA, 18 nt, Homo sapiens
uuagcauugcaggccaaa

SEQ ID NO: 2056616 - RNA, 18 nt, Homo sapiens
gccacauuuucagccaaa

SEQ ID NO: 2056617 - RNA, 12 nt, Homo sapiens
cagccucuggac

SEQ ID NO: 2056618 - RNA, 13 nt, Homo sapiens
agcuaaaacuggc

SEQ ID NO: 2056619 - RNA, 19 nt, Homo sapiens
aagcacaugaauaauuuca

SEQ ID NO: 2056620 - RNA, 22 nt, Homo sapiens
augacccagaggacagcacaga

SEQ ID NO: 2056621 - RNA, 17 nt, Homo sapiens
gagcacuagaagcacag

SEQ ID NO: 2056622 - RNA, 19 nt, Homo sapiens
cagaaucuguuaccagagg

SEQ ID NO: 2056623 - RNA, 18 nt, Homo sapiens
aucucuccaccuuccaaa

SEQ ID NO: 2056624 - RNA, 12 nt, Homo sapiens
aggugccuguaa

SEQ ID NO: 2056625 - RNA, 11 nt, Homo sapiens
uuugccuuccu

SEQ ID NO: 2056626 - RNA, 16 nt, Homo sapiens
ccuggggugaauacuu

SEQ ID NO: 2056627 - RNA, 19 nt, Homo sapiens
agaaauggcaucauuauaa

SEQ ID NO: 2056628 - RNA, 15 nt, Homo sapiens
uucaaauccugccac

SEQ ID NO: 2056629 - RNA, 14 nt, Homo sapiens
ugcaccucauucca

SEQ ID NO: 2056630 - RNA, 20 nt, Homo sapiens
uuaggaggaggugggggcua

SEQ ID NO: 2056631 - RNA, 20 nt, Homo sapiens
ugacaaagaagaccacaaau

SEQ ID NO: 2056632 - RNA, 15 nt, Homo sapiens
gaaggagaugcugcu

SEQ ID NO: 2056633 - RNA, 16 nt, Homo sapiens
ucuccuggguacugag

SEQ ID NO: 2056634 - RNA, 23 nt, Homo sapiens
uguuaaccucugcuuuuaucuca

SEQ ID NO: 2056635 - RNA, 18 nt, Homo sapiens
cuucagacuuaaagcacu

SEQ ID NO: 2056636 - RNA, 16 nt, Homo sapiens
acaaauuaucauacua

SEQ ID NO: 2056637 - RNA, 14 nt, Homo sapiens
caaaguaagccaug

SEQ ID NO: 2056638 - RNA, 17 nt, Homo sapiens
acauuuccgcuguccgu

SEQ ID NO: 2056639 - RNA, 12 nt, Homo sapiens
uauuucaggcau

SEQ ID NO: 2056640 - RNA, 14 nt, Homo sapiens
cuuucacacacaca

SEQ ID NO: 2056641 - RNA, 18 nt, Homo sapiens
agcagagauguacugcaa

SEQ ID NO: 2056642 - RNA, 14 nt, Homo sapiens
uauccuuacuuuau

SEQ ID NO: 2056643 - RNA, 15 nt, Homo sapiens
uccuucaagaacucu

SEQ ID NO: 2056644 - RNA, 18 nt, Homo sapiens
ugucuaggacugcagugu

SEQ ID NO: 2056645 - RNA, 18 nt, Homo sapiens
guugaagacagcuuccca

SEQ ID NO: 2056646 - RNA, 22 nt, Homo sapiens
uucauauuguggcacaagcaaa

SEQ ID NO: 2056647 - RNA, 15 nt, Homo sapiens
auuuacaaacugaag

SEQ ID NO: 2056648 - RNA, 21 nt, Homo sapiens
cacuggccacaauacccaccu

SEQ ID NO: 2056649 - RNA, 19 nt, Homo sapiens
aacauguaugugcauuuca

SEQ ID NO: 2056650 - RNA, 19 nt, Homo sapiens
ucaaggaacucaguuuaau

SEQ ID NO: 2056651 - RNA, 23 nt, Homo sapiens
agacauagcaucuuguggcuuug

SEQ ID NO: 2056652 - RNA, 16 nt, Homo sapiens
agaaacgcucaugaca

SEQ ID NO: 2056653 - RNA, 19 nt, Homo sapiens
gaucagauaauuaugcuuu

SEQ ID NO: 2056654 - RNA, 15 nt, Homo sapiens
cuguaagauaauguu

SEQ ID NO: 2056655 - RNA, 15 nt, Homo sapiens
uaccugcccugacau

SEQ ID NO: 2056656 - RNA, 19 nt, Homo sapiens
cacagccaagcccuaccuc

SEQ ID NO: 2056657 - RNA, 12 nt, Homo sapiens
acugaaaccaaa

SEQ ID NO: 2056658 - RNA, 16 nt, Homo sapiens
acaggccuguucccuu

SEQ ID NO: 2056659 - RNA, 17 nt, Homo sapiens
ccaacucuaaugcugca

SEQ ID NO: 2056660 - RNA, 21 nt, Homo sapiens
ugucauugcgaccauuucuca

SEQ ID NO: 2056661 - RNA, 15 nt, Homo sapiens
aucaguuacucuuca

SEQ ID NO: 2056662 - RNA, 16 nt, Homo sapiens
aaucuguauucuugcu

SEQ ID NO: 2056663 - RNA, 13 nt, Homo sapiens
ucauucugugacc

SEQ ID NO: 2056664 - RNA, 16 nt, Homo sapiens
gaguggggaagugauc

SEQ ID NO: 2056665 - RNA, 22 nt, Homo sapiens
acacugagacuugaaucaaguc

SEQ ID NO: 2056666 - RNA, 18 nt, Homo sapiens
cucauuuaaaacaggcaa

SEQ ID NO: 2056667 - RNA, 22 nt, Homo sapiens
gucuaggugggagagagugcau

SEQ ID NO: 2056668 - RNA, 18 nt, Homo sapiens
ugcuuuaacagcugauaa

SEQ ID NO: 2056669 - RNA, 21 nt, Homo sapiens
uccuaaaauaaacaugaagca

SEQ ID NO: 2056670 - RNA, 14 nt, Homo sapiens
gcucagacaugaua

SEQ ID NO: 2056671 - RNA, 15 nt, Homo sapiens
ucuuuccaugccacg

SEQ ID NO: 2056672 - RNA, 14 nt, Homo sapiens
uauugcucugagaa

SEQ ID NO: 2056673 - RNA, 12 nt, Homo sapiens
cuuuuugaucug

SEQ ID NO: 2056674 - RNA, 14 nt, Homo sapiens
aauugcucagagaa

SEQ ID NO: 2056675 - RNA, 19 nt, Homo sapiens
uaauaaaauauauacuaua

SEQ ID NO: 2056676 - RNA, 17 nt, Homo sapiens
gagcucauuuggggacc

SEQ ID NO: 2056677 - RNA, 14 nt, Homo sapiens
ucaugagcaaguga

SEQ ID NO: 2056678 - RNA, 14 nt, Homo sapiens
aaagguucuagguu

SEQ ID NO: 2056679 - RNA, 12 nt, Homo sapiens
gauuauuugccc

SEQ ID NO: 2056680 - RNA, 18 nt, Homo sapiens
ggugaaggcccagccugu

SEQ ID NO: 2056681 - RNA, 19 nt, Homo sapiens
ccucaaucucaauccugca

SEQ ID NO: 2056682 - RNA, 16 nt, Homo sapiens
gggcuuauccaugccu

SEQ ID NO: 2056683 - RNA, 16 nt, Homo sapiens
aaacuuuuuuucuuca

SEQ ID NO: 2056684 - RNA, 19 nt, Homo sapiens
aauaaaauuccuaucucau

SEQ ID NO: 2056685 - RNA, 15 nt, Homo sapiens
ggcaaugcucaaaca

SEQ ID NO: 2056686 - RNA, 20 nt, Homo sapiens
gcaguaggggcuacugugac

SEQ ID NO: 2056687 - RNA, 12 nt, Homo sapiens
acagacaaagcg

SEQ ID NO: 2056688 - RNA, 23 nt, Homo sapiens
ccacauggccgggcccucuguag

SEQ ID NO: 2056689 - RNA, 19 nt, Homo sapiens
cacuagguucaauucccug

SEQ ID NO: 2056690 - RNA, 12 nt, Homo sapiens
agccuucaagau

SEQ ID NO: 2056691 - RNA, 14 nt, Homo sapiens
ggccucagucuccc

SEQ ID NO: 2056692 - RNA, 14 nt, Homo sapiens
uaugugucuuuauc

SEQ ID NO: 2056693 - RNA, 14 nt, Homo sapiens
uauuggcagcucua

SEQ ID NO: 2056694 - RNA, 21 nt, Homo sapiens
gcagaagccuccccagcucac

SEQ ID NO: 2056695 - RNA, 22 nt, Homo sapiens
uguagagacgguguuuugccau

SEQ ID NO: 2056696 - RNA, 21 nt, Homo sapiens
cuacaagacacagugaccaua

SEQ ID NO: 2056697 - RNA, 17 nt, Homo sapiens
gcuggagagcacugcca

SEQ ID NO: 2056698 - RNA, 19 nt, Homo sapiens
uuuucuuuaaaauguauuu

SEQ ID NO: 2056699 - RNA, 13 nt, Homo sapiens
caagaaugcugaa

SEQ ID NO: 2056700 - RNA, 21 nt, Homo sapiens
uugaaucucauaauuuauaca

SEQ ID NO: 2056701 - RNA, 14 nt, Homo sapiens
ccucuaauucugua

SEQ ID NO: 2056702 - RNA, 17 nt, Homo sapiens
cuccuauuccuucacac

SEQ ID NO: 2056703 - RNA, 22 nt, Homo sapiens
acauuuucuguguguacaugua

SEQ ID NO: 2056704 - RNA, 17 nt, Homo sapiens
guuaauauugugcaaac

SEQ ID NO: 2056705 - RNA, 22 nt, Homo sapiens
guaaguaccccugauaagcaaa

SEQ ID NO: 2056706 - RNA, 15 nt, Homo sapiens
agaggcuuccuucau

SEQ ID NO: 2056707 - RNA, 22 nt, Homo sapiens
ugaaaagagccucuggaugcau

SEQ ID NO: 2056708 - RNA, 21 nt, Homo sapiens
aauuagcugugugaaauacca

SEQ ID NO: 2056709 - RNA, 15 nt, Homo sapiens
gcacagcaaacuguc

SEQ ID NO: 2056710 - RNA, 15 nt, Homo sapiens
gccugggaucccuca

SEQ ID NO: 2056711 - RNA, 18 nt, Homo sapiens
aagcuaccugaauggaga

SEQ ID NO: 2056712 - RNA, 14 nt, Homo sapiens
aguugggcuuucac

SEQ ID NO: 2056713 - RNA, 15 nt, Homo sapiens
gagaccaucccugaa

SEQ ID NO: 2056714 - RNA, 15 nt, Homo sapiens
ucccuugcagggguc

SEQ ID NO: 2056715 - RNA, 19 nt, Homo sapiens
cuguaggucacucuccagc

SEQ ID NO: 2056716 - RNA, 14 nt, Homo sapiens
uguuagcugcucac

SEQ ID NO: 2056717 - RNA, 19 nt, Homo sapiens
gugaaaaaggaaugauaua

SEQ ID NO: 2056718 - RNA, 20 nt, Homo sapiens
gaaauccaacuccaggguua

SEQ ID NO: 2056719 - RNA, 14 nt, Homo sapiens
cuucauuuagccaa

SEQ ID NO: 2056720 - RNA, 19 nt, Homo sapiens
uauuguccugcuccccugu

SEQ ID NO: 2056721 - RNA, 15 nt, Homo sapiens
ugucauuucaaagac

SEQ ID NO: 2056722 - RNA, 23 nt, Homo sapiens
caaaacgaaaugcuaugacugua

SEQ ID NO: 2056723 - RNA, 18 nt, Homo sapiens
ccacuccuccuagccacc

SEQ ID NO: 2056724 - RNA, 18 nt, Homo sapiens
ucagucuucugacuguca

SEQ ID NO: 2056725 - RNA, 17 nt, Homo sapiens
uaguauauuuauacucu

SEQ ID NO: 2056726 - RNA, 21 nt, Homo sapiens
ugcuaaucagggaggucauuu

SEQ ID NO: 2056727 - RNA, 22 nt, Homo sapiens
caggagucuucagacccagaga

SEQ ID NO: 2056728 - RNA, 16 nt, Homo sapiens
aaaaagaacaauauaa

SEQ ID NO: 2056729 - RNA, 18 nt, Homo sapiens
uucuacuuccccauuuca

SEQ ID NO: 2056730 - RNA, 21 nt, Homo sapiens
agcccucaccccugguucuca

SEQ ID NO: 2056731 - RNA, 17 nt, Homo sapiens
uaaauguugacauggga

SEQ ID NO: 2056732 - RNA, 22 nt, Homo sapiens
uacucagacgugugaccuccau

SEQ ID NO: 2056733 - RNA, 22 nt, Homo sapiens
uccaaaaacaguaaaaauaacc

SEQ ID NO: 2056734 - RNA, 14 nt, Homo sapiens
uaaugaugaucuuc

SEQ ID NO: 2056735 - RNA, 21 nt, Homo sapiens
ucugaggggcuaccaggaaag

SEQ ID NO: 2056736 - RNA, 17 nt, Homo sapiens
ccccuuuggcacuggau

SEQ ID NO: 2056737 - RNA, 15 nt, Homo sapiens
agcagaaucuuugca

SEQ ID NO: 2056738 - RNA, 14 nt, Homo sapiens
cagacgccugauau

SEQ ID NO: 2056739 - RNA, 22 nt, Homo sapiens
cugcccuucucacgggcucuau

SEQ ID NO: 2056740 - RNA, 20 nt, Homo sapiens
acaauauuguauacuaccau

SEQ ID NO: 2056741 - RNA, 18 nt, Homo sapiens
uaaugauggaacuuagac

SEQ ID NO: 2056742 - RNA, 16 nt, Homo sapiens
aaaacuuucacugaau

SEQ ID NO: 2056743 - RNA, 12 nt, Homo sapiens
ucauguaugcau

SEQ ID NO: 2056744 - RNA, 13 nt, Homo sapiens
cucaaaagaacuu

SEQ ID NO: 2056745 - RNA, 18 nt, Homo sapiens
uccugacaucacagcagc

SEQ ID NO: 2056746 - RNA, 19 nt, Homo sapiens
accucuguauagaaaucua

SEQ ID NO: 2056747 - RNA, 16 nt, Homo sapiens
cuggaaucaauuuccc

SEQ ID NO: 2056748 - RNA, 15 nt, Homo sapiens
uguauauuauuuggc

SEQ ID NO: 2056749 - RNA, 20 nt, Homo sapiens
ugaccaaucgggaguagcaa

SEQ ID NO: 2056750 - RNA, 19 nt, Homo sapiens
ccucuaacucacugccuag

SEQ ID NO: 2056751 - RNA, 22 nt, Homo sapiens
aaccucacauacccucacuuaa

SEQ ID NO: 2056752 - RNA, 15 nt, Homo sapiens
uacauaacuugauau

SEQ ID NO: 2056753 - RNA, 15 nt, Homo sapiens
caauaaagccuucaa

SEQ ID NO: 2056754 - RNA, 22 nt, Homo sapiens
caggguauaccucuaauaaccu

SEQ ID NO: 2056755 - RNA, 17 nt, Homo sapiens
cccucaaagcuuccauu

SEQ ID NO: 2056756 - RNA, 15 nt, Homo sapiens
uggauggcugccuca

SEQ ID NO: 2056757 - RNA, 17 nt, Homo sapiens
gccaccagaaaccacaa

SEQ ID NO: 2056758 - RNA, 17 nt, Homo sapiens
guugaaaaauguugcuc

SEQ ID NO: 2056759 - RNA, 14 nt, Homo sapiens
uaauacugaaggac

SEQ ID NO: 2056760 - RNA, 20 nt, Homo sapiens
acccuugagaaggugcuuug

SEQ ID NO: 2056761 - RNA, 20 nt, Homo sapiens
ccacuccccccauaucuuua

SEQ ID NO: 2056762 - RNA, 18 nt, Homo sapiens
ccaggaccaagcuuaagg

SEQ ID NO: 2056763 - RNA, 20 nt, Homo sapiens
aaaugccacucaccaaccca

SEQ ID NO: 2056764 - RNA, 19 nt, Homo sapiens
ggugccaucacgcuuguga

SEQ ID NO: 2056765 - RNA, 17 nt, Homo sapiens
gccaccuuuauggacug

SEQ ID NO: 2056766 - RNA, 15 nt, Homo sapiens
gggccuggggcuccu

SEQ ID NO: 2056767 - RNA, 22 nt, Homo sapiens
aaaagccuccgguuuccacuac

SEQ ID NO: 2056768 - RNA, 18 nt, Homo sapiens
caccaccaugcucaacua

SEQ ID NO: 2056769 - RNA, 13 nt, Homo sapiens
ugaaaguggacaa

SEQ ID NO: 2056770 - RNA, 17 nt, Homo sapiens
agaggaaccagcacucc

SEQ ID NO: 2056771 - RNA, 14 nt, Homo sapiens
ugauuaugccacug

SEQ ID NO: 2056772 - RNA, 22 nt, Homo sapiens
augucauagaaauauugacuca

SEQ ID NO: 2056773 - RNA, 17 nt, Homo sapiens
uugcuaaugacagccuu

SEQ ID NO: 2056774 - RNA, 16 nt, Homo sapiens
agguucagcugaagcu

SEQ ID NO: 2056775 - RNA, 22 nt, Homo sapiens
uauugcuucccugcuauuuccc

SEQ ID NO: 2056776 - RNA, 14 nt, Homo sapiens
acccccagcucaau

SEQ ID NO: 2056777 - RNA, 24 nt, Homo sapiens
caguuugaagcccaaucugcaagg

SEQ ID NO: 2056778 - RNA, 22 nt, Homo sapiens
agaaggauggcauuuuuugcaa

SEQ ID NO: 2056779 - RNA, 21 nt, Homo sapiens
cugauucaauuugauguggug

SEQ ID NO: 2056780 - RNA, 13 nt, Homo sapiens
uuaaaauacauga

SEQ ID NO: 2056781 - RNA, 13 nt, Homo sapiens
ugauguccagaag

SEQ ID NO: 2056782 - RNA, 14 nt, Homo sapiens
cacaaaggucacag

SEQ ID NO: 2056783 - RNA, 17 nt, Homo sapiens
uuaucuaaaucaccaga

SEQ ID NO: 2056784 - RNA, 21 nt, Homo sapiens
uccuugguaccccuaaaaaga

SEQ ID NO: 2056785 - RNA, 19 nt, Homo sapiens
aaugaguguguuuuguaca

SEQ ID NO: 2056786 - RNA, 17 nt, Homo sapiens
ugcaaaauguguuucag

SEQ ID NO: 2056787 - RNA, 17 nt, Homo sapiens
uacuuucuguugccaca

SEQ ID NO: 2056788 - RNA, 14 nt, Homo sapiens
ugggauggggacau

SEQ ID NO: 2056789 - RNA, 20 nt, Homo sapiens
aauguggaauugacugccua

SEQ ID NO: 2056790 - RNA, 13 nt, Homo sapiens
acauaaagguaaa

SEQ ID NO: 2056791 - RNA, 15 nt, Homo sapiens
auauggagugaccaa

SEQ ID NO: 2056792 - RNA, 21 nt, Homo sapiens
aucaacuggggggaccaaaua

SEQ ID NO: 2056793 - RNA, 19 nt, Homo sapiens
ccugggguucuuuuugcca

SEQ ID NO: 2056794 - RNA, 12 nt, Homo sapiens
uuccacaccccu

SEQ ID NO: 2056795 - RNA, 10 nt, Homo sapiens
cacacuccua

SEQ ID NO: 2056796 - RNA, 10 nt, Homo sapiens
cucacuccuu

SEQ ID NO: 2056797 - RNA, 13 nt, Homo sapiens
cacaggaagugac

SEQ ID NO: 2056798 - RNA, 16 nt, Homo sapiens
agcuaugcaaaaagcu

SEQ ID NO: 2056799 - RNA, 20 nt, Homo sapiens
auuauuaagguaacuacugc

SEQ ID NO: 2056800 - RNA, 20 nt, Homo sapiens
uuauaaaaaugagugcuuaa

SEQ ID NO: 2056801 - RNA, 23 nt, Homo sapiens
uccuaagcuggagugcaguggca

SEQ ID NO: 2056802 - RNA, 22 nt, Homo sapiens
aaucccaacguuuuacauaaaa

SEQ ID NO: 2056803 - RNA, 22 nt, Homo sapiens
ugaugccuuccgacaccacugg

SEQ ID NO: 2056804 - RNA, 14 nt, Homo sapiens
ucucuaacauuucc

SEQ ID NO: 2056805 - RNA, 14 nt, Homo sapiens
ccuaauguuuauag

SEQ ID NO: 2056806 - RNA, 14 nt, Homo sapiens
uggcuaauucccag

SEQ ID NO: 2056807 - RNA, 16 nt, Homo sapiens
ccuaugacauacaugg

SEQ ID NO: 2056808 - RNA, 23 nt, Homo sapiens
caggaagggggccgccacccucc

SEQ ID NO: 2056809 - RNA, 15 nt, Homo sapiens
acaugggacauuugc

SEQ ID NO: 2056810 - RNA, 18 nt, Homo sapiens
guuucugaggaucagcac

SEQ ID NO: 2056811 - RNA, 13 nt, Homo sapiens
cuucagucuugau

SEQ ID NO: 2056812 - RNA, 20 nt, Homo sapiens
gugauaggacauucuaugcu

SEQ ID NO: 2056813 - RNA, 13 nt, Homo sapiens
ucugaucuggguu

SEQ ID NO: 2056814 - RNA, 20 nt, Homo sapiens
ccugugaguacuacaguccu

SEQ ID NO: 2056815 - RNA, 17 nt, Homo sapiens
ucucacagaagggccug

SEQ ID NO: 2056816 - RNA, 19 nt, Homo sapiens
aguggauaaccacagggcu

SEQ ID NO: 2056817 - RNA, 16 nt, Homo sapiens
ucuuuaguugauuuaa

SEQ ID NO: 2056818 - RNA, 18 nt, Homo sapiens
ucaagccauaauguaagg

SEQ ID NO: 2056819 - RNA, 19 nt, Homo sapiens
gcccagcaggggcccucac

SEQ ID NO: 2056820 - RNA, 20 nt, Homo sapiens
cuguugcaaagguagggacu

SEQ ID NO: 2056821 - RNA, 19 nt, Homo sapiens
uucacaugguuacauauca

SEQ ID NO: 2056822 - RNA, 13 nt, Homo sapiens
augauacauccaa

SEQ ID NO: 2056823 - RNA, 14 nt, Homo sapiens
uagugcuggucaga

SEQ ID NO: 2056824 - RNA, 19 nt, Homo sapiens
ccaaagcccaaagugguau

SEQ ID NO: 2056825 - RNA, 19 nt, Homo sapiens
ugggcuacccuaaagggag

SEQ ID NO: 2056826 - RNA, 20 nt, Homo sapiens
uacauguacacgugcacaga

SEQ ID NO: 2056827 - RNA, 21 nt, Homo sapiens
acauaagacagacagcaguuu

SEQ ID NO: 2056828 - RNA, 18 nt, Homo sapiens
gcagcccccacugaccug

SEQ ID NO: 2056829 - RNA, 13 nt, Homo sapiens
ccauacagccagg

SEQ ID NO: 2056830 - RNA, 14 nt, Homo sapiens
cauucuccggccuc

SEQ ID NO: 2056831 - RNA, 20 nt, Homo sapiens
acaaucuaauuaaauggcau

SEQ ID NO: 2056832 - RNA, 17 nt, Homo sapiens
cccuccccagaguucuu

SEQ ID NO: 2056833 - RNA, 20 nt, Homo sapiens
uccuuauugaaaaaucagug

SEQ ID NO: 2056834 - RNA, 15 nt, Homo sapiens
cugcuaccuuccuag

SEQ ID NO: 2056835 - RNA, 19 nt, Homo sapiens
cuguuugaaaacuucagaa

SEQ ID NO: 2056836 - RNA, 18 nt, Homo sapiens
acggaggcauccuacccu

SEQ ID NO: 2056837 - RNA, 23 nt, Homo sapiens
gcagaucaagaaaucccugagac

SEQ ID NO: 2056838 - RNA, 18 nt, Homo sapiens
acuggcuccaacacugca

SEQ ID NO: 2056839 - RNA, 22 nt, Homo sapiens
guguuccugagacagaauuaau

SEQ ID NO: 2056840 - RNA, 22 nt, Homo sapiens
ccuggaacaccagcagcacugg

SEQ ID NO: 2056841 - RNA, 11 nt, Homo sapiens
accaaguccaa

SEQ ID NO: 2056842 - RNA, 15 nt, Homo sapiens
aguaacauuaacuca

SEQ ID NO: 2056843 - RNA, 14 nt, Homo sapiens
caacgcucccagac

SEQ ID NO: 2056844 - RNA, 22 nt, Homo sapiens
uaaaaaaaacaaaaagaacaaa

SEQ ID NO: 2056845 - RNA, 17 nt, Homo sapiens
ucaagguuuguucaaca

SEQ ID NO: 2056846 - RNA, 16 nt, Homo sapiens
cuaucuaacacuuuug

SEQ ID NO: 2056847 - RNA, 15 nt, Homo sapiens
augauaaauuugacu

SEQ ID NO: 2056848 - RNA, 21 nt, Homo sapiens
uccccuacaucaaaugcucaa

SEQ ID NO: 2056849 - RNA, 23 nt, Homo sapiens
acaagucaccaaaagacacugca

SEQ ID NO: 2056850 - RNA, 20 nt, Homo sapiens
caggagaauuaggaaggcca

SEQ ID NO: 2056851 - RNA, 20 nt, Homo sapiens
caugaguauuccuagcaaau

SEQ ID NO: 2056852 - RNA, 12 nt, Homo sapiens
gcaaaauggaga

SEQ ID NO: 2056853 - RNA, 12 nt, Homo sapiens
ugaaauaucauc

SEQ ID NO: 2056854 - RNA, 16 nt, Homo sapiens
gacaccauucauucca

SEQ ID NO: 2056855 - RNA, 15 nt, Homo sapiens
ggcccccugugccag

SEQ ID NO: 2056856 - RNA, 13 nt, Homo sapiens
aucaaacccacga

SEQ ID NO: 2056857 - RNA, 15 nt, Homo sapiens
agcuacugacauucc

SEQ ID NO: 2056858 - RNA, 22 nt, Homo sapiens
ucaaagagggagugcauuuaug

SEQ ID NO: 2056859 - RNA, 23 nt, Homo sapiens
caucugugucucuggaacccagg

SEQ ID NO: 2056860 - RNA, 22 nt, Homo sapiens
ucggucacuccaacucccuuaa

SEQ ID NO: 2056861 - RNA, 17 nt, Homo sapiens
cagcauggaaacaagau

SEQ ID NO: 2056862 - RNA, 14 nt, Homo sapiens
auaugaacuuucau

SEQ ID NO: 2056863 - RNA, 22 nt, Homo sapiens
caaugcacccccaaccuccauc

SEQ ID NO: 2056864 - RNA, 19 nt, Homo sapiens
agguagaaauaucugaaaa

SEQ ID NO: 2056865 - RNA, 17 nt, Homo sapiens
gccccaaaccagggugc

SEQ ID NO: 2056866 - RNA, 14 nt, Homo sapiens
cauaacuugcugaa

SEQ ID NO: 2056867 - RNA, 17 nt, Homo sapiens
caccaauuccaccaaga

SEQ ID NO: 2056868 - RNA, 20 nt, Homo sapiens
cuugaggggccccagcgucu

SEQ ID NO: 2056869 - RNA, 15 nt, Homo sapiens
uacacuaaccaaauc

SEQ ID NO: 2056870 - RNA, 16 nt, Homo sapiens
cgccaagcaggacagu

SEQ ID NO: 2056871 - RNA, 14 nt, Homo sapiens
aagaaagaauuccu

SEQ ID NO: 2056872 - RNA, 14 nt, Homo sapiens
cauccugacugaaa

SEQ ID NO: 2056873 - RNA, 16 nt, Homo sapiens
uuuagaaucagugugu

SEQ ID NO: 2056874 - RNA, 16 nt, Homo sapiens
gaaaagauugggucua

SEQ ID NO: 2056875 - RNA, 16 nt, Homo sapiens
uaaacgcugucccuag

SEQ ID NO: 2056876 - RNA, 22 nt, Homo sapiens
cacuagguaggcuucuaccugc

SEQ ID NO: 2056877 - RNA, 18 nt, Homo sapiens
uauagaauaaaagcuaua

SEQ ID NO: 2056878 - RNA, 19 nt, Homo sapiens
gccucccuuugugugcaua

SEQ ID NO: 2056879 - RNA, 15 nt, Homo sapiens
ugaaugcaauaguag

SEQ ID NO: 2056880 - RNA, 11 nt, Homo sapiens
ugcuaacuggu

SEQ ID NO: 2056881 - RNA, 13 nt, Homo sapiens
auuuauugccugg

SEQ ID NO: 2056882 - RNA, 16 nt, Homo sapiens
aauccauuaucgagca

SEQ ID NO: 2056883 - RNA, 19 nt, Homo sapiens
aaagcuguucugucuuccc

SEQ ID NO: 2056884 - RNA, 22 nt, Homo sapiens
uuuuaaauuuucucucacugau

SEQ ID NO: 2056885 - RNA, 16 nt, Homo sapiens
caggccucugugggcc

SEQ ID NO: 2056886 - RNA, 17 nt, Homo sapiens
ccuaggaguauccucau

SEQ ID NO: 2056887 - RNA, 23 nt, Homo sapiens
ucaucaacgucucagcccuucag

SEQ ID NO: 2056888 - RNA, 16 nt, Homo sapiens
uugacaagcaucagga

SEQ ID NO: 2056889 - RNA, 14 nt, Homo sapiens
gaauuccagcaaaa

SEQ ID NO: 2056890 - RNA, 15 nt, Homo sapiens
ucaagugauccuccu

SEQ ID NO: 2056891 - RNA, 21 nt, Homo sapiens
acacauuuuuauaaaaaugag

SEQ ID NO: 2056892 - RNA, 20 nt, Homo sapiens
ccugaucaagguacaauucu

SEQ ID NO: 2056893 - RNA, 16 nt, Homo sapiens
ugagaaaacuaaguca

SEQ ID NO: 2056894 - RNA, 21 nt, Homo sapiens
aaguuaaacuauuuugagcau

SEQ ID NO: 2056895 - RNA, 18 nt, Homo sapiens
gggucuaugcacagcugg

SEQ ID NO: 2056896 - RNA, 19 nt, Homo sapiens
ggugaacagaaccucccaa

SEQ ID NO: 2056897 - RNA, 15 nt, Homo sapiens
cuucaugcaaugaca

SEQ ID NO: 2056898 - RNA, 14 nt, Homo sapiens
auugugugugcaag

SEQ ID NO: 2056899 - RNA, 22 nt, Homo sapiens
acauccuaugaaauacuuuaua

SEQ ID NO: 2056900 - RNA, 22 nt, Homo sapiens
acgugugaguggucaggcaucu

SEQ ID NO: 2056901 - RNA, 18 nt, Homo sapiens
aaauucucaaccuaccac

SEQ ID NO: 2056902 - RNA, 14 nt, Homo sapiens
uagucauuuacuaa

SEQ ID NO: 2056903 - RNA, 20 nt, Homo sapiens
uauauaaugguuuacugcug

SEQ ID NO: 2056904 - RNA, 17 nt, Homo sapiens
augaaaagaaacaagau

SEQ ID NO: 2056905 - RNA, 22 nt, Homo sapiens
agaaucaauccagcgguucuca

SEQ ID NO: 2056906 - RNA, 23 nt, Homo sapiens
uuacuuuuuccuggcucaucucu

SEQ ID NO: 2056907 - RNA, 14 nt, Homo sapiens
aagggaaggacaga

SEQ ID NO: 2056908 - RNA, 17 nt, Homo sapiens
gcaggaggagcaacuca

SEQ ID NO: 2056909 - RNA, 23 nt, Homo sapiens
cugaggcacaagaaucacuugaa

SEQ ID NO: 2056910 - RNA, 22 nt, Homo sapiens
cuuuuaugugaaacauguuucu

SEQ ID NO: 2056911 - RNA, 17 nt, Homo sapiens
cacucagugcagcaaua

SEQ ID NO: 2056912 - RNA, 18 nt, Homo sapiens
ugacauauucaagugaua

SEQ ID NO: 2056913 - RNA, 16 nt, Homo sapiens
accaaaaugacaucuu

SEQ ID NO: 2056914 - RNA, 23 nt, Homo sapiens
uaaagauuauaauaugugccuua

SEQ ID NO: 2056915 - RNA, 11 nt, Homo sapiens
ccuggccagug

SEQ ID NO: 2056916 - RNA, 17 nt, Homo sapiens
ucccagcuacucgggag

SEQ ID NO: 2056917 - RNA, 12 nt, Homo sapiens
accugugaauca

SEQ ID NO: 2056918 - RNA, 16 nt, Homo sapiens
cuguucaaagcugccu

SEQ ID NO: 2056919 - RNA, 16 nt, Homo sapiens
uaaaguaugugcauau

SEQ ID NO: 2056920 - RNA, 20 nt, Homo sapiens
ggccaccugcaggacccugu

SEQ ID NO: 2056921 - RNA, 20 nt, Homo sapiens
ggucacccaacucaaggaca

SEQ ID NO: 2056922 - RNA, 17 nt, Homo sapiens
gcugcacugaugcugcc

SEQ ID NO: 2056923 - RNA, 18 nt, Homo sapiens
agcagaaucucagagaaa

SEQ ID NO: 2056924 - RNA, 16 nt, Homo sapiens
acuacuagagcuccau

SEQ ID NO: 2056925 - RNA, 14 nt, Homo sapiens
acaugaagcacaaa

SEQ ID NO: 2056926 - RNA, 19 nt, Homo sapiens
gcauucacaaggugacugg

SEQ ID NO: 2056927 - RNA, 21 nt, Homo sapiens
uuuccaaagcauuuuugauca

SEQ ID NO: 2056928 - RNA, 17 nt, Homo sapiens
caagugugugccugugu

SEQ ID NO: 2056929 - RNA, 13 nt, Homo sapiens
cagcugugcucca

SEQ ID NO: 2056930 - RNA, 20 nt, Homo sapiens
ccucacucagcaccacucaa

SEQ ID NO: 2056931 - RNA, 14 nt, Homo sapiens
ugacaauguuuaca

SEQ ID NO: 2056932 - RNA, 17 nt, Homo sapiens
aguguugugaaacugua

SEQ ID NO: 2056933 - RNA, 12 nt, Homo sapiens
ugagugucuguc

SEQ ID NO: 2056934 - RNA, 13 nt, Homo sapiens
aacucaagacaau

SEQ ID NO: 2056935 - RNA, 16 nt, Homo sapiens
gaaaugauuaauuuga

SEQ ID NO: 2056936 - RNA, 19 nt, Homo sapiens
gcauucucaauacuugaau

SEQ ID NO: 2056937 - RNA, 17 nt, Homo sapiens
agcccugugucuguaua

SEQ ID NO: 2056938 - RNA, 16 nt, Homo sapiens
auuauaaaaguuccua

SEQ ID NO: 2056939 - RNA, 18 nt, Homo sapiens
cugagugaaauacuguac

SEQ ID NO: 2056940 - RNA, 15 nt, Homo sapiens
aauaguauacauugu

SEQ ID NO: 2056941 - RNA, 17 nt, Homo sapiens
ugaaucuugucucacua

SEQ ID NO: 2056942 - RNA, 15 nt, Homo sapiens
uagcagucaaaucua

SEQ ID NO: 2056943 - RNA, 12 nt, Homo sapiens
ugaggugcucaa

SEQ ID NO: 2056944 - RNA, 16 nt, Homo sapiens
uucaccuaacuagaga

SEQ ID NO: 2056945 - RNA, 21 nt, Homo sapiens
uucgcuggcugaucauugcag

SEQ ID NO: 2056946 - RNA, 14 nt, Homo sapiens
cacuuugcucuggg

SEQ ID NO: 2056947 - RNA, 15 nt, Homo sapiens
ggacacuucucagga

SEQ ID NO: 2056948 - RNA, 17 nt, Homo sapiens
ggacucaaucuacaggc

SEQ ID NO: 2056949 - RNA, 16 nt, Homo sapiens
gaccccaggaacaaua

SEQ ID NO: 2056950 - RNA, 22 nt, Homo sapiens
caccuggggaguuuacuaccug

SEQ ID NO: 2056951 - RNA, 20 nt, Homo sapiens
ggaagcaccuaaaugaugcc

SEQ ID NO: 2056952 - RNA, 14 nt, Homo sapiens
ggaguaggcuguau

SEQ ID NO: 2056953 - RNA, 14 nt, Homo sapiens
ucuaucaauaguca

SEQ ID NO: 2056954 - RNA, 17 nt, Homo sapiens
ucauguaaguagcaaac

SEQ ID NO: 2056955 - RNA, 21 nt, Homo sapiens
uuccccugcucacucuuccac

SEQ ID NO: 2056956 - RNA, 16 nt, Homo sapiens
ugugccgaaugugcag

SEQ ID NO: 2056957 - RNA, 16 nt, Homo sapiens
ucuuccuaguauauua

SEQ ID NO: 2056958 - RNA, 20 nt, Homo sapiens
cuucuuaaggacaguguuca

SEQ ID NO: 2056959 - RNA, 15 nt, Homo sapiens
cugcuugaacccagg

SEQ ID NO: 2056960 - RNA, 15 nt, Homo sapiens
cuucgaggcccagcg

SEQ ID NO: 2056961 - RNA, 14 nt, Homo sapiens
auaugaguauacaa

SEQ ID NO: 2056962 - RNA, 14 nt, Homo sapiens
auucaaguauuuga

SEQ ID NO: 2056963 - RNA, 21 nt, Homo sapiens
auagcacuuugaaauaccuca

SEQ ID NO: 2056964 - RNA, 18 nt, Homo sapiens
gcuagaauggaaaacugc

SEQ ID NO: 2056965 - RNA, 18 nt, Homo sapiens
aaccuagggugccuuaaa

SEQ ID NO: 2056966 - RNA, 20 nt, Homo sapiens
ccucccaggaagaucuggcc

SEQ ID NO: 2056967 - RNA, 18 nt, Homo sapiens
aaagaaaucuucauuuau

SEQ ID NO: 2056968 - RNA, 23 nt, Homo sapiens
auguguucuaagcaaugcaaaug

SEQ ID NO: 2056969 - RNA, 20 nt, Homo sapiens
cuguuggauaaagaccuucc

SEQ ID NO: 2056970 - RNA, 17 nt, Homo sapiens
cuauuuuuauacaguga

SEQ ID NO: 2056971 - RNA, 18 nt, Homo sapiens
ucaccguguuagccagga

SEQ ID NO: 2056972 - RNA, 18 nt, Homo sapiens
cuaaaauauauuccugag

SEQ ID NO: 2056973 - RNA, 15 nt, Homo sapiens
gcuguggccacucca

SEQ ID NO: 2056974 - RNA, 16 nt, Homo sapiens
augaaucuuacuccuu

SEQ ID NO: 2056975 - RNA, 19 nt, Homo sapiens
aaugcagcacugcugccuc

SEQ ID NO: 2056976 - RNA, 20 nt, Homo sapiens
ugagcccccugaccuuccaa

SEQ ID NO: 2056977 - RNA, 15 nt, Homo sapiens
ggcggcccucaaaag

SEQ ID NO: 2056978 - RNA, 23 nt, Homo sapiens
uugcuaacauauuuaaagucuug

SEQ ID NO: 2056979 - RNA, 18 nt, Homo sapiens
auguacagaagagcaaaa

SEQ ID NO: 2056980 - RNA, 15 nt, Homo sapiens
uucccuucauuuaaa

SEQ ID NO: 2056981 - RNA, 17 nt, Homo sapiens
accccccguggcacuca

SEQ ID NO: 2056982 - RNA, 21 nt, Homo sapiens
aggucuccugggcaucuggcc

SEQ ID NO: 2056983 - RNA, 23 nt, Homo sapiens
ugccaguguuuagaagagccuga

SEQ ID NO: 2056984 - RNA, 20 nt, Homo sapiens
augccucacgagauuugcca

SEQ ID NO: 2056985 - RNA, 19 nt, Homo sapiens
acccuaggcagacaccagg

SEQ ID NO: 2056986 - RNA, 19 nt, Homo sapiens
cucucacugcauuugguca

SEQ ID NO: 2056987 - RNA, 23 nt, Homo sapiens
agaaaccuauauuucaauacugc

SEQ ID NO: 2056988 - RNA, 13 nt, Homo sapiens
ucugccuguggaa

SEQ ID NO: 2056989 - RNA, 12 nt, Homo sapiens
uguggacuccag

SEQ ID NO: 2056990 - RNA, 22 nt, Homo sapiens
gauuaaagugccuucagccaag

SEQ ID NO: 2056991 - RNA, 15 nt, Homo sapiens
gggcuggaguccucu

SEQ ID NO: 2056992 - RNA, 20 nt, Homo sapiens
ucucaggaccaaagcuuuca

SEQ ID NO: 2056993 - RNA, 21 nt, Homo sapiens
cugcauuuuacacaugugcug

SEQ ID NO: 2056994 - RNA, 17 nt, Homo sapiens
caccuacuuacaugcau

SEQ ID NO: 2056995 - RNA, 15 nt, Homo sapiens
uauacugagcugcua

SEQ ID NO: 2056996 - RNA, 22 nt, Homo sapiens
aguccccuccguaggagcucac

SEQ ID NO: 2056997 - RNA, 16 nt, Homo sapiens
cauguaaauugcaaau

SEQ ID NO: 2056998 - RNA, 20 nt, Homo sapiens
aucuguccacauccccagag

SEQ ID NO: 2056999 - RNA, 20 nt, Homo sapiens
ugauaugaaaaauaugauau

SEQ ID NO: 2057000 - RNA, 23 nt, Homo sapiens
ucacuuccguuuaccuucauggu

SEQ ID NO: 2057001 - RNA, 18 nt, Homo sapiens
ucaauuacaggaaguacu

SEQ ID NO: 2057002 - RNA, 13 nt, Homo sapiens
cucuaucugcaau

SEQ ID NO: 2057003 - RNA, 13 nt, Homo sapiens
agauccagcuuuu

SEQ ID NO: 2057004 - RNA, 17 nt, Homo sapiens
ucauguagccccaguca

SEQ ID NO: 2057005 - RNA, 14 nt, Homo sapiens
aaaacagugauuaa

SEQ ID NO: 2057006 - RNA, 22 nt, Homo sapiens
uacccaugcuuuguuuuucaca

SEQ ID NO: 2057007 - RNA, 17 nt, Homo sapiens
uuuuucugggaaguccu

SEQ ID NO: 2057008 - RNA, 21 nt, Homo sapiens
agagaucuuucuuuccaaaac

SEQ ID NO: 2057009 - RNA, 18 nt, Homo sapiens
cugccaaaggaugugaua

SEQ ID NO: 2057010 - RNA, 14 nt, Homo sapiens
uggcgacugucaug

SEQ ID NO: 2057011 - RNA, 16 nt, Homo sapiens
gacauuuucucuuaga

SEQ ID NO: 2057012 - RNA, 21 nt, Homo sapiens
ccagccucugccgcugccaug

SEQ ID NO: 2057013 - RNA, 17 nt, Homo sapiens
agacccaggagagacag

SEQ ID NO: 2057014 - RNA, 20 nt, Homo sapiens
cuaaauaugcccaauuucau

SEQ ID NO: 2057015 - RNA, 22 nt, Homo sapiens
caauaacuucagagaagucagu

SEQ ID NO: 2057016 - RNA, 23 nt, Homo sapiens
auagcuuccccaccagcuuuauu

SEQ ID NO: 2057017 - RNA, 15 nt, Homo sapiens
aaagccucagugaaa

SEQ ID NO: 2057018 - RNA, 19 nt, Homo sapiens
ugacaaagaagaccacaaa

SEQ ID NO: 2057019 - RNA, 17 nt, Homo sapiens
cauaacugaacauccaa

SEQ ID NO: 2057020 - RNA, 22 nt, Homo sapiens
ggagugaccaaaggugugcccu

SEQ ID NO: 2057021 - RNA, 16 nt, Homo sapiens
agcaagggggcccaaa

SEQ ID NO: 2057022 - RNA, 22 nt, Homo sapiens
aauaccagugaaccaaagagac

SEQ ID NO: 2057023 - RNA, 19 nt, Homo sapiens
gugaggguugcuucaauga

SEQ ID NO: 2057024 - RNA, 16 nt, Homo sapiens
uuuauauaauaucuaa

SEQ ID NO: 2057025 - RNA, 18 nt, Homo sapiens
uuaaucuauaacuacaua

SEQ ID NO: 2057026 - RNA, 16 nt, Homo sapiens
gucuagagaacacugu

SEQ ID NO: 2057027 - RNA, 18 nt, Homo sapiens
gccaacuguccuacucau

SEQ ID NO: 2057028 - RNA, 16 nt, Homo sapiens
aucucuugcccuuccu

SEQ ID NO: 2057029 - RNA, 12 nt, Homo sapiens
uuauucuaaggu

SEQ ID NO: 2057030 - RNA, 21 nt, Homo sapiens
ccugaguuggcaucaccugcg

SEQ ID NO: 2057031 - RNA, 23 nt, Homo sapiens
aggccuucaguuuauuuccacua

SEQ ID NO: 2057032 - RNA, 22 nt, Homo sapiens
gugugcaugaagaaaagacacu

SEQ ID NO: 2057033 - RNA, 11 nt, Homo sapiens
gacuccacugg

SEQ ID NO: 2057034 - RNA, 18 nt, Homo sapiens
agaccaggaggcugcaag

SEQ ID NO: 2057035 - RNA, 15 nt, Homo sapiens
aggugcuacuuuaua

SEQ ID NO: 2057036 - RNA, 13 nt, Homo sapiens
uacagucauuucc

SEQ ID NO: 2057037 - RNA, 18 nt, Homo sapiens
acugaguuugaacacaga

SEQ ID NO: 2057038 - RNA, 17 nt, Homo sapiens
guggccaggggugguga

SEQ ID NO: 2057039 - RNA, 18 nt, Homo sapiens
guaccauauucagcauuu

SEQ ID NO: 2057040 - RNA, 11 nt, Homo sapiens
ucccucaggcc

SEQ ID NO: 2057041 - RNA, 19 nt, Homo sapiens
cagacuuucaagauuauuc

SEQ ID NO: 2057042 - RNA, 13 nt, Homo sapiens
ugucucuugagaa

SEQ ID NO: 2057043 - RNA, 18 nt, Homo sapiens
gacuucuaauaucauuca

SEQ ID NO: 2057044 - RNA, 13 nt, Homo sapiens
cugcuagcacaga

SEQ ID NO: 2057045 - RNA, 21 nt, Homo sapiens
ccagcaucauguagugcauuu

SEQ ID NO: 2057046 - RNA, 23 nt, Homo sapiens
ucaccuuggaggcccugcacugc

SEQ ID NO: 2057047 - RNA, 19 nt, Homo sapiens
cuguguaaacucaucugaa

SEQ ID NO: 2057048 - RNA, 12 nt, Homo sapiens
aaagguccugua

SEQ ID NO: 2057049 - RNA, 21 nt, Homo sapiens
ccaccccuacauuuuuugaaa

SEQ ID NO: 2057050 - RNA, 16 nt, Homo sapiens
acucagaucugaaaga

SEQ ID NO: 2057051 - RNA, 18 nt, Homo sapiens
uaccaaccuguucaaguc

SEQ ID NO: 2057052 - RNA, 15 nt, Homo sapiens
ugauuaguaugcuau

SEQ ID NO: 2057053 - RNA, 19 nt, Homo sapiens
acugguuuggggacgggug

SEQ ID NO: 2057054 - RNA, 16 nt, Homo sapiens
ugcacucaguuuacuc

SEQ ID NO: 2057055 - RNA, 19 nt, Homo sapiens
acccuuguuuacacauacc

SEQ ID NO: 2057056 - RNA, 23 nt, Homo sapiens
uaaauauuuaaagaaaaaaaagu

SEQ ID NO: 2057057 - RNA, 18 nt, Homo sapiens
ucgcuggugaagacccag

SEQ ID NO: 2057058 - RNA, 13 nt, Homo sapiens
auuuuuuauucaa

SEQ ID NO: 2057059 - RNA, 20 nt, Homo sapiens
acuuuccccaauuacagggu

SEQ ID NO: 2057060 - RNA, 20 nt, Homo sapiens
cagagugagacucugucuca

SEQ ID NO: 2057061 - RNA, 20 nt, Homo sapiens
cagagcgagacuccgucuca

SEQ ID NO: 2057062 - RNA, 20 nt, Homo sapiens
cagagcgagauuccgucuua

SEQ ID NO: 2057063 - RNA, 20 nt, Homo sapiens
cagagcaagacuccaucuca

SEQ ID NO: 2057064 - RNA, 23 nt, Homo sapiens
uuaccuucugcuguuuguuccag

SEQ ID NO: 2057065 - RNA, 18 nt, Homo sapiens
gcaggaccagaaggcaau

SEQ ID NO: 2057066 - RNA, 20 nt, Homo sapiens
uggcagcauacacagaugaa

SEQ ID NO: 2057067 - RNA, 18 nt, Homo sapiens
ugugcuguugauucuuuc

SEQ ID NO: 2057068 - RNA, 14 nt, Homo sapiens
aucagacucaucua

SEQ ID NO: 2057069 - RNA, 19 nt, Homo sapiens
cauaggauccgaagugcaa

SEQ ID NO: 2057070 - RNA, 19 nt, Homo sapiens
uauauuugaacuccucuca

SEQ ID NO: 2057071 - RNA, 22 nt, Homo sapiens
gauuaagaucagcaaagggagg

SEQ ID NO: 2057072 - RNA, 17 nt, Homo sapiens
ccacagcacaaacacac

SEQ ID NO: 2057073 - RNA, 15 nt, Homo sapiens
gauccuuuuccaucc

SEQ ID NO: 2057074 - RNA, 23 nt, Homo sapiens
gcccuucuuccccuucccugacu

SEQ ID NO: 2057075 - RNA, 17 nt, Homo sapiens
aggagcaggcacgggug

SEQ ID NO: 2057076 - RNA, 18 nt, Homo sapiens
uuaauguagaaccucaaa

SEQ ID NO: 2057077 - RNA, 20 nt, Homo sapiens
gcuccccuccucggcuuccu

SEQ ID NO: 2057078 - RNA, 19 nt, Homo sapiens
ugcaccagcgcccccagaa

SEQ ID NO: 2057079 - RNA, 15 nt, Homo sapiens
uggaaaguuacugua

SEQ ID NO: 2057080 - RNA, 20 nt, Homo sapiens
cccccuccaaagucuugaua

SEQ ID NO: 2057081 - RNA, 13 nt, Homo sapiens
caaagacauucug

SEQ ID NO: 2057082 - RNA, 19 nt, Homo sapiens
ccugaaguggaaugacuga

SEQ ID NO: 2057083 - RNA, 20 nt, Homo sapiens
aaccuccaccucccagguuc

SEQ ID NO: 2057084 - RNA, 23 nt, Homo sapiens
ugaggaaaaauauuccugugacu

SEQ ID NO: 2057085 - RNA, 14 nt, Homo sapiens
uaccuauugcugua

SEQ ID NO: 2057086 - RNA, 20 nt, Homo sapiens
agcuggaucgcugcacaugg

SEQ ID NO: 2057087 - RNA, 18 nt, Homo sapiens
ggaucuuggagaauguga

SEQ ID NO: 2057088 - RNA, 17 nt, Homo sapiens
gcaaaugccaacuguug

SEQ ID NO: 2057089 - RNA, 21 nt, Homo sapiens
accacagucuucccagcaauu

SEQ ID NO: 2057090 - RNA, 15 nt, Homo sapiens
aaaucccaugguugu

SEQ ID NO: 2057091 - RNA, 14 nt, Homo sapiens
guuugcugugaaca

SEQ ID NO: 2057092 - RNA, 20 nt, Homo sapiens
auguuuuagacaaauacuca

SEQ ID NO: 2057093 - RNA, 21 nt, Homo sapiens
uauuagagcugccugugccuu

SEQ ID NO: 2057094 - RNA, 21 nt, Homo sapiens
agggcaaaucuauuacuuuug

SEQ ID NO: 2057095 - RNA, 18 nt, Homo sapiens
cuaaccugacaucaccaa

SEQ ID NO: 2057096 - RNA, 14 nt, Homo sapiens
ccuucucggagcug

SEQ ID NO: 2057097 - RNA, 23 nt, Homo sapiens
cugcagcccugagaaagcccugu

SEQ ID NO: 2057098 - RNA, 11 nt, Homo sapiens
gacccauuccu

SEQ ID NO: 2057099 - RNA, 21 nt, Homo sapiens
ugaaaugacuuuuccauucuc

SEQ ID NO: 2057100 - RNA, 20 nt, Homo sapiens
uugcugucuuggggucccac

SEQ ID NO: 2057101 - RNA, 12 nt, Homo sapiens
gaaaucuugcuu

SEQ ID NO: 2057102 - RNA, 12 nt, Homo sapiens
ucauucuuuaua

SEQ ID NO: 2057103 - RNA, 18 nt, Homo sapiens
aggugguaguaaaacaca

SEQ ID NO: 2057104 - RNA, 23 nt, Homo sapiens
caaucaaccaaaguuaguucagu

SEQ ID NO: 2057105 - RNA, 22 nt, Homo sapiens
uggagaccaggccugagcaaca

SEQ ID NO: 2057106 - RNA, 22 nt, Homo sapiens
ugggaaaugucgauuuucaaua

SEQ ID NO: 2057107 - RNA, 22 nt, Homo sapiens
ucuuaaauuuucuuccuuugaa

SEQ ID NO: 2057108 - RNA, 22 nt, Homo sapiens
gcacagccucuuagaugcaguu

SEQ ID NO: 2057109 - RNA, 14 nt, Homo sapiens
aucuugaauagucu

SEQ ID NO: 2057110 - RNA, 20 nt, Homo sapiens
auucuuauuuaaguuauuga

SEQ ID NO: 2057111 - RNA, 23 nt, Homo sapiens
agccauggcuucgucauuugcaa

SEQ ID NO: 2057112 - RNA, 21 nt, Homo sapiens
aucugacacaaaaaaaguuga

SEQ ID NO: 2057113 - RNA, 18 nt, Homo sapiens
gcaaguuuccaucaucua

SEQ ID NO: 2057114 - RNA, 17 nt, Homo sapiens
ugaaaaauauugcuaaa

SEQ ID NO: 2057115 - RNA, 23 nt, Homo sapiens
cccuaccugccuguucuccagau

SEQ ID NO: 2057116 - RNA, 17 nt, Homo sapiens
ccccagagagcaggcag

SEQ ID NO: 2057117 - RNA, 17 nt, Homo sapiens
ccuggggcugaucucag

SEQ ID NO: 2057118 - RNA, 19 nt, Homo sapiens
uauuucacuggagcacaau

SEQ ID NO: 2057119 - RNA, 18 nt, Homo sapiens
guagagaugggguuucac

SEQ ID NO: 2057120 - RNA, 18 nt, Homo sapiens
uucaggaagaaagggaaa

SEQ ID NO: 2057121 - RNA, 14 nt, Homo sapiens
cuguugaagucuca

SEQ ID NO: 2057122 - RNA, 14 nt, Homo sapiens
uucaaccaguuuga

SEQ ID NO: 2057123 - RNA, 21 nt, Homo sapiens
ccagauuagagccuguaaacu

SEQ ID NO: 2057124 - RNA, 10 nt, Homo sapiens
gaaaauggaa

SEQ ID NO: 2057125 - RNA, 22 nt, Homo sapiens
uaucuauaguagacacacuauc

SEQ ID NO: 2057126 - RNA, 19 nt, Homo sapiens
aaaugacucuacuaaaagu

SEQ ID NO: 2057127 - RNA, 17 nt, Homo sapiens
ugcucuguacccaugaa

SEQ ID NO: 2057128 - RNA, 20 nt, Homo sapiens
aucccacccaacagcucaga

SEQ ID NO: 2057129 - RNA, 18 nt, Homo sapiens
acccccgcaaguuugcac

SEQ ID NO: 2057130 - RNA, 15 nt, Homo sapiens
aggcugcaccaggag

SEQ ID NO: 2057131 - RNA, 19 nt, Homo sapiens
uugaauuggacaauaaucu

SEQ ID NO: 2057132 - RNA, 16 nt, Homo sapiens
aauaaauguacauuaa

SEQ ID NO: 2057133 - RNA, 16 nt, Homo sapiens
aaucuuuguaccaaaa

SEQ ID NO: 2057134 - RNA, 16 nt, Homo sapiens
ggagucagacauuuua

SEQ ID NO: 2057135 - RNA, 19 nt, Homo sapiens
aagguauuagcaaagcaaa

SEQ ID NO: 2057136 - RNA, 14 nt, Homo sapiens
acaugguuugacuc

SEQ ID NO: 2057137 - RNA, 14 nt, Homo sapiens
cuccccacagugcc

SEQ ID NO: 2057138 - RNA, 18 nt, Homo sapiens
agaucgugcuacugcacu

SEQ ID NO: 2057139 - RNA, 20 nt, Homo sapiens
uuguaacuugggcuguaaag

SEQ ID NO: 2057140 - RNA, 17 nt, Homo sapiens
gccuccaccagcaaggg

SEQ ID NO: 2057141 - RNA, 14 nt, Homo sapiens
ucacagcguuucag

SEQ ID NO: 2057142 - RNA, 15 nt, Homo sapiens
cuuucacaaaaggca

SEQ ID NO: 2057143 - RNA, 18 nt, Homo sapiens
agcauucucauuuugcuu

SEQ ID NO: 2057144 - RNA, 20 nt, Homo sapiens
gaaauuuaauucauguuucu

SEQ ID NO: 2057145 - RNA, 13 nt, Homo sapiens
gagaagguggucu

SEQ ID NO: 2057146 - RNA, 19 nt, Homo sapiens
cagaugccccagagcuguu

SEQ ID NO: 2057147 - RNA, 15 nt, Homo sapiens
gcuuugucuacuuca

SEQ ID NO: 2057148 - RNA, 23 nt, Homo sapiens
agucauuuuucuggaguggaaaa

SEQ ID NO: 2057149 - RNA, 16 nt, Homo sapiens
guuagaccuacagggg

SEQ ID NO: 2057150 - RNA, 19 nt, Homo sapiens
cacacggaugcacagagau

SEQ ID NO: 2057151 - RNA, 15 nt, Homo sapiens
cgacucuaaacacac

SEQ ID NO: 2057152 - RNA, 14 nt, Homo sapiens
acuuaguaugcagu

SEQ ID NO: 2057153 - RNA, 20 nt, Homo sapiens
agauaguugauucuugccuu

SEQ ID NO: 2057154 - RNA, 15 nt, Homo sapiens
agaauuauaacccag

SEQ ID NO: 2057155 - RNA, 23 nt, Homo sapiens
uccuggaggcugccugcugugcu

SEQ ID NO: 2057156 - RNA, 23 nt, Homo sapiens
cugccucaagcuaugugagcuca

SEQ ID NO: 2057157 - RNA, 19 nt, Homo sapiens
cuugcuuuuugcccguuga

SEQ ID NO: 2057158 - RNA, 18 nt, Homo sapiens
acuggaguaaaccaugua

SEQ ID NO: 2057159 - RNA, 23 nt, Homo sapiens
agggcugagggcuuugccgccau

SEQ ID NO: 2057160 - RNA, 15 nt, Homo sapiens
cgagucauggcuaau

SEQ ID NO: 2057161 - RNA, 11 nt, Homo sapiens
ccaaugcacac

SEQ ID NO: 2057162 - RNA, 18 nt, Homo sapiens
gcauauuuuaaugcaguu

SEQ ID NO: 2057163 - RNA, 20 nt, Homo sapiens
gagucucacuuugacaccca

SEQ ID NO: 2057164 - RNA, 16 nt, Homo sapiens
aaaaagacccuaucau

SEQ ID NO: 2057165 - RNA, 21 nt, Homo sapiens
guuguaguuaccuacugagua

SEQ ID NO: 2057166 - RNA, 19 nt, Homo sapiens
cauauucaugaaaugugga

SEQ ID NO: 2057167 - RNA, 16 nt, Homo sapiens
ggccagagccaugcca

SEQ ID NO: 2057168 - RNA, 22 nt, Homo sapiens
ugauuauaguuaauccuucuau

SEQ ID NO: 2057169 - RNA, 18 nt, Homo sapiens
uguaaaugacucuacuaa

SEQ ID NO: 2057170 - RNA, 18 nt, Homo sapiens
guauucuuuuccaagcuc

SEQ ID NO: 2057171 - RNA, 15 nt, Homo sapiens
gaugauaaugagcag

SEQ ID NO: 2057172 - RNA, 22 nt, Homo sapiens
cagguaucugaugauguucuga

SEQ ID NO: 2057173 - RNA, 17 nt, Homo sapiens
uacagaaauacauaggc

SEQ ID NO: 2057174 - RNA, 17 nt, Homo sapiens
ucauuuagucaugugac

SEQ ID NO: 2057175 - RNA, 22 nt, Homo sapiens
agguuuucagagaauuaucuca

SEQ ID NO: 2057176 - RNA, 21 nt, Homo sapiens
cagaaccucuaagugcugcug

SEQ ID NO: 2057177 - RNA, 20 nt, Homo sapiens
gucccaccccuaccucuagu

SEQ ID NO: 2057178 - RNA, 14 nt, Homo sapiens
ucaugaucaucaca

SEQ ID NO: 2057179 - RNA, 20 nt, Homo sapiens
cgucuuucauggaccagguc

SEQ ID NO: 2057180 - RNA, 23 nt, Homo sapiens
uugcuguuuaaaaguaaugcaau

SEQ ID NO: 2057181 - RNA, 22 nt, Homo sapiens
cauauauuuagccccauuacac

SEQ ID NO: 2057182 - RNA, 15 nt, Homo sapiens
guuugaaauucgcug

SEQ ID NO: 2057183 - RNA, 21 nt, Homo sapiens
auuuaugagaaauauuugaag

SEQ ID NO: 2057184 - RNA, 16 nt, Homo sapiens
uagggguuaagacuga

SEQ ID NO: 2057185 - RNA, 18 nt, Homo sapiens
cauggcccugugcuaauc

SEQ ID NO: 2057186 - RNA, 14 nt, Homo sapiens
aaacaaguauuugu

SEQ ID NO: 2057187 - RNA, 16 nt, Homo sapiens
ccuauuccagugucca

SEQ ID NO: 2057188 - RNA, 22 nt, Homo sapiens
ucugcacauacgcaccacaucu

SEQ ID NO: 2057189 - RNA, 13 nt, Homo sapiens
auuuuaaugcauu

SEQ ID NO: 2057190 - RNA, 16 nt, Homo sapiens
uaaugauguuaucuua

SEQ ID NO: 2057191 - RNA, 12 nt, Homo sapiens
acaguuuuccaa

SEQ ID NO: 2057192 - RNA, 14 nt, Homo sapiens
gcagugauuugaag

SEQ ID NO: 2057193 - RNA, 20 nt, Homo sapiens
aaaaggaaggagaaugggau

SEQ ID NO: 2057194 - RNA, 21 nt, Homo sapiens
cagucauggcaccaaagccac

SEQ ID NO: 2057195 - RNA, 16 nt, Homo sapiens
cucgguguaaaaccau

SEQ ID NO: 2057196 - RNA, 16 nt, Homo sapiens
auaagauauuguacau

SEQ ID NO: 2057197 - RNA, 13 nt, Homo sapiens
cuuucuucucgcc

SEQ ID NO: 2057198 - RNA, 11 nt, Homo sapiens
acuacaugcac

SEQ ID NO: 2057199 - RNA, 20 nt, Homo sapiens
aauucaaaaaaaaaagcaac

SEQ ID NO: 2057200 - RNA, 15 nt, Homo sapiens
gaugaagcauuuaca

SEQ ID NO: 2057201 - RNA, 20 nt, Homo sapiens
gaacucauuugaaugcuuaa

SEQ ID NO: 2057202 - RNA, 14 nt, Homo sapiens
uccacgauccugcc

SEQ ID NO: 2057203 - RNA, 17 nt, Homo sapiens
acauuccugaugcuucu

SEQ ID NO: 2057204 - RNA, 16 nt, Homo sapiens
auccuuuauagcuuug

SEQ ID NO: 2057205 - RNA, 13 nt, Homo sapiens
ugaaguaagcaac

SEQ ID NO: 2057206 - RNA, 16 nt, Homo sapiens
uguguuucuguucacc

SEQ ID NO: 2057207 - RNA, 23 nt, Homo sapiens
uaaugugagacagcaaguuuaua

SEQ ID NO: 2057208 - RNA, 20 nt, Homo sapiens
gcaccacuuuuaacagaaca

SEQ ID NO: 2057209 - RNA, 22 nt, Homo sapiens
aacaccaaaaaugaugcgcauc

SEQ ID NO: 2057210 - RNA, 13 nt, Homo sapiens
ccugcaauuccac

SEQ ID NO: 2057211 - RNA, 20 nt, Homo sapiens
gacaaauugagacagugcac

SEQ ID NO: 2057212 - RNA, 12 nt, Homo sapiens
agugauguaauc

SEQ ID NO: 2057213 - RNA, 16 nt, Homo sapiens
auuucucuacuuguca

SEQ ID NO: 2057214 - RNA, 17 nt, Homo sapiens
ucccagauagcugcauu

SEQ ID NO: 2057215 - RNA, 20 nt, Homo sapiens
aacaucauuacugccaucuu

SEQ ID NO: 2057216 - RNA, 11 nt, Homo sapiens
gucacaaagaa

SEQ ID NO: 2057217 - RNA, 18 nt, Homo sapiens
cagcucaaguuagcauuu

SEQ ID NO: 2057218 - RNA, 22 nt, Homo sapiens
uggagcccgcuucaagcucucu

SEQ ID NO: 2057219 - RNA, 21 nt, Homo sapiens
ccacaaugcgcauguaguuaa

SEQ ID NO: 2057220 - RNA, 18 nt, Homo sapiens
cagcauuuguucuuugcc

SEQ ID NO: 2057221 - RNA, 17 nt, Homo sapiens
gguaagcaaaacuuucc

SEQ ID NO: 2057222 - RNA, 23 nt, Homo sapiens
uaaguacucacuaaaaguucuca

SEQ ID NO: 2057223 - RNA, 16 nt, Homo sapiens
caauaccguaacaaug

SEQ ID NO: 2057224 - RNA, 16 nt, Homo sapiens
uugcagugaacugaga

SEQ ID NO: 2057225 - RNA, 12 nt, Homo sapiens
uaaaauaucauu

SEQ ID NO: 2057226 - RNA, 24 nt, Homo sapiens
cuugaugcgggucaacauuuccaa

SEQ ID NO: 2057227 - RNA, 22 nt, Homo sapiens
aggaugaaagacaaagaaggaa

SEQ ID NO: 2057228 - RNA, 22 nt, Homo sapiens
uccagcagugaaugcuagacag

SEQ ID NO: 2057229 - RNA, 22 nt, Homo sapiens
cagccaaguugugacagucacu

SEQ ID NO: 2057230 - RNA, 17 nt, Homo sapiens
uaagguagcugcagaua

SEQ ID NO: 2057231 - RNA, 21 nt, Homo sapiens
cucaucaauggggccagucag

SEQ ID NO: 2057232 - RNA, 12 nt, Homo sapiens
cauuuggcuuac

SEQ ID NO: 2057233 - RNA, 17 nt, Homo sapiens
caggacucacccuccac

SEQ ID NO: 2057234 - RNA, 21 nt, Homo sapiens
gaccccagagggaccagcugg

SEQ ID NO: 2057235 - RNA, 22 nt, Homo sapiens
guuuaucuagcauagcacaaac

SEQ ID NO: 2057236 - RNA, 21 nt, Homo sapiens
cucgccgggccauucugauug

SEQ ID NO: 2057237 - RNA, 23 nt, Homo sapiens
ggaagucucuuccugccucccaa

SEQ ID NO: 2057238 - RNA, 16 nt, Homo sapiens
uugcugccuucugucu

SEQ ID NO: 2057239 - RNA, 24 nt, Homo sapiens
uugcaaccuaccuguugagcauca

SEQ ID NO: 2057240 - RNA, 23 nt, Homo sapiens
cuagagaaauaaaauauggacuu

SEQ ID NO: 2057241 - RNA, 15 nt, Homo sapiens
acacucaccauuuaa

SEQ ID NO: 2057242 - RNA, 16 nt, Homo sapiens
aaguuccccugugaca

SEQ ID NO: 2057243 - RNA, 22 nt, Homo sapiens
aaggaaucauauuccuuuauga

SEQ ID NO: 2057244 - RNA, 17 nt, Homo sapiens
uaaucaaaccacuguua

SEQ ID NO: 2057245 - RNA, 14 nt, Homo sapiens
agcugagugcugaa

SEQ ID NO: 2057246 - RNA, 19 nt, Homo sapiens
gggaaagcagaguggugga

SEQ ID NO: 2057247 - RNA, 15 nt, Homo sapiens
ugggacacccuguga

SEQ ID NO: 2057248 - RNA, 17 nt, Homo sapiens
auuuagaugaugacuca

SEQ ID NO: 2057249 - RNA, 15 nt, Homo sapiens
ucaucuaacucuguc

SEQ ID NO: 2057250 - RNA, 20 nt, Homo sapiens
gauauuaauagauaauauga

SEQ ID NO: 2057251 - RNA, 20 nt, Homo sapiens
ugauaguuggggaauuguga

SEQ ID NO: 2057252 - RNA, 23 nt, Homo sapiens
aaugcugugugaugcaccugcag

SEQ ID NO: 2057253 - RNA, 16 nt, Homo sapiens
uaaaaucuuguuccau

SEQ ID NO: 2057254 - RNA, 22 nt, Homo sapiens
agugcauucaaccuuaccaaaa

SEQ ID NO: 2057255 - RNA, 15 nt, Homo sapiens
uccucaaacacugca

SEQ ID NO: 2057256 - RNA, 20 nt, Homo sapiens
ugccuauucccacaccucca

SEQ ID NO: 2057257 - RNA, 18 nt, Homo sapiens
caugcagccagccaucaa

SEQ ID NO: 2057258 - RNA, 23 nt, Homo sapiens
gccucuccccagagcauuugaua

SEQ ID NO: 2057259 - RNA, 18 nt, Homo sapiens
gccaucaugugccuggaa

SEQ ID NO: 2057260 - RNA, 22 nt, Homo sapiens
cugugacauacauauuaucuca

SEQ ID NO: 2057261 - RNA, 14 nt, Homo sapiens
cuacugaaugucau

SEQ ID NO: 2057262 - RNA, 23 nt, Homo sapiens
gcagcauuugauauacaugcuca

SEQ ID NO: 2057263 - RNA, 21 nt, Homo sapiens
cagggugauaaaucagacucu

SEQ ID NO: 2057264 - RNA, 13 nt, Homo sapiens
uacauaauacuga

SEQ ID NO: 2057265 - RNA, 17 nt, Homo sapiens
aaaggucccugagcucu

SEQ ID NO: 2057266 - RNA, 12 nt, Homo sapiens
ucacugagcucc

SEQ ID NO: 2057267 - RNA, 16 nt, Homo sapiens
ugggaccugcaggcca

SEQ ID NO: 2057268 - RNA, 16 nt, Homo sapiens
ugaaggguaaagaagu

SEQ ID NO: 2057269 - RNA, 20 nt, Homo sapiens
ccucaucuuuuuuugguucu

SEQ ID NO: 2057270 - RNA, 17 nt, Homo sapiens
ucacugucuuacucaag

SEQ ID NO: 2057271 - RNA, 14 nt, Homo sapiens
caaaggauacugua

SEQ ID NO: 2057272 - RNA, 23 nt, Homo sapiens
cacaaucccuguacucugaccca

SEQ ID NO: 2057273 - RNA, 15 nt, Homo sapiens
cuuggagccugcaga

SEQ ID NO: 2057274 - RNA, 23 nt, Homo sapiens
cacccuuugugguuacaguuuga

SEQ ID NO: 2057275 - RNA, 23 nt, Homo sapiens
ccugccaaaugaauaagacaaca

SEQ ID NO: 2057276 - RNA, 16 nt, Homo sapiens
gacccacgaaacugcc

SEQ ID NO: 2057277 - RNA, 13 nt, Homo sapiens
ggcccuuacaccc

SEQ ID NO: 2057278 - RNA, 19 nt, Homo sapiens
ggcacuguccagggcccau

SEQ ID NO: 2057279 - RNA, 19 nt, Homo sapiens
aggcaaaaccaacucucua

SEQ ID NO: 2057280 - RNA, 20 nt, Homo sapiens
gaugaugcaagcgacaggaa

SEQ ID NO: 2057281 - RNA, 15 nt, Homo sapiens
aaucuuuuucuccac

SEQ ID NO: 2057282 - RNA, 18 nt, Homo sapiens
cagaaagcagauaccuca

SEQ ID NO: 2057283 - RNA, 15 nt, Homo sapiens
aauauaaaugaugau

SEQ ID NO: 2057284 - RNA, 18 nt, Homo sapiens
cauagugcacacuuguau

SEQ ID NO: 2057285 - RNA, 14 nt, Homo sapiens
ggccaagguccugc

SEQ ID NO: 2057286 - RNA, 15 nt, Homo sapiens
aacaauucugugaca

SEQ ID NO: 2057287 - RNA, 20 nt, Homo sapiens
acugacuuuccgagccucca

SEQ ID NO: 2057288 - RNA, 15 nt, Homo sapiens
gauacaauaaauugc

SEQ ID NO: 2057289 - RNA, 20 nt, Homo sapiens
gccagaugugaaaacaucuc

SEQ ID NO: 2057290 - RNA, 21 nt, Homo sapiens
auccaagaccuuacaaccaca

SEQ ID NO: 2057291 - RNA, 17 nt, Homo sapiens
gcugggucccgggugcc

SEQ ID NO: 2057292 - RNA, 22 nt, Homo sapiens
cccagaggcuucuccaaaggga

SEQ ID NO: 2057293 - RNA, 20 nt, Homo sapiens
agauucugccuuugccaggu

SEQ ID NO: 2057294 - RNA, 22 nt, Homo sapiens
aagcaugucucucugccaagau

SEQ ID NO: 2057295 - RNA, 16 nt, Homo sapiens
gucccaaccccagugg

SEQ ID NO: 2057296 - RNA, 22 nt, Homo sapiens
gaaaaugcaucacaugaugaaa

SEQ ID NO: 2057297 - RNA, 20 nt, Homo sapiens
ugaguagcuggauuacaggc

SEQ ID NO: 2057298 - RNA, 13 nt, Homo sapiens
uagauucaccugu

SEQ ID NO: 2057299 - RNA, 16 nt, Homo sapiens
ucauuucaucuaccau

SEQ ID NO: 2057300 - RNA, 16 nt, Homo sapiens
uaggcaaaguacaaaa

SEQ ID NO: 2057301 - RNA, 15 nt, Homo sapiens
guugcaauugauccu

SEQ ID NO: 2057302 - RNA, 12 nt, Homo sapiens
acucacccaagc

SEQ ID NO: 2057303 - RNA, 14 nt, Homo sapiens
acaaggaucaggcu

SEQ ID NO: 2057304 - RNA, 17 nt, Homo sapiens
aaugauuaaacuauuaa

SEQ ID NO: 2057305 - RNA, 10 nt, Homo sapiens
ugacuuucaa

SEQ ID NO: 2057306 - RNA, 17 nt, Homo sapiens
auacuaauguuauuucu

SEQ ID NO: 2057307 - RNA, 19 nt, Homo sapiens
gugcuugcuccuaagcaaa

SEQ ID NO: 2057308 - RNA, 21 nt, Homo sapiens
ucuaaacagugggaguaccaa

SEQ ID NO: 2057309 - RNA, 21 nt, Homo sapiens
ucuugaauguggucucaggau

SEQ ID NO: 2057310 - RNA, 19 nt, Homo sapiens
gccaaccgcaucugcucau

SEQ ID NO: 2057311 - RNA, 20 nt, Homo sapiens
uccugugucuugcaauggca

SEQ ID NO: 2057312 - RNA, 13 nt, Homo sapiens
augcaaaugccuc

SEQ ID NO: 2057313 - RNA, 22 nt, Homo sapiens
ugccggugagacccauggcugu

SEQ ID NO: 2057314 - RNA, 11 nt, Homo sapiens
ccaggugggaa

SEQ ID NO: 2057315 - RNA, 19 nt, Homo sapiens
cccuccuugugcugccagu

SEQ ID NO: 2057316 - RNA, 18 nt, Homo sapiens
uuaguggucucuacugug

SEQ ID NO: 2057317 - RNA, 18 nt, Homo sapiens
uggcccucugcccagaaa

SEQ ID NO: 2057318 - RNA, 18 nt, Homo sapiens
ccagaggcagagccugag

SEQ ID NO: 2057319 - RNA, 21 nt, Homo sapiens
uggguaaugugaaggcccaag

SEQ ID NO: 2057320 - RNA, 21 nt, Homo sapiens
gaacaaccaaaugugcauuga

SEQ ID NO: 2057321 - RNA, 16 nt, Homo sapiens
ucuuuauugcugugaa

SEQ ID NO: 2057322 - RNA, 13 nt, Homo sapiens
aucccaagccaac

SEQ ID NO: 2057323 - RNA, 13 nt, Homo sapiens
caugcccucaauc

SEQ ID NO: 2057324 - RNA, 20 nt, Homo sapiens
cagagcgagacuccaucucu

SEQ ID NO: 2057325 - RNA, 15 nt, Homo sapiens
aacucacucacucug

SEQ ID NO: 2057326 - RNA, 14 nt, Homo sapiens
uacugucauauaau

SEQ ID NO: 2057327 - RNA, 18 nt, Homo sapiens
gaggcugccccucucacc

SEQ ID NO: 2057328 - RNA, 14 nt, Homo sapiens
ccuuacacugaaaa

SEQ ID NO: 2057329 - RNA, 15 nt, Homo sapiens
uuuaaaccacuaaaa

SEQ ID NO: 2057330 - RNA, 16 nt, Homo sapiens
ccugcugcagcaugaa

SEQ ID NO: 2057331 - RNA, 12 nt, Homo sapiens
agaguugugcac

SEQ ID NO: 2057332 - RNA, 15 nt, Homo sapiens
agauacaaaugucua

SEQ ID NO: 2057333 - RNA, 15 nt, Homo sapiens
uugcccuaugacauu

SEQ ID NO: 2057334 - RNA, 15 nt, Homo sapiens
aguuuccugccagau

SEQ ID NO: 2057335 - RNA, 20 nt, Homo sapiens
aucucacuuccagauaucca

SEQ ID NO: 2057336 - RNA, 23 nt, Homo sapiens
gaaauacacuguuaucuucacuu

SEQ ID NO: 2057337 - RNA, 14 nt, Homo sapiens
aaagcugaaaagca

SEQ ID NO: 2057338 - RNA, 20 nt, Homo sapiens
aucuugguaaacaacagacu

SEQ ID NO: 2057339 - RNA, 21 nt, Homo sapiens
cuccgugaggcugcugccauc

SEQ ID NO: 2057340 - RNA, 22 nt, Homo sapiens
gucaacaucaaagagcacauuu

SEQ ID NO: 2057341 - RNA, 20 nt, Homo sapiens
ucacuuauuucauaaacaac

SEQ ID NO: 2057342 - RNA, 17 nt, Homo sapiens
acaugcagcccaugccc

SEQ ID NO: 2057343 - RNA, 15 nt, Homo sapiens
gcaguucauacugaa

SEQ ID NO: 2057344 - RNA, 18 nt, Homo sapiens
uauuccuuugcauauuau

SEQ ID NO: 2057345 - RNA, 23 nt, Homo sapiens
agaggggccaaguguaggauugg

SEQ ID NO: 2057346 - RNA, 20 nt, Homo sapiens
uuaauauaauuggcacagaa

SEQ ID NO: 2057347 - RNA, 21 nt, Homo sapiens
agaacuccccuugaaaacugc

SEQ ID NO: 2057348 - RNA, 15 nt, Homo sapiens
aagauucauccauuu

SEQ ID NO: 2057349 - RNA, 19 nt, Homo sapiens
caggcuuucaagaagugcc

SEQ ID NO: 2057350 - RNA, 19 nt, Homo sapiens
agggcagugacaaguggag

SEQ ID NO: 2057351 - RNA, 15 nt, Homo sapiens
gcccuacaaaggcua

SEQ ID NO: 2057352 - RNA, 20 nt, Homo sapiens
cuuggagucuguucuaggga

SEQ ID NO: 2057353 - RNA, 15 nt, Homo sapiens
ccuuaaaagagccau

SEQ ID NO: 2057354 - RNA, 12 nt, Homo sapiens
ggcgcccagugg

SEQ ID NO: 2057355 - RNA, 17 nt, Homo sapiens
ucaccacaaacuguaau

SEQ ID NO: 2057356 - RNA, 20 nt, Homo sapiens
uuguuccuggggcuggaaug

SEQ ID NO: 2057357 - RNA, 20 nt, Homo sapiens
ugggaagaauaaaaugcagu

SEQ ID NO: 2057358 - RNA, 17 nt, Homo sapiens
aaacuugacauguagcu

SEQ ID NO: 2057359 - RNA, 13 nt, Homo sapiens
aaaagcauucugu

SEQ ID NO: 2057360 - RNA, 19 nt, Homo sapiens
acuguuuuggguagcugcc

SEQ ID NO: 2057361 - RNA, 22 nt, Homo sapiens
uucaaagacagagaagaccaaa

SEQ ID NO: 2057362 - RNA, 16 nt, Homo sapiens
uugcagaaaucacaau

SEQ ID NO: 2057363 - RNA, 15 nt, Homo sapiens
agagauccaaagacu

SEQ ID NO: 2057364 - RNA, 20 nt, Homo sapiens
acacucccacuuggcaucau

SEQ ID NO: 2057365 - RNA, 17 nt, Homo sapiens
agcaaacaccaccaagu

SEQ ID NO: 2057366 - RNA, 20 nt, Homo sapiens
gggugcagcccucuugcccg

SEQ ID NO: 2057367 - RNA, 17 nt, Homo sapiens
ugggaacccugugcaau

SEQ ID NO: 2057368 - RNA, 17 nt, Homo sapiens
caguaaaaauccacuau

SEQ ID NO: 2057369 - RNA, 15 nt, Homo sapiens
caauagagacuguag

SEQ ID NO: 2057370 - RNA, 19 nt, Homo sapiens
cucaccagccccacugcca

SEQ ID NO: 2057371 - RNA, 19 nt, Homo sapiens
uuaaauucuuuccuaccuu

SEQ ID NO: 2057372 - RNA, 15 nt, Homo sapiens
uuugagcacaacuuu

SEQ ID NO: 2057373 - RNA, 13 nt, Homo sapiens
gugauauaugcau

SEQ ID NO: 2057374 - RNA, 16 nt, Homo sapiens
ucuuugauuauuugca

SEQ ID NO: 2057375 - RNA, 17 nt, Homo sapiens
ugugaauuguuccucag

SEQ ID NO: 2057376 - RNA, 17 nt, Homo sapiens
aaugagcuuaaugucuu

SEQ ID NO: 2057377 - RNA, 18 nt, Homo sapiens
gauguuuucccuuaacuu

SEQ ID NO: 2057378 - RNA, 21 nt, Homo sapiens
ucacgccucuguguucaggau

SEQ ID NO: 2057379 - RNA, 17 nt, Homo sapiens
aacuggcaguuuuccau

SEQ ID NO: 2057380 - RNA, 19 nt, Homo sapiens
uaaccacugcacuuuccaa

SEQ ID NO: 2057381 - RNA, 22 nt, Homo sapiens
cuuugagaggaagggugaagcc

SEQ ID NO: 2057382 - RNA, 13 nt, Homo sapiens
uggagaccaucua

SEQ ID NO: 2057383 - RNA, 21 nt, Homo sapiens
ccucugcuaccaucucauuaa

SEQ ID NO: 2057384 - RNA, 22 nt, Homo sapiens
aggggccagaguuuucuaugaa

SEQ ID NO: 2057385 - RNA, 22 nt, Homo sapiens
uacauacgcuaccuugaugaaa

SEQ ID NO: 2057386 - RNA, 18 nt, Homo sapiens
uaacaccuucauccagau

SEQ ID NO: 2057387 - RNA, 16 nt, Homo sapiens
aaauucacaaacuuuu

SEQ ID NO: 2057388 - RNA, 19 nt, Homo sapiens
auacuguaacauucaggaa

SEQ ID NO: 2057389 - RNA, 13 nt, Homo sapiens
aauaaguaauauc

SEQ ID NO: 2057390 - RNA, 15 nt, Homo sapiens
cacgugccugugguc

SEQ ID NO: 2057391 - RNA, 11 nt, Homo sapiens
aagaacccagc

SEQ ID NO: 2057392 - RNA, 11 nt, Homo sapiens
guggugccugc

SEQ ID NO: 2057393 - RNA, 14 nt, Homo sapiens
aaaacagugucuug

SEQ ID NO: 2057394 - RNA, 21 nt, Homo sapiens
ccagcuauugggaaggaugag

SEQ ID NO: 2057395 - RNA, 15 nt, Homo sapiens
uggcaaggugacauu

SEQ ID NO: 2057396 - RNA, 17 nt, Homo sapiens
auagaaaaguauguucu

SEQ ID NO: 2057397 - RNA, 17 nt, Homo sapiens
cccuucuaggcaucucc

SEQ ID NO: 2057398 - RNA, 23 nt, Homo sapiens
ucaagugccucuuguugcagaga

SEQ ID NO: 2057399 - RNA, 13 nt, Homo sapiens
ugaagcugagaug

SEQ ID NO: 2057400 - RNA, 21 nt, Homo sapiens
acauaaauuuaucaucucgac

SEQ ID NO: 2057401 - RNA, 19 nt, Homo sapiens
uggucgcggagguccugcu

SEQ ID NO: 2057402 - RNA, 20 nt, Homo sapiens
acaauguggacgugcacuga

SEQ ID NO: 2057403 - RNA, 23 nt, Homo sapiens
cuaaugugguuauuuuacauuaa

SEQ ID NO: 2057404 - RNA, 13 nt, Homo sapiens
uguuggugacaau

SEQ ID NO: 2057405 - RNA, 17 nt, Homo sapiens
agauaacucaagaaauc

SEQ ID NO: 2057406 - RNA, 16 nt, Homo sapiens
cauaucaacuuaguca

SEQ ID NO: 2057407 - RNA, 13 nt, Homo sapiens
ccuccaauguaca

SEQ ID NO: 2057408 - RNA, 22 nt, Homo sapiens
aucccaucgucucggccuucac

SEQ ID NO: 2057409 - RNA, 20 nt, Homo sapiens
aauauuuuuuuuaacugcau

SEQ ID NO: 2057410 - RNA, 14 nt, Homo sapiens
agugggacucugau

SEQ ID NO: 2057411 - RNA, 19 nt, Homo sapiens
aauauauaguggacaguaa

SEQ ID NO: 2057412 - RNA, 15 nt, Homo sapiens
uuauugaaaugcaga

SEQ ID NO: 2057413 - RNA, 21 nt, Homo sapiens
gccugguggcaagagggaaug

SEQ ID NO: 2057414 - RNA, 21 nt, Homo sapiens
cucuacugaaaguacaaaaau

SEQ ID NO: 2057415 - RNA, 22 nt, Homo sapiens
ccagguuacuaaagggugcaug

SEQ ID NO: 2057416 - RNA, 15 nt, Homo sapiens
gcaaauggugcugaa

SEQ ID NO: 2057417 - RNA, 21 nt, Homo sapiens
ggcagcuauagucuggcacca

SEQ ID NO: 2057418 - RNA, 18 nt, Homo sapiens
accccucccccacgucuc

SEQ ID NO: 2057419 - RNA, 17 nt, Homo sapiens
ugaggccuuguguguca

SEQ ID NO: 2057420 - RNA, 22 nt, Homo sapiens
aagguuuccaagauaaaaccag

SEQ ID NO: 2057421 - RNA, 21 nt, Homo sapiens
uuauuccugcacucacaggcu

SEQ ID NO: 2057422 - RNA, 15 nt, Homo sapiens
gugggagaaggcagu

SEQ ID NO: 2057423 - RNA, 12 nt, Homo sapiens
caugugugcuca

SEQ ID NO: 2057424 - RNA, 15 nt, Homo sapiens
uaauucuagcacuuu

SEQ ID NO: 2057425 - RNA, 23 nt, Homo sapiens
uauggaaaagggucuucuuggca

SEQ ID NO: 2057426 - RNA, 19 nt, Homo sapiens
ucucagauuguaccauuga

SEQ ID NO: 2057427 - RNA, 15 nt, Homo sapiens
cuccuguggagucaa

SEQ ID NO: 2057428 - RNA, 15 nt, Homo sapiens
uaccagagcacagau

SEQ ID NO: 2057429 - RNA, 17 nt, Homo sapiens
gggcucaagcuucccaa

SEQ ID NO: 2057430 - RNA, 18 nt, Homo sapiens
ugaaaagcaggcaaaaga

SEQ ID NO: 2057431 - RNA, 23 nt, Homo sapiens
ccuuaacuuucauuaauaguguu

SEQ ID NO: 2057432 - RNA, 14 nt, Homo sapiens
uguaaaugcauuag

SEQ ID NO: 2057433 - RNA, 17 nt, Homo sapiens
auacgcaauuguauaua

SEQ ID NO: 2057434 - RNA, 24 nt, Homo sapiens
ugcugaggacaaugucuggcugaa

SEQ ID NO: 2057435 - RNA, 17 nt, Homo sapiens
acuuucaaccuugccag

SEQ ID NO: 2057436 - RNA, 16 nt, Homo sapiens
aaugacgucacaagac

SEQ ID NO: 2057437 - RNA, 16 nt, Homo sapiens
accaacacccugaggu

SEQ ID NO: 2057438 - RNA, 23 nt, Homo sapiens
ggagaauuaaguccuacuuuuaa

SEQ ID NO: 2057439 - RNA, 12 nt, Homo sapiens
aaccagugccag

SEQ ID NO: 2057440 - RNA, 22 nt, Homo sapiens
uucugaguuuacguggaggggu

SEQ ID NO: 2057441 - RNA, 22 nt, Homo sapiens
ugccuguaaucccagcacuuug

SEQ ID NO: 2057442 - RNA, 19 nt, Homo sapiens
ugagcagugagcacugaaa

SEQ ID NO: 2057443 - RNA, 22 nt, Homo sapiens
aaacaaaucucaaaguguacaa

SEQ ID NO: 2057444 - RNA, 16 nt, Homo sapiens
gaccaggcaaugugac

SEQ ID NO: 2057445 - RNA, 22 nt, Homo sapiens
guguauacuguaaucgugcuau

SEQ ID NO: 2057446 - RNA, 20 nt, Homo sapiens
gucacuucgugggaucugcc

SEQ ID NO: 2057447 - RNA, 17 nt, Homo sapiens
ggcugucaucugugcac

SEQ ID NO: 2057448 - RNA, 13 nt, Homo sapiens
ccacgguggacuu

SEQ ID NO: 2057449 - RNA, 16 nt, Homo sapiens
caaccgcuugccauau

SEQ ID NO: 2057450 - RNA, 17 nt, Homo sapiens
ucucuuucaauugcaga

SEQ ID NO: 2057451 - RNA, 14 nt, Homo sapiens
ugcuauggggacau

SEQ ID NO: 2057452 - RNA, 14 nt, Homo sapiens
uacuaagggaacaa

SEQ ID NO: 2057453 - RNA, 24 nt, Homo sapiens
auagauugagaaguuuuguacaga

SEQ ID NO: 2057454 - RNA, 20 nt, Homo sapiens
guugaggggccacaccaccu

SEQ ID NO: 2057455 - RNA, 18 nt, Homo sapiens
ccuauuuucauuuguaca

SEQ ID NO: 2057456 - RNA, 21 nt, Homo sapiens
agugguguucagccaagugac

SEQ ID NO: 2057457 - RNA, 13 nt, Homo sapiens
ccauuaucaguca

SEQ ID NO: 2057458 - RNA, 22 nt, Homo sapiens
aaauaauguguaguucauguaa

SEQ ID NO: 2057459 - RNA, 15 nt, Homo sapiens
ggagcugcuguggug

SEQ ID NO: 2057460 - RNA, 15 nt, Homo sapiens
cugacuuucucucca

SEQ ID NO: 2057461 - RNA, 21 nt, Homo sapiens
gacacucacacggacacucaa

SEQ ID NO: 2057462 - RNA, 14 nt, Homo sapiens
augucagucugucc

SEQ ID NO: 2057463 - RNA, 17 nt, Homo sapiens
aggaucagaaaguaauu

SEQ ID NO: 2057464 - RNA, 15 nt, Homo sapiens
uauaaaaucuuucca

SEQ ID NO: 2057465 - RNA, 20 nt, Homo sapiens
auguuaagcauggauuuucc

SEQ ID NO: 2057466 - RNA, 19 nt, Homo sapiens
gcuucuccgcccauucuga

SEQ ID NO: 2057467 - RNA, 21 nt, Homo sapiens
uggaaagcagguggcaucucu

SEQ ID NO: 2057468 - RNA, 19 nt, Homo sapiens
aguguauuaaaugaacauc

SEQ ID NO: 2057469 - RNA, 19 nt, Homo sapiens
aggugcagagugcccagaa

SEQ ID NO: 2057470 - RNA, 13 nt, Homo sapiens
ucuuccaaaaaga

SEQ ID NO: 2057471 - RNA, 14 nt, Homo sapiens
gacaaugaagggaa

SEQ ID NO: 2057472 - RNA, 14 nt, Homo sapiens
gagggagcugagaa

SEQ ID NO: 2057473 - RNA, 14 nt, Homo sapiens
gcuggaaaugcuga

SEQ ID NO: 2057474 - RNA, 15 nt, Homo sapiens
agcuagcgugugcca

SEQ ID NO: 2057475 - RNA, 23 nt, Homo sapiens
cagaacugaagugugcugugaca

SEQ ID NO: 2057476 - RNA, 14 nt, Homo sapiens
caaauaaugaauuu

SEQ ID NO: 2057477 - RNA, 17 nt, Homo sapiens
ggaugggcucuucgcca

SEQ ID NO: 2057478 - RNA, 19 nt, Homo sapiens
aaaacaguugccagugaua

SEQ ID NO: 2057479 - RNA, 13 nt, Homo sapiens
ccuucacuucuga

SEQ ID NO: 2057480 - RNA, 22 nt, Homo sapiens
gguauuuguucaaaauaaugaa

SEQ ID NO: 2057481 - RNA, 17 nt, Homo sapiens
gcacacacaccgaugua

SEQ ID NO: 2057482 - RNA, 17 nt, Homo sapiens
ugcugagucgcucucau

SEQ ID NO: 2057483 - RNA, 13 nt, Homo sapiens
acacacacaugca

SEQ ID NO: 2057484 - RNA, 24 nt, Homo sapiens
uaaauguuuaauaaacacugacau

SEQ ID NO: 2057485 - RNA, 17 nt, Homo sapiens
uucuagaagacuacaau

SEQ ID NO: 2057486 - RNA, 12 nt, Homo sapiens
ggugcaucucau

SEQ ID NO: 2057487 - RNA, 13 nt, Homo sapiens
agacuccaaagaa

SEQ ID NO: 2057488 - RNA, 13 nt, Homo sapiens
aaaauccaaggca

SEQ ID NO: 2057489 - RNA, 17 nt, Homo sapiens
gcaaucuuugccuuuau

SEQ ID NO: 2057490 - RNA, 18 nt, Homo sapiens
accgcgggggcugugagc

SEQ ID NO: 2057491 - RNA, 18 nt, Homo sapiens
caaagacauuauuucuca

SEQ ID NO: 2057492 - RNA, 14 nt, Homo sapiens
uguuagucaaggac

SEQ ID NO: 2057493 - RNA, 13 nt, Homo sapiens
agggacuccuccu

SEQ ID NO: 2057494 - RNA, 15 nt, Homo sapiens
caguggguucaggcc

SEQ ID NO: 2057495 - RNA, 14 nt, Homo sapiens
ugcccugggccaaa

SEQ ID NO: 2057496 - RNA, 17 nt, Homo sapiens
aagaacugucucuuuca

SEQ ID NO: 2057497 - RNA, 13 nt, Homo sapiens
uuuccuguugcac

SEQ ID NO: 2057498 - RNA, 13 nt, Homo sapiens
uuucauguugcaa

SEQ ID NO: 2057499 - RNA, 18 nt, Homo sapiens
gaaaaucaaccagcagga

SEQ ID NO: 2057500 - RNA, 17 nt, Homo sapiens
caagaguuuguucuguu

SEQ ID NO: 2057501 - RNA, 23 nt, Homo sapiens
aacuaggaucagaauaucacaga

SEQ ID NO: 2057502 - RNA, 20 nt, Homo sapiens
aacagauucaggccagccca

SEQ ID NO: 2057503 - RNA, 22 nt, Homo sapiens
augacuguuuuuauaugcacau

SEQ ID NO: 2057504 - RNA, 21 nt, Homo sapiens
ucauuuccccucccgucuucc

SEQ ID NO: 2057505 - RNA, 20 nt, Homo sapiens
cauaaaauccaauauuguaa

SEQ ID NO: 2057506 - RNA, 23 nt, Homo sapiens
aacccgagggacagcagauucca

SEQ ID NO: 2057507 - RNA, 14 nt, Homo sapiens
ucacagaugggcaa

SEQ ID NO: 2057508 - RNA, 15 nt, Homo sapiens
cucucugaacugcaa

SEQ ID NO: 2057509 - RNA, 21 nt, Homo sapiens
cuuagacacguguuguuccac

SEQ ID NO: 2057510 - RNA, 15 nt, Homo sapiens
guuuacguccuuugg

SEQ ID NO: 2057511 - RNA, 15 nt, Homo sapiens
ccuguauggcacugg

SEQ ID NO: 2057512 - RNA, 18 nt, Homo sapiens
cugaaaauaaagugucau

SEQ ID NO: 2057513 - RNA, 17 nt, Homo sapiens
cugaugguggcucuggu

SEQ ID NO: 2057514 - RNA, 12 nt, Homo sapiens
agaaugagccag

SEQ ID NO: 2057515 - RNA, 21 nt, Homo sapiens
ucaguucuuacacauuccauc

SEQ ID NO: 2057516 - RNA, 18 nt, Homo sapiens
uccaagacaguuguauca

SEQ ID NO: 2057517 - RNA, 19 nt, Homo sapiens
uguggaugcugagcuguga

SEQ ID NO: 2057518 - RNA, 11 nt, Homo sapiens
uuggggcuccu

SEQ ID NO: 2057519 - RNA, 18 nt, Homo sapiens
augaaacucuacauuuaa

SEQ ID NO: 2057520 - RNA, 16 nt, Homo sapiens
ucucacuccagccaaa

SEQ ID NO: 2057521 - RNA, 21 nt, Homo sapiens
auaaaauguuuaaucucugcu

SEQ ID NO: 2057522 - RNA, 16 nt, Homo sapiens
uuuacacuacauugua

SEQ ID NO: 2057523 - RNA, 22 nt, Homo sapiens
ugaagacccaguguaaagaaua

SEQ ID NO: 2057524 - RNA, 23 nt, Homo sapiens
aaggguuauagacugccaugcua

SEQ ID NO: 2057525 - RNA, 14 nt, Homo sapiens
agcaguucucugcc

SEQ ID NO: 2057526 - RNA, 21 nt, Homo sapiens
cagcuaaaauaagcucaguga

SEQ ID NO: 2057527 - RNA, 17 nt, Homo sapiens
cugcaccgagagagaug

SEQ ID NO: 2057528 - RNA, 20 nt, Homo sapiens
uuuagaugaggcucagagag

SEQ ID NO: 2057529 - RNA, 19 nt, Homo sapiens
guugcaugaaauuuugccu

SEQ ID NO: 2057530 - RNA, 19 nt, Homo sapiens
aaaauugcccccacauugg

SEQ ID NO: 2057531 - RNA, 17 nt, Homo sapiens
auguaaaacuccauuca

SEQ ID NO: 2057532 - RNA, 20 nt, Homo sapiens
gccuauagcagaagcacauu

SEQ ID NO: 2057533 - RNA, 21 nt, Homo sapiens
agcacagaggccugacugacu

SEQ ID NO: 2057534 - RNA, 18 nt, Homo sapiens
ucaccaaugagccuuagu

SEQ ID NO: 2057535 - RNA, 21 nt, Homo sapiens
cugguccccuccucagugaca

SEQ ID NO: 2057536 - RNA, 18 nt, Homo sapiens
agcccagugugggacuga

SEQ ID NO: 2057537 - RNA, 13 nt, Homo sapiens
cccacagugcuca

SEQ ID NO: 2057538 - RNA, 13 nt, Homo sapiens
cauccagugacaa

SEQ ID NO: 2057539 - RNA, 20 nt, Homo sapiens
ucaugccccuggcugggacg

SEQ ID NO: 2057540 - RNA, 15 nt, Homo sapiens
caagauuuaaccugc

SEQ ID NO: 2057541 - RNA, 22 nt, Homo sapiens
gguuugccuauaauuuauuaac

SEQ ID NO: 2057542 - RNA, 15 nt, Homo sapiens
uacacagaauauaau

SEQ ID NO: 2057543 - RNA, 22 nt, Homo sapiens
ugaauagcacaggugaccccua

SEQ ID NO: 2057544 - RNA, 16 nt, Homo sapiens
accaaauugcuuuaca

SEQ ID NO: 2057545 - RNA, 15 nt, Homo sapiens
agaggucucaucucc

SEQ ID NO: 2057546 - RNA, 17 nt, Homo sapiens
agugcaaauuugauaca

SEQ ID NO: 2057547 - RNA, 15 nt, Homo sapiens
ugaacagaaacuaca

SEQ ID NO: 2057548 - RNA, 22 nt, Homo sapiens
uacccauuuuuuaaaaaagcaa

SEQ ID NO: 2057549 - RNA, 14 nt, Homo sapiens
agagcauugccauu

SEQ ID NO: 2057550 - RNA, 19 nt, Homo sapiens
auaccauuuucaauggaaa

SEQ ID NO: 2057551 - RNA, 17 nt, Homo sapiens
uuggauauucaagccuu

SEQ ID NO: 2057552 - RNA, 10 nt, Homo sapiens
cacaccucau

SEQ ID NO: 2057553 - RNA, 18 nt, Homo sapiens
aaauguuuguuauuuaca

SEQ ID NO: 2057554 - RNA, 14 nt, Homo sapiens
agugcaguggcaca

SEQ ID NO: 2057555 - RNA, 14 nt, Homo sapiens
agcagaguggugga

SEQ ID NO: 2057556 - RNA, 13 nt, Homo sapiens
gggacucccaggc

SEQ ID NO: 2057557 - RNA, 20 nt, Homo sapiens
caaggcagccugaacacuca

SEQ ID NO: 2057558 - RNA, 19 nt, Homo sapiens
cuugaacuucaccugcaaa

SEQ ID NO: 2057559 - RNA, 16 nt, Homo sapiens
cuucgauggcauccug

SEQ ID NO: 2057560 - RNA, 19 nt, Homo sapiens
ugugccugacaccacgcug

SEQ ID NO: 2057561 - RNA, 20 nt, Homo sapiens
guguguaugugugugcaugu

SEQ ID NO: 2057562 - RNA, 13 nt, Homo sapiens
ccucugugaaauu

SEQ ID NO: 2057563 - RNA, 17 nt, Homo sapiens
aucacaccucaguggga

SEQ ID NO: 2057564 - RNA, 18 nt, Homo sapiens
aauuuggagacucugugg

SEQ ID NO: 2057565 - RNA, 17 nt, Homo sapiens
ggaggcugcaguucccu

SEQ ID NO: 2057566 - RNA, 16 nt, Homo sapiens
accugagguugcuuua

SEQ ID NO: 2057567 - RNA, 21 nt, Homo sapiens
aacaccaagugaggccauagc

SEQ ID NO: 2057568 - RNA, 14 nt, Homo sapiens
cagaaggcucuucu

SEQ ID NO: 2057569 - RNA, 22 nt, Homo sapiens
gauagugcaaggaaugacucau

SEQ ID NO: 2057570 - RNA, 14 nt, Homo sapiens
cucuggggcagcuc

SEQ ID NO: 2057571 - RNA, 20 nt, Homo sapiens
gcuuugggugccuuugccac

SEQ ID NO: 2057572 - RNA, 20 nt, Homo sapiens
acuacaccacacacaacagc

SEQ ID NO: 2057573 - RNA, 14 nt, Homo sapiens
ucuucaaacuguga

SEQ ID NO: 2057574 - RNA, 10 nt, Homo sapiens
uuuguuucaa

SEQ ID NO: 2057575 - RNA, 20 nt, Homo sapiens
gagaaaugcuuagaaauuca

SEQ ID NO: 2057576 - RNA, 12 nt, Homo sapiens
auugcuuucuaa

SEQ ID NO: 2057577 - RNA, 20 nt, Homo sapiens
acccaguucuucauuuggag

SEQ ID NO: 2057578 - RNA, 19 nt, Homo sapiens
aaauguaauuaugagguga

SEQ ID NO: 2057579 - RNA, 11 nt, Homo sapiens
agugagccaug

SEQ ID NO: 2057580 - RNA, 14 nt, Homo sapiens
gcuggagugccaug

SEQ ID NO: 2057581 - RNA, 19 nt, Homo sapiens
gaaaucuagaagacuguca

SEQ ID NO: 2057582 - RNA, 14 nt, Homo sapiens
auauuggaggaaua

SEQ ID NO: 2057583 - RNA, 20 nt, Homo sapiens
uaugaauuaaaagucuacag

SEQ ID NO: 2057584 - RNA, 16 nt, Homo sapiens
auaauaagcuaaagag

SEQ ID NO: 2057585 - RNA, 16 nt, Homo sapiens
auugcacaaauacaag

SEQ ID NO: 2057586 - RNA, 18 nt, Homo sapiens
agagugguacaagggaga

SEQ ID NO: 2057587 - RNA, 14 nt, Homo sapiens
auuuuuuaccacaa

SEQ ID NO: 2057588 - RNA, 18 nt, Homo sapiens
agucucuaugaucuuggc

SEQ ID NO: 2057589 - RNA, 22 nt, Homo sapiens
aaaccuugauuuaaaauaucac

SEQ ID NO: 2057590 - RNA, 18 nt, Homo sapiens
ccagagcaacagccuaaa

SEQ ID NO: 2057591 - RNA, 19 nt, Homo sapiens
ccauguggacugugccauc

SEQ ID NO: 2057592 - RNA, 15 nt, Homo sapiens
guugggagcacugga

SEQ ID NO: 2057593 - RNA, 15 nt, Homo sapiens
uaguauagaaaaugg

SEQ ID NO: 2057594 - RNA, 20 nt, Homo sapiens
ccuuuguguggcuccuggua

SEQ ID NO: 2057595 - RNA, 13 nt, Homo sapiens
agaagggggccau

SEQ ID NO: 2057596 - RNA, 17 nt, Homo sapiens
ugcaaccacacaccuca

SEQ ID NO: 2057597 - RNA, 21 nt, Homo sapiens
aacuucuugaaucuagggagg

SEQ ID NO: 2057598 - RNA, 20 nt, Homo sapiens
ugauuucuaguaucuauugu

SEQ ID NO: 2057599 - RNA, 16 nt, Homo sapiens
acagcuacaacagccu

SEQ ID NO: 2057600 - RNA, 18 nt, Homo sapiens
ugacauuggaacaugcua

SEQ ID NO: 2057601 - RNA, 20 nt, Homo sapiens
uccuacuuuuccuucccuca

SEQ ID NO: 2057602 - RNA, 14 nt, Homo sapiens
gcuaggaggacaag

SEQ ID NO: 2057603 - RNA, 22 nt, Homo sapiens
agaacagugcacaagauuauuu

SEQ ID NO: 2057604 - RNA, 18 nt, Homo sapiens
ugggcuacagaaaccaca

SEQ ID NO: 2057605 - RNA, 15 nt, Homo sapiens
gugaucucagcucac

SEQ ID NO: 2057606 - RNA, 19 nt, Homo sapiens
uuuugauaaaguaauucau

SEQ ID NO: 2057607 - RNA, 21 nt, Homo sapiens
acagugggccugcuggugggc

SEQ ID NO: 2057608 - RNA, 15 nt, Homo sapiens
cuggagaaaugggag

SEQ ID NO: 2057609 - RNA, 15 nt, Homo sapiens
cagagagaaagaaga

SEQ ID NO: 2057610 - RNA, 18 nt, Homo sapiens
auuugcuuuuugugauau

SEQ ID NO: 2057611 - RNA, 17 nt, Homo sapiens
gcuggugaacacuguga

SEQ ID NO: 2057612 - RNA, 13 nt, Homo sapiens
agauuuuggcaaa

SEQ ID NO: 2057613 - RNA, 19 nt, Homo sapiens
uuaggaauacugggugcug

SEQ ID NO: 2057614 - RNA, 17 nt, Homo sapiens
agaugguguguucugca

SEQ ID NO: 2057615 - RNA, 20 nt, Homo sapiens
cauagcgcuggcucaggaag

SEQ ID NO: 2057616 - RNA, 17 nt, Homo sapiens
agcaagcacuguggucu

SEQ ID NO: 2057617 - RNA, 20 nt, Homo sapiens
agacaggaacggcucugggg

SEQ ID NO: 2057618 - RNA, 14 nt, Homo sapiens
aauguccauaugcu

SEQ ID NO: 2057619 - RNA, 21 nt, Homo sapiens
acaauaaguaaauccacaggc

SEQ ID NO: 2057620 - RNA, 14 nt, Homo sapiens
cacucaaugucuua

SEQ ID NO: 2057621 - RNA, 15 nt, Homo sapiens
uauugcccaggcugu

SEQ ID NO: 2057622 - RNA, 18 nt, Homo sapiens
aaguggucugaauucugg

SEQ ID NO: 2057623 - RNA, 19 nt, Homo sapiens
auuuuaaaaucagcuauuu

SEQ ID NO: 2057624 - RNA, 19 nt, Homo sapiens
ucacacguuuaaucccagc

SEQ ID NO: 2057625 - RNA, 19 nt, Homo sapiens
cugccggucccccaugcca

SEQ ID NO: 2057626 - RNA, 22 nt, Homo sapiens
agggcuuguggacucucugccu

SEQ ID NO: 2057627 - RNA, 18 nt, Homo sapiens
ccaaggccuuuccuacau

SEQ ID NO: 2057628 - RNA, 22 nt, Homo sapiens
accucacuuuaggcagcuguaa

SEQ ID NO: 2057629 - RNA, 18 nt, Homo sapiens
auucuuuauucuuuuacu

SEQ ID NO: 2057630 - RNA, 21 nt, Homo sapiens
ucaaaauguuaacaacuugaa

SEQ ID NO: 2057631 - RNA, 16 nt, Homo sapiens
accauuccaacuucaa

SEQ ID NO: 2057632 - RNA, 15 nt, Homo sapiens
gaaguuugcugugcu

SEQ ID NO: 2057633 - RNA, 16 nt, Homo sapiens
cucccuccagcacaaa

SEQ ID NO: 2057634 - RNA, 14 nt, Homo sapiens
aaaaaugcugcuuc

SEQ ID NO: 2057635 - RNA, 12 nt, Homo sapiens
acuuccagcuuu

SEQ ID NO: 2057636 - RNA, 22 nt, Homo sapiens
ugccaacacacguccacuccca

SEQ ID NO: 2057637 - RNA, 17 nt, Homo sapiens
gcuguccugaucuguga

SEQ ID NO: 2057638 - RNA, 15 nt, Homo sapiens
cuggucuugaacucc

SEQ ID NO: 2057639 - RNA, 22 nt, Homo sapiens
ugagacuuugaggguguauauu

SEQ ID NO: 2057640 - RNA, 15 nt, Homo sapiens
cuugugccaggucaa

SEQ ID NO: 2057641 - RNA, 13 nt, Homo sapiens
ucagaacugcccu

SEQ ID NO: 2057642 - RNA, 18 nt, Homo sapiens
aacacuagagucugucau

SEQ ID NO: 2057643 - RNA, 21 nt, Homo sapiens
gaaccagagccauggacucua

SEQ ID NO: 2057644 - RNA, 16 nt, Homo sapiens
cauuaugcugugguca

SEQ ID NO: 2057645 - RNA, 13 nt, Homo sapiens
ggauuaugaagug

SEQ ID NO: 2057646 - RNA, 18 nt, Homo sapiens
gacuugccaugaaggcac

SEQ ID NO: 2057647 - RNA, 12 nt, Homo sapiens
accaaauucuga

SEQ ID NO: 2057648 - RNA, 18 nt, Homo sapiens
agccucagcggacaagca

SEQ ID NO: 2057649 - RNA, 22 nt, Homo sapiens
gauuguuaggagugguucucau

SEQ ID NO: 2057650 - RNA, 22 nt, Homo sapiens
ugacaggaauucucccuggcau

SEQ ID NO: 2057651 - RNA, 13 nt, Homo sapiens
ugguucccagaaa

SEQ ID NO: 2057652 - RNA, 18 nt, Homo sapiens
aguuacuucuuguaaaaa

SEQ ID NO: 2057653 - RNA, 13 nt, Homo sapiens
uucauucaugcca

SEQ ID NO: 2057654 - RNA, 13 nt, Homo sapiens
uugaauguacaaa

SEQ ID NO: 2057655 - RNA, 13 nt, Homo sapiens
auguguguucaug

SEQ ID NO: 2057656 - RNA, 16 nt, Homo sapiens
aagcugggugagccaa

SEQ ID NO: 2057657 - RNA, 11 nt, Homo sapiens
auggcuccuug

SEQ ID NO: 2057658 - RNA, 21 nt, Homo sapiens
accuaaaucgcaucaugccaa

SEQ ID NO: 2057659 - RNA, 16 nt, Homo sapiens
auguuuuaauauccua

SEQ ID NO: 2057660 - RNA, 14 nt, Homo sapiens
auggucucucaccc

SEQ ID NO: 2057661 - RNA, 19 nt, Homo sapiens
gaauaaugucuagauuuug

SEQ ID NO: 2057662 - RNA, 21 nt, Homo sapiens
aaacucuaucugaaaucccaa

SEQ ID NO: 2057663 - RNA, 21 nt, Homo sapiens
accauggugaauuaaucacuu

SEQ ID NO: 2057664 - RNA, 20 nt, Homo sapiens
aaaugggggcaggaaagcca

SEQ ID NO: 2057665 - RNA, 13 nt, Homo sapiens
uuuuaaauuugaa

SEQ ID NO: 2057666 - RNA, 13 nt, Homo sapiens
uuaggaucucagg

SEQ ID NO: 2057667 - RNA, 15 nt, Homo sapiens
accugaccucugcaa

SEQ ID NO: 2057668 - RNA, 21 nt, Homo sapiens
gggaucccagcaucucagagu

SEQ ID NO: 2057669 - RNA, 13 nt, Homo sapiens
ucguuuuguacug

SEQ ID NO: 2057670 - RNA, 21 nt, Homo sapiens
uauuugucuccaugauaccac

SEQ ID NO: 2057671 - RNA, 13 nt, Homo sapiens
aaagcugccuguc

SEQ ID NO: 2057672 - RNA, 22 nt, Homo sapiens
gggcccccaccgccgggguccu

SEQ ID NO: 2057673 - RNA, 12 nt, Homo sapiens
cagaagcugccc

SEQ ID NO: 2057674 - RNA, 14 nt, Homo sapiens
aaauugugaugugg

SEQ ID NO: 2057675 - RNA, 16 nt, Homo sapiens
ucaagccugugcaaug

SEQ ID NO: 2057676 - RNA, 21 nt, Homo sapiens
gugaugaugaaaugaggucag

SEQ ID NO: 2057677 - RNA, 19 nt, Homo sapiens
gugucucaggccacaccgg

SEQ ID NO: 2057678 - RNA, 14 nt, Homo sapiens
cagucauguaugca

SEQ ID NO: 2057679 - RNA, 16 nt, Homo sapiens
cuauaaaaaauaugua

SEQ ID NO: 2057680 - RNA, 22 nt, Homo sapiens
cuagauaugaagaaucugcucu

SEQ ID NO: 2057681 - RNA, 20 nt, Homo sapiens
aucauguuuuuucugcaaug

SEQ ID NO: 2057682 - RNA, 14 nt, Homo sapiens
caaagugaaggaca

SEQ ID NO: 2057683 - RNA, 20 nt, Homo sapiens
aaaugcuguauuagucacag

SEQ ID NO: 2057684 - RNA, 20 nt, Homo sapiens
auaacguagaucgaagccaa

SEQ ID NO: 2057685 - RNA, 14 nt, Homo sapiens
ucucaggccagcuc

SEQ ID NO: 2057686 - RNA, 18 nt, Homo sapiens
ugguccaggcuugggcuc

SEQ ID NO: 2057687 - RNA, 15 nt, Homo sapiens
ugcagaauggcauuu

SEQ ID NO: 2057688 - RNA, 13 nt, Homo sapiens
auuuaacaaauac

SEQ ID NO: 2057689 - RNA, 19 nt, Homo sapiens
cuaaggaauaugagcuuua

SEQ ID NO: 2057690 - RNA, 12 nt, Homo sapiens
acucaggaucca

SEQ ID NO: 2057691 - RNA, 12 nt, Homo sapiens
gcuuccaucagu

SEQ ID NO: 2057692 - RNA, 15 nt, Homo sapiens
aacagcaugcugcug

SEQ ID NO: 2057693 - RNA, 19 nt, Homo sapiens
uccagauaggaaaagaaga

SEQ ID NO: 2057694 - RNA, 13 nt, Homo sapiens
aaugcaugccagu

SEQ ID NO: 2057695 - RNA, 13 nt, Homo sapiens
acuauaugcaaac

SEQ ID NO: 2057696 - RNA, 18 nt, Homo sapiens
cauauucgauguacuuua

SEQ ID NO: 2057697 - RNA, 16 nt, Homo sapiens
gcaaauuaaacuuuaa

SEQ ID NO: 2057698 - RNA, 17 nt, Homo sapiens
aauagccuagauaugaa

SEQ ID NO: 2057699 - RNA, 16 nt, Homo sapiens
gcuggcggaaccuggc

SEQ ID NO: 2057700 - RNA, 15 nt, Homo sapiens
gaccucaagugaucu

SEQ ID NO: 2057701 - RNA, 22 nt, Homo sapiens
uagacaguaugagucaaugugc

SEQ ID NO: 2057702 - RNA, 14 nt, Homo sapiens
acacacugacauua

SEQ ID NO: 2057703 - RNA, 18 nt, Homo sapiens
uucaaguauuagggguaa

SEQ ID NO: 2057704 - RNA, 21 nt, Homo sapiens
ucaucuccaaaaacaguaaaa

SEQ ID NO: 2057705 - RNA, 15 nt, Homo sapiens
uugcuuuuaauucca

SEQ ID NO: 2057706 - RNA, 13 nt, Homo sapiens
caucuucuagaau

SEQ ID NO: 2057707 - RNA, 22 nt, Homo sapiens
cagaagcaucgcuccucuccag

SEQ ID NO: 2057708 - RNA, 21 nt, Homo sapiens
gaauucaaguggguauucugg

SEQ ID NO: 2057709 - RNA, 16 nt, Homo sapiens
cgugcaaacccaguga

SEQ ID NO: 2057710 - RNA, 16 nt, Homo sapiens
uucaaagguacuugga

SEQ ID NO: 2057711 - RNA, 20 nt, Homo sapiens
auuaauuaagucaccuguau

SEQ ID NO: 2057712 - RNA, 20 nt, Homo sapiens
gaggcgcaggacaccaugaa

SEQ ID NO: 2057713 - RNA, 18 nt, Homo sapiens
aauuuaguuuuagcagcu

SEQ ID NO: 2057714 - RNA, 14 nt, Homo sapiens
auuauaaacccaca

SEQ ID NO: 2057715 - RNA, 21 nt, Homo sapiens
augcugcuuugguuaaucucu

SEQ ID NO: 2057716 - RNA, 19 nt, Homo sapiens
uagaaagccccucaccuca

SEQ ID NO: 2057717 - RNA, 17 nt, Homo sapiens
cucugguggagacaaau

SEQ ID NO: 2057718 - RNA, 11 nt, Homo sapiens
uauuuugccac

SEQ ID NO: 2057719 - RNA, 21 nt, Homo sapiens
agggugggguaaggaggagaa

SEQ ID NO: 2057720 - RNA, 12 nt, Homo sapiens
acuaauccuuac

SEQ ID NO: 2057721 - RNA, 15 nt, Homo sapiens
gcucugggcggcccg

SEQ ID NO: 2057722 - RNA, 18 nt, Homo sapiens
gagcccgucaggccacag

SEQ ID NO: 2057723 - RNA, 17 nt, Homo sapiens
gccuaauacaacaugua

SEQ ID NO: 2057724 - RNA, 18 nt, Homo sapiens
uuuaaaaggauuaaucug

SEQ ID NO: 2057725 - RNA, 15 nt, Homo sapiens
acucaaguagcauuu

SEQ ID NO: 2057726 - RNA, 18 nt, Homo sapiens
ugcaccucuuugucacag

SEQ ID NO: 2057727 - RNA, 21 nt, Homo sapiens
accauaacacuugaugccguu

SEQ ID NO: 2057728 - RNA, 19 nt, Homo sapiens
cuaaaccauugugcauucu

SEQ ID NO: 2057729 - RNA, 21 nt, Homo sapiens
cuccuugacugccgcaucaug

SEQ ID NO: 2057730 - RNA, 13 nt, Homo sapiens
aaaacaucacuga

SEQ ID NO: 2057731 - RNA, 18 nt, Homo sapiens
caccccucccucugcucu

SEQ ID NO: 2057732 - RNA, 22 nt, Homo sapiens
cagaaccacauuaagucuccau

SEQ ID NO: 2057733 - RNA, 22 nt, Homo sapiens
ccaaauguggaauugacugccu

SEQ ID NO: 2057734 - RNA, 21 nt, Homo sapiens
acaggccucagggugggagau

SEQ ID NO: 2057735 - RNA, 17 nt, Homo sapiens
ccuccauuaaccaagaa

SEQ ID NO: 2057736 - RNA, 23 nt, Homo sapiens
caugaggugagagaaagccacaa

SEQ ID NO: 2057737 - RNA, 21 nt, Homo sapiens
uugggagcaccgccugugaaa

SEQ ID NO: 2057738 - RNA, 21 nt, Homo sapiens
agcaaacacuugaagugagaa

SEQ ID NO: 2057739 - RNA, 13 nt, Homo sapiens
aaaguuguuguaa

SEQ ID NO: 2057740 - RNA, 13 nt, Homo sapiens
aaugauguugaau

SEQ ID NO: 2057741 - RNA, 12 nt, Homo sapiens
gacucagcacug

SEQ ID NO: 2057742 - RNA, 23 nt, Homo sapiens
cugaugacauuccaccauuguga

SEQ ID NO: 2057743 - RNA, 11 nt, Homo sapiens
auuugacuuac

SEQ ID NO: 2057744 - RNA, 23 nt, Homo sapiens
aggaaaggaugguagauucuguu

SEQ ID NO: 2057745 - RNA, 23 nt, Homo sapiens
gggcugggggagagaaacacugc

SEQ ID NO: 2057746 - RNA, 20 nt, Homo sapiens
acccagaugccaaccagaca

SEQ ID NO: 2057747 - RNA, 21 nt, Homo sapiens
gagcaguucuguugcaugauu

SEQ ID NO: 2057748 - RNA, 22 nt, Homo sapiens
gcuguugacaucagccugcuuc

SEQ ID NO: 2057749 - RNA, 18 nt, Homo sapiens
aucuuggcaauaauguca

SEQ ID NO: 2057750 - RNA, 17 nt, Homo sapiens
caaagaacuucuccuac

SEQ ID NO: 2057751 - RNA, 19 nt, Homo sapiens
uaaaaauuaaaugugagca

SEQ ID NO: 2057752 - RNA, 16 nt, Homo sapiens
gcaacagaaaccaaga

SEQ ID NO: 2057753 - RNA, 17 nt, Homo sapiens
aaucaccuggcugagca

SEQ ID NO: 2057754 - RNA, 18 nt, Homo sapiens
cauuggaaacaagucagu

SEQ ID NO: 2057755 - RNA, 15 nt, Homo sapiens
gaacagaaccugcaa

SEQ ID NO: 2057756 - RNA, 23 nt, Homo sapiens
uaggggaaggaggauaagcuuuu

SEQ ID NO: 2057757 - RNA, 16 nt, Homo sapiens
ccuuccaucuucacac

SEQ ID NO: 2057758 - RNA, 17 nt, Homo sapiens
aaaguagauuaaaauau

SEQ ID NO: 2057759 - RNA, 21 nt, Homo sapiens
uuccacaguugccaccaccuc

SEQ ID NO: 2057760 - RNA, 15 nt, Homo sapiens
acuucagucuuggag

SEQ ID NO: 2057761 - RNA, 13 nt, Homo sapiens
aacuaaacaaggc

SEQ ID NO: 2057762 - RNA, 15 nt, Homo sapiens
aaaacugugccuugu

SEQ ID NO: 2057763 - RNA, 17 nt, Homo sapiens
cagagaaugugaacaug

SEQ ID NO: 2057764 - RNA, 17 nt, Homo sapiens
cgaguuccggaaagccu

SEQ ID NO: 2057765 - RNA, 20 nt, Homo sapiens
uggcugauggaagcaccuaa

SEQ ID NO: 2057766 - RNA, 23 nt, Homo sapiens
auacugagauugucuguucaguu

SEQ ID NO: 2057767 - RNA, 14 nt, Homo sapiens
uacagaggacagua

SEQ ID NO: 2057768 - RNA, 18 nt, Homo sapiens
ccaugcuuuguagguguc

SEQ ID NO: 2057769 - RNA, 20 nt, Homo sapiens
uguuuuuuucccaaguguga

SEQ ID NO: 2057770 - RNA, 20 nt, Homo sapiens
cacuggacugucuaugaacu

SEQ ID NO: 2057771 - RNA, 11 nt, Homo sapiens
gugcugggauu

SEQ ID NO: 2057772 - RNA, 22 nt, Homo sapiens
aauaggccaggggaguuuccaa

SEQ ID NO: 2057773 - RNA, 18 nt, Homo sapiens
uacuguuucuugcacuga

SEQ ID NO: 2057774 - RNA, 16 nt, Homo sapiens
guaaagcaguauuaaa

SEQ ID NO: 2057775 - RNA, 19 nt, Homo sapiens
uuaagaacacuuuuaauaa

SEQ ID NO: 2057776 - RNA, 13 nt, Homo sapiens
ucacuucaguugc

SEQ ID NO: 2057777 - RNA, 12 nt, Homo sapiens
uuucacacauuu

SEQ ID NO: 2057778 - RNA, 14 nt, Homo sapiens
agcccauggcuuua

SEQ ID NO: 2057779 - RNA, 16 nt, Homo sapiens
augcagggagcacugu

SEQ ID NO: 2057780 - RNA, 14 nt, Homo sapiens
augucaauagcauu

SEQ ID NO: 2057781 - RNA, 23 nt, Homo sapiens
ggagaccagaaaccuuccagaga

SEQ ID NO: 2057782 - RNA, 15 nt, Homo sapiens
uguacuugauauuau

SEQ ID NO: 2057783 - RNA, 17 nt, Homo sapiens
aacaagcauucucucca

SEQ ID NO: 2057784 - RNA, 18 nt, Homo sapiens
ugccaccaacacugcuca

SEQ ID NO: 2057785 - RNA, 18 nt, Homo sapiens
uucauuuuaagagcaaaa

SEQ ID NO: 2057786 - RNA, 14 nt, Homo sapiens
uccccuccagcucc

SEQ ID NO: 2057787 - RNA, 18 nt, Homo sapiens
aggcagggagugucugca

SEQ ID NO: 2057788 - RNA, 13 nt, Homo sapiens
ggacaaagcaaaa

SEQ ID NO: 2057789 - RNA, 19 nt, Homo sapiens
ggaaaagggucuugggaaa

SEQ ID NO: 2057790 - RNA, 12 nt, Homo sapiens
uuugccacugau

SEQ ID NO: 2057791 - RNA, 14 nt, Homo sapiens
ggcauccgcaaugu

SEQ ID NO: 2057792 - RNA, 22 nt, Homo sapiens
aacauuuguuucccccacaguu

SEQ ID NO: 2057793 - RNA, 13 nt, Homo sapiens
ugggccaccagag

SEQ ID NO: 2057794 - RNA, 20 nt, Homo sapiens
aggaauagaagcaaauuaaa

SEQ ID NO: 2057795 - RNA, 19 nt, Homo sapiens
gcugagacccuuauuuaaa

SEQ ID NO: 2057796 - RNA, 17 nt, Homo sapiens
aacuguguauguacaua

SEQ ID NO: 2057797 - RNA, 22 nt, Homo sapiens
aguaucaguugcaggugccaau

SEQ ID NO: 2057798 - RNA, 15 nt, Homo sapiens
ugucucaucugugcu

SEQ ID NO: 2057799 - RNA, 20 nt, Homo sapiens
acacaguguuuccugaguag

SEQ ID NO: 2057800 - RNA, 19 nt, Homo sapiens
cauaauuuguacauaugua

SEQ ID NO: 2057801 - RNA, 19 nt, Homo sapiens
uaaaauagucucauugcca

SEQ ID NO: 2057802 - RNA, 18 nt, Homo sapiens
agcauuuaccaugugcua

SEQ ID NO: 2057803 - RNA, 14 nt, Homo sapiens
ucacaaaauaucac

SEQ ID NO: 2057804 - RNA, 14 nt, Homo sapiens
cauaaaaaccaaac

SEQ ID NO: 2057805 - RNA, 16 nt, Homo sapiens
uacaaccgguuaucag

SEQ ID NO: 2057806 - RNA, 13 nt, Homo sapiens
cuucccugcauuu

SEQ ID NO: 2057807 - RNA, 19 nt, Homo sapiens
aauuuuagaacaguccagc

SEQ ID NO: 2057808 - RNA, 14 nt, Homo sapiens
ucagaacuuugaga

SEQ ID NO: 2057809 - RNA, 21 nt, Homo sapiens
auucuuucaagucaguucugu

SEQ ID NO: 2057810 - RNA, 16 nt, Homo sapiens
cggcccucagaugucc

SEQ ID NO: 2057811 - RNA, 20 nt, Homo sapiens
caugacucagcauaccugcu

SEQ ID NO: 2057812 - RNA, 17 nt, Homo sapiens
ugagaaaucguugcugc

SEQ ID NO: 2057813 - RNA, 15 nt, Homo sapiens
uucuuuauaucugaa

SEQ ID NO: 2057814 - RNA, 19 nt, Homo sapiens
gauaaguucuuuuacaaau

SEQ ID NO: 2057815 - RNA, 13 nt, Homo sapiens
aggccccuuccca

SEQ ID NO: 2057816 - RNA, 12 nt, Homo sapiens
ccagguaggaaa

SEQ ID NO: 2057817 - RNA, 19 nt, Homo sapiens
caaaggcagagagucagac

SEQ ID NO: 2057818 - RNA, 20 nt, Homo sapiens
cuuucugaaauaacauggcc

SEQ ID NO: 2057819 - RNA, 13 nt, Homo sapiens
agguggguucuga

SEQ ID NO: 2057820 - RNA, 17 nt, Homo sapiens
uaacaguaguccuuuga

SEQ ID NO: 2057821 - RNA, 20 nt, Homo sapiens
ggggccaccaucccugaugg

SEQ ID NO: 2057822 - RNA, 14 nt, Homo sapiens
uacggcccaugcaa

SEQ ID NO: 2057823 - RNA, 16 nt, Homo sapiens
uucacauugcacucau

SEQ ID NO: 2057824 - RNA, 20 nt, Homo sapiens
cauacguaaaaaucucucau

SEQ ID NO: 2057825 - RNA, 22 nt, Homo sapiens
cacaccuuauauuuacguauga

SEQ ID NO: 2057826 - RNA, 15 nt, Homo sapiens
cuuucagaaacuaaa

SEQ ID NO: 2057827 - RNA, 20 nt, Homo sapiens
acucuuacuaaccaccauuu

SEQ ID NO: 2057828 - RNA, 17 nt, Homo sapiens
agcauuggccucugugu

SEQ ID NO: 2057829 - RNA, 14 nt, Homo sapiens
ccuuacaucuggcu

SEQ ID NO: 2057830 - RNA, 19 nt, Homo sapiens
uagccccagcgccaaagga

SEQ ID NO: 2057831 - RNA, 18 nt, Homo sapiens
caugacgguguccaugcc

SEQ ID NO: 2057832 - RNA, 18 nt, Homo sapiens
ugagacagaccgccaaau

SEQ ID NO: 2057833 - RNA, 18 nt, Homo sapiens
auaaucgagucuaccucu

SEQ ID NO: 2057834 - RNA, 11 nt, Homo sapiens
auaaaaugcaa

SEQ ID NO: 2057835 - RNA, 20 nt, Homo sapiens
auaaauuuggacugucuaua

SEQ ID NO: 2057836 - RNA, 19 nt, Homo sapiens
uccuuuugaaauuguagug

SEQ ID NO: 2057837 - RNA, 19 nt, Homo sapiens
aacauuuuacugugcuguu

SEQ ID NO: 2057838 - RNA, 21 nt, Homo sapiens
cccaagcaaaaucauggaaug

SEQ ID NO: 2057839 - RNA, 22 nt, Homo sapiens
ccaccucggccucccaaaaugc

SEQ ID NO: 2057840 - RNA, 18 nt, Homo sapiens
uuuuuacugugcauacau

SEQ ID NO: 2057841 - RNA, 13 nt, Homo sapiens
gccucgggaccaa

SEQ ID NO: 2057842 - RNA, 13 nt, Homo sapiens
aacucggggacaa

SEQ ID NO: 2057843 - RNA, 20 nt, Homo sapiens
guuuuauugaaaauguggua

SEQ ID NO: 2057844 - RNA, 15 nt, Homo sapiens
acuagccaucucaag

SEQ ID NO: 2057845 - RNA, 16 nt, Homo sapiens
gaaaaaaaacauugca

SEQ ID NO: 2057846 - RNA, 20 nt, Homo sapiens
ccugcucagcccugcaccau

SEQ ID NO: 2057847 - RNA, 16 nt, Homo sapiens
ggcuggagugcagugg

SEQ ID NO: 2057848 - RNA, 20 nt, Homo sapiens
ucugagggcuuguaguucuu

SEQ ID NO: 2057849 - RNA, 16 nt, Homo sapiens
uuuuuaucugcauaaa

SEQ ID NO: 2057850 - RNA, 12 nt, Homo sapiens
ccugcugaccau

SEQ ID NO: 2057851 - RNA, 16 nt, Homo sapiens
uaaagaugaucuacuc

SEQ ID NO: 2057852 - RNA, 13 nt, Homo sapiens
aauuggucauucc

SEQ ID NO: 2057853 - RNA, 22 nt, Homo sapiens
guguuucgcauuaagcacacac

SEQ ID NO: 2057854 - RNA, 18 nt, Homo sapiens
caagugcugcacaaaagc

SEQ ID NO: 2057855 - RNA, 13 nt, Homo sapiens
aacucuugcucac

SEQ ID NO: 2057856 - RNA, 13 nt, Homo sapiens
aauuauugcuuaa

SEQ ID NO: 2057857 - RNA, 16 nt, Homo sapiens
cauuauugacgaacug

SEQ ID NO: 2057858 - RNA, 12 nt, Homo sapiens
acaaaagcuuuu

SEQ ID NO: 2057859 - RNA, 22 nt, Homo sapiens
aguccggugccuuccacccugc

SEQ ID NO: 2057860 - RNA, 22 nt, Homo sapiens
acaauguuauucguuuugucua

SEQ ID NO: 2057861 - RNA, 18 nt, Homo sapiens
agcuaguauaacuuuaca

SEQ ID NO: 2057862 - RNA, 23 nt, Homo sapiens
ccaagcguuucccagucuuagcc

SEQ ID NO: 2057863 - RNA, 23 nt, Homo sapiens
guaucagaagcgcugauggucau

SEQ ID NO: 2057864 - RNA, 23 nt, Homo sapiens
uugauuaaacagcaaagccauau

SEQ ID NO: 2057865 - RNA, 22 nt, Homo sapiens
cugcugaaaacuagcucgugau

SEQ ID NO: 2057866 - RNA, 23 nt, Homo sapiens
gagaaaauaagacuucuggugcu

SEQ ID NO: 2057867 - RNA, 19 nt, Homo sapiens
ugcguuuccugugcaugga

SEQ ID NO: 2057868 - RNA, 16 nt, Homo sapiens
agggaggggcuggggc

SEQ ID NO: 2057869 - RNA, 14 nt, Homo sapiens
ccacugccagcagc

SEQ ID NO: 2057870 - RNA, 17 nt, Homo sapiens
gaaaaucaucaagaagg

SEQ ID NO: 2057871 - RNA, 12 nt, Homo sapiens
acucgccagcuc

SEQ ID NO: 2057872 - RNA, 22 nt, Homo sapiens
cuuaauguucugaauaauuucu

SEQ ID NO: 2057873 - RNA, 11 nt, Homo sapiens
cuugccucuuc

SEQ ID NO: 2057874 - RNA, 22 nt, Homo sapiens
caccaguguccccuccacuguc

SEQ ID NO: 2057875 - RNA, 15 nt, Homo sapiens
ggucaaaaaggccaa

SEQ ID NO: 2057876 - RNA, 15 nt, Homo sapiens
auccacaagccauuu

SEQ ID NO: 2057877 - RNA, 16 nt, Homo sapiens
cuucucauuaccagua

SEQ ID NO: 2057878 - RNA, 16 nt, Homo sapiens
agcccuuagcagggaa

SEQ ID NO: 2057879 - RNA, 20 nt, Homo sapiens
aauaaaucaacuccagcucc

SEQ ID NO: 2057880 - RNA, 17 nt, Homo sapiens
ucuucugggcgucugag

SEQ ID NO: 2057881 - RNA, 16 nt, Homo sapiens
auucauuuugcaacuu

SEQ ID NO: 2057882 - RNA, 18 nt, Homo sapiens
gaaccucaaacuggguau

SEQ ID NO: 2057883 - RNA, 21 nt, Homo sapiens
aucacugaagaaacuucugcu

SEQ ID NO: 2057884 - RNA, 21 nt, Homo sapiens
aacauguggcaaccuguucuu

SEQ ID NO: 2057885 - RNA, 21 nt, Homo sapiens
gacccagcuccucugagccau

SEQ ID NO: 2057886 - RNA, 13 nt, Homo sapiens
gauaaauuguaua

SEQ ID NO: 2057887 - RNA, 12 nt, Homo sapiens
ggaucagccuug

SEQ ID NO: 2057888 - RNA, 20 nt, Homo sapiens
uaccuguguuucuugccuca

SEQ ID NO: 2057889 - RNA, 16 nt, Homo sapiens
uaaaauggaagcaauu

SEQ ID NO: 2057890 - RNA, 15 nt, Homo sapiens
auggugaaaccucau

SEQ ID NO: 2057891 - RNA, 20 nt, Homo sapiens
acauacagagguaacuauca

SEQ ID NO: 2057892 - RNA, 15 nt, Homo sapiens
ggaagccaggugagc

SEQ ID NO: 2057893 - RNA, 20 nt, Homo sapiens
gauuucaugucacuaaacaa

SEQ ID NO: 2057894 - RNA, 19 nt, Homo sapiens
cuguggggcgaauucaucc

SEQ ID NO: 2057895 - RNA, 11 nt, Homo sapiens
aaaugugcuca

SEQ ID NO: 2057896 - RNA, 11 nt, Homo sapiens
uccugugcaac

SEQ ID NO: 2057897 - RNA, 19 nt, Homo sapiens
cuaaaauguagaaauucua

SEQ ID NO: 2057898 - RNA, 21 nt, Homo sapiens
cuuccuucauccucaaccugc

SEQ ID NO: 2057899 - RNA, 13 nt, Homo sapiens
acacccaugugua

SEQ ID NO: 2057900 - RNA, 19 nt, Homo sapiens
ccaaguggcccccacccuc

SEQ ID NO: 2057901 - RNA, 16 nt, Homo sapiens
uguuuaagucagcaaa

SEQ ID NO: 2057902 - RNA, 14 nt, Homo sapiens
auauggacacugug

SEQ ID NO: 2057903 - RNA, 17 nt, Homo sapiens
agagaacugauugugag

SEQ ID NO: 2057904 - RNA, 18 nt, Homo sapiens
acuguugggacagccauu

SEQ ID NO: 2057905 - RNA, 14 nt, Homo sapiens
augcaugucugccu

SEQ ID NO: 2057906 - RNA, 14 nt, Homo sapiens
caaacuguaaaaau

SEQ ID NO: 2057907 - RNA, 16 nt, Homo sapiens
cuuagacagucccugc

SEQ ID NO: 2057908 - RNA, 17 nt, Homo sapiens
acaagauauuauguaua

SEQ ID NO: 2057909 - RNA, 21 nt, Homo sapiens
uucgugguuuuuacauucaau

SEQ ID NO: 2057910 - RNA, 14 nt, Homo sapiens
uguguuuuuaauaa

SEQ ID NO: 2057911 - RNA, 16 nt, Homo sapiens
auauaagcugccauau

SEQ ID NO: 2057912 - RNA, 19 nt, Homo sapiens
cucucccaguccauuucca

SEQ ID NO: 2057913 - RNA, 16 nt, Homo sapiens
guaauacuucauucuc

SEQ ID NO: 2057914 - RNA, 19 nt, Homo sapiens
aacaaauugggaucugucu

SEQ ID NO: 2057915 - RNA, 13 nt, Homo sapiens
cagcagaaacaca

SEQ ID NO: 2057916 - RNA, 16 nt, Homo sapiens
acaucucugcuuucac

SEQ ID NO: 2057917 - RNA, 13 nt, Homo sapiens
auauuuaucugau

SEQ ID NO: 2057918 - RNA, 13 nt, Homo sapiens
uccccuccucuau

SEQ ID NO: 2057919 - RNA, 15 nt, Homo sapiens
aguacugccaauacu

SEQ ID NO: 2057920 - RNA, 13 nt, Homo sapiens
ucucuuccuccac

SEQ ID NO: 2057921 - RNA, 18 nt, Homo sapiens
gccaugggcacugugggu

SEQ ID NO: 2057922 - RNA, 14 nt, Homo sapiens
uccauacagugaca

SEQ ID NO: 2057923 - RNA, 19 nt, Homo sapiens
aucgcuuucuacacuguau

SEQ ID NO: 2057924 - RNA, 18 nt, Homo sapiens
uaaaaagacuaaccugcc

SEQ ID NO: 2057925 - RNA, 20 nt, Homo sapiens
aauauauauuaagugugcca

SEQ ID NO: 2057926 - RNA, 18 nt, Homo sapiens
auucaaagaaguacuuua

SEQ ID NO: 2057927 - RNA, 20 nt, Homo sapiens
ccuaguacuuuauuaguuua

SEQ ID NO: 2057928 - RNA, 22 nt, Homo sapiens
cuccuccuacccuuccagugcc

SEQ ID NO: 2057929 - RNA, 21 nt, Homo sapiens
auuaaauggugauuucuugcu

SEQ ID NO: 2057930 - RNA, 22 nt, Homo sapiens
gaaauaaauucugacuuaugaa

SEQ ID NO: 2057931 - RNA, 14 nt, Homo sapiens
gagaaaagacauaa

SEQ ID NO: 2057932 - RNA, 20 nt, Homo sapiens
caugugcugucuccaugcug

SEQ ID NO: 2057933 - RNA, 22 nt, Homo sapiens
gcaggcaccuuaguggcuuuuu

SEQ ID NO: 2057934 - RNA, 18 nt, Homo sapiens
aauaugacacucuaguca

SEQ ID NO: 2057935 - RNA, 14 nt, Homo sapiens
ccagcacagacuca

SEQ ID NO: 2057936 - RNA, 19 nt, Homo sapiens
cagcauugucucguguaca

SEQ ID NO: 2057937 - RNA, 18 nt, Homo sapiens
aaagaaacuaagauuuau

SEQ ID NO: 2057938 - RNA, 12 nt, Homo sapiens
gggaaggugacc

SEQ ID NO: 2057939 - RNA, 13 nt, Homo sapiens
auggaaaacugcc

SEQ ID NO: 2057940 - RNA, 19 nt, Homo sapiens
aaaccugucuccacugugc

SEQ ID NO: 2057941 - RNA, 18 nt, Homo sapiens
agacacugugguugcaaa

SEQ ID NO: 2057942 - RNA, 15 nt, Homo sapiens
caaaaacuacacaua

SEQ ID NO: 2057943 - RNA, 23 nt, Homo sapiens
auaacauaaauuuaucaucucga

SEQ ID NO: 2057944 - RNA, 18 nt, Homo sapiens
ccuggucaacauagugag

SEQ ID NO: 2057945 - RNA, 18 nt, Homo sapiens
ggggucucccugagccug

SEQ ID NO: 2057946 - RNA, 18 nt, Homo sapiens
ucuccaaggcagggacca

SEQ ID NO: 2057947 - RNA, 13 nt, Homo sapiens
ugaauauuucaua

SEQ ID NO: 2057948 - RNA, 14 nt, Homo sapiens
uuaacacauaacua

SEQ ID NO: 2057949 - RNA, 21 nt, Homo sapiens
guagucauacucccuggugua

SEQ ID NO: 2057950 - RNA, 14 nt, Homo sapiens
auagcagcugcuac

SEQ ID NO: 2057951 - RNA, 14 nt, Homo sapiens
ucuuacccaaagca

SEQ ID NO: 2057952 - RNA, 14 nt, Homo sapiens
uuccuuuccaggua

SEQ ID NO: 2057953 - RNA, 14 nt, Homo sapiens
caggcaucuucccu

SEQ ID NO: 2057954 - RNA, 18 nt, Homo sapiens
auccagagucaucucagc

SEQ ID NO: 2057955 - RNA, 14 nt, Homo sapiens
aaaauguuaugcag

SEQ ID NO: 2057956 - RNA, 20 nt, Homo sapiens
auuuuaaaacucuacagaug

SEQ ID NO: 2057957 - RNA, 20 nt, Homo sapiens
gccccucccagccuaccccu

SEQ ID NO: 2057958 - RNA, 23 nt, Homo sapiens
ucucuccuaagacaccugcaaua

SEQ ID NO: 2057959 - RNA, 16 nt, Homo sapiens
acuuuccuguugucua

SEQ ID NO: 2057960 - RNA, 14 nt, Homo sapiens
ccccagcccaaguc

SEQ ID NO: 2057961 - RNA, 20 nt, Homo sapiens
ucugagucuauguucaaaga

SEQ ID NO: 2057962 - RNA, 21 nt, Homo sapiens
uaagguaaaaccaucuaggau

SEQ ID NO: 2057963 - RNA, 17 nt, Homo sapiens
gaagccagccacagacc

SEQ ID NO: 2057964 - RNA, 12 nt, Homo sapiens
ccccacucuaua

SEQ ID NO: 2057965 - RNA, 19 nt, Homo sapiens
augaugcacaguaucugcu

SEQ ID NO: 2057966 - RNA, 13 nt, Homo sapiens
gucugacucucca

SEQ ID NO: 2057967 - RNA, 16 nt, Homo sapiens
aucaguguuguugcuc

SEQ ID NO: 2057968 - RNA, 23 nt, Homo sapiens
gacugauguuacaucacaguguu

SEQ ID NO: 2057969 - RNA, 14 nt, Homo sapiens
augucacugccuga

SEQ ID NO: 2057970 - RNA, 19 nt, Homo sapiens
ccaguccucccagcugcca

SEQ ID NO: 2057971 - RNA, 15 nt, Homo sapiens
auuuugugacauucc

SEQ ID NO: 2057972 - RNA, 12 nt, Homo sapiens
aguuuucaccug

SEQ ID NO: 2057973 - RNA, 16 nt, Homo sapiens
uaaaagguaugcaauc

SEQ ID NO: 2057974 - RNA, 20 nt, Homo sapiens
gcaagcuaaccuuauccugc

SEQ ID NO: 2057975 - RNA, 14 nt, Homo sapiens
acaacaaaaagcuu

SEQ ID NO: 2057976 - RNA, 13 nt, Homo sapiens
agagcuggugcca

SEQ ID NO: 2057977 - RNA, 22 nt, Homo sapiens
guuccauacccccacaugccaa

SEQ ID NO: 2057978 - RNA, 21 nt, Homo sapiens
ugaauguguagaaccuuccuu

SEQ ID NO: 2057979 - RNA, 18 nt, Homo sapiens
caucgugaagaagccugu

SEQ ID NO: 2057980 - RNA, 18 nt, Homo sapiens
uaacuggcuuacuuccua

SEQ ID NO: 2057981 - RNA, 23 nt, Homo sapiens
cuaacucccuaggccugaguuag

SEQ ID NO: 2057982 - RNA, 15 nt, Homo sapiens
aaacugagacccaga

SEQ ID NO: 2057983 - RNA, 21 nt, Homo sapiens
uaucacauuuaccauaauuua

SEQ ID NO: 2057984 - RNA, 17 nt, Homo sapiens
gguggagaugaggugcu

SEQ ID NO: 2057985 - RNA, 16 nt, Homo sapiens
auaaaacacuaacuua

SEQ ID NO: 2057986 - RNA, 22 nt, Homo sapiens
agcccacguucucucugccugu

SEQ ID NO: 2057987 - RNA, 12 nt, Homo sapiens
uuagaacaggga

SEQ ID NO: 2057988 - RNA, 19 nt, Homo sapiens
gcuccagaagaacaaagag

SEQ ID NO: 2057989 - RNA, 18 nt, Homo sapiens
ggcagauggccacugcuc

SEQ ID NO: 2057990 - RNA, 17 nt, Homo sapiens
ggcccacacgugcauag

SEQ ID NO: 2057991 - RNA, 11 nt, Homo sapiens
ucagggucccc

SEQ ID NO: 2057992 - RNA, 12 nt, Homo sapiens
auacuguucuca

SEQ ID NO: 2057993 - RNA, 15 nt, Homo sapiens
agucauacuaguagu

SEQ ID NO: 2057994 - RNA, 15 nt, Homo sapiens
aaaauucucuuaaac

SEQ ID NO: 2057995 - RNA, 15 nt, Homo sapiens
cugcccgagagcucu

SEQ ID NO: 2057996 - RNA, 21 nt, Homo sapiens
cucaggaggguaagaacucca

SEQ ID NO: 2057997 - RNA, 16 nt, Homo sapiens
cuuuuauacauuuuag

SEQ ID NO: 2057998 - RNA, 17 nt, Homo sapiens
gacauuaaaauaacuaa

SEQ ID NO: 2057999 - RNA, 18 nt, Homo sapiens
agagcaagacugucucaa

SEQ ID NO: 2058000 - RNA, 13 nt, Homo sapiens
gaugcugucuucg

SEQ ID NO: 2058001 - RNA, 21 nt, Homo sapiens
ucccuggagaaggcauguucc

SEQ ID NO: 2058002 - RNA, 22 nt, Homo sapiens
aauaaccaaacauaacauuaua

SEQ ID NO: 2058003 - RNA, 21 nt, Homo sapiens
ucaacuggguuuucagcauaa

SEQ ID NO: 2058004 - RNA, 14 nt, Homo sapiens
cuucacacuaucaa

SEQ ID NO: 2058005 - RNA, 14 nt, Homo sapiens
cuuaaaacuauaac

SEQ ID NO: 2058006 - RNA, 22 nt, Homo sapiens
cuaugaagaaaacagcugcaug

SEQ ID NO: 2058007 - RNA, 23 nt, Homo sapiens
aggcuagaagugugaagugcaga

SEQ ID NO: 2058008 - RNA, 19 nt, Homo sapiens
cucccugucacacacugga

SEQ ID NO: 2058009 - RNA, 14 nt, Homo sapiens
uucaagucagugag

SEQ ID NO: 2058010 - RNA, 18 nt, Homo sapiens
gccucuggaauugcucaa

SEQ ID NO: 2058011 - RNA, 18 nt, Homo sapiens
cugggccucauucuagca

SEQ ID NO: 2058012 - RNA, 14 nt, Homo sapiens
cucuacaugcuugu

SEQ ID NO: 2058013 - RNA, 16 nt, Homo sapiens
guggaacaaccugcug

SEQ ID NO: 2058014 - RNA, 14 nt, Homo sapiens
acuucuaccaggac

SEQ ID NO: 2058015 - RNA, 17 nt, Homo sapiens
aaugaaaucccagguaa

SEQ ID NO: 2058016 - RNA, 14 nt, Homo sapiens
aauuucuuugucau

SEQ ID NO: 2058017 - RNA, 22 nt, Homo sapiens
cauaauugugauuagacagaac

SEQ ID NO: 2058018 - RNA, 14 nt, Homo sapiens
uggaaucuuuuaua

SEQ ID NO: 2058019 - RNA, 19 nt, Homo sapiens
uggcucaaaauccacugac

SEQ ID NO: 2058020 - RNA, 14 nt, Homo sapiens
cugagucaccaucu

SEQ ID NO: 2058021 - RNA, 22 nt, Homo sapiens
caguaaaaauccuggaagacaa

SEQ ID NO: 2058022 - RNA, 23 nt, Homo sapiens
accuggccgggucacccugugac

SEQ ID NO: 2058023 - RNA, 20 nt, Homo sapiens
gauguggccaggggugcucc

SEQ ID NO: 2058024 - RNA, 19 nt, Homo sapiens
gccuucucccccccggggc

SEQ ID NO: 2058025 - RNA, 16 nt, Homo sapiens
ggaagcagugcccagg

SEQ ID NO: 2058026 - RNA, 12 nt, Homo sapiens
gaagaacugaaa

SEQ ID NO: 2058027 - RNA, 15 nt, Homo sapiens
guguaauuggcccaa

SEQ ID NO: 2058028 - RNA, 20 nt, Homo sapiens
ccuccaccuccuaggcucaa

SEQ ID NO: 2058029 - RNA, 21 nt, Homo sapiens
gacaugccacccucuccaugc

SEQ ID NO: 2058030 - RNA, 16 nt, Homo sapiens
uccugugccccucaga

SEQ ID NO: 2058031 - RNA, 21 nt, Homo sapiens
cagaggcaggaccagaaggca

SEQ ID NO: 2058032 - RNA, 12 nt, Homo sapiens
uugccugaacau

SEQ ID NO: 2058033 - RNA, 14 nt, Homo sapiens
guuuguagugaaau

SEQ ID NO: 2058034 - RNA, 14 nt, Homo sapiens
gccuggggccucac

SEQ ID NO: 2058035 - RNA, 19 nt, Homo sapiens
gcuagaacacuacagggga

SEQ ID NO: 2058036 - RNA, 19 nt, Homo sapiens
ccauguggcagaagggaua

SEQ ID NO: 2058037 - RNA, 20 nt, Homo sapiens
gcucacuaggccgauccugc

SEQ ID NO: 2058038 - RNA, 14 nt, Homo sapiens
accuacucuugccu

SEQ ID NO: 2058039 - RNA, 14 nt, Homo sapiens
augucuucucccac

SEQ ID NO: 2058040 - RNA, 14 nt, Homo sapiens
guuucaccuuccau

SEQ ID NO: 2058041 - RNA, 23 nt, Homo sapiens
ugaaggaaaguguaugaguugca

SEQ ID NO: 2058042 - RNA, 20 nt, Homo sapiens
gccuggaagccaaacaaagg

SEQ ID NO: 2058043 - RNA, 17 nt, Homo sapiens
ccauggcuaaggcacca

SEQ ID NO: 2058044 - RNA, 14 nt, Homo sapiens
cuuucuugcacuau

SEQ ID NO: 2058045 - RNA, 19 nt, Homo sapiens
cagccuccacuguguccag

SEQ ID NO: 2058046 - RNA, 22 nt, Homo sapiens
agacaagagaucuacacauguu

SEQ ID NO: 2058047 - RNA, 16 nt, Homo sapiens
ucacugagcauacuca

SEQ ID NO: 2058048 - RNA, 19 nt, Homo sapiens
guugauaaaaagaaaguuu

SEQ ID NO: 2058049 - RNA, 15 nt, Homo sapiens
cuuccacccgucucu

SEQ ID NO: 2058050 - RNA, 14 nt, Homo sapiens
ucaagugguucucc

SEQ ID NO: 2058051 - RNA, 21 nt, Homo sapiens
ggaacauuggagcugacuguu

SEQ ID NO: 2058052 - RNA, 12 nt, Homo sapiens
uuaagugauuau

SEQ ID NO: 2058053 - RNA, 21 nt, Homo sapiens
guuucagagauggacagagaa

SEQ ID NO: 2058054 - RNA, 13 nt, Homo sapiens
cugucagccugac

SEQ ID NO: 2058055 - RNA, 20 nt, Homo sapiens
cagccuccccccgcugggga

SEQ ID NO: 2058056 - RNA, 13 nt, Homo sapiens
gaccuguguuuca

SEQ ID NO: 2058057 - RNA, 20 nt, Homo sapiens
cuucaguccacuucugcucu

SEQ ID NO: 2058058 - RNA, 19 nt, Homo sapiens
caggccuggccucaucuca

SEQ ID NO: 2058059 - RNA, 22 nt, Homo sapiens
caacaggcccuugguagagcug

SEQ ID NO: 2058060 - RNA, 13 nt, Homo sapiens
ucccauugccaug

SEQ ID NO: 2058061 - RNA, 13 nt, Homo sapiens
ucccaugauuucu

SEQ ID NO: 2058062 - RNA, 12 nt, Homo sapiens
uguaacaugaca

SEQ ID NO: 2058063 - RNA, 21 nt, Homo sapiens
ccuucacaccacuugugagcu

SEQ ID NO: 2058064 - RNA, 17 nt, Homo sapiens
uuuucauaugcuucaaa

SEQ ID NO: 2058065 - RNA, 21 nt, Homo sapiens
uguccuucuuuaucugugaua

SEQ ID NO: 2058066 - RNA, 14 nt, Homo sapiens
gaagcugucaggcu

SEQ ID NO: 2058067 - RNA, 17 nt, Homo sapiens
uaaauucaaaccuaagu

SEQ ID NO: 2058068 - RNA, 14 nt, Homo sapiens
aacuccaagcagac

SEQ ID NO: 2058069 - RNA, 18 nt, Homo sapiens
gccaucuucacauucuga

SEQ ID NO: 2058070 - RNA, 19 nt, Homo sapiens
uuuagaaauagaacuacaa

SEQ ID NO: 2058071 - RNA, 17 nt, Homo sapiens
agaugucaucaagcucc

SEQ ID NO: 2058072 - RNA, 19 nt, Homo sapiens
uccgacugccgcugagaag

SEQ ID NO: 2058073 - RNA, 22 nt, Homo sapiens
uuacuuuggaacacuacucuua

SEQ ID NO: 2058074 - RNA, 20 nt, Homo sapiens
agagaucaugaauuauauaa

SEQ ID NO: 2058075 - RNA, 19 nt, Homo sapiens
guuagauggggaacauuuu

SEQ ID NO: 2058076 - RNA, 23 nt, Homo sapiens
uuucuggacaguaccugauugua

SEQ ID NO: 2058077 - RNA, 18 nt, Homo sapiens
gccgacuuggagacuccu

SEQ ID NO: 2058078 - RNA, 14 nt, Homo sapiens
auccuauaucuguu

SEQ ID NO: 2058079 - RNA, 18 nt, Homo sapiens
uucaccaguacauucuca

SEQ ID NO: 2058080 - RNA, 16 nt, Homo sapiens
cccaucuuucucacac

SEQ ID NO: 2058081 - RNA, 15 nt, Homo sapiens
uggguagcuauacuc

SEQ ID NO: 2058082 - RNA, 13 nt, Homo sapiens
uuugugagccagc

SEQ ID NO: 2058083 - RNA, 17 nt, Homo sapiens
cuaucuuuuaguuuuag

SEQ ID NO: 2058084 - RNA, 19 nt, Homo sapiens
uaauuggcccuguacaguu

SEQ ID NO: 2058085 - RNA, 13 nt, Homo sapiens
cuaauaugccuag

SEQ ID NO: 2058086 - RNA, 18 nt, Homo sapiens
cuucagcaugauguguug

SEQ ID NO: 2058087 - RNA, 21 nt, Homo sapiens
gacaggaggucagcacaagau

SEQ ID NO: 2058088 - RNA, 17 nt, Homo sapiens
ccaggcugcagugcaau

SEQ ID NO: 2058089 - RNA, 15 nt, Homo sapiens
uucaagaaagcuuca

SEQ ID NO: 2058090 - RNA, 15 nt, Homo sapiens
uucagucauaaagag

SEQ ID NO: 2058091 - RNA, 14 nt, Homo sapiens
acagguuacucagg

SEQ ID NO: 2058092 - RNA, 14 nt, Homo sapiens
caggucucacugcu

SEQ ID NO: 2058093 - RNA, 18 nt, Homo sapiens
gaauaggcauuaaaugca

SEQ ID NO: 2058094 - RNA, 21 nt, Homo sapiens
ugaggcacaagaaucacuuga

SEQ ID NO: 2058095 - RNA, 22 nt, Homo sapiens
aaaaaggccuuugggauuugcc

SEQ ID NO: 2058096 - RNA, 17 nt, Homo sapiens
uacuguagugauucaaa

SEQ ID NO: 2058097 - RNA, 23 nt, Homo sapiens
ugcuuccgguagggaggcagccu

SEQ ID NO: 2058098 - RNA, 16 nt, Homo sapiens
aacuuauuuauaugaa

SEQ ID NO: 2058099 - RNA, 14 nt, Homo sapiens
ccuccgaccucucu

SEQ ID NO: 2058100 - RNA, 14 nt, Homo sapiens
cucuggaugccuga

SEQ ID NO: 2058101 - RNA, 13 nt, Homo sapiens
acucucugagaug

SEQ ID NO: 2058102 - RNA, 16 nt, Homo sapiens
cacccuuaacccaagg

SEQ ID NO: 2058103 - RNA, 15 nt, Homo sapiens
caguguguggcuuuc

SEQ ID NO: 2058104 - RNA, 14 nt, Homo sapiens
uaaggaaaaaagca

SEQ ID NO: 2058105 - RNA, 13 nt, Homo sapiens
ccagccuggaucu

SEQ ID NO: 2058106 - RNA, 19 nt, Homo sapiens
ccaaguccaccccaauuaa

SEQ ID NO: 2058107 - RNA, 23 nt, Homo sapiens
uagguuugucaacacaaagacau

SEQ ID NO: 2058108 - RNA, 19 nt, Homo sapiens
auguggagaagagugcccu

SEQ ID NO: 2058109 - RNA, 14 nt, Homo sapiens
cucuauacuacccu

SEQ ID NO: 2058110 - RNA, 18 nt, Homo sapiens
ugaguaauauuacauuuc

SEQ ID NO: 2058111 - RNA, 12 nt, Homo sapiens
uauuucagaaau

SEQ ID NO: 2058112 - RNA, 18 nt, Homo sapiens
cugguggagggugcccag

SEQ ID NO: 2058113 - RNA, 20 nt, Homo sapiens
aaagagaucacccacuccua

SEQ ID NO: 2058114 - RNA, 21 nt, Homo sapiens
caauucaguacugauuauucu

SEQ ID NO: 2058115 - RNA, 16 nt, Homo sapiens
gccugccacuguguga

SEQ ID NO: 2058116 - RNA, 22 nt, Homo sapiens
acacauaagccaaaacugagca

SEQ ID NO: 2058117 - RNA, 19 nt, Homo sapiens
uccauucuggaaacaccug

SEQ ID NO: 2058118 - RNA, 20 nt, Homo sapiens
aaauauguuaagggcuuuaa

SEQ ID NO: 2058119 - RNA, 14 nt, Homo sapiens
caagcaccacucug

SEQ ID NO: 2058120 - RNA, 16 nt, Homo sapiens
ugauauacuuacucau

SEQ ID NO: 2058121 - RNA, 19 nt, Homo sapiens
ucuacuuccccuucuugcc

SEQ ID NO: 2058122 - RNA, 14 nt, Homo sapiens
uuuuagugugugca

SEQ ID NO: 2058123 - RNA, 17 nt, Homo sapiens
gcacugugagcaccuga

SEQ ID NO: 2058124 - RNA, 14 nt, Homo sapiens
gacagugccuggga

SEQ ID NO: 2058125 - RNA, 16 nt, Homo sapiens
gcucaggaccaggcaa

SEQ ID NO: 2058126 - RNA, 16 nt, Homo sapiens
acuuccccuucuugcc

SEQ ID NO: 2058127 - RNA, 16 nt, Homo sapiens
cguaucaccugagguu

SEQ ID NO: 2058128 - RNA, 16 nt, Homo sapiens
gcuggagucucagagc

SEQ ID NO: 2058129 - RNA, 17 nt, Homo sapiens
agacaccuugacagggc

SEQ ID NO: 2058130 - RNA, 20 nt, Homo sapiens
auagauccuaagccauaaaa

SEQ ID NO: 2058131 - RNA, 13 nt, Homo sapiens
uugcuaaacacug

SEQ ID NO: 2058132 - RNA, 16 nt, Homo sapiens
aguaaaaaauguaagu

SEQ ID NO: 2058133 - RNA, 16 nt, Homo sapiens
agugccacucauuccu

SEQ ID NO: 2058134 - RNA, 23 nt, Homo sapiens
uuuaauuuuuaaaagacuuugau

SEQ ID NO: 2058135 - RNA, 17 nt, Homo sapiens
cccaauauuuaccagac

SEQ ID NO: 2058136 - RNA, 19 nt, Homo sapiens
acucagugggacauagcca

SEQ ID NO: 2058137 - RNA, 16 nt, Homo sapiens
uaguuggugaaaccca

SEQ ID NO: 2058138 - RNA, 21 nt, Homo sapiens
ggcacagccagccaaccuaag

SEQ ID NO: 2058139 - RNA, 20 nt, Homo sapiens
uagauuuggaggcuaccuca

SEQ ID NO: 2058140 - RNA, 18 nt, Homo sapiens
agauacugucucuuucau

SEQ ID NO: 2058141 - RNA, 20 nt, Homo sapiens
cuuucagcucagcuaaugaa

SEQ ID NO: 2058142 - RNA, 21 nt, Homo sapiens
gaugggcccuaugucucagga

SEQ ID NO: 2058143 - RNA, 21 nt, Homo sapiens
caucagccuucaagaaucaga

SEQ ID NO: 2058144 - RNA, 23 nt, Homo sapiens
agggccccaauguauguguggcu

SEQ ID NO: 2058145 - RNA, 24 nt, Homo sapiens
ugagguuaaggggaucuaaaagga

SEQ ID NO: 2058146 - RNA, 14 nt, Homo sapiens
aaaagccucuuucu

SEQ ID NO: 2058147 - RNA, 14 nt, Homo sapiens
uggagauuaaucua

SEQ ID NO: 2058148 - RNA, 15 nt, Homo sapiens
uagaguucagacuuu

SEQ ID NO: 2058149 - RNA, 23 nt, Homo sapiens
acucgccuucaucucccaaagug

SEQ ID NO: 2058150 - RNA, 16 nt, Homo sapiens
uucuauguccauucuc

SEQ ID NO: 2058151 - RNA, 13 nt, Homo sapiens
gaaaggugccaug

SEQ ID NO: 2058152 - RNA, 21 nt, Homo sapiens
uuuuuguaugaaaacauggaa

SEQ ID NO: 2058153 - RNA, 13 nt, Homo sapiens
gacgcagccugag

SEQ ID NO: 2058154 - RNA, 21 nt, Homo sapiens
acggucacaccucacugucau

SEQ ID NO: 2058155 - RNA, 15 nt, Homo sapiens
ucuagcugugggggu

SEQ ID NO: 2058156 - RNA, 23 nt, Homo sapiens
uggcaguuguuaaguccuuggcu

SEQ ID NO: 2058157 - RNA, 21 nt, Homo sapiens
accuaugucagacacuacaug

SEQ ID NO: 2058158 - RNA, 17 nt, Homo sapiens
gugaaccuuaguaccua

SEQ ID NO: 2058159 - RNA, 19 nt, Homo sapiens
uccucaauaaauauuuauu

SEQ ID NO: 2058160 - RNA, 23 nt, Homo sapiens
cauucuuuucacuuccucuccac

SEQ ID NO: 2058161 - RNA, 18 nt, Homo sapiens
ugcugaccaaaugccugg

SEQ ID NO: 2058162 - RNA, 21 nt, Homo sapiens
guuaaguauugugcacuguau

SEQ ID NO: 2058163 - RNA, 13 nt, Homo sapiens
uuagaaagcuuaa

SEQ ID NO: 2058164 - RNA, 21 nt, Homo sapiens
aacacaauuaaaucucuccuu

SEQ ID NO: 2058165 - RNA, 14 nt, Homo sapiens
acuaggagcacugu

SEQ ID NO: 2058166 - RNA, 14 nt, Homo sapiens
agucaccgggauga

SEQ ID NO: 2058167 - RNA, 21 nt, Homo sapiens
uccucagcagccucacugcau

SEQ ID NO: 2058168 - RNA, 19 nt, Homo sapiens
ccuuuguuggcuucuuugc

SEQ ID NO: 2058169 - RNA, 20 nt, Homo sapiens
gcuucuugcuuguaaaaaua

SEQ ID NO: 2058170 - RNA, 18 nt, Homo sapiens
gaacccagaaacaacaca

SEQ ID NO: 2058171 - RNA, 20 nt, Homo sapiens
acauggugaaaccccgucuc

SEQ ID NO: 2058172 - RNA, 21 nt, Homo sapiens
aguguggcugaggccacccag

SEQ ID NO: 2058173 - RNA, 12 nt, Homo sapiens
gacucaaugcac

SEQ ID NO: 2058174 - RNA, 18 nt, Homo sapiens
acaaaauauccaagccca

SEQ ID NO: 2058175 - RNA, 12 nt, Homo sapiens
gguucaagugac

SEQ ID NO: 2058176 - RNA, 13 nt, Homo sapiens
ucccaagagccau

SEQ ID NO: 2058177 - RNA, 11 nt, Homo sapiens
cugguccuguu

SEQ ID NO: 2058178 - RNA, 23 nt, Homo sapiens
acaaaaaaaguuuguuacuuuga

SEQ ID NO: 2058179 - RNA, 17 nt, Homo sapiens
uccuuggcuugccauuu

SEQ ID NO: 2058180 - RNA, 20 nt, Homo sapiens
gacacuuaauacuaccuuga

SEQ ID NO: 2058181 - RNA, 18 nt, Homo sapiens
ugaaucaguuuuggaauc

SEQ ID NO: 2058182 - RNA, 18 nt, Homo sapiens
uuucaauuugagauucua

SEQ ID NO: 2058183 - RNA, 13 nt, Homo sapiens
auuguguacauag

SEQ ID NO: 2058184 - RNA, 14 nt, Homo sapiens
acccguaucugccc

SEQ ID NO: 2058185 - RNA, 22 nt, Homo sapiens
uguaaaucauucuacuuuugca

SEQ ID NO: 2058186 - RNA, 23 nt, Homo sapiens
agccaagcuuguuaucagcuuuc

SEQ ID NO: 2058187 - RNA, 20 nt, Homo sapiens
agacacaacuauuuuuccaa

SEQ ID NO: 2058188 - RNA, 21 nt, Homo sapiens
gcaggcccuuugaagccucag

SEQ ID NO: 2058189 - RNA, 19 nt, Homo sapiens
acugauucucuacaugcuc

SEQ ID NO: 2058190 - RNA, 21 nt, Homo sapiens
acagaagcuuuuuguuugcau

SEQ ID NO: 2058191 - RNA, 16 nt, Homo sapiens
cuggucagaugauaua

SEQ ID NO: 2058192 - RNA, 23 nt, Homo sapiens
acacuuggaacaguguuuacuuu

SEQ ID NO: 2058193 - RNA, 17 nt, Homo sapiens
uuaggccucucagaguc

SEQ ID NO: 2058194 - RNA, 20 nt, Homo sapiens
ugaaaugugcucaggcccug

SEQ ID NO: 2058195 - RNA, 21 nt, Homo sapiens
accguucagugucccaggcag

SEQ ID NO: 2058196 - RNA, 13 nt, Homo sapiens
ucuaggcuaagca

SEQ ID NO: 2058197 - RNA, 18 nt, Homo sapiens
auccagugagcacuagaa

SEQ ID NO: 2058198 - RNA, 16 nt, Homo sapiens
gaaacuguucccaccu

SEQ ID NO: 2058199 - RNA, 17 nt, Homo sapiens
gggcagggaucuugcaa

SEQ ID NO: 2058200 - RNA, 18 nt, Homo sapiens
uuggcugagccauugagu

SEQ ID NO: 2058201 - RNA, 15 nt, Homo sapiens
aggaucaggcugcug

SEQ ID NO: 2058202 - RNA, 16 nt, Homo sapiens
caaaaagagcagcaca

SEQ ID NO: 2058203 - RNA, 15 nt, Homo sapiens
cuugcaaagccuuua

SEQ ID NO: 2058204 - RNA, 11 nt, Homo sapiens
ggaugucauag

SEQ ID NO: 2058205 - RNA, 14 nt, Homo sapiens
caaacuacauguaa

SEQ ID NO: 2058206 - RNA, 16 nt, Homo sapiens
aaggcuccuccuugcc

SEQ ID NO: 2058207 - RNA, 16 nt, Homo sapiens
cagugcugugucauuc

SEQ ID NO: 2058208 - RNA, 13 nt, Homo sapiens
uuuucugguucua

SEQ ID NO: 2058209 - RNA, 14 nt, Homo sapiens
gagcuggaucucuc

SEQ ID NO: 2058210 - RNA, 21 nt, Homo sapiens
gcagagcgauggagcagucuc

SEQ ID NO: 2058211 - RNA, 16 nt, Homo sapiens
cauuuuguuucacucu

SEQ ID NO: 2058212 - RNA, 19 nt, Homo sapiens
aaguguuuuacaaugauuu

SEQ ID NO: 2058213 - RNA, 17 nt, Homo sapiens
aguguuuaugacaaauu

SEQ ID NO: 2058214 - RNA, 21 nt, Homo sapiens
gcguccaccaggccucacugg

SEQ ID NO: 2058215 - RNA, 15 nt, Homo sapiens
cuguggguaaauuaa

SEQ ID NO: 2058216 - RNA, 14 nt, Homo sapiens
uccaggacuccacu

SEQ ID NO: 2058217 - RNA, 18 nt, Homo sapiens
uucccagaaggcauauca

SEQ ID NO: 2058218 - RNA, 21 nt, Homo sapiens
uaagaauucuuaacauagcca

SEQ ID NO: 2058219 - RNA, 21 nt, Homo sapiens
ugcaucuccccucagauucca

SEQ ID NO: 2058220 - RNA, 17 nt, Homo sapiens
agcacuagaucucccuu

SEQ ID NO: 2058221 - RNA, 22 nt, Homo sapiens
ggaaacaaauuacguacuagag

SEQ ID NO: 2058222 - RNA, 16 nt, Homo sapiens
uugccucucucaggag

SEQ ID NO: 2058223 - RNA, 19 nt, Homo sapiens
aagaugucuccucaagccu

SEQ ID NO: 2058224 - RNA, 11 nt, Homo sapiens
ucugcacggga

SEQ ID NO: 2058225 - RNA, 15 nt, Homo sapiens
agacaguuuuccaaa

SEQ ID NO: 2058226 - RNA, 15 nt, Homo sapiens
ugcuuguuauauuaa

SEQ ID NO: 2058227 - RNA, 16 nt, Homo sapiens
guuggccuuacuguug

SEQ ID NO: 2058228 - RNA, 16 nt, Homo sapiens
ggaaccuguccaguuu

SEQ ID NO: 2058229 - RNA, 14 nt, Homo sapiens
auguauugauacug

SEQ ID NO: 2058230 - RNA, 16 nt, Homo sapiens
cauuggaaacacugcc

SEQ ID NO: 2058231 - RNA, 14 nt, Homo sapiens
ucacccacaucuaa

SEQ ID NO: 2058232 - RNA, 13 nt, Homo sapiens
caggaagauguau

SEQ ID NO: 2058233 - RNA, 15 nt, Homo sapiens
cucaucucuccucca

SEQ ID NO: 2058234 - RNA, 17 nt, Homo sapiens
ucccacauccaacucca

SEQ ID NO: 2058235 - RNA, 17 nt, Homo sapiens
cugcagcuuggcauucu

SEQ ID NO: 2058236 - RNA, 19 nt, Homo sapiens
uggguaccugcaagcagaa

SEQ ID NO: 2058237 - RNA, 11 nt, Homo sapiens
cuucuugugaa

SEQ ID NO: 2058238 - RNA, 15 nt, Homo sapiens
uggcucagugccuuc

SEQ ID NO: 2058239 - RNA, 16 nt, Homo sapiens
guauggagcucagaga

SEQ ID NO: 2058240 - RNA, 20 nt, Homo sapiens
caaaucugugcucuuucauu

SEQ ID NO: 2058241 - RNA, 16 nt, Homo sapiens
ugacuuacagugccaa

SEQ ID NO: 2058242 - RNA, 22 nt, Homo sapiens
aacuugccacaucccagucaca

SEQ ID NO: 2058243 - RNA, 17 nt, Homo sapiens
ggguacagcgcggagga

SEQ ID NO: 2058244 - RNA, 14 nt, Homo sapiens
gugggcugccccau

SEQ ID NO: 2058245 - RNA, 18 nt, Homo sapiens
gaaccgaggggcucagga

SEQ ID NO: 2058246 - RNA, 13 nt, Homo sapiens
ccuuggccgugag

SEQ ID NO: 2058247 - RNA, 17 nt, Homo sapiens
uacccaggaugauuucc

SEQ ID NO: 2058248 - RNA, 19 nt, Homo sapiens
cagugaccagugccuguga

SEQ ID NO: 2058249 - RNA, 18 nt, Homo sapiens
agcuucugggaccauaag

SEQ ID NO: 2058250 - RNA, 23 nt, Homo sapiens
auuuucaaugauguuagccugau

SEQ ID NO: 2058251 - RNA, 13 nt, Homo sapiens
cucaaaacuguau

SEQ ID NO: 2058252 - RNA, 16 nt, Homo sapiens
aaaacccucugaacuc

SEQ ID NO: 2058253 - RNA, 13 nt, Homo sapiens
aggccccaaagga

SEQ ID NO: 2058254 - RNA, 20 nt, Homo sapiens
cuuucucucuuauaaauucu

SEQ ID NO: 2058255 - RNA, 15 nt, Homo sapiens
uuugauauuugauaa

SEQ ID NO: 2058256 - RNA, 22 nt, Homo sapiens
uccuggcccugaaggugccacu

SEQ ID NO: 2058257 - RNA, 19 nt, Homo sapiens
acaugccuguuaauauuca

SEQ ID NO: 2058258 - RNA, 22 nt, Homo sapiens
uguuaguuuuucuuacuugcau

SEQ ID NO: 2058259 - RNA, 14 nt, Homo sapiens
ugguguaccugcug

SEQ ID NO: 2058260 - RNA, 22 nt, Homo sapiens
gucagccccucaucagccuuuu

SEQ ID NO: 2058261 - RNA, 22 nt, Homo sapiens
cuggccacuggguauacugcug

SEQ ID NO: 2058262 - RNA, 15 nt, Homo sapiens
uuucauuuacugugg

SEQ ID NO: 2058263 - RNA, 13 nt, Homo sapiens
aauacuguuucca

SEQ ID NO: 2058264 - RNA, 22 nt, Homo sapiens
uuuuaaagacccaacuugccaa

SEQ ID NO: 2058265 - RNA, 19 nt, Homo sapiens
ggagugagacugacugcaa

SEQ ID NO: 2058266 - RNA, 20 nt, Homo sapiens
uacuaccccagaacgcaugc

SEQ ID NO: 2058267 - RNA, 15 nt, Homo sapiens
gaauucacgccucuc

SEQ ID NO: 2058268 - RNA, 18 nt, Homo sapiens
acuugcccugccacuuug

SEQ ID NO: 2058269 - RNA, 23 nt, Homo sapiens
caagcuggcacugccacugugga

SEQ ID NO: 2058270 - RNA, 19 nt, Homo sapiens
uuuguuacaaaaagacaaa

SEQ ID NO: 2058271 - RNA, 19 nt, Homo sapiens
cagaaauaugaaaagucau

SEQ ID NO: 2058272 - RNA, 13 nt, Homo sapiens
cagcaagagccac

SEQ ID NO: 2058273 - RNA, 21 nt, Homo sapiens
gcgggcgcucgcucaggugau

SEQ ID NO: 2058274 - RNA, 21 nt, Homo sapiens
auggcagguccucuguugcaa

SEQ ID NO: 2058275 - RNA, 16 nt, Homo sapiens
aacugagcuacuagag

SEQ ID NO: 2058276 - RNA, 19 nt, Homo sapiens
ggacugaagggguucucac

SEQ ID NO: 2058277 - RNA, 16 nt, Homo sapiens
ucgaguaaacuugaaa

SEQ ID NO: 2058278 - RNA, 17 nt, Homo sapiens
aguuacucucaggcaug

SEQ ID NO: 2058279 - RNA, 14 nt, Homo sapiens
cccuauccacaggg

SEQ ID NO: 2058280 - RNA, 20 nt, Homo sapiens
cgguuugaaaauaugccugc

SEQ ID NO: 2058281 - RNA, 21 nt, Homo sapiens
agaaaacucccaauacaaaga

SEQ ID NO: 2058282 - RNA, 15 nt, Homo sapiens
uucuaguuagucauc

SEQ ID NO: 2058283 - RNA, 16 nt, Homo sapiens
uacagacauuaaauaa

SEQ ID NO: 2058284 - RNA, 16 nt, Homo sapiens
auauaucaaacugaaa

SEQ ID NO: 2058285 - RNA, 23 nt, Homo sapiens
agcugccgcccccggacucugau

SEQ ID NO: 2058286 - RNA, 15 nt, Homo sapiens
auucuugcuugagga

SEQ ID NO: 2058287 - RNA, 15 nt, Homo sapiens
uuucuucuaccagac

SEQ ID NO: 2058288 - RNA, 18 nt, Homo sapiens
cacgugugaaguguagug

SEQ ID NO: 2058289 - RNA, 17 nt, Homo sapiens
guccucuuaagacacua

SEQ ID NO: 2058290 - RNA, 15 nt, Homo sapiens
ugccaaacuauauca

SEQ ID NO: 2058291 - RNA, 17 nt, Homo sapiens
aaaugggcagugaaggc

SEQ ID NO: 2058292 - RNA, 11 nt, Homo sapiens
cucugccauuc

SEQ ID NO: 2058293 - RNA, 17 nt, Homo sapiens
guuacucccuacacuga

SEQ ID NO: 2058294 - RNA, 15 nt, Homo sapiens
cuucuccaucuccug

SEQ ID NO: 2058295 - RNA, 18 nt, Homo sapiens
auucaggggcugacacuu

SEQ ID NO: 2058296 - RNA, 14 nt, Homo sapiens
cuuugucucaaaau

SEQ ID NO: 2058297 - RNA, 13 nt, Homo sapiens
cucaccagaucuc

SEQ ID NO: 2058298 - RNA, 15 nt, Homo sapiens
acuuuuaaauuauac

SEQ ID NO: 2058299 - RNA, 13 nt, Homo sapiens
auuccgucuuaaa

SEQ ID NO: 2058300 - RNA, 21 nt, Homo sapiens
ucccaaugcacauccauuccc

SEQ ID NO: 2058301 - RNA, 20 nt, Homo sapiens
uccuuacgcuuugucacaca

SEQ ID NO: 2058302 - RNA, 13 nt, Homo sapiens
aagacuugacagu

SEQ ID NO: 2058303 - RNA, 14 nt, Homo sapiens
uagaaaucucaucu

SEQ ID NO: 2058304 - RNA, 22 nt, Homo sapiens
cacuaacauuauauugcaauga

SEQ ID NO: 2058305 - RNA, 13 nt, Homo sapiens
gcacauuucugga

SEQ ID NO: 2058306 - RNA, 19 nt, Homo sapiens
uguaaacauaauucuugua

SEQ ID NO: 2058307 - RNA, 19 nt, Homo sapiens
auuuccuaguucauuugac

SEQ ID NO: 2058308 - RNA, 13 nt, Homo sapiens
agcagacauccac

SEQ ID NO: 2058309 - RNA, 13 nt, Homo sapiens
ggcacucauggag

SEQ ID NO: 2058310 - RNA, 18 nt, Homo sapiens
ugcaaacugaaagaucug

SEQ ID NO: 2058311 - RNA, 19 nt, Homo sapiens
ugaccugaggaagcgugaa

SEQ ID NO: 2058312 - RNA, 20 nt, Homo sapiens
cagauggucacacagagaua

SEQ ID NO: 2058313 - RNA, 15 nt, Homo sapiens
cuaaauuauagugua

SEQ ID NO: 2058314 - RNA, 22 nt, Homo sapiens
augugugagucacuucuacgca

SEQ ID NO: 2058315 - RNA, 13 nt, Homo sapiens
uugccucaccugc

SEQ ID NO: 2058316 - RNA, 18 nt, Homo sapiens
augacagcaaacagauca

SEQ ID NO: 2058317 - RNA, 14 nt, Homo sapiens
acagcuucuaguga

SEQ ID NO: 2058318 - RNA, 20 nt, Homo sapiens
ccauuaugcaaguguuccua

SEQ ID NO: 2058319 - RNA, 19 nt, Homo sapiens
uggaagcauuuguuucuac

SEQ ID NO: 2058320 - RNA, 15 nt, Homo sapiens
cugauaccauucuau

SEQ ID NO: 2058321 - RNA, 19 nt, Homo sapiens
acauauagcagaccaaucu

SEQ ID NO: 2058322 - RNA, 22 nt, Homo sapiens
cuuccagagccuaagaaaauca

SEQ ID NO: 2058323 - RNA, 13 nt, Homo sapiens
cccuuuuacuuuu

SEQ ID NO: 2058324 - RNA, 15 nt, Homo sapiens
agucugaacaauaua

SEQ ID NO: 2058325 - RNA, 12 nt, Homo sapiens
aaaacugucauc

SEQ ID NO: 2058326 - RNA, 23 nt, Homo sapiens
aggcaggggugggagagccagcu

SEQ ID NO: 2058327 - RNA, 18 nt, Homo sapiens
gcuuuugagaaccaagua

SEQ ID NO: 2058328 - RNA, 15 nt, Homo sapiens
uaccugaacaggaau

SEQ ID NO: 2058329 - RNA, 15 nt, Homo sapiens
uucguguacugcaaa

SEQ ID NO: 2058330 - RNA, 22 nt, Homo sapiens
ucuggagaaggugggcacugga

SEQ ID NO: 2058331 - RNA, 22 nt, Homo sapiens
cucgguucaaaaccuugcacag

SEQ ID NO: 2058332 - RNA, 21 nt, Homo sapiens
gccuggggcgagcacugugag

SEQ ID NO: 2058333 - RNA, 14 nt, Homo sapiens
cauccauuaccucc

SEQ ID NO: 2058334 - RNA, 21 nt, Homo sapiens
aucuuuguuuuuuguuuucau

SEQ ID NO: 2058335 - RNA, 19 nt, Homo sapiens
augcucuuuugcacaagga

SEQ ID NO: 2058336 - RNA, 17 nt, Homo sapiens
cuuuacaaacugaagau

SEQ ID NO: 2058337 - RNA, 14 nt, Homo sapiens
cuaaaugaccucag

SEQ ID NO: 2058338 - RNA, 21 nt, Homo sapiens
aaacugcugucccaaacaugc

SEQ ID NO: 2058339 - RNA, 19 nt, Homo sapiens
cuccuuagcaggcuaugaa

SEQ ID NO: 2058340 - RNA, 21 nt, Homo sapiens
ucuacaaucaguugacuuuaa

SEQ ID NO: 2058341 - RNA, 23 nt, Homo sapiens
acuugccuaaaauauauuccuga

SEQ ID NO: 2058342 - RNA, 14 nt, Homo sapiens
aggacuucugugca

SEQ ID NO: 2058343 - RNA, 20 nt, Homo sapiens
uaaaacugguuuuagacaaa

SEQ ID NO: 2058344 - RNA, 22 nt, Homo sapiens
ugaaugguccaggguugaucac

SEQ ID NO: 2058345 - RNA, 21 nt, Homo sapiens
uacugcacuuucccccuuccc

SEQ ID NO: 2058346 - RNA, 17 nt, Homo sapiens
ucuuuaccuaauggucu

SEQ ID NO: 2058347 - RNA, 17 nt, Homo sapiens
aaucgaccucacuguca

SEQ ID NO: 2058348 - RNA, 14 nt, Homo sapiens
cuuugcacccugua

SEQ ID NO: 2058349 - RNA, 17 nt, Homo sapiens
caugcguaagacguucu

SEQ ID NO: 2058350 - RNA, 20 nt, Homo sapiens
gugaauacuugaacucuguu

SEQ ID NO: 2058351 - RNA, 15 nt, Homo sapiens
ugcugccaucuccag

SEQ ID NO: 2058352 - RNA, 17 nt, Homo sapiens
agccuaccguauuucag

SEQ ID NO: 2058353 - RNA, 15 nt, Homo sapiens
uccuuuacuaaucca

SEQ ID NO: 2058354 - RNA, 16 nt, Homo sapiens
ucaauucuagucauau

SEQ ID NO: 2058355 - RNA, 13 nt, Homo sapiens
gaaguugcugcuu

SEQ ID NO: 2058356 - RNA, 15 nt, Homo sapiens
cuuccacacagggug

SEQ ID NO: 2058357 - RNA, 20 nt, Homo sapiens
acgcagacccaguacauccu

SEQ ID NO: 2058358 - RNA, 16 nt, Homo sapiens
gcccugcuuagcucau

SEQ ID NO: 2058359 - RNA, 18 nt, Homo sapiens
cugaacauucuugcucaa

SEQ ID NO: 2058360 - RNA, 14 nt, Homo sapiens
ccgccuuugcuuuu

SEQ ID NO: 2058361 - RNA, 15 nt, Homo sapiens
acaaaugcaauuuca

SEQ ID NO: 2058362 - RNA, 13 nt, Homo sapiens
auauuuugcuaac

SEQ ID NO: 2058363 - RNA, 17 nt, Homo sapiens
gaguucugucuggacuu

SEQ ID NO: 2058364 - RNA, 23 nt, Homo sapiens
agacauagaauuaacacaugauc

SEQ ID NO: 2058365 - RNA, 22 nt, Homo sapiens
agguuucacccuuaacccaagg

SEQ ID NO: 2058366 - RNA, 23 nt, Homo sapiens
gucagauaggacaacacugcugg

SEQ ID NO: 2058367 - RNA, 21 nt, Homo sapiens
gaucuauuacucugacauaaa

SEQ ID NO: 2058368 - RNA, 16 nt, Homo sapiens
aaggcgugagucugca

SEQ ID NO: 2058369 - RNA, 20 nt, Homo sapiens
cccagacaucuggacacugg

SEQ ID NO: 2058370 - RNA, 18 nt, Homo sapiens
acaaggggucaaugucau

SEQ ID NO: 2058371 - RNA, 14 nt, Homo sapiens
uguuguuguuuuaa

SEQ ID NO: 2058372 - RNA, 22 nt, Homo sapiens
auguauaauuugaggugaaauu

SEQ ID NO: 2058373 - RNA, 21 nt, Homo sapiens
auaucugaacacauacuagaa

SEQ ID NO: 2058374 - RNA, 20 nt, Homo sapiens
cccaauuuuaaaaaauaaca

SEQ ID NO: 2058375 - RNA, 14 nt, Homo sapiens
accuaaucucugua

SEQ ID NO: 2058376 - RNA, 18 nt, Homo sapiens
gaguagagggcacugggu

SEQ ID NO: 2058377 - RNA, 19 nt, Homo sapiens
ccaggaucaugguguaaua

SEQ ID NO: 2058378 - RNA, 12 nt, Homo sapiens
aagagugaauuu

SEQ ID NO: 2058379 - RNA, 13 nt, Homo sapiens
uuuuccaugacau

SEQ ID NO: 2058380 - RNA, 14 nt, Homo sapiens
gagcucccaggugc

SEQ ID NO: 2058381 - RNA, 22 nt, Homo sapiens
ugacugugcccaagugggucca

SEQ ID NO: 2058382 - RNA, 20 nt, Homo sapiens
agaaauuauguuuucaucca

SEQ ID NO: 2058383 - RNA, 17 nt, Homo sapiens
uggcugaaccaaagaaa

SEQ ID NO: 2058384 - RNA, 21 nt, Homo sapiens
ugggcaggugguggcacugag

SEQ ID NO: 2058385 - RNA, 16 nt, Homo sapiens
acaaugaagugacacu

SEQ ID NO: 2058386 - RNA, 14 nt, Homo sapiens
gaaggauccaucuu

SEQ ID NO: 2058387 - RNA, 19 nt, Homo sapiens
cugacacaaaagaagaaau

SEQ ID NO: 2058388 - RNA, 16 nt, Homo sapiens
uucucuaaacauuuca

SEQ ID NO: 2058389 - RNA, 18 nt, Homo sapiens
aaguccgcuggcacccau

SEQ ID NO: 2058390 - RNA, 22 nt, Homo sapiens
ucucauucccuuuuccucuauu

SEQ ID NO: 2058391 - RNA, 19 nt, Homo sapiens
uucagguaaaaacuucauu

SEQ ID NO: 2058392 - RNA, 22 nt, Homo sapiens
gaaauaaaaucuaauuaauucu

SEQ ID NO: 2058393 - RNA, 20 nt, Homo sapiens
cugaaauuauauaaggcauu

SEQ ID NO: 2058394 - RNA, 13 nt, Homo sapiens
cacuaagccaugc

SEQ ID NO: 2058395 - RNA, 13 nt, Homo sapiens
cuuagcugucacc

SEQ ID NO: 2058396 - RNA, 18 nt, Homo sapiens
uaucaagagagcuuaaca

SEQ ID NO: 2058397 - RNA, 14 nt, Homo sapiens
accaaaggugcuac

SEQ ID NO: 2058398 - RNA, 20 nt, Homo sapiens
uuuguaggagacuugccaga

SEQ ID NO: 2058399 - RNA, 19 nt, Homo sapiens
aaacacuugaagugagaag

SEQ ID NO: 2058400 - RNA, 16 nt, Homo sapiens
auaugcacacaccgau

SEQ ID NO: 2058401 - RNA, 14 nt, Homo sapiens
gcucccaagcugcc

SEQ ID NO: 2058402 - RNA, 14 nt, Homo sapiens
cuucccaacuugcc

SEQ ID NO: 2058403 - RNA, 14 nt, Homo sapiens
acacaaaaacagaa

SEQ ID NO: 2058404 - RNA, 21 nt, Homo sapiens
uggcagaagggaauugcucag

SEQ ID NO: 2058405 - RNA, 12 nt, Homo sapiens
uccccugcaaug

SEQ ID NO: 2058406 - RNA, 13 nt, Homo sapiens
cugauuucaggga

SEQ ID NO: 2058407 - RNA, 17 nt, Homo sapiens
agccccuucugcucagc

SEQ ID NO: 2058408 - RNA, 20 nt, Homo sapiens
cugguagaaaaacaucugaa

SEQ ID NO: 2058409 - RNA, 16 nt, Homo sapiens
uguugccaaggcagaa

SEQ ID NO: 2058410 - RNA, 13 nt, Homo sapiens
auggugugccuuc

SEQ ID NO: 2058411 - RNA, 21 nt, Homo sapiens
ugcugugugacucaaaccaaa

SEQ ID NO: 2058412 - RNA, 23 nt, Homo sapiens
acuuaaagaaauaacgugcaugc

SEQ ID NO: 2058413 - RNA, 15 nt, Homo sapiens
uccauagcugggaaa

SEQ ID NO: 2058414 - RNA, 17 nt, Homo sapiens
aauuuuuccugcauguu

SEQ ID NO: 2058415 - RNA, 17 nt, Homo sapiens
aggggagugcucugaag

SEQ ID NO: 2058416 - RNA, 20 nt, Homo sapiens
ugacacgugauggaccaaag

SEQ ID NO: 2058417 - RNA, 16 nt, Homo sapiens
cuagaaauagauuuaa

SEQ ID NO: 2058418 - RNA, 22 nt, Homo sapiens
ugacucagcauagauuguauaa

SEQ ID NO: 2058419 - RNA, 20 nt, Homo sapiens
ccucccgggggcacugccug

SEQ ID NO: 2058420 - RNA, 21 nt, Homo sapiens
aacucccuccucacacuccag

SEQ ID NO: 2058421 - RNA, 18 nt, Homo sapiens
ccuucuucauguucaauu

SEQ ID NO: 2058422 - RNA, 17 nt, Homo sapiens
cccaggaggcuccagga

SEQ ID NO: 2058423 - RNA, 20 nt, Homo sapiens
gcccauuagagaaguauuua

SEQ ID NO: 2058424 - RNA, 14 nt, Homo sapiens
ucacucuugccaac

SEQ ID NO: 2058425 - RNA, 14 nt, Homo sapiens
uccaauuugcacuu

SEQ ID NO: 2058426 - RNA, 21 nt, Homo sapiens
auuuuuagcucuguacuccua

SEQ ID NO: 2058427 - RNA, 13 nt, Homo sapiens
ugcaagucccaug

SEQ ID NO: 2058428 - RNA, 18 nt, Homo sapiens
gaggacucaccacugccc

SEQ ID NO: 2058429 - RNA, 19 nt, Homo sapiens
acuuccccacugcucucug

SEQ ID NO: 2058430 - RNA, 17 nt, Homo sapiens
gcagcugcugugccuga

SEQ ID NO: 2058431 - RNA, 14 nt, Homo sapiens
auuccuuacuagaa

SEQ ID NO: 2058432 - RNA, 15 nt, Homo sapiens
agcaucucaggagau

SEQ ID NO: 2058433 - RNA, 15 nt, Homo sapiens
ucuccuggucccugg

SEQ ID NO: 2058434 - RNA, 15 nt, Homo sapiens
uuccuggguuuccug

SEQ ID NO: 2058435 - RNA, 15 nt, Homo sapiens
ggccacuugcucaga

SEQ ID NO: 2058436 - RNA, 18 nt, Homo sapiens
caacagcaaaagcccuaa

SEQ ID NO: 2058437 - RNA, 19 nt, Homo sapiens
gcaaugcccuaauuagggc

SEQ ID NO: 2058438 - RNA, 21 nt, Homo sapiens
ugggcaugagggguuccuccc

SEQ ID NO: 2058439 - RNA, 12 nt, Homo sapiens
ucgcuacaagaa

SEQ ID NO: 2058440 - RNA, 21 nt, Homo sapiens
cuguggaacacuaaagagcua

SEQ ID NO: 2058441 - RNA, 19 nt, Homo sapiens
ucuccuuuucuccacuguc

SEQ ID NO: 2058442 - RNA, 15 nt, Homo sapiens
auuuauuguaccaaa

SEQ ID NO: 2058443 - RNA, 12 nt, Homo sapiens
ccuauuccagga

SEQ ID NO: 2058444 - RNA, 16 nt, Homo sapiens
ugaucauuucugccau

SEQ ID NO: 2058445 - RNA, 17 nt, Homo sapiens
acaaauacuaaaugugc

SEQ ID NO: 2058446 - RNA, 22 nt, Homo sapiens
ugucgggcucauuuugcucaac

SEQ ID NO: 2058447 - RNA, 21 nt, Homo sapiens
caccucagaguauggagcuca

SEQ ID NO: 2058448 - RNA, 20 nt, Homo sapiens
ugucaacaaaaagacaugga

SEQ ID NO: 2058449 - RNA, 15 nt, Homo sapiens
uuguauguaucuauu

SEQ ID NO: 2058450 - RNA, 16 nt, Homo sapiens
ucauuaagaagcuggg

SEQ ID NO: 2058451 - RNA, 13 nt, Homo sapiens
gcccuaggcugcu

SEQ ID NO: 2058452 - RNA, 12 nt, Homo sapiens
ugccuaccccag

SEQ ID NO: 2058453 - RNA, 19 nt, Homo sapiens
gugccugcuuaccugccag

SEQ ID NO: 2058454 - RNA, 16 nt, Homo sapiens
aaggcauuuucaucuu

SEQ ID NO: 2058455 - RNA, 17 nt, Homo sapiens
ucccagagagugaauaa

SEQ ID NO: 2058456 - RNA, 23 nt, Homo sapiens
cuuaccuggaggcucaccuugca

SEQ ID NO: 2058457 - RNA, 17 nt, Homo sapiens
ggcuuuaagcgaggcag

SEQ ID NO: 2058458 - RNA, 13 nt, Homo sapiens
gggcccugaggaa

SEQ ID NO: 2058459 - RNA, 21 nt, Homo sapiens
ccucaaaacuguaaaaaucau

SEQ ID NO: 2058460 - RNA, 14 nt, Homo sapiens
caccugaaccacug

SEQ ID NO: 2058461 - RNA, 16 nt, Homo sapiens
ucuaccuuuacuacau

SEQ ID NO: 2058462 - RNA, 16 nt, Homo sapiens
agaaaaaauucccuca

SEQ ID NO: 2058463 - RNA, 18 nt, Homo sapiens
agugaucuugagaaccuu

SEQ ID NO: 2058464 - RNA, 23 nt, Homo sapiens
uggugcucaucuucucuugucau

SEQ ID NO: 2058465 - RNA, 17 nt, Homo sapiens
ccacuuucguaucauaa

SEQ ID NO: 2058466 - RNA, 23 nt, Homo sapiens
ugcugugucuccucucagaguga

SEQ ID NO: 2058467 - RNA, 15 nt, Homo sapiens
auugaauacucugaa

SEQ ID NO: 2058468 - RNA, 16 nt, Homo sapiens
gcacagcagcaauugu

SEQ ID NO: 2058469 - RNA, 23 nt, Homo sapiens
auaauugcuuuuucacagucacu

SEQ ID NO: 2058470 - RNA, 21 nt, Homo sapiens
ugaaggaccugggcucuuggc

SEQ ID NO: 2058471 - RNA, 23 nt, Homo sapiens
aacucuguuuugcuaugcuauaa

SEQ ID NO: 2058472 - RNA, 18 nt, Homo sapiens
aagauccgagucuaccca

SEQ ID NO: 2058473 - RNA, 16 nt, Homo sapiens
cccuagaaauauaucc

SEQ ID NO: 2058474 - RNA, 23 nt, Homo sapiens
ggcugucucagacgacuagccca

SEQ ID NO: 2058475 - RNA, 14 nt, Homo sapiens
aggauuugcacaga

SEQ ID NO: 2058476 - RNA, 11 nt, Homo sapiens
acuuuuugccc

SEQ ID NO: 2058477 - RNA, 20 nt, Homo sapiens
uccuucacgaggaaucuggg

SEQ ID NO: 2058478 - RNA, 14 nt, Homo sapiens
uauaccuagaauaa

SEQ ID NO: 2058479 - RNA, 17 nt, Homo sapiens
aaaaacugcagucauca

SEQ ID NO: 2058480 - RNA, 12 nt, Homo sapiens
uugacugugcau

SEQ ID NO: 2058481 - RNA, 16 nt, Homo sapiens
cugggaagggacaucu

SEQ ID NO: 2058482 - RNA, 13 nt, Homo sapiens
gcugauguccuca

SEQ ID NO: 2058483 - RNA, 14 nt, Homo sapiens
ugucucuuugccaa

SEQ ID NO: 2058484 - RNA, 15 nt, Homo sapiens
ccagagccauggacu

SEQ ID NO: 2058485 - RNA, 15 nt, Homo sapiens
aagagccacuuucaa

SEQ ID NO: 2058486 - RNA, 14 nt, Homo sapiens
auugugauugugga

SEQ ID NO: 2058487 - RNA, 21 nt, Homo sapiens
aucuacuauauaugacuggaa

SEQ ID NO: 2058488 - RNA, 21 nt, Homo sapiens
uguuccaguacuauggagugc

SEQ ID NO: 2058489 - RNA, 18 nt, Homo sapiens
caggaagcacagguccaa

SEQ ID NO: 2058490 - RNA, 17 nt, Homo sapiens
cagaguggagcccucag

SEQ ID NO: 2058491 - RNA, 24 nt, Homo sapiens
gagcuucugggaagacaacuagga

SEQ ID NO: 2058492 - RNA, 13 nt, Homo sapiens
uucccuccccaga

SEQ ID NO: 2058493 - RNA, 16 nt, Homo sapiens
cccaccgguccagcug

SEQ ID NO: 2058494 - RNA, 23 nt, Homo sapiens
aauaaauucagaauuaacuccuu

SEQ ID NO: 2058495 - RNA, 14 nt, Homo sapiens
uguucuuggcucac

SEQ ID NO: 2058496 - RNA, 19 nt, Homo sapiens
ggagggcugguggccacga

SEQ ID NO: 2058497 - RNA, 20 nt, Homo sapiens
caggggggccuccuccuagg

SEQ ID NO: 2058498 - RNA, 21 nt, Homo sapiens
cucacucuugaaguccaggac

SEQ ID NO: 2058499 - RNA, 16 nt, Homo sapiens
augcccacauacccac

SEQ ID NO: 2058500 - RNA, 21 nt, Homo sapiens
gcgccaagcaaccugggucca

SEQ ID NO: 2058501 - RNA, 17 nt, Homo sapiens
uguccuacccacccucc

SEQ ID NO: 2058502 - RNA, 21 nt, Homo sapiens
acauugaguagacacauuuaa

SEQ ID NO: 2058503 - RNA, 15 nt, Homo sapiens
uuaucugucuugacu

SEQ ID NO: 2058504 - RNA, 19 nt, Homo sapiens
gccacacggcucucaccag

SEQ ID NO: 2058505 - RNA, 19 nt, Homo sapiens
caguccuauuuuucaaugg

SEQ ID NO: 2058506 - RNA, 16 nt, Homo sapiens
aaauaguugcauagca

SEQ ID NO: 2058507 - RNA, 18 nt, Homo sapiens
caucuaggagcaagguga

SEQ ID NO: 2058508 - RNA, 12 nt, Homo sapiens
aaaauuuugcuu

SEQ ID NO: 2058509 - RNA, 22 nt, Homo sapiens
uuccaguuccucuuuugugcug

SEQ ID NO: 2058510 - RNA, 17 nt, Homo sapiens
gcuccagugcaggagac

SEQ ID NO: 2058511 - RNA, 18 nt, Homo sapiens
gaggauccccugagguca

SEQ ID NO: 2058512 - RNA, 18 nt, Homo sapiens
auacaauuuccauauagu

SEQ ID NO: 2058513 - RNA, 17 nt, Homo sapiens
aagucuugcucugccac

SEQ ID NO: 2058514 - RNA, 20 nt, Homo sapiens
aagaucaagcuccaucuuau

SEQ ID NO: 2058515 - RNA, 16 nt, Homo sapiens
uaaagggucuuaugaa

SEQ ID NO: 2058516 - RNA, 20 nt, Homo sapiens
acacugcacgaauggaagag

SEQ ID NO: 2058517 - RNA, 15 nt, Homo sapiens
ggccuggauccaucc

SEQ ID NO: 2058518 - RNA, 15 nt, Homo sapiens
gaggaacgugguuca

SEQ ID NO: 2058519 - RNA, 19 nt, Homo sapiens
cguaucuccuugauuacau

SEQ ID NO: 2058520 - RNA, 17 nt, Homo sapiens
gauaaaugacaagcaaa

SEQ ID NO: 2058521 - RNA, 23 nt, Homo sapiens
guuccagugaugaaaacauucaa

SEQ ID NO: 2058522 - RNA, 16 nt, Homo sapiens
auuguuaaaauaacua

SEQ ID NO: 2058523 - RNA, 16 nt, Homo sapiens
aagauuucauggacac

SEQ ID NO: 2058524 - RNA, 21 nt, Homo sapiens
auuuaaaaauagaaacauauc

SEQ ID NO: 2058525 - RNA, 12 nt, Homo sapiens
ucugccugugga

SEQ ID NO: 2058526 - RNA, 21 nt, Homo sapiens
cacaugauaccucugaucaag

SEQ ID NO: 2058527 - RNA, 17 nt, Homo sapiens
ugguguuaaucauuuca

SEQ ID NO: 2058528 - RNA, 17 nt, Homo sapiens
uggggcauauucaucua

SEQ ID NO: 2058529 - RNA, 19 nt, Homo sapiens
aggccuugcgcuguugcgu

SEQ ID NO: 2058530 - RNA, 22 nt, Homo sapiens
cagggggagcucccaagcugcc

SEQ ID NO: 2058531 - RNA, 18 nt, Homo sapiens
guguucucuauuuugccu

SEQ ID NO: 2058532 - RNA, 16 nt, Homo sapiens
ucuccccuccaaguga

SEQ ID NO: 2058533 - RNA, 17 nt, Homo sapiens
ugaacuacaguaaaugu

SEQ ID NO: 2058534 - RNA, 14 nt, Homo sapiens
auucagugguccug

SEQ ID NO: 2058535 - RNA, 22 nt, Homo sapiens
uggacacccccagcugacuguu

SEQ ID NO: 2058536 - RNA, 19 nt, Homo sapiens
uacacaguaagucauuuaa

SEQ ID NO: 2058537 - RNA, 24 nt, Homo sapiens
ccauacucuaacaucuagcuggcu

SEQ ID NO: 2058538 - RNA, 15 nt, Homo sapiens
cugaauaacuugaag

SEQ ID NO: 2058539 - RNA, 15 nt, Homo sapiens
gagauugagauguaa

SEQ ID NO: 2058540 - RNA, 15 nt, Homo sapiens
uuuaacguuucucau

SEQ ID NO: 2058541 - RNA, 21 nt, Homo sapiens
uuaaccaccgcauaugcaugc

SEQ ID NO: 2058542 - RNA, 22 nt, Homo sapiens
uaggcagugggaggcaaauggg

SEQ ID NO: 2058543 - RNA, 15 nt, Homo sapiens
aauucagaugcuguu

SEQ ID NO: 2058544 - RNA, 17 nt, Homo sapiens
acagagugcauugugag

SEQ ID NO: 2058545 - RNA, 15 nt, Homo sapiens
caaaagagacaggga

SEQ ID NO: 2058546 - RNA, 18 nt, Homo sapiens
cuuccugccucucucaug

SEQ ID NO: 2058547 - RNA, 21 nt, Homo sapiens
cauaaaugcagcccauuucuc

SEQ ID NO: 2058548 - RNA, 15 nt, Homo sapiens
auuuuggccaaagug

SEQ ID NO: 2058549 - RNA, 11 nt, Homo sapiens
acacugugcua

SEQ ID NO: 2058550 - RNA, 19 nt, Homo sapiens
gagaacaucauaacccaug

SEQ ID NO: 2058551 - RNA, 19 nt, Homo sapiens
uaaaugacagcaccugaga

SEQ ID NO: 2058552 - RNA, 15 nt, Homo sapiens
uaaagaccauuuaau

SEQ ID NO: 2058553 - RNA, 16 nt, Homo sapiens
ugugagccggagcuca

SEQ ID NO: 2058554 - RNA, 21 nt, Homo sapiens
gaguguccggcugaggccuga

SEQ ID NO: 2058555 - RNA, 21 nt, Homo sapiens
auugucucuagagauugucag

SEQ ID NO: 2058556 - RNA, 14 nt, Homo sapiens
agauagcugugacu

SEQ ID NO: 2058557 - RNA, 19 nt, Homo sapiens
agaucgcaccauugcacuc

SEQ ID NO: 2058558 - RNA, 20 nt, Homo sapiens
cuuuccaaauaagugcauuu

SEQ ID NO: 2058559 - RNA, 19 nt, Homo sapiens
uggagggcuggaaucugga

SEQ ID NO: 2058560 - RNA, 20 nt, Homo sapiens
augcugcaggaaaagcaaaa

SEQ ID NO: 2058561 - RNA, 22 nt, Homo sapiens
uaauucgagcaaacaacuuucu

SEQ ID NO: 2058562 - RNA, 20 nt, Homo sapiens
aagucuuugguacaaguuua

SEQ ID NO: 2058563 - RNA, 19 nt, Homo sapiens
ucaccccuccccugggacu

SEQ ID NO: 2058564 - RNA, 14 nt, Homo sapiens
gcuuggagugcccc

SEQ ID NO: 2058565 - RNA, 16 nt, Homo sapiens
cugugagcauggggcc

SEQ ID NO: 2058566 - RNA, 19 nt, Homo sapiens
agccaagaucuugccacug

SEQ ID NO: 2058567 - RNA, 13 nt, Homo sapiens
gcaguuaauuuau

SEQ ID NO: 2058568 - RNA, 17 nt, Homo sapiens
ugagggcagggacauca

SEQ ID NO: 2058569 - RNA, 14 nt, Homo sapiens
guagauaacacuga

SEQ ID NO: 2058570 - RNA, 14 nt, Homo sapiens
aaguaaauugccug

SEQ ID NO: 2058571 - RNA, 20 nt, Homo sapiens
ggcauuuuugagaaagcaaa

SEQ ID NO: 2058572 - RNA, 16 nt, Homo sapiens
uaaucccaacuacuca

SEQ ID NO: 2058573 - RNA, 19 nt, Homo sapiens
ugcagcccagaauagcuuu

SEQ ID NO: 2058574 - RNA, 19 nt, Homo sapiens
aucaaugcauguuacccau

SEQ ID NO: 2058575 - RNA, 21 nt, Homo sapiens
ucuaauuagaucaauuacuua

SEQ ID NO: 2058576 - RNA, 15 nt, Homo sapiens
aauauaauacuguau

SEQ ID NO: 2058577 - RNA, 14 nt, Homo sapiens
gguuuagauccaau

SEQ ID NO: 2058578 - RNA, 17 nt, Homo sapiens
guuucucuggcccugag

SEQ ID NO: 2058579 - RNA, 14 nt, Homo sapiens
cucagagaugugca

SEQ ID NO: 2058580 - RNA, 16 nt, Homo sapiens
ucugaacccugagcag

SEQ ID NO: 2058581 - RNA, 20 nt, Homo sapiens
acaaaugauuucgugacugu

SEQ ID NO: 2058582 - RNA, 22 nt, Homo sapiens
aggcggucaugugugcauguga

SEQ ID NO: 2058583 - RNA, 23 nt, Homo sapiens
aacuuugugccuuugaccaucuc

SEQ ID NO: 2058584 - RNA, 22 nt, Homo sapiens
uauaaggcagccuugaguugca

SEQ ID NO: 2058585 - RNA, 12 nt, Homo sapiens
cagaagugcucu

SEQ ID NO: 2058586 - RNA, 16 nt, Homo sapiens
ugacaaugaagugaca

SEQ ID NO: 2058587 - RNA, 13 nt, Homo sapiens
uucacugcacugu

SEQ ID NO: 2058588 - RNA, 19 nt, Homo sapiens
cccugaggaauaaagcuuc

SEQ ID NO: 2058589 - RNA, 17 nt, Homo sapiens
uaaugucugccagguga

SEQ ID NO: 2058590 - RNA, 22 nt, Homo sapiens
cauguuaggaagguacugucau

SEQ ID NO: 2058591 - RNA, 14 nt, Homo sapiens
ucaacacaaacugg

SEQ ID NO: 2058592 - RNA, 20 nt, Homo sapiens
ggaucucucuccucucugac

SEQ ID NO: 2058593 - RNA, 15 nt, Homo sapiens
acccuccucaagaag

SEQ ID NO: 2058594 - RNA, 23 nt, Homo sapiens
aucuuuuugagagaaccuuauau

SEQ ID NO: 2058595 - RNA, 22 nt, Homo sapiens
cuccugcgggggcgaggccccu

SEQ ID NO: 2058596 - RNA, 13 nt, Homo sapiens
cuugagacccucu

SEQ ID NO: 2058597 - RNA, 13 nt, Homo sapiens
acccauuagccau

SEQ ID NO: 2058598 - RNA, 17 nt, Homo sapiens
cguguaggaaccugcac

SEQ ID NO: 2058599 - RNA, 16 nt, Homo sapiens
ucccgggcacugucau

SEQ ID NO: 2058600 - RNA, 20 nt, Homo sapiens
cuuggccagaagggggccau

SEQ ID NO: 2058601 - RNA, 18 nt, Homo sapiens
acaggcaaagacugcagu

SEQ ID NO: 2058602 - RNA, 14 nt, Homo sapiens
cccuuccagugccc

SEQ ID NO: 2058603 - RNA, 17 nt, Homo sapiens
uugucuuuacuccauga

SEQ ID NO: 2058604 - RNA, 12 nt, Homo sapiens
aauuauagcucu

SEQ ID NO: 2058605 - RNA, 17 nt, Homo sapiens
ucaguaacacagugcag

SEQ ID NO: 2058606 - RNA, 16 nt, Homo sapiens
uuuuaauuucuaugga

SEQ ID NO: 2058607 - RNA, 17 nt, Homo sapiens
uaaaagcacaaguacuu

SEQ ID NO: 2058608 - RNA, 16 nt, Homo sapiens
agcugguggcucugug

SEQ ID NO: 2058609 - RNA, 13 nt, Homo sapiens
gacccugggacca

SEQ ID NO: 2058610 - RNA, 19 nt, Homo sapiens
gcugccaccaaaucugucu

SEQ ID NO: 2058611 - RNA, 14 nt, Homo sapiens
acugaggaccagcc

SEQ ID NO: 2058612 - RNA, 19 nt, Homo sapiens
gcaacaggcucacugguca

SEQ ID NO: 2058613 - RNA, 19 nt, Homo sapiens
uccucaguuacacaaagga

SEQ ID NO: 2058614 - RNA, 22 nt, Homo sapiens
aacaauaaaguacuuuaccuaa

SEQ ID NO: 2058615 - RNA, 21 nt, Homo sapiens
aaagaauguuacugccuuaau

SEQ ID NO: 2058616 - RNA, 17 nt, Homo sapiens
guuaauaguacuauuaa

SEQ ID NO: 2058617 - RNA, 18 nt, Homo sapiens
gaugucauauuccauuuu

SEQ ID NO: 2058618 - RNA, 12 nt, Homo sapiens
accccagccuca

SEQ ID NO: 2058619 - RNA, 11 nt, Homo sapiens
gaggggccagc

SEQ ID NO: 2058620 - RNA, 18 nt, Homo sapiens
caaguggaaacaugcuga

SEQ ID NO: 2058621 - RNA, 18 nt, Homo sapiens
auucucuauguacagaug

SEQ ID NO: 2058622 - RNA, 20 nt, Homo sapiens
acagucaaaauguuugauau

SEQ ID NO: 2058623 - RNA, 20 nt, Homo sapiens
cccauguugagccaugagug

SEQ ID NO: 2058624 - RNA, 20 nt, Homo sapiens
ccccaucugccacguguauu

SEQ ID NO: 2058625 - RNA, 24 nt, Homo sapiens
aggcgccaccugggcggacagcca

SEQ ID NO: 2058626 - RNA, 14 nt, Homo sapiens
auugucucagugaa

SEQ ID NO: 2058627 - RNA, 21 nt, Homo sapiens
uugaacugauaguuacuguug

SEQ ID NO: 2058628 - RNA, 15 nt, Homo sapiens
accucauucacagcu

SEQ ID NO: 2058629 - RNA, 17 nt, Homo sapiens
uaaacacuccacauucu

SEQ ID NO: 2058630 - RNA, 22 nt, Homo sapiens
caccaacacugucccaagguga

SEQ ID NO: 2058631 - RNA, 17 nt, Homo sapiens
aacugcugaucaaugaa

SEQ ID NO: 2058632 - RNA, 15 nt, Homo sapiens
gcacagauggccagc

SEQ ID NO: 2058633 - RNA, 22 nt, Homo sapiens
cuccuuuaccccacauaugcaa

SEQ ID NO: 2058634 - RNA, 18 nt, Homo sapiens
cagugucccaccuugacc

SEQ ID NO: 2058635 - RNA, 16 nt, Homo sapiens
ucaagucucucacccu

SEQ ID NO: 2058636 - RNA, 18 nt, Homo sapiens
cuagcacuugucucagga

SEQ ID NO: 2058637 - RNA, 18 nt, Homo sapiens
ccuuguccccugccugug

SEQ ID NO: 2058638 - RNA, 22 nt, Homo sapiens
ccucuauuuguucagaucucau

SEQ ID NO: 2058639 - RNA, 18 nt, Homo sapiens
aguaugaagacacuguca

SEQ ID NO: 2058640 - RNA, 15 nt, Homo sapiens
cugcugaugaacaaa

SEQ ID NO: 2058641 - RNA, 14 nt, Homo sapiens
aagacauguacuga

SEQ ID NO: 2058642 - RNA, 14 nt, Homo sapiens
ccacgacauaagcu

SEQ ID NO: 2058643 - RNA, 16 nt, Homo sapiens
augucaguagugccag

SEQ ID NO: 2058644 - RNA, 14 nt, Homo sapiens
cacuuuccuuucaa

SEQ ID NO: 2058645 - RNA, 14 nt, Homo sapiens
auugaggacacuga

SEQ ID NO: 2058646 - RNA, 13 nt, Homo sapiens
auucuauugccuu

SEQ ID NO: 2058647 - RNA, 20 nt, Homo sapiens
agauccuggagugauaugau

SEQ ID NO: 2058648 - RNA, 18 nt, Homo sapiens
gguguaauuuuguccucu

SEQ ID NO: 2058649 - RNA, 10 nt, Homo sapiens
gauaugcaca

SEQ ID NO: 2058650 - RNA, 15 nt, Homo sapiens
uguaauuaacauauc

SEQ ID NO: 2058651 - RNA, 20 nt, Homo sapiens
uaccaaaaacaagucuauaa

SEQ ID NO: 2058652 - RNA, 16 nt, Homo sapiens
aggccagaggugaaca

SEQ ID NO: 2058653 - RNA, 14 nt, Homo sapiens
uguucagacauucc

SEQ ID NO: 2058654 - RNA, 11 nt, Homo sapiens
auucugcauuu

SEQ ID NO: 2058655 - RNA, 21 nt, Homo sapiens
agaauuauaauuaguuccuca

SEQ ID NO: 2058656 - RNA, 12 nt, Homo sapiens
cagaaacaucug

SEQ ID NO: 2058657 - RNA, 14 nt, Homo sapiens
cauagaauugcaau

SEQ ID NO: 2058658 - RNA, 12 nt, Homo sapiens
gcugcaacccaa

SEQ ID NO: 2058659 - RNA, 12 nt, Homo sapiens
acacccaugugu

SEQ ID NO: 2058660 - RNA, 21 nt, Homo sapiens
ucuuugcugcagaacugaaga

SEQ ID NO: 2058661 - RNA, 13 nt, Homo sapiens
acugucuuuacaa

SEQ ID NO: 2058662 - RNA, 17 nt, Homo sapiens
acucagcacagcagugg

SEQ ID NO: 2058663 - RNA, 17 nt, Homo sapiens
caggaguggaaggugag

SEQ ID NO: 2058664 - RNA, 21 nt, Homo sapiens
acucugauagaauuauuucac

SEQ ID NO: 2058665 - RNA, 16 nt, Homo sapiens
auaagaagauacacug

SEQ ID NO: 2058666 - RNA, 13 nt, Homo sapiens
aaagaacaaagua

SEQ ID NO: 2058667 - RNA, 22 nt, Homo sapiens
ccuauuggaagcauacaaagca

SEQ ID NO: 2058668 - RNA, 17 nt, Homo sapiens
acuccaccaucaccucu

SEQ ID NO: 2058669 - RNA, 15 nt, Homo sapiens
aaaguauuccaccuu

SEQ ID NO: 2058670 - RNA, 20 nt, Homo sapiens
ucuaaaaaccagacaaggaa

SEQ ID NO: 2058671 - RNA, 19 nt, Homo sapiens
agaaaagaaauuggacaga

SEQ ID NO: 2058672 - RNA, 23 nt, Homo sapiens
ggaggaggccguaugaagacaga

SEQ ID NO: 2058673 - RNA, 17 nt, Homo sapiens
cuaaaaagaagccacag

SEQ ID NO: 2058674 - RNA, 14 nt, Homo sapiens
gcuugucugcaguc

SEQ ID NO: 2058675 - RNA, 15 nt, Homo sapiens
gaacuccaguacuca

SEQ ID NO: 2058676 - RNA, 15 nt, Homo sapiens
augacccaaagacca

SEQ ID NO: 2058677 - RNA, 13 nt, Homo sapiens
ucuuccauucccu

SEQ ID NO: 2058678 - RNA, 13 nt, Homo sapiens
acucccauaccuu

SEQ ID NO: 2058679 - RNA, 17 nt, Homo sapiens
aacaaguuuuucuguca

SEQ ID NO: 2058680 - RNA, 16 nt, Homo sapiens
caaagaguguagauca

SEQ ID NO: 2058681 - RNA, 14 nt, Homo sapiens
caggagcugcuaaa

SEQ ID NO: 2058682 - RNA, 20 nt, Homo sapiens
guuucccuuagagauuuugu

SEQ ID NO: 2058683 - RNA, 15 nt, Homo sapiens
gccuaagaaacacuc

SEQ ID NO: 2058684 - RNA, 16 nt, Homo sapiens
uuucugaucugaugca

SEQ ID NO: 2058685 - RNA, 13 nt, Homo sapiens
ugaacccaggaga

SEQ ID NO: 2058686 - RNA, 19 nt, Homo sapiens
cuaaaaauaaaccaaagga

SEQ ID NO: 2058687 - RNA, 19 nt, Homo sapiens
ucuucauauucagcuugca

SEQ ID NO: 2058688 - RNA, 22 nt, Homo sapiens
gaggugcaggggaagaccaaag

SEQ ID NO: 2058689 - RNA, 22 nt, Homo sapiens
ugccuguaaucucagcacuuug

SEQ ID NO: 2058690 - RNA, 15 nt, Homo sapiens
aucaaguaccucauc

SEQ ID NO: 2058691 - RNA, 19 nt, Homo sapiens
auuuuaaaaauaaauucaa

SEQ ID NO: 2058692 - RNA, 16 nt, Homo sapiens
cagaaaccuccaucaa

SEQ ID NO: 2058693 - RNA, 21 nt, Homo sapiens
gagugggcugggcccucuguc

SEQ ID NO: 2058694 - RNA, 19 nt, Homo sapiens
gggaucugcuugauauccc

SEQ ID NO: 2058695 - RNA, 13 nt, Homo sapiens
uucguaguuuuca

SEQ ID NO: 2058696 - RNA, 23 nt, Homo sapiens
auucuuuauuauuuuucucucuc

SEQ ID NO: 2058697 - RNA, 19 nt, Homo sapiens
uacaauggcgugaucucag

SEQ ID NO: 2058698 - RNA, 12 nt, Homo sapiens
accucaagcacc

SEQ ID NO: 2058699 - RNA, 22 nt, Homo sapiens
acccuccuuucaccacaugugc

SEQ ID NO: 2058700 - RNA, 19 nt, Homo sapiens
aaccauaccuuccuucccu

SEQ ID NO: 2058701 - RNA, 19 nt, Homo sapiens
aauucauuuuuuaaauucc

SEQ ID NO: 2058702 - RNA, 14 nt, Homo sapiens
guuguccuugcccc

SEQ ID NO: 2058703 - RNA, 15 nt, Homo sapiens
agaacucacuggggc

SEQ ID NO: 2058704 - RNA, 15 nt, Homo sapiens
auuuauuauuaacau

SEQ ID NO: 2058705 - RNA, 19 nt, Homo sapiens
gcacauucuuaaauauuuc

SEQ ID NO: 2058706 - RNA, 11 nt, Homo sapiens
guucacuggag

SEQ ID NO: 2058707 - RNA, 11 nt, Homo sapiens
auugauuucaa

SEQ ID NO: 2058708 - RNA, 14 nt, Homo sapiens
agaagccagagggu

SEQ ID NO: 2058709 - RNA, 23 nt, Homo sapiens
ccauaaagaaugcucauauuaau

SEQ ID NO: 2058710 - RNA, 18 nt, Homo sapiens
guuggccucagggccagg

SEQ ID NO: 2058711 - RNA, 13 nt, Homo sapiens
ucaacuaugauau

SEQ ID NO: 2058712 - RNA, 16 nt, Homo sapiens
ucaagaacaagcaaug

SEQ ID NO: 2058713 - RNA, 18 nt, Homo sapiens
gccaguugguggggccag

SEQ ID NO: 2058714 - RNA, 12 nt, Homo sapiens
cugaaaccaaaa

SEQ ID NO: 2058715 - RNA, 20 nt, Homo sapiens
ucucaggugccagucuucca

SEQ ID NO: 2058716 - RNA, 16 nt, Homo sapiens
agguaaagacugccag

SEQ ID NO: 2058717 - RNA, 16 nt, Homo sapiens
ugagcuaacgugcugu

SEQ ID NO: 2058718 - RNA, 19 nt, Homo sapiens
aucuauuaccaaaagucaa

SEQ ID NO: 2058719 - RNA, 16 nt, Homo sapiens
ucccuaacaucaugca

SEQ ID NO: 2058720 - RNA, 17 nt, Homo sapiens
uccaugcccagccaaua

SEQ ID NO: 2058721 - RNA, 17 nt, Homo sapiens
acacuugaugaugugga

SEQ ID NO: 2058722 - RNA, 23 nt, Homo sapiens
cagcacaccucagccccacugac

SEQ ID NO: 2058723 - RNA, 20 nt, Homo sapiens
ugccaccgugggggaacuga

SEQ ID NO: 2058724 - RNA, 17 nt, Homo sapiens
augaccccacugcagca

SEQ ID NO: 2058725 - RNA, 17 nt, Homo sapiens
ccugcagccugacccca

SEQ ID NO: 2058726 - RNA, 19 nt, Homo sapiens
augugagcugucacugugg

SEQ ID NO: 2058727 - RNA, 16 nt, Homo sapiens
acccacagagugccau

SEQ ID NO: 2058728 - RNA, 20 nt, Homo sapiens
uuccuaucaaaaagauauca

SEQ ID NO: 2058729 - RNA, 16 nt, Homo sapiens
ucaaggucacuguuuc

SEQ ID NO: 2058730 - RNA, 17 nt, Homo sapiens
gaagugaccgcaccuca

SEQ ID NO: 2058731 - RNA, 19 nt, Homo sapiens
uucuaugaagaguauuaau

SEQ ID NO: 2058732 - RNA, 18 nt, Homo sapiens
acccaacgacccaugacc

SEQ ID NO: 2058733 - RNA, 20 nt, Homo sapiens
cugagacccuuuucucagga

SEQ ID NO: 2058734 - RNA, 11 nt, Homo sapiens
gacucauucuu

SEQ ID NO: 2058735 - RNA, 16 nt, Homo sapiens
guccuuuuguaccaug

SEQ ID NO: 2058736 - RNA, 22 nt, Homo sapiens
agccugacagaaggaacacugc

SEQ ID NO: 2058737 - RNA, 14 nt, Homo sapiens
aagaauagguugcc

SEQ ID NO: 2058738 - RNA, 17 nt, Homo sapiens
uggacagcuuuucccaa

SEQ ID NO: 2058739 - RNA, 23 nt, Homo sapiens
auccugagcaaacaaaaccaccu

SEQ ID NO: 2058740 - RNA, 15 nt, Homo sapiens
aaauugacugucacg

SEQ ID NO: 2058741 - RNA, 13 nt, Homo sapiens
ugccccaucuccc

SEQ ID NO: 2058742 - RNA, 13 nt, Homo sapiens
ugcaccaucucac

SEQ ID NO: 2058743 - RNA, 17 nt, Homo sapiens
aaaggcucugugcuuga

SEQ ID NO: 2058744 - RNA, 15 nt, Homo sapiens
acuugaaaaccucau

SEQ ID NO: 2058745 - RNA, 15 nt, Homo sapiens
uaccagaucuaauau

SEQ ID NO: 2058746 - RNA, 14 nt, Homo sapiens
cguugugcauuugg

SEQ ID NO: 2058747 - RNA, 23 nt, Homo sapiens
auacuaauuuuccauaagcuauu

SEQ ID NO: 2058748 - RNA, 16 nt, Homo sapiens
agauaggaaccagcag

SEQ ID NO: 2058749 - RNA, 23 nt, Homo sapiens
ugaugggaaauuauuuuucagga

SEQ ID NO: 2058750 - RNA, 18 nt, Homo sapiens
guuuccuuccagcccaga

SEQ ID NO: 2058751 - RNA, 22 nt, Homo sapiens
agauauggaaacagaagacaaa

SEQ ID NO: 2058752 - RNA, 18 nt, Homo sapiens
uuuuccuaugcaguguca

SEQ ID NO: 2058753 - RNA, 13 nt, Homo sapiens
uggcagugaugaa

SEQ ID NO: 2058754 - RNA, 22 nt, Homo sapiens
cuugcuugucauugacucuugc

SEQ ID NO: 2058755 - RNA, 17 nt, Homo sapiens
cagccucuggaauggcu

SEQ ID NO: 2058756 - RNA, 16 nt, Homo sapiens
accagacagaggguca

SEQ ID NO: 2058757 - RNA, 17 nt, Homo sapiens
aaauguucuauuuaaca

SEQ ID NO: 2058758 - RNA, 18 nt, Homo sapiens
cacugaccaagugcuggc

SEQ ID NO: 2058759 - RNA, 13 nt, Homo sapiens
uuauacuguacaa

SEQ ID NO: 2058760 - RNA, 14 nt, Homo sapiens
ugacuguaucuuga

SEQ ID NO: 2058761 - RNA, 15 nt, Homo sapiens
ccucaugcuguuuca

SEQ ID NO: 2058762 - RNA, 19 nt, Homo sapiens
ugccuuaaccugggaccaa

SEQ ID NO: 2058763 - RNA, 18 nt, Homo sapiens
caugaggcaguuccuucc

SEQ ID NO: 2058764 - RNA, 16 nt, Homo sapiens
ccucauggauugccac

SEQ ID NO: 2058765 - RNA, 13 nt, Homo sapiens
uucuccagacagg

SEQ ID NO: 2058766 - RNA, 17 nt, Homo sapiens
ccaguguauaaauccaa

SEQ ID NO: 2058767 - RNA, 14 nt, Homo sapiens
gacuugguugaacu

SEQ ID NO: 2058768 - RNA, 16 nt, Homo sapiens
auugcuaagaagggaa

SEQ ID NO: 2058769 - RNA, 16 nt, Homo sapiens
ugccucccagguucca

SEQ ID NO: 2058770 - RNA, 14 nt, Homo sapiens
uauaaauguaaaaa

SEQ ID NO: 2058771 - RNA, 16 nt, Homo sapiens
cucugcucugugcacu

SEQ ID NO: 2058772 - RNA, 24 nt, Homo sapiens
agcaggcuuucaagaagugccagu

SEQ ID NO: 2058773 - RNA, 22 nt, Homo sapiens
cuaaaagugguuuuuauuuccu

SEQ ID NO: 2058774 - RNA, 20 nt, Homo sapiens
auucccacucagcacucaga

SEQ ID NO: 2058775 - RNA, 19 nt, Homo sapiens
gcacuccaugagugcagcu

SEQ ID NO: 2058776 - RNA, 15 nt, Homo sapiens
aacacgcaugccuca

SEQ ID NO: 2058777 - RNA, 15 nt, Homo sapiens
gugagcugagauugc

SEQ ID NO: 2058778 - RNA, 20 nt, Homo sapiens
auaaaauauacuacuagcuu

SEQ ID NO: 2058779 - RNA, 16 nt, Homo sapiens
aaaaaguucagcauga

SEQ ID NO: 2058780 - RNA, 13 nt, Homo sapiens
ucacccaaccuga

SEQ ID NO: 2058781 - RNA, 12 nt, Homo sapiens
gagugcaauggu

SEQ ID NO: 2058782 - RNA, 20 nt, Homo sapiens
guccuuuaaaaaaaucccau

SEQ ID NO: 2058783 - RNA, 21 nt, Homo sapiens
cuauaauuuugccuuuaacag

SEQ ID NO: 2058784 - RNA, 17 nt, Homo sapiens
ucucugagaaccaaaag

SEQ ID NO: 2058785 - RNA, 20 nt, Homo sapiens
auacuagaaugguagcacua

SEQ ID NO: 2058786 - RNA, 14 nt, Homo sapiens
ggagccuccagcug

SEQ ID NO: 2058787 - RNA, 22 nt, Homo sapiens
cauugcuggacugaugguugcu

SEQ ID NO: 2058788 - RNA, 19 nt, Homo sapiens
cagugaccccugaccucac

SEQ ID NO: 2058789 - RNA, 21 nt, Homo sapiens
ucaacugccucagcgauuuca

SEQ ID NO: 2058790 - RNA, 15 nt, Homo sapiens
uaguuagccaucuaa

SEQ ID NO: 2058791 - RNA, 16 nt, Homo sapiens
ccugaaccucugaugc

SEQ ID NO: 2058792 - RNA, 23 nt, Homo sapiens
uguauuggcgcaccaagaucucc

SEQ ID NO: 2058793 - RNA, 19 nt, Homo sapiens
agcuuggcuguagaaggag

SEQ ID NO: 2058794 - RNA, 20 nt, Homo sapiens
auauauuuuugugcacauuu

SEQ ID NO: 2058795 - RNA, 20 nt, Homo sapiens
gggauuuucagcccucagaa

SEQ ID NO: 2058796 - RNA, 20 nt, Homo sapiens
gcagggcagccaccaggaga

SEQ ID NO: 2058797 - RNA, 16 nt, Homo sapiens
uaaaauaauaacaauc

SEQ ID NO: 2058798 - RNA, 20 nt, Homo sapiens
auggaacuuagacuccucuu

SEQ ID NO: 2058799 - RNA, 20 nt, Homo sapiens
ugccagaugcugauguucag

SEQ ID NO: 2058800 - RNA, 17 nt, Homo sapiens
uuuauggcucacuauga

SEQ ID NO: 2058801 - RNA, 18 nt, Homo sapiens
cucccucucuugccgaca

SEQ ID NO: 2058802 - RNA, 19 nt, Homo sapiens
ucaaucagugcagugauac

SEQ ID NO: 2058803 - RNA, 14 nt, Homo sapiens
ucagguauaccuca

SEQ ID NO: 2058804 - RNA, 19 nt, Homo sapiens
ccugauuuagauaugcaaa

SEQ ID NO: 2058805 - RNA, 17 nt, Homo sapiens
acccugggucaccuucc

SEQ ID NO: 2058806 - RNA, 16 nt, Homo sapiens
uacuucuugaauauaa

SEQ ID NO: 2058807 - RNA, 18 nt, Homo sapiens
ugacagcagagaaguauu

SEQ ID NO: 2058808 - RNA, 20 nt, Homo sapiens
ucagcaacccuacaguauau

SEQ ID NO: 2058809 - RNA, 16 nt, Homo sapiens
uucucccucagucugg

SEQ ID NO: 2058810 - RNA, 22 nt, Homo sapiens
auauuuccaucagcccaucuca

SEQ ID NO: 2058811 - RNA, 14 nt, Homo sapiens
auucauccuuccau

SEQ ID NO: 2058812 - RNA, 15 nt, Homo sapiens
uuucuuucauucucu

SEQ ID NO: 2058813 - RNA, 12 nt, Homo sapiens
gcugaugcaguu

SEQ ID NO: 2058814 - RNA, 12 nt, Homo sapiens
uauacagugcau

SEQ ID NO: 2058815 - RNA, 22 nt, Homo sapiens
cugaaucagaaaagcuauuaaa

SEQ ID NO: 2058816 - RNA, 14 nt, Homo sapiens
agagggcugcauuc

SEQ ID NO: 2058817 - RNA, 11 nt, Homo sapiens
gaagcaauaac

SEQ ID NO: 2058818 - RNA, 18 nt, Homo sapiens
uaaauuuacucuguugaa

SEQ ID NO: 2058819 - RNA, 18 nt, Homo sapiens
gauaaucucuccauuccc

SEQ ID NO: 2058820 - RNA, 14 nt, Homo sapiens
uacaaauuuauuga

SEQ ID NO: 2058821 - RNA, 21 nt, Homo sapiens
cagaauacaagccacuaccuu

SEQ ID NO: 2058822 - RNA, 19 nt, Homo sapiens
uugguuugaguuucucuca

SEQ ID NO: 2058823 - RNA, 16 nt, Homo sapiens
acaauaaagcaaugug

SEQ ID NO: 2058824 - RNA, 12 nt, Homo sapiens
cccccauuagaa

SEQ ID NO: 2058825 - RNA, 15 nt, Homo sapiens
aucuacaguaaugaa

SEQ ID NO: 2058826 - RNA, 16 nt, Homo sapiens
agauaaaaucuucaac

SEQ ID NO: 2058827 - RNA, 18 nt, Homo sapiens
agaagccaaaauacuucu

SEQ ID NO: 2058828 - RNA, 14 nt, Homo sapiens
uuuacuuccaugau

SEQ ID NO: 2058829 - RNA, 14 nt, Homo sapiens
uuuacauccaugaa

SEQ ID NO: 2058830 - RNA, 17 nt, Homo sapiens
uaauuacucuaacaaac

SEQ ID NO: 2058831 - RNA, 14 nt, Homo sapiens
agccccaccaaugg

SEQ ID NO: 2058832 - RNA, 16 nt, Homo sapiens
uacuugaagacuguga

SEQ ID NO: 2058833 - RNA, 16 nt, Homo sapiens
agccagucaagggcau

SEQ ID NO: 2058834 - RNA, 23 nt, Homo sapiens
gauaccuggauccagccauuccu

SEQ ID NO: 2058835 - RNA, 14 nt, Homo sapiens
uaugcaucuuugag

SEQ ID NO: 2058836 - RNA, 18 nt, Homo sapiens
cuuagcagcuaucucuca

SEQ ID NO: 2058837 - RNA, 16 nt, Homo sapiens
ccccaggcugggcugu

SEQ ID NO: 2058838 - RNA, 13 nt, Homo sapiens
cuccuccaugcag

SEQ ID NO: 2058839 - RNA, 18 nt, Homo sapiens
cagucaggcccaggcacu

SEQ ID NO: 2058840 - RNA, 12 nt, Homo sapiens
aacaaaaaccaa

SEQ ID NO: 2058841 - RNA, 17 nt, Homo sapiens
uaauacucugcagugau

SEQ ID NO: 2058842 - RNA, 16 nt, Homo sapiens
aaagcagccacgaggu

SEQ ID NO: 2058843 - RNA, 13 nt, Homo sapiens
uuccauacuguuu

SEQ ID NO: 2058844 - RNA, 23 nt, Homo sapiens
gugaaauuuacaguuacugccua

SEQ ID NO: 2058845 - RNA, 21 nt, Homo sapiens
aggagaacacuagacaugcca

SEQ ID NO: 2058846 - RNA, 16 nt, Homo sapiens
auuucuuuuuccaaaa

SEQ ID NO: 2058847 - RNA, 15 nt, Homo sapiens
auucacuacugcaaa

SEQ ID NO: 2058848 - RNA, 16 nt, Homo sapiens
caaggcuucagucuca

SEQ ID NO: 2058849 - RNA, 18 nt, Homo sapiens
gagaagcuguaggacugu

SEQ ID NO: 2058850 - RNA, 22 nt, Homo sapiens
ugcagcuuccugucaacacuuc

SEQ ID NO: 2058851 - RNA, 12 nt, Homo sapiens
acugugacuuaa

SEQ ID NO: 2058852 - RNA, 17 nt, Homo sapiens
aagggcuaaacauguga

SEQ ID NO: 2058853 - RNA, 22 nt, Homo sapiens
agucucuggaaaaagacugauu

SEQ ID NO: 2058854 - RNA, 19 nt, Homo sapiens
aguguaaagaauaaaugaa

SEQ ID NO: 2058855 - RNA, 14 nt, Homo sapiens
cuuccacugagggc

SEQ ID NO: 2058856 - RNA, 22 nt, Homo sapiens
ucuuaauaagcccacauauaaa

SEQ ID NO: 2058857 - RNA, 17 nt, Homo sapiens
uucuucaugcaaugaca

SEQ ID NO: 2058858 - RNA, 17 nt, Homo sapiens
uggaagaggaacagcac

SEQ ID NO: 2058859 - RNA, 17 nt, Homo sapiens
cagaccagugaccccag

SEQ ID NO: 2058860 - RNA, 18 nt, Homo sapiens
uacaguuagagauuuuua

SEQ ID NO: 2058861 - RNA, 23 nt, Homo sapiens
caauaugaauuagguguacugua

SEQ ID NO: 2058862 - RNA, 19 nt, Homo sapiens
gaggcauugcacagggaga

SEQ ID NO: 2058863 - RNA, 11 nt, Homo sapiens
ccucuguggaa

SEQ ID NO: 2058864 - RNA, 15 nt, Homo sapiens
auauuucaguauuga

SEQ ID NO: 2058865 - RNA, 15 nt, Homo sapiens
acguucauaaccaac

SEQ ID NO: 2058866 - RNA, 16 nt, Homo sapiens
acucugcaaaggccug

SEQ ID NO: 2058867 - RNA, 11 nt, Homo sapiens
uguucagggaa

SEQ ID NO: 2058868 - RNA, 21 nt, Homo sapiens
cacacagaugcacacacagau

SEQ ID NO: 2058869 - RNA, 22 nt, Homo sapiens
uaaaucaaugguucaagucuuc

SEQ ID NO: 2058870 - RNA, 21 nt, Homo sapiens
agaaaauuuggucgugguaua

SEQ ID NO: 2058871 - RNA, 18 nt, Homo sapiens
ccagugcaacagcacugg

SEQ ID NO: 2058872 - RNA, 12 nt, Homo sapiens
uuuuacugucag

SEQ ID NO: 2058873 - RNA, 23 nt, Homo sapiens
ucccuaaguuuaaaggacugauu

SEQ ID NO: 2058874 - RNA, 14 nt, Homo sapiens
ucaagcauggaaca

SEQ ID NO: 2058875 - RNA, 18 nt, Homo sapiens
aagauaaaaugauguuau

SEQ ID NO: 2058876 - RNA, 16 nt, Homo sapiens
cagagauaauugccau

SEQ ID NO: 2058877 - RNA, 19 nt, Homo sapiens
ccuacuguagcaaccugaa

SEQ ID NO: 2058878 - RNA, 23 nt, Homo sapiens
gccaacagccccccccuugaauc

SEQ ID NO: 2058879 - RNA, 16 nt, Homo sapiens
cugcauauucuaguaa

SEQ ID NO: 2058880 - RNA, 14 nt, Homo sapiens
acagauaaugauag

SEQ ID NO: 2058881 - RNA, 16 nt, Homo sapiens
gaaaacaucugcacaa

SEQ ID NO: 2058882 - RNA, 19 nt, Homo sapiens
augacuguuacagcuuucu

SEQ ID NO: 2058883 - RNA, 21 nt, Homo sapiens
gcccagacaccaugugcaaua

SEQ ID NO: 2058884 - RNA, 21 nt, Homo sapiens
ugguauaaacguccuacugua

SEQ ID NO: 2058885 - RNA, 17 nt, Homo sapiens
gcuucuguccaggacau

SEQ ID NO: 2058886 - RNA, 14 nt, Homo sapiens
gacggagcacugca

SEQ ID NO: 2058887 - RNA, 21 nt, Homo sapiens
auucuuuaucccauuuuauca

SEQ ID NO: 2058888 - RNA, 17 nt, Homo sapiens
cuccugaaugagacuua

SEQ ID NO: 2058889 - RNA, 11 nt, Homo sapiens
ggacauuucau

SEQ ID NO: 2058890 - RNA, 14 nt, Homo sapiens
gccugccugggaga

SEQ ID NO: 2058891 - RNA, 15 nt, Homo sapiens
aguucacuguagaaa

SEQ ID NO: 2058892 - RNA, 15 nt, Homo sapiens
caagaaucacuugaa

SEQ ID NO: 2058893 - RNA, 18 nt, Homo sapiens
gcugcuucugcugccuag

SEQ ID NO: 2058894 - RNA, 17 nt, Homo sapiens
agaacugacaaaggagc

SEQ ID NO: 2058895 - RNA, 17 nt, Homo sapiens
cauguuaugcagugaac

SEQ ID NO: 2058896 - RNA, 12 nt, Homo sapiens
acucucccugac

SEQ ID NO: 2058897 - RNA, 21 nt, Homo sapiens
ucuuagauaugauaccaaaga

SEQ ID NO: 2058898 - RNA, 21 nt, Homo sapiens
gcuagacuaccggacacucgu

SEQ ID NO: 2058899 - RNA, 23 nt, Homo sapiens
agaaaaaaauucaugauacucau

SEQ ID NO: 2058900 - RNA, 19 nt, Homo sapiens
agauugcaccacugcacuc

SEQ ID NO: 2058901 - RNA, 14 nt, Homo sapiens
aagaguuuucuucc

SEQ ID NO: 2058902 - RNA, 13 nt, Homo sapiens
cuucaaaugcaaa

SEQ ID NO: 2058903 - RNA, 19 nt, Homo sapiens
agauucaggcuugcauuaa

SEQ ID NO: 2058904 - RNA, 14 nt, Homo sapiens
uugauacauauaau

SEQ ID NO: 2058905 - RNA, 15 nt, Homo sapiens
acagugaugccugcc

SEQ ID NO: 2058906 - RNA, 13 nt, Homo sapiens
auguaacuugaaa

SEQ ID NO: 2058907 - RNA, 13 nt, Homo sapiens
aggagacuuuaug

SEQ ID NO: 2058908 - RNA, 21 nt, Homo sapiens
gaaacaagacaagcuccuccc

SEQ ID NO: 2058909 - RNA, 16 nt, Homo sapiens
acuuaguguacaugaa

SEQ ID NO: 2058910 - RNA, 20 nt, Homo sapiens
uugcaaagaaaaguuucacc

SEQ ID NO: 2058911 - RNA, 16 nt, Homo sapiens
ucggcccggagcagca

SEQ ID NO: 2058912 - RNA, 19 nt, Homo sapiens
ggguccuuuugacacugcu

SEQ ID NO: 2058913 - RNA, 19 nt, Homo sapiens
gugacacuugguccuugcu

SEQ ID NO: 2058914 - RNA, 11 nt, Homo sapiens
agacuguaaau

SEQ ID NO: 2058915 - RNA, 15 nt, Homo sapiens
agguauaugugauaa

SEQ ID NO: 2058916 - RNA, 17 nt, Homo sapiens
ccugguccugcacuguc

SEQ ID NO: 2058917 - RNA, 20 nt, Homo sapiens
ccauggaucuugcuggagaa

SEQ ID NO: 2058918 - RNA, 19 nt, Homo sapiens
aacuggaaauguccaagcu

SEQ ID NO: 2058919 - RNA, 22 nt, Homo sapiens
ugcuaagaagcgagcacugacc

SEQ ID NO: 2058920 - RNA, 19 nt, Homo sapiens
uaggaugaaucauauucau

SEQ ID NO: 2058921 - RNA, 15 nt, Homo sapiens
auuuuaugcacaccu

SEQ ID NO: 2058922 - RNA, 19 nt, Homo sapiens
caggccggaaccacagggc

SEQ ID NO: 2058923 - RNA, 16 nt, Homo sapiens
cguagacacagggaug

SEQ ID NO: 2058924 - RNA, 17 nt, Homo sapiens
uguugaauaaauguauc

SEQ ID NO: 2058925 - RNA, 14 nt, Homo sapiens
auaacuagaucucc

SEQ ID NO: 2058926 - RNA, 15 nt, Homo sapiens
augauguuuccagau

SEQ ID NO: 2058927 - RNA, 12 nt, Homo sapiens
gugagacucuga

SEQ ID NO: 2058928 - RNA, 21 nt, Homo sapiens
ccucaccccuccccugggacu

SEQ ID NO: 2058929 - RNA, 15 nt, Homo sapiens
ugccaagacacagca

SEQ ID NO: 2058930 - RNA, 16 nt, Homo sapiens
aucuguccacaucccc

SEQ ID NO: 2058931 - RNA, 14 nt, Homo sapiens
caccccaacacuuc

SEQ ID NO: 2058932 - RNA, 14 nt, Homo sapiens
ugacccaaugauuc

SEQ ID NO: 2058933 - RNA, 21 nt, Homo sapiens
auguuagauuccucuugccuc

SEQ ID NO: 2058934 - RNA, 15 nt, Homo sapiens
guuugucauuuugaa

SEQ ID NO: 2058935 - RNA, 13 nt, Homo sapiens
acugcccugggca

SEQ ID NO: 2058936 - RNA, 16 nt, Homo sapiens
aauacaauguacaauu

SEQ ID NO: 2058937 - RNA, 14 nt, Homo sapiens
augugaguccuguu

SEQ ID NO: 2058938 - RNA, 13 nt, Homo sapiens
augaauuucugcc

SEQ ID NO: 2058939 - RNA, 20 nt, Homo sapiens
caagccuucuuaaagccuua

SEQ ID NO: 2058940 - RNA, 21 nt, Homo sapiens
ucgguuuauucacuguauguc

SEQ ID NO: 2058941 - RNA, 14 nt, Homo sapiens
gagagagugccaug

SEQ ID NO: 2058942 - RNA, 19 nt, Homo sapiens
cuuaaagcacagucugaug

SEQ ID NO: 2058943 - RNA, 22 nt, Homo sapiens
acucugugcaaggaaauuugca

SEQ ID NO: 2058944 - RNA, 12 nt, Homo sapiens
agcaacauuugu

SEQ ID NO: 2058945 - RNA, 14 nt, Homo sapiens
ucuucaaccuuaag

SEQ ID NO: 2058946 - RNA, 19 nt, Homo sapiens
uuuugauucucauugccau

SEQ ID NO: 2058947 - RNA, 18 nt, Homo sapiens
gagacccagcugcagacc

SEQ ID NO: 2058948 - RNA, 16 nt, Homo sapiens
aauaaaaagaagagag

SEQ ID NO: 2058949 - RNA, 19 nt, Homo sapiens
accaguuuuuucaccucca

SEQ ID NO: 2058950 - RNA, 16 nt, Homo sapiens
agacaggacccuggga

SEQ ID NO: 2058951 - RNA, 21 nt, Homo sapiens
cuguuccuccccuccccgccg

SEQ ID NO: 2058952 - RNA, 14 nt, Homo sapiens
gccaaacacacugu

SEQ ID NO: 2058953 - RNA, 19 nt, Homo sapiens
ucaucucccggugccuugg

SEQ ID NO: 2058954 - RNA, 17 nt, Homo sapiens
auucugccuagagugua

SEQ ID NO: 2058955 - RNA, 20 nt, Homo sapiens
acaauaucuucauacaauga

SEQ ID NO: 2058956 - RNA, 18 nt, Homo sapiens
cuacucgaguuacagaca

SEQ ID NO: 2058957 - RNA, 17 nt, Homo sapiens
gagaacccuuccuuucc

SEQ ID NO: 2058958 - RNA, 23 nt, Homo sapiens
cuggcugggaguggcauguauga

SEQ ID NO: 2058959 - RNA, 13 nt, Homo sapiens
ugcugucugagua

SEQ ID NO: 2058960 - RNA, 19 nt, Homo sapiens
ucccaggagaaagaugaaa

SEQ ID NO: 2058961 - RNA, 14 nt, Homo sapiens
caaaggugcuaaau

SEQ ID NO: 2058962 - RNA, 15 nt, Homo sapiens
gaagugaggacaaaa

SEQ ID NO: 2058963 - RNA, 16 nt, Homo sapiens
uggccaggaaguagca

SEQ ID NO: 2058964 - RNA, 14 nt, Homo sapiens
uacaaaaugggccu

SEQ ID NO: 2058965 - RNA, 16 nt, Homo sapiens
ccuuccuuaugucucc

SEQ ID NO: 2058966 - RNA, 20 nt, Homo sapiens
cacaaaggcugacauucacu

SEQ ID NO: 2058967 - RNA, 18 nt, Homo sapiens
cugcugguugacaucaga

SEQ ID NO: 2058968 - RNA, 14 nt, Homo sapiens
aauucuauaguaag

SEQ ID NO: 2058969 - RNA, 22 nt, Homo sapiens
uagacaugcacacccauucaca

SEQ ID NO: 2058970 - RNA, 16 nt, Homo sapiens
agauugaaccauucau

SEQ ID NO: 2058971 - RNA, 14 nt, Homo sapiens
auuccauaugcugu

SEQ ID NO: 2058972 - RNA, 21 nt, Homo sapiens
agcucuguggccacauuuuca

SEQ ID NO: 2058973 - RNA, 13 nt, Homo sapiens
ggcugcugugaac

SEQ ID NO: 2058974 - RNA, 22 nt, Homo sapiens
ugaugcauauugcccuggagaa

SEQ ID NO: 2058975 - RNA, 20 nt, Homo sapiens
agccacagcaaaaaguaaag

SEQ ID NO: 2058976 - RNA, 20 nt, Homo sapiens
ucuuaugaaaugggcuuuaa

SEQ ID NO: 2058977 - RNA, 12 nt, Homo sapiens
aaauaugcucuc

SEQ ID NO: 2058978 - RNA, 21 nt, Homo sapiens
agaguuggcuggucaacuuga

SEQ ID NO: 2058979 - RNA, 20 nt, Homo sapiens
auaaucccagcuacuuggga

SEQ ID NO: 2058980 - RNA, 22 nt, Homo sapiens
cauucucucugcccaaguugcu

SEQ ID NO: 2058981 - RNA, 13 nt, Homo sapiens
ugagucagugcuc

SEQ ID NO: 2058982 - RNA, 17 nt, Homo sapiens
accuguuuguuucuuau

SEQ ID NO: 2058983 - RNA, 20 nt, Homo sapiens
aaaaaucuuuucauuaaaga

SEQ ID NO: 2058984 - RNA, 18 nt, Homo sapiens
agaagaccccugcccaag

SEQ ID NO: 2058985 - RNA, 13 nt, Homo sapiens
aguucaucuugca

SEQ ID NO: 2058986 - RNA, 21 nt, Homo sapiens
cacacgccucccacugggguc

SEQ ID NO: 2058987 - RNA, 18 nt, Homo sapiens
augcagucuguccaggcu

SEQ ID NO: 2058988 - RNA, 22 nt, Homo sapiens
gucucuuacauggccacaaagg

SEQ ID NO: 2058989 - RNA, 19 nt, Homo sapiens
aaauuccaguaaauccuca

SEQ ID NO: 2058990 - RNA, 19 nt, Homo sapiens
guggcaggaaaauggacau

SEQ ID NO: 2058991 - RNA, 15 nt, Homo sapiens
cucaucugccuggaa

SEQ ID NO: 2058992 - RNA, 18 nt, Homo sapiens
ggucacuacugcauuuau

SEQ ID NO: 2058993 - RNA, 11 nt, Homo sapiens
uaaugcuuaua

SEQ ID NO: 2058994 - RNA, 14 nt, Homo sapiens
gauagcugaaugag

SEQ ID NO: 2058995 - RNA, 13 nt, Homo sapiens
cagaaccaaagca

SEQ ID NO: 2058996 - RNA, 16 nt, Homo sapiens
gccugaggcaugagaa

SEQ ID NO: 2058997 - RNA, 17 nt, Homo sapiens
caccuuauacaucacuu

SEQ ID NO: 2058998 - RNA, 23 nt, Homo sapiens
ucucacucugguuguuuaugcaa

SEQ ID NO: 2058999 - RNA, 15 nt, Homo sapiens
ccuaauaacgugaaa

SEQ ID NO: 2059000 - RNA, 23 nt, Homo sapiens
augccacacgggguuugucugua

SEQ ID NO: 2059001 - RNA, 11 nt, Homo sapiens
guuaggcagug

SEQ ID NO: 2059002 - RNA, 18 nt, Homo sapiens
uagacuugcuuuggucac

SEQ ID NO: 2059003 - RNA, 14 nt, Homo sapiens
uacagucauuccaa

SEQ ID NO: 2059004 - RNA, 17 nt, Homo sapiens
aaagucaccugcccaau

SEQ ID NO: 2059005 - RNA, 20 nt, Homo sapiens
ugcacacaagcucugcgcca

SEQ ID NO: 2059006 - RNA, 22 nt, Homo sapiens
auaugcaccccuggaaccagca

SEQ ID NO: 2059007 - RNA, 23 nt, Homo sapiens
acuccagcccugauugcgcaaaa

SEQ ID NO: 2059008 - RNA, 14 nt, Homo sapiens
ggcaaaaugucauu

SEQ ID NO: 2059009 - RNA, 18 nt, Homo sapiens
caacuauuuauugaauga

SEQ ID NO: 2059010 - RNA, 19 nt, Homo sapiens
caagugacucuccugccuc

SEQ ID NO: 2059011 - RNA, 17 nt, Homo sapiens
ggucuaauuauuuacuc

SEQ ID NO: 2059012 - RNA, 21 nt, Homo sapiens
gaacuaaguuuuguguguaua

SEQ ID NO: 2059013 - RNA, 21 nt, Homo sapiens
ggaaaaucacaccaccugaca

SEQ ID NO: 2059014 - RNA, 15 nt, Homo sapiens
aaaagaaugacuaua

SEQ ID NO: 2059015 - RNA, 21 nt, Homo sapiens
cuugagugugcaagcaaagaa

SEQ ID NO: 2059016 - RNA, 19 nt, Homo sapiens
cugagugagccacagacca

SEQ ID NO: 2059017 - RNA, 13 nt, Homo sapiens
ucccggagcucaa

SEQ ID NO: 2059018 - RNA, 17 nt, Homo sapiens
uccuguaaagaaacauu

SEQ ID NO: 2059019 - RNA, 22 nt, Homo sapiens
gaugauuaagugcacaccgugu

SEQ ID NO: 2059020 - RNA, 20 nt, Homo sapiens
ccaacaucaacaucuugguc

SEQ ID NO: 2059021 - RNA, 12 nt, Homo sapiens
uucaaaauacuu

SEQ ID NO: 2059022 - RNA, 21 nt, Homo sapiens
aggucauguuguaguuuaaau

SEQ ID NO: 2059023 - RNA, 16 nt, Homo sapiens
cauuugugcguaugca

SEQ ID NO: 2059024 - RNA, 21 nt, Homo sapiens
ccucuuccuccucgcugccag

SEQ ID NO: 2059025 - RNA, 21 nt, Homo sapiens
uacaguugggaagucucagcc

SEQ ID NO: 2059026 - RNA, 19 nt, Homo sapiens
cuuucuucccguaaaaacu

SEQ ID NO: 2059027 - RNA, 15 nt, Homo sapiens
aagggaauugcucag

SEQ ID NO: 2059028 - RNA, 20 nt, Homo sapiens
uuuuauaaaauuaagcaaug

SEQ ID NO: 2059029 - RNA, 12 nt, Homo sapiens
agugcugugcac

SEQ ID NO: 2059030 - RNA, 18 nt, Homo sapiens
caccuacgggggcaucug

SEQ ID NO: 2059031 - RNA, 15 nt, Homo sapiens
cagguguuggugaca

SEQ ID NO: 2059032 - RNA, 22 nt, Homo sapiens
auggcuuauuucuaugacaaau

SEQ ID NO: 2059033 - RNA, 23 nt, Homo sapiens
gugugccuauagucccacuacuu

SEQ ID NO: 2059034 - RNA, 20 nt, Homo sapiens
ccgccauugggcuacuguag

SEQ ID NO: 2059035 - RNA, 20 nt, Homo sapiens
ccaacuugaugucaagcaau

SEQ ID NO: 2059036 - RNA, 14 nt, Homo sapiens
auucucucugccca

SEQ ID NO: 2059037 - RNA, 17 nt, Homo sapiens
uccgcuagcaguacuaa

SEQ ID NO: 2059038 - RNA, 17 nt, Homo sapiens
ggcaugauccaagcaag

SEQ ID NO: 2059039 - RNA, 23 nt, Homo sapiens
auuacaguauccaaugucuuuug

SEQ ID NO: 2059040 - RNA, 17 nt, Homo sapiens
caaggcucacaugcucc

SEQ ID NO: 2059041 - RNA, 14 nt, Homo sapiens
uuccagggaagcaa

SEQ ID NO: 2059042 - RNA, 19 nt, Homo sapiens
augccgggcacaggccagg

SEQ ID NO: 2059043 - RNA, 12 nt, Homo sapiens
cugcuauaacua

SEQ ID NO: 2059044 - RNA, 16 nt, Homo sapiens
ugaccgaguaccugcu

SEQ ID NO: 2059045 - RNA, 17 nt, Homo sapiens
auuuuugccaaggcaaa

SEQ ID NO: 2059046 - RNA, 22 nt, Homo sapiens
gaaugacuuucagucucucuga

SEQ ID NO: 2059047 - RNA, 15 nt, Homo sapiens
uugcaauguggcuug

SEQ ID NO: 2059048 - RNA, 21 nt, Homo sapiens
ucuaaugauuauagauaaaua

SEQ ID NO: 2059049 - RNA, 22 nt, Homo sapiens
ggccaagcccagcuuaauggcu

SEQ ID NO: 2059050 - RNA, 14 nt, Homo sapiens
cagaccccaaggcc

SEQ ID NO: 2059051 - RNA, 13 nt, Homo sapiens
cuucucacuuccu

SEQ ID NO: 2059052 - RNA, 13 nt, Homo sapiens
uuuaucaccucau

SEQ ID NO: 2059053 - RNA, 17 nt, Homo sapiens
cauugcagcaagcaaua

SEQ ID NO: 2059054 - RNA, 17 nt, Homo sapiens
gggagacugcaucucaa

SEQ ID NO: 2059055 - RNA, 20 nt, Homo sapiens
uucuuagugcuucagaguuu

SEQ ID NO: 2059056 - RNA, 20 nt, Homo sapiens
gccaggcugccaaggccaga

SEQ ID NO: 2059057 - RNA, 20 nt, Homo sapiens
cucuuaaacuaacaauucaa

SEQ ID NO: 2059058 - RNA, 18 nt, Homo sapiens
uugucacuggaaccuccc

SEQ ID NO: 2059059 - RNA, 17 nt, Homo sapiens
agccacaggaccaccuc

SEQ ID NO: 2059060 - RNA, 14 nt, Homo sapiens
gaacagccagaccc

SEQ ID NO: 2059061 - RNA, 15 nt, Homo sapiens
aggugccgauuucau

SEQ ID NO: 2059062 - RNA, 12 nt, Homo sapiens
ucaggcaccugc

SEQ ID NO: 2059063 - RNA, 19 nt, Homo sapiens
caaaucuugggugggugaa

SEQ ID NO: 2059064 - RNA, 18 nt, Homo sapiens
agaagcugucagaaguuu

SEQ ID NO: 2059065 - RNA, 13 nt, Homo sapiens
guuaagcauggau

SEQ ID NO: 2059066 - RNA, 23 nt, Homo sapiens
uauuucuuuuuaauuucugcaaa

SEQ ID NO: 2059067 - RNA, 20 nt, Homo sapiens
gauaauuuauuauacaccuu

SEQ ID NO: 2059068 - RNA, 13 nt, Homo sapiens
agcaguagcauca

SEQ ID NO: 2059069 - RNA, 19 nt, Homo sapiens
ucagaagcaguagacagau

SEQ ID NO: 2059070 - RNA, 18 nt, Homo sapiens
acuguccaagugccacau

SEQ ID NO: 2059071 - RNA, 17 nt, Homo sapiens
uggaggucagcauuuga

SEQ ID NO: 2059072 - RNA, 21 nt, Homo sapiens
gcucucccaacucuugcacag

SEQ ID NO: 2059073 - RNA, 21 nt, Homo sapiens
ugaggcccugagcauucuugg

SEQ ID NO: 2059074 - RNA, 23 nt, Homo sapiens
ucuggccauauuuacuaccuuau

SEQ ID NO: 2059075 - RNA, 19 nt, Homo sapiens
auuuuaggagacagucuca

SEQ ID NO: 2059076 - RNA, 12 nt, Homo sapiens
gagguugcacug

SEQ ID NO: 2059077 - RNA, 20 nt, Homo sapiens
uccuccagccaagaugaucc

SEQ ID NO: 2059078 - RNA, 22 nt, Homo sapiens
guucuaaacuaucaauaauaca

SEQ ID NO: 2059079 - RNA, 21 nt, Homo sapiens
uggcccucaaagcgagccguu

SEQ ID NO: 2059080 - RNA, 18 nt, Homo sapiens
aagcuguucucauuccug

SEQ ID NO: 2059081 - RNA, 20 nt, Homo sapiens
acuacaggcucaugccauca

SEQ ID NO: 2059082 - RNA, 19 nt, Homo sapiens
gagcgugaccuugcaaugu

SEQ ID NO: 2059083 - RNA, 13 nt, Homo sapiens
cuauuuauauuca

SEQ ID NO: 2059084 - RNA, 19 nt, Homo sapiens
ugcuacaguuuuuccuaaa

SEQ ID NO: 2059085 - RNA, 15 nt, Homo sapiens
accuacaagauuucc

SEQ ID NO: 2059086 - RNA, 15 nt, Homo sapiens
gacuaccaacuuuca

SEQ ID NO: 2059087 - RNA, 21 nt, Homo sapiens
ugagauaacauuuccaaagcu

SEQ ID NO: 2059088 - RNA, 11 nt, Homo sapiens
uaaacuacuga

SEQ ID NO: 2059089 - RNA, 19 nt, Homo sapiens
cagaggcaguaaccaugcc

SEQ ID NO: 2059090 - RNA, 24 nt, Homo sapiens
aaacccauacaauguauguacaau

SEQ ID NO: 2059091 - RNA, 19 nt, Homo sapiens
ugaguuacuaucaugucaa

SEQ ID NO: 2059092 - RNA, 21 nt, Homo sapiens
ggagcugccgugccugugucc

SEQ ID NO: 2059093 - RNA, 11 nt, Homo sapiens
ccaacacuuca

SEQ ID NO: 2059094 - RNA, 14 nt, Homo sapiens
cuuauccagcauua

SEQ ID NO: 2059095 - RNA, 18 nt, Homo sapiens
ggaccuggcgugcucaga

SEQ ID NO: 2059096 - RNA, 14 nt, Homo sapiens
cacugcaccugccu

SEQ ID NO: 2059097 - RNA, 22 nt, Homo sapiens
gucaaggccgagggccaggcag

SEQ ID NO: 2059098 - RNA, 16 nt, Homo sapiens
cuccaucucuacugaa

SEQ ID NO: 2059099 - RNA, 15 nt, Homo sapiens
aucagagagcucacu

SEQ ID NO: 2059100 - RNA, 16 nt, Homo sapiens
cagucggcugaacucu

SEQ ID NO: 2059101 - RNA, 20 nt, Homo sapiens
aaagacaaaacuuccuguuu

SEQ ID NO: 2059102 - RNA, 16 nt, Homo sapiens
aaaguauucucaaaga

SEQ ID NO: 2059103 - RNA, 22 nt, Homo sapiens
cauaauguauuuaaccagucuu

SEQ ID NO: 2059104 - RNA, 14 nt, Homo sapiens
accucugauuacau

SEQ ID NO: 2059105 - RNA, 14 nt, Homo sapiens
uucucugaacacau

SEQ ID NO: 2059106 - RNA, 15 nt, Homo sapiens
auaacccuguuacaa

SEQ ID NO: 2059107 - RNA, 15 nt, Homo sapiens
ugggcagcauacuga

SEQ ID NO: 2059108 - RNA, 15 nt, Homo sapiens
ugauaaaauacuaaa

SEQ ID NO: 2059109 - RNA, 17 nt, Homo sapiens
gaagagucuucaaaaac

SEQ ID NO: 2059110 - RNA, 17 nt, Homo sapiens
acccuugaaaagacauc

SEQ ID NO: 2059111 - RNA, 14 nt, Homo sapiens
cuuuaucauaugcu

SEQ ID NO: 2059112 - RNA, 17 nt, Homo sapiens
agcaugcagaagugcau

SEQ ID NO: 2059113 - RNA, 13 nt, Homo sapiens
uuucacucugcau

SEQ ID NO: 2059114 - RNA, 17 nt, Homo sapiens
agauuugggugaacaaa

SEQ ID NO: 2059115 - RNA, 18 nt, Homo sapiens
ccuggaccagugaccaaa

SEQ ID NO: 2059116 - RNA, 23 nt, Homo sapiens
uacugagaaaaaguccugucagu

SEQ ID NO: 2059117 - RNA, 14 nt, Homo sapiens
ggcuucugaugaau

SEQ ID NO: 2059118 - RNA, 17 nt, Homo sapiens
guacucacuuuucacuu

SEQ ID NO: 2059119 - RNA, 14 nt, Homo sapiens
uuuucuuccuugua

SEQ ID NO: 2059120 - RNA, 20 nt, Homo sapiens
gucagggaccccugcccuug

SEQ ID NO: 2059121 - RNA, 15 nt, Homo sapiens
cccuuaagccaacaa

SEQ ID NO: 2059122 - RNA, 15 nt, Homo sapiens
ccugccaggcacaca

SEQ ID NO: 2059123 - RNA, 21 nt, Homo sapiens
uggaaucacaaaccaagccau

SEQ ID NO: 2059124 - RNA, 15 nt, Homo sapiens
gccuugauaauacuu

SEQ ID NO: 2059125 - RNA, 23 nt, Homo sapiens
aaauccuggaaggacacagugau

SEQ ID NO: 2059126 - RNA, 23 nt, Homo sapiens
gaggacucccugcuuagcucugu

SEQ ID NO: 2059127 - RNA, 14 nt, Homo sapiens
agcauaagggcuuc

SEQ ID NO: 2059128 - RNA, 14 nt, Homo sapiens
agcaccagggcuca

SEQ ID NO: 2059129 - RNA, 14 nt, Homo sapiens
aguucaaugaucua

SEQ ID NO: 2059130 - RNA, 13 nt, Homo sapiens
cuggacugaccaa

SEQ ID NO: 2059131 - RNA, 18 nt, Homo sapiens
aauuugugcaucagaaaa

SEQ ID NO: 2059132 - RNA, 12 nt, Homo sapiens
ugacccaaacau

SEQ ID NO: 2059133 - RNA, 14 nt, Homo sapiens
gauugccacagcuc

SEQ ID NO: 2059134 - RNA, 16 nt, Homo sapiens
caucacagaacauccu

SEQ ID NO: 2059135 - RNA, 21 nt, Homo sapiens
cagccaaccucauugcagcua

SEQ ID NO: 2059136 - RNA, 14 nt, Homo sapiens
ugaccugacagccc

SEQ ID NO: 2059137 - RNA, 22 nt, Homo sapiens
caaagaguauguuguaagaaag

SEQ ID NO: 2059138 - RNA, 14 nt, Homo sapiens
agcucucccaguga

SEQ ID NO: 2059139 - RNA, 22 nt, Homo sapiens
acagcccuuccucccauuuccc

SEQ ID NO: 2059140 - RNA, 14 nt, Homo sapiens
agaucuuacaggua

SEQ ID NO: 2059141 - RNA, 19 nt, Homo sapiens
aauuuaucuuuaccaaaaa

SEQ ID NO: 2059142 - RNA, 21 nt, Homo sapiens
aguuauuucaaaaauuugcau

SEQ ID NO: 2059143 - RNA, 22 nt, Homo sapiens
ggcaccuacaagguugugcccu

SEQ ID NO: 2059144 - RNA, 22 nt, Homo sapiens
uacuaaauaaaaaaaugaauau

SEQ ID NO: 2059145 - RNA, 20 nt, Homo sapiens
auguacacacacagaugcac

SEQ ID NO: 2059146 - RNA, 15 nt, Homo sapiens
ugaaauaugugauuu

SEQ ID NO: 2059147 - RNA, 16 nt, Homo sapiens
cuggacugucuaugaa

SEQ ID NO: 2059148 - RNA, 13 nt, Homo sapiens
gcagaacuuucac

SEQ ID NO: 2059149 - RNA, 13 nt, Homo sapiens
uccgcacuguaaa

SEQ ID NO: 2059150 - RNA, 16 nt, Homo sapiens
ucaaaguguaacagau

SEQ ID NO: 2059151 - RNA, 14 nt, Homo sapiens
ugggacauugccuu

SEQ ID NO: 2059152 - RNA, 17 nt, Homo sapiens
agaaaacuucagagaaa

SEQ ID NO: 2059153 - RNA, 13 nt, Homo sapiens
ucuccuguaaaac

SEQ ID NO: 2059154 - RNA, 13 nt, Homo sapiens
aaucauguucaaa

SEQ ID NO: 2059155 - RNA, 23 nt, Homo sapiens
uguugaugaggcagaugccucua

SEQ ID NO: 2059156 - RNA, 13 nt, Homo sapiens
ccaacuauaauua

SEQ ID NO: 2059157 - RNA, 12 nt, Homo sapiens
acagaguaucuu

SEQ ID NO: 2059158 - RNA, 13 nt, Homo sapiens
uaagcuuuccauu

SEQ ID NO: 2059159 - RNA, 18 nt, Homo sapiens
cuguuuguuuuuguacau

SEQ ID NO: 2059160 - RNA, 17 nt, Homo sapiens
ccuuccuuucuccagga

SEQ ID NO: 2059161 - RNA, 21 nt, Homo sapiens
accaguuggagcagaugccuc

SEQ ID NO: 2059162 - RNA, 15 nt, Homo sapiens
auccugagaaguacc

SEQ ID NO: 2059163 - RNA, 12 nt, Homo sapiens
agccucccaagu

SEQ ID NO: 2059164 - RNA, 12 nt, Homo sapiens
aauauuauuaac

SEQ ID NO: 2059165 - RNA, 16 nt, Homo sapiens
cuuuuuuucuaugaaa

SEQ ID NO: 2059166 - RNA, 22 nt, Homo sapiens
uuaaguaauuuccccacucuga

SEQ ID NO: 2059167 - RNA, 19 nt, Homo sapiens
gcaaaaacuuucaugccuu

SEQ ID NO: 2059168 - RNA, 18 nt, Homo sapiens
aguuguugaaagcugaaa

SEQ ID NO: 2059169 - RNA, 21 nt, Homo sapiens
acucuaguagggagaggcucu

SEQ ID NO: 2059170 - RNA, 15 nt, Homo sapiens
caaaugggugcccgu

SEQ ID NO: 2059171 - RNA, 22 nt, Homo sapiens
caaauuuaauuaaagccuuaag

SEQ ID NO: 2059172 - RNA, 24 nt, Homo sapiens
aaucccucaaaacaaucuugucau

SEQ ID NO: 2059173 - RNA, 15 nt, Homo sapiens
cuuucaaaagggaag

SEQ ID NO: 2059174 - RNA, 14 nt, Homo sapiens
gagggagugucugu

SEQ ID NO: 2059175 - RNA, 12 nt, Homo sapiens
agauaaugccac

SEQ ID NO: 2059176 - RNA, 18 nt, Homo sapiens
acccagaaagaauguuca

SEQ ID NO: 2059177 - RNA, 15 nt, Homo sapiens
cccauccccuagugc

SEQ ID NO: 2059178 - RNA, 19 nt, Homo sapiens
gccagaugugaaaacaucu

SEQ ID NO: 2059179 - RNA, 23 nt, Homo sapiens
accacucaggccaacaagccaac

SEQ ID NO: 2059180 - RNA, 20 nt, Homo sapiens
agccaaauuuaaaacuguug

SEQ ID NO: 2059181 - RNA, 16 nt, Homo sapiens
agccuugaaaacaaac

SEQ ID NO: 2059182 - RNA, 20 nt, Homo sapiens
caaauaaugaguaguguaaa

SEQ ID NO: 2059183 - RNA, 18 nt, Homo sapiens
ccugagaucucugcagga

SEQ ID NO: 2059184 - RNA, 12 nt, Homo sapiens
gcaauugcucau

SEQ ID NO: 2059185 - RNA, 15 nt, Homo sapiens
agaaaccacuagaaa

SEQ ID NO: 2059186 - RNA, 17 nt, Homo sapiens
gagccagucuaguuccu

SEQ ID NO: 2059187 - RNA, 20 nt, Homo sapiens
cuaaagccaaggguauccaa

SEQ ID NO: 2059188 - RNA, 21 nt, Homo sapiens
auguaaaaaccuuguagauag

SEQ ID NO: 2059189 - RNA, 18 nt, Homo sapiens
aucaccaaaaaaucuaua

SEQ ID NO: 2059190 - RNA, 12 nt, Homo sapiens
augaacugguga

SEQ ID NO: 2059191 - RNA, 17 nt, Homo sapiens
agauaaucuugugcaaa

SEQ ID NO: 2059192 - RNA, 12 nt, Homo sapiens
ggacuaugacaa

SEQ ID NO: 2059193 - RNA, 15 nt, Homo sapiens
uccagugcaggagac

SEQ ID NO: 2059194 - RNA, 13 nt, Homo sapiens
caagaacugcauc

SEQ ID NO: 2059195 - RNA, 18 nt, Homo sapiens
uucuggggcaacugagag

SEQ ID NO: 2059196 - RNA, 15 nt, Homo sapiens
gauuuugcucugucu

SEQ ID NO: 2059197 - RNA, 17 nt, Homo sapiens
ucuagugccacacucca

SEQ ID NO: 2059198 - RNA, 14 nt, Homo sapiens
cauacucaagguga

SEQ ID NO: 2059199 - RNA, 14 nt, Homo sapiens
uacucccagcacuu

SEQ ID NO: 2059200 - RNA, 19 nt, Homo sapiens
auauucugauguuucucau

SEQ ID NO: 2059201 - RNA, 22 nt, Homo sapiens
uuucauacauuauauuccucua

SEQ ID NO: 2059202 - RNA, 15 nt, Homo sapiens
uggacacacacagcu

SEQ ID NO: 2059203 - RNA, 19 nt, Homo sapiens
cccagagcaccugcugucu

SEQ ID NO: 2059204 - RNA, 14 nt, Homo sapiens
uauuuuaacuacuu

SEQ ID NO: 2059205 - RNA, 16 nt, Homo sapiens
ucauccaucacagauc

SEQ ID NO: 2059206 - RNA, 17 nt, Homo sapiens
gcccaggcuggagugca

SEQ ID NO: 2059207 - RNA, 16 nt, Homo sapiens
agucagcaguccuagc

SEQ ID NO: 2059208 - RNA, 19 nt, Homo sapiens
agugaacacucuacuacau

SEQ ID NO: 2059209 - RNA, 14 nt, Homo sapiens
uuggcuuacguaag

SEQ ID NO: 2059210 - RNA, 22 nt, Homo sapiens
ucuggccguccuugucucuggg

SEQ ID NO: 2059211 - RNA, 21 nt, Homo sapiens
aucacuggcucucuaauucca

SEQ ID NO: 2059212 - RNA, 19 nt, Homo sapiens
gacuggucaccuugcacuc

SEQ ID NO: 2059213 - RNA, 13 nt, Homo sapiens
cguccuccgucca

SEQ ID NO: 2059214 - RNA, 15 nt, Homo sapiens
ucaccuuagugcaac

SEQ ID NO: 2059215 - RNA, 22 nt, Homo sapiens
ccagagccaggggggugaggag

SEQ ID NO: 2059216 - RNA, 14 nt, Homo sapiens
caguguuaauacug

SEQ ID NO: 2059217 - RNA, 15 nt, Homo sapiens
acagauuuguaacau

SEQ ID NO: 2059218 - RNA, 18 nt, Homo sapiens
uauaaaauuaacaguauu

SEQ ID NO: 2059219 - RNA, 18 nt, Homo sapiens
agcuuggccuacagucau

SEQ ID NO: 2059220 - RNA, 12 nt, Homo sapiens
ucagaagcacaa

SEQ ID NO: 2059221 - RNA, 14 nt, Homo sapiens
gaggcacaagaauc

SEQ ID NO: 2059222 - RNA, 20 nt, Homo sapiens
ggauccacuuggucugugag

SEQ ID NO: 2059223 - RNA, 17 nt, Homo sapiens
acaaacacaagcaaaac

SEQ ID NO: 2059224 - RNA, 22 nt, Homo sapiens
uugcagggaagccccacuugaa

SEQ ID NO: 2059225 - RNA, 16 nt, Homo sapiens
uccccuaaaccaaaaa

SEQ ID NO: 2059226 - RNA, 21 nt, Homo sapiens
aggcgaucacaacgugcauug

SEQ ID NO: 2059227 - RNA, 19 nt, Homo sapiens
uuuaaaagaaaaaugcugu

SEQ ID NO: 2059228 - RNA, 14 nt, Homo sapiens
uuaaccucagggag

SEQ ID NO: 2059229 - RNA, 22 nt, Homo sapiens
aacgcacaugacauagcacuug

SEQ ID NO: 2059230 - RNA, 13 nt, Homo sapiens
aggcacucaggua

SEQ ID NO: 2059231 - RNA, 15 nt, Homo sapiens
uucaaugcacauuag

SEQ ID NO: 2059232 - RNA, 18 nt, Homo sapiens
uagauuucucauuugcca

SEQ ID NO: 2059233 - RNA, 19 nt, Homo sapiens
uccccuccaaaaccuccau

SEQ ID NO: 2059234 - RNA, 14 nt, Homo sapiens
ucagcaccagugaa

SEQ ID NO: 2059235 - RNA, 23 nt, Homo sapiens
uacaacugaucauuugcagcugc

SEQ ID NO: 2059236 - RNA, 19 nt, Homo sapiens
gucuucccugaucaaguca

SEQ ID NO: 2059237 - RNA, 16 nt, Homo sapiens
auugcaccuggaugua

SEQ ID NO: 2059238 - RNA, 14 nt, Homo sapiens
uccagaugcuauca

SEQ ID NO: 2059239 - RNA, 18 nt, Homo sapiens
uuaauaccacagcuauuu

SEQ ID NO: 2059240 - RNA, 21 nt, Homo sapiens
agacuugauuuacaagcauca

SEQ ID NO: 2059241 - RNA, 19 nt, Homo sapiens
ugaggguucaccucugccu

SEQ ID NO: 2059242 - RNA, 16 nt, Homo sapiens
gagagggucacugggg

SEQ ID NO: 2059243 - RNA, 19 nt, Homo sapiens
ugccccacuucauggauuu

SEQ ID NO: 2059244 - RNA, 21 nt, Homo sapiens
gcugugaguuugggccccaga

SEQ ID NO: 2059245 - RNA, 17 nt, Homo sapiens
aaggcccuuuucagggc

SEQ ID NO: 2059246 - RNA, 18 nt, Homo sapiens
uacaaaaaaaucuuccaa

SEQ ID NO: 2059247 - RNA, 19 nt, Homo sapiens
aucugcaacaaaaagucau

SEQ ID NO: 2059248 - RNA, 21 nt, Homo sapiens
ugaagaguuuacugaagcaaa

SEQ ID NO: 2059249 - RNA, 15 nt, Homo sapiens
aagccaggugccacc

SEQ ID NO: 2059250 - RNA, 16 nt, Homo sapiens
guuccuggaauggcac

SEQ ID NO: 2059251 - RNA, 22 nt, Homo sapiens
ugcucagcccugcaccaugcug

SEQ ID NO: 2059252 - RNA, 16 nt, Homo sapiens
ggcuuccggcugagcu

SEQ ID NO: 2059253 - RNA, 22 nt, Homo sapiens
aaaguuggggacaugcugcuac

SEQ ID NO: 2059254 - RNA, 11 nt, Homo sapiens
gcaaagcccca

SEQ ID NO: 2059255 - RNA, 15 nt, Homo sapiens
aguuuauaaagccaa

SEQ ID NO: 2059256 - RNA, 15 nt, Homo sapiens
agucaaauuuguaaa

SEQ ID NO: 2059257 - RNA, 12 nt, Homo sapiens
uccuccaggcaa

SEQ ID NO: 2059258 - RNA, 16 nt, Homo sapiens
auuuggagccaggaug

SEQ ID NO: 2059259 - RNA, 16 nt, Homo sapiens
aauaaaaucauguauc

SEQ ID NO: 2059260 - RNA, 21 nt, Homo sapiens
gccugggaugauguuggucaa

SEQ ID NO: 2059261 - RNA, 18 nt, Homo sapiens
uacacauacaggauuuga

SEQ ID NO: 2059262 - RNA, 11 nt, Homo sapiens
acucugucagg

SEQ ID NO: 2059263 - RNA, 19 nt, Homo sapiens
cacagcaucagcucaagac

SEQ ID NO: 2059264 - RNA, 14 nt, Homo sapiens
gcuuucuagccuaa

SEQ ID NO: 2059265 - RNA, 18 nt, Homo sapiens
aggguuacugacguguaa

SEQ ID NO: 2059266 - RNA, 19 nt, Homo sapiens
aaugaggauauaguagcca

SEQ ID NO: 2059267 - RNA, 18 nt, Homo sapiens
ccaagggcagaccuuucu

SEQ ID NO: 2059268 - RNA, 22 nt, Homo sapiens
ccaucauugaugaucacuguga

SEQ ID NO: 2059269 - RNA, 18 nt, Homo sapiens
ugaauuuagcaaccuaga

SEQ ID NO: 2059270 - RNA, 15 nt, Homo sapiens
agcuacuugaaggac

SEQ ID NO: 2059271 - RNA, 18 nt, Homo sapiens
agagaggaaccaauaccu

SEQ ID NO: 2059272 - RNA, 14 nt, Homo sapiens
ugucagcacuguaa

SEQ ID NO: 2059273 - RNA, 18 nt, Homo sapiens
cgaagugccagaacccaa

SEQ ID NO: 2059274 - RNA, 17 nt, Homo sapiens
uaaaauaagaaugauuu

SEQ ID NO: 2059275 - RNA, 23 nt, Homo sapiens
ucucuucccugcgccugugaugc

SEQ ID NO: 2059276 - RNA, 20 nt, Homo sapiens
auugcacuccagccuaggca

SEQ ID NO: 2059277 - RNA, 16 nt, Homo sapiens
agaaugguaaaauacc

SEQ ID NO: 2059278 - RNA, 16 nt, Homo sapiens
uaccuguacacugacu

SEQ ID NO: 2059279 - RNA, 13 nt, Homo sapiens
ccuucucaccuca

SEQ ID NO: 2059280 - RNA, 14 nt, Homo sapiens
caccuucguuuacu

SEQ ID NO: 2059281 - RNA, 19 nt, Homo sapiens
uccucuggauggcaccaga

SEQ ID NO: 2059282 - RNA, 20 nt, Homo sapiens
guuuuuagauuaaacaaaca

SEQ ID NO: 2059283 - RNA, 14 nt, Homo sapiens
uauuuuuugcaagu

SEQ ID NO: 2059284 - RNA, 16 nt, Homo sapiens
gauaccuuccaucuca

SEQ ID NO: 2059285 - RNA, 20 nt, Homo sapiens
aacaaccuuuucucuggaca

SEQ ID NO: 2059286 - RNA, 17 nt, Homo sapiens
uugguuucaaauccuuu

SEQ ID NO: 2059287 - RNA, 21 nt, Homo sapiens
ugccuaauuuugaacuaguaa

SEQ ID NO: 2059288 - RNA, 14 nt, Homo sapiens
uccuggcugagaga

SEQ ID NO: 2059289 - RNA, 13 nt, Homo sapiens
gacucgccagcuc

SEQ ID NO: 2059290 - RNA, 17 nt, Homo sapiens
cacaacgcaccagacac

SEQ ID NO: 2059291 - RNA, 19 nt, Homo sapiens
acaaaauuuaauuguguaa

SEQ ID NO: 2059292 - RNA, 19 nt, Homo sapiens
gggaaaauacguugaggga

SEQ ID NO: 2059293 - RNA, 16 nt, Homo sapiens
ucccagcuacucggga

SEQ ID NO: 2059294 - RNA, 14 nt, Homo sapiens
gagaccaggccuca

SEQ ID NO: 2059295 - RNA, 22 nt, Homo sapiens
aaagaggaugcuuagucuuaaa

SEQ ID NO: 2059296 - RNA, 13 nt, Homo sapiens
aacaaaaugguaa

SEQ ID NO: 2059297 - RNA, 21 nt, Homo sapiens
uuuccggaaacaaaauccuuu

SEQ ID NO: 2059298 - RNA, 19 nt, Homo sapiens
ccucaaagauucugcauuu

SEQ ID NO: 2059299 - RNA, 14 nt, Homo sapiens
aagccauuaugaua

SEQ ID NO: 2059300 - RNA, 14 nt, Homo sapiens
cuuauauucaucca

SEQ ID NO: 2059301 - RNA, 14 nt, Homo sapiens
guccuuuugacacu

SEQ ID NO: 2059302 - RNA, 14 nt, Homo sapiens
cauucacaucucau

SEQ ID NO: 2059303 - RNA, 12 nt, Homo sapiens
cucgucuuucag

SEQ ID NO: 2059304 - RNA, 12 nt, Homo sapiens
cucuucuuucau

SEQ ID NO: 2059305 - RNA, 21 nt, Homo sapiens
cuucccaaucagcacugaaaa

SEQ ID NO: 2059306 - RNA, 23 nt, Homo sapiens
agguugccccuuccccaucucca

SEQ ID NO: 2059307 - RNA, 19 nt, Homo sapiens
uuggaagaggcugagacau

SEQ ID NO: 2059308 - RNA, 20 nt, Homo sapiens
ucacggcugcgcacuguguc

SEQ ID NO: 2059309 - RNA, 17 nt, Homo sapiens
caucaucucuuccucac

SEQ ID NO: 2059310 - RNA, 15 nt, Homo sapiens
uugcucucauuucaa

SEQ ID NO: 2059311 - RNA, 20 nt, Homo sapiens
ugcacccucauucccucggg

SEQ ID NO: 2059312 - RNA, 16 nt, Homo sapiens
agacaagucugaguag

SEQ ID NO: 2059313 - RNA, 20 nt, Homo sapiens
acuggaaugaagaccaugcc

SEQ ID NO: 2059314 - RNA, 14 nt, Homo sapiens
cuccccugcuccca

SEQ ID NO: 2059315 - RNA, 14 nt, Homo sapiens
uauaucuguauaua

SEQ ID NO: 2059316 - RNA, 14 nt, Homo sapiens
ugcuccugugcuca

SEQ ID NO: 2059317 - RNA, 15 nt, Homo sapiens
cagucuggcaugcag

SEQ ID NO: 2059318 - RNA, 20 nt, Homo sapiens
ccaagcccaauacagccauu

SEQ ID NO: 2059319 - RNA, 21 nt, Homo sapiens
ucuuugccggaggaaaagcag

SEQ ID NO: 2059320 - RNA, 18 nt, Homo sapiens
aaagauugcagcauuuau

SEQ ID NO: 2059321 - RNA, 22 nt, Homo sapiens
ucuugagauguauuaugcaaag

SEQ ID NO: 2059322 - RNA, 15 nt, Homo sapiens
aauccguaucugcag

SEQ ID NO: 2059323 - RNA, 13 nt, Homo sapiens
auaagccacuucc

SEQ ID NO: 2059324 - RNA, 17 nt, Homo sapiens
guccucucccugccaag

SEQ ID NO: 2059325 - RNA, 14 nt, Homo sapiens
gaggguacuugaau

SEQ ID NO: 2059326 - RNA, 19 nt, Homo sapiens
acaugucuuguacaugugu

SEQ ID NO: 2059327 - RNA, 19 nt, Homo sapiens
aaaugcuccuccuccaugc

SEQ ID NO: 2059328 - RNA, 15 nt, Homo sapiens
ggccucauuugcucu

SEQ ID NO: 2059329 - RNA, 15 nt, Homo sapiens
ugcgcaauguggcau

SEQ ID NO: 2059330 - RNA, 15 nt, Homo sapiens
agccugaguuugcuu

SEQ ID NO: 2059331 - RNA, 22 nt, Homo sapiens
ugggguuuuggacacacgguca

SEQ ID NO: 2059332 - RNA, 14 nt, Homo sapiens
gcugagacugcuga

SEQ ID NO: 2059333 - RNA, 17 nt, Homo sapiens
gggcuacugugaccaug

SEQ ID NO: 2059334 - RNA, 13 nt, Homo sapiens
uuuaaaaagaaga

SEQ ID NO: 2059335 - RNA, 20 nt, Homo sapiens
ugcacagugacuucugagau

SEQ ID NO: 2059336 - RNA, 15 nt, Homo sapiens
ucccaggcucaagcu

SEQ ID NO: 2059337 - RNA, 14 nt, Homo sapiens
auauucaagugaua

SEQ ID NO: 2059338 - RNA, 13 nt, Homo sapiens
gugguaugaaaug

SEQ ID NO: 2059339 - RNA, 20 nt, Homo sapiens
ggcacugcuggguggcccau

SEQ ID NO: 2059340 - RNA, 21 nt, Homo sapiens
agucacaugcguaaacgacac

SEQ ID NO: 2059341 - RNA, 20 nt, Homo sapiens
ccuaggguccuguccaugcc

SEQ ID NO: 2059342 - RNA, 20 nt, Homo sapiens
uuuuuaauagcuauggaauc

SEQ ID NO: 2059343 - RNA, 12 nt, Homo sapiens
agagggaccaga

SEQ ID NO: 2059344 - RNA, 14 nt, Homo sapiens
uccucgggaugaaa

SEQ ID NO: 2059345 - RNA, 20 nt, Homo sapiens
uguacacacuuuauuuacuu

SEQ ID NO: 2059346 - RNA, 16 nt, Homo sapiens
cuuguacuacacagaa

SEQ ID NO: 2059347 - RNA, 17 nt, Homo sapiens
accccaucuuuacuaaa

SEQ ID NO: 2059348 - RNA, 18 nt, Homo sapiens
aacagcagcagugccaua

SEQ ID NO: 2059349 - RNA, 15 nt, Homo sapiens
uacaaagacagggaa

SEQ ID NO: 2059350 - RNA, 23 nt, Homo sapiens
ucuaccugaacugaaaggacugu

SEQ ID NO: 2059351 - RNA, 22 nt, Homo sapiens
accucauaucaguuugcuagca

SEQ ID NO: 2059352 - RNA, 15 nt, Homo sapiens
gaaaaacagacaaaa

SEQ ID NO: 2059353 - RNA, 13 nt, Homo sapiens
cauugcacuccag

SEQ ID NO: 2059354 - RNA, 13 nt, Homo sapiens
cauuccacuccac

SEQ ID NO: 2059355 - RNA, 22 nt, Homo sapiens
acaauccuccaagaauuugacu

SEQ ID NO: 2059356 - RNA, 21 nt, Homo sapiens
uugcaaaguaucccuacugua

SEQ ID NO: 2059357 - RNA, 15 nt, Homo sapiens
cuucgaccacagcaa

SEQ ID NO: 2059358 - RNA, 22 nt, Homo sapiens
acauuggaagcucccaccccau

SEQ ID NO: 2059359 - RNA, 23 nt, Homo sapiens
gcugaaagggaaggacagcugug

SEQ ID NO: 2059360 - RNA, 15 nt, Homo sapiens
ugaaaauucuugaua

SEQ ID NO: 2059361 - RNA, 20 nt, Homo sapiens
aguccuguugaagacuuccu

SEQ ID NO: 2059362 - RNA, 17 nt, Homo sapiens
uacucuaaagcuucuau

SEQ ID NO: 2059363 - RNA, 23 nt, Homo sapiens
cacugucaaguguuuuacuaucu

SEQ ID NO: 2059364 - RNA, 17 nt, Homo sapiens
gcaccccccaagcuguu

SEQ ID NO: 2059365 - RNA, 16 nt, Homo sapiens
uaaugguuauauguau

SEQ ID NO: 2059366 - RNA, 16 nt, Homo sapiens
uugaugaaaagauuua

SEQ ID NO: 2059367 - RNA, 22 nt, Homo sapiens
aagccuuggggcugaugcaguu

SEQ ID NO: 2059368 - RNA, 17 nt, Homo sapiens
uauuuaccagaccacaa

SEQ ID NO: 2059369 - RNA, 19 nt, Homo sapiens
ucacuucccguagcugcca

SEQ ID NO: 2059370 - RNA, 17 nt, Homo sapiens
gcggcggaaagccugua

SEQ ID NO: 2059371 - RNA, 13 nt, Homo sapiens
aagauuaaauggg

SEQ ID NO: 2059372 - RNA, 21 nt, Homo sapiens
cuacuugagauaaucuaaaua

SEQ ID NO: 2059373 - RNA, 15 nt, Homo sapiens
ccagggcauguguau

SEQ ID NO: 2059374 - RNA, 16 nt, Homo sapiens
agugccuuauucucac

SEQ ID NO: 2059375 - RNA, 14 nt, Homo sapiens
ccaaguuuauauac

SEQ ID NO: 2059376 - RNA, 17 nt, Homo sapiens
uuagccaggaggccagg

SEQ ID NO: 2059377 - RNA, 17 nt, Homo sapiens
augcugauaaacugauu

SEQ ID NO: 2059378 - RNA, 16 nt, Homo sapiens
cagacuuuugugaaca

SEQ ID NO: 2059379 - RNA, 22 nt, Homo sapiens
ccugucccaccccuaccucuag

SEQ ID NO: 2059380 - RNA, 12 nt, Homo sapiens
auuugauaccau

SEQ ID NO: 2059381 - RNA, 20 nt, Homo sapiens
agacacaguguacuugucaa

SEQ ID NO: 2059382 - RNA, 22 nt, Homo sapiens
acccacugaaaugaccaagaca

SEQ ID NO: 2059383 - RNA, 13 nt, Homo sapiens
aaaugaccaguuu

SEQ ID NO: 2059384 - RNA, 23 nt, Homo sapiens
uacgaaacacaaaccacaacuga

SEQ ID NO: 2059385 - RNA, 15 nt, Homo sapiens
uguccaccacugacu

SEQ ID NO: 2059386 - RNA, 19 nt, Homo sapiens
cuaggccuacaugcuuugu

SEQ ID NO: 2059387 - RNA, 16 nt, Homo sapiens
ugcaggacaacucugu

SEQ ID NO: 2059388 - RNA, 15 nt, Homo sapiens
gcaaguccacugggg

SEQ ID NO: 2059389 - RNA, 18 nt, Homo sapiens
gggacacucgggcccaug

SEQ ID NO: 2059390 - RNA, 18 nt, Homo sapiens
cucuguccaaacauuuca

SEQ ID NO: 2059391 - RNA, 16 nt, Homo sapiens
acccaccuggcuucau

SEQ ID NO: 2059392 - RNA, 20 nt, Homo sapiens
guagaaaagaaaacauuuaa

SEQ ID NO: 2059393 - RNA, 22 nt, Homo sapiens
gggccccugucgucaggaccuc

SEQ ID NO: 2059394 - RNA, 23 nt, Homo sapiens
ugcauuuucuucacagugcagcu

SEQ ID NO: 2059395 - RNA, 16 nt, Homo sapiens
gcugauuucuagugua

SEQ ID NO: 2059396 - RNA, 16 nt, Homo sapiens
aacuuagcuugcacau

SEQ ID NO: 2059397 - RNA, 12 nt, Homo sapiens
ccuguugcccuu

SEQ ID NO: 2059398 - RNA, 22 nt, Homo sapiens
gcagccuccagugggaggacag

SEQ ID NO: 2059399 - RNA, 12 nt, Homo sapiens
ugacucuugggg

SEQ ID NO: 2059400 - RNA, 19 nt, Homo sapiens
ccauaaccccaggcauccc

SEQ ID NO: 2059401 - RNA, 22 nt, Homo sapiens
cugacugauagcuuacacugag

SEQ ID NO: 2059402 - RNA, 16 nt, Homo sapiens
aaagucaagauuucca

SEQ ID NO: 2059403 - RNA, 22 nt, Homo sapiens
ccagcuuuguuuuuggcauuuc

SEQ ID NO: 2059404 - RNA, 23 nt, Homo sapiens
gggugugugcagcauuguuggcu

SEQ ID NO: 2059405 - RNA, 18 nt, Homo sapiens
ucuaggagucaacuggcu

SEQ ID NO: 2059406 - RNA, 19 nt, Homo sapiens
ggauaggcaggaacauaca

SEQ ID NO: 2059407 - RNA, 22 nt, Homo sapiens
uuaauaaagcauucuuuaacag

SEQ ID NO: 2059408 - RNA, 18 nt, Homo sapiens
cucugccugaaggcucac

SEQ ID NO: 2059409 - RNA, 13 nt, Homo sapiens
auuaacugugaaa

SEQ ID NO: 2059410 - RNA, 16 nt, Homo sapiens
gaugaugacugaaaau

SEQ ID NO: 2059411 - RNA, 18 nt, Homo sapiens
gaaauuaacucagacaca

SEQ ID NO: 2059412 - RNA, 21 nt, Homo sapiens
uuucagcccccccacuccagc

SEQ ID NO: 2059413 - RNA, 21 nt, Homo sapiens
uguugaaaacccagacugucu

SEQ ID NO: 2059414 - RNA, 19 nt, Homo sapiens
cauuuguugccagauuuca

SEQ ID NO: 2059415 - RNA, 21 nt, Homo sapiens
aacuggaaugcuguuacuuug

SEQ ID NO: 2059416 - RNA, 18 nt, Homo sapiens
agcagagugcacagcugu

SEQ ID NO: 2059417 - RNA, 22 nt, Homo sapiens
gcaugguuugauuuugaccugg

SEQ ID NO: 2059418 - RNA, 22 nt, Homo sapiens
cucugccgcugccaugcuuuga

SEQ ID NO: 2059419 - RNA, 16 nt, Homo sapiens
ggauugaaauaaauga

SEQ ID NO: 2059420 - RNA, 12 nt, Homo sapiens
cuucugugugac

SEQ ID NO: 2059421 - RNA, 21 nt, Homo sapiens
aagccuaaagauuuugaucuc

SEQ ID NO: 2059422 - RNA, 23 nt, Homo sapiens
cucacucuugccaaccuguaaua

SEQ ID NO: 2059423 - RNA, 18 nt, Homo sapiens
uguugucaccagaucuga

SEQ ID NO: 2059424 - RNA, 16 nt, Homo sapiens
cacagcugaacuuguu

SEQ ID NO: 2059425 - RNA, 13 nt, Homo sapiens
gcauguguguuca

SEQ ID NO: 2059426 - RNA, 16 nt, Homo sapiens
auuucuaucugcaaau

SEQ ID NO: 2059427 - RNA, 16 nt, Homo sapiens
cagcaagcaauucugc

SEQ ID NO: 2059428 - RNA, 23 nt, Homo sapiens
cccaguccucucccaaguccaca

SEQ ID NO: 2059429 - RNA, 23 nt, Homo sapiens
aaggcucccggaauuccgucacc

SEQ ID NO: 2059430 - RNA, 13 nt, Homo sapiens
ugcuccugggcau

SEQ ID NO: 2059431 - RNA, 24 nt, Homo sapiens
ugaguauuccaugagcugcucauu

SEQ ID NO: 2059432 - RNA, 20 nt, Homo sapiens
uacaauuaaaacuaagcaca

SEQ ID NO: 2059433 - RNA, 22 nt, Homo sapiens
ccaaggaacucuacuucaguca

SEQ ID NO: 2059434 - RNA, 14 nt, Homo sapiens
ugguugaaaaccac

SEQ ID NO: 2059435 - RNA, 18 nt, Homo sapiens
ccaaguuggagugcaaug

SEQ ID NO: 2059436 - RNA, 21 nt, Homo sapiens
aaaauggucacguuuggugcu

SEQ ID NO: 2059437 - RNA, 18 nt, Homo sapiens
uugacuucucuugaauua

SEQ ID NO: 2059438 - RNA, 17 nt, Homo sapiens
acuccuagauccaggga

SEQ ID NO: 2059439 - RNA, 13 nt, Homo sapiens
auuuauaucuaau

SEQ ID NO: 2059440 - RNA, 13 nt, Homo sapiens
ucuccagccucag

SEQ ID NO: 2059441 - RNA, 18 nt, Homo sapiens
uaugugaucagcuuucaa

SEQ ID NO: 2059442 - RNA, 16 nt, Homo sapiens
gaaauuuacugugaga

SEQ ID NO: 2059443 - RNA, 16 nt, Homo sapiens
agauagcauuggggac

SEQ ID NO: 2059444 - RNA, 17 nt, Homo sapiens
agcagguuucaaggaag

SEQ ID NO: 2059445 - RNA, 13 nt, Homo sapiens
aacccucacugug

SEQ ID NO: 2059446 - RNA, 17 nt, Homo sapiens
cccacacaagacccaag

SEQ ID NO: 2059447 - RNA, 19 nt, Homo sapiens
ugcugacagauguuccauc

SEQ ID NO: 2059448 - RNA, 16 nt, Homo sapiens
agugacccugcucuca

SEQ ID NO: 2059449 - RNA, 17 nt, Homo sapiens
ucccuuuuccugucagu

SEQ ID NO: 2059450 - RNA, 19 nt, Homo sapiens
uuucaaaauuguugcaucc

SEQ ID NO: 2059451 - RNA, 23 nt, Homo sapiens
uucgcgaauccguaucugcagaa

SEQ ID NO: 2059452 - RNA, 22 nt, Homo sapiens
gccccacccuggaaugccaaug

SEQ ID NO: 2059453 - RNA, 23 nt, Homo sapiens
aaaugcagauauugcgccugugu

SEQ ID NO: 2059454 - RNA, 18 nt, Homo sapiens
ggguuagcucacgugucu

SEQ ID NO: 2059455 - RNA, 21 nt, Homo sapiens
cuugagagaaaaagugccccu

SEQ ID NO: 2059456 - RNA, 22 nt, Homo sapiens
uuacaucaugcuggaaccugca

SEQ ID NO: 2059457 - RNA, 10 nt, Homo sapiens
gaucuaccug

SEQ ID NO: 2059458 - RNA, 14 nt, Homo sapiens
acugagcacugaac

SEQ ID NO: 2059459 - RNA, 17 nt, Homo sapiens
ccccauccaacacugga

SEQ ID NO: 2059460 - RNA, 15 nt, Homo sapiens
ggaaguuuguucacu

SEQ ID NO: 2059461 - RNA, 14 nt, Homo sapiens
aaaugacccaaaga

SEQ ID NO: 2059462 - RNA, 18 nt, Homo sapiens
ccuccaggggucuugggu

SEQ ID NO: 2059463 - RNA, 16 nt, Homo sapiens
gcuucacaaaaugcac

SEQ ID NO: 2059464 - RNA, 16 nt, Homo sapiens
ugaguaguaaucucac

SEQ ID NO: 2059465 - RNA, 16 nt, Homo sapiens
ccagaacuauuuauuu

SEQ ID NO: 2059466 - RNA, 19 nt, Homo sapiens
aacaaaccuuaaacaccca

SEQ ID NO: 2059467 - RNA, 18 nt, Homo sapiens
caggccuuaccgcucugu

SEQ ID NO: 2059468 - RNA, 22 nt, Homo sapiens
gagagaucauagcucacuguaa

SEQ ID NO: 2059469 - RNA, 14 nt, Homo sapiens
uuuaaaaaagcaaa

SEQ ID NO: 2059470 - RNA, 23 nt, Homo sapiens
cagccuccccaguagcugggauu

SEQ ID NO: 2059471 - RNA, 17 nt, Homo sapiens
cagaaaucacugugaaa

SEQ ID NO: 2059472 - RNA, 15 nt, Homo sapiens
cugaacauugcauau

SEQ ID NO: 2059473 - RNA, 20 nt, Homo sapiens
uagccaguuccugccuuaac

SEQ ID NO: 2059474 - RNA, 14 nt, Homo sapiens
auaaguaauaucuu

SEQ ID NO: 2059475 - RNA, 16 nt, Homo sapiens
aggcaggacuucucac

SEQ ID NO: 2059476 - RNA, 22 nt, Homo sapiens
aaccccaggcuacugagccacc

SEQ ID NO: 2059477 - RNA, 13 nt, Homo sapiens
uguugagugagau

SEQ ID NO: 2059478 - RNA, 14 nt, Homo sapiens
acauaauucacucu

SEQ ID NO: 2059479 - RNA, 15 nt, Homo sapiens
ccugcuccaucucau

SEQ ID NO: 2059480 - RNA, 19 nt, Homo sapiens
cugauuccagaacaaauca

SEQ ID NO: 2059481 - RNA, 20 nt, Homo sapiens
ucauauauuuuuaccaucug

SEQ ID NO: 2059482 - RNA, 15 nt, Homo sapiens
ggcuccaaaucugcc

SEQ ID NO: 2059483 - RNA, 11 nt, Homo sapiens
caaaaacuggg

SEQ ID NO: 2059484 - RNA, 13 nt, Homo sapiens
ucaucagugugua

SEQ ID NO: 2059485 - RNA, 13 nt, Homo sapiens
ccauccaguuccu

SEQ ID NO: 2059486 - RNA, 16 nt, Homo sapiens
uguauacaaacaggug

SEQ ID NO: 2059487 - RNA, 21 nt, Homo sapiens
aggaggcccuggugucaggca

SEQ ID NO: 2059488 - RNA, 16 nt, Homo sapiens
ccagcucuaguuuuca

SEQ ID NO: 2059489 - RNA, 15 nt, Homo sapiens
ccuuugccugguaca

SEQ ID NO: 2059490 - RNA, 23 nt, Homo sapiens
cuguuuccuuuuacaauuguuga

SEQ ID NO: 2059491 - RNA, 23 nt, Homo sapiens
cccagcccuccuuaucaaaggac

SEQ ID NO: 2059492 - RNA, 15 nt, Homo sapiens
gugucuuaauuauua

SEQ ID NO: 2059493 - RNA, 21 nt, Homo sapiens
gucuaauccuaguuugcugug

SEQ ID NO: 2059494 - RNA, 16 nt, Homo sapiens
agcucccuguccugaa

SEQ ID NO: 2059495 - RNA, 24 nt, Homo sapiens
agaagaaacgucuauguguacaga

SEQ ID NO: 2059496 - RNA, 18 nt, Homo sapiens
cugcacuccagucuggau

SEQ ID NO: 2059497 - RNA, 18 nt, Homo sapiens
caggcacaggucaggggu

SEQ ID NO: 2059498 - RNA, 17 nt, Homo sapiens
auacuggucucaggcca

SEQ ID NO: 2059499 - RNA, 14 nt, Homo sapiens
ugggaaggcuuuca

SEQ ID NO: 2059500 - RNA, 16 nt, Homo sapiens
uggaagaaauggcuau

SEQ ID NO: 2059501 - RNA, 14 nt, Homo sapiens
uaaauuuugugaua

SEQ ID NO: 2059502 - RNA, 17 nt, Homo sapiens
acagcuggagcucucaa

SEQ ID NO: 2059503 - RNA, 19 nt, Homo sapiens
ugugagcauuaaauaaagg

SEQ ID NO: 2059504 - RNA, 17 nt, Homo sapiens
ucuuagggcagucagua

SEQ ID NO: 2059505 - RNA, 18 nt, Homo sapiens
aggaauccccaacaugca

SEQ ID NO: 2059506 - RNA, 19 nt, Homo sapiens
accgcggggaccacaucaa

SEQ ID NO: 2059507 - RNA, 12 nt, Homo sapiens
aggucacuccug

SEQ ID NO: 2059508 - RNA, 15 nt, Homo sapiens
ugaguggaaauggaa

SEQ ID NO: 2059509 - RNA, 22 nt, Homo sapiens
aagcucuguggccacauuuuca

SEQ ID NO: 2059510 - RNA, 23 nt, Homo sapiens
uguaaauagaugaccuuuuugca

SEQ ID NO: 2059511 - RNA, 20 nt, Homo sapiens
gccuaccucucguuucugcc

SEQ ID NO: 2059512 - RNA, 23 nt, Homo sapiens
auuacauauugugaauguauacu

SEQ ID NO: 2059513 - RNA, 16 nt, Homo sapiens
uauagacauuauguga

SEQ ID NO: 2059514 - RNA, 11 nt, Homo sapiens
caaacugugaa

SEQ ID NO: 2059515 - RNA, 18 nt, Homo sapiens
aacacaagaauuacacua

SEQ ID NO: 2059516 - RNA, 17 nt, Homo sapiens
guagcagggaguaccca

SEQ ID NO: 2059517 - RNA, 14 nt, Homo sapiens
cucucucacacaca

SEQ ID NO: 2059518 - RNA, 15 nt, Homo sapiens
gcaaggugugaauga

SEQ ID NO: 2059519 - RNA, 15 nt, Homo sapiens
ucaaagaagucaaau

SEQ ID NO: 2059520 - RNA, 20 nt, Homo sapiens
gcauaugggugggauuuugc

SEQ ID NO: 2059521 - RNA, 12 nt, Homo sapiens
ucauggaacuca

SEQ ID NO: 2059522 - RNA, 16 nt, Homo sapiens
ggaacaagaugguucu

SEQ ID NO: 2059523 - RNA, 21 nt, Homo sapiens
ugaaagauguauggauuucca

SEQ ID NO: 2059524 - RNA, 20 nt, Homo sapiens
agccagaaacguaacugugu

SEQ ID NO: 2059525 - RNA, 14 nt, Homo sapiens
cagguccuuuccac

SEQ ID NO: 2059526 - RNA, 19 nt, Homo sapiens
guguuauuauuuugcacug

SEQ ID NO: 2059527 - RNA, 18 nt, Homo sapiens
agaacccuuggagccaau

SEQ ID NO: 2059528 - RNA, 18 nt, Homo sapiens
uuucauaaccuagccuua

SEQ ID NO: 2059529 - RNA, 23 nt, Homo sapiens
uuagaaauauucuacuucucugu

SEQ ID NO: 2059530 - RNA, 22 nt, Homo sapiens
ugauguuuuuucuguaauguaa

SEQ ID NO: 2059531 - RNA, 22 nt, Homo sapiens
aaugacagaaugcuguuuuaaa

SEQ ID NO: 2059532 - RNA, 20 nt, Homo sapiens
uugggcuuguuuucuacuuu

SEQ ID NO: 2059533 - RNA, 19 nt, Homo sapiens
gaauuugaagagauugcug

SEQ ID NO: 2059534 - RNA, 12 nt, Homo sapiens
aaugaauauuua

SEQ ID NO: 2059535 - RNA, 17 nt, Homo sapiens
ucucuugauucugggau

SEQ ID NO: 2059536 - RNA, 18 nt, Homo sapiens
caugauccaaucaccucc

SEQ ID NO: 2059537 - RNA, 15 nt, Homo sapiens
aagaccuugcugaua

SEQ ID NO: 2059538 - RNA, 19 nt, Homo sapiens
cuugagucuccaacggcaa

SEQ ID NO: 2059539 - RNA, 11 nt, Homo sapiens
acccacacagg

SEQ ID NO: 2059540 - RNA, 21 nt, Homo sapiens
cuuugucugugggaaggcaaa

SEQ ID NO: 2059541 - RNA, 12 nt, Homo sapiens
auugucugcaau

SEQ ID NO: 2059542 - RNA, 20 nt, Homo sapiens
uaauacauccauucuacauc

SEQ ID NO: 2059543 - RNA, 16 nt, Homo sapiens
gcucuacccugcagcu

SEQ ID NO: 2059544 - RNA, 16 nt, Homo sapiens
aaaagucagagacaga

SEQ ID NO: 2059545 - RNA, 13 nt, Homo sapiens
gagagacuuggau

SEQ ID NO: 2059546 - RNA, 21 nt, Homo sapiens
caaacaauauugcuccaugau

SEQ ID NO: 2059547 - RNA, 14 nt, Homo sapiens
cucugcagucccag

SEQ ID NO: 2059548 - RNA, 18 nt, Homo sapiens
auggguccauuuugcccu

SEQ ID NO: 2059549 - RNA, 22 nt, Homo sapiens
ugccucucuggacgcucugcac

SEQ ID NO: 2059550 - RNA, 19 nt, Homo sapiens
cagggcugaggaugggcuc

SEQ ID NO: 2059551 - RNA, 20 nt, Homo sapiens
acaucuugucuaauuuucac

SEQ ID NO: 2059552 - RNA, 15 nt, Homo sapiens
uccugcuacccagua

SEQ ID NO: 2059553 - RNA, 15 nt, Homo sapiens
ugaauguaaaaugca

SEQ ID NO: 2059554 - RNA, 12 nt, Homo sapiens
cagaaaugugua

SEQ ID NO: 2059555 - RNA, 17 nt, Homo sapiens
aacucacacaaccauga

SEQ ID NO: 2059556 - RNA, 19 nt, Homo sapiens
cuaaagacaauucauucau

SEQ ID NO: 2059557 - RNA, 22 nt, Homo sapiens
caggaguguaguuggaucucua

SEQ ID NO: 2059558 - RNA, 18 nt, Homo sapiens
auauggaggaggcucugg

SEQ ID NO: 2059559 - RNA, 23 nt, Homo sapiens
uucucuggacacacuaucaccua

SEQ ID NO: 2059560 - RNA, 19 nt, Homo sapiens
ugacuaaagcuauguuaca

SEQ ID NO: 2059561 - RNA, 19 nt, Homo sapiens
aucagcucucugcaaagau

SEQ ID NO: 2059562 - RNA, 18 nt, Homo sapiens
auucauaccuugauggua

SEQ ID NO: 2059563 - RNA, 18 nt, Homo sapiens
aggacagggagaugcugc

SEQ ID NO: 2059564 - RNA, 14 nt, Homo sapiens
agaaacacugccuu

SEQ ID NO: 2059565 - RNA, 14 nt, Homo sapiens
auaaacacuuccuu

SEQ ID NO: 2059566 - RNA, 17 nt, Homo sapiens
caauccaauuaaucaaa

SEQ ID NO: 2059567 - RNA, 19 nt, Homo sapiens
auacgaaacacaaaccaca

SEQ ID NO: 2059568 - RNA, 18 nt, Homo sapiens
auggucaaucccaaaagu

SEQ ID NO: 2059569 - RNA, 20 nt, Homo sapiens
ccuccagcccucucacugug

SEQ ID NO: 2059570 - RNA, 16 nt, Homo sapiens
aaucuaucuauauaau

SEQ ID NO: 2059571 - RNA, 14 nt, Homo sapiens
agggaagcacuugc

SEQ ID NO: 2059572 - RNA, 14 nt, Homo sapiens
ucagccacauucua

SEQ ID NO: 2059573 - RNA, 11 nt, Homo sapiens
auucuacacau

SEQ ID NO: 2059574 - RNA, 13 nt, Homo sapiens
augaacagaauuu

SEQ ID NO: 2059575 - RNA, 21 nt, Homo sapiens
aaaauuauuacuaaugaugcu

SEQ ID NO: 2059576 - RNA, 13 nt, Homo sapiens
aauuaauagcuuu

SEQ ID NO: 2059577 - RNA, 20 nt, Homo sapiens
aaccagugucugaaccaccc

SEQ ID NO: 2059578 - RNA, 22 nt, Homo sapiens
agcugggacuacaaacgugugu

SEQ ID NO: 2059579 - RNA, 22 nt, Homo sapiens
aaucaguaucagaauacuugca

SEQ ID NO: 2059580 - RNA, 18 nt, Homo sapiens
cgucauuuccggacucuc

SEQ ID NO: 2059581 - RNA, 12 nt, Homo sapiens
aaaaaugcugcu

SEQ ID NO: 2059582 - RNA, 20 nt, Homo sapiens
acguagaauaaaaacauaac

SEQ ID NO: 2059583 - RNA, 20 nt, Homo sapiens
ugcuucucccaggcaaggcu

SEQ ID NO: 2059584 - RNA, 17 nt, Homo sapiens
auugacugucacuguuc

SEQ ID NO: 2059585 - RNA, 17 nt, Homo sapiens
aucuuucugaacuguaa

SEQ ID NO: 2059586 - RNA, 20 nt, Homo sapiens
gaacuuugcugagccuguaa

SEQ ID NO: 2059587 - RNA, 22 nt, Homo sapiens
gucucaacuacucagcucuccu

SEQ ID NO: 2059588 - RNA, 20 nt, Homo sapiens
ucgcaucaugccaacuugug

SEQ ID NO: 2059589 - RNA, 15 nt, Homo sapiens
acuguaaacauucau

SEQ ID NO: 2059590 - RNA, 14 nt, Homo sapiens
aggaggccacguga

SEQ ID NO: 2059591 - RNA, 14 nt, Homo sapiens
ugauuaauguuucu

SEQ ID NO: 2059592 - RNA, 23 nt, Homo sapiens
aucaaagauuugucacaucccua

SEQ ID NO: 2059593 - RNA, 15 nt, Homo sapiens
auucggauuugccau

SEQ ID NO: 2059594 - RNA, 21 nt, Homo sapiens
ccagaggaauaacuuagcuug

SEQ ID NO: 2059595 - RNA, 22 nt, Homo sapiens
uucagucauugucuuauaugcu

SEQ ID NO: 2059596 - RNA, 14 nt, Homo sapiens
uccagugcuuuauc

SEQ ID NO: 2059597 - RNA, 21 nt, Homo sapiens
aauuggcucacaguucugcag

SEQ ID NO: 2059598 - RNA, 23 nt, Homo sapiens
uguugauaagaguguaacaucca

SEQ ID NO: 2059599 - RNA, 18 nt, Homo sapiens
cuacccccaguaaaauca

SEQ ID NO: 2059600 - RNA, 19 nt, Homo sapiens
uuagacauuuaucaacugu

SEQ ID NO: 2059601 - RNA, 19 nt, Homo sapiens
ucagagagaggaauggaau

SEQ ID NO: 2059602 - RNA, 17 nt, Homo sapiens
guacaucccauguaaca

SEQ ID NO: 2059603 - RNA, 21 nt, Homo sapiens
caagaagcguuaugugcagua

SEQ ID NO: 2059604 - RNA, 22 nt, Homo sapiens
auuuaucuucauguccagugag

SEQ ID NO: 2059605 - RNA, 19 nt, Homo sapiens
cagaagaaucuuccuggca

SEQ ID NO: 2059606 - RNA, 23 nt, Homo sapiens
ggugagauggacacgcugcgcaa

SEQ ID NO: 2059607 - RNA, 19 nt, Homo sapiens
ugggucugcuggcuucuac

SEQ ID NO: 2059608 - RNA, 16 nt, Homo sapiens
aaaccauuuucaaaag

SEQ ID NO: 2059609 - RNA, 20 nt, Homo sapiens
uaagcuguggcuggaauuga

SEQ ID NO: 2059610 - RNA, 21 nt, Homo sapiens
gagagccaaggccuaugccac

SEQ ID NO: 2059611 - RNA, 21 nt, Homo sapiens
aacuaccaccucaggugacuu

SEQ ID NO: 2059612 - RNA, 21 nt, Homo sapiens
ugcaugucugccuaugcacug

SEQ ID NO: 2059613 - RNA, 17 nt, Homo sapiens
auaaugggaagccugua

SEQ ID NO: 2059614 - RNA, 13 nt, Homo sapiens
aggagggugcagu

SEQ ID NO: 2059615 - RNA, 17 nt, Homo sapiens
uguuucaaaauucucau

SEQ ID NO: 2059616 - RNA, 14 nt, Homo sapiens
aaccugugugccau

SEQ ID NO: 2059617 - RNA, 16 nt, Homo sapiens
guauguuuacacuguc

SEQ ID NO: 2059618 - RNA, 22 nt, Homo sapiens
gccccuucuaggggcaggugaa

SEQ ID NO: 2059619 - RNA, 19 nt, Homo sapiens
agcugucauggugcaauuu

SEQ ID NO: 2059620 - RNA, 15 nt, Homo sapiens
cacuugccgaucugc

SEQ ID NO: 2059621 - RNA, 18 nt, Homo sapiens
uaccagugaaccaaagag

SEQ ID NO: 2059622 - RNA, 17 nt, Homo sapiens
uggaaugagcagcuuua

SEQ ID NO: 2059623 - RNA, 15 nt, Homo sapiens
uagucucuccccugg

SEQ ID NO: 2059624 - RNA, 17 nt, Homo sapiens
uuucuuuugcugaucuu

SEQ ID NO: 2059625 - RNA, 17 nt, Homo sapiens
cacagggagugcacaua

SEQ ID NO: 2059626 - RNA, 21 nt, Homo sapiens
cugugaaacuaaucauaagcu

SEQ ID NO: 2059627 - RNA, 20 nt, Homo sapiens
acuuucccuagaaagccaua

SEQ ID NO: 2059628 - RNA, 15 nt, Homo sapiens
auuugugcugacgau

SEQ ID NO: 2059629 - RNA, 19 nt, Homo sapiens
uaugugaauggaaucauau

SEQ ID NO: 2059630 - RNA, 12 nt, Homo sapiens
gcuucaccaguc

SEQ ID NO: 2059631 - RNA, 21 nt, Homo sapiens
gagaaguucucagaauaacua

SEQ ID NO: 2059632 - RNA, 21 nt, Homo sapiens
uuaaauauccagccaguacag

SEQ ID NO: 2059633 - RNA, 17 nt, Homo sapiens
accaccuaccuuacagu

SEQ ID NO: 2059634 - RNA, 18 nt, Homo sapiens
caaucgagacugcaaugu

SEQ ID NO: 2059635 - RNA, 13 nt, Homo sapiens
ugcauuuguacug

SEQ ID NO: 2059636 - RNA, 13 nt, Homo sapiens
acaguauggcaau

SEQ ID NO: 2059637 - RNA, 18 nt, Homo sapiens
ggccucucccugccugug

SEQ ID NO: 2059638 - RNA, 16 nt, Homo sapiens
acuguaagcuccauga

SEQ ID NO: 2059639 - RNA, 12 nt, Homo sapiens
gauuuuuacaca

SEQ ID NO: 2059640 - RNA, 12 nt, Homo sapiens
aacuaaugauaa

SEQ ID NO: 2059641 - RNA, 16 nt, Homo sapiens
auguggccacaaucca

SEQ ID NO: 2059642 - RNA, 14 nt, Homo sapiens
ugguuccuucccaa

SEQ ID NO: 2059643 - RNA, 14 nt, Homo sapiens
uugagacaggagac

SEQ ID NO: 2059644 - RNA, 19 nt, Homo sapiens
gaucauugaaauucugaga

SEQ ID NO: 2059645 - RNA, 15 nt, Homo sapiens
aaaccaacugugaaa

SEQ ID NO: 2059646 - RNA, 16 nt, Homo sapiens
cacuuggccaccagga

SEQ ID NO: 2059647 - RNA, 22 nt, Homo sapiens
cggccugcccccaccccauucc

SEQ ID NO: 2059648 - RNA, 15 nt, Homo sapiens
uaucaucuuugccaa

SEQ ID NO: 2059649 - RNA, 13 nt, Homo sapiens
cgcgguccugacu

SEQ ID NO: 2059650 - RNA, 16 nt, Homo sapiens
cccacccccaugcacu

SEQ ID NO: 2059651 - RNA, 14 nt, Homo sapiens
uacuuucuaucuca

SEQ ID NO: 2059652 - RNA, 20 nt, Homo sapiens
uauauauuuucauccuauaa

SEQ ID NO: 2059653 - RNA, 15 nt, Homo sapiens
aauaccauguacaua

SEQ ID NO: 2059654 - RNA, 20 nt, Homo sapiens
aaaacucauuacuuuuccau

SEQ ID NO: 2059655 - RNA, 21 nt, Homo sapiens
aaggguaggcacgaagcaauu

SEQ ID NO: 2059656 - RNA, 15 nt, Homo sapiens
gcagaaauacaguau

SEQ ID NO: 2059657 - RNA, 22 nt, Homo sapiens
ucaaucacuauuuauaaacaga

SEQ ID NO: 2059658 - RNA, 20 nt, Homo sapiens
ugcccuguauauaauacuaa

SEQ ID NO: 2059659 - RNA, 14 nt, Homo sapiens
gauagaugcuggcc

SEQ ID NO: 2059660 - RNA, 15 nt, Homo sapiens
aaguguaugauguca

SEQ ID NO: 2059661 - RNA, 18 nt, Homo sapiens
guuuuauuuaaaugcuuu

SEQ ID NO: 2059662 - RNA, 13 nt, Homo sapiens
uugucaugcccuu

SEQ ID NO: 2059663 - RNA, 15 nt, Homo sapiens
uaaagcacuaccuaa

SEQ ID NO: 2059664 - RNA, 13 nt, Homo sapiens
agaaaaacaaauc

SEQ ID NO: 2059665 - RNA, 15 nt, Homo sapiens
acaaucagcugcuuu

SEQ ID NO: 2059666 - RNA, 17 nt, Homo sapiens
agcaaaagaaacuauca

SEQ ID NO: 2059667 - RNA, 17 nt, Homo sapiens
auugcagucacuuugac

SEQ ID NO: 2059668 - RNA, 23 nt, Homo sapiens
ugguaacuuuuuuuuaaagcuca

SEQ ID NO: 2059669 - RNA, 18 nt, Homo sapiens
cuaggaagaucucugcag

SEQ ID NO: 2059670 - RNA, 16 nt, Homo sapiens
acugauacacuugaag

SEQ ID NO: 2059671 - RNA, 12 nt, Homo sapiens
agcuggacaccc

SEQ ID NO: 2059672 - RNA, 14 nt, Homo sapiens
uuucccacacauau

SEQ ID NO: 2059673 - RNA, 14 nt, Homo sapiens
cauauuuaccucag

SEQ ID NO: 2059674 - RNA, 14 nt, Homo sapiens
cuugucacugaaga

SEQ ID NO: 2059675 - RNA, 16 nt, Homo sapiens
gcccacccuccagcuu

SEQ ID NO: 2059676 - RNA, 18 nt, Homo sapiens
cgccaaggcucacaugcu

SEQ ID NO: 2059677 - RNA, 15 nt, Homo sapiens
aucucauugcuuaca

SEQ ID NO: 2059678 - RNA, 20 nt, Homo sapiens
acaagguccucugucaguca

SEQ ID NO: 2059679 - RNA, 22 nt, Homo sapiens
ucccacguacuuauaaagaagg

SEQ ID NO: 2059680 - RNA, 17 nt, Homo sapiens
caguguuucuacaauca

SEQ ID NO: 2059681 - RNA, 17 nt, Homo sapiens
gaggacaauacuggggu

SEQ ID NO: 2059682 - RNA, 23 nt, Homo sapiens
cuccugaaaaaaaaccugagauu

SEQ ID NO: 2059683 - RNA, 19 nt, Homo sapiens
uacaauucauuguuuugca

SEQ ID NO: 2059684 - RNA, 22 nt, Homo sapiens
augcuucuacugugacacuuau

SEQ ID NO: 2059685 - RNA, 22 nt, Homo sapiens
acaucacuugagacaaaucuau

SEQ ID NO: 2059686 - RNA, 17 nt, Homo sapiens
agcuauuuaagugauac

SEQ ID NO: 2059687 - RNA, 23 nt, Homo sapiens
cacagauauacacauggaugcac

SEQ ID NO: 2059688 - RNA, 18 nt, Homo sapiens
acaggggccaugccccac

SEQ ID NO: 2059689 - RNA, 15 nt, Homo sapiens
uacuguaaucgugcu

SEQ ID NO: 2059690 - RNA, 17 nt, Homo sapiens
uggccaggugguugucu

SEQ ID NO: 2059691 - RNA, 16 nt, Homo sapiens
cacuccuccuacugua

SEQ ID NO: 2059692 - RNA, 18 nt, Homo sapiens
uccaagugugugugcaau

SEQ ID NO: 2059693 - RNA, 18 nt, Homo sapiens
agugacagagacccagau

SEQ ID NO: 2059694 - RNA, 16 nt, Homo sapiens
cugcccgagagcucuu

SEQ ID NO: 2059695 - RNA, 19 nt, Homo sapiens
guuuauucaacaacuacua

SEQ ID NO: 2059696 - RNA, 20 nt, Homo sapiens
gcuucaauuuauugcacaaa

SEQ ID NO: 2059697 - RNA, 13 nt, Homo sapiens
cggcuuuccucua

SEQ ID NO: 2059698 - RNA, 18 nt, Homo sapiens
uccccugggucaccuccu

SEQ ID NO: 2059699 - RNA, 19 nt, Homo sapiens
acagaugcuuuucugucuc

SEQ ID NO: 2059700 - RNA, 13 nt, Homo sapiens
gcaugagacuuuc

SEQ ID NO: 2059701 - RNA, 22 nt, Homo sapiens
aaauggaugaaugagagaggga

SEQ ID NO: 2059702 - RNA, 17 nt, Homo sapiens
uaaaaccauaaacugua

SEQ ID NO: 2059703 - RNA, 20 nt, Homo sapiens
cuguauaacuaggcuguuaa

SEQ ID NO: 2059704 - RNA, 15 nt, Homo sapiens
guucugacccuggua

SEQ ID NO: 2059705 - RNA, 15 nt, Homo sapiens
cacccucaaauguca

SEQ ID NO: 2059706 - RNA, 20 nt, Homo sapiens
cauuucugagaucaaaacgg

SEQ ID NO: 2059707 - RNA, 13 nt, Homo sapiens
aaguaauuuugca

SEQ ID NO: 2059708 - RNA, 20 nt, Homo sapiens
ugaaacuucauaaauguuca

SEQ ID NO: 2059709 - RNA, 15 nt, Homo sapiens
gcuaagccugaugau

SEQ ID NO: 2059710 - RNA, 20 nt, Homo sapiens
uagaaagcauaacaaaaaga

SEQ ID NO: 2059711 - RNA, 22 nt, Homo sapiens
ggccccaccuguucuuuccucc

SEQ ID NO: 2059712 - RNA, 21 nt, Homo sapiens
aacauuucuuguaggcaucac

SEQ ID NO: 2059713 - RNA, 12 nt, Homo sapiens
agaccugggauu

SEQ ID NO: 2059714 - RNA, 21 nt, Homo sapiens
agccuguccugguacagcagg

SEQ ID NO: 2059715 - RNA, 16 nt, Homo sapiens
gaggagggaggccagg

SEQ ID NO: 2059716 - RNA, 18 nt, Homo sapiens
uuugucacaaauaaacau

SEQ ID NO: 2059717 - RNA, 20 nt, Homo sapiens
aaguucugggcagcuaaaag

SEQ ID NO: 2059718 - RNA, 13 nt, Homo sapiens
gucgacucuccau

SEQ ID NO: 2059719 - RNA, 22 nt, Homo sapiens
cauggugccccaggaccagcuc

SEQ ID NO: 2059720 - RNA, 15 nt, Homo sapiens
gcagggcugcccuga

SEQ ID NO: 2059721 - RNA, 23 nt, Homo sapiens
ggguuuuuaaucuuugugacagg

SEQ ID NO: 2059722 - RNA, 16 nt, Homo sapiens
cugaacugcaacacug

SEQ ID NO: 2059723 - RNA, 17 nt, Homo sapiens
uccaauguacaacuucc

SEQ ID NO: 2059724 - RNA, 16 nt, Homo sapiens
aauaacaauaaaagac

SEQ ID NO: 2059725 - RNA, 19 nt, Homo sapiens
cauggccagcugccaguac

SEQ ID NO: 2059726 - RNA, 18 nt, Homo sapiens
uaagacagagucucacuu

SEQ ID NO: 2059727 - RNA, 20 nt, Homo sapiens
cuggguccaccccaugucac

SEQ ID NO: 2059728 - RNA, 17 nt, Homo sapiens
uuuuaguaaauccuuau

SEQ ID NO: 2059729 - RNA, 21 nt, Homo sapiens
gcaucuuccagaagugugauu

SEQ ID NO: 2059730 - RNA, 14 nt, Homo sapiens
uuuaggucauccaa

SEQ ID NO: 2059731 - RNA, 21 nt, Homo sapiens
uauauguuuauguaacuauca

SEQ ID NO: 2059732 - RNA, 16 nt, Homo sapiens
cugacaaauauuuuag

SEQ ID NO: 2059733 - RNA, 12 nt, Homo sapiens
cuuuauugcacu

SEQ ID NO: 2059734 - RNA, 23 nt, Homo sapiens
acuuuaccaaaugaaaugccaaa

SEQ ID NO: 2059735 - RNA, 23 nt, Homo sapiens
auaauguugguguggaguuuuca

SEQ ID NO: 2059736 - RNA, 16 nt, Homo sapiens
acuaaugaugcuuuua

SEQ ID NO: 2059737 - RNA, 12 nt, Homo sapiens
auaaacugugag

SEQ ID NO: 2059738 - RNA, 21 nt, Homo sapiens
aaagcuuuuagaaauacugca

SEQ ID NO: 2059739 - RNA, 21 nt, Homo sapiens
acacagcacgggggccaagga

SEQ ID NO: 2059740 - RNA, 17 nt, Homo sapiens
uuccaguaaaugcagac

SEQ ID NO: 2059741 - RNA, 21 nt, Homo sapiens
ucuguggaucccuacugcugg

SEQ ID NO: 2059742 - RNA, 19 nt, Homo sapiens
gcagucccuccacauuucc

SEQ ID NO: 2059743 - RNA, 22 nt, Homo sapiens
cagaugaggaacaccacuaucu

SEQ ID NO: 2059744 - RNA, 21 nt, Homo sapiens
aggggcaugguccugcugaau

SEQ ID NO: 2059745 - RNA, 23 nt, Homo sapiens
uuauauuuguaaauuuaugugau

SEQ ID NO: 2059746 - RNA, 17 nt, Homo sapiens
gcccccagccuggccag

SEQ ID NO: 2059747 - RNA, 19 nt, Homo sapiens
guugaauaaauguaucuga

SEQ ID NO: 2059748 - RNA, 13 nt, Homo sapiens
gacugaccaaauc

SEQ ID NO: 2059749 - RNA, 18 nt, Homo sapiens
ccauuauaaaaaauuaaa

SEQ ID NO: 2059750 - RNA, 18 nt, Homo sapiens
aguuggagggaaagccag

SEQ ID NO: 2059751 - RNA, 16 nt, Homo sapiens
uggagacuaaccccac

SEQ ID NO: 2059752 - RNA, 19 nt, Homo sapiens
cugggggaggaacagggcu

SEQ ID NO: 2059753 - RNA, 23 nt, Homo sapiens
aaagaauauuugguuuuccugua

SEQ ID NO: 2059754 - RNA, 21 nt, Homo sapiens
gucccagagcaggaaugggaa

SEQ ID NO: 2059755 - RNA, 23 nt, Homo sapiens
ggcaguuaccauuaaaccaucuc

SEQ ID NO: 2059756 - RNA, 16 nt, Homo sapiens
gauugggcggggcuuc

SEQ ID NO: 2059757 - RNA, 15 nt, Homo sapiens
gaggacgggacagau

SEQ ID NO: 2059758 - RNA, 22 nt, Homo sapiens
gccagccuggcugggacuggga

SEQ ID NO: 2059759 - RNA, 15 nt, Homo sapiens
ccuguaaaacuuuau

SEQ ID NO: 2059760 - RNA, 15 nt, Homo sapiens
caugacaaaauuacu

SEQ ID NO: 2059761 - RNA, 22 nt, Homo sapiens
agccugccagcaguuacuguga

SEQ ID NO: 2059762 - RNA, 14 nt, Homo sapiens
cuuuggaaagccau

SEQ ID NO: 2059763 - RNA, 19 nt, Homo sapiens
aguggaacuaaaauucugu

SEQ ID NO: 2059764 - RNA, 20 nt, Homo sapiens
aacccaggaggcggagguug

SEQ ID NO: 2059765 - RNA, 13 nt, Homo sapiens
uccugaaagccaa

SEQ ID NO: 2059766 - RNA, 24 nt, Homo sapiens
gcuggugcacaugacauuuguccu

SEQ ID NO: 2059767 - RNA, 20 nt, Homo sapiens
gauuucuacauuaacuugaa

SEQ ID NO: 2059768 - RNA, 15 nt, Homo sapiens
cuggcauuacaggug

SEQ ID NO: 2059769 - RNA, 21 nt, Homo sapiens
aaaugugucugcaacauggau

SEQ ID NO: 2059770 - RNA, 23 nt, Homo sapiens
agggucggggcuaggguaggggc

SEQ ID NO: 2059771 - RNA, 12 nt, Homo sapiens
ugauuaucuccc

SEQ ID NO: 2059772 - RNA, 20 nt, Homo sapiens
gaccgcgccccugggacuaa

SEQ ID NO: 2059773 - RNA, 22 nt, Homo sapiens
aguguucugcugagacugagca

SEQ ID NO: 2059774 - RNA, 17 nt, Homo sapiens
uuuaaacuguucugugu

SEQ ID NO: 2059775 - RNA, 22 nt, Homo sapiens
ccuccuaccgaaaccuugccuu

SEQ ID NO: 2059776 - RNA, 17 nt, Homo sapiens
acauagucuguuccuuu

SEQ ID NO: 2059777 - RNA, 21 nt, Homo sapiens
guuucucggcaccagugccuc

SEQ ID NO: 2059778 - RNA, 21 nt, Homo sapiens
agagccuucacugguucugca

SEQ ID NO: 2059779 - RNA, 14 nt, Homo sapiens
gaggaauaaugcgg

SEQ ID NO: 2059780 - RNA, 22 nt, Homo sapiens
cuuaaaaaucuuguacauuaua

SEQ ID NO: 2059781 - RNA, 20 nt, Homo sapiens
ggguuucaccaucuuggcca

SEQ ID NO: 2059782 - RNA, 21 nt, Homo sapiens
acucuaggggucaggcuccau

SEQ ID NO: 2059783 - RNA, 11 nt, Homo sapiens
uugggcaauaa

SEQ ID NO: 2059784 - RNA, 14 nt, Homo sapiens
gcuggggagggaga

SEQ ID NO: 2059785 - RNA, 12 nt, Homo sapiens
ucagacuaugaa

SEQ ID NO: 2059786 - RNA, 17 nt, Homo sapiens
uaguucaguagaauuac

SEQ ID NO: 2059787 - RNA, 19 nt, Homo sapiens
cagucagaguugugcacau

SEQ ID NO: 2059788 - RNA, 14 nt, Homo sapiens
gaucugaaaucauu

SEQ ID NO: 2059789 - RNA, 18 nt, Homo sapiens
acauuauucuucacuuaa

SEQ ID NO: 2059790 - RNA, 17 nt, Homo sapiens
aacucuucaaggccaag

SEQ ID NO: 2059791 - RNA, 21 nt, Homo sapiens
ccaccuccaucaaacgcagac

SEQ ID NO: 2059792 - RNA, 20 nt, Homo sapiens
uguaaaugcuugauggaauu

SEQ ID NO: 2059793 - RNA, 19 nt, Homo sapiens
aacuauugauaugugaaua

SEQ ID NO: 2059794 - RNA, 12 nt, Homo sapiens
ggacauggcuca

SEQ ID NO: 2059795 - RNA, 11 nt, Homo sapiens
gagaagcaauc

SEQ ID NO: 2059796 - RNA, 21 nt, Homo sapiens
uuuaucaguagaagugucaca

SEQ ID NO: 2059797 - RNA, 15 nt, Homo sapiens
cuacuggaauggugu

SEQ ID NO: 2059798 - RNA, 19 nt, Homo sapiens
agguuuuucucauguaucu

SEQ ID NO: 2059799 - RNA, 21 nt, Homo sapiens
acugacuuguuugucuuccau

SEQ ID NO: 2059800 - RNA, 16 nt, Homo sapiens
gccugccuggcaggcu

SEQ ID NO: 2059801 - RNA, 16 nt, Homo sapiens
aagaaaaacaccgcuu

SEQ ID NO: 2059802 - RNA, 16 nt, Homo sapiens
gcagccuccacuuccc

SEQ ID NO: 2059803 - RNA, 19 nt, Homo sapiens
cagccccagaguagcugga

SEQ ID NO: 2059804 - RNA, 17 nt, Homo sapiens
cauucuugggaggacac

SEQ ID NO: 2059805 - RNA, 17 nt, Homo sapiens
uuaaauuauguuuuacu

SEQ ID NO: 2059806 - RNA, 17 nt, Homo sapiens
auuaaguaugauugaca

SEQ ID NO: 2059807 - RNA, 17 nt, Homo sapiens
caagguuuuagguucua

SEQ ID NO: 2059808 - RNA, 14 nt, Homo sapiens
uuuaggaucucagg

SEQ ID NO: 2059809 - RNA, 14 nt, Homo sapiens
aguggccaugccac

SEQ ID NO: 2059810 - RNA, 19 nt, Homo sapiens
gguucaagcacacuggaau

SEQ ID NO: 2059811 - RNA, 13 nt, Homo sapiens
accagacagacaa

SEQ ID NO: 2059812 - RNA, 18 nt, Homo sapiens
cacccgccgccucccacg

SEQ ID NO: 2059813 - RNA, 14 nt, Homo sapiens
ugguuuuuugccag

SEQ ID NO: 2059814 - RNA, 16 nt, Homo sapiens
ugacugccaagccaga

SEQ ID NO: 2059815 - RNA, 21 nt, Homo sapiens
acccaguaaggucaugugcuu

SEQ ID NO: 2059816 - RNA, 14 nt, Homo sapiens
gaauucuucacaug

SEQ ID NO: 2059817 - RNA, 21 nt, Homo sapiens
gaagccggcagggaagggccu

SEQ ID NO: 2059818 - RNA, 17 nt, Homo sapiens
augggucuaggacacag

SEQ ID NO: 2059819 - RNA, 16 nt, Homo sapiens
gaagcauaaagcaauu

SEQ ID NO: 2059820 - RNA, 17 nt, Homo sapiens
uuaaaaaaauuacugug

SEQ ID NO: 2059821 - RNA, 18 nt, Homo sapiens
ucucgcuuuguugcccag

SEQ ID NO: 2059822 - RNA, 13 nt, Homo sapiens
cccucagacuuca

SEQ ID NO: 2059823 - RNA, 17 nt, Homo sapiens
ccaggcaccguggcuca

SEQ ID NO: 2059824 - RNA, 20 nt, Homo sapiens
gcugguuugcccagagccaa

SEQ ID NO: 2059825 - RNA, 18 nt, Homo sapiens
cacccagacuggagugca

SEQ ID NO: 2059826 - RNA, 21 nt, Homo sapiens
ggcuaauaaacuuugugcuga

SEQ ID NO: 2059827 - RNA, 20 nt, Homo sapiens
uucucucaccuccuaaagua

SEQ ID NO: 2059828 - RNA, 13 nt, Homo sapiens
uugcuguguuuaa

SEQ ID NO: 2059829 - RNA, 17 nt, Homo sapiens
aguucaauacagugaag

SEQ ID NO: 2059830 - RNA, 21 nt, Homo sapiens
cugggugucgaaaucaaacca

SEQ ID NO: 2059831 - RNA, 19 nt, Homo sapiens
ugggcugcugucauuuuau

SEQ ID NO: 2059832 - RNA, 17 nt, Homo sapiens
aagcauaacauggagcu

SEQ ID NO: 2059833 - RNA, 21 nt, Homo sapiens
cgcggccguggccucugaggg

SEQ ID NO: 2059834 - RNA, 18 nt, Homo sapiens
ucccuuuccccagcauca

SEQ ID NO: 2059835 - RNA, 22 nt, Homo sapiens
acaguggaggaagagggacaga

SEQ ID NO: 2059836 - RNA, 17 nt, Homo sapiens
cucugaucaaagcaccu

SEQ ID NO: 2059837 - RNA, 14 nt, Homo sapiens
aaauaagugauuaa

SEQ ID NO: 2059838 - RNA, 14 nt, Homo sapiens
acuagugugcaagu

SEQ ID NO: 2059839 - RNA, 23 nt, Homo sapiens
uaccuaggauauguuaaauguau

SEQ ID NO: 2059840 - RNA, 20 nt, Homo sapiens
uguucucagagcuccacaga

SEQ ID NO: 2059841 - RNA, 20 nt, Homo sapiens
uguuuuauagacccugggaa

SEQ ID NO: 2059842 - RNA, 16 nt, Homo sapiens
aaauaaggaauuuccu

SEQ ID NO: 2059843 - RNA, 13 nt, Homo sapiens
gaagcaguauuuu

SEQ ID NO: 2059844 - RNA, 15 nt, Homo sapiens
acauuugugaacuca

SEQ ID NO: 2059845 - RNA, 20 nt, Homo sapiens
ccagauugccccauugcuca

SEQ ID NO: 2059846 - RNA, 14 nt, Homo sapiens
uaaaguuacuugaa

SEQ ID NO: 2059847 - RNA, 22 nt, Homo sapiens
uauaagaaaugcauaugucacu

SEQ ID NO: 2059848 - RNA, 15 nt, Homo sapiens
acaagaagugggagu

SEQ ID NO: 2059849 - RNA, 16 nt, Homo sapiens
caggccggguggccaa

SEQ ID NO: 2059850 - RNA, 12 nt, Homo sapiens
cauuaagugugg

SEQ ID NO: 2059851 - RNA, 20 nt, Homo sapiens
auuuguauuuccccaaugac

SEQ ID NO: 2059852 - RNA, 15 nt, Homo sapiens
accuucccuugccac

SEQ ID NO: 2059853 - RNA, 16 nt, Homo sapiens
aucacacuugucugca

SEQ ID NO: 2059854 - RNA, 15 nt, Homo sapiens
aguucccgugcaccu

SEQ ID NO: 2059855 - RNA, 15 nt, Homo sapiens
uuauaaauacauaaa

SEQ ID NO: 2059856 - RNA, 14 nt, Homo sapiens
auccagcacuggug

SEQ ID NO: 2059857 - RNA, 17 nt, Homo sapiens
ggucauuauuucagugu

SEQ ID NO: 2059858 - RNA, 19 nt, Homo sapiens
aaaacauaacugauaccaa

SEQ ID NO: 2059859 - RNA, 16 nt, Homo sapiens
auugauuucugacucu

SEQ ID NO: 2059860 - RNA, 15 nt, Homo sapiens
cagaaacagccauug

SEQ ID NO: 2059861 - RNA, 15 nt, Homo sapiens
gauuauaagaguaau

SEQ ID NO: 2059862 - RNA, 13 nt, Homo sapiens
ucacauccauccc

SEQ ID NO: 2059863 - RNA, 19 nt, Homo sapiens
cugaacuaaucugauguua

SEQ ID NO: 2059864 - RNA, 18 nt, Homo sapiens
uagccacgcacagccaga

SEQ ID NO: 2059865 - RNA, 18 nt, Homo sapiens
cuuggcacccccaugcug

SEQ ID NO: 2059866 - RNA, 14 nt, Homo sapiens
cauucugcucccag

SEQ ID NO: 2059867 - RNA, 16 nt, Homo sapiens
gauccucaaacacaca

SEQ ID NO: 2059868 - RNA, 16 nt, Homo sapiens
ucaagagcccuuccag

SEQ ID NO: 2059869 - RNA, 16 nt, Homo sapiens
aucauaauguaaugag

SEQ ID NO: 2059870 - RNA, 16 nt, Homo sapiens
ugcauucccagugguc

SEQ ID NO: 2059871 - RNA, 15 nt, Homo sapiens
aagucaaacuuucac

SEQ ID NO: 2059872 - RNA, 23 nt, Homo sapiens
uggauccugggucaaaaaaaaga

SEQ ID NO: 2059873 - RNA, 16 nt, Homo sapiens
gauaacuuagguggca

SEQ ID NO: 2059874 - RNA, 13 nt, Homo sapiens
uucuaaugugcau

SEQ ID NO: 2059875 - RNA, 14 nt, Homo sapiens
ucauuuugcucaac

SEQ ID NO: 2059876 - RNA, 17 nt, Homo sapiens
gcucagauggacuggga

SEQ ID NO: 2059877 - RNA, 18 nt, Homo sapiens
cucacagauuuaaagcau

SEQ ID NO: 2059878 - RNA, 15 nt, Homo sapiens
auaaugguacuccca

SEQ ID NO: 2059879 - RNA, 13 nt, Homo sapiens
uccuguauaagca

SEQ ID NO: 2059880 - RNA, 18 nt, Homo sapiens
uaagauuuuuuguaggca

SEQ ID NO: 2059881 - RNA, 21 nt, Homo sapiens
ucccccagcccucaguuuuca

SEQ ID NO: 2059882 - RNA, 21 nt, Homo sapiens
augguaugcuggccagcaccc

SEQ ID NO: 2059883 - RNA, 13 nt, Homo sapiens
guagcugaugaaa

SEQ ID NO: 2059884 - RNA, 20 nt, Homo sapiens
auuuucuucucugcacuuau

SEQ ID NO: 2059885 - RNA, 16 nt, Homo sapiens
caggacuguggagucc

SEQ ID NO: 2059886 - RNA, 20 nt, Homo sapiens
gcucuuucucuuuguauuuc

SEQ ID NO: 2059887 - RNA, 21 nt, Homo sapiens
ggagcauucugccuaacagaa

SEQ ID NO: 2059888 - RNA, 23 nt, Homo sapiens
ugaagaaaauagucaguguucuu

SEQ ID NO: 2059889 - RNA, 14 nt, Homo sapiens
caugauguaaaaaa

SEQ ID NO: 2059890 - RNA, 19 nt, Homo sapiens
gacccaggcaccugcauuu

SEQ ID NO: 2059891 - RNA, 15 nt, Homo sapiens
cugucuaacugcugu

SEQ ID NO: 2059892 - RNA, 22 nt, Homo sapiens
ucacaagaacagaaccugcaaa

SEQ ID NO: 2059893 - RNA, 20 nt, Homo sapiens
uacuguuuucugggccagug

SEQ ID NO: 2059894 - RNA, 17 nt, Homo sapiens
cauucggugugaacuuu

SEQ ID NO: 2059895 - RNA, 16 nt, Homo sapiens
caugauuuuauacaua

SEQ ID NO: 2059896 - RNA, 17 nt, Homo sapiens
auuuagugaauggcauu

SEQ ID NO: 2059897 - RNA, 16 nt, Homo sapiens
gccuuagcacuaugga

SEQ ID NO: 2059898 - RNA, 20 nt, Homo sapiens
cuggagaaagggcccugggc

SEQ ID NO: 2059899 - RNA, 14 nt, Homo sapiens
agguaaaagcauca

SEQ ID NO: 2059900 - RNA, 18 nt, Homo sapiens
uuuuccucccgugccuga

SEQ ID NO: 2059901 - RNA, 20 nt, Homo sapiens
uccaauuuuuuaagugaaaa

SEQ ID NO: 2059902 - RNA, 21 nt, Homo sapiens
uugugaaaaaauuuacuuuaa

SEQ ID NO: 2059903 - RNA, 22 nt, Homo sapiens
gcagaaaccaagucuacuucac

SEQ ID NO: 2059904 - RNA, 15 nt, Homo sapiens
gcugccuaccagggg

SEQ ID NO: 2059905 - RNA, 15 nt, Homo sapiens
gugaguguguccaag

SEQ ID NO: 2059906 - RNA, 18 nt, Homo sapiens
uccugcagccccagaaga

SEQ ID NO: 2059907 - RNA, 24 nt, Homo sapiens
gcuucugggacaggcaccaugcug

SEQ ID NO: 2059908 - RNA, 14 nt, Homo sapiens
ccugcaaacgcugc

SEQ ID NO: 2059909 - RNA, 14 nt, Homo sapiens
ggcugcaagcugca

SEQ ID NO: 2059910 - RNA, 18 nt, Homo sapiens
cagugcccccuccgucca

SEQ ID NO: 2059911 - RNA, 14 nt, Homo sapiens
accgugaccaucuu

SEQ ID NO: 2059912 - RNA, 21 nt, Homo sapiens
uggagaaacaggcucugagau

SEQ ID NO: 2059913 - RNA, 15 nt, Homo sapiens
agcccaagacaccau

SEQ ID NO: 2059914 - RNA, 12 nt, Homo sapiens
caugaacuggag

SEQ ID NO: 2059915 - RNA, 16 nt, Homo sapiens
cagugcaagagacuuu

SEQ ID NO: 2059916 - RNA, 14 nt, Homo sapiens
uaauuugaacuuug

SEQ ID NO: 2059917 - RNA, 22 nt, Homo sapiens
auguggcaaggaaaaacagguc

SEQ ID NO: 2059918 - RNA, 20 nt, Homo sapiens
ucguucucgugacccagugg

SEQ ID NO: 2059919 - RNA, 17 nt, Homo sapiens
uggaaaggcagcucuaa

SEQ ID NO: 2059920 - RNA, 18 nt, Homo sapiens
aaggaugugggggaagac

SEQ ID NO: 2059921 - RNA, 13 nt, Homo sapiens
ugcuuaacuggcu

SEQ ID NO: 2059922 - RNA, 13 nt, Homo sapiens
cagcuaaccacuu

SEQ ID NO: 2059923 - RNA, 16 nt, Homo sapiens
aggauagauaacucuu

SEQ ID NO: 2059924 - RNA, 17 nt, Homo sapiens
uuaugaaaacuagcauu

SEQ ID NO: 2059925 - RNA, 17 nt, Homo sapiens
accugugguaucuuuaa

SEQ ID NO: 2059926 - RNA, 17 nt, Homo sapiens
ccagcuuauagucauau

SEQ ID NO: 2059927 - RNA, 13 nt, Homo sapiens
aacuugagcuuua

SEQ ID NO: 2059928 - RNA, 17 nt, Homo sapiens
gcagcuucuauuagcca

SEQ ID NO: 2059929 - RNA, 14 nt, Homo sapiens
cuucugaaugaagc

SEQ ID NO: 2059930 - RNA, 21 nt, Homo sapiens
guaguagaaucucagcacuuu

SEQ ID NO: 2059931 - RNA, 14 nt, Homo sapiens
gcuguggcggacac

SEQ ID NO: 2059932 - RNA, 18 nt, Homo sapiens
uccccacuuuauugccaa

SEQ ID NO: 2059933 - RNA, 12 nt, Homo sapiens
agcugcacugau

SEQ ID NO: 2059934 - RNA, 15 nt, Homo sapiens
gaaugacauugaacu

SEQ ID NO: 2059935 - RNA, 15 nt, Homo sapiens
acaucacaaccucca

SEQ ID NO: 2059936 - RNA, 17 nt, Homo sapiens
cagaaaaacugugggua

SEQ ID NO: 2059937 - RNA, 14 nt, Homo sapiens
agagcuacauggug

SEQ ID NO: 2059938 - RNA, 18 nt, Homo sapiens
caaaggcguaucaguuca

SEQ ID NO: 2059939 - RNA, 18 nt, Homo sapiens
acacaaccuacucugcaa

SEQ ID NO: 2059940 - RNA, 17 nt, Homo sapiens
uugcuagagguggcaug

SEQ ID NO: 2059941 - RNA, 17 nt, Homo sapiens
ucauggcuaauuuaaca

SEQ ID NO: 2059942 - RNA, 15 nt, Homo sapiens
cuuuuucauacaagg

SEQ ID NO: 2059943 - RNA, 17 nt, Homo sapiens
uguuagguguacauccu

SEQ ID NO: 2059944 - RNA, 15 nt, Homo sapiens
acagaaaacucccaa

SEQ ID NO: 2059945 - RNA, 15 nt, Homo sapiens
ccagcaaaauccaaa

SEQ ID NO: 2059946 - RNA, 21 nt, Homo sapiens
cacaauaagagucuccuucuc

SEQ ID NO: 2059947 - RNA, 12 nt, Homo sapiens
gagucacuugaa

SEQ ID NO: 2059948 - RNA, 14 nt, Homo sapiens
aaaauguacucagc

SEQ ID NO: 2059949 - RNA, 18 nt, Homo sapiens
agugccacaugccuacga

SEQ ID NO: 2059950 - RNA, 15 nt, Homo sapiens
cgucuccuucacuga

SEQ ID NO: 2059951 - RNA, 22 nt, Homo sapiens
ggacuccucuuaauguuuccaa

SEQ ID NO: 2059952 - RNA, 18 nt, Homo sapiens
cucaagauggauuaaaga

SEQ ID NO: 2059953 - RNA, 15 nt, Homo sapiens
caaugugcacugaau

SEQ ID NO: 2059954 - RNA, 22 nt, Homo sapiens
cgugacagccucugacucacca

SEQ ID NO: 2059955 - RNA, 13 nt, Homo sapiens
uacaaacaccugg

SEQ ID NO: 2059956 - RNA, 19 nt, Homo sapiens
aaaguauuuuaucugccuu

SEQ ID NO: 2059957 - RNA, 21 nt, Homo sapiens
gccacaucaucuuuaucuccu

SEQ ID NO: 2059958 - RNA, 23 nt, Homo sapiens
cugagucccguggggccccggcu

SEQ ID NO: 2059959 - RNA, 13 nt, Homo sapiens
ccagcuaaucucc

SEQ ID NO: 2059960 - RNA, 16 nt, Homo sapiens
cuguaggaagauuccc

SEQ ID NO: 2059961 - RNA, 23 nt, Homo sapiens
uuccacuuugaguaccaaaucca

SEQ ID NO: 2059962 - RNA, 15 nt, Homo sapiens
ucccugccaauggac

SEQ ID NO: 2059963 - RNA, 18 nt, Homo sapiens
agcucuaucaccaaggag

SEQ ID NO: 2059964 - RNA, 18 nt, Homo sapiens
uagaauccaguuugcaau

SEQ ID NO: 2059965 - RNA, 17 nt, Homo sapiens
aauuacuuuuucauucu

SEQ ID NO: 2059966 - RNA, 19 nt, Homo sapiens
aaaaguaagagagcacagu

SEQ ID NO: 2059967 - RNA, 19 nt, Homo sapiens
cgaguagcugggauuacag

SEQ ID NO: 2059968 - RNA, 15 nt, Homo sapiens
ggaguccaggccaug

SEQ ID NO: 2059969 - RNA, 15 nt, Homo sapiens
uguccauagauauaa

SEQ ID NO: 2059970 - RNA, 16 nt, Homo sapiens
cuuaagcuaagacuga

SEQ ID NO: 2059971 - RNA, 17 nt, Homo sapiens
ggaccacagagcuccug

SEQ ID NO: 2059972 - RNA, 23 nt, Homo sapiens
gagagggacauagaaucugugac

SEQ ID NO: 2059973 - RNA, 13 nt, Homo sapiens
auugaaaagcaca

SEQ ID NO: 2059974 - RNA, 21 nt, Homo sapiens
guauuauccugugugugucua

SEQ ID NO: 2059975 - RNA, 23 nt, Homo sapiens
ugucuuuuuuuucuucaccucac

SEQ ID NO: 2059976 - RNA, 20 nt, Homo sapiens
gccuucuccaucaugcccag

SEQ ID NO: 2059977 - RNA, 24 nt, Homo sapiens
caguugguuaucugaauaguguca

SEQ ID NO: 2059978 - RNA, 17 nt, Homo sapiens
agggcuugagguuggug

SEQ ID NO: 2059979 - RNA, 20 nt, Homo sapiens
ggccuggccagucuuccucu

SEQ ID NO: 2059980 - RNA, 22 nt, Homo sapiens
gagcaucaggauacucaaagug

SEQ ID NO: 2059981 - RNA, 15 nt, Homo sapiens
aggcuauguauggaa

SEQ ID NO: 2059982 - RNA, 18 nt, Homo sapiens
cucagcuucugggggaga

SEQ ID NO: 2059983 - RNA, 22 nt, Homo sapiens
auaauguuaacuaaauaacuuu

SEQ ID NO: 2059984 - RNA, 15 nt, Homo sapiens
ucuucaacaugacau

SEQ ID NO: 2059985 - RNA, 15 nt, Homo sapiens
aagaugcagcaaaau

SEQ ID NO: 2059986 - RNA, 18 nt, Homo sapiens
cucugaagcauguuucau

SEQ ID NO: 2059987 - RNA, 17 nt, Homo sapiens
ggcuuaaaccuggaauc

SEQ ID NO: 2059988 - RNA, 14 nt, Homo sapiens
gauacaugucuuuc

SEQ ID NO: 2059989 - RNA, 16 nt, Homo sapiens
uuuugcuuuauggguu

SEQ ID NO: 2059990 - RNA, 13 nt, Homo sapiens
uacuuugcagaug

SEQ ID NO: 2059991 - RNA, 12 nt, Homo sapiens
ggccaguggccu

SEQ ID NO: 2059992 - RNA, 12 nt, Homo sapiens
acauagugagac

SEQ ID NO: 2059993 - RNA, 21 nt, Homo sapiens
gaugguggccgcccacccgcc

SEQ ID NO: 2059994 - RNA, 18 nt, Homo sapiens
acuguaaggugcuugcuc

SEQ ID NO: 2059995 - RNA, 21 nt, Homo sapiens
agccccggccacccagggauc

SEQ ID NO: 2059996 - RNA, 14 nt, Homo sapiens
auuuuuugucuguu

SEQ ID NO: 2059997 - RNA, 15 nt, Homo sapiens
gcuucuagccaugua

SEQ ID NO: 2059998 - RNA, 16 nt, Homo sapiens
cggaguucaguuuuac

SEQ ID NO: 2059999 - RNA, 16 nt, Homo sapiens
gcagggcagccgucac

SEQ ID NO: 2060000 - RNA, 15 nt, Homo sapiens
acauauguuucacag

SEQ ID NO: 2060001 - RNA, 20 nt, Homo sapiens
uuuaaauagggcauaccauu

SEQ ID NO: 2060002 - RNA, 20 nt, Homo sapiens
ggcccugccaugcucuccaa

SEQ ID NO: 2060003 - RNA, 23 nt, Homo sapiens
uguuaaagcuggaacauuugaua

SEQ ID NO: 2060004 - RNA, 19 nt, Homo sapiens
ccgcaccauaaugagaugu

SEQ ID NO: 2060005 - RNA, 20 nt, Homo sapiens
uauaaucugcagugaugcaa

SEQ ID NO: 2060006 - RNA, 21 nt, Homo sapiens
ucuuuaacugacuucugucca

SEQ ID NO: 2060007 - RNA, 17 nt, Homo sapiens
auauucagccagcuuaa

SEQ ID NO: 2060008 - RNA, 18 nt, Homo sapiens
gcaggagggacagucuca

SEQ ID NO: 2060009 - RNA, 17 nt, Homo sapiens
gaacaauccauaacuuu

SEQ ID NO: 2060010 - RNA, 15 nt, Homo sapiens
ccaauaggugcaaaa

SEQ ID NO: 2060011 - RNA, 23 nt, Homo sapiens
ccuauguauaucuucuacaugca

SEQ ID NO: 2060012 - RNA, 17 nt, Homo sapiens
uuccuuugggucuguga

SEQ ID NO: 2060013 - RNA, 14 nt, Homo sapiens
aagagaucauaucc

SEQ ID NO: 2060014 - RNA, 19 nt, Homo sapiens
caacaacuuacacuuauuu

SEQ ID NO: 2060015 - RNA, 21 nt, Homo sapiens
agguugcagcaugagacuuuc

SEQ ID NO: 2060016 - RNA, 21 nt, Homo sapiens
ucaagacgucacccuccauuc

SEQ ID NO: 2060017 - RNA, 16 nt, Homo sapiens
uggggaaguguuccag

SEQ ID NO: 2060018 - RNA, 18 nt, Homo sapiens
uacuuccucauaccacau

SEQ ID NO: 2060019 - RNA, 15 nt, Homo sapiens
ugauggaacugugua

SEQ ID NO: 2060020 - RNA, 21 nt, Homo sapiens
gcuugccccacccaacaagcc

SEQ ID NO: 2060021 - RNA, 19 nt, Homo sapiens
guaacuccccucagggaua

SEQ ID NO: 2060022 - RNA, 14 nt, Homo sapiens
gacuagccaucuca

SEQ ID NO: 2060023 - RNA, 14 nt, Homo sapiens
acugaguacucuuu

SEQ ID NO: 2060024 - RNA, 16 nt, Homo sapiens
uucauauaacugagau

SEQ ID NO: 2060025 - RNA, 23 nt, Homo sapiens
uguggguucuccuguucucucug

SEQ ID NO: 2060026 - RNA, 12 nt, Homo sapiens
gugcucuuugcu

SEQ ID NO: 2060027 - RNA, 12 nt, Homo sapiens
ugguucuugucc

SEQ ID NO: 2060028 - RNA, 13 nt, Homo sapiens
aagggcauggguc

SEQ ID NO: 2060029 - RNA, 11 nt, Homo sapiens
caaugggaccg

SEQ ID NO: 2060030 - RNA, 18 nt, Homo sapiens
gaagcuaugucucuagca

SEQ ID NO: 2060031 - RNA, 21 nt, Homo sapiens
gaccccaccccucaucaggag

SEQ ID NO: 2060032 - RNA, 23 nt, Homo sapiens
agacuugagcuugaccuaaggau

SEQ ID NO: 2060033 - RNA, 17 nt, Homo sapiens
cucaguguagggaucag

SEQ ID NO: 2060034 - RNA, 19 nt, Homo sapiens
cugagcaaugucugugcua

SEQ ID NO: 2060035 - RNA, 17 nt, Homo sapiens
ucauuuucugcauuuaa

SEQ ID NO: 2060036 - RNA, 16 nt, Homo sapiens
ccuggcuccagucuca

SEQ ID NO: 2060037 - RNA, 22 nt, Homo sapiens
aaguccagauuuacacugggag

SEQ ID NO: 2060038 - RNA, 15 nt, Homo sapiens
ugagaaauggccaaa

SEQ ID NO: 2060039 - RNA, 15 nt, Homo sapiens
uaucaauaaaauucu

SEQ ID NO: 2060040 - RNA, 21 nt, Homo sapiens
ccagcuggccuggacaguauc

SEQ ID NO: 2060041 - RNA, 14 nt, Homo sapiens
ugaguaaacagaua

SEQ ID NO: 2060042 - RNA, 19 nt, Homo sapiens
acaugcugacuuucauuuc

SEQ ID NO: 2060043 - RNA, 15 nt, Homo sapiens
cuuucugggccaagu

SEQ ID NO: 2060044 - RNA, 22 nt, Homo sapiens
aacaguaauuauuauuuaacuc

SEQ ID NO: 2060045 - RNA, 14 nt, Homo sapiens
aguauacacaucau

SEQ ID NO: 2060046 - RNA, 18 nt, Homo sapiens
uuucaauaucuuaauacc

SEQ ID NO: 2060047 - RNA, 19 nt, Homo sapiens
cauugucgcucagcaauag

SEQ ID NO: 2060048 - RNA, 18 nt, Homo sapiens
ucagacuucagacuuuca

SEQ ID NO: 2060049 - RNA, 16 nt, Homo sapiens
ucugugaaaaaccuga

SEQ ID NO: 2060050 - RNA, 23 nt, Homo sapiens
gaaccgugguaugucugccaugu

SEQ ID NO: 2060051 - RNA, 21 nt, Homo sapiens
gacaaagacauuauuucucau

SEQ ID NO: 2060052 - RNA, 14 nt, Homo sapiens
guaauuagcucugg

SEQ ID NO: 2060053 - RNA, 19 nt, Homo sapiens
gcccaccugugaucccagc

SEQ ID NO: 2060054 - RNA, 14 nt, Homo sapiens
cacgacacacuuug

SEQ ID NO: 2060055 - RNA, 11 nt, Homo sapiens
cacugccccac

SEQ ID NO: 2060056 - RNA, 23 nt, Homo sapiens
cacaccuccucccacugcccacu

SEQ ID NO: 2060057 - RNA, 17 nt, Homo sapiens
cugcuaaagacagugcg

SEQ ID NO: 2060058 - RNA, 14 nt, Homo sapiens
cggagaauugccuc

SEQ ID NO: 2060059 - RNA, 21 nt, Homo sapiens
cggaugcccauuccugccugg

SEQ ID NO: 2060060 - RNA, 18 nt, Homo sapiens
cccuacacacacacuccc

SEQ ID NO: 2060061 - RNA, 16 nt, Homo sapiens
ccaagugccagucuug

SEQ ID NO: 2060062 - RNA, 16 nt, Homo sapiens
cccagucucaaaggcc

SEQ ID NO: 2060063 - RNA, 23 nt, Homo sapiens
agaaagcacgugucucagacugc

SEQ ID NO: 2060064 - RNA, 23 nt, Homo sapiens
accucauuuguccaugugcaaac

SEQ ID NO: 2060065 - RNA, 20 nt, Homo sapiens
auucaaauccauagauuucg

SEQ ID NO: 2060066 - RNA, 17 nt, Homo sapiens
uuucaccauguuggcua

SEQ ID NO: 2060067 - RNA, 19 nt, Homo sapiens
cugaccuggagaugcugcc

SEQ ID NO: 2060068 - RNA, 15 nt, Homo sapiens
gccaggccucaggga

SEQ ID NO: 2060069 - RNA, 18 nt, Homo sapiens
auuacaccuuuaucucaa

SEQ ID NO: 2060070 - RNA, 11 nt, Homo sapiens
ugugcugcuua

SEQ ID NO: 2060071 - RNA, 21 nt, Homo sapiens
aagggauaaucaucucuguca

SEQ ID NO: 2060072 - RNA, 15 nt, Homo sapiens
aaggcugcugugaac

SEQ ID NO: 2060073 - RNA, 17 nt, Homo sapiens
aacgcuuaagucaucau

SEQ ID NO: 2060074 - RNA, 17 nt, Homo sapiens
gcuuccacaugugccag

SEQ ID NO: 2060075 - RNA, 23 nt, Homo sapiens
ugucaagcugcugaaacuguaau

SEQ ID NO: 2060076 - RNA, 18 nt, Homo sapiens
uuccuuugaagaggaaaa

SEQ ID NO: 2060077 - RNA, 13 nt, Homo sapiens
uaaggaacaacgu

SEQ ID NO: 2060078 - RNA, 21 nt, Homo sapiens
caaagacccagagcaaaccca

SEQ ID NO: 2060079 - RNA, 17 nt, Homo sapiens
acaaauaagauuaauaa

SEQ ID NO: 2060080 - RNA, 14 nt, Homo sapiens
uaguuuugggauau

SEQ ID NO: 2060081 - RNA, 19 nt, Homo sapiens
cuuucaaaguguaagcacu

SEQ ID NO: 2060082 - RNA, 13 nt, Homo sapiens
aaaaauaucugua

SEQ ID NO: 2060083 - RNA, 19 nt, Homo sapiens
guuaucuuguguauggaua

SEQ ID NO: 2060084 - RNA, 17 nt, Homo sapiens
aauaguaaacacaggga

SEQ ID NO: 2060085 - RNA, 14 nt, Homo sapiens
cuugcagguggugg

SEQ ID NO: 2060086 - RNA, 19 nt, Homo sapiens
gaauuacagacaaccuauc

SEQ ID NO: 2060087 - RNA, 23 nt, Homo sapiens
cacauaacaauaaaaaccaaacu

SEQ ID NO: 2060088 - RNA, 22 nt, Homo sapiens
gcccagcugcucagugcaacug

SEQ ID NO: 2060089 - RNA, 20 nt, Homo sapiens
agagauccugcuugagcccu

SEQ ID NO: 2060090 - RNA, 20 nt, Homo sapiens
ggggucgucaccaccucucc

SEQ ID NO: 2060091 - RNA, 16 nt, Homo sapiens
gcccagggcaucccau

SEQ ID NO: 2060092 - RNA, 22 nt, Homo sapiens
aggauacgacaguacacuguca

SEQ ID NO: 2060093 - RNA, 17 nt, Homo sapiens
uuuggaauauuguccau

SEQ ID NO: 2060094 - RNA, 17 nt, Homo sapiens
cauugcaucauuuacaa

SEQ ID NO: 2060095 - RNA, 21 nt, Homo sapiens
cugagccacucgcagucgcag

SEQ ID NO: 2060096 - RNA, 21 nt, Homo sapiens
gccucccauucuacucaaagu

SEQ ID NO: 2060097 - RNA, 18 nt, Homo sapiens
gcuuccagcaggagggac

SEQ ID NO: 2060098 - RNA, 13 nt, Homo sapiens
uuccacugcuacu

SEQ ID NO: 2060099 - RNA, 15 nt, Homo sapiens
caaaacuuauuggaa

SEQ ID NO: 2060100 - RNA, 15 nt, Homo sapiens
acaauuugcacuguu

SEQ ID NO: 2060101 - RNA, 13 nt, Homo sapiens
cucugacaucaag

SEQ ID NO: 2060102 - RNA, 15 nt, Homo sapiens
aguacugaccacugg

SEQ ID NO: 2060103 - RNA, 14 nt, Homo sapiens
caaugcauugcuaa

SEQ ID NO: 2060104 - RNA, 15 nt, Homo sapiens
uaaauccacagugag

SEQ ID NO: 2060105 - RNA, 17 nt, Homo sapiens
caugagcuaaugguuca

SEQ ID NO: 2060106 - RNA, 12 nt, Homo sapiens
aggaccacuuug

SEQ ID NO: 2060107 - RNA, 21 nt, Homo sapiens
cuccccuucuucuccaucucc

SEQ ID NO: 2060108 - RNA, 12 nt, Homo sapiens
uggagccuuuga

SEQ ID NO: 2060109 - RNA, 16 nt, Homo sapiens
acugaagccugcuccu

SEQ ID NO: 2060110 - RNA, 15 nt, Homo sapiens
aauaaagccuuugau

SEQ ID NO: 2060111 - RNA, 15 nt, Homo sapiens
augaaauccagugag

SEQ ID NO: 2060112 - RNA, 13 nt, Homo sapiens
gcugcuggaagaa

SEQ ID NO: 2060113 - RNA, 18 nt, Homo sapiens
aaagcauguuuugcaugu

SEQ ID NO: 2060114 - RNA, 16 nt, Homo sapiens
aauuaacaugucacaa

SEQ ID NO: 2060115 - RNA, 16 nt, Homo sapiens
uaauuaaaagacucca

SEQ ID NO: 2060116 - RNA, 23 nt, Homo sapiens
ucucuccaucuaccuuccaguca

SEQ ID NO: 2060117 - RNA, 18 nt, Homo sapiens
ucuuuggggaaacuaaca

SEQ ID NO: 2060118 - RNA, 14 nt, Homo sapiens
ucugagagcaaagu

SEQ ID NO: 2060119 - RNA, 14 nt, Homo sapiens
uguuuccacauuca

SEQ ID NO: 2060120 - RNA, 18 nt, Homo sapiens
aucccauggguuaucugu

SEQ ID NO: 2060121 - RNA, 13 nt, Homo sapiens
aauauauugcuaa

SEQ ID NO: 2060122 - RNA, 14 nt, Homo sapiens
augccaccaaagga

SEQ ID NO: 2060123 - RNA, 17 nt, Homo sapiens
uucagagccaagccuua

SEQ ID NO: 2060124 - RNA, 14 nt, Homo sapiens
ccugcaaaccuuaa

SEQ ID NO: 2060125 - RNA, 14 nt, Homo sapiens
cuggaagagccaaa

SEQ ID NO: 2060126 - RNA, 15 nt, Homo sapiens
cugccauugugauca

SEQ ID NO: 2060127 - RNA, 23 nt, Homo sapiens
aaaccaugcagcuucaucaauuu

SEQ ID NO: 2060128 - RNA, 18 nt, Homo sapiens
ucacgcaugugugcugca

SEQ ID NO: 2060129 - RNA, 16 nt, Homo sapiens
guuuucuccacuggaa

SEQ ID NO: 2060130 - RNA, 12 nt, Homo sapiens
auucaaauccau

SEQ ID NO: 2060131 - RNA, 20 nt, Homo sapiens
auuucuaucagccuugcuaa

SEQ ID NO: 2060132 - RNA, 20 nt, Homo sapiens
aguccacaagaacaauucaa

SEQ ID NO: 2060133 - RNA, 23 nt, Homo sapiens
acagacacccuccacucugaggu

SEQ ID NO: 2060134 - RNA, 21 nt, Homo sapiens
auuauaaaauugaaaacacua

SEQ ID NO: 2060135 - RNA, 13 nt, Homo sapiens
gcaguuguccuga

SEQ ID NO: 2060136 - RNA, 15 nt, Homo sapiens
uacagaauauacuua

SEQ ID NO: 2060137 - RNA, 16 nt, Homo sapiens
cuggaggacacacagu

SEQ ID NO: 2060138 - RNA, 13 nt, Homo sapiens
aacucacacuccc

SEQ ID NO: 2060139 - RNA, 21 nt, Homo sapiens
ugauggggaguaaacccugga

SEQ ID NO: 2060140 - RNA, 13 nt, Homo sapiens
gcuuuaagccuaa

SEQ ID NO: 2060141 - RNA, 16 nt, Homo sapiens
acacagccugggacca

SEQ ID NO: 2060142 - RNA, 18 nt, Homo sapiens
accaaguuaucuguuucc

SEQ ID NO: 2060143 - RNA, 22 nt, Homo sapiens
cugaauuuuuaaaacccauuua

SEQ ID NO: 2060144 - RNA, 15 nt, Homo sapiens
cucauguuuaugaaa

SEQ ID NO: 2060145 - RNA, 23 nt, Homo sapiens
guccuuucccuucaguacccucu

SEQ ID NO: 2060146 - RNA, 13 nt, Homo sapiens
cacagcuacucag

SEQ ID NO: 2060147 - RNA, 17 nt, Homo sapiens
uauacaaaaaauuuuua

SEQ ID NO: 2060148 - RNA, 21 nt, Homo sapiens
gaaaaugcuguauuagucaca

SEQ ID NO: 2060149 - RNA, 12 nt, Homo sapiens
aaguagcuggaa

SEQ ID NO: 2060150 - RNA, 13 nt, Homo sapiens
gagcaggguccug

SEQ ID NO: 2060151 - RNA, 12 nt, Homo sapiens
aaacuugacagu

SEQ ID NO: 2060152 - RNA, 15 nt, Homo sapiens
ucuuucaucugggga

SEQ ID NO: 2060153 - RNA, 12 nt, Homo sapiens
gucugugucugc

SEQ ID NO: 2060154 - RNA, 16 nt, Homo sapiens
uuggaccguaucacug

SEQ ID NO: 2060155 - RNA, 21 nt, Homo sapiens
uagugacuuaauucuuucuaa

SEQ ID NO: 2060156 - RNA, 22 nt, Homo sapiens
ugagaaguucucagaauaacua

SEQ ID NO: 2060157 - RNA, 20 nt, Homo sapiens
aggccuggccagaugcacca

SEQ ID NO: 2060158 - RNA, 17 nt, Homo sapiens
uggccaucagccuggau

SEQ ID NO: 2060159 - RNA, 22 nt, Homo sapiens
aucauccugcagacagacaaua

SEQ ID NO: 2060160 - RNA, 14 nt, Homo sapiens
cuugagucugaggc

SEQ ID NO: 2060161 - RNA, 12 nt, Homo sapiens
uaucugagguac

SEQ ID NO: 2060162 - RNA, 23 nt, Homo sapiens
gacuguggacguggguugcacug

SEQ ID NO: 2060163 - RNA, 15 nt, Homo sapiens
aaggcaaacauuuga

SEQ ID NO: 2060164 - RNA, 15 nt, Homo sapiens
ccaaauucauauaaa

SEQ ID NO: 2060165 - RNA, 14 nt, Homo sapiens
cuaccucagccucc

SEQ ID NO: 2060166 - RNA, 18 nt, Homo sapiens
ugguccccuguggugaug

SEQ ID NO: 2060167 - RNA, 22 nt, Homo sapiens
gcaauguugguuucacugagag

SEQ ID NO: 2060168 - RNA, 15 nt, Homo sapiens
ucucaggacagugau

SEQ ID NO: 2060169 - RNA, 20 nt, Homo sapiens
gccugacaacagccugagaa

SEQ ID NO: 2060170 - RNA, 15 nt, Homo sapiens
ugugauucacugccu

SEQ ID NO: 2060171 - RNA, 17 nt, Homo sapiens
auugaauaacaguaguc

SEQ ID NO: 2060172 - RNA, 22 nt, Homo sapiens
gauacuugaaggucuaggugcu

SEQ ID NO: 2060173 - RNA, 19 nt, Homo sapiens
auggugugccuuccagauc

SEQ ID NO: 2060174 - RNA, 15 nt, Homo sapiens
cccuguuaagcaauu

SEQ ID NO: 2060175 - RNA, 15 nt, Homo sapiens
cccugauaagcaaau

SEQ ID NO: 2060176 - RNA, 12 nt, Homo sapiens
uggcucacuggc

SEQ ID NO: 2060177 - RNA, 12 nt, Homo sapiens
uacuucacuacu

SEQ ID NO: 2060178 - RNA, 13 nt, Homo sapiens
acaaagauucucu

SEQ ID NO: 2060179 - RNA, 18 nt, Homo sapiens
auuaggaaaguacugcau

SEQ ID NO: 2060180 - RNA, 13 nt, Homo sapiens
gaacaaauauuca

SEQ ID NO: 2060181 - RNA, 22 nt, Homo sapiens
uggauuucacaccccauucuca

SEQ ID NO: 2060182 - RNA, 23 nt, Homo sapiens
cugcuguaaauuuggcuucuguu

SEQ ID NO: 2060183 - RNA, 16 nt, Homo sapiens
cagacggugugcacca

SEQ ID NO: 2060184 - RNA, 17 nt, Homo sapiens
cuguagagucacugacc

SEQ ID NO: 2060185 - RNA, 17 nt, Homo sapiens
cuguuggcucacagggc

SEQ ID NO: 2060186 - RNA, 23 nt, Homo sapiens
cagcaggauuggauguuguguau

SEQ ID NO: 2060187 - RNA, 19 nt, Homo sapiens
uuuuacccuauaucuauaa

SEQ ID NO: 2060188 - RNA, 18 nt, Homo sapiens
gaagcaauuucaguuuua

SEQ ID NO: 2060189 - RNA, 15 nt, Homo sapiens
gggaggugggguaca

SEQ ID NO: 2060190 - RNA, 19 nt, Homo sapiens
uguuccuaaaauggugaua

SEQ ID NO: 2060191 - RNA, 15 nt, Homo sapiens
ugcaaaugacuguca

SEQ ID NO: 2060192 - RNA, 20 nt, Homo sapiens
aagcuggaacugaaguccaa

SEQ ID NO: 2060193 - RNA, 22 nt, Homo sapiens
ugcagaccaucgcacaccaaau

SEQ ID NO: 2060194 - RNA, 19 nt, Homo sapiens
guaugaucaauaaaggaca

SEQ ID NO: 2060195 - RNA, 14 nt, Homo sapiens
auggugaugaaaug

SEQ ID NO: 2060196 - RNA, 13 nt, Homo sapiens
aggcaagcacaau

SEQ ID NO: 2060197 - RNA, 17 nt, Homo sapiens
gaggcagugucauuugc

SEQ ID NO: 2060198 - RNA, 16 nt, Homo sapiens
ucuccaaaacaaccca

SEQ ID NO: 2060199 - RNA, 17 nt, Homo sapiens
acugaugguugcuuuga

SEQ ID NO: 2060200 - RNA, 17 nt, Homo sapiens
cacacacgaugcauuua

SEQ ID NO: 2060201 - RNA, 13 nt, Homo sapiens
aacaaaucugcac

SEQ ID NO: 2060202 - RNA, 13 nt, Homo sapiens
ugcaccaucccag

SEQ ID NO: 2060203 - RNA, 18 nt, Homo sapiens
aacuauuuacauuuucca

SEQ ID NO: 2060204 - RNA, 15 nt, Homo sapiens
cacaaaugauagcau

SEQ ID NO: 2060205 - RNA, 20 nt, Homo sapiens
caugcugguguggccaaggc

SEQ ID NO: 2060206 - RNA, 14 nt, Homo sapiens
uccagugcugcaug

SEQ ID NO: 2060207 - RNA, 16 nt, Homo sapiens
acuugaacauuugcag

SEQ ID NO: 2060208 - RNA, 22 nt, Homo sapiens
aaauugaaagcaggacauauga

SEQ ID NO: 2060209 - RNA, 22 nt, Homo sapiens
cuucaccuccagguucaaguga

SEQ ID NO: 2060210 - RNA, 14 nt, Homo sapiens
gggucucagugucc

SEQ ID NO: 2060211 - RNA, 14 nt, Homo sapiens
auugaccaagugau

SEQ ID NO: 2060212 - RNA, 13 nt, Homo sapiens
cagggucuugcuc

SEQ ID NO: 2060213 - RNA, 13 nt, Homo sapiens
cucccagccuacc

SEQ ID NO: 2060214 - RNA, 20 nt, Homo sapiens
ugcacuuuuuuauaagagcu

SEQ ID NO: 2060215 - RNA, 21 nt, Homo sapiens
gcuuguugucuccacuuguau

SEQ ID NO: 2060216 - RNA, 17 nt, Homo sapiens
gaccagccugaccaaca

SEQ ID NO: 2060217 - RNA, 22 nt, Homo sapiens
uuaagggauuuaguaacaucau

SEQ ID NO: 2060218 - RNA, 22 nt, Homo sapiens
cuaaagaguuauucaaaugaag

SEQ ID NO: 2060219 - RNA, 14 nt, Homo sapiens
uguaggcaaccuuc

SEQ ID NO: 2060220 - RNA, 19 nt, Homo sapiens
gcaggguagagaggacaaa

SEQ ID NO: 2060221 - RNA, 16 nt, Homo sapiens
cuggacccuguugcua

SEQ ID NO: 2060222 - RNA, 19 nt, Homo sapiens
uagugcucuuaacuuguua

SEQ ID NO: 2060223 - RNA, 14 nt, Homo sapiens
ucaggaaaccacaa

SEQ ID NO: 2060224 - RNA, 23 nt, Homo sapiens
auaccaaaguguuuggucauuuu

SEQ ID NO: 2060225 - RNA, 16 nt, Homo sapiens
ucuuugaacagguuuu

SEQ ID NO: 2060226 - RNA, 17 nt, Homo sapiens
ugaagacccaaaacagc

SEQ ID NO: 2060227 - RNA, 14 nt, Homo sapiens
ugacuccauucaaa

SEQ ID NO: 2060228 - RNA, 17 nt, Homo sapiens
ucgucuuagcaagaagu

SEQ ID NO: 2060229 - RNA, 23 nt, Homo sapiens
agagacgggcccuggugguggcu

SEQ ID NO: 2060230 - RNA, 14 nt, Homo sapiens
auguucuucaucca

SEQ ID NO: 2060231 - RNA, 20 nt, Homo sapiens
agaauagugguuaacagagc

SEQ ID NO: 2060232 - RNA, 19 nt, Homo sapiens
ccacuauugcuugcacaaa

SEQ ID NO: 2060233 - RNA, 22 nt, Homo sapiens
ugagaaaacaggcucacagaga

SEQ ID NO: 2060234 - RNA, 15 nt, Homo sapiens
acuccuucuccccaa

SEQ ID NO: 2060235 - RNA, 18 nt, Homo sapiens
uauuugacucagcacugu

SEQ ID NO: 2060236 - RNA, 16 nt, Homo sapiens
caauuaacugaagcaa

SEQ ID NO: 2060237 - RNA, 20 nt, Homo sapiens
aaacuugaaucaaagcaguu

SEQ ID NO: 2060238 - RNA, 19 nt, Homo sapiens
aauauguagccuuuuaucc

SEQ ID NO: 2060239 - RNA, 17 nt, Homo sapiens
ugguuucccaucuccau

SEQ ID NO: 2060240 - RNA, 17 nt, Homo sapiens
aaauccagaaguuuuaa

SEQ ID NO: 2060241 - RNA, 15 nt, Homo sapiens
agagaaaaacuaacu

SEQ ID NO: 2060242 - RNA, 17 nt, Homo sapiens
uaucacucuaaaaaaca

SEQ ID NO: 2060243 - RNA, 23 nt, Homo sapiens
uguagaaguccacagacaucuuu

SEQ ID NO: 2060244 - RNA, 22 nt, Homo sapiens
ucugcaaaaugucauagcuuau

SEQ ID NO: 2060245 - RNA, 13 nt, Homo sapiens
acaauaaauuauu

SEQ ID NO: 2060246 - RNA, 21 nt, Homo sapiens
augucaaaccugcaaauucag

SEQ ID NO: 2060247 - RNA, 22 nt, Homo sapiens
ccuuaaaauaaugaauacauuu

SEQ ID NO: 2060248 - RNA, 17 nt, Homo sapiens
ucucgagcccagaugga

SEQ ID NO: 2060249 - RNA, 22 nt, Homo sapiens
cuucaaguucucuugauuucuu

SEQ ID NO: 2060250 - RNA, 20 nt, Homo sapiens
cccuugauuuaaacacacag

SEQ ID NO: 2060251 - RNA, 19 nt, Homo sapiens
aaccugcccaaccuaccuc

SEQ ID NO: 2060252 - RNA, 20 nt, Homo sapiens
gguccugggggccugaccuc

SEQ ID NO: 2060253 - RNA, 15 nt, Homo sapiens
agugcguguguagag

SEQ ID NO: 2060254 - RNA, 14 nt, Homo sapiens
gagagaaucucaag

SEQ ID NO: 2060255 - RNA, 19 nt, Homo sapiens
agucucucugcaagacaga

SEQ ID NO: 2060256 - RNA, 22 nt, Homo sapiens
accucuggcaugaauauuucau

SEQ ID NO: 2060257 - RNA, 19 nt, Homo sapiens
gucugaagccugcaggucc

SEQ ID NO: 2060258 - RNA, 17 nt, Homo sapiens
uucagaaaaggaugccu

SEQ ID NO: 2060259 - RNA, 19 nt, Homo sapiens
aaaaaguuucuuaaggaaa

SEQ ID NO: 2060260 - RNA, 17 nt, Homo sapiens
agccuggauuccagcag

SEQ ID NO: 2060261 - RNA, 14 nt, Homo sapiens
uuuauugcuuguug

SEQ ID NO: 2060262 - RNA, 13 nt, Homo sapiens
ccaucgcucugag

SEQ ID NO: 2060263 - RNA, 22 nt, Homo sapiens
auacuacugugugugcauugaa

SEQ ID NO: 2060264 - RNA, 22 nt, Homo sapiens
acacaccgauguacacacacag

SEQ ID NO: 2060265 - RNA, 16 nt, Homo sapiens
acugccacaagcacaa

SEQ ID NO: 2060266 - RNA, 21 nt, Homo sapiens
guggguuauccuccucuccau

SEQ ID NO: 2060267 - RNA, 20 nt, Homo sapiens
accucacgugcaaagccacc

SEQ ID NO: 2060268 - RNA, 14 nt, Homo sapiens
ccuucugucagcag

SEQ ID NO: 2060269 - RNA, 19 nt, Homo sapiens
guguuucagcuaagggaag

SEQ ID NO: 2060270 - RNA, 12 nt, Homo sapiens
cagugacugugu

SEQ ID NO: 2060271 - RNA, 13 nt, Homo sapiens
gguggcagccagg

SEQ ID NO: 2060272 - RNA, 20 nt, Homo sapiens
caccucucugccuguuccuc

SEQ ID NO: 2060273 - RNA, 14 nt, Homo sapiens
ccuuucuuguaaua

SEQ ID NO: 2060274 - RNA, 16 nt, Homo sapiens
auaaaauaguauugaa

SEQ ID NO: 2060275 - RNA, 19 nt, Homo sapiens
uuccaacacuccauuauuc

SEQ ID NO: 2060276 - RNA, 17 nt, Homo sapiens
ccaaacaauuuagccag

SEQ ID NO: 2060277 - RNA, 20 nt, Homo sapiens
ugggagauuuggaauacaca

SEQ ID NO: 2060278 - RNA, 23 nt, Homo sapiens
ccacguccugggugcugucaugc

SEQ ID NO: 2060279 - RNA, 20 nt, Homo sapiens
uuaguagucaaaaacaaagc

SEQ ID NO: 2060280 - RNA, 16 nt, Homo sapiens
cugggcaaagccacaa

SEQ ID NO: 2060281 - RNA, 20 nt, Homo sapiens
cccaggcuggagugcaauga

SEQ ID NO: 2060282 - RNA, 13 nt, Homo sapiens
ugccagacgcuca

SEQ ID NO: 2060283 - RNA, 13 nt, Homo sapiens
aagccauaugaca

SEQ ID NO: 2060284 - RNA, 20 nt, Homo sapiens
cgcugcugugcucuggggau

SEQ ID NO: 2060285 - RNA, 12 nt, Homo sapiens
uaggcauacaag

SEQ ID NO: 2060286 - RNA, 16 nt, Homo sapiens
cugaucauuugaggaa

SEQ ID NO: 2060287 - RNA, 22 nt, Homo sapiens
ugcucaagccggaaacucggca

SEQ ID NO: 2060288 - RNA, 21 nt, Homo sapiens
cucccuguaaugcacuccugc

SEQ ID NO: 2060289 - RNA, 16 nt, Homo sapiens
ucucauccauggauuc

SEQ ID NO: 2060290 - RNA, 13 nt, Homo sapiens
cagggucugccuc

SEQ ID NO: 2060291 - RNA, 17 nt, Homo sapiens
ucuucuccccucaccca

SEQ ID NO: 2060292 - RNA, 23 nt, Homo sapiens
ccacagggcgagacuccgucuca

SEQ ID NO: 2060293 - RNA, 17 nt, Homo sapiens
cuggcuagcauuccuca

SEQ ID NO: 2060294 - RNA, 18 nt, Homo sapiens
aucuucagcuugugcaca

SEQ ID NO: 2060295 - RNA, 13 nt, Homo sapiens
cauauguaaaaua

SEQ ID NO: 2060296 - RNA, 20 nt, Homo sapiens
aaugauugauuauaucauuu

SEQ ID NO: 2060297 - RNA, 24 nt, Homo sapiens
ucacuucuaguuuggcauuucaca

SEQ ID NO: 2060298 - RNA, 19 nt, Homo sapiens
uauggcguaaguacagaga

SEQ ID NO: 2060299 - RNA, 18 nt, Homo sapiens
agggaugcggauccugcu

SEQ ID NO: 2060300 - RNA, 19 nt, Homo sapiens
uccaagccuggcacccacc

SEQ ID NO: 2060301 - RNA, 14 nt, Homo sapiens
uagaccaccuaaua

SEQ ID NO: 2060302 - RNA, 20 nt, Homo sapiens
ucugguugguaaagccucag

SEQ ID NO: 2060303 - RNA, 23 nt, Homo sapiens
uggagacacccucuggggguccu

SEQ ID NO: 2060304 - RNA, 13 nt, Homo sapiens
ucauucaacccac

SEQ ID NO: 2060305 - RNA, 21 nt, Homo sapiens
uagcugggauuugaacugagc

SEQ ID NO: 2060306 - RNA, 15 nt, Homo sapiens
gggaaauccauucca

SEQ ID NO: 2060307 - RNA, 19 nt, Homo sapiens
ugcuugcuggccacaagga

SEQ ID NO: 2060308 - RNA, 17 nt, Homo sapiens
cuauagguccagaaguc

SEQ ID NO: 2060309 - RNA, 14 nt, Homo sapiens
cagaaacuucucag

SEQ ID NO: 2060310 - RNA, 17 nt, Homo sapiens
uugcuuuucaacacaca

SEQ ID NO: 2060311 - RNA, 20 nt, Homo sapiens
ucaauauccaccccauccaa

SEQ ID NO: 2060312 - RNA, 14 nt, Homo sapiens
uagaauucagucaa

SEQ ID NO: 2060313 - RNA, 17 nt, Homo sapiens
ccuccugguccuggaca

SEQ ID NO: 2060314 - RNA, 20 nt, Homo sapiens
cauuccugagauucugggaa

SEQ ID NO: 2060315 - RNA, 13 nt, Homo sapiens
ucacugcacucca

SEQ ID NO: 2060316 - RNA, 14 nt, Homo sapiens
auuacuuggcuuuu

SEQ ID NO: 2060317 - RNA, 14 nt, Homo sapiens
cagauuaaacccuu

SEQ ID NO: 2060318 - RNA, 24 nt, Homo sapiens
ggugaucucauuuaauccucucaa

SEQ ID NO: 2060319 - RNA, 22 nt, Homo sapiens
cauugucuguuuggaagaccag

SEQ ID NO: 2060320 - RNA, 16 nt, Homo sapiens
uccuuuuguuuuccac

SEQ ID NO: 2060321 - RNA, 11 nt, Homo sapiens
uuuucuuuauc

SEQ ID NO: 2060322 - RNA, 16 nt, Homo sapiens
agacugcccuucucac

SEQ ID NO: 2060323 - RNA, 22 nt, Homo sapiens
ccauuuauaauguuaguagaaa

SEQ ID NO: 2060324 - RNA, 16 nt, Homo sapiens
ucuuaaucuuuucaca

SEQ ID NO: 2060325 - RNA, 17 nt, Homo sapiens
gaguuugcaaugucaca

SEQ ID NO: 2060326 - RNA, 17 nt, Homo sapiens
auuuaaaacaucauuac

SEQ ID NO: 2060327 - RNA, 16 nt, Homo sapiens
caguaaauguuuauua

SEQ ID NO: 2060328 - RNA, 21 nt, Homo sapiens
ugaggucagggggcacugucu

SEQ ID NO: 2060329 - RNA, 14 nt, Homo sapiens
gaggccauccugcc

SEQ ID NO: 2060330 - RNA, 17 nt, Homo sapiens
uucauuguuuugcaaaa

SEQ ID NO: 2060331 - RNA, 21 nt, Homo sapiens
ucugagaaccaaccaaugaaa

SEQ ID NO: 2060332 - RNA, 20 nt, Homo sapiens
acugggcuccggaggacuca

SEQ ID NO: 2060333 - RNA, 11 nt, Homo sapiens
uuccagaucaa

SEQ ID NO: 2060334 - RNA, 19 nt, Homo sapiens
uuuccccuccuuggcuuua

SEQ ID NO: 2060335 - RNA, 15 nt, Homo sapiens
guucuaaguucaugu

SEQ ID NO: 2060336 - RNA, 17 nt, Homo sapiens
uuaucaugcauguuaug

SEQ ID NO: 2060337 - RNA, 15 nt, Homo sapiens
caauucaaucaaagc

SEQ ID NO: 2060338 - RNA, 18 nt, Homo sapiens
acaaaggccacaggcagu

SEQ ID NO: 2060339 - RNA, 16 nt, Homo sapiens
cucuucuuacuugaug

SEQ ID NO: 2060340 - RNA, 22 nt, Homo sapiens
cuacaguccuuccaggggcucu

SEQ ID NO: 2060341 - RNA, 17 nt, Homo sapiens
gacucuaguacugugaa

SEQ ID NO: 2060342 - RNA, 12 nt, Homo sapiens
auugaagccaau

SEQ ID NO: 2060343 - RNA, 18 nt, Homo sapiens
augugucaccggggcaac

SEQ ID NO: 2060344 - RNA, 20 nt, Homo sapiens
cuugaacacaguauuuuccc

SEQ ID NO: 2060345 - RNA, 12 nt, Homo sapiens
aguguccaggcu

SEQ ID NO: 2060346 - RNA, 13 nt, Homo sapiens
augaucuagccuc

SEQ ID NO: 2060347 - RNA, 15 nt, Homo sapiens
ggagacagagccaag

SEQ ID NO: 2060348 - RNA, 22 nt, Homo sapiens
aaaaccuugauuuaaaauauca

SEQ ID NO: 2060349 - RNA, 22 nt, Homo sapiens
uaggaagcccucgucucuacaa

SEQ ID NO: 2060350 - RNA, 15 nt, Homo sapiens
aguuuuggcauaaua

SEQ ID NO: 2060351 - RNA, 12 nt, Homo sapiens
accuugcugcua

SEQ ID NO: 2060352 - RNA, 16 nt, Homo sapiens
gcauguuuguuguaua

SEQ ID NO: 2060353 - RNA, 17 nt, Homo sapiens
aauaggugcuuauucuc

SEQ ID NO: 2060354 - RNA, 12 nt, Homo sapiens
cuggacugggag

SEQ ID NO: 2060355 - RNA, 21 nt, Homo sapiens
uccuggcccucuucuuauuca

SEQ ID NO: 2060356 - RNA, 14 nt, Homo sapiens
aauucacacugcca

SEQ ID NO: 2060357 - RNA, 12 nt, Homo sapiens
accgaacacuac

SEQ ID NO: 2060358 - RNA, 15 nt, Homo sapiens
aagcaaguggcuuuc

SEQ ID NO: 2060359 - RNA, 20 nt, Homo sapiens
uggacgucagccuguggauu

SEQ ID NO: 2060360 - RNA, 19 nt, Homo sapiens
gugucugagagcaaaguga

SEQ ID NO: 2060361 - RNA, 16 nt, Homo sapiens
agauugauaacuauga

SEQ ID NO: 2060362 - RNA, 19 nt, Homo sapiens
cugccaccacgucugccag

SEQ ID NO: 2060363 - RNA, 22 nt, Homo sapiens
cuguaagcaccugggcugagga

SEQ ID NO: 2060364 - RNA, 20 nt, Homo sapiens
acagauccuuuuuccaucau

SEQ ID NO: 2060365 - RNA, 16 nt, Homo sapiens
aucauucucauucuca

SEQ ID NO: 2060366 - RNA, 19 nt, Homo sapiens
ggggauguuugugcugcag

SEQ ID NO: 2060367 - RNA, 12 nt, Homo sapiens
aacacagugaaa

SEQ ID NO: 2060368 - RNA, 13 nt, Homo sapiens
uucuuuucaccuc

SEQ ID NO: 2060369 - RNA, 22 nt, Homo sapiens
gguagaggugugugccuaguga

SEQ ID NO: 2060370 - RNA, 17 nt, Homo sapiens
agcaugaagauaaaucc

SEQ ID NO: 2060371 - RNA, 18 nt, Homo sapiens
aaacccuagaccauguca

SEQ ID NO: 2060372 - RNA, 16 nt, Homo sapiens
aagcaggggauccugg

SEQ ID NO: 2060373 - RNA, 15 nt, Homo sapiens
ccucagacuucucag

SEQ ID NO: 2060374 - RNA, 23 nt, Homo sapiens
cagccuuuggccuuggcuuuucu

SEQ ID NO: 2060375 - RNA, 19 nt, Homo sapiens
ugaaaugaagcaacagaga

SEQ ID NO: 2060376 - RNA, 21 nt, Homo sapiens
augccacagaauuugcuaaua

SEQ ID NO: 2060377 - RNA, 21 nt, Homo sapiens
uuuuuuguauagaccaaagca

SEQ ID NO: 2060378 - RNA, 22 nt, Homo sapiens
auuuccuuacagaacuacuucu

SEQ ID NO: 2060379 - RNA, 19 nt, Homo sapiens
auacauauguagacuauau

SEQ ID NO: 2060380 - RNA, 20 nt, Homo sapiens
cccaggcacuuugcaucaca

SEQ ID NO: 2060381 - RNA, 15 nt, Homo sapiens
gacccccaucugagc

SEQ ID NO: 2060382 - RNA, 16 nt, Homo sapiens
auugcaucgcugucca

SEQ ID NO: 2060383 - RNA, 16 nt, Homo sapiens
cuuucauucuucucac

SEQ ID NO: 2060384 - RNA, 15 nt, Homo sapiens
aggccuggauaauau

SEQ ID NO: 2060385 - RNA, 20 nt, Homo sapiens
aagaagacauuugccaacag

SEQ ID NO: 2060386 - RNA, 18 nt, Homo sapiens
acuccauguuaaucacau

SEQ ID NO: 2060387 - RNA, 22 nt, Homo sapiens
acgguggccuaggguacaggca

SEQ ID NO: 2060388 - RNA, 14 nt, Homo sapiens
ugaugacuuacuau

SEQ ID NO: 2060389 - RNA, 19 nt, Homo sapiens
gggccuguuacacaugaca

SEQ ID NO: 2060390 - RNA, 16 nt, Homo sapiens
ucaagcaaacaucaaa

SEQ ID NO: 2060391 - RNA, 23 nt, Homo sapiens
gauuaaaaucuggcaaaguuaua

SEQ ID NO: 2060392 - RNA, 17 nt, Homo sapiens
auuucuguuuugcauau

SEQ ID NO: 2060393 - RNA, 21 nt, Homo sapiens
agaaaagugaaaguaacuguu

SEQ ID NO: 2060394 - RNA, 15 nt, Homo sapiens
aguguaccauuugcc

SEQ ID NO: 2060395 - RNA, 13 nt, Homo sapiens
gccccuucuuauu

SEQ ID NO: 2060396 - RNA, 17 nt, Homo sapiens
agauggacaacucaaug

SEQ ID NO: 2060397 - RNA, 18 nt, Homo sapiens
gucacuugccagucacuc

SEQ ID NO: 2060398 - RNA, 15 nt, Homo sapiens
uguuaugcaagcaca

SEQ ID NO: 2060399 - RNA, 18 nt, Homo sapiens
ucacugaauuucaaacau

SEQ ID NO: 2060400 - RNA, 19 nt, Homo sapiens
aguagagacgagguuucac

SEQ ID NO: 2060401 - RNA, 19 nt, Homo sapiens
ucaacuuuuuauugccuuc

SEQ ID NO: 2060402 - RNA, 16 nt, Homo sapiens
cuggaaaccagaauga

SEQ ID NO: 2060403 - RNA, 18 nt, Homo sapiens
ggugaaacccccaucucu

SEQ ID NO: 2060404 - RNA, 21 nt, Homo sapiens
gacacaaucucggcucacuga

SEQ ID NO: 2060405 - RNA, 15 nt, Homo sapiens
uguucuuaacaagca

SEQ ID NO: 2060406 - RNA, 14 nt, Homo sapiens
cacucuccuugcag

SEQ ID NO: 2060407 - RNA, 15 nt, Homo sapiens
aacauuucucuggau

SEQ ID NO: 2060408 - RNA, 21 nt, Homo sapiens
auuacuggccuuuuucauuua

SEQ ID NO: 2060409 - RNA, 17 nt, Homo sapiens
uuaaagacaaauuuugc

SEQ ID NO: 2060410 - RNA, 17 nt, Homo sapiens
acaggaacccaccaaac

SEQ ID NO: 2060411 - RNA, 18 nt, Homo sapiens
cucucaggagaucuggcu

SEQ ID NO: 2060412 - RNA, 16 nt, Homo sapiens
ugcugugggaaggcaa

SEQ ID NO: 2060413 - RNA, 22 nt, Homo sapiens
aaaccugauguuaaaauuccau

SEQ ID NO: 2060414 - RNA, 22 nt, Homo sapiens
gacuuaagcccagugcacugaa

SEQ ID NO: 2060415 - RNA, 24 nt, Homo sapiens
cacuggucaaaaccuacacagcug

SEQ ID NO: 2060416 - RNA, 16 nt, Homo sapiens
aguuucuaguaucaca

SEQ ID NO: 2060417 - RNA, 19 nt, Homo sapiens
cccaguguaugucuuguau

SEQ ID NO: 2060418 - RNA, 21 nt, Homo sapiens
cuauucccuucuaaccugaac

SEQ ID NO: 2060419 - RNA, 22 nt, Homo sapiens
agaguuuuguaacaaaugacug

SEQ ID NO: 2060420 - RNA, 15 nt, Homo sapiens
uucaacuucaggaaa

SEQ ID NO: 2060421 - RNA, 15 nt, Homo sapiens
ugccaauuagcaauu

SEQ ID NO: 2060422 - RNA, 20 nt, Homo sapiens
cauggaucaaccaaguuaca

SEQ ID NO: 2060423 - RNA, 21 nt, Homo sapiens
agcaaaaagagaugcuggauu

SEQ ID NO: 2060424 - RNA, 16 nt, Homo sapiens
gauuagagagucucaa

SEQ ID NO: 2060425 - RNA, 13 nt, Homo sapiens
gucacagccacuu

SEQ ID NO: 2060426 - RNA, 15 nt, Homo sapiens
acgaaacacaaacca

SEQ ID NO: 2060427 - RNA, 17 nt, Homo sapiens
uuuagugguacucugaa

SEQ ID NO: 2060428 - RNA, 17 nt, Homo sapiens
acaacaggaaaugaaau

SEQ ID NO: 2060429 - RNA, 20 nt, Homo sapiens
cagagcgagagaauauguca

SEQ ID NO: 2060430 - RNA, 21 nt, Homo sapiens
cauucugcuuucuugccacac

SEQ ID NO: 2060431 - RNA, 16 nt, Homo sapiens
guuagagcagaauuca

SEQ ID NO: 2060432 - RNA, 13 nt, Homo sapiens
acuccuacuaaau

SEQ ID NO: 2060433 - RNA, 15 nt, Homo sapiens
ucgugagucauuuaa

SEQ ID NO: 2060434 - RNA, 14 nt, Homo sapiens
uuggaauaaucacu

SEQ ID NO: 2060435 - RNA, 17 nt, Homo sapiens
auuccugugcggacagc

SEQ ID NO: 2060436 - RNA, 17 nt, Homo sapiens
aucuugguuuaacucuu

SEQ ID NO: 2060437 - RNA, 14 nt, Homo sapiens
ugugggcuugacca

SEQ ID NO: 2060438 - RNA, 21 nt, Homo sapiens
agaaggacucacuagacucag

SEQ ID NO: 2060439 - RNA, 23 nt, Homo sapiens
acaguuuugcuuuaguacaauag

SEQ ID NO: 2060440 - RNA, 22 nt, Homo sapiens
cuggcuagaguccucacuccca

SEQ ID NO: 2060441 - RNA, 11 nt, Homo sapiens
accugugauga

SEQ ID NO: 2060442 - RNA, 16 nt, Homo sapiens
caacaggcuugugcaa

SEQ ID NO: 2060443 - RNA, 17 nt, Homo sapiens
gaaaguccagcacugga

SEQ ID NO: 2060444 - RNA, 16 nt, Homo sapiens
ugccguuaucauggag

SEQ ID NO: 2060445 - RNA, 23 nt, Homo sapiens
augauuuggggugauuucucacc

SEQ ID NO: 2060446 - RNA, 14 nt, Homo sapiens
auuuacaagcauca

SEQ ID NO: 2060447 - RNA, 15 nt, Homo sapiens
aaauuauacugagaa

SEQ ID NO: 2060448 - RNA, 13 nt, Homo sapiens
cauuccugcucaa

SEQ ID NO: 2060449 - RNA, 14 nt, Homo sapiens
cacuucuguuccag

SEQ ID NO: 2060450 - RNA, 15 nt, Homo sapiens
agcugugacuucucc

SEQ ID NO: 2060451 - RNA, 16 nt, Homo sapiens
ugagacacugcacaga

SEQ ID NO: 2060452 - RNA, 18 nt, Homo sapiens
cugcaugcgagugcucau

SEQ ID NO: 2060453 - RNA, 17 nt, Homo sapiens
auuauaagugcagagau

SEQ ID NO: 2060454 - RNA, 21 nt, Homo sapiens
caaggaugcugucaagcaccu

SEQ ID NO: 2060455 - RNA, 15 nt, Homo sapiens
uaagucuugucucau

SEQ ID NO: 2060456 - RNA, 18 nt, Homo sapiens
aaauguaaagucuagaaa

SEQ ID NO: 2060457 - RNA, 17 nt, Homo sapiens
aaguaauuuucuucuca

SEQ ID NO: 2060458 - RNA, 12 nt, Homo sapiens
acuugcacuguu

SEQ ID NO: 2060459 - RNA, 16 nt, Homo sapiens
augaguuacuguuuaa

SEQ ID NO: 2060460 - RNA, 16 nt, Homo sapiens
gacaugcggcugccca

SEQ ID NO: 2060461 - RNA, 19 nt, Homo sapiens
ucucuucuacaauuguggu

SEQ ID NO: 2060462 - RNA, 17 nt, Homo sapiens
auaucauauuguuaaau

SEQ ID NO: 2060463 - RNA, 19 nt, Homo sapiens
gaaagggccacccaugaua

SEQ ID NO: 2060464 - RNA, 13 nt, Homo sapiens
uauuuuaucucaa

SEQ ID NO: 2060465 - RNA, 18 nt, Homo sapiens
ugauuccaccuacaugag

SEQ ID NO: 2060466 - RNA, 21 nt, Homo sapiens
agaucugcuugaucaauuccc

SEQ ID NO: 2060467 - RNA, 15 nt, Homo sapiens
agauagccccacagg

SEQ ID NO: 2060468 - RNA, 18 nt, Homo sapiens
cuuuguaucaauccaggc

SEQ ID NO: 2060469 - RNA, 18 nt, Homo sapiens
aggcuguucugcacugaa

SEQ ID NO: 2060470 - RNA, 19 nt, Homo sapiens
ucuugacguuuacauauau

SEQ ID NO: 2060471 - RNA, 20 nt, Homo sapiens
agcaagggcaagaacccaag

SEQ ID NO: 2060472 - RNA, 21 nt, Homo sapiens
aagcaaaaaaugaaugucuaa

SEQ ID NO: 2060473 - RNA, 21 nt, Homo sapiens
auacauaauauaugacuuccu

SEQ ID NO: 2060474 - RNA, 17 nt, Homo sapiens
uacgacucuuuuccaaa

SEQ ID NO: 2060475 - RNA, 17 nt, Homo sapiens
ccagggcgagcacuuuc

SEQ ID NO: 2060476 - RNA, 16 nt, Homo sapiens
gcccccacugaccugc

SEQ ID NO: 2060477 - RNA, 16 nt, Homo sapiens
ccacucuucacaggcu

SEQ ID NO: 2060478 - RNA, 20 nt, Homo sapiens
cuccaugcuuugcucucaag

SEQ ID NO: 2060479 - RNA, 19 nt, Homo sapiens
gacacaauguugcacugaa

SEQ ID NO: 2060480 - RNA, 14 nt, Homo sapiens
agccucaaacucaa

SEQ ID NO: 2060481 - RNA, 21 nt, Homo sapiens
uguaaaaaauguaaaauggag

SEQ ID NO: 2060482 - RNA, 15 nt, Homo sapiens
acagaauagcacaaa

SEQ ID NO: 2060483 - RNA, 16 nt, Homo sapiens
ugcaucguggagacag

SEQ ID NO: 2060484 - RNA, 18 nt, Homo sapiens
gaaaguuaauccacugug

SEQ ID NO: 2060485 - RNA, 18 nt, Homo sapiens
auuugccacugauauuca

SEQ ID NO: 2060486 - RNA, 19 nt, Homo sapiens
uuuaaaaaauucuuguauu

SEQ ID NO: 2060487 - RNA, 19 nt, Homo sapiens
ugugggaaaaauaugugaa

SEQ ID NO: 2060488 - RNA, 18 nt, Homo sapiens
aauuuaucaaagcauaga

SEQ ID NO: 2060489 - RNA, 22 nt, Homo sapiens
uuugggggggaauaagauuaua

SEQ ID NO: 2060490 - RNA, 19 nt, Homo sapiens
uuaugucaucauacaugac

SEQ ID NO: 2060491 - RNA, 19 nt, Homo sapiens
ugaaucuugggaccuuuaa

SEQ ID NO: 2060492 - RNA, 14 nt, Homo sapiens
gcagauaggagcug

SEQ ID NO: 2060493 - RNA, 14 nt, Homo sapiens
ccagagagcagcuu

SEQ ID NO: 2060494 - RNA, 14 nt, Homo sapiens
auucuaauuacaaa

SEQ ID NO: 2060495 - RNA, 20 nt, Homo sapiens
auacuagaguucauggauau

SEQ ID NO: 2060496 - RNA, 18 nt, Homo sapiens
aaauauaaacugugagau

SEQ ID NO: 2060497 - RNA, 16 nt, Homo sapiens
cuucauagaaaccucu

SEQ ID NO: 2060498 - RNA, 20 nt, Homo sapiens
uuguccauuacuugccaggg

SEQ ID NO: 2060499 - RNA, 15 nt, Homo sapiens
auaaugcuacugucu

SEQ ID NO: 2060500 - RNA, 16 nt, Homo sapiens
aguucuuuuaagccca

SEQ ID NO: 2060501 - RNA, 17 nt, Homo sapiens
cuaaccaaagagucucu

SEQ ID NO: 2060502 - RNA, 17 nt, Homo sapiens
gggugcugucaugccca

SEQ ID NO: 2060503 - RNA, 18 nt, Homo sapiens
cccagaucacacaucauc

SEQ ID NO: 2060504 - RNA, 22 nt, Homo sapiens
guguugggaccugcugcuccau

SEQ ID NO: 2060505 - RNA, 21 nt, Homo sapiens
ugggaaauauuuagcaaauaa

SEQ ID NO: 2060506 - RNA, 23 nt, Homo sapiens
agaugcuggacacccucuuccca

SEQ ID NO: 2060507 - RNA, 17 nt, Homo sapiens
gccgucuccucccucag

SEQ ID NO: 2060508 - RNA, 15 nt, Homo sapiens
cauuuucauugauga

SEQ ID NO: 2060509 - RNA, 14 nt, Homo sapiens
uaaucccagcacua

SEQ ID NO: 2060510 - RNA, 17 nt, Homo sapiens
ucaauauuaaauacaga

SEQ ID NO: 2060511 - RNA, 15 nt, Homo sapiens
cucccuuggauuuuu

SEQ ID NO: 2060512 - RNA, 15 nt, Homo sapiens
gauucucgcuccuuc

SEQ ID NO: 2060513 - RNA, 23 nt, Homo sapiens
ggauacagucuucuuacuuggaa

SEQ ID NO: 2060514 - RNA, 16 nt, Homo sapiens
uggccagaccagguga

SEQ ID NO: 2060515 - RNA, 18 nt, Homo sapiens
agaugcuguugugaagcu

SEQ ID NO: 2060516 - RNA, 15 nt, Homo sapiens
uccaccaucaccucu

SEQ ID NO: 2060517 - RNA, 21 nt, Homo sapiens
uccagccugaauguuauuucc

SEQ ID NO: 2060518 - RNA, 21 nt, Homo sapiens
gcccaggaauuagagaagcug

SEQ ID NO: 2060519 - RNA, 18 nt, Homo sapiens
cagaguggggaugacaug

SEQ ID NO: 2060520 - RNA, 15 nt, Homo sapiens
acugugcucagccac

SEQ ID NO: 2060521 - RNA, 23 nt, Homo sapiens
acuuuucuuuuuuucaaaugaau

SEQ ID NO: 2060522 - RNA, 23 nt, Homo sapiens
ucagcauugucucguguacagcu

SEQ ID NO: 2060523 - RNA, 20 nt, Homo sapiens
ucaucaaauggaagacacau

SEQ ID NO: 2060524 - RNA, 16 nt, Homo sapiens
ucaguuuaaacaaagg

SEQ ID NO: 2060525 - RNA, 21 nt, Homo sapiens
agaagaccguuuaccuagaag

SEQ ID NO: 2060526 - RNA, 16 nt, Homo sapiens
aguguggcugaggcca

SEQ ID NO: 2060527 - RNA, 17 nt, Homo sapiens
gcuguguguccuugcau

SEQ ID NO: 2060528 - RNA, 20 nt, Homo sapiens
uauuccaaacucuccagcca

SEQ ID NO: 2060529 - RNA, 18 nt, Homo sapiens
auuuuuagaaaucagcua

SEQ ID NO: 2060530 - RNA, 19 nt, Homo sapiens
ucccauucacagauaccuc

SEQ ID NO: 2060531 - RNA, 20 nt, Homo sapiens
ccucccuucuucugagugaa

SEQ ID NO: 2060532 - RNA, 15 nt, Homo sapiens
cuucuccccuuccau

SEQ ID NO: 2060533 - RNA, 20 nt, Homo sapiens
ccauugauuuaauguaauag

SEQ ID NO: 2060534 - RNA, 22 nt, Homo sapiens
cuguggcaggccuaggaccuca

SEQ ID NO: 2060535 - RNA, 17 nt, Homo sapiens
agcuacucucuugccag

SEQ ID NO: 2060536 - RNA, 17 nt, Homo sapiens
acucaggguucaucugu

SEQ ID NO: 2060537 - RNA, 16 nt, Homo sapiens
gaagcaucucugacca

SEQ ID NO: 2060538 - RNA, 14 nt, Homo sapiens
acugauaaaccaaa

SEQ ID NO: 2060539 - RNA, 15 nt, Homo sapiens
aacuucccucuaguu

SEQ ID NO: 2060540 - RNA, 15 nt, Homo sapiens
cuugggagaaaauca

SEQ ID NO: 2060541 - RNA, 16 nt, Homo sapiens
agcccagacgcagcug

SEQ ID NO: 2060542 - RNA, 11 nt, Homo sapiens
ucagcccagug

SEQ ID NO: 2060543 - RNA, 13 nt, Homo sapiens
uauauccauaaga

SEQ ID NO: 2060544 - RNA, 15 nt, Homo sapiens
auacuauuauuugcu

SEQ ID NO: 2060545 - RNA, 22 nt, Homo sapiens
gagauugcucuggggcuugcua

SEQ ID NO: 2060546 - RNA, 15 nt, Homo sapiens
auaaaaagcauuauu

SEQ ID NO: 2060547 - RNA, 15 nt, Homo sapiens
gugcuguuguucucg

SEQ ID NO: 2060548 - RNA, 22 nt, Homo sapiens
acuaauucuaugucuagcacau

SEQ ID NO: 2060549 - RNA, 23 nt, Homo sapiens
uuaggaagaagugguacuagugu

SEQ ID NO: 2060550 - RNA, 20 nt, Homo sapiens
ccaggcuggacugcaaugac

SEQ ID NO: 2060551 - RNA, 16 nt, Homo sapiens
aacagccaagugugac

SEQ ID NO: 2060552 - RNA, 23 nt, Homo sapiens
ucaggcuggguugucacugagac

SEQ ID NO: 2060553 - RNA, 20 nt, Homo sapiens
aggcagaggauguucuggac

SEQ ID NO: 2060554 - RNA, 20 nt, Homo sapiens
uaaauaaagacgacuacaga

SEQ ID NO: 2060555 - RNA, 19 nt, Homo sapiens
uggcaccucagacaaucca

SEQ ID NO: 2060556 - RNA, 20 nt, Homo sapiens
ugauauuuauuuuuugccau

SEQ ID NO: 2060557 - RNA, 17 nt, Homo sapiens
aguaaucaucuaaguca

SEQ ID NO: 2060558 - RNA, 17 nt, Homo sapiens
cauagaaacaugacacu

SEQ ID NO: 2060559 - RNA, 20 nt, Homo sapiens
gcuaauccaggacagcauua

SEQ ID NO: 2060560 - RNA, 20 nt, Homo sapiens
uuguacaagguauuuacaca

SEQ ID NO: 2060561 - RNA, 18 nt, Homo sapiens
uaugcuuucuuuggccua

SEQ ID NO: 2060562 - RNA, 17 nt, Homo sapiens
auagaauaaauacaaua

SEQ ID NO: 2060563 - RNA, 17 nt, Homo sapiens
cagcauucucacuccua

SEQ ID NO: 2060564 - RNA, 14 nt, Homo sapiens
aacacaaaacauuc

SEQ ID NO: 2060565 - RNA, 22 nt, Homo sapiens
cacagagggcaggcacucccau

SEQ ID NO: 2060566 - RNA, 19 nt, Homo sapiens
cuuauauuuucguaugaaa

SEQ ID NO: 2060567 - RNA, 13 nt, Homo sapiens
cuguuuugaggaa

SEQ ID NO: 2060568 - RNA, 21 nt, Homo sapiens
uuuuggaaaaaugucacugaa

SEQ ID NO: 2060569 - RNA, 11 nt, Homo sapiens
cuuuuccucua

SEQ ID NO: 2060570 - RNA, 18 nt, Homo sapiens
uuuccuauuugcaguuac

SEQ ID NO: 2060571 - RNA, 12 nt, Homo sapiens
auaggugcaguu

SEQ ID NO: 2060572 - RNA, 18 nt, Homo sapiens
aaagcagaaaaucuacca

SEQ ID NO: 2060573 - RNA, 18 nt, Homo sapiens
aucaggugaggugugcuc

SEQ ID NO: 2060574 - RNA, 23 nt, Homo sapiens
gucugccacaagggcaguggaag

SEQ ID NO: 2060575 - RNA, 22 nt, Homo sapiens
aaugugaaaaugguccaggaga

SEQ ID NO: 2060576 - RNA, 22 nt, Homo sapiens
uccuucugggacuggacagcuu

SEQ ID NO: 2060577 - RNA, 21 nt, Homo sapiens
aguggugccccagcacggugg

SEQ ID NO: 2060578 - RNA, 21 nt, Homo sapiens
uuucagggcugggcuauaaca

SEQ ID NO: 2060579 - RNA, 16 nt, Homo sapiens
cgagccaggcugacca

SEQ ID NO: 2060580 - RNA, 20 nt, Homo sapiens
cucaagugcaaggaccaaag

SEQ ID NO: 2060581 - RNA, 13 nt, Homo sapiens
ggacuuaaacugc

SEQ ID NO: 2060582 - RNA, 21 nt, Homo sapiens
aucuagacucaagguucccag

SEQ ID NO: 2060583 - RNA, 21 nt, Homo sapiens
ugcaucuggguuuguuuacag

SEQ ID NO: 2060584 - RNA, 14 nt, Homo sapiens
aaggcaaaugaugc

SEQ ID NO: 2060585 - RNA, 21 nt, Homo sapiens
aaaggguguaggggccaccuc

SEQ ID NO: 2060586 - RNA, 19 nt, Homo sapiens
agggguccccaacauggau

SEQ ID NO: 2060587 - RNA, 16 nt, Homo sapiens
gugcuggauuugauga

SEQ ID NO: 2060588 - RNA, 18 nt, Homo sapiens
uguaauccuaaauuuacc

SEQ ID NO: 2060589 - RNA, 15 nt, Homo sapiens
auuucucaccugaaa

SEQ ID NO: 2060590 - RNA, 16 nt, Homo sapiens
gagagugcacaugccc

SEQ ID NO: 2060591 - RNA, 17 nt, Homo sapiens
uaguuauauauggggau

SEQ ID NO: 2060592 - RNA, 19 nt, Homo sapiens
gaaucauauucauaugcag

SEQ ID NO: 2060593 - RNA, 19 nt, Homo sapiens
gcccaugaugagaagcaga

SEQ ID NO: 2060594 - RNA, 19 nt, Homo sapiens
auauaguccagacacuuaa

SEQ ID NO: 2060595 - RNA, 16 nt, Homo sapiens
aagaaacccucuguca

SEQ ID NO: 2060596 - RNA, 20 nt, Homo sapiens
uuaaucacaccguccuccac

SEQ ID NO: 2060597 - RNA, 23 nt, Homo sapiens
gacccuaaauguggacaucauga

SEQ ID NO: 2060598 - RNA, 19 nt, Homo sapiens
ccuugaaaacacuguucuc

SEQ ID NO: 2060599 - RNA, 20 nt, Homo sapiens
gugucacagguuaauguggu

SEQ ID NO: 2060600 - RNA, 23 nt, Homo sapiens
aacccccugacauuaucuuggau

SEQ ID NO: 2060601 - RNA, 15 nt, Homo sapiens
uuugccccuggcaaa

SEQ ID NO: 2060602 - RNA, 21 nt, Homo sapiens
gaaggucuugccugaauccau

SEQ ID NO: 2060603 - RNA, 20 nt, Homo sapiens
cccacuggcugguuccagaa

SEQ ID NO: 2060604 - RNA, 22 nt, Homo sapiens
ucaaaccucugccgcccuccac

SEQ ID NO: 2060605 - RNA, 19 nt, Homo sapiens
cugcagccccugggaccag

SEQ ID NO: 2060606 - RNA, 15 nt, Homo sapiens
auuguaagaaauacu

SEQ ID NO: 2060607 - RNA, 22 nt, Homo sapiens
aggggaaagaauuaaugcucua

SEQ ID NO: 2060608 - RNA, 19 nt, Homo sapiens
augaaguugaaaaucauag

SEQ ID NO: 2060609 - RNA, 13 nt, Homo sapiens
cauuaaccaagaa

SEQ ID NO: 2060610 - RNA, 15 nt, Homo sapiens
uguguuggcuuugca

SEQ ID NO: 2060611 - RNA, 16 nt, Homo sapiens
ucaguaaauaccuuga

SEQ ID NO: 2060612 - RNA, 22 nt, Homo sapiens
uagagcuagaugugucuuacca

SEQ ID NO: 2060613 - RNA, 16 nt, Homo sapiens
ucuaacuauuacacau

SEQ ID NO: 2060614 - RNA, 20 nt, Homo sapiens
uguaaagugaagaauccuuu

SEQ ID NO: 2060615 - RNA, 18 nt, Homo sapiens
ccuggugggacaacaaag

SEQ ID NO: 2060616 - RNA, 14 nt, Homo sapiens
guucugucuuccca

SEQ ID NO: 2060617 - RNA, 15 nt, Homo sapiens
cgcaugacuguuaca

SEQ ID NO: 2060618 - RNA, 16 nt, Homo sapiens
accuguauuuugccag

SEQ ID NO: 2060619 - RNA, 13 nt, Homo sapiens
cacagaugcucca

SEQ ID NO: 2060620 - RNA, 16 nt, Homo sapiens
uuguuugauuucugac

SEQ ID NO: 2060621 - RNA, 13 nt, Homo sapiens
caccuucuucucc

SEQ ID NO: 2060622 - RNA, 23 nt, Homo sapiens
cugacugggaccaggcaccaggc

SEQ ID NO: 2060623 - RNA, 15 nt, Homo sapiens
cagguaccacguauu

SEQ ID NO: 2060624 - RNA, 16 nt, Homo sapiens
cagaacugaucucagg

SEQ ID NO: 2060625 - RNA, 13 nt, Homo sapiens
acagauccauccu

SEQ ID NO: 2060626 - RNA, 17 nt, Homo sapiens
ugcauugucuaaugaca

SEQ ID NO: 2060627 - RNA, 18 nt, Homo sapiens
cuccaagaccuucuccuu

SEQ ID NO: 2060628 - RNA, 17 nt, Homo sapiens
auaauuguccaugagga

SEQ ID NO: 2060629 - RNA, 11 nt, Homo sapiens
auggaccucag

SEQ ID NO: 2060630 - RNA, 12 nt, Homo sapiens
uuucuguuccag

SEQ ID NO: 2060631 - RNA, 12 nt, Homo sapiens
cuccaagaccac

SEQ ID NO: 2060632 - RNA, 22 nt, Homo sapiens
aucaauaaauguugcaaugcau

SEQ ID NO: 2060633 - RNA, 17 nt, Homo sapiens
ucuagacaucauuguca

SEQ ID NO: 2060634 - RNA, 12 nt, Homo sapiens
gacauugucucc

SEQ ID NO: 2060635 - RNA, 23 nt, Homo sapiens
acgugcacugacagccuugccca

SEQ ID NO: 2060636 - RNA, 16 nt, Homo sapiens
ugcacugaaguuuuug

SEQ ID NO: 2060637 - RNA, 21 nt, Homo sapiens
cuauagagaaaccccugggga

SEQ ID NO: 2060638 - RNA, 15 nt, Homo sapiens
gaguuggugugcuau

SEQ ID NO: 2060639 - RNA, 18 nt, Homo sapiens
aaguaucuaacucuucug

SEQ ID NO: 2060640 - RNA, 12 nt, Homo sapiens
cuuguacagugu

SEQ ID NO: 2060641 - RNA, 20 nt, Homo sapiens
ucucagcccccgcccgucac

SEQ ID NO: 2060642 - RNA, 11 nt, Homo sapiens
gagauccuccu

SEQ ID NO: 2060643 - RNA, 12 nt, Homo sapiens
ccucaagugcaa

SEQ ID NO: 2060644 - RNA, 21 nt, Homo sapiens
ccuuaagaauuuuugaaguga

SEQ ID NO: 2060645 - RNA, 14 nt, Homo sapiens
auguuaugugacua

SEQ ID NO: 2060646 - RNA, 11 nt, Homo sapiens
uaccucuggca

SEQ ID NO: 2060647 - RNA, 15 nt, Homo sapiens
agcuggauucaauuc

SEQ ID NO: 2060648 - RNA, 15 nt, Homo sapiens
aaugauaauagcuca

SEQ ID NO: 2060649 - RNA, 18 nt, Homo sapiens
aacucuaagacuacagca

SEQ ID NO: 2060650 - RNA, 21 nt, Homo sapiens
cuaugaaguaaagaacugcac

SEQ ID NO: 2060651 - RNA, 18 nt, Homo sapiens
cagacuggucuugaacuc

SEQ ID NO: 2060652 - RNA, 20 nt, Homo sapiens
ucaggaaugggccaagccag

SEQ ID NO: 2060653 - RNA, 15 nt, Homo sapiens
uguaagacucauucc

SEQ ID NO: 2060654 - RNA, 17 nt, Homo sapiens
ucucaaacacugcuuaa

SEQ ID NO: 2060655 - RNA, 14 nt, Homo sapiens
acagcucaaagagu

SEQ ID NO: 2060656 - RNA, 19 nt, Homo sapiens
cagguuuugaaaauguaca

SEQ ID NO: 2060657 - RNA, 18 nt, Homo sapiens
ccucugggaaggugaccu

SEQ ID NO: 2060658 - RNA, 16 nt, Homo sapiens
aggacacuuuugccaa

SEQ ID NO: 2060659 - RNA, 20 nt, Homo sapiens
agagacuugggacauugccu

SEQ ID NO: 2060660 - RNA, 17 nt, Homo sapiens
guggcggcagggccagg

SEQ ID NO: 2060661 - RNA, 13 nt, Homo sapiens
ugggaugagaaaa

SEQ ID NO: 2060662 - RNA, 13 nt, Homo sapiens
cuuccacuaccuu

SEQ ID NO: 2060663 - RNA, 22 nt, Homo sapiens
agggugguggcgugcauaugua

SEQ ID NO: 2060664 - RNA, 15 nt, Homo sapiens
agaguuuacagacaa

SEQ ID NO: 2060665 - RNA, 20 nt, Homo sapiens
ggcuggcccucucauucuca

SEQ ID NO: 2060666 - RNA, 15 nt, Homo sapiens
gauuucagcagggau

SEQ ID NO: 2060667 - RNA, 22 nt, Homo sapiens
aagaagguggaaggcaguguua

SEQ ID NO: 2060668 - RNA, 17 nt, Homo sapiens
ccucaauaaauguugcu

SEQ ID NO: 2060669 - RNA, 15 nt, Homo sapiens
cucuacuguggcaaa

SEQ ID NO: 2060670 - RNA, 15 nt, Homo sapiens
cuguccagugcccau

SEQ ID NO: 2060671 - RNA, 17 nt, Homo sapiens
uuaaguugaaaaguaaa

SEQ ID NO: 2060672 - RNA, 18 nt, Homo sapiens
uaaagagagaugaaccac

SEQ ID NO: 2060673 - RNA, 12 nt, Homo sapiens
ccuggugcucca

SEQ ID NO: 2060674 - RNA, 14 nt, Homo sapiens
ucucuuacugcaaa

SEQ ID NO: 2060675 - RNA, 23 nt, Homo sapiens
cugaacuguggggugugcacauc

SEQ ID NO: 2060676 - RNA, 17 nt, Homo sapiens
uccagaauggaacucaa

SEQ ID NO: 2060677 - RNA, 16 nt, Homo sapiens
ucaaggaaaaguucuu

SEQ ID NO: 2060678 - RNA, 20 nt, Homo sapiens
gggacucauccuugcccagg

SEQ ID NO: 2060679 - RNA, 22 nt, Homo sapiens
accuucaauaaaguaucuacau

SEQ ID NO: 2060680 - RNA, 18 nt, Homo sapiens
cccuggucccucugcagu

SEQ ID NO: 2060681 - RNA, 20 nt, Homo sapiens
acugguugacuuucuaauua

SEQ ID NO: 2060682 - RNA, 16 nt, Homo sapiens
uccacagaauucacuu

SEQ ID NO: 2060683 - RNA, 15 nt, Homo sapiens
agcaugccugaacua

SEQ ID NO: 2060684 - RNA, 14 nt, Homo sapiens
gacccaaagcaaaa

SEQ ID NO: 2060685 - RNA, 19 nt, Homo sapiens
gcaucccaucucucccacu

SEQ ID NO: 2060686 - RNA, 21 nt, Homo sapiens
cguuacuaaaaguacauuaaa

SEQ ID NO: 2060687 - RNA, 21 nt, Homo sapiens
cucacugcugcaaauacugua

SEQ ID NO: 2060688 - RNA, 18 nt, Homo sapiens
acaugccagccacuguga

SEQ ID NO: 2060689 - RNA, 14 nt, Homo sapiens
uaagaggcuauuua

SEQ ID NO: 2060690 - RNA, 22 nt, Homo sapiens
uggugcauggccuuagcuuucu

SEQ ID NO: 2060691 - RNA, 15 nt, Homo sapiens
uuuagaaaacauucu

SEQ ID NO: 2060692 - RNA, 15 nt, Homo sapiens
uccccacugcucauu

SEQ ID NO: 2060693 - RNA, 14 nt, Homo sapiens
gccacccacugacc

SEQ ID NO: 2060694 - RNA, 19 nt, Homo sapiens
agaucagaugcuccaagau

SEQ ID NO: 2060695 - RNA, 19 nt, Homo sapiens
aaaccaagcaucaggggga

SEQ ID NO: 2060696 - RNA, 18 nt, Homo sapiens
ugucucagacugcaugua

SEQ ID NO: 2060697 - RNA, 17 nt, Homo sapiens
ccuggccaggagcucuu

SEQ ID NO: 2060698 - RNA, 19 nt, Homo sapiens
auggaaugugauguucaug

SEQ ID NO: 2060699 - RNA, 19 nt, Homo sapiens
uccugaacucuucugcaaa

SEQ ID NO: 2060700 - RNA, 23 nt, Homo sapiens
uauggauauaccacaauucauuu

SEQ ID NO: 2060701 - RNA, 14 nt, Homo sapiens
cagagccucuggcc

SEQ ID NO: 2060702 - RNA, 14 nt, Homo sapiens
uuccucccagugag

SEQ ID NO: 2060703 - RNA, 14 nt, Homo sapiens
ccucccuguaacuu

SEQ ID NO: 2060704 - RNA, 23 nt, Homo sapiens
uagaaaugucucaaggcaguuaa

SEQ ID NO: 2060705 - RNA, 20 nt, Homo sapiens
guacaugggugacuaucucc

SEQ ID NO: 2060706 - RNA, 23 nt, Homo sapiens
agagcuuguaauaaauacugcag

SEQ ID NO: 2060707 - RNA, 15 nt, Homo sapiens
accugccugugugcu

SEQ ID NO: 2060708 - RNA, 21 nt, Homo sapiens
ucucagaaagugccugacaca

SEQ ID NO: 2060709 - RNA, 22 nt, Homo sapiens
uaccuguuccauuguugucaaa

SEQ ID NO: 2060710 - RNA, 16 nt, Homo sapiens
gagaacaaugugcuau

SEQ ID NO: 2060711 - RNA, 23 nt, Homo sapiens
ucagagccccucccugcuaccaa

SEQ ID NO: 2060712 - RNA, 16 nt, Homo sapiens
auaaugaauacuuucu

SEQ ID NO: 2060713 - RNA, 23 nt, Homo sapiens
uagcugaagaaguuauucucaag

SEQ ID NO: 2060714 - RNA, 21 nt, Homo sapiens
uccagaaccaacugcauuggu

SEQ ID NO: 2060715 - RNA, 18 nt, Homo sapiens
cucuuaagagaacauuau

SEQ ID NO: 2060716 - RNA, 12 nt, Homo sapiens
aucugugcagua

SEQ ID NO: 2060717 - RNA, 16 nt, Homo sapiens
gaccucguacucagga

SEQ ID NO: 2060718 - RNA, 17 nt, Homo sapiens
uaugcucugggugaaua

SEQ ID NO: 2060719 - RNA, 20 nt, Homo sapiens
agcuuuccaaagaaauggaa

SEQ ID NO: 2060720 - RNA, 15 nt, Homo sapiens
ugcuggcacagacuu

SEQ ID NO: 2060721 - RNA, 14 nt, Homo sapiens
gaaucuuacuccuu

SEQ ID NO: 2060722 - RNA, 17 nt, Homo sapiens
agucuuuguacagacaa

SEQ ID NO: 2060723 - RNA, 15 nt, Homo sapiens
uaccuagcugcaucu

SEQ ID NO: 2060724 - RNA, 15 nt, Homo sapiens
aucccaauaggcaga

SEQ ID NO: 2060725 - RNA, 16 nt, Homo sapiens
uugcagucacugugau

SEQ ID NO: 2060726 - RNA, 14 nt, Homo sapiens
uguggaaaauggag

SEQ ID NO: 2060727 - RNA, 18 nt, Homo sapiens
gagucuuucucacugccu

SEQ ID NO: 2060728 - RNA, 18 nt, Homo sapiens
guccugagccccagggag

SEQ ID NO: 2060729 - RNA, 20 nt, Homo sapiens
uugagugacucgaggguugg

SEQ ID NO: 2060730 - RNA, 21 nt, Homo sapiens
gagaaaaaggugccaucucag

SEQ ID NO: 2060731 - RNA, 18 nt, Homo sapiens
caugcacccucauacaca

SEQ ID NO: 2060732 - RNA, 19 nt, Homo sapiens
acucgaggagcucaggguu

SEQ ID NO: 2060733 - RNA, 13 nt, Homo sapiens
uaagagguugauu

SEQ ID NO: 2060734 - RNA, 20 nt, Homo sapiens
gacucuucucauccuuccuc

SEQ ID NO: 2060735 - RNA, 21 nt, Homo sapiens
cagcccacagaggacagugcu

SEQ ID NO: 2060736 - RNA, 21 nt, Homo sapiens
aucaagaaaacagcaagggag

SEQ ID NO: 2060737 - RNA, 21 nt, Homo sapiens
ugaauaagcagaacauacugu

SEQ ID NO: 2060738 - RNA, 15 nt, Homo sapiens
uuggcucuacccuga

SEQ ID NO: 2060739 - RNA, 14 nt, Homo sapiens
gcugggacugagaa

SEQ ID NO: 2060740 - RNA, 21 nt, Homo sapiens
uagcugaaaugguccaguaca

SEQ ID NO: 2060741 - RNA, 15 nt, Homo sapiens
auugaagacccucaa

SEQ ID NO: 2060742 - RNA, 13 nt, Homo sapiens
caagugucugugu

SEQ ID NO: 2060743 - RNA, 19 nt, Homo sapiens
ccaaacuuuagcaacaguu

SEQ ID NO: 2060744 - RNA, 12 nt, Homo sapiens
uaucuuugguau

SEQ ID NO: 2060745 - RNA, 22 nt, Homo sapiens
uguuuuccuggcaucuuucaac

SEQ ID NO: 2060746 - RNA, 20 nt, Homo sapiens
acuuuauauaaggcauucca

SEQ ID NO: 2060747 - RNA, 16 nt, Homo sapiens
agugucacagccauag

SEQ ID NO: 2060748 - RNA, 21 nt, Homo sapiens
agcaggcccagcuggggcccc

SEQ ID NO: 2060749 - RNA, 22 nt, Homo sapiens
aaugguauggaacucucuccac

SEQ ID NO: 2060750 - RNA, 14 nt, Homo sapiens
guuucugucuguaa

SEQ ID NO: 2060751 - RNA, 20 nt, Homo sapiens
aaccaauagugaaaugccac

SEQ ID NO: 2060752 - RNA, 15 nt, Homo sapiens
cacagaugugaagga

SEQ ID NO: 2060753 - RNA, 23 nt, Homo sapiens
cguguccaggagaccuuccacaa

SEQ ID NO: 2060754 - RNA, 17 nt, Homo sapiens
ccaggccuuggggacaa

SEQ ID NO: 2060755 - RNA, 17 nt, Homo sapiens
ggacugaaugugccuaa

SEQ ID NO: 2060756 - RNA, 20 nt, Homo sapiens
uugggcagucuuucuugaaa

SEQ ID NO: 2060757 - RNA, 23 nt, Homo sapiens
ugaagaaggggguggggggaguu

SEQ ID NO: 2060758 - RNA, 16 nt, Homo sapiens
caauaauucuguauua

SEQ ID NO: 2060759 - RNA, 15 nt, Homo sapiens
agggaucuggggaag

SEQ ID NO: 2060760 - RNA, 15 nt, Homo sapiens
gacucuguaacucac

SEQ ID NO: 2060761 - RNA, 20 nt, Homo sapiens
gaaaucccuucauacuugaa

SEQ ID NO: 2060762 - RNA, 21 nt, Homo sapiens
ugaacccaggaggcagcuguu

SEQ ID NO: 2060763 - RNA, 18 nt, Homo sapiens
cucaaugugcuguugauu

SEQ ID NO: 2060764 - RNA, 22 nt, Homo sapiens
uagcaugaaauaaaauauaucu

SEQ ID NO: 2060765 - RNA, 21 nt, Homo sapiens
uacucaaagcaaaagugcugc

SEQ ID NO: 2060766 - RNA, 18 nt, Homo sapiens
ccauuucuacucuuaaau

SEQ ID NO: 2060767 - RNA, 23 nt, Homo sapiens
caggaccucaccuuggcucuguu

SEQ ID NO: 2060768 - RNA, 17 nt, Homo sapiens
cuguuugguguguccca

SEQ ID NO: 2060769 - RNA, 19 nt, Homo sapiens
cugccuccccaacccugcc

SEQ ID NO: 2060770 - RNA, 16 nt, Homo sapiens
ccauucagcaucagag

SEQ ID NO: 2060771 - RNA, 19 nt, Homo sapiens
ucccuucucuucacaguca

SEQ ID NO: 2060772 - RNA, 13 nt, Homo sapiens
agauuucucaccu

SEQ ID NO: 2060773 - RNA, 22 nt, Homo sapiens
uaauaauuuacagguucuuagg

SEQ ID NO: 2060774 - RNA, 18 nt, Homo sapiens
aaaaacucaggcaaagaa

SEQ ID NO: 2060775 - RNA, 21 nt, Homo sapiens
gucauauuaauauauuuccau

SEQ ID NO: 2060776 - RNA, 15 nt, Homo sapiens
guguacauauuugaa

SEQ ID NO: 2060777 - RNA, 24 nt, Homo sapiens
cacacguguguaugagugcgcaga

SEQ ID NO: 2060778 - RNA, 15 nt, Homo sapiens
cugggauuacaggug

SEQ ID NO: 2060779 - RNA, 16 nt, Homo sapiens
acuuugaaacuauuaa

SEQ ID NO: 2060780 - RNA, 15 nt, Homo sapiens
cuuguuuugacuuaa

SEQ ID NO: 2060781 - RNA, 18 nt, Homo sapiens
cccucaggcacaccuugc

SEQ ID NO: 2060782 - RNA, 16 nt, Homo sapiens
cuguacuucaguaugu

SEQ ID NO: 2060783 - RNA, 16 nt, Homo sapiens
ggguccucagcugcuc

SEQ ID NO: 2060784 - RNA, 16 nt, Homo sapiens
aacagagagagacaga

SEQ ID NO: 2060785 - RNA, 14 nt, Homo sapiens
guccacuucuagcu

SEQ ID NO: 2060786 - RNA, 15 nt, Homo sapiens
gcugagcaccucuca

SEQ ID NO: 2060787 - RNA, 13 nt, Homo sapiens
uggucuccucuca

SEQ ID NO: 2060788 - RNA, 13 nt, Homo sapiens
acuucuccaggca

SEQ ID NO: 2060789 - RNA, 17 nt, Homo sapiens
aauccucaggauuucau

SEQ ID NO: 2060790 - RNA, 13 nt, Homo sapiens
ucuucugucugca

SEQ ID NO: 2060791 - RNA, 13 nt, Homo sapiens
gaacucacaguac

SEQ ID NO: 2060792 - RNA, 15 nt, Homo sapiens
aauuucaaaagugau

SEQ ID NO: 2060793 - RNA, 15 nt, Homo sapiens
aguagaaaaggaucu

SEQ ID NO: 2060794 - RNA, 18 nt, Homo sapiens
caaaucuguaaucagcaa

SEQ ID NO: 2060795 - RNA, 16 nt, Homo sapiens
ugccucccugcacuuc

SEQ ID NO: 2060796 - RNA, 15 nt, Homo sapiens
cuugaacuguugccc

SEQ ID NO: 2060797 - RNA, 11 nt, Homo sapiens
gggcuuucaua

SEQ ID NO: 2060798 - RNA, 19 nt, Homo sapiens
aacaguguugaaauuggaa

SEQ ID NO: 2060799 - RNA, 23 nt, Homo sapiens
caggcuggauacuaagcacaaag

SEQ ID NO: 2060800 - RNA, 19 nt, Homo sapiens
gaaaagcacagccucagaa

SEQ ID NO: 2060801 - RNA, 13 nt, Homo sapiens
gacagauauuuca

SEQ ID NO: 2060802 - RNA, 14 nt, Homo sapiens
gaugaacaucuaac

SEQ ID NO: 2060803 - RNA, 13 nt, Homo sapiens
ccugcggaugcau

SEQ ID NO: 2060804 - RNA, 21 nt, Homo sapiens
auagcaccuuucaaccaggca

SEQ ID NO: 2060805 - RNA, 12 nt, Homo sapiens
aaguguacagua

SEQ ID NO: 2060806 - RNA, 14 nt, Homo sapiens
agaauagugccuca

SEQ ID NO: 2060807 - RNA, 15 nt, Homo sapiens
ggauugcagacucau

SEQ ID NO: 2060808 - RNA, 18 nt, Homo sapiens
caggacugugccagcaca

SEQ ID NO: 2060809 - RNA, 16 nt, Homo sapiens
caagaaaaucacauca

SEQ ID NO: 2060810 - RNA, 14 nt, Homo sapiens
cucuucuuucccaa

SEQ ID NO: 2060811 - RNA, 14 nt, Homo sapiens
uuacaaaccaacca

SEQ ID NO: 2060812 - RNA, 15 nt, Homo sapiens
acagcccagacuuua

SEQ ID NO: 2060813 - RNA, 21 nt, Homo sapiens
guccucauuauaaaaugggaa

SEQ ID NO: 2060814 - RNA, 16 nt, Homo sapiens
agcccuuuuuguacug

SEQ ID NO: 2060815 - RNA, 13 nt, Homo sapiens
gaaaacugugcaa

SEQ ID NO: 2060816 - RNA, 15 nt, Homo sapiens
cagaauuuuuaacaa

SEQ ID NO: 2060817 - RNA, 21 nt, Homo sapiens
cauagcaacuccccuacauca

SEQ ID NO: 2060818 - RNA, 19 nt, Homo sapiens
gugccaccaugacuggcua

SEQ ID NO: 2060819 - RNA, 23 nt, Homo sapiens
aacugggaugaaacuaaagcaau

SEQ ID NO: 2060820 - RNA, 17 nt, Homo sapiens
guaacacuggccuuccc

SEQ ID NO: 2060821 - RNA, 22 nt, Homo sapiens
ugaaguucagugauaacucuga

SEQ ID NO: 2060822 - RNA, 11 nt, Homo sapiens
aauuccagcua

SEQ ID NO: 2060823 - RNA, 18 nt, Homo sapiens
uuguacaccaauauucau

SEQ ID NO: 2060824 - RNA, 19 nt, Homo sapiens
uuuguaauaauaaaaccaa

SEQ ID NO: 2060825 - RNA, 23 nt, Homo sapiens
cacagcaucgggagcacccagag

SEQ ID NO: 2060826 - RNA, 11 nt, Homo sapiens
cugggggaguu

SEQ ID NO: 2060827 - RNA, 22 nt, Homo sapiens
uccuuauuucucuuucaucaaa

SEQ ID NO: 2060828 - RNA, 23 nt, Homo sapiens
cagagagaaccaggaggguaaca

SEQ ID NO: 2060829 - RNA, 16 nt, Homo sapiens
agcaucaggauacuca

SEQ ID NO: 2060830 - RNA, 19 nt, Homo sapiens
cagcacuuuccuguugcac

SEQ ID NO: 2060831 - RNA, 21 nt, Homo sapiens
ggcaucaugcagaguugacau

SEQ ID NO: 2060832 - RNA, 21 nt, Homo sapiens
gaaccguaggacccaagcaga

SEQ ID NO: 2060833 - RNA, 19 nt, Homo sapiens
agaaaagcaguggcuccau

SEQ ID NO: 2060834 - RNA, 17 nt, Homo sapiens
cuaaaugugacaugcaa

SEQ ID NO: 2060835 - RNA, 12 nt, Homo sapiens
cugguucaauuu

SEQ ID NO: 2060836 - RNA, 19 nt, Homo sapiens
cgucugacaagguggucaa

SEQ ID NO: 2060837 - RNA, 14 nt, Homo sapiens
cauuaaaaaugcau

SEQ ID NO: 2060838 - RNA, 21 nt, Homo sapiens
gaaagcaggggcagaugccac

SEQ ID NO: 2060839 - RNA, 16 nt, Homo sapiens
aguccagugugacuuu

SEQ ID NO: 2060840 - RNA, 21 nt, Homo sapiens
guggggaggcggacguuccag

SEQ ID NO: 2060841 - RNA, 15 nt, Homo sapiens
cugcacuaagagaaa

SEQ ID NO: 2060842 - RNA, 21 nt, Homo sapiens
cauuuuauguuuuuguacucu

SEQ ID NO: 2060843 - RNA, 17 nt, Homo sapiens
cuccaggcuuuccugcc

SEQ ID NO: 2060844 - RNA, 17 nt, Homo sapiens
cuacuuccuguaaugua

SEQ ID NO: 2060845 - RNA, 14 nt, Homo sapiens
gugacgaacugccc

SEQ ID NO: 2060846 - RNA, 13 nt, Homo sapiens
aaucugagcugca

SEQ ID NO: 2060847 - RNA, 17 nt, Homo sapiens
ucagaauggauuuauca

SEQ ID NO: 2060848 - RNA, 19 nt, Homo sapiens
agaauaggcaaacuuuuau

SEQ ID NO: 2060849 - RNA, 15 nt, Homo sapiens
caggguucucuuagc

SEQ ID NO: 2060850 - RNA, 22 nt, Homo sapiens
uguucugcuacccacugccaga

SEQ ID NO: 2060851 - RNA, 19 nt, Homo sapiens
ucaaauuaagcauaugugu

SEQ ID NO: 2060852 - RNA, 18 nt, Homo sapiens
caaauacucaauuuacua

SEQ ID NO: 2060853 - RNA, 21 nt, Homo sapiens
caguaucuucaagguuuggaa

SEQ ID NO: 2060854 - RNA, 16 nt, Homo sapiens
cagcucuccaccagcu

SEQ ID NO: 2060855 - RNA, 18 nt, Homo sapiens
aaauaucauacuguucaa

SEQ ID NO: 2060856 - RNA, 20 nt, Homo sapiens
uuauacagauagaguuccau

SEQ ID NO: 2060857 - RNA, 21 nt, Homo sapiens
cggaucuggggcucugggaua

SEQ ID NO: 2060858 - RNA, 20 nt, Homo sapiens
uuaaugauucugaagcuuau

SEQ ID NO: 2060859 - RNA, 14 nt, Homo sapiens
cuucuucauauucu

SEQ ID NO: 2060860 - RNA, 18 nt, Homo sapiens
cacacuuugguaccagau

SEQ ID NO: 2060861 - RNA, 16 nt, Homo sapiens
ggcaagagggggaccu

SEQ ID NO: 2060862 - RNA, 16 nt, Homo sapiens
aggauagucacaguga

SEQ ID NO: 2060863 - RNA, 22 nt, Homo sapiens
aaugcugauagcucauauuaua

SEQ ID NO: 2060864 - RNA, 17 nt, Homo sapiens
acacauuuacuguacuc

SEQ ID NO: 2060865 - RNA, 23 nt, Homo sapiens
agauugugccacuucacuccagc

SEQ ID NO: 2060866 - RNA, 13 nt, Homo sapiens
cagcgagccacag

SEQ ID NO: 2060867 - RNA, 13 nt, Homo sapiens
augaggaccuccu

SEQ ID NO: 2060868 - RNA, 18 nt, Homo sapiens
agccaccaugcuugccug

SEQ ID NO: 2060869 - RNA, 17 nt, Homo sapiens
cuugauccacagaaaua

SEQ ID NO: 2060870 - RNA, 15 nt, Homo sapiens
gucaucuuuuuccac

SEQ ID NO: 2060871 - RNA, 13 nt, Homo sapiens
uggcaaagcagaa

SEQ ID NO: 2060872 - RNA, 18 nt, Homo sapiens
ucauggcccaucaggggc

SEQ ID NO: 2060873 - RNA, 22 nt, Homo sapiens
cuuuugggauguuaccuucaca

SEQ ID NO: 2060874 - RNA, 13 nt, Homo sapiens
guggaggcacuuu

SEQ ID NO: 2060875 - RNA, 15 nt, Homo sapiens
uuauaucauauguau

SEQ ID NO: 2060876 - RNA, 14 nt, Homo sapiens
gaaggaaaccgaaa

SEQ ID NO: 2060877 - RNA, 21 nt, Homo sapiens
auguauguuuacacugucaaa

SEQ ID NO: 2060878 - RNA, 18 nt, Homo sapiens
accccacgcccuguucac

SEQ ID NO: 2060879 - RNA, 18 nt, Homo sapiens
cuagaaaaggcagcuaaa

SEQ ID NO: 2060880 - RNA, 19 nt, Homo sapiens
ccaacacaucacuuaccac

SEQ ID NO: 2060881 - RNA, 15 nt, Homo sapiens
guacacuguuuccau

SEQ ID NO: 2060882 - RNA, 18 nt, Homo sapiens
caaauugaagcauguaca

SEQ ID NO: 2060883 - RNA, 16 nt, Homo sapiens
cuuugucuaauaaaga

SEQ ID NO: 2060884 - RNA, 19 nt, Homo sapiens
cuccugaccuuggguccug

SEQ ID NO: 2060885 - RNA, 22 nt, Homo sapiens
uugcacauuuuguggcuguuga

SEQ ID NO: 2060886 - RNA, 14 nt, Homo sapiens
gcaaggaagggugg

SEQ ID NO: 2060887 - RNA, 15 nt, Homo sapiens
uguauuauucauaga

SEQ ID NO: 2060888 - RNA, 17 nt, Homo sapiens
aaccccgggcaagacuu

SEQ ID NO: 2060889 - RNA, 18 nt, Homo sapiens
cuggcauaucuggucaga

SEQ ID NO: 2060890 - RNA, 18 nt, Homo sapiens
ucccuuaaaucaugguau

SEQ ID NO: 2060891 - RNA, 16 nt, Homo sapiens
uuaucucaaaacugca

SEQ ID NO: 2060892 - RNA, 24 nt, Homo sapiens
cauggacaguuguuuggagaacaa

SEQ ID NO: 2060893 - RNA, 16 nt, Homo sapiens
aaauaaaaaagcaaaa

SEQ ID NO: 2060894 - RNA, 17 nt, Homo sapiens
cauggaggaacaguauu

SEQ ID NO: 2060895 - RNA, 17 nt, Homo sapiens
uaugaauaagcacuuga

SEQ ID NO: 2060896 - RNA, 11 nt, Homo sapiens
ccguugcacaa

SEQ ID NO: 2060897 - RNA, 14 nt, Homo sapiens
acuuuugaccaaaa

SEQ ID NO: 2060898 - RNA, 19 nt, Homo sapiens
ucuaaaaauaguuaacaca

SEQ ID NO: 2060899 - RNA, 19 nt, Homo sapiens
aacacuguguacaccucaa

SEQ ID NO: 2060900 - RNA, 17 nt, Homo sapiens
aacacagccaguuuuca

SEQ ID NO: 2060901 - RNA, 14 nt, Homo sapiens
ugcacaucuacaca

SEQ ID NO: 2060902 - RNA, 14 nt, Homo sapiens
cguguguccaugug

SEQ ID NO: 2060903 - RNA, 20 nt, Homo sapiens
caaagcugugaaaugugcaa

SEQ ID NO: 2060904 - RNA, 14 nt, Homo sapiens
aacaugcugucuua

SEQ ID NO: 2060905 - RNA, 22 nt, Homo sapiens
agcaggugagcaaaaugcugcu

SEQ ID NO: 2060906 - RNA, 14 nt, Homo sapiens
agauacagacauuc

SEQ ID NO: 2060907 - RNA, 23 nt, Homo sapiens
aguuccaguuuagcccuucccug

SEQ ID NO: 2060908 - RNA, 22 nt, Homo sapiens
ucccgcgggcgaguucugccag

SEQ ID NO: 2060909 - RNA, 11 nt, Homo sapiens
cccauuugcca

SEQ ID NO: 2060910 - RNA, 15 nt, Homo sapiens
uaauaugaagcagga

SEQ ID NO: 2060911 - RNA, 14 nt, Homo sapiens
caggccugaccuca

SEQ ID NO: 2060912 - RNA, 17 nt, Homo sapiens
caagacccccagcacuu

SEQ ID NO: 2060913 - RNA, 22 nt, Homo sapiens
cagggcaugccuggccugagga

SEQ ID NO: 2060914 - RNA, 20 nt, Homo sapiens
agaugcuaaaauucuucgca

SEQ ID NO: 2060915 - RNA, 18 nt, Homo sapiens
guucuuuagcugucacuu

SEQ ID NO: 2060916 - RNA, 17 nt, Homo sapiens
cuucuuuuggcuuccau

SEQ ID NO: 2060917 - RNA, 19 nt, Homo sapiens
agaugucuucguacaguuc

SEQ ID NO: 2060918 - RNA, 13 nt, Homo sapiens
gcaggauucuucc

SEQ ID NO: 2060919 - RNA, 16 nt, Homo sapiens
guagcuauuacugucc

SEQ ID NO: 2060920 - RNA, 18 nt, Homo sapiens
ugacucauuuccauacca

SEQ ID NO: 2060921 - RNA, 22 nt, Homo sapiens
caaaccaaugcuauugugauua

SEQ ID NO: 2060922 - RNA, 16 nt, Homo sapiens
ucaguuucacuuucac

SEQ ID NO: 2060923 - RNA, 14 nt, Homo sapiens
aauuccaaagccag

SEQ ID NO: 2060924 - RNA, 12 nt, Homo sapiens
caaacuaugcau

SEQ ID NO: 2060925 - RNA, 19 nt, Homo sapiens
aaaggauaugguagcauuu

SEQ ID NO: 2060926 - RNA, 21 nt, Homo sapiens
aaugucaccagguacuugaga

SEQ ID NO: 2060927 - RNA, 15 nt, Homo sapiens
uuaaugacagagcca

SEQ ID NO: 2060928 - RNA, 12 nt, Homo sapiens
gcccuggcagca

SEQ ID NO: 2060929 - RNA, 19 nt, Homo sapiens
caauccuuuguucucccaa

SEQ ID NO: 2060930 - RNA, 23 nt, Homo sapiens
ugccaggagcagccuccaagaaa

SEQ ID NO: 2060931 - RNA, 18 nt, Homo sapiens
agccaguuaaaauguguu

SEQ ID NO: 2060932 - RNA, 14 nt, Homo sapiens
cugcucaagauaug

SEQ ID NO: 2060933 - RNA, 17 nt, Homo sapiens
aaagcaaaugacuagua

SEQ ID NO: 2060934 - RNA, 13 nt, Homo sapiens
uugaguagaucca

SEQ ID NO: 2060935 - RNA, 15 nt, Homo sapiens
ggauuuuucuguaac

SEQ ID NO: 2060936 - RNA, 15 nt, Homo sapiens
gcagccccaggacca

SEQ ID NO: 2060937 - RNA, 19 nt, Homo sapiens
uuaaaauaaaaaagcaaaa

SEQ ID NO: 2060938 - RNA, 17 nt, Homo sapiens
auugugugagugcaugu

SEQ ID NO: 2060939 - RNA, 18 nt, Homo sapiens
ucugcccaaccuugacca

SEQ ID NO: 2060940 - RNA, 16 nt, Homo sapiens
aggggauggacuucau

SEQ ID NO: 2060941 - RNA, 16 nt, Homo sapiens
agaaccuaaugcacuc

SEQ ID NO: 2060942 - RNA, 17 nt, Homo sapiens
gcauccaauuuauuaua

SEQ ID NO: 2060943 - RNA, 15 nt, Homo sapiens
caccggcucucaccu

SEQ ID NO: 2060944 - RNA, 16 nt, Homo sapiens
uauggacuuggcugua

SEQ ID NO: 2060945 - RNA, 22 nt, Homo sapiens
auuuccauuuacuuaagacuua

SEQ ID NO: 2060946 - RNA, 12 nt, Homo sapiens
uuuggcagagaa

SEQ ID NO: 2060947 - RNA, 18 nt, Homo sapiens
ucccugauuaaagugccu

SEQ ID NO: 2060948 - RNA, 15 nt, Homo sapiens
acacacguaccuuca

SEQ ID NO: 2060949 - RNA, 13 nt, Homo sapiens
uuugaguauugcu

SEQ ID NO: 2060950 - RNA, 13 nt, Homo sapiens
auagagguacaug

SEQ ID NO: 2060951 - RNA, 12 nt, Homo sapiens
ucucauuccugu

SEQ ID NO: 2060952 - RNA, 13 nt, Homo sapiens
cccuuccuggaaa

SEQ ID NO: 2060953 - RNA, 18 nt, Homo sapiens
ccgaaaaauccucuuccu

SEQ ID NO: 2060954 - RNA, 15 nt, Homo sapiens
ccgccugccugccac

SEQ ID NO: 2060955 - RNA, 13 nt, Homo sapiens
agccaguuuauuu

SEQ ID NO: 2060956 - RNA, 13 nt, Homo sapiens
aaucaguuugcuu

SEQ ID NO: 2060957 - RNA, 22 nt, Homo sapiens
cuugcaauauuuuaaauauugu

SEQ ID NO: 2060958 - RNA, 20 nt, Homo sapiens
cagcuuggagugccacgugg

SEQ ID NO: 2060959 - RNA, 17 nt, Homo sapiens
cggaguugacagugaaa

SEQ ID NO: 2060960 - RNA, 23 nt, Homo sapiens
ucaagcccagccacguggagccu

SEQ ID NO: 2060961 - RNA, 13 nt, Homo sapiens
uaauucugaugcu

SEQ ID NO: 2060962 - RNA, 23 nt, Homo sapiens
cugagcacuguuuucuaguguau

SEQ ID NO: 2060963 - RNA, 14 nt, Homo sapiens
ugucucuccaguga

SEQ ID NO: 2060964 - RNA, 16 nt, Homo sapiens
acccagucacugugag

SEQ ID NO: 2060965 - RNA, 16 nt, Homo sapiens
aaauuacagugcaguu

SEQ ID NO: 2060966 - RNA, 19 nt, Homo sapiens
cuuaauaacauacaaugac

SEQ ID NO: 2060967 - RNA, 16 nt, Homo sapiens
gggagcuaucacugua

SEQ ID NO: 2060968 - RNA, 16 nt, Homo sapiens
uggagcuggcacugug

SEQ ID NO: 2060969 - RNA, 18 nt, Homo sapiens
cugcagcugagauuccag

SEQ ID NO: 2060970 - RNA, 16 nt, Homo sapiens
aagacuuccacucgau

SEQ ID NO: 2060971 - RNA, 13 nt, Homo sapiens
gaauucaaacugg

SEQ ID NO: 2060972 - RNA, 14 nt, Homo sapiens
agcugugugcaguc

SEQ ID NO: 2060973 - RNA, 16 nt, Homo sapiens
accaaaaguuacaugu

SEQ ID NO: 2060974 - RNA, 23 nt, Homo sapiens
uaaaauugcuucuuuaccaagga

SEQ ID NO: 2060975 - RNA, 23 nt, Homo sapiens
cugggucucgcuuuguugcccag

SEQ ID NO: 2060976 - RNA, 13 nt, Homo sapiens
auguuaaugcaaa

SEQ ID NO: 2060977 - RNA, 11 nt, Homo sapiens
augguguaacc

SEQ ID NO: 2060978 - RNA, 13 nt, Homo sapiens
cagccugccaaau

SEQ ID NO: 2060979 - RNA, 18 nt, Homo sapiens
uaccauggcacugacaau

SEQ ID NO: 2060980 - RNA, 15 nt, Homo sapiens
cucaucuuucuugau

SEQ ID NO: 2060981 - RNA, 13 nt, Homo sapiens
caaucuccaucac

SEQ ID NO: 2060982 - RNA, 16 nt, Homo sapiens
gacaaagacauuauuu

SEQ ID NO: 2060983 - RNA, 15 nt, Homo sapiens
cugaacugacugaac

SEQ ID NO: 2060984 - RNA, 12 nt, Homo sapiens
auuucccaggac

SEQ ID NO: 2060985 - RNA, 21 nt, Homo sapiens
gaaaauaaauaucacaguauu

SEQ ID NO: 2060986 - RNA, 16 nt, Homo sapiens
cuuaaaaaauguccau

SEQ ID NO: 2060987 - RNA, 19 nt, Homo sapiens
cacaggaagccugcagucc

SEQ ID NO: 2060988 - RNA, 15 nt, Homo sapiens
uuuuaacacauaacu

SEQ ID NO: 2060989 - RNA, 21 nt, Homo sapiens
cagaccuccaccuccuccaga

SEQ ID NO: 2060990 - RNA, 14 nt, Homo sapiens
gcugucccuuccag

SEQ ID NO: 2060991 - RNA, 11 nt, Homo sapiens
aacucacucag

SEQ ID NO: 2060992 - RNA, 15 nt, Homo sapiens
uugccuucucugccc

SEQ ID NO: 2060993 - RNA, 16 nt, Homo sapiens
cagaaagccucagagu

SEQ ID NO: 2060994 - RNA, 17 nt, Homo sapiens
uaugacagaaaaguaau

SEQ ID NO: 2060995 - RNA, 19 nt, Homo sapiens
ugucccaguuaacuguuaa

SEQ ID NO: 2060996 - RNA, 15 nt, Homo sapiens
uuugaaguccacuug

SEQ ID NO: 2060997 - RNA, 15 nt, Homo sapiens
uuccuaccauacaau

SEQ ID NO: 2060998 - RNA, 22 nt, Homo sapiens
auucuuccucaaagcauuugca

SEQ ID NO: 2060999 - RNA, 13 nt, Homo sapiens
aagaggagcugcu

SEQ ID NO: 2061000 - RNA, 20 nt, Homo sapiens
guucauaggucuccaagacc

SEQ ID NO: 2061001 - RNA, 14 nt, Homo sapiens
aauuggccaugucg

SEQ ID NO: 2061002 - RNA, 21 nt, Homo sapiens
acuugggcuucaacagccaag

SEQ ID NO: 2061003 - RNA, 22 nt, Homo sapiens
cuuaaaagaaagagaaguuuuc

SEQ ID NO: 2061004 - RNA, 18 nt, Homo sapiens
ccuaucuuccuuccucuc

SEQ ID NO: 2061005 - RNA, 23 nt, Homo sapiens
cuccugaggcuuuggauuugaca

SEQ ID NO: 2061006 - RNA, 15 nt, Homo sapiens
ucugucaaaugcagu

SEQ ID NO: 2061007 - RNA, 17 nt, Homo sapiens
uugaagccguccaagaa

SEQ ID NO: 2061008 - RNA, 16 nt, Homo sapiens
cuacuauauaugacug

SEQ ID NO: 2061009 - RNA, 19 nt, Homo sapiens
agucuauuuuuauuccuug

SEQ ID NO: 2061010 - RNA, 12 nt, Homo sapiens
uuggcuuuucau

SEQ ID NO: 2061011 - RNA, 16 nt, Homo sapiens
acuguuggauacagga

SEQ ID NO: 2061012 - RNA, 21 nt, Homo sapiens
uuucuaguuucuugugggcua

SEQ ID NO: 2061013 - RNA, 22 nt, Homo sapiens
ucagaagguaucaguuauauga

SEQ ID NO: 2061014 - RNA, 21 nt, Homo sapiens
acaauaaauauucugcaugga

SEQ ID NO: 2061015 - RNA, 17 nt, Homo sapiens
auaccuucaaugaauua

SEQ ID NO: 2061016 - RNA, 20 nt, Homo sapiens
accacuuuuaauuguuacuc

SEQ ID NO: 2061017 - RNA, 17 nt, Homo sapiens
aaaauaccccuaacaua

SEQ ID NO: 2061018 - RNA, 15 nt, Homo sapiens
ccuaaacauaguggu

SEQ ID NO: 2061019 - RNA, 16 nt, Homo sapiens
auaucuguaaugauac

SEQ ID NO: 2061020 - RNA, 19 nt, Homo sapiens
agaaacuuuaagaacaaac

SEQ ID NO: 2061021 - RNA, 16 nt, Homo sapiens
caguaacacuggcgag

SEQ ID NO: 2061022 - RNA, 19 nt, Homo sapiens
aggacugaucgauuugcac

SEQ ID NO: 2061023 - RNA, 12 nt, Homo sapiens
ucaaaugcucac

SEQ ID NO: 2061024 - RNA, 19 nt, Homo sapiens
caggacugugaccaaagca

SEQ ID NO: 2061025 - RNA, 21 nt, Homo sapiens
cugcacggugggagaccugcu

SEQ ID NO: 2061026 - RNA, 23 nt, Homo sapiens
uccccaaaaacuaaaugugaaau

SEQ ID NO: 2061027 - RNA, 23 nt, Homo sapiens
auugguuaacaauaaagugacaa

SEQ ID NO: 2061028 - RNA, 17 nt, Homo sapiens
gcucaaggcugugcagg

SEQ ID NO: 2061029 - RNA, 20 nt, Homo sapiens
aucucugaagcauguuucau

SEQ ID NO: 2061030 - RNA, 13 nt, Homo sapiens
cccaaagugcagg

SEQ ID NO: 2061031 - RNA, 16 nt, Homo sapiens
aucaguuauaugauau

SEQ ID NO: 2061032 - RNA, 23 nt, Homo sapiens
gcuuucguguaaauuauguaaug

SEQ ID NO: 2061033 - RNA, 20 nt, Homo sapiens
gauguuguuccuggcuagau

SEQ ID NO: 2061034 - RNA, 16 nt, Homo sapiens
gggagggggcugggaa

SEQ ID NO: 2061035 - RNA, 16 nt, Homo sapiens
aucacaucacugcacu

SEQ ID NO: 2061036 - RNA, 16 nt, Homo sapiens
aaggccgccagcuccc

SEQ ID NO: 2061037 - RNA, 19 nt, Homo sapiens
ccacugcuaugccauuucu

SEQ ID NO: 2061038 - RNA, 14 nt, Homo sapiens
acuacuuacaggug

SEQ ID NO: 2061039 - RNA, 17 nt, Homo sapiens
uucccccuuccacccuc

SEQ ID NO: 2061040 - RNA, 22 nt, Homo sapiens
ugccauuaaagaauaugaaaca

SEQ ID NO: 2061041 - RNA, 13 nt, Homo sapiens
caaaaacaagcaa

SEQ ID NO: 2061042 - RNA, 13 nt, Homo sapiens
agaaaacacacaa

SEQ ID NO: 2061043 - RNA, 13 nt, Homo sapiens
cuuguaaauuaca

SEQ ID NO: 2061044 - RNA, 16 nt, Homo sapiens
ucaugaaggacacucu

SEQ ID NO: 2061045 - RNA, 20 nt, Homo sapiens
cagggcaaugccaucagccc

SEQ ID NO: 2061046 - RNA, 13 nt, Homo sapiens
aucuuaacacuga

SEQ ID NO: 2061047 - RNA, 19 nt, Homo sapiens
ccagaaugaaaacuguaaa

SEQ ID NO: 2061048 - RNA, 20 nt, Homo sapiens
cgccccugguggguggcacu

SEQ ID NO: 2061049 - RNA, 19 nt, Homo sapiens
ugucaguuacaauaugaga

SEQ ID NO: 2061050 - RNA, 15 nt, Homo sapiens
aaaugagaaugacag

SEQ ID NO: 2061051 - RNA, 15 nt, Homo sapiens
uaccacagacuguac

SEQ ID NO: 2061052 - RNA, 12 nt, Homo sapiens
gguggaaggccu

SEQ ID NO: 2061053 - RNA, 17 nt, Homo sapiens
ugcaaccuaguacuuua

SEQ ID NO: 2061054 - RNA, 19 nt, Homo sapiens
cuggccaaccaaagacacu

SEQ ID NO: 2061055 - RNA, 16 nt, Homo sapiens
cauagcuccugcucca

SEQ ID NO: 2061056 - RNA, 18 nt, Homo sapiens
aacuuuugguaucuacuu

SEQ ID NO: 2061057 - RNA, 14 nt, Homo sapiens
auccaggaggcaga

SEQ ID NO: 2061058 - RNA, 15 nt, Homo sapiens
caccgacaacaugcu

SEQ ID NO: 2061059 - RNA, 12 nt, Homo sapiens
cugucugugcca

SEQ ID NO: 2061060 - RNA, 20 nt, Homo sapiens
aaaacagcccucagacuguc

SEQ ID NO: 2061061 - RNA, 14 nt, Homo sapiens
gcaaaacuuuggca

SEQ ID NO: 2061062 - RNA, 14 nt, Homo sapiens
gcacaaaacuacuu

SEQ ID NO: 2061063 - RNA, 23 nt, Homo sapiens
gcacuagagaaaauaaauuccaa

SEQ ID NO: 2061064 - RNA, 22 nt, Homo sapiens
aaauuucccccucucccccagu

SEQ ID NO: 2061065 - RNA, 17 nt, Homo sapiens
gagguugggcugagacc

SEQ ID NO: 2061066 - RNA, 18 nt, Homo sapiens
cuggaggaaucacugggg

SEQ ID NO: 2061067 - RNA, 23 nt, Homo sapiens
auccaccugcacaaacauagaca

SEQ ID NO: 2061068 - RNA, 20 nt, Homo sapiens
auguuuuaaaauacucucau

SEQ ID NO: 2061069 - RNA, 13 nt, Homo sapiens
auuuugauggugu

SEQ ID NO: 2061070 - RNA, 15 nt, Homo sapiens
ccccaggauccacuu

SEQ ID NO: 2061071 - RNA, 11 nt, Homo sapiens
acaccccagac

SEQ ID NO: 2061072 - RNA, 21 nt, Homo sapiens
cuauugugaauauuuggaauu

SEQ ID NO: 2061073 - RNA, 21 nt, Homo sapiens
cauuuaaauuagauaacaaaa

SEQ ID NO: 2061074 - RNA, 21 nt, Homo sapiens
cacugcucauuuggaucccag

SEQ ID NO: 2061075 - RNA, 22 nt, Homo sapiens
guuugaaaauaguuaccuucaa

SEQ ID NO: 2061076 - RNA, 15 nt, Homo sapiens
uguuucuugggcaag

SEQ ID NO: 2061077 - RNA, 14 nt, Homo sapiens
aggauugucacucc

SEQ ID NO: 2061078 - RNA, 19 nt, Homo sapiens
ggguucucucucucugucu

SEQ ID NO: 2061079 - RNA, 19 nt, Homo sapiens
uggcauccaaauggcugcu

SEQ ID NO: 2061080 - RNA, 18 nt, Homo sapiens
uagccgauaucagaauuu

SEQ ID NO: 2061081 - RNA, 17 nt, Homo sapiens
cugcuggagcccaguca

SEQ ID NO: 2061082 - RNA, 10 nt, Homo sapiens
uguacauaca

SEQ ID NO: 2061083 - RNA, 14 nt, Homo sapiens
cagaaccugcaaau

SEQ ID NO: 2061084 - RNA, 19 nt, Homo sapiens
agcucuucucccagaugua

SEQ ID NO: 2061085 - RNA, 21 nt, Homo sapiens
acucuuucugaggagcuguua

SEQ ID NO: 2061086 - RNA, 21 nt, Homo sapiens
cgucucuacuaaaaaauacaa

SEQ ID NO: 2061087 - RNA, 23 nt, Homo sapiens
uaccccuaacauacugcauuuca

SEQ ID NO: 2061088 - RNA, 18 nt, Homo sapiens
ugggcaacagagcaagau

SEQ ID NO: 2061089 - RNA, 22 nt, Homo sapiens
gaccugggagcaggggcaauga

SEQ ID NO: 2061090 - RNA, 15 nt, Homo sapiens
caauaugagucucaa

SEQ ID NO: 2061091 - RNA, 15 nt, Homo sapiens
ucucacccauuaucu

SEQ ID NO: 2061092 - RNA, 23 nt, Homo sapiens
uacaagacuguugugaucuugca

SEQ ID NO: 2061093 - RNA, 14 nt, Homo sapiens
ucugacacauuaau

SEQ ID NO: 2061094 - RNA, 24 nt, Homo sapiens
augguaauucaguuauuugcacaa

SEQ ID NO: 2061095 - RNA, 17 nt, Homo sapiens
uaauguuagcaguucug

SEQ ID NO: 2061096 - RNA, 23 nt, Homo sapiens
aaaggaguaugugugccagcugu

SEQ ID NO: 2061097 - RNA, 16 nt, Homo sapiens
auuuuggccacacugu

SEQ ID NO: 2061098 - RNA, 20 nt, Homo sapiens
aaucacugaaccucucagga

SEQ ID NO: 2061099 - RNA, 16 nt, Homo sapiens
uugguuuugugcacau

SEQ ID NO: 2061100 - RNA, 16 nt, Homo sapiens
cuuccccaagaucugc

SEQ ID NO: 2061101 - RNA, 20 nt, Homo sapiens
uugucuuuuauuuugugucc

SEQ ID NO: 2061102 - RNA, 22 nt, Homo sapiens
aauaaguuuuauguucugcuca

SEQ ID NO: 2061103 - RNA, 15 nt, Homo sapiens
caagucuugagcaau

SEQ ID NO: 2061104 - RNA, 20 nt, Homo sapiens
agcccauuucuuuauugcau

SEQ ID NO: 2061105 - RNA, 14 nt, Homo sapiens
agaugcaggugaug

SEQ ID NO: 2061106 - RNA, 16 nt, Homo sapiens
ucuaagcccccuuccc

SEQ ID NO: 2061107 - RNA, 13 nt, Homo sapiens
gggaagccacugc

SEQ ID NO: 2061108 - RNA, 16 nt, Homo sapiens
cagaauuauacaguaa

SEQ ID NO: 2061109 - RNA, 18 nt, Homo sapiens
aggugcuggagcacuggg

SEQ ID NO: 2061110 - RNA, 17 nt, Homo sapiens
caacagguuuguucuca

SEQ ID NO: 2061111 - RNA, 23 nt, Homo sapiens
uuguuuaaagaauaaaguccaaa

SEQ ID NO: 2061112 - RNA, 15 nt, Homo sapiens
cagguggccuagcag

SEQ ID NO: 2061113 - RNA, 18 nt, Homo sapiens
ucuguaaguaacuucaca

SEQ ID NO: 2061114 - RNA, 17 nt, Homo sapiens
cacuucccuacauggag

SEQ ID NO: 2061115 - RNA, 15 nt, Homo sapiens
agugauaggcccaag

SEQ ID NO: 2061116 - RNA, 20 nt, Homo sapiens
accucuugccucagagcagc

SEQ ID NO: 2061117 - RNA, 13 nt, Homo sapiens
cagccgccggcug

SEQ ID NO: 2061118 - RNA, 15 nt, Homo sapiens
uacucauucagggau

SEQ ID NO: 2061119 - RNA, 16 nt, Homo sapiens
ccaggcuuccacacuu

SEQ ID NO: 2061120 - RNA, 17 nt, Homo sapiens
uuguggacuuuucccca

SEQ ID NO: 2061121 - RNA, 17 nt, Homo sapiens
auuucccuguguggaug

SEQ ID NO: 2061122 - RNA, 22 nt, Homo sapiens
caaacaaugcauaggauuccaa

SEQ ID NO: 2061123 - RNA, 20 nt, Homo sapiens
aacuuuuuuuccuugugguu

SEQ ID NO: 2061124 - RNA, 21 nt, Homo sapiens
agaugaucguagacacaggga

SEQ ID NO: 2061125 - RNA, 20 nt, Homo sapiens
guuuucucuuuguacugcuu

SEQ ID NO: 2061126 - RNA, 21 nt, Homo sapiens
caaugggcacauuuaugacaa

SEQ ID NO: 2061127 - RNA, 20 nt, Homo sapiens
cugacuaggugucaccauac

SEQ ID NO: 2061128 - RNA, 12 nt, Homo sapiens
aaagacagugaa

SEQ ID NO: 2061129 - RNA, 19 nt, Homo sapiens
gagcccagaagcucaaggc

SEQ ID NO: 2061130 - RNA, 20 nt, Homo sapiens
ccggcuuugcagggagacca

SEQ ID NO: 2061131 - RNA, 18 nt, Homo sapiens
cucucgggugggggagcc

SEQ ID NO: 2061132 - RNA, 14 nt, Homo sapiens
acaugcacugaccc

SEQ ID NO: 2061133 - RNA, 12 nt, Homo sapiens
ccucauggaaug

SEQ ID NO: 2061134 - RNA, 16 nt, Homo sapiens
ucacaguucauugcag

SEQ ID NO: 2061135 - RNA, 15 nt, Homo sapiens
auaaccauauucaca

SEQ ID NO: 2061136 - RNA, 20 nt, Homo sapiens
ugccgcccuccacaccucua

SEQ ID NO: 2061137 - RNA, 18 nt, Homo sapiens
ugaggccuggacuuuccu

SEQ ID NO: 2061138 - RNA, 21 nt, Homo sapiens
gagaucuuaagauuccauuuu

SEQ ID NO: 2061139 - RNA, 13 nt, Homo sapiens
caagcaaugcaag

SEQ ID NO: 2061140 - RNA, 19 nt, Homo sapiens
agaagaauguuuaauagaa

SEQ ID NO: 2061141 - RNA, 19 nt, Homo sapiens
ccuuacuucucuugccuua

SEQ ID NO: 2061142 - RNA, 15 nt, Homo sapiens
auguuaaacuagcau

SEQ ID NO: 2061143 - RNA, 22 nt, Homo sapiens
agcgguaucucuggcaccacac

SEQ ID NO: 2061144 - RNA, 16 nt, Homo sapiens
gcucagcagacaucca

SEQ ID NO: 2061145 - RNA, 20 nt, Homo sapiens
auuaguucuguauacaguac

SEQ ID NO: 2061146 - RNA, 14 nt, Homo sapiens
gcugccaagcccca

SEQ ID NO: 2061147 - RNA, 19 nt, Homo sapiens
augcacccgcauguacaaa

SEQ ID NO: 2061148 - RNA, 18 nt, Homo sapiens
aaaaggucucaccacaua

SEQ ID NO: 2061149 - RNA, 12 nt, Homo sapiens
gcacacaggaag

SEQ ID NO: 2061150 - RNA, 13 nt, Homo sapiens
uaagacacuguga

SEQ ID NO: 2061151 - RNA, 13 nt, Homo sapiens
agcccacaccuaa

SEQ ID NO: 2061152 - RNA, 18 nt, Homo sapiens
agccagcagacauuguca

SEQ ID NO: 2061153 - RNA, 23 nt, Homo sapiens
ccaugucuuucucucucacuccc

SEQ ID NO: 2061154 - RNA, 18 nt, Homo sapiens
agggcaaaaagaccaaga

SEQ ID NO: 2061155 - RNA, 18 nt, Homo sapiens
cagucugggccccaucau

SEQ ID NO: 2061156 - RNA, 14 nt, Homo sapiens
acaggaggaaugca

SEQ ID NO: 2061157 - RNA, 13 nt, Homo sapiens
uucugaggcaaau

SEQ ID NO: 2061158 - RNA, 17 nt, Homo sapiens
gcucugcuucaauguag

SEQ ID NO: 2061159 - RNA, 20 nt, Homo sapiens
uuguaaaaagcccagcacuu

SEQ ID NO: 2061160 - RNA, 23 nt, Homo sapiens
augacgguguccaugccuuccau

SEQ ID NO: 2061161 - RNA, 13 nt, Homo sapiens
ucugcacaugcag

SEQ ID NO: 2061162 - RNA, 21 nt, Homo sapiens
uuccugcgcgucaucucugac

SEQ ID NO: 2061163 - RNA, 23 nt, Homo sapiens
cuaccauuuuuuuuuaacacugu

SEQ ID NO: 2061164 - RNA, 14 nt, Homo sapiens
ugcuaguaccaaaa

SEQ ID NO: 2061165 - RNA, 22 nt, Homo sapiens
auuucauugagcuucauugcag

SEQ ID NO: 2061166 - RNA, 22 nt, Homo sapiens
aguuuuaaacaaaugugauaca

SEQ ID NO: 2061167 - RNA, 16 nt, Homo sapiens
cauguucguauuacaa

SEQ ID NO: 2061168 - RNA, 23 nt, Homo sapiens
ggcugguccugggagccacuggg

SEQ ID NO: 2061169 - RNA, 12 nt, Homo sapiens
augucagcuuau

SEQ ID NO: 2061170 - RNA, 22 nt, Homo sapiens
guaaggaaauggaauacugaag

SEQ ID NO: 2061171 - RNA, 19 nt, Homo sapiens
uaaacuuucugaguuuuuc

SEQ ID NO: 2061172 - RNA, 23 nt, Homo sapiens
caaggcucccguacugucugugu

SEQ ID NO: 2061173 - RNA, 16 nt, Homo sapiens
cucgugccguccuccc

SEQ ID NO: 2061174 - RNA, 19 nt, Homo sapiens
gacaaugcugccaugccca

SEQ ID NO: 2061175 - RNA, 22 nt, Homo sapiens
ugcaggaaauggcuguggagug

SEQ ID NO: 2061176 - RNA, 20 nt, Homo sapiens
cauaacuggauuuugaacgc

SEQ ID NO: 2061177 - RNA, 18 nt, Homo sapiens
ggcuaguugggaugggca

SEQ ID NO: 2061178 - RNA, 13 nt, Homo sapiens
cuccuucugcaaa

SEQ ID NO: 2061179 - RNA, 12 nt, Homo sapiens
gccaccuggacc

SEQ ID NO: 2061180 - RNA, 23 nt, Homo sapiens
cacccaguccucccagcugccau

SEQ ID NO: 2061181 - RNA, 17 nt, Homo sapiens
cuuuuucauauguugcu

SEQ ID NO: 2061182 - RNA, 19 nt, Homo sapiens
ccugcaggccaagagcaga

SEQ ID NO: 2061183 - RNA, 18 nt, Homo sapiens
aaugaucugccucuaaaa

SEQ ID NO: 2061184 - RNA, 18 nt, Homo sapiens
agaauaaaaauugacuuc

SEQ ID NO: 2061185 - RNA, 19 nt, Homo sapiens
ugauauaucaugagugaau

SEQ ID NO: 2061186 - RNA, 19 nt, Homo sapiens
cauuuuauuuuguaauauu

SEQ ID NO: 2061187 - RNA, 11 nt, Homo sapiens
uaaaaauggaa

SEQ ID NO: 2061188 - RNA, 11 nt, Homo sapiens
uacaaauggac

SEQ ID NO: 2061189 - RNA, 17 nt, Homo sapiens
agaaggcauuccagggu

SEQ ID NO: 2061190 - RNA, 19 nt, Homo sapiens
ggcaagcaagccugggagc

SEQ ID NO: 2061191 - RNA, 11 nt, Homo sapiens
uaaacuugaau

SEQ ID NO: 2061192 - RNA, 21 nt, Homo sapiens
acucugauggaaugugccacc

SEQ ID NO: 2061193 - RNA, 23 nt, Homo sapiens
gaaggugugcuacagaaaauaau

SEQ ID NO: 2061194 - RNA, 17 nt, Homo sapiens
uugaugagcugugcaca

SEQ ID NO: 2061195 - RNA, 12 nt, Homo sapiens
uggcugccuugu

SEQ ID NO: 2061196 - RNA, 21 nt, Homo sapiens
ugggcagcccagugcugccac

SEQ ID NO: 2061197 - RNA, 16 nt, Homo sapiens
auguauaucuucuaca

SEQ ID NO: 2061198 - RNA, 17 nt, Homo sapiens
augaaacagacccucaa

SEQ ID NO: 2061199 - RNA, 14 nt, Homo sapiens
cuuaccugacacaa

SEQ ID NO: 2061200 - RNA, 23 nt, Homo sapiens
cagcacagggggauucugagcag

SEQ ID NO: 2061201 - RNA, 15 nt, Homo sapiens
aaaacaaugccauga

SEQ ID NO: 2061202 - RNA, 14 nt, Homo sapiens
auugaauaggauca

SEQ ID NO: 2061203 - RNA, 14 nt, Homo sapiens
ugcucuugagucuu

SEQ ID NO: 2061204 - RNA, 14 nt, Homo sapiens
uuucucugaucucc

SEQ ID NO: 2061205 - RNA, 20 nt, Homo sapiens
ugcuaaagggagaaaugcca

SEQ ID NO: 2061206 - RNA, 20 nt, Homo sapiens
augccaggcucaaggucuua

SEQ ID NO: 2061207 - RNA, 21 nt, Homo sapiens
aauggguuuuguguacuguaa

SEQ ID NO: 2061208 - RNA, 15 nt, Homo sapiens
uguaugugaaagugu

SEQ ID NO: 2061209 - RNA, 15 nt, Homo sapiens
cugccugaacaaagg

SEQ ID NO: 2061210 - RNA, 12 nt, Homo sapiens
uaauucugggaa

SEQ ID NO: 2061211 - RNA, 11 nt, Homo sapiens
aaacaguuuag

SEQ ID NO: 2061212 - RNA, 13 nt, Homo sapiens
auuccccuaggcu

SEQ ID NO: 2061213 - RNA, 21 nt, Homo sapiens
gcaaacaugcaagaugaaccu

SEQ ID NO: 2061214 - RNA, 19 nt, Homo sapiens
ugcuaagcauuagcuuuaa

SEQ ID NO: 2061215 - RNA, 23 nt, Homo sapiens
acugcauucuucugagcacuguu

SEQ ID NO: 2061216 - RNA, 17 nt, Homo sapiens
agcuugugguggggcag

SEQ ID NO: 2061217 - RNA, 21 nt, Homo sapiens
cagaaauaaaaguaugaaucu

SEQ ID NO: 2061218 - RNA, 21 nt, Homo sapiens
aaagugguucucaugaugcuu

SEQ ID NO: 2061219 - RNA, 21 nt, Homo sapiens
cuggcaagaggccucaugccu

SEQ ID NO: 2061220 - RNA, 14 nt, Homo sapiens
uguuagagcagaga

SEQ ID NO: 2061221 - RNA, 19 nt, Homo sapiens
uauugagggccagugauga

SEQ ID NO: 2061222 - RNA, 16 nt, Homo sapiens
ucuugaauauuugcca

SEQ ID NO: 2061223 - RNA, 17 nt, Homo sapiens
uccuuuuuugcaugugc

SEQ ID NO: 2061224 - RNA, 14 nt, Homo sapiens
uuaccaugcucaau

SEQ ID NO: 2061225 - RNA, 13 nt, Homo sapiens
ucccucccagaaa

SEQ ID NO: 2061226 - RNA, 12 nt, Homo sapiens
aaacuaaacaga

SEQ ID NO: 2061227 - RNA, 21 nt, Homo sapiens
uccuaaaauuauggaaacaga

SEQ ID NO: 2061228 - RNA, 12 nt, Homo sapiens
uugaacuaugaa

SEQ ID NO: 2061229 - RNA, 13 nt, Homo sapiens
cuucucccugugu

SEQ ID NO: 2061230 - RNA, 19 nt, Homo sapiens
aggauccucuccacuccau

SEQ ID NO: 2061231 - RNA, 23 nt, Homo sapiens
ugacaccaagaaaccacugggca

SEQ ID NO: 2061232 - RNA, 18 nt, Homo sapiens
auccugggauccagugua

SEQ ID NO: 2061233 - RNA, 21 nt, Homo sapiens
uaugucaccuggcacauucau

SEQ ID NO: 2061234 - RNA, 15 nt, Homo sapiens
ggucuuucuccucag

SEQ ID NO: 2061235 - RNA, 17 nt, Homo sapiens
caauucagauccagugu

SEQ ID NO: 2061236 - RNA, 16 nt, Homo sapiens
ucuguaggacuuugaa

SEQ ID NO: 2061237 - RNA, 24 nt, Homo sapiens
guuuuuuaagaaacaaaagugcau

SEQ ID NO: 2061238 - RNA, 18 nt, Homo sapiens
uuccuuuguguguacuca

SEQ ID NO: 2061239 - RNA, 15 nt, Homo sapiens
ugacaucaguggcau

SEQ ID NO: 2061240 - RNA, 16 nt, Homo sapiens
ccacggugguccccaa

SEQ ID NO: 2061241 - RNA, 21 nt, Homo sapiens
cacuucuaguuuggcauuuca

SEQ ID NO: 2061242 - RNA, 24 nt, Homo sapiens
gcaguggagaggggacuuggauag

SEQ ID NO: 2061243 - RNA, 16 nt, Homo sapiens
aaaaggcuucacuuuu

SEQ ID NO: 2061244 - RNA, 21 nt, Homo sapiens
uuacuguuuggcugacaugac

SEQ ID NO: 2061245 - RNA, 13 nt, Homo sapiens
acucauucaggga

SEQ ID NO: 2061246 - RNA, 14 nt, Homo sapiens
ccacugagucucau

SEQ ID NO: 2061247 - RNA, 14 nt, Homo sapiens
cuaaagaguuuauu

SEQ ID NO: 2061248 - RNA, 16 nt, Homo sapiens
uuaaaaugaugaagga

SEQ ID NO: 2061249 - RNA, 17 nt, Homo sapiens
aauacaauuagccaggu

SEQ ID NO: 2061250 - RNA, 16 nt, Homo sapiens
augugaucagcuuuca

SEQ ID NO: 2061251 - RNA, 22 nt, Homo sapiens
uguugauacuagcauacuuaaa

SEQ ID NO: 2061252 - RNA, 15 nt, Homo sapiens
ugcgcuaacacuguc

SEQ ID NO: 2061253 - RNA, 15 nt, Homo sapiens
uccgcgugucucauu

SEQ ID NO: 2061254 - RNA, 16 nt, Homo sapiens
caaguaugaaguauaa

SEQ ID NO: 2061255 - RNA, 12 nt, Homo sapiens
aauucuauuaca

SEQ ID NO: 2061256 - RNA, 22 nt, Homo sapiens
gaggaagaacuacagcucuuaa

SEQ ID NO: 2061257 - RNA, 22 nt, Homo sapiens
aaggcaaggggugccugggaac

SEQ ID NO: 2061258 - RNA, 22 nt, Homo sapiens
aaaaccaaauucuauacaugua

SEQ ID NO: 2061259 - RNA, 20 nt, Homo sapiens
ugccccaguguggucaagca

SEQ ID NO: 2061260 - RNA, 14 nt, Homo sapiens
gaggccagacccac

SEQ ID NO: 2061261 - RNA, 22 nt, Homo sapiens
ugaaacccccacccuucugccu

SEQ ID NO: 2061262 - RNA, 19 nt, Homo sapiens
acuguagacaggaaagcca

SEQ ID NO: 2061263 - RNA, 18 nt, Homo sapiens
uaauugcuccuauacuau

SEQ ID NO: 2061264 - RNA, 15 nt, Homo sapiens
uggugcccgugccuc

SEQ ID NO: 2061265 - RNA, 14 nt, Homo sapiens
uagagcacugccac

SEQ ID NO: 2061266 - RNA, 20 nt, Homo sapiens
ggacaagugcuguugggaua

SEQ ID NO: 2061267 - RNA, 20 nt, Homo sapiens
augccaaaguagcugaugua

SEQ ID NO: 2061268 - RNA, 21 nt, Homo sapiens
aagcccguuaaauaauucccu

SEQ ID NO: 2061269 - RNA, 13 nt, Homo sapiens
ucuggagugagcu

SEQ ID NO: 2061270 - RNA, 17 nt, Homo sapiens
agauauugcuacuauaa

SEQ ID NO: 2061271 - RNA, 16 nt, Homo sapiens
guauuggaaauggaug

SEQ ID NO: 2061272 - RNA, 19 nt, Homo sapiens
augaaacagggcaccccag

SEQ ID NO: 2061273 - RNA, 16 nt, Homo sapiens
aucuacccacuuacua

SEQ ID NO: 2061274 - RNA, 19 nt, Homo sapiens
caggaaguggccaaaagcu

SEQ ID NO: 2061275 - RNA, 15 nt, Homo sapiens
caagcaaucaagaaa

SEQ ID NO: 2061276 - RNA, 15 nt, Homo sapiens
aauaauguaauacug

SEQ ID NO: 2061277 - RNA, 22 nt, Homo sapiens
cuugguccaacugcaacucauc

SEQ ID NO: 2061278 - RNA, 13 nt, Homo sapiens
cccucucaccuca

SEQ ID NO: 2061279 - RNA, 16 nt, Homo sapiens
auauuuauauugucac

SEQ ID NO: 2061280 - RNA, 21 nt, Homo sapiens
accuucaguugucucugaugu

SEQ ID NO: 2061281 - RNA, 23 nt, Homo sapiens
uuaauauaugcaucccuggugaa

SEQ ID NO: 2061282 - RNA, 16 nt, Homo sapiens
gccuucuccacuggcc

SEQ ID NO: 2061283 - RNA, 15 nt, Homo sapiens
gcuuugcacaggaaa

SEQ ID NO: 2061284 - RNA, 20 nt, Homo sapiens
gccugaagcuggccuggacc

SEQ ID NO: 2061285 - RNA, 20 nt, Homo sapiens
ucuccuaagcuggagugcag

SEQ ID NO: 2061286 - RNA, 21 nt, Homo sapiens
gagggagcgacacuugaaugu

SEQ ID NO: 2061287 - RNA, 13 nt, Homo sapiens
aaaucccacaguc

SEQ ID NO: 2061288 - RNA, 20 nt, Homo sapiens
caucacuggguguugaucuu

SEQ ID NO: 2061289 - RNA, 16 nt, Homo sapiens
cggggcuuugugggau

SEQ ID NO: 2061290 - RNA, 22 nt, Homo sapiens
ugugccacucaccgaagccacu

SEQ ID NO: 2061291 - RNA, 20 nt, Homo sapiens
aauccgcauugauggccuca

SEQ ID NO: 2061292 - RNA, 23 nt, Homo sapiens
gucgaugcucacugcuucugcuu

SEQ ID NO: 2061293 - RNA, 15 nt, Homo sapiens
caucuucgggaccag

SEQ ID NO: 2061294 - RNA, 23 nt, Homo sapiens
aggcucugcccugcccuagcucc

SEQ ID NO: 2061295 - RNA, 22 nt, Homo sapiens
ugcauggcucccgaguacagua

SEQ ID NO: 2061296 - RNA, 15 nt, Homo sapiens
uuaucuuggacugac

SEQ ID NO: 2061297 - RNA, 18 nt, Homo sapiens
accugggcaauauagcaa

SEQ ID NO: 2061298 - RNA, 21 nt, Homo sapiens
gagucaagcucugucacccag

SEQ ID NO: 2061299 - RNA, 16 nt, Homo sapiens
acauacuguucacuca

SEQ ID NO: 2061300 - RNA, 13 nt, Homo sapiens
gccagccucagaa

SEQ ID NO: 2061301 - RNA, 16 nt, Homo sapiens
cugcagugucugugau

SEQ ID NO: 2061302 - RNA, 17 nt, Homo sapiens
gagaauuguuaccuuaa

SEQ ID NO: 2061303 - RNA, 23 nt, Homo sapiens
cacugugaagagaaccauaucaa

SEQ ID NO: 2061304 - RNA, 18 nt, Homo sapiens
auuuuucagauauaaaag

SEQ ID NO: 2061305 - RNA, 17 nt, Homo sapiens
gugauccacccaccucg

SEQ ID NO: 2061306 - RNA, 18 nt, Homo sapiens
auuagccggucauggugg

SEQ ID NO: 2061307 - RNA, 22 nt, Homo sapiens
aguuaccuuauaguuacugugu

SEQ ID NO: 2061308 - RNA, 13 nt, Homo sapiens
cuauuagacugua

SEQ ID NO: 2061309 - RNA, 17 nt, Homo sapiens
uugggguuuaaauaucc

SEQ ID NO: 2061310 - RNA, 19 nt, Homo sapiens
cucauucaaauacuguauu

SEQ ID NO: 2061311 - RNA, 16 nt, Homo sapiens
caccucccugcaauaa

SEQ ID NO: 2061312 - RNA, 20 nt, Homo sapiens
ggcugguggcccaggaccau

SEQ ID NO: 2061313 - RNA, 21 nt, Homo sapiens
aaaugcuagguuaauuccaau

SEQ ID NO: 2061314 - RNA, 19 nt, Homo sapiens
acagcuuuaucaccagaga

SEQ ID NO: 2061315 - RNA, 21 nt, Homo sapiens
aaggacauuuaaaauucaauu

SEQ ID NO: 2061316 - RNA, 16 nt, Homo sapiens
acaaauuauguuacau

SEQ ID NO: 2061317 - RNA, 21 nt, Homo sapiens
uaagauuuuguuugcaucuga

SEQ ID NO: 2061318 - RNA, 15 nt, Homo sapiens
acaggagcguguacu

SEQ ID NO: 2061319 - RNA, 22 nt, Homo sapiens
gagcaaauaucauacuguucaa

SEQ ID NO: 2061320 - RNA, 22 nt, Homo sapiens
cuugucauaaaaugcauacugu

SEQ ID NO: 2061321 - RNA, 15 nt, Homo sapiens
gccaugacauuucau

SEQ ID NO: 2061322 - RNA, 17 nt, Homo sapiens
uugccuaauggcaaaac

SEQ ID NO: 2061323 - RNA, 13 nt, Homo sapiens
gcaucuuugcccu

SEQ ID NO: 2061324 - RNA, 12 nt, Homo sapiens
acugcacaaaag

SEQ ID NO: 2061325 - RNA, 12 nt, Homo sapiens
ccaccacacauc

SEQ ID NO: 2061326 - RNA, 17 nt, Homo sapiens
cugcucugccuguggag

SEQ ID NO: 2061327 - RNA, 22 nt, Homo sapiens
caguaagaauuauuuacugaaa

SEQ ID NO: 2061328 - RNA, 19 nt, Homo sapiens
aacaucccaauucuuuagu

SEQ ID NO: 2061329 - RNA, 23 nt, Homo sapiens
ggcccuuucaccccucuucccac

SEQ ID NO: 2061330 - RNA, 12 nt, Homo sapiens
gaaagaagacau

SEQ ID NO: 2061331 - RNA, 21 nt, Homo sapiens
acaauaaaauggaaagguccu

SEQ ID NO: 2061332 - RNA, 14 nt, Homo sapiens
cauguacugcauua

SEQ ID NO: 2061333 - RNA, 17 nt, Homo sapiens
uucaggaugcugugaua

SEQ ID NO: 2061334 - RNA, 14 nt, Homo sapiens
guuaagccauauga

SEQ ID NO: 2061335 - RNA, 18 nt, Homo sapiens
uuaauaaaaauaagaaau

SEQ ID NO: 2061336 - RNA, 17 nt, Homo sapiens
ucacaagugaaaacuga

SEQ ID NO: 2061337 - RNA, 17 nt, Homo sapiens
auccaugaaccaagacc

SEQ ID NO: 2061338 - RNA, 21 nt, Homo sapiens
uggcucuggguaccugcaagc

SEQ ID NO: 2061339 - RNA, 16 nt, Homo sapiens
augaaguccaagcauu

SEQ ID NO: 2061340 - RNA, 18 nt, Homo sapiens
ugggggugccgcugucuc

SEQ ID NO: 2061341 - RNA, 18 nt, Homo sapiens
guaauuuaaaauugugau

SEQ ID NO: 2061342 - RNA, 12 nt, Homo sapiens
ugguagcacuuu

SEQ ID NO: 2061343 - RNA, 20 nt, Homo sapiens
guuugaucacacagccacuu

SEQ ID NO: 2061344 - RNA, 15 nt, Homo sapiens
aggauguaagccugg

SEQ ID NO: 2061345 - RNA, 13 nt, Homo sapiens
uaguaaagcuuuu

SEQ ID NO: 2061346 - RNA, 13 nt, Homo sapiens
cuuugaaauaccu

SEQ ID NO: 2061347 - RNA, 13 nt, Homo sapiens
cguggcauuucaa

SEQ ID NO: 2061348 - RNA, 20 nt, Homo sapiens
acauucugaaucaagcacac

SEQ ID NO: 2061349 - RNA, 13 nt, Homo sapiens
caucuuuugauaa

SEQ ID NO: 2061350 - RNA, 15 nt, Homo sapiens
aguucuuaaaacacu

SEQ ID NO: 2061351 - RNA, 18 nt, Homo sapiens
acaguuuugccugcuaaa

SEQ ID NO: 2061352 - RNA, 22 nt, Homo sapiens
cugggaggggaagagugcucug

SEQ ID NO: 2061353 - RNA, 16 nt, Homo sapiens
agaugcuuugugacuu

SEQ ID NO: 2061354 - RNA, 19 nt, Homo sapiens
ugacugggucagccuuccg

SEQ ID NO: 2061355 - RNA, 13 nt, Homo sapiens
caccaugugaacc

SEQ ID NO: 2061356 - RNA, 20 nt, Homo sapiens
gacaggagccugguccuucc

SEQ ID NO: 2061357 - RNA, 13 nt, Homo sapiens
uguggaagcacuu

SEQ ID NO: 2061358 - RNA, 15 nt, Homo sapiens
aacagucacuggaaa

SEQ ID NO: 2061359 - RNA, 12 nt, Homo sapiens
ggccucccucag

SEQ ID NO: 2061360 - RNA, 20 nt, Homo sapiens
ucgcuuguuuuucuuugaag

SEQ ID NO: 2061361 - RNA, 19 nt, Homo sapiens
acgagaccugugugccagg

SEQ ID NO: 2061362 - RNA, 14 nt, Homo sapiens
aauuaaaagcccua

SEQ ID NO: 2061363 - RNA, 21 nt, Homo sapiens
uuuaaaagagacaaacuguaa

SEQ ID NO: 2061364 - RNA, 14 nt, Homo sapiens
uugcacagccaaau

SEQ ID NO: 2061365 - RNA, 21 nt, Homo sapiens
ccagugggccuguggcauuca

SEQ ID NO: 2061366 - RNA, 18 nt, Homo sapiens
cagaugccggagccccaa

SEQ ID NO: 2061367 - RNA, 16 nt, Homo sapiens
ucacacuuacugcaaa

SEQ ID NO: 2061368 - RNA, 14 nt, Homo sapiens
aaagggcacucuga

SEQ ID NO: 2061369 - RNA, 14 nt, Homo sapiens
cauuccagcuccuc

SEQ ID NO: 2061370 - RNA, 22 nt, Homo sapiens
cccauucuccacucacugcauu

SEQ ID NO: 2061371 - RNA, 21 nt, Homo sapiens
aacuauuuaacuugagcuuua

SEQ ID NO: 2061372 - RNA, 22 nt, Homo sapiens
uccacccauaauccuuucugcc

SEQ ID NO: 2061373 - RNA, 17 nt, Homo sapiens
auaaagacuugugcauc

SEQ ID NO: 2061374 - RNA, 15 nt, Homo sapiens
accugugcauucucc

SEQ ID NO: 2061375 - RNA, 16 nt, Homo sapiens
gaaccugguugcagga

SEQ ID NO: 2061376 - RNA, 14 nt, Homo sapiens
cugaugcugggacc

SEQ ID NO: 2061377 - RNA, 16 nt, Homo sapiens
uguugaggcugucaca

SEQ ID NO: 2061378 - RNA, 16 nt, Homo sapiens
caucuguaaaaggccu

SEQ ID NO: 2061379 - RNA, 23 nt, Homo sapiens
ucuucuggccuggugucuccuca

SEQ ID NO: 2061380 - RNA, 20 nt, Homo sapiens
ccaacugcugaucaaugaaa

SEQ ID NO: 2061381 - RNA, 12 nt, Homo sapiens
agagacugcuug

SEQ ID NO: 2061382 - RNA, 14 nt, Homo sapiens
uuaagacacaccuc

SEQ ID NO: 2061383 - RNA, 13 nt, Homo sapiens
aaaaauaacugug

SEQ ID NO: 2061384 - RNA, 15 nt, Homo sapiens
cccuccaaaagcacu

SEQ ID NO: 2061385 - RNA, 18 nt, Homo sapiens
uggcaugaggagguccca

SEQ ID NO: 2061386 - RNA, 17 nt, Homo sapiens
ccgcagcacccugcaga

SEQ ID NO: 2061387 - RNA, 15 nt, Homo sapiens
ugacuuuucaaguau

SEQ ID NO: 2061388 - RNA, 23 nt, Homo sapiens
uggaccagucccgucgugcaguc

SEQ ID NO: 2061389 - RNA, 18 nt, Homo sapiens
guucucagcuagauuuga

SEQ ID NO: 2061390 - RNA, 15 nt, Homo sapiens
ggcuugccacagcuc

SEQ ID NO: 2061391 - RNA, 21 nt, Homo sapiens
agucaggacagcuuguaugua

SEQ ID NO: 2061392 - RNA, 21 nt, Homo sapiens
agcauacguacacauuuuauu

SEQ ID NO: 2061393 - RNA, 16 nt, Homo sapiens
gccuccucagccucug

SEQ ID NO: 2061394 - RNA, 13 nt, Homo sapiens
ugaaaaauauuca

SEQ ID NO: 2061395 - RNA, 21 nt, Homo sapiens
caucucacuuugccccaguua

SEQ ID NO: 2061396 - RNA, 16 nt, Homo sapiens
aucuccuugauuacau

SEQ ID NO: 2061397 - RNA, 18 nt, Homo sapiens
uaauaaccaaacauaaca

SEQ ID NO: 2061398 - RNA, 15 nt, Homo sapiens
ugggcugagugcagc

SEQ ID NO: 2061399 - RNA, 14 nt, Homo sapiens
gcucgagcucgggg

SEQ ID NO: 2061400 - RNA, 17 nt, Homo sapiens
agcuuuaaacucaggga

SEQ ID NO: 2061401 - RNA, 17 nt, Homo sapiens
caagcugaccuugcuga

SEQ ID NO: 2061402 - RNA, 22 nt, Homo sapiens
ccaggauccccugcuacuccac

SEQ ID NO: 2061403 - RNA, 18 nt, Homo sapiens
uauuuuaagcacucuuaa

SEQ ID NO: 2061404 - RNA, 20 nt, Homo sapiens
aggacagauccagggacuga

SEQ ID NO: 2061405 - RNA, 14 nt, Homo sapiens
ucuaccaagcuguc

SEQ ID NO: 2061406 - RNA, 13 nt, Homo sapiens
ugcagggagacau

SEQ ID NO: 2061407 - RNA, 19 nt, Homo sapiens
aguuuaagccgcagaccug

SEQ ID NO: 2061408 - RNA, 19 nt, Homo sapiens
cuaagcuggggacagagaa

SEQ ID NO: 2061409 - RNA, 15 nt, Homo sapiens
uuccauuuuggaaaa

SEQ ID NO: 2061410 - RNA, 21 nt, Homo sapiens
uccugcacagaucgauaccuu

SEQ ID NO: 2061411 - RNA, 14 nt, Homo sapiens
agccagaaucucau

SEQ ID NO: 2061412 - RNA, 22 nt, Homo sapiens
gucucuucggcagggaggugaa

SEQ ID NO: 2061413 - RNA, 19 nt, Homo sapiens
ugcccuuggcaccaccagg

SEQ ID NO: 2061414 - RNA, 12 nt, Homo sapiens
gaaggguggaug

SEQ ID NO: 2061415 - RNA, 16 nt, Homo sapiens
caagaaacugagacca

SEQ ID NO: 2061416 - RNA, 20 nt, Homo sapiens
gagccaccgcgccuggccaa

SEQ ID NO: 2061417 - RNA, 13 nt, Homo sapiens
ugucucaguuuac

SEQ ID NO: 2061418 - RNA, 15 nt, Homo sapiens
uuaaauuucaucuca

SEQ ID NO: 2061419 - RNA, 20 nt, Homo sapiens
uagaaaacgcgaccuuggcc

SEQ ID NO: 2061420 - RNA, 13 nt, Homo sapiens
aggaacauacaga

SEQ ID NO: 2061421 - RNA, 16 nt, Homo sapiens
gccaccaagggccuca

SEQ ID NO: 2061422 - RNA, 22 nt, Homo sapiens
agaccugcucuggacacuugcu

SEQ ID NO: 2061423 - RNA, 17 nt, Homo sapiens
ccuccagagaccccagg

SEQ ID NO: 2061424 - RNA, 18 nt, Homo sapiens
ucagaggccugcugccag

SEQ ID NO: 2061425 - RNA, 19 nt, Homo sapiens
guugcaacuuuuuaauucc

SEQ ID NO: 2061426 - RNA, 15 nt, Homo sapiens
ccuaugaaauuucaa

SEQ ID NO: 2061427 - RNA, 21 nt, Homo sapiens
cuaugaaaacagcuaucucac

SEQ ID NO: 2061428 - RNA, 20 nt, Homo sapiens
acaccaguacaagaucucag

SEQ ID NO: 2061429 - RNA, 14 nt, Homo sapiens
uggaauuggagcuc

SEQ ID NO: 2061430 - RNA, 13 nt, Homo sapiens
cuguguugucucu

SEQ ID NO: 2061431 - RNA, 18 nt, Homo sapiens
auguuuuuugccacagcu

SEQ ID NO: 2061432 - RNA, 17 nt, Homo sapiens
guguugccaaaaccaaa

SEQ ID NO: 2061433 - RNA, 20 nt, Homo sapiens
uuugguauaugauagguuac

SEQ ID NO: 2061434 - RNA, 19 nt, Homo sapiens
cagauugcaacaggcuggg

SEQ ID NO: 2061435 - RNA, 21 nt, Homo sapiens
uauuaaaaagccugcauucug

SEQ ID NO: 2061436 - RNA, 14 nt, Homo sapiens
gagcuccccaucac

SEQ ID NO: 2061437 - RNA, 19 nt, Homo sapiens
acuucguguccgacucuuc

SEQ ID NO: 2061438 - RNA, 17 nt, Homo sapiens
ucugugcguguggcgug

SEQ ID NO: 2061439 - RNA, 22 nt, Homo sapiens
auucauugaucaaauauuucaa

SEQ ID NO: 2061440 - RNA, 15 nt, Homo sapiens
uacaguccuuccagg

SEQ ID NO: 2061441 - RNA, 17 nt, Homo sapiens
uacugugcaguuuucag

SEQ ID NO: 2061442 - RNA, 12 nt, Homo sapiens
aggccugugcuc

SEQ ID NO: 2061443 - RNA, 22 nt, Homo sapiens
ccuuaaaauguggucugccaau

SEQ ID NO: 2061444 - RNA, 15 nt, Homo sapiens
auagcaagugcuauu

SEQ ID NO: 2061445 - RNA, 15 nt, Homo sapiens
acaaauaauagcaau

SEQ ID NO: 2061446 - RNA, 18 nt, Homo sapiens
cacaccaaguaccaguau

SEQ ID NO: 2061447 - RNA, 23 nt, Homo sapiens
uuccucaauuauuauucacauuu

SEQ ID NO: 2061448 - RNA, 18 nt, Homo sapiens
agaagaaauucugucaua

SEQ ID NO: 2061449 - RNA, 21 nt, Homo sapiens
aagagcaucaugccucugagg

SEQ ID NO: 2061450 - RNA, 13 nt, Homo sapiens
auaucaacacuug

SEQ ID NO: 2061451 - RNA, 13 nt, Homo sapiens
aagcccuugaacc

SEQ ID NO: 2061452 - RNA, 14 nt, Homo sapiens
gugaauuuuugcaa

SEQ ID NO: 2061453 - RNA, 15 nt, Homo sapiens
uauugucaaagagua

SEQ ID NO: 2061454 - RNA, 23 nt, Homo sapiens
aaacccaaauaaauguguaaaug

SEQ ID NO: 2061455 - RNA, 12 nt, Homo sapiens
aaucuaucuaca

SEQ ID NO: 2061456 - RNA, 14 nt, Homo sapiens
gguauuauucuguu

SEQ ID NO: 2061457 - RNA, 20 nt, Homo sapiens
caucuagaggcuuccuucau

SEQ ID NO: 2061458 - RNA, 13 nt, Homo sapiens
cagacguugccug

SEQ ID NO: 2061459 - RNA, 21 nt, Homo sapiens
augaauaacauuuaaauucca

SEQ ID NO: 2061460 - RNA, 14 nt, Homo sapiens
ccaaauaaacucca

SEQ ID NO: 2061461 - RNA, 15 nt, Homo sapiens
ggugaccagcaccau

SEQ ID NO: 2061462 - RNA, 13 nt, Homo sapiens
ccgcugugccagg

SEQ ID NO: 2061463 - RNA, 15 nt, Homo sapiens
auauuagaucaaaua

SEQ ID NO: 2061464 - RNA, 22 nt, Homo sapiens
ccaagaacaagucaccuccaag

SEQ ID NO: 2061465 - RNA, 22 nt, Homo sapiens
cagcugacucucgugcauuuca

SEQ ID NO: 2061466 - RNA, 12 nt, Homo sapiens
gguuucaccucc

SEQ ID NO: 2061467 - RNA, 16 nt, Homo sapiens
agagugacacccaaga

SEQ ID NO: 2061468 - RNA, 15 nt, Homo sapiens
cagcccagugcaaac

SEQ ID NO: 2061469 - RNA, 12 nt, Homo sapiens
gugcacaaauac

SEQ ID NO: 2061470 - RNA, 14 nt, Homo sapiens
gcaugacauuggca

SEQ ID NO: 2061471 - RNA, 16 nt, Homo sapiens
ucuuucccucauguau

SEQ ID NO: 2061472 - RNA, 14 nt, Homo sapiens
gaauugacugccua

SEQ ID NO: 2061473 - RNA, 20 nt, Homo sapiens
agauguggcuacugacauau

SEQ ID NO: 2061474 - RNA, 19 nt, Homo sapiens
uucugagacagcuugucug

SEQ ID NO: 2061475 - RNA, 16 nt, Homo sapiens
auuuucuagauacaau

SEQ ID NO: 2061476 - RNA, 20 nt, Homo sapiens
uagaaaauaaaacugagcua

SEQ ID NO: 2061477 - RNA, 13 nt, Homo sapiens
uugaacugaaguc

SEQ ID NO: 2061478 - RNA, 18 nt, Homo sapiens
uccuacucugugucaggu

SEQ ID NO: 2061479 - RNA, 24 nt, Homo sapiens
cuuauuacugcuugcaguaauuca

SEQ ID NO: 2061480 - RNA, 19 nt, Homo sapiens
uggcuacaaagaccuaccu

SEQ ID NO: 2061481 - RNA, 18 nt, Homo sapiens
ucugggaguccugucagc

SEQ ID NO: 2061482 - RNA, 11 nt, Homo sapiens
uucaugaaauu

SEQ ID NO: 2061483 - RNA, 16 nt, Homo sapiens
gcuguguacaauguga

SEQ ID NO: 2061484 - RNA, 23 nt, Homo sapiens
ugcaaggugcccacaugugucca

SEQ ID NO: 2061485 - RNA, 16 nt, Homo sapiens
gucugggcaccaccuc

SEQ ID NO: 2061486 - RNA, 14 nt, Homo sapiens
ucuaaaaccaaaua

SEQ ID NO: 2061487 - RNA, 14 nt, Homo sapiens
gcucugucacccag

SEQ ID NO: 2061488 - RNA, 15 nt, Homo sapiens
acccucagcacuguu

SEQ ID NO: 2061489 - RNA, 15 nt, Homo sapiens
agaacaaugcuauaa

SEQ ID NO: 2061490 - RNA, 13 nt, Homo sapiens
gaugaaucagcaa

SEQ ID NO: 2061491 - RNA, 20 nt, Homo sapiens
gugugaggcggcccugacca

SEQ ID NO: 2061492 - RNA, 21 nt, Homo sapiens
ugguacuccaauucagaauga

SEQ ID NO: 2061493 - RNA, 17 nt, Homo sapiens
gcucuccugacuuuuaa

SEQ ID NO: 2061494 - RNA, 14 nt, Homo sapiens
uacaagaaagcaau

SEQ ID NO: 2061495 - RNA, 12 nt, Homo sapiens
caaaacccacuu

SEQ ID NO: 2061496 - RNA, 13 nt, Homo sapiens
uacucaggcagug

SEQ ID NO: 2061497 - RNA, 16 nt, Homo sapiens
acggcacgcacuugcc

SEQ ID NO: 2061498 - RNA, 22 nt, Homo sapiens
acaggcugagcuuucuagccua

SEQ ID NO: 2061499 - RNA, 20 nt, Homo sapiens
cugacccauucacauuuuaa

SEQ ID NO: 2061500 - RNA, 21 nt, Homo sapiens
auauagauuguccuuuugcaa

SEQ ID NO: 2061501 - RNA, 16 nt, Homo sapiens
aagaagaagugaccaa

SEQ ID NO: 2061502 - RNA, 13 nt, Homo sapiens
agaaagcauuucu

SEQ ID NO: 2061503 - RNA, 17 nt, Homo sapiens
acuaaaaauaccaaaaa

SEQ ID NO: 2061504 - RNA, 17 nt, Homo sapiens
gugacugaacgagggau

SEQ ID NO: 2061505 - RNA, 11 nt, Homo sapiens
gagugagcucu

SEQ ID NO: 2061506 - RNA, 19 nt, Homo sapiens
uuguacugugcaguuuuca

SEQ ID NO: 2061507 - RNA, 15 nt, Homo sapiens
aagaauguacauuac

SEQ ID NO: 2061508 - RNA, 17 nt, Homo sapiens
accuacauucaaggaga

SEQ ID NO: 2061509 - RNA, 21 nt, Homo sapiens
aauacuucuuaaaaugugcua

SEQ ID NO: 2061510 - RNA, 22 nt, Homo sapiens
guuugagagagcagccaggaga

SEQ ID NO: 2061511 - RNA, 22 nt, Homo sapiens
aagugcuacucucacucagccu

SEQ ID NO: 2061512 - RNA, 16 nt, Homo sapiens
cugucaccuagcucaa

SEQ ID NO: 2061513 - RNA, 19 nt, Homo sapiens
ugacauauguagaugugcu

SEQ ID NO: 2061514 - RNA, 19 nt, Homo sapiens
uacugaggaaugucuuuca

SEQ ID NO: 2061515 - RNA, 14 nt, Homo sapiens
acauggccuaugca

SEQ ID NO: 2061516 - RNA, 19 nt, Homo sapiens
agggauugaggaguugccu

SEQ ID NO: 2061517 - RNA, 16 nt, Homo sapiens
agaauaacuaauacaa

SEQ ID NO: 2061518 - RNA, 15 nt, Homo sapiens
cuggaacauuccaaa

SEQ ID NO: 2061519 - RNA, 19 nt, Homo sapiens
cccagcuuugcugccugag

SEQ ID NO: 2061520 - RNA, 19 nt, Homo sapiens
ggaaaaaccaauagcuuua

SEQ ID NO: 2061521 - RNA, 17 nt, Homo sapiens
acugaauuacucuccaa

SEQ ID NO: 2061522 - RNA, 22 nt, Homo sapiens
cagccugagcaacagagugaga

SEQ ID NO: 2061523 - RNA, 16 nt, Homo sapiens
ucccuggaucagaaca

SEQ ID NO: 2061524 - RNA, 15 nt, Homo sapiens
uucagcgaagucuca

SEQ ID NO: 2061525 - RNA, 13 nt, Homo sapiens
cuugaaugugguc

SEQ ID NO: 2061526 - RNA, 13 nt, Homo sapiens
aagaccccacugc

SEQ ID NO: 2061527 - RNA, 17 nt, Homo sapiens
uugugcaaacauggaga

SEQ ID NO: 2061528 - RNA, 17 nt, Homo sapiens
aguuccgccucccgggu

SEQ ID NO: 2061529 - RNA, 19 nt, Homo sapiens
cuuauagagagcccaaaga

SEQ ID NO: 2061530 - RNA, 20 nt, Homo sapiens
cggccuagggguccacggga

SEQ ID NO: 2061531 - RNA, 15 nt, Homo sapiens
uaaagugacuuucua

SEQ ID NO: 2061532 - RNA, 17 nt, Homo sapiens
uugguucagggugauaa

SEQ ID NO: 2061533 - RNA, 15 nt, Homo sapiens
cccucacccaaaaga

SEQ ID NO: 2061534 - RNA, 19 nt, Homo sapiens
uaaacuauuuugagcauua

SEQ ID NO: 2061535 - RNA, 18 nt, Homo sapiens
aucaagaaauacuuucga

SEQ ID NO: 2061536 - RNA, 20 nt, Homo sapiens
gucucugacaaagugugucu

SEQ ID NO: 2061537 - RNA, 14 nt, Homo sapiens
aggagcugggccag

SEQ ID NO: 2061538 - RNA, 18 nt, Homo sapiens
agcuaaggccaaugggcu

SEQ ID NO: 2061539 - RNA, 20 nt, Homo sapiens
uaagacuauaaauaaaaacu

SEQ ID NO: 2061540 - RNA, 13 nt, Homo sapiens
ucagcaugagauu

SEQ ID NO: 2061541 - RNA, 11 nt, Homo sapiens
agcagaugcca

SEQ ID NO: 2061542 - RNA, 18 nt, Homo sapiens
auuuuagcagagacuuua

SEQ ID NO: 2061543 - RNA, 16 nt, Homo sapiens
cucaggugugccuguu

SEQ ID NO: 2061544 - RNA, 15 nt, Homo sapiens
ucacaucucuguaga

SEQ ID NO: 2061545 - RNA, 16 nt, Homo sapiens
gugccaggauggaaug

SEQ ID NO: 2061546 - RNA, 16 nt, Homo sapiens
aucuaguugucaauaa

SEQ ID NO: 2061547 - RNA, 21 nt, Homo sapiens
uagaggcuccccagggcuccc

SEQ ID NO: 2061548 - RNA, 22 nt, Homo sapiens
ucuaagucacaggaugagacag

SEQ ID NO: 2061549 - RNA, 22 nt, Homo sapiens
cugauuuauuucuacuauauac

SEQ ID NO: 2061550 - RNA, 22 nt, Homo sapiens
uuuauauauauaaagucaguga

SEQ ID NO: 2061551 - RNA, 22 nt, Homo sapiens
uugacacuuuucauaucauuuc

SEQ ID NO: 2061552 - RNA, 16 nt, Homo sapiens
ccuuuagcacguuuaa

SEQ ID NO: 2061553 - RNA, 14 nt, Homo sapiens
uggccaaaaugcag

SEQ ID NO: 2061554 - RNA, 18 nt, Homo sapiens
cacuaaaauuccacucau

SEQ ID NO: 2061555 - RNA, 21 nt, Homo sapiens
uauacuuuuaaagccuauuca

SEQ ID NO: 2061556 - RNA, 18 nt, Homo sapiens
ccggcgcugauuccucgu

SEQ ID NO: 2061557 - RNA, 11 nt, Homo sapiens
aagaugcauuu

SEQ ID NO: 2061558 - RNA, 17 nt, Homo sapiens
ggccagcugcaucuacu

SEQ ID NO: 2061559 - RNA, 14 nt, Homo sapiens
ucaggaaaacaccc

SEQ ID NO: 2061560 - RNA, 20 nt, Homo sapiens
uuuuuucaaaauccaaaaag

SEQ ID NO: 2061561 - RNA, 23 nt, Homo sapiens
cuagugaagaccagagcaguuuc

SEQ ID NO: 2061562 - RNA, 19 nt, Homo sapiens
gagugcaggggggcaauca

SEQ ID NO: 2061563 - RNA, 12 nt, Homo sapiens
uacaacauguag

SEQ ID NO: 2061564 - RNA, 22 nt, Homo sapiens
ggaaaauaauacugcugagaua

SEQ ID NO: 2061565 - RNA, 17 nt, Homo sapiens
uggucacuggagucucc

SEQ ID NO: 2061566 - RNA, 21 nt, Homo sapiens
caaggaauguuaucaguauua

SEQ ID NO: 2061567 - RNA, 12 nt, Homo sapiens
caggaagacaca

SEQ ID NO: 2061568 - RNA, 23 nt, Homo sapiens
augugaagagggagaagcaugaa

SEQ ID NO: 2061569 - RNA, 18 nt, Homo sapiens
guaaauguguuagcacug

SEQ ID NO: 2061570 - RNA, 18 nt, Homo sapiens
uaaaauauuuaucugauu

SEQ ID NO: 2061571 - RNA, 17 nt, Homo sapiens
ucaggucagagcccagg

SEQ ID NO: 2061572 - RNA, 21 nt, Homo sapiens
ugcacgcuugcacacaugcac

SEQ ID NO: 2061573 - RNA, 21 nt, Homo sapiens
cagcuagugacccacaugcca

SEQ ID NO: 2061574 - RNA, 19 nt, Homo sapiens
uugagguucucuauauucg

SEQ ID NO: 2061575 - RNA, 16 nt, Homo sapiens
acuucauaaauguuca

SEQ ID NO: 2061576 - RNA, 22 nt, Homo sapiens
cuuaauaguaggguaaguuguu

SEQ ID NO: 2061577 - RNA, 17 nt, Homo sapiens
auaagauugaaauucca

SEQ ID NO: 2061578 - RNA, 11 nt, Homo sapiens
cugcugugaac

SEQ ID NO: 2061579 - RNA, 15 nt, Homo sapiens
guuggagagcagcag

SEQ ID NO: 2061580 - RNA, 18 nt, Homo sapiens
aagccaagagugccacau

SEQ ID NO: 2061581 - RNA, 18 nt, Homo sapiens
aggaccuaaaacaucuca

SEQ ID NO: 2061582 - RNA, 22 nt, Homo sapiens
gacaauccugaagaaaccacag

SEQ ID NO: 2061583 - RNA, 17 nt, Homo sapiens
cuggaguuugagaccag

SEQ ID NO: 2061584 - RNA, 21 nt, Homo sapiens
auguuucaagcgcuuaacucc

SEQ ID NO: 2061585 - RNA, 14 nt, Homo sapiens
uccuuucuuccuug

SEQ ID NO: 2061586 - RNA, 16 nt, Homo sapiens
cuucugcacccuccac

SEQ ID NO: 2061587 - RNA, 20 nt, Homo sapiens
accagaguuucuugguugcu

SEQ ID NO: 2061588 - RNA, 21 nt, Homo sapiens
uguuggggggccccacggaga

SEQ ID NO: 2061589 - RNA, 23 nt, Homo sapiens
aacacagagaagcggauuuccag

SEQ ID NO: 2061590 - RNA, 14 nt, Homo sapiens
auccauacauuugu

SEQ ID NO: 2061591 - RNA, 14 nt, Homo sapiens
ucucaaacuccuga

SEQ ID NO: 2061592 - RNA, 13 nt, Homo sapiens
cucacugccaaaa

SEQ ID NO: 2061593 - RNA, 11 nt, Homo sapiens
acuccuugcau

SEQ ID NO: 2061594 - RNA, 20 nt, Homo sapiens
agccaagugcccucucugaa

SEQ ID NO: 2061595 - RNA, 15 nt, Homo sapiens
accuucauuuaauau

SEQ ID NO: 2061596 - RNA, 16 nt, Homo sapiens
aucuccagcauccugc

SEQ ID NO: 2061597 - RNA, 14 nt, Homo sapiens
caaaugcugugcaa

SEQ ID NO: 2061598 - RNA, 20 nt, Homo sapiens
acacgcauacacacauauaa

SEQ ID NO: 2061599 - RNA, 23 nt, Homo sapiens
guaauagggcuucugccuaagcc

SEQ ID NO: 2061600 - RNA, 19 nt, Homo sapiens
gagccagacuguccaggga

SEQ ID NO: 2061601 - RNA, 18 nt, Homo sapiens
auguguaugcaaguacaa

SEQ ID NO: 2061602 - RNA, 17 nt, Homo sapiens
gucauagagcccaguga

SEQ ID NO: 2061603 - RNA, 13 nt, Homo sapiens
aucaggguuugca

SEQ ID NO: 2061604 - RNA, 22 nt, Homo sapiens
gcugcgucugacauccugaccu

SEQ ID NO: 2061605 - RNA, 14 nt, Homo sapiens
gaacucccuuucaa

SEQ ID NO: 2061606 - RNA, 19 nt, Homo sapiens
accguuauuauaauuguau

SEQ ID NO: 2061607 - RNA, 16 nt, Homo sapiens
cauccauauacauaua

SEQ ID NO: 2061608 - RNA, 22 nt, Homo sapiens
ccuuauuaguuacaaaguuaua

SEQ ID NO: 2061609 - RNA, 21 nt, Homo sapiens
cccugcccacguccccaccca

SEQ ID NO: 2061610 - RNA, 22 nt, Homo sapiens
ccagagagcagcuucagugaca

SEQ ID NO: 2061611 - RNA, 18 nt, Homo sapiens
uaagaaguccuaucucau

SEQ ID NO: 2061612 - RNA, 18 nt, Homo sapiens
cagacuccugagugaggu

SEQ ID NO: 2061613 - RNA, 15 nt, Homo sapiens
cugacugaaugcaga

SEQ ID NO: 2061614 - RNA, 19 nt, Homo sapiens
caaguggccauuaccaucu

SEQ ID NO: 2061615 - RNA, 23 nt, Homo sapiens
guccaggccugugaggugcagag

SEQ ID NO: 2061616 - RNA, 14 nt, Homo sapiens
agggugacuaugga

SEQ ID NO: 2061617 - RNA, 18 nt, Homo sapiens
aauugcuguugaaagcaa

SEQ ID NO: 2061618 - RNA, 20 nt, Homo sapiens
ccgaggaaugugaagccaga

SEQ ID NO: 2061619 - RNA, 20 nt, Homo sapiens
acugccuuaccuucacuuaa

SEQ ID NO: 2061620 - RNA, 15 nt, Homo sapiens
augaaccauggcacc

SEQ ID NO: 2061621 - RNA, 23 nt, Homo sapiens
acaggaaaaaaaaaaaucuaucc

SEQ ID NO: 2061622 - RNA, 23 nt, Homo sapiens
caauuucccccuaaaccaacuga

SEQ ID NO: 2061623 - RNA, 17 nt, Homo sapiens
auuacaggcuccugcca

SEQ ID NO: 2061624 - RNA, 15 nt, Homo sapiens
gcaaaaagaugccuu

SEQ ID NO: 2061625 - RNA, 23 nt, Homo sapiens
agcuucuuccaggugcccagcua

SEQ ID NO: 2061626 - RNA, 11 nt, Homo sapiens
cugaagggaag

SEQ ID NO: 2061627 - RNA, 14 nt, Homo sapiens
accucuccagccuc

SEQ ID NO: 2061628 - RNA, 14 nt, Homo sapiens
acccucccagcucu

SEQ ID NO: 2061629 - RNA, 22 nt, Homo sapiens
guauucuacccuguugcaaagg

SEQ ID NO: 2061630 - RNA, 21 nt, Homo sapiens
ucugaagcagaugcaaagagg

SEQ ID NO: 2061631 - RNA, 23 nt, Homo sapiens
cauguauuaugauuaaaucugag

SEQ ID NO: 2061632 - RNA, 12 nt, Homo sapiens
augaagacaaaa

SEQ ID NO: 2061633 - RNA, 19 nt, Homo sapiens
acaguccuguccucuggau

SEQ ID NO: 2061634 - RNA, 17 nt, Homo sapiens
gucgugcuuuuccugug

SEQ ID NO: 2061635 - RNA, 22 nt, Homo sapiens
cuggaacccgagacuuggccau

SEQ ID NO: 2061636 - RNA, 14 nt, Homo sapiens
uugacauagccuuu

SEQ ID NO: 2061637 - RNA, 19 nt, Homo sapiens
cuacacaccuaagggacau

SEQ ID NO: 2061638 - RNA, 20 nt, Homo sapiens
ucucaaauggacaauaccag

SEQ ID NO: 2061639 - RNA, 20 nt, Homo sapiens
acaaagauuuucuaaggaau

SEQ ID NO: 2061640 - RNA, 18 nt, Homo sapiens
auucaaauuuuaucucca

SEQ ID NO: 2061641 - RNA, 17 nt, Homo sapiens
uggcaucuuacaucuga

SEQ ID NO: 2061642 - RNA, 20 nt, Homo sapiens
cucagcacucuggacuccac

SEQ ID NO: 2061643 - RNA, 21 nt, Homo sapiens
augaaaccuguacauaugugu

SEQ ID NO: 2061644 - RNA, 20 nt, Homo sapiens
aagccagccaugcauuguua

SEQ ID NO: 2061645 - RNA, 16 nt, Homo sapiens
agcuggcgcucagcag

SEQ ID NO: 2061646 - RNA, 21 nt, Homo sapiens
ugacaguagcauacugaugag

SEQ ID NO: 2061647 - RNA, 20 nt, Homo sapiens
aaccuccaccucgcagguuc

SEQ ID NO: 2061648 - RNA, 21 nt, Homo sapiens
uuuguagagccagggucucac

SEQ ID NO: 2061649 - RNA, 15 nt, Homo sapiens
uccagaucacugcca

SEQ ID NO: 2061650 - RNA, 16 nt, Homo sapiens
aggagaaaaugcauua

SEQ ID NO: 2061651 - RNA, 17 nt, Homo sapiens
cgcacuggggcuggcaa

SEQ ID NO: 2061652 - RNA, 19 nt, Homo sapiens
aaacgaagcucauucccaa

SEQ ID NO: 2061653 - RNA, 19 nt, Homo sapiens
uauccagaggguugugauu

SEQ ID NO: 2061654 - RNA, 20 nt, Homo sapiens
gaaacgauagccuagcuuuc

SEQ ID NO: 2061655 - RNA, 12 nt, Homo sapiens
ccuccacagaga

SEQ ID NO: 2061656 - RNA, 14 nt, Homo sapiens
auccuaaucaucca

SEQ ID NO: 2061657 - RNA, 22 nt, Homo sapiens
auuccuuacuugcacuguuacu

SEQ ID NO: 2061658 - RNA, 13 nt, Homo sapiens
cauaugucuucaa

SEQ ID NO: 2061659 - RNA, 21 nt, Homo sapiens
agugggggcggggaagggugc

SEQ ID NO: 2061660 - RNA, 12 nt, Homo sapiens
auaacacugucu

SEQ ID NO: 2061661 - RNA, 18 nt, Homo sapiens
acaauuagucaaaccacu

SEQ ID NO: 2061662 - RNA, 23 nt, Homo sapiens
aggggagcuaugcuaggacucca

SEQ ID NO: 2061663 - RNA, 16 nt, Homo sapiens
agggagguuugugaga

SEQ ID NO: 2061664 - RNA, 18 nt, Homo sapiens
cagagaagcgcuguugcc

SEQ ID NO: 2061665 - RNA, 18 nt, Homo sapiens
uaccacacccagggcuau

SEQ ID NO: 2061666 - RNA, 13 nt, Homo sapiens
caacaugacuguu

SEQ ID NO: 2061667 - RNA, 21 nt, Homo sapiens
gucacuaaccaagccagaaac

SEQ ID NO: 2061668 - RNA, 12 nt, Homo sapiens
augauuugcacu

SEQ ID NO: 2061669 - RNA, 19 nt, Homo sapiens
gacuucaaaaggugauuaa

SEQ ID NO: 2061670 - RNA, 11 nt, Homo sapiens
guacucagggc

SEQ ID NO: 2061671 - RNA, 14 nt, Homo sapiens
uagcaagugugcac

SEQ ID NO: 2061672 - RNA, 21 nt, Homo sapiens
uguuuuaucuccauacuuugg

SEQ ID NO: 2061673 - RNA, 23 nt, Homo sapiens
acgccaaugcacacacacagaga

SEQ ID NO: 2061674 - RNA, 20 nt, Homo sapiens
agaaaccuuauuguaccucu

SEQ ID NO: 2061675 - RNA, 16 nt, Homo sapiens
ugggaucuaacuguug

SEQ ID NO: 2061676 - RNA, 15 nt, Homo sapiens
ccaccuuccccagaa

SEQ ID NO: 2061677 - RNA, 20 nt, Homo sapiens
uguaccacuuuugcaaauaa

SEQ ID NO: 2061678 - RNA, 21 nt, Homo sapiens
cugguugguguugcagaaggu

SEQ ID NO: 2061679 - RNA, 19 nt, Homo sapiens
gaccacauaagaaggcaau

SEQ ID NO: 2061680 - RNA, 19 nt, Homo sapiens
aauuuaagacaaguucaac

SEQ ID NO: 2061681 - RNA, 19 nt, Homo sapiens
acugcaugggcugugggcu

SEQ ID NO: 2061682 - RNA, 16 nt, Homo sapiens
cauggccaauagucau

SEQ ID NO: 2061683 - RNA, 14 nt, Homo sapiens
aauuuacacugcca

SEQ ID NO: 2061684 - RNA, 14 nt, Homo sapiens
cauccgcaauguug

SEQ ID NO: 2061685 - RNA, 20 nt, Homo sapiens
acaucuguggacaagacaug

SEQ ID NO: 2061686 - RNA, 22 nt, Homo sapiens
uuaaaccccgagauagugcugg

SEQ ID NO: 2061687 - RNA, 14 nt, Homo sapiens
cggcugugcuccug

SEQ ID NO: 2061688 - RNA, 17 nt, Homo sapiens
uauaggauagacacugg

SEQ ID NO: 2061689 - RNA, 13 nt, Homo sapiens
cauuauugucaac

SEQ ID NO: 2061690 - RNA, 22 nt, Homo sapiens
cacuagaauauuuaaaacauca

SEQ ID NO: 2061691 - RNA, 15 nt, Homo sapiens
cuguguggugcccau

SEQ ID NO: 2061692 - RNA, 15 nt, Homo sapiens
ugcccuggcugugau

SEQ ID NO: 2061693 - RNA, 16 nt, Homo sapiens
auugauuaaugaacua

SEQ ID NO: 2061694 - RNA, 20 nt, Homo sapiens
uuguuaggagaugucaucaa

SEQ ID NO: 2061695 - RNA, 17 nt, Homo sapiens
agccaucgcaucauguu

SEQ ID NO: 2061696 - RNA, 18 nt, Homo sapiens
gauugcuguguguugccu

SEQ ID NO: 2061697 - RNA, 18 nt, Homo sapiens
gcaaggccugguguuucu

SEQ ID NO: 2061698 - RNA, 16 nt, Homo sapiens
cauaaagguauuuaga

SEQ ID NO: 2061699 - RNA, 15 nt, Homo sapiens
gcccugaaggugcca

SEQ ID NO: 2061700 - RNA, 10 nt, Homo sapiens
acagauuuga

SEQ ID NO: 2061701 - RNA, 11 nt, Homo sapiens
uuuuguuccag

SEQ ID NO: 2061702 - RNA, 14 nt, Homo sapiens
aaauaauaacaauc

SEQ ID NO: 2061703 - RNA, 12 nt, Homo sapiens
ugugcugugacu

SEQ ID NO: 2061704 - RNA, 23 nt, Homo sapiens
agcuagagcuucauagguagugc

SEQ ID NO: 2061705 - RNA, 14 nt, Homo sapiens
aggaaacuacuuca

SEQ ID NO: 2061706 - RNA, 17 nt, Homo sapiens
acuuuaguuuguguuau

SEQ ID NO: 2061707 - RNA, 17 nt, Homo sapiens
auguuauauacaucuca

SEQ ID NO: 2061708 - RNA, 21 nt, Homo sapiens
cuccugauaaaacaacagcuc

SEQ ID NO: 2061709 - RNA, 17 nt, Homo sapiens
uggauuguuuauacucc

SEQ ID NO: 2061710 - RNA, 21 nt, Homo sapiens
aacucuucuuguaaaucacuu

SEQ ID NO: 2061711 - RNA, 17 nt, Homo sapiens
ucccagcagcccaagcu

SEQ ID NO: 2061712 - RNA, 22 nt, Homo sapiens
uucaagagacaguauugcuaac

SEQ ID NO: 2061713 - RNA, 17 nt, Homo sapiens
guaagagaacacaaucu

SEQ ID NO: 2061714 - RNA, 15 nt, Homo sapiens
aacugugcuccucac

SEQ ID NO: 2061715 - RNA, 10 nt, Homo sapiens
gcucuuccaa

SEQ ID NO: 2061716 - RNA, 19 nt, Homo sapiens
cugcagcucuccaccagcu

SEQ ID NO: 2061717 - RNA, 22 nt, Homo sapiens
ucggaagagagggcugagccau

SEQ ID NO: 2061718 - RNA, 17 nt, Homo sapiens
auucugaaucaagcaca

SEQ ID NO: 2061719 - RNA, 20 nt, Homo sapiens
uugucauuuuggucuaaggu

SEQ ID NO: 2061720 - RNA, 20 nt, Homo sapiens
gcugcggggggcaccagagg

SEQ ID NO: 2061721 - RNA, 18 nt, Homo sapiens
ugugaccaaaaguuacau

SEQ ID NO: 2061722 - RNA, 14 nt, Homo sapiens
ccagaaguguuuca

SEQ ID NO: 2061723 - RNA, 18 nt, Homo sapiens
ucccacuguuuaaggagu

SEQ ID NO: 2061724 - RNA, 23 nt, Homo sapiens
caccgagugccuucaacacagcu

SEQ ID NO: 2061725 - RNA, 18 nt, Homo sapiens
cacucagguucuucaggg

SEQ ID NO: 2061726 - RNA, 19 nt, Homo sapiens
aaagucagcuuuacuagug

SEQ ID NO: 2061727 - RNA, 13 nt, Homo sapiens
caagcauucugug

SEQ ID NO: 2061728 - RNA, 16 nt, Homo sapiens
uaggguccauaugagg

SEQ ID NO: 2061729 - RNA, 15 nt, Homo sapiens
acagauuuggaaaga

SEQ ID NO: 2061730 - RNA, 17 nt, Homo sapiens
ucugggacaaaacugga

SEQ ID NO: 2061731 - RNA, 14 nt, Homo sapiens
gccaccacauuuag

SEQ ID NO: 2061732 - RNA, 21 nt, Homo sapiens
ugugguuagcaagacugcaag

SEQ ID NO: 2061733 - RNA, 17 nt, Homo sapiens
acaauuaaacagccaaa

SEQ ID NO: 2061734 - RNA, 16 nt, Homo sapiens
auaaaugacauuauua

SEQ ID NO: 2061735 - RNA, 14 nt, Homo sapiens
ucuggacugcacac

SEQ ID NO: 2061736 - RNA, 13 nt, Homo sapiens
cauuuuacuauuu

SEQ ID NO: 2061737 - RNA, 21 nt, Homo sapiens
uagcguaacaaacaaaaucau

SEQ ID NO: 2061738 - RNA, 20 nt, Homo sapiens
aaacaucaaauaauugaaga

SEQ ID NO: 2061739 - RNA, 15 nt, Homo sapiens
ccuguguuacugauu

SEQ ID NO: 2061740 - RNA, 19 nt, Homo sapiens
acuugagccaguuaccuuu

SEQ ID NO: 2061741 - RNA, 22 nt, Homo sapiens
cuugucucaaaaaccauuacaa

SEQ ID NO: 2061742 - RNA, 14 nt, Homo sapiens
uauggcaagugaua

SEQ ID NO: 2061743 - RNA, 12 nt, Homo sapiens
caagacugagcc

SEQ ID NO: 2061744 - RNA, 14 nt, Homo sapiens
augaugaugaugau

SEQ ID NO: 2061745 - RNA, 16 nt, Homo sapiens
aauguaaaugaauuau

SEQ ID NO: 2061746 - RNA, 16 nt, Homo sapiens
ucucaucuaguuugau

SEQ ID NO: 2061747 - RNA, 20 nt, Homo sapiens
acaaguuccaguucugcaaa

SEQ ID NO: 2061748 - RNA, 15 nt, Homo sapiens
caggccaaagugccg

SEQ ID NO: 2061749 - RNA, 16 nt, Homo sapiens
auccauuccucuuacu

SEQ ID NO: 2061750 - RNA, 15 nt, Homo sapiens
cagaacacauggcug

SEQ ID NO: 2061751 - RNA, 22 nt, Homo sapiens
ugugucgggcucauuuugcuca

SEQ ID NO: 2061752 - RNA, 14 nt, Homo sapiens
cuggcucuacacau

SEQ ID NO: 2061753 - RNA, 21 nt, Homo sapiens
ugauaguuggggaauugugag

SEQ ID NO: 2061754 - RNA, 22 nt, Homo sapiens
uugucacuugggugccaaacau

SEQ ID NO: 2061755 - RNA, 14 nt, Homo sapiens
ucacggcugcgcac

SEQ ID NO: 2061756 - RNA, 22 nt, Homo sapiens
cuuucaguauuuguuuugaugu

SEQ ID NO: 2061757 - RNA, 20 nt, Homo sapiens
ggcucccagggccaugaacu

SEQ ID NO: 2061758 - RNA, 20 nt, Homo sapiens
cucaaacucuugaccucagg

SEQ ID NO: 2061759 - RNA, 16 nt, Homo sapiens
agguaguuaagggaug

SEQ ID NO: 2061760 - RNA, 21 nt, Homo sapiens
aaaugcuuuaaaaacuauuua

SEQ ID NO: 2061761 - RNA, 15 nt, Homo sapiens
aauuaaaccggacca

SEQ ID NO: 2061762 - RNA, 20 nt, Homo sapiens
aaugugaaacggaagcucau

SEQ ID NO: 2061763 - RNA, 19 nt, Homo sapiens
acuauaugaaaagagcaaa

SEQ ID NO: 2061764 - RNA, 14 nt, Homo sapiens
guuccuacacagga

SEQ ID NO: 2061765 - RNA, 23 nt, Homo sapiens
auuucugagagugaaaccaugac

SEQ ID NO: 2061766 - RNA, 16 nt, Homo sapiens
ugggcucagacaucca

SEQ ID NO: 2061767 - RNA, 17 nt, Homo sapiens
cucuccucuuugauguc

SEQ ID NO: 2061768 - RNA, 21 nt, Homo sapiens
gugcuucaaaugauccuuccu

SEQ ID NO: 2061769 - RNA, 14 nt, Homo sapiens
aagaaauaagcaug

SEQ ID NO: 2061770 - RNA, 19 nt, Homo sapiens
gugugugggaguguguaau

SEQ ID NO: 2061771 - RNA, 21 nt, Homo sapiens
ggaggcggcacauuggcagug

SEQ ID NO: 2061772 - RNA, 19 nt, Homo sapiens
cuugcauccaaaccuguaa

SEQ ID NO: 2061773 - RNA, 17 nt, Homo sapiens
uaaugucauggccuuga

SEQ ID NO: 2061774 - RNA, 16 nt, Homo sapiens
aauauauaugaugaaa

SEQ ID NO: 2061775 - RNA, 22 nt, Homo sapiens
guggcucacgucuguaauccca

SEQ ID NO: 2061776 - RNA, 18 nt, Homo sapiens
acuuauuaggacuuugaa

SEQ ID NO: 2061777 - RNA, 15 nt, Homo sapiens
gcccuccucugucaa

SEQ ID NO: 2061778 - RNA, 18 nt, Homo sapiens
acaccacaggaucugaac

SEQ ID NO: 2061779 - RNA, 19 nt, Homo sapiens
aggagccggacacuucuca

SEQ ID NO: 2061780 - RNA, 20 nt, Homo sapiens
uaucaaacguguuauauucc

SEQ ID NO: 2061781 - RNA, 16 nt, Homo sapiens
uauuaggguacuuuau

SEQ ID NO: 2061782 - RNA, 16 nt, Homo sapiens
aguuagguagcuuuag

SEQ ID NO: 2061783 - RNA, 17 nt, Homo sapiens
gcccaacccuaucccag

SEQ ID NO: 2061784 - RNA, 15 nt, Homo sapiens
uugccuuaaccaguc

SEQ ID NO: 2061785 - RNA, 17 nt, Homo sapiens
uucagugggaccaauga

SEQ ID NO: 2061786 - RNA, 17 nt, Homo sapiens
uugugagggacugagau

SEQ ID NO: 2061787 - RNA, 17 nt, Homo sapiens
uugaaccugucaccugg

SEQ ID NO: 2061788 - RNA, 19 nt, Homo sapiens
ggccuccauccucaucucu

SEQ ID NO: 2061789 - RNA, 21 nt, Homo sapiens
aguaucugagauuacagagau

SEQ ID NO: 2061790 - RNA, 17 nt, Homo sapiens
cucugccuacccacgug

SEQ ID NO: 2061791 - RNA, 22 nt, Homo sapiens
aaagcugugggacgaaagcaca

SEQ ID NO: 2061792 - RNA, 20 nt, Homo sapiens
uucguucugcugaccaaaug

SEQ ID NO: 2061793 - RNA, 15 nt, Homo sapiens
accccucauccaaag

SEQ ID NO: 2061794 - RNA, 14 nt, Homo sapiens
aaacuaaacuaaaa

SEQ ID NO: 2061795 - RNA, 14 nt, Homo sapiens
auacucaacaaaac

SEQ ID NO: 2061796 - RNA, 18 nt, Homo sapiens
ugaaguacaauaauucau

SEQ ID NO: 2061797 - RNA, 14 nt, Homo sapiens
uagaguuugaucau

SEQ ID NO: 2061798 - RNA, 14 nt, Homo sapiens
uuccacacauuucc

SEQ ID NO: 2061799 - RNA, 14 nt, Homo sapiens
agcuccacugucac

SEQ ID NO: 2061800 - RNA, 22 nt, Homo sapiens
aaucaaguuggcuucuaaucaa

SEQ ID NO: 2061801 - RNA, 19 nt, Homo sapiens
agauuccaaaaagcacaua

SEQ ID NO: 2061802 - RNA, 15 nt, Homo sapiens
gaaucugaacugcuc

SEQ ID NO: 2061803 - RNA, 23 nt, Homo sapiens
cccagauccucugcugacuccau

SEQ ID NO: 2061804 - RNA, 15 nt, Homo sapiens
auacucucuccacuu

SEQ ID NO: 2061805 - RNA, 17 nt, Homo sapiens
cacacaucccagcccaa

SEQ ID NO: 2061806 - RNA, 17 nt, Homo sapiens
ggauccagagcaauuuc

SEQ ID NO: 2061807 - RNA, 21 nt, Homo sapiens
aaugaugguuuaauagguaaa

SEQ ID NO: 2061808 - RNA, 15 nt, Homo sapiens
aacuuuauucaagua

SEQ ID NO: 2061809 - RNA, 16 nt, Homo sapiens
auggauccccagugaa

SEQ ID NO: 2061810 - RNA, 16 nt, Homo sapiens
ccuuuugagugccuua

SEQ ID NO: 2061811 - RNA, 23 nt, Homo sapiens
gaaauacacagugcugaccagac

SEQ ID NO: 2061812 - RNA, 20 nt, Homo sapiens
agaaaaaggacucugcuuca

SEQ ID NO: 2061813 - RNA, 13 nt, Homo sapiens
ugguuaacagagc

SEQ ID NO: 2061814 - RNA, 17 nt, Homo sapiens
gaaguguaacucaccag

SEQ ID NO: 2061815 - RNA, 19 nt, Homo sapiens
accaucucuccaacucaac

SEQ ID NO: 2061816 - RNA, 15 nt, Homo sapiens
auguaucuaaaugaa

SEQ ID NO: 2061817 - RNA, 14 nt, Homo sapiens
guauaaauaaccaa

SEQ ID NO: 2061818 - RNA, 23 nt, Homo sapiens
cuaauuuugugcucuuuccugcc

SEQ ID NO: 2061819 - RNA, 16 nt, Homo sapiens
aaacacagucacuguu

SEQ ID NO: 2061820 - RNA, 18 nt, Homo sapiens
cuucaaugcugcaggaug

SEQ ID NO: 2061821 - RNA, 12 nt, Homo sapiens
uuccaguaggaa

SEQ ID NO: 2061822 - RNA, 17 nt, Homo sapiens
ucuuacauaugauccag

SEQ ID NO: 2061823 - RNA, 13 nt, Homo sapiens
uggagaucaccag

SEQ ID NO: 2061824 - RNA, 20 nt, Homo sapiens
uuucuccaucaguucaccuu

SEQ ID NO: 2061825 - RNA, 20 nt, Homo sapiens
caagauugcaccacugcucu

SEQ ID NO: 2061826 - RNA, 23 nt, Homo sapiens
ucauuuaaaaagcucacugcuga

SEQ ID NO: 2061827 - RNA, 18 nt, Homo sapiens
aagcaagaagaaagccau

SEQ ID NO: 2061828 - RNA, 19 nt, Homo sapiens
cuuucuaaggauagccuuu

SEQ ID NO: 2061829 - RNA, 17 nt, Homo sapiens
cuccaauacagcaaacc

SEQ ID NO: 2061830 - RNA, 15 nt, Homo sapiens
aauccuuaucccaag

SEQ ID NO: 2061831 - RNA, 14 nt, Homo sapiens
auaccuacugcuga

SEQ ID NO: 2061832 - RNA, 23 nt, Homo sapiens
agagauccacccccaagcacucc

SEQ ID NO: 2061833 - RNA, 15 nt, Homo sapiens
ucuggaaggacaucu

SEQ ID NO: 2061834 - RNA, 20 nt, Homo sapiens
uggcuuuggaagccauguga

SEQ ID NO: 2061835 - RNA, 18 nt, Homo sapiens
ugacuuuaaaaggauuaa

SEQ ID NO: 2061836 - RNA, 13 nt, Homo sapiens
acaaacuaaaaau

SEQ ID NO: 2061837 - RNA, 17 nt, Homo sapiens
uuaagcaaaggaaacca

SEQ ID NO: 2061838 - RNA, 15 nt, Homo sapiens
ugcugggaaguggcu

SEQ ID NO: 2061839 - RNA, 18 nt, Homo sapiens
caaaaaaaaaccaugcau

SEQ ID NO: 2061840 - RNA, 23 nt, Homo sapiens
gacauguucccuucuccuuccaa

SEQ ID NO: 2061841 - RNA, 21 nt, Homo sapiens
uacauguucuugucauaaaau

SEQ ID NO: 2061842 - RNA, 14 nt, Homo sapiens
uaaugugccaaaau

SEQ ID NO: 2061843 - RNA, 17 nt, Homo sapiens
gauggccaugcccucca

SEQ ID NO: 2061844 - RNA, 15 nt, Homo sapiens
gcucucucucaccau

SEQ ID NO: 2061845 - RNA, 13 nt, Homo sapiens
cuauucagcaaaa

SEQ ID NO: 2061846 - RNA, 17 nt, Homo sapiens
aggaaaaaauuaauacu

SEQ ID NO: 2061847 - RNA, 22 nt, Homo sapiens
uucaauggcaccuucauucucc

SEQ ID NO: 2061848 - RNA, 21 nt, Homo sapiens
ucucgaccggcccugcauucu

SEQ ID NO: 2061849 - RNA, 18 nt, Homo sapiens
gacaucaagcucaaggca

SEQ ID NO: 2061850 - RNA, 23 nt, Homo sapiens
caguuccauuucauuugugccag

SEQ ID NO: 2061851 - RNA, 18 nt, Homo sapiens
ugucucagaccacuauuc

SEQ ID NO: 2061852 - RNA, 18 nt, Homo sapiens
ugucuuaguacaccauaa

SEQ ID NO: 2061853 - RNA, 14 nt, Homo sapiens
acacaaagacaugg

SEQ ID NO: 2061854 - RNA, 14 nt, Homo sapiens
ccaugaagccacag

SEQ ID NO: 2061855 - RNA, 18 nt, Homo sapiens
cagugggugugacauauu

SEQ ID NO: 2061856 - RNA, 13 nt, Homo sapiens
ugucauccagaaa

SEQ ID NO: 2061857 - RNA, 21 nt, Homo sapiens
aauucugggaagcaaaaccca

SEQ ID NO: 2061858 - RNA, 16 nt, Homo sapiens
ccacugcaugggcugu

SEQ ID NO: 2061859 - RNA, 20 nt, Homo sapiens
agaugaacaucucuguuauu

SEQ ID NO: 2061860 - RNA, 23 nt, Homo sapiens
ggagcugggcccugccugcagcc

SEQ ID NO: 2061861 - RNA, 22 nt, Homo sapiens
aggggccaucacaggaugccag

SEQ ID NO: 2061862 - RNA, 16 nt, Homo sapiens
cuggggccugugcacu

SEQ ID NO: 2061863 - RNA, 18 nt, Homo sapiens
acagucugagacuccuca

SEQ ID NO: 2061864 - RNA, 16 nt, Homo sapiens
agauggcaagugcacc

SEQ ID NO: 2061865 - RNA, 14 nt, Homo sapiens
cacaggacucugca

SEQ ID NO: 2061866 - RNA, 22 nt, Homo sapiens
uaauauccacuuguccauguga

SEQ ID NO: 2061867 - RNA, 22 nt, Homo sapiens
gauuagagaccagaucagauaa

SEQ ID NO: 2061868 - RNA, 12 nt, Homo sapiens
uuucagggcugg

SEQ ID NO: 2061869 - RNA, 14 nt, Homo sapiens
auaaagauacauga

SEQ ID NO: 2061870 - RNA, 17 nt, Homo sapiens
agcuauuuuaagccauc

SEQ ID NO: 2061871 - RNA, 19 nt, Homo sapiens
caccaacuugccacauguu

SEQ ID NO: 2061872 - RNA, 20 nt, Homo sapiens
uugcaugaaagacagaacau

SEQ ID NO: 2061873 - RNA, 15 nt, Homo sapiens
acaccucccuacucc

SEQ ID NO: 2061874 - RNA, 17 nt, Homo sapiens
uaauaaauacucaguga

SEQ ID NO: 2061875 - RNA, 14 nt, Homo sapiens
augagacugcccug

SEQ ID NO: 2061876 - RNA, 15 nt, Homo sapiens
agggacauguggaaa

SEQ ID NO: 2061877 - RNA, 15 nt, Homo sapiens
aggaaaaugugaaca

SEQ ID NO: 2061878 - RNA, 16 nt, Homo sapiens
aguggaguuggugaau

SEQ ID NO: 2061879 - RNA, 16 nt, Homo sapiens
uugugagugugugcac

SEQ ID NO: 2061880 - RNA, 16 nt, Homo sapiens
agaaauauauauacau

SEQ ID NO: 2061881 - RNA, 16 nt, Homo sapiens
caucaacuccagucuc

SEQ ID NO: 2061882 - RNA, 15 nt, Homo sapiens
ucugcuguggucuga

SEQ ID NO: 2061883 - RNA, 11 nt, Homo sapiens
caguccacugc

SEQ ID NO: 2061884 - RNA, 15 nt, Homo sapiens
ucagacgagcaguga

SEQ ID NO: 2061885 - RNA, 19 nt, Homo sapiens
cagagugagggaaugguag

SEQ ID NO: 2061886 - RNA, 23 nt, Homo sapiens
acgaccgccccaguuccuguggc

SEQ ID NO: 2061887 - RNA, 14 nt, Homo sapiens
ucauacuagaauuc

SEQ ID NO: 2061888 - RNA, 20 nt, Homo sapiens
cuacuuccccuucuugccau

SEQ ID NO: 2061889 - RNA, 16 nt, Homo sapiens
gcucuucaccaggaag

SEQ ID NO: 2061890 - RNA, 17 nt, Homo sapiens
gcaagugaacucauccc

SEQ ID NO: 2061891 - RNA, 19 nt, Homo sapiens
uccuaaugaaugcauaaaa

SEQ ID NO: 2061892 - RNA, 18 nt, Homo sapiens
uugaaacauacagaaugu

SEQ ID NO: 2061893 - RNA, 22 nt, Homo sapiens
acauguggcacguaaggucuca

SEQ ID NO: 2061894 - RNA, 21 nt, Homo sapiens
agauugcugaaaaaguagauu

SEQ ID NO: 2061895 - RNA, 17 nt, Homo sapiens
aaaacucuuuggugcac

SEQ ID NO: 2061896 - RNA, 13 nt, Homo sapiens
ccacucuaccuga

SEQ ID NO: 2061897 - RNA, 13 nt, Homo sapiens
auuaaaagcccua

SEQ ID NO: 2061898 - RNA, 15 nt, Homo sapiens
agcugacucauucuu

SEQ ID NO: 2061899 - RNA, 16 nt, Homo sapiens
gggcgaguucugccag

SEQ ID NO: 2061900 - RNA, 14 nt, Homo sapiens
ccaguaacuuuucu

SEQ ID NO: 2061901 - RNA, 18 nt, Homo sapiens
cccuguuuccaaugccaa

SEQ ID NO: 2061902 - RNA, 22 nt, Homo sapiens
gggaagcucccacacccaccuc

SEQ ID NO: 2061903 - RNA, 20 nt, Homo sapiens
caguguuauuaaugacaaag

SEQ ID NO: 2061904 - RNA, 19 nt, Homo sapiens
cagcuaacaaguagcacac

SEQ ID NO: 2061905 - RNA, 23 nt, Homo sapiens
ucagucuacaaacugaacacugc

SEQ ID NO: 2061906 - RNA, 17 nt, Homo sapiens
gcucagagcugcugagc

SEQ ID NO: 2061907 - RNA, 22 nt, Homo sapiens
ugccccaugacuugaugcaguu

SEQ ID NO: 2061908 - RNA, 16 nt, Homo sapiens
gcaaccacacaccuca

SEQ ID NO: 2061909 - RNA, 16 nt, Homo sapiens
cuucugaggaugcuga

SEQ ID NO: 2061910 - RNA, 14 nt, Homo sapiens
ugaauggaagcaaa

SEQ ID NO: 2061911 - RNA, 16 nt, Homo sapiens
ugcaggcggggcuccu

SEQ ID NO: 2061912 - RNA, 17 nt, Homo sapiens
agugagcuccuaagcca

SEQ ID NO: 2061913 - RNA, 14 nt, Homo sapiens
gucaaggccaccuc

SEQ ID NO: 2061914 - RNA, 14 nt, Homo sapiens
cgccagcugaugac

SEQ ID NO: 2061915 - RNA, 17 nt, Homo sapiens
auugaaaggcauucucu

SEQ ID NO: 2061916 - RNA, 20 nt, Homo sapiens
agcccuuucagcugcagcug

SEQ ID NO: 2061917 - RNA, 16 nt, Homo sapiens
cuugagugugugaaca

SEQ ID NO: 2061918 - RNA, 13 nt, Homo sapiens
aaccaccccaucu

SEQ ID NO: 2061919 - RNA, 15 nt, Homo sapiens
ccuuaauaaacucac

SEQ ID NO: 2061920 - RNA, 15 nt, Homo sapiens
caccauuaacuccuc

SEQ ID NO: 2061921 - RNA, 23 nt, Homo sapiens
aucacaugaauauaaaugggaaa

SEQ ID NO: 2061922 - RNA, 15 nt, Homo sapiens
guuauuuacacuggu

SEQ ID NO: 2061923 - RNA, 19 nt, Homo sapiens
cagaaugagccagaguuca

SEQ ID NO: 2061924 - RNA, 15 nt, Homo sapiens
acgugggguggaauu

SEQ ID NO: 2061925 - RNA, 21 nt, Homo sapiens
uucaaagaacccuagcacaaa

SEQ ID NO: 2061926 - RNA, 15 nt, Homo sapiens
auaaauaauucuucc

SEQ ID NO: 2061927 - RNA, 20 nt, Homo sapiens
uccuuacaacugcucuagau

SEQ ID NO: 2061928 - RNA, 21 nt, Homo sapiens
cccugagacagacacacagcc

SEQ ID NO: 2061929 - RNA, 18 nt, Homo sapiens
ggagcaaaucgugccuug

SEQ ID NO: 2061930 - RNA, 16 nt, Homo sapiens
aaagucauaauugcau

SEQ ID NO: 2061931 - RNA, 16 nt, Homo sapiens
acaggacaacuuuaca

SEQ ID NO: 2061932 - RNA, 15 nt, Homo sapiens
uaagaagcucuggcc

SEQ ID NO: 2061933 - RNA, 21 nt, Homo sapiens
uggugaacaguguauaggaag

SEQ ID NO: 2061934 - RNA, 12 nt, Homo sapiens
uaccguagcuuu

SEQ ID NO: 2061935 - RNA, 14 nt, Homo sapiens
guuaaugcagggac

SEQ ID NO: 2061936 - RNA, 22 nt, Homo sapiens
gaguaggugggggaacacugag

SEQ ID NO: 2061937 - RNA, 13 nt, Homo sapiens
gugagcaggguga

SEQ ID NO: 2061938 - RNA, 15 nt, Homo sapiens
agaucuacacauguu

SEQ ID NO: 2061939 - RNA, 15 nt, Homo sapiens
ugcagcucuccacca

SEQ ID NO: 2061940 - RNA, 15 nt, Homo sapiens
acagccucagaggca

SEQ ID NO: 2061941 - RNA, 19 nt, Homo sapiens
caggugguaagcaccagga

SEQ ID NO: 2061942 - RNA, 13 nt, Homo sapiens
uuucaaccagcau

SEQ ID NO: 2061943 - RNA, 14 nt, Homo sapiens
agacugauagacac

SEQ ID NO: 2061944 - RNA, 16 nt, Homo sapiens
ucaacaguucaaagaa

SEQ ID NO: 2061945 - RNA, 15 nt, Homo sapiens
auuaaggacauuuag

SEQ ID NO: 2061946 - RNA, 18 nt, Homo sapiens
guucaaaaccuugcacag

SEQ ID NO: 2061947 - RNA, 16 nt, Homo sapiens
cacagauuugagcuca

SEQ ID NO: 2061948 - RNA, 14 nt, Homo sapiens
cuucugaacuugga

SEQ ID NO: 2061949 - RNA, 21 nt, Homo sapiens
uuucacacguaagcacauucg

SEQ ID NO: 2061950 - RNA, 17 nt, Homo sapiens
cucccagguggauuuug

SEQ ID NO: 2061951 - RNA, 19 nt, Homo sapiens
agggcagccaccaggagag

SEQ ID NO: 2061952 - RNA, 17 nt, Homo sapiens
auaguuuuacauuaaca

SEQ ID NO: 2061953 - RNA, 22 nt, Homo sapiens
ggguucuuauuuugcauuccag

SEQ ID NO: 2061954 - RNA, 18 nt, Homo sapiens
agccacauugagacuuuc

SEQ ID NO: 2061955 - RNA, 18 nt, Homo sapiens
cugccuuuaagccaaaga

SEQ ID NO: 2061956 - RNA, 21 nt, Homo sapiens
caacauggcaaaaccccaucu

SEQ ID NO: 2061957 - RNA, 18 nt, Homo sapiens
aggagacccaacaaugag

SEQ ID NO: 2061958 - RNA, 19 nt, Homo sapiens
ccuacuuccucugcaaaaa

SEQ ID NO: 2061959 - RNA, 15 nt, Homo sapiens
acacacauaugucau

SEQ ID NO: 2061960 - RNA, 19 nt, Homo sapiens
ugauuuauuaaauaaucuc

SEQ ID NO: 2061961 - RNA, 12 nt, Homo sapiens
ucagaaagggau

SEQ ID NO: 2061962 - RNA, 15 nt, Homo sapiens
ccucgugucagcuca

SEQ ID NO: 2061963 - RNA, 22 nt, Homo sapiens
ugcucacccaggaccucugggg

SEQ ID NO: 2061964 - RNA, 13 nt, Homo sapiens
ccucuugcugucu

SEQ ID NO: 2061965 - RNA, 20 nt, Homo sapiens
cugacccuccuccacuccac

SEQ ID NO: 2061966 - RNA, 17 nt, Homo sapiens
auaguucacuccauuug

SEQ ID NO: 2061967 - RNA, 16 nt, Homo sapiens
aauacacuaauuccuu

SEQ ID NO: 2061968 - RNA, 21 nt, Homo sapiens
ugaaaaaaauaaauuuacuga

SEQ ID NO: 2061969 - RNA, 16 nt, Homo sapiens
ugguucuccuuccuca

SEQ ID NO: 2061970 - RNA, 18 nt, Homo sapiens
uggguacccaaaacacau

SEQ ID NO: 2061971 - RNA, 15 nt, Homo sapiens
uccuuucccacccac

SEQ ID NO: 2061972 - RNA, 13 nt, Homo sapiens
auuccgcacuggg

SEQ ID NO: 2061973 - RNA, 22 nt, Homo sapiens
cacagacagguuuucacauaaa

SEQ ID NO: 2061974 - RNA, 17 nt, Homo sapiens
caacuuccaaaggguua

SEQ ID NO: 2061975 - RNA, 14 nt, Homo sapiens
uccaugucucugag

SEQ ID NO: 2061976 - RNA, 15 nt, Homo sapiens
cuccucccugucaua

SEQ ID NO: 2061977 - RNA, 14 nt, Homo sapiens
ccucacaagcauga

SEQ ID NO: 2061978 - RNA, 22 nt, Homo sapiens
uuuaaauaauauccaccucucc

SEQ ID NO: 2061979 - RNA, 18 nt, Homo sapiens
caggacugugaccaaagc

SEQ ID NO: 2061980 - RNA, 24 nt, Homo sapiens
ccccagaaccagcugcagauggag

SEQ ID NO: 2061981 - RNA, 16 nt, Homo sapiens
caaaucagaaaaccca

SEQ ID NO: 2061982 - RNA, 14 nt, Homo sapiens
aauauaagaaucau

SEQ ID NO: 2061983 - RNA, 11 nt, Homo sapiens
agcaagggcag

SEQ ID NO: 2061984 - RNA, 16 nt, Homo sapiens
cugccaugcauacaug

SEQ ID NO: 2061985 - RNA, 19 nt, Homo sapiens
aauaucauuaaauuggaau

SEQ ID NO: 2061986 - RNA, 18 nt, Homo sapiens
accugagauggagcugcc

SEQ ID NO: 2061987 - RNA, 21 nt, Homo sapiens
uucuucagagaucauggaaca

SEQ ID NO: 2061988 - RNA, 20 nt, Homo sapiens
agaaacacuaaagcauucaa

SEQ ID NO: 2061989 - RNA, 18 nt, Homo sapiens
augacauuucaucugggu

SEQ ID NO: 2061990 - RNA, 17 nt, Homo sapiens
uuuaaugauaacuaaaa

SEQ ID NO: 2061991 - RNA, 11 nt, Homo sapiens
gcacaguauuu

SEQ ID NO: 2061992 - RNA, 14 nt, Homo sapiens
cagaucuaugccac

SEQ ID NO: 2061993 - RNA, 15 nt, Homo sapiens
uccauggcaaauggg

SEQ ID NO: 2061994 - RNA, 16 nt, Homo sapiens
uauuugaaaaauugcc

SEQ ID NO: 2061995 - RNA, 17 nt, Homo sapiens
guuugucauggugaaau

SEQ ID NO: 2061996 - RNA, 22 nt, Homo sapiens
gacagagcaagaccccaucuca

SEQ ID NO: 2061997 - RNA, 17 nt, Homo sapiens
ucacuuuggccucccaa

SEQ ID NO: 2061998 - RNA, 18 nt, Homo sapiens
aggaagaaaagcugccau

SEQ ID NO: 2061999 - RNA, 17 nt, Homo sapiens
aaguuucuggugccauu

SEQ ID NO: 2062000 - RNA, 17 nt, Homo sapiens
agaccauccuggacuga

SEQ ID NO: 2062001 - RNA, 21 nt, Homo sapiens
uugagccccugaggacagggg

SEQ ID NO: 2062002 - RNA, 17 nt, Homo sapiens
acacagggcccggccac

SEQ ID NO: 2062003 - RNA, 18 nt, Homo sapiens
cuucacugucaugugcga

SEQ ID NO: 2062004 - RNA, 20 nt, Homo sapiens
ugaaacuauuuuaccugaac

SEQ ID NO: 2062005 - RNA, 14 nt, Homo sapiens
caagcuauucucau

SEQ ID NO: 2062006 - RNA, 20 nt, Homo sapiens
gaggaaaggccagcuggcag

SEQ ID NO: 2062007 - RNA, 15 nt, Homo sapiens
aucuuauuuucucaa

SEQ ID NO: 2062008 - RNA, 15 nt, Homo sapiens
uugaagucuuguaua

SEQ ID NO: 2062009 - RNA, 23 nt, Homo sapiens
cuggcgacagagggagacuccau

SEQ ID NO: 2062010 - RNA, 15 nt, Homo sapiens
gaaguggagucucau

SEQ ID NO: 2062011 - RNA, 24 nt, Homo sapiens
gagccgcugcugagcugcgugcca

SEQ ID NO: 2062012 - RNA, 20 nt, Homo sapiens
ugaaauuauguauguuuaca

SEQ ID NO: 2062013 - RNA, 16 nt, Homo sapiens
aacuccugaccucagg

SEQ ID NO: 2062014 - RNA, 20 nt, Homo sapiens
uaccaugaggcuugugugaa

SEQ ID NO: 2062015 - RNA, 13 nt, Homo sapiens
gagcaucaugccu

SEQ ID NO: 2062016 - RNA, 16 nt, Homo sapiens
guagguuucucucuuc

SEQ ID NO: 2062017 - RNA, 17 nt, Homo sapiens
ucacuccaaaccuuacu

SEQ ID NO: 2062018 - RNA, 17 nt, Homo sapiens
ugcuccaagggacaggu

SEQ ID NO: 2062019 - RNA, 15 nt, Homo sapiens
cugaauaaaauugau

SEQ ID NO: 2062020 - RNA, 12 nt, Homo sapiens
gcuuuucuugcc

SEQ ID NO: 2062021 - RNA, 12 nt, Homo sapiens
ugcuuucugcuc

SEQ ID NO: 2062022 - RNA, 17 nt, Homo sapiens
uauuauuggcuugcacu

SEQ ID NO: 2062023 - RNA, 17 nt, Homo sapiens
acacauacagagcucuc

SEQ ID NO: 2062024 - RNA, 21 nt, Homo sapiens
uuuguuugccaggacaugcaa

SEQ ID NO: 2062025 - RNA, 20 nt, Homo sapiens
gcaaaauaauaagaaggaaa

SEQ ID NO: 2062026 - RNA, 13 nt, Homo sapiens
gcacccuacaggg

SEQ ID NO: 2062027 - RNA, 12 nt, Homo sapiens
gaaugugucuuu

SEQ ID NO: 2062028 - RNA, 16 nt, Homo sapiens
ccuguccccacccucc

SEQ ID NO: 2062029 - RNA, 18 nt, Homo sapiens
gagccuucaagugccaaa

SEQ ID NO: 2062030 - RNA, 21 nt, Homo sapiens
uauugacugggcaacacugca

SEQ ID NO: 2062031 - RNA, 18 nt, Homo sapiens
ucuuuaacauacaucuaa

SEQ ID NO: 2062032 - RNA, 17 nt, Homo sapiens
aguccagcucagucuca

SEQ ID NO: 2062033 - RNA, 13 nt, Homo sapiens
caaugauaugcaa

SEQ ID NO: 2062034 - RNA, 14 nt, Homo sapiens
cacccacccaggag

SEQ ID NO: 2062035 - RNA, 14 nt, Homo sapiens
ugccugacucugug

SEQ ID NO: 2062036 - RNA, 16 nt, Homo sapiens
cuccaaacuaaacccu

SEQ ID NO: 2062037 - RNA, 22 nt, Homo sapiens
ugaucagaguuccuccuacuua

SEQ ID NO: 2062038 - RNA, 16 nt, Homo sapiens
ccuuagguucuuucug

SEQ ID NO: 2062039 - RNA, 17 nt, Homo sapiens
cucacugcaaccuccac

SEQ ID NO: 2062040 - RNA, 20 nt, Homo sapiens
cugguauuguuuacguuuga

SEQ ID NO: 2062041 - RNA, 19 nt, Homo sapiens
uagagacgggguuucucca

SEQ ID NO: 2062042 - RNA, 23 nt, Homo sapiens
aaggaagaaauuccaggaaaauc

SEQ ID NO: 2062043 - RNA, 15 nt, Homo sapiens
gcaguggugucucug

SEQ ID NO: 2062044 - RNA, 20 nt, Homo sapiens
ugagauuccuguaaauguga

SEQ ID NO: 2062045 - RNA, 15 nt, Homo sapiens
ucaggagcagccuca

SEQ ID NO: 2062046 - RNA, 14 nt, Homo sapiens
cugggcaacacagc

SEQ ID NO: 2062047 - RNA, 21 nt, Homo sapiens
caguaacauuuuucucagugc

SEQ ID NO: 2062048 - RNA, 17 nt, Homo sapiens
auuucaacuacagugau

SEQ ID NO: 2062049 - RNA, 18 nt, Homo sapiens
ugugguggccucagcuga

SEQ ID NO: 2062050 - RNA, 15 nt, Homo sapiens
cacacacuuccauau

SEQ ID NO: 2062051 - RNA, 18 nt, Homo sapiens
uaugagaauauaccuuau

SEQ ID NO: 2062052 - RNA, 14 nt, Homo sapiens
ugccuuuuauguaa

SEQ ID NO: 2062053 - RNA, 11 nt, Homo sapiens
uguagugaaau

SEQ ID NO: 2062054 - RNA, 16 nt, Homo sapiens
accauugucagcucaa

SEQ ID NO: 2062055 - RNA, 13 nt, Homo sapiens
uagguuggcagua

SEQ ID NO: 2062056 - RNA, 13 nt, Homo sapiens
caacuuucuguaa

SEQ ID NO: 2062057 - RNA, 22 nt, Homo sapiens
gaacccuccuuuucucugagau

SEQ ID NO: 2062058 - RNA, 22 nt, Homo sapiens
aaguuagggaauggcacagccc

SEQ ID NO: 2062059 - RNA, 12 nt, Homo sapiens
aagcuucuugcu

SEQ ID NO: 2062060 - RNA, 22 nt, Homo sapiens
aaggccucuuguugagugccag

SEQ ID NO: 2062061 - RNA, 14 nt, Homo sapiens
gguggaagccucag

SEQ ID NO: 2062062 - RNA, 18 nt, Homo sapiens
agaggccaugucuccugc

SEQ ID NO: 2062063 - RNA, 18 nt, Homo sapiens
auuaagagcaaacuuuag

SEQ ID NO: 2062064 - RNA, 16 nt, Homo sapiens
auuuugcaucugaccc

SEQ ID NO: 2062065 - RNA, 19 nt, Homo sapiens
agcacuaaccaaugccuuu

SEQ ID NO: 2062066 - RNA, 14 nt, Homo sapiens
ugcagucacauuga

SEQ ID NO: 2062067 - RNA, 17 nt, Homo sapiens
acaacugacuaaccauu

SEQ ID NO: 2062068 - RNA, 16 nt, Homo sapiens
caauaaaguuugccca

SEQ ID NO: 2062069 - RNA, 15 nt, Homo sapiens
gaucccuuccuuccu

SEQ ID NO: 2062070 - RNA, 17 nt, Homo sapiens
cagcucucucuccugga

SEQ ID NO: 2062071 - RNA, 12 nt, Homo sapiens
agcucaccagcc

SEQ ID NO: 2062072 - RNA, 19 nt, Homo sapiens
gauauggacacuggugcca

SEQ ID NO: 2062073 - RNA, 22 nt, Homo sapiens
ugaagguaauacuauaaauaua

SEQ ID NO: 2062074 - RNA, 17 nt, Homo sapiens
cgcucaccucagagcag

SEQ ID NO: 2062075 - RNA, 16 nt, Homo sapiens
uauggauuuaauacca

SEQ ID NO: 2062076 - RNA, 14 nt, Homo sapiens
ccuauccacccucu

SEQ ID NO: 2062077 - RNA, 21 nt, Homo sapiens
gcuuuacccacuaacugggag

SEQ ID NO: 2062078 - RNA, 14 nt, Homo sapiens
gugagaaaagaaua

SEQ ID NO: 2062079 - RNA, 13 nt, Homo sapiens
ucccuauuagaua

SEQ ID NO: 2062080 - RNA, 21 nt, Homo sapiens
ugaucgcgccacuacacucca

SEQ ID NO: 2062081 - RNA, 17 nt, Homo sapiens
aaauaaaaccaccaaag

SEQ ID NO: 2062082 - RNA, 21 nt, Homo sapiens
acguguggaugagcgugcacu

SEQ ID NO: 2062083 - RNA, 15 nt, Homo sapiens
aagaauuccaaagca

SEQ ID NO: 2062084 - RNA, 22 nt, Homo sapiens
cugcuauaugccuuaagccaau

SEQ ID NO: 2062085 - RNA, 16 nt, Homo sapiens
cuccggcgucuugccc

SEQ ID NO: 2062086 - RNA, 21 nt, Homo sapiens
gagcaaccccuguacccagcu

SEQ ID NO: 2062087 - RNA, 22 nt, Homo sapiens
gaaauggccauugagcuguuuc

SEQ ID NO: 2062088 - RNA, 21 nt, Homo sapiens
uaacaggguggcccccugugc

SEQ ID NO: 2062089 - RNA, 13 nt, Homo sapiens
ugccucuggaugc

SEQ ID NO: 2062090 - RNA, 12 nt, Homo sapiens
cccuuuuacuuu

SEQ ID NO: 2062091 - RNA, 17 nt, Homo sapiens
ccacagcuggcucugac

SEQ ID NO: 2062092 - RNA, 13 nt, Homo sapiens
gguguucuuccca

SEQ ID NO: 2062093 - RNA, 14 nt, Homo sapiens
aauauauacucaag

SEQ ID NO: 2062094 - RNA, 16 nt, Homo sapiens
cucuugaagacacuga

SEQ ID NO: 2062095 - RNA, 14 nt, Homo sapiens
accuuuacauauua

SEQ ID NO: 2062096 - RNA, 16 nt, Homo sapiens
aacugcacaaauugua

SEQ ID NO: 2062097 - RNA, 20 nt, Homo sapiens
ugacugaagggacuagcuau

SEQ ID NO: 2062098 - RNA, 20 nt, Homo sapiens
agugucaccuugguuugcaa

SEQ ID NO: 2062099 - RNA, 18 nt, Homo sapiens
acugucaagcugcugaaa

SEQ ID NO: 2062100 - RNA, 21 nt, Homo sapiens
agcuuugaaugcagaagcaaa

SEQ ID NO: 2062101 - RNA, 15 nt, Homo sapiens
ugcacucacuccuga

SEQ ID NO: 2062102 - RNA, 20 nt, Homo sapiens
cuagauuacaucugccuuaa

SEQ ID NO: 2062103 - RNA, 20 nt, Homo sapiens
aagcuagauaugccuuaaaa

SEQ ID NO: 2062104 - RNA, 17 nt, Homo sapiens
agcucuugaccaaguau

SEQ ID NO: 2062105 - RNA, 15 nt, Homo sapiens
acucucuuccuuuca

SEQ ID NO: 2062106 - RNA, 18 nt, Homo sapiens
aaagauagcauuggggac

SEQ ID NO: 2062107 - RNA, 15 nt, Homo sapiens
ucucccuuccuggca

SEQ ID NO: 2062108 - RNA, 17 nt, Homo sapiens
acuggguuuucagcaua

SEQ ID NO: 2062109 - RNA, 20 nt, Homo sapiens
ugguguggccagcacucuga

SEQ ID NO: 2062110 - RNA, 21 nt, Homo sapiens
ccagagauuauaaguuugaca

SEQ ID NO: 2062111 - RNA, 15 nt, Homo sapiens
ccccaccaccugguu

SEQ ID NO: 2062112 - RNA, 19 nt, Homo sapiens
gccaugggagguccuggcu

SEQ ID NO: 2062113 - RNA, 23 nt, Homo sapiens
cuaaugccugcggaguugugcac

SEQ ID NO: 2062114 - RNA, 14 nt, Homo sapiens
caugcuucaugaaa

SEQ ID NO: 2062115 - RNA, 13 nt, Homo sapiens
ugucauaguucug

SEQ ID NO: 2062116 - RNA, 18 nt, Homo sapiens
ugggagacacagcaagac

SEQ ID NO: 2062117 - RNA, 13 nt, Homo sapiens
ugucaccaucauu

SEQ ID NO: 2062118 - RNA, 20 nt, Homo sapiens
agauauauguguauacauac

SEQ ID NO: 2062119 - RNA, 20 nt, Homo sapiens
cuucucaauaaucaaugaag

SEQ ID NO: 2062120 - RNA, 13 nt, Homo sapiens
cauugcaccagau

SEQ ID NO: 2062121 - RNA, 22 nt, Homo sapiens
aauuuucaaaaucaaauuccag

SEQ ID NO: 2062122 - RNA, 16 nt, Homo sapiens
aaaucuaguuuacuuc

SEQ ID NO: 2062123 - RNA, 21 nt, Homo sapiens
gaaaaaaagauuuccaagaaa

SEQ ID NO: 2062124 - RNA, 13 nt, Homo sapiens
caucacuauucaa

SEQ ID NO: 2062125 - RNA, 13 nt, Homo sapiens
cuucacuauacaa

SEQ ID NO: 2062126 - RNA, 22 nt, Homo sapiens
uuacuggaccccgccucccagc

SEQ ID NO: 2062127 - RNA, 13 nt, Homo sapiens
caucuaacucauc

SEQ ID NO: 2062128 - RNA, 18 nt, Homo sapiens
cacuuuguuuuacugucu

SEQ ID NO: 2062129 - RNA, 16 nt, Homo sapiens
ucccacucuuugaauc

SEQ ID NO: 2062130 - RNA, 14 nt, Homo sapiens
aaucccaaaccauu

SEQ ID NO: 2062131 - RNA, 14 nt, Homo sapiens
uucaguguugacau

SEQ ID NO: 2062132 - RNA, 15 nt, Homo sapiens
gcacguugugcacau

SEQ ID NO: 2062133 - RNA, 20 nt, Homo sapiens
aaugauuuagcucccuccau

SEQ ID NO: 2062134 - RNA, 20 nt, Homo sapiens
uuuuagucauuauagauccc

SEQ ID NO: 2062135 - RNA, 12 nt, Homo sapiens
gcuugcucuccu

SEQ ID NO: 2062136 - RNA, 18 nt, Homo sapiens
aauaaacaugaagcacaa

SEQ ID NO: 2062137 - RNA, 19 nt, Homo sapiens
cauaauggcugaagccaaa

SEQ ID NO: 2062138 - RNA, 20 nt, Homo sapiens
aagaauuccugaagccagau

SEQ ID NO: 2062139 - RNA, 19 nt, Homo sapiens
aaaauaaaugucacugcca

SEQ ID NO: 2062140 - RNA, 16 nt, Homo sapiens
ugaaguuuaauugacu

SEQ ID NO: 2062141 - RNA, 16 nt, Homo sapiens
ugaguccuaggacuua

SEQ ID NO: 2062142 - RNA, 16 nt, Homo sapiens
ucuggcauuauaaaga

SEQ ID NO: 2062143 - RNA, 17 nt, Homo sapiens
aacaaauuucauugcac

SEQ ID NO: 2062144 - RNA, 17 nt, Homo sapiens
ucauuguaaacaaacuc

SEQ ID NO: 2062145 - RNA, 14 nt, Homo sapiens
caccuugucaugua

SEQ ID NO: 2062146 - RNA, 19 nt, Homo sapiens
gacuucucuuuugcacauc

SEQ ID NO: 2062147 - RNA, 21 nt, Homo sapiens
agaugcuuuccugcacauuaa

SEQ ID NO: 2062148 - RNA, 17 nt, Homo sapiens
guuagcuguagaugacc

SEQ ID NO: 2062149 - RNA, 20 nt, Homo sapiens
auugucagaguucugcucua

SEQ ID NO: 2062150 - RNA, 11 nt, Homo sapiens
acuaaggugac

SEQ ID NO: 2062151 - RNA, 23 nt, Homo sapiens
auucacaccacacagagguuccc

SEQ ID NO: 2062152 - RNA, 21 nt, Homo sapiens
gaaucagauucaggagcucag

SEQ ID NO: 2062153 - RNA, 15 nt, Homo sapiens
caccaggccuuugag

SEQ ID NO: 2062154 - RNA, 22 nt, Homo sapiens
ucaugguacauuuaucacugaa

SEQ ID NO: 2062155 - RNA, 16 nt, Homo sapiens
ggagucucauucuguu

SEQ ID NO: 2062156 - RNA, 13 nt, Homo sapiens
ucucagcaugcau

SEQ ID NO: 2062157 - RNA, 15 nt, Homo sapiens
ggcagggaacauggg

SEQ ID NO: 2062158 - RNA, 23 nt, Homo sapiens
uuuaaauaaacgucuuugcugcg

SEQ ID NO: 2062159 - RNA, 19 nt, Homo sapiens
aagcaaguuaacacucuaa

SEQ ID NO: 2062160 - RNA, 18 nt, Homo sapiens
aaacuucuuucacucaca

SEQ ID NO: 2062161 - RNA, 15 nt, Homo sapiens
gcccuguguccugag

SEQ ID NO: 2062162 - RNA, 15 nt, Homo sapiens
ugaaguacaguccca

SEQ ID NO: 2062163 - RNA, 17 nt, Homo sapiens
gaaggagaaccgugaac

SEQ ID NO: 2062164 - RNA, 12 nt, Homo sapiens
ucauugcaccug

SEQ ID NO: 2062165 - RNA, 17 nt, Homo sapiens
agucacaucucuuccuc

SEQ ID NO: 2062166 - RNA, 13 nt, Homo sapiens
acauagccaacuc

SEQ ID NO: 2062167 - RNA, 11 nt, Homo sapiens
uaaauaaucuc

SEQ ID NO: 2062168 - RNA, 14 nt, Homo sapiens
gguacagguauauu

SEQ ID NO: 2062169 - RNA, 17 nt, Homo sapiens
cggaacugcaugcugcu

SEQ ID NO: 2062170 - RNA, 13 nt, Homo sapiens
agugucuuagcag

SEQ ID NO: 2062171 - RNA, 21 nt, Homo sapiens
uugugcuccuucggauaugau

SEQ ID NO: 2062172 - RNA, 16 nt, Homo sapiens
caccuauccugaagau

SEQ ID NO: 2062173 - RNA, 15 nt, Homo sapiens
agucugaguaaaauc

SEQ ID NO: 2062174 - RNA, 13 nt, Homo sapiens
cucaaaggcacag

SEQ ID NO: 2062175 - RNA, 21 nt, Homo sapiens
uacauuuuggauuucuuuaua

SEQ ID NO: 2062176 - RNA, 23 nt, Homo sapiens
cuuuucaagcuauaaugcuauuu

SEQ ID NO: 2062177 - RNA, 13 nt, Homo sapiens
ggcaucacugggu

SEQ ID NO: 2062178 - RNA, 22 nt, Homo sapiens
uaaucauaguuacuguguaaac

SEQ ID NO: 2062179 - RNA, 15 nt, Homo sapiens
cacagcuaugaaggc

SEQ ID NO: 2062180 - RNA, 16 nt, Homo sapiens
aaaaauauuugcugag

SEQ ID NO: 2062181 - RNA, 16 nt, Homo sapiens
uuaaagguaaaacaug

SEQ ID NO: 2062182 - RNA, 14 nt, Homo sapiens
cuggaugacauuaa

SEQ ID NO: 2062183 - RNA, 14 nt, Homo sapiens
guuaaaaacacugc

SEQ ID NO: 2062184 - RNA, 16 nt, Homo sapiens
agguccugugagcaaa

SEQ ID NO: 2062185 - RNA, 18 nt, Homo sapiens
uacagauagucaaaccau

SEQ ID NO: 2062186 - RNA, 18 nt, Homo sapiens
uuguuaagugcagucuga

SEQ ID NO: 2062187 - RNA, 12 nt, Homo sapiens
gauucacauaca

SEQ ID NO: 2062188 - RNA, 12 nt, Homo sapiens
ucuacacagccu

SEQ ID NO: 2062189 - RNA, 19 nt, Homo sapiens
ugccccuacugcaaauggc

SEQ ID NO: 2062190 - RNA, 18 nt, Homo sapiens
caacccccuuaacuguau

SEQ ID NO: 2062191 - RNA, 19 nt, Homo sapiens
uugacuuuagugaaagcgu

SEQ ID NO: 2062192 - RNA, 20 nt, Homo sapiens
ggagccccaucuaggggagc

SEQ ID NO: 2062193 - RNA, 17 nt, Homo sapiens
gacucuacagaggccau

SEQ ID NO: 2062194 - RNA, 19 nt, Homo sapiens
uuagaugugcaaccugugg

SEQ ID NO: 2062195 - RNA, 23 nt, Homo sapiens
aagaggcagcuugaaacugagau

SEQ ID NO: 2062196 - RNA, 13 nt, Homo sapiens
aaacauugccuua

SEQ ID NO: 2062197 - RNA, 12 nt, Homo sapiens
uaaggcaaaaaa

SEQ ID NO: 2062198 - RNA, 19 nt, Homo sapiens
aaccuuacuggcacugugg

SEQ ID NO: 2062199 - RNA, 17 nt, Homo sapiens
gccuccaagccauucac

SEQ ID NO: 2062200 - RNA, 22 nt, Homo sapiens
cuuccugcagaggcccagccac

SEQ ID NO: 2062201 - RNA, 14 nt, Homo sapiens
acauaguaacucuu

SEQ ID NO: 2062202 - RNA, 14 nt, Homo sapiens
ccucuuuaccauag

SEQ ID NO: 2062203 - RNA, 16 nt, Homo sapiens
guugaaguacaaaagg

SEQ ID NO: 2062204 - RNA, 17 nt, Homo sapiens
uauaccgugacugaaaa

SEQ ID NO: 2062205 - RNA, 17 nt, Homo sapiens
aucacaguguuugcaau

SEQ ID NO: 2062206 - RNA, 21 nt, Homo sapiens
ccaauaccuccuccagaucag

SEQ ID NO: 2062207 - RNA, 21 nt, Homo sapiens
agagaauaaacgccuucccaa

SEQ ID NO: 2062208 - RNA, 21 nt, Homo sapiens
uaaugcugaaacaucauuaca

SEQ ID NO: 2062209 - RNA, 20 nt, Homo sapiens
guccuucuuuaucugugaua

SEQ ID NO: 2062210 - RNA, 18 nt, Homo sapiens
uggccuugaaaccaccuu

SEQ ID NO: 2062211 - RNA, 20 nt, Homo sapiens
cagccuccuguguagcuggg

SEQ ID NO: 2062212 - RNA, 12 nt, Homo sapiens
gggccagcacuu

SEQ ID NO: 2062213 - RNA, 12 nt, Homo sapiens
ucaguaacauaa

SEQ ID NO: 2062214 - RNA, 18 nt, Homo sapiens
cuguccagcuuauagucu

SEQ ID NO: 2062215 - RNA, 17 nt, Homo sapiens
gacagugccucuuccag

SEQ ID NO: 2062216 - RNA, 21 nt, Homo sapiens
aguguauucucuucacagugc

SEQ ID NO: 2062217 - RNA, 15 nt, Homo sapiens
ugacugcucggucag

SEQ ID NO: 2062218 - RNA, 16 nt, Homo sapiens
gcaauaaaacugcuag

SEQ ID NO: 2062219 - RNA, 16 nt, Homo sapiens
gacaaauucaccuuca

SEQ ID NO: 2062220 - RNA, 23 nt, Homo sapiens
cuauucuggcaauaaacuuuuag

SEQ ID NO: 2062221 - RNA, 13 nt, Homo sapiens
uuuugagauucau

SEQ ID NO: 2062222 - RNA, 13 nt, Homo sapiens
auuuuagaaucag

SEQ ID NO: 2062223 - RNA, 16 nt, Homo sapiens
acuucaugcaggugaa

SEQ ID NO: 2062224 - RNA, 16 nt, Homo sapiens
uuccugccuacuggau

SEQ ID NO: 2062225 - RNA, 22 nt, Homo sapiens
auuuuuccugcuguauccagaa

SEQ ID NO: 2062226 - RNA, 18 nt, Homo sapiens
aacaaaauguaaagccag

SEQ ID NO: 2062227 - RNA, 22 nt, Homo sapiens
ugccauucagucuagcuuuuaa

SEQ ID NO: 2062228 - RNA, 21 nt, Homo sapiens
aguccagccuggcaaggguuc

SEQ ID NO: 2062229 - RNA, 21 nt, Homo sapiens
auuuaaaaacaggcagcucau

SEQ ID NO: 2062230 - RNA, 22 nt, Homo sapiens
gcagagaaaauugugaaaguga

SEQ ID NO: 2062231 - RNA, 20 nt, Homo sapiens
caauacuagccccccagugg

SEQ ID NO: 2062232 - RNA, 11 nt, Homo sapiens
ucggggcucca

SEQ ID NO: 2062233 - RNA, 14 nt, Homo sapiens
aucuguaaauuuaa

SEQ ID NO: 2062234 - RNA, 20 nt, Homo sapiens
gaaggcagagguugcaguga

SEQ ID NO: 2062235 - RNA, 18 nt, Homo sapiens
ucugggccagaaguccuc

SEQ ID NO: 2062236 - RNA, 15 nt, Homo sapiens
ucuuuucucaugugu

SEQ ID NO: 2062237 - RNA, 21 nt, Homo sapiens
aaguccagugugacuuuaucu

SEQ ID NO: 2062238 - RNA, 18 nt, Homo sapiens
aaugcuggagcaggcugu

SEQ ID NO: 2062239 - RNA, 15 nt, Homo sapiens
uccugcccaagcacu

SEQ ID NO: 2062240 - RNA, 18 nt, Homo sapiens
cagaaacagugaguuaaa

SEQ ID NO: 2062241 - RNA, 19 nt, Homo sapiens
auuaugaugaaaaccuaca

SEQ ID NO: 2062242 - RNA, 17 nt, Homo sapiens
agcaucagcucagggcu

SEQ ID NO: 2062243 - RNA, 13 nt, Homo sapiens
cugucacuuguga

SEQ ID NO: 2062244 - RNA, 14 nt, Homo sapiens
gacucgggccuuag

SEQ ID NO: 2062245 - RNA, 23 nt, Homo sapiens
ugguguaaauauuagugcaguua

SEQ ID NO: 2062246 - RNA, 20 nt, Homo sapiens
uccucagguaguacugggaa

SEQ ID NO: 2062247 - RNA, 21 nt, Homo sapiens
aaccuacucacuuagcaugaa

SEQ ID NO: 2062248 - RNA, 23 nt, Homo sapiens
uccauaaagacaaucacugccaa

SEQ ID NO: 2062249 - RNA, 16 nt, Homo sapiens
aaacccuuauacucac

SEQ ID NO: 2062250 - RNA, 15 nt, Homo sapiens
cuguacuuuuuccag

SEQ ID NO: 2062251 - RNA, 21 nt, Homo sapiens
uaagagcucaggaugagggaa

SEQ ID NO: 2062252 - RNA, 18 nt, Homo sapiens
uuuaacccuaaucuuuca

SEQ ID NO: 2062253 - RNA, 22 nt, Homo sapiens
uaaaagccuaugugccuuucac

SEQ ID NO: 2062254 - RNA, 13 nt, Homo sapiens
ucuuccauuuauu

SEQ ID NO: 2062255 - RNA, 13 nt, Homo sapiens
uuagucauucugc

SEQ ID NO: 2062256 - RNA, 13 nt, Homo sapiens
uuugguccuugaa

SEQ ID NO: 2062257 - RNA, 23 nt, Homo sapiens
caugggcaccucugcuguauuga

SEQ ID NO: 2062258 - RNA, 14 nt, Homo sapiens
uggcaaaagaguca

SEQ ID NO: 2062259 - RNA, 14 nt, Homo sapiens
cuggcacagaggua

SEQ ID NO: 2062260 - RNA, 17 nt, Homo sapiens
cagaaugaaaacuguaa

SEQ ID NO: 2062261 - RNA, 17 nt, Homo sapiens
caagacuauaccuuauc

SEQ ID NO: 2062262 - RNA, 22 nt, Homo sapiens
uuucugcuaaaaaguccuugau

SEQ ID NO: 2062263 - RNA, 23 nt, Homo sapiens
aagucccucccccagcccuguca

SEQ ID NO: 2062264 - RNA, 15 nt, Homo sapiens
uucuaacaguaccag

SEQ ID NO: 2062265 - RNA, 19 nt, Homo sapiens
ugcuucccguucagcguca

SEQ ID NO: 2062266 - RNA, 19 nt, Homo sapiens
uaaaagccuaugugccuuu

SEQ ID NO: 2062267 - RNA, 15 nt, Homo sapiens
aaugugcucaugcau

SEQ ID NO: 2062268 - RNA, 14 nt, Homo sapiens
aaauuaauguguaa

SEQ ID NO: 2062269 - RNA, 14 nt, Homo sapiens
aagcuacaguuuug

SEQ ID NO: 2062270 - RNA, 15 nt, Homo sapiens
caaugccaugaacaa

SEQ ID NO: 2062271 - RNA, 22 nt, Homo sapiens
caacaccuaggucgccagugaa

SEQ ID NO: 2062272 - RNA, 20 nt, Homo sapiens
ucugggcucaagcaauccuc

SEQ ID NO: 2062273 - RNA, 16 nt, Homo sapiens
cacuuuuucauaguca

SEQ ID NO: 2062274 - RNA, 12 nt, Homo sapiens
ccucaguucucu

SEQ ID NO: 2062275 - RNA, 16 nt, Homo sapiens
uagcagcagugcaugg

SEQ ID NO: 2062276 - RNA, 20 nt, Homo sapiens
ccaagaccaaccuacaauuu

SEQ ID NO: 2062277 - RNA, 20 nt, Homo sapiens
acucugucuuaaaugagaag

SEQ ID NO: 2062278 - RNA, 14 nt, Homo sapiens
ccucagaguggagu

SEQ ID NO: 2062279 - RNA, 17 nt, Homo sapiens
acaguagugucaucacu

SEQ ID NO: 2062280 - RNA, 18 nt, Homo sapiens
augaauucaagaaaggaa

SEQ ID NO: 2062281 - RNA, 17 nt, Homo sapiens
uaagacagaauucacug

SEQ ID NO: 2062282 - RNA, 18 nt, Homo sapiens
cucccaacucuugcacag

SEQ ID NO: 2062283 - RNA, 18 nt, Homo sapiens
gaccuggcucucagagga

SEQ ID NO: 2062284 - RNA, 19 nt, Homo sapiens
gacuggccucaaagcaagc

SEQ ID NO: 2062285 - RNA, 21 nt, Homo sapiens
acucucccugacgguggaauu

SEQ ID NO: 2062286 - RNA, 21 nt, Homo sapiens
ucacgaggguaggacccucau

SEQ ID NO: 2062287 - RNA, 14 nt, Homo sapiens
uuaucaagccauaa

SEQ ID NO: 2062288 - RNA, 20 nt, Homo sapiens
uacagauacauaucugugua

SEQ ID NO: 2062289 - RNA, 16 nt, Homo sapiens
gacuauuuaacuugag

SEQ ID NO: 2062290 - RNA, 16 nt, Homo sapiens
gaaaugaccaggccaa

SEQ ID NO: 2062291 - RNA, 14 nt, Homo sapiens
aucaaaagacuuuu

SEQ ID NO: 2062292 - RNA, 20 nt, Homo sapiens
gagaccccaggaacaauaaa

SEQ ID NO: 2062293 - RNA, 13 nt, Homo sapiens
cuuggguggggga

SEQ ID NO: 2062294 - RNA, 21 nt, Homo sapiens
ugaaauggacaaacagugcac

SEQ ID NO: 2062295 - RNA, 17 nt, Homo sapiens
guaaauuuuuaggcaaa

SEQ ID NO: 2062296 - RNA, 17 nt, Homo sapiens
cugaucugcacauuuca

SEQ ID NO: 2062297 - RNA, 17 nt, Homo sapiens
aguaaagaaaaguuuac

SEQ ID NO: 2062298 - RNA, 18 nt, Homo sapiens
caggaagaaaauagaaca

SEQ ID NO: 2062299 - RNA, 19 nt, Homo sapiens
uccagcugccccucccuca

SEQ ID NO: 2062300 - RNA, 11 nt, Homo sapiens
agccucuggcu

SEQ ID NO: 2062301 - RNA, 17 nt, Homo sapiens
ugagcugcccacagcag

SEQ ID NO: 2062302 - RNA, 19 nt, Homo sapiens
acccugugcccuccguuau

SEQ ID NO: 2062303 - RNA, 16 nt, Homo sapiens
cuccuuccccauuucc

SEQ ID NO: 2062304 - RNA, 18 nt, Homo sapiens
gaauggaauaacuaucuc

SEQ ID NO: 2062305 - RNA, 13 nt, Homo sapiens
acuggcagcaucu

SEQ ID NO: 2062306 - RNA, 13 nt, Homo sapiens
aauaaauaugagu

SEQ ID NO: 2062307 - RNA, 15 nt, Homo sapiens
gaggaaaaagcgaga

SEQ ID NO: 2062308 - RNA, 16 nt, Homo sapiens
augcauaaagccaaau

SEQ ID NO: 2062309 - RNA, 12 nt, Homo sapiens
gcccagcuacau

SEQ ID NO: 2062310 - RNA, 16 nt, Homo sapiens
cugacuuggugcaagg

SEQ ID NO: 2062311 - RNA, 17 nt, Homo sapiens
accuggcuuggcuuuaa

SEQ ID NO: 2062312 - RNA, 16 nt, Homo sapiens
ggauccgaagugcaau

SEQ ID NO: 2062313 - RNA, 23 nt, Homo sapiens
caguaccgcaucucccugcaguu

SEQ ID NO: 2062314 - RNA, 13 nt, Homo sapiens
cuuuguguagaaa

SEQ ID NO: 2062315 - RNA, 20 nt, Homo sapiens
aauggcucaugaccuggaaa

SEQ ID NO: 2062316 - RNA, 21 nt, Homo sapiens
uauuugugaugacaacuggaa

SEQ ID NO: 2062317 - RNA, 22 nt, Homo sapiens
guuuuaaggacugacugaggca

SEQ ID NO: 2062318 - RNA, 16 nt, Homo sapiens
aacaccaccaaaugac

SEQ ID NO: 2062319 - RNA, 16 nt, Homo sapiens
uuaaagaauuuggaag

SEQ ID NO: 2062320 - RNA, 17 nt, Homo sapiens
uuugcuaucacacagug

SEQ ID NO: 2062321 - RNA, 14 nt, Homo sapiens
ugcacaaacaugaa

SEQ ID NO: 2062322 - RNA, 16 nt, Homo sapiens
uguacagauaugcaaa

SEQ ID NO: 2062323 - RNA, 12 nt, Homo sapiens
ugccucugcucc

SEQ ID NO: 2062324 - RNA, 15 nt, Homo sapiens
cacgcgccuguaauc

SEQ ID NO: 2062325 - RNA, 15 nt, Homo sapiens
uggggccgggacccc

SEQ ID NO: 2062326 - RNA, 18 nt, Homo sapiens
ugaacugcagcaaucaca

SEQ ID NO: 2062327 - RNA, 18 nt, Homo sapiens
cauuuuugcucuauggga

SEQ ID NO: 2062328 - RNA, 17 nt, Homo sapiens
gcauuuucaagcaguua

SEQ ID NO: 2062329 - RNA, 15 nt, Homo sapiens
cucacugggcucacu

SEQ ID NO: 2062330 - RNA, 23 nt, Homo sapiens
cucaaggaaaagaugugcuccca

SEQ ID NO: 2062331 - RNA, 21 nt, Homo sapiens
cugaucagucuaagaugggug

SEQ ID NO: 2062332 - RNA, 16 nt, Homo sapiens
uuucuuuuaucacgau

SEQ ID NO: 2062333 - RNA, 14 nt, Homo sapiens
uggagcccacugua

SEQ ID NO: 2062334 - RNA, 22 nt, Homo sapiens
cagaaauccacgcucaaucuca

SEQ ID NO: 2062335 - RNA, 17 nt, Homo sapiens
gggugguggaaggcagc

SEQ ID NO: 2062336 - RNA, 20 nt, Homo sapiens
cugugcagaugcuuugccca

SEQ ID NO: 2062337 - RNA, 20 nt, Homo sapiens
aaaaugaaccuugcuaucaa

SEQ ID NO: 2062338 - RNA, 19 nt, Homo sapiens
caguguccugugcuuucug

SEQ ID NO: 2062339 - RNA, 17 nt, Homo sapiens
guauucuucaaccagug

SEQ ID NO: 2062340 - RNA, 18 nt, Homo sapiens
acugcuuggaacuggaau

SEQ ID NO: 2062341 - RNA, 20 nt, Homo sapiens
ccccaucauaagggcacuga

SEQ ID NO: 2062342 - RNA, 19 nt, Homo sapiens
cacacaggagaagcucgga

SEQ ID NO: 2062343 - RNA, 21 nt, Homo sapiens
ucuuugcacuccaaucauuca

SEQ ID NO: 2062344 - RNA, 18 nt, Homo sapiens
acuaaggggcagcuccug

SEQ ID NO: 2062345 - RNA, 14 nt, Homo sapiens
acucagagguccag

SEQ ID NO: 2062346 - RNA, 19 nt, Homo sapiens
acaguuuauaaagccaaga

SEQ ID NO: 2062347 - RNA, 16 nt, Homo sapiens
uacuuacacaucuucc

SEQ ID NO: 2062348 - RNA, 15 nt, Homo sapiens
cccacuuuauugcca

SEQ ID NO: 2062349 - RNA, 21 nt, Homo sapiens
gauucaagacucaauguggaa

SEQ ID NO: 2062350 - RNA, 17 nt, Homo sapiens
ucgggaggcugaggcag

SEQ ID NO: 2062351 - RNA, 12 nt, Homo sapiens
ucuuaucuuucu

SEQ ID NO: 2062352 - RNA, 12 nt, Homo sapiens
uuuaaucuucca

SEQ ID NO: 2062353 - RNA, 15 nt, Homo sapiens
agcaggaguggugca

SEQ ID NO: 2062354 - RNA, 22 nt, Homo sapiens
aguuuauaaauuaaaacugaau

SEQ ID NO: 2062355 - RNA, 16 nt, Homo sapiens
cuuaaaccacagcacu

SEQ ID NO: 2062356 - RNA, 20 nt, Homo sapiens
gagauugcaccacugcacuc

SEQ ID NO: 2062357 - RNA, 18 nt, Homo sapiens
acgcugaaggcuuacuuc

SEQ ID NO: 2062358 - RNA, 18 nt, Homo sapiens
ccagagaggcuggaugac

SEQ ID NO: 2062359 - RNA, 16 nt, Homo sapiens
aaaagaaaccacuucu

SEQ ID NO: 2062360 - RNA, 17 nt, Homo sapiens
ugcggccucugagacau

SEQ ID NO: 2062361 - RNA, 13 nt, Homo sapiens
agucacacagugu

SEQ ID NO: 2062362 - RNA, 13 nt, Homo sapiens
acagacacacacu

SEQ ID NO: 2062363 - RNA, 20 nt, Homo sapiens
ugagcacagccccagacaga

SEQ ID NO: 2062364 - RNA, 16 nt, Homo sapiens
cuucacucacugucaa

SEQ ID NO: 2062365 - RNA, 17 nt, Homo sapiens
cuuaaaaacagcuguaa

SEQ ID NO: 2062366 - RNA, 20 nt, Homo sapiens
cuuugggcuugacaccuguc

SEQ ID NO: 2062367 - RNA, 22 nt, Homo sapiens
agcucaggaaccgaggcaggga

SEQ ID NO: 2062368 - RNA, 16 nt, Homo sapiens
ucugccacccaguccu

SEQ ID NO: 2062369 - RNA, 15 nt, Homo sapiens
uguuucccauuacuu

SEQ ID NO: 2062370 - RNA, 16 nt, Homo sapiens
aaaaagaagaaaagau

SEQ ID NO: 2062371 - RNA, 21 nt, Homo sapiens
ugcuggggagucccugccaca

SEQ ID NO: 2062372 - RNA, 18 nt, Homo sapiens
accuccagugucaggguc

SEQ ID NO: 2062373 - RNA, 20 nt, Homo sapiens
ggacauuucucaagggccau

SEQ ID NO: 2062374 - RNA, 15 nt, Homo sapiens
uauuugcaguaugaa

SEQ ID NO: 2062375 - RNA, 18 nt, Homo sapiens
uauagccacaaaugccuu

SEQ ID NO: 2062376 - RNA, 19 nt, Homo sapiens
caaucuuuccuacuuucua

SEQ ID NO: 2062377 - RNA, 16 nt, Homo sapiens
auccauaagauuugca

SEQ ID NO: 2062378 - RNA, 20 nt, Homo sapiens
ucugccggcccuggggcuag

SEQ ID NO: 2062379 - RNA, 16 nt, Homo sapiens
agcccaagugccaucc

SEQ ID NO: 2062380 - RNA, 15 nt, Homo sapiens
agcucauuucacuuu

SEQ ID NO: 2062381 - RNA, 15 nt, Homo sapiens
caaaccaaugcuauu

SEQ ID NO: 2062382 - RNA, 12 nt, Homo sapiens
aguauacaugac

SEQ ID NO: 2062383 - RNA, 15 nt, Homo sapiens
cugacuguguucagu

SEQ ID NO: 2062384 - RNA, 16 nt, Homo sapiens
ggaugggaacacuggu

SEQ ID NO: 2062385 - RNA, 14 nt, Homo sapiens
aucuuaaaggacau

SEQ ID NO: 2062386 - RNA, 22 nt, Homo sapiens
aacaaaacccucagcacuguua

SEQ ID NO: 2062387 - RNA, 18 nt, Homo sapiens
ucuauauaaccacauuuc

SEQ ID NO: 2062388 - RNA, 15 nt, Homo sapiens
gugcuccugaaagaa

SEQ ID NO: 2062389 - RNA, 18 nt, Homo sapiens
auaaaguuaaauugcacg

SEQ ID NO: 2062390 - RNA, 23 nt, Homo sapiens
ugaaguuauggcuucacauucau

SEQ ID NO: 2062391 - RNA, 21 nt, Homo sapiens
aaacaaagaugccacauucaa

SEQ ID NO: 2062392 - RNA, 17 nt, Homo sapiens
ucaaagaaaacuuccaa

SEQ ID NO: 2062393 - RNA, 17 nt, Homo sapiens
caaagugugauauacaa

SEQ ID NO: 2062394 - RNA, 16 nt, Homo sapiens
aaaaaugaaugacuca

SEQ ID NO: 2062395 - RNA, 14 nt, Homo sapiens
aggauguacaaaga

SEQ ID NO: 2062396 - RNA, 19 nt, Homo sapiens
cuccaucccaacagccaug

SEQ ID NO: 2062397 - RNA, 19 nt, Homo sapiens
cucgaacucccgaccucag

SEQ ID NO: 2062398 - RNA, 17 nt, Homo sapiens
auaguauacacaucaua

SEQ ID NO: 2062399 - RNA, 20 nt, Homo sapiens
ugcuucaauuuauaccucaa

SEQ ID NO: 2062400 - RNA, 19 nt, Homo sapiens
auugaggagcugcacugau

SEQ ID NO: 2062401 - RNA, 15 nt, Homo sapiens
auuucauguaaccaa

SEQ ID NO: 2062402 - RNA, 15 nt, Homo sapiens
cuaauguaugcauuc

SEQ ID NO: 2062403 - RNA, 15 nt, Homo sapiens
ugauggcacucuguu

SEQ ID NO: 2062404 - RNA, 19 nt, Homo sapiens
agugggggugggggguccc

SEQ ID NO: 2062405 - RNA, 22 nt, Homo sapiens
ugcccuuaaguucagcaacugu

SEQ ID NO: 2062406 - RNA, 19 nt, Homo sapiens
auucuucaaccucauugac

SEQ ID NO: 2062407 - RNA, 13 nt, Homo sapiens
auugucacaugau

SEQ ID NO: 2062408 - RNA, 21 nt, Homo sapiens
aaacaccuuaagaagucuaua

SEQ ID NO: 2062409 - RNA, 16 nt, Homo sapiens
uuguaucuuaagccaa

SEQ ID NO: 2062410 - RNA, 14 nt, Homo sapiens
ucuuuguacauuuu

SEQ ID NO: 2062411 - RNA, 18 nt, Homo sapiens
uuaggaaagcagugcagu

SEQ ID NO: 2062412 - RNA, 13 nt, Homo sapiens
cugccuccaugau

SEQ ID NO: 2062413 - RNA, 16 nt, Homo sapiens
auuaaacaaguauaaa

SEQ ID NO: 2062414 - RNA, 14 nt, Homo sapiens
auuguacgaagagu

SEQ ID NO: 2062415 - RNA, 18 nt, Homo sapiens
uuaagcuccaugugcaua

SEQ ID NO: 2062416 - RNA, 18 nt, Homo sapiens
ccuagccaccaguguccu

SEQ ID NO: 2062417 - RNA, 15 nt, Homo sapiens
cuauugaacuguauu

SEQ ID NO: 2062418 - RNA, 13 nt, Homo sapiens
ugaauacacagua

SEQ ID NO: 2062419 - RNA, 19 nt, Homo sapiens
uuauugauaaguucauaca

SEQ ID NO: 2062420 - RNA, 22 nt, Homo sapiens
gagagauguuuggaaaccacag

SEQ ID NO: 2062421 - RNA, 19 nt, Homo sapiens
gaggcugcagcaggugcug

SEQ ID NO: 2062422 - RNA, 19 nt, Homo sapiens
agcucugcuccucucccca

SEQ ID NO: 2062423 - RNA, 15 nt, Homo sapiens
cccagucacuccucu

SEQ ID NO: 2062424 - RNA, 18 nt, Homo sapiens
uaaaacgauagcuauauu

SEQ ID NO: 2062425 - RNA, 16 nt, Homo sapiens
auuaucuaaaguauga

SEQ ID NO: 2062426 - RNA, 15 nt, Homo sapiens
ccaaagcugcugcac

SEQ ID NO: 2062427 - RNA, 13 nt, Homo sapiens
auucuuucccaac

SEQ ID NO: 2062428 - RNA, 20 nt, Homo sapiens
cacuguuaauaguacuauua

SEQ ID NO: 2062429 - RNA, 14 nt, Homo sapiens
ucaccacagacuuu

SEQ ID NO: 2062430 - RNA, 23 nt, Homo sapiens
ugcaaaaggcugauuacugaaau

SEQ ID NO: 2062431 - RNA, 19 nt, Homo sapiens
aacuagguaacaguuugau

SEQ ID NO: 2062432 - RNA, 20 nt, Homo sapiens
cucuuuucccucucuaggcc

SEQ ID NO: 2062433 - RNA, 16 nt, Homo sapiens
aauugaaauaaaugau

SEQ ID NO: 2062434 - RNA, 16 nt, Homo sapiens
guaacuuuuugcacua

SEQ ID NO: 2062435 - RNA, 12 nt, Homo sapiens
aucaagagucuc

SEQ ID NO: 2062436 - RNA, 18 nt, Homo sapiens
uugaaaaauggcaaagaa

SEQ ID NO: 2062437 - RNA, 18 nt, Homo sapiens
cuugaccucgugauccac

SEQ ID NO: 2062438 - RNA, 14 nt, Homo sapiens
auuggaagaaagaa

SEQ ID NO: 2062439 - RNA, 13 nt, Homo sapiens
cagcaugugcaau

SEQ ID NO: 2062440 - RNA, 15 nt, Homo sapiens
cagcuaggcugagau

SEQ ID NO: 2062441 - RNA, 21 nt, Homo sapiens
gugcauaccggacuugucaca

SEQ ID NO: 2062442 - RNA, 19 nt, Homo sapiens
aaaauguuuggaaacagua

SEQ ID NO: 2062443 - RNA, 15 nt, Homo sapiens
uucuucacuuaccca

SEQ ID NO: 2062444 - RNA, 14 nt, Homo sapiens
agugugugcucagc

SEQ ID NO: 2062445 - RNA, 20 nt, Homo sapiens
cauuugggagacaugugaca

SEQ ID NO: 2062446 - RNA, 21 nt, Homo sapiens
acaugcugagguuuugaauaa

SEQ ID NO: 2062447 - RNA, 23 nt, Homo sapiens
gucccuuccagucaugugugcau

SEQ ID NO: 2062448 - RNA, 17 nt, Homo sapiens
acccaugcccagcugua

SEQ ID NO: 2062449 - RNA, 23 nt, Homo sapiens
ucuccaucucuugaccucgugau

SEQ ID NO: 2062450 - RNA, 14 nt, Homo sapiens
cuuuagaacucuag

SEQ ID NO: 2062451 - RNA, 20 nt, Homo sapiens
gagcaaauccaggaaggcaa

SEQ ID NO: 2062452 - RNA, 20 nt, Homo sapiens
aaauugaguucuuccuguaa

SEQ ID NO: 2062453 - RNA, 19 nt, Homo sapiens
cagaggcguacuacccagc

SEQ ID NO: 2062454 - RNA, 20 nt, Homo sapiens
gacuaucuuacuauuucaca

SEQ ID NO: 2062455 - RNA, 21 nt, Homo sapiens
ugacauauuucauaagcacau

SEQ ID NO: 2062456 - RNA, 11 nt, Homo sapiens
auugcacucag

SEQ ID NO: 2062457 - RNA, 16 nt, Homo sapiens
aaauuaacaugugcca

SEQ ID NO: 2062458 - RNA, 19 nt, Homo sapiens
agccaugugcugcgugccu

SEQ ID NO: 2062459 - RNA, 18 nt, Homo sapiens
aacuuugaggaacauuca

SEQ ID NO: 2062460 - RNA, 23 nt, Homo sapiens
ucuaccaaauaauuucauauuca

SEQ ID NO: 2062461 - RNA, 23 nt, Homo sapiens
aauaucagugcucgagacacagu

SEQ ID NO: 2062462 - RNA, 16 nt, Homo sapiens
agaaaaugcuuucuca

SEQ ID NO: 2062463 - RNA, 17 nt, Homo sapiens
gaaucacugcuccaggc

SEQ ID NO: 2062464 - RNA, 19 nt, Homo sapiens
ggaagcuuuguuugaaaau

SEQ ID NO: 2062465 - RNA, 17 nt, Homo sapiens
ugaugaacuuauaauga

SEQ ID NO: 2062466 - RNA, 19 nt, Homo sapiens
aagaauuaagaggaugcug

SEQ ID NO: 2062467 - RNA, 16 nt, Homo sapiens
cgaugcaaacauugga

SEQ ID NO: 2062468 - RNA, 15 nt, Homo sapiens
aggucuacagugaua

SEQ ID NO: 2062469 - RNA, 17 nt, Homo sapiens
auuauuuuuucuaugaa

SEQ ID NO: 2062470 - RNA, 17 nt, Homo sapiens
cauguuugcagggguga

SEQ ID NO: 2062471 - RNA, 19 nt, Homo sapiens
caccgaguggccauggcau

SEQ ID NO: 2062472 - RNA, 23 nt, Homo sapiens
cccauguauuuaucucuauuuaa

SEQ ID NO: 2062473 - RNA, 16 nt, Homo sapiens
uaaaaugcacccauca

SEQ ID NO: 2062474 - RNA, 20 nt, Homo sapiens
aaucaaaaagaggagauuaa

SEQ ID NO: 2062475 - RNA, 22 nt, Homo sapiens
ccccagucucuggggucaggaa

SEQ ID NO: 2062476 - RNA, 12 nt, Homo sapiens
gaugaagcugag

SEQ ID NO: 2062477 - RNA, 18 nt, Homo sapiens
uuuguggaggacuuugaa

SEQ ID NO: 2062478 - RNA, 13 nt, Homo sapiens
auauaauugccaa

SEQ ID NO: 2062479 - RNA, 15 nt, Homo sapiens
uccauuugacaaagu

SEQ ID NO: 2062480 - RNA, 21 nt, Homo sapiens
ugucuucugcuguucuucacu

SEQ ID NO: 2062481 - RNA, 15 nt, Homo sapiens
uacuuaguucauggc

SEQ ID NO: 2062482 - RNA, 19 nt, Homo sapiens
uugucuuagacacuguggu

SEQ ID NO: 2062483 - RNA, 20 nt, Homo sapiens
uauauaaaauauauauugca

SEQ ID NO: 2062484 - RNA, 17 nt, Homo sapiens
cuggcagcaggaugcuc

SEQ ID NO: 2062485 - RNA, 18 nt, Homo sapiens
gagcaugcuuaccuucug

SEQ ID NO: 2062486 - RNA, 20 nt, Homo sapiens
cuaaugcuucaaguguugcu

SEQ ID NO: 2062487 - RNA, 15 nt, Homo sapiens
uccacagugacucca

SEQ ID NO: 2062488 - RNA, 19 nt, Homo sapiens
aaagguuggccuuacuguu

SEQ ID NO: 2062489 - RNA, 14 nt, Homo sapiens
aagacaaacacugc

SEQ ID NO: 2062490 - RNA, 21 nt, Homo sapiens
ucgucaacuuucuuagcucaa

SEQ ID NO: 2062491 - RNA, 17 nt, Homo sapiens
aacuuggagauuuugcu

SEQ ID NO: 2062492 - RNA, 17 nt, Homo sapiens
uuuuaacucaccucuca

SEQ ID NO: 2062493 - RNA, 14 nt, Homo sapiens
uuuuggugcuauaa

SEQ ID NO: 2062494 - RNA, 22 nt, Homo sapiens
gcagauagcccaggagcaacag

SEQ ID NO: 2062495 - RNA, 15 nt, Homo sapiens
accuuaguuccuuac

SEQ ID NO: 2062496 - RNA, 20 nt, Homo sapiens
uccagccaaccucauugcag

SEQ ID NO: 2062497 - RNA, 15 nt, Homo sapiens
ugaaaggugacaaaa

SEQ ID NO: 2062498 - RNA, 17 nt, Homo sapiens
aaccucacgcaccuccc

SEQ ID NO: 2062499 - RNA, 20 nt, Homo sapiens
auuaaaaugacaagcacuau

SEQ ID NO: 2062500 - RNA, 13 nt, Homo sapiens
uuagagugcacau

SEQ ID NO: 2062501 - RNA, 16 nt, Homo sapiens
uuaaucaagauguuca

SEQ ID NO: 2062502 - RNA, 22 nt, Homo sapiens
uuaaacgaggcaaugacuguga

SEQ ID NO: 2062503 - RNA, 17 nt, Homo sapiens
gccucucggugaccucc

SEQ ID NO: 2062504 - RNA, 16 nt, Homo sapiens
ucaguugcauucauua

SEQ ID NO: 2062505 - RNA, 18 nt, Homo sapiens
aacacagacaaagugcua

SEQ ID NO: 2062506 - RNA, 18 nt, Homo sapiens
cucugcuccagcaagcaa

SEQ ID NO: 2062507 - RNA, 15 nt, Homo sapiens
caugacugucugugc

SEQ ID NO: 2062508 - RNA, 19 nt, Homo sapiens
ucucaaaugcacaucucau

SEQ ID NO: 2062509 - RNA, 15 nt, Homo sapiens
cugcagccacauggg

SEQ ID NO: 2062510 - RNA, 13 nt, Homo sapiens
acuauuaguauua

SEQ ID NO: 2062511 - RNA, 15 nt, Homo sapiens
gucacugucagagaa

SEQ ID NO: 2062512 - RNA, 17 nt, Homo sapiens
gacauucuaugcuuaca

SEQ ID NO: 2062513 - RNA, 23 nt, Homo sapiens
auggaccacuguuucuugcuugu

SEQ ID NO: 2062514 - RNA, 17 nt, Homo sapiens
ccguggaucugggcaca

SEQ ID NO: 2062515 - RNA, 13 nt, Homo sapiens
gcucccaccacca

SEQ ID NO: 2062516 - RNA, 16 nt, Homo sapiens
ccaucaaguugugcca

SEQ ID NO: 2062517 - RNA, 18 nt, Homo sapiens
uaugauauugcauaugca

SEQ ID NO: 2062518 - RNA, 22 nt, Homo sapiens
ccuuggccaugggucccauucu

SEQ ID NO: 2062519 - RNA, 16 nt, Homo sapiens
gugcucuggggguccc

SEQ ID NO: 2062520 - RNA, 23 nt, Homo sapiens
agcugcaguuuccucaucuguca

SEQ ID NO: 2062521 - RNA, 12 nt, Homo sapiens
uaauuuaaucuu

SEQ ID NO: 2062522 - RNA, 22 nt, Homo sapiens
uccccagccccuccucccucag

SEQ ID NO: 2062523 - RNA, 19 nt, Homo sapiens
agcaucugacucacaagaa

SEQ ID NO: 2062524 - RNA, 14 nt, Homo sapiens
cagacuucucaaua

SEQ ID NO: 2062525 - RNA, 22 nt, Homo sapiens
cagcauuuagugaaguugugca

SEQ ID NO: 2062526 - RNA, 16 nt, Homo sapiens
aggagcacacauccaa

SEQ ID NO: 2062527 - RNA, 17 nt, Homo sapiens
uuauaucauguaccuca

SEQ ID NO: 2062528 - RNA, 22 nt, Homo sapiens
uuuuucuccagaccccaugccu

SEQ ID NO: 2062529 - RNA, 22 nt, Homo sapiens
ucaaacugcaaauauugucaua

SEQ ID NO: 2062530 - RNA, 14 nt, Homo sapiens
ugaauugucuucac

SEQ ID NO: 2062531 - RNA, 23 nt, Homo sapiens
uaaguguucucggggaugcauag

SEQ ID NO: 2062532 - RNA, 19 nt, Homo sapiens
aucaccucuaaaaaccaaa

SEQ ID NO: 2062533 - RNA, 22 nt, Homo sapiens
ccucagggcucugacucugcca

SEQ ID NO: 2062534 - RNA, 14 nt, Homo sapiens
ugccuuauugcugu

SEQ ID NO: 2062535 - RNA, 18 nt, Homo sapiens
ugaacuauuuuuaagguc

SEQ ID NO: 2062536 - RNA, 23 nt, Homo sapiens
uuuauugagcuguacaugcauau

SEQ ID NO: 2062537 - RNA, 16 nt, Homo sapiens
agcuggggucugggca

SEQ ID NO: 2062538 - RNA, 22 nt, Homo sapiens
acaugcuuuucugccacuccau

SEQ ID NO: 2062539 - RNA, 19 nt, Homo sapiens
gaaggcuucugugucaaug

SEQ ID NO: 2062540 - RNA, 17 nt, Homo sapiens
aaaacauuuuaaaauca

SEQ ID NO: 2062541 - RNA, 15 nt, Homo sapiens
cuguggucacaguga

SEQ ID NO: 2062542 - RNA, 16 nt, Homo sapiens
gugugugccaugucac

SEQ ID NO: 2062543 - RNA, 18 nt, Homo sapiens
ccuucugugcaucuggcc

SEQ ID NO: 2062544 - RNA, 19 nt, Homo sapiens
uacuaaauuuucuaauuaa

SEQ ID NO: 2062545 - RNA, 18 nt, Homo sapiens
gacguuaggccaggccuu

SEQ ID NO: 2062546 - RNA, 16 nt, Homo sapiens
aaagggaaaacaaaua

SEQ ID NO: 2062547 - RNA, 16 nt, Homo sapiens
cacggcaaaaugucau

SEQ ID NO: 2062548 - RNA, 21 nt, Homo sapiens
gaccagccugcccaacguggu

SEQ ID NO: 2062549 - RNA, 13 nt, Homo sapiens
cucucacaugcac

SEQ ID NO: 2062550 - RNA, 21 nt, Homo sapiens
acgagggauguggagcacaaa

SEQ ID NO: 2062551 - RNA, 17 nt, Homo sapiens
uuccaagucaacacucu

SEQ ID NO: 2062552 - RNA, 13 nt, Homo sapiens
cagagcugagcau

SEQ ID NO: 2062553 - RNA, 18 nt, Homo sapiens
gcucauauuguucccuau

SEQ ID NO: 2062554 - RNA, 16 nt, Homo sapiens
uguuuccacgggucuc

SEQ ID NO: 2062555 - RNA, 12 nt, Homo sapiens
aguaacaaauaa

SEQ ID NO: 2062556 - RNA, 19 nt, Homo sapiens
auauaugauuuaugaauua

SEQ ID NO: 2062557 - RNA, 17 nt, Homo sapiens
cucuuguuuuugcauaa

SEQ ID NO: 2062558 - RNA, 14 nt, Homo sapiens
aaugauuaaucagc

SEQ ID NO: 2062559 - RNA, 21 nt, Homo sapiens
cucgguucugcgccacuuccu

SEQ ID NO: 2062560 - RNA, 18 nt, Homo sapiens
ucaccccugguucucauc

SEQ ID NO: 2062561 - RNA, 17 nt, Homo sapiens
gacaccuugacagggca

SEQ ID NO: 2062562 - RNA, 12 nt, Homo sapiens
gucaucacccag

SEQ ID NO: 2062563 - RNA, 17 nt, Homo sapiens
aagucagcaugccucua

SEQ ID NO: 2062564 - RNA, 18 nt, Homo sapiens
auccccaagugugaacaa

SEQ ID NO: 2062565 - RNA, 10 nt, Homo sapiens
aauucaccuu

SEQ ID NO: 2062566 - RNA, 21 nt, Homo sapiens
ugacccuccaccgcagaagga

SEQ ID NO: 2062567 - RNA, 17 nt, Homo sapiens
uaacgauguuguauuga

SEQ ID NO: 2062568 - RNA, 14 nt, Homo sapiens
cacgauuagcuuua

SEQ ID NO: 2062569 - RNA, 15 nt, Homo sapiens
augcagccaaggaau

SEQ ID NO: 2062570 - RNA, 15 nt, Homo sapiens
agugaggaauggcag

SEQ ID NO: 2062571 - RNA, 22 nt, Homo sapiens
gccaggauggucucgaucuccu

SEQ ID NO: 2062572 - RNA, 15 nt, Homo sapiens
aguauuguggcugca

SEQ ID NO: 2062573 - RNA, 12 nt, Homo sapiens
acccuacuuugc

SEQ ID NO: 2062574 - RNA, 22 nt, Homo sapiens
uggaaaacugccacaagcacaa

SEQ ID NO: 2062575 - RNA, 11 nt, Homo sapiens
aaaacagucau

SEQ ID NO: 2062576 - RNA, 14 nt, Homo sapiens
ccugaaacacuuuu

SEQ ID NO: 2062577 - RNA, 22 nt, Homo sapiens
caaaccauggauagaaucaaua

SEQ ID NO: 2062578 - RNA, 15 nt, Homo sapiens
caugcagugcccuca

SEQ ID NO: 2062579 - RNA, 18 nt, Homo sapiens
acuguaaaaauaacauaa

SEQ ID NO: 2062580 - RNA, 18 nt, Homo sapiens
uuagaugggaggaugaau

SEQ ID NO: 2062581 - RNA, 12 nt, Homo sapiens
cauauguuccau

SEQ ID NO: 2062582 - RNA, 18 nt, Homo sapiens
auggcuaccguuuuacaa

SEQ ID NO: 2062583 - RNA, 17 nt, Homo sapiens
cuuugggacucacuuga

SEQ ID NO: 2062584 - RNA, 23 nt, Homo sapiens
ugaccgcggcagcuccucagcgg

SEQ ID NO: 2062585 - RNA, 19 nt, Homo sapiens
acucuaaagccaagcacuu

SEQ ID NO: 2062586 - RNA, 13 nt, Homo sapiens
cuggaaccuacca

SEQ ID NO: 2062587 - RNA, 17 nt, Homo sapiens
agaugcaggugagccca

SEQ ID NO: 2062588 - RNA, 22 nt, Homo sapiens
aguucauaccuaaguacuguaa

SEQ ID NO: 2062589 - RNA, 14 nt, Homo sapiens
ugucccccuaccca

SEQ ID NO: 2062590 - RNA, 15 nt, Homo sapiens
caucuugaucugugu

SEQ ID NO: 2062591 - RNA, 20 nt, Homo sapiens
gaccgcaggagggcagauuc

SEQ ID NO: 2062592 - RNA, 15 nt, Homo sapiens
cucccucugcucuca

SEQ ID NO: 2062593 - RNA, 19 nt, Homo sapiens
gagacaccauccugagcca

SEQ ID NO: 2062594 - RNA, 18 nt, Homo sapiens
uagaaagcaaagauuauu

SEQ ID NO: 2062595 - RNA, 20 nt, Homo sapiens
ccuuaacuggcccucgggcc

SEQ ID NO: 2062596 - RNA, 15 nt, Homo sapiens
caguggcuuuugccc

SEQ ID NO: 2062597 - RNA, 23 nt, Homo sapiens
ucuguugcaagccccucuuucug

SEQ ID NO: 2062598 - RNA, 15 nt, Homo sapiens
accaaauauaaagag

SEQ ID NO: 2062599 - RNA, 20 nt, Homo sapiens
cuuugaucucgcuguaagau

SEQ ID NO: 2062600 - RNA, 14 nt, Homo sapiens
uuucuaugugacaa

SEQ ID NO: 2062601 - RNA, 14 nt, Homo sapiens
uuuaauugugaauu

SEQ ID NO: 2062602 - RNA, 16 nt, Homo sapiens
agggaccuucaugccc

SEQ ID NO: 2062603 - RNA, 18 nt, Homo sapiens
aauaccccuguuaagcaa

SEQ ID NO: 2062604 - RNA, 12 nt, Homo sapiens
guaguuuugcca

SEQ ID NO: 2062605 - RNA, 22 nt, Homo sapiens
gaccugcucccacaggggccau

SEQ ID NO: 2062606 - RNA, 16 nt, Homo sapiens
gccggccacacugguc

SEQ ID NO: 2062607 - RNA, 18 nt, Homo sapiens
auaaguaaaugagccuuu

SEQ ID NO: 2062608 - RNA, 15 nt, Homo sapiens
cuguggcagaguuac

SEQ ID NO: 2062609 - RNA, 20 nt, Homo sapiens
agcuuggcacuuuaaagcau

SEQ ID NO: 2062610 - RNA, 18 nt, Homo sapiens
ucuggauauggugcaaaa

SEQ ID NO: 2062611 - RNA, 23 nt, Homo sapiens
agacaacgaugaauuucuucuaa

SEQ ID NO: 2062612 - RNA, 14 nt, Homo sapiens
cacacauugcagcu

SEQ ID NO: 2062613 - RNA, 20 nt, Homo sapiens
cccgcuuuuccuuucugcca

SEQ ID NO: 2062614 - RNA, 20 nt, Homo sapiens
uuuaagacagggucucauuc

SEQ ID NO: 2062615 - RNA, 16 nt, Homo sapiens
ggcaguaggaaaaaug

SEQ ID NO: 2062616 - RNA, 20 nt, Homo sapiens
ugggguuugggggcuucccu

SEQ ID NO: 2062617 - RNA, 15 nt, Homo sapiens
cuugcucagugcaaa

SEQ ID NO: 2062618 - RNA, 15 nt, Homo sapiens
ugccaagcuucuuga

SEQ ID NO: 2062619 - RNA, 16 nt, Homo sapiens
uuuuuccuccuugucu

SEQ ID NO: 2062620 - RNA, 13 nt, Homo sapiens
uggacacuguggu

SEQ ID NO: 2062621 - RNA, 11 nt, Homo sapiens
gaugguugguu

SEQ ID NO: 2062622 - RNA, 13 nt, Homo sapiens
aacagaauauucu

SEQ ID NO: 2062623 - RNA, 17 nt, Homo sapiens
acaccuucugugcucau

SEQ ID NO: 2062624 - RNA, 14 nt, Homo sapiens
gaaagccuuaggga

SEQ ID NO: 2062625 - RNA, 20 nt, Homo sapiens
accagacccuggcaucugac

SEQ ID NO: 2062626 - RNA, 14 nt, Homo sapiens
ugccucucacacau

SEQ ID NO: 2062627 - RNA, 13 nt, Homo sapiens
agcugaugacuca

SEQ ID NO: 2062628 - RNA, 14 nt, Homo sapiens
auugcaaaauuugg

SEQ ID NO: 2062629 - RNA, 19 nt, Homo sapiens
ggugcuuugcgacuuguca

SEQ ID NO: 2062630 - RNA, 13 nt, Homo sapiens
acaacugcuccca

SEQ ID NO: 2062631 - RNA, 13 nt, Homo sapiens
gcagcauuuacua

SEQ ID NO: 2062632 - RNA, 17 nt, Homo sapiens
uuguuccaaugccacau

SEQ ID NO: 2062633 - RNA, 17 nt, Homo sapiens
guuuauaucuccuuugu

SEQ ID NO: 2062634 - RNA, 14 nt, Homo sapiens
ugaaaggaaagugc

SEQ ID NO: 2062635 - RNA, 23 nt, Homo sapiens
auuauauuugugugaaaauguga

SEQ ID NO: 2062636 - RNA, 16 nt, Homo sapiens
gacugagaagauguua

SEQ ID NO: 2062637 - RNA, 13 nt, Homo sapiens
aucagccacggag

SEQ ID NO: 2062638 - RNA, 13 nt, Homo sapiens
agcauccacugau

SEQ ID NO: 2062639 - RNA, 18 nt, Homo sapiens
gccuuaaugacauucccc

SEQ ID NO: 2062640 - RNA, 16 nt, Homo sapiens
agggcauugcucagcc

SEQ ID NO: 2062641 - RNA, 16 nt, Homo sapiens
cuuuauacaacagugc

SEQ ID NO: 2062642 - RNA, 22 nt, Homo sapiens
gaauuucuaagcgccuauuguu

SEQ ID NO: 2062643 - RNA, 20 nt, Homo sapiens
ugcaaaugccuccaagccau

SEQ ID NO: 2062644 - RNA, 12 nt, Homo sapiens
gaugaagcuucc

SEQ ID NO: 2062645 - RNA, 13 nt, Homo sapiens
agcagaaugagau

SEQ ID NO: 2062646 - RNA, 20 nt, Homo sapiens
gcaagcccguuaaauaauuc

SEQ ID NO: 2062647 - RNA, 21 nt, Homo sapiens
cuuaguaaguaauaucaaagc

SEQ ID NO: 2062648 - RNA, 18 nt, Homo sapiens
uauuuagauauaacacua

SEQ ID NO: 2062649 - RNA, 24 nt, Homo sapiens
agcagggugaucgcacaaccugca

SEQ ID NO: 2062650 - RNA, 19 nt, Homo sapiens
ggagcaaggcugcuaagug

SEQ ID NO: 2062651 - RNA, 14 nt, Homo sapiens
gaccucuacugccu

SEQ ID NO: 2062652 - RNA, 17 nt, Homo sapiens
ugguuauucaaguauuc

SEQ ID NO: 2062653 - RNA, 15 nt, Homo sapiens
cuaagucaauuccac

SEQ ID NO: 2062654 - RNA, 13 nt, Homo sapiens
agaccuggugcug

SEQ ID NO: 2062655 - RNA, 14 nt, Homo sapiens
gcugagugaaggaa

SEQ ID NO: 2062656 - RNA, 21 nt, Homo sapiens
uccucuguuguagaaaaacua

SEQ ID NO: 2062657 - RNA, 22 nt, Homo sapiens
cuuggaggcccugcacugccag

SEQ ID NO: 2062658 - RNA, 23 nt, Homo sapiens
ggaauaaaaugacacaacuuguc

SEQ ID NO: 2062659 - RNA, 19 nt, Homo sapiens
gaucagacuugauuuacaa

SEQ ID NO: 2062660 - RNA, 19 nt, Homo sapiens
auaaagccuuuaaaaccag

SEQ ID NO: 2062661 - RNA, 17 nt, Homo sapiens
uaaacuuacuagcuuua

SEQ ID NO: 2062662 - RNA, 21 nt, Homo sapiens
ugugcgacuucacaaaaugca

SEQ ID NO: 2062663 - RNA, 15 nt, Homo sapiens
cuuggaacuugccug

SEQ ID NO: 2062664 - RNA, 14 nt, Homo sapiens
aucucaaggaucca

SEQ ID NO: 2062665 - RNA, 21 nt, Homo sapiens
aagauggaagcuuccagucca

SEQ ID NO: 2062666 - RNA, 20 nt, Homo sapiens
uaacaagggcugcaaugccc

SEQ ID NO: 2062667 - RNA, 17 nt, Homo sapiens
guacaagcugauguuuu

SEQ ID NO: 2062668 - RNA, 13 nt, Homo sapiens
aacaauuccacac

SEQ ID NO: 2062669 - RNA, 13 nt, Homo sapiens
acaacuucccaaa

SEQ ID NO: 2062670 - RNA, 15 nt, Homo sapiens
ugagaaacugauuua

SEQ ID NO: 2062671 - RNA, 18 nt, Homo sapiens
gcaggcugggccaugucc

SEQ ID NO: 2062672 - RNA, 19 nt, Homo sapiens
ggcgagcucuggcuuugca

SEQ ID NO: 2062673 - RNA, 15 nt, Homo sapiens
ucccuccaguaccau

SEQ ID NO: 2062674 - RNA, 20 nt, Homo sapiens
uaccucaaagggcaguuuug

SEQ ID NO: 2062675 - RNA, 17 nt, Homo sapiens
gacaccgcucaguauua

SEQ ID NO: 2062676 - RNA, 21 nt, Homo sapiens
gagcuuaaagauaguuacaaa

SEQ ID NO: 2062677 - RNA, 11 nt, Homo sapiens
acucaauggag

SEQ ID NO: 2062678 - RNA, 22 nt, Homo sapiens
auuuucacaugaacauacuggc

SEQ ID NO: 2062679 - RNA, 15 nt, Homo sapiens
ugcagucacauugau

SEQ ID NO: 2062680 - RNA, 15 nt, Homo sapiens
caaggcuacaguaac

SEQ ID NO: 2062681 - RNA, 10 nt, Homo sapiens
uucauuccau

SEQ ID NO: 2062682 - RNA, 15 nt, Homo sapiens
cugccuugcugugaa

SEQ ID NO: 2062683 - RNA, 20 nt, Homo sapiens
acauaaucccgccccagggc

SEQ ID NO: 2062684 - RNA, 13 nt, Homo sapiens
guugaugacuguu

SEQ ID NO: 2062685 - RNA, 19 nt, Homo sapiens
cagcccuggaugguggcca

SEQ ID NO: 2062686 - RNA, 16 nt, Homo sapiens
aacaccaaacucuuaa

SEQ ID NO: 2062687 - RNA, 21 nt, Homo sapiens
cugcagcacuucacuaccaaa

SEQ ID NO: 2062688 - RNA, 22 nt, Homo sapiens
cccagcagccugccagcaguua

SEQ ID NO: 2062689 - RNA, 14 nt, Homo sapiens
gggagcugcagggg

SEQ ID NO: 2062690 - RNA, 13 nt, Homo sapiens
ccaggcuggauac

SEQ ID NO: 2062691 - RNA, 22 nt, Homo sapiens
cuaguugaacaucucacuuugc

SEQ ID NO: 2062692 - RNA, 23 nt, Homo sapiens
cagauaacaaauuuuaagaccaa

SEQ ID NO: 2062693 - RNA, 13 nt, Homo sapiens
gcaugcuuaccuu

SEQ ID NO: 2062694 - RNA, 14 nt, Homo sapiens
agaucccagcucac

SEQ ID NO: 2062695 - RNA, 17 nt, Homo sapiens
agcuucucuccacugaa

SEQ ID NO: 2062696 - RNA, 13 nt, Homo sapiens
uuggcaugccauu

SEQ ID NO: 2062697 - RNA, 20 nt, Homo sapiens
ucguuucugacauaccuuag

SEQ ID NO: 2062698 - RNA, 23 nt, Homo sapiens
aucacgucacugcacuccagcuu

SEQ ID NO: 2062699 - RNA, 18 nt, Homo sapiens
auacuuuuuuucacaguu

SEQ ID NO: 2062700 - RNA, 18 nt, Homo sapiens
uuaugcuccuuaugaugc

SEQ ID NO: 2062701 - RNA, 18 nt, Homo sapiens
cauauuacaacacuuuaa

SEQ ID NO: 2062702 - RNA, 15 nt, Homo sapiens
acugagauggaguga

SEQ ID NO: 2062703 - RNA, 13 nt, Homo sapiens
uaugaaugcagug

SEQ ID NO: 2062704 - RNA, 12 nt, Homo sapiens
gucagcuugcuc

SEQ ID NO: 2062705 - RNA, 11 nt, Homo sapiens
acuuuccugca

SEQ ID NO: 2062706 - RNA, 23 nt, Homo sapiens
ugauaaaagcauuguuugugaua

SEQ ID NO: 2062707 - RNA, 16 nt, Homo sapiens
cuuuauucacaguauc

SEQ ID NO: 2062708 - RNA, 20 nt, Homo sapiens
agggacaccaagccuuggcu

SEQ ID NO: 2062709 - RNA, 12 nt, Homo sapiens
uauuauucuuga

SEQ ID NO: 2062710 - RNA, 16 nt, Homo sapiens
aggcuucuauguccaa

SEQ ID NO: 2062711 - RNA, 13 nt, Homo sapiens
aguuaaauugcac

SEQ ID NO: 2062712 - RNA, 20 nt, Homo sapiens
auucuaccgugguacacagu

SEQ ID NO: 2062713 - RNA, 15 nt, Homo sapiens
ggaccagcccugaga

SEQ ID NO: 2062714 - RNA, 19 nt, Homo sapiens
uaagcugugguguguuccc

SEQ ID NO: 2062715 - RNA, 17 nt, Homo sapiens
aaacagcugcccugugu

SEQ ID NO: 2062716 - RNA, 18 nt, Homo sapiens
uccccaugggcacagugg

SEQ ID NO: 2062717 - RNA, 14 nt, Homo sapiens
aaaagcagcuacca

SEQ ID NO: 2062718 - RNA, 22 nt, Homo sapiens
uuucugcugauuaucacacauc

SEQ ID NO: 2062719 - RNA, 16 nt, Homo sapiens
auuugugucacaaaga

SEQ ID NO: 2062720 - RNA, 14 nt, Homo sapiens
auuaguuucaggca

SEQ ID NO: 2062721 - RNA, 15 nt, Homo sapiens
cuuaugcaugaaaug

SEQ ID NO: 2062722 - RNA, 20 nt, Homo sapiens
ccagugaauuuggucucucc

SEQ ID NO: 2062723 - RNA, 14 nt, Homo sapiens
ugugaaauuuacau

SEQ ID NO: 2062724 - RNA, 12 nt, Homo sapiens
uuuacagcacug

SEQ ID NO: 2062725 - RNA, 22 nt, Homo sapiens
cucauucaucuugcaagcaaau

SEQ ID NO: 2062726 - RNA, 15 nt, Homo sapiens
auguucugacauuaa

SEQ ID NO: 2062727 - RNA, 15 nt, Homo sapiens
ggcucugggugcagu

SEQ ID NO: 2062728 - RNA, 17 nt, Homo sapiens
cucaucuucacagauug

SEQ ID NO: 2062729 - RNA, 13 nt, Homo sapiens
augaucucccugc

SEQ ID NO: 2062730 - RNA, 13 nt, Homo sapiens
ccuucacauuuaa

SEQ ID NO: 2062731 - RNA, 15 nt, Homo sapiens
caagaucccauuuga

SEQ ID NO: 2062732 - RNA, 14 nt, Homo sapiens
acaccuccucucac

SEQ ID NO: 2062733 - RNA, 17 nt, Homo sapiens
gaaaacccacccuacca

SEQ ID NO: 2062734 - RNA, 12 nt, Homo sapiens
guuuaaagucaa

SEQ ID NO: 2062735 - RNA, 20 nt, Homo sapiens
ucccagcaugcugagauuac

SEQ ID NO: 2062736 - RNA, 17 nt, Homo sapiens
cauucacagccaggaga

SEQ ID NO: 2062737 - RNA, 15 nt, Homo sapiens
cucagcagacaucca

SEQ ID NO: 2062738 - RNA, 20 nt, Homo sapiens
cacacuguaaauauccacag

SEQ ID NO: 2062739 - RNA, 22 nt, Homo sapiens
agugaccauuauucacaggugg

SEQ ID NO: 2062740 - RNA, 23 nt, Homo sapiens
accaagguuuugaaaucccauca

SEQ ID NO: 2062741 - RNA, 15 nt, Homo sapiens
gugaguuaucacuuc

SEQ ID NO: 2062742 - RNA, 21 nt, Homo sapiens
auaauaaaucugccugcaacu

SEQ ID NO: 2062743 - RNA, 23 nt, Homo sapiens
gcuuaguagagcuuuuugcaugu

SEQ ID NO: 2062744 - RNA, 13 nt, Homo sapiens
agauuugccuuau

SEQ ID NO: 2062745 - RNA, 17 nt, Homo sapiens
auugacagaacacccaa

SEQ ID NO: 2062746 - RNA, 15 nt, Homo sapiens
cugguauguugcacg

SEQ ID NO: 2062747 - RNA, 13 nt, Homo sapiens
ggaccacugggua

SEQ ID NO: 2062748 - RNA, 19 nt, Homo sapiens
uaaauaauguuaucugugu

SEQ ID NO: 2062749 - RNA, 17 nt, Homo sapiens
cuacagaaagagcguca

SEQ ID NO: 2062750 - RNA, 15 nt, Homo sapiens
uauucauauauauac

SEQ ID NO: 2062751 - RNA, 23 nt, Homo sapiens
aaacaaaauuuaugucauuuuca

SEQ ID NO: 2062752 - RNA, 23 nt, Homo sapiens
cgguuugggagagaccauugcau

SEQ ID NO: 2062753 - RNA, 23 nt, Homo sapiens
ggccuuucccacugguccaucug

SEQ ID NO: 2062754 - RNA, 16 nt, Homo sapiens
uaugcaaagucucuca

SEQ ID NO: 2062755 - RNA, 16 nt, Homo sapiens
gaaaacuucauucuug

SEQ ID NO: 2062756 - RNA, 15 nt, Homo sapiens
uuucugaacucugac

SEQ ID NO: 2062757 - RNA, 13 nt, Homo sapiens
auuucugccaaua

SEQ ID NO: 2062758 - RNA, 13 nt, Homo sapiens
auugcugccaaga

SEQ ID NO: 2062759 - RNA, 13 nt, Homo sapiens
ccuagcuguccca

SEQ ID NO: 2062760 - RNA, 16 nt, Homo sapiens
uagcuagcgugugcca

SEQ ID NO: 2062761 - RNA, 19 nt, Homo sapiens
gugugcauugcugugaauu

SEQ ID NO: 2062762 - RNA, 14 nt, Homo sapiens
caaacuccaagaca

SEQ ID NO: 2062763 - RNA, 22 nt, Homo sapiens
ugaaguccuucaccucacugaa

SEQ ID NO: 2062764 - RNA, 18 nt, Homo sapiens
gugguggcacacaccagu

SEQ ID NO: 2062765 - RNA, 16 nt, Homo sapiens
ucacuggcaugguggu

SEQ ID NO: 2062766 - RNA, 15 nt, Homo sapiens
ucucuuaaucacaag

SEQ ID NO: 2062767 - RNA, 14 nt, Homo sapiens
gaagccuugcacua

SEQ ID NO: 2062768 - RNA, 19 nt, Homo sapiens
agagaugucaaaaugugau

SEQ ID NO: 2062769 - RNA, 19 nt, Homo sapiens
ggaggcacacuuucuggca

SEQ ID NO: 2062770 - RNA, 21 nt, Homo sapiens
ccaguucagacacuaccccau

SEQ ID NO: 2062771 - RNA, 19 nt, Homo sapiens
auuuuccugagaccucaau

SEQ ID NO: 2062772 - RNA, 19 nt, Homo sapiens
guuucacuguguuagccac

SEQ ID NO: 2062773 - RNA, 13 nt, Homo sapiens
acaccacgaauuu

SEQ ID NO: 2062774 - RNA, 18 nt, Homo sapiens
uaaaauuaucaauaucua

SEQ ID NO: 2062775 - RNA, 20 nt, Homo sapiens
uuccuaagacugcugcugaa

SEQ ID NO: 2062776 - RNA, 17 nt, Homo sapiens
gacucugcuuaaacaaa

SEQ ID NO: 2062777 - RNA, 20 nt, Homo sapiens
gacuauggauaaacuaaaca

SEQ ID NO: 2062778 - RNA, 23 nt, Homo sapiens
uuuguuguaaaaagaaaaaccac

SEQ ID NO: 2062779 - RNA, 14 nt, Homo sapiens
auguucauugccac

SEQ ID NO: 2062780 - RNA, 16 nt, Homo sapiens
uuauuaauuaaaccag

SEQ ID NO: 2062781 - RNA, 21 nt, Homo sapiens
gguggccacuucauuccagca

SEQ ID NO: 2062782 - RNA, 14 nt, Homo sapiens
gaaauguaugugcu

SEQ ID NO: 2062783 - RNA, 18 nt, Homo sapiens
aguccuaacuuccugugc

SEQ ID NO: 2062784 - RNA, 17 nt, Homo sapiens
cugcaaaggaaaagcca

SEQ ID NO: 2062785 - RNA, 20 nt, Homo sapiens
auguguucucugaucugccc

SEQ ID NO: 2062786 - RNA, 14 nt, Homo sapiens
ccaaauugcagcuu

SEQ ID NO: 2062787 - RNA, 16 nt, Homo sapiens
gcacaggagcuaccug

SEQ ID NO: 2062788 - RNA, 18 nt, Homo sapiens
uacaaccuuguugcuuua

SEQ ID NO: 2062789 - RNA, 12 nt, Homo sapiens
guaaaagccauc

SEQ ID NO: 2062790 - RNA, 13 nt, Homo sapiens
agggagcacuuua

SEQ ID NO: 2062791 - RNA, 19 nt, Homo sapiens
caguuuaaucauugccugg

SEQ ID NO: 2062792 - RNA, 21 nt, Homo sapiens
uuucaaagagguauauuugaa

SEQ ID NO: 2062793 - RNA, 17 nt, Homo sapiens
uacccuuggugccuaau

SEQ ID NO: 2062794 - RNA, 13 nt, Homo sapiens
cagcgaacagccu

SEQ ID NO: 2062795 - RNA, 19 nt, Homo sapiens
cguggcaacuagauaucau

SEQ ID NO: 2062796 - RNA, 23 nt, Homo sapiens
uuuuauaugucuaauaucuuaau

SEQ ID NO: 2062797 - RNA, 16 nt, Homo sapiens
uggaacauuugauauu

SEQ ID NO: 2062798 - RNA, 22 nt, Homo sapiens
uggauugggacgcacagugcag

SEQ ID NO: 2062799 - RNA, 13 nt, Homo sapiens
gcuuccuguuucu

SEQ ID NO: 2062800 - RNA, 17 nt, Homo sapiens
uggcagggcgugaggaa

SEQ ID NO: 2062801 - RNA, 16 nt, Homo sapiens
uggaacucaaggaaau

SEQ ID NO: 2062802 - RNA, 23 nt, Homo sapiens
caucaauugaauggucagcguug

SEQ ID NO: 2062803 - RNA, 15 nt, Homo sapiens
caaggaugcauacau

SEQ ID NO: 2062804 - RNA, 22 nt, Homo sapiens
auuccaugcacucucucucugu

SEQ ID NO: 2062805 - RNA, 16 nt, Homo sapiens
ugccaggaagggccau

SEQ ID NO: 2062806 - RNA, 23 nt, Homo sapiens
ucuuuauuauuccuagucuuucc

SEQ ID NO: 2062807 - RNA, 13 nt, Homo sapiens
gaacacugcuuga

SEQ ID NO: 2062808 - RNA, 12 nt, Homo sapiens
ggaccacuccag

SEQ ID NO: 2062809 - RNA, 16 nt, Homo sapiens
ccuuuggggacuuuuc

SEQ ID NO: 2062810 - RNA, 20 nt, Homo sapiens
cuggcaagucuuccaugacc

SEQ ID NO: 2062811 - RNA, 20 nt, Homo sapiens
uucugucuggacuuuccaga

SEQ ID NO: 2062812 - RNA, 23 nt, Homo sapiens
uauguaaaguagaauaagccuuc

SEQ ID NO: 2062813 - RNA, 13 nt, Homo sapiens
ugcucacucagga

SEQ ID NO: 2062814 - RNA, 16 nt, Homo sapiens
ucacagugaacacuca

SEQ ID NO: 2062815 - RNA, 13 nt, Homo sapiens
gcugaucucaggg

SEQ ID NO: 2062816 - RNA, 20 nt, Homo sapiens
agaugccuucuccagacaaa

SEQ ID NO: 2062817 - RNA, 19 nt, Homo sapiens
caacuaucaauucuugaga

SEQ ID NO: 2062818 - RNA, 23 nt, Homo sapiens
uguaucuucugcagacacugugg

SEQ ID NO: 2062819 - RNA, 12 nt, Homo sapiens
aaagcauaacac

SEQ ID NO: 2062820 - RNA, 23 nt, Homo sapiens
uuccauaugugggugucagucag

SEQ ID NO: 2062821 - RNA, 13 nt, Homo sapiens
ggcugaagugcau

SEQ ID NO: 2062822 - RNA, 19 nt, Homo sapiens
agcaggcagcgccaagugc

SEQ ID NO: 2062823 - RNA, 18 nt, Homo sapiens
gcugauguuuauguacug

SEQ ID NO: 2062824 - RNA, 16 nt, Homo sapiens
ccuuagccaugaucug

SEQ ID NO: 2062825 - RNA, 13 nt, Homo sapiens
cauuuaccaaauu

SEQ ID NO: 2062826 - RNA, 19 nt, Homo sapiens
auuccucuaagaucuugcc

SEQ ID NO: 2062827 - RNA, 14 nt, Homo sapiens
aaaugucacuguga

SEQ ID NO: 2062828 - RNA, 19 nt, Homo sapiens
ugcaagaauuaaaacugag

SEQ ID NO: 2062829 - RNA, 20 nt, Homo sapiens
uucccuauggguucugugac

SEQ ID NO: 2062830 - RNA, 19 nt, Homo sapiens
cuucuccguacaccccagc

SEQ ID NO: 2062831 - RNA, 23 nt, Homo sapiens
agcaucuaguuucccuggugccc

SEQ ID NO: 2062832 - RNA, 14 nt, Homo sapiens
gaagaaaaaauaca

SEQ ID NO: 2062833 - RNA, 16 nt, Homo sapiens
cuguaccacaucugcu

SEQ ID NO: 2062834 - RNA, 22 nt, Homo sapiens
cauccccaacugcgacugugac

SEQ ID NO: 2062835 - RNA, 13 nt, Homo sapiens
ccaagcaggcaaa

SEQ ID NO: 2062836 - RNA, 16 nt, Homo sapiens
ccaagcugcugggauu

SEQ ID NO: 2062837 - RNA, 19 nt, Homo sapiens
gaaagguuggccuuacugu

SEQ ID NO: 2062838 - RNA, 21 nt, Homo sapiens
agccaccuggcagggcucaca

SEQ ID NO: 2062839 - RNA, 20 nt, Homo sapiens
gcccagaacuggacucagga

SEQ ID NO: 2062840 - RNA, 21 nt, Homo sapiens
uacagaaaagacaaacaguag

SEQ ID NO: 2062841 - RNA, 14 nt, Homo sapiens
cuccauacuuugga

SEQ ID NO: 2062842 - RNA, 23 nt, Homo sapiens
uucuucacacuaucaacacugca

SEQ ID NO: 2062843 - RNA, 22 nt, Homo sapiens
uguauugcuccucccacuucuc

SEQ ID NO: 2062844 - RNA, 17 nt, Homo sapiens
acuuaugaaacuugaaa

SEQ ID NO: 2062845 - RNA, 20 nt, Homo sapiens
aaauucuauaggaacauaug

SEQ ID NO: 2062846 - RNA, 22 nt, Homo sapiens
gcaggcccccggggaggggcca

SEQ ID NO: 2062847 - RNA, 22 nt, Homo sapiens
acgcacgcucgcugccaucacc

SEQ ID NO: 2062848 - RNA, 17 nt, Homo sapiens
cuguaaaugacacuuuc

SEQ ID NO: 2062849 - RNA, 21 nt, Homo sapiens
cuuguaaauguguuggacaaa

SEQ ID NO: 2062850 - RNA, 21 nt, Homo sapiens
ucgcagacuuaagcguacaaa

SEQ ID NO: 2062851 - RNA, 19 nt, Homo sapiens
acacguaaugaaacuugga

SEQ ID NO: 2062852 - RNA, 17 nt, Homo sapiens
cauucgggccauuuccg

SEQ ID NO: 2062853 - RNA, 23 nt, Homo sapiens
gaaacuauugugcacaagucuuu

SEQ ID NO: 2062854 - RNA, 18 nt, Homo sapiens
uccugggucuaccacuca

SEQ ID NO: 2062855 - RNA, 21 nt, Homo sapiens
aaaggaacucuagaagaccaa

SEQ ID NO: 2062856 - RNA, 14 nt, Homo sapiens
agucucguugcuca

SEQ ID NO: 2062857 - RNA, 22 nt, Homo sapiens
auuuccauaccauuguggaauu

SEQ ID NO: 2062858 - RNA, 21 nt, Homo sapiens
aaacaaacauacccaucugca

SEQ ID NO: 2062859 - RNA, 12 nt, Homo sapiens
aaauggggugaa

SEQ ID NO: 2062860 - RNA, 21 nt, Homo sapiens
acguacaaaauccagcuauga

SEQ ID NO: 2062861 - RNA, 21 nt, Homo sapiens
uuuggcaaacucuccaccaca

SEQ ID NO: 2062862 - RNA, 17 nt, Homo sapiens
uccuucuaaucugcuau

SEQ ID NO: 2062863 - RNA, 16 nt, Homo sapiens
auguaguuugcacuua

SEQ ID NO: 2062864 - RNA, 14 nt, Homo sapiens
uccccuccaaguga

SEQ ID NO: 2062865 - RNA, 17 nt, Homo sapiens
acuagauucuugucaca

SEQ ID NO: 2062866 - RNA, 23 nt, Homo sapiens
cuccagucucaucuaugucauau

SEQ ID NO: 2062867 - RNA, 12 nt, Homo sapiens
cucugaagucac

SEQ ID NO: 2062868 - RNA, 14 nt, Homo sapiens
cccagagaagccaa

SEQ ID NO: 2062869 - RNA, 11 nt, Homo sapiens
ugcagccagaa

SEQ ID NO: 2062870 - RNA, 12 nt, Homo sapiens
augcaugcacag

SEQ ID NO: 2062871 - RNA, 12 nt, Homo sapiens
auggaugcacac

SEQ ID NO: 2062872 - RNA, 18 nt, Homo sapiens
caccgcugccagcacaga

SEQ ID NO: 2062873 - RNA, 15 nt, Homo sapiens
gugucuguuucagaa

SEQ ID NO: 2062874 - RNA, 18 nt, Homo sapiens
ucauagcuaauuuuugca

SEQ ID NO: 2062875 - RNA, 16 nt, Homo sapiens
cuuucaggcuaccuuu

SEQ ID NO: 2062876 - RNA, 22 nt, Homo sapiens
uggacagugggcaucagcagca

SEQ ID NO: 2062877 - RNA, 20 nt, Homo sapiens
ucaucccucccaaugccacc

SEQ ID NO: 2062878 - RNA, 20 nt, Homo sapiens
agacccauuuccuugugcuc

SEQ ID NO: 2062879 - RNA, 17 nt, Homo sapiens
agaugcugauguucagu

SEQ ID NO: 2062880 - RNA, 15 nt, Homo sapiens
caaugggauguauga

SEQ ID NO: 2062881 - RNA, 12 nt, Homo sapiens
agauccaaagac

SEQ ID NO: 2062882 - RNA, 18 nt, Homo sapiens
gaggacagcucuggggua

SEQ ID NO: 2062883 - RNA, 19 nt, Homo sapiens
acugcugcccagccuccaa

SEQ ID NO: 2062884 - RNA, 18 nt, Homo sapiens
gaucucucuagcuuuguc

SEQ ID NO: 2062885 - RNA, 17 nt, Homo sapiens
cgauuuuguaucugcag

SEQ ID NO: 2062886 - RNA, 14 nt, Homo sapiens
agaggccuuguccc

SEQ ID NO: 2062887 - RNA, 23 nt, Homo sapiens
aggucccgggcuuagugugagca

SEQ ID NO: 2062888 - RNA, 17 nt, Homo sapiens
aacugucaguucauccu

SEQ ID NO: 2062889 - RNA, 23 nt, Homo sapiens
uuccuccucacccugccggguag

SEQ ID NO: 2062890 - RNA, 14 nt, Homo sapiens
cucagcuucucaaa

SEQ ID NO: 2062891 - RNA, 23 nt, Homo sapiens
aaugauuaacaguuaugugguca

SEQ ID NO: 2062892 - RNA, 20 nt, Homo sapiens
aucugcuucauccaauguga

SEQ ID NO: 2062893 - RNA, 11 nt, Homo sapiens
uaaacauucau

SEQ ID NO: 2062894 - RNA, 21 nt, Homo sapiens
aaauacuugcuccauuuacaa

SEQ ID NO: 2062895 - RNA, 16 nt, Homo sapiens
aucugucucauccaaa

SEQ ID NO: 2062896 - RNA, 19 nt, Homo sapiens
guuaauuuugaagugcugu

SEQ ID NO: 2062897 - RNA, 16 nt, Homo sapiens
cccaugcuuaucccuc

SEQ ID NO: 2062898 - RNA, 19 nt, Homo sapiens
uacaaugaaguuaagguua

SEQ ID NO: 2062899 - RNA, 19 nt, Homo sapiens
gaaacaugucuugacuguu

SEQ ID NO: 2062900 - RNA, 14 nt, Homo sapiens
uauugaaucuuaau

SEQ ID NO: 2062901 - RNA, 22 nt, Homo sapiens
caggcaugugccacccacccaa

SEQ ID NO: 2062902 - RNA, 22 nt, Homo sapiens
ucaccccaggcucaacugagga

SEQ ID NO: 2062903 - RNA, 22 nt, Homo sapiens
gaagcuccggcagaagcagcug

SEQ ID NO: 2062904 - RNA, 15 nt, Homo sapiens
uccugguuuccacug

SEQ ID NO: 2062905 - RNA, 13 nt, Homo sapiens
uggcacugagaaa

SEQ ID NO: 2062906 - RNA, 20 nt, Homo sapiens
ccuugguuccuccccgaaaa

SEQ ID NO: 2062907 - RNA, 18 nt, Homo sapiens
augcuguuaaaacuacuu

SEQ ID NO: 2062908 - RNA, 19 nt, Homo sapiens
auucccaccccacuucugc

SEQ ID NO: 2062909 - RNA, 18 nt, Homo sapiens
gucagcagaugccaguga

SEQ ID NO: 2062910 - RNA, 20 nt, Homo sapiens
uauacuuguaauuauggagu

SEQ ID NO: 2062911 - RNA, 23 nt, Homo sapiens
uauggacgugugugaaugguugu

SEQ ID NO: 2062912 - RNA, 17 nt, Homo sapiens
acucuggggcucaagca

SEQ ID NO: 2062913 - RNA, 13 nt, Homo sapiens
uaggacuuuuugu

SEQ ID NO: 2062914 - RNA, 21 nt, Homo sapiens
aaccuaccuuauagagcacaa

SEQ ID NO: 2062915 - RNA, 13 nt, Homo sapiens
gugguauggggcu

SEQ ID NO: 2062916 - RNA, 17 nt, Homo sapiens
ugcagguuugaccagga

SEQ ID NO: 2062917 - RNA, 14 nt, Homo sapiens
gaccguacucucac

SEQ ID NO: 2062918 - RNA, 15 nt, Homo sapiens
cacuuuguccauuug

SEQ ID NO: 2062919 - RNA, 23 nt, Homo sapiens
cgagccccucggcucuggaggca

SEQ ID NO: 2062920 - RNA, 15 nt, Homo sapiens
aaguuaaugaaauaa

SEQ ID NO: 2062921 - RNA, 14 nt, Homo sapiens
cacaauacaguauu

SEQ ID NO: 2062922 - RNA, 16 nt, Homo sapiens
ucacagagugagacuc

SEQ ID NO: 2062923 - RNA, 22 nt, Homo sapiens
ccuuaguccgcaaguucaggga

SEQ ID NO: 2062924 - RNA, 14 nt, Homo sapiens
aagcaacuagcugg

SEQ ID NO: 2062925 - RNA, 17 nt, Homo sapiens
ccuuucaggaagggaga

SEQ ID NO: 2062926 - RNA, 19 nt, Homo sapiens
cuuaacuuaaaagaacaua

SEQ ID NO: 2062927 - RNA, 19 nt, Homo sapiens
aauugugcuggucauacau

SEQ ID NO: 2062928 - RNA, 16 nt, Homo sapiens
ggggcugcuccagugg

SEQ ID NO: 2062929 - RNA, 13 nt, Homo sapiens
uuauugagugcca

SEQ ID NO: 2062930 - RNA, 21 nt, Homo sapiens
cuaacccagcaguaacuggaa

SEQ ID NO: 2062931 - RNA, 16 nt, Homo sapiens
auccccuggacuggga

SEQ ID NO: 2062932 - RNA, 14 nt, Homo sapiens
gccugcuucuucuc

SEQ ID NO: 2062933 - RNA, 14 nt, Homo sapiens
ucaaaacucaguau

SEQ ID NO: 2062934 - RNA, 16 nt, Homo sapiens
cugaagggacuagcua

SEQ ID NO: 2062935 - RNA, 19 nt, Homo sapiens
cguccuuagaauacuguau

SEQ ID NO: 2062936 - RNA, 18 nt, Homo sapiens
caccugccccaggcucag

SEQ ID NO: 2062937 - RNA, 13 nt, Homo sapiens
gaguggccagcuu

SEQ ID NO: 2062938 - RNA, 11 nt, Homo sapiens
gagcacuguga

SEQ ID NO: 2062939 - RNA, 15 nt, Homo sapiens
cacaaccacauguau

SEQ ID NO: 2062940 - RNA, 16 nt, Homo sapiens
cuugaaaaacuuacaa

SEQ ID NO: 2062941 - RNA, 17 nt, Homo sapiens
aauaagaucagacucug

SEQ ID NO: 2062942 - RNA, 21 nt, Homo sapiens
cagacucuuuuuguaccuggu

SEQ ID NO: 2062943 - RNA, 13 nt, Homo sapiens
gucaagcauguau

SEQ ID NO: 2062944 - RNA, 18 nt, Homo sapiens
gacccagaaaggacacaa

SEQ ID NO: 2062945 - RNA, 14 nt, Homo sapiens
gauuauucaucaaa

SEQ ID NO: 2062946 - RNA, 21 nt, Homo sapiens
cacaauuaacuccguuuccaa

SEQ ID NO: 2062947 - RNA, 14 nt, Homo sapiens
aaacugacuucuuu

SEQ ID NO: 2062948 - RNA, 15 nt, Homo sapiens
gccugcagagugcaa

SEQ ID NO: 2062949 - RNA, 13 nt, Homo sapiens
gcugugggcugcu

SEQ ID NO: 2062950 - RNA, 19 nt, Homo sapiens
auucucucugaacacacau

SEQ ID NO: 2062951 - RNA, 19 nt, Homo sapiens
ugcuaccccuacaucaucu

SEQ ID NO: 2062952 - RNA, 20 nt, Homo sapiens
gcccugggcucgucuuugca

SEQ ID NO: 2062953 - RNA, 13 nt, Homo sapiens
cugcucacagucc

SEQ ID NO: 2062954 - RNA, 22 nt, Homo sapiens
uggagccuuaguugagauuuca

SEQ ID NO: 2062955 - RNA, 20 nt, Homo sapiens
gauaacuuccuucacaucuc

SEQ ID NO: 2062956 - RNA, 20 nt, Homo sapiens
caguaaaaggacagagauua

SEQ ID NO: 2062957 - RNA, 17 nt, Homo sapiens
gucagucugcuuagaaa

SEQ ID NO: 2062958 - RNA, 16 nt, Homo sapiens
ucaaccucuacagggu

SEQ ID NO: 2062959 - RNA, 17 nt, Homo sapiens
agcacccugggugccau

SEQ ID NO: 2062960 - RNA, 16 nt, Homo sapiens
ucuuuuuuaugcagaa

SEQ ID NO: 2062961 - RNA, 14 nt, Homo sapiens
ccugcugagcacag

SEQ ID NO: 2062962 - RNA, 22 nt, Homo sapiens
ucaggugggguggagucccaga

SEQ ID NO: 2062963 - RNA, 15 nt, Homo sapiens
auaaauggguguaua

SEQ ID NO: 2062964 - RNA, 23 nt, Homo sapiens
ggaaaacuacaaacguuugacaa

SEQ ID NO: 2062965 - RNA, 17 nt, Homo sapiens
caacagcaaaucacgac

SEQ ID NO: 2062966 - RNA, 12 nt, Homo sapiens
gucccucugcag

SEQ ID NO: 2062967 - RNA, 21 nt, Homo sapiens
aguuguauuuugacaaaaaug

SEQ ID NO: 2062968 - RNA, 11 nt, Homo sapiens
cucugagauuu

SEQ ID NO: 2062969 - RNA, 20 nt, Homo sapiens
acuccagcaucgucucaugu

SEQ ID NO: 2062970 - RNA, 14 nt, Homo sapiens
ggcuggccaaggug

SEQ ID NO: 2062971 - RNA, 14 nt, Homo sapiens
gggccugcugcuga

SEQ ID NO: 2062972 - RNA, 18 nt, Homo sapiens
gggcucugacccaagugg

SEQ ID NO: 2062973 - RNA, 14 nt, Homo sapiens
ucugucuguggcaa

SEQ ID NO: 2062974 - RNA, 15 nt, Homo sapiens
aguuguaucacaaag

SEQ ID NO: 2062975 - RNA, 15 nt, Homo sapiens
auucuccugccucag

SEQ ID NO: 2062976 - RNA, 16 nt, Homo sapiens
uaguggggucagggcu

SEQ ID NO: 2062977 - RNA, 15 nt, Homo sapiens
caccgugugccauag

SEQ ID NO: 2062978 - RNA, 14 nt, Homo sapiens
cuggacagggcuuu

SEQ ID NO: 2062979 - RNA, 23 nt, Homo sapiens
ucuugaggaauaaaugccuuuau

SEQ ID NO: 2062980 - RNA, 18 nt, Homo sapiens
caugggguagggugagaa

SEQ ID NO: 2062981 - RNA, 13 nt, Homo sapiens
cucagagcacaga

SEQ ID NO: 2062982 - RNA, 20 nt, Homo sapiens
ucacccaggcacugggcaag

SEQ ID NO: 2062983 - RNA, 11 nt, Homo sapiens
ggugauggugu

SEQ ID NO: 2062984 - RNA, 15 nt, Homo sapiens
ucccaugugauuuaa

SEQ ID NO: 2062985 - RNA, 17 nt, Homo sapiens
ugacuuuauugcaucug

SEQ ID NO: 2062986 - RNA, 16 nt, Homo sapiens
uucgcugccaggacac

SEQ ID NO: 2062987 - RNA, 15 nt, Homo sapiens
aggagaacugugcuc

SEQ ID NO: 2062988 - RNA, 22 nt, Homo sapiens
cacccauuuuugcucuauggga

SEQ ID NO: 2062989 - RNA, 20 nt, Homo sapiens
cugaauuuggccugcacuaa

SEQ ID NO: 2062990 - RNA, 18 nt, Homo sapiens
acccacagccccugcugg

SEQ ID NO: 2062991 - RNA, 16 nt, Homo sapiens
ugcccggccuaugauu

SEQ ID NO: 2062992 - RNA, 21 nt, Homo sapiens
accuguuuuuuuuucauuuau

SEQ ID NO: 2062993 - RNA, 14 nt, Homo sapiens
uauuaucaccagca

SEQ ID NO: 2062994 - RNA, 14 nt, Homo sapiens
ucagaacacauucu

SEQ ID NO: 2062995 - RNA, 20 nt, Homo sapiens
guaucaugcuucuacuccau

SEQ ID NO: 2062996 - RNA, 21 nt, Homo sapiens
uguaaauugagauuuaauucc

SEQ ID NO: 2062997 - RNA, 15 nt, Homo sapiens
aaccacaucaauauu

SEQ ID NO: 2062998 - RNA, 11 nt, Homo sapiens
cucuguaaaac

SEQ ID NO: 2062999 - RNA, 23 nt, Homo sapiens
agagaauguguguguguggcagg

SEQ ID NO: 2063000 - RNA, 20 nt, Homo sapiens
ucucuuuacuucccaguaua

SEQ ID NO: 2063001 - RNA, 13 nt, Homo sapiens
gaagccugcugau

SEQ ID NO: 2063002 - RNA, 16 nt, Homo sapiens
cauucuggaugggcuu

SEQ ID NO: 2063003 - RNA, 22 nt, Homo sapiens
gauuggcaggugugggcuccca

SEQ ID NO: 2063004 - RNA, 12 nt, Homo sapiens
caaaggugcuaa

SEQ ID NO: 2063005 - RNA, 16 nt, Homo sapiens
aggaugguucugugac

SEQ ID NO: 2063006 - RNA, 17 nt, Homo sapiens
uaaaacaagugugaugc

SEQ ID NO: 2063007 - RNA, 13 nt, Homo sapiens
acucuuuguauga

SEQ ID NO: 2063008 - RNA, 13 nt, Homo sapiens
aauguuugucuca

SEQ ID NO: 2063009 - RNA, 14 nt, Homo sapiens
caaauacaauagag

SEQ ID NO: 2063010 - RNA, 19 nt, Homo sapiens
ugcaugucgcacaauguuu

SEQ ID NO: 2063011 - RNA, 15 nt, Homo sapiens
cuuuguguccagagu

SEQ ID NO: 2063012 - RNA, 22 nt, Homo sapiens
caaagacaauuuauaauuugaa

SEQ ID NO: 2063013 - RNA, 23 nt, Homo sapiens
uaugcaacucaucuucacagauu

SEQ ID NO: 2063014 - RNA, 15 nt, Homo sapiens
aagaggcuccagaaa

SEQ ID NO: 2063015 - RNA, 20 nt, Homo sapiens
ccagcucaggcuacugccac

SEQ ID NO: 2063016 - RNA, 15 nt, Homo sapiens
cuggggaguccucau

SEQ ID NO: 2063017 - RNA, 21 nt, Homo sapiens
gccggacacagcaccgugcca

SEQ ID NO: 2063018 - RNA, 12 nt, Homo sapiens
uaguuugcaaac

SEQ ID NO: 2063019 - RNA, 21 nt, Homo sapiens
acuucacuaccaagcagcuca

SEQ ID NO: 2063020 - RNA, 20 nt, Homo sapiens
gccaucaccuaggacugacu

SEQ ID NO: 2063021 - RNA, 15 nt, Homo sapiens
ggggacugucuuuca

SEQ ID NO: 2063022 - RNA, 15 nt, Homo sapiens
cccuacccuugucca

SEQ ID NO: 2063023 - RNA, 21 nt, Homo sapiens
acaaaguuuugcucuugucac

SEQ ID NO: 2063024 - RNA, 15 nt, Homo sapiens
uguucacugcuccuu

SEQ ID NO: 2063025 - RNA, 20 nt, Homo sapiens
aaauauuauugguguuuacc

SEQ ID NO: 2063026 - RNA, 16 nt, Homo sapiens
ucccuguguggaccau

SEQ ID NO: 2063027 - RNA, 23 nt, Homo sapiens
cauggccuuggcaggcugcugga

SEQ ID NO: 2063028 - RNA, 20 nt, Homo sapiens
ugauuuaccacuuaugcaua

SEQ ID NO: 2063029 - RNA, 15 nt, Homo sapiens
gggaggcaggaucca

SEQ ID NO: 2063030 - RNA, 16 nt, Homo sapiens
uuuacuacugcaaguu

SEQ ID NO: 2063031 - RNA, 23 nt, Homo sapiens
cggagggugacccauuucaggag

SEQ ID NO: 2063032 - RNA, 19 nt, Homo sapiens
ggcuuccagagaguccucu

SEQ ID NO: 2063033 - RNA, 15 nt, Homo sapiens
aaacuggauacugua

SEQ ID NO: 2063034 - RNA, 19 nt, Homo sapiens
uccuucaacuggcuacuga

SEQ ID NO: 2063035 - RNA, 12 nt, Homo sapiens
caguuguuaaaa

SEQ ID NO: 2063036 - RNA, 12 nt, Homo sapiens
caagacaccaaa

SEQ ID NO: 2063037 - RNA, 17 nt, Homo sapiens
cuggccugaacugagga

SEQ ID NO: 2063038 - RNA, 18 nt, Homo sapiens
cuaugaagccaacugaca

SEQ ID NO: 2063039 - RNA, 23 nt, Homo sapiens
gccuuagggugcugagugccuga

SEQ ID NO: 2063040 - RNA, 19 nt, Homo sapiens
aggaaauauacuuuuacaa

SEQ ID NO: 2063041 - RNA, 19 nt, Homo sapiens
gcaauucagcaaagaacaa

SEQ ID NO: 2063042 - RNA, 19 nt, Homo sapiens
gcagugcuugaaugaaguu

SEQ ID NO: 2063043 - RNA, 21 nt, Homo sapiens
cugccgacggagccacugggg

SEQ ID NO: 2063044 - RNA, 20 nt, Homo sapiens
ucugguagcuccacaagaga

SEQ ID NO: 2063045 - RNA, 22 nt, Homo sapiens
agcacaaagcccauagcacugg

SEQ ID NO: 2063046 - RNA, 16 nt, Homo sapiens
cuucgcagccuagaua

SEQ ID NO: 2063047 - RNA, 23 nt, Homo sapiens
ccaugccucuccaacaucuucaa

SEQ ID NO: 2063048 - RNA, 14 nt, Homo sapiens
acacgcucaguuga

SEQ ID NO: 2063049 - RNA, 15 nt, Homo sapiens
augauuuugaaguca

SEQ ID NO: 2063050 - RNA, 19 nt, Homo sapiens
uauaaugaacacgugggua

SEQ ID NO: 2063051 - RNA, 15 nt, Homo sapiens
cucucuucguccuga

SEQ ID NO: 2063052 - RNA, 12 nt, Homo sapiens
ccuuaaauaugu

SEQ ID NO: 2063053 - RNA, 15 nt, Homo sapiens
acuuuauagcacaug

SEQ ID NO: 2063054 - RNA, 21 nt, Homo sapiens
cugaugcuggggacacagcau

SEQ ID NO: 2063055 - RNA, 21 nt, Homo sapiens
accaacuggcccucuucuuac

SEQ ID NO: 2063056 - RNA, 18 nt, Homo sapiens
cccauuccaaagcuuuau

SEQ ID NO: 2063057 - RNA, 14 nt, Homo sapiens
ugggccuggcagga

SEQ ID NO: 2063058 - RNA, 15 nt, Homo sapiens
auuaaagugcacugu

SEQ ID NO: 2063059 - RNA, 17 nt, Homo sapiens
ggauauuugcacuuaug

SEQ ID NO: 2063060 - RNA, 17 nt, Homo sapiens
uucuuuaccaaggauau

SEQ ID NO: 2063061 - RNA, 21 nt, Homo sapiens
ccagagaggggacauuucccu

SEQ ID NO: 2063062 - RNA, 15 nt, Homo sapiens
gccuucaguguaccg

SEQ ID NO: 2063063 - RNA, 21 nt, Homo sapiens
cuuugggggauucaaaugcau

SEQ ID NO: 2063064 - RNA, 19 nt, Homo sapiens
ugacauuucuuugugcuuu

SEQ ID NO: 2063065 - RNA, 19 nt, Homo sapiens
accuuuuccccaggagcag

SEQ ID NO: 2063066 - RNA, 20 nt, Homo sapiens
cagagggugggcuucagggc

SEQ ID NO: 2063067 - RNA, 17 nt, Homo sapiens
ucuccaccugccaggga

SEQ ID NO: 2063068 - RNA, 23 nt, Homo sapiens
ugggccaccccuaaucacuauug

SEQ ID NO: 2063069 - RNA, 18 nt, Homo sapiens
auguaaguaagugacaau

SEQ ID NO: 2063070 - RNA, 20 nt, Homo sapiens
gcuggagugcaauggcgcga

SEQ ID NO: 2063071 - RNA, 21 nt, Homo sapiens
uaguuuuaucuuaacacugaa

SEQ ID NO: 2063072 - RNA, 22 nt, Homo sapiens
acccagaagaggagacaguuua

SEQ ID NO: 2063073 - RNA, 22 nt, Homo sapiens
agaagggggucucuucuuccag

SEQ ID NO: 2063074 - RNA, 19 nt, Homo sapiens
ccauccuaccaaugcaugc

SEQ ID NO: 2063075 - RNA, 10 nt, Homo sapiens
gaucugcuca

SEQ ID NO: 2063076 - RNA, 19 nt, Homo sapiens
aaacuggguuccugcaaug

SEQ ID NO: 2063077 - RNA, 17 nt, Homo sapiens
ggugugguggcacacac

SEQ ID NO: 2063078 - RNA, 23 nt, Homo sapiens
ccugagaaugccuaggccagcuc

SEQ ID NO: 2063079 - RNA, 13 nt, Homo sapiens
cauaguaaaguau

SEQ ID NO: 2063080 - RNA, 17 nt, Homo sapiens
gggccuggccuuguccc

SEQ ID NO: 2063081 - RNA, 24 nt, Homo sapiens
gaaaagaccccagacucagaggga

SEQ ID NO: 2063082 - RNA, 17 nt, Homo sapiens
uaugauaaaacacugcc

SEQ ID NO: 2063083 - RNA, 14 nt, Homo sapiens
auuaacaucaucuu

SEQ ID NO: 2063084 - RNA, 15 nt, Homo sapiens
gaauaaaugucuugc

SEQ ID NO: 2063085 - RNA, 14 nt, Homo sapiens
aguucaccccuuau

SEQ ID NO: 2063086 - RNA, 13 nt, Homo sapiens
cauggacacucca

SEQ ID NO: 2063087 - RNA, 20 nt, Homo sapiens
guagcuaagugaaaagguca

SEQ ID NO: 2063088 - RNA, 14 nt, Homo sapiens
gugccauuccacuc

SEQ ID NO: 2063089 - RNA, 18 nt, Homo sapiens
cucugcuucuccaaggaa

SEQ ID NO: 2063090 - RNA, 20 nt, Homo sapiens
cugaagaccccaaagaucuc

SEQ ID NO: 2063091 - RNA, 15 nt, Homo sapiens
cuucuguagugccau

SEQ ID NO: 2063092 - RNA, 16 nt, Homo sapiens
acucugguauggccaa

SEQ ID NO: 2063093 - RNA, 17 nt, Homo sapiens
ggcuuuccucagcaccu

SEQ ID NO: 2063094 - RNA, 20 nt, Homo sapiens
aaggccacggccuugugucu

SEQ ID NO: 2063095 - RNA, 19 nt, Homo sapiens
aacacagugccuucaauaa

SEQ ID NO: 2063096 - RNA, 22 nt, Homo sapiens
uucucaccuaaacccucuguga

SEQ ID NO: 2063097 - RNA, 23 nt, Homo sapiens
gcauucagaacauaaaugcacaa

SEQ ID NO: 2063098 - RNA, 13 nt, Homo sapiens
caguaacugugcu

SEQ ID NO: 2063099 - RNA, 15 nt, Homo sapiens
aaagagaaguuccca

SEQ ID NO: 2063100 - RNA, 17 nt, Homo sapiens
ugggcagugagugcagg

SEQ ID NO: 2063101 - RNA, 19 nt, Homo sapiens
ggcugaauccgugguggca

SEQ ID NO: 2063102 - RNA, 15 nt, Homo sapiens
uguaccugacuucca

SEQ ID NO: 2063103 - RNA, 23 nt, Homo sapiens
ucccugcagaggaaagacaggac

SEQ ID NO: 2063104 - RNA, 15 nt, Homo sapiens
caaaaauaucuugca

SEQ ID NO: 2063105 - RNA, 13 nt, Homo sapiens
auauauucacuuu

SEQ ID NO: 2063106 - RNA, 15 nt, Homo sapiens
guucgcaccgugcug

SEQ ID NO: 2063107 - RNA, 16 nt, Homo sapiens
gcacaguaucugcugu

SEQ ID NO: 2063108 - RNA, 15 nt, Homo sapiens
aacuauuuacuauuc

SEQ ID NO: 2063109 - RNA, 17 nt, Homo sapiens
gaaggaggggaaccaga

SEQ ID NO: 2063110 - RNA, 15 nt, Homo sapiens
aauguauacaaugca

SEQ ID NO: 2063111 - RNA, 19 nt, Homo sapiens
gcuuucauccaacuggaag

SEQ ID NO: 2063112 - RNA, 21 nt, Homo sapiens
agaacauggaaauaaccauug

SEQ ID NO: 2063113 - RNA, 22 nt, Homo sapiens
uaaaauuacaguggauugcuca

SEQ ID NO: 2063114 - RNA, 21 nt, Homo sapiens
ucugcaaaaugucauagcuua

SEQ ID NO: 2063115 - RNA, 16 nt, Homo sapiens
auccugucagugucac

SEQ ID NO: 2063116 - RNA, 14 nt, Homo sapiens
auuccuucuggccu

SEQ ID NO: 2063117 - RNA, 20 nt, Homo sapiens
gcucacucuggauuccacac

SEQ ID NO: 2063118 - RNA, 21 nt, Homo sapiens
aacaugaaaauuaugucaguu

SEQ ID NO: 2063119 - RNA, 17 nt, Homo sapiens
aaacuguccucuuucag

SEQ ID NO: 2063120 - RNA, 21 nt, Homo sapiens
aaugcauuuaaacucauuuga

SEQ ID NO: 2063121 - RNA, 16 nt, Homo sapiens
uccaguuugcauuugg

SEQ ID NO: 2063122 - RNA, 21 nt, Homo sapiens
caaaguuaucuuaaauaugaa

SEQ ID NO: 2063123 - RNA, 13 nt, Homo sapiens
gcgcgugcacagc

SEQ ID NO: 2063124 - RNA, 21 nt, Homo sapiens
aacaggaaaggagcaaugaag

SEQ ID NO: 2063125 - RNA, 20 nt, Homo sapiens
uuugcccacugucugcuacc

SEQ ID NO: 2063126 - RNA, 16 nt, Homo sapiens
ucuaauuuuuaagaau

SEQ ID NO: 2063127 - RNA, 15 nt, Homo sapiens
ucuuaaacacaaauu

SEQ ID NO: 2063128 - RNA, 19 nt, Homo sapiens
cagcaacuucuucuccauc

SEQ ID NO: 2063129 - RNA, 17 nt, Homo sapiens
uccagacucacuugcca

SEQ ID NO: 2063130 - RNA, 22 nt, Homo sapiens
aauaagugaagaauacaucaga

SEQ ID NO: 2063131 - RNA, 13 nt, Homo sapiens
acuaccaugcuuu

SEQ ID NO: 2063132 - RNA, 18 nt, Homo sapiens
acaaauaaauaagaucag

SEQ ID NO: 2063133 - RNA, 22 nt, Homo sapiens
cuaaaucuuccagcaugcaucc

SEQ ID NO: 2063134 - RNA, 14 nt, Homo sapiens
agaugaaacauuaa

SEQ ID NO: 2063135 - RNA, 18 nt, Homo sapiens
ccacuaucugggugcaug

SEQ ID NO: 2063136 - RNA, 13 nt, Homo sapiens
uauuaaucaccuc

SEQ ID NO: 2063137 - RNA, 19 nt, Homo sapiens
caaguugacaaaugccaaa

SEQ ID NO: 2063138 - RNA, 13 nt, Homo sapiens
uguguuucuuuag

SEQ ID NO: 2063139 - RNA, 23 nt, Homo sapiens
uuucuuuugcuuaggaaauugcu

SEQ ID NO: 2063140 - RNA, 16 nt, Homo sapiens
ucaggaugagauauca

SEQ ID NO: 2063141 - RNA, 24 nt, Homo sapiens
uuguuggaagaagugugugaccua

SEQ ID NO: 2063142 - RNA, 18 nt, Homo sapiens
ccucuccccagagcauuu

SEQ ID NO: 2063143 - RNA, 17 nt, Homo sapiens
uuuaaguugucaaagaa

SEQ ID NO: 2063144 - RNA, 13 nt, Homo sapiens
uucugauguuucu

SEQ ID NO: 2063145 - RNA, 18 nt, Homo sapiens
aagugaagccccuugucc

SEQ ID NO: 2063146 - RNA, 16 nt, Homo sapiens
uauuuaaaacaaagaa

SEQ ID NO: 2063147 - RNA, 22 nt, Homo sapiens
agcugucugucaucugcugcga

SEQ ID NO: 2063148 - RNA, 19 nt, Homo sapiens
gcguccugcccucugggag

SEQ ID NO: 2063149 - RNA, 23 nt, Homo sapiens
uggugaaaccccaucucuacuaa

SEQ ID NO: 2063150 - RNA, 11 nt, Homo sapiens
ucucacugcca

SEQ ID NO: 2063151 - RNA, 11 nt, Homo sapiens
gcuugccauau

SEQ ID NO: 2063152 - RNA, 14 nt, Homo sapiens
ucuuucugauaaca

SEQ ID NO: 2063153 - RNA, 13 nt, Homo sapiens
acagagacagaga

SEQ ID NO: 2063154 - RNA, 13 nt, Homo sapiens
agaaagacacaaa

SEQ ID NO: 2063155 - RNA, 18 nt, Homo sapiens
uaccccggcugcuuggca

SEQ ID NO: 2063156 - RNA, 13 nt, Homo sapiens
ugggcucuuccaa

SEQ ID NO: 2063157 - RNA, 20 nt, Homo sapiens
gauagaucuuggcccuguua

SEQ ID NO: 2063158 - RNA, 16 nt, Homo sapiens
acuuacaaguaaugaa

SEQ ID NO: 2063159 - RNA, 15 nt, Homo sapiens
ccugccaacugauuu

SEQ ID NO: 2063160 - RNA, 15 nt, Homo sapiens
cccuacaugcauguu

SEQ ID NO: 2063161 - RNA, 17 nt, Homo sapiens
uguaugacuuugugcca

SEQ ID NO: 2063162 - RNA, 14 nt, Homo sapiens
cuugccacuuucca

SEQ ID NO: 2063163 - RNA, 20 nt, Homo sapiens
ucugcgugucaccugugcuu

SEQ ID NO: 2063164 - RNA, 14 nt, Homo sapiens
cacagauaauuuac

SEQ ID NO: 2063165 - RNA, 23 nt, Homo sapiens
uuucacggggccgugacagugac

SEQ ID NO: 2063166 - RNA, 23 nt, Homo sapiens
caggaaaaagaacuuccccauac

SEQ ID NO: 2063167 - RNA, 18 nt, Homo sapiens
cgucccgggcacugucau

SEQ ID NO: 2063168 - RNA, 20 nt, Homo sapiens
uucucuguagcugcuaguga

SEQ ID NO: 2063169 - RNA, 22 nt, Homo sapiens
auuccgaaaaaaaaauguucau

SEQ ID NO: 2063170 - RNA, 13 nt, Homo sapiens
uuuaagucaguga

SEQ ID NO: 2063171 - RNA, 17 nt, Homo sapiens
gcaaaaucaacaugacu

SEQ ID NO: 2063172 - RNA, 20 nt, Homo sapiens
auccuaagaaauaugugaga

SEQ ID NO: 2063173 - RNA, 13 nt, Homo sapiens
uuuccucaaagaa

SEQ ID NO: 2063174 - RNA, 22 nt, Homo sapiens
ugaaaguuuguucugcagagac

SEQ ID NO: 2063175 - RNA, 20 nt, Homo sapiens
cuggccuugguaugugccag

SEQ ID NO: 2063176 - RNA, 21 nt, Homo sapiens
cuggauuaucuacuacagagu

SEQ ID NO: 2063177 - RNA, 22 nt, Homo sapiens
aaagcaugcucaguauugagac

SEQ ID NO: 2063178 - RNA, 19 nt, Homo sapiens
agaccagggugguugggac

SEQ ID NO: 2063179 - RNA, 20 nt, Homo sapiens
ccuaaugggaaucauuccac

SEQ ID NO: 2063180 - RNA, 20 nt, Homo sapiens
uugucuuaucuaccaguuua

SEQ ID NO: 2063181 - RNA, 15 nt, Homo sapiens
uguaccuaugugaca

SEQ ID NO: 2063182 - RNA, 22 nt, Homo sapiens
uauggaaauccuguuacuuaaa

SEQ ID NO: 2063183 - RNA, 13 nt, Homo sapiens
gcgcagugcuguc

SEQ ID NO: 2063184 - RNA, 13 nt, Homo sapiens
guucagugccuuc

SEQ ID NO: 2063185 - RNA, 20 nt, Homo sapiens
cugcuggagaggaacccaga

SEQ ID NO: 2063186 - RNA, 17 nt, Homo sapiens
aacaucauauaccucuu

SEQ ID NO: 2063187 - RNA, 17 nt, Homo sapiens
auaccucgaacaucagu

SEQ ID NO: 2063188 - RNA, 22 nt, Homo sapiens
caagucuugaauaguacauuuu

SEQ ID NO: 2063189 - RNA, 22 nt, Homo sapiens
cagaaaaaaauaaaaacauaaa

SEQ ID NO: 2063190 - RNA, 21 nt, Homo sapiens
uuaucuggcccucgacacuca

SEQ ID NO: 2063191 - RNA, 19 nt, Homo sapiens
cuaggaauuguguuuauaa

SEQ ID NO: 2063192 - RNA, 15 nt, Homo sapiens
uagucccagcacuuu

SEQ ID NO: 2063193 - RNA, 22 nt, Homo sapiens
ucccuuugccagccuugaguua

SEQ ID NO: 2063194 - RNA, 22 nt, Homo sapiens
auucugcuuucuugccacacag

SEQ ID NO: 2063195 - RNA, 16 nt, Homo sapiens
cuuucuguaaccaaaa

SEQ ID NO: 2063196 - RNA, 14 nt, Homo sapiens
acuugaacaaaagg

SEQ ID NO: 2063197 - RNA, 18 nt, Homo sapiens
aggccacagcugccaucg

SEQ ID NO: 2063198 - RNA, 21 nt, Homo sapiens
ccccuuucgcccacagucuga

SEQ ID NO: 2063199 - RNA, 15 nt, Homo sapiens
cgaccaccccugugc

SEQ ID NO: 2063200 - RNA, 14 nt, Homo sapiens
guauaaagauugua

SEQ ID NO: 2063201 - RNA, 13 nt, Homo sapiens
ugaccaucauuuc

SEQ ID NO: 2063202 - RNA, 14 nt, Homo sapiens
gagacgcaggaaug

SEQ ID NO: 2063203 - RNA, 24 nt, Homo sapiens
cuccuuuugcuguuuggauguuuc

SEQ ID NO: 2063204 - RNA, 18 nt, Homo sapiens
accacgacuggccagggc

SEQ ID NO: 2063205 - RNA, 23 nt, Homo sapiens
ucaguacuugugaaacacagcug

SEQ ID NO: 2063206 - RNA, 22 nt, Homo sapiens
caggcuguucuccaggcuucac

SEQ ID NO: 2063207 - RNA, 21 nt, Homo sapiens
uaaacucuuuuaucuccugaa

SEQ ID NO: 2063208 - RNA, 17 nt, Homo sapiens
cugagaaauagugcacu

SEQ ID NO: 2063209 - RNA, 17 nt, Homo sapiens
cagaggauguucuggac

SEQ ID NO: 2063210 - RNA, 19 nt, Homo sapiens
uuaugcacuuauaaggugu

SEQ ID NO: 2063211 - RNA, 14 nt, Homo sapiens
uuaaacuuacuuag

SEQ ID NO: 2063212 - RNA, 13 nt, Homo sapiens
acuaugagccuau

SEQ ID NO: 2063213 - RNA, 13 nt, Homo sapiens
ccagagagacaga

SEQ ID NO: 2063214 - RNA, 19 nt, Homo sapiens
ccagaaggcaaaaaccaga

SEQ ID NO: 2063215 - RNA, 12 nt, Homo sapiens
uuccuucuugcc

SEQ ID NO: 2063216 - RNA, 16 nt, Homo sapiens
aaucaugaaacucccu

SEQ ID NO: 2063217 - RNA, 18 nt, Homo sapiens
guaagucaaaugugugcu

SEQ ID NO: 2063218 - RNA, 15 nt, Homo sapiens
cuucuuggauuagcc

SEQ ID NO: 2063219 - RNA, 18 nt, Homo sapiens
ccagugcuuuauccacau

SEQ ID NO: 2063220 - RNA, 17 nt, Homo sapiens
ugcucugaccuuccaga

SEQ ID NO: 2063221 - RNA, 20 nt, Homo sapiens
gcuucccaagcagcugggau

SEQ ID NO: 2063222 - RNA, 15 nt, Homo sapiens
uuggaccacagcaug

SEQ ID NO: 2063223 - RNA, 16 nt, Homo sapiens
ugaaacaaucuuccaa

SEQ ID NO: 2063224 - RNA, 18 nt, Homo sapiens
cccauuggugcuaccugg

SEQ ID NO: 2063225 - RNA, 12 nt, Homo sapiens
ugaggggugcug

SEQ ID NO: 2063226 - RNA, 18 nt, Homo sapiens
ccauuguuccuuaccuuu

SEQ ID NO: 2063227 - RNA, 13 nt, Homo sapiens
aacucauuagaga

SEQ ID NO: 2063228 - RNA, 13 nt, Homo sapiens
agugugaauucac

SEQ ID NO: 2063229 - RNA, 19 nt, Homo sapiens
ugagaggugacacuguugg

SEQ ID NO: 2063230 - RNA, 17 nt, Homo sapiens
caugauguuuuccauga

SEQ ID NO: 2063231 - RNA, 16 nt, Homo sapiens
auguuguacaaucaaa

SEQ ID NO: 2063232 - RNA, 18 nt, Homo sapiens
agcuuagcaucagagguu

SEQ ID NO: 2063233 - RNA, 15 nt, Homo sapiens
uaugugcacaucugu

SEQ ID NO: 2063234 - RNA, 17 nt, Homo sapiens
uaacccuccaccuccuc

SEQ ID NO: 2063235 - RNA, 12 nt, Homo sapiens
guuccugacugg

SEQ ID NO: 2063236 - RNA, 17 nt, Homo sapiens
acugccgugacaucauu

SEQ ID NO: 2063237 - RNA, 15 nt, Homo sapiens
acuuggaacuaggcu

SEQ ID NO: 2063238 - RNA, 15 nt, Homo sapiens
auguguggacugugg

SEQ ID NO: 2063239 - RNA, 19 nt, Homo sapiens
uuagugaaguugugcaacg

SEQ ID NO: 2063240 - RNA, 14 nt, Homo sapiens
uacaugucacauuu

SEQ ID NO: 2063241 - RNA, 18 nt, Homo sapiens
uccagccccuuuccaaaa

SEQ ID NO: 2063242 - RNA, 14 nt, Homo sapiens
aguuucacugccaa

SEQ ID NO: 2063243 - RNA, 18 nt, Homo sapiens
accuucccuccucaugcc

SEQ ID NO: 2063244 - RNA, 19 nt, Homo sapiens
uggcauuccuucugaccac

SEQ ID NO: 2063245 - RNA, 21 nt, Homo sapiens
auuaauuugugaauuugcaac

SEQ ID NO: 2063246 - RNA, 16 nt, Homo sapiens
cucaggagacugaguu

SEQ ID NO: 2063247 - RNA, 21 nt, Homo sapiens
aaaucauaguuuaaacugcau

SEQ ID NO: 2063248 - RNA, 21 nt, Homo sapiens
aaauacaugaagcuucaugca

SEQ ID NO: 2063249 - RNA, 19 nt, Homo sapiens
caugauggagcgcaccugc

SEQ ID NO: 2063250 - RNA, 16 nt, Homo sapiens
uauaaagaggacuuga

SEQ ID NO: 2063251 - RNA, 16 nt, Homo sapiens
aaaaauaaaaauucau

SEQ ID NO: 2063252 - RNA, 16 nt, Homo sapiens
cuuauggauuuggacu

SEQ ID NO: 2063253 - RNA, 21 nt, Homo sapiens
agcacuuuuugggguucaaga

SEQ ID NO: 2063254 - RNA, 11 nt, Homo sapiens
caaaaugcuca

SEQ ID NO: 2063255 - RNA, 14 nt, Homo sapiens
auaaaaaaagacaa

SEQ ID NO: 2063256 - RNA, 16 nt, Homo sapiens
accaccagacugcaau

SEQ ID NO: 2063257 - RNA, 20 nt, Homo sapiens
aauuuccuuuuugacacuga

SEQ ID NO: 2063258 - RNA, 21 nt, Homo sapiens
cuauaaucucuugaauuuggu

SEQ ID NO: 2063259 - RNA, 15 nt, Homo sapiens
ugugugugugcacac

SEQ ID NO: 2063260 - RNA, 21 nt, Homo sapiens
uaaaauccacuuuaucuugaa

SEQ ID NO: 2063261 - RNA, 17 nt, Homo sapiens
ccuuuauguaagaauga

SEQ ID NO: 2063262 - RNA, 18 nt, Homo sapiens
acugcagauagcccagga

SEQ ID NO: 2063263 - RNA, 18 nt, Homo sapiens
uuuaagcaucacauuaaa

SEQ ID NO: 2063264 - RNA, 23 nt, Homo sapiens
caagaaguugcuugaggagcuuu

SEQ ID NO: 2063265 - RNA, 15 nt, Homo sapiens
cgauggggcaugacc

SEQ ID NO: 2063266 - RNA, 19 nt, Homo sapiens
uggagacguggaaccucug

SEQ ID NO: 2063267 - RNA, 13 nt, Homo sapiens
aucucuugucaua

SEQ ID NO: 2063268 - RNA, 14 nt, Homo sapiens
agauaggcucucag

SEQ ID NO: 2063269 - RNA, 17 nt, Homo sapiens
ucaauaaagaagcccau

SEQ ID NO: 2063270 - RNA, 23 nt, Homo sapiens
uauuaauuuuuaaggauguugcc

SEQ ID NO: 2063271 - RNA, 19 nt, Homo sapiens
aggccccagcuggagaaaa

SEQ ID NO: 2063272 - RNA, 13 nt, Homo sapiens
agaauuacuugug

SEQ ID NO: 2063273 - RNA, 16 nt, Homo sapiens
cacugccuuugucuua

SEQ ID NO: 2063274 - RNA, 20 nt, Homo sapiens
auaguaacguguuacuggaa

SEQ ID NO: 2063275 - RNA, 22 nt, Homo sapiens
auuccauaauacauaacauuca

SEQ ID NO: 2063276 - RNA, 18 nt, Homo sapiens
accuaauccaggcagauc

SEQ ID NO: 2063277 - RNA, 12 nt, Homo sapiens
cuguuauugcca

SEQ ID NO: 2063278 - RNA, 22 nt, Homo sapiens
ucuaaagcuuagaauaguguga

SEQ ID NO: 2063279 - RNA, 19 nt, Homo sapiens
agacagauguggacaugca

SEQ ID NO: 2063280 - RNA, 17 nt, Homo sapiens
guaaccugugguguauu

SEQ ID NO: 2063281 - RNA, 18 nt, Homo sapiens
cauucacuucgccauuca

SEQ ID NO: 2063282 - RNA, 17 nt, Homo sapiens
aggugcccgcguggcau

SEQ ID NO: 2063283 - RNA, 18 nt, Homo sapiens
ucaaaccccgaccaccug

SEQ ID NO: 2063284 - RNA, 17 nt, Homo sapiens
cuacaagcagcaggaaa

SEQ ID NO: 2063285 - RNA, 24 nt, Homo sapiens
ucucauuuauauugcagauugaau

SEQ ID NO: 2063286 - RNA, 21 nt, Homo sapiens
uccaacauuucucacugaaag

SEQ ID NO: 2063287 - RNA, 23 nt, Homo sapiens
gcugugaaaauuacacccaugca

SEQ ID NO: 2063288 - RNA, 14 nt, Homo sapiens
augcucagaccagc

SEQ ID NO: 2063289 - RNA, 23 nt, Homo sapiens
gcuucucaucuaaauauuuccau

SEQ ID NO: 2063290 - RNA, 15 nt, Homo sapiens
cagcaacaucugcaa

SEQ ID NO: 2063291 - RNA, 13 nt, Homo sapiens
cauggauuccacu

SEQ ID NO: 2063292 - RNA, 18 nt, Homo sapiens
ccaaaguuuucaaacugc

SEQ ID NO: 2063293 - RNA, 17 nt, Homo sapiens
gaaagcuguuaaauucu

SEQ ID NO: 2063294 - RNA, 15 nt, Homo sapiens
uucaaugaccuguau

SEQ ID NO: 2063295 - RNA, 19 nt, Homo sapiens
agacauuaaaucuaugaag

SEQ ID NO: 2063296 - RNA, 20 nt, Homo sapiens
acauuuacugaccauguacu

SEQ ID NO: 2063297 - RNA, 22 nt, Homo sapiens
cuuuugggccuccuucccaugc

SEQ ID NO: 2063298 - RNA, 23 nt, Homo sapiens
gaacuaagagaugagggaggcac

SEQ ID NO: 2063299 - RNA, 19 nt, Homo sapiens
gaccaggcaaagcaaguga

SEQ ID NO: 2063300 - RNA, 15 nt, Homo sapiens
aaucuccugacuuca

SEQ ID NO: 2063301 - RNA, 12 nt, Homo sapiens
aagcugacagca

SEQ ID NO: 2063302 - RNA, 22 nt, Homo sapiens
gaagagcauccggcaugagggc

SEQ ID NO: 2063303 - RNA, 20 nt, Homo sapiens
ugcugcuggggaagacagug

SEQ ID NO: 2063304 - RNA, 15 nt, Homo sapiens
caaguggcaguuuua

SEQ ID NO: 2063305 - RNA, 19 nt, Homo sapiens
gcaauuagauuaguauuuu

SEQ ID NO: 2063306 - RNA, 19 nt, Homo sapiens
ccccagggcugucaucuga

SEQ ID NO: 2063307 - RNA, 11 nt, Homo sapiens
caucucugucu

SEQ ID NO: 2063308 - RNA, 22 nt, Homo sapiens
aucagaauuguucaacuuuuca

SEQ ID NO: 2063309 - RNA, 17 nt, Homo sapiens
ugcuuuugaaaucugua

SEQ ID NO: 2063310 - RNA, 19 nt, Homo sapiens
aauuauauguuguaagcaa

SEQ ID NO: 2063311 - RNA, 16 nt, Homo sapiens
agcugccuuagcuuca

SEQ ID NO: 2063312 - RNA, 24 nt, Homo sapiens
aauaccacuuuuaauuguuacuca

SEQ ID NO: 2063313 - RNA, 17 nt, Homo sapiens
cuccuggagcuauucac

SEQ ID NO: 2063314 - RNA, 14 nt, Homo sapiens
uuacugaagucuua

SEQ ID NO: 2063315 - RNA, 21 nt, Homo sapiens
agcuaacaaguagcacacuga

SEQ ID NO: 2063316 - RNA, 20 nt, Homo sapiens
cauuccccuccccacuccuc

SEQ ID NO: 2063317 - RNA, 12 nt, Homo sapiens
uaauuacuguac

SEQ ID NO: 2063318 - RNA, 16 nt, Homo sapiens
gccuuugauguggaug

SEQ ID NO: 2063319 - RNA, 16 nt, Homo sapiens
ucauuaguauuucaca

SEQ ID NO: 2063320 - RNA, 20 nt, Homo sapiens
aggauuguuaauguuugcau

SEQ ID NO: 2063321 - RNA, 22 nt, Homo sapiens
gaaaaugugaguaguacaauga

SEQ ID NO: 2063322 - RNA, 23 nt, Homo sapiens
aaaaggacuauaagaauaauuuc

SEQ ID NO: 2063323 - RNA, 14 nt, Homo sapiens
aaagauuaaaugug

SEQ ID NO: 2063324 - RNA, 14 nt, Homo sapiens
ccuuuguaccauau

SEQ ID NO: 2063325 - RNA, 17 nt, Homo sapiens
ugauacgauaguuacau

SEQ ID NO: 2063326 - RNA, 16 nt, Homo sapiens
aggaggaaaagacaga

SEQ ID NO: 2063327 - RNA, 17 nt, Homo sapiens
ucuacugcuaaauaagu

SEQ ID NO: 2063328 - RNA, 12 nt, Homo sapiens
ucaucauucccu

SEQ ID NO: 2063329 - RNA, 15 nt, Homo sapiens
guuccagaccagccu

SEQ ID NO: 2063330 - RNA, 12 nt, Homo sapiens
cccccauuucac

SEQ ID NO: 2063331 - RNA, 17 nt, Homo sapiens
uggucucgaacuccuga

SEQ ID NO: 2063332 - RNA, 19 nt, Homo sapiens
ucacagucacaugcccauu

SEQ ID NO: 2063333 - RNA, 17 nt, Homo sapiens
caguuuaaucuucacaa

SEQ ID NO: 2063334 - RNA, 22 nt, Homo sapiens
ccagcccgucuucucucucugc

SEQ ID NO: 2063335 - RNA, 17 nt, Homo sapiens
auguucuuuuuucuguc

SEQ ID NO: 2063336 - RNA, 15 nt, Homo sapiens
ugccaaggagcucag

SEQ ID NO: 2063337 - RNA, 18 nt, Homo sapiens
aaaaacugcuuacuuaug

SEQ ID NO: 2063338 - RNA, 12 nt, Homo sapiens
agaagcagcccu

SEQ ID NO: 2063339 - RNA, 14 nt, Homo sapiens
gcuggagauacuga

SEQ ID NO: 2063340 - RNA, 16 nt, Homo sapiens
auuacagugcaguuua

SEQ ID NO: 2063341 - RNA, 21 nt, Homo sapiens
ugauaaagaagcuaaccugcc

SEQ ID NO: 2063342 - RNA, 17 nt, Homo sapiens
gaacagcaguguucuca

SEQ ID NO: 2063343 - RNA, 19 nt, Homo sapiens
guugauuuaugaguaauug

SEQ ID NO: 2063344 - RNA, 17 nt, Homo sapiens
cuggcuuuacauuuuau

SEQ ID NO: 2063345 - RNA, 21 nt, Homo sapiens
auaucuauguuuuaccaagcc

SEQ ID NO: 2063346 - RNA, 15 nt, Homo sapiens
auucaguauuacaaa

SEQ ID NO: 2063347 - RNA, 15 nt, Homo sapiens
aguauauaugaauga

SEQ ID NO: 2063348 - RNA, 16 nt, Homo sapiens
ugcauuauucauaugc

SEQ ID NO: 2063349 - RNA, 21 nt, Homo sapiens
ggguggcgguggaccaaagga

SEQ ID NO: 2063350 - RNA, 13 nt, Homo sapiens
uaaacugugagau

SEQ ID NO: 2063351 - RNA, 14 nt, Homo sapiens
gcugcccucaggga

SEQ ID NO: 2063352 - RNA, 13 nt, Homo sapiens
agcucaggugccu

SEQ ID NO: 2063353 - RNA, 20 nt, Homo sapiens
uuuugcuuccccgugcauga

SEQ ID NO: 2063354 - RNA, 15 nt, Homo sapiens
caugaguccuugaaa

SEQ ID NO: 2063355 - RNA, 18 nt, Homo sapiens
uguuauaaagacacaugc

SEQ ID NO: 2063356 - RNA, 20 nt, Homo sapiens
uaauuuauuauacaccuuag

SEQ ID NO: 2063357 - RNA, 14 nt, Homo sapiens
acccugcaaaggga

SEQ ID NO: 2063358 - RNA, 17 nt, Homo sapiens
gccagcuuuaguccccu

SEQ ID NO: 2063359 - RNA, 16 nt, Homo sapiens
auuugcucauggaauu

SEQ ID NO: 2063360 - RNA, 23 nt, Homo sapiens
cuauugguaauaaaccuugaugg

SEQ ID NO: 2063361 - RNA, 23 nt, Homo sapiens
aagaacucuuuuuccucuaauau

SEQ ID NO: 2063362 - RNA, 16 nt, Homo sapiens
ggcauucacaucucau

SEQ ID NO: 2063363 - RNA, 17 nt, Homo sapiens
aagaauuccaaccgacc

SEQ ID NO: 2063364 - RNA, 13 nt, Homo sapiens
cuuuauagcucua

SEQ ID NO: 2063365 - RNA, 19 nt, Homo sapiens
gccaaccucuggagcaaug

SEQ ID NO: 2063366 - RNA, 15 nt, Homo sapiens
cugaugacacugaga

SEQ ID NO: 2063367 - RNA, 12 nt, Homo sapiens
cgcaggaacuca

SEQ ID NO: 2063368 - RNA, 24 nt, Homo sapiens
ggucagggggagucuuugcaccaa

SEQ ID NO: 2063369 - RNA, 16 nt, Homo sapiens
acccugcauguuggcc

SEQ ID NO: 2063370 - RNA, 17 nt, Homo sapiens
acagugucuguguacau

SEQ ID NO: 2063371 - RNA, 15 nt, Homo sapiens
ccugaccaugcauuu

SEQ ID NO: 2063372 - RNA, 20 nt, Homo sapiens
acuaggcccccacuugccuc

SEQ ID NO: 2063373 - RNA, 23 nt, Homo sapiens
caauauugucauuccuguauuca

SEQ ID NO: 2063374 - RNA, 20 nt, Homo sapiens
gguuagaauuucuguguuua

SEQ ID NO: 2063375 - RNA, 13 nt, Homo sapiens
uggggaccacaga

SEQ ID NO: 2063376 - RNA, 16 nt, Homo sapiens
uuccccuguccuguga

SEQ ID NO: 2063377 - RNA, 16 nt, Homo sapiens
cgucaugcuuguguua

SEQ ID NO: 2063378 - RNA, 14 nt, Homo sapiens
accaacacugaccc

SEQ ID NO: 2063379 - RNA, 13 nt, Homo sapiens
augacuaagccaa

SEQ ID NO: 2063380 - RNA, 15 nt, Homo sapiens
cuccgucugcuccaa

SEQ ID NO: 2063381 - RNA, 15 nt, Homo sapiens
ugaaacuuacuaaaa

SEQ ID NO: 2063382 - RNA, 22 nt, Homo sapiens
cacucagcugcuucuuugguca

SEQ ID NO: 2063383 - RNA, 22 nt, Homo sapiens
gaugucaggaaacauucaguga

SEQ ID NO: 2063384 - RNA, 14 nt, Homo sapiens
cucagccagcacuu

SEQ ID NO: 2063385 - RNA, 12 nt, Homo sapiens
ugcaaugucaca

SEQ ID NO: 2063386 - RNA, 12 nt, Homo sapiens
cacaauguugca

SEQ ID NO: 2063387 - RNA, 17 nt, Homo sapiens
cuggcccucugcuaaag

SEQ ID NO: 2063388 - RNA, 16 nt, Homo sapiens
guuauaauaaccuggu

SEQ ID NO: 2063389 - RNA, 19 nt, Homo sapiens
acacagccguguguucaaa

SEQ ID NO: 2063390 - RNA, 23 nt, Homo sapiens
ccaacucacugaacuagugcagg

SEQ ID NO: 2063391 - RNA, 13 nt, Homo sapiens
accccaccugcag

SEQ ID NO: 2063392 - RNA, 18 nt, Homo sapiens
accagauauuugaaucuu

SEQ ID NO: 2063393 - RNA, 18 nt, Homo sapiens
agcccagucgagaccuca

SEQ ID NO: 2063394 - RNA, 15 nt, Homo sapiens
uuaagagacacucca

SEQ ID NO: 2063395 - RNA, 21 nt, Homo sapiens
aauaaagaaugccauuucuca

SEQ ID NO: 2063396 - RNA, 23 nt, Homo sapiens
caaacuucuggcuucaugcaauc

SEQ ID NO: 2063397 - RNA, 23 nt, Homo sapiens
caccuggaaagcauauacuauau

SEQ ID NO: 2063398 - RNA, 13 nt, Homo sapiens
caggacaggugug

SEQ ID NO: 2063399 - RNA, 15 nt, Homo sapiens
uaagcccuuugcucu

SEQ ID NO: 2063400 - RNA, 17 nt, Homo sapiens
augccagugaaacuuca

SEQ ID NO: 2063401 - RNA, 16 nt, Homo sapiens
gcaguccuaugucuca

SEQ ID NO: 2063402 - RNA, 19 nt, Homo sapiens
ucaucauguuggccaggcu

SEQ ID NO: 2063403 - RNA, 15 nt, Homo sapiens
uccucagcuguacaa

SEQ ID NO: 2063404 - RNA, 18 nt, Homo sapiens
cuugcucugcacccccau

SEQ ID NO: 2063405 - RNA, 23 nt, Homo sapiens
cuauauguuauggcuuauugugu

SEQ ID NO: 2063406 - RNA, 14 nt, Homo sapiens
aucauuaacacuuu

SEQ ID NO: 2063407 - RNA, 14 nt, Homo sapiens
aaaagaaacuauga

SEQ ID NO: 2063408 - RNA, 14 nt, Homo sapiens
aacaugaacucuug

SEQ ID NO: 2063409 - RNA, 13 nt, Homo sapiens
aacaaacaagaga

SEQ ID NO: 2063410 - RNA, 20 nt, Homo sapiens
aguuuguauuuagcugccaa

SEQ ID NO: 2063411 - RNA, 16 nt, Homo sapiens
uucacagcaccaaaau

SEQ ID NO: 2063412 - RNA, 21 nt, Homo sapiens
aaaccuguugaaaugauaauu

SEQ ID NO: 2063413 - RNA, 18 nt, Homo sapiens
uuuagccuaggaguaaga

SEQ ID NO: 2063414 - RNA, 20 nt, Homo sapiens
gcacucagaaaauggcacuu

SEQ ID NO: 2063415 - RNA, 15 nt, Homo sapiens
aaccuaucucaggga

SEQ ID NO: 2063416 - RNA, 19 nt, Homo sapiens
cuguuuuaaaugaaccaaa

SEQ ID NO: 2063417 - RNA, 20 nt, Homo sapiens
aaccauuuaacugcagugua

SEQ ID NO: 2063418 - RNA, 19 nt, Homo sapiens
ugcauguuugauuauagua

SEQ ID NO: 2063419 - RNA, 14 nt, Homo sapiens
cacccugacugugg

SEQ ID NO: 2063420 - RNA, 14 nt, Homo sapiens
ugaauaucuuccac

SEQ ID NO: 2063421 - RNA, 22 nt, Homo sapiens
uauuguaaaaaauucacauaau

SEQ ID NO: 2063422 - RNA, 13 nt, Homo sapiens
acugguccaggca

SEQ ID NO: 2063423 - RNA, 21 nt, Homo sapiens
ucaggcagguuugccagugaa

SEQ ID NO: 2063424 - RNA, 18 nt, Homo sapiens
aaucugcuuguauuccaa

SEQ ID NO: 2063425 - RNA, 17 nt, Homo sapiens
gcacaauaaacauaaca

SEQ ID NO: 2063426 - RNA, 21 nt, Homo sapiens
acugauucucuaugacaugaa

SEQ ID NO: 2063427 - RNA, 18 nt, Homo sapiens
agucuuuguuuacaugag

SEQ ID NO: 2063428 - RNA, 20 nt, Homo sapiens
agucaugagcugagcaggga

SEQ ID NO: 2063429 - RNA, 22 nt, Homo sapiens
aggaccuggagauugugcucug

SEQ ID NO: 2063430 - RNA, 15 nt, Homo sapiens
agccaaucacaagca

SEQ ID NO: 2063431 - RNA, 15 nt, Homo sapiens
aaguggucuuaagaa

SEQ ID NO: 2063432 - RNA, 19 nt, Homo sapiens
cagaacccaggacagccac

SEQ ID NO: 2063433 - RNA, 21 nt, Homo sapiens
agauggcagauucccacugcc

SEQ ID NO: 2063434 - RNA, 13 nt, Homo sapiens
cuuuuucuacuau

SEQ ID NO: 2063435 - RNA, 15 nt, Homo sapiens
caaagguugcagugc

SEQ ID NO: 2063436 - RNA, 21 nt, Homo sapiens
accaggccuggccucugggca

SEQ ID NO: 2063437 - RNA, 14 nt, Homo sapiens
uucauagccaaaca

SEQ ID NO: 2063438 - RNA, 20 nt, Homo sapiens
aaauacuguguggaacuuuu

SEQ ID NO: 2063439 - RNA, 15 nt, Homo sapiens
ggcgaugucacucag

SEQ ID NO: 2063440 - RNA, 22 nt, Homo sapiens
cuagugugaguggcagccaugc

SEQ ID NO: 2063441 - RNA, 16 nt, Homo sapiens
gcucugucaccgccau

SEQ ID NO: 2063442 - RNA, 18 nt, Homo sapiens
auucccccuaagaggcag

SEQ ID NO: 2063443 - RNA, 18 nt, Homo sapiens
gcaggugcugagcaaagg

SEQ ID NO: 2063444 - RNA, 10 nt, Homo sapiens
aacuaauaca

SEQ ID NO: 2063445 - RNA, 12 nt, Homo sapiens
ccugagccauug

SEQ ID NO: 2063446 - RNA, 12 nt, Homo sapiens
auccuaggacag

SEQ ID NO: 2063447 - RNA, 11 nt, Homo sapiens
augagcucaaa

SEQ ID NO: 2063448 - RNA, 23 nt, Homo sapiens
caauauguuuaucaacucaagaa

SEQ ID NO: 2063449 - RNA, 22 nt, Homo sapiens
caaguuauauugaauauaucag

SEQ ID NO: 2063450 - RNA, 19 nt, Homo sapiens
uauucuauaaucacuacua

SEQ ID NO: 2063451 - RNA, 13 nt, Homo sapiens
gaccaagagcaau

SEQ ID NO: 2063452 - RNA, 23 nt, Homo sapiens
ucuccugcgugugcccacugaac

SEQ ID NO: 2063453 - RNA, 17 nt, Homo sapiens
ccccuaguaacugcugu

SEQ ID NO: 2063454 - RNA, 23 nt, Homo sapiens
ucugucccuuaauaaaaauauau

SEQ ID NO: 2063455 - RNA, 13 nt, Homo sapiens
agaagcagcugca

SEQ ID NO: 2063456 - RNA, 17 nt, Homo sapiens
agcugcucugagccaca

SEQ ID NO: 2063457 - RNA, 14 nt, Homo sapiens
uauucuugucaaaa

SEQ ID NO: 2063458 - RNA, 20 nt, Homo sapiens
acccuuuccucuuaauuccc

SEQ ID NO: 2063459 - RNA, 14 nt, Homo sapiens
uucucaucccacgc

SEQ ID NO: 2063460 - RNA, 11 nt, Homo sapiens
ggaucuucaau

SEQ ID NO: 2063461 - RNA, 20 nt, Homo sapiens
cacuaaaugaucugauuucg

SEQ ID NO: 2063462 - RNA, 20 nt, Homo sapiens
uccagagagcaaacauagga

SEQ ID NO: 2063463 - RNA, 18 nt, Homo sapiens
uaauaagaccccacugga

SEQ ID NO: 2063464 - RNA, 16 nt, Homo sapiens
ucaguggugagacugu

SEQ ID NO: 2063465 - RNA, 22 nt, Homo sapiens
ugcuucuuuccuuuccauugua

SEQ ID NO: 2063466 - RNA, 14 nt, Homo sapiens
ucugcaaaauggag

SEQ ID NO: 2063467 - RNA, 21 nt, Homo sapiens
ugugggcgcucucccuaccuu

SEQ ID NO: 2063468 - RNA, 13 nt, Homo sapiens
guuuuauauccau

SEQ ID NO: 2063469 - RNA, 19 nt, Homo sapiens
cagggaggcugugcacaga

SEQ ID NO: 2063470 - RNA, 13 nt, Homo sapiens
gugacuggccugc

SEQ ID NO: 2063471 - RNA, 21 nt, Homo sapiens
gcagagcucccacaaugcuga

SEQ ID NO: 2063472 - RNA, 15 nt, Homo sapiens
acuguguguguccua

SEQ ID NO: 2063473 - RNA, 21 nt, Homo sapiens
uuuucccaggaaagaagcauu

SEQ ID NO: 2063474 - RNA, 16 nt, Homo sapiens
cauccaaggcuguuac

SEQ ID NO: 2063475 - RNA, 12 nt, Homo sapiens
agagccacagaa

SEQ ID NO: 2063476 - RNA, 22 nt, Homo sapiens
ucuguuucuaauuugcugcuga

SEQ ID NO: 2063477 - RNA, 14 nt, Homo sapiens
uagacuaaggccau

SEQ ID NO: 2063478 - RNA, 20 nt, Homo sapiens
aaaagaaugaugcuaugaaa

SEQ ID NO: 2063479 - RNA, 19 nt, Homo sapiens
caaaccaagagccaaaaau

SEQ ID NO: 2063480 - RNA, 19 nt, Homo sapiens
cacgggugucacggccagg

SEQ ID NO: 2063481 - RNA, 20 nt, Homo sapiens
uuucccgcgcuccaugccuc

SEQ ID NO: 2063482 - RNA, 23 nt, Homo sapiens
cccagagugagcuuuagcucucu

SEQ ID NO: 2063483 - RNA, 14 nt, Homo sapiens
aacucggaaacuau

SEQ ID NO: 2063484 - RNA, 20 nt, Homo sapiens
auacacaagagggacuguau

SEQ ID NO: 2063485 - RNA, 15 nt, Homo sapiens
caaacacauugugaa

SEQ ID NO: 2063486 - RNA, 18 nt, Homo sapiens
aggcucucgcacaccucu

SEQ ID NO: 2063487 - RNA, 17 nt, Homo sapiens
aagggacccaccugcua

SEQ ID NO: 2063488 - RNA, 18 nt, Homo sapiens
uccucaauaaacauuuca

SEQ ID NO: 2063489 - RNA, 13 nt, Homo sapiens
agaggugcuucug

SEQ ID NO: 2063490 - RNA, 20 nt, Homo sapiens
gggggcuuggcugugcccuc

SEQ ID NO: 2063491 - RNA, 19 nt, Homo sapiens
ccugauauaacacuuucca

SEQ ID NO: 2063492 - RNA, 12 nt, Homo sapiens
cagggcugcauc

SEQ ID NO: 2063493 - RNA, 13 nt, Homo sapiens
caguuaagccuuu

SEQ ID NO: 2063494 - RNA, 15 nt, Homo sapiens
ggacuuucuugcaag

SEQ ID NO: 2063495 - RNA, 17 nt, Homo sapiens
uaaaccuugucuaugaa

SEQ ID NO: 2063496 - RNA, 19 nt, Homo sapiens
agccauauugucaccucag

SEQ ID NO: 2063497 - RNA, 22 nt, Homo sapiens
uagaucacuuguccucuugcca

SEQ ID NO: 2063498 - RNA, 17 nt, Homo sapiens
acucaguauauagccuu

SEQ ID NO: 2063499 - RNA, 19 nt, Homo sapiens
ugcaauuggaauaaucacu

SEQ ID NO: 2063500 - RNA, 23 nt, Homo sapiens
ccgugaacuugugagaacacagc

SEQ ID NO: 2063501 - RNA, 13 nt, Homo sapiens
ggguccacagcug

SEQ ID NO: 2063502 - RNA, 18 nt, Homo sapiens
agggcugguucagggcug

SEQ ID NO: 2063503 - RNA, 18 nt, Homo sapiens
acuguauuugaaauaaga

SEQ ID NO: 2063504 - RNA, 21 nt, Homo sapiens
ccuucauugccacacuuggug

SEQ ID NO: 2063505 - RNA, 17 nt, Homo sapiens
ccacgggggcaguguga

SEQ ID NO: 2063506 - RNA, 17 nt, Homo sapiens
uaaucuauuauuuggag

SEQ ID NO: 2063507 - RNA, 18 nt, Homo sapiens
ccacucccagugcuugca

SEQ ID NO: 2063508 - RNA, 16 nt, Homo sapiens
ucugcacuauaugcaa

SEQ ID NO: 2063509 - RNA, 13 nt, Homo sapiens
gcugaaaacauaa

SEQ ID NO: 2063510 - RNA, 21 nt, Homo sapiens
ucauguaauuugcauuacucu

SEQ ID NO: 2063511 - RNA, 13 nt, Homo sapiens
gaugagcuuucuu

SEQ ID NO: 2063512 - RNA, 14 nt, Homo sapiens
cuuagagaacuaaa

SEQ ID NO: 2063513 - RNA, 19 nt, Homo sapiens
cccaguuggugacugggaa

SEQ ID NO: 2063514 - RNA, 22 nt, Homo sapiens
aaguaaaggcauuguccaaagu

SEQ ID NO: 2063515 - RNA, 14 nt, Homo sapiens
agaugugagccuug

SEQ ID NO: 2063516 - RNA, 14 nt, Homo sapiens
uucuucacauguaa

SEQ ID NO: 2063517 - RNA, 17 nt, Homo sapiens
aucauagccuauugugu

SEQ ID NO: 2063518 - RNA, 17 nt, Homo sapiens
cuuacuaaugugcccca

SEQ ID NO: 2063519 - RNA, 20 nt, Homo sapiens
cuacucgggaggcugaggca

SEQ ID NO: 2063520 - RNA, 18 nt, Homo sapiens
guugaugguuguacauau

SEQ ID NO: 2063521 - RNA, 17 nt, Homo sapiens
agcugaguucauggcuu

SEQ ID NO: 2063522 - RNA, 23 nt, Homo sapiens
aaaguuaccuggaaucaaauaaa

SEQ ID NO: 2063523 - RNA, 20 nt, Homo sapiens
cugcuuaucagugugcaaua

SEQ ID NO: 2063524 - RNA, 13 nt, Homo sapiens
uaauucaguguca

SEQ ID NO: 2063525 - RNA, 17 nt, Homo sapiens
gaauuuugauuucuuaa

SEQ ID NO: 2063526 - RNA, 12 nt, Homo sapiens
guccacugugac

SEQ ID NO: 2063527 - RNA, 18 nt, Homo sapiens
aucacuucacuguucucu

SEQ ID NO: 2063528 - RNA, 13 nt, Homo sapiens
gaccccagcagcu

SEQ ID NO: 2063529 - RNA, 11 nt, Homo sapiens
acaaacagacg

SEQ ID NO: 2063530 - RNA, 17 nt, Homo sapiens
cccgccgggcaguguca

SEQ ID NO: 2063531 - RNA, 16 nt, Homo sapiens
cuugccgucuaccuga

SEQ ID NO: 2063532 - RNA, 12 nt, Homo sapiens
cagcaccugcca

SEQ ID NO: 2063533 - RNA, 19 nt, Homo sapiens
cuagacugccagggagacc

SEQ ID NO: 2063534 - RNA, 14 nt, Homo sapiens
accauaacugacaa

SEQ ID NO: 2063535 - RNA, 19 nt, Homo sapiens
agggaguguuugugucuga

SEQ ID NO: 2063536 - RNA, 23 nt, Homo sapiens
aagcuccggguguagauucccuu

SEQ ID NO: 2063537 - RNA, 18 nt, Homo sapiens
auaugugugugugugcau

SEQ ID NO: 2063538 - RNA, 21 nt, Homo sapiens
gguugaacucugguggcacag

SEQ ID NO: 2063539 - RNA, 21 nt, Homo sapiens
gcauauguuguugcuuguaua

SEQ ID NO: 2063540 - RNA, 13 nt, Homo sapiens
uuccuggugcugg

SEQ ID NO: 2063541 - RNA, 16 nt, Homo sapiens
agcacugcugccucag

SEQ ID NO: 2063542 - RNA, 13 nt, Homo sapiens
ccuucagagccag

SEQ ID NO: 2063543 - RNA, 18 nt, Homo sapiens
guaauucuagccuuuuaa

SEQ ID NO: 2063544 - RNA, 18 nt, Homo sapiens
accuccuccugcugcuca

SEQ ID NO: 2063545 - RNA, 13 nt, Homo sapiens
cuaagauuaccuu

SEQ ID NO: 2063546 - RNA, 15 nt, Homo sapiens
gacaccaccacugug

SEQ ID NO: 2063547 - RNA, 15 nt, Homo sapiens
aaaaaugucacugaa

SEQ ID NO: 2063548 - RNA, 21 nt, Homo sapiens
aaccgccauugggcuacugua

SEQ ID NO: 2063549 - RNA, 20 nt, Homo sapiens
cugagccauuugcugcauuu

SEQ ID NO: 2063550 - RNA, 21 nt, Homo sapiens
ggaauuccagugccaggccag

SEQ ID NO: 2063551 - RNA, 21 nt, Homo sapiens
uggccaaagauuugagcacaa

SEQ ID NO: 2063552 - RNA, 15 nt, Homo sapiens
ucauaagggcacuga

SEQ ID NO: 2063553 - RNA, 21 nt, Homo sapiens
cuggggucuccuauacucuau

SEQ ID NO: 2063554 - RNA, 17 nt, Homo sapiens
uguguuucacaguuuga

SEQ ID NO: 2063555 - RNA, 16 nt, Homo sapiens
aagaauugucuugcaa

SEQ ID NO: 2063556 - RNA, 16 nt, Homo sapiens
caauugggagcugcca

SEQ ID NO: 2063557 - RNA, 14 nt, Homo sapiens
uccuauauauagau

SEQ ID NO: 2063558 - RNA, 20 nt, Homo sapiens
guaauuuagcaguccaaaga

SEQ ID NO: 2063559 - RNA, 15 nt, Homo sapiens
ucaaguccaucugac

SEQ ID NO: 2063560 - RNA, 15 nt, Homo sapiens
uucuaaacacaaaua

SEQ ID NO: 2063561 - RNA, 17 nt, Homo sapiens
auucauaacagaacaag

SEQ ID NO: 2063562 - RNA, 19 nt, Homo sapiens
gaagucgaggcugcaguca

SEQ ID NO: 2063563 - RNA, 13 nt, Homo sapiens
ucacucauugcag

SEQ ID NO: 2063564 - RNA, 15 nt, Homo sapiens
gccaucgcaucaugu

SEQ ID NO: 2063565 - RNA, 22 nt, Homo sapiens
uggagccagcaaccagcacauc

SEQ ID NO: 2063566 - RNA, 19 nt, Homo sapiens
ccacuuucuagccagagga

SEQ ID NO: 2063567 - RNA, 15 nt, Homo sapiens
auaggauugcuucaa

SEQ ID NO: 2063568 - RNA, 15 nt, Homo sapiens
acuguugauguaucu

SEQ ID NO: 2063569 - RNA, 22 nt, Homo sapiens
cauaucuuguuguucaguuugg

SEQ ID NO: 2063570 - RNA, 12 nt, Homo sapiens
auggacucugca

SEQ ID NO: 2063571 - RNA, 20 nt, Homo sapiens
ucaaacagggacacuacaaa

SEQ ID NO: 2063572 - RNA, 17 nt, Homo sapiens
ugaccucguacucagga

SEQ ID NO: 2063573 - RNA, 21 nt, Homo sapiens
uauaucauaacuauacuugau

SEQ ID NO: 2063574 - RNA, 14 nt, Homo sapiens
uaccuuucuucacu

SEQ ID NO: 2063575 - RNA, 15 nt, Homo sapiens
uuugggguucaagaa

SEQ ID NO: 2063576 - RNA, 13 nt, Homo sapiens
cugaguguggacu

SEQ ID NO: 2063577 - RNA, 16 nt, Homo sapiens
caauugaccuugugac

SEQ ID NO: 2063578 - RNA, 12 nt, Homo sapiens
guuccuggugac

SEQ ID NO: 2063579 - RNA, 18 nt, Homo sapiens
aucaauaccugcugagag

SEQ ID NO: 2063580 - RNA, 14 nt, Homo sapiens
uguaccugccauaa

SEQ ID NO: 2063581 - RNA, 11 nt, Homo sapiens
ccgugguccaa

SEQ ID NO: 2063582 - RNA, 17 nt, Homo sapiens
auaaacaaucuuagaca

SEQ ID NO: 2063583 - RNA, 14 nt, Homo sapiens
aauacgauccugca

SEQ ID NO: 2063584 - RNA, 20 nt, Homo sapiens
uuugcucuagggaagcagug

SEQ ID NO: 2063585 - RNA, 20 nt, Homo sapiens
guaacgggucguaaugacuu

SEQ ID NO: 2063586 - RNA, 21 nt, Homo sapiens
gaaggccacuguuugucucac

SEQ ID NO: 2063587 - RNA, 15 nt, Homo sapiens
auauauuuacucagu

SEQ ID NO: 2063588 - RNA, 19 nt, Homo sapiens
aaaacucagccugggacag

SEQ ID NO: 2063589 - RNA, 19 nt, Homo sapiens
aaguacaaacuucuccuau

SEQ ID NO: 2063590 - RNA, 16 nt, Homo sapiens
uguccccuccacuguc

SEQ ID NO: 2063591 - RNA, 19 nt, Homo sapiens
cuggggaauauacgugcuu

SEQ ID NO: 2063592 - RNA, 19 nt, Homo sapiens
cagugcaacugacaaguua

SEQ ID NO: 2063593 - RNA, 23 nt, Homo sapiens
uaccuuccccagacuugcacugg

SEQ ID NO: 2063594 - RNA, 19 nt, Homo sapiens
ccaggcuaauacaggaaac

SEQ ID NO: 2063595 - RNA, 13 nt, Homo sapiens
uccuccacuuugc

SEQ ID NO: 2063596 - RNA, 20 nt, Homo sapiens
aaaugcuggugaaaugcugu

SEQ ID NO: 2063597 - RNA, 19 nt, Homo sapiens
ugacuuuugaagaacaaaa

SEQ ID NO: 2063598 - RNA, 19 nt, Homo sapiens
gcaaccaagucacacgcuu

SEQ ID NO: 2063599 - RNA, 14 nt, Homo sapiens
ccaccaucccugau

SEQ ID NO: 2063600 - RNA, 22 nt, Homo sapiens
uucuguguacugggugaugcac

SEQ ID NO: 2063601 - RNA, 14 nt, Homo sapiens
ugagcgcugaugau

SEQ ID NO: 2063602 - RNA, 22 nt, Homo sapiens
acaaaaaucacaaggcauucaa

SEQ ID NO: 2063603 - RNA, 15 nt, Homo sapiens
auuguuuaagcagaa

SEQ ID NO: 2063604 - RNA, 17 nt, Homo sapiens
agagagcaucugcaaca

SEQ ID NO: 2063605 - RNA, 16 nt, Homo sapiens
cagcucugaggacugc

SEQ ID NO: 2063606 - RNA, 22 nt, Homo sapiens
uccaaauaaaaauaacaucauu

SEQ ID NO: 2063607 - RNA, 14 nt, Homo sapiens
aaaguagugaguua

SEQ ID NO: 2063608 - RNA, 14 nt, Homo sapiens
acuuucugauuacu

SEQ ID NO: 2063609 - RNA, 21 nt, Homo sapiens
aagcuaguguaccuccucuca

SEQ ID NO: 2063610 - RNA, 13 nt, Homo sapiens
ugggcagcuguua

SEQ ID NO: 2063611 - RNA, 15 nt, Homo sapiens
gugagagaaucugcc

SEQ ID NO: 2063612 - RNA, 16 nt, Homo sapiens
uaauauuauuacuuua

SEQ ID NO: 2063613 - RNA, 20 nt, Homo sapiens
guaaccuguugcuguguuua

SEQ ID NO: 2063614 - RNA, 18 nt, Homo sapiens
ggccugcuccagaccuga

SEQ ID NO: 2063615 - RNA, 16 nt, Homo sapiens
cagaucaagccugccu

SEQ ID NO: 2063616 - RNA, 15 nt, Homo sapiens
cuaauaauuugccau

SEQ ID NO: 2063617 - RNA, 13 nt, Homo sapiens
uuucacacacaca

SEQ ID NO: 2063618 - RNA, 18 nt, Homo sapiens
uacuacaggauauuuacu

SEQ ID NO: 2063619 - RNA, 15 nt, Homo sapiens
ugcuggcaguacugu

SEQ ID NO: 2063620 - RNA, 20 nt, Homo sapiens
caguguauagaaaaaccaaa

SEQ ID NO: 2063621 - RNA, 14 nt, Homo sapiens
ugcaacuucugccu

SEQ ID NO: 2063622 - RNA, 20 nt, Homo sapiens
gcuaauuuugaaaaacugcu

SEQ ID NO: 2063623 - RNA, 21 nt, Homo sapiens
gggagauucaagggacccaug

SEQ ID NO: 2063624 - RNA, 15 nt, Homo sapiens
uuaguuuuugaucaa

SEQ ID NO: 2063625 - RNA, 24 nt, Homo sapiens
agaaacuuuggaaguuuuacuuga

SEQ ID NO: 2063626 - RNA, 18 nt, Homo sapiens
ucaauaucugggucaauc

SEQ ID NO: 2063627 - RNA, 14 nt, Homo sapiens
ugcaauguccugca

SEQ ID NO: 2063628 - RNA, 13 nt, Homo sapiens
ggacugaguuuau

SEQ ID NO: 2063629 - RNA, 14 nt, Homo sapiens
caagcaagcagaca

SEQ ID NO: 2063630 - RNA, 16 nt, Homo sapiens
agauggacacugccaa

SEQ ID NO: 2063631 - RNA, 15 nt, Homo sapiens
cacagacaacucaca

SEQ ID NO: 2063632 - RNA, 20 nt, Homo sapiens
aaauuucuuaggaacucaaa

SEQ ID NO: 2063633 - RNA, 19 nt, Homo sapiens
aacuuuuuguuuuuauuuc

SEQ ID NO: 2063634 - RNA, 19 nt, Homo sapiens
aauuaaaggguuaaugugu

SEQ ID NO: 2063635 - RNA, 14 nt, Homo sapiens
uagccacagcaguu

SEQ ID NO: 2063636 - RNA, 15 nt, Homo sapiens
aaaucauacuuucuc

SEQ ID NO: 2063637 - RNA, 20 nt, Homo sapiens
uaauuuuaaccaguucuguc

SEQ ID NO: 2063638 - RNA, 20 nt, Homo sapiens
cagugagccuccugugccug

SEQ ID NO: 2063639 - RNA, 14 nt, Homo sapiens
aaaauauagcugua

SEQ ID NO: 2063640 - RNA, 16 nt, Homo sapiens
uauauagaaugaucua

SEQ ID NO: 2063641 - RNA, 12 nt, Homo sapiens
gaagucccucag

SEQ ID NO: 2063642 - RNA, 18 nt, Homo sapiens
uggacuuuccacccccuc

SEQ ID NO: 2063643 - RNA, 23 nt, Homo sapiens
auguccggagagacagugacagc

SEQ ID NO: 2063644 - RNA, 19 nt, Homo sapiens
agaagacauuugccaacag

SEQ ID NO: 2063645 - RNA, 18 nt, Homo sapiens
gcccauaucugugaaaug

SEQ ID NO: 2063646 - RNA, 22 nt, Homo sapiens
ucuucgacuguuguuaucuguu

SEQ ID NO: 2063647 - RNA, 17 nt, Homo sapiens
uguuuucugacuaggcu

SEQ ID NO: 2063648 - RNA, 14 nt, Homo sapiens
uaaaauagccacuu

SEQ ID NO: 2063649 - RNA, 15 nt, Homo sapiens
aagaaggacacuugu

SEQ ID NO: 2063650 - RNA, 14 nt, Homo sapiens
ugucaugcagagua

SEQ ID NO: 2063651 - RNA, 16 nt, Homo sapiens
cagggacaaccaccag

SEQ ID NO: 2063652 - RNA, 21 nt, Homo sapiens
aggcaaaggcucucacuccag

SEQ ID NO: 2063653 - RNA, 16 nt, Homo sapiens
auggaaacagacucau

SEQ ID NO: 2063654 - RNA, 15 nt, Homo sapiens
cacacgcaggaacuc

SEQ ID NO: 2063655 - RNA, 15 nt, Homo sapiens
ugugagagcccaguc

SEQ ID NO: 2063656 - RNA, 12 nt, Homo sapiens
ugcuggcuucag

SEQ ID NO: 2063657 - RNA, 15 nt, Homo sapiens
uuauuauaauuguau

SEQ ID NO: 2063658 - RNA, 15 nt, Homo sapiens
aaucauuuguucaaa

SEQ ID NO: 2063659 - RNA, 16 nt, Homo sapiens
auugggauuuucuaca

SEQ ID NO: 2063660 - RNA, 12 nt, Homo sapiens
aaacucucacca

SEQ ID NO: 2063661 - RNA, 19 nt, Homo sapiens
uauuuguguaaaguaugca

SEQ ID NO: 2063662 - RNA, 20 nt, Homo sapiens
caucugaagagcuagucuau

SEQ ID NO: 2063663 - RNA, 16 nt, Homo sapiens
gcucccuuccugccac

SEQ ID NO: 2063664 - RNA, 19 nt, Homo sapiens
ccaugugacuguggcauuu

SEQ ID NO: 2063665 - RNA, 21 nt, Homo sapiens
caagcugcagggaauuuucau

SEQ ID NO: 2063666 - RNA, 16 nt, Homo sapiens
ucucucacaaagucca

SEQ ID NO: 2063667 - RNA, 22 nt, Homo sapiens
uggauuuauaguaugugacuuu

SEQ ID NO: 2063668 - RNA, 14 nt, Homo sapiens
aaccaacacuaaca

SEQ ID NO: 2063669 - RNA, 17 nt, Homo sapiens
ggggaagaccuuguccc

SEQ ID NO: 2063670 - RNA, 14 nt, Homo sapiens
cacaggagacauua

SEQ ID NO: 2063671 - RNA, 19 nt, Homo sapiens
uaaagacaaaaaaaucacg

SEQ ID NO: 2063672 - RNA, 12 nt, Homo sapiens
cuguggggagcc

SEQ ID NO: 2063673 - RNA, 20 nt, Homo sapiens
gcuucucuccacccaugacc

SEQ ID NO: 2063674 - RNA, 17 nt, Homo sapiens
aucuaugcgccuguagu

SEQ ID NO: 2063675 - RNA, 18 nt, Homo sapiens
cuggcugcugcugugcag

SEQ ID NO: 2063676 - RNA, 20 nt, Homo sapiens
gucuuaucugcuauaaacuu

SEQ ID NO: 2063677 - RNA, 14 nt, Homo sapiens
ccaaugccaccuag

SEQ ID NO: 2063678 - RNA, 13 nt, Homo sapiens
ccugccacuucaa

SEQ ID NO: 2063679 - RNA, 16 nt, Homo sapiens
uagaucaacagaucaa

SEQ ID NO: 2063680 - RNA, 15 nt, Homo sapiens
uucaagagugagcua

SEQ ID NO: 2063681 - RNA, 12 nt, Homo sapiens
ugcaccuaccuu

SEQ ID NO: 2063682 - RNA, 21 nt, Homo sapiens
aaugugcuggugaacacugug

SEQ ID NO: 2063683 - RNA, 14 nt, Homo sapiens
uuagaaaugcaaaa

SEQ ID NO: 2063684 - RNA, 16 nt, Homo sapiens
gcugcagucccuggaa

SEQ ID NO: 2063685 - RNA, 20 nt, Homo sapiens
guagccucaauucuccauua

SEQ ID NO: 2063686 - RNA, 22 nt, Homo sapiens
gacuuuuguguaaaaagcaaag

SEQ ID NO: 2063687 - RNA, 16 nt, Homo sapiens
ucacuucacuguucuc

SEQ ID NO: 2063688 - RNA, 15 nt, Homo sapiens
auugaggaguugccu

SEQ ID NO: 2063689 - RNA, 14 nt, Homo sapiens
cugcaaaaugaagg

SEQ ID NO: 2063690 - RNA, 18 nt, Homo sapiens
uugggaaggcaccugcuc

SEQ ID NO: 2063691 - RNA, 22 nt, Homo sapiens
aggccuagaguggcagccaaga

SEQ ID NO: 2063692 - RNA, 15 nt, Homo sapiens
cuuaaaaucugugaa

SEQ ID NO: 2063693 - RNA, 15 nt, Homo sapiens
ccaucagagaggcaa

SEQ ID NO: 2063694 - RNA, 12 nt, Homo sapiens
aagcgugcugcc

SEQ ID NO: 2063695 - RNA, 16 nt, Homo sapiens
ucaacuucaucagugu

SEQ ID NO: 2063696 - RNA, 21 nt, Homo sapiens
aaauuauuuuuguucauauaa

SEQ ID NO: 2063697 - RNA, 20 nt, Homo sapiens
augcugcuuccauuugacaa

SEQ ID NO: 2063698 - RNA, 18 nt, Homo sapiens
ugaauccucuucuuuaua

SEQ ID NO: 2063699 - RNA, 15 nt, Homo sapiens
agcagaugcaaucuc

SEQ ID NO: 2063700 - RNA, 20 nt, Homo sapiens
aacaucaucaaggcacugcc

SEQ ID NO: 2063701 - RNA, 23 nt, Homo sapiens
aaaugcaagccaucucuaauaau

SEQ ID NO: 2063702 - RNA, 16 nt, Homo sapiens
ugugccagcacaaagu

SEQ ID NO: 2063703 - RNA, 23 nt, Homo sapiens
ucugcuucucaucuaaauauuuc

SEQ ID NO: 2063704 - RNA, 15 nt, Homo sapiens
uuauuuuuuucccaa

SEQ ID NO: 2063705 - RNA, 15 nt, Homo sapiens
gaccacaauuaucuu

SEQ ID NO: 2063706 - RNA, 19 nt, Homo sapiens
uuucauaccuaucaucuua

SEQ ID NO: 2063707 - RNA, 14 nt, Homo sapiens
aaaauauugcuuau

SEQ ID NO: 2063708 - RNA, 15 nt, Homo sapiens
aguuaauaacagcuc

SEQ ID NO: 2063709 - RNA, 15 nt, Homo sapiens
uuuccucaccagucc

SEQ ID NO: 2063710 - RNA, 21 nt, Homo sapiens
auaaaaauguuucuacagaua

SEQ ID NO: 2063711 - RNA, 15 nt, Homo sapiens
cauugccuggacuga

SEQ ID NO: 2063712 - RNA, 19 nt, Homo sapiens
ccuuugaauaaaaaugcac

SEQ ID NO: 2063713 - RNA, 13 nt, Homo sapiens
aaagcugcugaca

SEQ ID NO: 2063714 - RNA, 13 nt, Homo sapiens
ugaggagucuugu

SEQ ID NO: 2063715 - RNA, 15 nt, Homo sapiens
gagugacagcuuucu

SEQ ID NO: 2063716 - RNA, 20 nt, Homo sapiens
gugaguucuuucaucucccu

SEQ ID NO: 2063717 - RNA, 17 nt, Homo sapiens
auaggauagacacugga

SEQ ID NO: 2063718 - RNA, 18 nt, Homo sapiens
cauaauuucuucacucaa

SEQ ID NO: 2063719 - RNA, 18 nt, Homo sapiens
ccaggcuggagugcaaug

SEQ ID NO: 2063720 - RNA, 18 nt, Homo sapiens
ccaggcuagagugcagug

SEQ ID NO: 2063721 - RNA, 21 nt, Homo sapiens
cuuaauaaucaagagccuuaa

SEQ ID NO: 2063722 - RNA, 14 nt, Homo sapiens
auucacacaaagac

SEQ ID NO: 2063723 - RNA, 14 nt, Homo sapiens
caagauaccuucau

SEQ ID NO: 2063724 - RNA, 20 nt, Homo sapiens
uccucccauuucccauuaaa

SEQ ID NO: 2063725 - RNA, 14 nt, Homo sapiens
acuaccaacuuuca

SEQ ID NO: 2063726 - RNA, 17 nt, Homo sapiens
agcugcuguugaacuuu

SEQ ID NO: 2063727 - RNA, 17 nt, Homo sapiens
aagaaauacagacugga

SEQ ID NO: 2063728 - RNA, 20 nt, Homo sapiens
ucuucccagcacuaugcuuu

SEQ ID NO: 2063729 - RNA, 15 nt, Homo sapiens
cugacuggcaaagga

SEQ ID NO: 2063730 - RNA, 20 nt, Homo sapiens
caaaucuagaagaugcaguu

SEQ ID NO: 2063731 - RNA, 19 nt, Homo sapiens
augcuuugccauaaccaca

SEQ ID NO: 2063732 - RNA, 16 nt, Homo sapiens
cugauuuuugucccag

SEQ ID NO: 2063733 - RNA, 15 nt, Homo sapiens
ggcgcaucauaugca

SEQ ID NO: 2063734 - RNA, 13 nt, Homo sapiens
auggugucauuua

SEQ ID NO: 2063735 - RNA, 15 nt, Homo sapiens
ucaaccgcuugccau

SEQ ID NO: 2063736 - RNA, 22 nt, Homo sapiens
aacugugcuuguugaaugucaa

SEQ ID NO: 2063737 - RNA, 17 nt, Homo sapiens
aaggucugagcacugga

SEQ ID NO: 2063738 - RNA, 19 nt, Homo sapiens
cugugcuacacuggauaaa

SEQ ID NO: 2063739 - RNA, 19 nt, Homo sapiens
caaguaauacguuuugaca

SEQ ID NO: 2063740 - RNA, 20 nt, Homo sapiens
uacauucuuuaucuugacau

SEQ ID NO: 2063741 - RNA, 17 nt, Homo sapiens
cgcugcucagaccugug

SEQ ID NO: 2063742 - RNA, 16 nt, Homo sapiens
ucagacugucaggcaa

SEQ ID NO: 2063743 - RNA, 22 nt, Homo sapiens
caccuagaaaggaacugcaaua

SEQ ID NO: 2063744 - RNA, 14 nt, Homo sapiens
accgauaugcacuu

SEQ ID NO: 2063745 - RNA, 14 nt, Homo sapiens
guguccagcacaga

SEQ ID NO: 2063746 - RNA, 16 nt, Homo sapiens
accugucucucucuuc

SEQ ID NO: 2063747 - RNA, 12 nt, Homo sapiens
ccuccuuggcac

SEQ ID NO: 2063748 - RNA, 16 nt, Homo sapiens
ucaguggcucugggua

SEQ ID NO: 2063749 - RNA, 20 nt, Homo sapiens
uaaaacugucuugugagcug

SEQ ID NO: 2063750 - RNA, 12 nt, Homo sapiens
cuccagugcagg

SEQ ID NO: 2063751 - RNA, 17 nt, Homo sapiens
cucaagucuucccugau

SEQ ID NO: 2063752 - RNA, 17 nt, Homo sapiens
gcucagucccuacugag

SEQ ID NO: 2063753 - RNA, 17 nt, Homo sapiens
auaaaguuagaaucuau

SEQ ID NO: 2063754 - RNA, 19 nt, Homo sapiens
cuuuacuauuuauuuacau

SEQ ID NO: 2063755 - RNA, 18 nt, Homo sapiens
acaaggcuggcagugaca

SEQ ID NO: 2063756 - RNA, 15 nt, Homo sapiens
cacacaucuuaccuc

SEQ ID NO: 2063757 - RNA, 22 nt, Homo sapiens
accugauugaucacacaguguu

SEQ ID NO: 2063758 - RNA, 14 nt, Homo sapiens
uaaaguauguccuu

SEQ ID NO: 2063759 - RNA, 19 nt, Homo sapiens
uauuuucuuuucuuucaac

SEQ ID NO: 2063760 - RNA, 12 nt, Homo sapiens
cugauugggcac

SEQ ID NO: 2063761 - RNA, 17 nt, Homo sapiens
gugaccucacgugcaaa

SEQ ID NO: 2063762 - RNA, 21 nt, Homo sapiens
cacacucucuucuuacuguau

SEQ ID NO: 2063763 - RNA, 18 nt, Homo sapiens
cugcuccaguguaucuca

SEQ ID NO: 2063764 - RNA, 20 nt, Homo sapiens
cucaguggcucacaccugua

SEQ ID NO: 2063765 - RNA, 18 nt, Homo sapiens
acacaaucugaaacagcu

SEQ ID NO: 2063766 - RNA, 19 nt, Homo sapiens
uuucacuguguuggccagg

SEQ ID NO: 2063767 - RNA, 16 nt, Homo sapiens
ucacaguuucuuccau

SEQ ID NO: 2063768 - RNA, 16 nt, Homo sapiens
caaagcaggauuauua

SEQ ID NO: 2063769 - RNA, 16 nt, Homo sapiens
uauuucaaaacacauc

SEQ ID NO: 2063770 - RNA, 19 nt, Homo sapiens
ggagaguugaccguuuuca

SEQ ID NO: 2063771 - RNA, 20 nt, Homo sapiens
acagccuccgccaagaucua

SEQ ID NO: 2063772 - RNA, 22 nt, Homo sapiens
acucacagcugaagaaaaugag

SEQ ID NO: 2063773 - RNA, 18 nt, Homo sapiens
ucccucaucuagucuuga

SEQ ID NO: 2063774 - RNA, 20 nt, Homo sapiens
aggcaggaggaucacuugga

SEQ ID NO: 2063775 - RNA, 15 nt, Homo sapiens
auggccuugcuaccu

SEQ ID NO: 2063776 - RNA, 13 nt, Homo sapiens
aguauuacacauu

SEQ ID NO: 2063777 - RNA, 12 nt, Homo sapiens
auuuucaccucc

SEQ ID NO: 2063778 - RNA, 23 nt, Homo sapiens
auaaauaaaacagcagcagcaaa

SEQ ID NO: 2063779 - RNA, 17 nt, Homo sapiens
cagauuuaaagcaucau

SEQ ID NO: 2063780 - RNA, 18 nt, Homo sapiens
uagugccugaaauuucac

SEQ ID NO: 2063781 - RNA, 14 nt, Homo sapiens
ccaacagcacccuc

SEQ ID NO: 2063782 - RNA, 23 nt, Homo sapiens
caggggccaaccucaggcuccua

SEQ ID NO: 2063783 - RNA, 16 nt, Homo sapiens
caaugcuaucacuguc

SEQ ID NO: 2063784 - RNA, 12 nt, Homo sapiens
caauuucucugc

SEQ ID NO: 2063785 - RNA, 17 nt, Homo sapiens
augaagugacucucaca

SEQ ID NO: 2063786 - RNA, 18 nt, Homo sapiens
ccacccaguccugcacac

SEQ ID NO: 2063787 - RNA, 19 nt, Homo sapiens
gaacucauuuccauuugag

SEQ ID NO: 2063788 - RNA, 13 nt, Homo sapiens
ucauuagcuguga

SEQ ID NO: 2063789 - RNA, 14 nt, Homo sapiens
uuggagucacugua

SEQ ID NO: 2063790 - RNA, 15 nt, Homo sapiens
accugaaacacugga

SEQ ID NO: 2063791 - RNA, 16 nt, Homo sapiens
guggcagauuuaguga

SEQ ID NO: 2063792 - RNA, 15 nt, Homo sapiens
auagcauacugugua

SEQ ID NO: 2063793 - RNA, 23 nt, Homo sapiens
gagcagaugguccuccauuucaa

SEQ ID NO: 2063794 - RNA, 16 nt, Homo sapiens
cuccaggauuguccac

SEQ ID NO: 2063795 - RNA, 18 nt, Homo sapiens
agacacucacagcaagga

SEQ ID NO: 2063796 - RNA, 13 nt, Homo sapiens
agucaggauuuau

SEQ ID NO: 2063797 - RNA, 15 nt, Homo sapiens
uucugggcggccagu

SEQ ID NO: 2063798 - RNA, 13 nt, Homo sapiens
gguuagugcaugu

SEQ ID NO: 2063799 - RNA, 19 nt, Homo sapiens
cuagaauccugcuuuacag

SEQ ID NO: 2063800 - RNA, 21 nt, Homo sapiens
gaucuccugguagcaugaccu

SEQ ID NO: 2063801 - RNA, 14 nt, Homo sapiens
caauaaaccuuccu

SEQ ID NO: 2063802 - RNA, 20 nt, Homo sapiens
ccuucagcccuggccaagcu

SEQ ID NO: 2063803 - RNA, 17 nt, Homo sapiens
aaacuagcacaguaaaa

SEQ ID NO: 2063804 - RNA, 16 nt, Homo sapiens
ccuaaugcuugcugcu

SEQ ID NO: 2063805 - RNA, 17 nt, Homo sapiens
uaguuucuuacacacug

SEQ ID NO: 2063806 - RNA, 14 nt, Homo sapiens
ccagaccucugaca

SEQ ID NO: 2063807 - RNA, 18 nt, Homo sapiens
cugcugucucaucacaua

SEQ ID NO: 2063808 - RNA, 14 nt, Homo sapiens
ucccaauaacccag

SEQ ID NO: 2063809 - RNA, 22 nt, Homo sapiens
aucccaaaggaugagaauguga

SEQ ID NO: 2063810 - RNA, 14 nt, Homo sapiens
gggacuuccuugcu

SEQ ID NO: 2063811 - RNA, 18 nt, Homo sapiens
gcaaccagagcacuguau

SEQ ID NO: 2063812 - RNA, 15 nt, Homo sapiens
ggaugcgacccaaga

SEQ ID NO: 2063813 - RNA, 16 nt, Homo sapiens
aucacgccauugcacu

SEQ ID NO: 2063814 - RNA, 15 nt, Homo sapiens
agauggccgggacau

SEQ ID NO: 2063815 - RNA, 16 nt, Homo sapiens
aagaugggucacugaa

SEQ ID NO: 2063816 - RNA, 20 nt, Homo sapiens
ugaaugucccaacccagaca

SEQ ID NO: 2063817 - RNA, 19 nt, Homo sapiens
gcaugauauuguucuccaa

SEQ ID NO: 2063818 - RNA, 20 nt, Homo sapiens
auccagaacucaaaugagcc

SEQ ID NO: 2063819 - RNA, 13 nt, Homo sapiens
cccacggggugca

SEQ ID NO: 2063820 - RNA, 20 nt, Homo sapiens
cccagaucaagccugccuca

SEQ ID NO: 2063821 - RNA, 17 nt, Homo sapiens
uacaauucccaaaggca

SEQ ID NO: 2063822 - RNA, 24 nt, Homo sapiens
guggucaagcccucgucuagagca

SEQ ID NO: 2063823 - RNA, 22 nt, Homo sapiens
aagugcauuuuuaucugugagu

SEQ ID NO: 2063824 - RNA, 23 nt, Homo sapiens
gacaaggucaccugggcugugau

SEQ ID NO: 2063825 - RNA, 13 nt, Homo sapiens
cacucagaaaaug

SEQ ID NO: 2063826 - RNA, 15 nt, Homo sapiens
ugagcuugacaccug

SEQ ID NO: 2063827 - RNA, 21 nt, Homo sapiens
ugguuacauaucaaaacaucc

SEQ ID NO: 2063828 - RNA, 18 nt, Homo sapiens
ccaacccaugagugcuaa

SEQ ID NO: 2063829 - RNA, 18 nt, Homo sapiens
caugcugggaaugagaca

SEQ ID NO: 2063830 - RNA, 20 nt, Homo sapiens
aguuuggcugguuaauucca

SEQ ID NO: 2063831 - RNA, 16 nt, Homo sapiens
gucacccugggagcag

SEQ ID NO: 2063832 - RNA, 17 nt, Homo sapiens
auaagcaaagacuauga

SEQ ID NO: 2063833 - RNA, 16 nt, Homo sapiens
agucuuaauauucaga

SEQ ID NO: 2063834 - RNA, 14 nt, Homo sapiens
cauagcugaucaug

SEQ ID NO: 2063835 - RNA, 22 nt, Homo sapiens
uagauuaaaggaauuaaacuaa

SEQ ID NO: 2063836 - RNA, 20 nt, Homo sapiens
guaagagagaugagcacuuc

SEQ ID NO: 2063837 - RNA, 22 nt, Homo sapiens
aguugcacagcaucucagcuca

SEQ ID NO: 2063838 - RNA, 21 nt, Homo sapiens
uuccaauuucaaaaugucuca

SEQ ID NO: 2063839 - RNA, 23 nt, Homo sapiens
aggcagugaugcuggaugcuccu

SEQ ID NO: 2063840 - RNA, 17 nt, Homo sapiens
agaaaauaagacuucug

SEQ ID NO: 2063841 - RNA, 17 nt, Homo sapiens
ugugagcagugaguuac

SEQ ID NO: 2063842 - RNA, 20 nt, Homo sapiens
uugcugcaaacccaugaagc

SEQ ID NO: 2063843 - RNA, 19 nt, Homo sapiens
agguggcccuucacugucc

SEQ ID NO: 2063844 - RNA, 15 nt, Homo sapiens
agcaaauuccaauac

SEQ ID NO: 2063845 - RNA, 19 nt, Homo sapiens
augacauagacgcacuugg

SEQ ID NO: 2063846 - RNA, 21 nt, Homo sapiens
gcauuuggggccuuucccauu

SEQ ID NO: 2063847 - RNA, 20 nt, Homo sapiens
cucugcauaccgugaauuua

SEQ ID NO: 2063848 - RNA, 21 nt, Homo sapiens
ugcugauaaauauaaccauca

SEQ ID NO: 2063849 - RNA, 15 nt, Homo sapiens
caucgcgaugucgca

SEQ ID NO: 2063850 - RNA, 21 nt, Homo sapiens
auuuaaagacaaagacauuau

SEQ ID NO: 2063851 - RNA, 15 nt, Homo sapiens
caguuguuagcauuu

SEQ ID NO: 2063852 - RNA, 19 nt, Homo sapiens
auuguaccaggaugugcua

SEQ ID NO: 2063853 - RNA, 14 nt, Homo sapiens
gaggaacacugcac

SEQ ID NO: 2063854 - RNA, 21 nt, Homo sapiens
ccucaauuuccucaucugggu

SEQ ID NO: 2063855 - RNA, 14 nt, Homo sapiens
cauauccaacaugu

SEQ ID NO: 2063856 - RNA, 19 nt, Homo sapiens
gguauuaaacaagucaauu

SEQ ID NO: 2063857 - RNA, 21 nt, Homo sapiens
agcucuguauggucaggaugu

SEQ ID NO: 2063858 - RNA, 22 nt, Homo sapiens
uuguuuuauucaccaucaugua

SEQ ID NO: 2063859 - RNA, 14 nt, Homo sapiens
cccugucuuccaca

SEQ ID NO: 2063860 - RNA, 13 nt, Homo sapiens
uuuuaaccaguuc

SEQ ID NO: 2063861 - RNA, 13 nt, Homo sapiens
aucccaccugcca

SEQ ID NO: 2063862 - RNA, 15 nt, Homo sapiens
ggucagagugccacu

SEQ ID NO: 2063863 - RNA, 14 nt, Homo sapiens
uagcucacaccuga

SEQ ID NO: 2063864 - RNA, 14 nt, Homo sapiens
cagcugcauggcac

SEQ ID NO: 2063865 - RNA, 20 nt, Homo sapiens
gacagugggcaucagcagca

SEQ ID NO: 2063866 - RNA, 16 nt, Homo sapiens
gaugacggccaggcuc

SEQ ID NO: 2063867 - RNA, 14 nt, Homo sapiens
uggaauaacaugua

SEQ ID NO: 2063868 - RNA, 22 nt, Homo sapiens
cagucagauccuguuacuugcu

SEQ ID NO: 2063869 - RNA, 19 nt, Homo sapiens
augcuguggcuccuuccua

SEQ ID NO: 2063870 - RNA, 19 nt, Homo sapiens
augaccccagaaacugaac

SEQ ID NO: 2063871 - RNA, 23 nt, Homo sapiens
cauacuuucuaaaugccuuugac

SEQ ID NO: 2063872 - RNA, 14 nt, Homo sapiens
uaguaaaugcgugc

SEQ ID NO: 2063873 - RNA, 14 nt, Homo sapiens
uacuuagacccagu

SEQ ID NO: 2063874 - RNA, 17 nt, Homo sapiens
cucaaaugacccaaaga

SEQ ID NO: 2063875 - RNA, 17 nt, Homo sapiens
ucaaauugcuacauagu

SEQ ID NO: 2063876 - RNA, 21 nt, Homo sapiens
uguguaacugcccaaagcagc

SEQ ID NO: 2063877 - RNA, 18 nt, Homo sapiens
gucucuaguuccacgccu

SEQ ID NO: 2063878 - RNA, 21 nt, Homo sapiens
auugaaugauuacuauaugca

SEQ ID NO: 2063879 - RNA, 21 nt, Homo sapiens
uucuggaaagaaaaccauucu

SEQ ID NO: 2063880 - RNA, 17 nt, Homo sapiens
ugaugaucauugcuggc

SEQ ID NO: 2063881 - RNA, 23 nt, Homo sapiens
uucugcaggcuucagccauccac

SEQ ID NO: 2063882 - RNA, 20 nt, Homo sapiens
aguuguacauauguuucaca

SEQ ID NO: 2063883 - RNA, 18 nt, Homo sapiens
gaugccucuugcaggguc

SEQ ID NO: 2063884 - RNA, 20 nt, Homo sapiens
ugaaaauugggcaugccauu

SEQ ID NO: 2063885 - RNA, 13 nt, Homo sapiens
agaauggacuguu

SEQ ID NO: 2063886 - RNA, 16 nt, Homo sapiens
cuucuuuuaugagcag

SEQ ID NO: 2063887 - RNA, 19 nt, Homo sapiens
cucuccccguggacccugu

SEQ ID NO: 2063888 - RNA, 15 nt, Homo sapiens
ucuugacuuccccac

SEQ ID NO: 2063889 - RNA, 20 nt, Homo sapiens
ccaugaggaaggaacagcaa

SEQ ID NO: 2063890 - RNA, 20 nt, Homo sapiens
gaaauugucaaagacuguau

SEQ ID NO: 2063891 - RNA, 21 nt, Homo sapiens
agauguuuggaaaccacaguc

SEQ ID NO: 2063892 - RNA, 23 nt, Homo sapiens
cugaaagacuuggguugaacuau

SEQ ID NO: 2063893 - RNA, 15 nt, Homo sapiens
gagaacuccucauuc

SEQ ID NO: 2063894 - RNA, 20 nt, Homo sapiens
auucuggcugcaagggccag

SEQ ID NO: 2063895 - RNA, 17 nt, Homo sapiens
uuaauaucaacucugaa

SEQ ID NO: 2063896 - RNA, 13 nt, Homo sapiens
cuuuaaccucauc

SEQ ID NO: 2063897 - RNA, 16 nt, Homo sapiens
ccuaaugcugcagauu

SEQ ID NO: 2063898 - RNA, 15 nt, Homo sapiens
uagugaagcucucac

SEQ ID NO: 2063899 - RNA, 20 nt, Homo sapiens
cagaaauuuuaagccaaaaa

SEQ ID NO: 2063900 - RNA, 20 nt, Homo sapiens
ccagagccccccacaaugau

SEQ ID NO: 2063901 - RNA, 15 nt, Homo sapiens
ucauuuaauccuccc

SEQ ID NO: 2063902 - RNA, 17 nt, Homo sapiens
gagagggcugagccaug

SEQ ID NO: 2063903 - RNA, 17 nt, Homo sapiens
ccugaaauaaacacugg

SEQ ID NO: 2063904 - RNA, 17 nt, Homo sapiens
ggacaugaagauucuuu

SEQ ID NO: 2063905 - RNA, 20 nt, Homo sapiens
aucuggaacaacuuguagca

SEQ ID NO: 2063906 - RNA, 18 nt, Homo sapiens
aagccgccaguucaucuu

SEQ ID NO: 2063907 - RNA, 21 nt, Homo sapiens
aggcuuagagaagggcucuau

SEQ ID NO: 2063908 - RNA, 12 nt, Homo sapiens
ugcacacuaaga

SEQ ID NO: 2063909 - RNA, 17 nt, Homo sapiens
gcccccugcacagggag

SEQ ID NO: 2063910 - RNA, 23 nt, Homo sapiens
guuuugucuugcgggucugucag

SEQ ID NO: 2063911 - RNA, 20 nt, Homo sapiens
agcuggggagaugggggcuu

SEQ ID NO: 2063912 - RNA, 19 nt, Homo sapiens
aauacagcugagcuaugua

SEQ ID NO: 2063913 - RNA, 21 nt, Homo sapiens
guuuguacucaaagcccagaa

SEQ ID NO: 2063914 - RNA, 19 nt, Homo sapiens
ugcuugaucauuauaucau

SEQ ID NO: 2063915 - RNA, 16 nt, Homo sapiens
ccacucacuuugcaau

SEQ ID NO: 2063916 - RNA, 14 nt, Homo sapiens
auuuggaauacaca

SEQ ID NO: 2063917 - RNA, 18 nt, Homo sapiens
auggauguuuuagccauu

SEQ ID NO: 2063918 - RNA, 20 nt, Homo sapiens
cacagugaacauaacuguaa

SEQ ID NO: 2063919 - RNA, 21 nt, Homo sapiens
ccagugagaucaaugugacgg

SEQ ID NO: 2063920 - RNA, 14 nt, Homo sapiens
aagggaagcuguuu

SEQ ID NO: 2063921 - RNA, 17 nt, Homo sapiens
accauugaaacaugcca

SEQ ID NO: 2063922 - RNA, 17 nt, Homo sapiens
gaaacuaaagcaauaga

SEQ ID NO: 2063923 - RNA, 18 nt, Homo sapiens
uaauccaggcagauccag

SEQ ID NO: 2063924 - RNA, 14 nt, Homo sapiens
uauaagccaguuca

SEQ ID NO: 2063925 - RNA, 14 nt, Homo sapiens
gcaggcugagugca

SEQ ID NO: 2063926 - RNA, 21 nt, Homo sapiens
cucuaagucauguauguuucu

SEQ ID NO: 2063927 - RNA, 22 nt, Homo sapiens
accagugcaagcagaugacaaa

SEQ ID NO: 2063928 - RNA, 18 nt, Homo sapiens
uaccaguauagcuugcau

SEQ ID NO: 2063929 - RNA, 13 nt, Homo sapiens
ucccacucaagcc

SEQ ID NO: 2063930 - RNA, 18 nt, Homo sapiens
augacaaacacacaucca

SEQ ID NO: 2063931 - RNA, 17 nt, Homo sapiens
auuagggccuacauugu

SEQ ID NO: 2063932 - RNA, 21 nt, Homo sapiens
uguagcagcauuacagaaaua

SEQ ID NO: 2063933 - RNA, 19 nt, Homo sapiens
uacugaaaucaagcuggag

SEQ ID NO: 2063934 - RNA, 21 nt, Homo sapiens
cacauuugcuuuuugugauau

SEQ ID NO: 2063935 - RNA, 14 nt, Homo sapiens
gacagccugaguca

SEQ ID NO: 2063936 - RNA, 15 nt, Homo sapiens
ggaagaagugguacu

SEQ ID NO: 2063937 - RNA, 12 nt, Homo sapiens
cccugacugugu

SEQ ID NO: 2063938 - RNA, 15 nt, Homo sapiens
cugagucccaaagcu

SEQ ID NO: 2063939 - RNA, 17 nt, Homo sapiens
agacagcaggucucaug

SEQ ID NO: 2063940 - RNA, 16 nt, Homo sapiens
cgaacaugaccaaaaa

SEQ ID NO: 2063941 - RNA, 15 nt, Homo sapiens
aaccaagcuauucaa

SEQ ID NO: 2063942 - RNA, 15 nt, Homo sapiens
caaaccuaauugcac

SEQ ID NO: 2063943 - RNA, 21 nt, Homo sapiens
cagauucuccucuaauucugu

SEQ ID NO: 2063944 - RNA, 17 nt, Homo sapiens
ucaauuagggaugcuca

SEQ ID NO: 2063945 - RNA, 16 nt, Homo sapiens
cuggaccaucaagggu

SEQ ID NO: 2063946 - RNA, 15 nt, Homo sapiens
agugccauuccacuc

SEQ ID NO: 2063947 - RNA, 16 nt, Homo sapiens
uccccaagaauguuuc

SEQ ID NO: 2063948 - RNA, 12 nt, Homo sapiens
agaguacacugc

SEQ ID NO: 2063949 - RNA, 14 nt, Homo sapiens
agaaaaaacacucc

SEQ ID NO: 2063950 - RNA, 21 nt, Homo sapiens
ucauugagaaauaaagcacau

SEQ ID NO: 2063951 - RNA, 16 nt, Homo sapiens
uaaaaauaaaagcagu

SEQ ID NO: 2063952 - RNA, 19 nt, Homo sapiens
uaguuuucuagaugacaua

SEQ ID NO: 2063953 - RNA, 21 nt, Homo sapiens
aaguagcugucagaugucaca

SEQ ID NO: 2063954 - RNA, 24 nt, Homo sapiens
cugaaaucugucaagaguaguuau

SEQ ID NO: 2063955 - RNA, 18 nt, Homo sapiens
uggaaaauggugauuuaa

SEQ ID NO: 2063956 - RNA, 18 nt, Homo sapiens
agacauuugcuaugagcu

SEQ ID NO: 2063957 - RNA, 23 nt, Homo sapiens
acagaaugcggccucugagacau

SEQ ID NO: 2063958 - RNA, 14 nt, Homo sapiens
aacugaagcccaca

SEQ ID NO: 2063959 - RNA, 16 nt, Homo sapiens
uuguuaauccuucuuu

SEQ ID NO: 2063960 - RNA, 20 nt, Homo sapiens
ugcacuccaagaaacgugga

SEQ ID NO: 2063961 - RNA, 13 nt, Homo sapiens
caacauccacucu

SEQ ID NO: 2063962 - RNA, 18 nt, Homo sapiens
gccacggcugagccuuca

SEQ ID NO: 2063963 - RNA, 15 nt, Homo sapiens
cuugaugcaugcaca

SEQ ID NO: 2063964 - RNA, 16 nt, Homo sapiens
cuugaacucuuggccu

SEQ ID NO: 2063965 - RNA, 18 nt, Homo sapiens
guucuucaccuccugcca

SEQ ID NO: 2063966 - RNA, 18 nt, Homo sapiens
ccuuaaagaaaauugcau

SEQ ID NO: 2063967 - RNA, 23 nt, Homo sapiens
acucugggcuguaacguggcacu

SEQ ID NO: 2063968 - RNA, 23 nt, Homo sapiens
ggcgucugcugucucaucacaua

SEQ ID NO: 2063969 - RNA, 23 nt, Homo sapiens
aaacuuuuguucuuuaauaugcu

SEQ ID NO: 2063970 - RNA, 15 nt, Homo sapiens
uacaguagugcauug

SEQ ID NO: 2063971 - RNA, 17 nt, Homo sapiens
aguguggccaggcugcc

SEQ ID NO: 2063972 - RNA, 23 nt, Homo sapiens
caugcccuggauccaucaggcca

SEQ ID NO: 2063973 - RNA, 13 nt, Homo sapiens
cugauacauuaaa

SEQ ID NO: 2063974 - RNA, 20 nt, Homo sapiens
uuuaccacuaugcaauauau

SEQ ID NO: 2063975 - RNA, 19 nt, Homo sapiens
ucauauuuugccacugccu

SEQ ID NO: 2063976 - RNA, 15 nt, Homo sapiens
augcugaaacaucau

SEQ ID NO: 2063977 - RNA, 18 nt, Homo sapiens
aucagucccccugugcau

SEQ ID NO: 2063978 - RNA, 17 nt, Homo sapiens
cggagagagccaagacg

SEQ ID NO: 2063979 - RNA, 21 nt, Homo sapiens
accguuauaaagugugccaca

SEQ ID NO: 2063980 - RNA, 17 nt, Homo sapiens
uuauuuaaaugggaaua

SEQ ID NO: 2063981 - RNA, 13 nt, Homo sapiens
uaacuugcaauuu

SEQ ID NO: 2063982 - RNA, 17 nt, Homo sapiens
cucagccccucagagaa

SEQ ID NO: 2063983 - RNA, 22 nt, Homo sapiens
caaugccuugacaacagacuga

SEQ ID NO: 2063984 - RNA, 17 nt, Homo sapiens
gggaggccaagugcagg

SEQ ID NO: 2063985 - RNA, 16 nt, Homo sapiens
aacacaauuaaaucuc

SEQ ID NO: 2063986 - RNA, 17 nt, Homo sapiens
aaccuuaaacuuucaau

SEQ ID NO: 2063987 - RNA, 23 nt, Homo sapiens
cuauauuuuugggaggagccaua

SEQ ID NO: 2063988 - RNA, 16 nt, Homo sapiens
uauaacuauguugaua

SEQ ID NO: 2063989 - RNA, 12 nt, Homo sapiens
gaacucuuuaug

SEQ ID NO: 2063990 - RNA, 20 nt, Homo sapiens
cuuccccuuagaaacacugc

SEQ ID NO: 2063991 - RNA, 18 nt, Homo sapiens
caucauuccaaagcuaaa

SEQ ID NO: 2063992 - RNA, 18 nt, Homo sapiens
aucccaggauuaggccau

SEQ ID NO: 2063993 - RNA, 20 nt, Homo sapiens
gucccuuuaugcagagccac

SEQ ID NO: 2063994 - RNA, 13 nt, Homo sapiens
aagugaaaacuga

SEQ ID NO: 2063995 - RNA, 20 nt, Homo sapiens
agagcaagacccugucucaa

SEQ ID NO: 2063996 - RNA, 22 nt, Homo sapiens
ucccugguggggugugcaugcc

SEQ ID NO: 2063997 - RNA, 14 nt, Homo sapiens
aguauauucuuucc

SEQ ID NO: 2063998 - RNA, 22 nt, Homo sapiens
gaggcugaggcagaaggauuac

SEQ ID NO: 2063999 - RNA, 14 nt, Homo sapiens
gaguugacuuuccu

SEQ ID NO: 2064000 - RNA, 21 nt, Homo sapiens
ugcuugaaccaaaauggugaa

SEQ ID NO: 2064001 - RNA, 20 nt, Homo sapiens
caaaggcaagcguauaucaa

SEQ ID NO: 2064002 - RNA, 21 nt, Homo sapiens
gcagggugcaguaucaugccc

SEQ ID NO: 2064003 - RNA, 13 nt, Homo sapiens
ccccaucacuuga

SEQ ID NO: 2064004 - RNA, 20 nt, Homo sapiens
gaccaccaguuaacguauua

SEQ ID NO: 2064005 - RNA, 20 nt, Homo sapiens
acaccacacacaacagccaa

SEQ ID NO: 2064006 - RNA, 13 nt, Homo sapiens
cuuuaaaugcaac

SEQ ID NO: 2064007 - RNA, 19 nt, Homo sapiens
ucaaccaaaaacauguuuc

SEQ ID NO: 2064008 - RNA, 15 nt, Homo sapiens
guucaaagaugcauu

SEQ ID NO: 2064009 - RNA, 14 nt, Homo sapiens
acuccuagcugacu

SEQ ID NO: 2064010 - RNA, 16 nt, Homo sapiens
uggaggcaguccaucu

SEQ ID NO: 2064011 - RNA, 19 nt, Homo sapiens
auaaucugaauccuguuaa

SEQ ID NO: 2064012 - RNA, 15 nt, Homo sapiens
cagaaauaccugucu

SEQ ID NO: 2064013 - RNA, 22 nt, Homo sapiens
ugcuaaaugcuacauacuccaa

SEQ ID NO: 2064014 - RNA, 15 nt, Homo sapiens
ugauacauaugugaa

SEQ ID NO: 2064015 - RNA, 14 nt, Homo sapiens
uccaagaaugcuga

SEQ ID NO: 2064016 - RNA, 16 nt, Homo sapiens
aggcaguagaacucca

SEQ ID NO: 2064017 - RNA, 23 nt, Homo sapiens
uaaacuggaauccuuucacccgc

SEQ ID NO: 2064018 - RNA, 22 nt, Homo sapiens
uuacauugccauuugguagcau

SEQ ID NO: 2064019 - RNA, 20 nt, Homo sapiens
cacuugauguguagacaugu

SEQ ID NO: 2064020 - RNA, 15 nt, Homo sapiens
cggcagcauucucca

SEQ ID NO: 2064021 - RNA, 19 nt, Homo sapiens
aauauauuuuuagacucau

SEQ ID NO: 2064022 - RNA, 22 nt, Homo sapiens
uuaccagaugcugacuggcacu

SEQ ID NO: 2064023 - RNA, 18 nt, Homo sapiens
uuggcauggauuucuguc

SEQ ID NO: 2064024 - RNA, 11 nt, Homo sapiens
ucaaguaauau

SEQ ID NO: 2064025 - RNA, 13 nt, Homo sapiens
aacuaauuugaau

SEQ ID NO: 2064026 - RNA, 15 nt, Homo sapiens
uucuccucauccauu

SEQ ID NO: 2064027 - RNA, 18 nt, Homo sapiens
uuggacuguaagggauug

SEQ ID NO: 2064028 - RNA, 22 nt, Homo sapiens
caauuaaaaaaaauuaaaacca

SEQ ID NO: 2064029 - RNA, 13 nt, Homo sapiens
ugaggggccugug

SEQ ID NO: 2064030 - RNA, 18 nt, Homo sapiens
auuagcauggccacaucu

SEQ ID NO: 2064031 - RNA, 18 nt, Homo sapiens
auaccccaagacucccau

SEQ ID NO: 2064032 - RNA, 22 nt, Homo sapiens
uugggcacugcacccuguuuaa

SEQ ID NO: 2064033 - RNA, 19 nt, Homo sapiens
gauguugacaucacuggca

SEQ ID NO: 2064034 - RNA, 20 nt, Homo sapiens
agggaggcaagcccuguuga

SEQ ID NO: 2064035 - RNA, 15 nt, Homo sapiens
aauggcuacaucucc

SEQ ID NO: 2064036 - RNA, 18 nt, Homo sapiens
uuuuugguuaagcuuuga

SEQ ID NO: 2064037 - RNA, 15 nt, Homo sapiens
gagaaaguacuuucu

SEQ ID NO: 2064038 - RNA, 19 nt, Homo sapiens
uaaguccuguauauguaug

SEQ ID NO: 2064039 - RNA, 19 nt, Homo sapiens
ucucuuuaaaaccauauca

SEQ ID NO: 2064040 - RNA, 23 nt, Homo sapiens
cagccucccucccugugccagac

SEQ ID NO: 2064041 - RNA, 15 nt, Homo sapiens
gcccuugugcuccag

SEQ ID NO: 2064042 - RNA, 20 nt, Homo sapiens
uucuugcuuugaaugcaugu

SEQ ID NO: 2064043 - RNA, 12 nt, Homo sapiens
agaauucacaau

SEQ ID NO: 2064044 - RNA, 12 nt, Homo sapiens
uguauuuccaca

SEQ ID NO: 2064045 - RNA, 21 nt, Homo sapiens
cagucacuguugguuccuucu

SEQ ID NO: 2064046 - RNA, 14 nt, Homo sapiens
cagcaucugugaug

SEQ ID NO: 2064047 - RNA, 16 nt, Homo sapiens
agaugugaguccuguu

SEQ ID NO: 2064048 - RNA, 19 nt, Homo sapiens
ucagguuaaauuaaaccaa

SEQ ID NO: 2064049 - RNA, 13 nt, Homo sapiens
guccucacacuca

SEQ ID NO: 2064050 - RNA, 21 nt, Homo sapiens
ugugaacacuggagucuugca

SEQ ID NO: 2064051 - RNA, 18 nt, Homo sapiens
aaacucaagacaaugcac

SEQ ID NO: 2064052 - RNA, 16 nt, Homo sapiens
cagagcauacaacaga

SEQ ID NO: 2064053 - RNA, 20 nt, Homo sapiens
gccuggccuccugccucuac

SEQ ID NO: 2064054 - RNA, 20 nt, Homo sapiens
agaaugacuccaccuucuca

SEQ ID NO: 2064055 - RNA, 12 nt, Homo sapiens
cggcacacugcc

SEQ ID NO: 2064056 - RNA, 16 nt, Homo sapiens
uacccucccucuagcc

SEQ ID NO: 2064057 - RNA, 18 nt, Homo sapiens
caacuauuaaagugccau

SEQ ID NO: 2064058 - RNA, 15 nt, Homo sapiens
acucuggcugccaag

SEQ ID NO: 2064059 - RNA, 17 nt, Homo sapiens
cacuagaaaugcagcau

SEQ ID NO: 2064060 - RNA, 17 nt, Homo sapiens
aggaaguaucagcacua

SEQ ID NO: 2064061 - RNA, 21 nt, Homo sapiens
cccucagaauauuaagcacau

SEQ ID NO: 2064062 - RNA, 15 nt, Homo sapiens
gagaucuaggugagg

SEQ ID NO: 2064063 - RNA, 13 nt, Homo sapiens
caauccuaucaca

SEQ ID NO: 2064064 - RNA, 19 nt, Homo sapiens
ugcaugccaggcugggcac

SEQ ID NO: 2064065 - RNA, 22 nt, Homo sapiens
ccaaaaauuauguguugccaaa

SEQ ID NO: 2064066 - RNA, 16 nt, Homo sapiens
agcucugcagucccag

SEQ ID NO: 2064067 - RNA, 21 nt, Homo sapiens
gauucuugugccucagcuucc

SEQ ID NO: 2064068 - RNA, 17 nt, Homo sapiens
gaaacagacugccugaa

SEQ ID NO: 2064069 - RNA, 21 nt, Homo sapiens
cucagccauaaagugccaguu

SEQ ID NO: 2064070 - RNA, 18 nt, Homo sapiens
augcugcucauccaaagu

SEQ ID NO: 2064071 - RNA, 14 nt, Homo sapiens
uugucuuggaacca

SEQ ID NO: 2064072 - RNA, 20 nt, Homo sapiens
cacacuuccauaugucauug

SEQ ID NO: 2064073 - RNA, 20 nt, Homo sapiens
cucagucugugggagcucag

SEQ ID NO: 2064074 - RNA, 23 nt, Homo sapiens
cugcuguggggcgaauucauccc

SEQ ID NO: 2064075 - RNA, 20 nt, Homo sapiens
ugcccacauuaagcacugug

SEQ ID NO: 2064076 - RNA, 19 nt, Homo sapiens
ugucuagguuaaagcuaaa

SEQ ID NO: 2064077 - RNA, 13 nt, Homo sapiens
uaagagagucaua

SEQ ID NO: 2064078 - RNA, 20 nt, Homo sapiens
ugaacugguagaaaaacauc

SEQ ID NO: 2064079 - RNA, 14 nt, Homo sapiens
ucaaaaauaugugu

SEQ ID NO: 2064080 - RNA, 20 nt, Homo sapiens
ugcaguccgcagucuggccu

SEQ ID NO: 2064081 - RNA, 22 nt, Homo sapiens
cagguugcuuucccacccuggg

SEQ ID NO: 2064082 - RNA, 20 nt, Homo sapiens
acuagaaaauuagacuguga

SEQ ID NO: 2064083 - RNA, 21 nt, Homo sapiens
gacauacuagaguugauuaua

SEQ ID NO: 2064084 - RNA, 23 nt, Homo sapiens
agauucuggagcaaucugacccu

SEQ ID NO: 2064085 - RNA, 13 nt, Homo sapiens
agccuacugccuc

SEQ ID NO: 2064086 - RNA, 18 nt, Homo sapiens
ugaaauuauuucucucac

SEQ ID NO: 2064087 - RNA, 21 nt, Homo sapiens
gaaggaacccccucaccaccu

SEQ ID NO: 2064088 - RNA, 20 nt, Homo sapiens
aauauuuauaguaguggugu

SEQ ID NO: 2064089 - RNA, 22 nt, Homo sapiens
uguccacacugaagaacauguc

SEQ ID NO: 2064090 - RNA, 22 nt, Homo sapiens
agcagccggaagucuguucuca

SEQ ID NO: 2064091 - RNA, 15 nt, Homo sapiens
ucaaauaaacauguc

SEQ ID NO: 2064092 - RNA, 17 nt, Homo sapiens
ccuugggaugggcacag

SEQ ID NO: 2064093 - RNA, 18 nt, Homo sapiens
guauuuucaguuugcccu

SEQ ID NO: 2064094 - RNA, 17 nt, Homo sapiens
aagaauuuuaugucaua

SEQ ID NO: 2064095 - RNA, 19 nt, Homo sapiens
ccccauagcagcagugcau

SEQ ID NO: 2064096 - RNA, 12 nt, Homo sapiens
aagaugccugau

SEQ ID NO: 2064097 - RNA, 20 nt, Homo sapiens
gcuuuauuauggcuugugaa

SEQ ID NO: 2064098 - RNA, 17 nt, Homo sapiens
uaaugacuuaagcacac

SEQ ID NO: 2064099 - RNA, 19 nt, Homo sapiens
ugaagauaauaaucuuggc

SEQ ID NO: 2064100 - RNA, 19 nt, Homo sapiens
aaugccagggacauuuuca

SEQ ID NO: 2064101 - RNA, 22 nt, Homo sapiens
agucaggcuuacuaaugcugcc

SEQ ID NO: 2064102 - RNA, 21 nt, Homo sapiens
agcuggugcuccaagcacagg

SEQ ID NO: 2064103 - RNA, 12 nt, Homo sapiens
agaaaacauugu

SEQ ID NO: 2064104 - RNA, 12 nt, Homo sapiens
uuguaacaagaa

SEQ ID NO: 2064105 - RNA, 22 nt, Homo sapiens
cuuaacuccuuuuccacuuuaa

SEQ ID NO: 2064106 - RNA, 14 nt, Homo sapiens
caaucacaguguua

SEQ ID NO: 2064107 - RNA, 19 nt, Homo sapiens
cuaaaagaauugugacaua

SEQ ID NO: 2064108 - RNA, 22 nt, Homo sapiens
gucaacccaauaguuguugauu

SEQ ID NO: 2064109 - RNA, 21 nt, Homo sapiens
uuaaacccugccccacuucuc

SEQ ID NO: 2064110 - RNA, 16 nt, Homo sapiens
aguguguuuccuucag

SEQ ID NO: 2064111 - RNA, 19 nt, Homo sapiens
agccaccauguauguggaa

SEQ ID NO: 2064112 - RNA, 20 nt, Homo sapiens
uugaauuuugucauguaauu

SEQ ID NO: 2064113 - RNA, 21 nt, Homo sapiens
cuggagggacuuuuaaucagu

SEQ ID NO: 2064114 - RNA, 14 nt, Homo sapiens
guaacagcuaugca

SEQ ID NO: 2064115 - RNA, 16 nt, Homo sapiens
gucagguaguugcaau

SEQ ID NO: 2064116 - RNA, 17 nt, Homo sapiens
gccaacuccuccuugcc

SEQ ID NO: 2064117 - RNA, 20 nt, Homo sapiens
agaguaacacauaacauugu

SEQ ID NO: 2064118 - RNA, 16 nt, Homo sapiens
aacuguuucaaagcca

SEQ ID NO: 2064119 - RNA, 20 nt, Homo sapiens
guagcgagcugcucugcuau

SEQ ID NO: 2064120 - RNA, 20 nt, Homo sapiens
ugacacucccuugggcuccc

SEQ ID NO: 2064121 - RNA, 19 nt, Homo sapiens
cacuauucaucaaugaaga

SEQ ID NO: 2064122 - RNA, 21 nt, Homo sapiens
ccuucaacuugugccugggag

SEQ ID NO: 2064123 - RNA, 15 nt, Homo sapiens
uuauuuuucuaugaa

SEQ ID NO: 2064124 - RNA, 20 nt, Homo sapiens
uaccugcaccguugacucag

SEQ ID NO: 2064125 - RNA, 13 nt, Homo sapiens
cuggcacaguguc

SEQ ID NO: 2064126 - RNA, 13 nt, Homo sapiens
guuuagcucugag

SEQ ID NO: 2064127 - RNA, 19 nt, Homo sapiens
cugcauuugauagcaaugu

SEQ ID NO: 2064128 - RNA, 18 nt, Homo sapiens
ucagaguggaccccguca

SEQ ID NO: 2064129 - RNA, 13 nt, Homo sapiens
auaagaugacaau

SEQ ID NO: 2064130 - RNA, 15 nt, Homo sapiens
caaucugaaacagcu

SEQ ID NO: 2064131 - RNA, 15 nt, Homo sapiens
aaucauauagugucu

SEQ ID NO: 2064132 - RNA, 15 nt, Homo sapiens
gguccuuuucagagu

SEQ ID NO: 2064133 - RNA, 20 nt, Homo sapiens
uuuccccuuuugcauucucc

SEQ ID NO: 2064134 - RNA, 19 nt, Homo sapiens
cacaauuuucugugccaaa

SEQ ID NO: 2064135 - RNA, 14 nt, Homo sapiens
uccuaauacguauu

SEQ ID NO: 2064136 - RNA, 16 nt, Homo sapiens
aaucugugcuguuuca

SEQ ID NO: 2064137 - RNA, 11 nt, Homo sapiens
gcucacugggc

SEQ ID NO: 2064138 - RNA, 12 nt, Homo sapiens
acauaugcaccu

SEQ ID NO: 2064139 - RNA, 12 nt, Homo sapiens
caaaaugccaca

SEQ ID NO: 2064140 - RNA, 16 nt, Homo sapiens
gauauauagaaggacu

SEQ ID NO: 2064141 - RNA, 19 nt, Homo sapiens
acuuccgccuccuguguuc

SEQ ID NO: 2064142 - RNA, 15 nt, Homo sapiens
auagacaauuugcac

SEQ ID NO: 2064143 - RNA, 12 nt, Homo sapiens
ccuuucugggaa

SEQ ID NO: 2064144 - RNA, 20 nt, Homo sapiens
ggaacugaauuguguuuuca

SEQ ID NO: 2064145 - RNA, 18 nt, Homo sapiens
cugucugaucagggugga

SEQ ID NO: 2064146 - RNA, 20 nt, Homo sapiens
aauacuguaaaugcauugga

SEQ ID NO: 2064147 - RNA, 21 nt, Homo sapiens
gcccaggaccccauggcagug

SEQ ID NO: 2064148 - RNA, 16 nt, Homo sapiens
uguuugcauguggcca

SEQ ID NO: 2064149 - RNA, 16 nt, Homo sapiens
uuaaaaaugcaugaua

SEQ ID NO: 2064150 - RNA, 22 nt, Homo sapiens
gcacuggaacccacagaccuca

SEQ ID NO: 2064151 - RNA, 19 nt, Homo sapiens
ucgaaaugaauuuaucuga

SEQ ID NO: 2064152 - RNA, 19 nt, Homo sapiens
cagcuauuugaaugagaug

SEQ ID NO: 2064153 - RNA, 20 nt, Homo sapiens
agcucuauggauuauccacu

SEQ ID NO: 2064154 - RNA, 22 nt, Homo sapiens
ccacacauuuguugccagauuu

SEQ ID NO: 2064155 - RNA, 12 nt, Homo sapiens
caucagcauuug

SEQ ID NO: 2064156 - RNA, 15 nt, Homo sapiens
cgaggacagcaaugc

SEQ ID NO: 2064157 - RNA, 23 nt, Homo sapiens
caauaaugucuuuuaaagccaga

SEQ ID NO: 2064158 - RNA, 15 nt, Homo sapiens
augccucauacacau

SEQ ID NO: 2064159 - RNA, 14 nt, Homo sapiens
guuccuccagccac

SEQ ID NO: 2064160 - RNA, 20 nt, Homo sapiens
cagggguguugugagagcug

SEQ ID NO: 2064161 - RNA, 20 nt, Homo sapiens
gaggcagaggcugcauugag

SEQ ID NO: 2064162 - RNA, 18 nt, Homo sapiens
uuuaaauagcauuaucuu

SEQ ID NO: 2064163 - RNA, 16 nt, Homo sapiens
aagguuaagucaggga

SEQ ID NO: 2064164 - RNA, 12 nt, Homo sapiens
augagaugacca

SEQ ID NO: 2064165 - RNA, 13 nt, Homo sapiens
aacagaacuuauu

SEQ ID NO: 2064166 - RNA, 21 nt, Homo sapiens
cuuuaguguucaaauacuuca

SEQ ID NO: 2064167 - RNA, 20 nt, Homo sapiens
cuacagcaguagggagguca

SEQ ID NO: 2064168 - RNA, 12 nt, Homo sapiens
cccuucagggau

SEQ ID NO: 2064169 - RNA, 15 nt, Homo sapiens
gcuguuaaaauaaga

SEQ ID NO: 2064170 - RNA, 21 nt, Homo sapiens
ccagacagcuugacugcuuuu

SEQ ID NO: 2064171 - RNA, 20 nt, Homo sapiens
ugaaaauaacugaaccaaau

SEQ ID NO: 2064172 - RNA, 16 nt, Homo sapiens
ccauagucacauggcc

SEQ ID NO: 2064173 - RNA, 15 nt, Homo sapiens
cuugaauacuuugag

SEQ ID NO: 2064174 - RNA, 20 nt, Homo sapiens
gggcggccagggacccaaag

SEQ ID NO: 2064175 - RNA, 18 nt, Homo sapiens
gagaauauguaacagcca

SEQ ID NO: 2064176 - RNA, 19 nt, Homo sapiens
accauuccuuuaaauucuc

SEQ ID NO: 2064177 - RNA, 16 nt, Homo sapiens
gaaaagcaaaucugua

SEQ ID NO: 2064178 - RNA, 12 nt, Homo sapiens
aaagacaucaau

SEQ ID NO: 2064179 - RNA, 17 nt, Homo sapiens
ccgaauagcugggacua

SEQ ID NO: 2064180 - RNA, 23 nt, Homo sapiens
uuccaugucgccucugcauucag

SEQ ID NO: 2064181 - RNA, 18 nt, Homo sapiens
ccaggcuggagugcagua

SEQ ID NO: 2064182 - RNA, 16 nt, Homo sapiens
cuuugaaauaccucau

SEQ ID NO: 2064183 - RNA, 16 nt, Homo sapiens
cuauguaauguaaaua

SEQ ID NO: 2064184 - RNA, 14 nt, Homo sapiens
acgaagccacaggc

SEQ ID NO: 2064185 - RNA, 13 nt, Homo sapiens
ccugcuagacaca

SEQ ID NO: 2064186 - RNA, 15 nt, Homo sapiens
aauacaacauugcca

SEQ ID NO: 2064187 - RNA, 19 nt, Homo sapiens
uaagcucccagggccuguc

SEQ ID NO: 2064188 - RNA, 22 nt, Homo sapiens
gcucuaaaguccagacuaugga

SEQ ID NO: 2064189 - RNA, 16 nt, Homo sapiens
ugacaggaaagcccuc

SEQ ID NO: 2064190 - RNA, 15 nt, Homo sapiens
gcuaaggaagggaaa

SEQ ID NO: 2064191 - RNA, 20 nt, Homo sapiens
gagcauagguagcuugucca

SEQ ID NO: 2064192 - RNA, 19 nt, Homo sapiens
acccuugauggauuuucaa

SEQ ID NO: 2064193 - RNA, 13 nt, Homo sapiens
gcuccuccaguga

SEQ ID NO: 2064194 - RNA, 19 nt, Homo sapiens
ugagaagucaaacauuuca

SEQ ID NO: 2064195 - RNA, 11 nt, Homo sapiens
caacagucuug

SEQ ID NO: 2064196 - RNA, 18 nt, Homo sapiens
ugagauauacgcccucuu

SEQ ID NO: 2064197 - RNA, 19 nt, Homo sapiens
gauaaagaagcuaaccugc

SEQ ID NO: 2064198 - RNA, 23 nt, Homo sapiens
ucagcacugaaaauaccaucagg

SEQ ID NO: 2064199 - RNA, 19 nt, Homo sapiens
agugccucuggucugggug

SEQ ID NO: 2064200 - RNA, 18 nt, Homo sapiens
augcaauuggcauuaaca

SEQ ID NO: 2064201 - RNA, 17 nt, Homo sapiens
ugggucuuucauggggu

SEQ ID NO: 2064202 - RNA, 20 nt, Homo sapiens
cuuccucccuauuaaccuag

SEQ ID NO: 2064203 - RNA, 19 nt, Homo sapiens
aucccaaccagugccaagg

SEQ ID NO: 2064204 - RNA, 22 nt, Homo sapiens
uugaguuuuuccucccagugag

SEQ ID NO: 2064205 - RNA, 15 nt, Homo sapiens
gagccucuccuugcc

SEQ ID NO: 2064206 - RNA, 18 nt, Homo sapiens
uucaccuuagaaguuuag

SEQ ID NO: 2064207 - RNA, 17 nt, Homo sapiens
acgggaaaggagcugcu

SEQ ID NO: 2064208 - RNA, 18 nt, Homo sapiens
agagguagcgagcugcuc

SEQ ID NO: 2064209 - RNA, 14 nt, Homo sapiens
cuugaaacauuaua

SEQ ID NO: 2064210 - RNA, 13 nt, Homo sapiens
acuauaacauuca

SEQ ID NO: 2064211 - RNA, 16 nt, Homo sapiens
gaccaaaacuauucca

SEQ ID NO: 2064212 - RNA, 13 nt, Homo sapiens
agauguagaggag

SEQ ID NO: 2064213 - RNA, 17 nt, Homo sapiens
cacuguagcagguucua

SEQ ID NO: 2064214 - RNA, 15 nt, Homo sapiens
caccugcaaaccuua

SEQ ID NO: 2064215 - RNA, 18 nt, Homo sapiens
ucaacaccaccgagcucu

SEQ ID NO: 2064216 - RNA, 17 nt, Homo sapiens
ucacccagggacacucc

SEQ ID NO: 2064217 - RNA, 23 nt, Homo sapiens
aucccugaaccccuggccagcuc

SEQ ID NO: 2064218 - RNA, 17 nt, Homo sapiens
uacaaugaucaccgacu

SEQ ID NO: 2064219 - RNA, 19 nt, Homo sapiens
agauaccaaaugaaacacu

SEQ ID NO: 2064220 - RNA, 20 nt, Homo sapiens
uauugggagaggucauaaaa

SEQ ID NO: 2064221 - RNA, 12 nt, Homo sapiens
ggaaauguauau

SEQ ID NO: 2064222 - RNA, 12 nt, Homo sapiens
auaaauguggau

SEQ ID NO: 2064223 - RNA, 18 nt, Homo sapiens
uucugacgcagccugaga

SEQ ID NO: 2064224 - RNA, 15 nt, Homo sapiens
uugcuucccugcuau

SEQ ID NO: 2064225 - RNA, 20 nt, Homo sapiens
aacugaauuuugggacuucu

SEQ ID NO: 2064226 - RNA, 13 nt, Homo sapiens
aaauuuugugaua

SEQ ID NO: 2064227 - RNA, 13 nt, Homo sapiens
uaauuuugagaua

SEQ ID NO: 2064228 - RNA, 18 nt, Homo sapiens
cagagagacccugccaac

SEQ ID NO: 2064229 - RNA, 14 nt, Homo sapiens
auggcauugaacug

SEQ ID NO: 2064230 - RNA, 13 nt, Homo sapiens
cucgcacucuggu

SEQ ID NO: 2064231 - RNA, 18 nt, Homo sapiens
gugccagguccuugcccu

SEQ ID NO: 2064232 - RNA, 14 nt, Homo sapiens
ccccgggcaucuuu

SEQ ID NO: 2064233 - RNA, 17 nt, Homo sapiens
ugacuuuagaaagcuga

SEQ ID NO: 2064234 - RNA, 17 nt, Homo sapiens
augugccaauaaccaag

SEQ ID NO: 2064235 - RNA, 19 nt, Homo sapiens
gauauccucugcuuaaaaa

SEQ ID NO: 2064236 - RNA, 13 nt, Homo sapiens
ggugugaggucca

SEQ ID NO: 2064237 - RNA, 15 nt, Homo sapiens
ucuuccucuguuaca

SEQ ID NO: 2064238 - RNA, 18 nt, Homo sapiens
cagccaccccaaagcccu

SEQ ID NO: 2064239 - RNA, 20 nt, Homo sapiens
agcaaauaauuuccuggugu

SEQ ID NO: 2064240 - RNA, 20 nt, Homo sapiens
ugugcaaguguguaugugcg

SEQ ID NO: 2064241 - RNA, 18 nt, Homo sapiens
cuuuccaaauacccaaau

SEQ ID NO: 2064242 - RNA, 14 nt, Homo sapiens
caugaagcacaaaa

SEQ ID NO: 2064243 - RNA, 19 nt, Homo sapiens
aaagauguuuacaucaaag

SEQ ID NO: 2064244 - RNA, 12 nt, Homo sapiens
ccaucuuuacaa

SEQ ID NO: 2064245 - RNA, 15 nt, Homo sapiens
cucaagauccugucu

SEQ ID NO: 2064246 - RNA, 16 nt, Homo sapiens
gcuuugaaaaacaguu

SEQ ID NO: 2064247 - RNA, 22 nt, Homo sapiens
gucuagccacucccucccagaa

SEQ ID NO: 2064248 - RNA, 18 nt, Homo sapiens
gcagccuggggucugaca

SEQ ID NO: 2064249 - RNA, 13 nt, Homo sapiens
ccugcacaggcug

SEQ ID NO: 2064250 - RNA, 22 nt, Homo sapiens
ggccaggcugccugugugcaug

SEQ ID NO: 2064251 - RNA, 20 nt, Homo sapiens
agaaaaaggccgggugacac

SEQ ID NO: 2064252 - RNA, 21 nt, Homo sapiens
uggagacugauggccaggcaa

SEQ ID NO: 2064253 - RNA, 15 nt, Homo sapiens
uucuguccaggacau

SEQ ID NO: 2064254 - RNA, 21 nt, Homo sapiens
gaagggaguuggugugcuauu

SEQ ID NO: 2064255 - RNA, 22 nt, Homo sapiens
agcuggcgucaugcaaagucau

SEQ ID NO: 2064256 - RNA, 23 nt, Homo sapiens
uugggauauccuuucacucugca

SEQ ID NO: 2064257 - RNA, 22 nt, Homo sapiens
agucuagcauucugcaacauuu

SEQ ID NO: 2064258 - RNA, 19 nt, Homo sapiens
gcugcuccucccucugacc

SEQ ID NO: 2064259 - RNA, 14 nt, Homo sapiens
augcauaaaugcga

SEQ ID NO: 2064260 - RNA, 23 nt, Homo sapiens
cauuggagacaucacuugccaau

SEQ ID NO: 2064261 - RNA, 17 nt, Homo sapiens
auguucugggcuuaauu

SEQ ID NO: 2064262 - RNA, 17 nt, Homo sapiens
agccaauggugcacauu

SEQ ID NO: 2064263 - RNA, 18 nt, Homo sapiens
ucugugcagacaguguca

SEQ ID NO: 2064264 - RNA, 17 nt, Homo sapiens
gacgcaucucaaaacag

SEQ ID NO: 2064265 - RNA, 16 nt, Homo sapiens
gccuucucucagcucc

SEQ ID NO: 2064266 - RNA, 19 nt, Homo sapiens
agaagaaacuggggcuccu

SEQ ID NO: 2064267 - RNA, 22 nt, Homo sapiens
auucaccuuccagugucucgga

SEQ ID NO: 2064268 - RNA, 11 nt, Homo sapiens
gagccaggaaa

SEQ ID NO: 2064269 - RNA, 14 nt, Homo sapiens
caauuaugugacaa

SEQ ID NO: 2064270 - RNA, 15 nt, Homo sapiens
cuuuuugcuggagaa

SEQ ID NO: 2064271 - RNA, 19 nt, Homo sapiens
aacaaagaaauaauggucu

SEQ ID NO: 2064272 - RNA, 13 nt, Homo sapiens
gggcuuacaggca

SEQ ID NO: 2064273 - RNA, 13 nt, Homo sapiens
guauauacauauu

SEQ ID NO: 2064274 - RNA, 12 nt, Homo sapiens
cuugugucuccc

SEQ ID NO: 2064275 - RNA, 13 nt, Homo sapiens
gagaauacaagau

SEQ ID NO: 2064276 - RNA, 22 nt, Homo sapiens
caugcccucccaggacccucca

SEQ ID NO: 2064277 - RNA, 21 nt, Homo sapiens
gacacagcucuucuccaggcu

SEQ ID NO: 2064278 - RNA, 22 nt, Homo sapiens
aaccuaaugggaaucauuccac

SEQ ID NO: 2064279 - RNA, 18 nt, Homo sapiens
gcuucuacuccaugguga

SEQ ID NO: 2064280 - RNA, 18 nt, Homo sapiens
gcaguggcgugaucucag

SEQ ID NO: 2064281 - RNA, 17 nt, Homo sapiens
uacuugaaauguaaaaa

SEQ ID NO: 2064282 - RNA, 18 nt, Homo sapiens
aagguacuauauuugcua

SEQ ID NO: 2064283 - RNA, 14 nt, Homo sapiens
cuggugcugcagua

SEQ ID NO: 2064284 - RNA, 19 nt, Homo sapiens
cacuaaacucuggggcuug

SEQ ID NO: 2064285 - RNA, 21 nt, Homo sapiens
cagaagcuuggcaugaccuca

SEQ ID NO: 2064286 - RNA, 17 nt, Homo sapiens
uaagucacuuaaacuca

SEQ ID NO: 2064287 - RNA, 21 nt, Homo sapiens
agcacuguuuauacacugugu

SEQ ID NO: 2064288 - RNA, 14 nt, Homo sapiens
gagaaacugccaca

SEQ ID NO: 2064289 - RNA, 13 nt, Homo sapiens
cugccaugauagc

SEQ ID NO: 2064290 - RNA, 20 nt, Homo sapiens
aaucuuucaaagugucuuga

SEQ ID NO: 2064291 - RNA, 22 nt, Homo sapiens
uccugugacaacacucaucaca

SEQ ID NO: 2064292 - RNA, 23 nt, Homo sapiens
agcauuuuccagcccuauagcca

SEQ ID NO: 2064293 - RNA, 13 nt, Homo sapiens
uuggacuuuggac

SEQ ID NO: 2064294 - RNA, 15 nt, Homo sapiens
augauucccacccaa

SEQ ID NO: 2064295 - RNA, 11 nt, Homo sapiens
ugccccagugu

SEQ ID NO: 2064296 - RNA, 16 nt, Homo sapiens
caggaaggcuucuugc

SEQ ID NO: 2064297 - RNA, 20 nt, Homo sapiens
aaccgacacuccuacaagau

SEQ ID NO: 2064298 - RNA, 20 nt, Homo sapiens
agcaaugguaauugugaaua

SEQ ID NO: 2064299 - RNA, 17 nt, Homo sapiens
acugauaaaaaugauau

SEQ ID NO: 2064300 - RNA, 23 nt, Homo sapiens
gagaacuccaucagaaaaccaaa

SEQ ID NO: 2064301 - RNA, 20 nt, Homo sapiens
cacauaauuugaauggugca

SEQ ID NO: 2064302 - RNA, 21 nt, Homo sapiens
uucguccuuagaauacuguau

SEQ ID NO: 2064303 - RNA, 21 nt, Homo sapiens
agcuaccucacuaugcugcuu

SEQ ID NO: 2064304 - RNA, 16 nt, Homo sapiens
gucugggagucacaca

SEQ ID NO: 2064305 - RNA, 21 nt, Homo sapiens
cugacuuuucccauucagcug

SEQ ID NO: 2064306 - RNA, 19 nt, Homo sapiens
cccgugcaacggaagccag

SEQ ID NO: 2064307 - RNA, 22 nt, Homo sapiens
uguaaaucuuugugaacauucu

SEQ ID NO: 2064308 - RNA, 22 nt, Homo sapiens
caaaaccaaauauuccagagac

SEQ ID NO: 2064309 - RNA, 13 nt, Homo sapiens
aauccugccauuu

SEQ ID NO: 2064310 - RNA, 18 nt, Homo sapiens
aagccucagccauucacu

SEQ ID NO: 2064311 - RNA, 15 nt, Homo sapiens
guccagcaaguguca

SEQ ID NO: 2064312 - RNA, 16 nt, Homo sapiens
acucucccuggagcug

SEQ ID NO: 2064313 - RNA, 18 nt, Homo sapiens
gaaugagaguuccuucuc

SEQ ID NO: 2064314 - RNA, 11 nt, Homo sapiens
gugugugcaag

SEQ ID NO: 2064315 - RNA, 21 nt, Homo sapiens
aaaauguaugccacaucucag

SEQ ID NO: 2064316 - RNA, 21 nt, Homo sapiens
ucagcuuauaaaaucaaacag

SEQ ID NO: 2064317 - RNA, 16 nt, Homo sapiens
cuaugagaugaaauau

SEQ ID NO: 2064318 - RNA, 20 nt, Homo sapiens
gccugagcaacucuugauua

SEQ ID NO: 2064319 - RNA, 20 nt, Homo sapiens
caggcauggcuggugccuga

SEQ ID NO: 2064320 - RNA, 15 nt, Homo sapiens
cugaauuagccaaaa

SEQ ID NO: 2064321 - RNA, 18 nt, Homo sapiens
uacauuuccucaccauaa

SEQ ID NO: 2064322 - RNA, 14 nt, Homo sapiens
acagacgucucaag

SEQ ID NO: 2064323 - RNA, 18 nt, Homo sapiens
ugagaggcaugacagcug

SEQ ID NO: 2064324 - RNA, 17 nt, Homo sapiens
auacaguuugucacaug

SEQ ID NO: 2064325 - RNA, 20 nt, Homo sapiens
uauuuuuguguuuucuugua

SEQ ID NO: 2064326 - RNA, 23 nt, Homo sapiens
cccaagccugggcuugagcugca

SEQ ID NO: 2064327 - RNA, 22 nt, Homo sapiens
augugaacauggaaacaacuuc

SEQ ID NO: 2064328 - RNA, 15 nt, Homo sapiens
ugagucuccugugcc

SEQ ID NO: 2064329 - RNA, 15 nt, Homo sapiens
auagacuuuugugac

SEQ ID NO: 2064330 - RNA, 16 nt, Homo sapiens
augugcggcugaacug

SEQ ID NO: 2064331 - RNA, 22 nt, Homo sapiens
uaaauaaaaauucaaccacaga

SEQ ID NO: 2064332 - RNA, 19 nt, Homo sapiens
gaccugggagcccucggga

SEQ ID NO: 2064333 - RNA, 20 nt, Homo sapiens
aauuuaaggccugcacucuu

SEQ ID NO: 2064334 - RNA, 17 nt, Homo sapiens
cuggagucaugccaagc

SEQ ID NO: 2064335 - RNA, 13 nt, Homo sapiens
agccacugucaca

SEQ ID NO: 2064336 - RNA, 15 nt, Homo sapiens
uccuaccacaaugca

SEQ ID NO: 2064337 - RNA, 14 nt, Homo sapiens
ccucucguacuuga

SEQ ID NO: 2064338 - RNA, 21 nt, Homo sapiens
ggaaaacgggcagucugcucu

SEQ ID NO: 2064339 - RNA, 18 nt, Homo sapiens
cccgagguggcugccugg

SEQ ID NO: 2064340 - RNA, 18 nt, Homo sapiens
uggcaaucccaccaaauc

SEQ ID NO: 2064341 - RNA, 16 nt, Homo sapiens
ggcuagugucuaucag

SEQ ID NO: 2064342 - RNA, 20 nt, Homo sapiens
cauuagauuccuuuccugug

SEQ ID NO: 2064343 - RNA, 21 nt, Homo sapiens
caauucaguuaggcuagagac

SEQ ID NO: 2064344 - RNA, 13 nt, Homo sapiens
gaggccucucuca

SEQ ID NO: 2064345 - RNA, 13 nt, Homo sapiens
agaaaacaaucaa

SEQ ID NO: 2064346 - RNA, 13 nt, Homo sapiens
ugaaaacauucaa

SEQ ID NO: 2064347 - RNA, 21 nt, Homo sapiens
uugcauauuuuuaaacaaaga

SEQ ID NO: 2064348 - RNA, 14 nt, Homo sapiens
cuaaaaacuuagaa

SEQ ID NO: 2064349 - RNA, 18 nt, Homo sapiens
ccaaaacguugaauugau

SEQ ID NO: 2064350 - RNA, 13 nt, Homo sapiens
gccucuacuuuau

SEQ ID NO: 2064351 - RNA, 18 nt, Homo sapiens
caagaacugcauggaccu

SEQ ID NO: 2064352 - RNA, 20 nt, Homo sapiens
guccaggacugggucugacc

SEQ ID NO: 2064353 - RNA, 19 nt, Homo sapiens
aagagauagagaccaucuu

SEQ ID NO: 2064354 - RNA, 14 nt, Homo sapiens
uguuuugaaaaccu

SEQ ID NO: 2064355 - RNA, 19 nt, Homo sapiens
cucugccgcugccaugcuu

SEQ ID NO: 2064356 - RNA, 16 nt, Homo sapiens
cugugccaucagcucc

SEQ ID NO: 2064357 - RNA, 22 nt, Homo sapiens
gauugaggccaagaguuaaaga

SEQ ID NO: 2064358 - RNA, 23 nt, Homo sapiens
gauagcccaggagcaacagccua

SEQ ID NO: 2064359 - RNA, 21 nt, Homo sapiens
ugugggcggcuccuggugcua

SEQ ID NO: 2064360 - RNA, 12 nt, Homo sapiens
aauguauaccag

SEQ ID NO: 2064361 - RNA, 23 nt, Homo sapiens
agcagcccuucccccagugcccu

SEQ ID NO: 2064362 - RNA, 13 nt, Homo sapiens
cuagccugcacuu

SEQ ID NO: 2064363 - RNA, 21 nt, Homo sapiens
cagacuggcaauaaacuccua

SEQ ID NO: 2064364 - RNA, 15 nt, Homo sapiens
gacagaucuggaaug

SEQ ID NO: 2064365 - RNA, 18 nt, Homo sapiens
caaauguuacaguuuaua

SEQ ID NO: 2064366 - RNA, 17 nt, Homo sapiens
accuguagaaaagugag

SEQ ID NO: 2064367 - RNA, 21 nt, Homo sapiens
cacaucccuaacaucaugcau

SEQ ID NO: 2064368 - RNA, 15 nt, Homo sapiens
aaguccuugcucccg

SEQ ID NO: 2064369 - RNA, 12 nt, Homo sapiens
ccaaguaaaggu

SEQ ID NO: 2064370 - RNA, 16 nt, Homo sapiens
aguguccuaugcaaua

SEQ ID NO: 2064371 - RNA, 18 nt, Homo sapiens
gagcacccccucauuccc

SEQ ID NO: 2064372 - RNA, 22 nt, Homo sapiens
auccuagucucuaucauuaaag

SEQ ID NO: 2064373 - RNA, 21 nt, Homo sapiens
augucaggcaaagugcugcug

SEQ ID NO: 2064374 - RNA, 22 nt, Homo sapiens
gaccuguuaggucucaugccca

SEQ ID NO: 2064375 - RNA, 19 nt, Homo sapiens
gagucucauuugggcuaga

SEQ ID NO: 2064376 - RNA, 21 nt, Homo sapiens
auaucuaccugcccucucuca

SEQ ID NO: 2064377 - RNA, 21 nt, Homo sapiens
cacuguguuuaguugcaagga

SEQ ID NO: 2064378 - RNA, 16 nt, Homo sapiens
uguaauagugaacaua

SEQ ID NO: 2064379 - RNA, 21 nt, Homo sapiens
gguaauugccuaaaucuccag

SEQ ID NO: 2064380 - RNA, 22 nt, Homo sapiens
ggacccaaggcucagucccucu

SEQ ID NO: 2064381 - RNA, 20 nt, Homo sapiens
aacauuucuggacaguaccu

SEQ ID NO: 2064382 - RNA, 18 nt, Homo sapiens
ggugacaggcccagugga

SEQ ID NO: 2064383 - RNA, 21 nt, Homo sapiens
cagccccagagugcuuuaaaa

SEQ ID NO: 2064384 - RNA, 12 nt, Homo sapiens
uuuuuacuauua

SEQ ID NO: 2064385 - RNA, 22 nt, Homo sapiens
gacaaugaagugacacuuugac

SEQ ID NO: 2064386 - RNA, 20 nt, Homo sapiens
ugaccccuuccuccaggggu

SEQ ID NO: 2064387 - RNA, 12 nt, Homo sapiens
ugauaugcauuu

SEQ ID NO: 2064388 - RNA, 17 nt, Homo sapiens
ccaagauacuugaacac

SEQ ID NO: 2064389 - RNA, 23 nt, Homo sapiens
aucaaaucugcuuuuuaaagaau

SEQ ID NO: 2064390 - RNA, 12 nt, Homo sapiens
aaaauaguagca

SEQ ID NO: 2064391 - RNA, 15 nt, Homo sapiens
aggaauccagugaau

SEQ ID NO: 2064392 - RNA, 17 nt, Homo sapiens
uccucugcugcaucccc

SEQ ID NO: 2064393 - RNA, 16 nt, Homo sapiens
uuuuucuccucuccau

SEQ ID NO: 2064394 - RNA, 15 nt, Homo sapiens
gauagcauauauuca

SEQ ID NO: 2064395 - RNA, 22 nt, Homo sapiens
ucuuccgcacccucccuagcuc

SEQ ID NO: 2064396 - RNA, 15 nt, Homo sapiens
cauagcagugcuagg

SEQ ID NO: 2064397 - RNA, 12 nt, Homo sapiens
ccucccaaagug

SEQ ID NO: 2064398 - RNA, 18 nt, Homo sapiens
uagaugcacuuaugcagu

SEQ ID NO: 2064399 - RNA, 16 nt, Homo sapiens
ucacucaggacagccc

SEQ ID NO: 2064400 - RNA, 16 nt, Homo sapiens
aauaaugaacagcaga

SEQ ID NO: 2064401 - RNA, 20 nt, Homo sapiens
guggugcagugugugaaaau

SEQ ID NO: 2064402 - RNA, 17 nt, Homo sapiens
gaccaggccugagcaac

SEQ ID NO: 2064403 - RNA, 14 nt, Homo sapiens
ugaguacauacuca

SEQ ID NO: 2064404 - RNA, 13 nt, Homo sapiens
uagcucauugcaa

SEQ ID NO: 2064405 - RNA, 22 nt, Homo sapiens
agugcugagaaggacaccuccu

SEQ ID NO: 2064406 - RNA, 14 nt, Homo sapiens
aggagcugcucacu

SEQ ID NO: 2064407 - RNA, 18 nt, Homo sapiens
gcugguuuggaaugcuuc

SEQ ID NO: 2064408 - RNA, 18 nt, Homo sapiens
accccuccccuaaugccu

SEQ ID NO: 2064409 - RNA, 13 nt, Homo sapiens
uaacgugccccca

SEQ ID NO: 2064410 - RNA, 20 nt, Homo sapiens
ugcacacuuugguaccagau

SEQ ID NO: 2064411 - RNA, 22 nt, Homo sapiens
gugcaugccaggaagcacguuc

SEQ ID NO: 2064412 - RNA, 14 nt, Homo sapiens
uuggaaaucugcca

SEQ ID NO: 2064413 - RNA, 13 nt, Homo sapiens
accaaaauuacua

SEQ ID NO: 2064414 - RNA, 15 nt, Homo sapiens
auuguaauacacaua

SEQ ID NO: 2064415 - RNA, 12 nt, Homo sapiens
uugagucuucca

SEQ ID NO: 2064416 - RNA, 17 nt, Homo sapiens
ucuuugacaucauucau

SEQ ID NO: 2064417 - RNA, 15 nt, Homo sapiens
gcggcugaacugaga

SEQ ID NO: 2064418 - RNA, 15 nt, Homo sapiens
ccugcuacaccuauu

SEQ ID NO: 2064419 - RNA, 21 nt, Homo sapiens
agccaagaucgccccacugca

SEQ ID NO: 2064420 - RNA, 18 nt, Homo sapiens
gacucaugguguguuaca

SEQ ID NO: 2064421 - RNA, 16 nt, Homo sapiens
cucuuucucuuaauaa

SEQ ID NO: 2064422 - RNA, 18 nt, Homo sapiens
aaaugucaugcugccuua

SEQ ID NO: 2064423 - RNA, 14 nt, Homo sapiens
guuuuuauucugaa

SEQ ID NO: 2064424 - RNA, 22 nt, Homo sapiens
ucaaaauuauaggagacuugua

SEQ ID NO: 2064425 - RNA, 19 nt, Homo sapiens
ugauccuaguaauugccua

SEQ ID NO: 2064426 - RNA, 14 nt, Homo sapiens
auguucuaauacuu

SEQ ID NO: 2064427 - RNA, 13 nt, Homo sapiens
gagauagucucau

SEQ ID NO: 2064428 - RNA, 17 nt, Homo sapiens
acaaaggcugacauuca

SEQ ID NO: 2064429 - RNA, 14 nt, Homo sapiens
agugauuacuguca

SEQ ID NO: 2064430 - RNA, 18 nt, Homo sapiens
ggaacccucuggggcccu

SEQ ID NO: 2064431 - RNA, 18 nt, Homo sapiens
uugaccagagugggacca

SEQ ID NO: 2064432 - RNA, 20 nt, Homo sapiens
gaccucccagagagugaaua

SEQ ID NO: 2064433 - RNA, 17 nt, Homo sapiens
cgugagcgccugugcac

SEQ ID NO: 2064434 - RNA, 18 nt, Homo sapiens
gaacacagcaugugccaa

SEQ ID NO: 2064435 - RNA, 16 nt, Homo sapiens
caaacacacagacucu

SEQ ID NO: 2064436 - RNA, 18 nt, Homo sapiens
acgucauguguuuugcca

SEQ ID NO: 2064437 - RNA, 15 nt, Homo sapiens
cuccugauguuuuuc

SEQ ID NO: 2064438 - RNA, 22 nt, Homo sapiens
accucaccagaauugugcaaau

SEQ ID NO: 2064439 - RNA, 18 nt, Homo sapiens
ucuguguaaccuccacag

SEQ ID NO: 2064440 - RNA, 22 nt, Homo sapiens
ugaugggagagguucugugcaa

SEQ ID NO: 2064441 - RNA, 21 nt, Homo sapiens
uguacaaugacuuuauugcau

SEQ ID NO: 2064442 - RNA, 17 nt, Homo sapiens
aauguauuuguuugcaa

SEQ ID NO: 2064443 - RNA, 13 nt, Homo sapiens
cugguugcuguau

SEQ ID NO: 2064444 - RNA, 21 nt, Homo sapiens
cuuugaagcaaauacaauuca

SEQ ID NO: 2064445 - RNA, 13 nt, Homo sapiens
ggaaggagagcuc

SEQ ID NO: 2064446 - RNA, 16 nt, Homo sapiens
ccuguagggaacuuuc

SEQ ID NO: 2064447 - RNA, 18 nt, Homo sapiens
ccacuguggagaugcugu

SEQ ID NO: 2064448 - RNA, 15 nt, Homo sapiens
cuuauacugcuguaa

SEQ ID NO: 2064449 - RNA, 14 nt, Homo sapiens
cccccagcgucagu

SEQ ID NO: 2064450 - RNA, 21 nt, Homo sapiens
acagucguucccaguguggcu

SEQ ID NO: 2064451 - RNA, 23 nt, Homo sapiens
auaaagaagguuggugaauuuca

SEQ ID NO: 2064452 - RNA, 15 nt, Homo sapiens
uaucugugucaaaag

SEQ ID NO: 2064453 - RNA, 21 nt, Homo sapiens
ccaugaagucucuaacaaugu

SEQ ID NO: 2064454 - RNA, 14 nt, Homo sapiens
cucacuccuguuac

SEQ ID NO: 2064455 - RNA, 20 nt, Homo sapiens
ucccacugcucccccaacac

SEQ ID NO: 2064456 - RNA, 20 nt, Homo sapiens
aacuccuuguaggucugcag

SEQ ID NO: 2064457 - RNA, 20 nt, Homo sapiens
gccuuaaaccuaccucccac

SEQ ID NO: 2064458 - RNA, 16 nt, Homo sapiens
ugcauugucugcaaug

SEQ ID NO: 2064459 - RNA, 21 nt, Homo sapiens
uccaccgaccaacugcccuaa

SEQ ID NO: 2064460 - RNA, 19 nt, Homo sapiens
uucugguugaugccuguga

SEQ ID NO: 2064461 - RNA, 17 nt, Homo sapiens
gacuguuagacaaaagu

SEQ ID NO: 2064462 - RNA, 15 nt, Homo sapiens
guuuacucuguuacc

SEQ ID NO: 2064463 - RNA, 15 nt, Homo sapiens
gucaaaccugcaaau

SEQ ID NO: 2064464 - RNA, 18 nt, Homo sapiens
guuuuuagagcuuccaaa

SEQ ID NO: 2064465 - RNA, 21 nt, Homo sapiens
gcaaaaugucuuaacaaauca

SEQ ID NO: 2064466 - RNA, 15 nt, Homo sapiens
ucauggauauguuau

SEQ ID NO: 2064467 - RNA, 22 nt, Homo sapiens
gagcuuccaacccgaggcaaua

SEQ ID NO: 2064468 - RNA, 18 nt, Homo sapiens
ccucucucacacaucaca

SEQ ID NO: 2064469 - RNA, 18 nt, Homo sapiens
gcauuccugagucuucca

SEQ ID NO: 2064470 - RNA, 19 nt, Homo sapiens
auguacuguuacuguguca

SEQ ID NO: 2064471 - RNA, 16 nt, Homo sapiens
uucauuucaaucuuuu

SEQ ID NO: 2064472 - RNA, 19 nt, Homo sapiens
ccaauauuucucagacauc

SEQ ID NO: 2064473 - RNA, 20 nt, Homo sapiens
gcuuuugucucccuuaccuc

SEQ ID NO: 2064474 - RNA, 16 nt, Homo sapiens
gagccuggcaagaaug

SEQ ID NO: 2064475 - RNA, 17 nt, Homo sapiens
gacgugaggcccauucu

SEQ ID NO: 2064476 - RNA, 13 nt, Homo sapiens
aguaaaaauccac

SEQ ID NO: 2064477 - RNA, 22 nt, Homo sapiens
ugaaaaaugugcaaaacagcgu

SEQ ID NO: 2064478 - RNA, 15 nt, Homo sapiens
cuucugaucuccaaa

SEQ ID NO: 2064479 - RNA, 14 nt, Homo sapiens
uaaagugugccaca

SEQ ID NO: 2064480 - RNA, 14 nt, Homo sapiens
cucaaguacucaaa

SEQ ID NO: 2064481 - RNA, 20 nt, Homo sapiens
aaccuucgccucccagguuc

SEQ ID NO: 2064482 - RNA, 13 nt, Homo sapiens
augccacccucac

SEQ ID NO: 2064483 - RNA, 22 nt, Homo sapiens
cuccgggcaaauggcugagaug

SEQ ID NO: 2064484 - RNA, 18 nt, Homo sapiens
cagugaaggcuaaaugag

SEQ ID NO: 2064485 - RNA, 13 nt, Homo sapiens
aguaagacacaaa

SEQ ID NO: 2064486 - RNA, 17 nt, Homo sapiens
aauauucuucuuugaua

SEQ ID NO: 2064487 - RNA, 18 nt, Homo sapiens
guaucacuguaucaucuu

SEQ ID NO: 2064488 - RNA, 23 nt, Homo sapiens
gcauuacauuuguuccugggacu

SEQ ID NO: 2064489 - RNA, 17 nt, Homo sapiens
acagucucaguucucuu

SEQ ID NO: 2064490 - RNA, 18 nt, Homo sapiens
accauaguuuacaauauu

SEQ ID NO: 2064491 - RNA, 12 nt, Homo sapiens
ggagaugcugcc

SEQ ID NO: 2064492 - RNA, 16 nt, Homo sapiens
ucgggaggcugaggca

SEQ ID NO: 2064493 - RNA, 16 nt, Homo sapiens
ggccccucucauuccc

SEQ ID NO: 2064494 - RNA, 16 nt, Homo sapiens
aggugccuggcuugcu

SEQ ID NO: 2064495 - RNA, 20 nt, Homo sapiens
cuuuggcaaaacuuaggcau

SEQ ID NO: 2064496 - RNA, 16 nt, Homo sapiens
ucggggagugccacuu

SEQ ID NO: 2064497 - RNA, 12 nt, Homo sapiens
cauaaagcauuu

SEQ ID NO: 2064498 - RNA, 12 nt, Homo sapiens
ugcccugcauuc

SEQ ID NO: 2064499 - RNA, 12 nt, Homo sapiens
uagaaauggauu

SEQ ID NO: 2064500 - RNA, 15 nt, Homo sapiens
acacguccacuuuca

SEQ ID NO: 2064501 - RNA, 17 nt, Homo sapiens
gagcuggucaguugcca

SEQ ID NO: 2064502 - RNA, 22 nt, Homo sapiens
ugcaauaaggauuuauucucag

SEQ ID NO: 2064503 - RNA, 15 nt, Homo sapiens
ucucuggcgcaucac

SEQ ID NO: 2064504 - RNA, 16 nt, Homo sapiens
ugcaucuuaacaugcu

SEQ ID NO: 2064505 - RNA, 20 nt, Homo sapiens
cauuucuuuuaaaauaagca

SEQ ID NO: 2064506 - RNA, 20 nt, Homo sapiens
cugcugagucagacugucag

SEQ ID NO: 2064507 - RNA, 20 nt, Homo sapiens
cuggcugggaacaacuucag

SEQ ID NO: 2064508 - RNA, 17 nt, Homo sapiens
uggagacaucacuugcc

SEQ ID NO: 2064509 - RNA, 18 nt, Homo sapiens
gacuuucaguaaacauaa

SEQ ID NO: 2064510 - RNA, 19 nt, Homo sapiens
uacugguguucuguuucaa

SEQ ID NO: 2064511 - RNA, 12 nt, Homo sapiens
agagaccugcug

SEQ ID NO: 2064512 - RNA, 13 nt, Homo sapiens
gugcucugacccu

SEQ ID NO: 2064513 - RNA, 23 nt, Homo sapiens
agggucuucuuacaugcauuuga

SEQ ID NO: 2064514 - RNA, 21 nt, Homo sapiens
aaaaauauuuauaaaacuucu

SEQ ID NO: 2064515 - RNA, 15 nt, Homo sapiens
ggcaaggcauuccuc

SEQ ID NO: 2064516 - RNA, 17 nt, Homo sapiens
cauacuugaagggccag

SEQ ID NO: 2064517 - RNA, 17 nt, Homo sapiens
aacucauuccugccugu

SEQ ID NO: 2064518 - RNA, 15 nt, Homo sapiens
ugaauuagacuugua

SEQ ID NO: 2064519 - RNA, 21 nt, Homo sapiens
agccuauaucaaacaugcaca

SEQ ID NO: 2064520 - RNA, 17 nt, Homo sapiens
ggggaccucgccuguug

SEQ ID NO: 2064521 - RNA, 17 nt, Homo sapiens
guucagucccagggaaa

SEQ ID NO: 2064522 - RNA, 15 nt, Homo sapiens
aggaugcagaaggag

SEQ ID NO: 2064523 - RNA, 17 nt, Homo sapiens
agucagaacucuguguu

SEQ ID NO: 2064524 - RNA, 19 nt, Homo sapiens
aggcagcucaccccugggc

SEQ ID NO: 2064525 - RNA, 12 nt, Homo sapiens
acuaguuuccag

SEQ ID NO: 2064526 - RNA, 21 nt, Homo sapiens
guauucacacaccccucaaaa

SEQ ID NO: 2064527 - RNA, 16 nt, Homo sapiens
ccucaugauauguccu

SEQ ID NO: 2064528 - RNA, 22 nt, Homo sapiens
caaauucaaauaauccauucca

SEQ ID NO: 2064529 - RNA, 15 nt, Homo sapiens
aauauuauuugcuaa

SEQ ID NO: 2064530 - RNA, 21 nt, Homo sapiens
aggacccugaaggggccauga

SEQ ID NO: 2064531 - RNA, 14 nt, Homo sapiens
agucaauccuguca

SEQ ID NO: 2064532 - RNA, 20 nt, Homo sapiens
accccugcuccccugagcug

SEQ ID NO: 2064533 - RNA, 12 nt, Homo sapiens
acagcuguguac

SEQ ID NO: 2064534 - RNA, 19 nt, Homo sapiens
ggguuggacuguaagggau

SEQ ID NO: 2064535 - RNA, 18 nt, Homo sapiens
gugugucuccaugcacau

SEQ ID NO: 2064536 - RNA, 16 nt, Homo sapiens
ggaguggaaacaaagg

SEQ ID NO: 2064537 - RNA, 18 nt, Homo sapiens
ccaaaacccugaagccau

SEQ ID NO: 2064538 - RNA, 18 nt, Homo sapiens
cugacacaagaauggucu

SEQ ID NO: 2064539 - RNA, 18 nt, Homo sapiens
ucccgaauucgcuguuac

SEQ ID NO: 2064540 - RNA, 10 nt, Homo sapiens
cccucuguag

SEQ ID NO: 2064541 - RNA, 12 nt, Homo sapiens
gcagaaccacaa

SEQ ID NO: 2064542 - RNA, 17 nt, Homo sapiens
caauauaaaaacauuca

SEQ ID NO: 2064543 - RNA, 13 nt, Homo sapiens
ugcccugugcucc

SEQ ID NO: 2064544 - RNA, 12 nt, Homo sapiens
gugggcagucac

SEQ ID NO: 2064545 - RNA, 21 nt, Homo sapiens
uuacaagacggggagugagac

SEQ ID NO: 2064546 - RNA, 18 nt, Homo sapiens
auuguucaaagcacagaa

SEQ ID NO: 2064547 - RNA, 17 nt, Homo sapiens
cuuuuucucagcccuga

SEQ ID NO: 2064548 - RNA, 17 nt, Homo sapiens
gugacagacuuuggaca

SEQ ID NO: 2064549 - RNA, 16 nt, Homo sapiens
uucuucccuacaguug

SEQ ID NO: 2064550 - RNA, 15 nt, Homo sapiens
ccuggcuucugggac

SEQ ID NO: 2064551 - RNA, 16 nt, Homo sapiens
ggaagaaaugggagaa

SEQ ID NO: 2064552 - RNA, 15 nt, Homo sapiens
uucagucuucugacu

SEQ ID NO: 2064553 - RNA, 19 nt, Homo sapiens
ccaccauaugaauuguaca

SEQ ID NO: 2064554 - RNA, 13 nt, Homo sapiens
uauaauacauuaa

SEQ ID NO: 2064555 - RNA, 21 nt, Homo sapiens
aaaguguaauuccacaucaug

SEQ ID NO: 2064556 - RNA, 20 nt, Homo sapiens
agugacuuccaaacaacucu

SEQ ID NO: 2064557 - RNA, 14 nt, Homo sapiens
acucugcacuccau

SEQ ID NO: 2064558 - RNA, 16 nt, Homo sapiens
aucucagcucacucug

SEQ ID NO: 2064559 - RNA, 15 nt, Homo sapiens
gaaaacaaacccagg

SEQ ID NO: 2064560 - RNA, 18 nt, Homo sapiens
ggcccccugccaguugaa

SEQ ID NO: 2064561 - RNA, 20 nt, Homo sapiens
cugucuuauuaagacuggcu

SEQ ID NO: 2064562 - RNA, 13 nt, Homo sapiens
cucaucagccuuc

SEQ ID NO: 2064563 - RNA, 16 nt, Homo sapiens
caucaaguugugccaa

SEQ ID NO: 2064564 - RNA, 21 nt, Homo sapiens
aggaagacuuccagcuuucuc

SEQ ID NO: 2064565 - RNA, 14 nt, Homo sapiens
accucccucccacc

SEQ ID NO: 2064566 - RNA, 20 nt, Homo sapiens
uugcaucccugaaacaucuc

SEQ ID NO: 2064567 - RNA, 18 nt, Homo sapiens
uaaaaaggcuaaauggaa

SEQ ID NO: 2064568 - RNA, 18 nt, Homo sapiens
gaaauagauccagugcug

SEQ ID NO: 2064569 - RNA, 16 nt, Homo sapiens
gucugagaagauucaa

SEQ ID NO: 2064570 - RNA, 19 nt, Homo sapiens
uggcuaauuccccuuccau

SEQ ID NO: 2064571 - RNA, 14 nt, Homo sapiens
caaagagugaaaua

SEQ ID NO: 2064572 - RNA, 21 nt, Homo sapiens
ccagggccuggaggcugugag

SEQ ID NO: 2064573 - RNA, 20 nt, Homo sapiens
ucuauuuuaguuaacuauga

SEQ ID NO: 2064574 - RNA, 19 nt, Homo sapiens
gucaacaucaccccagugg

SEQ ID NO: 2064575 - RNA, 19 nt, Homo sapiens
cuggcuccaaggugcucug

SEQ ID NO: 2064576 - RNA, 15 nt, Homo sapiens
gcugggcagcuggaa

SEQ ID NO: 2064577 - RNA, 14 nt, Homo sapiens
uugccucaccuaau

SEQ ID NO: 2064578 - RNA, 12 nt, Homo sapiens
acagggccagug

SEQ ID NO: 2064579 - RNA, 18 nt, Homo sapiens
ugccaccaaaagaagaaa

SEQ ID NO: 2064580 - RNA, 18 nt, Homo sapiens
cuuacaauugcacugcug

SEQ ID NO: 2064581 - RNA, 21 nt, Homo sapiens
ucaaggcaagccccccaucua

SEQ ID NO: 2064582 - RNA, 15 nt, Homo sapiens
cagucccugcacuuu

SEQ ID NO: 2064583 - RNA, 20 nt, Homo sapiens
uugcucuaggaagacauuuu

SEQ ID NO: 2064584 - RNA, 11 nt, Homo sapiens
acaacacuuaa

SEQ ID NO: 2064585 - RNA, 19 nt, Homo sapiens
acucucucccuggucucug

SEQ ID NO: 2064586 - RNA, 24 nt, Homo sapiens
uaaauggcuuuugccacauacaua

SEQ ID NO: 2064587 - RNA, 13 nt, Homo sapiens
ggucaggccuuug

SEQ ID NO: 2064588 - RNA, 20 nt, Homo sapiens
uaacucugaccugggagccc

SEQ ID NO: 2064589 - RNA, 17 nt, Homo sapiens
agggagaccccaaaaag

SEQ ID NO: 2064590 - RNA, 18 nt, Homo sapiens
augaaaaaaaaaugggaa

SEQ ID NO: 2064591 - RNA, 23 nt, Homo sapiens
aacuguuggagagagauguuccu

SEQ ID NO: 2064592 - RNA, 19 nt, Homo sapiens
caaaguguggucucuggaa

SEQ ID NO: 2064593 - RNA, 20 nt, Homo sapiens
ucagcuccuucaaugcaaag

SEQ ID NO: 2064594 - RNA, 22 nt, Homo sapiens
aaggagcccuuaucugugcuca

SEQ ID NO: 2064595 - RNA, 21 nt, Homo sapiens
acaccaagugaggccauagca

SEQ ID NO: 2064596 - RNA, 21 nt, Homo sapiens
ccacuacacagucugcaagau

SEQ ID NO: 2064597 - RNA, 23 nt, Homo sapiens
aggauacccgguggcuucuggca

SEQ ID NO: 2064598 - RNA, 20 nt, Homo sapiens
acaacuuggguucuucucag

SEQ ID NO: 2064599 - RNA, 21 nt, Homo sapiens
cugggccccucaucugcucag

SEQ ID NO: 2064600 - RNA, 18 nt, Homo sapiens
ucauagaagguguaggcu

SEQ ID NO: 2064601 - RNA, 17 nt, Homo sapiens
cuguuccucccaagagg

SEQ ID NO: 2064602 - RNA, 19 nt, Homo sapiens
caguacuuguuucuaugca

SEQ ID NO: 2064603 - RNA, 21 nt, Homo sapiens
cagcaaaagaagacaacauuu

SEQ ID NO: 2064604 - RNA, 18 nt, Homo sapiens
auuuuguguuccuaucaa

SEQ ID NO: 2064605 - RNA, 17 nt, Homo sapiens
agaagauuaguuaccau

SEQ ID NO: 2064606 - RNA, 14 nt, Homo sapiens
uuaaaaaaacagac

SEQ ID NO: 2064607 - RNA, 18 nt, Homo sapiens
ggaacgugguucagagac

SEQ ID NO: 2064608 - RNA, 18 nt, Homo sapiens
uaauuaugaaaagaaaua

SEQ ID NO: 2064609 - RNA, 15 nt, Homo sapiens
caccaaguaccagua

SEQ ID NO: 2064610 - RNA, 14 nt, Homo sapiens
uuccuuucuugucu

SEQ ID NO: 2064611 - RNA, 20 nt, Homo sapiens
ugagaugcuucuggcuccca

SEQ ID NO: 2064612 - RNA, 13 nt, Homo sapiens
auauauacaggca

SEQ ID NO: 2064613 - RNA, 21 nt, Homo sapiens
cugugaccccuccuuucuucc

SEQ ID NO: 2064614 - RNA, 15 nt, Homo sapiens
ccugcaggccagucc

SEQ ID NO: 2064615 - RNA, 19 nt, Homo sapiens
auuugccaacucgaacaaa

SEQ ID NO: 2064616 - RNA, 13 nt, Homo sapiens
ugcccacagcagg

SEQ ID NO: 2064617 - RNA, 20 nt, Homo sapiens
agcccuggggacaccugccc

SEQ ID NO: 2064618 - RNA, 18 nt, Homo sapiens
ccacaguuuugccuuaaa

SEQ ID NO: 2064619 - RNA, 17 nt, Homo sapiens
uguaaacauuucuugua

SEQ ID NO: 2064620 - RNA, 18 nt, Homo sapiens
cugagcgagcacaccuuc

SEQ ID NO: 2064621 - RNA, 18 nt, Homo sapiens
gaaaucuagaagacuguc

SEQ ID NO: 2064622 - RNA, 23 nt, Homo sapiens
gaccuauuuccagaaauacaauu

SEQ ID NO: 2064623 - RNA, 17 nt, Homo sapiens
gaccccuuguugcacug

SEQ ID NO: 2064624 - RNA, 21 nt, Homo sapiens
gcaaaugccuuuucaaaugca

SEQ ID NO: 2064625 - RNA, 20 nt, Homo sapiens
ccuguggcggccuuccgggu

SEQ ID NO: 2064626 - RNA, 17 nt, Homo sapiens
gccccuagaaacccaag

SEQ ID NO: 2064627 - RNA, 15 nt, Homo sapiens
ccuuaucagugccau

SEQ ID NO: 2064628 - RNA, 22 nt, Homo sapiens
aagccggcucuucaaagacaau

SEQ ID NO: 2064629 - RNA, 19 nt, Homo sapiens
auuggguacccaguuaaau

SEQ ID NO: 2064630 - RNA, 14 nt, Homo sapiens
cgagccaggaacug

SEQ ID NO: 2064631 - RNA, 15 nt, Homo sapiens
acaucuggauuucau

SEQ ID NO: 2064632 - RNA, 20 nt, Homo sapiens
cggccaggugccuccugaca

SEQ ID NO: 2064633 - RNA, 22 nt, Homo sapiens
ggggaccgccccaggcaccgcc

SEQ ID NO: 2064634 - RNA, 16 nt, Homo sapiens
ccagcagugguauuaa

SEQ ID NO: 2064635 - RNA, 22 nt, Homo sapiens
aacucuuugcccaguucauccc

SEQ ID NO: 2064636 - RNA, 14 nt, Homo sapiens
guggcaacccucac

SEQ ID NO: 2064637 - RNA, 14 nt, Homo sapiens
cugcaaacgcugcc

SEQ ID NO: 2064638 - RNA, 13 nt, Homo sapiens
aauccaagcuccc

SEQ ID NO: 2064639 - RNA, 12 nt, Homo sapiens
aaggcugaccaa

SEQ ID NO: 2064640 - RNA, 23 nt, Homo sapiens
auauguguaaauguuaugacucc

SEQ ID NO: 2064641 - RNA, 15 nt, Homo sapiens
ugaaaaaacaccaug

SEQ ID NO: 2064642 - RNA, 17 nt, Homo sapiens
agagacgaagaccccag

SEQ ID NO: 2064643 - RNA, 21 nt, Homo sapiens
gacacagagggggccuucaca

SEQ ID NO: 2064644 - RNA, 15 nt, Homo sapiens
caagacacagugacc

SEQ ID NO: 2064645 - RNA, 14 nt, Homo sapiens
ucuccucacugcca

SEQ ID NO: 2064646 - RNA, 16 nt, Homo sapiens
aggccuuccagcugcu

SEQ ID NO: 2064647 - RNA, 20 nt, Homo sapiens
aaggggaagccuccugucuc

SEQ ID NO: 2064648 - RNA, 15 nt, Homo sapiens
aucuacaagcauuug

SEQ ID NO: 2064649 - RNA, 16 nt, Homo sapiens
ugcuacaacuacuauu

SEQ ID NO: 2064650 - RNA, 12 nt, Homo sapiens
gaacuaggcucu

SEQ ID NO: 2064651 - RNA, 13 nt, Homo sapiens
acauuaguucuau

SEQ ID NO: 2064652 - RNA, 15 nt, Homo sapiens
aaaaugcucuugucc

SEQ ID NO: 2064653 - RNA, 13 nt, Homo sapiens
cuaacacuggcau

SEQ ID NO: 2064654 - RNA, 19 nt, Homo sapiens
aggcugauggagacaguaa

SEQ ID NO: 2064655 - RNA, 17 nt, Homo sapiens
agacuggcucuuuuacc

SEQ ID NO: 2064656 - RNA, 23 nt, Homo sapiens
ugcugggacugagccagucccag

SEQ ID NO: 2064657 - RNA, 15 nt, Homo sapiens
aaaaacuuugacaaa

SEQ ID NO: 2064658 - RNA, 23 nt, Homo sapiens
uaagaauggagcaguacauggga

SEQ ID NO: 2064659 - RNA, 20 nt, Homo sapiens
ucaucaggagcuagagccau

SEQ ID NO: 2064660 - RNA, 12 nt, Homo sapiens
ucuucaggccau

SEQ ID NO: 2064661 - RNA, 19 nt, Homo sapiens
gcucugagaaaccucggga

SEQ ID NO: 2064662 - RNA, 20 nt, Homo sapiens
uccaugggauacaaccuccc

SEQ ID NO: 2064663 - RNA, 17 nt, Homo sapiens
ucucuggcuggucuuca

SEQ ID NO: 2064664 - RNA, 18 nt, Homo sapiens
aaaguuacauguuugcac

SEQ ID NO: 2064665 - RNA, 20 nt, Homo sapiens
uuggcccaggauuauuguca

SEQ ID NO: 2064666 - RNA, 23 nt, Homo sapiens
auagugcuucacaaaaugcacuu

SEQ ID NO: 2064667 - RNA, 19 nt, Homo sapiens
gccuuaaguaauguuaauu

SEQ ID NO: 2064668 - RNA, 16 nt, Homo sapiens
agcugucggagggcug

SEQ ID NO: 2064669 - RNA, 15 nt, Homo sapiens
cugcagauccagggg

SEQ ID NO: 2064670 - RNA, 16 nt, Homo sapiens
ucuuucacaggcauca

SEQ ID NO: 2064671 - RNA, 20 nt, Homo sapiens
ccucauuguucagaaaagca

SEQ ID NO: 2064672 - RNA, 14 nt, Homo sapiens
cuuccucugcugca

SEQ ID NO: 2064673 - RNA, 19 nt, Homo sapiens
gcccuugcccugaccuccc

SEQ ID NO: 2064674 - RNA, 19 nt, Homo sapiens
guacaauaaguuacuugaa

SEQ ID NO: 2064675 - RNA, 18 nt, Homo sapiens
uagauuaauggcacugau

SEQ ID NO: 2064676 - RNA, 17 nt, Homo sapiens
cugaaaucccaacaaaa

SEQ ID NO: 2064677 - RNA, 22 nt, Homo sapiens
uuugaaaaccaacaccaucaca

SEQ ID NO: 2064678 - RNA, 20 nt, Homo sapiens
cucuuuucuacauacauuau

SEQ ID NO: 2064679 - RNA, 22 nt, Homo sapiens
ccuggacaggcuucgucucaga

SEQ ID NO: 2064680 - RNA, 12 nt, Homo sapiens
ucucuuuggucu

SEQ ID NO: 2064681 - RNA, 19 nt, Homo sapiens
gcauggaacuaaaauguua

SEQ ID NO: 2064682 - RNA, 20 nt, Homo sapiens
cccaucagacugucaagaag

SEQ ID NO: 2064683 - RNA, 20 nt, Homo sapiens
caagaaacuucggggcugca

SEQ ID NO: 2064684 - RNA, 15 nt, Homo sapiens
ugaagggaagugggg

SEQ ID NO: 2064685 - RNA, 20 nt, Homo sapiens
uagaggggucucaugucucc

SEQ ID NO: 2064686 - RNA, 21 nt, Homo sapiens
cuuauguggguugccugguga

SEQ ID NO: 2064687 - RNA, 17 nt, Homo sapiens
guccacagggcaccugc

SEQ ID NO: 2064688 - RNA, 15 nt, Homo sapiens
cccucagauuccacc

SEQ ID NO: 2064689 - RNA, 14 nt, Homo sapiens
gaauuugcaaagua

SEQ ID NO: 2064690 - RNA, 14 nt, Homo sapiens
gcuugugcacugga

SEQ ID NO: 2064691 - RNA, 15 nt, Homo sapiens
uuuaauggcauguca

SEQ ID NO: 2064692 - RNA, 14 nt, Homo sapiens
ugaugacauucccu

SEQ ID NO: 2064693 - RNA, 21 nt, Homo sapiens
caugcaugucugccuaugcac

SEQ ID NO: 2064694 - RNA, 19 nt, Homo sapiens
ucaucccucccaaugccac

SEQ ID NO: 2064695 - RNA, 16 nt, Homo sapiens
guaauuuuucugggaa

SEQ ID NO: 2064696 - RNA, 12 nt, Homo sapiens
gaaggcaaaauu

SEQ ID NO: 2064697 - RNA, 16 nt, Homo sapiens
cccaagucuccagaga

SEQ ID NO: 2064698 - RNA, 15 nt, Homo sapiens
auauuagucuuugaa

SEQ ID NO: 2064699 - RNA, 15 nt, Homo sapiens
caaauggauguaaua

SEQ ID NO: 2064700 - RNA, 24 nt, Homo sapiens
accaugaagucucuaacaauguau

SEQ ID NO: 2064701 - RNA, 23 nt, Homo sapiens
uuacuaaauuuucuaauuaaaga

SEQ ID NO: 2064702 - RNA, 16 nt, Homo sapiens
aauugagaaagcuuaa

SEQ ID NO: 2064703 - RNA, 16 nt, Homo sapiens
uauuaaaucuugcaac

SEQ ID NO: 2064704 - RNA, 18 nt, Homo sapiens
uuucuuguauuuuuccaa

SEQ ID NO: 2064705 - RNA, 16 nt, Homo sapiens
accauguggccauuaa

SEQ ID NO: 2064706 - RNA, 18 nt, Homo sapiens
cuaaaugaauguuuacac

SEQ ID NO: 2064707 - RNA, 12 nt, Homo sapiens
ccugugugagca

SEQ ID NO: 2064708 - RNA, 22 nt, Homo sapiens
ggugucauacagauuugcaaag

SEQ ID NO: 2064709 - RNA, 18 nt, Homo sapiens
augcgugugucagggaug

SEQ ID NO: 2064710 - RNA, 21 nt, Homo sapiens
uccccugccuuccuuuaaucc

SEQ ID NO: 2064711 - RNA, 18 nt, Homo sapiens
uaaacacuguuuguucca

SEQ ID NO: 2064712 - RNA, 21 nt, Homo sapiens
cagucaauguuucgguuuaga

SEQ ID NO: 2064713 - RNA, 20 nt, Homo sapiens
ggauugucacuccaaaccuu

SEQ ID NO: 2064714 - RNA, 16 nt, Homo sapiens
guaucaccucuucaca

SEQ ID NO: 2064715 - RNA, 15 nt, Homo sapiens
ugcugagaaccuggc

SEQ ID NO: 2064716 - RNA, 17 nt, Homo sapiens
uuagaguaaugaaaugg

SEQ ID NO: 2064717 - RNA, 21 nt, Homo sapiens
gcugggauuacaggcuugaaa

SEQ ID NO: 2064718 - RNA, 22 nt, Homo sapiens
acgggguucgcgcaccaggugu

SEQ ID NO: 2064719 - RNA, 16 nt, Homo sapiens
cacugcaagcucugcc

SEQ ID NO: 2064720 - RNA, 20 nt, Homo sapiens
uauuuuuaaaaucauaacau

SEQ ID NO: 2064721 - RNA, 13 nt, Homo sapiens
cacauccauuccc

SEQ ID NO: 2064722 - RNA, 15 nt, Homo sapiens
gcuuccacucagggc

SEQ ID NO: 2064723 - RNA, 15 nt, Homo sapiens
gcuaaacacuaugua

SEQ ID NO: 2064724 - RNA, 19 nt, Homo sapiens
gccacacgcacuggugcca

SEQ ID NO: 2064725 - RNA, 21 nt, Homo sapiens
ugagucccuuaaccccucuga

SEQ ID NO: 2064726 - RNA, 23 nt, Homo sapiens
uucaguguuuugaaaaauacauc

SEQ ID NO: 2064727 - RNA, 15 nt, Homo sapiens
gcucuucacucagcc

SEQ ID NO: 2064728 - RNA, 21 nt, Homo sapiens
ucacacugguucucaaugaaa

SEQ ID NO: 2064729 - RNA, 20 nt, Homo sapiens
gcagucugcuucagugcagu

SEQ ID NO: 2064730 - RNA, 20 nt, Homo sapiens
gcugggcuucccaucuucca

SEQ ID NO: 2064731 - RNA, 15 nt, Homo sapiens
guacaccauaugcaa

SEQ ID NO: 2064732 - RNA, 20 nt, Homo sapiens
caaaucuggcuccuuuacaa

SEQ ID NO: 2064733 - RNA, 16 nt, Homo sapiens
cuguccccucagcucc

SEQ ID NO: 2064734 - RNA, 17 nt, Homo sapiens
gaaacaaggcugccagg

SEQ ID NO: 2064735 - RNA, 21 nt, Homo sapiens
gaaagauuagugauucaucuu

SEQ ID NO: 2064736 - RNA, 22 nt, Homo sapiens
caucaugggaguaaguucuuca

SEQ ID NO: 2064737 - RNA, 21 nt, Homo sapiens
uaaaagggucguuaccagaga

SEQ ID NO: 2064738 - RNA, 13 nt, Homo sapiens
uccagaggacucu

SEQ ID NO: 2064739 - RNA, 20 nt, Homo sapiens
cuucagcuccugaguagcug

SEQ ID NO: 2064740 - RNA, 17 nt, Homo sapiens
caugcuguguaauauca

SEQ ID NO: 2064741 - RNA, 23 nt, Homo sapiens
agcacagacucacauauggacga

SEQ ID NO: 2064742 - RNA, 17 nt, Homo sapiens
ggagugcaauggcacaa

SEQ ID NO: 2064743 - RNA, 21 nt, Homo sapiens
uauauuacuugccuaucugac

SEQ ID NO: 2064744 - RNA, 16 nt, Homo sapiens
ugauuguauaauguga

SEQ ID NO: 2064745 - RNA, 21 nt, Homo sapiens
cucuugaaguacuuaacauac

SEQ ID NO: 2064746 - RNA, 16 nt, Homo sapiens
acacauuuacccuuug

SEQ ID NO: 2064747 - RNA, 16 nt, Homo sapiens
uaaaauuuuacauuug

SEQ ID NO: 2064748 - RNA, 18 nt, Homo sapiens
uugaaugaacacuaugca

SEQ ID NO: 2064749 - RNA, 18 nt, Homo sapiens
ccuagguaucuauagcau

SEQ ID NO: 2064750 - RNA, 13 nt, Homo sapiens
uggucuggccacu

SEQ ID NO: 2064751 - RNA, 16 nt, Homo sapiens
uccccagucccagaca

SEQ ID NO: 2064752 - RNA, 21 nt, Homo sapiens
cugaaacugaguugaauagag

SEQ ID NO: 2064753 - RNA, 16 nt, Homo sapiens
cagcccccacccggug

SEQ ID NO: 2064754 - RNA, 11 nt, Homo sapiens
guacagagaug

SEQ ID NO: 2064755 - RNA, 22 nt, Homo sapiens
uaauaaagaugaguugguucuc

SEQ ID NO: 2064756 - RNA, 14 nt, Homo sapiens
ugacagucugcuca

SEQ ID NO: 2064757 - RNA, 11 nt, Homo sapiens
cuccucugauu

SEQ ID NO: 2064758 - RNA, 16 nt, Homo sapiens
gacucuggucauagaa

SEQ ID NO: 2064759 - RNA, 14 nt, Homo sapiens
acccuucuuuccau

SEQ ID NO: 2064760 - RNA, 19 nt, Homo sapiens
auguacgcacgcauguguc

SEQ ID NO: 2064761 - RNA, 16 nt, Homo sapiens
caggucuccaccugca

SEQ ID NO: 2064762 - RNA, 18 nt, Homo sapiens
gaacauucagauuuacca

SEQ ID NO: 2064763 - RNA, 21 nt, Homo sapiens
auguguggcucagugccugga

SEQ ID NO: 2064764 - RNA, 15 nt, Homo sapiens
gcccucaccagccuu

SEQ ID NO: 2064765 - RNA, 13 nt, Homo sapiens
gccuugaguagaa

SEQ ID NO: 2064766 - RNA, 15 nt, Homo sapiens
ggcuggagccugggg

SEQ ID NO: 2064767 - RNA, 23 nt, Homo sapiens
gccacugcacaccagcccagcuc

SEQ ID NO: 2064768 - RNA, 11 nt, Homo sapiens
acuuugcucuc

SEQ ID NO: 2064769 - RNA, 17 nt, Homo sapiens
aagaaagccagucuuaa

SEQ ID NO: 2064770 - RNA, 20 nt, Homo sapiens
cacaggugcugaguacucag

SEQ ID NO: 2064771 - RNA, 14 nt, Homo sapiens
ucgcgugaugcgca

SEQ ID NO: 2064772 - RNA, 20 nt, Homo sapiens
ccacccaaugcugauguccu

SEQ ID NO: 2064773 - RNA, 21 nt, Homo sapiens
ggccugugagguaacugggau

SEQ ID NO: 2064774 - RNA, 16 nt, Homo sapiens
ugacucucacacugaa

SEQ ID NO: 2064775 - RNA, 13 nt, Homo sapiens
agccaacuccucc

SEQ ID NO: 2064776 - RNA, 13 nt, Homo sapiens
gagggacugccuc

SEQ ID NO: 2064777 - RNA, 19 nt, Homo sapiens
cugaucucagagcauuuca

SEQ ID NO: 2064778 - RNA, 13 nt, Homo sapiens
uacugaauuccau

SEQ ID NO: 2064779 - RNA, 13 nt, Homo sapiens
gaaagaaugcauu

SEQ ID NO: 2064780 - RNA, 23 nt, Homo sapiens
uggcucccaucugaaccacuuug

SEQ ID NO: 2064781 - RNA, 11 nt, Homo sapiens
caaggccaaag

SEQ ID NO: 2064782 - RNA, 13 nt, Homo sapiens
ucccuuucuuuuc

SEQ ID NO: 2064783 - RNA, 20 nt, Homo sapiens
gaggguuguucuccuagacu

SEQ ID NO: 2064784 - RNA, 16 nt, Homo sapiens
cuagacucauacucaa

SEQ ID NO: 2064785 - RNA, 17 nt, Homo sapiens
uuuuuaaauagggaaua

SEQ ID NO: 2064786 - RNA, 18 nt, Homo sapiens
cuggguuucuagagguca

SEQ ID NO: 2064787 - RNA, 19 nt, Homo sapiens
uuucaaggauaggcuuuau

SEQ ID NO: 2064788 - RNA, 20 nt, Homo sapiens
ggcaagugugugccugugug

SEQ ID NO: 2064789 - RNA, 21 nt, Homo sapiens
aguagagcacuuuucacuuau

SEQ ID NO: 2064790 - RNA, 16 nt, Homo sapiens
aguuuccucagugaug

SEQ ID NO: 2064791 - RNA, 14 nt, Homo sapiens
uggggccacagcca

SEQ ID NO: 2064792 - RNA, 19 nt, Homo sapiens
ugccuucagcuguugcaga

SEQ ID NO: 2064793 - RNA, 21 nt, Homo sapiens
agaccuccagcccugggacag

SEQ ID NO: 2064794 - RNA, 19 nt, Homo sapiens
aucuccacccugagccuga

SEQ ID NO: 2064795 - RNA, 13 nt, Homo sapiens
caaagaaauaucu

SEQ ID NO: 2064796 - RNA, 17 nt, Homo sapiens
caacauggcagagcagu

SEQ ID NO: 2064797 - RNA, 23 nt, Homo sapiens
agccuggcaggggauccagcuca

SEQ ID NO: 2064798 - RNA, 23 nt, Homo sapiens
cucaccagcccugaccccagugu

SEQ ID NO: 2064799 - RNA, 13 nt, Homo sapiens
uuagauaaccaua

SEQ ID NO: 2064800 - RNA, 15 nt, Homo sapiens
cuacuggcccaagau

SEQ ID NO: 2064801 - RNA, 15 nt, Homo sapiens
augucccugggccag

SEQ ID NO: 2064802 - RNA, 17 nt, Homo sapiens
aaccaggggccaugaau

SEQ ID NO: 2064803 - RNA, 19 nt, Homo sapiens
ccuggcugaaggacuguga

SEQ ID NO: 2064804 - RNA, 22 nt, Homo sapiens
uugcuaaagacaugaagccacg

SEQ ID NO: 2064805 - RNA, 20 nt, Homo sapiens
gauuuaacaaauacauucau

SEQ ID NO: 2064806 - RNA, 21 nt, Homo sapiens
aguucugcucauucuaaugau

SEQ ID NO: 2064807 - RNA, 19 nt, Homo sapiens
cugaaaugcuagcugcaag

SEQ ID NO: 2064808 - RNA, 21 nt, Homo sapiens
caggagcguguacuaccccag

SEQ ID NO: 2064809 - RNA, 19 nt, Homo sapiens
cugagaacagugcacaaga

SEQ ID NO: 2064810 - RNA, 14 nt, Homo sapiens
aaugcaaaaaaucu

SEQ ID NO: 2064811 - RNA, 14 nt, Homo sapiens
ucagcaaaucuucu

SEQ ID NO: 2064812 - RNA, 19 nt, Homo sapiens
uccaacauuucucacugaa

SEQ ID NO: 2064813 - RNA, 15 nt, Homo sapiens
cugaacucagcacau

SEQ ID NO: 2064814 - RNA, 24 nt, Homo sapiens
aaccaagauuaugugacuugcaau

SEQ ID NO: 2064815 - RNA, 18 nt, Homo sapiens
cauuaauaccuaaacugu

SEQ ID NO: 2064816 - RNA, 16 nt, Homo sapiens
uguuugguaccaagaa

SEQ ID NO: 2064817 - RNA, 19 nt, Homo sapiens
aucuuaaaugacagugaau

SEQ ID NO: 2064818 - RNA, 13 nt, Homo sapiens
aggauguaacuuu

SEQ ID NO: 2064819 - RNA, 15 nt, Homo sapiens
acggccagguacaac

SEQ ID NO: 2064820 - RNA, 15 nt, Homo sapiens
uauaaagauacuaaa

SEQ ID NO: 2064821 - RNA, 20 nt, Homo sapiens
cagaacuggaaauguccaag

SEQ ID NO: 2064822 - RNA, 18 nt, Homo sapiens
agguggaggcaaguggaa

SEQ ID NO: 2064823 - RNA, 22 nt, Homo sapiens
uuugaccaaauaaaguaccauu

SEQ ID NO: 2064824 - RNA, 14 nt, Homo sapiens
aaauaaucaguuac

SEQ ID NO: 2064825 - RNA, 16 nt, Homo sapiens
cuugaggcuaccucua

SEQ ID NO: 2064826 - RNA, 20 nt, Homo sapiens
uccaucggaacagaaaacua

SEQ ID NO: 2064827 - RNA, 22 nt, Homo sapiens
aggauugaaaauguccaggaaa

SEQ ID NO: 2064828 - RNA, 19 nt, Homo sapiens
aggguugguccucuugccu

SEQ ID NO: 2064829 - RNA, 17 nt, Homo sapiens
gagguacugagagugaa

SEQ ID NO: 2064830 - RNA, 23 nt, Homo sapiens
gggcucucucuccccacugucuc

SEQ ID NO: 2064831 - RNA, 16 nt, Homo sapiens
cccaggcuggaugcug

SEQ ID NO: 2064832 - RNA, 13 nt, Homo sapiens
uugaaauauucag

SEQ ID NO: 2064833 - RNA, 13 nt, Homo sapiens
augaaauaaucag

SEQ ID NO: 2064834 - RNA, 19 nt, Homo sapiens
agcaguaagcuaucuucaa

SEQ ID NO: 2064835 - RNA, 22 nt, Homo sapiens
gaguaauaguaaacacagggaa

SEQ ID NO: 2064836 - RNA, 18 nt, Homo sapiens
gaaauaaaguuggugaca

SEQ ID NO: 2064837 - RNA, 19 nt, Homo sapiens
uuggcuucucauacgucca

SEQ ID NO: 2064838 - RNA, 22 nt, Homo sapiens
guuucuauagcgagacauagaa

SEQ ID NO: 2064839 - RNA, 14 nt, Homo sapiens
cugucacaccagcc

SEQ ID NO: 2064840 - RNA, 14 nt, Homo sapiens
aacacaugacuaga

SEQ ID NO: 2064841 - RNA, 22 nt, Homo sapiens
aucgaucuggaaagagcuguuu

SEQ ID NO: 2064842 - RNA, 19 nt, Homo sapiens
ucuuccugaguggugccaa

SEQ ID NO: 2064843 - RNA, 17 nt, Homo sapiens
uccaccuccuaccccau

SEQ ID NO: 2064844 - RNA, 24 nt, Homo sapiens
uaaaagguauacuuuaguagacau

SEQ ID NO: 2064845 - RNA, 16 nt, Homo sapiens
ccuguacacacacaga

SEQ ID NO: 2064846 - RNA, 18 nt, Homo sapiens
aacccuuaaacaguugca

SEQ ID NO: 2064847 - RNA, 17 nt, Homo sapiens
ucaaaaagugacuucca

SEQ ID NO: 2064848 - RNA, 16 nt, Homo sapiens
auacuacuacuguuau

SEQ ID NO: 2064849 - RNA, 17 nt, Homo sapiens
aucugaggaauggacau

SEQ ID NO: 2064850 - RNA, 21 nt, Homo sapiens
accccacauuggacuuccuug

SEQ ID NO: 2064851 - RNA, 20 nt, Homo sapiens
auauacuuuuacaaguaaca

SEQ ID NO: 2064852 - RNA, 14 nt, Homo sapiens
aaaucuauuacuuu

SEQ ID NO: 2064853 - RNA, 14 nt, Homo sapiens
ugccaaaccuuuaa

SEQ ID NO: 2064854 - RNA, 22 nt, Homo sapiens
cacuaaaagaauugugacauaa

SEQ ID NO: 2064855 - RNA, 13 nt, Homo sapiens
aaaacauuugcug

SEQ ID NO: 2064856 - RNA, 17 nt, Homo sapiens
ccuugagagacccagcu

SEQ ID NO: 2064857 - RNA, 16 nt, Homo sapiens
ucuagcaccaggacuc

SEQ ID NO: 2064858 - RNA, 13 nt, Homo sapiens
gaugugacaggaa

SEQ ID NO: 2064859 - RNA, 15 nt, Homo sapiens
caagcauucaagaaa

SEQ ID NO: 2064860 - RNA, 14 nt, Homo sapiens
aauugaacuaacaa

SEQ ID NO: 2064861 - RNA, 15 nt, Homo sapiens
cauuuaugauuuauc

SEQ ID NO: 2064862 - RNA, 18 nt, Homo sapiens
agcuugacaccuggugcu

SEQ ID NO: 2064863 - RNA, 12 nt, Homo sapiens
cauguugucaau

SEQ ID NO: 2064864 - RNA, 18 nt, Homo sapiens
gucaagcccuugcccaga

SEQ ID NO: 2064865 - RNA, 17 nt, Homo sapiens
cccaaaaauuacuuugg

SEQ ID NO: 2064866 - RNA, 21 nt, Homo sapiens
accucauuuuucauacugaaa

SEQ ID NO: 2064867 - RNA, 19 nt, Homo sapiens
uucacccaaaacaaaguaa

SEQ ID NO: 2064868 - RNA, 17 nt, Homo sapiens
augugaaacucaucuca

SEQ ID NO: 2064869 - RNA, 20 nt, Homo sapiens
caaucacguuauaguccaug

SEQ ID NO: 2064870 - RNA, 17 nt, Homo sapiens
accaugcgacacuggga

SEQ ID NO: 2064871 - RNA, 19 nt, Homo sapiens
auuuuguucuuaauuguga

SEQ ID NO: 2064872 - RNA, 22 nt, Homo sapiens
aaguaacauuaacucaguggaa

SEQ ID NO: 2064873 - RNA, 17 nt, Homo sapiens
guucuaaauaugaauga

SEQ ID NO: 2064874 - RNA, 12 nt, Homo sapiens
cacaagugcgcc

SEQ ID NO: 2064875 - RNA, 12 nt, Homo sapiens
ggccaguggaca

SEQ ID NO: 2064876 - RNA, 21 nt, Homo sapiens
agugcacauggcagcgguggg

SEQ ID NO: 2064877 - RNA, 23 nt, Homo sapiens
uggggaucuugcccccuuugacc

SEQ ID NO: 2064878 - RNA, 18 nt, Homo sapiens
ucagagacagauaccucc

SEQ ID NO: 2064879 - RNA, 15 nt, Homo sapiens
aguacuggcacaaaa

SEQ ID NO: 2064880 - RNA, 20 nt, Homo sapiens
aaauaagaauaaacuuucuc

SEQ ID NO: 2064881 - RNA, 11 nt, Homo sapiens
uggggcccaag

SEQ ID NO: 2064882 - RNA, 12 nt, Homo sapiens
uucaucaugacu

SEQ ID NO: 2064883 - RNA, 13 nt, Homo sapiens
cauucuuuugcac

SEQ ID NO: 2064884 - RNA, 17 nt, Homo sapiens
augaagggaugcugcaa

SEQ ID NO: 2064885 - RNA, 17 nt, Homo sapiens
cuccugggcucaagcaa

SEQ ID NO: 2064886 - RNA, 23 nt, Homo sapiens
ugcuggcuugccucuugcaauuc

SEQ ID NO: 2064887 - RNA, 22 nt, Homo sapiens
ugaagcccaggcugaugcuuga

SEQ ID NO: 2064888 - RNA, 15 nt, Homo sapiens
ucucagauuccaugc

SEQ ID NO: 2064889 - RNA, 15 nt, Homo sapiens
gcuaagcugcccuga

SEQ ID NO: 2064890 - RNA, 17 nt, Homo sapiens
agaauaugaaacuuuca

SEQ ID NO: 2064891 - RNA, 15 nt, Homo sapiens
cucugcuuccugagc

SEQ ID NO: 2064892 - RNA, 14 nt, Homo sapiens
aacuuuaucacuua

SEQ ID NO: 2064893 - RNA, 14 nt, Homo sapiens
auguauaucuguaa

SEQ ID NO: 2064894 - RNA, 20 nt, Homo sapiens
cuggucaccuugcacuccuc

SEQ ID NO: 2064895 - RNA, 23 nt, Homo sapiens
aauucucuuuccuguagucccau

SEQ ID NO: 2064896 - RNA, 15 nt, Homo sapiens
agcccacacuugaga

SEQ ID NO: 2064897 - RNA, 19 nt, Homo sapiens
acccaccuggcuucauaca

SEQ ID NO: 2064898 - RNA, 19 nt, Homo sapiens
cuaaccaguaccucuguau

SEQ ID NO: 2064899 - RNA, 14 nt, Homo sapiens
ugcuccuuacccug

SEQ ID NO: 2064900 - RNA, 14 nt, Homo sapiens
ggugacuacccuag

SEQ ID NO: 2064901 - RNA, 14 nt, Homo sapiens
gcugggcacugcuc

SEQ ID NO: 2064902 - RNA, 16 nt, Homo sapiens
aauaaaaaucauucua

SEQ ID NO: 2064903 - RNA, 12 nt, Homo sapiens
cacccuucuccc

SEQ ID NO: 2064904 - RNA, 12 nt, Homo sapiens
ucaacuuccaaa

SEQ ID NO: 2064905 - RNA, 23 nt, Homo sapiens
acaggaucauguaaaugcucaaa

SEQ ID NO: 2064906 - RNA, 15 nt, Homo sapiens
uccaccugcacauug

SEQ ID NO: 2064907 - RNA, 22 nt, Homo sapiens
uauauauuugaaagaagucaaa

SEQ ID NO: 2064908 - RNA, 16 nt, Homo sapiens
aaugcgacaaguaguu

SEQ ID NO: 2064909 - RNA, 20 nt, Homo sapiens
aguucuccuuguacuugaau

SEQ ID NO: 2064910 - RNA, 15 nt, Homo sapiens
uuccuuagucucaag

SEQ ID NO: 2064911 - RNA, 17 nt, Homo sapiens
acugcucaucauuccuu

SEQ ID NO: 2064912 - RNA, 19 nt, Homo sapiens
aacccgugccaaguccagg

SEQ ID NO: 2064913 - RNA, 15 nt, Homo sapiens
cuuuccaaaaucagg

SEQ ID NO: 2064914 - RNA, 12 nt, Homo sapiens
caagcuucauua

SEQ ID NO: 2064915 - RNA, 20 nt, Homo sapiens
auucuuccuugagcuaagca

SEQ ID NO: 2064916 - RNA, 20 nt, Homo sapiens
aauaauaaaucguccuccca

SEQ ID NO: 2064917 - RNA, 14 nt, Homo sapiens
agcagggacuguaa

SEQ ID NO: 2064918 - RNA, 12 nt, Homo sapiens
agauggcccaag

SEQ ID NO: 2064919 - RNA, 17 nt, Homo sapiens
uuaugcgaaccuauguc

SEQ ID NO: 2064920 - RNA, 18 nt, Homo sapiens
aaagugauugacuugacu

SEQ ID NO: 2064921 - RNA, 17 nt, Homo sapiens
cgacauagcgagacucc

SEQ ID NO: 2064922 - RNA, 22 nt, Homo sapiens
aucaggcagcccaaaaguuuau

SEQ ID NO: 2064923 - RNA, 21 nt, Homo sapiens
gcacugcggcugucuccuuga

SEQ ID NO: 2064924 - RNA, 15 nt, Homo sapiens
ucuacacauacugca

SEQ ID NO: 2064925 - RNA, 21 nt, Homo sapiens
uuagcaccucuuuuugaacag

SEQ ID NO: 2064926 - RNA, 18 nt, Homo sapiens
cgauggggcccacauuag

SEQ ID NO: 2064927 - RNA, 22 nt, Homo sapiens
accuacugaaucagaaauguaa

SEQ ID NO: 2064928 - RNA, 23 nt, Homo sapiens
caaugugauggucaggaucucau

SEQ ID NO: 2064929 - RNA, 15 nt, Homo sapiens
cccggugucaucccu

SEQ ID NO: 2064930 - RNA, 20 nt, Homo sapiens
aauuuaucuuaaccucaaaa

SEQ ID NO: 2064931 - RNA, 15 nt, Homo sapiens
cugcugaaacugugu

SEQ ID NO: 2064932 - RNA, 15 nt, Homo sapiens
aaacacacagucaca

SEQ ID NO: 2064933 - RNA, 23 nt, Homo sapiens
guccagagccggggcacuuucag

SEQ ID NO: 2064934 - RNA, 15 nt, Homo sapiens
uaaaaagucuucacu

SEQ ID NO: 2064935 - RNA, 22 nt, Homo sapiens
aacacaagagacuuaaaggaca

SEQ ID NO: 2064936 - RNA, 12 nt, Homo sapiens
gcaguugcaaug

SEQ ID NO: 2064937 - RNA, 14 nt, Homo sapiens
acagugaaaggccu

SEQ ID NO: 2064938 - RNA, 19 nt, Homo sapiens
auauccuuugccucaagga

SEQ ID NO: 2064939 - RNA, 17 nt, Homo sapiens
cuuggggaacccaugag

SEQ ID NO: 2064940 - RNA, 16 nt, Homo sapiens
aguaugguguguucac

SEQ ID NO: 2064941 - RNA, 16 nt, Homo sapiens
ccaagucaaagacauu

SEQ ID NO: 2064942 - RNA, 15 nt, Homo sapiens
uaggugcagcuccuc

SEQ ID NO: 2064943 - RNA, 15 nt, Homo sapiens
ccuuaacgcuagaga

SEQ ID NO: 2064944 - RNA, 17 nt, Homo sapiens
ccacuucuccaugcugc

SEQ ID NO: 2064945 - RNA, 20 nt, Homo sapiens
uccuaucauuuuauuaucac

SEQ ID NO: 2064946 - RNA, 20 nt, Homo sapiens
gcuugcccagggugcagugu

SEQ ID NO: 2064947 - RNA, 13 nt, Homo sapiens
aauaaauuccuaa

SEQ ID NO: 2064948 - RNA, 15 nt, Homo sapiens
cagagaugacugucc

SEQ ID NO: 2064949 - RNA, 21 nt, Homo sapiens
ugugucucccaggugcauuuc

SEQ ID NO: 2064950 - RNA, 13 nt, Homo sapiens
agcccagcacagg

SEQ ID NO: 2064951 - RNA, 14 nt, Homo sapiens
ucuguuuaacauuu

SEQ ID NO: 2064952 - RNA, 14 nt, Homo sapiens
uguuacacaugaca

SEQ ID NO: 2064953 - RNA, 20 nt, Homo sapiens
auuauagaaacaauacuguu

SEQ ID NO: 2064954 - RNA, 17 nt, Homo sapiens
agcucacacuccagugg

SEQ ID NO: 2064955 - RNA, 15 nt, Homo sapiens
gaagauucauuuaag

SEQ ID NO: 2064956 - RNA, 14 nt, Homo sapiens
auaaaauauguaca

SEQ ID NO: 2064957 - RNA, 20 nt, Homo sapiens
cgcccaggcuggaguacagu

SEQ ID NO: 2064958 - RNA, 16 nt, Homo sapiens
uuaaaacaugcacaaa

SEQ ID NO: 2064959 - RNA, 22 nt, Homo sapiens
ucuaaauuuugucuuuaacuca

SEQ ID NO: 2064960 - RNA, 20 nt, Homo sapiens
aaagggcagcuucagucucu

SEQ ID NO: 2064961 - RNA, 21 nt, Homo sapiens
accacucaggcauuugacuga

SEQ ID NO: 2064962 - RNA, 15 nt, Homo sapiens
agcaugaucacagcu

SEQ ID NO: 2064963 - RNA, 17 nt, Homo sapiens
agaguauguucuugaag

SEQ ID NO: 2064964 - RNA, 16 nt, Homo sapiens
ccaauggcggacucaa

SEQ ID NO: 2064965 - RNA, 17 nt, Homo sapiens
cagaugaacucaugucu

SEQ ID NO: 2064966 - RNA, 18 nt, Homo sapiens
gaugagcacacacacacc

SEQ ID NO: 2064967 - RNA, 11 nt, Homo sapiens
aaacagacuug

SEQ ID NO: 2064968 - RNA, 22 nt, Homo sapiens
guugcuguuauuauauuugaca

SEQ ID NO: 2064969 - RNA, 19 nt, Homo sapiens
gaaggggcucgagugcccc

SEQ ID NO: 2064970 - RNA, 22 nt, Homo sapiens
cauuuuuuaugaacacuugaca

SEQ ID NO: 2064971 - RNA, 15 nt, Homo sapiens
cccagcuacuaggga

SEQ ID NO: 2064972 - RNA, 22 nt, Homo sapiens
ugaaaaaagguuguguagcugu

SEQ ID NO: 2064973 - RNA, 13 nt, Homo sapiens
cuuucauccucag

SEQ ID NO: 2064974 - RNA, 20 nt, Homo sapiens
cacuucccagagcaucuugc

SEQ ID NO: 2064975 - RNA, 17 nt, Homo sapiens
uacaccucugauuacaa

SEQ ID NO: 2064976 - RNA, 21 nt, Homo sapiens
uuaaaguaccuuaaaauugag

SEQ ID NO: 2064977 - RNA, 21 nt, Homo sapiens
aaaugauccaguggacacuug

SEQ ID NO: 2064978 - RNA, 18 nt, Homo sapiens
uucaagaagauggcaaaa

SEQ ID NO: 2064979 - RNA, 17 nt, Homo sapiens
acuccuuccuugaaccc

SEQ ID NO: 2064980 - RNA, 22 nt, Homo sapiens
caucgaauaagacucaucauuu

SEQ ID NO: 2064981 - RNA, 19 nt, Homo sapiens
agaucaugagaaauuacca

SEQ ID NO: 2064982 - RNA, 17 nt, Homo sapiens
uacauauauaugucagg

SEQ ID NO: 2064983 - RNA, 16 nt, Homo sapiens
cagugacgcugcugac

SEQ ID NO: 2064984 - RNA, 19 nt, Homo sapiens
gacaauuccuccagagaca

SEQ ID NO: 2064985 - RNA, 14 nt, Homo sapiens
cuaagaucuguuaa

SEQ ID NO: 2064986 - RNA, 19 nt, Homo sapiens
cugcucccacaggggccau

SEQ ID NO: 2064987 - RNA, 22 nt, Homo sapiens
ugagcacugccaggagggacaa

SEQ ID NO: 2064988 - RNA, 22 nt, Homo sapiens
cuguugcuuuaauaugagcuuc

SEQ ID NO: 2064989 - RNA, 17 nt, Homo sapiens
ccuggcccaugugccca

SEQ ID NO: 2064990 - RNA, 15 nt, Homo sapiens
aggcacagcuaacca

SEQ ID NO: 2064991 - RNA, 12 nt, Homo sapiens
uguucagauuaa

SEQ ID NO: 2064992 - RNA, 23 nt, Homo sapiens
auuagacaauguggaauuacaua

SEQ ID NO: 2064993 - RNA, 22 nt, Homo sapiens
acuuucuuccgaucuguaccug

SEQ ID NO: 2064994 - RNA, 18 nt, Homo sapiens
ugccccucagggggccag

SEQ ID NO: 2064995 - RNA, 19 nt, Homo sapiens
cuaauuguccauucuugcu

SEQ ID NO: 2064996 - RNA, 18 nt, Homo sapiens
uaggugacugaaauugca

SEQ ID NO: 2064997 - RNA, 19 nt, Homo sapiens
caucaauauucagcaaaau

SEQ ID NO: 2064998 - RNA, 12 nt, Homo sapiens
ucauucagggau

SEQ ID NO: 2064999 - RNA, 21 nt, Homo sapiens
gcugcaacggaauuaggaaga

SEQ ID NO: 2065000 - RNA, 17 nt, Homo sapiens
caccaaauacaauucaa

SEQ ID NO: 2065001 - RNA, 17 nt, Homo sapiens
aacccugcccugcaccu

SEQ ID NO: 2065002 - RNA, 15 nt, Homo sapiens
gcaccguccaaccug

SEQ ID NO: 2065003 - RNA, 23 nt, Homo sapiens
cccacaugugacacauaugcacc

SEQ ID NO: 2065004 - RNA, 20 nt, Homo sapiens
ccauuguguaugauuuugau

SEQ ID NO: 2065005 - RNA, 16 nt, Homo sapiens
cccucagcccuggccu

SEQ ID NO: 2065006 - RNA, 19 nt, Homo sapiens
acagcugaacaguguuaau

SEQ ID NO: 2065007 - RNA, 19 nt, Homo sapiens
gcaacaaaacuauggaaau

SEQ ID NO: 2065008 - RNA, 19 nt, Homo sapiens
augauucuccucucccaaa

SEQ ID NO: 2065009 - RNA, 16 nt, Homo sapiens
ugauucugucaauguc

SEQ ID NO: 2065010 - RNA, 15 nt, Homo sapiens
aaauucaacuuugua

SEQ ID NO: 2065011 - RNA, 15 nt, Homo sapiens
uauccuuacauuuca

SEQ ID NO: 2065012 - RNA, 21 nt, Homo sapiens
auuugcuauagaaaacaauac

SEQ ID NO: 2065013 - RNA, 19 nt, Homo sapiens
accucccccugccuuccaa

SEQ ID NO: 2065014 - RNA, 14 nt, Homo sapiens
ugcaaaaacagagg

SEQ ID NO: 2065015 - RNA, 19 nt, Homo sapiens
cuccaccacugugcacuua

SEQ ID NO: 2065016 - RNA, 21 nt, Homo sapiens
cuccauuuuacagaagcauuu

SEQ ID NO: 2065017 - RNA, 19 nt, Homo sapiens
uaccaguucagacacuacc

SEQ ID NO: 2065018 - RNA, 19 nt, Homo sapiens
agugccauuccacuccacu

SEQ ID NO: 2065019 - RNA, 16 nt, Homo sapiens
ggucaucaccucccag

SEQ ID NO: 2065020 - RNA, 18 nt, Homo sapiens
caaguuacauacauuuaa

SEQ ID NO: 2065021 - RNA, 22 nt, Homo sapiens
augugcuauuggcccagcuuuu

SEQ ID NO: 2065022 - RNA, 15 nt, Homo sapiens
aaccugauuacagaa

SEQ ID NO: 2065023 - RNA, 20 nt, Homo sapiens
gcaccuggcggggucuugcu

SEQ ID NO: 2065024 - RNA, 13 nt, Homo sapiens
aacccuagcaaaa

SEQ ID NO: 2065025 - RNA, 19 nt, Homo sapiens
uccucggcccaucugucca

SEQ ID NO: 2065026 - RNA, 12 nt, Homo sapiens
cuauauuugcuu

SEQ ID NO: 2065027 - RNA, 14 nt, Homo sapiens
ucugugcuguggaa

SEQ ID NO: 2065028 - RNA, 20 nt, Homo sapiens
agucacuggcccaaccagaa

SEQ ID NO: 2065029 - RNA, 12 nt, Homo sapiens
ugggcugugcua

SEQ ID NO: 2065030 - RNA, 22 nt, Homo sapiens
aauuuaaauaagauuuaauuca

SEQ ID NO: 2065031 - RNA, 21 nt, Homo sapiens
aaugaaagggaaacugggaaa

SEQ ID NO: 2065032 - RNA, 19 nt, Homo sapiens
aagaugauuuaaguauaca

SEQ ID NO: 2065033 - RNA, 20 nt, Homo sapiens
aagucagcucagacccagac

SEQ ID NO: 2065034 - RNA, 22 nt, Homo sapiens
uacuuuuauaauuuccuaugcc

SEQ ID NO: 2065035 - RNA, 19 nt, Homo sapiens
ugcagauuucucaccugua

SEQ ID NO: 2065036 - RNA, 12 nt, Homo sapiens
ucucugagucaa

SEQ ID NO: 2065037 - RNA, 20 nt, Homo sapiens
agaugucuucuugcaauauu

SEQ ID NO: 2065038 - RNA, 11 nt, Homo sapiens
uauauucuuga

SEQ ID NO: 2065039 - RNA, 14 nt, Homo sapiens
aaagcaugcauauc

SEQ ID NO: 2065040 - RNA, 22 nt, Homo sapiens
agacauuccugcgcauggugca

SEQ ID NO: 2065041 - RNA, 14 nt, Homo sapiens
uucuuacuguagua

SEQ ID NO: 2065042 - RNA, 17 nt, Homo sapiens
cggcucucaccaguggc

SEQ ID NO: 2065043 - RNA, 15 nt, Homo sapiens
uuuucauacugaaaa

SEQ ID NO: 2065044 - RNA, 15 nt, Homo sapiens
cuguaauauuuacaa

SEQ ID NO: 2065045 - RNA, 16 nt, Homo sapiens
ucccacuuaucaaauc

SEQ ID NO: 2065046 - RNA, 19 nt, Homo sapiens
caauuacaggaaguacugg

SEQ ID NO: 2065047 - RNA, 22 nt, Homo sapiens
accaguaaaggcugcugcuaca

SEQ ID NO: 2065048 - RNA, 19 nt, Homo sapiens
caaggcagcccugucugaa

SEQ ID NO: 2065049 - RNA, 19 nt, Homo sapiens
ugccacacugaaacagcca

SEQ ID NO: 2065050 - RNA, 15 nt, Homo sapiens
gccgcuuucucugag

SEQ ID NO: 2065051 - RNA, 20 nt, Homo sapiens
uuuaaaugaugauuccuuga

SEQ ID NO: 2065052 - RNA, 17 nt, Homo sapiens
gcacagggucucuacca

SEQ ID NO: 2065053 - RNA, 16 nt, Homo sapiens
cuggaaaacucaggau

SEQ ID NO: 2065054 - RNA, 21 nt, Homo sapiens
aguguuuguuagagugcacau

SEQ ID NO: 2065055 - RNA, 20 nt, Homo sapiens
gaaaagcugcugacaguguu

SEQ ID NO: 2065056 - RNA, 15 nt, Homo sapiens
acccugcgauuuugc

SEQ ID NO: 2065057 - RNA, 15 nt, Homo sapiens
cugcacuuacaggcc

SEQ ID NO: 2065058 - RNA, 11 nt, Homo sapiens
cuuagugaauu

SEQ ID NO: 2065059 - RNA, 21 nt, Homo sapiens
acaagucugcauuucauauua

SEQ ID NO: 2065060 - RNA, 17 nt, Homo sapiens
gagccccggaucccaag

SEQ ID NO: 2065061 - RNA, 18 nt, Homo sapiens
ucccccuauccuuggcac

SEQ ID NO: 2065062 - RNA, 18 nt, Homo sapiens
cuuucuuuucaugcccau

SEQ ID NO: 2065063 - RNA, 11 nt, Homo sapiens
uuugcauuucc

SEQ ID NO: 2065064 - RNA, 19 nt, Homo sapiens
uccuaaggccuuagggguc

SEQ ID NO: 2065065 - RNA, 17 nt, Homo sapiens
acaucagcaaacaggau

SEQ ID NO: 2065066 - RNA, 20 nt, Homo sapiens
guauaaaauguaacacugau

SEQ ID NO: 2065067 - RNA, 19 nt, Homo sapiens
cagaauacaguaagcugcu

SEQ ID NO: 2065068 - RNA, 23 nt, Homo sapiens
ggcaauuaauuccuucagcacuu

SEQ ID NO: 2065069 - RNA, 10 nt, Homo sapiens
aaaaugagau

SEQ ID NO: 2065070 - RNA, 24 nt, Homo sapiens
cuuuugguuucaccuucccucgac

SEQ ID NO: 2065071 - RNA, 14 nt, Homo sapiens
auuauuuccacuug

SEQ ID NO: 2065072 - RNA, 15 nt, Homo sapiens
ucagugacaucugau

SEQ ID NO: 2065073 - RNA, 19 nt, Homo sapiens
gaagggaguuggugugcua

SEQ ID NO: 2065074 - RNA, 23 nt, Homo sapiens
accaguguaaauucagucuuuuc

SEQ ID NO: 2065075 - RNA, 22 nt, Homo sapiens
aagagacuaauagagacacaga

SEQ ID NO: 2065076 - RNA, 17 nt, Homo sapiens
ugugaauugcugcaaca

SEQ ID NO: 2065077 - RNA, 16 nt, Homo sapiens
aauucuguggcaguuu

SEQ ID NO: 2065078 - RNA, 20 nt, Homo sapiens
caccucggccucccaaagug

SEQ ID NO: 2065079 - RNA, 17 nt, Homo sapiens
ggacuucuuccagggag

SEQ ID NO: 2065080 - RNA, 20 nt, Homo sapiens
acauauauauucuacauaua

SEQ ID NO: 2065081 - RNA, 14 nt, Homo sapiens
aucccaguuacuca

SEQ ID NO: 2065082 - RNA, 13 nt, Homo sapiens
ucagacacuuugg

SEQ ID NO: 2065083 - RNA, 19 nt, Homo sapiens
cagccagcucccagccaca

SEQ ID NO: 2065084 - RNA, 18 nt, Homo sapiens
uguuguaagcaacaggcu

SEQ ID NO: 2065085 - RNA, 16 nt, Homo sapiens
aguaugaaaaugucau

SEQ ID NO: 2065086 - RNA, 20 nt, Homo sapiens
uaaccaugucuguuggucaa

SEQ ID NO: 2065087 - RNA, 18 nt, Homo sapiens
uuaaacuugcaguaucuc

SEQ ID NO: 2065088 - RNA, 23 nt, Homo sapiens
aguguuauuugcacacugcacug

SEQ ID NO: 2065089 - RNA, 18 nt, Homo sapiens
aguaguguggccugugcc

SEQ ID NO: 2065090 - RNA, 18 nt, Homo sapiens
ggacauuugcucauggaa

SEQ ID NO: 2065091 - RNA, 13 nt, Homo sapiens
uuaauuacaucca

SEQ ID NO: 2065092 - RNA, 21 nt, Homo sapiens
acuugcguggacagucagggu

SEQ ID NO: 2065093 - RNA, 23 nt, Homo sapiens
ccauagcugggaaacguggguuc

SEQ ID NO: 2065094 - RNA, 17 nt, Homo sapiens
ccucagcucaaugcagu

SEQ ID NO: 2065095 - RNA, 23 nt, Homo sapiens
gaccgcccccugucucucagggc

SEQ ID NO: 2065096 - RNA, 20 nt, Homo sapiens
aaauauuuuuaugugcaaua

SEQ ID NO: 2065097 - RNA, 12 nt, Homo sapiens
auucuuauucaa

SEQ ID NO: 2065098 - RNA, 13 nt, Homo sapiens
aaggccacagugc

SEQ ID NO: 2065099 - RNA, 13 nt, Homo sapiens
aaggacacaguga

SEQ ID NO: 2065100 - RNA, 23 nt, Homo sapiens
ccauauuuguggcccgugcagcu

SEQ ID NO: 2065101 - RNA, 16 nt, Homo sapiens
cguggugggauuugcu

SEQ ID NO: 2065102 - RNA, 18 nt, Homo sapiens
cuguaaucccagcuacua

SEQ ID NO: 2065103 - RNA, 21 nt, Homo sapiens
aggucagagcagagguggaaa

SEQ ID NO: 2065104 - RNA, 18 nt, Homo sapiens
ucccugaacaucugugug

SEQ ID NO: 2065105 - RNA, 23 nt, Homo sapiens
gaagguagcccagcacugugaag

SEQ ID NO: 2065106 - RNA, 15 nt, Homo sapiens
uaggugcaguuugcu

SEQ ID NO: 2065107 - RNA, 18 nt, Homo sapiens
caagaugguuaagucaau

SEQ ID NO: 2065108 - RNA, 16 nt, Homo sapiens
cuuuuucuuguauuca

SEQ ID NO: 2065109 - RNA, 22 nt, Homo sapiens
auccuaugguuucuccauccaa

SEQ ID NO: 2065110 - RNA, 15 nt, Homo sapiens
ugcccagcaggggag

SEQ ID NO: 2065111 - RNA, 19 nt, Homo sapiens
gccccuaaucccagcacuu

SEQ ID NO: 2065112 - RNA, 17 nt, Homo sapiens
uccauggcagcuggucu

SEQ ID NO: 2065113 - RNA, 22 nt, Homo sapiens
gugcgaucucggcucagugcaa

SEQ ID NO: 2065114 - RNA, 23 nt, Homo sapiens
cagugggaaauaugccacugacc

SEQ ID NO: 2065115 - RNA, 15 nt, Homo sapiens
cccacagcacuaauu

SEQ ID NO: 2065116 - RNA, 20 nt, Homo sapiens
ccccauuucaggugugagau

SEQ ID NO: 2065117 - RNA, 23 nt, Homo sapiens
caggugucgggggaaaugaacug

SEQ ID NO: 2065118 - RNA, 15 nt, Homo sapiens
gccccucacuuccag

SEQ ID NO: 2065119 - RNA, 15 nt, Homo sapiens
gccuuucacuuuuag

SEQ ID NO: 2065120 - RNA, 15 nt, Homo sapiens
gucuuuaucaaagga

SEQ ID NO: 2065121 - RNA, 13 nt, Homo sapiens
auuucagcauuau

SEQ ID NO: 2065122 - RNA, 13 nt, Homo sapiens
ugcacagcugcuu

SEQ ID NO: 2065123 - RNA, 19 nt, Homo sapiens
uaccuuccuuaagccagga

SEQ ID NO: 2065124 - RNA, 21 nt, Homo sapiens
acaaggacgcccgaagcacag

SEQ ID NO: 2065125 - RNA, 13 nt, Homo sapiens
uugcuagcaguaa

SEQ ID NO: 2065126 - RNA, 13 nt, Homo sapiens
accuccauuuccc

SEQ ID NO: 2065127 - RNA, 19 nt, Homo sapiens
ccuagacaaacaagggaga

SEQ ID NO: 2065128 - RNA, 17 nt, Homo sapiens
caggaugaaugaggaaa

SEQ ID NO: 2065129 - RNA, 17 nt, Homo sapiens
gagugcccccaacagca

SEQ ID NO: 2065130 - RNA, 17 nt, Homo sapiens
uccauggaagaaacaca

SEQ ID NO: 2065131 - RNA, 18 nt, Homo sapiens
ucaacuaaguucagggaa

SEQ ID NO: 2065132 - RNA, 15 nt, Homo sapiens
ccaaagccacuggaa

SEQ ID NO: 2065133 - RNA, 23 nt, Homo sapiens
cccagccccuguggagggggugc

SEQ ID NO: 2065134 - RNA, 15 nt, Homo sapiens
auaaaauacagagaa

SEQ ID NO: 2065135 - RNA, 19 nt, Homo sapiens
uaaagagagaauguagaua

SEQ ID NO: 2065136 - RNA, 23 nt, Homo sapiens
cacauguguucucuauuuugccu

SEQ ID NO: 2065137 - RNA, 17 nt, Homo sapiens
uuugccauuaugcaaau

SEQ ID NO: 2065138 - RNA, 22 nt, Homo sapiens
ccugcugggggcagcaguacca

SEQ ID NO: 2065139 - RNA, 20 nt, Homo sapiens
gcacagaacaagccacagga

SEQ ID NO: 2065140 - RNA, 12 nt, Homo sapiens
accucccagcgu

SEQ ID NO: 2065141 - RNA, 13 nt, Homo sapiens
auaauuugaucuu

SEQ ID NO: 2065142 - RNA, 13 nt, Homo sapiens
aaaaauugaacua

SEQ ID NO: 2065143 - RNA, 13 nt, Homo sapiens
cacuguugcaaag

SEQ ID NO: 2065144 - RNA, 11 nt, Homo sapiens
cuucaccacug

SEQ ID NO: 2065145 - RNA, 18 nt, Homo sapiens
ccuuuccuuuucuuuaaa

SEQ ID NO: 2065146 - RNA, 18 nt, Homo sapiens
aaguuaugcaugauguaa

SEQ ID NO: 2065147 - RNA, 22 nt, Homo sapiens
uggaaucauacugccuacuguu

SEQ ID NO: 2065148 - RNA, 22 nt, Homo sapiens
aguccaagguuuaaagagucua

SEQ ID NO: 2065149 - RNA, 19 nt, Homo sapiens
ucagcagguuccagugccu

SEQ ID NO: 2065150 - RNA, 20 nt, Homo sapiens
ggacauuccaauuugcacuu

SEQ ID NO: 2065151 - RNA, 14 nt, Homo sapiens
gugaggacaaggua

SEQ ID NO: 2065152 - RNA, 21 nt, Homo sapiens
auguauacgcacgcacccaca

SEQ ID NO: 2065153 - RNA, 16 nt, Homo sapiens
gccaagcccucaauaa

SEQ ID NO: 2065154 - RNA, 23 nt, Homo sapiens
gagugguuuccaauguguucaau

SEQ ID NO: 2065155 - RNA, 22 nt, Homo sapiens
ugaaauaugaaacucaucugua

SEQ ID NO: 2065156 - RNA, 19 nt, Homo sapiens
cucuagguaaccaguuuaa

SEQ ID NO: 2065157 - RNA, 19 nt, Homo sapiens
auucuuuuuuuuuugucua

SEQ ID NO: 2065158 - RNA, 21 nt, Homo sapiens
agugcacugcauuccugugcc

SEQ ID NO: 2065159 - RNA, 13 nt, Homo sapiens
uccucccuguucc

SEQ ID NO: 2065160 - RNA, 21 nt, Homo sapiens
uaaugcgccaauaaaccaaug

SEQ ID NO: 2065161 - RNA, 22 nt, Homo sapiens
cuggggagaagguggacagauu

SEQ ID NO: 2065162 - RNA, 16 nt, Homo sapiens
ucugccucaccgcuuc

SEQ ID NO: 2065163 - RNA, 20 nt, Homo sapiens
cggaagcuggugaaagcucg

SEQ ID NO: 2065164 - RNA, 12 nt, Homo sapiens
caccugaagggu

SEQ ID NO: 2065165 - RNA, 16 nt, Homo sapiens
ccaucagcccaucuca

SEQ ID NO: 2065166 - RNA, 16 nt, Homo sapiens
aucugaccaucuguga

SEQ ID NO: 2065167 - RNA, 17 nt, Homo sapiens
cagugacagucagggaa

SEQ ID NO: 2065168 - RNA, 23 nt, Homo sapiens
gcuuuaaauuaaacucuacuuca

SEQ ID NO: 2065169 - RNA, 21 nt, Homo sapiens
aaaauacggacguacuuugug

SEQ ID NO: 2065170 - RNA, 13 nt, Homo sapiens
aaccugugauuca

SEQ ID NO: 2065171 - RNA, 20 nt, Homo sapiens
acuucuuuauacucucuucc

SEQ ID NO: 2065172 - RNA, 17 nt, Homo sapiens
ccagucuuaccaaacaa

SEQ ID NO: 2065173 - RNA, 22 nt, Homo sapiens
ugggaauugcaugccaucucca

SEQ ID NO: 2065174 - RNA, 21 nt, Homo sapiens
uaaaagauguuuaugauguaa

SEQ ID NO: 2065175 - RNA, 14 nt, Homo sapiens
accucuaccaaaaa

SEQ ID NO: 2065176 - RNA, 19 nt, Homo sapiens
aaauauauauagugcuaua

SEQ ID NO: 2065177 - RNA, 18 nt, Homo sapiens
cuauauuuucccuuauua

SEQ ID NO: 2065178 - RNA, 14 nt, Homo sapiens
gcuccuccacgccu

SEQ ID NO: 2065179 - RNA, 15 nt, Homo sapiens
gugggcugugccaag

SEQ ID NO: 2065180 - RNA, 15 nt, Homo sapiens
ucugugacauacaua

SEQ ID NO: 2065181 - RNA, 20 nt, Homo sapiens
gcagucuuggcucacuacag

SEQ ID NO: 2065182 - RNA, 22 nt, Homo sapiens
ugugaaagaugcacaacacucc

SEQ ID NO: 2065183 - RNA, 20 nt, Homo sapiens
uuguacagugucugugccau

SEQ ID NO: 2065184 - RNA, 23 nt, Homo sapiens
acaauguauuuuaauaacauauc

SEQ ID NO: 2065185 - RNA, 20 nt, Homo sapiens
gugaaagcuauaucaaucuc

SEQ ID NO: 2065186 - RNA, 15 nt, Homo sapiens
gucauucuacacuga

SEQ ID NO: 2065187 - RNA, 17 nt, Homo sapiens
ugcaucuauauguguau

SEQ ID NO: 2065188 - RNA, 14 nt, Homo sapiens
uucugaacuuggaa

SEQ ID NO: 2065189 - RNA, 16 nt, Homo sapiens
accaccaacacacagg

SEQ ID NO: 2065190 - RNA, 19 nt, Homo sapiens
uauaugccucauacacaua

SEQ ID NO: 2065191 - RNA, 11 nt, Homo sapiens
cauguucugug

SEQ ID NO: 2065192 - RNA, 17 nt, Homo sapiens
ccucucaacacccaguu

SEQ ID NO: 2065193 - RNA, 18 nt, Homo sapiens
ucugagccaaauucuaaa

SEQ ID NO: 2065194 - RNA, 10 nt, Homo sapiens
uucacauaaa

SEQ ID NO: 2065195 - RNA, 20 nt, Homo sapiens
ccauggauccuggauugaga

SEQ ID NO: 2065196 - RNA, 17 nt, Homo sapiens
cugaggugcacugggag

SEQ ID NO: 2065197 - RNA, 18 nt, Homo sapiens
gugaaauggccacuacuu

SEQ ID NO: 2065198 - RNA, 15 nt, Homo sapiens
agcacuaaagcagug

SEQ ID NO: 2065199 - RNA, 16 nt, Homo sapiens
ucuuucaucucugcuu

SEQ ID NO: 2065200 - RNA, 19 nt, Homo sapiens
ugccugucuguuacacugg

SEQ ID NO: 2065201 - RNA, 19 nt, Homo sapiens
agagaaaaggaaaagccaa

SEQ ID NO: 2065202 - RNA, 15 nt, Homo sapiens
caguguggucaagca

SEQ ID NO: 2065203 - RNA, 13 nt, Homo sapiens
ugggcaauaugaa

SEQ ID NO: 2065204 - RNA, 11 nt, Homo sapiens
ugacccagugg

SEQ ID NO: 2065205 - RNA, 20 nt, Homo sapiens
ccaugaaacauuacaggaaa

SEQ ID NO: 2065206 - RNA, 16 nt, Homo sapiens
auuagugcuagucuca

SEQ ID NO: 2065207 - RNA, 14 nt, Homo sapiens
aacacuaaucacaa

SEQ ID NO: 2065208 - RNA, 12 nt, Homo sapiens
uuggaaaugggg

SEQ ID NO: 2065209 - RNA, 11 nt, Homo sapiens
aguguguaaaa

SEQ ID NO: 2065210 - RNA, 23 nt, Homo sapiens
ucugcuccaaaggaaauccaaaa

SEQ ID NO: 2065211 - RNA, 12 nt, Homo sapiens
uaauuaccaugc

SEQ ID NO: 2065212 - RNA, 16 nt, Homo sapiens
gaaaaauaaacauucu

SEQ ID NO: 2065213 - RNA, 15 nt, Homo sapiens
cugcgauaacugaga

SEQ ID NO: 2065214 - RNA, 13 nt, Homo sapiens
gggaaagaaggga

SEQ ID NO: 2065215 - RNA, 19 nt, Homo sapiens
aggcaguauuuuguguccu

SEQ ID NO: 2065216 - RNA, 17 nt, Homo sapiens
ggagccccagugccaag

SEQ ID NO: 2065217 - RNA, 16 nt, Homo sapiens
ccauauuuaacaugua

SEQ ID NO: 2065218 - RNA, 16 nt, Homo sapiens
gaauaaauucuaccuc

SEQ ID NO: 2065219 - RNA, 15 nt, Homo sapiens
cacaucaagcgauga

SEQ ID NO: 2065220 - RNA, 12 nt, Homo sapiens
accaaaugcaau

SEQ ID NO: 2065221 - RNA, 12 nt, Homo sapiens
acaaaaugcacu

SEQ ID NO: 2065222 - RNA, 16 nt, Homo sapiens
auuagggacacuuuca

SEQ ID NO: 2065223 - RNA, 14 nt, Homo sapiens
guaacaguuugaua

SEQ ID NO: 2065224 - RNA, 19 nt, Homo sapiens
uugaaguaggacuuuccua

SEQ ID NO: 2065225 - RNA, 16 nt, Homo sapiens
ccuucauucagccuug

SEQ ID NO: 2065226 - RNA, 22 nt, Homo sapiens
aauauuuuuauauuuccuuuau

SEQ ID NO: 2065227 - RNA, 17 nt, Homo sapiens
gagucugccucuguuca

SEQ ID NO: 2065228 - RNA, 18 nt, Homo sapiens
cuacagaaagcacaaaga

SEQ ID NO: 2065229 - RNA, 18 nt, Homo sapiens
uaagaguaaaaauaugug

SEQ ID NO: 2065230 - RNA, 20 nt, Homo sapiens
aggcuaauuuuucaacuugg

SEQ ID NO: 2065231 - RNA, 23 nt, Homo sapiens
uggcucuggugugaaguuugcuu

SEQ ID NO: 2065232 - RNA, 17 nt, Homo sapiens
caccaucggcaggcagu

SEQ ID NO: 2065233 - RNA, 23 nt, Homo sapiens
gaauauauauuauauauaaucua

SEQ ID NO: 2065234 - RNA, 17 nt, Homo sapiens
aacuuuaagaaagguaa

SEQ ID NO: 2065235 - RNA, 21 nt, Homo sapiens
ggugcagggauguggguucca

SEQ ID NO: 2065236 - RNA, 19 nt, Homo sapiens
uggcagauguggauuugaa

SEQ ID NO: 2065237 - RNA, 24 nt, Homo sapiens
gguggucugaauauuaaagcucuu

SEQ ID NO: 2065238 - RNA, 14 nt, Homo sapiens
gaagcuggugaaag

SEQ ID NO: 2065239 - RNA, 17 nt, Homo sapiens
acccccaccaccauaca

SEQ ID NO: 2065240 - RNA, 16 nt, Homo sapiens
uaacauuauacacaaa

SEQ ID NO: 2065241 - RNA, 20 nt, Homo sapiens
caggcugcuggagugcagug

SEQ ID NO: 2065242 - RNA, 23 nt, Homo sapiens
cuaggaccucauaucuuccucau

SEQ ID NO: 2065243 - RNA, 16 nt, Homo sapiens
gcagcugggccggcca

SEQ ID NO: 2065244 - RNA, 22 nt, Homo sapiens
aauuagcauuuuucaaaugauc

SEQ ID NO: 2065245 - RNA, 20 nt, Homo sapiens
aauggcgcgaucucagcuca

SEQ ID NO: 2065246 - RNA, 18 nt, Homo sapiens
ugaguuuaaucuuuucag

SEQ ID NO: 2065247 - RNA, 15 nt, Homo sapiens
uggaaguaagucugc

SEQ ID NO: 2065248 - RNA, 17 nt, Homo sapiens
augaagaccaaagacca

SEQ ID NO: 2065249 - RNA, 21 nt, Homo sapiens
cauauugaucuuuuuaucaug

SEQ ID NO: 2065250 - RNA, 21 nt, Homo sapiens
aagccuuaauuugcacagugu

SEQ ID NO: 2065251 - RNA, 16 nt, Homo sapiens
uaacauacucauuuaa

SEQ ID NO: 2065252 - RNA, 18 nt, Homo sapiens
auauucaauaaagcugcu

SEQ ID NO: 2065253 - RNA, 14 nt, Homo sapiens
cuuuuccacuuuaa

SEQ ID NO: 2065254 - RNA, 14 nt, Homo sapiens
caucuuuuauagau

SEQ ID NO: 2065255 - RNA, 18 nt, Homo sapiens
ccaaggccuccugugacu

SEQ ID NO: 2065256 - RNA, 16 nt, Homo sapiens
caaacccaacucuaau

SEQ ID NO: 2065257 - RNA, 11 nt, Homo sapiens
cugcugugauc

SEQ ID NO: 2065258 - RNA, 18 nt, Homo sapiens
gcuauagaaugagugcag

SEQ ID NO: 2065259 - RNA, 21 nt, Homo sapiens
gcagcucacggaacuggagaa

SEQ ID NO: 2065260 - RNA, 11 nt, Homo sapiens
ggccuucucac

SEQ ID NO: 2065261 - RNA, 13 nt, Homo sapiens
uggaaaaugucac

SEQ ID NO: 2065262 - RNA, 16 nt, Homo sapiens
acuuuaccugaaacaa

SEQ ID NO: 2065263 - RNA, 20 nt, Homo sapiens
uuuuuaaaugggagcaacau

SEQ ID NO: 2065264 - RNA, 15 nt, Homo sapiens
aggaagacaauguga

SEQ ID NO: 2065265 - RNA, 18 nt, Homo sapiens
uaagcaacuugcuucuaa

SEQ ID NO: 2065266 - RNA, 15 nt, Homo sapiens
acuuuaaaacuguau

SEQ ID NO: 2065267 - RNA, 14 nt, Homo sapiens
acaaacucacucag

SEQ ID NO: 2065268 - RNA, 19 nt, Homo sapiens
ucacccaggcuagagugca

SEQ ID NO: 2065269 - RNA, 18 nt, Homo sapiens
auaaaacucugcauguag

SEQ ID NO: 2065270 - RNA, 18 nt, Homo sapiens
ugaccagcuagacuccca

SEQ ID NO: 2065271 - RNA, 23 nt, Homo sapiens
guguaccucccccugccuuccaa

SEQ ID NO: 2065272 - RNA, 14 nt, Homo sapiens
aaaguaauuuuguc

SEQ ID NO: 2065273 - RNA, 20 nt, Homo sapiens
ugagcaaugguaacugcacc

SEQ ID NO: 2065274 - RNA, 16 nt, Homo sapiens
uuuuauuaaacuuaaa

SEQ ID NO: 2065275 - RNA, 21 nt, Homo sapiens
gaaccuugucccagccaguga

SEQ ID NO: 2065276 - RNA, 23 nt, Homo sapiens
cacagccagaaccccgagcccua

SEQ ID NO: 2065277 - RNA, 15 nt, Homo sapiens
uauuaagauuuccaa

SEQ ID NO: 2065278 - RNA, 14 nt, Homo sapiens
auacuguaugcagu

SEQ ID NO: 2065279 - RNA, 23 nt, Homo sapiens
aacuaccucgcaucauugcagau

SEQ ID NO: 2065280 - RNA, 20 nt, Homo sapiens
caacauagugagacacuguc

SEQ ID NO: 2065281 - RNA, 14 nt, Homo sapiens
cuuugucuguccag

SEQ ID NO: 2065282 - RNA, 17 nt, Homo sapiens
uugaauucuuuugccaa

SEQ ID NO: 2065283 - RNA, 15 nt, Homo sapiens
cggcuccuucaagcu

SEQ ID NO: 2065284 - RNA, 16 nt, Homo sapiens
uuccuggugacuccug

SEQ ID NO: 2065285 - RNA, 19 nt, Homo sapiens
uuggaauggcugagcaaau

SEQ ID NO: 2065286 - RNA, 17 nt, Homo sapiens
gcgggccaaggacugcc

SEQ ID NO: 2065287 - RNA, 18 nt, Homo sapiens
uagccucuggacuggaaa

SEQ ID NO: 2065288 - RNA, 21 nt, Homo sapiens
aaaaugaagaaaagagucuau

SEQ ID NO: 2065289 - RNA, 14 nt, Homo sapiens
uccuucucugaaag

SEQ ID NO: 2065290 - RNA, 16 nt, Homo sapiens
acugcaacuucugccu

SEQ ID NO: 2065291 - RNA, 15 nt, Homo sapiens
auauguagcaaaaug

SEQ ID NO: 2065292 - RNA, 22 nt, Homo sapiens
caaaauauuauguuaacaugua

SEQ ID NO: 2065293 - RNA, 17 nt, Homo sapiens
agagaaguugacaugga

SEQ ID NO: 2065294 - RNA, 19 nt, Homo sapiens
aaucaaauuccagaaugau

SEQ ID NO: 2065295 - RNA, 20 nt, Homo sapiens
agaaugaugaguccagaacc

SEQ ID NO: 2065296 - RNA, 15 nt, Homo sapiens
auuaacuuauacugu

SEQ ID NO: 2065297 - RNA, 15 nt, Homo sapiens
ucauugaauccucau

SEQ ID NO: 2065298 - RNA, 15 nt, Homo sapiens
ugaauacacaacucc

SEQ ID NO: 2065299 - RNA, 16 nt, Homo sapiens
auccaguuugcaauua

SEQ ID NO: 2065300 - RNA, 14 nt, Homo sapiens
cucuuccacauucc

SEQ ID NO: 2065301 - RNA, 16 nt, Homo sapiens
agcccauagccagcug

SEQ ID NO: 2065302 - RNA, 14 nt, Homo sapiens
cuucuagugcuuuu

SEQ ID NO: 2065303 - RNA, 21 nt, Homo sapiens
cuuccaucaaaccuuugccaa

SEQ ID NO: 2065304 - RNA, 17 nt, Homo sapiens
uucagcugccagugucc

SEQ ID NO: 2065305 - RNA, 15 nt, Homo sapiens
acacaaaagccaaaa

SEQ ID NO: 2065306 - RNA, 16 nt, Homo sapiens
guaaaugccacaaaga

SEQ ID NO: 2065307 - RNA, 17 nt, Homo sapiens
acgaggagcaugcagcg

SEQ ID NO: 2065308 - RNA, 20 nt, Homo sapiens
ucuggaaagaaaaccauucu

SEQ ID NO: 2065309 - RNA, 15 nt, Homo sapiens
agaaagugauccaua

SEQ ID NO: 2065310 - RNA, 16 nt, Homo sapiens
uccugugauccuuuga

SEQ ID NO: 2065311 - RNA, 16 nt, Homo sapiens
ucauggcaucauugca

SEQ ID NO: 2065312 - RNA, 19 nt, Homo sapiens
gacgugugagggaggacag

SEQ ID NO: 2065313 - RNA, 22 nt, Homo sapiens
augagagagguguguaaaggag

SEQ ID NO: 2065314 - RNA, 17 nt, Homo sapiens
acaacauguauaauauu

SEQ ID NO: 2065315 - RNA, 23 nt, Homo sapiens
gauucucuuuaaaaaagacugaa

SEQ ID NO: 2065316 - RNA, 13 nt, Homo sapiens
agacggggugaag

SEQ ID NO: 2065317 - RNA, 18 nt, Homo sapiens
acaagcacuaaacaaaga

SEQ ID NO: 2065318 - RNA, 14 nt, Homo sapiens
uuuaaaaaggguaa

SEQ ID NO: 2065319 - RNA, 15 nt, Homo sapiens
ggagugaacauuucu

SEQ ID NO: 2065320 - RNA, 14 nt, Homo sapiens
guaauuauacuuau

SEQ ID NO: 2065321 - RNA, 17 nt, Homo sapiens
auccaaggaaacaugca

SEQ ID NO: 2065322 - RNA, 20 nt, Homo sapiens
aucaaacauaaugaugagua

SEQ ID NO: 2065323 - RNA, 23 nt, Homo sapiens
uaugauaacuauuuacauauaau

SEQ ID NO: 2065324 - RNA, 12 nt, Homo sapiens
aaaauacaugua

SEQ ID NO: 2065325 - RNA, 12 nt, Homo sapiens
aaauuacauguu

SEQ ID NO: 2065326 - RNA, 19 nt, Homo sapiens
ugcgcgcaugugcgcacac

SEQ ID NO: 2065327 - RNA, 19 nt, Homo sapiens
acuucuucaccucuuccac

SEQ ID NO: 2065328 - RNA, 16 nt, Homo sapiens
uugcuguucugcugaa

SEQ ID NO: 2065329 - RNA, 16 nt, Homo sapiens
uaaaaauacaaaaaau

SEQ ID NO: 2065330 - RNA, 12 nt, Homo sapiens
cuugaaugccau

SEQ ID NO: 2065331 - RNA, 20 nt, Homo sapiens
aaaguuuuauuugaaugaac

SEQ ID NO: 2065332 - RNA, 23 nt, Homo sapiens
gaacacacaccaguuuacaggaa

SEQ ID NO: 2065333 - RNA, 14 nt, Homo sapiens
agggugcaguccag

SEQ ID NO: 2065334 - RNA, 13 nt, Homo sapiens
gucagacuggaua

SEQ ID NO: 2065335 - RNA, 13 nt, Homo sapiens
gaaaucacuguga

SEQ ID NO: 2065336 - RNA, 11 nt, Homo sapiens
aggcuuucaug

SEQ ID NO: 2065337 - RNA, 14 nt, Homo sapiens
agcugaagaacuug

SEQ ID NO: 2065338 - RNA, 17 nt, Homo sapiens
uuugaacagggcaguuu

SEQ ID NO: 2065339 - RNA, 19 nt, Homo sapiens
ugggcuugugguggcugcu

SEQ ID NO: 2065340 - RNA, 15 nt, Homo sapiens
ugcagaccugucacc

SEQ ID NO: 2065341 - RNA, 15 nt, Homo sapiens
uaauuuucacucugg

SEQ ID NO: 2065342 - RNA, 13 nt, Homo sapiens
caaaguguacaaa

SEQ ID NO: 2065343 - RNA, 15 nt, Homo sapiens
ggcaggucugagaua

SEQ ID NO: 2065344 - RNA, 20 nt, Homo sapiens
uuuuaagaaaguaauuuaau

SEQ ID NO: 2065345 - RNA, 23 nt, Homo sapiens
aguuuuauuuuuucgugcacucu

SEQ ID NO: 2065346 - RNA, 19 nt, Homo sapiens
augcaauuuggguuuuaga

SEQ ID NO: 2065347 - RNA, 16 nt, Homo sapiens
auuauaaacaaccuag

SEQ ID NO: 2065348 - RNA, 16 nt, Homo sapiens
cgagugcucauuucag

SEQ ID NO: 2065349 - RNA, 23 nt, Homo sapiens
aaugugauccugccuugcuguga

SEQ ID NO: 2065350 - RNA, 17 nt, Homo sapiens
uccuucaguucugcuug

SEQ ID NO: 2065351 - RNA, 14 nt, Homo sapiens
ucuaguaugucuug

SEQ ID NO: 2065352 - RNA, 17 nt, Homo sapiens
accagaagcauuucacc

SEQ ID NO: 2065353 - RNA, 16 nt, Homo sapiens
uuaucuagagaauaca

SEQ ID NO: 2065354 - RNA, 12 nt, Homo sapiens
ccucagcacugu

SEQ ID NO: 2065355 - RNA, 17 nt, Homo sapiens
agcauaguucugcaaua

SEQ ID NO: 2065356 - RNA, 20 nt, Homo sapiens
uccacgcaauggaacauuau

SEQ ID NO: 2065357 - RNA, 17 nt, Homo sapiens
cuuaacagaugcaaugu

SEQ ID NO: 2065358 - RNA, 21 nt, Homo sapiens
agugaaaagucucccuuucca

SEQ ID NO: 2065359 - RNA, 22 nt, Homo sapiens
aagccacauggugacuuuugaa

SEQ ID NO: 2065360 - RNA, 16 nt, Homo sapiens
cugcucuauacugugg

SEQ ID NO: 2065361 - RNA, 16 nt, Homo sapiens
acuaucucacugcugu

SEQ ID NO: 2065362 - RNA, 15 nt, Homo sapiens
ucucauaucagggau

SEQ ID NO: 2065363 - RNA, 22 nt, Homo sapiens
agugauugaaccagcucaucuc

SEQ ID NO: 2065364 - RNA, 19 nt, Homo sapiens
auguauuuuagacuuccug

SEQ ID NO: 2065365 - RNA, 14 nt, Homo sapiens
ucucgguuugccaa

SEQ ID NO: 2065366 - RNA, 16 nt, Homo sapiens
gucccuuccaggccau

SEQ ID NO: 2065367 - RNA, 16 nt, Homo sapiens
cucuguccuagacucc

SEQ ID NO: 2065368 - RNA, 14 nt, Homo sapiens
uuuaaaauaucugu

SEQ ID NO: 2065369 - RNA, 23 nt, Homo sapiens
aauuaaucaaguaccuauauuga

SEQ ID NO: 2065370 - RNA, 21 nt, Homo sapiens
gcccaacuacuaucucagaga

SEQ ID NO: 2065371 - RNA, 18 nt, Homo sapiens
guaagcugauuaccugaa

SEQ ID NO: 2065372 - RNA, 16 nt, Homo sapiens
gcaaaugaaaaaguca

SEQ ID NO: 2065373 - RNA, 17 nt, Homo sapiens
uagcaaacugaauccag

SEQ ID NO: 2065374 - RNA, 18 nt, Homo sapiens
accaguguuaagugacau

SEQ ID NO: 2065375 - RNA, 23 nt, Homo sapiens
auauauuguauuuuuauuugaua

SEQ ID NO: 2065376 - RNA, 23 nt, Homo sapiens
ugagguuguggagaaaaagauau

SEQ ID NO: 2065377 - RNA, 18 nt, Homo sapiens
auuaccugucaucugggc

SEQ ID NO: 2065378 - RNA, 17 nt, Homo sapiens
uucugagaucuguugau

SEQ ID NO: 2065379 - RNA, 18 nt, Homo sapiens
gucuagaaaauaaugcaa

SEQ ID NO: 2065380 - RNA, 20 nt, Homo sapiens
ccugagcccuacucccugca

SEQ ID NO: 2065381 - RNA, 20 nt, Homo sapiens
cugaaauuuuuuuccuaagu

SEQ ID NO: 2065382 - RNA, 22 nt, Homo sapiens
gcccacucuguaauaguucagu

SEQ ID NO: 2065383 - RNA, 14 nt, Homo sapiens
guacgggaggguaa

SEQ ID NO: 2065384 - RNA, 22 nt, Homo sapiens
cucccaggcugcuggagugcag

SEQ ID NO: 2065385 - RNA, 13 nt, Homo sapiens
cugagaucaugag

SEQ ID NO: 2065386 - RNA, 15 nt, Homo sapiens
uuucauaguguucau

SEQ ID NO: 2065387 - RNA, 13 nt, Homo sapiens
uccucuucugccu

SEQ ID NO: 2065388 - RNA, 22 nt, Homo sapiens
ucugacacauaucauucuguga

SEQ ID NO: 2065389 - RNA, 19 nt, Homo sapiens
gauauaaaaggcaaauaca

SEQ ID NO: 2065390 - RNA, 12 nt, Homo sapiens
augaugaucugg

SEQ ID NO: 2065391 - RNA, 12 nt, Homo sapiens
acaaugauccag

SEQ ID NO: 2065392 - RNA, 17 nt, Homo sapiens
cgaagcugugaacucag

SEQ ID NO: 2065393 - RNA, 14 nt, Homo sapiens
uaauucagcacuga

SEQ ID NO: 2065394 - RNA, 18 nt, Homo sapiens
aagcacaagugcauggca

SEQ ID NO: 2065395 - RNA, 16 nt, Homo sapiens
uuaguccccacccaaa

SEQ ID NO: 2065396 - RNA, 19 nt, Homo sapiens
auugacgacaagugcugaa

SEQ ID NO: 2065397 - RNA, 18 nt, Homo sapiens
acuuaauguucuuaugca

SEQ ID NO: 2065398 - RNA, 13 nt, Homo sapiens
ggacacuuguaug

SEQ ID NO: 2065399 - RNA, 12 nt, Homo sapiens
cauggaaauucc

SEQ ID NO: 2065400 - RNA, 15 nt, Homo sapiens
aaccuccaacacagu

SEQ ID NO: 2065401 - RNA, 19 nt, Homo sapiens
aacucuuccaccucugggg

SEQ ID NO: 2065402 - RNA, 11 nt, Homo sapiens
ggacucaaggg

SEQ ID NO: 2065403 - RNA, 21 nt, Homo sapiens
ugcagugucugcuggagacau

SEQ ID NO: 2065404 - RNA, 17 nt, Homo sapiens
ccauguaccaguguacu

SEQ ID NO: 2065405 - RNA, 21 nt, Homo sapiens
cauauucacuauagaaugaua

SEQ ID NO: 2065406 - RNA, 15 nt, Homo sapiens
auccccacuuuucag

SEQ ID NO: 2065407 - RNA, 17 nt, Homo sapiens
gauuccaaaaagcacau

SEQ ID NO: 2065408 - RNA, 20 nt, Homo sapiens
ucuguccagccagcuccugc

SEQ ID NO: 2065409 - RNA, 13 nt, Homo sapiens
cacuuggccaguu

SEQ ID NO: 2065410 - RNA, 19 nt, Homo sapiens
cggacgcgcgugacacaau

SEQ ID NO: 2065411 - RNA, 19 nt, Homo sapiens
uaaagaaggguguuuaaua

SEQ ID NO: 2065412 - RNA, 22 nt, Homo sapiens
cauuuuacugauuaacaaauaa

SEQ ID NO: 2065413 - RNA, 15 nt, Homo sapiens
cucugcaaaccaaca

SEQ ID NO: 2065414 - RNA, 22 nt, Homo sapiens
uaaaaaaacuggauauuucaau

SEQ ID NO: 2065415 - RNA, 16 nt, Homo sapiens
auaaacuuuccucuuc

SEQ ID NO: 2065416 - RNA, 15 nt, Homo sapiens
aacaguaacauagcu

SEQ ID NO: 2065417 - RNA, 12 nt, Homo sapiens
uugucaccaauc

SEQ ID NO: 2065418 - RNA, 23 nt, Homo sapiens
gccccaccaaugggccuccagag

SEQ ID NO: 2065419 - RNA, 14 nt, Homo sapiens
ugagaacacacuga

SEQ ID NO: 2065420 - RNA, 16 nt, Homo sapiens
cuucccuaaucuucca

SEQ ID NO: 2065421 - RNA, 12 nt, Homo sapiens
acuuccuugcau

SEQ ID NO: 2065422 - RNA, 23 nt, Homo sapiens
uaugucgagagcuggccaaagag

SEQ ID NO: 2065423 - RNA, 17 nt, Homo sapiens
caggccauggauggaaa

SEQ ID NO: 2065424 - RNA, 21 nt, Homo sapiens
aagaguucaagaccagccugg

SEQ ID NO: 2065425 - RNA, 17 nt, Homo sapiens
agguggugucacugucc

SEQ ID NO: 2065426 - RNA, 16 nt, Homo sapiens
ugcacugccagcaucu

SEQ ID NO: 2065427 - RNA, 23 nt, Homo sapiens
uucccaaagauccacccaaauau

SEQ ID NO: 2065428 - RNA, 18 nt, Homo sapiens
caaaagcccauucauucc

SEQ ID NO: 2065429 - RNA, 19 nt, Homo sapiens
gccugaaccgugugcuccu

SEQ ID NO: 2065430 - RNA, 22 nt, Homo sapiens
aaaggauuguuaauguuugcau

SEQ ID NO: 2065431 - RNA, 19 nt, Homo sapiens
acuacaggcgccugccaca

SEQ ID NO: 2065432 - RNA, 11 nt, Homo sapiens
gacaucugccu

SEQ ID NO: 2065433 - RNA, 19 nt, Homo sapiens
uugcaucuggguagcugua

SEQ ID NO: 2065434 - RNA, 24 nt, Homo sapiens
aauucuaacgcaaaaauagcucuu

SEQ ID NO: 2065435 - RNA, 22 nt, Homo sapiens
aaggaaauagacuuuguaugaa

SEQ ID NO: 2065436 - RNA, 23 nt, Homo sapiens
gcaauugagggacugagccagac

SEQ ID NO: 2065437 - RNA, 13 nt, Homo sapiens
ucuauauucucau

SEQ ID NO: 2065438 - RNA, 15 nt, Homo sapiens
gcagcaguaccaucu

SEQ ID NO: 2065439 - RNA, 14 nt, Homo sapiens
acguggcucagcca

SEQ ID NO: 2065440 - RNA, 14 nt, Homo sapiens
cuuucucugccugg

SEQ ID NO: 2065441 - RNA, 12 nt, Homo sapiens
uuauugccauua

SEQ ID NO: 2065442 - RNA, 13 nt, Homo sapiens
uuuaacaguaccu

SEQ ID NO: 2065443 - RNA, 14 nt, Homo sapiens
ucagccccacagga

SEQ ID NO: 2065444 - RNA, 18 nt, Homo sapiens
auuucacucucaaacuuc

SEQ ID NO: 2065445 - RNA, 18 nt, Homo sapiens
cuuuuugaggcaaaagaa

SEQ ID NO: 2065446 - RNA, 13 nt, Homo sapiens
aaacacuucucau

SEQ ID NO: 2065447 - RNA, 11 nt, Homo sapiens
aacucaauauu

SEQ ID NO: 2065448 - RNA, 17 nt, Homo sapiens
aucauugugacgugugu

SEQ ID NO: 2065449 - RNA, 18 nt, Homo sapiens
cucacugcagggcacugu

SEQ ID NO: 2065450 - RNA, 16 nt, Homo sapiens
auugcaguaaugauau

SEQ ID NO: 2065451 - RNA, 17 nt, Homo sapiens
aaucauugugugucuuc

SEQ ID NO: 2065452 - RNA, 15 nt, Homo sapiens
ugaaauuaauuugug

SEQ ID NO: 2065453 - RNA, 18 nt, Homo sapiens
uaaucuuguguagucuuc

SEQ ID NO: 2065454 - RNA, 17 nt, Homo sapiens
gaaacuaacacagccau

SEQ ID NO: 2065455 - RNA, 22 nt, Homo sapiens
cuucaagaucauguaccccaau

SEQ ID NO: 2065456 - RNA, 21 nt, Homo sapiens
guuucaugggccccuucaaac

SEQ ID NO: 2065457 - RNA, 22 nt, Homo sapiens
gaccuuucuagacaucauuguc

SEQ ID NO: 2065458 - RNA, 17 nt, Homo sapiens
uaacuuguuuccaaugu

SEQ ID NO: 2065459 - RNA, 12 nt, Homo sapiens
ugauaagcauuu

SEQ ID NO: 2065460 - RNA, 19 nt, Homo sapiens
guaauacaguacaguacuc

SEQ ID NO: 2065461 - RNA, 22 nt, Homo sapiens
aaauauuguauaaagcauuugu

SEQ ID NO: 2065462 - RNA, 23 nt, Homo sapiens
cugugugagcguguccacagagu

SEQ ID NO: 2065463 - RNA, 22 nt, Homo sapiens
caauucuaucuuuuguuuccuu

SEQ ID NO: 2065464 - RNA, 21 nt, Homo sapiens
aggccgcacaucucacuucag

SEQ ID NO: 2065465 - RNA, 22 nt, Homo sapiens
auaaaguacaagagcuuaacag

SEQ ID NO: 2065466 - RNA, 22 nt, Homo sapiens
uccccuaacccccaguccucac

SEQ ID NO: 2065467 - RNA, 18 nt, Homo sapiens
gcaauguguuucugguau

SEQ ID NO: 2065468 - RNA, 15 nt, Homo sapiens
gauccucucuccagg

SEQ ID NO: 2065469 - RNA, 16 nt, Homo sapiens
aaggucucacacuccu

SEQ ID NO: 2065470 - RNA, 16 nt, Homo sapiens
ugagguuuagaugugc

SEQ ID NO: 2065471 - RNA, 14 nt, Homo sapiens
ugggcgugcuaccu

SEQ ID NO: 2065472 - RNA, 18 nt, Homo sapiens
ugaacugacaaugaaggg

SEQ ID NO: 2065473 - RNA, 18 nt, Homo sapiens
gccacaucuuagcaagca

SEQ ID NO: 2065474 - RNA, 22 nt, Homo sapiens
uguccuccagggcgagcacuuu

SEQ ID NO: 2065475 - RNA, 18 nt, Homo sapiens
cucccucggaaugcuaag

SEQ ID NO: 2065476 - RNA, 21 nt, Homo sapiens
cugcccugggauguccacaga

SEQ ID NO: 2065477 - RNA, 21 nt, Homo sapiens
auuuaucuacaugcauuucaa

SEQ ID NO: 2065478 - RNA, 15 nt, Homo sapiens
uguauugguguugca

SEQ ID NO: 2065479 - RNA, 18 nt, Homo sapiens
aucuauauuucuggugaa

SEQ ID NO: 2065480 - RNA, 16 nt, Homo sapiens
auuaauaaauuuucca

SEQ ID NO: 2065481 - RNA, 23 nt, Homo sapiens
gcuucaaauaaaguccugacacu

SEQ ID NO: 2065482 - RNA, 22 nt, Homo sapiens
caguuugcuauuugcuuuagag

SEQ ID NO: 2065483 - RNA, 14 nt, Homo sapiens
gcugaguauggagc

SEQ ID NO: 2065484 - RNA, 14 nt, Homo sapiens
agugagauacaaag

SEQ ID NO: 2065485 - RNA, 19 nt, Homo sapiens
cuucucaaauuagcugcaa

SEQ ID NO: 2065486 - RNA, 23 nt, Homo sapiens
ggggagcugggguacagguuugg

SEQ ID NO: 2065487 - RNA, 17 nt, Homo sapiens
caucccaacagccaaga

SEQ ID NO: 2065488 - RNA, 17 nt, Homo sapiens
uaauuuacaagcacgau

SEQ ID NO: 2065489 - RNA, 18 nt, Homo sapiens
ggaccggacgcaugcagg

SEQ ID NO: 2065490 - RNA, 20 nt, Homo sapiens
uggggucucugcaucuucag

SEQ ID NO: 2065491 - RNA, 20 nt, Homo sapiens
ccuguaaucucagcacuuug

SEQ ID NO: 2065492 - RNA, 23 nt, Homo sapiens
caaacucaaugcuuuauuuguaa

SEQ ID NO: 2065493 - RNA, 19 nt, Homo sapiens
uuccaaaggcguauguauu

SEQ ID NO: 2065494 - RNA, 14 nt, Homo sapiens
ucccagugacuuag

SEQ ID NO: 2065495 - RNA, 18 nt, Homo sapiens
acaaguuuuaauccagaa

SEQ ID NO: 2065496 - RNA, 19 nt, Homo sapiens
auggaaaauaaacaucagu

SEQ ID NO: 2065497 - RNA, 15 nt, Homo sapiens
uuauccauguacuuu

SEQ ID NO: 2065498 - RNA, 18 nt, Homo sapiens
cggaguggacaccgcuca

SEQ ID NO: 2065499 - RNA, 15 nt, Homo sapiens
cuauuucuugaagaa

SEQ ID NO: 2065500 - RNA, 20 nt, Homo sapiens
cagcuucucuacagacucca

SEQ ID NO: 2065501 - RNA, 16 nt, Homo sapiens
acccaggaagacuuug

SEQ ID NO: 2065502 - RNA, 15 nt, Homo sapiens
gcgucccuguacaga

SEQ ID NO: 2065503 - RNA, 16 nt, Homo sapiens
gugugugcgcacacau

SEQ ID NO: 2065504 - RNA, 22 nt, Homo sapiens
auaacuaggaaauccauucaca

SEQ ID NO: 2065505 - RNA, 14 nt, Homo sapiens
aauuugaaauccaa

SEQ ID NO: 2065506 - RNA, 20 nt, Homo sapiens
cccuccaagccuggcaccca

SEQ ID NO: 2065507 - RNA, 16 nt, Homo sapiens
auccuaucucuccaac

SEQ ID NO: 2065508 - RNA, 15 nt, Homo sapiens
auaagaaagcacuau

SEQ ID NO: 2065509 - RNA, 17 nt, Homo sapiens
uauaaguguuugucaua

SEQ ID NO: 2065510 - RNA, 22 nt, Homo sapiens
ugucauguaaggcuuaacacag

SEQ ID NO: 2065511 - RNA, 15 nt, Homo sapiens
aggagaagcacagcu

SEQ ID NO: 2065512 - RNA, 15 nt, Homo sapiens
gugccccagcuagga

SEQ ID NO: 2065513 - RNA, 16 nt, Homo sapiens
acuuugaagugcagcu

SEQ ID NO: 2065514 - RNA, 15 nt, Homo sapiens
ugcugugugacucaa

SEQ ID NO: 2065515 - RNA, 13 nt, Homo sapiens
uaaaauauucacu

SEQ ID NO: 2065516 - RNA, 13 nt, Homo sapiens
gaacuuaugcaaa

SEQ ID NO: 2065517 - RNA, 16 nt, Homo sapiens
auuuucuucugagacu

SEQ ID NO: 2065518 - RNA, 14 nt, Homo sapiens
auccuugcaucacu

SEQ ID NO: 2065519 - RNA, 21 nt, Homo sapiens
ggaaagaaacuugcagcuuua

SEQ ID NO: 2065520 - RNA, 12 nt, Homo sapiens
agaagacugggc

SEQ ID NO: 2065521 - RNA, 15 nt, Homo sapiens
ucaaugcaguugucu

SEQ ID NO: 2065522 - RNA, 14 nt, Homo sapiens
gucaacaugcauau

SEQ ID NO: 2065523 - RNA, 15 nt, Homo sapiens
cugaugcaggauuug

SEQ ID NO: 2065524 - RNA, 15 nt, Homo sapiens
guaauuaaauacuau

SEQ ID NO: 2065525 - RNA, 21 nt, Homo sapiens
uugcuccuauacuauugaagu

SEQ ID NO: 2065526 - RNA, 13 nt, Homo sapiens
ucucugucucucu

SEQ ID NO: 2065527 - RNA, 18 nt, Homo sapiens
cuagauacuggaaaccua

SEQ ID NO: 2065528 - RNA, 17 nt, Homo sapiens
cugaaagaauaggauua

SEQ ID NO: 2065529 - RNA, 21 nt, Homo sapiens
aaggucugaacccuuccacca

SEQ ID NO: 2065530 - RNA, 20 nt, Homo sapiens
cacgcuccuauaggaccaag

SEQ ID NO: 2065531 - RNA, 17 nt, Homo sapiens
aucacagaccacaggaa

SEQ ID NO: 2065532 - RNA, 12 nt, Homo sapiens
aaguuacuuuau

SEQ ID NO: 2065533 - RNA, 16 nt, Homo sapiens
aacuuuggaacagggu

SEQ ID NO: 2065534 - RNA, 18 nt, Homo sapiens
uggaaucccacuaaugca

SEQ ID NO: 2065535 - RNA, 13 nt, Homo sapiens
auuuuaucauuaa

SEQ ID NO: 2065536 - RNA, 22 nt, Homo sapiens
aagaaauugugaaaaaugagcu

SEQ ID NO: 2065537 - RNA, 15 nt, Homo sapiens
agaacuauauuuucc

SEQ ID NO: 2065538 - RNA, 22 nt, Homo sapiens
auacaggagucugucucugcua

SEQ ID NO: 2065539 - RNA, 17 nt, Homo sapiens
gcacagaaauuuucaau

SEQ ID NO: 2065540 - RNA, 14 nt, Homo sapiens
aacauuuguuccug

SEQ ID NO: 2065541 - RNA, 22 nt, Homo sapiens
auaagggaaauuccuaacuuug

SEQ ID NO: 2065542 - RNA, 17 nt, Homo sapiens
agauauccaaaugauag

SEQ ID NO: 2065543 - RNA, 21 nt, Homo sapiens
acacugugauuuaucuuucaa

SEQ ID NO: 2065544 - RNA, 12 nt, Homo sapiens
aacauaaagccu

SEQ ID NO: 2065545 - RNA, 16 nt, Homo sapiens
gacagaaugugucuca

SEQ ID NO: 2065546 - RNA, 15 nt, Homo sapiens
uucccuuuucuuucc

SEQ ID NO: 2065547 - RNA, 17 nt, Homo sapiens
ugggguauaggucucau

SEQ ID NO: 2065548 - RNA, 18 nt, Homo sapiens
uccccaaagccacuggaa

SEQ ID NO: 2065549 - RNA, 13 nt, Homo sapiens
aaaaugcugcuuc

SEQ ID NO: 2065550 - RNA, 21 nt, Homo sapiens
ucaugucuuuuuacccuuuaa

SEQ ID NO: 2065551 - RNA, 13 nt, Homo sapiens
guuggaguauuua

SEQ ID NO: 2065552 - RNA, 14 nt, Homo sapiens
ucuaugaaacugca

SEQ ID NO: 2065553 - RNA, 15 nt, Homo sapiens
ccugcucacagggau

SEQ ID NO: 2065554 - RNA, 17 nt, Homo sapiens
gaaagcuggacugacca

SEQ ID NO: 2065555 - RNA, 14 nt, Homo sapiens
guggugacaccucc

SEQ ID NO: 2065556 - RNA, 22 nt, Homo sapiens
gccccaccucggcacacacugu

SEQ ID NO: 2065557 - RNA, 14 nt, Homo sapiens
cugauaaaccuaau

SEQ ID NO: 2065558 - RNA, 11 nt, Homo sapiens
ugagaguacac

SEQ ID NO: 2065559 - RNA, 19 nt, Homo sapiens
uccuugaagauuuaccacu

SEQ ID NO: 2065560 - RNA, 23 nt, Homo sapiens
uagaaugggaagggucauagaaa

SEQ ID NO: 2065561 - RNA, 17 nt, Homo sapiens
aaacuacugcaccauuu

SEQ ID NO: 2065562 - RNA, 12 nt, Homo sapiens
guguaugugacc

SEQ ID NO: 2065563 - RNA, 18 nt, Homo sapiens
aagagccgggaacagaga

SEQ ID NO: 2065564 - RNA, 18 nt, Homo sapiens
uagacuuuguaugaacuc

SEQ ID NO: 2065565 - RNA, 16 nt, Homo sapiens
caggugcuuguggaca

SEQ ID NO: 2065566 - RNA, 21 nt, Homo sapiens
gggccuguucucuuggcugca

SEQ ID NO: 2065567 - RNA, 18 nt, Homo sapiens
gggaagaggccagcguga

SEQ ID NO: 2065568 - RNA, 18 nt, Homo sapiens
aggcaugagucagucuga

SEQ ID NO: 2065569 - RNA, 18 nt, Homo sapiens
uuacacccuuucuugaca

SEQ ID NO: 2065570 - RNA, 14 nt, Homo sapiens
uguguuggguugaa

SEQ ID NO: 2065571 - RNA, 18 nt, Homo sapiens
gacugaauucugccuugg

SEQ ID NO: 2065572 - RNA, 13 nt, Homo sapiens
aaggguugagcug

SEQ ID NO: 2065573 - RNA, 19 nt, Homo sapiens
uuuucuguaaauaaccuau

SEQ ID NO: 2065574 - RNA, 19 nt, Homo sapiens
cucaagcccugcagucaca

SEQ ID NO: 2065575 - RNA, 17 nt, Homo sapiens
gcuucuagaguuuuaua

SEQ ID NO: 2065576 - RNA, 14 nt, Homo sapiens
gucacucacacugg

SEQ ID NO: 2065577 - RNA, 23 nt, Homo sapiens
ccaugagaguagagggcacuggg

SEQ ID NO: 2065578 - RNA, 14 nt, Homo sapiens
ugaaggcauaugca

SEQ ID NO: 2065579 - RNA, 22 nt, Homo sapiens
ccaaugcacaguugccacauuu

SEQ ID NO: 2065580 - RNA, 19 nt, Homo sapiens
gcaaagcaacgacuacuuu

SEQ ID NO: 2065581 - RNA, 16 nt, Homo sapiens
aagcuucuugcuccug

SEQ ID NO: 2065582 - RNA, 13 nt, Homo sapiens
uauauuaauauca

SEQ ID NO: 2065583 - RNA, 14 nt, Homo sapiens
acucauaaggcaua

SEQ ID NO: 2065584 - RNA, 13 nt, Homo sapiens
cauuuugagcuga

SEQ ID NO: 2065585 - RNA, 13 nt, Homo sapiens
ccugaugagauuu

SEQ ID NO: 2065586 - RNA, 19 nt, Homo sapiens
gguuuucuguguuuagcua

SEQ ID NO: 2065587 - RNA, 19 nt, Homo sapiens
gccugaaccuuccaucucg

SEQ ID NO: 2065588 - RNA, 15 nt, Homo sapiens
cagccuguuuagcca

SEQ ID NO: 2065589 - RNA, 19 nt, Homo sapiens
uguugguuacaugaaugaa

SEQ ID NO: 2065590 - RNA, 14 nt, Homo sapiens
acacaggaaaccaa

SEQ ID NO: 2065591 - RNA, 12 nt, Homo sapiens
aggaucucagcc

SEQ ID NO: 2065592 - RNA, 18 nt, Homo sapiens
uucucauuuuauugcuag

SEQ ID NO: 2065593 - RNA, 18 nt, Homo sapiens
cucuuccuggaaugcauu

SEQ ID NO: 2065594 - RNA, 12 nt, Homo sapiens
agccuggaugcc

SEQ ID NO: 2065595 - RNA, 19 nt, Homo sapiens
ucccuuuuuauuugcagaa

SEQ ID NO: 2065596 - RNA, 22 nt, Homo sapiens
acuggaaaaguguuccuugcuc

SEQ ID NO: 2065597 - RNA, 15 nt, Homo sapiens
cuccuccgcccagcu

SEQ ID NO: 2065598 - RNA, 23 nt, Homo sapiens
acuggaaaugcaugacuucccuc

SEQ ID NO: 2065599 - RNA, 22 nt, Homo sapiens
uaaggucuauaaacaugaaggg

SEQ ID NO: 2065600 - RNA, 18 nt, Homo sapiens
uggagugcaguggcguga

SEQ ID NO: 2065601 - RNA, 20 nt, Homo sapiens
cugcuuaaauuucuccagug

SEQ ID NO: 2065602 - RNA, 16 nt, Homo sapiens
aucuauauucauuuca

SEQ ID NO: 2065603 - RNA, 19 nt, Homo sapiens
uuauucugcaagcaauaca

SEQ ID NO: 2065604 - RNA, 17 nt, Homo sapiens
gacgggagagggcagug

SEQ ID NO: 2065605 - RNA, 21 nt, Homo sapiens
cucccucccagcgcucuggga

SEQ ID NO: 2065606 - RNA, 14 nt, Homo sapiens
uucuuauugacaau

SEQ ID NO: 2065607 - RNA, 16 nt, Homo sapiens
cauuuccuuccuucca

SEQ ID NO: 2065608 - RNA, 23 nt, Homo sapiens
auugugguuuauugaaugugauu

SEQ ID NO: 2065609 - RNA, 15 nt, Homo sapiens
acaauuuaaugcacu

SEQ ID NO: 2065610 - RNA, 21 nt, Homo sapiens
aauucacauaacuucucugag

SEQ ID NO: 2065611 - RNA, 17 nt, Homo sapiens
ucccucugugucugcuc

SEQ ID NO: 2065612 - RNA, 23 nt, Homo sapiens
ucuccaaaccacuuuuugcagcu

SEQ ID NO: 2065613 - RNA, 14 nt, Homo sapiens
ugacccaaaugcaa

SEQ ID NO: 2065614 - RNA, 17 nt, Homo sapiens
auaccugggauacugug

SEQ ID NO: 2065615 - RNA, 21 nt, Homo sapiens
acagucucuauuugauuugca

SEQ ID NO: 2065616 - RNA, 23 nt, Homo sapiens
uaccaaaguguuuggucauuuua

SEQ ID NO: 2065617 - RNA, 23 nt, Homo sapiens
gaacucagcacauucgggaccaa

SEQ ID NO: 2065618 - RNA, 22 nt, Homo sapiens
gaaggcaucagaaacaucugau

SEQ ID NO: 2065619 - RNA, 14 nt, Homo sapiens
acagugagcugaug

SEQ ID NO: 2065620 - RNA, 22 nt, Homo sapiens
aacagaugucuucuugcaauau

SEQ ID NO: 2065621 - RNA, 16 nt, Homo sapiens
cucugcaguugaucuc

SEQ ID NO: 2065622 - RNA, 21 nt, Homo sapiens
caauuauauuuuuguaaauag

SEQ ID NO: 2065623 - RNA, 14 nt, Homo sapiens
aauaaauacauucg

SEQ ID NO: 2065624 - RNA, 23 nt, Homo sapiens
ugucagcuucccagccaugccca

SEQ ID NO: 2065625 - RNA, 21 nt, Homo sapiens
cuucaguucugcuugcuccca

SEQ ID NO: 2065626 - RNA, 19 nt, Homo sapiens
auaaauguaaauauguaca

SEQ ID NO: 2065627 - RNA, 16 nt, Homo sapiens
agggaaugagcuucca

SEQ ID NO: 2065628 - RNA, 22 nt, Homo sapiens
cccuuuguuuaaaaugucauuu

SEQ ID NO: 2065629 - RNA, 20 nt, Homo sapiens
ccuguaccccagcacuugug

SEQ ID NO: 2065630 - RNA, 20 nt, Homo sapiens
uacaggcgugauccaccaca

SEQ ID NO: 2065631 - RNA, 20 nt, Homo sapiens
uuugggggauucaaaugcau

SEQ ID NO: 2065632 - RNA, 15 nt, Homo sapiens
gcccaguacauuuaa

SEQ ID NO: 2065633 - RNA, 15 nt, Homo sapiens
ugcuagaacucccuu

SEQ ID NO: 2065634 - RNA, 17 nt, Homo sapiens
gguccgggucgcaggac

SEQ ID NO: 2065635 - RNA, 16 nt, Homo sapiens
caaacagccacacugu

SEQ ID NO: 2065636 - RNA, 20 nt, Homo sapiens
uggaacaugcaaggcacuga

SEQ ID NO: 2065637 - RNA, 19 nt, Homo sapiens
uccagagagcuuaaauugu

SEQ ID NO: 2065638 - RNA, 14 nt, Homo sapiens
acuaacccaaugcc

SEQ ID NO: 2065639 - RNA, 17 nt, Homo sapiens
cuguuuaugaacggaaa

SEQ ID NO: 2065640 - RNA, 18 nt, Homo sapiens
ccuagguguuuuguucac

SEQ ID NO: 2065641 - RNA, 18 nt, Homo sapiens
guccugcuggccugcucu

SEQ ID NO: 2065642 - RNA, 15 nt, Homo sapiens
uccagaacaaagcac

SEQ ID NO: 2065643 - RNA, 22 nt, Homo sapiens
aaagcugauggccuuguuucaa

SEQ ID NO: 2065644 - RNA, 21 nt, Homo sapiens
aacugcccaaagcagcacuua

SEQ ID NO: 2065645 - RNA, 22 nt, Homo sapiens
uagcaauaacauacaugagaua

SEQ ID NO: 2065646 - RNA, 20 nt, Homo sapiens
ggugcaggggaagaccaaag

SEQ ID NO: 2065647 - RNA, 19 nt, Homo sapiens
agccugugcccauaugguc

SEQ ID NO: 2065648 - RNA, 19 nt, Homo sapiens
gauuaggucguuuuccaaa

SEQ ID NO: 2065649 - RNA, 20 nt, Homo sapiens
aguggcgugaucucagcuca

SEQ ID NO: 2065650 - RNA, 20 nt, Homo sapiens
auaauucuggagauacuggu

SEQ ID NO: 2065651 - RNA, 19 nt, Homo sapiens
ucucccagaccgccaguga

SEQ ID NO: 2065652 - RNA, 15 nt, Homo sapiens
aggaaccagcaggau

SEQ ID NO: 2065653 - RNA, 16 nt, Homo sapiens
cucccaacacugucac

SEQ ID NO: 2065654 - RNA, 15 nt, Homo sapiens
uccacaugugccagu

SEQ ID NO: 2065655 - RNA, 16 nt, Homo sapiens
agcaauccagccucau

SEQ ID NO: 2065656 - RNA, 17 nt, Homo sapiens
agaggugccacacugaa

SEQ ID NO: 2065657 - RNA, 17 nt, Homo sapiens
cgcagcccgaagcccag

SEQ ID NO: 2065658 - RNA, 23 nt, Homo sapiens
agaaguauuccuguugcugucuu

SEQ ID NO: 2065659 - RNA, 17 nt, Homo sapiens
cucagaaggccccagag

SEQ ID NO: 2065660 - RNA, 17 nt, Homo sapiens
uuguaaaauuauuucau

SEQ ID NO: 2065661 - RNA, 18 nt, Homo sapiens
uguacgucugacaggcaa

SEQ ID NO: 2065662 - RNA, 19 nt, Homo sapiens
cugaauaacuugaagaaca

SEQ ID NO: 2065663 - RNA, 18 nt, Homo sapiens
gcaaaaguaaucacuuaa

SEQ ID NO: 2065664 - RNA, 17 nt, Homo sapiens
uuuuuggauggcuuaag

SEQ ID NO: 2065665 - RNA, 14 nt, Homo sapiens
auaucauacuucca

SEQ ID NO: 2065666 - RNA, 21 nt, Homo sapiens
aaaugcaccucauuccaguca

SEQ ID NO: 2065667 - RNA, 22 nt, Homo sapiens
gcagccuugggggggcugccuu

SEQ ID NO: 2065668 - RNA, 18 nt, Homo sapiens
cuagaacaacgccuguca

SEQ ID NO: 2065669 - RNA, 12 nt, Homo sapiens
cagucaccugcc

SEQ ID NO: 2065670 - RNA, 16 nt, Homo sapiens
aggaagccacugccag

SEQ ID NO: 2065671 - RNA, 21 nt, Homo sapiens
cugggcaacagaugaagaccc

SEQ ID NO: 2065672 - RNA, 21 nt, Homo sapiens
cucugcaaugggcacugggau

SEQ ID NO: 2065673 - RNA, 18 nt, Homo sapiens
ugacaccacuuagauuua

SEQ ID NO: 2065674 - RNA, 17 nt, Homo sapiens
aagaaauaacacuguga

SEQ ID NO: 2065675 - RNA, 14 nt, Homo sapiens
ugugagauguuuaa

SEQ ID NO: 2065676 - RNA, 14 nt, Homo sapiens
augccugcaaucug

SEQ ID NO: 2065677 - RNA, 23 nt, Homo sapiens
ucacaaaguagaggaauccaugu

SEQ ID NO: 2065678 - RNA, 14 nt, Homo sapiens
gaaguggacuggag

SEQ ID NO: 2065679 - RNA, 21 nt, Homo sapiens
cuguaagguggacuuccagcu

SEQ ID NO: 2065680 - RNA, 15 nt, Homo sapiens
ucugaacugguagaa

SEQ ID NO: 2065681 - RNA, 17 nt, Homo sapiens
ccaggagcaacagccua

SEQ ID NO: 2065682 - RNA, 18 nt, Homo sapiens
aauuaacagcagaaucuc

SEQ ID NO: 2065683 - RNA, 16 nt, Homo sapiens
auauucucuccacuuu

SEQ ID NO: 2065684 - RNA, 20 nt, Homo sapiens
cuucucugcaaugcuucugu

SEQ ID NO: 2065685 - RNA, 19 nt, Homo sapiens
cuuuugccaguauuaugca

SEQ ID NO: 2065686 - RNA, 19 nt, Homo sapiens
auccaaaugcugugcaaac

SEQ ID NO: 2065687 - RNA, 16 nt, Homo sapiens
agaaaucuggucuugu

SEQ ID NO: 2065688 - RNA, 13 nt, Homo sapiens
cacuucuuaacag

SEQ ID NO: 2065689 - RNA, 18 nt, Homo sapiens
uauacuguggcuaugcaa

SEQ ID NO: 2065690 - RNA, 16 nt, Homo sapiens
guuacuguggucacuu

SEQ ID NO: 2065691 - RNA, 16 nt, Homo sapiens
auacuugaacacugug

SEQ ID NO: 2065692 - RNA, 11 nt, Homo sapiens
cuuugcaguga

SEQ ID NO: 2065693 - RNA, 11 nt, Homo sapiens
ugaugcagcuu

SEQ ID NO: 2065694 - RNA, 18 nt, Homo sapiens
caugugcacaagugugca

SEQ ID NO: 2065695 - RNA, 16 nt, Homo sapiens
cgggaagaaggggaca

SEQ ID NO: 2065696 - RNA, 21 nt, Homo sapiens
uccaucagagaaggugcaggu

SEQ ID NO: 2065697 - RNA, 20 nt, Homo sapiens
uaguacuuauguugcacaau

SEQ ID NO: 2065698 - RNA, 21 nt, Homo sapiens
cucugacgcuugugacagugc

SEQ ID NO: 2065699 - RNA, 17 nt, Homo sapiens
gaugcuggggacacagc

SEQ ID NO: 2065700 - RNA, 19 nt, Homo sapiens
ccagcagcuggaaucugaa

SEQ ID NO: 2065701 - RNA, 13 nt, Homo sapiens
gauuauaaaguuu

SEQ ID NO: 2065702 - RNA, 19 nt, Homo sapiens
aguucugagcaccguguca

SEQ ID NO: 2065703 - RNA, 22 nt, Homo sapiens
cuccuugcaggcagaaggcagu

SEQ ID NO: 2065704 - RNA, 19 nt, Homo sapiens
uaucagugcuccaguauau

SEQ ID NO: 2065705 - RNA, 14 nt, Homo sapiens
uugggacauugcaa

SEQ ID NO: 2065706 - RNA, 22 nt, Homo sapiens
gcuacaaaugaaaacaauccag

SEQ ID NO: 2065707 - RNA, 16 nt, Homo sapiens
ccagccgcaaauccau

SEQ ID NO: 2065708 - RNA, 19 nt, Homo sapiens
cugcacaacugacuuccaa

SEQ ID NO: 2065709 - RNA, 10 nt, Homo sapiens
gaaacauuua

SEQ ID NO: 2065710 - RNA, 22 nt, Homo sapiens
ugacauuuauauuuguguauuu

SEQ ID NO: 2065711 - RNA, 18 nt, Homo sapiens
ucuaggacugaauuauga

SEQ ID NO: 2065712 - RNA, 16 nt, Homo sapiens
auuuuuuuaaauuuca

SEQ ID NO: 2065713 - RNA, 19 nt, Homo sapiens
acccaccccguagauuccc

SEQ ID NO: 2065714 - RNA, 15 nt, Homo sapiens
auuuaugucccugac

SEQ ID NO: 2065715 - RNA, 18 nt, Homo sapiens
caggaaggaaugcaaaac

SEQ ID NO: 2065716 - RNA, 17 nt, Homo sapiens
ugaaggaaggacuauga

SEQ ID NO: 2065717 - RNA, 16 nt, Homo sapiens
uuaaacaaaaaaccca

SEQ ID NO: 2065718 - RNA, 19 nt, Homo sapiens
ugucuuccacuuugcauau

SEQ ID NO: 2065719 - RNA, 12 nt, Homo sapiens
augcacuuccug

SEQ ID NO: 2065720 - RNA, 18 nt, Homo sapiens
gcagaaaaucuaccaaga

SEQ ID NO: 2065721 - RNA, 16 nt, Homo sapiens
aggcgccuaaagucau

SEQ ID NO: 2065722 - RNA, 23 nt, Homo sapiens
aggggcaggccugggacccagcu

SEQ ID NO: 2065723 - RNA, 17 nt, Homo sapiens
auauuagcgacaacaga

SEQ ID NO: 2065724 - RNA, 16 nt, Homo sapiens
auuuauguaacaaagu

SEQ ID NO: 2065725 - RNA, 16 nt, Homo sapiens
cucacauccauucuuc

SEQ ID NO: 2065726 - RNA, 17 nt, Homo sapiens
uuucagaaaauucccau

SEQ ID NO: 2065727 - RNA, 21 nt, Homo sapiens
uuguucguauuuagaauggga

SEQ ID NO: 2065728 - RNA, 14 nt, Homo sapiens
auuaucaagcuuuu

SEQ ID NO: 2065729 - RNA, 20 nt, Homo sapiens
aguggcugaguagcucugcc

SEQ ID NO: 2065730 - RNA, 13 nt, Homo sapiens
aaguguccuggac

SEQ ID NO: 2065731 - RNA, 20 nt, Homo sapiens
acaacauguauguggauaca

SEQ ID NO: 2065732 - RNA, 20 nt, Homo sapiens
augcaaacaaaauccaagau

SEQ ID NO: 2065733 - RNA, 16 nt, Homo sapiens
gacagucacugccacu

SEQ ID NO: 2065734 - RNA, 16 nt, Homo sapiens
acucugcacuacuccu

SEQ ID NO: 2065735 - RNA, 23 nt, Homo sapiens
agcucugggagcccugccgaggu

SEQ ID NO: 2065736 - RNA, 20 nt, Homo sapiens
ugcuggugaauaacuaugcc

SEQ ID NO: 2065737 - RNA, 14 nt, Homo sapiens
aagcugcuuuagaa

SEQ ID NO: 2065738 - RNA, 13 nt, Homo sapiens
ugaguauuuagga

SEQ ID NO: 2065739 - RNA, 16 nt, Homo sapiens
uagggaucaaagaaga

SEQ ID NO: 2065740 - RNA, 19 nt, Homo sapiens
cucuaagccacucuuccaa

SEQ ID NO: 2065741 - RNA, 16 nt, Homo sapiens
cucaucugggggagug

SEQ ID NO: 2065742 - RNA, 17 nt, Homo sapiens
gaggcaggggcucugcu

SEQ ID NO: 2065743 - RNA, 19 nt, Homo sapiens
uguggaacugcuauuuucc

SEQ ID NO: 2065744 - RNA, 12 nt, Homo sapiens
uacauacauaua

SEQ ID NO: 2065745 - RNA, 22 nt, Homo sapiens
ucuggucuucgcagccuagaua

SEQ ID NO: 2065746 - RNA, 20 nt, Homo sapiens
ugcuaggacuccaaccucag

SEQ ID NO: 2065747 - RNA, 19 nt, Homo sapiens
gauguugauaauaguaaug

SEQ ID NO: 2065748 - RNA, 22 nt, Homo sapiens
ccagccaccccgcagucacuuu

SEQ ID NO: 2065749 - RNA, 18 nt, Homo sapiens
uugaccucaaccugugau

SEQ ID NO: 2065750 - RNA, 14 nt, Homo sapiens
guguauuucauuua

SEQ ID NO: 2065751 - RNA, 13 nt, Homo sapiens
caagacagugaag

SEQ ID NO: 2065752 - RNA, 17 nt, Homo sapiens
agccugaaaauuccaau

SEQ ID NO: 2065753 - RNA, 11 nt, Homo sapiens
ugcccuggcag

SEQ ID NO: 2065754 - RNA, 17 nt, Homo sapiens
cccucccccagcuccuu

SEQ ID NO: 2065755 - RNA, 19 nt, Homo sapiens
auuuuuucgugcacucugc

SEQ ID NO: 2065756 - RNA, 19 nt, Homo sapiens
ugcccagccuauacuuccc

SEQ ID NO: 2065757 - RNA, 18 nt, Homo sapiens
cugaacgucuccuagcca

SEQ ID NO: 2065758 - RNA, 13 nt, Homo sapiens
uugaaguuuacaa

SEQ ID NO: 2065759 - RNA, 20 nt, Homo sapiens
ugcaagaaggauaccaaaua

SEQ ID NO: 2065760 - RNA, 12 nt, Homo sapiens
ucaaacuuuuau

SEQ ID NO: 2065761 - RNA, 14 nt, Homo sapiens
acauccuuggacug

SEQ ID NO: 2065762 - RNA, 11 nt, Homo sapiens
guauacuguac

SEQ ID NO: 2065763 - RNA, 19 nt, Homo sapiens
gaaugcagagaugugcccc

SEQ ID NO: 2065764 - RNA, 21 nt, Homo sapiens
aucugcucuuaggugcuucuu

SEQ ID NO: 2065765 - RNA, 16 nt, Homo sapiens
ugauuuuauaugcuau

SEQ ID NO: 2065766 - RNA, 18 nt, Homo sapiens
uuuuccuggcucaucucu

SEQ ID NO: 2065767 - RNA, 21 nt, Homo sapiens
uucucuguauuccgauacaaa

SEQ ID NO: 2065768 - RNA, 13 nt, Homo sapiens
uaauuguacaaua

SEQ ID NO: 2065769 - RNA, 21 nt, Homo sapiens
uaauguuagaauugauuucca

SEQ ID NO: 2065770 - RNA, 16 nt, Homo sapiens
uagacuuuaugcaaua

SEQ ID NO: 2065771 - RNA, 16 nt, Homo sapiens
ucacaagaaaacuaua

SEQ ID NO: 2065772 - RNA, 16 nt, Homo sapiens
gucuugaugacugcug

SEQ ID NO: 2065773 - RNA, 12 nt, Homo sapiens
cuuugcugugaa

SEQ ID NO: 2065774 - RNA, 12 nt, Homo sapiens
uggaaaaaucac

SEQ ID NO: 2065775 - RNA, 16 nt, Homo sapiens
agguuauggggagaag

SEQ ID NO: 2065776 - RNA, 15 nt, Homo sapiens
agcuguuagggacau

SEQ ID NO: 2065777 - RNA, 17 nt, Homo sapiens
gaucacgccacuggacu

SEQ ID NO: 2065778 - RNA, 17 nt, Homo sapiens
ugcccuucuuccauucc

SEQ ID NO: 2065779 - RNA, 22 nt, Homo sapiens
acaagacuguaaauuccaaaga

SEQ ID NO: 2065780 - RNA, 11 nt, Homo sapiens
ucucucuccag

SEQ ID NO: 2065781 - RNA, 13 nt, Homo sapiens
cugcucucugagu

SEQ ID NO: 2065782 - RNA, 19 nt, Homo sapiens
acauuuuucccuauuuucc

SEQ ID NO: 2065783 - RNA, 19 nt, Homo sapiens
ucacauccauucuucccuu

SEQ ID NO: 2065784 - RNA, 17 nt, Homo sapiens
guauuuaaggagaacca

SEQ ID NO: 2065785 - RNA, 19 nt, Homo sapiens
ugauuuaccucuuaccugu

SEQ ID NO: 2065786 - RNA, 18 nt, Homo sapiens
uacuauuucaauacuuac

SEQ ID NO: 2065787 - RNA, 23 nt, Homo sapiens
augauuccagccaucaccuuaga

SEQ ID NO: 2065788 - RNA, 14 nt, Homo sapiens
uuuauauuaauuuc

SEQ ID NO: 2065789 - RNA, 21 nt, Homo sapiens
gcugagugccugauacugccu

SEQ ID NO: 2065790 - RNA, 16 nt, Homo sapiens
ccauagaaaacuugac

SEQ ID NO: 2065791 - RNA, 18 nt, Homo sapiens
gcuuacuagcacuuugag

SEQ ID NO: 2065792 - RNA, 19 nt, Homo sapiens
aaagccauuauuaugaugu

SEQ ID NO: 2065793 - RNA, 20 nt, Homo sapiens
auuaucacuuuaaagcccuu

SEQ ID NO: 2065794 - RNA, 23 nt, Homo sapiens
ucuacucuugagagcucaggcag

SEQ ID NO: 2065795 - RNA, 17 nt, Homo sapiens
cugccaagacagugaag

SEQ ID NO: 2065796 - RNA, 19 nt, Homo sapiens
uguucucuauuagacuuua

SEQ ID NO: 2065797 - RNA, 17 nt, Homo sapiens
cugauguuaaaauucca

SEQ ID NO: 2065798 - RNA, 16 nt, Homo sapiens
ugagaaccauuuacuu

SEQ ID NO: 2065799 - RNA, 16 nt, Homo sapiens
uaaauguuaugacuau

SEQ ID NO: 2065800 - RNA, 13 nt, Homo sapiens
cggggugcuccug

SEQ ID NO: 2065801 - RNA, 16 nt, Homo sapiens
cauggagacagguaga

SEQ ID NO: 2065802 - RNA, 19 nt, Homo sapiens
caucuagcgcaauugaagg

SEQ ID NO: 2065803 - RNA, 17 nt, Homo sapiens
uaccugaaagacaguau

SEQ ID NO: 2065804 - RNA, 21 nt, Homo sapiens
acaacacugauacuagauucc

SEQ ID NO: 2065805 - RNA, 20 nt, Homo sapiens
cuucuaguuucucuuagaaa

SEQ ID NO: 2065806 - RNA, 13 nt, Homo sapiens
agaaagugccuga

SEQ ID NO: 2065807 - RNA, 14 nt, Homo sapiens
aacgugcauugugc

SEQ ID NO: 2065808 - RNA, 22 nt, Homo sapiens
uugaggaggggcaccugccacc

SEQ ID NO: 2065809 - RNA, 22 nt, Homo sapiens
ucacaaggggaagaaacaugcu

SEQ ID NO: 2065810 - RNA, 20 nt, Homo sapiens
cugauuaaaaauaccuucua

SEQ ID NO: 2065811 - RNA, 14 nt, Homo sapiens
gcccucgugcacac

SEQ ID NO: 2065812 - RNA, 14 nt, Homo sapiens
ucucuucaccacug

SEQ ID NO: 2065813 - RNA, 22 nt, Homo sapiens
accugggcugugcugcuuuuga

SEQ ID NO: 2065814 - RNA, 15 nt, Homo sapiens
aucugcugucuuuau

SEQ ID NO: 2065815 - RNA, 19 nt, Homo sapiens
cugaauaaaaagcuguucu

SEQ ID NO: 2065816 - RNA, 22 nt, Homo sapiens
cucaagacuuauggaacaggga

SEQ ID NO: 2065817 - RNA, 19 nt, Homo sapiens
cugucuccccacucagugg

SEQ ID NO: 2065818 - RNA, 19 nt, Homo sapiens
cuaaauugaauacacaaau

SEQ ID NO: 2065819 - RNA, 11 nt, Homo sapiens
aaugagccauu

SEQ ID NO: 2065820 - RNA, 21 nt, Homo sapiens
auccuuuugcucuguccuccc

SEQ ID NO: 2065821 - RNA, 13 nt, Homo sapiens
uuaaauacacucu

SEQ ID NO: 2065822 - RNA, 13 nt, Homo sapiens
gggugauggauga

SEQ ID NO: 2065823 - RNA, 16 nt, Homo sapiens
caguggcgcaugccug

SEQ ID NO: 2065824 - RNA, 15 nt, Homo sapiens
auacaucaaggaguu

SEQ ID NO: 2065825 - RNA, 17 nt, Homo sapiens
uagaugcugacuguacu

SEQ ID NO: 2065826 - RNA, 17 nt, Homo sapiens
uacauucuaaaucacuu

SEQ ID NO: 2065827 - RNA, 18 nt, Homo sapiens
agcugacagcacuacaaa

SEQ ID NO: 2065828 - RNA, 21 nt, Homo sapiens
ggccaccuguagccaucugca

SEQ ID NO: 2065829 - RNA, 14 nt, Homo sapiens
uaagaacaaugcca

SEQ ID NO: 2065830 - RNA, 16 nt, Homo sapiens
auucuaagucacagga

SEQ ID NO: 2065831 - RNA, 16 nt, Homo sapiens
uccuuccacuaacuca

SEQ ID NO: 2065832 - RNA, 12 nt, Homo sapiens
uucaccaaagau

SEQ ID NO: 2065833 - RNA, 18 nt, Homo sapiens
gcauguuacugccaaaac

SEQ ID NO: 2065834 - RNA, 17 nt, Homo sapiens
gaaugcaaaccauagca

SEQ ID NO: 2065835 - RNA, 22 nt, Homo sapiens
cccuuuuaguuugaucagacag

SEQ ID NO: 2065836 - RNA, 14 nt, Homo sapiens
cucaaagcuuccau

SEQ ID NO: 2065837 - RNA, 19 nt, Homo sapiens
uacaauuguaaaacugagg

SEQ ID NO: 2065838 - RNA, 14 nt, Homo sapiens
uguagcuacagaga

SEQ ID NO: 2065839 - RNA, 19 nt, Homo sapiens
caguugccgucuaggauug

SEQ ID NO: 2065840 - RNA, 17 nt, Homo sapiens
gcacccaccacucucag

SEQ ID NO: 2065841 - RNA, 14 nt, Homo sapiens
gcaggacacugcag

SEQ ID NO: 2065842 - RNA, 15 nt, Homo sapiens
guuaugggcacuggu

SEQ ID NO: 2065843 - RNA, 21 nt, Homo sapiens
uccagacagugggaaggggug

SEQ ID NO: 2065844 - RNA, 11 nt, Homo sapiens
cacauaugcaa

SEQ ID NO: 2065845 - RNA, 21 nt, Homo sapiens
cuggaaauugaaauaaagaua

SEQ ID NO: 2065846 - RNA, 15 nt, Homo sapiens
gggcccuccuuccua

SEQ ID NO: 2065847 - RNA, 16 nt, Homo sapiens
ggggaauguuuuggcu

SEQ ID NO: 2065848 - RNA, 14 nt, Homo sapiens
cucaccacacccag

SEQ ID NO: 2065849 - RNA, 17 nt, Homo sapiens
gcuauauccauguacug

SEQ ID NO: 2065850 - RNA, 16 nt, Homo sapiens
auaaaaaccuuccaaa

SEQ ID NO: 2065851 - RNA, 18 nt, Homo sapiens
ugggaauaacauggugag

SEQ ID NO: 2065852 - RNA, 14 nt, Homo sapiens
gcugccaucuccag

SEQ ID NO: 2065853 - RNA, 22 nt, Homo sapiens
aggaaaggccccaaucuugccc

SEQ ID NO: 2065854 - RNA, 14 nt, Homo sapiens
uaaaugcuguagaa

SEQ ID NO: 2065855 - RNA, 19 nt, Homo sapiens
uauaagucugggcacugga

SEQ ID NO: 2065856 - RNA, 20 nt, Homo sapiens
auauguauacaugugccaug

SEQ ID NO: 2065857 - RNA, 15 nt, Homo sapiens
cgugucuggugggga

SEQ ID NO: 2065858 - RNA, 19 nt, Homo sapiens
ugaaguuugugggggccaa

SEQ ID NO: 2065859 - RNA, 18 nt, Homo sapiens
caaacaauuaacugagca

SEQ ID NO: 2065860 - RNA, 17 nt, Homo sapiens
uaucugguuaaugacau

SEQ ID NO: 2065861 - RNA, 14 nt, Homo sapiens
uauacagauuuucu

SEQ ID NO: 2065862 - RNA, 22 nt, Homo sapiens
gcaacauuauuuguaauagcca

SEQ ID NO: 2065863 - RNA, 15 nt, Homo sapiens
uuaauaacagguuua

SEQ ID NO: 2065864 - RNA, 15 nt, Homo sapiens
ccuccgccauucuca

SEQ ID NO: 2065865 - RNA, 16 nt, Homo sapiens
cccuuauuuucaagaa

SEQ ID NO: 2065866 - RNA, 15 nt, Homo sapiens
gauccagccaugccu

SEQ ID NO: 2065867 - RNA, 15 nt, Homo sapiens
cucacaagaagacca

SEQ ID NO: 2065868 - RNA, 13 nt, Homo sapiens
cuugauuguguag

SEQ ID NO: 2065869 - RNA, 13 nt, Homo sapiens
acccuacagcaga

SEQ ID NO: 2065870 - RNA, 13 nt, Homo sapiens
acccaacagcagu

SEQ ID NO: 2065871 - RNA, 20 nt, Homo sapiens
ccuuaaauuaaacaauuuau

SEQ ID NO: 2065872 - RNA, 22 nt, Homo sapiens
ucucccagcuuucagggacagc

SEQ ID NO: 2065873 - RNA, 20 nt, Homo sapiens
cucuaauauguaaaauuaca

SEQ ID NO: 2065874 - RNA, 22 nt, Homo sapiens
gaauauaagguuaagauaucau

SEQ ID NO: 2065875 - RNA, 14 nt, Homo sapiens
augaauacagcagc

SEQ ID NO: 2065876 - RNA, 14 nt, Homo sapiens
uuguacacugcugu

SEQ ID NO: 2065877 - RNA, 14 nt, Homo sapiens
aucuacaacuccaa

SEQ ID NO: 2065878 - RNA, 21 nt, Homo sapiens
aaacuaugugcuaucacaugu

SEQ ID NO: 2065879 - RNA, 18 nt, Homo sapiens
accaccagaucagguaua

SEQ ID NO: 2065880 - RNA, 14 nt, Homo sapiens
agaccugggagcag

SEQ ID NO: 2065881 - RNA, 21 nt, Homo sapiens
ucagaaacaaagcauuugacu

SEQ ID NO: 2065882 - RNA, 17 nt, Homo sapiens
gcauggagagccucuua

SEQ ID NO: 2065883 - RNA, 23 nt, Homo sapiens
aaggaagucauccagucuauuca

SEQ ID NO: 2065884 - RNA, 19 nt, Homo sapiens
auugcugguuuuaguugca

SEQ ID NO: 2065885 - RNA, 17 nt, Homo sapiens
caccauguuacccagcc

SEQ ID NO: 2065886 - RNA, 22 nt, Homo sapiens
cuggcauuccuucugaccacag

SEQ ID NO: 2065887 - RNA, 14 nt, Homo sapiens
guaccucucuuaua

SEQ ID NO: 2065888 - RNA, 22 nt, Homo sapiens
agagagagugagagcacaaaga

SEQ ID NO: 2065889 - RNA, 16 nt, Homo sapiens
agauuuauaaauuuga

SEQ ID NO: 2065890 - RNA, 23 nt, Homo sapiens
guacuugcucaauaaaggucaua

SEQ ID NO: 2065891 - RNA, 13 nt, Homo sapiens
cacuccaggugug

SEQ ID NO: 2065892 - RNA, 13 nt, Homo sapiens
cuggacucucagu

SEQ ID NO: 2065893 - RNA, 17 nt, Homo sapiens
caugagucagauacaca

SEQ ID NO: 2065894 - RNA, 15 nt, Homo sapiens
ggaauaugaccauuu

SEQ ID NO: 2065895 - RNA, 14 nt, Homo sapiens
acaaccaaaugugc

SEQ ID NO: 2065896 - RNA, 19 nt, Homo sapiens
acagcaggagggacaauga

SEQ ID NO: 2065897 - RNA, 14 nt, Homo sapiens
cugggauguagaac

SEQ ID NO: 2065898 - RNA, 16 nt, Homo sapiens
agucggccccaucucu

SEQ ID NO: 2065899 - RNA, 18 nt, Homo sapiens
uggaguguaguggcauga

SEQ ID NO: 2065900 - RNA, 16 nt, Homo sapiens
cuuccuuaaaugacuu

SEQ ID NO: 2065901 - RNA, 14 nt, Homo sapiens
uguacagauaugca

SEQ ID NO: 2065902 - RNA, 14 nt, Homo sapiens
agaggagaaaaaga

SEQ ID NO: 2065903 - RNA, 13 nt, Homo sapiens
auauaaggcauuc

SEQ ID NO: 2065904 - RNA, 14 nt, Homo sapiens
gaauucaaaaguga

SEQ ID NO: 2065905 - RNA, 21 nt, Homo sapiens
ucuccaagacaauaauuacau

SEQ ID NO: 2065906 - RNA, 17 nt, Homo sapiens
ccuugguuuuaccugua

SEQ ID NO: 2065907 - RNA, 18 nt, Homo sapiens
ucuuccagaagugugauu

SEQ ID NO: 2065908 - RNA, 12 nt, Homo sapiens
accacuuccagg

SEQ ID NO: 2065909 - RNA, 20 nt, Homo sapiens
aacuugaauuucuggaagau

SEQ ID NO: 2065910 - RNA, 17 nt, Homo sapiens
caggccgcagcuccauu

SEQ ID NO: 2065911 - RNA, 14 nt, Homo sapiens
ccuacugaugucag

SEQ ID NO: 2065912 - RNA, 19 nt, Homo sapiens
auguguugcagcugucacc

SEQ ID NO: 2065913 - RNA, 18 nt, Homo sapiens
gucccacaucccugggcc

SEQ ID NO: 2065914 - RNA, 18 nt, Homo sapiens
ucaauaauuuguggugau

SEQ ID NO: 2065915 - RNA, 21 nt, Homo sapiens
ccggccacucuguuugcucac

SEQ ID NO: 2065916 - RNA, 13 nt, Homo sapiens
uuaauaaugugua

SEQ ID NO: 2065917 - RNA, 20 nt, Homo sapiens
auuuaguaaaaauaaaucaa

SEQ ID NO: 2065918 - RNA, 22 nt, Homo sapiens
caucguggugugucaaugccac

SEQ ID NO: 2065919 - RNA, 20 nt, Homo sapiens
ucaaucaauggugcaaaaaa

SEQ ID NO: 2065920 - RNA, 20 nt, Homo sapiens
ccaaauucaaagaaaacccu

SEQ ID NO: 2065921 - RNA, 15 nt, Homo sapiens
guaaggaacuggaac

SEQ ID NO: 2065922 - RNA, 16 nt, Homo sapiens
auccgcccaccucagc

SEQ ID NO: 2065923 - RNA, 21 nt, Homo sapiens
uaauggugaaaacgucuuccu

SEQ ID NO: 2065924 - RNA, 19 nt, Homo sapiens
guaggauauuggcauuugu

SEQ ID NO: 2065925 - RNA, 17 nt, Homo sapiens
gcaccucuugugcugag

SEQ ID NO: 2065926 - RNA, 19 nt, Homo sapiens
cauuccucaugaauguaaa

SEQ ID NO: 2065927 - RNA, 14 nt, Homo sapiens
cuguaaccaccucu

SEQ ID NO: 2065928 - RNA, 22 nt, Homo sapiens
ccuaaucuauggucgggagaca

SEQ ID NO: 2065929 - RNA, 19 nt, Homo sapiens
gcagucaacaguucaaaga

SEQ ID NO: 2065930 - RNA, 18 nt, Homo sapiens
ugugccuuugaccaucuc

SEQ ID NO: 2065931 - RNA, 19 nt, Homo sapiens
acuuccccaagaucugcca

SEQ ID NO: 2065932 - RNA, 18 nt, Homo sapiens
aucuuuauugcaugagaa

SEQ ID NO: 2065933 - RNA, 18 nt, Homo sapiens
agaagaaagaacuaucuu

SEQ ID NO: 2065934 - RNA, 13 nt, Homo sapiens
aaauccuuccaaa

SEQ ID NO: 2065935 - RNA, 11 nt, Homo sapiens
uaaacuaaagu

SEQ ID NO: 2065936 - RNA, 15 nt, Homo sapiens
cugccagacccccug

SEQ ID NO: 2065937 - RNA, 17 nt, Homo sapiens
uuccauuuccguuccag

SEQ ID NO: 2065938 - RNA, 20 nt, Homo sapiens
gcucugagacccuuuucuca

SEQ ID NO: 2065939 - RNA, 12 nt, Homo sapiens
caggauucauug

SEQ ID NO: 2065940 - RNA, 12 nt, Homo sapiens
cagaauucauua

SEQ ID NO: 2065941 - RNA, 16 nt, Homo sapiens
uuauagaaguagcaaa

SEQ ID NO: 2065942 - RNA, 17 nt, Homo sapiens
agugaaggcuguccuua

SEQ ID NO: 2065943 - RNA, 19 nt, Homo sapiens
gagacauugggaggggcuu

SEQ ID NO: 2065944 - RNA, 20 nt, Homo sapiens
ucccaucugaagaguggaaa

SEQ ID NO: 2065945 - RNA, 18 nt, Homo sapiens
auuuugagcaaaccacau

SEQ ID NO: 2065946 - RNA, 20 nt, Homo sapiens
cgcuuugauaauacuuccaa

SEQ ID NO: 2065947 - RNA, 21 nt, Homo sapiens
accagauuuuuacacauguau

SEQ ID NO: 2065948 - RNA, 15 nt, Homo sapiens
agccacacuuccuuu

SEQ ID NO: 2065949 - RNA, 22 nt, Homo sapiens
augacugcuugcccuaagcaga

SEQ ID NO: 2065950 - RNA, 16 nt, Homo sapiens
aggcugccugcuaugu

SEQ ID NO: 2065951 - RNA, 13 nt, Homo sapiens
gaccagggaccac

SEQ ID NO: 2065952 - RNA, 23 nt, Homo sapiens
cuaggggucuuguuaagugcagu

SEQ ID NO: 2065953 - RNA, 17 nt, Homo sapiens
accuccagacaccagug

SEQ ID NO: 2065954 - RNA, 20 nt, Homo sapiens
uccauccacacacagcagcu

SEQ ID NO: 2065955 - RNA, 20 nt, Homo sapiens
cuaaggacccaaauuucccu

SEQ ID NO: 2065956 - RNA, 15 nt, Homo sapiens
uaccgcccucggggc

SEQ ID NO: 2065957 - RNA, 17 nt, Homo sapiens
gagcaguggccaggcca

SEQ ID NO: 2065958 - RNA, 22 nt, Homo sapiens
cuggacaaaugaugccauggca

SEQ ID NO: 2065959 - RNA, 18 nt, Homo sapiens
ccucacugaaaauuacag

SEQ ID NO: 2065960 - RNA, 15 nt, Homo sapiens
auaaaauauucacuc

SEQ ID NO: 2065961 - RNA, 15 nt, Homo sapiens
ucaaaacaaccacuu

SEQ ID NO: 2065962 - RNA, 15 nt, Homo sapiens
gaugaggguggcaug

SEQ ID NO: 2065963 - RNA, 18 nt, Homo sapiens
uuucuuuuuuauacucaa

SEQ ID NO: 2065964 - RNA, 13 nt, Homo sapiens
gaaaugccagugu

SEQ ID NO: 2065965 - RNA, 16 nt, Homo sapiens
acauugagaguaagca

SEQ ID NO: 2065966 - RNA, 14 nt, Homo sapiens
acacagagugccug

SEQ ID NO: 2065967 - RNA, 16 nt, Homo sapiens
ucaguccaagucuucu

SEQ ID NO: 2065968 - RNA, 16 nt, Homo sapiens
guaaauagaugacaaa

SEQ ID NO: 2065969 - RNA, 22 nt, Homo sapiens
ggccaguugcccagagcacuuu

SEQ ID NO: 2065970 - RNA, 14 nt, Homo sapiens
gaagcaucugucuu

SEQ ID NO: 2065971 - RNA, 17 nt, Homo sapiens
caggacacauuuccacu

SEQ ID NO: 2065972 - RNA, 18 nt, Homo sapiens
caguggcugcugcccagg

SEQ ID NO: 2065973 - RNA, 19 nt, Homo sapiens
uauccuucuagaucauaca

SEQ ID NO: 2065974 - RNA, 23 nt, Homo sapiens
ugagcccaauguauuaugaucuc

SEQ ID NO: 2065975 - RNA, 21 nt, Homo sapiens
ugggagaccuguuggccugug

SEQ ID NO: 2065976 - RNA, 22 nt, Homo sapiens
ucccaaaauacuacacauccaa

SEQ ID NO: 2065977 - RNA, 16 nt, Homo sapiens
cauuauuuucugucag

SEQ ID NO: 2065978 - RNA, 17 nt, Homo sapiens
gaaaugugcaaccacug

SEQ ID NO: 2065979 - RNA, 16 nt, Homo sapiens
caagcucaguucaaug

SEQ ID NO: 2065980 - RNA, 23 nt, Homo sapiens
uaauuuacuguugcccauugcac

SEQ ID NO: 2065981 - RNA, 17 nt, Homo sapiens
cugaaauggaauuccca

SEQ ID NO: 2065982 - RNA, 17 nt, Homo sapiens
ggggcaagccugagugg

SEQ ID NO: 2065983 - RNA, 17 nt, Homo sapiens
ucccacucaccaggcac

SEQ ID NO: 2065984 - RNA, 21 nt, Homo sapiens
ccacagaaaggccacucagga

SEQ ID NO: 2065985 - RNA, 17 nt, Homo sapiens
ccugaaccaguccugcu

SEQ ID NO: 2065986 - RNA, 22 nt, Homo sapiens
uuucagugcugugucauuccaa

SEQ ID NO: 2065987 - RNA, 21 nt, Homo sapiens
uacuacuuucucaaaauggaa

SEQ ID NO: 2065988 - RNA, 16 nt, Homo sapiens
cuccuuuacaaaagaa

SEQ ID NO: 2065989 - RNA, 17 nt, Homo sapiens
auaggugguauggagcu

SEQ ID NO: 2065990 - RNA, 18 nt, Homo sapiens
gcaacuaggccuucagua

SEQ ID NO: 2065991 - RNA, 19 nt, Homo sapiens
gacagccacuuggccucac

SEQ ID NO: 2065992 - RNA, 13 nt, Homo sapiens
aaguucuuaucuc

SEQ ID NO: 2065993 - RNA, 16 nt, Homo sapiens
acagcagccacuuugc

SEQ ID NO: 2065994 - RNA, 15 nt, Homo sapiens
uaccuugaacucuua

SEQ ID NO: 2065995 - RNA, 22 nt, Homo sapiens
gcuggggaggugagagugcaga

SEQ ID NO: 2065996 - RNA, 16 nt, Homo sapiens
uauuuaaaacauuuca

SEQ ID NO: 2065997 - RNA, 22 nt, Homo sapiens
accuugcuuuugcuucuagagc

SEQ ID NO: 2065998 - RNA, 20 nt, Homo sapiens
uugaacugauucacaucuca

SEQ ID NO: 2065999 - RNA, 17 nt, Homo sapiens
ugggacacaaccacuaa

SEQ ID NO: 2066000 - RNA, 13 nt, Homo sapiens
aguuuuucccaag

SEQ ID NO: 2066001 - RNA, 22 nt, Homo sapiens
gaucaucccuuucucccaguga

SEQ ID NO: 2066002 - RNA, 21 nt, Homo sapiens
gugaagacagaaccacagggc

SEQ ID NO: 2066003 - RNA, 14 nt, Homo sapiens
gagaagacccagcu

SEQ ID NO: 2066004 - RNA, 23 nt, Homo sapiens
gguaguuuguuuuagaaccagcc

SEQ ID NO: 2066005 - RNA, 16 nt, Homo sapiens
agcacuuccagaacuu

SEQ ID NO: 2066006 - RNA, 14 nt, Homo sapiens
aaggcugucauuuc

SEQ ID NO: 2066007 - RNA, 23 nt, Homo sapiens
gaccaguggucucacauggugcu

SEQ ID NO: 2066008 - RNA, 24 nt, Homo sapiens
ucccugcacuaaagccagccugac

SEQ ID NO: 2066009 - RNA, 17 nt, Homo sapiens
aauauuugcaagacaua

SEQ ID NO: 2066010 - RNA, 16 nt, Homo sapiens
cagcuagacauugcaa

SEQ ID NO: 2066011 - RNA, 15 nt, Homo sapiens
uugauaucugaucaa

SEQ ID NO: 2066012 - RNA, 15 nt, Homo sapiens
aaaauggucaugaau

SEQ ID NO: 2066013 - RNA, 20 nt, Homo sapiens
cucauuuguuuaucugauuu

SEQ ID NO: 2066014 - RNA, 19 nt, Homo sapiens
ccaaauaucaaacacggac

SEQ ID NO: 2066015 - RNA, 15 nt, Homo sapiens
ucuauuuugugauga

SEQ ID NO: 2066016 - RNA, 20 nt, Homo sapiens
gacacgauugagaacugaca

SEQ ID NO: 2066017 - RNA, 22 nt, Homo sapiens
auguguuuuaucacuucauuca

SEQ ID NO: 2066018 - RNA, 16 nt, Homo sapiens
acuuuauuugccuaaa

SEQ ID NO: 2066019 - RNA, 22 nt, Homo sapiens
acaguuguguuccugacacuca

SEQ ID NO: 2066020 - RNA, 20 nt, Homo sapiens
ugcauuuuuuaaauuugcca

SEQ ID NO: 2066021 - RNA, 23 nt, Homo sapiens
aacaagguccucugucagucaca

SEQ ID NO: 2066022 - RNA, 18 nt, Homo sapiens
cugagacuccagaccuga

SEQ ID NO: 2066023 - RNA, 23 nt, Homo sapiens
cuggcacaacgcucuacccugca

SEQ ID NO: 2066024 - RNA, 22 nt, Homo sapiens
aaguucacuggagucuuguaca

SEQ ID NO: 2066025 - RNA, 13 nt, Homo sapiens
ucaaggauaggcu

SEQ ID NO: 2066026 - RNA, 16 nt, Homo sapiens
ugucucacaucuacac

SEQ ID NO: 2066027 - RNA, 23 nt, Homo sapiens
cuuuagcuuggguccaccaugca

SEQ ID NO: 2066028 - RNA, 21 nt, Homo sapiens
gcaaauauaucugcuauucuc

SEQ ID NO: 2066029 - RNA, 18 nt, Homo sapiens
uguugcaaugcaugauac

SEQ ID NO: 2066030 - RNA, 17 nt, Homo sapiens
uccccuccgucugugac

SEQ ID NO: 2066031 - RNA, 20 nt, Homo sapiens
ggaugucccugaagugccag

SEQ ID NO: 2066032 - RNA, 18 nt, Homo sapiens
auuuggagccugccaaga

SEQ ID NO: 2066033 - RNA, 15 nt, Homo sapiens
gcaagcccugaccca

SEQ ID NO: 2066034 - RNA, 19 nt, Homo sapiens
caugaaaaagaauaccaau

SEQ ID NO: 2066035 - RNA, 15 nt, Homo sapiens
agccgaaaagcuuuu

SEQ ID NO: 2066036 - RNA, 22 nt, Homo sapiens
aaguugcauuccuuugucuuca

SEQ ID NO: 2066037 - RNA, 20 nt, Homo sapiens
uccucaccccagacuccuga

SEQ ID NO: 2066038 - RNA, 15 nt, Homo sapiens
ccuccuuuuggccug

SEQ ID NO: 2066039 - RNA, 15 nt, Homo sapiens
ccugagguugggagu

SEQ ID NO: 2066040 - RNA, 15 nt, Homo sapiens
acuauauuugcuaga

SEQ ID NO: 2066041 - RNA, 14 nt, Homo sapiens
augguuuacugcug

SEQ ID NO: 2066042 - RNA, 15 nt, Homo sapiens
ccugcaucuggguuu

SEQ ID NO: 2066043 - RNA, 19 nt, Homo sapiens
ugcuggacuguuccaggcc

SEQ ID NO: 2066044 - RNA, 20 nt, Homo sapiens
uuucuugucuauaaagcauu

SEQ ID NO: 2066045 - RNA, 12 nt, Homo sapiens
cuagucuuucac

SEQ ID NO: 2066046 - RNA, 15 nt, Homo sapiens
augaauuuacuacuu

SEQ ID NO: 2066047 - RNA, 13 nt, Homo sapiens
gcuaauucauacc

SEQ ID NO: 2066048 - RNA, 20 nt, Homo sapiens
gaaaucauacuuugccaaau

SEQ ID NO: 2066049 - RNA, 17 nt, Homo sapiens
auacuaaaguaguuuaa

SEQ ID NO: 2066050 - RNA, 17 nt, Homo sapiens
cuuccaaucuugcuuug

SEQ ID NO: 2066051 - RNA, 15 nt, Homo sapiens
aaaagggccaggugc

SEQ ID NO: 2066052 - RNA, 17 nt, Homo sapiens
ugcuacaugguuuagau

SEQ ID NO: 2066053 - RNA, 18 nt, Homo sapiens
ccucaagaucauucagug

SEQ ID NO: 2066054 - RNA, 22 nt, Homo sapiens
cugcucccacacuugugccagc

SEQ ID NO: 2066055 - RNA, 19 nt, Homo sapiens
cacuugaggccaggacuuu

SEQ ID NO: 2066056 - RNA, 21 nt, Homo sapiens
ucuuucuauguagaacuguuc

SEQ ID NO: 2066057 - RNA, 23 nt, Homo sapiens
uuguuugucaauauaagcucaau

SEQ ID NO: 2066058 - RNA, 14 nt, Homo sapiens
auaaagggugccag

SEQ ID NO: 2066059 - RNA, 23 nt, Homo sapiens
accacuccugaaugagacuuaau

SEQ ID NO: 2066060 - RNA, 21 nt, Homo sapiens
guagccauuucuucuguucua

SEQ ID NO: 2066061 - RNA, 21 nt, Homo sapiens
uuguccaggcuggagugcaau

SEQ ID NO: 2066062 - RNA, 18 nt, Homo sapiens
ccauaggacuguggcaaa

SEQ ID NO: 2066063 - RNA, 23 nt, Homo sapiens
uccaagugccccaccacucccca

SEQ ID NO: 2066064 - RNA, 20 nt, Homo sapiens
acauagagauaugcacacac

SEQ ID NO: 2066065 - RNA, 16 nt, Homo sapiens
ucuagguuuaacucag

SEQ ID NO: 2066066 - RNA, 12 nt, Homo sapiens
cagaggaacaaa

SEQ ID NO: 2066067 - RNA, 12 nt, Homo sapiens
agccucaucucu

SEQ ID NO: 2066068 - RNA, 19 nt, Homo sapiens
cccaugcucugaugcagug

SEQ ID NO: 2066069 - RNA, 15 nt, Homo sapiens
cagagcucaccaggc

SEQ ID NO: 2066070 - RNA, 19 nt, Homo sapiens
cgacuucaucccaaaggac

SEQ ID NO: 2066071 - RNA, 13 nt, Homo sapiens
aaagaugcagugg

SEQ ID NO: 2066072 - RNA, 21 nt, Homo sapiens
cuguccccaaaccuauggaag

SEQ ID NO: 2066073 - RNA, 13 nt, Homo sapiens
aaucuaguaaugu

SEQ ID NO: 2066074 - RNA, 17 nt, Homo sapiens
aucacugcuccugucac

SEQ ID NO: 2066075 - RNA, 16 nt, Homo sapiens
uaccuagggacacaca

SEQ ID NO: 2066076 - RNA, 15 nt, Homo sapiens
acgauaauuccucaa

SEQ ID NO: 2066077 - RNA, 16 nt, Homo sapiens
cccugaccucccagcc

SEQ ID NO: 2066078 - RNA, 17 nt, Homo sapiens
uaaagucaacauaugca

SEQ ID NO: 2066079 - RNA, 13 nt, Homo sapiens
ugcugcuccaugg

SEQ ID NO: 2066080 - RNA, 13 nt, Homo sapiens
caggaauguauca

SEQ ID NO: 2066081 - RNA, 17 nt, Homo sapiens
uagaugcuccuuuuuac

SEQ ID NO: 2066082 - RNA, 19 nt, Homo sapiens
aguaauuguaaguaccccu

SEQ ID NO: 2066083 - RNA, 15 nt, Homo sapiens
cuucuccaaagggag

SEQ ID NO: 2066084 - RNA, 15 nt, Homo sapiens
aaaccaaugucauaa

SEQ ID NO: 2066085 - RNA, 17 nt, Homo sapiens
ggaauuccacagggacc

SEQ ID NO: 2066086 - RNA, 18 nt, Homo sapiens
ccggaggaaaagcagcuc

SEQ ID NO: 2066087 - RNA, 16 nt, Homo sapiens
ggaaaggagcaaugaa

SEQ ID NO: 2066088 - RNA, 22 nt, Homo sapiens
aaguucaacaacaaaacauuug

SEQ ID NO: 2066089 - RNA, 19 nt, Homo sapiens
gauuaugagacacaggaug

SEQ ID NO: 2066090 - RNA, 15 nt, Homo sapiens
aacccaaagagacag

SEQ ID NO: 2066091 - RNA, 23 nt, Homo sapiens
caggaaaaaaaaaaaucuaucca

SEQ ID NO: 2066092 - RNA, 20 nt, Homo sapiens
auccuaaagauuauuaccuu

SEQ ID NO: 2066093 - RNA, 15 nt, Homo sapiens
gggcccucgguggga

SEQ ID NO: 2066094 - RNA, 23 nt, Homo sapiens
gccagagggugggaggggccaug

SEQ ID NO: 2066095 - RNA, 19 nt, Homo sapiens
uacacauguaucuaugcau

SEQ ID NO: 2066096 - RNA, 13 nt, Homo sapiens
gaaaaugcauuau

SEQ ID NO: 2066097 - RNA, 13 nt, Homo sapiens
caccucagccucc

SEQ ID NO: 2066098 - RNA, 19 nt, Homo sapiens
uaaaaucaaaucauccugu

SEQ ID NO: 2066099 - RNA, 19 nt, Homo sapiens
auucuuuccuguauggccu

SEQ ID NO: 2066100 - RNA, 22 nt, Homo sapiens
cacucgggugcguguguuugua

SEQ ID NO: 2066101 - RNA, 16 nt, Homo sapiens
cugaaauuaacucaga

SEQ ID NO: 2066102 - RNA, 14 nt, Homo sapiens
ugcaauuuacuugg

SEQ ID NO: 2066103 - RNA, 22 nt, Homo sapiens
cuuaaggugaagugaggacaaa

SEQ ID NO: 2066104 - RNA, 19 nt, Homo sapiens
aacauagagaacugucacc

SEQ ID NO: 2066105 - RNA, 21 nt, Homo sapiens
aucacaugaccacauagcaug

SEQ ID NO: 2066106 - RNA, 14 nt, Homo sapiens
cuucgacucaggau

SEQ ID NO: 2066107 - RNA, 14 nt, Homo sapiens
aucaguagccagca

SEQ ID NO: 2066108 - RNA, 13 nt, Homo sapiens
ucucugauuuuga

SEQ ID NO: 2066109 - RNA, 17 nt, Homo sapiens
gacuauggugcugccuu

SEQ ID NO: 2066110 - RNA, 14 nt, Homo sapiens
uaugggaagccaua

SEQ ID NO: 2066111 - RNA, 16 nt, Homo sapiens
cuguggggaacacagc

SEQ ID NO: 2066112 - RNA, 21 nt, Homo sapiens
guccagacagagcccugugag

SEQ ID NO: 2066113 - RNA, 18 nt, Homo sapiens
acuucuauuuuaaagaca

SEQ ID NO: 2066114 - RNA, 17 nt, Homo sapiens
ugauggagucagguuug

SEQ ID NO: 2066115 - RNA, 23 nt, Homo sapiens
agcuggcccgacggcagccagaa

SEQ ID NO: 2066116 - RNA, 16 nt, Homo sapiens
uaaugcaaaugacugu

SEQ ID NO: 2066117 - RNA, 17 nt, Homo sapiens
aagcaagcagaugaacu

SEQ ID NO: 2066118 - RNA, 21 nt, Homo sapiens
aauuauuuuugagacugucag

SEQ ID NO: 2066119 - RNA, 18 nt, Homo sapiens
ccagcucuggaguucucu

SEQ ID NO: 2066120 - RNA, 20 nt, Homo sapiens
agguguucuucauuaccuca

SEQ ID NO: 2066121 - RNA, 17 nt, Homo sapiens
uacaggaaauugacuua

SEQ ID NO: 2066122 - RNA, 14 nt, Homo sapiens
caaggaguacaaug

SEQ ID NO: 2066123 - RNA, 18 nt, Homo sapiens
cucugcaugacaaacaca

SEQ ID NO: 2066124 - RNA, 18 nt, Homo sapiens
caaauccccucccuguga

SEQ ID NO: 2066125 - RNA, 12 nt, Homo sapiens
agccuuacaaac

SEQ ID NO: 2066126 - RNA, 18 nt, Homo sapiens
uguuugauacacauuuga

SEQ ID NO: 2066127 - RNA, 19 nt, Homo sapiens
caggaugaggcagaaggaa

SEQ ID NO: 2066128 - RNA, 18 nt, Homo sapiens
cuacauuuuaaaaacuga

SEQ ID NO: 2066129 - RNA, 20 nt, Homo sapiens
uuaugcucuuaaugauuuac

SEQ ID NO: 2066130 - RNA, 13 nt, Homo sapiens
agguccccagacu

SEQ ID NO: 2066131 - RNA, 21 nt, Homo sapiens
agaugaaggaaggacuaugac

SEQ ID NO: 2066132 - RNA, 16 nt, Homo sapiens
ugaaugagccaaagaa

SEQ ID NO: 2066133 - RNA, 18 nt, Homo sapiens
gauagucucauucuguca

SEQ ID NO: 2066134 - RNA, 14 nt, Homo sapiens
ggggcacaugcuga

SEQ ID NO: 2066135 - RNA, 15 nt, Homo sapiens
uagcugucugugaau

SEQ ID NO: 2066136 - RNA, 16 nt, Homo sapiens
gccuucuuuaugggaa

SEQ ID NO: 2066137 - RNA, 21 nt, Homo sapiens
gagcucuaucuucauguacuc

SEQ ID NO: 2066138 - RNA, 15 nt, Homo sapiens
cacuuuaauguacau

SEQ ID NO: 2066139 - RNA, 22 nt, Homo sapiens
agcugucaucaauuaaaggcaa

SEQ ID NO: 2066140 - RNA, 15 nt, Homo sapiens
uuuaucaaagcauag

SEQ ID NO: 2066141 - RNA, 14 nt, Homo sapiens
uugcucaagugcag

SEQ ID NO: 2066142 - RNA, 21 nt, Homo sapiens
uuugggagacugugcucucug

SEQ ID NO: 2066143 - RNA, 15 nt, Homo sapiens
gccugcacugggaag

SEQ ID NO: 2066144 - RNA, 20 nt, Homo sapiens
aagaaaaaguugcagucuca

SEQ ID NO: 2066145 - RNA, 18 nt, Homo sapiens
agccuccccuucuucccg

SEQ ID NO: 2066146 - RNA, 18 nt, Homo sapiens
aauucaacauauaccuua

SEQ ID NO: 2066147 - RNA, 15 nt, Homo sapiens
ugucucaacuacuca

SEQ ID NO: 2066148 - RNA, 17 nt, Homo sapiens
agccauuuuuagcucug

SEQ ID NO: 2066149 - RNA, 12 nt, Homo sapiens
aguuuagugcau

SEQ ID NO: 2066150 - RNA, 17 nt, Homo sapiens
ccugccugcgucuuccg

SEQ ID NO: 2066151 - RNA, 20 nt, Homo sapiens
auucaucauuccauaugacu

SEQ ID NO: 2066152 - RNA, 20 nt, Homo sapiens
ggucccauuucucacugaga

SEQ ID NO: 2066153 - RNA, 19 nt, Homo sapiens
ugaauuccacuccuuccag

SEQ ID NO: 2066154 - RNA, 17 nt, Homo sapiens
gacacauucacacuggg

SEQ ID NO: 2066155 - RNA, 13 nt, Homo sapiens
uaggcacuuuaaa

SEQ ID NO: 2066156 - RNA, 19 nt, Homo sapiens
uguuuaaauaaacacaguc

SEQ ID NO: 2066157 - RNA, 12 nt, Homo sapiens
gcacgcccuccu

SEQ ID NO: 2066158 - RNA, 20 nt, Homo sapiens
ugugcaacuggccagccaau

SEQ ID NO: 2066159 - RNA, 20 nt, Homo sapiens
guacccacuuagucauguaa

SEQ ID NO: 2066160 - RNA, 14 nt, Homo sapiens
gccuugccaugucu

SEQ ID NO: 2066161 - RNA, 15 nt, Homo sapiens
guguucugugauaua

SEQ ID NO: 2066162 - RNA, 15 nt, Homo sapiens
uuaaccaaucgcaaa

SEQ ID NO: 2066163 - RNA, 22 nt, Homo sapiens
uucccuguguacccuccaugua

SEQ ID NO: 2066164 - RNA, 21 nt, Homo sapiens
aauguuuuucccuccccagaa

SEQ ID NO: 2066165 - RNA, 12 nt, Homo sapiens
agcaacacaaag

SEQ ID NO: 2066166 - RNA, 20 nt, Homo sapiens
ugagcacaaucuguucuacu

SEQ ID NO: 2066167 - RNA, 13 nt, Homo sapiens
gugcgugucucug

SEQ ID NO: 2066168 - RNA, 15 nt, Homo sapiens
gagacaaagacucac

SEQ ID NO: 2066169 - RNA, 19 nt, Homo sapiens
caaucucaaucccucaaaa

SEQ ID NO: 2066170 - RNA, 13 nt, Homo sapiens
uugccauggacac

SEQ ID NO: 2066171 - RNA, 23 nt, Homo sapiens
acuuauaauuugcauaccauuaa

SEQ ID NO: 2066172 - RNA, 15 nt, Homo sapiens
uuugcaaaguacugu

SEQ ID NO: 2066173 - RNA, 19 nt, Homo sapiens
acucacacuaugugcaaaa

SEQ ID NO: 2066174 - RNA, 12 nt, Homo sapiens
guguaggggcca

SEQ ID NO: 2066175 - RNA, 12 nt, Homo sapiens
ggggcacccgcc

SEQ ID NO: 2066176 - RNA, 21 nt, Homo sapiens
gaugguaucuggguaagaaga

SEQ ID NO: 2066177 - RNA, 19 nt, Homo sapiens
cugugaggaaguguggaaa

SEQ ID NO: 2066178 - RNA, 19 nt, Homo sapiens
cuaaguuucuaagauucua

SEQ ID NO: 2066179 - RNA, 23 nt, Homo sapiens
ucacauucuguuuaucaagccau

SEQ ID NO: 2066180 - RNA, 21 nt, Homo sapiens
caaauucggauguaugaucuc

SEQ ID NO: 2066181 - RNA, 13 nt, Homo sapiens
uccugccuugaug

SEQ ID NO: 2066182 - RNA, 11 nt, Homo sapiens
caaaaaaucug

SEQ ID NO: 2066183 - RNA, 20 nt, Homo sapiens
cuuacaaaaagaaaugucaa

SEQ ID NO: 2066184 - RNA, 20 nt, Homo sapiens
agaaauuuugccugccauuu

SEQ ID NO: 2066185 - RNA, 20 nt, Homo sapiens
uguggccugggccuccucac

SEQ ID NO: 2066186 - RNA, 22 nt, Homo sapiens
uaccaagugcuuccuacaaaga

SEQ ID NO: 2066187 - RNA, 15 nt, Homo sapiens
cuaaugauuagcacu

SEQ ID NO: 2066188 - RNA, 15 nt, Homo sapiens
aaacuuguucaaaag

SEQ ID NO: 2066189 - RNA, 16 nt, Homo sapiens
aguacagacgucucaa

SEQ ID NO: 2066190 - RNA, 18 nt, Homo sapiens
uauccuuuauuucugaua

SEQ ID NO: 2066191 - RNA, 16 nt, Homo sapiens
ggcauccauaccagcu

SEQ ID NO: 2066192 - RNA, 13 nt, Homo sapiens
aucccauguagaa

SEQ ID NO: 2066193 - RNA, 22 nt, Homo sapiens
cuaaaguagaauuaucucucau

SEQ ID NO: 2066194 - RNA, 21 nt, Homo sapiens
gucaggaguccaagaccagac

SEQ ID NO: 2066195 - RNA, 16 nt, Homo sapiens
aauaaauucaucagau

SEQ ID NO: 2066196 - RNA, 21 nt, Homo sapiens
gccccauucucccuccauggc

SEQ ID NO: 2066197 - RNA, 18 nt, Homo sapiens
uccagaggaauaaaaagg

SEQ ID NO: 2066198 - RNA, 21 nt, Homo sapiens
ucucuaucuggccuuugcaug

SEQ ID NO: 2066199 - RNA, 22 nt, Homo sapiens
cuaauuagagaacuggaggaac

SEQ ID NO: 2066200 - RNA, 11 nt, Homo sapiens
accuacaaggu

SEQ ID NO: 2066201 - RNA, 13 nt, Homo sapiens
aaagaugacuuga

SEQ ID NO: 2066202 - RNA, 13 nt, Homo sapiens
aauaaugacuaaa

SEQ ID NO: 2066203 - RNA, 22 nt, Homo sapiens
uuaucccacggaaaaugccaau

SEQ ID NO: 2066204 - RNA, 23 nt, Homo sapiens
cacaguaauggggugagcucaca

SEQ ID NO: 2066205 - RNA, 22 nt, Homo sapiens
cccaagucccugucauuugaac

SEQ ID NO: 2066206 - RNA, 13 nt, Homo sapiens
ccuuauuucucuc

SEQ ID NO: 2066207 - RNA, 19 nt, Homo sapiens
gagaagucugcaagauguc

SEQ ID NO: 2066208 - RNA, 22 nt, Homo sapiens
aauugcaacuucuaaacacaaa

SEQ ID NO: 2066209 - RNA, 17 nt, Homo sapiens
cagcucaguaguauaug

SEQ ID NO: 2066210 - RNA, 14 nt, Homo sapiens
cacagaaaucacag

SEQ ID NO: 2066211 - RNA, 22 nt, Homo sapiens
guacugguccccuucugggcaa

SEQ ID NO: 2066212 - RNA, 23 nt, Homo sapiens
gacucccuccccaccccaaccac

SEQ ID NO: 2066213 - RNA, 19 nt, Homo sapiens
uuuccuuuuuccugugaca

SEQ ID NO: 2066214 - RNA, 22 nt, Homo sapiens
uuggccucagaauucacaaaau

SEQ ID NO: 2066215 - RNA, 12 nt, Homo sapiens
cuccuguuucac

SEQ ID NO: 2066216 - RNA, 21 nt, Homo sapiens
cuaguagaacucacagaaaua

SEQ ID NO: 2066217 - RNA, 15 nt, Homo sapiens
gauagacaucagaaa

SEQ ID NO: 2066218 - RNA, 20 nt, Homo sapiens
cccaucuuccaccucaccuc

SEQ ID NO: 2066219 - RNA, 12 nt, Homo sapiens
auuguggaagac

SEQ ID NO: 2066220 - RNA, 16 nt, Homo sapiens
agauauggcauugcac

SEQ ID NO: 2066221 - RNA, 20 nt, Homo sapiens
auuacaguuaaagaagcaau

SEQ ID NO: 2066222 - RNA, 14 nt, Homo sapiens
caugaauauuucaa

SEQ ID NO: 2066223 - RNA, 18 nt, Homo sapiens
auguucagggaugcucau

SEQ ID NO: 2066224 - RNA, 19 nt, Homo sapiens
gaaggcuucaucaccaaga

SEQ ID NO: 2066225 - RNA, 21 nt, Homo sapiens
ucuggcaucucccacacaaga

SEQ ID NO: 2066226 - RNA, 14 nt, Homo sapiens
uaaaucaaugcuau

SEQ ID NO: 2066227 - RNA, 13 nt, Homo sapiens
ucaugaaaucagc

SEQ ID NO: 2066228 - RNA, 13 nt, Homo sapiens
cugugaaacuggc

SEQ ID NO: 2066229 - RNA, 13 nt, Homo sapiens
ccacaccccaaaa

SEQ ID NO: 2066230 - RNA, 19 nt, Homo sapiens
ggcucuucugacuacuggg

SEQ ID NO: 2066231 - RNA, 22 nt, Homo sapiens
gaauccaccucggagcauggug

SEQ ID NO: 2066232 - RNA, 22 nt, Homo sapiens
agagcuggucguuuugugauua

SEQ ID NO: 2066233 - RNA, 17 nt, Homo sapiens
cucagacuguugcacuc

SEQ ID NO: 2066234 - RNA, 18 nt, Homo sapiens
guaugugcagugugggau

SEQ ID NO: 2066235 - RNA, 21 nt, Homo sapiens
aauuauuauuaucacauuuac

SEQ ID NO: 2066236 - RNA, 16 nt, Homo sapiens
cauuuguuaaaauaca

SEQ ID NO: 2066237 - RNA, 23 nt, Homo sapiens
caucuguagauacuagcuaucua

SEQ ID NO: 2066238 - RNA, 22 nt, Homo sapiens
ugcacuccagccugggggacag

SEQ ID NO: 2066239 - RNA, 14 nt, Homo sapiens
gcgaggugggagag

SEQ ID NO: 2066240 - RNA, 17 nt, Homo sapiens
ucccagacucaccccau

SEQ ID NO: 2066241 - RNA, 16 nt, Homo sapiens
uucucuuucucuccuu

SEQ ID NO: 2066242 - RNA, 20 nt, Homo sapiens
auaaauggccagugcugcuu

SEQ ID NO: 2066243 - RNA, 16 nt, Homo sapiens
cucauuauuucaucau

SEQ ID NO: 2066244 - RNA, 16 nt, Homo sapiens
uauacuugaauauuau

SEQ ID NO: 2066245 - RNA, 15 nt, Homo sapiens
ccucugcagcacuuu

SEQ ID NO: 2066246 - RNA, 18 nt, Homo sapiens
uugccaggcuugucaaau

SEQ ID NO: 2066247 - RNA, 14 nt, Homo sapiens
aucagagcauuuau

SEQ ID NO: 2066248 - RNA, 20 nt, Homo sapiens
uucccuguacuuuucccauu

SEQ ID NO: 2066249 - RNA, 14 nt, Homo sapiens
uccucggacucugc

SEQ ID NO: 2066250 - RNA, 18 nt, Homo sapiens
uguauuaguuuuugauca

SEQ ID NO: 2066251 - RNA, 15 nt, Homo sapiens
caaucuuugccuuua

SEQ ID NO: 2066252 - RNA, 19 nt, Homo sapiens
ugguaguggaauagugaau

SEQ ID NO: 2066253 - RNA, 23 nt, Homo sapiens
agcccuagaaagcugcugugauc

SEQ ID NO: 2066254 - RNA, 15 nt, Homo sapiens
uguauuuaagcaaau

SEQ ID NO: 2066255 - RNA, 22 nt, Homo sapiens
ucauuauuuuuguuagcaaaga

SEQ ID NO: 2066256 - RNA, 17 nt, Homo sapiens
aggucucauucuuccaa

SEQ ID NO: 2066257 - RNA, 17 nt, Homo sapiens
cugucucucaugaaccu

SEQ ID NO: 2066258 - RNA, 18 nt, Homo sapiens
cauguguccccccugugg

SEQ ID NO: 2066259 - RNA, 21 nt, Homo sapiens
auuuugcggcauuaaagccau

SEQ ID NO: 2066260 - RNA, 15 nt, Homo sapiens
acugagcuacuagag

SEQ ID NO: 2066261 - RNA, 14 nt, Homo sapiens
gcggugaugaugua

SEQ ID NO: 2066262 - RNA, 18 nt, Homo sapiens
ugccuacuuuucuuuauu

SEQ ID NO: 2066263 - RNA, 12 nt, Homo sapiens
ccuagugcuguu

SEQ ID NO: 2066264 - RNA, 18 nt, Homo sapiens
auaaaagauuuacauucc

SEQ ID NO: 2066265 - RNA, 12 nt, Homo sapiens
cccagugcugcu

SEQ ID NO: 2066266 - RNA, 21 nt, Homo sapiens
caggauuuuuagagcauuaaa

SEQ ID NO: 2066267 - RNA, 17 nt, Homo sapiens
gcaccuuugcacaggau

SEQ ID NO: 2066268 - RNA, 18 nt, Homo sapiens
uagauuaacggagugucu

SEQ ID NO: 2066269 - RNA, 22 nt, Homo sapiens
uucuaacgaguggaccauuauc

SEQ ID NO: 2066270 - RNA, 14 nt, Homo sapiens
cauuauaugcacua

SEQ ID NO: 2066271 - RNA, 14 nt, Homo sapiens
caucaaaugcauuu

SEQ ID NO: 2066272 - RNA, 15 nt, Homo sapiens
ucucucucuuagcau

SEQ ID NO: 2066273 - RNA, 15 nt, Homo sapiens
acagucacauuccaa

SEQ ID NO: 2066274 - RNA, 12 nt, Homo sapiens
cauuucacuucc

SEQ ID NO: 2066275 - RNA, 19 nt, Homo sapiens
ugacugugauuagaucaca

SEQ ID NO: 2066276 - RNA, 23 nt, Homo sapiens
gggguccuguuaacgucaucuca

SEQ ID NO: 2066277 - RNA, 13 nt, Homo sapiens
ucccgaauccuga

SEQ ID NO: 2066278 - RNA, 21 nt, Homo sapiens
acuuauuaugcauaaagccaa

SEQ ID NO: 2066279 - RNA, 18 nt, Homo sapiens
aagacugugaaguugcca

SEQ ID NO: 2066280 - RNA, 17 nt, Homo sapiens
auucaugguucaaguau

SEQ ID NO: 2066281 - RNA, 18 nt, Homo sapiens
ucugcuaugcuauugaag

SEQ ID NO: 2066282 - RNA, 22 nt, Homo sapiens
cuugucacuugcaugucccauc

SEQ ID NO: 2066283 - RNA, 17 nt, Homo sapiens
cucauuuauagauguca

SEQ ID NO: 2066284 - RNA, 15 nt, Homo sapiens
agcacugcguacaaa

SEQ ID NO: 2066285 - RNA, 22 nt, Homo sapiens
aaugguuuguuuucuacauuga

SEQ ID NO: 2066286 - RNA, 20 nt, Homo sapiens
acuugcugaauuucaggcau

SEQ ID NO: 2066287 - RNA, 16 nt, Homo sapiens
ugcaaccaaacuccca

SEQ ID NO: 2066288 - RNA, 16 nt, Homo sapiens
ucaccuuccuaaucac

SEQ ID NO: 2066289 - RNA, 17 nt, Homo sapiens
uggccacagccagggga

SEQ ID NO: 2066290 - RNA, 22 nt, Homo sapiens
uggagcuaaaacuggcccuguu

SEQ ID NO: 2066291 - RNA, 20 nt, Homo sapiens
uggaggacgggacagaugga

SEQ ID NO: 2066292 - RNA, 22 nt, Homo sapiens
auaucacuugauaugugcacca

SEQ ID NO: 2066293 - RNA, 18 nt, Homo sapiens
caauaaaaguugaucaua

SEQ ID NO: 2066294 - RNA, 20 nt, Homo sapiens
aguggauuuuccugaauauu

SEQ ID NO: 2066295 - RNA, 17 nt, Homo sapiens
gcccccaccuggcucac

SEQ ID NO: 2066296 - RNA, 14 nt, Homo sapiens
cauuucagcuguga

SEQ ID NO: 2066297 - RNA, 23 nt, Homo sapiens
cuggggcauuauccaucuuucac

SEQ ID NO: 2066298 - RNA, 18 nt, Homo sapiens
auaaaggccagauuacaa

SEQ ID NO: 2066299 - RNA, 17 nt, Homo sapiens
auaaaaugacuacuuag

SEQ ID NO: 2066300 - RNA, 14 nt, Homo sapiens
guuuacaguggaau

SEQ ID NO: 2066301 - RNA, 21 nt, Homo sapiens
ucacaaaacgaaaugcuauga

SEQ ID NO: 2066302 - RNA, 18 nt, Homo sapiens
cagagguuguagugagcc

SEQ ID NO: 2066303 - RNA, 14 nt, Homo sapiens
caagucaugccuga

SEQ ID NO: 2066304 - RNA, 13 nt, Homo sapiens
aguaacacagugc

SEQ ID NO: 2066305 - RNA, 15 nt, Homo sapiens
cggcucugguggcca

SEQ ID NO: 2066306 - RNA, 22 nt, Homo sapiens
cuucugugcccagaauacugau

SEQ ID NO: 2066307 - RNA, 17 nt, Homo sapiens
ccaggaguagugagcug

SEQ ID NO: 2066308 - RNA, 17 nt, Homo sapiens
ucucuggaaagggggga

SEQ ID NO: 2066309 - RNA, 18 nt, Homo sapiens
gaccaguggcuggucuca

SEQ ID NO: 2066310 - RNA, 13 nt, Homo sapiens
auaacucaauaua

SEQ ID NO: 2066311 - RNA, 13 nt, Homo sapiens
cauucucacauaa

SEQ ID NO: 2066312 - RNA, 12 nt, Homo sapiens
uucauggaccaa

SEQ ID NO: 2066313 - RNA, 11 nt, Homo sapiens
gacaaaccucu

SEQ ID NO: 2066314 - RNA, 19 nt, Homo sapiens
acggcugcgcacugugucc

SEQ ID NO: 2066315 - RNA, 16 nt, Homo sapiens
aucccuuaagaaugag

SEQ ID NO: 2066316 - RNA, 20 nt, Homo sapiens
gucuaguuucccacauucca

SEQ ID NO: 2066317 - RNA, 21 nt, Homo sapiens
augcaguauuguaucauuaau

SEQ ID NO: 2066318 - RNA, 23 nt, Homo sapiens
aaauuuuuuuuuuuuacuugaaa

SEQ ID NO: 2066319 - RNA, 22 nt, Homo sapiens
acagauuuacaucccagacaca

SEQ ID NO: 2066320 - RNA, 17 nt, Homo sapiens
aaauaagccagacauca

SEQ ID NO: 2066321 - RNA, 20 nt, Homo sapiens
ucaagagcaaaguagaucau

SEQ ID NO: 2066322 - RNA, 21 nt, Homo sapiens
uucuaagagcgaacuucacau

SEQ ID NO: 2066323 - RNA, 13 nt, Homo sapiens
accgcugcugcug

SEQ ID NO: 2066324 - RNA, 12 nt, Homo sapiens
agccuauagcag

SEQ ID NO: 2066325 - RNA, 15 nt, Homo sapiens
agacccaguguaaag

SEQ ID NO: 2066326 - RNA, 15 nt, Homo sapiens
cauucauucauucag

SEQ ID NO: 2066327 - RNA, 15 nt, Homo sapiens
uuguauuuuuguaug

SEQ ID NO: 2066328 - RNA, 15 nt, Homo sapiens
ccuuaaguccuuaau

SEQ ID NO: 2066329 - RNA, 14 nt, Homo sapiens
aauccccagcugag

SEQ ID NO: 2066330 - RNA, 18 nt, Homo sapiens
ggcaucgggccaucucag

SEQ ID NO: 2066331 - RNA, 14 nt, Homo sapiens
aggugaaccaaaga

SEQ ID NO: 2066332 - RNA, 13 nt, Homo sapiens
ucaugauuucccu

SEQ ID NO: 2066333 - RNA, 16 nt, Homo sapiens
acugaaguuaucaucc

SEQ ID NO: 2066334 - RNA, 19 nt, Homo sapiens
uuacuuuuuuuuaagucac

SEQ ID NO: 2066335 - RNA, 15 nt, Homo sapiens
guugcuuuuuuucca

SEQ ID NO: 2066336 - RNA, 15 nt, Homo sapiens
uggcacucagucucu

SEQ ID NO: 2066337 - RNA, 14 nt, Homo sapiens
aaagcaguggggac

SEQ ID NO: 2066338 - RNA, 22 nt, Homo sapiens
gcaucuuuagugcuuucuuguc

SEQ ID NO: 2066339 - RNA, 23 nt, Homo sapiens
ggcagcaaaacgacacugcgcau

SEQ ID NO: 2066340 - RNA, 19 nt, Homo sapiens
cugggcauucucaauacuu

SEQ ID NO: 2066341 - RNA, 20 nt, Homo sapiens
gaaaucugaggaaggugcuu

SEQ ID NO: 2066342 - RNA, 13 nt, Homo sapiens
aacagcgacaaaa

SEQ ID NO: 2066343 - RNA, 23 nt, Homo sapiens
ucauuguuggaguguaaaccaaa

SEQ ID NO: 2066344 - RNA, 16 nt, Homo sapiens
ucccauguugucaaua

SEQ ID NO: 2066345 - RNA, 12 nt, Homo sapiens
ucuucagccuag

SEQ ID NO: 2066346 - RNA, 19 nt, Homo sapiens
gaccucccugucucuacaa

SEQ ID NO: 2066347 - RNA, 21 nt, Homo sapiens
ugugaaaugcuuuuauauucu

SEQ ID NO: 2066348 - RNA, 10 nt, Homo sapiens
caaaccucaa

SEQ ID NO: 2066349 - RNA, 14 nt, Homo sapiens
ugucaaagacugua

SEQ ID NO: 2066350 - RNA, 16 nt, Homo sapiens
cuuuugaaauccagaa

SEQ ID NO: 2066351 - RNA, 13 nt, Homo sapiens
gguucaagugcuu

SEQ ID NO: 2066352 - RNA, 22 nt, Homo sapiens
gcugauuccuaaaacucugcca

SEQ ID NO: 2066353 - RNA, 19 nt, Homo sapiens
cauucucgugagucauuua

SEQ ID NO: 2066354 - RNA, 14 nt, Homo sapiens
gcaacaaaugcauc

SEQ ID NO: 2066355 - RNA, 11 nt, Homo sapiens
uuccugcaaug

SEQ ID NO: 2066356 - RNA, 18 nt, Homo sapiens
aaguacagggcagaacca

SEQ ID NO: 2066357 - RNA, 18 nt, Homo sapiens
gucucgcgcgacugagaa

SEQ ID NO: 2066358 - RNA, 21 nt, Homo sapiens
uaaugagaggcacacugcuaa

SEQ ID NO: 2066359 - RNA, 18 nt, Homo sapiens
cauuagagaguggcaaua

SEQ ID NO: 2066360 - RNA, 14 nt, Homo sapiens
uuauaguaugugac

SEQ ID NO: 2066361 - RNA, 14 nt, Homo sapiens
cuuacuugcacugu

SEQ ID NO: 2066362 - RNA, 22 nt, Homo sapiens
aaaggcugacauucacugagug

SEQ ID NO: 2066363 - RNA, 14 nt, Homo sapiens
cuuuugccuccuuu

SEQ ID NO: 2066364 - RNA, 18 nt, Homo sapiens
aguagagaacccagauga

SEQ ID NO: 2066365 - RNA, 13 nt, Homo sapiens
aggcugcauagaa

SEQ ID NO: 2066366 - RNA, 17 nt, Homo sapiens
uauaaauguuucaugaa

SEQ ID NO: 2066367 - RNA, 13 nt, Homo sapiens
cagagcaaaagaa

SEQ ID NO: 2066368 - RNA, 13 nt, Homo sapiens
auuugcaacuuua

SEQ ID NO: 2066369 - RNA, 14 nt, Homo sapiens
acacuuaguaugca

SEQ ID NO: 2066370 - RNA, 18 nt, Homo sapiens
ucugauuuguaaugagca

SEQ ID NO: 2066371 - RNA, 22 nt, Homo sapiens
aaggaaacuguacuacaucuag

SEQ ID NO: 2066372 - RNA, 22 nt, Homo sapiens
ugucaccagcuaucugucaucu

SEQ ID NO: 2066373 - RNA, 19 nt, Homo sapiens
agagaucacaauacucaaa

SEQ ID NO: 2066374 - RNA, 16 nt, Homo sapiens
ugagacuccaucucaa

SEQ ID NO: 2066375 - RNA, 17 nt, Homo sapiens
aaggaaacccccagugu

SEQ ID NO: 2066376 - RNA, 18 nt, Homo sapiens
uagcaaugugauuuugua

SEQ ID NO: 2066377 - RNA, 16 nt, Homo sapiens
ccuuacaaguuagaaa

SEQ ID NO: 2066378 - RNA, 18 nt, Homo sapiens
gguaagcaaauuucuaaa

SEQ ID NO: 2066379 - RNA, 14 nt, Homo sapiens
agacuguacuggcc

SEQ ID NO: 2066380 - RNA, 17 nt, Homo sapiens
caaccccugcuccaguc

SEQ ID NO: 2066381 - RNA, 14 nt, Homo sapiens
cgacaccacuggga

SEQ ID NO: 2066382 - RNA, 14 nt, Homo sapiens
uucucaccgauauu

SEQ ID NO: 2066383 - RNA, 17 nt, Homo sapiens
uggcccgccccucgcug

SEQ ID NO: 2066384 - RNA, 15 nt, Homo sapiens
gcauuuguccaccca

SEQ ID NO: 2066385 - RNA, 14 nt, Homo sapiens
caauacaaccagcc

SEQ ID NO: 2066386 - RNA, 19 nt, Homo sapiens
accaacaguuccuucagcu

SEQ ID NO: 2066387 - RNA, 20 nt, Homo sapiens
agagaucaggaagagaagga

SEQ ID NO: 2066388 - RNA, 15 nt, Homo sapiens
ggugacccaaugauu

SEQ ID NO: 2066389 - RNA, 20 nt, Homo sapiens
ucacaucucagggaacugac

SEQ ID NO: 2066390 - RNA, 12 nt, Homo sapiens
aaucacaguaua

SEQ ID NO: 2066391 - RNA, 12 nt, Homo sapiens
agcaacagugcc

SEQ ID NO: 2066392 - RNA, 19 nt, Homo sapiens
aauauugccauauucugua

SEQ ID NO: 2066393 - RNA, 17 nt, Homo sapiens
ugauagcuuacacugag

SEQ ID NO: 2066394 - RNA, 15 nt, Homo sapiens
uuauaccuggaugau

SEQ ID NO: 2066395 - RNA, 18 nt, Homo sapiens
ccagagaacugacaugca

SEQ ID NO: 2066396 - RNA, 14 nt, Homo sapiens
auggcuacaccuca

SEQ ID NO: 2066397 - RNA, 15 nt, Homo sapiens
ucuugggaagcaguu

SEQ ID NO: 2066398 - RNA, 17 nt, Homo sapiens
acagcccucucucucac

SEQ ID NO: 2066399 - RNA, 21 nt, Homo sapiens
gagaguauuuuagaaacucca

SEQ ID NO: 2066400 - RNA, 12 nt, Homo sapiens
uuagcccaagag

SEQ ID NO: 2066401 - RNA, 18 nt, Homo sapiens
aauugaaacuaguuauuu

SEQ ID NO: 2066402 - RNA, 20 nt, Homo sapiens
aguauguauguguaccuaag

SEQ ID NO: 2066403 - RNA, 19 nt, Homo sapiens
cuauaaguguucaguguug

SEQ ID NO: 2066404 - RNA, 15 nt, Homo sapiens
auuccaguauuucau

SEQ ID NO: 2066405 - RNA, 17 nt, Homo sapiens
guaaguuucucauccca

SEQ ID NO: 2066406 - RNA, 18 nt, Homo sapiens
acugaagaugcagcaaaa

SEQ ID NO: 2066407 - RNA, 15 nt, Homo sapiens
ucaauaagccagcaa

SEQ ID NO: 2066408 - RNA, 14 nt, Homo sapiens
caucuucagcauuu

SEQ ID NO: 2066409 - RNA, 18 nt, Homo sapiens
caaaguagcugggauuac

SEQ ID NO: 2066410 - RNA, 22 nt, Homo sapiens
augauacuuggaugcagcucuu

SEQ ID NO: 2066411 - RNA, 19 nt, Homo sapiens
auuuaauaucuggcacugu

SEQ ID NO: 2066412 - RNA, 15 nt, Homo sapiens
ucaauaugagucuca

SEQ ID NO: 2066413 - RNA, 21 nt, Homo sapiens
ucaaugcugacuggacugugu

SEQ ID NO: 2066414 - RNA, 21 nt, Homo sapiens
gagcugauacuuugacagugu

SEQ ID NO: 2066415 - RNA, 14 nt, Homo sapiens
uguccaacauggug

SEQ ID NO: 2066416 - RNA, 20 nt, Homo sapiens
gagcacccuugcccggcugu

SEQ ID NO: 2066417 - RNA, 22 nt, Homo sapiens
aucaugggagcaugcuuaccuu

SEQ ID NO: 2066418 - RNA, 18 nt, Homo sapiens
gccuguaacauaucugua

SEQ ID NO: 2066419 - RNA, 17 nt, Homo sapiens
acuauggguacauucca

SEQ ID NO: 2066420 - RNA, 23 nt, Homo sapiens
agcucugggccucuuuuugcccu

SEQ ID NO: 2066421 - RNA, 20 nt, Homo sapiens
gaaacaaauaagaccauaaa

SEQ ID NO: 2066422 - RNA, 17 nt, Homo sapiens
uaugccuuuuuugauca

SEQ ID NO: 2066423 - RNA, 14 nt, Homo sapiens
ugcuggaccagcug

SEQ ID NO: 2066424 - RNA, 15 nt, Homo sapiens
agagaacaggggcuu

SEQ ID NO: 2066425 - RNA, 20 nt, Homo sapiens
ggccccucacccccagcugg

SEQ ID NO: 2066426 - RNA, 20 nt, Homo sapiens
aacagaggaaucuaccugug

SEQ ID NO: 2066427 - RNA, 17 nt, Homo sapiens
auagaccccaagcauuc

SEQ ID NO: 2066428 - RNA, 23 nt, Homo sapiens
cccaggagguugagaaugcagug

SEQ ID NO: 2066429 - RNA, 14 nt, Homo sapiens
ugugacauucacuc

SEQ ID NO: 2066430 - RNA, 15 nt, Homo sapiens
cagacgccacagucu

SEQ ID NO: 2066431 - RNA, 16 nt, Homo sapiens
agcaacuucauuugac

SEQ ID NO: 2066432 - RNA, 15 nt, Homo sapiens
acacuggagugaaug

SEQ ID NO: 2066433 - RNA, 20 nt, Homo sapiens
ugcuaggcccccggguguga

SEQ ID NO: 2066434 - RNA, 12 nt, Homo sapiens
cugcuugcacug

SEQ ID NO: 2066435 - RNA, 18 nt, Homo sapiens
uaaguguguaugugcauu

SEQ ID NO: 2066436 - RNA, 18 nt, Homo sapiens
ucaaucuuaacaaaagug

SEQ ID NO: 2066437 - RNA, 12 nt, Homo sapiens
cuuaucaaagga

SEQ ID NO: 2066438 - RNA, 18 nt, Homo sapiens
cuggauggggcaggccac

SEQ ID NO: 2066439 - RNA, 21 nt, Homo sapiens
uaccaccaugcacuguaaaua

SEQ ID NO: 2066440 - RNA, 23 nt, Homo sapiens
agguagcccccuaaaugggcaag

SEQ ID NO: 2066441 - RNA, 12 nt, Homo sapiens
aaucaaccaaag

SEQ ID NO: 2066442 - RNA, 22 nt, Homo sapiens
cauugcucagaaaugucaugug

SEQ ID NO: 2066443 - RNA, 24 nt, Homo sapiens
uuugcuguagguuuuuuauagcua

SEQ ID NO: 2066444 - RNA, 19 nt, Homo sapiens
aucaacuuauuauaugacu

SEQ ID NO: 2066445 - RNA, 13 nt, Homo sapiens
caagccaggguuc

SEQ ID NO: 2066446 - RNA, 15 nt, Homo sapiens
cagccauagaccuac

SEQ ID NO: 2066447 - RNA, 19 nt, Homo sapiens
aguccuugcuuggcugcuu

SEQ ID NO: 2066448 - RNA, 13 nt, Homo sapiens
cuuccaaguccuu

SEQ ID NO: 2066449 - RNA, 14 nt, Homo sapiens
ucuaaccagaugga

SEQ ID NO: 2066450 - RNA, 18 nt, Homo sapiens
gcauccagccuguguguu

SEQ ID NO: 2066451 - RNA, 17 nt, Homo sapiens
ggcaggcagaucacaag

SEQ ID NO: 2066452 - RNA, 17 nt, Homo sapiens
uuuaaaagauuaucuca

SEQ ID NO: 2066453 - RNA, 16 nt, Homo sapiens
ccaggacccugccagg

SEQ ID NO: 2066454 - RNA, 15 nt, Homo sapiens
aggaaucauucugua

SEQ ID NO: 2066455 - RNA, 21 nt, Homo sapiens
gccuggagcccuccgccuuca

SEQ ID NO: 2066456 - RNA, 16 nt, Homo sapiens
auggaaaaaaauuaca

SEQ ID NO: 2066457 - RNA, 22 nt, Homo sapiens
aaagagagcaccacgugaugga

SEQ ID NO: 2066458 - RNA, 13 nt, Homo sapiens
uggucucaucucc

SEQ ID NO: 2066459 - RNA, 16 nt, Homo sapiens
aaugcaaugugaaaua

SEQ ID NO: 2066460 - RNA, 18 nt, Homo sapiens
caggauccagaagggguu

SEQ ID NO: 2066461 - RNA, 19 nt, Homo sapiens
uguugaaauuggaaaggac

SEQ ID NO: 2066462 - RNA, 22 nt, Homo sapiens
aaguuaugcaagggacugugug

SEQ ID NO: 2066463 - RNA, 16 nt, Homo sapiens
uaauguuugcauuucc

SEQ ID NO: 2066464 - RNA, 20 nt, Homo sapiens
ccauuucuuaacagucucca

SEQ ID NO: 2066465 - RNA, 23 nt, Homo sapiens
ucaaaugagaaaaugucuuuauu

SEQ ID NO: 2066466 - RNA, 19 nt, Homo sapiens
cauuuaauauuuaugcucu

SEQ ID NO: 2066467 - RNA, 17 nt, Homo sapiens
gugccacccaugcagcu

SEQ ID NO: 2066468 - RNA, 17 nt, Homo sapiens
cacuguuccagucuccu

SEQ ID NO: 2066469 - RNA, 15 nt, Homo sapiens
auaaaaggaagccaa

SEQ ID NO: 2066470 - RNA, 13 nt, Homo sapiens
uuuaugagacagc

SEQ ID NO: 2066471 - RNA, 16 nt, Homo sapiens
ccugacuuugugaucc

SEQ ID NO: 2066472 - RNA, 14 nt, Homo sapiens
aggucccagcccug

SEQ ID NO: 2066473 - RNA, 15 nt, Homo sapiens
cugucaccuugcuca

SEQ ID NO: 2066474 - RNA, 15 nt, Homo sapiens
agacucuaccacuua

SEQ ID NO: 2066475 - RNA, 17 nt, Homo sapiens
uagugcuuuccaguuca

SEQ ID NO: 2066476 - RNA, 18 nt, Homo sapiens
caaaucaaacauauucua

SEQ ID NO: 2066477 - RNA, 22 nt, Homo sapiens
cuggcucugagagccccaggac

SEQ ID NO: 2066478 - RNA, 23 nt, Homo sapiens
caaagacugaguacguugugcau

SEQ ID NO: 2066479 - RNA, 14 nt, Homo sapiens
aaauccuuucauaa

SEQ ID NO: 2066480 - RNA, 15 nt, Homo sapiens
gguguuggaagccag

SEQ ID NO: 2066481 - RNA, 18 nt, Homo sapiens
cgaauuuuaucuguggag

SEQ ID NO: 2066482 - RNA, 15 nt, Homo sapiens
aguccugcuggccug

SEQ ID NO: 2066483 - RNA, 14 nt, Homo sapiens
agacccgcccuccc

SEQ ID NO: 2066484 - RNA, 14 nt, Homo sapiens
cguugugcacaugu

SEQ ID NO: 2066485 - RNA, 20 nt, Homo sapiens
aaauugcuacauaguccaaa

SEQ ID NO: 2066486 - RNA, 20 nt, Homo sapiens
cauauucaacacacugccuu

SEQ ID NO: 2066487 - RNA, 15 nt, Homo sapiens
guauguuugaucaca

SEQ ID NO: 2066488 - RNA, 11 nt, Homo sapiens
agaaggucugu

SEQ ID NO: 2066489 - RNA, 18 nt, Homo sapiens
ccagacccuggcaucuga

SEQ ID NO: 2066490 - RNA, 13 nt, Homo sapiens
auuauuauuacuc

SEQ ID NO: 2066491 - RNA, 10 nt, Homo sapiens
ccauuauuca

SEQ ID NO: 2066492 - RNA, 14 nt, Homo sapiens
acccacgugccugc

SEQ ID NO: 2066493 - RNA, 13 nt, Homo sapiens
ucugggugcggug

SEQ ID NO: 2066494 - RNA, 16 nt, Homo sapiens
uucuguccgcucuuac

SEQ ID NO: 2066495 - RNA, 9 nt, Homo sapiens
cugagacag

SEQ ID NO: 2066496 - RNA, 18 nt, Homo sapiens
uuugguuuaccuggggau

SEQ ID NO: 2066497 - RNA, 21 nt, Homo sapiens
uaaugauaaaauacuaaacua

SEQ ID NO: 2066498 - RNA, 21 nt, Homo sapiens
ccaaggugugccccgugggca

SEQ ID NO: 2066499 - RNA, 18 nt, Homo sapiens
ggguacagcccuugcacu

SEQ ID NO: 2066500 - RNA, 16 nt, Homo sapiens
ggcguggcccguggcu

SEQ ID NO: 2066501 - RNA, 21 nt, Homo sapiens
cauuaugugugcaugugugua

SEQ ID NO: 2066502 - RNA, 21 nt, Homo sapiens
gauccagggcagcaggccaga

SEQ ID NO: 2066503 - RNA, 16 nt, Homo sapiens
cagucaucaacaauga

SEQ ID NO: 2066504 - RNA, 13 nt, Homo sapiens
uagaauacauuaa

SEQ ID NO: 2066505 - RNA, 20 nt, Homo sapiens
agcaaggguuggaggcaaug

SEQ ID NO: 2066506 - RNA, 21 nt, Homo sapiens
uaaaacauuuaauauuauaua

SEQ ID NO: 2066507 - RNA, 15 nt, Homo sapiens
cuccuccauucccua

SEQ ID NO: 2066508 - RNA, 17 nt, Homo sapiens
ucaaaacaauuggcaaa

SEQ ID NO: 2066509 - RNA, 22 nt, Homo sapiens
aauacauauaucuacacauaca

SEQ ID NO: 2066510 - RNA, 20 nt, Homo sapiens
aaaaaaauuuuaaguaucua

SEQ ID NO: 2066511 - RNA, 14 nt, Homo sapiens
uccaugaugacuua

SEQ ID NO: 2066512 - RNA, 19 nt, Homo sapiens
cuguccucagccuugccag

SEQ ID NO: 2066513 - RNA, 12 nt, Homo sapiens
caucauuacuug

SEQ ID NO: 2066514 - RNA, 16 nt, Homo sapiens
gacagaccaaaaauca

SEQ ID NO: 2066515 - RNA, 22 nt, Homo sapiens
acucucaccgacuuauucugau

SEQ ID NO: 2066516 - RNA, 19 nt, Homo sapiens
gauugaaauuaaacccuga

SEQ ID NO: 2066517 - RNA, 16 nt, Homo sapiens
ugaaaggcagggcaag

SEQ ID NO: 2066518 - RNA, 18 nt, Homo sapiens
uucaagcuuucaaauccu

SEQ ID NO: 2066519 - RNA, 22 nt, Homo sapiens
cuaagggucgaaagcucuagaa

SEQ ID NO: 2066520 - RNA, 16 nt, Homo sapiens
ccugcuggacagccuc

SEQ ID NO: 2066521 - RNA, 19 nt, Homo sapiens
uaaauauacucaaguuuca

SEQ ID NO: 2066522 - RNA, 19 nt, Homo sapiens
gagaggcagauuucaggga

SEQ ID NO: 2066523 - RNA, 21 nt, Homo sapiens
ucagaacaaugaaaaaagucu

SEQ ID NO: 2066524 - RNA, 16 nt, Homo sapiens
cugaagucacaucaca

SEQ ID NO: 2066525 - RNA, 23 nt, Homo sapiens
gccuguuggcaggcccacucccc

SEQ ID NO: 2066526 - RNA, 19 nt, Homo sapiens
uggagugagaugaaggaag

SEQ ID NO: 2066527 - RNA, 17 nt, Homo sapiens
uuuauuuuugagacaga

SEQ ID NO: 2066528 - RNA, 23 nt, Homo sapiens
uagcaggaagcugugagagcagu

SEQ ID NO: 2066529 - RNA, 23 nt, Homo sapiens
ccuggguucuggggcaucagcca

SEQ ID NO: 2066530 - RNA, 14 nt, Homo sapiens
aagugaacucucaa

SEQ ID NO: 2066531 - RNA, 17 nt, Homo sapiens
auggaggcaugccaaau

SEQ ID NO: 2066532 - RNA, 13 nt, Homo sapiens
ugugcauuggaua

SEQ ID NO: 2066533 - RNA, 17 nt, Homo sapiens
cucucacccgaccggug

SEQ ID NO: 2066534 - RNA, 14 nt, Homo sapiens
ugaguuuucaccug

SEQ ID NO: 2066535 - RNA, 17 nt, Homo sapiens
caguggauugcauuucu

SEQ ID NO: 2066536 - RNA, 14 nt, Homo sapiens
uacaauguuaaccc

SEQ ID NO: 2066537 - RNA, 17 nt, Homo sapiens
ugauuucuuaugccugu

SEQ ID NO: 2066538 - RNA, 22 nt, Homo sapiens
aaaccaaacccagccacugcca

SEQ ID NO: 2066539 - RNA, 15 nt, Homo sapiens
cacaaaugcagacac

SEQ ID NO: 2066540 - RNA, 18 nt, Homo sapiens
ggggccuugggugagugg

SEQ ID NO: 2066541 - RNA, 15 nt, Homo sapiens
agaauacuugcacuc

SEQ ID NO: 2066542 - RNA, 18 nt, Homo sapiens
agucugaggccugaguga

SEQ ID NO: 2066543 - RNA, 20 nt, Homo sapiens
ucccagcaccuauugaauua

SEQ ID NO: 2066544 - RNA, 17 nt, Homo sapiens
caugcuguuccaccucc

SEQ ID NO: 2066545 - RNA, 12 nt, Homo sapiens
uggcuuacuucc

SEQ ID NO: 2066546 - RNA, 23 nt, Homo sapiens
agguagauuuaaaauggggugcu

SEQ ID NO: 2066547 - RNA, 18 nt, Homo sapiens
auucucuucgcugugaug

SEQ ID NO: 2066548 - RNA, 21 nt, Homo sapiens
gaggacagggagggaacagac

SEQ ID NO: 2066549 - RNA, 17 nt, Homo sapiens
cuacuauauaugacugg

SEQ ID NO: 2066550 - RNA, 22 nt, Homo sapiens
ugugcugaguugguguugacau

SEQ ID NO: 2066551 - RNA, 16 nt, Homo sapiens
gccucuccagcacuuc

SEQ ID NO: 2066552 - RNA, 14 nt, Homo sapiens
cuucugaucuugga

SEQ ID NO: 2066553 - RNA, 23 nt, Homo sapiens
caccaugcucggcuuuugcauua

SEQ ID NO: 2066554 - RNA, 15 nt, Homo sapiens
agauuguguucuucc

SEQ ID NO: 2066555 - RNA, 13 nt, Homo sapiens
gcaccccggccuc

SEQ ID NO: 2066556 - RNA, 14 nt, Homo sapiens
cauauauuagcacc

SEQ ID NO: 2066557 - RNA, 17 nt, Homo sapiens
gccaaacuguacaguuu

SEQ ID NO: 2066558 - RNA, 13 nt, Homo sapiens
gaaaugaacuugg

SEQ ID NO: 2066559 - RNA, 10 nt, Homo sapiens
aacaaaaagu

SEQ ID NO: 2066560 - RNA, 21 nt, Homo sapiens
cuagcuuagugcuauguguga

SEQ ID NO: 2066561 - RNA, 17 nt, Homo sapiens
uccuccgugcuuccuca

SEQ ID NO: 2066562 - RNA, 14 nt, Homo sapiens
guaggaacugcugg

SEQ ID NO: 2066563 - RNA, 21 nt, Homo sapiens
uuugccagagcgugcuuucaa

SEQ ID NO: 2066564 - RNA, 23 nt, Homo sapiens
cuucauuccaaucuauugcuuca

SEQ ID NO: 2066565 - RNA, 22 nt, Homo sapiens
uucuuacaauaauucuaugaga

SEQ ID NO: 2066566 - RNA, 17 nt, Homo sapiens
ucaucauauguauaugu

SEQ ID NO: 2066567 - RNA, 16 nt, Homo sapiens
guacaaaauugccuau

SEQ ID NO: 2066568 - RNA, 16 nt, Homo sapiens
cuuccagaagcaaaaa

SEQ ID NO: 2066569 - RNA, 12 nt, Homo sapiens
ggauucuauuua

SEQ ID NO: 2066570 - RNA, 12 nt, Homo sapiens
guauucuaugua

SEQ ID NO: 2066571 - RNA, 16 nt, Homo sapiens
auguauuaauaccacu

SEQ ID NO: 2066572 - RNA, 20 nt, Homo sapiens
aaaauucacaagcuaacuuc

SEQ ID NO: 2066573 - RNA, 13 nt, Homo sapiens
ugcaugucccauc

SEQ ID NO: 2066574 - RNA, 19 nt, Homo sapiens
ugaacgcuuaagucaucau

SEQ ID NO: 2066575 - RNA, 19 nt, Homo sapiens
auugaggcuuuaaaacuua

SEQ ID NO: 2066576 - RNA, 16 nt, Homo sapiens
ugcgcucggcaggaag

SEQ ID NO: 2066577 - RNA, 17 nt, Homo sapiens
accugcagcccauggug

SEQ ID NO: 2066578 - RNA, 22 nt, Homo sapiens
ucuuguguuguuuucucugauc

SEQ ID NO: 2066579 - RNA, 20 nt, Homo sapiens
aauucugcccuuuucucuca

SEQ ID NO: 2066580 - RNA, 20 nt, Homo sapiens
gccacucuguaauugcaaaa

SEQ ID NO: 2066581 - RNA, 19 nt, Homo sapiens
auguuagggugcucuggaa

SEQ ID NO: 2066582 - RNA, 15 nt, Homo sapiens
cuaggguuucuuaaa

SEQ ID NO: 2066583 - RNA, 22 nt, Homo sapiens
cagccuuuuauguauuuuccaa

SEQ ID NO: 2066584 - RNA, 11 nt, Homo sapiens
ccacauggugu

SEQ ID NO: 2066585 - RNA, 23 nt, Homo sapiens
ugcagaugagcagucacacuguu

SEQ ID NO: 2066586 - RNA, 20 nt, Homo sapiens
cuggcuucccugcccaaucc

SEQ ID NO: 2066587 - RNA, 19 nt, Homo sapiens
ccacagccgcagcuguaag

SEQ ID NO: 2066588 - RNA, 19 nt, Homo sapiens
cgcacaauaguaaccuggg

SEQ ID NO: 2066589 - RNA, 14 nt, Homo sapiens
uaugaacuugagga

SEQ ID NO: 2066590 - RNA, 13 nt, Homo sapiens
cuucagccauagu

SEQ ID NO: 2066591 - RNA, 17 nt, Homo sapiens
caagauuuuuuuacuua

SEQ ID NO: 2066592 - RNA, 13 nt, Homo sapiens
ggaugucaacagc

SEQ ID NO: 2066593 - RNA, 15 nt, Homo sapiens
cuucaaaacauucuc

SEQ ID NO: 2066594 - RNA, 19 nt, Homo sapiens
cuaagccuuugagacuguu

SEQ ID NO: 2066595 - RNA, 20 nt, Homo sapiens
uaaaucuggcagagccucag

SEQ ID NO: 2066596 - RNA, 17 nt, Homo sapiens
cugauggaaaaugcaaa

SEQ ID NO: 2066597 - RNA, 17 nt, Homo sapiens
guugcauuuagcuucuu

SEQ ID NO: 2066598 - RNA, 22 nt, Homo sapiens
aggcacaggccauuaugccugg

SEQ ID NO: 2066599 - RNA, 16 nt, Homo sapiens
aguggcuucuucauga

SEQ ID NO: 2066600 - RNA, 22 nt, Homo sapiens
aaucuucuacuuuuaacuaaua

SEQ ID NO: 2066601 - RNA, 23 nt, Homo sapiens
ccauuaaaauaaaacaagccuua

SEQ ID NO: 2066602 - RNA, 15 nt, Homo sapiens
uaguaaaugcgugcu

SEQ ID NO: 2066603 - RNA, 14 nt, Homo sapiens
gauuugcauauuca

SEQ ID NO: 2066604 - RNA, 16 nt, Homo sapiens
gcugccucaacacuga

SEQ ID NO: 2066605 - RNA, 14 nt, Homo sapiens
auaaaaaacacuaa

SEQ ID NO: 2066606 - RNA, 23 nt, Homo sapiens
caacauuggagacaucacuugcc

SEQ ID NO: 2066607 - RNA, 22 nt, Homo sapiens
acuuccacaaaauuaugcugca

SEQ ID NO: 2066608 - RNA, 14 nt, Homo sapiens
uuuugagaguauau

SEQ ID NO: 2066609 - RNA, 19 nt, Homo sapiens
agcugcugugccugaugug

SEQ ID NO: 2066610 - RNA, 15 nt, Homo sapiens
aauaaaugucacugc

SEQ ID NO: 2066611 - RNA, 23 nt, Homo sapiens
uuucucuccagcgguccaaaguu

SEQ ID NO: 2066612 - RNA, 16 nt, Homo sapiens
acccuagggauuugca

SEQ ID NO: 2066613 - RNA, 16 nt, Homo sapiens
uccuuagagacaucaa

SEQ ID NO: 2066614 - RNA, 19 nt, Homo sapiens
ucgcuuguaaauaccagga

SEQ ID NO: 2066615 - RNA, 19 nt, Homo sapiens
aguggcaccaccauggcuc

SEQ ID NO: 2066616 - RNA, 15 nt, Homo sapiens
aauauacacauugcu

SEQ ID NO: 2066617 - RNA, 14 nt, Homo sapiens
uuaagcaucagaaa

SEQ ID NO: 2066618 - RNA, 23 nt, Homo sapiens
cccaccucccgguguaugcagug

SEQ ID NO: 2066619 - RNA, 16 nt, Homo sapiens
aaugaugcacauuuca

SEQ ID NO: 2066620 - RNA, 16 nt, Homo sapiens
aaauucauuuuauucu

SEQ ID NO: 2066621 - RNA, 15 nt, Homo sapiens
cauuacuauucacug

SEQ ID NO: 2066622 - RNA, 12 nt, Homo sapiens
caggcacaggcc

SEQ ID NO: 2066623 - RNA, 16 nt, Homo sapiens
ggaccugcaaacgcuu

SEQ ID NO: 2066624 - RNA, 13 nt, Homo sapiens
cagagggacugga

SEQ ID NO: 2066625 - RNA, 12 nt, Homo sapiens
acauuaccauau

SEQ ID NO: 2066626 - RNA, 15 nt, Homo sapiens
caacagaagcaaaaa

SEQ ID NO: 2066627 - RNA, 19 nt, Homo sapiens
agggaagccgccuuugcaa

SEQ ID NO: 2066628 - RNA, 12 nt, Homo sapiens
cuaagugaugcu

SEQ ID NO: 2066629 - RNA, 14 nt, Homo sapiens
cuugccacauuucu

SEQ ID NO: 2066630 - RNA, 23 nt, Homo sapiens
ccaaauuuccaguuuaaguaauu

SEQ ID NO: 2066631 - RNA, 11 nt, Homo sapiens
gacagaauucu

SEQ ID NO: 2066632 - RNA, 15 nt, Homo sapiens
acauuguuaccucua

SEQ ID NO: 2066633 - RNA, 15 nt, Homo sapiens
gacaguauauaacua

SEQ ID NO: 2066634 - RNA, 17 nt, Homo sapiens
ggugaaaauccaucuca

SEQ ID NO: 2066635 - RNA, 20 nt, Homo sapiens
acuaagaugacauugcuaag

SEQ ID NO: 2066636 - RNA, 13 nt, Homo sapiens
accaauauuguac

SEQ ID NO: 2066637 - RNA, 16 nt, Homo sapiens
uagaaccguagguuuu

SEQ ID NO: 2066638 - RNA, 14 nt, Homo sapiens
ugcaccgccucagg

SEQ ID NO: 2066639 - RNA, 21 nt, Homo sapiens
cccagaggcucagcacuuugg

SEQ ID NO: 2066640 - RNA, 19 nt, Homo sapiens
auuuccuccgucaccucag

SEQ ID NO: 2066641 - RNA, 20 nt, Homo sapiens
cucgguauaguuuugucaca

SEQ ID NO: 2066642 - RNA, 20 nt, Homo sapiens
aaccucucgaacaguauuca

SEQ ID NO: 2066643 - RNA, 19 nt, Homo sapiens
ccaaagaaaauuauaguuu

SEQ ID NO: 2066644 - RNA, 19 nt, Homo sapiens
cuaagguagacuacuuugg

SEQ ID NO: 2066645 - RNA, 20 nt, Homo sapiens
aaagaucuugaauagucuca

SEQ ID NO: 2066646 - RNA, 14 nt, Homo sapiens
auauuguagcucaa

SEQ ID NO: 2066647 - RNA, 12 nt, Homo sapiens
gccuuguuucau

SEQ ID NO: 2066648 - RNA, 13 nt, Homo sapiens
ucucucaccucua

SEQ ID NO: 2066649 - RNA, 13 nt, Homo sapiens
uaaaauaacuuca

SEQ ID NO: 2066650 - RNA, 14 nt, Homo sapiens
aacugcuuuuccac

SEQ ID NO: 2066651 - RNA, 16 nt, Homo sapiens
aaaacagccucuuugc

SEQ ID NO: 2066652 - RNA, 12 nt, Homo sapiens
ucuacugugguc

SEQ ID NO: 2066653 - RNA, 20 nt, Homo sapiens
acuaacucacucaauuuucc

SEQ ID NO: 2066654 - RNA, 14 nt, Homo sapiens
ucagggaucucaga

SEQ ID NO: 2066655 - RNA, 21 nt, Homo sapiens
gccagcauuucccuuccuucc

SEQ ID NO: 2066656 - RNA, 10 nt, Homo sapiens
ggacaugucc

SEQ ID NO: 2066657 - RNA, 17 nt, Homo sapiens
accugucuccacugugc

SEQ ID NO: 2066658 - RNA, 23 nt, Homo sapiens
ccaugccccccguggcuggcacc

SEQ ID NO: 2066659 - RNA, 17 nt, Homo sapiens
acauuuaauaaaacugc

SEQ ID NO: 2066660 - RNA, 14 nt, Homo sapiens
guguucuucauuac

SEQ ID NO: 2066661 - RNA, 16 nt, Homo sapiens
cgggucucucacuguu

SEQ ID NO: 2066662 - RNA, 18 nt, Homo sapiens
acagaugccauauagugu

SEQ ID NO: 2066663 - RNA, 16 nt, Homo sapiens
uaccaaacucagguga

SEQ ID NO: 2066664 - RNA, 18 nt, Homo sapiens
caggaggcagcucaggau

SEQ ID NO: 2066665 - RNA, 15 nt, Homo sapiens
caaaaaaaggaagga

SEQ ID NO: 2066666 - RNA, 19 nt, Homo sapiens
ugauguacagucugucaug

SEQ ID NO: 2066667 - RNA, 17 nt, Homo sapiens
cucaucacuacaguauu

SEQ ID NO: 2066668 - RNA, 21 nt, Homo sapiens
uaaaauaaacaugaagcacaa

SEQ ID NO: 2066669 - RNA, 24 nt, Homo sapiens
ucccuggcccccggguguaaauag

SEQ ID NO: 2066670 - RNA, 13 nt, Homo sapiens
auuaaucugccuc

SEQ ID NO: 2066671 - RNA, 15 nt, Homo sapiens
uucaaccuacuuuca

SEQ ID NO: 2066672 - RNA, 18 nt, Homo sapiens
cuugucugucucagcuca

SEQ ID NO: 2066673 - RNA, 21 nt, Homo sapiens
caccuucgccuuugcugaagu

SEQ ID NO: 2066674 - RNA, 23 nt, Homo sapiens
ggagaaaauuggaacucuacuca

SEQ ID NO: 2066675 - RNA, 23 nt, Homo sapiens
agaaaugucauguggcuaccugu

SEQ ID NO: 2066676 - RNA, 19 nt, Homo sapiens
uaucugugaacauguuaag

SEQ ID NO: 2066677 - RNA, 14 nt, Homo sapiens
auuaugaggucaga

SEQ ID NO: 2066678 - RNA, 16 nt, Homo sapiens
gcaacucacacauucc

SEQ ID NO: 2066679 - RNA, 20 nt, Homo sapiens
ggucacaguccuauguacag

SEQ ID NO: 2066680 - RNA, 14 nt, Homo sapiens
acccaggaagggaa

SEQ ID NO: 2066681 - RNA, 15 nt, Homo sapiens
aagaaucaagcuaga

SEQ ID NO: 2066682 - RNA, 23 nt, Homo sapiens
acauuuuuaaaaugcaacaugug

SEQ ID NO: 2066683 - RNA, 18 nt, Homo sapiens
uuucauagcgaguuuucu

SEQ ID NO: 2066684 - RNA, 21 nt, Homo sapiens
cuuagaccaagggaugggacc

SEQ ID NO: 2066685 - RNA, 11 nt, Homo sapiens
gacagcccuuc

SEQ ID NO: 2066686 - RNA, 21 nt, Homo sapiens
ucuuucucuccccaaccccca

SEQ ID NO: 2066687 - RNA, 19 nt, Homo sapiens
ggcccugacucuuccccau

SEQ ID NO: 2066688 - RNA, 15 nt, Homo sapiens
uggugaauccuccag

SEQ ID NO: 2066689 - RNA, 12 nt, Homo sapiens
aacaccugccuc

SEQ ID NO: 2066690 - RNA, 12 nt, Homo sapiens
gagaugcugauu

SEQ ID NO: 2066691 - RNA, 21 nt, Homo sapiens
gaacaggaaugcugggcuguu

SEQ ID NO: 2066692 - RNA, 15 nt, Homo sapiens
ucagcauugugacac

SEQ ID NO: 2066693 - RNA, 18 nt, Homo sapiens
aucuaaggaugucacagg

SEQ ID NO: 2066694 - RNA, 21 nt, Homo sapiens
ucauuuacuuguacgagacag

SEQ ID NO: 2066695 - RNA, 20 nt, Homo sapiens
ugcuuaacuccccacugccu

SEQ ID NO: 2066696 - RNA, 15 nt, Homo sapiens
cagccaagcucugca

SEQ ID NO: 2066697 - RNA, 18 nt, Homo sapiens
gcuuauauuaagcaaaca

SEQ ID NO: 2066698 - RNA, 16 nt, Homo sapiens
aacuggagugguuuga

SEQ ID NO: 2066699 - RNA, 22 nt, Homo sapiens
ucuuaacaacagcuucuugcuu

SEQ ID NO: 2066700 - RNA, 13 nt, Homo sapiens
cccucccuuugaa

SEQ ID NO: 2066701 - RNA, 14 nt, Homo sapiens
ggaaggucagccag

SEQ ID NO: 2066702 - RNA, 15 nt, Homo sapiens
uuucauugauaugaa

SEQ ID NO: 2066703 - RNA, 11 nt, Homo sapiens
uggcucugauu

SEQ ID NO: 2066704 - RNA, 13 nt, Homo sapiens
cuaaugcuuuaag

SEQ ID NO: 2066705 - RNA, 14 nt, Homo sapiens
gaugaaacuggaaa

SEQ ID NO: 2066706 - RNA, 22 nt, Homo sapiens
auuccucugacuugccaaagaa

SEQ ID NO: 2066707 - RNA, 21 nt, Homo sapiens
acaugcuggugaacguguccu

SEQ ID NO: 2066708 - RNA, 23 nt, Homo sapiens
uuaccguucacuuccccuuccaa

SEQ ID NO: 2066709 - RNA, 21 nt, Homo sapiens
gcaggcccuccgcgggggaca

SEQ ID NO: 2066710 - RNA, 21 nt, Homo sapiens
aacacagcuuuacaacuucca

SEQ ID NO: 2066711 - RNA, 14 nt, Homo sapiens
uccaugaagaccac

SEQ ID NO: 2066712 - RNA, 15 nt, Homo sapiens
aucugucccacuggg

SEQ ID NO: 2066713 - RNA, 17 nt, Homo sapiens
caacaaagcaugcucag

SEQ ID NO: 2066714 - RNA, 22 nt, Homo sapiens
uuaaagcucauaaacugccaag

SEQ ID NO: 2066715 - RNA, 17 nt, Homo sapiens
guacaucguuugcaaau

SEQ ID NO: 2066716 - RNA, 23 nt, Homo sapiens
gaagauccacauccucuacaggu

SEQ ID NO: 2066717 - RNA, 19 nt, Homo sapiens
uuuaauuaacuaugugaug

SEQ ID NO: 2066718 - RNA, 14 nt, Homo sapiens
gauccccacgccac

SEQ ID NO: 2066719 - RNA, 14 nt, Homo sapiens
uugcccagugugag

SEQ ID NO: 2066720 - RNA, 23 nt, Homo sapiens
ucacuaaagggugcccacaaaau

SEQ ID NO: 2066721 - RNA, 17 nt, Homo sapiens
cugcucucccuugugga

SEQ ID NO: 2066722 - RNA, 15 nt, Homo sapiens
cucguauuuuguccc

SEQ ID NO: 2066723 - RNA, 13 nt, Homo sapiens
ugggucugagcug

SEQ ID NO: 2066724 - RNA, 13 nt, Homo sapiens
cugccucugguca

SEQ ID NO: 2066725 - RNA, 23 nt, Homo sapiens
caaucauagccaagaucccaucu

SEQ ID NO: 2066726 - RNA, 15 nt, Homo sapiens
caucuggacacuggg

SEQ ID NO: 2066727 - RNA, 17 nt, Homo sapiens
uuaaauaaaucauaaaa

SEQ ID NO: 2066728 - RNA, 21 nt, Homo sapiens
gcugcuauuuuacugucuuaa

SEQ ID NO: 2066729 - RNA, 17 nt, Homo sapiens
ccugcagucccccgaga

SEQ ID NO: 2066730 - RNA, 18 nt, Homo sapiens
cuuuguauuguauauuac

SEQ ID NO: 2066731 - RNA, 23 nt, Homo sapiens
caugucagcaucagcucagggcu

SEQ ID NO: 2066732 - RNA, 23 nt, Homo sapiens
cuaaguuaaacagucaguaugca

SEQ ID NO: 2066733 - RNA, 15 nt, Homo sapiens
augaaggacuauuaa

SEQ ID NO: 2066734 - RNA, 17 nt, Homo sapiens
aguaagcaaagacuuuc

SEQ ID NO: 2066735 - RNA, 18 nt, Homo sapiens
agccugcucuaaggcagu

SEQ ID NO: 2066736 - RNA, 15 nt, Homo sapiens
uccaaaauugcaaac

SEQ ID NO: 2066737 - RNA, 15 nt, Homo sapiens
agacagcuacacaga

SEQ ID NO: 2066738 - RNA, 16 nt, Homo sapiens
ccccuucucucaucuc

SEQ ID NO: 2066739 - RNA, 22 nt, Homo sapiens
ucaagaacaugaugggccugaa

SEQ ID NO: 2066740 - RNA, 13 nt, Homo sapiens
cagugauucagca

SEQ ID NO: 2066741 - RNA, 19 nt, Homo sapiens
gacuagccaucucaagcaa

SEQ ID NO: 2066742 - RNA, 13 nt, Homo sapiens
aagacuaggauau

SEQ ID NO: 2066743 - RNA, 15 nt, Homo sapiens
ccuccaguccuuaau

SEQ ID NO: 2066744 - RNA, 15 nt, Homo sapiens
ucaacucaaccugga

SEQ ID NO: 2066745 - RNA, 18 nt, Homo sapiens
agaaccagcagaagccag

SEQ ID NO: 2066746 - RNA, 23 nt, Homo sapiens
gguugaaaaaauagauccaauca

SEQ ID NO: 2066747 - RNA, 20 nt, Homo sapiens
gaaaaggaggggacgggaca

SEQ ID NO: 2066748 - RNA, 17 nt, Homo sapiens
cacagaaggugaacuuu

SEQ ID NO: 2066749 - RNA, 15 nt, Homo sapiens
gaaguagcugggauu

SEQ ID NO: 2066750 - RNA, 16 nt, Homo sapiens
guucuuuugacuuaau

SEQ ID NO: 2066751 - RNA, 22 nt, Homo sapiens
auucugguauacauugaauuca

SEQ ID NO: 2066752 - RNA, 12 nt, Homo sapiens
uugcacuaugaa

SEQ ID NO: 2066753 - RNA, 17 nt, Homo sapiens
gaucagauugcauguga

SEQ ID NO: 2066754 - RNA, 23 nt, Homo sapiens
ugcuuugggcuugggccuaggcu

SEQ ID NO: 2066755 - RNA, 23 nt, Homo sapiens
caauuauuucagucaucaucuca

SEQ ID NO: 2066756 - RNA, 20 nt, Homo sapiens
aauacccguugauaacucag

SEQ ID NO: 2066757 - RNA, 15 nt, Homo sapiens
auaaaagacaaaugc

SEQ ID NO: 2066758 - RNA, 22 nt, Homo sapiens
gaccucccaacucuaaagccaa

SEQ ID NO: 2066759 - RNA, 17 nt, Homo sapiens
uucuuuuccuaacaugc

SEQ ID NO: 2066760 - RNA, 18 nt, Homo sapiens
augagagggaugaggcaa

SEQ ID NO: 2066761 - RNA, 10 nt, Homo sapiens
cacuguccag

SEQ ID NO: 2066762 - RNA, 21 nt, Homo sapiens
uauugaauacuuacauucucu

SEQ ID NO: 2066763 - RNA, 16 nt, Homo sapiens
ucuuuccacucuggau

SEQ ID NO: 2066764 - RNA, 15 nt, Homo sapiens
cuguccuaagcacuu

SEQ ID NO: 2066765 - RNA, 14 nt, Homo sapiens
cagaagugaccaaa

SEQ ID NO: 2066766 - RNA, 19 nt, Homo sapiens
ccgcaugcagcagcuugcu

SEQ ID NO: 2066767 - RNA, 20 nt, Homo sapiens
accauuuuaagucccuguca

SEQ ID NO: 2066768 - RNA, 17 nt, Homo sapiens
agagcaaucaaagcagc

SEQ ID NO: 2066769 - RNA, 21 nt, Homo sapiens
gauaucuauuugaaaguucuc

SEQ ID NO: 2066770 - RNA, 15 nt, Homo sapiens
aguuuuaaguccagc

SEQ ID NO: 2066771 - RNA, 16 nt, Homo sapiens
cuuauccaucuuugaa

SEQ ID NO: 2066772 - RNA, 14 nt, Homo sapiens
gacuucuucccaag

SEQ ID NO: 2066773 - RNA, 16 nt, Homo sapiens
auacucaagagcauaa

SEQ ID NO: 2066774 - RNA, 16 nt, Homo sapiens
aaguauaaguauucaa

SEQ ID NO: 2066775 - RNA, 17 nt, Homo sapiens
aaucuuuuaaaucuuug

SEQ ID NO: 2066776 - RNA, 22 nt, Homo sapiens
aucucugauucccugauuuaau

SEQ ID NO: 2066777 - RNA, 17 nt, Homo sapiens
ccauguaaauugcaaau

SEQ ID NO: 2066778 - RNA, 19 nt, Homo sapiens
caguuccaggccugaucuu

SEQ ID NO: 2066779 - RNA, 18 nt, Homo sapiens
gucuauuuuuucuugaca

SEQ ID NO: 2066780 - RNA, 21 nt, Homo sapiens
agacuuaaaaaauacuugcau

SEQ ID NO: 2066781 - RNA, 16 nt, Homo sapiens
uguuuuuuccuaagga

SEQ ID NO: 2066782 - RNA, 19 nt, Homo sapiens
cuccuguuuuuugaugcuu

SEQ ID NO: 2066783 - RNA, 21 nt, Homo sapiens
ugccuuugcccacguguccug

SEQ ID NO: 2066784 - RNA, 21 nt, Homo sapiens
ucugaaacccacagaugucuc

SEQ ID NO: 2066785 - RNA, 16 nt, Homo sapiens
acaccccagcuccuag

SEQ ID NO: 2066786 - RNA, 15 nt, Homo sapiens
caaauaaaugaacug

SEQ ID NO: 2066787 - RNA, 16 nt, Homo sapiens
cccaucuucgggacca

SEQ ID NO: 2066788 - RNA, 15 nt, Homo sapiens
gucccgggcacuguc

SEQ ID NO: 2066789 - RNA, 15 nt, Homo sapiens
uuuaaaauaugcucu

SEQ ID NO: 2066790 - RNA, 15 nt, Homo sapiens
accuguucaaaaagg

SEQ ID NO: 2066791 - RNA, 22 nt, Homo sapiens
uguuucuauauuggucauugcc

SEQ ID NO: 2066792 - RNA, 19 nt, Homo sapiens
ccuauagucgcagcuacua

SEQ ID NO: 2066793 - RNA, 20 nt, Homo sapiens
cugaaauacguggcauuauu

SEQ ID NO: 2066794 - RNA, 18 nt, Homo sapiens
aagcagcacacauugugu

SEQ ID NO: 2066795 - RNA, 13 nt, Homo sapiens
uugcugugaauua

SEQ ID NO: 2066796 - RNA, 17 nt, Homo sapiens
auuuucucucaggugaa

SEQ ID NO: 2066797 - RNA, 16 nt, Homo sapiens
auacacugucacgugg

SEQ ID NO: 2066798 - RNA, 17 nt, Homo sapiens
uccugccucuuguuucu

SEQ ID NO: 2066799 - RNA, 20 nt, Homo sapiens
cugacagaugaccgcaauaa

SEQ ID NO: 2066800 - RNA, 22 nt, Homo sapiens
cuuccagauggucauccagacu

SEQ ID NO: 2066801 - RNA, 18 nt, Homo sapiens
uacaaguuccaacaugca

SEQ ID NO: 2066802 - RNA, 23 nt, Homo sapiens
acuuguguuuuauuaacauugau

SEQ ID NO: 2066803 - RNA, 15 nt, Homo sapiens
uuaaaauaguuuucu

SEQ ID NO: 2066804 - RNA, 17 nt, Homo sapiens
caguauauuuauaguca

SEQ ID NO: 2066805 - RNA, 22 nt, Homo sapiens
uacugaauuuugagucuauccu

SEQ ID NO: 2066806 - RNA, 20 nt, Homo sapiens
uauuguaaaugagugccaca

SEQ ID NO: 2066807 - RNA, 12 nt, Homo sapiens
cuaugcauuuga

SEQ ID NO: 2066808 - RNA, 16 nt, Homo sapiens
uuugaauaccauuugg

SEQ ID NO: 2066809 - RNA, 17 nt, Homo sapiens
cucugcaaaccaacagg

SEQ ID NO: 2066810 - RNA, 19 nt, Homo sapiens
aguaaaaacuguucucuau

SEQ ID NO: 2066811 - RNA, 23 nt, Homo sapiens
auuucuuuauggucgauauacaa

SEQ ID NO: 2066812 - RNA, 21 nt, Homo sapiens
cugggagaguggaccugugcu

SEQ ID NO: 2066813 - RNA, 18 nt, Homo sapiens
acucagggcagcugccug

SEQ ID NO: 2066814 - RNA, 23 nt, Homo sapiens
uggcuucacagaugugugauuca

SEQ ID NO: 2066815 - RNA, 15 nt, Homo sapiens
ucauacuggugauua

SEQ ID NO: 2066816 - RNA, 16 nt, Homo sapiens
uguuauugauguugcu

SEQ ID NO: 2066817 - RNA, 18 nt, Homo sapiens
uauuacuaguacuauuac

SEQ ID NO: 2066818 - RNA, 14 nt, Homo sapiens
guucuucuggugag

SEQ ID NO: 2066819 - RNA, 17 nt, Homo sapiens
cuguccuugaaugccau

SEQ ID NO: 2066820 - RNA, 15 nt, Homo sapiens
aaacuaaaaagccau

SEQ ID NO: 2066821 - RNA, 16 nt, Homo sapiens
aagcagagugaaauuc

SEQ ID NO: 2066822 - RNA, 11 nt, Homo sapiens
uacaggacaag

SEQ ID NO: 2066823 - RNA, 14 nt, Homo sapiens
uguuaaauucaaug

SEQ ID NO: 2066824 - RNA, 20 nt, Homo sapiens
auucucccaaaguaccuuga

SEQ ID NO: 2066825 - RNA, 22 nt, Homo sapiens
ggcuucccacagccucuuccuc

SEQ ID NO: 2066826 - RNA, 15 nt, Homo sapiens
gagggccucaucuca

SEQ ID NO: 2066827 - RNA, 22 nt, Homo sapiens
acaguuugccugcuguauuuau

SEQ ID NO: 2066828 - RNA, 14 nt, Homo sapiens
uccuccccaccaga

SEQ ID NO: 2066829 - RNA, 15 nt, Homo sapiens
cugggcuacugccac

SEQ ID NO: 2066830 - RNA, 22 nt, Homo sapiens
uuaauauuuauaggucacuuug

SEQ ID NO: 2066831 - RNA, 18 nt, Homo sapiens
agcuuccauuaugcugca

SEQ ID NO: 2066832 - RNA, 20 nt, Homo sapiens
uggguuauucagaaccuaaa

SEQ ID NO: 2066833 - RNA, 19 nt, Homo sapiens
caaaaaugauccucagugc

SEQ ID NO: 2066834 - RNA, 16 nt, Homo sapiens
ugcacucucucucugu

SEQ ID NO: 2066835 - RNA, 16 nt, Homo sapiens
cagagaaacccaggga

SEQ ID NO: 2066836 - RNA, 16 nt, Homo sapiens
gggccccgucucaggu

SEQ ID NO: 2066837 - RNA, 21 nt, Homo sapiens
gaaguucauuuggagagucaa

SEQ ID NO: 2066838 - RNA, 12 nt, Homo sapiens
aguucacaucag

SEQ ID NO: 2066839 - RNA, 19 nt, Homo sapiens
gacaguuuuugacauuuau

SEQ ID NO: 2066840 - RNA, 11 nt, Homo sapiens
caacacaguga

SEQ ID NO: 2066841 - RNA, 14 nt, Homo sapiens
acauuuaugugcug

SEQ ID NO: 2066842 - RNA, 19 nt, Homo sapiens
ucuuccucuagacuuggag

SEQ ID NO: 2066843 - RNA, 15 nt, Homo sapiens
uaagcugcugaaugc

SEQ ID NO: 2066844 - RNA, 12 nt, Homo sapiens
uguacagccuuu

SEQ ID NO: 2066845 - RNA, 15 nt, Homo sapiens
ugaucuauuaaggga

SEQ ID NO: 2066846 - RNA, 18 nt, Homo sapiens
cauaaacaugcauuguga

SEQ ID NO: 2066847 - RNA, 23 nt, Homo sapiens
uuuccaguuuauaagacuggaau

SEQ ID NO: 2066848 - RNA, 12 nt, Homo sapiens
cugcuuggucaa

SEQ ID NO: 2066849 - RNA, 14 nt, Homo sapiens
uaaaaaucugccac

SEQ ID NO: 2066850 - RNA, 19 nt, Homo sapiens
auuuuuguggaagcacuug

SEQ ID NO: 2066851 - RNA, 17 nt, Homo sapiens
gacacauacaugucaca

SEQ ID NO: 2066852 - RNA, 13 nt, Homo sapiens
uuuauaucucuca

SEQ ID NO: 2066853 - RNA, 13 nt, Homo sapiens
uccauaucuucca

SEQ ID NO: 2066854 - RNA, 21 nt, Homo sapiens
ccagcuacuugggaggcugag

SEQ ID NO: 2066855 - RNA, 14 nt, Homo sapiens
cuauggacagggcu

SEQ ID NO: 2066856 - RNA, 21 nt, Homo sapiens
caaacauguguguacaugugc

SEQ ID NO: 2066857 - RNA, 13 nt, Homo sapiens
agcugaccagaca

SEQ ID NO: 2066858 - RNA, 19 nt, Homo sapiens
cccgaauucuaugagcaug

SEQ ID NO: 2066859 - RNA, 21 nt, Homo sapiens
agagugccagucagcagucau

SEQ ID NO: 2066860 - RNA, 19 nt, Homo sapiens
uguacagaaaguaucacaa

SEQ ID NO: 2066861 - RNA, 14 nt, Homo sapiens
ugaugggguggaag

SEQ ID NO: 2066862 - RNA, 16 nt, Homo sapiens
augcccgccagugcac

SEQ ID NO: 2066863 - RNA, 15 nt, Homo sapiens
uuuaagcgauucucu

SEQ ID NO: 2066864 - RNA, 17 nt, Homo sapiens
uauaguacugacagaua

SEQ ID NO: 2066865 - RNA, 24 nt, Homo sapiens
cuucagauggugaagcauucuccc

SEQ ID NO: 2066866 - RNA, 17 nt, Homo sapiens
accuucuuucuggacug

SEQ ID NO: 2066867 - RNA, 19 nt, Homo sapiens
accaaaaugacaaugauga

SEQ ID NO: 2066868 - RNA, 17 nt, Homo sapiens
uaaacauguuuccacua

SEQ ID NO: 2066869 - RNA, 16 nt, Homo sapiens
ccuguguucugcacau

SEQ ID NO: 2066870 - RNA, 18 nt, Homo sapiens
ugccuaucuucuuucaca

SEQ ID NO: 2066871 - RNA, 16 nt, Homo sapiens
ugagcuaugcaaacaa

SEQ ID NO: 2066872 - RNA, 20 nt, Homo sapiens
aauagaaaagucuccacccc

SEQ ID NO: 2066873 - RNA, 18 nt, Homo sapiens
ccacuuucaccaguuucu

SEQ ID NO: 2066874 - RNA, 18 nt, Homo sapiens
agcacauaccaugugcca

SEQ ID NO: 2066875 - RNA, 23 nt, Homo sapiens
cacaaagcuuuugcauauugcau

SEQ ID NO: 2066876 - RNA, 13 nt, Homo sapiens
cugcacauuccug

SEQ ID NO: 2066877 - RNA, 13 nt, Homo sapiens
cugugcauuccca

SEQ ID NO: 2066878 - RNA, 17 nt, Homo sapiens
uagcuuagcaucagagg

SEQ ID NO: 2066879 - RNA, 21 nt, Homo sapiens
aacuccugaccucaggugauu

SEQ ID NO: 2066880 - RNA, 11 nt, Homo sapiens
uugggcuguga

SEQ ID NO: 2066881 - RNA, 13 nt, Homo sapiens
gaaguuuccucau

SEQ ID NO: 2066882 - RNA, 16 nt, Homo sapiens
agucgugacuaucuau

SEQ ID NO: 2066883 - RNA, 20 nt, Homo sapiens
cuuacuuuaccucucuguca

SEQ ID NO: 2066884 - RNA, 13 nt, Homo sapiens
cuugucugcuaaa

SEQ ID NO: 2066885 - RNA, 16 nt, Homo sapiens
gguauggcagaggugc

SEQ ID NO: 2066886 - RNA, 18 nt, Homo sapiens
cuacuuuuggugcuuaaa

SEQ ID NO: 2066887 - RNA, 18 nt, Homo sapiens
ugacaaucaacucuaaua

SEQ ID NO: 2066888 - RNA, 22 nt, Homo sapiens
uaaagacauucuuauauuucau

SEQ ID NO: 2066889 - RNA, 15 nt, Homo sapiens
ucuagaggcaaggag

SEQ ID NO: 2066890 - RNA, 17 nt, Homo sapiens
acccaaugccugugaag

SEQ ID NO: 2066891 - RNA, 17 nt, Homo sapiens
aauuuccuaugccuguc

SEQ ID NO: 2066892 - RNA, 18 nt, Homo sapiens
uauccaauaggcauuuga

SEQ ID NO: 2066893 - RNA, 21 nt, Homo sapiens
ugguggagucaggaaagacag

SEQ ID NO: 2066894 - RNA, 22 nt, Homo sapiens
ucacccacaucuaaugucucuu

SEQ ID NO: 2066895 - RNA, 18 nt, Homo sapiens
uagacugaggagcccucu

SEQ ID NO: 2066896 - RNA, 18 nt, Homo sapiens
acugcuggacgucuuucu

SEQ ID NO: 2066897 - RNA, 19 nt, Homo sapiens
uaccuaguagucauuucau

SEQ ID NO: 2066898 - RNA, 21 nt, Homo sapiens
cauggaucagcucuuccugug

SEQ ID NO: 2066899 - RNA, 20 nt, Homo sapiens
auagcaauuccccuacauca

SEQ ID NO: 2066900 - RNA, 19 nt, Homo sapiens
cucuguaaguguagcucaa

SEQ ID NO: 2066901 - RNA, 14 nt, Homo sapiens
cagcuuaugagcuc

SEQ ID NO: 2066902 - RNA, 14 nt, Homo sapiens
cuuaauauguuaac

SEQ ID NO: 2066903 - RNA, 19 nt, Homo sapiens
aaguugaaugggcacagca

SEQ ID NO: 2066904 - RNA, 13 nt, Homo sapiens
aaauaaaacccaa

SEQ ID NO: 2066905 - RNA, 15 nt, Homo sapiens
cuccauuugagaaaa

SEQ ID NO: 2066906 - RNA, 16 nt, Homo sapiens
cuaugugaaacuugaa

SEQ ID NO: 2066907 - RNA, 22 nt, Homo sapiens
gggccaguuggucccccuucca

SEQ ID NO: 2066908 - RNA, 18 nt, Homo sapiens
gagaagucagcuacucua

SEQ ID NO: 2066909 - RNA, 22 nt, Homo sapiens
uacgcuuuuauuggaaauguga

SEQ ID NO: 2066910 - RNA, 16 nt, Homo sapiens
ccuggacaaccagagg

SEQ ID NO: 2066911 - RNA, 14 nt, Homo sapiens
guccacacaucucc

SEQ ID NO: 2066912 - RNA, 15 nt, Homo sapiens
augucauacagagaa

SEQ ID NO: 2066913 - RNA, 22 nt, Homo sapiens
agaagcccugauguguccucag

SEQ ID NO: 2066914 - RNA, 22 nt, Homo sapiens
uggugcacuuuucugugucaua

SEQ ID NO: 2066915 - RNA, 14 nt, Homo sapiens
auuucuaacaguac

SEQ ID NO: 2066916 - RNA, 18 nt, Homo sapiens
gugcuauaacauucugac

SEQ ID NO: 2066917 - RNA, 15 nt, Homo sapiens
ucuucucagcuccca

SEQ ID NO: 2066918 - RNA, 13 nt, Homo sapiens
uuacugaugugau

SEQ ID NO: 2066919 - RNA, 14 nt, Homo sapiens
uguccauaaauaaa

SEQ ID NO: 2066920 - RNA, 14 nt, Homo sapiens
agagaaguacuauc

SEQ ID NO: 2066921 - RNA, 19 nt, Homo sapiens
gccggcagaaguuugccau

SEQ ID NO: 2066922 - RNA, 20 nt, Homo sapiens
aaugaggcagauagcacugg

SEQ ID NO: 2066923 - RNA, 16 nt, Homo sapiens
caggcccuucucuaca

SEQ ID NO: 2066924 - RNA, 18 nt, Homo sapiens
acauuuuguaacaaagaa

SEQ ID NO: 2066925 - RNA, 16 nt, Homo sapiens
aguuuaguauagcuuc

SEQ ID NO: 2066926 - RNA, 19 nt, Homo sapiens
acuuacaggccuugcucac

SEQ ID NO: 2066927 - RNA, 14 nt, Homo sapiens
aaaucaggggccag

SEQ ID NO: 2066928 - RNA, 17 nt, Homo sapiens
gaauuguggaguguuuu

SEQ ID NO: 2066929 - RNA, 17 nt, Homo sapiens
cauucuuguucagauua

SEQ ID NO: 2066930 - RNA, 18 nt, Homo sapiens
uuacaguccaaaauacug

SEQ ID NO: 2066931 - RNA, 21 nt, Homo sapiens
agcuuucccugccucucauca

SEQ ID NO: 2066932 - RNA, 14 nt, Homo sapiens
uuucuaaacuacaa

SEQ ID NO: 2066933 - RNA, 16 nt, Homo sapiens
ccucuucccugaccuc

SEQ ID NO: 2066934 - RNA, 22 nt, Homo sapiens
auguacaauauuuuaagcauua

SEQ ID NO: 2066935 - RNA, 14 nt, Homo sapiens
ugaguccauuagcu

SEQ ID NO: 2066936 - RNA, 23 nt, Homo sapiens
uacauaacguucaguugggaugg

SEQ ID NO: 2066937 - RNA, 21 nt, Homo sapiens
gacagguguauggagucaccu

SEQ ID NO: 2066938 - RNA, 16 nt, Homo sapiens
cuggaaagaaaaccau

SEQ ID NO: 2066939 - RNA, 13 nt, Homo sapiens
uguagauuucaag

SEQ ID NO: 2066940 - RNA, 17 nt, Homo sapiens
cuuuuuuguacuuuucu

SEQ ID NO: 2066941 - RNA, 21 nt, Homo sapiens
auuuguuauagcaauguaaca

SEQ ID NO: 2066942 - RNA, 22 nt, Homo sapiens
gcgcagcgcgugcggugcaaag

SEQ ID NO: 2066943 - RNA, 14 nt, Homo sapiens
caaaaucuuuccaa

SEQ ID NO: 2066944 - RNA, 14 nt, Homo sapiens
ugccuuauguaauu

SEQ ID NO: 2066945 - RNA, 14 nt, Homo sapiens
ggaaauauuuccau

SEQ ID NO: 2066946 - RNA, 18 nt, Homo sapiens
ugguacuuuuaugaugua

SEQ ID NO: 2066947 - RNA, 19 nt, Homo sapiens
acauccgcgugugccugug

SEQ ID NO: 2066948 - RNA, 13 nt, Homo sapiens
caacuaugauuau

SEQ ID NO: 2066949 - RNA, 19 nt, Homo sapiens
uuuaugcaaauacaaucag

SEQ ID NO: 2066950 - RNA, 15 nt, Homo sapiens
gaaauagacaguaua

SEQ ID NO: 2066951 - RNA, 22 nt, Homo sapiens
guuugucccagcgauggugccu

SEQ ID NO: 2066952 - RNA, 20 nt, Homo sapiens
gauuuuuguuuuccacugug

SEQ ID NO: 2066953 - RNA, 19 nt, Homo sapiens
aaaugauaaggcucugaaa

SEQ ID NO: 2066954 - RNA, 16 nt, Homo sapiens
ugcuggaauuccuaac

SEQ ID NO: 2066955 - RNA, 15 nt, Homo sapiens
ugagauaaaugcaca

SEQ ID NO: 2066956 - RNA, 17 nt, Homo sapiens
cccaaggcaguguuccu

SEQ ID NO: 2066957 - RNA, 14 nt, Homo sapiens
auuuuaaguaggaa

SEQ ID NO: 2066958 - RNA, 22 nt, Homo sapiens
cugaauaaacucaaaacucuug

SEQ ID NO: 2066959 - RNA, 22 nt, Homo sapiens
ugauucuuauuugaugguggua

SEQ ID NO: 2066960 - RNA, 16 nt, Homo sapiens
agauuggaccagugcu

SEQ ID NO: 2066961 - RNA, 14 nt, Homo sapiens
uuuaugagguugau

SEQ ID NO: 2066962 - RNA, 19 nt, Homo sapiens
cugcccuguacugaagaaa

SEQ ID NO: 2066963 - RNA, 17 nt, Homo sapiens
cuucaagaacuuucucu

SEQ ID NO: 2066964 - RNA, 19 nt, Homo sapiens
ggaucugucauuaucaaaa

SEQ ID NO: 2066965 - RNA, 14 nt, Homo sapiens
guacuuuaccugaa

SEQ ID NO: 2066966 - RNA, 21 nt, Homo sapiens
gccaaauaggagggagacugu

SEQ ID NO: 2066967 - RNA, 23 nt, Homo sapiens
aauuauaucuguuuuguuucuug

SEQ ID NO: 2066968 - RNA, 22 nt, Homo sapiens
cuaguacuauugcuauuacuag

SEQ ID NO: 2066969 - RNA, 21 nt, Homo sapiens
agggaacccucuaagggaccu

SEQ ID NO: 2066970 - RNA, 15 nt, Homo sapiens
gaccucacaguacug

SEQ ID NO: 2066971 - RNA, 15 nt, Homo sapiens
cugauccuugcacgc

SEQ ID NO: 2066972 - RNA, 19 nt, Homo sapiens
cccaguuuccuggggcaca

SEQ ID NO: 2066973 - RNA, 12 nt, Homo sapiens
gaagcucucgau

SEQ ID NO: 2066974 - RNA, 18 nt, Homo sapiens
cuccugacgucaagugau

SEQ ID NO: 2066975 - RNA, 16 nt, Homo sapiens
ggaagggcugggccac

SEQ ID NO: 2066976 - RNA, 18 nt, Homo sapiens
cuacaaaggaaauaucaa

SEQ ID NO: 2066977 - RNA, 18 nt, Homo sapiens
guaaauuuuauaauguca

SEQ ID NO: 2066978 - RNA, 20 nt, Homo sapiens
ucagccuagccgaccucagc

SEQ ID NO: 2066979 - RNA, 20 nt, Homo sapiens
cauaccguuuauaaugccau

SEQ ID NO: 2066980 - RNA, 16 nt, Homo sapiens
ccuggagccucagcag

SEQ ID NO: 2066981 - RNA, 19 nt, Homo sapiens
gaaacaagcaacagaugga

SEQ ID NO: 2066982 - RNA, 18 nt, Homo sapiens
gaaggagaaucaucagga

SEQ ID NO: 2066983 - RNA, 18 nt, Homo sapiens
ucaggaaaacuacugaua

SEQ ID NO: 2066984 - RNA, 21 nt, Homo sapiens
uacugaaaaggaggggucugg

SEQ ID NO: 2066985 - RNA, 13 nt, Homo sapiens
uuccuuuugcaca

SEQ ID NO: 2066986 - RNA, 14 nt, Homo sapiens
cuuuuaaaauucac

SEQ ID NO: 2066987 - RNA, 20 nt, Homo sapiens
auacacagaugauaauaugc

SEQ ID NO: 2066988 - RNA, 21 nt, Homo sapiens
agcuacucuccccacgagggc

SEQ ID NO: 2066989 - RNA, 13 nt, Homo sapiens
augagacuguuua

SEQ ID NO: 2066990 - RNA, 16 nt, Homo sapiens
gauuucuuaaugcuau

SEQ ID NO: 2066991 - RNA, 18 nt, Homo sapiens
acuuuaagucucacccau

SEQ ID NO: 2066992 - RNA, 17 nt, Homo sapiens
cagaauucuaagcuggu

SEQ ID NO: 2066993 - RNA, 19 nt, Homo sapiens
gacacuccccgaagucuuu

SEQ ID NO: 2066994 - RNA, 17 nt, Homo sapiens
acccagcucuacuccag

SEQ ID NO: 2066995 - RNA, 19 nt, Homo sapiens
gagaggagagaaugagaga

SEQ ID NO: 2066996 - RNA, 16 nt, Homo sapiens
ccacccauggggagga

SEQ ID NO: 2066997 - RNA, 20 nt, Homo sapiens
acucaccagccccacugcca

SEQ ID NO: 2066998 - RNA, 17 nt, Homo sapiens
ugcuucaaaugauccuu

SEQ ID NO: 2066999 - RNA, 18 nt, Homo sapiens
augcuuuuggggggcaua

SEQ ID NO: 2067000 - RNA, 21 nt, Homo sapiens
gaagauggauugguguaaaag

SEQ ID NO: 2067001 - RNA, 15 nt, Homo sapiens
acauuuagucuuccu

SEQ ID NO: 2067002 - RNA, 20 nt, Homo sapiens
caggguucuaaccuuucuaa

SEQ ID NO: 2067003 - RNA, 17 nt, Homo sapiens
cuguguguuugugugua

SEQ ID NO: 2067004 - RNA, 19 nt, Homo sapiens
aacauguguguacaugugc

SEQ ID NO: 2067005 - RNA, 17 nt, Homo sapiens
caccuuuccagccauag

SEQ ID NO: 2067006 - RNA, 17 nt, Homo sapiens
gaagguggcuacaaaga

SEQ ID NO: 2067007 - RNA, 13 nt, Homo sapiens
acaggagaccacc

SEQ ID NO: 2067008 - RNA, 23 nt, Homo sapiens
uaaaaaaaaaaaaaacauugugu

SEQ ID NO: 2067009 - RNA, 19 nt, Homo sapiens
ccauaaauaaaaguacagu

SEQ ID NO: 2067010 - RNA, 19 nt, Homo sapiens
aauucuuagcauacauuca

SEQ ID NO: 2067011 - RNA, 18 nt, Homo sapiens
aggaugggguucuugucc

SEQ ID NO: 2067012 - RNA, 16 nt, Homo sapiens
gaacuccugaccucag

SEQ ID NO: 2067013 - RNA, 16 nt, Homo sapiens
acaagaagaccagacu

SEQ ID NO: 2067014 - RNA, 13 nt, Homo sapiens
ugaauuuaauaca

SEQ ID NO: 2067015 - RNA, 21 nt, Homo sapiens
ucucuccaggccccaggucau

SEQ ID NO: 2067016 - RNA, 20 nt, Homo sapiens
acuagccuuuggcucuggag

SEQ ID NO: 2067017 - RNA, 22 nt, Homo sapiens
augaucuuggcuuuccuauaag

SEQ ID NO: 2067018 - RNA, 19 nt, Homo sapiens
guacaaaagagaagcaaaa

SEQ ID NO: 2067019 - RNA, 20 nt, Homo sapiens
cacaauagcaguugaaacaa

SEQ ID NO: 2067020 - RNA, 21 nt, Homo sapiens
cccuugcuuagccugugcugg

SEQ ID NO: 2067021 - RNA, 21 nt, Homo sapiens
uuggccuagucagauggaugu

SEQ ID NO: 2067022 - RNA, 13 nt, Homo sapiens
acaaacagugcac

SEQ ID NO: 2067023 - RNA, 14 nt, Homo sapiens
uuaagcacugugga

SEQ ID NO: 2067024 - RNA, 13 nt, Homo sapiens
aaagaaccacuug

SEQ ID NO: 2067025 - RNA, 15 nt, Homo sapiens
ugaccucacgugcaa

SEQ ID NO: 2067026 - RNA, 18 nt, Homo sapiens
aaucucguuucuccucuu

SEQ ID NO: 2067027 - RNA, 20 nt, Homo sapiens
guuccucauggcuguuaucu

SEQ ID NO: 2067028 - RNA, 14 nt, Homo sapiens
aagcgucugugcau

SEQ ID NO: 2067029 - RNA, 23 nt, Homo sapiens
gaacuuuuucgauaaacuaacua

SEQ ID NO: 2067030 - RNA, 17 nt, Homo sapiens
uacauagccaccuguca

SEQ ID NO: 2067031 - RNA, 17 nt, Homo sapiens
guucauauuaugucaug

SEQ ID NO: 2067032 - RNA, 17 nt, Homo sapiens
ugucaaaacuacugaca

SEQ ID NO: 2067033 - RNA, 12 nt, Homo sapiens
gaccaggucuca

SEQ ID NO: 2067034 - RNA, 22 nt, Homo sapiens
gccagugguguuacacauugag

SEQ ID NO: 2067035 - RNA, 14 nt, Homo sapiens
cugccccagacaga

SEQ ID NO: 2067036 - RNA, 20 nt, Homo sapiens
accugaucaaugacagagcc

SEQ ID NO: 2067037 - RNA, 17 nt, Homo sapiens
ggcaagguuaagccuuu

SEQ ID NO: 2067038 - RNA, 15 nt, Homo sapiens
gcagacaaguggaca

SEQ ID NO: 2067039 - RNA, 15 nt, Homo sapiens
augaaacaacaaaac

SEQ ID NO: 2067040 - RNA, 15 nt, Homo sapiens
cuuugaaaacaauuc

SEQ ID NO: 2067041 - RNA, 21 nt, Homo sapiens
ccugcagagccucuacacaga

SEQ ID NO: 2067042 - RNA, 21 nt, Homo sapiens
uauuaaucauacaaacucuca

SEQ ID NO: 2067043 - RNA, 23 nt, Homo sapiens
aaccgccggccacacuggucaca

SEQ ID NO: 2067044 - RNA, 12 nt, Homo sapiens
guaucucuuaca

SEQ ID NO: 2067045 - RNA, 16 nt, Homo sapiens
uuccuuggaacacaua

SEQ ID NO: 2067046 - RNA, 17 nt, Homo sapiens
cccauaauuuucuucau

SEQ ID NO: 2067047 - RNA, 18 nt, Homo sapiens
accaagcaggaagcucag

SEQ ID NO: 2067048 - RNA, 23 nt, Homo sapiens
ucaaggauaggcuuuauucugca

SEQ ID NO: 2067049 - RNA, 18 nt, Homo sapiens
agugaucuacguagcucg

SEQ ID NO: 2067050 - RNA, 14 nt, Homo sapiens
auguaacuggaauc

SEQ ID NO: 2067051 - RNA, 17 nt, Homo sapiens
gcacaguacauaauaca

SEQ ID NO: 2067052 - RNA, 21 nt, Homo sapiens
guccaagugugugugcgugug

SEQ ID NO: 2067053 - RNA, 19 nt, Homo sapiens
ggcaagguugggcuggugc

SEQ ID NO: 2067054 - RNA, 22 nt, Homo sapiens
aggcacuguaguucuaagacuc

SEQ ID NO: 2067055 - RNA, 18 nt, Homo sapiens
auaccaaagccaauaaau

SEQ ID NO: 2067056 - RNA, 18 nt, Homo sapiens
aacccagggcaaauggaa

SEQ ID NO: 2067057 - RNA, 19 nt, Homo sapiens
auggaaugucaguguucag

SEQ ID NO: 2067058 - RNA, 14 nt, Homo sapiens
aaauuugauuuuga

SEQ ID NO: 2067059 - RNA, 20 nt, Homo sapiens
cuuccacugaggugggagca

SEQ ID NO: 2067060 - RNA, 12 nt, Homo sapiens
ucauuacagcuu

SEQ ID NO: 2067061 - RNA, 13 nt, Homo sapiens
agaaggugccacu

SEQ ID NO: 2067062 - RNA, 21 nt, Homo sapiens
gcauucuuugcaauacugcuu

SEQ ID NO: 2067063 - RNA, 22 nt, Homo sapiens
augaaugucacauuugaauucu

SEQ ID NO: 2067064 - RNA, 19 nt, Homo sapiens
uccugagaaaggugaggag

SEQ ID NO: 2067065 - RNA, 18 nt, Homo sapiens
acccaaugucucccacac

SEQ ID NO: 2067066 - RNA, 13 nt, Homo sapiens
auuuaucaguaca

SEQ ID NO: 2067067 - RNA, 18 nt, Homo sapiens
aggaugcugacaucauuu

SEQ ID NO: 2067068 - RNA, 15 nt, Homo sapiens
caggggugacacaga

SEQ ID NO: 2067069 - RNA, 17 nt, Homo sapiens
aggugaggaagcaaaag

SEQ ID NO: 2067070 - RNA, 19 nt, Homo sapiens
uuaaaugaauuuuucuucc

SEQ ID NO: 2067071 - RNA, 19 nt, Homo sapiens
uaaccacagggcugggcua

SEQ ID NO: 2067072 - RNA, 14 nt, Homo sapiens
cacauggugccccu

SEQ ID NO: 2067073 - RNA, 17 nt, Homo sapiens
uucaacuaguaccacag

SEQ ID NO: 2067074 - RNA, 15 nt, Homo sapiens
caauacaaucuugga

SEQ ID NO: 2067075 - RNA, 12 nt, Homo sapiens
uaaguaacauau

SEQ ID NO: 2067076 - RNA, 20 nt, Homo sapiens
cagagucuugcucuguugcc

SEQ ID NO: 2067077 - RNA, 18 nt, Homo sapiens
aagagcuuuccuucucca

SEQ ID NO: 2067078 - RNA, 16 nt, Homo sapiens
cagcuguccacacuga

SEQ ID NO: 2067079 - RNA, 23 nt, Homo sapiens
cagcacucugugggucuggugau

SEQ ID NO: 2067080 - RNA, 17 nt, Homo sapiens
uggaaaaaauuagacaa

SEQ ID NO: 2067081 - RNA, 18 nt, Homo sapiens
acagaacagcaaguauga

SEQ ID NO: 2067082 - RNA, 19 nt, Homo sapiens
cugaguggaucuccaagga

SEQ ID NO: 2067083 - RNA, 19 nt, Homo sapiens
aauaauaaaucguccuccc

SEQ ID NO: 2067084 - RNA, 23 nt, Homo sapiens
uugugagaccauuagcauugcag

SEQ ID NO: 2067085 - RNA, 16 nt, Homo sapiens
uccuccugggcuccag

SEQ ID NO: 2067086 - RNA, 20 nt, Homo sapiens
aaagaggcugccccucucac

SEQ ID NO: 2067087 - RNA, 16 nt, Homo sapiens
ucccaugaccccaaag

SEQ ID NO: 2067088 - RNA, 16 nt, Homo sapiens
ucaggaagccagguga

SEQ ID NO: 2067089 - RNA, 19 nt, Homo sapiens
cuuauccuguuuucaugga

SEQ ID NO: 2067090 - RNA, 13 nt, Homo sapiens
gcuacagccucuu

SEQ ID NO: 2067091 - RNA, 14 nt, Homo sapiens
cgcacagugcaguu

SEQ ID NO: 2067092 - RNA, 20 nt, Homo sapiens
ggcuugguuuccucaccuug

SEQ ID NO: 2067093 - RNA, 23 nt, Homo sapiens
auaacagugccagcuucuuugca

SEQ ID NO: 2067094 - RNA, 13 nt, Homo sapiens
cacacugagcugg

SEQ ID NO: 2067095 - RNA, 22 nt, Homo sapiens
ccugccuuuccauccauggcca

SEQ ID NO: 2067096 - RNA, 18 nt, Homo sapiens
acccgaguaccuccaguc

SEQ ID NO: 2067097 - RNA, 17 nt, Homo sapiens
uguuuaagucacauuau

SEQ ID NO: 2067098 - RNA, 22 nt, Homo sapiens
gcacacgucuggccuacagaau

SEQ ID NO: 2067099 - RNA, 20 nt, Homo sapiens
gcucaacuguugccaggaga

SEQ ID NO: 2067100 - RNA, 11 nt, Homo sapiens
uaucauuucau

SEQ ID NO: 2067101 - RNA, 18 nt, Homo sapiens
guauuaaauuagauaucu

SEQ ID NO: 2067102 - RNA, 23 nt, Homo sapiens
ucucacuucguuggugaccaguu

SEQ ID NO: 2067103 - RNA, 16 nt, Homo sapiens
cagacagaaggugcua

SEQ ID NO: 2067104 - RNA, 16 nt, Homo sapiens
agcaguggcuggugcc

SEQ ID NO: 2067105 - RNA, 23 nt, Homo sapiens
aacuuuguaaccagaauuauaca

SEQ ID NO: 2067106 - RNA, 18 nt, Homo sapiens
uaaaaagcaaagguuaca

SEQ ID NO: 2067107 - RNA, 17 nt, Homo sapiens
ugacaaccucauccagg

SEQ ID NO: 2067108 - RNA, 16 nt, Homo sapiens
gccccuccucccucaa

SEQ ID NO: 2067109 - RNA, 18 nt, Homo sapiens
gcccuggugcauggccuu

SEQ ID NO: 2067110 - RNA, 19 nt, Homo sapiens
uguacaccagagccucagu

SEQ ID NO: 2067111 - RNA, 21 nt, Homo sapiens
gcugcucacuuaaacaauguc

SEQ ID NO: 2067112 - RNA, 16 nt, Homo sapiens
cuuuucccuguccuga

SEQ ID NO: 2067113 - RNA, 17 nt, Homo sapiens
uaaaggaaccauuccuu

SEQ ID NO: 2067114 - RNA, 15 nt, Homo sapiens
ugagccuuugugcuu

SEQ ID NO: 2067115 - RNA, 15 nt, Homo sapiens
caucucaucaacuua

SEQ ID NO: 2067116 - RNA, 13 nt, Homo sapiens
cuaagcaccauaa

SEQ ID NO: 2067117 - RNA, 14 nt, Homo sapiens
uaccaaucucugaa

SEQ ID NO: 2067118 - RNA, 14 nt, Homo sapiens
ccccaauccaugaa

SEQ ID NO: 2067119 - RNA, 13 nt, Homo sapiens
agugcugcugaag

SEQ ID NO: 2067120 - RNA, 13 nt, Homo sapiens
ccuugcuggcgcu

SEQ ID NO: 2067121 - RNA, 13 nt, Homo sapiens
acaguauugccac

SEQ ID NO: 2067122 - RNA, 23 nt, Homo sapiens
agcccauuucuccagaacccauu

SEQ ID NO: 2067123 - RNA, 17 nt, Homo sapiens
gugaagcuggcugugca

SEQ ID NO: 2067124 - RNA, 15 nt, Homo sapiens
gucuguaugucaugg

SEQ ID NO: 2067125 - RNA, 21 nt, Homo sapiens
guccacauaauccacgcucau

SEQ ID NO: 2067126 - RNA, 17 nt, Homo sapiens
aagauaguaucuuuuaa

SEQ ID NO: 2067127 - RNA, 15 nt, Homo sapiens
uaaauuuuauuccaa

SEQ ID NO: 2067128 - RNA, 16 nt, Homo sapiens
cggagcgaguccccca

SEQ ID NO: 2067129 - RNA, 17 nt, Homo sapiens
ggagucacugagaccaa

SEQ ID NO: 2067130 - RNA, 23 nt, Homo sapiens
uccuuaccgucuugaucggaaag

SEQ ID NO: 2067131 - RNA, 23 nt, Homo sapiens
ucacauuuuuuaaacaguuacau

SEQ ID NO: 2067132 - RNA, 21 nt, Homo sapiens
cucuagaggguugcugccuuu

SEQ ID NO: 2067133 - RNA, 16 nt, Homo sapiens
aucucuacuaccacaa

SEQ ID NO: 2067134 - RNA, 18 nt, Homo sapiens
uuugaaagacugugcugu

SEQ ID NO: 2067135 - RNA, 14 nt, Homo sapiens
ggauggcaccagag

SEQ ID NO: 2067136 - RNA, 15 nt, Homo sapiens
uggggacuaacccaa

SEQ ID NO: 2067137 - RNA, 14 nt, Homo sapiens
auugguacacgugu

SEQ ID NO: 2067138 - RNA, 23 nt, Homo sapiens
cuugaaaucuaauauuucuagua

SEQ ID NO: 2067139 - RNA, 22 nt, Homo sapiens
aggcggagcugugcucagcaca

SEQ ID NO: 2067140 - RNA, 21 nt, Homo sapiens
uacacacuguugucaaaaagu

SEQ ID NO: 2067141 - RNA, 18 nt, Homo sapiens
gaaccaggccagagcaaa

SEQ ID NO: 2067142 - RNA, 13 nt, Homo sapiens
auuucauggugac

SEQ ID NO: 2067143 - RNA, 18 nt, Homo sapiens
aaaauucugagugaucca

SEQ ID NO: 2067144 - RNA, 20 nt, Homo sapiens
agugcccucgagcacugaag

SEQ ID NO: 2067145 - RNA, 23 nt, Homo sapiens
agaaugagugaaucaccuguggu

SEQ ID NO: 2067146 - RNA, 11 nt, Homo sapiens
aaaagcagcuc

SEQ ID NO: 2067147 - RNA, 21 nt, Homo sapiens
ugucaguauuauucuacuaua

SEQ ID NO: 2067148 - RNA, 15 nt, Homo sapiens
ugcuaaagccaggau

SEQ ID NO: 2067149 - RNA, 18 nt, Homo sapiens
gaaauuuaggaagcgaaa

SEQ ID NO: 2067150 - RNA, 12 nt, Homo sapiens
acugccagguau

SEQ ID NO: 2067151 - RNA, 15 nt, Homo sapiens
gaaccuggcugcgaa

SEQ ID NO: 2067152 - RNA, 17 nt, Homo sapiens
gauugcagaaauacagu

SEQ ID NO: 2067153 - RNA, 15 nt, Homo sapiens
uggauuugggaugaa

SEQ ID NO: 2067154 - RNA, 15 nt, Homo sapiens
cuuucucuuugccau

SEQ ID NO: 2067155 - RNA, 15 nt, Homo sapiens
ugaagagugaggaua

SEQ ID NO: 2067156 - RNA, 21 nt, Homo sapiens
cacuuguuuuucuuuuuacag

SEQ ID NO: 2067157 - RNA, 20 nt, Homo sapiens
cauuccagagcaggaggcag

SEQ ID NO: 2067158 - RNA, 18 nt, Homo sapiens
ggauguaagccuggagcu

SEQ ID NO: 2067159 - RNA, 21 nt, Homo sapiens
aagcuuccaguccaaucucau

SEQ ID NO: 2067160 - RNA, 17 nt, Homo sapiens
cugaguggcuucacucc

SEQ ID NO: 2067161 - RNA, 13 nt, Homo sapiens
gccauuucuuccc

SEQ ID NO: 2067162 - RNA, 18 nt, Homo sapiens
cauguaccucugauuaau

SEQ ID NO: 2067163 - RNA, 17 nt, Homo sapiens
auguuuaaaaacauucc

SEQ ID NO: 2067164 - RNA, 16 nt, Homo sapiens
cagauguacacccacc

SEQ ID NO: 2067165 - RNA, 17 nt, Homo sapiens
ucuuuaccaguuucuga

SEQ ID NO: 2067166 - RNA, 20 nt, Homo sapiens
agaugcauuaucuaugauau

SEQ ID NO: 2067167 - RNA, 10 nt, Homo sapiens
gacuggccau

SEQ ID NO: 2067168 - RNA, 20 nt, Homo sapiens
aacaccgucccagggcucug

SEQ ID NO: 2067169 - RNA, 11 nt, Homo sapiens
ugcugcugcuu

SEQ ID NO: 2067170 - RNA, 14 nt, Homo sapiens
acaccugcccuaaa

SEQ ID NO: 2067171 - RNA, 15 nt, Homo sapiens
aaucugaacucucaa

SEQ ID NO: 2067172 - RNA, 21 nt, Homo sapiens
cuccaccucugguggcuccuc

SEQ ID NO: 2067173 - RNA, 16 nt, Homo sapiens
ggcagcugucauucag

SEQ ID NO: 2067174 - RNA, 17 nt, Homo sapiens
ucuuuugugucugucau

SEQ ID NO: 2067175 - RNA, 16 nt, Homo sapiens
uaugaauagacauaaa

SEQ ID NO: 2067176 - RNA, 16 nt, Homo sapiens
ccuagaacugugccua

SEQ ID NO: 2067177 - RNA, 21 nt, Homo sapiens
cucugcccauccugccccuga

SEQ ID NO: 2067178 - RNA, 22 nt, Homo sapiens
ugcacauauggacucugcacau

SEQ ID NO: 2067179 - RNA, 23 nt, Homo sapiens
uaaauuaugcuuucuauuuugag

SEQ ID NO: 2067180 - RNA, 17 nt, Homo sapiens
guggucugagccaaaga

SEQ ID NO: 2067181 - RNA, 23 nt, Homo sapiens
ggcuacuaguuuaagcaaauaaa

SEQ ID NO: 2067182 - RNA, 23 nt, Homo sapiens
cuaaauccaaaugaggauaucau

SEQ ID NO: 2067183 - RNA, 12 nt, Homo sapiens
agacuaugcagc

SEQ ID NO: 2067184 - RNA, 16 nt, Homo sapiens
uguugaggugcaagga

SEQ ID NO: 2067185 - RNA, 21 nt, Homo sapiens
uggagaaagggcagaggaaga

SEQ ID NO: 2067186 - RNA, 15 nt, Homo sapiens
ucaggcaacgcacaa

SEQ ID NO: 2067187 - RNA, 17 nt, Homo sapiens
ucuaacccccagugcca

SEQ ID NO: 2067188 - RNA, 23 nt, Homo sapiens
accuguuaucuguguuugcugag

SEQ ID NO: 2067189 - RNA, 13 nt, Homo sapiens
acccagcuggucc

SEQ ID NO: 2067190 - RNA, 22 nt, Homo sapiens
cagcuacuagggaggcugaggc

SEQ ID NO: 2067191 - RNA, 20 nt, Homo sapiens
aaccaggccuccaagccagg

SEQ ID NO: 2067192 - RNA, 13 nt, Homo sapiens
agcaaacuaagcc

SEQ ID NO: 2067193 - RNA, 15 nt, Homo sapiens
ucuccucuaucacau

SEQ ID NO: 2067194 - RNA, 11 nt, Homo sapiens
uuugaguacag

SEQ ID NO: 2067195 - RNA, 19 nt, Homo sapiens
uccucuuuuccuucccaaa

SEQ ID NO: 2067196 - RNA, 15 nt, Homo sapiens
ugauaccacugcacu

SEQ ID NO: 2067197 - RNA, 13 nt, Homo sapiens
uucccaaucccau

SEQ ID NO: 2067198 - RNA, 17 nt, Homo sapiens
auucuguuagcugcuca

SEQ ID NO: 2067199 - RNA, 17 nt, Homo sapiens
cucuacccaucuuaaaa

SEQ ID NO: 2067200 - RNA, 20 nt, Homo sapiens
accgugccugaucugcacau

SEQ ID NO: 2067201 - RNA, 21 nt, Homo sapiens
aagaacauuaauuauauguau

SEQ ID NO: 2067202 - RNA, 21 nt, Homo sapiens
ggcccaagugaagcauggcau

SEQ ID NO: 2067203 - RNA, 14 nt, Homo sapiens
ggacccauuugcca

SEQ ID NO: 2067204 - RNA, 16 nt, Homo sapiens
uuccuuuguugcacaa

SEQ ID NO: 2067205 - RNA, 17 nt, Homo sapiens
gucacaccucacuguca

SEQ ID NO: 2067206 - RNA, 21 nt, Homo sapiens
agucucugguagccugcagaa

SEQ ID NO: 2067207 - RNA, 11 nt, Homo sapiens
aaaaccaauga

SEQ ID NO: 2067208 - RNA, 17 nt, Homo sapiens
uggguuuucuaacugua

SEQ ID NO: 2067209 - RNA, 17 nt, Homo sapiens
acgucagugcucagaaa

SEQ ID NO: 2067210 - RNA, 12 nt, Homo sapiens
ccagcguaucau

SEQ ID NO: 2067211 - RNA, 20 nt, Homo sapiens
auucuuggcuaaaggaucag

SEQ ID NO: 2067212 - RNA, 20 nt, Homo sapiens
cuaaaccaagauuaugugac

SEQ ID NO: 2067213 - RNA, 14 nt, Homo sapiens
cuaugcuggugaaa

SEQ ID NO: 2067214 - RNA, 14 nt, Homo sapiens
caaaaaauugcaca

SEQ ID NO: 2067215 - RNA, 18 nt, Homo sapiens
auguagacuuuugcuuua

SEQ ID NO: 2067216 - RNA, 20 nt, Homo sapiens
cagugugcaagggcagugaa

SEQ ID NO: 2067217 - RNA, 19 nt, Homo sapiens
aucacuaaauaaacacgau

SEQ ID NO: 2067218 - RNA, 21 nt, Homo sapiens
auuccuuccacuaacucauag

SEQ ID NO: 2067219 - RNA, 20 nt, Homo sapiens
aaaaaugguugauggaaaau

SEQ ID NO: 2067220 - RNA, 13 nt, Homo sapiens
ugcggcuuuucag

SEQ ID NO: 2067221 - RNA, 16 nt, Homo sapiens
ugcuccuggcccuucu

SEQ ID NO: 2067222 - RNA, 16 nt, Homo sapiens
aaauaaaucaguucau

SEQ ID NO: 2067223 - RNA, 22 nt, Homo sapiens
gcaagcucugcccuggcugugg

SEQ ID NO: 2067224 - RNA, 23 nt, Homo sapiens
aauaacgggcugcccucagcuca

SEQ ID NO: 2067225 - RNA, 16 nt, Homo sapiens
ugggaagggacaucug

SEQ ID NO: 2067226 - RNA, 19 nt, Homo sapiens
auuaaugauaaacucagau

SEQ ID NO: 2067227 - RNA, 21 nt, Homo sapiens
agguugucuccaggccaugau

SEQ ID NO: 2067228 - RNA, 14 nt, Homo sapiens
ugcacugacaagau

SEQ ID NO: 2067229 - RNA, 20 nt, Homo sapiens
auucaccuucaaaagcacug

SEQ ID NO: 2067230 - RNA, 15 nt, Homo sapiens
aaucuuuaccuguau

SEQ ID NO: 2067231 - RNA, 21 nt, Homo sapiens
cuuuaaccaccccaucugcau

SEQ ID NO: 2067232 - RNA, 16 nt, Homo sapiens
auggggcaugugccau

SEQ ID NO: 2067233 - RNA, 17 nt, Homo sapiens
aaaaauuaaaaccugau

SEQ ID NO: 2067234 - RNA, 19 nt, Homo sapiens
agaagaaagaaacuucauu

SEQ ID NO: 2067235 - RNA, 19 nt, Homo sapiens
gguugcuuuaauaucauca

SEQ ID NO: 2067236 - RNA, 13 nt, Homo sapiens
ggcaggacagcuc

SEQ ID NO: 2067237 - RNA, 10 nt, Homo sapiens
ugacaugaag

SEQ ID NO: 2067238 - RNA, 10 nt, Homo sapiens
auacaugauu

SEQ ID NO: 2067239 - RNA, 18 nt, Homo sapiens
aagcgugagccacugcac

SEQ ID NO: 2067240 - RNA, 21 nt, Homo sapiens
gccaguuccucccaucuucag

SEQ ID NO: 2067241 - RNA, 14 nt, Homo sapiens
aaauuaaaagcccu

SEQ ID NO: 2067242 - RNA, 17 nt, Homo sapiens
caucuuuugaagcuuuc

SEQ ID NO: 2067243 - RNA, 14 nt, Homo sapiens
cagaacgucucuca

SEQ ID NO: 2067244 - RNA, 11 nt, Homo sapiens
aaacaaugaag

SEQ ID NO: 2067245 - RNA, 13 nt, Homo sapiens
agagaauuuccuu

SEQ ID NO: 2067246 - RNA, 23 nt, Homo sapiens
agaacagaaaacaagaagucaua

SEQ ID NO: 2067247 - RNA, 21 nt, Homo sapiens
ugcauauccaacaugugcuca

SEQ ID NO: 2067248 - RNA, 18 nt, Homo sapiens
agggagcucugaugagca

SEQ ID NO: 2067249 - RNA, 17 nt, Homo sapiens
cuuuuacugaagccuuu

SEQ ID NO: 2067250 - RNA, 22 nt, Homo sapiens
ucagucugcuuuuggauuuuca

SEQ ID NO: 2067251 - RNA, 19 nt, Homo sapiens
acucagcuguccagcugca

SEQ ID NO: 2067252 - RNA, 19 nt, Homo sapiens
gaaucauauaguauguaac

SEQ ID NO: 2067253 - RNA, 22 nt, Homo sapiens
ugaauuguuaauucacagaaua

SEQ ID NO: 2067254 - RNA, 22 nt, Homo sapiens
aaaugacacaacuugucccuuu

SEQ ID NO: 2067255 - RNA, 23 nt, Homo sapiens
acacugagacuugaaucaaguca

SEQ ID NO: 2067256 - RNA, 14 nt, Homo sapiens
gcuccagcaccuuc

SEQ ID NO: 2067257 - RNA, 16 nt, Homo sapiens
aagugauaucaccucu

SEQ ID NO: 2067258 - RNA, 22 nt, Homo sapiens
aagccacagguguugauuguua

SEQ ID NO: 2067259 - RNA, 14 nt, Homo sapiens
cuacaaaaugacua

SEQ ID NO: 2067260 - RNA, 14 nt, Homo sapiens
guuccuucugugaa

SEQ ID NO: 2067261 - RNA, 21 nt, Homo sapiens
auucaaggaggaaagaagaag

SEQ ID NO: 2067262 - RNA, 20 nt, Homo sapiens
ugucacauaaaagucuguga

SEQ ID NO: 2067263 - RNA, 17 nt, Homo sapiens
ugaauaguugcuuaauu

SEQ ID NO: 2067264 - RNA, 15 nt, Homo sapiens
aaaugaauuuuccac

SEQ ID NO: 2067265 - RNA, 19 nt, Homo sapiens
ugcagcuuugggaaagcug

SEQ ID NO: 2067266 - RNA, 18 nt, Homo sapiens
gaggcccgcggcggugga

SEQ ID NO: 2067267 - RNA, 14 nt, Homo sapiens
agacaaagacauuu

SEQ ID NO: 2067268 - RNA, 19 nt, Homo sapiens
agauccaccugcacaaaca

SEQ ID NO: 2067269 - RNA, 19 nt, Homo sapiens
accgcaggauuugggcucu

SEQ ID NO: 2067270 - RNA, 16 nt, Homo sapiens
caguggugagacugua

SEQ ID NO: 2067271 - RNA, 13 nt, Homo sapiens
agucagauuuauu

SEQ ID NO: 2067272 - RNA, 16 nt, Homo sapiens
agcaggcuacugucag

SEQ ID NO: 2067273 - RNA, 23 nt, Homo sapiens
gcaaucuuggcucgcaaccuccg

SEQ ID NO: 2067274 - RNA, 17 nt, Homo sapiens
agcuaccucaaccaaug

SEQ ID NO: 2067275 - RNA, 22 nt, Homo sapiens
aaauuguacaagauaaguucca

SEQ ID NO: 2067276 - RNA, 23 nt, Homo sapiens
aaucucuugucauucucauccaa

SEQ ID NO: 2067277 - RNA, 20 nt, Homo sapiens
gcucagucccucugcucuca

SEQ ID NO: 2067278 - RNA, 18 nt, Homo sapiens
gaauauaaggaaagcaau

SEQ ID NO: 2067279 - RNA, 16 nt, Homo sapiens
cauagccauggaaccc

SEQ ID NO: 2067280 - RNA, 13 nt, Homo sapiens
aauguuaugugcu

SEQ ID NO: 2067281 - RNA, 18 nt, Homo sapiens
aucccagcuacuuggaag

SEQ ID NO: 2067282 - RNA, 17 nt, Homo sapiens
auauauuuuguaugcaa

SEQ ID NO: 2067283 - RNA, 21 nt, Homo sapiens
cagccacuuugcuaccaugac

SEQ ID NO: 2067284 - RNA, 23 nt, Homo sapiens
aacuaaauacuguaacacuguau

SEQ ID NO: 2067285 - RNA, 18 nt, Homo sapiens
ucccucccaggacucuga

SEQ ID NO: 2067286 - RNA, 20 nt, Homo sapiens
agagcgcaguguuuugcaag

SEQ ID NO: 2067287 - RNA, 22 nt, Homo sapiens
aaaguauuggcauucaaaaaga

SEQ ID NO: 2067288 - RNA, 15 nt, Homo sapiens
gcagcaacaacuguc

SEQ ID NO: 2067289 - RNA, 12 nt, Homo sapiens
gcauccacagga

SEQ ID NO: 2067290 - RNA, 13 nt, Homo sapiens
uuuaccagaugau

SEQ ID NO: 2067291 - RNA, 15 nt, Homo sapiens
aucauagguacaauc

SEQ ID NO: 2067292 - RNA, 14 nt, Homo sapiens
ccaauuauaucucc

SEQ ID NO: 2067293 - RNA, 18 nt, Homo sapiens
ggcucuccucgcaggugu

SEQ ID NO: 2067294 - RNA, 14 nt, Homo sapiens
cccagaaugacccc

SEQ ID NO: 2067295 - RNA, 18 nt, Homo sapiens
cagaacacccaauucaaa

SEQ ID NO: 2067296 - RNA, 20 nt, Homo sapiens
aauuagaucgguucugugcc

SEQ ID NO: 2067297 - RNA, 18 nt, Homo sapiens
agaagauuuuaugcugcu

SEQ ID NO: 2067298 - RNA, 11 nt, Homo sapiens
agaaaagcuau

SEQ ID NO: 2067299 - RNA, 15 nt, Homo sapiens
uccaacuuaauacaa

SEQ ID NO: 2067300 - RNA, 17 nt, Homo sapiens
cuagacuccauugugcc

SEQ ID NO: 2067301 - RNA, 22 nt, Homo sapiens
ccaccacuauaaaaugucuuca

SEQ ID NO: 2067302 - RNA, 12 nt, Homo sapiens
cgcccauuuaga

SEQ ID NO: 2067303 - RNA, 17 nt, Homo sapiens
uccugcugcucacuccc

SEQ ID NO: 2067304 - RNA, 11 nt, Homo sapiens
cagcucagggc

SEQ ID NO: 2067305 - RNA, 19 nt, Homo sapiens
uacguaugucugguucuca

SEQ ID NO: 2067306 - RNA, 22 nt, Homo sapiens
ucuucccgcaaggccucucaga

SEQ ID NO: 2067307 - RNA, 20 nt, Homo sapiens
uggcaaugaaaaauucucag

SEQ ID NO: 2067308 - RNA, 15 nt, Homo sapiens
uuguagagcuuacuu

SEQ ID NO: 2067309 - RNA, 20 nt, Homo sapiens
uguugagcaaugugcacuuc

SEQ ID NO: 2067310 - RNA, 13 nt, Homo sapiens
aaugaguaaaaac

SEQ ID NO: 2067311 - RNA, 13 nt, Homo sapiens
uuagaguauuuac

SEQ ID NO: 2067312 - RNA, 16 nt, Homo sapiens
aaaccuaauauucaau

SEQ ID NO: 2067313 - RNA, 16 nt, Homo sapiens
ggacaauggacuguac

SEQ ID NO: 2067314 - RNA, 17 nt, Homo sapiens
uugcuaucaauccaaga

SEQ ID NO: 2067315 - RNA, 20 nt, Homo sapiens
gcacaaaagcagauacuuga

SEQ ID NO: 2067316 - RNA, 18 nt, Homo sapiens
auguacuguuugcugcca

SEQ ID NO: 2067317 - RNA, 19 nt, Homo sapiens
cccuuagcuuuuagccugg

SEQ ID NO: 2067318 - RNA, 17 nt, Homo sapiens
guugaaaaccacaguca

SEQ ID NO: 2067319 - RNA, 17 nt, Homo sapiens
uugcuuacuuuggaaua

SEQ ID NO: 2067320 - RNA, 14 nt, Homo sapiens
gugauaaugcagau

SEQ ID NO: 2067321 - RNA, 20 nt, Homo sapiens
cagagggaugggagagucaa

SEQ ID NO: 2067322 - RNA, 23 nt, Homo sapiens
agaccuguugguuagcuggacau

SEQ ID NO: 2067323 - RNA, 10 nt, Homo sapiens
uaggaaaauu

SEQ ID NO: 2067324 - RNA, 14 nt, Homo sapiens
ugauacauauguga

SEQ ID NO: 2067325 - RNA, 18 nt, Homo sapiens
cugccgugguggcagcug

SEQ ID NO: 2067326 - RNA, 18 nt, Homo sapiens
uccagugcauguugccau

SEQ ID NO: 2067327 - RNA, 21 nt, Homo sapiens
auagagugacuccaagaacaa

SEQ ID NO: 2067328 - RNA, 20 nt, Homo sapiens
gaacaggaggaacuggucca

SEQ ID NO: 2067329 - RNA, 14 nt, Homo sapiens
caagauaauuuuca

SEQ ID NO: 2067330 - RNA, 20 nt, Homo sapiens
ugaucauuucucaagaauaa

SEQ ID NO: 2067331 - RNA, 16 nt, Homo sapiens
aauaaccuuauucuau

SEQ ID NO: 2067332 - RNA, 14 nt, Homo sapiens
aacauuuacaacuc

SEQ ID NO: 2067333 - RNA, 13 nt, Homo sapiens
cagaauccugaug

SEQ ID NO: 2067334 - RNA, 14 nt, Homo sapiens
gccuucaaagccac

SEQ ID NO: 2067335 - RNA, 15 nt, Homo sapiens
uuuaauuuagugauc

SEQ ID NO: 2067336 - RNA, 19 nt, Homo sapiens
ggcagggguggaggagagc

SEQ ID NO: 2067337 - RNA, 21 nt, Homo sapiens
uggaauucucuguaagccuag

SEQ ID NO: 2067338 - RNA, 19 nt, Homo sapiens
gagaaaauaaaagcacuua

SEQ ID NO: 2067339 - RNA, 16 nt, Homo sapiens
agauauauauauacac

SEQ ID NO: 2067340 - RNA, 16 nt, Homo sapiens
auaaacucagaaauuu

SEQ ID NO: 2067341 - RNA, 21 nt, Homo sapiens
gccacucaggaggcugaggca

SEQ ID NO: 2067342 - RNA, 21 nt, Homo sapiens
agcuacgagaccuucacagag

SEQ ID NO: 2067343 - RNA, 15 nt, Homo sapiens
uagcuagcuauuucu

SEQ ID NO: 2067344 - RNA, 17 nt, Homo sapiens
uacagaaauauccauga

SEQ ID NO: 2067345 - RNA, 19 nt, Homo sapiens
uggucagggccacggccaa

SEQ ID NO: 2067346 - RNA, 23 nt, Homo sapiens
cagccauuugggagaagaucuca

SEQ ID NO: 2067347 - RNA, 17 nt, Homo sapiens
ucuguucccuuccucac

SEQ ID NO: 2067348 - RNA, 15 nt, Homo sapiens
acguaaauaaacuaa

SEQ ID NO: 2067349 - RNA, 22 nt, Homo sapiens
uagaacuggaucccaacaccaa

SEQ ID NO: 2067350 - RNA, 20 nt, Homo sapiens
aucccagacugacagacuua

SEQ ID NO: 2067351 - RNA, 20 nt, Homo sapiens
cuugucccucucacucccca

SEQ ID NO: 2067352 - RNA, 13 nt, Homo sapiens
gaaucccuagucc

SEQ ID NO: 2067353 - RNA, 23 nt, Homo sapiens
aucuuuuaguuuuaguugcagaa

SEQ ID NO: 2067354 - RNA, 16 nt, Homo sapiens
aauuauaauguugccc

SEQ ID NO: 2067355 - RNA, 19 nt, Homo sapiens
agacaggugccuggggcug

SEQ ID NO: 2067356 - RNA, 14 nt, Homo sapiens
guaucaaaugugac

SEQ ID NO: 2067357 - RNA, 12 nt, Homo sapiens
ggcuagucauaa

SEQ ID NO: 2067358 - RNA, 17 nt, Homo sapiens
acugcaggggucuggug

SEQ ID NO: 2067359 - RNA, 15 nt, Homo sapiens
uuggaaucaaaagag

SEQ ID NO: 2067360 - RNA, 19 nt, Homo sapiens
uaguauauuaggaaacugg

SEQ ID NO: 2067361 - RNA, 19 nt, Homo sapiens
ccuggcacugguuuguucc

SEQ ID NO: 2067362 - RNA, 12 nt, Homo sapiens
gacacucagggc

SEQ ID NO: 2067363 - RNA, 14 nt, Homo sapiens
ugaaugguggugga

SEQ ID NO: 2067364 - RNA, 15 nt, Homo sapiens
uuucaaaacacaucu

SEQ ID NO: 2067365 - RNA, 21 nt, Homo sapiens
gaaguuguugcuauacauguu

SEQ ID NO: 2067366 - RNA, 14 nt, Homo sapiens
uuuuuauuugcuca

SEQ ID NO: 2067367 - RNA, 19 nt, Homo sapiens
uucccugaagaucuaguga

SEQ ID NO: 2067368 - RNA, 23 nt, Homo sapiens
cuugcagcauuuacuaugcacaa

SEQ ID NO: 2067369 - RNA, 13 nt, Homo sapiens
uuauuauucuuga

SEQ ID NO: 2067370 - RNA, 16 nt, Homo sapiens
acagagcauccgucuc

SEQ ID NO: 2067371 - RNA, 15 nt, Homo sapiens
agagaggaguucaau

SEQ ID NO: 2067372 - RNA, 16 nt, Homo sapiens
ccacuguuugucucac

SEQ ID NO: 2067373 - RNA, 14 nt, Homo sapiens
aguccuaucugggc

SEQ ID NO: 2067374 - RNA, 15 nt, Homo sapiens
gcauucagcacacac

SEQ ID NO: 2067375 - RNA, 12 nt, Homo sapiens
aaauuuacugag

SEQ ID NO: 2067376 - RNA, 18 nt, Homo sapiens
accuuccaaggacauauu

SEQ ID NO: 2067377 - RNA, 14 nt, Homo sapiens
acuaccaagcuggc

SEQ ID NO: 2067378 - RNA, 16 nt, Homo sapiens
uuugcauagcucuccu

SEQ ID NO: 2067379 - RNA, 13 nt, Homo sapiens
guauccugugaca

SEQ ID NO: 2067380 - RNA, 15 nt, Homo sapiens
uauuaaucauacaaa

SEQ ID NO: 2067381 - RNA, 22 nt, Homo sapiens
aucuucuuuauaauucuacuuu

SEQ ID NO: 2067382 - RNA, 22 nt, Homo sapiens
caaggagaccaaguccuggcua

SEQ ID NO: 2067383 - RNA, 18 nt, Homo sapiens
cagcacgccaacauggca

SEQ ID NO: 2067384 - RNA, 18 nt, Homo sapiens
aauaguaauaucaauaaa

SEQ ID NO: 2067385 - RNA, 14 nt, Homo sapiens
cuugaaaaaugcau

SEQ ID NO: 2067386 - RNA, 18 nt, Homo sapiens
caauacaguauuucuuug

SEQ ID NO: 2067387 - RNA, 17 nt, Homo sapiens
ucaccccagagccacac

SEQ ID NO: 2067388 - RNA, 15 nt, Homo sapiens
ugggagcaccgccug

SEQ ID NO: 2067389 - RNA, 13 nt, Homo sapiens
gcauuauuuuaua

SEQ ID NO: 2067390 - RNA, 22 nt, Homo sapiens
gcaacugguugacuaauacauu

SEQ ID NO: 2067391 - RNA, 12 nt, Homo sapiens
guagcucugcug

SEQ ID NO: 2067392 - RNA, 12 nt, Homo sapiens
cuuccucuccac

SEQ ID NO: 2067393 - RNA, 20 nt, Homo sapiens
uuaauuggcucacaguucug

SEQ ID NO: 2067394 - RNA, 17 nt, Homo sapiens
gacgcuauaggaugugg

SEQ ID NO: 2067395 - RNA, 12 nt, Homo sapiens
ccagugaccaaa

SEQ ID NO: 2067396 - RNA, 22 nt, Homo sapiens
ccagugaggaacccugaucucu

SEQ ID NO: 2067397 - RNA, 14 nt, Homo sapiens
cauuaaacuacuuu

SEQ ID NO: 2067398 - RNA, 22 nt, Homo sapiens
aaagcuguuuuuauuagcagua

SEQ ID NO: 2067399 - RNA, 18 nt, Homo sapiens
caucaguuuaaacaaagg

SEQ ID NO: 2067400 - RNA, 13 nt, Homo sapiens
gaaaggggcccca

SEQ ID NO: 2067401 - RNA, 12 nt, Homo sapiens
gcaccugucuga

SEQ ID NO: 2067402 - RNA, 23 nt, Homo sapiens
cuguauaaguaacauguggguca

SEQ ID NO: 2067403 - RNA, 18 nt, Homo sapiens
uggaaagaaucuuuacaa

SEQ ID NO: 2067404 - RNA, 14 nt, Homo sapiens
accagggagcuucc

SEQ ID NO: 2067405 - RNA, 16 nt, Homo sapiens
acccaucagcacucug

SEQ ID NO: 2067406 - RNA, 13 nt, Homo sapiens
acuguuuugauag

SEQ ID NO: 2067407 - RNA, 20 nt, Homo sapiens
ggugauccuuuugugccaug

SEQ ID NO: 2067408 - RNA, 22 nt, Homo sapiens
gauaaaagacacucccaccagc

SEQ ID NO: 2067409 - RNA, 19 nt, Homo sapiens
gaaaagaguggugacaaau

SEQ ID NO: 2067410 - RNA, 18 nt, Homo sapiens
aauugagagccucuaugu

SEQ ID NO: 2067411 - RNA, 21 nt, Homo sapiens
caaaagcauaaaaaaccacag

SEQ ID NO: 2067412 - RNA, 18 nt, Homo sapiens
acaagaggcucccucuua

SEQ ID NO: 2067413 - RNA, 17 nt, Homo sapiens
aggcccgagcagcugag

SEQ ID NO: 2067414 - RNA, 22 nt, Homo sapiens
gaacagaaguaguuaaccaaac

SEQ ID NO: 2067415 - RNA, 19 nt, Homo sapiens
acuuugguuugaacacaau

SEQ ID NO: 2067416 - RNA, 16 nt, Homo sapiens
uggcaugcugccuuaa

SEQ ID NO: 2067417 - RNA, 22 nt, Homo sapiens
gucucuauaccaauaaagugac

SEQ ID NO: 2067418 - RNA, 13 nt, Homo sapiens
aaauaccacugua

SEQ ID NO: 2067419 - RNA, 13 nt, Homo sapiens
ccgaguaccucca

SEQ ID NO: 2067420 - RNA, 23 nt, Homo sapiens
cguaagugguaugcaugggaugu

SEQ ID NO: 2067421 - RNA, 11 nt, Homo sapiens
cugacaccacc

SEQ ID NO: 2067422 - RNA, 15 nt, Homo sapiens
acucauuuaucuccu

SEQ ID NO: 2067423 - RNA, 20 nt, Homo sapiens
ugcucaguguccagcuucca

SEQ ID NO: 2067424 - RNA, 18 nt, Homo sapiens
acauugugaaaaggcaaa

SEQ ID NO: 2067425 - RNA, 18 nt, Homo sapiens
acacguaccuucauguga

SEQ ID NO: 2067426 - RNA, 19 nt, Homo sapiens
caccuuauaguucauagca

SEQ ID NO: 2067427 - RNA, 21 nt, Homo sapiens
cacgauccgcaacccaugccc

SEQ ID NO: 2067428 - RNA, 18 nt, Homo sapiens
uugaugagcacuccugau

SEQ ID NO: 2067429 - RNA, 22 nt, Homo sapiens
ucuggcagccacacuucucagg

SEQ ID NO: 2067430 - RNA, 23 nt, Homo sapiens
agaagauuacguuuuacaaugua

SEQ ID NO: 2067431 - RNA, 22 nt, Homo sapiens
agcucuucaucugcuacaagaa

SEQ ID NO: 2067432 - RNA, 17 nt, Homo sapiens
ugcuaugcuggacauua

SEQ ID NO: 2067433 - RNA, 19 nt, Homo sapiens
gcuagagcaugcugccuga

SEQ ID NO: 2067434 - RNA, 20 nt, Homo sapiens
aaaguuguuuaauaaguaua

SEQ ID NO: 2067435 - RNA, 16 nt, Homo sapiens
uccuuucucuauccca

SEQ ID NO: 2067436 - RNA, 19 nt, Homo sapiens
agagggcacacacugugua

SEQ ID NO: 2067437 - RNA, 19 nt, Homo sapiens
uguucacaauggauaggca

SEQ ID NO: 2067438 - RNA, 20 nt, Homo sapiens
agaagacaucguaugcuugg

SEQ ID NO: 2067439 - RNA, 23 nt, Homo sapiens
uauauuuuuuguaacauaaugca

SEQ ID NO: 2067440 - RNA, 14 nt, Homo sapiens
aucugaggacaagg

SEQ ID NO: 2067441 - RNA, 21 nt, Homo sapiens
ucaagcccugcagucacagcu

SEQ ID NO: 2067442 - RNA, 22 nt, Homo sapiens
agccagcacucacaccacuaac

SEQ ID NO: 2067443 - RNA, 12 nt, Homo sapiens
aggcuacuugag

SEQ ID NO: 2067444 - RNA, 15 nt, Homo sapiens
uauaaaauuaaucac

SEQ ID NO: 2067445 - RNA, 16 nt, Homo sapiens
ucuccccuccucugaa

SEQ ID NO: 2067446 - RNA, 12 nt, Homo sapiens
auaguguccaaa

SEQ ID NO: 2067447 - RNA, 15 nt, Homo sapiens
cuacgagaugaccuu

SEQ ID NO: 2067448 - RNA, 15 nt, Homo sapiens
uuaaauugcugugua

SEQ ID NO: 2067449 - RNA, 12 nt, Homo sapiens
ccauuugauacc

SEQ ID NO: 2067450 - RNA, 21 nt, Homo sapiens
uacccagacugguuugggcaa

SEQ ID NO: 2067451 - RNA, 11 nt, Homo sapiens
cauuucaggga

SEQ ID NO: 2067452 - RNA, 21 nt, Homo sapiens
acuucuagcugucugugaaua

SEQ ID NO: 2067453 - RNA, 21 nt, Homo sapiens
gggcaugagcugcugugccca

SEQ ID NO: 2067454 - RNA, 16 nt, Homo sapiens
cuggcuaacacgguga

SEQ ID NO: 2067455 - RNA, 20 nt, Homo sapiens
aucaguuugcuaauguuucc

SEQ ID NO: 2067456 - RNA, 20 nt, Homo sapiens
auuuguaaauuuaugugaug

SEQ ID NO: 2067457 - RNA, 19 nt, Homo sapiens
ccuguauucucagcacuuu

SEQ ID NO: 2067458 - RNA, 13 nt, Homo sapiens
agacuuugcccag

SEQ ID NO: 2067459 - RNA, 14 nt, Homo sapiens
uagucuuauguaaa

SEQ ID NO: 2067460 - RNA, 18 nt, Homo sapiens
guuguaacaauagcacaa

SEQ ID NO: 2067461 - RNA, 17 nt, Homo sapiens
ucuucaucccauuccag

SEQ ID NO: 2067462 - RNA, 20 nt, Homo sapiens
agccacagggucugccucca

SEQ ID NO: 2067463 - RNA, 20 nt, Homo sapiens
auuaucaaggggacuaaagu

SEQ ID NO: 2067464 - RNA, 17 nt, Homo sapiens
gcggcuuugggacaccu

SEQ ID NO: 2067465 - RNA, 22 nt, Homo sapiens
cugaccucgugaucuacccacc

SEQ ID NO: 2067466 - RNA, 23 nt, Homo sapiens
auucuuuaaaauuacaacuaagu

SEQ ID NO: 2067467 - RNA, 16 nt, Homo sapiens
caaggcagagcgcaaa

SEQ ID NO: 2067468 - RNA, 18 nt, Homo sapiens
gguauugucuuuugacau

SEQ ID NO: 2067469 - RNA, 21 nt, Homo sapiens
cuguucaaugauuauuuguau

SEQ ID NO: 2067470 - RNA, 12 nt, Homo sapiens
caaggugacaaa

SEQ ID NO: 2067471 - RNA, 22 nt, Homo sapiens
acaagagccauguaccagugua

SEQ ID NO: 2067472 - RNA, 23 nt, Homo sapiens
agcaaugggagggggcuccaugg

SEQ ID NO: 2067473 - RNA, 16 nt, Homo sapiens
cuuauugacucauaca

SEQ ID NO: 2067474 - RNA, 13 nt, Homo sapiens
cacagucauucac

SEQ ID NO: 2067475 - RNA, 13 nt, Homo sapiens
uagagucacugac

SEQ ID NO: 2067476 - RNA, 15 nt, Homo sapiens
cauagaggugaggga

SEQ ID NO: 2067477 - RNA, 23 nt, Homo sapiens
ucuuucccacccuccaccucuca

SEQ ID NO: 2067478 - RNA, 19 nt, Homo sapiens
acagcgaagacugcuaaau

SEQ ID NO: 2067479 - RNA, 17 nt, Homo sapiens
ggcaaugccaucagccc

SEQ ID NO: 2067480 - RNA, 18 nt, Homo sapiens
agucucuuuucuuuagag

SEQ ID NO: 2067481 - RNA, 22 nt, Homo sapiens
cccagaaagugauaagugcagg

SEQ ID NO: 2067482 - RNA, 14 nt, Homo sapiens
ugggagcugccaag

SEQ ID NO: 2067483 - RNA, 22 nt, Homo sapiens
uauacuuaauaaaacauuuuaa

SEQ ID NO: 2067484 - RNA, 12 nt, Homo sapiens
auuuuugcccag

SEQ ID NO: 2067485 - RNA, 20 nt, Homo sapiens
ugaaauuuguuauacuucaa

SEQ ID NO: 2067486 - RNA, 11 nt, Homo sapiens
cuuacuugcca

SEQ ID NO: 2067487 - RNA, 15 nt, Homo sapiens
uucuuuuugcucuaa

SEQ ID NO: 2067488 - RNA, 21 nt, Homo sapiens
gaaccugaaggggaaggaaau

SEQ ID NO: 2067489 - RNA, 18 nt, Homo sapiens
auauuucaggcauacuga

SEQ ID NO: 2067490 - RNA, 19 nt, Homo sapiens
aaauggugaauggauuucc

SEQ ID NO: 2067491 - RNA, 12 nt, Homo sapiens
cuaauacuuugu

SEQ ID NO: 2067492 - RNA, 18 nt, Homo sapiens
auucauuggcaugccaca

SEQ ID NO: 2067493 - RNA, 12 nt, Homo sapiens
caugaaggacac

SEQ ID NO: 2067494 - RNA, 20 nt, Homo sapiens
ccacauauaaauguacuuuu

SEQ ID NO: 2067495 - RNA, 20 nt, Homo sapiens
ccucugccucccggguucaa

SEQ ID NO: 2067496 - RNA, 19 nt, Homo sapiens
uccacaccaaagucaggga

SEQ ID NO: 2067497 - RNA, 20 nt, Homo sapiens
guucacaaacuucauuucag

SEQ ID NO: 2067498 - RNA, 18 nt, Homo sapiens
auauaacauucaguuccc

SEQ ID NO: 2067499 - RNA, 13 nt, Homo sapiens
aaaagagaucuua

SEQ ID NO: 2067500 - RNA, 20 nt, Homo sapiens
cuuaucuguuuucuaccucc

SEQ ID NO: 2067501 - RNA, 13 nt, Homo sapiens
caagaaaucccug

SEQ ID NO: 2067502 - RNA, 17 nt, Homo sapiens
cuuuccguaaaugcaaa

SEQ ID NO: 2067503 - RNA, 20 nt, Homo sapiens
gaguuuguguguauuuguau

SEQ ID NO: 2067504 - RNA, 23 nt, Homo sapiens
ccucgccuccuacucugagacaa

SEQ ID NO: 2067505 - RNA, 19 nt, Homo sapiens
guaggaaagaggaagcaaa

SEQ ID NO: 2067506 - RNA, 22 nt, Homo sapiens
ucuaaacuaucaauaauacaaa

SEQ ID NO: 2067507 - RNA, 18 nt, Homo sapiens
aucuauucuucugaccau

SEQ ID NO: 2067508 - RNA, 21 nt, Homo sapiens
agggacagagccccacgcugu

SEQ ID NO: 2067509 - RNA, 22 nt, Homo sapiens
acgucugggagaaauugacaga

SEQ ID NO: 2067510 - RNA, 22 nt, Homo sapiens
cugggauuacagacaugaacug

SEQ ID NO: 2067511 - RNA, 22 nt, Homo sapiens
ucaaaauguggaccaguucccu

SEQ ID NO: 2067512 - RNA, 18 nt, Homo sapiens
cggcaucaaggugcugaa

SEQ ID NO: 2067513 - RNA, 21 nt, Homo sapiens
ugaggcaggagaauggcguga

SEQ ID NO: 2067514 - RNA, 16 nt, Homo sapiens
ucuagagcacugccac

SEQ ID NO: 2067515 - RNA, 18 nt, Homo sapiens
uuggugaauuugaaucuc

SEQ ID NO: 2067516 - RNA, 11 nt, Homo sapiens
aagcagggaaa

SEQ ID NO: 2067517 - RNA, 23 nt, Homo sapiens
gccuuugggugcuguuuugccag

SEQ ID NO: 2067518 - RNA, 23 nt, Homo sapiens
ccuauuguugaauaaauguaucu

SEQ ID NO: 2067519 - RNA, 23 nt, Homo sapiens
ucaaacauuuuguaucaaggaaa

SEQ ID NO: 2067520 - RNA, 13 nt, Homo sapiens
gagccaacaucac

SEQ ID NO: 2067521 - RNA, 22 nt, Homo sapiens
caagcccguuaaauaauucccu

SEQ ID NO: 2067522 - RNA, 23 nt, Homo sapiens
aggcguauguggcaaaauguuac

SEQ ID NO: 2067523 - RNA, 17 nt, Homo sapiens
ggccuucuccacaggga

SEQ ID NO: 2067524 - RNA, 19 nt, Homo sapiens
cauggauucagcaugucca

SEQ ID NO: 2067525 - RNA, 21 nt, Homo sapiens
uacccacccuaauuugcccuu

SEQ ID NO: 2067526 - RNA, 16 nt, Homo sapiens
uaaauuuuagcaaguu

SEQ ID NO: 2067527 - RNA, 22 nt, Homo sapiens
ugcuuucaagucugacucucca

SEQ ID NO: 2067528 - RNA, 20 nt, Homo sapiens
agccucuggaauggcucagg

SEQ ID NO: 2067529 - RNA, 20 nt, Homo sapiens
uauagagaaaggucuaugca

SEQ ID NO: 2067530 - RNA, 17 nt, Homo sapiens
gugcaugguaugugggu

SEQ ID NO: 2067531 - RNA, 21 nt, Homo sapiens
cauuuaucuuuuguauaucua

SEQ ID NO: 2067532 - RNA, 22 nt, Homo sapiens
cuaauaaagaaauaauacccug

SEQ ID NO: 2067533 - RNA, 15 nt, Homo sapiens
gaauuaacaggaaau

SEQ ID NO: 2067534 - RNA, 20 nt, Homo sapiens
cggucagggucagggccauu

SEQ ID NO: 2067535 - RNA, 14 nt, Homo sapiens
accucugagcacau

SEQ ID NO: 2067536 - RNA, 22 nt, Homo sapiens
ugccuaucugccuggaggcaaa

SEQ ID NO: 2067537 - RNA, 20 nt, Homo sapiens
uaguauugguguauguauga

SEQ ID NO: 2067538 - RNA, 11 nt, Homo sapiens
uauacauauuc

SEQ ID NO: 2067539 - RNA, 13 nt, Homo sapiens
auuccaaacauac

SEQ ID NO: 2067540 - RNA, 18 nt, Homo sapiens
cuacauuuuauuacacua

SEQ ID NO: 2067541 - RNA, 15 nt, Homo sapiens
ugcaaauacaaucag

SEQ ID NO: 2067542 - RNA, 17 nt, Homo sapiens
ugaagccacugccuuca

SEQ ID NO: 2067543 - RNA, 18 nt, Homo sapiens
aaaauuucguuguccaau

SEQ ID NO: 2067544 - RNA, 24 nt, Homo sapiens
agggauuuucacagugugcuccag

SEQ ID NO: 2067545 - RNA, 20 nt, Homo sapiens
ggugcugugugccccacucc

SEQ ID NO: 2067546 - RNA, 14 nt, Homo sapiens
uucucuuugccuca

SEQ ID NO: 2067547 - RNA, 20 nt, Homo sapiens
cggggcacuggcugcucugu

SEQ ID NO: 2067548 - RNA, 22 nt, Homo sapiens
auugggcacagccuagggucuu

SEQ ID NO: 2067549 - RNA, 19 nt, Homo sapiens
gauucucuuaggugucaug

SEQ ID NO: 2067550 - RNA, 15 nt, Homo sapiens
acuauaaugguugga

SEQ ID NO: 2067551 - RNA, 18 nt, Homo sapiens
aagaucaccacuucccca

SEQ ID NO: 2067552 - RNA, 14 nt, Homo sapiens
cccagccccuccau

SEQ ID NO: 2067553 - RNA, 17 nt, Homo sapiens
aacacuuaguaugcagu

SEQ ID NO: 2067554 - RNA, 16 nt, Homo sapiens
auuucugaaacaauua

SEQ ID NO: 2067555 - RNA, 14 nt, Homo sapiens
uggcgaccaccaaa

SEQ ID NO: 2067556 - RNA, 23 nt, Homo sapiens
guugaaaacuuaaggaagcaaau

SEQ ID NO: 2067557 - RNA, 13 nt, Homo sapiens
acuuuuaguauua

SEQ ID NO: 2067558 - RNA, 19 nt, Homo sapiens
aacucuugaagacuccagu

SEQ ID NO: 2067559 - RNA, 22 nt, Homo sapiens
cucggugaugcggacaucucag

SEQ ID NO: 2067560 - RNA, 18 nt, Homo sapiens
ugucacauacaacuuuuu

SEQ ID NO: 2067561 - RNA, 15 nt, Homo sapiens
aagccaauccucacu

SEQ ID NO: 2067562 - RNA, 19 nt, Homo sapiens
uuugagaacugccauucag

SEQ ID NO: 2067563 - RNA, 17 nt, Homo sapiens
auuuugacaaagugccu

SEQ ID NO: 2067564 - RNA, 15 nt, Homo sapiens
uuuccucucucacaa

SEQ ID NO: 2067565 - RNA, 16 nt, Homo sapiens
gaugagacuacuucag

SEQ ID NO: 2067566 - RNA, 22 nt, Homo sapiens
aguucgagacuagccugggaaa

SEQ ID NO: 2067567 - RNA, 20 nt, Homo sapiens
ucuugauuugaguugauuga

SEQ ID NO: 2067568 - RNA, 13 nt, Homo sapiens
uguaagucaucua

SEQ ID NO: 2067569 - RNA, 19 nt, Homo sapiens
ccaucuccauugcauucau

SEQ ID NO: 2067570 - RNA, 16 nt, Homo sapiens
agauuacugaugugau

SEQ ID NO: 2067571 - RNA, 18 nt, Homo sapiens
aaugcucccugauauuuc

SEQ ID NO: 2067572 - RNA, 18 nt, Homo sapiens
uuguuuccauucuugucc

SEQ ID NO: 2067573 - RNA, 21 nt, Homo sapiens
ugacugauagcuuacacugag

SEQ ID NO: 2067574 - RNA, 21 nt, Homo sapiens
gccgggcuuuuccaagcugcc

SEQ ID NO: 2067575 - RNA, 22 nt, Homo sapiens
agcaaccguggcccuuccugga

SEQ ID NO: 2067576 - RNA, 21 nt, Homo sapiens
agcaaguuggcaaaacagaca

SEQ ID NO: 2067577 - RNA, 23 nt, Homo sapiens
cuucauuagcuuugggugccuuu

SEQ ID NO: 2067578 - RNA, 15 nt, Homo sapiens
cuuacaucaguagca

SEQ ID NO: 2067579 - RNA, 22 nt, Homo sapiens
uguaccauguugcccagaauuu

SEQ ID NO: 2067580 - RNA, 20 nt, Homo sapiens
cugaaacauucacacagggc

SEQ ID NO: 2067581 - RNA, 17 nt, Homo sapiens
auuuucuccccuuggca

SEQ ID NO: 2067582 - RNA, 16 nt, Homo sapiens
augguugccaccccaa

SEQ ID NO: 2067583 - RNA, 18 nt, Homo sapiens
uucagugcagcauauaca

SEQ ID NO: 2067584 - RNA, 20 nt, Homo sapiens
uauuuuuauaauaaacauaa

SEQ ID NO: 2067585 - RNA, 17 nt, Homo sapiens
uaauauaagcugccaua

SEQ ID NO: 2067586 - RNA, 12 nt, Homo sapiens
uaguaucuguau

SEQ ID NO: 2067587 - RNA, 12 nt, Homo sapiens
ccauuucuugaa

SEQ ID NO: 2067588 - RNA, 19 nt, Homo sapiens
uggggccuugcuccucuuc

SEQ ID NO: 2067589 - RNA, 14 nt, Homo sapiens
acauggauuccacu

SEQ ID NO: 2067590 - RNA, 17 nt, Homo sapiens
uagauuuguacaggagu

SEQ ID NO: 2067591 - RNA, 20 nt, Homo sapiens
uaaaauaucuggguggcuua

SEQ ID NO: 2067592 - RNA, 21 nt, Homo sapiens
cacaauguucuggcacuauua

SEQ ID NO: 2067593 - RNA, 11 nt, Homo sapiens
caccuccaguc

SEQ ID NO: 2067594 - RNA, 19 nt, Homo sapiens
ucaggaaucagaaaucaua

SEQ ID NO: 2067595 - RNA, 15 nt, Homo sapiens
auucuuaaaucugcc

SEQ ID NO: 2067596 - RNA, 23 nt, Homo sapiens
agccaaccugggggcuuuaggga

SEQ ID NO: 2067597 - RNA, 22 nt, Homo sapiens
gccacuuucccacgucacuuga

SEQ ID NO: 2067598 - RNA, 22 nt, Homo sapiens
gaaacuaagagacaguucucug

SEQ ID NO: 2067599 - RNA, 15 nt, Homo sapiens
ccagcccagcuccac

SEQ ID NO: 2067600 - RNA, 20 nt, Homo sapiens
gaccucaggugauccaccca

SEQ ID NO: 2067601 - RNA, 20 nt, Homo sapiens
uacaaucagccacauucuag

SEQ ID NO: 2067602 - RNA, 15 nt, Homo sapiens
aaagguagauuuuac

SEQ ID NO: 2067603 - RNA, 16 nt, Homo sapiens
agcccaugaucuucaa

SEQ ID NO: 2067604 - RNA, 21 nt, Homo sapiens
ucgcuaugugacuugcgcuua

SEQ ID NO: 2067605 - RNA, 21 nt, Homo sapiens
aggaaucuccgaggcucccca

SEQ ID NO: 2067606 - RNA, 23 nt, Homo sapiens
uuaccaaagaugaaugaagcaaa

SEQ ID NO: 2067607 - RNA, 18 nt, Homo sapiens
cauauuuuacugaucucu

SEQ ID NO: 2067608 - RNA, 16 nt, Homo sapiens
ugacuaaacuaccacc

SEQ ID NO: 2067609 - RNA, 22 nt, Homo sapiens
ucaaauuuuuuguagacagggu

SEQ ID NO: 2067610 - RNA, 19 nt, Homo sapiens
ugugggaaugcggcaagaa

SEQ ID NO: 2067611 - RNA, 19 nt, Homo sapiens
ggaugaggucaccagggga

SEQ ID NO: 2067612 - RNA, 17 nt, Homo sapiens
cucuggcacucugaggu

SEQ ID NO: 2067613 - RNA, 21 nt, Homo sapiens
cuaaaaccuuccaugucaaga

SEQ ID NO: 2067614 - RNA, 22 nt, Homo sapiens
cugugcccccagccucagccca

SEQ ID NO: 2067615 - RNA, 19 nt, Homo sapiens
caaaauaaauagugucucu

SEQ ID NO: 2067616 - RNA, 16 nt, Homo sapiens
auuaucaccuuuguca

SEQ ID NO: 2067617 - RNA, 15 nt, Homo sapiens
aaacagagaugugau

SEQ ID NO: 2067618 - RNA, 16 nt, Homo sapiens
guugugaaacuguaaa

SEQ ID NO: 2067619 - RNA, 14 nt, Homo sapiens
uugcaccuuucuag

SEQ ID NO: 2067620 - RNA, 15 nt, Homo sapiens
ucaaccuccuggaca

SEQ ID NO: 2067621 - RNA, 16 nt, Homo sapiens
ugaaguccuucaccuc

SEQ ID NO: 2067622 - RNA, 10 nt, Homo sapiens
ucaaacugcu

SEQ ID NO: 2067623 - RNA, 12 nt, Homo sapiens
uuacauacaaau

SEQ ID NO: 2067624 - RNA, 20 nt, Homo sapiens
aaagaacuguauuuagugau

SEQ ID NO: 2067625 - RNA, 22 nt, Homo sapiens
caauaaagaguauuuacaauaa

SEQ ID NO: 2067626 - RNA, 15 nt, Homo sapiens
cagauagcugaauga

SEQ ID NO: 2067627 - RNA, 22 nt, Homo sapiens
aacagaagggaaauuucaauaa

SEQ ID NO: 2067628 - RNA, 23 nt, Homo sapiens
cccgggagguggagguugcagug

SEQ ID NO: 2067629 - RNA, 16 nt, Homo sapiens
uuccagaucacugcca

SEQ ID NO: 2067630 - RNA, 17 nt, Homo sapiens
ucagcucuuccuguguu

SEQ ID NO: 2067631 - RNA, 19 nt, Homo sapiens
acagucaccccaggacuca

SEQ ID NO: 2067632 - RNA, 12 nt, Homo sapiens
aaaaaaccacag

SEQ ID NO: 2067633 - RNA, 15 nt, Homo sapiens
cuuccagguacugau

SEQ ID NO: 2067634 - RNA, 16 nt, Homo sapiens
uuccagggaaccagag

SEQ ID NO: 2067635 - RNA, 22 nt, Homo sapiens
ugucucuagaagugccaucuca

SEQ ID NO: 2067636 - RNA, 15 nt, Homo sapiens
uauauacauggaauc

SEQ ID NO: 2067637 - RNA, 15 nt, Homo sapiens
aagaugauuucucaa

SEQ ID NO: 2067638 - RNA, 19 nt, Homo sapiens
cacuuuggacuucucugaa

SEQ ID NO: 2067639 - RNA, 13 nt, Homo sapiens
gaaacugcuuuau

SEQ ID NO: 2067640 - RNA, 14 nt, Homo sapiens
ugaggcugcagauu

SEQ ID NO: 2067641 - RNA, 19 nt, Homo sapiens
cauggguggagggucccua

SEQ ID NO: 2067642 - RNA, 22 nt, Homo sapiens
cuuuguguuugcuuggugcugg

SEQ ID NO: 2067643 - RNA, 18 nt, Homo sapiens
aaugguagcaacugaaag

SEQ ID NO: 2067644 - RNA, 18 nt, Homo sapiens
cuguggaugauaaaacac

SEQ ID NO: 2067645 - RNA, 18 nt, Homo sapiens
caauuccaucagcacaaa

SEQ ID NO: 2067646 - RNA, 14 nt, Homo sapiens
ucaacauuuccaaa

SEQ ID NO: 2067647 - RNA, 18 nt, Homo sapiens
cacuuugcgugugucaua

SEQ ID NO: 2067648 - RNA, 23 nt, Homo sapiens
agcaacuugaacuucaccugcaa

SEQ ID NO: 2067649 - RNA, 18 nt, Homo sapiens
aagauucuugacuuauau

SEQ ID NO: 2067650 - RNA, 22 nt, Homo sapiens
gugugguucagcuacuuuccau

SEQ ID NO: 2067651 - RNA, 21 nt, Homo sapiens
aguguaccauucucagguggu

SEQ ID NO: 2067652 - RNA, 21 nt, Homo sapiens
gaccccuccuuucuuccucca

SEQ ID NO: 2067653 - RNA, 21 nt, Homo sapiens
gccccucgcugcugcuacuac

SEQ ID NO: 2067654 - RNA, 15 nt, Homo sapiens
uaaaaugaacaucuc

SEQ ID NO: 2067655 - RNA, 20 nt, Homo sapiens
cuuacugcuugguccuugau

SEQ ID NO: 2067656 - RNA, 16 nt, Homo sapiens
agcaacagccagugga

SEQ ID NO: 2067657 - RNA, 21 nt, Homo sapiens
gucacccagguuggagugcag

SEQ ID NO: 2067658 - RNA, 14 nt, Homo sapiens
accccaaccucaga

SEQ ID NO: 2067659 - RNA, 18 nt, Homo sapiens
gcccagcuuggagugcca

SEQ ID NO: 2067660 - RNA, 19 nt, Homo sapiens
gacucuuuaugcuugcaaa

SEQ ID NO: 2067661 - RNA, 15 nt, Homo sapiens
guauaaagcucucaa

SEQ ID NO: 2067662 - RNA, 17 nt, Homo sapiens
accagccugcagcacac

SEQ ID NO: 2067663 - RNA, 20 nt, Homo sapiens
ucaaccugggacuuccuaaa

SEQ ID NO: 2067664 - RNA, 20 nt, Homo sapiens
ggcuggagauaacagccucu

SEQ ID NO: 2067665 - RNA, 13 nt, Homo sapiens
cuaccaucugcau

SEQ ID NO: 2067666 - RNA, 16 nt, Homo sapiens
uucuuacuuuccugaa

SEQ ID NO: 2067667 - RNA, 15 nt, Homo sapiens
guucugaaagugacu

SEQ ID NO: 2067668 - RNA, 20 nt, Homo sapiens
aaggauaaugaauacuuuau

SEQ ID NO: 2067669 - RNA, 19 nt, Homo sapiens
cuccuccgccuugcugaga

SEQ ID NO: 2067670 - RNA, 20 nt, Homo sapiens
cauguuccuguuuaugcauu

SEQ ID NO: 2067671 - RNA, 14 nt, Homo sapiens
uuaaugcuugaaua

SEQ ID NO: 2067672 - RNA, 14 nt, Homo sapiens
aauaaagcauuaua

SEQ ID NO: 2067673 - RNA, 22 nt, Homo sapiens
aagugaggagaaugaaauguau

SEQ ID NO: 2067674 - RNA, 23 nt, Homo sapiens
auuucuuucuuugcaccaaagac

SEQ ID NO: 2067675 - RNA, 16 nt, Homo sapiens
auugauauugaaggaa

SEQ ID NO: 2067676 - RNA, 16 nt, Homo sapiens
aacuacccucuggaga

SEQ ID NO: 2067677 - RNA, 22 nt, Homo sapiens
aggaacagauuuugcuaagaca

SEQ ID NO: 2067678 - RNA, 22 nt, Homo sapiens
cuugauuuuccuaauggucuca

SEQ ID NO: 2067679 - RNA, 14 nt, Homo sapiens
uuuuucaaagcaau

SEQ ID NO: 2067680 - RNA, 23 nt, Homo sapiens
aggaagucauccugccaacugau

SEQ ID NO: 2067681 - RNA, 20 nt, Homo sapiens
gcccagaggggcggggccag

SEQ ID NO: 2067682 - RNA, 18 nt, Homo sapiens
aacucgccccccuacccc

SEQ ID NO: 2067683 - RNA, 19 nt, Homo sapiens
cuccuaagcuggagugcag

SEQ ID NO: 2067684 - RNA, 15 nt, Homo sapiens
cuuuccaggggccaa

SEQ ID NO: 2067685 - RNA, 18 nt, Homo sapiens
agccuaaaugauggugcu

SEQ ID NO: 2067686 - RNA, 15 nt, Homo sapiens
cccuggcuccaggcc

SEQ ID NO: 2067687 - RNA, 16 nt, Homo sapiens
cagggcucacacuccu

SEQ ID NO: 2067688 - RNA, 15 nt, Homo sapiens
ccauucuggacacug

SEQ ID NO: 2067689 - RNA, 12 nt, Homo sapiens
uugcaccacugc

SEQ ID NO: 2067690 - RNA, 17 nt, Homo sapiens
aggaaagcagugcagua

SEQ ID NO: 2067691 - RNA, 19 nt, Homo sapiens
uggccaaggagcugcuaua

SEQ ID NO: 2067692 - RNA, 14 nt, Homo sapiens
auuagugacuucaa

SEQ ID NO: 2067693 - RNA, 18 nt, Homo sapiens
accucagucucccagcua

SEQ ID NO: 2067694 - RNA, 23 nt, Homo sapiens
ugugccaaacuaccguucccaaa

SEQ ID NO: 2067695 - RNA, 14 nt, Homo sapiens
agucucauaucagg

SEQ ID NO: 2067696 - RNA, 14 nt, Homo sapiens
aacagaguaaucuu

SEQ ID NO: 2067697 - RNA, 14 nt, Homo sapiens
aaccagaguuucuu

SEQ ID NO: 2067698 - RNA, 16 nt, Homo sapiens
uuccucuccaccugca

SEQ ID NO: 2067699 - RNA, 20 nt, Homo sapiens
uggaugaaggcaucagaaac

SEQ ID NO: 2067700 - RNA, 14 nt, Homo sapiens
ccagcgccaaagga

SEQ ID NO: 2067701 - RNA, 14 nt, Homo sapiens
gucuuuaaccacuu

SEQ ID NO: 2067702 - RNA, 16 nt, Homo sapiens
ugaaaggaagaguuau

SEQ ID NO: 2067703 - RNA, 13 nt, Homo sapiens
gugggugggaugg

SEQ ID NO: 2067704 - RNA, 16 nt, Homo sapiens
agcaaauguggcuccu

SEQ ID NO: 2067705 - RNA, 17 nt, Homo sapiens
gaguccaggguggauga

SEQ ID NO: 2067706 - RNA, 20 nt, Homo sapiens
aacagacauagacugcaaaa

SEQ ID NO: 2067707 - RNA, 22 nt, Homo sapiens
ugaaacugcuguuuucuaggcc

SEQ ID NO: 2067708 - RNA, 21 nt, Homo sapiens
aaauuaauuuugguugguguu

SEQ ID NO: 2067709 - RNA, 19 nt, Homo sapiens
aacaucucaugugugcuca

SEQ ID NO: 2067710 - RNA, 16 nt, Homo sapiens
gcaugccuccaaaaau

SEQ ID NO: 2067711 - RNA, 17 nt, Homo sapiens
ggcaguugggagugagu

SEQ ID NO: 2067712 - RNA, 12 nt, Homo sapiens
guaucaucagac

SEQ ID NO: 2067713 - RNA, 22 nt, Homo sapiens
uagccaccuggccuaaugcugu

SEQ ID NO: 2067714 - RNA, 22 nt, Homo sapiens
agcuagacuagcuguaaaggac

SEQ ID NO: 2067715 - RNA, 14 nt, Homo sapiens
gcacagggcuguaa

SEQ ID NO: 2067716 - RNA, 14 nt, Homo sapiens
acugagagcccacu

SEQ ID NO: 2067717 - RNA, 20 nt, Homo sapiens
acccaugggcaggagacugu

SEQ ID NO: 2067718 - RNA, 19 nt, Homo sapiens
agaaaaggaaaagccaaca

SEQ ID NO: 2067719 - RNA, 16 nt, Homo sapiens
aauuccucuuacugua

SEQ ID NO: 2067720 - RNA, 19 nt, Homo sapiens
gaucacuuccuauaugcac

SEQ ID NO: 2067721 - RNA, 13 nt, Homo sapiens
gccucagaccuga

SEQ ID NO: 2067722 - RNA, 15 nt, Homo sapiens
ucaaggccuacugac

SEQ ID NO: 2067723 - RNA, 20 nt, Homo sapiens
auuuggucucucccagcucu

SEQ ID NO: 2067724 - RNA, 15 nt, Homo sapiens
acauuaucaacaugu

SEQ ID NO: 2067725 - RNA, 19 nt, Homo sapiens
aucgaaucuacuaauucca

SEQ ID NO: 2067726 - RNA, 15 nt, Homo sapiens
cagaagugcccuucc

SEQ ID NO: 2067727 - RNA, 21 nt, Homo sapiens
agcacauuuggcuuacaguaa

SEQ ID NO: 2067728 - RNA, 13 nt, Homo sapiens
aauuugaauuuau

SEQ ID NO: 2067729 - RNA, 13 nt, Homo sapiens
agaaaguuaugaa

SEQ ID NO: 2067730 - RNA, 15 nt, Homo sapiens
agugguggucuucaa

SEQ ID NO: 2067731 - RNA, 16 nt, Homo sapiens
gucaguggccaggugc

SEQ ID NO: 2067732 - RNA, 23 nt, Homo sapiens
caggaguucucccaccaccucac

SEQ ID NO: 2067733 - RNA, 20 nt, Homo sapiens
agguucucagguguugccaa

SEQ ID NO: 2067734 - RNA, 17 nt, Homo sapiens
auuccgaucgacugcca

SEQ ID NO: 2067735 - RNA, 15 nt, Homo sapiens
auguaguaugcuaug

SEQ ID NO: 2067736 - RNA, 14 nt, Homo sapiens
augaaaguggacaa

SEQ ID NO: 2067737 - RNA, 21 nt, Homo sapiens
uagaggaaggcugaacucuuc

SEQ ID NO: 2067738 - RNA, 17 nt, Homo sapiens
uagugcacaagcacuau

SEQ ID NO: 2067739 - RNA, 16 nt, Homo sapiens
ugucaggcuacaaggu

SEQ ID NO: 2067740 - RNA, 14 nt, Homo sapiens
caugugccucuuug

SEQ ID NO: 2067741 - RNA, 19 nt, Homo sapiens
gcccaguccuggccuggcu

SEQ ID NO: 2067742 - RNA, 16 nt, Homo sapiens
auccugccauccucaa

SEQ ID NO: 2067743 - RNA, 15 nt, Homo sapiens
ccuccaaaagcacuu

SEQ ID NO: 2067744 - RNA, 16 nt, Homo sapiens
guggcacacaccagua

SEQ ID NO: 2067745 - RNA, 21 nt, Homo sapiens
cccaaguacuuuccaaucuca

SEQ ID NO: 2067746 - RNA, 15 nt, Homo sapiens
uaaaauuagugcugu

SEQ ID NO: 2067747 - RNA, 15 nt, Homo sapiens
aggugagagcccuuu

SEQ ID NO: 2067748 - RNA, 17 nt, Homo sapiens
uggcuacugacuacccu

SEQ ID NO: 2067749 - RNA, 14 nt, Homo sapiens
cagaccacucccuu

SEQ ID NO: 2067750 - RNA, 18 nt, Homo sapiens
auaucaagagacauggua

SEQ ID NO: 2067751 - RNA, 21 nt, Homo sapiens
agggagcaacucuccacucca

SEQ ID NO: 2067752 - RNA, 12 nt, Homo sapiens
agggaggggaag

SEQ ID NO: 2067753 - RNA, 18 nt, Homo sapiens
agaauucacuuguggcua

SEQ ID NO: 2067754 - RNA, 16 nt, Homo sapiens
auaaagcguccucuca

SEQ ID NO: 2067755 - RNA, 15 nt, Homo sapiens
aaacaggcucugaga

SEQ ID NO: 2067756 - RNA, 19 nt, Homo sapiens
ccucuccaggcauuuagcc

SEQ ID NO: 2067757 - RNA, 15 nt, Homo sapiens
auguguguucaugca

SEQ ID NO: 2067758 - RNA, 15 nt, Homo sapiens
ccaaccuaaugcucu

SEQ ID NO: 2067759 - RNA, 22 nt, Homo sapiens
uauuuuccuucuuuguuucccc

SEQ ID NO: 2067760 - RNA, 17 nt, Homo sapiens
caaaagaauaagacaag

SEQ ID NO: 2067761 - RNA, 17 nt, Homo sapiens
aaucauuauuacuuuug

SEQ ID NO: 2067762 - RNA, 20 nt, Homo sapiens
ucucagaguccacuguggca

SEQ ID NO: 2067763 - RNA, 17 nt, Homo sapiens
ccuggaaaccacagucc

SEQ ID NO: 2067764 - RNA, 21 nt, Homo sapiens
cuguuugaugcuauuuaugca

SEQ ID NO: 2067765 - RNA, 21 nt, Homo sapiens
agcagaguguucccugacucc

SEQ ID NO: 2067766 - RNA, 19 nt, Homo sapiens
aacagcaggugccagagcu

SEQ ID NO: 2067767 - RNA, 16 nt, Homo sapiens
uuggggccaccaaagc

SEQ ID NO: 2067768 - RNA, 16 nt, Homo sapiens
uucacaugagcuauuu

SEQ ID NO: 2067769 - RNA, 13 nt, Homo sapiens
cccucaucagccu

SEQ ID NO: 2067770 - RNA, 15 nt, Homo sapiens
cuuacccaccuguca

SEQ ID NO: 2067771 - RNA, 22 nt, Homo sapiens
gagacacccucuggggguccuc

SEQ ID NO: 2067772 - RNA, 22 nt, Homo sapiens
aaaagacuuuuuccuugggcuu

SEQ ID NO: 2067773 - RNA, 14 nt, Homo sapiens
aauguacauaccuu

SEQ ID NO: 2067774 - RNA, 15 nt, Homo sapiens
guacagucuuaucaa

SEQ ID NO: 2067775 - RNA, 23 nt, Homo sapiens
gucucgucuccugacaugucuca

SEQ ID NO: 2067776 - RNA, 21 nt, Homo sapiens
gggccaugagggacagggucu

SEQ ID NO: 2067777 - RNA, 16 nt, Homo sapiens
gcccuugcuccagccu

SEQ ID NO: 2067778 - RNA, 16 nt, Homo sapiens
acuaguuuucaaucau

SEQ ID NO: 2067779 - RNA, 16 nt, Homo sapiens
uguuuaucgaaguaua

SEQ ID NO: 2067780 - RNA, 20 nt, Homo sapiens
acucacauacacacacaccu

SEQ ID NO: 2067781 - RNA, 17 nt, Homo sapiens
auaugauagaugacaaa

SEQ ID NO: 2067782 - RNA, 14 nt, Homo sapiens
aaguuuacuucucu

SEQ ID NO: 2067783 - RNA, 22 nt, Homo sapiens
ucacaggcagccagugcccuga

SEQ ID NO: 2067784 - RNA, 14 nt, Homo sapiens
aaugugaaacggaa

SEQ ID NO: 2067785 - RNA, 15 nt, Homo sapiens
ccgggcuggagaaag

SEQ ID NO: 2067786 - RNA, 18 nt, Homo sapiens
aaauuuaaaacuguugga

SEQ ID NO: 2067787 - RNA, 16 nt, Homo sapiens
ucagaaguuuggauaa

SEQ ID NO: 2067788 - RNA, 23 nt, Homo sapiens
cagagaaaggggagcccacuguc

SEQ ID NO: 2067789 - RNA, 16 nt, Homo sapiens
uaaugucuucacucua

SEQ ID NO: 2067790 - RNA, 19 nt, Homo sapiens
ugcagccugccccugugau

SEQ ID NO: 2067791 - RNA, 23 nt, Homo sapiens
uauacauacgcaauuguauauau

SEQ ID NO: 2067792 - RNA, 20 nt, Homo sapiens
ucuaagccuucugguuuuau

SEQ ID NO: 2067793 - RNA, 13 nt, Homo sapiens
gcacuagcauuuu

SEQ ID NO: 2067794 - RNA, 17 nt, Homo sapiens
cuuuucuauaaugugcc

SEQ ID NO: 2067795 - RNA, 21 nt, Homo sapiens
agaguuuggaauuauuguaga

SEQ ID NO: 2067796 - RNA, 14 nt, Homo sapiens
aucaagugucuucc

SEQ ID NO: 2067797 - RNA, 19 nt, Homo sapiens
gucuuccagcgagguggga

SEQ ID NO: 2067798 - RNA, 14 nt, Homo sapiens
ugaaccacuuugcc

SEQ ID NO: 2067799 - RNA, 17 nt, Homo sapiens
cugagccgaucuggucu

SEQ ID NO: 2067800 - RNA, 19 nt, Homo sapiens
ggaguuuaaacugaaugaa

SEQ ID NO: 2067801 - RNA, 13 nt, Homo sapiens
aggacgcgcacuc

SEQ ID NO: 2067802 - RNA, 15 nt, Homo sapiens
guguaguaucuugaa

SEQ ID NO: 2067803 - RNA, 14 nt, Homo sapiens
auacugaaacauuu

SEQ ID NO: 2067804 - RNA, 17 nt, Homo sapiens
accuauuugacuuacca

SEQ ID NO: 2067805 - RNA, 18 nt, Homo sapiens
cagcaacaggaaucucag

SEQ ID NO: 2067806 - RNA, 20 nt, Homo sapiens
gcaggaucugucugugcaca

SEQ ID NO: 2067807 - RNA, 22 nt, Homo sapiens
cacaucuccuguggucucugac

SEQ ID NO: 2067808 - RNA, 16 nt, Homo sapiens
cauggggcaagccagg

SEQ ID NO: 2067809 - RNA, 18 nt, Homo sapiens
gcacacgccuggcuucca

SEQ ID NO: 2067810 - RNA, 14 nt, Homo sapiens
ucccagagcccagg

SEQ ID NO: 2067811 - RNA, 20 nt, Homo sapiens
agucccuguccggaaugcca

SEQ ID NO: 2067812 - RNA, 21 nt, Homo sapiens
agcuaucugccugacaggcug

SEQ ID NO: 2067813 - RNA, 19 nt, Homo sapiens
ugcuuucuuguugcugcau

SEQ ID NO: 2067814 - RNA, 21 nt, Homo sapiens
aagacucuuuggguccauuca

SEQ ID NO: 2067815 - RNA, 21 nt, Homo sapiens
aguggaaacaaagggugggca

SEQ ID NO: 2067816 - RNA, 21 nt, Homo sapiens
auauuuuuggugguggugggu

SEQ ID NO: 2067817 - RNA, 14 nt, Homo sapiens
acugucucacuuaa

SEQ ID NO: 2067818 - RNA, 16 nt, Homo sapiens
auaucccuacauguau

SEQ ID NO: 2067819 - RNA, 23 nt, Homo sapiens
acucaaaacgcuacugagucaca

SEQ ID NO: 2067820 - RNA, 20 nt, Homo sapiens
gccugggcaacacggugaaa

SEQ ID NO: 2067821 - RNA, 19 nt, Homo sapiens
gagucaggaaagacaggcu

SEQ ID NO: 2067822 - RNA, 16 nt, Homo sapiens
auaacuggaaacuuca

SEQ ID NO: 2067823 - RNA, 20 nt, Homo sapiens
ccagaggaagggacaccaag

SEQ ID NO: 2067824 - RNA, 15 nt, Homo sapiens
cugauacuuuagcca

SEQ ID NO: 2067825 - RNA, 20 nt, Homo sapiens
gggccuugcucugagcacag

SEQ ID NO: 2067826 - RNA, 17 nt, Homo sapiens
gagggauuuucacagug

SEQ ID NO: 2067827 - RNA, 15 nt, Homo sapiens
aauacucucugagua

SEQ ID NO: 2067828 - RNA, 15 nt, Homo sapiens
uuuaauuuugcagau

SEQ ID NO: 2067829 - RNA, 14 nt, Homo sapiens
caccacugauauca

SEQ ID NO: 2067830 - RNA, 22 nt, Homo sapiens
ucaaugcuauaacuauguugau

SEQ ID NO: 2067831 - RNA, 13 nt, Homo sapiens
uuaauaaugguua

SEQ ID NO: 2067832 - RNA, 13 nt, Homo sapiens
uuuuuaauggaaa

SEQ ID NO: 2067833 - RNA, 20 nt, Homo sapiens
caccacccccacuggugaga

SEQ ID NO: 2067834 - RNA, 14 nt, Homo sapiens
cauuguuuuaagga

SEQ ID NO: 2067835 - RNA, 22 nt, Homo sapiens
ugaacuggaaaagaucauugcu

SEQ ID NO: 2067836 - RNA, 16 nt, Homo sapiens
agccagggcacaacca

SEQ ID NO: 2067837 - RNA, 13 nt, Homo sapiens
ccaagcauuucau

SEQ ID NO: 2067838 - RNA, 17 nt, Homo sapiens
acugucaugcugucagu

SEQ ID NO: 2067839 - RNA, 17 nt, Homo sapiens
ggcagcugagcagcuuu

SEQ ID NO: 2067840 - RNA, 17 nt, Homo sapiens
gagcacuguagcacuua

SEQ ID NO: 2067841 - RNA, 13 nt, Homo sapiens
ccuggacacagcc

SEQ ID NO: 2067842 - RNA, 11 nt, Homo sapiens
uaggcuucuau

SEQ ID NO: 2067843 - RNA, 13 nt, Homo sapiens
acgauuugucagu

SEQ ID NO: 2067844 - RNA, 15 nt, Homo sapiens
ucagucuauccacag

SEQ ID NO: 2067845 - RNA, 15 nt, Homo sapiens
gugaaaggcucagua

SEQ ID NO: 2067846 - RNA, 19 nt, Homo sapiens
agcccacccugcaccucau

SEQ ID NO: 2067847 - RNA, 17 nt, Homo sapiens
gugcucagagaccugaa

SEQ ID NO: 2067848 - RNA, 20 nt, Homo sapiens
uggaaauaacugagcacuuu

SEQ ID NO: 2067849 - RNA, 21 nt, Homo sapiens
uauucgugcauuuuuggauca

SEQ ID NO: 2067850 - RNA, 14 nt, Homo sapiens
aaugauguuuuccu

SEQ ID NO: 2067851 - RNA, 21 nt, Homo sapiens
agcuucuuuugauacugaaaa

SEQ ID NO: 2067852 - RNA, 20 nt, Homo sapiens
uaaugaucucaaacuaugac

SEQ ID NO: 2067853 - RNA, 17 nt, Homo sapiens
cauaccguguaccucag

SEQ ID NO: 2067854 - RNA, 12 nt, Homo sapiens
ucaagugcaguc

SEQ ID NO: 2067855 - RNA, 22 nt, Homo sapiens
caggugagcaauuagauuagua

SEQ ID NO: 2067856 - RNA, 20 nt, Homo sapiens
ucuuuguauauuucuaguau

SEQ ID NO: 2067857 - RNA, 16 nt, Homo sapiens
acauccaagcuuccuu

SEQ ID NO: 2067858 - RNA, 20 nt, Homo sapiens
gccuucccaagguucuaucc

SEQ ID NO: 2067859 - RNA, 20 nt, Homo sapiens
cuuagauuagcucuggacca

SEQ ID NO: 2067860 - RNA, 15 nt, Homo sapiens
caaaacugcauuuca

SEQ ID NO: 2067861 - RNA, 13 nt, Homo sapiens
agcaaacuuggaa

SEQ ID NO: 2067862 - RNA, 21 nt, Homo sapiens
cuucccuggcuuguaacucca

SEQ ID NO: 2067863 - RNA, 16 nt, Homo sapiens
augggagggcauucca

SEQ ID NO: 2067864 - RNA, 22 nt, Homo sapiens
ggugcuauccugcccaggccag

SEQ ID NO: 2067865 - RNA, 13 nt, Homo sapiens
cuuccccuaccca

SEQ ID NO: 2067866 - RNA, 21 nt, Homo sapiens
gcccaggucucucaacuucau

SEQ ID NO: 2067867 - RNA, 17 nt, Homo sapiens
augccacccugcauuug

SEQ ID NO: 2067868 - RNA, 14 nt, Homo sapiens
uuggcaucugcaaa

SEQ ID NO: 2067869 - RNA, 19 nt, Homo sapiens
uugcacucuggaacugcau

SEQ ID NO: 2067870 - RNA, 19 nt, Homo sapiens
ccugauacaggcauggcag

SEQ ID NO: 2067871 - RNA, 17 nt, Homo sapiens
gccuccagaagcacugg

SEQ ID NO: 2067872 - RNA, 14 nt, Homo sapiens
acuaaugacuuugu

SEQ ID NO: 2067873 - RNA, 14 nt, Homo sapiens
uucauaaccaaaga

SEQ ID NO: 2067874 - RNA, 19 nt, Homo sapiens
agauucauaaaguaaugau

SEQ ID NO: 2067875 - RNA, 15 nt, Homo sapiens
cuuuugaaugaugcc

SEQ ID NO: 2067876 - RNA, 19 nt, Homo sapiens
augguuccauucucucucc

SEQ ID NO: 2067877 - RNA, 15 nt, Homo sapiens
auacauguguguaua

SEQ ID NO: 2067878 - RNA, 17 nt, Homo sapiens
ggauggucuugaucucc

SEQ ID NO: 2067879 - RNA, 13 nt, Homo sapiens
ucccuuucugccc

SEQ ID NO: 2067880 - RNA, 20 nt, Homo sapiens
acccuggugaccuccuguca

SEQ ID NO: 2067881 - RNA, 13 nt, Homo sapiens
uugacuuugccac

SEQ ID NO: 2067882 - RNA, 17 nt, Homo sapiens
aacaaucuuugcuguau

SEQ ID NO: 2067883 - RNA, 13 nt, Homo sapiens
caagcuccaucuc

SEQ ID NO: 2067884 - RNA, 23 nt, Homo sapiens
cggucugagaagauucaauuuaa

SEQ ID NO: 2067885 - RNA, 14 nt, Homo sapiens
ugcagugaugcaau

SEQ ID NO: 2067886 - RNA, 19 nt, Homo sapiens
agaugugcaagucuuguca

SEQ ID NO: 2067887 - RNA, 20 nt, Homo sapiens
caacuggcuucugugcacua

SEQ ID NO: 2067888 - RNA, 19 nt, Homo sapiens
uuaaggaaaaguaagggaa

SEQ ID NO: 2067889 - RNA, 23 nt, Homo sapiens
accuucacuccagacagacaggg

SEQ ID NO: 2067890 - RNA, 18 nt, Homo sapiens
cagcccugucacgccggg

SEQ ID NO: 2067891 - RNA, 20 nt, Homo sapiens
ugggggacccaggugggacu

SEQ ID NO: 2067892 - RNA, 14 nt, Homo sapiens
gacccacaaacugc

SEQ ID NO: 2067893 - RNA, 18 nt, Homo sapiens
uccagaggggugcgcaga

SEQ ID NO: 2067894 - RNA, 23 nt, Homo sapiens
cuggaagauauaacauucaguuc

SEQ ID NO: 2067895 - RNA, 18 nt, Homo sapiens
ugcacuagccugugauua

SEQ ID NO: 2067896 - RNA, 14 nt, Homo sapiens
aaauggcuuaucca

SEQ ID NO: 2067897 - RNA, 15 nt, Homo sapiens
ggcccugugccuugg

SEQ ID NO: 2067898 - RNA, 20 nt, Homo sapiens
uccagauugaaaaguguccu

SEQ ID NO: 2067899 - RNA, 13 nt, Homo sapiens
aggagcuucccac

SEQ ID NO: 2067900 - RNA, 18 nt, Homo sapiens
accuaaauugaacugcca

SEQ ID NO: 2067901 - RNA, 17 nt, Homo sapiens
uaauuccuucagcacuu

SEQ ID NO: 2067902 - RNA, 17 nt, Homo sapiens
uaauuccuacagcacua

SEQ ID NO: 2067903 - RNA, 18 nt, Homo sapiens
uccugccaggauuaaaag

SEQ ID NO: 2067904 - RNA, 17 nt, Homo sapiens
aacaucuuucagcugcu

SEQ ID NO: 2067905 - RNA, 19 nt, Homo sapiens
ucgccuguuggggaccuca

SEQ ID NO: 2067906 - RNA, 16 nt, Homo sapiens
aguaugguauuacaaa

SEQ ID NO: 2067907 - RNA, 16 nt, Homo sapiens
caguacuuaccaguca

SEQ ID NO: 2067908 - RNA, 19 nt, Homo sapiens
agggauuuucacagugugc

SEQ ID NO: 2067909 - RNA, 15 nt, Homo sapiens
ugccacaagcacaau

SEQ ID NO: 2067910 - RNA, 12 nt, Homo sapiens
aacaaagucuuu

SEQ ID NO: 2067911 - RNA, 12 nt, Homo sapiens
uccuaccucagc

SEQ ID NO: 2067912 - RNA, 20 nt, Homo sapiens
caggaaaauggacaucaaaa

SEQ ID NO: 2067913 - RNA, 14 nt, Homo sapiens
gaccucauguuguu

SEQ ID NO: 2067914 - RNA, 16 nt, Homo sapiens
accauaucacaaguga

SEQ ID NO: 2067915 - RNA, 21 nt, Homo sapiens
uggcaguucucgcagauguua

SEQ ID NO: 2067916 - RNA, 16 nt, Homo sapiens
augauagaugacaaau

SEQ ID NO: 2067917 - RNA, 18 nt, Homo sapiens
uuacucuuuccuauuuca

SEQ ID NO: 2067918 - RNA, 21 nt, Homo sapiens
ccauuaucuguauuaaugcuu

SEQ ID NO: 2067919 - RNA, 22 nt, Homo sapiens
aaucaggcugaggugucuuaag

SEQ ID NO: 2067920 - RNA, 16 nt, Homo sapiens
uuuacagaacuguugu

SEQ ID NO: 2067921 - RNA, 15 nt, Homo sapiens
ccauguuacuucucu

SEQ ID NO: 2067922 - RNA, 22 nt, Homo sapiens
ugcaacagguuuguucucagga

SEQ ID NO: 2067923 - RNA, 21 nt, Homo sapiens
augccccccucaaaccuccuc

SEQ ID NO: 2067924 - RNA, 22 nt, Homo sapiens
ccgcucguuccugcagccagaa

SEQ ID NO: 2067925 - RNA, 15 nt, Homo sapiens
guguucucagugaaa

SEQ ID NO: 2067926 - RNA, 21 nt, Homo sapiens
guucagcuccuuccaccacaa

SEQ ID NO: 2067927 - RNA, 19 nt, Homo sapiens
cucacaauuccaaacauac

SEQ ID NO: 2067928 - RNA, 16 nt, Homo sapiens
caugucuauucagcuu

SEQ ID NO: 2067929 - RNA, 12 nt, Homo sapiens
gaugccucagag

SEQ ID NO: 2067930 - RNA, 17 nt, Homo sapiens
caggugggacuuagcag

SEQ ID NO: 2067931 - RNA, 17 nt, Homo sapiens
aagauugauuaaugaac

SEQ ID NO: 2067932 - RNA, 17 nt, Homo sapiens
gaugccccagagcucua

SEQ ID NO: 2067933 - RNA, 22 nt, Homo sapiens
cuggaauguaaguaagugacaa

SEQ ID NO: 2067934 - RNA, 23 nt, Homo sapiens
aaggaacauugcagagcuaagca

SEQ ID NO: 2067935 - RNA, 22 nt, Homo sapiens
aaugaaguagaaguuacuuaau

SEQ ID NO: 2067936 - RNA, 13 nt, Homo sapiens
ugccacggccaug

SEQ ID NO: 2067937 - RNA, 16 nt, Homo sapiens
auguuacugugugaag

SEQ ID NO: 2067938 - RNA, 12 nt, Homo sapiens
ggcugcuugcuu

SEQ ID NO: 2067939 - RNA, 18 nt, Homo sapiens
aauaaugucaacaccaga

SEQ ID NO: 2067940 - RNA, 16 nt, Homo sapiens
gagaauacaauaacua

SEQ ID NO: 2067941 - RNA, 17 nt, Homo sapiens
acgccuguaaucccaga

SEQ ID NO: 2067942 - RNA, 18 nt, Homo sapiens
cacuuggcugcucauucc

SEQ ID NO: 2067943 - RNA, 20 nt, Homo sapiens
aauucucauuugucacacac

SEQ ID NO: 2067944 - RNA, 17 nt, Homo sapiens
ccaugggccugggccug

SEQ ID NO: 2067945 - RNA, 21 nt, Homo sapiens
ccugagagcccagaaaaggua

SEQ ID NO: 2067946 - RNA, 21 nt, Homo sapiens
ugugcugguucuguuuucuaa

SEQ ID NO: 2067947 - RNA, 17 nt, Homo sapiens
gccucucuuucacacaa

SEQ ID NO: 2067948 - RNA, 15 nt, Homo sapiens
cacaaaugaccgcac

SEQ ID NO: 2067949 - RNA, 20 nt, Homo sapiens
uguagccccgggcugaccca

SEQ ID NO: 2067950 - RNA, 23 nt, Homo sapiens
uguuaauggucaaugcuagcaca

SEQ ID NO: 2067951 - RNA, 15 nt, Homo sapiens
aucccagcaccugcc

SEQ ID NO: 2067952 - RNA, 19 nt, Homo sapiens
acccugcuuuggcggcccg

SEQ ID NO: 2067953 - RNA, 15 nt, Homo sapiens
uggagggcaucaggc

SEQ ID NO: 2067954 - RNA, 21 nt, Homo sapiens
uaucacgcgcacagccuggca

SEQ ID NO: 2067955 - RNA, 16 nt, Homo sapiens
uuacaugcagaguauu

SEQ ID NO: 2067956 - RNA, 16 nt, Homo sapiens
uguauauauauucuca

SEQ ID NO: 2067957 - RNA, 16 nt, Homo sapiens
uaaacauaugauuuca

SEQ ID NO: 2067958 - RNA, 15 nt, Homo sapiens
auucuuaagcacuuu

SEQ ID NO: 2067959 - RNA, 13 nt, Homo sapiens
uagcuuaguucuc

SEQ ID NO: 2067960 - RNA, 17 nt, Homo sapiens
aucuuucccaaaaccca

SEQ ID NO: 2067961 - RNA, 11 nt, Homo sapiens
aacuggcugca

SEQ ID NO: 2067962 - RNA, 19 nt, Homo sapiens
gaacauguaaaagggugaa

SEQ ID NO: 2067963 - RNA, 22 nt, Homo sapiens
aggaaucggaauccugucgauu

SEQ ID NO: 2067964 - RNA, 21 nt, Homo sapiens
aaauugcucuuggcugugaaa

SEQ ID NO: 2067965 - RNA, 16 nt, Homo sapiens
uccaguugucuauuca

SEQ ID NO: 2067966 - RNA, 21 nt, Homo sapiens
accauggauggcaaaugugau

SEQ ID NO: 2067967 - RNA, 19 nt, Homo sapiens
ccaguccccagcccugggc

SEQ ID NO: 2067968 - RNA, 20 nt, Homo sapiens
caaaacuuggaauucucuca

SEQ ID NO: 2067969 - RNA, 19 nt, Homo sapiens
auauauguuaagcagauau

SEQ ID NO: 2067970 - RNA, 14 nt, Homo sapiens
auauccucccucca

SEQ ID NO: 2067971 - RNA, 21 nt, Homo sapiens
cagccaugcauuguuaaucau

SEQ ID NO: 2067972 - RNA, 22 nt, Homo sapiens
agaccuugaugcuuggccuccc

SEQ ID NO: 2067973 - RNA, 18 nt, Homo sapiens
ugauacaugcauugcucu

SEQ ID NO: 2067974 - RNA, 13 nt, Homo sapiens
cagcugucauuca

SEQ ID NO: 2067975 - RNA, 13 nt, Homo sapiens
caguagucauuuu

SEQ ID NO: 2067976 - RNA, 22 nt, Homo sapiens
ggcugucagauauaaguaacuu

SEQ ID NO: 2067977 - RNA, 20 nt, Homo sapiens
caccaggggugcucaccucu

SEQ ID NO: 2067978 - RNA, 14 nt, Homo sapiens
uggcaauugcacuc

SEQ ID NO: 2067979 - RNA, 16 nt, Homo sapiens
aacccaaaacaguaaa

SEQ ID NO: 2067980 - RNA, 11 nt, Homo sapiens
ugcggcugugc

SEQ ID NO: 2067981 - RNA, 16 nt, Homo sapiens
uuccuguccaaacuca

SEQ ID NO: 2067982 - RNA, 18 nt, Homo sapiens
uuugguacacacuugacc

SEQ ID NO: 2067983 - RNA, 14 nt, Homo sapiens
ccagcccaggaguu

SEQ ID NO: 2067984 - RNA, 17 nt, Homo sapiens
uauagcaagacauuaua

SEQ ID NO: 2067985 - RNA, 12 nt, Homo sapiens
cucuuccuugaa

SEQ ID NO: 2067986 - RNA, 16 nt, Homo sapiens
uuggacucuugcucuu

SEQ ID NO: 2067987 - RNA, 16 nt, Homo sapiens
cauguuuccaucauuu

SEQ ID NO: 2067988 - RNA, 15 nt, Homo sapiens
aaagucagagacaga

SEQ ID NO: 2067989 - RNA, 20 nt, Homo sapiens
uaacacuggcuucaggcaaa

SEQ ID NO: 2067990 - RNA, 23 nt, Homo sapiens
gcucacauuucauuagugagcca

SEQ ID NO: 2067991 - RNA, 18 nt, Homo sapiens
ucuagcuaccuguauuau

SEQ ID NO: 2067992 - RNA, 16 nt, Homo sapiens
gcugggccauguccaa

SEQ ID NO: 2067993 - RNA, 20 nt, Homo sapiens
gacucccaugcaaguagcug

SEQ ID NO: 2067994 - RNA, 19 nt, Homo sapiens
cuggacauucucuuugaua

SEQ ID NO: 2067995 - RNA, 17 nt, Homo sapiens
aauucauaacuaaugaa

SEQ ID NO: 2067996 - RNA, 15 nt, Homo sapiens
cacucuguuugcuca

SEQ ID NO: 2067997 - RNA, 14 nt, Homo sapiens
auaaugcaguaugg

SEQ ID NO: 2067998 - RNA, 15 nt, Homo sapiens
cuucuccacagggac

SEQ ID NO: 2067999 - RNA, 17 nt, Homo sapiens
guagcagugucuguaaa

SEQ ID NO: 2068000 - RNA, 20 nt, Homo sapiens
ucgucuuaaguuuuuuaugc

SEQ ID NO: 2068001 - RNA, 19 nt, Homo sapiens
uacaccugcggggccaccc

SEQ ID NO: 2068002 - RNA, 22 nt, Homo sapiens
ggacuugccacccccaguuccu

SEQ ID NO: 2068003 - RNA, 22 nt, Homo sapiens
uuuuuucuuuuuugccaaauug

SEQ ID NO: 2068004 - RNA, 15 nt, Homo sapiens
uauaauaugucuuca

SEQ ID NO: 2068005 - RNA, 15 nt, Homo sapiens
cugcuucaugggaaa

SEQ ID NO: 2068006 - RNA, 20 nt, Homo sapiens
aaacuguuagcacuguugau

SEQ ID NO: 2068007 - RNA, 18 nt, Homo sapiens
uuggcuccagucuuccga

SEQ ID NO: 2068008 - RNA, 22 nt, Homo sapiens
gcugugauuguacuguacauaa

SEQ ID NO: 2068009 - RNA, 13 nt, Homo sapiens
ggaucuucccaca

SEQ ID NO: 2068010 - RNA, 19 nt, Homo sapiens
gacaacuguggacuccagu

SEQ ID NO: 2068011 - RNA, 22 nt, Homo sapiens
cugggaccacaagugugcauua

SEQ ID NO: 2068012 - RNA, 23 nt, Homo sapiens
auaugcaugcccuuccuuucuau

SEQ ID NO: 2068013 - RNA, 16 nt, Homo sapiens
cugacucauaggggag

SEQ ID NO: 2068014 - RNA, 14 nt, Homo sapiens
aaagccuuccucaa

SEQ ID NO: 2068015 - RNA, 14 nt, Homo sapiens
cccucucugaaccu

SEQ ID NO: 2068016 - RNA, 14 nt, Homo sapiens
cacuuucugcacuu

SEQ ID NO: 2068017 - RNA, 21 nt, Homo sapiens
cuuagcuaguuuuauucuugg

SEQ ID NO: 2068018 - RNA, 16 nt, Homo sapiens
gccagggcuuccucaa

SEQ ID NO: 2068019 - RNA, 19 nt, Homo sapiens
aaugaauuccucauuugga

SEQ ID NO: 2068020 - RNA, 14 nt, Homo sapiens
uugcuucuauuauu

SEQ ID NO: 2068021 - RNA, 18 nt, Homo sapiens
guggcugcaggggucuca

SEQ ID NO: 2068022 - RNA, 20 nt, Homo sapiens
ggcucaggaagaaaccccaa

SEQ ID NO: 2068023 - RNA, 14 nt, Homo sapiens
uuauguagcuaaac

SEQ ID NO: 2068024 - RNA, 17 nt, Homo sapiens
caguccacacuuugucc

SEQ ID NO: 2068025 - RNA, 13 nt, Homo sapiens
gccagaggcaccu

SEQ ID NO: 2068026 - RNA, 15 nt, Homo sapiens
aaggucacucuuggu

SEQ ID NO: 2068027 - RNA, 13 nt, Homo sapiens
auuccugcugccu

SEQ ID NO: 2068028 - RNA, 18 nt, Homo sapiens
cuauaaaacuaggugcug

SEQ ID NO: 2068029 - RNA, 19 nt, Homo sapiens
uuuaaaaaugcaccacuuu

SEQ ID NO: 2068030 - RNA, 14 nt, Homo sapiens
gagguacgaaaaga

SEQ ID NO: 2068031 - RNA, 20 nt, Homo sapiens
uagaacuucaagaaguaaga

SEQ ID NO: 2068032 - RNA, 18 nt, Homo sapiens
agugaacaagaaacauga

SEQ ID NO: 2068033 - RNA, 23 nt, Homo sapiens
aaaaguaaagaugcuacuuccca

SEQ ID NO: 2068034 - RNA, 22 nt, Homo sapiens
cuuaauuuugcgauacacugca

SEQ ID NO: 2068035 - RNA, 21 nt, Homo sapiens
uaucaggaguucuaggaacuc

SEQ ID NO: 2068036 - RNA, 15 nt, Homo sapiens
ugcuuucugguggug

SEQ ID NO: 2068037 - RNA, 15 nt, Homo sapiens
gcaggccacugggga

SEQ ID NO: 2068038 - RNA, 18 nt, Homo sapiens
guaugaaggaaucauucc

SEQ ID NO: 2068039 - RNA, 20 nt, Homo sapiens
ugaggccacacccagaguag

SEQ ID NO: 2068040 - RNA, 14 nt, Homo sapiens
cucagguaguacug

SEQ ID NO: 2068041 - RNA, 15 nt, Homo sapiens
ggguugagggaugcu

SEQ ID NO: 2068042 - RNA, 12 nt, Homo sapiens
gauucugcauuu

SEQ ID NO: 2068043 - RNA, 17 nt, Homo sapiens
acaacuuaaugugcugc

SEQ ID NO: 2068044 - RNA, 23 nt, Homo sapiens
guguccccccuugaagcaauaac

SEQ ID NO: 2068045 - RNA, 16 nt, Homo sapiens
agucaccuuucugggc

SEQ ID NO: 2068046 - RNA, 16 nt, Homo sapiens
aaggugcauugauaca

SEQ ID NO: 2068047 - RNA, 14 nt, Homo sapiens
gcucauagcacaug

SEQ ID NO: 2068048 - RNA, 17 nt, Homo sapiens
acucacuuagcaugaau

SEQ ID NO: 2068049 - RNA, 14 nt, Homo sapiens
augcgaugugucca

SEQ ID NO: 2068050 - RNA, 13 nt, Homo sapiens
caaagccaaaacc

SEQ ID NO: 2068051 - RNA, 11 nt, Homo sapiens
gguggggccag

SEQ ID NO: 2068052 - RNA, 13 nt, Homo sapiens
uucacagccagac

SEQ ID NO: 2068053 - RNA, 21 nt, Homo sapiens
ccaauagcaggggcugcagua

SEQ ID NO: 2068054 - RNA, 18 nt, Homo sapiens
gcuugaguggacagcagc

SEQ ID NO: 2068055 - RNA, 13 nt, Homo sapiens
uuaugacacuccc

SEQ ID NO: 2068056 - RNA, 20 nt, Homo sapiens
caaccucaaugcccugccau

SEQ ID NO: 2068057 - RNA, 18 nt, Homo sapiens
uuuggcuagguaucauuc

SEQ ID NO: 2068058 - RNA, 19 nt, Homo sapiens
uuaccuaguagucauuuca

SEQ ID NO: 2068059 - RNA, 16 nt, Homo sapiens
agaggaccccagggug

SEQ ID NO: 2068060 - RNA, 23 nt, Homo sapiens
caucuacucuaaagaaaaaugcc

SEQ ID NO: 2068061 - RNA, 15 nt, Homo sapiens
auaaguagagacuga

SEQ ID NO: 2068062 - RNA, 13 nt, Homo sapiens
gacuuaacaccca

SEQ ID NO: 2068063 - RNA, 23 nt, Homo sapiens
aaugagaagccaagcucuucaag

SEQ ID NO: 2068064 - RNA, 16 nt, Homo sapiens
agugguggucuucaag

SEQ ID NO: 2068065 - RNA, 17 nt, Homo sapiens
ugagaucagucagcucc

SEQ ID NO: 2068066 - RNA, 17 nt, Homo sapiens
ggccuggcaagugggug

SEQ ID NO: 2068067 - RNA, 21 nt, Homo sapiens
cugugugugacaccaccacug

SEQ ID NO: 2068068 - RNA, 21 nt, Homo sapiens
ccgggagggugcggcugugca

SEQ ID NO: 2068069 - RNA, 13 nt, Homo sapiens
cccugcaaccucg

SEQ ID NO: 2068070 - RNA, 11 nt, Homo sapiens
cuuaguugaaa

SEQ ID NO: 2068071 - RNA, 21 nt, Homo sapiens
cagggaaaugccucgagccau

SEQ ID NO: 2068072 - RNA, 15 nt, Homo sapiens
agcaucccccaaagu

SEQ ID NO: 2068073 - RNA, 15 nt, Homo sapiens
ccccaggaacaauaa

SEQ ID NO: 2068074 - RNA, 16 nt, Homo sapiens
ccugugugugcugcca

SEQ ID NO: 2068075 - RNA, 20 nt, Homo sapiens
ucacgggcaacacucacugc

SEQ ID NO: 2068076 - RNA, 18 nt, Homo sapiens
guauauaugaaugaauaa

SEQ ID NO: 2068077 - RNA, 19 nt, Homo sapiens
ccuccuauuccagugucca

SEQ ID NO: 2068078 - RNA, 23 nt, Homo sapiens
ggcuaccucaccugggcagggau

SEQ ID NO: 2068079 - RNA, 17 nt, Homo sapiens
ucagugcucagaaauuu

SEQ ID NO: 2068080 - RNA, 14 nt, Homo sapiens
cucugcucaaugaa

SEQ ID NO: 2068081 - RNA, 13 nt, Homo sapiens
gucaguugccaug

SEQ ID NO: 2068082 - RNA, 22 nt, Homo sapiens
cuauguguuaaacagaggugau

SEQ ID NO: 2068083 - RNA, 16 nt, Homo sapiens
uccuaaaguaacauca

SEQ ID NO: 2068084 - RNA, 17 nt, Homo sapiens
gaaaauaugauguuuca

SEQ ID NO: 2068085 - RNA, 16 nt, Homo sapiens
uucagaaucuuuucaa

SEQ ID NO: 2068086 - RNA, 17 nt, Homo sapiens
guguguucuauccaaac

SEQ ID NO: 2068087 - RNA, 15 nt, Homo sapiens
uaauuuaacuuucca

SEQ ID NO: 2068088 - RNA, 16 nt, Homo sapiens
acccccaucucuacua

SEQ ID NO: 2068089 - RNA, 22 nt, Homo sapiens
uccaggaauauaugucagugau

SEQ ID NO: 2068090 - RNA, 14 nt, Homo sapiens
accaagaguaugag

SEQ ID NO: 2068091 - RNA, 15 nt, Homo sapiens
auuuaauuugauauc

SEQ ID NO: 2068092 - RNA, 14 nt, Homo sapiens
gugaccacuuucaa

SEQ ID NO: 2068093 - RNA, 21 nt, Homo sapiens
uccaauucugaccuuacaaaa

SEQ ID NO: 2068094 - RNA, 16 nt, Homo sapiens
gcgccaggaagccaga

SEQ ID NO: 2068095 - RNA, 24 nt, Homo sapiens
aaaggaaugaaagagagcucuaac

SEQ ID NO: 2068096 - RNA, 21 nt, Homo sapiens
acugaggcaggcauggaguug

SEQ ID NO: 2068097 - RNA, 17 nt, Homo sapiens
ccgucugaccaagggcu

SEQ ID NO: 2068098 - RNA, 15 nt, Homo sapiens
gcauucaaaugggcu

SEQ ID NO: 2068099 - RNA, 19 nt, Homo sapiens
aaacaggccgagugaaggu

SEQ ID NO: 2068100 - RNA, 12 nt, Homo sapiens
agaucacugcca

SEQ ID NO: 2068101 - RNA, 22 nt, Homo sapiens
auguugauacuagcauacuuaa

SEQ ID NO: 2068102 - RNA, 18 nt, Homo sapiens
auccuugcuuuaccacaa

SEQ ID NO: 2068103 - RNA, 20 nt, Homo sapiens
gccaaggggugggccuguga

SEQ ID NO: 2068104 - RNA, 19 nt, Homo sapiens
aaaaccuuguaaaaaaagc

SEQ ID NO: 2068105 - RNA, 18 nt, Homo sapiens
uaagcugauuugauacca

SEQ ID NO: 2068106 - RNA, 15 nt, Homo sapiens
cugucccggcuccau

SEQ ID NO: 2068107 - RNA, 16 nt, Homo sapiens
aggguccccacagccc

SEQ ID NO: 2068108 - RNA, 15 nt, Homo sapiens
cgguuaccucugcau

SEQ ID NO: 2068109 - RNA, 20 nt, Homo sapiens
gucaugcauaaauaugcagu

SEQ ID NO: 2068110 - RNA, 12 nt, Homo sapiens
augugucuucaa

SEQ ID NO: 2068111 - RNA, 16 nt, Homo sapiens
uugaaaaagacauuca

SEQ ID NO: 2068112 - RNA, 21 nt, Homo sapiens
augugaccagacugcacagga

SEQ ID NO: 2068113 - RNA, 18 nt, Homo sapiens
agguucuuuaaaaugcca

SEQ ID NO: 2068114 - RNA, 21 nt, Homo sapiens
uuuuggggggagagacacaga

SEQ ID NO: 2068115 - RNA, 14 nt, Homo sapiens
agaaauuaugugcc

SEQ ID NO: 2068116 - RNA, 20 nt, Homo sapiens
ugcuuucaauugauggacua

SEQ ID NO: 2068117 - RNA, 16 nt, Homo sapiens
augcugcgcuuaccuu

SEQ ID NO: 2068118 - RNA, 15 nt, Homo sapiens
aaauuuuuaccuguu

SEQ ID NO: 2068119 - RNA, 17 nt, Homo sapiens
gccugaugugagugugu

SEQ ID NO: 2068120 - RNA, 13 nt, Homo sapiens
aagaaaucaaaga

SEQ ID NO: 2068121 - RNA, 17 nt, Homo sapiens
ucaugaagcccaaguga

SEQ ID NO: 2068122 - RNA, 14 nt, Homo sapiens
cuucuuacucauua

SEQ ID NO: 2068123 - RNA, 20 nt, Homo sapiens
uggucuaagguucagccuga

SEQ ID NO: 2068124 - RNA, 18 nt, Homo sapiens
aguugggaagucucagcc

SEQ ID NO: 2068125 - RNA, 16 nt, Homo sapiens
ccaauuacuacuuugu

SEQ ID NO: 2068126 - RNA, 18 nt, Homo sapiens
cuaucuuuugguauacuu

SEQ ID NO: 2068127 - RNA, 17 nt, Homo sapiens
uuugcuaaagacaugaa

SEQ ID NO: 2068128 - RNA, 14 nt, Homo sapiens
acacagacuggcaa

SEQ ID NO: 2068129 - RNA, 15 nt, Homo sapiens
uugcuggcaaagaca

SEQ ID NO: 2068130 - RNA, 15 nt, Homo sapiens
aucuuucacagggga

SEQ ID NO: 2068131 - RNA, 17 nt, Homo sapiens
gcaucugugccagagau

SEQ ID NO: 2068132 - RNA, 20 nt, Homo sapiens
uuaacaucuugaacugguug

SEQ ID NO: 2068133 - RNA, 22 nt, Homo sapiens
gccaguuggcuucugugccuga

SEQ ID NO: 2068134 - RNA, 14 nt, Homo sapiens
ugcagagguccaaa

SEQ ID NO: 2068135 - RNA, 20 nt, Homo sapiens
uaucaaugcccaacagggca

SEQ ID NO: 2068136 - RNA, 22 nt, Homo sapiens
cagugcuccuguaagucaaaug

SEQ ID NO: 2068137 - RNA, 21 nt, Homo sapiens
aaauuugugcuggguuauuca

SEQ ID NO: 2068138 - RNA, 22 nt, Homo sapiens
cauuucucaucaguaguucaca

SEQ ID NO: 2068139 - RNA, 16 nt, Homo sapiens
guacagagaaggaaug

SEQ ID NO: 2068140 - RNA, 22 nt, Homo sapiens
cacaagacccaaguagcugcua

SEQ ID NO: 2068141 - RNA, 13 nt, Homo sapiens
cauccuaccacaa

SEQ ID NO: 2068142 - RNA, 18 nt, Homo sapiens
uguaggcuuaucagggag

SEQ ID NO: 2068143 - RNA, 20 nt, Homo sapiens
ccuucugugcccagcucagu

SEQ ID NO: 2068144 - RNA, 22 nt, Homo sapiens
uaaugaacaguguaccuuuuaa

SEQ ID NO: 2068145 - RNA, 12 nt, Homo sapiens
ugcacgugugca

SEQ ID NO: 2068146 - RNA, 14 nt, Homo sapiens
caauccuaagcaaa

SEQ ID NO: 2068147 - RNA, 16 nt, Homo sapiens
gggcacagcuggagac

SEQ ID NO: 2068148 - RNA, 17 nt, Homo sapiens
uccaacacagugcaucu

SEQ ID NO: 2068149 - RNA, 23 nt, Homo sapiens
ugaucucccuucagcaacuuauu

SEQ ID NO: 2068150 - RNA, 21 nt, Homo sapiens
cuugggaacaggguuacugua

SEQ ID NO: 2068151 - RNA, 14 nt, Homo sapiens
gaugacccccaggu

SEQ ID NO: 2068152 - RNA, 14 nt, Homo sapiens
uaaauuugauuucc

SEQ ID NO: 2068153 - RNA, 17 nt, Homo sapiens
gcaagucucacauauuc

SEQ ID NO: 2068154 - RNA, 12 nt, Homo sapiens
cacagauuuaua

SEQ ID NO: 2068155 - RNA, 12 nt, Homo sapiens
cccugauuucuu

SEQ ID NO: 2068156 - RNA, 23 nt, Homo sapiens
aaguaucagaggugaaugcacag

SEQ ID NO: 2068157 - RNA, 13 nt, Homo sapiens
gacuuugcugauu

SEQ ID NO: 2068158 - RNA, 23 nt, Homo sapiens
ggauucuuuucaucaaaaagccu

SEQ ID NO: 2068159 - RNA, 15 nt, Homo sapiens
gccaaguugugacag

SEQ ID NO: 2068160 - RNA, 15 nt, Homo sapiens
gcuucucucuucucu

SEQ ID NO: 2068161 - RNA, 21 nt, Homo sapiens
cuucucugucucaugugugcu

SEQ ID NO: 2068162 - RNA, 17 nt, Homo sapiens
ugauuuguaacauucac

SEQ ID NO: 2068163 - RNA, 16 nt, Homo sapiens
auuaauuuaauuacua

SEQ ID NO: 2068164 - RNA, 17 nt, Homo sapiens
gacugugccaucugugg

SEQ ID NO: 2068165 - RNA, 18 nt, Homo sapiens
caggagaccugauucccu

SEQ ID NO: 2068166 - RNA, 15 nt, Homo sapiens
auccaugaugcuggg

SEQ ID NO: 2068167 - RNA, 16 nt, Homo sapiens
ggagggggaagcaaag

SEQ ID NO: 2068168 - RNA, 17 nt, Homo sapiens
gggacacuuacccaagg

SEQ ID NO: 2068169 - RNA, 17 nt, Homo sapiens
aagugggagugggagag

SEQ ID NO: 2068170 - RNA, 17 nt, Homo sapiens
uaauggcaauaggacau

SEQ ID NO: 2068171 - RNA, 12 nt, Homo sapiens
aauuaugcugca

SEQ ID NO: 2068172 - RNA, 12 nt, Homo sapiens
gacugauuucaa

SEQ ID NO: 2068173 - RNA, 23 nt, Homo sapiens
cuuguauagcaugaaauaaaaua

SEQ ID NO: 2068174 - RNA, 18 nt, Homo sapiens
guuuucuccuagacccgu

SEQ ID NO: 2068175 - RNA, 15 nt, Homo sapiens
uccacgucagugcca

SEQ ID NO: 2068176 - RNA, 22 nt, Homo sapiens
gccuagcagagugcuggcacuu

SEQ ID NO: 2068177 - RNA, 14 nt, Homo sapiens
uuuucucacaaaaa

SEQ ID NO: 2068178 - RNA, 17 nt, Homo sapiens
ccucuaagaucuugccu

SEQ ID NO: 2068179 - RNA, 18 nt, Homo sapiens
uaagaaaagcccugagau

SEQ ID NO: 2068180 - RNA, 10 nt, Homo sapiens
uuuuuggaca

SEQ ID NO: 2068181 - RNA, 23 nt, Homo sapiens
ccucaaacuccuggacucaugca

SEQ ID NO: 2068182 - RNA, 13 nt, Homo sapiens
ccuuuuacauacu

SEQ ID NO: 2068183 - RNA, 16 nt, Homo sapiens
acucccucugugucac

SEQ ID NO: 2068184 - RNA, 13 nt, Homo sapiens
aaagacugugggu

SEQ ID NO: 2068185 - RNA, 15 nt, Homo sapiens
auguaacgaauggua

SEQ ID NO: 2068186 - RNA, 12 nt, Homo sapiens
ucagacugcaau

SEQ ID NO: 2068187 - RNA, 18 nt, Homo sapiens
uuggaaaaagccugugaa

SEQ ID NO: 2068188 - RNA, 18 nt, Homo sapiens
ugcuuuuccaacccauga

SEQ ID NO: 2068189 - RNA, 15 nt, Homo sapiens
agagauagcuucucu

SEQ ID NO: 2068190 - RNA, 20 nt, Homo sapiens
acuucacugaaagacaccau

SEQ ID NO: 2068191 - RNA, 13 nt, Homo sapiens
uucuucauggugu

SEQ ID NO: 2068192 - RNA, 21 nt, Homo sapiens
guauaagguggucauaaguga

SEQ ID NO: 2068193 - RNA, 12 nt, Homo sapiens
ggggguuucuca

SEQ ID NO: 2068194 - RNA, 13 nt, Homo sapiens
ggcugugcugagg

SEQ ID NO: 2068195 - RNA, 23 nt, Homo sapiens
ccugcugugaugugcaaaggcau

SEQ ID NO: 2068196 - RNA, 13 nt, Homo sapiens
uacugaugcauug

SEQ ID NO: 2068197 - RNA, 14 nt, Homo sapiens
uuggucaugcaaua

SEQ ID NO: 2068198 - RNA, 22 nt, Homo sapiens
ugccucacaguuguuaaagucu

SEQ ID NO: 2068199 - RNA, 21 nt, Homo sapiens
ucucccauggcuuaaugcuuc

SEQ ID NO: 2068200 - RNA, 14 nt, Homo sapiens
guacugugcaguuu

SEQ ID NO: 2068201 - RNA, 19 nt, Homo sapiens
aguuuuuacaaaauacuau

SEQ ID NO: 2068202 - RNA, 14 nt, Homo sapiens
ucauguauauaccu

SEQ ID NO: 2068203 - RNA, 16 nt, Homo sapiens
cuccagaguuguugaa

SEQ ID NO: 2068204 - RNA, 17 nt, Homo sapiens
agacuuugcuaaagaca

SEQ ID NO: 2068205 - RNA, 11 nt, Homo sapiens
cuccugaaauc

SEQ ID NO: 2068206 - RNA, 23 nt, Homo sapiens
aaaucuauguguuuuagacuuag

SEQ ID NO: 2068207 - RNA, 17 nt, Homo sapiens
ugcaauagucuuauuaa

SEQ ID NO: 2068208 - RNA, 12 nt, Homo sapiens
agccucaccaag

SEQ ID NO: 2068209 - RNA, 11 nt, Homo sapiens
ccuucuuucac

SEQ ID NO: 2068210 - RNA, 14 nt, Homo sapiens
aagccccgcucagg

SEQ ID NO: 2068211 - RNA, 16 nt, Homo sapiens
cugugaauuaagccca

SEQ ID NO: 2068212 - RNA, 13 nt, Homo sapiens
acucccuaagucc

SEQ ID NO: 2068213 - RNA, 13 nt, Homo sapiens
cgucccuaccucc

SEQ ID NO: 2068214 - RNA, 18 nt, Homo sapiens
uacgaucccccaaguguc

SEQ ID NO: 2068215 - RNA, 16 nt, Homo sapiens
uagccuucuccccaac

SEQ ID NO: 2068216 - RNA, 20 nt, Homo sapiens
gcugguuuuccuaaaugcag

SEQ ID NO: 2068217 - RNA, 13 nt, Homo sapiens
cucuccacugaaa

SEQ ID NO: 2068218 - RNA, 15 nt, Homo sapiens
gauuuagaaguguca

SEQ ID NO: 2068219 - RNA, 16 nt, Homo sapiens
ccggcugaaggcugag

SEQ ID NO: 2068220 - RNA, 19 nt, Homo sapiens
gcagucccaguauucucag

SEQ ID NO: 2068221 - RNA, 23 nt, Homo sapiens
agcuuugugaaaacuacugaugu

SEQ ID NO: 2068222 - RNA, 13 nt, Homo sapiens
guuagagcugguc

SEQ ID NO: 2068223 - RNA, 12 nt, Homo sapiens
ccucaguuuccu

SEQ ID NO: 2068224 - RNA, 21 nt, Homo sapiens
cagcaguagcaaacuuuucac

SEQ ID NO: 2068225 - RNA, 20 nt, Homo sapiens
ucuaauucuuuaaugauucc

SEQ ID NO: 2068226 - RNA, 17 nt, Homo sapiens
aauaguggcauaccaaa

SEQ ID NO: 2068227 - RNA, 22 nt, Homo sapiens
cuuuucuuuuuuuuuuacuuuu

SEQ ID NO: 2068228 - RNA, 12 nt, Homo sapiens
gaugaagcucac

SEQ ID NO: 2068229 - RNA, 16 nt, Homo sapiens
ugguagguuaacauua

SEQ ID NO: 2068230 - RNA, 21 nt, Homo sapiens
cucacuggggcagacaauaaa

SEQ ID NO: 2068231 - RNA, 19 nt, Homo sapiens
aacacauuucuaauuugaa

SEQ ID NO: 2068232 - RNA, 23 nt, Homo sapiens
ugacuuuuucucggagcauauau

SEQ ID NO: 2068233 - RNA, 16 nt, Homo sapiens
ucuaaauaccugcccu

SEQ ID NO: 2068234 - RNA, 16 nt, Homo sapiens
cucccugccaacucca

SEQ ID NO: 2068235 - RNA, 22 nt, Homo sapiens
aggggcugcagggccacuggaa

SEQ ID NO: 2068236 - RNA, 22 nt, Homo sapiens
agcauguguugcagcugucacc

SEQ ID NO: 2068237 - RNA, 16 nt, Homo sapiens
ucugcagagccacucu

SEQ ID NO: 2068238 - RNA, 19 nt, Homo sapiens
cagguuuuugauuuugaau

SEQ ID NO: 2068239 - RNA, 15 nt, Homo sapiens
aagccccuucucuca

SEQ ID NO: 2068240 - RNA, 19 nt, Homo sapiens
aaggcaguagucauuuuca

SEQ ID NO: 2068241 - RNA, 21 nt, Homo sapiens
acucacugacucuucuaugca

SEQ ID NO: 2068242 - RNA, 16 nt, Homo sapiens
auaucuguacaaugac

SEQ ID NO: 2068243 - RNA, 15 nt, Homo sapiens
uauaguccagcuuug

SEQ ID NO: 2068244 - RNA, 18 nt, Homo sapiens
cuaaguuuuuauaccagc

SEQ ID NO: 2068245 - RNA, 21 nt, Homo sapiens
uacgcucauuguagaaaagcu

SEQ ID NO: 2068246 - RNA, 14 nt, Homo sapiens
ugcaggagugacuc

SEQ ID NO: 2068247 - RNA, 14 nt, Homo sapiens
accagcagacacug

SEQ ID NO: 2068248 - RNA, 14 nt, Homo sapiens
cagcaucuuugccc

SEQ ID NO: 2068249 - RNA, 22 nt, Homo sapiens
cugggguguaaugagcuccugc

SEQ ID NO: 2068250 - RNA, 21 nt, Homo sapiens
uucaaaaucaaauuccagaau

SEQ ID NO: 2068251 - RNA, 20 nt, Homo sapiens
aaugcauauccaacaugugc

SEQ ID NO: 2068252 - RNA, 22 nt, Homo sapiens
uuccacuccaaccagaagugaa

SEQ ID NO: 2068253 - RNA, 20 nt, Homo sapiens
aagaagcccugcugggccca

SEQ ID NO: 2068254 - RNA, 23 nt, Homo sapiens
agaauuauacagaccuaauauca

SEQ ID NO: 2068255 - RNA, 20 nt, Homo sapiens
ccaggaucuggguuaggugg

SEQ ID NO: 2068256 - RNA, 15 nt, Homo sapiens
cugagucaaauccag

SEQ ID NO: 2068257 - RNA, 21 nt, Homo sapiens
agauauguauucuuuucucag

SEQ ID NO: 2068258 - RNA, 20 nt, Homo sapiens
aauaccucaaccuaugguau

SEQ ID NO: 2068259 - RNA, 18 nt, Homo sapiens
gagaauuaggaaggccau

SEQ ID NO: 2068260 - RNA, 13 nt, Homo sapiens
acggaaagcaucc

SEQ ID NO: 2068261 - RNA, 21 nt, Homo sapiens
gaauguccuuucuccagugua

SEQ ID NO: 2068262 - RNA, 14 nt, Homo sapiens
ucagugcugcugaa

SEQ ID NO: 2068263 - RNA, 20 nt, Homo sapiens
uuugaguuuucccacauuau

SEQ ID NO: 2068264 - RNA, 18 nt, Homo sapiens
auuuuaaaucauuaggaa

SEQ ID NO: 2068265 - RNA, 17 nt, Homo sapiens
aaaggaugagaauguga

SEQ ID NO: 2068266 - RNA, 21 nt, Homo sapiens
gcccuggggcugaucucaggg

SEQ ID NO: 2068267 - RNA, 11 nt, Homo sapiens
gguucuugucc

SEQ ID NO: 2068268 - RNA, 13 nt, Homo sapiens
agcaaaaccaaau

SEQ ID NO: 2068269 - RNA, 22 nt, Homo sapiens
agcuuagggaugagauacuuau

SEQ ID NO: 2068270 - RNA, 19 nt, Homo sapiens
agauuuaguugaguuauuc

SEQ ID NO: 2068271 - RNA, 17 nt, Homo sapiens
agaggucagcacacauu

SEQ ID NO: 2068272 - RNA, 13 nt, Homo sapiens
ugcacuccaauca

SEQ ID NO: 2068273 - RNA, 22 nt, Homo sapiens
ggaacaaagacaaccacuggga

SEQ ID NO: 2068274 - RNA, 23 nt, Homo sapiens
acgauguguugaccggcugccgu

SEQ ID NO: 2068275 - RNA, 14 nt, Homo sapiens
aacggaugaguuau

SEQ ID NO: 2068276 - RNA, 17 nt, Homo sapiens
ugcagggauuacaggca

SEQ ID NO: 2068277 - RNA, 20 nt, Homo sapiens
cagugagccgagauggcgcu

SEQ ID NO: 2068278 - RNA, 14 nt, Homo sapiens
agccccacugcccu

SEQ ID NO: 2068279 - RNA, 17 nt, Homo sapiens
ccauuugacuguucaau

SEQ ID NO: 2068280 - RNA, 17 nt, Homo sapiens
uuguucgggugugcaau

SEQ ID NO: 2068281 - RNA, 17 nt, Homo sapiens
acauucaggcaugcgaa

SEQ ID NO: 2068282 - RNA, 17 nt, Homo sapiens
cuucuggaacaccuguc

SEQ ID NO: 2068283 - RNA, 21 nt, Homo sapiens
cugaaccguuacaaaagaaga

SEQ ID NO: 2068284 - RNA, 15 nt, Homo sapiens
accgcaggugcucau

SEQ ID NO: 2068285 - RNA, 15 nt, Homo sapiens
guuuuuucauuugaa

SEQ ID NO: 2068286 - RNA, 15 nt, Homo sapiens
cugaaaguuacccac

SEQ ID NO: 2068287 - RNA, 22 nt, Homo sapiens
gauuuauaguaugugacuuuuc

SEQ ID NO: 2068288 - RNA, 15 nt, Homo sapiens
aggugcuauccugcc

SEQ ID NO: 2068289 - RNA, 18 nt, Homo sapiens
caaaaaaaaauuuccauu

SEQ ID NO: 2068290 - RNA, 20 nt, Homo sapiens
ugccucccauccuucccuca

SEQ ID NO: 2068291 - RNA, 17 nt, Homo sapiens
uugaagaucccuauuau

SEQ ID NO: 2068292 - RNA, 22 nt, Homo sapiens
auauccuuuucuucuauguagg

SEQ ID NO: 2068293 - RNA, 22 nt, Homo sapiens
cuguuaguuuuguaaaaacuga

SEQ ID NO: 2068294 - RNA, 20 nt, Homo sapiens
agacuuguuaaauguauaca

SEQ ID NO: 2068295 - RNA, 23 nt, Homo sapiens
cucaacagccaagugugacccca

SEQ ID NO: 2068296 - RNA, 20 nt, Homo sapiens
ugaggcuacagaacuaaaaa

SEQ ID NO: 2068297 - RNA, 16 nt, Homo sapiens
gaccuguguucuugcu

SEQ ID NO: 2068298 - RNA, 16 nt, Homo sapiens
acgcccccagcuguga

SEQ ID NO: 2068299 - RNA, 23 nt, Homo sapiens
augcaugagaacuaaauagauuu

SEQ ID NO: 2068300 - RNA, 18 nt, Homo sapiens
caucuuugacacucugca

SEQ ID NO: 2068301 - RNA, 21 nt, Homo sapiens
uggagccauugaacagcugug

SEQ ID NO: 2068302 - RNA, 21 nt, Homo sapiens
accauccucucccuucuuaca

SEQ ID NO: 2068303 - RNA, 15 nt, Homo sapiens
aaaaguuuucaagca

SEQ ID NO: 2068304 - RNA, 23 nt, Homo sapiens
guacugccuuaaauguaccuaug

SEQ ID NO: 2068305 - RNA, 22 nt, Homo sapiens
uaaugugguuauuuuacauuaa

SEQ ID NO: 2068306 - RNA, 22 nt, Homo sapiens
gagcagcuucugggaccauaag

SEQ ID NO: 2068307 - RNA, 17 nt, Homo sapiens
cacacugaguucuauca

SEQ ID NO: 2068308 - RNA, 21 nt, Homo sapiens
aagcagugccucgaggcaccg

SEQ ID NO: 2068309 - RNA, 11 nt, Homo sapiens
auguuggucag

SEQ ID NO: 2068310 - RNA, 18 nt, Homo sapiens
augcccucauaaaccaau

SEQ ID NO: 2068311 - RNA, 17 nt, Homo sapiens
caaagggauguucacug

SEQ ID NO: 2068312 - RNA, 16 nt, Homo sapiens
cagggcaacuguagaa

SEQ ID NO: 2068313 - RNA, 15 nt, Homo sapiens
cucuuaauucccaau

SEQ ID NO: 2068314 - RNA, 18 nt, Homo sapiens
uggguaugcucugugaca

SEQ ID NO: 2068315 - RNA, 17 nt, Homo sapiens
agcuuucaaaagcaaga

SEQ ID NO: 2068316 - RNA, 17 nt, Homo sapiens
gaaagugcguucuccca

SEQ ID NO: 2068317 - RNA, 20 nt, Homo sapiens
cauuucucuacacuaagggg

SEQ ID NO: 2068318 - RNA, 15 nt, Homo sapiens
gauccccccacugag

SEQ ID NO: 2068319 - RNA, 15 nt, Homo sapiens
uacuaaagugccuac

SEQ ID NO: 2068320 - RNA, 14 nt, Homo sapiens
caaggacaccauag

SEQ ID NO: 2068321 - RNA, 19 nt, Homo sapiens
uggaauuaauaaaugucau

SEQ ID NO: 2068322 - RNA, 14 nt, Homo sapiens
uccaaaacauuucu

SEQ ID NO: 2068323 - RNA, 13 nt, Homo sapiens
uaccuacaaaaug

SEQ ID NO: 2068324 - RNA, 18 nt, Homo sapiens
gaucaauucccucucuca

SEQ ID NO: 2068325 - RNA, 14 nt, Homo sapiens
cuugaguucccaga

SEQ ID NO: 2068326 - RNA, 13 nt, Homo sapiens
agacuccucagca

SEQ ID NO: 2068327 - RNA, 19 nt, Homo sapiens
ggccucugagaagcucuga

SEQ ID NO: 2068328 - RNA, 21 nt, Homo sapiens
auccagaccucuacaagcaaa

SEQ ID NO: 2068329 - RNA, 19 nt, Homo sapiens
uggggcccaagcaugcccc

SEQ ID NO: 2068330 - RNA, 19 nt, Homo sapiens
uggaaaauguuaugugcuc

SEQ ID NO: 2068331 - RNA, 23 nt, Homo sapiens
aagcuuauuuaagaucacaguga

SEQ ID NO: 2068332 - RNA, 14 nt, Homo sapiens
ugagaaguucucag

SEQ ID NO: 2068333 - RNA, 20 nt, Homo sapiens
uggauauucgguaauaucau

SEQ ID NO: 2068334 - RNA, 13 nt, Homo sapiens
uuuuaauuuucag

SEQ ID NO: 2068335 - RNA, 17 nt, Homo sapiens
uaagaaaaaucauaacu

SEQ ID NO: 2068336 - RNA, 15 nt, Homo sapiens
accugguaccuggac

SEQ ID NO: 2068337 - RNA, 18 nt, Homo sapiens
agaucuggucccuugcag

SEQ ID NO: 2068338 - RNA, 18 nt, Homo sapiens
gacugaaaagccaugugu

SEQ ID NO: 2068339 - RNA, 19 nt, Homo sapiens
gguccuggccgucccuaag

SEQ ID NO: 2068340 - RNA, 20 nt, Homo sapiens
auccccaugcccucaucccg

SEQ ID NO: 2068341 - RNA, 16 nt, Homo sapiens
gaaauaaaguguguug

SEQ ID NO: 2068342 - RNA, 14 nt, Homo sapiens
auuucacugaagau

SEQ ID NO: 2068343 - RNA, 19 nt, Homo sapiens
gucccggggccagcacuuc

SEQ ID NO: 2068344 - RNA, 17 nt, Homo sapiens
caggaacaaacagggcu

SEQ ID NO: 2068345 - RNA, 23 nt, Homo sapiens
accaagaucacauaccagagucu

SEQ ID NO: 2068346 - RNA, 15 nt, Homo sapiens
uuggaagaccagaau

SEQ ID NO: 2068347 - RNA, 23 nt, Homo sapiens
uuguauugaaaacacuuaguaug

SEQ ID NO: 2068348 - RNA, 13 nt, Homo sapiens
gaucuacacucuc

SEQ ID NO: 2068349 - RNA, 22 nt, Homo sapiens
gacuugguaagaugacucugag

SEQ ID NO: 2068350 - RNA, 21 nt, Homo sapiens
aaccaccaccuuauacaucac

SEQ ID NO: 2068351 - RNA, 12 nt, Homo sapiens
cacauaccuuca

SEQ ID NO: 2068352 - RNA, 20 nt, Homo sapiens
gcauccuuuaggguucugcc

SEQ ID NO: 2068353 - RNA, 21 nt, Homo sapiens
acuguugaugucuaaguaugc

SEQ ID NO: 2068354 - RNA, 18 nt, Homo sapiens
aaucagcgauguauauaa

SEQ ID NO: 2068355 - RNA, 16 nt, Homo sapiens
uggggccaauuacuug

SEQ ID NO: 2068356 - RNA, 15 nt, Homo sapiens
gccucccugccagua

SEQ ID NO: 2068357 - RNA, 14 nt, Homo sapiens
ugucuugauguguc

SEQ ID NO: 2068358 - RNA, 14 nt, Homo sapiens
agaaaacugucauu

SEQ ID NO: 2068359 - RNA, 23 nt, Homo sapiens
ccaggugagacagcggucccagg

SEQ ID NO: 2068360 - RNA, 22 nt, Homo sapiens
aacaagccaacgacaaagccaa

SEQ ID NO: 2068361 - RNA, 20 nt, Homo sapiens
agugggaaggggugauggau

SEQ ID NO: 2068362 - RNA, 20 nt, Homo sapiens
uugcuucuucaauggcaccu

SEQ ID NO: 2068363 - RNA, 21 nt, Homo sapiens
acaccauuuuggcaagcucua

SEQ ID NO: 2068364 - RNA, 14 nt, Homo sapiens
ucugcaaugacugu

SEQ ID NO: 2068365 - RNA, 23 nt, Homo sapiens
aacucauuugaaugcuuaauuca

SEQ ID NO: 2068366 - RNA, 19 nt, Homo sapiens
ggaccaugcgacacuggga

SEQ ID NO: 2068367 - RNA, 22 nt, Homo sapiens
gucagcacauguugcuaaugac

SEQ ID NO: 2068368 - RNA, 22 nt, Homo sapiens
ggcuucucuugcuaccugugag

SEQ ID NO: 2068369 - RNA, 18 nt, Homo sapiens
aacucuuggcuccaagug

SEQ ID NO: 2068370 - RNA, 21 nt, Homo sapiens
uauaagacacaugcaggguga

SEQ ID NO: 2068371 - RNA, 18 nt, Homo sapiens
ccacagccugucuuguca

SEQ ID NO: 2068372 - RNA, 17 nt, Homo sapiens
aaaggcaguucagucca

SEQ ID NO: 2068373 - RNA, 18 nt, Homo sapiens
cuguguuuaaccuguugc

SEQ ID NO: 2068374 - RNA, 19 nt, Homo sapiens
ccaugaguuaucaugaauu

SEQ ID NO: 2068375 - RNA, 17 nt, Homo sapiens
caugagggccacauucc

SEQ ID NO: 2068376 - RNA, 14 nt, Homo sapiens
ucagauggggacac

SEQ ID NO: 2068377 - RNA, 23 nt, Homo sapiens
acagaagcuucugcccaccuacu

SEQ ID NO: 2068378 - RNA, 17 nt, Homo sapiens
guaagcccagcauuuga

SEQ ID NO: 2068379 - RNA, 13 nt, Homo sapiens
gcccagggagcaa

SEQ ID NO: 2068380 - RNA, 22 nt, Homo sapiens
gcuuaagaacugcuucauguga

SEQ ID NO: 2068381 - RNA, 20 nt, Homo sapiens
uuacuguaauuggugacaau

SEQ ID NO: 2068382 - RNA, 12 nt, Homo sapiens
acuccggcuccu

SEQ ID NO: 2068383 - RNA, 18 nt, Homo sapiens
ccuguucucguugcccua

SEQ ID NO: 2068384 - RNA, 17 nt, Homo sapiens
ccagguuggagugcagu

SEQ ID NO: 2068385 - RNA, 14 nt, Homo sapiens
agcuuuuaugugau

SEQ ID NO: 2068386 - RNA, 20 nt, Homo sapiens
agaaauuuucuacaguacau

SEQ ID NO: 2068387 - RNA, 23 nt, Homo sapiens
uucauggauucaggugcuggaga

SEQ ID NO: 2068388 - RNA, 21 nt, Homo sapiens
ugacucacaccugaacugaac

SEQ ID NO: 2068389 - RNA, 15 nt, Homo sapiens
ucagcacacaugcau

SEQ ID NO: 2068390 - RNA, 21 nt, Homo sapiens
uucgccaccuggguuccagca

SEQ ID NO: 2068391 - RNA, 18 nt, Homo sapiens
auuaugguguaaugcaca

SEQ ID NO: 2068392 - RNA, 15 nt, Homo sapiens
aagucauugcugaca

SEQ ID NO: 2068393 - RNA, 13 nt, Homo sapiens
aagacuaucuaca

SEQ ID NO: 2068394 - RNA, 19 nt, Homo sapiens
aaaccaagugcgcuuugca

SEQ ID NO: 2068395 - RNA, 22 nt, Homo sapiens
ucccucuucuucucccugugug

SEQ ID NO: 2068396 - RNA, 12 nt, Homo sapiens
aacaaugcuuug

SEQ ID NO: 2068397 - RNA, 18 nt, Homo sapiens
cuucacugccaugccuca

SEQ ID NO: 2068398 - RNA, 17 nt, Homo sapiens
acugguuuuagacaaaa

SEQ ID NO: 2068399 - RNA, 20 nt, Homo sapiens
caagagcaggaggugccuga

SEQ ID NO: 2068400 - RNA, 18 nt, Homo sapiens
auguuuuuaggaguauua

SEQ ID NO: 2068401 - RNA, 15 nt, Homo sapiens
ucuucccucucugca

SEQ ID NO: 2068402 - RNA, 15 nt, Homo sapiens
ucuucacucucugaa

SEQ ID NO: 2068403 - RNA, 21 nt, Homo sapiens
ugauaaugauaaaacaccuca

SEQ ID NO: 2068404 - RNA, 14 nt, Homo sapiens
gucugaaucuucac

SEQ ID NO: 2068405 - RNA, 17 nt, Homo sapiens
gauagguauaaguggug

SEQ ID NO: 2068406 - RNA, 22 nt, Homo sapiens
acucaaguuucuucaaucugaa

SEQ ID NO: 2068407 - RNA, 18 nt, Homo sapiens
uggacccaaaaaaucauc

SEQ ID NO: 2068408 - RNA, 12 nt, Homo sapiens
cuuguaucugaa

SEQ ID NO: 2068409 - RNA, 12 nt, Homo sapiens
auuuauauucau

SEQ ID NO: 2068410 - RNA, 16 nt, Homo sapiens
ugaaagaaggagcaag

SEQ ID NO: 2068411 - RNA, 18 nt, Homo sapiens
cuuguucuuuucugguag

SEQ ID NO: 2068412 - RNA, 22 nt, Homo sapiens
ggaugggugcuuaguaaguacu

SEQ ID NO: 2068413 - RNA, 23 nt, Homo sapiens
acacaaauaaaggaaacccagcu

SEQ ID NO: 2068414 - RNA, 24 nt, Homo sapiens
agcauagagaacgggaguggccau

SEQ ID NO: 2068415 - RNA, 15 nt, Homo sapiens
ggauacuucauuaaa

SEQ ID NO: 2068416 - RNA, 14 nt, Homo sapiens
gccuccugaccuga

SEQ ID NO: 2068417 - RNA, 18 nt, Homo sapiens
ugcagggcccccacugga

SEQ ID NO: 2068418 - RNA, 20 nt, Homo sapiens
ucaggcagguuugccaguga

SEQ ID NO: 2068419 - RNA, 19 nt, Homo sapiens
auaucagacaagcacuauu

SEQ ID NO: 2068420 - RNA, 19 nt, Homo sapiens
uguugcuuuucacaaauca

SEQ ID NO: 2068421 - RNA, 17 nt, Homo sapiens
gccauauaugcuguauu

SEQ ID NO: 2068422 - RNA, 21 nt, Homo sapiens
cuuccccagagauggcuccuu

SEQ ID NO: 2068423 - RNA, 21 nt, Homo sapiens
cagugaguggccccaccugug

SEQ ID NO: 2068424 - RNA, 20 nt, Homo sapiens
auggcaggaggcauccaaag

SEQ ID NO: 2068425 - RNA, 18 nt, Homo sapiens
auuggcacuguggagcuc

SEQ ID NO: 2068426 - RNA, 18 nt, Homo sapiens
gguuaucuuaaauagauc

SEQ ID NO: 2068427 - RNA, 20 nt, Homo sapiens
gccugugggcgcauacuaca

SEQ ID NO: 2068428 - RNA, 12 nt, Homo sapiens
caacaugcaaua

SEQ ID NO: 2068429 - RNA, 19 nt, Homo sapiens
uaauucauaaucacucuaa

SEQ ID NO: 2068430 - RNA, 12 nt, Homo sapiens
aagcaguucucc

SEQ ID NO: 2068431 - RNA, 16 nt, Homo sapiens
gcccaggccuaccuca

SEQ ID NO: 2068432 - RNA, 16 nt, Homo sapiens
aggaccgccugcccug

SEQ ID NO: 2068433 - RNA, 22 nt, Homo sapiens
uggugccccaggaccagcucag

SEQ ID NO: 2068434 - RNA, 20 nt, Homo sapiens
gguauugaacugcaggugac

SEQ ID NO: 2068435 - RNA, 21 nt, Homo sapiens
gcuaugcuauggaauauacau

SEQ ID NO: 2068436 - RNA, 22 nt, Homo sapiens
acuggaaaaaaauacaaaaagc

SEQ ID NO: 2068437 - RNA, 19 nt, Homo sapiens
uccccugcuggccggacac

SEQ ID NO: 2068438 - RNA, 15 nt, Homo sapiens
uauucauucauucau

SEQ ID NO: 2068439 - RNA, 15 nt, Homo sapiens
uaaguauucaaguau

SEQ ID NO: 2068440 - RNA, 23 nt, Homo sapiens
cugcagcgucagaaucguguuga

SEQ ID NO: 2068441 - RNA, 22 nt, Homo sapiens
cgggagagggcagugcaauggg

SEQ ID NO: 2068442 - RNA, 16 nt, Homo sapiens
ggacuguccuagccag

SEQ ID NO: 2068443 - RNA, 15 nt, Homo sapiens
auuucuucaccagau

SEQ ID NO: 2068444 - RNA, 17 nt, Homo sapiens
guaugagugcaagcaaa

SEQ ID NO: 2068445 - RNA, 15 nt, Homo sapiens
uccuguccuuuacac

SEQ ID NO: 2068446 - RNA, 15 nt, Homo sapiens
ucuaaguuagacucu

SEQ ID NO: 2068447 - RNA, 15 nt, Homo sapiens
cagaagugaccaaau

SEQ ID NO: 2068448 - RNA, 17 nt, Homo sapiens
caguaugggaucugaua

SEQ ID NO: 2068449 - RNA, 21 nt, Homo sapiens
cauauuaguaaaagaugccau

SEQ ID NO: 2068450 - RNA, 20 nt, Homo sapiens
gagcaccuacuacaugcaag

SEQ ID NO: 2068451 - RNA, 18 nt, Homo sapiens
guuugugcauaucugccu

SEQ ID NO: 2068452 - RNA, 17 nt, Homo sapiens
acuucauugucccucuu

SEQ ID NO: 2068453 - RNA, 13 nt, Homo sapiens
agacccaucucaa

SEQ ID NO: 2068454 - RNA, 22 nt, Homo sapiens
gggcaguggagaucaggaguga

SEQ ID NO: 2068455 - RNA, 14 nt, Homo sapiens
gcuuucacuuccca

SEQ ID NO: 2068456 - RNA, 22 nt, Homo sapiens
gcccagauucuaccacacagca

SEQ ID NO: 2068457 - RNA, 17 nt, Homo sapiens
gagauaugggaacacug

SEQ ID NO: 2068458 - RNA, 13 nt, Homo sapiens
cuucacucuucau

SEQ ID NO: 2068459 - RNA, 13 nt, Homo sapiens
cuucucucuucaa

SEQ ID NO: 2068460 - RNA, 18 nt, Homo sapiens
aagauggcauccugugaa

SEQ ID NO: 2068461 - RNA, 14 nt, Homo sapiens
aaagaaaaguuuau

SEQ ID NO: 2068462 - RNA, 16 nt, Homo sapiens
uucuggggcccaggaa

SEQ ID NO: 2068463 - RNA, 13 nt, Homo sapiens
cagaaaaagaagg

SEQ ID NO: 2068464 - RNA, 13 nt, Homo sapiens
gagggaaacaaaa

SEQ ID NO: 2068465 - RNA, 12 nt, Homo sapiens
acugcaagcucu

SEQ ID NO: 2068466 - RNA, 11 nt, Homo sapiens
gagcauugcag

SEQ ID NO: 2068467 - RNA, 18 nt, Homo sapiens
gaggagggcgugacucac

SEQ ID NO: 2068468 - RNA, 18 nt, Homo sapiens
caccuggugggugguguc

SEQ ID NO: 2068469 - RNA, 20 nt, Homo sapiens
auugcuccauuuucuuguca

SEQ ID NO: 2068470 - RNA, 16 nt, Homo sapiens
agccacuggcugcuaa

SEQ ID NO: 2068471 - RNA, 14 nt, Homo sapiens
uuaucaaaaaugca

SEQ ID NO: 2068472 - RNA, 15 nt, Homo sapiens
gcugaggcaccagaa

SEQ ID NO: 2068473 - RNA, 22 nt, Homo sapiens
cacagaggcaguaggaacccag

SEQ ID NO: 2068474 - RNA, 18 nt, Homo sapiens
agagauugagcuacuuca

SEQ ID NO: 2068475 - RNA, 12 nt, Homo sapiens
cugaaggcuaaa

SEQ ID NO: 2068476 - RNA, 19 nt, Homo sapiens
ugauuguguuuauugauga

SEQ ID NO: 2068477 - RNA, 15 nt, Homo sapiens
gcgccucggguccca

SEQ ID NO: 2068478 - RNA, 17 nt, Homo sapiens
uaauaauguccuuuccc

SEQ ID NO: 2068479 - RNA, 22 nt, Homo sapiens
uagauaauuuauuauacaccuu

SEQ ID NO: 2068480 - RNA, 18 nt, Homo sapiens
uguuguugaggcugucac

SEQ ID NO: 2068481 - RNA, 23 nt, Homo sapiens
agcagcuaucucucagugaacug

SEQ ID NO: 2068482 - RNA, 16 nt, Homo sapiens
cuucauugcaguuauu

SEQ ID NO: 2068483 - RNA, 13 nt, Homo sapiens
cacauuccaaacu

SEQ ID NO: 2068484 - RNA, 23 nt, Homo sapiens
aagcagucagcccuuauggccaa

SEQ ID NO: 2068485 - RNA, 17 nt, Homo sapiens
aauucuaaagagcacuu

SEQ ID NO: 2068486 - RNA, 20 nt, Homo sapiens
cacuaugaagguaaagggag

SEQ ID NO: 2068487 - RNA, 21 nt, Homo sapiens
ccaaucagcaggauucuaaaa

SEQ ID NO: 2068488 - RNA, 23 nt, Homo sapiens
ucuaugggguucguuaugccaaa

SEQ ID NO: 2068489 - RNA, 15 nt, Homo sapiens
gguauguaauggaac

SEQ ID NO: 2068490 - RNA, 16 nt, Homo sapiens
cugcucuugggcaaua

SEQ ID NO: 2068491 - RNA, 19 nt, Homo sapiens
auaaucaugcucauguaua

SEQ ID NO: 2068492 - RNA, 16 nt, Homo sapiens
acuacuggacuucuau

SEQ ID NO: 2068493 - RNA, 15 nt, Homo sapiens
gaugcagugcuucca

SEQ ID NO: 2068494 - RNA, 18 nt, Homo sapiens
ucaacugaguucaggagu

SEQ ID NO: 2068495 - RNA, 16 nt, Homo sapiens
aagggcaucacugggu

SEQ ID NO: 2068496 - RNA, 13 nt, Homo sapiens
cuuauuuccucau

SEQ ID NO: 2068497 - RNA, 13 nt, Homo sapiens
cuuuguuccucug

SEQ ID NO: 2068498 - RNA, 13 nt, Homo sapiens
aguuuuucagcuu

SEQ ID NO: 2068499 - RNA, 19 nt, Homo sapiens
acuugguagaguuccuuuc

SEQ ID NO: 2068500 - RNA, 14 nt, Homo sapiens
cugaauaacacugg

SEQ ID NO: 2068501 - RNA, 19 nt, Homo sapiens
cauggcuugccacagcucu

SEQ ID NO: 2068502 - RNA, 16 nt, Homo sapiens
gcuaccucacuggggu

SEQ ID NO: 2068503 - RNA, 21 nt, Homo sapiens
gaaaauuucaacgucauuccu

SEQ ID NO: 2068504 - RNA, 15 nt, Homo sapiens
uguguuggcacaugc

SEQ ID NO: 2068505 - RNA, 23 nt, Homo sapiens
ccuccgaacuguucaaguguccc

SEQ ID NO: 2068506 - RNA, 17 nt, Homo sapiens
uuacucagguuugagaa

SEQ ID NO: 2068507 - RNA, 19 nt, Homo sapiens
agcaugaugggaauaggga

SEQ ID NO: 2068508 - RNA, 20 nt, Homo sapiens
cuggccaagcgagagcagcu

SEQ ID NO: 2068509 - RNA, 23 nt, Homo sapiens
cuucccccagcacaaagcacugg

SEQ ID NO: 2068510 - RNA, 23 nt, Homo sapiens
gauccaccugcacaaacauagac

SEQ ID NO: 2068511 - RNA, 21 nt, Homo sapiens
agccacaccacaggaucugaa

SEQ ID NO: 2068512 - RNA, 13 nt, Homo sapiens
uaaaaaaugcaga

SEQ ID NO: 2068513 - RNA, 19 nt, Homo sapiens
acacaaagaucaaaugaaa

SEQ ID NO: 2068514 - RNA, 20 nt, Homo sapiens
gcucacuguggugucugugu

SEQ ID NO: 2068515 - RNA, 22 nt, Homo sapiens
caucaccccagaggccuuguca

SEQ ID NO: 2068516 - RNA, 18 nt, Homo sapiens
guauguguaaaacaaucu

SEQ ID NO: 2068517 - RNA, 21 nt, Homo sapiens
cauuuauuaagcacguauuua

SEQ ID NO: 2068518 - RNA, 22 nt, Homo sapiens
aguggaggaggggguacagucc

SEQ ID NO: 2068519 - RNA, 21 nt, Homo sapiens
uagccauuuuucaaagcaauu

SEQ ID NO: 2068520 - RNA, 18 nt, Homo sapiens
uguaaacagaaauugcaa

SEQ ID NO: 2068521 - RNA, 21 nt, Homo sapiens
ggacaagacccccagcacuug

SEQ ID NO: 2068522 - RNA, 18 nt, Homo sapiens
cugagacuuguucuuggu

SEQ ID NO: 2068523 - RNA, 21 nt, Homo sapiens
uguguauuuacgcuuugauuc

SEQ ID NO: 2068524 - RNA, 14 nt, Homo sapiens
guaagugcugcuau

SEQ ID NO: 2068525 - RNA, 15 nt, Homo sapiens
cugagagaguagcag

SEQ ID NO: 2068526 - RNA, 21 nt, Homo sapiens
ggucuuguucaagcagcgagu

SEQ ID NO: 2068527 - RNA, 21 nt, Homo sapiens
agacuuggcuccaccacugau

SEQ ID NO: 2068528 - RNA, 22 nt, Homo sapiens
gugcuguggcauagacauggau

SEQ ID NO: 2068529 - RNA, 22 nt, Homo sapiens
ugagucccuggcaagacugucu

SEQ ID NO: 2068530 - RNA, 13 nt, Homo sapiens
aggccucugagaa

SEQ ID NO: 2068531 - RNA, 22 nt, Homo sapiens
aggaacucuggccacccaaaca

SEQ ID NO: 2068532 - RNA, 19 nt, Homo sapiens
uuaugacuuuccucagaac

SEQ ID NO: 2068533 - RNA, 13 nt, Homo sapiens
cucuuagagccau

SEQ ID NO: 2068534 - RNA, 16 nt, Homo sapiens
agcuugagaccauuuc

SEQ ID NO: 2068535 - RNA, 13 nt, Homo sapiens
cuguacccagugu

SEQ ID NO: 2068536 - RNA, 17 nt, Homo sapiens
ucagcaauacuaaggga

SEQ ID NO: 2068537 - RNA, 14 nt, Homo sapiens
accauucagaauau

SEQ ID NO: 2068538 - RNA, 15 nt, Homo sapiens
ucuugugaguggaua

SEQ ID NO: 2068539 - RNA, 12 nt, Homo sapiens
gcaaugugcuac

SEQ ID NO: 2068540 - RNA, 12 nt, Homo sapiens
gcacugugcuaa

SEQ ID NO: 2068541 - RNA, 23 nt, Homo sapiens
ucauucacuuuugaaauaaacca

SEQ ID NO: 2068542 - RNA, 22 nt, Homo sapiens
cucaauucauauuuaugaaucu

SEQ ID NO: 2068543 - RNA, 14 nt, Homo sapiens
ucuaguuaaucaua

SEQ ID NO: 2068544 - RNA, 19 nt, Homo sapiens
aucuuguaaaggauauuaa

SEQ ID NO: 2068545 - RNA, 20 nt, Homo sapiens
aaauauugacuucucuugaa

SEQ ID NO: 2068546 - RNA, 15 nt, Homo sapiens
uggucccccuuccau

SEQ ID NO: 2068547 - RNA, 20 nt, Homo sapiens
agcaacccuuccugcugcug

SEQ ID NO: 2068548 - RNA, 15 nt, Homo sapiens
aggugccaucaucuc

SEQ ID NO: 2068549 - RNA, 20 nt, Homo sapiens
aauauuuauuauuuucaccu

SEQ ID NO: 2068550 - RNA, 12 nt, Homo sapiens
gagaaucacuug

SEQ ID NO: 2068551 - RNA, 14 nt, Homo sapiens
gggaagacuguggc

SEQ ID NO: 2068552 - RNA, 22 nt, Homo sapiens
uagaccaagcaggaagaacauu

SEQ ID NO: 2068553 - RNA, 22 nt, Homo sapiens
aaauuuacaucagaaguuugca

SEQ ID NO: 2068554 - RNA, 17 nt, Homo sapiens
uaaucugaaaauagcaa

SEQ ID NO: 2068555 - RNA, 17 nt, Homo sapiens
ugguuuuaauacuugau

SEQ ID NO: 2068556 - RNA, 22 nt, Homo sapiens
ucuuuggccccuggacuauggu

SEQ ID NO: 2068557 - RNA, 17 nt, Homo sapiens
gccugaauccaccugca

SEQ ID NO: 2068558 - RNA, 15 nt, Homo sapiens
aaagguuaagccaua

SEQ ID NO: 2068559 - RNA, 20 nt, Homo sapiens
aaacacggacccauagacag

SEQ ID NO: 2068560 - RNA, 21 nt, Homo sapiens
acggcagagaccccaggaucc

SEQ ID NO: 2068561 - RNA, 12 nt, Homo sapiens
uauguugcccaa

SEQ ID NO: 2068562 - RNA, 21 nt, Homo sapiens
cauaucuagauuuuucuguga

SEQ ID NO: 2068563 - RNA, 12 nt, Homo sapiens
uauauugcccag

SEQ ID NO: 2068564 - RNA, 18 nt, Homo sapiens
cccagauacccaucuuga

SEQ ID NO: 2068565 - RNA, 22 nt, Homo sapiens
aucugacugagagcccacugca

SEQ ID NO: 2068566 - RNA, 16 nt, Homo sapiens
gaaaugccacgugguc

SEQ ID NO: 2068567 - RNA, 22 nt, Homo sapiens
acacguaucucuugguaugcau

SEQ ID NO: 2068568 - RNA, 20 nt, Homo sapiens
uggaaaaaaugauguucauu

SEQ ID NO: 2068569 - RNA, 12 nt, Homo sapiens
gagacaccaaac

SEQ ID NO: 2068570 - RNA, 15 nt, Homo sapiens
aguggacaccaauga

SEQ ID NO: 2068571 - RNA, 12 nt, Homo sapiens
auccaccaccuu

SEQ ID NO: 2068572 - RNA, 16 nt, Homo sapiens
aaguucauggaacuca

SEQ ID NO: 2068573 - RNA, 18 nt, Homo sapiens
aggaacaaaaaaaccaca

SEQ ID NO: 2068574 - RNA, 19 nt, Homo sapiens
ucuggccuaugacccugug

SEQ ID NO: 2068575 - RNA, 20 nt, Homo sapiens
aaucccucccugacccacug

SEQ ID NO: 2068576 - RNA, 21 nt, Homo sapiens
cugcauuugccugucaugcgc

SEQ ID NO: 2068577 - RNA, 16 nt, Homo sapiens
uaaacagcuuucccac

SEQ ID NO: 2068578 - RNA, 17 nt, Homo sapiens
cccucagccaaugaauc

SEQ ID NO: 2068579 - RNA, 17 nt, Homo sapiens
acuggaaccaccuggac

SEQ ID NO: 2068580 - RNA, 19 nt, Homo sapiens
cuacuucugucuuccuuca

SEQ ID NO: 2068581 - RNA, 16 nt, Homo sapiens
aacuugcaauaccaau

SEQ ID NO: 2068582 - RNA, 17 nt, Homo sapiens
aaccuucuaauccaugu

SEQ ID NO: 2068583 - RNA, 15 nt, Homo sapiens
ucuacugaaugucau

SEQ ID NO: 2068584 - RNA, 22 nt, Homo sapiens
aaaggaaauaagagcagucaca

SEQ ID NO: 2068585 - RNA, 21 nt, Homo sapiens
uagguauuucuaacgccagca

SEQ ID NO: 2068586 - RNA, 18 nt, Homo sapiens
agaacccccacauuuacc

SEQ ID NO: 2068587 - RNA, 16 nt, Homo sapiens
agugaaaaacauuagu

SEQ ID NO: 2068588 - RNA, 15 nt, Homo sapiens
aaacaugcuuuucca

SEQ ID NO: 2068589 - RNA, 17 nt, Homo sapiens
guccugccucagccucc

SEQ ID NO: 2068590 - RNA, 22 nt, Homo sapiens
aauaguuaaugaaggugugcua

SEQ ID NO: 2068591 - RNA, 18 nt, Homo sapiens
cuuugugcuugucauucc

SEQ ID NO: 2068592 - RNA, 16 nt, Homo sapiens
cgugaugccaggacca

SEQ ID NO: 2068593 - RNA, 23 nt, Homo sapiens
ccagggaugggggaugggccagg

SEQ ID NO: 2068594 - RNA, 17 nt, Homo sapiens
gcccggaguggacugau

SEQ ID NO: 2068595 - RNA, 20 nt, Homo sapiens
cugccucuggccguguccac

SEQ ID NO: 2068596 - RNA, 17 nt, Homo sapiens
agcagagauguacugca

SEQ ID NO: 2068597 - RNA, 18 nt, Homo sapiens
ugugugcauguaugugca

SEQ ID NO: 2068598 - RNA, 19 nt, Homo sapiens
cuuugacauugauguguuc

SEQ ID NO: 2068599 - RNA, 15 nt, Homo sapiens
cccauuucaaugugu

SEQ ID NO: 2068600 - RNA, 15 nt, Homo sapiens
uggaagggcguucua

SEQ ID NO: 2068601 - RNA, 21 nt, Homo sapiens
aucacgccauugcacuccagc

SEQ ID NO: 2068602 - RNA, 14 nt, Homo sapiens
gugucugucagugg

SEQ ID NO: 2068603 - RNA, 14 nt, Homo sapiens
gacagggucucacu

SEQ ID NO: 2068604 - RNA, 15 nt, Homo sapiens
uugagauggagcuuu

SEQ ID NO: 2068605 - RNA, 19 nt, Homo sapiens
aacucauuucuuauaucau

SEQ ID NO: 2068606 - RNA, 14 nt, Homo sapiens
aaaacaaacccagg

SEQ ID NO: 2068607 - RNA, 13 nt, Homo sapiens
uaaaucaucuuug

SEQ ID NO: 2068608 - RNA, 14 nt, Homo sapiens
agugaugugccuaa

SEQ ID NO: 2068609 - RNA, 13 nt, Homo sapiens
ugaacauugcaau

SEQ ID NO: 2068610 - RNA, 21 nt, Homo sapiens
ucuaaugagcuagugucuuau

SEQ ID NO: 2068611 - RNA, 11 nt, Homo sapiens
auuugcacuau

SEQ ID NO: 2068612 - RNA, 19 nt, Homo sapiens
ccugaacaaagcaccucaa

SEQ ID NO: 2068613 - RNA, 18 nt, Homo sapiens
gggagcgacacuugaaug

SEQ ID NO: 2068614 - RNA, 21 nt, Homo sapiens
gacuugaaaguuuuccaguau

SEQ ID NO: 2068615 - RNA, 15 nt, Homo sapiens
cagcuagcucugcca

SEQ ID NO: 2068616 - RNA, 22 nt, Homo sapiens
ucacuuaacugauguuacugaa

SEQ ID NO: 2068617 - RNA, 16 nt, Homo sapiens
aacaacugauauacuu

SEQ ID NO: 2068618 - RNA, 20 nt, Homo sapiens
ugcuguccugaucugugaua

SEQ ID NO: 2068619 - RNA, 20 nt, Homo sapiens
ccugcagaggucugugcuga

SEQ ID NO: 2068620 - RNA, 16 nt, Homo sapiens
caguuccucaccauca

SEQ ID NO: 2068621 - RNA, 15 nt, Homo sapiens
uguggguuauacaca

SEQ ID NO: 2068622 - RNA, 11 nt, Homo sapiens
ggccuugcccg

SEQ ID NO: 2068623 - RNA, 18 nt, Homo sapiens
gauggagccagcucugca

SEQ ID NO: 2068624 - RNA, 19 nt, Homo sapiens
uacuugagaauaaaugagc

SEQ ID NO: 2068625 - RNA, 14 nt, Homo sapiens
ugggcuauggacac

SEQ ID NO: 2068626 - RNA, 15 nt, Homo sapiens
cacucagaacccagg

SEQ ID NO: 2068627 - RNA, 16 nt, Homo sapiens
caauccuggcucugug

SEQ ID NO: 2068628 - RNA, 23 nt, Homo sapiens
agaacugcacuuuuuuuacuucg

SEQ ID NO: 2068629 - RNA, 17 nt, Homo sapiens
agacucugucuaccugg

SEQ ID NO: 2068630 - RNA, 10 nt, Homo sapiens
aaaacauuuu

SEQ ID NO: 2068631 - RNA, 20 nt, Homo sapiens
uagaagugguuuccugauaa

SEQ ID NO: 2068632 - RNA, 17 nt, Homo sapiens
gucuccuuuaacuagca

SEQ ID NO: 2068633 - RNA, 18 nt, Homo sapiens
aggcuguacgacacgggu

SEQ ID NO: 2068634 - RNA, 21 nt, Homo sapiens
uccugucugcccuagggagaa

SEQ ID NO: 2068635 - RNA, 22 nt, Homo sapiens
aagucagcuacucuaguucugu

SEQ ID NO: 2068636 - RNA, 16 nt, Homo sapiens
aaagucguuuuccaaa

SEQ ID NO: 2068637 - RNA, 16 nt, Homo sapiens
acugaaagaugaucau

SEQ ID NO: 2068638 - RNA, 11 nt, Homo sapiens
uagaauaucua

SEQ ID NO: 2068639 - RNA, 17 nt, Homo sapiens
aagucucaacugcucuu

SEQ ID NO: 2068640 - RNA, 19 nt, Homo sapiens
acagugaagcagcacugug

SEQ ID NO: 2068641 - RNA, 22 nt, Homo sapiens
caaaaugucucuuguggcccau

SEQ ID NO: 2068642 - RNA, 17 nt, Homo sapiens
gcagcaucuacuacucu

SEQ ID NO: 2068643 - RNA, 20 nt, Homo sapiens
gugagccaaauaaaccucuu

SEQ ID NO: 2068644 - RNA, 14 nt, Homo sapiens
uaauacuacugugu

SEQ ID NO: 2068645 - RNA, 22 nt, Homo sapiens
gaagcugaagauccccaacugc

SEQ ID NO: 2068646 - RNA, 21 nt, Homo sapiens
cucugcuccagguucacuuug

SEQ ID NO: 2068647 - RNA, 18 nt, Homo sapiens
aagaaguguaacucacca

SEQ ID NO: 2068648 - RNA, 15 nt, Homo sapiens
agaacauuaagagau

SEQ ID NO: 2068649 - RNA, 20 nt, Homo sapiens
cagcucucccucacaccucc

SEQ ID NO: 2068650 - RNA, 23 nt, Homo sapiens
cugagcacagggggccuccagga

SEQ ID NO: 2068651 - RNA, 12 nt, Homo sapiens
uggaacaaacaa

SEQ ID NO: 2068652 - RNA, 22 nt, Homo sapiens
aaaauagauccaaucaguuuau

SEQ ID NO: 2068653 - RNA, 17 nt, Homo sapiens
aggaaaagguugaauaa

SEQ ID NO: 2068654 - RNA, 13 nt, Homo sapiens
ucuuaccagaugc

SEQ ID NO: 2068655 - RNA, 19 nt, Homo sapiens
cuugaagggggauaugaau

SEQ ID NO: 2068656 - RNA, 19 nt, Homo sapiens
uguugacuugcauucagaa

SEQ ID NO: 2068657 - RNA, 19 nt, Homo sapiens
gaccaaugucuugaugcau

SEQ ID NO: 2068658 - RNA, 16 nt, Homo sapiens
guguugagaugauauu

SEQ ID NO: 2068659 - RNA, 22 nt, Homo sapiens
gcuuuaaguaaaaauccaaaaa

SEQ ID NO: 2068660 - RNA, 15 nt, Homo sapiens
ugggagcaaucugga

SEQ ID NO: 2068661 - RNA, 12 nt, Homo sapiens
ugcaugucuuaa

SEQ ID NO: 2068662 - RNA, 23 nt, Homo sapiens
ccggcuuggcuagucacauauca

SEQ ID NO: 2068663 - RNA, 22 nt, Homo sapiens
agcuugccuguuucuucucuac

SEQ ID NO: 2068664 - RNA, 15 nt, Homo sapiens
ucaguccuugacauu

SEQ ID NO: 2068665 - RNA, 15 nt, Homo sapiens
ucagauuaguauuag

SEQ ID NO: 2068666 - RNA, 15 nt, Homo sapiens
uuuuuacuuccacag

SEQ ID NO: 2068667 - RNA, 20 nt, Homo sapiens
ucagucaacaacuuacacuu

SEQ ID NO: 2068668 - RNA, 18 nt, Homo sapiens
agguggaaaauggugccu

SEQ ID NO: 2068669 - RNA, 18 nt, Homo sapiens
cggccacuggccaucucc

SEQ ID NO: 2068670 - RNA, 17 nt, Homo sapiens
aucagggaggucauuuu

SEQ ID NO: 2068671 - RNA, 13 nt, Homo sapiens
aucugaacuaauu

SEQ ID NO: 2068672 - RNA, 21 nt, Homo sapiens
gaauggcagguucaaguucca

SEQ ID NO: 2068673 - RNA, 15 nt, Homo sapiens
cagaaggaucuucau

SEQ ID NO: 2068674 - RNA, 16 nt, Homo sapiens
ugauuuuaacucuguc

SEQ ID NO: 2068675 - RNA, 13 nt, Homo sapiens
auccuccacagag

SEQ ID NO: 2068676 - RNA, 18 nt, Homo sapiens
agucugcuucauuuccuc

SEQ ID NO: 2068677 - RNA, 24 nt, Homo sapiens
ugaggaacccugaucucucagccc

SEQ ID NO: 2068678 - RNA, 14 nt, Homo sapiens
aaugugcuuucuaa

SEQ ID NO: 2068679 - RNA, 22 nt, Homo sapiens
gaggagucugagguccugagca

SEQ ID NO: 2068680 - RNA, 23 nt, Homo sapiens
cuuuaccuccuuuucucuuucac

SEQ ID NO: 2068681 - RNA, 22 nt, Homo sapiens
auuuaggccagggucucacuga

SEQ ID NO: 2068682 - RNA, 15 nt, Homo sapiens
caguccacugcugag

SEQ ID NO: 2068683 - RNA, 14 nt, Homo sapiens
aaaugucacaguaa

SEQ ID NO: 2068684 - RNA, 12 nt, Homo sapiens
uucacacuuuuu

SEQ ID NO: 2068685 - RNA, 15 nt, Homo sapiens
gaugaagacaacagc

SEQ ID NO: 2068686 - RNA, 18 nt, Homo sapiens
cugggggcagauauuucc

SEQ ID NO: 2068687 - RNA, 16 nt, Homo sapiens
acugcuugaccaaaga

SEQ ID NO: 2068688 - RNA, 15 nt, Homo sapiens
acagauuguuugcaa

SEQ ID NO: 2068689 - RNA, 13 nt, Homo sapiens
cacugguuuucaa

SEQ ID NO: 2068690 - RNA, 24 nt, Homo sapiens
gcuuccuaccacagauucuuuauu

SEQ ID NO: 2068691 - RNA, 14 nt, Homo sapiens
gcccaggacccauc

SEQ ID NO: 2068692 - RNA, 14 nt, Homo sapiens
gagaaggacagcuc

SEQ ID NO: 2068693 - RNA, 16 nt, Homo sapiens
cacagaaaugagauca

SEQ ID NO: 2068694 - RNA, 11 nt, Homo sapiens
uaaauuuucca

SEQ ID NO: 2068695 - RNA, 20 nt, Homo sapiens
ccagccgcccagaucaugcc

SEQ ID NO: 2068696 - RNA, 15 nt, Homo sapiens
agugggaaugcagug

SEQ ID NO: 2068697 - RNA, 16 nt, Homo sapiens
acuucuggugcugcug

SEQ ID NO: 2068698 - RNA, 21 nt, Homo sapiens
accugugccucggcuuuucuc

SEQ ID NO: 2068699 - RNA, 24 nt, Homo sapiens
ucaauauacauaauacaugauugc

SEQ ID NO: 2068700 - RNA, 11 nt, Homo sapiens
ucccagcauug

SEQ ID NO: 2068701 - RNA, 20 nt, Homo sapiens
guaauaugagaauguauuag

SEQ ID NO: 2068702 - RNA, 16 nt, Homo sapiens
gacagucuguuaugca

SEQ ID NO: 2068703 - RNA, 19 nt, Homo sapiens
cuaaaugacuugcagauga

SEQ ID NO: 2068704 - RNA, 22 nt, Homo sapiens
aauuacacaguaagucauuuaa

SEQ ID NO: 2068705 - RNA, 23 nt, Homo sapiens
aauacuuugcagcacagcugaga

SEQ ID NO: 2068706 - RNA, 19 nt, Homo sapiens
uaacauaaaggacaggcca

SEQ ID NO: 2068707 - RNA, 20 nt, Homo sapiens
auguuuuucuucucccucag

SEQ ID NO: 2068708 - RNA, 16 nt, Homo sapiens
aggaacccagcucuca

SEQ ID NO: 2068709 - RNA, 21 nt, Homo sapiens
uuucuuaaguauaaaccuuau

SEQ ID NO: 2068710 - RNA, 21 nt, Homo sapiens
gguuacauaucaaaacauccc

SEQ ID NO: 2068711 - RNA, 20 nt, Homo sapiens
aaaaaaucucuccccaaugc

SEQ ID NO: 2068712 - RNA, 20 nt, Homo sapiens
auuguuucaucccauguaca

SEQ ID NO: 2068713 - RNA, 19 nt, Homo sapiens
caaaauggaaauguaauaa

SEQ ID NO: 2068714 - RNA, 15 nt, Homo sapiens
uugcaauucauaacu

SEQ ID NO: 2068715 - RNA, 17 nt, Homo sapiens
agaacaguaacugccau

SEQ ID NO: 2068716 - RNA, 19 nt, Homo sapiens
ucaaaauccuuccaaagaa

SEQ ID NO: 2068717 - RNA, 17 nt, Homo sapiens
aguaauaugcacacauu

SEQ ID NO: 2068718 - RNA, 22 nt, Homo sapiens
ugcuucccagaggagcagcucu

SEQ ID NO: 2068719 - RNA, 17 nt, Homo sapiens
aggccccuuaccugcag

SEQ ID NO: 2068720 - RNA, 23 nt, Homo sapiens
aguugugagcacucuacugcaag

SEQ ID NO: 2068721 - RNA, 21 nt, Homo sapiens
cagugugagauuucucauuga

SEQ ID NO: 2068722 - RNA, 22 nt, Homo sapiens
acuuaaaccacacacacaaggu

SEQ ID NO: 2068723 - RNA, 13 nt, Homo sapiens
uuucaacuugcau

SEQ ID NO: 2068724 - RNA, 16 nt, Homo sapiens
acguggcucagccagc

SEQ ID NO: 2068725 - RNA, 18 nt, Homo sapiens
auuuugagucucaggccc

SEQ ID NO: 2068726 - RNA, 17 nt, Homo sapiens
cacucaugggucacugg

SEQ ID NO: 2068727 - RNA, 16 nt, Homo sapiens
aaugucacauaaugaa

SEQ ID NO: 2068728 - RNA, 18 nt, Homo sapiens
ugggaaauaugccacuga

SEQ ID NO: 2068729 - RNA, 19 nt, Homo sapiens
ugcuuguuagcaaaaugga

SEQ ID NO: 2068730 - RNA, 12 nt, Homo sapiens
accacaucuuuu

SEQ ID NO: 2068731 - RNA, 15 nt, Homo sapiens
acaugugacuggcag

SEQ ID NO: 2068732 - RNA, 15 nt, Homo sapiens
aagugggcauugcaa

SEQ ID NO: 2068733 - RNA, 22 nt, Homo sapiens
ggauggggcuucacugcuguga

SEQ ID NO: 2068734 - RNA, 16 nt, Homo sapiens
uuuuacaguugcauca

SEQ ID NO: 2068735 - RNA, 21 nt, Homo sapiens
augucaaaauuuuuacagguu

SEQ ID NO: 2068736 - RNA, 16 nt, Homo sapiens
guaaugucauuuucca

SEQ ID NO: 2068737 - RNA, 11 nt, Homo sapiens
cgccuguaauu

SEQ ID NO: 2068738 - RNA, 18 nt, Homo sapiens
agguugcacacuuuggua

SEQ ID NO: 2068739 - RNA, 22 nt, Homo sapiens
cacuuuggacuucucugaaaua

SEQ ID NO: 2068740 - RNA, 15 nt, Homo sapiens
ccccaagguuccaga

SEQ ID NO: 2068741 - RNA, 14 nt, Homo sapiens
aagcuauauaugaa

SEQ ID NO: 2068742 - RNA, 18 nt, Homo sapiens
cugccuacaaaauggaga

SEQ ID NO: 2068743 - RNA, 16 nt, Homo sapiens
uucucaacacacagua

SEQ ID NO: 2068744 - RNA, 14 nt, Homo sapiens
uaacaguaugucag

SEQ ID NO: 2068745 - RNA, 14 nt, Homo sapiens
ugacauuauaucau

SEQ ID NO: 2068746 - RNA, 19 nt, Homo sapiens
gucagaggaaggacuuugg

SEQ ID NO: 2068747 - RNA, 16 nt, Homo sapiens
agacauaaauuacuuu

SEQ ID NO: 2068748 - RNA, 23 nt, Homo sapiens
cauuauccauucccaagaugccu

SEQ ID NO: 2068749 - RNA, 19 nt, Homo sapiens
aaggcagagcgcaaagugc

SEQ ID NO: 2068750 - RNA, 20 nt, Homo sapiens
aaaauuguuuuucccaccuu

SEQ ID NO: 2068751 - RNA, 19 nt, Homo sapiens
accaaacaucccccaauga

SEQ ID NO: 2068752 - RNA, 14 nt, Homo sapiens
cccauugcaguuga

SEQ ID NO: 2068753 - RNA, 23 nt, Homo sapiens
cuguaaucccagcacuuugggag

SEQ ID NO: 2068754 - RNA, 22 nt, Homo sapiens
accugcuaaucacauccacaaa

SEQ ID NO: 2068755 - RNA, 21 nt, Homo sapiens
gcuuuacagauguagauauaa

SEQ ID NO: 2068756 - RNA, 21 nt, Homo sapiens
cuaggggcuggggccaaauaa

SEQ ID NO: 2068757 - RNA, 14 nt, Homo sapiens
uuguugcugcugcu

SEQ ID NO: 2068758 - RNA, 17 nt, Homo sapiens
accaaaucagcugcuac

SEQ ID NO: 2068759 - RNA, 23 nt, Homo sapiens
acuguuacaacuuguauuuccaa

SEQ ID NO: 2068760 - RNA, 19 nt, Homo sapiens
caccuguccggcccagugc

SEQ ID NO: 2068761 - RNA, 17 nt, Homo sapiens
cucacacuuacugcaaa

SEQ ID NO: 2068762 - RNA, 16 nt, Homo sapiens
caacagaucaaugaca

SEQ ID NO: 2068763 - RNA, 13 nt, Homo sapiens
uuccacacuauuc

SEQ ID NO: 2068764 - RNA, 12 nt, Homo sapiens
acuccagaagau

SEQ ID NO: 2068765 - RNA, 13 nt, Homo sapiens
cuuuuuguugccu

SEQ ID NO: 2068766 - RNA, 19 nt, Homo sapiens
caaucaucaucauucucau

SEQ ID NO: 2068767 - RNA, 22 nt, Homo sapiens
cauugagauucacaugcuggcu

SEQ ID NO: 2068768 - RNA, 14 nt, Homo sapiens
auccaaauggacug

SEQ ID NO: 2068769 - RNA, 16 nt, Homo sapiens
cuucuaacaugaaaua

SEQ ID NO: 2068770 - RNA, 17 nt, Homo sapiens
cccuacagccugcacac

SEQ ID NO: 2068771 - RNA, 14 nt, Homo sapiens
gcugccugcugcgc

SEQ ID NO: 2068772 - RNA, 23 nt, Homo sapiens
uaguggcuuccuccgucugcaau

SEQ ID NO: 2068773 - RNA, 17 nt, Homo sapiens
auuuucaagauacaugu

SEQ ID NO: 2068774 - RNA, 21 nt, Homo sapiens
uguacauagugcuaacaugaa

SEQ ID NO: 2068775 - RNA, 17 nt, Homo sapiens
uucugugcagagaugac

SEQ ID NO: 2068776 - RNA, 17 nt, Homo sapiens
aaauauucuucuuugau

SEQ ID NO: 2068777 - RNA, 13 nt, Homo sapiens
cgccagggcucag

SEQ ID NO: 2068778 - RNA, 20 nt, Homo sapiens
uucuacaacugauugcaaca

SEQ ID NO: 2068779 - RNA, 16 nt, Homo sapiens
aaugaggaggaugcua

SEQ ID NO: 2068780 - RNA, 22 nt, Homo sapiens
uuccccagacccagagguccag

SEQ ID NO: 2068781 - RNA, 18 nt, Homo sapiens
augucuguaaccaauaau

SEQ ID NO: 2068782 - RNA, 18 nt, Homo sapiens
gccccacugcccuucuca

SEQ ID NO: 2068783 - RNA, 21 nt, Homo sapiens
gacccaggaaccgauuaucua

SEQ ID NO: 2068784 - RNA, 18 nt, Homo sapiens
gaaccaggcaacuuggga

SEQ ID NO: 2068785 - RNA, 17 nt, Homo sapiens
auaucaagguuccugau

SEQ ID NO: 2068786 - RNA, 14 nt, Homo sapiens
cccaggcccggaug

SEQ ID NO: 2068787 - RNA, 14 nt, Homo sapiens
uccagcccuggauc

SEQ ID NO: 2068788 - RNA, 13 nt, Homo sapiens
gauaacagcacug

SEQ ID NO: 2068789 - RNA, 15 nt, Homo sapiens
acaccucugcuccaa

SEQ ID NO: 2068790 - RNA, 22 nt, Homo sapiens
auuuuugcuuguuucugauuaa

SEQ ID NO: 2068791 - RNA, 13 nt, Homo sapiens
uucuguuuuccaa

SEQ ID NO: 2068792 - RNA, 23 nt, Homo sapiens
accacacacacaaggugcucaga

SEQ ID NO: 2068793 - RNA, 13 nt, Homo sapiens
cauuaauguuucu

SEQ ID NO: 2068794 - RNA, 14 nt, Homo sapiens
aucuugugcaugca

SEQ ID NO: 2068795 - RNA, 16 nt, Homo sapiens
aguccuggacgcacaa

SEQ ID NO: 2068796 - RNA, 12 nt, Homo sapiens
gggucgucugcc

SEQ ID NO: 2068797 - RNA, 20 nt, Homo sapiens
cguuccaaguauuuugccac

SEQ ID NO: 2068798 - RNA, 15 nt, Homo sapiens
acuaauuagugucca

SEQ ID NO: 2068799 - RNA, 22 nt, Homo sapiens
auacauuuuuuaggacaucuua

SEQ ID NO: 2068800 - RNA, 18 nt, Homo sapiens
uggaguaaucagaaugaa

SEQ ID NO: 2068801 - RNA, 12 nt, Homo sapiens
uagucgucuccu

SEQ ID NO: 2068802 - RNA, 18 nt, Homo sapiens
ccaggcagauccucugga

SEQ ID NO: 2068803 - RNA, 19 nt, Homo sapiens
agcuaccaacuaaguugua

SEQ ID NO: 2068804 - RNA, 23 nt, Homo sapiens
ccaggcugaccacagcacagcca

SEQ ID NO: 2068805 - RNA, 18 nt, Homo sapiens
caggagcccggcuuccac

SEQ ID NO: 2068806 - RNA, 14 nt, Homo sapiens
uuccaugucuccuu

SEQ ID NO: 2068807 - RNA, 14 nt, Homo sapiens
ccucauguucucuu

SEQ ID NO: 2068808 - RNA, 19 nt, Homo sapiens
agccccacagcacccaggc

SEQ ID NO: 2068809 - RNA, 16 nt, Homo sapiens
cgcugaagauggcauc

SEQ ID NO: 2068810 - RNA, 20 nt, Homo sapiens
aauccuggagucucacuguc

SEQ ID NO: 2068811 - RNA, 22 nt, Homo sapiens
cacgaggagcuuccagugcaug

SEQ ID NO: 2068812 - RNA, 15 nt, Homo sapiens
accaaaagugcuccc

SEQ ID NO: 2068813 - RNA, 17 nt, Homo sapiens
uuaaggcucugugccuu

SEQ ID NO: 2068814 - RNA, 19 nt, Homo sapiens
cccagaggcagagguugug

SEQ ID NO: 2068815 - RNA, 16 nt, Homo sapiens
uaacaggaauuuucau

SEQ ID NO: 2068816 - RNA, 16 nt, Homo sapiens
uaaggaagaaucuucu

SEQ ID NO: 2068817 - RNA, 18 nt, Homo sapiens
ggugaaaccucaucucua

SEQ ID NO: 2068818 - RNA, 11 nt, Homo sapiens
caggggccaug

SEQ ID NO: 2068819 - RNA, 16 nt, Homo sapiens
ccuaugucaccuugau

SEQ ID NO: 2068820 - RNA, 17 nt, Homo sapiens
aucucuugcccuuccua

SEQ ID NO: 2068821 - RNA, 15 nt, Homo sapiens
cauagagcagcacua

SEQ ID NO: 2068822 - RNA, 21 nt, Homo sapiens
cccugggugcaggacacuggu

SEQ ID NO: 2068823 - RNA, 22 nt, Homo sapiens
cauguuuugauuuguagcacug

SEQ ID NO: 2068824 - RNA, 16 nt, Homo sapiens
accauccaccaggccu

SEQ ID NO: 2068825 - RNA, 13 nt, Homo sapiens
cucccaguacaac

SEQ ID NO: 2068826 - RNA, 14 nt, Homo sapiens
ccugccuccugcca

SEQ ID NO: 2068827 - RNA, 16 nt, Homo sapiens
accagccuuguccuaa

SEQ ID NO: 2068828 - RNA, 21 nt, Homo sapiens
ccuaucagccugucucuucca

SEQ ID NO: 2068829 - RNA, 15 nt, Homo sapiens
uuuaacaagcugucu

SEQ ID NO: 2068830 - RNA, 18 nt, Homo sapiens
ucaccucccaaacccagc

SEQ ID NO: 2068831 - RNA, 20 nt, Homo sapiens
uccguggucagagugccacu

SEQ ID NO: 2068832 - RNA, 21 nt, Homo sapiens
aacuguaaaugugacauugau

SEQ ID NO: 2068833 - RNA, 20 nt, Homo sapiens
gggagacggagguugcagug

SEQ ID NO: 2068834 - RNA, 12 nt, Homo sapiens
uggagacucagc

SEQ ID NO: 2068835 - RNA, 15 nt, Homo sapiens
uuggcuuugcaaaau

SEQ ID NO: 2068836 - RNA, 15 nt, Homo sapiens
aucacuggcucucua

SEQ ID NO: 2068837 - RNA, 21 nt, Homo sapiens
guacaaaaugaauugccuuug

SEQ ID NO: 2068838 - RNA, 16 nt, Homo sapiens
ucuggcuggagaggaa

SEQ ID NO: 2068839 - RNA, 19 nt, Homo sapiens
caguggggccuguggaaug

SEQ ID NO: 2068840 - RNA, 17 nt, Homo sapiens
uuguuacaaauuguaga

SEQ ID NO: 2068841 - RNA, 11 nt, Homo sapiens
cuucagucuuc

SEQ ID NO: 2068842 - RNA, 17 nt, Homo sapiens
uuaaguaaauacaguag

SEQ ID NO: 2068843 - RNA, 13 nt, Homo sapiens
gagccacugggcc

SEQ ID NO: 2068844 - RNA, 13 nt, Homo sapiens
cucagguggugcc

SEQ ID NO: 2068845 - RNA, 19 nt, Homo sapiens
cgccuuugugagcugugag

SEQ ID NO: 2068846 - RNA, 20 nt, Homo sapiens
cucuagccugggccagagaa

SEQ ID NO: 2068847 - RNA, 23 nt, Homo sapiens
ccaggagacagacagagaaggca

SEQ ID NO: 2068848 - RNA, 15 nt, Homo sapiens
cgcaggcaucugauu

SEQ ID NO: 2068849 - RNA, 22 nt, Homo sapiens
uaaacagaggaguacaggugaa

SEQ ID NO: 2068850 - RNA, 16 nt, Homo sapiens
cccacccacaugacuu

SEQ ID NO: 2068851 - RNA, 14 nt, Homo sapiens
gcagcaaugaaggg

SEQ ID NO: 2068852 - RNA, 21 nt, Homo sapiens
agugcaauggcgcgaucucag

SEQ ID NO: 2068853 - RNA, 12 nt, Homo sapiens
acuugcaauacc

SEQ ID NO: 2068854 - RNA, 21 nt, Homo sapiens
caccugugugcuguagauuca

SEQ ID NO: 2068855 - RNA, 17 nt, Homo sapiens
cccugaguuccuagcca

SEQ ID NO: 2068856 - RNA, 13 nt, Homo sapiens
gcaugaaacaugu

SEQ ID NO: 2068857 - RNA, 19 nt, Homo sapiens
aggggguaggagagcacug

SEQ ID NO: 2068858 - RNA, 20 nt, Homo sapiens
aaacugauuucccauuuuaa

SEQ ID NO: 2068859 - RNA, 19 nt, Homo sapiens
agggccgugugacacucuc

SEQ ID NO: 2068860 - RNA, 13 nt, Homo sapiens
caccaugagcuca

SEQ ID NO: 2068861 - RNA, 22 nt, Homo sapiens
augauuaaauaagguaauacau

SEQ ID NO: 2068862 - RNA, 12 nt, Homo sapiens
cuagugccuuua

SEQ ID NO: 2068863 - RNA, 12 nt, Homo sapiens
gaucccugacau

SEQ ID NO: 2068864 - RNA, 19 nt, Homo sapiens
guucuggggggacccagug

SEQ ID NO: 2068865 - RNA, 21 nt, Homo sapiens
uaucuaaaugaaugagccaaa

SEQ ID NO: 2068866 - RNA, 14 nt, Homo sapiens
acuggaaccaggga

SEQ ID NO: 2068867 - RNA, 17 nt, Homo sapiens
cugggaggcggagagua

SEQ ID NO: 2068868 - RNA, 12 nt, Homo sapiens
aaaauaaggaac

SEQ ID NO: 2068869 - RNA, 19 nt, Homo sapiens
guuucguguauaugccuca

SEQ ID NO: 2068870 - RNA, 23 nt, Homo sapiens
aaagucagagacagauaccucca

SEQ ID NO: 2068871 - RNA, 14 nt, Homo sapiens
cacuuccuuggaaa

SEQ ID NO: 2068872 - RNA, 19 nt, Homo sapiens
aagaucuuuccaaagacaa

SEQ ID NO: 2068873 - RNA, 23 nt, Homo sapiens
aguggcugagacuuguguccuga

SEQ ID NO: 2068874 - RNA, 19 nt, Homo sapiens
gaagaagcaucuuccuuag

SEQ ID NO: 2068875 - RNA, 14 nt, Homo sapiens
agagugaggacuga

SEQ ID NO: 2068876 - RNA, 15 nt, Homo sapiens
cagaggugcugucag

SEQ ID NO: 2068877 - RNA, 17 nt, Homo sapiens
guagcuguggccucacc

SEQ ID NO: 2068878 - RNA, 14 nt, Homo sapiens
ccugcaaucccagc

SEQ ID NO: 2068879 - RNA, 19 nt, Homo sapiens
aauuuaauuuugcaggauu

SEQ ID NO: 2068880 - RNA, 13 nt, Homo sapiens
agagaaaacuuau

SEQ ID NO: 2068881 - RNA, 17 nt, Homo sapiens
gagaucuuaagauucca

SEQ ID NO: 2068882 - RNA, 16 nt, Homo sapiens
uugucagaaaccugca

SEQ ID NO: 2068883 - RNA, 16 nt, Homo sapiens
augccaguuacuugcu

SEQ ID NO: 2068884 - RNA, 16 nt, Homo sapiens
gaaaggaucugugauu

SEQ ID NO: 2068885 - RNA, 19 nt, Homo sapiens
ggaggcggccuccaugcac

SEQ ID NO: 2068886 - RNA, 14 nt, Homo sapiens
agaaacagcuuuca

SEQ ID NO: 2068887 - RNA, 17 nt, Homo sapiens
cucauucuagcaccuug

SEQ ID NO: 2068888 - RNA, 15 nt, Homo sapiens
ccgcauuggugacuc

SEQ ID NO: 2068889 - RNA, 16 nt, Homo sapiens
ucuggacagaugggug

SEQ ID NO: 2068890 - RNA, 17 nt, Homo sapiens
uggagugcuucuggaac

SEQ ID NO: 2068891 - RNA, 15 nt, Homo sapiens
ugcuuuuccaucuaa

SEQ ID NO: 2068892 - RNA, 20 nt, Homo sapiens
gagagcacagugaucaccag

SEQ ID NO: 2068893 - RNA, 17 nt, Homo sapiens
cagccaugucugugcug

SEQ ID NO: 2068894 - RNA, 16 nt, Homo sapiens
cucaccugaauaaggg

SEQ ID NO: 2068895 - RNA, 13 nt, Homo sapiens
acucaggcugcuc

SEQ ID NO: 2068896 - RNA, 13 nt, Homo sapiens
cuuaaaauaguuu

SEQ ID NO: 2068897 - RNA, 19 nt, Homo sapiens
aaggaagauguaagaagcu

SEQ ID NO: 2068898 - RNA, 18 nt, Homo sapiens
caaggaugcugucaagca

SEQ ID NO: 2068899 - RNA, 18 nt, Homo sapiens
auuguuuuuauucuguau

SEQ ID NO: 2068900 - RNA, 20 nt, Homo sapiens
gaacagccagguagagcccu

SEQ ID NO: 2068901 - RNA, 15 nt, Homo sapiens
ucaggagagugcaga

SEQ ID NO: 2068902 - RNA, 18 nt, Homo sapiens
agucuuaaagcauuucag

SEQ ID NO: 2068903 - RNA, 15 nt, Homo sapiens
auuugggcaucucua

SEQ ID NO: 2068904 - RNA, 18 nt, Homo sapiens
uagcacaucauuccuccu

SEQ ID NO: 2068905 - RNA, 21 nt, Homo sapiens
caggagaaggugguggcauuu

SEQ ID NO: 2068906 - RNA, 13 nt, Homo sapiens
uggacaaacugca

SEQ ID NO: 2068907 - RNA, 19 nt, Homo sapiens
cauucacagauaccucucu

SEQ ID NO: 2068908 - RNA, 18 nt, Homo sapiens
agccccuuccucugccag

SEQ ID NO: 2068909 - RNA, 21 nt, Homo sapiens
aaaaugcugcuucuccuccca

SEQ ID NO: 2068910 - RNA, 13 nt, Homo sapiens
gccacuaugucca

SEQ ID NO: 2068911 - RNA, 13 nt, Homo sapiens
uccacuauuucca

SEQ ID NO: 2068912 - RNA, 11 nt, Homo sapiens
aaauugaacaa

SEQ ID NO: 2068913 - RNA, 19 nt, Homo sapiens
gacaugaacagaaacaaua

SEQ ID NO: 2068914 - RNA, 12 nt, Homo sapiens
aauacaaaaacu

SEQ ID NO: 2068915 - RNA, 12 nt, Homo sapiens
aauucaaaaaca

SEQ ID NO: 2068916 - RNA, 15 nt, Homo sapiens
acauuguuaggugcu

SEQ ID NO: 2068917 - RNA, 16 nt, Homo sapiens
auuaacuuccucuauu

SEQ ID NO: 2068918 - RNA, 21 nt, Homo sapiens
agagucucuuuuuacacuuca

SEQ ID NO: 2068919 - RNA, 20 nt, Homo sapiens
gaagaauuggggauucucua

SEQ ID NO: 2068920 - RNA, 20 nt, Homo sapiens
uucauuuaggaugcuuucau

SEQ ID NO: 2068921 - RNA, 16 nt, Homo sapiens
ggucaucccggggcca

SEQ ID NO: 2068922 - RNA, 17 nt, Homo sapiens
ugcaguggcacaaucuc

SEQ ID NO: 2068923 - RNA, 23 nt, Homo sapiens
accaaagagacuggagcaucuga

SEQ ID NO: 2068924 - RNA, 14 nt, Homo sapiens
cauucccaugugga

SEQ ID NO: 2068925 - RNA, 18 nt, Homo sapiens
cuugucucuugccugcca

SEQ ID NO: 2068926 - RNA, 16 nt, Homo sapiens
aaccccagacacuggu

SEQ ID NO: 2068927 - RNA, 16 nt, Homo sapiens
aauccuugcauuuugg

SEQ ID NO: 2068928 - RNA, 15 nt, Homo sapiens
ugucaugcaugaagg

SEQ ID NO: 2068929 - RNA, 20 nt, Homo sapiens
aaaagcaagauuuugucaaa

SEQ ID NO: 2068930 - RNA, 15 nt, Homo sapiens
aacugguaguguuca

SEQ ID NO: 2068931 - RNA, 19 nt, Homo sapiens
ucuuuguaugucuguuacc

SEQ ID NO: 2068932 - RNA, 21 nt, Homo sapiens
cuuuauuuugaacuaauuucu

SEQ ID NO: 2068933 - RNA, 19 nt, Homo sapiens
auuuccuuuuguaaaguaa

SEQ ID NO: 2068934 - RNA, 15 nt, Homo sapiens
agagaugucaucaga

SEQ ID NO: 2068935 - RNA, 11 nt, Homo sapiens
acucugacccc

SEQ ID NO: 2068936 - RNA, 12 nt, Homo sapiens
aaaaagauguac

SEQ ID NO: 2068937 - RNA, 15 nt, Homo sapiens
ucuucccccaccacc

SEQ ID NO: 2068938 - RNA, 18 nt, Homo sapiens
ugugcugggauuacaggc

SEQ ID NO: 2068939 - RNA, 19 nt, Homo sapiens
caugcugcccagccacucc

SEQ ID NO: 2068940 - RNA, 14 nt, Homo sapiens
auccaacauccaga

SEQ ID NO: 2068941 - RNA, 16 nt, Homo sapiens
aggcuggaguacaaug

SEQ ID NO: 2068942 - RNA, 16 nt, Homo sapiens
acaaaaagcuucccca

SEQ ID NO: 2068943 - RNA, 17 nt, Homo sapiens
ccucagucucccagcua

SEQ ID NO: 2068944 - RNA, 12 nt, Homo sapiens
cucuucacagau

SEQ ID NO: 2068945 - RNA, 12 nt, Homo sapiens
agaaucaccuca

SEQ ID NO: 2068946 - RNA, 15 nt, Homo sapiens
aagcauguacuguac

SEQ ID NO: 2068947 - RNA, 19 nt, Homo sapiens
cgucuaguuaacauuucaa

SEQ ID NO: 2068948 - RNA, 16 nt, Homo sapiens
aaauaagcuucaucuc

SEQ ID NO: 2068949 - RNA, 20 nt, Homo sapiens
uaagagggcauauacaguga

SEQ ID NO: 2068950 - RNA, 18 nt, Homo sapiens
ggagagaaaguuacuguu

SEQ ID NO: 2068951 - RNA, 17 nt, Homo sapiens
cucaguagagaucuaua

SEQ ID NO: 2068952 - RNA, 21 nt, Homo sapiens
aaccagaacaguaugaauuug

SEQ ID NO: 2068953 - RNA, 13 nt, Homo sapiens
ggagauacugaac

SEQ ID NO: 2068954 - RNA, 22 nt, Homo sapiens
cagcuggugucggcaucauacu

SEQ ID NO: 2068955 - RNA, 22 nt, Homo sapiens
auugaauuaaaacagcugcgac

SEQ ID NO: 2068956 - RNA, 18 nt, Homo sapiens
cugcucaaugaaaccuuc

SEQ ID NO: 2068957 - RNA, 13 nt, Homo sapiens
auauaguuuacua

SEQ ID NO: 2068958 - RNA, 20 nt, Homo sapiens
gguccucugagacuccagac

SEQ ID NO: 2068959 - RNA, 17 nt, Homo sapiens
ucugaggggugggggug

SEQ ID NO: 2068960 - RNA, 20 nt, Homo sapiens
gcaucucugucacacccggg

SEQ ID NO: 2068961 - RNA, 14 nt, Homo sapiens
uaauaauaauaaua

SEQ ID NO: 2068962 - RNA, 14 nt, Homo sapiens
aaaaauuauuauuu

SEQ ID NO: 2068963 - RNA, 20 nt, Homo sapiens
cuugggaccaaaacugccua

SEQ ID NO: 2068964 - RNA, 18 nt, Homo sapiens
cggccucucaguucuuga

SEQ ID NO: 2068965 - RNA, 21 nt, Homo sapiens
cugucucccugaagagugaac

SEQ ID NO: 2068966 - RNA, 22 nt, Homo sapiens
gguauguguggaugaugcugcc

SEQ ID NO: 2068967 - RNA, 15 nt, Homo sapiens
uacaaaacugugaau

SEQ ID NO: 2068968 - RNA, 17 nt, Homo sapiens
caaauuucauuuccauu

SEQ ID NO: 2068969 - RNA, 14 nt, Homo sapiens
gcagcaaugcaaug

SEQ ID NO: 2068970 - RNA, 13 nt, Homo sapiens
ugaagacauucca

SEQ ID NO: 2068971 - RNA, 16 nt, Homo sapiens
cugggugggcaucuca

SEQ ID NO: 2068972 - RNA, 18 nt, Homo sapiens
agaccugcugugaugacu

SEQ ID NO: 2068973 - RNA, 15 nt, Homo sapiens
agagagauacaucuu

SEQ ID NO: 2068974 - RNA, 17 nt, Homo sapiens
cuagguagaacacugcu

SEQ ID NO: 2068975 - RNA, 19 nt, Homo sapiens
auugcacuuuuaaaccucu

SEQ ID NO: 2068976 - RNA, 11 nt, Homo sapiens
aagaguggucu

SEQ ID NO: 2068977 - RNA, 22 nt, Homo sapiens
gcacuaccauagcuacaucagu

SEQ ID NO: 2068978 - RNA, 20 nt, Homo sapiens
auaaggcugagggcugccag

SEQ ID NO: 2068979 - RNA, 15 nt, Homo sapiens
caaaaggaagacugg

SEQ ID NO: 2068980 - RNA, 13 nt, Homo sapiens
aauugugacauaa

SEQ ID NO: 2068981 - RNA, 19 nt, Homo sapiens
ucccaaacccagccucuag

SEQ ID NO: 2068982 - RNA, 21 nt, Homo sapiens
ggaaacacuuugaggacauuu

SEQ ID NO: 2068983 - RNA, 16 nt, Homo sapiens
ccucaugguacuguag

SEQ ID NO: 2068984 - RNA, 22 nt, Homo sapiens
uggagccugaaccgugugcucc

SEQ ID NO: 2068985 - RNA, 18 nt, Homo sapiens
uucugcuaugaccaugac

SEQ ID NO: 2068986 - RNA, 18 nt, Homo sapiens
auucauaguaagauugau

SEQ ID NO: 2068987 - RNA, 23 nt, Homo sapiens
aauggcuguaaacuauaaacuac

SEQ ID NO: 2068988 - RNA, 13 nt, Homo sapiens
cacuaagccauga

SEQ ID NO: 2068989 - RNA, 19 nt, Homo sapiens
uccauuuuuguaagccaua

SEQ ID NO: 2068990 - RNA, 19 nt, Homo sapiens
ccuucugacuuugccaaaa

SEQ ID NO: 2068991 - RNA, 15 nt, Homo sapiens
cuaauucucuuuuca

SEQ ID NO: 2068992 - RNA, 22 nt, Homo sapiens
aaaguagucucuccccuggcca

SEQ ID NO: 2068993 - RNA, 12 nt, Homo sapiens
ucugucaccagc

SEQ ID NO: 2068994 - RNA, 13 nt, Homo sapiens
ucaaagauguacu

SEQ ID NO: 2068995 - RNA, 15 nt, Homo sapiens
uuuaaguaauuuugc

SEQ ID NO: 2068996 - RNA, 15 nt, Homo sapiens
aaacacuucuccuua

SEQ ID NO: 2068997 - RNA, 21 nt, Homo sapiens
agcuauuuuagaaagcuaaau

SEQ ID NO: 2068998 - RNA, 22 nt, Homo sapiens
ugaagcugccugcuuuucacug

SEQ ID NO: 2068999 - RNA, 12 nt, Homo sapiens
ccuguaacacaa

SEQ ID NO: 2069000 - RNA, 18 nt, Homo sapiens
cccugacagggccagugc

SEQ ID NO: 2069001 - RNA, 13 nt, Homo sapiens
caaugacuuuccu

SEQ ID NO: 2069002 - RNA, 14 nt, Homo sapiens
uauauuccuuugcc

SEQ ID NO: 2069003 - RNA, 19 nt, Homo sapiens
uuguuuugaagcuguugcu

SEQ ID NO: 2069004 - RNA, 15 nt, Homo sapiens
agcccuguugacaca

SEQ ID NO: 2069005 - RNA, 17 nt, Homo sapiens
acauucuguguucacau

SEQ ID NO: 2069006 - RNA, 12 nt, Homo sapiens
cuuugugcucug

SEQ ID NO: 2069007 - RNA, 13 nt, Homo sapiens
auucucaauacuu

SEQ ID NO: 2069008 - RNA, 18 nt, Homo sapiens
gcaauggcuccuucacaa

SEQ ID NO: 2069009 - RNA, 13 nt, Homo sapiens
uuacggaauucca

SEQ ID NO: 2069010 - RNA, 20 nt, Homo sapiens
agaugcccucauaaaccaau

SEQ ID NO: 2069011 - RNA, 20 nt, Homo sapiens
gaaaauggacagaauguguc

SEQ ID NO: 2069012 - RNA, 22 nt, Homo sapiens
ugugcucuuauccccagcuguu

SEQ ID NO: 2069013 - RNA, 20 nt, Homo sapiens
uucauaguaguuacugucag

SEQ ID NO: 2069014 - RNA, 17 nt, Homo sapiens
acagcccuuccucccau

SEQ ID NO: 2069015 - RNA, 14 nt, Homo sapiens
aaucacucuguccu

SEQ ID NO: 2069016 - RNA, 15 nt, Homo sapiens
ucugucugaauccuc

SEQ ID NO: 2069017 - RNA, 15 nt, Homo sapiens
cacacacacaaauua

SEQ ID NO: 2069018 - RNA, 16 nt, Homo sapiens
uuccucuacagccucc

SEQ ID NO: 2069019 - RNA, 20 nt, Homo sapiens
auaagaacaaauacaauaca

SEQ ID NO: 2069020 - RNA, 15 nt, Homo sapiens
aucuguguuuacuua

SEQ ID NO: 2069021 - RNA, 17 nt, Homo sapiens
uaaaguaccacacauau

SEQ ID NO: 2069022 - RNA, 16 nt, Homo sapiens
gaaaaauagcugugaa

SEQ ID NO: 2069023 - RNA, 18 nt, Homo sapiens
aacaguccaaucaguggg

SEQ ID NO: 2069024 - RNA, 21 nt, Homo sapiens
ggcuagacacccauuuucaca

SEQ ID NO: 2069025 - RNA, 23 nt, Homo sapiens
acuuucauccucaagcucagggc

SEQ ID NO: 2069026 - RNA, 18 nt, Homo sapiens
cagccuccaguuguagca

SEQ ID NO: 2069027 - RNA, 21 nt, Homo sapiens
cauccuggcccaucaguguac

SEQ ID NO: 2069028 - RNA, 22 nt, Homo sapiens
cuuuucgccaaggcucacaugc

SEQ ID NO: 2069029 - RNA, 22 nt, Homo sapiens
acucccaugagggagaugccau

SEQ ID NO: 2069030 - RNA, 20 nt, Homo sapiens
cuugcuuucaucacuaccuu

SEQ ID NO: 2069031 - RNA, 13 nt, Homo sapiens
uuaagcccagaga

SEQ ID NO: 2069032 - RNA, 13 nt, Homo sapiens
ggcucucugugaa

SEQ ID NO: 2069033 - RNA, 18 nt, Homo sapiens
uaccuugcagccaugacc

SEQ ID NO: 2069034 - RNA, 15 nt, Homo sapiens
ucuugucccuaagua

SEQ ID NO: 2069035 - RNA, 15 nt, Homo sapiens
ucaaagcacauaugu

SEQ ID NO: 2069036 - RNA, 17 nt, Homo sapiens
cgagcaccugugcccau

SEQ ID NO: 2069037 - RNA, 11 nt, Homo sapiens
gggagggauga

SEQ ID NO: 2069038 - RNA, 13 nt, Homo sapiens
auucacauucaga

SEQ ID NO: 2069039 - RNA, 13 nt, Homo sapiens
auagacauucuca

SEQ ID NO: 2069040 - RNA, 24 nt, Homo sapiens
auuggagugcagcuaacaugagua

SEQ ID NO: 2069041 - RNA, 19 nt, Homo sapiens
uucacuuuuucugucuuua

SEQ ID NO: 2069042 - RNA, 14 nt, Homo sapiens
cggugcuccaucuc

SEQ ID NO: 2069043 - RNA, 15 nt, Homo sapiens
auggacuuguauauu

SEQ ID NO: 2069044 - RNA, 23 nt, Homo sapiens
uagucccauuuuucucuugccau

SEQ ID NO: 2069045 - RNA, 17 nt, Homo sapiens
uugggaaauaugucaaa

SEQ ID NO: 2069046 - RNA, 21 nt, Homo sapiens
gaaauaucuuaaaacgcaaaa

SEQ ID NO: 2069047 - RNA, 20 nt, Homo sapiens
ucuuaauacuugaacuguug

SEQ ID NO: 2069048 - RNA, 23 nt, Homo sapiens
accaaguuauaaaucaaugucac

SEQ ID NO: 2069049 - RNA, 13 nt, Homo sapiens
uagaaaugauuca

SEQ ID NO: 2069050 - RNA, 14 nt, Homo sapiens
gucugucucucuuu

SEQ ID NO: 2069051 - RNA, 15 nt, Homo sapiens
ggcuguaucccauga

SEQ ID NO: 2069052 - RNA, 13 nt, Homo sapiens
cagguaaugugaa

SEQ ID NO: 2069053 - RNA, 17 nt, Homo sapiens
aagugcacaccuuuauu

SEQ ID NO: 2069054 - RNA, 17 nt, Homo sapiens
aucaucacucaucugcc

SEQ ID NO: 2069055 - RNA, 21 nt, Homo sapiens
ucuuggccaggcuggucuuga

SEQ ID NO: 2069056 - RNA, 19 nt, Homo sapiens
auauagaggagcacuauua

SEQ ID NO: 2069057 - RNA, 17 nt, Homo sapiens
uguccccucauaggaug

SEQ ID NO: 2069058 - RNA, 11 nt, Homo sapiens
gcucuucacau

SEQ ID NO: 2069059 - RNA, 19 nt, Homo sapiens
aacacuagaaaacauucca

SEQ ID NO: 2069060 - RNA, 13 nt, Homo sapiens
gaccugacacaau

SEQ ID NO: 2069061 - RNA, 16 nt, Homo sapiens
ucguccauguuucuca

SEQ ID NO: 2069062 - RNA, 21 nt, Homo sapiens
ggccucaaaugacaguagcau

SEQ ID NO: 2069063 - RNA, 18 nt, Homo sapiens
ucccugaagagacaggca

SEQ ID NO: 2069064 - RNA, 12 nt, Homo sapiens
aaaguucuggaa

SEQ ID NO: 2069065 - RNA, 16 nt, Homo sapiens
cagaccucaggugcua

SEQ ID NO: 2069066 - RNA, 22 nt, Homo sapiens
ucagcagccgccuuaagcugau

SEQ ID NO: 2069067 - RNA, 15 nt, Homo sapiens
aaccuuuaauauauc

SEQ ID NO: 2069068 - RNA, 14 nt, Homo sapiens
agcaucucauucau

SEQ ID NO: 2069069 - RNA, 19 nt, Homo sapiens
gcugggauuacagguguga

SEQ ID NO: 2069070 - RNA, 16 nt, Homo sapiens
acaaacagcucaguuc

SEQ ID NO: 2069071 - RNA, 16 nt, Homo sapiens
acucaguaaaagcaaa

SEQ ID NO: 2069072 - RNA, 17 nt, Homo sapiens
uucgcacucaaugccaa

SEQ ID NO: 2069073 - RNA, 20 nt, Homo sapiens
cauaucuaaagcuuuggaca

SEQ ID NO: 2069074 - RNA, 19 nt, Homo sapiens
uguccaugaagcacugagc

SEQ ID NO: 2069075 - RNA, 22 nt, Homo sapiens
ucucccagggccuuaaaagcca

SEQ ID NO: 2069076 - RNA, 19 nt, Homo sapiens
uaaacaaugaauucuucaa

SEQ ID NO: 2069077 - RNA, 15 nt, Homo sapiens
gcagccauccaugag

SEQ ID NO: 2069078 - RNA, 17 nt, Homo sapiens
ccacagacgggcacaca

SEQ ID NO: 2069079 - RNA, 20 nt, Homo sapiens
cugaugcuguuaaccaaagg

SEQ ID NO: 2069080 - RNA, 13 nt, Homo sapiens
aaacuucuuuaaa

SEQ ID NO: 2069081 - RNA, 18 nt, Homo sapiens
ccuaaucuuccacuugag

SEQ ID NO: 2069082 - RNA, 20 nt, Homo sapiens
uuaccugggaccucacacgc

SEQ ID NO: 2069083 - RNA, 16 nt, Homo sapiens
ccuucugaagaucuca

SEQ ID NO: 2069084 - RNA, 16 nt, Homo sapiens
aguacaccccaacagc

SEQ ID NO: 2069085 - RNA, 18 nt, Homo sapiens
caaaggagggucaggaag

SEQ ID NO: 2069086 - RNA, 22 nt, Homo sapiens
aauaaaugacaagugagacaaa

SEQ ID NO: 2069087 - RNA, 13 nt, Homo sapiens
ugagccaguguca

SEQ ID NO: 2069088 - RNA, 14 nt, Homo sapiens
gcccgccaccugug

SEQ ID NO: 2069089 - RNA, 18 nt, Homo sapiens
uaaauauauaugucaaua

SEQ ID NO: 2069090 - RNA, 23 nt, Homo sapiens
cuaaaaaugaaccugcaagccuu

SEQ ID NO: 2069091 - RNA, 23 nt, Homo sapiens
aaauacuuuuucaguuguuuaga

SEQ ID NO: 2069092 - RNA, 21 nt, Homo sapiens
ccagguuggaggcccuaggcg

SEQ ID NO: 2069093 - RNA, 21 nt, Homo sapiens
cacaaaaaggcauaugcaaua

SEQ ID NO: 2069094 - RNA, 19 nt, Homo sapiens
gacagcaucuuccucccuc

SEQ ID NO: 2069095 - RNA, 16 nt, Homo sapiens
gcagccagccaucaaa

SEQ ID NO: 2069096 - RNA, 20 nt, Homo sapiens
auccuuguguuuaucagaaa

SEQ ID NO: 2069097 - RNA, 11 nt, Homo sapiens
cauaguguacc

SEQ ID NO: 2069098 - RNA, 16 nt, Homo sapiens
ccugaccuugugaucc

SEQ ID NO: 2069099 - RNA, 19 nt, Homo sapiens
accuacagagcagccaggu

SEQ ID NO: 2069100 - RNA, 19 nt, Homo sapiens
cuccccagagcugccugcu

SEQ ID NO: 2069101 - RNA, 18 nt, Homo sapiens
gcuaucgcaaaucacaaa

SEQ ID NO: 2069102 - RNA, 19 nt, Homo sapiens
cuuugcugcauuuuacaca

SEQ ID NO: 2069103 - RNA, 21 nt, Homo sapiens
aaagcuuuuuacucaaagagu

SEQ ID NO: 2069104 - RNA, 16 nt, Homo sapiens
aauccaaaucuguccu

SEQ ID NO: 2069105 - RNA, 15 nt, Homo sapiens
auucacaggacauug

SEQ ID NO: 2069106 - RNA, 15 nt, Homo sapiens
aaugaaaugcauuuu

SEQ ID NO: 2069107 - RNA, 21 nt, Homo sapiens
acauucuuugggccuccugga

SEQ ID NO: 2069108 - RNA, 19 nt, Homo sapiens
gcuucagagacacacaauu

SEQ ID NO: 2069109 - RNA, 19 nt, Homo sapiens
gcagcugcuggcugugaca

SEQ ID NO: 2069110 - RNA, 16 nt, Homo sapiens
agcuuaaaaucuguga

SEQ ID NO: 2069111 - RNA, 16 nt, Homo sapiens
gaacuaaauguucuau

SEQ ID NO: 2069112 - RNA, 19 nt, Homo sapiens
uucaaccuaguccgcugaa

SEQ ID NO: 2069113 - RNA, 23 nt, Homo sapiens
cuugagggcugcaguucuacuca

SEQ ID NO: 2069114 - RNA, 12 nt, Homo sapiens
ggcugcaaucac

SEQ ID NO: 2069115 - RNA, 19 nt, Homo sapiens
agguccuuuccacccugag

SEQ ID NO: 2069116 - RNA, 23 nt, Homo sapiens
uguuucugaaccauuacuguaau

SEQ ID NO: 2069117 - RNA, 18 nt, Homo sapiens
ggaagcaagaaagccgua

SEQ ID NO: 2069118 - RNA, 15 nt, Homo sapiens
acugugcaguuuuca

SEQ ID NO: 2069119 - RNA, 14 nt, Homo sapiens
ggcauuacucugca

SEQ ID NO: 2069120 - RNA, 11 nt, Homo sapiens
acuuaaugucu

SEQ ID NO: 2069121 - RNA, 21 nt, Homo sapiens
caaaucuacgguuaugaaggc

SEQ ID NO: 2069122 - RNA, 20 nt, Homo sapiens
agaauaaaugaaucuuacuc

SEQ ID NO: 2069123 - RNA, 19 nt, Homo sapiens
cugaggccagaaaggugug

SEQ ID NO: 2069124 - RNA, 17 nt, Homo sapiens
guauuuaccacagcagc

SEQ ID NO: 2069125 - RNA, 20 nt, Homo sapiens
gcuguguguguuagcuugua

SEQ ID NO: 2069126 - RNA, 20 nt, Homo sapiens
gcugggggagggacugcuga

SEQ ID NO: 2069127 - RNA, 15 nt, Homo sapiens
cugcccgacucaggu

SEQ ID NO: 2069128 - RNA, 20 nt, Homo sapiens
uugucucuagagcagggauu

SEQ ID NO: 2069129 - RNA, 19 nt, Homo sapiens
gguauauacgugugguuca

SEQ ID NO: 2069130 - RNA, 21 nt, Homo sapiens
ugaagcuuuaggcagagccau

SEQ ID NO: 2069131 - RNA, 18 nt, Homo sapiens
ccagggagggugagcugg

SEQ ID NO: 2069132 - RNA, 16 nt, Homo sapiens
uuucacuguuuccuau

SEQ ID NO: 2069133 - RNA, 17 nt, Homo sapiens
cugcagaugacuggaaa

SEQ ID NO: 2069134 - RNA, 15 nt, Homo sapiens
cucacucacucugau

SEQ ID NO: 2069135 - RNA, 12 nt, Homo sapiens
auucaaagcucu

SEQ ID NO: 2069136 - RNA, 21 nt, Homo sapiens
ccucaguaagacgacaaggaa

SEQ ID NO: 2069137 - RNA, 14 nt, Homo sapiens
cuuuuucacuuuga

SEQ ID NO: 2069138 - RNA, 14 nt, Homo sapiens
uacuuucauacuga

SEQ ID NO: 2069139 - RNA, 12 nt, Homo sapiens
ccuccaccagcc

SEQ ID NO: 2069140 - RNA, 18 nt, Homo sapiens
gaaucggcuuugcagugc

SEQ ID NO: 2069141 - RNA, 23 nt, Homo sapiens
acucugucacacuaaacuucuua

SEQ ID NO: 2069142 - RNA, 16 nt, Homo sapiens
ccugugccuaacagca

SEQ ID NO: 2069143 - RNA, 15 nt, Homo sapiens
aggcagccaguguga

SEQ ID NO: 2069144 - RNA, 15 nt, Homo sapiens
caggaacccaucuaa

SEQ ID NO: 2069145 - RNA, 19 nt, Homo sapiens
caaugacuuuccuagacaa

SEQ ID NO: 2069146 - RNA, 20 nt, Homo sapiens
uuuuaaccugccaacauacu

SEQ ID NO: 2069147 - RNA, 14 nt, Homo sapiens
caauaaagacugag

SEQ ID NO: 2069148 - RNA, 21 nt, Homo sapiens
ucagcugaucugauucuacca

SEQ ID NO: 2069149 - RNA, 16 nt, Homo sapiens
acuauaaauauacaua

SEQ ID NO: 2069150 - RNA, 12 nt, Homo sapiens
uggugcagugaa

SEQ ID NO: 2069151 - RNA, 19 nt, Homo sapiens
cauagaguauagcucugua

SEQ ID NO: 2069152 - RNA, 14 nt, Homo sapiens
ccaucgucuuuaac

SEQ ID NO: 2069153 - RNA, 14 nt, Homo sapiens
aacaacauguucua

SEQ ID NO: 2069154 - RNA, 15 nt, Homo sapiens
uuucucguuccagaa

SEQ ID NO: 2069155 - RNA, 15 nt, Homo sapiens
uuuugaaaaccuaaa

SEQ ID NO: 2069156 - RNA, 16 nt, Homo sapiens
aggggauuuggggcuu

SEQ ID NO: 2069157 - RNA, 14 nt, Homo sapiens
aucuccauuucaca

SEQ ID NO: 2069158 - RNA, 20 nt, Homo sapiens
cgagucugccccagugggga

SEQ ID NO: 2069159 - RNA, 20 nt, Homo sapiens
ucacaaaaaggcauaugcaa

SEQ ID NO: 2069160 - RNA, 20 nt, Homo sapiens
cugaggagucugagguccug

SEQ ID NO: 2069161 - RNA, 18 nt, Homo sapiens
ccuugcuagacagccagg

SEQ ID NO: 2069162 - RNA, 18 nt, Homo sapiens
aauucuuuguauaugcau

SEQ ID NO: 2069163 - RNA, 15 nt, Homo sapiens
aaauuaagaaggcaa

SEQ ID NO: 2069164 - RNA, 21 nt, Homo sapiens
augcucaaugaaaaggugauu

SEQ ID NO: 2069165 - RNA, 20 nt, Homo sapiens
caugaagggaugcugcaaug

SEQ ID NO: 2069166 - RNA, 21 nt, Homo sapiens
uggucugugugugacaccacc

SEQ ID NO: 2069167 - RNA, 19 nt, Homo sapiens
cuaaauuuugugauucuau

SEQ ID NO: 2069168 - RNA, 23 nt, Homo sapiens
cuggacacuguccaugaagcacu

SEQ ID NO: 2069169 - RNA, 21 nt, Homo sapiens
uuuacguuuuaacacacagac

SEQ ID NO: 2069170 - RNA, 17 nt, Homo sapiens
aaaccgaggacccauga

SEQ ID NO: 2069171 - RNA, 19 nt, Homo sapiens
uucaguagaagaacuuaaa

SEQ ID NO: 2069172 - RNA, 13 nt, Homo sapiens
gcugaggucuguu

SEQ ID NO: 2069173 - RNA, 16 nt, Homo sapiens
uuguuucccccucuuu

SEQ ID NO: 2069174 - RNA, 19 nt, Homo sapiens
ucacccggcccccaugcaa

SEQ ID NO: 2069175 - RNA, 16 nt, Homo sapiens
cuccugugaauggagg

SEQ ID NO: 2069176 - RNA, 12 nt, Homo sapiens
agaggcucugug

SEQ ID NO: 2069177 - RNA, 20 nt, Homo sapiens
ccaacuuuccccacguuaaa

SEQ ID NO: 2069178 - RNA, 12 nt, Homo sapiens
auuuaagaggaa

SEQ ID NO: 2069179 - RNA, 13 nt, Homo sapiens
cagaaaagacacu

SEQ ID NO: 2069180 - RNA, 18 nt, Homo sapiens
acuuugacacaaggugua

SEQ ID NO: 2069181 - RNA, 15 nt, Homo sapiens
ucauaguuuugcacu

SEQ ID NO: 2069182 - RNA, 21 nt, Homo sapiens
cauccuuuuuccuacuuguua

SEQ ID NO: 2069183 - RNA, 11 nt, Homo sapiens
gcuaccaacuu

SEQ ID NO: 2069184 - RNA, 16 nt, Homo sapiens
acgaagcuuaguauaa

SEQ ID NO: 2069185 - RNA, 20 nt, Homo sapiens
accuuuucuccuacaaaggg

SEQ ID NO: 2069186 - RNA, 12 nt, Homo sapiens
gggacaugcagc

SEQ ID NO: 2069187 - RNA, 18 nt, Homo sapiens
aacgacgggggcaggugc

SEQ ID NO: 2069188 - RNA, 14 nt, Homo sapiens
uccucuuuuuuaug

SEQ ID NO: 2069189 - RNA, 14 nt, Homo sapiens
ucugucucauugac

SEQ ID NO: 2069190 - RNA, 15 nt, Homo sapiens
aacuagaugaccuca

SEQ ID NO: 2069191 - RNA, 16 nt, Homo sapiens
guacuguuacuguguc

SEQ ID NO: 2069192 - RNA, 22 nt, Homo sapiens
gaccaacauggugaaacccugu

SEQ ID NO: 2069193 - RNA, 14 nt, Homo sapiens
aaugauuaucuccu

SEQ ID NO: 2069194 - RNA, 14 nt, Homo sapiens
gugaggccugcaca

SEQ ID NO: 2069195 - RNA, 18 nt, Homo sapiens
uuuggcugguuaauucca

SEQ ID NO: 2069196 - RNA, 23 nt, Homo sapiens
gaccuuugcccacacacacuccu

SEQ ID NO: 2069197 - RNA, 17 nt, Homo sapiens
aauccugacaaaaggga

SEQ ID NO: 2069198 - RNA, 19 nt, Homo sapiens
aagaauguuguuagcuuuu

SEQ ID NO: 2069199 - RNA, 20 nt, Homo sapiens
aaugcgaacuuggagauaau

SEQ ID NO: 2069200 - RNA, 22 nt, Homo sapiens
agggcugccccuguagguugcu

SEQ ID NO: 2069201 - RNA, 17 nt, Homo sapiens
aagaccucccaagcugu

SEQ ID NO: 2069202 - RNA, 16 nt, Homo sapiens
cacuaacaaacucuga

SEQ ID NO: 2069203 - RNA, 16 nt, Homo sapiens
auuuaugacuuucaca

SEQ ID NO: 2069204 - RNA, 17 nt, Homo sapiens
aacugaaggccacuuga

SEQ ID NO: 2069205 - RNA, 15 nt, Homo sapiens
ggcaaaguagugaau

SEQ ID NO: 2069206 - RNA, 16 nt, Homo sapiens
aaauaaaguaccauua

SEQ ID NO: 2069207 - RNA, 12 nt, Homo sapiens
gauauaaacagc

SEQ ID NO: 2069208 - RNA, 21 nt, Homo sapiens
caacuccuccauuuuccuccc

SEQ ID NO: 2069209 - RNA, 23 nt, Homo sapiens
cagucuguuaugcacugugguuu

SEQ ID NO: 2069210 - RNA, 21 nt, Homo sapiens
agggugaccacaccuuggccu

SEQ ID NO: 2069211 - RNA, 20 nt, Homo sapiens
cucaaacucccgaccucagg

SEQ ID NO: 2069212 - RNA, 22 nt, Homo sapiens
cugaggaaguggggcaaggaau

SEQ ID NO: 2069213 - RNA, 16 nt, Homo sapiens
agggacugccucugcc

SEQ ID NO: 2069214 - RNA, 21 nt, Homo sapiens
cacugaucacccaaugcauca

SEQ ID NO: 2069215 - RNA, 19 nt, Homo sapiens
ccugaaccagggccagaua

SEQ ID NO: 2069216 - RNA, 20 nt, Homo sapiens
uaugaucagagcuugaacac

SEQ ID NO: 2069217 - RNA, 17 nt, Homo sapiens
uuuaacauucacagccc

SEQ ID NO: 2069218 - RNA, 11 nt, Homo sapiens
aaguaaucuca

SEQ ID NO: 2069219 - RNA, 15 nt, Homo sapiens
augaguuucacagug

SEQ ID NO: 2069220 - RNA, 13 nt, Homo sapiens
acagagacacuuu

SEQ ID NO: 2069221 - RNA, 15 nt, Homo sapiens
ugaugugaaacauua

SEQ ID NO: 2069222 - RNA, 13 nt, Homo sapiens
cagccaucuguau

SEQ ID NO: 2069223 - RNA, 22 nt, Homo sapiens
aaauauuugagaauaaguucau

SEQ ID NO: 2069224 - RNA, 20 nt, Homo sapiens
ugccgcagacgggcacagac

SEQ ID NO: 2069225 - RNA, 22 nt, Homo sapiens
cagugagccaugaguaugccac

SEQ ID NO: 2069226 - RNA, 16 nt, Homo sapiens
aggucagucuucuucc

SEQ ID NO: 2069227 - RNA, 19 nt, Homo sapiens
gaucuuagggaacuuugau

SEQ ID NO: 2069228 - RNA, 23 nt, Homo sapiens
aaagcaauauuuuggaguauguu

SEQ ID NO: 2069229 - RNA, 15 nt, Homo sapiens
cccacuggcauuaaa

SEQ ID NO: 2069230 - RNA, 19 nt, Homo sapiens
agacuuuuaugauacuuga

SEQ ID NO: 2069231 - RNA, 15 nt, Homo sapiens
uagaguguagcugua

SEQ ID NO: 2069232 - RNA, 20 nt, Homo sapiens
caaagaaaaaaaaaaaagcc

SEQ ID NO: 2069233 - RNA, 18 nt, Homo sapiens
uaauaccaaaauugagcu

SEQ ID NO: 2069234 - RNA, 20 nt, Homo sapiens
gaggcaggagaauggcguga

SEQ ID NO: 2069235 - RNA, 18 nt, Homo sapiens
agaugggaggaucacuug

SEQ ID NO: 2069236 - RNA, 22 nt, Homo sapiens
cccauuguauuuaaaacauuuc

SEQ ID NO: 2069237 - RNA, 22 nt, Homo sapiens
uuaguagaaacgggguuucacc

SEQ ID NO: 2069238 - RNA, 18 nt, Homo sapiens
agccuuaguugagauuuc

SEQ ID NO: 2069239 - RNA, 16 nt, Homo sapiens
ugguccaacaguuuga

SEQ ID NO: 2069240 - RNA, 16 nt, Homo sapiens
auuuggacagccaagg

SEQ ID NO: 2069241 - RNA, 18 nt, Homo sapiens
uuagaaucuccacuacuu

SEQ ID NO: 2069242 - RNA, 20 nt, Homo sapiens
auagcugaaauuccaguuua

SEQ ID NO: 2069243 - RNA, 16 nt, Homo sapiens
guuugggaaggugaug

SEQ ID NO: 2069244 - RNA, 21 nt, Homo sapiens
aagaaggaaaagauacccaaa

SEQ ID NO: 2069245 - RNA, 23 nt, Homo sapiens
acauuuguguuuuuuucuagccu

SEQ ID NO: 2069246 - RNA, 19 nt, Homo sapiens
ugaaaauauuuuguugccu

SEQ ID NO: 2069247 - RNA, 17 nt, Homo sapiens
accccucugucuucaag

SEQ ID NO: 2069248 - RNA, 14 nt, Homo sapiens
ggggaggggacaga

SEQ ID NO: 2069249 - RNA, 18 nt, Homo sapiens
agcacuacauaaacugac

SEQ ID NO: 2069250 - RNA, 19 nt, Homo sapiens
aaggacaaagugccaaaga

SEQ ID NO: 2069251 - RNA, 16 nt, Homo sapiens
acugaccaggcccaag

SEQ ID NO: 2069252 - RNA, 18 nt, Homo sapiens
caacuucaggagcucuuu

SEQ ID NO: 2069253 - RNA, 17 nt, Homo sapiens
uccuuccugaaacuaua

SEQ ID NO: 2069254 - RNA, 18 nt, Homo sapiens
aaugagagaguguggaaa

SEQ ID NO: 2069255 - RNA, 18 nt, Homo sapiens
guuggcaucuugcugcua

SEQ ID NO: 2069256 - RNA, 13 nt, Homo sapiens
auucugcuaccaa

SEQ ID NO: 2069257 - RNA, 19 nt, Homo sapiens
ugccaaaguagcugaugua

SEQ ID NO: 2069258 - RNA, 14 nt, Homo sapiens
aacauguguaugua

SEQ ID NO: 2069259 - RNA, 18 nt, Homo sapiens
aaaauaguaagccucccu

SEQ ID NO: 2069260 - RNA, 22 nt, Homo sapiens
uuggcuacgaaaugcuugcuca

SEQ ID NO: 2069261 - RNA, 13 nt, Homo sapiens
ggagguacuguga

SEQ ID NO: 2069262 - RNA, 14 nt, Homo sapiens
ccagagaacacagg

SEQ ID NO: 2069263 - RNA, 11 nt, Homo sapiens
gacaccaaagc

SEQ ID NO: 2069264 - RNA, 13 nt, Homo sapiens
gccuggguggaug

SEQ ID NO: 2069265 - RNA, 14 nt, Homo sapiens
cagcuuuucuugcc

SEQ ID NO: 2069266 - RNA, 21 nt, Homo sapiens
gccacagcacuagagucaccc

SEQ ID NO: 2069267 - RNA, 19 nt, Homo sapiens
aggaggcugcaugcucugg

SEQ ID NO: 2069268 - RNA, 20 nt, Homo sapiens
uauggaauucaaagcucuaa

SEQ ID NO: 2069269 - RNA, 20 nt, Homo sapiens
uucuagaucuggaaccuuac

SEQ ID NO: 2069270 - RNA, 12 nt, Homo sapiens
ugaauaugugua

SEQ ID NO: 2069271 - RNA, 12 nt, Homo sapiens
gagaucaugcca

SEQ ID NO: 2069272 - RNA, 21 nt, Homo sapiens
agacucagggccccagcacua

SEQ ID NO: 2069273 - RNA, 23 nt, Homo sapiens
ugaacaccacuuugucucugaga

SEQ ID NO: 2069274 - RNA, 15 nt, Homo sapiens
agcacagucagugac

SEQ ID NO: 2069275 - RNA, 18 nt, Homo sapiens
cucaaccuaacacauuaa

SEQ ID NO: 2069276 - RNA, 22 nt, Homo sapiens
cugaaccguuugugauugccau

SEQ ID NO: 2069277 - RNA, 23 nt, Homo sapiens
cauagucuuuggagaaaugcuua

SEQ ID NO: 2069278 - RNA, 15 nt, Homo sapiens
uguuaaggaaacucu

SEQ ID NO: 2069279 - RNA, 15 nt, Homo sapiens
ucaguguacucugag

SEQ ID NO: 2069280 - RNA, 16 nt, Homo sapiens
auagcuuuauacucuc

SEQ ID NO: 2069281 - RNA, 15 nt, Homo sapiens
auccaaucugugaug

SEQ ID NO: 2069282 - RNA, 21 nt, Homo sapiens
caaaggcuuucuuuccaaucc

SEQ ID NO: 2069283 - RNA, 22 nt, Homo sapiens
aauuaaggguaugauuaacucu

SEQ ID NO: 2069284 - RNA, 17 nt, Homo sapiens
aggagugacuuugcagg

SEQ ID NO: 2069285 - RNA, 11 nt, Homo sapiens
cacagagccac

SEQ ID NO: 2069286 - RNA, 19 nt, Homo sapiens
aagcauggaaaaucaguga

SEQ ID NO: 2069287 - RNA, 22 nt, Homo sapiens
gucaagcuuacuacagugaaag

SEQ ID NO: 2069288 - RNA, 21 nt, Homo sapiens
aaaguuuaggcaugcucagaa

SEQ ID NO: 2069289 - RNA, 17 nt, Homo sapiens
acagcggucccaggggc

SEQ ID NO: 2069290 - RNA, 15 nt, Homo sapiens
uuggggacaacguau

SEQ ID NO: 2069291 - RNA, 12 nt, Homo sapiens
uccauaccagcu

SEQ ID NO: 2069292 - RNA, 20 nt, Homo sapiens
cauagucuguauccaaauaa

SEQ ID NO: 2069293 - RNA, 18 nt, Homo sapiens
aacaucacugucuugcca

SEQ ID NO: 2069294 - RNA, 16 nt, Homo sapiens
aucugucugugcacau

SEQ ID NO: 2069295 - RNA, 21 nt, Homo sapiens
aaucaccaauaaauaagugca

SEQ ID NO: 2069296 - RNA, 16 nt, Homo sapiens
ugaaaaaaaugcauuu

SEQ ID NO: 2069297 - RNA, 14 nt, Homo sapiens
cuccauuugcucuu

SEQ ID NO: 2069298 - RNA, 15 nt, Homo sapiens
cuuccccagacccag

SEQ ID NO: 2069299 - RNA, 23 nt, Homo sapiens
agacacagcgucccuagcaguga

SEQ ID NO: 2069300 - RNA, 16 nt, Homo sapiens
acccacauccaaacau

SEQ ID NO: 2069301 - RNA, 13 nt, Homo sapiens
uccuagcacuuug

SEQ ID NO: 2069302 - RNA, 21 nt, Homo sapiens
uggugagcuuaacccuggaaa

SEQ ID NO: 2069303 - RNA, 16 nt, Homo sapiens
guuuaaguacuucaca

SEQ ID NO: 2069304 - RNA, 16 nt, Homo sapiens
cagacuguggcugcag

SEQ ID NO: 2069305 - RNA, 17 nt, Homo sapiens
cuuuaccuuuucagggc

SEQ ID NO: 2069306 - RNA, 23 nt, Homo sapiens
aaggcaguguuauuuauuucuuu

SEQ ID NO: 2069307 - RNA, 17 nt, Homo sapiens
auagccaauacauuuac

SEQ ID NO: 2069308 - RNA, 15 nt, Homo sapiens
cuuuccauguugcug

SEQ ID NO: 2069309 - RNA, 14 nt, Homo sapiens
cacuugugugugua

SEQ ID NO: 2069310 - RNA, 18 nt, Homo sapiens
uuccuguauguuguccaa

SEQ ID NO: 2069311 - RNA, 18 nt, Homo sapiens
agucaagagcauccugcu

SEQ ID NO: 2069312 - RNA, 22 nt, Homo sapiens
caaauguuguauuucaaaccag

SEQ ID NO: 2069313 - RNA, 15 nt, Homo sapiens
uccuugaaaaugugu

SEQ ID NO: 2069314 - RNA, 15 nt, Homo sapiens
uacucuuaagccauc

SEQ ID NO: 2069315 - RNA, 21 nt, Homo sapiens
aaacuaccagcccuacaccau

SEQ ID NO: 2069316 - RNA, 17 nt, Homo sapiens
guauucagcguacuuga

SEQ ID NO: 2069317 - RNA, 20 nt, Homo sapiens
uuaagugacuauagaaugca

SEQ ID NO: 2069318 - RNA, 15 nt, Homo sapiens
ccaaaggcaugcagu

SEQ ID NO: 2069319 - RNA, 14 nt, Homo sapiens
cucuuuaaucucau

SEQ ID NO: 2069320 - RNA, 13 nt, Homo sapiens
gaaugacccuguc

SEQ ID NO: 2069321 - RNA, 19 nt, Homo sapiens
aauuauuacaauucuugaa

SEQ ID NO: 2069322 - RNA, 22 nt, Homo sapiens
auacaaaccuuuagcugugaau

SEQ ID NO: 2069323 - RNA, 23 nt, Homo sapiens
auuuucugucagaugagaacaaa

SEQ ID NO: 2069324 - RNA, 18 nt, Homo sapiens
ucauugucaccucuguga

SEQ ID NO: 2069325 - RNA, 18 nt, Homo sapiens
cuguccuggaggcacugg

SEQ ID NO: 2069326 - RNA, 14 nt, Homo sapiens
gcuuugcugugaag

SEQ ID NO: 2069327 - RNA, 13 nt, Homo sapiens
ucuaccucaggca

SEQ ID NO: 2069328 - RNA, 16 nt, Homo sapiens
uucaggacucuaccuc

SEQ ID NO: 2069329 - RNA, 18 nt, Homo sapiens
gugcaaagauuugcuuua

SEQ ID NO: 2069330 - RNA, 18 nt, Homo sapiens
aagacuacuauacaaacu

SEQ ID NO: 2069331 - RNA, 21 nt, Homo sapiens
acuauggagcugagcaggugu

SEQ ID NO: 2069332 - RNA, 17 nt, Homo sapiens
aggacguugaggacuuu

SEQ ID NO: 2069333 - RNA, 18 nt, Homo sapiens
cagaguuuuuaaagccuu

SEQ ID NO: 2069334 - RNA, 15 nt, Homo sapiens
guggcaucuugccaa

SEQ ID NO: 2069335 - RNA, 22 nt, Homo sapiens
agugauugauagaguguuauca

SEQ ID NO: 2069336 - RNA, 14 nt, Homo sapiens
ucugccauucaacu

SEQ ID NO: 2069337 - RNA, 15 nt, Homo sapiens
uacaaagaaccaaga

SEQ ID NO: 2069338 - RNA, 13 nt, Homo sapiens
aauucuucauccu

SEQ ID NO: 2069339 - RNA, 17 nt, Homo sapiens
uuaaauucuucuugaaa

SEQ ID NO: 2069340 - RNA, 15 nt, Homo sapiens
cauaucuaugggaaa

SEQ ID NO: 2069341 - RNA, 18 nt, Homo sapiens
agcagcgaaaacugccag

SEQ ID NO: 2069342 - RNA, 14 nt, Homo sapiens
uaaaaggagcacau

SEQ ID NO: 2069343 - RNA, 17 nt, Homo sapiens
aauguacaugucaauaa

SEQ ID NO: 2069344 - RNA, 17 nt, Homo sapiens
cugacugagcaauaugc

SEQ ID NO: 2069345 - RNA, 21 nt, Homo sapiens
aagguccaguucuacagagug

SEQ ID NO: 2069346 - RNA, 17 nt, Homo sapiens
ggacaccauuaccaaaa

SEQ ID NO: 2069347 - RNA, 18 nt, Homo sapiens
uguagaagauggcacuua

SEQ ID NO: 2069348 - RNA, 21 nt, Homo sapiens
guuauagcccugcccucccaa

SEQ ID NO: 2069349 - RNA, 16 nt, Homo sapiens
aucagccgcaaggauc

SEQ ID NO: 2069350 - RNA, 17 nt, Homo sapiens
gucuuaaucaugagaua

SEQ ID NO: 2069351 - RNA, 22 nt, Homo sapiens
gcgugggaguauguuauuucuc

SEQ ID NO: 2069352 - RNA, 22 nt, Homo sapiens
cucccgcgcccccaccccagac

SEQ ID NO: 2069353 - RNA, 19 nt, Homo sapiens
ucgauccuggauucacuca

SEQ ID NO: 2069354 - RNA, 20 nt, Homo sapiens
acccccccuccugcugccua

SEQ ID NO: 2069355 - RNA, 20 nt, Homo sapiens
caggaaagcuguuaggcuca

SEQ ID NO: 2069356 - RNA, 22 nt, Homo sapiens
ggaggauacugaggcacacaga

SEQ ID NO: 2069357 - RNA, 14 nt, Homo sapiens
accauuacuguaau

SEQ ID NO: 2069358 - RNA, 19 nt, Homo sapiens
ccuugcacaaaaagcacaa

SEQ ID NO: 2069359 - RNA, 14 nt, Homo sapiens
uuaccuguucucua

SEQ ID NO: 2069360 - RNA, 18 nt, Homo sapiens
guggaggaaaauccaugg

SEQ ID NO: 2069361 - RNA, 17 nt, Homo sapiens
aaaaucagaagcacaaa

SEQ ID NO: 2069362 - RNA, 15 nt, Homo sapiens
uauugcauaugcaua

SEQ ID NO: 2069363 - RNA, 23 nt, Homo sapiens
cagagcuaaggccaaugggcuag

SEQ ID NO: 2069364 - RNA, 21 nt, Homo sapiens
uccuucuaaagugcugggauu

SEQ ID NO: 2069365 - RNA, 22 nt, Homo sapiens
cuguuagaugugacacauucuc

SEQ ID NO: 2069366 - RNA, 14 nt, Homo sapiens
aaauaaacuaguuu

SEQ ID NO: 2069367 - RNA, 16 nt, Homo sapiens
agaaucuaaacuuuau

SEQ ID NO: 2069368 - RNA, 19 nt, Homo sapiens
acuuauggaacagggaugg

SEQ ID NO: 2069369 - RNA, 20 nt, Homo sapiens
gacgaagcggagagagccaa

SEQ ID NO: 2069370 - RNA, 20 nt, Homo sapiens
aacagaaauuagaauugugu

SEQ ID NO: 2069371 - RNA, 17 nt, Homo sapiens
uaaaguucauccuuuga

SEQ ID NO: 2069372 - RNA, 23 nt, Homo sapiens
ucuccucaugcccccucagugag

SEQ ID NO: 2069373 - RNA, 21 nt, Homo sapiens
uaaaacugcgaggacaucaaa

SEQ ID NO: 2069374 - RNA, 16 nt, Homo sapiens
gcucucaacaggacuu

SEQ ID NO: 2069375 - RNA, 17 nt, Homo sapiens
cuccuaauggcauggag

SEQ ID NO: 2069376 - RNA, 11 nt, Homo sapiens
ucccaucaggu

SEQ ID NO: 2069377 - RNA, 13 nt, Homo sapiens
cucaccacuucag

SEQ ID NO: 2069378 - RNA, 13 nt, Homo sapiens
cugaccacuugag

SEQ ID NO: 2069379 - RNA, 23 nt, Homo sapiens
ugagggaccaauauuaccaucuu

SEQ ID NO: 2069380 - RNA, 13 nt, Homo sapiens
agcccaggaccca

SEQ ID NO: 2069381 - RNA, 20 nt, Homo sapiens
auuucaaaaucuuaaccuga

SEQ ID NO: 2069382 - RNA, 23 nt, Homo sapiens
aguauuuuauuugucugacaaac

SEQ ID NO: 2069383 - RNA, 19 nt, Homo sapiens
ccacuguaauuaaaacuau

SEQ ID NO: 2069384 - RNA, 23 nt, Homo sapiens
cagagaaaacagcaauagugaau

SEQ ID NO: 2069385 - RNA, 20 nt, Homo sapiens
ucccuaaaauaaagaucacc

SEQ ID NO: 2069386 - RNA, 20 nt, Homo sapiens
uuugugauuacccauaauau

SEQ ID NO: 2069387 - RNA, 21 nt, Homo sapiens
uggagccuguguaacagcucc

SEQ ID NO: 2069388 - RNA, 21 nt, Homo sapiens
gauuuaaugaagacccagugu

SEQ ID NO: 2069389 - RNA, 12 nt, Homo sapiens
gaucauugcugg

SEQ ID NO: 2069390 - RNA, 14 nt, Homo sapiens
ccucuucuaacuca

SEQ ID NO: 2069391 - RNA, 23 nt, Homo sapiens
ccagugucauuucucauccacau

SEQ ID NO: 2069392 - RNA, 21 nt, Homo sapiens
cugaacgacagucccaguucc

SEQ ID NO: 2069393 - RNA, 23 nt, Homo sapiens
ucaaagauguguugcuauccuga

SEQ ID NO: 2069394 - RNA, 20 nt, Homo sapiens
gccucccaggagaaucacuu

SEQ ID NO: 2069395 - RNA, 13 nt, Homo sapiens
aaauuucacuuaa

SEQ ID NO: 2069396 - RNA, 15 nt, Homo sapiens
ccuuuaggaucucag

SEQ ID NO: 2069397 - RNA, 14 nt, Homo sapiens
augagcacuucuaa

SEQ ID NO: 2069398 - RNA, 20 nt, Homo sapiens
agguuggccacagucaccac

SEQ ID NO: 2069399 - RNA, 21 nt, Homo sapiens
agccagcccccuccagcucau

SEQ ID NO: 2069400 - RNA, 21 nt, Homo sapiens
cucugggaaguggucagcgca

SEQ ID NO: 2069401 - RNA, 20 nt, Homo sapiens
acuucgcuaaccaacuguuc

SEQ ID NO: 2069402 - RNA, 13 nt, Homo sapiens
uuuaaaagugauc

SEQ ID NO: 2069403 - RNA, 22 nt, Homo sapiens
aaaugccuccaagccauucacu

SEQ ID NO: 2069404 - RNA, 18 nt, Homo sapiens
cgggcagcuggugcugug

SEQ ID NO: 2069405 - RNA, 17 nt, Homo sapiens
aucccuauccauagucc

SEQ ID NO: 2069406 - RNA, 13 nt, Homo sapiens
uacaggugugagc

SEQ ID NO: 2069407 - RNA, 13 nt, Homo sapiens
acccacuauccca

SEQ ID NO: 2069408 - RNA, 13 nt, Homo sapiens
aaugucuauaugu

SEQ ID NO: 2069409 - RNA, 16 nt, Homo sapiens
gaaauacucaugugca

SEQ ID NO: 2069410 - RNA, 18 nt, Homo sapiens
uaugauuuugaugcacaa

SEQ ID NO: 2069411 - RNA, 23 nt, Homo sapiens
aggauugagauaacauuuccaaa

SEQ ID NO: 2069412 - RNA, 20 nt, Homo sapiens
gaagggaauuaaaaagaaga

SEQ ID NO: 2069413 - RNA, 18 nt, Homo sapiens
uuugaugaaacucaugaa

SEQ ID NO: 2069414 - RNA, 18 nt, Homo sapiens
aguucccuauuugugaau

SEQ ID NO: 2069415 - RNA, 14 nt, Homo sapiens
gcagaguucuccug

SEQ ID NO: 2069416 - RNA, 14 nt, Homo sapiens
aaaagaaacuugug

SEQ ID NO: 2069417 - RNA, 22 nt, Homo sapiens
uggaggaaaugguacugcccaa

SEQ ID NO: 2069418 - RNA, 13 nt, Homo sapiens
aaaauuaaauugc

SEQ ID NO: 2069419 - RNA, 20 nt, Homo sapiens
cacucucuucuuacuguauu

SEQ ID NO: 2069420 - RNA, 19 nt, Homo sapiens
auuucugaaaaagaacugu

SEQ ID NO: 2069421 - RNA, 13 nt, Homo sapiens
uccucuccaagcu

SEQ ID NO: 2069422 - RNA, 19 nt, Homo sapiens
uaagaguguuuaauggcaa

SEQ ID NO: 2069423 - RNA, 22 nt, Homo sapiens
cagacacacacacgcacgcaca

SEQ ID NO: 2069424 - RNA, 19 nt, Homo sapiens
uaauuuuuccuauauugca

SEQ ID NO: 2069425 - RNA, 16 nt, Homo sapiens
guuuucuugccaauga

SEQ ID NO: 2069426 - RNA, 18 nt, Homo sapiens
aucugguguucuugcuaa

SEQ ID NO: 2069427 - RNA, 20 nt, Homo sapiens
acauguacuacagcuauauu

SEQ ID NO: 2069428 - RNA, 18 nt, Homo sapiens
aacauuuaggaacccaga

SEQ ID NO: 2069429 - RNA, 15 nt, Homo sapiens
uuucaauuacaaagc

SEQ ID NO: 2069430 - RNA, 14 nt, Homo sapiens
acuaacccuguggu

SEQ ID NO: 2069431 - RNA, 22 nt, Homo sapiens
gagugaguucccuuagugaauu

SEQ ID NO: 2069432 - RNA, 16 nt, Homo sapiens
ggcuugucagcacuuc

SEQ ID NO: 2069433 - RNA, 23 nt, Homo sapiens
ccccucagccuugggaccgugcc

SEQ ID NO: 2069434 - RNA, 19 nt, Homo sapiens
gccagccaguucccagguc

SEQ ID NO: 2069435 - RNA, 14 nt, Homo sapiens
ugggccacugugaa

SEQ ID NO: 2069436 - RNA, 14 nt, Homo sapiens
auucacacaugcca

SEQ ID NO: 2069437 - RNA, 18 nt, Homo sapiens
auuauuuuuuauacugua

SEQ ID NO: 2069438 - RNA, 15 nt, Homo sapiens
acccuaccugcagag

SEQ ID NO: 2069439 - RNA, 15 nt, Homo sapiens
gguaaggaaagggcu

SEQ ID NO: 2069440 - RNA, 18 nt, Homo sapiens
aucucuucagguucucau

SEQ ID NO: 2069441 - RNA, 14 nt, Homo sapiens
caugggcucagggc

SEQ ID NO: 2069442 - RNA, 20 nt, Homo sapiens
accaaaugaguccaaacugg

SEQ ID NO: 2069443 - RNA, 20 nt, Homo sapiens
agccuggcuggagagcugcu

SEQ ID NO: 2069444 - RNA, 20 nt, Homo sapiens
caggccccuuuggaccugca

SEQ ID NO: 2069445 - RNA, 18 nt, Homo sapiens
guaacaugcaauuuugca

SEQ ID NO: 2069446 - RNA, 13 nt, Homo sapiens
uaaauaagacaac

SEQ ID NO: 2069447 - RNA, 14 nt, Homo sapiens
ugcugugugccuuc

SEQ ID NO: 2069448 - RNA, 17 nt, Homo sapiens
cuaaggcagcugaucca

SEQ ID NO: 2069449 - RNA, 11 nt, Homo sapiens
cuggacuguca

SEQ ID NO: 2069450 - RNA, 13 nt, Homo sapiens
cuacuucagucuu

SEQ ID NO: 2069451 - RNA, 21 nt, Homo sapiens
agaaauguuugcugaacauug

SEQ ID NO: 2069452 - RNA, 22 nt, Homo sapiens
cuugucauuccaggugccagaa

SEQ ID NO: 2069453 - RNA, 16 nt, Homo sapiens
ucaaauguauucagau

SEQ ID NO: 2069454 - RNA, 17 nt, Homo sapiens
aaacucccuaguuccuu

SEQ ID NO: 2069455 - RNA, 17 nt, Homo sapiens
cuguaucccuacaucua

SEQ ID NO: 2069456 - RNA, 14 nt, Homo sapiens
cuauccuuuugccu

SEQ ID NO: 2069457 - RNA, 13 nt, Homo sapiens
acuagcuccccaa

SEQ ID NO: 2069458 - RNA, 16 nt, Homo sapiens
aauacauuuugcacaa

SEQ ID NO: 2069459 - RNA, 14 nt, Homo sapiens
uuaguccucaccuu

SEQ ID NO: 2069460 - RNA, 18 nt, Homo sapiens
ucuccccaccccuuccaa

SEQ ID NO: 2069461 - RNA, 23 nt, Homo sapiens
agaccuuugauuuuugcccagaa

SEQ ID NO: 2069462 - RNA, 22 nt, Homo sapiens
aucuucccuuuauuacaagaag

SEQ ID NO: 2069463 - RNA, 20 nt, Homo sapiens
gcagggcggucuucugcucc

SEQ ID NO: 2069464 - RNA, 12 nt, Homo sapiens
gcacagcuguuu

SEQ ID NO: 2069465 - RNA, 22 nt, Homo sapiens
uucucaacaguucauugcucaa

SEQ ID NO: 2069466 - RNA, 15 nt, Homo sapiens
ggaagucugugucua

SEQ ID NO: 2069467 - RNA, 21 nt, Homo sapiens
gcaaaccauggcagacucacc

SEQ ID NO: 2069468 - RNA, 20 nt, Homo sapiens
uaagcacagacaauucuaau

SEQ ID NO: 2069469 - RNA, 22 nt, Homo sapiens
ggaguaacaauacaaauggauu

SEQ ID NO: 2069470 - RNA, 21 nt, Homo sapiens
ucuuaaacacuaaaaaggcau

SEQ ID NO: 2069471 - RNA, 17 nt, Homo sapiens
cgagugugccucaggga

SEQ ID NO: 2069472 - RNA, 12 nt, Homo sapiens
uuggagcugucu

SEQ ID NO: 2069473 - RNA, 14 nt, Homo sapiens
ccacaguagcauuu

SEQ ID NO: 2069474 - RNA, 14 nt, Homo sapiens
guacuguacuauau

SEQ ID NO: 2069475 - RNA, 14 nt, Homo sapiens
caucccuccauuca

SEQ ID NO: 2069476 - RNA, 15 nt, Homo sapiens
gcgugagccaccaaa

SEQ ID NO: 2069477 - RNA, 17 nt, Homo sapiens
agaccuagauaggucau

SEQ ID NO: 2069478 - RNA, 17 nt, Homo sapiens
uaaacuguaugcucaca

SEQ ID NO: 2069479 - RNA, 15 nt, Homo sapiens
aagaagcuaugucaa

SEQ ID NO: 2069480 - RNA, 20 nt, Homo sapiens
uccaggaggggccugggcag

SEQ ID NO: 2069481 - RNA, 17 nt, Homo sapiens
aaaacugauuuuuagcu

SEQ ID NO: 2069482 - RNA, 19 nt, Homo sapiens
uccaaugucugcugaggag

SEQ ID NO: 2069483 - RNA, 14 nt, Homo sapiens
cacuugacauuccu

SEQ ID NO: 2069484 - RNA, 15 nt, Homo sapiens
uauucaggcacugag

SEQ ID NO: 2069485 - RNA, 16 nt, Homo sapiens
caauguccucuuugag

SEQ ID NO: 2069486 - RNA, 15 nt, Homo sapiens
gcaaguguaucuccu

SEQ ID NO: 2069487 - RNA, 15 nt, Homo sapiens
ugccauaugugcaaa

SEQ ID NO: 2069488 - RNA, 19 nt, Homo sapiens
ccccaggcuggagugcagu

SEQ ID NO: 2069489 - RNA, 12 nt, Homo sapiens
ggguccaagugg

SEQ ID NO: 2069490 - RNA, 22 nt, Homo sapiens
uccuuuaaugacauugauuucu

SEQ ID NO: 2069491 - RNA, 13 nt, Homo sapiens
cagauaauguccu

SEQ ID NO: 2069492 - RNA, 15 nt, Homo sapiens
ccaacuguaaugcag

SEQ ID NO: 2069493 - RNA, 22 nt, Homo sapiens
ggagcauccuuggcagugggaa

SEQ ID NO: 2069494 - RNA, 20 nt, Homo sapiens
ccucacccccuccuucauau

SEQ ID NO: 2069495 - RNA, 14 nt, Homo sapiens
uucuaggcuaccag

SEQ ID NO: 2069496 - RNA, 14 nt, Homo sapiens
uaucaagcuuuuaa

SEQ ID NO: 2069497 - RNA, 12 nt, Homo sapiens
aggaaguucucc

SEQ ID NO: 2069498 - RNA, 12 nt, Homo sapiens
augacagucaca

SEQ ID NO: 2069499 - RNA, 19 nt, Homo sapiens
uauccaggcuuaccaaagu

SEQ ID NO: 2069500 - RNA, 21 nt, Homo sapiens
uuccaaauugcccuaugcugu

SEQ ID NO: 2069501 - RNA, 16 nt, Homo sapiens
guuaauuacuuuugaa

SEQ ID NO: 2069502 - RNA, 23 nt, Homo sapiens
cgggacgguaggucaugucugua

SEQ ID NO: 2069503 - RNA, 17 nt, Homo sapiens
ugcaccaaacugccuca

SEQ ID NO: 2069504 - RNA, 21 nt, Homo sapiens
agcucaucccucucacccaga

SEQ ID NO: 2069505 - RNA, 17 nt, Homo sapiens
gaaccacagaacacugg

SEQ ID NO: 2069506 - RNA, 19 nt, Homo sapiens
guaaauucagucuuuucuc

SEQ ID NO: 2069507 - RNA, 21 nt, Homo sapiens
aaacauuaaaauauaaucucu

SEQ ID NO: 2069508 - RNA, 22 nt, Homo sapiens
ugcgugcgcgcgcuucugggaa

SEQ ID NO: 2069509 - RNA, 13 nt, Homo sapiens
cccucucaugguc

SEQ ID NO: 2069510 - RNA, 11 nt, Homo sapiens
aacacugagaa

SEQ ID NO: 2069511 - RNA, 15 nt, Homo sapiens
guagccuccuaucca

SEQ ID NO: 2069512 - RNA, 22 nt, Homo sapiens
cauuaaaugacucuucccucaa

SEQ ID NO: 2069513 - RNA, 19 nt, Homo sapiens
cagaucuaccccuuacuua

SEQ ID NO: 2069514 - RNA, 19 nt, Homo sapiens
acagacucugcuagugaaa

SEQ ID NO: 2069515 - RNA, 20 nt, Homo sapiens
auaaaauaaguggauuuugu

SEQ ID NO: 2069516 - RNA, 20 nt, Homo sapiens
auacggcucuaacagauuag

SEQ ID NO: 2069517 - RNA, 16 nt, Homo sapiens
ggucuugaucuccuga

SEQ ID NO: 2069518 - RNA, 16 nt, Homo sapiens
auaauuucaaaccaca

SEQ ID NO: 2069519 - RNA, 14 nt, Homo sapiens
ggugaagugccugc

SEQ ID NO: 2069520 - RNA, 12 nt, Homo sapiens
cccuaucuccaa

SEQ ID NO: 2069521 - RNA, 21 nt, Homo sapiens
caacccacagcucagcugccc

SEQ ID NO: 2069522 - RNA, 23 nt, Homo sapiens
uccugagaaaaucccucccugac

SEQ ID NO: 2069523 - RNA, 17 nt, Homo sapiens
uacauuagcagaagcau

SEQ ID NO: 2069524 - RNA, 11 nt, Homo sapiens
guuuuugccca

SEQ ID NO: 2069525 - RNA, 14 nt, Homo sapiens
gcccugucagugca

SEQ ID NO: 2069526 - RNA, 16 nt, Homo sapiens
aaaaaagccuccaagg

SEQ ID NO: 2069527 - RNA, 15 nt, Homo sapiens
gcaggaaaaacaaau

SEQ ID NO: 2069528 - RNA, 15 nt, Homo sapiens
agggauguucuagcc

SEQ ID NO: 2069529 - RNA, 23 nt, Homo sapiens
uaaaacucaaaacacccaaaaau

SEQ ID NO: 2069530 - RNA, 19 nt, Homo sapiens
gucucucacagacaggacc

SEQ ID NO: 2069531 - RNA, 19 nt, Homo sapiens
ucugaaggucccaccucca

SEQ ID NO: 2069532 - RNA, 20 nt, Homo sapiens
gcugcugacccagccuguuu

SEQ ID NO: 2069533 - RNA, 16 nt, Homo sapiens
uuccaucaucacugua

SEQ ID NO: 2069534 - RNA, 20 nt, Homo sapiens
uacagaaaaguugaauuuua

SEQ ID NO: 2069535 - RNA, 16 nt, Homo sapiens
gacuccaucucaaaaa

SEQ ID NO: 2069536 - RNA, 23 nt, Homo sapiens
uccugaggcaaaguagugaauau

SEQ ID NO: 2069537 - RNA, 19 nt, Homo sapiens
gaugaaggacgugucucag

SEQ ID NO: 2069538 - RNA, 20 nt, Homo sapiens
uccauacagucaagauacau

SEQ ID NO: 2069539 - RNA, 19 nt, Homo sapiens
ccuaaggacaagacacuga

SEQ ID NO: 2069540 - RNA, 22 nt, Homo sapiens
auauucccaugguagacuguga

SEQ ID NO: 2069541 - RNA, 14 nt, Homo sapiens
aggcauaguuuuua

SEQ ID NO: 2069542 - RNA, 17 nt, Homo sapiens
uuccaguuuagugcuug

SEQ ID NO: 2069543 - RNA, 23 nt, Homo sapiens
ccagagccguuacuacacacaaa

SEQ ID NO: 2069544 - RNA, 14 nt, Homo sapiens
aaagacaaagacau

SEQ ID NO: 2069545 - RNA, 22 nt, Homo sapiens
aauguguaauuguuuuggaaua

SEQ ID NO: 2069546 - RNA, 20 nt, Homo sapiens
ucucuuagaaaagcuaagag

SEQ ID NO: 2069547 - RNA, 15 nt, Homo sapiens
accacacugauccag

SEQ ID NO: 2069548 - RNA, 13 nt, Homo sapiens
agacuaacauguc

SEQ ID NO: 2069549 - RNA, 17 nt, Homo sapiens
cccagacuccaccguca

SEQ ID NO: 2069550 - RNA, 18 nt, Homo sapiens
auguuuaauaaagcuuua

SEQ ID NO: 2069551 - RNA, 21 nt, Homo sapiens
aaguucaaccucuuacaauaa

SEQ ID NO: 2069552 - RNA, 13 nt, Homo sapiens
augucuauuccau

SEQ ID NO: 2069553 - RNA, 18 nt, Homo sapiens
cuuucuaaaauauuucau

SEQ ID NO: 2069554 - RNA, 16 nt, Homo sapiens
cuuccuacccuuccuc

SEQ ID NO: 2069555 - RNA, 19 nt, Homo sapiens
uucaagcuacguguacaua

SEQ ID NO: 2069556 - RNA, 20 nt, Homo sapiens
acagaaaugauuacuaagga

SEQ ID NO: 2069557 - RNA, 15 nt, Homo sapiens
uggcucagcucucaa

SEQ ID NO: 2069558 - RNA, 19 nt, Homo sapiens
acuauugcaaggacagcau

SEQ ID NO: 2069559 - RNA, 17 nt, Homo sapiens
acuguacacacuuuauu

SEQ ID NO: 2069560 - RNA, 22 nt, Homo sapiens
uagccuuuuuuccccagacuug

SEQ ID NO: 2069561 - RNA, 15 nt, Homo sapiens
cuggcaagacugucu

SEQ ID NO: 2069562 - RNA, 15 nt, Homo sapiens
gaaugaagucuuucc

SEQ ID NO: 2069563 - RNA, 18 nt, Homo sapiens
aaauuuugugacauuccu

SEQ ID NO: 2069564 - RNA, 20 nt, Homo sapiens
aacuuuuccuggacacuuua

SEQ ID NO: 2069565 - RNA, 16 nt, Homo sapiens
cauagguaacaguuau

SEQ ID NO: 2069566 - RNA, 16 nt, Homo sapiens
aaccuuuaaucugcac

SEQ ID NO: 2069567 - RNA, 13 nt, Homo sapiens
accaacaaaaaga

SEQ ID NO: 2069568 - RNA, 18 nt, Homo sapiens
cagggccuugaauccuuu

SEQ ID NO: 2069569 - RNA, 15 nt, Homo sapiens
ugguuauaauguguu

SEQ ID NO: 2069570 - RNA, 13 nt, Homo sapiens
gagauagggaaaa

SEQ ID NO: 2069571 - RNA, 16 nt, Homo sapiens
acccacacagcugccc

SEQ ID NO: 2069572 - RNA, 14 nt, Homo sapiens
gaguggggaugaca

SEQ ID NO: 2069573 - RNA, 12 nt, Homo sapiens
ucuguacuucca

SEQ ID NO: 2069574 - RNA, 18 nt, Homo sapiens
gcuacucagaagccugag

SEQ ID NO: 2069575 - RNA, 20 nt, Homo sapiens
gauugcgccacugcacucca

SEQ ID NO: 2069576 - RNA, 14 nt, Homo sapiens
gacaucuacauuuu

SEQ ID NO: 2069577 - RNA, 15 nt, Homo sapiens
uaauaaaguggcauu

SEQ ID NO: 2069578 - RNA, 18 nt, Homo sapiens
gugcuggccucucugaca

SEQ ID NO: 2069579 - RNA, 15 nt, Homo sapiens
ugaagagcuagucua

SEQ ID NO: 2069580 - RNA, 18 nt, Homo sapiens
ggagaaguugaggggagc

SEQ ID NO: 2069581 - RNA, 22 nt, Homo sapiens
ugagagcccgcgugcuggagaa

SEQ ID NO: 2069582 - RNA, 18 nt, Homo sapiens
gaauauggaacauaugca

SEQ ID NO: 2069583 - RNA, 20 nt, Homo sapiens
gcagcacagcagacuaguua

SEQ ID NO: 2069584 - RNA, 20 nt, Homo sapiens
ccugcaacacaacauuugug

SEQ ID NO: 2069585 - RNA, 21 nt, Homo sapiens
auuaucgggagcagugucuuc

SEQ ID NO: 2069586 - RNA, 15 nt, Homo sapiens
acgugugugucuuac

SEQ ID NO: 2069587 - RNA, 17 nt, Homo sapiens
ccgcaaauuuucuucca

SEQ ID NO: 2069588 - RNA, 21 nt, Homo sapiens
gcucugagccgcgcuuucccc

SEQ ID NO: 2069589 - RNA, 18 nt, Homo sapiens
ucagugguuucuacuucc

SEQ ID NO: 2069590 - RNA, 16 nt, Homo sapiens
caaauugggaaaucca

SEQ ID NO: 2069591 - RNA, 17 nt, Homo sapiens
ucacaacuaggaccuca

SEQ ID NO: 2069592 - RNA, 16 nt, Homo sapiens
ccagacugaacuuacc

SEQ ID NO: 2069593 - RNA, 16 nt, Homo sapiens
aucagccuuguccuaa

SEQ ID NO: 2069594 - RNA, 22 nt, Homo sapiens
uaauaaaguaugaauauuucau

SEQ ID NO: 2069595 - RNA, 23 nt, Homo sapiens
cuggugucacccuggauaggcaa

SEQ ID NO: 2069596 - RNA, 19 nt, Homo sapiens
aacaauauuuaaccaaaga

SEQ ID NO: 2069597 - RNA, 17 nt, Homo sapiens
augucuuguacaugugu

SEQ ID NO: 2069598 - RNA, 15 nt, Homo sapiens
aagcaacguguuaau

SEQ ID NO: 2069599 - RNA, 16 nt, Homo sapiens
aagugggucaauuccu

SEQ ID NO: 2069600 - RNA, 21 nt, Homo sapiens
cacaaaguuggugccaagcuu

SEQ ID NO: 2069601 - RNA, 20 nt, Homo sapiens
ugcuauuuucuuauccuuug

SEQ ID NO: 2069602 - RNA, 11 nt, Homo sapiens
aagaaaugcaa

SEQ ID NO: 2069603 - RNA, 14 nt, Homo sapiens
gagaugcugggcca

SEQ ID NO: 2069604 - RNA, 21 nt, Homo sapiens
cuggccagacucgauguguac

SEQ ID NO: 2069605 - RNA, 12 nt, Homo sapiens
ccuuugaucucg

SEQ ID NO: 2069606 - RNA, 16 nt, Homo sapiens
uguacuugugguucuc

SEQ ID NO: 2069607 - RNA, 15 nt, Homo sapiens
uucaccucacugaaa

SEQ ID NO: 2069608 - RNA, 17 nt, Homo sapiens
ccagcccuggugcugua

SEQ ID NO: 2069609 - RNA, 20 nt, Homo sapiens
cuggccccgggcucuggcca

SEQ ID NO: 2069610 - RNA, 13 nt, Homo sapiens
aacugcaggugac

SEQ ID NO: 2069611 - RNA, 11 nt, Homo sapiens
cccagugccua

SEQ ID NO: 2069612 - RNA, 19 nt, Homo sapiens
auuuuuaucccaggaaaua

SEQ ID NO: 2069613 - RNA, 17 nt, Homo sapiens
ccucuugccauccugau

SEQ ID NO: 2069614 - RNA, 13 nt, Homo sapiens
cggcuccugaugg

SEQ ID NO: 2069615 - RNA, 18 nt, Homo sapiens
cugucccaccccuaccuc

SEQ ID NO: 2069616 - RNA, 22 nt, Homo sapiens
acgcaagggagaagaaauccau

SEQ ID NO: 2069617 - RNA, 23 nt, Homo sapiens
gagacacagcccccacggacaaa

SEQ ID NO: 2069618 - RNA, 19 nt, Homo sapiens
gaggcaugugaugugcaag

SEQ ID NO: 2069619 - RNA, 11 nt, Homo sapiens
aagucuugaca

SEQ ID NO: 2069620 - RNA, 20 nt, Homo sapiens
auuuuugcaggugcuuuuau

SEQ ID NO: 2069621 - RNA, 20 nt, Homo sapiens
uuuucagacuucaucuucaa

SEQ ID NO: 2069622 - RNA, 23 nt, Homo sapiens
ugauugagaagaggacauuggag

SEQ ID NO: 2069623 - RNA, 20 nt, Homo sapiens
cuguacauacucaguaaaau

SEQ ID NO: 2069624 - RNA, 16 nt, Homo sapiens
cuacugcaagagccaa

SEQ ID NO: 2069625 - RNA, 21 nt, Homo sapiens
aaggaugguuuuaucuucccu

SEQ ID NO: 2069626 - RNA, 15 nt, Homo sapiens
acaggucuucucucc

SEQ ID NO: 2069627 - RNA, 13 nt, Homo sapiens
accaaggucuuca

SEQ ID NO: 2069628 - RNA, 14 nt, Homo sapiens
acaccugccuucaa

SEQ ID NO: 2069629 - RNA, 16 nt, Homo sapiens
aaccaaggacugagca

SEQ ID NO: 2069630 - RNA, 23 nt, Homo sapiens
acuuuaauuuccuugacuguaaa

SEQ ID NO: 2069631 - RNA, 19 nt, Homo sapiens
uguuuucucagaacagcug

SEQ ID NO: 2069632 - RNA, 14 nt, Homo sapiens
uuaauacauucacc

SEQ ID NO: 2069633 - RNA, 17 nt, Homo sapiens
caugagauagcuauuau

SEQ ID NO: 2069634 - RNA, 23 nt, Homo sapiens
aacaaacuggcugcuuuguucaa

SEQ ID NO: 2069635 - RNA, 19 nt, Homo sapiens
gccuugcuuggcccaucca

SEQ ID NO: 2069636 - RNA, 13 nt, Homo sapiens
cuuaaacaguauu

SEQ ID NO: 2069637 - RNA, 13 nt, Homo sapiens
gcgggccaugagg

SEQ ID NO: 2069638 - RNA, 22 nt, Homo sapiens
auuaaaguucuaggcauacuuu

SEQ ID NO: 2069639 - RNA, 16 nt, Homo sapiens
uuaaucaucaaaaaga

SEQ ID NO: 2069640 - RNA, 22 nt, Homo sapiens
cuggaaauuccaggaaccaaaa

SEQ ID NO: 2069641 - RNA, 15 nt, Homo sapiens
gaagcugcauaugau

SEQ ID NO: 2069642 - RNA, 19 nt, Homo sapiens
gcugcugagggucugggau

SEQ ID NO: 2069643 - RNA, 18 nt, Homo sapiens
aacauaaugcacuuuaga

SEQ ID NO: 2069644 - RNA, 19 nt, Homo sapiens
caccuuuggugcuuuccag

SEQ ID NO: 2069645 - RNA, 20 nt, Homo sapiens
aaagucaaacuuucaccuca

SEQ ID NO: 2069646 - RNA, 22 nt, Homo sapiens
uguauccuggcaaauaauacua

SEQ ID NO: 2069647 - RNA, 18 nt, Homo sapiens
aggcugaaaagugcuuug

SEQ ID NO: 2069648 - RNA, 22 nt, Homo sapiens
ccuuugggccucugcuucucuc

SEQ ID NO: 2069649 - RNA, 21 nt, Homo sapiens
cccuggaugugaagcucacac

SEQ ID NO: 2069650 - RNA, 10 nt, Homo sapiens
gaaacauuca

SEQ ID NO: 2069651 - RNA, 20 nt, Homo sapiens
caaaugagccauccccaggg

SEQ ID NO: 2069652 - RNA, 22 nt, Homo sapiens
augcuguucagaaauaugaaaa

SEQ ID NO: 2069653 - RNA, 16 nt, Homo sapiens
caagauaaacacuuuc

SEQ ID NO: 2069654 - RNA, 23 nt, Homo sapiens
ccaauaaagugacccugcucuca

SEQ ID NO: 2069655 - RNA, 15 nt, Homo sapiens
ccuacccuuggcagu

SEQ ID NO: 2069656 - RNA, 17 nt, Homo sapiens
guugaaaggccucaaga

SEQ ID NO: 2069657 - RNA, 20 nt, Homo sapiens
ccuucaugguguucaugaca

SEQ ID NO: 2069658 - RNA, 23 nt, Homo sapiens
uuggaagacuuggguugaucucu

SEQ ID NO: 2069659 - RNA, 22 nt, Homo sapiens
acucuccuaaaauaaacaugaa

SEQ ID NO: 2069660 - RNA, 19 nt, Homo sapiens
caugcacaguuugcaaucu

SEQ ID NO: 2069661 - RNA, 17 nt, Homo sapiens
auugaggggcaacucca

SEQ ID NO: 2069662 - RNA, 14 nt, Homo sapiens
uacacaacuuugca

SEQ ID NO: 2069663 - RNA, 13 nt, Homo sapiens
gaacccugugcug

SEQ ID NO: 2069664 - RNA, 12 nt, Homo sapiens
ccaacccaugag

SEQ ID NO: 2069665 - RNA, 21 nt, Homo sapiens
ggaagacuuugugacugucac

SEQ ID NO: 2069666 - RNA, 18 nt, Homo sapiens
cucccagcuguaccggcc

SEQ ID NO: 2069667 - RNA, 17 nt, Homo sapiens
uucaaugcuuccuccuu

SEQ ID NO: 2069668 - RNA, 19 nt, Homo sapiens
uguucuugcagucaucaga

SEQ ID NO: 2069669 - RNA, 16 nt, Homo sapiens
auuagcccacugccug

SEQ ID NO: 2069670 - RNA, 17 nt, Homo sapiens
uaccaacccugugcaug

SEQ ID NO: 2069671 - RNA, 20 nt, Homo sapiens
accuuccuuccucuugcagu

SEQ ID NO: 2069672 - RNA, 15 nt, Homo sapiens
ucaagugcaauccau

SEQ ID NO: 2069673 - RNA, 14 nt, Homo sapiens
cuuuaacaagacuu

SEQ ID NO: 2069674 - RNA, 20 nt, Homo sapiens
agaaagugggugagaugcug

SEQ ID NO: 2069675 - RNA, 17 nt, Homo sapiens
cuccauuucuacugugu

SEQ ID NO: 2069676 - RNA, 16 nt, Homo sapiens
cagcuggucuucagca

SEQ ID NO: 2069677 - RNA, 14 nt, Homo sapiens
auagcaaaacuaaa

SEQ ID NO: 2069678 - RNA, 22 nt, Homo sapiens
aaucuggaccccaucugugaau

SEQ ID NO: 2069679 - RNA, 18 nt, Homo sapiens
gccuucucuguucauuuc

SEQ ID NO: 2069680 - RNA, 20 nt, Homo sapiens
ugggaauguauuauucugca

SEQ ID NO: 2069681 - RNA, 19 nt, Homo sapiens
gaaagcugacaucuguaaa

SEQ ID NO: 2069682 - RNA, 19 nt, Homo sapiens
ugcccccuccacagcugug

SEQ ID NO: 2069683 - RNA, 20 nt, Homo sapiens
cagcuuuagcaaagaacucu

SEQ ID NO: 2069684 - RNA, 14 nt, Homo sapiens
uugcaaaauggaga

SEQ ID NO: 2069685 - RNA, 15 nt, Homo sapiens
guauaugauucucuu

SEQ ID NO: 2069686 - RNA, 13 nt, Homo sapiens
ccugcagaguaua

SEQ ID NO: 2069687 - RNA, 21 nt, Homo sapiens
caggccuuucuggccugcuau

SEQ ID NO: 2069688 - RNA, 18 nt, Homo sapiens
cuguuaccagagccucuu

SEQ ID NO: 2069689 - RNA, 18 nt, Homo sapiens
aaaggauuaauugcugca

SEQ ID NO: 2069690 - RNA, 16 nt, Homo sapiens
agcuaguauaacuuua

SEQ ID NO: 2069691 - RNA, 16 nt, Homo sapiens
caauuggcacuaaaga

SEQ ID NO: 2069692 - RNA, 16 nt, Homo sapiens
cuauucuccugccaug

SEQ ID NO: 2069693 - RNA, 16 nt, Homo sapiens
uagacaaagagccaga

SEQ ID NO: 2069694 - RNA, 21 nt, Homo sapiens
cagcacugaaauauccuaacc

SEQ ID NO: 2069695 - RNA, 16 nt, Homo sapiens
uuugaaaaacuccuuc

SEQ ID NO: 2069696 - RNA, 15 nt, Homo sapiens
uuacaacagugagaa

SEQ ID NO: 2069697 - RNA, 16 nt, Homo sapiens
ccaccugacacaccag

SEQ ID NO: 2069698 - RNA, 17 nt, Homo sapiens
acgccuuguucuuggcc

SEQ ID NO: 2069699 - RNA, 16 nt, Homo sapiens
acacacucaaaucaag

SEQ ID NO: 2069700 - RNA, 18 nt, Homo sapiens
agcacaaucacuaaacuu

SEQ ID NO: 2069701 - RNA, 18 nt, Homo sapiens
gcaccuuaccaacuuucu

SEQ ID NO: 2069702 - RNA, 18 nt, Homo sapiens
cucccugacccacugugc

SEQ ID NO: 2069703 - RNA, 15 nt, Homo sapiens
gucaauccugucaua

SEQ ID NO: 2069704 - RNA, 20 nt, Homo sapiens
ucauaaaccaauguggcaag

SEQ ID NO: 2069705 - RNA, 15 nt, Homo sapiens
guauauaugaaugaa

SEQ ID NO: 2069706 - RNA, 17 nt, Homo sapiens
aaaccagaacccagugu

SEQ ID NO: 2069707 - RNA, 12 nt, Homo sapiens
gucaugccaaaa

SEQ ID NO: 2069708 - RNA, 14 nt, Homo sapiens
cuucuacuuaucau

SEQ ID NO: 2069709 - RNA, 10 nt, Homo sapiens
aaaaauacuu

SEQ ID NO: 2069710 - RNA, 19 nt, Homo sapiens
aaccaaucauuuuaagaag

SEQ ID NO: 2069711 - RNA, 14 nt, Homo sapiens
augggauggcaaau

SEQ ID NO: 2069712 - RNA, 19 nt, Homo sapiens
ggaggaucgccugagccca

SEQ ID NO: 2069713 - RNA, 10 nt, Homo sapiens
agugcacaga

SEQ ID NO: 2069714 - RNA, 17 nt, Homo sapiens
ugcacuaaaaguaguau

SEQ ID NO: 2069715 - RNA, 11 nt, Homo sapiens
aagauuccaaa

SEQ ID NO: 2069716 - RNA, 20 nt, Homo sapiens
cagccccuuauuugcacuuc

SEQ ID NO: 2069717 - RNA, 15 nt, Homo sapiens
aaugggacucugaga

SEQ ID NO: 2069718 - RNA, 15 nt, Homo sapiens
auacucuucaaggac

SEQ ID NO: 2069719 - RNA, 22 nt, Homo sapiens
aaaccauggucucucugcuugc

SEQ ID NO: 2069720 - RNA, 17 nt, Homo sapiens
ugugagagccugugauc

SEQ ID NO: 2069721 - RNA, 13 nt, Homo sapiens
uaucuauuuuccu

SEQ ID NO: 2069722 - RNA, 15 nt, Homo sapiens
acugccuggauucca

SEQ ID NO: 2069723 - RNA, 20 nt, Homo sapiens
augcaucuggcucaccgggu

SEQ ID NO: 2069724 - RNA, 12 nt, Homo sapiens
gcucuaaugcca

SEQ ID NO: 2069725 - RNA, 21 nt, Homo sapiens
aauaaacacuggugccaacca

SEQ ID NO: 2069726 - RNA, 15 nt, Homo sapiens
uuuacuuaucucuca

SEQ ID NO: 2069727 - RNA, 22 nt, Homo sapiens
agaggggugggauccacacuga

SEQ ID NO: 2069728 - RNA, 17 nt, Homo sapiens
ccucccugccugcuccu

SEQ ID NO: 2069729 - RNA, 16 nt, Homo sapiens
ccagggcugcccugag

SEQ ID NO: 2069730 - RNA, 14 nt, Homo sapiens
uaguacuaagcuua

SEQ ID NO: 2069731 - RNA, 18 nt, Homo sapiens
auuuuacauguggcccaa

SEQ ID NO: 2069732 - RNA, 18 nt, Homo sapiens
ucugaggcuuccagagag

SEQ ID NO: 2069733 - RNA, 22 nt, Homo sapiens
cucauccuccaggaacugcagg

SEQ ID NO: 2069734 - RNA, 21 nt, Homo sapiens
aauuucauaccuaucaucuua

SEQ ID NO: 2069735 - RNA, 13 nt, Homo sapiens
uuaaagaaaugaa

SEQ ID NO: 2069736 - RNA, 19 nt, Homo sapiens
uacaugaaauaaugcacug

SEQ ID NO: 2069737 - RNA, 18 nt, Homo sapiens
uccuugggaugaucuuga

SEQ ID NO: 2069738 - RNA, 17 nt, Homo sapiens
agcauuugaugauagca

SEQ ID NO: 2069739 - RNA, 22 nt, Homo sapiens
gccuucgcauggcuggccuucc

SEQ ID NO: 2069740 - RNA, 20 nt, Homo sapiens
uguauuuuggucauauugcc

SEQ ID NO: 2069741 - RNA, 12 nt, Homo sapiens
uaguccaaaaag

SEQ ID NO: 2069742 - RNA, 21 nt, Homo sapiens
aauuccguguuuucgcuuuuu

SEQ ID NO: 2069743 - RNA, 14 nt, Homo sapiens
aucucguauaauau

SEQ ID NO: 2069744 - RNA, 13 nt, Homo sapiens
agagaaggccugg

SEQ ID NO: 2069745 - RNA, 13 nt, Homo sapiens
acuguuugcccca

SEQ ID NO: 2069746 - RNA, 18 nt, Homo sapiens
ggcucccggggcagggca

SEQ ID NO: 2069747 - RNA, 15 nt, Homo sapiens
uuggaaaccaugcac

SEQ ID NO: 2069748 - RNA, 14 nt, Homo sapiens
cuacagaugaguca

SEQ ID NO: 2069749 - RNA, 14 nt, Homo sapiens
ugguaccuccuagg

SEQ ID NO: 2069750 - RNA, 14 nt, Homo sapiens
caacagauguguca

SEQ ID NO: 2069751 - RNA, 10 nt, Homo sapiens
ugcugcuaug

SEQ ID NO: 2069752 - RNA, 21 nt, Homo sapiens
agucuagccuggacaacacag

SEQ ID NO: 2069753 - RNA, 19 nt, Homo sapiens
aagcagcucauuugugaca

SEQ ID NO: 2069754 - RNA, 23 nt, Homo sapiens
uucaauaaaagaauaguugccaa

SEQ ID NO: 2069755 - RNA, 13 nt, Homo sapiens
aggaaacaauaua

SEQ ID NO: 2069756 - RNA, 15 nt, Homo sapiens
acuuguacccacagg

SEQ ID NO: 2069757 - RNA, 18 nt, Homo sapiens
ugccauagcugacuacaa

SEQ ID NO: 2069758 - RNA, 21 nt, Homo sapiens
ucuuagugcaaaaaacauacu

SEQ ID NO: 2069759 - RNA, 21 nt, Homo sapiens
aguaaaauacuauugccucau

SEQ ID NO: 2069760 - RNA, 11 nt, Homo sapiens
auuauggcauu

SEQ ID NO: 2069761 - RNA, 19 nt, Homo sapiens
cccuucaaugcaaaauaca

SEQ ID NO: 2069762 - RNA, 19 nt, Homo sapiens
uaaagcuguucucauuccu

SEQ ID NO: 2069763 - RNA, 18 nt, Homo sapiens
gcugagguuccucugccu

SEQ ID NO: 2069764 - RNA, 18 nt, Homo sapiens
cuaaaguugcuccauaca

SEQ ID NO: 2069765 - RNA, 15 nt, Homo sapiens
cugcccuaaacccug

SEQ ID NO: 2069766 - RNA, 17 nt, Homo sapiens
uuaaacuaacaauucaa

SEQ ID NO: 2069767 - RNA, 16 nt, Homo sapiens
aaauuuuuauuacuua

SEQ ID NO: 2069768 - RNA, 15 nt, Homo sapiens
ccauaaaaggugugu

SEQ ID NO: 2069769 - RNA, 22 nt, Homo sapiens
auguuuucagugcugugucauu

SEQ ID NO: 2069770 - RNA, 23 nt, Homo sapiens
cuucaggggagcccggagcuuug

SEQ ID NO: 2069771 - RNA, 20 nt, Homo sapiens
gaaagauuugugaacuggaa

SEQ ID NO: 2069772 - RNA, 19 nt, Homo sapiens
cugagggugcuuuguguaa

SEQ ID NO: 2069773 - RNA, 23 nt, Homo sapiens
uuaccugguagaucaagcauuac

SEQ ID NO: 2069774 - RNA, 16 nt, Homo sapiens
ugggcuuccucccaga

SEQ ID NO: 2069775 - RNA, 19 nt, Homo sapiens
acuuucccuagaaagccau

SEQ ID NO: 2069776 - RNA, 20 nt, Homo sapiens
agacuuuucucuagaagcug

SEQ ID NO: 2069777 - RNA, 14 nt, Homo sapiens
aauuugaauguggu

SEQ ID NO: 2069778 - RNA, 13 nt, Homo sapiens
cauuauccuugcu

SEQ ID NO: 2069779 - RNA, 23 nt, Homo sapiens
auucagagacugcccuucucacg

SEQ ID NO: 2069780 - RNA, 18 nt, Homo sapiens
cucauguuuuuaaagggc

SEQ ID NO: 2069781 - RNA, 18 nt, Homo sapiens
guuuaaacccaagugcug

SEQ ID NO: 2069782 - RNA, 17 nt, Homo sapiens
caaaagaaaauuuucca

SEQ ID NO: 2069783 - RNA, 16 nt, Homo sapiens
cagaccuaaugcuccu

SEQ ID NO: 2069784 - RNA, 16 nt, Homo sapiens
caucuauuauuacaca

SEQ ID NO: 2069785 - RNA, 17 nt, Homo sapiens
caucagcccaucucaac

SEQ ID NO: 2069786 - RNA, 19 nt, Homo sapiens
agacgcucauucagcaucu

SEQ ID NO: 2069787 - RNA, 19 nt, Homo sapiens
augguggggcaugccugua

SEQ ID NO: 2069788 - RNA, 23 nt, Homo sapiens
auggcaggaucucagaucacugc

SEQ ID NO: 2069789 - RNA, 15 nt, Homo sapiens
acauuccacagugcc

SEQ ID NO: 2069790 - RNA, 16 nt, Homo sapiens
uggcccgcacgugucc

SEQ ID NO: 2069791 - RNA, 18 nt, Homo sapiens
ucaaaugcaguccaguga

SEQ ID NO: 2069792 - RNA, 14 nt, Homo sapiens
ucccccugugaaag

SEQ ID NO: 2069793 - RNA, 23 nt, Homo sapiens
uuccuuuaaaacauaagcuaccu

SEQ ID NO: 2069794 - RNA, 14 nt, Homo sapiens
uucugggugcagcu

SEQ ID NO: 2069795 - RNA, 13 nt, Homo sapiens
caaugaccuguau

SEQ ID NO: 2069796 - RNA, 10 nt, Homo sapiens
aagcaguuua

SEQ ID NO: 2069797 - RNA, 17 nt, Homo sapiens
auguuucacugugcaaa

SEQ ID NO: 2069798 - RNA, 18 nt, Homo sapiens
ccaagguaaacaguuuga

SEQ ID NO: 2069799 - RNA, 17 nt, Homo sapiens
ucuguggugcagugugu

SEQ ID NO: 2069800 - RNA, 17 nt, Homo sapiens
gcucuggggcacuguug

SEQ ID NO: 2069801 - RNA, 19 nt, Homo sapiens
uuaagauccacaaaugaag

SEQ ID NO: 2069802 - RNA, 15 nt, Homo sapiens
uguaauaagcaauca

SEQ ID NO: 2069803 - RNA, 24 nt, Homo sapiens
uccuuuugaccaaauaaaguacca

SEQ ID NO: 2069804 - RNA, 19 nt, Homo sapiens
aggggcagcuccugaccaa

SEQ ID NO: 2069805 - RNA, 17 nt, Homo sapiens
cugaggacacucagugu

SEQ ID NO: 2069806 - RNA, 15 nt, Homo sapiens
ucuauaacaguuuug

SEQ ID NO: 2069807 - RNA, 11 nt, Homo sapiens
gaacacuguga

SEQ ID NO: 2069808 - RNA, 17 nt, Homo sapiens
agagccaccccaugagc

SEQ ID NO: 2069809 - RNA, 15 nt, Homo sapiens
gcccuauauaccuca

SEQ ID NO: 2069810 - RNA, 18 nt, Homo sapiens
cacucuguaauugcaaaa

SEQ ID NO: 2069811 - RNA, 21 nt, Homo sapiens
uugcaucccugaaacaucuca

SEQ ID NO: 2069812 - RNA, 14 nt, Homo sapiens
caacccaccaucua

SEQ ID NO: 2069813 - RNA, 20 nt, Homo sapiens
cacauaggaaaaugccauga

SEQ ID NO: 2069814 - RNA, 22 nt, Homo sapiens
ggccuccuuggcaaugcauuug

SEQ ID NO: 2069815 - RNA, 21 nt, Homo sapiens
auguccaccaugaacuugaua

SEQ ID NO: 2069816 - RNA, 14 nt, Homo sapiens
caguauuacagugu

SEQ ID NO: 2069817 - RNA, 16 nt, Homo sapiens
ucaacuguugccagga

SEQ ID NO: 2069818 - RNA, 13 nt, Homo sapiens
cauuacauggcug

SEQ ID NO: 2069819 - RNA, 13 nt, Homo sapiens
aaggagacaccaa

SEQ ID NO: 2069820 - RNA, 13 nt, Homo sapiens
ugaugcaugagcu

SEQ ID NO: 2069821 - RNA, 19 nt, Homo sapiens
uggugaaaccucaucucua

SEQ ID NO: 2069822 - RNA, 15 nt, Homo sapiens
aacaccuggcauucu

SEQ ID NO: 2069823 - RNA, 21 nt, Homo sapiens
cagggcauaaagcauguuuca

SEQ ID NO: 2069824 - RNA, 15 nt, Homo sapiens
uuuguugccaugugc

SEQ ID NO: 2069825 - RNA, 18 nt, Homo sapiens
aaaacagagaugugauaa

SEQ ID NO: 2069826 - RNA, 21 nt, Homo sapiens
uggggagaccucuacugccuu

SEQ ID NO: 2069827 - RNA, 14 nt, Homo sapiens
uugaucaugcugca

SEQ ID NO: 2069828 - RNA, 19 nt, Homo sapiens
uuccugaaauaaacacugg

SEQ ID NO: 2069829 - RNA, 16 nt, Homo sapiens
gaaaugugucuugucu

SEQ ID NO: 2069830 - RNA, 15 nt, Homo sapiens
ugaucgugccuauaa

SEQ ID NO: 2069831 - RNA, 19 nt, Homo sapiens
cucacauccauucuucccu

SEQ ID NO: 2069832 - RNA, 12 nt, Homo sapiens
uugacucaaaaa

SEQ ID NO: 2069833 - RNA, 15 nt, Homo sapiens
auuucugaacaaaga

SEQ ID NO: 2069834 - RNA, 17 nt, Homo sapiens
gaggacuuggcaagggc

SEQ ID NO: 2069835 - RNA, 12 nt, Homo sapiens
cacaauucacua

SEQ ID NO: 2069836 - RNA, 16 nt, Homo sapiens
aaagcugagccugcag

SEQ ID NO: 2069837 - RNA, 21 nt, Homo sapiens
gaaaaugaagcccuauuacuu

SEQ ID NO: 2069838 - RNA, 20 nt, Homo sapiens
gacacuauuuaucugugcaa

SEQ ID NO: 2069839 - RNA, 21 nt, Homo sapiens
aucuucaauuuauuacugaaa

SEQ ID NO: 2069840 - RNA, 12 nt, Homo sapiens
ucuacacuguau

SEQ ID NO: 2069841 - RNA, 16 nt, Homo sapiens
caaauguuacauagug

SEQ ID NO: 2069842 - RNA, 11 nt, Homo sapiens
aauuuuuccau

SEQ ID NO: 2069843 - RNA, 11 nt, Homo sapiens
aaauuuuccaa

SEQ ID NO: 2069844 - RNA, 21 nt, Homo sapiens
cuggcucccccacaccuccca

SEQ ID NO: 2069845 - RNA, 15 nt, Homo sapiens
cuaacaaaaagcaau

SEQ ID NO: 2069846 - RNA, 12 nt, Homo sapiens
aaauuacuuauu

SEQ ID NO: 2069847 - RNA, 14 nt, Homo sapiens
caaaaauauuccau

SEQ ID NO: 2069848 - RNA, 20 nt, Homo sapiens
aucaauuucuaauguuuacu

SEQ ID NO: 2069849 - RNA, 18 nt, Homo sapiens
cuuuacaaaaguauuauc

SEQ ID NO: 2069850 - RNA, 18 nt, Homo sapiens
cugagcccccagcuucca

SEQ ID NO: 2069851 - RNA, 15 nt, Homo sapiens
uuugcaguucaccug

SEQ ID NO: 2069852 - RNA, 14 nt, Homo sapiens
acuugauugucucc

SEQ ID NO: 2069853 - RNA, 14 nt, Homo sapiens
cugucaacuuguau

SEQ ID NO: 2069854 - RNA, 14 nt, Homo sapiens
cuuacuacuuuaaa

SEQ ID NO: 2069855 - RNA, 20 nt, Homo sapiens
ggcuggugugguacagagaa

SEQ ID NO: 2069856 - RNA, 13 nt, Homo sapiens
uugaaauccagaa

SEQ ID NO: 2069857 - RNA, 17 nt, Homo sapiens
cuggaauucagaugcaa

SEQ ID NO: 2069858 - RNA, 14 nt, Homo sapiens
aaaaugugccuccc

SEQ ID NO: 2069859 - RNA, 22 nt, Homo sapiens
gugcucggcuguaaacagcucu

SEQ ID NO: 2069860 - RNA, 19 nt, Homo sapiens
gcccuucccccugcaaaaa

SEQ ID NO: 2069861 - RNA, 20 nt, Homo sapiens
ccauaccucgaacaucaguu

SEQ ID NO: 2069862 - RNA, 23 nt, Homo sapiens
uuacagaaaauuugcaacauaua

SEQ ID NO: 2069863 - RNA, 18 nt, Homo sapiens
ggaaauuuuucagacuuu

SEQ ID NO: 2069864 - RNA, 20 nt, Homo sapiens
uucaaaaaagucaacaaacu

SEQ ID NO: 2069865 - RNA, 17 nt, Homo sapiens
gaaguagcaaugacaau

SEQ ID NO: 2069866 - RNA, 14 nt, Homo sapiens
ugcguggcucuccu

SEQ ID NO: 2069867 - RNA, 16 nt, Homo sapiens
ugaaauugguuuucca

SEQ ID NO: 2069868 - RNA, 16 nt, Homo sapiens
acauccacaaaacccu

SEQ ID NO: 2069869 - RNA, 18 nt, Homo sapiens
cgugggcaaacaggcagu

SEQ ID NO: 2069870 - RNA, 18 nt, Homo sapiens
auuaagaagcucagcuau

SEQ ID NO: 2069871 - RNA, 14 nt, Homo sapiens
acacaacuuugcaa

SEQ ID NO: 2069872 - RNA, 18 nt, Homo sapiens
gcucugcgucgguccugg

SEQ ID NO: 2069873 - RNA, 14 nt, Homo sapiens
cuuaaccacuuuca

SEQ ID NO: 2069874 - RNA, 16 nt, Homo sapiens
ucugaaaugaccucaa

SEQ ID NO: 2069875 - RNA, 13 nt, Homo sapiens
cuucagaauuaga

SEQ ID NO: 2069876 - RNA, 20 nt, Homo sapiens
gcuacgaaaugcuugcucag

SEQ ID NO: 2069877 - RNA, 22 nt, Homo sapiens
cugggguuguucacaccacagg

SEQ ID NO: 2069878 - RNA, 14 nt, Homo sapiens
guugccacaucaca

SEQ ID NO: 2069879 - RNA, 19 nt, Homo sapiens
uggagcagaaauucaccuc

SEQ ID NO: 2069880 - RNA, 15 nt, Homo sapiens
acacaccaaguggag

SEQ ID NO: 2069881 - RNA, 22 nt, Homo sapiens
gggaggaggcauucuugaacug

SEQ ID NO: 2069882 - RNA, 22 nt, Homo sapiens
ggcucccacugccccugcaccu

SEQ ID NO: 2069883 - RNA, 23 nt, Homo sapiens
cuuuucaaggaaaaaugcugcuu

SEQ ID NO: 2069884 - RNA, 13 nt, Homo sapiens
uuacaauugugag

SEQ ID NO: 2069885 - RNA, 19 nt, Homo sapiens
aacaaaagcgacccauuca

SEQ ID NO: 2069886 - RNA, 15 nt, Homo sapiens
aacauaguaacgugu

SEQ ID NO: 2069887 - RNA, 19 nt, Homo sapiens
ucugccuauaaauuuacuc

SEQ ID NO: 2069888 - RNA, 19 nt, Homo sapiens
agaccaaagcauugccugc

SEQ ID NO: 2069889 - RNA, 22 nt, Homo sapiens
aggaaagccaaauuuuauuaaa

SEQ ID NO: 2069890 - RNA, 18 nt, Homo sapiens
ugcccaaucugagcaaac

SEQ ID NO: 2069891 - RNA, 15 nt, Homo sapiens
aguugcaacuuugua

SEQ ID NO: 2069892 - RNA, 20 nt, Homo sapiens
auaguauuucagcugcaaua

SEQ ID NO: 2069893 - RNA, 16 nt, Homo sapiens
aguguaacuaugcugu

SEQ ID NO: 2069894 - RNA, 17 nt, Homo sapiens
uggacacuggugccaug

SEQ ID NO: 2069895 - RNA, 13 nt, Homo sapiens
cacacaccacaca

SEQ ID NO: 2069896 - RNA, 15 nt, Homo sapiens
cccaauaaaggcagc

SEQ ID NO: 2069897 - RNA, 20 nt, Homo sapiens
cuuuagaguagaguuuggaa

SEQ ID NO: 2069898 - RNA, 16 nt, Homo sapiens
uucauagcauccugau

SEQ ID NO: 2069899 - RNA, 15 nt, Homo sapiens
cagucaucaggugug

SEQ ID NO: 2069900 - RNA, 18 nt, Homo sapiens
ugacucagugcagggaca

SEQ ID NO: 2069901 - RNA, 17 nt, Homo sapiens
aagcagaucaucuccaa

SEQ ID NO: 2069902 - RNA, 17 nt, Homo sapiens
ccccacacuccauggag

SEQ ID NO: 2069903 - RNA, 15 nt, Homo sapiens
ucaggcuagcugugc

SEQ ID NO: 2069904 - RNA, 22 nt, Homo sapiens
uugaacuccugaccucagguga

SEQ ID NO: 2069905 - RNA, 15 nt, Homo sapiens
ggcuggagugcaaug

SEQ ID NO: 2069906 - RNA, 17 nt, Homo sapiens
gagcaggggcaggguga

SEQ ID NO: 2069907 - RNA, 19 nt, Homo sapiens
ucucuuaaucacuacugua

SEQ ID NO: 2069908 - RNA, 17 nt, Homo sapiens
uggagcuagcaaagacu

SEQ ID NO: 2069909 - RNA, 12 nt, Homo sapiens
acugucacuguu

SEQ ID NO: 2069910 - RNA, 17 nt, Homo sapiens
ccucaggccagugccag

SEQ ID NO: 2069911 - RNA, 15 nt, Homo sapiens
ccucccccaugggcu

SEQ ID NO: 2069912 - RNA, 22 nt, Homo sapiens
agaguggaaccaacacuaacau

SEQ ID NO: 2069913 - RNA, 14 nt, Homo sapiens
uacgggggcuguga

SEQ ID NO: 2069914 - RNA, 16 nt, Homo sapiens
gaaaagggauggagcu

SEQ ID NO: 2069915 - RNA, 19 nt, Homo sapiens
acacccagcccagcuugcc

SEQ ID NO: 2069916 - RNA, 21 nt, Homo sapiens
gaaucucaauguacauagacc

SEQ ID NO: 2069917 - RNA, 23 nt, Homo sapiens
auauugaaauuuauuuaauguga

SEQ ID NO: 2069918 - RNA, 13 nt, Homo sapiens
cuacccacgugcc

SEQ ID NO: 2069919 - RNA, 21 nt, Homo sapiens
ucuuucaguggcuaccuacau

SEQ ID NO: 2069920 - RNA, 19 nt, Homo sapiens
cccagggcuccugcacuua

SEQ ID NO: 2069921 - RNA, 17 nt, Homo sapiens
ucaaggccuucaguuua

SEQ ID NO: 2069922 - RNA, 16 nt, Homo sapiens
cuagagcuacaggggu

SEQ ID NO: 2069923 - RNA, 23 nt, Homo sapiens
gcaggcaagugggauaaaggccc

SEQ ID NO: 2069924 - RNA, 13 nt, Homo sapiens
cuuugggcuguga

SEQ ID NO: 2069925 - RNA, 20 nt, Homo sapiens
cucuuccaaaggcauaagac

SEQ ID NO: 2069926 - RNA, 20 nt, Homo sapiens
aacugaaaaccagucuucuc

SEQ ID NO: 2069927 - RNA, 22 nt, Homo sapiens
ccaggugcuaggaacacuccuu

SEQ ID NO: 2069928 - RNA, 15 nt, Homo sapiens
ggaccccucagcucc

SEQ ID NO: 2069929 - RNA, 15 nt, Homo sapiens
gccauguuuccucuu

SEQ ID NO: 2069930 - RNA, 18 nt, Homo sapiens
cuuugccuuggcuuugcc

SEQ ID NO: 2069931 - RNA, 20 nt, Homo sapiens
aauugccuauaauacuugca

SEQ ID NO: 2069932 - RNA, 17 nt, Homo sapiens
agugaccccagccuccu

SEQ ID NO: 2069933 - RNA, 16 nt, Homo sapiens
aagaaaacaucacuga

SEQ ID NO: 2069934 - RNA, 21 nt, Homo sapiens
uccagcggcucacaaagaaua

SEQ ID NO: 2069935 - RNA, 16 nt, Homo sapiens
guucuggaacauucug

SEQ ID NO: 2069936 - RNA, 21 nt, Homo sapiens
ugucauauuaagaaacaccug

SEQ ID NO: 2069937 - RNA, 15 nt, Homo sapiens
acauaaugaaugcua

SEQ ID NO: 2069938 - RNA, 16 nt, Homo sapiens
uucucuauagagccaa

SEQ ID NO: 2069939 - RNA, 11 nt, Homo sapiens
aguaugaauga

SEQ ID NO: 2069940 - RNA, 17 nt, Homo sapiens
ccuuccccagacuucuc

SEQ ID NO: 2069941 - RNA, 18 nt, Homo sapiens
guugugauauagaacaaa

SEQ ID NO: 2069942 - RNA, 15 nt, Homo sapiens
uguuuguugagugca

SEQ ID NO: 2069943 - RNA, 23 nt, Homo sapiens
aaggauuuuucuguaacugucac

SEQ ID NO: 2069944 - RNA, 22 nt, Homo sapiens
ugaaaagggguguggcaaagga

SEQ ID NO: 2069945 - RNA, 11 nt, Homo sapiens
acaagcagcug

SEQ ID NO: 2069946 - RNA, 13 nt, Homo sapiens
uggauguuuguca

SEQ ID NO: 2069947 - RNA, 16 nt, Homo sapiens
agcuuaggcauucuaa

SEQ ID NO: 2069948 - RNA, 18 nt, Homo sapiens
aagacguccuggaaugaa

SEQ ID NO: 2069949 - RNA, 18 nt, Homo sapiens
cacuuccccaagaucugc

SEQ ID NO: 2069950 - RNA, 20 nt, Homo sapiens
gucacggcugcgcacugugu

SEQ ID NO: 2069951 - RNA, 15 nt, Homo sapiens
ugugacuguguuugc

SEQ ID NO: 2069952 - RNA, 12 nt, Homo sapiens
ccugcuucacac

SEQ ID NO: 2069953 - RNA, 18 nt, Homo sapiens
aacuagaaagcagagauu

SEQ ID NO: 2069954 - RNA, 19 nt, Homo sapiens
gaggcgggcagaucaccag

SEQ ID NO: 2069955 - RNA, 17 nt, Homo sapiens
agcccuccccaccugcu

SEQ ID NO: 2069956 - RNA, 13 nt, Homo sapiens
cccucugucuuca

SEQ ID NO: 2069957 - RNA, 20 nt, Homo sapiens
gguucagacaccuguucaca

SEQ ID NO: 2069958 - RNA, 17 nt, Homo sapiens
gcauucucuccauuuca

SEQ ID NO: 2069959 - RNA, 14 nt, Homo sapiens
guggcaaaugccag

SEQ ID NO: 2069960 - RNA, 18 nt, Homo sapiens
ccuuaaggccacacuggc

SEQ ID NO: 2069961 - RNA, 14 nt, Homo sapiens
uguugaauaaugcu

SEQ ID NO: 2069962 - RNA, 17 nt, Homo sapiens
cauuuucuucacuugca

SEQ ID NO: 2069963 - RNA, 12 nt, Homo sapiens
aacauacuucua

SEQ ID NO: 2069964 - RNA, 12 nt, Homo sapiens
aauauacuucca

SEQ ID NO: 2069965 - RNA, 19 nt, Homo sapiens
gccugggagaugcagcugg

SEQ ID NO: 2069966 - RNA, 16 nt, Homo sapiens
uuccuaaugugaucau

SEQ ID NO: 2069967 - RNA, 12 nt, Homo sapiens
cccacaaagggg

SEQ ID NO: 2069968 - RNA, 18 nt, Homo sapiens
ccuugagagacccagcug

SEQ ID NO: 2069969 - RNA, 12 nt, Homo sapiens
uauuauuugcua

SEQ ID NO: 2069970 - RNA, 17 nt, Homo sapiens
aaaacugaacuauguaa

SEQ ID NO: 2069971 - RNA, 14 nt, Homo sapiens
aauugguucuucuc

SEQ ID NO: 2069972 - RNA, 17 nt, Homo sapiens
agccaggaaagcagcaa

SEQ ID NO: 2069973 - RNA, 21 nt, Homo sapiens
uuucuggauggcaucuagcca

SEQ ID NO: 2069974 - RNA, 19 nt, Homo sapiens
ccuuggcacccccaugcug

SEQ ID NO: 2069975 - RNA, 21 nt, Homo sapiens
gucuauuugucucuuacaucu

SEQ ID NO: 2069976 - RNA, 17 nt, Homo sapiens
uuugcuagagcuaacag

SEQ ID NO: 2069977 - RNA, 21 nt, Homo sapiens
caaccacuguaaaaugaaauu

SEQ ID NO: 2069978 - RNA, 16 nt, Homo sapiens
auccagccaccaccua

SEQ ID NO: 2069979 - RNA, 19 nt, Homo sapiens
caauucaguuuuaguuuca

SEQ ID NO: 2069980 - RNA, 16 nt, Homo sapiens
ucagcugugccuuccc

SEQ ID NO: 2069981 - RNA, 23 nt, Homo sapiens
aggaggagcaccuccgccagauc

SEQ ID NO: 2069982 - RNA, 14 nt, Homo sapiens
aucaggaugccuua

SEQ ID NO: 2069983 - RNA, 19 nt, Homo sapiens
ggucauuuuuauguuauua

SEQ ID NO: 2069984 - RNA, 19 nt, Homo sapiens
aaugacauucaguauauaa

SEQ ID NO: 2069985 - RNA, 16 nt, Homo sapiens
cauucacacacagccu

SEQ ID NO: 2069986 - RNA, 11 nt, Homo sapiens
uccaccucuac

SEQ ID NO: 2069987 - RNA, 11 nt, Homo sapiens
accaccucaac

SEQ ID NO: 2069988 - RNA, 18 nt, Homo sapiens
aacuuuggguacuuauac

SEQ ID NO: 2069989 - RNA, 13 nt, Homo sapiens
aguagccauucua

SEQ ID NO: 2069990 - RNA, 13 nt, Homo sapiens
cacuugguguacu

SEQ ID NO: 2069991 - RNA, 23 nt, Homo sapiens
aguauuuggaauuagaacccuug

SEQ ID NO: 2069992 - RNA, 15 nt, Homo sapiens
cuguucuugcugcua

SEQ ID NO: 2069993 - RNA, 17 nt, Homo sapiens
cucagcacucugcagug

SEQ ID NO: 2069994 - RNA, 21 nt, Homo sapiens
cuggaacaugcuuuuacuuua

SEQ ID NO: 2069995 - RNA, 18 nt, Homo sapiens
cugaauuaucuauuucau

SEQ ID NO: 2069996 - RNA, 22 nt, Homo sapiens
guaagguguguacucagggcau

SEQ ID NO: 2069997 - RNA, 15 nt, Homo sapiens
uugucauagcagcaa

SEQ ID NO: 2069998 - RNA, 22 nt, Homo sapiens
auacucacguuugcuuaaaccc

SEQ ID NO: 2069999 - RNA, 19 nt, Homo sapiens
agcacuaaggugugcucug

SEQ ID NO: 2070000 - RNA, 17 nt, Homo sapiens
agcauuucccccaggga

SEQ ID NO: 2070001 - RNA, 23 nt, Homo sapiens
accaauuugguaaaaaugcugcu

SEQ ID NO: 2070002 - RNA, 21 nt, Homo sapiens
ucagacuaggauaauguccaa

SEQ ID NO: 2070003 - RNA, 20 nt, Homo sapiens
uuuuucuucaugccugauga

SEQ ID NO: 2070004 - RNA, 14 nt, Homo sapiens
cauggugcaauuug

SEQ ID NO: 2070005 - RNA, 20 nt, Homo sapiens
uccucucaucccaguccuga

SEQ ID NO: 2070006 - RNA, 16 nt, Homo sapiens
ccacuagcauuuucuc

SEQ ID NO: 2070007 - RNA, 15 nt, Homo sapiens
guugcagucacugug

SEQ ID NO: 2070008 - RNA, 23 nt, Homo sapiens
cccauccccgucugaccaagggc

SEQ ID NO: 2070009 - RNA, 10 nt, Homo sapiens
aaaggccagu

SEQ ID NO: 2070010 - RNA, 20 nt, Homo sapiens
ugaaaaggugauugucacca

SEQ ID NO: 2070011 - RNA, 22 nt, Homo sapiens
guugauaagaguguaacaucca

SEQ ID NO: 2070012 - RNA, 16 nt, Homo sapiens
uccagaauaugcauaa

SEQ ID NO: 2070013 - RNA, 20 nt, Homo sapiens
uuucccacaucuuuccucaa

SEQ ID NO: 2070014 - RNA, 21 nt, Homo sapiens
auccuccuucacucccuguca

SEQ ID NO: 2070015 - RNA, 15 nt, Homo sapiens
cuaccuuuugucucu

SEQ ID NO: 2070016 - RNA, 14 nt, Homo sapiens
gccaacgagacaca

SEQ ID NO: 2070017 - RNA, 19 nt, Homo sapiens
ucaaagaaaaagguccaug

SEQ ID NO: 2070018 - RNA, 23 nt, Homo sapiens
aaccacauaguucguuuaccuuc

SEQ ID NO: 2070019 - RNA, 13 nt, Homo sapiens
aaagccuuaggga

SEQ ID NO: 2070020 - RNA, 20 nt, Homo sapiens
uaaauauuugaaaauuaccu

SEQ ID NO: 2070021 - RNA, 20 nt, Homo sapiens
uuuaaacuacugaacuguua

SEQ ID NO: 2070022 - RNA, 18 nt, Homo sapiens
gacccuggcaucugacac

SEQ ID NO: 2070023 - RNA, 19 nt, Homo sapiens
ucccaaagccagaaccaga

SEQ ID NO: 2070024 - RNA, 11 nt, Homo sapiens
gaaacacugga

SEQ ID NO: 2070025 - RNA, 19 nt, Homo sapiens
aaauccgcuucuccugcag

SEQ ID NO: 2070026 - RNA, 17 nt, Homo sapiens
uugaucgcgguauguca

SEQ ID NO: 2070027 - RNA, 20 nt, Homo sapiens
cugggggccugaccuccccc

SEQ ID NO: 2070028 - RNA, 21 nt, Homo sapiens
uuaaaucacucuucuguaaau

SEQ ID NO: 2070029 - RNA, 15 nt, Homo sapiens
cccucuuccugccaa

SEQ ID NO: 2070030 - RNA, 18 nt, Homo sapiens
cugauguccucaccacau

SEQ ID NO: 2070031 - RNA, 19 nt, Homo sapiens
ugcugcuucuccauggcca

SEQ ID NO: 2070032 - RNA, 13 nt, Homo sapiens
ugggccaguggca

SEQ ID NO: 2070033 - RNA, 21 nt, Homo sapiens
agcagcuucuuuugucuccca

SEQ ID NO: 2070034 - RNA, 16 nt, Homo sapiens
cucgcccaggacuccc

SEQ ID NO: 2070035 - RNA, 23 nt, Homo sapiens
acgacaggcgagagaggagccag

SEQ ID NO: 2070036 - RNA, 22 nt, Homo sapiens
uucagaagccccauuugcacag

SEQ ID NO: 2070037 - RNA, 21 nt, Homo sapiens
aagugaggcauugcacaggga

SEQ ID NO: 2070038 - RNA, 17 nt, Homo sapiens
auucccggcuggacuuu

SEQ ID NO: 2070039 - RNA, 15 nt, Homo sapiens
cagaaaaacaaucuu

SEQ ID NO: 2070040 - RNA, 22 nt, Homo sapiens
aauggggcgcuggacaccuaca

SEQ ID NO: 2070041 - RNA, 22 nt, Homo sapiens
cuggagaaguggguggggacag

SEQ ID NO: 2070042 - RNA, 17 nt, Homo sapiens
aggaaugaagccuuagc

SEQ ID NO: 2070043 - RNA, 17 nt, Homo sapiens
cugaagaaauccuggga

SEQ ID NO: 2070044 - RNA, 15 nt, Homo sapiens
ccucagaggccacuu

SEQ ID NO: 2070045 - RNA, 15 nt, Homo sapiens
augauacugucucuc

SEQ ID NO: 2070046 - RNA, 17 nt, Homo sapiens
agcccuggcuuccaagg

SEQ ID NO: 2070047 - RNA, 22 nt, Homo sapiens
gacuucucuuauucuuuacaaa

SEQ ID NO: 2070048 - RNA, 13 nt, Homo sapiens
uagcccugcauuu

SEQ ID NO: 2070049 - RNA, 13 nt, Homo sapiens
cccagaaaacaca

SEQ ID NO: 2070050 - RNA, 19 nt, Homo sapiens
cuuguguaauuuaugugaa

SEQ ID NO: 2070051 - RNA, 24 nt, Homo sapiens
ggguucugucauguaacacgacau

SEQ ID NO: 2070052 - RNA, 23 nt, Homo sapiens
aaaucugacauauuaugccugaa

SEQ ID NO: 2070053 - RNA, 20 nt, Homo sapiens
aguuuugcuuuaguacaaua

SEQ ID NO: 2070054 - RNA, 16 nt, Homo sapiens
auaguagaaccaguga

SEQ ID NO: 2070055 - RNA, 15 nt, Homo sapiens
agcuguagaacucug

SEQ ID NO: 2070056 - RNA, 23 nt, Homo sapiens
ucauuuauuggcuuaaguaugcu

SEQ ID NO: 2070057 - RNA, 20 nt, Homo sapiens
aaggacugcagccacugauu

SEQ ID NO: 2070058 - RNA, 18 nt, Homo sapiens
aggggcaugacugucgcc

SEQ ID NO: 2070059 - RNA, 17 nt, Homo sapiens
gauuucaguucuaggaa

SEQ ID NO: 2070060 - RNA, 13 nt, Homo sapiens
aagucagagccaa

SEQ ID NO: 2070061 - RNA, 20 nt, Homo sapiens
aacaggaucucaaacuugau

SEQ ID NO: 2070062 - RNA, 18 nt, Homo sapiens
auaaugaaaauuaugaua

SEQ ID NO: 2070063 - RNA, 22 nt, Homo sapiens
acagaggagaugccacuucuca

SEQ ID NO: 2070064 - RNA, 18 nt, Homo sapiens
ggccuucugggaacucuc

SEQ ID NO: 2070065 - RNA, 18 nt, Homo sapiens
augcacuguaauauguac

SEQ ID NO: 2070066 - RNA, 15 nt, Homo sapiens
acuauuuugugcucc

SEQ ID NO: 2070067 - RNA, 17 nt, Homo sapiens
ucuaacagcaccaaauc

SEQ ID NO: 2070068 - RNA, 16 nt, Homo sapiens
gaaacucacacucccc

SEQ ID NO: 2070069 - RNA, 18 nt, Homo sapiens
uguaaugaaaaugaauau

SEQ ID NO: 2070070 - RNA, 22 nt, Homo sapiens
aggaaaacuacugauacuuuca

SEQ ID NO: 2070071 - RNA, 20 nt, Homo sapiens
aacauuucauuaaccaaaga

SEQ ID NO: 2070072 - RNA, 19 nt, Homo sapiens
uugauauugccacccucca

SEQ ID NO: 2070073 - RNA, 19 nt, Homo sapiens
ucuacacauacauguaaaa

SEQ ID NO: 2070074 - RNA, 16 nt, Homo sapiens
aagaguaaaaccaaag

SEQ ID NO: 2070075 - RNA, 20 nt, Homo sapiens
uccacgugauuuccagugag

SEQ ID NO: 2070076 - RNA, 23 nt, Homo sapiens
agcaggaggccaauaaaaaguuc

SEQ ID NO: 2070077 - RNA, 13 nt, Homo sapiens
caagggcaccugg

SEQ ID NO: 2070078 - RNA, 13 nt, Homo sapiens
acuaggcaaaaag

SEQ ID NO: 2070079 - RNA, 19 nt, Homo sapiens
uuguaaugacagugcuaaa

SEQ ID NO: 2070080 - RNA, 18 nt, Homo sapiens
uaacuauauuugcuuuuu

SEQ ID NO: 2070081 - RNA, 23 nt, Homo sapiens
aacaguaguugcaauguuuuaga

SEQ ID NO: 2070082 - RNA, 19 nt, Homo sapiens
acugagagucugcacuuaa

SEQ ID NO: 2070083 - RNA, 13 nt, Homo sapiens
agcugacccaucu

SEQ ID NO: 2070084 - RNA, 13 nt, Homo sapiens
cauuuacagugua

SEQ ID NO: 2070085 - RNA, 20 nt, Homo sapiens
acuucuuucccuuccuccau

SEQ ID NO: 2070086 - RNA, 14 nt, Homo sapiens
uagcccagccuuuu

SEQ ID NO: 2070087 - RNA, 16 nt, Homo sapiens
uuagggagagucauau

SEQ ID NO: 2070088 - RNA, 12 nt, Homo sapiens
cuucccuguuga

SEQ ID NO: 2070089 - RNA, 21 nt, Homo sapiens
uacagguuacaugagagcaau

SEQ ID NO: 2070090 - RNA, 14 nt, Homo sapiens
caagaaggggcucg

SEQ ID NO: 2070091 - RNA, 22 nt, Homo sapiens
auuucaaccagcauucaugccg

SEQ ID NO: 2070092 - RNA, 13 nt, Homo sapiens
agacuccaaaagg

SEQ ID NO: 2070093 - RNA, 20 nt, Homo sapiens
gaggcuucugauacguguau

SEQ ID NO: 2070094 - RNA, 22 nt, Homo sapiens
acaaaggaguaguagcugaauu

SEQ ID NO: 2070095 - RNA, 17 nt, Homo sapiens
ugaggaauaaaugccuu

SEQ ID NO: 2070096 - RNA, 21 nt, Homo sapiens
gcagaacgaugccugcaggca

SEQ ID NO: 2070097 - RNA, 23 nt, Homo sapiens
ucauaauguggugauggcccuaa

SEQ ID NO: 2070098 - RNA, 12 nt, Homo sapiens
gauaugauucaa

SEQ ID NO: 2070099 - RNA, 20 nt, Homo sapiens
agcacuagagaaugcacaga

SEQ ID NO: 2070100 - RNA, 20 nt, Homo sapiens
cuucaugcuugacauaccua

SEQ ID NO: 2070101 - RNA, 21 nt, Homo sapiens
aggacacuagaagauuuugaa

SEQ ID NO: 2070102 - RNA, 22 nt, Homo sapiens
caguggaugccacagcccagcu

SEQ ID NO: 2070103 - RNA, 12 nt, Homo sapiens
ccuuaacacuga

SEQ ID NO: 2070104 - RNA, 13 nt, Homo sapiens
uucaggaagaccg

SEQ ID NO: 2070105 - RNA, 14 nt, Homo sapiens
uugaaaacauacac

SEQ ID NO: 2070106 - RNA, 14 nt, Homo sapiens
caugcacacacaca

SEQ ID NO: 2070107 - RNA, 14 nt, Homo sapiens
cacacacacaugca

SEQ ID NO: 2070108 - RNA, 16 nt, Homo sapiens
caauaacaaagguuac

SEQ ID NO: 2070109 - RNA, 19 nt, Homo sapiens
ucccuggggaaaacuugca

SEQ ID NO: 2070110 - RNA, 13 nt, Homo sapiens
uauuuaguggaac

SEQ ID NO: 2070111 - RNA, 13 nt, Homo sapiens
uguacagugaauu

SEQ ID NO: 2070112 - RNA, 12 nt, Homo sapiens
auggcaguauuu

SEQ ID NO: 2070113 - RNA, 17 nt, Homo sapiens
cauccauauacauauau

SEQ ID NO: 2070114 - RNA, 22 nt, Homo sapiens
ucuuucagcuccugaccaguug

SEQ ID NO: 2070115 - RNA, 12 nt, Homo sapiens
cuaccucuccac

SEQ ID NO: 2070116 - RNA, 20 nt, Homo sapiens
gaugggacacccaacacuuu

SEQ ID NO: 2070117 - RNA, 17 nt, Homo sapiens
ccucccagaaagcaaac

SEQ ID NO: 2070118 - RNA, 13 nt, Homo sapiens
uagaucuuauauu

SEQ ID NO: 2070119 - RNA, 17 nt, Homo sapiens
aaaaugcaacgcuguaa

SEQ ID NO: 2070120 - RNA, 13 nt, Homo sapiens
uuuccaauuucau

SEQ ID NO: 2070121 - RNA, 21 nt, Homo sapiens
aaagcuacgcagacaagaaca

SEQ ID NO: 2070122 - RNA, 17 nt, Homo sapiens
auuugauuuagcauuca

SEQ ID NO: 2070123 - RNA, 17 nt, Homo sapiens
aggaacuagaaagaagg

SEQ ID NO: 2070124 - RNA, 17 nt, Homo sapiens
uuuaaagcacaugccuu

SEQ ID NO: 2070125 - RNA, 21 nt, Homo sapiens
gaaccuucuggccucccacag

SEQ ID NO: 2070126 - RNA, 17 nt, Homo sapiens
cuucuuuagcaagauau

SEQ ID NO: 2070127 - RNA, 20 nt, Homo sapiens
aaaauguggaaugcauccaa

SEQ ID NO: 2070128 - RNA, 13 nt, Homo sapiens
gugauuaaaugac

SEQ ID NO: 2070129 - RNA, 15 nt, Homo sapiens
ugggcagaaggccaa

SEQ ID NO: 2070130 - RNA, 24 nt, Homo sapiens
augacuucccaacugcaagucaca

SEQ ID NO: 2070131 - RNA, 14 nt, Homo sapiens
gaaacuaaagcaau

SEQ ID NO: 2070132 - RNA, 14 nt, Homo sapiens
agcaugugugcaaa

SEQ ID NO: 2070133 - RNA, 13 nt, Homo sapiens
agucaugcugugc

SEQ ID NO: 2070134 - RNA, 16 nt, Homo sapiens
caggacuccccaggag

SEQ ID NO: 2070135 - RNA, 21 nt, Homo sapiens
uaguuccaggacucagggacu

SEQ ID NO: 2070136 - RNA, 15 nt, Homo sapiens
aacugccauaacaua

SEQ ID NO: 2070137 - RNA, 17 nt, Homo sapiens
cagaagcagguucuuga

SEQ ID NO: 2070138 - RNA, 17 nt, Homo sapiens
cagagguggauacuggg

SEQ ID NO: 2070139 - RNA, 16 nt, Homo sapiens
acaccugugugcugua

SEQ ID NO: 2070140 - RNA, 12 nt, Homo sapiens
caucuccagugc

SEQ ID NO: 2070141 - RNA, 16 nt, Homo sapiens
uauuauuuggugggga

SEQ ID NO: 2070142 - RNA, 17 nt, Homo sapiens
ggagacacugugcuaua

SEQ ID NO: 2070143 - RNA, 21 nt, Homo sapiens
acucagccguaggguggcacu

SEQ ID NO: 2070144 - RNA, 21 nt, Homo sapiens
ucuauuuuaguuaacuaugau

SEQ ID NO: 2070145 - RNA, 21 nt, Homo sapiens
ucccuccuuuccuuugcccuu

SEQ ID NO: 2070146 - RNA, 15 nt, Homo sapiens
auguuuucacuguau

SEQ ID NO: 2070147 - RNA, 14 nt, Homo sapiens
ccaccgcaugcccc

SEQ ID NO: 2070148 - RNA, 23 nt, Homo sapiens
uccaggaggaguuagccaaacaa

SEQ ID NO: 2070149 - RNA, 15 nt, Homo sapiens
cuggaugcucucguu

SEQ ID NO: 2070150 - RNA, 16 nt, Homo sapiens
guauaaauuacaugca

SEQ ID NO: 2070151 - RNA, 14 nt, Homo sapiens
uugucuguguugcu

SEQ ID NO: 2070152 - RNA, 19 nt, Homo sapiens
uaauaaaggucuuugcaca

SEQ ID NO: 2070153 - RNA, 12 nt, Homo sapiens
aaccccaguguu

SEQ ID NO: 2070154 - RNA, 16 nt, Homo sapiens
auuaccuccugagaaa

SEQ ID NO: 2070155 - RNA, 14 nt, Homo sapiens
acaaaaucacauuc

SEQ ID NO: 2070156 - RNA, 18 nt, Homo sapiens
acuuuugauauggccaau

SEQ ID NO: 2070157 - RNA, 21 nt, Homo sapiens
gucugugugcgcucuguggau

SEQ ID NO: 2070158 - RNA, 21 nt, Homo sapiens
uuaaauaaagucucucugacu

SEQ ID NO: 2070159 - RNA, 16 nt, Homo sapiens
uugggcuggugucacc

SEQ ID NO: 2070160 - RNA, 15 nt, Homo sapiens
uguacucuacugaua

SEQ ID NO: 2070161 - RNA, 16 nt, Homo sapiens
cugguagaccacugcc

SEQ ID NO: 2070162 - RNA, 19 nt, Homo sapiens
uguaacaugcaauuuugca

SEQ ID NO: 2070163 - RNA, 17 nt, Homo sapiens
gccaugauggugcugac

SEQ ID NO: 2070164 - RNA, 20 nt, Homo sapiens
ggguucguggaaagggugcu

SEQ ID NO: 2070165 - RNA, 22 nt, Homo sapiens
uucucugguugagcugggccag

SEQ ID NO: 2070166 - RNA, 22 nt, Homo sapiens
agccucucccuccagccaauag

SEQ ID NO: 2070167 - RNA, 20 nt, Homo sapiens
uucuuuauacucucuucccu

SEQ ID NO: 2070168 - RNA, 12 nt, Homo sapiens
ucccuugaccau

SEQ ID NO: 2070169 - RNA, 16 nt, Homo sapiens
uucugaagugcugcuc

SEQ ID NO: 2070170 - RNA, 17 nt, Homo sapiens
aucuccagacucuacca

SEQ ID NO: 2070171 - RNA, 20 nt, Homo sapiens
agagguggagguugcaguga

SEQ ID NO: 2070172 - RNA, 18 nt, Homo sapiens
uugcaguuuacaguauuu

SEQ ID NO: 2070173 - RNA, 21 nt, Homo sapiens
acaauguuuuuuauacuucaa

SEQ ID NO: 2070174 - RNA, 17 nt, Homo sapiens
caacaaugugauuuaua

SEQ ID NO: 2070175 - RNA, 18 nt, Homo sapiens
ugccauuauuuucuguca

SEQ ID NO: 2070176 - RNA, 15 nt, Homo sapiens
aauacaaguuucuga

SEQ ID NO: 2070177 - RNA, 23 nt, Homo sapiens
caaaaaaaaaaaaaaauuacaaa

SEQ ID NO: 2070178 - RNA, 18 nt, Homo sapiens
ucccccagagccccucau

SEQ ID NO: 2070179 - RNA, 19 nt, Homo sapiens
aauauaaaccguggucuca

SEQ ID NO: 2070180 - RNA, 23 nt, Homo sapiens
aaaauaaaauguuucauuaugca

SEQ ID NO: 2070181 - RNA, 21 nt, Homo sapiens
aacaccgagugaggccauagc

SEQ ID NO: 2070182 - RNA, 20 nt, Homo sapiens
uaaggagaggagaaacugag

SEQ ID NO: 2070183 - RNA, 13 nt, Homo sapiens
auuggcacaagcu

SEQ ID NO: 2070184 - RNA, 17 nt, Homo sapiens
guuuggaaaaguggcgu

SEQ ID NO: 2070185 - RNA, 16 nt, Homo sapiens
ccugcgagacgcacac

SEQ ID NO: 2070186 - RNA, 15 nt, Homo sapiens
ggaccucgugccacc

SEQ ID NO: 2070187 - RNA, 13 nt, Homo sapiens
ccacaugugucca

SEQ ID NO: 2070188 - RNA, 14 nt, Homo sapiens
cauggaaacaacuu

SEQ ID NO: 2070189 - RNA, 22 nt, Homo sapiens
acagccacugcggaguccaggc

SEQ ID NO: 2070190 - RNA, 12 nt, Homo sapiens
acuuugaacuaa

SEQ ID NO: 2070191 - RNA, 18 nt, Homo sapiens
uacaaggacuuuccaaau

SEQ ID NO: 2070192 - RNA, 19 nt, Homo sapiens
agaauuaaccauugcuaau

SEQ ID NO: 2070193 - RNA, 18 nt, Homo sapiens
uccaaaucugccuagaaa

SEQ ID NO: 2070194 - RNA, 23 nt, Homo sapiens
gggcaauaaaagauaagugcagu

SEQ ID NO: 2070195 - RNA, 19 nt, Homo sapiens
ugaaaaccuacauauucca

SEQ ID NO: 2070196 - RNA, 18 nt, Homo sapiens
auauucaugaaaugugga

SEQ ID NO: 2070197 - RNA, 15 nt, Homo sapiens
uguuaagguucaaga

SEQ ID NO: 2070198 - RNA, 20 nt, Homo sapiens
ccuaauucaauccuacuuuu

SEQ ID NO: 2070199 - RNA, 21 nt, Homo sapiens
auucuucagauacaaacugca

SEQ ID NO: 2070200 - RNA, 13 nt, Homo sapiens
auacuucauuaaa

SEQ ID NO: 2070201 - RNA, 16 nt, Homo sapiens
gauuccucuugccucu

SEQ ID NO: 2070202 - RNA, 13 nt, Homo sapiens
accucuacaagca

SEQ ID NO: 2070203 - RNA, 19 nt, Homo sapiens
ucaagaaaugacugaggua

SEQ ID NO: 2070204 - RNA, 18 nt, Homo sapiens
acucucacuaugcugcua

SEQ ID NO: 2070205 - RNA, 20 nt, Homo sapiens
ccugcgacccugggggcaca

SEQ ID NO: 2070206 - RNA, 23 nt, Homo sapiens
guuucccaagcuagacugugucu

SEQ ID NO: 2070207 - RNA, 17 nt, Homo sapiens
acuaaacuucaccuaca

SEQ ID NO: 2070208 - RNA, 23 nt, Homo sapiens
ugccaucuccacccugagccuga

SEQ ID NO: 2070209 - RNA, 21 nt, Homo sapiens
cugauuuugaagagaguugcu

SEQ ID NO: 2070210 - RNA, 23 nt, Homo sapiens
uaaaaaaaaauuguaucucauua

SEQ ID NO: 2070211 - RNA, 19 nt, Homo sapiens
cauccuaugcaauauaucu

SEQ ID NO: 2070212 - RNA, 21 nt, Homo sapiens
agcuacuugauguaacugaga

SEQ ID NO: 2070213 - RNA, 22 nt, Homo sapiens
caggcagccuugcccauucucu

SEQ ID NO: 2070214 - RNA, 18 nt, Homo sapiens
uacugcauuuacagugua

SEQ ID NO: 2070215 - RNA, 19 nt, Homo sapiens
uguguucucuauugcugcu

SEQ ID NO: 2070216 - RNA, 21 nt, Homo sapiens
aagaucccaccgacccuuccu

SEQ ID NO: 2070217 - RNA, 21 nt, Homo sapiens
caacagagaggggcagggaag

SEQ ID NO: 2070218 - RNA, 22 nt, Homo sapiens
ucuugccgucacuauucaucaa

SEQ ID NO: 2070219 - RNA, 19 nt, Homo sapiens
agccuaauacaacauguag

SEQ ID NO: 2070220 - RNA, 13 nt, Homo sapiens
cugcagacauucu

SEQ ID NO: 2070221 - RNA, 19 nt, Homo sapiens
cuagucagccacaugggaa

SEQ ID NO: 2070222 - RNA, 12 nt, Homo sapiens
ucagaaaccaaa

SEQ ID NO: 2070223 - RNA, 13 nt, Homo sapiens
gccgacacuguuc

SEQ ID NO: 2070224 - RNA, 14 nt, Homo sapiens
cugacugcacacag

SEQ ID NO: 2070225 - RNA, 15 nt, Homo sapiens
uccaggcgaugugca

SEQ ID NO: 2070226 - RNA, 13 nt, Homo sapiens
uuaggagcccuag

SEQ ID NO: 2070227 - RNA, 17 nt, Homo sapiens
uaaaauuaaaugcaugu

SEQ ID NO: 2070228 - RNA, 15 nt, Homo sapiens
guuaacagacacugu

SEQ ID NO: 2070229 - RNA, 15 nt, Homo sapiens
cugcacaaacaauau

SEQ ID NO: 2070230 - RNA, 17 nt, Homo sapiens
uaaaaugcacccaucag

SEQ ID NO: 2070231 - RNA, 11 nt, Homo sapiens
aaagacaucaa

SEQ ID NO: 2070232 - RNA, 21 nt, Homo sapiens
ucaacauaggccugcucagcc

SEQ ID NO: 2070233 - RNA, 13 nt, Homo sapiens
acuagcugagaaa

SEQ ID NO: 2070234 - RNA, 14 nt, Homo sapiens
cacucccagcacuc

SEQ ID NO: 2070235 - RNA, 18 nt, Homo sapiens
cuugauuggggaauuaaa

SEQ ID NO: 2070236 - RNA, 19 nt, Homo sapiens
acuuuaacacagugucugg

SEQ ID NO: 2070237 - RNA, 21 nt, Homo sapiens
uugaacauguuuaauggguau

SEQ ID NO: 2070238 - RNA, 13 nt, Homo sapiens
cccagcaccccuu

SEQ ID NO: 2070239 - RNA, 14 nt, Homo sapiens
caagaacugccaua

SEQ ID NO: 2070240 - RNA, 13 nt, Homo sapiens
auggaacuuucau

SEQ ID NO: 2070241 - RNA, 22 nt, Homo sapiens
cagccacuuuuagcuacugcua

SEQ ID NO: 2070242 - RNA, 15 nt, Homo sapiens
uguuuugcacugaca

SEQ ID NO: 2070243 - RNA, 15 nt, Homo sapiens
uggagauagugccag

SEQ ID NO: 2070244 - RNA, 15 nt, Homo sapiens
gagauccagugcagu

SEQ ID NO: 2070245 - RNA, 20 nt, Homo sapiens
uuuucgaauacgucagauug

SEQ ID NO: 2070246 - RNA, 16 nt, Homo sapiens
agcgucaagguggcau

SEQ ID NO: 2070247 - RNA, 14 nt, Homo sapiens
aacaucauuucaau

SEQ ID NO: 2070248 - RNA, 17 nt, Homo sapiens
cacuacagguguugaau

SEQ ID NO: 2070249 - RNA, 19 nt, Homo sapiens
uugaacuuuaagaagcagu

SEQ ID NO: 2070250 - RNA, 11 nt, Homo sapiens
ccacuucucac

SEQ ID NO: 2070251 - RNA, 18 nt, Homo sapiens
uucucuggacacugccac

SEQ ID NO: 2070252 - RNA, 18 nt, Homo sapiens
ggcugagggcugccagca

SEQ ID NO: 2070253 - RNA, 14 nt, Homo sapiens
ugaucagaucuuac

SEQ ID NO: 2070254 - RNA, 17 nt, Homo sapiens
gcaaugacugugcucac

SEQ ID NO: 2070255 - RNA, 19 nt, Homo sapiens
gaaucucugagccaaccuu

SEQ ID NO: 2070256 - RNA, 16 nt, Homo sapiens
gauccggcagcacaag

SEQ ID NO: 2070257 - RNA, 22 nt, Homo sapiens
acagaacuuuuccucuguauca

SEQ ID NO: 2070258 - RNA, 14 nt, Homo sapiens
ucuagcauggcaua

SEQ ID NO: 2070259 - RNA, 20 nt, Homo sapiens
uauuuuguguuguucauuga

SEQ ID NO: 2070260 - RNA, 16 nt, Homo sapiens
guagcucggcaccaac

SEQ ID NO: 2070261 - RNA, 17 nt, Homo sapiens
caaaguccuccuuucau

SEQ ID NO: 2070262 - RNA, 15 nt, Homo sapiens
ugaauuccaagugua

SEQ ID NO: 2070263 - RNA, 18 nt, Homo sapiens
uucucucuuguuguccag

SEQ ID NO: 2070264 - RNA, 22 nt, Homo sapiens
cuuaauaaaggcccccacuucu

SEQ ID NO: 2070265 - RNA, 15 nt, Homo sapiens
agggaggggugguau

SEQ ID NO: 2070266 - RNA, 22 nt, Homo sapiens
gccuccuacucugagacaaaag

SEQ ID NO: 2070267 - RNA, 12 nt, Homo sapiens
ccagauacauac

SEQ ID NO: 2070268 - RNA, 21 nt, Homo sapiens
ugcaauugucuuguaccuuga

SEQ ID NO: 2070269 - RNA, 21 nt, Homo sapiens
ucacagguugaugcugcacag

SEQ ID NO: 2070270 - RNA, 16 nt, Homo sapiens
augcugcaauacauua

SEQ ID NO: 2070271 - RNA, 17 nt, Homo sapiens
cacugacagccuugccc

SEQ ID NO: 2070272 - RNA, 22 nt, Homo sapiens
uaccauguugcccagaauuuca

SEQ ID NO: 2070273 - RNA, 17 nt, Homo sapiens
cccuuguuacucaggaa

SEQ ID NO: 2070274 - RNA, 17 nt, Homo sapiens
ucucauuucccuuugau

SEQ ID NO: 2070275 - RNA, 22 nt, Homo sapiens
gacaaccaacggccgacugccu

SEQ ID NO: 2070276 - RNA, 17 nt, Homo sapiens
agcuacccaucugccag

SEQ ID NO: 2070277 - RNA, 14 nt, Homo sapiens
aaauauuaggagac

SEQ ID NO: 2070278 - RNA, 15 nt, Homo sapiens
ccagugcaaaugcau

SEQ ID NO: 2070279 - RNA, 20 nt, Homo sapiens
uaguuguauuuuguacauuu

SEQ ID NO: 2070280 - RNA, 18 nt, Homo sapiens
ggaaggucaguugccaug

SEQ ID NO: 2070281 - RNA, 20 nt, Homo sapiens
gcuucuuggaccuuggcgcu

SEQ ID NO: 2070282 - RNA, 15 nt, Homo sapiens
uauuauugagcucua

SEQ ID NO: 2070283 - RNA, 17 nt, Homo sapiens
ucgcuccuucauuucag

SEQ ID NO: 2070284 - RNA, 16 nt, Homo sapiens
gcugucaacauucaaa

SEQ ID NO: 2070285 - RNA, 16 nt, Homo sapiens
gcuaccucuccagccu

SEQ ID NO: 2070286 - RNA, 14 nt, Homo sapiens
uguaaaaauacugu

SEQ ID NO: 2070287 - RNA, 19 nt, Homo sapiens
aaccucugagucaccaucu

SEQ ID NO: 2070288 - RNA, 18 nt, Homo sapiens
cucuuuugaauccaugcu

SEQ ID NO: 2070289 - RNA, 15 nt, Homo sapiens
acauggugugccaca

SEQ ID NO: 2070290 - RNA, 22 nt, Homo sapiens
acguuucuaaaggcuaccuuug

SEQ ID NO: 2070291 - RNA, 20 nt, Homo sapiens
gagguagcucccagcacuca

SEQ ID NO: 2070292 - RNA, 18 nt, Homo sapiens
ccagguuuuucaaaagga

SEQ ID NO: 2070293 - RNA, 20 nt, Homo sapiens
cugggaaugacaacaccugg

SEQ ID NO: 2070294 - RNA, 18 nt, Homo sapiens
guuuucaucucuagggac

SEQ ID NO: 2070295 - RNA, 17 nt, Homo sapiens
gccacuaucacauaugc

SEQ ID NO: 2070296 - RNA, 16 nt, Homo sapiens
uauguaccaagaaucu

SEQ ID NO: 2070297 - RNA, 15 nt, Homo sapiens
ucuaaacacuucauu

SEQ ID NO: 2070298 - RNA, 22 nt, Homo sapiens
uugugagucuucacuaaaauca

SEQ ID NO: 2070299 - RNA, 14 nt, Homo sapiens
ugcugugaacaauu

SEQ ID NO: 2070300 - RNA, 22 nt, Homo sapiens
gggauugaauuaaaacagcugc

SEQ ID NO: 2070301 - RNA, 20 nt, Homo sapiens
ccagccucugccgcugccau

SEQ ID NO: 2070302 - RNA, 22 nt, Homo sapiens
cugauccagucacagccauaca

SEQ ID NO: 2070303 - RNA, 19 nt, Homo sapiens
auuuguuaaaauuaucaau

SEQ ID NO: 2070304 - RNA, 16 nt, Homo sapiens
uaaaaugcuucacugu

SEQ ID NO: 2070305 - RNA, 20 nt, Homo sapiens
accucugugcagggcacaga

SEQ ID NO: 2070306 - RNA, 12 nt, Homo sapiens
cugaaguaauaa

SEQ ID NO: 2070307 - RNA, 17 nt, Homo sapiens
cugauuucuacaacuga

SEQ ID NO: 2070308 - RNA, 18 nt, Homo sapiens
ggaaggggugggagccaa

SEQ ID NO: 2070309 - RNA, 19 nt, Homo sapiens
ggcuccucugcaucuugcu

SEQ ID NO: 2070310 - RNA, 15 nt, Homo sapiens
ugucccuuguaaaua

SEQ ID NO: 2070311 - RNA, 22 nt, Homo sapiens
ugcaaacaauuuuaaugauggu

SEQ ID NO: 2070312 - RNA, 18 nt, Homo sapiens
ccugggcacauagcauag

SEQ ID NO: 2070313 - RNA, 22 nt, Homo sapiens
cuuuccccagugacaccucagc

SEQ ID NO: 2070314 - RNA, 13 nt, Homo sapiens
ucucuugccauuu

SEQ ID NO: 2070315 - RNA, 15 nt, Homo sapiens
gaucucacauuucac

SEQ ID NO: 2070316 - RNA, 20 nt, Homo sapiens
aaggcgggaggaucacuuga

SEQ ID NO: 2070317 - RNA, 12 nt, Homo sapiens
cgaugcucccuc

SEQ ID NO: 2070318 - RNA, 22 nt, Homo sapiens
guaacagauuuuguuggcauag

SEQ ID NO: 2070319 - RNA, 14 nt, Homo sapiens
ugcuuaaacuacaa

SEQ ID NO: 2070320 - RNA, 11 nt, Homo sapiens
uguugcaaugc

SEQ ID NO: 2070321 - RNA, 21 nt, Homo sapiens
cuugcucauccaaggauuaaa

SEQ ID NO: 2070322 - RNA, 19 nt, Homo sapiens
cauaucugguauaugucau

SEQ ID NO: 2070323 - RNA, 14 nt, Homo sapiens
acagcugucccugc

SEQ ID NO: 2070324 - RNA, 20 nt, Homo sapiens
auggacucugaaaaacauuc

SEQ ID NO: 2070325 - RNA, 17 nt, Homo sapiens
ccucugggaucugccaa

SEQ ID NO: 2070326 - RNA, 15 nt, Homo sapiens
acagagaaaccagcu

SEQ ID NO: 2070327 - RNA, 15 nt, Homo sapiens
ugaaugcagggaaug

SEQ ID NO: 2070328 - RNA, 16 nt, Homo sapiens
aaugauuguuugucaa

SEQ ID NO: 2070329 - RNA, 13 nt, Homo sapiens
cuuucugugcaug

SEQ ID NO: 2070330 - RNA, 15 nt, Homo sapiens
gccugguuggcagca

SEQ ID NO: 2070331 - RNA, 14 nt, Homo sapiens
uugcuuuaaaacaa

SEQ ID NO: 2070332 - RNA, 12 nt, Homo sapiens
gccccuggccau

SEQ ID NO: 2070333 - RNA, 20 nt, Homo sapiens
aacaaaucauuuugauguau

SEQ ID NO: 2070334 - RNA, 19 nt, Homo sapiens
cuuuauccccguuucuugc

SEQ ID NO: 2070335 - RNA, 17 nt, Homo sapiens
acgggagaauauacaaa

SEQ ID NO: 2070336 - RNA, 16 nt, Homo sapiens
gcucugucugcucaau

SEQ ID NO: 2070337 - RNA, 14 nt, Homo sapiens
aacacacagaagaa

SEQ ID NO: 2070338 - RNA, 15 nt, Homo sapiens
aaaguccgaaaagca

SEQ ID NO: 2070339 - RNA, 16 nt, Homo sapiens
gggacugggagucaga

SEQ ID NO: 2070340 - RNA, 17 nt, Homo sapiens
acuaauccucucugcaa

SEQ ID NO: 2070341 - RNA, 17 nt, Homo sapiens
uagauuucuagcaguau

SEQ ID NO: 2070342 - RNA, 18 nt, Homo sapiens
uuaauauuuacucuauaa

SEQ ID NO: 2070343 - RNA, 14 nt, Homo sapiens
caagggcagggucu

SEQ ID NO: 2070344 - RNA, 14 nt, Homo sapiens
gagcuuagauuucc

SEQ ID NO: 2070345 - RNA, 21 nt, Homo sapiens
ucucaccuaaacccucuguga

SEQ ID NO: 2070346 - RNA, 17 nt, Homo sapiens
uccagguuuaugaauga

SEQ ID NO: 2070347 - RNA, 18 nt, Homo sapiens
caaauuguuuuuacuguc

SEQ ID NO: 2070348 - RNA, 18 nt, Homo sapiens
caggccucccugccagua

SEQ ID NO: 2070349 - RNA, 17 nt, Homo sapiens
uagagauaaaacagaau

SEQ ID NO: 2070350 - RNA, 20 nt, Homo sapiens
auaguaauaaacaccauuuc

SEQ ID NO: 2070351 - RNA, 16 nt, Homo sapiens
aauucauuugacuuug

SEQ ID NO: 2070352 - RNA, 19 nt, Homo sapiens
aagucaccacuccauuccc

SEQ ID NO: 2070353 - RNA, 22 nt, Homo sapiens
uaauuguccacagcaaagggca

SEQ ID NO: 2070354 - RNA, 19 nt, Homo sapiens
accuuaguguccuuuucuc

SEQ ID NO: 2070355 - RNA, 18 nt, Homo sapiens
guuuucauuauguucaug

SEQ ID NO: 2070356 - RNA, 21 nt, Homo sapiens
uuccguuggaaagaacauuua

SEQ ID NO: 2070357 - RNA, 19 nt, Homo sapiens
cauuauuuuauuauaacau

SEQ ID NO: 2070358 - RNA, 17 nt, Homo sapiens
aaccgcaggaagcugcu

SEQ ID NO: 2070359 - RNA, 22 nt, Homo sapiens
ucuuguuuuuuuuuuccacuua

SEQ ID NO: 2070360 - RNA, 14 nt, Homo sapiens
gaaaaguauucuca

SEQ ID NO: 2070361 - RNA, 14 nt, Homo sapiens
gagcccggcaaaug

SEQ ID NO: 2070362 - RNA, 14 nt, Homo sapiens
aucuaucacugcau

SEQ ID NO: 2070363 - RNA, 21 nt, Homo sapiens
ucucaauaugcuuacaaaguc

SEQ ID NO: 2070364 - RNA, 16 nt, Homo sapiens
agcugcuguuuuuaga

SEQ ID NO: 2070365 - RNA, 13 nt, Homo sapiens
agccuucauuuua

SEQ ID NO: 2070366 - RNA, 19 nt, Homo sapiens
agcccucaguuuucaguca

SEQ ID NO: 2070367 - RNA, 16 nt, Homo sapiens
caacagagacagugaa

SEQ ID NO: 2070368 - RNA, 12 nt, Homo sapiens
aguauacuuuca

SEQ ID NO: 2070369 - RNA, 18 nt, Homo sapiens
ucccaaucagcacugaaa

SEQ ID NO: 2070370 - RNA, 21 nt, Homo sapiens
uguccuuuuacucagcuuuau

SEQ ID NO: 2070371 - RNA, 16 nt, Homo sapiens
gggcccccaccgccgg

SEQ ID NO: 2070372 - RNA, 14 nt, Homo sapiens
accugagauggagg

SEQ ID NO: 2070373 - RNA, 18 nt, Homo sapiens
agccagguucccaggagg

SEQ ID NO: 2070374 - RNA, 18 nt, Homo sapiens
accuucaauacuucauga

SEQ ID NO: 2070375 - RNA, 16 nt, Homo sapiens
cucaucaacacaguga

SEQ ID NO: 2070376 - RNA, 13 nt, Homo sapiens
guccacaggucua

SEQ ID NO: 2070377 - RNA, 13 nt, Homo sapiens
acauacagacaca

SEQ ID NO: 2070378 - RNA, 13 nt, Homo sapiens
auguugaguucag

SEQ ID NO: 2070379 - RNA, 17 nt, Homo sapiens
ugccauugcacuccagc

SEQ ID NO: 2070380 - RNA, 13 nt, Homo sapiens
ugcaaauucucaa

SEQ ID NO: 2070381 - RNA, 23 nt, Homo sapiens
uaaccuccaacacagugcaucuc

SEQ ID NO: 2070382 - RNA, 13 nt, Homo sapiens
agaccugacaauu

SEQ ID NO: 2070383 - RNA, 23 nt, Homo sapiens
caagacagggcucauuuuugcac

SEQ ID NO: 2070384 - RNA, 14 nt, Homo sapiens
uuccgaaacauaca

SEQ ID NO: 2070385 - RNA, 22 nt, Homo sapiens
aacgugcauugugcuucuuucu

SEQ ID NO: 2070386 - RNA, 15 nt, Homo sapiens
gccagccaugcauug

SEQ ID NO: 2070387 - RNA, 14 nt, Homo sapiens
caggauggugggca

SEQ ID NO: 2070388 - RNA, 19 nt, Homo sapiens
ucucacgauuccagugcag

SEQ ID NO: 2070389 - RNA, 16 nt, Homo sapiens
gagcccccacauucuc

SEQ ID NO: 2070390 - RNA, 19 nt, Homo sapiens
ccaaacucauucaccaaau

SEQ ID NO: 2070391 - RNA, 16 nt, Homo sapiens
aaaguauucuguacuc

SEQ ID NO: 2070392 - RNA, 19 nt, Homo sapiens
cugacaucuccucuaucac

SEQ ID NO: 2070393 - RNA, 14 nt, Homo sapiens
uuuuaguucucuag

SEQ ID NO: 2070394 - RNA, 14 nt, Homo sapiens
gcauuccucaucac

SEQ ID NO: 2070395 - RNA, 20 nt, Homo sapiens
caggugcuguuuuuguucua

SEQ ID NO: 2070396 - RNA, 21 nt, Homo sapiens
agcaucauaaacaggcugacu

SEQ ID NO: 2070397 - RNA, 12 nt, Homo sapiens
uguucuugugaa

SEQ ID NO: 2070398 - RNA, 17 nt, Homo sapiens
ucagaacccugccaugg

SEQ ID NO: 2070399 - RNA, 20 nt, Homo sapiens
uuauggggacagcauaccuu

SEQ ID NO: 2070400 - RNA, 13 nt, Homo sapiens
cacccauccauga

SEQ ID NO: 2070401 - RNA, 14 nt, Homo sapiens
ucaggugugcucag

SEQ ID NO: 2070402 - RNA, 17 nt, Homo sapiens
augugugccuuguucaa

SEQ ID NO: 2070403 - RNA, 13 nt, Homo sapiens
ugggcucagcauu

SEQ ID NO: 2070404 - RNA, 13 nt, Homo sapiens
uugacacacagca

SEQ ID NO: 2070405 - RNA, 20 nt, Homo sapiens
auaacuuaaauauugcucua

SEQ ID NO: 2070406 - RNA, 15 nt, Homo sapiens
uuaggaaaggcugau

SEQ ID NO: 2070407 - RNA, 24 nt, Homo sapiens
caauuuugaaaacucuaauugucc

SEQ ID NO: 2070408 - RNA, 16 nt, Homo sapiens
gucuugugacuagugc

SEQ ID NO: 2070409 - RNA, 14 nt, Homo sapiens
uuuaaagcuuucaa

SEQ ID NO: 2070410 - RNA, 16 nt, Homo sapiens
ucaaaugcagcaaucc

SEQ ID NO: 2070411 - RNA, 22 nt, Homo sapiens
caagaggcgagaugagcccaca

SEQ ID NO: 2070412 - RNA, 13 nt, Homo sapiens
aguggagccaggu

SEQ ID NO: 2070413 - RNA, 12 nt, Homo sapiens
agccccagcuga

SEQ ID NO: 2070414 - RNA, 21 nt, Homo sapiens
ugaguuuaaaaaaauaacauc

SEQ ID NO: 2070415 - RNA, 14 nt, Homo sapiens
aaugcaucuguccu

SEQ ID NO: 2070416 - RNA, 19 nt, Homo sapiens
cugcuggcugucuggcuuc

SEQ ID NO: 2070417 - RNA, 20 nt, Homo sapiens
cuacucuagggaaaaaccag

SEQ ID NO: 2070418 - RNA, 15 nt, Homo sapiens
acuccaucgccaucu

SEQ ID NO: 2070419 - RNA, 15 nt, Homo sapiens
aaaggauuuuaccaa

SEQ ID NO: 2070420 - RNA, 20 nt, Homo sapiens
gaaaggucuaugcagaaaua

SEQ ID NO: 2070421 - RNA, 18 nt, Homo sapiens
ugccaauuugcacauuaa

SEQ ID NO: 2070422 - RNA, 21 nt, Homo sapiens
uccugccccacccuaacugau

SEQ ID NO: 2070423 - RNA, 22 nt, Homo sapiens
ggaggcagagguugcagugagc

SEQ ID NO: 2070424 - RNA, 17 nt, Homo sapiens
uucauccauaacugaac

SEQ ID NO: 2070425 - RNA, 18 nt, Homo sapiens
auugugacuucacuguau

SEQ ID NO: 2070426 - RNA, 18 nt, Homo sapiens
auucuguuuuuaaugcua

SEQ ID NO: 2070427 - RNA, 21 nt, Homo sapiens
auguguuccauugccauagcu

SEQ ID NO: 2070428 - RNA, 15 nt, Homo sapiens
caguccuauucugua

SEQ ID NO: 2070429 - RNA, 15 nt, Homo sapiens
agggccaauggccug

SEQ ID NO: 2070430 - RNA, 21 nt, Homo sapiens
uuccuacacccuuggacuuga

SEQ ID NO: 2070431 - RNA, 14 nt, Homo sapiens
acacuagucugugu

SEQ ID NO: 2070432 - RNA, 17 nt, Homo sapiens
acuacagguguugucca

SEQ ID NO: 2070433 - RNA, 17 nt, Homo sapiens
ggcuucccuaaacugca

SEQ ID NO: 2070434 - RNA, 18 nt, Homo sapiens
caaaugggaaaaccagac

SEQ ID NO: 2070435 - RNA, 14 nt, Homo sapiens
ugaauuuucagaga

SEQ ID NO: 2070436 - RNA, 18 nt, Homo sapiens
ucuauggggagaaaggga

SEQ ID NO: 2070437 - RNA, 16 nt, Homo sapiens
uaaagacaaucacugc

SEQ ID NO: 2070438 - RNA, 22 nt, Homo sapiens
uguucucaaaugcuaaaugcaa

SEQ ID NO: 2070439 - RNA, 20 nt, Homo sapiens
gucggagucuguaaaaccag

SEQ ID NO: 2070440 - RNA, 16 nt, Homo sapiens
aguuggagcuccagcc

SEQ ID NO: 2070441 - RNA, 13 nt, Homo sapiens
ccggaggggaccc

SEQ ID NO: 2070442 - RNA, 21 nt, Homo sapiens
auuaaaauaaaacaagccuua

SEQ ID NO: 2070443 - RNA, 22 nt, Homo sapiens
caccaaggaaaaagcagagaau

SEQ ID NO: 2070444 - RNA, 19 nt, Homo sapiens
aauuccugccaugccccag

SEQ ID NO: 2070445 - RNA, 15 nt, Homo sapiens
ggcacccucagggag

SEQ ID NO: 2070446 - RNA, 19 nt, Homo sapiens
auuaucaaugggauaugau

SEQ ID NO: 2070447 - RNA, 18 nt, Homo sapiens
aucauccugccuucaugg

SEQ ID NO: 2070448 - RNA, 22 nt, Homo sapiens
caagcaccacucugggcacaag

SEQ ID NO: 2070449 - RNA, 16 nt, Homo sapiens
agcugagccagucaug

SEQ ID NO: 2070450 - RNA, 19 nt, Homo sapiens
aguuacuguggucacuugu

SEQ ID NO: 2070451 - RNA, 15 nt, Homo sapiens
acuccguuccuggca

SEQ ID NO: 2070452 - RNA, 19 nt, Homo sapiens
ccaguccucccuagcucuu

SEQ ID NO: 2070453 - RNA, 18 nt, Homo sapiens
cagacuccuaacuacagg

SEQ ID NO: 2070454 - RNA, 15 nt, Homo sapiens
gggcaggccucccaa

SEQ ID NO: 2070455 - RNA, 22 nt, Homo sapiens
gcuaagcuuuauggguguuaau

SEQ ID NO: 2070456 - RNA, 18 nt, Homo sapiens
aauuuaaaggguguacuu

SEQ ID NO: 2070457 - RNA, 18 nt, Homo sapiens
uuugguaggcuuaucaaa

SEQ ID NO: 2070458 - RNA, 23 nt, Homo sapiens
auaauuaaugauuaaacuauuaa

SEQ ID NO: 2070459 - RNA, 17 nt, Homo sapiens
accucuggggaccccaa

SEQ ID NO: 2070460 - RNA, 14 nt, Homo sapiens
uucugccacuccau

SEQ ID NO: 2070461 - RNA, 16 nt, Homo sapiens
uggaggccucagggag

SEQ ID NO: 2070462 - RNA, 14 nt, Homo sapiens
cacaguacccggug

SEQ ID NO: 2070463 - RNA, 17 nt, Homo sapiens
uuauuguauuuauucca

SEQ ID NO: 2070464 - RNA, 19 nt, Homo sapiens
aagggcaggagcucacacc

SEQ ID NO: 2070465 - RNA, 18 nt, Homo sapiens
aaugaaaauaacugaacc

SEQ ID NO: 2070466 - RNA, 13 nt, Homo sapiens
uaucauacuucca

SEQ ID NO: 2070467 - RNA, 23 nt, Homo sapiens
ucuucccugggcugccaccagcc

SEQ ID NO: 2070468 - RNA, 16 nt, Homo sapiens
aucccuccucacuugc

SEQ ID NO: 2070469 - RNA, 18 nt, Homo sapiens
cccaaauccaugcaagug

SEQ ID NO: 2070470 - RNA, 17 nt, Homo sapiens
cacaucuugcucugcau

SEQ ID NO: 2070471 - RNA, 14 nt, Homo sapiens
cuauagcagucauc

SEQ ID NO: 2070472 - RNA, 15 nt, Homo sapiens
gcugugaugguaccu

SEQ ID NO: 2070473 - RNA, 18 nt, Homo sapiens
ugcuaugcaaaauagaca

SEQ ID NO: 2070474 - RNA, 19 nt, Homo sapiens
caccuuaucuauguagaau

SEQ ID NO: 2070475 - RNA, 13 nt, Homo sapiens
aauaauaucccac

SEQ ID NO: 2070476 - RNA, 14 nt, Homo sapiens
guggcuccuaucug

SEQ ID NO: 2070477 - RNA, 23 nt, Homo sapiens
acucgugugcaugagaaugucau

SEQ ID NO: 2070478 - RNA, 16 nt, Homo sapiens
cagcuuuacuagugcc

SEQ ID NO: 2070479 - RNA, 17 nt, Homo sapiens
augaaauuccagcaaua

SEQ ID NO: 2070480 - RNA, 21 nt, Homo sapiens
ucacucugggccuggggaccc

SEQ ID NO: 2070481 - RNA, 16 nt, Homo sapiens
agaaguccacagacau

SEQ ID NO: 2070482 - RNA, 14 nt, Homo sapiens
caacuaacuccaga

SEQ ID NO: 2070483 - RNA, 19 nt, Homo sapiens
gguacaaguuuacaugaua

SEQ ID NO: 2070484 - RNA, 13 nt, Homo sapiens
auuaagugccuga

SEQ ID NO: 2070485 - RNA, 14 nt, Homo sapiens
cagaagccugaugc

SEQ ID NO: 2070486 - RNA, 22 nt, Homo sapiens
auuucaaaagauuguguuccca

SEQ ID NO: 2070487 - RNA, 15 nt, Homo sapiens
agacauaaagccaug

SEQ ID NO: 2070488 - RNA, 14 nt, Homo sapiens
agcaaagaagggaa

SEQ ID NO: 2070489 - RNA, 16 nt, Homo sapiens
acaucacugagacaau

SEQ ID NO: 2070490 - RNA, 21 nt, Homo sapiens
aggcugccggagggagcccug

SEQ ID NO: 2070491 - RNA, 19 nt, Homo sapiens
aacuuaggaaggauccucu

SEQ ID NO: 2070492 - RNA, 16 nt, Homo sapiens
gagccuccacugccuc

SEQ ID NO: 2070493 - RNA, 21 nt, Homo sapiens
uuuccaaagguuucaacugua

SEQ ID NO: 2070494 - RNA, 21 nt, Homo sapiens
cauuccaacaccugccauagg

SEQ ID NO: 2070495 - RNA, 21 nt, Homo sapiens
ugauuaaucuccuggaagauu

SEQ ID NO: 2070496 - RNA, 17 nt, Homo sapiens
cauguauacuccauaga

SEQ ID NO: 2070497 - RNA, 19 nt, Homo sapiens
cuuugcuucauucaaguca

SEQ ID NO: 2070498 - RNA, 17 nt, Homo sapiens
aaguggaagccacugga

SEQ ID NO: 2070499 - RNA, 23 nt, Homo sapiens
gaguuucuggcucuugaggcauu

SEQ ID NO: 2070500 - RNA, 15 nt, Homo sapiens
gaacuauuucuacac

SEQ ID NO: 2070501 - RNA, 16 nt, Homo sapiens
uuucccuucagucuuc

SEQ ID NO: 2070502 - RNA, 17 nt, Homo sapiens
gacagaaugguggagug

SEQ ID NO: 2070503 - RNA, 16 nt, Homo sapiens
ucacuccaaagagaaa

SEQ ID NO: 2070504 - RNA, 14 nt, Homo sapiens
aaguggacucaggg

SEQ ID NO: 2070505 - RNA, 13 nt, Homo sapiens
uagcaucuaauga

SEQ ID NO: 2070506 - RNA, 14 nt, Homo sapiens
acaaacaagcacag

SEQ ID NO: 2070507 - RNA, 20 nt, Homo sapiens
cuuucuguugaaaagcacac

SEQ ID NO: 2070508 - RNA, 21 nt, Homo sapiens
uccugcucuucccucauuaaa

SEQ ID NO: 2070509 - RNA, 12 nt, Homo sapiens
auccuggaauau

SEQ ID NO: 2070510 - RNA, 16 nt, Homo sapiens
auccaccaccaaaauu

SEQ ID NO: 2070511 - RNA, 22 nt, Homo sapiens
guacucaguuaggcagugcagu

SEQ ID NO: 2070512 - RNA, 14 nt, Homo sapiens
agccuuaccaaagc

SEQ ID NO: 2070513 - RNA, 18 nt, Homo sapiens
acaaacauuuaagcugug

SEQ ID NO: 2070514 - RNA, 18 nt, Homo sapiens
auugauauugaaugaugu

SEQ ID NO: 2070515 - RNA, 18 nt, Homo sapiens
ugacuggggcccugcaga

SEQ ID NO: 2070516 - RNA, 21 nt, Homo sapiens
ugcagucggugguaccugaga

SEQ ID NO: 2070517 - RNA, 16 nt, Homo sapiens
ugaaugccacucugua

SEQ ID NO: 2070518 - RNA, 13 nt, Homo sapiens
aaacuacuucaca

SEQ ID NO: 2070519 - RNA, 17 nt, Homo sapiens
acauccugugaugucau

SEQ ID NO: 2070520 - RNA, 13 nt, Homo sapiens
cagacucuuggcu

SEQ ID NO: 2070521 - RNA, 22 nt, Homo sapiens
gcucuacuuuauaaucaagaca

SEQ ID NO: 2070522 - RNA, 17 nt, Homo sapiens
auguacauuaaauacca

SEQ ID NO: 2070523 - RNA, 19 nt, Homo sapiens
ugcaucauuaauaccuaaa

SEQ ID NO: 2070524 - RNA, 24 nt, Homo sapiens
gauaauggauccuuaacagaugaa

SEQ ID NO: 2070525 - RNA, 21 nt, Homo sapiens
agucagaggagaagagacaug

SEQ ID NO: 2070526 - RNA, 16 nt, Homo sapiens
gugucaaaagccagau

SEQ ID NO: 2070527 - RNA, 18 nt, Homo sapiens
gaagaaguugauaugccu

SEQ ID NO: 2070528 - RNA, 15 nt, Homo sapiens
caaauaaacuguaag

SEQ ID NO: 2070529 - RNA, 15 nt, Homo sapiens
caaauuaacuguaug

SEQ ID NO: 2070530 - RNA, 11 nt, Homo sapiens
aagaugcccuc

SEQ ID NO: 2070531 - RNA, 18 nt, Homo sapiens
ggauggggcuucacugcu

SEQ ID NO: 2070532 - RNA, 15 nt, Homo sapiens
ugcucuucagacuua

SEQ ID NO: 2070533 - RNA, 18 nt, Homo sapiens
gucugcuuagaguuuacu

SEQ ID NO: 2070534 - RNA, 20 nt, Homo sapiens
ugaccaaaacaaacaaacag

SEQ ID NO: 2070535 - RNA, 21 nt, Homo sapiens
aaagggccaaagaaccaaaga

SEQ ID NO: 2070536 - RNA, 20 nt, Homo sapiens
cacaagugcaguagugcagu

SEQ ID NO: 2070537 - RNA, 20 nt, Homo sapiens
ugcacacacacacacaugca

SEQ ID NO: 2070538 - RNA, 21 nt, Homo sapiens
caagguauaccucaguuccac

SEQ ID NO: 2070539 - RNA, 20 nt, Homo sapiens
uuucauauuuauggacauga

SEQ ID NO: 2070540 - RNA, 16 nt, Homo sapiens
gagcccauagccagcu

SEQ ID NO: 2070541 - RNA, 23 nt, Homo sapiens
agucauuccaugaagccccagag

SEQ ID NO: 2070542 - RNA, 13 nt, Homo sapiens
uacaccacauuag

SEQ ID NO: 2070543 - RNA, 23 nt, Homo sapiens
gaaagaaccacacagcuaaggga

SEQ ID NO: 2070544 - RNA, 15 nt, Homo sapiens
gagggcugccugaaa

SEQ ID NO: 2070545 - RNA, 21 nt, Homo sapiens
gauuuuauggugaugucacuc

SEQ ID NO: 2070546 - RNA, 21 nt, Homo sapiens
cucgagaauguauggauuuac

SEQ ID NO: 2070547 - RNA, 13 nt, Homo sapiens
cacuucucuccag

SEQ ID NO: 2070548 - RNA, 15 nt, Homo sapiens
auaggcagcaucuca

SEQ ID NO: 2070549 - RNA, 14 nt, Homo sapiens
ugcuaagagccucu

SEQ ID NO: 2070550 - RNA, 15 nt, Homo sapiens
gacccuggaccauuc

SEQ ID NO: 2070551 - RNA, 15 nt, Homo sapiens
ccugcuggacagggg

SEQ ID NO: 2070552 - RNA, 16 nt, Homo sapiens
uacagucuuguauuaa

SEQ ID NO: 2070553 - RNA, 18 nt, Homo sapiens
agcgauugauugauguac

SEQ ID NO: 2070554 - RNA, 13 nt, Homo sapiens
gugauccacccac

SEQ ID NO: 2070555 - RNA, 17 nt, Homo sapiens
aaggaagacuucauccc

SEQ ID NO: 2070556 - RNA, 12 nt, Homo sapiens
ugaaaagccaug

SEQ ID NO: 2070557 - RNA, 12 nt, Homo sapiens
ugugaagccaaa

SEQ ID NO: 2070558 - RNA, 23 nt, Homo sapiens
aacaacauuggaugugcauuucu

SEQ ID NO: 2070559 - RNA, 22 nt, Homo sapiens
uacuauaacauagaauugcaau

SEQ ID NO: 2070560 - RNA, 17 nt, Homo sapiens
aaauguacaucaguuug

SEQ ID NO: 2070561 - RNA, 20 nt, Homo sapiens
ccuggaaauuaaacccugcc

SEQ ID NO: 2070562 - RNA, 14 nt, Homo sapiens
ggggaacaaccaga

SEQ ID NO: 2070563 - RNA, 13 nt, Homo sapiens
ucagcaacagagc

SEQ ID NO: 2070564 - RNA, 21 nt, Homo sapiens
uguucuguggcugauuuacua

SEQ ID NO: 2070565 - RNA, 20 nt, Homo sapiens
cacaggcuacaguugaacag

SEQ ID NO: 2070566 - RNA, 21 nt, Homo sapiens
aaaauauauuucagauaucag

SEQ ID NO: 2070567 - RNA, 20 nt, Homo sapiens
aggcccauuaguugagaaag

SEQ ID NO: 2070568 - RNA, 15 nt, Homo sapiens
ccagcuuuacugugg

SEQ ID NO: 2070569 - RNA, 19 nt, Homo sapiens
acacuaaauccccucacua

SEQ ID NO: 2070570 - RNA, 15 nt, Homo sapiens
ccacacagacuccac

SEQ ID NO: 2070571 - RNA, 15 nt, Homo sapiens
caggugcuuguucug

SEQ ID NO: 2070572 - RNA, 13 nt, Homo sapiens
ucuggcauuacaa

SEQ ID NO: 2070573 - RNA, 18 nt, Homo sapiens
ucuccaggauuguccaca

SEQ ID NO: 2070574 - RNA, 20 nt, Homo sapiens
aaaucugguccauauuuaca

SEQ ID NO: 2070575 - RNA, 22 nt, Homo sapiens
uauaaagugaucaguaugcugu

SEQ ID NO: 2070576 - RNA, 16 nt, Homo sapiens
ucagcugucaccugcu

SEQ ID NO: 2070577 - RNA, 21 nt, Homo sapiens
gcuaccauuuaucaagcauuu

SEQ ID NO: 2070578 - RNA, 14 nt, Homo sapiens
aacauuuucccaau

SEQ ID NO: 2070579 - RNA, 14 nt, Homo sapiens
aacauguucccaag

SEQ ID NO: 2070580 - RNA, 15 nt, Homo sapiens
cuuugguaaucuuca

SEQ ID NO: 2070581 - RNA, 11 nt, Homo sapiens
gugaaggaaua

SEQ ID NO: 2070582 - RNA, 19 nt, Homo sapiens
uguauuuuuuguaugcuua

SEQ ID NO: 2070583 - RNA, 18 nt, Homo sapiens
caccugguaugugccagg

SEQ ID NO: 2070584 - RNA, 15 nt, Homo sapiens
ccacauauugagaug

SEQ ID NO: 2070585 - RNA, 20 nt, Homo sapiens
uaguuacgaguuuucccuca

SEQ ID NO: 2070586 - RNA, 20 nt, Homo sapiens
ccauagaaaacaaucugccc

SEQ ID NO: 2070587 - RNA, 20 nt, Homo sapiens
caauguauaaccccaaagaa

SEQ ID NO: 2070588 - RNA, 15 nt, Homo sapiens
uggaaaguacuauga

SEQ ID NO: 2070589 - RNA, 20 nt, Homo sapiens
cuccaauggggccagcacug

SEQ ID NO: 2070590 - RNA, 14 nt, Homo sapiens
ucauuaacagugcu

SEQ ID NO: 2070591 - RNA, 15 nt, Homo sapiens
cggccagaagaucua

SEQ ID NO: 2070592 - RNA, 17 nt, Homo sapiens
uauacuuccaugcacuc

SEQ ID NO: 2070593 - RNA, 18 nt, Homo sapiens
aagagccuucacaugaaa

SEQ ID NO: 2070594 - RNA, 23 nt, Homo sapiens
uuccuuaagcagaacuaagcuca

SEQ ID NO: 2070595 - RNA, 14 nt, Homo sapiens
acaaguucuuguug

SEQ ID NO: 2070596 - RNA, 15 nt, Homo sapiens
gcaaaacuacaaugu

SEQ ID NO: 2070597 - RNA, 19 nt, Homo sapiens
uuacuuuuuugguacuaua

SEQ ID NO: 2070598 - RNA, 14 nt, Homo sapiens
uuugaagcaacugu

SEQ ID NO: 2070599 - RNA, 20 nt, Homo sapiens
cuguacaaaauaacucucca

SEQ ID NO: 2070600 - RNA, 18 nt, Homo sapiens
caauucccucuacugugu

SEQ ID NO: 2070601 - RNA, 13 nt, Homo sapiens
uaaugucaucucu

SEQ ID NO: 2070602 - RNA, 15 nt, Homo sapiens
guuauguuugcacuu

SEQ ID NO: 2070603 - RNA, 16 nt, Homo sapiens
ugcuguuuuaaacauu

SEQ ID NO: 2070604 - RNA, 22 nt, Homo sapiens
gauucuuuuuuucugucaguaa

SEQ ID NO: 2070605 - RNA, 14 nt, Homo sapiens
uauaauucuguuuc

SEQ ID NO: 2070606 - RNA, 22 nt, Homo sapiens
cagaugcuuuccugcacauuaa

SEQ ID NO: 2070607 - RNA, 12 nt, Homo sapiens
caaccucaguga

SEQ ID NO: 2070608 - RNA, 12 nt, Homo sapiens
caaacucagugc

SEQ ID NO: 2070609 - RNA, 22 nt, Homo sapiens
gggguucucagacugccaaaga

SEQ ID NO: 2070610 - RNA, 19 nt, Homo sapiens
ucaaaugcccuuccagugg

SEQ ID NO: 2070611 - RNA, 15 nt, Homo sapiens
auccccugccuccau

SEQ ID NO: 2070612 - RNA, 17 nt, Homo sapiens
uguguacaacaaugcuu

SEQ ID NO: 2070613 - RNA, 19 nt, Homo sapiens
auccacgcucaaucucagg

SEQ ID NO: 2070614 - RNA, 20 nt, Homo sapiens
gaggaguggugggugcaguc

SEQ ID NO: 2070615 - RNA, 16 nt, Homo sapiens
aggaaagccaaacacu

SEQ ID NO: 2070616 - RNA, 17 nt, Homo sapiens
cagcucuagcuuugcag

SEQ ID NO: 2070617 - RNA, 13 nt, Homo sapiens
agagagcacuuga

SEQ ID NO: 2070618 - RNA, 23 nt, Homo sapiens
aagcaugucucaauaguaaaaga

SEQ ID NO: 2070619 - RNA, 20 nt, Homo sapiens
uguacaaguauucuaccuaa

SEQ ID NO: 2070620 - RNA, 15 nt, Homo sapiens
uagcgaaucaucuca

SEQ ID NO: 2070621 - RNA, 15 nt, Homo sapiens
uugggccucuuguac

SEQ ID NO: 2070622 - RNA, 14 nt, Homo sapiens
ucugcaucuugggg

SEQ ID NO: 2070623 - RNA, 14 nt, Homo sapiens
auauacaaguagau

SEQ ID NO: 2070624 - RNA, 16 nt, Homo sapiens
gugucccagugucugg

SEQ ID NO: 2070625 - RNA, 19 nt, Homo sapiens
cuuuggaugggucacuugu

SEQ ID NO: 2070626 - RNA, 21 nt, Homo sapiens
uguaacaucacuauccaugca

SEQ ID NO: 2070627 - RNA, 20 nt, Homo sapiens
uugcauuccagccugggcaa

SEQ ID NO: 2070628 - RNA, 15 nt, Homo sapiens
uccuagcaaccucca

SEQ ID NO: 2070629 - RNA, 14 nt, Homo sapiens
ucuccuuugcugag

SEQ ID NO: 2070630 - RNA, 23 nt, Homo sapiens
gaccuuggcugcucacuguccac

SEQ ID NO: 2070631 - RNA, 21 nt, Homo sapiens
cgggcaccaacuccauguuug

SEQ ID NO: 2070632 - RNA, 20 nt, Homo sapiens
aucugaggguauaaagacau

SEQ ID NO: 2070633 - RNA, 22 nt, Homo sapiens
aaggauuacagaaacugaugcc

SEQ ID NO: 2070634 - RNA, 14 nt, Homo sapiens
ccuggcaucugugu

SEQ ID NO: 2070635 - RNA, 21 nt, Homo sapiens
ugagugccugauacugccuga

SEQ ID NO: 2070636 - RNA, 17 nt, Homo sapiens
ccugauacuggguacaa

SEQ ID NO: 2070637 - RNA, 17 nt, Homo sapiens
cugggagaaccucaggc

SEQ ID NO: 2070638 - RNA, 15 nt, Homo sapiens
ucagauuuccacaga

SEQ ID NO: 2070639 - RNA, 17 nt, Homo sapiens
aaaauccagaacucaaa

SEQ ID NO: 2070640 - RNA, 19 nt, Homo sapiens
aaacacacuuuugcacaua

SEQ ID NO: 2070641 - RNA, 16 nt, Homo sapiens
ugcagauagaaagcau

SEQ ID NO: 2070642 - RNA, 20 nt, Homo sapiens
cuaaauuuucugaaacugca

SEQ ID NO: 2070643 - RNA, 19 nt, Homo sapiens
uuccuggaacuugcucuca

SEQ ID NO: 2070644 - RNA, 16 nt, Homo sapiens
ugaucaacauaaugga

SEQ ID NO: 2070645 - RNA, 22 nt, Homo sapiens
uuuuucaaaaacagcuacuuaa

SEQ ID NO: 2070646 - RNA, 16 nt, Homo sapiens
aucuguuaucuaguau

SEQ ID NO: 2070647 - RNA, 21 nt, Homo sapiens
augguuggaaaacacuuucau

SEQ ID NO: 2070648 - RNA, 23 nt, Homo sapiens
guacaagcuggcggccugcagcg

SEQ ID NO: 2070649 - RNA, 13 nt, Homo sapiens
gcacguccuccac

SEQ ID NO: 2070650 - RNA, 17 nt, Homo sapiens
aaggucauggucugagu

SEQ ID NO: 2070651 - RNA, 16 nt, Homo sapiens
caguggauuguuuaua

SEQ ID NO: 2070652 - RNA, 21 nt, Homo sapiens
agaauguacagaaaauagcuu

SEQ ID NO: 2070653 - RNA, 18 nt, Homo sapiens
caauaccagaucacucaa

SEQ ID NO: 2070654 - RNA, 12 nt, Homo sapiens
agccugaucuuu

SEQ ID NO: 2070655 - RNA, 22 nt, Homo sapiens
gacauagcuggaaaauuccuau

SEQ ID NO: 2070656 - RNA, 20 nt, Homo sapiens
caagaaaggagagucuugca

SEQ ID NO: 2070657 - RNA, 15 nt, Homo sapiens
uggggaaaaaacugu

SEQ ID NO: 2070658 - RNA, 18 nt, Homo sapiens
cuuaacuacaguggcuga

SEQ ID NO: 2070659 - RNA, 18 nt, Homo sapiens
gcaggauagagugggaca

SEQ ID NO: 2070660 - RNA, 13 nt, Homo sapiens
aagucuuacuguu

SEQ ID NO: 2070661 - RNA, 21 nt, Homo sapiens
aaggguucugcccugccugag

SEQ ID NO: 2070662 - RNA, 15 nt, Homo sapiens
cugaguauugauaaa

SEQ ID NO: 2070663 - RNA, 14 nt, Homo sapiens
ggcucacaugccac

SEQ ID NO: 2070664 - RNA, 19 nt, Homo sapiens
aggcggagcgccaguggaa

SEQ ID NO: 2070665 - RNA, 15 nt, Homo sapiens
ggccuaacacugggc

SEQ ID NO: 2070666 - RNA, 16 nt, Homo sapiens
uuaucaccccuuccuc

SEQ ID NO: 2070667 - RNA, 15 nt, Homo sapiens
uaauguaauuguaau

SEQ ID NO: 2070668 - RNA, 16 nt, Homo sapiens
ucccacuccuucagga

SEQ ID NO: 2070669 - RNA, 20 nt, Homo sapiens
ccacgugggccucacauucc

SEQ ID NO: 2070670 - RNA, 22 nt, Homo sapiens
cugggccaaguuccucuagugc

SEQ ID NO: 2070671 - RNA, 15 nt, Homo sapiens
cccagacacauucac

SEQ ID NO: 2070672 - RNA, 15 nt, Homo sapiens
agccaguuggugggg

SEQ ID NO: 2070673 - RNA, 20 nt, Homo sapiens
accuagcaaagcuccugccu

SEQ ID NO: 2070674 - RNA, 13 nt, Homo sapiens
aagccacugagca

SEQ ID NO: 2070675 - RNA, 19 nt, Homo sapiens
ugcuacguuccuauuguca

SEQ ID NO: 2070676 - RNA, 17 nt, Homo sapiens
cugagcgggucaugggg

SEQ ID NO: 2070677 - RNA, 18 nt, Homo sapiens
uucuaaugcugauaugau

SEQ ID NO: 2070678 - RNA, 20 nt, Homo sapiens
agaagucagagaaaacacuu

SEQ ID NO: 2070679 - RNA, 13 nt, Homo sapiens
cucccaucagaaa

SEQ ID NO: 2070680 - RNA, 15 nt, Homo sapiens
uauuuauagucacaa

SEQ ID NO: 2070681 - RNA, 21 nt, Homo sapiens
acauaccuaugggauuuuaca

SEQ ID NO: 2070682 - RNA, 19 nt, Homo sapiens
agucuugguaacaaauaac

SEQ ID NO: 2070683 - RNA, 16 nt, Homo sapiens
uucaguuagcaaagag

SEQ ID NO: 2070684 - RNA, 18 nt, Homo sapiens
cuaaccaaggcuguguuu

SEQ ID NO: 2070685 - RNA, 13 nt, Homo sapiens
ccccaggccucca

SEQ ID NO: 2070686 - RNA, 20 nt, Homo sapiens
uuuuuaaagucuucuuucau

SEQ ID NO: 2070687 - RNA, 21 nt, Homo sapiens
gccuccuucccaggacccagg

SEQ ID NO: 2070688 - RNA, 12 nt, Homo sapiens
ccacuaauacug

SEQ ID NO: 2070689 - RNA, 21 nt, Homo sapiens
gagcugcugagggaccuugga

SEQ ID NO: 2070690 - RNA, 19 nt, Homo sapiens
aggaugaauguaugugcac

SEQ ID NO: 2070691 - RNA, 18 nt, Homo sapiens
ugcccgaccccaucucau

SEQ ID NO: 2070692 - RNA, 12 nt, Homo sapiens
ucugaugcucaa

SEQ ID NO: 2070693 - RNA, 12 nt, Homo sapiens
cauaaugccaag

SEQ ID NO: 2070694 - RNA, 20 nt, Homo sapiens
caaguauuacaaccauauau

SEQ ID NO: 2070695 - RNA, 20 nt, Homo sapiens
gauauauucuuuccaugcag

SEQ ID NO: 2070696 - RNA, 18 nt, Homo sapiens
gcaucuagaaagcuuuga

SEQ ID NO: 2070697 - RNA, 15 nt, Homo sapiens
caucagcguaguguu

SEQ ID NO: 2070698 - RNA, 22 nt, Homo sapiens
agcccugacuguguggagcuaa

SEQ ID NO: 2070699 - RNA, 17 nt, Homo sapiens
aggccuucaggacucua

SEQ ID NO: 2070700 - RNA, 18 nt, Homo sapiens
aaagagagaugaaccaca

SEQ ID NO: 2070701 - RNA, 19 nt, Homo sapiens
uguauuuaaaugaaaguga

SEQ ID NO: 2070702 - RNA, 22 nt, Homo sapiens
gucucucuaguugaacccuggg

SEQ ID NO: 2070703 - RNA, 15 nt, Homo sapiens
ucccaucauuacccu

SEQ ID NO: 2070704 - RNA, 15 nt, Homo sapiens
uuaaaaaauaccauu

SEQ ID NO: 2070705 - RNA, 22 nt, Homo sapiens
aucacuuccuauaugcacuuau

SEQ ID NO: 2070706 - RNA, 21 nt, Homo sapiens
aauuucacgacacacuuugau

SEQ ID NO: 2070707 - RNA, 15 nt, Homo sapiens
accauccugccaucc

SEQ ID NO: 2070708 - RNA, 15 nt, Homo sapiens
accaaaaugccaaaa

SEQ ID NO: 2070709 - RNA, 15 nt, Homo sapiens
gcauauauacauaua

SEQ ID NO: 2070710 - RNA, 15 nt, Homo sapiens
auagauauguagaua

SEQ ID NO: 2070711 - RNA, 17 nt, Homo sapiens
uuagacaccuaucagag

SEQ ID NO: 2070712 - RNA, 22 nt, Homo sapiens
auuucuuuucugcauguucuaa

SEQ ID NO: 2070713 - RNA, 20 nt, Homo sapiens
auucauacccacacacccag

SEQ ID NO: 2070714 - RNA, 16 nt, Homo sapiens
auguuuccaccaaaug

SEQ ID NO: 2070715 - RNA, 19 nt, Homo sapiens
gguaauaaucaaauuuaag

SEQ ID NO: 2070716 - RNA, 13 nt, Homo sapiens
uauaccugggaag

SEQ ID NO: 2070717 - RNA, 13 nt, Homo sapiens
uauagcugggaac

SEQ ID NO: 2070718 - RNA, 15 nt, Homo sapiens
ccugcaguuggcaga

SEQ ID NO: 2070719 - RNA, 23 nt, Homo sapiens
agcuucagcaggaggcaagcgug

SEQ ID NO: 2070720 - RNA, 15 nt, Homo sapiens
uggaaauucccuuca

SEQ ID NO: 2070721 - RNA, 23 nt, Homo sapiens
auuaauguuaauucagcacugau

SEQ ID NO: 2070722 - RNA, 13 nt, Homo sapiens
agaggagugcagc

SEQ ID NO: 2070723 - RNA, 24 nt, Homo sapiens
ggguuucaccauguuagccaggcu

SEQ ID NO: 2070724 - RNA, 17 nt, Homo sapiens
caaagaaucuacuggaa

SEQ ID NO: 2070725 - RNA, 17 nt, Homo sapiens
ucccugccaccaggcac

SEQ ID NO: 2070726 - RNA, 17 nt, Homo sapiens
aaauaccagugaaccaa

SEQ ID NO: 2070727 - RNA, 15 nt, Homo sapiens
acuguuuucaucaca

SEQ ID NO: 2070728 - RNA, 22 nt, Homo sapiens
ccaggucucuccacugcucuca

SEQ ID NO: 2070729 - RNA, 17 nt, Homo sapiens
cacccacugacccaacu

SEQ ID NO: 2070730 - RNA, 12 nt, Homo sapiens
ccuaucuggaag

SEQ ID NO: 2070731 - RNA, 18 nt, Homo sapiens
ugucuaaugacagauaaa

SEQ ID NO: 2070732 - RNA, 17 nt, Homo sapiens
gugguaagguguguacu

SEQ ID NO: 2070733 - RNA, 14 nt, Homo sapiens
agaugagggggcca

SEQ ID NO: 2070734 - RNA, 21 nt, Homo sapiens
uucaggcccauuaccuagaaa

SEQ ID NO: 2070735 - RNA, 14 nt, Homo sapiens
guuaaagugaauaa

SEQ ID NO: 2070736 - RNA, 21 nt, Homo sapiens
cugcagccaucccaaggcucc

SEQ ID NO: 2070737 - RNA, 19 nt, Homo sapiens
auuuuuacuaaagcagugu

SEQ ID NO: 2070738 - RNA, 19 nt, Homo sapiens
ucaacccuggagaguucaa

SEQ ID NO: 2070739 - RNA, 11 nt, Homo sapiens
gggagccagcc

SEQ ID NO: 2070740 - RNA, 15 nt, Homo sapiens
cauucagugacaugu

SEQ ID NO: 2070741 - RNA, 23 nt, Homo sapiens
cagauguggaguauuagugacac

SEQ ID NO: 2070742 - RNA, 22 nt, Homo sapiens
uggaaucuauaguauagaauga

SEQ ID NO: 2070743 - RNA, 19 nt, Homo sapiens
cuccaggguggcagcaaca

SEQ ID NO: 2070744 - RNA, 15 nt, Homo sapiens
uuccuauguaacugc

SEQ ID NO: 2070745 - RNA, 18 nt, Homo sapiens
gacuuauucauuccucac

SEQ ID NO: 2070746 - RNA, 15 nt, Homo sapiens
gagucaaaguucaaa

SEQ ID NO: 2070747 - RNA, 17 nt, Homo sapiens
caauuuaacauguguau

SEQ ID NO: 2070748 - RNA, 19 nt, Homo sapiens
accaacccuguuuccugag

SEQ ID NO: 2070749 - RNA, 23 nt, Homo sapiens
acagagcugccucucgguggcca

SEQ ID NO: 2070750 - RNA, 15 nt, Homo sapiens
gcaagguuuccuuuc

SEQ ID NO: 2070751 - RNA, 21 nt, Homo sapiens
uucuaaaucagaaauaggaag

SEQ ID NO: 2070752 - RNA, 15 nt, Homo sapiens
agcagagaacaucug

SEQ ID NO: 2070753 - RNA, 20 nt, Homo sapiens
uucagcucagcuaaugaagu

SEQ ID NO: 2070754 - RNA, 21 nt, Homo sapiens
caggaaguggcucagaccccu

SEQ ID NO: 2070755 - RNA, 16 nt, Homo sapiens
aaguagaaguuacuua

SEQ ID NO: 2070756 - RNA, 15 nt, Homo sapiens
guaccacuuuugcaa

SEQ ID NO: 2070757 - RNA, 19 nt, Homo sapiens
agccauuuuuaaugaucuc

SEQ ID NO: 2070758 - RNA, 19 nt, Homo sapiens
cacaggcccuuuccucagg

SEQ ID NO: 2070759 - RNA, 22 nt, Homo sapiens
cuccucacuggaggagcagcuu

SEQ ID NO: 2070760 - RNA, 17 nt, Homo sapiens
ugacuccccagcccagc

SEQ ID NO: 2070761 - RNA, 13 nt, Homo sapiens
cugccagggccag

SEQ ID NO: 2070762 - RNA, 23 nt, Homo sapiens
auuaaucagaaaccccacuucca

SEQ ID NO: 2070763 - RNA, 21 nt, Homo sapiens
gggcaugaaugagacccagcu

SEQ ID NO: 2070764 - RNA, 21 nt, Homo sapiens
ugugcaccaauuaucaucuuu

SEQ ID NO: 2070765 - RNA, 16 nt, Homo sapiens
aauauacaagcuuuua

SEQ ID NO: 2070766 - RNA, 19 nt, Homo sapiens
gcucugaguuccggcacca

SEQ ID NO: 2070767 - RNA, 16 nt, Homo sapiens
aauauacaacuguaaa

SEQ ID NO: 2070768 - RNA, 21 nt, Homo sapiens
cgaucaguggugucugugaag

SEQ ID NO: 2070769 - RNA, 15 nt, Homo sapiens
aucaucaaguaauac

SEQ ID NO: 2070770 - RNA, 21 nt, Homo sapiens
gauaggucaugcaagugagaa

SEQ ID NO: 2070771 - RNA, 16 nt, Homo sapiens
ccaccaccucaccagu

SEQ ID NO: 2070772 - RNA, 20 nt, Homo sapiens
caagcucuucccuugcucau

SEQ ID NO: 2070773 - RNA, 17 nt, Homo sapiens
gcaaggugcucuugaac

SEQ ID NO: 2070774 - RNA, 23 nt, Homo sapiens
ccucucugcagacuucccagcua

SEQ ID NO: 2070775 - RNA, 14 nt, Homo sapiens
uuauguacuuugau

SEQ ID NO: 2070776 - RNA, 15 nt, Homo sapiens
cagaaaauugcacaa

SEQ ID NO: 2070777 - RNA, 20 nt, Homo sapiens
caagaaaaucagguauuaau

SEQ ID NO: 2070778 - RNA, 18 nt, Homo sapiens
ccagucaauuacauguuu

SEQ ID NO: 2070779 - RNA, 21 nt, Homo sapiens
ccuuccauagccuaaucccug

SEQ ID NO: 2070780 - RNA, 15 nt, Homo sapiens
ggccccaucuccaca

SEQ ID NO: 2070781 - RNA, 13 nt, Homo sapiens
gaccugaacucug

SEQ ID NO: 2070782 - RNA, 23 nt, Homo sapiens
ugcaaacagucucuucuauuucu

SEQ ID NO: 2070783 - RNA, 20 nt, Homo sapiens
aggcaggagaauuacuugaa

SEQ ID NO: 2070784 - RNA, 19 nt, Homo sapiens
cucguugccugccacugag

SEQ ID NO: 2070785 - RNA, 14 nt, Homo sapiens
ccaagccacuagcc

SEQ ID NO: 2070786 - RNA, 19 nt, Homo sapiens
ugaaaacaccaagaguaca

SEQ ID NO: 2070787 - RNA, 13 nt, Homo sapiens
auuaccuauucaa

SEQ ID NO: 2070788 - RNA, 13 nt, Homo sapiens
aucaccuauuuaa

SEQ ID NO: 2070789 - RNA, 20 nt, Homo sapiens
uuuaacuggugaagagaaaa

SEQ ID NO: 2070790 - RNA, 18 nt, Homo sapiens
uauagaagaaaauuuugg

SEQ ID NO: 2070791 - RNA, 15 nt, Homo sapiens
ccucgcccaguccca

SEQ ID NO: 2070792 - RNA, 16 nt, Homo sapiens
auagacggugcucacu

SEQ ID NO: 2070793 - RNA, 19 nt, Homo sapiens
uaagugguaaaauaaucca

SEQ ID NO: 2070794 - RNA, 22 nt, Homo sapiens
aaugagccauuuccauggugcc

SEQ ID NO: 2070795 - RNA, 18 nt, Homo sapiens
gagaaccuaaugcacucu

SEQ ID NO: 2070796 - RNA, 19 nt, Homo sapiens
uuauugcuggaaucuacua

SEQ ID NO: 2070797 - RNA, 21 nt, Homo sapiens
gagggaagaaugaacacuccc

SEQ ID NO: 2070798 - RNA, 22 nt, Homo sapiens
aauauccaagauuuaaaugcca

SEQ ID NO: 2070799 - RNA, 15 nt, Homo sapiens
uucucuuaagauuua

SEQ ID NO: 2070800 - RNA, 21 nt, Homo sapiens
uggcuuggccacaaccugaaa

SEQ ID NO: 2070801 - RNA, 17 nt, Homo sapiens
agaauauaccauuucaa

SEQ ID NO: 2070802 - RNA, 19 nt, Homo sapiens
ggggagccugugguggccu

SEQ ID NO: 2070803 - RNA, 13 nt, Homo sapiens
aagucacccagag

SEQ ID NO: 2070804 - RNA, 21 nt, Homo sapiens
uagccucauaguuauuaucca

SEQ ID NO: 2070805 - RNA, 11 nt, Homo sapiens
augagccauga

SEQ ID NO: 2070806 - RNA, 14 nt, Homo sapiens
auaaaaguugcaaa

SEQ ID NO: 2070807 - RNA, 16 nt, Homo sapiens
ggauuguuacagcuuc

SEQ ID NO: 2070808 - RNA, 22 nt, Homo sapiens
guuuuuaaaaaggucauauauu

SEQ ID NO: 2070809 - RNA, 15 nt, Homo sapiens
uuuucucagugucca

SEQ ID NO: 2070810 - RNA, 19 nt, Homo sapiens
gaaccugaaggugcugaca

SEQ ID NO: 2070811 - RNA, 19 nt, Homo sapiens
agcccauccaaacacugag

SEQ ID NO: 2070812 - RNA, 21 nt, Homo sapiens
gacacaaccacuaauuuguca

SEQ ID NO: 2070813 - RNA, 19 nt, Homo sapiens
agugggacccacagucaca

SEQ ID NO: 2070814 - RNA, 13 nt, Homo sapiens
aaacuacuucuuu

SEQ ID NO: 2070815 - RNA, 15 nt, Homo sapiens
augucuguuggucaa

SEQ ID NO: 2070816 - RNA, 21 nt, Homo sapiens
uuggacucaagcaagauuuca

SEQ ID NO: 2070817 - RNA, 14 nt, Homo sapiens
aucaguguuuuaga

SEQ ID NO: 2070818 - RNA, 11 nt, Homo sapiens
cgguucacucu

SEQ ID NO: 2070819 - RNA, 16 nt, Homo sapiens
aauucuaacuuaaugu

SEQ ID NO: 2070820 - RNA, 18 nt, Homo sapiens
cacugauaauauguuuga

SEQ ID NO: 2070821 - RNA, 19 nt, Homo sapiens
aaccagaaacaccccucug

SEQ ID NO: 2070822 - RNA, 15 nt, Homo sapiens
uauugaccaccaguu

SEQ ID NO: 2070823 - RNA, 20 nt, Homo sapiens
ucucagucacucuaggacuc

SEQ ID NO: 2070824 - RNA, 16 nt, Homo sapiens
acauacugcggaccaa

SEQ ID NO: 2070825 - RNA, 16 nt, Homo sapiens
ccuaagaaacacucau

SEQ ID NO: 2070826 - RNA, 15 nt, Homo sapiens
ugcacucccaccuga

SEQ ID NO: 2070827 - RNA, 19 nt, Homo sapiens
caaguauauaauaugucac

SEQ ID NO: 2070828 - RNA, 20 nt, Homo sapiens
guccacuccuccuacuguau

SEQ ID NO: 2070829 - RNA, 17 nt, Homo sapiens
cucuaggccuguugccu

SEQ ID NO: 2070830 - RNA, 20 nt, Homo sapiens
augaggaggcagaaagcaga

SEQ ID NO: 2070831 - RNA, 18 nt, Homo sapiens
caggaaaaagacuaagcc

SEQ ID NO: 2070832 - RNA, 14 nt, Homo sapiens
cauguguauguguc

SEQ ID NO: 2070833 - RNA, 19 nt, Homo sapiens
gaacaccuauugcacuugg

SEQ ID NO: 2070834 - RNA, 21 nt, Homo sapiens
cuauucgaaugaaaagacaag

SEQ ID NO: 2070835 - RNA, 16 nt, Homo sapiens
gagaaauuucugugaa

SEQ ID NO: 2070836 - RNA, 18 nt, Homo sapiens
ccagggucaaaguacaga

SEQ ID NO: 2070837 - RNA, 19 nt, Homo sapiens
caaugaaaaauguaauuua

SEQ ID NO: 2070838 - RNA, 17 nt, Homo sapiens
guccucaugguacugua

SEQ ID NO: 2070839 - RNA, 19 nt, Homo sapiens
ggauuaugggucacaggaa

SEQ ID NO: 2070840 - RNA, 16 nt, Homo sapiens
uauuuaguucuugagu

SEQ ID NO: 2070841 - RNA, 16 nt, Homo sapiens
aauguaauacuggaau

SEQ ID NO: 2070842 - RNA, 14 nt, Homo sapiens
gucagguucuugcc

SEQ ID NO: 2070843 - RNA, 19 nt, Homo sapiens
gccugcccccagcacuccu

SEQ ID NO: 2070844 - RNA, 15 nt, Homo sapiens
uggccuuaugaccag

SEQ ID NO: 2070845 - RNA, 15 nt, Homo sapiens
ggugaucucaucucc

SEQ ID NO: 2070846 - RNA, 14 nt, Homo sapiens
uaccacucacauga

SEQ ID NO: 2070847 - RNA, 21 nt, Homo sapiens
uccuugugccuucuuuguaua

SEQ ID NO: 2070848 - RNA, 20 nt, Homo sapiens
ccugucauuuuuaacagcau

SEQ ID NO: 2070849 - RNA, 17 nt, Homo sapiens
ccuaaacaucauucauu

SEQ ID NO: 2070850 - RNA, 20 nt, Homo sapiens
agacaauugcauugcuacca

SEQ ID NO: 2070851 - RNA, 21 nt, Homo sapiens
uggucagcugccccaauguga

SEQ ID NO: 2070852 - RNA, 15 nt, Homo sapiens
cuucaugggugguga

SEQ ID NO: 2070853 - RNA, 23 nt, Homo sapiens
gaacuaggagucuucacugcucu

SEQ ID NO: 2070854 - RNA, 19 nt, Homo sapiens
ggcccaguuguccaugaca

SEQ ID NO: 2070855 - RNA, 22 nt, Homo sapiens
caagcuaaaauuagaugaacuc

SEQ ID NO: 2070856 - RNA, 23 nt, Homo sapiens
cagagaugggcaaagcugugcac

SEQ ID NO: 2070857 - RNA, 14 nt, Homo sapiens
caggugaauggagg

SEQ ID NO: 2070858 - RNA, 18 nt, Homo sapiens
gccagcaggcucucaggc

SEQ ID NO: 2070859 - RNA, 20 nt, Homo sapiens
cagauuugggaggccccucc

SEQ ID NO: 2070860 - RNA, 17 nt, Homo sapiens
ucugcuaugucugugau

SEQ ID NO: 2070861 - RNA, 16 nt, Homo sapiens
agccucuauugccaug

SEQ ID NO: 2070862 - RNA, 14 nt, Homo sapiens
ugaggugacacucc

SEQ ID NO: 2070863 - RNA, 16 nt, Homo sapiens
cuuaaugguguuguuu

SEQ ID NO: 2070864 - RNA, 15 nt, Homo sapiens
cuagaaauucuuaag

SEQ ID NO: 2070865 - RNA, 17 nt, Homo sapiens
acuguacaugggacuau

SEQ ID NO: 2070866 - RNA, 23 nt, Homo sapiens
gaugaacaaaucugcaccccacu

SEQ ID NO: 2070867 - RNA, 19 nt, Homo sapiens
aggccauuuggacucugcc

SEQ ID NO: 2070868 - RNA, 18 nt, Homo sapiens
aaauauaaucuaauacac

SEQ ID NO: 2070869 - RNA, 18 nt, Homo sapiens
gugucucaggaaaacagc

SEQ ID NO: 2070870 - RNA, 14 nt, Homo sapiens
gguuggagugcagu

SEQ ID NO: 2070871 - RNA, 12 nt, Homo sapiens
auacaugcucuu

SEQ ID NO: 2070872 - RNA, 18 nt, Homo sapiens
aucucauuucauucucac

SEQ ID NO: 2070873 - RNA, 13 nt, Homo sapiens
gagaggccagcug

SEQ ID NO: 2070874 - RNA, 15 nt, Homo sapiens
auacacauacauaca

SEQ ID NO: 2070875 - RNA, 18 nt, Homo sapiens
gaccgaggacacagugga

SEQ ID NO: 2070876 - RNA, 14 nt, Homo sapiens
caauuucaguguau

SEQ ID NO: 2070877 - RNA, 16 nt, Homo sapiens
uucucaaaaacaaaga

SEQ ID NO: 2070878 - RNA, 21 nt, Homo sapiens
ucaucuguaaaauggagacac

SEQ ID NO: 2070879 - RNA, 13 nt, Homo sapiens
gaaauguuuccag

SEQ ID NO: 2070880 - RNA, 17 nt, Homo sapiens
aucugccuuaaaaccaa

SEQ ID NO: 2070881 - RNA, 19 nt, Homo sapiens
ccagagcuguggacuuugu

SEQ ID NO: 2070882 - RNA, 15 nt, Homo sapiens
ucucagauugggauu

SEQ ID NO: 2070883 - RNA, 12 nt, Homo sapiens
gacuaugcacua

SEQ ID NO: 2070884 - RNA, 15 nt, Homo sapiens
cuuaauauucuggag

SEQ ID NO: 2070885 - RNA, 17 nt, Homo sapiens
uugauuaaccuuuucaa

SEQ ID NO: 2070886 - RNA, 18 nt, Homo sapiens
accuaucaaaaauuauuc

SEQ ID NO: 2070887 - RNA, 19 nt, Homo sapiens
ucaaugugccuuugcauaa

SEQ ID NO: 2070888 - RNA, 14 nt, Homo sapiens
cacaacacaguucu

SEQ ID NO: 2070889 - RNA, 17 nt, Homo sapiens
auuuuguuugcaucuga

SEQ ID NO: 2070890 - RNA, 20 nt, Homo sapiens
gcaucagucugaaagccagg

SEQ ID NO: 2070891 - RNA, 21 nt, Homo sapiens
aagcagaugcaaagaggcaag

SEQ ID NO: 2070892 - RNA, 17 nt, Homo sapiens
ucugcucuguucuggau

SEQ ID NO: 2070893 - RNA, 22 nt, Homo sapiens
gccguccaagaacaagucaccu

SEQ ID NO: 2070894 - RNA, 14 nt, Homo sapiens
caggaagaggccca

SEQ ID NO: 2070895 - RNA, 13 nt, Homo sapiens
gaaaagcacuuua

SEQ ID NO: 2070896 - RNA, 18 nt, Homo sapiens
cuaaaccaaggacugagc

SEQ ID NO: 2070897 - RNA, 14 nt, Homo sapiens
cccacaacuugcca

SEQ ID NO: 2070898 - RNA, 14 nt, Homo sapiens
uugcccaccccacc

SEQ ID NO: 2070899 - RNA, 17 nt, Homo sapiens
auuaauaccugaccuca

SEQ ID NO: 2070900 - RNA, 17 nt, Homo sapiens
accuguuguacacuugg

SEQ ID NO: 2070901 - RNA, 18 nt, Homo sapiens
aagcugcaggcuuugcca

SEQ ID NO: 2070902 - RNA, 11 nt, Homo sapiens
agacagggucu

SEQ ID NO: 2070903 - RNA, 12 nt, Homo sapiens
gacucacacaaa

SEQ ID NO: 2070904 - RNA, 23 nt, Homo sapiens
aauucuaaauaaauuucccaguu

SEQ ID NO: 2070905 - RNA, 21 nt, Homo sapiens
aguagugacacacagacucua

SEQ ID NO: 2070906 - RNA, 22 nt, Homo sapiens
acccacuaucccauuugcccuc

SEQ ID NO: 2070907 - RNA, 13 nt, Homo sapiens
aaaugacuuucaa

SEQ ID NO: 2070908 - RNA, 21 nt, Homo sapiens
uaccucucuccucuccgcgcc

SEQ ID NO: 2070909 - RNA, 22 nt, Homo sapiens
ugcaaaaugucuuaaugcaaau

SEQ ID NO: 2070910 - RNA, 15 nt, Homo sapiens
caaaugaaauguaug

SEQ ID NO: 2070911 - RNA, 16 nt, Homo sapiens
uguaauagugacauau

SEQ ID NO: 2070912 - RNA, 20 nt, Homo sapiens
gacgcagcccugggggccag

SEQ ID NO: 2070913 - RNA, 12 nt, Homo sapiens
ugcccagugugu

SEQ ID NO: 2070914 - RNA, 21 nt, Homo sapiens
cccagauguugcaucccugaa

SEQ ID NO: 2070915 - RNA, 13 nt, Homo sapiens
agagcuaaggcca

SEQ ID NO: 2070916 - RNA, 21 nt, Homo sapiens
ccucuucaggggucaccuccu

SEQ ID NO: 2070917 - RNA, 14 nt, Homo sapiens
cccugauccagaca

SEQ ID NO: 2070918 - RNA, 13 nt, Homo sapiens
cacauguacauaa

SEQ ID NO: 2070919 - RNA, 14 nt, Homo sapiens
gcucuucaucugcc

SEQ ID NO: 2070920 - RNA, 15 nt, Homo sapiens
aucuggcccagggug

SEQ ID NO: 2070921 - RNA, 12 nt, Homo sapiens
uuagcaugcugc

SEQ ID NO: 2070922 - RNA, 20 nt, Homo sapiens
uuucguaacggccuugaucc

SEQ ID NO: 2070923 - RNA, 21 nt, Homo sapiens
uauuuaaggaaucaaaucuua

SEQ ID NO: 2070924 - RNA, 20 nt, Homo sapiens
acucuguaucuccagccacu

SEQ ID NO: 2070925 - RNA, 13 nt, Homo sapiens
cauccacuuuaug

SEQ ID NO: 2070926 - RNA, 21 nt, Homo sapiens
gaggugggcagaucaacugag

SEQ ID NO: 2070927 - RNA, 15 nt, Homo sapiens
aauaauaauuugcac

SEQ ID NO: 2070928 - RNA, 23 nt, Homo sapiens
caggauggcuggaacacuguacu

SEQ ID NO: 2070929 - RNA, 16 nt, Homo sapiens
agaaagauucaauuaa

SEQ ID NO: 2070930 - RNA, 16 nt, Homo sapiens
agucuuuccuaccuug

SEQ ID NO: 2070931 - RNA, 17 nt, Homo sapiens
auuugccagagccaaau

SEQ ID NO: 2070932 - RNA, 16 nt, Homo sapiens
caugcuggcuccugaa

SEQ ID NO: 2070933 - RNA, 15 nt, Homo sapiens
uaucaacugcugcuu

SEQ ID NO: 2070934 - RNA, 15 nt, Homo sapiens
gaaccauccuuccca

SEQ ID NO: 2070935 - RNA, 18 nt, Homo sapiens
ugcaccaacgagcuguac

SEQ ID NO: 2070936 - RNA, 20 nt, Homo sapiens
aaggaggggaaacaaugaaa

SEQ ID NO: 2070937 - RNA, 16 nt, Homo sapiens
cugcagacucauccuu

SEQ ID NO: 2070938 - RNA, 21 nt, Homo sapiens
acagauccugaaagaaagcuu

SEQ ID NO: 2070939 - RNA, 21 nt, Homo sapiens
aucuucacacugguuugccag

SEQ ID NO: 2070940 - RNA, 15 nt, Homo sapiens
cagcucagugccaca

SEQ ID NO: 2070941 - RNA, 14 nt, Homo sapiens
cauccgacugcccc

SEQ ID NO: 2070942 - RNA, 18 nt, Homo sapiens
uucauaauaaacuacaca

SEQ ID NO: 2070943 - RNA, 17 nt, Homo sapiens
ucgaccaggaaagccac

SEQ ID NO: 2070944 - RNA, 22 nt, Homo sapiens
agaugcgugcccagcucuucac

SEQ ID NO: 2070945 - RNA, 16 nt, Homo sapiens
gagagccucgcuuuuu

SEQ ID NO: 2070946 - RNA, 23 nt, Homo sapiens
aagcuguuugucguaacuugaaa

SEQ ID NO: 2070947 - RNA, 17 nt, Homo sapiens
cuaaagagagugagcau

SEQ ID NO: 2070948 - RNA, 13 nt, Homo sapiens
gaugugucuucaa

SEQ ID NO: 2070949 - RNA, 15 nt, Homo sapiens
cucuggggguuuugu

SEQ ID NO: 2070950 - RNA, 15 nt, Homo sapiens
cuguccuggcuacua

SEQ ID NO: 2070951 - RNA, 22 nt, Homo sapiens
auuuccagaaccacacuugaaa

SEQ ID NO: 2070952 - RNA, 16 nt, Homo sapiens
guuuugaauugucaau

SEQ ID NO: 2070953 - RNA, 15 nt, Homo sapiens
gggagagcagagggu

SEQ ID NO: 2070954 - RNA, 22 nt, Homo sapiens
auuuuucaauauauugaacuuu

SEQ ID NO: 2070955 - RNA, 13 nt, Homo sapiens
uauuuaacaugua

SEQ ID NO: 2070956 - RNA, 19 nt, Homo sapiens
uuauguauuuuugucauau

SEQ ID NO: 2070957 - RNA, 21 nt, Homo sapiens
cuccuugcccagacuacaggg

SEQ ID NO: 2070958 - RNA, 15 nt, Homo sapiens
auccccaccuuccaa

SEQ ID NO: 2070959 - RNA, 19 nt, Homo sapiens
ggccaggcaugguggcuca

SEQ ID NO: 2070960 - RNA, 16 nt, Homo sapiens
cugaacgcuucugcuu

SEQ ID NO: 2070961 - RNA, 18 nt, Homo sapiens
gcacguaaaguacuugua

SEQ ID NO: 2070962 - RNA, 19 nt, Homo sapiens
cauccagcaguguugcuca

SEQ ID NO: 2070963 - RNA, 10 nt, Homo sapiens
ccaugccacc

SEQ ID NO: 2070964 - RNA, 19 nt, Homo sapiens
uaaaagacaagcacuuugg

SEQ ID NO: 2070965 - RNA, 13 nt, Homo sapiens
ccagauugcccca

SEQ ID NO: 2070966 - RNA, 16 nt, Homo sapiens
uggagcaugagccagc

SEQ ID NO: 2070967 - RNA, 16 nt, Homo sapiens
cugggccugugcagca

SEQ ID NO: 2070968 - RNA, 16 nt, Homo sapiens
cagggccagagcagcu

SEQ ID NO: 2070969 - RNA, 16 nt, Homo sapiens
ugcuggugccugccac

SEQ ID NO: 2070970 - RNA, 12 nt, Homo sapiens
uaaaucugaaua

SEQ ID NO: 2070971 - RNA, 19 nt, Homo sapiens
uacaagcuacaguugucca

SEQ ID NO: 2070972 - RNA, 23 nt, Homo sapiens
guaaauuaaauuaguucagccau

SEQ ID NO: 2070973 - RNA, 13 nt, Homo sapiens
uggggagggucau

SEQ ID NO: 2070974 - RNA, 17 nt, Homo sapiens
aaaccccagccacuucc

SEQ ID NO: 2070975 - RNA, 12 nt, Homo sapiens
caaaaauguaau

SEQ ID NO: 2070976 - RNA, 20 nt, Homo sapiens
cagaaccucuuccccagaaa

SEQ ID NO: 2070977 - RNA, 12 nt, Homo sapiens
agugcaccacuu

SEQ ID NO: 2070978 - RNA, 22 nt, Homo sapiens
cuuuaucaagggccuacuuuau

SEQ ID NO: 2070979 - RNA, 22 nt, Homo sapiens
acacuuccauaugucauugcua

SEQ ID NO: 2070980 - RNA, 16 nt, Homo sapiens
uaaggagaaaucuaua

SEQ ID NO: 2070981 - RNA, 18 nt, Homo sapiens
acuagccaaaccaggacc

SEQ ID NO: 2070982 - RNA, 15 nt, Homo sapiens
agaacagagucucag

SEQ ID NO: 2070983 - RNA, 21 nt, Homo sapiens
ggcaaucaacaaacguuucuu

SEQ ID NO: 2070984 - RNA, 16 nt, Homo sapiens
cucuacuaaugccucu

SEQ ID NO: 2070985 - RNA, 15 nt, Homo sapiens
aaaaauaguucuaaa

SEQ ID NO: 2070986 - RNA, 24 nt, Homo sapiens
cuuucaacuuaaaucacugaggca

SEQ ID NO: 2070987 - RNA, 21 nt, Homo sapiens
gcaugugaugagaggaaauca

SEQ ID NO: 2070988 - RNA, 20 nt, Homo sapiens
cccaucaaagaaccuugaag

SEQ ID NO: 2070989 - RNA, 17 nt, Homo sapiens
agauucuaaagauucua

SEQ ID NO: 2070990 - RNA, 18 nt, Homo sapiens
auaauuccuacagcacua

SEQ ID NO: 2070991 - RNA, 17 nt, Homo sapiens
aacucacugauucucua

SEQ ID NO: 2070992 - RNA, 16 nt, Homo sapiens
uaagguuucaacaaau

SEQ ID NO: 2070993 - RNA, 21 nt, Homo sapiens
gcaauauaucugaagagcuau

SEQ ID NO: 2070994 - RNA, 23 nt, Homo sapiens
gaucuucuucauccaacuuccaa

SEQ ID NO: 2070995 - RNA, 19 nt, Homo sapiens
agaaagaauuggccaggca

SEQ ID NO: 2070996 - RNA, 16 nt, Homo sapiens
cuguccccuaccccca

SEQ ID NO: 2070997 - RNA, 12 nt, Homo sapiens
acauucugucau

SEQ ID NO: 2070998 - RNA, 23 nt, Homo sapiens
ggccaggugcuuuucccuaucca

SEQ ID NO: 2070999 - RNA, 23 nt, Homo sapiens
uggcuggcuuguuugauuucaac

SEQ ID NO: 2071000 - RNA, 17 nt, Homo sapiens
aagaugaccuuugucuc

SEQ ID NO: 2071001 - RNA, 21 nt, Homo sapiens
agaaacuagaaaugugaauga

SEQ ID NO: 2071002 - RNA, 23 nt, Homo sapiens
acuucaaguauaacaacuuugaa

SEQ ID NO: 2071003 - RNA, 15 nt, Homo sapiens
ccugaagggugcuca

SEQ ID NO: 2071004 - RNA, 22 nt, Homo sapiens
ccuuccagaaauacuacugugu

SEQ ID NO: 2071005 - RNA, 20 nt, Homo sapiens
agauguggucaauggaagaa

SEQ ID NO: 2071006 - RNA, 18 nt, Homo sapiens
cacgucacguguaguguc

SEQ ID NO: 2071007 - RNA, 13 nt, Homo sapiens
aaccagaaggaag

SEQ ID NO: 2071008 - RNA, 22 nt, Homo sapiens
ggccugaggugugugccacuca

SEQ ID NO: 2071009 - RNA, 11 nt, Homo sapiens
agaauuaucuc

SEQ ID NO: 2071010 - RNA, 14 nt, Homo sapiens
agugcuaguauuau

SEQ ID NO: 2071011 - RNA, 15 nt, Homo sapiens
gucaguauguggaag

SEQ ID NO: 2071012 - RNA, 18 nt, Homo sapiens
ccuaaugugaucauauga

SEQ ID NO: 2071013 - RNA, 15 nt, Homo sapiens
gaugucuucaaugga

SEQ ID NO: 2071014 - RNA, 15 nt, Homo sapiens
guccuguacauugug

SEQ ID NO: 2071015 - RNA, 16 nt, Homo sapiens
uauaauugguagccau

SEQ ID NO: 2071016 - RNA, 13 nt, Homo sapiens
acaugugccugua

SEQ ID NO: 2071017 - RNA, 14 nt, Homo sapiens
gacugaagcacagc

SEQ ID NO: 2071018 - RNA, 22 nt, Homo sapiens
caaauucauuuuuuucacugga

SEQ ID NO: 2071019 - RNA, 21 nt, Homo sapiens
gggugcagcugggcuuggccu

SEQ ID NO: 2071020 - RNA, 18 nt, Homo sapiens
aacaucauuacuuaugau

SEQ ID NO: 2071021 - RNA, 13 nt, Homo sapiens
agcagcauuccau

SEQ ID NO: 2071022 - RNA, 14 nt, Homo sapiens
cucacuguugugaa

SEQ ID NO: 2071023 - RNA, 15 nt, Homo sapiens
uaagauuuugugaau

SEQ ID NO: 2071024 - RNA, 12 nt, Homo sapiens
accaucuguaua

SEQ ID NO: 2071025 - RNA, 22 nt, Homo sapiens
aauuuaucccuuuacaauguga

SEQ ID NO: 2071026 - RNA, 15 nt, Homo sapiens
cagccccugggacca

SEQ ID NO: 2071027 - RNA, 12 nt, Homo sapiens
ucugguaacugc

SEQ ID NO: 2071028 - RNA, 11 nt, Homo sapiens
ucggccuucac

SEQ ID NO: 2071029 - RNA, 15 nt, Homo sapiens
guuaauggucaaugc

SEQ ID NO: 2071030 - RNA, 22 nt, Homo sapiens
ucuacaaaaaaugcagaacuua

SEQ ID NO: 2071031 - RNA, 16 nt, Homo sapiens
uggucaccuugcacuc

SEQ ID NO: 2071032 - RNA, 22 nt, Homo sapiens
gagguuccggugucuggaaaag

SEQ ID NO: 2071033 - RNA, 20 nt, Homo sapiens
ucuuaauauuaaauauauga

SEQ ID NO: 2071034 - RNA, 14 nt, Homo sapiens
uaguaacauagaca

SEQ ID NO: 2071035 - RNA, 15 nt, Homo sapiens
uuaaguucacaaccu

SEQ ID NO: 2071036 - RNA, 16 nt, Homo sapiens
acugucccuugccuca

SEQ ID NO: 2071037 - RNA, 23 nt, Homo sapiens
gauucccccagucauucugggaa

SEQ ID NO: 2071038 - RNA, 17 nt, Homo sapiens
caguuaaugccacaaaa

SEQ ID NO: 2071039 - RNA, 22 nt, Homo sapiens
uagauugauuuaccuuuggaau

SEQ ID NO: 2071040 - RNA, 16 nt, Homo sapiens
accacagcacagccaa

SEQ ID NO: 2071041 - RNA, 23 nt, Homo sapiens
aaacugauacccuuugaaaaagu

SEQ ID NO: 2071042 - RNA, 20 nt, Homo sapiens
cuggaacugucucucaugaa

SEQ ID NO: 2071043 - RNA, 19 nt, Homo sapiens
aaaaccuacccucagugag

SEQ ID NO: 2071044 - RNA, 19 nt, Homo sapiens
aggcgauccaccugucuca

SEQ ID NO: 2071045 - RNA, 20 nt, Homo sapiens
caguacucccacaauuggcc

SEQ ID NO: 2071046 - RNA, 10 nt, Homo sapiens
acacauucca

SEQ ID NO: 2071047 - RNA, 20 nt, Homo sapiens
cacugacucaggcugcuccu

SEQ ID NO: 2071048 - RNA, 17 nt, Homo sapiens
acugagaaagccaauga

SEQ ID NO: 2071049 - RNA, 21 nt, Homo sapiens
acucagaggagcugcaaauug

SEQ ID NO: 2071050 - RNA, 13 nt, Homo sapiens
agggaaagugcau

SEQ ID NO: 2071051 - RNA, 20 nt, Homo sapiens
caaggcccaggagaccucca

SEQ ID NO: 2071052 - RNA, 22 nt, Homo sapiens
cagguugugugugugugcagug

SEQ ID NO: 2071053 - RNA, 15 nt, Homo sapiens
agauaagaaggugcg

SEQ ID NO: 2071054 - RNA, 21 nt, Homo sapiens
uucuggacggcccagcagcuc

SEQ ID NO: 2071055 - RNA, 15 nt, Homo sapiens
cacugugagcaccug

SEQ ID NO: 2071056 - RNA, 17 nt, Homo sapiens
acagcuguccugagcua

SEQ ID NO: 2071057 - RNA, 18 nt, Homo sapiens
cauugaucuuuugcuaau

SEQ ID NO: 2071058 - RNA, 16 nt, Homo sapiens
ugaucagcaucuguga

SEQ ID NO: 2071059 - RNA, 18 nt, Homo sapiens
agcccaagggcuccagac

SEQ ID NO: 2071060 - RNA, 21 nt, Homo sapiens
ccagggcugccccuaaucucu

SEQ ID NO: 2071061 - RNA, 18 nt, Homo sapiens
agccucacugcaagcacu

SEQ ID NO: 2071062 - RNA, 12 nt, Homo sapiens
guaaauguuucu

SEQ ID NO: 2071063 - RNA, 16 nt, Homo sapiens
agccuggccaccagcu

SEQ ID NO: 2071064 - RNA, 13 nt, Homo sapiens
cagcaugauuaua

SEQ ID NO: 2071065 - RNA, 18 nt, Homo sapiens
gcccgugcacccuggaag

SEQ ID NO: 2071066 - RNA, 15 nt, Homo sapiens
uaaccccaccuugcc

SEQ ID NO: 2071067 - RNA, 18 nt, Homo sapiens
auugcuaaucaccaaagg

SEQ ID NO: 2071068 - RNA, 11 nt, Homo sapiens
uaacucuuaug

SEQ ID NO: 2071069 - RNA, 20 nt, Homo sapiens
ccuugaguugaguauuacac

SEQ ID NO: 2071070 - RNA, 14 nt, Homo sapiens
ucaacaacugcuac

SEQ ID NO: 2071071 - RNA, 22 nt, Homo sapiens
ucccaucagaaagauucauugg

SEQ ID NO: 2071072 - RNA, 20 nt, Homo sapiens
ggacaauggacuugcaaagc

SEQ ID NO: 2071073 - RNA, 20 nt, Homo sapiens
ugccucuucuuugugccuuu

SEQ ID NO: 2071074 - RNA, 17 nt, Homo sapiens
gcuauggacugcacaaa

SEQ ID NO: 2071075 - RNA, 14 nt, Homo sapiens
uuguuuuucuccac

SEQ ID NO: 2071076 - RNA, 14 nt, Homo sapiens
uaccucuucaguau

SEQ ID NO: 2071077 - RNA, 15 nt, Homo sapiens
uucaaacaaccugcc

SEQ ID NO: 2071078 - RNA, 18 nt, Homo sapiens
cgguaccuggcaauguuu

SEQ ID NO: 2071079 - RNA, 18 nt, Homo sapiens
aguaugaaugacaauuua

SEQ ID NO: 2071080 - RNA, 21 nt, Homo sapiens
aaggauauaaaaggcaaauac

SEQ ID NO: 2071081 - RNA, 12 nt, Homo sapiens
ugaggaccugcg

SEQ ID NO: 2071082 - RNA, 20 nt, Homo sapiens
ucuucauguccagugagcag

SEQ ID NO: 2071083 - RNA, 13 nt, Homo sapiens
ucauuucagccaa

SEQ ID NO: 2071084 - RNA, 15 nt, Homo sapiens
ucacacuggagugaa

SEQ ID NO: 2071085 - RNA, 17 nt, Homo sapiens
uagaguguuguugcuga

SEQ ID NO: 2071086 - RNA, 13 nt, Homo sapiens
uccaccagcagca

SEQ ID NO: 2071087 - RNA, 19 nt, Homo sapiens
acaaugaaggaaaaccuca

SEQ ID NO: 2071088 - RNA, 17 nt, Homo sapiens
gcucccacacccaccuc

SEQ ID NO: 2071089 - RNA, 20 nt, Homo sapiens
aaagugccagaaaguguuua

SEQ ID NO: 2071090 - RNA, 15 nt, Homo sapiens
uuuaaagagaaugua

SEQ ID NO: 2071091 - RNA, 21 nt, Homo sapiens
cagaacacagcaauuccucag

SEQ ID NO: 2071092 - RNA, 17 nt, Homo sapiens
accuuuuucacuguggc

SEQ ID NO: 2071093 - RNA, 18 nt, Homo sapiens
auuggggaagacuguggc

SEQ ID NO: 2071094 - RNA, 23 nt, Homo sapiens
uggggcaugguuuuacagugaau

SEQ ID NO: 2071095 - RNA, 19 nt, Homo sapiens
gcuacuuuauuugccuaaa

SEQ ID NO: 2071096 - RNA, 13 nt, Homo sapiens
aaacaguugacaa

SEQ ID NO: 2071097 - RNA, 19 nt, Homo sapiens
aacaauaaaaaccaaacuc

SEQ ID NO: 2071098 - RNA, 15 nt, Homo sapiens
uacaggugacaguga

SEQ ID NO: 2071099 - RNA, 14 nt, Homo sapiens
aaccucacugagag

SEQ ID NO: 2071100 - RNA, 15 nt, Homo sapiens
gaaggaaaacaugcu

SEQ ID NO: 2071101 - RNA, 14 nt, Homo sapiens
uaacccuacaugca

SEQ ID NO: 2071102 - RNA, 16 nt, Homo sapiens
ucauaccuaucaucuu

SEQ ID NO: 2071103 - RNA, 17 nt, Homo sapiens
auaguguagcugaggag

SEQ ID NO: 2071104 - RNA, 14 nt, Homo sapiens
gccaucccaaaaau

SEQ ID NO: 2071105 - RNA, 20 nt, Homo sapiens
uuugacuguucaaugauuau

SEQ ID NO: 2071106 - RNA, 18 nt, Homo sapiens
gcaguguguccaucauau

SEQ ID NO: 2071107 - RNA, 18 nt, Homo sapiens
gacacuggccccacagga

SEQ ID NO: 2071108 - RNA, 23 nt, Homo sapiens
uuuccaguuaaaauauugcugua

SEQ ID NO: 2071109 - RNA, 15 nt, Homo sapiens
aucuuuucacaaaua

SEQ ID NO: 2071110 - RNA, 11 nt, Homo sapiens
uucaugucucu

SEQ ID NO: 2071111 - RNA, 18 nt, Homo sapiens
gaaacugccaaacuauuu

SEQ ID NO: 2071112 - RNA, 14 nt, Homo sapiens
auuuauacagcaga

SEQ ID NO: 2071113 - RNA, 15 nt, Homo sapiens
uugcaggaaccagca

SEQ ID NO: 2071114 - RNA, 16 nt, Homo sapiens
aacucguuaaagcaaa

SEQ ID NO: 2071115 - RNA, 16 nt, Homo sapiens
uccugauuucagggaa

SEQ ID NO: 2071116 - RNA, 14 nt, Homo sapiens
ccugcugcugccaa

SEQ ID NO: 2071117 - RNA, 22 nt, Homo sapiens
auagcauguucguauuacaaga

SEQ ID NO: 2071118 - RNA, 17 nt, Homo sapiens
aauggcaacaucuugca

SEQ ID NO: 2071119 - RNA, 17 nt, Homo sapiens
ccaaguagcugggacua

SEQ ID NO: 2071120 - RNA, 17 nt, Homo sapiens
uaaaaaguuaaucuuca

SEQ ID NO: 2071121 - RNA, 18 nt, Homo sapiens
auucuuuugccaauguca

SEQ ID NO: 2071122 - RNA, 15 nt, Homo sapiens
accauuacauguuua

SEQ ID NO: 2071123 - RNA, 18 nt, Homo sapiens
ucucauaccucugggaaa

SEQ ID NO: 2071124 - RNA, 19 nt, Homo sapiens
uccugcuuuaaccacccca

SEQ ID NO: 2071125 - RNA, 20 nt, Homo sapiens
accagauccuuuuccagaaa

SEQ ID NO: 2071126 - RNA, 22 nt, Homo sapiens
acacuuaucugucucuucuaca

SEQ ID NO: 2071127 - RNA, 16 nt, Homo sapiens
gucacuggcucuccaa

SEQ ID NO: 2071128 - RNA, 14 nt, Homo sapiens
caaacaaaaccacc

SEQ ID NO: 2071129 - RNA, 16 nt, Homo sapiens
ugcccguaaucccagc

SEQ ID NO: 2071130 - RNA, 15 nt, Homo sapiens
ggcagucuucuuagc

SEQ ID NO: 2071131 - RNA, 17 nt, Homo sapiens
ucagaaugagaaagccu

SEQ ID NO: 2071132 - RNA, 22 nt, Homo sapiens
cugaaaugcuugaaaccagaau

SEQ ID NO: 2071133 - RNA, 21 nt, Homo sapiens
agccugggccccucagccacc

SEQ ID NO: 2071134 - RNA, 17 nt, Homo sapiens
ugcagugagcccagauc

SEQ ID NO: 2071135 - RNA, 17 nt, Homo sapiens
agcaaacgggagaaauu

SEQ ID NO: 2071136 - RNA, 21 nt, Homo sapiens
uucgaccucgucuuucuccau

SEQ ID NO: 2071137 - RNA, 15 nt, Homo sapiens
caccuccgcuugcca

SEQ ID NO: 2071138 - RNA, 18 nt, Homo sapiens
guucccuuacuguuucac

SEQ ID NO: 2071139 - RNA, 23 nt, Homo sapiens
auucaugcagcaaauaugggcug

SEQ ID NO: 2071140 - RNA, 22 nt, Homo sapiens
cugggauuacuggcaugagcca

SEQ ID NO: 2071141 - RNA, 20 nt, Homo sapiens
uaggacaaaugauaaguacu

SEQ ID NO: 2071142 - RNA, 14 nt, Homo sapiens
agagaaccaaaggg

SEQ ID NO: 2071143 - RNA, 22 nt, Homo sapiens
cuaaauuuuauaucuuguagcu

SEQ ID NO: 2071144 - RNA, 13 nt, Homo sapiens
acaugcacucagc

SEQ ID NO: 2071145 - RNA, 13 nt, Homo sapiens
ccacccacaugug

SEQ ID NO: 2071146 - RNA, 21 nt, Homo sapiens
gcaccccuccuauaccauaug

SEQ ID NO: 2071147 - RNA, 16 nt, Homo sapiens
cuauaagcccacuguu

SEQ ID NO: 2071148 - RNA, 13 nt, Homo sapiens
cagagcaucccag

SEQ ID NO: 2071149 - RNA, 11 nt, Homo sapiens
gcuccacugaa

SEQ ID NO: 2071150 - RNA, 19 nt, Homo sapiens
aaaaucccagacuacuuca

SEQ ID NO: 2071151 - RNA, 21 nt, Homo sapiens
guuuuuugaaauuaugugaca

SEQ ID NO: 2071152 - RNA, 21 nt, Homo sapiens
uuucauuugguucauuaauuc

SEQ ID NO: 2071153 - RNA, 22 nt, Homo sapiens
ccaacaguuugaugcugaguca

SEQ ID NO: 2071154 - RNA, 21 nt, Homo sapiens
agcaaagcagcaauuacaugg

SEQ ID NO: 2071155 - RNA, 19 nt, Homo sapiens
uggauagaaaaaugcuguu

SEQ ID NO: 2071156 - RNA, 15 nt, Homo sapiens
gcccuguuagcuuuc

SEQ ID NO: 2071157 - RNA, 20 nt, Homo sapiens
gagaacuccuaggguggcug

SEQ ID NO: 2071158 - RNA, 16 nt, Homo sapiens
caggacuccacuggac

SEQ ID NO: 2071159 - RNA, 14 nt, Homo sapiens
auaugaccaagagu

SEQ ID NO: 2071160 - RNA, 15 nt, Homo sapiens
uacuggucucaggcc

SEQ ID NO: 2071161 - RNA, 19 nt, Homo sapiens
uauagauaacugcauaaau

SEQ ID NO: 2071162 - RNA, 15 nt, Homo sapiens
ggccuggccagucaa

SEQ ID NO: 2071163 - RNA, 16 nt, Homo sapiens
agcuggaccugagcua

SEQ ID NO: 2071164 - RNA, 21 nt, Homo sapiens
aaugcuccuagaguauauucc

SEQ ID NO: 2071165 - RNA, 19 nt, Homo sapiens
uuaagccauaugacaauuu

SEQ ID NO: 2071166 - RNA, 16 nt, Homo sapiens
gcuugggcuuccauuu

SEQ ID NO: 2071167 - RNA, 21 nt, Homo sapiens
uaaauuuugaaaacugugcaa

SEQ ID NO: 2071168 - RNA, 18 nt, Homo sapiens
acacauaguggcuucucc

SEQ ID NO: 2071169 - RNA, 14 nt, Homo sapiens
ugcuacaauucauu

SEQ ID NO: 2071170 - RNA, 15 nt, Homo sapiens
aaaauuuuacuucca

SEQ ID NO: 2071171 - RNA, 15 nt, Homo sapiens
aaaacuuuacuuuca

SEQ ID NO: 2071172 - RNA, 15 nt, Homo sapiens
guuacugauguucaa

SEQ ID NO: 2071173 - RNA, 18 nt, Homo sapiens
agaaauuuucugaucuca

SEQ ID NO: 2071174 - RNA, 21 nt, Homo sapiens
cuggggggcagggaaaacaca

SEQ ID NO: 2071175 - RNA, 21 nt, Homo sapiens
uuaaaucaacgaguacuucaa

SEQ ID NO: 2071176 - RNA, 19 nt, Homo sapiens
caaacaaaaucauggagcu

SEQ ID NO: 2071177 - RNA, 17 nt, Homo sapiens
uugaacuauaacuguug

SEQ ID NO: 2071178 - RNA, 18 nt, Homo sapiens
ccaaggaugacacugcca

SEQ ID NO: 2071179 - RNA, 20 nt, Homo sapiens
auuucagauacuugaagaau

SEQ ID NO: 2071180 - RNA, 15 nt, Homo sapiens
uggccuggcaucugu

SEQ ID NO: 2071181 - RNA, 15 nt, Homo sapiens
aggaacgaacauguu

SEQ ID NO: 2071182 - RNA, 14 nt, Homo sapiens
uaaacaucacuugu

SEQ ID NO: 2071183 - RNA, 18 nt, Homo sapiens
auuagcauuuugcuaaau

SEQ ID NO: 2071184 - RNA, 13 nt, Homo sapiens
ggucagcauguac

SEQ ID NO: 2071185 - RNA, 18 nt, Homo sapiens
uaaauaauguauacacau

SEQ ID NO: 2071186 - RNA, 23 nt, Homo sapiens
ugacacccacccugugccaucac

SEQ ID NO: 2071187 - RNA, 15 nt, Homo sapiens
acaucaagcgaugaa

SEQ ID NO: 2071188 - RNA, 14 nt, Homo sapiens
uuauauugcaagcu

SEQ ID NO: 2071189 - RNA, 20 nt, Homo sapiens
cucgugguaggacuguagaa

SEQ ID NO: 2071190 - RNA, 20 nt, Homo sapiens
gagcugcagucccaugcaca

SEQ ID NO: 2071191 - RNA, 14 nt, Homo sapiens
aaaucuugcaacug

SEQ ID NO: 2071192 - RNA, 13 nt, Homo sapiens
aaucaacuugugg

SEQ ID NO: 2071193 - RNA, 20 nt, Homo sapiens
gacgugcacgcacacugucu

SEQ ID NO: 2071194 - RNA, 13 nt, Homo sapiens
cuccacucugagc

SEQ ID NO: 2071195 - RNA, 20 nt, Homo sapiens
caucauauuuuguugugcac

SEQ ID NO: 2071196 - RNA, 17 nt, Homo sapiens
guaaugcuuguacaguu

SEQ ID NO: 2071197 - RNA, 22 nt, Homo sapiens
gugagcaggguggggucuggga

SEQ ID NO: 2071198 - RNA, 16 nt, Homo sapiens
gggucucucuugcccc

SEQ ID NO: 2071199 - RNA, 18 nt, Homo sapiens
uuauuuacaucacuuugu

SEQ ID NO: 2071200 - RNA, 16 nt, Homo sapiens
cuagaagcugaucuga

SEQ ID NO: 2071201 - RNA, 21 nt, Homo sapiens
uucaaauccucccuacuucca

SEQ ID NO: 2071202 - RNA, 20 nt, Homo sapiens
aggaccagguuugaugccug

SEQ ID NO: 2071203 - RNA, 15 nt, Homo sapiens
ucaaugccaacuuuu

SEQ ID NO: 2071204 - RNA, 15 nt, Homo sapiens
uaccuaccacagugu

SEQ ID NO: 2071205 - RNA, 15 nt, Homo sapiens
guauggaaacacuga

SEQ ID NO: 2071206 - RNA, 17 nt, Homo sapiens
aggugucuggacauuca

SEQ ID NO: 2071207 - RNA, 12 nt, Homo sapiens
cuucuccaguau

SEQ ID NO: 2071208 - RNA, 18 nt, Homo sapiens
uaacuacccucucaaaug

SEQ ID NO: 2071209 - RNA, 22 nt, Homo sapiens
guuaaugcuuuucccacucuca

SEQ ID NO: 2071210 - RNA, 23 nt, Homo sapiens
gaauagugacgcaaaucugcaug

SEQ ID NO: 2071211 - RNA, 22 nt, Homo sapiens
aaccgcauggaacagugcagga

SEQ ID NO: 2071212 - RNA, 17 nt, Homo sapiens
agguggugggacacugg

SEQ ID NO: 2071213 - RNA, 23 nt, Homo sapiens
acaccaaauucuguggcugccau

SEQ ID NO: 2071214 - RNA, 14 nt, Homo sapiens
uggagagugcacau

SEQ ID NO: 2071215 - RNA, 16 nt, Homo sapiens
uccucaguuucucaaa

SEQ ID NO: 2071216 - RNA, 20 nt, Homo sapiens
cucagaauugaucauuuucc

SEQ ID NO: 2071217 - RNA, 16 nt, Homo sapiens
gcacuuauguacuuga

SEQ ID NO: 2071218 - RNA, 15 nt, Homo sapiens
aguggcgcaugccug

SEQ ID NO: 2071219 - RNA, 22 nt, Homo sapiens
uucaaagccauauggacacugu

SEQ ID NO: 2071220 - RNA, 20 nt, Homo sapiens
gggaggcggagguugcagug

SEQ ID NO: 2071221 - RNA, 19 nt, Homo sapiens
aacaggacagcacugggaa

SEQ ID NO: 2071222 - RNA, 21 nt, Homo sapiens
uaaacuugaugccagugggca

SEQ ID NO: 2071223 - RNA, 17 nt, Homo sapiens
agggugcggcugugcag

SEQ ID NO: 2071224 - RNA, 22 nt, Homo sapiens
cccucauugcauuuauugcagu

SEQ ID NO: 2071225 - RNA, 20 nt, Homo sapiens
caguaucuauauauguguau

SEQ ID NO: 2071226 - RNA, 18 nt, Homo sapiens
acagcccugucucaaaac

SEQ ID NO: 2071227 - RNA, 17 nt, Homo sapiens
caagagaaacuuccuag

SEQ ID NO: 2071228 - RNA, 21 nt, Homo sapiens
aacucaaggaaaaguucuuuc

SEQ ID NO: 2071229 - RNA, 21 nt, Homo sapiens
aacucuuggccagagcugagu

SEQ ID NO: 2071230 - RNA, 16 nt, Homo sapiens
uagugccuuuacuuca

SEQ ID NO: 2071231 - RNA, 20 nt, Homo sapiens
gagugcaguggugugaucau

SEQ ID NO: 2071232 - RNA, 17 nt, Homo sapiens
cugugggugcuaagggu

SEQ ID NO: 2071233 - RNA, 14 nt, Homo sapiens
uuuggcucacugca

SEQ ID NO: 2071234 - RNA, 15 nt, Homo sapiens
cuagcccuuacgucc

SEQ ID NO: 2071235 - RNA, 17 nt, Homo sapiens
gcuuaaugcuacaugug

SEQ ID NO: 2071236 - RNA, 13 nt, Homo sapiens
uuagaucagggga

SEQ ID NO: 2071237 - RNA, 19 nt, Homo sapiens
agggauuuuagucacacgu

SEQ ID NO: 2071238 - RNA, 19 nt, Homo sapiens
ccuacuuugacuuuuugca

SEQ ID NO: 2071239 - RNA, 23 nt, Homo sapiens
uaaaggaagcaaguuuucuucca

SEQ ID NO: 2071240 - RNA, 20 nt, Homo sapiens
ggaucuucauggccucagga

SEQ ID NO: 2071241 - RNA, 18 nt, Homo sapiens
ucauucuuucugcuauau

SEQ ID NO: 2071242 - RNA, 11 nt, Homo sapiens
agcaccaaauc

SEQ ID NO: 2071243 - RNA, 11 nt, Homo sapiens
auaaccaaaga

SEQ ID NO: 2071244 - RNA, 18 nt, Homo sapiens
cacauguugcuaaugaca

SEQ ID NO: 2071245 - RNA, 22 nt, Homo sapiens
agaauacuugcacucuuuaaca

SEQ ID NO: 2071246 - RNA, 14 nt, Homo sapiens
gaacgguucuuuga

SEQ ID NO: 2071247 - RNA, 15 nt, Homo sapiens
uggagguuggccaca

SEQ ID NO: 2071248 - RNA, 13 nt, Homo sapiens
gggagagucucac

SEQ ID NO: 2071249 - RNA, 13 nt, Homo sapiens
cgcacagugugag

SEQ ID NO: 2071250 - RNA, 19 nt, Homo sapiens
cccucuaggaggugaugau

SEQ ID NO: 2071251 - RNA, 17 nt, Homo sapiens
uagaaaggcaaaguaca

SEQ ID NO: 2071252 - RNA, 14 nt, Homo sapiens
ucauucacauucag

SEQ ID NO: 2071253 - RNA, 16 nt, Homo sapiens
cugccaaggaugacac

SEQ ID NO: 2071254 - RNA, 19 nt, Homo sapiens
ugauugugugacuauucau

SEQ ID NO: 2071255 - RNA, 10 nt, Homo sapiens
cacauaugaa

SEQ ID NO: 2071256 - RNA, 19 nt, Homo sapiens
ucccaggcuggagugcagu

SEQ ID NO: 2071257 - RNA, 19 nt, Homo sapiens
uugaauuuagcaaccuaga

SEQ ID NO: 2071258 - RNA, 21 nt, Homo sapiens
accauccaggaagaccccagc

SEQ ID NO: 2071259 - RNA, 20 nt, Homo sapiens
ugagaaauuacagguuccuu

SEQ ID NO: 2071260 - RNA, 23 nt, Homo sapiens
cuuaaagccuuuuccugaauugg

SEQ ID NO: 2071261 - RNA, 15 nt, Homo sapiens
gacuggguuacauau

SEQ ID NO: 2071262 - RNA, 19 nt, Homo sapiens
gccaguacuacugcucuca

SEQ ID NO: 2071263 - RNA, 19 nt, Homo sapiens
uaaaauuggauuacaguau

SEQ ID NO: 2071264 - RNA, 21 nt, Homo sapiens
uucauaagauauucuuuacaa

SEQ ID NO: 2071265 - RNA, 22 nt, Homo sapiens
auauugucugaacggcugaaua

SEQ ID NO: 2071266 - RNA, 17 nt, Homo sapiens
uacaauuguuaugaucu

SEQ ID NO: 2071267 - RNA, 15 nt, Homo sapiens
gcauagaauaaugaa

SEQ ID NO: 2071268 - RNA, 15 nt, Homo sapiens
aauacaauguacaau

SEQ ID NO: 2071269 - RNA, 17 nt, Homo sapiens
auuacaggcgugaucca

SEQ ID NO: 2071270 - RNA, 20 nt, Homo sapiens
uauggacaguaaguccagua

SEQ ID NO: 2071271 - RNA, 19 nt, Homo sapiens
uggaggcacccaugccauc

SEQ ID NO: 2071272 - RNA, 21 nt, Homo sapiens
uaugucaggcaaagugcugcu

SEQ ID NO: 2071273 - RNA, 20 nt, Homo sapiens
agccaagauugcaccacugc

SEQ ID NO: 2071274 - RNA, 20 nt, Homo sapiens
agccgagauugcgccacugc

SEQ ID NO: 2071275 - RNA, 20 nt, Homo sapiens
cuggaaaggaggaaggagcc

SEQ ID NO: 2071276 - RNA, 22 nt, Homo sapiens
guagaaggggaggacacuggug

SEQ ID NO: 2071277 - RNA, 15 nt, Homo sapiens
ugacauggcaaguca

SEQ ID NO: 2071278 - RNA, 23 nt, Homo sapiens
aagccucuggcuaccucuguccc

SEQ ID NO: 2071279 - RNA, 13 nt, Homo sapiens
cucuucacagucc

SEQ ID NO: 2071280 - RNA, 18 nt, Homo sapiens
cgcccagcucucccacau

SEQ ID NO: 2071281 - RNA, 18 nt, Homo sapiens
cucucgccuguaaucuca

SEQ ID NO: 2071282 - RNA, 13 nt, Homo sapiens
uaauaauaccuca

SEQ ID NO: 2071283 - RNA, 19 nt, Homo sapiens
acuuuacuuguguuauaua

SEQ ID NO: 2071284 - RNA, 22 nt, Homo sapiens
uuauuuuguugaaauugucaaa

SEQ ID NO: 2071285 - RNA, 18 nt, Homo sapiens
ugcuuuuagcaaccauaa

SEQ ID NO: 2071286 - RNA, 22 nt, Homo sapiens
gggagaugcuucucuccuugcc

SEQ ID NO: 2071287 - RNA, 17 nt, Homo sapiens
uucugcaaccccaggua

SEQ ID NO: 2071288 - RNA, 21 nt, Homo sapiens
aauguauucuuggcuaaagga

SEQ ID NO: 2071289 - RNA, 23 nt, Homo sapiens
gucauccagucuauucacagaag

SEQ ID NO: 2071290 - RNA, 22 nt, Homo sapiens
auauugugauuuuaauuugacc

SEQ ID NO: 2071291 - RNA, 19 nt, Homo sapiens
ugcuccuuggcuuaccuga

SEQ ID NO: 2071292 - RNA, 15 nt, Homo sapiens
uaggaggccuuagca

SEQ ID NO: 2071293 - RNA, 11 nt, Homo sapiens
accuuccacaa

SEQ ID NO: 2071294 - RNA, 18 nt, Homo sapiens
gauaagggugucuuccua

SEQ ID NO: 2071295 - RNA, 21 nt, Homo sapiens
gucuagaacccaggcuucuaa

SEQ ID NO: 2071296 - RNA, 15 nt, Homo sapiens
auuccaccauuguga

SEQ ID NO: 2071297 - RNA, 18 nt, Homo sapiens
cauggaacagugcaggac

SEQ ID NO: 2071298 - RNA, 18 nt, Homo sapiens
cccuuaggaauauacaua

SEQ ID NO: 2071299 - RNA, 12 nt, Homo sapiens
cugggacugugc

SEQ ID NO: 2071300 - RNA, 17 nt, Homo sapiens
uuaagugcauaaagaau

SEQ ID NO: 2071301 - RNA, 20 nt, Homo sapiens
cgagcuguuaccauucacaa

SEQ ID NO: 2071302 - RNA, 20 nt, Homo sapiens
cgcccacccuccugaccgca

SEQ ID NO: 2071303 - RNA, 17 nt, Homo sapiens
cucucaggcugucccaa

SEQ ID NO: 2071304 - RNA, 16 nt, Homo sapiens
cuauaccgagacccac

SEQ ID NO: 2071305 - RNA, 18 nt, Homo sapiens
caucucugucuaguucca

SEQ ID NO: 2071306 - RNA, 11 nt, Homo sapiens
gcuaaccacuu

SEQ ID NO: 2071307 - RNA, 16 nt, Homo sapiens
acccagggcagugugg

SEQ ID NO: 2071308 - RNA, 22 nt, Homo sapiens
acauuuuuaaaagaacaaugac

SEQ ID NO: 2071309 - RNA, 12 nt, Homo sapiens
acagggugcaug

SEQ ID NO: 2071310 - RNA, 22 nt, Homo sapiens
cucuuaguuuuuaaaaaggccu

SEQ ID NO: 2071311 - RNA, 14 nt, Homo sapiens
uggacccccuggaa

SEQ ID NO: 2071312 - RNA, 21 nt, Homo sapiens
ucaauucuauuacgugcaaua

SEQ ID NO: 2071313 - RNA, 15 nt, Homo sapiens
ugcuuagacauuaca

SEQ ID NO: 2071314 - RNA, 13 nt, Homo sapiens
cucuuugcucccu

SEQ ID NO: 2071315 - RNA, 18 nt, Homo sapiens
ggcugggaagaagcugca

SEQ ID NO: 2071316 - RNA, 21 nt, Homo sapiens
uaaagaauacuugaacuuguc

SEQ ID NO: 2071317 - RNA, 13 nt, Homo sapiens
acauugcacuuua

SEQ ID NO: 2071318 - RNA, 16 nt, Homo sapiens
uccaaucuugagauug

SEQ ID NO: 2071319 - RNA, 19 nt, Homo sapiens
gucuuugccagucauucag

SEQ ID NO: 2071320 - RNA, 23 nt, Homo sapiens
ucuauaaguguucaguguugaca

SEQ ID NO: 2071321 - RNA, 13 nt, Homo sapiens
uucagaaagaagu

SEQ ID NO: 2071322 - RNA, 15 nt, Homo sapiens
ugugauuauucugua

SEQ ID NO: 2071323 - RNA, 21 nt, Homo sapiens
agucgaacugggggcuagcca

SEQ ID NO: 2071324 - RNA, 17 nt, Homo sapiens
gacaguggggaaggcau

SEQ ID NO: 2071325 - RNA, 15 nt, Homo sapiens
ccagcucccuucuuc

SEQ ID NO: 2071326 - RNA, 20 nt, Homo sapiens
aaugccaaguuauacacggg

SEQ ID NO: 2071327 - RNA, 13 nt, Homo sapiens
auauaacuuuuuc

SEQ ID NO: 2071328 - RNA, 13 nt, Homo sapiens
ucuaaacuacaac

SEQ ID NO: 2071329 - RNA, 18 nt, Homo sapiens
ucuaugauuguacuuuga

SEQ ID NO: 2071330 - RNA, 13 nt, Homo sapiens
uggcaagugaauu

SEQ ID NO: 2071331 - RNA, 17 nt, Homo sapiens
cagggugccuguccagg

SEQ ID NO: 2071332 - RNA, 21 nt, Homo sapiens
caguuagaaauacauuaugcu

SEQ ID NO: 2071333 - RNA, 18 nt, Homo sapiens
gaaguuaguuuuaguucu

SEQ ID NO: 2071334 - RNA, 14 nt, Homo sapiens
ucacucuguuaaua

SEQ ID NO: 2071335 - RNA, 18 nt, Homo sapiens
ucccuguuuaaugauuga

SEQ ID NO: 2071336 - RNA, 17 nt, Homo sapiens
uauugguguuuacccag

SEQ ID NO: 2071337 - RNA, 21 nt, Homo sapiens
ugcaucaagggcuuuaucaaa

SEQ ID NO: 2071338 - RNA, 13 nt, Homo sapiens
uggaacugccacc

SEQ ID NO: 2071339 - RNA, 19 nt, Homo sapiens
cugaacccuccaaaggaac

SEQ ID NO: 2071340 - RNA, 19 nt, Homo sapiens
agcaagacuucucuuugcc

SEQ ID NO: 2071341 - RNA, 17 nt, Homo sapiens
cuaaaggugguuuuauu

SEQ ID NO: 2071342 - RNA, 20 nt, Homo sapiens
uaugaugauuugcuaucaaa

SEQ ID NO: 2071343 - RNA, 18 nt, Homo sapiens
ccggcuuccacuccccac

SEQ ID NO: 2071344 - RNA, 22 nt, Homo sapiens
gaaccuucuuaacaucacuguc

SEQ ID NO: 2071345 - RNA, 22 nt, Homo sapiens
gauugccccuggcuuugccucu

SEQ ID NO: 2071346 - RNA, 21 nt, Homo sapiens
ccagggccugagccaagcuag

SEQ ID NO: 2071347 - RNA, 13 nt, Homo sapiens
uaaggaaacugcu

SEQ ID NO: 2071348 - RNA, 16 nt, Homo sapiens
gcgaggaccacuuugg

SEQ ID NO: 2071349 - RNA, 12 nt, Homo sapiens
agacaagugauu

SEQ ID NO: 2071350 - RNA, 19 nt, Homo sapiens
uaggcgggaugggcucgcu

SEQ ID NO: 2071351 - RNA, 15 nt, Homo sapiens
agaggauuucugcuu

SEQ ID NO: 2071352 - RNA, 22 nt, Homo sapiens
agugaccccugaccucacugug

SEQ ID NO: 2071353 - RNA, 12 nt, Homo sapiens
ucucauaugauu

SEQ ID NO: 2071354 - RNA, 16 nt, Homo sapiens
cuccugccuugaugaa

SEQ ID NO: 2071355 - RNA, 16 nt, Homo sapiens
gcccuucagccuucaa

SEQ ID NO: 2071356 - RNA, 18 nt, Homo sapiens
agcaugcaauacauacca

SEQ ID NO: 2071357 - RNA, 21 nt, Homo sapiens
aguuucuuggccacugaauua

SEQ ID NO: 2071358 - RNA, 14 nt, Homo sapiens
uauagaacuucaug

SEQ ID NO: 2071359 - RNA, 22 nt, Homo sapiens
agccucuggaauggcucaggga

SEQ ID NO: 2071360 - RNA, 16 nt, Homo sapiens
ggacugagccagaccu

SEQ ID NO: 2071361 - RNA, 17 nt, Homo sapiens
cuguacauguucuuguc

SEQ ID NO: 2071362 - RNA, 13 nt, Homo sapiens
uauccagagagua

SEQ ID NO: 2071363 - RNA, 17 nt, Homo sapiens
cugggaucacaugugga

SEQ ID NO: 2071364 - RNA, 17 nt, Homo sapiens
cuuuucuacgagaugac

SEQ ID NO: 2071365 - RNA, 21 nt, Homo sapiens
acaguuguuaaagucuguucc

SEQ ID NO: 2071366 - RNA, 22 nt, Homo sapiens
gagauagcuuauuacucugaua

SEQ ID NO: 2071367 - RNA, 13 nt, Homo sapiens
aacuaccaggugg

SEQ ID NO: 2071368 - RNA, 18 nt, Homo sapiens
uucugcaccaacucaccu

SEQ ID NO: 2071369 - RNA, 16 nt, Homo sapiens
gcaaauccucuucuaa

SEQ ID NO: 2071370 - RNA, 18 nt, Homo sapiens
augucaguagugccagaa

SEQ ID NO: 2071371 - RNA, 15 nt, Homo sapiens
cugugcagucacugg

SEQ ID NO: 2071372 - RNA, 12 nt, Homo sapiens
agucacuggcag

SEQ ID NO: 2071373 - RNA, 17 nt, Homo sapiens
aagucaugaacacauca

SEQ ID NO: 2071374 - RNA, 18 nt, Homo sapiens
caguauuagaugcacuua

SEQ ID NO: 2071375 - RNA, 20 nt, Homo sapiens
uauauuuauaaaauugcuau

SEQ ID NO: 2071376 - RNA, 15 nt, Homo sapiens
cucuuacacacugga

SEQ ID NO: 2071377 - RNA, 21 nt, Homo sapiens
uggaauccuuucagcaagacu

SEQ ID NO: 2071378 - RNA, 17 nt, Homo sapiens
agcuaguguuaauccag

SEQ ID NO: 2071379 - RNA, 16 nt, Homo sapiens
ccauaaaucaauucau

SEQ ID NO: 2071380 - RNA, 18 nt, Homo sapiens
uaagcuggagugcagugg

SEQ ID NO: 2071381 - RNA, 22 nt, Homo sapiens
agguccugcuccgcugccugga

SEQ ID NO: 2071382 - RNA, 18 nt, Homo sapiens
gacagcucuuacuuuuaa

SEQ ID NO: 2071383 - RNA, 22 nt, Homo sapiens
aggccgggcgcaguggcucacg

SEQ ID NO: 2071384 - RNA, 21 nt, Homo sapiens
ucuguguuuguacugugcagu

SEQ ID NO: 2071385 - RNA, 23 nt, Homo sapiens
ccucagacgagacccaagggcag

SEQ ID NO: 2071386 - RNA, 17 nt, Homo sapiens
uauagccaauauaacua

SEQ ID NO: 2071387 - RNA, 21 nt, Homo sapiens
cuguacaauaaguuacuugaa

SEQ ID NO: 2071388 - RNA, 17 nt, Homo sapiens
ccagagcgguaucucug

SEQ ID NO: 2071389 - RNA, 17 nt, Homo sapiens
uccugucggagcccugu

SEQ ID NO: 2071390 - RNA, 20 nt, Homo sapiens
gaaauuaacucagacacaaa

SEQ ID NO: 2071391 - RNA, 19 nt, Homo sapiens
uuaaugaaugagucuguug

SEQ ID NO: 2071392 - RNA, 16 nt, Homo sapiens
gaauucuagugcugcu

SEQ ID NO: 2071393 - RNA, 14 nt, Homo sapiens
aaaauucacaugau

SEQ ID NO: 2071394 - RNA, 15 nt, Homo sapiens
accuacucuauguau

SEQ ID NO: 2071395 - RNA, 15 nt, Homo sapiens
caaaccuuucuggcc

SEQ ID NO: 2071396 - RNA, 21 nt, Homo sapiens
acugacaagcuccauuuaaac

SEQ ID NO: 2071397 - RNA, 12 nt, Homo sapiens
ugaaugaugcuu

SEQ ID NO: 2071398 - RNA, 22 nt, Homo sapiens
ugcuuaaaagguuaaauuucaa

SEQ ID NO: 2071399 - RNA, 12 nt, Homo sapiens
ucccugcucagu

SEQ ID NO: 2071400 - RNA, 22 nt, Homo sapiens
agagaacaaugugcuaugugaa

SEQ ID NO: 2071401 - RNA, 16 nt, Homo sapiens
cagauuguccuggaac

SEQ ID NO: 2071402 - RNA, 17 nt, Homo sapiens
aaaucugugccugagaa

SEQ ID NO: 2071403 - RNA, 21 nt, Homo sapiens
auuuuucagcuacagcaaaua

SEQ ID NO: 2071404 - RNA, 16 nt, Homo sapiens
cacaucuuguaacuua

SEQ ID NO: 2071405 - RNA, 17 nt, Homo sapiens
augcaacaacauguaua

SEQ ID NO: 2071406 - RNA, 23 nt, Homo sapiens
ggaaauucaaaacaauuggcaaa

SEQ ID NO: 2071407 - RNA, 23 nt, Homo sapiens
cuucaccaagaagcaaaguucaa

SEQ ID NO: 2071408 - RNA, 21 nt, Homo sapiens
auuuuaaguguuuaaaagcaa

SEQ ID NO: 2071409 - RNA, 17 nt, Homo sapiens
aaguaccacacauauug

SEQ ID NO: 2071410 - RNA, 20 nt, Homo sapiens
ugaagccccuuguccucucc

SEQ ID NO: 2071411 - RNA, 18 nt, Homo sapiens
aggggaagucucuuccug

SEQ ID NO: 2071412 - RNA, 21 nt, Homo sapiens
ccacuuuuaacagaacagaca

SEQ ID NO: 2071413 - RNA, 15 nt, Homo sapiens
accccacgcugacca

SEQ ID NO: 2071414 - RNA, 19 nt, Homo sapiens
aaauauguugaguguucau

SEQ ID NO: 2071415 - RNA, 14 nt, Homo sapiens
acacccuggcccag

SEQ ID NO: 2071416 - RNA, 13 nt, Homo sapiens
gaguaacaguaaa

SEQ ID NO: 2071417 - RNA, 22 nt, Homo sapiens
aucacugcaccucuuugucaca

SEQ ID NO: 2071418 - RNA, 17 nt, Homo sapiens
cacauguugcuaaugac

SEQ ID NO: 2071419 - RNA, 22 nt, Homo sapiens
aguccuuucuuuugaaaugcca

SEQ ID NO: 2071420 - RNA, 15 nt, Homo sapiens
ccaaaggaaugucca

SEQ ID NO: 2071421 - RNA, 22 nt, Homo sapiens
uaaaugauuaaaaaaucagaga

SEQ ID NO: 2071422 - RNA, 16 nt, Homo sapiens
gagagcccaaguuauc

SEQ ID NO: 2071423 - RNA, 14 nt, Homo sapiens
accaucuggcagac

SEQ ID NO: 2071424 - RNA, 19 nt, Homo sapiens
acacaguccagacucaaac

SEQ ID NO: 2071425 - RNA, 14 nt, Homo sapiens
cugagcccaaggca

SEQ ID NO: 2071426 - RNA, 20 nt, Homo sapiens
guguaguggcacaaucucag

SEQ ID NO: 2071427 - RNA, 17 nt, Homo sapiens
agcuacuuuugccaaau

SEQ ID NO: 2071428 - RNA, 17 nt, Homo sapiens
ucuccuuugcaguuccu

SEQ ID NO: 2071429 - RNA, 16 nt, Homo sapiens
acguuccauaccccca

SEQ ID NO: 2071430 - RNA, 15 nt, Homo sapiens
aagagugaagagcau

SEQ ID NO: 2071431 - RNA, 16 nt, Homo sapiens
caagcgugauuccugc

SEQ ID NO: 2071432 - RNA, 13 nt, Homo sapiens
cacuggcauuaaa

SEQ ID NO: 2071433 - RNA, 13 nt, Homo sapiens
agcugccucugcu

SEQ ID NO: 2071434 - RNA, 17 nt, Homo sapiens
aaauuguugugcuuaga

SEQ ID NO: 2071435 - RNA, 15 nt, Homo sapiens
auagcaagaucccau

SEQ ID NO: 2071436 - RNA, 20 nt, Homo sapiens
cagauaucuauggcagcaca

SEQ ID NO: 2071437 - RNA, 17 nt, Homo sapiens
caaugcugcuuugguua

SEQ ID NO: 2071438 - RNA, 21 nt, Homo sapiens
uaucaauguuuguccuguaua

SEQ ID NO: 2071439 - RNA, 17 nt, Homo sapiens
caggcugggcccugcau

SEQ ID NO: 2071440 - RNA, 17 nt, Homo sapiens
auuuagucacaccaucu

SEQ ID NO: 2071441 - RNA, 14 nt, Homo sapiens
cccagaacaugaag

SEQ ID NO: 2071442 - RNA, 19 nt, Homo sapiens
cucauuuuagaaccaccaa

SEQ ID NO: 2071443 - RNA, 14 nt, Homo sapiens
uaaaauauuauuua

SEQ ID NO: 2071444 - RNA, 20 nt, Homo sapiens
gcugaagugaaaaaaaaaga

SEQ ID NO: 2071445 - RNA, 18 nt, Homo sapiens
cccgaguaacugagauua

SEQ ID NO: 2071446 - RNA, 16 nt, Homo sapiens
agucacagucacacac

SEQ ID NO: 2071447 - RNA, 15 nt, Homo sapiens
cugauugcauccacu

SEQ ID NO: 2071448 - RNA, 20 nt, Homo sapiens
uucccaguggucaaaccgca

SEQ ID NO: 2071449 - RNA, 21 nt, Homo sapiens
gucugggcucccugcgccuga

SEQ ID NO: 2071450 - RNA, 18 nt, Homo sapiens
cucucccaaguccagugu

SEQ ID NO: 2071451 - RNA, 22 nt, Homo sapiens
cuuguauggcucucaagugaaa

SEQ ID NO: 2071452 - RNA, 17 nt, Homo sapiens
ugcucauugaacuuuaa

SEQ ID NO: 2071453 - RNA, 20 nt, Homo sapiens
gcugcacauccuucuuggcu

SEQ ID NO: 2071454 - RNA, 20 nt, Homo sapiens
cagucccuauguauuugcag

SEQ ID NO: 2071455 - RNA, 14 nt, Homo sapiens
uucaggcuaccuuu

SEQ ID NO: 2071456 - RNA, 18 nt, Homo sapiens
acugaaugaccucucuac

SEQ ID NO: 2071457 - RNA, 21 nt, Homo sapiens
cugcccuccucucccgucucg

SEQ ID NO: 2071458 - RNA, 18 nt, Homo sapiens
aacccggcugacucagug

SEQ ID NO: 2071459 - RNA, 14 nt, Homo sapiens
cucucugccaagau

SEQ ID NO: 2071460 - RNA, 15 nt, Homo sapiens
ugaggcccugugaua

SEQ ID NO: 2071461 - RNA, 13 nt, Homo sapiens
caccuucaccucg

SEQ ID NO: 2071462 - RNA, 17 nt, Homo sapiens
aguaacacucaccauca

SEQ ID NO: 2071463 - RNA, 19 nt, Homo sapiens
aagugauacucccaccucu

SEQ ID NO: 2071464 - RNA, 19 nt, Homo sapiens
ugcucaaugaaaccuuccu

SEQ ID NO: 2071465 - RNA, 19 nt, Homo sapiens
ccccagaggcucagcacuu

SEQ ID NO: 2071466 - RNA, 20 nt, Homo sapiens
gcauagaguauagcucugua

SEQ ID NO: 2071467 - RNA, 11 nt, Homo sapiens
acccucccacu

SEQ ID NO: 2071468 - RNA, 23 nt, Homo sapiens
aggggcuucagguccaggcugug

SEQ ID NO: 2071469 - RNA, 14 nt, Homo sapiens
uccccuccuuccag

SEQ ID NO: 2071470 - RNA, 19 nt, Homo sapiens
ucccagugucaguauuuac

SEQ ID NO: 2071471 - RNA, 23 nt, Homo sapiens
cuuuuaaauucaaauuuuaucuc

SEQ ID NO: 2071472 - RNA, 23 nt, Homo sapiens
ccagagcgguaucucuggcacca

SEQ ID NO: 2071473 - RNA, 14 nt, Homo sapiens
ucuuucuguacaag

SEQ ID NO: 2071474 - RNA, 18 nt, Homo sapiens
uucgaaggagcaguguga

SEQ ID NO: 2071475 - RNA, 17 nt, Homo sapiens
gguggcucacgccugua

SEQ ID NO: 2071476 - RNA, 14 nt, Homo sapiens
uaguggaaagucag

SEQ ID NO: 2071477 - RNA, 22 nt, Homo sapiens
caacaguuugaugcugagucau

SEQ ID NO: 2071478 - RNA, 23 nt, Homo sapiens
acccuggagcccauccagucucc

SEQ ID NO: 2071479 - RNA, 15 nt, Homo sapiens
caaguguacaguauu

SEQ ID NO: 2071480 - RNA, 22 nt, Homo sapiens
cugauuaacugcaagucuucau

SEQ ID NO: 2071481 - RNA, 13 nt, Homo sapiens
aaccaucccugau

SEQ ID NO: 2071482 - RNA, 21 nt, Homo sapiens
ccagaaccuggacauuggcca

SEQ ID NO: 2071483 - RNA, 19 nt, Homo sapiens
uguuccuacucagacuguu

SEQ ID NO: 2071484 - RNA, 17 nt, Homo sapiens
gguucaagugugcacug

SEQ ID NO: 2071485 - RNA, 19 nt, Homo sapiens
gaacuguccacaucugccu

SEQ ID NO: 2071486 - RNA, 18 nt, Homo sapiens
guuuauccuaucucucca

SEQ ID NO: 2071487 - RNA, 14 nt, Homo sapiens
uucauacacguaaa

SEQ ID NO: 2071488 - RNA, 14 nt, Homo sapiens
cugcugagaguacu

SEQ ID NO: 2071489 - RNA, 20 nt, Homo sapiens
gugugcaagugugugcacau

SEQ ID NO: 2071490 - RNA, 17 nt, Homo sapiens
aagggaccuucgugcaa

SEQ ID NO: 2071491 - RNA, 17 nt, Homo sapiens
cugcagcagcagggaaa

SEQ ID NO: 2071492 - RNA, 16 nt, Homo sapiens
aauaugcuuucaucuu

SEQ ID NO: 2071493 - RNA, 12 nt, Homo sapiens
cuccucugaccu

SEQ ID NO: 2071494 - RNA, 22 nt, Homo sapiens
caaacccuuuucauccuggcug

SEQ ID NO: 2071495 - RNA, 16 nt, Homo sapiens
gccccagagccuggga

SEQ ID NO: 2071496 - RNA, 11 nt, Homo sapiens
ggcacauuccc

SEQ ID NO: 2071497 - RNA, 15 nt, Homo sapiens
gacacugagucagaa

SEQ ID NO: 2071498 - RNA, 17 nt, Homo sapiens
uaccgaaguaaacugau

SEQ ID NO: 2071499 - RNA, 22 nt, Homo sapiens
ucucaccugcuggggaccucac

SEQ ID NO: 2071500 - RNA, 19 nt, Homo sapiens
cauuugauaaaauccaaaa

SEQ ID NO: 2071501 - RNA, 19 nt, Homo sapiens
uaggagagagaucaugaga

SEQ ID NO: 2071502 - RNA, 20 nt, Homo sapiens
aaggcggguggaucacuuga

SEQ ID NO: 2071503 - RNA, 14 nt, Homo sapiens
uggcacugcgauca

SEQ ID NO: 2071504 - RNA, 20 nt, Homo sapiens
aguaacaugcauacuuuauu

SEQ ID NO: 2071505 - RNA, 18 nt, Homo sapiens
acuuucagccgacucagc

SEQ ID NO: 2071506 - RNA, 15 nt, Homo sapiens
ugggaacucccaaga

SEQ ID NO: 2071507 - RNA, 20 nt, Homo sapiens
cccuggaaaccuuccaccca

SEQ ID NO: 2071508 - RNA, 20 nt, Homo sapiens
ugauggaaccaaaaaucacu

SEQ ID NO: 2071509 - RNA, 17 nt, Homo sapiens
auguguugcagcuguca

SEQ ID NO: 2071510 - RNA, 18 nt, Homo sapiens
uggaagaacuuguucuaa

SEQ ID NO: 2071511 - RNA, 20 nt, Homo sapiens
agcccgucuucucucucugc

SEQ ID NO: 2071512 - RNA, 21 nt, Homo sapiens
auaagacuacugaaucugcua

SEQ ID NO: 2071513 - RNA, 24 nt, Homo sapiens
uaagaagauuaguuaccauugaaa

SEQ ID NO: 2071514 - RNA, 19 nt, Homo sapiens
ucccugcuuaaauuucucc

SEQ ID NO: 2071515 - RNA, 21 nt, Homo sapiens
caaaacaccagggacacauuu

SEQ ID NO: 2071516 - RNA, 19 nt, Homo sapiens
ccuuccugucccaccucuu

SEQ ID NO: 2071517 - RNA, 20 nt, Homo sapiens
uauuuaacuaugaacugaag

SEQ ID NO: 2071518 - RNA, 18 nt, Homo sapiens
gggcagaucacagguuau

SEQ ID NO: 2071519 - RNA, 21 nt, Homo sapiens
gcugccccaccccuccaugau

SEQ ID NO: 2071520 - RNA, 15 nt, Homo sapiens
ccguuaaaaaaucaa

SEQ ID NO: 2071521 - RNA, 17 nt, Homo sapiens
caugcaaacagguuguu

SEQ ID NO: 2071522 - RNA, 14 nt, Homo sapiens
uaggcacuguucaa

SEQ ID NO: 2071523 - RNA, 18 nt, Homo sapiens
ucuagugucuuuugccuu

SEQ ID NO: 2071524 - RNA, 13 nt, Homo sapiens
uggaaacuaagac

SEQ ID NO: 2071525 - RNA, 21 nt, Homo sapiens
auagggaaguaacauuugccu

SEQ ID NO: 2071526 - RNA, 17 nt, Homo sapiens
gcacucauagggugcuc

SEQ ID NO: 2071527 - RNA, 14 nt, Homo sapiens
uggccaucuguauu

SEQ ID NO: 2071528 - RNA, 16 nt, Homo sapiens
aggggcagauggaaag

SEQ ID NO: 2071529 - RNA, 14 nt, Homo sapiens
cucagucucaggag

SEQ ID NO: 2071530 - RNA, 16 nt, Homo sapiens
aguaagcugcucuauu

SEQ ID NO: 2071531 - RNA, 16 nt, Homo sapiens
cggacccaucuuugcu

SEQ ID NO: 2071532 - RNA, 14 nt, Homo sapiens
aagauugcugaaaa

SEQ ID NO: 2071533 - RNA, 18 nt, Homo sapiens
ugcugggcucuccaccuc

SEQ ID NO: 2071534 - RNA, 20 nt, Homo sapiens
gaagauguuucaaaaaaucu

SEQ ID NO: 2071535 - RNA, 15 nt, Homo sapiens
auaaacugugccaau

SEQ ID NO: 2071536 - RNA, 11 nt, Homo sapiens
uacaagggaag

SEQ ID NO: 2071537 - RNA, 15 nt, Homo sapiens
aacuuaauuaccuaa

SEQ ID NO: 2071538 - RNA, 15 nt, Homo sapiens
uuguaaauaugcaaa

SEQ ID NO: 2071539 - RNA, 18 nt, Homo sapiens
cuacuucugcccuugcca

SEQ ID NO: 2071540 - RNA, 16 nt, Homo sapiens
agacuugauugguuua

SEQ ID NO: 2071541 - RNA, 12 nt, Homo sapiens
auccagcucaag

SEQ ID NO: 2071542 - RNA, 22 nt, Homo sapiens
gaaacucuacauguaacuauuu

SEQ ID NO: 2071543 - RNA, 15 nt, Homo sapiens
aaccuagaucugcac

SEQ ID NO: 2071544 - RNA, 12 nt, Homo sapiens
uucaaacuuuac

SEQ ID NO: 2071545 - RNA, 19 nt, Homo sapiens
caacuugagcauguuacug

SEQ ID NO: 2071546 - RNA, 18 nt, Homo sapiens
acuuaugaaccuuuacau

SEQ ID NO: 2071547 - RNA, 21 nt, Homo sapiens
uaaauugcauuucuaugccau

SEQ ID NO: 2071548 - RNA, 14 nt, Homo sapiens
cuccucggagagca

SEQ ID NO: 2071549 - RNA, 13 nt, Homo sapiens
agaauaugacuuu

SEQ ID NO: 2071550 - RNA, 16 nt, Homo sapiens
aaugauauuguuauau

SEQ ID NO: 2071551 - RNA, 11 nt, Homo sapiens
caugauuuggg

SEQ ID NO: 2071552 - RNA, 18 nt, Homo sapiens
gaagagauccuucuguaa

SEQ ID NO: 2071553 - RNA, 19 nt, Homo sapiens
ggugaugggcucccucccc

SEQ ID NO: 2071554 - RNA, 17 nt, Homo sapiens
uagccauuucacucuca

SEQ ID NO: 2071555 - RNA, 17 nt, Homo sapiens
guggauaucuguguaua

SEQ ID NO: 2071556 - RNA, 15 nt, Homo sapiens
acaaaaccacuggga

SEQ ID NO: 2071557 - RNA, 22 nt, Homo sapiens
uaguaaagacaggguuucacca

SEQ ID NO: 2071558 - RNA, 13 nt, Homo sapiens
acaauccacucuc

SEQ ID NO: 2071559 - RNA, 13 nt, Homo sapiens
cacaugguuguga

SEQ ID NO: 2071560 - RNA, 15 nt, Homo sapiens
cagccaucagacaac

SEQ ID NO: 2071561 - RNA, 13 nt, Homo sapiens
ucuagaagcagaa

SEQ ID NO: 2071562 - RNA, 13 nt, Homo sapiens
ucuugaagcagua

SEQ ID NO: 2071563 - RNA, 18 nt, Homo sapiens
guguggccccagcccgac

SEQ ID NO: 2071564 - RNA, 17 nt, Homo sapiens
gggagacccugggagag

SEQ ID NO: 2071565 - RNA, 15 nt, Homo sapiens
aaauugacagaucaa

SEQ ID NO: 2071566 - RNA, 20 nt, Homo sapiens
uccuaaggccacuguuuuaa

SEQ ID NO: 2071567 - RNA, 12 nt, Homo sapiens
gcuucagaauug

SEQ ID NO: 2071568 - RNA, 20 nt, Homo sapiens
uaguagcugggauuacaggc

SEQ ID NO: 2071569 - RNA, 15 nt, Homo sapiens
aguguggucccucca

SEQ ID NO: 2071570 - RNA, 13 nt, Homo sapiens
ggagcugcugagu

SEQ ID NO: 2071571 - RNA, 22 nt, Homo sapiens
uuaaaauaacuaagcaaguaua

SEQ ID NO: 2071572 - RNA, 17 nt, Homo sapiens
ucacuauauaagucaca

SEQ ID NO: 2071573 - RNA, 13 nt, Homo sapiens
cuggcaggcaaga

SEQ ID NO: 2071574 - RNA, 18 nt, Homo sapiens
gcacagggaacaagcauu

SEQ ID NO: 2071575 - RNA, 14 nt, Homo sapiens
uucuuaacaagaua

SEQ ID NO: 2071576 - RNA, 17 nt, Homo sapiens
ucucccuuccaccucac

SEQ ID NO: 2071577 - RNA, 17 nt, Homo sapiens
caggagaguguauauga

SEQ ID NO: 2071578 - RNA, 19 nt, Homo sapiens
gaaaaauccuuguagaucu

SEQ ID NO: 2071579 - RNA, 19 nt, Homo sapiens
ugaacacucuacuacaugu

SEQ ID NO: 2071580 - RNA, 16 nt, Homo sapiens
uggcaacccucagcug

SEQ ID NO: 2071581 - RNA, 13 nt, Homo sapiens
cucucccaaauaa

SEQ ID NO: 2071582 - RNA, 22 nt, Homo sapiens
uuuuaaaaagcaaaucuuucug

SEQ ID NO: 2071583 - RNA, 16 nt, Homo sapiens
auaauauauuuucaag

SEQ ID NO: 2071584 - RNA, 15 nt, Homo sapiens
auccguuugcaagaa

SEQ ID NO: 2071585 - RNA, 23 nt, Homo sapiens
aguguccucaucuguaaaaugga

SEQ ID NO: 2071586 - RNA, 22 nt, Homo sapiens
uuauaaugaauacuuucuuaga

SEQ ID NO: 2071587 - RNA, 20 nt, Homo sapiens
cucagcuucucaaaguacug

SEQ ID NO: 2071588 - RNA, 19 nt, Homo sapiens
aagugauucuuccaccuca

SEQ ID NO: 2071589 - RNA, 20 nt, Homo sapiens
augauaaguacuacauaccu

SEQ ID NO: 2071590 - RNA, 13 nt, Homo sapiens
ugacugcuuuuaa

SEQ ID NO: 2071591 - RNA, 16 nt, Homo sapiens
gccuaggaacauuuuu

SEQ ID NO: 2071592 - RNA, 13 nt, Homo sapiens
ugauagcacuuuc

SEQ ID NO: 2071593 - RNA, 16 nt, Homo sapiens
ucccaugacccaggcu

SEQ ID NO: 2071594 - RNA, 23 nt, Homo sapiens
cucagugcagcaauauauuacca

SEQ ID NO: 2071595 - RNA, 21 nt, Homo sapiens
agcaccaaaauaaaucaucuu

SEQ ID NO: 2071596 - RNA, 17 nt, Homo sapiens
cagaaggugguuugaca

SEQ ID NO: 2071597 - RNA, 21 nt, Homo sapiens
acauugucaaagcuugccgua

SEQ ID NO: 2071598 - RNA, 20 nt, Homo sapiens
acccuaguuucccugaagga

SEQ ID NO: 2071599 - RNA, 19 nt, Homo sapiens
agacugucucaagagggca

SEQ ID NO: 2071600 - RNA, 19 nt, Homo sapiens
caaaaugucuaagauagua

SEQ ID NO: 2071601 - RNA, 14 nt, Homo sapiens
agucuuaauauaua

SEQ ID NO: 2071602 - RNA, 18 nt, Homo sapiens
uauuaauauaaccauaaa

SEQ ID NO: 2071603 - RNA, 17 nt, Homo sapiens
caaaguccagauaccaa

SEQ ID NO: 2071604 - RNA, 14 nt, Homo sapiens
gccaagggggaccu

SEQ ID NO: 2071605 - RNA, 17 nt, Homo sapiens
acugaaaugaccaagac

SEQ ID NO: 2071606 - RNA, 20 nt, Homo sapiens
gaccugagagcaucucagga

SEQ ID NO: 2071607 - RNA, 15 nt, Homo sapiens
uugggcuugacaccu

SEQ ID NO: 2071608 - RNA, 18 nt, Homo sapiens
agcguuagaggggccagc

SEQ ID NO: 2071609 - RNA, 19 nt, Homo sapiens
uccacuggacagacccagg

SEQ ID NO: 2071610 - RNA, 21 nt, Homo sapiens
ggcaggcaccugggcuuucug

SEQ ID NO: 2071611 - RNA, 21 nt, Homo sapiens
uccagaaacuuuaagaacaaa

SEQ ID NO: 2071612 - RNA, 21 nt, Homo sapiens
gccuuuccugugugagaccca

SEQ ID NO: 2071613 - RNA, 14 nt, Homo sapiens
auaaaugcauuaaa

SEQ ID NO: 2071614 - RNA, 14 nt, Homo sapiens
gcacauauuugaau

SEQ ID NO: 2071615 - RNA, 13 nt, Homo sapiens
augaagcuuuuau

SEQ ID NO: 2071616 - RNA, 13 nt, Homo sapiens
auuaugcuuugaa

SEQ ID NO: 2071617 - RNA, 19 nt, Homo sapiens
ugauggggaaggaguacaa

SEQ ID NO: 2071618 - RNA, 17 nt, Homo sapiens
gccugaccaaaagugag

SEQ ID NO: 2071619 - RNA, 18 nt, Homo sapiens
caaugaugugugcaagua

SEQ ID NO: 2071620 - RNA, 20 nt, Homo sapiens
uuucuacucuuaaguuucuc

SEQ ID NO: 2071621 - RNA, 18 nt, Homo sapiens
cuagucacgcaugcagug

SEQ ID NO: 2071622 - RNA, 22 nt, Homo sapiens
aauaaaaauggcucagaugcca

SEQ ID NO: 2071623 - RNA, 21 nt, Homo sapiens
aauuauguuuugugauucaaa

SEQ ID NO: 2071624 - RNA, 22 nt, Homo sapiens
ucuuugcucauggcaacaguua

SEQ ID NO: 2071625 - RNA, 20 nt, Homo sapiens
acgccagauucuuuccugag

SEQ ID NO: 2071626 - RNA, 20 nt, Homo sapiens
uucuggcacugugacuacua

SEQ ID NO: 2071627 - RNA, 23 nt, Homo sapiens
uacuccaaaacuucguuuaauga

SEQ ID NO: 2071628 - RNA, 17 nt, Homo sapiens
uuuaaauuauacaauga

SEQ ID NO: 2071629 - RNA, 14 nt, Homo sapiens
aaugaaguacucau

SEQ ID NO: 2071630 - RNA, 23 nt, Homo sapiens
cugaggcccucacugagccucaa

SEQ ID NO: 2071631 - RNA, 19 nt, Homo sapiens
gaggcagagucucauucug

SEQ ID NO: 2071632 - RNA, 15 nt, Homo sapiens
ccuugauauuuuucu

SEQ ID NO: 2071633 - RNA, 16 nt, Homo sapiens
ucuauacuuuguucug

SEQ ID NO: 2071634 - RNA, 14 nt, Homo sapiens
ccagugagauauau

SEQ ID NO: 2071635 - RNA, 11 nt, Homo sapiens
uugaaaagccu

SEQ ID NO: 2071636 - RNA, 23 nt, Homo sapiens
aggccacucccagggacccaggg

SEQ ID NO: 2071637 - RNA, 19 nt, Homo sapiens
ccagcuuucccugccucuc

SEQ ID NO: 2071638 - RNA, 13 nt, Homo sapiens
ugaccucaucucc

SEQ ID NO: 2071639 - RNA, 13 nt, Homo sapiens
acuaaucaagaaa

SEQ ID NO: 2071640 - RNA, 19 nt, Homo sapiens
ugaaacuacuacaaugaua

SEQ ID NO: 2071641 - RNA, 16 nt, Homo sapiens
accaugcgacacuggg

SEQ ID NO: 2071642 - RNA, 19 nt, Homo sapiens
gaagucacacaguauuacu

SEQ ID NO: 2071643 - RNA, 13 nt, Homo sapiens
auaaucagugugu

SEQ ID NO: 2071644 - RNA, 23 nt, Homo sapiens
aaacauugcaauaaauggcuuga

SEQ ID NO: 2071645 - RNA, 17 nt, Homo sapiens
gcacacaggaaccuaau

SEQ ID NO: 2071646 - RNA, 23 nt, Homo sapiens
cugagcaccacacccagugggaa

SEQ ID NO: 2071647 - RNA, 14 nt, Homo sapiens
aacuugauuguuga

SEQ ID NO: 2071648 - RNA, 17 nt, Homo sapiens
auauguauaggagcucu

SEQ ID NO: 2071649 - RNA, 20 nt, Homo sapiens
uaccuccuccucuggacaaa

SEQ ID NO: 2071650 - RNA, 15 nt, Homo sapiens
gucuguaaaaccagc

SEQ ID NO: 2071651 - RNA, 14 nt, Homo sapiens
agugugugucuuuc

SEQ ID NO: 2071652 - RNA, 18 nt, Homo sapiens
gacuuugaugcauuucca

SEQ ID NO: 2071653 - RNA, 15 nt, Homo sapiens
gcugagauuacucug

SEQ ID NO: 2071654 - RNA, 22 nt, Homo sapiens
uaccaaaaaucucaauauuuca

SEQ ID NO: 2071655 - RNA, 18 nt, Homo sapiens
cagggcugugucccagau

SEQ ID NO: 2071656 - RNA, 14 nt, Homo sapiens
uaauaugcucucau

SEQ ID NO: 2071657 - RNA, 13 nt, Homo sapiens
gacgcaugcaggg

SEQ ID NO: 2071658 - RNA, 17 nt, Homo sapiens
cacacuaagagggcaga

SEQ ID NO: 2071659 - RNA, 18 nt, Homo sapiens
aaaagauauaagugcugu

SEQ ID NO: 2071660 - RNA, 13 nt, Homo sapiens
acuacaucugccu

SEQ ID NO: 2071661 - RNA, 14 nt, Homo sapiens
auucacaguaauau

SEQ ID NO: 2071662 - RNA, 23 nt, Homo sapiens
acacaguaauggggugagcucac

SEQ ID NO: 2071663 - RNA, 14 nt, Homo sapiens
uaaaagacagugaa

SEQ ID NO: 2071664 - RNA, 14 nt, Homo sapiens
uguaaaacaaagag

SEQ ID NO: 2071665 - RNA, 19 nt, Homo sapiens
cggucaauccuguggguga

SEQ ID NO: 2071666 - RNA, 16 nt, Homo sapiens
ggccagugacauuuca

SEQ ID NO: 2071667 - RNA, 17 nt, Homo sapiens
aaggucgagacauuccu

SEQ ID NO: 2071668 - RNA, 19 nt, Homo sapiens
ugcccccagccucuguccc

SEQ ID NO: 2071669 - RNA, 18 nt, Homo sapiens
uaaaaucaaaugugcauc

SEQ ID NO: 2071670 - RNA, 14 nt, Homo sapiens
gccauccucaccca

SEQ ID NO: 2071671 - RNA, 17 nt, Homo sapiens
uguuaaccguuucagga

SEQ ID NO: 2071672 - RNA, 17 nt, Homo sapiens
cuuguuagaaaugcaaa

SEQ ID NO: 2071673 - RNA, 16 nt, Homo sapiens
agccaucugaagccac

SEQ ID NO: 2071674 - RNA, 22 nt, Homo sapiens
gaaacauccuaugaaauacuuu

SEQ ID NO: 2071675 - RNA, 16 nt, Homo sapiens
ucucugaacaauacaa

SEQ ID NO: 2071676 - RNA, 19 nt, Homo sapiens
gcuuaaggggguguaauga

SEQ ID NO: 2071677 - RNA, 19 nt, Homo sapiens
uguccccucugcaugcccu

SEQ ID NO: 2071678 - RNA, 21 nt, Homo sapiens
cuccucaugaggccaugcaag

SEQ ID NO: 2071679 - RNA, 13 nt, Homo sapiens
caugguggggcca

SEQ ID NO: 2071680 - RNA, 17 nt, Homo sapiens
aaauuuauuuuacacau

SEQ ID NO: 2071681 - RNA, 22 nt, Homo sapiens
uggaagccccaacgggaaagga

SEQ ID NO: 2071682 - RNA, 22 nt, Homo sapiens
uuucauccugguuuccacuguc

SEQ ID NO: 2071683 - RNA, 20 nt, Homo sapiens
gaaaauauagaccuaugaua

SEQ ID NO: 2071684 - RNA, 15 nt, Homo sapiens
ccgggacugggcuag

SEQ ID NO: 2071685 - RNA, 14 nt, Homo sapiens
uuguucacauauau

SEQ ID NO: 2071686 - RNA, 22 nt, Homo sapiens
acuggauguggccccacccuuu

SEQ ID NO: 2071687 - RNA, 14 nt, Homo sapiens
uuggguggggcucc

SEQ ID NO: 2071688 - RNA, 20 nt, Homo sapiens
cuaagaagaaggccagagag

SEQ ID NO: 2071689 - RNA, 18 nt, Homo sapiens
ucccaaaauaacugagaa

SEQ ID NO: 2071690 - RNA, 21 nt, Homo sapiens
gguugcagugagccaagauca

SEQ ID NO: 2071691 - RNA, 13 nt, Homo sapiens
auaaauaugcagu

SEQ ID NO: 2071692 - RNA, 17 nt, Homo sapiens
guagagcccacugcuca

SEQ ID NO: 2071693 - RNA, 23 nt, Homo sapiens
ggccaucugacugccaagccaga

SEQ ID NO: 2071694 - RNA, 19 nt, Homo sapiens
gguagcaauucuacccaga

SEQ ID NO: 2071695 - RNA, 14 nt, Homo sapiens
guuaaucacaggau

SEQ ID NO: 2071696 - RNA, 14 nt, Homo sapiens
gagaagcacuugag

SEQ ID NO: 2071697 - RNA, 16 nt, Homo sapiens
ggccagcccugcagcc

SEQ ID NO: 2071698 - RNA, 17 nt, Homo sapiens
ccuccccagugccucuc

SEQ ID NO: 2071699 - RNA, 13 nt, Homo sapiens
agaagaucuguaa

SEQ ID NO: 2071700 - RNA, 22 nt, Homo sapiens
uuucuccccauuugggacauca

SEQ ID NO: 2071701 - RNA, 20 nt, Homo sapiens
cauaauagcuacagugcaua

SEQ ID NO: 2071702 - RNA, 15 nt, Homo sapiens
caaucagcagucuag

SEQ ID NO: 2071703 - RNA, 18 nt, Homo sapiens
aguaaauaaaaguacaaa

SEQ ID NO: 2071704 - RNA, 22 nt, Homo sapiens
gcuccgggcaaauggcugagau

SEQ ID NO: 2071705 - RNA, 16 nt, Homo sapiens
cagucuuggcucacua

SEQ ID NO: 2071706 - RNA, 23 nt, Homo sapiens
agcguuugcauuugcagugcauc

SEQ ID NO: 2071707 - RNA, 18 nt, Homo sapiens
ugaucaguccaacugaac

SEQ ID NO: 2071708 - RNA, 14 nt, Homo sapiens
gucuuuucucugaa

SEQ ID NO: 2071709 - RNA, 15 nt, Homo sapiens
ugcagaugaggacua

SEQ ID NO: 2071710 - RNA, 21 nt, Homo sapiens
augacuucagugaaauuuuca

SEQ ID NO: 2071711 - RNA, 17 nt, Homo sapiens
aggaaaaaaacuauuaa

SEQ ID NO: 2071712 - RNA, 16 nt, Homo sapiens
ugaaaacccuugccau

SEQ ID NO: 2071713 - RNA, 23 nt, Homo sapiens
ccccaguucaaucucccgcugcu

SEQ ID NO: 2071714 - RNA, 13 nt, Homo sapiens
cucccagggccau

SEQ ID NO: 2071715 - RNA, 13 nt, Homo sapiens
aaugaaccacgug

SEQ ID NO: 2071716 - RNA, 20 nt, Homo sapiens
guccucagguucaauaugaa

SEQ ID NO: 2071717 - RNA, 22 nt, Homo sapiens
gggaggagccuuggaguguaau

SEQ ID NO: 2071718 - RNA, 15 nt, Homo sapiens
caaguagcugcuacc

SEQ ID NO: 2071719 - RNA, 13 nt, Homo sapiens
auaaaacauuaug

SEQ ID NO: 2071720 - RNA, 15 nt, Homo sapiens
cugcaugcccagaga

SEQ ID NO: 2071721 - RNA, 21 nt, Homo sapiens
uggauauguuuucacuguauu

SEQ ID NO: 2071722 - RNA, 18 nt, Homo sapiens
cauauuaacaaauugcau

SEQ ID NO: 2071723 - RNA, 19 nt, Homo sapiens
uaugcuguaaccaaauuau

SEQ ID NO: 2071724 - RNA, 13 nt, Homo sapiens
cuguccgucuguc

SEQ ID NO: 2071725 - RNA, 15 nt, Homo sapiens
cagaauuacccuucc

SEQ ID NO: 2071726 - RNA, 12 nt, Homo sapiens
aaaacagaauuu

SEQ ID NO: 2071727 - RNA, 18 nt, Homo sapiens
accccaaacuguugauua

SEQ ID NO: 2071728 - RNA, 22 nt, Homo sapiens
ugcucagacaugaaauguacau

SEQ ID NO: 2071729 - RNA, 22 nt, Homo sapiens
gugacacugugggucugacuuu

SEQ ID NO: 2071730 - RNA, 14 nt, Homo sapiens
uauauggggggcca

SEQ ID NO: 2071731 - RNA, 18 nt, Homo sapiens
aaguguugcucuuggaaa

SEQ ID NO: 2071732 - RNA, 22 nt, Homo sapiens
agcccacgagcacgagcuggaa

SEQ ID NO: 2071733 - RNA, 23 nt, Homo sapiens
cccaaccugcacggggcauuccu

SEQ ID NO: 2071734 - RNA, 21 nt, Homo sapiens
uugugugugaugugaagccaa

SEQ ID NO: 2071735 - RNA, 20 nt, Homo sapiens
agaugcccuaguugugauca

SEQ ID NO: 2071736 - RNA, 18 nt, Homo sapiens
aauagcuguaguuuuccc

SEQ ID NO: 2071737 - RNA, 20 nt, Homo sapiens
cuggagggcuggaaucugga

SEQ ID NO: 2071738 - RNA, 22 nt, Homo sapiens
gagguuagcccaauggagaaau

SEQ ID NO: 2071739 - RNA, 20 nt, Homo sapiens
guugcaauaucuacauucua

SEQ ID NO: 2071740 - RNA, 21 nt, Homo sapiens
cagagggugggaggggccaug

SEQ ID NO: 2071741 - RNA, 17 nt, Homo sapiens
cucaucccuccaucuca

SEQ ID NO: 2071742 - RNA, 19 nt, Homo sapiens
uaguucuuuguuccugcuu

SEQ ID NO: 2071743 - RNA, 17 nt, Homo sapiens
ucuguuuccuuguucca

SEQ ID NO: 2071744 - RNA, 18 nt, Homo sapiens
ugcagccacugugcugaa

SEQ ID NO: 2071745 - RNA, 10 nt, Homo sapiens
cauugcagag

SEQ ID NO: 2071746 - RNA, 20 nt, Homo sapiens
auuaugcauuauaucaaauc

SEQ ID NO: 2071747 - RNA, 16 nt, Homo sapiens
cacgcuuugcugcuac

SEQ ID NO: 2071748 - RNA, 17 nt, Homo sapiens
cauuugcaaaauggaaa

SEQ ID NO: 2071749 - RNA, 16 nt, Homo sapiens
gaguguggauuguaua

SEQ ID NO: 2071750 - RNA, 14 nt, Homo sapiens
auguccaccaugaa

SEQ ID NO: 2071751 - RNA, 17 nt, Homo sapiens
gguggcuuaccaagauc

SEQ ID NO: 2071752 - RNA, 23 nt, Homo sapiens
aguccuguaguuuuauuuuaugu

SEQ ID NO: 2071753 - RNA, 14 nt, Homo sapiens
uguuaucaguauua

SEQ ID NO: 2071754 - RNA, 20 nt, Homo sapiens
auuucaaggaacagccacaa

SEQ ID NO: 2071755 - RNA, 19 nt, Homo sapiens
agcucauuuggggaccaca

SEQ ID NO: 2071756 - RNA, 20 nt, Homo sapiens
augucucaauggugcuauaa

SEQ ID NO: 2071757 - RNA, 15 nt, Homo sapiens
uauggacucugcaca

SEQ ID NO: 2071758 - RNA, 18 nt, Homo sapiens
aggaagaauuccugccau

SEQ ID NO: 2071759 - RNA, 17 nt, Homo sapiens
caggcacuguucaucuc

SEQ ID NO: 2071760 - RNA, 23 nt, Homo sapiens
ucuuguuuucaaagggacuuuug

SEQ ID NO: 2071761 - RNA, 18 nt, Homo sapiens
augcauauugcccuggag

SEQ ID NO: 2071762 - RNA, 17 nt, Homo sapiens
aaagcucacugcugauc

SEQ ID NO: 2071763 - RNA, 23 nt, Homo sapiens
cagcauaaccccacccuuuacau

SEQ ID NO: 2071764 - RNA, 11 nt, Homo sapiens
aguugccaauc

SEQ ID NO: 2071765 - RNA, 20 nt, Homo sapiens
ugcuuguuuacaaagcaucu

SEQ ID NO: 2071766 - RNA, 20 nt, Homo sapiens
uguacaguuauacauaccuc

SEQ ID NO: 2071767 - RNA, 15 nt, Homo sapiens
cucugaucugaggcu

SEQ ID NO: 2071768 - RNA, 19 nt, Homo sapiens
gaaaugucuggucugucca

SEQ ID NO: 2071769 - RNA, 17 nt, Homo sapiens
ccuugaugagcugugca

SEQ ID NO: 2071770 - RNA, 19 nt, Homo sapiens
cuccucuucacuuggccag

SEQ ID NO: 2071771 - RNA, 18 nt, Homo sapiens
gauuccuuuccuguguga

SEQ ID NO: 2071772 - RNA, 11 nt, Homo sapiens
guugauuuucu

SEQ ID NO: 2071773 - RNA, 14 nt, Homo sapiens
uccucgcagccucu

SEQ ID NO: 2071774 - RNA, 13 nt, Homo sapiens
cugaggaccagcc

SEQ ID NO: 2071775 - RNA, 18 nt, Homo sapiens
guccccaugauucccucc

SEQ ID NO: 2071776 - RNA, 18 nt, Homo sapiens
cacacuuguauauugaaa

SEQ ID NO: 2071777 - RNA, 13 nt, Homo sapiens
uuacgucaaaaca

SEQ ID NO: 2071778 - RNA, 14 nt, Homo sapiens
aagaaaacuggaaa

SEQ ID NO: 2071779 - RNA, 15 nt, Homo sapiens
ccucagcugccucau

SEQ ID NO: 2071780 - RNA, 17 nt, Homo sapiens
acucacuucucuuuuua

SEQ ID NO: 2071781 - RNA, 17 nt, Homo sapiens
cucacuccugaauucag

SEQ ID NO: 2071782 - RNA, 21 nt, Homo sapiens
uauaauaacuuugaagccaua

SEQ ID NO: 2071783 - RNA, 21 nt, Homo sapiens
gggcaugacggcucaugccug

SEQ ID NO: 2071784 - RNA, 17 nt, Homo sapiens
uaacuucagauguuucc

SEQ ID NO: 2071785 - RNA, 13 nt, Homo sapiens
ggguugcgucuca

SEQ ID NO: 2071786 - RNA, 16 nt, Homo sapiens
auuguugggaggacag

SEQ ID NO: 2071787 - RNA, 13 nt, Homo sapiens
ucaaggccuucag

SEQ ID NO: 2071788 - RNA, 18 nt, Homo sapiens
auuuauagcuaugaaacc

SEQ ID NO: 2071789 - RNA, 16 nt, Homo sapiens
ugccggaugcaggaag

SEQ ID NO: 2071790 - RNA, 20 nt, Homo sapiens
aggcuugacagagucugccc

SEQ ID NO: 2071791 - RNA, 16 nt, Homo sapiens
aauaacaaacuaguca

SEQ ID NO: 2071792 - RNA, 16 nt, Homo sapiens
aauuuuuugugaugaa

SEQ ID NO: 2071793 - RNA, 16 nt, Homo sapiens
gagcccacugcaguua

SEQ ID NO: 2071794 - RNA, 23 nt, Homo sapiens
agccacuguaugauucucuuaau

SEQ ID NO: 2071795 - RNA, 17 nt, Homo sapiens
ccagaacuuucuuucac

SEQ ID NO: 2071796 - RNA, 20 nt, Homo sapiens
ugaggaugauguuauucaca

SEQ ID NO: 2071797 - RNA, 16 nt, Homo sapiens
ccuuggccucugcuaa

SEQ ID NO: 2071798 - RNA, 23 nt, Homo sapiens
auuucccugggggcauccugcuu

SEQ ID NO: 2071799 - RNA, 17 nt, Homo sapiens
agacacauucacacugg

SEQ ID NO: 2071800 - RNA, 20 nt, Homo sapiens
gcuaagaauagauggaagac

SEQ ID NO: 2071801 - RNA, 10 nt, Homo sapiens
cccaaacuuu

SEQ ID NO: 2071802 - RNA, 21 nt, Homo sapiens
cagauggcaggaugggcacug

SEQ ID NO: 2071803 - RNA, 16 nt, Homo sapiens
ggaagcccucucagau

SEQ ID NO: 2071804 - RNA, 21 nt, Homo sapiens
gucagcuuuuugauccucuac

SEQ ID NO: 2071805 - RNA, 12 nt, Homo sapiens
auggaagcaucu

SEQ ID NO: 2071806 - RNA, 19 nt, Homo sapiens
agccuagcacagcagcuua

SEQ ID NO: 2071807 - RNA, 13 nt, Homo sapiens
gggcugagccaug

SEQ ID NO: 2071808 - RNA, 11 nt, Homo sapiens
auauguuacaa

SEQ ID NO: 2071809 - RNA, 18 nt, Homo sapiens
acucugacgcaaaaccac

SEQ ID NO: 2071810 - RNA, 21 nt, Homo sapiens
aacccaggaguucagggucau

SEQ ID NO: 2071811 - RNA, 18 nt, Homo sapiens
ugauacuccaccagugaa

SEQ ID NO: 2071812 - RNA, 20 nt, Homo sapiens
agucuccaugcaagauuucu

SEQ ID NO: 2071813 - RNA, 16 nt, Homo sapiens
gcaagucccuuuguga

SEQ ID NO: 2071814 - RNA, 21 nt, Homo sapiens
gggaagaugcccucaacucac

SEQ ID NO: 2071815 - RNA, 15 nt, Homo sapiens
ugacugucucacuua

SEQ ID NO: 2071816 - RNA, 16 nt, Homo sapiens
gccuuaucaaauaaua

SEQ ID NO: 2071817 - RNA, 14 nt, Homo sapiens
uuuaaaauagcaaa

SEQ ID NO: 2071818 - RNA, 19 nt, Homo sapiens
ucuuuaccuaauggucucu

SEQ ID NO: 2071819 - RNA, 22 nt, Homo sapiens
uaaaaucuguauugcuaagaua

SEQ ID NO: 2071820 - RNA, 22 nt, Homo sapiens
uucuuuuguguuccuauggaaa

SEQ ID NO: 2071821 - RNA, 15 nt, Homo sapiens
gagagaggacuggag

SEQ ID NO: 2071822 - RNA, 16 nt, Homo sapiens
aauaaugaacacuaca

SEQ ID NO: 2071823 - RNA, 15 nt, Homo sapiens
ucgccuuagcacuac

SEQ ID NO: 2071824 - RNA, 13 nt, Homo sapiens
aguaggugggucu

SEQ ID NO: 2071825 - RNA, 13 nt, Homo sapiens
uuuucauugggaa

SEQ ID NO: 2071826 - RNA, 23 nt, Homo sapiens
acaggaaaggccccaaucuugcc

SEQ ID NO: 2071827 - RNA, 13 nt, Homo sapiens
acaguugccaugu

SEQ ID NO: 2071828 - RNA, 13 nt, Homo sapiens
aaacaugcccuca

SEQ ID NO: 2071829 - RNA, 19 nt, Homo sapiens
cugccuggaaaguccuccu

SEQ ID NO: 2071830 - RNA, 22 nt, Homo sapiens
aauaaaacaccuuguacuuuau

SEQ ID NO: 2071831 - RNA, 17 nt, Homo sapiens
ugccuggugugccucag

SEQ ID NO: 2071832 - RNA, 20 nt, Homo sapiens
acgagugcucucggcccaac

SEQ ID NO: 2071833 - RNA, 14 nt, Homo sapiens
aaauaguaauguga

SEQ ID NO: 2071834 - RNA, 23 nt, Homo sapiens
acucccagcgcuggcuccaggcu

SEQ ID NO: 2071835 - RNA, 21 nt, Homo sapiens
cuguauuaauuauaccagugu

SEQ ID NO: 2071836 - RNA, 22 nt, Homo sapiens
gaauacuuggaccucagccaac

SEQ ID NO: 2071837 - RNA, 13 nt, Homo sapiens
acaucaagcacag

SEQ ID NO: 2071838 - RNA, 12 nt, Homo sapiens
uuuuacuuucag

SEQ ID NO: 2071839 - RNA, 22 nt, Homo sapiens
ccaugcuuaucccucucucuac

SEQ ID NO: 2071840 - RNA, 13 nt, Homo sapiens
uaccgcuuaucag

SEQ ID NO: 2071841 - RNA, 23 nt, Homo sapiens
gaggccugaaauguuuccaggca

SEQ ID NO: 2071842 - RNA, 13 nt, Homo sapiens
ggacacaagaacu

SEQ ID NO: 2071843 - RNA, 17 nt, Homo sapiens
gaagagagagacccuca

SEQ ID NO: 2071844 - RNA, 21 nt, Homo sapiens
uagugacauuuaaugccaucu

SEQ ID NO: 2071845 - RNA, 23 nt, Homo sapiens
uuucucucuggaaaggauuuuca

SEQ ID NO: 2071846 - RNA, 11 nt, Homo sapiens
aaaucuauucc

SEQ ID NO: 2071847 - RNA, 22 nt, Homo sapiens
agauagauccauuuggacaaaa

SEQ ID NO: 2071848 - RNA, 19 nt, Homo sapiens
agauuauaaguuugacaca

SEQ ID NO: 2071849 - RNA, 17 nt, Homo sapiens
uggaaaaaccauuugaa

SEQ ID NO: 2071850 - RNA, 15 nt, Homo sapiens
gcagccaagggauga

SEQ ID NO: 2071851 - RNA, 20 nt, Homo sapiens
caccugcccaagaaacaccg

SEQ ID NO: 2071852 - RNA, 22 nt, Homo sapiens
aaguugcugggauuacaggugu

SEQ ID NO: 2071853 - RNA, 23 nt, Homo sapiens
agccgagaucgcgccacugcacu

SEQ ID NO: 2071854 - RNA, 22 nt, Homo sapiens
gagagcccccaccuugauccca

SEQ ID NO: 2071855 - RNA, 21 nt, Homo sapiens
gaggagcuggccugcggugga

SEQ ID NO: 2071856 - RNA, 18 nt, Homo sapiens
uauuuuaugaucuuggcu

SEQ ID NO: 2071857 - RNA, 20 nt, Homo sapiens
aaacugcgaggacaucaaag

SEQ ID NO: 2071858 - RNA, 12 nt, Homo sapiens
gugcaucuggcc

SEQ ID NO: 2071859 - RNA, 17 nt, Homo sapiens
caugaggaaucugggag

SEQ ID NO: 2071860 - RNA, 20 nt, Homo sapiens
ccuacugucccucucagugc

SEQ ID NO: 2071861 - RNA, 17 nt, Homo sapiens
cagucuuccaccuggaa

SEQ ID NO: 2071862 - RNA, 20 nt, Homo sapiens
cacagcacuaacacaugcac

SEQ ID NO: 2071863 - RNA, 18 nt, Homo sapiens
cuccaggcccaaggcucc

SEQ ID NO: 2071864 - RNA, 17 nt, Homo sapiens
cuaaggccaaugggcua

SEQ ID NO: 2071865 - RNA, 19 nt, Homo sapiens
uaaaaucuuggcacagaaa

SEQ ID NO: 2071866 - RNA, 18 nt, Homo sapiens
aucuugaugucuaugaua

SEQ ID NO: 2071867 - RNA, 22 nt, Homo sapiens
acagacaauaauuuaacaagcu

SEQ ID NO: 2071868 - RNA, 18 nt, Homo sapiens
cuggugggugguguccug

SEQ ID NO: 2071869 - RNA, 20 nt, Homo sapiens
gaauugaacgacuguauauu

SEQ ID NO: 2071870 - RNA, 20 nt, Homo sapiens
auuaaaccaaggagucugau

SEQ ID NO: 2071871 - RNA, 14 nt, Homo sapiens
ggccucugcaaagg

SEQ ID NO: 2071872 - RNA, 22 nt, Homo sapiens
acuccagccugagugacagagc

SEQ ID NO: 2071873 - RNA, 23 nt, Homo sapiens
augccaauuucucuuaaguacug

SEQ ID NO: 2071874 - RNA, 14 nt, Homo sapiens
agccuugcacuagg

SEQ ID NO: 2071875 - RNA, 22 nt, Homo sapiens
gcuauuucagcaacaaccaucu

SEQ ID NO: 2071876 - RNA, 15 nt, Homo sapiens
guagauucccuugca

SEQ ID NO: 2071877 - RNA, 16 nt, Homo sapiens
ccuugccuagcccuuu

SEQ ID NO: 2071878 - RNA, 20 nt, Homo sapiens
uccuaaagcaugggaucuca

SEQ ID NO: 2071879 - RNA, 17 nt, Homo sapiens
cagaaucaguguuaaau

SEQ ID NO: 2071880 - RNA, 19 nt, Homo sapiens
cccaaguuccaaaagcaca

SEQ ID NO: 2071881 - RNA, 16 nt, Homo sapiens
uugauauuugcauuga

SEQ ID NO: 2071882 - RNA, 19 nt, Homo sapiens
acaguccaaacuguucuga

SEQ ID NO: 2071883 - RNA, 14 nt, Homo sapiens
augguagcauuuua

SEQ ID NO: 2071884 - RNA, 13 nt, Homo sapiens
guuuggccaaaaa

SEQ ID NO: 2071885 - RNA, 21 nt, Homo sapiens
aaauguggaauugacugccua

SEQ ID NO: 2071886 - RNA, 17 nt, Homo sapiens
acccuuaucaccagcug

SEQ ID NO: 2071887 - RNA, 21 nt, Homo sapiens
agagaaggggauuaccuugua

SEQ ID NO: 2071888 - RNA, 21 nt, Homo sapiens
gaaaacuaggcaauguacucu

SEQ ID NO: 2071889 - RNA, 18 nt, Homo sapiens
acaagaaagucaauguca

SEQ ID NO: 2071890 - RNA, 18 nt, Homo sapiens
gccaucaucagcuuaauu

SEQ ID NO: 2071891 - RNA, 14 nt, Homo sapiens
gccgcauggcacuc

SEQ ID NO: 2071892 - RNA, 24 nt, Homo sapiens
caacauuccaagaauagcaucugu

SEQ ID NO: 2071893 - RNA, 22 nt, Homo sapiens
aaucaacaaaauggucauccaa

SEQ ID NO: 2071894 - RNA, 15 nt, Homo sapiens
aaagacaugcauuuu

SEQ ID NO: 2071895 - RNA, 19 nt, Homo sapiens
acacacucugagucucuga

SEQ ID NO: 2071896 - RNA, 21 nt, Homo sapiens
gccagagcguuagaggggcca

SEQ ID NO: 2071897 - RNA, 15 nt, Homo sapiens
ucacuguggucaucc

SEQ ID NO: 2071898 - RNA, 21 nt, Homo sapiens
uuccuuaaauuuuuagccauu

SEQ ID NO: 2071899 - RNA, 21 nt, Homo sapiens
agacauauaacgcagucuaau

SEQ ID NO: 2071900 - RNA, 22 nt, Homo sapiens
cucuaggcccugugagcacaaa

SEQ ID NO: 2071901 - RNA, 23 nt, Homo sapiens
augacccccaaccaaguggcucc

SEQ ID NO: 2071902 - RNA, 18 nt, Homo sapiens
ccccaaugaacuucagaa

SEQ ID NO: 2071903 - RNA, 20 nt, Homo sapiens
ucuuucaagcuucuugccag

SEQ ID NO: 2071904 - RNA, 19 nt, Homo sapiens
acacccagagggaguagaa

SEQ ID NO: 2071905 - RNA, 18 nt, Homo sapiens
auuucuucccgcacaaau

SEQ ID NO: 2071906 - RNA, 13 nt, Homo sapiens
gagaugacucugu

SEQ ID NO: 2071907 - RNA, 16 nt, Homo sapiens
cuagacauaguaccga

SEQ ID NO: 2071908 - RNA, 23 nt, Homo sapiens
ugcaaguguuucuucuggcuuag

SEQ ID NO: 2071909 - RNA, 12 nt, Homo sapiens
uucuauuuacaa

SEQ ID NO: 2071910 - RNA, 16 nt, Homo sapiens
ugagacagagucucac

SEQ ID NO: 2071911 - RNA, 15 nt, Homo sapiens
agcccugagcuuucu

SEQ ID NO: 2071912 - RNA, 21 nt, Homo sapiens
agguuccucgcaggucucagc

SEQ ID NO: 2071913 - RNA, 15 nt, Homo sapiens
aucacaccucugggc

SEQ ID NO: 2071914 - RNA, 16 nt, Homo sapiens
uccaauauuuugccuu

SEQ ID NO: 2071915 - RNA, 12 nt, Homo sapiens
aauuuacuguga

SEQ ID NO: 2071916 - RNA, 19 nt, Homo sapiens
uucaucuacuacaggguga

SEQ ID NO: 2071917 - RNA, 12 nt, Homo sapiens
uagaccaggcag

SEQ ID NO: 2071918 - RNA, 14 nt, Homo sapiens
agcggccucagggu

SEQ ID NO: 2071919 - RNA, 19 nt, Homo sapiens
aucuccugucuacaguuua

SEQ ID NO: 2071920 - RNA, 18 nt, Homo sapiens
cuuggugccucugcagua

SEQ ID NO: 2071921 - RNA, 17 nt, Homo sapiens
cccucgucccauccagc

SEQ ID NO: 2071922 - RNA, 14 nt, Homo sapiens
uggaugcaggguuu

SEQ ID NO: 2071923 - RNA, 16 nt, Homo sapiens
guggaaauaauuugaa

SEQ ID NO: 2071924 - RNA, 14 nt, Homo sapiens
acaucuuuccuguc

SEQ ID NO: 2071925 - RNA, 17 nt, Homo sapiens
uucuccugcaaauuuag

SEQ ID NO: 2071926 - RNA, 19 nt, Homo sapiens
agucugaugagaacucuga

SEQ ID NO: 2071927 - RNA, 15 nt, Homo sapiens
uucccaucuccauug

SEQ ID NO: 2071928 - RNA, 15 nt, Homo sapiens
agcaauaaaaugcua

SEQ ID NO: 2071929 - RNA, 17 nt, Homo sapiens
agacagcugcuggguca

SEQ ID NO: 2071930 - RNA, 17 nt, Homo sapiens
auggcaguugcuuccuc

SEQ ID NO: 2071931 - RNA, 21 nt, Homo sapiens
ugucucaaaggagcuuucuca

SEQ ID NO: 2071932 - RNA, 16 nt, Homo sapiens
auagcacuaaugcuuu

SEQ ID NO: 2071933 - RNA, 17 nt, Homo sapiens
ggggucuggacaugugg

SEQ ID NO: 2071934 - RNA, 14 nt, Homo sapiens
ucuugccaaccugu

SEQ ID NO: 2071935 - RNA, 21 nt, Homo sapiens
ugcugucaauauugguguacu

SEQ ID NO: 2071936 - RNA, 14 nt, Homo sapiens
auaaagcauuauaa

SEQ ID NO: 2071937 - RNA, 15 nt, Homo sapiens
gaaguggucucccca

SEQ ID NO: 2071938 - RNA, 14 nt, Homo sapiens
acuccagauaugaa

SEQ ID NO: 2071939 - RNA, 20 nt, Homo sapiens
aauuuuggucauagcauuca

SEQ ID NO: 2071940 - RNA, 23 nt, Homo sapiens
agcugagaucaugccacugcacu

SEQ ID NO: 2071941 - RNA, 16 nt, Homo sapiens
uauaguuucugaggcu

SEQ ID NO: 2071942 - RNA, 11 nt, Homo sapiens
agccuacucca

SEQ ID NO: 2071943 - RNA, 20 nt, Homo sapiens
guuuugcacaucauguaucu

SEQ ID NO: 2071944 - RNA, 12 nt, Homo sapiens
ccucaguguccu

SEQ ID NO: 2071945 - RNA, 17 nt, Homo sapiens
gacuuuguauagaaggu

SEQ ID NO: 2071946 - RNA, 18 nt, Homo sapiens
auacaugucuuucuccag

SEQ ID NO: 2071947 - RNA, 13 nt, Homo sapiens
gaauucuucucaa

SEQ ID NO: 2071948 - RNA, 14 nt, Homo sapiens
agaagagauuucuc

SEQ ID NO: 2071949 - RNA, 15 nt, Homo sapiens
cccuccacaaagcaa

SEQ ID NO: 2071950 - RNA, 23 nt, Homo sapiens
cuauaguuugucaucccugauga

SEQ ID NO: 2071951 - RNA, 21 nt, Homo sapiens
gagccccaggggacaagggau

SEQ ID NO: 2071952 - RNA, 22 nt, Homo sapiens
augacacacaaaucccauuaaa

SEQ ID NO: 2071953 - RNA, 14 nt, Homo sapiens
cagccaaaggggag

SEQ ID NO: 2071954 - RNA, 16 nt, Homo sapiens
cuggaagguacuuuaa

SEQ ID NO: 2071955 - RNA, 15 nt, Homo sapiens
cugccagaacaugga

SEQ ID NO: 2071956 - RNA, 17 nt, Homo sapiens
agcaacaacuuacuaaa

SEQ ID NO: 2071957 - RNA, 24 nt, Homo sapiens
auauggugaagggaaguggggagu

SEQ ID NO: 2071958 - RNA, 15 nt, Homo sapiens
uagcauguaugaaug

SEQ ID NO: 2071959 - RNA, 19 nt, Homo sapiens
cucaaacuccugaccucag

SEQ ID NO: 2071960 - RNA, 19 nt, Homo sapiens
cagaccuguucugaccuca

SEQ ID NO: 2071961 - RNA, 23 nt, Homo sapiens
uauuaaguaacuuauuuaugaaa

SEQ ID NO: 2071962 - RNA, 19 nt, Homo sapiens
uaugauuuaaaacauguaa

SEQ ID NO: 2071963 - RNA, 22 nt, Homo sapiens
uuccaauaauugacugguggaa

SEQ ID NO: 2071964 - RNA, 21 nt, Homo sapiens
cagcacuucccaaagugcacu

SEQ ID NO: 2071965 - RNA, 20 nt, Homo sapiens
gccgauauuuucuugcugga

SEQ ID NO: 2071966 - RNA, 17 nt, Homo sapiens
uacaucuuuuauacauu

SEQ ID NO: 2071967 - RNA, 16 nt, Homo sapiens
ccacgcccagcuaauu

SEQ ID NO: 2071968 - RNA, 16 nt, Homo sapiens
caaauaugugguccau

SEQ ID NO: 2071969 - RNA, 13 nt, Homo sapiens
accacagcugccu

SEQ ID NO: 2071970 - RNA, 16 nt, Homo sapiens
ucuuuaguucugucag

SEQ ID NO: 2071971 - RNA, 21 nt, Homo sapiens
auuuguguuaagugacugaga

SEQ ID NO: 2071972 - RNA, 20 nt, Homo sapiens
augaggugguggaguggagu

SEQ ID NO: 2071973 - RNA, 18 nt, Homo sapiens
gaggaaguuuugucuaau

SEQ ID NO: 2071974 - RNA, 11 nt, Homo sapiens
uagcacuugca

SEQ ID NO: 2071975 - RNA, 14 nt, Homo sapiens
gucccuugcugaca

SEQ ID NO: 2071976 - RNA, 13 nt, Homo sapiens
aucuaagaccacg

SEQ ID NO: 2071977 - RNA, 19 nt, Homo sapiens
agcaucccuugaccaggcc

SEQ ID NO: 2071978 - RNA, 14 nt, Homo sapiens
aucaucuuguugaa

SEQ ID NO: 2071979 - RNA, 17 nt, Homo sapiens
agcucaguaacugugca

SEQ ID NO: 2071980 - RNA, 13 nt, Homo sapiens
uguccccuugaag

SEQ ID NO: 2071981 - RNA, 14 nt, Homo sapiens
aucaccaaggcuga

SEQ ID NO: 2071982 - RNA, 16 nt, Homo sapiens
aggggaaugaaccaug

SEQ ID NO: 2071983 - RNA, 21 nt, Homo sapiens
uucaucuuugggaaagcuuac

SEQ ID NO: 2071984 - RNA, 19 nt, Homo sapiens
uuaaucaaugaucaucuca

SEQ ID NO: 2071985 - RNA, 13 nt, Homo sapiens
uaaguugucaaag

SEQ ID NO: 2071986 - RNA, 22 nt, Homo sapiens
aauuaaaugcauguccucaaaa

SEQ ID NO: 2071987 - RNA, 21 nt, Homo sapiens
gaaucauacugccuacuguua

SEQ ID NO: 2071988 - RNA, 19 nt, Homo sapiens
agagugcagaucugugcuc

SEQ ID NO: 2071989 - RNA, 15 nt, Homo sapiens
cggaaggagacugug

SEQ ID NO: 2071990 - RNA, 19 nt, Homo sapiens
uucugccuucucaugaucc

SEQ ID NO: 2071991 - RNA, 12 nt, Homo sapiens
acaaugcugauu

SEQ ID NO: 2071992 - RNA, 12 nt, Homo sapiens
aaaaugcugcuu

SEQ ID NO: 2071993 - RNA, 17 nt, Homo sapiens
cagaucuuugcugccag

SEQ ID NO: 2071994 - RNA, 21 nt, Homo sapiens
ggcugauuauuaaaguccuuu

SEQ ID NO: 2071995 - RNA, 21 nt, Homo sapiens
auguucuuuuccaacacaucu

SEQ ID NO: 2071996 - RNA, 17 nt, Homo sapiens
gccuugcggaagccaua

SEQ ID NO: 2071997 - RNA, 17 nt, Homo sapiens
uucucugcucucuugga

SEQ ID NO: 2071998 - RNA, 13 nt, Homo sapiens
guguuuaccuaaa

SEQ ID NO: 2071999 - RNA, 19 nt, Homo sapiens
ggccaggcuggagugcagu

SEQ ID NO: 2072000 - RNA, 21 nt, Homo sapiens
cuggcaauacgacgugggaau

SEQ ID NO: 2072001 - RNA, 13 nt, Homo sapiens
cacuuaguuauuu

SEQ ID NO: 2072002 - RNA, 21 nt, Homo sapiens
gugcuuccuugcucagugcaa

SEQ ID NO: 2072003 - RNA, 20 nt, Homo sapiens
gcuuaagucaucauuacuug

SEQ ID NO: 2072004 - RNA, 22 nt, Homo sapiens
guauguaaaucuucauggugau

SEQ ID NO: 2072005 - RNA, 15 nt, Homo sapiens
augugacaacaugug

SEQ ID NO: 2072006 - RNA, 16 nt, Homo sapiens
gccaggcguguucaua

SEQ ID NO: 2072007 - RNA, 13 nt, Homo sapiens
cauuuauagcaua

SEQ ID NO: 2072008 - RNA, 18 nt, Homo sapiens
gguuggcccucacugcag

SEQ ID NO: 2072009 - RNA, 21 nt, Homo sapiens
caacauggaguaaagagcaua

SEQ ID NO: 2072010 - RNA, 15 nt, Homo sapiens
uauuuccaacaaacu

SEQ ID NO: 2072011 - RNA, 18 nt, Homo sapiens
ugugaugaacgugccuga

SEQ ID NO: 2072012 - RNA, 13 nt, Homo sapiens
agucuaaaguuua

SEQ ID NO: 2072013 - RNA, 22 nt, Homo sapiens
aaucuuaucuuugcucccugca

SEQ ID NO: 2072014 - RNA, 13 nt, Homo sapiens
aaagcuuccccaa

SEQ ID NO: 2072015 - RNA, 21 nt, Homo sapiens
cuccagcccugggacagggca

SEQ ID NO: 2072016 - RNA, 23 nt, Homo sapiens
agcaagacugaagauggcuuuuc

SEQ ID NO: 2072017 - RNA, 14 nt, Homo sapiens
aguaaggugcaguu

SEQ ID NO: 2072018 - RNA, 17 nt, Homo sapiens
gaguuccuaacaggaug

SEQ ID NO: 2072019 - RNA, 21 nt, Homo sapiens
agucauaugagaaggaacuuu

SEQ ID NO: 2072020 - RNA, 16 nt, Homo sapiens
gcgcugcuugguguga

SEQ ID NO: 2072021 - RNA, 23 nt, Homo sapiens
agguaauccuauuaaaacacagc

SEQ ID NO: 2072022 - RNA, 14 nt, Homo sapiens
uggaugcacgcaca

SEQ ID NO: 2072023 - RNA, 14 nt, Homo sapiens
uacacacacagaug

SEQ ID NO: 2072024 - RNA, 15 nt, Homo sapiens
ugaacagaaaugcau

SEQ ID NO: 2072025 - RNA, 20 nt, Homo sapiens
agaaucuccauuucugcuca

SEQ ID NO: 2072026 - RNA, 16 nt, Homo sapiens
ccacuggccuaccccu

SEQ ID NO: 2072027 - RNA, 20 nt, Homo sapiens
cuguaaaacuaaacauacau

SEQ ID NO: 2072028 - RNA, 20 nt, Homo sapiens
agucguggagaugucuucgu

SEQ ID NO: 2072029 - RNA, 12 nt, Homo sapiens
cucccuuugaaa

SEQ ID NO: 2072030 - RNA, 16 nt, Homo sapiens
cagagagguagcacuc

SEQ ID NO: 2072031 - RNA, 23 nt, Homo sapiens
uccugaccccucuccucaaggga

SEQ ID NO: 2072032 - RNA, 15 nt, Homo sapiens
aacauuucauuguac

SEQ ID NO: 2072033 - RNA, 21 nt, Homo sapiens
aagguggauuuuaaaaauugg

SEQ ID NO: 2072034 - RNA, 15 nt, Homo sapiens
ucucuucccagugaa

SEQ ID NO: 2072035 - RNA, 15 nt, Homo sapiens
cauuaauucaauuaa

SEQ ID NO: 2072036 - RNA, 15 nt, Homo sapiens
gauuuuuagaaauca

SEQ ID NO: 2072037 - RNA, 13 nt, Homo sapiens
accucaaggucau

SEQ ID NO: 2072038 - RNA, 16 nt, Homo sapiens
uaggugcuauuuguca

SEQ ID NO: 2072039 - RNA, 17 nt, Homo sapiens
gggugaaguccacagaa

SEQ ID NO: 2072040 - RNA, 14 nt, Homo sapiens
ucccaacuauaaaa

SEQ ID NO: 2072041 - RNA, 20 nt, Homo sapiens
uuaguaaugcucugaccaag

SEQ ID NO: 2072042 - RNA, 13 nt, Homo sapiens
aaauagugucuga

SEQ ID NO: 2072043 - RNA, 19 nt, Homo sapiens
cagucucacaugauuccag

SEQ ID NO: 2072044 - RNA, 19 nt, Homo sapiens
gcagaauuguggaguguuu

SEQ ID NO: 2072045 - RNA, 12 nt, Homo sapiens
gaacaguuugua

SEQ ID NO: 2072046 - RNA, 13 nt, Homo sapiens
aguauugagacac

SEQ ID NO: 2072047 - RNA, 15 nt, Homo sapiens
aaaugucacugccaa

SEQ ID NO: 2072048 - RNA, 13 nt, Homo sapiens
ucauuauguauga

SEQ ID NO: 2072049 - RNA, 16 nt, Homo sapiens
aaauuucuacaccaag

SEQ ID NO: 2072050 - RNA, 23 nt, Homo sapiens
acaguuuuuaacucuacugugua

SEQ ID NO: 2072051 - RNA, 18 nt, Homo sapiens
uaaaggcaccucccccaa

SEQ ID NO: 2072052 - RNA, 17 nt, Homo sapiens
aucuuuagagaaguaua

SEQ ID NO: 2072053 - RNA, 13 nt, Homo sapiens
ugaaagugcauuu

SEQ ID NO: 2072054 - RNA, 20 nt, Homo sapiens
aggagggggacuaaacucaa

SEQ ID NO: 2072055 - RNA, 16 nt, Homo sapiens
ggccucgucuuucaug

SEQ ID NO: 2072056 - RNA, 22 nt, Homo sapiens
ggcacuaguauuucuaugaaau

SEQ ID NO: 2072057 - RNA, 15 nt, Homo sapiens
uuuauuuuccaggga

SEQ ID NO: 2072058 - RNA, 13 nt, Homo sapiens
uuuccuugucucu

SEQ ID NO: 2072059 - RNA, 16 nt, Homo sapiens
guccugacagcacucc

SEQ ID NO: 2072060 - RNA, 16 nt, Homo sapiens
gacugccgcugagaag

SEQ ID NO: 2072061 - RNA, 23 nt, Homo sapiens
auagccuguggccuuugcaauuu

SEQ ID NO: 2072062 - RNA, 21 nt, Homo sapiens
accggggaggcggagguugca

SEQ ID NO: 2072063 - RNA, 16 nt, Homo sapiens
aaaaccuugauuuaaa

SEQ ID NO: 2072064 - RNA, 17 nt, Homo sapiens
caauaaaagagcugucu

SEQ ID NO: 2072065 - RNA, 12 nt, Homo sapiens
ccauccauguga

SEQ ID NO: 2072066 - RNA, 13 nt, Homo sapiens
cgugacccagugg

SEQ ID NO: 2072067 - RNA, 15 nt, Homo sapiens
ugcugcuggugcaca

SEQ ID NO: 2072068 - RNA, 22 nt, Homo sapiens
uacuuuauggcagacauugugc

SEQ ID NO: 2072069 - RNA, 21 nt, Homo sapiens
uaaagacugguuuucugccaa

SEQ ID NO: 2072070 - RNA, 20 nt, Homo sapiens
agacugugacaacugucuaa

SEQ ID NO: 2072071 - RNA, 15 nt, Homo sapiens
ugcccuccuggugac

SEQ ID NO: 2072072 - RNA, 16 nt, Homo sapiens
cuguccaccaguuuau

SEQ ID NO: 2072073 - RNA, 19 nt, Homo sapiens
caaaaccuacccucaguga

SEQ ID NO: 2072074 - RNA, 17 nt, Homo sapiens
uaggagugauuacuaau

SEQ ID NO: 2072075 - RNA, 20 nt, Homo sapiens
ugucaggcaugaagaagcca

SEQ ID NO: 2072076 - RNA, 22 nt, Homo sapiens
gaugaaucgcauuuccugagaa

SEQ ID NO: 2072077 - RNA, 14 nt, Homo sapiens
cgagaucucaggag

SEQ ID NO: 2072078 - RNA, 19 nt, Homo sapiens
ugaaaaugagcaucagaga

SEQ ID NO: 2072079 - RNA, 17 nt, Homo sapiens
ccuucgccuuugcugaa

SEQ ID NO: 2072080 - RNA, 11 nt, Homo sapiens
caagugacaag

SEQ ID NO: 2072081 - RNA, 15 nt, Homo sapiens
gacagguaaguggca

SEQ ID NO: 2072082 - RNA, 14 nt, Homo sapiens
agauuuuaugugcu

SEQ ID NO: 2072083 - RNA, 18 nt, Homo sapiens
gcagugaaagcuuucaug

SEQ ID NO: 2072084 - RNA, 12 nt, Homo sapiens
aaggaaaaagcu

SEQ ID NO: 2072085 - RNA, 15 nt, Homo sapiens
cccaguuguccguga

SEQ ID NO: 2072086 - RNA, 14 nt, Homo sapiens
uaagaauuugcaua

SEQ ID NO: 2072087 - RNA, 18 nt, Homo sapiens
gcuuccgcauccuagucu

SEQ ID NO: 2072088 - RNA, 20 nt, Homo sapiens
aaguagcuuugaacuaguuu

SEQ ID NO: 2072089 - RNA, 19 nt, Homo sapiens
uuugagaucaucagugaua

SEQ ID NO: 2072090 - RNA, 16 nt, Homo sapiens
acugaaggugauggag

SEQ ID NO: 2072091 - RNA, 15 nt, Homo sapiens
uaauauuaauuucca

SEQ ID NO: 2072092 - RNA, 23 nt, Homo sapiens
uuauuggaugucaauagcauugu

SEQ ID NO: 2072093 - RNA, 22 nt, Homo sapiens
cuugccugaggggaaagagaga

SEQ ID NO: 2072094 - RNA, 15 nt, Homo sapiens
aucaaugcauguuac

SEQ ID NO: 2072095 - RNA, 16 nt, Homo sapiens
gggcaggaaccagaca

SEQ ID NO: 2072096 - RNA, 15 nt, Homo sapiens
aacagcugacccagu

SEQ ID NO: 2072097 - RNA, 15 nt, Homo sapiens
ugacagaugauucac

SEQ ID NO: 2072098 - RNA, 22 nt, Homo sapiens
aaaaauaaucaagugcauuucu

SEQ ID NO: 2072099 - RNA, 13 nt, Homo sapiens
auucgcuguuacc

SEQ ID NO: 2072100 - RNA, 21 nt, Homo sapiens
uggggaccgguucccacaagc

SEQ ID NO: 2072101 - RNA, 20 nt, Homo sapiens
gcacauguaauaaauucaaa

SEQ ID NO: 2072102 - RNA, 18 nt, Homo sapiens
ccacuuuugaagucuucc

SEQ ID NO: 2072103 - RNA, 17 nt, Homo sapiens
auuguguccacauaauc

SEQ ID NO: 2072104 - RNA, 17 nt, Homo sapiens
gcccacggcucaaguga

SEQ ID NO: 2072105 - RNA, 21 nt, Homo sapiens
uguaaaccuagaguuuuauca

SEQ ID NO: 2072106 - RNA, 22 nt, Homo sapiens
cuuccuggggaccaagauuuac

SEQ ID NO: 2072107 - RNA, 14 nt, Homo sapiens
ugcaaauauaucug

SEQ ID NO: 2072108 - RNA, 20 nt, Homo sapiens
aauaaaaugauuuguggaaa

SEQ ID NO: 2072109 - RNA, 21 nt, Homo sapiens
cuuggaaauguuaagaaagaa

SEQ ID NO: 2072110 - RNA, 19 nt, Homo sapiens
accccaucuuuacuaaaaa

SEQ ID NO: 2072111 - RNA, 16 nt, Homo sapiens
cuagcugucugugaau

SEQ ID NO: 2072112 - RNA, 17 nt, Homo sapiens
ugagaaccgugacauca

SEQ ID NO: 2072113 - RNA, 23 nt, Homo sapiens
aacuuaauuaccuaagagccaca

SEQ ID NO: 2072114 - RNA, 23 nt, Homo sapiens
gcauauuguacccccucauuugu

SEQ ID NO: 2072115 - RNA, 17 nt, Homo sapiens
accuggcagcccugggc

SEQ ID NO: 2072116 - RNA, 20 nt, Homo sapiens
aauuuuauucaagaaugcca

SEQ ID NO: 2072117 - RNA, 17 nt, Homo sapiens
accaaaauuuuguccca

SEQ ID NO: 2072118 - RNA, 20 nt, Homo sapiens
uuacuaugguaacacuuugc

SEQ ID NO: 2072119 - RNA, 19 nt, Homo sapiens
acagccuucuaaauuccca

SEQ ID NO: 2072120 - RNA, 21 nt, Homo sapiens
cuccuucuuuugucuuugauu

SEQ ID NO: 2072121 - RNA, 17 nt, Homo sapiens
cuugauacaggggccaa

SEQ ID NO: 2072122 - RNA, 16 nt, Homo sapiens
cuuaauaaauauuaca

SEQ ID NO: 2072123 - RNA, 20 nt, Homo sapiens
cugcauuuuccuaaacccag

SEQ ID NO: 2072124 - RNA, 17 nt, Homo sapiens
cuauaucaaacaugcac

SEQ ID NO: 2072125 - RNA, 17 nt, Homo sapiens
gugguucagcuacuuuc

SEQ ID NO: 2072126 - RNA, 23 nt, Homo sapiens
auacuacauacaagcauaagcaa

SEQ ID NO: 2072127 - RNA, 14 nt, Homo sapiens
ggaagucugucuca

SEQ ID NO: 2072128 - RNA, 20 nt, Homo sapiens
ggaggucaaggcuucaguga

SEQ ID NO: 2072129 - RNA, 17 nt, Homo sapiens
cuuuuuauuuagauugg

SEQ ID NO: 2072130 - RNA, 16 nt, Homo sapiens
agauccuggguacuga

SEQ ID NO: 2072131 - RNA, 15 nt, Homo sapiens
caucagggacaggau

SEQ ID NO: 2072132 - RNA, 21 nt, Homo sapiens
cuucuguaguguauuaaucuc

SEQ ID NO: 2072133 - RNA, 22 nt, Homo sapiens
aguggaucuucagaacugcccu

SEQ ID NO: 2072134 - RNA, 23 nt, Homo sapiens
augaggcugcuuuccaaagccaa

SEQ ID NO: 2072135 - RNA, 21 nt, Homo sapiens
uagucccgauaggguauuuga

SEQ ID NO: 2072136 - RNA, 17 nt, Homo sapiens
cugggggccucugccuc

SEQ ID NO: 2072137 - RNA, 20 nt, Homo sapiens
cccaggcuggagugcaacgg

SEQ ID NO: 2072138 - RNA, 14 nt, Homo sapiens
uauaucuaccccag

SEQ ID NO: 2072139 - RNA, 18 nt, Homo sapiens
caaggcucuucuuccuca

SEQ ID NO: 2072140 - RNA, 13 nt, Homo sapiens
gcacaauaguaac

SEQ ID NO: 2072141 - RNA, 14 nt, Homo sapiens
uucacugccuuccu

SEQ ID NO: 2072142 - RNA, 20 nt, Homo sapiens
gauggauuaaacucaguggu

SEQ ID NO: 2072143 - RNA, 15 nt, Homo sapiens
auucacuccagucaa

SEQ ID NO: 2072144 - RNA, 17 nt, Homo sapiens
gggacagagcugaggau

SEQ ID NO: 2072145 - RNA, 12 nt, Homo sapiens
caaguccaagca

SEQ ID NO: 2072146 - RNA, 20 nt, Homo sapiens
aaaugagaagucucacugau

SEQ ID NO: 2072147 - RNA, 16 nt, Homo sapiens
cauauggacacuguga

SEQ ID NO: 2072148 - RNA, 18 nt, Homo sapiens
ugcaguaucucccauaaa

SEQ ID NO: 2072149 - RNA, 15 nt, Homo sapiens
cuuauaacaggaaua

SEQ ID NO: 2072150 - RNA, 18 nt, Homo sapiens
ugaaauaagaaagugcga

SEQ ID NO: 2072151 - RNA, 16 nt, Homo sapiens
aguugauuacuuuuca

SEQ ID NO: 2072152 - RNA, 18 nt, Homo sapiens
augccuacugaugucagu

SEQ ID NO: 2072153 - RNA, 19 nt, Homo sapiens
cuagaaaggaagacagauu

SEQ ID NO: 2072154 - RNA, 22 nt, Homo sapiens
aauagaauuugagcaucaguga

SEQ ID NO: 2072155 - RNA, 18 nt, Homo sapiens
cugaguugccaagacaaa

SEQ ID NO: 2072156 - RNA, 20 nt, Homo sapiens
acuauauuuaauaccaccaa

SEQ ID NO: 2072157 - RNA, 15 nt, Homo sapiens
gcucaguaacugugc

SEQ ID NO: 2072158 - RNA, 18 nt, Homo sapiens
uaauggggacacagauca

SEQ ID NO: 2072159 - RNA, 20 nt, Homo sapiens
uaauugccuuugagguuauu

SEQ ID NO: 2072160 - RNA, 13 nt, Homo sapiens
uuccucgcauuaa

SEQ ID NO: 2072161 - RNA, 21 nt, Homo sapiens
aagggaucaucaugcagcuca

SEQ ID NO: 2072162 - RNA, 20 nt, Homo sapiens
agagcgagacuccaucucaa

SEQ ID NO: 2072163 - RNA, 20 nt, Homo sapiens
agagcaagacuccgucucaa

SEQ ID NO: 2072164 - RNA, 20 nt, Homo sapiens
agaguaagacucugucucaa

SEQ ID NO: 2072165 - RNA, 20 nt, Homo sapiens
caauauuuccucaugugauc

SEQ ID NO: 2072166 - RNA, 11 nt, Homo sapiens
aaauagcagua

SEQ ID NO: 2072167 - RNA, 13 nt, Homo sapiens
guugaucuuuuaa

SEQ ID NO: 2072168 - RNA, 13 nt, Homo sapiens
uggggucugggag

SEQ ID NO: 2072169 - RNA, 15 nt, Homo sapiens
ccugacaagugccug

SEQ ID NO: 2072170 - RNA, 18 nt, Homo sapiens
acugagcuacuagagaua

SEQ ID NO: 2072171 - RNA, 17 nt, Homo sapiens
uaaguuaugacugugaa

SEQ ID NO: 2072172 - RNA, 19 nt, Homo sapiens
gacagcaucuaagaaguuu

SEQ ID NO: 2072173 - RNA, 14 nt, Homo sapiens
aucaaauugcuaca

SEQ ID NO: 2072174 - RNA, 17 nt, Homo sapiens
aucuucccuuuccuccc

SEQ ID NO: 2072175 - RNA, 15 nt, Homo sapiens
uuaccuauugcugua

SEQ ID NO: 2072176 - RNA, 14 nt, Homo sapiens
aaaauuaauuccua

SEQ ID NO: 2072177 - RNA, 17 nt, Homo sapiens
acagagaaaagacauaa

SEQ ID NO: 2072178 - RNA, 16 nt, Homo sapiens
ucucugcugcauuugu

SEQ ID NO: 2072179 - RNA, 17 nt, Homo sapiens
ucugacucagggcuccu

SEQ ID NO: 2072180 - RNA, 22 nt, Homo sapiens
augagacuacuucagaaucaga

SEQ ID NO: 2072181 - RNA, 13 nt, Homo sapiens
gcaggugugcgug

SEQ ID NO: 2072182 - RNA, 22 nt, Homo sapiens
acagcccugucagcaugaauuu

SEQ ID NO: 2072183 - RNA, 17 nt, Homo sapiens
ucauucucauaauuccu

SEQ ID NO: 2072184 - RNA, 12 nt, Homo sapiens
uuacuuuaguua

SEQ ID NO: 2072185 - RNA, 13 nt, Homo sapiens
agaccacucugcu

SEQ ID NO: 2072186 - RNA, 12 nt, Homo sapiens
ugaagcauaauu

SEQ ID NO: 2072187 - RNA, 13 nt, Homo sapiens
cacugucuuucaa

SEQ ID NO: 2072188 - RNA, 22 nt, Homo sapiens
aagagaugcuggauucagauau

SEQ ID NO: 2072189 - RNA, 13 nt, Homo sapiens
gguggagggcaca

SEQ ID NO: 2072190 - RNA, 23 nt, Homo sapiens
uuuuaaauaggguuguacuaugc

SEQ ID NO: 2072191 - RNA, 20 nt, Homo sapiens
cuuaccccacacacagucca

SEQ ID NO: 2072192 - RNA, 20 nt, Homo sapiens
ccuuuggacuugucccggga

SEQ ID NO: 2072193 - RNA, 22 nt, Homo sapiens
uuaagcgauucucaugccucag

SEQ ID NO: 2072194 - RNA, 17 nt, Homo sapiens
gcauggaaacauggagg

SEQ ID NO: 2072195 - RNA, 17 nt, Homo sapiens
guucuaaaguucuaaga

SEQ ID NO: 2072196 - RNA, 17 nt, Homo sapiens
agaccaggggaccagag

SEQ ID NO: 2072197 - RNA, 16 nt, Homo sapiens
cagaggacgagugcuu

SEQ ID NO: 2072198 - RNA, 14 nt, Homo sapiens
acuucuacugagca

SEQ ID NO: 2072199 - RNA, 23 nt, Homo sapiens
cagauaaauagaacuaucugcau

SEQ ID NO: 2072200 - RNA, 19 nt, Homo sapiens
uaggaccauuucucugcag

SEQ ID NO: 2072201 - RNA, 16 nt, Homo sapiens
aguugucaccaaauac

SEQ ID NO: 2072202 - RNA, 17 nt, Homo sapiens
cagauguauugacugua

SEQ ID NO: 2072203 - RNA, 18 nt, Homo sapiens
aaccaaugcuauugugau

SEQ ID NO: 2072204 - RNA, 15 nt, Homo sapiens
ucuuggcucacuaca

SEQ ID NO: 2072205 - RNA, 18 nt, Homo sapiens
cucuguagugcuacaggg

SEQ ID NO: 2072206 - RNA, 17 nt, Homo sapiens
gaagaaacacacuggau

SEQ ID NO: 2072207 - RNA, 20 nt, Homo sapiens
ugaucuugcucuaucucaca

SEQ ID NO: 2072208 - RNA, 19 nt, Homo sapiens
gccuuuaauaauguuauag

SEQ ID NO: 2072209 - RNA, 16 nt, Homo sapiens
auaagucaguguuaaa

SEQ ID NO: 2072210 - RNA, 20 nt, Homo sapiens
uccaugucccuguauaauuc

SEQ ID NO: 2072211 - RNA, 23 nt, Homo sapiens
cccagaugcaagacacugugcca

SEQ ID NO: 2072212 - RNA, 16 nt, Homo sapiens
cuccaucucaaaaaag

SEQ ID NO: 2072213 - RNA, 15 nt, Homo sapiens
cuccaauguccaaaa

SEQ ID NO: 2072214 - RNA, 15 nt, Homo sapiens
agaaagaaacacuca

SEQ ID NO: 2072215 - RNA, 15 nt, Homo sapiens
uugagggccagugau

SEQ ID NO: 2072216 - RNA, 13 nt, Homo sapiens
cuacuucccuucc

SEQ ID NO: 2072217 - RNA, 23 nt, Homo sapiens
ggaguccaggguggaugaucuca

SEQ ID NO: 2072218 - RNA, 23 nt, Homo sapiens
cuccgugaugcuguuuuucucau

SEQ ID NO: 2072219 - RNA, 21 nt, Homo sapiens
ugauguauuucaagucucuca

SEQ ID NO: 2072220 - RNA, 14 nt, Homo sapiens
auuugcagagacag

SEQ ID NO: 2072221 - RNA, 20 nt, Homo sapiens
gacaguuacccccaaccuga

SEQ ID NO: 2072222 - RNA, 17 nt, Homo sapiens
cucagaccaaucaucaa

SEQ ID NO: 2072223 - RNA, 19 nt, Homo sapiens
ucugcauggaacagcauua

SEQ ID NO: 2072224 - RNA, 15 nt, Homo sapiens
augauuccuugagca

SEQ ID NO: 2072225 - RNA, 22 nt, Homo sapiens
uguggagucauuucugauuuca

SEQ ID NO: 2072226 - RNA, 18 nt, Homo sapiens
ccuggccucagccagcug

SEQ ID NO: 2072227 - RNA, 12 nt, Homo sapiens
uagaaacaaaca

SEQ ID NO: 2072228 - RNA, 12 nt, Homo sapiens
augaaacauuca

SEQ ID NO: 2072229 - RNA, 23 nt, Homo sapiens
gaaauuugugggcuuggggacag

SEQ ID NO: 2072230 - RNA, 22 nt, Homo sapiens
gaccaccaacguguccuuguac

SEQ ID NO: 2072231 - RNA, 14 nt, Homo sapiens
cuguaggugaaaga

SEQ ID NO: 2072232 - RNA, 15 nt, Homo sapiens
ucguaguuacucuca

SEQ ID NO: 2072233 - RNA, 20 nt, Homo sapiens
cuccucuuuaaaacaaaaca

SEQ ID NO: 2072234 - RNA, 23 nt, Homo sapiens
guuucacuacaaucgcuaccuga

SEQ ID NO: 2072235 - RNA, 19 nt, Homo sapiens
gccuguaauccuagcacuu

SEQ ID NO: 2072236 - RNA, 19 nt, Homo sapiens
cccaccuccaucaaacgca

SEQ ID NO: 2072237 - RNA, 19 nt, Homo sapiens
cugaaggugccacuccagu

SEQ ID NO: 2072238 - RNA, 19 nt, Homo sapiens
gucacaccuuagugcuaua

SEQ ID NO: 2072239 - RNA, 23 nt, Homo sapiens
cuguucuugacaaucaucuccaa

SEQ ID NO: 2072240 - RNA, 14 nt, Homo sapiens
auguuaaguuacag

SEQ ID NO: 2072241 - RNA, 23 nt, Homo sapiens
uguauguguucgucaguguucau

SEQ ID NO: 2072242 - RNA, 20 nt, Homo sapiens
ccuugcccuccugggcccug

SEQ ID NO: 2072243 - RNA, 22 nt, Homo sapiens
uggccuggcaguugaacagagg

SEQ ID NO: 2072244 - RNA, 16 nt, Homo sapiens
gacaaaacccacuguu

SEQ ID NO: 2072245 - RNA, 16 nt, Homo sapiens
aggagacagaccacuu

SEQ ID NO: 2072246 - RNA, 15 nt, Homo sapiens
auuaggagacacagg

SEQ ID NO: 2072247 - RNA, 15 nt, Homo sapiens
uggugauuucuugcu

SEQ ID NO: 2072248 - RNA, 23 nt, Homo sapiens
cuccuguuuuuuucaggcuccua

SEQ ID NO: 2072249 - RNA, 22 nt, Homo sapiens
uuggugagaaagggauugcuga

SEQ ID NO: 2072250 - RNA, 17 nt, Homo sapiens
gguaauggugucccaaa

SEQ ID NO: 2072251 - RNA, 14 nt, Homo sapiens
caugcccugugcaa

SEQ ID NO: 2072252 - RNA, 12 nt, Homo sapiens
acugcccuggca

SEQ ID NO: 2072253 - RNA, 15 nt, Homo sapiens
guuuuuaacauguca

SEQ ID NO: 2072254 - RNA, 21 nt, Homo sapiens
cuaaauaaauguaauagccaa

SEQ ID NO: 2072255 - RNA, 12 nt, Homo sapiens
uuuaacacuguc

SEQ ID NO: 2072256 - RNA, 22 nt, Homo sapiens
cauuuaagagacagucacccca

SEQ ID NO: 2072257 - RNA, 19 nt, Homo sapiens
gcccacuguuaauauucua

SEQ ID NO: 2072258 - RNA, 22 nt, Homo sapiens
ugucuggcccgcaauacuguag

SEQ ID NO: 2072259 - RNA, 16 nt, Homo sapiens
caauucuccugccuua

SEQ ID NO: 2072260 - RNA, 23 nt, Homo sapiens
gacucugucuuguucacugcagu

SEQ ID NO: 2072261 - RNA, 15 nt, Homo sapiens
uacuuuaaagagcuu

SEQ ID NO: 2072262 - RNA, 17 nt, Homo sapiens
auuugaaggucuugauu

SEQ ID NO: 2072263 - RNA, 14 nt, Homo sapiens
caggaaauucuguu

SEQ ID NO: 2072264 - RNA, 17 nt, Homo sapiens
cuuaauucccaauccca

SEQ ID NO: 2072265 - RNA, 23 nt, Homo sapiens
ugguagaaauacccaacgcacaa

SEQ ID NO: 2072266 - RNA, 11 nt, Homo sapiens
uucaguaggau

SEQ ID NO: 2072267 - RNA, 19 nt, Homo sapiens
uaaagcaacaaaaauuacu

SEQ ID NO: 2072268 - RNA, 24 nt, Homo sapiens
aagcccggaucccaacaguuguca

SEQ ID NO: 2072269 - RNA, 21 nt, Homo sapiens
cccuucgacacggaccugcuu

SEQ ID NO: 2072270 - RNA, 20 nt, Homo sapiens
auguucguauuacaagagaa

SEQ ID NO: 2072271 - RNA, 21 nt, Homo sapiens
uagauauugugaaguacauau

SEQ ID NO: 2072272 - RNA, 16 nt, Homo sapiens
agcccuucuguaccug

SEQ ID NO: 2072273 - RNA, 17 nt, Homo sapiens
gccaggcucccugacca

SEQ ID NO: 2072274 - RNA, 15 nt, Homo sapiens
guuucaaaaccaugc

SEQ ID NO: 2072275 - RNA, 14 nt, Homo sapiens
caagagaccagccu

SEQ ID NO: 2072276 - RNA, 17 nt, Homo sapiens
gccuguguagcugugac

SEQ ID NO: 2072277 - RNA, 16 nt, Homo sapiens
gaauucguuucugaca

SEQ ID NO: 2072278 - RNA, 19 nt, Homo sapiens
gauucucccaaaguaccuu

SEQ ID NO: 2072279 - RNA, 21 nt, Homo sapiens
guggcuggcucuaccuuccug

SEQ ID NO: 2072280 - RNA, 21 nt, Homo sapiens
agccacaguggggcccauggc

SEQ ID NO: 2072281 - RNA, 12 nt, Homo sapiens
cugggcuauauu

SEQ ID NO: 2072282 - RNA, 20 nt, Homo sapiens
acucauuugcugacacauca

SEQ ID NO: 2072283 - RNA, 14 nt, Homo sapiens
auugaaagaaccag

SEQ ID NO: 2072284 - RNA, 16 nt, Homo sapiens
cuuaggcaaucacaua

SEQ ID NO: 2072285 - RNA, 21 nt, Homo sapiens
cccuaaagccaggcucaggag

SEQ ID NO: 2072286 - RNA, 14 nt, Homo sapiens
agggacaguuugua

SEQ ID NO: 2072287 - RNA, 17 nt, Homo sapiens
aggaucaguuaacuauu

SEQ ID NO: 2072288 - RNA, 15 nt, Homo sapiens
uaaacaauaguucac

SEQ ID NO: 2072289 - RNA, 12 nt, Homo sapiens
agguaacauguu

SEQ ID NO: 2072290 - RNA, 22 nt, Homo sapiens
cagaaacucaaccaucaaugga

SEQ ID NO: 2072291 - RNA, 13 nt, Homo sapiens
cuucaauacuuaa

SEQ ID NO: 2072292 - RNA, 20 nt, Homo sapiens
guuggucacauggagcucuu

SEQ ID NO: 2072293 - RNA, 15 nt, Homo sapiens
uguccucuucugcau

SEQ ID NO: 2072294 - RNA, 15 nt, Homo sapiens
ugggcucuucgccau

SEQ ID NO: 2072295 - RNA, 17 nt, Homo sapiens
uaaaguuuaaauaccag

SEQ ID NO: 2072296 - RNA, 18 nt, Homo sapiens
acgaucuugcuggcaggg

SEQ ID NO: 2072297 - RNA, 23 nt, Homo sapiens
auaaauguaccuucacaccaaua

SEQ ID NO: 2072298 - RNA, 19 nt, Homo sapiens
accaauagcaucugugcca

SEQ ID NO: 2072299 - RNA, 16 nt, Homo sapiens
ugcucagccaccaucu

SEQ ID NO: 2072300 - RNA, 16 nt, Homo sapiens
gauuucuuccugcaga

SEQ ID NO: 2072301 - RNA, 11 nt, Homo sapiens
guuccuuucag

SEQ ID NO: 2072302 - RNA, 15 nt, Homo sapiens
aaacaugcacgguga

SEQ ID NO: 2072303 - RNA, 14 nt, Homo sapiens
uaagagauaauugu

SEQ ID NO: 2072304 - RNA, 20 nt, Homo sapiens
ccugggaggguguggugcuu

SEQ ID NO: 2072305 - RNA, 23 nt, Homo sapiens
gcuccuuaaccuuccaugucucc

SEQ ID NO: 2072306 - RNA, 22 nt, Homo sapiens
acacauucaggaguuaaauauu

SEQ ID NO: 2072307 - RNA, 13 nt, Homo sapiens
gaaauauaaugca

SEQ ID NO: 2072308 - RNA, 19 nt, Homo sapiens
uccaagccaaguuuucuca

SEQ ID NO: 2072309 - RNA, 20 nt, Homo sapiens
gcacugugaccgagaacuuu

SEQ ID NO: 2072310 - RNA, 16 nt, Homo sapiens
cuuucuuccaaacagg

SEQ ID NO: 2072311 - RNA, 14 nt, Homo sapiens
gggcaagucaccca

SEQ ID NO: 2072312 - RNA, 16 nt, Homo sapiens
ucucucuuuguaaaac

SEQ ID NO: 2072313 - RNA, 20 nt, Homo sapiens
auccccggggcggcaggaag

SEQ ID NO: 2072314 - RNA, 13 nt, Homo sapiens
ugcagcuccucug

SEQ ID NO: 2072315 - RNA, 18 nt, Homo sapiens
ggaaaaacaaaugccaua

SEQ ID NO: 2072316 - RNA, 15 nt, Homo sapiens
gccaguacuuaccag

SEQ ID NO: 2072317 - RNA, 18 nt, Homo sapiens
aaaagucguuuuccaaac

SEQ ID NO: 2072318 - RNA, 16 nt, Homo sapiens
gauauagugcuguuua

SEQ ID NO: 2072319 - RNA, 16 nt, Homo sapiens
aacugcagcaguggcu

SEQ ID NO: 2072320 - RNA, 15 nt, Homo sapiens
ucuucuuagcaccac

SEQ ID NO: 2072321 - RNA, 16 nt, Homo sapiens
cauaaaggauauuuca

SEQ ID NO: 2072322 - RNA, 21 nt, Homo sapiens
aauuuguaagcaacuugcuuc

SEQ ID NO: 2072323 - RNA, 18 nt, Homo sapiens
acugagcagccgccagcu

SEQ ID NO: 2072324 - RNA, 15 nt, Homo sapiens
ugaaauuaaacagau

SEQ ID NO: 2072325 - RNA, 16 nt, Homo sapiens
aaugaugagguaauaa

SEQ ID NO: 2072326 - RNA, 22 nt, Homo sapiens
gagucccaaccccagcuacucu

SEQ ID NO: 2072327 - RNA, 15 nt, Homo sapiens
ucuauaaacuucaga

SEQ ID NO: 2072328 - RNA, 13 nt, Homo sapiens
caagcuuccauag

SEQ ID NO: 2072329 - RNA, 12 nt, Homo sapiens
uaucucaaugug

SEQ ID NO: 2072330 - RNA, 22 nt, Homo sapiens
ccuagauuagguagacuuugcu

SEQ ID NO: 2072331 - RNA, 19 nt, Homo sapiens
gacugucaguaggcuggaa

SEQ ID NO: 2072332 - RNA, 23 nt, Homo sapiens
acaaaugguggaggauugcugcc

SEQ ID NO: 2072333 - RNA, 16 nt, Homo sapiens
auuuuuaucugaguua

SEQ ID NO: 2072334 - RNA, 21 nt, Homo sapiens
acugagcaaugguaacugcac

SEQ ID NO: 2072335 - RNA, 18 nt, Homo sapiens
aagcaccacucugggcac

SEQ ID NO: 2072336 - RNA, 20 nt, Homo sapiens
ucauuuuaaaaaauggaaca

SEQ ID NO: 2072337 - RNA, 15 nt, Homo sapiens
cugcucaacauuuaa

SEQ ID NO: 2072338 - RNA, 14 nt, Homo sapiens
uaaaaagcagagcu

SEQ ID NO: 2072339 - RNA, 16 nt, Homo sapiens
auacacauacauauau

SEQ ID NO: 2072340 - RNA, 23 nt, Homo sapiens
uaacaaauugaguuuagaaguga

SEQ ID NO: 2072341 - RNA, 22 nt, Homo sapiens
agucaucugucuuucacuggaa

SEQ ID NO: 2072342 - RNA, 14 nt, Homo sapiens
auacaaaauauuua

SEQ ID NO: 2072343 - RNA, 17 nt, Homo sapiens
auuacaauugcaguuuu

SEQ ID NO: 2072344 - RNA, 23 nt, Homo sapiens
aucauuguaacaugacacuuaga

SEQ ID NO: 2072345 - RNA, 21 nt, Homo sapiens
ggauggagcugaaaacauaac

SEQ ID NO: 2072346 - RNA, 16 nt, Homo sapiens
caauaacuauuuuucc

SEQ ID NO: 2072347 - RNA, 16 nt, Homo sapiens
cuuuuuuugcuuuaaa

SEQ ID NO: 2072348 - RNA, 14 nt, Homo sapiens
cucuggucacuuca

SEQ ID NO: 2072349 - RNA, 21 nt, Homo sapiens
aauuaucaggcaaauuugcau

SEQ ID NO: 2072350 - RNA, 19 nt, Homo sapiens
acuguccccacgccgggaa

SEQ ID NO: 2072351 - RNA, 22 nt, Homo sapiens
aggcacagcgagggcagcaucu

SEQ ID NO: 2072352 - RNA, 14 nt, Homo sapiens
cucuguugcccaag

SEQ ID NO: 2072353 - RNA, 14 nt, Homo sapiens
cuguaguuacugug

SEQ ID NO: 2072354 - RNA, 23 nt, Homo sapiens
aggaagcaaaagcaucuauguga

SEQ ID NO: 2072355 - RNA, 23 nt, Homo sapiens
agccccauuauucauucucccuu

SEQ ID NO: 2072356 - RNA, 19 nt, Homo sapiens
guacuaugacacuguuaau

SEQ ID NO: 2072357 - RNA, 14 nt, Homo sapiens
cugaugcagaaaga

SEQ ID NO: 2072358 - RNA, 23 nt, Homo sapiens
cauauacauuuuuagccuguguc

SEQ ID NO: 2072359 - RNA, 16 nt, Homo sapiens
ucucuggaccauacgc

SEQ ID NO: 2072360 - RNA, 18 nt, Homo sapiens
cucaaagucccuugagac

SEQ ID NO: 2072361 - RNA, 23 nt, Homo sapiens
aaaugccacucugggcagucuuu

SEQ ID NO: 2072362 - RNA, 14 nt, Homo sapiens
auguaguauacacu

SEQ ID NO: 2072363 - RNA, 16 nt, Homo sapiens
ccaagucuguaccuca

SEQ ID NO: 2072364 - RNA, 14 nt, Homo sapiens
agcccaugaucuuc

SEQ ID NO: 2072365 - RNA, 13 nt, Homo sapiens
auuauguuuauuu

SEQ ID NO: 2072366 - RNA, 13 nt, Homo sapiens
aaauaguuuuaaa

SEQ ID NO: 2072367 - RNA, 22 nt, Homo sapiens
uuugucucuuagaaauacuugu

SEQ ID NO: 2072368 - RNA, 17 nt, Homo sapiens
aacuaauuucauuucaa

SEQ ID NO: 2072369 - RNA, 17 nt, Homo sapiens
agcugggccccaugcuc

SEQ ID NO: 2072370 - RNA, 14 nt, Homo sapiens
uaaagauacaugau

SEQ ID NO: 2072371 - RNA, 16 nt, Homo sapiens
guuuacauagcauuug

SEQ ID NO: 2072372 - RNA, 14 nt, Homo sapiens
gcuaugccaugugc

SEQ ID NO: 2072373 - RNA, 22 nt, Homo sapiens
aggcugaggccuggacuuuccu

SEQ ID NO: 2072374 - RNA, 22 nt, Homo sapiens
cgagggaugggauuucauguaa

SEQ ID NO: 2072375 - RNA, 21 nt, Homo sapiens
ugccaucccugagagaccaga

SEQ ID NO: 2072376 - RNA, 14 nt, Homo sapiens
caggcccccagugg

SEQ ID NO: 2072377 - RNA, 14 nt, Homo sapiens
caagugcacugagc

SEQ ID NO: 2072378 - RNA, 18 nt, Homo sapiens
acuuuuauuuccagugaa

SEQ ID NO: 2072379 - RNA, 17 nt, Homo sapiens
ugggcguccagcucagc

SEQ ID NO: 2072380 - RNA, 18 nt, Homo sapiens
cuucucccgccauuggcc

SEQ ID NO: 2072381 - RNA, 22 nt, Homo sapiens
ugcauauguauuuuguauuugc

SEQ ID NO: 2072382 - RNA, 19 nt, Homo sapiens
gagccuacuucuagcugua

SEQ ID NO: 2072383 - RNA, 14 nt, Homo sapiens
cagguuagccuuug

SEQ ID NO: 2072384 - RNA, 18 nt, Homo sapiens
uaccuggcucugcuucca

SEQ ID NO: 2072385 - RNA, 21 nt, Homo sapiens
ucuauuaccuguuaguauuau

SEQ ID NO: 2072386 - RNA, 18 nt, Homo sapiens
agcauuaaaauuuuaccu

SEQ ID NO: 2072387 - RNA, 18 nt, Homo sapiens
auuucauaagcacaucca

SEQ ID NO: 2072388 - RNA, 20 nt, Homo sapiens
cagcggguacuuauuucuca

SEQ ID NO: 2072389 - RNA, 18 nt, Homo sapiens
ccaggcgaugugcaagug

SEQ ID NO: 2072390 - RNA, 18 nt, Homo sapiens
gauggagagcagccagca

SEQ ID NO: 2072391 - RNA, 13 nt, Homo sapiens
uguaugacaguga

SEQ ID NO: 2072392 - RNA, 15 nt, Homo sapiens
uuuccagauauucaa

SEQ ID NO: 2072393 - RNA, 20 nt, Homo sapiens
auuuuuguauuuuggcagag

SEQ ID NO: 2072394 - RNA, 23 nt, Homo sapiens
auggagugcaguggcucaaucuc

SEQ ID NO: 2072395 - RNA, 20 nt, Homo sapiens
accaacugggccucugaugu

SEQ ID NO: 2072396 - RNA, 12 nt, Homo sapiens
agaaaacaucuu

SEQ ID NO: 2072397 - RNA, 15 nt, Homo sapiens
cucugcccugcccua

SEQ ID NO: 2072398 - RNA, 14 nt, Homo sapiens
cccauucauuccau

SEQ ID NO: 2072399 - RNA, 17 nt, Homo sapiens
gcuuauaaacacauuga

SEQ ID NO: 2072400 - RNA, 17 nt, Homo sapiens
cagagugaagagugaag

SEQ ID NO: 2072401 - RNA, 20 nt, Homo sapiens
gccaguacuacugcucucaa

SEQ ID NO: 2072402 - RNA, 17 nt, Homo sapiens
augugugcaucaugucu

SEQ ID NO: 2072403 - RNA, 14 nt, Homo sapiens
acauaaagccuugg

SEQ ID NO: 2072404 - RNA, 19 nt, Homo sapiens
accuccauuucccaaaguc

SEQ ID NO: 2072405 - RNA, 17 nt, Homo sapiens
agaauguucuauuguca

SEQ ID NO: 2072406 - RNA, 18 nt, Homo sapiens
cccucuccccacugcuca

SEQ ID NO: 2072407 - RNA, 13 nt, Homo sapiens
caggcccuagcuu

SEQ ID NO: 2072408 - RNA, 22 nt, Homo sapiens
aauucuaccaaggucuucuuaa

SEQ ID NO: 2072409 - RNA, 13 nt, Homo sapiens
caacaaaccaaaa

SEQ ID NO: 2072410 - RNA, 13 nt, Homo sapiens
cuuacaaccuucc

SEQ ID NO: 2072411 - RNA, 13 nt, Homo sapiens
uaugcagugucag

SEQ ID NO: 2072412 - RNA, 17 nt, Homo sapiens
acgauuucacuaggacu

SEQ ID NO: 2072413 - RNA, 14 nt, Homo sapiens
cuguguuuguccug

SEQ ID NO: 2072414 - RNA, 16 nt, Homo sapiens
auuacaggcacccacc

SEQ ID NO: 2072415 - RNA, 12 nt, Homo sapiens
gcaguaucucaa

SEQ ID NO: 2072416 - RNA, 19 nt, Homo sapiens
cagaaaucaaaaagggaau

SEQ ID NO: 2072417 - RNA, 19 nt, Homo sapiens
aguguuaagcguucaguga

SEQ ID NO: 2072418 - RNA, 14 nt, Homo sapiens
agucauauaccuau

SEQ ID NO: 2072419 - RNA, 14 nt, Homo sapiens
ucuuauauugccau

SEQ ID NO: 2072420 - RNA, 21 nt, Homo sapiens
ggagggggucauuguucuccu

SEQ ID NO: 2072421 - RNA, 16 nt, Homo sapiens
cuguucugaugccacc

SEQ ID NO: 2072422 - RNA, 21 nt, Homo sapiens
cuacagcgccaacgagcagug

SEQ ID NO: 2072423 - RNA, 17 nt, Homo sapiens
cauaucaaaacauccca

SEQ ID NO: 2072424 - RNA, 14 nt, Homo sapiens
acuuuccauugcua

SEQ ID NO: 2072425 - RNA, 17 nt, Homo sapiens
uuggcuuaaaccagaac

SEQ ID NO: 2072426 - RNA, 13 nt, Homo sapiens
cuuagcaucugaa

SEQ ID NO: 2072427 - RNA, 17 nt, Homo sapiens
uuugagcccucccagca

SEQ ID NO: 2072428 - RNA, 21 nt, Homo sapiens
cuggccagacaagaagacugu

SEQ ID NO: 2072429 - RNA, 22 nt, Homo sapiens
uuuccccaaagacgaccagcau

SEQ ID NO: 2072430 - RNA, 14 nt, Homo sapiens
cugacccaacuggg

SEQ ID NO: 2072431 - RNA, 12 nt, Homo sapiens
aauaauagcaau

SEQ ID NO: 2072432 - RNA, 15 nt, Homo sapiens
ugacuuuucugcccu

SEQ ID NO: 2072433 - RNA, 20 nt, Homo sapiens
aaugguuuguuuucuacauu

SEQ ID NO: 2072434 - RNA, 19 nt, Homo sapiens
uuuggaaaugguacuucau

SEQ ID NO: 2072435 - RNA, 18 nt, Homo sapiens
guguucauccccuuccug

SEQ ID NO: 2072436 - RNA, 12 nt, Homo sapiens
auaugugaugcc

SEQ ID NO: 2072437 - RNA, 18 nt, Homo sapiens
ugccuggccuccgaugcc

SEQ ID NO: 2072438 - RNA, 10 nt, Homo sapiens
acagcuacuu

SEQ ID NO: 2072439 - RNA, 19 nt, Homo sapiens
ugguggcccacgccuguaa

SEQ ID NO: 2072440 - RNA, 16 nt, Homo sapiens
agaacugguucuugcc

SEQ ID NO: 2072441 - RNA, 14 nt, Homo sapiens
gaucucaguauugu

SEQ ID NO: 2072442 - RNA, 16 nt, Homo sapiens
ggacuccacuggacag

SEQ ID NO: 2072443 - RNA, 16 nt, Homo sapiens
agacuucuuugcaaca

SEQ ID NO: 2072444 - RNA, 13 nt, Homo sapiens
acuagaaccugga

SEQ ID NO: 2072445 - RNA, 20 nt, Homo sapiens
ggaauccauagcggggccca

SEQ ID NO: 2072446 - RNA, 22 nt, Homo sapiens
uaaaacauuugguugcuacugu

SEQ ID NO: 2072447 - RNA, 16 nt, Homo sapiens
uaaagaauauuuacaa

SEQ ID NO: 2072448 - RNA, 21 nt, Homo sapiens
uguugccuaagcuggucucaa

SEQ ID NO: 2072449 - RNA, 20 nt, Homo sapiens
gauuucuuuguucucaugca

SEQ ID NO: 2072450 - RNA, 18 nt, Homo sapiens
gcugguaacaguggcugc

SEQ ID NO: 2072451 - RNA, 12 nt, Homo sapiens
agcucuguccac

SEQ ID NO: 2072452 - RNA, 23 nt, Homo sapiens
aagaaucaguaggaccaggccac

SEQ ID NO: 2072453 - RNA, 16 nt, Homo sapiens
accccaacccaauaaa

SEQ ID NO: 2072454 - RNA, 19 nt, Homo sapiens
gccaagaaacgucuucuaa

SEQ ID NO: 2072455 - RNA, 19 nt, Homo sapiens
agacccaguggacucuucc

SEQ ID NO: 2072456 - RNA, 22 nt, Homo sapiens
cuuacauuuuucgacugugaac

SEQ ID NO: 2072457 - RNA, 22 nt, Homo sapiens
ucccugggaguguucccgugcc

SEQ ID NO: 2072458 - RNA, 23 nt, Homo sapiens
guagccagaguuguucucagggg

SEQ ID NO: 2072459 - RNA, 16 nt, Homo sapiens
uccagaucagauucuu

SEQ ID NO: 2072460 - RNA, 18 nt, Homo sapiens
caggcaaucguucugcug

SEQ ID NO: 2072461 - RNA, 15 nt, Homo sapiens
ugcccuccugugugg

SEQ ID NO: 2072462 - RNA, 23 nt, Homo sapiens
aaaucuuugauucagacagcuua

SEQ ID NO: 2072463 - RNA, 18 nt, Homo sapiens
acccuccaggaccccagc

SEQ ID NO: 2072464 - RNA, 15 nt, Homo sapiens
agagcaguuggccaa

SEQ ID NO: 2072465 - RNA, 19 nt, Homo sapiens
ccuuucauggucugcugag

SEQ ID NO: 2072466 - RNA, 16 nt, Homo sapiens
ggcuuagaauggggcu

SEQ ID NO: 2072467 - RNA, 14 nt, Homo sapiens
ucaucuugccaaga

SEQ ID NO: 2072468 - RNA, 13 nt, Homo sapiens
cugcugaccucca

SEQ ID NO: 2072469 - RNA, 13 nt, Homo sapiens
augcugacaucca

SEQ ID NO: 2072470 - RNA, 15 nt, Homo sapiens
caaaaugugaacuuc

SEQ ID NO: 2072471 - RNA, 18 nt, Homo sapiens
agccaggacaucucugcc

SEQ ID NO: 2072472 - RNA, 14 nt, Homo sapiens
cacgauuccagugc

SEQ ID NO: 2072473 - RNA, 22 nt, Homo sapiens
caggacucugccuccucuucaa

SEQ ID NO: 2072474 - RNA, 12 nt, Homo sapiens
ccuucugcugaa

SEQ ID NO: 2072475 - RNA, 22 nt, Homo sapiens
ccagccaaccucauugcagcua

SEQ ID NO: 2072476 - RNA, 23 nt, Homo sapiens
cagccucacuugaaugugucacu

SEQ ID NO: 2072477 - RNA, 12 nt, Homo sapiens
cugagugacaug

SEQ ID NO: 2072478 - RNA, 20 nt, Homo sapiens
gagacagcgaacuagaagaa

SEQ ID NO: 2072479 - RNA, 20 nt, Homo sapiens
aaggacucugcuucagucca

SEQ ID NO: 2072480 - RNA, 14 nt, Homo sapiens
gagccccacgcugu

SEQ ID NO: 2072481 - RNA, 19 nt, Homo sapiens
acucugcagugauuagaag

SEQ ID NO: 2072482 - RNA, 23 nt, Homo sapiens
gcccaucccuggaaggugcuguu

SEQ ID NO: 2072483 - RNA, 23 nt, Homo sapiens
gcaaauaguaaucuguaagcaua

SEQ ID NO: 2072484 - RNA, 19 nt, Homo sapiens
aaacggguggugugucuca

SEQ ID NO: 2072485 - RNA, 17 nt, Homo sapiens
ccuccagcuucaggcag

SEQ ID NO: 2072486 - RNA, 21 nt, Homo sapiens
agaauuguuccaguacuaugg

SEQ ID NO: 2072487 - RNA, 22 nt, Homo sapiens
gcaucauuaaugcacaucugca

SEQ ID NO: 2072488 - RNA, 17 nt, Homo sapiens
ugccgcucucucugagg

SEQ ID NO: 2072489 - RNA, 20 nt, Homo sapiens
cagggauggggccacagcca

SEQ ID NO: 2072490 - RNA, 22 nt, Homo sapiens
aaauguauugauucaacaggga

SEQ ID NO: 2072491 - RNA, 16 nt, Homo sapiens
gcuguccuuacccauc

SEQ ID NO: 2072492 - RNA, 20 nt, Homo sapiens
ggccaaggagggcagaucac

SEQ ID NO: 2072493 - RNA, 19 nt, Homo sapiens
uuccaaagcagccugugaa

SEQ ID NO: 2072494 - RNA, 22 nt, Homo sapiens
agacauaccucucaacuuacau

SEQ ID NO: 2072495 - RNA, 14 nt, Homo sapiens
uaaugauuaaagac

SEQ ID NO: 2072496 - RNA, 23 nt, Homo sapiens
agguaaguuucaguggagcucag

SEQ ID NO: 2072497 - RNA, 14 nt, Homo sapiens
cccgaccguugcca

SEQ ID NO: 2072498 - RNA, 20 nt, Homo sapiens
cugaagggcaucaugcaucu

SEQ ID NO: 2072499 - RNA, 16 nt, Homo sapiens
ccagccuguucucuga

SEQ ID NO: 2072500 - RNA, 14 nt, Homo sapiens
cccaggcaaauagg

SEQ ID NO: 2072501 - RNA, 14 nt, Homo sapiens
accuaacacauuaa

SEQ ID NO: 2072502 - RNA, 12 nt, Homo sapiens
caagucaaauac

SEQ ID NO: 2072503 - RNA, 19 nt, Homo sapiens
agaaauuaugaaaguuaau

SEQ ID NO: 2072504 - RNA, 16 nt, Homo sapiens
ccaggaucugcuccaa

SEQ ID NO: 2072505 - RNA, 15 nt, Homo sapiens
ucagaggaagcacau

SEQ ID NO: 2072506 - RNA, 15 nt, Homo sapiens
uauguuagcauuaaa

SEQ ID NO: 2072507 - RNA, 22 nt, Homo sapiens
ggaacuuuagugaaacauaaua

SEQ ID NO: 2072508 - RNA, 21 nt, Homo sapiens
ugaaucaagggucaggccuuu

SEQ ID NO: 2072509 - RNA, 18 nt, Homo sapiens
ccuuccuugaacugucua

SEQ ID NO: 2072510 - RNA, 21 nt, Homo sapiens
gucagaguccagugcucugcc

SEQ ID NO: 2072511 - RNA, 16 nt, Homo sapiens
cuccaggccugaccag

SEQ ID NO: 2072512 - RNA, 13 nt, Homo sapiens
cgggcaagcacua

SEQ ID NO: 2072513 - RNA, 17 nt, Homo sapiens
auccaguuucccaugca

SEQ ID NO: 2072514 - RNA, 13 nt, Homo sapiens
uguuuccuugccu

SEQ ID NO: 2072515 - RNA, 14 nt, Homo sapiens
gucuucugcuccau

SEQ ID NO: 2072516 - RNA, 16 nt, Homo sapiens
ucauuguaugugguca

SEQ ID NO: 2072517 - RNA, 18 nt, Homo sapiens
cugaaacaugugccccug

SEQ ID NO: 2072518 - RNA, 12 nt, Homo sapiens
acacccuaccuu

SEQ ID NO: 2072519 - RNA, 22 nt, Homo sapiens
aggguggaugauaccauuuccu

SEQ ID NO: 2072520 - RNA, 22 nt, Homo sapiens
gaagggcucagagaggacaaaa

SEQ ID NO: 2072521 - RNA, 18 nt, Homo sapiens
guucuuccuaccaaauau

SEQ ID NO: 2072522 - RNA, 15 nt, Homo sapiens
uuccuguagucccau

SEQ ID NO: 2072523 - RNA, 15 nt, Homo sapiens
uagcugcagagccac

SEQ ID NO: 2072524 - RNA, 22 nt, Homo sapiens
acucucugugaacccuaugaga

SEQ ID NO: 2072525 - RNA, 13 nt, Homo sapiens
acuguaagggauu

SEQ ID NO: 2072526 - RNA, 17 nt, Homo sapiens
agaaaauuguacaaccu

SEQ ID NO: 2072527 - RNA, 23 nt, Homo sapiens
ccauguaucuuuugaacuggcaa

SEQ ID NO: 2072528 - RNA, 22 nt, Homo sapiens
augaacgaauuaauuaccuggc

SEQ ID NO: 2072529 - RNA, 13 nt, Homo sapiens
ccuggacuuuccu

SEQ ID NO: 2072530 - RNA, 23 nt, Homo sapiens
uuucaacaaauggcaccgagaca

SEQ ID NO: 2072531 - RNA, 12 nt, Homo sapiens
accaucccugaa

SEQ ID NO: 2072532 - RNA, 20 nt, Homo sapiens
guuucuccuuuugaccaaau

SEQ ID NO: 2072533 - RNA, 12 nt, Homo sapiens
ccagccuugacc

SEQ ID NO: 2072534 - RNA, 18 nt, Homo sapiens
uacucagugacuguugua

SEQ ID NO: 2072535 - RNA, 17 nt, Homo sapiens
uagugagucagcaccuu

SEQ ID NO: 2072536 - RNA, 17 nt, Homo sapiens
ccacgcggccaccucac

SEQ ID NO: 2072537 - RNA, 16 nt, Homo sapiens
cauauacaaaagcaag

SEQ ID NO: 2072538 - RNA, 13 nt, Homo sapiens
guugugagacuuc

SEQ ID NO: 2072539 - RNA, 14 nt, Homo sapiens
aaauuagagaucau

SEQ ID NO: 2072540 - RNA, 16 nt, Homo sapiens
ucugauuucauaauuc

SEQ ID NO: 2072541 - RNA, 19 nt, Homo sapiens
uuccugaguggugccaaac

SEQ ID NO: 2072542 - RNA, 22 nt, Homo sapiens
aacccagcucuaauacauucca

SEQ ID NO: 2072543 - RNA, 16 nt, Homo sapiens
acccuggauaggcaag

SEQ ID NO: 2072544 - RNA, 17 nt, Homo sapiens
acauacccucacuuaaa

SEQ ID NO: 2072545 - RNA, 19 nt, Homo sapiens
ucugucaccacaucuuguc

SEQ ID NO: 2072546 - RNA, 19 nt, Homo sapiens
auaucugagaaguguauau

SEQ ID NO: 2072547 - RNA, 15 nt, Homo sapiens
ugggaccaucacuga

SEQ ID NO: 2072548 - RNA, 12 nt, Homo sapiens
caccuugacaaa

SEQ ID NO: 2072549 - RNA, 12 nt, Homo sapiens
ugccuugaugaa

SEQ ID NO: 2072550 - RNA, 17 nt, Homo sapiens
agacagagaccuccugc

SEQ ID NO: 2072551 - RNA, 20 nt, Homo sapiens
ggauacgacaguacacuguc

SEQ ID NO: 2072552 - RNA, 21 nt, Homo sapiens
acaggaaaagggcauuuugua

SEQ ID NO: 2072553 - RNA, 16 nt, Homo sapiens
guguguaacacugugu

SEQ ID NO: 2072554 - RNA, 12 nt, Homo sapiens
aggcccuaggcg

SEQ ID NO: 2072555 - RNA, 20 nt, Homo sapiens
cagggcuggcacgugacagg

SEQ ID NO: 2072556 - RNA, 19 nt, Homo sapiens
gcuacuuuccccaguacug

SEQ ID NO: 2072557 - RNA, 17 nt, Homo sapiens
cugugacaaugguuuca

SEQ ID NO: 2072558 - RNA, 14 nt, Homo sapiens
cuguccucuuucag

SEQ ID NO: 2072559 - RNA, 20 nt, Homo sapiens
aauuggucauugacuggcca

SEQ ID NO: 2072560 - RNA, 13 nt, Homo sapiens
aauccaguuauua

SEQ ID NO: 2072561 - RNA, 20 nt, Homo sapiens
uccuggggaauucacuucuc

SEQ ID NO: 2072562 - RNA, 19 nt, Homo sapiens
auuauuuuaauuagguuaa

SEQ ID NO: 2072563 - RNA, 14 nt, Homo sapiens
cccugaacucagaa

SEQ ID NO: 2072564 - RNA, 19 nt, Homo sapiens
uuuacccugaggucacugc

SEQ ID NO: 2072565 - RNA, 14 nt, Homo sapiens
gcugcaacccaagu

SEQ ID NO: 2072566 - RNA, 23 nt, Homo sapiens
gaccccuuucccccaccccagag

SEQ ID NO: 2072567 - RNA, 20 nt, Homo sapiens
augcagccagccaucaaaua

SEQ ID NO: 2072568 - RNA, 17 nt, Homo sapiens
acacuaucuguacuaaa

SEQ ID NO: 2072569 - RNA, 14 nt, Homo sapiens
caaggcauccccag

SEQ ID NO: 2072570 - RNA, 18 nt, Homo sapiens
ucauguugccuugcauaa

SEQ ID NO: 2072571 - RNA, 22 nt, Homo sapiens
ugucagaaaccugcagggacuc

SEQ ID NO: 2072572 - RNA, 19 nt, Homo sapiens
guucccaauaucaugugau

SEQ ID NO: 2072573 - RNA, 16 nt, Homo sapiens
aaugccuuuuauucau

SEQ ID NO: 2072574 - RNA, 20 nt, Homo sapiens
ccaggcuggagugcaaugac

SEQ ID NO: 2072575 - RNA, 17 nt, Homo sapiens
ucuaacuguaaaucacu

SEQ ID NO: 2072576 - RNA, 13 nt, Homo sapiens
uuaacuacuguuu

SEQ ID NO: 2072577 - RNA, 21 nt, Homo sapiens
cucuaucauguugaagucaaa

SEQ ID NO: 2072578 - RNA, 19 nt, Homo sapiens
uggucuuuccaucuaucac

SEQ ID NO: 2072579 - RNA, 16 nt, Homo sapiens
ugcacugacugugaaa

SEQ ID NO: 2072580 - RNA, 20 nt, Homo sapiens
cacugagcuauaacuuacuu

SEQ ID NO: 2072581 - RNA, 20 nt, Homo sapiens
aggaucugucugugcacaug

SEQ ID NO: 2072582 - RNA, 14 nt, Homo sapiens
ugcuuauacaagac

SEQ ID NO: 2072583 - RNA, 14 nt, Homo sapiens
cucuauugagccaa

SEQ ID NO: 2072584 - RNA, 16 nt, Homo sapiens
auaaacucauuuaacu

SEQ ID NO: 2072585 - RNA, 22 nt, Homo sapiens
ugcuccaacccccgccaccuca

SEQ ID NO: 2072586 - RNA, 19 nt, Homo sapiens
aauuaaacgguaacaucca

SEQ ID NO: 2072587 - RNA, 18 nt, Homo sapiens
acaguuuauuauguacua

SEQ ID NO: 2072588 - RNA, 18 nt, Homo sapiens
ccaggcugcacugcagug

SEQ ID NO: 2072589 - RNA, 18 nt, Homo sapiens
cugaccucaggugaugca

SEQ ID NO: 2072590 - RNA, 20 nt, Homo sapiens
caggguggugguauucuguc

SEQ ID NO: 2072591 - RNA, 19 nt, Homo sapiens
uaucuuuauguagcacuac

SEQ ID NO: 2072592 - RNA, 20 nt, Homo sapiens
gauggcauaccugugccugc

SEQ ID NO: 2072593 - RNA, 11 nt, Homo sapiens
cucugaaaugu

SEQ ID NO: 2072594 - RNA, 20 nt, Homo sapiens
gagcaaacucugcugucuaa

SEQ ID NO: 2072595 - RNA, 15 nt, Homo sapiens
augcaaggcacugac

SEQ ID NO: 2072596 - RNA, 22 nt, Homo sapiens
acccuuuuacagucacauucag

SEQ ID NO: 2072597 - RNA, 19 nt, Homo sapiens
ucccuggccacugaaaagc

SEQ ID NO: 2072598 - RNA, 13 nt, Homo sapiens
ugacgcacuguau

SEQ ID NO: 2072599 - RNA, 12 nt, Homo sapiens
agccacaucacu

SEQ ID NO: 2072600 - RNA, 14 nt, Homo sapiens
uuugccacaucccu

SEQ ID NO: 2072601 - RNA, 19 nt, Homo sapiens
acaaauggcuuguucaguc

SEQ ID NO: 2072602 - RNA, 13 nt, Homo sapiens
ucccacaggacau

SEQ ID NO: 2072603 - RNA, 12 nt, Homo sapiens
guuccugcacuc

SEQ ID NO: 2072604 - RNA, 14 nt, Homo sapiens
acuuuucaccuuaa

SEQ ID NO: 2072605 - RNA, 14 nt, Homo sapiens
cuaaguuagagcug

SEQ ID NO: 2072606 - RNA, 15 nt, Homo sapiens
gaccaauaggugcaa

SEQ ID NO: 2072607 - RNA, 19 nt, Homo sapiens
uacguguuuugaauugcaa

SEQ ID NO: 2072608 - RNA, 16 nt, Homo sapiens
auuuuuauacuuucag

SEQ ID NO: 2072609 - RNA, 16 nt, Homo sapiens
auaugcagacauguau

SEQ ID NO: 2072610 - RNA, 19 nt, Homo sapiens
gaugcugagcgaagcuaua

SEQ ID NO: 2072611 - RNA, 23 nt, Homo sapiens
ccucacucauucccauguuguca

SEQ ID NO: 2072612 - RNA, 16 nt, Homo sapiens
cuggagagugcacaug

SEQ ID NO: 2072613 - RNA, 15 nt, Homo sapiens
uggaccuaucuguaa

SEQ ID NO: 2072614 - RNA, 20 nt, Homo sapiens
gcaacuccuguaauacgguc

SEQ ID NO: 2072615 - RNA, 20 nt, Homo sapiens
gaugcgaaccacccaaaaca

SEQ ID NO: 2072616 - RNA, 11 nt, Homo sapiens
ggaugaugacu

SEQ ID NO: 2072617 - RNA, 19 nt, Homo sapiens
guuacauaguuaaaugugc

SEQ ID NO: 2072618 - RNA, 22 nt, Homo sapiens
aacaccagcagcacuggaacca

SEQ ID NO: 2072619 - RNA, 18 nt, Homo sapiens
agcuuaagaaccauugau

SEQ ID NO: 2072620 - RNA, 19 nt, Homo sapiens
guucucuccccuugcacug

SEQ ID NO: 2072621 - RNA, 15 nt, Homo sapiens
gcugagcauguggag

SEQ ID NO: 2072622 - RNA, 23 nt, Homo sapiens
uucugaaaaccuaccagccagag

SEQ ID NO: 2072623 - RNA, 21 nt, Homo sapiens
cacccucaauaaauguugcuu

SEQ ID NO: 2072624 - RNA, 22 nt, Homo sapiens
aggcauccucugacuccacuca

SEQ ID NO: 2072625 - RNA, 18 nt, Homo sapiens
uggauggcacccuggaac

SEQ ID NO: 2072626 - RNA, 12 nt, Homo sapiens
uucccuaucacu

SEQ ID NO: 2072627 - RNA, 12 nt, Homo sapiens
gucuguguuauu

SEQ ID NO: 2072628 - RNA, 17 nt, Homo sapiens
uggcuguguuugcagcc

SEQ ID NO: 2072629 - RNA, 23 nt, Homo sapiens
guagagguuuuuuuccuccuugu

SEQ ID NO: 2072630 - RNA, 17 nt, Homo sapiens
augauauuuuaugcaaa

SEQ ID NO: 2072631 - RNA, 11 nt, Homo sapiens
aauaaaacaca

SEQ ID NO: 2072632 - RNA, 21 nt, Homo sapiens
auuguuacagguguacuaugg

SEQ ID NO: 2072633 - RNA, 22 nt, Homo sapiens
agaguggccuagagcacucuca

SEQ ID NO: 2072634 - RNA, 14 nt, Homo sapiens
aaggaaaguuauuu

SEQ ID NO: 2072635 - RNA, 18 nt, Homo sapiens
uguuuagaaaucauagaa

SEQ ID NO: 2072636 - RNA, 19 nt, Homo sapiens
uauugaaaguugcuuuuau

SEQ ID NO: 2072637 - RNA, 18 nt, Homo sapiens
ucacucagccccuacccc

SEQ ID NO: 2072638 - RNA, 12 nt, Homo sapiens
cucuuucaucua

SEQ ID NO: 2072639 - RNA, 15 nt, Homo sapiens
uacugcaugcacuuc

SEQ ID NO: 2072640 - RNA, 17 nt, Homo sapiens
guaacugucaccugaaa

SEQ ID NO: 2072641 - RNA, 16 nt, Homo sapiens
cuuuggcucaguucau

SEQ ID NO: 2072642 - RNA, 16 nt, Homo sapiens
cuguugcccauugcac

SEQ ID NO: 2072643 - RNA, 17 nt, Homo sapiens
caguaugagucaaugug

SEQ ID NO: 2072644 - RNA, 13 nt, Homo sapiens
uggauucagaaua

SEQ ID NO: 2072645 - RNA, 16 nt, Homo sapiens
uagcugcacuguuuau

SEQ ID NO: 2072646 - RNA, 13 nt, Homo sapiens
gccuucucaggaa

SEQ ID NO: 2072647 - RNA, 14 nt, Homo sapiens
ccauguuagccuua

SEQ ID NO: 2072648 - RNA, 15 nt, Homo sapiens
uaauugagaagcgua

SEQ ID NO: 2072649 - RNA, 16 nt, Homo sapiens
caagacggauccacag

SEQ ID NO: 2072650 - RNA, 14 nt, Homo sapiens
uaauuccacuuuaa

SEQ ID NO: 2072651 - RNA, 14 nt, Homo sapiens
ugcaggcaaaugua

SEQ ID NO: 2072652 - RNA, 19 nt, Homo sapiens
uguauucucuucuacaaua

SEQ ID NO: 2072653 - RNA, 14 nt, Homo sapiens
caucuguccagagg

SEQ ID NO: 2072654 - RNA, 16 nt, Homo sapiens
augaauuaguucuccu

SEQ ID NO: 2072655 - RNA, 15 nt, Homo sapiens
gcccuucaugcauuu

SEQ ID NO: 2072656 - RNA, 15 nt, Homo sapiens
uccacacaggcccau

SEQ ID NO: 2072657 - RNA, 16 nt, Homo sapiens
ucagugagauauuugg

SEQ ID NO: 2072658 - RNA, 17 nt, Homo sapiens
uucaccugugacaaagg

SEQ ID NO: 2072659 - RNA, 15 nt, Homo sapiens
ucuugugauguuugc

SEQ ID NO: 2072660 - RNA, 20 nt, Homo sapiens
cugguucgugccaugcccuu

SEQ ID NO: 2072661 - RNA, 19 nt, Homo sapiens
ggcccagccucugccccac

SEQ ID NO: 2072662 - RNA, 23 nt, Homo sapiens
ucagauugaaccauucauugcag

SEQ ID NO: 2072663 - RNA, 18 nt, Homo sapiens
ucucaugagcuguguuca

SEQ ID NO: 2072664 - RNA, 20 nt, Homo sapiens
acacugcuaggugggccagc

SEQ ID NO: 2072665 - RNA, 20 nt, Homo sapiens
ccuauauagaugcagcauuu

SEQ ID NO: 2072666 - RNA, 16 nt, Homo sapiens
uaaaaguucauaacag

SEQ ID NO: 2072667 - RNA, 24 nt, Homo sapiens
auccaccacugcuuaagugccuau

SEQ ID NO: 2072668 - RNA, 15 nt, Homo sapiens
gacagggacaugccc

SEQ ID NO: 2072669 - RNA, 16 nt, Homo sapiens
gauauucagaaguaua

SEQ ID NO: 2072670 - RNA, 23 nt, Homo sapiens
ucacccccuacacacacaugaga

SEQ ID NO: 2072671 - RNA, 15 nt, Homo sapiens
aaggcugccugcuau

SEQ ID NO: 2072672 - RNA, 15 nt, Homo sapiens
auucuuuccaugcag

SEQ ID NO: 2072673 - RNA, 18 nt, Homo sapiens
cugucacucagcugagaa

SEQ ID NO: 2072674 - RNA, 17 nt, Homo sapiens
aagaauaaaauugcacu

SEQ ID NO: 2072675 - RNA, 17 nt, Homo sapiens
ugcucauguaugugcga

SEQ ID NO: 2072676 - RNA, 14 nt, Homo sapiens
gccaagguguccag

SEQ ID NO: 2072677 - RNA, 18 nt, Homo sapiens
cucaccagagaccaggag

SEQ ID NO: 2072678 - RNA, 20 nt, Homo sapiens
ugcugucucaucacauaaaa

SEQ ID NO: 2072679 - RNA, 20 nt, Homo sapiens
auuuaauuuuuacaugacca

SEQ ID NO: 2072680 - RNA, 15 nt, Homo sapiens
ucggcacacacugug

SEQ ID NO: 2072681 - RNA, 18 nt, Homo sapiens
auacgcuuugguuucuca

SEQ ID NO: 2072682 - RNA, 19 nt, Homo sapiens
cagugggcgggccaugagg

SEQ ID NO: 2072683 - RNA, 18 nt, Homo sapiens
ugcauuaguguugaacca

SEQ ID NO: 2072684 - RNA, 22 nt, Homo sapiens
cagaauuuugggacauuugcau

SEQ ID NO: 2072685 - RNA, 21 nt, Homo sapiens
acacccuuugggaaagcucuu

SEQ ID NO: 2072686 - RNA, 15 nt, Homo sapiens
cugauuucugagcau

SEQ ID NO: 2072687 - RNA, 14 nt, Homo sapiens
aaaugggaagcauu

SEQ ID NO: 2072688 - RNA, 16 nt, Homo sapiens
uaaugaaggacaguga

SEQ ID NO: 2072689 - RNA, 21 nt, Homo sapiens
cuacaccaaugaaaacaugua

SEQ ID NO: 2072690 - RNA, 12 nt, Homo sapiens
aaggcagugcag

SEQ ID NO: 2072691 - RNA, 15 nt, Homo sapiens
cuaccucuggugaug

SEQ ID NO: 2072692 - RNA, 12 nt, Homo sapiens
aaaacuauucca

SEQ ID NO: 2072693 - RNA, 18 nt, Homo sapiens
acagcacuuggcuccuua

SEQ ID NO: 2072694 - RNA, 15 nt, Homo sapiens
acuugcaauuugcaa

SEQ ID NO: 2072695 - RNA, 15 nt, Homo sapiens
auuucccaucuggac

SEQ ID NO: 2072696 - RNA, 14 nt, Homo sapiens
aaaaucuaccuguu

SEQ ID NO: 2072697 - RNA, 14 nt, Homo sapiens
ugccuggcucagag

SEQ ID NO: 2072698 - RNA, 12 nt, Homo sapiens
aauauguacaaa

SEQ ID NO: 2072699 - RNA, 18 nt, Homo sapiens
agaugccccagagcuguu

SEQ ID NO: 2072700 - RNA, 22 nt, Homo sapiens
cucucacuccaggacaguggag

SEQ ID NO: 2072701 - RNA, 17 nt, Homo sapiens
guacuacucuccagcuu

SEQ ID NO: 2072702 - RNA, 16 nt, Homo sapiens
gcuccugaccaaagac

SEQ ID NO: 2072703 - RNA, 23 nt, Homo sapiens
aggcagcugcaggcgcucuccuc

SEQ ID NO: 2072704 - RNA, 22 nt, Homo sapiens
aagaauguuuggcacucucuaa

SEQ ID NO: 2072705 - RNA, 16 nt, Homo sapiens
gagggguuaaugcaga

SEQ ID NO: 2072706 - RNA, 15 nt, Homo sapiens
aaagaauucuugaaa

SEQ ID NO: 2072707 - RNA, 15 nt, Homo sapiens
guuugagaccagccc

SEQ ID NO: 2072708 - RNA, 20 nt, Homo sapiens
gugggccugcugaggccuuc

SEQ ID NO: 2072709 - RNA, 17 nt, Homo sapiens
aaaacaucagaaacuga

SEQ ID NO: 2072710 - RNA, 17 nt, Homo sapiens
gcuaucgcaccacugug

SEQ ID NO: 2072711 - RNA, 13 nt, Homo sapiens
aaccagagcagga

SEQ ID NO: 2072712 - RNA, 16 nt, Homo sapiens
gacauuccauggugau

SEQ ID NO: 2072713 - RNA, 16 nt, Homo sapiens
uaaucaauauaaucug

SEQ ID NO: 2072714 - RNA, 16 nt, Homo sapiens
uacuucccaauugcca

SEQ ID NO: 2072715 - RNA, 23 nt, Homo sapiens
ugguacuccaugcauucaccugc

SEQ ID NO: 2072716 - RNA, 15 nt, Homo sapiens
cuaccugagcauuca

SEQ ID NO: 2072717 - RNA, 20 nt, Homo sapiens
auugggacaacagugcuuug

SEQ ID NO: 2072718 - RNA, 22 nt, Homo sapiens
ucauagucccaccuuggagcau

SEQ ID NO: 2072719 - RNA, 15 nt, Homo sapiens
ugaaucuuacuccuu

SEQ ID NO: 2072720 - RNA, 13 nt, Homo sapiens
accagccugucac

SEQ ID NO: 2072721 - RNA, 18 nt, Homo sapiens
guuagggugugugccaca

SEQ ID NO: 2072722 - RNA, 20 nt, Homo sapiens
ugcaaacauaacaaaaucac

SEQ ID NO: 2072723 - RNA, 15 nt, Homo sapiens
ucugacuaugacaua

SEQ ID NO: 2072724 - RNA, 16 nt, Homo sapiens
cugguucaguacuguc

SEQ ID NO: 2072725 - RNA, 13 nt, Homo sapiens
uauccgacucuaa

SEQ ID NO: 2072726 - RNA, 15 nt, Homo sapiens
cauuacaauccugca

SEQ ID NO: 2072727 - RNA, 14 nt, Homo sapiens
cagcggcagugugu

SEQ ID NO: 2072728 - RNA, 13 nt, Homo sapiens
aaugcacaucuca

SEQ ID NO: 2072729 - RNA, 21 nt, Homo sapiens
cagaugcccagaggcuccauc

SEQ ID NO: 2072730 - RNA, 13 nt, Homo sapiens
cuucccugacacu

SEQ ID NO: 2072731 - RNA, 23 nt, Homo sapiens
ccuucccuagcuuuagacccugg

SEQ ID NO: 2072732 - RNA, 23 nt, Homo sapiens
cugccaccccucuucugcuccuu

SEQ ID NO: 2072733 - RNA, 15 nt, Homo sapiens
uccgcaggacuuccc

SEQ ID NO: 2072734 - RNA, 14 nt, Homo sapiens
cauuggcuacugac

SEQ ID NO: 2072735 - RNA, 16 nt, Homo sapiens
aucaaggucccuucau

SEQ ID NO: 2072736 - RNA, 19 nt, Homo sapiens
cucaacaagugcuccugaa

SEQ ID NO: 2072737 - RNA, 23 nt, Homo sapiens
cugcuugugcacuggauguggcc

SEQ ID NO: 2072738 - RNA, 16 nt, Homo sapiens
agcacuuuaaacuuaa

SEQ ID NO: 2072739 - RNA, 20 nt, Homo sapiens
ccugauuuguuuucauuaua

SEQ ID NO: 2072740 - RNA, 14 nt, Homo sapiens
gaugugugaggcac

SEQ ID NO: 2072741 - RNA, 12 nt, Homo sapiens
cacaucugggag

SEQ ID NO: 2072742 - RNA, 16 nt, Homo sapiens
aaaagccuaaucacag

SEQ ID NO: 2072743 - RNA, 11 nt, Homo sapiens
cagauagucaa

SEQ ID NO: 2072744 - RNA, 17 nt, Homo sapiens
gggcaguuccuuaccuc

SEQ ID NO: 2072745 - RNA, 21 nt, Homo sapiens
auaggccacacagcacaugca

SEQ ID NO: 2072746 - RNA, 17 nt, Homo sapiens
ugaacuaggcugagcaa

SEQ ID NO: 2072747 - RNA, 14 nt, Homo sapiens
caacaagauuucca

SEQ ID NO: 2072748 - RNA, 14 nt, Homo sapiens
acuuaauaaugugu

SEQ ID NO: 2072749 - RNA, 21 nt, Homo sapiens
cugcgcccugccgcacccgcg

SEQ ID NO: 2072750 - RNA, 23 nt, Homo sapiens
uggucucgaacuccuggccucaa

SEQ ID NO: 2072751 - RNA, 16 nt, Homo sapiens
ccuucuuugcacuuuu

SEQ ID NO: 2072752 - RNA, 22 nt, Homo sapiens
uuacaauguaauagaagcuuaa

SEQ ID NO: 2072753 - RNA, 16 nt, Homo sapiens
guaauugaaacauuua

SEQ ID NO: 2072754 - RNA, 13 nt, Homo sapiens
gauuuuaccaaag

SEQ ID NO: 2072755 - RNA, 15 nt, Homo sapiens
gguucaaaagcaauc

SEQ ID NO: 2072756 - RNA, 16 nt, Homo sapiens
acucccucucuugccg

SEQ ID NO: 2072757 - RNA, 16 nt, Homo sapiens
ugcccccgagcugcuc

SEQ ID NO: 2072758 - RNA, 13 nt, Homo sapiens
cuucugaguuuac

SEQ ID NO: 2072759 - RNA, 14 nt, Homo sapiens
gauaauagcauuuu

SEQ ID NO: 2072760 - RNA, 19 nt, Homo sapiens
gcuggaccugccugcugca

SEQ ID NO: 2072761 - RNA, 22 nt, Homo sapiens
auauuucccaugauuucaugua

SEQ ID NO: 2072762 - RNA, 17 nt, Homo sapiens
ugaauuguaaggaauga

SEQ ID NO: 2072763 - RNA, 15 nt, Homo sapiens
cagcugucaccugcu

SEQ ID NO: 2072764 - RNA, 15 nt, Homo sapiens
uugucaugacuuuca

SEQ ID NO: 2072765 - RNA, 10 nt, Homo sapiens
ccaagagcua

SEQ ID NO: 2072766 - RNA, 11 nt, Homo sapiens
cagcauugcag

SEQ ID NO: 2072767 - RNA, 14 nt, Homo sapiens
cuucuucuuagcac

SEQ ID NO: 2072768 - RNA, 20 nt, Homo sapiens
cucccaaagugcuaggauua

SEQ ID NO: 2072769 - RNA, 19 nt, Homo sapiens
caucuuagagguccaugga

SEQ ID NO: 2072770 - RNA, 18 nt, Homo sapiens
agacuauucccuucuaac

SEQ ID NO: 2072771 - RNA, 12 nt, Homo sapiens
cagcucccaugu

SEQ ID NO: 2072772 - RNA, 19 nt, Homo sapiens
ggagacccugaacucagaa

SEQ ID NO: 2072773 - RNA, 17 nt, Homo sapiens
uuuaaagccauucugau

SEQ ID NO: 2072774 - RNA, 17 nt, Homo sapiens
gcacugaugucccuccu

SEQ ID NO: 2072775 - RNA, 20 nt, Homo sapiens
uuuggugagagaaguacaaa

SEQ ID NO: 2072776 - RNA, 15 nt, Homo sapiens
ucguuuagugccaau

SEQ ID NO: 2072777 - RNA, 20 nt, Homo sapiens
ucccuuucuuuucaugccca

SEQ ID NO: 2072778 - RNA, 15 nt, Homo sapiens
cucaucuuucuucca

SEQ ID NO: 2072779 - RNA, 15 nt, Homo sapiens
ugagaggcauuuccc

SEQ ID NO: 2072780 - RNA, 20 nt, Homo sapiens
aagaacugaaggcauaugca

SEQ ID NO: 2072781 - RNA, 21 nt, Homo sapiens
cauauauguauauauaugcac

SEQ ID NO: 2072782 - RNA, 19 nt, Homo sapiens
gaaucccgucggcuucucg

SEQ ID NO: 2072783 - RNA, 20 nt, Homo sapiens
aaguuuuaggguacaugugc

SEQ ID NO: 2072784 - RNA, 18 nt, Homo sapiens
ucugcggaucucagcuuu

SEQ ID NO: 2072785 - RNA, 19 nt, Homo sapiens
ugaagucccagauacuugg

SEQ ID NO: 2072786 - RNA, 15 nt, Homo sapiens
cccacaccucugcca

SEQ ID NO: 2072787 - RNA, 21 nt, Homo sapiens
cugucccaccccuaccucuag

SEQ ID NO: 2072788 - RNA, 15 nt, Homo sapiens
gaauauugugcccca

SEQ ID NO: 2072789 - RNA, 22 nt, Homo sapiens
ugaaaauacaacuuaaauaaua

SEQ ID NO: 2072790 - RNA, 13 nt, Homo sapiens
uagaaacaugaca

SEQ ID NO: 2072791 - RNA, 15 nt, Homo sapiens
gggagagucucccag

SEQ ID NO: 2072792 - RNA, 13 nt, Homo sapiens
ccaagaacugcau

SEQ ID NO: 2072793 - RNA, 19 nt, Homo sapiens
uuagccuaaauguuaacua

SEQ ID NO: 2072794 - RNA, 17 nt, Homo sapiens
gcccaccgaggugcuau

SEQ ID NO: 2072795 - RNA, 15 nt, Homo sapiens
gcagagcaugaccug

SEQ ID NO: 2072796 - RNA, 20 nt, Homo sapiens
aaguucaugcagcuguggca

SEQ ID NO: 2072797 - RNA, 22 nt, Homo sapiens
aaaagaguccauguggacugug

SEQ ID NO: 2072798 - RNA, 14 nt, Homo sapiens
gccuaucugaccaa

SEQ ID NO: 2072799 - RNA, 22 nt, Homo sapiens
agcaagcuuugguuuaugguuu

SEQ ID NO: 2072800 - RNA, 20 nt, Homo sapiens
gcccagccauuaccauggag

SEQ ID NO: 2072801 - RNA, 23 nt, Homo sapiens
gaauggcacaugucauugcccac

SEQ ID NO: 2072802 - RNA, 17 nt, Homo sapiens
uucccuauugugacaga

SEQ ID NO: 2072803 - RNA, 17 nt, Homo sapiens
gcucacacagcaggaac

SEQ ID NO: 2072804 - RNA, 17 nt, Homo sapiens
cggcucccaccggugcc

SEQ ID NO: 2072805 - RNA, 21 nt, Homo sapiens
aagaaacacagcaacaaugac

SEQ ID NO: 2072806 - RNA, 21 nt, Homo sapiens
cuccauuaaccaagaaaacca

SEQ ID NO: 2072807 - RNA, 11 nt, Homo sapiens
acagccuucag

SEQ ID NO: 2072808 - RNA, 12 nt, Homo sapiens
ucuaggauuuua

SEQ ID NO: 2072809 - RNA, 19 nt, Homo sapiens
uagguaugucugugccauu

SEQ ID NO: 2072810 - RNA, 20 nt, Homo sapiens
cuggucaguugccaaaggag

SEQ ID NO: 2072811 - RNA, 18 nt, Homo sapiens
ccaccaaccaagauuucu

SEQ ID NO: 2072812 - RNA, 15 nt, Homo sapiens
uugaaguccaggacu

SEQ ID NO: 2072813 - RNA, 13 nt, Homo sapiens
gccagcgugaagg

SEQ ID NO: 2072814 - RNA, 19 nt, Homo sapiens
guccucgagcaacugcugu

SEQ ID NO: 2072815 - RNA, 13 nt, Homo sapiens
auuugaguggugu

SEQ ID NO: 2072816 - RNA, 11 nt, Homo sapiens
acugugcugaa

SEQ ID NO: 2072817 - RNA, 13 nt, Homo sapiens
guugcaucauguu

SEQ ID NO: 2072818 - RNA, 14 nt, Homo sapiens
cuacaugccaugac

SEQ ID NO: 2072819 - RNA, 23 nt, Homo sapiens
ccucuccacaggagccucugcag

SEQ ID NO: 2072820 - RNA, 13 nt, Homo sapiens
cugauacguguau

SEQ ID NO: 2072821 - RNA, 12 nt, Homo sapiens
auuuccaccucc

SEQ ID NO: 2072822 - RNA, 21 nt, Homo sapiens
gccaaaccuguguaggcauuu

SEQ ID NO: 2072823 - RNA, 21 nt, Homo sapiens
gcaugacuuggacacgguaac

SEQ ID NO: 2072824 - RNA, 18 nt, Homo sapiens
cuuguccuuucucucuaa

SEQ ID NO: 2072825 - RNA, 13 nt, Homo sapiens
gcaauucauccca

SEQ ID NO: 2072826 - RNA, 14 nt, Homo sapiens
cccaccagugccuu

SEQ ID NO: 2072827 - RNA, 16 nt, Homo sapiens
auggaacacggccaca

SEQ ID NO: 2072828 - RNA, 22 nt, Homo sapiens
accgaaucucuuuucucuguaa

SEQ ID NO: 2072829 - RNA, 13 nt, Homo sapiens
ccucuaugaacua

SEQ ID NO: 2072830 - RNA, 21 nt, Homo sapiens
gucucuaaugucugcagcuca

SEQ ID NO: 2072831 - RNA, 15 nt, Homo sapiens
aagcccagugaauua

SEQ ID NO: 2072832 - RNA, 18 nt, Homo sapiens
ugcugaccuccacagcuu

SEQ ID NO: 2072833 - RNA, 13 nt, Homo sapiens
uuguuuuugcaua

SEQ ID NO: 2072834 - RNA, 20 nt, Homo sapiens
gaauuucugugcccuccuga

SEQ ID NO: 2072835 - RNA, 19 nt, Homo sapiens
aacaauuucacccauagcu

SEQ ID NO: 2072836 - RNA, 12 nt, Homo sapiens
gugacuuucuaa

SEQ ID NO: 2072837 - RNA, 15 nt, Homo sapiens
aaucccuuucucacu

SEQ ID NO: 2072838 - RNA, 15 nt, Homo sapiens
uaaacuguacaaaug

SEQ ID NO: 2072839 - RNA, 16 nt, Homo sapiens
gccgucacgcuuucau

SEQ ID NO: 2072840 - RNA, 21 nt, Homo sapiens
cauucacauuugauguacaug

SEQ ID NO: 2072841 - RNA, 14 nt, Homo sapiens
uauuuugcaaacaa

SEQ ID NO: 2072842 - RNA, 13 nt, Homo sapiens
accaauccucacc

SEQ ID NO: 2072843 - RNA, 22 nt, Homo sapiens
aggccuggguuuguacuuccac

SEQ ID NO: 2072844 - RNA, 17 nt, Homo sapiens
uaaguuucaguggagcu

SEQ ID NO: 2072845 - RNA, 22 nt, Homo sapiens
ugcagaggcccagccacguguc

SEQ ID NO: 2072846 - RNA, 14 nt, Homo sapiens
uuuauuuuggaacu

SEQ ID NO: 2072847 - RNA, 20 nt, Homo sapiens
ugacaaaccauaacugacaa

SEQ ID NO: 2072848 - RNA, 18 nt, Homo sapiens
gagcacuccuggugcagg

SEQ ID NO: 2072849 - RNA, 16 nt, Homo sapiens
ugcccccaaaauuaca

SEQ ID NO: 2072850 - RNA, 17 nt, Homo sapiens
aucuaucaauagucaag

SEQ ID NO: 2072851 - RNA, 10 nt, Homo sapiens
ugugugcaca

SEQ ID NO: 2072852 - RNA, 13 nt, Homo sapiens
ucacacucagaaa

SEQ ID NO: 2072853 - RNA, 19 nt, Homo sapiens
cagaugaccauuuucugcc

SEQ ID NO: 2072854 - RNA, 16 nt, Homo sapiens
uggaguauacaugacu

SEQ ID NO: 2072855 - RNA, 18 nt, Homo sapiens
ugaaauguucaagucaug

SEQ ID NO: 2072856 - RNA, 15 nt, Homo sapiens
gcagugacuuuagaa

SEQ ID NO: 2072857 - RNA, 20 nt, Homo sapiens
uagccaaaccucaccaacuc

SEQ ID NO: 2072858 - RNA, 20 nt, Homo sapiens
ccauuccuaggucacuugaa

SEQ ID NO: 2072859 - RNA, 16 nt, Homo sapiens
uacuaaggugcuagga

SEQ ID NO: 2072860 - RNA, 19 nt, Homo sapiens
ucgaguccuaaggccuuag

SEQ ID NO: 2072861 - RNA, 13 nt, Homo sapiens
agaaaaugccuca

SEQ ID NO: 2072862 - RNA, 23 nt, Homo sapiens
cauguucaucaauaccugcugag

SEQ ID NO: 2072863 - RNA, 21 nt, Homo sapiens
gugauauuuucacacugguaa

SEQ ID NO: 2072864 - RNA, 21 nt, Homo sapiens
ucuugauccuaugaguguagu

SEQ ID NO: 2072865 - RNA, 14 nt, Homo sapiens
ugcauggaauuugu

SEQ ID NO: 2072866 - RNA, 20 nt, Homo sapiens
guaggaagaugauggcucau

SEQ ID NO: 2072867 - RNA, 22 nt, Homo sapiens
uaaaaguuacuaauauaucugu

SEQ ID NO: 2072868 - RNA, 18 nt, Homo sapiens
agaaacccuugcugcuuu

SEQ ID NO: 2072869 - RNA, 20 nt, Homo sapiens
aacccgcagccucucugcac

SEQ ID NO: 2072870 - RNA, 10 nt, Homo sapiens
cuucugggaa

SEQ ID NO: 2072871 - RNA, 20 nt, Homo sapiens
auagagcuuucaaguacaug

SEQ ID NO: 2072872 - RNA, 21 nt, Homo sapiens
guugucugaagucacugcaca

SEQ ID NO: 2072873 - RNA, 22 nt, Homo sapiens
ccaaaagacagucgagaagcca

SEQ ID NO: 2072874 - RNA, 21 nt, Homo sapiens
uaauaugaaagaaaaauggau

SEQ ID NO: 2072875 - RNA, 22 nt, Homo sapiens
aucuucccaauguuugggauau

SEQ ID NO: 2072876 - RNA, 16 nt, Homo sapiens
gcugcucaaggaccaa

SEQ ID NO: 2072877 - RNA, 13 nt, Homo sapiens
ggcuagggguccu

SEQ ID NO: 2072878 - RNA, 13 nt, Homo sapiens
aaugcucaagccc

SEQ ID NO: 2072879 - RNA, 13 nt, Homo sapiens
ugcccacaccuaa

SEQ ID NO: 2072880 - RNA, 19 nt, Homo sapiens
uacucauggcagaaggcaa

SEQ ID NO: 2072881 - RNA, 15 nt, Homo sapiens
aauauguucugacau

SEQ ID NO: 2072882 - RNA, 15 nt, Homo sapiens
ugaacugacuucaac

SEQ ID NO: 2072883 - RNA, 21 nt, Homo sapiens
agauacagagaugcaaugaua

SEQ ID NO: 2072884 - RNA, 21 nt, Homo sapiens
auuuuaauaacuaaaccagau

SEQ ID NO: 2072885 - RNA, 12 nt, Homo sapiens
auuaacugguga

SEQ ID NO: 2072886 - RNA, 16 nt, Homo sapiens
uaaccaagcuauucaa

SEQ ID NO: 2072887 - RNA, 13 nt, Homo sapiens
uaggcaauaucuu

SEQ ID NO: 2072888 - RNA, 17 nt, Homo sapiens
ucacaaccuaaauggag

SEQ ID NO: 2072889 - RNA, 21 nt, Homo sapiens
gagcugagaucacaccacugu

SEQ ID NO: 2072890 - RNA, 19 nt, Homo sapiens
cgggucuccuagcucccug

SEQ ID NO: 2072891 - RNA, 14 nt, Homo sapiens
cagccaggcugcca

SEQ ID NO: 2072892 - RNA, 14 nt, Homo sapiens
gaaagaugaugcuc

SEQ ID NO: 2072893 - RNA, 19 nt, Homo sapiens
ugggugucauuucauucca

SEQ ID NO: 2072894 - RNA, 18 nt, Homo sapiens
aaagucccuuuauaaaga

SEQ ID NO: 2072895 - RNA, 14 nt, Homo sapiens
uguaucugacauau

SEQ ID NO: 2072896 - RNA, 23 nt, Homo sapiens
caggagguggaggcugcagugag

SEQ ID NO: 2072897 - RNA, 23 nt, Homo sapiens
guuaaccuuuuuguaaauacugc

SEQ ID NO: 2072898 - RNA, 18 nt, Homo sapiens
acuuauggcaugacucuu

SEQ ID NO: 2072899 - RNA, 14 nt, Homo sapiens
ucucccauccuuga

SEQ ID NO: 2072900 - RNA, 16 nt, Homo sapiens
uucauuucuagacuca

SEQ ID NO: 2072901 - RNA, 17 nt, Homo sapiens
gucagaacucuguguug

SEQ ID NO: 2072902 - RNA, 14 nt, Homo sapiens
auaacccugaauca

SEQ ID NO: 2072903 - RNA, 17 nt, Homo sapiens
caaucaaggccacugcu

SEQ ID NO: 2072904 - RNA, 19 nt, Homo sapiens
cagacggcggggggcagca

SEQ ID NO: 2072905 - RNA, 12 nt, Homo sapiens
caggauauucca

SEQ ID NO: 2072906 - RNA, 20 nt, Homo sapiens
aagcaauucuccugccuuag

SEQ ID NO: 2072907 - RNA, 17 nt, Homo sapiens
uguaucguauugagugg

SEQ ID NO: 2072908 - RNA, 13 nt, Homo sapiens
uuaagcugugcaa

SEQ ID NO: 2072909 - RNA, 14 nt, Homo sapiens
agccagggggacua

SEQ ID NO: 2072910 - RNA, 14 nt, Homo sapiens
ugucccacugggac

SEQ ID NO: 2072911 - RNA, 21 nt, Homo sapiens
cucuggcuuccugcugagucc

SEQ ID NO: 2072912 - RNA, 22 nt, Homo sapiens
ccugucuaggucuccucagggu

SEQ ID NO: 2072913 - RNA, 11 nt, Homo sapiens
aaacaguuuua

SEQ ID NO: 2072914 - RNA, 10 nt, Homo sapiens
agcucuaccg

SEQ ID NO: 2072915 - RNA, 12 nt, Homo sapiens
gcagaagcccug

SEQ ID NO: 2072916 - RNA, 19 nt, Homo sapiens
aaaacauuccaaauaauuc

SEQ ID NO: 2072917 - RNA, 21 nt, Homo sapiens
acaucagagugacauccagga

SEQ ID NO: 2072918 - RNA, 18 nt, Homo sapiens
aaaacuuaaggaagcaaa

SEQ ID NO: 2072919 - RNA, 13 nt, Homo sapiens
ucccucaaaacaa

SEQ ID NO: 2072920 - RNA, 14 nt, Homo sapiens
uucacauuguacuu

SEQ ID NO: 2072921 - RNA, 17 nt, Homo sapiens
cccaggccccuccaguu

SEQ ID NO: 2072922 - RNA, 13 nt, Homo sapiens
uuggcucuacucc

SEQ ID NO: 2072923 - RNA, 15 nt, Homo sapiens
gugaaaacugguuaa

SEQ ID NO: 2072924 - RNA, 20 nt, Homo sapiens
ucuugccaaaaagcacaaga

SEQ ID NO: 2072925 - RNA, 20 nt, Homo sapiens
uacuauuuaagagaacaagc

SEQ ID NO: 2072926 - RNA, 21 nt, Homo sapiens
gcccacaucgggcucaccuua

SEQ ID NO: 2072927 - RNA, 14 nt, Homo sapiens
gauuaaacaaguau

SEQ ID NO: 2072928 - RNA, 15 nt, Homo sapiens
aggaaaauccaaaag

SEQ ID NO: 2072929 - RNA, 14 nt, Homo sapiens
cucauagaggugag

SEQ ID NO: 2072930 - RNA, 18 nt, Homo sapiens
ucacauuuuccuuuucaa

SEQ ID NO: 2072931 - RNA, 22 nt, Homo sapiens
gcacauuugucaguauuuuugc

SEQ ID NO: 2072932 - RNA, 17 nt, Homo sapiens
ggcuacacugacacugg

SEQ ID NO: 2072933 - RNA, 17 nt, Homo sapiens
agggugaacaauccccu

SEQ ID NO: 2072934 - RNA, 13 nt, Homo sapiens
caccauguuggcu

SEQ ID NO: 2072935 - RNA, 14 nt, Homo sapiens
aacuucucugaguc

SEQ ID NO: 2072936 - RNA, 14 nt, Homo sapiens
agcugaucuaagga

SEQ ID NO: 2072937 - RNA, 15 nt, Homo sapiens
ucugcuuuuccucug

SEQ ID NO: 2072938 - RNA, 20 nt, Homo sapiens
aaguuaccuacaagaacaau

SEQ ID NO: 2072939 - RNA, 15 nt, Homo sapiens
agccaaaugcauggu

SEQ ID NO: 2072940 - RNA, 15 nt, Homo sapiens
uuaauuaacaucaaa

SEQ ID NO: 2072941 - RNA, 14 nt, Homo sapiens
cacccagugccagg

SEQ ID NO: 2072942 - RNA, 12 nt, Homo sapiens
uaugcauaucag

SEQ ID NO: 2072943 - RNA, 18 nt, Homo sapiens
uagaagcaugaagucuua

SEQ ID NO: 2072944 - RNA, 13 nt, Homo sapiens
ggagaggccauga

SEQ ID NO: 2072945 - RNA, 12 nt, Homo sapiens
agaccuagagau

SEQ ID NO: 2072946 - RNA, 15 nt, Homo sapiens
ccccuuaucuuuuau

SEQ ID NO: 2072947 - RNA, 15 nt, Homo sapiens
gccaucagccuggau

SEQ ID NO: 2072948 - RNA, 16 nt, Homo sapiens
auauucuucauauccu

SEQ ID NO: 2072949 - RNA, 20 nt, Homo sapiens
augucacaugacauccacau

SEQ ID NO: 2072950 - RNA, 17 nt, Homo sapiens
cagacuucacacugcaa

SEQ ID NO: 2072951 - RNA, 22 nt, Homo sapiens
gccaaugcuguacguacugcau

SEQ ID NO: 2072952 - RNA, 16 nt, Homo sapiens
acauucccugcaucca

SEQ ID NO: 2072953 - RNA, 21 nt, Homo sapiens
cuuuuccuuggucuccagugg

SEQ ID NO: 2072954 - RNA, 13 nt, Homo sapiens
augcucauaccuc

SEQ ID NO: 2072955 - RNA, 18 nt, Homo sapiens
cuugaaaacacuguucuc

SEQ ID NO: 2072956 - RNA, 14 nt, Homo sapiens
gaccagugccuugg

SEQ ID NO: 2072957 - RNA, 23 nt, Homo sapiens
ugaggccacugcugcuucuccau

SEQ ID NO: 2072958 - RNA, 13 nt, Homo sapiens
auaauugaaacuu

SEQ ID NO: 2072959 - RNA, 14 nt, Homo sapiens
gccauuucucaggg

SEQ ID NO: 2072960 - RNA, 12 nt, Homo sapiens
auauuucaaaac

SEQ ID NO: 2072961 - RNA, 12 nt, Homo sapiens
caguuucacugc

SEQ ID NO: 2072962 - RNA, 23 nt, Homo sapiens
cauauuuguauuccuuuucauaa

SEQ ID NO: 2072963 - RNA, 13 nt, Homo sapiens
uaauuaaguacaa

SEQ ID NO: 2072964 - RNA, 15 nt, Homo sapiens
gguccccacugccug

SEQ ID NO: 2072965 - RNA, 15 nt, Homo sapiens
gcuaguuugaccuca

SEQ ID NO: 2072966 - RNA, 12 nt, Homo sapiens
gagcauuuccaa

SEQ ID NO: 2072967 - RNA, 14 nt, Homo sapiens
auagccgggcucca

SEQ ID NO: 2072968 - RNA, 16 nt, Homo sapiens
gccaggacaccugccc

SEQ ID NO: 2072969 - RNA, 14 nt, Homo sapiens
aaaaaccuuccaaa

SEQ ID NO: 2072970 - RNA, 23 nt, Homo sapiens
caccaggucucccgggaagccac

SEQ ID NO: 2072971 - RNA, 16 nt, Homo sapiens
agcucuccugacuuuu

SEQ ID NO: 2072972 - RNA, 16 nt, Homo sapiens
cuguaguuuugagugu

SEQ ID NO: 2072973 - RNA, 12 nt, Homo sapiens
uggccugugagc

SEQ ID NO: 2072974 - RNA, 11 nt, Homo sapiens
accgucuuucu

SEQ ID NO: 2072975 - RNA, 21 nt, Homo sapiens
aggaguacaccccaacagcac

SEQ ID NO: 2072976 - RNA, 16 nt, Homo sapiens
ccauugauucuucaga

SEQ ID NO: 2072977 - RNA, 17 nt, Homo sapiens
gccacaaacuccaucca

SEQ ID NO: 2072978 - RNA, 15 nt, Homo sapiens
uguccccgccuuccc

SEQ ID NO: 2072979 - RNA, 14 nt, Homo sapiens
gacagaaccuuguu

SEQ ID NO: 2072980 - RNA, 22 nt, Homo sapiens
uagagaccaguuuucucuggaa

SEQ ID NO: 2072981 - RNA, 14 nt, Homo sapiens
guucuuagugacac

SEQ ID NO: 2072982 - RNA, 12 nt, Homo sapiens
cuugucucaaga

SEQ ID NO: 2072983 - RNA, 14 nt, Homo sapiens
cgucaggcugccag

SEQ ID NO: 2072984 - RNA, 18 nt, Homo sapiens
aaaaugcauauacuuuaa

SEQ ID NO: 2072985 - RNA, 11 nt, Homo sapiens
ccaugugauua

SEQ ID NO: 2072986 - RNA, 22 nt, Homo sapiens
aggagggcaugugcagacacuc

SEQ ID NO: 2072987 - RNA, 17 nt, Homo sapiens
ggaaagugauaugcauu

SEQ ID NO: 2072988 - RNA, 12 nt, Homo sapiens
cuuauguuauac

SEQ ID NO: 2072989 - RNA, 19 nt, Homo sapiens
gaaaauaacugaaccaaau

SEQ ID NO: 2072990 - RNA, 18 nt, Homo sapiens
aguggcucaugcccauaa

SEQ ID NO: 2072991 - RNA, 21 nt, Homo sapiens
gaucaccccagccucacucca

SEQ ID NO: 2072992 - RNA, 16 nt, Homo sapiens
ucagacuaaugauagu

SEQ ID NO: 2072993 - RNA, 23 nt, Homo sapiens
aggaggugaccaaaucaguguga

SEQ ID NO: 2072994 - RNA, 22 nt, Homo sapiens
uaaauuauuuuuguucauauaa

SEQ ID NO: 2072995 - RNA, 15 nt, Homo sapiens
gcaugaaaaaacauc

SEQ ID NO: 2072996 - RNA, 19 nt, Homo sapiens
augucccagccccugguac

SEQ ID NO: 2072997 - RNA, 18 nt, Homo sapiens
gggaaaagcaguggggac

SEQ ID NO: 2072998 - RNA, 15 nt, Homo sapiens
ggaaaacaagcauuc

SEQ ID NO: 2072999 - RNA, 20 nt, Homo sapiens
auagauagguagaacuauau

SEQ ID NO: 2073000 - RNA, 15 nt, Homo sapiens
ugguacacaauguga

SEQ ID NO: 2073001 - RNA, 17 nt, Homo sapiens
accugugcccucaccac

SEQ ID NO: 2073002 - RNA, 20 nt, Homo sapiens
uguugccagaugcagcacau

SEQ ID NO: 2073003 - RNA, 14 nt, Homo sapiens
auuaggacauaaca

SEQ ID NO: 2073004 - RNA, 13 nt, Homo sapiens
aagcuaaauuaca

SEQ ID NO: 2073005 - RNA, 17 nt, Homo sapiens
gauggaggggugguccu

SEQ ID NO: 2073006 - RNA, 12 nt, Homo sapiens
uguaauugcaaa

SEQ ID NO: 2073007 - RNA, 14 nt, Homo sapiens
uccucaaaucaaaa

SEQ ID NO: 2073008 - RNA, 20 nt, Homo sapiens
auguacaguaaauucucucc

SEQ ID NO: 2073009 - RNA, 18 nt, Homo sapiens
uucagugucaacuauuca

SEQ ID NO: 2073010 - RNA, 17 nt, Homo sapiens
cauuuuugugccauuau

SEQ ID NO: 2073011 - RNA, 15 nt, Homo sapiens
aguccaccugaggaa

SEQ ID NO: 2073012 - RNA, 19 nt, Homo sapiens
auggccuggacugacugca

SEQ ID NO: 2073013 - RNA, 16 nt, Homo sapiens
aacaaauaaaugagcc

SEQ ID NO: 2073014 - RNA, 17 nt, Homo sapiens
acugaaaaaauguagcu

SEQ ID NO: 2073015 - RNA, 18 nt, Homo sapiens
gcaaauauaauccacuuu

SEQ ID NO: 2073016 - RNA, 21 nt, Homo sapiens
aguauuccuuuccugaucacu

SEQ ID NO: 2073017 - RNA, 16 nt, Homo sapiens
auuggcugaacugaau

SEQ ID NO: 2073018 - RNA, 17 nt, Homo sapiens
uagagguucugccucua

SEQ ID NO: 2073019 - RNA, 20 nt, Homo sapiens
cuuugcaaaggagacuuaau

SEQ ID NO: 2073020 - RNA, 20 nt, Homo sapiens
agguuacuuaauucaacuua

SEQ ID NO: 2073021 - RNA, 23 nt, Homo sapiens
agcaggaaccaagaaagcaauac
